United States Patent 10,058,623 (COMPOSITIONS AND METHODS FOR MODULATING UTRN EXPRESSION) - sequence listing, part 6

SEQ ID NO: 159932 - DNA, 15 bp, Homo sapiens
aattttacaaaatac

SEQ ID NO: 159933 - DNA, 15 bp, Homo sapiens
taattttacaaaata

SEQ ID NO: 159934 - DNA, 15 bp, Homo sapiens
ttaattttacaaaat

SEQ ID NO: 159935 - DNA, 15 bp, Homo sapiens
tttaattttacaaaa

SEQ ID NO: 159936 - DNA, 15 bp, Homo sapiens
atttaattttacaaa

SEQ ID NO: 159937 - DNA, 15 bp, Homo sapiens
tatttaattttacaa

SEQ ID NO: 159938 - DNA, 15 bp, Homo sapiens
atatttaattttaca

SEQ ID NO: 159939 - DNA, 15 bp, Homo sapiens
tatatttaattttac

SEQ ID NO: 159940 - DNA, 15 bp, Homo sapiens
atatatttaatttta

SEQ ID NO: 159941 - DNA, 15 bp, Homo sapiens
tatatatttaatttt

SEQ ID NO: 159942 - DNA, 15 bp, Homo sapiens
atatatatttaattt

SEQ ID NO: 159943 - DNA, 15 bp, Homo sapiens
tatatatatttaatt

SEQ ID NO: 159944 - DNA, 15 bp, Homo sapiens
gtatatatatttaat

SEQ ID NO: 159945 - DNA, 15 bp, Homo sapiens
tgtatatatatttaa

SEQ ID NO: 159946 - DNA, 15 bp, Homo sapiens
gtgtatatatattta

SEQ ID NO: 159947 - DNA, 15 bp, Homo sapiens
cgtgtatatatattt

SEQ ID NO: 159948 - DNA, 15 bp, Homo sapiens
gcgtgtatatatatt

SEQ ID NO: 159949 - DNA, 15 bp, Homo sapiens
tgcgtgtatatatat

SEQ ID NO: 159950 - DNA, 15 bp, Homo sapiens
atgcgtgtatatata

SEQ ID NO: 159951 - DNA, 15 bp, Homo sapiens
aatgcgtgtatatat

SEQ ID NO: 159952 - DNA, 15 bp, Homo sapiens
taatgcgtgtatata

SEQ ID NO: 159953 - DNA, 15 bp, Homo sapiens
ttaatgcgtgtatat

SEQ ID NO: 159954 - DNA, 15 bp, Homo sapiens
tttaatgcgtgtata

SEQ ID NO: 159955 - DNA, 15 bp, Homo sapiens
ttttaatgcgtgtat

SEQ ID NO: 159956 - DNA, 15 bp, Homo sapiens
attttaatgcgtgta

SEQ ID NO: 159957 - DNA, 15 bp, Homo sapiens
cattttaatgcgtgt

SEQ ID NO: 159958 - DNA, 15 bp, Homo sapiens
acattttaatgcgtg

SEQ ID NO: 159959 - DNA, 15 bp, Homo sapiens
cacattttaatgcgt

SEQ ID NO: 159960 - DNA, 15 bp, Homo sapiens
acacattttaatgcg

SEQ ID NO: 159961 - DNA, 15 bp, Homo sapiens
aacacattttaatgc

SEQ ID NO: 159962 - DNA, 15 bp, Homo sapiens
gaacacattttaatg

SEQ ID NO: 159963 - DNA, 15 bp, Homo sapiens
agaacacattttaat

SEQ ID NO: 159964 - DNA, 15 bp, Homo sapiens
tagaacacattttaa

SEQ ID NO: 159965 - DNA, 15 bp, Homo sapiens
ttagaacacatttta

SEQ ID NO: 159966 - DNA, 15 bp, Homo sapiens
attagaacacatttt

SEQ ID NO: 159967 - DNA, 15 bp, Homo sapiens
cattagaacacattt

SEQ ID NO: 159968 - DNA, 15 bp, Homo sapiens
gcattagaacacatt

SEQ ID NO: 159969 - DNA, 15 bp, Homo sapiens
tgcattagaacacat

SEQ ID NO: 159970 - DNA, 15 bp, Homo sapiens
atgcattagaacaca

SEQ ID NO: 159971 - DNA, 15 bp, Homo sapiens
catgcattagaacac

SEQ ID NO: 159972 - DNA, 15 bp, Homo sapiens
acatgcattagaaca

SEQ ID NO: 159973 - DNA, 15 bp, Homo sapiens
tacatgcattagaac

SEQ ID NO: 159974 - DNA, 15 bp, Homo sapiens
atacatgcattagaa

SEQ ID NO: 159975 - DNA, 15 bp, Homo sapiens
catacatgcattaga

SEQ ID NO: 159976 - DNA, 15 bp, Homo sapiens
gcatacatgcattag

SEQ ID NO: 159977 - DNA, 15 bp, Homo sapiens
tgcatacatgcatta

SEQ ID NO: 159978 - DNA, 15 bp, Homo sapiens
ttgcatacatgcatt

SEQ ID NO: 159979 - DNA, 15 bp, Homo sapiens
tttgcatacatgcat

SEQ ID NO: 159980 - DNA, 15 bp, Homo sapiens
gtttgcatacatgca

SEQ ID NO: 159981 - DNA, 15 bp, Homo sapiens
tgtttgcatacatgc

SEQ ID NO: 159982 - DNA, 15 bp, Homo sapiens
atgtttgcatacatg

SEQ ID NO: 159983 - DNA, 15 bp, Homo sapiens
tatgtttgcatacat

SEQ ID NO: 159984 - DNA, 15 bp, Homo sapiens
atatgtttgcataca

SEQ ID NO: 159985 - DNA, 15 bp, Homo sapiens
tatatgtttgcatac

SEQ ID NO: 159986 - DNA, 15 bp, Homo sapiens
atatatgtttgcata

SEQ ID NO: 159987 - DNA, 15 bp, Homo sapiens
tatatatgtttgcat

SEQ ID NO: 159988 - DNA, 15 bp, Homo sapiens
atatatatgtttgca

SEQ ID NO: 159989 - DNA, 15 bp, Homo sapiens
aatatatatgtttgc

SEQ ID NO: 159990 - DNA, 15 bp, Homo sapiens
aaatatatatgtttg

SEQ ID NO: 159991 - DNA, 15 bp, Homo sapiens
aaaatatatatgttt

SEQ ID NO: 159992 - DNA, 15 bp, Homo sapiens
gaaaatatatatgtt

SEQ ID NO: 159993 - DNA, 15 bp, Homo sapiens
tgaaaatatatatgt

SEQ ID NO: 159994 - DNA, 15 bp, Homo sapiens
ttgaaaatatatatg

SEQ ID NO: 159995 - DNA, 15 bp, Homo sapiens
tttgaaaatatatat

SEQ ID NO: 159996 - DNA, 15 bp, Homo sapiens
ttttgaaaatatata

SEQ ID NO: 159997 - DNA, 15 bp, Homo sapiens
gttttgaaaatatat

SEQ ID NO: 159998 - DNA, 15 bp, Homo sapiens
tgttttgaaaatata

SEQ ID NO: 159999 - DNA, 15 bp, Homo sapiens
gtgttttgaaaatat

SEQ ID NO: 160000 - DNA, 15 bp, Homo sapiens
agtgttttgaaaata

SEQ ID NO: 160001 - DNA, 15 bp, Homo sapiens
tagtgttttgaaaat

SEQ ID NO: 160002 - DNA, 15 bp, Homo sapiens
atagtgttttgaaaa

SEQ ID NO: 160003 - DNA, 15 bp, Homo sapiens
aatagtgttttgaaa

SEQ ID NO: 160004 - DNA, 15 bp, Homo sapiens
aaatagtgttttgaa

SEQ ID NO: 160005 - DNA, 15 bp, Homo sapiens
aaaatagtgttttga

SEQ ID NO: 160006 - DNA, 15 bp, Homo sapiens
taaaatagtgttttg

SEQ ID NO: 160007 - DNA, 15 bp, Homo sapiens
ataaaatagtgtttt

SEQ ID NO: 160008 - DNA, 15 bp, Homo sapiens
aataaaatagtgttt

SEQ ID NO: 160009 - DNA, 15 bp, Homo sapiens
aaataaaatagtgtt

SEQ ID NO: 160010 - DNA, 15 bp, Homo sapiens
aaaataaaatagtgt

SEQ ID NO: 160011 - DNA, 15 bp, Homo sapiens
taaaataaaatagtg

SEQ ID NO: 160012 - DNA, 15 bp, Homo sapiens
ataaaataaaatagt

SEQ ID NO: 160013 - DNA, 15 bp, Homo sapiens
gataaaataaaatag

SEQ ID NO: 160014 - DNA, 15 bp, Homo sapiens
agataaaataaaata

SEQ ID NO: 160015 - DNA, 15 bp, Homo sapiens
aagataaaataaaat

SEQ ID NO: 160016 - DNA, 15 bp, Homo sapiens
aaagataaaataaaa

SEQ ID NO: 160017 - DNA, 15 bp, Homo sapiens
aaaagataaaataaa

SEQ ID NO: 160018 - DNA, 15 bp, Homo sapiens
gaaaagataaaataa

SEQ ID NO: 160019 - DNA, 15 bp, Homo sapiens
ggaaaagataaaata

SEQ ID NO: 160020 - DNA, 15 bp, Homo sapiens
gggaaaagataaaat

SEQ ID NO: 160021 - DNA, 15 bp, Homo sapiens
tgggaaaagataaaa

SEQ ID NO: 160022 - DNA, 15 bp, Homo sapiens
atgggaaaagataaa

SEQ ID NO: 160023 - DNA, 15 bp, Homo sapiens
tatgggaaaagataa

SEQ ID NO: 160024 - DNA, 15 bp, Homo sapiens
gtatgggaaaagata

SEQ ID NO: 160025 - DNA, 15 bp, Homo sapiens
agtatgggaaaagat

SEQ ID NO: 160026 - DNA, 15 bp, Homo sapiens
tagtatgggaaaaga

SEQ ID NO: 160027 - DNA, 15 bp, Homo sapiens
ttagtatgggaaaag

SEQ ID NO: 160028 - DNA, 15 bp, Homo sapiens
tttagtatgggaaaa

SEQ ID NO: 160029 - DNA, 15 bp, Homo sapiens
ttttagtatgggaaa

SEQ ID NO: 160030 - DNA, 15 bp, Homo sapiens
cttttagtatgggaa

SEQ ID NO: 160031 - DNA, 15 bp, Homo sapiens
acttttagtatggga

SEQ ID NO: 160032 - DNA, 15 bp, Homo sapiens
tacttttagtatggg

SEQ ID NO: 160033 - DNA, 15 bp, Homo sapiens
gtacttttagtatgg

SEQ ID NO: 160034 - DNA, 15 bp, Homo sapiens
agtacttttagtatg

SEQ ID NO: 160035 - DNA, 15 bp, Homo sapiens
gagtacttttagtat

SEQ ID NO: 160036 - DNA, 15 bp, Homo sapiens
tgagtacttttagta

SEQ ID NO: 160037 - DNA, 15 bp, Homo sapiens
atgagtacttttagt

SEQ ID NO: 160038 - DNA, 15 bp, Homo sapiens
gatgagtacttttag

SEQ ID NO: 160039 - DNA, 15 bp, Homo sapiens
tgatgagtactttta

SEQ ID NO: 160040 - DNA, 15 bp, Homo sapiens
ctgatgagtactttt

SEQ ID NO: 160041 - DNA, 15 bp, Homo sapiens
tctgatgagtacttt

SEQ ID NO: 160042 - DNA, 15 bp, Homo sapiens
atctgatgagtactt

SEQ ID NO: 160043 - DNA, 15 bp, Homo sapiens
aatctgatgagtact

SEQ ID NO: 160044 - DNA, 15 bp, Homo sapiens
caatctgatgagtac

SEQ ID NO: 160045 - DNA, 15 bp, Homo sapiens
acaatctgatgagta

SEQ ID NO: 160046 - DNA, 15 bp, Homo sapiens
gacaatctgatgagt

SEQ ID NO: 160047 - DNA, 15 bp, Homo sapiens
tgacaatctgatgag

SEQ ID NO: 160048 - DNA, 15 bp, Homo sapiens
atgacaatctgatga

SEQ ID NO: 160049 - DNA, 15 bp, Homo sapiens
aatgacaatctgatg

SEQ ID NO: 160050 - DNA, 15 bp, Homo sapiens
caatgacaatctgat

SEQ ID NO: 160051 - DNA, 15 bp, Homo sapiens
tcaatgacaatctga

SEQ ID NO: 160052 - DNA, 15 bp, Homo sapiens
atcaatgacaatctg

SEQ ID NO: 160053 - DNA, 15 bp, Homo sapiens
aatcaatgacaatct

SEQ ID NO: 160054 - DNA, 15 bp, Homo sapiens
aaatcaatgacaatc

SEQ ID NO: 160055 - DNA, 15 bp, Homo sapiens
gaaatcaatgacaat

SEQ ID NO: 160056 - DNA, 15 bp, Homo sapiens
agaaatcaatgacaa

SEQ ID NO: 160057 - DNA, 15 bp, Homo sapiens
aagaaatcaatgaca

SEQ ID NO: 160058 - DNA, 15 bp, Homo sapiens
gaagaaatcaatgac

SEQ ID NO: 160059 - DNA, 15 bp, Homo sapiens
agaagaaatcaatga

SEQ ID NO: 160060 - DNA, 15 bp, Homo sapiens
aagaagaaatcaatg

SEQ ID NO: 160061 - DNA, 15 bp, Homo sapiens
aaagaagaaatcaat

SEQ ID NO: 160062 - DNA, 15 bp, Homo sapiens
gaaagaagaaatcaa

SEQ ID NO: 160063 - DNA, 15 bp, Homo sapiens
ggaaagaagaaatca

SEQ ID NO: 160064 - DNA, 15 bp, Homo sapiens
aggaaagaagaaatc

SEQ ID NO: 160065 - DNA, 15 bp, Homo sapiens
gaggaaagaagaaat

SEQ ID NO: 160066 - DNA, 15 bp, Homo sapiens
ggaggaaagaagaaa

SEQ ID NO: 160067 - DNA, 15 bp, Homo sapiens
aggaggaaagaagaa

SEQ ID NO: 160068 - DNA, 15 bp, Homo sapiens
gaggaggaaagaaga

SEQ ID NO: 160069 - DNA, 15 bp, Homo sapiens
agaggaggaaagaag

SEQ ID NO: 160070 - DNA, 15 bp, Homo sapiens
gagaggaggaaagaa

SEQ ID NO: 160071 - DNA, 15 bp, Homo sapiens
tgagaggaggaaaga

SEQ ID NO: 160072 - DNA, 15 bp, Homo sapiens
gtgagaggaggaaag

SEQ ID NO: 160073 - DNA, 15 bp, Homo sapiens
ggtgagaggaggaaa

SEQ ID NO: 160074 - DNA, 15 bp, Homo sapiens
aggtgagaggaggaa

SEQ ID NO: 160075 - DNA, 15 bp, Homo sapiens
caggtgagaggagga

SEQ ID NO: 160076 - DNA, 15 bp, Homo sapiens
acaggtgagaggagg

SEQ ID NO: 160077 - DNA, 15 bp, Homo sapiens
cacaggtgagaggag

SEQ ID NO: 160078 - DNA, 15 bp, Homo sapiens
tcacaggtgagagga

SEQ ID NO: 160079 - DNA, 15 bp, Homo sapiens
gtcacaggtgagagg

SEQ ID NO: 160080 - DNA, 15 bp, Homo sapiens
agtcacaggtgagag

SEQ ID NO: 160081 - DNA, 15 bp, Homo sapiens
cagtcacaggtgaga

SEQ ID NO: 160082 - DNA, 15 bp, Homo sapiens
acagtcacaggtgag

SEQ ID NO: 160083 - DNA, 15 bp, Homo sapiens
cacagtcacaggtga

SEQ ID NO: 160084 - DNA, 15 bp, Homo sapiens
ccacagtcacaggtg

SEQ ID NO: 160085 - DNA, 15 bp, Homo sapiens
cccacagtcacaggt

SEQ ID NO: 160086 - DNA, 15 bp, Homo sapiens
tcccacagtcacagg

SEQ ID NO: 160087 - DNA, 15 bp, Homo sapiens
ttcccacagtcacag

SEQ ID NO: 160088 - DNA, 15 bp, Homo sapiens
tttcccacagtcaca

SEQ ID NO: 160089 - DNA, 15 bp, Homo sapiens
ctttcccacagtcac

SEQ ID NO: 160090 - DNA, 15 bp, Homo sapiens
tctttcccacagtca

SEQ ID NO: 160091 - DNA, 15 bp, Homo sapiens
ttctttcccacagtc

SEQ ID NO: 160092 - DNA, 15 bp, Homo sapiens
attctttcccacagt

SEQ ID NO: 160093 - DNA, 15 bp, Homo sapiens
cattctttcccacag

SEQ ID NO: 160094 - DNA, 15 bp, Homo sapiens
tcattctttcccaca

SEQ ID NO: 160095 - DNA, 15 bp, Homo sapiens
atcattctttcccac

SEQ ID NO: 160096 - DNA, 15 bp, Homo sapiens
aatcattctttccca

SEQ ID NO: 160097 - DNA, 15 bp, Homo sapiens
gaatcattctttccc

SEQ ID NO: 160098 - DNA, 15 bp, Homo sapiens
agaatcattctttcc

SEQ ID NO: 160099 - DNA, 15 bp, Homo sapiens
gagaatcattctttc

SEQ ID NO: 160100 - DNA, 15 bp, Homo sapiens
agagaatcattcttt

SEQ ID NO: 160101 - DNA, 15 bp, Homo sapiens
gagagaatcattctt

SEQ ID NO: 160102 - DNA, 15 bp, Homo sapiens
tgagagaatcattct

SEQ ID NO: 160103 - DNA, 15 bp, Homo sapiens
atgagagaatcattc

SEQ ID NO: 160104 - DNA, 15 bp, Homo sapiens
aatgagagaatcatt

SEQ ID NO: 160105 - DNA, 15 bp, Homo sapiens
taatgagagaatcat

SEQ ID NO: 160106 - DNA, 15 bp, Homo sapiens
ataatgagagaatca

SEQ ID NO: 160107 - DNA, 15 bp, Homo sapiens
cataatgagagaatc

SEQ ID NO: 160108 - DNA, 15 bp, Homo sapiens
tcataatgagagaat

SEQ ID NO: 160109 - DNA, 15 bp, Homo sapiens
ctcataatgagagaa

SEQ ID NO: 160110 - DNA, 15 bp, Homo sapiens
actcataatgagaga

SEQ ID NO: 160111 - DNA, 15 bp, Homo sapiens
gactcataatgagag

SEQ ID NO: 160112 - DNA, 15 bp, Homo sapiens
tgactcataatgaga

SEQ ID NO: 160113 - DNA, 15 bp, Homo sapiens
ctgactcataatgag

SEQ ID NO: 160114 - DNA, 15 bp, Homo sapiens
tctgactcataatga

SEQ ID NO: 160115 - DNA, 15 bp, Homo sapiens
ctctgactcataatg

SEQ ID NO: 160116 - DNA, 15 bp, Homo sapiens
gctctgactcataat

SEQ ID NO: 160117 - DNA, 15 bp, Homo sapiens
ggctctgactcataa

SEQ ID NO: 160118 - DNA, 15 bp, Homo sapiens
aggctctgactcata

SEQ ID NO: 160119 - DNA, 15 bp, Homo sapiens
aaggctctgactcat

SEQ ID NO: 160120 - DNA, 15 bp, Homo sapiens
aaaggctctgactca

SEQ ID NO: 160121 - DNA, 15 bp, Homo sapiens
aaaaggctctgactc

SEQ ID NO: 160122 - DNA, 15 bp, Homo sapiens
aaaaaggctctgact

SEQ ID NO: 160123 - DNA, 15 bp, Homo sapiens
aaaaaaggctctgac

SEQ ID NO: 160124 - DNA, 15 bp, Homo sapiens
aaaaaaaggctctga

SEQ ID NO: 160125 - DNA, 15 bp, Homo sapiens
aaaaaaaaggctctg

SEQ ID NO: 160126 - DNA, 15 bp, Homo sapiens
gaaaaaaaaggctct

SEQ ID NO: 160127 - DNA, 15 bp, Homo sapiens
ggaaaaaaaaggctc

SEQ ID NO: 160128 - DNA, 15 bp, Homo sapiens
aggaaaaaaaaggct

SEQ ID NO: 160129 - DNA, 15 bp, Homo sapiens
aaggaaaaaaaaggc

SEQ ID NO: 160130 - DNA, 15 bp, Homo sapiens
aaaggaaaaaaaagg

SEQ ID NO: 160131 - DNA, 15 bp, Homo sapiens
aaaaggaaaaaaaag

SEQ ID NO: 160132 - DNA, 15 bp, Homo sapiens
gaaaaggaaaaaaaa

SEQ ID NO: 160133 - DNA, 15 bp, Homo sapiens
agaaaaggaaaaaaa

SEQ ID NO: 160134 - DNA, 15 bp, Homo sapiens
cagaaaaggaaaaaa

SEQ ID NO: 160135 - DNA, 15 bp, Homo sapiens
tcagaaaaggaaaaa

SEQ ID NO: 160136 - DNA, 15 bp, Homo sapiens
ttcagaaaaggaaaa

SEQ ID NO: 160137 - DNA, 15 bp, Homo sapiens
attcagaaaaggaaa

SEQ ID NO: 160138 - DNA, 15 bp, Homo sapiens
aattcagaaaaggaa

SEQ ID NO: 160139 - DNA, 15 bp, Homo sapiens
aaattcagaaaagga

SEQ ID NO: 160140 - DNA, 15 bp, Homo sapiens
taaattcagaaaagg

SEQ ID NO: 160141 - DNA, 15 bp, Homo sapiens
ataaattcagaaaag

SEQ ID NO: 160142 - DNA, 15 bp, Homo sapiens
tataaattcagaaaa

SEQ ID NO: 160143 - DNA, 15 bp, Homo sapiens
ctataaattcagaaa

SEQ ID NO: 160144 - DNA, 15 bp, Homo sapiens
actataaattcagaa

SEQ ID NO: 160145 - DNA, 15 bp, Homo sapiens
tactataaattcaga

SEQ ID NO: 160146 - DNA, 15 bp, Homo sapiens
ttactataaattcag

SEQ ID NO: 160147 - DNA, 15 bp, Homo sapiens
gttactataaattca

SEQ ID NO: 160148 - DNA, 15 bp, Homo sapiens
cgttactataaattc

SEQ ID NO: 160149 - DNA, 15 bp, Homo sapiens
tcgttactataaatt

SEQ ID NO: 160150 - DNA, 15 bp, Homo sapiens
gtcgttactataaat

SEQ ID NO: 160151 - DNA, 15 bp, Homo sapiens
agtcgttactataaa

SEQ ID NO: 160152 - DNA, 15 bp, Homo sapiens
gagtcgttactataa

SEQ ID NO: 160153 - DNA, 15 bp, Homo sapiens
tgagtcgttactata

SEQ ID NO: 160154 - DNA, 15 bp, Homo sapiens
ttgagtcgttactat

SEQ ID NO: 160155 - DNA, 15 bp, Homo sapiens
gttgagtcgttacta

SEQ ID NO: 160156 - DNA, 15 bp, Homo sapiens
tgttgagtcgttact

SEQ ID NO: 160157 - DNA, 15 bp, Homo sapiens
gtgttgagtcgttac

SEQ ID NO: 160158 - DNA, 15 bp, Homo sapiens
agtgttgagtcgtta

SEQ ID NO: 160159 - DNA, 15 bp, Homo sapiens
tagtgttgagtcgtt

SEQ ID NO: 160160 - DNA, 15 bp, Homo sapiens
ctagtgttgagtcgt

SEQ ID NO: 160161 - DNA, 15 bp, Homo sapiens
tctagtgttgagtcg

SEQ ID NO: 160162 - DNA, 15 bp, Homo sapiens
ttctagtgttgagtc

SEQ ID NO: 160163 - DNA, 15 bp, Homo sapiens
cttctagtgttgagt

SEQ ID NO: 160164 - DNA, 15 bp, Homo sapiens
acttctagtgttgag

SEQ ID NO: 160165 - DNA, 15 bp, Homo sapiens
gacttctagtgttga

SEQ ID NO: 160166 - DNA, 15 bp, Homo sapiens
agacttctagtgttg

SEQ ID NO: 160167 - DNA, 15 bp, Homo sapiens
gagacttctagtgtt

SEQ ID NO: 160168 - DNA, 15 bp, Homo sapiens
tgagacttctagtgt

SEQ ID NO: 160169 - DNA, 15 bp, Homo sapiens
ctgagacttctagtg

SEQ ID NO: 160170 - DNA, 15 bp, Homo sapiens
gctgagacttctagt

SEQ ID NO: 160171 - DNA, 15 bp, Homo sapiens
tgctgagacttctag

SEQ ID NO: 160172 - DNA, 15 bp, Homo sapiens
ctgctgagacttcta

SEQ ID NO: 160173 - DNA, 15 bp, Homo sapiens
gctgctgagacttct

SEQ ID NO: 160174 - DNA, 15 bp, Homo sapiens
agctgctgagacttc

SEQ ID NO: 160175 - DNA, 15 bp, Homo sapiens
aagctgctgagactt

SEQ ID NO: 160176 - DNA, 15 bp, Homo sapiens
caagctgctgagact

SEQ ID NO: 160177 - DNA, 15 bp, Homo sapiens
ccaagctgctgagac

SEQ ID NO: 160178 - DNA, 15 bp, Homo sapiens
accaagctgctgaga

SEQ ID NO: 160179 - DNA, 15 bp, Homo sapiens
aaccaagctgctgag

SEQ ID NO: 160180 - DNA, 15 bp, Homo sapiens
aaaccaagctgctga

SEQ ID NO: 160181 - DNA, 15 bp, Homo sapiens
caaaccaagctgctg

SEQ ID NO: 160182 - DNA, 15 bp, Homo sapiens
gcaaaccaagctgct

SEQ ID NO: 160183 - DNA, 15 bp, Homo sapiens
ggcaaaccaagctgc

SEQ ID NO: 160184 - DNA, 15 bp, Homo sapiens
aggcaaaccaagctg

SEQ ID NO: 160185 - DNA, 15 bp, Homo sapiens
caggcaaaccaagct

SEQ ID NO: 160186 - DNA, 15 bp, Homo sapiens
acaggcaaaccaagc

SEQ ID NO: 160187 - DNA, 15 bp, Homo sapiens
gacaggcaaaccaag

SEQ ID NO: 160188 - DNA, 15 bp, Homo sapiens
tgacaggcaaaccaa

SEQ ID NO: 160189 - DNA, 15 bp, Homo sapiens
atgacaggcaaacca

SEQ ID NO: 160190 - DNA, 15 bp, Homo sapiens
aatgacaggcaaacc

SEQ ID NO: 160191 - DNA, 15 bp, Homo sapiens
taatgacaggcaaac

SEQ ID NO: 160192 - DNA, 15 bp, Homo sapiens
ttaatgacaggcaaa

SEQ ID NO: 160193 - DNA, 15 bp, Homo sapiens
attaatgacaggcaa

SEQ ID NO: 160194 - DNA, 15 bp, Homo sapiens
aattaatgacaggca

SEQ ID NO: 160195 - DNA, 15 bp, Homo sapiens
aaattaatgacaggc

SEQ ID NO: 160196 - DNA, 15 bp, Homo sapiens
aaaattaatgacagg

SEQ ID NO: 160197 - DNA, 15 bp, Homo sapiens
taaaattaatgacag

SEQ ID NO: 160198 - DNA, 15 bp, Homo sapiens
gtaaaattaatgaca

SEQ ID NO: 160199 - DNA, 15 bp, Homo sapiens
ggtaaaattaatgac

SEQ ID NO: 160200 - DNA, 15 bp, Homo sapiens
tggtaaaattaatga

SEQ ID NO: 160201 - DNA, 15 bp, Homo sapiens
ttggtaaaattaatg

SEQ ID NO: 160202 - DNA, 15 bp, Homo sapiens
attggtaaaattaat

SEQ ID NO: 160203 - DNA, 15 bp, Homo sapiens
cattggtaaaattaa

SEQ ID NO: 160204 - DNA, 15 bp, Homo sapiens
ccattggtaaaatta

SEQ ID NO: 160205 - DNA, 15 bp, Homo sapiens
accattggtaaaatt

SEQ ID NO: 160206 - DNA, 15 bp, Homo sapiens
aaccattggtaaaat

SEQ ID NO: 160207 - DNA, 15 bp, Homo sapiens
caaccattggtaaaa

SEQ ID NO: 160208 - DNA, 15 bp, Homo sapiens
gcaaccattggtaaa

SEQ ID NO: 160209 - DNA, 15 bp, Homo sapiens
tgcaaccattggtaa

SEQ ID NO: 160210 - DNA, 15 bp, Homo sapiens
ctgcaaccattggta

SEQ ID NO: 160211 - DNA, 15 bp, Homo sapiens
cctgcaaccattggt

SEQ ID NO: 160212 - DNA, 15 bp, Homo sapiens
acctgcaaccattgg

SEQ ID NO: 160213 - DNA, 15 bp, Homo sapiens
cacctgcaaccattg

SEQ ID NO: 160214 - DNA, 15 bp, Homo sapiens
acacctgcaaccatt

SEQ ID NO: 160215 - DNA, 15 bp, Homo sapiens
tacacctgcaaccat

SEQ ID NO: 160216 - DNA, 15 bp, Homo sapiens
ctacacctgcaacca

SEQ ID NO: 160217 - DNA, 15 bp, Homo sapiens
gctacacctgcaacc

SEQ ID NO: 160218 - DNA, 15 bp, Homo sapiens
ggctacacctgcaac

SEQ ID NO: 160219 - DNA, 15 bp, Homo sapiens
aggctacacctgcaa

SEQ ID NO: 160220 - DNA, 15 bp, Homo sapiens
caggctacacctgca

SEQ ID NO: 160221 - DNA, 15 bp, Homo sapiens
tcaggctacacctgc

SEQ ID NO: 160222 - DNA, 15 bp, Homo sapiens
ttcaggctacacctg

SEQ ID NO: 160223 - DNA, 15 bp, Homo sapiens
tttcaggctacacct

SEQ ID NO: 160224 - DNA, 15 bp, Homo sapiens
ctttcaggctacacc

SEQ ID NO: 160225 - DNA, 15 bp, Homo sapiens
tctttcaggctacac

SEQ ID NO: 160226 - DNA, 15 bp, Homo sapiens
ttctttcaggctaca

SEQ ID NO: 160227 - DNA, 15 bp, Homo sapiens
attctttcaggctac

SEQ ID NO: 160228 - DNA, 15 bp, Homo sapiens
tattctttcaggcta

SEQ ID NO: 160229 - DNA, 15 bp, Homo sapiens
ctattctttcaggct

SEQ ID NO: 160230 - DNA, 15 bp, Homo sapiens
cctattctttcaggc

SEQ ID NO: 160231 - DNA, 15 bp, Homo sapiens
acctattctttcagg

SEQ ID NO: 160232 - DNA, 15 bp, Homo sapiens
tacctattctttcag

SEQ ID NO: 160233 - DNA, 15 bp, Homo sapiens
atacctattctttca

SEQ ID NO: 160234 - DNA, 15 bp, Homo sapiens
tatacctattctttc

SEQ ID NO: 160235 - DNA, 15 bp, Homo sapiens
ttatacctattcttt

SEQ ID NO: 160236 - DNA, 15 bp, Homo sapiens
attatacctattctt

SEQ ID NO: 160237 - DNA, 15 bp, Homo sapiens
cattatacctattct

SEQ ID NO: 160238 - DNA, 15 bp, Homo sapiens
gcattatacctattc

SEQ ID NO: 160239 - DNA, 15 bp, Homo sapiens
agcattatacctatt

SEQ ID NO: 160240 - DNA, 15 bp, Homo sapiens
cagcattatacctat

SEQ ID NO: 160241 - DNA, 15 bp, Homo sapiens
ccagcattataccta

SEQ ID NO: 160242 - DNA, 15 bp, Homo sapiens
accagcattatacct

SEQ ID NO: 160243 - DNA, 15 bp, Homo sapiens
taccagcattatacc

SEQ ID NO: 160244 - DNA, 15 bp, Homo sapiens
ataccagcattatac

SEQ ID NO: 160245 - DNA, 15 bp, Homo sapiens
cataccagcattata

SEQ ID NO: 160246 - DNA, 15 bp, Homo sapiens
acataccagcattat

SEQ ID NO: 160247 - DNA, 15 bp, Homo sapiens
tacataccagcatta

SEQ ID NO: 160248 - DNA, 15 bp, Homo sapiens
ttacataccagcatt

SEQ ID NO: 160249 - DNA, 15 bp, Homo sapiens
attacataccagcat

SEQ ID NO: 160250 - DNA, 15 bp, Homo sapiens
cattacataccagca

SEQ ID NO: 160251 - DNA, 15 bp, Homo sapiens
gcattacataccagc

SEQ ID NO: 160252 - DNA, 15 bp, Homo sapiens
agcattacataccag

SEQ ID NO: 160253 - DNA, 15 bp, Homo sapiens
aagcattacatacca

SEQ ID NO: 160254 - DNA, 15 bp, Homo sapiens
aaagcattacatacc

SEQ ID NO: 160255 - DNA, 15 bp, Homo sapiens
gaaagcattacatac

SEQ ID NO: 160256 - DNA, 15 bp, Homo sapiens
agaaagcattacata

SEQ ID NO: 160257 - DNA, 15 bp, Homo sapiens
gagaaagcattacat

SEQ ID NO: 160258 - DNA, 15 bp, Homo sapiens
ggagaaagcattaca

SEQ ID NO: 160259 - DNA, 15 bp, Homo sapiens
aggagaaagcattac

SEQ ID NO: 160260 - DNA, 15 bp, Homo sapiens
caggagaaagcatta

SEQ ID NO: 160261 - DNA, 15 bp, Homo sapiens
gcaggagaaagcatt

SEQ ID NO: 160262 - DNA, 15 bp, Homo sapiens
agcaggagaaagcat

SEQ ID NO: 160263 - DNA, 15 bp, Homo sapiens
aagcaggagaaagca

SEQ ID NO: 160264 - DNA, 15 bp, Homo sapiens
gaagcaggagaaagc

SEQ ID NO: 160265 - DNA, 15 bp, Homo sapiens
agaagcaggagaaag

SEQ ID NO: 160266 - DNA, 15 bp, Homo sapiens
tagaagcaggagaaa

SEQ ID NO: 160267 - DNA, 15 bp, Homo sapiens
ttagaagcaggagaa

SEQ ID NO: 160268 - DNA, 15 bp, Homo sapiens
tttagaagcaggaga

SEQ ID NO: 160269 - DNA, 15 bp, Homo sapiens
ttttagaagcaggag

SEQ ID NO: 160270 - DNA, 15 bp, Homo sapiens
cttttagaagcagga

SEQ ID NO: 160271 - DNA, 15 bp, Homo sapiens
ccttttagaagcagg

SEQ ID NO: 160272 - DNA, 15 bp, Homo sapiens
accttttagaagcag

SEQ ID NO: 160273 - DNA, 15 bp, Homo sapiens
caccttttagaagca

SEQ ID NO: 160274 - DNA, 15 bp, Homo sapiens
gcaccttttagaagc

SEQ ID NO: 160275 - DNA, 15 bp, Homo sapiens
agcaccttttagaag

SEQ ID NO: 160276 - DNA, 15 bp, Homo sapiens
cagcaccttttagaa

SEQ ID NO: 160277 - DNA, 15 bp, Homo sapiens
acagcaccttttaga

SEQ ID NO: 160278 - DNA, 15 bp, Homo sapiens
cacagcaccttttag

SEQ ID NO: 160279 - DNA, 15 bp, Homo sapiens
ccacagcacctttta

SEQ ID NO: 160280 - DNA, 15 bp, Homo sapiens
cccacagcacctttt

SEQ ID NO: 160281 - DNA, 15 bp, Homo sapiens
ccccacagcaccttt

SEQ ID NO: 160282 - DNA, 15 bp, Homo sapiens
tccccacagcacctt

SEQ ID NO: 160283 - DNA, 15 bp, Homo sapiens
ctccccacagcacct

SEQ ID NO: 160284 - DNA, 15 bp, Homo sapiens
cctccccacagcacc

SEQ ID NO: 160285 - DNA, 15 bp, Homo sapiens
acctccccacagcac

SEQ ID NO: 160286 - DNA, 15 bp, Homo sapiens
cacctccccacagca

SEQ ID NO: 160287 - DNA, 15 bp, Homo sapiens
acacctccccacagc

SEQ ID NO: 160288 - DNA, 15 bp, Homo sapiens
aacacctccccacag

SEQ ID NO: 160289 - DNA, 15 bp, Homo sapiens
caacacctccccaca

SEQ ID NO: 160290 - DNA, 15 bp, Homo sapiens
tcaacacctccccac

SEQ ID NO: 160291 - DNA, 15 bp, Homo sapiens
ttcaacacctcccca

SEQ ID NO: 160292 - DNA, 15 bp, Homo sapiens
attcaacacctcccc

SEQ ID NO: 160293 - DNA, 15 bp, Homo sapiens
cattcaacacctccc

SEQ ID NO: 160294 - DNA, 15 bp, Homo sapiens
tcattcaacacctcc

SEQ ID NO: 160295 - DNA, 15 bp, Homo sapiens
ctcattcaacacctc

SEQ ID NO: 160296 - DNA, 15 bp, Homo sapiens
tctcattcaacacct

SEQ ID NO: 160297 - DNA, 15 bp, Homo sapiens
atctcattcaacacc

SEQ ID NO: 160298 - DNA, 15 bp, Homo sapiens
aatctcattcaacac

SEQ ID NO: 160299 - DNA, 15 bp, Homo sapiens
gaatctcattcaaca

SEQ ID NO: 160300 - DNA, 15 bp, Homo sapiens
tgaatctcattcaac

SEQ ID NO: 160301 - DNA, 15 bp, Homo sapiens
atgaatctcattcaa

SEQ ID NO: 160302 - DNA, 15 bp, Homo sapiens
catgaatctcattca

SEQ ID NO: 160303 - DNA, 15 bp, Homo sapiens
ccatgaatctcattc

SEQ ID NO: 160304 - DNA, 15 bp, Homo sapiens
accatgaatctcatt

SEQ ID NO: 160305 - DNA, 15 bp, Homo sapiens
caccatgaatctcat

SEQ ID NO: 160306 - DNA, 15 bp, Homo sapiens
ccaccatgaatctca

SEQ ID NO: 160307 - DNA, 15 bp, Homo sapiens
accaccatgaatctc

SEQ ID NO: 160308 - DNA, 15 bp, Homo sapiens
taccaccatgaatct

SEQ ID NO: 160309 - DNA, 15 bp, Homo sapiens
ttaccaccatgaatc

SEQ ID NO: 160310 - DNA, 15 bp, Homo sapiens
tttaccaccatgaat

SEQ ID NO: 160311 - DNA, 15 bp, Homo sapiens
gtttaccaccatgaa

SEQ ID NO: 160312 - DNA, 15 bp, Homo sapiens
tgtttaccaccatga

SEQ ID NO: 160313 - DNA, 15 bp, Homo sapiens
ttgtttaccaccatg

SEQ ID NO: 160314 - DNA, 15 bp, Homo sapiens
cttgtttaccaccat

SEQ ID NO: 160315 - DNA, 15 bp, Homo sapiens
tcttgtttaccacca

SEQ ID NO: 160316 - DNA, 15 bp, Homo sapiens
ttcttgtttaccacc

SEQ ID NO: 160317 - DNA, 15 bp, Homo sapiens
attcttgtttaccac

SEQ ID NO: 160318 - DNA, 15 bp, Homo sapiens
tattcttgtttacca

SEQ ID NO: 160319 - DNA, 15 bp, Homo sapiens
atattcttgtttacc

SEQ ID NO: 160320 - DNA, 15 bp, Homo sapiens
tatattcttgtttac

SEQ ID NO: 160321 - DNA, 15 bp, Homo sapiens
ttatattcttgttta

SEQ ID NO: 160322 - DNA, 15 bp, Homo sapiens
tttatattcttgttt

SEQ ID NO: 160323 - DNA, 15 bp, Homo sapiens
atttatattcttgtt

SEQ ID NO: 160324 - DNA, 15 bp, Homo sapiens
aatttatattcttgt

SEQ ID NO: 160325 - DNA, 15 bp, Homo sapiens
gaatttatattcttg

SEQ ID NO: 160326 - DNA, 15 bp, Homo sapiens
tgaatttatattctt

SEQ ID NO: 160327 - DNA, 15 bp, Homo sapiens
ttgaatttatattct

SEQ ID NO: 160328 - DNA, 15 bp, Homo sapiens
tttgaatttatattc

SEQ ID NO: 160329 - DNA, 15 bp, Homo sapiens
atttgaatttatatt

SEQ ID NO: 160330 - DNA, 15 bp, Homo sapiens
tatttgaatttatat

SEQ ID NO: 160331 - DNA, 15 bp, Homo sapiens
atatttgaatttata

SEQ ID NO: 160332 - DNA, 15 bp, Homo sapiens
aatatttgaatttat

SEQ ID NO: 160333 - DNA, 15 bp, Homo sapiens
taatatttgaattta

SEQ ID NO: 160334 - DNA, 15 bp, Homo sapiens
ataatatttgaattt

SEQ ID NO: 160335 - DNA, 15 bp, Homo sapiens
gataatatttgaatt

SEQ ID NO: 160336 - DNA, 15 bp, Homo sapiens
agataatatttgaat

SEQ ID NO: 160337 - DNA, 15 bp, Homo sapiens
aagataatatttgaa

SEQ ID NO: 160338 - DNA, 15 bp, Homo sapiens
taagataatatttga

SEQ ID NO: 160339 - DNA, 15 bp, Homo sapiens
ttaagataatatttg

SEQ ID NO: 160340 - DNA, 15 bp, Homo sapiens
tttaagataatattt

SEQ ID NO: 160341 - DNA, 15 bp, Homo sapiens
ttttaagataatatt

SEQ ID NO: 160342 - DNA, 15 bp, Homo sapiens
gttttaagataatat

SEQ ID NO: 160343 - DNA, 15 bp, Homo sapiens
tgttttaagataata

SEQ ID NO: 160344 - DNA, 15 bp, Homo sapiens
ctgttttaagataat

SEQ ID NO: 160345 - DNA, 15 bp, Homo sapiens
tctgttttaagataa

SEQ ID NO: 160346 - DNA, 15 bp, Homo sapiens
ttctgttttaagata

SEQ ID NO: 160347 - DNA, 15 bp, Homo sapiens
tttctgttttaagat

SEQ ID NO: 160348 - DNA, 15 bp, Homo sapiens
gtttctgttttaaga

SEQ ID NO: 160349 - DNA, 15 bp, Homo sapiens
tgtttctgttttaag

SEQ ID NO: 160350 - DNA, 15 bp, Homo sapiens
ctgtttctgttttaa

SEQ ID NO: 160351 - DNA, 15 bp, Homo sapiens
actgtttctgtttta

SEQ ID NO: 160352 - DNA, 15 bp, Homo sapiens
tactgtttctgtttt

SEQ ID NO: 160353 - DNA, 15 bp, Homo sapiens
ttactgtttctgttt

SEQ ID NO: 160354 - DNA, 15 bp, Homo sapiens
tttactgtttctgtt

SEQ ID NO: 160355 - DNA, 15 bp, Homo sapiens
ctttactgtttctgt

SEQ ID NO: 160356 - DNA, 15 bp, Homo sapiens
gctttactgtttctg

SEQ ID NO: 160357 - DNA, 15 bp, Homo sapiens
tgctttactgtttct

SEQ ID NO: 160358 - DNA, 15 bp, Homo sapiens
atgctttactgtttc

SEQ ID NO: 160359 - DNA, 15 bp, Homo sapiens
catgctttactgttt

SEQ ID NO: 160360 - DNA, 15 bp, Homo sapiens
ccatgctttactgtt

SEQ ID NO: 160361 - DNA, 15 bp, Homo sapiens
tccatgctttactgt

SEQ ID NO: 160362 - DNA, 15 bp, Homo sapiens
ctccatgctttactg

SEQ ID NO: 160363 - DNA, 15 bp, Homo sapiens
tctccatgctttact

SEQ ID NO: 160364 - DNA, 15 bp, Homo sapiens
ttctccatgctttac

SEQ ID NO: 160365 - DNA, 15 bp, Homo sapiens
tttctccatgcttta

SEQ ID NO: 160366 - DNA, 15 bp, Homo sapiens
ttttctccatgcttt

SEQ ID NO: 160367 - DNA, 15 bp, Homo sapiens
cttttctccatgctt

SEQ ID NO: 160368 - DNA, 15 bp, Homo sapiens
tcttttctccatgct

SEQ ID NO: 160369 - DNA, 15 bp, Homo sapiens
atcttttctccatgc

SEQ ID NO: 160370 - DNA, 15 bp, Homo sapiens
gatcttttctccatg

SEQ ID NO: 160371 - DNA, 15 bp, Homo sapiens
ggatcttttctccat

SEQ ID NO: 160372 - DNA, 15 bp, Homo sapiens
tggatcttttctcca

SEQ ID NO: 160373 - DNA, 15 bp, Homo sapiens
ctggatcttttctcc

SEQ ID NO: 160374 - DNA, 15 bp, Homo sapiens
gctggatcttttctc

SEQ ID NO: 160375 - DNA, 15 bp, Homo sapiens
agctggatcttttct

SEQ ID NO: 160376 - DNA, 15 bp, Homo sapiens
cagctggatcttttc

SEQ ID NO: 160377 - DNA, 15 bp, Homo sapiens
tcagctggatctttt

SEQ ID NO: 160378 - DNA, 15 bp, Homo sapiens
atcagctggatcttt

SEQ ID NO: 160379 - DNA, 15 bp, Homo sapiens
aatcagctggatctt

SEQ ID NO: 160380 - DNA, 15 bp, Homo sapiens
gaatcagctggatct

SEQ ID NO: 160381 - DNA, 15 bp, Homo sapiens
agaatcagctggatc

SEQ ID NO: 160382 - DNA, 15 bp, Homo sapiens
tagaatcagctggat

SEQ ID NO: 160383 - DNA, 15 bp, Homo sapiens
ctagaatcagctgga

SEQ ID NO: 160384 - DNA, 15 bp, Homo sapiens
tctagaatcagctgg

SEQ ID NO: 160385 - DNA, 15 bp, Homo sapiens
ttctagaatcagctg

SEQ ID NO: 160386 - DNA, 15 bp, Homo sapiens
tttctagaatcagct

SEQ ID NO: 160387 - DNA, 15 bp, Homo sapiens
ctttctagaatcagc

SEQ ID NO: 160388 - DNA, 15 bp, Homo sapiens
tctttctagaatcag

SEQ ID NO: 160389 - DNA, 15 bp, Homo sapiens
ctctttctagaatca

SEQ ID NO: 160390 - DNA, 15 bp, Homo sapiens
gctctttctagaatc

SEQ ID NO: 160391 - DNA, 15 bp, Homo sapiens
tgctctttctagaat

SEQ ID NO: 160392 - DNA, 15 bp, Homo sapiens
ttgctctttctagaa

SEQ ID NO: 160393 - DNA, 15 bp, Homo sapiens
tttgctctttctaga

SEQ ID NO: 160394 - DNA, 15 bp, Homo sapiens
atttgctctttctag

SEQ ID NO: 160395 - DNA, 15 bp, Homo sapiens
catttgctctttcta

SEQ ID NO: 160396 - DNA, 15 bp, Homo sapiens
tcatttgctctttct

SEQ ID NO: 160397 - DNA, 15 bp, Homo sapiens
ttcatttgctctttc

SEQ ID NO: 160398 - DNA, 15 bp, Homo sapiens
cttcatttgctcttt

SEQ ID NO: 160399 - DNA, 15 bp, Homo sapiens
tcttcatttgctctt

SEQ ID NO: 160400 - DNA, 15 bp, Homo sapiens
ttcttcatttgctct

SEQ ID NO: 160401 - DNA, 15 bp, Homo sapiens
cttcttcatttgctc

SEQ ID NO: 160402 - DNA, 15 bp, Homo sapiens
tcttcttcatttgct

SEQ ID NO: 160403 - DNA, 15 bp, Homo sapiens
ttcttcttcatttgc

SEQ ID NO: 160404 - DNA, 15 bp, Homo sapiens
tttcttcttcatttg

SEQ ID NO: 160405 - DNA, 15 bp, Homo sapiens
gtttcttcttcattt

SEQ ID NO: 160406 - DNA, 15 bp, Homo sapiens
tgtttcttcttcatt

SEQ ID NO: 160407 - DNA, 15 bp, Homo sapiens
ttgtttcttcttcat

SEQ ID NO: 160408 - DNA, 15 bp, Homo sapiens
cttgtttcttcttca

SEQ ID NO: 160409 - DNA, 15 bp, Homo sapiens
tcttgtttcttcttc

SEQ ID NO: 160410 - DNA, 15 bp, Homo sapiens
ctcttgtttcttctt

SEQ ID NO: 160411 - DNA, 15 bp, Homo sapiens
actcttgtttcttct

SEQ ID NO: 160412 - DNA, 15 bp, Homo sapiens
cactcttgtttcttc

SEQ ID NO: 160413 - DNA, 15 bp, Homo sapiens
tcactcttgtttctt

SEQ ID NO: 160414 - DNA, 15 bp, Homo sapiens
ttcactcttgtttct

SEQ ID NO: 160415 - DNA, 15 bp, Homo sapiens
tttcactcttgtttc

SEQ ID NO: 160416 - DNA, 15 bp, Homo sapiens
ttttcactcttgttt

SEQ ID NO: 160417 - DNA, 15 bp, Homo sapiens
cttttcactcttgtt

SEQ ID NO: 160418 - DNA, 15 bp, Homo sapiens
tcttttcactcttgt

SEQ ID NO: 160419 - DNA, 15 bp, Homo sapiens
ctcttttcactcttg

SEQ ID NO: 160420 - DNA, 15 bp, Homo sapiens
actcttttcactctt

SEQ ID NO: 160421 - DNA, 15 bp, Homo sapiens
cactcttttcactct

SEQ ID NO: 160422 - DNA, 15 bp, Homo sapiens
ccactcttttcactc

SEQ ID NO: 160423 - DNA, 15 bp, Homo sapiens
gccactcttttcact

SEQ ID NO: 160424 - DNA, 15 bp, Homo sapiens
agccactcttttcac

SEQ ID NO: 160425 - DNA, 15 bp, Homo sapiens
tttggtagccactct

SEQ ID NO: 160426 - DNA, 15 bp, Homo sapiens
atttggtagccactc

SEQ ID NO: 160427 - DNA, 15 bp, Homo sapiens
gatttggtagccact

SEQ ID NO: 160428 - DNA, 15 bp, Homo sapiens
tgatttggtagccac

SEQ ID NO: 160429 - DNA, 15 bp, Homo sapiens
atgatttggtagcca

SEQ ID NO: 160430 - DNA, 15 bp, Homo sapiens
tatgatttggtagcc

SEQ ID NO: 160431 - DNA, 15 bp, Homo sapiens
ctatgatttggtagc

SEQ ID NO: 160432 - DNA, 15 bp, Homo sapiens
cctatgatttggtag

SEQ ID NO: 160433 - DNA, 15 bp, Homo sapiens
tcctatgatttggta

SEQ ID NO: 160434 - DNA, 15 bp, Homo sapiens
ttcctatgatttggt

SEQ ID NO: 160435 - DNA, 15 bp, Homo sapiens
tttcctatgatttgg

SEQ ID NO: 160436 - DNA, 15 bp, Homo sapiens
ttttcctatgatttg

SEQ ID NO: 160437 - DNA, 15 bp, Homo sapiens
tttttcctatgattt

SEQ ID NO: 160438 - DNA, 15 bp, Homo sapiens
ttttttcctatgatt

SEQ ID NO: 160439 - DNA, 15 bp, Homo sapiens
attttttcctatgat

SEQ ID NO: 160440 - DNA, 15 bp, Homo sapiens
tattttttcctatga

SEQ ID NO: 160441 - DNA, 15 bp, Homo sapiens
gtattttttcctatg

SEQ ID NO: 160442 - DNA, 15 bp, Homo sapiens
tgtattttttcctat

SEQ ID NO: 160443 - DNA, 15 bp, Homo sapiens
ctgtattttttccta

SEQ ID NO: 160444 - DNA, 15 bp, Homo sapiens
cctgtattttttcct

SEQ ID NO: 160445 - DNA, 15 bp, Homo sapiens
tcctgtattttttcc

SEQ ID NO: 160446 - DNA, 15 bp, Homo sapiens
ctcctgtattttttc

SEQ ID NO: 160447 - DNA, 15 bp, Homo sapiens
actcctgtatttttt

SEQ ID NO: 160448 - DNA, 15 bp, Homo sapiens
gactcctgtattttt

SEQ ID NO: 160449 - DNA, 15 bp, Homo sapiens
ggactcctgtatttt

SEQ ID NO: 160450 - DNA, 15 bp, Homo sapiens
gggactcctgtattt

SEQ ID NO: 160451 - DNA, 15 bp, Homo sapiens
tgggactcctgtatt

SEQ ID NO: 160452 - DNA, 15 bp, Homo sapiens
ctgggactcctgtat

SEQ ID NO: 160453 - DNA, 15 bp, Homo sapiens
cctgggactcctgta

SEQ ID NO: 160454 - DNA, 15 bp, Homo sapiens
tcctgggactcctgt

SEQ ID NO: 160455 - DNA, 15 bp, Homo sapiens
gtcctgggactcctg

SEQ ID NO: 160456 - DNA, 15 bp, Homo sapiens
ggtcctgggactcct

SEQ ID NO: 160457 - DNA, 15 bp, Homo sapiens
aggtcctgggactcc

SEQ ID NO: 160458 - DNA, 15 bp, Homo sapiens
aaggtcctgggactc

SEQ ID NO: 160459 - DNA, 15 bp, Homo sapiens
gaaggtcctgggact

SEQ ID NO: 160460 - DNA, 15 bp, Homo sapiens
ggaaggtcctgggac

SEQ ID NO: 160461 - DNA, 15 bp, Homo sapiens
gggaaggtcctggga

SEQ ID NO: 160462 - DNA, 15 bp, Homo sapiens
ggggaaggtcctggg

SEQ ID NO: 160463 - DNA, 15 bp, Homo sapiens
gggggaaggtcctgg

SEQ ID NO: 160464 - DNA, 15 bp, Homo sapiens
tgggggaaggtcctg

SEQ ID NO: 160465 - DNA, 15 bp, Homo sapiens
ttgggggaaggtcct

SEQ ID NO: 160466 - DNA, 15 bp, Homo sapiens
cttgggggaaggtcc

SEQ ID NO: 160467 - DNA, 15 bp, Homo sapiens
ccttgggggaaggtc

SEQ ID NO: 160468 - DNA, 15 bp, Homo sapiens
tccttgggggaaggt

SEQ ID NO: 160469 - DNA, 15 bp, Homo sapiens
gtccttgggggaagg

SEQ ID NO: 160470 - DNA, 15 bp, Homo sapiens
tgtccttgggggaag

SEQ ID NO: 160471 - DNA, 15 bp, Homo sapiens
ctgtccttgggggaa

SEQ ID NO: 160472 - DNA, 15 bp, Homo sapiens
tctgtccttggggga

SEQ ID NO: 160473 - DNA, 15 bp, Homo sapiens
atctgtccttggggg

SEQ ID NO: 160474 - DNA, 15 bp, Homo sapiens
aatctgtccttgggg

SEQ ID NO: 160475 - DNA, 15 bp, Homo sapiens
gaatctgtccttggg

SEQ ID NO: 160476 - DNA, 15 bp, Homo sapiens
ggaatctgtccttgg

SEQ ID NO: 160477 - DNA, 15 bp, Homo sapiens
aggaatctgtccttg

SEQ ID NO: 160478 - DNA, 15 bp, Homo sapiens
caggaatctgtcctt

SEQ ID NO: 160479 - DNA, 15 bp, Homo sapiens
ccaggaatctgtcct

SEQ ID NO: 160480 - DNA, 15 bp, Homo sapiens
cccaggaatctgtcc

SEQ ID NO: 160481 - DNA, 15 bp, Homo sapiens
tcccaggaatctgtc

SEQ ID NO: 160482 - DNA, 15 bp, Homo sapiens
ttcccaggaatctgt

SEQ ID NO: 160483 - DNA, 15 bp, Homo sapiens
cttcccaggaatctg

SEQ ID NO: 160484 - DNA, 15 bp, Homo sapiens
ccttcccaggaatct

SEQ ID NO: 160485 - DNA, 15 bp, Homo sapiens
accttcccaggaatc

SEQ ID NO: 160486 - DNA, 15 bp, Homo sapiens
aaccttcccaggaat

SEQ ID NO: 160487 - DNA, 15 bp, Homo sapiens
aaaccttcccaggaa

SEQ ID NO: 160488 - DNA, 15 bp, Homo sapiens
gaaaccttcccagga

SEQ ID NO: 160489 - DNA, 15 bp, Homo sapiens
ggaaaccttcccagg

SEQ ID NO: 160490 - DNA, 15 bp, Homo sapiens
tggaaaccttcccag

SEQ ID NO: 160491 - DNA, 15 bp, Homo sapiens
ctggaaaccttccca

SEQ ID NO: 160492 - DNA, 15 bp, Homo sapiens
actggaaaccttccc

SEQ ID NO: 160493 - DNA, 15 bp, Homo sapiens
cactggaaaccttcc

SEQ ID NO: 160494 - DNA, 15 bp, Homo sapiens
tcactggaaaccttc

SEQ ID NO: 160495 - DNA, 15 bp, Homo sapiens
ctcactggaaacctt

SEQ ID NO: 160496 - DNA, 15 bp, Homo sapiens
actcactggaaacct

SEQ ID NO: 160497 - DNA, 15 bp, Homo sapiens
aactcactggaaacc

SEQ ID NO: 160498 - DNA, 15 bp, Homo sapiens
aaactcactggaaac

SEQ ID NO: 160499 - DNA, 15 bp, Homo sapiens
aaaactcactggaaa

SEQ ID NO: 160500 - DNA, 15 bp, Homo sapiens
aaaaactcactggaa

SEQ ID NO: 160501 - DNA, 15 bp, Homo sapiens
caaaaactcactgga

SEQ ID NO: 160502 - DNA, 15 bp, Homo sapiens
tcaaaaactcactgg

SEQ ID NO: 160503 - DNA, 15 bp, Homo sapiens
ttcaaaaactcactg

SEQ ID NO: 160504 - DNA, 15 bp, Homo sapiens
gttcaaaaactcact

SEQ ID NO: 160505 - DNA, 15 bp, Homo sapiens
ggttcaaaaactcac

SEQ ID NO: 160506 - DNA, 15 bp, Homo sapiens
aggttcaaaaactca

SEQ ID NO: 160507 - DNA, 15 bp, Homo sapiens
taggttcaaaaactc

SEQ ID NO: 160508 - DNA, 15 bp, Homo sapiens
ttaggttcaaaaact

SEQ ID NO: 160509 - DNA, 15 bp, Homo sapiens
gttaggttcaaaaac

SEQ ID NO: 160510 - DNA, 15 bp, Homo sapiens
ggttaggttcaaaaa

SEQ ID NO: 160511 - DNA, 15 bp, Homo sapiens
cggttaggttcaaaa

SEQ ID NO: 160512 - DNA, 15 bp, Homo sapiens
gcggttaggttcaaa

SEQ ID NO: 160513 - DNA, 15 bp, Homo sapiens
agcggttaggttcaa

SEQ ID NO: 160514 - DNA, 15 bp, Homo sapiens
tagcggttaggttca

SEQ ID NO: 160515 - DNA, 15 bp, Homo sapiens
ctagcggttaggttc

SEQ ID NO: 160516 - DNA, 15 bp, Homo sapiens
cctagcggttaggtt

SEQ ID NO: 160517 - DNA, 15 bp, Homo sapiens
acctagcggttaggt

SEQ ID NO: 160518 - DNA, 15 bp, Homo sapiens
aacctagcggttagg

SEQ ID NO: 160519 - DNA, 15 bp, Homo sapiens
taacctagcggttag

SEQ ID NO: 160520 - DNA, 15 bp, Homo sapiens
ttaacctagcggtta

SEQ ID NO: 160521 - DNA, 15 bp, Homo sapiens
tttaacctagcggtt

SEQ ID NO: 160522 - DNA, 15 bp, Homo sapiens
atttaacctagcggt

SEQ ID NO: 160523 - DNA, 15 bp, Homo sapiens
tatttaacctagcgg

SEQ ID NO: 160524 - DNA, 15 bp, Homo sapiens
gtatttaacctagcg

SEQ ID NO: 160525 - DNA, 15 bp, Homo sapiens
tgtatttaacctagc

SEQ ID NO: 160526 - DNA, 15 bp, Homo sapiens
atgtatttaacctag

SEQ ID NO: 160527 - DNA, 15 bp, Homo sapiens
gatgtatttaaccta

SEQ ID NO: 160528 - DNA, 15 bp, Homo sapiens
ggatgtatttaacct

SEQ ID NO: 160529 - DNA, 15 bp, Homo sapiens
gggatgtatttaacc

SEQ ID NO: 160530 - DNA, 15 bp, Homo sapiens
agggatgtatttaac

SEQ ID NO: 160531 - DNA, 15 bp, Homo sapiens
aagggatgtatttaa

SEQ ID NO: 160532 - DNA, 15 bp, Homo sapiens
aaagggatgtattta

SEQ ID NO: 160533 - DNA, 15 bp, Homo sapiens
taaagggatgtattt

SEQ ID NO: 160534 - DNA, 15 bp, Homo sapiens
ctaaagggatgtatt

SEQ ID NO: 160535 - DNA, 15 bp, Homo sapiens
actaaagggatgtat

SEQ ID NO: 160536 - DNA, 15 bp, Homo sapiens
gactaaagggatgta

SEQ ID NO: 160537 - DNA, 15 bp, Homo sapiens
agactaaagggatgt

SEQ ID NO: 160538 - DNA, 15 bp, Homo sapiens
gagactaaagggatg

SEQ ID NO: 160539 - DNA, 15 bp, Homo sapiens
tgagactaaagggat

SEQ ID NO: 160540 - DNA, 15 bp, Homo sapiens
ctgagactaaaggga

SEQ ID NO: 160541 - DNA, 15 bp, Homo sapiens
gctgagactaaaggg

SEQ ID NO: 160542 - DNA, 15 bp, Homo sapiens
agctgagactaaagg

SEQ ID NO: 160543 - DNA, 15 bp, Homo sapiens
gagctgagactaaag

SEQ ID NO: 160544 - DNA, 15 bp, Homo sapiens
tgagctgagactaaa

SEQ ID NO: 160545 - DNA, 15 bp, Homo sapiens
atgagctgagactaa

SEQ ID NO: 160546 - DNA, 15 bp, Homo sapiens
gatgagctgagacta

SEQ ID NO: 160547 - DNA, 15 bp, Homo sapiens
agatgagctgagact

SEQ ID NO: 160548 - DNA, 15 bp, Homo sapiens
aagatgagctgagac

SEQ ID NO: 160549 - DNA, 15 bp, Homo sapiens
gaagatgagctgaga

SEQ ID NO: 160550 - DNA, 15 bp, Homo sapiens
ggaagatgagctgag

SEQ ID NO: 160551 - DNA, 15 bp, Homo sapiens
aggaagatgagctga

SEQ ID NO: 160552 - DNA, 15 bp, Homo sapiens
taggaagatgagctg

SEQ ID NO: 160553 - DNA, 15 bp, Homo sapiens
ttaggaagatgagct

SEQ ID NO: 160554 - DNA, 15 bp, Homo sapiens
attaggaagatgagc

SEQ ID NO: 160555 - DNA, 15 bp, Homo sapiens
aattaggaagatgag

SEQ ID NO: 160556 - DNA, 15 bp, Homo sapiens
taattaggaagatga

SEQ ID NO: 160557 - DNA, 15 bp, Homo sapiens
ttaattaggaagatg

SEQ ID NO: 160558 - DNA, 15 bp, Homo sapiens
cttaattaggaagat

SEQ ID NO: 160559 - DNA, 15 bp, Homo sapiens
acttaattaggaaga

SEQ ID NO: 160560 - DNA, 15 bp, Homo sapiens
tacttaattaggaag

SEQ ID NO: 160561 - DNA, 15 bp, Homo sapiens
gtacttaattaggaa

SEQ ID NO: 160562 - DNA, 15 bp, Homo sapiens
tgtacttaattagga

SEQ ID NO: 160563 - DNA, 15 bp, Homo sapiens
ttgtacttaattagg

SEQ ID NO: 160564 - DNA, 15 bp, Homo sapiens
tttgtacttaattag

SEQ ID NO: 160565 - DNA, 15 bp, Homo sapiens
atttgtacttaatta

SEQ ID NO: 160566 - DNA, 15 bp, Homo sapiens
aatttgtacttaatt

SEQ ID NO: 160567 - DNA, 15 bp, Homo sapiens
gaatttgtacttaat

SEQ ID NO: 160568 - DNA, 15 bp, Homo sapiens
cgaatttgtacttaa

SEQ ID NO: 160569 - DNA, 15 bp, Homo sapiens
tcgaatttgtactta

SEQ ID NO: 160570 - DNA, 15 bp, Homo sapiens
ttcgaatttgtactt

SEQ ID NO: 160571 - DNA, 15 bp, Homo sapiens
tttcgaatttgtact

SEQ ID NO: 160572 - DNA, 15 bp, Homo sapiens
ttttcgaatttgtac

SEQ ID NO: 160573 - DNA, 15 bp, Homo sapiens
attttcgaatttgta

SEQ ID NO: 160574 - DNA, 15 bp, Homo sapiens
tattttcgaatttgt

SEQ ID NO: 160575 - DNA, 15 bp, Homo sapiens
ttattttcgaatttg

SEQ ID NO: 160576 - DNA, 15 bp, Homo sapiens
attattttcgaattt

SEQ ID NO: 160577 - DNA, 15 bp, Homo sapiens
aattattttcgaatt

SEQ ID NO: 160578 - DNA, 15 bp, Homo sapiens
caattattttcgaat

SEQ ID NO: 160579 - DNA, 15 bp, Homo sapiens
acaattattttcgaa

SEQ ID NO: 160580 - DNA, 15 bp, Homo sapiens
tacaattattttcga

SEQ ID NO: 160581 - DNA, 15 bp, Homo sapiens
ttacaattattttcg

SEQ ID NO: 160582 - DNA, 15 bp, Homo sapiens
cttacaattattttc

SEQ ID NO: 160583 - DNA, 15 bp, Homo sapiens
ccttacaattatttt

SEQ ID NO: 160584 - DNA, 15 bp, Homo sapiens
accttacaattattt

SEQ ID NO: 160585 - DNA, 15 bp, Homo sapiens
aaccttacaattatt

SEQ ID NO: 160586 - DNA, 15 bp, Homo sapiens
aaaccttacaattat

SEQ ID NO: 160587 - DNA, 15 bp, Homo sapiens
aaaaccttacaatta

SEQ ID NO: 160588 - DNA, 15 bp, Homo sapiens
gaaaaccttacaatt

SEQ ID NO: 160589 - DNA, 15 bp, Homo sapiens
agaaaaccttacaat

SEQ ID NO: 160590 - DNA, 15 bp, Homo sapiens
gagaaaaccttacaa

SEQ ID NO: 160591 - DNA, 15 bp, Homo sapiens
tgagaaaaccttaca

SEQ ID NO: 160592 - DNA, 15 bp, Homo sapiens
ctgagaaaaccttac

SEQ ID NO: 160593 - DNA, 15 bp, Homo sapiens
tctgagaaaacctta

SEQ ID NO: 160594 - DNA, 15 bp, Homo sapiens
atctgagaaaacctt

SEQ ID NO: 160595 - DNA, 15 bp, Homo sapiens
tatctgagaaaacct

SEQ ID NO: 160596 - DNA, 15 bp, Homo sapiens
atatctgagaaaacc

SEQ ID NO: 160597 - DNA, 15 bp, Homo sapiens
catatctgagaaaac

SEQ ID NO: 160598 - DNA, 15 bp, Homo sapiens
acatatctgagaaaa

SEQ ID NO: 160599 - DNA, 15 bp, Homo sapiens
cacatatctgagaaa

SEQ ID NO: 160600 - DNA, 15 bp, Homo sapiens
tcacatatctgagaa

SEQ ID NO: 160601 - DNA, 15 bp, Homo sapiens
atcacatatctgaga

SEQ ID NO: 160602 - DNA, 15 bp, Homo sapiens
catcacatatctgag

SEQ ID NO: 160603 - DNA, 15 bp, Homo sapiens
ccatcacatatctga

SEQ ID NO: 160604 - DNA, 15 bp, Homo sapiens
tccatcacatatctg

SEQ ID NO: 160605 - DNA, 15 bp, Homo sapiens
atccatcacatatct

SEQ ID NO: 160606 - DNA, 15 bp, Homo sapiens
aatccatcacatatc

SEQ ID NO: 160607 - DNA, 15 bp, Homo sapiens
taatccatcacatat

SEQ ID NO: 160608 - DNA, 15 bp, Homo sapiens
tgtaatccatcacat

SEQ ID NO: 160609 - DNA, 15 bp, Homo sapiens
atgtaatccatcaca

SEQ ID NO: 160610 - DNA, 15 bp, Homo sapiens
catgtaatccatcac

SEQ ID NO: 160611 - DNA, 15 bp, Homo sapiens
acatgtaatccatca

SEQ ID NO: 160612 - DNA, 15 bp, Homo sapiens
gacatgtaatccatc

SEQ ID NO: 160613 - DNA, 15 bp, Homo sapiens
tgacatgtaatccat

SEQ ID NO: 160614 - DNA, 15 bp, Homo sapiens
ctgacatgtaatcca

SEQ ID NO: 160615 - DNA, 15 bp, Homo sapiens
actgacatgtaatcc

SEQ ID NO: 160616 - DNA, 15 bp, Homo sapiens
aactgacatgtaatc

SEQ ID NO: 160617 - DNA, 15 bp, Homo sapiens
caactgacatgtaat

SEQ ID NO: 160618 - DNA, 15 bp, Homo sapiens
gcaactgacatgtaa

SEQ ID NO: 160619 - DNA, 15 bp, Homo sapiens
tgcaactgacatgta

SEQ ID NO: 160620 - DNA, 15 bp, Homo sapiens
atgcaactgacatgt

SEQ ID NO: 160621 - DNA, 15 bp, Homo sapiens
gatgcaactgacatg

SEQ ID NO: 160622 - DNA, 15 bp, Homo sapiens
tgatgcaactgacat

SEQ ID NO: 160623 - DNA, 15 bp, Homo sapiens
gtgatgcaactgaca

SEQ ID NO: 160624 - DNA, 15 bp, Homo sapiens
tgtgatgcaactgac

SEQ ID NO: 160625 - DNA, 15 bp, Homo sapiens
atgtgatgcaactga

SEQ ID NO: 160626 - DNA, 15 bp, Homo sapiens
aatgtgatgcaactg

SEQ ID NO: 160627 - DNA, 15 bp, Homo sapiens
gaatgtgatgcaact

SEQ ID NO: 160628 - DNA, 15 bp, Homo sapiens
agaatgtgatgcaac

SEQ ID NO: 160629 - DNA, 15 bp, Homo sapiens
aagaatgtgatgcaa

SEQ ID NO: 160630 - DNA, 15 bp, Homo sapiens
gaagaatgtgatgca

SEQ ID NO: 160631 - DNA, 15 bp, Homo sapiens
tgaagaatgtgatgc

SEQ ID NO: 160632 - DNA, 15 bp, Homo sapiens
ttgaagaatgtgatg

SEQ ID NO: 160633 - DNA, 15 bp, Homo sapiens
cttgaagaatgtgat

SEQ ID NO: 160634 - DNA, 15 bp, Homo sapiens
gcttgaagaatgtga

SEQ ID NO: 160635 - DNA, 15 bp, Homo sapiens
tgcttgaagaatgtg

SEQ ID NO: 160636 - DNA, 15 bp, Homo sapiens
ttgcttgaagaatgt

SEQ ID NO: 160637 - DNA, 15 bp, Homo sapiens
tttgcttgaagaatg

SEQ ID NO: 160638 - DNA, 15 bp, Homo sapiens
ctttgcttgaagaat

SEQ ID NO: 160639 - DNA, 15 bp, Homo sapiens
actttgcttgaagaa

SEQ ID NO: 160640 - DNA, 15 bp, Homo sapiens
tactttgcttgaaga

SEQ ID NO: 160641 - DNA, 15 bp, Homo sapiens
ttactttgcttgaag

SEQ ID NO: 160642 - DNA, 15 bp, Homo sapiens
tttactttgcttgaa

SEQ ID NO: 160643 - DNA, 15 bp, Homo sapiens
atttactttgcttga

SEQ ID NO: 160644 - DNA, 15 bp, Homo sapiens
catttactttgcttg

SEQ ID NO: 160645 - DNA, 15 bp, Homo sapiens
tcatttactttgctt

SEQ ID NO: 160646 - DNA, 15 bp, Homo sapiens
ttcatttactttgct

SEQ ID NO: 160647 - DNA, 15 bp, Homo sapiens
attcatttactttgc

SEQ ID NO: 160648 - DNA, 15 bp, Homo sapiens
cattcatttactttg

SEQ ID NO: 160649 - DNA, 15 bp, Homo sapiens
tcattcatttacttt

SEQ ID NO: 160650 - DNA, 15 bp, Homo sapiens
ttcattcatttactt

SEQ ID NO: 160651 - DNA, 15 bp, Homo sapiens
attcattcatttact

SEQ ID NO: 160652 - DNA, 15 bp, Homo sapiens
cattcattcatttac

SEQ ID NO: 160653 - DNA, 15 bp, Homo sapiens
gttcattcattcatt

SEQ ID NO: 160654 - DNA, 15 bp, Homo sapiens
tgttcattcattcat

SEQ ID NO: 160655 - DNA, 15 bp, Homo sapiens
ttgttcattcattca

SEQ ID NO: 160656 - DNA, 15 bp, Homo sapiens
cttgttcattcattc

SEQ ID NO: 160657 - DNA, 15 bp, Homo sapiens
ccttgttcattcatt

SEQ ID NO: 160658 - DNA, 15 bp, Homo sapiens
cccttgttcattcat

SEQ ID NO: 160659 - DNA, 15 bp, Homo sapiens
tcccttgttcattca

SEQ ID NO: 160660 - DNA, 15 bp, Homo sapiens
ttcccttgttcattc

SEQ ID NO: 160661 - DNA, 15 bp, Homo sapiens
attcccttgttcatt

SEQ ID NO: 160662 - DNA, 15 bp, Homo sapiens
cattcccttgttcat

SEQ ID NO: 160663 - DNA, 15 bp, Homo sapiens
tcattcccttgttca

SEQ ID NO: 160664 - DNA, 15 bp, Homo sapiens
ttcattcccttgttc

SEQ ID NO: 160665 - DNA, 15 bp, Homo sapiens
attcattcccttgtt

SEQ ID NO: 160666 - DNA, 15 bp, Homo sapiens
tattcattcccttgt

SEQ ID NO: 160667 - DNA, 15 bp, Homo sapiens
ttattcattcccttg

SEQ ID NO: 160668 - DNA, 15 bp, Homo sapiens
tttattcattccctt

SEQ ID NO: 160669 - DNA, 15 bp, Homo sapiens
gtttattcattccct

SEQ ID NO: 160670 - DNA, 15 bp, Homo sapiens
tgtttattcattccc

SEQ ID NO: 160671 - DNA, 15 bp, Homo sapiens
ttgtttattcattcc

SEQ ID NO: 160672 - DNA, 15 bp, Homo sapiens
tttgtttattcattc

SEQ ID NO: 160673 - DNA, 15 bp, Homo sapiens
ttttgtttattcatt

SEQ ID NO: 160674 - DNA, 15 bp, Homo sapiens
cttttgtttattcat

SEQ ID NO: 160675 - DNA, 15 bp, Homo sapiens
ccttttgtttattca

SEQ ID NO: 160676 - DNA, 15 bp, Homo sapiens
tccttttgtttattc

SEQ ID NO: 160677 - DNA, 15 bp, Homo sapiens
ctccttttgtttatt

SEQ ID NO: 160678 - DNA, 15 bp, Homo sapiens
gctccttttgtttat

SEQ ID NO: 160679 - DNA, 15 bp, Homo sapiens
agctccttttgttta

SEQ ID NO: 160680 - DNA, 15 bp, Homo sapiens
tagctccttttgttt

SEQ ID NO: 160681 - DNA, 15 bp, Homo sapiens
ctagctccttttgtt

SEQ ID NO: 160682 - DNA, 15 bp, Homo sapiens
tctagctccttttgt

SEQ ID NO: 160683 - DNA, 15 bp, Homo sapiens
atctagctccttttg

SEQ ID NO: 160684 - DNA, 15 bp, Homo sapiens
tatctagctcctttt

SEQ ID NO: 160685 - DNA, 15 bp, Homo sapiens
atatctagctccttt

SEQ ID NO: 160686 - DNA, 15 bp, Homo sapiens
aatatctagctcctt

SEQ ID NO: 160687 - DNA, 15 bp, Homo sapiens
gaatatctagctcct

SEQ ID NO: 160688 - DNA, 15 bp, Homo sapiens
ggaatatctagctcc

SEQ ID NO: 160689 - DNA, 15 bp, Homo sapiens
gggaatatctagctc

SEQ ID NO: 160690 - DNA, 15 bp, Homo sapiens
agggaatatctagct

SEQ ID NO: 160691 - DNA, 15 bp, Homo sapiens
cagggaatatctagc

SEQ ID NO: 160692 - DNA, 15 bp, Homo sapiens
tcagggaatatctag

SEQ ID NO: 160693 - DNA, 15 bp, Homo sapiens
ttcagggaatatcta

SEQ ID NO: 160694 - DNA, 15 bp, Homo sapiens
gttcagggaatatct

SEQ ID NO: 160695 - DNA, 15 bp, Homo sapiens
tgttcagggaatatc

SEQ ID NO: 160696 - DNA, 15 bp, Homo sapiens
atgttcagggaatat

SEQ ID NO: 160697 - DNA, 15 bp, Homo sapiens
aatgttcagggaata

SEQ ID NO: 160698 - DNA, 15 bp, Homo sapiens
caatgttcagggaat

SEQ ID NO: 160699 - DNA, 15 bp, Homo sapiens
gcaatgttcagggaa

SEQ ID NO: 160700 - DNA, 15 bp, Homo sapiens
tgcaatgttcaggga

SEQ ID NO: 160701 - DNA, 15 bp, Homo sapiens
ttgcaatgttcaggg

SEQ ID NO: 160702 - DNA, 15 bp, Homo sapiens
cttgcaatgttcagg

SEQ ID NO: 160703 - DNA, 15 bp, Homo sapiens
gcttgcaatgttcag

SEQ ID NO: 160704 - DNA, 15 bp, Homo sapiens
agcttgcaatgttca

SEQ ID NO: 160705 - DNA, 15 bp, Homo sapiens
aagcttgcaatgttc

SEQ ID NO: 160706 - DNA, 15 bp, Homo sapiens
gaagcttgcaatgtt

SEQ ID NO: 160707 - DNA, 15 bp, Homo sapiens
ggaagcttgcaatgt

SEQ ID NO: 160708 - DNA, 15 bp, Homo sapiens
aggaagcttgcaatg

SEQ ID NO: 160709 - DNA, 15 bp, Homo sapiens
aaggaagcttgcaat

SEQ ID NO: 160710 - DNA, 15 bp, Homo sapiens
aaaggaagcttgcaa

SEQ ID NO: 160711 - DNA, 15 bp, Homo sapiens
caaaggaagcttgca

SEQ ID NO: 160712 - DNA, 15 bp, Homo sapiens
ccaaaggaagcttgc

SEQ ID NO: 160713 - DNA, 15 bp, Homo sapiens
gccaaaggaagcttg

SEQ ID NO: 160714 - DNA, 15 bp, Homo sapiens
ggccaaaggaagctt

SEQ ID NO: 160715 - DNA, 15 bp, Homo sapiens
aggccaaaggaagct

SEQ ID NO: 160716 - DNA, 15 bp, Homo sapiens
caggccaaaggaagc

SEQ ID NO: 160717 - DNA, 15 bp, Homo sapiens
acaggccaaaggaag

SEQ ID NO: 160718 - DNA, 15 bp, Homo sapiens
cacaggccaaaggaa

SEQ ID NO: 160719 - DNA, 15 bp, Homo sapiens
ccacaggccaaagga

SEQ ID NO: 160720 - DNA, 15 bp, Homo sapiens
accacaggccaaagg

SEQ ID NO: 160721 - DNA, 15 bp, Homo sapiens
caccacaggccaaag

SEQ ID NO: 160722 - DNA, 15 bp, Homo sapiens
gcaccacaggccaaa

SEQ ID NO: 160723 - DNA, 15 bp, Homo sapiens
agcaccacaggccaa

SEQ ID NO: 160724 - DNA, 15 bp, Homo sapiens
aagcaccacaggcca

SEQ ID NO: 160725 - DNA, 15 bp, Homo sapiens
gaagcaccacaggcc

SEQ ID NO: 160726 - DNA, 15 bp, Homo sapiens
ggaagcaccacaggc

SEQ ID NO: 160727 - DNA, 15 bp, Homo sapiens
tggaagcaccacagg

SEQ ID NO: 160728 - DNA, 15 bp, Homo sapiens
atggaagcaccacag

SEQ ID NO: 160729 - DNA, 15 bp, Homo sapiens
aatggaagcaccaca

SEQ ID NO: 160730 - DNA, 15 bp, Homo sapiens
taatggaagcaccac

SEQ ID NO: 160731 - DNA, 15 bp, Homo sapiens
gtaatggaagcacca

SEQ ID NO: 160732 - DNA, 15 bp, Homo sapiens
ggtaatggaagcacc

SEQ ID NO: 160733 - DNA, 15 bp, Homo sapiens
tggtaatggaagcac

SEQ ID NO: 160734 - DNA, 15 bp, Homo sapiens
ctggtaatggaagca

SEQ ID NO: 160735 - DNA, 15 bp, Homo sapiens
gctggtaatggaagc

SEQ ID NO: 160736 - DNA, 15 bp, Homo sapiens
tgctggtaatggaag

SEQ ID NO: 160737 - DNA, 15 bp, Homo sapiens
ctgctggtaatggaa

SEQ ID NO: 160738 - DNA, 15 bp, Homo sapiens
gctgctggtaatgga

SEQ ID NO: 160739 - DNA, 15 bp, Homo sapiens
tgctgctggtaatgg

SEQ ID NO: 160740 - DNA, 15 bp, Homo sapiens
gtgctgctggtaatg

SEQ ID NO: 160741 - DNA, 15 bp, Homo sapiens
agtgctgctggtaat

SEQ ID NO: 160742 - DNA, 15 bp, Homo sapiens
aagtgctgctggtaa

SEQ ID NO: 160743 - DNA, 15 bp, Homo sapiens
gaagtgctgctggta

SEQ ID NO: 160744 - DNA, 15 bp, Homo sapiens
tgaagtgctgctggt

SEQ ID NO: 160745 - DNA, 15 bp, Homo sapiens
ctgaagtgctgctgg

SEQ ID NO: 160746 - DNA, 15 bp, Homo sapiens
actgaagtgctgctg

SEQ ID NO: 160747 - DNA, 15 bp, Homo sapiens
aactgaagtgctgct

SEQ ID NO: 160748 - DNA, 15 bp, Homo sapiens
taactgaagtgctgc

SEQ ID NO: 160749 - DNA, 15 bp, Homo sapiens
ctaactgaagtgctg

SEQ ID NO: 160750 - DNA, 15 bp, Homo sapiens
tctaactgaagtgct

SEQ ID NO: 160751 - DNA, 15 bp, Homo sapiens
ttctaactgaagtgc

SEQ ID NO: 160752 - DNA, 15 bp, Homo sapiens
attctaactgaagtg

SEQ ID NO: 160753 - DNA, 15 bp, Homo sapiens
cattctaactgaagt

SEQ ID NO: 160754 - DNA, 15 bp, Homo sapiens
tcattctaactgaag

SEQ ID NO: 160755 - DNA, 15 bp, Homo sapiens
atcattctaactgaa

SEQ ID NO: 160756 - DNA, 15 bp, Homo sapiens
gatcattctaactga

SEQ ID NO: 160757 - DNA, 15 bp, Homo sapiens
ggatcattctaactg

SEQ ID NO: 160758 - DNA, 15 bp, Homo sapiens
gggatcattctaact

SEQ ID NO: 160759 - DNA, 15 bp, Homo sapiens
agggatcattctaac

SEQ ID NO: 160760 - DNA, 15 bp, Homo sapiens
tagggatcattctaa

SEQ ID NO: 160761 - DNA, 15 bp, Homo sapiens
atagggatcattcta

SEQ ID NO: 160762 - DNA, 15 bp, Homo sapiens
catagggatcattct

SEQ ID NO: 160763 - DNA, 15 bp, Homo sapiens
tcatagggatcattc

SEQ ID NO: 160764 - DNA, 15 bp, Homo sapiens
ttcatagggatcatt

SEQ ID NO: 160765 - DNA, 15 bp, Homo sapiens
attcatagggatcat

SEQ ID NO: 160766 - DNA, 15 bp, Homo sapiens
aattcatagggatca

SEQ ID NO: 160767 - DNA, 15 bp, Homo sapiens
taattcatagggatc

SEQ ID NO: 160768 - DNA, 15 bp, Homo sapiens
ttaattcatagggat

SEQ ID NO: 160769 - DNA, 15 bp, Homo sapiens
gttaattcataggga

SEQ ID NO: 160770 - DNA, 15 bp, Homo sapiens
agttaattcataggg

SEQ ID NO: 160771 - DNA, 15 bp, Homo sapiens
aagttaattcatagg

SEQ ID NO: 160772 - DNA, 15 bp, Homo sapiens
caagttaattcatag

SEQ ID NO: 160773 - DNA, 15 bp, Homo sapiens
acaagttaattcata

SEQ ID NO: 160774 - DNA, 15 bp, Homo sapiens
tacaagttaattcat

SEQ ID NO: 160775 - DNA, 15 bp, Homo sapiens
ttacaagttaattca

SEQ ID NO: 160776 - DNA, 15 bp, Homo sapiens
tttacaagttaattc

SEQ ID NO: 160777 - DNA, 15 bp, Homo sapiens
atttacaagttaatt

SEQ ID NO: 160778 - DNA, 15 bp, Homo sapiens
catttacaagttaat

SEQ ID NO: 160779 - DNA, 15 bp, Homo sapiens
tcatttacaagttaa

SEQ ID NO: 160780 - DNA, 15 bp, Homo sapiens
ctcatttacaagtta

SEQ ID NO: 160781 - DNA, 15 bp, Homo sapiens
cctcatttacaagtt

SEQ ID NO: 160782 - DNA, 15 bp, Homo sapiens
tcctcatttacaagt

SEQ ID NO: 160783 - DNA, 15 bp, Homo sapiens
ctcctcatttacaag

SEQ ID NO: 160784 - DNA, 15 bp, Homo sapiens
cctcctcatttacaa

SEQ ID NO: 160785 - DNA, 15 bp, Homo sapiens
acctcctcatttaca

SEQ ID NO: 160786 - DNA, 15 bp, Homo sapiens
gacctcctcatttac

SEQ ID NO: 160787 - DNA, 15 bp, Homo sapiens
tgacctcctcattta

SEQ ID NO: 160788 - DNA, 15 bp, Homo sapiens
ttgacctcctcattt

SEQ ID NO: 160789 - DNA, 15 bp, Homo sapiens
tttgacctcctcatt

SEQ ID NO: 160790 - DNA, 15 bp, Homo sapiens
atttgacctcctcat

SEQ ID NO: 160791 - DNA, 15 bp, Homo sapiens
catttgacctcctca

SEQ ID NO: 160792 - DNA, 15 bp, Homo sapiens
acatttgacctcctc

SEQ ID NO: 160793 - DNA, 15 bp, Homo sapiens
cacatttgacctcct

SEQ ID NO: 160794 - DNA, 15 bp, Homo sapiens
gcacatttgacctcc

SEQ ID NO: 160795 - DNA, 15 bp, Homo sapiens
agcacatttgacctc

SEQ ID NO: 160796 - DNA, 15 bp, Homo sapiens
aagcacatttgacct

SEQ ID NO: 160797 - DNA, 15 bp, Homo sapiens
aaagcacatttgacc

SEQ ID NO: 160798 - DNA, 15 bp, Homo sapiens
aaaagcacatttgac

SEQ ID NO: 160799 - DNA, 15 bp, Homo sapiens
caaaagcacatttga

SEQ ID NO: 160800 - DNA, 15 bp, Homo sapiens
gcaaaagcacatttg

SEQ ID NO: 160801 - DNA, 15 bp, Homo sapiens
tgcaaaagcacattt

SEQ ID NO: 160802 - DNA, 15 bp, Homo sapiens
gtgcaaaagcacatt

SEQ ID NO: 160803 - DNA, 15 bp, Homo sapiens
tgtgcaaaagcacat

SEQ ID NO: 160804 - DNA, 15 bp, Homo sapiens
ctgtgcaaaagcaca

SEQ ID NO: 160805 - DNA, 15 bp, Homo sapiens
actgtgcaaaagcac

SEQ ID NO: 160806 - DNA, 15 bp, Homo sapiens
cactgtgcaaaagca

SEQ ID NO: 160807 - DNA, 15 bp, Homo sapiens
ccactgtgcaaaagc

SEQ ID NO: 160808 - DNA, 15 bp, Homo sapiens
accactgtgcaaaag

SEQ ID NO: 160809 - DNA, 15 bp, Homo sapiens
caccactgtgcaaaa

SEQ ID NO: 160810 - DNA, 15 bp, Homo sapiens
acaccactgtgcaaa

SEQ ID NO: 160811 - DNA, 15 bp, Homo sapiens
aacaccactgtgcaa

SEQ ID NO: 160812 - DNA, 15 bp, Homo sapiens
taacaccactgtgca

SEQ ID NO: 160813 - DNA, 15 bp, Homo sapiens
ttaacaccactgtgc

SEQ ID NO: 160814 - DNA, 15 bp, Homo sapiens
tttaacaccactgtg

SEQ ID NO: 160815 - DNA, 15 bp, Homo sapiens
atttaacaccactgt

SEQ ID NO: 160816 - DNA, 15 bp, Homo sapiens
tatttaacaccactg

SEQ ID NO: 160817 - DNA, 15 bp, Homo sapiens
atatttaacaccact

SEQ ID NO: 160818 - DNA, 15 bp, Homo sapiens
catatttaacaccac

SEQ ID NO: 160819 - DNA, 15 bp, Homo sapiens
acatatttaacacca

SEQ ID NO: 160820 - DNA, 15 bp, Homo sapiens
cacatatttaacacc

SEQ ID NO: 160821 - DNA, 15 bp, Homo sapiens
ccacatatttaacac

SEQ ID NO: 160822 - DNA, 15 bp, Homo sapiens
tccacatatttaaca

SEQ ID NO: 160823 - DNA, 15 bp, Homo sapiens
atccacatatttaac

SEQ ID NO: 160824 - DNA, 15 bp, Homo sapiens
catccacatatttaa

SEQ ID NO: 160825 - DNA, 15 bp, Homo sapiens
tcatccacatattta

SEQ ID NO: 160826 - DNA, 15 bp, Homo sapiens
ttcatccacatattt

SEQ ID NO: 160827 - DNA, 15 bp, Homo sapiens
attcatccacatatt

SEQ ID NO: 160828 - DNA, 15 bp, Homo sapiens
tattcatccacatat

SEQ ID NO: 160829 - DNA, 15 bp, Homo sapiens
ttattcatccacata

SEQ ID NO: 160830 - DNA, 15 bp, Homo sapiens
tttattcatccacat

SEQ ID NO: 160831 - DNA, 15 bp, Homo sapiens
atttattcatccaca

SEQ ID NO: 160832 - DNA, 15 bp, Homo sapiens
aatttattcatccac

SEQ ID NO: 160833 - DNA, 15 bp, Homo sapiens
gaatttattcatcca

SEQ ID NO: 160834 - DNA, 15 bp, Homo sapiens
agaatttattcatcc

SEQ ID NO: 160835 - DNA, 15 bp, Homo sapiens
aagaatttattcatc

SEQ ID NO: 160836 - DNA, 15 bp, Homo sapiens
aaagaatttattcat

SEQ ID NO: 160837 - DNA, 15 bp, Homo sapiens
gaaagaatttattca

SEQ ID NO: 160838 - DNA, 15 bp, Homo sapiens
agaaagaatttattc

SEQ ID NO: 160839 - DNA, 15 bp, Homo sapiens
aagaaagaatttatt

SEQ ID NO: 160840 - DNA, 15 bp, Homo sapiens
caagaaagaatttat

SEQ ID NO: 160841 - DNA, 15 bp, Homo sapiens
acaagaaagaattta

SEQ ID NO: 160842 - DNA, 15 bp, Homo sapiens
tacaagaaagaattt

SEQ ID NO: 160843 - DNA, 15 bp, Homo sapiens
gtacaagaaagaatt

SEQ ID NO: 160844 - DNA, 15 bp, Homo sapiens
agtacaagaaagaat

SEQ ID NO: 160845 - DNA, 15 bp, Homo sapiens
aagtacaagaaagaa

SEQ ID NO: 160846 - DNA, 15 bp, Homo sapiens
aaagtacaagaaaga

SEQ ID NO: 160847 - DNA, 15 bp, Homo sapiens
caaagtacaagaaag

SEQ ID NO: 160848 - DNA, 15 bp, Homo sapiens
ccaaagtacaagaaa

SEQ ID NO: 160849 - DNA, 15 bp, Homo sapiens
cccaaagtacaagaa

SEQ ID NO: 160850 - DNA, 15 bp, Homo sapiens
gcccaaagtacaaga

SEQ ID NO: 160851 - DNA, 15 bp, Homo sapiens
agcccaaagtacaag

SEQ ID NO: 160852 - DNA, 15 bp, Homo sapiens
tagcccaaagtacaa

SEQ ID NO: 160853 - DNA, 15 bp, Homo sapiens
atagcccaaagtaca

SEQ ID NO: 160854 - DNA, 15 bp, Homo sapiens
catagcccaaagtac

SEQ ID NO: 160855 - DNA, 15 bp, Homo sapiens
ccatagcccaaagta

SEQ ID NO: 160856 - DNA, 15 bp, Homo sapiens
tccatagcccaaagt

SEQ ID NO: 160857 - DNA, 15 bp, Homo sapiens
ctccatagcccaaag

SEQ ID NO: 160858 - DNA, 15 bp, Homo sapiens
actccatagcccaaa

SEQ ID NO: 160859 - DNA, 15 bp, Homo sapiens
gactccatagcccaa

SEQ ID NO: 160860 - DNA, 15 bp, Homo sapiens
agactccatagccca

SEQ ID NO: 160861 - DNA, 15 bp, Homo sapiens
tagactccatagccc

SEQ ID NO: 160862 - DNA, 15 bp, Homo sapiens
atagactccatagcc

SEQ ID NO: 160863 - DNA, 15 bp, Homo sapiens
catagactccatagc

SEQ ID NO: 160864 - DNA, 15 bp, Homo sapiens
acatagactccatag

SEQ ID NO: 160865 - DNA, 15 bp, Homo sapiens
tacatagactccata

SEQ ID NO: 160866 - DNA, 15 bp, Homo sapiens
ctacatagactccat

SEQ ID NO: 160867 - DNA, 15 bp, Homo sapiens
cctacatagactcca

SEQ ID NO: 160868 - DNA, 15 bp, Homo sapiens
ccctacatagactcc

SEQ ID NO: 160869 - DNA, 15 bp, Homo sapiens
accctacatagactc

SEQ ID NO: 160870 - DNA, 15 bp, Homo sapiens
aaccctacatagact

SEQ ID NO: 160871 - DNA, 15 bp, Homo sapiens
taaccctacatagac

SEQ ID NO: 160872 - DNA, 15 bp, Homo sapiens
ctaaccctacataga

SEQ ID NO: 160873 - DNA, 15 bp, Homo sapiens
tctaaccctacatag

SEQ ID NO: 160874 - DNA, 15 bp, Homo sapiens
ttctaaccctacata

SEQ ID NO: 160875 - DNA, 15 bp, Homo sapiens
tttctaaccctacat

SEQ ID NO: 160876 - DNA, 15 bp, Homo sapiens
atttctaaccctaca

SEQ ID NO: 160877 - DNA, 15 bp, Homo sapiens
tatttctaaccctac

SEQ ID NO: 160878 - DNA, 15 bp, Homo sapiens
atatttctaacccta

SEQ ID NO: 160879 - DNA, 15 bp, Homo sapiens
tatatttctaaccct

SEQ ID NO: 160880 - DNA, 15 bp, Homo sapiens
ctatatttctaaccc

SEQ ID NO: 160881 - DNA, 15 bp, Homo sapiens
cctatatttctaacc

SEQ ID NO: 160882 - DNA, 15 bp, Homo sapiens
gcctatatttctaac

SEQ ID NO: 160883 - DNA, 15 bp, Homo sapiens
agcctatatttctaa

SEQ ID NO: 160884 - DNA, 15 bp, Homo sapiens
aagcctatatttcta

SEQ ID NO: 160885 - DNA, 15 bp, Homo sapiens
aaagcctatatttct

SEQ ID NO: 160886 - DNA, 15 bp, Homo sapiens
aaaagcctatatttc

SEQ ID NO: 160887 - DNA, 15 bp, Homo sapiens
aaaaagcctatattt

SEQ ID NO: 160888 - DNA, 15 bp, Homo sapiens
gaaaaagcctatatt

SEQ ID NO: 160889 - DNA, 15 bp, Homo sapiens
agaaaaagcctatat

SEQ ID NO: 160890 - DNA, 15 bp, Homo sapiens
tagaaaaagcctata

SEQ ID NO: 160891 - DNA, 15 bp, Homo sapiens
ttagaaaaagcctat

SEQ ID NO: 160892 - DNA, 15 bp, Homo sapiens
cttagaaaaagccta

SEQ ID NO: 160893 - DNA, 15 bp, Homo sapiens
acttagaaaaagcct

SEQ ID NO: 160894 - DNA, 15 bp, Homo sapiens
aacttagaaaaagcc

SEQ ID NO: 160895 - DNA, 15 bp, Homo sapiens
caacttagaaaaagc

SEQ ID NO: 160896 - DNA, 15 bp, Homo sapiens
acaacttagaaaaag

SEQ ID NO: 160897 - DNA, 15 bp, Homo sapiens
aacaacttagaaaaa

SEQ ID NO: 160898 - DNA, 15 bp, Homo sapiens
gaacaacttagaaaa

SEQ ID NO: 160899 - DNA, 15 bp, Homo sapiens
agaacaacttagaaa

SEQ ID NO: 160900 - DNA, 15 bp, Homo sapiens
gagaacaacttagaa

SEQ ID NO: 160901 - DNA, 15 bp, Homo sapiens
ggagaacaacttaga

SEQ ID NO: 160902 - DNA, 15 bp, Homo sapiens
aggagaacaacttag

SEQ ID NO: 160903 - DNA, 15 bp, Homo sapiens
gaggagaacaactta

SEQ ID NO: 160904 - DNA, 15 bp, Homo sapiens
agaggagaacaactt

SEQ ID NO: 160905 - DNA, 15 bp, Homo sapiens
aagaggagaacaact

SEQ ID NO: 160906 - DNA, 15 bp, Homo sapiens
taagaggagaacaac

SEQ ID NO: 160907 - DNA, 15 bp, Homo sapiens
ctaagaggagaacaa

SEQ ID NO: 160908 - DNA, 15 bp, Homo sapiens
cctaagaggagaaca

SEQ ID NO: 160909 - DNA, 15 bp, Homo sapiens
tcctaagaggagaac

SEQ ID NO: 160910 - DNA, 15 bp, Homo sapiens
ttcctaagaggagaa

SEQ ID NO: 160911 - DNA, 15 bp, Homo sapiens
tttcctaagaggaga

SEQ ID NO: 160912 - DNA, 15 bp, Homo sapiens
ctttcctaagaggag

SEQ ID NO: 160913 - DNA, 15 bp, Homo sapiens
actttcctaagagga

SEQ ID NO: 160914 - DNA, 15 bp, Homo sapiens
aactttcctaagagg

SEQ ID NO: 160915 - DNA, 15 bp, Homo sapiens
taactttcctaagag

SEQ ID NO: 160916 - DNA, 15 bp, Homo sapiens
ataactttcctaaga

SEQ ID NO: 160917 - DNA, 15 bp, Homo sapiens
aataactttcctaag

SEQ ID NO: 160918 - DNA, 15 bp, Homo sapiens
aaataactttcctaa

SEQ ID NO: 160919 - DNA, 15 bp, Homo sapiens
taaataactttccta

SEQ ID NO: 160920 - DNA, 15 bp, Homo sapiens
gtaaataactttcct

SEQ ID NO: 160921 - DNA, 15 bp, Homo sapiens
tgtaaataactttcc

SEQ ID NO: 160922 - DNA, 15 bp, Homo sapiens
atgtaaataactttc

SEQ ID NO: 160923 - DNA, 15 bp, Homo sapiens
catgtaaataacttt

SEQ ID NO: 160924 - DNA, 15 bp, Homo sapiens
tcatgtaaataactt

SEQ ID NO: 160925 - DNA, 15 bp, Homo sapiens
atcatgtaaataact

SEQ ID NO: 160926 - DNA, 15 bp, Homo sapiens
tatcatgtaaataac

SEQ ID NO: 160927 - DNA, 15 bp, Homo sapiens
ttatcatgtaaataa

SEQ ID NO: 160928 - DNA, 15 bp, Homo sapiens
attatcatgtaaata

SEQ ID NO: 160929 - DNA, 15 bp, Homo sapiens
aattatcatgtaaat

SEQ ID NO: 160930 - DNA, 15 bp, Homo sapiens
taattatcatgtaaa

SEQ ID NO: 160931 - DNA, 15 bp, Homo sapiens
ttaattatcatgtaa

SEQ ID NO: 160932 - DNA, 15 bp, Homo sapiens
tttaattatcatgta

SEQ ID NO: 160933 - DNA, 15 bp, Homo sapiens
ctttaattatcatgt

SEQ ID NO: 160934 - DNA, 15 bp, Homo sapiens
tctttaattatcatg

SEQ ID NO: 160935 - DNA, 15 bp, Homo sapiens
ttctttaattatcat

SEQ ID NO: 160936 - DNA, 15 bp, Homo sapiens
cttctttaattatca

SEQ ID NO: 160937 - DNA, 15 bp, Homo sapiens
acttctttaattatc

SEQ ID NO: 160938 - DNA, 15 bp, Homo sapiens
aacttctttaattat

SEQ ID NO: 160939 - DNA, 15 bp, Homo sapiens
aaacttctttaatta

SEQ ID NO: 160940 - DNA, 15 bp, Homo sapiens
taaacttctttaatt

SEQ ID NO: 160941 - DNA, 15 bp, Homo sapiens
ctaaacttctttaat

SEQ ID NO: 160942 - DNA, 15 bp, Homo sapiens
tctaaacttctttaa

SEQ ID NO: 160943 - DNA, 15 bp, Homo sapiens
ttctaaacttcttta

SEQ ID NO: 160944 - DNA, 15 bp, Homo sapiens
cttctaaacttcttt

SEQ ID NO: 160945 - DNA, 15 bp, Homo sapiens
gcttctaaacttctt

SEQ ID NO: 160946 - DNA, 15 bp, Homo sapiens
tgcttctaaacttct

SEQ ID NO: 160947 - DNA, 15 bp, Homo sapiens
ttgcttctaaacttc

SEQ ID NO: 160948 - DNA, 15 bp, Homo sapiens
attgcttctaaactt

SEQ ID NO: 160949 - DNA, 15 bp, Homo sapiens
aattgcttctaaact

SEQ ID NO: 160950 - DNA, 15 bp, Homo sapiens
gaattgcttctaaac

SEQ ID NO: 160951 - DNA, 15 bp, Homo sapiens
ggaattgcttctaaa

SEQ ID NO: 160952 - DNA, 15 bp, Homo sapiens
aggaattgcttctaa

SEQ ID NO: 160953 - DNA, 15 bp, Homo sapiens
caggaattgcttcta

SEQ ID NO: 160954 - DNA, 15 bp, Homo sapiens
tcaggaattgcttct

SEQ ID NO: 160955 - DNA, 15 bp, Homo sapiens
gtcaggaattgcttc

SEQ ID NO: 160956 - DNA, 15 bp, Homo sapiens
ggtcaggaattgctt

SEQ ID NO: 160957 - DNA, 15 bp, Homo sapiens
aggtcaggaattgct

SEQ ID NO: 160958 - DNA, 15 bp, Homo sapiens
aaggtcaggaattgc

SEQ ID NO: 160959 - DNA, 15 bp, Homo sapiens
taaggtcaggaattg

SEQ ID NO: 160960 - DNA, 15 bp, Homo sapiens
ttaaggtcaggaatt

SEQ ID NO: 160961 - DNA, 15 bp, Homo sapiens
tttaaggtcaggaat

SEQ ID NO: 160962 - DNA, 15 bp, Homo sapiens
gtttaaggtcaggaa

SEQ ID NO: 160963 - DNA, 15 bp, Homo sapiens
tgtttaaggtcagga

SEQ ID NO: 160964 - DNA, 15 bp, Homo sapiens
ttgtttaaggtcagg

SEQ ID NO: 160965 - DNA, 15 bp, Homo sapiens
tttgtttaaggtcag

SEQ ID NO: 160966 - DNA, 15 bp, Homo sapiens
ctttgtttaaggtca

SEQ ID NO: 160967 - DNA, 15 bp, Homo sapiens
tctttgtttaaggtc

SEQ ID NO: 160968 - DNA, 15 bp, Homo sapiens
atctttgtttaaggt

SEQ ID NO: 160969 - DNA, 15 bp, Homo sapiens
tatctttgtttaagg

SEQ ID NO: 160970 - DNA, 15 bp, Homo sapiens
ttatctttgtttaag

SEQ ID NO: 160971 - DNA, 15 bp, Homo sapiens
gttatctttgtttaa

SEQ ID NO: 160972 - DNA, 15 bp, Homo sapiens
cgttatctttgttta

SEQ ID NO: 160973 - DNA, 15 bp, Homo sapiens
acgttatctttgttt

SEQ ID NO: 160974 - DNA, 15 bp, Homo sapiens
cacgttatctttgtt

SEQ ID NO: 160975 - DNA, 15 bp, Homo sapiens
acacgttatctttgt

SEQ ID NO: 160976 - DNA, 15 bp, Homo sapiens
tacacgttatctttg

SEQ ID NO: 160977 - DNA, 15 bp, Homo sapiens
ctacacgttatcttt

SEQ ID NO: 160978 - DNA, 15 bp, Homo sapiens
gctacacgttatctt

SEQ ID NO: 160979 - DNA, 15 bp, Homo sapiens
agctacacgttatct

SEQ ID NO: 160980 - DNA, 15 bp, Homo sapiens
aagctacacgttatc

SEQ ID NO: 160981 - DNA, 15 bp, Homo sapiens
aaagctacacgttat

SEQ ID NO: 160982 - DNA, 15 bp, Homo sapiens
gaaagctacacgtta

SEQ ID NO: 160983 - DNA, 15 bp, Homo sapiens
tgaaagctacacgtt

SEQ ID NO: 160984 - DNA, 15 bp, Homo sapiens
ttgaaagctacacgt

SEQ ID NO: 160985 - DNA, 15 bp, Homo sapiens
attgaaagctacacg

SEQ ID NO: 160986 - DNA, 15 bp, Homo sapiens
tattgaaagctacac

SEQ ID NO: 160987 - DNA, 15 bp, Homo sapiens
atattgaaagctaca

SEQ ID NO: 160988 - DNA, 15 bp, Homo sapiens
tatattgaaagctac

SEQ ID NO: 160989 - DNA, 15 bp, Homo sapiens
atatattgaaagcta

SEQ ID NO: 160990 - DNA, 15 bp, Homo sapiens
catatattgaaagct

SEQ ID NO: 160991 - DNA, 15 bp, Homo sapiens
tcatatattgaaagc

SEQ ID NO: 160992 - DNA, 15 bp, Homo sapiens
ttcatatattgaaag

SEQ ID NO: 160993 - DNA, 15 bp, Homo sapiens
gttcatatattgaaa

SEQ ID NO: 160994 - DNA, 15 bp, Homo sapiens
ggttcatatattgaa

SEQ ID NO: 160995 - DNA, 15 bp, Homo sapiens
aggttcatatattga

SEQ ID NO: 160996 - DNA, 15 bp, Homo sapiens
aaggttcatatattg

SEQ ID NO: 160997 - DNA, 15 bp, Homo sapiens
aaaggttcatatatt

SEQ ID NO: 160998 - DNA, 15 bp, Homo sapiens
taaaggttcatatat

SEQ ID NO: 160999 - DNA, 15 bp, Homo sapiens
ttaaaggttcatata

SEQ ID NO: 161000 - DNA, 15 bp, Homo sapiens
cttaaaggttcatat

SEQ ID NO: 161001 - DNA, 15 bp, Homo sapiens
tcttaaaggttcata

SEQ ID NO: 161002 - DNA, 15 bp, Homo sapiens
ttcttaaaggttcat

SEQ ID NO: 161003 - DNA, 15 bp, Homo sapiens
tttcttaaaggttca

SEQ ID NO: 161004 - DNA, 15 bp, Homo sapiens
gtttcttaaaggttc

SEQ ID NO: 161005 - DNA, 15 bp, Homo sapiens
ggtttcttaaaggtt

SEQ ID NO: 161006 - DNA, 15 bp, Homo sapiens
gggtttcttaaaggt

SEQ ID NO: 161007 - DNA, 15 bp, Homo sapiens
agggtttcttaaagg

SEQ ID NO: 161008 - DNA, 15 bp, Homo sapiens
gagggtttcttaaag

SEQ ID NO: 161009 - DNA, 15 bp, Homo sapiens
tgagggtttcttaaa

SEQ ID NO: 161010 - DNA, 15 bp, Homo sapiens
ttgagggtttcttaa

SEQ ID NO: 161011 - DNA, 15 bp, Homo sapiens
gttgagggtttctta

SEQ ID NO: 161012 - DNA, 15 bp, Homo sapiens
tgttgagggtttctt

SEQ ID NO: 161013 - DNA, 15 bp, Homo sapiens
atgttgagggtttct

SEQ ID NO: 161014 - DNA, 15 bp, Homo sapiens
aatgttgagggtttc

SEQ ID NO: 161015 - DNA, 15 bp, Homo sapiens
aaatgttgagggttt

SEQ ID NO: 161016 - DNA, 15 bp, Homo sapiens
gaaatgttgagggtt

SEQ ID NO: 161017 - DNA, 15 bp, Homo sapiens
tgaaatgttgagggt

SEQ ID NO: 161018 - DNA, 15 bp, Homo sapiens
ttgaaatgttgaggg

SEQ ID NO: 161019 - DNA, 15 bp, Homo sapiens
tttgaaatgttgagg

SEQ ID NO: 161020 - DNA, 15 bp, Homo sapiens
ctttgaaatgttgag

SEQ ID NO: 161021 - DNA, 15 bp, Homo sapiens
cctttgaaatgttga

SEQ ID NO: 161022 - DNA, 15 bp, Homo sapiens
gcctttgaaatgttg

SEQ ID NO: 161023 - DNA, 15 bp, Homo sapiens
tgcctttgaaatgtt

SEQ ID NO: 161024 - DNA, 15 bp, Homo sapiens
gtgcctttgaaatgt

SEQ ID NO: 161025 - DNA, 15 bp, Homo sapiens
tgtgcctttgaaatg

SEQ ID NO: 161026 - DNA, 15 bp, Homo sapiens
ttgtgcctttgaaat

SEQ ID NO: 161027 - DNA, 15 bp, Homo sapiens
tttgtgcctttgaaa

SEQ ID NO: 161028 - DNA, 15 bp, Homo sapiens
atttgtgcctttgaa

SEQ ID NO: 161029 - DNA, 15 bp, Homo sapiens
aatttgtgcctttga

SEQ ID NO: 161030 - DNA, 15 bp, Homo sapiens
taatttgtgcctttg

SEQ ID NO: 161031 - DNA, 15 bp, Homo sapiens
ctaatttgtgccttt

SEQ ID NO: 161032 - DNA, 15 bp, Homo sapiens
tctaatttgtgcctt

SEQ ID NO: 161033 - DNA, 15 bp, Homo sapiens
ctctaatttgtgcct

SEQ ID NO: 161034 - DNA, 15 bp, Homo sapiens
gctctaatttgtgcc

SEQ ID NO: 161035 - DNA, 15 bp, Homo sapiens
tgctctaatttgtgc

SEQ ID NO: 161036 - DNA, 15 bp, Homo sapiens
atgctctaatttgtg

SEQ ID NO: 161037 - DNA, 15 bp, Homo sapiens
aatgctctaatttgt

SEQ ID NO: 161038 - DNA, 15 bp, Homo sapiens
taatgctctaatttg

SEQ ID NO: 161039 - DNA, 15 bp, Homo sapiens
ctaatgctctaattt

SEQ ID NO: 161040 - DNA, 15 bp, Homo sapiens
actaatgctctaatt

SEQ ID NO: 161041 - DNA, 15 bp, Homo sapiens
gactaatgctctaat

SEQ ID NO: 161042 - DNA, 15 bp, Homo sapiens
agactaatgctctaa

SEQ ID NO: 161043 - DNA, 15 bp, Homo sapiens
tagactaatgctcta

SEQ ID NO: 161044 - DNA, 15 bp, Homo sapiens
ttagactaatgctct

SEQ ID NO: 161045 - DNA, 15 bp, Homo sapiens
tttagactaatgctc

SEQ ID NO: 161046 - DNA, 15 bp, Homo sapiens
atttagactaatgct

SEQ ID NO: 161047 - DNA, 15 bp, Homo sapiens
tatttagactaatgc

SEQ ID NO: 161048 - DNA, 15 bp, Homo sapiens
ttatttagactaatg

SEQ ID NO: 161049 - DNA, 15 bp, Homo sapiens
gttatttagactaat

SEQ ID NO: 161050 - DNA, 15 bp, Homo sapiens
tgttatttagactaa

SEQ ID NO: 161051 - DNA, 15 bp, Homo sapiens
ttgttatttagacta

SEQ ID NO: 161052 - DNA, 15 bp, Homo sapiens
tttgttatttagact

SEQ ID NO: 161053 - DNA, 15 bp, Homo sapiens
gtttgttatttagac

SEQ ID NO: 161054 - DNA, 15 bp, Homo sapiens
ggtttgttatttaga

SEQ ID NO: 161055 - DNA, 15 bp, Homo sapiens
gggtttgttatttag

SEQ ID NO: 161056 - DNA, 15 bp, Homo sapiens
ggggtttgttattta

SEQ ID NO: 161057 - DNA, 15 bp, Homo sapiens
gggggtttgttattt

SEQ ID NO: 161058 - DNA, 15 bp, Homo sapiens
ggggggtttgttatt

SEQ ID NO: 161059 - DNA, 15 bp, Homo sapiens
aggggggtttgttat

SEQ ID NO: 161060 - DNA, 15 bp, Homo sapiens
gaggggggtttgtta

SEQ ID NO: 161061 - DNA, 15 bp, Homo sapiens
agaggggggtttgtt

SEQ ID NO: 161062 - DNA, 15 bp, Homo sapiens
aagaggggggtttgt

SEQ ID NO: 161063 - DNA, 15 bp, Homo sapiens
aaagaggggggtttg

SEQ ID NO: 161064 - DNA, 15 bp, Homo sapiens
gaaagaggggggttt

SEQ ID NO: 161065 - DNA, 15 bp, Homo sapiens
ggaaagaggggggtt

SEQ ID NO: 161066 - DNA, 15 bp, Homo sapiens
gggaaagaggggggt

SEQ ID NO: 161067 - DNA, 15 bp, Homo sapiens
cgggaaagagggggg

SEQ ID NO: 161068 - DNA, 15 bp, Homo sapiens
tcgggaaagaggggg

SEQ ID NO: 161069 - DNA, 15 bp, Homo sapiens
atcgggaaagagggg

SEQ ID NO: 161070 - DNA, 15 bp, Homo sapiens
tatcgggaaagaggg

SEQ ID NO: 161071 - DNA, 15 bp, Homo sapiens
atatcgggaaagagg

SEQ ID NO: 161072 - DNA, 15 bp, Homo sapiens
aatatcgggaaagag

SEQ ID NO: 161073 - DNA, 15 bp, Homo sapiens
gaatatcgggaaaga

SEQ ID NO: 161074 - DNA, 15 bp, Homo sapiens
tgaatatcgggaaag

SEQ ID NO: 161075 - DNA, 15 bp, Homo sapiens
atgaatatcgggaaa

SEQ ID NO: 161076 - DNA, 15 bp, Homo sapiens
aatgaatatcgggaa

SEQ ID NO: 161077 - DNA, 15 bp, Homo sapiens
aaatgaatatcggga

SEQ ID NO: 161078 - DNA, 15 bp, Homo sapiens
taaatgaatatcggg

SEQ ID NO: 161079 - DNA, 15 bp, Homo sapiens
ataaatgaatatcgg

SEQ ID NO: 161080 - DNA, 15 bp, Homo sapiens
tataaatgaatatcg

SEQ ID NO: 161081 - DNA, 15 bp, Homo sapiens
ctataaatgaatatc

SEQ ID NO: 161082 - DNA, 15 bp, Homo sapiens
cctataaatgaatat

SEQ ID NO: 161083 - DNA, 15 bp, Homo sapiens
ccctataaatgaata

SEQ ID NO: 161084 - DNA, 15 bp, Homo sapiens
accctataaatgaat

SEQ ID NO: 161085 - DNA, 15 bp, Homo sapiens
taccctataaatgaa

SEQ ID NO: 161086 - DNA, 15 bp, Homo sapiens
ataccctataaatga

SEQ ID NO: 161087 - DNA, 15 bp, Homo sapiens
tataccctataaatg

SEQ ID NO: 161088 - DNA, 15 bp, Homo sapiens
ttataccctataaat

SEQ ID NO: 161089 - DNA, 15 bp, Homo sapiens
tttataccctataaa

SEQ ID NO: 161090 - DNA, 15 bp, Homo sapiens
ttttataccctataa

SEQ ID NO: 161091 - DNA, 15 bp, Homo sapiens
attttataccctata

SEQ ID NO: 161092 - DNA, 15 bp, Homo sapiens
tattttataccctat

SEQ ID NO: 161093 - DNA, 15 bp, Homo sapiens
gtattttatacccta

SEQ ID NO: 161094 - DNA, 15 bp, Homo sapiens
agtattttataccct

SEQ ID NO: 161095 - DNA, 15 bp, Homo sapiens
aagtattttataccc

SEQ ID NO: 161096 - DNA, 15 bp, Homo sapiens
caagtattttatacc

SEQ ID NO: 161097 - DNA, 15 bp, Homo sapiens
tcaagtattttatac

SEQ ID NO: 161098 - DNA, 15 bp, Homo sapiens
gtcaagtattttata

SEQ ID NO: 161099 - DNA, 15 bp, Homo sapiens
tgtcaagtattttat

SEQ ID NO: 161100 - DNA, 15 bp, Homo sapiens
ctgtcaagtatttta

SEQ ID NO: 161101 - DNA, 15 bp, Homo sapiens
tctgtcaagtatttt

SEQ ID NO: 161102 - DNA, 15 bp, Homo sapiens
ttctgtcaagtattt

SEQ ID NO: 161103 - DNA, 15 bp, Homo sapiens
tttctgtcaagtatt

SEQ ID NO: 161104 - DNA, 15 bp, Homo sapiens
ttttctgtcaagtat

SEQ ID NO: 161105 - DNA, 15 bp, Homo sapiens
cttttctgtcaagta

SEQ ID NO: 161106 - DNA, 15 bp, Homo sapiens
acttttctgtcaagt

SEQ ID NO: 161107 - DNA, 15 bp, Homo sapiens
aacttttctgtcaag

SEQ ID NO: 161108 - DNA, 15 bp, Homo sapiens
caacttttctgtcaa

SEQ ID NO: 161109 - DNA, 15 bp, Homo sapiens
tcaacttttctgtca

SEQ ID NO: 161110 - DNA, 15 bp, Homo sapiens
ctcaacttttctgtc

SEQ ID NO: 161111 - DNA, 15 bp, Homo sapiens
tctcaacttttctgt

SEQ ID NO: 161112 - DNA, 15 bp, Homo sapiens
atctcaacttttctg

SEQ ID NO: 161113 - DNA, 15 bp, Homo sapiens
tatctcaacttttct

SEQ ID NO: 161114 - DNA, 15 bp, Homo sapiens
gtatctcaacttttc

SEQ ID NO: 161115 - DNA, 15 bp, Homo sapiens
tgtatctcaactttt

SEQ ID NO: 161116 - DNA, 15 bp, Homo sapiens
ctgtatctcaacttt

SEQ ID NO: 161117 - DNA, 15 bp, Homo sapiens
tctgtatctcaactt

SEQ ID NO: 161118 - DNA, 15 bp, Homo sapiens
ttctgtatctcaact

SEQ ID NO: 161119 - DNA, 15 bp, Homo sapiens
tttctgtatctcaac

SEQ ID NO: 161120 - DNA, 15 bp, Homo sapiens
ttttctgtatctcaa

SEQ ID NO: 161121 - DNA, 15 bp, Homo sapiens
cttttctgtatctca

SEQ ID NO: 161122 - DNA, 15 bp, Homo sapiens
tcttttctgtatctc

SEQ ID NO: 161123 - DNA, 15 bp, Homo sapiens
atcttttctgtatct

SEQ ID NO: 161124 - DNA, 15 bp, Homo sapiens
catcttttctgtatc

SEQ ID NO: 161125 - DNA, 15 bp, Homo sapiens
gcatcttttctgtat

SEQ ID NO: 161126 - DNA, 15 bp, Homo sapiens
agcatcttttctgta

SEQ ID NO: 161127 - DNA, 15 bp, Homo sapiens
tagcatcttttctgt

SEQ ID NO: 161128 - DNA, 15 bp, Homo sapiens
ttagcatcttttctg

SEQ ID NO: 161129 - DNA, 15 bp, Homo sapiens
tttagcatcttttct

SEQ ID NO: 161130 - DNA, 15 bp, Homo sapiens
atttagcatcttttc

SEQ ID NO: 161131 - DNA, 15 bp, Homo sapiens
aatttagcatctttt

SEQ ID NO: 161132 - DNA, 15 bp, Homo sapiens
aaatttagcatcttt

SEQ ID NO: 161133 - DNA, 15 bp, Homo sapiens
gaaatttagcatctt

SEQ ID NO: 161134 - DNA, 15 bp, Homo sapiens
tgaaatttagcatct

SEQ ID NO: 161135 - DNA, 15 bp, Homo sapiens
atgaaatttagcatc

SEQ ID NO: 161136 - DNA, 15 bp, Homo sapiens
catgaaatttagcat

SEQ ID NO: 161137 - DNA, 15 bp, Homo sapiens
tcatgaaatttagca

SEQ ID NO: 161138 - DNA, 15 bp, Homo sapiens
ttcatgaaatttagc

SEQ ID NO: 161139 - DNA, 15 bp, Homo sapiens
tttcatgaaatttag

SEQ ID NO: 161140 - DNA, 15 bp, Homo sapiens
gtttcatgaaattta

SEQ ID NO: 161141 - DNA, 15 bp, Homo sapiens
tgtttcatgaaattt

SEQ ID NO: 161142 - DNA, 15 bp, Homo sapiens
atgtttcatgaaatt

SEQ ID NO: 161143 - DNA, 15 bp, Homo sapiens
aatgtttcatgaaat

SEQ ID NO: 161144 - DNA, 15 bp, Homo sapiens
caatgtttcatgaaa

SEQ ID NO: 161145 - DNA, 15 bp, Homo sapiens
acaatgtttcatgaa

SEQ ID NO: 161146 - DNA, 15 bp, Homo sapiens
aacaatgtttcatga

SEQ ID NO: 161147 - DNA, 15 bp, Homo sapiens
taacaatgtttcatg

SEQ ID NO: 161148 - DNA, 15 bp, Homo sapiens
ataacaatgtttcat

SEQ ID NO: 161149 - DNA, 15 bp, Homo sapiens
cataacaatgtttca

SEQ ID NO: 161150 - DNA, 15 bp, Homo sapiens
tcataacaatgtttc

SEQ ID NO: 161151 - DNA, 15 bp, Homo sapiens
ttcataacaatgttt

SEQ ID NO: 161152 - DNA, 15 bp, Homo sapiens
attcataacaatgtt

SEQ ID NO: 161153 - DNA, 15 bp, Homo sapiens
gattcataacaatgt

SEQ ID NO: 161154 - DNA, 15 bp, Homo sapiens
tgattcataacaatg

SEQ ID NO: 161155 - DNA, 15 bp, Homo sapiens
ttgattcataacaat

SEQ ID NO: 161156 - DNA, 15 bp, Homo sapiens
attgattcataacaa

SEQ ID NO: 161157 - DNA, 15 bp, Homo sapiens
aattgattcataaca

SEQ ID NO: 161158 - DNA, 15 bp, Homo sapiens
taattgattcataac

SEQ ID NO: 161159 - DNA, 15 bp, Homo sapiens
gtaattgattcataa

SEQ ID NO: 161160 - DNA, 15 bp, Homo sapiens
tgtaattgattcata

SEQ ID NO: 161161 - DNA, 15 bp, Homo sapiens
ctgtaattgattcat

SEQ ID NO: 161162 - DNA, 15 bp, Homo sapiens
tctgtaattgattca

SEQ ID NO: 161163 - DNA, 15 bp, Homo sapiens
gtctgtaattgattc

SEQ ID NO: 161164 - DNA, 15 bp, Homo sapiens
tgtctgtaattgatt

SEQ ID NO: 161165 - DNA, 15 bp, Homo sapiens
atgtctgtaattgat

SEQ ID NO: 161166 - DNA, 15 bp, Homo sapiens
aatgtctgtaattga

SEQ ID NO: 161167 - DNA, 15 bp, Homo sapiens
aaatgtctgtaattg

SEQ ID NO: 161168 - DNA, 15 bp, Homo sapiens
aaaatgtctgtaatt

SEQ ID NO: 161169 - DNA, 15 bp, Homo sapiens
taaaatgtctgtaat

SEQ ID NO: 161170 - DNA, 15 bp, Homo sapiens
ctaaaatgtctgtaa

SEQ ID NO: 161171 - DNA, 15 bp, Homo sapiens
actaaaatgtctgta

SEQ ID NO: 161172 - DNA, 15 bp, Homo sapiens
aactaaaatgtctgt

SEQ ID NO: 161173 - DNA, 15 bp, Homo sapiens
aaactaaaatgtctg

SEQ ID NO: 161174 - DNA, 15 bp, Homo sapiens
taaactaaaatgtct

SEQ ID NO: 161175 - DNA, 15 bp, Homo sapiens
ataaactaaaatgtc

SEQ ID NO: 161176 - DNA, 15 bp, Homo sapiens
aataaactaaaatgt

SEQ ID NO: 161177 - DNA, 15 bp, Homo sapiens
aaataaactaaaatg

SEQ ID NO: 161178 - DNA, 15 bp, Homo sapiens
taaataaactaaaat

SEQ ID NO: 161179 - DNA, 15 bp, Homo sapiens
ttaaataaactaaaa

SEQ ID NO: 161180 - DNA, 15 bp, Homo sapiens
tttaaataaactaaa

SEQ ID NO: 161181 - DNA, 15 bp, Homo sapiens
ttttaaataaactaa

SEQ ID NO: 161182 - DNA, 15 bp, Homo sapiens
gttttaaataaacta

SEQ ID NO: 161183 - DNA, 15 bp, Homo sapiens
tgttttaaataaact

SEQ ID NO: 161184 - DNA, 15 bp, Homo sapiens
ctgttttaaataaac

SEQ ID NO: 161185 - DNA, 15 bp, Homo sapiens
actgttttaaataaa

SEQ ID NO: 161186 - DNA, 15 bp, Homo sapiens
aactgttttaaataa

SEQ ID NO: 161187 - DNA, 15 bp, Homo sapiens
aaactgttttaaata

SEQ ID NO: 161188 - DNA, 15 bp, Homo sapiens
caaactgttttaaat

SEQ ID NO: 161189 - DNA, 15 bp, Homo sapiens
aacaaactgttttaa

SEQ ID NO: 161190 - DNA, 15 bp, Homo sapiens
aaacaaactgtttta

SEQ ID NO: 161191 - DNA, 15 bp, Homo sapiens
caaacaaactgtttt

SEQ ID NO: 161192 - DNA, 15 bp, Homo sapiens
acaaacaaactgttt

SEQ ID NO: 161193 - DNA, 15 bp, Homo sapiens
tacaaacaaactgtt

SEQ ID NO: 161194 - DNA, 15 bp, Homo sapiens
ttacaaacaaactgt

SEQ ID NO: 161195 - DNA, 15 bp, Homo sapiens
gttacaaacaaactg

SEQ ID NO: 161196 - DNA, 15 bp, Homo sapiens
agttacaaacaaact

SEQ ID NO: 161197 - DNA, 15 bp, Homo sapiens
cagttacaaacaaac

SEQ ID NO: 161198 - DNA, 15 bp, Homo sapiens
acagttacaaacaaa

SEQ ID NO: 161199 - DNA, 15 bp, Homo sapiens
aacagttacaaacaa

SEQ ID NO: 161200 - DNA, 15 bp, Homo sapiens
gaacagttacaaaca

SEQ ID NO: 161201 - DNA, 15 bp, Homo sapiens
tgaacagttacaaac

SEQ ID NO: 161202 - DNA, 15 bp, Homo sapiens
ctgaacagttacaaa

SEQ ID NO: 161203 - DNA, 15 bp, Homo sapiens
tctgaacagttacaa

SEQ ID NO: 161204 - DNA, 15 bp, Homo sapiens
ttctgaacagttaca

SEQ ID NO: 161205 - DNA, 15 bp, Homo sapiens
tttctgaacagttac

SEQ ID NO: 161206 - DNA, 15 bp, Homo sapiens
atttctgaacagtta

SEQ ID NO: 161207 - DNA, 15 bp, Homo sapiens
tatttctgaacagtt

SEQ ID NO: 161208 - DNA, 15 bp, Homo sapiens
gtatttctgaacagt

SEQ ID NO: 161209 - DNA, 15 bp, Homo sapiens
agtatttctgaacag

SEQ ID NO: 161210 - DNA, 15 bp, Homo sapiens
aagtatttctgaaca

SEQ ID NO: 161211 - DNA, 15 bp, Homo sapiens
taagtatttctgaac

SEQ ID NO: 161212 - DNA, 15 bp, Homo sapiens
atgtaagtatttctg

SEQ ID NO: 161213 - DNA, 15 bp, Homo sapiens
aatgtaagtatttct

SEQ ID NO: 161214 - DNA, 15 bp, Homo sapiens
caatgtaagtatttc

SEQ ID NO: 161215 - DNA, 15 bp, Homo sapiens
tcaatgtaagtattt

SEQ ID NO: 161216 - DNA, 15 bp, Homo sapiens
ttcaatgtaagtatt

SEQ ID NO: 161217 - DNA, 15 bp, Homo sapiens
tttcaatgtaagtat

SEQ ID NO: 161218 - DNA, 15 bp, Homo sapiens
ctttcaatgtaagta

SEQ ID NO: 161219 - DNA, 15 bp, Homo sapiens
tctttcaatgtaagt

SEQ ID NO: 161220 - DNA, 15 bp, Homo sapiens
ttctttcaatgtaag

SEQ ID NO: 161221 - DNA, 15 bp, Homo sapiens
attctttcaatgtaa

SEQ ID NO: 161222 - DNA, 15 bp, Homo sapiens
cattctttcaatgta

SEQ ID NO: 161223 - DNA, 15 bp, Homo sapiens
acattctttcaatgt

SEQ ID NO: 161224 - DNA, 15 bp, Homo sapiens
gacattctttcaatg

SEQ ID NO: 161225 - DNA, 15 bp, Homo sapiens
ggacattctttcaat

SEQ ID NO: 161226 - DNA, 15 bp, Homo sapiens
tggacattctttcaa

SEQ ID NO: 161227 - DNA, 15 bp, Homo sapiens
gtggacattctttca

SEQ ID NO: 161228 - DNA, 15 bp, Homo sapiens
tgtggacattctttc

SEQ ID NO: 161229 - DNA, 15 bp, Homo sapiens
ttgtggacattcttt

SEQ ID NO: 161230 - DNA, 15 bp, Homo sapiens
tttgtggacattctt

SEQ ID NO: 161231 - DNA, 15 bp, Homo sapiens
ctttgtggacattct

SEQ ID NO: 161232 - DNA, 15 bp, Homo sapiens
gctttgtggacattc

SEQ ID NO: 161233 - DNA, 15 bp, Homo sapiens
tgctttgtggacatt

SEQ ID NO: 161234 - DNA, 15 bp, Homo sapiens
gtgctttgtggacat

SEQ ID NO: 161235 - DNA, 15 bp, Homo sapiens
agtgctttgtggaca

SEQ ID NO: 161236 - DNA, 15 bp, Homo sapiens
tagtgctttgtggac

SEQ ID NO: 161237 - DNA, 15 bp, Homo sapiens
ctagtgctttgtgga

SEQ ID NO: 161238 - DNA, 15 bp, Homo sapiens
tctagtgctttgtgg

SEQ ID NO: 161239 - DNA, 15 bp, Homo sapiens
atctagtgctttgtg

SEQ ID NO: 161240 - DNA, 15 bp, Homo sapiens
gatctagtgctttgt

SEQ ID NO: 161241 - DNA, 15 bp, Homo sapiens
agatctagtgctttg

SEQ ID NO: 161242 - DNA, 15 bp, Homo sapiens
cagatctagtgcttt

SEQ ID NO: 161243 - DNA, 15 bp, Homo sapiens
acagatctagtgctt

SEQ ID NO: 161244 - DNA, 15 bp, Homo sapiens
tacagatctagtgct

SEQ ID NO: 161245 - DNA, 15 bp, Homo sapiens
ctacagatctagtgc

SEQ ID NO: 161246 - DNA, 15 bp, Homo sapiens
actacagatctagtg

SEQ ID NO: 161247 - DNA, 15 bp, Homo sapiens
aactacagatctagt

SEQ ID NO: 161248 - DNA, 15 bp, Homo sapiens
aaactacagatctag

SEQ ID NO: 161249 - DNA, 15 bp, Homo sapiens
gaaactacagatcta

SEQ ID NO: 161250 - DNA, 15 bp, Homo sapiens
tgaaactacagatct

SEQ ID NO: 161251 - DNA, 15 bp, Homo sapiens
ctgaaactacagatc

SEQ ID NO: 161252 - DNA, 15 bp, Homo sapiens
actgaaactacagat

SEQ ID NO: 161253 - DNA, 15 bp, Homo sapiens
cactgaaactacaga

SEQ ID NO: 161254 - DNA, 15 bp, Homo sapiens
ccactgaaactacag

SEQ ID NO: 161255 - DNA, 15 bp, Homo sapiens
tccactgaaactaca

SEQ ID NO: 161256 - DNA, 15 bp, Homo sapiens
ctccactgaaactac

SEQ ID NO: 161257 - DNA, 15 bp, Homo sapiens
tctccactgaaacta

SEQ ID NO: 161258 - DNA, 15 bp, Homo sapiens
ctctccactgaaact

SEQ ID NO: 161259 - DNA, 15 bp, Homo sapiens
actctccactgaaac

SEQ ID NO: 161260 - DNA, 15 bp, Homo sapiens
gactctccactgaaa

SEQ ID NO: 161261 - DNA, 15 bp, Homo sapiens
tgactctccactgaa

SEQ ID NO: 161262 - DNA, 15 bp, Homo sapiens
ctgactctccactga

SEQ ID NO: 161263 - DNA, 15 bp, Homo sapiens
actgactctccactg

SEQ ID NO: 161264 - DNA, 15 bp, Homo sapiens
tactgactctccact

SEQ ID NO: 161265 - DNA, 15 bp, Homo sapiens
atactgactctccac

SEQ ID NO: 161266 - DNA, 15 bp, Homo sapiens
aatactgactctcca

SEQ ID NO: 161267 - DNA, 15 bp, Homo sapiens
taatactgactctcc

SEQ ID NO: 161268 - DNA, 15 bp, Homo sapiens
ataatactgactctc

SEQ ID NO: 161269 - DNA, 15 bp, Homo sapiens
tataatactgactct

SEQ ID NO: 161270 - DNA, 15 bp, Homo sapiens
atataatactgactc

SEQ ID NO: 161271 - DNA, 15 bp, Homo sapiens
tatataatactgact

SEQ ID NO: 161272 - DNA, 15 bp, Homo sapiens
atatataatactgac

SEQ ID NO: 161273 - DNA, 15 bp, Homo sapiens
aatatataatactga

SEQ ID NO: 161274 - DNA, 15 bp, Homo sapiens
taatatataatactg

SEQ ID NO: 161275 - DNA, 15 bp, Homo sapiens
ataatatataatact

SEQ ID NO: 161276 - DNA, 15 bp, Homo sapiens
tataatatataatac

SEQ ID NO: 161277 - DNA, 15 bp, Homo sapiens
ttataatatataata

SEQ ID NO: 161278 - DNA, 15 bp, Homo sapiens
attataatatataat

SEQ ID NO: 161279 - DNA, 15 bp, Homo sapiens
tattataatatataa

SEQ ID NO: 161280 - DNA, 15 bp, Homo sapiens
atattataatatata

SEQ ID NO: 161281 - DNA, 15 bp, Homo sapiens
aatattataatatat

SEQ ID NO: 161282 - DNA, 15 bp, Homo sapiens
taatattataatata

SEQ ID NO: 161283 - DNA, 15 bp, Homo sapiens
ataatattataatat

SEQ ID NO: 161284 - DNA, 15 bp, Homo sapiens
tataatattataata

SEQ ID NO: 161285 - DNA, 15 bp, Homo sapiens
ttataatattataat

SEQ ID NO: 161286 - DNA, 15 bp, Homo sapiens
tttataatattataa

SEQ ID NO: 161287 - DNA, 15 bp, Homo sapiens
ttttataatattata

SEQ ID NO: 161288 - DNA, 15 bp, Homo sapiens
attttataatattat

SEQ ID NO: 161289 - DNA, 15 bp, Homo sapiens
cattttataatatta

SEQ ID NO: 161290 - DNA, 15 bp, Homo sapiens
tcattttataatatt

SEQ ID NO: 161291 - DNA, 15 bp, Homo sapiens
gtcattttataatat

SEQ ID NO: 161292 - DNA, 15 bp, Homo sapiens
tgtcattttataata

SEQ ID NO: 161293 - DNA, 15 bp, Homo sapiens
gtgtcattttataat

SEQ ID NO: 161294 - DNA, 15 bp, Homo sapiens
tgtgtcattttataa

SEQ ID NO: 161295 - DNA, 15 bp, Homo sapiens
gtgtgtcattttata

SEQ ID NO: 161296 - DNA, 15 bp, Homo sapiens
agtgtgtcattttat

SEQ ID NO: 161297 - DNA, 15 bp, Homo sapiens
aagtgtgtcatttta

SEQ ID NO: 161298 - DNA, 15 bp, Homo sapiens
gaagtgtgtcatttt

SEQ ID NO: 161299 - DNA, 15 bp, Homo sapiens
agaagtgtgtcattt

SEQ ID NO: 161300 - DNA, 15 bp, Homo sapiens
gagaagtgtgtcatt

SEQ ID NO: 161301 - DNA, 15 bp, Homo sapiens
tgagaagtgtgtcat

SEQ ID NO: 161302 - DNA, 15 bp, Homo sapiens
ttgagaagtgtgtca

SEQ ID NO: 161303 - DNA, 15 bp, Homo sapiens
attgagaagtgtgtc

SEQ ID NO: 161304 - DNA, 15 bp, Homo sapiens
cattgagaagtgtgt

SEQ ID NO: 161305 - DNA, 15 bp, Homo sapiens
ccattgagaagtgtg

SEQ ID NO: 161306 - DNA, 15 bp, Homo sapiens
gccattgagaagtgt

SEQ ID NO: 161307 - DNA, 15 bp, Homo sapiens
cgccattgagaagtg

SEQ ID NO: 161308 - DNA, 15 bp, Homo sapiens
gcgccattgagaagt

SEQ ID NO: 161309 - DNA, 15 bp, Homo sapiens
tgcgccattgagaag

SEQ ID NO: 161310 - DNA, 15 bp, Homo sapiens
ctgcgccattgagaa

SEQ ID NO: 161311 - DNA, 15 bp, Homo sapiens
gctgcgccattgaga

SEQ ID NO: 161312 - DNA, 15 bp, Homo sapiens
agctgcgccattgag

SEQ ID NO: 161313 - DNA, 15 bp, Homo sapiens
aagctgcgccattga

SEQ ID NO: 161314 - DNA, 15 bp, Homo sapiens
gaagctgcgccattg

SEQ ID NO: 161315 - DNA, 15 bp, Homo sapiens
ggaagctgcgccatt

SEQ ID NO: 161316 - DNA, 15 bp, Homo sapiens
aggaagctgcgccat

SEQ ID NO: 161317 - DNA, 15 bp, Homo sapiens
taggaagctgcgcca

SEQ ID NO: 161318 - DNA, 15 bp, Homo sapiens
ctaggaagctgcgcc

SEQ ID NO: 161319 - DNA, 15 bp, Homo sapiens
tctaggaagctgcgc

SEQ ID NO: 161320 - DNA, 15 bp, Homo sapiens
ttctaggaagctgcg

SEQ ID NO: 161321 - DNA, 15 bp, Homo sapiens
cttctaggaagctgc

SEQ ID NO: 161322 - DNA, 15 bp, Homo sapiens
acttctaggaagctg

SEQ ID NO: 161323 - DNA, 15 bp, Homo sapiens
gacttctaggaagct

SEQ ID NO: 161324 - DNA, 15 bp, Homo sapiens
tgacttctaggaagc

SEQ ID NO: 161325 - DNA, 15 bp, Homo sapiens
atgacttctaggaag

SEQ ID NO: 161326 - DNA, 15 bp, Homo sapiens
aatgacttctaggaa

SEQ ID NO: 161327 - DNA, 15 bp, Homo sapiens
aaatgacttctagga

SEQ ID NO: 161328 - DNA, 15 bp, Homo sapiens
gaaatgacttctagg

SEQ ID NO: 161329 - DNA, 15 bp, Homo sapiens
ggaaatgacttctag

SEQ ID NO: 161330 - DNA, 15 bp, Homo sapiens
aggaaatgacttcta

SEQ ID NO: 161331 - DNA, 15 bp, Homo sapiens
taggaaatgacttct

SEQ ID NO: 161332 - DNA, 15 bp, Homo sapiens
ataggaaatgacttc

SEQ ID NO: 161333 - DNA, 15 bp, Homo sapiens
tataggaaatgactt

SEQ ID NO: 161334 - DNA, 15 bp, Homo sapiens
atataggaaatgact

SEQ ID NO: 161335 - DNA, 15 bp, Homo sapiens
aatataggaaatgac

SEQ ID NO: 161336 - DNA, 15 bp, Homo sapiens
taatataggaaatga

SEQ ID NO: 161337 - DNA, 15 bp, Homo sapiens
gtaatataggaaatg

SEQ ID NO: 161338 - DNA, 15 bp, Homo sapiens
agtaatataggaaat

SEQ ID NO: 161339 - DNA, 15 bp, Homo sapiens
aagtaatataggaaa

SEQ ID NO: 161340 - DNA, 15 bp, Homo sapiens
caagtaatataggaa

SEQ ID NO: 161341 - DNA, 15 bp, Homo sapiens
ccaagtaatatagga

SEQ ID NO: 161342 - DNA, 15 bp, Homo sapiens
gccaagtaatatagg

SEQ ID NO: 161343 - DNA, 15 bp, Homo sapiens
ggccaagtaatatag

SEQ ID NO: 161344 - DNA, 15 bp, Homo sapiens
tggccaagtaatata

SEQ ID NO: 161345 - DNA, 15 bp, Homo sapiens
atggccaagtaatat

SEQ ID NO: 161346 - DNA, 15 bp, Homo sapiens
tatggccaagtaata

SEQ ID NO: 161347 - DNA, 15 bp, Homo sapiens
ttatggccaagtaat

SEQ ID NO: 161348 - DNA, 15 bp, Homo sapiens
attatggccaagtaa

SEQ ID NO: 161349 - DNA, 15 bp, Homo sapiens
gattatggccaagta

SEQ ID NO: 161350 - DNA, 15 bp, Homo sapiens
tgattatggccaagt

SEQ ID NO: 161351 - DNA, 15 bp, Homo sapiens
gtgattatggccaag

SEQ ID NO: 161352 - DNA, 15 bp, Homo sapiens
agtgattatggccaa

SEQ ID NO: 161353 - DNA, 15 bp, Homo sapiens
tagtgattatggcca

SEQ ID NO: 161354 - DNA, 15 bp, Homo sapiens
atagtgattatggcc

SEQ ID NO: 161355 - DNA, 15 bp, Homo sapiens
aatagtgattatggc

SEQ ID NO: 161356 - DNA, 15 bp, Homo sapiens
taatagtgattatgg

SEQ ID NO: 161357 - DNA, 15 bp, Homo sapiens
ttaatagtgattatg

SEQ ID NO: 161358 - DNA, 15 bp, Homo sapiens
attaatagtgattat

SEQ ID NO: 161359 - DNA, 15 bp, Homo sapiens
aattaatagtgatta

SEQ ID NO: 161360 - DNA, 15 bp, Homo sapiens
gaattaatagtgatt

SEQ ID NO: 161361 - DNA, 15 bp, Homo sapiens
tgaattaatagtgat

SEQ ID NO: 161362 - DNA, 15 bp, Homo sapiens
ctgaattaatagtga

SEQ ID NO: 161363 - DNA, 15 bp, Homo sapiens
actgaattaatagtg

SEQ ID NO: 161364 - DNA, 15 bp, Homo sapiens
aactgaattaatagt

SEQ ID NO: 161365 - DNA, 15 bp, Homo sapiens
aaactgaattaatag

SEQ ID NO: 161366 - DNA, 15 bp, Homo sapiens
gaaactgaattaata

SEQ ID NO: 161367 - DNA, 15 bp, Homo sapiens
tgaaactgaattaat

SEQ ID NO: 161368 - DNA, 15 bp, Homo sapiens
atgaaactgaattaa

SEQ ID NO: 161369 - DNA, 15 bp, Homo sapiens
tatgaaactgaatta

SEQ ID NO: 161370 - DNA, 15 bp, Homo sapiens
ttatgaaactgaatt

SEQ ID NO: 161371 - DNA, 15 bp, Homo sapiens
tttatgaaactgaat

SEQ ID NO: 161372 - DNA, 15 bp, Homo sapiens
atttatgaaactgaa

SEQ ID NO: 161373 - DNA, 15 bp, Homo sapiens
catttatgaaactga

SEQ ID NO: 161374 - DNA, 15 bp, Homo sapiens
tcatttatgaaactg

SEQ ID NO: 161375 - DNA, 15 bp, Homo sapiens
atcatttatgaaact

SEQ ID NO: 161376 - DNA, 15 bp, Homo sapiens
aatcatttatgaaac

SEQ ID NO: 161377 - DNA, 15 bp, Homo sapiens
caatcatttatgaaa

SEQ ID NO: 161378 - DNA, 15 bp, Homo sapiens
ccaatcatttatgaa

SEQ ID NO: 161379 - DNA, 15 bp, Homo sapiens
tccaatcatttatga

SEQ ID NO: 161380 - DNA, 15 bp, Homo sapiens
gtccaatcatttatg

SEQ ID NO: 161381 - DNA, 15 bp, Homo sapiens
tgtccaatcatttat

SEQ ID NO: 161382 - DNA, 15 bp, Homo sapiens
atgtccaatcattta

SEQ ID NO: 161383 - DNA, 15 bp, Homo sapiens
catgtccaatcattt

SEQ ID NO: 161384 - DNA, 15 bp, Homo sapiens
tcatgtccaatcatt

SEQ ID NO: 161385 - DNA, 15 bp, Homo sapiens
atcatgtccaatcat

SEQ ID NO: 161386 - DNA, 15 bp, Homo sapiens
gatcatgtccaatca

SEQ ID NO: 161387 - DNA, 15 bp, Homo sapiens
agatcatgtccaatc

SEQ ID NO: 161388 - DNA, 15 bp, Homo sapiens
aagatcatgtccaat

SEQ ID NO: 161389 - DNA, 15 bp, Homo sapiens
aaagatcatgtccaa

SEQ ID NO: 161390 - DNA, 15 bp, Homo sapiens
aaaagatcatgtcca

SEQ ID NO: 161391 - DNA, 15 bp, Homo sapiens
taaaagatcatgtcc

SEQ ID NO: 161392 - DNA, 15 bp, Homo sapiens
ttaaaagatcatgtc

SEQ ID NO: 161393 - DNA, 15 bp, Homo sapiens
attaaaagatcatgt

SEQ ID NO: 161394 - DNA, 15 bp, Homo sapiens
aattaaaagatcatg

SEQ ID NO: 161395 - DNA, 15 bp, Homo sapiens
gaattaaaagatcat

SEQ ID NO: 161396 - DNA, 15 bp, Homo sapiens
agaattaaaagatca

SEQ ID NO: 161397 - DNA, 15 bp, Homo sapiens
cagaattaaaagatc

SEQ ID NO: 161398 - DNA, 15 bp, Homo sapiens
tcagaattaaaagat

SEQ ID NO: 161399 - DNA, 15 bp, Homo sapiens
ctcagaattaaaaga

SEQ ID NO: 161400 - DNA, 15 bp, Homo sapiens
gctcagaattaaaag

SEQ ID NO: 161401 - DNA, 15 bp, Homo sapiens
ggctcagaattaaaa

SEQ ID NO: 161402 - DNA, 15 bp, Homo sapiens
aggctcagaattaaa

SEQ ID NO: 161403 - DNA, 15 bp, Homo sapiens
aaggctcagaattaa

SEQ ID NO: 161404 - DNA, 15 bp, Homo sapiens
gaaggctcagaatta

SEQ ID NO: 161405 - DNA, 15 bp, Homo sapiens
tgaaggctcagaatt

SEQ ID NO: 161406 - DNA, 15 bp, Homo sapiens
atgaaggctcagaat

SEQ ID NO: 161407 - DNA, 15 bp, Homo sapiens
tatgaaggctcagaa

SEQ ID NO: 161408 - DNA, 15 bp, Homo sapiens
ttatgaaggctcaga

SEQ ID NO: 161409 - DNA, 15 bp, Homo sapiens
tttatgaaggctcag

SEQ ID NO: 161410 - DNA, 15 bp, Homo sapiens
atttatgaaggctca

SEQ ID NO: 161411 - DNA, 15 bp, Homo sapiens
tatttatgaaggctc

SEQ ID NO: 161412 - DNA, 15 bp, Homo sapiens
atatttatgaaggct

SEQ ID NO: 161413 - DNA, 15 bp, Homo sapiens
catatttatgaaggc

SEQ ID NO: 161414 - DNA, 15 bp, Homo sapiens
tcatatttatgaagg

SEQ ID NO: 161415 - DNA, 15 bp, Homo sapiens
atcatatttatgaag

SEQ ID NO: 161416 - DNA, 15 bp, Homo sapiens
aatcatatttatgaa

SEQ ID NO: 161417 - DNA, 15 bp, Homo sapiens
aaatcatatttatga

SEQ ID NO: 161418 - DNA, 15 bp, Homo sapiens
gaaatcatatttatg

SEQ ID NO: 161419 - DNA, 15 bp, Homo sapiens
ggaaatcatatttat

SEQ ID NO: 161420 - DNA, 15 bp, Homo sapiens
aggaaatcatattta

SEQ ID NO: 161421 - DNA, 15 bp, Homo sapiens
gaggaaatcatattt

SEQ ID NO: 161422 - DNA, 15 bp, Homo sapiens
agaggaaatcatatt

SEQ ID NO: 161423 - DNA, 15 bp, Homo sapiens
cagaggaaatcatat

SEQ ID NO: 161424 - DNA, 15 bp, Homo sapiens
acagaggaaatcata

SEQ ID NO: 161425 - DNA, 15 bp, Homo sapiens
gacagaggaaatcat

SEQ ID NO: 161426 - DNA, 15 bp, Homo sapiens
agacagaggaaatca

SEQ ID NO: 161427 - DNA, 15 bp, Homo sapiens
cagacagaggaaatc

SEQ ID NO: 161428 - DNA, 15 bp, Homo sapiens
acagacagaggaaat

SEQ ID NO: 161429 - DNA, 15 bp, Homo sapiens
aacagacagaggaaa

SEQ ID NO: 161430 - DNA, 15 bp, Homo sapiens
aaacagacagaggaa

SEQ ID NO: 161431 - DNA, 15 bp, Homo sapiens
taaacagacagagga

SEQ ID NO: 161432 - DNA, 15 bp, Homo sapiens
ctaaacagacagagg

SEQ ID NO: 161433 - DNA, 15 bp, Homo sapiens
tctaaacagacagag

SEQ ID NO: 161434 - DNA, 15 bp, Homo sapiens
gtctaaacagacaga

SEQ ID NO: 161435 - DNA, 15 bp, Homo sapiens
agtctaaacagacag

SEQ ID NO: 161436 - DNA, 15 bp, Homo sapiens
cagtctaaacagaca

SEQ ID NO: 161437 - DNA, 15 bp, Homo sapiens
acagtctaaacagac

SEQ ID NO: 161438 - DNA, 15 bp, Homo sapiens
aacagtctaaacaga

SEQ ID NO: 161439 - DNA, 15 bp, Homo sapiens
aaacagtctaaacag

SEQ ID NO: 161440 - DNA, 15 bp, Homo sapiens
aaaacagtctaaaca

SEQ ID NO: 161441 - DNA, 15 bp, Homo sapiens
gaaaacagtctaaac

SEQ ID NO: 161442 - DNA, 15 bp, Homo sapiens
agaaaacagtctaaa

SEQ ID NO: 161443 - DNA, 15 bp, Homo sapiens
aagaaaacagtctaa

SEQ ID NO: 161444 - DNA, 15 bp, Homo sapiens
aaagaaaacagtcta

SEQ ID NO: 161445 - DNA, 15 bp, Homo sapiens
taaagaaaacagtct

SEQ ID NO: 161446 - DNA, 15 bp, Homo sapiens
ctaaagaaaacagtc

SEQ ID NO: 161447 - DNA, 15 bp, Homo sapiens
cctaaagaaaacagt

SEQ ID NO: 161448 - DNA, 15 bp, Homo sapiens
tcctaaagaaaacag

SEQ ID NO: 161449 - DNA, 15 bp, Homo sapiens
ctcctaaagaaaaca

SEQ ID NO: 161450 - DNA, 15 bp, Homo sapiens
actcctaaagaaaac

SEQ ID NO: 161451 - DNA, 15 bp, Homo sapiens
gactcctaaagaaaa

SEQ ID NO: 161452 - DNA, 15 bp, Homo sapiens
ggactcctaaagaaa

SEQ ID NO: 161453 - DNA, 15 bp, Homo sapiens
tggactcctaaagaa

SEQ ID NO: 161454 - DNA, 15 bp, Homo sapiens
gtggactcctaaaga

SEQ ID NO: 161455 - DNA, 15 bp, Homo sapiens
agtggactcctaaag

SEQ ID NO: 161456 - DNA, 15 bp, Homo sapiens
aagtggactcctaaa

SEQ ID NO: 161457 - DNA, 15 bp, Homo sapiens
caagtggactcctaa

SEQ ID NO: 161458 - DNA, 15 bp, Homo sapiens
acaagtggactccta

SEQ ID NO: 161459 - DNA, 15 bp, Homo sapiens
gacaagtggactcct

SEQ ID NO: 161460 - DNA, 15 bp, Homo sapiens
agacaagtggactcc

SEQ ID NO: 161461 - DNA, 15 bp, Homo sapiens
tagacaagtggactc

SEQ ID NO: 161462 - DNA, 15 bp, Homo sapiens
ttagacaagtggact

SEQ ID NO: 161463 - DNA, 15 bp, Homo sapiens
gttagacaagtggac

SEQ ID NO: 161464 - DNA, 15 bp, Homo sapiens
agttagacaagtgga

SEQ ID NO: 161465 - DNA, 15 bp, Homo sapiens
aagttagacaagtgg

SEQ ID NO: 161466 - DNA, 15 bp, Homo sapiens
gaagttagacaagtg

SEQ ID NO: 161467 - DNA, 15 bp, Homo sapiens
tgaagttagacaagt

SEQ ID NO: 161468 - DNA, 15 bp, Homo sapiens
ctgaagttagacaag

SEQ ID NO: 161469 - DNA, 15 bp, Homo sapiens
actgaagttagacaa

SEQ ID NO: 161470 - DNA, 15 bp, Homo sapiens
aactgaagttagaca

SEQ ID NO: 161471 - DNA, 15 bp, Homo sapiens
caactgaagttagac

SEQ ID NO: 161472 - DNA, 15 bp, Homo sapiens
gcaactgaagttaga

SEQ ID NO: 161473 - DNA, 15 bp, Homo sapiens
ggcaactgaagttag

SEQ ID NO: 161474 - DNA, 15 bp, Homo sapiens
tggcaactgaagtta

SEQ ID NO: 161475 - DNA, 15 bp, Homo sapiens
atggcaactgaagtt

SEQ ID NO: 161476 - DNA, 15 bp, Homo sapiens
gatggcaactgaagt

SEQ ID NO: 161477 - DNA, 15 bp, Homo sapiens
agatggcaactgaag

SEQ ID NO: 161478 - DNA, 15 bp, Homo sapiens
gagatggcaactgaa

SEQ ID NO: 161479 - DNA, 15 bp, Homo sapiens
tgagatggcaactga

SEQ ID NO: 161480 - DNA, 15 bp, Homo sapiens
ctgagatggcaactg

SEQ ID NO: 161481 - DNA, 15 bp, Homo sapiens
cctgagatggcaact

SEQ ID NO: 161482 - DNA, 15 bp, Homo sapiens
gcctgagatggcaac

SEQ ID NO: 161483 - DNA, 15 bp, Homo sapiens
tgcctgagatggcaa

SEQ ID NO: 161484 - DNA, 15 bp, Homo sapiens
atgcctgagatggca

SEQ ID NO: 161485 - DNA, 15 bp, Homo sapiens
aatgcctgagatggc

SEQ ID NO: 161486 - DNA, 15 bp, Homo sapiens
taatgcctgagatgg

SEQ ID NO: 161487 - DNA, 15 bp, Homo sapiens
gtaatgcctgagatg

SEQ ID NO: 161488 - DNA, 15 bp, Homo sapiens
agtaatgcctgagat

SEQ ID NO: 161489 - DNA, 15 bp, Homo sapiens
aagtaatgcctgaga

SEQ ID NO: 161490 - DNA, 15 bp, Homo sapiens
gaagtaatgcctgag

SEQ ID NO: 161491 - DNA, 15 bp, Homo sapiens
agaagtaatgcctga

SEQ ID NO: 161492 - DNA, 15 bp, Homo sapiens
gagaagtaatgcctg

SEQ ID NO: 161493 - DNA, 15 bp, Homo sapiens
ggagaagtaatgcct

SEQ ID NO: 161494 - DNA, 15 bp, Homo sapiens
aggagaagtaatgcc

SEQ ID NO: 161495 - DNA, 15 bp, Homo sapiens
caggagaagtaatgc

SEQ ID NO: 161496 - DNA, 15 bp, Homo sapiens
ccaggagaagtaatg

SEQ ID NO: 161497 - DNA, 15 bp, Homo sapiens
cccaggagaagtaat

SEQ ID NO: 161498 - DNA, 15 bp, Homo sapiens
tcccaggagaagtaa

SEQ ID NO: 161499 - DNA, 15 bp, Homo sapiens
ttcccaggagaagta

SEQ ID NO: 161500 - DNA, 15 bp, Homo sapiens
cttcccaggagaagt

SEQ ID NO: 161501 - DNA, 15 bp, Homo sapiens
gcttcccaggagaag

SEQ ID NO: 161502 - DNA, 15 bp, Homo sapiens
ggcttcccaggagaa

SEQ ID NO: 161503 - DNA, 15 bp, Homo sapiens
aggcttcccaggaga

SEQ ID NO: 161504 - DNA, 15 bp, Homo sapiens
taggcttcccaggag

SEQ ID NO: 161505 - DNA, 15 bp, Homo sapiens
ataggcttcccagga

SEQ ID NO: 161506 - DNA, 15 bp, Homo sapiens
gataggcttcccagg

SEQ ID NO: 161507 - DNA, 15 bp, Homo sapiens
agataggcttcccag

SEQ ID NO: 161508 - DNA, 15 bp, Homo sapiens
gagataggcttccca

SEQ ID NO: 161509 - DNA, 15 bp, Homo sapiens
tgagataggcttccc

SEQ ID NO: 161510 - DNA, 15 bp, Homo sapiens
gtgagataggcttcc

SEQ ID NO: 161511 - DNA, 15 bp, Homo sapiens
agtgagataggcttc

SEQ ID NO: 161512 - DNA, 15 bp, Homo sapiens
cagtgagataggctt

SEQ ID NO: 161513 - DNA, 15 bp, Homo sapiens
gcagtgagataggct

SEQ ID NO: 161514 - DNA, 15 bp, Homo sapiens
ggcagtgagataggc

SEQ ID NO: 161515 - DNA, 15 bp, Homo sapiens
aggcagtgagatagg

SEQ ID NO: 161516 - DNA, 15 bp, Homo sapiens
aaggcagtgagatag

SEQ ID NO: 161517 - DNA, 15 bp, Homo sapiens
aaaggcagtgagata

SEQ ID NO: 161518 - DNA, 15 bp, Homo sapiens
gaaaggcagtgagat

SEQ ID NO: 161519 - DNA, 15 bp, Homo sapiens
ggaaaggcagtgaga

SEQ ID NO: 161520 - DNA, 15 bp, Homo sapiens
gggaaaggcagtgag

SEQ ID NO: 161521 - DNA, 15 bp, Homo sapiens
agggaaaggcagtga

SEQ ID NO: 161522 - DNA, 15 bp, Homo sapiens
aagggaaaggcagtg

SEQ ID NO: 161523 - DNA, 15 bp, Homo sapiens
aaagggaaaggcagt

SEQ ID NO: 161524 - DNA, 15 bp, Homo sapiens
taaagggaaaggcag

SEQ ID NO: 161525 - DNA, 15 bp, Homo sapiens
ctaaagggaaaggca

SEQ ID NO: 161526 - DNA, 15 bp, Homo sapiens
tctaaagggaaaggc

SEQ ID NO: 161527 - DNA, 15 bp, Homo sapiens
gtctaaagggaaagg

SEQ ID NO: 161528 - DNA, 15 bp, Homo sapiens
tgtctaaagggaaag

SEQ ID NO: 161529 - DNA, 15 bp, Homo sapiens
gtgtctaaagggaaa

SEQ ID NO: 161530 - DNA, 15 bp, Homo sapiens
ggtgtctaaagggaa

SEQ ID NO: 161531 - DNA, 15 bp, Homo sapiens
aggtgtctaaaggga

SEQ ID NO: 161532 - DNA, 15 bp, Homo sapiens
caggtgtctaaaggg

SEQ ID NO: 161533 - DNA, 15 bp, Homo sapiens
ccaggtgtctaaagg

SEQ ID NO: 161534 - DNA, 15 bp, Homo sapiens
tccaggtgtctaaag

SEQ ID NO: 161535 - DNA, 15 bp, Homo sapiens
gtccaggtgtctaaa

SEQ ID NO: 161536 - DNA, 15 bp, Homo sapiens
agtccaggtgtctaa

SEQ ID NO: 161537 - DNA, 15 bp, Homo sapiens
tagtccaggtgtcta

SEQ ID NO: 161538 - DNA, 15 bp, Homo sapiens
ctagtccaggtgtct

SEQ ID NO: 161539 - DNA, 15 bp, Homo sapiens
cctagtccaggtgtc

SEQ ID NO: 161540 - DNA, 15 bp, Homo sapiens
tcctagtccaggtgt

SEQ ID NO: 161541 - DNA, 15 bp, Homo sapiens
ctcctagtccaggtg

SEQ ID NO: 161542 - DNA, 15 bp, Homo sapiens
actcctagtccaggt

SEQ ID NO: 161543 - DNA, 15 bp, Homo sapiens
aactcctagtccagg

SEQ ID NO: 161544 - DNA, 15 bp, Homo sapiens
aaactcctagtccag

SEQ ID NO: 161545 - DNA, 15 bp, Homo sapiens
gaaactcctagtcca

SEQ ID NO: 161546 - DNA, 15 bp, Homo sapiens
agaaactcctagtcc

SEQ ID NO: 161547 - DNA, 15 bp, Homo sapiens
gagaaactcctagtc

SEQ ID NO: 161548 - DNA, 15 bp, Homo sapiens
agagaaactcctagt

SEQ ID NO: 161549 - DNA, 15 bp, Homo sapiens
cagagaaactcctag

SEQ ID NO: 161550 - DNA, 15 bp, Homo sapiens
acagagaaactccta

SEQ ID NO: 161551 - DNA, 15 bp, Homo sapiens
cacagagaaactcct

SEQ ID NO: 161552 - DNA, 15 bp, Homo sapiens
gcacagagaaactcc

SEQ ID NO: 161553 - DNA, 15 bp, Homo sapiens
agcacagagaaactc

SEQ ID NO: 161554 - DNA, 15 bp, Homo sapiens
gagcacagagaaact

SEQ ID NO: 161555 - DNA, 15 bp, Homo sapiens
tgagcacagagaaac

SEQ ID NO: 161556 - DNA, 15 bp, Homo sapiens
atgagcacagagaaa

SEQ ID NO: 161557 - DNA, 15 bp, Homo sapiens
tatgagcacagagaa

SEQ ID NO: 161558 - DNA, 15 bp, Homo sapiens
atatgagcacagaga

SEQ ID NO: 161559 - DNA, 15 bp, Homo sapiens
catatgagcacagag

SEQ ID NO: 161560 - DNA, 15 bp, Homo sapiens
tcatatgagcacaga

SEQ ID NO: 161561 - DNA, 15 bp, Homo sapiens
atcatatgagcacag

SEQ ID NO: 161562 - DNA, 15 bp, Homo sapiens
tatcatatgagcaca

SEQ ID NO: 161563 - DNA, 15 bp, Homo sapiens
gtatcatatgagcac

SEQ ID NO: 161564 - DNA, 15 bp, Homo sapiens
ggtatcatatgagca

SEQ ID NO: 161565 - DNA, 15 bp, Homo sapiens
gggtatcatatgagc

SEQ ID NO: 161566 - DNA, 15 bp, Homo sapiens
agggtatcatatgag

SEQ ID NO: 161567 - DNA, 15 bp, Homo sapiens
aagggtatcatatga

SEQ ID NO: 161568 - DNA, 15 bp, Homo sapiens
aaagggtatcatatg

SEQ ID NO: 161569 - DNA, 15 bp, Homo sapiens
taaagggtatcatat

SEQ ID NO: 161570 - DNA, 15 bp, Homo sapiens
ctaaagggtatcata

SEQ ID NO: 161571 - DNA, 15 bp, Homo sapiens
cctaaagggtatcat

SEQ ID NO: 161572 - DNA, 15 bp, Homo sapiens
tcctaaagggtatca

SEQ ID NO: 161573 - DNA, 15 bp, Homo sapiens
gtcctaaagggtatc

SEQ ID NO: 161574 - DNA, 15 bp, Homo sapiens
agtcctaaagggtat

SEQ ID NO: 161575 - DNA, 15 bp, Homo sapiens
aagtcctaaagggta

SEQ ID NO: 161576 - DNA, 15 bp, Homo sapiens
aaagtcctaaagggt

SEQ ID NO: 161577 - DNA, 15 bp, Homo sapiens
aaaagtcctaaaggg

SEQ ID NO: 161578 - DNA, 15 bp, Homo sapiens
aaaaagtcctaaagg

SEQ ID NO: 161579 - DNA, 15 bp, Homo sapiens
gaaaaagtcctaaag

SEQ ID NO: 161580 - DNA, 15 bp, Homo sapiens
tgaaaaagtcctaaa

SEQ ID NO: 161581 - DNA, 15 bp, Homo sapiens
atgaaaaagtcctaa

SEQ ID NO: 161582 - DNA, 15 bp, Homo sapiens
aatgaaaaagtccta

SEQ ID NO: 161583 - DNA, 15 bp, Homo sapiens
gaatgaaaaagtcct

SEQ ID NO: 161584 - DNA, 15 bp, Homo sapiens
tgaatgaaaaagtcc

SEQ ID NO: 161585 - DNA, 15 bp, Homo sapiens
ctgaatgaaaaagtc

SEQ ID NO: 161586 - DNA, 15 bp, Homo sapiens
actgaatgaaaaagt

SEQ ID NO: 161587 - DNA, 15 bp, Homo sapiens
aactgaatgaaaaag

SEQ ID NO: 161588 - DNA, 15 bp, Homo sapiens
taactgaatgaaaaa

SEQ ID NO: 161589 - DNA, 15 bp, Homo sapiens
ctaactgaatgaaaa

SEQ ID NO: 161590 - DNA, 15 bp, Homo sapiens
actaactgaatgaaa

SEQ ID NO: 161591 - DNA, 15 bp, Homo sapiens
aactaactgaatgaa

SEQ ID NO: 161592 - DNA, 15 bp, Homo sapiens
aaactaactgaatga

SEQ ID NO: 161593 - DNA, 15 bp, Homo sapiens
gaaactaactgaatg

SEQ ID NO: 161594 - DNA, 15 bp, Homo sapiens
agaaactaactgaat

SEQ ID NO: 161595 - DNA, 15 bp, Homo sapiens
cagaaactaactgaa

SEQ ID NO: 161596 - DNA, 15 bp, Homo sapiens
tcagaaactaactga

SEQ ID NO: 161597 - DNA, 15 bp, Homo sapiens
ttcagaaactaactg

SEQ ID NO: 161598 - DNA, 15 bp, Homo sapiens
attcagaaactaact

SEQ ID NO: 161599 - DNA, 15 bp, Homo sapiens
gattcagaaactaac

SEQ ID NO: 161600 - DNA, 15 bp, Homo sapiens
ggattcagaaactaa

SEQ ID NO: 161601 - DNA, 15 bp, Homo sapiens
aggattcagaaacta

SEQ ID NO: 161602 - DNA, 15 bp, Homo sapiens
aaggattcagaaact

SEQ ID NO: 161603 - DNA, 15 bp, Homo sapiens
aaaggattcagaaac

SEQ ID NO: 161604 - DNA, 15 bp, Homo sapiens
taaaggattcagaaa

SEQ ID NO: 161605 - DNA, 15 bp, Homo sapiens
ctaaaggattcagaa

SEQ ID NO: 161606 - DNA, 15 bp, Homo sapiens
gctaaaggattcaga

SEQ ID NO: 161607 - DNA, 15 bp, Homo sapiens
agctaaaggattcag

SEQ ID NO: 161608 - DNA, 15 bp, Homo sapiens
gagctaaaggattca

SEQ ID NO: 161609 - DNA, 15 bp, Homo sapiens
tgagctaaaggattc

SEQ ID NO: 161610 - DNA, 15 bp, Homo sapiens
ttgagctaaaggatt

SEQ ID NO: 161611 - DNA, 15 bp, Homo sapiens
tttgagctaaaggat

SEQ ID NO: 161612 - DNA, 15 bp, Homo sapiens
gtttgagctaaagga

SEQ ID NO: 161613 - DNA, 15 bp, Homo sapiens
ggtttgagctaaagg

SEQ ID NO: 161614 - DNA, 15 bp, Homo sapiens
tggtttgagctaaag

SEQ ID NO: 161615 - DNA, 15 bp, Homo sapiens
ctggtttgagctaaa

SEQ ID NO: 161616 - DNA, 15 bp, Homo sapiens
tctggtttgagctaa

SEQ ID NO: 161617 - DNA, 15 bp, Homo sapiens
ttctggtttgagcta

SEQ ID NO: 161618 - DNA, 15 bp, Homo sapiens
gttctggtttgagct

SEQ ID NO: 161619 - DNA, 15 bp, Homo sapiens
tgttctggtttgagc

SEQ ID NO: 161620 - DNA, 15 bp, Homo sapiens
gtgttctggtttgag

SEQ ID NO: 161621 - DNA, 15 bp, Homo sapiens
agtgttctggtttga

SEQ ID NO: 161622 - DNA, 15 bp, Homo sapiens
gagtgttctggtttg

SEQ ID NO: 161623 - DNA, 15 bp, Homo sapiens
agagtgttctggttt

SEQ ID NO: 161624 - DNA, 15 bp, Homo sapiens
tagagtgttctggtt

SEQ ID NO: 161625 - DNA, 15 bp, Homo sapiens
ttagagtgttctggt

SEQ ID NO: 161626 - DNA, 15 bp, Homo sapiens
cttagagtgttctgg

SEQ ID NO: 161627 - DNA, 15 bp, Homo sapiens
acttagagtgttctg

SEQ ID NO: 161628 - DNA, 15 bp, Homo sapiens
gacttagagtgttct

SEQ ID NO: 161629 - DNA, 15 bp, Homo sapiens
tgacttagagtgttc

SEQ ID NO: 161630 - DNA, 15 bp, Homo sapiens
gtgacttagagtgtt

SEQ ID NO: 161631 - DNA, 15 bp, Homo sapiens
cgtgacttagagtgt

SEQ ID NO: 161632 - DNA, 15 bp, Homo sapiens
gcgtgacttagagtg

SEQ ID NO: 161633 - DNA, 15 bp, Homo sapiens
agcgtgacttagagt

SEQ ID NO: 161634 - DNA, 15 bp, Homo sapiens
aagcgtgacttagag

SEQ ID NO: 161635 - DNA, 15 bp, Homo sapiens
caagcgtgacttaga

SEQ ID NO: 161636 - DNA, 15 bp, Homo sapiens
tcaagcgtgacttag

SEQ ID NO: 161637 - DNA, 15 bp, Homo sapiens
atcaagcgtgactta

SEQ ID NO: 161638 - DNA, 15 bp, Homo sapiens
aatcaagcgtgactt

SEQ ID NO: 161639 - DNA, 15 bp, Homo sapiens
caatcaagcgtgact

SEQ ID NO: 161640 - DNA, 15 bp, Homo sapiens
gcaatcaagcgtgac

SEQ ID NO: 161641 - DNA, 15 bp, Homo sapiens
agcaatcaagcgtga

SEQ ID NO: 161642 - DNA, 15 bp, Homo sapiens
gagcaatcaagcgtg

SEQ ID NO: 161643 - DNA, 15 bp, Homo sapiens
tgagcaatcaagcgt

SEQ ID NO: 161644 - DNA, 15 bp, Homo sapiens
atgagcaatcaagcg

SEQ ID NO: 161645 - DNA, 15 bp, Homo sapiens
aatgagcaatcaagc

SEQ ID NO: 161646 - DNA, 15 bp, Homo sapiens
aaatgagcaatcaag

SEQ ID NO: 161647 - DNA, 15 bp, Homo sapiens
aaaatgagcaatcaa

SEQ ID NO: 161648 - DNA, 15 bp, Homo sapiens
aaaaatgagcaatca

SEQ ID NO: 161649 - DNA, 15 bp, Homo sapiens
aaaaaatgagcaatc

SEQ ID NO: 161650 - DNA, 15 bp, Homo sapiens
gaaaaaatgagcaat

SEQ ID NO: 161651 - DNA, 15 bp, Homo sapiens
tgaaaaaatgagcaa

SEQ ID NO: 161652 - DNA, 15 bp, Homo sapiens
gtgaaaaaatgagca

SEQ ID NO: 161653 - DNA, 15 bp, Homo sapiens
ggtgaaaaaatgagc

SEQ ID NO: 161654 - DNA, 15 bp, Homo sapiens
aggtgaaaaaatgag

SEQ ID NO: 161655 - DNA, 15 bp, Homo sapiens
taggtgaaaaaatga

SEQ ID NO: 161656 - DNA, 15 bp, Homo sapiens
gtaggtgaaaaaatg

SEQ ID NO: 161657 - DNA, 15 bp, Homo sapiens
ggtaggtgaaaaaat

SEQ ID NO: 161658 - DNA, 15 bp, Homo sapiens
gggtaggtgaaaaaa

SEQ ID NO: 161659 - DNA, 15 bp, Homo sapiens
agggtaggtgaaaaa

SEQ ID NO: 161660 - DNA, 15 bp, Homo sapiens
tagggtaggtgaaaa

SEQ ID NO: 161661 - DNA, 15 bp, Homo sapiens
atagggtaggtgaaa

SEQ ID NO: 161662 - DNA, 15 bp, Homo sapiens
catagggtaggtgaa

SEQ ID NO: 161663 - DNA, 15 bp, Homo sapiens
acatagggtaggtga

SEQ ID NO: 161664 - DNA, 15 bp, Homo sapiens
tacatagggtaggtg

SEQ ID NO: 161665 - DNA, 15 bp, Homo sapiens
atacatagggtaggt

SEQ ID NO: 161666 - DNA, 15 bp, Homo sapiens
aatacatagggtagg

SEQ ID NO: 161667 - DNA, 15 bp, Homo sapiens
gaatacatagggtag

SEQ ID NO: 161668 - DNA, 15 bp, Homo sapiens
ggaatacatagggta

SEQ ID NO: 161669 - DNA, 15 bp, Homo sapiens
aggaatacatagggt

SEQ ID NO: 161670 - DNA, 15 bp, Homo sapiens
taggaatacataggg

SEQ ID NO: 161671 - DNA, 15 bp, Homo sapiens
ataggaatacatagg

SEQ ID NO: 161672 - DNA, 15 bp, Homo sapiens
aataggaatacatag

SEQ ID NO: 161673 - DNA, 15 bp, Homo sapiens
aaataggaatacata

SEQ ID NO: 161674 - DNA, 15 bp, Homo sapiens
caaataggaatacat

SEQ ID NO: 161675 - DNA, 15 bp, Homo sapiens
acaaataggaataca

SEQ ID NO: 161676 - DNA, 15 bp, Homo sapiens
aacaaataggaatac

SEQ ID NO: 161677 - DNA, 15 bp, Homo sapiens
caacaaataggaata

SEQ ID NO: 161678 - DNA, 15 bp, Homo sapiens
acaacaaataggaat

SEQ ID NO: 161679 - DNA, 15 bp, Homo sapiens
tacaacaaataggaa

SEQ ID NO: 161680 - DNA, 15 bp, Homo sapiens
gtacaacaaatagga

SEQ ID NO: 161681 - DNA, 15 bp, Homo sapiens
ggtacaacaaatagg

SEQ ID NO: 161682 - DNA, 15 bp, Homo sapiens
aggtacaacaaatag

SEQ ID NO: 161683 - DNA, 15 bp, Homo sapiens
gaggtacaacaaata

SEQ ID NO: 161684 - DNA, 15 bp, Homo sapiens
tgaggtacaacaaat

SEQ ID NO: 161685 - DNA, 15 bp, Homo sapiens
ctgaggtacaacaaa

SEQ ID NO: 161686 - DNA, 15 bp, Homo sapiens
gctgaggtacaacaa

SEQ ID NO: 161687 - DNA, 15 bp, Homo sapiens
agctgaggtacaaca

SEQ ID NO: 161688 - DNA, 15 bp, Homo sapiens
tagctgaggtacaac

SEQ ID NO: 161689 - DNA, 15 bp, Homo sapiens
ctagctgaggtacaa

SEQ ID NO: 161690 - DNA, 15 bp, Homo sapiens
gctagctgaggtaca

SEQ ID NO: 161691 - DNA, 15 bp, Homo sapiens
tgctagctgaggtac

SEQ ID NO: 161692 - DNA, 15 bp, Homo sapiens
gtgctagctgaggta

SEQ ID NO: 161693 - DNA, 15 bp, Homo sapiens
tgtgctagctgaggt

SEQ ID NO: 161694 - DNA, 15 bp, Homo sapiens
atgtgctagctgagg

SEQ ID NO: 161695 - DNA, 15 bp, Homo sapiens
aatgtgctagctgag

SEQ ID NO: 161696 - DNA, 15 bp, Homo sapiens
caatgtgctagctga

SEQ ID NO: 161697 - DNA, 15 bp, Homo sapiens
ccaatgtgctagctg

SEQ ID NO: 161698 - DNA, 15 bp, Homo sapiens
accaatgtgctagct

SEQ ID NO: 161699 - DNA, 15 bp, Homo sapiens
gaccaatgtgctagc

SEQ ID NO: 161700 - DNA, 15 bp, Homo sapiens
agaccaatgtgctag

SEQ ID NO: 161701 - DNA, 15 bp, Homo sapiens
gagaccaatgtgcta

SEQ ID NO: 161702 - DNA, 15 bp, Homo sapiens
agagaccaatgtgct

SEQ ID NO: 161703 - DNA, 15 bp, Homo sapiens
cagagaccaatgtgc

SEQ ID NO: 161704 - DNA, 15 bp, Homo sapiens
gcagagaccaatgtg

SEQ ID NO: 161705 - DNA, 15 bp, Homo sapiens
ggcagagaccaatgt

SEQ ID NO: 161706 - DNA, 15 bp, Homo sapiens
aggcagagaccaatg

SEQ ID NO: 161707 - DNA, 15 bp, Homo sapiens
gaggcagagaccaat

SEQ ID NO: 161708 - DNA, 15 bp, Homo sapiens
ggaggcagagaccaa

SEQ ID NO: 161709 - DNA, 15 bp, Homo sapiens
tggaggcagagacca

SEQ ID NO: 161710 - DNA, 15 bp, Homo sapiens
ttggaggcagagacc

SEQ ID NO: 161711 - DNA, 15 bp, Homo sapiens
tttggaggcagagac

SEQ ID NO: 161712 - DNA, 15 bp, Homo sapiens
ctttggaggcagaga

SEQ ID NO: 161713 - DNA, 15 bp, Homo sapiens
actttggaggcagag

SEQ ID NO: 161714 - DNA, 15 bp, Homo sapiens
tactttggaggcaga

SEQ ID NO: 161715 - DNA, 15 bp, Homo sapiens
atactttggaggcag

SEQ ID NO: 161716 - DNA, 15 bp, Homo sapiens
tatactttggaggca

SEQ ID NO: 161717 - DNA, 15 bp, Homo sapiens
atatactttggaggc

SEQ ID NO: 161718 - DNA, 15 bp, Homo sapiens
aatatactttggagg

SEQ ID NO: 161719 - DNA, 15 bp, Homo sapiens
gaatatactttggag

SEQ ID NO: 161720 - DNA, 15 bp, Homo sapiens
agaatatactttgga

SEQ ID NO: 161721 - DNA, 15 bp, Homo sapiens
aagaatatactttgg

SEQ ID NO: 161722 - DNA, 15 bp, Homo sapiens
taagaatatactttg

SEQ ID NO: 161723 - DNA, 15 bp, Homo sapiens
ttaagaatatacttt

SEQ ID NO: 161724 - DNA, 15 bp, Homo sapiens
attaagaatatactt

SEQ ID NO: 161725 - DNA, 15 bp, Homo sapiens
gattaagaatatact

SEQ ID NO: 161726 - DNA, 15 bp, Homo sapiens
tgattaagaatatac

SEQ ID NO: 161727 - DNA, 15 bp, Homo sapiens
atgattaagaatata

SEQ ID NO: 161728 - DNA, 15 bp, Homo sapiens
gatgattaagaatat

SEQ ID NO: 161729 - DNA, 15 bp, Homo sapiens
agatgattaagaata

SEQ ID NO: 161730 - DNA, 15 bp, Homo sapiens
cagatgattaagaat

SEQ ID NO: 161731 - DNA, 15 bp, Homo sapiens
acagatgattaagaa

SEQ ID NO: 161732 - DNA, 15 bp, Homo sapiens
gacagatgattaaga

SEQ ID NO: 161733 - DNA, 15 bp, Homo sapiens
agacagatgattaag

SEQ ID NO: 161734 - DNA, 15 bp, Homo sapiens
gagacagatgattaa

SEQ ID NO: 161735 - DNA, 15 bp, Homo sapiens
agagacagatgatta

SEQ ID NO: 161736 - DNA, 15 bp, Homo sapiens
gagagacagatgatt

SEQ ID NO: 161737 - DNA, 15 bp, Homo sapiens
agagagacagatgat

SEQ ID NO: 161738 - DNA, 15 bp, Homo sapiens
aagagagacagatga

SEQ ID NO: 161739 - DNA, 15 bp, Homo sapiens
gaagagagacagatg

SEQ ID NO: 161740 - DNA, 15 bp, Homo sapiens
tgaagagagacagat

SEQ ID NO: 161741 - DNA, 15 bp, Homo sapiens
atgaagagagacaga

SEQ ID NO: 161742 - DNA, 15 bp, Homo sapiens
aatgaagagagacag

SEQ ID NO: 161743 - DNA, 15 bp, Homo sapiens
aaatgaagagagaca

SEQ ID NO: 161744 - DNA, 15 bp, Homo sapiens
aaaatgaagagagac

SEQ ID NO: 161745 - DNA, 15 bp, Homo sapiens
gaaaatgaagagaga

SEQ ID NO: 161746 - DNA, 15 bp, Homo sapiens
tgaaaatgaagagag

SEQ ID NO: 161747 - DNA, 15 bp, Homo sapiens
atgaaaatgaagaga

SEQ ID NO: 161748 - DNA, 15 bp, Homo sapiens
catgaaaatgaagag

SEQ ID NO: 161749 - DNA, 15 bp, Homo sapiens
ccatgaaaatgaaga

SEQ ID NO: 161750 - DNA, 15 bp, Homo sapiens
accatgaaaatgaag

SEQ ID NO: 161751 - DNA, 15 bp, Homo sapiens
aaccatgaaaatgaa

SEQ ID NO: 161752 - DNA, 15 bp, Homo sapiens
taaccatgaaaatga

SEQ ID NO: 161753 - DNA, 15 bp, Homo sapiens
ttaaccatgaaaatg

SEQ ID NO: 161754 - DNA, 15 bp, Homo sapiens
attaaccatgaaaat

SEQ ID NO: 161755 - DNA, 15 bp, Homo sapiens
gattaaccatgaaaa

SEQ ID NO: 161756 - DNA, 15 bp, Homo sapiens
ggattaaccatgaaa

SEQ ID NO: 161757 - DNA, 15 bp, Homo sapiens
tggattaaccatgaa

SEQ ID NO: 161758 - DNA, 15 bp, Homo sapiens
atggattaaccatga

SEQ ID NO: 161759 - DNA, 15 bp, Homo sapiens
gatggattaaccatg

SEQ ID NO: 161760 - DNA, 15 bp, Homo sapiens
tgatggattaaccat

SEQ ID NO: 161761 - DNA, 15 bp, Homo sapiens
ttgatggattaacca

SEQ ID NO: 161762 - DNA, 15 bp, Homo sapiens
tttgatggattaacc

SEQ ID NO: 161763 - DNA, 15 bp, Homo sapiens
ctttgatggattaac

SEQ ID NO: 161764 - DNA, 15 bp, Homo sapiens
gctttgatggattaa

SEQ ID NO: 161765 - DNA, 15 bp, Homo sapiens
ggctttgatggatta

SEQ ID NO: 161766 - DNA, 15 bp, Homo sapiens
tggctttgatggatt

SEQ ID NO: 161767 - DNA, 15 bp, Homo sapiens
atggctttgatggat

SEQ ID NO: 161768 - DNA, 15 bp, Homo sapiens
catggctttgatgga

SEQ ID NO: 161769 - DNA, 15 bp, Homo sapiens
gcatggctttgatgg

SEQ ID NO: 161770 - DNA, 15 bp, Homo sapiens
ggcatggctttgatg

SEQ ID NO: 161771 - DNA, 15 bp, Homo sapiens
tggcatggctttgat

SEQ ID NO: 161772 - DNA, 15 bp, Homo sapiens
atggcatggctttga

SEQ ID NO: 161773 - DNA, 15 bp, Homo sapiens
aatggcatggctttg

SEQ ID NO: 161774 - DNA, 15 bp, Homo sapiens
aaatggcatggcttt

SEQ ID NO: 161775 - DNA, 15 bp, Homo sapiens
aaaatggcatggctt

SEQ ID NO: 161776 - DNA, 15 bp, Homo sapiens
taaaatggcatggct

SEQ ID NO: 161777 - DNA, 15 bp, Homo sapiens
ataaaatggcatggc

SEQ ID NO: 161778 - DNA, 15 bp, Homo sapiens
gataaaatggcatgg

SEQ ID NO: 161779 - DNA, 15 bp, Homo sapiens
ggataaaatggcatg

SEQ ID NO: 161780 - DNA, 15 bp, Homo sapiens
tggataaaatggcat

SEQ ID NO: 161781 - DNA, 15 bp, Homo sapiens
ctggataaaatggca

SEQ ID NO: 161782 - DNA, 15 bp, Homo sapiens
tctggataaaatggc

SEQ ID NO: 161783 - DNA, 15 bp, Homo sapiens
gtctggataaaatgg

SEQ ID NO: 161784 - DNA, 15 bp, Homo sapiens
tgtctggataaaatg

SEQ ID NO: 161785 - DNA, 15 bp, Homo sapiens
ttgtctggataaaat

SEQ ID NO: 161786 - DNA, 15 bp, Homo sapiens
tttgtctggataaaa

SEQ ID NO: 161787 - DNA, 15 bp, Homo sapiens
atttgtctggataaa

SEQ ID NO: 161788 - DNA, 15 bp, Homo sapiens
catttgtctggataa

SEQ ID NO: 161789 - DNA, 15 bp, Homo sapiens
ccatttgtctggata

SEQ ID NO: 161790 - DNA, 15 bp, Homo sapiens
tccatttgtctggat

SEQ ID NO: 161791 - DNA, 15 bp, Homo sapiens
ctccatttgtctgga

SEQ ID NO: 161792 - DNA, 15 bp, Homo sapiens
actccatttgtctgg

SEQ ID NO: 161793 - DNA, 15 bp, Homo sapiens
tactccatttgtctg

SEQ ID NO: 161794 - DNA, 15 bp, Homo sapiens
ctactccatttgtct

SEQ ID NO: 161795 - DNA, 15 bp, Homo sapiens
gctactccatttgtc

SEQ ID NO: 161796 - DNA, 15 bp, Homo sapiens
ggctactccatttgt

SEQ ID NO: 161797 - DNA, 15 bp, Homo sapiens
tggctactccatttg

SEQ ID NO: 161798 - DNA, 15 bp, Homo sapiens
atggctactccattt

SEQ ID NO: 161799 - DNA, 15 bp, Homo sapiens
gatggctactccatt

SEQ ID NO: 161800 - DNA, 15 bp, Homo sapiens
agatggctactccat

SEQ ID NO: 161801 - DNA, 15 bp, Homo sapiens
tagatggctactcca

SEQ ID NO: 161802 - DNA, 15 bp, Homo sapiens
ttagatggctactcc

SEQ ID NO: 161803 - DNA, 15 bp, Homo sapiens
cttagatggctactc

SEQ ID NO: 161804 - DNA, 15 bp, Homo sapiens
acttagatggctact

SEQ ID NO: 161805 - DNA, 15 bp, Homo sapiens
cacttagatggctac

SEQ ID NO: 161806 - DNA, 15 bp, Homo sapiens
acacttagatggcta

SEQ ID NO: 161807 - DNA, 15 bp, Homo sapiens
aacacttagatggct

SEQ ID NO: 161808 - DNA, 15 bp, Homo sapiens
caacacttagatggc

SEQ ID NO: 161809 - DNA, 15 bp, Homo sapiens
acaacacttagatgg

SEQ ID NO: 161810 - DNA, 15 bp, Homo sapiens
aacaacacttagatg

SEQ ID NO: 161811 - DNA, 15 bp, Homo sapiens
aaacaacacttagat

SEQ ID NO: 161812 - DNA, 15 bp, Homo sapiens
aaaacaacacttaga

SEQ ID NO: 161813 - DNA, 15 bp, Homo sapiens
aaaaacaacacttag

SEQ ID NO: 161814 - DNA, 15 bp, Homo sapiens
caaaaacaacactta

SEQ ID NO: 161815 - DNA, 15 bp, Homo sapiens
gcaaaaacaacactt

SEQ ID NO: 161816 - DNA, 15 bp, Homo sapiens
agcaaaaacaacact

SEQ ID NO: 161817 - DNA, 15 bp, Homo sapiens
aagcaaaaacaacac

SEQ ID NO: 161818 - DNA, 15 bp, Homo sapiens
gaagcaaaaacaaca

SEQ ID NO: 161819 - DNA, 15 bp, Homo sapiens
agaagcaaaaacaac

SEQ ID NO: 161820 - DNA, 15 bp, Homo sapiens
tagaagcaaaaacaa

SEQ ID NO: 161821 - DNA, 15 bp, Homo sapiens
ctagaagcaaaaaca

SEQ ID NO: 161822 - DNA, 15 bp, Homo sapiens
actagaagcaaaaac

SEQ ID NO: 161823 - DNA, 15 bp, Homo sapiens
tactagaagcaaaaa

SEQ ID NO: 161824 - DNA, 15 bp, Homo sapiens
atactagaagcaaaa

SEQ ID NO: 161825 - DNA, 15 bp, Homo sapiens
aatactagaagcaaa

SEQ ID NO: 161826 - DNA, 15 bp, Homo sapiens
aaatactagaagcaa

SEQ ID NO: 161827 - DNA, 15 bp, Homo sapiens
caaatactagaagca

SEQ ID NO: 161828 - DNA, 15 bp, Homo sapiens
tcaaatactagaagc

SEQ ID NO: 161829 - DNA, 15 bp, Homo sapiens
ttcaaatactagaag

SEQ ID NO: 161830 - DNA, 15 bp, Homo sapiens
cttcaaatactagaa

SEQ ID NO: 161831 - DNA, 15 bp, Homo sapiens
gcttcaaatactaga

SEQ ID NO: 161832 - DNA, 15 bp, Homo sapiens
tgcttcaaatactag

SEQ ID NO: 161833 - DNA, 15 bp, Homo sapiens
ttgcttcaaatacta

SEQ ID NO: 161834 - DNA, 15 bp, Homo sapiens
tttgcttcaaatact

SEQ ID NO: 161835 - DNA, 15 bp, Homo sapiens
atttgcttcaaatac

SEQ ID NO: 161836 - DNA, 15 bp, Homo sapiens
tatttgcttcaaata

SEQ ID NO: 161837 - DNA, 15 bp, Homo sapiens
gtatttgcttcaaat

SEQ ID NO: 161838 - DNA, 15 bp, Homo sapiens
tgtatttgcttcaaa

SEQ ID NO: 161839 - DNA, 15 bp, Homo sapiens
atgtatttgcttcaa

SEQ ID NO: 161840 - DNA, 15 bp, Homo sapiens
tatgtatttgcttca

SEQ ID NO: 161841 - DNA, 15 bp, Homo sapiens
ttatgtatttgcttc

SEQ ID NO: 161842 - DNA, 15 bp, Homo sapiens
gttatgtatttgctt

SEQ ID NO: 161843 - DNA, 15 bp, Homo sapiens
tgttatgtatttgct

SEQ ID NO: 161844 - DNA, 15 bp, Homo sapiens
atgttatgtatttgc

SEQ ID NO: 161845 - DNA, 15 bp, Homo sapiens
tatgttatgtatttg

SEQ ID NO: 161846 - DNA, 15 bp, Homo sapiens
ttatgttatgtattt

SEQ ID NO: 161847 - DNA, 15 bp, Homo sapiens
cttatgttatgtatt

SEQ ID NO: 161848 - DNA, 15 bp, Homo sapiens
acttatgttatgtat

SEQ ID NO: 161849 - DNA, 15 bp, Homo sapiens
aacttatgttatgta

SEQ ID NO: 161850 - DNA, 15 bp, Homo sapiens
taacttatgttatgt

SEQ ID NO: 161851 - DNA, 15 bp, Homo sapiens
ataacttatgttatg

SEQ ID NO: 161852 - DNA, 15 bp, Homo sapiens
cataacttatgttat

SEQ ID NO: 161853 - DNA, 15 bp, Homo sapiens
ccataacttatgtta

SEQ ID NO: 161854 - DNA, 15 bp, Homo sapiens
tccataacttatgtt

SEQ ID NO: 161855 - DNA, 15 bp, Homo sapiens
ttccataacttatgt

SEQ ID NO: 161856 - DNA, 15 bp, Homo sapiens
cttccataacttatg

SEQ ID NO: 161857 - DNA, 15 bp, Homo sapiens
gcttccataacttat

SEQ ID NO: 161858 - DNA, 15 bp, Homo sapiens
tgcttccataactta

SEQ ID NO: 161859 - DNA, 15 bp, Homo sapiens
ttgcttccataactt

SEQ ID NO: 161860 - DNA, 15 bp, Homo sapiens
tttgcttccataact

SEQ ID NO: 161861 - DNA, 15 bp, Homo sapiens
atttgcttccataac

SEQ ID NO: 161862 - DNA, 15 bp, Homo sapiens
tatttgcttccataa

SEQ ID NO: 161863 - DNA, 15 bp, Homo sapiens
gtatttgcttccata

SEQ ID NO: 161864 - DNA, 15 bp, Homo sapiens
tgtatttgcttccat

SEQ ID NO: 161865 - DNA, 15 bp, Homo sapiens
atgtatttgcttcca

SEQ ID NO: 161866 - DNA, 15 bp, Homo sapiens
tatgtatttgcttcc

SEQ ID NO: 161867 - DNA, 15 bp, Homo sapiens
catgttatgtatttg

SEQ ID NO: 161868 - DNA, 15 bp, Homo sapiens
tcatgttatgtattt

SEQ ID NO: 161869 - DNA, 15 bp, Homo sapiens
gtcatgttatgtatt

SEQ ID NO: 161870 - DNA, 15 bp, Homo sapiens
tgtcatgttatgtat

SEQ ID NO: 161871 - DNA, 15 bp, Homo sapiens
atgtcatgttatgta

SEQ ID NO: 161872 - DNA, 15 bp, Homo sapiens
tatgtcatgttatgt

SEQ ID NO: 161873 - DNA, 15 bp, Homo sapiens
ttatgtcatgttatg

SEQ ID NO: 161874 - DNA, 15 bp, Homo sapiens
tttatgtcatgttat

SEQ ID NO: 161875 - DNA, 15 bp, Homo sapiens
gtttatgtcatgtta

SEQ ID NO: 161876 - DNA, 15 bp, Homo sapiens
ggtttatgtcatgtt

SEQ ID NO: 161877 - DNA, 15 bp, Homo sapiens
tggtttatgtcatgt

SEQ ID NO: 161878 - DNA, 15 bp, Homo sapiens
ttggtttatgtcatg

SEQ ID NO: 161879 - DNA, 15 bp, Homo sapiens
cttggtttatgtcat

SEQ ID NO: 161880 - DNA, 15 bp, Homo sapiens
acttggtttatgtca

SEQ ID NO: 161881 - DNA, 15 bp, Homo sapiens
gacttggtttatgtc

SEQ ID NO: 161882 - DNA, 15 bp, Homo sapiens
tgacttggtttatgt

SEQ ID NO: 161883 - DNA, 15 bp, Homo sapiens
atgacttggtttatg

SEQ ID NO: 161884 - DNA, 15 bp, Homo sapiens
catgacttggtttat

SEQ ID NO: 161885 - DNA, 15 bp, Homo sapiens
acatgacttggttta

SEQ ID NO: 161886 - DNA, 15 bp, Homo sapiens
gacatgacttggttt

SEQ ID NO: 161887 - DNA, 15 bp, Homo sapiens
tgacatgacttggtt

SEQ ID NO: 161888 - DNA, 15 bp, Homo sapiens
ctgacatgacttggt

SEQ ID NO: 161889 - DNA, 15 bp, Homo sapiens
actgacatgacttgg

SEQ ID NO: 161890 - DNA, 15 bp, Homo sapiens
aactgacatgacttg

SEQ ID NO: 161891 - DNA, 15 bp, Homo sapiens
gaactgacatgactt

SEQ ID NO: 161892 - DNA, 15 bp, Homo sapiens
agaactgacatgact

SEQ ID NO: 161893 - DNA, 15 bp, Homo sapiens
gagaactgacatgac

SEQ ID NO: 161894 - DNA, 15 bp, Homo sapiens
agagaactgacatga

SEQ ID NO: 161895 - DNA, 15 bp, Homo sapiens
cagagaactgacatg

SEQ ID NO: 161896 - DNA, 15 bp, Homo sapiens
gcagagaactgacat

SEQ ID NO: 161897 - DNA, 15 bp, Homo sapiens
agcagagaactgaca

SEQ ID NO: 161898 - DNA, 15 bp, Homo sapiens
aagcagagaactgac

SEQ ID NO: 161899 - DNA, 15 bp, Homo sapiens
caagcagagaactga

SEQ ID NO: 161900 - DNA, 15 bp, Homo sapiens
tcaagcagagaactg

SEQ ID NO: 161901 - DNA, 15 bp, Homo sapiens
ttcaagcagagaact

SEQ ID NO: 161902 - DNA, 15 bp, Homo sapiens
tttcaagcagagaac

SEQ ID NO: 161903 - DNA, 15 bp, Homo sapiens
gtttcaagcagagaa

SEQ ID NO: 161904 - DNA, 15 bp, Homo sapiens
tgtttcaagcagaga

SEQ ID NO: 161905 - DNA, 15 bp, Homo sapiens
ttgtttcaagcagag

SEQ ID NO: 161906 - DNA, 15 bp, Homo sapiens
gttgtttcaagcaga

SEQ ID NO: 161907 - DNA, 15 bp, Homo sapiens
ggttgtttcaagcag

SEQ ID NO: 161908 - DNA, 15 bp, Homo sapiens
gggttgtttcaagca

SEQ ID NO: 161909 - DNA, 15 bp, Homo sapiens
tgggttgtttcaagc

SEQ ID NO: 161910 - DNA, 15 bp, Homo sapiens
ttgggttgtttcaag

SEQ ID NO: 161911 - DNA, 15 bp, Homo sapiens
tttgggttgtttcaa

SEQ ID NO: 161912 - DNA, 15 bp, Homo sapiens
ctttgggttgtttca

SEQ ID NO: 161913 - DNA, 15 bp, Homo sapiens
cctttgggttgtttc

SEQ ID NO: 161914 - DNA, 15 bp, Homo sapiens
gcctttgggttgttt

SEQ ID NO: 161915 - DNA, 15 bp, Homo sapiens
agcctttgggttgtt

SEQ ID NO: 161916 - DNA, 15 bp, Homo sapiens
gagcctttgggttgt

SEQ ID NO: 161917 - DNA, 15 bp, Homo sapiens
ggagcctttgggttg

SEQ ID NO: 161918 - DNA, 15 bp, Homo sapiens
gggagcctttgggtt

SEQ ID NO: 161919 - DNA, 15 bp, Homo sapiens
tgggagcctttgggt

SEQ ID NO: 161920 - DNA, 15 bp, Homo sapiens
atgggagcctttggg

SEQ ID NO: 161921 - DNA, 15 bp, Homo sapiens
aatgggagcctttgg

SEQ ID NO: 161922 - DNA, 15 bp, Homo sapiens
taatgggagcctttg

SEQ ID NO: 161923 - DNA, 15 bp, Homo sapiens
gtaatgggagccttt

SEQ ID NO: 161924 - DNA, 15 bp, Homo sapiens
tgtaatgggagcctt

SEQ ID NO: 161925 - DNA, 15 bp, Homo sapiens
gtgtaatgggagcct

SEQ ID NO: 161926 - DNA, 15 bp, Homo sapiens
agtgtaatgggagcc

SEQ ID NO: 161927 - DNA, 15 bp, Homo sapiens
aagtgtaatgggagc

SEQ ID NO: 161928 - DNA, 15 bp, Homo sapiens
taagtgtaatgggag

SEQ ID NO: 161929 - DNA, 15 bp, Homo sapiens
ataagtgtaatggga

SEQ ID NO: 161930 - DNA, 15 bp, Homo sapiens
tataagtgtaatggg

SEQ ID NO: 161931 - DNA, 15 bp, Homo sapiens
ttataagtgtaatgg

SEQ ID NO: 161932 - DNA, 15 bp, Homo sapiens
attataagtgtaatg

SEQ ID NO: 161933 - DNA, 15 bp, Homo sapiens
tattataagtgtaat

SEQ ID NO: 161934 - DNA, 15 bp, Homo sapiens
ttattataagtgtaa

SEQ ID NO: 161935 - DNA, 15 bp, Homo sapiens
tttattataagtgta

SEQ ID NO: 161936 - DNA, 15 bp, Homo sapiens
ttttattataagtgt

SEQ ID NO: 161937 - DNA, 15 bp, Homo sapiens
attttattataagtg

SEQ ID NO: 161938 - DNA, 15 bp, Homo sapiens
gattttattataagt

SEQ ID NO: 161939 - DNA, 15 bp, Homo sapiens
agattttattataag

SEQ ID NO: 161940 - DNA, 15 bp, Homo sapiens
tagattttattataa

SEQ ID NO: 161941 - DNA, 15 bp, Homo sapiens
ttagattttattata

SEQ ID NO: 161942 - DNA, 15 bp, Homo sapiens
tttagattttattat

SEQ ID NO: 161943 - DNA, 15 bp, Homo sapiens
gtttagattttatta

SEQ ID NO: 161944 - DNA, 15 bp, Homo sapiens
ggtttagattttatt

SEQ ID NO: 161945 - DNA, 15 bp, Homo sapiens
gggtttagattttat

SEQ ID NO: 161946 - DNA, 15 bp, Homo sapiens
ggggtttagatttta

SEQ ID NO: 161947 - DNA, 15 bp, Homo sapiens
aggggtttagatttt

SEQ ID NO: 161948 - DNA, 15 bp, Homo sapiens
aaggggtttagattt

SEQ ID NO: 161949 - DNA, 15 bp, Homo sapiens
taaggggtttagatt

SEQ ID NO: 161950 - DNA, 15 bp, Homo sapiens
gtaaggggtttagat

SEQ ID NO: 161951 - DNA, 15 bp, Homo sapiens
cgtaaggggtttaga

SEQ ID NO: 161952 - DNA, 15 bp, Homo sapiens
gcgtaaggggtttag

SEQ ID NO: 161953 - DNA, 15 bp, Homo sapiens
agcgtaaggggttta

SEQ ID NO: 161954 - DNA, 15 bp, Homo sapiens
cagcgtaaggggttt

SEQ ID NO: 161955 - DNA, 15 bp, Homo sapiens
gcagcgtaaggggtt

SEQ ID NO: 161956 - DNA, 15 bp, Homo sapiens
ggcagcgtaaggggt

SEQ ID NO: 161957 - DNA, 15 bp, Homo sapiens
gggcagcgtaagggg

SEQ ID NO: 161958 - DNA, 15 bp, Homo sapiens
agggcagcgtaaggg

SEQ ID NO: 161959 - DNA, 15 bp, Homo sapiens
tagggcagcgtaagg

SEQ ID NO: 161960 - DNA, 15 bp, Homo sapiens
gtagggcagcgtaag

SEQ ID NO: 161961 - DNA, 15 bp, Homo sapiens
ggtagggcagcgtaa

SEQ ID NO: 161962 - DNA, 15 bp, Homo sapiens
tggtagggcagcgta

SEQ ID NO: 161963 - DNA, 15 bp, Homo sapiens
ctggtagggcagcgt

SEQ ID NO: 161964 - DNA, 15 bp, Homo sapiens
cctggtagggcagcg

SEQ ID NO: 161965 - DNA, 15 bp, Homo sapiens
acctggtagggcagc

SEQ ID NO: 161966 - DNA, 15 bp, Homo sapiens
gacctggtagggcag

SEQ ID NO: 161967 - DNA, 15 bp, Homo sapiens
ggacctggtagggca

SEQ ID NO: 161968 - DNA, 15 bp, Homo sapiens
aggacctggtagggc

SEQ ID NO: 161969 - DNA, 15 bp, Homo sapiens
taggacctggtaggg

SEQ ID NO: 161970 - DNA, 15 bp, Homo sapiens
gtaggacctggtagg

SEQ ID NO: 161971 - DNA, 15 bp, Homo sapiens
tgtaggacctggtag

SEQ ID NO: 161972 - DNA, 15 bp, Homo sapiens
atgtaggacctggta

SEQ ID NO: 161973 - DNA, 15 bp, Homo sapiens
catgtaggacctggt

SEQ ID NO: 161974 - DNA, 15 bp, Homo sapiens
tcatgtaggacctgg

SEQ ID NO: 161975 - DNA, 15 bp, Homo sapiens
atcatgtaggacctg

SEQ ID NO: 161976 - DNA, 15 bp, Homo sapiens
gatcatgtaggacct

SEQ ID NO: 161977 - DNA, 15 bp, Homo sapiens
tgatcatgtaggacc

SEQ ID NO: 161978 - DNA, 15 bp, Homo sapiens
ctgatcatgtaggac

SEQ ID NO: 161979 - DNA, 15 bp, Homo sapiens
cctgatcatgtagga

SEQ ID NO: 161980 - DNA, 15 bp, Homo sapiens
gcctgatcatgtagg

SEQ ID NO: 161981 - DNA, 15 bp, Homo sapiens
tgcctgatcatgtag

SEQ ID NO: 161982 - DNA, 15 bp, Homo sapiens
ctgcctgatcatgta

SEQ ID NO: 161983 - DNA, 15 bp, Homo sapiens
cctgcctgatcatgt

SEQ ID NO: 161984 - DNA, 15 bp, Homo sapiens
ccctgcctgatcatg

SEQ ID NO: 161985 - DNA, 15 bp, Homo sapiens
gccctgcctgatcat

SEQ ID NO: 161986 - DNA, 15 bp, Homo sapiens
ggccctgcctgatca

SEQ ID NO: 161987 - DNA, 15 bp, Homo sapiens
tggccctgcctgatc

SEQ ID NO: 161988 - DNA, 15 bp, Homo sapiens
atggccctgcctgat

SEQ ID NO: 161989 - DNA, 15 bp, Homo sapiens
aatggccctgcctga

SEQ ID NO: 161990 - DNA, 15 bp, Homo sapiens
aaatggccctgcctg

SEQ ID NO: 161991 - DNA, 15 bp, Homo sapiens
caaatggccctgcct

SEQ ID NO: 161992 - DNA, 15 bp, Homo sapiens
acaaatggccctgcc

SEQ ID NO: 161993 - DNA, 15 bp, Homo sapiens
gacaaatggccctgc

SEQ ID NO: 161994 - DNA, 15 bp, Homo sapiens
agacaaatggccctg

SEQ ID NO: 161995 - DNA, 15 bp, Homo sapiens
gagacaaatggccct

SEQ ID NO: 161996 - DNA, 15 bp, Homo sapiens
agagacaaatggccc

SEQ ID NO: 161997 - DNA, 15 bp, Homo sapiens
gagagacaaatggcc

SEQ ID NO: 161998 - DNA, 15 bp, Homo sapiens
agagagacaaatggc

SEQ ID NO: 161999 - DNA, 15 bp, Homo sapiens
cagagagacaaatgg

SEQ ID NO: 162000 - DNA, 15 bp, Homo sapiens
tcagagagacaaatg

SEQ ID NO: 162001 - DNA, 15 bp, Homo sapiens
gtcagagagacaaat

SEQ ID NO: 162002 - DNA, 15 bp, Homo sapiens
tgtcagagagacaaa

SEQ ID NO: 162003 - DNA, 15 bp, Homo sapiens
atgtcagagagacaa

SEQ ID NO: 162004 - DNA, 15 bp, Homo sapiens
aatgtcagagagaca

SEQ ID NO: 162005 - DNA, 15 bp, Homo sapiens
aaatgtcagagagac

SEQ ID NO: 162006 - DNA, 15 bp, Homo sapiens
aaaatgtcagagaga

SEQ ID NO: 162007 - DNA, 15 bp, Homo sapiens
taaaatgtcagagag

SEQ ID NO: 162008 - DNA, 15 bp, Homo sapiens
ttttaaaatgtcaga

SEQ ID NO: 162009 - DNA, 15 bp, Homo sapiens
tttttaaaatgtcag

SEQ ID NO: 162010 - DNA, 15 bp, Homo sapiens
atttttaaaatgtca

SEQ ID NO: 162011 - DNA, 15 bp, Homo sapiens
aatttttaaaatgtc

SEQ ID NO: 162012 - DNA, 15 bp, Homo sapiens
aaatttttaaaatgt

SEQ ID NO: 162013 - DNA, 15 bp, Homo sapiens
aaaatttttaaaatg

SEQ ID NO: 162014 - DNA, 15 bp, Homo sapiens
aaaaatttttaaaat

SEQ ID NO: 162015 - DNA, 15 bp, Homo sapiens
ttaaaaatttttaaa

SEQ ID NO: 162016 - DNA, 15 bp, Homo sapiens
gttaaaaatttttaa

SEQ ID NO: 162017 - DNA, 15 bp, Homo sapiens
ggttaaaaattttta

SEQ ID NO: 162018 - DNA, 15 bp, Homo sapiens
tggttaaaaattttt

SEQ ID NO: 162019 - DNA, 15 bp, Homo sapiens
atggttaaaaatttt

SEQ ID NO: 162020 - DNA, 15 bp, Homo sapiens
gatggttaaaaattt

SEQ ID NO: 162021 - DNA, 15 bp, Homo sapiens
tgatggttaaaaatt

SEQ ID NO: 162022 - DNA, 15 bp, Homo sapiens
gtgatggttaaaaat

SEQ ID NO: 162023 - DNA, 15 bp, Homo sapiens
agtgatggttaaaaa

SEQ ID NO: 162024 - DNA, 15 bp, Homo sapiens
gagtgatggttaaaa

SEQ ID NO: 162025 - DNA, 15 bp, Homo sapiens
ggagtgatggttaaa

SEQ ID NO: 162026 - DNA, 15 bp, Homo sapiens
aggagtgatggttaa

SEQ ID NO: 162027 - DNA, 15 bp, Homo sapiens
caggagtgatggtta

SEQ ID NO: 162028 - DNA, 15 bp, Homo sapiens
acaggagtgatggtt

SEQ ID NO: 162029 - DNA, 15 bp, Homo sapiens
gacaggagtgatggt

SEQ ID NO: 162030 - DNA, 15 bp, Homo sapiens
ggacaggagtgatgg

SEQ ID NO: 162031 - DNA, 15 bp, Homo sapiens
gggacaggagtgatg

SEQ ID NO: 162032 - DNA, 15 bp, Homo sapiens
ggggacaggagtgat

SEQ ID NO: 162033 - DNA, 15 bp, Homo sapiens
aggggacaggagtga

SEQ ID NO: 162034 - DNA, 15 bp, Homo sapiens
caggggacaggagtg

SEQ ID NO: 162035 - DNA, 15 bp, Homo sapiens
ccaggggacaggagt

SEQ ID NO: 162036 - DNA, 15 bp, Homo sapiens
gccaggggacaggag

SEQ ID NO: 162037 - DNA, 15 bp, Homo sapiens
ggccaggggacagga

SEQ ID NO: 162038 - DNA, 15 bp, Homo sapiens
gggccaggggacagg

SEQ ID NO: 162039 - DNA, 15 bp, Homo sapiens
tgggccaggggacag

SEQ ID NO: 162040 - DNA, 15 bp, Homo sapiens
gtgggccaggggaca

SEQ ID NO: 162041 - DNA, 15 bp, Homo sapiens
agtgggccaggggac

SEQ ID NO: 162042 - DNA, 15 bp, Homo sapiens
cagtgggccagggga

SEQ ID NO: 162043 - DNA, 15 bp, Homo sapiens
acagtgggccagggg

SEQ ID NO: 162044 - DNA, 15 bp, Homo sapiens
tacagtgggccaggg

SEQ ID NO: 162045 - DNA, 15 bp, Homo sapiens
atacagtgggccagg

SEQ ID NO: 162046 - DNA, 15 bp, Homo sapiens
aatacagtgggccag

SEQ ID NO: 162047 - DNA, 15 bp, Homo sapiens
aaatacagtgggcca

SEQ ID NO: 162048 - DNA, 15 bp, Homo sapiens
caaatacagtgggcc

SEQ ID NO: 162049 - DNA, 15 bp, Homo sapiens
ccaaatacagtgggc

SEQ ID NO: 162050 - DNA, 15 bp, Homo sapiens
gccaaatacagtggg

SEQ ID NO: 162051 - DNA, 15 bp, Homo sapiens
agccaaatacagtgg

SEQ ID NO: 162052 - DNA, 15 bp, Homo sapiens
gagccaaatacagtg

SEQ ID NO: 162053 - DNA, 15 bp, Homo sapiens
agagccaaatacagt

SEQ ID NO: 162054 - DNA, 15 bp, Homo sapiens
aagagccaaatacag

SEQ ID NO: 162055 - DNA, 15 bp, Homo sapiens
aaagagccaaataca

SEQ ID NO: 162056 - DNA, 15 bp, Homo sapiens
aaaagagccaaatac

SEQ ID NO: 162057 - DNA, 15 bp, Homo sapiens
gaaaagagccaaata

SEQ ID NO: 162058 - DNA, 15 bp, Homo sapiens
agaaaagagccaaat

SEQ ID NO: 162059 - DNA, 15 bp, Homo sapiens
gagaaaagagccaaa

SEQ ID NO: 162060 - DNA, 15 bp, Homo sapiens
agagaaaagagccaa

SEQ ID NO: 162061 - DNA, 15 bp, Homo sapiens
aagagaaaagagcca

SEQ ID NO: 162062 - DNA, 15 bp, Homo sapiens
gaagagaaaagagcc

SEQ ID NO: 162063 - DNA, 15 bp, Homo sapiens
ggaagagaaaagagc

SEQ ID NO: 162064 - DNA, 15 bp, Homo sapiens
aggaagagaaaagag

SEQ ID NO: 162065 - DNA, 15 bp, Homo sapiens
aaggaagagaaaaga

SEQ ID NO: 162066 - DNA, 15 bp, Homo sapiens
caaggaagagaaaag

SEQ ID NO: 162067 - DNA, 15 bp, Homo sapiens
acaaggaagagaaaa

SEQ ID NO: 162068 - DNA, 15 bp, Homo sapiens
tacaaggaagagaaa

SEQ ID NO: 162069 - DNA, 15 bp, Homo sapiens
gtacaaggaagagaa

SEQ ID NO: 162070 - DNA, 15 bp, Homo sapiens
tgtacaaggaagaga

SEQ ID NO: 162071 - DNA, 15 bp, Homo sapiens
atgtacaaggaagag

SEQ ID NO: 162072 - DNA, 15 bp, Homo sapiens
tatgtacaaggaaga

SEQ ID NO: 162073 - DNA, 15 bp, Homo sapiens
gtatgtacaaggaag

SEQ ID NO: 162074 - DNA, 15 bp, Homo sapiens
ggtatgtacaaggaa

SEQ ID NO: 162075 - DNA, 15 bp, Homo sapiens
tggtatgtacaagga

SEQ ID NO: 162076 - DNA, 15 bp, Homo sapiens
ttggtatgtacaagg

SEQ ID NO: 162077 - DNA, 15 bp, Homo sapiens
cttggtatgtacaag

SEQ ID NO: 162078 - DNA, 15 bp, Homo sapiens
gcttggtatgtacaa

SEQ ID NO: 162079 - DNA, 15 bp, Homo sapiens
ggcttggtatgtaca

SEQ ID NO: 162080 - DNA, 15 bp, Homo sapiens
aggcttggtatgtac

SEQ ID NO: 162081 - DNA, 15 bp, Homo sapiens
aaggcttggtatgta

SEQ ID NO: 162082 - DNA, 15 bp, Homo sapiens
gaaggcttggtatgt

SEQ ID NO: 162083 - DNA, 15 bp, Homo sapiens
ggaaggcttggtatg

SEQ ID NO: 162084 - DNA, 15 bp, Homo sapiens
aggaaggcttggtat

SEQ ID NO: 162085 - DNA, 15 bp, Homo sapiens
taggaaggcttggta

SEQ ID NO: 162086 - DNA, 15 bp, Homo sapiens
gtaggaaggcttggt

SEQ ID NO: 162087 - DNA, 15 bp, Homo sapiens
ggtaggaaggcttgg

SEQ ID NO: 162088 - DNA, 15 bp, Homo sapiens
tggtaggaaggcttg

SEQ ID NO: 162089 - DNA, 15 bp, Homo sapiens
gtggtaggaaggctt

SEQ ID NO: 162090 - DNA, 15 bp, Homo sapiens
tgtggtaggaaggct

SEQ ID NO: 162091 - DNA, 15 bp, Homo sapiens
ctgtggtaggaaggc

SEQ ID NO: 162092 - DNA, 15 bp, Homo sapiens
cctgtggtaggaagg

SEQ ID NO: 162093 - DNA, 15 bp, Homo sapiens
tcctgtggtaggaag

SEQ ID NO: 162094 - DNA, 15 bp, Homo sapiens
gtcctgtggtaggaa

SEQ ID NO: 162095 - DNA, 15 bp, Homo sapiens
ggtcctgtggtagga

SEQ ID NO: 162096 - DNA, 15 bp, Homo sapiens
aggtcctgtggtagg

SEQ ID NO: 162097 - DNA, 15 bp, Homo sapiens
aaggtcctgtggtag

SEQ ID NO: 162098 - DNA, 15 bp, Homo sapiens
aaaggtcctgtggta

SEQ ID NO: 162099 - DNA, 15 bp, Homo sapiens
caaaggtcctgtggt

SEQ ID NO: 162100 - DNA, 15 bp, Homo sapiens
gcaaaggtcctgtgg

SEQ ID NO: 162101 - DNA, 15 bp, Homo sapiens
tgcaaaggtcctgtg

SEQ ID NO: 162102 - DNA, 15 bp, Homo sapiens
gtgcaaaggtcctgt

SEQ ID NO: 162103 - DNA, 15 bp, Homo sapiens
agtgcaaaggtcctg

SEQ ID NO: 162104 - DNA, 15 bp, Homo sapiens
tagtgcaaaggtcct

SEQ ID NO: 162105 - DNA, 15 bp, Homo sapiens
ctagtgcaaaggtcc

SEQ ID NO: 162106 - DNA, 15 bp, Homo sapiens
actagtgcaaaggtc

SEQ ID NO: 162107 - DNA, 15 bp, Homo sapiens
cactagtgcaaaggt

SEQ ID NO: 162108 - DNA, 15 bp, Homo sapiens
acactagtgcaaagg

SEQ ID NO: 162109 - DNA, 15 bp, Homo sapiens
gacactagtgcaaag

SEQ ID NO: 162110 - DNA, 15 bp, Homo sapiens
agacactagtgcaaa

SEQ ID NO: 162111 - DNA, 15 bp, Homo sapiens
gagacactagtgcaa

SEQ ID NO: 162112 - DNA, 15 bp, Homo sapiens
tgagacactagtgca

SEQ ID NO: 162113 - DNA, 15 bp, Homo sapiens
atgagacactagtgc

SEQ ID NO: 162114 - DNA, 15 bp, Homo sapiens
aatgagacactagtg

SEQ ID NO: 162115 - DNA, 15 bp, Homo sapiens
taatgagacactagt

SEQ ID NO: 162116 - DNA, 15 bp, Homo sapiens
ataatgagacactag

SEQ ID NO: 162117 - DNA, 15 bp, Homo sapiens
gataatgagacacta

SEQ ID NO: 162118 - DNA, 15 bp, Homo sapiens
agataatgagacact

SEQ ID NO: 162119 - DNA, 15 bp, Homo sapiens
aagataatgagacac

SEQ ID NO: 162120 - DNA, 15 bp, Homo sapiens
caagataatgagaca

SEQ ID NO: 162121 - DNA, 15 bp, Homo sapiens
tcaagataatgagac

SEQ ID NO: 162122 - DNA, 15 bp, Homo sapiens
ttcaagataatgaga

SEQ ID NO: 162123 - DNA, 15 bp, Homo sapiens
tttcaagataatgag

SEQ ID NO: 162124 - DNA, 15 bp, Homo sapiens
gtttcaagataatga

SEQ ID NO: 162125 - DNA, 15 bp, Homo sapiens
tgtttcaagataatg

SEQ ID NO: 162126 - DNA, 15 bp, Homo sapiens
ctgtttcaagataat

SEQ ID NO: 162127 - DNA, 15 bp, Homo sapiens
actgtttcaagataa

SEQ ID NO: 162128 - DNA, 15 bp, Homo sapiens
aactgtttcaagata

SEQ ID NO: 162129 - DNA, 15 bp, Homo sapiens
aaactgtttcaagat

SEQ ID NO: 162130 - DNA, 15 bp, Homo sapiens
aaaactgtttcaaga

SEQ ID NO: 162131 - DNA, 15 bp, Homo sapiens
gaaaactgtttcaag

SEQ ID NO: 162132 - DNA, 15 bp, Homo sapiens
tgaaaactgtttcaa

SEQ ID NO: 162133 - DNA, 15 bp, Homo sapiens
gtgaaaactgtttca

SEQ ID NO: 162134 - DNA, 15 bp, Homo sapiens
agtgaaaactgtttc

SEQ ID NO: 162135 - DNA, 15 bp, Homo sapiens
cagtgaaaactgttt

SEQ ID NO: 162136 - DNA, 15 bp, Homo sapiens
tcagtgaaaactgtt

SEQ ID NO: 162137 - DNA, 15 bp, Homo sapiens
atcagtgaaaactgt

SEQ ID NO: 162138 - DNA, 15 bp, Homo sapiens
gatcagtgaaaactg

SEQ ID NO: 162139 - DNA, 15 bp, Homo sapiens
agatcagtgaaaact

SEQ ID NO: 162140 - DNA, 15 bp, Homo sapiens
gagatcagtgaaaac

SEQ ID NO: 162141 - DNA, 15 bp, Homo sapiens
ggagatcagtgaaaa

SEQ ID NO: 162142 - DNA, 15 bp, Homo sapiens
tggagatcagtgaaa

SEQ ID NO: 162143 - DNA, 15 bp, Homo sapiens
atggagatcagtgaa

SEQ ID NO: 162144 - DNA, 15 bp, Homo sapiens
catggagatcagtga

SEQ ID NO: 162145 - DNA, 15 bp, Homo sapiens
acatggagatcagtg

SEQ ID NO: 162146 - DNA, 15 bp, Homo sapiens
aacatggagatcagt

SEQ ID NO: 162147 - DNA, 15 bp, Homo sapiens
caacatggagatcag

SEQ ID NO: 162148 - DNA, 15 bp, Homo sapiens
acaacatggagatca

SEQ ID NO: 162149 - DNA, 15 bp, Homo sapiens
tacaacatggagatc

SEQ ID NO: 162150 - DNA, 15 bp, Homo sapiens
ttacaacatggagat

SEQ ID NO: 162151 - DNA, 15 bp, Homo sapiens
gttacaacatggaga

SEQ ID NO: 162152 - DNA, 15 bp, Homo sapiens
agttacaacatggag

SEQ ID NO: 162153 - DNA, 15 bp, Homo sapiens
gagttacaacatgga

SEQ ID NO: 162154 - DNA, 15 bp, Homo sapiens
ggagttacaacatgg

SEQ ID NO: 162155 - DNA, 15 bp, Homo sapiens
aggagttacaacatg

SEQ ID NO: 162156 - DNA, 15 bp, Homo sapiens
aaggagttacaacat

SEQ ID NO: 162157 - DNA, 15 bp, Homo sapiens
gaaggagttacaaca

SEQ ID NO: 162158 - DNA, 15 bp, Homo sapiens
agaaggagttacaac

SEQ ID NO: 162159 - DNA, 15 bp, Homo sapiens
gagaaggagttacaa

SEQ ID NO: 162160 - DNA, 15 bp, Homo sapiens
cgagaaggagttaca

SEQ ID NO: 162161 - DNA, 15 bp, Homo sapiens
ccgagaaggagttac

SEQ ID NO: 162162 - DNA, 15 bp, Homo sapiens
gccgagaaggagtta

SEQ ID NO: 162163 - DNA, 15 bp, Homo sapiens
tgccgagaaggagtt

SEQ ID NO: 162164 - DNA, 15 bp, Homo sapiens
ctgccgagaaggagt

SEQ ID NO: 162165 - DNA, 15 bp, Homo sapiens
actgccgagaaggag

SEQ ID NO: 162166 - DNA, 15 bp, Homo sapiens
tactgccgagaagga

SEQ ID NO: 162167 - DNA, 15 bp, Homo sapiens
ctactgccgagaagg

SEQ ID NO: 162168 - DNA, 15 bp, Homo sapiens
gctactgccgagaag

SEQ ID NO: 162169 - DNA, 15 bp, Homo sapiens
tgctactgccgagaa

SEQ ID NO: 162170 - DNA, 15 bp, Homo sapiens
atgctactgccgaga

SEQ ID NO: 162171 - DNA, 15 bp, Homo sapiens
aatgctactgccgag

SEQ ID NO: 162172 - DNA, 15 bp, Homo sapiens
caatgctactgccga

SEQ ID NO: 162173 - DNA, 15 bp, Homo sapiens
ccaatgctactgccg

SEQ ID NO: 162174 - DNA, 15 bp, Homo sapiens
tccaatgctactgcc

SEQ ID NO: 162175 - DNA, 15 bp, Homo sapiens
gtccaatgctactgc

SEQ ID NO: 162176 - DNA, 15 bp, Homo sapiens
ggtccaatgctactg

SEQ ID NO: 162177 - DNA, 15 bp, Homo sapiens
gggtccaatgctact

SEQ ID NO: 162178 - DNA, 15 bp, Homo sapiens
agggtccaatgctac

SEQ ID NO: 162179 - DNA, 15 bp, Homo sapiens
tagggtccaatgcta

SEQ ID NO: 162180 - DNA, 15 bp, Homo sapiens
ttagggtccaatgct

SEQ ID NO: 162181 - DNA, 15 bp, Homo sapiens
cttagggtccaatgc

SEQ ID NO: 162182 - DNA, 15 bp, Homo sapiens
ccttagggtccaatg

SEQ ID NO: 162183 - DNA, 15 bp, Homo sapiens
tccttagggtccaat

SEQ ID NO: 162184 - DNA, 15 bp, Homo sapiens
atccttagggtccaa

SEQ ID NO: 162185 - DNA, 15 bp, Homo sapiens
catccttagggtcca

SEQ ID NO: 162186 - DNA, 15 bp, Homo sapiens
acatccttagggtcc

SEQ ID NO: 162187 - DNA, 15 bp, Homo sapiens
tacatccttagggtc

SEQ ID NO: 162188 - DNA, 15 bp, Homo sapiens
gtacatccttagggt

SEQ ID NO: 162189 - DNA, 15 bp, Homo sapiens
tgtacatccttaggg

SEQ ID NO: 162190 - DNA, 15 bp, Homo sapiens
ttgtacatccttagg

SEQ ID NO: 162191 - DNA, 15 bp, Homo sapiens
attgtacatccttag

SEQ ID NO: 162192 - DNA, 15 bp, Homo sapiens
cattgtacatcctta

SEQ ID NO: 162193 - DNA, 15 bp, Homo sapiens
acattgtacatcctt

SEQ ID NO: 162194 - DNA, 15 bp, Homo sapiens
aacattgtacatcct

SEQ ID NO: 162195 - DNA, 15 bp, Homo sapiens
aaacattgtacatcc

SEQ ID NO: 162196 - DNA, 15 bp, Homo sapiens
aaaacattgtacatc

SEQ ID NO: 162197 - DNA, 15 bp, Homo sapiens
taaaacattgtacat

SEQ ID NO: 162198 - DNA, 15 bp, Homo sapiens
ataaaacattgtaca

SEQ ID NO: 162199 - DNA, 15 bp, Homo sapiens
tataaaacattgtac

SEQ ID NO: 162200 - DNA, 15 bp, Homo sapiens
gtataaaacattgta

SEQ ID NO: 162201 - DNA, 15 bp, Homo sapiens
agtataaaacattgt

SEQ ID NO: 162202 - DNA, 15 bp, Homo sapiens
cagtataaaacattg

SEQ ID NO: 162203 - DNA, 15 bp, Homo sapiens
acagtataaaacatt

SEQ ID NO: 162204 - DNA, 15 bp, Homo sapiens
cacagtataaaacat

SEQ ID NO: 162205 - DNA, 15 bp, Homo sapiens
acacagtataaaaca

SEQ ID NO: 162206 - DNA, 15 bp, Homo sapiens
aacacagtataaaac

SEQ ID NO: 162207 - DNA, 15 bp, Homo sapiens
aaacacagtataaaa

SEQ ID NO: 162208 - DNA, 15 bp, Homo sapiens
taaacacagtataaa

SEQ ID NO: 162209 - DNA, 15 bp, Homo sapiens
ttaaacacagtataa

SEQ ID NO: 162210 - DNA, 15 bp, Homo sapiens
attaaacacagtata

SEQ ID NO: 162211 - DNA, 15 bp, Homo sapiens
aattaaacacagtat

SEQ ID NO: 162212 - DNA, 15 bp, Homo sapiens
gaattaaacacagta

SEQ ID NO: 162213 - DNA, 15 bp, Homo sapiens
tgaattaaacacagt

SEQ ID NO: 162214 - DNA, 15 bp, Homo sapiens
ctgaattaaacacag

SEQ ID NO: 162215 - DNA, 15 bp, Homo sapiens
actgaattaaacaca

SEQ ID NO: 162216 - DNA, 15 bp, Homo sapiens
aactgaattaaacac

SEQ ID NO: 162217 - DNA, 15 bp, Homo sapiens
taactgaattaaaca

SEQ ID NO: 162218 - DNA, 15 bp, Homo sapiens
gtaactgaattaaac

SEQ ID NO: 162219 - DNA, 15 bp, Homo sapiens
agtaactgaattaaa

SEQ ID NO: 162220 - DNA, 15 bp, Homo sapiens
gagtaactgaattaa

SEQ ID NO: 162221 - DNA, 15 bp, Homo sapiens
agagtaactgaatta

SEQ ID NO: 162222 - DNA, 15 bp, Homo sapiens
cagagtaactgaatt

SEQ ID NO: 162223 - DNA, 15 bp, Homo sapiens
tcagagtaactgaat

SEQ ID NO: 162224 - DNA, 15 bp, Homo sapiens
ttcagagtaactgaa

SEQ ID NO: 162225 - DNA, 15 bp, Homo sapiens
attcagagtaactga

SEQ ID NO: 162226 - DNA, 15 bp, Homo sapiens
aattcagagtaactg

SEQ ID NO: 162227 - DNA, 15 bp, Homo sapiens
taattcagagtaact

SEQ ID NO: 162228 - DNA, 15 bp, Homo sapiens
ctaattcagagtaac

SEQ ID NO: 162229 - DNA, 15 bp, Homo sapiens
tctaattcagagtaa

SEQ ID NO: 162230 - DNA, 15 bp, Homo sapiens
atctaattcagagta

SEQ ID NO: 162231 - DNA, 15 bp, Homo sapiens
tatctaattcagagt

SEQ ID NO: 162232 - DNA, 15 bp, Homo sapiens
ttatctaattcagag

SEQ ID NO: 162233 - DNA, 15 bp, Homo sapiens
cttatctaattcaga

SEQ ID NO: 162234 - DNA, 15 bp, Homo sapiens
gcttatctaattcag

SEQ ID NO: 162235 - DNA, 15 bp, Homo sapiens
tgcttatctaattca

SEQ ID NO: 162236 - DNA, 15 bp, Homo sapiens
ctgcttatctaattc

SEQ ID NO: 162237 - DNA, 15 bp, Homo sapiens
actgcttatctaatt

SEQ ID NO: 162238 - DNA, 15 bp, Homo sapiens
cactgcttatctaat

SEQ ID NO: 162239 - DNA, 15 bp, Homo sapiens
ccactgcttatctaa

SEQ ID NO: 162240 - DNA, 15 bp, Homo sapiens
cccactgcttatcta

SEQ ID NO: 162241 - DNA, 15 bp, Homo sapiens
gcccactgcttatct

SEQ ID NO: 162242 - DNA, 15 bp, Homo sapiens
ggcccactgcttatc

SEQ ID NO: 162243 - DNA, 15 bp, Homo sapiens
aggcccactgcttat

SEQ ID NO: 162244 - DNA, 15 bp, Homo sapiens
aaggcccactgctta

SEQ ID NO: 162245 - DNA, 15 bp, Homo sapiens
taaggcccactgctt

SEQ ID NO: 162246 - DNA, 15 bp, Homo sapiens
ttaaggcccactgct

SEQ ID NO: 162247 - DNA, 15 bp, Homo sapiens
gttaaggcccactgc

SEQ ID NO: 162248 - DNA, 15 bp, Homo sapiens
tgttaaggcccactg

SEQ ID NO: 162249 - DNA, 15 bp, Homo sapiens
ctgttaaggcccact

SEQ ID NO: 162250 - DNA, 15 bp, Homo sapiens
gctgttaaggcccac

SEQ ID NO: 162251 - DNA, 15 bp, Homo sapiens
tgctgttaaggccca

SEQ ID NO: 162252 - DNA, 15 bp, Homo sapiens
atgctgttaaggccc

SEQ ID NO: 162253 - DNA, 15 bp, Homo sapiens
tatgctgttaaggcc

SEQ ID NO: 162254 - DNA, 15 bp, Homo sapiens
gtatgctgttaaggc

SEQ ID NO: 162255 - DNA, 15 bp, Homo sapiens
tgtatgctgttaagg

SEQ ID NO: 162256 - DNA, 15 bp, Homo sapiens
ctgtatgctgttaag

SEQ ID NO: 162257 - DNA, 15 bp, Homo sapiens
cctgtatgctgttaa

SEQ ID NO: 162258 - DNA, 15 bp, Homo sapiens
acctgtatgctgtta

SEQ ID NO: 162259 - DNA, 15 bp, Homo sapiens
cacctgtatgctgtt

SEQ ID NO: 162260 - DNA, 15 bp, Homo sapiens
tcacctgtatgctgt

SEQ ID NO: 162261 - DNA, 15 bp, Homo sapiens
ttcacctgtatgctg

SEQ ID NO: 162262 - DNA, 15 bp, Homo sapiens
tttcacctgtatgct

SEQ ID NO: 162263 - DNA, 15 bp, Homo sapiens
atttcacctgtatgc

SEQ ID NO: 162264 - DNA, 15 bp, Homo sapiens
gatttcacctgtatg

SEQ ID NO: 162265 - DNA, 15 bp, Homo sapiens
agatttcacctgtat

SEQ ID NO: 162266 - DNA, 15 bp, Homo sapiens
aagatttcacctgta

SEQ ID NO: 162267 - DNA, 15 bp, Homo sapiens
caagatttcacctgt

SEQ ID NO: 162268 - DNA, 15 bp, Homo sapiens
tcaagatttcacctg

SEQ ID NO: 162269 - DNA, 15 bp, Homo sapiens
ttcaagatttcacct

SEQ ID NO: 162270 - DNA, 15 bp, Homo sapiens
attcaagatttcacc

SEQ ID NO: 162271 - DNA, 15 bp, Homo sapiens
tattcaagatttcac

SEQ ID NO: 162272 - DNA, 15 bp, Homo sapiens
ttattcaagatttca

SEQ ID NO: 162273 - DNA, 15 bp, Homo sapiens
attattcaagatttc

SEQ ID NO: 162274 - DNA, 15 bp, Homo sapiens
aattattcaagattt

SEQ ID NO: 162275 - DNA, 15 bp, Homo sapiens
aaattattcaagatt

SEQ ID NO: 162276 - DNA, 15 bp, Homo sapiens
taaattattcaagat

SEQ ID NO: 162277 - DNA, 15 bp, Homo sapiens
ttaaattattcaaga

SEQ ID NO: 162278 - DNA, 15 bp, Homo sapiens
gttaaattattcaag

SEQ ID NO: 162279 - DNA, 15 bp, Homo sapiens
tgttaaattattcaa

SEQ ID NO: 162280 - DNA, 15 bp, Homo sapiens
ttgttaaattattca

SEQ ID NO: 162281 - DNA, 15 bp, Homo sapiens
cttgttaaattattc

SEQ ID NO: 162282 - DNA, 15 bp, Homo sapiens
acttgttaaattatt

SEQ ID NO: 162283 - DNA, 15 bp, Homo sapiens
tacttgttaaattat

SEQ ID NO: 162284 - DNA, 15 bp, Homo sapiens
atacttgttaaatta

SEQ ID NO: 162285 - DNA, 15 bp, Homo sapiens
aatacttgttaaatt

SEQ ID NO: 162286 - DNA, 15 bp, Homo sapiens
caatacttgttaaat

SEQ ID NO: 162287 - DNA, 15 bp, Homo sapiens
atcaatacttgttaa

SEQ ID NO: 162288 - DNA, 15 bp, Homo sapiens
aatcaatacttgtta

SEQ ID NO: 162289 - DNA, 15 bp, Homo sapiens
gaatcaatacttgtt

SEQ ID NO: 162290 - DNA, 15 bp, Homo sapiens
agaatcaatacttgt

SEQ ID NO: 162291 - DNA, 15 bp, Homo sapiens
cagaatcaatacttg

SEQ ID NO: 162292 - DNA, 15 bp, Homo sapiens
tcagaatcaatactt

SEQ ID NO: 162293 - DNA, 15 bp, Homo sapiens
ttcagaatcaatact

SEQ ID NO: 162294 - DNA, 15 bp, Homo sapiens
gttcagaatcaatac

SEQ ID NO: 162295 - DNA, 15 bp, Homo sapiens
agttcagaatcaata

SEQ ID NO: 162296 - DNA, 15 bp, Homo sapiens
tagttcagaatcaat

SEQ ID NO: 162297 - DNA, 15 bp, Homo sapiens
atagttcagaatcaa

SEQ ID NO: 162298 - DNA, 15 bp, Homo sapiens
aatagttcagaatca

SEQ ID NO: 162299 - DNA, 15 bp, Homo sapiens
caatagttcagaatc

SEQ ID NO: 162300 - DNA, 15 bp, Homo sapiens
acaatagttcagaat

SEQ ID NO: 162301 - DNA, 15 bp, Homo sapiens
aacaatagttcagaa

SEQ ID NO: 162302 - DNA, 15 bp, Homo sapiens
taacaatagttcaga

SEQ ID NO: 162303 - DNA, 15 bp, Homo sapiens
ttaacaatagttcag

SEQ ID NO: 162304 - DNA, 15 bp, Homo sapiens
tttaacaatagttca

SEQ ID NO: 162305 - DNA, 15 bp, Homo sapiens
atttaacaatagttc

SEQ ID NO: 162306 - DNA, 15 bp, Homo sapiens
tatttaacaatagtt

SEQ ID NO: 162307 - DNA, 15 bp, Homo sapiens
ttatttaacaatagt

SEQ ID NO: 162308 - DNA, 15 bp, Homo sapiens
attatttaacaatag

SEQ ID NO: 162309 - DNA, 15 bp, Homo sapiens
aattatttaacaata

SEQ ID NO: 162310 - DNA, 15 bp, Homo sapiens
gaattatttaacaat

SEQ ID NO: 162311 - DNA, 15 bp, Homo sapiens
tgaattatttaacaa

SEQ ID NO: 162312 - DNA, 15 bp, Homo sapiens
gtgaattatttaaca

SEQ ID NO: 162313 - DNA, 15 bp, Homo sapiens
tgtgaattatttaac

SEQ ID NO: 162314 - DNA, 15 bp, Homo sapiens
gtgtgaattatttaa

SEQ ID NO: 162315 - DNA, 15 bp, Homo sapiens
tgtgtgaattattta

SEQ ID NO: 162316 - DNA, 15 bp, Homo sapiens
ctgtgtgaattattt

SEQ ID NO: 162317 - DNA, 15 bp, Homo sapiens
actgtgtgaattatt

SEQ ID NO: 162318 - DNA, 15 bp, Homo sapiens
aactgtgtgaattat

SEQ ID NO: 162319 - DNA, 15 bp, Homo sapiens
taactgtgtgaatta

SEQ ID NO: 162320 - DNA, 15 bp, Homo sapiens
ttaactgtgtgaatt

SEQ ID NO: 162321 - DNA, 15 bp, Homo sapiens
attaactgtgtgaat

SEQ ID NO: 162322 - DNA, 15 bp, Homo sapiens
aattaactgtgtgaa

SEQ ID NO: 162323 - DNA, 15 bp, Homo sapiens
taattaactgtgtga

SEQ ID NO: 162324 - DNA, 15 bp, Homo sapiens
ataattaactgtgtg

SEQ ID NO: 162325 - DNA, 15 bp, Homo sapiens
tataattaactgtgt

SEQ ID NO: 162326 - DNA, 15 bp, Homo sapiens
ttataattaactgtg

SEQ ID NO: 162327 - DNA, 15 bp, Homo sapiens
attataattaactgt

SEQ ID NO: 162328 - DNA, 15 bp, Homo sapiens
aattataattaactg

SEQ ID NO: 162329 - DNA, 15 bp, Homo sapiens
taattataattaact

SEQ ID NO: 162330 - DNA, 15 bp, Homo sapiens
gtaattataattaac

SEQ ID NO: 162331 - DNA, 15 bp, Homo sapiens
ggtaattataattaa

SEQ ID NO: 162332 - DNA, 15 bp, Homo sapiens
tggtaattataatta

SEQ ID NO: 162333 - DNA, 15 bp, Homo sapiens
atggtaattataatt

SEQ ID NO: 162334 - DNA, 15 bp, Homo sapiens
aatggtaattataat

SEQ ID NO: 162335 - DNA, 15 bp, Homo sapiens
taatggtaattataa

SEQ ID NO: 162336 - DNA, 15 bp, Homo sapiens
ataatggtaattata

SEQ ID NO: 162337 - DNA, 15 bp, Homo sapiens
aataatggtaattat

SEQ ID NO: 162338 - DNA, 15 bp, Homo sapiens
caataatggtaatta

SEQ ID NO: 162339 - DNA, 15 bp, Homo sapiens
gcaataatggtaatt

SEQ ID NO: 162340 - DNA, 15 bp, Homo sapiens
agcaataatggtaat

SEQ ID NO: 162341 - DNA, 15 bp, Homo sapiens
aagcaataatggtaa

SEQ ID NO: 162342 - DNA, 15 bp, Homo sapiens
taagcaataatggta

SEQ ID NO: 162343 - DNA, 15 bp, Homo sapiens
ttaagcaataatggt

SEQ ID NO: 162344 - DNA, 15 bp, Homo sapiens
cttaagcaataatgg

SEQ ID NO: 162345 - DNA, 15 bp, Homo sapiens
tcttaagcaataatg

SEQ ID NO: 162346 - DNA, 15 bp, Homo sapiens
ttcttaagcaataat

SEQ ID NO: 162347 - DNA, 15 bp, Homo sapiens
gttcttaagcaataa

SEQ ID NO: 162348 - DNA, 15 bp, Homo sapiens
agttcttaagcaata

SEQ ID NO: 162349 - DNA, 15 bp, Homo sapiens
tagttcttaagcaat

SEQ ID NO: 162350 - DNA, 15 bp, Homo sapiens
gtagttcttaagcaa

SEQ ID NO: 162351 - DNA, 15 bp, Homo sapiens
agtagttcttaagca

SEQ ID NO: 162352 - DNA, 15 bp, Homo sapiens
aagtagttcttaagc

SEQ ID NO: 162353 - DNA, 15 bp, Homo sapiens
taagtagttcttaag

SEQ ID NO: 162354 - DNA, 15 bp, Homo sapiens
ttaagtagttcttaa

SEQ ID NO: 162355 - DNA, 15 bp, Homo sapiens
attaagtagttctta

SEQ ID NO: 162356 - DNA, 15 bp, Homo sapiens
tattaagtagttctt

SEQ ID NO: 162357 - DNA, 15 bp, Homo sapiens
ttattaagtagttct

SEQ ID NO: 162358 - DNA, 15 bp, Homo sapiens
tttattaagtagttc

SEQ ID NO: 162359 - DNA, 15 bp, Homo sapiens
ctttattaagtagtt

SEQ ID NO: 162360 - DNA, 15 bp, Homo sapiens
gctttattaagtagt

SEQ ID NO: 162361 - DNA, 15 bp, Homo sapiens
tgctttattaagtag

SEQ ID NO: 162362 - DNA, 15 bp, Homo sapiens
ctgctttattaagta

SEQ ID NO: 162363 - DNA, 15 bp, Homo sapiens
cctgctttattaagt

SEQ ID NO: 162364 - DNA, 15 bp, Homo sapiens
ccctgctttattaag

SEQ ID NO: 162365 - DNA, 15 bp, Homo sapiens
accctgctttattaa

SEQ ID NO: 162366 - DNA, 15 bp, Homo sapiens
aaccctgctttatta

SEQ ID NO: 162367 - DNA, 15 bp, Homo sapiens
aaaccctgctttatt

SEQ ID NO: 162368 - DNA, 15 bp, Homo sapiens
caaaccctgctttat

SEQ ID NO: 162369 - DNA, 15 bp, Homo sapiens
acaaaccctgcttta

SEQ ID NO: 162370 - DNA, 15 bp, Homo sapiens
cacaaaccctgcttt

SEQ ID NO: 162371 - DNA, 15 bp, Homo sapiens
ccacaaaccctgctt

SEQ ID NO: 162372 - DNA, 15 bp, Homo sapiens
gccacaaaccctgct

SEQ ID NO: 162373 - DNA, 15 bp, Homo sapiens
agccacaaaccctgc

SEQ ID NO: 162374 - DNA, 15 bp, Homo sapiens
tagccacaaaccctg

SEQ ID NO: 162375 - DNA, 15 bp, Homo sapiens
ctagccacaaaccct

SEQ ID NO: 162376 - DNA, 15 bp, Homo sapiens
tctagccacaaaccc

SEQ ID NO: 162377 - DNA, 15 bp, Homo sapiens
ttctagccacaaacc

SEQ ID NO: 162378 - DNA, 15 bp, Homo sapiens
attctagccacaaac

SEQ ID NO: 162379 - DNA, 15 bp, Homo sapiens
aattctagccacaaa

SEQ ID NO: 162380 - DNA, 15 bp, Homo sapiens
aaattctagccacaa

SEQ ID NO: 162381 - DNA, 15 bp, Homo sapiens
taaattctagccaca

SEQ ID NO: 162382 - DNA, 15 bp, Homo sapiens
ttaaattctagccac

SEQ ID NO: 162383 - DNA, 15 bp, Homo sapiens
tttaaattctagcca

SEQ ID NO: 162384 - DNA, 15 bp, Homo sapiens
ctttaaattctagcc

SEQ ID NO: 162385 - DNA, 15 bp, Homo sapiens
tctttaaattctagc

SEQ ID NO: 162386 - DNA, 15 bp, Homo sapiens
gtctttaaattctag

SEQ ID NO: 162387 - DNA, 15 bp, Homo sapiens
tgtctttaaattcta

SEQ ID NO: 162388 - DNA, 15 bp, Homo sapiens
ttgtctttaaattct

SEQ ID NO: 162389 - DNA, 15 bp, Homo sapiens
attgtctttaaattc

SEQ ID NO: 162390 - DNA, 15 bp, Homo sapiens
aattgtctttaaatt

SEQ ID NO: 162391 - DNA, 15 bp, Homo sapiens
aaattgtctttaaat

SEQ ID NO: 162392 - DNA, 15 bp, Homo sapiens
caaattgtctttaaa

SEQ ID NO: 162393 - DNA, 15 bp, Homo sapiens
acaaattgtctttaa

SEQ ID NO: 162394 - DNA, 15 bp, Homo sapiens
aacaaattgtcttta

SEQ ID NO: 162395 - DNA, 15 bp, Homo sapiens
caacaaattgtcttt

SEQ ID NO: 162396 - DNA, 15 bp, Homo sapiens
ccaacaaattgtctt

SEQ ID NO: 162397 - DNA, 15 bp, Homo sapiens
tccaacaaattgtct

SEQ ID NO: 162398 - DNA, 15 bp, Homo sapiens
atccaacaaattgtc

SEQ ID NO: 162399 - DNA, 15 bp, Homo sapiens
tatccaacaaattgt

SEQ ID NO: 162400 - DNA, 15 bp, Homo sapiens
gtatccaacaaattg

SEQ ID NO: 162401 - DNA, 15 bp, Homo sapiens
ggtatccaacaaatt

SEQ ID NO: 162402 - DNA, 15 bp, Homo sapiens
aggtatccaacaaat

SEQ ID NO: 162403 - DNA, 15 bp, Homo sapiens
aaggtatccaacaaa

SEQ ID NO: 162404 - DNA, 15 bp, Homo sapiens
aaaggtatccaacaa

SEQ ID NO: 162405 - DNA, 15 bp, Homo sapiens
taaaggtatccaaca

SEQ ID NO: 162406 - DNA, 15 bp, Homo sapiens
ttaaaggtatccaac

SEQ ID NO: 162407 - DNA, 15 bp, Homo sapiens
attaaaggtatccaa

SEQ ID NO: 162408 - DNA, 15 bp, Homo sapiens
gattaaaggtatcca

SEQ ID NO: 162409 - DNA, 15 bp, Homo sapiens
agattaaaggtatcc

SEQ ID NO: 162410 - DNA, 15 bp, Homo sapiens
tagattaaaggtatc

SEQ ID NO: 162411 - DNA, 15 bp, Homo sapiens
atagattaaaggtat

SEQ ID NO: 162412 - DNA, 15 bp, Homo sapiens
tatagattaaaggta

SEQ ID NO: 162413 - DNA, 15 bp, Homo sapiens
ctatagattaaaggt

SEQ ID NO: 162414 - DNA, 15 bp, Homo sapiens
tctatagattaaagg

SEQ ID NO: 162415 - DNA, 15 bp, Homo sapiens
ttctatagattaaag

SEQ ID NO: 162416 - DNA, 15 bp, Homo sapiens
tttctatagattaaa

SEQ ID NO: 162417 - DNA, 15 bp, Homo sapiens
atttctatagattaa

SEQ ID NO: 162418 - DNA, 15 bp, Homo sapiens
catttctatagatta

SEQ ID NO: 162419 - DNA, 15 bp, Homo sapiens
acatttctatagatt

SEQ ID NO: 162420 - DNA, 15 bp, Homo sapiens
tacatttctatagat

SEQ ID NO: 162421 - DNA, 15 bp, Homo sapiens
atacatttctataga

SEQ ID NO: 162422 - DNA, 15 bp, Homo sapiens
tatacatttctatag

SEQ ID NO: 162423 - DNA, 15 bp, Homo sapiens
ttatacatttctata

SEQ ID NO: 162424 - DNA, 15 bp, Homo sapiens
attatacatttctat

SEQ ID NO: 162425 - DNA, 15 bp, Homo sapiens
tattatacatttcta

SEQ ID NO: 162426 - DNA, 15 bp, Homo sapiens
ttattatacatttct

SEQ ID NO: 162427 - DNA, 15 bp, Homo sapiens
tttattatacatttc

SEQ ID NO: 162428 - DNA, 15 bp, Homo sapiens
ctttattatacattt

SEQ ID NO: 162429 - DNA, 15 bp, Homo sapiens
tctttattatacatt

SEQ ID NO: 162430 - DNA, 15 bp, Homo sapiens
atctttattatacat

SEQ ID NO: 162431 - DNA, 15 bp, Homo sapiens
catctttattataca

SEQ ID NO: 162432 - DNA, 15 bp, Homo sapiens
tcatctttattatac

SEQ ID NO: 162433 - DNA, 15 bp, Homo sapiens
ctcatctttattata

SEQ ID NO: 162434 - DNA, 15 bp, Homo sapiens
tctcatctttattat

SEQ ID NO: 162435 - DNA, 15 bp, Homo sapiens
ctctcatctttatta

SEQ ID NO: 162436 - DNA, 15 bp, Homo sapiens
tctctcatctttatt

SEQ ID NO: 162437 - DNA, 15 bp, Homo sapiens
ttctctcatctttat

SEQ ID NO: 162438 - DNA, 15 bp, Homo sapiens
tttctctcatcttta

SEQ ID NO: 162439 - DNA, 15 bp, Homo sapiens
atttctctcatcttt

SEQ ID NO: 162440 - DNA, 15 bp, Homo sapiens
tatttctctcatctt

SEQ ID NO: 162441 - DNA, 15 bp, Homo sapiens
ttatttctctcatct

SEQ ID NO: 162442 - DNA, 15 bp, Homo sapiens
gttatttctctcatc

SEQ ID NO: 162443 - DNA, 15 bp, Homo sapiens
agttatttctctcat

SEQ ID NO: 162444 - DNA, 15 bp, Homo sapiens
cagttatttctctca

SEQ ID NO: 162445 - DNA, 15 bp, Homo sapiens
acagttatttctctc

SEQ ID NO: 162446 - DNA, 15 bp, Homo sapiens
aacagttatttctct

SEQ ID NO: 162447 - DNA, 15 bp, Homo sapiens
taacagttatttctc

SEQ ID NO: 162448 - DNA, 15 bp, Homo sapiens
ctaacagttatttct

SEQ ID NO: 162449 - DNA, 15 bp, Homo sapiens
gctaacagttatttc

SEQ ID NO: 162450 - DNA, 15 bp, Homo sapiens
cgctaacagttattt

SEQ ID NO: 162451 - DNA, 15 bp, Homo sapiens
tcgctaacagttatt

SEQ ID NO: 162452 - DNA, 15 bp, Homo sapiens
ttcgctaacagttat

SEQ ID NO: 162453 - DNA, 15 bp, Homo sapiens
attcgctaacagtta

SEQ ID NO: 162454 - DNA, 15 bp, Homo sapiens
gattcgctaacagtt

SEQ ID NO: 162455 - DNA, 15 bp, Homo sapiens
ggattcgctaacagt

SEQ ID NO: 162456 - DNA, 15 bp, Homo sapiens
aggattcgctaacag

SEQ ID NO: 162457 - DNA, 15 bp, Homo sapiens
aaggattcgctaaca

SEQ ID NO: 162458 - DNA, 15 bp, Homo sapiens
aaaggattcgctaac

SEQ ID NO: 162459 - DNA, 15 bp, Homo sapiens
caaaggattcgctaa

SEQ ID NO: 162460 - DNA, 15 bp, Homo sapiens
ccaaaggattcgcta

SEQ ID NO: 162461 - DNA, 15 bp, Homo sapiens
tccaaaggattcgct

SEQ ID NO: 162462 - DNA, 15 bp, Homo sapiens
atccaaaggattcgc

SEQ ID NO: 162463 - DNA, 15 bp, Homo sapiens
aatccaaaggattcg

SEQ ID NO: 162464 - DNA, 15 bp, Homo sapiens
taatccaaaggattc

SEQ ID NO: 162465 - DNA, 15 bp, Homo sapiens
ttaatccaaaggatt

SEQ ID NO: 162466 - DNA, 15 bp, Homo sapiens
cttaatccaaaggat

SEQ ID NO: 162467 - DNA, 15 bp, Homo sapiens
gcttaatccaaagga

SEQ ID NO: 162468 - DNA, 15 bp, Homo sapiens
agcttaatccaaagg

SEQ ID NO: 162469 - DNA, 15 bp, Homo sapiens
tagcttaatccaaag

SEQ ID NO: 162470 - DNA, 15 bp, Homo sapiens
gtagcttaatccaaa

SEQ ID NO: 162471 - DNA, 15 bp, Homo sapiens
tgtagcttaatccaa

SEQ ID NO: 162472 - DNA, 15 bp, Homo sapiens
ttgtagcttaatcca

SEQ ID NO: 162473 - DNA, 15 bp, Homo sapiens
cttgtagcttaatcc

SEQ ID NO: 162474 - DNA, 15 bp, Homo sapiens
gcttgtagcttaatc

SEQ ID NO: 162475 - DNA, 15 bp, Homo sapiens
ggcttgtagcttaat

SEQ ID NO: 162476 - DNA, 15 bp, Homo sapiens
tggcttgtagcttaa

SEQ ID NO: 162477 - DNA, 15 bp, Homo sapiens
atggcttgtagctta

SEQ ID NO: 162478 - DNA, 15 bp, Homo sapiens
aatggcttgtagctt

SEQ ID NO: 162479 - DNA, 15 bp, Homo sapiens
taatggcttgtagct

SEQ ID NO: 162480 - DNA, 15 bp, Homo sapiens
ataatggcttgtagc

SEQ ID NO: 162481 - DNA, 15 bp, Homo sapiens
tataatggcttgtag

SEQ ID NO: 162482 - DNA, 15 bp, Homo sapiens
ttataatggcttgta

SEQ ID NO: 162483 - DNA, 15 bp, Homo sapiens
attataatggcttgt

SEQ ID NO: 162484 - DNA, 15 bp, Homo sapiens
aattataatggcttg

SEQ ID NO: 162485 - DNA, 15 bp, Homo sapiens
aaattataatggctt

SEQ ID NO: 162486 - DNA, 15 bp, Homo sapiens
caaattataatggct

SEQ ID NO: 162487 - DNA, 15 bp, Homo sapiens
gcaaattataatggc

SEQ ID NO: 162488 - DNA, 15 bp, Homo sapiens
tgcaaattataatgg

SEQ ID NO: 162489 - DNA, 15 bp, Homo sapiens
ctgcaaattataatg

SEQ ID NO: 162490 - DNA, 15 bp, Homo sapiens
actgcaaattataat

SEQ ID NO: 162491 - DNA, 15 bp, Homo sapiens
tactgcaaattataa

SEQ ID NO: 162492 - DNA, 15 bp, Homo sapiens
ctactgcaaattata

SEQ ID NO: 162493 - DNA, 15 bp, Homo sapiens
gctactgcaaattat

SEQ ID NO: 162494 - DNA, 15 bp, Homo sapiens
tgctactgcaaatta

SEQ ID NO: 162495 - DNA, 15 bp, Homo sapiens
ttgctactgcaaatt

SEQ ID NO: 162496 - DNA, 15 bp, Homo sapiens
cttgctactgcaaat

SEQ ID NO: 162497 - DNA, 15 bp, Homo sapiens
gcttgctactgcaaa

SEQ ID NO: 162498 - DNA, 15 bp, Homo sapiens
ggcttgctactgcaa

SEQ ID NO: 162499 - DNA, 15 bp, Homo sapiens
aggcttgctactgca

SEQ ID NO: 162500 - DNA, 15 bp, Homo sapiens
aaggcttgctactgc

SEQ ID NO: 162501 - DNA, 15 bp, Homo sapiens
caaggcttgctactg

SEQ ID NO: 162502 - DNA, 15 bp, Homo sapiens
acaaggcttgctact

SEQ ID NO: 162503 - DNA, 15 bp, Homo sapiens
tacaaggcttgctac

SEQ ID NO: 162504 - DNA, 15 bp, Homo sapiens
ttacaaggcttgcta

SEQ ID NO: 162505 - DNA, 15 bp, Homo sapiens
attacaaggcttgct

SEQ ID NO: 162506 - DNA, 15 bp, Homo sapiens
cattacaaggcttgc

SEQ ID NO: 162507 - DNA, 15 bp, Homo sapiens
gcattacaaggcttg

SEQ ID NO: 162508 - DNA, 15 bp, Homo sapiens
agcattacaaggctt

SEQ ID NO: 162509 - DNA, 15 bp, Homo sapiens
tagcattacaaggct

SEQ ID NO: 162510 - DNA, 15 bp, Homo sapiens
ttagcattacaaggc

SEQ ID NO: 162511 - DNA, 15 bp, Homo sapiens
attagcattacaagg

SEQ ID NO: 162512 - DNA, 15 bp, Homo sapiens
cattagcattacaag

SEQ ID NO: 162513 - DNA, 15 bp, Homo sapiens
tcattagcattacaa

SEQ ID NO: 162514 - DNA, 15 bp, Homo sapiens
gtcattagcattaca

SEQ ID NO: 162515 - DNA, 15 bp, Homo sapiens
tgtcattagcattac

SEQ ID NO: 162516 - DNA, 15 bp, Homo sapiens
ttgtcattagcatta

SEQ ID NO: 162517 - DNA, 15 bp, Homo sapiens
tttgtcattagcatt

SEQ ID NO: 162518 - DNA, 15 bp, Homo sapiens
atttgtcattagcat

SEQ ID NO: 162519 - DNA, 15 bp, Homo sapiens
tatttgtcattagca

SEQ ID NO: 162520 - DNA, 15 bp, Homo sapiens
atatttgtcattagc

SEQ ID NO: 162521 - DNA, 15 bp, Homo sapiens
tatatttgtcattag

SEQ ID NO: 162522 - DNA, 15 bp, Homo sapiens
ttatatttgtcatta

SEQ ID NO: 162523 - DNA, 15 bp, Homo sapiens
cttatatttgtcatt

SEQ ID NO: 162524 - DNA, 15 bp, Homo sapiens
acttatatttgtcat

SEQ ID NO: 162525 - DNA, 15 bp, Homo sapiens
gacttatatttgtca

SEQ ID NO: 162526 - DNA, 15 bp, Homo sapiens
tgacttatatttgtc

SEQ ID NO: 162527 - DNA, 15 bp, Homo sapiens
ctgacttatatttgt

SEQ ID NO: 162528 - DNA, 15 bp, Homo sapiens
actgacttatatttg

SEQ ID NO: 162529 - DNA, 15 bp, Homo sapiens
aactgacttatattt

SEQ ID NO: 162530 - DNA, 15 bp, Homo sapiens
aaactgacttatatt

SEQ ID NO: 162531 - DNA, 15 bp, Homo sapiens
caaactgacttatat

SEQ ID NO: 162532 - DNA, 15 bp, Homo sapiens
acaaactgacttata

SEQ ID NO: 162533 - DNA, 15 bp, Homo sapiens
aacaaactgacttat

SEQ ID NO: 162534 - DNA, 15 bp, Homo sapiens
aaacaaactgactta

SEQ ID NO: 162535 - DNA, 15 bp, Homo sapiens
gaaacaaactgactt

SEQ ID NO: 162536 - DNA, 15 bp, Homo sapiens
ggaaacaaactgact

SEQ ID NO: 162537 - DNA, 15 bp, Homo sapiens
aggaaacaaactgac

SEQ ID NO: 162538 - DNA, 15 bp, Homo sapiens
taggaaacaaactga

SEQ ID NO: 162539 - DNA, 15 bp, Homo sapiens
ataggaaacaaactg

SEQ ID NO: 162540 - DNA, 15 bp, Homo sapiens
cataggaaacaaact

SEQ ID NO: 162541 - DNA, 15 bp, Homo sapiens
gcataggaaacaaac

SEQ ID NO: 162542 - DNA, 15 bp, Homo sapiens
tgcataggaaacaaa

SEQ ID NO: 162543 - DNA, 15 bp, Homo sapiens
gtgcataggaaacaa

SEQ ID NO: 162544 - DNA, 15 bp, Homo sapiens
agtgcataggaaaca

SEQ ID NO: 162545 - DNA, 15 bp, Homo sapiens
gagtgcataggaaac

SEQ ID NO: 162546 - DNA, 15 bp, Homo sapiens
tgagtgcataggaaa

SEQ ID NO: 162547 - DNA, 15 bp, Homo sapiens
atgagtgcataggaa

SEQ ID NO: 162548 - DNA, 15 bp, Homo sapiens
catgagtgcatagga

SEQ ID NO: 162549 - DNA, 15 bp, Homo sapiens
ccatgagtgcatagg

SEQ ID NO: 162550 - DNA, 15 bp, Homo sapiens
tccatgagtgcatag

SEQ ID NO: 162551 - DNA, 15 bp, Homo sapiens
atccatgagtgcata

SEQ ID NO: 162552 - DNA, 15 bp, Homo sapiens
gatccatgagtgcat

SEQ ID NO: 162553 - DNA, 15 bp, Homo sapiens
tgatccatgagtgca

SEQ ID NO: 162554 - DNA, 15 bp, Homo sapiens
ctgatccatgagtgc

SEQ ID NO: 162555 - DNA, 15 bp, Homo sapiens
actgatccatgagtg

SEQ ID NO: 162556 - DNA, 15 bp, Homo sapiens
cactgatccatgagt

SEQ ID NO: 162557 - DNA, 15 bp, Homo sapiens
ccactgatccatgag

SEQ ID NO: 162558 - DNA, 15 bp, Homo sapiens
accactgatccatga

SEQ ID NO: 162559 - DNA, 15 bp, Homo sapiens
aaccactgatccatg

SEQ ID NO: 162560 - DNA, 15 bp, Homo sapiens
taaccactgatccat

SEQ ID NO: 162561 - DNA, 15 bp, Homo sapiens
gtaaccactgatcca

SEQ ID NO: 162562 - DNA, 15 bp, Homo sapiens
agtaaccactgatcc

SEQ ID NO: 162563 - DNA, 15 bp, Homo sapiens
aagtaaccactgatc

SEQ ID NO: 162564 - DNA, 15 bp, Homo sapiens
gaagtaaccactgat

SEQ ID NO: 162565 - DNA, 15 bp, Homo sapiens
cgaagtaaccactga

SEQ ID NO: 162566 - DNA, 15 bp, Homo sapiens
ccgaagtaaccactg

SEQ ID NO: 162567 - DNA, 15 bp, Homo sapiens
tccgaagtaaccact

SEQ ID NO: 162568 - DNA, 15 bp, Homo sapiens
ttccgaagtaaccac

SEQ ID NO: 162569 - DNA, 15 bp, Homo sapiens
tttccgaagtaacca

SEQ ID NO: 162570 - DNA, 15 bp, Homo sapiens
atttccgaagtaacc

SEQ ID NO: 162571 - DNA, 15 bp, Homo sapiens
aatttccgaagtaac

SEQ ID NO: 162572 - DNA, 15 bp, Homo sapiens
aaatttccgaagtaa

SEQ ID NO: 162573 - DNA, 15 bp, Homo sapiens
caaatttccgaagta

SEQ ID NO: 162574 - DNA, 15 bp, Homo sapiens
acaaatttccgaagt

SEQ ID NO: 162575 - DNA, 15 bp, Homo sapiens
cacaaatttccgaag

SEQ ID NO: 162576 - DNA, 15 bp, Homo sapiens
acacaaatttccgaa

SEQ ID NO: 162577 - DNA, 15 bp, Homo sapiens
aacacaaatttccga

SEQ ID NO: 162578 - DNA, 15 bp, Homo sapiens
aaacacaaatttccg

SEQ ID NO: 162579 - DNA, 15 bp, Homo sapiens
aaaacacaaatttcc

SEQ ID NO: 162580 - DNA, 15 bp, Homo sapiens
caaaacacaaatttc

SEQ ID NO: 162581 - DNA, 15 bp, Homo sapiens
acaaaacacaaattt

SEQ ID NO: 162582 - DNA, 15 bp, Homo sapiens
gacaaaacacaaatt

SEQ ID NO: 162583 - DNA, 15 bp, Homo sapiens
agacaaaacacaaat

SEQ ID NO: 162584 - DNA, 15 bp, Homo sapiens
cagacaaaacacaaa

SEQ ID NO: 162585 - DNA, 15 bp, Homo sapiens
tcagacaaaacacaa

SEQ ID NO: 162586 - DNA, 15 bp, Homo sapiens
atcagacaaaacaca

SEQ ID NO: 162587 - DNA, 15 bp, Homo sapiens
tatcagacaaaacac

SEQ ID NO: 162588 - DNA, 15 bp, Homo sapiens
ctatcagacaaaaca

SEQ ID NO: 162589 - DNA, 15 bp, Homo sapiens
actatcagacaaaac

SEQ ID NO: 162590 - DNA, 15 bp, Homo sapiens
aactatcagacaaaa

SEQ ID NO: 162591 - DNA, 15 bp, Homo sapiens
aaactatcagacaaa

SEQ ID NO: 162592 - DNA, 15 bp, Homo sapiens
aaaactatcagacaa

SEQ ID NO: 162593 - DNA, 15 bp, Homo sapiens
aaaaactatcagaca

SEQ ID NO: 162594 - DNA, 15 bp, Homo sapiens
aaaaaactatcagac

SEQ ID NO: 162595 - DNA, 15 bp, Homo sapiens
aaaaaaactatcaga

SEQ ID NO: 162596 - DNA, 15 bp, Homo sapiens
aaaaaaaactatcag

SEQ ID NO: 162597 - DNA, 15 bp, Homo sapiens
aaaaaaaaactatca

SEQ ID NO: 162598 - DNA, 15 bp, Homo sapiens
aaaaaaaaaactatc

SEQ ID NO: 162599 - DNA, 15 bp, Homo sapiens
cttttcaaaaaaaaa

SEQ ID NO: 162600 - DNA, 15 bp, Homo sapiens
gcttttcaaaaaaaa

SEQ ID NO: 162601 - DNA, 15 bp, Homo sapiens
ggcttttcaaaaaaa

SEQ ID NO: 162602 - DNA, 15 bp, Homo sapiens
gggcttttcaaaaaa

SEQ ID NO: 162603 - DNA, 15 bp, Homo sapiens
agggcttttcaaaaa

SEQ ID NO: 162604 - DNA, 15 bp, Homo sapiens
aagggcttttcaaaa

SEQ ID NO: 162605 - DNA, 15 bp, Homo sapiens
aaagggcttttcaaa

SEQ ID NO: 162606 - DNA, 15 bp, Homo sapiens
aaaagggcttttcaa

SEQ ID NO: 162607 - DNA, 15 bp, Homo sapiens
aaaaagggcttttca

SEQ ID NO: 162608 - DNA, 15 bp, Homo sapiens
aaaaaagggcttttc

SEQ ID NO: 162609 - DNA, 15 bp, Homo sapiens
taaaaaagggctttt

SEQ ID NO: 162610 - DNA, 15 bp, Homo sapiens
ttaaaaaagggcttt

SEQ ID NO: 162611 - DNA, 15 bp, Homo sapiens
tttaaaaaagggctt

SEQ ID NO: 162612 - DNA, 15 bp, Homo sapiens
ttttaaaaaagggct

SEQ ID NO: 162613 - DNA, 15 bp, Homo sapiens
tttttaaaaaagggc

SEQ ID NO: 162614 - DNA, 15 bp, Homo sapiens
ttttttaaaaaaggg

SEQ ID NO: 162615 - DNA, 15 bp, Homo sapiens
cttttttaaaaaagg

SEQ ID NO: 162616 - DNA, 15 bp, Homo sapiens
tcttttttaaaaaag

SEQ ID NO: 162617 - DNA, 15 bp, Homo sapiens
atcttttttaaaaaa

SEQ ID NO: 162618 - DNA, 15 bp, Homo sapiens
aatcttttttaaaaa

SEQ ID NO: 162619 - DNA, 15 bp, Homo sapiens
aaatcttttttaaaa

SEQ ID NO: 162620 - DNA, 15 bp, Homo sapiens
aaaatcttttttaaa

SEQ ID NO: 162621 - DNA, 15 bp, Homo sapiens
taaaatcttttttaa

SEQ ID NO: 162622 - DNA, 15 bp, Homo sapiens
ttaaaatctttttta

SEQ ID NO: 162623 - DNA, 15 bp, Homo sapiens
tttaaaatctttttt

SEQ ID NO: 162624 - DNA, 15 bp, Homo sapiens
ttttaaaatcttttt

SEQ ID NO: 162625 - DNA, 15 bp, Homo sapiens
tttttaaaatctttt

SEQ ID NO: 162626 - DNA, 15 bp, Homo sapiens
atttttaaaatcttt

SEQ ID NO: 162627 - DNA, 15 bp, Homo sapiens
tatttttaaaatctt

SEQ ID NO: 162628 - DNA, 15 bp, Homo sapiens
ttatttttaaaatct

SEQ ID NO: 162629 - DNA, 15 bp, Homo sapiens
tttatttttaaaatc

SEQ ID NO: 162630 - DNA, 15 bp, Homo sapiens
ctttatttttaaaat

SEQ ID NO: 162631 - DNA, 15 bp, Homo sapiens
cctttatttttaaaa

SEQ ID NO: 162632 - DNA, 15 bp, Homo sapiens
acctttatttttaaa

SEQ ID NO: 162633 - DNA, 15 bp, Homo sapiens
cacctttatttttaa

SEQ ID NO: 162634 - DNA, 15 bp, Homo sapiens
tcacctttattttta

SEQ ID NO: 162635 - DNA, 15 bp, Homo sapiens
ttcacctttattttt

SEQ ID NO: 162636 - DNA, 15 bp, Homo sapiens
attcacctttatttt

SEQ ID NO: 162637 - DNA, 15 bp, Homo sapiens
aattcacctttattt

SEQ ID NO: 162638 - DNA, 15 bp, Homo sapiens
aaattcacctttatt

SEQ ID NO: 162639 - DNA, 15 bp, Homo sapiens
gaaattcacctttat

SEQ ID NO: 162640 - DNA, 15 bp, Homo sapiens
tgaaattcaccttta

SEQ ID NO: 162641 - DNA, 15 bp, Homo sapiens
gtgaaattcaccttt

SEQ ID NO: 162642 - DNA, 15 bp, Homo sapiens
tgtgaaattcacctt

SEQ ID NO: 162643 - DNA, 15 bp, Homo sapiens
gtgtgaaattcacct

SEQ ID NO: 162644 - DNA, 15 bp, Homo sapiens
tgtgtgaaattcacc

SEQ ID NO: 162645 - DNA, 15 bp, Homo sapiens
ttgtgtgaaattcac

SEQ ID NO: 162646 - DNA, 15 bp, Homo sapiens
attgtgtgaaattca

SEQ ID NO: 162647 - DNA, 15 bp, Homo sapiens
gattgtgtgaaattc

SEQ ID NO: 162648 - DNA, 15 bp, Homo sapiens
agattgtgtgaaatt

SEQ ID NO: 162649 - DNA, 15 bp, Homo sapiens
tagattgtgtgaaat

SEQ ID NO: 162650 - DNA, 15 bp, Homo sapiens
ttagattgtgtgaaa

SEQ ID NO: 162651 - DNA, 15 bp, Homo sapiens
tttagattgtgtgaa

SEQ ID NO: 162652 - DNA, 15 bp, Homo sapiens
ttttagattgtgtga

SEQ ID NO: 162653 - DNA, 15 bp, Homo sapiens
attttagattgtgtg

SEQ ID NO: 162654 - DNA, 15 bp, Homo sapiens
aattttagattgtgt

SEQ ID NO: 162655 - DNA, 15 bp, Homo sapiens
taattttagattgtg

SEQ ID NO: 162656 - DNA, 15 bp, Homo sapiens
ttaattttagattgt

SEQ ID NO: 162657 - DNA, 15 bp, Homo sapiens
gttaattttagattg

SEQ ID NO: 162658 - DNA, 15 bp, Homo sapiens
ggttaattttagatt

SEQ ID NO: 162659 - DNA, 15 bp, Homo sapiens
tggttaattttagat

SEQ ID NO: 162660 - DNA, 15 bp, Homo sapiens
ttggttaattttaga

SEQ ID NO: 162661 - DNA, 15 bp, Homo sapiens
tttggttaattttag

SEQ ID NO: 162662 - DNA, 15 bp, Homo sapiens
ctttggttaatttta

SEQ ID NO: 162663 - DNA, 15 bp, Homo sapiens
actttggttaatttt

SEQ ID NO: 162664 - DNA, 15 bp, Homo sapiens
cactttggttaattt

SEQ ID NO: 162665 - DNA, 15 bp, Homo sapiens
tcactttggttaatt

SEQ ID NO: 162666 - DNA, 15 bp, Homo sapiens
ttcactttggttaat

SEQ ID NO: 162667 - DNA, 15 bp, Homo sapiens
gttcactttggttaa

SEQ ID NO: 162668 - DNA, 15 bp, Homo sapiens
tgttcactttggtta

SEQ ID NO: 162669 - DNA, 15 bp, Homo sapiens
atgttcactttggtt

SEQ ID NO: 162670 - DNA, 15 bp, Homo sapiens
gatgttcactttggt

SEQ ID NO: 162671 - DNA, 15 bp, Homo sapiens
agatgttcactttgg

SEQ ID NO: 162672 - DNA, 15 bp, Homo sapiens
aagatgttcactttg

SEQ ID NO: 162673 - DNA, 15 bp, Homo sapiens
aaagatgttcacttt

SEQ ID NO: 162674 - DNA, 15 bp, Homo sapiens
caaagatgttcactt

SEQ ID NO: 162675 - DNA, 15 bp, Homo sapiens
ccaaagatgttcact

SEQ ID NO: 162676 - DNA, 15 bp, Homo sapiens
accaaagatgttcac

SEQ ID NO: 162677 - DNA, 15 bp, Homo sapiens
taccaaagatgttca

SEQ ID NO: 162678 - DNA, 15 bp, Homo sapiens
ctaccaaagatgttc

SEQ ID NO: 162679 - DNA, 15 bp, Homo sapiens
gctaccaaagatgtt

SEQ ID NO: 162680 - DNA, 15 bp, Homo sapiens
ggctaccaaagatgt

SEQ ID NO: 162681 - DNA, 15 bp, Homo sapiens
aggctaccaaagatg

SEQ ID NO: 162682 - DNA, 15 bp, Homo sapiens
aaggctaccaaagat

SEQ ID NO: 162683 - DNA, 15 bp, Homo sapiens
aaaggctaccaaaga

SEQ ID NO: 162684 - DNA, 15 bp, Homo sapiens
aaaaggctaccaaag

SEQ ID NO: 162685 - DNA, 15 bp, Homo sapiens
taaaaggctaccaaa

SEQ ID NO: 162686 - DNA, 15 bp, Homo sapiens
gtaaaaggctaccaa

SEQ ID NO: 162687 - DNA, 15 bp, Homo sapiens
agtaaaaggctacca

SEQ ID NO: 162688 - DNA, 15 bp, Homo sapiens
aagtaaaaggctacc

SEQ ID NO: 162689 - DNA, 15 bp, Homo sapiens
aaagtaaaaggctac

SEQ ID NO: 162690 - DNA, 15 bp, Homo sapiens
caaagtaaaaggcta

SEQ ID NO: 162691 - DNA, 15 bp, Homo sapiens
tcaaagtaaaaggct

SEQ ID NO: 162692 - DNA, 15 bp, Homo sapiens
atcaaagtaaaaggc

SEQ ID NO: 162693 - DNA, 15 bp, Homo sapiens
aatcaaagtaaaagg

SEQ ID NO: 162694 - DNA, 15 bp, Homo sapiens
aaatcaaagtaaaag

SEQ ID NO: 162695 - DNA, 15 bp, Homo sapiens
aaaatcaaagtaaaa

SEQ ID NO: 162696 - DNA, 15 bp, Homo sapiens
aaaaatcaaagtaaa

SEQ ID NO: 162697 - DNA, 15 bp, Homo sapiens
taaaaatcaaagtaa

SEQ ID NO: 162698 - DNA, 15 bp, Homo sapiens
ataaaaatcaaagta

SEQ ID NO: 162699 - DNA, 15 bp, Homo sapiens
cataaaaatcaaagt

SEQ ID NO: 162700 - DNA, 15 bp, Homo sapiens
acataaaaatcaaag

SEQ ID NO: 162701 - DNA, 15 bp, Homo sapiens
tacataaaaatcaaa

SEQ ID NO: 162702 - DNA, 15 bp, Homo sapiens
atacataaaaatcaa

SEQ ID NO: 162703 - DNA, 15 bp, Homo sapiens
tatacataaaaatca

SEQ ID NO: 162704 - DNA, 15 bp, Homo sapiens
atatacataaaaatc

SEQ ID NO: 162705 - DNA, 15 bp, Homo sapiens
aatatacataaaaat

SEQ ID NO: 162706 - DNA, 15 bp, Homo sapiens
taatatacataaaaa

SEQ ID NO: 162707 - DNA, 15 bp, Homo sapiens
ataatatacataaaa

SEQ ID NO: 162708 - DNA, 15 bp, Homo sapiens
aataatatacataaa

SEQ ID NO: 162709 - DNA, 15 bp, Homo sapiens
taataatatacataa

SEQ ID NO: 162710 - DNA, 15 bp, Homo sapiens
ataataatatacata

SEQ ID NO: 162711 - DNA, 15 bp, Homo sapiens
tataataatatacat

SEQ ID NO: 162712 - DNA, 15 bp, Homo sapiens
ctataataatataca

SEQ ID NO: 162713 - DNA, 15 bp, Homo sapiens
actataataatatac

SEQ ID NO: 162714 - DNA, 15 bp, Homo sapiens
aactataataatata

SEQ ID NO: 162715 - DNA, 15 bp, Homo sapiens
taactataataatat

SEQ ID NO: 162716 - DNA, 15 bp, Homo sapiens
ataactataataata

SEQ ID NO: 162717 - DNA, 15 bp, Homo sapiens
aataactataataat

SEQ ID NO: 162718 - DNA, 15 bp, Homo sapiens
aaataactataataa

SEQ ID NO: 162719 - DNA, 15 bp, Homo sapiens
taaataactataata

SEQ ID NO: 162720 - DNA, 15 bp, Homo sapiens
ttaaataactataat

SEQ ID NO: 162721 - DNA, 15 bp, Homo sapiens
attaaataactataa

SEQ ID NO: 162722 - DNA, 15 bp, Homo sapiens
tattaaataactata

SEQ ID NO: 162723 - DNA, 15 bp, Homo sapiens
ctattaaataactat

SEQ ID NO: 162724 - DNA, 15 bp, Homo sapiens
gctattaaataacta

SEQ ID NO: 162725 - DNA, 15 bp, Homo sapiens
ggctattaaataact

SEQ ID NO: 162726 - DNA, 15 bp, Homo sapiens
aggctattaaataac

SEQ ID NO: 162727 - DNA, 15 bp, Homo sapiens
gaggctattaaataa

SEQ ID NO: 162728 - DNA, 15 bp, Homo sapiens
agaggctattaaata

SEQ ID NO: 162729 - DNA, 15 bp, Homo sapiens
tagaggctattaaat

SEQ ID NO: 162730 - DNA, 15 bp, Homo sapiens
ttagaggctattaaa

SEQ ID NO: 162731 - DNA, 15 bp, Homo sapiens
tttttagaggctatt

SEQ ID NO: 162732 - DNA, 15 bp, Homo sapiens
atttttagaggctat

SEQ ID NO: 162733 - DNA, 15 bp, Homo sapiens
tatttttagaggcta

SEQ ID NO: 162734 - DNA, 15 bp, Homo sapiens
gtatttttagaggct

SEQ ID NO: 162735 - DNA, 15 bp, Homo sapiens
ggtatttttagaggc

SEQ ID NO: 162736 - DNA, 15 bp, Homo sapiens
gggtatttttagagg

SEQ ID NO: 162737 - DNA, 15 bp, Homo sapiens
tgggtatttttagag

SEQ ID NO: 162738 - DNA, 15 bp, Homo sapiens
ctgggtatttttaga

SEQ ID NO: 162739 - DNA, 15 bp, Homo sapiens
tctgggtatttttag

SEQ ID NO: 162740 - DNA, 15 bp, Homo sapiens
ttctgggtattttta

SEQ ID NO: 162741 - DNA, 15 bp, Homo sapiens
attctgggtattttt

SEQ ID NO: 162742 - DNA, 15 bp, Homo sapiens
cattctgggtatttt

SEQ ID NO: 162743 - DNA, 15 bp, Homo sapiens
ccattctgggtattt

SEQ ID NO: 162744 - DNA, 15 bp, Homo sapiens
gccattctgggtatt

SEQ ID NO: 162745 - DNA, 15 bp, Homo sapiens
agccattctgggtat

SEQ ID NO: 162746 - DNA, 15 bp, Homo sapiens
aagccattctgggta

SEQ ID NO: 162747 - DNA, 15 bp, Homo sapiens
taagccattctgggt

SEQ ID NO: 162748 - DNA, 15 bp, Homo sapiens
gtaagccattctggg

SEQ ID NO: 162749 - DNA, 15 bp, Homo sapiens
ggtaagccattctgg

SEQ ID NO: 162750 - DNA, 15 bp, Homo sapiens
tggtaagccattctg

SEQ ID NO: 162751 - DNA, 15 bp, Homo sapiens
gtggtaagccattct

SEQ ID NO: 162752 - DNA, 15 bp, Homo sapiens
agtggtaagccattc

SEQ ID NO: 162753 - DNA, 15 bp, Homo sapiens
aagtggtaagccatt

SEQ ID NO: 162754 - DNA, 15 bp, Homo sapiens
gaagtggtaagccat

SEQ ID NO: 162755 - DNA, 15 bp, Homo sapiens
ggaagtggtaagcca

SEQ ID NO: 162756 - DNA, 15 bp, Homo sapiens
aggaagtggtaagcc

SEQ ID NO: 162757 - DNA, 15 bp, Homo sapiens
aaggaagtggtaagc

SEQ ID NO: 162758 - DNA, 15 bp, Homo sapiens
aaaggaagtggtaag

SEQ ID NO: 162759 - DNA, 15 bp, Homo sapiens
aaaaggaagtggtaa

SEQ ID NO: 162760 - DNA, 15 bp, Homo sapiens
gaaaaggaagtggta

SEQ ID NO: 162761 - DNA, 15 bp, Homo sapiens
tgaaaaggaagtggt

SEQ ID NO: 162762 - DNA, 15 bp, Homo sapiens
ttgaaaaggaagtgg

SEQ ID NO: 162763 - DNA, 15 bp, Homo sapiens
cttgaaaaggaagtg

SEQ ID NO: 162764 - DNA, 15 bp, Homo sapiens
tcttgaaaaggaagt

SEQ ID NO: 162765 - DNA, 15 bp, Homo sapiens
ttcttgaaaaggaag

SEQ ID NO: 162766 - DNA, 15 bp, Homo sapiens
tttcttgaaaaggaa

SEQ ID NO: 162767 - DNA, 15 bp, Homo sapiens
ttttcttgaaaagga

SEQ ID NO: 162768 - DNA, 15 bp, Homo sapiens
cttttcttgaaaagg

SEQ ID NO: 162769 - DNA, 15 bp, Homo sapiens
tcttttcttgaaaag

SEQ ID NO: 162770 - DNA, 15 bp, Homo sapiens
ttcttttcttgaaaa

SEQ ID NO: 162771 - DNA, 15 bp, Homo sapiens
attcttttcttgaaa

SEQ ID NO: 162772 - DNA, 15 bp, Homo sapiens
aattcttttcttgaa

SEQ ID NO: 162773 - DNA, 15 bp, Homo sapiens
gaattcttttcttga

SEQ ID NO: 162774 - DNA, 15 bp, Homo sapiens
agaattcttttcttg

SEQ ID NO: 162775 - DNA, 15 bp, Homo sapiens
aagaattcttttctt

SEQ ID NO: 162776 - DNA, 15 bp, Homo sapiens
aaagaattcttttct

SEQ ID NO: 162777 - DNA, 15 bp, Homo sapiens
taaagaattcttttc

SEQ ID NO: 162778 - DNA, 15 bp, Homo sapiens
ctaaagaattctttt

SEQ ID NO: 162779 - DNA, 15 bp, Homo sapiens
actaaagaattcttt

SEQ ID NO: 162780 - DNA, 15 bp, Homo sapiens
gactaaagaattctt

SEQ ID NO: 162781 - DNA, 15 bp, Homo sapiens
agactaaagaattct

SEQ ID NO: 162782 - DNA, 15 bp, Homo sapiens
gagactaaagaattc

SEQ ID NO: 162783 - DNA, 15 bp, Homo sapiens
ggagactaaagaatt

SEQ ID NO: 162784 - DNA, 15 bp, Homo sapiens
gggagactaaagaat

SEQ ID NO: 162785 - DNA, 15 bp, Homo sapiens
ggggagactaaagaa

SEQ ID NO: 162786 - DNA, 15 bp, Homo sapiens
tggggagactaaaga

SEQ ID NO: 162787 - DNA, 15 bp, Homo sapiens
ttggggagactaaag

SEQ ID NO: 162788 - DNA, 15 bp, Homo sapiens
tttggggagactaaa

SEQ ID NO: 162789 - DNA, 15 bp, Homo sapiens
atttggggagactaa

SEQ ID NO: 162790 - DNA, 15 bp, Homo sapiens
gatttggggagacta

SEQ ID NO: 162791 - DNA, 15 bp, Homo sapiens
agatttggggagact

SEQ ID NO: 162792 - DNA, 15 bp, Homo sapiens
aagatttggggagac

SEQ ID NO: 162793 - DNA, 15 bp, Homo sapiens
taagatttggggaga

SEQ ID NO: 162794 - DNA, 15 bp, Homo sapiens
ataagatttggggag

SEQ ID NO: 162795 - DNA, 15 bp, Homo sapiens
cataagatttgggga

SEQ ID NO: 162796 - DNA, 15 bp, Homo sapiens
gcataagatttgggg

SEQ ID NO: 162797 - DNA, 15 bp, Homo sapiens
ggcataagatttggg

SEQ ID NO: 162798 - DNA, 15 bp, Homo sapiens
gggcataagatttgg

SEQ ID NO: 162799 - DNA, 15 bp, Homo sapiens
tgggcataagatttg

SEQ ID NO: 162800 - DNA, 15 bp, Homo sapiens
gtgggcataagattt

SEQ ID NO: 162801 - DNA, 15 bp, Homo sapiens
agtgggcataagatt

SEQ ID NO: 162802 - DNA, 15 bp, Homo sapiens
cagtgggcataagat

SEQ ID NO: 162803 - DNA, 15 bp, Homo sapiens
ccagtgggcataaga

SEQ ID NO: 162804 - DNA, 15 bp, Homo sapiens
gccagtgggcataag

SEQ ID NO: 162805 - DNA, 15 bp, Homo sapiens
agccagtgggcataa

SEQ ID NO: 162806 - DNA, 15 bp, Homo sapiens
gagccagtgggcata

SEQ ID NO: 162807 - DNA, 15 bp, Homo sapiens
tgagccagtgggcat

SEQ ID NO: 162808 - DNA, 15 bp, Homo sapiens
atgagccagtgggca

SEQ ID NO: 162809 - DNA, 15 bp, Homo sapiens
aatgagccagtgggc

SEQ ID NO: 162810 - DNA, 15 bp, Homo sapiens
caatgagccagtggg

SEQ ID NO: 162811 - DNA, 15 bp, Homo sapiens
acaatgagccagtgg

SEQ ID NO: 162812 - DNA, 15 bp, Homo sapiens
tacaatgagccagtg

SEQ ID NO: 162813 - DNA, 15 bp, Homo sapiens
gtacaatgagccagt

SEQ ID NO: 162814 - DNA, 15 bp, Homo sapiens
tgtacaatgagccag

SEQ ID NO: 162815 - DNA, 15 bp, Homo sapiens
ctgtacaatgagcca

SEQ ID NO: 162816 - DNA, 15 bp, Homo sapiens
actgtacaatgagcc

SEQ ID NO: 162817 - DNA, 15 bp, Homo sapiens
gactgtacaatgagc

SEQ ID NO: 162818 - DNA, 15 bp, Homo sapiens
agactgtacaatgag

SEQ ID NO: 162819 - DNA, 15 bp, Homo sapiens
gagactgtacaatga

SEQ ID NO: 162820 - DNA, 15 bp, Homo sapiens
agagactgtacaatg

SEQ ID NO: 162821 - DNA, 15 bp, Homo sapiens
gagagactgtacaat

SEQ ID NO: 162822 - DNA, 15 bp, Homo sapiens
agagagactgtacaa

SEQ ID NO: 162823 - DNA, 15 bp, Homo sapiens
cagagagactgtaca

SEQ ID NO: 162824 - DNA, 15 bp, Homo sapiens
tcagagagactgtac

SEQ ID NO: 162825 - DNA, 15 bp, Homo sapiens
ttcagagagactgta

SEQ ID NO: 162826 - DNA, 15 bp, Homo sapiens
attcagagagactgt

SEQ ID NO: 162827 - DNA, 15 bp, Homo sapiens
aattcagagagactg

SEQ ID NO: 162828 - DNA, 15 bp, Homo sapiens
gaattcagagagact

SEQ ID NO: 162829 - DNA, 15 bp, Homo sapiens
agaattcagagagac

SEQ ID NO: 162830 - DNA, 15 bp, Homo sapiens
tagaattcagagaga

SEQ ID NO: 162831 - DNA, 15 bp, Homo sapiens
atagaattcagagag

SEQ ID NO: 162832 - DNA, 15 bp, Homo sapiens
catagaattcagaga

SEQ ID NO: 162833 - DNA, 15 bp, Homo sapiens
gcatagaattcagag

SEQ ID NO: 162834 - DNA, 15 bp, Homo sapiens
ggcatagaattcaga

SEQ ID NO: 162835 - DNA, 15 bp, Homo sapiens
tggcatagaattcag

SEQ ID NO: 162836 - DNA, 15 bp, Homo sapiens
ctggcatagaattca

SEQ ID NO: 162837 - DNA, 15 bp, Homo sapiens
actggcatagaattc

SEQ ID NO: 162838 - DNA, 15 bp, Homo sapiens
aactggcatagaatt

SEQ ID NO: 162839 - DNA, 15 bp, Homo sapiens
gaactggcatagaat

SEQ ID NO: 162840 - DNA, 15 bp, Homo sapiens
ggaactggcatagaa

SEQ ID NO: 162841 - DNA, 15 bp, Homo sapiens
cggaactggcataga

SEQ ID NO: 162842 - DNA, 15 bp, Homo sapiens
gcggaactggcatag

SEQ ID NO: 162843 - DNA, 15 bp, Homo sapiens
agcggaactggcata

SEQ ID NO: 162844 - DNA, 15 bp, Homo sapiens
gagcggaactggcat

SEQ ID NO: 162845 - DNA, 15 bp, Homo sapiens
agagcggaactggca

SEQ ID NO: 162846 - DNA, 15 bp, Homo sapiens
aagagcggaactggc

SEQ ID NO: 162847 - DNA, 15 bp, Homo sapiens
taagagcggaactgg

SEQ ID NO: 162848 - DNA, 15 bp, Homo sapiens
ataagagcggaactg

SEQ ID NO: 162849 - DNA, 15 bp, Homo sapiens
tataagagcggaact

SEQ ID NO: 162850 - DNA, 15 bp, Homo sapiens
ttataagagcggaac

SEQ ID NO: 162851 - DNA, 15 bp, Homo sapiens
tttataagagcggaa

SEQ ID NO: 162852 - DNA, 15 bp, Homo sapiens
atttataagagcgga

SEQ ID NO: 162853 - DNA, 15 bp, Homo sapiens
aatttataagagcgg

SEQ ID NO: 162854 - DNA, 15 bp, Homo sapiens
caatttataagagcg

SEQ ID NO: 162855 - DNA, 15 bp, Homo sapiens
acaatttataagagc

SEQ ID NO: 162856 - DNA, 15 bp, Homo sapiens
cacaatttataagag

SEQ ID NO: 162857 - DNA, 15 bp, Homo sapiens
tcacaatttataaga

SEQ ID NO: 162858 - DNA, 15 bp, Homo sapiens
ctcacaatttataag

SEQ ID NO: 162859 - DNA, 15 bp, Homo sapiens
gctcacaatttataa

SEQ ID NO: 162860 - DNA, 15 bp, Homo sapiens
ggctcacaatttata

SEQ ID NO: 162861 - DNA, 15 bp, Homo sapiens
aggctcacaatttat

SEQ ID NO: 162862 - DNA, 15 bp, Homo sapiens
caggctcacaattta

SEQ ID NO: 162863 - DNA, 15 bp, Homo sapiens
acaggctcacaattt

SEQ ID NO: 162864 - DNA, 15 bp, Homo sapiens
cacaggctcacaatt

SEQ ID NO: 162865 - DNA, 15 bp, Homo sapiens
acacaggctcacaat

SEQ ID NO: 162866 - DNA, 15 bp, Homo sapiens
aacacaggctcacaa

SEQ ID NO: 162867 - DNA, 15 bp, Homo sapiens
aaacacaggctcaca

SEQ ID NO: 162868 - DNA, 15 bp, Homo sapiens
gaaacacaggctcac

SEQ ID NO: 162869 - DNA, 15 bp, Homo sapiens
agaaacacaggctca

SEQ ID NO: 162870 - DNA, 15 bp, Homo sapiens
aagaaacacaggctc

SEQ ID NO: 162871 - DNA, 15 bp, Homo sapiens
caagaaacacaggct

SEQ ID NO: 162872 - DNA, 15 bp, Homo sapiens
acaagaaacacaggc

SEQ ID NO: 162873 - DNA, 15 bp, Homo sapiens
cacaagaaacacagg

SEQ ID NO: 162874 - DNA, 15 bp, Homo sapiens
gcacaagaaacacag

SEQ ID NO: 162875 - DNA, 15 bp, Homo sapiens
ggcacaagaaacaca

SEQ ID NO: 162876 - DNA, 15 bp, Homo sapiens
tggcacaagaaacac

SEQ ID NO: 162877 - DNA, 15 bp, Homo sapiens
ctggcacaagaaaca

SEQ ID NO: 162878 - DNA, 15 bp, Homo sapiens
cctggcacaagaaac

SEQ ID NO: 162879 - DNA, 15 bp, Homo sapiens
acctggcacaagaaa

SEQ ID NO: 162880 - DNA, 15 bp, Homo sapiens
aacctggcacaagaa

SEQ ID NO: 162881 - DNA, 15 bp, Homo sapiens
gaacctggcacaaga

SEQ ID NO: 162882 - DNA, 15 bp, Homo sapiens
agaacctggcacaag

SEQ ID NO: 162883 - DNA, 15 bp, Homo sapiens
tagaacctggcacaa

SEQ ID NO: 162884 - DNA, 15 bp, Homo sapiens
atagaacctggcaca

SEQ ID NO: 162885 - DNA, 15 bp, Homo sapiens
aatagaacctggcac

SEQ ID NO: 162886 - DNA, 15 bp, Homo sapiens
gaatagaacctggca

SEQ ID NO: 162887 - DNA, 15 bp, Homo sapiens
ggaatagaacctggc

SEQ ID NO: 162888 - DNA, 15 bp, Homo sapiens
tggaatagaacctgg

SEQ ID NO: 162889 - DNA, 15 bp, Homo sapiens
ctggaatagaacctg

SEQ ID NO: 162890 - DNA, 15 bp, Homo sapiens
cctggaatagaacct

SEQ ID NO: 162891 - DNA, 15 bp, Homo sapiens
gcctggaatagaacc

SEQ ID NO: 162892 - DNA, 15 bp, Homo sapiens
cgcctggaatagaac

SEQ ID NO: 162893 - DNA, 15 bp, Homo sapiens
gcgcctggaatagaa

SEQ ID NO: 162894 - DNA, 15 bp, Homo sapiens
tgcgcctggaataga

SEQ ID NO: 162895 - DNA, 15 bp, Homo sapiens
ctgcgcctggaatag

SEQ ID NO: 162896 - DNA, 15 bp, Homo sapiens
cctgcgcctggaata

SEQ ID NO: 162897 - DNA, 15 bp, Homo sapiens
acctgcgcctggaat

SEQ ID NO: 162898 - DNA, 15 bp, Homo sapiens
cacctgcgcctggaa

SEQ ID NO: 162899 - DNA, 15 bp, Homo sapiens
ccacctgcgcctgga

SEQ ID NO: 162900 - DNA, 15 bp, Homo sapiens
cccacctgcgcctgg

SEQ ID NO: 162901 - DNA, 15 bp, Homo sapiens
gcccacctgcgcctg

SEQ ID NO: 162902 - DNA, 15 bp, Homo sapiens
tgcccacctgcgcct

SEQ ID NO: 162903 - DNA, 15 bp, Homo sapiens
atgcccacctgcgcc

SEQ ID NO: 162904 - DNA, 15 bp, Homo sapiens
gatgcccacctgcgc

SEQ ID NO: 162905 - DNA, 15 bp, Homo sapiens
tgatgcccacctgcg

SEQ ID NO: 162906 - DNA, 15 bp, Homo sapiens
ctgatgcccacctgc

SEQ ID NO: 162907 - DNA, 15 bp, Homo sapiens
actgatgcccacctg

SEQ ID NO: 162908 - DNA, 15 bp, Homo sapiens
cactgatgcccacct

SEQ ID NO: 162909 - DNA, 15 bp, Homo sapiens
gcactgatgcccacc

SEQ ID NO: 162910 - DNA, 15 bp, Homo sapiens
tgcactgatgcccac

SEQ ID NO: 162911 - DNA, 15 bp, Homo sapiens
ctgcactgatgccca

SEQ ID NO: 162912 - DNA, 15 bp, Homo sapiens
gctgcactgatgccc

SEQ ID NO: 162913 - DNA, 15 bp, Homo sapiens
ggctgcactgatgcc

SEQ ID NO: 162914 - DNA, 15 bp, Homo sapiens
tggctgcactgatgc

SEQ ID NO: 162915 - DNA, 15 bp, Homo sapiens
ctggctgcactgatg

SEQ ID NO: 162916 - DNA, 15 bp, Homo sapiens
gctggctgcactgat

SEQ ID NO: 162917 - DNA, 15 bp, Homo sapiens
ggctggctgcactga

SEQ ID NO: 162918 - DNA, 15 bp, Homo sapiens
gggctggctgcactg

SEQ ID NO: 162919 - DNA, 15 bp, Homo sapiens
cgggctggctgcact

SEQ ID NO: 162920 - DNA, 15 bp, Homo sapiens
gcgggctggctgcac

SEQ ID NO: 162921 - DNA, 15 bp, Homo sapiens
ggcgggctggctgca

SEQ ID NO: 162922 - DNA, 15 bp, Homo sapiens
tggcgggctggctgc

SEQ ID NO: 162923 - DNA, 15 bp, Homo sapiens
atggcgggctggctg

SEQ ID NO: 162924 - DNA, 15 bp, Homo sapiens
tatggcgggctggct

SEQ ID NO: 162925 - DNA, 15 bp, Homo sapiens
ctatggcgggctggc

SEQ ID NO: 162926 - DNA, 15 bp, Homo sapiens
gctatggcgggctgg

SEQ ID NO: 162927 - DNA, 15 bp, Homo sapiens
cgctatggcgggctg

SEQ ID NO: 162928 - DNA, 15 bp, Homo sapiens
acgctatggcgggct

SEQ ID NO: 162929 - DNA, 15 bp, Homo sapiens
aacgctatggcgggc

SEQ ID NO: 162930 - DNA, 15 bp, Homo sapiens
gaacgctatggcggg

SEQ ID NO: 162931 - DNA, 15 bp, Homo sapiens
agaacgctatggcgg

SEQ ID NO: 162932 - DNA, 15 bp, Homo sapiens
tagaacgctatggcg

SEQ ID NO: 162933 - DNA, 15 bp, Homo sapiens
gtagaacgctatggc

SEQ ID NO: 162934 - DNA, 15 bp, Homo sapiens
ggtagaacgctatgg

SEQ ID NO: 162935 - DNA, 15 bp, Homo sapiens
tggtagaacgctatg

SEQ ID NO: 162936 - DNA, 15 bp, Homo sapiens
gtggtagaacgctat

SEQ ID NO: 162937 - DNA, 15 bp, Homo sapiens
ggtggtagaacgcta

SEQ ID NO: 162938 - DNA, 15 bp, Homo sapiens
aggtggtagaacgct

SEQ ID NO: 162939 - DNA, 15 bp, Homo sapiens
caggtggtagaacgc

SEQ ID NO: 162940 - DNA, 15 bp, Homo sapiens
ccaggtggtagaacg

SEQ ID NO: 162941 - DNA, 15 bp, Homo sapiens
accaggtggtagaac

SEQ ID NO: 162942 - DNA, 15 bp, Homo sapiens
caccaggtggtagaa

SEQ ID NO: 162943 - DNA, 15 bp, Homo sapiens
acaccaggtggtaga

SEQ ID NO: 162944 - DNA, 15 bp, Homo sapiens
tacaccaggtggtag

SEQ ID NO: 162945 - DNA, 15 bp, Homo sapiens
ctacaccaggtggta

SEQ ID NO: 162946 - DNA, 15 bp, Homo sapiens
tctacaccaggtggt

SEQ ID NO: 162947 - DNA, 15 bp, Homo sapiens
ttctacaccaggtgg

SEQ ID NO: 162948 - DNA, 15 bp, Homo sapiens
tttctacaccaggtg

SEQ ID NO: 162949 - DNA, 15 bp, Homo sapiens
atttctacaccaggt

SEQ ID NO: 162950 - DNA, 15 bp, Homo sapiens
gatttctacaccagg

SEQ ID NO: 162951 - DNA, 15 bp, Homo sapiens
agatttctacaccag

SEQ ID NO: 162952 - DNA, 15 bp, Homo sapiens
cagatttctacacca

SEQ ID NO: 162953 - DNA, 15 bp, Homo sapiens
acagatttctacacc

SEQ ID NO: 162954 - DNA, 15 bp, Homo sapiens
aacagatttctacac

SEQ ID NO: 162955 - DNA, 15 bp, Homo sapiens
taacagatttctaca

SEQ ID NO: 162956 - DNA, 15 bp, Homo sapiens
ctaacagatttctac

SEQ ID NO: 162957 - DNA, 15 bp, Homo sapiens
cctaacagatttcta

SEQ ID NO: 162958 - DNA, 15 bp, Homo sapiens
tcctaacagatttct

SEQ ID NO: 162959 - DNA, 15 bp, Homo sapiens
ttcctaacagatttc

SEQ ID NO: 162960 - DNA, 15 bp, Homo sapiens
attcctaacagattt

SEQ ID NO: 162961 - DNA, 15 bp, Homo sapiens
tattcctaacagatt

SEQ ID NO: 162962 - DNA, 15 bp, Homo sapiens
gtattcctaacagat

SEQ ID NO: 162963 - DNA, 15 bp, Homo sapiens
cgtattcctaacaga

SEQ ID NO: 162964 - DNA, 15 bp, Homo sapiens
ccgtattcctaacag

SEQ ID NO: 162965 - DNA, 15 bp, Homo sapiens
cccgtattcctaaca

SEQ ID NO: 162966 - DNA, 15 bp, Homo sapiens
tcccgtattcctaac

SEQ ID NO: 162967 - DNA, 15 bp, Homo sapiens
ttcccgtattcctaa

SEQ ID NO: 162968 - DNA, 15 bp, Homo sapiens
cttcccgtattccta

SEQ ID NO: 162969 - DNA, 15 bp, Homo sapiens
tcttcccgtattcct

SEQ ID NO: 162970 - DNA, 15 bp, Homo sapiens
gtcttcccgtattcc

SEQ ID NO: 162971 - DNA, 15 bp, Homo sapiens
agtcttcccgtattc

SEQ ID NO: 162972 - DNA, 15 bp, Homo sapiens
tagtcttcccgtatt

SEQ ID NO: 162973 - DNA, 15 bp, Homo sapiens
atagtcttcccgtat

SEQ ID NO: 162974 - DNA, 15 bp, Homo sapiens
aatagtcttcccgta

SEQ ID NO: 162975 - DNA, 15 bp, Homo sapiens
aaatagtcttcccgt

SEQ ID NO: 162976 - DNA, 15 bp, Homo sapiens
caaatagtcttcccg

SEQ ID NO: 162977 - DNA, 15 bp, Homo sapiens
acaaatagtcttccc

SEQ ID NO: 162978 - DNA, 15 bp, Homo sapiens
cacaaatagtcttcc

SEQ ID NO: 162979 - DNA, 15 bp, Homo sapiens
ccacaaatagtcttc

SEQ ID NO: 162980 - DNA, 15 bp, Homo sapiens
gccacaaatagtctt

SEQ ID NO: 162981 - DNA, 15 bp, Homo sapiens
ggccacaaatagtct

SEQ ID NO: 162982 - DNA, 15 bp, Homo sapiens
aggccacaaatagtc

SEQ ID NO: 162983 - DNA, 15 bp, Homo sapiens
aaggccacaaatagt

SEQ ID NO: 162984 - DNA, 15 bp, Homo sapiens
aaaggccacaaatag

SEQ ID NO: 162985 - DNA, 15 bp, Homo sapiens
taaaggccacaaata

SEQ ID NO: 162986 - DNA, 15 bp, Homo sapiens
ataaaggccacaaat

SEQ ID NO: 162987 - DNA, 15 bp, Homo sapiens
aataaaggccacaaa

SEQ ID NO: 162988 - DNA, 15 bp, Homo sapiens
caataaaggccacaa

SEQ ID NO: 162989 - DNA, 15 bp, Homo sapiens
tcaataaaggccaca

SEQ ID NO: 162990 - DNA, 15 bp, Homo sapiens
gtcaataaaggccac

SEQ ID NO: 162991 - DNA, 15 bp, Homo sapiens
agtcaataaaggcca

SEQ ID NO: 162992 - DNA, 15 bp, Homo sapiens
tagtcaataaaggcc

SEQ ID NO: 162993 - DNA, 15 bp, Homo sapiens
atagtcaataaaggc

SEQ ID NO: 162994 - DNA, 15 bp, Homo sapiens
gatagtcaataaagg

SEQ ID NO: 162995 - DNA, 15 bp, Homo sapiens
ggatagtcaataaag

SEQ ID NO: 162996 - DNA, 15 bp, Homo sapiens
aggatagtcaataaa

SEQ ID NO: 162997 - DNA, 15 bp, Homo sapiens
aaggatagtcaataa

SEQ ID NO: 162998 - DNA, 15 bp, Homo sapiens
aaaggatagtcaata

SEQ ID NO: 162999 - DNA, 15 bp, Homo sapiens
caaaggatagtcaat

SEQ ID NO: 163000 - DNA, 15 bp, Homo sapiens
gcaaaggatagtcaa

SEQ ID NO: 163001 - DNA, 15 bp, Homo sapiens
ggcaaaggatagtca

SEQ ID NO: 163002 - DNA, 15 bp, Homo sapiens
aggcaaaggatagtc

SEQ ID NO: 163003 - DNA, 15 bp, Homo sapiens
aaggcaaaggatagt

SEQ ID NO: 163004 - DNA, 15 bp, Homo sapiens
aaaggcaaaggatag

SEQ ID NO: 163005 - DNA, 15 bp, Homo sapiens
caaaggcaaaggata

SEQ ID NO: 163006 - DNA, 15 bp, Homo sapiens
tcaaaggcaaaggat

SEQ ID NO: 163007 - DNA, 15 bp, Homo sapiens
ttcaaaggcaaagga

SEQ ID NO: 163008 - DNA, 15 bp, Homo sapiens
attcaaaggcaaagg

SEQ ID NO: 163009 - DNA, 15 bp, Homo sapiens
gattcaaaggcaaag

SEQ ID NO: 163010 - DNA, 15 bp, Homo sapiens
ggattcaaaggcaaa

SEQ ID NO: 163011 - DNA, 15 bp, Homo sapiens
cggattcaaaggcaa

SEQ ID NO: 163012 - DNA, 15 bp, Homo sapiens
acggattcaaaggca

SEQ ID NO: 163013 - DNA, 15 bp, Homo sapiens
cacggattcaaaggc

SEQ ID NO: 163014 - DNA, 15 bp, Homo sapiens
tcacggattcaaagg

SEQ ID NO: 163015 - DNA, 15 bp, Homo sapiens
ctcacggattcaaag

SEQ ID NO: 163016 - DNA, 15 bp, Homo sapiens
gctcacggattcaaa

SEQ ID NO: 163017 - DNA, 15 bp, Homo sapiens
tgctcacggattcaa

SEQ ID NO: 163018 - DNA, 15 bp, Homo sapiens
ctgctcacggattca

SEQ ID NO: 163019 - DNA, 15 bp, Homo sapiens
tctgctcacggattc

SEQ ID NO: 163020 - DNA, 15 bp, Homo sapiens
ttctgctcacggatt

SEQ ID NO: 163021 - DNA, 15 bp, Homo sapiens
tttctgctcacggat

SEQ ID NO: 163022 - DNA, 15 bp, Homo sapiens
atttctgctcacgga

SEQ ID NO: 163023 - DNA, 15 bp, Homo sapiens
gatttctgctcacgg

SEQ ID NO: 163024 - DNA, 15 bp, Homo sapiens
agatttctgctcacg

SEQ ID NO: 163025 - DNA, 15 bp, Homo sapiens
tagatttctgctcac

SEQ ID NO: 163026 - DNA, 15 bp, Homo sapiens
atagatttctgctca

SEQ ID NO: 163027 - DNA, 15 bp, Homo sapiens
aatagatttctgctc

SEQ ID NO: 163028 - DNA, 15 bp, Homo sapiens
taatagatttctgct

SEQ ID NO: 163029 - DNA, 15 bp, Homo sapiens
ataatagatttctgc

SEQ ID NO: 163030 - DNA, 15 bp, Homo sapiens
aataatagatttctg

SEQ ID NO: 163031 - DNA, 15 bp, Homo sapiens
caataatagatttct

SEQ ID NO: 163032 - DNA, 15 bp, Homo sapiens
tcaataatagatttc

SEQ ID NO: 163033 - DNA, 15 bp, Homo sapiens
ttcaataatagattt

SEQ ID NO: 163034 - DNA, 15 bp, Homo sapiens
attcaataatagatt

SEQ ID NO: 163035 - DNA, 15 bp, Homo sapiens
tattcaataatagat

SEQ ID NO: 163036 - DNA, 15 bp, Homo sapiens
ttattcaataataga

SEQ ID NO: 163037 - DNA, 15 bp, Homo sapiens
tttattcaataatag

SEQ ID NO: 163038 - DNA, 15 bp, Homo sapiens
ctttattcaataata

SEQ ID NO: 163039 - DNA, 15 bp, Homo sapiens
actttattcaataat

SEQ ID NO: 163040 - DNA, 15 bp, Homo sapiens
gactttattcaataa

SEQ ID NO: 163041 - DNA, 15 bp, Homo sapiens
ggactttattcaata

SEQ ID NO: 163042 - DNA, 15 bp, Homo sapiens
gggactttattcaat

SEQ ID NO: 163043 - DNA, 15 bp, Homo sapiens
tgggactttattcaa

SEQ ID NO: 163044 - DNA, 15 bp, Homo sapiens
atgggactttattca

SEQ ID NO: 163045 - DNA, 15 bp, Homo sapiens
catgggactttattc

SEQ ID NO: 163046 - DNA, 15 bp, Homo sapiens
tcatgggactttatt

SEQ ID NO: 163047 - DNA, 15 bp, Homo sapiens
ttcatgggactttat

SEQ ID NO: 163048 - DNA, 15 bp, Homo sapiens
attcatgggacttta

SEQ ID NO: 163049 - DNA, 15 bp, Homo sapiens
aattcatgggacttt

SEQ ID NO: 163050 - DNA, 15 bp, Homo sapiens
gaattcatgggactt

SEQ ID NO: 163051 - DNA, 15 bp, Homo sapiens
tgaattcatgggact

SEQ ID NO: 163052 - DNA, 15 bp, Homo sapiens
ttgaattcatgggac

SEQ ID NO: 163053 - DNA, 15 bp, Homo sapiens
attgaattcatggga

SEQ ID NO: 163054 - DNA, 15 bp, Homo sapiens
aattgaattcatggg

SEQ ID NO: 163055 - DNA, 15 bp, Homo sapiens
gaattgaattcatgg

SEQ ID NO: 163056 - DNA, 15 bp, Homo sapiens
tgaattgaattcatg

SEQ ID NO: 163057 - DNA, 15 bp, Homo sapiens
ttgaattgaattcat

SEQ ID NO: 163058 - DNA, 15 bp, Homo sapiens
tttgaattgaattca

SEQ ID NO: 163059 - DNA, 15 bp, Homo sapiens
gtttgaattgaattc

SEQ ID NO: 163060 - DNA, 15 bp, Homo sapiens
ggtttgaattgaatt

SEQ ID NO: 163061 - DNA, 15 bp, Homo sapiens
gggtttgaattgaat

SEQ ID NO: 163062 - DNA, 15 bp, Homo sapiens
agggtttgaattgaa

SEQ ID NO: 163063 - DNA, 15 bp, Homo sapiens
cagggtttgaattga

SEQ ID NO: 163064 - DNA, 15 bp, Homo sapiens
gcagggtttgaattg

SEQ ID NO: 163065 - DNA, 15 bp, Homo sapiens
tgcagggtttgaatt

SEQ ID NO: 163066 - DNA, 15 bp, Homo sapiens
atgcagggtttgaat

SEQ ID NO: 163067 - DNA, 15 bp, Homo sapiens
aatgcagggtttgaa

SEQ ID NO: 163068 - DNA, 15 bp, Homo sapiens
taatgcagggtttga

SEQ ID NO: 163069 - DNA, 15 bp, Homo sapiens
ataatgcagggtttg

SEQ ID NO: 163070 - DNA, 15 bp, Homo sapiens
aataatgcagggttt

SEQ ID NO: 163071 - DNA, 15 bp, Homo sapiens
caataatgcagggtt

SEQ ID NO: 163072 - DNA, 15 bp, Homo sapiens
tcaataatgcagggt

SEQ ID NO: 163073 - DNA, 15 bp, Homo sapiens
atcaataatgcaggg

SEQ ID NO: 163074 - DNA, 15 bp, Homo sapiens
aatcaataatgcagg

SEQ ID NO: 163075 - DNA, 15 bp, Homo sapiens
aaatcaataatgcag

SEQ ID NO: 163076 - DNA, 15 bp, Homo sapiens
aaaatcaataatgca

SEQ ID NO: 163077 - DNA, 15 bp, Homo sapiens
gaaaatcaataatgc

SEQ ID NO: 163078 - DNA, 15 bp, Homo sapiens
tgaaaatcaataatg

SEQ ID NO: 163079 - DNA, 15 bp, Homo sapiens
ttgaaaatcaataat

SEQ ID NO: 163080 - DNA, 15 bp, Homo sapiens
cttgaaaatcaataa

SEQ ID NO: 163081 - DNA, 15 bp, Homo sapiens
gcttgaaaatcaata

SEQ ID NO: 163082 - DNA, 15 bp, Homo sapiens
tgcttgaaaatcaat

SEQ ID NO: 163083 - DNA, 15 bp, Homo sapiens
ctgcttgaaaatcaa

SEQ ID NO: 163084 - DNA, 15 bp, Homo sapiens
tctgcttgaaaatca

SEQ ID NO: 163085 - DNA, 15 bp, Homo sapiens
ttctgcttgaaaatc

SEQ ID NO: 163086 - DNA, 15 bp, Homo sapiens
gttctgcttgaaaat

SEQ ID NO: 163087 - DNA, 15 bp, Homo sapiens
agttctgcttgaaaa

SEQ ID NO: 163088 - DNA, 15 bp, Homo sapiens
aagttctgcttgaaa

SEQ ID NO: 163089 - DNA, 15 bp, Homo sapiens
caagttctgcttgaa

SEQ ID NO: 163090 - DNA, 15 bp, Homo sapiens
acaagttctgcttga

SEQ ID NO: 163091 - DNA, 15 bp, Homo sapiens
cacaagttctgcttg

SEQ ID NO: 163092 - DNA, 15 bp, Homo sapiens
gcacaagttctgctt

SEQ ID NO: 163093 - DNA, 15 bp, Homo sapiens
ggcacaagttctgct

SEQ ID NO: 163094 - DNA, 15 bp, Homo sapiens
tggcacaagttctgc

SEQ ID NO: 163095 - DNA, 15 bp, Homo sapiens
atggcacaagttctg

SEQ ID NO: 163096 - DNA, 15 bp, Homo sapiens
tatggcacaagttct

SEQ ID NO: 163097 - DNA, 15 bp, Homo sapiens
ttatggcacaagttc

SEQ ID NO: 163098 - DNA, 15 bp, Homo sapiens
attatggcacaagtt

SEQ ID NO: 163099 - DNA, 15 bp, Homo sapiens
tattatggcacaagt

SEQ ID NO: 163100 - DNA, 15 bp, Homo sapiens
gtattatggcacaag

SEQ ID NO: 163101 - DNA, 15 bp, Homo sapiens
agtattatggcacaa

SEQ ID NO: 163102 - DNA, 15 bp, Homo sapiens
cagtattatggcaca

SEQ ID NO: 163103 - DNA, 15 bp, Homo sapiens
acagtattatggcac

SEQ ID NO: 163104 - DNA, 15 bp, Homo sapiens
aacagtattatggca

SEQ ID NO: 163105 - DNA, 15 bp, Homo sapiens
taacagtattatggc

SEQ ID NO: 163106 - DNA, 15 bp, Homo sapiens
ataacagtattatgg

SEQ ID NO: 163107 - DNA, 15 bp, Homo sapiens
tataacagtattatg

SEQ ID NO: 163108 - DNA, 15 bp, Homo sapiens
gtataacagtattat

SEQ ID NO: 163109 - DNA, 15 bp, Homo sapiens
agtataacagtatta

SEQ ID NO: 163110 - DNA, 15 bp, Homo sapiens
cagtataacagtatt

SEQ ID NO: 163111 - DNA, 15 bp, Homo sapiens
acagtataacagtat

SEQ ID NO: 163112 - DNA, 15 bp, Homo sapiens
tacagtataacagta

SEQ ID NO: 163113 - DNA, 15 bp, Homo sapiens
ctacagtataacagt

SEQ ID NO: 163114 - DNA, 15 bp, Homo sapiens
actacagtataacag

SEQ ID NO: 163115 - DNA, 15 bp, Homo sapiens
aactacagtataaca

SEQ ID NO: 163116 - DNA, 15 bp, Homo sapiens
caactacagtataac

SEQ ID NO: 163117 - DNA, 15 bp, Homo sapiens
ccaactacagtataa

SEQ ID NO: 163118 - DNA, 15 bp, Homo sapiens
accaactacagtata

SEQ ID NO: 163119 - DNA, 15 bp, Homo sapiens
aaccaactacagtat

SEQ ID NO: 163120 - DNA, 15 bp, Homo sapiens
taaccaactacagta

SEQ ID NO: 163121 - DNA, 15 bp, Homo sapiens
gtaaccaactacagt

SEQ ID NO: 163122 - DNA, 15 bp, Homo sapiens
tgtaaccaactacag

SEQ ID NO: 163123 - DNA, 15 bp, Homo sapiens
atgtaaccaactaca

SEQ ID NO: 163124 - DNA, 15 bp, Homo sapiens
aatgtaaccaactac

SEQ ID NO: 163125 - DNA, 15 bp, Homo sapiens
gaatgtaaccaacta

SEQ ID NO: 163126 - DNA, 15 bp, Homo sapiens
tgaatgtaaccaact

SEQ ID NO: 163127 - DNA, 15 bp, Homo sapiens
ctgaatgtaaccaac

SEQ ID NO: 163128 - DNA, 15 bp, Homo sapiens
cctgaatgtaaccaa

SEQ ID NO: 163129 - DNA, 15 bp, Homo sapiens
ccctgaatgtaacca

SEQ ID NO: 163130 - DNA, 15 bp, Homo sapiens
accctgaatgtaacc

SEQ ID NO: 163131 - DNA, 15 bp, Homo sapiens
gaccctgaatgtaac

SEQ ID NO: 163132 - DNA, 15 bp, Homo sapiens
tgaccctgaatgtaa

SEQ ID NO: 163133 - DNA, 15 bp, Homo sapiens
ttgaccctgaatgta

SEQ ID NO: 163134 - DNA, 15 bp, Homo sapiens
attgaccctgaatgt

SEQ ID NO: 163135 - DNA, 15 bp, Homo sapiens
tattgaccctgaatg

SEQ ID NO: 163136 - DNA, 15 bp, Homo sapiens
ctattgaccctgaat

SEQ ID NO: 163137 - DNA, 15 bp, Homo sapiens
tctattgaccctgaa

SEQ ID NO: 163138 - DNA, 15 bp, Homo sapiens
ttctattgaccctga

SEQ ID NO: 163139 - DNA, 15 bp, Homo sapiens
tttctattgaccctg

SEQ ID NO: 163140 - DNA, 15 bp, Homo sapiens
atttctattgaccct

SEQ ID NO: 163141 - DNA, 15 bp, Homo sapiens
catttctattgaccc

SEQ ID NO: 163142 - DNA, 15 bp, Homo sapiens
tcatttctattgacc

SEQ ID NO: 163143 - DNA, 15 bp, Homo sapiens
atcatttctattgac

SEQ ID NO: 163144 - DNA, 15 bp, Homo sapiens
aatcatttctattga

SEQ ID NO: 163145 - DNA, 15 bp, Homo sapiens
aaatcatttctattg

SEQ ID NO: 163146 - DNA, 15 bp, Homo sapiens
gaaatcatttctatt

SEQ ID NO: 163147 - DNA, 15 bp, Homo sapiens
agaaatcatttctat

SEQ ID NO: 163148 - DNA, 15 bp, Homo sapiens
aagaaatcatttcta

SEQ ID NO: 163149 - DNA, 15 bp, Homo sapiens
caagaaatcatttct

SEQ ID NO: 163150 - DNA, 15 bp, Homo sapiens
tcaagaaatcatttc

SEQ ID NO: 163151 - DNA, 15 bp, Homo sapiens
ctcaagaaatcattt

SEQ ID NO: 163152 - DNA, 15 bp, Homo sapiens
tctcaagaaatcatt

SEQ ID NO: 163153 - DNA, 15 bp, Homo sapiens
atctcaagaaatcat

SEQ ID NO: 163154 - DNA, 15 bp, Homo sapiens
tatctcaagaaatca

SEQ ID NO: 163155 - DNA, 15 bp, Homo sapiens
atatctcaagaaatc

SEQ ID NO: 163156 - DNA, 15 bp, Homo sapiens
gatatctcaagaaat

SEQ ID NO: 163157 - DNA, 15 bp, Homo sapiens
tgatatctcaagaaa

SEQ ID NO: 163158 - DNA, 15 bp, Homo sapiens
ctgatatctcaagaa

SEQ ID NO: 163159 - DNA, 15 bp, Homo sapiens
actgatatctcaaga

SEQ ID NO: 163160 - DNA, 15 bp, Homo sapiens
cactgatatctcaag

SEQ ID NO: 163161 - DNA, 15 bp, Homo sapiens
ccactgatatctcaa

SEQ ID NO: 163162 - DNA, 15 bp, Homo sapiens
tccactgatatctca

SEQ ID NO: 163163 - DNA, 15 bp, Homo sapiens
atccactgatatctc

SEQ ID NO: 163164 - DNA, 15 bp, Homo sapiens
tatccactgatatct

SEQ ID NO: 163165 - DNA, 15 bp, Homo sapiens
ttatccactgatatc

SEQ ID NO: 163166 - DNA, 15 bp, Homo sapiens
attatccactgatat

SEQ ID NO: 163167 - DNA, 15 bp, Homo sapiens
aattatccactgata

SEQ ID NO: 163168 - DNA, 15 bp, Homo sapiens
aaattatccactgat

SEQ ID NO: 163169 - DNA, 15 bp, Homo sapiens
aaaattatccactga

SEQ ID NO: 163170 - DNA, 15 bp, Homo sapiens
gaaaattatccactg

SEQ ID NO: 163171 - DNA, 15 bp, Homo sapiens
tgaaaattatccact

SEQ ID NO: 163172 - DNA, 15 bp, Homo sapiens
atgaaaattatccac

SEQ ID NO: 163173 - DNA, 15 bp, Homo sapiens
aatgaaaattatcca

SEQ ID NO: 163174 - DNA, 15 bp, Homo sapiens
caatgaaaattatcc

SEQ ID NO: 163175 - DNA, 15 bp, Homo sapiens
ccaatgaaaattatc

SEQ ID NO: 163176 - DNA, 15 bp, Homo sapiens
cccaatgaaaattat

SEQ ID NO: 163177 - DNA, 15 bp, Homo sapiens
tcccaatgaaaatta

SEQ ID NO: 163178 - DNA, 15 bp, Homo sapiens
atcccaatgaaaatt

SEQ ID NO: 163179 - DNA, 15 bp, Homo sapiens
aatcccaatgaaaat

SEQ ID NO: 163180 - DNA, 15 bp, Homo sapiens
taatcccaatgaaaa

SEQ ID NO: 163181 - DNA, 15 bp, Homo sapiens
ctaatcccaatgaaa

SEQ ID NO: 163182 - DNA, 15 bp, Homo sapiens
actaatcccaatgaa

SEQ ID NO: 163183 - DNA, 15 bp, Homo sapiens
gactaatcccaatga

SEQ ID NO: 163184 - DNA, 15 bp, Homo sapiens
tgactaatcccaatg

SEQ ID NO: 163185 - DNA, 15 bp, Homo sapiens
ctgactaatcccaat

SEQ ID NO: 163186 - DNA, 15 bp, Homo sapiens
cctgactaatcccaa

SEQ ID NO: 163187 - DNA, 15 bp, Homo sapiens
tcctgactaatccca

SEQ ID NO: 163188 - DNA, 15 bp, Homo sapiens
ttcctgactaatccc

SEQ ID NO: 163189 - DNA, 15 bp, Homo sapiens
attcctgactaatcc

SEQ ID NO: 163190 - DNA, 15 bp, Homo sapiens
cattcctgactaatc

SEQ ID NO: 163191 - DNA, 15 bp, Homo sapiens
acattcctgactaat

SEQ ID NO: 163192 - DNA, 15 bp, Homo sapiens
cacattcctgactaa

SEQ ID NO: 163193 - DNA, 15 bp, Homo sapiens
acacattcctgacta

SEQ ID NO: 163194 - DNA, 15 bp, Homo sapiens
aacacattcctgact

SEQ ID NO: 163195 - DNA, 15 bp, Homo sapiens
gaacacattcctgac

SEQ ID NO: 163196 - DNA, 15 bp, Homo sapiens
agaacacattcctga

SEQ ID NO: 163197 - DNA, 15 bp, Homo sapiens
cagaacacattcctg

SEQ ID NO: 163198 - DNA, 15 bp, Homo sapiens
acagaacacattcct

SEQ ID NO: 163199 - DNA, 15 bp, Homo sapiens
gacagaacacattcc

SEQ ID NO: 163200 - DNA, 15 bp, Homo sapiens
agacagaacacattc

SEQ ID NO: 163201 - DNA, 15 bp, Homo sapiens
aagacagaacacatt

SEQ ID NO: 163202 - DNA, 15 bp, Homo sapiens
gaagacagaacacat

SEQ ID NO: 163203 - DNA, 15 bp, Homo sapiens
ggaagacagaacaca

SEQ ID NO: 163204 - DNA, 15 bp, Homo sapiens
tggaagacagaacac

SEQ ID NO: 163205 - DNA, 15 bp, Homo sapiens
atggaagacagaaca

SEQ ID NO: 163206 - DNA, 15 bp, Homo sapiens
gatggaagacagaac

SEQ ID NO: 163207 - DNA, 15 bp, Homo sapiens
agatggaagacagaa

SEQ ID NO: 163208 - DNA, 15 bp, Homo sapiens
cagatggaagacaga

SEQ ID NO: 163209 - DNA, 15 bp, Homo sapiens
acagatggaagacag

SEQ ID NO: 163210 - DNA, 15 bp, Homo sapiens
gacagatggaagaca

SEQ ID NO: 163211 - DNA, 15 bp, Homo sapiens
agacagatggaagac

SEQ ID NO: 163212 - DNA, 15 bp, Homo sapiens
cagacagatggaaga

SEQ ID NO: 163213 - DNA, 15 bp, Homo sapiens
gcagacagatggaag

SEQ ID NO: 163214 - DNA, 15 bp, Homo sapiens
tgcagacagatggaa

SEQ ID NO: 163215 - DNA, 15 bp, Homo sapiens
gtgcagacagatgga

SEQ ID NO: 163216 - DNA, 15 bp, Homo sapiens
tgtgcagacagatgg

SEQ ID NO: 163217 - DNA, 15 bp, Homo sapiens
atgtgcagacagatg

SEQ ID NO: 163218 - DNA, 15 bp, Homo sapiens
aatgtgcagacagat

SEQ ID NO: 163219 - DNA, 15 bp, Homo sapiens
caatgtgcagacaga

SEQ ID NO: 163220 - DNA, 15 bp, Homo sapiens
acaatgtgcagacag

SEQ ID NO: 163221 - DNA, 15 bp, Homo sapiens
cacaatgtgcagaca

SEQ ID NO: 163222 - DNA, 15 bp, Homo sapiens
tcacaatgtgcagac

SEQ ID NO: 163223 - DNA, 15 bp, Homo sapiens
ctcacaatgtgcaga

SEQ ID NO: 163224 - DNA, 15 bp, Homo sapiens
actcacaatgtgcag

SEQ ID NO: 163225 - DNA, 15 bp, Homo sapiens
aactcacaatgtgca

SEQ ID NO: 163226 - DNA, 15 bp, Homo sapiens
gaactcacaatgtgc

SEQ ID NO: 163227 - DNA, 15 bp, Homo sapiens
agaactcacaatgtg

SEQ ID NO: 163228 - DNA, 15 bp, Homo sapiens
aagaactcacaatgt

SEQ ID NO: 163229 - DNA, 15 bp, Homo sapiens
taagaactcacaatg

SEQ ID NO: 163230 - DNA, 15 bp, Homo sapiens
ttaagaactcacaat

SEQ ID NO: 163231 - DNA, 15 bp, Homo sapiens
attaagaactcacaa

SEQ ID NO: 163232 - DNA, 15 bp, Homo sapiens
cattaagaactcaca

SEQ ID NO: 163233 - DNA, 15 bp, Homo sapiens
tcattaagaactcac

SEQ ID NO: 163234 - DNA, 15 bp, Homo sapiens
atcattaagaactca

SEQ ID NO: 163235 - DNA, 15 bp, Homo sapiens
aatcattaagaactc

SEQ ID NO: 163236 - DNA, 15 bp, Homo sapiens
aaatcattaagaact

SEQ ID NO: 163237 - DNA, 15 bp, Homo sapiens
caaatcattaagaac

SEQ ID NO: 163238 - DNA, 15 bp, Homo sapiens
tcaaatcattaagaa

SEQ ID NO: 163239 - DNA, 15 bp, Homo sapiens
atcaaatcattaaga

SEQ ID NO: 163240 - DNA, 15 bp, Homo sapiens
catcaaatcattaag

SEQ ID NO: 163241 - DNA, 15 bp, Homo sapiens
gcatcaaatcattaa

SEQ ID NO: 163242 - DNA, 15 bp, Homo sapiens
ggcatcaaatcatta

SEQ ID NO: 163243 - DNA, 15 bp, Homo sapiens
aggcatcaaatcatt

SEQ ID NO: 163244 - DNA, 15 bp, Homo sapiens
gaggcatcaaatcat

SEQ ID NO: 163245 - DNA, 15 bp, Homo sapiens
agaggcatcaaatca

SEQ ID NO: 163246 - DNA, 15 bp, Homo sapiens
aagaggcatcaaatc

SEQ ID NO: 163247 - DNA, 15 bp, Homo sapiens
aaagaggcatcaaat

SEQ ID NO: 163248 - DNA, 15 bp, Homo sapiens
aaaagaggcatcaaa

SEQ ID NO: 163249 - DNA, 15 bp, Homo sapiens
caaaagaggcatcaa

SEQ ID NO: 163250 - DNA, 15 bp, Homo sapiens
ccaaaagaggcatca

SEQ ID NO: 163251 - DNA, 15 bp, Homo sapiens
gccaaaagaggcatc

SEQ ID NO: 163252 - DNA, 15 bp, Homo sapiens
agccaaaagaggcat

SEQ ID NO: 163253 - DNA, 15 bp, Homo sapiens
cagccaaaagaggca

SEQ ID NO: 163254 - DNA, 15 bp, Homo sapiens
tcagccaaaagaggc

SEQ ID NO: 163255 - DNA, 15 bp, Homo sapiens
ttcagccaaaagagg

SEQ ID NO: 163256 - DNA, 15 bp, Homo sapiens
attcagccaaaagag

SEQ ID NO: 163257 - DNA, 15 bp, Homo sapiens
tataattcagccaaa

SEQ ID NO: 163258 - DNA, 15 bp, Homo sapiens
atataattcagccaa

SEQ ID NO: 163259 - DNA, 15 bp, Homo sapiens
gatataattcagcca

SEQ ID NO: 163260 - DNA, 15 bp, Homo sapiens
ggatataattcagcc

SEQ ID NO: 163261 - DNA, 15 bp, Homo sapiens
tggatataattcagc

SEQ ID NO: 163262 - DNA, 15 bp, Homo sapiens
gtggatataattcag

SEQ ID NO: 163263 - DNA, 15 bp, Homo sapiens
ggtggatataattca

SEQ ID NO: 163264 - DNA, 15 bp, Homo sapiens
tggtggatataattc

SEQ ID NO: 163265 - DNA, 15 bp, Homo sapiens
atggtggatataatt

SEQ ID NO: 163266 - DNA, 15 bp, Homo sapiens
tatggtggatataat

SEQ ID NO: 163267 - DNA, 15 bp, Homo sapiens
gtatggtggatataa

SEQ ID NO: 163268 - DNA, 15 bp, Homo sapiens
ggtatggtggatata

SEQ ID NO: 163269 - DNA, 15 bp, Homo sapiens
tggtatggtggatat

SEQ ID NO: 163270 - DNA, 15 bp, Homo sapiens
atggtatggtggata

SEQ ID NO: 163271 - DNA, 15 bp, Homo sapiens
gatggtatggtggat

SEQ ID NO: 163272 - DNA, 15 bp, Homo sapiens
tgatggtatggtgga

SEQ ID NO: 163273 - DNA, 15 bp, Homo sapiens
gtgatggtatggtgg

SEQ ID NO: 163274 - DNA, 15 bp, Homo sapiens
agtgatggtatggtg

SEQ ID NO: 163275 - DNA, 15 bp, Homo sapiens
gagtgatggtatggt

SEQ ID NO: 163276 - DNA, 15 bp, Homo sapiens
agagtgatggtatgg

SEQ ID NO: 163277 - DNA, 15 bp, Homo sapiens
cagagtgatggtatg

SEQ ID NO: 163278 - DNA, 15 bp, Homo sapiens
ccagagtgatggtat

SEQ ID NO: 163279 - DNA, 15 bp, Homo sapiens
accagagtgatggta

SEQ ID NO: 163280 - DNA, 15 bp, Homo sapiens
caccagagtgatggt

SEQ ID NO: 163281 - DNA, 15 bp, Homo sapiens
tcaccagagtgatgg

SEQ ID NO: 163282 - DNA, 15 bp, Homo sapiens
ctcaccagagtgatg

SEQ ID NO: 163283 - DNA, 15 bp, Homo sapiens
gctcaccagagtgat

SEQ ID NO: 163284 - DNA, 15 bp, Homo sapiens
tgctcaccagagtga

SEQ ID NO: 163285 - DNA, 15 bp, Homo sapiens
ttgctcaccagagtg

SEQ ID NO: 163286 - DNA, 15 bp, Homo sapiens
tttgctcaccagagt

SEQ ID NO: 163287 - DNA, 15 bp, Homo sapiens
ttttgctcaccagag

SEQ ID NO: 163288 - DNA, 15 bp, Homo sapiens
tttttgctcaccaga

SEQ ID NO: 163289 - DNA, 15 bp, Homo sapiens
ctttttgctcaccag

SEQ ID NO: 163290 - DNA, 15 bp, Homo sapiens
tctttttgctcacca

SEQ ID NO: 163291 - DNA, 15 bp, Homo sapiens
ctctttttgctcacc

SEQ ID NO: 163292 - DNA, 15 bp, Homo sapiens
tctctttttgctcac

SEQ ID NO: 163293 - DNA, 15 bp, Homo sapiens
ttctctttttgctca

SEQ ID NO: 163294 - DNA, 15 bp, Homo sapiens
cttctctttttgctc

SEQ ID NO: 163295 - DNA, 15 bp, Homo sapiens
gcttctctttttgct

SEQ ID NO: 163296 - DNA, 15 bp, Homo sapiens
tgcttctctttttgc

SEQ ID NO: 163297 - DNA, 15 bp, Homo sapiens
atgcttctctttttg

SEQ ID NO: 163298 - DNA, 15 bp, Homo sapiens
aatgcttctcttttt

SEQ ID NO: 163299 - DNA, 15 bp, Homo sapiens
gaatgcttctctttt

SEQ ID NO: 163300 - DNA, 15 bp, Homo sapiens
agaatgcttctcttt

SEQ ID NO: 163301 - DNA, 15 bp, Homo sapiens
cagaatgcttctctt

SEQ ID NO: 163302 - DNA, 15 bp, Homo sapiens
acagaatgcttctct

SEQ ID NO: 163303 - DNA, 15 bp, Homo sapiens
tacagaatgcttctc

SEQ ID NO: 163304 - DNA, 15 bp, Homo sapiens
atacagaatgcttct

SEQ ID NO: 163305 - DNA, 15 bp, Homo sapiens
aatacagaatgcttc

SEQ ID NO: 163306 - DNA, 15 bp, Homo sapiens
taatacagaatgctt

SEQ ID NO: 163307 - DNA, 15 bp, Homo sapiens
ataatacagaatgct

SEQ ID NO: 163308 - DNA, 15 bp, Homo sapiens
tataatacagaatgc

SEQ ID NO: 163309 - DNA, 15 bp, Homo sapiens
gtataatacagaatg

SEQ ID NO: 163310 - DNA, 15 bp, Homo sapiens
tgtataatacagaat

SEQ ID NO: 163311 - DNA, 15 bp, Homo sapiens
ttgtataatacagaa

SEQ ID NO: 163312 - DNA, 15 bp, Homo sapiens
tttgtataatacaga

SEQ ID NO: 163313 - DNA, 15 bp, Homo sapiens
atttgtataatacag

SEQ ID NO: 163314 - DNA, 15 bp, Homo sapiens
catttgtataataca

SEQ ID NO: 163315 - DNA, 15 bp, Homo sapiens
tcatttgtataatac

SEQ ID NO: 163316 - DNA, 15 bp, Homo sapiens
atcatttgtataata

SEQ ID NO: 163317 - DNA, 15 bp, Homo sapiens
tatcatttgtataat

SEQ ID NO: 163318 - DNA, 15 bp, Homo sapiens
atatcatttgtataa

SEQ ID NO: 163319 - DNA, 15 bp, Homo sapiens
catatcatttgtata

SEQ ID NO: 163320 - DNA, 15 bp, Homo sapiens
acatatcatttgtat

SEQ ID NO: 163321 - DNA, 15 bp, Homo sapiens
aacatatcatttgta

SEQ ID NO: 163322 - DNA, 15 bp, Homo sapiens
aaacatatcatttgt

SEQ ID NO: 163323 - DNA, 15 bp, Homo sapiens
taaacatatcatttg

SEQ ID NO: 163324 - DNA, 15 bp, Homo sapiens
ctaaacatatcattt

SEQ ID NO: 163325 - DNA, 15 bp, Homo sapiens
tctaaacatatcatt

SEQ ID NO: 163326 - DNA, 15 bp, Homo sapiens
ttctaaacatatcat

SEQ ID NO: 163327 - DNA, 15 bp, Homo sapiens
tttctaaacatatca

SEQ ID NO: 163328 - DNA, 15 bp, Homo sapiens
gtttctaaacatatc

SEQ ID NO: 163329 - DNA, 15 bp, Homo sapiens
tgtttctaaacatat

SEQ ID NO: 163330 - DNA, 15 bp, Homo sapiens
atgtttctaaacata

SEQ ID NO: 163331 - DNA, 15 bp, Homo sapiens
tatgtttctaaacat

SEQ ID NO: 163332 - DNA, 15 bp, Homo sapiens
ttatgtttctaaaca

SEQ ID NO: 163333 - DNA, 15 bp, Homo sapiens
gttatgtttctaaac

SEQ ID NO: 163334 - DNA, 15 bp, Homo sapiens
agttatgtttctaaa

SEQ ID NO: 163335 - DNA, 15 bp, Homo sapiens
tagttatgtttctaa

SEQ ID NO: 163336 - DNA, 15 bp, Homo sapiens
ttagttatgtttcta

SEQ ID NO: 163337 - DNA, 15 bp, Homo sapiens
cttagttatgtttct

SEQ ID NO: 163338 - DNA, 15 bp, Homo sapiens
tcttagttatgtttc

SEQ ID NO: 163339 - DNA, 15 bp, Homo sapiens
ttcttagttatgttt

SEQ ID NO: 163340 - DNA, 15 bp, Homo sapiens
attcttagttatgtt

SEQ ID NO: 163341 - DNA, 15 bp, Homo sapiens
cattcttagttatgt

SEQ ID NO: 163342 - DNA, 15 bp, Homo sapiens
acattcttagttatg

SEQ ID NO: 163343 - DNA, 15 bp, Homo sapiens
aacattcttagttat

SEQ ID NO: 163344 - DNA, 15 bp, Homo sapiens
aaacattcttagtta

SEQ ID NO: 163345 - DNA, 15 bp, Homo sapiens
aaaacattcttagtt

SEQ ID NO: 163346 - DNA, 15 bp, Homo sapiens
aaaaacattcttagt

SEQ ID NO: 163347 - DNA, 15 bp, Homo sapiens
taaaaacattcttag

SEQ ID NO: 163348 - DNA, 15 bp, Homo sapiens
ttaaaaacattctta

SEQ ID NO: 163349 - DNA, 15 bp, Homo sapiens
attaaaaacattctt

SEQ ID NO: 163350 - DNA, 15 bp, Homo sapiens
gattaaaaacattct

SEQ ID NO: 163351 - DNA, 15 bp, Homo sapiens
tgattaaaaacattc

SEQ ID NO: 163352 - DNA, 15 bp, Homo sapiens
ggtgattaaaaacat

SEQ ID NO: 163353 - DNA, 15 bp, Homo sapiens
gggtgattaaaaaca

SEQ ID NO: 163354 - DNA, 15 bp, Homo sapiens
tgggtgattaaaaac

SEQ ID NO: 163355 - DNA, 15 bp, Homo sapiens
gtgggtgattaaaaa

SEQ ID NO: 163356 - DNA, 15 bp, Homo sapiens
agtgggtgattaaaa

SEQ ID NO: 163357 - DNA, 15 bp, Homo sapiens
cagtgggtgattaaa

SEQ ID NO: 163358 - DNA, 15 bp, Homo sapiens
ccagtgggtgattaa

SEQ ID NO: 163359 - DNA, 15 bp, Homo sapiens
gccagtgggtgatta

SEQ ID NO: 163360 - DNA, 15 bp, Homo sapiens
ggccagtgggtgatt

SEQ ID NO: 163361 - DNA, 15 bp, Homo sapiens
aggccagtgggtgat

SEQ ID NO: 163362 - DNA, 15 bp, Homo sapiens
taggccagtgggtga

SEQ ID NO: 163363 - DNA, 15 bp, Homo sapiens
gtaggccagtgggtg

SEQ ID NO: 163364 - DNA, 15 bp, Homo sapiens
ggtaggccagtgggt

SEQ ID NO: 163365 - DNA, 15 bp, Homo sapiens
gggtaggccagtggg

SEQ ID NO: 163366 - DNA, 15 bp, Homo sapiens
tgggtaggccagtgg

SEQ ID NO: 163367 - DNA, 15 bp, Homo sapiens
atgggtaggccagtg

SEQ ID NO: 163368 - DNA, 15 bp, Homo sapiens
gatgggtaggccagt

SEQ ID NO: 163369 - DNA, 15 bp, Homo sapiens
ggatgggtaggccag

SEQ ID NO: 163370 - DNA, 15 bp, Homo sapiens
tggatgggtaggcca

SEQ ID NO: 163371 - DNA, 15 bp, Homo sapiens
ttggatgggtaggcc

SEQ ID NO: 163372 - DNA, 15 bp, Homo sapiens
attggatgggtaggc

SEQ ID NO: 163373 - DNA, 15 bp, Homo sapiens
gattggatgggtagg

SEQ ID NO: 163374 - DNA, 15 bp, Homo sapiens
ggattggatgggtag

SEQ ID NO: 163375 - DNA, 15 bp, Homo sapiens
gggattggatgggta

SEQ ID NO: 163376 - DNA, 15 bp, Homo sapiens
agggattggatgggt

SEQ ID NO: 163377 - DNA, 15 bp, Homo sapiens
cagggattggatggg

SEQ ID NO: 163378 - DNA, 15 bp, Homo sapiens
gcagggattggatgg

SEQ ID NO: 163379 - DNA, 15 bp, Homo sapiens
agcagggattggatg

SEQ ID NO: 163380 - DNA, 15 bp, Homo sapiens
tagcagggattggat

SEQ ID NO: 163381 - DNA, 15 bp, Homo sapiens
atagcagggattgga

SEQ ID NO: 163382 - DNA, 15 bp, Homo sapiens
gatagcagggattgg

SEQ ID NO: 163383 - DNA, 15 bp, Homo sapiens
tgatagcagggattg

SEQ ID NO: 163384 - DNA, 15 bp, Homo sapiens
ttgatagcagggatt

SEQ ID NO: 163385 - DNA, 15 bp, Homo sapiens
attgatagcagggat

SEQ ID NO: 163386 - DNA, 15 bp, Homo sapiens
aattgatagcaggga

SEQ ID NO: 163387 - DNA, 15 bp, Homo sapiens
taattgatagcaggg

SEQ ID NO: 163388 - DNA, 15 bp, Homo sapiens
ttaattgatagcagg

SEQ ID NO: 163389 - DNA, 15 bp, Homo sapiens
gttaattgatagcag

SEQ ID NO: 163390 - DNA, 15 bp, Homo sapiens
agttaattgatagca

SEQ ID NO: 163391 - DNA, 15 bp, Homo sapiens
tagttaattgatagc

SEQ ID NO: 163392 - DNA, 15 bp, Homo sapiens
atagttaattgatag

SEQ ID NO: 163393 - DNA, 15 bp, Homo sapiens
aatagttaattgata

SEQ ID NO: 163394 - DNA, 15 bp, Homo sapiens
gaatagttaattgat

SEQ ID NO: 163395 - DNA, 15 bp, Homo sapiens
agaatagttaattga

SEQ ID NO: 163396 - DNA, 15 bp, Homo sapiens
cagaatagttaattg

SEQ ID NO: 163397 - DNA, 15 bp, Homo sapiens
tcagaatagttaatt

SEQ ID NO: 163398 - DNA, 15 bp, Homo sapiens
ttcagaatagttaat

SEQ ID NO: 163399 - DNA, 15 bp, Homo sapiens
tttcagaatagttaa

SEQ ID NO: 163400 - DNA, 15 bp, Homo sapiens
gtttcagaatagtta

SEQ ID NO: 163401 - DNA, 15 bp, Homo sapiens
ggtttcagaatagtt

SEQ ID NO: 163402 - DNA, 15 bp, Homo sapiens
tggtttcagaatagt

SEQ ID NO: 163403 - DNA, 15 bp, Homo sapiens
atggtttcagaatag

SEQ ID NO: 163404 - DNA, 15 bp, Homo sapiens
gatggtttcagaata

SEQ ID NO: 163405 - DNA, 15 bp, Homo sapiens
tgatggtttcagaat

SEQ ID NO: 163406 - DNA, 15 bp, Homo sapiens
atgatggtttcagaa

SEQ ID NO: 163407 - DNA, 15 bp, Homo sapiens
gatgatggtttcaga

SEQ ID NO: 163408 - DNA, 15 bp, Homo sapiens
tgatgatggtttcag

SEQ ID NO: 163409 - DNA, 15 bp, Homo sapiens
atgatgatggtttca

SEQ ID NO: 163410 - DNA, 15 bp, Homo sapiens
catgatgatggtttc

SEQ ID NO: 163411 - DNA, 15 bp, Homo sapiens
tcatgatgatggttt

SEQ ID NO: 163412 - DNA, 15 bp, Homo sapiens
atcatgatgatggtt

SEQ ID NO: 163413 - DNA, 15 bp, Homo sapiens
aatcatgatgatggt

SEQ ID NO: 163414 - DNA, 15 bp, Homo sapiens
aaatcatgatgatgg

SEQ ID NO: 163415 - DNA, 15 bp, Homo sapiens
gaaatcatgatgatg

SEQ ID NO: 163416 - DNA, 15 bp, Homo sapiens
tgaaatcatgatgat

SEQ ID NO: 163417 - DNA, 15 bp, Homo sapiens
gtgaaatcatgatga

SEQ ID NO: 163418 - DNA, 15 bp, Homo sapiens
tgtgaaatcatgatg

SEQ ID NO: 163419 - DNA, 15 bp, Homo sapiens
atgtgaaatcatgat

SEQ ID NO: 163420 - DNA, 15 bp, Homo sapiens
catgtgaaatcatga

SEQ ID NO: 163421 - DNA, 15 bp, Homo sapiens
tcatgtgaaatcatg

SEQ ID NO: 163422 - DNA, 15 bp, Homo sapiens
atcatgtgaaatcat

SEQ ID NO: 163423 - DNA, 15 bp, Homo sapiens
tatcatgtgaaatca

SEQ ID NO: 163424 - DNA, 15 bp, Homo sapiens
atatcatgtgaaatc

SEQ ID NO: 163425 - DNA, 15 bp, Homo sapiens
aatatcatgtgaaat

SEQ ID NO: 163426 - DNA, 15 bp, Homo sapiens
aaatatcatgtgaaa

SEQ ID NO: 163427 - DNA, 15 bp, Homo sapiens
gaaatatcatgtgaa

SEQ ID NO: 163428 - DNA, 15 bp, Homo sapiens
ggaaatatcatgtga

SEQ ID NO: 163429 - DNA, 15 bp, Homo sapiens
aggaaatatcatgtg

SEQ ID NO: 163430 - DNA, 15 bp, Homo sapiens
gaggaaatatcatgt

SEQ ID NO: 163431 - DNA, 15 bp, Homo sapiens
agaggaaatatcatg

SEQ ID NO: 163432 - DNA, 15 bp, Homo sapiens
tagaggaaatatcat

SEQ ID NO: 163433 - DNA, 15 bp, Homo sapiens
atagaggaaatatca

SEQ ID NO: 163434 - DNA, 15 bp, Homo sapiens
aatagaggaaatatc

SEQ ID NO: 163435 - DNA, 15 bp, Homo sapiens
aaatagaggaaatat

SEQ ID NO: 163436 - DNA, 15 bp, Homo sapiens
taaatagaggaaata

SEQ ID NO: 163437 - DNA, 15 bp, Homo sapiens
ttaaatagaggaaat

SEQ ID NO: 163438 - DNA, 15 bp, Homo sapiens
tttaaatagaggaaa

SEQ ID NO: 163439 - DNA, 15 bp, Homo sapiens
ctttaaatagaggaa

SEQ ID NO: 163440 - DNA, 15 bp, Homo sapiens
actttaaatagagga

SEQ ID NO: 163441 - DNA, 15 bp, Homo sapiens
tactttaaatagagg

SEQ ID NO: 163442 - DNA, 15 bp, Homo sapiens
ctactttaaatagag

SEQ ID NO: 163443 - DNA, 15 bp, Homo sapiens
actactttaaataga

SEQ ID NO: 163444 - DNA, 15 bp, Homo sapiens
cactactttaaatag

SEQ ID NO: 163445 - DNA, 15 bp, Homo sapiens
acactactttaaata

SEQ ID NO: 163446 - DNA, 15 bp, Homo sapiens
tacactactttaaat

SEQ ID NO: 163447 - DNA, 15 bp, Homo sapiens
ttacactactttaaa

SEQ ID NO: 163448 - DNA, 15 bp, Homo sapiens
gttacactactttaa

SEQ ID NO: 163449 - DNA, 15 bp, Homo sapiens
agttacactacttta

SEQ ID NO: 163450 - DNA, 15 bp, Homo sapiens
cagttacactacttt

SEQ ID NO: 163451 - DNA, 15 bp, Homo sapiens
acagttacactactt

SEQ ID NO: 163452 - DNA, 15 bp, Homo sapiens
tacagttacactact

SEQ ID NO: 163453 - DNA, 15 bp, Homo sapiens
ttacagttacactac

SEQ ID NO: 163454 - DNA, 15 bp, Homo sapiens
cttacagttacacta

SEQ ID NO: 163455 - DNA, 15 bp, Homo sapiens
acttacagttacact

SEQ ID NO: 163456 - DNA, 15 bp, Homo sapiens
gacttacagttacac

SEQ ID NO: 163457 - DNA, 15 bp, Homo sapiens
tgacttacagttaca

SEQ ID NO: 163458 - DNA, 15 bp, Homo sapiens
gtgacttacagttac

SEQ ID NO: 163459 - DNA, 15 bp, Homo sapiens
ggtgacttacagtta

SEQ ID NO: 163460 - DNA, 15 bp, Homo sapiens
aggtgacttacagtt

SEQ ID NO: 163461 - DNA, 15 bp, Homo sapiens
gaggtgacttacagt

SEQ ID NO: 163462 - DNA, 15 bp, Homo sapiens
tgaggtgacttacag

SEQ ID NO: 163463 - DNA, 15 bp, Homo sapiens
ttgaggtgacttaca

SEQ ID NO: 163464 - DNA, 15 bp, Homo sapiens
attgaggtgacttac

SEQ ID NO: 163465 - DNA, 15 bp, Homo sapiens
aattgaggtgactta

SEQ ID NO: 163466 - DNA, 15 bp, Homo sapiens
aaattgaggtgactt

SEQ ID NO: 163467 - DNA, 15 bp, Homo sapiens
caaattgaggtgact

SEQ ID NO: 163468 - DNA, 15 bp, Homo sapiens
ccaaattgaggtgac

SEQ ID NO: 163469 - DNA, 15 bp, Homo sapiens
accaaattgaggtga

SEQ ID NO: 163470 - DNA, 15 bp, Homo sapiens
taccaaattgaggtg

SEQ ID NO: 163471 - DNA, 15 bp, Homo sapiens
ataccaaattgaggt

SEQ ID NO: 163472 - DNA, 15 bp, Homo sapiens
gataccaaattgagg

SEQ ID NO: 163473 - DNA, 15 bp, Homo sapiens
ggataccaaattgag

SEQ ID NO: 163474 - DNA, 15 bp, Homo sapiens
tggataccaaattga

SEQ ID NO: 163475 - DNA, 15 bp, Homo sapiens
ctggataccaaattg

SEQ ID NO: 163476 - DNA, 15 bp, Homo sapiens
cctggataccaaatt

SEQ ID NO: 163477 - DNA, 15 bp, Homo sapiens
acctggataccaaat

SEQ ID NO: 163478 - DNA, 15 bp, Homo sapiens
aacctggataccaaa

SEQ ID NO: 163479 - DNA, 15 bp, Homo sapiens
aaacctggataccaa

SEQ ID NO: 163480 - DNA, 15 bp, Homo sapiens
caaacctggatacca

SEQ ID NO: 163481 - DNA, 15 bp, Homo sapiens
gcaaacctggatacc

SEQ ID NO: 163482 - DNA, 15 bp, Homo sapiens
cgcaaacctggatac

SEQ ID NO: 163483 - DNA, 15 bp, Homo sapiens
acgcaaacctggata

SEQ ID NO: 163484 - DNA, 15 bp, Homo sapiens
aacgcaaacctggat

SEQ ID NO: 163485 - DNA, 15 bp, Homo sapiens
aaacgcaaacctgga

SEQ ID NO: 163486 - DNA, 15 bp, Homo sapiens
caaacgcaaacctgg

SEQ ID NO: 163487 - DNA, 15 bp, Homo sapiens
ccaaacgcaaacctg

SEQ ID NO: 163488 - DNA, 15 bp, Homo sapiens
gccaaacgcaaacct

SEQ ID NO: 163489 - DNA, 15 bp, Homo sapiens
tgccaaacgcaaacc

SEQ ID NO: 163490 - DNA, 15 bp, Homo sapiens
ttgccaaacgcaaac

SEQ ID NO: 163491 - DNA, 15 bp, Homo sapiens
attgccaaacgcaaa

SEQ ID NO: 163492 - DNA, 15 bp, Homo sapiens
tattgccaaacgcaa

SEQ ID NO: 163493 - DNA, 15 bp, Homo sapiens
ttattgccaaacgca

SEQ ID NO: 163494 - DNA, 15 bp, Homo sapiens
tttattgccaaacgc

SEQ ID NO: 163495 - DNA, 15 bp, Homo sapiens
atttattgccaaacg

SEQ ID NO: 163496 - DNA, 15 bp, Homo sapiens
aatttattgccaaac

SEQ ID NO: 163497 - DNA, 15 bp, Homo sapiens
gaatttattgccaaa

SEQ ID NO: 163498 - DNA, 15 bp, Homo sapiens
ggaatttattgccaa

SEQ ID NO: 163499 - DNA, 15 bp, Homo sapiens
aggaatttattgcca

SEQ ID NO: 163500 - DNA, 15 bp, Homo sapiens
gaggaatttattgcc

SEQ ID NO: 163501 - DNA, 15 bp, Homo sapiens
agaggaatttattgc

SEQ ID NO: 163502 - DNA, 15 bp, Homo sapiens
aagaggaatttattg

SEQ ID NO: 163503 - DNA, 15 bp, Homo sapiens
caagaggaatttatt

SEQ ID NO: 163504 - DNA, 15 bp, Homo sapiens
ccaagaggaatttat

SEQ ID NO: 163505 - DNA, 15 bp, Homo sapiens
gccaagaggaattta

SEQ ID NO: 163506 - DNA, 15 bp, Homo sapiens
tgccaagaggaattt

SEQ ID NO: 163507 - DNA, 15 bp, Homo sapiens
ctgccaagaggaatt

SEQ ID NO: 163508 - DNA, 15 bp, Homo sapiens
gctgccaagaggaat

SEQ ID NO: 163509 - DNA, 15 bp, Homo sapiens
agctgccaagaggaa

SEQ ID NO: 163510 - DNA, 15 bp, Homo sapiens
aagctgccaagagga

SEQ ID NO: 163511 - DNA, 15 bp, Homo sapiens
gaagctgccaagagg

SEQ ID NO: 163512 - DNA, 15 bp, Homo sapiens
tgaagctgccaagag

SEQ ID NO: 163513 - DNA, 15 bp, Homo sapiens
ctgaagctgccaaga

SEQ ID NO: 163514 - DNA, 15 bp, Homo sapiens
gctgaagctgccaag

SEQ ID NO: 163515 - DNA, 15 bp, Homo sapiens
tgctgaagctgccaa

SEQ ID NO: 163516 - DNA, 15 bp, Homo sapiens
ttgctgaagctgcca

SEQ ID NO: 163517 - DNA, 15 bp, Homo sapiens
cttgctgaagctgcc

SEQ ID NO: 163518 - DNA, 15 bp, Homo sapiens
acttgctgaagctgc

SEQ ID NO: 163519 - DNA, 15 bp, Homo sapiens
aacttgctgaagctg

SEQ ID NO: 163520 - DNA, 15 bp, Homo sapiens
taacttgctgaagct

SEQ ID NO: 163521 - DNA, 15 bp, Homo sapiens
ataacttgctgaagc

SEQ ID NO: 163522 - DNA, 15 bp, Homo sapiens
tataacttgctgaag

SEQ ID NO: 163523 - DNA, 15 bp, Homo sapiens
atataacttgctgaa

SEQ ID NO: 163524 - DNA, 15 bp, Homo sapiens
aatataacttgctga

SEQ ID NO: 163525 - DNA, 15 bp, Homo sapiens
aaatataacttgctg

SEQ ID NO: 163526 - DNA, 15 bp, Homo sapiens
gaaatataacttgct

SEQ ID NO: 163527 - DNA, 15 bp, Homo sapiens
agaaatataacttgc

SEQ ID NO: 163528 - DNA, 15 bp, Homo sapiens
aagaaatataacttg

SEQ ID NO: 163529 - DNA, 15 bp, Homo sapiens
taagaaatataactt

SEQ ID NO: 163530 - DNA, 15 bp, Homo sapiens
ttaagaaatataact

SEQ ID NO: 163531 - DNA, 15 bp, Homo sapiens
attaagaaatataac

SEQ ID NO: 163532 - DNA, 15 bp, Homo sapiens
tattaagaaatataa

SEQ ID NO: 163533 - DNA, 15 bp, Homo sapiens
gtattaagaaatata

SEQ ID NO: 163534 - DNA, 15 bp, Homo sapiens
agtattaagaaatat

SEQ ID NO: 163535 - DNA, 15 bp, Homo sapiens
cagtattaagaaata

SEQ ID NO: 163536 - DNA, 15 bp, Homo sapiens
ccagtattaagaaat

SEQ ID NO: 163537 - DNA, 15 bp, Homo sapiens
tccagtattaagaaa

SEQ ID NO: 163538 - DNA, 15 bp, Homo sapiens
atccagtattaagaa

SEQ ID NO: 163539 - DNA, 15 bp, Homo sapiens
gatccagtattaaga

SEQ ID NO: 163540 - DNA, 15 bp, Homo sapiens
agatccagtattaag

SEQ ID NO: 163541 - DNA, 15 bp, Homo sapiens
cagatccagtattaa

SEQ ID NO: 163542 - DNA, 15 bp, Homo sapiens
gcagatccagtatta

SEQ ID NO: 163543 - DNA, 15 bp, Homo sapiens
agcagatccagtatt

SEQ ID NO: 163544 - DNA, 15 bp, Homo sapiens
cagcagatccagtat

SEQ ID NO: 163545 - DNA, 15 bp, Homo sapiens
tcagcagatccagta

SEQ ID NO: 163546 - DNA, 15 bp, Homo sapiens
ctcagcagatccagt

SEQ ID NO: 163547 - DNA, 15 bp, Homo sapiens
cctcagcagatccag

SEQ ID NO: 163548 - DNA, 15 bp, Homo sapiens
acctcagcagatcca

SEQ ID NO: 163549 - DNA, 15 bp, Homo sapiens
aacctcagcagatcc

SEQ ID NO: 163550 - DNA, 15 bp, Homo sapiens
taacctcagcagatc

SEQ ID NO: 163551 - DNA, 15 bp, Homo sapiens
ataacctcagcagat

SEQ ID NO: 163552 - DNA, 15 bp, Homo sapiens
cataacctcagcaga

SEQ ID NO: 163553 - DNA, 15 bp, Homo sapiens
acataacctcagcag

SEQ ID NO: 163554 - DNA, 15 bp, Homo sapiens
aacataacctcagca

SEQ ID NO: 163555 - DNA, 15 bp, Homo sapiens
aaacataacctcagc

SEQ ID NO: 163556 - DNA, 15 bp, Homo sapiens
taaacataacctcag

SEQ ID NO: 163557 - DNA, 15 bp, Homo sapiens
ataaacataacctca

SEQ ID NO: 163558 - DNA, 15 bp, Homo sapiens
cataaacataacctc

SEQ ID NO: 163559 - DNA, 15 bp, Homo sapiens
ccataaacataacct

SEQ ID NO: 163560 - DNA, 15 bp, Homo sapiens
tccataaacataacc

SEQ ID NO: 163561 - DNA, 15 bp, Homo sapiens
ctccataaacataac

SEQ ID NO: 163562 - DNA, 15 bp, Homo sapiens
tctccataaacataa

SEQ ID NO: 163563 - DNA, 15 bp, Homo sapiens
gtctccataaacata

SEQ ID NO: 163564 - DNA, 15 bp, Homo sapiens
ggtctccataaacat

SEQ ID NO: 163565 - DNA, 15 bp, Homo sapiens
tggtctccataaaca

SEQ ID NO: 163566 - DNA, 15 bp, Homo sapiens
ctggtctccataaac

SEQ ID NO: 163567 - DNA, 15 bp, Homo sapiens
tctggtctccataaa

SEQ ID NO: 163568 - DNA, 15 bp, Homo sapiens
ttctggtctccataa

SEQ ID NO: 163569 - DNA, 15 bp, Homo sapiens
gttctggtctccata

SEQ ID NO: 163570 - DNA, 15 bp, Homo sapiens
agttctggtctccat

SEQ ID NO: 163571 - DNA, 15 bp, Homo sapiens
tagttctggtctcca

SEQ ID NO: 163572 - DNA, 15 bp, Homo sapiens
atagttctggtctcc

SEQ ID NO: 163573 - DNA, 15 bp, Homo sapiens
catagttctggtctc

SEQ ID NO: 163574 - DNA, 15 bp, Homo sapiens
tcatagttctggtct

SEQ ID NO: 163575 - DNA, 15 bp, Homo sapiens
ctcatagttctggtc

SEQ ID NO: 163576 - DNA, 15 bp, Homo sapiens
actcatagttctggt

SEQ ID NO: 163577 - DNA, 15 bp, Homo sapiens
tactcatagttctgg

SEQ ID NO: 163578 - DNA, 15 bp, Homo sapiens
atactcatagttctg

SEQ ID NO: 163579 - DNA, 15 bp, Homo sapiens
aatactcatagttct

SEQ ID NO: 163580 - DNA, 15 bp, Homo sapiens
caatactcatagttc

SEQ ID NO: 163581 - DNA, 15 bp, Homo sapiens
tcaatactcatagtt

SEQ ID NO: 163582 - DNA, 15 bp, Homo sapiens
atcaatactcatagt

SEQ ID NO: 163583 - DNA, 15 bp, Homo sapiens
aatcaatactcatag

SEQ ID NO: 163584 - DNA, 15 bp, Homo sapiens
aaatcaatactcata

SEQ ID NO: 163585 - DNA, 15 bp, Homo sapiens
taaatcaatactcat

SEQ ID NO: 163586 - DNA, 15 bp, Homo sapiens
ataaatcaatactca

SEQ ID NO: 163587 - DNA, 15 bp, Homo sapiens
cataaatcaatactc

SEQ ID NO: 163588 - DNA, 15 bp, Homo sapiens
acataaatcaatact

SEQ ID NO: 163589 - DNA, 15 bp, Homo sapiens
aacataaatcaatac

SEQ ID NO: 163590 - DNA, 15 bp, Homo sapiens
aaacataaatcaata

SEQ ID NO: 163591 - DNA, 15 bp, Homo sapiens
caaacataaatcaat

SEQ ID NO: 163592 - DNA, 15 bp, Homo sapiens
gcaaacataaatcaa

SEQ ID NO: 163593 - DNA, 15 bp, Homo sapiens
agcaaacataaatca

SEQ ID NO: 163594 - DNA, 15 bp, Homo sapiens
aagcaaacataaatc

SEQ ID NO: 163595 - DNA, 15 bp, Homo sapiens
aaagcaaacataaat

SEQ ID NO: 163596 - DNA, 15 bp, Homo sapiens
caaagcaaacataaa

SEQ ID NO: 163597 - DNA, 15 bp, Homo sapiens
tcaaagcaaacataa

SEQ ID NO: 163598 - DNA, 15 bp, Homo sapiens
ttcaaagcaaacata

SEQ ID NO: 163599 - DNA, 15 bp, Homo sapiens
gttcaaagcaaacat

SEQ ID NO: 163600 - DNA, 15 bp, Homo sapiens
tgttcaaagcaaaca

SEQ ID NO: 163601 - DNA, 15 bp, Homo sapiens
atgttcaaagcaaac

SEQ ID NO: 163602 - DNA, 15 bp, Homo sapiens
gatgttcaaagcaaa

SEQ ID NO: 163603 - DNA, 15 bp, Homo sapiens
agatgttcaaagcaa

SEQ ID NO: 163604 - DNA, 15 bp, Homo sapiens
aagatgttcaaagca

SEQ ID NO: 163605 - DNA, 15 bp, Homo sapiens
gaagatgttcaaagc

SEQ ID NO: 163606 - DNA, 15 bp, Homo sapiens
ggaagatgttcaaag

SEQ ID NO: 163607 - DNA, 15 bp, Homo sapiens
tggaagatgttcaaa

SEQ ID NO: 163608 - DNA, 15 bp, Homo sapiens
ctggaagatgttcaa

SEQ ID NO: 163609 - DNA, 15 bp, Homo sapiens
actggaagatgttca

SEQ ID NO: 163610 - DNA, 15 bp, Homo sapiens
gactggaagatgttc

SEQ ID NO: 163611 - DNA, 15 bp, Homo sapiens
agactggaagatgtt

SEQ ID NO: 163612 - DNA, 15 bp, Homo sapiens
tagactggaagatgt

SEQ ID NO: 163613 - DNA, 15 bp, Homo sapiens
ttagactggaagatg

SEQ ID NO: 163614 - DNA, 15 bp, Homo sapiens
tttagactggaagat

SEQ ID NO: 163615 - DNA, 15 bp, Homo sapiens
ctttagactggaaga

SEQ ID NO: 163616 - DNA, 15 bp, Homo sapiens
actttagactggaag

SEQ ID NO: 163617 - DNA, 15 bp, Homo sapiens
gactttagactggaa

SEQ ID NO: 163618 - DNA, 15 bp, Homo sapiens
tgactttagactgga

SEQ ID NO: 163619 - DNA, 15 bp, Homo sapiens
atgactttagactgg

SEQ ID NO: 163620 - DNA, 15 bp, Homo sapiens
aatgactttagactg

SEQ ID NO: 163621 - DNA, 15 bp, Homo sapiens
caatgactttagact

SEQ ID NO: 163622 - DNA, 15 bp, Homo sapiens
acaatgactttagac

SEQ ID NO: 163623 - DNA, 15 bp, Homo sapiens
cacaatgactttaga

SEQ ID NO: 163624 - DNA, 15 bp, Homo sapiens
ccacaatgactttag

SEQ ID NO: 163625 - DNA, 15 bp, Homo sapiens
gccacaatgacttta

SEQ ID NO: 163626 - DNA, 15 bp, Homo sapiens
agccacaatgacttt

SEQ ID NO: 163627 - DNA, 15 bp, Homo sapiens
tagccacaatgactt

SEQ ID NO: 163628 - DNA, 15 bp, Homo sapiens
atagccacaatgact

SEQ ID NO: 163629 - DNA, 15 bp, Homo sapiens
catagccacaatgac

SEQ ID NO: 163630 - DNA, 15 bp, Homo sapiens
gcatagccacaatga

SEQ ID NO: 163631 - DNA, 15 bp, Homo sapiens
agcatagccacaatg

SEQ ID NO: 163632 - DNA, 15 bp, Homo sapiens
aagcatagccacaat

SEQ ID NO: 163633 - DNA, 15 bp, Homo sapiens
aaagcatagccacaa

SEQ ID NO: 163634 - DNA, 15 bp, Homo sapiens
caaagcatagccaca

SEQ ID NO: 163635 - DNA, 15 bp, Homo sapiens
acaaagcatagccac

SEQ ID NO: 163636 - DNA, 15 bp, Homo sapiens
aacaaagcatagcca

SEQ ID NO: 163637 - DNA, 15 bp, Homo sapiens
caacaaagcatagcc

SEQ ID NO: 163638 - DNA, 15 bp, Homo sapiens
tcaacaaagcatagc

SEQ ID NO: 163639 - DNA, 15 bp, Homo sapiens
atcaacaaagcatag

SEQ ID NO: 163640 - DNA, 15 bp, Homo sapiens
catcaacaaagcata

SEQ ID NO: 163641 - DNA, 15 bp, Homo sapiens
tcatcaacaaagcat

SEQ ID NO: 163642 - DNA, 15 bp, Homo sapiens
ttcatcaacaaagca

SEQ ID NO: 163643 - DNA, 15 bp, Homo sapiens
gttcatcaacaaagc

SEQ ID NO: 163644 - DNA, 15 bp, Homo sapiens
agttcatcaacaaag

SEQ ID NO: 163645 - DNA, 15 bp, Homo sapiens
cagttcatcaacaaa

SEQ ID NO: 163646 - DNA, 15 bp, Homo sapiens
gcagttcatcaacaa

SEQ ID NO: 163647 - DNA, 15 bp, Homo sapiens
tgcagttcatcaaca

SEQ ID NO: 163648 - DNA, 15 bp, Homo sapiens
ctgcagttcatcaac

SEQ ID NO: 163649 - DNA, 15 bp, Homo sapiens
cctgcagttcatcaa

SEQ ID NO: 163650 - DNA, 15 bp, Homo sapiens
tcctgcagttcatca

SEQ ID NO: 163651 - DNA, 15 bp, Homo sapiens
ctcctgcagttcatc

SEQ ID NO: 163652 - DNA, 15 bp, Homo sapiens
tctcctgcagttcat

SEQ ID NO: 163653 - DNA, 15 bp, Homo sapiens
atctcctgcagttca

SEQ ID NO: 163654 - DNA, 15 bp, Homo sapiens
aatctcctgcagttc

SEQ ID NO: 163655 - DNA, 15 bp, Homo sapiens
caatctcctgcagtt

SEQ ID NO: 163656 - DNA, 15 bp, Homo sapiens
gcaatctcctgcagt

SEQ ID NO: 163657 - DNA, 15 bp, Homo sapiens
ggcaatctcctgcag

SEQ ID NO: 163658 - DNA, 15 bp, Homo sapiens
gggcaatctcctgca

SEQ ID NO: 163659 - DNA, 15 bp, Homo sapiens
agggcaatctcctgc

SEQ ID NO: 163660 - DNA, 15 bp, Homo sapiens
aagggcaatctcctg

SEQ ID NO: 163661 - DNA, 15 bp, Homo sapiens
caagggcaatctcct

SEQ ID NO: 163662 - DNA, 15 bp, Homo sapiens
ccaagggcaatctcc

SEQ ID NO: 163663 - DNA, 15 bp, Homo sapiens
cccaagggcaatctc

SEQ ID NO: 163664 - DNA, 15 bp, Homo sapiens
tcccaagggcaatct

SEQ ID NO: 163665 - DNA, 15 bp, Homo sapiens
atcccaagggcaatc

SEQ ID NO: 163666 - DNA, 15 bp, Homo sapiens
aatcccaagggcaat

SEQ ID NO: 163667 - DNA, 15 bp, Homo sapiens
caatcccaagggcaa

SEQ ID NO: 163668 - DNA, 15 bp, Homo sapiens
gcaatcccaagggca

SEQ ID NO: 163669 - DNA, 15 bp, Homo sapiens
tgcaatcccaagggc

SEQ ID NO: 163670 - DNA, 15 bp, Homo sapiens
atgcaatcccaaggg

SEQ ID NO: 163671 - DNA, 15 bp, Homo sapiens
aatgcaatcccaagg

SEQ ID NO: 163672 - DNA, 15 bp, Homo sapiens
caatgcaatcccaag

SEQ ID NO: 163673 - DNA, 15 bp, Homo sapiens
tcaatgcaatcccaa

SEQ ID NO: 163674 - DNA, 15 bp, Homo sapiens
ctcaatgcaatccca

SEQ ID NO: 163675 - DNA, 15 bp, Homo sapiens
actcaatgcaatccc

SEQ ID NO: 163676 - DNA, 15 bp, Homo sapiens
cactcaatgcaatcc

SEQ ID NO: 163677 - DNA, 15 bp, Homo sapiens
tcactcaatgcaatc

SEQ ID NO: 163678 - DNA, 15 bp, Homo sapiens
ttcactcaatgcaat

SEQ ID NO: 163679 - DNA, 15 bp, Homo sapiens
gttcactcaatgcaa

SEQ ID NO: 163680 - DNA, 15 bp, Homo sapiens
agttcactcaatgca

SEQ ID NO: 163681 - DNA, 15 bp, Homo sapiens
aagttcactcaatgc

SEQ ID NO: 163682 - DNA, 15 bp, Homo sapiens
caagttcactcaatg

SEQ ID NO: 163683 - DNA, 15 bp, Homo sapiens
ccaagttcactcaat

SEQ ID NO: 163684 - DNA, 15 bp, Homo sapiens
gccaagttcactcaa

SEQ ID NO: 163685 - DNA, 15 bp, Homo sapiens
ggccaagttcactca

SEQ ID NO: 163686 - DNA, 15 bp, Homo sapiens
gggccaagttcactc

SEQ ID NO: 163687 - DNA, 15 bp, Homo sapiens
ggggccaagttcact

SEQ ID NO: 163688 - DNA, 15 bp, Homo sapiens
aggggccaagttcac

SEQ ID NO: 163689 - DNA, 15 bp, Homo sapiens
caggggccaagttca

SEQ ID NO: 163690 - DNA, 15 bp, Homo sapiens
acaggggccaagttc

SEQ ID NO: 163691 - DNA, 15 bp, Homo sapiens
tacaggggccaagtt

SEQ ID NO: 163692 - DNA, 15 bp, Homo sapiens
gtacaggggccaagt

SEQ ID NO: 163693 - DNA, 15 bp, Homo sapiens
agtacaggggccaag

SEQ ID NO: 163694 - DNA, 15 bp, Homo sapiens
aagtacaggggccaa

SEQ ID NO: 163695 - DNA, 15 bp, Homo sapiens
gaagtacaggggcca

SEQ ID NO: 163696 - DNA, 15 bp, Homo sapiens
agaagtacaggggcc

SEQ ID NO: 163697 - DNA, 15 bp, Homo sapiens
aagaagtacaggggc

SEQ ID NO: 163698 - DNA, 15 bp, Homo sapiens
gaagaagtacagggg

SEQ ID NO: 163699 - DNA, 15 bp, Homo sapiens
tgaagaagtacaggg

SEQ ID NO: 163700 - DNA, 15 bp, Homo sapiens
ctgaagaagtacagg

SEQ ID NO: 163701 - DNA, 15 bp, Homo sapiens
tctgaagaagtacag

SEQ ID NO: 163702 - DNA, 15 bp, Homo sapiens
atctgaagaagtaca

SEQ ID NO: 163703 - DNA, 15 bp, Homo sapiens
gatctgaagaagtac

SEQ ID NO: 163704 - DNA, 15 bp, Homo sapiens
tgatctgaagaagta

SEQ ID NO: 163705 - DNA, 15 bp, Homo sapiens
atgatctgaagaagt

SEQ ID NO: 163706 - DNA, 15 bp, Homo sapiens
aatgatctgaagaag

SEQ ID NO: 163707 - DNA, 15 bp, Homo sapiens
aaatgatctgaagaa

SEQ ID NO: 163708 - DNA, 15 bp, Homo sapiens
gaaatgatctgaaga

SEQ ID NO: 163709 - DNA, 15 bp, Homo sapiens
tgaaatgatctgaag

SEQ ID NO: 163710 - DNA, 15 bp, Homo sapiens
ctgaaatgatctgaa

SEQ ID NO: 163711 - DNA, 15 bp, Homo sapiens
cctgaaatgatctga

SEQ ID NO: 163712 - DNA, 15 bp, Homo sapiens
tcctgaaatgatctg

SEQ ID NO: 163713 - DNA, 15 bp, Homo sapiens
ctcctgaaatgatct

SEQ ID NO: 163714 - DNA, 15 bp, Homo sapiens
tctcctgaaatgatc

SEQ ID NO: 163715 - DNA, 15 bp, Homo sapiens
ctctcctgaaatgat

SEQ ID NO: 163716 - DNA, 15 bp, Homo sapiens
actctcctgaaatga

SEQ ID NO: 163717 - DNA, 15 bp, Homo sapiens
aactctcctgaaatg

SEQ ID NO: 163718 - DNA, 15 bp, Homo sapiens
caactctcctgaaat

SEQ ID NO: 163719 - DNA, 15 bp, Homo sapiens
tcaactctcctgaaa

SEQ ID NO: 163720 - DNA, 15 bp, Homo sapiens
ctcaactctcctgaa

SEQ ID NO: 163721 - DNA, 15 bp, Homo sapiens
cctcaactctcctga

SEQ ID NO: 163722 - DNA, 15 bp, Homo sapiens
acctcaactctcctg

SEQ ID NO: 163723 - DNA, 15 bp, Homo sapiens
cacctcaactctcct

SEQ ID NO: 163724 - DNA, 15 bp, Homo sapiens
ccacctcaactctcc

SEQ ID NO: 163725 - DNA, 15 bp, Homo sapiens
tccacctcaactctc

SEQ ID NO: 163726 - DNA, 15 bp, Homo sapiens
gtccacctcaactct

SEQ ID NO: 163727 - DNA, 15 bp, Homo sapiens
agtccacctcaactc

SEQ ID NO: 163728 - DNA, 15 bp, Homo sapiens
aagtccacctcaact

SEQ ID NO: 163729 - DNA, 15 bp, Homo sapiens
gaagtccacctcaac

SEQ ID NO: 163730 - DNA, 15 bp, Homo sapiens
agaagtccacctcaa

SEQ ID NO: 163731 - DNA, 15 bp, Homo sapiens
gagaagtccacctca

SEQ ID NO: 163732 - DNA, 15 bp, Homo sapiens
agagaagtccacctc

SEQ ID NO: 163733 - DNA, 15 bp, Homo sapiens
aagagaagtccacct

SEQ ID NO: 163734 - DNA, 15 bp, Homo sapiens
aaagagaagtccacc

SEQ ID NO: 163735 - DNA, 15 bp, Homo sapiens
taaagagaagtccac

SEQ ID NO: 163736 - DNA, 15 bp, Homo sapiens
ctaaagagaagtcca

SEQ ID NO: 163737 - DNA, 15 bp, Homo sapiens
cctaaagagaagtcc

SEQ ID NO: 163738 - DNA, 15 bp, Homo sapiens
tcctaaagagaagtc

SEQ ID NO: 163739 - DNA, 15 bp, Homo sapiens
ttcctaaagagaagt

SEQ ID NO: 163740 - DNA, 15 bp, Homo sapiens
cttcctaaagagaag

SEQ ID NO: 163741 - DNA, 15 bp, Homo sapiens
ccttcctaaagagaa

SEQ ID NO: 163742 - DNA, 15 bp, Homo sapiens
accttcctaaagaga

SEQ ID NO: 163743 - DNA, 15 bp, Homo sapiens
caccttcctaaagag

SEQ ID NO: 163744 - DNA, 15 bp, Homo sapiens
acaccttcctaaaga

SEQ ID NO: 163745 - DNA, 15 bp, Homo sapiens
aacaccttcctaaag

SEQ ID NO: 163746 - DNA, 15 bp, Homo sapiens
gaacaccttcctaaa

SEQ ID NO: 163747 - DNA, 15 bp, Homo sapiens
agaacaccttcctaa

SEQ ID NO: 163748 - DNA, 15 bp, Homo sapiens
aagaacaccttccta

SEQ ID NO: 163749 - DNA, 15 bp, Homo sapiens
aaagaacaccttcct

SEQ ID NO: 163750 - DNA, 15 bp, Homo sapiens
aaaagaacaccttcc

SEQ ID NO: 163751 - DNA, 15 bp, Homo sapiens
aaaaagaacaccttc

SEQ ID NO: 163752 - DNA, 15 bp, Homo sapiens
aaaaaagaacacctt

SEQ ID NO: 163753 - DNA, 15 bp, Homo sapiens
aaaaaaagaacacct

SEQ ID NO: 163754 - DNA, 15 bp, Homo sapiens
aaaaaaaagaacacc

SEQ ID NO: 163755 - DNA, 15 bp, Homo sapiens
gaaaaaaaagaacac

SEQ ID NO: 163756 - DNA, 15 bp, Homo sapiens
tgaaaaaaaagaaca

SEQ ID NO: 163757 - DNA, 15 bp, Homo sapiens
ctgaaaaaaaagaac

SEQ ID NO: 163758 - DNA, 15 bp, Homo sapiens
gctgaaaaaaaagaa

SEQ ID NO: 163759 - DNA, 15 bp, Homo sapiens
agctgaaaaaaaaga

SEQ ID NO: 163760 - DNA, 15 bp, Homo sapiens
gagctgaaaaaaaag

SEQ ID NO: 163761 - DNA, 15 bp, Homo sapiens
agagctgaaaaaaaa

SEQ ID NO: 163762 - DNA, 15 bp, Homo sapiens
aagagctgaaaaaaa

SEQ ID NO: 163763 - DNA, 15 bp, Homo sapiens
gaagagctgaaaaaa

SEQ ID NO: 163764 - DNA, 15 bp, Homo sapiens
cgaagagctgaaaaa

SEQ ID NO: 163765 - DNA, 15 bp, Homo sapiens
acgaagagctgaaaa

SEQ ID NO: 163766 - DNA, 15 bp, Homo sapiens
tacgaagagctgaaa

SEQ ID NO: 163767 - DNA, 15 bp, Homo sapiens
ttacgaagagctgaa

SEQ ID NO: 163768 - DNA, 15 bp, Homo sapiens
tttacgaagagctga

SEQ ID NO: 163769 - DNA, 15 bp, Homo sapiens
atttacgaagagctg

SEQ ID NO: 163770 - DNA, 15 bp, Homo sapiens
catttacgaagagct

SEQ ID NO: 163771 - DNA, 15 bp, Homo sapiens
acatttacgaagagc

SEQ ID NO: 163772 - DNA, 15 bp, Homo sapiens
gacatttacgaagag

SEQ ID NO: 163773 - DNA, 15 bp, Homo sapiens
ggacatttacgaaga

SEQ ID NO: 163774 - DNA, 15 bp, Homo sapiens
tggacatttacgaag

SEQ ID NO: 163775 - DNA, 15 bp, Homo sapiens
atggacatttacgaa

SEQ ID NO: 163776 - DNA, 15 bp, Homo sapiens
gatggacatttacga

SEQ ID NO: 163777 - DNA, 15 bp, Homo sapiens
tgatggacatttacg

SEQ ID NO: 163778 - DNA, 15 bp, Homo sapiens
ctgatggacatttac

SEQ ID NO: 163779 - DNA, 15 bp, Homo sapiens
actgatggacattta

SEQ ID NO: 163780 - DNA, 15 bp, Homo sapiens
gactgatggacattt

SEQ ID NO: 163781 - DNA, 15 bp, Homo sapiens
agactgatggacatt

SEQ ID NO: 163782 - DNA, 15 bp, Homo sapiens
aagactgatggacat

SEQ ID NO: 163783 - DNA, 15 bp, Homo sapiens
caagactgatggaca

SEQ ID NO: 163784 - DNA, 15 bp, Homo sapiens
gcaagactgatggac

SEQ ID NO: 163785 - DNA, 15 bp, Homo sapiens
agcaagactgatgga

SEQ ID NO: 163786 - DNA, 15 bp, Homo sapiens
gagcaagactgatgg

SEQ ID NO: 163787 - DNA, 15 bp, Homo sapiens
agagcaagactgatg

SEQ ID NO: 163788 - DNA, 15 bp, Homo sapiens
cagagcaagactgat

SEQ ID NO: 163789 - DNA, 15 bp, Homo sapiens
gcagagcaagactga

SEQ ID NO: 163790 - DNA, 15 bp, Homo sapiens
tgcagagcaagactg

SEQ ID NO: 163791 - DNA, 15 bp, Homo sapiens
atgcagagcaagact

SEQ ID NO: 163792 - DNA, 15 bp, Homo sapiens
tatgcagagcaagac

SEQ ID NO: 163793 - DNA, 15 bp, Homo sapiens
ctatgcagagcaaga

SEQ ID NO: 163794 - DNA, 15 bp, Homo sapiens
gctatgcagagcaag

SEQ ID NO: 163795 - DNA, 15 bp, Homo sapiens
ggctatgcagagcaa

SEQ ID NO: 163796 - DNA, 15 bp, Homo sapiens
tggctatgcagagca

SEQ ID NO: 163797 - DNA, 15 bp, Homo sapiens
ttggctatgcagagc

SEQ ID NO: 163798 - DNA, 15 bp, Homo sapiens
cttggctatgcagag

SEQ ID NO: 163799 - DNA, 15 bp, Homo sapiens
gcttggctatgcaga

SEQ ID NO: 163800 - DNA, 15 bp, Homo sapiens
agcttggctatgcag

SEQ ID NO: 163801 - DNA, 15 bp, Homo sapiens
cagcttggctatgca

SEQ ID NO: 163802 - DNA, 15 bp, Homo sapiens
acagcttggctatgc

SEQ ID NO: 163803 - DNA, 15 bp, Homo sapiens
aacagcttggctatg

SEQ ID NO: 163804 - DNA, 15 bp, Homo sapiens
caacagcttggctat

SEQ ID NO: 163805 - DNA, 15 bp, Homo sapiens
tcaacagcttggcta

SEQ ID NO: 163806 - DNA, 15 bp, Homo sapiens
ttcaacagcttggct

SEQ ID NO: 163807 - DNA, 15 bp, Homo sapiens
cttcaacagcttggc

SEQ ID NO: 163808 - DNA, 15 bp, Homo sapiens
gcttcaacagcttgg

SEQ ID NO: 163809 - DNA, 15 bp, Homo sapiens
tgcttcaacagcttg

SEQ ID NO: 163810 - DNA, 15 bp, Homo sapiens
atgcttcaacagctt

SEQ ID NO: 163811 - DNA, 15 bp, Homo sapiens
catgcttcaacagct

SEQ ID NO: 163812 - DNA, 15 bp, Homo sapiens
tcatgcttcaacagc

SEQ ID NO: 163813 - DNA, 15 bp, Homo sapiens
atcatgcttcaacag

SEQ ID NO: 163814 - DNA, 15 bp, Homo sapiens
gatcatgcttcaaca

SEQ ID NO: 163815 - DNA, 15 bp, Homo sapiens
tgatcatgcttcaac

SEQ ID NO: 163816 - DNA, 15 bp, Homo sapiens
gtgatcatgcttcaa

SEQ ID NO: 163817 - DNA, 15 bp, Homo sapiens
ggtgatcatgcttca

SEQ ID NO: 163818 - DNA, 15 bp, Homo sapiens
aggtgatcatgcttc

SEQ ID NO: 163819 - DNA, 15 bp, Homo sapiens
aaggtgatcatgctt

SEQ ID NO: 163820 - DNA, 15 bp, Homo sapiens
caaggtgatcatgct

SEQ ID NO: 163821 - DNA, 15 bp, Homo sapiens
gcaaggtgatcatgc

SEQ ID NO: 163822 - DNA, 15 bp, Homo sapiens
tgcaaggtgatcatg

SEQ ID NO: 163823 - DNA, 15 bp, Homo sapiens
atgcaaggtgatcat

SEQ ID NO: 163824 - DNA, 15 bp, Homo sapiens
aatgcaaggtgatca

SEQ ID NO: 163825 - DNA, 15 bp, Homo sapiens
caatgcaaggtgatc

SEQ ID NO: 163826 - DNA, 15 bp, Homo sapiens
tcaatgcaaggtgat

SEQ ID NO: 163827 - DNA, 15 bp, Homo sapiens
ttcaatgcaaggtga

SEQ ID NO: 163828 - DNA, 15 bp, Homo sapiens
attcaatgcaaggtg

SEQ ID NO: 163829 - DNA, 15 bp, Homo sapiens
tattcaatgcaaggt

SEQ ID NO: 163830 - DNA, 15 bp, Homo sapiens
ttattcaatgcaagg

SEQ ID NO: 163831 - DNA, 15 bp, Homo sapiens
cttattcaatgcaag

SEQ ID NO: 163832 - DNA, 15 bp, Homo sapiens
gcttattcaatgcaa

SEQ ID NO: 163833 - DNA, 15 bp, Homo sapiens
agcttattcaatgca

SEQ ID NO: 163834 - DNA, 15 bp, Homo sapiens
cagcttattcaatgc

SEQ ID NO: 163835 - DNA, 15 bp, Homo sapiens
gcagcttattcaatg

SEQ ID NO: 163836 - DNA, 15 bp, Homo sapiens
tgcagcttattcaat

SEQ ID NO: 163837 - DNA, 15 bp, Homo sapiens
gtgcagcttattcaa

SEQ ID NO: 163838 - DNA, 15 bp, Homo sapiens
tgtgcagcttattca

SEQ ID NO: 163839 - DNA, 15 bp, Homo sapiens
ctgtgcagcttattc

SEQ ID NO: 163840 - DNA, 15 bp, Homo sapiens
tctgtgcagcttatt

SEQ ID NO: 163841 - DNA, 15 bp, Homo sapiens
ctctgtgcagcttat

SEQ ID NO: 163842 - DNA, 15 bp, Homo sapiens
gctctgtgcagctta

SEQ ID NO: 163843 - DNA, 15 bp, Homo sapiens
agctctgtgcagctt

SEQ ID NO: 163844 - DNA, 15 bp, Homo sapiens
tagctctgtgcagct

SEQ ID NO: 163845 - DNA, 15 bp, Homo sapiens
gtagctctgtgcagc

SEQ ID NO: 163846 - DNA, 15 bp, Homo sapiens
agtagctctgtgcag

SEQ ID NO: 163847 - DNA, 15 bp, Homo sapiens
cagtagctctgtgca

SEQ ID NO: 163848 - DNA, 15 bp, Homo sapiens
acagtagctctgtgc

SEQ ID NO: 163849 - DNA, 15 bp, Homo sapiens
aacagtagctctgtg

SEQ ID NO: 163850 - DNA, 15 bp, Homo sapiens
gaacagtagctctgt

SEQ ID NO: 163851 - DNA, 15 bp, Homo sapiens
agaacagtagctctg

SEQ ID NO: 163852 - DNA, 15 bp, Homo sapiens
tagaacagtagctct

SEQ ID NO: 163853 - DNA, 15 bp, Homo sapiens
gtagaacagtagctc

SEQ ID NO: 163854 - DNA, 15 bp, Homo sapiens
ggtagaacagtagct

SEQ ID NO: 163855 - DNA, 15 bp, Homo sapiens
cggtagaacagtagc

SEQ ID NO: 163856 - DNA, 15 bp, Homo sapiens
ccggtagaacagtag

SEQ ID NO: 163857 - DNA, 15 bp, Homo sapiens
cccggtagaacagta

SEQ ID NO: 163858 - DNA, 15 bp, Homo sapiens
ccccggtagaacagt

SEQ ID NO: 163859 - DNA, 15 bp, Homo sapiens
tccccggtagaacag

SEQ ID NO: 163860 - DNA, 15 bp, Homo sapiens
ctccccggtagaaca

SEQ ID NO: 163861 - DNA, 15 bp, Homo sapiens
actccccggtagaac

SEQ ID NO: 163862 - DNA, 15 bp, Homo sapiens
tactccccggtagaa

SEQ ID NO: 163863 - DNA, 15 bp, Homo sapiens
atactccccggtaga

SEQ ID NO: 163864 - DNA, 15 bp, Homo sapiens
catactccccggtag

SEQ ID NO: 163865 - DNA, 15 bp, Homo sapiens
gcatactccccggta

SEQ ID NO: 163866 - DNA, 15 bp, Homo sapiens
agcatactccccggt

SEQ ID NO: 163867 - DNA, 15 bp, Homo sapiens
aagcatactccccgg

SEQ ID NO: 163868 - DNA, 15 bp, Homo sapiens
caagcatactccccg

SEQ ID NO: 163869 - DNA, 15 bp, Homo sapiens
gcaagcatactcccc

SEQ ID NO: 163870 - DNA, 15 bp, Homo sapiens
tgcaagcatactccc

SEQ ID NO: 163871 - DNA, 15 bp, Homo sapiens
ctgcaagcatactcc

SEQ ID NO: 163872 - DNA, 15 bp, Homo sapiens
cctgcaagcatactc

SEQ ID NO: 163873 - DNA, 15 bp, Homo sapiens
ccctgcaagcatact

SEQ ID NO: 163874 - DNA, 15 bp, Homo sapiens
cccctgcaagcatac

SEQ ID NO: 163875 - DNA, 15 bp, Homo sapiens
tcccctgcaagcata

SEQ ID NO: 163876 - DNA, 15 bp, Homo sapiens
ctcccctgcaagcat

SEQ ID NO: 163877 - DNA, 15 bp, Homo sapiens
gctcccctgcaagca

SEQ ID NO: 163878 - DNA, 15 bp, Homo sapiens
tgctcccctgcaagc

SEQ ID NO: 163879 - DNA, 15 bp, Homo sapiens
atgctcccctgcaag

SEQ ID NO: 163880 - DNA, 15 bp, Homo sapiens
tatgctcccctgcaa

SEQ ID NO: 163881 - DNA, 15 bp, Homo sapiens
ttatgctcccctgca

SEQ ID NO: 163882 - DNA, 15 bp, Homo sapiens
attatgctcccctgc

SEQ ID NO: 163883 - DNA, 15 bp, Homo sapiens
gattatgctcccctg

SEQ ID NO: 163884 - DNA, 15 bp, Homo sapiens
agattatgctcccct

SEQ ID NO: 163885 - DNA, 15 bp, Homo sapiens
gagattatgctcccc

SEQ ID NO: 163886 - DNA, 15 bp, Homo sapiens
tgagattatgctccc

SEQ ID NO: 163887 - DNA, 15 bp, Homo sapiens
ttgagattatgctcc

SEQ ID NO: 163888 - DNA, 15 bp, Homo sapiens
tttgagattatgctc

SEQ ID NO: 163889 - DNA, 15 bp, Homo sapiens
atttgagattatgct

SEQ ID NO: 163890 - DNA, 15 bp, Homo sapiens
aatttgagattatgc

SEQ ID NO: 163891 - DNA, 15 bp, Homo sapiens
aaatttgagattatg

SEQ ID NO: 163892 - DNA, 15 bp, Homo sapiens
taaatttgagattat

SEQ ID NO: 163893 - DNA, 15 bp, Homo sapiens
gtaaatttgagatta

SEQ ID NO: 163894 - DNA, 15 bp, Homo sapiens
agtaaatttgagatt

SEQ ID NO: 163895 - DNA, 15 bp, Homo sapiens
cagtaaatttgagat

SEQ ID NO: 163896 - DNA, 15 bp, Homo sapiens
gcagtaaatttgaga

SEQ ID NO: 163897 - DNA, 15 bp, Homo sapiens
agcagtaaatttgag

SEQ ID NO: 163898 - DNA, 15 bp, Homo sapiens
tagcagtaaatttga

SEQ ID NO: 163899 - DNA, 15 bp, Homo sapiens
gtagcagtaaatttg

SEQ ID NO: 163900 - DNA, 15 bp, Homo sapiens
ggtagcagtaaattt

SEQ ID NO: 163901 - DNA, 15 bp, Homo sapiens
gggtagcagtaaatt

SEQ ID NO: 163902 - DNA, 15 bp, Homo sapiens
tgggtagcagtaaat

SEQ ID NO: 163903 - DNA, 15 bp, Homo sapiens
gtgggtagcagtaaa

SEQ ID NO: 163904 - DNA, 15 bp, Homo sapiens
agtgggtagcagtaa

SEQ ID NO: 163905 - DNA, 15 bp, Homo sapiens
gagtgggtagcagta

SEQ ID NO: 163906 - DNA, 15 bp, Homo sapiens
cgagtgggtagcagt

SEQ ID NO: 163907 - DNA, 15 bp, Homo sapiens
ccgagtgggtagcag

SEQ ID NO: 163908 - DNA, 15 bp, Homo sapiens
accgagtgggtagca

SEQ ID NO: 163909 - DNA, 15 bp, Homo sapiens
taccgagtgggtagc

SEQ ID NO: 163910 - DNA, 15 bp, Homo sapiens
gtaccgagtgggtag

SEQ ID NO: 163911 - DNA, 15 bp, Homo sapiens
ggtaccgagtgggta

SEQ ID NO: 163912 - DNA, 15 bp, Homo sapiens
tggtaccgagtgggt

SEQ ID NO: 163913 - DNA, 15 bp, Homo sapiens
atggtaccgagtggg

SEQ ID NO: 163914 - DNA, 15 bp, Homo sapiens
catggtaccgagtgg

SEQ ID NO: 163915 - DNA, 15 bp, Homo sapiens
gcatggtaccgagtg

SEQ ID NO: 163916 - DNA, 15 bp, Homo sapiens
tgcatggtaccgagt

SEQ ID NO: 163917 - DNA, 15 bp, Homo sapiens
ctgcatggtaccgag

SEQ ID NO: 163918 - DNA, 15 bp, Homo sapiens
tctgcatggtaccga

SEQ ID NO: 163919 - DNA, 15 bp, Homo sapiens
ctctgcatggtaccg

SEQ ID NO: 163920 - DNA, 15 bp, Homo sapiens
gctctgcatggtacc

SEQ ID NO: 163921 - DNA, 15 bp, Homo sapiens
agctctgcatggtac

SEQ ID NO: 163922 - DNA, 15 bp, Homo sapiens
aagctctgcatggta

SEQ ID NO: 163923 - DNA, 15 bp, Homo sapiens
caagctctgcatggt

SEQ ID NO: 163924 - DNA, 15 bp, Homo sapiens
gcaagctctgcatgg

SEQ ID NO: 163925 - DNA, 15 bp, Homo sapiens
agcaagctctgcatg

SEQ ID NO: 163926 - DNA, 15 bp, Homo sapiens
aagcaagctctgcat

SEQ ID NO: 163927 - DNA, 15 bp, Homo sapiens
caagcaagctctgca

SEQ ID NO: 163928 - DNA, 15 bp, Homo sapiens
ccaagcaagctctgc

SEQ ID NO: 163929 - DNA, 15 bp, Homo sapiens
cccaagcaagctctg

SEQ ID NO: 163930 - DNA, 15 bp, Homo sapiens
tcccaagcaagctct

SEQ ID NO: 163931 - DNA, 15 bp, Homo sapiens
ctcccaagcaagctc

SEQ ID NO: 163932 - DNA, 15 bp, Homo sapiens
actcccaagcaagct

SEQ ID NO: 163933 - DNA, 15 bp, Homo sapiens
aactcccaagcaagc

SEQ ID NO: 163934 - DNA, 15 bp, Homo sapiens
gaactcccaagcaag

SEQ ID NO: 163935 - DNA, 15 bp, Homo sapiens
tgaactcccaagcaa

SEQ ID NO: 163936 - DNA, 15 bp, Homo sapiens
ctgaactcccaagca

SEQ ID NO: 163937 - DNA, 15 bp, Homo sapiens
cctgaactcccaagc

SEQ ID NO: 163938 - DNA, 15 bp, Homo sapiens
ccctgaactcccaag

SEQ ID NO: 163939 - DNA, 15 bp, Homo sapiens
tccctgaactcccaa

SEQ ID NO: 163940 - DNA, 15 bp, Homo sapiens
ctccctgaactccca

SEQ ID NO: 163941 - DNA, 15 bp, Homo sapiens
cctccctgaactccc

SEQ ID NO: 163942 - DNA, 15 bp, Homo sapiens
tcctccctgaactcc

SEQ ID NO: 163943 - DNA, 15 bp, Homo sapiens
atcctccctgaactc

SEQ ID NO: 163944 - DNA, 15 bp, Homo sapiens
aatcctccctgaact

SEQ ID NO: 163945 - DNA, 15 bp, Homo sapiens
caatcctccctgaac

SEQ ID NO: 163946 - DNA, 15 bp, Homo sapiens
acaatcctccctgaa

SEQ ID NO: 163947 - DNA, 15 bp, Homo sapiens
aacaatcctccctga

SEQ ID NO: 163948 - DNA, 15 bp, Homo sapiens
aaacaatcctccctg

SEQ ID NO: 163949 - DNA, 15 bp, Homo sapiens
caaacaatcctccct

SEQ ID NO: 163950 - DNA, 15 bp, Homo sapiens
tcaaacaatcctccc

SEQ ID NO: 163951 - DNA, 15 bp, Homo sapiens
ttcaaacaatcctcc

SEQ ID NO: 163952 - DNA, 15 bp, Homo sapiens
tttcaaacaatcctc

SEQ ID NO: 163953 - DNA, 15 bp, Homo sapiens
atttcaaacaatcct

SEQ ID NO: 163954 - DNA, 15 bp, Homo sapiens
catttcaaacaatcc

SEQ ID NO: 163955 - DNA, 15 bp, Homo sapiens
ccatttcaaacaatc

SEQ ID NO: 163956 - DNA, 15 bp, Homo sapiens
cccatttcaaacaat

SEQ ID NO: 163957 - DNA, 15 bp, Homo sapiens
gcccatttcaaacaa

SEQ ID NO: 163958 - DNA, 15 bp, Homo sapiens
tgcccatttcaaaca

SEQ ID NO: 163959 - DNA, 15 bp, Homo sapiens
ctgcccatttcaaac

SEQ ID NO: 163960 - DNA, 15 bp, Homo sapiens
actgcccatttcaaa

SEQ ID NO: 163961 - DNA, 15 bp, Homo sapiens
aactgcccatttcaa

SEQ ID NO: 163962 - DNA, 15 bp, Homo sapiens
gaactgcccatttca

SEQ ID NO: 163963 - DNA, 15 bp, Homo sapiens
tgaactgcccatttc

SEQ ID NO: 163964 - DNA, 15 bp, Homo sapiens
ttgaactgcccattt

SEQ ID NO: 163965 - DNA, 15 bp, Homo sapiens
gttgaactgcccatt

SEQ ID NO: 163966 - DNA, 15 bp, Homo sapiens
agttgaactgcccat

SEQ ID NO: 163967 - DNA, 15 bp, Homo sapiens
tagttgaactgccca

SEQ ID NO: 163968 - DNA, 15 bp, Homo sapiens
atagttgaactgccc

SEQ ID NO: 163969 - DNA, 15 bp, Homo sapiens
aatagttgaactgcc

SEQ ID NO: 163970 - DNA, 15 bp, Homo sapiens
gaatagttgaactgc

SEQ ID NO: 163971 - DNA, 15 bp, Homo sapiens
agaatagttgaactg

SEQ ID NO: 163972 - DNA, 15 bp, Homo sapiens
aagaatagttgaact

SEQ ID NO: 163973 - DNA, 15 bp, Homo sapiens
gaagaatagttgaac

SEQ ID NO: 163974 - DNA, 15 bp, Homo sapiens
ggaagaatagttgaa

SEQ ID NO: 163975 - DNA, 15 bp, Homo sapiens
tggaagaatagttga

SEQ ID NO: 163976 - DNA, 15 bp, Homo sapiens
ctggaagaatagttg

SEQ ID NO: 163977 - DNA, 15 bp, Homo sapiens
tctggaagaatagtt

SEQ ID NO: 163978 - DNA, 15 bp, Homo sapiens
atctggaagaatagt

SEQ ID NO: 163979 - DNA, 15 bp, Homo sapiens
tatctggaagaatag

SEQ ID NO: 163980 - DNA, 15 bp, Homo sapiens
ttatctggaagaata

SEQ ID NO: 163981 - DNA, 15 bp, Homo sapiens
attatctggaagaat

SEQ ID NO: 163982 - DNA, 15 bp, Homo sapiens
gattatctggaagaa

SEQ ID NO: 163983 - DNA, 15 bp, Homo sapiens
tgattatctggaaga

SEQ ID NO: 163984 - DNA, 15 bp, Homo sapiens
ttgattatctggaag

SEQ ID NO: 163985 - DNA, 15 bp, Homo sapiens
tttgattatctggaa

SEQ ID NO: 163986 - DNA, 15 bp, Homo sapiens
ttttgattatctgga

SEQ ID NO: 163987 - DNA, 15 bp, Homo sapiens
tttttgattatctgg

SEQ ID NO: 163988 - DNA, 15 bp, Homo sapiens
ttttttgattatctg

SEQ ID NO: 163989 - DNA, 15 bp, Homo sapiens
cttttttgattatct

SEQ ID NO: 163990 - DNA, 15 bp, Homo sapiens
gcttttttgattatc

SEQ ID NO: 163991 - DNA, 15 bp, Homo sapiens
ggcttttttgattat

SEQ ID NO: 163992 - DNA, 15 bp, Homo sapiens
tggcttttttgatta

SEQ ID NO: 163993 - DNA, 15 bp, Homo sapiens
atggcttttttgatt

SEQ ID NO: 163994 - DNA, 15 bp, Homo sapiens
gatggcttttttgat

SEQ ID NO: 163995 - DNA, 15 bp, Homo sapiens
ggatggcttttttga

SEQ ID NO: 163996 - DNA, 15 bp, Homo sapiens
gggatggcttttttg

SEQ ID NO: 163997 - DNA, 15 bp, Homo sapiens
agggatggctttttt

SEQ ID NO: 163998 - DNA, 15 bp, Homo sapiens
gagggatggcttttt

SEQ ID NO: 163999 - DNA, 15 bp, Homo sapiens
cgagggatggctttt

SEQ ID NO: 164000 - DNA, 15 bp, Homo sapiens
tcgagggatggcttt

SEQ ID NO: 164001 - DNA, 15 bp, Homo sapiens
atcgagggatggctt

SEQ ID NO: 164002 - DNA, 15 bp, Homo sapiens
aatcgagggatggct

SEQ ID NO: 164003 - DNA, 15 bp, Homo sapiens
aaatcgagggatggc

SEQ ID NO: 164004 - DNA, 15 bp, Homo sapiens
taaatcgagggatgg

SEQ ID NO: 164005 - DNA, 15 bp, Homo sapiens
ctaaatcgagggatg

SEQ ID NO: 164006 - DNA, 15 bp, Homo sapiens
gctaaatcgagggat

SEQ ID NO: 164007 - DNA, 15 bp, Homo sapiens
tgctaaatcgaggga

SEQ ID NO: 164008 - DNA, 15 bp, Homo sapiens
ctgctaaatcgaggg

SEQ ID NO: 164009 - DNA, 15 bp, Homo sapiens
tctgctaaatcgagg

SEQ ID NO: 164010 - DNA, 15 bp, Homo sapiens
ttctgctaaatcgag

SEQ ID NO: 164011 - DNA, 15 bp, Homo sapiens
gttctgctaaatcga

SEQ ID NO: 164012 - DNA, 15 bp, Homo sapiens
tgttctgctaaatcg

SEQ ID NO: 164013 - DNA, 15 bp, Homo sapiens
atgttctgctaaatc

SEQ ID NO: 164014 - DNA, 15 bp, Homo sapiens
aatgttctgctaaat

SEQ ID NO: 164015 - DNA, 15 bp, Homo sapiens
caatgttctgctaaa

SEQ ID NO: 164016 - DNA, 15 bp, Homo sapiens
tcaatgttctgctaa

SEQ ID NO: 164017 - DNA, 15 bp, Homo sapiens
ctcaatgttctgcta

SEQ ID NO: 164018 - DNA, 15 bp, Homo sapiens
tctcaatgttctgct

SEQ ID NO: 164019 - DNA, 15 bp, Homo sapiens
ttctcaatgttctgc

SEQ ID NO: 164020 - DNA, 15 bp, Homo sapiens
tttctcaatgttctg

SEQ ID NO: 164021 - DNA, 15 bp, Homo sapiens
atttctcaatgttct

SEQ ID NO: 164022 - DNA, 15 bp, Homo sapiens
gatttctcaatgttc

SEQ ID NO: 164023 - DNA, 15 bp, Homo sapiens
ggatttctcaatgtt

SEQ ID NO: 164024 - DNA, 15 bp, Homo sapiens
aggatttctcaatgt

SEQ ID NO: 164025 - DNA, 15 bp, Homo sapiens
aaggatttctcaatg

SEQ ID NO: 164026 - DNA, 15 bp, Homo sapiens
aaaggatttctcaat

SEQ ID NO: 164027 - DNA, 15 bp, Homo sapiens
gaaaggatttctcaa

SEQ ID NO: 164028 - DNA, 15 bp, Homo sapiens
ggaaaggatttctca

SEQ ID NO: 164029 - DNA, 15 bp, Homo sapiens
aggaaaggatttctc

SEQ ID NO: 164030 - DNA, 15 bp, Homo sapiens
aaggaaaggatttct

SEQ ID NO: 164031 - DNA, 15 bp, Homo sapiens
aaaggaaaggatttc

SEQ ID NO: 164032 - DNA, 15 bp, Homo sapiens
caaaggaaaggattt

SEQ ID NO: 164033 - DNA, 15 bp, Homo sapiens
tcaaaggaaaggatt

SEQ ID NO: 164034 - DNA, 15 bp, Homo sapiens
gtcaaaggaaaggat

SEQ ID NO: 164035 - DNA, 15 bp, Homo sapiens
agtcaaaggaaagga

SEQ ID NO: 164036 - DNA, 15 bp, Homo sapiens
cagtcaaaggaaagg

SEQ ID NO: 164037 - DNA, 15 bp, Homo sapiens
acagtcaaaggaaag

SEQ ID NO: 164038 - DNA, 15 bp, Homo sapiens
tacagtcaaaggaaa

SEQ ID NO: 164039 - DNA, 15 bp, Homo sapiens
atacagtcaaaggaa

SEQ ID NO: 164040 - DNA, 15 bp, Homo sapiens
aatacagtcaaagga

SEQ ID NO: 164041 - DNA, 15 bp, Homo sapiens
caatacagtcaaagg

SEQ ID NO: 164042 - DNA, 15 bp, Homo sapiens
acaatacagtcaaag

SEQ ID NO: 164043 - DNA, 15 bp, Homo sapiens
tacaatacagtcaaa

SEQ ID NO: 164044 - DNA, 15 bp, Homo sapiens
atacaatacagtcaa

SEQ ID NO: 164045 - DNA, 15 bp, Homo sapiens
aatacaatacagtca

SEQ ID NO: 164046 - DNA, 15 bp, Homo sapiens
caatacaatacagtc

SEQ ID NO: 164047 - DNA, 15 bp, Homo sapiens
acaatacaatacagt

SEQ ID NO: 164048 - DNA, 15 bp, Homo sapiens
aacaatacaatacag

SEQ ID NO: 164049 - DNA, 15 bp, Homo sapiens
aaacaatacaataca

SEQ ID NO: 164050 - DNA, 15 bp, Homo sapiens
gaaacaatacaatac

SEQ ID NO: 164051 - DNA, 15 bp, Homo sapiens
agaaacaatacaata

SEQ ID NO: 164052 - DNA, 15 bp, Homo sapiens
gagaaacaatacaat

SEQ ID NO: 164053 - DNA, 15 bp, Homo sapiens
agagaaacaatacaa

SEQ ID NO: 164054 - DNA, 15 bp, Homo sapiens
tagagaaacaataca

SEQ ID NO: 164055 - DNA, 15 bp, Homo sapiens
ttagagaaacaatac

SEQ ID NO: 164056 - DNA, 15 bp, Homo sapiens
tttagagaaacaata

SEQ ID NO: 164057 - DNA, 15 bp, Homo sapiens
ttttagagaaacaat

SEQ ID NO: 164058 - DNA, 15 bp, Homo sapiens
cttttagagaaacaa

SEQ ID NO: 164059 - DNA, 15 bp, Homo sapiens
gcttttagagaaaca

SEQ ID NO: 164060 - DNA, 15 bp, Homo sapiens
agcttttagagaaac

SEQ ID NO: 164061 - DNA, 15 bp, Homo sapiens
aagcttttagagaaa

SEQ ID NO: 164062 - DNA, 15 bp, Homo sapiens
caagcttttagagaa

SEQ ID NO: 164063 - DNA, 15 bp, Homo sapiens
gcaagcttttagaga

SEQ ID NO: 164064 - DNA, 15 bp, Homo sapiens
agcaagcttttagag

SEQ ID NO: 164065 - DNA, 15 bp, Homo sapiens
aagcaagcttttaga

SEQ ID NO: 164066 - DNA, 15 bp, Homo sapiens
aaagcaagcttttag

SEQ ID NO: 164067 - DNA, 15 bp, Homo sapiens
caaagcaagctttta

SEQ ID NO: 164068 - DNA, 15 bp, Homo sapiens
tcaaagcaagctttt

SEQ ID NO: 164069 - DNA, 15 bp, Homo sapiens
atcaaagcaagcttt

SEQ ID NO: 164070 - DNA, 15 bp, Homo sapiens
aatcaaagcaagctt

SEQ ID NO: 164071 - DNA, 15 bp, Homo sapiens
taatcaaagcaagct

SEQ ID NO: 164072 - DNA, 15 bp, Homo sapiens
ttaatcaaagcaagc

SEQ ID NO: 164073 - DNA, 15 bp, Homo sapiens
tttaatcaaagcaag

SEQ ID NO: 164074 - DNA, 15 bp, Homo sapiens
atttaatcaaagcaa

SEQ ID NO: 164075 - DNA, 15 bp, Homo sapiens
aatttaatcaaagca

SEQ ID NO: 164076 - DNA, 15 bp, Homo sapiens
caatttaatcaaagc

SEQ ID NO: 164077 - DNA, 15 bp, Homo sapiens
gcaatttaatcaaag

SEQ ID NO: 164078 - DNA, 15 bp, Homo sapiens
tgcaatttaatcaaa

SEQ ID NO: 164079 - DNA, 15 bp, Homo sapiens
gtgcaatttaatcaa

SEQ ID NO: 164080 - DNA, 15 bp, Homo sapiens
ggtgcaatttaatca

SEQ ID NO: 164081 - DNA, 15 bp, Homo sapiens
aggtgcaatttaatc

SEQ ID NO: 164082 - DNA, 15 bp, Homo sapiens
caggtgcaatttaat

SEQ ID NO: 164083 - DNA, 15 bp, Homo sapiens
ccaggtgcaatttaa

SEQ ID NO: 164084 - DNA, 15 bp, Homo sapiens
cccaggtgcaattta

SEQ ID NO: 164085 - DNA, 15 bp, Homo sapiens
acccaggtgcaattt

SEQ ID NO: 164086 - DNA, 15 bp, Homo sapiens
cacccaggtgcaatt

SEQ ID NO: 164087 - DNA, 15 bp, Homo sapiens
acacccaggtgcaat

SEQ ID NO: 164088 - DNA, 15 bp, Homo sapiens
aacacccaggtgcaa

SEQ ID NO: 164089 - DNA, 15 bp, Homo sapiens
aaacacccaggtgca

SEQ ID NO: 164090 - DNA, 15 bp, Homo sapiens
taaacacccaggtgc

SEQ ID NO: 164091 - DNA, 15 bp, Homo sapiens
ttaaacacccaggtg

SEQ ID NO: 164092 - DNA, 15 bp, Homo sapiens
tttaaacacccaggt

SEQ ID NO: 164093 - DNA, 15 bp, Homo sapiens
ttttaaacacccagg

SEQ ID NO: 164094 - DNA, 15 bp, Homo sapiens
tttttaaacacccag

SEQ ID NO: 164095 - DNA, 15 bp, Homo sapiens
ctttttaaacaccca

SEQ ID NO: 164096 - DNA, 15 bp, Homo sapiens
tctttttaaacaccc

SEQ ID NO: 164097 - DNA, 15 bp, Homo sapiens
ctctttttaaacacc

SEQ ID NO: 164098 - DNA, 15 bp, Homo sapiens
tctctttttaaacac

SEQ ID NO: 164099 - DNA, 15 bp, Homo sapiens
ttctctttttaaaca

SEQ ID NO: 164100 - DNA, 15 bp, Homo sapiens
attctctttttaaac

SEQ ID NO: 164101 - DNA, 15 bp, Homo sapiens
tattctctttttaaa

SEQ ID NO: 164102 - DNA, 15 bp, Homo sapiens
gtattctctttttaa

SEQ ID NO: 164103 - DNA, 15 bp, Homo sapiens
tgtattctcttttta

SEQ ID NO: 164104 - DNA, 15 bp, Homo sapiens
atgtattctcttttt

SEQ ID NO: 164105 - DNA, 15 bp, Homo sapiens
catgtattctctttt

SEQ ID NO: 164106 - DNA, 15 bp, Homo sapiens
acatgtattctcttt

SEQ ID NO: 164107 - DNA, 15 bp, Homo sapiens
cacatgtattctctt

SEQ ID NO: 164108 - DNA, 15 bp, Homo sapiens
tcacatgtattctct

SEQ ID NO: 164109 - DNA, 15 bp, Homo sapiens
ctcacatgtattctc

SEQ ID NO: 164110 - DNA, 15 bp, Homo sapiens
actcacatgtattct

SEQ ID NO: 164111 - DNA, 15 bp, Homo sapiens
cactcacatgtattc

SEQ ID NO: 164112 - DNA, 15 bp, Homo sapiens
acactcacatgtatt

SEQ ID NO: 164113 - DNA, 15 bp, Homo sapiens
aacactcacatgtat

SEQ ID NO: 164114 - DNA, 15 bp, Homo sapiens
taacactcacatgta

SEQ ID NO: 164115 - DNA, 15 bp, Homo sapiens
ttaacactcacatgt

SEQ ID NO: 164116 - DNA, 15 bp, Homo sapiens
attaacactcacatg

SEQ ID NO: 164117 - DNA, 15 bp, Homo sapiens
cattaacactcacat

SEQ ID NO: 164118 - DNA, 15 bp, Homo sapiens
gcattaacactcaca

SEQ ID NO: 164119 - DNA, 15 bp, Homo sapiens
tgcattaacactcac

SEQ ID NO: 164120 - DNA, 15 bp, Homo sapiens
gtgcattaacactca

SEQ ID NO: 164121 - DNA, 15 bp, Homo sapiens
agtgcattaacactc

SEQ ID NO: 164122 - DNA, 15 bp, Homo sapiens
aagtgcattaacact

SEQ ID NO: 164123 - DNA, 15 bp, Homo sapiens
taagtgcattaacac

SEQ ID NO: 164124 - DNA, 15 bp, Homo sapiens
gtaagtgcattaaca

SEQ ID NO: 164125 - DNA, 15 bp, Homo sapiens
tgtaagtgcattaac

SEQ ID NO: 164126 - DNA, 15 bp, Homo sapiens
atgtaagtgcattaa

SEQ ID NO: 164127 - DNA, 15 bp, Homo sapiens
aatgtaagtgcatta

SEQ ID NO: 164128 - DNA, 15 bp, Homo sapiens
caatgtaagtgcatt

SEQ ID NO: 164129 - DNA, 15 bp, Homo sapiens
acaatgtaagtgcat

SEQ ID NO: 164130 - DNA, 15 bp, Homo sapiens
tacaatgtaagtgca

SEQ ID NO: 164131 - DNA, 15 bp, Homo sapiens
ttacaatgtaagtgc

SEQ ID NO: 164132 - DNA, 15 bp, Homo sapiens
attacaatgtaagtg

SEQ ID NO: 164133 - DNA, 15 bp, Homo sapiens
aattacaatgtaagt

SEQ ID NO: 164134 - DNA, 15 bp, Homo sapiens
gaattacaatgtaag

SEQ ID NO: 164135 - DNA, 15 bp, Homo sapiens
tgaattacaatgtaa

SEQ ID NO: 164136 - DNA, 15 bp, Homo sapiens
ctgaattacaatgta

SEQ ID NO: 164137 - DNA, 15 bp, Homo sapiens
tctgaattacaatgt

SEQ ID NO: 164138 - DNA, 15 bp, Homo sapiens
atctgaattacaatg

SEQ ID NO: 164139 - DNA, 15 bp, Homo sapiens
catctgaattacaat

SEQ ID NO: 164140 - DNA, 15 bp, Homo sapiens
ccatctgaattacaa

SEQ ID NO: 164141 - DNA, 15 bp, Homo sapiens
tccatctgaattaca

SEQ ID NO: 164142 - DNA, 15 bp, Homo sapiens
atccatctgaattac

SEQ ID NO: 164143 - DNA, 15 bp, Homo sapiens
gatccatctgaatta

SEQ ID NO: 164144 - DNA, 15 bp, Homo sapiens
agatccatctgaatt

SEQ ID NO: 164145 - DNA, 15 bp, Homo sapiens
aagatccatctgaat

SEQ ID NO: 164146 - DNA, 15 bp, Homo sapiens
aaagatccatctgaa

SEQ ID NO: 164147 - DNA, 15 bp, Homo sapiens
aaaagatccatctga

SEQ ID NO: 164148 - DNA, 15 bp, Homo sapiens
aaaaagatccatctg

SEQ ID NO: 164149 - DNA, 15 bp, Homo sapiens
aaaaaagatccatct

SEQ ID NO: 164150 - DNA, 15 bp, Homo sapiens
caaaaaagatccatc

SEQ ID NO: 164151 - DNA, 15 bp, Homo sapiens
gcaaaaaagatccat

SEQ ID NO: 164152 - DNA, 15 bp, Homo sapiens
tgcaaaaaagatcca

SEQ ID NO: 164153 - DNA, 15 bp, Homo sapiens
ttgcaaaaaagatcc

SEQ ID NO: 164154 - DNA, 15 bp, Homo sapiens
tttgcaaaaaagatc

SEQ ID NO: 164155 - DNA, 15 bp, Homo sapiens
gtttgcaaaaaagat

SEQ ID NO: 164156 - DNA, 15 bp, Homo sapiens
agtttgcaaaaaaga

SEQ ID NO: 164157 - DNA, 15 bp, Homo sapiens
tagtttgcaaaaaag

SEQ ID NO: 164158 - DNA, 15 bp, Homo sapiens
ttagtttgcaaaaaa

SEQ ID NO: 164159 - DNA, 15 bp, Homo sapiens
tttagtttgcaaaaa

SEQ ID NO: 164160 - DNA, 15 bp, Homo sapiens
atttagtttgcaaaa

SEQ ID NO: 164161 - DNA, 15 bp, Homo sapiens
aatttagtttgcaaa

SEQ ID NO: 164162 - DNA, 15 bp, Homo sapiens
taatttagtttgcaa

SEQ ID NO: 164163 - DNA, 15 bp, Homo sapiens
ttaatttagtttgca

SEQ ID NO: 164164 - DNA, 15 bp, Homo sapiens
tttaatttagtttgc

SEQ ID NO: 164165 - DNA, 15 bp, Homo sapiens
ttttaatttagtttg

SEQ ID NO: 164166 - DNA, 15 bp, Homo sapiens
cttttaatttagttt

SEQ ID NO: 164167 - DNA, 15 bp, Homo sapiens
ccttttaatttagtt

SEQ ID NO: 164168 - DNA, 15 bp, Homo sapiens
accttttaatttagt

SEQ ID NO: 164169 - DNA, 15 bp, Homo sapiens
taccttttaatttag

SEQ ID NO: 164170 - DNA, 15 bp, Homo sapiens
gtaccttttaattta

SEQ ID NO: 164171 - DNA, 15 bp, Homo sapiens
tgtaccttttaattt

SEQ ID NO: 164172 - DNA, 15 bp, Homo sapiens
ctgtaccttttaatt

SEQ ID NO: 164173 - DNA, 15 bp, Homo sapiens
tctgtaccttttaat

SEQ ID NO: 164174 - DNA, 15 bp, Homo sapiens
ctctgtaccttttaa

SEQ ID NO: 164175 - DNA, 15 bp, Homo sapiens
tctctgtacctttta

SEQ ID NO: 164176 - DNA, 15 bp, Homo sapiens
gtctctgtacctttt

SEQ ID NO: 164177 - DNA, 15 bp, Homo sapiens
ggtctctgtaccttt

SEQ ID NO: 164178 - DNA, 15 bp, Homo sapiens
tggtctctgtacctt

SEQ ID NO: 164179 - DNA, 15 bp, Homo sapiens
atggtctctgtacct

SEQ ID NO: 164180 - DNA, 15 bp, Homo sapiens
aatggtctctgtacc

SEQ ID NO: 164181 - DNA, 15 bp, Homo sapiens
gaatggtctctgtac

SEQ ID NO: 164182 - DNA, 15 bp, Homo sapiens
tgaatggtctctgta

SEQ ID NO: 164183 - DNA, 15 bp, Homo sapiens
ctgaatggtctctgt

SEQ ID NO: 164184 - DNA, 15 bp, Homo sapiens
tctgaatggtctctg

SEQ ID NO: 164185 - DNA, 15 bp, Homo sapiens
ctctgaatggtctct

SEQ ID NO: 164186 - DNA, 15 bp, Homo sapiens
tctctgaatggtctc

SEQ ID NO: 164187 - DNA, 15 bp, Homo sapiens
ttctctgaatggtct

SEQ ID NO: 164188 - DNA, 15 bp, Homo sapiens
cttctctgaatggtc

SEQ ID NO: 164189 - DNA, 15 bp, Homo sapiens
gcttctctgaatggt

SEQ ID NO: 164190 - DNA, 15 bp, Homo sapiens
ggcttctctgaatgg

SEQ ID NO: 164191 - DNA, 15 bp, Homo sapiens
tggcttctctgaatg

SEQ ID NO: 164192 - DNA, 15 bp, Homo sapiens
atggcttctctgaat

SEQ ID NO: 164193 - DNA, 15 bp, Homo sapiens
gatggcttctctgaa

SEQ ID NO: 164194 - DNA, 15 bp, Homo sapiens
agatggcttctctga

SEQ ID NO: 164195 - DNA, 15 bp, Homo sapiens
cagatggcttctctg

SEQ ID NO: 164196 - DNA, 15 bp, Homo sapiens
acagatggcttctct

SEQ ID NO: 164197 - DNA, 15 bp, Homo sapiens
gacagatggcttctc

SEQ ID NO: 164198 - DNA, 15 bp, Homo sapiens
tgacagatggcttct

SEQ ID NO: 164199 - DNA, 15 bp, Homo sapiens
gtgacagatggcttc

SEQ ID NO: 164200 - DNA, 15 bp, Homo sapiens
agtgacagatggctt

SEQ ID NO: 164201 - DNA, 15 bp, Homo sapiens
tagtgacagatggct

SEQ ID NO: 164202 - DNA, 15 bp, Homo sapiens
atagtgacagatggc

SEQ ID NO: 164203 - DNA, 15 bp, Homo sapiens
aatagtgacagatgg

SEQ ID NO: 164204 - DNA, 15 bp, Homo sapiens
aaatagtgacagatg

SEQ ID NO: 164205 - DNA, 15 bp, Homo sapiens
caaatagtgacagat

SEQ ID NO: 164206 - DNA, 15 bp, Homo sapiens
tcaaatagtgacaga

SEQ ID NO: 164207 - DNA, 15 bp, Homo sapiens
ttcaaatagtgacag

SEQ ID NO: 164208 - DNA, 15 bp, Homo sapiens
tttcaaatagtgaca

SEQ ID NO: 164209 - DNA, 15 bp, Homo sapiens
ctttcaaatagtgac

SEQ ID NO: 164210 - DNA, 15 bp, Homo sapiens
actttcaaatagtga

SEQ ID NO: 164211 - DNA, 15 bp, Homo sapiens
aactttcaaatagtg

SEQ ID NO: 164212 - DNA, 15 bp, Homo sapiens
taactttcaaatagt

SEQ ID NO: 164213 - DNA, 15 bp, Homo sapiens
ataactttcaaatag

SEQ ID NO: 164214 - DNA, 15 bp, Homo sapiens
tataactttcaaata

SEQ ID NO: 164215 - DNA, 15 bp, Homo sapiens
ttataactttcaaat

SEQ ID NO: 164216 - DNA, 15 bp, Homo sapiens
attataactttcaaa

SEQ ID NO: 164217 - DNA, 15 bp, Homo sapiens
aattataactttcaa

SEQ ID NO: 164218 - DNA, 15 bp, Homo sapiens
taattataactttca

SEQ ID NO: 164219 - DNA, 15 bp, Homo sapiens
ctaattataactttc

SEQ ID NO: 164220 - DNA, 15 bp, Homo sapiens
cctaattataacttt

SEQ ID NO: 164221 - DNA, 15 bp, Homo sapiens
ccctaattataactt

SEQ ID NO: 164222 - DNA, 15 bp, Homo sapiens
accctaattataact

SEQ ID NO: 164223 - DNA, 15 bp, Homo sapiens
gaccctaattataac

SEQ ID NO: 164224 - DNA, 15 bp, Homo sapiens
tgaccctaattataa

SEQ ID NO: 164225 - DNA, 15 bp, Homo sapiens
atgaccctaattata

SEQ ID NO: 164226 - DNA, 15 bp, Homo sapiens
tatgaccctaattat

SEQ ID NO: 164227 - DNA, 15 bp, Homo sapiens
ttatgaccctaatta

SEQ ID NO: 164228 - DNA, 15 bp, Homo sapiens
attatgaccctaatt

SEQ ID NO: 164229 - DNA, 15 bp, Homo sapiens
aattatgaccctaat

SEQ ID NO: 164230 - DNA, 15 bp, Homo sapiens
aaattatgaccctaa

SEQ ID NO: 164231 - DNA, 15 bp, Homo sapiens
aaaattatgacccta

SEQ ID NO: 164232 - DNA, 15 bp, Homo sapiens
aaaaattatgaccct

SEQ ID NO: 164233 - DNA, 15 bp, Homo sapiens
taaaaattatgaccc

SEQ ID NO: 164234 - DNA, 15 bp, Homo sapiens
ttaaaaattatgacc

SEQ ID NO: 164235 - DNA, 15 bp, Homo sapiens
attaaaaattatgac

SEQ ID NO: 164236 - DNA, 15 bp, Homo sapiens
cattaaaaattatga

SEQ ID NO: 164237 - DNA, 15 bp, Homo sapiens
acattaaaaattatg

SEQ ID NO: 164238 - DNA, 15 bp, Homo sapiens
gacattaaaaattat

SEQ ID NO: 164239 - DNA, 15 bp, Homo sapiens
tgacattaaaaatta

SEQ ID NO: 164240 - DNA, 15 bp, Homo sapiens
atgacattaaaaatt

SEQ ID NO: 164241 - DNA, 15 bp, Homo sapiens
aatgacattaaaaat

SEQ ID NO: 164242 - DNA, 15 bp, Homo sapiens
caatgacattaaaaa

SEQ ID NO: 164243 - DNA, 15 bp, Homo sapiens
acaatgacattaaaa

SEQ ID NO: 164244 - DNA, 15 bp, Homo sapiens
gacaatgacattaaa

SEQ ID NO: 164245 - DNA, 15 bp, Homo sapiens
tgacaatgacattaa

SEQ ID NO: 164246 - DNA, 15 bp, Homo sapiens
atgacaatgacatta

SEQ ID NO: 164247 - DNA, 15 bp, Homo sapiens
tatgacaatgacatt

SEQ ID NO: 164248 - DNA, 15 bp, Homo sapiens
gtatgacaatgacat

SEQ ID NO: 164249 - DNA, 15 bp, Homo sapiens
tgtatgacaatgaca

SEQ ID NO: 164250 - DNA, 15 bp, Homo sapiens
atgtatgacaatgac

SEQ ID NO: 164251 - DNA, 15 bp, Homo sapiens
aatgtatgacaatga

SEQ ID NO: 164252 - DNA, 15 bp, Homo sapiens
caatgtatgacaatg

SEQ ID NO: 164253 - DNA, 15 bp, Homo sapiens
ccaatgtatgacaat

SEQ ID NO: 164254 - DNA, 15 bp, Homo sapiens
tccaatgtatgacaa

SEQ ID NO: 164255 - DNA, 15 bp, Homo sapiens
ttccaatgtatgaca

SEQ ID NO: 164256 - DNA, 15 bp, Homo sapiens
tttccaatgtatgac

SEQ ID NO: 164257 - DNA, 15 bp, Homo sapiens
ttttccaatgtatga

SEQ ID NO: 164258 - DNA, 15 bp, Homo sapiens
attttccaatgtatg

SEQ ID NO: 164259 - DNA, 15 bp, Homo sapiens
cattttccaatgtat

SEQ ID NO: 164260 - DNA, 15 bp, Homo sapiens
ccattttccaatgta

SEQ ID NO: 164261 - DNA, 15 bp, Homo sapiens
tccattttccaatgt

SEQ ID NO: 164262 - DNA, 15 bp, Homo sapiens
ttccattttccaatg

SEQ ID NO: 164263 - DNA, 15 bp, Homo sapiens
cttccattttccaat

SEQ ID NO: 164264 - DNA, 15 bp, Homo sapiens
gcttccattttccaa

SEQ ID NO: 164265 - DNA, 15 bp, Homo sapiens
agcttccattttcca

SEQ ID NO: 164266 - DNA, 15 bp, Homo sapiens
aagcttccattttcc

SEQ ID NO: 164267 - DNA, 15 bp, Homo sapiens
aaagcttccattttc

SEQ ID NO: 164268 - DNA, 15 bp, Homo sapiens
caaagcttccatttt

SEQ ID NO: 164269 - DNA, 15 bp, Homo sapiens
ccaaagcttccattt

SEQ ID NO: 164270 - DNA, 15 bp, Homo sapiens
cccaaagcttccatt

SEQ ID NO: 164271 - DNA, 15 bp, Homo sapiens
tcccaaagcttccat

SEQ ID NO: 164272 - DNA, 15 bp, Homo sapiens
atcccaaagcttcca

SEQ ID NO: 164273 - DNA, 15 bp, Homo sapiens
tatcccaaagcttcc

SEQ ID NO: 164274 - DNA, 15 bp, Homo sapiens
atatcccaaagcttc

SEQ ID NO: 164275 - DNA, 15 bp, Homo sapiens
gatatcccaaagctt

SEQ ID NO: 164276 - DNA, 15 bp, Homo sapiens
ggatatcccaaagct

SEQ ID NO: 164277 - DNA, 15 bp, Homo sapiens
tggatatcccaaagc

SEQ ID NO: 164278 - DNA, 15 bp, Homo sapiens
gtggatatcccaaag

SEQ ID NO: 164279 - DNA, 15 bp, Homo sapiens
agtggatatcccaaa

SEQ ID NO: 164280 - DNA, 15 bp, Homo sapiens
cagtggatatcccaa

SEQ ID NO: 164281 - DNA, 15 bp, Homo sapiens
ccagtggatatccca

SEQ ID NO: 164282 - DNA, 15 bp, Homo sapiens
tccagtggatatccc

SEQ ID NO: 164283 - DNA, 15 bp, Homo sapiens
ctccagtggatatcc

SEQ ID NO: 164284 - DNA, 15 bp, Homo sapiens
cctccagtggatatc

SEQ ID NO: 164285 - DNA, 15 bp, Homo sapiens
acctccagtggatat

SEQ ID NO: 164286 - DNA, 15 bp, Homo sapiens
aacctccagtggata

SEQ ID NO: 164287 - DNA, 15 bp, Homo sapiens
aaacctccagtggat

SEQ ID NO: 164288 - DNA, 15 bp, Homo sapiens
aaaacctccagtgga

SEQ ID NO: 164289 - DNA, 15 bp, Homo sapiens
taaaacctccagtgg

SEQ ID NO: 164290 - DNA, 15 bp, Homo sapiens
gtaaaacctccagtg

SEQ ID NO: 164291 - DNA, 15 bp, Homo sapiens
ggtaaaacctccagt

SEQ ID NO: 164292 - DNA, 15 bp, Homo sapiens
aggtaaaacctccag

SEQ ID NO: 164293 - DNA, 15 bp, Homo sapiens
gaggtaaaacctcca

SEQ ID NO: 164294 - DNA, 15 bp, Homo sapiens
agaggtaaaacctcc

SEQ ID NO: 164295 - DNA, 15 bp, Homo sapiens
gagaggtaaaacctc

SEQ ID NO: 164296 - DNA, 15 bp, Homo sapiens
ggagaggtaaaacct

SEQ ID NO: 164297 - DNA, 15 bp, Homo sapiens
aggagaggtaaaacc

SEQ ID NO: 164298 - DNA, 15 bp, Homo sapiens
gaggagaggtaaaac

SEQ ID NO: 164299 - DNA, 15 bp, Homo sapiens
agaggagaggtaaaa

SEQ ID NO: 164300 - DNA, 15 bp, Homo sapiens
tagaggagaggtaaa

SEQ ID NO: 164301 - DNA, 15 bp, Homo sapiens
gtagaggagaggtaa

SEQ ID NO: 164302 - DNA, 15 bp, Homo sapiens
tgtagaggagaggta

SEQ ID NO: 164303 - DNA, 15 bp, Homo sapiens
ttgtagaggagaggt

SEQ ID NO: 164304 - DNA, 15 bp, Homo sapiens
attgtagaggagagg

SEQ ID NO: 164305 - DNA, 15 bp, Homo sapiens
cattgtagaggagag

SEQ ID NO: 164306 - DNA, 15 bp, Homo sapiens
gcattgtagaggaga

SEQ ID NO: 164307 - DNA, 15 bp, Homo sapiens
ggcattgtagaggag

SEQ ID NO: 164308 - DNA, 15 bp, Homo sapiens
tggcattgtagagga

SEQ ID NO: 164309 - DNA, 15 bp, Homo sapiens
gtggcattgtagagg

SEQ ID NO: 164310 - DNA, 15 bp, Homo sapiens
tgtggcattgtagag

SEQ ID NO: 164311 - DNA, 15 bp, Homo sapiens
gtgtggcattgtaga

SEQ ID NO: 164312 - DNA, 15 bp, Homo sapiens
agtgtggcattgtag

SEQ ID NO: 164313 - DNA, 15 bp, Homo sapiens
tagtgtggcattgta

SEQ ID NO: 164314 - DNA, 15 bp, Homo sapiens
ttagtgtggcattgt

SEQ ID NO: 164315 - DNA, 15 bp, Homo sapiens
tttagtgtggcattg

SEQ ID NO: 164316 - DNA, 15 bp, Homo sapiens
atttagtgtggcatt

SEQ ID NO: 164317 - DNA, 15 bp, Homo sapiens
aatttagtgtggcat

SEQ ID NO: 164318 - DNA, 15 bp, Homo sapiens
aaatttagtgtggca

SEQ ID NO: 164319 - DNA, 15 bp, Homo sapiens
caaatttagtgtggc

SEQ ID NO: 164320 - DNA, 15 bp, Homo sapiens
ccaaatttagtgtgg

SEQ ID NO: 164321 - DNA, 15 bp, Homo sapiens
tccaaatttagtgtg

SEQ ID NO: 164322 - DNA, 15 bp, Homo sapiens
ttccaaatttagtgt

SEQ ID NO: 164323 - DNA, 15 bp, Homo sapiens
tttccaaatttagtg

SEQ ID NO: 164324 - DNA, 15 bp, Homo sapiens
atttccaaatttagt

SEQ ID NO: 164325 - DNA, 15 bp, Homo sapiens
aatttccaaatttag

SEQ ID NO: 164326 - DNA, 15 bp, Homo sapiens
aaatttccaaattta

SEQ ID NO: 164327 - DNA, 15 bp, Homo sapiens
taaatttccaaattt

SEQ ID NO: 164328 - DNA, 15 bp, Homo sapiens
ataaatttccaaatt

SEQ ID NO: 164329 - DNA, 15 bp, Homo sapiens
aataaatttccaaat

SEQ ID NO: 164330 - DNA, 15 bp, Homo sapiens
gaataaatttccaaa

SEQ ID NO: 164331 - DNA, 15 bp, Homo sapiens
tgaataaatttccaa

SEQ ID NO: 164332 - DNA, 15 bp, Homo sapiens
ctgaataaatttcca

SEQ ID NO: 164333 - DNA, 15 bp, Homo sapiens
gctgaataaatttcc

SEQ ID NO: 164334 - DNA, 15 bp, Homo sapiens
agctgaataaatttc

SEQ ID NO: 164335 - DNA, 15 bp, Homo sapiens
cagctgaataaattt

SEQ ID NO: 164336 - DNA, 15 bp, Homo sapiens
tcagctgaataaatt

SEQ ID NO: 164337 - DNA, 15 bp, Homo sapiens
ttcagctgaataaat

SEQ ID NO: 164338 - DNA, 15 bp, Homo sapiens
tttcagctgaataaa

SEQ ID NO: 164339 - DNA, 15 bp, Homo sapiens
atttcagctgaataa

SEQ ID NO: 164340 - DNA, 15 bp, Homo sapiens
aatttcagctgaata

SEQ ID NO: 164341 - DNA, 15 bp, Homo sapiens
aaatttcagctgaat

SEQ ID NO: 164342 - DNA, 15 bp, Homo sapiens
aaaatttcagctgaa

SEQ ID NO: 164343 - DNA, 15 bp, Homo sapiens
aaaaatttcagctga

SEQ ID NO: 164344 - DNA, 15 bp, Homo sapiens
aaaaaatttcagctg

SEQ ID NO: 164345 - DNA, 15 bp, Homo sapiens
gaaaaaatttcagct

SEQ ID NO: 164346 - DNA, 15 bp, Homo sapiens
tgaaaaaatttcagc

SEQ ID NO: 164347 - DNA, 15 bp, Homo sapiens
ttgaaaaaatttcag

SEQ ID NO: 164348 - DNA, 15 bp, Homo sapiens
cttgaaaaaatttca

SEQ ID NO: 164349 - DNA, 15 bp, Homo sapiens
acttgaaaaaatttc

SEQ ID NO: 164350 - DNA, 15 bp, Homo sapiens
aacttgaaaaaattt

SEQ ID NO: 164351 - DNA, 15 bp, Homo sapiens
aaacttgaaaaaatt

SEQ ID NO: 164352 - DNA, 15 bp, Homo sapiens
taaacttgaaaaaat

SEQ ID NO: 164353 - DNA, 15 bp, Homo sapiens
ttaaacttgaaaaaa

SEQ ID NO: 164354 - DNA, 15 bp, Homo sapiens
tttaaacttgaaaaa

SEQ ID NO: 164355 - DNA, 15 bp, Homo sapiens
atttaaacttgaaaa

SEQ ID NO: 164356 - DNA, 15 bp, Homo sapiens
tatttaaacttgaaa

SEQ ID NO: 164357 - DNA, 15 bp, Homo sapiens
atatttaaacttgaa

SEQ ID NO: 164358 - DNA, 15 bp, Homo sapiens
aatatttaaacttga

SEQ ID NO: 164359 - DNA, 15 bp, Homo sapiens
taatatttaaacttg

SEQ ID NO: 164360 - DNA, 15 bp, Homo sapiens
ataatatttaaactt

SEQ ID NO: 164361 - DNA, 15 bp, Homo sapiens
tataatatttaaact

SEQ ID NO: 164362 - DNA, 15 bp, Homo sapiens
atataatatttaaac

SEQ ID NO: 164363 - DNA, 15 bp, Homo sapiens
aaatataatatttaa

SEQ ID NO: 164364 - DNA, 15 bp, Homo sapiens
taaatataatattta

SEQ ID NO: 164365 - DNA, 15 bp, Homo sapiens
gtaaatataatattt

SEQ ID NO: 164366 - DNA, 15 bp, Homo sapiens
agtaaatataatatt

SEQ ID NO: 164367 - DNA, 15 bp, Homo sapiens
aagtaaatataatat

SEQ ID NO: 164368 - DNA, 15 bp, Homo sapiens
aaagtaaatataata

SEQ ID NO: 164369 - DNA, 15 bp, Homo sapiens
aaaagtaaatataat

SEQ ID NO: 164370 - DNA, 15 bp, Homo sapiens
aaaaagtaaatataa

SEQ ID NO: 164371 - DNA, 15 bp, Homo sapiens
taaaaagtaaatata

SEQ ID NO: 164372 - DNA, 15 bp, Homo sapiens
aataaaaagtaaata

SEQ ID NO: 164373 - DNA, 15 bp, Homo sapiens
caataaaaagtaaat

SEQ ID NO: 164374 - DNA, 15 bp, Homo sapiens
tcaataaaaagtaaa

SEQ ID NO: 164375 - DNA, 15 bp, Homo sapiens
atcaataaaaagtaa

SEQ ID NO: 164376 - DNA, 15 bp, Homo sapiens
catcaataaaaagta

SEQ ID NO: 164377 - DNA, 15 bp, Homo sapiens
tcatcaataaaaagt

SEQ ID NO: 164378 - DNA, 15 bp, Homo sapiens
atcatcaataaaaag

SEQ ID NO: 164379 - DNA, 15 bp, Homo sapiens
tatcatcaataaaaa

SEQ ID NO: 164380 - DNA, 15 bp, Homo sapiens
gtatcatcaataaaa

SEQ ID NO: 164381 - DNA, 15 bp, Homo sapiens
agtatcatcaataaa

SEQ ID NO: 164382 - DNA, 15 bp, Homo sapiens
tagtatcatcaataa

SEQ ID NO: 164383 - DNA, 15 bp, Homo sapiens
gtagtatcatcaata

SEQ ID NO: 164384 - DNA, 15 bp, Homo sapiens
agtagtatcatcaat

SEQ ID NO: 164385 - DNA, 15 bp, Homo sapiens
tagtagtatcatcaa

SEQ ID NO: 164386 - DNA, 15 bp, Homo sapiens
ttagtagtatcatca

SEQ ID NO: 164387 - DNA, 15 bp, Homo sapiens
cttagtagtatcatc

SEQ ID NO: 164388 - DNA, 15 bp, Homo sapiens
acttagtagtatcat

SEQ ID NO: 164389 - DNA, 15 bp, Homo sapiens
tacttagtagtatca

SEQ ID NO: 164390 - DNA, 15 bp, Homo sapiens
gtacttagtagtatc

SEQ ID NO: 164391 - DNA, 15 bp, Homo sapiens
tgtacttagtagtat

SEQ ID NO: 164392 - DNA, 15 bp, Homo sapiens
ctgtacttagtagta

SEQ ID NO: 164393 - DNA, 15 bp, Homo sapiens
actgtacttagtagt

SEQ ID NO: 164394 - DNA, 15 bp, Homo sapiens
cactgtacttagtag

SEQ ID NO: 164395 - DNA, 15 bp, Homo sapiens
gcactgtacttagta

SEQ ID NO: 164396 - DNA, 15 bp, Homo sapiens
agcactgtacttagt

SEQ ID NO: 164397 - DNA, 15 bp, Homo sapiens
aagcactgtacttag

SEQ ID NO: 164398 - DNA, 15 bp, Homo sapiens
gaagcactgtactta

SEQ ID NO: 164399 - DNA, 15 bp, Homo sapiens
ggaagcactgtactt

SEQ ID NO: 164400 - DNA, 15 bp, Homo sapiens
aggaagcactgtact

SEQ ID NO: 164401 - DNA, 15 bp, Homo sapiens
aaggaagcactgtac

SEQ ID NO: 164402 - DNA, 15 bp, Homo sapiens
caaggaagcactgta

SEQ ID NO: 164403 - DNA, 15 bp, Homo sapiens
tcaaggaagcactgt

SEQ ID NO: 164404 - DNA, 15 bp, Homo sapiens
ctcaaggaagcactg

SEQ ID NO: 164405 - DNA, 15 bp, Homo sapiens
actcaaggaagcact

SEQ ID NO: 164406 - DNA, 15 bp, Homo sapiens
cactcaaggaagcac

SEQ ID NO: 164407 - DNA, 15 bp, Homo sapiens
acactcaaggaagca

SEQ ID NO: 164408 - DNA, 15 bp, Homo sapiens
tacactcaaggaagc

SEQ ID NO: 164409 - DNA, 15 bp, Homo sapiens
atacactcaaggaag

SEQ ID NO: 164410 - DNA, 15 bp, Homo sapiens
aatacactcaaggaa

SEQ ID NO: 164411 - DNA, 15 bp, Homo sapiens
gaatacactcaagga

SEQ ID NO: 164412 - DNA, 15 bp, Homo sapiens
ggaatacactcaagg

SEQ ID NO: 164413 - DNA, 15 bp, Homo sapiens
aggaatacactcaag

SEQ ID NO: 164414 - DNA, 15 bp, Homo sapiens
aaggaatacactcaa

SEQ ID NO: 164415 - DNA, 15 bp, Homo sapiens
taaggaatacactca

SEQ ID NO: 164416 - DNA, 15 bp, Homo sapiens
ttaaggaatacactc

SEQ ID NO: 164417 - DNA, 15 bp, Homo sapiens
attaaggaatacact

SEQ ID NO: 164418 - DNA, 15 bp, Homo sapiens
tattaaggaatacac

SEQ ID NO: 164419 - DNA, 15 bp, Homo sapiens
ttattaaggaataca

SEQ ID NO: 164420 - DNA, 15 bp, Homo sapiens
tttattaaggaatac

SEQ ID NO: 164421 - DNA, 15 bp, Homo sapiens
atttattaaggaata

SEQ ID NO: 164422 - DNA, 15 bp, Homo sapiens
tatttattaaggaat

SEQ ID NO: 164423 - DNA, 15 bp, Homo sapiens
atatttattaaggaa

SEQ ID NO: 164424 - DNA, 15 bp, Homo sapiens
aatatttattaagga

SEQ ID NO: 164425 - DNA, 15 bp, Homo sapiens
aaatatttattaagg

SEQ ID NO: 164426 - DNA, 15 bp, Homo sapiens
gaaatatttattaag

SEQ ID NO: 164427 - DNA, 15 bp, Homo sapiens
agaaatatttattaa

SEQ ID NO: 164428 - DNA, 15 bp, Homo sapiens
aagaaatatttatta

SEQ ID NO: 164429 - DNA, 15 bp, Homo sapiens
gaagaaatatttatt

SEQ ID NO: 164430 - DNA, 15 bp, Homo sapiens
tgaagaaatatttat

SEQ ID NO: 164431 - DNA, 15 bp, Homo sapiens
ttgaagaaatattta

SEQ ID NO: 164432 - DNA, 15 bp, Homo sapiens
attgaagaaatattt

SEQ ID NO: 164433 - DNA, 15 bp, Homo sapiens
aattgaagaaatatt

SEQ ID NO: 164434 - DNA, 15 bp, Homo sapiens
aaattgaagaaatat

SEQ ID NO: 164435 - DNA, 15 bp, Homo sapiens
caaattgaagaaata

SEQ ID NO: 164436 - DNA, 15 bp, Homo sapiens
acaaattgaagaaat

SEQ ID NO: 164437 - DNA, 15 bp, Homo sapiens
aacaaattgaagaaa

SEQ ID NO: 164438 - DNA, 15 bp, Homo sapiens
aaacaaattgaagaa

SEQ ID NO: 164439 - DNA, 15 bp, Homo sapiens
caaacaaattgaaga

SEQ ID NO: 164440 - DNA, 15 bp, Homo sapiens
tcaaacaaattgaag

SEQ ID NO: 164441 - DNA, 15 bp, Homo sapiens
ttcaaacaaattgaa

SEQ ID NO: 164442 - DNA, 15 bp, Homo sapiens
attcaaacaaattga

SEQ ID NO: 164443 - DNA, 15 bp, Homo sapiens
tattcaaacaaattg

SEQ ID NO: 164444 - DNA, 15 bp, Homo sapiens
atattcaaacaaatt

SEQ ID NO: 164445 - DNA, 15 bp, Homo sapiens
aatattcaaacaaat

SEQ ID NO: 164446 - DNA, 15 bp, Homo sapiens
aaatattcaaacaaa

SEQ ID NO: 164447 - DNA, 15 bp, Homo sapiens
aaaatattcaaacaa

SEQ ID NO: 164448 - DNA, 15 bp, Homo sapiens
caaaatattcaaaca

SEQ ID NO: 164449 - DNA, 15 bp, Homo sapiens
gcaaaatattcaaac

SEQ ID NO: 164450 - DNA, 15 bp, Homo sapiens
ggcaaaatattcaaa

SEQ ID NO: 164451 - DNA, 15 bp, Homo sapiens
tggcaaaatattcaa

SEQ ID NO: 164452 - DNA, 15 bp, Homo sapiens
gtggcaaaatattca

SEQ ID NO: 164453 - DNA, 15 bp, Homo sapiens
tgtggcaaaatattc

SEQ ID NO: 164454 - DNA, 15 bp, Homo sapiens
ttgtggcaaaatatt

SEQ ID NO: 164455 - DNA, 15 bp, Homo sapiens
tttgtggcaaaatat

SEQ ID NO: 164456 - DNA, 15 bp, Homo sapiens
gtttgtggcaaaata

SEQ ID NO: 164457 - DNA, 15 bp, Homo sapiens
ggtttgtggcaaaat

SEQ ID NO: 164458 - DNA, 15 bp, Homo sapiens
tggtttgtggcaaaa

SEQ ID NO: 164459 - DNA, 15 bp, Homo sapiens
ctggtttgtggcaaa

SEQ ID NO: 164460 - DNA, 15 bp, Homo sapiens
actggtttgtggcaa

SEQ ID NO: 164461 - DNA, 15 bp, Homo sapiens
gactggtttgtggca

SEQ ID NO: 164462 - DNA, 15 bp, Homo sapiens
agactggtttgtggc

SEQ ID NO: 164463 - DNA, 15 bp, Homo sapiens
aagactggtttgtgg

SEQ ID NO: 164464 - DNA, 15 bp, Homo sapiens
aaagactggtttgtg

SEQ ID NO: 164465 - DNA, 15 bp, Homo sapiens
taaagactggtttgt

SEQ ID NO: 164466 - DNA, 15 bp, Homo sapiens
ctaaagactggtttg

SEQ ID NO: 164467 - DNA, 15 bp, Homo sapiens
gctaaagactggttt

SEQ ID NO: 164468 - DNA, 15 bp, Homo sapiens
agctaaagactggtt

SEQ ID NO: 164469 - DNA, 15 bp, Homo sapiens
aagctaaagactggt

SEQ ID NO: 164470 - DNA, 15 bp, Homo sapiens
caagctaaagactgg

SEQ ID NO: 164471 - DNA, 15 bp, Homo sapiens
tcaagctaaagactg

SEQ ID NO: 164472 - DNA, 15 bp, Homo sapiens
gtcaagctaaagact

SEQ ID NO: 164473 - DNA, 15 bp, Homo sapiens
tgtcaagctaaagac

SEQ ID NO: 164474 - DNA, 15 bp, Homo sapiens
atgtcaagctaaaga

SEQ ID NO: 164475 - DNA, 15 bp, Homo sapiens
aatgtcaagctaaag

SEQ ID NO: 164476 - DNA, 15 bp, Homo sapiens
aaatgtcaagctaaa

SEQ ID NO: 164477 - DNA, 15 bp, Homo sapiens
caaatgtcaagctaa

SEQ ID NO: 164478 - DNA, 15 bp, Homo sapiens
tcaaatgtcaagcta

SEQ ID NO: 164479 - DNA, 15 bp, Homo sapiens
ttcaaatgtcaagct

SEQ ID NO: 164480 - DNA, 15 bp, Homo sapiens
attcaaatgtcaagc

SEQ ID NO: 164481 - DNA, 15 bp, Homo sapiens
aattcaaatgtcaag

SEQ ID NO: 164482 - DNA, 15 bp, Homo sapiens
aaattcaaatgtcaa

SEQ ID NO: 164483 - DNA, 15 bp, Homo sapiens
taaattcaaatgtca

SEQ ID NO: 164484 - DNA, 15 bp, Homo sapiens
ttaaattcaaatgtc

SEQ ID NO: 164485 - DNA, 15 bp, Homo sapiens
attaaattcaaatgt

SEQ ID NO: 164486 - DNA, 15 bp, Homo sapiens
gattaaattcaaatg

SEQ ID NO: 164487 - DNA, 15 bp, Homo sapiens
agattaaattcaaat

SEQ ID NO: 164488 - DNA, 15 bp, Homo sapiens
aagattaaattcaaa

SEQ ID NO: 164489 - DNA, 15 bp, Homo sapiens
gaagattaaattcaa

SEQ ID NO: 164490 - DNA, 15 bp, Homo sapiens
ggaagattaaattca

SEQ ID NO: 164491 - DNA, 15 bp, Homo sapiens
tggaagattaaattc

SEQ ID NO: 164492 - DNA, 15 bp, Homo sapiens
atggaagattaaatt

SEQ ID NO: 164493 - DNA, 15 bp, Homo sapiens
catggaagattaaat

SEQ ID NO: 164494 - DNA, 15 bp, Homo sapiens
acatggaagattaaa

SEQ ID NO: 164495 - DNA, 15 bp, Homo sapiens
tacatggaagattaa

SEQ ID NO: 164496 - DNA, 15 bp, Homo sapiens
atacatggaagatta

SEQ ID NO: 164497 - DNA, 15 bp, Homo sapiens
aatacatggaagatt

SEQ ID NO: 164498 - DNA, 15 bp, Homo sapiens
taatacatggaagat

SEQ ID NO: 164499 - DNA, 15 bp, Homo sapiens
ttaatacatggaaga

SEQ ID NO: 164500 - DNA, 15 bp, Homo sapiens
gttaatacatggaag

SEQ ID NO: 164501 - DNA, 15 bp, Homo sapiens
agttaatacatggaa

SEQ ID NO: 164502 - DNA, 15 bp, Homo sapiens
tagttaatacatgga

SEQ ID NO: 164503 - DNA, 15 bp, Homo sapiens
ctagttaatacatgg

SEQ ID NO: 164504 - DNA, 15 bp, Homo sapiens
cctagttaatacatg

SEQ ID NO: 164505 - DNA, 15 bp, Homo sapiens
gcctagttaatacat

SEQ ID NO: 164506 - DNA, 15 bp, Homo sapiens
tgcctagttaataca

SEQ ID NO: 164507 - DNA, 15 bp, Homo sapiens
atgcctagttaatac

SEQ ID NO: 164508 - DNA, 15 bp, Homo sapiens
catgcctagttaata

SEQ ID NO: 164509 - DNA, 15 bp, Homo sapiens
acatgcctagttaat

SEQ ID NO: 164510 - DNA, 15 bp, Homo sapiens
tacatgcctagttaa

SEQ ID NO: 164511 - DNA, 15 bp, Homo sapiens
gtacatgcctagtta

SEQ ID NO: 164512 - DNA, 15 bp, Homo sapiens
tgtacatgcctagtt

SEQ ID NO: 164513 - DNA, 15 bp, Homo sapiens
ttgtacatgcctagt

SEQ ID NO: 164514 - DNA, 15 bp, Homo sapiens
tttgtacatgcctag

SEQ ID NO: 164515 - DNA, 15 bp, Homo sapiens
ttttgtacatgccta

SEQ ID NO: 164516 - DNA, 15 bp, Homo sapiens
gttttgtacatgcct

SEQ ID NO: 164517 - DNA, 15 bp, Homo sapiens
tgttttgtacatgcc

SEQ ID NO: 164518 - DNA, 15 bp, Homo sapiens
gtgttttgtacatgc

SEQ ID NO: 164519 - DNA, 15 bp, Homo sapiens
tgtgttttgtacatg

SEQ ID NO: 164520 - DNA, 15 bp, Homo sapiens
atgtgttttgtacat

SEQ ID NO: 164521 - DNA, 15 bp, Homo sapiens
catgtgttttgtaca

SEQ ID NO: 164522 - DNA, 15 bp, Homo sapiens
gcatgtgttttgtac

SEQ ID NO: 164523 - DNA, 15 bp, Homo sapiens
agcatgtgttttgta

SEQ ID NO: 164524 - DNA, 15 bp, Homo sapiens
aagcatgtgttttgt

SEQ ID NO: 164525 - DNA, 15 bp, Homo sapiens
taagcatgtgttttg

SEQ ID NO: 164526 - DNA, 15 bp, Homo sapiens
ataagcatgtgtttt

SEQ ID NO: 164527 - DNA, 15 bp, Homo sapiens
aataagcatgtgttt

SEQ ID NO: 164528 - DNA, 15 bp, Homo sapiens
aaataagcatgtgtt

SEQ ID NO: 164529 - DNA, 15 bp, Homo sapiens
taaataagcatgtgt

SEQ ID NO: 164530 - DNA, 15 bp, Homo sapiens
ataaataagcatgtg

SEQ ID NO: 164531 - DNA, 15 bp, Homo sapiens
aataaataagcatgt

SEQ ID NO: 164532 - DNA, 15 bp, Homo sapiens
taataaataagcatg

SEQ ID NO: 164533 - DNA, 15 bp, Homo sapiens
ctaataaataagcat

SEQ ID NO: 164534 - DNA, 15 bp, Homo sapiens
cctaataaataagca

SEQ ID NO: 164535 - DNA, 15 bp, Homo sapiens
gcctaataaataagc

SEQ ID NO: 164536 - DNA, 15 bp, Homo sapiens
tgcctaataaataag

SEQ ID NO: 164537 - DNA, 15 bp, Homo sapiens
atgcctaataaataa

SEQ ID NO: 164538 - DNA, 15 bp, Homo sapiens
catgcctaataaata

SEQ ID NO: 164539 - DNA, 15 bp, Homo sapiens
gcatgcctaataaat

SEQ ID NO: 164540 - DNA, 15 bp, Homo sapiens
tgcatgcctaataaa

SEQ ID NO: 164541 - DNA, 15 bp, Homo sapiens
gtgcatgcctaataa

SEQ ID NO: 164542 - DNA, 15 bp, Homo sapiens
agtgcatgcctaata

SEQ ID NO: 164543 - DNA, 15 bp, Homo sapiens
tagtgcatgcctaat

SEQ ID NO: 164544 - DNA, 15 bp, Homo sapiens
ttagtgcatgcctaa

SEQ ID NO: 164545 - DNA, 15 bp, Homo sapiens
gttagtgcatgccta

SEQ ID NO: 164546 - DNA, 15 bp, Homo sapiens
agttagtgcatgcct

SEQ ID NO: 164547 - DNA, 15 bp, Homo sapiens
cagttagtgcatgcc

SEQ ID NO: 164548 - DNA, 15 bp, Homo sapiens
acagttagtgcatgc

SEQ ID NO: 164549 - DNA, 15 bp, Homo sapiens
tacagttagtgcatg

SEQ ID NO: 164550 - DNA, 15 bp, Homo sapiens
gtacagttagtgcat

SEQ ID NO: 164551 - DNA, 15 bp, Homo sapiens
agtacagttagtgca

SEQ ID NO: 164552 - DNA, 15 bp, Homo sapiens
aagtacagttagtgc

SEQ ID NO: 164553 - DNA, 15 bp, Homo sapiens
aaagtacagttagtg

SEQ ID NO: 164554 - DNA, 15 bp, Homo sapiens
caaagtacagttagt

SEQ ID NO: 164555 - DNA, 15 bp, Homo sapiens
ccaaagtacagttag

SEQ ID NO: 164556 - DNA, 15 bp, Homo sapiens
accaaagtacagtta

SEQ ID NO: 164557 - DNA, 15 bp, Homo sapiens
aaccaaagtacagtt

SEQ ID NO: 164558 - DNA, 15 bp, Homo sapiens
taaccaaagtacagt

SEQ ID NO: 164559 - DNA, 15 bp, Homo sapiens
gtaaccaaagtacag

SEQ ID NO: 164560 - DNA, 15 bp, Homo sapiens
tgtaaccaaagtaca

SEQ ID NO: 164561 - DNA, 15 bp, Homo sapiens
ctgtaaccaaagtac

SEQ ID NO: 164562 - DNA, 15 bp, Homo sapiens
cctgtaaccaaagta

SEQ ID NO: 164563 - DNA, 15 bp, Homo sapiens
gcctgtaaccaaagt

SEQ ID NO: 164564 - DNA, 15 bp, Homo sapiens
agcctgtaaccaaag

SEQ ID NO: 164565 - DNA, 15 bp, Homo sapiens
tagcctgtaaccaaa

SEQ ID NO: 164566 - DNA, 15 bp, Homo sapiens
ttagcctgtaaccaa

SEQ ID NO: 164567 - DNA, 15 bp, Homo sapiens
tttagcctgtaacca

SEQ ID NO: 164568 - DNA, 15 bp, Homo sapiens
ttttagcctgtaacc

SEQ ID NO: 164569 - DNA, 15 bp, Homo sapiens
cttttagcctgtaac

SEQ ID NO: 164570 - DNA, 15 bp, Homo sapiens
tcttttagcctgtaa

SEQ ID NO: 164571 - DNA, 15 bp, Homo sapiens
gtcttttagcctgta

SEQ ID NO: 164572 - DNA, 15 bp, Homo sapiens
agtcttttagcctgt

SEQ ID NO: 164573 - DNA, 15 bp, Homo sapiens
aagtcttttagcctg

SEQ ID NO: 164574 - DNA, 15 bp, Homo sapiens
aaagtcttttagcct

SEQ ID NO: 164575 - DNA, 15 bp, Homo sapiens
taaagtcttttagcc

SEQ ID NO: 164576 - DNA, 15 bp, Homo sapiens
ctaaagtcttttagc

SEQ ID NO: 164577 - DNA, 15 bp, Homo sapiens
tctaaagtcttttag

SEQ ID NO: 164578 - DNA, 15 bp, Homo sapiens
ctctaaagtctttta

SEQ ID NO: 164579 - DNA, 15 bp, Homo sapiens
actctaaagtctttt

SEQ ID NO: 164580 - DNA, 15 bp, Homo sapiens
aactctaaagtcttt

SEQ ID NO: 164581 - DNA, 15 bp, Homo sapiens
caactctaaagtctt

SEQ ID NO: 164582 - DNA, 15 bp, Homo sapiens
ccaactctaaagtct

SEQ ID NO: 164583 - DNA, 15 bp, Homo sapiens
accaactctaaagtc

SEQ ID NO: 164584 - DNA, 15 bp, Homo sapiens
aaccaactctaaagt

SEQ ID NO: 164585 - DNA, 15 bp, Homo sapiens
aaaccaactctaaag

SEQ ID NO: 164586 - DNA, 15 bp, Homo sapiens
aaaaccaactctaaa

SEQ ID NO: 164587 - DNA, 15 bp, Homo sapiens
gaaaaccaactctaa

SEQ ID NO: 164588 - DNA, 15 bp, Homo sapiens
tgaaaaccaactcta

SEQ ID NO: 164589 - DNA, 15 bp, Homo sapiens
ttgaaaaccaactct

SEQ ID NO: 164590 - DNA, 15 bp, Homo sapiens
tttgaaaaccaactc

SEQ ID NO: 164591 - DNA, 15 bp, Homo sapiens
ttttgaaaaccaact

SEQ ID NO: 164592 - DNA, 15 bp, Homo sapiens
attttgaaaaccaac

SEQ ID NO: 164593 - DNA, 15 bp, Homo sapiens
gattttgaaaaccaa

SEQ ID NO: 164594 - DNA, 15 bp, Homo sapiens
agattttgaaaacca

SEQ ID NO: 164595 - DNA, 15 bp, Homo sapiens
tagattttgaaaacc

SEQ ID NO: 164596 - DNA, 15 bp, Homo sapiens
atagattttgaaaac

SEQ ID NO: 164597 - DNA, 15 bp, Homo sapiens
aatagattttgaaaa

SEQ ID NO: 164598 - DNA, 15 bp, Homo sapiens
aaatagattttgaaa

SEQ ID NO: 164599 - DNA, 15 bp, Homo sapiens
caaatagattttgaa

SEQ ID NO: 164600 - DNA, 15 bp, Homo sapiens
gcaaatagattttga

SEQ ID NO: 164601 - DNA, 15 bp, Homo sapiens
agcaaatagattttg

SEQ ID NO: 164602 - DNA, 15 bp, Homo sapiens
aagcaaatagatttt

SEQ ID NO: 164603 - DNA, 15 bp, Homo sapiens
gaagcaaatagattt

SEQ ID NO: 164604 - DNA, 15 bp, Homo sapiens
tgaagcaaatagatt

SEQ ID NO: 164605 - DNA, 15 bp, Homo sapiens
ttgaagcaaatagat

SEQ ID NO: 164606 - DNA, 15 bp, Homo sapiens
tttgaagcaaataga

SEQ ID NO: 164607 - DNA, 15 bp, Homo sapiens
ctttgaagcaaatag

SEQ ID NO: 164608 - DNA, 15 bp, Homo sapiens
tctttgaagcaaata

SEQ ID NO: 164609 - DNA, 15 bp, Homo sapiens
ttctttgaagcaaat

SEQ ID NO: 164610 - DNA, 15 bp, Homo sapiens
attctttgaagcaaa

SEQ ID NO: 164611 - DNA, 15 bp, Homo sapiens
gattctttgaagcaa

SEQ ID NO: 164612 - DNA, 15 bp, Homo sapiens
agattctttgaagca

SEQ ID NO: 164613 - DNA, 15 bp, Homo sapiens
aagattctttgaagc

SEQ ID NO: 164614 - DNA, 15 bp, Homo sapiens
taagattctttgaag

SEQ ID NO: 164615 - DNA, 15 bp, Homo sapiens
ctaagattctttgaa

SEQ ID NO: 164616 - DNA, 15 bp, Homo sapiens
actaagattctttga

SEQ ID NO: 164617 - DNA, 15 bp, Homo sapiens
tactaagattctttg

SEQ ID NO: 164618 - DNA, 15 bp, Homo sapiens
ctactaagattcttt

SEQ ID NO: 164619 - DNA, 15 bp, Homo sapiens
actactaagattctt

SEQ ID NO: 164620 - DNA, 15 bp, Homo sapiens
gactactaagattct

SEQ ID NO: 164621 - DNA, 15 bp, Homo sapiens
tgactactaagattc

SEQ ID NO: 164622 - DNA, 15 bp, Homo sapiens
ctgactactaagatt

SEQ ID NO: 164623 - DNA, 15 bp, Homo sapiens
actgactactaagat

SEQ ID NO: 164624 - DNA, 15 bp, Homo sapiens
tactgactactaaga

SEQ ID NO: 164625 - DNA, 15 bp, Homo sapiens
ctactgactactaag

SEQ ID NO: 164626 - DNA, 15 bp, Homo sapiens
actactgactactaa

SEQ ID NO: 164627 - DNA, 15 bp, Homo sapiens
aactactgactacta

SEQ ID NO: 164628 - DNA, 15 bp, Homo sapiens
taactactgactact

SEQ ID NO: 164629 - DNA, 15 bp, Homo sapiens
ttaactactgactac

SEQ ID NO: 164630 - DNA, 15 bp, Homo sapiens
gttaactactgacta

SEQ ID NO: 164631 - DNA, 15 bp, Homo sapiens
ggttaactactgact

SEQ ID NO: 164632 - DNA, 15 bp, Homo sapiens
tggttaactactgac

SEQ ID NO: 164633 - DNA, 15 bp, Homo sapiens
ttggttaactactga

SEQ ID NO: 164634 - DNA, 15 bp, Homo sapiens
cttggttaactactg

SEQ ID NO: 164635 - DNA, 15 bp, Homo sapiens
tcttggttaactact

SEQ ID NO: 164636 - DNA, 15 bp, Homo sapiens
ttcttggttaactac

SEQ ID NO: 164637 - DNA, 15 bp, Homo sapiens
tttcttggttaacta

SEQ ID NO: 164638 - DNA, 15 bp, Homo sapiens
gtttcttggttaact

SEQ ID NO: 164639 - DNA, 15 bp, Homo sapiens
agtttcttggttaac

SEQ ID NO: 164640 - DNA, 15 bp, Homo sapiens
aagtttcttggttaa

SEQ ID NO: 164641 - DNA, 15 bp, Homo sapiens
aaagtttcttggtta

SEQ ID NO: 164642 - DNA, 15 bp, Homo sapiens
taaagtttcttggtt

SEQ ID NO: 164643 - DNA, 15 bp, Homo sapiens
ttaaagtttcttggt

SEQ ID NO: 164644 - DNA, 15 bp, Homo sapiens
tttaaagtttcttgg

SEQ ID NO: 164645 - DNA, 15 bp, Homo sapiens
ttttaaagtttcttg

SEQ ID NO: 164646 - DNA, 15 bp, Homo sapiens
tttttaaagtttctt

SEQ ID NO: 164647 - DNA, 15 bp, Homo sapiens
ttttttaaagtttct

SEQ ID NO: 164648 - DNA, 15 bp, Homo sapiens
tttttttaaagtttc

SEQ ID NO: 164649 - DNA, 15 bp, Homo sapiens
atttttttaaagttt

SEQ ID NO: 164650 - DNA, 15 bp, Homo sapiens
catttttttaaagtt

SEQ ID NO: 164651 - DNA, 15 bp, Homo sapiens
tcatttttttaaagt

SEQ ID NO: 164652 - DNA, 15 bp, Homo sapiens
ctcatttttttaaag

SEQ ID NO: 164653 - DNA, 15 bp, Homo sapiens
gctcatttttttaaa

SEQ ID NO: 164654 - DNA, 15 bp, Homo sapiens
ggctcatttttttaa

SEQ ID NO: 164655 - DNA, 15 bp, Homo sapiens
gggctcattttttta

SEQ ID NO: 164656 - DNA, 15 bp, Homo sapiens
ggggctcattttttt

SEQ ID NO: 164657 - DNA, 15 bp, Homo sapiens
tggggctcatttttt

SEQ ID NO: 164658 - DNA, 15 bp, Homo sapiens
atggggctcattttt

SEQ ID NO: 164659 - DNA, 15 bp, Homo sapiens
aatggggctcatttt

SEQ ID NO: 164660 - DNA, 15 bp, Homo sapiens
aaatggggctcattt

SEQ ID NO: 164661 - DNA, 15 bp, Homo sapiens
aaaatggggctcatt

SEQ ID NO: 164662 - DNA, 15 bp, Homo sapiens
taaaatggggctcat

SEQ ID NO: 164663 - DNA, 15 bp, Homo sapiens
ttaaaatggggctca

SEQ ID NO: 164664 - DNA, 15 bp, Homo sapiens
attaaaatggggctc

SEQ ID NO: 164665 - DNA, 15 bp, Homo sapiens
aattaaaatggggct

SEQ ID NO: 164666 - DNA, 15 bp, Homo sapiens
aaattaaaatggggc

SEQ ID NO: 164667 - DNA, 15 bp, Homo sapiens
aaaattaaaatgggg

SEQ ID NO: 164668 - DNA, 15 bp, Homo sapiens
taaaattaaaatggg

SEQ ID NO: 164669 - DNA, 15 bp, Homo sapiens
ataaaattaaaatgg

SEQ ID NO: 164670 - DNA, 15 bp, Homo sapiens
aataaaattaaaatg

SEQ ID NO: 164671 - DNA, 15 bp, Homo sapiens
aaataaaattaaaat

SEQ ID NO: 164672 - DNA, 15 bp, Homo sapiens
taaataaaattaaaa

SEQ ID NO: 164673 - DNA, 15 bp, Homo sapiens
gtaaataaaattaaa

SEQ ID NO: 164674 - DNA, 15 bp, Homo sapiens
ggtaaataaaattaa

SEQ ID NO: 164675 - DNA, 15 bp, Homo sapiens
gggtaaataaaatta

SEQ ID NO: 164676 - DNA, 15 bp, Homo sapiens
tgggtaaataaaatt

SEQ ID NO: 164677 - DNA, 15 bp, Homo sapiens
atgggtaaataaaat

SEQ ID NO: 164678 - DNA, 15 bp, Homo sapiens
gatgggtaaataaaa

SEQ ID NO: 164679 - DNA, 15 bp, Homo sapiens
agatgggtaaataaa

SEQ ID NO: 164680 - DNA, 15 bp, Homo sapiens
tagatgggtaaataa

SEQ ID NO: 164681 - DNA, 15 bp, Homo sapiens
ctagatgggtaaata

SEQ ID NO: 164682 - DNA, 15 bp, Homo sapiens
gctagatgggtaaat

SEQ ID NO: 164683 - DNA, 15 bp, Homo sapiens
agctagatgggtaaa

SEQ ID NO: 164684 - DNA, 15 bp, Homo sapiens
tagctagatgggtaa

SEQ ID NO: 164685 - DNA, 15 bp, Homo sapiens
atagctagatgggta

SEQ ID NO: 164686 - DNA, 15 bp, Homo sapiens
aatagctagatgggt

SEQ ID NO: 164687 - DNA, 15 bp, Homo sapiens
gaatagctagatggg

SEQ ID NO: 164688 - DNA, 15 bp, Homo sapiens
tgaatagctagatgg

SEQ ID NO: 164689 - DNA, 15 bp, Homo sapiens
atgaatagctagatg

SEQ ID NO: 164690 - DNA, 15 bp, Homo sapiens
aatgaatagctagat

SEQ ID NO: 164691 - DNA, 15 bp, Homo sapiens
aaatgaatagctaga

SEQ ID NO: 164692 - DNA, 15 bp, Homo sapiens
taaatgaatagctag

SEQ ID NO: 164693 - DNA, 15 bp, Homo sapiens
ataaatgaatagcta

SEQ ID NO: 164694 - DNA, 15 bp, Homo sapiens
aataaatgaatagct

SEQ ID NO: 164695 - DNA, 15 bp, Homo sapiens
aaataaatgaatagc

SEQ ID NO: 164696 - DNA, 15 bp, Homo sapiens
caaataaatgaatag

SEQ ID NO: 164697 - DNA, 15 bp, Homo sapiens
tcaaataaatgaata

SEQ ID NO: 164698 - DNA, 15 bp, Homo sapiens
gtcaaataaatgaat

SEQ ID NO: 164699 - DNA, 15 bp, Homo sapiens
tgtcaaataaatgaa

SEQ ID NO: 164700 - DNA, 15 bp, Homo sapiens
ctgtcaaataaatga

SEQ ID NO: 164701 - DNA, 15 bp, Homo sapiens
tctgtcaaataaatg

SEQ ID NO: 164702 - DNA, 15 bp, Homo sapiens
atctgtcaaataaat

SEQ ID NO: 164703 - DNA, 15 bp, Homo sapiens
tatctgtcaaataaa

SEQ ID NO: 164704 - DNA, 15 bp, Homo sapiens
atatctgtcaaataa

SEQ ID NO: 164705 - DNA, 15 bp, Homo sapiens
aatatctgtcaaata

SEQ ID NO: 164706 - DNA, 15 bp, Homo sapiens
aaatatctgtcaaat

SEQ ID NO: 164707 - DNA, 15 bp, Homo sapiens
taaatatctgtcaaa

SEQ ID NO: 164708 - DNA, 15 bp, Homo sapiens
ataaatatctgtcaa

SEQ ID NO: 164709 - DNA, 15 bp, Homo sapiens
aataaatatctgtca

SEQ ID NO: 164710 - DNA, 15 bp, Homo sapiens
aaataaatatctgtc

SEQ ID NO: 164711 - DNA, 15 bp, Homo sapiens
aaaataaatatctgt

SEQ ID NO: 164712 - DNA, 15 bp, Homo sapiens
aaaaataaatatctg

SEQ ID NO: 164713 - DNA, 15 bp, Homo sapiens
caaaaataaatatct

SEQ ID NO: 164714 - DNA, 15 bp, Homo sapiens
acaaaaataaatatc

SEQ ID NO: 164715 - DNA, 15 bp, Homo sapiens
cacaaaaataaatat

SEQ ID NO: 164716 - DNA, 15 bp, Homo sapiens
gcacaaaaataaata

SEQ ID NO: 164717 - DNA, 15 bp, Homo sapiens
ggcacaaaaataaat

SEQ ID NO: 164718 - DNA, 15 bp, Homo sapiens
aggcacaaaaataaa

SEQ ID NO: 164719 - DNA, 15 bp, Homo sapiens
taggcacaaaaataa

SEQ ID NO: 164720 - DNA, 15 bp, Homo sapiens
gtaggcacaaaaata

SEQ ID NO: 164721 - DNA, 15 bp, Homo sapiens
agtaggcacaaaaat

SEQ ID NO: 164722 - DNA, 15 bp, Homo sapiens
tagtaggcacaaaaa

SEQ ID NO: 164723 - DNA, 15 bp, Homo sapiens
atagtaggcacaaaa

SEQ ID NO: 164724 - DNA, 15 bp, Homo sapiens
catagtaggcacaaa

SEQ ID NO: 164725 - DNA, 15 bp, Homo sapiens
acatagtaggcacaa

SEQ ID NO: 164726 - DNA, 15 bp, Homo sapiens
tacatagtaggcaca

SEQ ID NO: 164727 - DNA, 15 bp, Homo sapiens
gtacatagtaggcac

SEQ ID NO: 164728 - DNA, 15 bp, Homo sapiens
agtacatagtaggca

SEQ ID NO: 164729 - DNA, 15 bp, Homo sapiens
aagtacatagtaggc

SEQ ID NO: 164730 - DNA, 15 bp, Homo sapiens
caagtacatagtagg

SEQ ID NO: 164731 - DNA, 15 bp, Homo sapiens
ccaagtacatagtag

SEQ ID NO: 164732 - DNA, 15 bp, Homo sapiens
gccaagtacatagta

SEQ ID NO: 164733 - DNA, 15 bp, Homo sapiens
tgccaagtacatagt

SEQ ID NO: 164734 - DNA, 15 bp, Homo sapiens
gtgccaagtacatag

SEQ ID NO: 164735 - DNA, 15 bp, Homo sapiens
tgtgccaagtacata

SEQ ID NO: 164736 - DNA, 15 bp, Homo sapiens
ttgtgccaagtacat

SEQ ID NO: 164737 - DNA, 15 bp, Homo sapiens
attgtgccaagtaca

SEQ ID NO: 164738 - DNA, 15 bp, Homo sapiens
cattgtgccaagtac

SEQ ID NO: 164739 - DNA, 15 bp, Homo sapiens
tcattgtgccaagta

SEQ ID NO: 164740 - DNA, 15 bp, Homo sapiens
atcattgtgccaagt

SEQ ID NO: 164741 - DNA, 15 bp, Homo sapiens
tatcattgtgccaag

SEQ ID NO: 164742 - DNA, 15 bp, Homo sapiens
ttatcattgtgccaa

SEQ ID NO: 164743 - DNA, 15 bp, Homo sapiens
gttatcattgtgcca

SEQ ID NO: 164744 - DNA, 15 bp, Homo sapiens
ggttatcattgtgcc

SEQ ID NO: 164745 - DNA, 15 bp, Homo sapiens
aggttatcattgtgc

SEQ ID NO: 164746 - DNA, 15 bp, Homo sapiens
aaggttatcattgtg

SEQ ID NO: 164747 - DNA, 15 bp, Homo sapiens
aaaggttatcattgt

SEQ ID NO: 164748 - DNA, 15 bp, Homo sapiens
aaaaggttatcattg

SEQ ID NO: 164749 - DNA, 15 bp, Homo sapiens
gaaaaggttatcatt

SEQ ID NO: 164750 - DNA, 15 bp, Homo sapiens
ggaaaaggttatcat

SEQ ID NO: 164751 - DNA, 15 bp, Homo sapiens
gggaaaaggttatca

SEQ ID NO: 164752 - DNA, 15 bp, Homo sapiens
tgggaaaaggttatc

SEQ ID NO: 164753 - DNA, 15 bp, Homo sapiens
ctgggaaaaggttat

SEQ ID NO: 164754 - DNA, 15 bp, Homo sapiens
actgggaaaaggtta

SEQ ID NO: 164755 - DNA, 15 bp, Homo sapiens
aactgggaaaaggtt

SEQ ID NO: 164756 - DNA, 15 bp, Homo sapiens
gaactgggaaaaggt

SEQ ID NO: 164757 - DNA, 15 bp, Homo sapiens
agaactgggaaaagg

SEQ ID NO: 164758 - DNA, 15 bp, Homo sapiens
aagaactgggaaaag

SEQ ID NO: 164759 - DNA, 15 bp, Homo sapiens
aaagaactgggaaaa

SEQ ID NO: 164760 - DNA, 15 bp, Homo sapiens
aaaagaactgggaaa

SEQ ID NO: 164761 - DNA, 15 bp, Homo sapiens
taaaagaactgggaa

SEQ ID NO: 164762 - DNA, 15 bp, Homo sapiens
gtaaaagaactggga

SEQ ID NO: 164763 - DNA, 15 bp, Homo sapiens
agtaaaagaactggg

SEQ ID NO: 164764 - DNA, 15 bp, Homo sapiens
gagtaaaagaactgg

SEQ ID NO: 164765 - DNA, 15 bp, Homo sapiens
agagtaaaagaactg

SEQ ID NO: 164766 - DNA, 15 bp, Homo sapiens
cagagtaaaagaact

SEQ ID NO: 164767 - DNA, 15 bp, Homo sapiens
acagagtaaaagaac

SEQ ID NO: 164768 - DNA, 15 bp, Homo sapiens
aacagagtaaaagaa

SEQ ID NO: 164769 - DNA, 15 bp, Homo sapiens
taacagagtaaaaga

SEQ ID NO: 164770 - DNA, 15 bp, Homo sapiens
ataacagagtaaaag

SEQ ID NO: 164771 - DNA, 15 bp, Homo sapiens
aataacagagtaaaa

SEQ ID NO: 164772 - DNA, 15 bp, Homo sapiens
taataacagagtaaa

SEQ ID NO: 164773 - DNA, 15 bp, Homo sapiens
ataataacagagtaa

SEQ ID NO: 164774 - DNA, 15 bp, Homo sapiens
aataataacagagta

SEQ ID NO: 164775 - DNA, 15 bp, Homo sapiens
caataataacagagt

SEQ ID NO: 164776 - DNA, 15 bp, Homo sapiens
acaataataacagag

SEQ ID NO: 164777 - DNA, 15 bp, Homo sapiens
aacaataataacaga

SEQ ID NO: 164778 - DNA, 15 bp, Homo sapiens
aaacaataataacag

SEQ ID NO: 164779 - DNA, 15 bp, Homo sapiens
taaacaataataaca

SEQ ID NO: 164780 - DNA, 15 bp, Homo sapiens
ttaaacaataataac

SEQ ID NO: 164781 - DNA, 15 bp, Homo sapiens
tttaaacaataataa

SEQ ID NO: 164782 - DNA, 15 bp, Homo sapiens
ctttaaacaataata

SEQ ID NO: 164783 - DNA, 15 bp, Homo sapiens
actttaaacaataat

SEQ ID NO: 164784 - DNA, 15 bp, Homo sapiens
aactttaaacaataa

SEQ ID NO: 164785 - DNA, 15 bp, Homo sapiens
aaactttaaacaata

SEQ ID NO: 164786 - DNA, 15 bp, Homo sapiens
caaactttaaacaat

SEQ ID NO: 164787 - DNA, 15 bp, Homo sapiens
ccaaactttaaacaa

SEQ ID NO: 164788 - DNA, 15 bp, Homo sapiens
tccaaactttaaaca

SEQ ID NO: 164789 - DNA, 15 bp, Homo sapiens
ttccaaactttaaac

SEQ ID NO: 164790 - DNA, 15 bp, Homo sapiens
tttccaaactttaaa

SEQ ID NO: 164791 - DNA, 15 bp, Homo sapiens
atttccaaactttaa

SEQ ID NO: 164792 - DNA, 15 bp, Homo sapiens
aatttccaaacttta

SEQ ID NO: 164793 - DNA, 15 bp, Homo sapiens
taatttccaaacttt

SEQ ID NO: 164794 - DNA, 15 bp, Homo sapiens
ttaatttccaaactt

SEQ ID NO: 164795 - DNA, 15 bp, Homo sapiens
tttaatttccaaact

SEQ ID NO: 164796 - DNA, 15 bp, Homo sapiens
ttttaatttccaaac

SEQ ID NO: 164797 - DNA, 15 bp, Homo sapiens
attttaatttccaaa

SEQ ID NO: 164798 - DNA, 15 bp, Homo sapiens
tattttaatttccaa

SEQ ID NO: 164799 - DNA, 15 bp, Homo sapiens
gtattttaatttcca

SEQ ID NO: 164800 - DNA, 15 bp, Homo sapiens
agtattttaatttcc

SEQ ID NO: 164801 - DNA, 15 bp, Homo sapiens
gagtattttaatttc

SEQ ID NO: 164802 - DNA, 15 bp, Homo sapiens
agagtattttaattt

SEQ ID NO: 164803 - DNA, 15 bp, Homo sapiens
tagagtattttaatt

SEQ ID NO: 164804 - DNA, 15 bp, Homo sapiens
atagagtattttaat

SEQ ID NO: 164805 - DNA, 15 bp, Homo sapiens
tatagagtattttaa

SEQ ID NO: 164806 - DNA, 15 bp, Homo sapiens
atatagagtatttta

SEQ ID NO: 164807 - DNA, 15 bp, Homo sapiens
aatatagagtatttt

SEQ ID NO: 164808 - DNA, 15 bp, Homo sapiens
taatatagagtattt

SEQ ID NO: 164809 - DNA, 15 bp, Homo sapiens
ataatatagagtatt

SEQ ID NO: 164810 - DNA, 15 bp, Homo sapiens
tataatatagagtat

SEQ ID NO: 164811 - DNA, 15 bp, Homo sapiens
atataatatagagta

SEQ ID NO: 164812 - DNA, 15 bp, Homo sapiens
catataatatagagt

SEQ ID NO: 164813 - DNA, 15 bp, Homo sapiens
gcatataatatagag

SEQ ID NO: 164814 - DNA, 15 bp, Homo sapiens
agcatataatataga

SEQ ID NO: 164815 - DNA, 15 bp, Homo sapiens
tagcatataatatag

SEQ ID NO: 164816 - DNA, 15 bp, Homo sapiens
atagcatataatata

SEQ ID NO: 164817 - DNA, 15 bp, Homo sapiens
tatagcatataatat

SEQ ID NO: 164818 - DNA, 15 bp, Homo sapiens
atatagcatataata

SEQ ID NO: 164819 - DNA, 15 bp, Homo sapiens
aatatagcatataat

SEQ ID NO: 164820 - DNA, 15 bp, Homo sapiens
taatatagcatataa

SEQ ID NO: 164821 - DNA, 15 bp, Homo sapiens
ctaatatagcatata

SEQ ID NO: 164822 - DNA, 15 bp, Homo sapiens
actaatatagcatat

SEQ ID NO: 164823 - DNA, 15 bp, Homo sapiens
aactaatatagcata

SEQ ID NO: 164824 - DNA, 15 bp, Homo sapiens
taactaatatagcat

SEQ ID NO: 164825 - DNA, 15 bp, Homo sapiens
ttaactaatatagca

SEQ ID NO: 164826 - DNA, 15 bp, Homo sapiens
tttaactaatatagc

SEQ ID NO: 164827 - DNA, 15 bp, Homo sapiens
ctttaactaatatag

SEQ ID NO: 164828 - DNA, 15 bp, Homo sapiens
gctttaactaatata

SEQ ID NO: 164829 - DNA, 15 bp, Homo sapiens
agctttaactaatat

SEQ ID NO: 164830 - DNA, 15 bp, Homo sapiens
tagctttaactaata

SEQ ID NO: 164831 - DNA, 15 bp, Homo sapiens
ttagctttaactaat

SEQ ID NO: 164832 - DNA, 15 bp, Homo sapiens
cttagctttaactaa

SEQ ID NO: 164833 - DNA, 15 bp, Homo sapiens
gcttagctttaacta

SEQ ID NO: 164834 - DNA, 15 bp, Homo sapiens
tgcttagctttaact

SEQ ID NO: 164835 - DNA, 15 bp, Homo sapiens
atgcttagctttaac

SEQ ID NO: 164836 - DNA, 15 bp, Homo sapiens
catgcttagctttaa

SEQ ID NO: 164837 - DNA, 15 bp, Homo sapiens
ccatgcttagcttta

SEQ ID NO: 164838 - DNA, 15 bp, Homo sapiens
accatgcttagcttt

SEQ ID NO: 164839 - DNA, 15 bp, Homo sapiens
caccatgcttagctt

SEQ ID NO: 164840 - DNA, 15 bp, Homo sapiens
gcaccatgcttagct

SEQ ID NO: 164841 - DNA, 15 bp, Homo sapiens
agcaccatgcttagc

SEQ ID NO: 164842 - DNA, 15 bp, Homo sapiens
cagcaccatgcttag

SEQ ID NO: 164843 - DNA, 15 bp, Homo sapiens
acagcaccatgctta

SEQ ID NO: 164844 - DNA, 15 bp, Homo sapiens
tacagcaccatgctt

SEQ ID NO: 164845 - DNA, 15 bp, Homo sapiens
atacagcaccatgct

SEQ ID NO: 164846 - DNA, 15 bp, Homo sapiens
gatacagcaccatgc

SEQ ID NO: 164847 - DNA, 15 bp, Homo sapiens
tgatacagcaccatg

SEQ ID NO: 164848 - DNA, 15 bp, Homo sapiens
atgatacagcaccat

SEQ ID NO: 164849 - DNA, 15 bp, Homo sapiens
aatgatacagcacca

SEQ ID NO: 164850 - DNA, 15 bp, Homo sapiens
taatgatacagcacc

SEQ ID NO: 164851 - DNA, 15 bp, Homo sapiens
ttaatgatacagcac

SEQ ID NO: 164852 - DNA, 15 bp, Homo sapiens
tttaatgatacagca

SEQ ID NO: 164853 - DNA, 15 bp, Homo sapiens
gtttaatgatacagc

SEQ ID NO: 164854 - DNA, 15 bp, Homo sapiens
tgtttaatgatacag

SEQ ID NO: 164855 - DNA, 15 bp, Homo sapiens
gtgtttaatgataca

SEQ ID NO: 164856 - DNA, 15 bp, Homo sapiens
tgtgtttaatgatac

SEQ ID NO: 164857 - DNA, 15 bp, Homo sapiens
ttgtgtttaatgata

SEQ ID NO: 164858 - DNA, 15 bp, Homo sapiens
gttgtgtttaatgat

SEQ ID NO: 164859 - DNA, 15 bp, Homo sapiens
tgttgtgtttaatga

SEQ ID NO: 164860 - DNA, 15 bp, Homo sapiens
ttgttgtgtttaatg

SEQ ID NO: 164861 - DNA, 15 bp, Homo sapiens
attgttgtgtttaat

SEQ ID NO: 164862 - DNA, 15 bp, Homo sapiens
tattgttgtgtttaa

SEQ ID NO: 164863 - DNA, 15 bp, Homo sapiens
ttattgttgtgttta

SEQ ID NO: 164864 - DNA, 15 bp, Homo sapiens
gttattgttgtgttt

SEQ ID NO: 164865 - DNA, 15 bp, Homo sapiens
tgttattgttgtgtt

SEQ ID NO: 164866 - DNA, 15 bp, Homo sapiens
ctgttattgttgtgt

SEQ ID NO: 164867 - DNA, 15 bp, Homo sapiens
gctgttattgttgtg

SEQ ID NO: 164868 - DNA, 15 bp, Homo sapiens
ggctgttattgttgt

SEQ ID NO: 164869 - DNA, 15 bp, Homo sapiens
tggctgttattgttg

SEQ ID NO: 164870 - DNA, 15 bp, Homo sapiens
ttggctgttattgtt

SEQ ID NO: 164871 - DNA, 15 bp, Homo sapiens
tttggctgttattgt

SEQ ID NO: 164872 - DNA, 15 bp, Homo sapiens
atttggctgttattg

SEQ ID NO: 164873 - DNA, 15 bp, Homo sapiens
tatttggctgttatt

SEQ ID NO: 164874 - DNA, 15 bp, Homo sapiens
ttatttggctgttat

SEQ ID NO: 164875 - DNA, 15 bp, Homo sapiens
tttatttggctgtta

SEQ ID NO: 164876 - DNA, 15 bp, Homo sapiens
ctttatttggctgtt

SEQ ID NO: 164877 - DNA, 15 bp, Homo sapiens
actttatttggctgt

SEQ ID NO: 164878 - DNA, 15 bp, Homo sapiens
aactttatttggctg

SEQ ID NO: 164879 - DNA, 15 bp, Homo sapiens
taactttatttggct

SEQ ID NO: 164880 - DNA, 15 bp, Homo sapiens
ctaactttatttggc

SEQ ID NO: 164881 - DNA, 15 bp, Homo sapiens
tctaactttatttgg

SEQ ID NO: 164882 - DNA, 15 bp, Homo sapiens
ttctaactttatttg

SEQ ID NO: 164883 - DNA, 15 bp, Homo sapiens
gttctaactttattt

SEQ ID NO: 164884 - DNA, 15 bp, Homo sapiens
tgttctaactttatt

SEQ ID NO: 164885 - DNA, 15 bp, Homo sapiens
gtgttctaactttat

SEQ ID NO: 164886 - DNA, 15 bp, Homo sapiens
tgtgttctaacttta

SEQ ID NO: 164887 - DNA, 15 bp, Homo sapiens
gtgtgttctaacttt

SEQ ID NO: 164888 - DNA, 15 bp, Homo sapiens
ggtgtgttctaactt

SEQ ID NO: 164889 - DNA, 15 bp, Homo sapiens
tggtgtgttctaact

SEQ ID NO: 164890 - DNA, 15 bp, Homo sapiens
ttggtgtgttctaac

SEQ ID NO: 164891 - DNA, 15 bp, Homo sapiens
tttggtgtgttctaa

SEQ ID NO: 164892 - DNA, 15 bp, Homo sapiens
atttggtgtgttcta

SEQ ID NO: 164893 - DNA, 15 bp, Homo sapiens
tatttggtgtgttct

SEQ ID NO: 164894 - DNA, 15 bp, Homo sapiens
atatttggtgtgttc

SEQ ID NO: 164895 - DNA, 15 bp, Homo sapiens
catatttggtgtgtt

SEQ ID NO: 164896 - DNA, 15 bp, Homo sapiens
acatatttggtgtgt

SEQ ID NO: 164897 - DNA, 15 bp, Homo sapiens
aacatatttggtgtg

SEQ ID NO: 164898 - DNA, 15 bp, Homo sapiens
aaacatatttggtgt

SEQ ID NO: 164899 - DNA, 15 bp, Homo sapiens
aaaacatatttggtg

SEQ ID NO: 164900 - DNA, 15 bp, Homo sapiens
taaaacatatttggt

SEQ ID NO: 164901 - DNA, 15 bp, Homo sapiens
ataaaacatatttgg

SEQ ID NO: 164902 - DNA, 15 bp, Homo sapiens
aataaaacatatttg

SEQ ID NO: 164903 - DNA, 15 bp, Homo sapiens
aaataaaacatattt

SEQ ID NO: 164904 - DNA, 15 bp, Homo sapiens
taaataaaacatatt

SEQ ID NO: 164905 - DNA, 15 bp, Homo sapiens
gtaaataaaacatat

SEQ ID NO: 164906 - DNA, 15 bp, Homo sapiens
tgtaaataaaacata

SEQ ID NO: 164907 - DNA, 15 bp, Homo sapiens
atgtaaataaaacat

SEQ ID NO: 164908 - DNA, 15 bp, Homo sapiens
catgtaaataaaaca

SEQ ID NO: 164909 - DNA, 15 bp, Homo sapiens
gcatgtaaataaaac

SEQ ID NO: 164910 - DNA, 15 bp, Homo sapiens
tgcatgtaaataaaa

SEQ ID NO: 164911 - DNA, 15 bp, Homo sapiens
ttgcatgtaaataaa

SEQ ID NO: 164912 - DNA, 15 bp, Homo sapiens
tttgcatgtaaataa

SEQ ID NO: 164913 - DNA, 15 bp, Homo sapiens
atttgcatgtaaata

SEQ ID NO: 164914 - DNA, 15 bp, Homo sapiens
tatttgcatgtaaat

SEQ ID NO: 164915 - DNA, 15 bp, Homo sapiens
atatttgcatgtaaa

SEQ ID NO: 164916 - DNA, 15 bp, Homo sapiens
aatatttgcatgtaa

SEQ ID NO: 164917 - DNA, 15 bp, Homo sapiens
aaatatttgcatgta

SEQ ID NO: 164918 - DNA, 15 bp, Homo sapiens
taaatatttgcatgt

SEQ ID NO: 164919 - DNA, 15 bp, Homo sapiens
ttaaatatttgcatg

SEQ ID NO: 164920 - DNA, 15 bp, Homo sapiens
tttaaatatttgcat

SEQ ID NO: 164921 - DNA, 15 bp, Homo sapiens
ttttaaatatttgca

SEQ ID NO: 164922 - DNA, 15 bp, Homo sapiens
attttaaatatttgc

SEQ ID NO: 164923 - DNA, 15 bp, Homo sapiens
cattttaaatatttg

SEQ ID NO: 164924 - DNA, 15 bp, Homo sapiens
tcattttaaatattt

SEQ ID NO: 164925 - DNA, 15 bp, Homo sapiens
atcattttaaatatt

SEQ ID NO: 164926 - DNA, 15 bp, Homo sapiens
tatcattttaaatat

SEQ ID NO: 164927 - DNA, 15 bp, Homo sapiens
atatcattttaaata

SEQ ID NO: 164928 - DNA, 15 bp, Homo sapiens
tatatcattttaaat

SEQ ID NO: 164929 - DNA, 15 bp, Homo sapiens
atatatcattttaaa

SEQ ID NO: 164930 - DNA, 15 bp, Homo sapiens
aatatatcattttaa

SEQ ID NO: 164931 - DNA, 15 bp, Homo sapiens
aaatatatcatttta

SEQ ID NO: 164932 - DNA, 15 bp, Homo sapiens
taaatatatcatttt

SEQ ID NO: 164933 - DNA, 15 bp, Homo sapiens
ctaaatatatcattt

SEQ ID NO: 164934 - DNA, 15 bp, Homo sapiens
cctaaatatatcatt

SEQ ID NO: 164935 - DNA, 15 bp, Homo sapiens
acctaaatatatcat

SEQ ID NO: 164936 - DNA, 15 bp, Homo sapiens
tacctaaatatatca

SEQ ID NO: 164937 - DNA, 15 bp, Homo sapiens
atacctaaatatatc

SEQ ID NO: 164938 - DNA, 15 bp, Homo sapiens
tatacctaaatatat

SEQ ID NO: 164939 - DNA, 15 bp, Homo sapiens
ctatacctaaatata

SEQ ID NO: 164940 - DNA, 15 bp, Homo sapiens
actatacctaaatat

SEQ ID NO: 164941 - DNA, 15 bp, Homo sapiens
tactatacctaaata

SEQ ID NO: 164942 - DNA, 15 bp, Homo sapiens
atactatacctaaat

SEQ ID NO: 164943 - DNA, 15 bp, Homo sapiens
aatactatacctaaa

SEQ ID NO: 164944 - DNA, 15 bp, Homo sapiens
aaatactatacctaa

SEQ ID NO: 164945 - DNA, 15 bp, Homo sapiens
taaatactataccta

SEQ ID NO: 164946 - DNA, 15 bp, Homo sapiens
ttaaatactatacct

SEQ ID NO: 164947 - DNA, 15 bp, Homo sapiens
gttaaatactatacc

SEQ ID NO: 164948 - DNA, 15 bp, Homo sapiens
tgttaaatactatac

SEQ ID NO: 164949 - DNA, 15 bp, Homo sapiens
ttgttaaatactata

SEQ ID NO: 164950 - DNA, 15 bp, Homo sapiens
gttgttaaatactat

SEQ ID NO: 164951 - DNA, 15 bp, Homo sapiens
agttgttaaatacta

SEQ ID NO: 164952 - DNA, 15 bp, Homo sapiens
aagttgttaaatact

SEQ ID NO: 164953 - DNA, 15 bp, Homo sapiens
aaagttgttaaatac

SEQ ID NO: 164954 - DNA, 15 bp, Homo sapiens
aaaagttgttaaata

SEQ ID NO: 164955 - DNA, 15 bp, Homo sapiens
taaaagttgttaaat

SEQ ID NO: 164956 - DNA, 15 bp, Homo sapiens
ataaaagttgttaaa

SEQ ID NO: 164957 - DNA, 15 bp, Homo sapiens
cataaaagttgttaa

SEQ ID NO: 164958 - DNA, 15 bp, Homo sapiens
acataaaagttgtta

SEQ ID NO: 164959 - DNA, 15 bp, Homo sapiens
aacataaaagttgtt

SEQ ID NO: 164960 - DNA, 15 bp, Homo sapiens
gaacataaaagttgt

SEQ ID NO: 164961 - DNA, 15 bp, Homo sapiens
ggaacataaaagttg

SEQ ID NO: 164962 - DNA, 15 bp, Homo sapiens
aggaacataaaagtt

SEQ ID NO: 164963 - DNA, 15 bp, Homo sapiens
gaggaacataaaagt

SEQ ID NO: 164964 - DNA, 15 bp, Homo sapiens
tgaggaacataaaag

SEQ ID NO: 164965 - DNA, 15 bp, Homo sapiens
gtgaggaacataaaa

SEQ ID NO: 164966 - DNA, 15 bp, Homo sapiens
tgtgaggaacataaa

SEQ ID NO: 164967 - DNA, 15 bp, Homo sapiens
atgtgaggaacataa

SEQ ID NO: 164968 - DNA, 15 bp, Homo sapiens
gatgtgaggaacata

SEQ ID NO: 164969 - DNA, 15 bp, Homo sapiens
tgatgtgaggaacat

SEQ ID NO: 164970 - DNA, 15 bp, Homo sapiens
ctgatgtgaggaaca

SEQ ID NO: 164971 - DNA, 15 bp, Homo sapiens
tctgatgtgaggaac

SEQ ID NO: 164972 - DNA, 15 bp, Homo sapiens
ttctgatgtgaggaa

SEQ ID NO: 164973 - DNA, 15 bp, Homo sapiens
attctgatgtgagga

SEQ ID NO: 164974 - DNA, 15 bp, Homo sapiens
aattctgatgtgagg

SEQ ID NO: 164975 - DNA, 15 bp, Homo sapiens
aaattctgatgtgag

SEQ ID NO: 164976 - DNA, 15 bp, Homo sapiens
taaattctgatgtga

SEQ ID NO: 164977 - DNA, 15 bp, Homo sapiens
ataaattctgatgtg

SEQ ID NO: 164978 - DNA, 15 bp, Homo sapiens
tataaattctgatgt

SEQ ID NO: 164979 - DNA, 15 bp, Homo sapiens
atataaattctgatg

SEQ ID NO: 164980 - DNA, 15 bp, Homo sapiens
aatataaattctgat

SEQ ID NO: 164981 - DNA, 15 bp, Homo sapiens
gaatataaattctga

SEQ ID NO: 164982 - DNA, 15 bp, Homo sapiens
agaatataaattctg

SEQ ID NO: 164983 - DNA, 15 bp, Homo sapiens
aagaatataaattct

SEQ ID NO: 164984 - DNA, 15 bp, Homo sapiens
aaagaatataaattc

SEQ ID NO: 164985 - DNA, 15 bp, Homo sapiens
gaaagaatataaatt

SEQ ID NO: 164986 - DNA, 15 bp, Homo sapiens
tgaaagaatataaat

SEQ ID NO: 164987 - DNA, 15 bp, Homo sapiens
ttgaaagaatataaa

SEQ ID NO: 164988 - DNA, 15 bp, Homo sapiens
gttgaaagaatataa

SEQ ID NO: 164989 - DNA, 15 bp, Homo sapiens
tgttgaaagaatata

SEQ ID NO: 164990 - DNA, 15 bp, Homo sapiens
ttgttgaaagaatat

SEQ ID NO: 164991 - DNA, 15 bp, Homo sapiens
cttgttgaaagaata

SEQ ID NO: 164992 - DNA, 15 bp, Homo sapiens
tcttgttgaaagaat

SEQ ID NO: 164993 - DNA, 15 bp, Homo sapiens
gctcttgttgaaaga

SEQ ID NO: 164994 - DNA, 15 bp, Homo sapiens
ggctcttgttgaaag

SEQ ID NO: 164995 - DNA, 15 bp, Homo sapiens
aggctcttgttgaaa

SEQ ID NO: 164996 - DNA, 15 bp, Homo sapiens
aaggctcttgttgaa

SEQ ID NO: 164997 - DNA, 15 bp, Homo sapiens
aaaggctcttgttga

SEQ ID NO: 164998 - DNA, 15 bp, Homo sapiens
aaaaggctcttgttg

SEQ ID NO: 164999 - DNA, 15 bp, Homo sapiens
aaaaaggctcttgtt

SEQ ID NO: 165000 - DNA, 15 bp, Homo sapiens
taaaaaggctcttgt

SEQ ID NO: 165001 - DNA, 15 bp, Homo sapiens
ttaaaaaggctcttg

SEQ ID NO: 165002 - DNA, 15 bp, Homo sapiens
tttaaaaaggctctt

SEQ ID NO: 165003 - DNA, 15 bp, Homo sapiens
ctttaaaaaggctct

SEQ ID NO: 165004 - DNA, 15 bp, Homo sapiens
tctttaaaaaggctc

SEQ ID NO: 165005 - DNA, 15 bp, Homo sapiens
atctttaaaaaggct

SEQ ID NO: 165006 - DNA, 15 bp, Homo sapiens
tatctttaaaaaggc

SEQ ID NO: 165007 - DNA, 15 bp, Homo sapiens
ttatctttaaaaagg

SEQ ID NO: 165008 - DNA, 15 bp, Homo sapiens
cttatctttaaaaag

SEQ ID NO: 165009 - DNA, 15 bp, Homo sapiens
ccttatctttaaaaa

SEQ ID NO: 165010 - DNA, 15 bp, Homo sapiens
tccttatctttaaaa

SEQ ID NO: 165011 - DNA, 15 bp, Homo sapiens
atccttatctttaaa

SEQ ID NO: 165012 - DNA, 15 bp, Homo sapiens
aatccttatctttaa

SEQ ID NO: 165013 - DNA, 15 bp, Homo sapiens
taatccttatcttta

SEQ ID NO: 165014 - DNA, 15 bp, Homo sapiens
ttaatccttatcttt

SEQ ID NO: 165015 - DNA, 15 bp, Homo sapiens
tttaatccttatctt

SEQ ID NO: 165016 - DNA, 15 bp, Homo sapiens
atttaatccttatct

SEQ ID NO: 165017 - DNA, 15 bp, Homo sapiens
aatttaatccttatc

SEQ ID NO: 165018 - DNA, 15 bp, Homo sapiens
caatttaatccttat

SEQ ID NO: 165019 - DNA, 15 bp, Homo sapiens
tcaatttaatcctta

SEQ ID NO: 165020 - DNA, 15 bp, Homo sapiens
gtcaatttaatcctt

SEQ ID NO: 165021 - DNA, 15 bp, Homo sapiens
ggtcaatttaatcct

SEQ ID NO: 165022 - DNA, 15 bp, Homo sapiens
tggtcaatttaatcc

SEQ ID NO: 165023 - DNA, 15 bp, Homo sapiens
atggtcaatttaatc

SEQ ID NO: 165024 - DNA, 15 bp, Homo sapiens
catggtcaatttaat

SEQ ID NO: 165025 - DNA, 15 bp, Homo sapiens
gcatggtcaatttaa

SEQ ID NO: 165026 - DNA, 15 bp, Homo sapiens
tgcatggtcaattta

SEQ ID NO: 165027 - DNA, 15 bp, Homo sapiens
atgcatggtcaattt

SEQ ID NO: 165028 - DNA, 15 bp, Homo sapiens
tatgcatggtcaatt

SEQ ID NO: 165029 - DNA, 15 bp, Homo sapiens
ttatgcatggtcaat

SEQ ID NO: 165030 - DNA, 15 bp, Homo sapiens
gttatgcatggtcaa

SEQ ID NO: 165031 - DNA, 15 bp, Homo sapiens
agttatgcatggtca

SEQ ID NO: 165032 - DNA, 15 bp, Homo sapiens
aagttatgcatggtc

SEQ ID NO: 165033 - DNA, 15 bp, Homo sapiens
aaagttatgcatggt

SEQ ID NO: 165034 - DNA, 15 bp, Homo sapiens
caaagttatgcatgg

SEQ ID NO: 165035 - DNA, 15 bp, Homo sapiens
tcaaagttatgcatg

SEQ ID NO: 165036 - DNA, 15 bp, Homo sapiens
atcaaagttatgcat

SEQ ID NO: 165037 - DNA, 15 bp, Homo sapiens
catcaaagttatgca

SEQ ID NO: 165038 - DNA, 15 bp, Homo sapiens
acatcaaagttatgc

SEQ ID NO: 165039 - DNA, 15 bp, Homo sapiens
cacatcaaagttatg

SEQ ID NO: 165040 - DNA, 15 bp, Homo sapiens
tcacatcaaagttat

SEQ ID NO: 165041 - DNA, 15 bp, Homo sapiens
atcacatcaaagtta

SEQ ID NO: 165042 - DNA, 15 bp, Homo sapiens
aatcacatcaaagtt

SEQ ID NO: 165043 - DNA, 15 bp, Homo sapiens
taatcacatcaaagt

SEQ ID NO: 165044 - DNA, 15 bp, Homo sapiens
ttaatcacatcaaag

SEQ ID NO: 165045 - DNA, 15 bp, Homo sapiens
cttaatcacatcaaa

SEQ ID NO: 165046 - DNA, 15 bp, Homo sapiens
gcttaatcacatcaa

SEQ ID NO: 165047 - DNA, 15 bp, Homo sapiens
agcttaatcacatca

SEQ ID NO: 165048 - DNA, 15 bp, Homo sapiens
tagcttaatcacatc

SEQ ID NO: 165049 - DNA, 15 bp, Homo sapiens
atagcttaatcacat

SEQ ID NO: 165050 - DNA, 15 bp, Homo sapiens
aatagcttaatcaca

SEQ ID NO: 165051 - DNA, 15 bp, Homo sapiens
aaatagcttaatcac

SEQ ID NO: 165052 - DNA, 15 bp, Homo sapiens
caaatagcttaatca

SEQ ID NO: 165053 - DNA, 15 bp, Homo sapiens
tcaaatagcttaatc

SEQ ID NO: 165054 - DNA, 15 bp, Homo sapiens
atcaaatagcttaat

SEQ ID NO: 165055 - DNA, 15 bp, Homo sapiens
gatcaaatagcttaa

SEQ ID NO: 165056 - DNA, 15 bp, Homo sapiens
agatcaaatagctta

SEQ ID NO: 165057 - DNA, 15 bp, Homo sapiens
aagatcaaatagctt

SEQ ID NO: 165058 - DNA, 15 bp, Homo sapiens
aaagatcaaatagct

SEQ ID NO: 165059 - DNA, 15 bp, Homo sapiens
aaaagatcaaatagc

SEQ ID NO: 165060 - DNA, 15 bp, Homo sapiens
taaaagatcaaatag

SEQ ID NO: 165061 - DNA, 15 bp, Homo sapiens
ttaaaagatcaaata

SEQ ID NO: 165062 - DNA, 15 bp, Homo sapiens
tttaaaagatcaaat

SEQ ID NO: 165063 - DNA, 15 bp, Homo sapiens
atttaaaagatcaaa

SEQ ID NO: 165064 - DNA, 15 bp, Homo sapiens
tatttaaaagatcaa

SEQ ID NO: 165065 - DNA, 15 bp, Homo sapiens
ctatttaaaagatca

SEQ ID NO: 165066 - DNA, 15 bp, Homo sapiens
tctatttaaaagatc

SEQ ID NO: 165067 - DNA, 15 bp, Homo sapiens
ttctatttaaaagat

SEQ ID NO: 165068 - DNA, 15 bp, Homo sapiens
attctatttaaaaga

SEQ ID NO: 165069 - DNA, 15 bp, Homo sapiens
gattctatttaaaag

SEQ ID NO: 165070 - DNA, 15 bp, Homo sapiens
tgattctatttaaaa

SEQ ID NO: 165071 - DNA, 15 bp, Homo sapiens
atgattctatttaaa

SEQ ID NO: 165072 - DNA, 15 bp, Homo sapiens
aatgattctatttaa

SEQ ID NO: 165073 - DNA, 15 bp, Homo sapiens
gaatgattctattta

SEQ ID NO: 165074 - DNA, 15 bp, Homo sapiens
cgaatgattctattt

SEQ ID NO: 165075 - DNA, 15 bp, Homo sapiens
tcgaatgattctatt

SEQ ID NO: 165076 - DNA, 15 bp, Homo sapiens
atcgaatgattctat

SEQ ID NO: 165077 - DNA, 15 bp, Homo sapiens
aatcgaatgattcta

SEQ ID NO: 165078 - DNA, 15 bp, Homo sapiens
aaatcgaatgattct

SEQ ID NO: 165079 - DNA, 15 bp, Homo sapiens
aaaatcgaatgattc

SEQ ID NO: 165080 - DNA, 15 bp, Homo sapiens
caaaatcgaatgatt

SEQ ID NO: 165081 - DNA, 15 bp, Homo sapiens
gcaaaatcgaatgat

SEQ ID NO: 165082 - DNA, 15 bp, Homo sapiens
agcaaaatcgaatga

SEQ ID NO: 165083 - DNA, 15 bp, Homo sapiens
cagcaaaatcgaatg

SEQ ID NO: 165084 - DNA, 15 bp, Homo sapiens
tcagcaaaatcgaat

SEQ ID NO: 165085 - DNA, 15 bp, Homo sapiens
gtcagcaaaatcgaa

SEQ ID NO: 165086 - DNA, 15 bp, Homo sapiens
tgtcagcaaaatcga

SEQ ID NO: 165087 - DNA, 15 bp, Homo sapiens
gtgtcagcaaaatcg

SEQ ID NO: 165088 - DNA, 15 bp, Homo sapiens
agtgtcagcaaaatc

SEQ ID NO: 165089 - DNA, 15 bp, Homo sapiens
aagtgtcagcaaaat

SEQ ID NO: 165090 - DNA, 15 bp, Homo sapiens
taagtgtcagcaaaa

SEQ ID NO: 165091 - DNA, 15 bp, Homo sapiens
ctaagtgtcagcaaa

SEQ ID NO: 165092 - DNA, 15 bp, Homo sapiens
gctaagtgtcagcaa

SEQ ID NO: 165093 - DNA, 15 bp, Homo sapiens
tgctaagtgtcagca

SEQ ID NO: 165094 - DNA, 15 bp, Homo sapiens
ttgctaagtgtcagc

SEQ ID NO: 165095 - DNA, 15 bp, Homo sapiens
attgctaagtgtcag

SEQ ID NO: 165096 - DNA, 15 bp, Homo sapiens
tattgctaagtgtca

SEQ ID NO: 165097 - DNA, 15 bp, Homo sapiens
ctattgctaagtgtc

SEQ ID NO: 165098 - DNA, 15 bp, Homo sapiens
gctattgctaagtgt

SEQ ID NO: 165099 - DNA, 15 bp, Homo sapiens
ggctattgctaagtg

SEQ ID NO: 165100 - DNA, 15 bp, Homo sapiens
gggctattgctaagt

SEQ ID NO: 165101 - DNA, 15 bp, Homo sapiens
tgggctattgctaag

SEQ ID NO: 165102 - DNA, 15 bp, Homo sapiens
atgggctattgctaa

SEQ ID NO: 165103 - DNA, 15 bp, Homo sapiens
aatgggctattgcta

SEQ ID NO: 165104 - DNA, 15 bp, Homo sapiens
taatgggctattgct

SEQ ID NO: 165105 - DNA, 15 bp, Homo sapiens
ataatgggctattgc

SEQ ID NO: 165106 - DNA, 15 bp, Homo sapiens
aataatgggctattg

SEQ ID NO: 165107 - DNA, 15 bp, Homo sapiens
aaataatgggctatt

SEQ ID NO: 165108 - DNA, 15 bp, Homo sapiens
aaaataatgggctat

SEQ ID NO: 165109 - DNA, 15 bp, Homo sapiens
taaaataatgggcta

SEQ ID NO: 165110 - DNA, 15 bp, Homo sapiens
ctaaaataatgggct

SEQ ID NO: 165111 - DNA, 15 bp, Homo sapiens
tctaaaataatgggc

SEQ ID NO: 165112 - DNA, 15 bp, Homo sapiens
atctaaaataatggg

SEQ ID NO: 165113 - DNA, 15 bp, Homo sapiens
tatctaaaataatgg

SEQ ID NO: 165114 - DNA, 15 bp, Homo sapiens
atatctaaaataatg

SEQ ID NO: 165115 - DNA, 15 bp, Homo sapiens
tatatctaaaataat

SEQ ID NO: 165116 - DNA, 15 bp, Homo sapiens
ttatatctaaaataa

SEQ ID NO: 165117 - DNA, 15 bp, Homo sapiens
attatatctaaaata

SEQ ID NO: 165118 - DNA, 15 bp, Homo sapiens
aattatatctaaaat

SEQ ID NO: 165119 - DNA, 15 bp, Homo sapiens
aaattatatctaaaa

SEQ ID NO: 165120 - DNA, 15 bp, Homo sapiens
gaaattatatctaaa

SEQ ID NO: 165121 - DNA, 15 bp, Homo sapiens
agaaattatatctaa

SEQ ID NO: 165122 - DNA, 15 bp, Homo sapiens
aagaaattatatcta

SEQ ID NO: 165123 - DNA, 15 bp, Homo sapiens
aaagaaattatatct

SEQ ID NO: 165124 - DNA, 15 bp, Homo sapiens
caaagaaattatatc

SEQ ID NO: 165125 - DNA, 15 bp, Homo sapiens
acaaagaaattatat

SEQ ID NO: 165126 - DNA, 15 bp, Homo sapiens
cacaaagaaattata

SEQ ID NO: 165127 - DNA, 15 bp, Homo sapiens
tcacaaagaaattat

SEQ ID NO: 165128 - DNA, 15 bp, Homo sapiens
atcacaaagaaatta

SEQ ID NO: 165129 - DNA, 15 bp, Homo sapiens
gatcacaaagaaatt

SEQ ID NO: 165130 - DNA, 15 bp, Homo sapiens
tgatcacaaagaaat

SEQ ID NO: 165131 - DNA, 15 bp, Homo sapiens
atgatcacaaagaaa

SEQ ID NO: 165132 - DNA, 15 bp, Homo sapiens
tatgatcacaaagaa

SEQ ID NO: 165133 - DNA, 15 bp, Homo sapiens
ctatgatcacaaaga

SEQ ID NO: 165134 - DNA, 15 bp, Homo sapiens
actatgatcacaaag

SEQ ID NO: 165135 - DNA, 15 bp, Homo sapiens
tactatgatcacaaa

SEQ ID NO: 165136 - DNA, 15 bp, Homo sapiens
ttactatgatcacaa

SEQ ID NO: 165137 - DNA, 15 bp, Homo sapiens
cttactatgatcaca

SEQ ID NO: 165138 - DNA, 15 bp, Homo sapiens
acttactatgatcac

SEQ ID NO: 165139 - DNA, 15 bp, Homo sapiens
aacttactatgatca

SEQ ID NO: 165140 - DNA, 15 bp, Homo sapiens
aaacttactatgatc

SEQ ID NO: 165141 - DNA, 15 bp, Homo sapiens
taaacttactatgat

SEQ ID NO: 165142 - DNA, 15 bp, Homo sapiens
ctaaacttactatga

SEQ ID NO: 165143 - DNA, 15 bp, Homo sapiens
tctaaacttactatg

SEQ ID NO: 165144 - DNA, 15 bp, Homo sapiens
ctctaaacttactat

SEQ ID NO: 165145 - DNA, 15 bp, Homo sapiens
actctaaacttacta

SEQ ID NO: 165146 - DNA, 15 bp, Homo sapiens
gactctaaacttact

SEQ ID NO: 165147 - DNA, 15 bp, Homo sapiens
tgactctaaacttac

SEQ ID NO: 165148 - DNA, 15 bp, Homo sapiens
atgactctaaactta

SEQ ID NO: 165149 - DNA, 15 bp, Homo sapiens
tatgactctaaactt

SEQ ID NO: 165150 - DNA, 15 bp, Homo sapiens
ctatgactctaaact

SEQ ID NO: 165151 - DNA, 15 bp, Homo sapiens
tctatgactctaaac

SEQ ID NO: 165152 - DNA, 15 bp, Homo sapiens
atctatgactctaaa

SEQ ID NO: 165153 - DNA, 15 bp, Homo sapiens
catctatgactctaa

SEQ ID NO: 165154 - DNA, 15 bp, Homo sapiens
tcatctatgactcta

SEQ ID NO: 165155 - DNA, 15 bp, Homo sapiens
gtcatctatgactct

SEQ ID NO: 165156 - DNA, 15 bp, Homo sapiens
agtcatctatgactc

SEQ ID NO: 165157 - DNA, 15 bp, Homo sapiens
gagtcatctatgact

SEQ ID NO: 165158 - DNA, 15 bp, Homo sapiens
ggagtcatctatgac

SEQ ID NO: 165159 - DNA, 15 bp, Homo sapiens
gggagtcatctatga

SEQ ID NO: 165160 - DNA, 15 bp, Homo sapiens
agggagtcatctatg

SEQ ID NO: 165161 - DNA, 15 bp, Homo sapiens
gagggagtcatctat

SEQ ID NO: 165162 - DNA, 15 bp, Homo sapiens
cgagggagtcatcta

SEQ ID NO: 165163 - DNA, 15 bp, Homo sapiens
tcgagggagtcatct

SEQ ID NO: 165164 - DNA, 15 bp, Homo sapiens
ctcgagggagtcatc

SEQ ID NO: 165165 - DNA, 15 bp, Homo sapiens
cctcgagggagtcat

SEQ ID NO: 165166 - DNA, 15 bp, Homo sapiens
acctcgagggagtca

SEQ ID NO: 165167 - DNA, 15 bp, Homo sapiens
gacctcgagggagtc

SEQ ID NO: 165168 - DNA, 15 bp, Homo sapiens
agacctcgagggagt

SEQ ID NO: 165169 - DNA, 15 bp, Homo sapiens
aagacctcgagggag

SEQ ID NO: 165170 - DNA, 15 bp, Homo sapiens
taagacctcgaggga

SEQ ID NO: 165171 - DNA, 15 bp, Homo sapiens
ctaagacctcgaggg

SEQ ID NO: 165172 - DNA, 15 bp, Homo sapiens
actaagacctcgagg

SEQ ID NO: 165173 - DNA, 15 bp, Homo sapiens
tactaagacctcgag

SEQ ID NO: 165174 - DNA, 15 bp, Homo sapiens
ctactaagacctcga

SEQ ID NO: 165175 - DNA, 15 bp, Homo sapiens
gctactaagacctcg

SEQ ID NO: 165176 - DNA, 15 bp, Homo sapiens
tgctactaagacctc

SEQ ID NO: 165177 - DNA, 15 bp, Homo sapiens
atgctactaagacct

SEQ ID NO: 165178 - DNA, 15 bp, Homo sapiens
tatgctactaagacc

SEQ ID NO: 165179 - DNA, 15 bp, Homo sapiens
atatgctactaagac

SEQ ID NO: 165180 - DNA, 15 bp, Homo sapiens
aatatgctactaaga

SEQ ID NO: 165181 - DNA, 15 bp, Homo sapiens
taatatgctactaag

SEQ ID NO: 165182 - DNA, 15 bp, Homo sapiens
ataatatgctactaa

SEQ ID NO: 165183 - DNA, 15 bp, Homo sapiens
cataatatgctacta

SEQ ID NO: 165184 - DNA, 15 bp, Homo sapiens
tcataatatgctact

SEQ ID NO: 165185 - DNA, 15 bp, Homo sapiens
ttcataatatgctac

SEQ ID NO: 165186 - DNA, 15 bp, Homo sapiens
attcataatatgcta

SEQ ID NO: 165187 - DNA, 15 bp, Homo sapiens
aattcataatatgct

SEQ ID NO: 165188 - DNA, 15 bp, Homo sapiens
aaattcataatatgc

SEQ ID NO: 165189 - DNA, 15 bp, Homo sapiens
caaattcataatatg

SEQ ID NO: 165190 - DNA, 15 bp, Homo sapiens
ccaaattcataatat

SEQ ID NO: 165191 - DNA, 15 bp, Homo sapiens
accaaattcataata

SEQ ID NO: 165192 - DNA, 15 bp, Homo sapiens
taccaaattcataat

SEQ ID NO: 165193 - DNA, 15 bp, Homo sapiens
ataccaaattcataa

SEQ ID NO: 165194 - DNA, 15 bp, Homo sapiens
gataccaaattcata

SEQ ID NO: 165195 - DNA, 15 bp, Homo sapiens
agataccaaattcat

SEQ ID NO: 165196 - DNA, 15 bp, Homo sapiens
tagataccaaattca

SEQ ID NO: 165197 - DNA, 15 bp, Homo sapiens
atagataccaaattc

SEQ ID NO: 165198 - DNA, 15 bp, Homo sapiens
catagataccaaatt

SEQ ID NO: 165199 - DNA, 15 bp, Homo sapiens
acatagataccaaat

SEQ ID NO: 165200 - DNA, 15 bp, Homo sapiens
cacatagataccaaa

SEQ ID NO: 165201 - DNA, 15 bp, Homo sapiens
tcacatagataccaa

SEQ ID NO: 165202 - DNA, 15 bp, Homo sapiens
atcacatagatacca

SEQ ID NO: 165203 - DNA, 15 bp, Homo sapiens
aatcacatagatacc

SEQ ID NO: 165204 - DNA, 15 bp, Homo sapiens
taatcacatagatac

SEQ ID NO: 165205 - DNA, 15 bp, Homo sapiens
ttaatcacatagata

SEQ ID NO: 165206 - DNA, 15 bp, Homo sapiens
tttaatcacatagat

SEQ ID NO: 165207 - DNA, 15 bp, Homo sapiens
atttaatcacataga

SEQ ID NO: 165208 - DNA, 15 bp, Homo sapiens
tatttaatcacatag

SEQ ID NO: 165209 - DNA, 15 bp, Homo sapiens
ttatttaatcacata

SEQ ID NO: 165210 - DNA, 15 bp, Homo sapiens
cttatttaatcacat

SEQ ID NO: 165211 - DNA, 15 bp, Homo sapiens
gcttatttaatcaca

SEQ ID NO: 165212 - DNA, 15 bp, Homo sapiens
tgcttatttaatcac

SEQ ID NO: 165213 - DNA, 15 bp, Homo sapiens
gtgcttatttaatca

SEQ ID NO: 165214 - DNA, 15 bp, Homo sapiens
tgtgcttatttaatc

SEQ ID NO: 165215 - DNA, 15 bp, Homo sapiens
ttgtgcttatttaat

SEQ ID NO: 165216 - DNA, 15 bp, Homo sapiens
gttgtgcttatttaa

SEQ ID NO: 165217 - DNA, 15 bp, Homo sapiens
tgttgtgcttattta

SEQ ID NO: 165218 - DNA, 15 bp, Homo sapiens
ttgttgtgcttattt

SEQ ID NO: 165219 - DNA, 15 bp, Homo sapiens
tttgttgtgcttatt

SEQ ID NO: 165220 - DNA, 15 bp, Homo sapiens
ttttgttgtgcttat

SEQ ID NO: 165221 - DNA, 15 bp, Homo sapiens
attttgttgtgctta

SEQ ID NO: 165222 - DNA, 15 bp, Homo sapiens
aattttgttgtgctt

SEQ ID NO: 165223 - DNA, 15 bp, Homo sapiens
gaattttgttgtgct

SEQ ID NO: 165224 - DNA, 15 bp, Homo sapiens
tgaattttgttgtgc

SEQ ID NO: 165225 - DNA, 15 bp, Homo sapiens
atgaattttgttgtg

SEQ ID NO: 165226 - DNA, 15 bp, Homo sapiens
tatgaattttgttgt

SEQ ID NO: 165227 - DNA, 15 bp, Homo sapiens
atatgaattttgttg

SEQ ID NO: 165228 - DNA, 15 bp, Homo sapiens
gatatgaattttgtt

SEQ ID NO: 165229 - DNA, 15 bp, Homo sapiens
tgatatgaattttgt

SEQ ID NO: 165230 - DNA, 15 bp, Homo sapiens
ttgatatgaattttg

SEQ ID NO: 165231 - DNA, 15 bp, Homo sapiens
tttgatatgaatttt

SEQ ID NO: 165232 - DNA, 15 bp, Homo sapiens
atttgatatgaattt

SEQ ID NO: 165233 - DNA, 15 bp, Homo sapiens
aatttgatatgaatt

SEQ ID NO: 165234 - DNA, 15 bp, Homo sapiens
caatttgatatgaat

SEQ ID NO: 165235 - DNA, 15 bp, Homo sapiens
ccaatttgatatgaa

SEQ ID NO: 165236 - DNA, 15 bp, Homo sapiens
accaatttgatatga

SEQ ID NO: 165237 - DNA, 15 bp, Homo sapiens
gaccaatttgatatg

SEQ ID NO: 165238 - DNA, 15 bp, Homo sapiens
cgaccaatttgatat

SEQ ID NO: 165239 - DNA, 15 bp, Homo sapiens
tcgaccaatttgata

SEQ ID NO: 165240 - DNA, 15 bp, Homo sapiens
atcgaccaatttgat

SEQ ID NO: 165241 - DNA, 15 bp, Homo sapiens
tatcgaccaatttga

SEQ ID NO: 165242 - DNA, 15 bp, Homo sapiens
ttatcgaccaatttg

SEQ ID NO: 165243 - DNA, 15 bp, Homo sapiens
tttatcgaccaattt

SEQ ID NO: 165244 - DNA, 15 bp, Homo sapiens
gtttatcgaccaatt

SEQ ID NO: 165245 - DNA, 15 bp, Homo sapiens
tgtttatcgaccaat

SEQ ID NO: 165246 - DNA, 15 bp, Homo sapiens
gtgtttatcgaccaa

SEQ ID NO: 165247 - DNA, 15 bp, Homo sapiens
tgtgtttatcgacca

SEQ ID NO: 165248 - DNA, 15 bp, Homo sapiens
atgtgtttatcgacc

SEQ ID NO: 165249 - DNA, 15 bp, Homo sapiens
aatgtgtttatcgac

SEQ ID NO: 165250 - DNA, 15 bp, Homo sapiens
aaatgtgtttatcga

SEQ ID NO: 165251 - DNA, 15 bp, Homo sapiens
aaaatgtgtttatcg

SEQ ID NO: 165252 - DNA, 15 bp, Homo sapiens
aaaaatgtgtttatc

SEQ ID NO: 165253 - DNA, 15 bp, Homo sapiens
taaaaatgtgtttat

SEQ ID NO: 165254 - DNA, 15 bp, Homo sapiens
ttaaaaatgtgttta

SEQ ID NO: 165255 - DNA, 15 bp, Homo sapiens
attaaaaatgtgttt

SEQ ID NO: 165256 - DNA, 15 bp, Homo sapiens
tattaaaaatgtgtt

SEQ ID NO: 165257 - DNA, 15 bp, Homo sapiens
atattaaaaatgtgt

SEQ ID NO: 165258 - DNA, 15 bp, Homo sapiens
aatattaaaaatgtg

SEQ ID NO: 165259 - DNA, 15 bp, Homo sapiens
caatattaaaaatgt

SEQ ID NO: 165260 - DNA, 15 bp, Homo sapiens
acaatattaaaaatg

SEQ ID NO: 165261 - DNA, 15 bp, Homo sapiens
cacaatattaaaaat

SEQ ID NO: 165262 - DNA, 15 bp, Homo sapiens
gcacaatattaaaaa

SEQ ID NO: 165263 - DNA, 15 bp, Homo sapiens
ggcacaatattaaaa

SEQ ID NO: 165264 - DNA, 15 bp, Homo sapiens
tggcacaatattaaa

SEQ ID NO: 165265 - DNA, 15 bp, Homo sapiens
ctggcacaatattaa

SEQ ID NO: 165266 - DNA, 15 bp, Homo sapiens
tctggcacaatatta

SEQ ID NO: 165267 - DNA, 15 bp, Homo sapiens
gtctggcacaatatt

SEQ ID NO: 165268 - DNA, 15 bp, Homo sapiens
agtctggcacaatat

SEQ ID NO: 165269 - DNA, 15 bp, Homo sapiens
tagtctggcacaata

SEQ ID NO: 165270 - DNA, 15 bp, Homo sapiens
atagtctggcacaat

SEQ ID NO: 165271 - DNA, 15 bp, Homo sapiens
gatagtctggcacaa

SEQ ID NO: 165272 - DNA, 15 bp, Homo sapiens
tgatagtctggcaca

SEQ ID NO: 165273 - DNA, 15 bp, Homo sapiens
atgatagtctggcac

SEQ ID NO: 165274 - DNA, 15 bp, Homo sapiens
aatgatagtctggca

SEQ ID NO: 165275 - DNA, 15 bp, Homo sapiens
taatgatagtctggc

SEQ ID NO: 165276 - DNA, 15 bp, Homo sapiens
ataatgatagtctgg

SEQ ID NO: 165277 - DNA, 15 bp, Homo sapiens
aataatgatagtctg

SEQ ID NO: 165278 - DNA, 15 bp, Homo sapiens
taataatgatagtct

SEQ ID NO: 165279 - DNA, 15 bp, Homo sapiens
ttaataatgatagtc

SEQ ID NO: 165280 - DNA, 15 bp, Homo sapiens
attaataatgatagt

SEQ ID NO: 165281 - DNA, 15 bp, Homo sapiens
aattaataatgatag

SEQ ID NO: 165282 - DNA, 15 bp, Homo sapiens
aaattaataatgata

SEQ ID NO: 165283 - DNA, 15 bp, Homo sapiens
aaaattaataatgat

SEQ ID NO: 165284 - DNA, 15 bp, Homo sapiens
aaaaattaataatga

SEQ ID NO: 165285 - DNA, 15 bp, Homo sapiens
taaaaattaataatg

SEQ ID NO: 165286 - DNA, 15 bp, Homo sapiens
ttaaaaattaataat

SEQ ID NO: 165287 - DNA, 15 bp, Homo sapiens
tttaaaaattaataa

SEQ ID NO: 165288 - DNA, 15 bp, Homo sapiens
atttaaaaattaata

SEQ ID NO: 165289 - DNA, 15 bp, Homo sapiens
gatttaaaaattaat

SEQ ID NO: 165290 - DNA, 15 bp, Homo sapiens
tgatttaaaaattaa

SEQ ID NO: 165291 - DNA, 15 bp, Homo sapiens
ttgatttaaaaatta

SEQ ID NO: 165292 - DNA, 15 bp, Homo sapiens
attgatttaaaaatt

SEQ ID NO: 165293 - DNA, 15 bp, Homo sapiens
tattgatttaaaaat

SEQ ID NO: 165294 - DNA, 15 bp, Homo sapiens
atattgatttaaaaa

SEQ ID NO: 165295 - DNA, 15 bp, Homo sapiens
catattgatttaaaa

SEQ ID NO: 165296 - DNA, 15 bp, Homo sapiens
acatattgatttaaa

SEQ ID NO: 165297 - DNA, 15 bp, Homo sapiens
tacatattgatttaa

SEQ ID NO: 165298 - DNA, 15 bp, Homo sapiens
ctacatattgattta

SEQ ID NO: 165299 - DNA, 15 bp, Homo sapiens
actacatattgattt

SEQ ID NO: 165300 - DNA, 15 bp, Homo sapiens
tactacatattgatt

SEQ ID NO: 165301 - DNA, 15 bp, Homo sapiens
ctactacatattgat

SEQ ID NO: 165302 - DNA, 15 bp, Homo sapiens
actactacatattga

SEQ ID NO: 165303 - DNA, 15 bp, Homo sapiens
tactactacatattg

SEQ ID NO: 165304 - DNA, 15 bp, Homo sapiens
atactactacatatt

SEQ ID NO: 165305 - DNA, 15 bp, Homo sapiens
catactactacatat

SEQ ID NO: 165306 - DNA, 15 bp, Homo sapiens
tcatactactacata

SEQ ID NO: 165307 - DNA, 15 bp, Homo sapiens
gtcatactactacat

SEQ ID NO: 165308 - DNA, 15 bp, Homo sapiens
ggtcatactactaca

SEQ ID NO: 165309 - DNA, 15 bp, Homo sapiens
tggtcatactactac

SEQ ID NO: 165310 - DNA, 15 bp, Homo sapiens
gtggtcatactacta

SEQ ID NO: 165311 - DNA, 15 bp, Homo sapiens
tgtggtcatactact

SEQ ID NO: 165312 - DNA, 15 bp, Homo sapiens
ttgtggtcatactac

SEQ ID NO: 165313 - DNA, 15 bp, Homo sapiens
attgtggtcatacta

SEQ ID NO: 165314 - DNA, 15 bp, Homo sapiens
cattgtggtcatact

SEQ ID NO: 165315 - DNA, 15 bp, Homo sapiens
acattgtggtcatac

SEQ ID NO: 165316 - DNA, 15 bp, Homo sapiens
gacattgtggtcata

SEQ ID NO: 165317 - DNA, 15 bp, Homo sapiens
tgacattgtggtcat

SEQ ID NO: 165318 - DNA, 15 bp, Homo sapiens
atgacattgtggtca

SEQ ID NO: 165319 - DNA, 15 bp, Homo sapiens
tatgacattgtggtc

SEQ ID NO: 165320 - DNA, 15 bp, Homo sapiens
atatgacattgtggt

SEQ ID NO: 165321 - DNA, 15 bp, Homo sapiens
aatatgacattgtgg

SEQ ID NO: 165322 - DNA, 15 bp, Homo sapiens
gaatatgacattgtg

SEQ ID NO: 165323 - DNA, 15 bp, Homo sapiens
tgaatatgacattgt

SEQ ID NO: 165324 - DNA, 15 bp, Homo sapiens
atgaatatgacattg

SEQ ID NO: 165325 - DNA, 15 bp, Homo sapiens
aatgaatatgacatt

SEQ ID NO: 165326 - DNA, 15 bp, Homo sapiens
taatgaatatgacat

SEQ ID NO: 165327 - DNA, 15 bp, Homo sapiens
ctaatgaatatgaca

SEQ ID NO: 165328 - DNA, 15 bp, Homo sapiens
actaatgaatatgac

SEQ ID NO: 165329 - DNA, 15 bp, Homo sapiens
tactaatgaatatga

SEQ ID NO: 165330 - DNA, 15 bp, Homo sapiens
ttactaatgaatatg

SEQ ID NO: 165331 - DNA, 15 bp, Homo sapiens
tttactaatgaatat

SEQ ID NO: 165332 - DNA, 15 bp, Homo sapiens
ctttactaatgaata

SEQ ID NO: 165333 - DNA, 15 bp, Homo sapiens
actttactaatgaat

SEQ ID NO: 165334 - DNA, 15 bp, Homo sapiens
tactttactaatgaa

SEQ ID NO: 165335 - DNA, 15 bp, Homo sapiens
gtactttactaatga

SEQ ID NO: 165336 - DNA, 15 bp, Homo sapiens
tgtactttactaatg

SEQ ID NO: 165337 - DNA, 15 bp, Homo sapiens
ctgtactttactaat

SEQ ID NO: 165338 - DNA, 15 bp, Homo sapiens
gctgtactttactaa

SEQ ID NO: 165339 - DNA, 15 bp, Homo sapiens
agctgtactttacta

SEQ ID NO: 165340 - DNA, 15 bp, Homo sapiens
cagctgtactttact

SEQ ID NO: 165341 - DNA, 15 bp, Homo sapiens
acagctgtactttac

SEQ ID NO: 165342 - DNA, 15 bp, Homo sapiens
aacagctgtacttta

SEQ ID NO: 165343 - DNA, 15 bp, Homo sapiens
aaacagctgtacttt

SEQ ID NO: 165344 - DNA, 15 bp, Homo sapiens
aaaacagctgtactt

SEQ ID NO: 165345 - DNA, 15 bp, Homo sapiens
aaaaacagctgtact

SEQ ID NO: 165346 - DNA, 15 bp, Homo sapiens
aaaaaacagctgtac

SEQ ID NO: 165347 - DNA, 15 bp, Homo sapiens
taaaaaacagctgta

SEQ ID NO: 165348 - DNA, 15 bp, Homo sapiens
ataaaaaacagctgt

SEQ ID NO: 165349 - DNA, 15 bp, Homo sapiens
cataaaaaacagctg

SEQ ID NO: 165350 - DNA, 15 bp, Homo sapiens
gcataaaaaacagct

SEQ ID NO: 165351 - DNA, 15 bp, Homo sapiens
ggcataaaaaacagc

SEQ ID NO: 165352 - DNA, 15 bp, Homo sapiens
tggcataaaaaacag

SEQ ID NO: 165353 - DNA, 15 bp, Homo sapiens
atggcataaaaaaca

SEQ ID NO: 165354 - DNA, 15 bp, Homo sapiens
gatggcataaaaaac

SEQ ID NO: 165355 - DNA, 15 bp, Homo sapiens
tgatggcataaaaaa

SEQ ID NO: 165356 - DNA, 15 bp, Homo sapiens
ctgatggcataaaaa

SEQ ID NO: 165357 - DNA, 15 bp, Homo sapiens
cctgatggcataaaa

SEQ ID NO: 165358 - DNA, 15 bp, Homo sapiens
tcctgatggcataaa

SEQ ID NO: 165359 - DNA, 15 bp, Homo sapiens
atcctgatggcataa

SEQ ID NO: 165360 - DNA, 15 bp, Homo sapiens
aatcctgatggcata

SEQ ID NO: 165361 - DNA, 15 bp, Homo sapiens
taatcctgatggcat

SEQ ID NO: 165362 - DNA, 15 bp, Homo sapiens
ataatcctgatggca

SEQ ID NO: 165363 - DNA, 15 bp, Homo sapiens
aataatcctgatggc

SEQ ID NO: 165364 - DNA, 15 bp, Homo sapiens
aaataatcctgatgg

SEQ ID NO: 165365 - DNA, 15 bp, Homo sapiens
caaataatcctgatg

SEQ ID NO: 165366 - DNA, 15 bp, Homo sapiens
ccaaataatcctgat

SEQ ID NO: 165367 - DNA, 15 bp, Homo sapiens
gccaaataatcctga

SEQ ID NO: 165368 - DNA, 15 bp, Homo sapiens
tgccaaataatcctg

SEQ ID NO: 165369 - DNA, 15 bp, Homo sapiens
atgccaaataatcct

SEQ ID NO: 165370 - DNA, 15 bp, Homo sapiens
aatgccaaataatcc

SEQ ID NO: 165371 - DNA, 15 bp, Homo sapiens
aaatgccaaataatc

SEQ ID NO: 165372 - DNA, 15 bp, Homo sapiens
taaatgccaaataat

SEQ ID NO: 165373 - DNA, 15 bp, Homo sapiens
ttaaatgccaaataa

SEQ ID NO: 165374 - DNA, 15 bp, Homo sapiens
cttaaatgccaaata

SEQ ID NO: 165375 - DNA, 15 bp, Homo sapiens
gcttaaatgccaaat

SEQ ID NO: 165376 - DNA, 15 bp, Homo sapiens
tgcttaaatgccaaa

SEQ ID NO: 165377 - DNA, 15 bp, Homo sapiens
ctgcttaaatgccaa

SEQ ID NO: 165378 - DNA, 15 bp, Homo sapiens
actgcttaaatgcca

SEQ ID NO: 165379 - DNA, 15 bp, Homo sapiens
cactgcttaaatgcc

SEQ ID NO: 165380 - DNA, 15 bp, Homo sapiens
gcactgcttaaatgc

SEQ ID NO: 165381 - DNA, 15 bp, Homo sapiens
ggcactgcttaaatg

SEQ ID NO: 165382 - DNA, 15 bp, Homo sapiens
aggcactgcttaaat

SEQ ID NO: 165383 - DNA, 15 bp, Homo sapiens
aaggcactgcttaaa

SEQ ID NO: 165384 - DNA, 15 bp, Homo sapiens
gaaggcactgcttaa

SEQ ID NO: 165385 - DNA, 15 bp, Homo sapiens
agaaggcactgctta

SEQ ID NO: 165386 - DNA, 15 bp, Homo sapiens
tagaaggcactgctt

SEQ ID NO: 165387 - DNA, 15 bp, Homo sapiens
gtagaaggcactgct

SEQ ID NO: 165388 - DNA, 15 bp, Homo sapiens
agtagaaggcactgc

SEQ ID NO: 165389 - DNA, 15 bp, Homo sapiens
aagtagaaggcactg

SEQ ID NO: 165390 - DNA, 15 bp, Homo sapiens
aaagtagaaggcact

SEQ ID NO: 165391 - DNA, 15 bp, Homo sapiens
taaagtagaaggcac

SEQ ID NO: 165392 - DNA, 15 bp, Homo sapiens
ttaaagtagaaggca

SEQ ID NO: 165393 - DNA, 15 bp, Homo sapiens
tttaaagtagaaggc

SEQ ID NO: 165394 - DNA, 15 bp, Homo sapiens
atttaaagtagaagg

SEQ ID NO: 165395 - DNA, 15 bp, Homo sapiens
catttaaagtagaag

SEQ ID NO: 165396 - DNA, 15 bp, Homo sapiens
tcatttaaagtagaa

SEQ ID NO: 165397 - DNA, 15 bp, Homo sapiens
atcatttaaagtaga

SEQ ID NO: 165398 - DNA, 15 bp, Homo sapiens
catcatttaaagtag

SEQ ID NO: 165399 - DNA, 15 bp, Homo sapiens
gcatcatttaaagta

SEQ ID NO: 165400 - DNA, 15 bp, Homo sapiens
ggcatcatttaaagt

SEQ ID NO: 165401 - DNA, 15 bp, Homo sapiens
tggcatcatttaaag

SEQ ID NO: 165402 - DNA, 15 bp, Homo sapiens
atggcatcatttaaa

SEQ ID NO: 165403 - DNA, 15 bp, Homo sapiens
aatggcatcatttaa

SEQ ID NO: 165404 - DNA, 15 bp, Homo sapiens
taatggcatcattta

SEQ ID NO: 165405 - DNA, 15 bp, Homo sapiens
ataatggcatcattt

SEQ ID NO: 165406 - DNA, 15 bp, Homo sapiens
gataatggcatcatt

SEQ ID NO: 165407 - DNA, 15 bp, Homo sapiens
ggataatggcatcat

SEQ ID NO: 165408 - DNA, 15 bp, Homo sapiens
aggataatggcatca

SEQ ID NO: 165409 - DNA, 15 bp, Homo sapiens
aaggataatggcatc

SEQ ID NO: 165410 - DNA, 15 bp, Homo sapiens
aaaggataatggcat

SEQ ID NO: 165411 - DNA, 15 bp, Homo sapiens
caaaggataatggca

SEQ ID NO: 165412 - DNA, 15 bp, Homo sapiens
tcaaaggataatggc

SEQ ID NO: 165413 - DNA, 15 bp, Homo sapiens
ctcaaaggataatgg

SEQ ID NO: 165414 - DNA, 15 bp, Homo sapiens
cctcaaaggataatg

SEQ ID NO: 165415 - DNA, 15 bp, Homo sapiens
tcctcaaaggataat

SEQ ID NO: 165416 - DNA, 15 bp, Homo sapiens
gtcctcaaaggataa

SEQ ID NO: 165417 - DNA, 15 bp, Homo sapiens
agtcctcaaaggata

SEQ ID NO: 165418 - DNA, 15 bp, Homo sapiens
gagtcctcaaaggat

SEQ ID NO: 165419 - DNA, 15 bp, Homo sapiens
agagtcctcaaagga

SEQ ID NO: 165420 - DNA, 15 bp, Homo sapiens
cagagtcctcaaagg

SEQ ID NO: 165421 - DNA, 15 bp, Homo sapiens
gcagagtcctcaaag

SEQ ID NO: 165422 - DNA, 15 bp, Homo sapiens
ggcagagtcctcaaa

SEQ ID NO: 165423 - DNA, 15 bp, Homo sapiens
aggcagagtcctcaa

SEQ ID NO: 165424 - DNA, 15 bp, Homo sapiens
taggcagagtcctca

SEQ ID NO: 165425 - DNA, 15 bp, Homo sapiens
ataggcagagtcctc

SEQ ID NO: 165426 - DNA, 15 bp, Homo sapiens
gataggcagagtcct

SEQ ID NO: 165427 - DNA, 15 bp, Homo sapiens
tgataggcagagtcc

SEQ ID NO: 165428 - DNA, 15 bp, Homo sapiens
ttgataggcagagtc

SEQ ID NO: 165429 - DNA, 15 bp, Homo sapiens
attgataggcagagt

SEQ ID NO: 165430 - DNA, 15 bp, Homo sapiens
aattgataggcagag

SEQ ID NO: 165431 - DNA, 15 bp, Homo sapiens
aaattgataggcaga

SEQ ID NO: 165432 - DNA, 15 bp, Homo sapiens
caaattgataggcag

SEQ ID NO: 165433 - DNA, 15 bp, Homo sapiens
ccaaattgataggca

SEQ ID NO: 165434 - DNA, 15 bp, Homo sapiens
accaaattgataggc

SEQ ID NO: 165435 - DNA, 15 bp, Homo sapiens
gaccaaattgatagg

SEQ ID NO: 165436 - DNA, 15 bp, Homo sapiens
tgaccaaattgatag

SEQ ID NO: 165437 - DNA, 15 bp, Homo sapiens
ctgaccaaattgata

SEQ ID NO: 165438 - DNA, 15 bp, Homo sapiens
actgaccaaattgat

SEQ ID NO: 165439 - DNA, 15 bp, Homo sapiens
gactgaccaaattga

SEQ ID NO: 165440 - DNA, 15 bp, Homo sapiens
agactgaccaaattg

SEQ ID NO: 165441 - DNA, 15 bp, Homo sapiens
tagactgaccaaatt

SEQ ID NO: 165442 - DNA, 15 bp, Homo sapiens
ctagactgaccaaat

SEQ ID NO: 165443 - DNA, 15 bp, Homo sapiens
tctagactgaccaaa

SEQ ID NO: 165444 - DNA, 15 bp, Homo sapiens
ttctagactgaccaa

SEQ ID NO: 165445 - DNA, 15 bp, Homo sapiens
tttctagactgacca

SEQ ID NO: 165446 - DNA, 15 bp, Homo sapiens
atttctagactgacc

SEQ ID NO: 165447 - DNA, 15 bp, Homo sapiens
catttctagactgac

SEQ ID NO: 165448 - DNA, 15 bp, Homo sapiens
gcatttctagactga

SEQ ID NO: 165449 - DNA, 15 bp, Homo sapiens
tgcatttctagactg

SEQ ID NO: 165450 - DNA, 15 bp, Homo sapiens
ttgcatttctagact

SEQ ID NO: 165451 - DNA, 15 bp, Homo sapiens
gttgcatttctagac

SEQ ID NO: 165452 - DNA, 15 bp, Homo sapiens
agttgcatttctaga

SEQ ID NO: 165453 - DNA, 15 bp, Homo sapiens
gagttgcatttctag

SEQ ID NO: 165454 - DNA, 15 bp, Homo sapiens
tgagttgcatttcta

SEQ ID NO: 165455 - DNA, 15 bp, Homo sapiens
atgagttgcatttct

SEQ ID NO: 165456 - DNA, 15 bp, Homo sapiens
aatgagttgcatttc

SEQ ID NO: 165457 - DNA, 15 bp, Homo sapiens
taatgagttgcattt

SEQ ID NO: 165458 - DNA, 15 bp, Homo sapiens
ataatgagttgcatt

SEQ ID NO: 165459 - DNA, 15 bp, Homo sapiens
tataatgagttgcat

SEQ ID NO: 165460 - DNA, 15 bp, Homo sapiens
ctataatgagttgca

SEQ ID NO: 165461 - DNA, 15 bp, Homo sapiens
tctataatgagttgc

SEQ ID NO: 165462 - DNA, 15 bp, Homo sapiens
ttctataatgagttg

SEQ ID NO: 165463 - DNA, 15 bp, Homo sapiens
attctataatgagtt

SEQ ID NO: 165464 - DNA, 15 bp, Homo sapiens
cattctataatgagt

SEQ ID NO: 165465 - DNA, 15 bp, Homo sapiens
tcattctataatgag

SEQ ID NO: 165466 - DNA, 15 bp, Homo sapiens
ttcattctataatga

SEQ ID NO: 165467 - DNA, 15 bp, Homo sapiens
cttcattctataatg

SEQ ID NO: 165468 - DNA, 15 bp, Homo sapiens
gcttcattctataat

SEQ ID NO: 165469 - DNA, 15 bp, Homo sapiens
agcttcattctataa

SEQ ID NO: 165470 - DNA, 15 bp, Homo sapiens
cagcttcattctata

SEQ ID NO: 165471 - DNA, 15 bp, Homo sapiens
tcagcttcattctat

SEQ ID NO: 165472 - DNA, 15 bp, Homo sapiens
ttcagcttcattcta

SEQ ID NO: 165473 - DNA, 15 bp, Homo sapiens
attcagcttcattct

SEQ ID NO: 165474 - DNA, 15 bp, Homo sapiens
tattcagcttcattc

SEQ ID NO: 165475 - DNA, 15 bp, Homo sapiens
ctattcagcttcatt

SEQ ID NO: 165476 - DNA, 15 bp, Homo sapiens
actattcagcttcat

SEQ ID NO: 165477 - DNA, 15 bp, Homo sapiens
aactattcagcttca

SEQ ID NO: 165478 - DNA, 15 bp, Homo sapiens
taactattcagcttc

SEQ ID NO: 165479 - DNA, 15 bp, Homo sapiens
gtaactattcagctt

SEQ ID NO: 165480 - DNA, 15 bp, Homo sapiens
agtaactattcagct

SEQ ID NO: 165481 - DNA, 15 bp, Homo sapiens
cagtaactattcagc

SEQ ID NO: 165482 - DNA, 15 bp, Homo sapiens
tcagtaactattcag

SEQ ID NO: 165483 - DNA, 15 bp, Homo sapiens
ttcagtaactattca

SEQ ID NO: 165484 - DNA, 15 bp, Homo sapiens
cttcagtaactattc

SEQ ID NO: 165485 - DNA, 15 bp, Homo sapiens
gcttcagtaactatt

SEQ ID NO: 165486 - DNA, 15 bp, Homo sapiens
tgcttcagtaactat

SEQ ID NO: 165487 - DNA, 15 bp, Homo sapiens
ctgcttcagtaacta

SEQ ID NO: 165488 - DNA, 15 bp, Homo sapiens
tctgcttcagtaact

SEQ ID NO: 165489 - DNA, 15 bp, Homo sapiens
ttctgcttcagtaac

SEQ ID NO: 165490 - DNA, 15 bp, Homo sapiens
attctgcttcagtaa

SEQ ID NO: 165491 - DNA, 15 bp, Homo sapiens
tattctgcttcagta

SEQ ID NO: 165492 - DNA, 15 bp, Homo sapiens
gtattctgcttcagt

SEQ ID NO: 165493 - DNA, 15 bp, Homo sapiens
tgtattctgcttcag

SEQ ID NO: 165494 - DNA, 15 bp, Homo sapiens
ttgtattctgcttca

SEQ ID NO: 165495 - DNA, 15 bp, Homo sapiens
gttgtattctgcttc

SEQ ID NO: 165496 - DNA, 15 bp, Homo sapiens
agttgtattctgctt

SEQ ID NO: 165497 - DNA, 15 bp, Homo sapiens
aagttgtattctgct

SEQ ID NO: 165498 - DNA, 15 bp, Homo sapiens
aaagttgtattctgc

SEQ ID NO: 165499 - DNA, 15 bp, Homo sapiens
taaagttgtattctg

SEQ ID NO: 165500 - DNA, 15 bp, Homo sapiens
gtaaagttgtattct

SEQ ID NO: 165501 - DNA, 15 bp, Homo sapiens
tgtaaagttgtattc

SEQ ID NO: 165502 - DNA, 15 bp, Homo sapiens
ttgtaaagttgtatt

SEQ ID NO: 165503 - DNA, 15 bp, Homo sapiens
gttgtaaagttgtat

SEQ ID NO: 165504 - DNA, 15 bp, Homo sapiens
ggttgtaaagttgta

SEQ ID NO: 165505 - DNA, 15 bp, Homo sapiens
aggttgtaaagttgt

SEQ ID NO: 165506 - DNA, 15 bp, Homo sapiens
gaggttgtaaagttg

SEQ ID NO: 165507 - DNA, 15 bp, Homo sapiens
agaggttgtaaagtt

SEQ ID NO: 165508 - DNA, 15 bp, Homo sapiens
aagaggttgtaaagt

SEQ ID NO: 165509 - DNA, 15 bp, Homo sapiens
taagaggttgtaaag

SEQ ID NO: 165510 - DNA, 15 bp, Homo sapiens
ttaagaggttgtaaa

SEQ ID NO: 165511 - DNA, 15 bp, Homo sapiens
tttaagaggttgtaa

SEQ ID NO: 165512 - DNA, 15 bp, Homo sapiens
gtttaagaggttgta

SEQ ID NO: 165513 - DNA, 15 bp, Homo sapiens
ggtttaagaggttgt

SEQ ID NO: 165514 - DNA, 15 bp, Homo sapiens
tggtttaagaggttg

SEQ ID NO: 165515 - DNA, 15 bp, Homo sapiens
ctggtttaagaggtt

SEQ ID NO: 165516 - DNA, 15 bp, Homo sapiens
tctggtttaagaggt

SEQ ID NO: 165517 - DNA, 15 bp, Homo sapiens
ttctggtttaagagg

SEQ ID NO: 165518 - DNA, 15 bp, Homo sapiens
attctggtttaagag

SEQ ID NO: 165519 - DNA, 15 bp, Homo sapiens
tattctggtttaaga

SEQ ID NO: 165520 - DNA, 15 bp, Homo sapiens
atattctggtttaag

SEQ ID NO: 165521 - DNA, 15 bp, Homo sapiens
catattctggtttaa

SEQ ID NO: 165522 - DNA, 15 bp, Homo sapiens
ccatattctggttta

SEQ ID NO: 165523 - DNA, 15 bp, Homo sapiens
cccatattctggttt

SEQ ID NO: 165524 - DNA, 15 bp, Homo sapiens
tcccatattctggtt

SEQ ID NO: 165525 - DNA, 15 bp, Homo sapiens
ctcccatattctggt

SEQ ID NO: 165526 - DNA, 15 bp, Homo sapiens
tctcccatattctgg

SEQ ID NO: 165527 - DNA, 15 bp, Homo sapiens
ttctcccatattctg

SEQ ID NO: 165528 - DNA, 15 bp, Homo sapiens
cttctcccatattct

SEQ ID NO: 165529 - DNA, 15 bp, Homo sapiens
gcttctcccatattc

SEQ ID NO: 165530 - DNA, 15 bp, Homo sapiens
ggcttctcccatatt

SEQ ID NO: 165531 - DNA, 15 bp, Homo sapiens
gggcttctcccatat

SEQ ID NO: 165532 - DNA, 15 bp, Homo sapiens
tgggcttctcccata

SEQ ID NO: 165533 - DNA, 15 bp, Homo sapiens
ttgggcttctcccat

SEQ ID NO: 165534 - DNA, 15 bp, Homo sapiens
attgggcttctccca

SEQ ID NO: 165535 - DNA, 15 bp, Homo sapiens
aattgggcttctccc

SEQ ID NO: 165536 - DNA, 15 bp, Homo sapiens
aaattgggcttctcc

SEQ ID NO: 165537 - DNA, 15 bp, Homo sapiens
taaattgggcttctc

SEQ ID NO: 165538 - DNA, 15 bp, Homo sapiens
gtaaattgggcttct

SEQ ID NO: 165539 - DNA, 15 bp, Homo sapiens
ggtaaattgggcttc

SEQ ID NO: 165540 - DNA, 15 bp, Homo sapiens
aggtaaattgggctt

SEQ ID NO: 165541 - DNA, 15 bp, Homo sapiens
aaggtaaattgggct

SEQ ID NO: 165542 - DNA, 15 bp, Homo sapiens
aaaggtaaattgggc

SEQ ID NO: 165543 - DNA, 15 bp, Homo sapiens
taaaggtaaattggg

SEQ ID NO: 165544 - DNA, 15 bp, Homo sapiens
ttaaaggtaaattgg

SEQ ID NO: 165545 - DNA, 15 bp, Homo sapiens
tttaaaggtaaattg

SEQ ID NO: 165546 - DNA, 15 bp, Homo sapiens
ttttaaaggtaaatt

SEQ ID NO: 165547 - DNA, 15 bp, Homo sapiens
gttttaaaggtaaat

SEQ ID NO: 165548 - DNA, 15 bp, Homo sapiens
agttttaaaggtaaa

SEQ ID NO: 165549 - DNA, 15 bp, Homo sapiens
aagttttaaaggtaa

SEQ ID NO: 165550 - DNA, 15 bp, Homo sapiens
aaagttttaaaggta

SEQ ID NO: 165551 - DNA, 15 bp, Homo sapiens
aaaagttttaaaggt

SEQ ID NO: 165552 - DNA, 15 bp, Homo sapiens
caaaagttttaaagg

SEQ ID NO: 165553 - DNA, 15 bp, Homo sapiens
ccaaaagttttaaag

SEQ ID NO: 165554 - DNA, 15 bp, Homo sapiens
cccaaaagttttaaa

SEQ ID NO: 165555 - DNA, 15 bp, Homo sapiens
acccaaaagttttaa

SEQ ID NO: 165556 - DNA, 15 bp, Homo sapiens
cacccaaaagtttta

SEQ ID NO: 165557 - DNA, 15 bp, Homo sapiens
acacccaaaagtttt

SEQ ID NO: 165558 - DNA, 15 bp, Homo sapiens
gacacccaaaagttt

SEQ ID NO: 165559 - DNA, 15 bp, Homo sapiens
agacacccaaaagtt

SEQ ID NO: 165560 - DNA, 15 bp, Homo sapiens
tagacacccaaaagt

SEQ ID NO: 165561 - DNA, 15 bp, Homo sapiens
gtagacacccaaaag

SEQ ID NO: 165562 - DNA, 15 bp, Homo sapiens
tgtagacacccaaaa

SEQ ID NO: 165563 - DNA, 15 bp, Homo sapiens
gtgtagacacccaaa

SEQ ID NO: 165564 - DNA, 15 bp, Homo sapiens
tgtgtagacacccaa

SEQ ID NO: 165565 - DNA, 15 bp, Homo sapiens
ctgtgtagacaccca

SEQ ID NO: 165566 - DNA, 15 bp, Homo sapiens
tctgtgtagacaccc

SEQ ID NO: 165567 - DNA, 15 bp, Homo sapiens
ttctgtgtagacacc

SEQ ID NO: 165568 - DNA, 15 bp, Homo sapiens
tttctgtgtagacac

SEQ ID NO: 165569 - DNA, 15 bp, Homo sapiens
ttttctgtgtagaca

SEQ ID NO: 165570 - DNA, 15 bp, Homo sapiens
tttttctgtgtagac

SEQ ID NO: 165571 - DNA, 15 bp, Homo sapiens
ctttttctgtgtaga

SEQ ID NO: 165572 - DNA, 15 bp, Homo sapiens
cctttttctgtgtag

SEQ ID NO: 165573 - DNA, 15 bp, Homo sapiens
acctttttctgtgta

SEQ ID NO: 165574 - DNA, 15 bp, Homo sapiens
cacctttttctgtgt

SEQ ID NO: 165575 - DNA, 15 bp, Homo sapiens
acacctttttctgtg

SEQ ID NO: 165576 - DNA, 15 bp, Homo sapiens
aacacctttttctgt

SEQ ID NO: 165577 - DNA, 15 bp, Homo sapiens
taacacctttttctg

SEQ ID NO: 165578 - DNA, 15 bp, Homo sapiens
ttaacacctttttct

SEQ ID NO: 165579 - DNA, 15 bp, Homo sapiens
attaacacctttttc

SEQ ID NO: 165580 - DNA, 15 bp, Homo sapiens
cattaacaccttttt

SEQ ID NO: 165581 - DNA, 15 bp, Homo sapiens
acattaacacctttt

SEQ ID NO: 165582 - DNA, 15 bp, Homo sapiens
cacattaacaccttt

SEQ ID NO: 165583 - DNA, 15 bp, Homo sapiens
gcacattaacacctt

SEQ ID NO: 165584 - DNA, 15 bp, Homo sapiens
ggcacattaacacct

SEQ ID NO: 165585 - DNA, 15 bp, Homo sapiens
aggcacattaacacc

SEQ ID NO: 165586 - DNA, 15 bp, Homo sapiens
aaggcacattaacac

SEQ ID NO: 165587 - DNA, 15 bp, Homo sapiens
caaggcacattaaca

SEQ ID NO: 165588 - DNA, 15 bp, Homo sapiens
acaaggcacattaac

SEQ ID NO: 165589 - DNA, 15 bp, Homo sapiens
cacaaggcacattaa

SEQ ID NO: 165590 - DNA, 15 bp, Homo sapiens
tcacaaggcacatta

SEQ ID NO: 165591 - DNA, 15 bp, Homo sapiens
ttcacaaggcacatt

SEQ ID NO: 165592 - DNA, 15 bp, Homo sapiens
tttcacaaggcacat

SEQ ID NO: 165593 - DNA, 15 bp, Homo sapiens
atttcacaaggcaca

SEQ ID NO: 165594 - DNA, 15 bp, Homo sapiens
aatttcacaaggcac

SEQ ID NO: 165595 - DNA, 15 bp, Homo sapiens
aaatttcacaaggca

SEQ ID NO: 165596 - DNA, 15 bp, Homo sapiens
gaaatttcacaaggc

SEQ ID NO: 165597 - DNA, 15 bp, Homo sapiens
agaaatttcacaagg

SEQ ID NO: 165598 - DNA, 15 bp, Homo sapiens
gagaaatttcacaag

SEQ ID NO: 165599 - DNA, 15 bp, Homo sapiens
tgagaaatttcacaa

SEQ ID NO: 165600 - DNA, 15 bp, Homo sapiens
ttgagaaatttcaca

SEQ ID NO: 165601 - DNA, 15 bp, Homo sapiens
attgagaaatttcac

SEQ ID NO: 165602 - DNA, 15 bp, Homo sapiens
cattgagaaatttca

SEQ ID NO: 165603 - DNA, 15 bp, Homo sapiens
ccattgagaaatttc

SEQ ID NO: 165604 - DNA, 15 bp, Homo sapiens
accattgagaaattt

SEQ ID NO: 165605 - DNA, 15 bp, Homo sapiens
caccattgagaaatt

SEQ ID NO: 165606 - DNA, 15 bp, Homo sapiens
tcaccattgagaaat

SEQ ID NO: 165607 - DNA, 15 bp, Homo sapiens
ttcaccattgagaaa

SEQ ID NO: 165608 - DNA, 15 bp, Homo sapiens
attcaccattgagaa

SEQ ID NO: 165609 - DNA, 15 bp, Homo sapiens
tattcaccattgaga

SEQ ID NO: 165610 - DNA, 15 bp, Homo sapiens
gtattcaccattgag

SEQ ID NO: 165611 - DNA, 15 bp, Homo sapiens
tgtattcaccattga

SEQ ID NO: 165612 - DNA, 15 bp, Homo sapiens
atgtattcaccattg

SEQ ID NO: 165613 - DNA, 15 bp, Homo sapiens
aatgtattcaccatt

SEQ ID NO: 165614 - DNA, 15 bp, Homo sapiens
aaatgtattcaccat

SEQ ID NO: 165615 - DNA, 15 bp, Homo sapiens
aaaatgtattcacca

SEQ ID NO: 165616 - DNA, 15 bp, Homo sapiens
aaaaatgtattcacc

SEQ ID NO: 165617 - DNA, 15 bp, Homo sapiens
aaaaaatgtattcac

SEQ ID NO: 165618 - DNA, 15 bp, Homo sapiens
taaaaaatgtattca

SEQ ID NO: 165619 - DNA, 15 bp, Homo sapiens
ataaaaaatgtattc

SEQ ID NO: 165620 - DNA, 15 bp, Homo sapiens
aataaaaaatgtatt

SEQ ID NO: 165621 - DNA, 15 bp, Homo sapiens
gaataaaaaatgtat

SEQ ID NO: 165622 - DNA, 15 bp, Homo sapiens
agaataaaaaatgta

SEQ ID NO: 165623 - DNA, 15 bp, Homo sapiens
tagaataaaaaatgt

SEQ ID NO: 165624 - DNA, 15 bp, Homo sapiens
atagaataaaaaatg

SEQ ID NO: 165625 - DNA, 15 bp, Homo sapiens
catagaataaaaaat

SEQ ID NO: 165626 - DNA, 15 bp, Homo sapiens
acatagaataaaaaa

SEQ ID NO: 165627 - DNA, 15 bp, Homo sapiens
cacatagaataaaaa

SEQ ID NO: 165628 - DNA, 15 bp, Homo sapiens
tcacatagaataaaa

SEQ ID NO: 165629 - DNA, 15 bp, Homo sapiens
atcacatagaataaa

SEQ ID NO: 165630 - DNA, 15 bp, Homo sapiens
aatcacatagaataa

SEQ ID NO: 165631 - DNA, 15 bp, Homo sapiens
aaatcacatagaata

SEQ ID NO: 165632 - DNA, 15 bp, Homo sapiens
taaatcacatagaat

SEQ ID NO: 165633 - DNA, 15 bp, Homo sapiens
ataaatcacatagaa

SEQ ID NO: 165634 - DNA, 15 bp, Homo sapiens
aataaatcacataga

SEQ ID NO: 165635 - DNA, 15 bp, Homo sapiens
aaataaatcacatag

SEQ ID NO: 165636 - DNA, 15 bp, Homo sapiens
gaaataaatcacata

SEQ ID NO: 165637 - DNA, 15 bp, Homo sapiens
agaaataaatcacat

SEQ ID NO: 165638 - DNA, 15 bp, Homo sapiens
cagaaataaatcaca

SEQ ID NO: 165639 - DNA, 15 bp, Homo sapiens
ccagaaataaatcac

SEQ ID NO: 165640 - DNA, 15 bp, Homo sapiens
tccagaaataaatca

SEQ ID NO: 165641 - DNA, 15 bp, Homo sapiens
ctccagaaataaatc

SEQ ID NO: 165642 - DNA, 15 bp, Homo sapiens
tctccagaaataaat

SEQ ID NO: 165643 - DNA, 15 bp, Homo sapiens
atctccagaaataaa

SEQ ID NO: 165644 - DNA, 15 bp, Homo sapiens
catctccagaaataa

SEQ ID NO: 165645 - DNA, 15 bp, Homo sapiens
acatctccagaaata

SEQ ID NO: 165646 - DNA, 15 bp, Homo sapiens
tacatctccagaaat

SEQ ID NO: 165647 - DNA, 15 bp, Homo sapiens
gtacatctccagaaa

SEQ ID NO: 165648 - DNA, 15 bp, Homo sapiens
tgtacatctccagaa

SEQ ID NO: 165649 - DNA, 15 bp, Homo sapiens
atgtacatctccaga

SEQ ID NO: 165650 - DNA, 15 bp, Homo sapiens
aatgtacatctccag

SEQ ID NO: 165651 - DNA, 15 bp, Homo sapiens
taatgtacatctcca

SEQ ID NO: 165652 - DNA, 15 bp, Homo sapiens
ttaatgtacatctcc

SEQ ID NO: 165653 - DNA, 15 bp, Homo sapiens
attaatgtacatctc

SEQ ID NO: 165654 - DNA, 15 bp, Homo sapiens
gattaatgtacatct

SEQ ID NO: 165655 - DNA, 15 bp, Homo sapiens
agattaatgtacatc

SEQ ID NO: 165656 - DNA, 15 bp, Homo sapiens
aagattaatgtacat

SEQ ID NO: 165657 - DNA, 15 bp, Homo sapiens
aaagattaatgtaca

SEQ ID NO: 165658 - DNA, 15 bp, Homo sapiens
caaagattaatgtac

SEQ ID NO: 165659 - DNA, 15 bp, Homo sapiens
acaaagattaatgta

SEQ ID NO: 165660 - DNA, 15 bp, Homo sapiens
cacaaagattaatgt

SEQ ID NO: 165661 - DNA, 15 bp, Homo sapiens
tcacaaagattaatg

SEQ ID NO: 165662 - DNA, 15 bp, Homo sapiens
ttcacaaagattaat

SEQ ID NO: 165663 - DNA, 15 bp, Homo sapiens
cttcacaaagattaa

SEQ ID NO: 165664 - DNA, 15 bp, Homo sapiens
acttcacaaagatta

SEQ ID NO: 165665 - DNA, 15 bp, Homo sapiens
aacttcacaaagatt

SEQ ID NO: 165666 - DNA, 15 bp, Homo sapiens
caacttcacaaagat

SEQ ID NO: 165667 - DNA, 15 bp, Homo sapiens
gcaacttcacaaaga

SEQ ID NO: 165668 - DNA, 15 bp, Homo sapiens
agcaacttcacaaag

SEQ ID NO: 165669 - DNA, 15 bp, Homo sapiens
cagcaacttcacaaa

SEQ ID NO: 165670 - DNA, 15 bp, Homo sapiens
acagcaacttcacaa

SEQ ID NO: 165671 - DNA, 15 bp, Homo sapiens
cacagcaacttcaca

SEQ ID NO: 165672 - DNA, 15 bp, Homo sapiens
ccacagcaacttcac

SEQ ID NO: 165673 - DNA, 15 bp, Homo sapiens
tccacagcaacttca

SEQ ID NO: 165674 - DNA, 15 bp, Homo sapiens
ttccacagcaacttc

SEQ ID NO: 165675 - DNA, 15 bp, Homo sapiens
attccacagcaactt

SEQ ID NO: 165676 - DNA, 15 bp, Homo sapiens
aattccacagcaact

SEQ ID NO: 165677 - DNA, 15 bp, Homo sapiens
aaattccacagcaac

SEQ ID NO: 165678 - DNA, 15 bp, Homo sapiens
caaattccacagcaa

SEQ ID NO: 165679 - DNA, 15 bp, Homo sapiens
ccaaattccacagca

SEQ ID NO: 165680 - DNA, 15 bp, Homo sapiens
accaaattccacagc

SEQ ID NO: 165681 - DNA, 15 bp, Homo sapiens
aaccaaattccacag

SEQ ID NO: 165682 - DNA, 15 bp, Homo sapiens
caaccaaattccaca

SEQ ID NO: 165683 - DNA, 15 bp, Homo sapiens
ccaaccaaattccac

SEQ ID NO: 165684 - DNA, 15 bp, Homo sapiens
cccaaccaaattcca

SEQ ID NO: 165685 - DNA, 15 bp, Homo sapiens
acccaaccaaattcc

SEQ ID NO: 165686 - DNA, 15 bp, Homo sapiens
aacccaaccaaattc

SEQ ID NO: 165687 - DNA, 15 bp, Homo sapiens
aaacccaaccaaatt

SEQ ID NO: 165688 - DNA, 15 bp, Homo sapiens
caaacccaaccaaat

SEQ ID NO: 165689 - DNA, 15 bp, Homo sapiens
acaaacccaaccaaa

SEQ ID NO: 165690 - DNA, 15 bp, Homo sapiens
gacaaacccaaccaa

SEQ ID NO: 165691 - DNA, 15 bp, Homo sapiens
tgacaaacccaacca

SEQ ID NO: 165692 - DNA, 15 bp, Homo sapiens
ttgacaaacccaacc

SEQ ID NO: 165693 - DNA, 15 bp, Homo sapiens
tttgacaaacccaac

SEQ ID NO: 165694 - DNA, 15 bp, Homo sapiens
ttttgacaaacccaa

SEQ ID NO: 165695 - DNA, 15 bp, Homo sapiens
attttgacaaaccca

SEQ ID NO: 165696 - DNA, 15 bp, Homo sapiens
cattttgacaaaccc

SEQ ID NO: 165697 - DNA, 15 bp, Homo sapiens
acattttgacaaacc

SEQ ID NO: 165698 - DNA, 15 bp, Homo sapiens
cacattttgacaaac

SEQ ID NO: 165699 - DNA, 15 bp, Homo sapiens
acacattttgacaaa

SEQ ID NO: 165700 - DNA, 15 bp, Homo sapiens
gacacattttgacaa

SEQ ID NO: 165701 - DNA, 15 bp, Homo sapiens
tgacacattttgaca

SEQ ID NO: 165702 - DNA, 15 bp, Homo sapiens
ttgacacattttgac

SEQ ID NO: 165703 - DNA, 15 bp, Homo sapiens
tttgacacattttga

SEQ ID NO: 165704 - DNA, 15 bp, Homo sapiens
ttttgacacattttg

SEQ ID NO: 165705 - DNA, 15 bp, Homo sapiens
tttttgacacatttt

SEQ ID NO: 165706 - DNA, 15 bp, Homo sapiens
atttttgacacattt

SEQ ID NO: 165707 - DNA, 15 bp, Homo sapiens
catttttgacacatt

SEQ ID NO: 165708 - DNA, 15 bp, Homo sapiens
acatttttgacacat

SEQ ID NO: 165709 - DNA, 15 bp, Homo sapiens
cacatttttgacaca

SEQ ID NO: 165710 - DNA, 15 bp, Homo sapiens
tcacatttttgacac

SEQ ID NO: 165711 - DNA, 15 bp, Homo sapiens
ttcacatttttgaca

SEQ ID NO: 165712 - DNA, 15 bp, Homo sapiens
tttcacatttttgac

SEQ ID NO: 165713 - DNA, 15 bp, Homo sapiens
atttcacatttttga

SEQ ID NO: 165714 - DNA, 15 bp, Homo sapiens
tatttcacatttttg

SEQ ID NO: 165715 - DNA, 15 bp, Homo sapiens
atatttcacattttt

SEQ ID NO: 165716 - DNA, 15 bp, Homo sapiens
gatatttcacatttt

SEQ ID NO: 165717 - DNA, 15 bp, Homo sapiens
ggatatttcacattt

SEQ ID NO: 165718 - DNA, 15 bp, Homo sapiens
gggatatttcacatt

SEQ ID NO: 165719 - DNA, 15 bp, Homo sapiens
tgggatatttcacat

SEQ ID NO: 165720 - DNA, 15 bp, Homo sapiens
ctgggatatttcaca

SEQ ID NO: 165721 - DNA, 15 bp, Homo sapiens
actgggatatttcac

SEQ ID NO: 165722 - DNA, 15 bp, Homo sapiens
aactgggatatttca

SEQ ID NO: 165723 - DNA, 15 bp, Homo sapiens
gaactgggatatttc

SEQ ID NO: 165724 - DNA, 15 bp, Homo sapiens
agaactgggatattt

SEQ ID NO: 165725 - DNA, 15 bp, Homo sapiens
tagaactgggatatt

SEQ ID NO: 165726 - DNA, 15 bp, Homo sapiens
gtagaactgggatat

SEQ ID NO: 165727 - DNA, 15 bp, Homo sapiens
agtagaactgggata

SEQ ID NO: 165728 - DNA, 15 bp, Homo sapiens
tagtagaactgggat

SEQ ID NO: 165729 - DNA, 15 bp, Homo sapiens
ttagtagaactggga

SEQ ID NO: 165730 - DNA, 15 bp, Homo sapiens
attagtagaactggg

SEQ ID NO: 165731 - DNA, 15 bp, Homo sapiens
aattagtagaactgg

SEQ ID NO: 165732 - DNA, 15 bp, Homo sapiens
aaattagtagaactg

SEQ ID NO: 165733 - DNA, 15 bp, Homo sapiens
aaaattagtagaact

SEQ ID NO: 165734 - DNA, 15 bp, Homo sapiens
gaaaattagtagaac

SEQ ID NO: 165735 - DNA, 15 bp, Homo sapiens
agaaaattagtagaa

SEQ ID NO: 165736 - DNA, 15 bp, Homo sapiens
tagaaaattagtaga

SEQ ID NO: 165737 - DNA, 15 bp, Homo sapiens
ttagaaaattagtag

SEQ ID NO: 165738 - DNA, 15 bp, Homo sapiens
gttagaaaattagta

SEQ ID NO: 165739 - DNA, 15 bp, Homo sapiens
tgttagaaaattagt

SEQ ID NO: 165740 - DNA, 15 bp, Homo sapiens
gtgttagaaaattag

SEQ ID NO: 165741 - DNA, 15 bp, Homo sapiens
tgtgttagaaaatta

SEQ ID NO: 165742 - DNA, 15 bp, Homo sapiens
ttgtgttagaaaatt

SEQ ID NO: 165743 - DNA, 15 bp, Homo sapiens
tttgtgttagaaaat

SEQ ID NO: 165744 - DNA, 15 bp, Homo sapiens
ctttgtgttagaaaa

SEQ ID NO: 165745 - DNA, 15 bp, Homo sapiens
actttgtgttagaaa

SEQ ID NO: 165746 - DNA, 15 bp, Homo sapiens
aactttgtgttagaa

SEQ ID NO: 165747 - DNA, 15 bp, Homo sapiens
taactttgtgttaga

SEQ ID NO: 165748 - DNA, 15 bp, Homo sapiens
ctaactttgtgttag

SEQ ID NO: 165749 - DNA, 15 bp, Homo sapiens
tctaactttgtgtta

SEQ ID NO: 165750 - DNA, 15 bp, Homo sapiens
atctaactttgtgtt

SEQ ID NO: 165751 - DNA, 15 bp, Homo sapiens
catctaactttgtgt

SEQ ID NO: 165752 - DNA, 15 bp, Homo sapiens
ccatctaactttgtg

SEQ ID NO: 165753 - DNA, 15 bp, Homo sapiens
tccatctaactttgt

SEQ ID NO: 165754 - DNA, 15 bp, Homo sapiens
gtccatctaactttg

SEQ ID NO: 165755 - DNA, 15 bp, Homo sapiens
tgtccatctaacttt

SEQ ID NO: 165756 - DNA, 15 bp, Homo sapiens
ttgtccatctaactt

SEQ ID NO: 165757 - DNA, 15 bp, Homo sapiens
tttgtccatctaact

SEQ ID NO: 165758 - DNA, 15 bp, Homo sapiens
ctttgtccatctaac

SEQ ID NO: 165759 - DNA, 15 bp, Homo sapiens
actttgtccatctaa

SEQ ID NO: 165760 - DNA, 15 bp, Homo sapiens
aactttgtccatcta

SEQ ID NO: 165761 - DNA, 15 bp, Homo sapiens
taactttgtccatct

SEQ ID NO: 165762 - DNA, 15 bp, Homo sapiens
ctaactttgtccatc

SEQ ID NO: 165763 - DNA, 15 bp, Homo sapiens
tctaactttgtccat

SEQ ID NO: 165764 - DNA, 15 bp, Homo sapiens
atctaactttgtcca

SEQ ID NO: 165765 - DNA, 15 bp, Homo sapiens
catctaactttgtcc

SEQ ID NO: 165766 - DNA, 15 bp, Homo sapiens
tcatctaactttgtc

SEQ ID NO: 165767 - DNA, 15 bp, Homo sapiens
gtcatctaactttgt

SEQ ID NO: 165768 - DNA, 15 bp, Homo sapiens
tgtcatctaactttg

SEQ ID NO: 165769 - DNA, 15 bp, Homo sapiens
ttgtcatctaacttt

SEQ ID NO: 165770 - DNA, 15 bp, Homo sapiens
tttgtcatctaactt

SEQ ID NO: 165771 - DNA, 15 bp, Homo sapiens
ctttgtcatctaact

SEQ ID NO: 165772 - DNA, 15 bp, Homo sapiens
tctttgtcatctaac

SEQ ID NO: 165773 - DNA, 15 bp, Homo sapiens
ttctttgtcatctaa

SEQ ID NO: 165774 - DNA, 15 bp, Homo sapiens
cttctttgtcatcta

SEQ ID NO: 165775 - DNA, 15 bp, Homo sapiens
tcttctttgtcatct

SEQ ID NO: 165776 - DNA, 15 bp, Homo sapiens
ttcttctttgtcatc

SEQ ID NO: 165777 - DNA, 15 bp, Homo sapiens
cttcttctttgtcat

SEQ ID NO: 165778 - DNA, 15 bp, Homo sapiens
tcttcttctttgtca

SEQ ID NO: 165779 - DNA, 15 bp, Homo sapiens
gtcttcttctttgtc

SEQ ID NO: 165780 - DNA, 15 bp, Homo sapiens
tgtcttcttctttgt

SEQ ID NO: 165781 - DNA, 15 bp, Homo sapiens
ttgtcttcttctttg

SEQ ID NO: 165782 - DNA, 15 bp, Homo sapiens
tttgtcttcttcttt

SEQ ID NO: 165783 - DNA, 15 bp, Homo sapiens
ctttgtcttcttctt

SEQ ID NO: 165784 - DNA, 15 bp, Homo sapiens
actttgtcttcttct

SEQ ID NO: 165785 - DNA, 15 bp, Homo sapiens
aactttgtcttcttc

SEQ ID NO: 165786 - DNA, 15 bp, Homo sapiens
taactttgtcttctt

SEQ ID NO: 165787 - DNA, 15 bp, Homo sapiens
ctaactttgtcttct

SEQ ID NO: 165788 - DNA, 15 bp, Homo sapiens
tctaactttgtcttc

SEQ ID NO: 165789 - DNA, 15 bp, Homo sapiens
atctaactttgtctt

SEQ ID NO: 165790 - DNA, 15 bp, Homo sapiens
catctaactttgtct

SEQ ID NO: 165791 - DNA, 15 bp, Homo sapiens
ccatctaactttgtc

SEQ ID NO: 165792 - DNA, 15 bp, Homo sapiens
agtccatctaacttt

SEQ ID NO: 165793 - DNA, 15 bp, Homo sapiens
gagtccatctaactt

SEQ ID NO: 165794 - DNA, 15 bp, Homo sapiens
ggagtccatctaact

SEQ ID NO: 165795 - DNA, 15 bp, Homo sapiens
tggagtccatctaac

SEQ ID NO: 165796 - DNA, 15 bp, Homo sapiens
atggagtccatctaa

SEQ ID NO: 165797 - DNA, 15 bp, Homo sapiens
tatggagtccatcta

SEQ ID NO: 165798 - DNA, 15 bp, Homo sapiens
ctatggagtccatct

SEQ ID NO: 165799 - DNA, 15 bp, Homo sapiens
cctatggagtccatc

SEQ ID NO: 165800 - DNA, 15 bp, Homo sapiens
tcctatggagtccat

SEQ ID NO: 165801 - DNA, 15 bp, Homo sapiens
ctcctatggagtcca

SEQ ID NO: 165802 - DNA, 15 bp, Homo sapiens
tctcctatggagtcc

SEQ ID NO: 165803 - DNA, 15 bp, Homo sapiens
ctctcctatggagtc

SEQ ID NO: 165804 - DNA, 15 bp, Homo sapiens
tctctcctatggagt

SEQ ID NO: 165805 - DNA, 15 bp, Homo sapiens
ttctctcctatggag

SEQ ID NO: 165806 - DNA, 15 bp, Homo sapiens
cttctctcctatgga

SEQ ID NO: 165807 - DNA, 15 bp, Homo sapiens
tcttctctcctatgg

SEQ ID NO: 165808 - DNA, 15 bp, Homo sapiens
ctcttctctcctatg

SEQ ID NO: 165809 - DNA, 15 bp, Homo sapiens
cctcttctctcctat

SEQ ID NO: 165810 - DNA, 15 bp, Homo sapiens
tcctcttctctccta

SEQ ID NO: 165811 - DNA, 15 bp, Homo sapiens
gtcctcttctctcct

SEQ ID NO: 165812 - DNA, 15 bp, Homo sapiens
agtcctcttctctcc

SEQ ID NO: 165813 - DNA, 15 bp, Homo sapiens
aagtcctcttctctc

SEQ ID NO: 165814 - DNA, 15 bp, Homo sapiens
taagtcctcttctct

SEQ ID NO: 165815 - DNA, 15 bp, Homo sapiens
ttaagtcctcttctc

SEQ ID NO: 165816 - DNA, 15 bp, Homo sapiens
tttaagtcctcttct

SEQ ID NO: 165817 - DNA, 15 bp, Homo sapiens
ttttaagtcctcttc

SEQ ID NO: 165818 - DNA, 15 bp, Homo sapiens
tttttaagtcctctt

SEQ ID NO: 165819 - DNA, 15 bp, Homo sapiens
atttttaagtcctct

SEQ ID NO: 165820 - DNA, 15 bp, Homo sapiens
catttttaagtcctc

SEQ ID NO: 165821 - DNA, 15 bp, Homo sapiens
tcatttttaagtcct

SEQ ID NO: 165822 - DNA, 15 bp, Homo sapiens
atcatttttaagtcc

SEQ ID NO: 165823 - DNA, 15 bp, Homo sapiens
catcatttttaagtc

SEQ ID NO: 165824 - DNA, 15 bp, Homo sapiens
gcatcatttttaagt

SEQ ID NO: 165825 - DNA, 15 bp, Homo sapiens
ggcatcatttttaag

SEQ ID NO: 165826 - DNA, 15 bp, Homo sapiens
aggcatcatttttaa

SEQ ID NO: 165827 - DNA, 15 bp, Homo sapiens
aaggcatcattttta

SEQ ID NO: 165828 - DNA, 15 bp, Homo sapiens
taaggcatcattttt

SEQ ID NO: 165829 - DNA, 15 bp, Homo sapiens
ttaaggcatcatttt

SEQ ID NO: 165830 - DNA, 15 bp, Homo sapiens
attaaggcatcattt

SEQ ID NO: 165831 - DNA, 15 bp, Homo sapiens
tattaaggcatcatt

SEQ ID NO: 165832 - DNA, 15 bp, Homo sapiens
atattaaggcatcat

SEQ ID NO: 165833 - DNA, 15 bp, Homo sapiens
gatattaaggcatca

SEQ ID NO: 165834 - DNA, 15 bp, Homo sapiens
agatattaaggcatc

SEQ ID NO: 165835 - DNA, 15 bp, Homo sapiens
cagatattaaggcat

SEQ ID NO: 165836 - DNA, 15 bp, Homo sapiens
gcagatattaaggca

SEQ ID NO: 165837 - DNA, 15 bp, Homo sapiens
ggcagatattaaggc

SEQ ID NO: 165838 - DNA, 15 bp, Homo sapiens
gggcagatattaagg

SEQ ID NO: 165839 - DNA, 15 bp, Homo sapiens
ggggcagatattaag

SEQ ID NO: 165840 - DNA, 15 bp, Homo sapiens
gggggcagatattaa

SEQ ID NO: 165841 - DNA, 15 bp, Homo sapiens
tgggggcagatatta

SEQ ID NO: 165842 - DNA, 15 bp, Homo sapiens
atgggggcagatatt

SEQ ID NO: 165843 - DNA, 15 bp, Homo sapiens
aatgggggcagatat

SEQ ID NO: 165844 - DNA, 15 bp, Homo sapiens
aaatgggggcagata

SEQ ID NO: 165845 - DNA, 15 bp, Homo sapiens
aaaatgggggcagat

SEQ ID NO: 165846 - DNA, 15 bp, Homo sapiens
caaaatgggggcaga

SEQ ID NO: 165847 - DNA, 15 bp, Homo sapiens
tcaaaatgggggcag

SEQ ID NO: 165848 - DNA, 15 bp, Homo sapiens
ttcaaaatgggggca

SEQ ID NO: 165849 - DNA, 15 bp, Homo sapiens
tttcaaaatgggggc

SEQ ID NO: 165850 - DNA, 15 bp, Homo sapiens
ctttcaaaatggggg

SEQ ID NO: 165851 - DNA, 15 bp, Homo sapiens
actttcaaaatgggg

SEQ ID NO: 165852 - DNA, 15 bp, Homo sapiens
cactttcaaaatggg

SEQ ID NO: 165853 - DNA, 15 bp, Homo sapiens
tcactttcaaaatgg

SEQ ID NO: 165854 - DNA, 15 bp, Homo sapiens
ttcactttcaaaatg

SEQ ID NO: 165855 - DNA, 15 bp, Homo sapiens
tttcactttcaaaat

SEQ ID NO: 165856 - DNA, 15 bp, Homo sapiens
atttcactttcaaaa

SEQ ID NO: 165857 - DNA, 15 bp, Homo sapiens
aatttcactttcaaa

SEQ ID NO: 165858 - DNA, 15 bp, Homo sapiens
aaatttcactttcaa

SEQ ID NO: 165859 - DNA, 15 bp, Homo sapiens
aaaatttcactttca

SEQ ID NO: 165860 - DNA, 15 bp, Homo sapiens
caaaatttcactttc

SEQ ID NO: 165861 - DNA, 15 bp, Homo sapiens
gcaaaatttcacttt

SEQ ID NO: 165862 - DNA, 15 bp, Homo sapiens
cgcaaaatttcactt

SEQ ID NO: 165863 - DNA, 15 bp, Homo sapiens
ccgcaaaatttcact

SEQ ID NO: 165864 - DNA, 15 bp, Homo sapiens
tccgcaaaatttcac

SEQ ID NO: 165865 - DNA, 15 bp, Homo sapiens
atccgcaaaatttca

SEQ ID NO: 165866 - DNA, 15 bp, Homo sapiens
tatccgcaaaatttc

SEQ ID NO: 165867 - DNA, 15 bp, Homo sapiens
ttatccgcaaaattt

SEQ ID NO: 165868 - DNA, 15 bp, Homo sapiens
attatccgcaaaatt

SEQ ID NO: 165869 - DNA, 15 bp, Homo sapiens
cattatccgcaaaat

SEQ ID NO: 165870 - DNA, 15 bp, Homo sapiens
acattatccgcaaaa

SEQ ID NO: 165871 - DNA, 15 bp, Homo sapiens
aacattatccgcaaa

SEQ ID NO: 165872 - DNA, 15 bp, Homo sapiens
aaacattatccgcaa

SEQ ID NO: 165873 - DNA, 15 bp, Homo sapiens
gaaacattatccgca

SEQ ID NO: 165874 - DNA, 15 bp, Homo sapiens
agaaacattatccgc

SEQ ID NO: 165875 - DNA, 15 bp, Homo sapiens
tagaaacattatccg

SEQ ID NO: 165876 - DNA, 15 bp, Homo sapiens
atagaaacattatcc

SEQ ID NO: 165877 - DNA, 15 bp, Homo sapiens
aatagaaacattatc

SEQ ID NO: 165878 - DNA, 15 bp, Homo sapiens
caatagaaacattat

SEQ ID NO: 165879 - DNA, 15 bp, Homo sapiens
gcaatagaaacatta

SEQ ID NO: 165880 - DNA, 15 bp, Homo sapiens
tgcaatagaaacatt

SEQ ID NO: 165881 - DNA, 15 bp, Homo sapiens
ctgcaatagaaacat

SEQ ID NO: 165882 - DNA, 15 bp, Homo sapiens
actgcaatagaaaca

SEQ ID NO: 165883 - DNA, 15 bp, Homo sapiens
aactgcaatagaaac

SEQ ID NO: 165884 - DNA, 15 bp, Homo sapiens
caactgcaatagaaa

SEQ ID NO: 165885 - DNA, 15 bp, Homo sapiens
tcaactgcaatagaa

SEQ ID NO: 165886 - DNA, 15 bp, Homo sapiens
ctcaactgcaataga

SEQ ID NO: 165887 - DNA, 15 bp, Homo sapiens
actcaactgcaatag

SEQ ID NO: 165888 - DNA, 15 bp, Homo sapiens
aactcaactgcaata

SEQ ID NO: 165889 - DNA, 15 bp, Homo sapiens
taactcaactgcaat

SEQ ID NO: 165890 - DNA, 15 bp, Homo sapiens
ctaactcaactgcaa

SEQ ID NO: 165891 - DNA, 15 bp, Homo sapiens
tctaactcaactgca

SEQ ID NO: 165892 - DNA, 15 bp, Homo sapiens
ttctaactcaactgc

SEQ ID NO: 165893 - DNA, 15 bp, Homo sapiens
tttctaactcaactg

SEQ ID NO: 165894 - DNA, 15 bp, Homo sapiens
atttctaactcaact

SEQ ID NO: 165895 - DNA, 15 bp, Homo sapiens
tatttctaactcaac

SEQ ID NO: 165896 - DNA, 15 bp, Homo sapiens
ttatttctaactcaa

SEQ ID NO: 165897 - DNA, 15 bp, Homo sapiens
cttatttctaactca

SEQ ID NO: 165898 - DNA, 15 bp, Homo sapiens
ccttatttctaactc

SEQ ID NO: 165899 - DNA, 15 bp, Homo sapiens
tccttatttctaact

SEQ ID NO: 165900 - DNA, 15 bp, Homo sapiens
ttccttatttctaac

SEQ ID NO: 165901 - DNA, 15 bp, Homo sapiens
cttccttatttctaa

SEQ ID NO: 165902 - DNA, 15 bp, Homo sapiens
gcttccttatttcta

SEQ ID NO: 165903 - DNA, 15 bp, Homo sapiens
tgcttccttatttct

SEQ ID NO: 165904 - DNA, 15 bp, Homo sapiens
atgcttccttatttc

SEQ ID NO: 165905 - DNA, 15 bp, Homo sapiens
aatgcttccttattt

SEQ ID NO: 165906 - DNA, 15 bp, Homo sapiens
aaatgcttccttatt

SEQ ID NO: 165907 - DNA, 15 bp, Homo sapiens
aaaatgcttccttat

SEQ ID NO: 165908 - DNA, 15 bp, Homo sapiens
taaaatgcttcctta

SEQ ID NO: 165909 - DNA, 15 bp, Homo sapiens
ttaaaatgcttcctt

SEQ ID NO: 165910 - DNA, 15 bp, Homo sapiens
tttaaaatgcttcct

SEQ ID NO: 165911 - DNA, 15 bp, Homo sapiens
ttttaaaatgcttcc

SEQ ID NO: 165912 - DNA, 15 bp, Homo sapiens
gttttaaaatgcttc

SEQ ID NO: 165913 - DNA, 15 bp, Homo sapiens
ggttttaaaatgctt

SEQ ID NO: 165914 - DNA, 15 bp, Homo sapiens
tggttttaaaatgct

SEQ ID NO: 165915 - DNA, 15 bp, Homo sapiens
ctggttttaaaatgc

SEQ ID NO: 165916 - DNA, 15 bp, Homo sapiens
cctggttttaaaatg

SEQ ID NO: 165917 - DNA, 15 bp, Homo sapiens
acctggttttaaaat

SEQ ID NO: 165918 - DNA, 15 bp, Homo sapiens
cacctggttttaaaa

SEQ ID NO: 165919 - DNA, 15 bp, Homo sapiens
ccacctggttttaaa

SEQ ID NO: 165920 - DNA, 15 bp, Homo sapiens
tccacctggttttaa

SEQ ID NO: 165921 - DNA, 15 bp, Homo sapiens
atccacctggtttta

SEQ ID NO: 165922 - DNA, 15 bp, Homo sapiens
catccacctggtttt

SEQ ID NO: 165923 - DNA, 15 bp, Homo sapiens
tcatccacctggttt

SEQ ID NO: 165924 - DNA, 15 bp, Homo sapiens
atcatccacctggtt

SEQ ID NO: 165925 - DNA, 15 bp, Homo sapiens
aatcatccacctggt

SEQ ID NO: 165926 - DNA, 15 bp, Homo sapiens
gaatcatccacctgg

SEQ ID NO: 165927 - DNA, 15 bp, Homo sapiens
tgaatcatccacctg

SEQ ID NO: 165928 - DNA, 15 bp, Homo sapiens
ttgaatcatccacct

SEQ ID NO: 165929 - DNA, 15 bp, Homo sapiens
gttgaatcatccacc

SEQ ID NO: 165930 - DNA, 15 bp, Homo sapiens
tgttgaatcatccac

SEQ ID NO: 165931 - DNA, 15 bp, Homo sapiens
gtgttgaatcatcca

SEQ ID NO: 165932 - DNA, 15 bp, Homo sapiens
agtgttgaatcatcc

SEQ ID NO: 165933 - DNA, 15 bp, Homo sapiens
tagtgttgaatcatc

SEQ ID NO: 165934 - DNA, 15 bp, Homo sapiens
ctagtgttgaatcat

SEQ ID NO: 165935 - DNA, 15 bp, Homo sapiens
tctagtgttgaatca

SEQ ID NO: 165936 - DNA, 15 bp, Homo sapiens
gtctagtgttgaatc

SEQ ID NO: 165937 - DNA, 15 bp, Homo sapiens
ggtctagtgttgaat

SEQ ID NO: 165938 - DNA, 15 bp, Homo sapiens
tggtctagtgttgaa

SEQ ID NO: 165939 - DNA, 15 bp, Homo sapiens
gtggtctagtgttga

SEQ ID NO: 165940 - DNA, 15 bp, Homo sapiens
ggtggtctagtgttg

SEQ ID NO: 165941 - DNA, 15 bp, Homo sapiens
gggtggtctagtgtt

SEQ ID NO: 165942 - DNA, 15 bp, Homo sapiens
tgggtggtctagtgt

SEQ ID NO: 165943 - DNA, 15 bp, Homo sapiens
ctgggtggtctagtg

SEQ ID NO: 165944 - DNA, 15 bp, Homo sapiens
cctgggtggtctagt

SEQ ID NO: 165945 - DNA, 15 bp, Homo sapiens
tcctgggtggtctag

SEQ ID NO: 165946 - DNA, 15 bp, Homo sapiens
ttcctgggtggtcta

SEQ ID NO: 165947 - DNA, 15 bp, Homo sapiens
cttcctgggtggtct

SEQ ID NO: 165948 - DNA, 15 bp, Homo sapiens
ccttcctgggtggtc

SEQ ID NO: 165949 - DNA, 15 bp, Homo sapiens
cccttcctgggtggt

SEQ ID NO: 165950 - DNA, 15 bp, Homo sapiens
gcccttcctgggtgg

SEQ ID NO: 165951 - DNA, 15 bp, Homo sapiens
tgcccttcctgggtg

SEQ ID NO: 165952 - DNA, 15 bp, Homo sapiens
atgcccttcctgggt

SEQ ID NO: 165953 - DNA, 15 bp, Homo sapiens
aatgcccttcctggg

SEQ ID NO: 165954 - DNA, 15 bp, Homo sapiens
gaatgcccttcctgg

SEQ ID NO: 165955 - DNA, 15 bp, Homo sapiens
ggaatgcccttcctg

SEQ ID NO: 165956 - DNA, 15 bp, Homo sapiens
aggaatgcccttcct

SEQ ID NO: 165957 - DNA, 15 bp, Homo sapiens
aaggaatgcccttcc

SEQ ID NO: 165958 - DNA, 15 bp, Homo sapiens
gaaggaatgcccttc

SEQ ID NO: 165959 - DNA, 15 bp, Homo sapiens
agaaggaatgccctt

SEQ ID NO: 165960 - DNA, 15 bp, Homo sapiens
cagaaggaatgccct

SEQ ID NO: 165961 - DNA, 15 bp, Homo sapiens
acagaaggaatgccc

SEQ ID NO: 165962 - DNA, 15 bp, Homo sapiens
tacagaaggaatgcc

SEQ ID NO: 165963 - DNA, 15 bp, Homo sapiens
ttacagaaggaatgc

SEQ ID NO: 165964 - DNA, 15 bp, Homo sapiens
attacagaaggaatg

SEQ ID NO: 165965 - DNA, 15 bp, Homo sapiens
tattacagaaggaat

SEQ ID NO: 165966 - DNA, 15 bp, Homo sapiens
ctattacagaaggaa

SEQ ID NO: 165967 - DNA, 15 bp, Homo sapiens
cctattacagaagga

SEQ ID NO: 165968 - DNA, 15 bp, Homo sapiens
tcctattacagaagg

SEQ ID NO: 165969 - DNA, 15 bp, Homo sapiens
ttcctattacagaag

SEQ ID NO: 165970 - DNA, 15 bp, Homo sapiens
tttcctattacagaa

SEQ ID NO: 165971 - DNA, 15 bp, Homo sapiens
ctttcctattacaga

SEQ ID NO: 165972 - DNA, 15 bp, Homo sapiens
cctttcctattacag

SEQ ID NO: 165973 - DNA, 15 bp, Homo sapiens
acctttcctattaca

SEQ ID NO: 165974 - DNA, 15 bp, Homo sapiens
gacctttcctattac

SEQ ID NO: 165975 - DNA, 15 bp, Homo sapiens
agacctttcctatta

SEQ ID NO: 165976 - DNA, 15 bp, Homo sapiens
aagacctttcctatt

SEQ ID NO: 165977 - DNA, 15 bp, Homo sapiens
aaagacctttcctat

SEQ ID NO: 165978 - DNA, 15 bp, Homo sapiens
taaagacctttccta

SEQ ID NO: 165979 - DNA, 15 bp, Homo sapiens
ttaaagacctttcct

SEQ ID NO: 165980 - DNA, 15 bp, Homo sapiens
tttaaagacctttcc

SEQ ID NO: 165981 - DNA, 15 bp, Homo sapiens
gtttaaagacctttc

SEQ ID NO: 165982 - DNA, 15 bp, Homo sapiens
ggtttaaagaccttt

SEQ ID NO: 165983 - DNA, 15 bp, Homo sapiens
aggtttaaagacctt

SEQ ID NO: 165984 - DNA, 15 bp, Homo sapiens
caggtttaaagacct

SEQ ID NO: 165985 - DNA, 15 bp, Homo sapiens
ccaggtttaaagacc

SEQ ID NO: 165986 - DNA, 15 bp, Homo sapiens
tccaggtttaaagac

SEQ ID NO: 165987 - DNA, 15 bp, Homo sapiens
ctccaggtttaaaga

SEQ ID NO: 165988 - DNA, 15 bp, Homo sapiens
actccaggtttaaag

SEQ ID NO: 165989 - DNA, 15 bp, Homo sapiens
tactccaggtttaaa

SEQ ID NO: 165990 - DNA, 15 bp, Homo sapiens
gtactccaggtttaa

SEQ ID NO: 165991 - DNA, 15 bp, Homo sapiens
ggtactccaggttta

SEQ ID NO: 165992 - DNA, 15 bp, Homo sapiens
tggtactccaggttt

SEQ ID NO: 165993 - DNA, 15 bp, Homo sapiens
gtggtactccaggtt

SEQ ID NO: 165994 - DNA, 15 bp, Homo sapiens
tgtggtactccaggt

SEQ ID NO: 165995 - DNA, 15 bp, Homo sapiens
atgtggtactccagg

SEQ ID NO: 165996 - DNA, 15 bp, Homo sapiens
gatgtggtactccag

SEQ ID NO: 165997 - DNA, 15 bp, Homo sapiens
tgatgtggtactcca

SEQ ID NO: 165998 - DNA, 15 bp, Homo sapiens
gtgatgtggtactcc

SEQ ID NO: 165999 - DNA, 15 bp, Homo sapiens
tgtgatgtggtactc

SEQ ID NO: 166000 - DNA, 15 bp, Homo sapiens
atgtgatgtggtact

SEQ ID NO: 166001 - DNA, 15 bp, Homo sapiens
catgtgatgtggtac

SEQ ID NO: 166002 - DNA, 15 bp, Homo sapiens
acatgtgatgtggta

SEQ ID NO: 166003 - DNA, 15 bp, Homo sapiens
tacatgtgatgtggt

SEQ ID NO: 166004 - DNA, 15 bp, Homo sapiens
ttacatgtgatgtgg

SEQ ID NO: 166005 - DNA, 15 bp, Homo sapiens
attacatgtgatgtg

SEQ ID NO: 166006 - DNA, 15 bp, Homo sapiens
cattacatgtgatgt

SEQ ID NO: 166007 - DNA, 15 bp, Homo sapiens
acattacatgtgatg

SEQ ID NO: 166008 - DNA, 15 bp, Homo sapiens
cacattacatgtgat

SEQ ID NO: 166009 - DNA, 15 bp, Homo sapiens
acacattacatgtga

SEQ ID NO: 166010 - DNA, 15 bp, Homo sapiens
tacacattacatgtg

SEQ ID NO: 166011 - DNA, 15 bp, Homo sapiens
ttacacattacatgt

SEQ ID NO: 166012 - DNA, 15 bp, Homo sapiens
cttacacattacatg

SEQ ID NO: 166013 - DNA, 15 bp, Homo sapiens
acttacacattacat

SEQ ID NO: 166014 - DNA, 15 bp, Homo sapiens
cacttacacattaca

SEQ ID NO: 166015 - DNA, 15 bp, Homo sapiens
acacttacacattac

SEQ ID NO: 166016 - DNA, 15 bp, Homo sapiens
cacacttacacatta

SEQ ID NO: 166017 - DNA, 15 bp, Homo sapiens
ccacacttacacatt

SEQ ID NO: 166018 - DNA, 15 bp, Homo sapiens
tccacacttacacat

SEQ ID NO: 166019 - DNA, 15 bp, Homo sapiens
atccacacttacaca

SEQ ID NO: 166020 - DNA, 15 bp, Homo sapiens
tatccacacttacac

SEQ ID NO: 166021 - DNA, 15 bp, Homo sapiens
atatccacacttaca

SEQ ID NO: 166022 - DNA, 15 bp, Homo sapiens
aatatccacacttac

SEQ ID NO: 166023 - DNA, 15 bp, Homo sapiens
aaatatccacactta

SEQ ID NO: 166024 - DNA, 15 bp, Homo sapiens
gaaatatccacactt

SEQ ID NO: 166025 - DNA, 15 bp, Homo sapiens
agaaatatccacact

SEQ ID NO: 166026 - DNA, 15 bp, Homo sapiens
cagaaatatccacac

SEQ ID NO: 166027 - DNA, 15 bp, Homo sapiens
ccagaaatatccaca

SEQ ID NO: 166028 - DNA, 15 bp, Homo sapiens
tccagaaatatccac

SEQ ID NO: 166029 - DNA, 15 bp, Homo sapiens
ctccagaaatatcca

SEQ ID NO: 166030 - DNA, 15 bp, Homo sapiens
gctccagaaatatcc

SEQ ID NO: 166031 - DNA, 15 bp, Homo sapiens
agctccagaaatatc

SEQ ID NO: 166032 - DNA, 15 bp, Homo sapiens
gagctccagaaatat

SEQ ID NO: 166033 - DNA, 15 bp, Homo sapiens
agagctccagaaata

SEQ ID NO: 166034 - DNA, 15 bp, Homo sapiens
gagagctccagaaat

SEQ ID NO: 166035 - DNA, 15 bp, Homo sapiens
ggagagctccagaaa

SEQ ID NO: 166036 - DNA, 15 bp, Homo sapiens
gggagagctccagaa

SEQ ID NO: 166037 - DNA, 15 bp, Homo sapiens
tgggagagctccaga

SEQ ID NO: 166038 - DNA, 15 bp, Homo sapiens
ctgggagagctccag

SEQ ID NO: 166039 - DNA, 15 bp, Homo sapiens
tctgggagagctcca

SEQ ID NO: 166040 - DNA, 15 bp, Homo sapiens
atctgggagagctcc

SEQ ID NO: 166041 - DNA, 15 bp, Homo sapiens
tatctgggagagctc

SEQ ID NO: 166042 - DNA, 15 bp, Homo sapiens
atatctgggagagct

SEQ ID NO: 166043 - DNA, 15 bp, Homo sapiens
gatatctgggagagc

SEQ ID NO: 166044 - DNA, 15 bp, Homo sapiens
ggatatctgggagag

SEQ ID NO: 166045 - DNA, 15 bp, Homo sapiens
tggatatctgggaga

SEQ ID NO: 166046 - DNA, 15 bp, Homo sapiens
ctggatatctgggag

SEQ ID NO: 166047 - DNA, 15 bp, Homo sapiens
actggatatctggga

SEQ ID NO: 166048 - DNA, 15 bp, Homo sapiens
cactggatatctggg

SEQ ID NO: 166049 - DNA, 15 bp, Homo sapiens
acactggatatctgg

SEQ ID NO: 166050 - DNA, 15 bp, Homo sapiens
cacactggatatctg

SEQ ID NO: 166051 - DNA, 15 bp, Homo sapiens
acacactggatatct

SEQ ID NO: 166052 - DNA, 15 bp, Homo sapiens
gacacactggatatc

SEQ ID NO: 166053 - DNA, 15 bp, Homo sapiens
agacacactggatat

SEQ ID NO: 166054 - DNA, 15 bp, Homo sapiens
cagacacactggata

SEQ ID NO: 166055 - DNA, 15 bp, Homo sapiens
gcagacacactggat

SEQ ID NO: 166056 - DNA, 15 bp, Homo sapiens
tgcagacacactgga

SEQ ID NO: 166057 - DNA, 15 bp, Homo sapiens
atgcagacacactgg

SEQ ID NO: 166058 - DNA, 15 bp, Homo sapiens
catgcagacacactg

SEQ ID NO: 166059 - DNA, 15 bp, Homo sapiens
tcatgcagacacact

SEQ ID NO: 166060 - DNA, 15 bp, Homo sapiens
ttcatgcagacacac

SEQ ID NO: 166061 - DNA, 15 bp, Homo sapiens
attcatgcagacaca

SEQ ID NO: 166062 - DNA, 15 bp, Homo sapiens
cattcatgcagacac

SEQ ID NO: 166063 - DNA, 15 bp, Homo sapiens
acattcatgcagaca

SEQ ID NO: 166064 - DNA, 15 bp, Homo sapiens
cacattcatgcagac

SEQ ID NO: 166065 - DNA, 15 bp, Homo sapiens
acacattcatgcaga

SEQ ID NO: 166066 - DNA, 15 bp, Homo sapiens
gacacattcatgcag

SEQ ID NO: 166067 - DNA, 15 bp, Homo sapiens
agacacattcatgca

SEQ ID NO: 166068 - DNA, 15 bp, Homo sapiens
gagacacattcatgc

SEQ ID NO: 166069 - DNA, 15 bp, Homo sapiens
agagacacattcatg

SEQ ID NO: 166070 - DNA, 15 bp, Homo sapiens
gagagacacattcat

SEQ ID NO: 166071 - DNA, 15 bp, Homo sapiens
agagagacacattca

SEQ ID NO: 166072 - DNA, 15 bp, Homo sapiens
aagagagacacattc

SEQ ID NO: 166073 - DNA, 15 bp, Homo sapiens
aaagagagacacatt

SEQ ID NO: 166074 - DNA, 15 bp, Homo sapiens
taaagagagacacat

SEQ ID NO: 166075 - DNA, 15 bp, Homo sapiens
ataaagagagacaca

SEQ ID NO: 166076 - DNA, 15 bp, Homo sapiens
gataaagagagacac

SEQ ID NO: 166077 - DNA, 15 bp, Homo sapiens
agataaagagagaca

SEQ ID NO: 166078 - DNA, 15 bp, Homo sapiens
aagataaagagagac

SEQ ID NO: 166079 - DNA, 15 bp, Homo sapiens
aaagataaagagaga

SEQ ID NO: 166080 - DNA, 15 bp, Homo sapiens
aaaagataaagagag

SEQ ID NO: 166081 - DNA, 15 bp, Homo sapiens
aaaaagataaagaga

SEQ ID NO: 166082 - DNA, 15 bp, Homo sapiens
aaaaaagataaagag

SEQ ID NO: 166083 - DNA, 15 bp, Homo sapiens
caaaaaagataaaga

SEQ ID NO: 166084 - DNA, 15 bp, Homo sapiens
acaaaaaagataaag

SEQ ID NO: 166085 - DNA, 15 bp, Homo sapiens
aacaaaaaagataaa

SEQ ID NO: 166086 - DNA, 15 bp, Homo sapiens
taacaaaaaagataa

SEQ ID NO: 166087 - DNA, 15 bp, Homo sapiens
ttaacaaaaaagata

SEQ ID NO: 166088 - DNA, 15 bp, Homo sapiens
cttaacaaaaaagat

SEQ ID NO: 166089 - DNA, 15 bp, Homo sapiens
ccttaacaaaaaaga

SEQ ID NO: 166090 - DNA, 15 bp, Homo sapiens
tccttaacaaaaaag

SEQ ID NO: 166091 - DNA, 15 bp, Homo sapiens
atccttaacaaaaaa

SEQ ID NO: 166092 - DNA, 15 bp, Homo sapiens
catccttaacaaaaa

SEQ ID NO: 166093 - DNA, 15 bp, Homo sapiens
gcatccttaacaaaa

SEQ ID NO: 166094 - DNA, 15 bp, Homo sapiens
tgcatccttaacaaa

SEQ ID NO: 166095 - DNA, 15 bp, Homo sapiens
ttgcatccttaacaa

SEQ ID NO: 166096 - DNA, 15 bp, Homo sapiens
tttgcatccttaaca

SEQ ID NO: 166097 - DNA, 15 bp, Homo sapiens
atttgcatccttaac

SEQ ID NO: 166098 - DNA, 15 bp, Homo sapiens
catttgcatccttaa

SEQ ID NO: 166099 - DNA, 15 bp, Homo sapiens
ccatttgcatcctta

SEQ ID NO: 166100 - DNA, 15 bp, Homo sapiens
tccatttgcatcctt

SEQ ID NO: 166101 - DNA, 15 bp, Homo sapiens
ctccatttgcatcct

SEQ ID NO: 166102 - DNA, 15 bp, Homo sapiens
tctccatttgcatcc

SEQ ID NO: 166103 - DNA, 15 bp, Homo sapiens
ctctccatttgcatc

SEQ ID NO: 166104 - DNA, 15 bp, Homo sapiens
actctccatttgcat

SEQ ID NO: 166105 - DNA, 15 bp, Homo sapiens
aactctccatttgca

SEQ ID NO: 166106 - DNA, 15 bp, Homo sapiens
taactctccatttgc

SEQ ID NO: 166107 - DNA, 15 bp, Homo sapiens
ataactctccatttg

SEQ ID NO: 166108 - DNA, 15 bp, Homo sapiens
tataactctccattt

SEQ ID NO: 166109 - DNA, 15 bp, Homo sapiens
atataactctccatt

SEQ ID NO: 166110 - DNA, 15 bp, Homo sapiens
tatataactctccat

SEQ ID NO: 166111 - DNA, 15 bp, Homo sapiens
atatataactctcca

SEQ ID NO: 166112 - DNA, 15 bp, Homo sapiens
aatatataactctcc

SEQ ID NO: 166113 - DNA, 15 bp, Homo sapiens
caatatataactctc

SEQ ID NO: 166114 - DNA, 15 bp, Homo sapiens
ccaatatataactct

SEQ ID NO: 166115 - DNA, 15 bp, Homo sapiens
tccaatatataactc

SEQ ID NO: 166116 - DNA, 15 bp, Homo sapiens
atccaatatataact

SEQ ID NO: 166117 - DNA, 15 bp, Homo sapiens
aatccaatatataac

SEQ ID NO: 166118 - DNA, 15 bp, Homo sapiens
gaatccaatatataa

SEQ ID NO: 166119 - DNA, 15 bp, Homo sapiens
ggaatccaatatata

SEQ ID NO: 166120 - DNA, 15 bp, Homo sapiens
aggaatccaatatat

SEQ ID NO: 166121 - DNA, 15 bp, Homo sapiens
gaggaatccaatata

SEQ ID NO: 166122 - DNA, 15 bp, Homo sapiens
agaggaatccaatat

SEQ ID NO: 166123 - DNA, 15 bp, Homo sapiens
aagaggaatccaata

SEQ ID NO: 166124 - DNA, 15 bp, Homo sapiens
caagaggaatccaat

SEQ ID NO: 166125 - DNA, 15 bp, Homo sapiens
gcaagaggaatccaa

SEQ ID NO: 166126 - DNA, 15 bp, Homo sapiens
tgcaagaggaatcca

SEQ ID NO: 166127 - DNA, 15 bp, Homo sapiens
atgcaagaggaatcc

SEQ ID NO: 166128 - DNA, 15 bp, Homo sapiens
gatgcaagaggaatc

SEQ ID NO: 166129 - DNA, 15 bp, Homo sapiens
tgatgcaagaggaat

SEQ ID NO: 166130 - DNA, 15 bp, Homo sapiens
gtgatgcaagaggaa

SEQ ID NO: 166131 - DNA, 15 bp, Homo sapiens
agtgatgcaagagga

SEQ ID NO: 166132 - DNA, 15 bp, Homo sapiens
aagtgatgcaagagg

SEQ ID NO: 166133 - DNA, 15 bp, Homo sapiens
aaagtgatgcaagag

SEQ ID NO: 166134 - DNA, 15 bp, Homo sapiens
taaagtgatgcaaga

SEQ ID NO: 166135 - DNA, 15 bp, Homo sapiens
ctaaagtgatgcaag

SEQ ID NO: 166136 - DNA, 15 bp, Homo sapiens
tctaaagtgatgcaa

SEQ ID NO: 166137 - DNA, 15 bp, Homo sapiens
atctaaagtgatgca

SEQ ID NO: 166138 - DNA, 15 bp, Homo sapiens
catctaaagtgatgc

SEQ ID NO: 166139 - DNA, 15 bp, Homo sapiens
gcatctaaagtgatg

SEQ ID NO: 166140 - DNA, 15 bp, Homo sapiens
ggcatctaaagtgat

SEQ ID NO: 166141 - DNA, 15 bp, Homo sapiens
aggcatctaaagtga

SEQ ID NO: 166142 - DNA, 15 bp, Homo sapiens
aaggcatctaaagtg

SEQ ID NO: 166143 - DNA, 15 bp, Homo sapiens
gaaggcatctaaagt

SEQ ID NO: 166144 - DNA, 15 bp, Homo sapiens
agaaggcatctaaag

SEQ ID NO: 166145 - DNA, 15 bp, Homo sapiens
cagaaggcatctaaa

SEQ ID NO: 166146 - DNA, 15 bp, Homo sapiens
acagaaggcatctaa

SEQ ID NO: 166147 - DNA, 15 bp, Homo sapiens
aacagaaggcatcta

SEQ ID NO: 166148 - DNA, 15 bp, Homo sapiens
aaacagaaggcatct

SEQ ID NO: 166149 - DNA, 15 bp, Homo sapiens
taaacagaaggcatc

SEQ ID NO: 166150 - DNA, 15 bp, Homo sapiens
ataaacagaaggcat

SEQ ID NO: 166151 - DNA, 15 bp, Homo sapiens
tataaacagaaggca

SEQ ID NO: 166152 - DNA, 15 bp, Homo sapiens
atataaacagaaggc

SEQ ID NO: 166153 - DNA, 15 bp, Homo sapiens
aatataaacagaagg

SEQ ID NO: 166154 - DNA, 15 bp, Homo sapiens
caatataaacagaag

SEQ ID NO: 166155 - DNA, 15 bp, Homo sapiens
tcaatataaacagaa

SEQ ID NO: 166156 - DNA, 15 bp, Homo sapiens
ctcaatataaacaga

SEQ ID NO: 166157 - DNA, 15 bp, Homo sapiens
gctcaatataaacag

SEQ ID NO: 166158 - DNA, 15 bp, Homo sapiens
ggctcaatataaaca

SEQ ID NO: 166159 - DNA, 15 bp, Homo sapiens
aggctcaatataaac

SEQ ID NO: 166160 - DNA, 15 bp, Homo sapiens
caggctcaatataaa

SEQ ID NO: 166161 - DNA, 15 bp, Homo sapiens
ccaggctcaatataa

SEQ ID NO: 166162 - DNA, 15 bp, Homo sapiens
gccaggctcaatata

SEQ ID NO: 166163 - DNA, 15 bp, Homo sapiens
agccaggctcaatat

SEQ ID NO: 166164 - DNA, 15 bp, Homo sapiens
aagccaggctcaata

SEQ ID NO: 166165 - DNA, 15 bp, Homo sapiens
taagccaggctcaat

SEQ ID NO: 166166 - DNA, 15 bp, Homo sapiens
ataagccaggctcaa

SEQ ID NO: 166167 - DNA, 15 bp, Homo sapiens
aataagccaggctca

SEQ ID NO: 166168 - DNA, 15 bp, Homo sapiens
aaataagccaggctc

SEQ ID NO: 166169 - DNA, 15 bp, Homo sapiens
caaataagccaggct

SEQ ID NO: 166170 - DNA, 15 bp, Homo sapiens
ccaaataagccaggc

SEQ ID NO: 166171 - DNA, 15 bp, Homo sapiens
tccaaataagccagg

SEQ ID NO: 166172 - DNA, 15 bp, Homo sapiens
ctccaaataagccag

SEQ ID NO: 166173 - DNA, 15 bp, Homo sapiens
actccaaataagcca

SEQ ID NO: 166174 - DNA, 15 bp, Homo sapiens
aactccaaataagcc

SEQ ID NO: 166175 - DNA, 15 bp, Homo sapiens
taactccaaataagc

SEQ ID NO: 166176 - DNA, 15 bp, Homo sapiens
ctaactccaaataag

SEQ ID NO: 166177 - DNA, 15 bp, Homo sapiens
gctaactccaaataa

SEQ ID NO: 166178 - DNA, 15 bp, Homo sapiens
agctaactccaaata

SEQ ID NO: 166179 - DNA, 15 bp, Homo sapiens
aagctaactccaaat

SEQ ID NO: 166180 - DNA, 15 bp, Homo sapiens
caagctaactccaaa

SEQ ID NO: 166181 - DNA, 15 bp, Homo sapiens
acaagctaactccaa

SEQ ID NO: 166182 - DNA, 15 bp, Homo sapiens
tacaagctaactcca

SEQ ID NO: 166183 - DNA, 15 bp, Homo sapiens
ttacaagctaactcc

SEQ ID NO: 166184 - DNA, 15 bp, Homo sapiens
tttacaagctaactc

SEQ ID NO: 166185 - DNA, 15 bp, Homo sapiens
atttacaagctaact

SEQ ID NO: 166186 - DNA, 15 bp, Homo sapiens
aatttacaagctaac

SEQ ID NO: 166187 - DNA, 15 bp, Homo sapiens
aaatttacaagctaa

SEQ ID NO: 166188 - DNA, 15 bp, Homo sapiens
taaatttacaagcta

SEQ ID NO: 166189 - DNA, 15 bp, Homo sapiens
ttaaatttacaagct

SEQ ID NO: 166190 - DNA, 15 bp, Homo sapiens
attaaatttacaagc

SEQ ID NO: 166191 - DNA, 15 bp, Homo sapiens
cattaaatttacaag

SEQ ID NO: 166192 - DNA, 15 bp, Homo sapiens
tcattaaatttacaa

SEQ ID NO: 166193 - DNA, 15 bp, Homo sapiens
ctcattaaatttaca

SEQ ID NO: 166194 - DNA, 15 bp, Homo sapiens
tctcattaaatttac

SEQ ID NO: 166195 - DNA, 15 bp, Homo sapiens
atctcattaaattta

SEQ ID NO: 166196 - DNA, 15 bp, Homo sapiens
gatctcattaaattt

SEQ ID NO: 166197 - DNA, 15 bp, Homo sapiens
tgatctcattaaatt

SEQ ID NO: 166198 - DNA, 15 bp, Homo sapiens
atgatctcattaaat

SEQ ID NO: 166199 - DNA, 15 bp, Homo sapiens
aatgatctcattaaa

SEQ ID NO: 166200 - DNA, 15 bp, Homo sapiens
caatgatctcattaa

SEQ ID NO: 166201 - DNA, 15 bp, Homo sapiens
acaatgatctcatta

SEQ ID NO: 166202 - DNA, 15 bp, Homo sapiens
cacaatgatctcatt

SEQ ID NO: 166203 - DNA, 15 bp, Homo sapiens
tcacaatgatctcat

SEQ ID NO: 166204 - DNA, 15 bp, Homo sapiens
atcacaatgatctca

SEQ ID NO: 166205 - DNA, 15 bp, Homo sapiens
catcacaatgatctc

SEQ ID NO: 166206 - DNA, 15 bp, Homo sapiens
ccatcacaatgatct

SEQ ID NO: 166207 - DNA, 15 bp, Homo sapiens
gccatcacaatgatc

SEQ ID NO: 166208 - DNA, 15 bp, Homo sapiens
ggccatcacaatgat

SEQ ID NO: 166209 - DNA, 15 bp, Homo sapiens
tggccatcacaatga

SEQ ID NO: 166210 - DNA, 15 bp, Homo sapiens
atggccatcacaatg

SEQ ID NO: 166211 - DNA, 15 bp, Homo sapiens
catggccatcacaat

SEQ ID NO: 166212 - DNA, 15 bp, Homo sapiens
tcatggccatcacaa

SEQ ID NO: 166213 - DNA, 15 bp, Homo sapiens
atcatggccatcaca

SEQ ID NO: 166214 - DNA, 15 bp, Homo sapiens
aatcatggccatcac

SEQ ID NO: 166215 - DNA, 15 bp, Homo sapiens
caatcatggccatca

SEQ ID NO: 166216 - DNA, 15 bp, Homo sapiens
gcaatcatggccatc

SEQ ID NO: 166217 - DNA, 15 bp, Homo sapiens
tgcaatcatggccat

SEQ ID NO: 166218 - DNA, 15 bp, Homo sapiens
ctgcaatcatggcca

SEQ ID NO: 166219 - DNA, 15 bp, Homo sapiens
tctgcaatcatggcc

SEQ ID NO: 166220 - DNA, 15 bp, Homo sapiens
ttctgcaatcatggc

SEQ ID NO: 166221 - DNA, 15 bp, Homo sapiens
attctgcaatcatgg

SEQ ID NO: 166222 - DNA, 15 bp, Homo sapiens
cattctgcaatcatg

SEQ ID NO: 166223 - DNA, 15 bp, Homo sapiens
ccattctgcaatcat

SEQ ID NO: 166224 - DNA, 15 bp, Homo sapiens
tccattctgcaatca

SEQ ID NO: 166225 - DNA, 15 bp, Homo sapiens
ttccattctgcaatc

SEQ ID NO: 166226 - DNA, 15 bp, Homo sapiens
tttccattctgcaat

SEQ ID NO: 166227 - DNA, 15 bp, Homo sapiens
ttttccattctgcaa

SEQ ID NO: 166228 - DNA, 15 bp, Homo sapiens
attttccattctgca

SEQ ID NO: 166229 - DNA, 15 bp, Homo sapiens
cattttccattctgc

SEQ ID NO: 166230 - DNA, 15 bp, Homo sapiens
acattttccattctg

SEQ ID NO: 166231 - DNA, 15 bp, Homo sapiens
gacattttccattct

SEQ ID NO: 166232 - DNA, 15 bp, Homo sapiens
tgacattttccattc

SEQ ID NO: 166233 - DNA, 15 bp, Homo sapiens
gtgacattttccatt

SEQ ID NO: 166234 - DNA, 15 bp, Homo sapiens
agtgacattttccat

SEQ ID NO: 166235 - DNA, 15 bp, Homo sapiens
tagtgacattttcca

SEQ ID NO: 166236 - DNA, 15 bp, Homo sapiens
gtagtgacattttcc

SEQ ID NO: 166237 - DNA, 15 bp, Homo sapiens
agtagtgacattttc

SEQ ID NO: 166238 - DNA, 15 bp, Homo sapiens
tagtagtgacatttt

SEQ ID NO: 166239 - DNA, 15 bp, Homo sapiens
atagtagtgacattt

SEQ ID NO: 166240 - DNA, 15 bp, Homo sapiens
catagtagtgacatt

SEQ ID NO: 166241 - DNA, 15 bp, Homo sapiens
acatagtagtgacat

SEQ ID NO: 166242 - DNA, 15 bp, Homo sapiens
cacatagtagtgaca

SEQ ID NO: 166243 - DNA, 15 bp, Homo sapiens
gcacatagtagtgac

SEQ ID NO: 166244 - DNA, 15 bp, Homo sapiens
ggcacatagtagtga

SEQ ID NO: 166245 - DNA, 15 bp, Homo sapiens
tggcacatagtagtg

SEQ ID NO: 166246 - DNA, 15 bp, Homo sapiens
ctggcacatagtagt

SEQ ID NO: 166247 - DNA, 15 bp, Homo sapiens
actggcacatagtag

SEQ ID NO: 166248 - DNA, 15 bp, Homo sapiens
aactggcacatagta

SEQ ID NO: 166249 - DNA, 15 bp, Homo sapiens
aaactggcacatagt

SEQ ID NO: 166250 - DNA, 15 bp, Homo sapiens
caaactggcacatag

SEQ ID NO: 166251 - DNA, 15 bp, Homo sapiens
gcaaactggcacata

SEQ ID NO: 166252 - DNA, 15 bp, Homo sapiens
agcaaactggcacat

SEQ ID NO: 166253 - DNA, 15 bp, Homo sapiens
aagcaaactggcaca

SEQ ID NO: 166254 - DNA, 15 bp, Homo sapiens
taagcaaactggcac

SEQ ID NO: 166255 - DNA, 15 bp, Homo sapiens
ttaagcaaactggca

SEQ ID NO: 166256 - DNA, 15 bp, Homo sapiens
tttaagcaaactggc

SEQ ID NO: 166257 - DNA, 15 bp, Homo sapiens
atttaagcaaactgg

SEQ ID NO: 166258 - DNA, 15 bp, Homo sapiens
gatttaagcaaactg

SEQ ID NO: 166259 - DNA, 15 bp, Homo sapiens
tgatttaagcaaact

SEQ ID NO: 166260 - DNA, 15 bp, Homo sapiens
atgatttaagcaaac

SEQ ID NO: 166261 - DNA, 15 bp, Homo sapiens
aatgatttaagcaaa

SEQ ID NO: 166262 - DNA, 15 bp, Homo sapiens
aaatgatttaagcaa

SEQ ID NO: 166263 - DNA, 15 bp, Homo sapiens
aaaatgatttaagca

SEQ ID NO: 166264 - DNA, 15 bp, Homo sapiens
aaaaatgatttaagc

SEQ ID NO: 166265 - DNA, 15 bp, Homo sapiens
taaaaatgatttaag

SEQ ID NO: 166266 - DNA, 15 bp, Homo sapiens
ttaaaaatgatttaa

SEQ ID NO: 166267 - DNA, 15 bp, Homo sapiens
cttaaaaatgattta

SEQ ID NO: 166268 - DNA, 15 bp, Homo sapiens
acttaaaaatgattt

SEQ ID NO: 166269 - DNA, 15 bp, Homo sapiens
tacttaaaaatgatt

SEQ ID NO: 166270 - DNA, 15 bp, Homo sapiens
gtacttaaaaatgat

SEQ ID NO: 166271 - DNA, 15 bp, Homo sapiens
ggtacttaaaaatga

SEQ ID NO: 166272 - DNA, 15 bp, Homo sapiens
gggtacttaaaaatg

SEQ ID NO: 166273 - DNA, 15 bp, Homo sapiens
tgggtacttaaaaat

SEQ ID NO: 166274 - DNA, 15 bp, Homo sapiens
gtgggtacttaaaaa

SEQ ID NO: 166275 - DNA, 15 bp, Homo sapiens
ggtgggtacttaaaa

SEQ ID NO: 166276 - DNA, 15 bp, Homo sapiens
aggtgggtacttaaa

SEQ ID NO: 166277 - DNA, 15 bp, Homo sapiens
caggtgggtacttaa

SEQ ID NO: 166278 - DNA, 15 bp, Homo sapiens
acaggtgggtactta

SEQ ID NO: 166279 - DNA, 15 bp, Homo sapiens
cacaggtgggtactt

SEQ ID NO: 166280 - DNA, 15 bp, Homo sapiens
gcacaggtgggtact

SEQ ID NO: 166281 - DNA, 15 bp, Homo sapiens
agcacaggtgggtac

SEQ ID NO: 166282 - DNA, 15 bp, Homo sapiens
cagcacaggtgggta

SEQ ID NO: 166283 - DNA, 15 bp, Homo sapiens
gcagcacaggtgggt

SEQ ID NO: 166284 - DNA, 15 bp, Homo sapiens
agcagcacaggtggg

SEQ ID NO: 166285 - DNA, 15 bp, Homo sapiens
tagcagcacaggtgg

SEQ ID NO: 166286 - DNA, 15 bp, Homo sapiens
ttagcagcacaggtg

SEQ ID NO: 166287 - DNA, 15 bp, Homo sapiens
tttagcagcacaggt

SEQ ID NO: 166288 - DNA, 15 bp, Homo sapiens
gtttagcagcacagg

SEQ ID NO: 166289 - DNA, 15 bp, Homo sapiens
agtttagcagcacag

SEQ ID NO: 166290 - DNA, 15 bp, Homo sapiens
gagtttagcagcaca

SEQ ID NO: 166291 - DNA, 15 bp, Homo sapiens
agagtttagcagcac

SEQ ID NO: 166292 - DNA, 15 bp, Homo sapiens
gagagtttagcagca

SEQ ID NO: 166293 - DNA, 15 bp, Homo sapiens
ggagagtttagcagc

SEQ ID NO: 166294 - DNA, 15 bp, Homo sapiens
tggagagtttagcag

SEQ ID NO: 166295 - DNA, 15 bp, Homo sapiens
atggagagtttagca

SEQ ID NO: 166296 - DNA, 15 bp, Homo sapiens
aatggagagtttagc

SEQ ID NO: 166297 - DNA, 15 bp, Homo sapiens
aaatggagagtttag

SEQ ID NO: 166298 - DNA, 15 bp, Homo sapiens
caaatggagagttta

SEQ ID NO: 166299 - DNA, 15 bp, Homo sapiens
gcaaatggagagttt

SEQ ID NO: 166300 - DNA, 15 bp, Homo sapiens
tgcaaatggagagtt

SEQ ID NO: 166301 - DNA, 15 bp, Homo sapiens
atgcaaatggagagt

SEQ ID NO: 166302 - DNA, 15 bp, Homo sapiens
aatgcaaatggagag

SEQ ID NO: 166303 - DNA, 15 bp, Homo sapiens
aaatgcaaatggaga

SEQ ID NO: 166304 - DNA, 15 bp, Homo sapiens
aaaatgcaaatggag

SEQ ID NO: 166305 - DNA, 15 bp, Homo sapiens
taaaatgcaaatgga

SEQ ID NO: 166306 - DNA, 15 bp, Homo sapiens
ataaaatgcaaatgg

SEQ ID NO: 166307 - DNA, 15 bp, Homo sapiens
aataaaatgcaaatg

SEQ ID NO: 166308 - DNA, 15 bp, Homo sapiens
caataaaatgcaaat

SEQ ID NO: 166309 - DNA, 15 bp, Homo sapiens
ccaataaaatgcaaa

SEQ ID NO: 166310 - DNA, 15 bp, Homo sapiens
gccaataaaatgcaa

SEQ ID NO: 166311 - DNA, 15 bp, Homo sapiens
agccaataaaatgca

SEQ ID NO: 166312 - DNA, 15 bp, Homo sapiens
tagccaataaaatgc

SEQ ID NO: 166313 - DNA, 15 bp, Homo sapiens
gtagccaataaaatg

SEQ ID NO: 166314 - DNA, 15 bp, Homo sapiens
agtagccaataaaat

SEQ ID NO: 166315 - DNA, 15 bp, Homo sapiens
tagtagccaataaaa

SEQ ID NO: 166316 - DNA, 15 bp, Homo sapiens
atagtagccaataaa

SEQ ID NO: 166317 - DNA, 15 bp, Homo sapiens
catagtagccaataa

SEQ ID NO: 166318 - DNA, 15 bp, Homo sapiens
acatagtagccaata

SEQ ID NO: 166319 - DNA, 15 bp, Homo sapiens
aacatagtagccaat

SEQ ID NO: 166320 - DNA, 15 bp, Homo sapiens
aaacatagtagccaa

SEQ ID NO: 166321 - DNA, 15 bp, Homo sapiens
aaaacatagtagcca

SEQ ID NO: 166322 - DNA, 15 bp, Homo sapiens
aaaaacatagtagcc

SEQ ID NO: 166323 - DNA, 15 bp, Homo sapiens
caaaaacatagtagc

SEQ ID NO: 166324 - DNA, 15 bp, Homo sapiens
gcaaaaacatagtag

SEQ ID NO: 166325 - DNA, 15 bp, Homo sapiens
agcaaaaacatagta

SEQ ID NO: 166326 - DNA, 15 bp, Homo sapiens
gagcaaaaacatagt

SEQ ID NO: 166327 - DNA, 15 bp, Homo sapiens
ggagcaaaaacatag

SEQ ID NO: 166328 - DNA, 15 bp, Homo sapiens
tggagcaaaaacata

SEQ ID NO: 166329 - DNA, 15 bp, Homo sapiens
ctggagcaaaaacat

SEQ ID NO: 166330 - DNA, 15 bp, Homo sapiens
tctggagcaaaaaca

SEQ ID NO: 166331 - DNA, 15 bp, Homo sapiens
ctctggagcaaaaac

SEQ ID NO: 166332 - DNA, 15 bp, Homo sapiens
gctctggagcaaaaa

SEQ ID NO: 166333 - DNA, 15 bp, Homo sapiens
cgctctggagcaaaa

SEQ ID NO: 166334 - DNA, 15 bp, Homo sapiens
ccgctctggagcaaa

SEQ ID NO: 166335 - DNA, 15 bp, Homo sapiens
cccgctctggagcaa

SEQ ID NO: 166336 - DNA, 15 bp, Homo sapiens
acccgctctggagca

SEQ ID NO: 166337 - DNA, 15 bp, Homo sapiens
aacccgctctggagc

SEQ ID NO: 166338 - DNA, 15 bp, Homo sapiens
gaacccgctctggag

SEQ ID NO: 166339 - DNA, 15 bp, Homo sapiens
ggaacccgctctgga

SEQ ID NO: 166340 - DNA, 15 bp, Homo sapiens
aggaacccgctctgg

SEQ ID NO: 166341 - DNA, 15 bp, Homo sapiens
aaggaacccgctctg

SEQ ID NO: 166342 - DNA, 15 bp, Homo sapiens
aaaggaacccgctct

SEQ ID NO: 166343 - DNA, 15 bp, Homo sapiens
taaaggaacccgctc

SEQ ID NO: 166344 - DNA, 15 bp, Homo sapiens
ttaaaggaacccgct

SEQ ID NO: 166345 - DNA, 15 bp, Homo sapiens
gttaaaggaacccgc

SEQ ID NO: 166346 - DNA, 15 bp, Homo sapiens
agttaaaggaacccg

SEQ ID NO: 166347 - DNA, 15 bp, Homo sapiens
gagttaaaggaaccc

SEQ ID NO: 166348 - DNA, 15 bp, Homo sapiens
agagttaaaggaacc

SEQ ID NO: 166349 - DNA, 15 bp, Homo sapiens
cagagttaaaggaac

SEQ ID NO: 166350 - DNA, 15 bp, Homo sapiens
tcagagttaaaggaa

SEQ ID NO: 166351 - DNA, 15 bp, Homo sapiens
atcagagttaaagga

SEQ ID NO: 166352 - DNA, 15 bp, Homo sapiens
catcagagttaaagg

SEQ ID NO: 166353 - DNA, 15 bp, Homo sapiens
gcatcagagttaaag

SEQ ID NO: 166354 - DNA, 15 bp, Homo sapiens
ggcatcagagttaaa

SEQ ID NO: 166355 - DNA, 15 bp, Homo sapiens
aggcatcagagttaa

SEQ ID NO: 166356 - DNA, 15 bp, Homo sapiens
caggcatcagagtta

SEQ ID NO: 166357 - DNA, 15 bp, Homo sapiens
ccaggcatcagagtt

SEQ ID NO: 166358 - DNA, 15 bp, Homo sapiens
cccaggcatcagagt

SEQ ID NO: 166359 - DNA, 15 bp, Homo sapiens
acccaggcatcagag

SEQ ID NO: 166360 - DNA, 15 bp, Homo sapiens
tacccaggcatcaga

SEQ ID NO: 166361 - DNA, 15 bp, Homo sapiens
ttacccaggcatcag

SEQ ID NO: 166362 - DNA, 15 bp, Homo sapiens
tttacccaggcatca

SEQ ID NO: 166363 - DNA, 15 bp, Homo sapiens
atttacccaggcatc

SEQ ID NO: 166364 - DNA, 15 bp, Homo sapiens
aatttacccaggcat

SEQ ID NO: 166365 - DNA, 15 bp, Homo sapiens
taatttacccaggca

SEQ ID NO: 166366 - DNA, 15 bp, Homo sapiens
ttaatttacccaggc

SEQ ID NO: 166367 - DNA, 15 bp, Homo sapiens
attaatttacccagg

SEQ ID NO: 166368 - DNA, 15 bp, Homo sapiens
gattaatttacccag

SEQ ID NO: 166369 - DNA, 15 bp, Homo sapiens
cgattaatttaccca

SEQ ID NO: 166370 - DNA, 15 bp, Homo sapiens
ccgattaatttaccc

SEQ ID NO: 166371 - DNA, 15 bp, Homo sapiens
cccgattaatttacc

SEQ ID NO: 166372 - DNA, 15 bp, Homo sapiens
ccccgattaatttac

SEQ ID NO: 166373 - DNA, 15 bp, Homo sapiens
accccgattaattta

SEQ ID NO: 166374 - DNA, 15 bp, Homo sapiens
caccccgattaattt

SEQ ID NO: 166375 - DNA, 15 bp, Homo sapiens
acaccccgattaatt

SEQ ID NO: 166376 - DNA, 15 bp, Homo sapiens
cacaccccgattaat

SEQ ID NO: 166377 - DNA, 15 bp, Homo sapiens
gcacaccccgattaa

SEQ ID NO: 166378 - DNA, 15 bp, Homo sapiens
tgcacaccccgatta

SEQ ID NO: 166379 - DNA, 15 bp, Homo sapiens
atgcacaccccgatt

SEQ ID NO: 166380 - DNA, 15 bp, Homo sapiens
catgcacaccccgat

SEQ ID NO: 166381 - DNA, 15 bp, Homo sapiens
gcatgcacaccccga

SEQ ID NO: 166382 - DNA, 15 bp, Homo sapiens
ggcatgcacaccccg

SEQ ID NO: 166383 - DNA, 15 bp, Homo sapiens
tggcatgcacacccc

SEQ ID NO: 166384 - DNA, 15 bp, Homo sapiens
atggcatgcacaccc

SEQ ID NO: 166385 - DNA, 15 bp, Homo sapiens
aatggcatgcacacc

SEQ ID NO: 166386 - DNA, 15 bp, Homo sapiens
caatggcatgcacac

SEQ ID NO: 166387 - DNA, 15 bp, Homo sapiens
gcaatggcatgcaca

SEQ ID NO: 166388 - DNA, 15 bp, Homo sapiens
ggcaatggcatgcac

SEQ ID NO: 166389 - DNA, 15 bp, Homo sapiens
gggcaatggcatgca

SEQ ID NO: 166390 - DNA, 15 bp, Homo sapiens
agggcaatggcatgc

SEQ ID NO: 166391 - DNA, 15 bp, Homo sapiens
aagggcaatggcatg

SEQ ID NO: 166392 - DNA, 15 bp, Homo sapiens
aaagggcaatggcat

SEQ ID NO: 166393 - DNA, 15 bp, Homo sapiens
aaaagggcaatggca

SEQ ID NO: 166394 - DNA, 15 bp, Homo sapiens
taaaagggcaatggc

SEQ ID NO: 166395 - DNA, 15 bp, Homo sapiens
ctaaaagggcaatgg

SEQ ID NO: 166396 - DNA, 15 bp, Homo sapiens
gctaaaagggcaatg

SEQ ID NO: 166397 - DNA, 15 bp, Homo sapiens
agctaaaagggcaat

SEQ ID NO: 166398 - DNA, 15 bp, Homo sapiens
aagctaaaagggcaa

SEQ ID NO: 166399 - DNA, 15 bp, Homo sapiens
gaagctaaaagggca

SEQ ID NO: 166400 - DNA, 15 bp, Homo sapiens
agaagctaaaagggc

SEQ ID NO: 166401 - DNA, 15 bp, Homo sapiens
cagaagctaaaaggg

SEQ ID NO: 166402 - DNA, 15 bp, Homo sapiens
gcagaagctaaaagg

SEQ ID NO: 166403 - DNA, 15 bp, Homo sapiens
agcagaagctaaaag

SEQ ID NO: 166404 - DNA, 15 bp, Homo sapiens
gagcagaagctaaaa

SEQ ID NO: 166405 - DNA, 15 bp, Homo sapiens
ggagcagaagctaaa

SEQ ID NO: 166406 - DNA, 15 bp, Homo sapiens
aggagcagaagctaa

SEQ ID NO: 166407 - DNA, 15 bp, Homo sapiens
caggagcagaagcta

SEQ ID NO: 166408 - DNA, 15 bp, Homo sapiens
acaggagcagaagct

SEQ ID NO: 166409 - DNA, 15 bp, Homo sapiens
aacaggagcagaagc

SEQ ID NO: 166410 - DNA, 15 bp, Homo sapiens
gaacaggagcagaag

SEQ ID NO: 166411 - DNA, 15 bp, Homo sapiens
agaacaggagcagaa

SEQ ID NO: 166412 - DNA, 15 bp, Homo sapiens
tagaacaggagcaga

SEQ ID NO: 166413 - DNA, 15 bp, Homo sapiens
ttagaacaggagcag

SEQ ID NO: 166414 - DNA, 15 bp, Homo sapiens
attagaacaggagca

SEQ ID NO: 166415 - DNA, 15 bp, Homo sapiens
tattagaacaggagc

SEQ ID NO: 166416 - DNA, 15 bp, Homo sapiens
ttattagaacaggag

SEQ ID NO: 166417 - DNA, 15 bp, Homo sapiens
tttattagaacagga

SEQ ID NO: 166418 - DNA, 15 bp, Homo sapiens
ctttattagaacagg

SEQ ID NO: 166419 - DNA, 15 bp, Homo sapiens
cctttattagaacag

SEQ ID NO: 166420 - DNA, 15 bp, Homo sapiens
gcctttattagaaca

SEQ ID NO: 166421 - DNA, 15 bp, Homo sapiens
agcctttattagaac

SEQ ID NO: 166422 - DNA, 15 bp, Homo sapiens
gagcctttattagaa

SEQ ID NO: 166423 - DNA, 15 bp, Homo sapiens
ggagcctttattaga

SEQ ID NO: 166424 - DNA, 15 bp, Homo sapiens
tggagcctttattag

SEQ ID NO: 166425 - DNA, 15 bp, Homo sapiens
atggagcctttatta

SEQ ID NO: 166426 - DNA, 15 bp, Homo sapiens
gatggagcctttatt

SEQ ID NO: 166427 - DNA, 15 bp, Homo sapiens
agatggagcctttat

SEQ ID NO: 166428 - DNA, 15 bp, Homo sapiens
cagatggagccttta

SEQ ID NO: 166429 - DNA, 15 bp, Homo sapiens
gcagatggagccttt

SEQ ID NO: 166430 - DNA, 15 bp, Homo sapiens
agcagatggagcctt

SEQ ID NO: 166431 - DNA, 15 bp, Homo sapiens
aagcagatggagcct

SEQ ID NO: 166432 - DNA, 15 bp, Homo sapiens
taagcagatggagcc

SEQ ID NO: 166433 - DNA, 15 bp, Homo sapiens
ttaagcagatggagc

SEQ ID NO: 166434 - DNA, 15 bp, Homo sapiens
attaagcagatggag

SEQ ID NO: 166435 - DNA, 15 bp, Homo sapiens
aattaagcagatgga

SEQ ID NO: 166436 - DNA, 15 bp, Homo sapiens
caattaagcagatgg

SEQ ID NO: 166437 - DNA, 15 bp, Homo sapiens
ccaattaagcagatg

SEQ ID NO: 166438 - DNA, 15 bp, Homo sapiens
accaattaagcagat

SEQ ID NO: 166439 - DNA, 15 bp, Homo sapiens
taccaattaagcaga

SEQ ID NO: 166440 - DNA, 15 bp, Homo sapiens
ctaccaattaagcag

SEQ ID NO: 166441 - DNA, 15 bp, Homo sapiens
tctaccaattaagca

SEQ ID NO: 166442 - DNA, 15 bp, Homo sapiens
gtctaccaattaagc

SEQ ID NO: 166443 - DNA, 15 bp, Homo sapiens
agtctaccaattaag

SEQ ID NO: 166444 - DNA, 15 bp, Homo sapiens
aagtctaccaattaa

SEQ ID NO: 166445 - DNA, 15 bp, Homo sapiens
taagtctaccaatta

SEQ ID NO: 166446 - DNA, 15 bp, Homo sapiens
gtaagtctaccaatt

SEQ ID NO: 166447 - DNA, 15 bp, Homo sapiens
tgtaagtctaccaat

SEQ ID NO: 166448 - DNA, 15 bp, Homo sapiens
ctgtaagtctaccaa

SEQ ID NO: 166449 - DNA, 15 bp, Homo sapiens
cctgtaagtctacca

SEQ ID NO: 166450 - DNA, 15 bp, Homo sapiens
gcctgtaagtctacc

SEQ ID NO: 166451 - DNA, 15 bp, Homo sapiens
ggcctgtaagtctac

SEQ ID NO: 166452 - DNA, 15 bp, Homo sapiens
aggcctgtaagtcta

SEQ ID NO: 166453 - DNA, 15 bp, Homo sapiens
aaggcctgtaagtct

SEQ ID NO: 166454 - DNA, 15 bp, Homo sapiens
aaaggcctgtaagtc

SEQ ID NO: 166455 - DNA, 15 bp, Homo sapiens
gaaaggcctgtaagt

SEQ ID NO: 166456 - DNA, 15 bp, Homo sapiens
agaaaggcctgtaag

SEQ ID NO: 166457 - DNA, 15 bp, Homo sapiens
aagaaaggcctgtaa

SEQ ID NO: 166458 - DNA, 15 bp, Homo sapiens
taagaaaggcctgta

SEQ ID NO: 166459 - DNA, 15 bp, Homo sapiens
ataagaaaggcctgt

SEQ ID NO: 166460 - DNA, 15 bp, Homo sapiens
aataagaaaggcctg

SEQ ID NO: 166461 - DNA, 15 bp, Homo sapiens
aaataagaaaggcct

SEQ ID NO: 166462 - DNA, 15 bp, Homo sapiens
gaaataagaaaggcc

SEQ ID NO: 166463 - DNA, 15 bp, Homo sapiens
tgaaataagaaaggc

SEQ ID NO: 166464 - DNA, 15 bp, Homo sapiens
ttgaaataagaaagg

SEQ ID NO: 166465 - DNA, 15 bp, Homo sapiens
tttgaaataagaaag

SEQ ID NO: 166466 - DNA, 15 bp, Homo sapiens
ttttgaaataagaaa

SEQ ID NO: 166467 - DNA, 15 bp, Homo sapiens
ttttttgaaataaga

SEQ ID NO: 166468 - DNA, 15 bp, Homo sapiens
attttttgaaataag

SEQ ID NO: 166469 - DNA, 15 bp, Homo sapiens
gattttttgaaataa

SEQ ID NO: 166470 - DNA, 15 bp, Homo sapiens
tgattttttgaaata

SEQ ID NO: 166471 - DNA, 15 bp, Homo sapiens
gtgattttttgaaat

SEQ ID NO: 166472 - DNA, 15 bp, Homo sapiens
agtgattttttgaaa

SEQ ID NO: 166473 - DNA, 15 bp, Homo sapiens
aagtgattttttgaa

SEQ ID NO: 166474 - DNA, 15 bp, Homo sapiens
aaagtgattttttga

SEQ ID NO: 166475 - DNA, 15 bp, Homo sapiens
caaagtgattttttg

SEQ ID NO: 166476 - DNA, 15 bp, Homo sapiens
tcaaagtgatttttt

SEQ ID NO: 166477 - DNA, 15 bp, Homo sapiens
ttcaaagtgattttt

SEQ ID NO: 166478 - DNA, 15 bp, Homo sapiens
tttcaaagtgatttt

SEQ ID NO: 166479 - DNA, 15 bp, Homo sapiens
ttttcaaagtgattt

SEQ ID NO: 166480 - DNA, 15 bp, Homo sapiens
tttttcaaagtgatt

SEQ ID NO: 166481 - DNA, 15 bp, Homo sapiens
ttttttcaaagtgat

SEQ ID NO: 166482 - DNA, 15 bp, Homo sapiens
tttttttcaaagtga

SEQ ID NO: 166483 - DNA, 15 bp, Homo sapiens
ctttttttcaaagtg

SEQ ID NO: 166484 - DNA, 15 bp, Homo sapiens
gctttttttcaaagt

SEQ ID NO: 166485 - DNA, 15 bp, Homo sapiens
tgctttttttcaaag

SEQ ID NO: 166486 - DNA, 15 bp, Homo sapiens
atgctttttttcaaa

SEQ ID NO: 166487 - DNA, 15 bp, Homo sapiens
tatgctttttttcaa

SEQ ID NO: 166488 - DNA, 15 bp, Homo sapiens
ctatgctttttttca

SEQ ID NO: 166489 - DNA, 15 bp, Homo sapiens
gctatgctttttttc

SEQ ID NO: 166490 - DNA, 15 bp, Homo sapiens
agctatgcttttttt

SEQ ID NO: 166491 - DNA, 15 bp, Homo sapiens
aagctatgctttttt

SEQ ID NO: 166492 - DNA, 15 bp, Homo sapiens
gaagctatgcttttt

SEQ ID NO: 166493 - DNA, 15 bp, Homo sapiens
agaagctatgctttt

SEQ ID NO: 166494 - DNA, 15 bp, Homo sapiens
gagaagctatgcttt

SEQ ID NO: 166495 - DNA, 15 bp, Homo sapiens
tgagaagctatgctt

SEQ ID NO: 166496 - DNA, 15 bp, Homo sapiens
ttgagaagctatgct

SEQ ID NO: 166497 - DNA, 15 bp, Homo sapiens
cttgagaagctatgc

SEQ ID NO: 166498 - DNA, 15 bp, Homo sapiens
ccttgagaagctatg

SEQ ID NO: 166499 - DNA, 15 bp, Homo sapiens
cccttgagaagctat

SEQ ID NO: 166500 - DNA, 15 bp, Homo sapiens
tcccttgagaagcta

SEQ ID NO: 166501 - DNA, 15 bp, Homo sapiens
ttcccttgagaagct

SEQ ID NO: 166502 - DNA, 15 bp, Homo sapiens
tttcccttgagaagc

SEQ ID NO: 166503 - DNA, 15 bp, Homo sapiens
ctttcccttgagaag

SEQ ID NO: 166504 - DNA, 15 bp, Homo sapiens
tctttcccttgagaa

SEQ ID NO: 166505 - DNA, 15 bp, Homo sapiens
ttctttcccttgaga

SEQ ID NO: 166506 - DNA, 15 bp, Homo sapiens
cttctttcccttgag

SEQ ID NO: 166507 - DNA, 15 bp, Homo sapiens
tcttctttcccttga

SEQ ID NO: 166508 - DNA, 15 bp, Homo sapiens
ttcttctttcccttg

SEQ ID NO: 166509 - DNA, 15 bp, Homo sapiens
gttcttctttccctt

SEQ ID NO: 166510 - DNA, 15 bp, Homo sapiens
ggttcttctttccct

SEQ ID NO: 166511 - DNA, 15 bp, Homo sapiens
tggttcttctttccc

SEQ ID NO: 166512 - DNA, 15 bp, Homo sapiens
ctggttcttctttcc

SEQ ID NO: 166513 - DNA, 15 bp, Homo sapiens
tctggttcttctttc

SEQ ID NO: 166514 - DNA, 15 bp, Homo sapiens
ttctggttcttcttt

SEQ ID NO: 166515 - DNA, 15 bp, Homo sapiens
gttctggttcttctt

SEQ ID NO: 166516 - DNA, 15 bp, Homo sapiens
agttctggttcttct

SEQ ID NO: 166517 - DNA, 15 bp, Homo sapiens
gagttctggttcttc

SEQ ID NO: 166518 - DNA, 15 bp, Homo sapiens
agagttctggttctt

SEQ ID NO: 166519 - DNA, 15 bp, Homo sapiens
aagagttctggttct

SEQ ID NO: 166520 - DNA, 15 bp, Homo sapiens
caagagttctggttc

SEQ ID NO: 166521 - DNA, 15 bp, Homo sapiens
tcaagagttctggtt

SEQ ID NO: 166522 - DNA, 15 bp, Homo sapiens
ttcaagagttctggt

SEQ ID NO: 166523 - DNA, 15 bp, Homo sapiens
tttcaagagttctgg

SEQ ID NO: 166524 - DNA, 15 bp, Homo sapiens
ttttcaagagttctg

SEQ ID NO: 166525 - DNA, 15 bp, Homo sapiens
tttttcaagagttct

SEQ ID NO: 166526 - DNA, 15 bp, Homo sapiens
atttttcaagagttc

SEQ ID NO: 166527 - DNA, 15 bp, Homo sapiens
catttttcaagagtt

SEQ ID NO: 166528 - DNA, 15 bp, Homo sapiens
acatttttcaagagt

SEQ ID NO: 166529 - DNA, 15 bp, Homo sapiens
tacatttttcaagag

SEQ ID NO: 166530 - DNA, 15 bp, Homo sapiens
atacatttttcaaga

SEQ ID NO: 166531 - DNA, 15 bp, Homo sapiens
aatacatttttcaag

SEQ ID NO: 166532 - DNA, 15 bp, Homo sapiens
taatacatttttcaa

SEQ ID NO: 166533 - DNA, 15 bp, Homo sapiens
ataatacatttttca

SEQ ID NO: 166534 - DNA, 15 bp, Homo sapiens
aataatacatttttc

SEQ ID NO: 166535 - DNA, 15 bp, Homo sapiens
aaataatacattttt

SEQ ID NO: 166536 - DNA, 15 bp, Homo sapiens
caaataatacatttt

SEQ ID NO: 166537 - DNA, 15 bp, Homo sapiens
ccaaataatacattt

SEQ ID NO: 166538 - DNA, 15 bp, Homo sapiens
cccaaataatacatt

SEQ ID NO: 166539 - DNA, 15 bp, Homo sapiens
tcccaaataatacat

SEQ ID NO: 166540 - DNA, 15 bp, Homo sapiens
ctcccaaataataca

SEQ ID NO: 166541 - DNA, 15 bp, Homo sapiens
tctcccaaataatac

SEQ ID NO: 166542 - DNA, 15 bp, Homo sapiens
atctcccaaataata

SEQ ID NO: 166543 - DNA, 15 bp, Homo sapiens
catctcccaaataat

SEQ ID NO: 166544 - DNA, 15 bp, Homo sapiens
acatctcccaaataa

SEQ ID NO: 166545 - DNA, 15 bp, Homo sapiens
aacatctcccaaata

SEQ ID NO: 166546 - DNA, 15 bp, Homo sapiens
taacatctcccaaat

SEQ ID NO: 166547 - DNA, 15 bp, Homo sapiens
ttaacatctcccaaa

SEQ ID NO: 166548 - DNA, 15 bp, Homo sapiens
tttaacatctcccaa

SEQ ID NO: 166549 - DNA, 15 bp, Homo sapiens
atttaacatctccca

SEQ ID NO: 166550 - DNA, 15 bp, Homo sapiens
aatttaacatctccc

SEQ ID NO: 166551 - DNA, 15 bp, Homo sapiens
aaatttaacatctcc

SEQ ID NO: 166552 - DNA, 15 bp, Homo sapiens
gaaatttaacatctc

SEQ ID NO: 166553 - DNA, 15 bp, Homo sapiens
agaaatttaacatct

SEQ ID NO: 166554 - DNA, 15 bp, Homo sapiens
cagaaatttaacatc

SEQ ID NO: 166555 - DNA, 15 bp, Homo sapiens
gcagaaatttaacat

SEQ ID NO: 166556 - DNA, 15 bp, Homo sapiens
ggcagaaatttaaca

SEQ ID NO: 166557 - DNA, 15 bp, Homo sapiens
tggcagaaatttaac

SEQ ID NO: 166558 - DNA, 15 bp, Homo sapiens
atggcagaaatttaa

SEQ ID NO: 166559 - DNA, 15 bp, Homo sapiens
gatggcagaaattta

SEQ ID NO: 166560 - DNA, 15 bp, Homo sapiens
tgatggcagaaattt

SEQ ID NO: 166561 - DNA, 15 bp, Homo sapiens
gtgatggcagaaatt

SEQ ID NO: 166562 - DNA, 15 bp, Homo sapiens
agtgatggcagaaat

SEQ ID NO: 166563 - DNA, 15 bp, Homo sapiens
cagtgatggcagaaa

SEQ ID NO: 166564 - DNA, 15 bp, Homo sapiens
acagtgatggcagaa

SEQ ID NO: 166565 - DNA, 15 bp, Homo sapiens
cacagtgatggcaga

SEQ ID NO: 166566 - DNA, 15 bp, Homo sapiens
gcacagtgatggcag

SEQ ID NO: 166567 - DNA, 15 bp, Homo sapiens
agcacagtgatggca

SEQ ID NO: 166568 - DNA, 15 bp, Homo sapiens
cagcacagtgatggc

SEQ ID NO: 166569 - DNA, 15 bp, Homo sapiens
tcagcacagtgatgg

SEQ ID NO: 166570 - DNA, 15 bp, Homo sapiens
ctcagcacagtgatg

SEQ ID NO: 166571 - DNA, 15 bp, Homo sapiens
tctcagcacagtgat

SEQ ID NO: 166572 - DNA, 15 bp, Homo sapiens
atctcagcacagtga

SEQ ID NO: 166573 - DNA, 15 bp, Homo sapiens
catctcagcacagtg

SEQ ID NO: 166574 - DNA, 15 bp, Homo sapiens
acatctcagcacagt

SEQ ID NO: 166575 - DNA, 15 bp, Homo sapiens
tacatctcagcacag

SEQ ID NO: 166576 - DNA, 15 bp, Homo sapiens
atacatctcagcaca

SEQ ID NO: 166577 - DNA, 15 bp, Homo sapiens
catacatctcagcac

SEQ ID NO: 166578 - DNA, 15 bp, Homo sapiens
acatacatctcagca

SEQ ID NO: 166579 - DNA, 15 bp, Homo sapiens
tacatacatctcagc

SEQ ID NO: 166580 - DNA, 15 bp, Homo sapiens
ctacatacatctcag

SEQ ID NO: 166581 - DNA, 15 bp, Homo sapiens
actacatacatctca

SEQ ID NO: 166582 - DNA, 15 bp, Homo sapiens
gactacatacatctc

SEQ ID NO: 166583 - DNA, 15 bp, Homo sapiens
tgactacatacatct

SEQ ID NO: 166584 - DNA, 15 bp, Homo sapiens
ttgactacatacatc

SEQ ID NO: 166585 - DNA, 15 bp, Homo sapiens
attgactacatacat

SEQ ID NO: 166586 - DNA, 15 bp, Homo sapiens
cattgactacataca

SEQ ID NO: 166587 - DNA, 15 bp, Homo sapiens
tcattgactacatac

SEQ ID NO: 166588 - DNA, 15 bp, Homo sapiens
ctcattgactacata

SEQ ID NO: 166589 - DNA, 15 bp, Homo sapiens
tctcattgactacat

SEQ ID NO: 166590 - DNA, 15 bp, Homo sapiens
ttctcattgactaca

SEQ ID NO: 166591 - DNA, 15 bp, Homo sapiens
tttctcattgactac

SEQ ID NO: 166592 - DNA, 15 bp, Homo sapiens
gtttctcattgacta

SEQ ID NO: 166593 - DNA, 15 bp, Homo sapiens
tgtttctcattgact

SEQ ID NO: 166594 - DNA, 15 bp, Homo sapiens
ctgtttctcattgac

SEQ ID NO: 166595 - DNA, 15 bp, Homo sapiens
gctgtttctcattga

SEQ ID NO: 166596 - DNA, 15 bp, Homo sapiens
tgctgtttctcattg

SEQ ID NO: 166597 - DNA, 15 bp, Homo sapiens
atgctgtttctcatt

SEQ ID NO: 166598 - DNA, 15 bp, Homo sapiens
gatgctgtttctcat

SEQ ID NO: 166599 - DNA, 15 bp, Homo sapiens
ggatgctgtttctca

SEQ ID NO: 166600 - DNA, 15 bp, Homo sapiens
tggatgctgtttctc

SEQ ID NO: 166601 - DNA, 15 bp, Homo sapiens
ttggatgctgtttct

SEQ ID NO: 166602 - DNA, 15 bp, Homo sapiens
cttggatgctgtttc

SEQ ID NO: 166603 - DNA, 15 bp, Homo sapiens
tcttggatgctgttt

SEQ ID NO: 166604 - DNA, 15 bp, Homo sapiens
atcttggatgctgtt

SEQ ID NO: 166605 - DNA, 15 bp, Homo sapiens
tatcttggatgctgt

SEQ ID NO: 166606 - DNA, 15 bp, Homo sapiens
ttatcttggatgctg

SEQ ID NO: 166607 - DNA, 15 bp, Homo sapiens
attatcttggatgct

SEQ ID NO: 166608 - DNA, 15 bp, Homo sapiens
tattatcttggatgc

SEQ ID NO: 166609 - DNA, 15 bp, Homo sapiens
gtattatcttggatg

SEQ ID NO: 166610 - DNA, 15 bp, Homo sapiens
agtattatcttggat

SEQ ID NO: 166611 - DNA, 15 bp, Homo sapiens
cagtattatcttgga

SEQ ID NO: 166612 - DNA, 15 bp, Homo sapiens
ccagtattatcttgg

SEQ ID NO: 166613 - DNA, 15 bp, Homo sapiens
accagtattatcttg

SEQ ID NO: 166614 - DNA, 15 bp, Homo sapiens
aaccagtattatctt

SEQ ID NO: 166615 - DNA, 15 bp, Homo sapiens
aaaccagtattatct

SEQ ID NO: 166616 - DNA, 15 bp, Homo sapiens
aaaaccagtattatc

SEQ ID NO: 166617 - DNA, 15 bp, Homo sapiens
gaaaaccagtattat

SEQ ID NO: 166618 - DNA, 15 bp, Homo sapiens
agaaaaccagtatta

SEQ ID NO: 166619 - DNA, 15 bp, Homo sapiens
aagaaaaccagtatt

SEQ ID NO: 166620 - DNA, 15 bp, Homo sapiens
taagaaaaccagtat

SEQ ID NO: 166621 - DNA, 15 bp, Homo sapiens
gtaagaaaaccagta

SEQ ID NO: 166622 - DNA, 15 bp, Homo sapiens
agtaagaaaaccagt

SEQ ID NO: 166623 - DNA, 15 bp, Homo sapiens
tagtaagaaaaccag

SEQ ID NO: 166624 - DNA, 15 bp, Homo sapiens
gtagtaagaaaacca

SEQ ID NO: 166625 - DNA, 15 bp, Homo sapiens
agtagtaagaaaacc

SEQ ID NO: 166626 - DNA, 15 bp, Homo sapiens
aagtagtaagaaaac

SEQ ID NO: 166627 - DNA, 15 bp, Homo sapiens
aaagtagtaagaaaa

SEQ ID NO: 166628 - DNA, 15 bp, Homo sapiens
aaaaagtagtaagaa

SEQ ID NO: 166629 - DNA, 15 bp, Homo sapiens
aaaaaagtagtaaga

SEQ ID NO: 166630 - DNA, 15 bp, Homo sapiens
aaaaaaagtagtaag

SEQ ID NO: 166631 - DNA, 15 bp, Homo sapiens
gaaaaaaagtagtaa

SEQ ID NO: 166632 - DNA, 15 bp, Homo sapiens
ggaaaaaaagtagta

SEQ ID NO: 166633 - DNA, 15 bp, Homo sapiens
tggaaaaaaagtagt

SEQ ID NO: 166634 - DNA, 15 bp, Homo sapiens
atggaaaaaaagtag

SEQ ID NO: 166635 - DNA, 15 bp, Homo sapiens
gatggaaaaaaagta

SEQ ID NO: 166636 - DNA, 15 bp, Homo sapiens
agatggaaaaaaagt

SEQ ID NO: 166637 - DNA, 15 bp, Homo sapiens
gagatggaaaaaaag

SEQ ID NO: 166638 - DNA, 15 bp, Homo sapiens
agagatggaaaaaaa

SEQ ID NO: 166639 - DNA, 15 bp, Homo sapiens
aagagatggaaaaaa

SEQ ID NO: 166640 - DNA, 15 bp, Homo sapiens
caagagatggaaaaa

SEQ ID NO: 166641 - DNA, 15 bp, Homo sapiens
acaagagatggaaaa

SEQ ID NO: 166642 - DNA, 15 bp, Homo sapiens
tacaagagatggaaa

SEQ ID NO: 166643 - DNA, 15 bp, Homo sapiens
gtacaagagatggaa

SEQ ID NO: 166644 - DNA, 15 bp, Homo sapiens
tgtacaagagatgga

SEQ ID NO: 166645 - DNA, 15 bp, Homo sapiens
atgtacaagagatgg

SEQ ID NO: 166646 - DNA, 15 bp, Homo sapiens
gatgtacaagagatg

SEQ ID NO: 166647 - DNA, 15 bp, Homo sapiens
agatgtacaagagat

SEQ ID NO: 166648 - DNA, 15 bp, Homo sapiens
gagatgtacaagaga

SEQ ID NO: 166649 - DNA, 15 bp, Homo sapiens
agagatgtacaagag

SEQ ID NO: 166650 - DNA, 15 bp, Homo sapiens
tagagatgtacaaga

SEQ ID NO: 166651 - DNA, 15 bp, Homo sapiens
atagagatgtacaag

SEQ ID NO: 166652 - DNA, 15 bp, Homo sapiens
catagagatgtacaa

SEQ ID NO: 166653 - DNA, 15 bp, Homo sapiens
acatagagatgtaca

SEQ ID NO: 166654 - DNA, 15 bp, Homo sapiens
gacatagagatgtac

SEQ ID NO: 166655 - DNA, 15 bp, Homo sapiens
agacatagagatgta

SEQ ID NO: 166656 - DNA, 15 bp, Homo sapiens
cagacatagagatgt

SEQ ID NO: 166657 - DNA, 15 bp, Homo sapiens
acagacatagagatg

SEQ ID NO: 166658 - DNA, 15 bp, Homo sapiens
tacagacatagagat

SEQ ID NO: 166659 - DNA, 15 bp, Homo sapiens
atacagacatagaga

SEQ ID NO: 166660 - DNA, 15 bp, Homo sapiens
aatacagacatagag

SEQ ID NO: 166661 - DNA, 15 bp, Homo sapiens
aaatacagacataga

SEQ ID NO: 166662 - DNA, 15 bp, Homo sapiens
gaaatacagacatag

SEQ ID NO: 166663 - DNA, 15 bp, Homo sapiens
tgaaatacagacata

SEQ ID NO: 166664 - DNA, 15 bp, Homo sapiens
atgaaatacagacat

SEQ ID NO: 166665 - DNA, 15 bp, Homo sapiens
catgaaatacagaca

SEQ ID NO: 166666 - DNA, 15 bp, Homo sapiens
tcatgaaatacagac

SEQ ID NO: 166667 - DNA, 15 bp, Homo sapiens
ttcatgaaatacaga

SEQ ID NO: 166668 - DNA, 15 bp, Homo sapiens
tttcatgaaatacag

SEQ ID NO: 166669 - DNA, 15 bp, Homo sapiens
ttttcatgaaataca

SEQ ID NO: 166670 - DNA, 15 bp, Homo sapiens
gttttcatgaaatac

SEQ ID NO: 166671 - DNA, 15 bp, Homo sapiens
ggttttcatgaaata

SEQ ID NO: 166672 - DNA, 15 bp, Homo sapiens
aggttttcatgaaat

SEQ ID NO: 166673 - DNA, 15 bp, Homo sapiens
taggttttcatgaaa

SEQ ID NO: 166674 - DNA, 15 bp, Homo sapiens
gtaggttttcatgaa

SEQ ID NO: 166675 - DNA, 15 bp, Homo sapiens
ggtaggttttcatga

SEQ ID NO: 166676 - DNA, 15 bp, Homo sapiens
aggtaggttttcatg

SEQ ID NO: 166677 - DNA, 15 bp, Homo sapiens
aaggtaggttttcat

SEQ ID NO: 166678 - DNA, 15 bp, Homo sapiens
gaaggtaggttttca

SEQ ID NO: 166679 - DNA, 15 bp, Homo sapiens
agaaggtaggttttc

SEQ ID NO: 166680 - DNA, 15 bp, Homo sapiens
gagaaggtaggtttt

SEQ ID NO: 166681 - DNA, 15 bp, Homo sapiens
agagaaggtaggttt

SEQ ID NO: 166682 - DNA, 15 bp, Homo sapiens
tagagaaggtaggtt

SEQ ID NO: 166683 - DNA, 15 bp, Homo sapiens
ttagagaaggtaggt

SEQ ID NO: 166684 - DNA, 15 bp, Homo sapiens
attagagaaggtagg

SEQ ID NO: 166685 - DNA, 15 bp, Homo sapiens
tattagagaaggtag

SEQ ID NO: 166686 - DNA, 15 bp, Homo sapiens
ttattagagaaggta

SEQ ID NO: 166687 - DNA, 15 bp, Homo sapiens
tttattagagaaggt

SEQ ID NO: 166688 - DNA, 15 bp, Homo sapiens
ctttattagagaagg

SEQ ID NO: 166689 - DNA, 15 bp, Homo sapiens
cctttattagagaag

SEQ ID NO: 166690 - DNA, 15 bp, Homo sapiens
acctttattagagaa

SEQ ID NO: 166691 - DNA, 15 bp, Homo sapiens
cacctttattagaga

SEQ ID NO: 166692 - DNA, 15 bp, Homo sapiens
acacctttattagag

SEQ ID NO: 166693 - DNA, 15 bp, Homo sapiens
cacacctttattaga

SEQ ID NO: 166694 - DNA, 15 bp, Homo sapiens
ccacacctttattag

SEQ ID NO: 166695 - DNA, 15 bp, Homo sapiens
accacacctttatta

SEQ ID NO: 166696 - DNA, 15 bp, Homo sapiens
caccacacctttatt

SEQ ID NO: 166697 - DNA, 15 bp, Homo sapiens
tcaccacacctttat

SEQ ID NO: 166698 - DNA, 15 bp, Homo sapiens
ctcaccacaccttta

SEQ ID NO: 166699 - DNA, 15 bp, Homo sapiens
gctcaccacaccttt

SEQ ID NO: 166700 - DNA, 15 bp, Homo sapiens
agctcaccacacctt

SEQ ID NO: 166701 - DNA, 15 bp, Homo sapiens
cagctcaccacacct

SEQ ID NO: 166702 - DNA, 15 bp, Homo sapiens
ccagctcaccacacc

SEQ ID NO: 166703 - DNA, 15 bp, Homo sapiens
cccagctcaccacac

SEQ ID NO: 166704 - DNA, 15 bp, Homo sapiens
ccccagctcaccaca

SEQ ID NO: 166705 - DNA, 15 bp, Homo sapiens
tccccagctcaccac

SEQ ID NO: 166706 - DNA, 15 bp, Homo sapiens
gtccccagctcacca

SEQ ID NO: 166707 - DNA, 15 bp, Homo sapiens
tgtccccagctcacc

SEQ ID NO: 166708 - DNA, 15 bp, Homo sapiens
ttgtccccagctcac

SEQ ID NO: 166709 - DNA, 15 bp, Homo sapiens
cttgtccccagctca

SEQ ID NO: 166710 - DNA, 15 bp, Homo sapiens
tcttgtccccagctc

SEQ ID NO: 166711 - DNA, 15 bp, Homo sapiens
gtcttgtccccagct

SEQ ID NO: 166712 - DNA, 15 bp, Homo sapiens
tgtcttgtccccagc

SEQ ID NO: 166713 - DNA, 15 bp, Homo sapiens
ttgtcttgtccccag

SEQ ID NO: 166714 - DNA, 15 bp, Homo sapiens
gttgtcttgtcccca

SEQ ID NO: 166715 - DNA, 15 bp, Homo sapiens
agttgtcttgtcccc

SEQ ID NO: 166716 - DNA, 15 bp, Homo sapiens
gagttgtcttgtccc

SEQ ID NO: 166717 - DNA, 15 bp, Homo sapiens
agagttgtcttgtcc

SEQ ID NO: 166718 - DNA, 15 bp, Homo sapiens
cagagttgtcttgtc

SEQ ID NO: 166719 - DNA, 15 bp, Homo sapiens
ccagagttgtcttgt

SEQ ID NO: 166720 - DNA, 15 bp, Homo sapiens
cccagagttgtcttg

SEQ ID NO: 166721 - DNA, 15 bp, Homo sapiens
ccccagagttgtctt

SEQ ID NO: 166722 - DNA, 15 bp, Homo sapiens
tccccagagttgtct

SEQ ID NO: 166723 - DNA, 15 bp, Homo sapiens
atccccagagttgtc

SEQ ID NO: 166724 - DNA, 15 bp, Homo sapiens
aatccccagagttgt

SEQ ID NO: 166725 - DNA, 15 bp, Homo sapiens
aaatccccagagttg

SEQ ID NO: 166726 - DNA, 15 bp, Homo sapiens
taaatccccagagtt

SEQ ID NO: 166727 - DNA, 15 bp, Homo sapiens
gtaaatccccagagt

SEQ ID NO: 166728 - DNA, 15 bp, Homo sapiens
ggtaaatccccagag

SEQ ID NO: 166729 - DNA, 15 bp, Homo sapiens
aggtaaatccccaga

SEQ ID NO: 166730 - DNA, 15 bp, Homo sapiens
caggtaaatccccag

SEQ ID NO: 166731 - DNA, 15 bp, Homo sapiens
acaggtaaatcccca

SEQ ID NO: 166732 - DNA, 15 bp, Homo sapiens
aacaggtaaatcccc

SEQ ID NO: 166733 - DNA, 15 bp, Homo sapiens
taacaggtaaatccc

SEQ ID NO: 166734 - DNA, 15 bp, Homo sapiens
ataacaggtaaatcc

SEQ ID NO: 166735 - DNA, 15 bp, Homo sapiens
tataacaggtaaatc

SEQ ID NO: 166736 - DNA, 15 bp, Homo sapiens
ctataacaggtaaat

SEQ ID NO: 166737 - DNA, 15 bp, Homo sapiens
tctataacaggtaaa

SEQ ID NO: 166738 - DNA, 15 bp, Homo sapiens
gtctataacaggtaa

SEQ ID NO: 166739 - DNA, 15 bp, Homo sapiens
tgtctataacaggta

SEQ ID NO: 166740 - DNA, 15 bp, Homo sapiens
ttgtctataacaggt

SEQ ID NO: 166741 - DNA, 15 bp, Homo sapiens
tttgtctataacagg

SEQ ID NO: 166742 - DNA, 15 bp, Homo sapiens
gtttgtctataacag

SEQ ID NO: 166743 - DNA, 15 bp, Homo sapiens
agtttgtctataaca

SEQ ID NO: 166744 - DNA, 15 bp, Homo sapiens
gagtttgtctataac

SEQ ID NO: 166745 - DNA, 15 bp, Homo sapiens
agagtttgtctataa

SEQ ID NO: 166746 - DNA, 15 bp, Homo sapiens
aagagtttgtctata

SEQ ID NO: 166747 - DNA, 15 bp, Homo sapiens
aaagagtttgtctat

SEQ ID NO: 166748 - DNA, 15 bp, Homo sapiens
taaagagtttgtcta

SEQ ID NO: 166749 - DNA, 15 bp, Homo sapiens
gtaaagagtttgtct

SEQ ID NO: 166750 - DNA, 15 bp, Homo sapiens
agtaaagagtttgtc

SEQ ID NO: 166751 - DNA, 15 bp, Homo sapiens
aagtaaagagtttgt

SEQ ID NO: 166752 - DNA, 15 bp, Homo sapiens
aaagtaaagagtttg

SEQ ID NO: 166753 - DNA, 15 bp, Homo sapiens
aaaagtaaagagttt

SEQ ID NO: 166754 - DNA, 15 bp, Homo sapiens
aaaaagtaaagagtt

SEQ ID NO: 166755 - DNA, 15 bp, Homo sapiens
aaaaaagtaaagagt

SEQ ID NO: 166756 - DNA, 15 bp, Homo sapiens
aaaaaaagtaaagag

SEQ ID NO: 166757 - DNA, 15 bp, Homo sapiens
gaaaaaaagtaaaga

SEQ ID NO: 166758 - DNA, 15 bp, Homo sapiens
agaaaaaaagtaaag

SEQ ID NO: 166759 - DNA, 15 bp, Homo sapiens
aagaaaaaaagtaaa

SEQ ID NO: 166760 - DNA, 15 bp, Homo sapiens
aaagaaaaaaagtaa

SEQ ID NO: 166761 - DNA, 15 bp, Homo sapiens
aaaagaaaaaaagta

SEQ ID NO: 166762 - DNA, 15 bp, Homo sapiens
aaaaagaaaaaaagt

SEQ ID NO: 166763 - DNA, 15 bp, Homo sapiens
caaaaagaaaaaaag

SEQ ID NO: 166764 - DNA, 15 bp, Homo sapiens
tcaaaaagaaaaaaa

SEQ ID NO: 166765 - DNA, 15 bp, Homo sapiens
atcaaaaagaaaaaa

SEQ ID NO: 166766 - DNA, 15 bp, Homo sapiens
gatcaaaaagaaaaa

SEQ ID NO: 166767 - DNA, 15 bp, Homo sapiens
agatcaaaaagaaaa

SEQ ID NO: 166768 - DNA, 15 bp, Homo sapiens
cagatcaaaaagaaa

SEQ ID NO: 166769 - DNA, 15 bp, Homo sapiens
ccagatcaaaaagaa

SEQ ID NO: 166770 - DNA, 15 bp, Homo sapiens
gccagatcaaaaaga

SEQ ID NO: 166771 - DNA, 15 bp, Homo sapiens
agccagatcaaaaag

SEQ ID NO: 166772 - DNA, 15 bp, Homo sapiens
cagccagatcaaaaa

SEQ ID NO: 166773 - DNA, 15 bp, Homo sapiens
gcagccagatcaaaa

SEQ ID NO: 166774 - DNA, 15 bp, Homo sapiens
ggcagccagatcaaa

SEQ ID NO: 166775 - DNA, 15 bp, Homo sapiens
aggcagccagatcaa

SEQ ID NO: 166776 - DNA, 15 bp, Homo sapiens
aaggcagccagatca

SEQ ID NO: 166777 - DNA, 15 bp, Homo sapiens
gaaggcagccagatc

SEQ ID NO: 166778 - DNA, 15 bp, Homo sapiens
agaaggcagccagat

SEQ ID NO: 166779 - DNA, 15 bp, Homo sapiens
aagaaggcagccaga

SEQ ID NO: 166780 - DNA, 15 bp, Homo sapiens
caagaaggcagccag

SEQ ID NO: 166781 - DNA, 15 bp, Homo sapiens
ccaagaaggcagcca

SEQ ID NO: 166782 - DNA, 15 bp, Homo sapiens
accaagaaggcagcc

SEQ ID NO: 166783 - DNA, 15 bp, Homo sapiens
caccaagaaggcagc

SEQ ID NO: 166784 - DNA, 15 bp, Homo sapiens
tcaccaagaaggcag

SEQ ID NO: 166785 - DNA, 15 bp, Homo sapiens
atcaccaagaaggca

SEQ ID NO: 166786 - DNA, 15 bp, Homo sapiens
tatcaccaagaaggc

SEQ ID NO: 166787 - DNA, 15 bp, Homo sapiens
atatcaccaagaagg

SEQ ID NO: 166788 - DNA, 15 bp, Homo sapiens
aatatcaccaagaag

SEQ ID NO: 166789 - DNA, 15 bp, Homo sapiens
taatatcaccaagaa

SEQ ID NO: 166790 - DNA, 15 bp, Homo sapiens
gtaatatcaccaaga

SEQ ID NO: 166791 - DNA, 15 bp, Homo sapiens
agtaatatcaccaag

SEQ ID NO: 166792 - DNA, 15 bp, Homo sapiens
tagtaatatcaccaa

SEQ ID NO: 166793 - DNA, 15 bp, Homo sapiens
atagtaatatcacca

SEQ ID NO: 166794 - DNA, 15 bp, Homo sapiens
catagtaatatcacc

SEQ ID NO: 166795 - DNA, 15 bp, Homo sapiens
tcatagtaatatcac

SEQ ID NO: 166796 - DNA, 15 bp, Homo sapiens
ctcatagtaatatca

SEQ ID NO: 166797 - DNA, 15 bp, Homo sapiens
tctcatagtaatatc

SEQ ID NO: 166798 - DNA, 15 bp, Homo sapiens
ttctcatagtaatat

SEQ ID NO: 166799 - DNA, 15 bp, Homo sapiens
attctcatagtaata

SEQ ID NO: 166800 - DNA, 15 bp, Homo sapiens
cattctcatagtaat

SEQ ID NO: 166801 - DNA, 15 bp, Homo sapiens
tcattctcatagtaa

SEQ ID NO: 166802 - DNA, 15 bp, Homo sapiens
ctcattctcatagta

SEQ ID NO: 166803 - DNA, 15 bp, Homo sapiens
cctcattctcatagt

SEQ ID NO: 166804 - DNA, 15 bp, Homo sapiens
tcctcattctcatag

SEQ ID NO: 166805 - DNA, 15 bp, Homo sapiens
ctcctcattctcata

SEQ ID NO: 166806 - DNA, 15 bp, Homo sapiens
cctcctcattctcat

SEQ ID NO: 166807 - DNA, 15 bp, Homo sapiens
ccctcctcattctca

SEQ ID NO: 166808 - DNA, 15 bp, Homo sapiens
tccctcctcattctc

SEQ ID NO: 166809 - DNA, 15 bp, Homo sapiens
ttccctcctcattct

SEQ ID NO: 166810 - DNA, 15 bp, Homo sapiens
attccctcctcattc

SEQ ID NO: 166811 - DNA, 15 bp, Homo sapiens
aattccctcctcatt

SEQ ID NO: 166812 - DNA, 15 bp, Homo sapiens
taattccctcctcat

SEQ ID NO: 166813 - DNA, 15 bp, Homo sapiens
ttaattccctcctca

SEQ ID NO: 166814 - DNA, 15 bp, Homo sapiens
cttaattccctcctc

SEQ ID NO: 166815 - DNA, 15 bp, Homo sapiens
ccttaattccctcct

SEQ ID NO: 166816 - DNA, 15 bp, Homo sapiens
tccttaattccctcc

SEQ ID NO: 166817 - DNA, 15 bp, Homo sapiens
atccttaattccctc

SEQ ID NO: 166818 - DNA, 15 bp, Homo sapiens
aatccttaattccct

SEQ ID NO: 166819 - DNA, 15 bp, Homo sapiens
taatccttaattccc

SEQ ID NO: 166820 - DNA, 15 bp, Homo sapiens
ataatccttaattcc

SEQ ID NO: 166821 - DNA, 15 bp, Homo sapiens
aataatccttaattc

SEQ ID NO: 166822 - DNA, 15 bp, Homo sapiens
caataatccttaatt

SEQ ID NO: 166823 - DNA, 15 bp, Homo sapiens
acaataatccttaat

SEQ ID NO: 166824 - DNA, 15 bp, Homo sapiens
tacaataatccttaa

SEQ ID NO: 166825 - DNA, 15 bp, Homo sapiens
ttacaataatcctta

SEQ ID NO: 166826 - DNA, 15 bp, Homo sapiens
tttacaataatcctt

SEQ ID NO: 166827 - DNA, 15 bp, Homo sapiens
ctttacaataatcct

SEQ ID NO: 166828 - DNA, 15 bp, Homo sapiens
actttacaataatcc

SEQ ID NO: 166829 - DNA, 15 bp, Homo sapiens
cactttacaataatc

SEQ ID NO: 166830 - DNA, 15 bp, Homo sapiens
tcactttacaataat

SEQ ID NO: 166831 - DNA, 15 bp, Homo sapiens
ttcactttacaataa

SEQ ID NO: 166832 - DNA, 15 bp, Homo sapiens
tttcactttacaata

SEQ ID NO: 166833 - DNA, 15 bp, Homo sapiens
atttcactttacaat

SEQ ID NO: 166834 - DNA, 15 bp, Homo sapiens
tatttcactttacaa

SEQ ID NO: 166835 - DNA, 15 bp, Homo sapiens
ctatttcactttaca

SEQ ID NO: 166836 - DNA, 15 bp, Homo sapiens
gctatttcactttac

SEQ ID NO: 166837 - DNA, 15 bp, Homo sapiens
tgctatttcacttta

SEQ ID NO: 166838 - DNA, 15 bp, Homo sapiens
ctgctatttcacttt

SEQ ID NO: 166839 - DNA, 15 bp, Homo sapiens
gctgctatttcactt

SEQ ID NO: 166840 - DNA, 15 bp, Homo sapiens
agctgctatttcact

SEQ ID NO: 166841 - DNA, 15 bp, Homo sapiens
aagctgctatttcac

SEQ ID NO: 166842 - DNA, 15 bp, Homo sapiens
aaagctgctatttca

SEQ ID NO: 166843 - DNA, 15 bp, Homo sapiens
caaagctgctatttc

SEQ ID NO: 166844 - DNA, 15 bp, Homo sapiens
tcaaagctgctattt

SEQ ID NO: 166845 - DNA, 15 bp, Homo sapiens
ctcaaagctgctatt

SEQ ID NO: 166846 - DNA, 15 bp, Homo sapiens
cctcaaagctgctat

SEQ ID NO: 166847 - DNA, 15 bp, Homo sapiens
acctcaaagctgcta

SEQ ID NO: 166848 - DNA, 15 bp, Homo sapiens
gacctcaaagctgct

SEQ ID NO: 166849 - DNA, 15 bp, Homo sapiens
agacctcaaagctgc

SEQ ID NO: 166850 - DNA, 15 bp, Homo sapiens
cagacctcaaagctg

SEQ ID NO: 166851 - DNA, 15 bp, Homo sapiens
tcagacctcaaagct

SEQ ID NO: 166852 - DNA, 15 bp, Homo sapiens
ttcagacctcaaagc

SEQ ID NO: 166853 - DNA, 15 bp, Homo sapiens
tttcagacctcaaag

SEQ ID NO: 166854 - DNA, 15 bp, Homo sapiens
gtttcagacctcaaa

SEQ ID NO: 166855 - DNA, 15 bp, Homo sapiens
tgtttcagacctcaa

SEQ ID NO: 166856 - DNA, 15 bp, Homo sapiens
gtgtttcagacctca

SEQ ID NO: 166857 - DNA, 15 bp, Homo sapiens
agtgtttcagacctc

SEQ ID NO: 166858 - DNA, 15 bp, Homo sapiens
cagtgtttcagacct

SEQ ID NO: 166859 - DNA, 15 bp, Homo sapiens
tcagtgtttcagacc

SEQ ID NO: 166860 - DNA, 15 bp, Homo sapiens
ctcagtgtttcagac

SEQ ID NO: 166861 - DNA, 15 bp, Homo sapiens
cctcagtgtttcaga

SEQ ID NO: 166862 - DNA, 15 bp, Homo sapiens
ccctcagtgtttcag

SEQ ID NO: 166863 - DNA, 15 bp, Homo sapiens
tccctcagtgtttca

SEQ ID NO: 166864 - DNA, 15 bp, Homo sapiens
ctccctcagtgtttc

SEQ ID NO: 166865 - DNA, 15 bp, Homo sapiens
tctccctcagtgttt

SEQ ID NO: 166866 - DNA, 15 bp, Homo sapiens
ttctccctcagtgtt

SEQ ID NO: 166867 - DNA, 15 bp, Homo sapiens
cttctccctcagtgt

SEQ ID NO: 166868 - DNA, 15 bp, Homo sapiens
tcttctccctcagtg

SEQ ID NO: 166869 - DNA, 15 bp, Homo sapiens
ttcttctccctcagt

SEQ ID NO: 166870 - DNA, 15 bp, Homo sapiens
cttcttctccctcag

SEQ ID NO: 166871 - DNA, 15 bp, Homo sapiens
ccttcttctccctca

SEQ ID NO: 166872 - DNA, 15 bp, Homo sapiens
tccttcttctccctc

SEQ ID NO: 166873 - DNA, 15 bp, Homo sapiens
ttccttcttctccct

SEQ ID NO: 166874 - DNA, 15 bp, Homo sapiens
tttccttcttctccc

SEQ ID NO: 166875 - DNA, 15 bp, Homo sapiens
ttttccttcttctcc

SEQ ID NO: 166876 - DNA, 15 bp, Homo sapiens
cttttccttcttctc

SEQ ID NO: 166877 - DNA, 15 bp, Homo sapiens
tcttttccttcttct

SEQ ID NO: 166878 - DNA, 15 bp, Homo sapiens
ttcttttccttcttc

SEQ ID NO: 166879 - DNA, 15 bp, Homo sapiens
cttcttttccttctt

SEQ ID NO: 166880 - DNA, 15 bp, Homo sapiens
tcttcttttccttct

SEQ ID NO: 166881 - DNA, 15 bp, Homo sapiens
ctcttcttttccttc

SEQ ID NO: 166882 - DNA, 15 bp, Homo sapiens
tctcttcttttcctt

SEQ ID NO: 166883 - DNA, 15 bp, Homo sapiens
gtctcttcttttcct

SEQ ID NO: 166884 - DNA, 15 bp, Homo sapiens
tgtctcttcttttcc

SEQ ID NO: 166885 - DNA, 15 bp, Homo sapiens
atgtctcttcttttc

SEQ ID NO: 166886 - DNA, 15 bp, Homo sapiens
catgtctcttctttt

SEQ ID NO: 166887 - DNA, 15 bp, Homo sapiens
ccatgtctcttcttt

SEQ ID NO: 166888 - DNA, 15 bp, Homo sapiens
accatgtctcttctt

SEQ ID NO: 166889 - DNA, 15 bp, Homo sapiens
taccatgtctcttct

SEQ ID NO: 166890 - DNA, 15 bp, Homo sapiens
ttaccatgtctcttc

SEQ ID NO: 166891 - DNA, 15 bp, Homo sapiens
cttaccatgtctctt

SEQ ID NO: 166892 - DNA, 15 bp, Homo sapiens
ccttaccatgtctct

SEQ ID NO: 166893 - DNA, 15 bp, Homo sapiens
tccttaccatgtctc

SEQ ID NO: 166894 - DNA, 15 bp, Homo sapiens
atccttaccatgtct

SEQ ID NO: 166895 - DNA, 15 bp, Homo sapiens
aatccttaccatgtc

SEQ ID NO: 166896 - DNA, 15 bp, Homo sapiens
gaatccttaccatgt

SEQ ID NO: 166897 - DNA, 15 bp, Homo sapiens
agaatccttaccatg

SEQ ID NO: 166898 - DNA, 15 bp, Homo sapiens
tagaatccttaccat

SEQ ID NO: 166899 - DNA, 15 bp, Homo sapiens
ttagaatccttacca

SEQ ID NO: 166900 - DNA, 15 bp, Homo sapiens
cttagaatccttacc

SEQ ID NO: 166901 - DNA, 15 bp, Homo sapiens
ccttagaatccttac

SEQ ID NO: 166902 - DNA, 15 bp, Homo sapiens
tccttagaatcctta

SEQ ID NO: 166903 - DNA, 15 bp, Homo sapiens
ctccttagaatcctt

SEQ ID NO: 166904 - DNA, 15 bp, Homo sapiens
cctccttagaatcct

SEQ ID NO: 166905 - DNA, 15 bp, Homo sapiens
gcctccttagaatcc

SEQ ID NO: 166906 - DNA, 15 bp, Homo sapiens
ggcctccttagaatc

SEQ ID NO: 166907 - DNA, 15 bp, Homo sapiens
aggcctccttagaat

SEQ ID NO: 166908 - DNA, 15 bp, Homo sapiens
caggcctccttagaa

SEQ ID NO: 166909 - DNA, 15 bp, Homo sapiens
tcaggcctccttaga

SEQ ID NO: 166910 - DNA, 15 bp, Homo sapiens
ttcaggcctccttag

SEQ ID NO: 166911 - DNA, 15 bp, Homo sapiens
cttcaggcctcctta

SEQ ID NO: 166912 - DNA, 15 bp, Homo sapiens
tcttcaggcctcctt

SEQ ID NO: 166913 - DNA, 15 bp, Homo sapiens
atcttcaggcctcct

SEQ ID NO: 166914 - DNA, 15 bp, Homo sapiens
tatcttcaggcctcc

SEQ ID NO: 166915 - DNA, 15 bp, Homo sapiens
atatcttcaggcctc

SEQ ID NO: 166916 - DNA, 15 bp, Homo sapiens
gatatcttcaggcct

SEQ ID NO: 166917 - DNA, 15 bp, Homo sapiens
agatatcttcaggcc

SEQ ID NO: 166918 - DNA, 15 bp, Homo sapiens
cagatatcttcaggc

SEQ ID NO: 166919 - DNA, 15 bp, Homo sapiens
ccagatatcttcagg

SEQ ID NO: 166920 - DNA, 15 bp, Homo sapiens
cccagatatcttcag

SEQ ID NO: 166921 - DNA, 15 bp, Homo sapiens
tcccagatatcttca

SEQ ID NO: 166922 - DNA, 15 bp, Homo sapiens
atcccagatatcttc

SEQ ID NO: 166923 - DNA, 15 bp, Homo sapiens
aatcccagatatctt

SEQ ID NO: 166924 - DNA, 15 bp, Homo sapiens
gaatcccagatatct

SEQ ID NO: 166925 - DNA, 15 bp, Homo sapiens
ggaatcccagatatc

SEQ ID NO: 166926 - DNA, 15 bp, Homo sapiens
gggaatcccagatat

SEQ ID NO: 166927 - DNA, 15 bp, Homo sapiens
tgggaatcccagata

SEQ ID NO: 166928 - DNA, 15 bp, Homo sapiens
atgggaatcccagat

SEQ ID NO: 166929 - DNA, 15 bp, Homo sapiens
aatgggaatcccaga

SEQ ID NO: 166930 - DNA, 15 bp, Homo sapiens
gaatgggaatcccag

SEQ ID NO: 166931 - DNA, 15 bp, Homo sapiens
agaatgggaatccca

SEQ ID NO: 166932 - DNA, 15 bp, Homo sapiens
aagaatgggaatccc

SEQ ID NO: 166933 - DNA, 15 bp, Homo sapiens
aaagaatgggaatcc

SEQ ID NO: 166934 - DNA, 15 bp, Homo sapiens
aaaagaatgggaatc

SEQ ID NO: 166935 - DNA, 15 bp, Homo sapiens
aaaaagaatgggaat

SEQ ID NO: 166936 - DNA, 15 bp, Homo sapiens
caaaaagaatgggaa

SEQ ID NO: 166937 - DNA, 15 bp, Homo sapiens
acaaaaagaatggga

SEQ ID NO: 166938 - DNA, 15 bp, Homo sapiens
gacaaaaagaatggg

SEQ ID NO: 166939 - DNA, 15 bp, Homo sapiens
ggacaaaaagaatgg

SEQ ID NO: 166940 - DNA, 15 bp, Homo sapiens
tggacaaaaagaatg

SEQ ID NO: 166941 - DNA, 15 bp, Homo sapiens
gtggacaaaaagaat

SEQ ID NO: 166942 - DNA, 15 bp, Homo sapiens
tgtggacaaaaagaa

SEQ ID NO: 166943 - DNA, 15 bp, Homo sapiens
ctgtggacaaaaaga

SEQ ID NO: 166944 - DNA, 15 bp, Homo sapiens
gctgtggacaaaaag

SEQ ID NO: 166945 - DNA, 15 bp, Homo sapiens
tgctgtggacaaaaa

SEQ ID NO: 166946 - DNA, 15 bp, Homo sapiens
atgctgtggacaaaa

SEQ ID NO: 166947 - DNA, 15 bp, Homo sapiens
tatgctgtggacaaa

SEQ ID NO: 166948 - DNA, 15 bp, Homo sapiens
gtatgctgtggacaa

SEQ ID NO: 166949 - DNA, 15 bp, Homo sapiens
agtatgctgtggaca

SEQ ID NO: 166950 - DNA, 15 bp, Homo sapiens
aagtatgctgtggac

SEQ ID NO: 166951 - DNA, 15 bp, Homo sapiens
taagtatgctgtgga

SEQ ID NO: 166952 - DNA, 15 bp, Homo sapiens
ctaagtatgctgtgg

SEQ ID NO: 166953 - DNA, 15 bp, Homo sapiens
cctaagtatgctgtg

SEQ ID NO: 166954 - DNA, 15 bp, Homo sapiens
acctaagtatgctgt

SEQ ID NO: 166955 - DNA, 15 bp, Homo sapiens
aacctaagtatgctg

SEQ ID NO: 166956 - DNA, 15 bp, Homo sapiens
caacctaagtatgct

SEQ ID NO: 166957 - DNA, 15 bp, Homo sapiens
ccaacctaagtatgc

SEQ ID NO: 166958 - DNA, 15 bp, Homo sapiens
accaacctaagtatg

SEQ ID NO: 166959 - DNA, 15 bp, Homo sapiens
gaccaacctaagtat

SEQ ID NO: 166960 - DNA, 15 bp, Homo sapiens
tgaccaacctaagta

SEQ ID NO: 166961 - DNA, 15 bp, Homo sapiens
ctgaccaacctaagt

SEQ ID NO: 166962 - DNA, 15 bp, Homo sapiens
cctgaccaacctaag

SEQ ID NO: 166963 - DNA, 15 bp, Homo sapiens
acctgaccaacctaa

SEQ ID NO: 166964 - DNA, 15 bp, Homo sapiens
cacctgaccaaccta

SEQ ID NO: 166965 - DNA, 15 bp, Homo sapiens
acacctgaccaacct

SEQ ID NO: 166966 - DNA, 15 bp, Homo sapiens
tacacctgaccaacc

SEQ ID NO: 166967 - DNA, 15 bp, Homo sapiens
ttacacctgaccaac

SEQ ID NO: 166968 - DNA, 15 bp, Homo sapiens
cttacacctgaccaa

SEQ ID NO: 166969 - DNA, 15 bp, Homo sapiens
acttacacctgacca

SEQ ID NO: 166970 - DNA, 15 bp, Homo sapiens
cacttacacctgacc

SEQ ID NO: 166971 - DNA, 15 bp, Homo sapiens
tcacttacacctgac

SEQ ID NO: 166972 - DNA, 15 bp, Homo sapiens
ctcacttacacctga

SEQ ID NO: 166973 - DNA, 15 bp, Homo sapiens
cctcacttacacctg

SEQ ID NO: 166974 - DNA, 15 bp, Homo sapiens
tcctcacttacacct

SEQ ID NO: 166975 - DNA, 15 bp, Homo sapiens
ctcctcacttacacc

SEQ ID NO: 166976 - DNA, 15 bp, Homo sapiens
tctcctcacttacac

SEQ ID NO: 166977 - DNA, 15 bp, Homo sapiens
ctctcctcacttaca

SEQ ID NO: 166978 - DNA, 15 bp, Homo sapiens
gctctcctcacttac

SEQ ID NO: 166979 - DNA, 15 bp, Homo sapiens
agctctcctcactta

SEQ ID NO: 166980 - DNA, 15 bp, Homo sapiens
aagctctcctcactt

SEQ ID NO: 166981 - DNA, 15 bp, Homo sapiens
caagctctcctcact

SEQ ID NO: 166982 - DNA, 15 bp, Homo sapiens
gcaagctctcctcac

SEQ ID NO: 166983 - DNA, 15 bp, Homo sapiens
tgcaagctctcctca

SEQ ID NO: 166984 - DNA, 15 bp, Homo sapiens
atgcaagctctcctc

SEQ ID NO: 166985 - DNA, 15 bp, Homo sapiens
tatgcaagctctcct

SEQ ID NO: 166986 - DNA, 15 bp, Homo sapiens
ctatgcaagctctcc

SEQ ID NO: 166987 - DNA, 15 bp, Homo sapiens
actatgcaagctctc

SEQ ID NO: 166988 - DNA, 15 bp, Homo sapiens
tactatgcaagctct

SEQ ID NO: 166989 - DNA, 15 bp, Homo sapiens
ttactatgcaagctc

SEQ ID NO: 166990 - DNA, 15 bp, Homo sapiens
cttactatgcaagct

SEQ ID NO: 166991 - DNA, 15 bp, Homo sapiens
tcttactatgcaagc

SEQ ID NO: 166992 - DNA, 15 bp, Homo sapiens
ctcttactatgcaag

SEQ ID NO: 166993 - DNA, 15 bp, Homo sapiens
gctcttactatgcaa

SEQ ID NO: 166994 - DNA, 15 bp, Homo sapiens
tgctcttactatgca

SEQ ID NO: 166995 - DNA, 15 bp, Homo sapiens
ctgctcttactatgc

SEQ ID NO: 166996 - DNA, 15 bp, Homo sapiens
gctgctcttactatg

SEQ ID NO: 166997 - DNA, 15 bp, Homo sapiens
agctgctcttactat

SEQ ID NO: 166998 - DNA, 15 bp, Homo sapiens
gagctgctcttacta

SEQ ID NO: 166999 - DNA, 15 bp, Homo sapiens
ggagctgctcttact

SEQ ID NO: 167000 - DNA, 15 bp, Homo sapiens
tggagctgctcttac

SEQ ID NO: 167001 - DNA, 15 bp, Homo sapiens
ctggagctgctctta

SEQ ID NO: 167002 - DNA, 15 bp, Homo sapiens
actggagctgctctt

SEQ ID NO: 167003 - DNA, 15 bp, Homo sapiens
cactggagctgctct

SEQ ID NO: 167004 - DNA, 15 bp, Homo sapiens
acactggagctgctc

SEQ ID NO: 167005 - DNA, 15 bp, Homo sapiens
cacactggagctgct

SEQ ID NO: 167006 - DNA, 15 bp, Homo sapiens
ccacactggagctgc

SEQ ID NO: 167007 - DNA, 15 bp, Homo sapiens
accacactggagctg

SEQ ID NO: 167008 - DNA, 15 bp, Homo sapiens
taccacactggagct

SEQ ID NO: 167009 - DNA, 15 bp, Homo sapiens
ataccacactggagc

SEQ ID NO: 167010 - DNA, 15 bp, Homo sapiens
aataccacactggag

SEQ ID NO: 167011 - DNA, 15 bp, Homo sapiens
taataccacactgga

SEQ ID NO: 167012 - DNA, 15 bp, Homo sapiens
ctaataccacactgg

SEQ ID NO: 167013 - DNA, 15 bp, Homo sapiens
actaataccacactg

SEQ ID NO: 167014 - DNA, 15 bp, Homo sapiens
tactaataccacact

SEQ ID NO: 167015 - DNA, 15 bp, Homo sapiens
ctactaataccacac

SEQ ID NO: 167016 - DNA, 15 bp, Homo sapiens
cctactaataccaca

SEQ ID NO: 167017 - DNA, 15 bp, Homo sapiens
ccctactaataccac

SEQ ID NO: 167018 - DNA, 15 bp, Homo sapiens
accctactaatacca

SEQ ID NO: 167019 - DNA, 15 bp, Homo sapiens
aaccctactaatacc

SEQ ID NO: 167020 - DNA, 15 bp, Homo sapiens
taaccctactaatac

SEQ ID NO: 167021 - DNA, 15 bp, Homo sapiens
ttaaccctactaata

SEQ ID NO: 167022 - DNA, 15 bp, Homo sapiens
attaaccctactaat

SEQ ID NO: 167023 - DNA, 15 bp, Homo sapiens
cattaaccctactaa

SEQ ID NO: 167024 - DNA, 15 bp, Homo sapiens
tcattaaccctacta

SEQ ID NO: 167025 - DNA, 15 bp, Homo sapiens
atcattaaccctact

SEQ ID NO: 167026 - DNA, 15 bp, Homo sapiens
aatcattaaccctac

SEQ ID NO: 167027 - DNA, 15 bp, Homo sapiens
caatcattaacccta

SEQ ID NO: 167028 - DNA, 15 bp, Homo sapiens
tcaatcattaaccct

SEQ ID NO: 167029 - DNA, 15 bp, Homo sapiens
ctcaatcattaaccc

SEQ ID NO: 167030 - DNA, 15 bp, Homo sapiens
actcaatcattaacc

SEQ ID NO: 167031 - DNA, 15 bp, Homo sapiens
cactcaatcattaac

SEQ ID NO: 167032 - DNA, 15 bp, Homo sapiens
acactcaatcattaa

SEQ ID NO: 167033 - DNA, 15 bp, Homo sapiens
cacactcaatcatta

SEQ ID NO: 167034 - DNA, 15 bp, Homo sapiens
acacactcaatcatt

SEQ ID NO: 167035 - DNA, 15 bp, Homo sapiens
cacacactcaatcat

SEQ ID NO: 167036 - DNA, 15 bp, Homo sapiens
tcacacactcaatca

SEQ ID NO: 167037 - DNA, 15 bp, Homo sapiens
atcacacactcaatc

SEQ ID NO: 167038 - DNA, 15 bp, Homo sapiens
aatcacacactcaat

SEQ ID NO: 167039 - DNA, 15 bp, Homo sapiens
aaatcacacactcaa

SEQ ID NO: 167040 - DNA, 15 bp, Homo sapiens
taaatcacacactca

SEQ ID NO: 167041 - DNA, 15 bp, Homo sapiens
gtaaatcacacactc

SEQ ID NO: 167042 - DNA, 15 bp, Homo sapiens
tgtaaatcacacact

SEQ ID NO: 167043 - DNA, 15 bp, Homo sapiens
ctgtaaatcacacac

SEQ ID NO: 167044 - DNA, 15 bp, Homo sapiens
actgtaaatcacaca

SEQ ID NO: 167045 - DNA, 15 bp, Homo sapiens
tactgtaaatcacac

SEQ ID NO: 167046 - DNA, 15 bp, Homo sapiens
atactgtaaatcaca

SEQ ID NO: 167047 - DNA, 15 bp, Homo sapiens
aatactgtaaatcac

SEQ ID NO: 167048 - DNA, 15 bp, Homo sapiens
caatactgtaaatca

SEQ ID NO: 167049 - DNA, 15 bp, Homo sapiens
ccaatactgtaaatc

SEQ ID NO: 167050 - DNA, 15 bp, Homo sapiens
tccaatactgtaaat

SEQ ID NO: 167051 - DNA, 15 bp, Homo sapiens
atccaatactgtaaa

SEQ ID NO: 167052 - DNA, 15 bp, Homo sapiens
gatccaatactgtaa

SEQ ID NO: 167053 - DNA, 15 bp, Homo sapiens
agatccaatactgta

SEQ ID NO: 167054 - DNA, 15 bp, Homo sapiens
tagatccaatactgt

SEQ ID NO: 167055 - DNA, 15 bp, Homo sapiens
ttagatccaatactg

SEQ ID NO: 167056 - DNA, 15 bp, Homo sapiens
cttagatccaatact

SEQ ID NO: 167057 - DNA, 15 bp, Homo sapiens
ccttagatccaatac

SEQ ID NO: 167058 - DNA, 15 bp, Homo sapiens
cccttagatccaata

SEQ ID NO: 167059 - DNA, 15 bp, Homo sapiens
acccttagatccaat

SEQ ID NO: 167060 - DNA, 15 bp, Homo sapiens
tacccttagatccaa

SEQ ID NO: 167061 - DNA, 15 bp, Homo sapiens
atacccttagatcca

SEQ ID NO: 167062 - DNA, 15 bp, Homo sapiens
gatacccttagatcc

SEQ ID NO: 167063 - DNA, 15 bp, Homo sapiens
tgatacccttagatc

SEQ ID NO: 167064 - DNA, 15 bp, Homo sapiens
atgatacccttagat

SEQ ID NO: 167065 - DNA, 15 bp, Homo sapiens
catgatacccttaga

SEQ ID NO: 167066 - DNA, 15 bp, Homo sapiens
tcatgatacccttag

SEQ ID NO: 167067 - DNA, 15 bp, Homo sapiens
ttcatgataccctta

SEQ ID NO: 167068 - DNA, 15 bp, Homo sapiens
cttcatgataccctt

SEQ ID NO: 167069 - DNA, 15 bp, Homo sapiens
acttcatgataccct

SEQ ID NO: 167070 - DNA, 15 bp, Homo sapiens
gacttcatgataccc

SEQ ID NO: 167071 - DNA, 15 bp, Homo sapiens
tgacttcatgatacc

SEQ ID NO: 167072 - DNA, 15 bp, Homo sapiens
ctgacttcatgatac

SEQ ID NO: 167073 - DNA, 15 bp, Homo sapiens
tctgacttcatgata

SEQ ID NO: 167074 - DNA, 15 bp, Homo sapiens
gtctgacttcatgat

SEQ ID NO: 167075 - DNA, 15 bp, Homo sapiens
agtctgacttcatga

SEQ ID NO: 167076 - DNA, 15 bp, Homo sapiens
cagtctgacttcatg

SEQ ID NO: 167077 - DNA, 15 bp, Homo sapiens
acagtctgacttcat

SEQ ID NO: 167078 - DNA, 15 bp, Homo sapiens
tacagtctgacttca

SEQ ID NO: 167079 - DNA, 15 bp, Homo sapiens
ttacagtctgacttc

SEQ ID NO: 167080 - DNA, 15 bp, Homo sapiens
gttacagtctgactt

SEQ ID NO: 167081 - DNA, 15 bp, Homo sapiens
ggttacagtctgact

SEQ ID NO: 167082 - DNA, 15 bp, Homo sapiens
aggttacagtctgac

SEQ ID NO: 167083 - DNA, 15 bp, Homo sapiens
aaggttacagtctga

SEQ ID NO: 167084 - DNA, 15 bp, Homo sapiens
caaggttacagtctg

SEQ ID NO: 167085 - DNA, 15 bp, Homo sapiens
ccaaggttacagtct

SEQ ID NO: 167086 - DNA, 15 bp, Homo sapiens
tccaaggttacagtc

SEQ ID NO: 167087 - DNA, 15 bp, Homo sapiens
gtccaaggttacagt

SEQ ID NO: 167088 - DNA, 15 bp, Homo sapiens
tgtccaaggttacag

SEQ ID NO: 167089 - DNA, 15 bp, Homo sapiens
ttgtccaaggttaca

SEQ ID NO: 167090 - DNA, 15 bp, Homo sapiens
tttgtccaaggttac

SEQ ID NO: 167091 - DNA, 15 bp, Homo sapiens
gtttgtccaaggtta

SEQ ID NO: 167092 - DNA, 15 bp, Homo sapiens
agtttgtccaaggtt

SEQ ID NO: 167093 - DNA, 15 bp, Homo sapiens
tagtttgtccaaggt

SEQ ID NO: 167094 - DNA, 15 bp, Homo sapiens
ctagtttgtccaagg

SEQ ID NO: 167095 - DNA, 15 bp, Homo sapiens
actagtttgtccaag

SEQ ID NO: 167096 - DNA, 15 bp, Homo sapiens
aactagtttgtccaa

SEQ ID NO: 167097 - DNA, 15 bp, Homo sapiens
taactagtttgtcca

SEQ ID NO: 167098 - DNA, 15 bp, Homo sapiens
ttaactagtttgtcc

SEQ ID NO: 167099 - DNA, 15 bp, Homo sapiens
gttaactagtttgtc

SEQ ID NO: 167100 - DNA, 15 bp, Homo sapiens
ggttaactagtttgt

SEQ ID NO: 167101 - DNA, 15 bp, Homo sapiens
aggttaactagtttg

SEQ ID NO: 167102 - DNA, 15 bp, Homo sapiens
gaggttaactagttt

SEQ ID NO: 167103 - DNA, 15 bp, Homo sapiens
agaggttaactagtt

SEQ ID NO: 167104 - DNA, 15 bp, Homo sapiens
aagaggttaactagt

SEQ ID NO: 167105 - DNA, 15 bp, Homo sapiens
aaagaggttaactag

SEQ ID NO: 167106 - DNA, 15 bp, Homo sapiens
caaagaggttaacta

SEQ ID NO: 167107 - DNA, 15 bp, Homo sapiens
ccaaagaggttaact

SEQ ID NO: 167108 - DNA, 15 bp, Homo sapiens
cccaaagaggttaac

SEQ ID NO: 167109 - DNA, 15 bp, Homo sapiens
gcccaaagaggttaa

SEQ ID NO: 167110 - DNA, 15 bp, Homo sapiens
ggcccaaagaggtta

SEQ ID NO: 167111 - DNA, 15 bp, Homo sapiens
gggcccaaagaggtt

SEQ ID NO: 167112 - DNA, 15 bp, Homo sapiens
ggggcccaaagaggt

SEQ ID NO: 167113 - DNA, 15 bp, Homo sapiens
tggggcccaaagagg

SEQ ID NO: 167114 - DNA, 15 bp, Homo sapiens
ctggggcccaaagag

SEQ ID NO: 167115 - DNA, 15 bp, Homo sapiens
actggggcccaaaga

SEQ ID NO: 167116 - DNA, 15 bp, Homo sapiens
gactggggcccaaag

SEQ ID NO: 167117 - DNA, 15 bp, Homo sapiens
agactggggcccaaa

SEQ ID NO: 167118 - DNA, 15 bp, Homo sapiens
gagactggggcccaa

SEQ ID NO: 167119 - DNA, 15 bp, Homo sapiens
agagactggggccca

SEQ ID NO: 167120 - DNA, 15 bp, Homo sapiens
gagagactggggccc

SEQ ID NO: 167121 - DNA, 15 bp, Homo sapiens
ggagagactggggcc

SEQ ID NO: 167122 - DNA, 15 bp, Homo sapiens
tggagagactggggc

SEQ ID NO: 167123 - DNA, 15 bp, Homo sapiens
atggagagactgggg

SEQ ID NO: 167124 - DNA, 15 bp, Homo sapiens
gatggagagactggg

SEQ ID NO: 167125 - DNA, 15 bp, Homo sapiens
agatggagagactgg

SEQ ID NO: 167126 - DNA, 15 bp, Homo sapiens
tagatggagagactg

SEQ ID NO: 167127 - DNA, 15 bp, Homo sapiens
gtagatggagagact

SEQ ID NO: 167128 - DNA, 15 bp, Homo sapiens
tgtagatggagagac

SEQ ID NO: 167129 - DNA, 15 bp, Homo sapiens
ttgtagatggagaga

SEQ ID NO: 167130 - DNA, 15 bp, Homo sapiens
tttgtagatggagag

SEQ ID NO: 167131 - DNA, 15 bp, Homo sapiens
ttttgtagatggaga

SEQ ID NO: 167132 - DNA, 15 bp, Homo sapiens
attttgtagatggag

SEQ ID NO: 167133 - DNA, 15 bp, Homo sapiens
cattttgtagatgga

SEQ ID NO: 167134 - DNA, 15 bp, Homo sapiens
tcattttgtagatgg

SEQ ID NO: 167135 - DNA, 15 bp, Homo sapiens
ctcattttgtagatg

SEQ ID NO: 167136 - DNA, 15 bp, Homo sapiens
tctcattttgtagat

SEQ ID NO: 167137 - DNA, 15 bp, Homo sapiens
ctctcattttgtaga

SEQ ID NO: 167138 - DNA, 15 bp, Homo sapiens
actctcattttgtag

SEQ ID NO: 167139 - DNA, 15 bp, Homo sapiens
tactctcattttgta

SEQ ID NO: 167140 - DNA, 15 bp, Homo sapiens
ttactctcattttgt

SEQ ID NO: 167141 - DNA, 15 bp, Homo sapiens
attactctcattttg

SEQ ID NO: 167142 - DNA, 15 bp, Homo sapiens
aattactctcatttt

SEQ ID NO: 167143 - DNA, 15 bp, Homo sapiens
taattactctcattt

SEQ ID NO: 167144 - DNA, 15 bp, Homo sapiens
ttaattactctcatt

SEQ ID NO: 167145 - DNA, 15 bp, Homo sapiens
attaattactctcat

SEQ ID NO: 167146 - DNA, 15 bp, Homo sapiens
cattaattactctca

SEQ ID NO: 167147 - DNA, 15 bp, Homo sapiens
ccattaattactctc

SEQ ID NO: 167148 - DNA, 15 bp, Homo sapiens
accattaattactct

SEQ ID NO: 167149 - DNA, 15 bp, Homo sapiens
caccattaattactc

SEQ ID NO: 167150 - DNA, 15 bp, Homo sapiens
ccaccattaattact

SEQ ID NO: 167151 - DNA, 15 bp, Homo sapiens
accaccattaattac

SEQ ID NO: 167152 - DNA, 15 bp, Homo sapiens
taccaccattaatta

SEQ ID NO: 167153 - DNA, 15 bp, Homo sapiens
ataccaccattaatt

SEQ ID NO: 167154 - DNA, 15 bp, Homo sapiens
aataccaccattaat

SEQ ID NO: 167155 - DNA, 15 bp, Homo sapiens
taataccaccattaa

SEQ ID NO: 167156 - DNA, 15 bp, Homo sapiens
gtaataccaccatta

SEQ ID NO: 167157 - DNA, 15 bp, Homo sapiens
ggtaataccaccatt

SEQ ID NO: 167158 - DNA, 15 bp, Homo sapiens
aggtaataccaccat

SEQ ID NO: 167159 - DNA, 15 bp, Homo sapiens
gaggtaataccacca

SEQ ID NO: 167160 - DNA, 15 bp, Homo sapiens
agaggtaataccacc

SEQ ID NO: 167161 - DNA, 15 bp, Homo sapiens
aagaggtaataccac

SEQ ID NO: 167162 - DNA, 15 bp, Homo sapiens
taagaggtaatacca

SEQ ID NO: 167163 - DNA, 15 bp, Homo sapiens
ctaagaggtaatacc

SEQ ID NO: 167164 - DNA, 15 bp, Homo sapiens
cctaagaggtaatac

SEQ ID NO: 167165 - DNA, 15 bp, Homo sapiens
ccctaagaggtaata

SEQ ID NO: 167166 - DNA, 15 bp, Homo sapiens
accctaagaggtaat

SEQ ID NO: 167167 - DNA, 15 bp, Homo sapiens
aaccctaagaggtaa

SEQ ID NO: 167168 - DNA, 15 bp, Homo sapiens
caaccctaagaggta

SEQ ID NO: 167169 - DNA, 15 bp, Homo sapiens
acaaccctaagaggt

SEQ ID NO: 167170 - DNA, 15 bp, Homo sapiens
aacaaccctaagagg

SEQ ID NO: 167171 - DNA, 15 bp, Homo sapiens
caacaaccctaagag

SEQ ID NO: 167172 - DNA, 15 bp, Homo sapiens
acaacaaccctaaga

SEQ ID NO: 167173 - DNA, 15 bp, Homo sapiens
gacaacaaccctaag

SEQ ID NO: 167174 - DNA, 15 bp, Homo sapiens
tgacaacaaccctaa

SEQ ID NO: 167175 - DNA, 15 bp, Homo sapiens
ttgacaacaacccta

SEQ ID NO: 167176 - DNA, 15 bp, Homo sapiens
cttgacaacaaccct

SEQ ID NO: 167177 - DNA, 15 bp, Homo sapiens
tcttgacaacaaccc

SEQ ID NO: 167178 - DNA, 15 bp, Homo sapiens
atcttgacaacaacc

SEQ ID NO: 167179 - DNA, 15 bp, Homo sapiens
aatcttgacaacaac

SEQ ID NO: 167180 - DNA, 15 bp, Homo sapiens
taatcttgacaacaa

SEQ ID NO: 167181 - DNA, 15 bp, Homo sapiens
ttaatcttgacaaca

SEQ ID NO: 167182 - DNA, 15 bp, Homo sapiens
tttaatcttgacaac

SEQ ID NO: 167183 - DNA, 15 bp, Homo sapiens
atttaatcttgacaa

SEQ ID NO: 167184 - DNA, 15 bp, Homo sapiens
catttaatcttgaca

SEQ ID NO: 167185 - DNA, 15 bp, Homo sapiens
tcatttaatcttgac

SEQ ID NO: 167186 - DNA, 15 bp, Homo sapiens
ctcatttaatcttga

SEQ ID NO: 167187 - DNA, 15 bp, Homo sapiens
gctcatttaatcttg

SEQ ID NO: 167188 - DNA, 15 bp, Homo sapiens
agctcatttaatctt

SEQ ID NO: 167189 - DNA, 15 bp, Homo sapiens
tagctcatttaatct

SEQ ID NO: 167190 - DNA, 15 bp, Homo sapiens
atagctcatttaatc

SEQ ID NO: 167191 - DNA, 15 bp, Homo sapiens
aatagctcatttaat

SEQ ID NO: 167192 - DNA, 15 bp, Homo sapiens
taatagctcatttaa

SEQ ID NO: 167193 - DNA, 15 bp, Homo sapiens
gtaatagctcattta

SEQ ID NO: 167194 - DNA, 15 bp, Homo sapiens
tgtaatagctcattt

SEQ ID NO: 167195 - DNA, 15 bp, Homo sapiens
ctgtaatagctcatt

SEQ ID NO: 167196 - DNA, 15 bp, Homo sapiens
cctgtaatagctcat

SEQ ID NO: 167197 - DNA, 15 bp, Homo sapiens
acctgtaatagctca

SEQ ID NO: 167198 - DNA, 15 bp, Homo sapiens
tacctgtaatagctc

SEQ ID NO: 167199 - DNA, 15 bp, Homo sapiens
ttacctgtaatagct

SEQ ID NO: 167200 - DNA, 15 bp, Homo sapiens
tttacctgtaatagc

SEQ ID NO: 167201 - DNA, 15 bp, Homo sapiens
ctttacctgtaatag

SEQ ID NO: 167202 - DNA, 15 bp, Homo sapiens
actttacctgtaata

SEQ ID NO: 167203 - DNA, 15 bp, Homo sapiens
cactttacctgtaat

SEQ ID NO: 167204 - DNA, 15 bp, Homo sapiens
gcactttacctgtaa

SEQ ID NO: 167205 - DNA, 15 bp, Homo sapiens
agcactttacctgta

SEQ ID NO: 167206 - DNA, 15 bp, Homo sapiens
aagcactttacctgt

SEQ ID NO: 167207 - DNA, 15 bp, Homo sapiens
taagcactttacctg

SEQ ID NO: 167208 - DNA, 15 bp, Homo sapiens
ctaagcactttacct

SEQ ID NO: 167209 - DNA, 15 bp, Homo sapiens
tctaagcactttacc

SEQ ID NO: 167210 - DNA, 15 bp, Homo sapiens
ttctaagcactttac

SEQ ID NO: 167211 - DNA, 15 bp, Homo sapiens
tttctaagcacttta

SEQ ID NO: 167212 - DNA, 15 bp, Homo sapiens
ttttctaagcacttt

SEQ ID NO: 167213 - DNA, 15 bp, Homo sapiens
tttttctaagcactt

SEQ ID NO: 167214 - DNA, 15 bp, Homo sapiens
gtttttctaagcact

SEQ ID NO: 167215 - DNA, 15 bp, Homo sapiens
cgtttttctaagcac

SEQ ID NO: 167216 - DNA, 15 bp, Homo sapiens
gcgtttttctaagca

SEQ ID NO: 167217 - DNA, 15 bp, Homo sapiens
ggcgtttttctaagc

SEQ ID NO: 167218 - DNA, 15 bp, Homo sapiens
aggcgtttttctaag

SEQ ID NO: 167219 - DNA, 15 bp, Homo sapiens
taggcgtttttctaa

SEQ ID NO: 167220 - DNA, 15 bp, Homo sapiens
ataggcgtttttcta

SEQ ID NO: 167221 - DNA, 15 bp, Homo sapiens
aataggcgtttttct

SEQ ID NO: 167222 - DNA, 15 bp, Homo sapiens
aaataggcgtttttc

SEQ ID NO: 167223 - DNA, 15 bp, Homo sapiens
caaataggcgttttt

SEQ ID NO: 167224 - DNA, 15 bp, Homo sapiens
acaaataggcgtttt

SEQ ID NO: 167225 - DNA, 15 bp, Homo sapiens
tacaaataggcgttt

SEQ ID NO: 167226 - DNA, 15 bp, Homo sapiens
ttacaaataggcgtt

SEQ ID NO: 167227 - DNA, 15 bp, Homo sapiens
attacaaataggcgt

SEQ ID NO: 167228 - DNA, 15 bp, Homo sapiens
tattacaaataggcg

SEQ ID NO: 167229 - DNA, 15 bp, Homo sapiens
atattacaaataggc

SEQ ID NO: 167230 - DNA, 15 bp, Homo sapiens
aatattacaaatagg

SEQ ID NO: 167231 - DNA, 15 bp, Homo sapiens
gaatattacaaatag

SEQ ID NO: 167232 - DNA, 15 bp, Homo sapiens
tgaatattacaaata

SEQ ID NO: 167233 - DNA, 15 bp, Homo sapiens
atgaatattacaaat

SEQ ID NO: 167234 - DNA, 15 bp, Homo sapiens
aatgaatattacaaa

SEQ ID NO: 167235 - DNA, 15 bp, Homo sapiens
aaatgaatattacaa

SEQ ID NO: 167236 - DNA, 15 bp, Homo sapiens
aaaatgaatattaca

SEQ ID NO: 167237 - DNA, 15 bp, Homo sapiens
aaaaatgaatattac

SEQ ID NO: 167238 - DNA, 15 bp, Homo sapiens
taaaaatgaatatta

SEQ ID NO: 167239 - DNA, 15 bp, Homo sapiens
gtaaaaatgaatatt

SEQ ID NO: 167240 - DNA, 15 bp, Homo sapiens
agtaaaaatgaatat

SEQ ID NO: 167241 - DNA, 15 bp, Homo sapiens
tagtaaaaatgaata

SEQ ID NO: 167242 - DNA, 15 bp, Homo sapiens
ttagtaaaaatgaat

SEQ ID NO: 167243 - DNA, 15 bp, Homo sapiens
attagtaaaaatgaa

SEQ ID NO: 167244 - DNA, 15 bp, Homo sapiens
tattagtaaaaatga

SEQ ID NO: 167245 - DNA, 15 bp, Homo sapiens
ttattagtaaaaatg

SEQ ID NO: 167246 - DNA, 15 bp, Homo sapiens
gttattagtaaaaat

SEQ ID NO: 167247 - DNA, 15 bp, Homo sapiens
agttattagtaaaaa

SEQ ID NO: 167248 - DNA, 15 bp, Homo sapiens
cagttattagtaaaa

SEQ ID NO: 167249 - DNA, 15 bp, Homo sapiens
acagttattagtaaa

SEQ ID NO: 167250 - DNA, 15 bp, Homo sapiens
aacagttattagtaa

SEQ ID NO: 167251 - DNA, 15 bp, Homo sapiens
taacagttattagta

SEQ ID NO: 167252 - DNA, 15 bp, Homo sapiens
ataacagttattagt

SEQ ID NO: 167253 - DNA, 15 bp, Homo sapiens
aataacagttattag

SEQ ID NO: 167254 - DNA, 15 bp, Homo sapiens
taataacagttatta

SEQ ID NO: 167255 - DNA, 15 bp, Homo sapiens
ctaataacagttatt

SEQ ID NO: 167256 - DNA, 15 bp, Homo sapiens
cctaataacagttat

SEQ ID NO: 167257 - DNA, 15 bp, Homo sapiens
tcctaataacagtta

SEQ ID NO: 167258 - DNA, 15 bp, Homo sapiens
ctcctaataacagtt

SEQ ID NO: 167259 - DNA, 15 bp, Homo sapiens
actcctaataacagt

SEQ ID NO: 167260 - DNA, 15 bp, Homo sapiens
cactcctaataacag

SEQ ID NO: 167261 - DNA, 15 bp, Homo sapiens
ccactcctaataaca

SEQ ID NO: 167262 - DNA, 15 bp, Homo sapiens
cccactcctaataac

SEQ ID NO: 167263 - DNA, 15 bp, Homo sapiens
tcccactcctaataa

SEQ ID NO: 167264 - DNA, 15 bp, Homo sapiens
ttcccactcctaata

SEQ ID NO: 167265 - DNA, 15 bp, Homo sapiens
attcccactcctaat

SEQ ID NO: 167266 - DNA, 15 bp, Homo sapiens
tattcccactcctaa

SEQ ID NO: 167267 - DNA, 15 bp, Homo sapiens
ctattcccactccta

SEQ ID NO: 167268 - DNA, 15 bp, Homo sapiens
gctattcccactcct

SEQ ID NO: 167269 - DNA, 15 bp, Homo sapiens
tgctattcccactcc

SEQ ID NO: 167270 - DNA, 15 bp, Homo sapiens
ttgctattcccactc

SEQ ID NO: 167271 - DNA, 15 bp, Homo sapiens
attgctattcccact

SEQ ID NO: 167272 - DNA, 15 bp, Homo sapiens
aattgctattcccac

SEQ ID NO: 167273 - DNA, 15 bp, Homo sapiens
aaattgctattccca

SEQ ID NO: 167274 - DNA, 15 bp, Homo sapiens
gaaattgctattccc

SEQ ID NO: 167275 - DNA, 15 bp, Homo sapiens
tgaaattgctattcc

SEQ ID NO: 167276 - DNA, 15 bp, Homo sapiens
ctgaaattgctattc

SEQ ID NO: 167277 - DNA, 15 bp, Homo sapiens
actgaaattgctatt

SEQ ID NO: 167278 - DNA, 15 bp, Homo sapiens
cactgaaattgctat

SEQ ID NO: 167279 - DNA, 15 bp, Homo sapiens
tcactgaaattgcta

SEQ ID NO: 167280 - DNA, 15 bp, Homo sapiens
ctcactgaaattgct

SEQ ID NO: 167281 - DNA, 15 bp, Homo sapiens
actcactgaaattgc

SEQ ID NO: 167282 - DNA, 15 bp, Homo sapiens
aactcactgaaattg

SEQ ID NO: 167283 - DNA, 15 bp, Homo sapiens
taactcactgaaatt

SEQ ID NO: 167284 - DNA, 15 bp, Homo sapiens
ataactcactgaaat

SEQ ID NO: 167285 - DNA, 15 bp, Homo sapiens
tataactcactgaaa

SEQ ID NO: 167286 - DNA, 15 bp, Homo sapiens
ttataactcactgaa

SEQ ID NO: 167287 - DNA, 15 bp, Homo sapiens
tttataactcactga

SEQ ID NO: 167288 - DNA, 15 bp, Homo sapiens
ttttataactcactg

SEQ ID NO: 167289 - DNA, 15 bp, Homo sapiens
gttttataactcact

SEQ ID NO: 167290 - DNA, 15 bp, Homo sapiens
tgttttataactcac

SEQ ID NO: 167291 - DNA, 15 bp, Homo sapiens
atgttttataactca

SEQ ID NO: 167292 - DNA, 15 bp, Homo sapiens
aatgttttataactc

SEQ ID NO: 167293 - DNA, 15 bp, Homo sapiens
caatgttttataact

SEQ ID NO: 167294 - DNA, 15 bp, Homo sapiens
tcaatgttttataac

SEQ ID NO: 167295 - DNA, 15 bp, Homo sapiens
atcaatgttttataa

SEQ ID NO: 167296 - DNA, 15 bp, Homo sapiens
aatcaatgttttata

SEQ ID NO: 167297 - DNA, 15 bp, Homo sapiens
taatcaatgttttat

SEQ ID NO: 167298 - DNA, 15 bp, Homo sapiens
ataatcaatgtttta

SEQ ID NO: 167299 - DNA, 15 bp, Homo sapiens
cataatcaatgtttt

SEQ ID NO: 167300 - DNA, 15 bp, Homo sapiens
tcataatcaatgttt

SEQ ID NO: 167301 - DNA, 15 bp, Homo sapiens
ttcataatcaatgtt

SEQ ID NO: 167302 - DNA, 15 bp, Homo sapiens
gttcataatcaatgt

SEQ ID NO: 167303 - DNA, 15 bp, Homo sapiens
ggttcataatcaatg

SEQ ID NO: 167304 - DNA, 15 bp, Homo sapiens
tggttcataatcaat

SEQ ID NO: 167305 - DNA, 15 bp, Homo sapiens
atggttcataatcaa

SEQ ID NO: 167306 - DNA, 15 bp, Homo sapiens
aatggttcataatca

SEQ ID NO: 167307 - DNA, 15 bp, Homo sapiens
aaatggttcataatc

SEQ ID NO: 167308 - DNA, 15 bp, Homo sapiens
aaaatggttcataat

SEQ ID NO: 167309 - DNA, 15 bp, Homo sapiens
taaaatggttcataa

SEQ ID NO: 167310 - DNA, 15 bp, Homo sapiens
ctaaaatggttcata

SEQ ID NO: 167311 - DNA, 15 bp, Homo sapiens
tctaaaatggttcat

SEQ ID NO: 167312 - DNA, 15 bp, Homo sapiens
ctctaaaatggttca

SEQ ID NO: 167313 - DNA, 15 bp, Homo sapiens
tctctaaaatggttc

SEQ ID NO: 167314 - DNA, 15 bp, Homo sapiens
ttctctaaaatggtt

SEQ ID NO: 167315 - DNA, 15 bp, Homo sapiens
gttctctaaaatggt

SEQ ID NO: 167316 - DNA, 15 bp, Homo sapiens
cgttctctaaaatgg

SEQ ID NO: 167317 - DNA, 15 bp, Homo sapiens
tcgttctctaaaatg

SEQ ID NO: 167318 - DNA, 15 bp, Homo sapiens
atcgttctctaaaat

SEQ ID NO: 167319 - DNA, 15 bp, Homo sapiens
tatcgttctctaaaa

SEQ ID NO: 167320 - DNA, 15 bp, Homo sapiens
ctatcgttctctaaa

SEQ ID NO: 167321 - DNA, 15 bp, Homo sapiens
actatcgttctctaa

SEQ ID NO: 167322 - DNA, 15 bp, Homo sapiens
aactatcgttctcta

SEQ ID NO: 167323 - DNA, 15 bp, Homo sapiens
caactatcgttctct

SEQ ID NO: 167324 - DNA, 15 bp, Homo sapiens
acaactatcgttctc

SEQ ID NO: 167325 - DNA, 15 bp, Homo sapiens
aacaactatcgttct

SEQ ID NO: 167326 - DNA, 15 bp, Homo sapiens
aaacaactatcgttc

SEQ ID NO: 167327 - DNA, 15 bp, Homo sapiens
aaaacaactatcgtt

SEQ ID NO: 167328 - DNA, 15 bp, Homo sapiens
taaaacaactatcgt

SEQ ID NO: 167329 - DNA, 15 bp, Homo sapiens
ataaaacaactatcg

SEQ ID NO: 167330 - DNA, 15 bp, Homo sapiens
aataaaacaactatc

SEQ ID NO: 167331 - DNA, 15 bp, Homo sapiens
caataaaacaactat

SEQ ID NO: 167332 - DNA, 15 bp, Homo sapiens
gcaataaaacaacta

SEQ ID NO: 167333 - DNA, 15 bp, Homo sapiens
agcaataaaacaact

SEQ ID NO: 167334 - DNA, 15 bp, Homo sapiens
tagcaataaaacaac

SEQ ID NO: 167335 - DNA, 15 bp, Homo sapiens
ttagcaataaaacaa

SEQ ID NO: 167336 - DNA, 15 bp, Homo sapiens
attagcaataaaaca

SEQ ID NO: 167337 - DNA, 15 bp, Homo sapiens
cattagcaataaaac

SEQ ID NO: 167338 - DNA, 15 bp, Homo sapiens
acattagcaataaaa

SEQ ID NO: 167339 - DNA, 15 bp, Homo sapiens
cacattagcaataaa

SEQ ID NO: 167340 - DNA, 15 bp, Homo sapiens
tcacattagcaataa

SEQ ID NO: 167341 - DNA, 15 bp, Homo sapiens
ttcacattagcaata

SEQ ID NO: 167342 - DNA, 15 bp, Homo sapiens
gttcacattagcaat

SEQ ID NO: 167343 - DNA, 15 bp, Homo sapiens
tgttcacattagcaa

SEQ ID NO: 167344 - DNA, 15 bp, Homo sapiens
ttgttcacattagca

SEQ ID NO: 167345 - DNA, 15 bp, Homo sapiens
tttgttcacattagc

SEQ ID NO: 167346 - DNA, 15 bp, Homo sapiens
gtttgttcacattag

SEQ ID NO: 167347 - DNA, 15 bp, Homo sapiens
ggtttgttcacatta

SEQ ID NO: 167348 - DNA, 15 bp, Homo sapiens
tggtttgttcacatt

SEQ ID NO: 167349 - DNA, 15 bp, Homo sapiens
atggtttgttcacat

SEQ ID NO: 167350 - DNA, 15 bp, Homo sapiens
tatggtttgttcaca

SEQ ID NO: 167351 - DNA, 15 bp, Homo sapiens
gtatggtttgttcac

SEQ ID NO: 167352 - DNA, 15 bp, Homo sapiens
agtatggtttgttca

SEQ ID NO: 167353 - DNA, 15 bp, Homo sapiens
cagtatggtttgttc

SEQ ID NO: 167354 - DNA, 15 bp, Homo sapiens
acagtatggtttgtt

SEQ ID NO: 167355 - DNA, 15 bp, Homo sapiens
tacagtatggtttgt

SEQ ID NO: 167356 - DNA, 15 bp, Homo sapiens
atacagtatggtttg

SEQ ID NO: 167357 - DNA, 15 bp, Homo sapiens
tatacagtatggttt

SEQ ID NO: 167358 - DNA, 15 bp, Homo sapiens
atatacagtatggtt

SEQ ID NO: 167359 - DNA, 15 bp, Homo sapiens
catatacagtatggt

SEQ ID NO: 167360 - DNA, 15 bp, Homo sapiens
tcatatacagtatgg

SEQ ID NO: 167361 - DNA, 15 bp, Homo sapiens
ttcatatacagtatg

SEQ ID NO: 167362 - DNA, 15 bp, Homo sapiens
tttcatatacagtat

SEQ ID NO: 167363 - DNA, 15 bp, Homo sapiens
gtttcatatacagta

SEQ ID NO: 167364 - DNA, 15 bp, Homo sapiens
agtttcatatacagt

SEQ ID NO: 167365 - DNA, 15 bp, Homo sapiens
aagtttcatatacag

SEQ ID NO: 167366 - DNA, 15 bp, Homo sapiens
aaagtttcatataca

SEQ ID NO: 167367 - DNA, 15 bp, Homo sapiens
aaaagtttcatatac

SEQ ID NO: 167368 - DNA, 15 bp, Homo sapiens
aaaaagtttcatata

SEQ ID NO: 167369 - DNA, 15 bp, Homo sapiens
taaaaagtttcatat

SEQ ID NO: 167370 - DNA, 15 bp, Homo sapiens
ataaaaagtttcata

SEQ ID NO: 167371 - DNA, 15 bp, Homo sapiens
cataaaaagtttcat

SEQ ID NO: 167372 - DNA, 15 bp, Homo sapiens
ccataaaaagtttca

SEQ ID NO: 167373 - DNA, 15 bp, Homo sapiens
accataaaaagtttc

SEQ ID NO: 167374 - DNA, 15 bp, Homo sapiens
aaccataaaaagttt

SEQ ID NO: 167375 - DNA, 15 bp, Homo sapiens
gaaccataaaaagtt

SEQ ID NO: 167376 - DNA, 15 bp, Homo sapiens
agaaccataaaaagt

SEQ ID NO: 167377 - DNA, 15 bp, Homo sapiens
gagaaccataaaaag

SEQ ID NO: 167378 - DNA, 15 bp, Homo sapiens
ggagaaccataaaaa

SEQ ID NO: 167379 - DNA, 15 bp, Homo sapiens
tggagaaccataaaa

SEQ ID NO: 167380 - DNA, 15 bp, Homo sapiens
ctggagaaccataaa

SEQ ID NO: 167381 - DNA, 15 bp, Homo sapiens
tctggagaaccataa

SEQ ID NO: 167382 - DNA, 15 bp, Homo sapiens
ctctggagaaccata

SEQ ID NO: 167383 - DNA, 15 bp, Homo sapiens
tctctggagaaccat

SEQ ID NO: 167384 - DNA, 15 bp, Homo sapiens
ttctctggagaacca

SEQ ID NO: 167385 - DNA, 15 bp, Homo sapiens
tttctctggagaacc

SEQ ID NO: 167386 - DNA, 15 bp, Homo sapiens
gtttctctggagaac

SEQ ID NO: 167387 - DNA, 15 bp, Homo sapiens
ggtttctctggagaa

SEQ ID NO: 167388 - DNA, 15 bp, Homo sapiens
tggtttctctggaga

SEQ ID NO: 167389 - DNA, 15 bp, Homo sapiens
atggtttctctggag

SEQ ID NO: 167390 - DNA, 15 bp, Homo sapiens
catggtttctctgga

SEQ ID NO: 167391 - DNA, 15 bp, Homo sapiens
acatggtttctctgg

SEQ ID NO: 167392 - DNA, 15 bp, Homo sapiens
tacatggtttctctg

SEQ ID NO: 167393 - DNA, 15 bp, Homo sapiens
atacatggtttctct

SEQ ID NO: 167394 - DNA, 15 bp, Homo sapiens
aatacatggtttctc

SEQ ID NO: 167395 - DNA, 15 bp, Homo sapiens
aaatacatggtttct

SEQ ID NO: 167396 - DNA, 15 bp, Homo sapiens
aaaatacatggtttc

SEQ ID NO: 167397 - DNA, 15 bp, Homo sapiens
aaaaatacatggttt

SEQ ID NO: 167398 - DNA, 15 bp, Homo sapiens
aaaaaatacatggtt

SEQ ID NO: 167399 - DNA, 15 bp, Homo sapiens
aaaaaaatacatggt

SEQ ID NO: 167400 - DNA, 15 bp, Homo sapiens
gaaaaaaatacatgg

SEQ ID NO: 167401 - DNA, 15 bp, Homo sapiens
agaaaaaaatacatg

SEQ ID NO: 167402 - DNA, 15 bp, Homo sapiens
cagaaaaaaatacat

SEQ ID NO: 167403 - DNA, 15 bp, Homo sapiens
tcagaaaaaaataca

SEQ ID NO: 167404 - DNA, 15 bp, Homo sapiens
gtcagaaaaaaatac

SEQ ID NO: 167405 - DNA, 15 bp, Homo sapiens
agtcagaaaaaaata

SEQ ID NO: 167406 - DNA, 15 bp, Homo sapiens
aagtcagaaaaaaat

SEQ ID NO: 167407 - DNA, 15 bp, Homo sapiens
aaagtcagaaaaaaa

SEQ ID NO: 167408 - DNA, 15 bp, Homo sapiens
caaagtcagaaaaaa

SEQ ID NO: 167409 - DNA, 15 bp, Homo sapiens
acaaagtcagaaaaa

SEQ ID NO: 167410 - DNA, 15 bp, Homo sapiens
tacaaagtcagaaaa

SEQ ID NO: 167411 - DNA, 15 bp, Homo sapiens
gtacaaagtcagaaa

SEQ ID NO: 167412 - DNA, 15 bp, Homo sapiens
ggtacaaagtcagaa

SEQ ID NO: 167413 - DNA, 15 bp, Homo sapiens
aggtacaaagtcaga

SEQ ID NO: 167414 - DNA, 15 bp, Homo sapiens
taggtacaaagtcag

SEQ ID NO: 167415 - DNA, 15 bp, Homo sapiens
ataggtacaaagtca

SEQ ID NO: 167416 - DNA, 15 bp, Homo sapiens
gataggtacaaagtc

SEQ ID NO: 167417 - DNA, 15 bp, Homo sapiens
ggataggtacaaagt

SEQ ID NO: 167418 - DNA, 15 bp, Homo sapiens
aggataggtacaaag

SEQ ID NO: 167419 - DNA, 15 bp, Homo sapiens
aaggataggtacaaa

SEQ ID NO: 167420 - DNA, 15 bp, Homo sapiens
aaaggataggtacaa

SEQ ID NO: 167421 - DNA, 15 bp, Homo sapiens
aaaaggataggtaca

SEQ ID NO: 167422 - DNA, 15 bp, Homo sapiens
caaaaggataggtac

SEQ ID NO: 167423 - DNA, 15 bp, Homo sapiens
gcaaaaggataggta

SEQ ID NO: 167424 - DNA, 15 bp, Homo sapiens
agcaaaaggataggt

SEQ ID NO: 167425 - DNA, 15 bp, Homo sapiens
aagcaaaaggatagg

SEQ ID NO: 167426 - DNA, 15 bp, Homo sapiens
caagcaaaaggatag

SEQ ID NO: 167427 - DNA, 15 bp, Homo sapiens
ccaagcaaaaggata

SEQ ID NO: 167428 - DNA, 15 bp, Homo sapiens
tccaagcaaaaggat

SEQ ID NO: 167429 - DNA, 15 bp, Homo sapiens
atccaagcaaaagga

SEQ ID NO: 167430 - DNA, 15 bp, Homo sapiens
catccaagcaaaagg

SEQ ID NO: 167431 - DNA, 15 bp, Homo sapiens
gcatccaagcaaaag

SEQ ID NO: 167432 - DNA, 15 bp, Homo sapiens
ggcatccaagcaaaa

SEQ ID NO: 167433 - DNA, 15 bp, Homo sapiens
aggcatccaagcaaa

SEQ ID NO: 167434 - DNA, 15 bp, Homo sapiens
aaggcatccaagcaa

SEQ ID NO: 167435 - DNA, 15 bp, Homo sapiens
aaaggcatccaagca

SEQ ID NO: 167436 - DNA, 15 bp, Homo sapiens
gaaaggcatccaagc

SEQ ID NO: 167437 - DNA, 15 bp, Homo sapiens
agaaaggcatccaag

SEQ ID NO: 167438 - DNA, 15 bp, Homo sapiens
aagaaaggcatccaa

SEQ ID NO: 167439 - DNA, 15 bp, Homo sapiens
gaagaaaggcatcca

SEQ ID NO: 167440 - DNA, 15 bp, Homo sapiens
agaagaaaggcatcc

SEQ ID NO: 167441 - DNA, 15 bp, Homo sapiens
tagaagaaaggcatc

SEQ ID NO: 167442 - DNA, 15 bp, Homo sapiens
ctagaagaaaggcat

SEQ ID NO: 167443 - DNA, 15 bp, Homo sapiens
tctagaagaaaggca

SEQ ID NO: 167444 - DNA, 15 bp, Homo sapiens
ttctagaagaaaggc

SEQ ID NO: 167445 - DNA, 15 bp, Homo sapiens
tttctagaagaaagg

SEQ ID NO: 167446 - DNA, 15 bp, Homo sapiens
ctttctagaagaaag

SEQ ID NO: 167447 - DNA, 15 bp, Homo sapiens
actttctagaagaaa

SEQ ID NO: 167448 - DNA, 15 bp, Homo sapiens
aactttctagaagaa

SEQ ID NO: 167449 - DNA, 15 bp, Homo sapiens
aaactttctagaaga

SEQ ID NO: 167450 - DNA, 15 bp, Homo sapiens
aaaactttctagaag

SEQ ID NO: 167451 - DNA, 15 bp, Homo sapiens
taaaactttctagaa

SEQ ID NO: 167452 - DNA, 15 bp, Homo sapiens
gtaaaactttctaga

SEQ ID NO: 167453 - DNA, 15 bp, Homo sapiens
agtaaaactttctag

SEQ ID NO: 167454 - DNA, 15 bp, Homo sapiens
cagtaaaactttcta

SEQ ID NO: 167455 - DNA, 15 bp, Homo sapiens
tcagtaaaactttct

SEQ ID NO: 167456 - DNA, 15 bp, Homo sapiens
atcagtaaaactttc

SEQ ID NO: 167457 - DNA, 15 bp, Homo sapiens
gatcagtaaaacttt

SEQ ID NO: 167458 - DNA, 15 bp, Homo sapiens
ggatcagtaaaactt

SEQ ID NO: 167459 - DNA, 15 bp, Homo sapiens
aggatcagtaaaact

SEQ ID NO: 167460 - DNA, 15 bp, Homo sapiens
aaggatcagtaaaac

SEQ ID NO: 167461 - DNA, 15 bp, Homo sapiens
gaaggatcagtaaaa

SEQ ID NO: 167462 - DNA, 15 bp, Homo sapiens
tgaaggatcagtaaa

SEQ ID NO: 167463 - DNA, 15 bp, Homo sapiens
ctgaaggatcagtaa

SEQ ID NO: 167464 - DNA, 15 bp, Homo sapiens
cctgaaggatcagta

SEQ ID NO: 167465 - DNA, 15 bp, Homo sapiens
ccctgaaggatcagt

SEQ ID NO: 167466 - DNA, 15 bp, Homo sapiens
gccctgaaggatcag

SEQ ID NO: 167467 - DNA, 15 bp, Homo sapiens
ggccctgaaggatca

SEQ ID NO: 167468 - DNA, 15 bp, Homo sapiens
gggccctgaaggatc

SEQ ID NO: 167469 - DNA, 15 bp, Homo sapiens
tgggccctgaaggat

SEQ ID NO: 167470 - DNA, 15 bp, Homo sapiens
atgggccctgaagga

SEQ ID NO: 167471 - DNA, 15 bp, Homo sapiens
tatgggccctgaagg

SEQ ID NO: 167472 - DNA, 15 bp, Homo sapiens
atatgggccctgaag

SEQ ID NO: 167473 - DNA, 15 bp, Homo sapiens
gatatgggccctgaa

SEQ ID NO: 167474 - DNA, 15 bp, Homo sapiens
tgatatgggccctga

SEQ ID NO: 167475 - DNA, 15 bp, Homo sapiens
ttgatatgggccctg

SEQ ID NO: 167476 - DNA, 15 bp, Homo sapiens
tttgatatgggccct

SEQ ID NO: 167477 - DNA, 15 bp, Homo sapiens
atttgatatgggccc

SEQ ID NO: 167478 - DNA, 15 bp, Homo sapiens
catttgatatgggcc

SEQ ID NO: 167479 - DNA, 15 bp, Homo sapiens
acatttgatatgggc

SEQ ID NO: 167480 - DNA, 15 bp, Homo sapiens
tacatttgatatggg

SEQ ID NO: 167481 - DNA, 15 bp, Homo sapiens
atacatttgatatgg

SEQ ID NO: 167482 - DNA, 15 bp, Homo sapiens
gatacatttgatatg

SEQ ID NO: 167483 - DNA, 15 bp, Homo sapiens
agatacatttgatat

SEQ ID NO: 167484 - DNA, 15 bp, Homo sapiens
aagatacatttgata

SEQ ID NO: 167485 - DNA, 15 bp, Homo sapiens
taagatacatttgat

SEQ ID NO: 167486 - DNA, 15 bp, Homo sapiens
ataagatacatttga

SEQ ID NO: 167487 - DNA, 15 bp, Homo sapiens
gataagatacatttg

SEQ ID NO: 167488 - DNA, 15 bp, Homo sapiens
tgataagatacattt

SEQ ID NO: 167489 - DNA, 15 bp, Homo sapiens
ctgataagatacatt

SEQ ID NO: 167490 - DNA, 15 bp, Homo sapiens
actgataagatacat

SEQ ID NO: 167491 - DNA, 15 bp, Homo sapiens
cactgataagataca

SEQ ID NO: 167492 - DNA, 15 bp, Homo sapiens
tcactgataagatac

SEQ ID NO: 167493 - DNA, 15 bp, Homo sapiens
ttcactgataagata

SEQ ID NO: 167494 - DNA, 15 bp, Homo sapiens
attcactgataagat

SEQ ID NO: 167495 - DNA, 15 bp, Homo sapiens
aattcactgataaga

SEQ ID NO: 167496 - DNA, 15 bp, Homo sapiens
caattcactgataag

SEQ ID NO: 167497 - DNA, 15 bp, Homo sapiens
acaattcactgataa

SEQ ID NO: 167498 - DNA, 15 bp, Homo sapiens
gacaattcactgata

SEQ ID NO: 167499 - DNA, 15 bp, Homo sapiens
agacaattcactgat

SEQ ID NO: 167500 - DNA, 15 bp, Homo sapiens
gagacaattcactga

SEQ ID NO: 167501 - DNA, 15 bp, Homo sapiens
agagacaattcactg

SEQ ID NO: 167502 - DNA, 15 bp, Homo sapiens
gagagacaattcact

SEQ ID NO: 167503 - DNA, 15 bp, Homo sapiens
tgagagacaattcac

SEQ ID NO: 167504 - DNA, 15 bp, Homo sapiens
atgagagacaattca

SEQ ID NO: 167505 - DNA, 15 bp, Homo sapiens
gatgagagacaattc

SEQ ID NO: 167506 - DNA, 15 bp, Homo sapiens
ggatgagagacaatt

SEQ ID NO: 167507 - DNA, 15 bp, Homo sapiens
gggatgagagacaat

SEQ ID NO: 167508 - DNA, 15 bp, Homo sapiens
agggatgagagacaa

SEQ ID NO: 167509 - DNA, 15 bp, Homo sapiens
aagggatgagagaca

SEQ ID NO: 167510 - DNA, 15 bp, Homo sapiens
aaagggatgagagac

SEQ ID NO: 167511 - DNA, 15 bp, Homo sapiens
gaaagggatgagaga

SEQ ID NO: 167512 - DNA, 15 bp, Homo sapiens
tgaaagggatgagag

SEQ ID NO: 167513 - DNA, 15 bp, Homo sapiens
ctgaaagggatgaga

SEQ ID NO: 167514 - DNA, 15 bp, Homo sapiens
tctgaaagggatgag

SEQ ID NO: 167515 - DNA, 15 bp, Homo sapiens
gtctgaaagggatga

SEQ ID NO: 167516 - DNA, 15 bp, Homo sapiens
tgtctgaaagggatg

SEQ ID NO: 167517 - DNA, 15 bp, Homo sapiens
ctgtctgaaagggat

SEQ ID NO: 167518 - DNA, 15 bp, Homo sapiens
tctgtctgaaaggga

SEQ ID NO: 167519 - DNA, 15 bp, Homo sapiens
ttctgtctgaaaggg

SEQ ID NO: 167520 - DNA, 15 bp, Homo sapiens
attctgtctgaaagg

SEQ ID NO: 167521 - DNA, 15 bp, Homo sapiens
cattctgtctgaaag

SEQ ID NO: 167522 - DNA, 15 bp, Homo sapiens
tcattctgtctgaaa

SEQ ID NO: 167523 - DNA, 15 bp, Homo sapiens
ctcattctgtctgaa

SEQ ID NO: 167524 - DNA, 15 bp, Homo sapiens
actcattctgtctga

SEQ ID NO: 167525 - DNA, 15 bp, Homo sapiens
aactcattctgtctg

SEQ ID NO: 167526 - DNA, 15 bp, Homo sapiens
aaactcattctgtct

SEQ ID NO: 167527 - DNA, 15 bp, Homo sapiens
taaactcattctgtc

SEQ ID NO: 167528 - DNA, 15 bp, Homo sapiens
gtaaactcattctgt

SEQ ID NO: 167529 - DNA, 15 bp, Homo sapiens
cgtaaactcattctg

SEQ ID NO: 167530 - DNA, 15 bp, Homo sapiens
gcgtaaactcattct

SEQ ID NO: 167531 - DNA, 15 bp, Homo sapiens
ggcgtaaactcattc

SEQ ID NO: 167532 - DNA, 15 bp, Homo sapiens
gggcgtaaactcatt

SEQ ID NO: 167533 - DNA, 15 bp, Homo sapiens
agggcgtaaactcat

SEQ ID NO: 167534 - DNA, 15 bp, Homo sapiens
tagggcgtaaactca

SEQ ID NO: 167535 - DNA, 15 bp, Homo sapiens
atagggcgtaaactc

SEQ ID NO: 167536 - DNA, 15 bp, Homo sapiens
gatagggcgtaaact

SEQ ID NO: 167537 - DNA, 15 bp, Homo sapiens
agatagggcgtaaac

SEQ ID NO: 167538 - DNA, 15 bp, Homo sapiens
aagatagggcgtaaa

SEQ ID NO: 167539 - DNA, 15 bp, Homo sapiens
caagatagggcgtaa

SEQ ID NO: 167540 - DNA, 15 bp, Homo sapiens
ccaagatagggcgta

SEQ ID NO: 167541 - DNA, 15 bp, Homo sapiens
cccaagatagggcgt

SEQ ID NO: 167542 - DNA, 15 bp, Homo sapiens
gcccaagatagggcg

SEQ ID NO: 167543 - DNA, 15 bp, Homo sapiens
agcccaagatagggc

SEQ ID NO: 167544 - DNA, 15 bp, Homo sapiens
gagcccaagataggg

SEQ ID NO: 167545 - DNA, 15 bp, Homo sapiens
ggagcccaagatagg

SEQ ID NO: 167546 - DNA, 15 bp, Homo sapiens
gggagcccaagatag

SEQ ID NO: 167547 - DNA, 15 bp, Homo sapiens
tgggagcccaagata

SEQ ID NO: 167548 - DNA, 15 bp, Homo sapiens
atgggagcccaagat

SEQ ID NO: 167549 - DNA, 15 bp, Homo sapiens
tatgggagcccaaga

SEQ ID NO: 167550 - DNA, 15 bp, Homo sapiens
ctatgggagcccaag

SEQ ID NO: 167551 - DNA, 15 bp, Homo sapiens
gctatgggagcccaa

SEQ ID NO: 167552 - DNA, 15 bp, Homo sapiens
tgctatgggagccca

SEQ ID NO: 167553 - DNA, 15 bp, Homo sapiens
gtgctatgggagccc

SEQ ID NO: 167554 - DNA, 15 bp, Homo sapiens
agtgctatgggagcc

SEQ ID NO: 167555 - DNA, 15 bp, Homo sapiens
aagtgctatgggagc

SEQ ID NO: 167556 - DNA, 15 bp, Homo sapiens
taagtgctatgggag

SEQ ID NO: 167557 - DNA, 15 bp, Homo sapiens
ataagtgctatggga

SEQ ID NO: 167558 - DNA, 15 bp, Homo sapiens
gataagtgctatggg

SEQ ID NO: 167559 - DNA, 15 bp, Homo sapiens
agataagtgctatgg

SEQ ID NO: 167560 - DNA, 15 bp, Homo sapiens
gagataagtgctatg

SEQ ID NO: 167561 - DNA, 15 bp, Homo sapiens
cgagataagtgctat

SEQ ID NO: 167562 - DNA, 15 bp, Homo sapiens
gcgagataagtgcta

SEQ ID NO: 167563 - DNA, 15 bp, Homo sapiens
agcgagataagtgct

SEQ ID NO: 167564 - DNA, 15 bp, Homo sapiens
tagcgagataagtgc

SEQ ID NO: 167565 - DNA, 15 bp, Homo sapiens
atagcgagataagtg

SEQ ID NO: 167566 - DNA, 15 bp, Homo sapiens
catagcgagataagt

SEQ ID NO: 167567 - DNA, 15 bp, Homo sapiens
tcatagcgagataag

SEQ ID NO: 167568 - DNA, 15 bp, Homo sapiens
atcatagcgagataa

SEQ ID NO: 167569 - DNA, 15 bp, Homo sapiens
catcatagcgagata

SEQ ID NO: 167570 - DNA, 15 bp, Homo sapiens
gcatcatagcgagat

SEQ ID NO: 167571 - DNA, 15 bp, Homo sapiens
tgcatcatagcgaga

SEQ ID NO: 167572 - DNA, 15 bp, Homo sapiens
ttgcatcatagcgag

SEQ ID NO: 167573 - DNA, 15 bp, Homo sapiens
attgcatcatagcga

SEQ ID NO: 167574 - DNA, 15 bp, Homo sapiens
aattgcatcatagcg

SEQ ID NO: 167575 - DNA, 15 bp, Homo sapiens
gaattgcatcatagc

SEQ ID NO: 167576 - DNA, 15 bp, Homo sapiens
agaattgcatcatag

SEQ ID NO: 167577 - DNA, 15 bp, Homo sapiens
gagaattgcatcata

SEQ ID NO: 167578 - DNA, 15 bp, Homo sapiens
agagaattgcatcat

SEQ ID NO: 167579 - DNA, 15 bp, Homo sapiens
aagagaattgcatca

SEQ ID NO: 167580 - DNA, 15 bp, Homo sapiens
gaagagaattgcatc

SEQ ID NO: 167581 - DNA, 15 bp, Homo sapiens
agaagagaattgcat

SEQ ID NO: 167582 - DNA, 15 bp, Homo sapiens
gagaagagaattgca

SEQ ID NO: 167583 - DNA, 15 bp, Homo sapiens
tgagaagagaattgc

SEQ ID NO: 167584 - DNA, 15 bp, Homo sapiens
ctgagaagagaattg

SEQ ID NO: 167585 - DNA, 15 bp, Homo sapiens
tctgagaagagaatt

SEQ ID NO: 167586 - DNA, 15 bp, Homo sapiens
atctgagaagagaat

SEQ ID NO: 167587 - DNA, 15 bp, Homo sapiens
aatctgagaagagaa

SEQ ID NO: 167588 - DNA, 15 bp, Homo sapiens
aaatctgagaagaga

SEQ ID NO: 167589 - DNA, 15 bp, Homo sapiens
caaatctgagaagag

SEQ ID NO: 167590 - DNA, 15 bp, Homo sapiens
acaaatctgagaaga

SEQ ID NO: 167591 - DNA, 15 bp, Homo sapiens
atacaaatctgagaa

SEQ ID NO: 167592 - DNA, 15 bp, Homo sapiens
tatacaaatctgaga

SEQ ID NO: 167593 - DNA, 15 bp, Homo sapiens
atatacaaatctgag

SEQ ID NO: 167594 - DNA, 15 bp, Homo sapiens
aatatacaaatctga

SEQ ID NO: 167595 - DNA, 15 bp, Homo sapiens
gaatatacaaatctg

SEQ ID NO: 167596 - DNA, 15 bp, Homo sapiens
agaatatacaaatct

SEQ ID NO: 167597 - DNA, 15 bp, Homo sapiens
gagaatatacaaatc

SEQ ID NO: 167598 - DNA, 15 bp, Homo sapiens
agagaatatacaaat

SEQ ID NO: 167599 - DNA, 15 bp, Homo sapiens
gagagaatatacaaa

SEQ ID NO: 167600 - DNA, 15 bp, Homo sapiens
ggagagaatatacaa

SEQ ID NO: 167601 - DNA, 15 bp, Homo sapiens
aggagagaatataca

SEQ ID NO: 167602 - DNA, 15 bp, Homo sapiens
aaggagagaatatac

SEQ ID NO: 167603 - DNA, 15 bp, Homo sapiens
caaggagagaatata

SEQ ID NO: 167604 - DNA, 15 bp, Homo sapiens
tcaaggagagaatat

SEQ ID NO: 167605 - DNA, 15 bp, Homo sapiens
atcaaggagagaata

SEQ ID NO: 167606 - DNA, 15 bp, Homo sapiens
catcaaggagagaat

SEQ ID NO: 167607 - DNA, 15 bp, Homo sapiens
ccatcaaggagagaa

SEQ ID NO: 167608 - DNA, 15 bp, Homo sapiens
gccatcaaggagaga

SEQ ID NO: 167609 - DNA, 15 bp, Homo sapiens
tgccatcaaggagag

SEQ ID NO: 167610 - DNA, 15 bp, Homo sapiens
ttgccatcaaggaga

SEQ ID NO: 167611 - DNA, 15 bp, Homo sapiens
attgccatcaaggag

SEQ ID NO: 167612 - DNA, 15 bp, Homo sapiens
cattgccatcaagga

SEQ ID NO: 167613 - DNA, 15 bp, Homo sapiens
gcattgccatcaagg

SEQ ID NO: 167614 - DNA, 15 bp, Homo sapiens
tgcattgccatcaag

SEQ ID NO: 167615 - DNA, 15 bp, Homo sapiens
ctgcattgccatcaa

SEQ ID NO: 167616 - DNA, 15 bp, Homo sapiens
tctgcattgccatca

SEQ ID NO: 167617 - DNA, 15 bp, Homo sapiens
ctctgcattgccatc

SEQ ID NO: 167618 - DNA, 15 bp, Homo sapiens
actctgcattgccat

SEQ ID NO: 167619 - DNA, 15 bp, Homo sapiens
gactctgcattgcca

SEQ ID NO: 167620 - DNA, 15 bp, Homo sapiens
agactctgcattgcc

SEQ ID NO: 167621 - DNA, 15 bp, Homo sapiens
aagactctgcattgc

SEQ ID NO: 167622 - DNA, 15 bp, Homo sapiens
gaagactctgcattg

SEQ ID NO: 167623 - DNA, 15 bp, Homo sapiens
agaagactctgcatt

SEQ ID NO: 167624 - DNA, 15 bp, Homo sapiens
gagaagactctgcat

SEQ ID NO: 167625 - DNA, 15 bp, Homo sapiens
tgagaagactctgca

SEQ ID NO: 167626 - DNA, 15 bp, Homo sapiens
atgagaagactctgc

SEQ ID NO: 167627 - DNA, 15 bp, Homo sapiens
tatgagaagactctg

SEQ ID NO: 167628 - DNA, 15 bp, Homo sapiens
ctatgagaagactct

SEQ ID NO: 167629 - DNA, 15 bp, Homo sapiens
actatgagaagactc

SEQ ID NO: 167630 - DNA, 15 bp, Homo sapiens
cactatgagaagact

SEQ ID NO: 167631 - DNA, 15 bp, Homo sapiens
acactatgagaagac

SEQ ID NO: 167632 - DNA, 15 bp, Homo sapiens
aacactatgagaaga

SEQ ID NO: 167633 - DNA, 15 bp, Homo sapiens
taacactatgagaag

SEQ ID NO: 167634 - DNA, 15 bp, Homo sapiens
ttaacactatgagaa

SEQ ID NO: 167635 - DNA, 15 bp, Homo sapiens
attaacactatgaga

SEQ ID NO: 167636 - DNA, 15 bp, Homo sapiens
tattaacactatgag

SEQ ID NO: 167637 - DNA, 15 bp, Homo sapiens
ttattaacactatga

SEQ ID NO: 167638 - DNA, 15 bp, Homo sapiens
attattaacactatg

SEQ ID NO: 167639 - DNA, 15 bp, Homo sapiens
tattattaacactat

SEQ ID NO: 167640 - DNA, 15 bp, Homo sapiens
ttattattaacacta

SEQ ID NO: 167641 - DNA, 15 bp, Homo sapiens
gttattattaacact

SEQ ID NO: 167642 - DNA, 15 bp, Homo sapiens
tgttattattaacac

SEQ ID NO: 167643 - DNA, 15 bp, Homo sapiens
atgttattattaaca

SEQ ID NO: 167644 - DNA, 15 bp, Homo sapiens
tatgttattattaac

SEQ ID NO: 167645 - DNA, 15 bp, Homo sapiens
atatgttattattaa

SEQ ID NO: 167646 - DNA, 15 bp, Homo sapiens
catatgttattatta

SEQ ID NO: 167647 - DNA, 15 bp, Homo sapiens
acatatgttattatt

SEQ ID NO: 167648 - DNA, 15 bp, Homo sapiens
tacatatgttattat

SEQ ID NO: 167649 - DNA, 15 bp, Homo sapiens
ctacatatgttatta

SEQ ID NO: 167650 - DNA, 15 bp, Homo sapiens
gctacatatgttatt

SEQ ID NO: 167651 - DNA, 15 bp, Homo sapiens
ggctacatatgttat

SEQ ID NO: 167652 - DNA, 15 bp, Homo sapiens
aggctacatatgtta

SEQ ID NO: 167653 - DNA, 15 bp, Homo sapiens
caggctacatatgtt

SEQ ID NO: 167654 - DNA, 15 bp, Homo sapiens
acaggctacatatgt

SEQ ID NO: 167655 - DNA, 15 bp, Homo sapiens
cacaggctacatatg

SEQ ID NO: 167656 - DNA, 15 bp, Homo sapiens
acacaggctacatat

SEQ ID NO: 167657 - DNA, 15 bp, Homo sapiens
tacacaggctacata

SEQ ID NO: 167658 - DNA, 15 bp, Homo sapiens
atacacaggctacat

SEQ ID NO: 167659 - DNA, 15 bp, Homo sapiens
catacacaggctaca

SEQ ID NO: 167660 - DNA, 15 bp, Homo sapiens
acatacacaggctac

SEQ ID NO: 167661 - DNA, 15 bp, Homo sapiens
cacatacacaggcta

SEQ ID NO: 167662 - DNA, 15 bp, Homo sapiens
tcacatacacaggct

SEQ ID NO: 167663 - DNA, 15 bp, Homo sapiens
ttcacatacacaggc

SEQ ID NO: 167664 - DNA, 15 bp, Homo sapiens
tttcacatacacagg

SEQ ID NO: 167665 - DNA, 15 bp, Homo sapiens
gtttcacatacacag

SEQ ID NO: 167666 - DNA, 15 bp, Homo sapiens
tgtttcacatacaca

SEQ ID NO: 167667 - DNA, 15 bp, Homo sapiens
ctgtttcacatacac

SEQ ID NO: 167668 - DNA, 15 bp, Homo sapiens
cctgtttcacataca

SEQ ID NO: 167669 - DNA, 15 bp, Homo sapiens
acctgtttcacatac

SEQ ID NO: 167670 - DNA, 15 bp, Homo sapiens
cacctgtttcacata

SEQ ID NO: 167671 - DNA, 15 bp, Homo sapiens
ccacctgtttcacat

SEQ ID NO: 167672 - DNA, 15 bp, Homo sapiens
tccacctgtttcaca

SEQ ID NO: 167673 - DNA, 15 bp, Homo sapiens
atccacctgtttcac

SEQ ID NO: 167674 - DNA, 15 bp, Homo sapiens
catccacctgtttca

SEQ ID NO: 167675 - DNA, 15 bp, Homo sapiens
acatccacctgtttc

SEQ ID NO: 167676 - DNA, 15 bp, Homo sapiens
aacatccacctgttt

SEQ ID NO: 167677 - DNA, 15 bp, Homo sapiens
caacatccacctgtt

SEQ ID NO: 167678 - DNA, 15 bp, Homo sapiens
gcaacatccacctgt

SEQ ID NO: 167679 - DNA, 15 bp, Homo sapiens
agcaacatccacctg

SEQ ID NO: 167680 - DNA, 15 bp, Homo sapiens
cagcaacatccacct

SEQ ID NO: 167681 - DNA, 15 bp, Homo sapiens
tcagcaacatccacc

SEQ ID NO: 167682 - DNA, 15 bp, Homo sapiens
atcagcaacatccac

SEQ ID NO: 167683 - DNA, 15 bp, Homo sapiens
tatcagcaacatcca

SEQ ID NO: 167684 - DNA, 15 bp, Homo sapiens
gtatcagcaacatcc

SEQ ID NO: 167685 - DNA, 15 bp, Homo sapiens
agtatcagcaacatc

SEQ ID NO: 167686 - DNA, 15 bp, Homo sapiens
aagtatcagcaacat

SEQ ID NO: 167687 - DNA, 15 bp, Homo sapiens
taagtatcagcaaca

SEQ ID NO: 167688 - DNA, 15 bp, Homo sapiens
ttaagtatcagcaac

SEQ ID NO: 167689 - DNA, 15 bp, Homo sapiens
attaagtatcagcaa

SEQ ID NO: 167690 - DNA, 15 bp, Homo sapiens
aattaagtatcagca

SEQ ID NO: 167691 - DNA, 15 bp, Homo sapiens
taattaagtatcagc

SEQ ID NO: 167692 - DNA, 15 bp, Homo sapiens
ctaattaagtatcag

SEQ ID NO: 167693 - DNA, 15 bp, Homo sapiens
cctaattaagtatca

SEQ ID NO: 167694 - DNA, 15 bp, Homo sapiens
tcctaattaagtatc

SEQ ID NO: 167695 - DNA, 15 bp, Homo sapiens
ttcctaattaagtat

SEQ ID NO: 167696 - DNA, 15 bp, Homo sapiens
tttcctaattaagta

SEQ ID NO: 167697 - DNA, 15 bp, Homo sapiens
ctttcctaattaagt

SEQ ID NO: 167698 - DNA, 15 bp, Homo sapiens
cctttcctaattaag

SEQ ID NO: 167699 - DNA, 15 bp, Homo sapiens
acctttcctaattaa

SEQ ID NO: 167700 - DNA, 15 bp, Homo sapiens
tacctttcctaatta

SEQ ID NO: 167701 - DNA, 15 bp, Homo sapiens
atacctttcctaatt

SEQ ID NO: 167702 - DNA, 15 bp, Homo sapiens
tatacctttcctaat

SEQ ID NO: 167703 - DNA, 15 bp, Homo sapiens
ctatacctttcctaa

SEQ ID NO: 167704 - DNA, 15 bp, Homo sapiens
actatacctttccta

SEQ ID NO: 167705 - DNA, 15 bp, Homo sapiens
cactatacctttcct

SEQ ID NO: 167706 - DNA, 15 bp, Homo sapiens
tcactatacctttcc

SEQ ID NO: 167707 - DNA, 15 bp, Homo sapiens
atcactatacctttc

SEQ ID NO: 167708 - DNA, 15 bp, Homo sapiens
aatcactataccttt

SEQ ID NO: 167709 - DNA, 15 bp, Homo sapiens
gaatcactatacctt

SEQ ID NO: 167710 - DNA, 15 bp, Homo sapiens
agaatcactatacct

SEQ ID NO: 167711 - DNA, 15 bp, Homo sapiens
gagaatcactatacc

SEQ ID NO: 167712 - DNA, 15 bp, Homo sapiens
tgagaatcactatac

SEQ ID NO: 167713 - DNA, 15 bp, Homo sapiens
atgagaatcactata

SEQ ID NO: 167714 - DNA, 15 bp, Homo sapiens
gatgagaatcactat

SEQ ID NO: 167715 - DNA, 15 bp, Homo sapiens
cgatgagaatcacta

SEQ ID NO: 167716 - DNA, 15 bp, Homo sapiens
acgatgagaatcact

SEQ ID NO: 167717 - DNA, 15 bp, Homo sapiens
cacgatgagaatcac

SEQ ID NO: 167718 - DNA, 15 bp, Homo sapiens
acacgatgagaatca

SEQ ID NO: 167719 - DNA, 15 bp, Homo sapiens
aacacgatgagaatc

SEQ ID NO: 167720 - DNA, 15 bp, Homo sapiens
gaacacgatgagaat

SEQ ID NO: 167721 - DNA, 15 bp, Homo sapiens
tgaacacgatgagaa

SEQ ID NO: 167722 - DNA, 15 bp, Homo sapiens
gtgaacacgatgaga

SEQ ID NO: 167723 - DNA, 15 bp, Homo sapiens
tgtgaacacgatgag

SEQ ID NO: 167724 - DNA, 15 bp, Homo sapiens
ttgtgaacacgatga

SEQ ID NO: 167725 - DNA, 15 bp, Homo sapiens
cttgtgaacacgatg

SEQ ID NO: 167726 - DNA, 15 bp, Homo sapiens
acttgtgaacacgat

SEQ ID NO: 167727 - DNA, 15 bp, Homo sapiens
gacttgtgaacacga

SEQ ID NO: 167728 - DNA, 15 bp, Homo sapiens
tgacttgtgaacacg

SEQ ID NO: 167729 - DNA, 15 bp, Homo sapiens
ctgacttgtgaacac

SEQ ID NO: 167730 - DNA, 15 bp, Homo sapiens
tctgacttgtgaaca

SEQ ID NO: 167731 - DNA, 15 bp, Homo sapiens
gtctgacttgtgaac

SEQ ID NO: 167732 - DNA, 15 bp, Homo sapiens
agtctgacttgtgaa

SEQ ID NO: 167733 - DNA, 15 bp, Homo sapiens
gagtctgacttgtga

SEQ ID NO: 167734 - DNA, 15 bp, Homo sapiens
agagtctgacttgtg

SEQ ID NO: 167735 - DNA, 15 bp, Homo sapiens
gagagtctgacttgt

SEQ ID NO: 167736 - DNA, 15 bp, Homo sapiens
ggagagtctgacttg

SEQ ID NO: 167737 - DNA, 15 bp, Homo sapiens
aggagagtctgactt

SEQ ID NO: 167738 - DNA, 15 bp, Homo sapiens
taaggagagtctgac

SEQ ID NO: 167739 - DNA, 15 bp, Homo sapiens
ataaggagagtctga

SEQ ID NO: 167740 - DNA, 15 bp, Homo sapiens
tataaggagagtctg

SEQ ID NO: 167741 - DNA, 15 bp, Homo sapiens
gtataaggagagtct

SEQ ID NO: 167742 - DNA, 15 bp, Homo sapiens
ggtataaggagagtc

SEQ ID NO: 167743 - DNA, 15 bp, Homo sapiens
aggtataaggagagt

SEQ ID NO: 167744 - DNA, 15 bp, Homo sapiens
gaggtataaggagag

SEQ ID NO: 167745 - DNA, 15 bp, Homo sapiens
tgaggtataaggaga

SEQ ID NO: 167746 - DNA, 15 bp, Homo sapiens
ttgaggtataaggag

SEQ ID NO: 167747 - DNA, 15 bp, Homo sapiens
attgaggtataagga

SEQ ID NO: 167748 - DNA, 15 bp, Homo sapiens
gattgaggtataagg

SEQ ID NO: 167749 - DNA, 15 bp, Homo sapiens
tgattgaggtataag

SEQ ID NO: 167750 - DNA, 15 bp, Homo sapiens
gtgattgaggtataa

SEQ ID NO: 167751 - DNA, 15 bp, Homo sapiens
agtgattgaggtata

SEQ ID NO: 167752 - DNA, 15 bp, Homo sapiens
cagtgattgaggtat

SEQ ID NO: 167753 - DNA, 15 bp, Homo sapiens
gcagtgattgaggta

SEQ ID NO: 167754 - DNA, 15 bp, Homo sapiens
ggcagtgattgaggt

SEQ ID NO: 167755 - DNA, 15 bp, Homo sapiens
cggcagtgattgagg

SEQ ID NO: 167756 - DNA, 15 bp, Homo sapiens
acggcagtgattgag

SEQ ID NO: 167757 - DNA, 15 bp, Homo sapiens
tacggcagtgattga

SEQ ID NO: 167758 - DNA, 15 bp, Homo sapiens
atacggcagtgattg

SEQ ID NO: 167759 - DNA, 15 bp, Homo sapiens
gatacggcagtgatt

SEQ ID NO: 167760 - DNA, 15 bp, Homo sapiens
agatacggcagtgat

SEQ ID NO: 167761 - DNA, 15 bp, Homo sapiens
aagatacggcagtga

SEQ ID NO: 167762 - DNA, 15 bp, Homo sapiens
aaagatacggcagtg

SEQ ID NO: 167763 - DNA, 15 bp, Homo sapiens
aaaagatacggcagt

SEQ ID NO: 167764 - DNA, 15 bp, Homo sapiens
taaaagatacggcag

SEQ ID NO: 167765 - DNA, 15 bp, Homo sapiens
gtaaaagatacggca

SEQ ID NO: 167766 - DNA, 15 bp, Homo sapiens
ggtaaaagatacggc

SEQ ID NO: 167767 - DNA, 15 bp, Homo sapiens
aggtaaaagatacgg

SEQ ID NO: 167768 - DNA, 15 bp, Homo sapiens
aaggtaaaagatacg

SEQ ID NO: 167769 - DNA, 15 bp, Homo sapiens
caaggtaaaagatac

SEQ ID NO: 167770 - DNA, 15 bp, Homo sapiens
gcaaggtaaaagata

SEQ ID NO: 167771 - DNA, 15 bp, Homo sapiens
tgcaaggtaaaagat

SEQ ID NO: 167772 - DNA, 15 bp, Homo sapiens
atgcaaggtaaaaga

SEQ ID NO: 167773 - DNA, 15 bp, Homo sapiens
tatgcaaggtaaaag

SEQ ID NO: 167774 - DNA, 15 bp, Homo sapiens
atatgcaaggtaaaa

SEQ ID NO: 167775 - DNA, 15 bp, Homo sapiens
catatgcaaggtaaa

SEQ ID NO: 167776 - DNA, 15 bp, Homo sapiens
tcatatgcaaggtaa

SEQ ID NO: 167777 - DNA, 15 bp, Homo sapiens
ctcatatgcaaggta

SEQ ID NO: 167778 - DNA, 15 bp, Homo sapiens
tctcatatgcaaggt

SEQ ID NO: 167779 - DNA, 15 bp, Homo sapiens
gtctcatatgcaagg

SEQ ID NO: 167780 - DNA, 15 bp, Homo sapiens
ggtctcatatgcaag

SEQ ID NO: 167781 - DNA, 15 bp, Homo sapiens
gggtctcatatgcaa

SEQ ID NO: 167782 - DNA, 15 bp, Homo sapiens
ggggtctcatatgca

SEQ ID NO: 167783 - DNA, 15 bp, Homo sapiens
gggggtctcatatgc

SEQ ID NO: 167784 - DNA, 15 bp, Homo sapiens
tgggggtctcatatg

SEQ ID NO: 167785 - DNA, 15 bp, Homo sapiens
ctgggggtctcatat

SEQ ID NO: 167786 - DNA, 15 bp, Homo sapiens
actgggggtctcata

SEQ ID NO: 167787 - DNA, 15 bp, Homo sapiens
tactgggggtctcat

SEQ ID NO: 167788 - DNA, 15 bp, Homo sapiens
atactgggggtctca

SEQ ID NO: 167789 - DNA, 15 bp, Homo sapiens
tatactgggggtctc

SEQ ID NO: 167790 - DNA, 15 bp, Homo sapiens
ttatactgggggtct

SEQ ID NO: 167791 - DNA, 15 bp, Homo sapiens
cttatactgggggtc

SEQ ID NO: 167792 - DNA, 15 bp, Homo sapiens
tcttatactgggggt

SEQ ID NO: 167793 - DNA, 15 bp, Homo sapiens
ctcttatactggggg

SEQ ID NO: 167794 - DNA, 15 bp, Homo sapiens
actcttatactgggg

SEQ ID NO: 167795 - DNA, 15 bp, Homo sapiens
cactcttatactggg

SEQ ID NO: 167796 - DNA, 15 bp, Homo sapiens
acactcttatactgg

SEQ ID NO: 167797 - DNA, 15 bp, Homo sapiens
tacactcttatactg

SEQ ID NO: 167798 - DNA, 15 bp, Homo sapiens
ttacactcttatact

SEQ ID NO: 167799 - DNA, 15 bp, Homo sapiens
attacactcttatac

SEQ ID NO: 167800 - DNA, 15 bp, Homo sapiens
tattacactcttata

SEQ ID NO: 167801 - DNA, 15 bp, Homo sapiens
ttattacactcttat

SEQ ID NO: 167802 - DNA, 15 bp, Homo sapiens
gttattacactctta

SEQ ID NO: 167803 - DNA, 15 bp, Homo sapiens
agttattacactctt

SEQ ID NO: 167804 - DNA, 15 bp, Homo sapiens
tagttattacactct

SEQ ID NO: 167805 - DNA, 15 bp, Homo sapiens
atagttattacactc

SEQ ID NO: 167806 - DNA, 15 bp, Homo sapiens
gatagttattacact

SEQ ID NO: 167807 - DNA, 15 bp, Homo sapiens
agatagttattacac

SEQ ID NO: 167808 - DNA, 15 bp, Homo sapiens
cagatagttattaca

SEQ ID NO: 167809 - DNA, 15 bp, Homo sapiens
tcagatagttattac

SEQ ID NO: 167810 - DNA, 15 bp, Homo sapiens
atcagatagttatta

SEQ ID NO: 167811 - DNA, 15 bp, Homo sapiens
aatcagatagttatt

SEQ ID NO: 167812 - DNA, 15 bp, Homo sapiens
gaatcagatagttat

SEQ ID NO: 167813 - DNA, 15 bp, Homo sapiens
tgaatcagatagtta

SEQ ID NO: 167814 - DNA, 15 bp, Homo sapiens
atgaatcagatagtt

SEQ ID NO: 167815 - DNA, 15 bp, Homo sapiens
aatgaatcagatagt

SEQ ID NO: 167816 - DNA, 15 bp, Homo sapiens
aaatgaatcagatag

SEQ ID NO: 167817 - DNA, 15 bp, Homo sapiens
caaatgaatcagata

SEQ ID NO: 167818 - DNA, 15 bp, Homo sapiens
gcaaatgaatcagat

SEQ ID NO: 167819 - DNA, 15 bp, Homo sapiens
agcaaatgaatcaga

SEQ ID NO: 167820 - DNA, 15 bp, Homo sapiens
tagcaaatgaatcag

SEQ ID NO: 167821 - DNA, 15 bp, Homo sapiens
ctagcaaatgaatca

SEQ ID NO: 167822 - DNA, 15 bp, Homo sapiens
actagcaaatgaatc

SEQ ID NO: 167823 - DNA, 15 bp, Homo sapiens
tactagcaaatgaat

SEQ ID NO: 167824 - DNA, 15 bp, Homo sapiens
ttactagcaaatgaa

SEQ ID NO: 167825 - DNA, 15 bp, Homo sapiens
attactagcaaatga

SEQ ID NO: 167826 - DNA, 15 bp, Homo sapiens
cattactagcaaatg

SEQ ID NO: 167827 - DNA, 15 bp, Homo sapiens
gcattactagcaaat

SEQ ID NO: 167828 - DNA, 15 bp, Homo sapiens
agcattactagcaaa

SEQ ID NO: 167829 - DNA, 15 bp, Homo sapiens
cagcattactagcaa

SEQ ID NO: 167830 - DNA, 15 bp, Homo sapiens
tcagcattactagca

SEQ ID NO: 167831 - DNA, 15 bp, Homo sapiens
ttcagcattactagc

SEQ ID NO: 167832 - DNA, 15 bp, Homo sapiens
cttcagcattactag

SEQ ID NO: 167833 - DNA, 15 bp, Homo sapiens
ccttcagcattacta

SEQ ID NO: 167834 - DNA, 15 bp, Homo sapiens
cccttcagcattact

SEQ ID NO: 167835 - DNA, 15 bp, Homo sapiens
tcccttcagcattac

SEQ ID NO: 167836 - DNA, 15 bp, Homo sapiens
ttcccttcagcatta

SEQ ID NO: 167837 - DNA, 15 bp, Homo sapiens
attcccttcagcatt

SEQ ID NO: 167838 - DNA, 15 bp, Homo sapiens
aattcccttcagcat

SEQ ID NO: 167839 - DNA, 15 bp, Homo sapiens
caattcccttcagca

SEQ ID NO: 167840 - DNA, 15 bp, Homo sapiens
acaattcccttcagc

SEQ ID NO: 167841 - DNA, 15 bp, Homo sapiens
aacaattcccttcag

SEQ ID NO: 167842 - DNA, 15 bp, Homo sapiens
taacaattcccttca

SEQ ID NO: 167843 - DNA, 15 bp, Homo sapiens
ttaacaattcccttc

SEQ ID NO: 167844 - DNA, 15 bp, Homo sapiens
cttaacaattccctt

SEQ ID NO: 167845 - DNA, 15 bp, Homo sapiens
gcttaacaattccct

SEQ ID NO: 167846 - DNA, 15 bp, Homo sapiens
agcttaacaattccc

SEQ ID NO: 167847 - DNA, 15 bp, Homo sapiens
cagcttaacaattcc

SEQ ID NO: 167848 - DNA, 15 bp, Homo sapiens
tcagcttaacaattc

SEQ ID NO: 167849 - DNA, 15 bp, Homo sapiens
atcagcttaacaatt

SEQ ID NO: 167850 - DNA, 15 bp, Homo sapiens
gatcagcttaacaat

SEQ ID NO: 167851 - DNA, 15 bp, Homo sapiens
agatcagcttaacaa

SEQ ID NO: 167852 - DNA, 15 bp, Homo sapiens
cagatcagcttaaca

SEQ ID NO: 167853 - DNA, 15 bp, Homo sapiens
acagatcagcttaac

SEQ ID NO: 167854 - DNA, 15 bp, Homo sapiens
aacagatcagcttaa

SEQ ID NO: 167855 - DNA, 15 bp, Homo sapiens
aaacagatcagctta

SEQ ID NO: 167856 - DNA, 15 bp, Homo sapiens
caaacagatcagctt

SEQ ID NO: 167857 - DNA, 15 bp, Homo sapiens
ccaaacagatcagct

SEQ ID NO: 167858 - DNA, 15 bp, Homo sapiens
accaaacagatcagc

SEQ ID NO: 167859 - DNA, 15 bp, Homo sapiens
aaccaaacagatcag

SEQ ID NO: 167860 - DNA, 15 bp, Homo sapiens
aaaccaaacagatca

SEQ ID NO: 167861 - DNA, 15 bp, Homo sapiens
taaaccaaacagatc

SEQ ID NO: 167862 - DNA, 15 bp, Homo sapiens
ataaaccaaacagat

SEQ ID NO: 167863 - DNA, 15 bp, Homo sapiens
cataaaccaaacaga

SEQ ID NO: 167864 - DNA, 15 bp, Homo sapiens
ccataaaccaaacag

SEQ ID NO: 167865 - DNA, 15 bp, Homo sapiens
tccataaaccaaaca

SEQ ID NO: 167866 - DNA, 15 bp, Homo sapiens
ttccataaaccaaac

SEQ ID NO: 167867 - DNA, 15 bp, Homo sapiens
tttccataaaccaaa

SEQ ID NO: 167868 - DNA, 15 bp, Homo sapiens
ttttccataaaccaa

SEQ ID NO: 167869 - DNA, 15 bp, Homo sapiens
cttttccataaacca

SEQ ID NO: 167870 - DNA, 15 bp, Homo sapiens
tcttttccataaacc

SEQ ID NO: 167871 - DNA, 15 bp, Homo sapiens
atcttttccataaac

SEQ ID NO: 167872 - DNA, 15 bp, Homo sapiens
catcttttccataaa

SEQ ID NO: 167873 - DNA, 15 bp, Homo sapiens
acatcttttccataa

SEQ ID NO: 167874 - DNA, 15 bp, Homo sapiens
aacatcttttccata

SEQ ID NO: 167875 - DNA, 15 bp, Homo sapiens
aaacatcttttccat

SEQ ID NO: 167876 - DNA, 15 bp, Homo sapiens
taaacatcttttcca

SEQ ID NO: 167877 - DNA, 15 bp, Homo sapiens
ataaacatcttttcc

SEQ ID NO: 167878 - DNA, 15 bp, Homo sapiens
aataaacatcttttc

SEQ ID NO: 167879 - DNA, 15 bp, Homo sapiens
gaataaacatctttt

SEQ ID NO: 167880 - DNA, 15 bp, Homo sapiens
agaataaacatcttt

SEQ ID NO: 167881 - DNA, 15 bp, Homo sapiens
aagaataaacatctt

SEQ ID NO: 167882 - DNA, 15 bp, Homo sapiens
gaagaataaacatct

SEQ ID NO: 167883 - DNA, 15 bp, Homo sapiens
ggaagaataaacatc

SEQ ID NO: 167884 - DNA, 15 bp, Homo sapiens
aggaagaataaacat

SEQ ID NO: 167885 - DNA, 15 bp, Homo sapiens
taggaagaataaaca

SEQ ID NO: 167886 - DNA, 15 bp, Homo sapiens
gtaggaagaataaac

SEQ ID NO: 167887 - DNA, 15 bp, Homo sapiens
cgtaggaagaataaa

SEQ ID NO: 167888 - DNA, 15 bp, Homo sapiens
gcgtaggaagaataa

SEQ ID NO: 167889 - DNA, 15 bp, Homo sapiens
ggcgtaggaagaata

SEQ ID NO: 167890 - DNA, 15 bp, Homo sapiens
aggcgtaggaagaat

SEQ ID NO: 167891 - DNA, 15 bp, Homo sapiens
aaggcgtaggaagaa

SEQ ID NO: 167892 - DNA, 15 bp, Homo sapiens
gaaggcgtaggaaga

SEQ ID NO: 167893 - DNA, 15 bp, Homo sapiens
agaaggcgtaggaag

SEQ ID NO: 167894 - DNA, 15 bp, Homo sapiens
gagaaggcgtaggaa

SEQ ID NO: 167895 - DNA, 15 bp, Homo sapiens
agagaaggcgtagga

SEQ ID NO: 167896 - DNA, 15 bp, Homo sapiens
aagagaaggcgtagg

SEQ ID NO: 167897 - DNA, 15 bp, Homo sapiens
aaagagaaggcgtag

SEQ ID NO: 167898 - DNA, 15 bp, Homo sapiens
aaaagagaaggcgta

SEQ ID NO: 167899 - DNA, 15 bp, Homo sapiens
aaaaagagaaggcgt

SEQ ID NO: 167900 - DNA, 15 bp, Homo sapiens
aaaaaagagaaggcg

SEQ ID NO: 167901 - DNA, 15 bp, Homo sapiens
gaaaaaagagaaggc

SEQ ID NO: 167902 - DNA, 15 bp, Homo sapiens
agaaaaaagagaagg

SEQ ID NO: 167903 - DNA, 15 bp, Homo sapiens
gagaaaaaagagaag

SEQ ID NO: 167904 - DNA, 15 bp, Homo sapiens
ggagaaaaaagagaa

SEQ ID NO: 167905 - DNA, 15 bp, Homo sapiens
aggagaaaaaagaga

SEQ ID NO: 167906 - DNA, 15 bp, Homo sapiens
aaggagaaaaaagag

SEQ ID NO: 167907 - DNA, 15 bp, Homo sapiens
aaaggagaaaaaaga

SEQ ID NO: 167908 - DNA, 15 bp, Homo sapiens
caaaggagaaaaaag

SEQ ID NO: 167909 - DNA, 15 bp, Homo sapiens
gcaaaggagaaaaaa

SEQ ID NO: 167910 - DNA, 15 bp, Homo sapiens
ggcaaaggagaaaaa

SEQ ID NO: 167911 - DNA, 15 bp, Homo sapiens
aggcaaaggagaaaa

SEQ ID NO: 167912 - DNA, 15 bp, Homo sapiens
gaggcaaaggagaaa

SEQ ID NO: 167913 - DNA, 15 bp, Homo sapiens
ggaggcaaaggagaa

SEQ ID NO: 167914 - DNA, 15 bp, Homo sapiens
aggaggcaaaggaga

SEQ ID NO: 167915 - DNA, 15 bp, Homo sapiens
gaggaggcaaaggag

SEQ ID NO: 167916 - DNA, 15 bp, Homo sapiens
ggaggaggcaaagga

SEQ ID NO: 167917 - DNA, 15 bp, Homo sapiens
aggaggaggcaaagg

SEQ ID NO: 167918 - DNA, 15 bp, Homo sapiens
aaggaggaggcaaag

SEQ ID NO: 167919 - DNA, 15 bp, Homo sapiens
aaaggaggaggcaaa

SEQ ID NO: 167920 - DNA, 15 bp, Homo sapiens
aaaaggaggaggcaa

SEQ ID NO: 167921 - DNA, 15 bp, Homo sapiens
caaaaggaggaggca

SEQ ID NO: 167922 - DNA, 15 bp, Homo sapiens
acaaaaggaggaggc

SEQ ID NO: 167923 - DNA, 15 bp, Homo sapiens
gacaaaaggaggagg

SEQ ID NO: 167924 - DNA, 15 bp, Homo sapiens
ggacaaaaggaggag

SEQ ID NO: 167925 - DNA, 15 bp, Homo sapiens
aggacaaaaggagga

SEQ ID NO: 167926 - DNA, 15 bp, Homo sapiens
aaggacaaaaggagg

SEQ ID NO: 167927 - DNA, 15 bp, Homo sapiens
aaaggacaaaaggag

SEQ ID NO: 167928 - DNA, 15 bp, Homo sapiens
aaaaggacaaaagga

SEQ ID NO: 167929 - DNA, 15 bp, Homo sapiens
gaaaaggacaaaagg

SEQ ID NO: 167930 - DNA, 15 bp, Homo sapiens
ggaaaaggacaaaag

SEQ ID NO: 167931 - DNA, 15 bp, Homo sapiens
tggaaaaggacaaaa

SEQ ID NO: 167932 - DNA, 15 bp, Homo sapiens
gtggaaaaggacaaa

SEQ ID NO: 167933 - DNA, 15 bp, Homo sapiens
ggtggaaaaggacaa

SEQ ID NO: 167934 - DNA, 15 bp, Homo sapiens
aggtggaaaaggaca

SEQ ID NO: 167935 - DNA, 15 bp, Homo sapiens
gaggtggaaaaggac

SEQ ID NO: 167936 - DNA, 15 bp, Homo sapiens
ggaggtggaaaagga

SEQ ID NO: 167937 - DNA, 15 bp, Homo sapiens
aggaggtggaaaagg

SEQ ID NO: 167938 - DNA, 15 bp, Homo sapiens
gaggaggtggaaaag

SEQ ID NO: 167939 - DNA, 15 bp, Homo sapiens
agaggaggtggaaaa

SEQ ID NO: 167940 - DNA, 15 bp, Homo sapiens
aagaggaggtggaaa

SEQ ID NO: 167941 - DNA, 15 bp, Homo sapiens
gaagaggaggtggaa

SEQ ID NO: 167942 - DNA, 15 bp, Homo sapiens
ggaagaggaggtgga

SEQ ID NO: 167943 - DNA, 15 bp, Homo sapiens
aggaagaggaggtgg

SEQ ID NO: 167944 - DNA, 15 bp, Homo sapiens
gaggaagaggaggtg

SEQ ID NO: 167945 - DNA, 15 bp, Homo sapiens
ggaggaagaggaggt

SEQ ID NO: 167946 - DNA, 15 bp, Homo sapiens
aggaggaagaggagg

SEQ ID NO: 167947 - DNA, 15 bp, Homo sapiens
aaggaggaagaggag

SEQ ID NO: 167948 - DNA, 15 bp, Homo sapiens
caaggaggaagagga

SEQ ID NO: 167949 - DNA, 15 bp, Homo sapiens
acaaggaggaagagg

SEQ ID NO: 167950 - DNA, 15 bp, Homo sapiens
gacaaggaggaagag

SEQ ID NO: 167951 - DNA, 15 bp, Homo sapiens
ggacaaggaggaaga

SEQ ID NO: 167952 - DNA, 15 bp, Homo sapiens
aggacaaggaggaag

SEQ ID NO: 167953 - DNA, 15 bp, Homo sapiens
gaggacaaggaggaa

SEQ ID NO: 167954 - DNA, 15 bp, Homo sapiens
ggaggacaaggagga

SEQ ID NO: 167955 - DNA, 15 bp, Homo sapiens
aggaggacaaggagg

SEQ ID NO: 167956 - DNA, 15 bp, Homo sapiens
aaggaggacaaggag

SEQ ID NO: 167957 - DNA, 15 bp, Homo sapiens
aaaggaggacaagga

SEQ ID NO: 167958 - DNA, 15 bp, Homo sapiens
aaaaggaggacaagg

SEQ ID NO: 167959 - DNA, 15 bp, Homo sapiens
aaaaaggaggacaag

SEQ ID NO: 167960 - DNA, 15 bp, Homo sapiens
gaaaaaggaggacaa

SEQ ID NO: 167961 - DNA, 15 bp, Homo sapiens
agaaaaaggaggaca

SEQ ID NO: 167962 - DNA, 15 bp, Homo sapiens
aagaaaaaggaggac

SEQ ID NO: 167963 - DNA, 15 bp, Homo sapiens
gaagaaaaaggagga

SEQ ID NO: 167964 - DNA, 15 bp, Homo sapiens
ggaagaaaaaggagg

SEQ ID NO: 167965 - DNA, 15 bp, Homo sapiens
aggaagaaaaaggag

SEQ ID NO: 167966 - DNA, 15 bp, Homo sapiens
aaggaagaaaaagga

SEQ ID NO: 167967 - DNA, 15 bp, Homo sapiens
gaaggaagaaaaagg

SEQ ID NO: 167968 - DNA, 15 bp, Homo sapiens
agaaggaagaaaaag

SEQ ID NO: 167969 - DNA, 15 bp, Homo sapiens
gagaaggaagaaaaa

SEQ ID NO: 167970 - DNA, 15 bp, Homo sapiens
agagaaggaagaaaa

SEQ ID NO: 167971 - DNA, 15 bp, Homo sapiens
gagagaaggaagaaa

SEQ ID NO: 167972 - DNA, 15 bp, Homo sapiens
agagagaaggaagaa

SEQ ID NO: 167973 - DNA, 15 bp, Homo sapiens
gagagagaaggaaga

SEQ ID NO: 167974 - DNA, 15 bp, Homo sapiens
ggagagagaaggaag

SEQ ID NO: 167975 - DNA, 15 bp, Homo sapiens
gggagagagaaggaa

SEQ ID NO: 167976 - DNA, 15 bp, Homo sapiens
agggagagagaagga

SEQ ID NO: 167977 - DNA, 15 bp, Homo sapiens
gagggagagagaagg

SEQ ID NO: 167978 - DNA, 15 bp, Homo sapiens
agagggagagagaag

SEQ ID NO: 167979 - DNA, 15 bp, Homo sapiens
aagagggagagagaa

SEQ ID NO: 167980 - DNA, 15 bp, Homo sapiens
gaagagggagagaga

SEQ ID NO: 167981 - DNA, 15 bp, Homo sapiens
agaagagggagagag

SEQ ID NO: 167982 - DNA, 15 bp, Homo sapiens
gagaagagggagaga

SEQ ID NO: 167983 - DNA, 15 bp, Homo sapiens
ggagaagagggagag

SEQ ID NO: 167984 - DNA, 15 bp, Homo sapiens
aggagaagagggaga

SEQ ID NO: 167985 - DNA, 15 bp, Homo sapiens
aaggagaagagggag

SEQ ID NO: 167986 - DNA, 15 bp, Homo sapiens
aaaggagaagaggga

SEQ ID NO: 167987 - DNA, 15 bp, Homo sapiens
aaaaggagaagaggg

SEQ ID NO: 167988 - DNA, 15 bp, Homo sapiens
aaaaaggagaagagg

SEQ ID NO: 167989 - DNA, 15 bp, Homo sapiens
aaaaaaggagaagag

SEQ ID NO: 167990 - DNA, 15 bp, Homo sapiens
aaaaaaaggagaaga

SEQ ID NO: 167991 - DNA, 15 bp, Homo sapiens
caaaaaaaggagaag

SEQ ID NO: 167992 - DNA, 15 bp, Homo sapiens
ccaaaaaaaggagaa

SEQ ID NO: 167993 - DNA, 15 bp, Homo sapiens
accaaaaaaaggaga

SEQ ID NO: 167994 - DNA, 15 bp, Homo sapiens
aaccaaaaaaaggag

SEQ ID NO: 167995 - DNA, 15 bp, Homo sapiens
taaccaaaaaaagga

SEQ ID NO: 167996 - DNA, 15 bp, Homo sapiens
ataaccaaaaaaagg

SEQ ID NO: 167997 - DNA, 15 bp, Homo sapiens
tataaccaaaaaaag

SEQ ID NO: 167998 - DNA, 15 bp, Homo sapiens
ttataaccaaaaaaa

SEQ ID NO: 167999 - DNA, 15 bp, Homo sapiens
attataaccaaaaaa

SEQ ID NO: 168000 - DNA, 15 bp, Homo sapiens
aattataaccaaaaa

SEQ ID NO: 168001 - DNA, 15 bp, Homo sapiens
taattataaccaaaa

SEQ ID NO: 168002 - DNA, 15 bp, Homo sapiens
ctaattataaccaaa

SEQ ID NO: 168003 - DNA, 15 bp, Homo sapiens
actaattataaccaa

SEQ ID NO: 168004 - DNA, 15 bp, Homo sapiens
aactaattataacca

SEQ ID NO: 168005 - DNA, 15 bp, Homo sapiens
aaactaattataacc

SEQ ID NO: 168006 - DNA, 15 bp, Homo sapiens
taaactaattataac

SEQ ID NO: 168007 - DNA, 15 bp, Homo sapiens
ataaactaattataa

SEQ ID NO: 168008 - DNA, 15 bp, Homo sapiens
aataaactaattata

SEQ ID NO: 168009 - DNA, 15 bp, Homo sapiens
aaataaactaattat

SEQ ID NO: 168010 - DNA, 15 bp, Homo sapiens
taaataaactaatta

SEQ ID NO: 168011 - DNA, 15 bp, Homo sapiens
ttaaataaactaatt

SEQ ID NO: 168012 - DNA, 15 bp, Homo sapiens
tttaaataaactaat

SEQ ID NO: 168013 - DNA, 15 bp, Homo sapiens
ctttaaataaactaa

SEQ ID NO: 168014 - DNA, 15 bp, Homo sapiens
gctttaaataaacta

SEQ ID NO: 168015 - DNA, 15 bp, Homo sapiens
agctttaaataaact

SEQ ID NO: 168016 - DNA, 15 bp, Homo sapiens
gagctttaaataaac

SEQ ID NO: 168017 - DNA, 15 bp, Homo sapiens
agagctttaaataaa

SEQ ID NO: 168018 - DNA, 15 bp, Homo sapiens
aagagctttaaataa

SEQ ID NO: 168019 - DNA, 15 bp, Homo sapiens
caagagctttaaata

SEQ ID NO: 168020 - DNA, 15 bp, Homo sapiens
gcaagagctttaaat

SEQ ID NO: 168021 - DNA, 15 bp, Homo sapiens
agcaagagctttaaa

SEQ ID NO: 168022 - DNA, 15 bp, Homo sapiens
aagcaagagctttaa

SEQ ID NO: 168023 - DNA, 15 bp, Homo sapiens
taagcaagagcttta

SEQ ID NO: 168024 - DNA, 15 bp, Homo sapiens
ataagcaagagcttt

SEQ ID NO: 168025 - DNA, 15 bp, Homo sapiens
aataagcaagagctt

SEQ ID NO: 168026 - DNA, 15 bp, Homo sapiens
aaataagcaagagct

SEQ ID NO: 168027 - DNA, 15 bp, Homo sapiens
aaaataagcaagagc

SEQ ID NO: 168028 - DNA, 15 bp, Homo sapiens
aaaaataagcaagag

SEQ ID NO: 168029 - DNA, 15 bp, Homo sapiens
caaaaataagcaaga

SEQ ID NO: 168030 - DNA, 15 bp, Homo sapiens
gcaaaaataagcaag

SEQ ID NO: 168031 - DNA, 15 bp, Homo sapiens
agcaaaaataagcaa

SEQ ID NO: 168032 - DNA, 15 bp, Homo sapiens
gagcaaaaataagca

SEQ ID NO: 168033 - DNA, 15 bp, Homo sapiens
tgagcaaaaataagc

SEQ ID NO: 168034 - DNA, 15 bp, Homo sapiens
atgagcaaaaataag

SEQ ID NO: 168035 - DNA, 15 bp, Homo sapiens
gatgagcaaaaataa

SEQ ID NO: 168036 - DNA, 15 bp, Homo sapiens
ggatgagcaaaaata

SEQ ID NO: 168037 - DNA, 15 bp, Homo sapiens
aggatgagcaaaaat

SEQ ID NO: 168038 - DNA, 15 bp, Homo sapiens
aaggatgagcaaaaa

SEQ ID NO: 168039 - DNA, 15 bp, Homo sapiens
taaggatgagcaaaa

SEQ ID NO: 168040 - DNA, 15 bp, Homo sapiens
ttaaggatgagcaaa

SEQ ID NO: 168041 - DNA, 15 bp, Homo sapiens
attaaggatgagcaa

SEQ ID NO: 168042 - DNA, 15 bp, Homo sapiens
tattaaggatgagca

SEQ ID NO: 168043 - DNA, 15 bp, Homo sapiens
atattaaggatgagc

SEQ ID NO: 168044 - DNA, 15 bp, Homo sapiens
tatattaaggatgag

SEQ ID NO: 168045 - DNA, 15 bp, Homo sapiens
ttatattaaggatga

SEQ ID NO: 168046 - DNA, 15 bp, Homo sapiens
tttatattaaggatg

SEQ ID NO: 168047 - DNA, 15 bp, Homo sapiens
atttatattaaggat

SEQ ID NO: 168048 - DNA, 15 bp, Homo sapiens
tatttatattaagga

SEQ ID NO: 168049 - DNA, 15 bp, Homo sapiens
ctatttatattaagg

SEQ ID NO: 168050 - DNA, 15 bp, Homo sapiens
tctatttatattaag

SEQ ID NO: 168051 - DNA, 15 bp, Homo sapiens
atctatttatattaa

SEQ ID NO: 168052 - DNA, 15 bp, Homo sapiens
gatctatttatatta

SEQ ID NO: 168053 - DNA, 15 bp, Homo sapiens
agatctatttatatt

SEQ ID NO: 168054 - DNA, 15 bp, Homo sapiens
aagatctatttatat

SEQ ID NO: 168055 - DNA, 15 bp, Homo sapiens
gaagatctatttata

SEQ ID NO: 168056 - DNA, 15 bp, Homo sapiens
tgaagatctatttat

SEQ ID NO: 168057 - DNA, 15 bp, Homo sapiens
atgaagatctattta

SEQ ID NO: 168058 - DNA, 15 bp, Homo sapiens
aatgaagatctattt

SEQ ID NO: 168059 - DNA, 15 bp, Homo sapiens
caatgaagatctatt

SEQ ID NO: 168060 - DNA, 15 bp, Homo sapiens
acaatgaagatctat

SEQ ID NO: 168061 - DNA, 15 bp, Homo sapiens
tacaatgaagatcta

SEQ ID NO: 168062 - DNA, 15 bp, Homo sapiens
atacaatgaagatct

SEQ ID NO: 168063 - DNA, 15 bp, Homo sapiens
aatacaatgaagatc

SEQ ID NO: 168064 - DNA, 15 bp, Homo sapiens
gaatacaatgaagat

SEQ ID NO: 168065 - DNA, 15 bp, Homo sapiens
cgaatacaatgaaga

SEQ ID NO: 168066 - DNA, 15 bp, Homo sapiens
acgaatacaatgaag

SEQ ID NO: 168067 - DNA, 15 bp, Homo sapiens
cacgaatacaatgaa

SEQ ID NO: 168068 - DNA, 15 bp, Homo sapiens
tcacgaatacaatga

SEQ ID NO: 168069 - DNA, 15 bp, Homo sapiens
gtcacgaatacaatg

SEQ ID NO: 168070 - DNA, 15 bp, Homo sapiens
tgtcacgaatacaat

SEQ ID NO: 168071 - DNA, 15 bp, Homo sapiens
atgtcacgaatacaa

SEQ ID NO: 168072 - DNA, 15 bp, Homo sapiens
catgtcacgaataca

SEQ ID NO: 168073 - DNA, 15 bp, Homo sapiens
acatgtcacgaatac

SEQ ID NO: 168074 - DNA, 15 bp, Homo sapiens
aacatgtcacgaata

SEQ ID NO: 168075 - DNA, 15 bp, Homo sapiens
aaacatgtcacgaat

SEQ ID NO: 168076 - DNA, 15 bp, Homo sapiens
aaaacatgtcacgaa

SEQ ID NO: 168077 - DNA, 15 bp, Homo sapiens
taaaacatgtcacga

SEQ ID NO: 168078 - DNA, 15 bp, Homo sapiens
ataaaacatgtcacg

SEQ ID NO: 168079 - DNA, 15 bp, Homo sapiens
gataaaacatgtcac

SEQ ID NO: 168080 - DNA, 15 bp, Homo sapiens
tgataaaacatgtca

SEQ ID NO: 168081 - DNA, 15 bp, Homo sapiens
gtgataaaacatgtc

SEQ ID NO: 168082 - DNA, 15 bp, Homo sapiens
tgtgataaaacatgt

SEQ ID NO: 168083 - DNA, 15 bp, Homo sapiens
atgtgataaaacatg

SEQ ID NO: 168084 - DNA, 15 bp, Homo sapiens
aatgtgataaaacat

SEQ ID NO: 168085 - DNA, 15 bp, Homo sapiens
gaatgtgataaaaca

SEQ ID NO: 168086 - DNA, 15 bp, Homo sapiens
agaatgtgataaaac

SEQ ID NO: 168087 - DNA, 15 bp, Homo sapiens
aagaatgtgataaaa

SEQ ID NO: 168088 - DNA, 15 bp, Homo sapiens
gaagaatgtgataaa

SEQ ID NO: 168089 - DNA, 15 bp, Homo sapiens
tgaagaatgtgataa

SEQ ID NO: 168090 - DNA, 15 bp, Homo sapiens
atgaagaatgtgata

SEQ ID NO: 168091 - DNA, 15 bp, Homo sapiens
catgaagaatgtgat

SEQ ID NO: 168092 - DNA, 15 bp, Homo sapiens
tcatgaagaatgtga

SEQ ID NO: 168093 - DNA, 15 bp, Homo sapiens
ttcatgaagaatgtg

SEQ ID NO: 168094 - DNA, 15 bp, Homo sapiens
tttcatgaagaatgt

SEQ ID NO: 168095 - DNA, 15 bp, Homo sapiens
atttcatgaagaatg

SEQ ID NO: 168096 - DNA, 15 bp, Homo sapiens
aatttcatgaagaat

SEQ ID NO: 168097 - DNA, 15 bp, Homo sapiens
aaatttcatgaagaa

SEQ ID NO: 168098 - DNA, 15 bp, Homo sapiens
aaaatttcatgaaga

SEQ ID NO: 168099 - DNA, 15 bp, Homo sapiens
taaaatttcatgaag

SEQ ID NO: 168100 - DNA, 15 bp, Homo sapiens
ttaaaatttcatgaa

SEQ ID NO: 168101 - DNA, 15 bp, Homo sapiens
attaaaatttcatga

SEQ ID NO: 168102 - DNA, 15 bp, Homo sapiens
ttattaaaatttcat

SEQ ID NO: 168103 - DNA, 15 bp, Homo sapiens
tttattaaaatttca

SEQ ID NO: 168104 - DNA, 15 bp, Homo sapiens
gtttattaaaatttc

SEQ ID NO: 168105 - DNA, 15 bp, Homo sapiens
tgtttattaaaattt

SEQ ID NO: 168106 - DNA, 15 bp, Homo sapiens
ctgtttattaaaatt

SEQ ID NO: 168107 - DNA, 15 bp, Homo sapiens
actgtttattaaaat

SEQ ID NO: 168108 - DNA, 15 bp, Homo sapiens
aactgtttattaaaa

SEQ ID NO: 168109 - DNA, 15 bp, Homo sapiens
caactgtttattaaa

SEQ ID NO: 168110 - DNA, 15 bp, Homo sapiens
tcaactgtttattaa

SEQ ID NO: 168111 - DNA, 15 bp, Homo sapiens
ttcaactgtttatta

SEQ ID NO: 168112 - DNA, 15 bp, Homo sapiens
attcaactgtttatt

SEQ ID NO: 168113 - DNA, 15 bp, Homo sapiens
tattcaactgtttat

SEQ ID NO: 168114 - DNA, 15 bp, Homo sapiens
atattcaactgttta

SEQ ID NO: 168115 - DNA, 15 bp, Homo sapiens
aatattcaactgttt

SEQ ID NO: 168116 - DNA, 15 bp, Homo sapiens
aaatattcaactgtt

SEQ ID NO: 168117 - DNA, 15 bp, Homo sapiens
aaaatattcaactgt

SEQ ID NO: 168118 - DNA, 15 bp, Homo sapiens
gaaaatattcaactg

SEQ ID NO: 168119 - DNA, 15 bp, Homo sapiens
agaaaatattcaact

SEQ ID NO: 168120 - DNA, 15 bp, Homo sapiens
tagaaaatattcaac

SEQ ID NO: 168121 - DNA, 15 bp, Homo sapiens
atagaaaatattcaa

SEQ ID NO: 168122 - DNA, 15 bp, Homo sapiens
aatagaaaatattca

SEQ ID NO: 168123 - DNA, 15 bp, Homo sapiens
aataatagaaaatat

SEQ ID NO: 168124 - DNA, 15 bp, Homo sapiens
aaataatagaaaata

SEQ ID NO: 168125 - DNA, 15 bp, Homo sapiens
taaataatagaaaat

SEQ ID NO: 168126 - DNA, 15 bp, Homo sapiens
ataaataatagaaaa

SEQ ID NO: 168127 - DNA, 15 bp, Homo sapiens
tataaataatagaaa

SEQ ID NO: 168128 - DNA, 15 bp, Homo sapiens
gtataaataatagaa

SEQ ID NO: 168129 - DNA, 15 bp, Homo sapiens
tgtataaataataga

SEQ ID NO: 168130 - DNA, 15 bp, Homo sapiens
atgtataaataatag

SEQ ID NO: 168131 - DNA, 15 bp, Homo sapiens
tatgtataaataata

SEQ ID NO: 168132 - DNA, 15 bp, Homo sapiens
atatgtataaataat

SEQ ID NO: 168133 - DNA, 15 bp, Homo sapiens
catatgtataaataa

SEQ ID NO: 168134 - DNA, 15 bp, Homo sapiens
cacatatgtataaat

SEQ ID NO: 168135 - DNA, 15 bp, Homo sapiens
acacatatgtataaa

SEQ ID NO: 168136 - DNA, 15 bp, Homo sapiens
tacacatatgtataa

SEQ ID NO: 168137 - DNA, 15 bp, Homo sapiens
ttacacatatgtata

SEQ ID NO: 168138 - DNA, 15 bp, Homo sapiens
attacacatatgtat

SEQ ID NO: 168139 - DNA, 15 bp, Homo sapiens
tattacacatatgta

SEQ ID NO: 168140 - DNA, 15 bp, Homo sapiens
atattacacatatgt

SEQ ID NO: 168141 - DNA, 15 bp, Homo sapiens
aatattacacatatg

SEQ ID NO: 168142 - DNA, 15 bp, Homo sapiens
taatattacacatat

SEQ ID NO: 168143 - DNA, 15 bp, Homo sapiens
gtaatattacacata

SEQ ID NO: 168144 - DNA, 15 bp, Homo sapiens
agtaatattacacat

SEQ ID NO: 168145 - DNA, 15 bp, Homo sapiens
gagtaatattacaca

SEQ ID NO: 168146 - DNA, 15 bp, Homo sapiens
agagtaatattacac

SEQ ID NO: 168147 - DNA, 15 bp, Homo sapiens
aagagtaatattaca

SEQ ID NO: 168148 - DNA, 15 bp, Homo sapiens
gaagagtaatattac

SEQ ID NO: 168149 - DNA, 15 bp, Homo sapiens
agaagagtaatatta

SEQ ID NO: 168150 - DNA, 15 bp, Homo sapiens
gagaagagtaatatt

SEQ ID NO: 168151 - DNA, 15 bp, Homo sapiens
tgagaagagtaatat

SEQ ID NO: 168152 - DNA, 15 bp, Homo sapiens
ttgagaagagtaata

SEQ ID NO: 168153 - DNA, 15 bp, Homo sapiens
tttgagaagagtaat

SEQ ID NO: 168154 - DNA, 15 bp, Homo sapiens
atttgagaagagtaa

SEQ ID NO: 168155 - DNA, 15 bp, Homo sapiens
tatttgagaagagta

SEQ ID NO: 168156 - DNA, 15 bp, Homo sapiens
atatttgagaagagt

SEQ ID NO: 168157 - DNA, 15 bp, Homo sapiens
tatatttgagaagag

SEQ ID NO: 168158 - DNA, 15 bp, Homo sapiens
gtatatttgagaaga

SEQ ID NO: 168159 - DNA, 15 bp, Homo sapiens
ggtatatttgagaag

SEQ ID NO: 168160 - DNA, 15 bp, Homo sapiens
tggtatatttgagaa

SEQ ID NO: 168161 - DNA, 15 bp, Homo sapiens
atggtatatttgaga

SEQ ID NO: 168162 - DNA, 15 bp, Homo sapiens
aatggtatatttgag

SEQ ID NO: 168163 - DNA, 15 bp, Homo sapiens
caatggtatatttga

SEQ ID NO: 168164 - DNA, 15 bp, Homo sapiens
tcaatggtatatttg

SEQ ID NO: 168165 - DNA, 15 bp, Homo sapiens
ttcaatggtatattt

SEQ ID NO: 168166 - DNA, 15 bp, Homo sapiens
attcaatggtatatt

SEQ ID NO: 168167 - DNA, 15 bp, Homo sapiens
cattcaatggtatat

SEQ ID NO: 168168 - DNA, 15 bp, Homo sapiens
tcattcaatggtata

SEQ ID NO: 168169 - DNA, 15 bp, Homo sapiens
ctcattcaatggtat

SEQ ID NO: 168170 - DNA, 15 bp, Homo sapiens
actcattcaatggta

SEQ ID NO: 168171 - DNA, 15 bp, Homo sapiens
cactcattcaatggt

SEQ ID NO: 168172 - DNA, 15 bp, Homo sapiens
acactcattcaatgg

SEQ ID NO: 168173 - DNA, 15 bp, Homo sapiens
aacactcattcaatg

SEQ ID NO: 168174 - DNA, 15 bp, Homo sapiens
aaacactcattcaat

SEQ ID NO: 168175 - DNA, 15 bp, Homo sapiens
aaaacactcattcaa

SEQ ID NO: 168176 - DNA, 15 bp, Homo sapiens
taaaacactcattca

SEQ ID NO: 168177 - DNA, 15 bp, Homo sapiens
ataaaacactcattc

SEQ ID NO: 168178 - DNA, 15 bp, Homo sapiens
gataaaacactcatt

SEQ ID NO: 168179 - DNA, 15 bp, Homo sapiens
agataaaacactcat

SEQ ID NO: 168180 - DNA, 15 bp, Homo sapiens
aagataaaacactca

SEQ ID NO: 168181 - DNA, 15 bp, Homo sapiens
taagataaaacactc

SEQ ID NO: 168182 - DNA, 15 bp, Homo sapiens
gtaagataaaacact

SEQ ID NO: 168183 - DNA, 15 bp, Homo sapiens
tgtaagataaaacac

SEQ ID NO: 168184 - DNA, 15 bp, Homo sapiens
ttgtaagataaaaca

SEQ ID NO: 168185 - DNA, 15 bp, Homo sapiens
attgtaagataaaac

SEQ ID NO: 168186 - DNA, 15 bp, Homo sapiens
tattgtaagataaaa

SEQ ID NO: 168187 - DNA, 15 bp, Homo sapiens
ctattgtaagataaa

SEQ ID NO: 168188 - DNA, 15 bp, Homo sapiens
tctattgtaagataa

SEQ ID NO: 168189 - DNA, 15 bp, Homo sapiens
atctattgtaagata

SEQ ID NO: 168190 - DNA, 15 bp, Homo sapiens
catctattgtaagat

SEQ ID NO: 168191 - DNA, 15 bp, Homo sapiens
ccatctattgtaaga

SEQ ID NO: 168192 - DNA, 15 bp, Homo sapiens
accatctattgtaag

SEQ ID NO: 168193 - DNA, 15 bp, Homo sapiens
taccatctattgtaa

SEQ ID NO: 168194 - DNA, 15 bp, Homo sapiens
ataccatctattgta

SEQ ID NO: 168195 - DNA, 15 bp, Homo sapiens
gataccatctattgt

SEQ ID NO: 168196 - DNA, 15 bp, Homo sapiens
ggataccatctattg

SEQ ID NO: 168197 - DNA, 15 bp, Homo sapiens
tggataccatctatt

SEQ ID NO: 168198 - DNA, 15 bp, Homo sapiens
atggataccatctat

SEQ ID NO: 168199 - DNA, 15 bp, Homo sapiens
aatggataccatcta

SEQ ID NO: 168200 - DNA, 15 bp, Homo sapiens
aaatggataccatct

SEQ ID NO: 168201 - DNA, 15 bp, Homo sapiens
aaaatggataccatc

SEQ ID NO: 168202 - DNA, 15 bp, Homo sapiens
aaaaatggataccat

SEQ ID NO: 168203 - DNA, 15 bp, Homo sapiens
aaaaaatggatacca

SEQ ID NO: 168204 - DNA, 15 bp, Homo sapiens
aaaaaaatggatacc

SEQ ID NO: 168205 - DNA, 15 bp, Homo sapiens
aaaaaaaatggatac

SEQ ID NO: 168206 - DNA, 15 bp, Homo sapiens
aaaaaaaaatggata

SEQ ID NO: 168207 - DNA, 15 bp, Homo sapiens
caaaaaaaaatggat

SEQ ID NO: 168208 - DNA, 15 bp, Homo sapiens
acaaaaaaaaatgga

SEQ ID NO: 168209 - DNA, 15 bp, Homo sapiens
aacaaaaaaaaatgg

SEQ ID NO: 168210 - DNA, 15 bp, Homo sapiens
caacaaaaaaaaatg

SEQ ID NO: 168211 - DNA, 15 bp, Homo sapiens
aaaacaacaaaaaaa

SEQ ID NO: 168212 - DNA, 15 bp, Homo sapiens
aaaaacaacaaaaaa

SEQ ID NO: 168213 - DNA, 15 bp, Homo sapiens
aaaaaacaacaaaaa

SEQ ID NO: 168214 - DNA, 15 bp, Homo sapiens
aaaaaaacaacaaaa

SEQ ID NO: 168215 - DNA, 15 bp, Homo sapiens
aaaaaaaacaacaaa

SEQ ID NO: 168216 - DNA, 15 bp, Homo sapiens
aaaaaaaaacaacaa

SEQ ID NO: 168217 - DNA, 15 bp, Homo sapiens
aaaaaaaaaacaaca

SEQ ID NO: 168218 - DNA, 15 bp, Homo sapiens
aaaaaaaaaaacaac

SEQ ID NO: 168219 - DNA, 15 bp, Homo sapiens
aaaaaaaaaaaaaca

SEQ ID NO: 168220 - DNA, 15 bp, Homo sapiens
gtctccaaaaaaaaa

SEQ ID NO: 168221 - DNA, 15 bp, Homo sapiens
cgtctccaaaaaaaa

SEQ ID NO: 168222 - DNA, 15 bp, Homo sapiens
ccgtctccaaaaaaa

SEQ ID NO: 168223 - DNA, 15 bp, Homo sapiens
tccgtctccaaaaaa

SEQ ID NO: 168224 - DNA, 15 bp, Homo sapiens
ctccgtctccaaaaa

SEQ ID NO: 168225 - DNA, 15 bp, Homo sapiens
actccgtctccaaaa

SEQ ID NO: 168226 - DNA, 15 bp, Homo sapiens
gactccgtctccaaa

SEQ ID NO: 168227 - DNA, 15 bp, Homo sapiens
agactccgtctccaa

SEQ ID NO: 168228 - DNA, 15 bp, Homo sapiens
aagactccgtctcca

SEQ ID NO: 168229 - DNA, 15 bp, Homo sapiens
caagactccgtctcc

SEQ ID NO: 168230 - DNA, 15 bp, Homo sapiens
cagcaagactccgtc

SEQ ID NO: 168231 - DNA, 15 bp, Homo sapiens
acagcaagactccgt

SEQ ID NO: 168232 - DNA, 15 bp, Homo sapiens
cacagcaagactccg

SEQ ID NO: 168233 - DNA, 15 bp, Homo sapiens
acacagcaagactcc

SEQ ID NO: 168234 - DNA, 15 bp, Homo sapiens
gacacagcaagactc

SEQ ID NO: 168235 - DNA, 15 bp, Homo sapiens
cgacacagcaagact

SEQ ID NO: 168236 - DNA, 15 bp, Homo sapiens
acgacacagcaagac

SEQ ID NO: 168237 - DNA, 15 bp, Homo sapiens
gacgacacagcaaga

SEQ ID NO: 168238 - DNA, 15 bp, Homo sapiens
ggacgacacagcaag

SEQ ID NO: 168239 - DNA, 15 bp, Homo sapiens
tggacgacacagcaa

SEQ ID NO: 168240 - DNA, 15 bp, Homo sapiens
ctggacgacacagca

SEQ ID NO: 168241 - DNA, 15 bp, Homo sapiens
cctggacgacacagc

SEQ ID NO: 168242 - DNA, 15 bp, Homo sapiens
gcctggacgacacag

SEQ ID NO: 168243 - DNA, 15 bp, Homo sapiens
agcctggacgacaca

SEQ ID NO: 168244 - DNA, 15 bp, Homo sapiens
cagcctggacgacac

SEQ ID NO: 168245 - DNA, 15 bp, Homo sapiens
ccagcctggacgaca

SEQ ID NO: 168246 - DNA, 15 bp, Homo sapiens
tccagcctggacgac

SEQ ID NO: 168247 - DNA, 15 bp, Homo sapiens
ctccagcctggacga

SEQ ID NO: 168248 - DNA, 15 bp, Homo sapiens
actccagcctggacg

SEQ ID NO: 168249 - DNA, 15 bp, Homo sapiens
tactccagcctggac

SEQ ID NO: 168250 - DNA, 15 bp, Homo sapiens
gtactccagcctgga

SEQ ID NO: 168251 - DNA, 15 bp, Homo sapiens
gtgtactccagcctg

SEQ ID NO: 168252 - DNA, 15 bp, Homo sapiens
cgtgtactccagcct

SEQ ID NO: 168253 - DNA, 15 bp, Homo sapiens
tcgtgtactccagcc

SEQ ID NO: 168254 - DNA, 15 bp, Homo sapiens
atcgtgtactccagc

SEQ ID NO: 168255 - DNA, 15 bp, Homo sapiens
gatcgtgtactccag

SEQ ID NO: 168256 - DNA, 15 bp, Homo sapiens
agatcgtgtactcca

SEQ ID NO: 168257 - DNA, 15 bp, Homo sapiens
aagatcgtgtactcc

SEQ ID NO: 168258 - DNA, 15 bp, Homo sapiens
caagatcgtgtactc

SEQ ID NO: 168259 - DNA, 15 bp, Homo sapiens
ccaagatcgtgtact

SEQ ID NO: 168260 - DNA, 15 bp, Homo sapiens
gccaagatcgtgtac

SEQ ID NO: 168261 - DNA, 15 bp, Homo sapiens
agccaagatcgtgta

SEQ ID NO: 168262 - DNA, 15 bp, Homo sapiens
gagccaagatcgtgt

SEQ ID NO: 168263 - DNA, 15 bp, Homo sapiens
ggcagtgagccaaga

SEQ ID NO: 168264 - DNA, 15 bp, Homo sapiens
tggcagtgagccaag

SEQ ID NO: 168265 - DNA, 15 bp, Homo sapiens
gtggcagtgagccaa

SEQ ID NO: 168266 - DNA, 15 bp, Homo sapiens
ggtggcagtgagcca

SEQ ID NO: 168267 - DNA, 15 bp, Homo sapiens
aggtggcagtgagcc

SEQ ID NO: 168268 - DNA, 15 bp, Homo sapiens
gaggtggcagtgagc

SEQ ID NO: 168269 - DNA, 15 bp, Homo sapiens
ggaggtggcagtgag

SEQ ID NO: 168270 - DNA, 15 bp, Homo sapiens
cggaggtggcagtga

SEQ ID NO: 168271 - DNA, 15 bp, Homo sapiens
gcggaggtggcagtg

SEQ ID NO: 168272 - DNA, 15 bp, Homo sapiens
ggcggaggtggcagt

SEQ ID NO: 168273 - DNA, 15 bp, Homo sapiens
aggcggaggtggcag

SEQ ID NO: 168274 - DNA, 15 bp, Homo sapiens
gaggcggaggtggca

SEQ ID NO: 168275 - DNA, 15 bp, Homo sapiens
ggaggcggaggtggc

SEQ ID NO: 168276 - DNA, 15 bp, Homo sapiens
gggaggcggaggtgg

SEQ ID NO: 168277 - DNA, 15 bp, Homo sapiens
tgggaggcggaggtg

SEQ ID NO: 168278 - DNA, 15 bp, Homo sapiens
tgcatgaacctggga

SEQ ID NO: 168279 - DNA, 15 bp, Homo sapiens
ttgcatgaacctggg

SEQ ID NO: 168280 - DNA, 15 bp, Homo sapiens
attgcatgaacctgg

SEQ ID NO: 168281 - DNA, 15 bp, Homo sapiens
aattgcatgaacctg

SEQ ID NO: 168282 - DNA, 15 bp, Homo sapiens
taattgcatgaacct

SEQ ID NO: 168283 - DNA, 15 bp, Homo sapiens
ttaattgcatgaacc

SEQ ID NO: 168284 - DNA, 15 bp, Homo sapiens
attaattgcatgaac

SEQ ID NO: 168285 - DNA, 15 bp, Homo sapiens
aattaattgcatgaa

SEQ ID NO: 168286 - DNA, 15 bp, Homo sapiens
gaattaattgcatga

SEQ ID NO: 168287 - DNA, 15 bp, Homo sapiens
agaattaattgcatg

SEQ ID NO: 168288 - DNA, 15 bp, Homo sapiens
gagaattaattgcat

SEQ ID NO: 168289 - DNA, 15 bp, Homo sapiens
ggagaattaattgca

SEQ ID NO: 168290 - DNA, 15 bp, Homo sapiens
aggagaattaattgc

SEQ ID NO: 168291 - DNA, 15 bp, Homo sapiens
caggagaattaattg

SEQ ID NO: 168292 - DNA, 15 bp, Homo sapiens
gcaggagaattaatt

SEQ ID NO: 168293 - DNA, 15 bp, Homo sapiens
ggcaggagaattaat

SEQ ID NO: 168294 - DNA, 15 bp, Homo sapiens
aggcaggagaattaa

SEQ ID NO: 168295 - DNA, 15 bp, Homo sapiens
gaggcaggagaatta

SEQ ID NO: 168296 - DNA, 15 bp, Homo sapiens
atatgcctgtaatcc

SEQ ID NO: 168297 - DNA, 15 bp, Homo sapiens
catatgcctgtaatc

SEQ ID NO: 168298 - DNA, 15 bp, Homo sapiens
gcatatgcctgtaat

SEQ ID NO: 168299 - DNA, 15 bp, Homo sapiens
ggcatatgcctgtaa

SEQ ID NO: 168300 - DNA, 15 bp, Homo sapiens
tggcatatgcctgta

SEQ ID NO: 168301 - DNA, 15 bp, Homo sapiens
atggtggcatatgcc

SEQ ID NO: 168302 - DNA, 15 bp, Homo sapiens
tatggtggcatatgc

SEQ ID NO: 168303 - DNA, 15 bp, Homo sapiens
gtatggtggcatatg

SEQ ID NO: 168304 - DNA, 15 bp, Homo sapiens
ggtatggtggcatat

SEQ ID NO: 168305 - DNA, 15 bp, Homo sapiens
aggtatggtggcata

SEQ ID NO: 168306 - DNA, 15 bp, Homo sapiens
caggtatggtggcat

SEQ ID NO: 168307 - DNA, 15 bp, Homo sapiens
gccaggtatggtggc

SEQ ID NO: 168308 - DNA, 15 bp, Homo sapiens
agccaggtatggtgg

SEQ ID NO: 168309 - DNA, 15 bp, Homo sapiens
tagccaggtatggtg

SEQ ID NO: 168310 - DNA, 15 bp, Homo sapiens
ttagccaggtatggt

SEQ ID NO: 168311 - DNA, 15 bp, Homo sapiens
aataaaaatacaaaa

SEQ ID NO: 168312 - DNA, 15 bp, Homo sapiens
taataaaaatacaaa

SEQ ID NO: 168313 - DNA, 15 bp, Homo sapiens
ctaataaaaatacaa

SEQ ID NO: 168314 - DNA, 15 bp, Homo sapiens
tctaataaaaataca

SEQ ID NO: 168315 - DNA, 15 bp, Homo sapiens
ctctaataaaaatac

SEQ ID NO: 168316 - DNA, 15 bp, Homo sapiens
tctctaataaaaata

SEQ ID NO: 168317 - DNA, 15 bp, Homo sapiens
atctctaataaaaat

SEQ ID NO: 168318 - DNA, 15 bp, Homo sapiens
catctctaataaaaa

SEQ ID NO: 168319 - DNA, 15 bp, Homo sapiens
ccatctctaataaaa

SEQ ID NO: 168320 - DNA, 15 bp, Homo sapiens
cccatctctaataaa

SEQ ID NO: 168321 - DNA, 15 bp, Homo sapiens
ccccatctctaataa

SEQ ID NO: 168322 - DNA, 15 bp, Homo sapiens
accccatctctaata

SEQ ID NO: 168323 - DNA, 15 bp, Homo sapiens
aaccccatctctaat

SEQ ID NO: 168324 - DNA, 15 bp, Homo sapiens
aaaccccatctctaa

SEQ ID NO: 168325 - DNA, 15 bp, Homo sapiens
agataccagcctggc

SEQ ID NO: 168326 - DNA, 15 bp, Homo sapiens
tagataccagcctgg

SEQ ID NO: 168327 - DNA, 15 bp, Homo sapiens
ttagataccagcctg

SEQ ID NO: 168328 - DNA, 15 bp, Homo sapiens
gttagataccagcct

SEQ ID NO: 168329 - DNA, 15 bp, Homo sapiens
agttagataccagcc

SEQ ID NO: 168330 - DNA, 15 bp, Homo sapiens
gagttagataccagc

SEQ ID NO: 168331 - DNA, 15 bp, Homo sapiens
ggagttagataccag

SEQ ID NO: 168332 - DNA, 15 bp, Homo sapiens
aggagttagatacca

SEQ ID NO: 168333 - DNA, 15 bp, Homo sapiens
caggagttagatacc

SEQ ID NO: 168334 - DNA, 15 bp, Homo sapiens
tcaggagttagatac

SEQ ID NO: 168335 - DNA, 15 bp, Homo sapiens
gtcaggagttagata

SEQ ID NO: 168336 - DNA, 15 bp, Homo sapiens
ggtcaggagttagat

SEQ ID NO: 168337 - DNA, 15 bp, Homo sapiens
cggtcaggagttaga

SEQ ID NO: 168338 - DNA, 15 bp, Homo sapiens
gcggtcaggagttag

SEQ ID NO: 168339 - DNA, 15 bp, Homo sapiens
tgcggtcaggagtta

SEQ ID NO: 168340 - DNA, 15 bp, Homo sapiens
ttgcggtcaggagtt

SEQ ID NO: 168341 - DNA, 15 bp, Homo sapiens
cttgcggtcaggagt

SEQ ID NO: 168342 - DNA, 15 bp, Homo sapiens
acttgcggtcaggag

SEQ ID NO: 168343 - DNA, 15 bp, Homo sapiens
cacttgcggtcagga

SEQ ID NO: 168344 - DNA, 15 bp, Homo sapiens
tcacttgcggtcagg

SEQ ID NO: 168345 - DNA, 15 bp, Homo sapiens
atcacttgcggtcag

SEQ ID NO: 168346 - DNA, 15 bp, Homo sapiens
gatcacttgcggtca

SEQ ID NO: 168347 - DNA, 15 bp, Homo sapiens
agatcacttgcggtc

SEQ ID NO: 168348 - DNA, 15 bp, Homo sapiens
cagatcacttgcggt

SEQ ID NO: 168349 - DNA, 15 bp, Homo sapiens
gcagatcacttgcgg

SEQ ID NO: 168350 - DNA, 15 bp, Homo sapiens
ggcagatcacttgcg

SEQ ID NO: 168351 - DNA, 15 bp, Homo sapiens
aggcagatcacttgc

SEQ ID NO: 168352 - DNA, 15 bp, Homo sapiens
aggaggccaaggcag

SEQ ID NO: 168353 - DNA, 15 bp, Homo sapiens
caggaggccaaggca

SEQ ID NO: 168354 - DNA, 15 bp, Homo sapiens
tcaggaggccaaggc

SEQ ID NO: 168355 - DNA, 15 bp, Homo sapiens
ttcaggaggccaagg

SEQ ID NO: 168356 - DNA, 15 bp, Homo sapiens
cttcaggaggccaag

SEQ ID NO: 168357 - DNA, 15 bp, Homo sapiens
acttcaggaggccaa

SEQ ID NO: 168358 - DNA, 15 bp, Homo sapiens
cacttcaggaggcca

SEQ ID NO: 168359 - DNA, 15 bp, Homo sapiens
gcacttcaggaggcc

SEQ ID NO: 168360 - DNA, 15 bp, Homo sapiens
agcacttcaggaggc

SEQ ID NO: 168361 - DNA, 15 bp, Homo sapiens
cagcacttcaggagg

SEQ ID NO: 168362 - DNA, 15 bp, Homo sapiens
ccagcacttcaggag

SEQ ID NO: 168363 - DNA, 15 bp, Homo sapiens
cccagcacttcagga

SEQ ID NO: 168364 - DNA, 15 bp, Homo sapiens
tcccagcacttcagg

SEQ ID NO: 168365 - DNA, 15 bp, Homo sapiens
tggcacagtggctca

SEQ ID NO: 168366 - DNA, 15 bp, Homo sapiens
ctggcacagtggctc

SEQ ID NO: 168367 - DNA, 15 bp, Homo sapiens
cctggcacagtggct

SEQ ID NO: 168368 - DNA, 15 bp, Homo sapiens
gcctggcacagtggc

SEQ ID NO: 168369 - DNA, 15 bp, Homo sapiens
agcctggcacagtgg

SEQ ID NO: 168370 - DNA, 15 bp, Homo sapiens
cagcctggcacagtg

SEQ ID NO: 168371 - DNA, 15 bp, Homo sapiens
ccagcctggcacagt

SEQ ID NO: 168372 - DNA, 15 bp, Homo sapiens
tccagcctggcacag

SEQ ID NO: 168373 - DNA, 15 bp, Homo sapiens
atccagcctggcaca

SEQ ID NO: 168374 - DNA, 15 bp, Homo sapiens
catccagcctggcac

SEQ ID NO: 168375 - DNA, 15 bp, Homo sapiens
ccatccagcctggca

SEQ ID NO: 168376 - DNA, 15 bp, Homo sapiens
accatccagcctggc

SEQ ID NO: 168377 - DNA, 15 bp, Homo sapiens
taccatccagcctgg

SEQ ID NO: 168378 - DNA, 15 bp, Homo sapiens
ataccatccagcctg

SEQ ID NO: 168379 - DNA, 15 bp, Homo sapiens
gataccatccagcct

SEQ ID NO: 168380 - DNA, 15 bp, Homo sapiens
agataccatccagcc

SEQ ID NO: 168381 - DNA, 15 bp, Homo sapiens
aagataccatccagc

SEQ ID NO: 168382 - DNA, 15 bp, Homo sapiens
gaagataccatccag

SEQ ID NO: 168383 - DNA, 15 bp, Homo sapiens
agaagataccatcca

SEQ ID NO: 168384 - DNA, 15 bp, Homo sapiens
tagaagataccatcc

SEQ ID NO: 168385 - DNA, 15 bp, Homo sapiens
ttagaagataccatc

SEQ ID NO: 168386 - DNA, 15 bp, Homo sapiens
attagaagataccat

SEQ ID NO: 168387 - DNA, 15 bp, Homo sapiens
gattagaagatacca

SEQ ID NO: 168388 - DNA, 15 bp, Homo sapiens
tgattagaagatacc

SEQ ID NO: 168389 - DNA, 15 bp, Homo sapiens
ttgattagaagatac

SEQ ID NO: 168390 - DNA, 15 bp, Homo sapiens
cttgattagaagata

SEQ ID NO: 168391 - DNA, 15 bp, Homo sapiens
tcttgattagaagat

SEQ ID NO: 168392 - DNA, 15 bp, Homo sapiens
ttcttgattagaaga

SEQ ID NO: 168393 - DNA, 15 bp, Homo sapiens
tttcttgattagaag

SEQ ID NO: 168394 - DNA, 15 bp, Homo sapiens
ttttcttgattagaa

SEQ ID NO: 168395 - DNA, 15 bp, Homo sapiens
cttttcttgattaga

SEQ ID NO: 168396 - DNA, 15 bp, Homo sapiens
tcttttcttgattag

SEQ ID NO: 168397 - DNA, 15 bp, Homo sapiens
atcttttcttgatta

SEQ ID NO: 168398 - DNA, 15 bp, Homo sapiens
tatcttttcttgatt

SEQ ID NO: 168399 - DNA, 15 bp, Homo sapiens
atatcttttcttgat

SEQ ID NO: 168400 - DNA, 15 bp, Homo sapiens
tatatcttttcttga

SEQ ID NO: 168401 - DNA, 15 bp, Homo sapiens
ttatatcttttcttg

SEQ ID NO: 168402 - DNA, 15 bp, Homo sapiens
cttatatcttttctt

SEQ ID NO: 168403 - DNA, 15 bp, Homo sapiens
acttatatcttttct

SEQ ID NO: 168404 - DNA, 15 bp, Homo sapiens
tacttatatcttttc

SEQ ID NO: 168405 - DNA, 15 bp, Homo sapiens
atacttatatctttt

SEQ ID NO: 168406 - DNA, 15 bp, Homo sapiens
aatacttatatcttt

SEQ ID NO: 168407 - DNA, 15 bp, Homo sapiens
aaatacttatatctt

SEQ ID NO: 168408 - DNA, 15 bp, Homo sapiens
aaaatacttatatct

SEQ ID NO: 168409 - DNA, 15 bp, Homo sapiens
aaaaatacttatatc

SEQ ID NO: 168410 - DNA, 15 bp, Homo sapiens
taaaaatacttatat

SEQ ID NO: 168411 - DNA, 15 bp, Homo sapiens
ataaaaatacttata

SEQ ID NO: 168412 - DNA, 15 bp, Homo sapiens
cataaaaatacttat

SEQ ID NO: 168413 - DNA, 15 bp, Homo sapiens
tcataaaaatactta

SEQ ID NO: 168414 - DNA, 15 bp, Homo sapiens
gtcataaaaatactt

SEQ ID NO: 168415 - DNA, 15 bp, Homo sapiens
tgtcataaaaatact

SEQ ID NO: 168416 - DNA, 15 bp, Homo sapiens
atgtcataaaaatac

SEQ ID NO: 168417 - DNA, 15 bp, Homo sapiens
gatgtcataaaaata

SEQ ID NO: 168418 - DNA, 15 bp, Homo sapiens
tgatgtcataaaaat

SEQ ID NO: 168419 - DNA, 15 bp, Homo sapiens
ttgatgtcataaaaa

SEQ ID NO: 168420 - DNA, 15 bp, Homo sapiens
tttgatgtcataaaa

SEQ ID NO: 168421 - DNA, 15 bp, Homo sapiens
atttgatgtcataaa

SEQ ID NO: 168422 - DNA, 15 bp, Homo sapiens
aatttgatgtcataa

SEQ ID NO: 168423 - DNA, 15 bp, Homo sapiens
aaatttgatgtcata

SEQ ID NO: 168424 - DNA, 15 bp, Homo sapiens
taaatttgatgtcat

SEQ ID NO: 168425 - DNA, 15 bp, Homo sapiens
ttaaatttgatgtca

SEQ ID NO: 168426 - DNA, 15 bp, Homo sapiens
cttaaatttgatgtc

SEQ ID NO: 168427 - DNA, 15 bp, Homo sapiens
tcttaaatttgatgt

SEQ ID NO: 168428 - DNA, 15 bp, Homo sapiens
ttcttaaatttgatg

SEQ ID NO: 168429 - DNA, 15 bp, Homo sapiens
attcttaaatttgat

SEQ ID NO: 168430 - DNA, 15 bp, Homo sapiens
tattcttaaatttga

SEQ ID NO: 168431 - DNA, 15 bp, Homo sapiens
ttattcttaaatttg

SEQ ID NO: 168432 - DNA, 15 bp, Homo sapiens
attattcttaaattt

SEQ ID NO: 168433 - DNA, 15 bp, Homo sapiens
tattattcttaaatt

SEQ ID NO: 168434 - DNA, 15 bp, Homo sapiens
ctattattcttaaat

SEQ ID NO: 168435 - DNA, 15 bp, Homo sapiens
gctattattcttaaa

SEQ ID NO: 168436 - DNA, 15 bp, Homo sapiens
ggctattattcttaa

SEQ ID NO: 168437 - DNA, 15 bp, Homo sapiens
tggctattattctta

SEQ ID NO: 168438 - DNA, 15 bp, Homo sapiens
ctggctattattctt

SEQ ID NO: 168439 - DNA, 15 bp, Homo sapiens
actggctattattct

SEQ ID NO: 168440 - DNA, 15 bp, Homo sapiens
aactggctattattc

SEQ ID NO: 168441 - DNA, 15 bp, Homo sapiens
taactggctattatt

SEQ ID NO: 168442 - DNA, 15 bp, Homo sapiens
ataactggctattat

SEQ ID NO: 168443 - DNA, 15 bp, Homo sapiens
tataactggctatta

SEQ ID NO: 168444 - DNA, 15 bp, Homo sapiens
atataactggctatt

SEQ ID NO: 168445 - DNA, 15 bp, Homo sapiens
tatataactggctat

SEQ ID NO: 168446 - DNA, 15 bp, Homo sapiens
atatataactggcta

SEQ ID NO: 168447 - DNA, 15 bp, Homo sapiens
aatatataactggct

SEQ ID NO: 168448 - DNA, 15 bp, Homo sapiens
aaatatataactggc

SEQ ID NO: 168449 - DNA, 15 bp, Homo sapiens
caaatatataactgg

SEQ ID NO: 168450 - DNA, 15 bp, Homo sapiens
acaaatatataactg

SEQ ID NO: 168451 - DNA, 15 bp, Homo sapiens
cacaaatatataact

SEQ ID NO: 168452 - DNA, 15 bp, Homo sapiens
ccacaaatatataac

SEQ ID NO: 168453 - DNA, 15 bp, Homo sapiens
cccacaaatatataa

SEQ ID NO: 168454 - DNA, 15 bp, Homo sapiens
tcccacaaatatata

SEQ ID NO: 168455 - DNA, 15 bp, Homo sapiens
atcccacaaatatat

SEQ ID NO: 168456 - DNA, 15 bp, Homo sapiens
gatcccacaaatata

SEQ ID NO: 168457 - DNA, 15 bp, Homo sapiens
tgatcccacaaatat

SEQ ID NO: 168458 - DNA, 15 bp, Homo sapiens
atgatcccacaaata

SEQ ID NO: 168459 - DNA, 15 bp, Homo sapiens
catgatcccacaaat

SEQ ID NO: 168460 - DNA, 15 bp, Homo sapiens
acatgatcccacaaa

SEQ ID NO: 168461 - DNA, 15 bp, Homo sapiens
cacatgatcccacaa

SEQ ID NO: 168462 - DNA, 15 bp, Homo sapiens
tcacatgatcccaca

SEQ ID NO: 168463 - DNA, 15 bp, Homo sapiens
atcacatgatcccac

SEQ ID NO: 168464 - DNA, 15 bp, Homo sapiens
tatcacatgatccca

SEQ ID NO: 168465 - DNA, 15 bp, Homo sapiens
ttatcacatgatccc

SEQ ID NO: 168466 - DNA, 15 bp, Homo sapiens
cttatcacatgatcc

SEQ ID NO: 168467 - DNA, 15 bp, Homo sapiens
tcttatcacatgatc

SEQ ID NO: 168468 - DNA, 15 bp, Homo sapiens
ttcttatcacatgat

SEQ ID NO: 168469 - DNA, 15 bp, Homo sapiens
tttcttatcacatga

SEQ ID NO: 168470 - DNA, 15 bp, Homo sapiens
ttttcttatcacatg

SEQ ID NO: 168471 - DNA, 15 bp, Homo sapiens
tttttcttatcacat

SEQ ID NO: 168472 - DNA, 15 bp, Homo sapiens
atttttcttatcaca

SEQ ID NO: 168473 - DNA, 15 bp, Homo sapiens
tatttttcttatcac

SEQ ID NO: 168474 - DNA, 15 bp, Homo sapiens
atatttttcttatca

SEQ ID NO: 168475 - DNA, 15 bp, Homo sapiens
tatatttttcttatc

SEQ ID NO: 168476 - DNA, 15 bp, Homo sapiens
atatatttttcttat

SEQ ID NO: 168477 - DNA, 15 bp, Homo sapiens
aatatatttttctta

SEQ ID NO: 168478 - DNA, 15 bp, Homo sapiens
caatatatttttctt

SEQ ID NO: 168479 - DNA, 15 bp, Homo sapiens
ccaatatatttttct

SEQ ID NO: 168480 - DNA, 15 bp, Homo sapiens
accaatatatttttc

SEQ ID NO: 168481 - DNA, 15 bp, Homo sapiens
aaccaatatattttt

SEQ ID NO: 168482 - DNA, 15 bp, Homo sapiens
aaaccaatatatttt

SEQ ID NO: 168483 - DNA, 15 bp, Homo sapiens
taaaccaatatattt

SEQ ID NO: 168484 - DNA, 15 bp, Homo sapiens
gtaaaccaatatatt

SEQ ID NO: 168485 - DNA, 15 bp, Homo sapiens
agtaaaccaatatat

SEQ ID NO: 168486 - DNA, 15 bp, Homo sapiens
tagtaaaccaatata

SEQ ID NO: 168487 - DNA, 15 bp, Homo sapiens
atagtaaaccaatat

SEQ ID NO: 168488 - DNA, 15 bp, Homo sapiens
aatagtaaaccaata

SEQ ID NO: 168489 - DNA, 15 bp, Homo sapiens
aaatagtaaaccaat

SEQ ID NO: 168490 - DNA, 15 bp, Homo sapiens
aaaatagtaaaccaa

SEQ ID NO: 168491 - DNA, 15 bp, Homo sapiens
taaaatagtaaacca

SEQ ID NO: 168492 - DNA, 15 bp, Homo sapiens
ctaaaatagtaaacc

SEQ ID NO: 168493 - DNA, 15 bp, Homo sapiens
tctaaaatagtaaac

SEQ ID NO: 168494 - DNA, 15 bp, Homo sapiens
atctaaaatagtaaa

SEQ ID NO: 168495 - DNA, 15 bp, Homo sapiens
catctaaaatagtaa

SEQ ID NO: 168496 - DNA, 15 bp, Homo sapiens
ccatctaaaatagta

SEQ ID NO: 168497 - DNA, 15 bp, Homo sapiens
tccatctaaaatagt

SEQ ID NO: 168498 - DNA, 15 bp, Homo sapiens
ttccatctaaaatag

SEQ ID NO: 168499 - DNA, 15 bp, Homo sapiens
attccatctaaaata

SEQ ID NO: 168500 - DNA, 15 bp, Homo sapiens
tattccatctaaaat

SEQ ID NO: 168501 - DNA, 15 bp, Homo sapiens
ttattccatctaaaa

SEQ ID NO: 168502 - DNA, 15 bp, Homo sapiens
attattccatctaaa

SEQ ID NO: 168503 - DNA, 15 bp, Homo sapiens
tattattccatctaa

SEQ ID NO: 168504 - DNA, 15 bp, Homo sapiens
ttattattccatcta

SEQ ID NO: 168505 - DNA, 15 bp, Homo sapiens
attattattccatct

SEQ ID NO: 168506 - DNA, 15 bp, Homo sapiens
cattattattccatc

SEQ ID NO: 168507 - DNA, 15 bp, Homo sapiens
acattattattccat

SEQ ID NO: 168508 - DNA, 15 bp, Homo sapiens
cacattattattcca

SEQ ID NO: 168509 - DNA, 15 bp, Homo sapiens
acacattattattcc

SEQ ID NO: 168510 - DNA, 15 bp, Homo sapiens
gacacattattattc

SEQ ID NO: 168511 - DNA, 15 bp, Homo sapiens
agacacattattatt

SEQ ID NO: 168512 - DNA, 15 bp, Homo sapiens
aagacacattattat

SEQ ID NO: 168513 - DNA, 15 bp, Homo sapiens
aaagacacattatta

SEQ ID NO: 168514 - DNA, 15 bp, Homo sapiens
aaaagacacattatt

SEQ ID NO: 168515 - DNA, 15 bp, Homo sapiens
gaaaagacacattat

SEQ ID NO: 168516 - DNA, 15 bp, Homo sapiens
agaaaagacacatta

SEQ ID NO: 168517 - DNA, 15 bp, Homo sapiens
cagaaaagacacatt

SEQ ID NO: 168518 - DNA, 15 bp, Homo sapiens
tcagaaaagacacat

SEQ ID NO: 168519 - DNA, 15 bp, Homo sapiens
atcagaaaagacaca

SEQ ID NO: 168520 - DNA, 15 bp, Homo sapiens
tatcagaaaagacac

SEQ ID NO: 168521 - DNA, 15 bp, Homo sapiens
atatcagaaaagaca

SEQ ID NO: 168522 - DNA, 15 bp, Homo sapiens
gatatcagaaaagac

SEQ ID NO: 168523 - DNA, 15 bp, Homo sapiens
agatatcagaaaaga

SEQ ID NO: 168524 - DNA, 15 bp, Homo sapiens
aagatatcagaaaag

SEQ ID NO: 168525 - DNA, 15 bp, Homo sapiens
aaagatatcagaaaa

SEQ ID NO: 168526 - DNA, 15 bp, Homo sapiens
taaagatatcagaaa

SEQ ID NO: 168527 - DNA, 15 bp, Homo sapiens
gtaaagatatcagaa

SEQ ID NO: 168528 - DNA, 15 bp, Homo sapiens
tgtaaagatatcaga

SEQ ID NO: 168529 - DNA, 15 bp, Homo sapiens
ttgtaaagatatcag

SEQ ID NO: 168530 - DNA, 15 bp, Homo sapiens
cttgtaaagatatca

SEQ ID NO: 168531 - DNA, 15 bp, Homo sapiens
tcttgtaaagatatc

SEQ ID NO: 168532 - DNA, 15 bp, Homo sapiens
ttcttgtaaagatat

SEQ ID NO: 168533 - DNA, 15 bp, Homo sapiens
attcttgtaaagata

SEQ ID NO: 168534 - DNA, 15 bp, Homo sapiens
cattcttgtaaagat

SEQ ID NO: 168535 - DNA, 15 bp, Homo sapiens
acattcttgtaaaga

SEQ ID NO: 168536 - DNA, 15 bp, Homo sapiens
aacattcttgtaaag

SEQ ID NO: 168537 - DNA, 15 bp, Homo sapiens
taacattcttgtaaa

SEQ ID NO: 168538 - DNA, 15 bp, Homo sapiens
ctaacattcttgtaa

SEQ ID NO: 168539 - DNA, 15 bp, Homo sapiens
tctaacattcttgta

SEQ ID NO: 168540 - DNA, 15 bp, Homo sapiens
ttctaacattcttgt

SEQ ID NO: 168541 - DNA, 15 bp, Homo sapiens
tttctaacattcttg

SEQ ID NO: 168542 - DNA, 15 bp, Homo sapiens
atttctaacattctt

SEQ ID NO: 168543 - DNA, 15 bp, Homo sapiens
gatttctaacattct

SEQ ID NO: 168544 - DNA, 15 bp, Homo sapiens
tgatttctaacattc

SEQ ID NO: 168545 - DNA, 15 bp, Homo sapiens
atgatttctaacatt

SEQ ID NO: 168546 - DNA, 15 bp, Homo sapiens
gatgatttctaacat

SEQ ID NO: 168547 - DNA, 15 bp, Homo sapiens
agatgatttctaaca

SEQ ID NO: 168548 - DNA, 15 bp, Homo sapiens
cagatgatttctaac

SEQ ID NO: 168549 - DNA, 15 bp, Homo sapiens
acagatgatttctaa

SEQ ID NO: 168550 - DNA, 15 bp, Homo sapiens
tacagatgatttcta

SEQ ID NO: 168551 - DNA, 15 bp, Homo sapiens
atacagatgatttct

SEQ ID NO: 168552 - DNA, 15 bp, Homo sapiens
aatacagatgatttc

SEQ ID NO: 168553 - DNA, 15 bp, Homo sapiens
caatacagatgattt

SEQ ID NO: 168554 - DNA, 15 bp, Homo sapiens
acaatacagatgatt

SEQ ID NO: 168555 - DNA, 15 bp, Homo sapiens
tacaatacagatgat

SEQ ID NO: 168556 - DNA, 15 bp, Homo sapiens
ttacaatacagatga

SEQ ID NO: 168557 - DNA, 15 bp, Homo sapiens
attacaatacagatg

SEQ ID NO: 168558 - DNA, 15 bp, Homo sapiens
cattacaatacagat

SEQ ID NO: 168559 - DNA, 15 bp, Homo sapiens
acattacaatacaga

SEQ ID NO: 168560 - DNA, 15 bp, Homo sapiens
aacattacaatacag

SEQ ID NO: 168561 - DNA, 15 bp, Homo sapiens
caacattacaataca

SEQ ID NO: 168562 - DNA, 15 bp, Homo sapiens
acaacattacaatac

SEQ ID NO: 168563 - DNA, 15 bp, Homo sapiens
aacaacattacaata

SEQ ID NO: 168564 - DNA, 15 bp, Homo sapiens
aaacaacattacaat

SEQ ID NO: 168565 - DNA, 15 bp, Homo sapiens
aaaacaacattacaa

SEQ ID NO: 168566 - DNA, 15 bp, Homo sapiens
taaaacaacattaca

SEQ ID NO: 168567 - DNA, 15 bp, Homo sapiens
gtaaaacaacattac

SEQ ID NO: 168568 - DNA, 15 bp, Homo sapiens
ggtaaaacaacatta

SEQ ID NO: 168569 - DNA, 15 bp, Homo sapiens
aggtaaaacaacatt

SEQ ID NO: 168570 - DNA, 15 bp, Homo sapiens
aaggtaaaacaacat

SEQ ID NO: 168571 - DNA, 15 bp, Homo sapiens
taaggtaaaacaaca

SEQ ID NO: 168572 - DNA, 15 bp, Homo sapiens
ataaggtaaaacaac

SEQ ID NO: 168573 - DNA, 15 bp, Homo sapiens
gataaggtaaaacaa

SEQ ID NO: 168574 - DNA, 15 bp, Homo sapiens
ggataaggtaaaaca

SEQ ID NO: 168575 - DNA, 15 bp, Homo sapiens
tggataaggtaaaac

SEQ ID NO: 168576 - DNA, 15 bp, Homo sapiens
ttggataaggtaaaa

SEQ ID NO: 168577 - DNA, 15 bp, Homo sapiens
cttggataaggtaaa

SEQ ID NO: 168578 - DNA, 15 bp, Homo sapiens
ccttggataaggtaa

SEQ ID NO: 168579 - DNA, 15 bp, Homo sapiens
cccttggataaggta

SEQ ID NO: 168580 - DNA, 15 bp, Homo sapiens
ccccttggataaggt

SEQ ID NO: 168581 - DNA, 15 bp, Homo sapiens
tccccttggataagg

SEQ ID NO: 168582 - DNA, 15 bp, Homo sapiens
ttccccttggataag

SEQ ID NO: 168583 - DNA, 15 bp, Homo sapiens
tttccccttggataa

SEQ ID NO: 168584 - DNA, 15 bp, Homo sapiens
atttccccttggata

SEQ ID NO: 168585 - DNA, 15 bp, Homo sapiens
tatttccccttggat

SEQ ID NO: 168586 - DNA, 15 bp, Homo sapiens
ttatttccccttgga

SEQ ID NO: 168587 - DNA, 15 bp, Homo sapiens
tttatttccccttgg

SEQ ID NO: 168588 - DNA, 15 bp, Homo sapiens
ctttatttccccttg

SEQ ID NO: 168589 - DNA, 15 bp, Homo sapiens
gctttatttcccctt

SEQ ID NO: 168590 - DNA, 15 bp, Homo sapiens
tgctttatttcccct

SEQ ID NO: 168591 - DNA, 15 bp, Homo sapiens
atgctttatttcccc

SEQ ID NO: 168592 - DNA, 15 bp, Homo sapiens
catgctttatttccc

SEQ ID NO: 168593 - DNA, 15 bp, Homo sapiens
tcatgctttatttcc

SEQ ID NO: 168594 - DNA, 15 bp, Homo sapiens
ttcatgctttatttc

SEQ ID NO: 168595 - DNA, 15 bp, Homo sapiens
gttcatgctttattt

SEQ ID NO: 168596 - DNA, 15 bp, Homo sapiens
tgttcatgctttatt

SEQ ID NO: 168597 - DNA, 15 bp, Homo sapiens
atgttcatgctttat

SEQ ID NO: 168598 - DNA, 15 bp, Homo sapiens
aatgttcatgcttta

SEQ ID NO: 168599 - DNA, 15 bp, Homo sapiens
aaatgttcatgcttt

SEQ ID NO: 168600 - DNA, 15 bp, Homo sapiens
taaatgttcatgctt

SEQ ID NO: 168601 - DNA, 15 bp, Homo sapiens
ataaatgttcatgct

SEQ ID NO: 168602 - DNA, 15 bp, Homo sapiens
tataaatgttcatgc

SEQ ID NO: 168603 - DNA, 15 bp, Homo sapiens
ctataaatgttcatg

SEQ ID NO: 168604 - DNA, 15 bp, Homo sapiens
cctataaatgttcat

SEQ ID NO: 168605 - DNA, 15 bp, Homo sapiens
gcctataaatgttca

SEQ ID NO: 168606 - DNA, 15 bp, Homo sapiens
agcctataaatgttc

SEQ ID NO: 168607 - DNA, 15 bp, Homo sapiens
aagcctataaatgtt

SEQ ID NO: 168608 - DNA, 15 bp, Homo sapiens
aaagcctataaatgt

SEQ ID NO: 168609 - DNA, 15 bp, Homo sapiens
aaaagcctataaatg

SEQ ID NO: 168610 - DNA, 15 bp, Homo sapiens
taaaagcctataaat

SEQ ID NO: 168611 - DNA, 15 bp, Homo sapiens
ataaaagcctataaa

SEQ ID NO: 168612 - DNA, 15 bp, Homo sapiens
aataaaagcctataa

SEQ ID NO: 168613 - DNA, 15 bp, Homo sapiens
aaataaaagcctata

SEQ ID NO: 168614 - DNA, 15 bp, Homo sapiens
taaataaaagcctat

SEQ ID NO: 168615 - DNA, 15 bp, Homo sapiens
ataaataaaagccta

SEQ ID NO: 168616 - DNA, 15 bp, Homo sapiens
tataaataaaagcct

SEQ ID NO: 168617 - DNA, 15 bp, Homo sapiens
ttataaataaaagcc

SEQ ID NO: 168618 - DNA, 15 bp, Homo sapiens
tttataaataaaagc

SEQ ID NO: 168619 - DNA, 15 bp, Homo sapiens
atttataaataaaag

SEQ ID NO: 168620 - DNA, 15 bp, Homo sapiens
catttataaataaaa

SEQ ID NO: 168621 - DNA, 15 bp, Homo sapiens
ccatttataaataaa

SEQ ID NO: 168622 - DNA, 15 bp, Homo sapiens
tccatttataaataa

SEQ ID NO: 168623 - DNA, 15 bp, Homo sapiens
gtccatttataaata

SEQ ID NO: 168624 - DNA, 15 bp, Homo sapiens
agtccatttataaat

SEQ ID NO: 168625 - DNA, 15 bp, Homo sapiens
aagtccatttataaa

SEQ ID NO: 168626 - DNA, 15 bp, Homo sapiens
aaagtccatttataa

SEQ ID NO: 168627 - DNA, 15 bp, Homo sapiens
aaaagtccatttata

SEQ ID NO: 168628 - DNA, 15 bp, Homo sapiens
taaaagtccatttat

SEQ ID NO: 168629 - DNA, 15 bp, Homo sapiens
ttaaaagtccattta

SEQ ID NO: 168630 - DNA, 15 bp, Homo sapiens
tttaaaagtccattt

SEQ ID NO: 168631 - DNA, 15 bp, Homo sapiens
ttttaaaagtccatt

SEQ ID NO: 168632 - DNA, 15 bp, Homo sapiens
attttaaaagtccat

SEQ ID NO: 168633 - DNA, 15 bp, Homo sapiens
tattttaaaagtcca

SEQ ID NO: 168634 - DNA, 15 bp, Homo sapiens
atattttaaaagtcc

SEQ ID NO: 168635 - DNA, 15 bp, Homo sapiens
catattttaaaagtc

SEQ ID NO: 168636 - DNA, 15 bp, Homo sapiens
acatattttaaaagt

SEQ ID NO: 168637 - DNA, 15 bp, Homo sapiens
aacatattttaaaag

SEQ ID NO: 168638 - DNA, 15 bp, Homo sapiens
aaacatattttaaaa

SEQ ID NO: 168639 - DNA, 15 bp, Homo sapiens
aaaacatattttaaa

SEQ ID NO: 168640 - DNA, 15 bp, Homo sapiens
gaaaacatattttaa

SEQ ID NO: 168641 - DNA, 15 bp, Homo sapiens
agaaaacatatttta

SEQ ID NO: 168642 - DNA, 15 bp, Homo sapiens
gagaaaacatatttt

SEQ ID NO: 168643 - DNA, 15 bp, Homo sapiens
tgagaaaacatattt

SEQ ID NO: 168644 - DNA, 15 bp, Homo sapiens
gtgagaaaacatatt

SEQ ID NO: 168645 - DNA, 15 bp, Homo sapiens
tgtgagaaaacatat

SEQ ID NO: 168646 - DNA, 15 bp, Homo sapiens
ttgtgagaaaacata

SEQ ID NO: 168647 - DNA, 15 bp, Homo sapiens
tttgtgagaaaacat

SEQ ID NO: 168648 - DNA, 15 bp, Homo sapiens
ctttgtgagaaaaca

SEQ ID NO: 168649 - DNA, 15 bp, Homo sapiens
tctttgtgagaaaac

SEQ ID NO: 168650 - DNA, 15 bp, Homo sapiens
ctctttgtgagaaaa

SEQ ID NO: 168651 - DNA, 15 bp, Homo sapiens
cctctttgtgagaaa

SEQ ID NO: 168652 - DNA, 15 bp, Homo sapiens
tcctctttgtgagaa

SEQ ID NO: 168653 - DNA, 15 bp, Homo sapiens
ttcctctttgtgaga

SEQ ID NO: 168654 - DNA, 15 bp, Homo sapiens
tttcctctttgtgag

SEQ ID NO: 168655 - DNA, 15 bp, Homo sapiens
atttcctctttgtga

SEQ ID NO: 168656 - DNA, 15 bp, Homo sapiens
aatttcctctttgtg

SEQ ID NO: 168657 - DNA, 15 bp, Homo sapiens
aaatttcctctttgt

SEQ ID NO: 168658 - DNA, 15 bp, Homo sapiens
taaatttcctctttg

SEQ ID NO: 168659 - DNA, 15 bp, Homo sapiens
ctaaatttcctcttt

SEQ ID NO: 168660 - DNA, 15 bp, Homo sapiens
gctaaatttcctctt

SEQ ID NO: 168661 - DNA, 15 bp, Homo sapiens
agctaaatttcctct

SEQ ID NO: 168662 - DNA, 15 bp, Homo sapiens
gagctaaatttcctc

SEQ ID NO: 168663 - DNA, 15 bp, Homo sapiens
agagctaaatttcct

SEQ ID NO: 168664 - DNA, 15 bp, Homo sapiens
tagagctaaatttcc

SEQ ID NO: 168665 - DNA, 15 bp, Homo sapiens
ctagagctaaatttc

SEQ ID NO: 168666 - DNA, 15 bp, Homo sapiens
tctagagctaaattt

SEQ ID NO: 168667 - DNA, 15 bp, Homo sapiens
ttctagagctaaatt

SEQ ID NO: 168668 - DNA, 15 bp, Homo sapiens
tttctagagctaaat

SEQ ID NO: 168669 - DNA, 15 bp, Homo sapiens
ttttctagagctaaa

SEQ ID NO: 168670 - DNA, 15 bp, Homo sapiens
gttttctagagctaa

SEQ ID NO: 168671 - DNA, 15 bp, Homo sapiens
tgttttctagagcta

SEQ ID NO: 168672 - DNA, 15 bp, Homo sapiens
ctgttttctagagct

SEQ ID NO: 168673 - DNA, 15 bp, Homo sapiens
cctgttttctagagc

SEQ ID NO: 168674 - DNA, 15 bp, Homo sapiens
tcctgttttctagag

SEQ ID NO: 168675 - DNA, 15 bp, Homo sapiens
ttcctgttttctaga

SEQ ID NO: 168676 - DNA, 15 bp, Homo sapiens
tttcctgttttctag

SEQ ID NO: 168677 - DNA, 15 bp, Homo sapiens
ctttcctgttttcta

SEQ ID NO: 168678 - DNA, 15 bp, Homo sapiens
cctttcctgttttct

SEQ ID NO: 168679 - DNA, 15 bp, Homo sapiens
tcctttcctgttttc

SEQ ID NO: 168680 - DNA, 15 bp, Homo sapiens
atcctttcctgtttt

SEQ ID NO: 168681 - DNA, 15 bp, Homo sapiens
aatcctttcctgttt

SEQ ID NO: 168682 - DNA, 15 bp, Homo sapiens
caatcctttcctgtt

SEQ ID NO: 168683 - DNA, 15 bp, Homo sapiens
acaatcctttcctgt

SEQ ID NO: 168684 - DNA, 15 bp, Homo sapiens
tacaatcctttcctg

SEQ ID NO: 168685 - DNA, 15 bp, Homo sapiens
ctacaatcctttcct

SEQ ID NO: 168686 - DNA, 15 bp, Homo sapiens
cctacaatcctttcc

SEQ ID NO: 168687 - DNA, 15 bp, Homo sapiens
tcctacaatcctttc

SEQ ID NO: 168688 - DNA, 15 bp, Homo sapiens
ttcctacaatccttt

SEQ ID NO: 168689 - DNA, 15 bp, Homo sapiens
gttcctacaatcctt

SEQ ID NO: 168690 - DNA, 15 bp, Homo sapiens
agttcctacaatcct

SEQ ID NO: 168691 - DNA, 15 bp, Homo sapiens
gagttcctacaatcc

SEQ ID NO: 168692 - DNA, 15 bp, Homo sapiens
ggagttcctacaatc

SEQ ID NO: 168693 - DNA, 15 bp, Homo sapiens
gggagttcctacaat

SEQ ID NO: 168694 - DNA, 15 bp, Homo sapiens
tgggagttcctacaa

SEQ ID NO: 168695 - DNA, 15 bp, Homo sapiens
atgggagttcctaca

SEQ ID NO: 168696 - DNA, 15 bp, Homo sapiens
gatgggagttcctac

SEQ ID NO: 168697 - DNA, 15 bp, Homo sapiens
agatgggagttccta

SEQ ID NO: 168698 - DNA, 15 bp, Homo sapiens
cagatgggagttcct

SEQ ID NO: 168699 - DNA, 15 bp, Homo sapiens
gcagatgggagttcc

SEQ ID NO: 168700 - DNA, 15 bp, Homo sapiens
tgcagatgggagttc

SEQ ID NO: 168701 - DNA, 15 bp, Homo sapiens
atgcagatgggagtt

SEQ ID NO: 168702 - DNA, 15 bp, Homo sapiens
aatgcagatgggagt

SEQ ID NO: 168703 - DNA, 15 bp, Homo sapiens
caatgcagatgggag

SEQ ID NO: 168704 - DNA, 15 bp, Homo sapiens
ccaatgcagatggga

SEQ ID NO: 168705 - DNA, 15 bp, Homo sapiens
tccaatgcagatggg

SEQ ID NO: 168706 - DNA, 15 bp, Homo sapiens
ttccaatgcagatgg

SEQ ID NO: 168707 - DNA, 15 bp, Homo sapiens
tttccaatgcagatg

SEQ ID NO: 168708 - DNA, 15 bp, Homo sapiens
ctttccaatgcagat

SEQ ID NO: 168709 - DNA, 15 bp, Homo sapiens
actttccaatgcaga

SEQ ID NO: 168710 - DNA, 15 bp, Homo sapiens
cactttccaatgcag

SEQ ID NO: 168711 - DNA, 15 bp, Homo sapiens
tcactttccaatgca

SEQ ID NO: 168712 - DNA, 15 bp, Homo sapiens
gtcactttccaatgc

SEQ ID NO: 168713 - DNA, 15 bp, Homo sapiens
agtcactttccaatg

SEQ ID NO: 168714 - DNA, 15 bp, Homo sapiens
cagtcactttccaat

SEQ ID NO: 168715 - DNA, 15 bp, Homo sapiens
acagtcactttccaa

SEQ ID NO: 168716 - DNA, 15 bp, Homo sapiens
gacagtcactttcca

SEQ ID NO: 168717 - DNA, 15 bp, Homo sapiens
tgacagtcactttcc

SEQ ID NO: 168718 - DNA, 15 bp, Homo sapiens
gtgacagtcactttc

SEQ ID NO: 168719 - DNA, 15 bp, Homo sapiens
agtgacagtcacttt

SEQ ID NO: 168720 - DNA, 15 bp, Homo sapiens
gagtgacagtcactt

SEQ ID NO: 168721 - DNA, 15 bp, Homo sapiens
agagtgacagtcact

SEQ ID NO: 168722 - DNA, 15 bp, Homo sapiens
gagagtgacagtcac

SEQ ID NO: 168723 - DNA, 15 bp, Homo sapiens
cgagagtgacagtca

SEQ ID NO: 168724 - DNA, 15 bp, Homo sapiens
acgagagtgacagtc

SEQ ID NO: 168725 - DNA, 15 bp, Homo sapiens
tacgagagtgacagt

SEQ ID NO: 168726 - DNA, 15 bp, Homo sapiens
atacgagagtgacag

SEQ ID NO: 168727 - DNA, 15 bp, Homo sapiens
aatacgagagtgaca

SEQ ID NO: 168728 - DNA, 15 bp, Homo sapiens
caatacgagagtgac

SEQ ID NO: 168729 - DNA, 15 bp, Homo sapiens
ccaatacgagagtga

SEQ ID NO: 168730 - DNA, 15 bp, Homo sapiens
tccaatacgagagtg

SEQ ID NO: 168731 - DNA, 15 bp, Homo sapiens
gtccaatacgagagt

SEQ ID NO: 168732 - DNA, 15 bp, Homo sapiens
tgtccaatacgagag

SEQ ID NO: 168733 - DNA, 15 bp, Homo sapiens
ttgtccaatacgaga

SEQ ID NO: 168734 - DNA, 15 bp, Homo sapiens
attgtccaatacgag

SEQ ID NO: 168735 - DNA, 15 bp, Homo sapiens
cattgtccaatacga

SEQ ID NO: 168736 - DNA, 15 bp, Homo sapiens
tcattgtccaatacg

SEQ ID NO: 168737 - DNA, 15 bp, Homo sapiens
atcattgtccaatac

SEQ ID NO: 168738 - DNA, 15 bp, Homo sapiens
aatcattgtccaata

SEQ ID NO: 168739 - DNA, 15 bp, Homo sapiens
caatcattgtccaat

SEQ ID NO: 168740 - DNA, 15 bp, Homo sapiens
acaatcattgtccaa

SEQ ID NO: 168741 - DNA, 15 bp, Homo sapiens
aacaatcattgtcca

SEQ ID NO: 168742 - DNA, 15 bp, Homo sapiens
caacaatcattgtcc

SEQ ID NO: 168743 - DNA, 15 bp, Homo sapiens
gcaacaatcattgtc

SEQ ID NO: 168744 - DNA, 15 bp, Homo sapiens
tgcaacaatcattgt

SEQ ID NO: 168745 - DNA, 15 bp, Homo sapiens
ctgcaacaatcattg

SEQ ID NO: 168746 - DNA, 15 bp, Homo sapiens
tctgcaacaatcatt

SEQ ID NO: 168747 - DNA, 15 bp, Homo sapiens
atctgcaacaatcat

SEQ ID NO: 168748 - DNA, 15 bp, Homo sapiens
catctgcaacaatca

SEQ ID NO: 168749 - DNA, 15 bp, Homo sapiens
tcatctgcaacaatc

SEQ ID NO: 168750 - DNA, 15 bp, Homo sapiens
atcatctgcaacaat

SEQ ID NO: 168751 - DNA, 15 bp, Homo sapiens
tatcatctgcaacaa

SEQ ID NO: 168752 - DNA, 15 bp, Homo sapiens
gtatcatctgcaaca

SEQ ID NO: 168753 - DNA, 15 bp, Homo sapiens
ggtatcatctgcaac

SEQ ID NO: 168754 - DNA, 15 bp, Homo sapiens
aggtatcatctgcaa

SEQ ID NO: 168755 - DNA, 15 bp, Homo sapiens
caggtatcatctgca

SEQ ID NO: 168756 - DNA, 15 bp, Homo sapiens
acaggtatcatctgc

SEQ ID NO: 168757 - DNA, 15 bp, Homo sapiens
aacaggtatcatctg

SEQ ID NO: 168758 - DNA, 15 bp, Homo sapiens
aaacaggtatcatct

SEQ ID NO: 168759 - DNA, 15 bp, Homo sapiens
gaaacaggtatcatc

SEQ ID NO: 168760 - DNA, 15 bp, Homo sapiens
tgaaacaggtatcat

SEQ ID NO: 168761 - DNA, 15 bp, Homo sapiens
atgaaacaggtatca

SEQ ID NO: 168762 - DNA, 15 bp, Homo sapiens
aatgaaacaggtatc

SEQ ID NO: 168763 - DNA, 15 bp, Homo sapiens
gaatgaaacaggtat

SEQ ID NO: 168764 - DNA, 15 bp, Homo sapiens
agaatgaaacaggta

SEQ ID NO: 168765 - DNA, 15 bp, Homo sapiens
cagaatgaaacaggt

SEQ ID NO: 168766 - DNA, 15 bp, Homo sapiens
ccagaatgaaacagg

SEQ ID NO: 168767 - DNA, 15 bp, Homo sapiens
tccagaatgaaacag

SEQ ID NO: 168768 - DNA, 15 bp, Homo sapiens
atccagaatgaaaca

SEQ ID NO: 168769 - DNA, 15 bp, Homo sapiens
gatccagaatgaaac

SEQ ID NO: 168770 - DNA, 15 bp, Homo sapiens
tgatccagaatgaaa

SEQ ID NO: 168771 - DNA, 15 bp, Homo sapiens
gtgatccagaatgaa

SEQ ID NO: 168772 - DNA, 15 bp, Homo sapiens
ggtgatccagaatga

SEQ ID NO: 168773 - DNA, 15 bp, Homo sapiens
aggtgatccagaatg

SEQ ID NO: 168774 - DNA, 15 bp, Homo sapiens
aaggtgatccagaat

SEQ ID NO: 168775 - DNA, 15 bp, Homo sapiens
aaaggtgatccagaa

SEQ ID NO: 168776 - DNA, 15 bp, Homo sapiens
caaaggtgatccaga

SEQ ID NO: 168777 - DNA, 15 bp, Homo sapiens
acaaaggtgatccag

SEQ ID NO: 168778 - DNA, 15 bp, Homo sapiens
aacaaaggtgatcca

SEQ ID NO: 168779 - DNA, 15 bp, Homo sapiens
aaacaaaggtgatcc

SEQ ID NO: 168780 - DNA, 15 bp, Homo sapiens
aaaacaaaggtgatc

SEQ ID NO: 168781 - DNA, 15 bp, Homo sapiens
aaaaacaaaggtgat

SEQ ID NO: 168782 - DNA, 15 bp, Homo sapiens
taaaaacaaaggtga

SEQ ID NO: 168783 - DNA, 15 bp, Homo sapiens
ttaaaaacaaaggtg

SEQ ID NO: 168784 - DNA, 15 bp, Homo sapiens
tttaaaaacaaaggt

SEQ ID NO: 168785 - DNA, 15 bp, Homo sapiens
ttttaaaaacaaagg

SEQ ID NO: 168786 - DNA, 15 bp, Homo sapiens
attttaaaaacaaag

SEQ ID NO: 168787 - DNA, 15 bp, Homo sapiens
cattttaaaaacaaa

SEQ ID NO: 168788 - DNA, 15 bp, Homo sapiens
tcattttaaaaacaa

SEQ ID NO: 168789 - DNA, 15 bp, Homo sapiens
ctcattttaaaaaca

SEQ ID NO: 168790 - DNA, 15 bp, Homo sapiens
tctcattttaaaaac

SEQ ID NO: 168791 - DNA, 15 bp, Homo sapiens
gtctcattttaaaaa

SEQ ID NO: 168792 - DNA, 15 bp, Homo sapiens
tgtctcattttaaaa

SEQ ID NO: 168793 - DNA, 15 bp, Homo sapiens
atgtctcattttaaa

SEQ ID NO: 168794 - DNA, 15 bp, Homo sapiens
tatgtctcattttaa

SEQ ID NO: 168795 - DNA, 15 bp, Homo sapiens
ttatgtctcatttta

SEQ ID NO: 168796 - DNA, 15 bp, Homo sapiens
gttatgtctcatttt

SEQ ID NO: 168797 - DNA, 15 bp, Homo sapiens
agttatgtctcattt

SEQ ID NO: 168798 - DNA, 15 bp, Homo sapiens
tagttatgtctcatt

SEQ ID NO: 168799 - DNA, 15 bp, Homo sapiens
ttagttatgtctcat

SEQ ID NO: 168800 - DNA, 15 bp, Homo sapiens
attagttatgtctca

SEQ ID NO: 168801 - DNA, 15 bp, Homo sapiens
aattagttatgtctc

SEQ ID NO: 168802 - DNA, 15 bp, Homo sapiens
taattagttatgtct

SEQ ID NO: 168803 - DNA, 15 bp, Homo sapiens
ttaattagttatgtc

SEQ ID NO: 168804 - DNA, 15 bp, Homo sapiens
gttaattagttatgt

SEQ ID NO: 168805 - DNA, 15 bp, Homo sapiens
tgttaattagttatg

SEQ ID NO: 168806 - DNA, 15 bp, Homo sapiens
ctgttaattagttat

SEQ ID NO: 168807 - DNA, 15 bp, Homo sapiens
tctgttaattagtta

SEQ ID NO: 168808 - DNA, 15 bp, Homo sapiens
ttctgttaattagtt

SEQ ID NO: 168809 - DNA, 15 bp, Homo sapiens
cttctgttaattagt

SEQ ID NO: 168810 - DNA, 15 bp, Homo sapiens
tcttctgttaattag

SEQ ID NO: 168811 - DNA, 15 bp, Homo sapiens
ctcttctgttaatta

SEQ ID NO: 168812 - DNA, 15 bp, Homo sapiens
gctcttctgttaatt

SEQ ID NO: 168813 - DNA, 15 bp, Homo sapiens
tgctcttctgttaat

SEQ ID NO: 168814 - DNA, 15 bp, Homo sapiens
ttgctcttctgttaa

SEQ ID NO: 168815 - DNA, 15 bp, Homo sapiens
cttgctcttctgtta

SEQ ID NO: 168816 - DNA, 15 bp, Homo sapiens
tcttgctcttctgtt

SEQ ID NO: 168817 - DNA, 15 bp, Homo sapiens
atcttgctcttctgt

SEQ ID NO: 168818 - DNA, 15 bp, Homo sapiens
aatcttgctcttctg

SEQ ID NO: 168819 - DNA, 15 bp, Homo sapiens
taatcttgctcttct

SEQ ID NO: 168820 - DNA, 15 bp, Homo sapiens
ataatcttgctcttc

SEQ ID NO: 168821 - DNA, 15 bp, Homo sapiens
aataatcttgctctt

SEQ ID NO: 168822 - DNA, 15 bp, Homo sapiens
caataatcttgctct

SEQ ID NO: 168823 - DNA, 15 bp, Homo sapiens
ccaataatcttgctc

SEQ ID NO: 168824 - DNA, 15 bp, Homo sapiens
gccaataatcttgct

SEQ ID NO: 168825 - DNA, 15 bp, Homo sapiens
tgccaataatcttgc

SEQ ID NO: 168826 - DNA, 15 bp, Homo sapiens
ttgccaataatcttg

SEQ ID NO: 168827 - DNA, 15 bp, Homo sapiens
gttgccaataatctt

SEQ ID NO: 168828 - DNA, 15 bp, Homo sapiens
agttgccaataatct

SEQ ID NO: 168829 - DNA, 15 bp, Homo sapiens
gagttgccaataatc

SEQ ID NO: 168830 - DNA, 15 bp, Homo sapiens
ggagttgccaataat

SEQ ID NO: 168831 - DNA, 15 bp, Homo sapiens
tggagttgccaataa

SEQ ID NO: 168832 - DNA, 15 bp, Homo sapiens
atggagttgccaata

SEQ ID NO: 168833 - DNA, 15 bp, Homo sapiens
aatggagttgccaat

SEQ ID NO: 168834 - DNA, 15 bp, Homo sapiens
taatggagttgccaa

SEQ ID NO: 168835 - DNA, 15 bp, Homo sapiens
ttaatggagttgcca

SEQ ID NO: 168836 - DNA, 15 bp, Homo sapiens
attaatggagttgcc

SEQ ID NO: 168837 - DNA, 15 bp, Homo sapiens
tattaatggagttgc

SEQ ID NO: 168838 - DNA, 15 bp, Homo sapiens
atattaatggagttg

SEQ ID NO: 168839 - DNA, 15 bp, Homo sapiens
aatattaatggagtt

SEQ ID NO: 168840 - DNA, 15 bp, Homo sapiens
taatattaatggagt

SEQ ID NO: 168841 - DNA, 15 bp, Homo sapiens
ctaatattaatggag

SEQ ID NO: 168842 - DNA, 15 bp, Homo sapiens
actaatattaatgga

SEQ ID NO: 168843 - DNA, 15 bp, Homo sapiens
tactaatattaatgg

SEQ ID NO: 168844 - DNA, 15 bp, Homo sapiens
atactaatattaatg

SEQ ID NO: 168845 - DNA, 15 bp, Homo sapiens
tatactaatattaat

SEQ ID NO: 168846 - DNA, 15 bp, Homo sapiens
ctatactaatattaa

SEQ ID NO: 168847 - DNA, 15 bp, Homo sapiens
tctatactaatatta

SEQ ID NO: 168848 - DNA, 15 bp, Homo sapiens
ctctatactaatatt

SEQ ID NO: 168849 - DNA, 15 bp, Homo sapiens
tctctatactaatat

SEQ ID NO: 168850 - DNA, 15 bp, Homo sapiens
gtctctatactaata

SEQ ID NO: 168851 - DNA, 15 bp, Homo sapiens
tgtctctatactaat

SEQ ID NO: 168852 - DNA, 15 bp, Homo sapiens
ctgtctctatactaa

SEQ ID NO: 168853 - DNA, 15 bp, Homo sapiens
actgtctctatacta

SEQ ID NO: 168854 - DNA, 15 bp, Homo sapiens
cactgtctctatact

SEQ ID NO: 168855 - DNA, 15 bp, Homo sapiens
gcactgtctctatac

SEQ ID NO: 168856 - DNA, 15 bp, Homo sapiens
agcactgtctctata

SEQ ID NO: 168857 - DNA, 15 bp, Homo sapiens
tagcactgtctctat

SEQ ID NO: 168858 - DNA, 15 bp, Homo sapiens
ctagcactgtctcta

SEQ ID NO: 168859 - DNA, 15 bp, Homo sapiens
gctagcactgtctct

SEQ ID NO: 168860 - DNA, 15 bp, Homo sapiens
tgctagcactgtctc

SEQ ID NO: 168861 - DNA, 15 bp, Homo sapiens
ttgctagcactgtct

SEQ ID NO: 168862 - DNA, 15 bp, Homo sapiens
gttgctagcactgtc

SEQ ID NO: 168863 - DNA, 15 bp, Homo sapiens
tgttgctagcactgt

SEQ ID NO: 168864 - DNA, 15 bp, Homo sapiens
atgttgctagcactg

SEQ ID NO: 168865 - DNA, 15 bp, Homo sapiens
catgttgctagcact

SEQ ID NO: 168866 - DNA, 15 bp, Homo sapiens
ccatgttgctagcac

SEQ ID NO: 168867 - DNA, 15 bp, Homo sapiens
gccatgttgctagca

SEQ ID NO: 168868 - DNA, 15 bp, Homo sapiens
tgccatgttgctagc

SEQ ID NO: 168869 - DNA, 15 bp, Homo sapiens
atgccatgttgctag

SEQ ID NO: 168870 - DNA, 15 bp, Homo sapiens
aatgccatgttgcta

SEQ ID NO: 168871 - DNA, 15 bp, Homo sapiens
aaatgccatgttgct

SEQ ID NO: 168872 - DNA, 15 bp, Homo sapiens
aaaatgccatgttgc

SEQ ID NO: 168873 - DNA, 15 bp, Homo sapiens
taaaatgccatgttg

SEQ ID NO: 168874 - DNA, 15 bp, Homo sapiens
ttaaaatgccatgtt

SEQ ID NO: 168875 - DNA, 15 bp, Homo sapiens
tttaaaatgccatgt

SEQ ID NO: 168876 - DNA, 15 bp, Homo sapiens
ctttaaaatgccatg

SEQ ID NO: 168877 - DNA, 15 bp, Homo sapiens
tctttaaaatgccat

SEQ ID NO: 168878 - DNA, 15 bp, Homo sapiens
ttctttaaaatgcca

SEQ ID NO: 168879 - DNA, 15 bp, Homo sapiens
attctttaaaatgcc

SEQ ID NO: 168880 - DNA, 15 bp, Homo sapiens
aattctttaaaatgc

SEQ ID NO: 168881 - DNA, 15 bp, Homo sapiens
taattctttaaaatg

SEQ ID NO: 168882 - DNA, 15 bp, Homo sapiens
gtaattctttaaaat

SEQ ID NO: 168883 - DNA, 15 bp, Homo sapiens
tgtaattctttaaaa

SEQ ID NO: 168884 - DNA, 15 bp, Homo sapiens
ctgtaattctttaaa

SEQ ID NO: 168885 - DNA, 15 bp, Homo sapiens
actgtaattctttaa

SEQ ID NO: 168886 - DNA, 15 bp, Homo sapiens
cactgtaattcttta

SEQ ID NO: 168887 - DNA, 15 bp, Homo sapiens
ccactgtaattcttt

SEQ ID NO: 168888 - DNA, 15 bp, Homo sapiens
gccactgtaattctt

SEQ ID NO: 168889 - DNA, 15 bp, Homo sapiens
tgccactgtaattct

SEQ ID NO: 168890 - DNA, 15 bp, Homo sapiens
ctgccactgtaattc

SEQ ID NO: 168891 - DNA, 15 bp, Homo sapiens
actgccactgtaatt

SEQ ID NO: 168892 - DNA, 15 bp, Homo sapiens
aactgccactgtaat

SEQ ID NO: 168893 - DNA, 15 bp, Homo sapiens
gaactgccactgtaa

SEQ ID NO: 168894 - DNA, 15 bp, Homo sapiens
agaactgccactgta

SEQ ID NO: 168895 - DNA, 15 bp, Homo sapiens
gagaactgccactgt

SEQ ID NO: 168896 - DNA, 15 bp, Homo sapiens
ggagaactgccactg

SEQ ID NO: 168897 - DNA, 15 bp, Homo sapiens
gggagaactgccact

SEQ ID NO: 168898 - DNA, 15 bp, Homo sapiens
tgggagaactgccac

SEQ ID NO: 168899 - DNA, 15 bp, Homo sapiens
ttgggagaactgcca

SEQ ID NO: 168900 - DNA, 15 bp, Homo sapiens
attgggagaactgcc

SEQ ID NO: 168901 - DNA, 15 bp, Homo sapiens
gattgggagaactgc

SEQ ID NO: 168902 - DNA, 15 bp, Homo sapiens
tgattgggagaactg

SEQ ID NO: 168903 - DNA, 15 bp, Homo sapiens
ctgattgggagaact

SEQ ID NO: 168904 - DNA, 15 bp, Homo sapiens
gctgattgggagaac

SEQ ID NO: 168905 - DNA, 15 bp, Homo sapiens
ggctgattgggagaa

SEQ ID NO: 168906 - DNA, 15 bp, Homo sapiens
tggctgattgggaga

SEQ ID NO: 168907 - DNA, 15 bp, Homo sapiens
ctggctgattgggag

SEQ ID NO: 168908 - DNA, 15 bp, Homo sapiens
tctggctgattggga

SEQ ID NO: 168909 - DNA, 15 bp, Homo sapiens
atctggctgattggg

SEQ ID NO: 168910 - DNA, 15 bp, Homo sapiens
aatctggctgattgg

SEQ ID NO: 168911 - DNA, 15 bp, Homo sapiens
aaatctggctgattg

SEQ ID NO: 168912 - DNA, 15 bp, Homo sapiens
gaaatctggctgatt

SEQ ID NO: 168913 - DNA, 15 bp, Homo sapiens
agaaatctggctgat

SEQ ID NO: 168914 - DNA, 15 bp, Homo sapiens
aagaaatctggctga

SEQ ID NO: 168915 - DNA, 15 bp, Homo sapiens
gaagaaatctggctg

SEQ ID NO: 168916 - DNA, 15 bp, Homo sapiens
ggaagaaatctggct

SEQ ID NO: 168917 - DNA, 15 bp, Homo sapiens
tggaagaaatctggc

SEQ ID NO: 168918 - DNA, 15 bp, Homo sapiens
ctggaagaaatctgg

SEQ ID NO: 168919 - DNA, 15 bp, Homo sapiens
tctggaagaaatctg

SEQ ID NO: 168920 - DNA, 15 bp, Homo sapiens
ttctggaagaaatct

SEQ ID NO: 168921 - DNA, 15 bp, Homo sapiens
tttctggaagaaatc

SEQ ID NO: 168922 - DNA, 15 bp, Homo sapiens
ttttctggaagaaat

SEQ ID NO: 168923 - DNA, 15 bp, Homo sapiens
attttctggaagaaa

SEQ ID NO: 168924 - DNA, 15 bp, Homo sapiens
aattttctggaagaa

SEQ ID NO: 168925 - DNA, 15 bp, Homo sapiens
taattttctggaaga

SEQ ID NO: 168926 - DNA, 15 bp, Homo sapiens
ataattttctggaag

SEQ ID NO: 168927 - DNA, 15 bp, Homo sapiens
tataattttctggaa

SEQ ID NO: 168928 - DNA, 15 bp, Homo sapiens
ttataattttctgga

SEQ ID NO: 168929 - DNA, 15 bp, Homo sapiens
tttataattttctgg

SEQ ID NO: 168930 - DNA, 15 bp, Homo sapiens
ctttataattttctg

SEQ ID NO: 168931 - DNA, 15 bp, Homo sapiens
cctttataattttct

SEQ ID NO: 168932 - DNA, 15 bp, Homo sapiens
tcctttataattttc

SEQ ID NO: 168933 - DNA, 15 bp, Homo sapiens
ttcctttataatttt

SEQ ID NO: 168934 - DNA, 15 bp, Homo sapiens
attcctttataattt

SEQ ID NO: 168935 - DNA, 15 bp, Homo sapiens
gattcctttataatt

SEQ ID NO: 168936 - DNA, 15 bp, Homo sapiens
agattcctttataat

SEQ ID NO: 168937 - DNA, 15 bp, Homo sapiens
gagattcctttataa

SEQ ID NO: 168938 - DNA, 15 bp, Homo sapiens
ggagattcctttata

SEQ ID NO: 168939 - DNA, 15 bp, Homo sapiens
aggagattcctttat

SEQ ID NO: 168940 - DNA, 15 bp, Homo sapiens
taggagattccttta

SEQ ID NO: 168941 - DNA, 15 bp, Homo sapiens
ctaggagattccttt

SEQ ID NO: 168942 - DNA, 15 bp, Homo sapiens
tctaggagattcctt

SEQ ID NO: 168943 - DNA, 15 bp, Homo sapiens
atctaggagattcct

SEQ ID NO: 168944 - DNA, 15 bp, Homo sapiens
tatctaggagattcc

SEQ ID NO: 168945 - DNA, 15 bp, Homo sapiens
ttatctaggagattc

SEQ ID NO: 168946 - DNA, 15 bp, Homo sapiens
tttatctaggagatt

SEQ ID NO: 168947 - DNA, 15 bp, Homo sapiens
gtttatctaggagat

SEQ ID NO: 168948 - DNA, 15 bp, Homo sapiens
agtttatctaggaga

SEQ ID NO: 168949 - DNA, 15 bp, Homo sapiens
aagtttatctaggag

SEQ ID NO: 168950 - DNA, 15 bp, Homo sapiens
taagtttatctagga

SEQ ID NO: 168951 - DNA, 15 bp, Homo sapiens
ataagtttatctagg

SEQ ID NO: 168952 - DNA, 15 bp, Homo sapiens
aataagtttatctag

SEQ ID NO: 168953 - DNA, 15 bp, Homo sapiens
aaataagtttatcta

SEQ ID NO: 168954 - DNA, 15 bp, Homo sapiens
aaaataagtttatct

SEQ ID NO: 168955 - DNA, 15 bp, Homo sapiens
gaaaataagtttatc

SEQ ID NO: 168956 - DNA, 15 bp, Homo sapiens
ggaaaataagtttat

SEQ ID NO: 168957 - DNA, 15 bp, Homo sapiens
gggaaaataagttta

SEQ ID NO: 168958 - DNA, 15 bp, Homo sapiens
tgggaaaataagttt

SEQ ID NO: 168959 - DNA, 15 bp, Homo sapiens
gtgggaaaataagtt

SEQ ID NO: 168960 - DNA, 15 bp, Homo sapiens
agtgggaaaataagt

SEQ ID NO: 168961 - DNA, 15 bp, Homo sapiens
cagtgggaaaataag

SEQ ID NO: 168962 - DNA, 15 bp, Homo sapiens
ccagtgggaaaataa

SEQ ID NO: 168963 - DNA, 15 bp, Homo sapiens
accagtgggaaaata

SEQ ID NO: 168964 - DNA, 15 bp, Homo sapiens
caccagtgggaaaat

SEQ ID NO: 168965 - DNA, 15 bp, Homo sapiens
acaccagtgggaaaa

SEQ ID NO: 168966 - DNA, 15 bp, Homo sapiens
aacaccagtgggaaa

SEQ ID NO: 168967 - DNA, 15 bp, Homo sapiens
taacaccagtgggaa

SEQ ID NO: 168968 - DNA, 15 bp, Homo sapiens
gtaacaccagtggga

SEQ ID NO: 168969 - DNA, 15 bp, Homo sapiens
agtaacaccagtggg

SEQ ID NO: 168970 - DNA, 15 bp, Homo sapiens
aagtaacaccagtgg

SEQ ID NO: 168971 - DNA, 15 bp, Homo sapiens
aaagtaacaccagtg

SEQ ID NO: 168972 - DNA, 15 bp, Homo sapiens
taaagtaacaccagt

SEQ ID NO: 168973 - DNA, 15 bp, Homo sapiens
ataaagtaacaccag

SEQ ID NO: 168974 - DNA, 15 bp, Homo sapiens
gataaagtaacacca

SEQ ID NO: 168975 - DNA, 15 bp, Homo sapiens
tgataaagtaacacc

SEQ ID NO: 168976 - DNA, 15 bp, Homo sapiens
ctgataaagtaacac

SEQ ID NO: 168977 - DNA, 15 bp, Homo sapiens
gctgataaagtaaca

SEQ ID NO: 168978 - DNA, 15 bp, Homo sapiens
ggctgataaagtaac

SEQ ID NO: 168979 - DNA, 15 bp, Homo sapiens
aggctgataaagtaa

SEQ ID NO: 168980 - DNA, 15 bp, Homo sapiens
taggctgataaagta

SEQ ID NO: 168981 - DNA, 15 bp, Homo sapiens
ttaggctgataaagt

SEQ ID NO: 168982 - DNA, 15 bp, Homo sapiens
cttaggctgataaag

SEQ ID NO: 168983 - DNA, 15 bp, Homo sapiens
acttaggctgataaa

SEQ ID NO: 168984 - DNA, 15 bp, Homo sapiens
tacttaggctgataa

SEQ ID NO: 168985 - DNA, 15 bp, Homo sapiens
ctacttaggctgata

SEQ ID NO: 168986 - DNA, 15 bp, Homo sapiens
actacttaggctgat

SEQ ID NO: 168987 - DNA, 15 bp, Homo sapiens
tactacttaggctga

SEQ ID NO: 168988 - DNA, 15 bp, Homo sapiens
ctactacttaggctg

SEQ ID NO: 168989 - DNA, 15 bp, Homo sapiens
gctactacttaggct

SEQ ID NO: 168990 - DNA, 15 bp, Homo sapiens
agctactacttaggc

SEQ ID NO: 168991 - DNA, 15 bp, Homo sapiens
gagctactacttagg

SEQ ID NO: 168992 - DNA, 15 bp, Homo sapiens
agagctactacttag

SEQ ID NO: 168993 - DNA, 15 bp, Homo sapiens
cagagctactactta

SEQ ID NO: 168994 - DNA, 15 bp, Homo sapiens
acagagctactactt

SEQ ID NO: 168995 - DNA, 15 bp, Homo sapiens
tacagagctactact

SEQ ID NO: 168996 - DNA, 15 bp, Homo sapiens
ttacagagctactac

SEQ ID NO: 168997 - DNA, 15 bp, Homo sapiens
tttacagagctacta

SEQ ID NO: 168998 - DNA, 15 bp, Homo sapiens
atttacagagctact

SEQ ID NO: 168999 - DNA, 15 bp, Homo sapiens
tatttacagagctac

SEQ ID NO: 169000 - DNA, 15 bp, Homo sapiens
ctatttacagagcta

SEQ ID NO: 169001 - DNA, 15 bp, Homo sapiens
tctatttacagagct

SEQ ID NO: 169002 - DNA, 15 bp, Homo sapiens
ctctatttacagagc

SEQ ID NO: 169003 - DNA, 15 bp, Homo sapiens
cctctatttacagag

SEQ ID NO: 169004 - DNA, 15 bp, Homo sapiens
tcctctatttacaga

SEQ ID NO: 169005 - DNA, 15 bp, Homo sapiens
gtcctctatttacag

SEQ ID NO: 169006 - DNA, 15 bp, Homo sapiens
agtcctctatttaca

SEQ ID NO: 169007 - DNA, 15 bp, Homo sapiens
cagtcctctatttac

SEQ ID NO: 169008 - DNA, 15 bp, Homo sapiens
tcagtcctctattta

SEQ ID NO: 169009 - DNA, 15 bp, Homo sapiens
ttcagtcctctattt

SEQ ID NO: 169010 - DNA, 15 bp, Homo sapiens
gttcagtcctctatt

SEQ ID NO: 169011 - DNA, 15 bp, Homo sapiens
tgttcagtcctctat

SEQ ID NO: 169012 - DNA, 15 bp, Homo sapiens
gtgttcagtcctcta

SEQ ID NO: 169013 - DNA, 15 bp, Homo sapiens
agtgttcagtcctct

SEQ ID NO: 169014 - DNA, 15 bp, Homo sapiens
aagtgttcagtcctc

SEQ ID NO: 169015 - DNA, 15 bp, Homo sapiens
caagtgttcagtcct

SEQ ID NO: 169016 - DNA, 15 bp, Homo sapiens
tcaagtgttcagtcc

SEQ ID NO: 169017 - DNA, 15 bp, Homo sapiens
ctcaagtgttcagtc

SEQ ID NO: 169018 - DNA, 15 bp, Homo sapiens
actcaagtgttcagt

SEQ ID NO: 169019 - DNA, 15 bp, Homo sapiens
aactcaagtgttcag

SEQ ID NO: 169020 - DNA, 15 bp, Homo sapiens
aaactcaagtgttca

SEQ ID NO: 169021 - DNA, 15 bp, Homo sapiens
caaactcaagtgttc

SEQ ID NO: 169022 - DNA, 15 bp, Homo sapiens
ccaaactcaagtgtt

SEQ ID NO: 169023 - DNA, 15 bp, Homo sapiens
cccaaactcaagtgt

SEQ ID NO: 169024 - DNA, 15 bp, Homo sapiens
acccaaactcaagtg

SEQ ID NO: 169025 - DNA, 15 bp, Homo sapiens
gacccaaactcaagt

SEQ ID NO: 169026 - DNA, 15 bp, Homo sapiens
ggacccaaactcaag

SEQ ID NO: 169027 - DNA, 15 bp, Homo sapiens
aggacccaaactcaa

SEQ ID NO: 169028 - DNA, 15 bp, Homo sapiens
caggacccaaactca

SEQ ID NO: 169029 - DNA, 15 bp, Homo sapiens
tcaggacccaaactc

SEQ ID NO: 169030 - DNA, 15 bp, Homo sapiens
atcaggacccaaact

SEQ ID NO: 169031 - DNA, 15 bp, Homo sapiens
aatcaggacccaaac

SEQ ID NO: 169032 - DNA, 15 bp, Homo sapiens
aaatcaggacccaaa

SEQ ID NO: 169033 - DNA, 15 bp, Homo sapiens
aaaatcaggacccaa

SEQ ID NO: 169034 - DNA, 15 bp, Homo sapiens
caaaatcaggaccca

SEQ ID NO: 169035 - DNA, 15 bp, Homo sapiens
acaaaatcaggaccc

SEQ ID NO: 169036 - DNA, 15 bp, Homo sapiens
tacaaaatcaggacc

SEQ ID NO: 169037 - DNA, 15 bp, Homo sapiens
ttacaaaatcaggac

SEQ ID NO: 169038 - DNA, 15 bp, Homo sapiens
attacaaaatcagga

SEQ ID NO: 169039 - DNA, 15 bp, Homo sapiens
aattacaaaatcagg

SEQ ID NO: 169040 - DNA, 15 bp, Homo sapiens
taattacaaaatcag

SEQ ID NO: 169041 - DNA, 15 bp, Homo sapiens
ctaattacaaaatca

SEQ ID NO: 169042 - DNA, 15 bp, Homo sapiens
gctaattacaaaatc

SEQ ID NO: 169043 - DNA, 15 bp, Homo sapiens
agctaattacaaaat

SEQ ID NO: 169044 - DNA, 15 bp, Homo sapiens
cagctaattacaaaa

SEQ ID NO: 169045 - DNA, 15 bp, Homo sapiens
acagctaattacaaa

SEQ ID NO: 169046 - DNA, 15 bp, Homo sapiens
cacagctaattacaa

SEQ ID NO: 169047 - DNA, 15 bp, Homo sapiens
acacagctaattaca

SEQ ID NO: 169048 - DNA, 15 bp, Homo sapiens
cacacagctaattac

SEQ ID NO: 169049 - DNA, 15 bp, Homo sapiens
tcacacagctaatta

SEQ ID NO: 169050 - DNA, 15 bp, Homo sapiens
ttcacacagctaatt

SEQ ID NO: 169051 - DNA, 15 bp, Homo sapiens
attcacacagctaat

SEQ ID NO: 169052 - DNA, 15 bp, Homo sapiens
aattcacacagctaa

SEQ ID NO: 169053 - DNA, 15 bp, Homo sapiens
caattcacacagcta

SEQ ID NO: 169054 - DNA, 15 bp, Homo sapiens
ccaattcacacagct

SEQ ID NO: 169055 - DNA, 15 bp, Homo sapiens
tccaattcacacagc

SEQ ID NO: 169056 - DNA, 15 bp, Homo sapiens
atccaattcacacag

SEQ ID NO: 169057 - DNA, 15 bp, Homo sapiens
gatccaattcacaca

SEQ ID NO: 169058 - DNA, 15 bp, Homo sapiens
tgatccaattcacac

SEQ ID NO: 169059 - DNA, 15 bp, Homo sapiens
ttgatccaattcaca

SEQ ID NO: 169060 - DNA, 15 bp, Homo sapiens
cttgatccaattcac

SEQ ID NO: 169061 - DNA, 15 bp, Homo sapiens
acttgatccaattca

SEQ ID NO: 169062 - DNA, 15 bp, Homo sapiens
gacttgatccaattc

SEQ ID NO: 169063 - DNA, 15 bp, Homo sapiens
cgacttgatccaatt

SEQ ID NO: 169064 - DNA, 15 bp, Homo sapiens
acgacttgatccaat

SEQ ID NO: 169065 - DNA, 15 bp, Homo sapiens
aacgacttgatccaa

SEQ ID NO: 169066 - DNA, 15 bp, Homo sapiens
aaacgacttgatcca

SEQ ID NO: 169067 - DNA, 15 bp, Homo sapiens
taaacgacttgatcc

SEQ ID NO: 169068 - DNA, 15 bp, Homo sapiens
ctaaacgacttgatc

SEQ ID NO: 169069 - DNA, 15 bp, Homo sapiens
tctaaacgacttgat

SEQ ID NO: 169070 - DNA, 15 bp, Homo sapiens
atctaaacgacttga

SEQ ID NO: 169071 - DNA, 15 bp, Homo sapiens
aatctaaacgacttg

SEQ ID NO: 169072 - DNA, 15 bp, Homo sapiens
gaatctaaacgactt

SEQ ID NO: 169073 - DNA, 15 bp, Homo sapiens
agaatctaaacgact

SEQ ID NO: 169074 - DNA, 15 bp, Homo sapiens
gagaatctaaacgac

SEQ ID NO: 169075 - DNA, 15 bp, Homo sapiens
agagaatctaaacga

SEQ ID NO: 169076 - DNA, 15 bp, Homo sapiens
cagagaatctaaacg

SEQ ID NO: 169077 - DNA, 15 bp, Homo sapiens
ccagagaatctaaac

SEQ ID NO: 169078 - DNA, 15 bp, Homo sapiens
cccagagaatctaaa

SEQ ID NO: 169079 - DNA, 15 bp, Homo sapiens
gcccagagaatctaa

SEQ ID NO: 169080 - DNA, 15 bp, Homo sapiens
ggcccagagaatcta

SEQ ID NO: 169081 - DNA, 15 bp, Homo sapiens
aggcccagagaatct

SEQ ID NO: 169082 - DNA, 15 bp, Homo sapiens
gaggcccagagaatc

SEQ ID NO: 169083 - DNA, 15 bp, Homo sapiens
tgaggcccagagaat

SEQ ID NO: 169084 - DNA, 15 bp, Homo sapiens
ttgaggcccagagaa

SEQ ID NO: 169085 - DNA, 15 bp, Homo sapiens
attgaggcccagaga

SEQ ID NO: 169086 - DNA, 15 bp, Homo sapiens
aattgaggcccagag

SEQ ID NO: 169087 - DNA, 15 bp, Homo sapiens
aaattgaggcccaga

SEQ ID NO: 169088 - DNA, 15 bp, Homo sapiens
gaaattgaggcccag

SEQ ID NO: 169089 - DNA, 15 bp, Homo sapiens
agaaattgaggccca

SEQ ID NO: 169090 - DNA, 15 bp, Homo sapiens
aagaaattgaggccc

SEQ ID NO: 169091 - DNA, 15 bp, Homo sapiens
gaagaaattgaggcc

SEQ ID NO: 169092 - DNA, 15 bp, Homo sapiens
tgaagaaattgaggc

SEQ ID NO: 169093 - DNA, 15 bp, Homo sapiens
atgaagaaattgagg

SEQ ID NO: 169094 - DNA, 15 bp, Homo sapiens
gatgaagaaattgag

SEQ ID NO: 169095 - DNA, 15 bp, Homo sapiens
agatgaagaaattga

SEQ ID NO: 169096 - DNA, 15 bp, Homo sapiens
cagatgaagaaattg

SEQ ID NO: 169097 - DNA, 15 bp, Homo sapiens
acagatgaagaaatt

SEQ ID NO: 169098 - DNA, 15 bp, Homo sapiens
tacagatgaagaaat

SEQ ID NO: 169099 - DNA, 15 bp, Homo sapiens
ttacagatgaagaaa

SEQ ID NO: 169100 - DNA, 15 bp, Homo sapiens
attacagatgaagaa

SEQ ID NO: 169101 - DNA, 15 bp, Homo sapiens
tattacagatgaaga

SEQ ID NO: 169102 - DNA, 15 bp, Homo sapiens
atattacagatgaag

SEQ ID NO: 169103 - DNA, 15 bp, Homo sapiens
catattacagatgaa

SEQ ID NO: 169104 - DNA, 15 bp, Homo sapiens
tcatattacagatga

SEQ ID NO: 169105 - DNA, 15 bp, Homo sapiens
ctcatattacagatg

SEQ ID NO: 169106 - DNA, 15 bp, Homo sapiens
tctcatattacagat

SEQ ID NO: 169107 - DNA, 15 bp, Homo sapiens
ttctcatattacaga

SEQ ID NO: 169108 - DNA, 15 bp, Homo sapiens
tttctcatattacag

SEQ ID NO: 169109 - DNA, 15 bp, Homo sapiens
ctttctcatattaca

SEQ ID NO: 169110 - DNA, 15 bp, Homo sapiens
cctttctcatattac

SEQ ID NO: 169111 - DNA, 15 bp, Homo sapiens
acctttctcatatta

SEQ ID NO: 169112 - DNA, 15 bp, Homo sapiens
gacctttctcatatt

SEQ ID NO: 169113 - DNA, 15 bp, Homo sapiens
cgacctttctcatat

SEQ ID NO: 169114 - DNA, 15 bp, Homo sapiens
tcgacctttctcata

SEQ ID NO: 169115 - DNA, 15 bp, Homo sapiens
ttcgacctttctcat

SEQ ID NO: 169116 - DNA, 15 bp, Homo sapiens
tttcgacctttctca

SEQ ID NO: 169117 - DNA, 15 bp, Homo sapiens
atttcgacctttctc

SEQ ID NO: 169118 - DNA, 15 bp, Homo sapiens
tatttcgacctttct

SEQ ID NO: 169119 - DNA, 15 bp, Homo sapiens
ttatttcgacctttc

SEQ ID NO: 169120 - DNA, 15 bp, Homo sapiens
attatttcgaccttt

SEQ ID NO: 169121 - DNA, 15 bp, Homo sapiens
aattatttcgacctt

SEQ ID NO: 169122 - DNA, 15 bp, Homo sapiens
caattatttcgacct

SEQ ID NO: 169123 - DNA, 15 bp, Homo sapiens
tcaattatttcgacc

SEQ ID NO: 169124 - DNA, 15 bp, Homo sapiens
atcaattatttcgac

SEQ ID NO: 169125 - DNA, 15 bp, Homo sapiens
aatcaattatttcga

SEQ ID NO: 169126 - DNA, 15 bp, Homo sapiens
aaatcaattatttcg

SEQ ID NO: 169127 - DNA, 15 bp, Homo sapiens
taaatcaattatttc

SEQ ID NO: 169128 - DNA, 15 bp, Homo sapiens
ctaaatcaattattt

SEQ ID NO: 169129 - DNA, 15 bp, Homo sapiens
gctaaatcaattatt

SEQ ID NO: 169130 - DNA, 15 bp, Homo sapiens
tgctaaatcaattat

SEQ ID NO: 169131 - DNA, 15 bp, Homo sapiens
ttgctaaatcaatta

SEQ ID NO: 169132 - DNA, 15 bp, Homo sapiens
attgctaaatcaatt

SEQ ID NO: 169133 - DNA, 15 bp, Homo sapiens
tattgctaaatcaat

SEQ ID NO: 169134 - DNA, 15 bp, Homo sapiens
atattgctaaatcaa

SEQ ID NO: 169135 - DNA, 15 bp, Homo sapiens
tatattgctaaatca

SEQ ID NO: 169136 - DNA, 15 bp, Homo sapiens
atatattgctaaatc

SEQ ID NO: 169137 - DNA, 15 bp, Homo sapiens
aatatattgctaaat

SEQ ID NO: 169138 - DNA, 15 bp, Homo sapiens
aaatatattgctaaa

SEQ ID NO: 169139 - DNA, 15 bp, Homo sapiens
aaaatatattgctaa

SEQ ID NO: 169140 - DNA, 15 bp, Homo sapiens
taaaatatattgcta

SEQ ID NO: 169141 - DNA, 15 bp, Homo sapiens
ataaaatatattgct

SEQ ID NO: 169142 - DNA, 15 bp, Homo sapiens
gataaaatatattgc

SEQ ID NO: 169143 - DNA, 15 bp, Homo sapiens
tgataaaatatattg

SEQ ID NO: 169144 - DNA, 15 bp, Homo sapiens
ttgataaaatatatt

SEQ ID NO: 169145 - DNA, 15 bp, Homo sapiens
attgataaaatatat

SEQ ID NO: 169146 - DNA, 15 bp, Homo sapiens
gattgataaaatata

SEQ ID NO: 169147 - DNA, 15 bp, Homo sapiens
tgattgataaaatat

SEQ ID NO: 169148 - DNA, 15 bp, Homo sapiens
ctgattgataaaata

SEQ ID NO: 169149 - DNA, 15 bp, Homo sapiens
tctgattgataaaat

SEQ ID NO: 169150 - DNA, 15 bp, Homo sapiens
ttctgattgataaaa

SEQ ID NO: 169151 - DNA, 15 bp, Homo sapiens
tttctgattgataaa

SEQ ID NO: 169152 - DNA, 15 bp, Homo sapiens
atttctgattgataa

SEQ ID NO: 169153 - DNA, 15 bp, Homo sapiens
tatttctgattgata

SEQ ID NO: 169154 - DNA, 15 bp, Homo sapiens
atatttctgattgat

SEQ ID NO: 169155 - DNA, 15 bp, Homo sapiens
aatatttctgattga

SEQ ID NO: 169156 - DNA, 15 bp, Homo sapiens
taatatttctgattg

SEQ ID NO: 169157 - DNA, 15 bp, Homo sapiens
ctaatatttctgatt

SEQ ID NO: 169158 - DNA, 15 bp, Homo sapiens
actaatatttctgat

SEQ ID NO: 169159 - DNA, 15 bp, Homo sapiens
cactaatatttctga

SEQ ID NO: 169160 - DNA, 15 bp, Homo sapiens
tcactaatatttctg

SEQ ID NO: 169161 - DNA, 15 bp, Homo sapiens
atcactaatatttct

SEQ ID NO: 169162 - DNA, 15 bp, Homo sapiens
catcactaatatttc

SEQ ID NO: 169163 - DNA, 15 bp, Homo sapiens
acatcactaatattt

SEQ ID NO: 169164 - DNA, 15 bp, Homo sapiens
gacatcactaatatt

SEQ ID NO: 169165 - DNA, 15 bp, Homo sapiens
tgacatcactaatat

SEQ ID NO: 169166 - DNA, 15 bp, Homo sapiens
ctgacatcactaata

SEQ ID NO: 169167 - DNA, 15 bp, Homo sapiens
actgacatcactaat

SEQ ID NO: 169168 - DNA, 15 bp, Homo sapiens
cactgacatcactaa

SEQ ID NO: 169169 - DNA, 15 bp, Homo sapiens
tcactgacatcacta

SEQ ID NO: 169170 - DNA, 15 bp, Homo sapiens
ttcactgacatcact

SEQ ID NO: 169171 - DNA, 15 bp, Homo sapiens
cttcactgacatcac

SEQ ID NO: 169172 - DNA, 15 bp, Homo sapiens
gcttcactgacatca

SEQ ID NO: 169173 - DNA, 15 bp, Homo sapiens
agcttcactgacatc

SEQ ID NO: 169174 - DNA, 15 bp, Homo sapiens
aagcttcactgacat

SEQ ID NO: 169175 - DNA, 15 bp, Homo sapiens
caagcttcactgaca

SEQ ID NO: 169176 - DNA, 15 bp, Homo sapiens
acaagcttcactgac

SEQ ID NO: 169177 - DNA, 15 bp, Homo sapiens
cacaagcttcactga

SEQ ID NO: 169178 - DNA, 15 bp, Homo sapiens
acacaagcttcactg

SEQ ID NO: 169179 - DNA, 15 bp, Homo sapiens
tacacaagcttcact

SEQ ID NO: 169180 - DNA, 15 bp, Homo sapiens
atacacaagcttcac

SEQ ID NO: 169181 - DNA, 15 bp, Homo sapiens
tatacacaagcttca

SEQ ID NO: 169182 - DNA, 15 bp, Homo sapiens
atatacacaagcttc

SEQ ID NO: 169183 - DNA, 15 bp, Homo sapiens
tatatacacaagctt

SEQ ID NO: 169184 - DNA, 15 bp, Homo sapiens
ttatatacacaagct

SEQ ID NO: 169185 - DNA, 15 bp, Homo sapiens
tttatatacacaagc

SEQ ID NO: 169186 - DNA, 15 bp, Homo sapiens
atttatatacacaag

SEQ ID NO: 169187 - DNA, 15 bp, Homo sapiens
aatttatatacacaa

SEQ ID NO: 169188 - DNA, 15 bp, Homo sapiens
gaatttatatacaca

SEQ ID NO: 169189 - DNA, 15 bp, Homo sapiens
tgaatttatatacac

SEQ ID NO: 169190 - DNA, 15 bp, Homo sapiens
atgaatttatataca

SEQ ID NO: 169191 - DNA, 15 bp, Homo sapiens
aatgaatttatatac

SEQ ID NO: 169192 - DNA, 15 bp, Homo sapiens
aaaatgaatttatat

SEQ ID NO: 169193 - DNA, 15 bp, Homo sapiens
aaaaatgaatttata

SEQ ID NO: 169194 - DNA, 15 bp, Homo sapiens
aaaaaatgaatttat

SEQ ID NO: 169195 - DNA, 15 bp, Homo sapiens
gaaaaaatgaattta

SEQ ID NO: 169196 - DNA, 15 bp, Homo sapiens
tgaaaaaatgaattt

SEQ ID NO: 169197 - DNA, 15 bp, Homo sapiens
ttgaaaaaatgaatt

SEQ ID NO: 169198 - DNA, 15 bp, Homo sapiens
attgaaaaaatgaat

SEQ ID NO: 169199 - DNA, 15 bp, Homo sapiens
gattgaaaaaatgaa

SEQ ID NO: 169200 - DNA, 15 bp, Homo sapiens
tgattgaaaaaatga

SEQ ID NO: 169201 - DNA, 15 bp, Homo sapiens
atgattgaaaaaatg

SEQ ID NO: 169202 - DNA, 15 bp, Homo sapiens
aatgattgaaaaaat

SEQ ID NO: 169203 - DNA, 15 bp, Homo sapiens
aaatgattgaaaaaa

SEQ ID NO: 169204 - DNA, 15 bp, Homo sapiens
taaatgattgaaaaa

SEQ ID NO: 169205 - DNA, 15 bp, Homo sapiens
ttaaatgattgaaaa

SEQ ID NO: 169206 - DNA, 15 bp, Homo sapiens
cttaaatgattgaaa

SEQ ID NO: 169207 - DNA, 15 bp, Homo sapiens
ccttaaatgattgaa

SEQ ID NO: 169208 - DNA, 15 bp, Homo sapiens
tccttaaatgattga

SEQ ID NO: 169209 - DNA, 15 bp, Homo sapiens
ttccttaaatgattg

SEQ ID NO: 169210 - DNA, 15 bp, Homo sapiens
gttccttaaatgatt

SEQ ID NO: 169211 - DNA, 15 bp, Homo sapiens
agttccttaaatgat

SEQ ID NO: 169212 - DNA, 15 bp, Homo sapiens
aagttccttaaatga

SEQ ID NO: 169213 - DNA, 15 bp, Homo sapiens
taagttccttaaatg

SEQ ID NO: 169214 - DNA, 15 bp, Homo sapiens
ctaagttccttaaat

SEQ ID NO: 169215 - DNA, 15 bp, Homo sapiens
tctaagttccttaaa

SEQ ID NO: 169216 - DNA, 15 bp, Homo sapiens
atctaagttccttaa

SEQ ID NO: 169217 - DNA, 15 bp, Homo sapiens
tatctaagttcctta

SEQ ID NO: 169218 - DNA, 15 bp, Homo sapiens
atatctaagttcctt

SEQ ID NO: 169219 - DNA, 15 bp, Homo sapiens
tatatctaagttcct

SEQ ID NO: 169220 - DNA, 15 bp, Homo sapiens
ttatatctaagttcc

SEQ ID NO: 169221 - DNA, 15 bp, Homo sapiens
tttatatctaagttc

SEQ ID NO: 169222 - DNA, 15 bp, Homo sapiens
ttttatatctaagtt

SEQ ID NO: 169223 - DNA, 15 bp, Homo sapiens
attttatatctaagt

SEQ ID NO: 169224 - DNA, 15 bp, Homo sapiens
tattttatatctaag

SEQ ID NO: 169225 - DNA, 15 bp, Homo sapiens
gtattttatatctaa

SEQ ID NO: 169226 - DNA, 15 bp, Homo sapiens
tgtattttatatcta

SEQ ID NO: 169227 - DNA, 15 bp, Homo sapiens
gtgtattttatatct

SEQ ID NO: 169228 - DNA, 15 bp, Homo sapiens
ggtgtattttatatc

SEQ ID NO: 169229 - DNA, 15 bp, Homo sapiens
aggtgtattttatat

SEQ ID NO: 169230 - DNA, 15 bp, Homo sapiens
aaggtgtattttata

SEQ ID NO: 169231 - DNA, 15 bp, Homo sapiens
aaaggtgtattttat

SEQ ID NO: 169232 - DNA, 15 bp, Homo sapiens
taaaggtgtatttta

SEQ ID NO: 169233 - DNA, 15 bp, Homo sapiens
ttaaaggtgtatttt

SEQ ID NO: 169234 - DNA, 15 bp, Homo sapiens
attaaaggtgtattt

SEQ ID NO: 169235 - DNA, 15 bp, Homo sapiens
aattaaaggtgtatt

SEQ ID NO: 169236 - DNA, 15 bp, Homo sapiens
gaattaaaggtgtat

SEQ ID NO: 169237 - DNA, 15 bp, Homo sapiens
tgaattaaaggtgta

SEQ ID NO: 169238 - DNA, 15 bp, Homo sapiens
gtgaattaaaggtgt

SEQ ID NO: 169239 - DNA, 15 bp, Homo sapiens
ggtgaattaaaggtg

SEQ ID NO: 169240 - DNA, 15 bp, Homo sapiens
aggtgaattaaaggt

SEQ ID NO: 169241 - DNA, 15 bp, Homo sapiens
aaggtgaattaaagg

SEQ ID NO: 169242 - DNA, 15 bp, Homo sapiens
aaaggtgaattaaag

SEQ ID NO: 169243 - DNA, 15 bp, Homo sapiens
caaaggtgaattaaa

SEQ ID NO: 169244 - DNA, 15 bp, Homo sapiens
ccaaaggtgaattaa

SEQ ID NO: 169245 - DNA, 15 bp, Homo sapiens
tccaaaggtgaatta

SEQ ID NO: 169246 - DNA, 15 bp, Homo sapiens
ttccaaaggtgaatt

SEQ ID NO: 169247 - DNA, 15 bp, Homo sapiens
tttccaaaggtgaat

SEQ ID NO: 169248 - DNA, 15 bp, Homo sapiens
atttccaaaggtgaa

SEQ ID NO: 169249 - DNA, 15 bp, Homo sapiens
aatttccaaaggtga

SEQ ID NO: 169250 - DNA, 15 bp, Homo sapiens
aaatttccaaaggtg

SEQ ID NO: 169251 - DNA, 15 bp, Homo sapiens
aaaatttccaaaggt

SEQ ID NO: 169252 - DNA, 15 bp, Homo sapiens
aaaaatttccaaagg

SEQ ID NO: 169253 - DNA, 15 bp, Homo sapiens
aaaaaatttccaaag

SEQ ID NO: 169254 - DNA, 15 bp, Homo sapiens
taaaaaatttccaaa

SEQ ID NO: 169255 - DNA, 15 bp, Homo sapiens
gtaaaaaatttccaa

SEQ ID NO: 169256 - DNA, 15 bp, Homo sapiens
tgtaaaaaatttcca

SEQ ID NO: 169257 - DNA, 15 bp, Homo sapiens
ttgtaaaaaatttcc

SEQ ID NO: 169258 - DNA, 15 bp, Homo sapiens
tttgtaaaaaatttc

SEQ ID NO: 169259 - DNA, 15 bp, Homo sapiens
ctttgtaaaaaattt

SEQ ID NO: 169260 - DNA, 15 bp, Homo sapiens
actttgtaaaaaatt

SEQ ID NO: 169261 - DNA, 15 bp, Homo sapiens
cactttgtaaaaaat

SEQ ID NO: 169262 - DNA, 15 bp, Homo sapiens
acactttgtaaaaaa

SEQ ID NO: 169263 - DNA, 15 bp, Homo sapiens
aacactttgtaaaaa

SEQ ID NO: 169264 - DNA, 15 bp, Homo sapiens
aaacactttgtaaaa

SEQ ID NO: 169265 - DNA, 15 bp, Homo sapiens
aaaacactttgtaaa

SEQ ID NO: 169266 - DNA, 15 bp, Homo sapiens
taaaacactttgtaa

SEQ ID NO: 169267 - DNA, 15 bp, Homo sapiens
ataaaacactttgta

SEQ ID NO: 169268 - DNA, 15 bp, Homo sapiens
aataaaacactttgt

SEQ ID NO: 169269 - DNA, 15 bp, Homo sapiens
aaataaaacactttg

SEQ ID NO: 169270 - DNA, 15 bp, Homo sapiens
caaataaaacacttt

SEQ ID NO: 169271 - DNA, 15 bp, Homo sapiens
gcaaataaaacactt

SEQ ID NO: 169272 - DNA, 15 bp, Homo sapiens
tgcaaataaaacact

SEQ ID NO: 169273 - DNA, 15 bp, Homo sapiens
ttgcaaataaaacac

SEQ ID NO: 169274 - DNA, 15 bp, Homo sapiens
tttgcaaataaaaca

SEQ ID NO: 169275 - DNA, 15 bp, Homo sapiens
atttgcaaataaaac

SEQ ID NO: 169276 - DNA, 15 bp, Homo sapiens
catttgcaaataaaa

SEQ ID NO: 169277 - DNA, 15 bp, Homo sapiens
tcatttgcaaataaa

SEQ ID NO: 169278 - DNA, 15 bp, Homo sapiens
gtcatttgcaaataa

SEQ ID NO: 169279 - DNA, 15 bp, Homo sapiens
tgtcatttgcaaata

SEQ ID NO: 169280 - DNA, 15 bp, Homo sapiens
ctgtcatttgcaaat

SEQ ID NO: 169281 - DNA, 15 bp, Homo sapiens
actgtcatttgcaaa

SEQ ID NO: 169282 - DNA, 15 bp, Homo sapiens
cactgtcatttgcaa

SEQ ID NO: 169283 - DNA, 15 bp, Homo sapiens
tcactgtcatttgca

SEQ ID NO: 169284 - DNA, 15 bp, Homo sapiens
atcactgtcatttgc

SEQ ID NO: 169285 - DNA, 15 bp, Homo sapiens
tatcactgtcatttg

SEQ ID NO: 169286 - DNA, 15 bp, Homo sapiens
ctatcactgtcattt

SEQ ID NO: 169287 - DNA, 15 bp, Homo sapiens
actatcactgtcatt

SEQ ID NO: 169288 - DNA, 15 bp, Homo sapiens
tactatcactgtcat

SEQ ID NO: 169289 - DNA, 15 bp, Homo sapiens
ttactatcactgtca

SEQ ID NO: 169290 - DNA, 15 bp, Homo sapiens
cttactatcactgtc

SEQ ID NO: 169291 - DNA, 15 bp, Homo sapiens
tcttactatcactgt

SEQ ID NO: 169292 - DNA, 15 bp, Homo sapiens
ctcttactatcactg

SEQ ID NO: 169293 - DNA, 15 bp, Homo sapiens
actcttactatcact

SEQ ID NO: 169294 - DNA, 15 bp, Homo sapiens
aactcttactatcac

SEQ ID NO: 169295 - DNA, 15 bp, Homo sapiens
taactcttactatca

SEQ ID NO: 169296 - DNA, 15 bp, Homo sapiens
ttaactcttactatc

SEQ ID NO: 169297 - DNA, 15 bp, Homo sapiens
attaactcttactat

SEQ ID NO: 169298 - DNA, 15 bp, Homo sapiens
cattaactcttacta

SEQ ID NO: 169299 - DNA, 15 bp, Homo sapiens
acattaactcttact

SEQ ID NO: 169300 - DNA, 15 bp, Homo sapiens
aacattaactcttac

SEQ ID NO: 169301 - DNA, 15 bp, Homo sapiens
aaacattaactctta

SEQ ID NO: 169302 - DNA, 15 bp, Homo sapiens
taaacattaactctt

SEQ ID NO: 169303 - DNA, 15 bp, Homo sapiens
ttaaacattaactct

SEQ ID NO: 169304 - DNA, 15 bp, Homo sapiens
cttaaacattaactc

SEQ ID NO: 169305 - DNA, 15 bp, Homo sapiens
ccttaaacattaact

SEQ ID NO: 169306 - DNA, 15 bp, Homo sapiens
gccttaaacattaac

SEQ ID NO: 169307 - DNA, 15 bp, Homo sapiens
agccttaaacattaa

SEQ ID NO: 169308 - DNA, 15 bp, Homo sapiens
tagccttaaacatta

SEQ ID NO: 169309 - DNA, 15 bp, Homo sapiens
atagccttaaacatt

SEQ ID NO: 169310 - DNA, 15 bp, Homo sapiens
aatagccttaaacat

SEQ ID NO: 169311 - DNA, 15 bp, Homo sapiens
aaatagccttaaaca

SEQ ID NO: 169312 - DNA, 15 bp, Homo sapiens
aaaatagccttaaac

SEQ ID NO: 169313 - DNA, 15 bp, Homo sapiens
caaaatagccttaaa

SEQ ID NO: 169314 - DNA, 15 bp, Homo sapiens
acaaaatagccttaa

SEQ ID NO: 169315 - DNA, 15 bp, Homo sapiens
tacaaaatagcctta

SEQ ID NO: 169316 - DNA, 15 bp, Homo sapiens
ttacaaaatagcctt

SEQ ID NO: 169317 - DNA, 15 bp, Homo sapiens
tttacaaaatagcct

SEQ ID NO: 169318 - DNA, 15 bp, Homo sapiens
atttacaaaatagcc

SEQ ID NO: 169319 - DNA, 15 bp, Homo sapiens
catttacaaaatagc

SEQ ID NO: 169320 - DNA, 15 bp, Homo sapiens
tcatttacaaaatag

SEQ ID NO: 169321 - DNA, 15 bp, Homo sapiens
gtcatttacaaaata

SEQ ID NO: 169322 - DNA, 15 bp, Homo sapiens
agtcatttacaaaat

SEQ ID NO: 169323 - DNA, 15 bp, Homo sapiens
aagtcatttacaaaa

SEQ ID NO: 169324 - DNA, 15 bp, Homo sapiens
aaagtcatttacaaa

SEQ ID NO: 169325 - DNA, 15 bp, Homo sapiens
taaagtcatttacaa

SEQ ID NO: 169326 - DNA, 15 bp, Homo sapiens
ttaaagtcatttaca

SEQ ID NO: 169327 - DNA, 15 bp, Homo sapiens
tttaaagtcatttac

SEQ ID NO: 169328 - DNA, 15 bp, Homo sapiens
atttaaagtcattta

SEQ ID NO: 169329 - DNA, 15 bp, Homo sapiens
catttaaagtcattt

SEQ ID NO: 169330 - DNA, 15 bp, Homo sapiens
tcatttaaagtcatt

SEQ ID NO: 169331 - DNA, 15 bp, Homo sapiens
atcatttaaagtcat

SEQ ID NO: 169332 - DNA, 15 bp, Homo sapiens
aatcatttaaagtca

SEQ ID NO: 169333 - DNA, 15 bp, Homo sapiens
gaatcatttaaagtc

SEQ ID NO: 169334 - DNA, 15 bp, Homo sapiens
agaatcatttaaagt

SEQ ID NO: 169335 - DNA, 15 bp, Homo sapiens
tagaatcatttaaag

SEQ ID NO: 169336 - DNA, 15 bp, Homo sapiens
ttagaatcatttaaa

SEQ ID NO: 169337 - DNA, 15 bp, Homo sapiens
cttagaatcatttaa

SEQ ID NO: 169338 - DNA, 15 bp, Homo sapiens
acttagaatcattta

SEQ ID NO: 169339 - DNA, 15 bp, Homo sapiens
tacttagaatcattt

SEQ ID NO: 169340 - DNA, 15 bp, Homo sapiens
gtacttagaatcatt

SEQ ID NO: 169341 - DNA, 15 bp, Homo sapiens
agtacttagaatcat

SEQ ID NO: 169342 - DNA, 15 bp, Homo sapiens
aagtacttagaatca

SEQ ID NO: 169343 - DNA, 15 bp, Homo sapiens
caagtacttagaatc

SEQ ID NO: 169344 - DNA, 15 bp, Homo sapiens
acaagtacttagaat

SEQ ID NO: 169345 - DNA, 15 bp, Homo sapiens
aacaagtacttagaa

SEQ ID NO: 169346 - DNA, 15 bp, Homo sapiens
taacaagtacttaga

SEQ ID NO: 169347 - DNA, 15 bp, Homo sapiens
gtaacaagtacttag

SEQ ID NO: 169348 - DNA, 15 bp, Homo sapiens
agtaacaagtactta

SEQ ID NO: 169349 - DNA, 15 bp, Homo sapiens
gagtaacaagtactt

SEQ ID NO: 169350 - DNA, 15 bp, Homo sapiens
agagtaacaagtact

SEQ ID NO: 169351 - DNA, 15 bp, Homo sapiens
aagagtaacaagtac

SEQ ID NO: 169352 - DNA, 15 bp, Homo sapiens
taagagtaacaagta

SEQ ID NO: 169353 - DNA, 15 bp, Homo sapiens
ttaagagtaacaagt

SEQ ID NO: 169354 - DNA, 15 bp, Homo sapiens
gttaagagtaacaag

SEQ ID NO: 169355 - DNA, 15 bp, Homo sapiens
agttaagagtaacaa

SEQ ID NO: 169356 - DNA, 15 bp, Homo sapiens
tagttaagagtaaca

SEQ ID NO: 169357 - DNA, 15 bp, Homo sapiens
gtagttaagagtaac

SEQ ID NO: 169358 - DNA, 15 bp, Homo sapiens
cgtagttaagagtaa

SEQ ID NO: 169359 - DNA, 15 bp, Homo sapiens
gcgtagttaagagta

SEQ ID NO: 169360 - DNA, 15 bp, Homo sapiens
agcgtagttaagagt

SEQ ID NO: 169361 - DNA, 15 bp, Homo sapiens
cagcgtagttaagag

SEQ ID NO: 169362 - DNA, 15 bp, Homo sapiens
acagcgtagttaaga

SEQ ID NO: 169363 - DNA, 15 bp, Homo sapiens
aacagcgtagttaag

SEQ ID NO: 169364 - DNA, 15 bp, Homo sapiens
aaacagcgtagttaa

SEQ ID NO: 169365 - DNA, 15 bp, Homo sapiens
gaaacagcgtagtta

SEQ ID NO: 169366 - DNA, 15 bp, Homo sapiens
tgaaacagcgtagtt

SEQ ID NO: 169367 - DNA, 15 bp, Homo sapiens
atgaaacagcgtagt

SEQ ID NO: 169368 - DNA, 15 bp, Homo sapiens
aatgaaacagcgtag

SEQ ID NO: 169369 - DNA, 15 bp, Homo sapiens
gaatgaaacagcgta

SEQ ID NO: 169370 - DNA, 15 bp, Homo sapiens
tgaatgaaacagcgt

SEQ ID NO: 169371 - DNA, 15 bp, Homo sapiens
atgaatgaaacagcg

SEQ ID NO: 169372 - DNA, 15 bp, Homo sapiens
tatgaatgaaacagc

SEQ ID NO: 169373 - DNA, 15 bp, Homo sapiens
gtatgaatgaaacag

SEQ ID NO: 169374 - DNA, 15 bp, Homo sapiens
tgtatgaatgaaaca

SEQ ID NO: 169375 - DNA, 15 bp, Homo sapiens
atgtatgaatgaaac

SEQ ID NO: 169376 - DNA, 15 bp, Homo sapiens
aatgtatgaatgaaa

SEQ ID NO: 169377 - DNA, 15 bp, Homo sapiens
caatgtatgaatgaa

SEQ ID NO: 169378 - DNA, 15 bp, Homo sapiens
tcaatgtatgaatga

SEQ ID NO: 169379 - DNA, 15 bp, Homo sapiens
ttcaatgtatgaatg

SEQ ID NO: 169380 - DNA, 15 bp, Homo sapiens
tttcaatgtatgaat

SEQ ID NO: 169381 - DNA, 15 bp, Homo sapiens
atttcaatgtatgaa

SEQ ID NO: 169382 - DNA, 15 bp, Homo sapiens
tatttcaatgtatga

SEQ ID NO: 169383 - DNA, 15 bp, Homo sapiens
ctatttcaatgtatg

SEQ ID NO: 169384 - DNA, 15 bp, Homo sapiens
tctatttcaatgtat

SEQ ID NO: 169385 - DNA, 15 bp, Homo sapiens
atctatttcaatgta

SEQ ID NO: 169386 - DNA, 15 bp, Homo sapiens
gatctatttcaatgt

SEQ ID NO: 169387 - DNA, 15 bp, Homo sapiens
ggatctatttcaatg

SEQ ID NO: 169388 - DNA, 15 bp, Homo sapiens
gggatctatttcaat

SEQ ID NO: 169389 - DNA, 15 bp, Homo sapiens
ggggatctatttcaa

SEQ ID NO: 169390 - DNA, 15 bp, Homo sapiens
aggggatctatttca

SEQ ID NO: 169391 - DNA, 15 bp, Homo sapiens
aaggggatctatttc

SEQ ID NO: 169392 - DNA, 15 bp, Homo sapiens
aaaggggatctattt

SEQ ID NO: 169393 - DNA, 15 bp, Homo sapiens
caaaggggatctatt

SEQ ID NO: 169394 - DNA, 15 bp, Homo sapiens
ccaaaggggatctat

SEQ ID NO: 169395 - DNA, 15 bp, Homo sapiens
tccaaaggggatcta

SEQ ID NO: 169396 - DNA, 15 bp, Homo sapiens
ttccaaaggggatct

SEQ ID NO: 169397 - DNA, 15 bp, Homo sapiens
gttccaaaggggatc

SEQ ID NO: 169398 - DNA, 15 bp, Homo sapiens
tgttccaaaggggat

SEQ ID NO: 169399 - DNA, 15 bp, Homo sapiens
gtgttccaaagggga

SEQ ID NO: 169400 - DNA, 15 bp, Homo sapiens
agtgttccaaagggg

SEQ ID NO: 169401 - DNA, 15 bp, Homo sapiens
cagtgttccaaaggg

SEQ ID NO: 169402 - DNA, 15 bp, Homo sapiens
ccagtgttccaaagg

SEQ ID NO: 169403 - DNA, 15 bp, Homo sapiens
cccagtgttccaaag

SEQ ID NO: 169404 - DNA, 15 bp, Homo sapiens
ccccagtgttccaaa

SEQ ID NO: 169405 - DNA, 15 bp, Homo sapiens
tccccagtgttccaa

SEQ ID NO: 169406 - DNA, 15 bp, Homo sapiens
ttccccagtgttcca

SEQ ID NO: 169407 - DNA, 15 bp, Homo sapiens
cttccccagtgttcc

SEQ ID NO: 169408 - DNA, 15 bp, Homo sapiens
tcttccccagtgttc

SEQ ID NO: 169409 - DNA, 15 bp, Homo sapiens
atcttccccagtgtt

SEQ ID NO: 169410 - DNA, 15 bp, Homo sapiens
aatcttccccagtgt

SEQ ID NO: 169411 - DNA, 15 bp, Homo sapiens
caatcttccccagtg

SEQ ID NO: 169412 - DNA, 15 bp, Homo sapiens
tcaatcttccccagt

SEQ ID NO: 169413 - DNA, 15 bp, Homo sapiens
ttcaatcttccccag

SEQ ID NO: 169414 - DNA, 15 bp, Homo sapiens
cttcaatcttcccca

SEQ ID NO: 169415 - DNA, 15 bp, Homo sapiens
tcttcaatcttcccc

SEQ ID NO: 169416 - DNA, 15 bp, Homo sapiens
atcttcaatcttccc

SEQ ID NO: 169417 - DNA, 15 bp, Homo sapiens
aatcttcaatcttcc

SEQ ID NO: 169418 - DNA, 15 bp, Homo sapiens
caatcttcaatcttc

SEQ ID NO: 169419 - DNA, 15 bp, Homo sapiens
gcaatcttcaatctt

SEQ ID NO: 169420 - DNA, 15 bp, Homo sapiens
agcaatcttcaatct

SEQ ID NO: 169421 - DNA, 15 bp, Homo sapiens
aagcaatcttcaatc

SEQ ID NO: 169422 - DNA, 15 bp, Homo sapiens
aaagcaatcttcaat

SEQ ID NO: 169423 - DNA, 15 bp, Homo sapiens
aaaagcaatcttcaa

SEQ ID NO: 169424 - DNA, 15 bp, Homo sapiens
taaaagcaatcttca

SEQ ID NO: 169425 - DNA, 15 bp, Homo sapiens
ttaaaagcaatcttc

SEQ ID NO: 169426 - DNA, 15 bp, Homo sapiens
attaaaagcaatctt

SEQ ID NO: 169427 - DNA, 15 bp, Homo sapiens
aattaaaagcaatct

SEQ ID NO: 169428 - DNA, 15 bp, Homo sapiens
aaattaaaagcaatc

SEQ ID NO: 169429 - DNA, 15 bp, Homo sapiens
gaaattaaaagcaat

SEQ ID NO: 169430 - DNA, 15 bp, Homo sapiens
tgaaattaaaagcaa

SEQ ID NO: 169431 - DNA, 15 bp, Homo sapiens
atgaaattaaaagca

SEQ ID NO: 169432 - DNA, 15 bp, Homo sapiens
aatgaaattaaaagc

SEQ ID NO: 169433 - DNA, 15 bp, Homo sapiens
taatgaaattaaaag

SEQ ID NO: 169434 - DNA, 15 bp, Homo sapiens
ataatgaaattaaaa

SEQ ID NO: 169435 - DNA, 15 bp, Homo sapiens
cataatgaaattaaa

SEQ ID NO: 169436 - DNA, 15 bp, Homo sapiens
ccataatgaaattaa

SEQ ID NO: 169437 - DNA, 15 bp, Homo sapiens
gccataatgaaatta

SEQ ID NO: 169438 - DNA, 15 bp, Homo sapiens
tgccataatgaaatt

SEQ ID NO: 169439 - DNA, 15 bp, Homo sapiens
gtgccataatgaaat

SEQ ID NO: 169440 - DNA, 15 bp, Homo sapiens
tgtgccataatgaaa

SEQ ID NO: 169441 - DNA, 15 bp, Homo sapiens
gtgtgccataatgaa

SEQ ID NO: 169442 - DNA, 15 bp, Homo sapiens
tgtgtgccataatga

SEQ ID NO: 169443 - DNA, 15 bp, Homo sapiens
ctgtgtgccataatg

SEQ ID NO: 169444 - DNA, 15 bp, Homo sapiens
tctgtgtgccataat

SEQ ID NO: 169445 - DNA, 15 bp, Homo sapiens
ttctgtgtgccataa

SEQ ID NO: 169446 - DNA, 15 bp, Homo sapiens
attctgtgtgccata

SEQ ID NO: 169447 - DNA, 15 bp, Homo sapiens
aattctgtgtgccat

SEQ ID NO: 169448 - DNA, 15 bp, Homo sapiens
aaattctgtgtgcca

SEQ ID NO: 169449 - DNA, 15 bp, Homo sapiens
taaattctgtgtgcc

SEQ ID NO: 169450 - DNA, 15 bp, Homo sapiens
ctaaattctgtgtgc

SEQ ID NO: 169451 - DNA, 15 bp, Homo sapiens
actaaattctgtgtg

SEQ ID NO: 169452 - DNA, 15 bp, Homo sapiens
cactaaattctgtgt

SEQ ID NO: 169453 - DNA, 15 bp, Homo sapiens
tcactaaattctgtg

SEQ ID NO: 169454 - DNA, 15 bp, Homo sapiens
ttcactaaattctgt

SEQ ID NO: 169455 - DNA, 15 bp, Homo sapiens
cttcactaaattctg

SEQ ID NO: 169456 - DNA, 15 bp, Homo sapiens
tcttcactaaattct

SEQ ID NO: 169457 - DNA, 15 bp, Homo sapiens
ttcttcactaaattc

SEQ ID NO: 169458 - DNA, 15 bp, Homo sapiens
tttcttcactaaatt

SEQ ID NO: 169459 - DNA, 15 bp, Homo sapiens
ttttcttcactaaat

SEQ ID NO: 169460 - DNA, 15 bp, Homo sapiens
tttttcttcactaaa

SEQ ID NO: 169461 - DNA, 15 bp, Homo sapiens
atttttcttcactaa

SEQ ID NO: 169462 - DNA, 15 bp, Homo sapiens
catttttcttcacta

SEQ ID NO: 169463 - DNA, 15 bp, Homo sapiens
ccatttttcttcact

SEQ ID NO: 169464 - DNA, 15 bp, Homo sapiens
accatttttcttcac

SEQ ID NO: 169465 - DNA, 15 bp, Homo sapiens
taccatttttcttca

SEQ ID NO: 169466 - DNA, 15 bp, Homo sapiens
ctaccatttttcttc

SEQ ID NO: 169467 - DNA, 15 bp, Homo sapiens
actaccatttttctt

SEQ ID NO: 169468 - DNA, 15 bp, Homo sapiens
gactaccatttttct

SEQ ID NO: 169469 - DNA, 15 bp, Homo sapiens
ggactaccatttttc

SEQ ID NO: 169470 - DNA, 15 bp, Homo sapiens
aggactaccattttt

SEQ ID NO: 169471 - DNA, 15 bp, Homo sapiens
gaggactaccatttt

SEQ ID NO: 169472 - DNA, 15 bp, Homo sapiens
agaggactaccattt

SEQ ID NO: 169473 - DNA, 15 bp, Homo sapiens
aagaggactaccatt

SEQ ID NO: 169474 - DNA, 15 bp, Homo sapiens
aaagaggactaccat

SEQ ID NO: 169475 - DNA, 15 bp, Homo sapiens
gaaagaggactacca

SEQ ID NO: 169476 - DNA, 15 bp, Homo sapiens
tgaaagaggactacc

SEQ ID NO: 169477 - DNA, 15 bp, Homo sapiens
ctgaaagaggactac

SEQ ID NO: 169478 - DNA, 15 bp, Homo sapiens
tctgaaagaggacta

SEQ ID NO: 169479 - DNA, 15 bp, Homo sapiens
atctgaaagaggact

SEQ ID NO: 169480 - DNA, 15 bp, Homo sapiens
tatctgaaagaggac

SEQ ID NO: 169481 - DNA, 15 bp, Homo sapiens
ctatctgaaagagga

SEQ ID NO: 169482 - DNA, 15 bp, Homo sapiens
tctatctgaaagagg

SEQ ID NO: 169483 - DNA, 15 bp, Homo sapiens
atctatctgaaagag

SEQ ID NO: 169484 - DNA, 15 bp, Homo sapiens
aatctatctgaaaga

SEQ ID NO: 169485 - DNA, 15 bp, Homo sapiens
taatctatctgaaag

SEQ ID NO: 169486 - DNA, 15 bp, Homo sapiens
gtaatctatctgaaa

SEQ ID NO: 169487 - DNA, 15 bp, Homo sapiens
agtaatctatctgaa

SEQ ID NO: 169488 - DNA, 15 bp, Homo sapiens
tagtaatctatctga

SEQ ID NO: 169489 - DNA, 15 bp, Homo sapiens
ttagtaatctatctg

SEQ ID NO: 169490 - DNA, 15 bp, Homo sapiens
cttagtaatctatct

SEQ ID NO: 169491 - DNA, 15 bp, Homo sapiens
acttagtaatctatc

SEQ ID NO: 169492 - DNA, 15 bp, Homo sapiens
gacttagtaatctat

SEQ ID NO: 169493 - DNA, 15 bp, Homo sapiens
tgacttagtaatcta

SEQ ID NO: 169494 - DNA, 15 bp, Homo sapiens
ctgacttagtaatct

SEQ ID NO: 169495 - DNA, 15 bp, Homo sapiens
gctgacttagtaatc

SEQ ID NO: 169496 - DNA, 15 bp, Homo sapiens
agctgacttagtaat

SEQ ID NO: 169497 - DNA, 15 bp, Homo sapiens
cagctgacttagtaa

SEQ ID NO: 169498 - DNA, 15 bp, Homo sapiens
acagctgacttagta

SEQ ID NO: 169499 - DNA, 15 bp, Homo sapiens
aacagctgacttagt

SEQ ID NO: 169500 - DNA, 15 bp, Homo sapiens
aaacagctgacttag

SEQ ID NO: 169501 - DNA, 15 bp, Homo sapiens
caaacagctgactta

SEQ ID NO: 169502 - DNA, 15 bp, Homo sapiens
ccaaacagctgactt

SEQ ID NO: 169503 - DNA, 15 bp, Homo sapiens
tccaaacagctgact

SEQ ID NO: 169504 - DNA, 15 bp, Homo sapiens
ttccaaacagctgac

SEQ ID NO: 169505 - DNA, 15 bp, Homo sapiens
cttccaaacagctga

SEQ ID NO: 169506 - DNA, 15 bp, Homo sapiens
acttccaaacagctg

SEQ ID NO: 169507 - DNA, 15 bp, Homo sapiens
gacttccaaacagct

SEQ ID NO: 169508 - DNA, 15 bp, Homo sapiens
agacttccaaacagc

SEQ ID NO: 169509 - DNA, 15 bp, Homo sapiens
aagacttccaaacag

SEQ ID NO: 169510 - DNA, 15 bp, Homo sapiens
caagacttccaaaca

SEQ ID NO: 169511 - DNA, 15 bp, Homo sapiens
ccaagacttccaaac

SEQ ID NO: 169512 - DNA, 15 bp, Homo sapiens
accaagacttccaaa

SEQ ID NO: 169513 - DNA, 15 bp, Homo sapiens
caccaagacttccaa

SEQ ID NO: 169514 - DNA, 15 bp, Homo sapiens
acaccaagacttcca

SEQ ID NO: 169515 - DNA, 15 bp, Homo sapiens
tacaccaagacttcc

SEQ ID NO: 169516 - DNA, 15 bp, Homo sapiens
ttacaccaagacttc

SEQ ID NO: 169517 - DNA, 15 bp, Homo sapiens
tttacaccaagactt

SEQ ID NO: 169518 - DNA, 15 bp, Homo sapiens
ttttacaccaagact

SEQ ID NO: 169519 - DNA, 15 bp, Homo sapiens
tttttacaccaagac

SEQ ID NO: 169520 - DNA, 15 bp, Homo sapiens
atttttacaccaaga

SEQ ID NO: 169521 - DNA, 15 bp, Homo sapiens
catttttacaccaag

SEQ ID NO: 169522 - DNA, 15 bp, Homo sapiens
acatttttacaccaa

SEQ ID NO: 169523 - DNA, 15 bp, Homo sapiens
gacatttttacacca

SEQ ID NO: 169524 - DNA, 15 bp, Homo sapiens
agacatttttacacc

SEQ ID NO: 169525 - DNA, 15 bp, Homo sapiens
aagacatttttacac

SEQ ID NO: 169526 - DNA, 15 bp, Homo sapiens
taagacatttttaca

SEQ ID NO: 169527 - DNA, 15 bp, Homo sapiens
ctaagacatttttac

SEQ ID NO: 169528 - DNA, 15 bp, Homo sapiens
tctaagacattttta

SEQ ID NO: 169529 - DNA, 15 bp, Homo sapiens
ctctaagacattttt

SEQ ID NO: 169530 - DNA, 15 bp, Homo sapiens
gctctaagacatttt

SEQ ID NO: 169531 - DNA, 15 bp, Homo sapiens
agctctaagacattt

SEQ ID NO: 169532 - DNA, 15 bp, Homo sapiens
aagctctaagacatt

SEQ ID NO: 169533 - DNA, 15 bp, Homo sapiens
aaagctctaagacat

SEQ ID NO: 169534 - DNA, 15 bp, Homo sapiens
caaagctctaagaca

SEQ ID NO: 169535 - DNA, 15 bp, Homo sapiens
gcaaagctctaagac

SEQ ID NO: 169536 - DNA, 15 bp, Homo sapiens
tgcaaagctctaaga

SEQ ID NO: 169537 - DNA, 15 bp, Homo sapiens
ttgcaaagctctaag

SEQ ID NO: 169538 - DNA, 15 bp, Homo sapiens
cttgcaaagctctaa

SEQ ID NO: 169539 - DNA, 15 bp, Homo sapiens
acttgcaaagctcta

SEQ ID NO: 169540 - DNA, 15 bp, Homo sapiens
aacttgcaaagctct

SEQ ID NO: 169541 - DNA, 15 bp, Homo sapiens
taacttgcaaagctc

SEQ ID NO: 169542 - DNA, 15 bp, Homo sapiens
gtaacttgcaaagct

SEQ ID NO: 169543 - DNA, 15 bp, Homo sapiens
tgtaacttgcaaagc

SEQ ID NO: 169544 - DNA, 15 bp, Homo sapiens
ctgtaacttgcaaag

SEQ ID NO: 169545 - DNA, 15 bp, Homo sapiens
tctgtaacttgcaaa

SEQ ID NO: 169546 - DNA, 15 bp, Homo sapiens
ctctgtaacttgcaa

SEQ ID NO: 169547 - DNA, 15 bp, Homo sapiens
tctctgtaacttgca

SEQ ID NO: 169548 - DNA, 15 bp, Homo sapiens
atctctgtaacttgc

SEQ ID NO: 169549 - DNA, 15 bp, Homo sapiens
tatctctgtaacttg

SEQ ID NO: 169550 - DNA, 15 bp, Homo sapiens
ctatctctgtaactt

SEQ ID NO: 169551 - DNA, 15 bp, Homo sapiens
tctatctctgtaact

SEQ ID NO: 169552 - DNA, 15 bp, Homo sapiens
ttctatctctgtaac

SEQ ID NO: 169553 - DNA, 15 bp, Homo sapiens
tttctatctctgtaa

SEQ ID NO: 169554 - DNA, 15 bp, Homo sapiens
ttttctatctctgta

SEQ ID NO: 169555 - DNA, 15 bp, Homo sapiens
attttctatctctgt

SEQ ID NO: 169556 - DNA, 15 bp, Homo sapiens
cattttctatctctg

SEQ ID NO: 169557 - DNA, 15 bp, Homo sapiens
acattttctatctct

SEQ ID NO: 169558 - DNA, 15 bp, Homo sapiens
tacattttctatctc

SEQ ID NO: 169559 - DNA, 15 bp, Homo sapiens
atacattttctatct

SEQ ID NO: 169560 - DNA, 15 bp, Homo sapiens
aatacattttctatc

SEQ ID NO: 169561 - DNA, 15 bp, Homo sapiens
aaatacattttctat

SEQ ID NO: 169562 - DNA, 15 bp, Homo sapiens
taaatacattttcta

SEQ ID NO: 169563 - DNA, 15 bp, Homo sapiens
ttaaatacattttct

SEQ ID NO: 169564 - DNA, 15 bp, Homo sapiens
attaaatacattttc

SEQ ID NO: 169565 - DNA, 15 bp, Homo sapiens
aattaaatacatttt

SEQ ID NO: 169566 - DNA, 15 bp, Homo sapiens
aaattaaatacattt

SEQ ID NO: 169567 - DNA, 15 bp, Homo sapiens
aaaattaaatacatt

SEQ ID NO: 169568 - DNA, 15 bp, Homo sapiens
taaaattaaatacat

SEQ ID NO: 169569 - DNA, 15 bp, Homo sapiens
ttaaaattaaataca

SEQ ID NO: 169570 - DNA, 15 bp, Homo sapiens
attaaaattaaatac

SEQ ID NO: 169571 - DNA, 15 bp, Homo sapiens
tattaaaattaaata

SEQ ID NO: 169572 - DNA, 15 bp, Homo sapiens
atattaaaattaaat

SEQ ID NO: 169573 - DNA, 15 bp, Homo sapiens
aatattaaaattaaa

SEQ ID NO: 169574 - DNA, 15 bp, Homo sapiens
aaatattaaaattaa

SEQ ID NO: 169575 - DNA, 15 bp, Homo sapiens
gaaatattaaaatta

SEQ ID NO: 169576 - DNA, 15 bp, Homo sapiens
agaaatattaaaatt

SEQ ID NO: 169577 - DNA, 15 bp, Homo sapiens
tagaaatattaaaat

SEQ ID NO: 169578 - DNA, 15 bp, Homo sapiens
ttagaaatattaaaa

SEQ ID NO: 169579 - DNA, 15 bp, Homo sapiens
attagaaatattaaa

SEQ ID NO: 169580 - DNA, 15 bp, Homo sapiens
aattagaaatattaa

SEQ ID NO: 169581 - DNA, 15 bp, Homo sapiens
gaattagaaatatta

SEQ ID NO: 169582 - DNA, 15 bp, Homo sapiens
tgaattagaaatatt

SEQ ID NO: 169583 - DNA, 15 bp, Homo sapiens
gtgaattagaaatat

SEQ ID NO: 169584 - DNA, 15 bp, Homo sapiens
agtgaattagaaata

SEQ ID NO: 169585 - DNA, 15 bp, Homo sapiens
tagtgaattagaaat

SEQ ID NO: 169586 - DNA, 15 bp, Homo sapiens
atagtgaattagaaa

SEQ ID NO: 169587 - DNA, 15 bp, Homo sapiens
aatagtgaattagaa

SEQ ID NO: 169588 - DNA, 15 bp, Homo sapiens
aaatagtgaattaga

SEQ ID NO: 169589 - DNA, 15 bp, Homo sapiens
caaatagtgaattag

SEQ ID NO: 169590 - DNA, 15 bp, Homo sapiens
gcaaatagtgaatta

SEQ ID NO: 169591 - DNA, 15 bp, Homo sapiens
agcaaatagtgaatt

SEQ ID NO: 169592 - DNA, 15 bp, Homo sapiens
aagcaaatagtgaat

SEQ ID NO: 169593 - DNA, 15 bp, Homo sapiens
aaagcaaatagtgaa

SEQ ID NO: 169594 - DNA, 15 bp, Homo sapiens
caaagcaaatagtga

SEQ ID NO: 169595 - DNA, 15 bp, Homo sapiens
acaaagcaaatagtg

SEQ ID NO: 169596 - DNA, 15 bp, Homo sapiens
aacaaagcaaatagt

SEQ ID NO: 169597 - DNA, 15 bp, Homo sapiens
taacaaagcaaatag

SEQ ID NO: 169598 - DNA, 15 bp, Homo sapiens
ctaacaaagcaaata

SEQ ID NO: 169599 - DNA, 15 bp, Homo sapiens
actaacaaagcaaat

SEQ ID NO: 169600 - DNA, 15 bp, Homo sapiens
tactaacaaagcaaa

SEQ ID NO: 169601 - DNA, 15 bp, Homo sapiens
atactaacaaagcaa

SEQ ID NO: 169602 - DNA, 15 bp, Homo sapiens
aatactaacaaagca

SEQ ID NO: 169603 - DNA, 15 bp, Homo sapiens
aaatactaacaaagc

SEQ ID NO: 169604 - DNA, 15 bp, Homo sapiens
taaatactaacaaag

SEQ ID NO: 169605 - DNA, 15 bp, Homo sapiens
ctaaatactaacaaa

SEQ ID NO: 169606 - DNA, 15 bp, Homo sapiens
tctaaatactaacaa

SEQ ID NO: 169607 - DNA, 15 bp, Homo sapiens
atctaaatactaaca

SEQ ID NO: 169608 - DNA, 15 bp, Homo sapiens
aatctaaatactaac

SEQ ID NO: 169609 - DNA, 15 bp, Homo sapiens
aaatctaaatactaa

SEQ ID NO: 169610 - DNA, 15 bp, Homo sapiens
gaaatctaaatacta

SEQ ID NO: 169611 - DNA, 15 bp, Homo sapiens
tgaaatctaaatact

SEQ ID NO: 169612 - DNA, 15 bp, Homo sapiens
ctgaaatctaaatac

SEQ ID NO: 169613 - DNA, 15 bp, Homo sapiens
actgaaatctaaata

SEQ ID NO: 169614 - DNA, 15 bp, Homo sapiens
cactgaaatctaaat

SEQ ID NO: 169615 - DNA, 15 bp, Homo sapiens
gcactgaaatctaaa

SEQ ID NO: 169616 - DNA, 15 bp, Homo sapiens
agcactgaaatctaa

SEQ ID NO: 169617 - DNA, 15 bp, Homo sapiens
aagcactgaaatcta

SEQ ID NO: 169618 - DNA, 15 bp, Homo sapiens
taagcactgaaatct

SEQ ID NO: 169619 - DNA, 15 bp, Homo sapiens
ttaagcactgaaatc

SEQ ID NO: 169620 - DNA, 15 bp, Homo sapiens
tttaagcactgaaat

SEQ ID NO: 169621 - DNA, 15 bp, Homo sapiens
ttttaagcactgaaa

SEQ ID NO: 169622 - DNA, 15 bp, Homo sapiens
tttttaagcactgaa

SEQ ID NO: 169623 - DNA, 15 bp, Homo sapiens
ttttttaagcactga

SEQ ID NO: 169624 - DNA, 15 bp, Homo sapiens
attttttaagcactg

SEQ ID NO: 169625 - DNA, 15 bp, Homo sapiens
aattttttaagcact

SEQ ID NO: 169626 - DNA, 15 bp, Homo sapiens
taattttttaagcac

SEQ ID NO: 169627 - DNA, 15 bp, Homo sapiens
ataattttttaagca

SEQ ID NO: 169628 - DNA, 15 bp, Homo sapiens
aataattttttaagc

SEQ ID NO: 169629 - DNA, 15 bp, Homo sapiens
gaataattttttaag

SEQ ID NO: 169630 - DNA, 15 bp, Homo sapiens
tgaataattttttaa

SEQ ID NO: 169631 - DNA, 15 bp, Homo sapiens
gtgaataatttttta

SEQ ID NO: 169632 - DNA, 15 bp, Homo sapiens
cgtgaataatttttt

SEQ ID NO: 169633 - DNA, 15 bp, Homo sapiens
ccgtgaataattttt

SEQ ID NO: 169634 - DNA, 15 bp, Homo sapiens
cccgtgaataatttt

SEQ ID NO: 169635 - DNA, 15 bp, Homo sapiens
tcccgtgaataattt

SEQ ID NO: 169636 - DNA, 15 bp, Homo sapiens
atcccgtgaataatt

SEQ ID NO: 169637 - DNA, 15 bp, Homo sapiens
aatcccgtgaataat

SEQ ID NO: 169638 - DNA, 15 bp, Homo sapiens
aaatcccgtgaataa

SEQ ID NO: 169639 - DNA, 15 bp, Homo sapiens
aaaatcccgtgaata

SEQ ID NO: 169640 - DNA, 15 bp, Homo sapiens
aaaaatcccgtgaat

SEQ ID NO: 169641 - DNA, 15 bp, Homo sapiens
aaaaaatcccgtgaa

SEQ ID NO: 169642 - DNA, 15 bp, Homo sapiens
gaaaaaatcccgtga

SEQ ID NO: 169643 - DNA, 15 bp, Homo sapiens
ggaaaaaatcccgtg

SEQ ID NO: 169644 - DNA, 15 bp, Homo sapiens
gggaaaaaatcccgt

SEQ ID NO: 169645 - DNA, 15 bp, Homo sapiens
agggaaaaaatcccg

SEQ ID NO: 169646 - DNA, 15 bp, Homo sapiens
aagggaaaaaatccc

SEQ ID NO: 169647 - DNA, 15 bp, Homo sapiens
gaagggaaaaaatcc

SEQ ID NO: 169648 - DNA, 15 bp, Homo sapiens
tgaagggaaaaaatc

SEQ ID NO: 169649 - DNA, 15 bp, Homo sapiens
atgaagggaaaaaat

SEQ ID NO: 169650 - DNA, 15 bp, Homo sapiens
aatgaagggaaaaaa

SEQ ID NO: 169651 - DNA, 15 bp, Homo sapiens
gaatgaagggaaaaa

SEQ ID NO: 169652 - DNA, 15 bp, Homo sapiens
tgaatgaagggaaaa

SEQ ID NO: 169653 - DNA, 15 bp, Homo sapiens
ttgaatgaagggaaa

SEQ ID NO: 169654 - DNA, 15 bp, Homo sapiens
gttgaatgaagggaa

SEQ ID NO: 169655 - DNA, 15 bp, Homo sapiens
tgttgaatgaaggga

SEQ ID NO: 169656 - DNA, 15 bp, Homo sapiens
ttgttgaatgaaggg

SEQ ID NO: 169657 - DNA, 15 bp, Homo sapiens
gttgttgaatgaagg

SEQ ID NO: 169658 - DNA, 15 bp, Homo sapiens
tgttgttgaatgaag

SEQ ID NO: 169659 - DNA, 15 bp, Homo sapiens
ctgttgttgaatgaa

SEQ ID NO: 169660 - DNA, 15 bp, Homo sapiens
cctgttgttgaatga

SEQ ID NO: 169661 - DNA, 15 bp, Homo sapiens
acctgttgttgaatg

SEQ ID NO: 169662 - DNA, 15 bp, Homo sapiens
aacctgttgttgaat

SEQ ID NO: 169663 - DNA, 15 bp, Homo sapiens
gaacctgttgttgaa

SEQ ID NO: 169664 - DNA, 15 bp, Homo sapiens
agaacctgttgttga

SEQ ID NO: 169665 - DNA, 15 bp, Homo sapiens
tagaacctgttgttg

SEQ ID NO: 169666 - DNA, 15 bp, Homo sapiens
atagaacctgttgtt

SEQ ID NO: 169667 - DNA, 15 bp, Homo sapiens
tatagaacctgttgt

SEQ ID NO: 169668 - DNA, 15 bp, Homo sapiens
ctatagaacctgttg

SEQ ID NO: 169669 - DNA, 15 bp, Homo sapiens
gctatagaacctgtt

SEQ ID NO: 169670 - DNA, 15 bp, Homo sapiens
tgctatagaacctgt

SEQ ID NO: 169671 - DNA, 15 bp, Homo sapiens
gtgctatagaacctg

SEQ ID NO: 169672 - DNA, 15 bp, Homo sapiens
tgtgctatagaacct

SEQ ID NO: 169673 - DNA, 15 bp, Homo sapiens
atgtgctatagaacc

SEQ ID NO: 169674 - DNA, 15 bp, Homo sapiens
gatgtgctatagaac

SEQ ID NO: 169675 - DNA, 15 bp, Homo sapiens
agatgtgctatagaa

SEQ ID NO: 169676 - DNA, 15 bp, Homo sapiens
aagatgtgctataga

SEQ ID NO: 169677 - DNA, 15 bp, Homo sapiens
caagatgtgctatag

SEQ ID NO: 169678 - DNA, 15 bp, Homo sapiens
ccaagatgtgctata

SEQ ID NO: 169679 - DNA, 15 bp, Homo sapiens
cccaagatgtgctat

SEQ ID NO: 169680 - DNA, 15 bp, Homo sapiens
tcccaagatgtgcta

SEQ ID NO: 169681 - DNA, 15 bp, Homo sapiens
ttcccaagatgtgct

SEQ ID NO: 169682 - DNA, 15 bp, Homo sapiens
tttcccaagatgtgc

SEQ ID NO: 169683 - DNA, 15 bp, Homo sapiens
ttttcccaagatgtg

SEQ ID NO: 169684 - DNA, 15 bp, Homo sapiens
attttcccaagatgt

SEQ ID NO: 169685 - DNA, 15 bp, Homo sapiens
aattttcccaagatg

SEQ ID NO: 169686 - DNA, 15 bp, Homo sapiens
taattttcccaagat

SEQ ID NO: 169687 - DNA, 15 bp, Homo sapiens
ataattttcccaaga

SEQ ID NO: 169688 - DNA, 15 bp, Homo sapiens
gataattttcccaag

SEQ ID NO: 169689 - DNA, 15 bp, Homo sapiens
ggataattttcccaa

SEQ ID NO: 169690 - DNA, 15 bp, Homo sapiens
aggataattttccca

SEQ ID NO: 169691 - DNA, 15 bp, Homo sapiens
caggataattttccc

SEQ ID NO: 169692 - DNA, 15 bp, Homo sapiens
gcaggataattttcc

SEQ ID NO: 169693 - DNA, 15 bp, Homo sapiens
tgcaggataattttc

SEQ ID NO: 169694 - DNA, 15 bp, Homo sapiens
atgcaggataatttt

SEQ ID NO: 169695 - DNA, 15 bp, Homo sapiens
aatgcaggataattt

SEQ ID NO: 169696 - DNA, 15 bp, Homo sapiens
caatgcaggataatt

SEQ ID NO: 169697 - DNA, 15 bp, Homo sapiens
ccaatgcaggataat

SEQ ID NO: 169698 - DNA, 15 bp, Homo sapiens
accaatgcaggataa

SEQ ID NO: 169699 - DNA, 15 bp, Homo sapiens
taccaatgcaggata

SEQ ID NO: 169700 - DNA, 15 bp, Homo sapiens
ctaccaatgcaggat

SEQ ID NO: 169701 - DNA, 15 bp, Homo sapiens
cctaccaatgcagga

SEQ ID NO: 169702 - DNA, 15 bp, Homo sapiens
ccctaccaatgcagg

SEQ ID NO: 169703 - DNA, 15 bp, Homo sapiens
cccctaccaatgcag

SEQ ID NO: 169704 - DNA, 15 bp, Homo sapiens
tcccctaccaatgca

SEQ ID NO: 169705 - DNA, 15 bp, Homo sapiens
gtcccctaccaatgc

SEQ ID NO: 169706 - DNA, 15 bp, Homo sapiens
agtcccctaccaatg

SEQ ID NO: 169707 - DNA, 15 bp, Homo sapiens
cagtcccctaccaat

SEQ ID NO: 169708 - DNA, 15 bp, Homo sapiens
tcagtcccctaccaa

SEQ ID NO: 169709 - DNA, 15 bp, Homo sapiens
ttcagtcccctacca

SEQ ID NO: 169710 - DNA, 15 bp, Homo sapiens
tttcagtcccctacc

SEQ ID NO: 169711 - DNA, 15 bp, Homo sapiens
ctttcagtcccctac

SEQ ID NO: 169712 - DNA, 15 bp, Homo sapiens
tctttcagtccccta

SEQ ID NO: 169713 - DNA, 15 bp, Homo sapiens
gtctttcagtcccct

SEQ ID NO: 169714 - DNA, 15 bp, Homo sapiens
tgtctttcagtcccc

SEQ ID NO: 169715 - DNA, 15 bp, Homo sapiens
ctgtctttcagtccc

SEQ ID NO: 169716 - DNA, 15 bp, Homo sapiens
cctgtctttcagtcc

SEQ ID NO: 169717 - DNA, 15 bp, Homo sapiens
tcctgtctttcagtc

SEQ ID NO: 169718 - DNA, 15 bp, Homo sapiens
ttcctgtctttcagt

SEQ ID NO: 169719 - DNA, 15 bp, Homo sapiens
cttcctgtctttcag

SEQ ID NO: 169720 - DNA, 15 bp, Homo sapiens
tcttcctgtctttca

SEQ ID NO: 169721 - DNA, 15 bp, Homo sapiens
atcttcctgtctttc

SEQ ID NO: 169722 - DNA, 15 bp, Homo sapiens
catcttcctgtcttt

SEQ ID NO: 169723 - DNA, 15 bp, Homo sapiens
tcatcttcctgtctt

SEQ ID NO: 169724 - DNA, 15 bp, Homo sapiens
ttcatcttcctgtct

SEQ ID NO: 169725 - DNA, 15 bp, Homo sapiens
tttcatcttcctgtc

SEQ ID NO: 169726 - DNA, 15 bp, Homo sapiens
ttttcatcttcctgt

SEQ ID NO: 169727 - DNA, 15 bp, Homo sapiens
tttttcatcttcctg

SEQ ID NO: 169728 - DNA, 15 bp, Homo sapiens
atttttcatcttcct

SEQ ID NO: 169729 - DNA, 15 bp, Homo sapiens
tatttttcatcttcc

SEQ ID NO: 169730 - DNA, 15 bp, Homo sapiens
gtatttttcatcttc

SEQ ID NO: 169731 - DNA, 15 bp, Homo sapiens
tgtatttttcatctt

SEQ ID NO: 169732 - DNA, 15 bp, Homo sapiens
atgtatttttcatct

SEQ ID NO: 169733 - DNA, 15 bp, Homo sapiens
catgtatttttcatc

SEQ ID NO: 169734 - DNA, 15 bp, Homo sapiens
tcatgtatttttcat

SEQ ID NO: 169735 - DNA, 15 bp, Homo sapiens
atcatgtatttttca

SEQ ID NO: 169736 - DNA, 15 bp, Homo sapiens
tatcatgtatttttc

SEQ ID NO: 169737 - DNA, 15 bp, Homo sapiens
gtatcatgtattttt

SEQ ID NO: 169738 - DNA, 15 bp, Homo sapiens
ggtatcatgtatttt

SEQ ID NO: 169739 - DNA, 15 bp, Homo sapiens
aggtatcatgtattt

SEQ ID NO: 169740 - DNA, 15 bp, Homo sapiens
aaggtatcatgtatt

SEQ ID NO: 169741 - DNA, 15 bp, Homo sapiens
aaaggtatcatgtat

SEQ ID NO: 169742 - DNA, 15 bp, Homo sapiens
taaaggtatcatgta

SEQ ID NO: 169743 - DNA, 15 bp, Homo sapiens
ttaaaggtatcatgt

SEQ ID NO: 169744 - DNA, 15 bp, Homo sapiens
attaaaggtatcatg

SEQ ID NO: 169745 - DNA, 15 bp, Homo sapiens
tattaaaggtatcat

SEQ ID NO: 169746 - DNA, 15 bp, Homo sapiens
ttattaaaggtatca

SEQ ID NO: 169747 - DNA, 15 bp, Homo sapiens
attattaaaggtatc

SEQ ID NO: 169748 - DNA, 15 bp, Homo sapiens
aattattaaaggtat

SEQ ID NO: 169749 - DNA, 15 bp, Homo sapiens
aaattattaaaggta

SEQ ID NO: 169750 - DNA, 15 bp, Homo sapiens
aaaattattaaaggt

SEQ ID NO: 169751 - DNA, 15 bp, Homo sapiens
aaaaattattaaagg

SEQ ID NO: 169752 - DNA, 15 bp, Homo sapiens
caaaaattattaaag

SEQ ID NO: 169753 - DNA, 15 bp, Homo sapiens
tcaaaaattattaaa

SEQ ID NO: 169754 - DNA, 15 bp, Homo sapiens
ttcaaaaattattaa

SEQ ID NO: 169755 - DNA, 15 bp, Homo sapiens
attcaaaaattatta

SEQ ID NO: 169756 - DNA, 15 bp, Homo sapiens
aattcaaaaattatt

SEQ ID NO: 169757 - DNA, 15 bp, Homo sapiens
aaattcaaaaattat

SEQ ID NO: 169758 - DNA, 15 bp, Homo sapiens
aaaattcaaaaatta

SEQ ID NO: 169759 - DNA, 15 bp, Homo sapiens
caaaattcaaaaatt

SEQ ID NO: 169760 - DNA, 15 bp, Homo sapiens
tcaaaattcaaaaat

SEQ ID NO: 169761 - DNA, 15 bp, Homo sapiens
ttcaaaattcaaaaa

SEQ ID NO: 169762 - DNA, 15 bp, Homo sapiens
attcaaaattcaaaa

SEQ ID NO: 169763 - DNA, 15 bp, Homo sapiens
aattcaaaattcaaa

SEQ ID NO: 169764 - DNA, 15 bp, Homo sapiens
aaattcaaaattcaa

SEQ ID NO: 169765 - DNA, 15 bp, Homo sapiens
aaaattcaaaattca

SEQ ID NO: 169766 - DNA, 15 bp, Homo sapiens
caaaattcaaaattc

SEQ ID NO: 169767 - DNA, 15 bp, Homo sapiens
ccaaaattcaaaatt

SEQ ID NO: 169768 - DNA, 15 bp, Homo sapiens
tccaaaattcaaaat

SEQ ID NO: 169769 - DNA, 15 bp, Homo sapiens
ttccaaaattcaaaa

SEQ ID NO: 169770 - DNA, 15 bp, Homo sapiens
attccaaaattcaaa

SEQ ID NO: 169771 - DNA, 15 bp, Homo sapiens
aattccaaaattcaa

SEQ ID NO: 169772 - DNA, 15 bp, Homo sapiens
aaattccaaaattca

SEQ ID NO: 169773 - DNA, 15 bp, Homo sapiens
aaaattccaaaattc

SEQ ID NO: 169774 - DNA, 15 bp, Homo sapiens
taaaattccaaaatt

SEQ ID NO: 169775 - DNA, 15 bp, Homo sapiens
ctaaaattccaaaat

SEQ ID NO: 169776 - DNA, 15 bp, Homo sapiens
tctaaaattccaaaa

SEQ ID NO: 169777 - DNA, 15 bp, Homo sapiens
ctctaaaattccaaa

SEQ ID NO: 169778 - DNA, 15 bp, Homo sapiens
cctctaaaattccaa

SEQ ID NO: 169779 - DNA, 15 bp, Homo sapiens
ccctctaaaattcca

SEQ ID NO: 169780 - DNA, 15 bp, Homo sapiens
gccctctaaaattcc

SEQ ID NO: 169781 - DNA, 15 bp, Homo sapiens
tgccctctaaaattc

SEQ ID NO: 169782 - DNA, 15 bp, Homo sapiens
ctgccctctaaaatt

SEQ ID NO: 169783 - DNA, 15 bp, Homo sapiens
tctgccctctaaaat

SEQ ID NO: 169784 - DNA, 15 bp, Homo sapiens
atctgccctctaaaa

SEQ ID NO: 169785 - DNA, 15 bp, Homo sapiens
tatctgccctctaaa

SEQ ID NO: 169786 - DNA, 15 bp, Homo sapiens
ttatctgccctctaa

SEQ ID NO: 169787 - DNA, 15 bp, Homo sapiens
tttatctgccctcta

SEQ ID NO: 169788 - DNA, 15 bp, Homo sapiens
ttttatctgccctct

SEQ ID NO: 169789 - DNA, 15 bp, Homo sapiens
gttttatctgccctc

SEQ ID NO: 169790 - DNA, 15 bp, Homo sapiens
agttttatctgccct

SEQ ID NO: 169791 - DNA, 15 bp, Homo sapiens
tagttttatctgccc

SEQ ID NO: 169792 - DNA, 15 bp, Homo sapiens
atagttttatctgcc

SEQ ID NO: 169793 - DNA, 15 bp, Homo sapiens
tatagttttatctgc

SEQ ID NO: 169794 - DNA, 15 bp, Homo sapiens
atatagttttatctg

SEQ ID NO: 169795 - DNA, 15 bp, Homo sapiens
gatatagttttatct

SEQ ID NO: 169796 - DNA, 15 bp, Homo sapiens
agatatagttttatc

SEQ ID NO: 169797 - DNA, 15 bp, Homo sapiens
gagatatagttttat

SEQ ID NO: 169798 - DNA, 15 bp, Homo sapiens
agagatatagtttta

SEQ ID NO: 169799 - DNA, 15 bp, Homo sapiens
cagagatatagtttt

SEQ ID NO: 169800 - DNA, 15 bp, Homo sapiens
ccagagatatagttt

SEQ ID NO: 169801 - DNA, 15 bp, Homo sapiens
cccagagatatagtt

SEQ ID NO: 169802 - DNA, 15 bp, Homo sapiens
ccccagagatatagt

SEQ ID NO: 169803 - DNA, 15 bp, Homo sapiens
gccccagagatatag

SEQ ID NO: 169804 - DNA, 15 bp, Homo sapiens
tgccccagagatata

SEQ ID NO: 169805 - DNA, 15 bp, Homo sapiens
ttgccccagagatat

SEQ ID NO: 169806 - DNA, 15 bp, Homo sapiens
attgccccagagata

SEQ ID NO: 169807 - DNA, 15 bp, Homo sapiens
tattgccccagagat

SEQ ID NO: 169808 - DNA, 15 bp, Homo sapiens
ttattgccccagaga

SEQ ID NO: 169809 - DNA, 15 bp, Homo sapiens
tttattgccccagag

SEQ ID NO: 169810 - DNA, 15 bp, Homo sapiens
ttttattgccccaga

SEQ ID NO: 169811 - DNA, 15 bp, Homo sapiens
cttttattgccccag

SEQ ID NO: 169812 - DNA, 15 bp, Homo sapiens
tcttttattgcccca

SEQ ID NO: 169813 - DNA, 15 bp, Homo sapiens
ttcttttattgcccc

SEQ ID NO: 169814 - DNA, 15 bp, Homo sapiens
cttcttttattgccc

SEQ ID NO: 169815 - DNA, 15 bp, Homo sapiens
tcttcttttattgcc

SEQ ID NO: 169816 - DNA, 15 bp, Homo sapiens
gtcttcttttattgc

SEQ ID NO: 169817 - DNA, 15 bp, Homo sapiens
tgtcttcttttattg

SEQ ID NO: 169818 - DNA, 15 bp, Homo sapiens
ttgtcttcttttatt

SEQ ID NO: 169819 - DNA, 15 bp, Homo sapiens
cttgtcttcttttat

SEQ ID NO: 169820 - DNA, 15 bp, Homo sapiens
acttgtcttctttta

SEQ ID NO: 169821 - DNA, 15 bp, Homo sapiens
tacttgtcttctttt

SEQ ID NO: 169822 - DNA, 15 bp, Homo sapiens
ctacttgtcttcttt

SEQ ID NO: 169823 - DNA, 15 bp, Homo sapiens
tctacttgtcttctt

SEQ ID NO: 169824 - DNA, 15 bp, Homo sapiens
ttctacttgtcttct

SEQ ID NO: 169825 - DNA, 15 bp, Homo sapiens
cttctacttgtcttc

SEQ ID NO: 169826 - DNA, 15 bp, Homo sapiens
tcttctacttgtctt

SEQ ID NO: 169827 - DNA, 15 bp, Homo sapiens
ttcttctacttgtct

SEQ ID NO: 169828 - DNA, 15 bp, Homo sapiens
tttcttctacttgtc

SEQ ID NO: 169829 - DNA, 15 bp, Homo sapiens
ctttcttctacttgt

SEQ ID NO: 169830 - DNA, 15 bp, Homo sapiens
actttcttctacttg

SEQ ID NO: 169831 - DNA, 15 bp, Homo sapiens
tactttcttctactt

SEQ ID NO: 169832 - DNA, 15 bp, Homo sapiens
ttactttcttctact

SEQ ID NO: 169833 - DNA, 15 bp, Homo sapiens
attactttcttctac

SEQ ID NO: 169834 - DNA, 15 bp, Homo sapiens
gattactttcttcta

SEQ ID NO: 169835 - DNA, 15 bp, Homo sapiens
tgattactttcttct

SEQ ID NO: 169836 - DNA, 15 bp, Homo sapiens
atgattactttcttc

SEQ ID NO: 169837 - DNA, 15 bp, Homo sapiens
aatgattactttctt

SEQ ID NO: 169838 - DNA, 15 bp, Homo sapiens
caatgattactttct

SEQ ID NO: 169839 - DNA, 15 bp, Homo sapiens
tcaatgattactttc

SEQ ID NO: 169840 - DNA, 15 bp, Homo sapiens
ctcaatgattacttt

SEQ ID NO: 169841 - DNA, 15 bp, Homo sapiens
tctcaatgattactt

SEQ ID NO: 169842 - DNA, 15 bp, Homo sapiens
ctctcaatgattact

SEQ ID NO: 169843 - DNA, 15 bp, Homo sapiens
tctctcaatgattac

SEQ ID NO: 169844 - DNA, 15 bp, Homo sapiens
ctctctcaatgatta

SEQ ID NO: 169845 - DNA, 15 bp, Homo sapiens
tctctctcaatgatt

SEQ ID NO: 169846 - DNA, 15 bp, Homo sapiens
ctctctctcaatgat

SEQ ID NO: 169847 - DNA, 15 bp, Homo sapiens
cctctctctcaatga

SEQ ID NO: 169848 - DNA, 15 bp, Homo sapiens
tcctctctctcaatg

SEQ ID NO: 169849 - DNA, 15 bp, Homo sapiens
ttcctctctctcaat

SEQ ID NO: 169850 - DNA, 15 bp, Homo sapiens
gttcctctctctcaa

SEQ ID NO: 169851 - DNA, 15 bp, Homo sapiens
tgttcctctctctca

SEQ ID NO: 169852 - DNA, 15 bp, Homo sapiens
ttgttcctctctctc

SEQ ID NO: 169853 - DNA, 15 bp, Homo sapiens
tttgttcctctctct

SEQ ID NO: 169854 - DNA, 15 bp, Homo sapiens
ctttgttcctctctc

SEQ ID NO: 169855 - DNA, 15 bp, Homo sapiens
actttgttcctctct

SEQ ID NO: 169856 - DNA, 15 bp, Homo sapiens
gactttgttcctctc

SEQ ID NO: 169857 - DNA, 15 bp, Homo sapiens
agactttgttcctct

SEQ ID NO: 169858 - DNA, 15 bp, Homo sapiens
aagactttgttcctc

SEQ ID NO: 169859 - DNA, 15 bp, Homo sapiens
taagactttgttcct

SEQ ID NO: 169860 - DNA, 15 bp, Homo sapiens
gtaagactttgttcc

SEQ ID NO: 169861 - DNA, 15 bp, Homo sapiens
tgtaagactttgttc

SEQ ID NO: 169862 - DNA, 15 bp, Homo sapiens
ctgtaagactttgtt

SEQ ID NO: 169863 - DNA, 15 bp, Homo sapiens
actgtaagactttgt

SEQ ID NO: 169864 - DNA, 15 bp, Homo sapiens
tactgtaagactttg

SEQ ID NO: 169865 - DNA, 15 bp, Homo sapiens
ttactgtaagacttt

SEQ ID NO: 169866 - DNA, 15 bp, Homo sapiens
attactgtaagactt

SEQ ID NO: 169867 - DNA, 15 bp, Homo sapiens
aattactgtaagact

SEQ ID NO: 169868 - DNA, 15 bp, Homo sapiens
gaattactgtaagac

SEQ ID NO: 169869 - DNA, 15 bp, Homo sapiens
tgaattactgtaaga

SEQ ID NO: 169870 - DNA, 15 bp, Homo sapiens
ctgaattactgtaag

SEQ ID NO: 169871 - DNA, 15 bp, Homo sapiens
tctgaattactgtaa

SEQ ID NO: 169872 - DNA, 15 bp, Homo sapiens
atctgaattactgta

SEQ ID NO: 169873 - DNA, 15 bp, Homo sapiens
aatctgaattactgt

SEQ ID NO: 169874 - DNA, 15 bp, Homo sapiens
aaatctgaattactg

SEQ ID NO: 169875 - DNA, 15 bp, Homo sapiens
caaatctgaattact

SEQ ID NO: 169876 - DNA, 15 bp, Homo sapiens
ccaaatctgaattac

SEQ ID NO: 169877 - DNA, 15 bp, Homo sapiens
cccaaatctgaatta

SEQ ID NO: 169878 - DNA, 15 bp, Homo sapiens
tcccaaatctgaatt

SEQ ID NO: 169879 - DNA, 15 bp, Homo sapiens
ctcccaaatctgaat

SEQ ID NO: 169880 - DNA, 15 bp, Homo sapiens
tctcccaaatctgaa

SEQ ID NO: 169881 - DNA, 15 bp, Homo sapiens
atctcccaaatctga

SEQ ID NO: 169882 - DNA, 15 bp, Homo sapiens
aatctcccaaatctg

SEQ ID NO: 169883 - DNA, 15 bp, Homo sapiens
taatctcccaaatct

SEQ ID NO: 169884 - DNA, 15 bp, Homo sapiens
ataatctcccaaatc

SEQ ID NO: 169885 - DNA, 15 bp, Homo sapiens
aataatctcccaaat

SEQ ID NO: 169886 - DNA, 15 bp, Homo sapiens
aaataatctcccaaa

SEQ ID NO: 169887 - DNA, 15 bp, Homo sapiens
gaaataatctcccaa

SEQ ID NO: 169888 - DNA, 15 bp, Homo sapiens
agaaataatctccca

SEQ ID NO: 169889 - DNA, 15 bp, Homo sapiens
tagaaataatctccc

SEQ ID NO: 169890 - DNA, 15 bp, Homo sapiens
atagaaataatctcc

SEQ ID NO: 169891 - DNA, 15 bp, Homo sapiens
aatagaaataatctc

SEQ ID NO: 169892 - DNA, 15 bp, Homo sapiens
aaatagaaataatct

SEQ ID NO: 169893 - DNA, 15 bp, Homo sapiens
caaatagaaataatc

SEQ ID NO: 169894 - DNA, 15 bp, Homo sapiens
ccaaatagaaataat

SEQ ID NO: 169895 - DNA, 15 bp, Homo sapiens
cccaaatagaaataa

SEQ ID NO: 169896 - DNA, 15 bp, Homo sapiens
tcccaaatagaaata

SEQ ID NO: 169897 - DNA, 15 bp, Homo sapiens
ttcccaaatagaaat

SEQ ID NO: 169898 - DNA, 15 bp, Homo sapiens
tttcccaaatagaaa

SEQ ID NO: 169899 - DNA, 15 bp, Homo sapiens
ttttcccaaatagaa

SEQ ID NO: 169900 - DNA, 15 bp, Homo sapiens
attttcccaaataga

SEQ ID NO: 169901 - DNA, 15 bp, Homo sapiens
aattttcccaaatag

SEQ ID NO: 169902 - DNA, 15 bp, Homo sapiens
caattttcccaaata

SEQ ID NO: 169903 - DNA, 15 bp, Homo sapiens
ccaattttcccaaat

SEQ ID NO: 169904 - DNA, 15 bp, Homo sapiens
gccaattttcccaaa

SEQ ID NO: 169905 - DNA, 15 bp, Homo sapiens
ggccaattttcccaa

SEQ ID NO: 169906 - DNA, 15 bp, Homo sapiens
tggccaattttccca

SEQ ID NO: 169907 - DNA, 15 bp, Homo sapiens
gtggccaattttccc

SEQ ID NO: 169908 - DNA, 15 bp, Homo sapiens
ggtggccaattttcc

SEQ ID NO: 169909 - DNA, 15 bp, Homo sapiens
tggtggccaattttc

SEQ ID NO: 169910 - DNA, 15 bp, Homo sapiens
ctggtggccaatttt

SEQ ID NO: 169911 - DNA, 15 bp, Homo sapiens
cctggtggccaattt

SEQ ID NO: 169912 - DNA, 15 bp, Homo sapiens
acctggtggccaatt

SEQ ID NO: 169913 - DNA, 15 bp, Homo sapiens
tacctggtggccaat

SEQ ID NO: 169914 - DNA, 15 bp, Homo sapiens
ctacctggtggccaa

SEQ ID NO: 169915 - DNA, 15 bp, Homo sapiens
tctacctggtggcca

SEQ ID NO: 169916 - DNA, 15 bp, Homo sapiens
atctacctggtggcc

SEQ ID NO: 169917 - DNA, 15 bp, Homo sapiens
catctacctggtggc

SEQ ID NO: 169918 - DNA, 15 bp, Homo sapiens
acatctacctggtgg

SEQ ID NO: 169919 - DNA, 15 bp, Homo sapiens
aacatctacctggtg

SEQ ID NO: 169920 - DNA, 15 bp, Homo sapiens
aaacatctacctggt

SEQ ID NO: 169921 - DNA, 15 bp, Homo sapiens
aaaacatctacctgg

SEQ ID NO: 169922 - DNA, 15 bp, Homo sapiens
taaaacatctacctg

SEQ ID NO: 169923 - DNA, 15 bp, Homo sapiens
ataaaacatctacct

SEQ ID NO: 169924 - DNA, 15 bp, Homo sapiens
cataaaacatctacc

SEQ ID NO: 169925 - DNA, 15 bp, Homo sapiens
gcataaaacatctac

SEQ ID NO: 169926 - DNA, 15 bp, Homo sapiens
agcataaaacatcta

SEQ ID NO: 169927 - DNA, 15 bp, Homo sapiens
cagcataaaacatct

SEQ ID NO: 169928 - DNA, 15 bp, Homo sapiens
ccagcataaaacatc

SEQ ID NO: 169929 - DNA, 15 bp, Homo sapiens
cccagcataaaacat

SEQ ID NO: 169930 - DNA, 15 bp, Homo sapiens
acccagcataaaaca

SEQ ID NO: 169931 - DNA, 15 bp, Homo sapiens
aacccagcataaaac

SEQ ID NO: 169932 - DNA, 15 bp, Homo sapiens
gaacccagcataaaa

SEQ ID NO: 169933 - DNA, 15 bp, Homo sapiens
ggaacccagcataaa

SEQ ID NO: 169934 - DNA, 15 bp, Homo sapiens
aggaacccagcataa

SEQ ID NO: 169935 - DNA, 15 bp, Homo sapiens
taggaacccagcata

SEQ ID NO: 169936 - DNA, 15 bp, Homo sapiens
ttaggaacccagcat

SEQ ID NO: 169937 - DNA, 15 bp, Homo sapiens
tttaggaacccagca

SEQ ID NO: 169938 - DNA, 15 bp, Homo sapiens
ctttaggaacccagc

SEQ ID NO: 169939 - DNA, 15 bp, Homo sapiens
cctttaggaacccag

SEQ ID NO: 169940 - DNA, 15 bp, Homo sapiens
acctttaggaaccca

SEQ ID NO: 169941 - DNA, 15 bp, Homo sapiens
tacctttaggaaccc

SEQ ID NO: 169942 - DNA, 15 bp, Homo sapiens
ctacctttaggaacc

SEQ ID NO: 169943 - DNA, 15 bp, Homo sapiens
tctacctttaggaac

SEQ ID NO: 169944 - DNA, 15 bp, Homo sapiens
ttctacctttaggaa

SEQ ID NO: 169945 - DNA, 15 bp, Homo sapiens
tttctacctttagga

SEQ ID NO: 169946 - DNA, 15 bp, Homo sapiens
atttctacctttagg

SEQ ID NO: 169947 - DNA, 15 bp, Homo sapiens
catttctacctttag

SEQ ID NO: 169948 - DNA, 15 bp, Homo sapiens
ccatttctaccttta

SEQ ID NO: 169949 - DNA, 15 bp, Homo sapiens
accatttctaccttt

SEQ ID NO: 169950 - DNA, 15 bp, Homo sapiens
caccatttctacctt

SEQ ID NO: 169951 - DNA, 15 bp, Homo sapiens
ccaccatttctacct

SEQ ID NO: 169952 - DNA, 15 bp, Homo sapiens
cccaccatttctacc

SEQ ID NO: 169953 - DNA, 15 bp, Homo sapiens
tcccaccatttctac

SEQ ID NO: 169954 - DNA, 15 bp, Homo sapiens
ttcccaccatttcta

SEQ ID NO: 169955 - DNA, 15 bp, Homo sapiens
tttcccaccatttct

SEQ ID NO: 169956 - DNA, 15 bp, Homo sapiens
ctttcccaccatttc

SEQ ID NO: 169957 - DNA, 15 bp, Homo sapiens
tctttcccaccattt

SEQ ID NO: 169958 - DNA, 15 bp, Homo sapiens
ttctttcccaccatt

SEQ ID NO: 169959 - DNA, 15 bp, Homo sapiens
tttctttcccaccat

SEQ ID NO: 169960 - DNA, 15 bp, Homo sapiens
ctttctttcccacca

SEQ ID NO: 169961 - DNA, 15 bp, Homo sapiens
tctttctttcccacc

SEQ ID NO: 169962 - DNA, 15 bp, Homo sapiens
ttctttctttcccac

SEQ ID NO: 169963 - DNA, 15 bp, Homo sapiens
tttctttctttccca

SEQ ID NO: 169964 - DNA, 15 bp, Homo sapiens
ttttctttctttccc

SEQ ID NO: 169965 - DNA, 15 bp, Homo sapiens
attttctttctttcc

SEQ ID NO: 169966 - DNA, 15 bp, Homo sapiens
cattttctttctttc

SEQ ID NO: 169967 - DNA, 15 bp, Homo sapiens
tcattttctttcttt

SEQ ID NO: 169968 - DNA, 15 bp, Homo sapiens
gtcattttctttctt

SEQ ID NO: 169969 - DNA, 15 bp, Homo sapiens
tgtcattttctttct

SEQ ID NO: 169970 - DNA, 15 bp, Homo sapiens
atgtcattttctttc

SEQ ID NO: 169971 - DNA, 15 bp, Homo sapiens
aatgtcattttcttt

SEQ ID NO: 169972 - DNA, 15 bp, Homo sapiens
caatgtcattttctt

SEQ ID NO: 169973 - DNA, 15 bp, Homo sapiens
tcaatgtcattttct

SEQ ID NO: 169974 - DNA, 15 bp, Homo sapiens
ctcaatgtcattttc

SEQ ID NO: 169975 - DNA, 15 bp, Homo sapiens
cctcaatgtcatttt

SEQ ID NO: 169976 - DNA, 15 bp, Homo sapiens
ccctcaatgtcattt

SEQ ID NO: 169977 - DNA, 15 bp, Homo sapiens
gccctcaatgtcatt

SEQ ID NO: 169978 - DNA, 15 bp, Homo sapiens
tgccctcaatgtcat

SEQ ID NO: 169979 - DNA, 15 bp, Homo sapiens
ctgccctcaatgtca

SEQ ID NO: 169980 - DNA, 15 bp, Homo sapiens
tctgccctcaatgtc

SEQ ID NO: 169981 - DNA, 15 bp, Homo sapiens
ctctgccctcaatgt

SEQ ID NO: 169982 - DNA, 15 bp, Homo sapiens
cctctgccctcaatg

SEQ ID NO: 169983 - DNA, 15 bp, Homo sapiens
ccctctgccctcaat

SEQ ID NO: 169984 - DNA, 15 bp, Homo sapiens
cccctctgccctcaa

SEQ ID NO: 169985 - DNA, 15 bp, Homo sapiens
tcccctctgccctca

SEQ ID NO: 169986 - DNA, 15 bp, Homo sapiens
gtcccctctgccctc

SEQ ID NO: 169987 - DNA, 15 bp, Homo sapiens
tgtcccctctgccct

SEQ ID NO: 169988 - DNA, 15 bp, Homo sapiens
ctgtcccctctgccc

SEQ ID NO: 169989 - DNA, 15 bp, Homo sapiens
gctgtcccctctgcc

SEQ ID NO: 169990 - DNA, 15 bp, Homo sapiens
agctgtcccctctgc

SEQ ID NO: 169991 - DNA, 15 bp, Homo sapiens
aagctgtcccctctg

SEQ ID NO: 169992 - DNA, 15 bp, Homo sapiens
caagctgtcccctct

SEQ ID NO: 169993 - DNA, 15 bp, Homo sapiens
tcaagctgtcccctc

SEQ ID NO: 169994 - DNA, 15 bp, Homo sapiens
atcaagctgtcccct

SEQ ID NO: 169995 - DNA, 15 bp, Homo sapiens
aatcaagctgtcccc

SEQ ID NO: 169996 - DNA, 15 bp, Homo sapiens
taatcaagctgtccc

SEQ ID NO: 169997 - DNA, 15 bp, Homo sapiens
ctaatcaagctgtcc

SEQ ID NO: 169998 - DNA, 15 bp, Homo sapiens
actaatcaagctgtc

SEQ ID NO: 169999 - DNA, 15 bp, Homo sapiens
cactaatcaagctgt

SEQ ID NO: 170000 - DNA, 15 bp, Homo sapiens
ccactaatcaagctg

SEQ ID NO: 170001 - DNA, 15 bp, Homo sapiens
gccactaatcaagct

SEQ ID NO: 170002 - DNA, 15 bp, Homo sapiens
agccactaatcaagc

SEQ ID NO: 170003 - DNA, 15 bp, Homo sapiens
aagccactaatcaag

SEQ ID NO: 170004 - DNA, 15 bp, Homo sapiens
caagccactaatcaa

SEQ ID NO: 170005 - DNA, 15 bp, Homo sapiens
ccaagccactaatca

SEQ ID NO: 170006 - DNA, 15 bp, Homo sapiens
cccaagccactaatc

SEQ ID NO: 170007 - DNA, 15 bp, Homo sapiens
tcccaagccactaat

SEQ ID NO: 170008 - DNA, 15 bp, Homo sapiens
ttcccaagccactaa

SEQ ID NO: 170009 - DNA, 15 bp, Homo sapiens
attcccaagccacta

SEQ ID NO: 170010 - DNA, 15 bp, Homo sapiens
cattcccaagccact

SEQ ID NO: 170011 - DNA, 15 bp, Homo sapiens
ccattcccaagccac

SEQ ID NO: 170012 - DNA, 15 bp, Homo sapiens
cccattcccaagcca

SEQ ID NO: 170013 - DNA, 15 bp, Homo sapiens
catcccattcccaag

SEQ ID NO: 170014 - DNA, 15 bp, Homo sapiens
tcatcccattcccaa

SEQ ID NO: 170015 - DNA, 15 bp, Homo sapiens
ttcatcccattccca

SEQ ID NO: 170016 - DNA, 15 bp, Homo sapiens
cttcatcccattccc

SEQ ID NO: 170017 - DNA, 15 bp, Homo sapiens
gcttcatcccattcc

SEQ ID NO: 170018 - DNA, 15 bp, Homo sapiens
ggcttcatcccattc

SEQ ID NO: 170019 - DNA, 15 bp, Homo sapiens
tggcttcatcccatt

SEQ ID NO: 170020 - DNA, 15 bp, Homo sapiens
ctggcttcatcccat

SEQ ID NO: 170021 - DNA, 15 bp, Homo sapiens
actggcttcatccca

SEQ ID NO: 170022 - DNA, 15 bp, Homo sapiens
cactggcttcatccc

SEQ ID NO: 170023 - DNA, 15 bp, Homo sapiens
acactggcttcatcc

SEQ ID NO: 170024 - DNA, 15 bp, Homo sapiens
aacactggcttcatc

SEQ ID NO: 170025 - DNA, 15 bp, Homo sapiens
caacactggcttcat

SEQ ID NO: 170026 - DNA, 15 bp, Homo sapiens
gcaacactggcttca

SEQ ID NO: 170027 - DNA, 15 bp, Homo sapiens
ggcaacactggcttc

SEQ ID NO: 170028 - DNA, 15 bp, Homo sapiens
tggcaacactggctt

SEQ ID NO: 170029 - DNA, 15 bp, Homo sapiens
ttggcaacactggct

SEQ ID NO: 170030 - DNA, 15 bp, Homo sapiens
cttggcaacactggc

SEQ ID NO: 170031 - DNA, 15 bp, Homo sapiens
acttggcaacactgg

SEQ ID NO: 170032 - DNA, 15 bp, Homo sapiens
tacttggcaacactg

SEQ ID NO: 170033 - DNA, 15 bp, Homo sapiens
ctacttggcaacact

SEQ ID NO: 170034 - DNA, 15 bp, Homo sapiens
actacttggcaacac

SEQ ID NO: 170035 - DNA, 15 bp, Homo sapiens
cactacttggcaaca

SEQ ID NO: 170036 - DNA, 15 bp, Homo sapiens
acactacttggcaac

SEQ ID NO: 170037 - DNA, 15 bp, Homo sapiens
gacactacttggcaa

SEQ ID NO: 170038 - DNA, 15 bp, Homo sapiens
agacactacttggca

SEQ ID NO: 170039 - DNA, 15 bp, Homo sapiens
cagacactacttggc

SEQ ID NO: 170040 - DNA, 15 bp, Homo sapiens
acagacactacttgg

SEQ ID NO: 170041 - DNA, 15 bp, Homo sapiens
aacagacactacttg

SEQ ID NO: 170042 - DNA, 15 bp, Homo sapiens
taacagacactactt

SEQ ID NO: 170043 - DNA, 15 bp, Homo sapiens
ttaacagacactact

SEQ ID NO: 170044 - DNA, 15 bp, Homo sapiens
tttaacagacactac

SEQ ID NO: 170045 - DNA, 15 bp, Homo sapiens
ttttaacagacacta

SEQ ID NO: 170046 - DNA, 15 bp, Homo sapiens
cttttaacagacact

SEQ ID NO: 170047 - DNA, 15 bp, Homo sapiens
ccttttaacagacac

SEQ ID NO: 170048 - DNA, 15 bp, Homo sapiens
tccttttaacagaca

SEQ ID NO: 170049 - DNA, 15 bp, Homo sapiens
ctccttttaacagac

SEQ ID NO: 170050 - DNA, 15 bp, Homo sapiens
gctccttttaacaga

SEQ ID NO: 170051 - DNA, 15 bp, Homo sapiens
tgctccttttaacag

SEQ ID NO: 170052 - DNA, 15 bp, Homo sapiens
atgctccttttaaca

SEQ ID NO: 170053 - DNA, 15 bp, Homo sapiens
tatgctccttttaac

SEQ ID NO: 170054 - DNA, 15 bp, Homo sapiens
atatgctccttttaa

SEQ ID NO: 170055 - DNA, 15 bp, Homo sapiens
aatatgctcctttta

SEQ ID NO: 170056 - DNA, 15 bp, Homo sapiens
caatatgctcctttt

SEQ ID NO: 170057 - DNA, 15 bp, Homo sapiens
ccaatatgctccttt

SEQ ID NO: 170058 - DNA, 15 bp, Homo sapiens
cccaatatgctcctt

SEQ ID NO: 170059 - DNA, 15 bp, Homo sapiens
tcccaatatgctcct

SEQ ID NO: 170060 - DNA, 15 bp, Homo sapiens
ttcccaatatgctcc

SEQ ID NO: 170061 - DNA, 15 bp, Homo sapiens
tttcccaatatgctc

SEQ ID NO: 170062 - DNA, 15 bp, Homo sapiens
ttttcccaatatgct

SEQ ID NO: 170063 - DNA, 15 bp, Homo sapiens
attttcccaatatgc

SEQ ID NO: 170064 - DNA, 15 bp, Homo sapiens
cattttcccaatatg

SEQ ID NO: 170065 - DNA, 15 bp, Homo sapiens
tcattttcccaatat

SEQ ID NO: 170066 - DNA, 15 bp, Homo sapiens
ctcattttcccaata

SEQ ID NO: 170067 - DNA, 15 bp, Homo sapiens
cctcattttcccaat

SEQ ID NO: 170068 - DNA, 15 bp, Homo sapiens
tcctcattttcccaa

SEQ ID NO: 170069 - DNA, 15 bp, Homo sapiens
gtcctcattttccca

SEQ ID NO: 170070 - DNA, 15 bp, Homo sapiens
tgtcctcattttccc

SEQ ID NO: 170071 - DNA, 15 bp, Homo sapiens
ctgtcctcattttcc

SEQ ID NO: 170072 - DNA, 15 bp, Homo sapiens
tctgtcctcattttc

SEQ ID NO: 170073 - DNA, 15 bp, Homo sapiens
ttctgtcctcatttt

SEQ ID NO: 170074 - DNA, 15 bp, Homo sapiens
tttctgtcctcattt

SEQ ID NO: 170075 - DNA, 15 bp, Homo sapiens
ctttctgtcctcatt

SEQ ID NO: 170076 - DNA, 15 bp, Homo sapiens
cctttctgtcctcat

SEQ ID NO: 170077 - DNA, 15 bp, Homo sapiens
acctttctgtcctca

SEQ ID NO: 170078 - DNA, 15 bp, Homo sapiens
tacctttctgtcctc

SEQ ID NO: 170079 - DNA, 15 bp, Homo sapiens
ttacctttctgtcct

SEQ ID NO: 170080 - DNA, 15 bp, Homo sapiens
tttacctttctgtcc

SEQ ID NO: 170081 - DNA, 15 bp, Homo sapiens
ttttacctttctgtc

SEQ ID NO: 170082 - DNA, 15 bp, Homo sapiens
attttacctttctgt

SEQ ID NO: 170083 - DNA, 15 bp, Homo sapiens
aattttacctttctg

SEQ ID NO: 170084 - DNA, 15 bp, Homo sapiens
taattttacctttct

SEQ ID NO: 170085 - DNA, 15 bp, Homo sapiens
ctaattttacctttc

SEQ ID NO: 170086 - DNA, 15 bp, Homo sapiens
cctaattttaccttt

SEQ ID NO: 170087 - DNA, 15 bp, Homo sapiens
acctaattttacctt

SEQ ID NO: 170088 - DNA, 15 bp, Homo sapiens
gacctaattttacct

SEQ ID NO: 170089 - DNA, 15 bp, Homo sapiens
tgacctaattttacc

SEQ ID NO: 170090 - DNA, 15 bp, Homo sapiens
ctgacctaattttac

SEQ ID NO: 170091 - DNA, 15 bp, Homo sapiens
tctgacctaatttta

SEQ ID NO: 170092 - DNA, 15 bp, Homo sapiens
atctgacctaatttt

SEQ ID NO: 170093 - DNA, 15 bp, Homo sapiens
tatctgacctaattt

SEQ ID NO: 170094 - DNA, 15 bp, Homo sapiens
ttatctgacctaatt

SEQ ID NO: 170095 - DNA, 15 bp, Homo sapiens
attatctgacctaat

SEQ ID NO: 170096 - DNA, 15 bp, Homo sapiens
tattatctgacctaa

SEQ ID NO: 170097 - DNA, 15 bp, Homo sapiens
gtattatctgaccta

SEQ ID NO: 170098 - DNA, 15 bp, Homo sapiens
tgtattatctgacct

SEQ ID NO: 170099 - DNA, 15 bp, Homo sapiens
ctgtattatctgacc

SEQ ID NO: 170100 - DNA, 15 bp, Homo sapiens
cctgtattatctgac

SEQ ID NO: 170101 - DNA, 15 bp, Homo sapiens
tcctgtattatctga

SEQ ID NO: 170102 - DNA, 15 bp, Homo sapiens
atcctgtattatctg

SEQ ID NO: 170103 - DNA, 15 bp, Homo sapiens
aatcctgtattatct

SEQ ID NO: 170104 - DNA, 15 bp, Homo sapiens
aaatcctgtattatc

SEQ ID NO: 170105 - DNA, 15 bp, Homo sapiens
aaaatcctgtattat

SEQ ID NO: 170106 - DNA, 15 bp, Homo sapiens
caaaatcctgtatta

SEQ ID NO: 170107 - DNA, 15 bp, Homo sapiens
tcaaaatcctgtatt

SEQ ID NO: 170108 - DNA, 15 bp, Homo sapiens
ctcaaaatcctgtat

SEQ ID NO: 170109 - DNA, 15 bp, Homo sapiens
actcaaaatcctgta

SEQ ID NO: 170110 - DNA, 15 bp, Homo sapiens
aactcaaaatcctgt

SEQ ID NO: 170111 - DNA, 15 bp, Homo sapiens
gaactcaaaatcctg

SEQ ID NO: 170112 - DNA, 15 bp, Homo sapiens
agaactcaaaatcct

SEQ ID NO: 170113 - DNA, 15 bp, Homo sapiens
aagaactcaaaatcc

SEQ ID NO: 170114 - DNA, 15 bp, Homo sapiens
caagaactcaaaatc

SEQ ID NO: 170115 - DNA, 15 bp, Homo sapiens
acaagaactcaaaat

SEQ ID NO: 170116 - DNA, 15 bp, Homo sapiens
gacaagaactcaaaa

SEQ ID NO: 170117 - DNA, 15 bp, Homo sapiens
tgacaagaactcaaa

SEQ ID NO: 170118 - DNA, 15 bp, Homo sapiens
ttgacaagaactcaa

SEQ ID NO: 170119 - DNA, 15 bp, Homo sapiens
tttgacaagaactca

SEQ ID NO: 170120 - DNA, 15 bp, Homo sapiens
ctttgacaagaactc

SEQ ID NO: 170121 - DNA, 15 bp, Homo sapiens
tctttgacaagaact

SEQ ID NO: 170122 - DNA, 15 bp, Homo sapiens
ttctttgacaagaac

SEQ ID NO: 170123 - DNA, 15 bp, Homo sapiens
attctttgacaagaa

SEQ ID NO: 170124 - DNA, 15 bp, Homo sapiens
tattctttgacaaga

SEQ ID NO: 170125 - DNA, 15 bp, Homo sapiens
atattctttgacaag

SEQ ID NO: 170126 - DNA, 15 bp, Homo sapiens
catattctttgacaa

SEQ ID NO: 170127 - DNA, 15 bp, Homo sapiens
tcatattctttgaca

SEQ ID NO: 170128 - DNA, 15 bp, Homo sapiens
ttcatattctttgac

SEQ ID NO: 170129 - DNA, 15 bp, Homo sapiens
gttcatattctttga

SEQ ID NO: 170130 - DNA, 15 bp, Homo sapiens
agttcatattctttg

SEQ ID NO: 170131 - DNA, 15 bp, Homo sapiens
aagttcatattcttt

SEQ ID NO: 170132 - DNA, 15 bp, Homo sapiens
caagttcatattctt

SEQ ID NO: 170133 - DNA, 15 bp, Homo sapiens
tcaagttcatattct

SEQ ID NO: 170134 - DNA, 15 bp, Homo sapiens
ctcaagttcatattc

SEQ ID NO: 170135 - DNA, 15 bp, Homo sapiens
actcaagttcatatt

SEQ ID NO: 170136 - DNA, 15 bp, Homo sapiens
gactcaagttcatat

SEQ ID NO: 170137 - DNA, 15 bp, Homo sapiens
agactcaagttcata

SEQ ID NO: 170138 - DNA, 15 bp, Homo sapiens
tagactcaagttcat

SEQ ID NO: 170139 - DNA, 15 bp, Homo sapiens
ctagactcaagttca

SEQ ID NO: 170140 - DNA, 15 bp, Homo sapiens
tctagactcaagttc

SEQ ID NO: 170141 - DNA, 15 bp, Homo sapiens
atctagactcaagtt

SEQ ID NO: 170142 - DNA, 15 bp, Homo sapiens
aatctagactcaagt

SEQ ID NO: 170143 - DNA, 15 bp, Homo sapiens
aaatctagactcaag

SEQ ID NO: 170144 - DNA, 15 bp, Homo sapiens
caaatctagactcaa

SEQ ID NO: 170145 - DNA, 15 bp, Homo sapiens
tcaaatctagactca

SEQ ID NO: 170146 - DNA, 15 bp, Homo sapiens
ctcaaatctagactc

SEQ ID NO: 170147 - DNA, 15 bp, Homo sapiens
actcaaatctagact

SEQ ID NO: 170148 - DNA, 15 bp, Homo sapiens
tactcaaatctagac

SEQ ID NO: 170149 - DNA, 15 bp, Homo sapiens
atactcaaatctaga

SEQ ID NO: 170150 - DNA, 15 bp, Homo sapiens
tatactcaaatctag

SEQ ID NO: 170151 - DNA, 15 bp, Homo sapiens
atatactcaaatcta

SEQ ID NO: 170152 - DNA, 15 bp, Homo sapiens
aatatactcaaatct

SEQ ID NO: 170153 - DNA, 15 bp, Homo sapiens
taatatactcaaatc

SEQ ID NO: 170154 - DNA, 15 bp, Homo sapiens
gtaatatactcaaat

SEQ ID NO: 170155 - DNA, 15 bp, Homo sapiens
agtaatatactcaaa

SEQ ID NO: 170156 - DNA, 15 bp, Homo sapiens
cagtaatatactcaa

SEQ ID NO: 170157 - DNA, 15 bp, Homo sapiens
tcagtaatatactca

SEQ ID NO: 170158 - DNA, 15 bp, Homo sapiens
ttcagtaatatactc

SEQ ID NO: 170159 - DNA, 15 bp, Homo sapiens
cttcagtaatatact

SEQ ID NO: 170160 - DNA, 15 bp, Homo sapiens
ccttcagtaatatac

SEQ ID NO: 170161 - DNA, 15 bp, Homo sapiens
accttcagtaatata

SEQ ID NO: 170162 - DNA, 15 bp, Homo sapiens
aaccttcagtaatat

SEQ ID NO: 170163 - DNA, 15 bp, Homo sapiens
aaaccttcagtaata

SEQ ID NO: 170164 - DNA, 15 bp, Homo sapiens
aaaaccttcagtaat

SEQ ID NO: 170165 - DNA, 15 bp, Homo sapiens
aaaaaccttcagtaa

SEQ ID NO: 170166 - DNA, 15 bp, Homo sapiens
caaaaaccttcagta

SEQ ID NO: 170167 - DNA, 15 bp, Homo sapiens
tcaaaaaccttcagt

SEQ ID NO: 170168 - DNA, 15 bp, Homo sapiens
ctcaaaaaccttcag

SEQ ID NO: 170169 - DNA, 15 bp, Homo sapiens
gctcaaaaaccttca

SEQ ID NO: 170170 - DNA, 15 bp, Homo sapiens
tgctcaaaaaccttc

SEQ ID NO: 170171 - DNA, 15 bp, Homo sapiens
ttgctcaaaaacctt

SEQ ID NO: 170172 - DNA, 15 bp, Homo sapiens
cttgctcaaaaacct

SEQ ID NO: 170173 - DNA, 15 bp, Homo sapiens
ccttgctcaaaaacc

SEQ ID NO: 170174 - DNA, 15 bp, Homo sapiens
cccttgctcaaaaac

SEQ ID NO: 170175 - DNA, 15 bp, Homo sapiens
tcccttgctcaaaaa

SEQ ID NO: 170176 - DNA, 15 bp, Homo sapiens
ctcccttgctcaaaa

SEQ ID NO: 170177 - DNA, 15 bp, Homo sapiens
cctcccttgctcaaa

SEQ ID NO: 170178 - DNA, 15 bp, Homo sapiens
ccctcccttgctcaa

SEQ ID NO: 170179 - DNA, 15 bp, Homo sapiens
gccctcccttgctca

SEQ ID NO: 170180 - DNA, 15 bp, Homo sapiens
tgccctcccttgctc

SEQ ID NO: 170181 - DNA, 15 bp, Homo sapiens
atgccctcccttgct

SEQ ID NO: 170182 - DNA, 15 bp, Homo sapiens
aatgccctcccttgc

SEQ ID NO: 170183 - DNA, 15 bp, Homo sapiens
taatgccctcccttg

SEQ ID NO: 170184 - DNA, 15 bp, Homo sapiens
gtaatgccctccctt

SEQ ID NO: 170185 - DNA, 15 bp, Homo sapiens
agtaatgccctccct

SEQ ID NO: 170186 - DNA, 15 bp, Homo sapiens
cagtaatgccctccc

SEQ ID NO: 170187 - DNA, 15 bp, Homo sapiens
acagtaatgccctcc

SEQ ID NO: 170188 - DNA, 15 bp, Homo sapiens
cacagtaatgccctc

SEQ ID NO: 170189 - DNA, 15 bp, Homo sapiens
gcacagtaatgccct

SEQ ID NO: 170190 - DNA, 15 bp, Homo sapiens
agcacagtaatgccc

SEQ ID NO: 170191 - DNA, 15 bp, Homo sapiens
aagcacagtaatgcc

SEQ ID NO: 170192 - DNA, 15 bp, Homo sapiens
aaagcacagtaatgc

SEQ ID NO: 170193 - DNA, 15 bp, Homo sapiens
taaagcacagtaatg

SEQ ID NO: 170194 - DNA, 15 bp, Homo sapiens
ctaaagcacagtaat

SEQ ID NO: 170195 - DNA, 15 bp, Homo sapiens
tctaaagcacagtaa

SEQ ID NO: 170196 - DNA, 15 bp, Homo sapiens
ttctaaagcacagta

SEQ ID NO: 170197 - DNA, 15 bp, Homo sapiens
tttctaaagcacagt

SEQ ID NO: 170198 - DNA, 15 bp, Homo sapiens
ctttctaaagcacag

SEQ ID NO: 170199 - DNA, 15 bp, Homo sapiens
tctttctaaagcaca

SEQ ID NO: 170200 - DNA, 15 bp, Homo sapiens
atctttctaaagcac

SEQ ID NO: 170201 - DNA, 15 bp, Homo sapiens
aatctttctaaagca

SEQ ID NO: 170202 - DNA, 15 bp, Homo sapiens
taatctttctaaagc

SEQ ID NO: 170203 - DNA, 15 bp, Homo sapiens
ttaatctttctaaag

SEQ ID NO: 170204 - DNA, 15 bp, Homo sapiens
attaatctttctaaa

SEQ ID NO: 170205 - DNA, 15 bp, Homo sapiens
gattaatctttctaa

SEQ ID NO: 170206 - DNA, 15 bp, Homo sapiens
agattaatctttcta

SEQ ID NO: 170207 - DNA, 15 bp, Homo sapiens
cagattaatctttct

SEQ ID NO: 170208 - DNA, 15 bp, Homo sapiens
ccagattaatctttc

SEQ ID NO: 170209 - DNA, 15 bp, Homo sapiens
gccagattaatcttt

SEQ ID NO: 170210 - DNA, 15 bp, Homo sapiens
ggccagattaatctt

SEQ ID NO: 170211 - DNA, 15 bp, Homo sapiens
tggccagattaatct

SEQ ID NO: 170212 - DNA, 15 bp, Homo sapiens
gtggccagattaatc

SEQ ID NO: 170213 - DNA, 15 bp, Homo sapiens
tgtggccagattaat

SEQ ID NO: 170214 - DNA, 15 bp, Homo sapiens
ttgtggccagattaa

SEQ ID NO: 170215 - DNA, 15 bp, Homo sapiens
attgtggccagatta

SEQ ID NO: 170216 - DNA, 15 bp, Homo sapiens
aattgtggccagatt

SEQ ID NO: 170217 - DNA, 15 bp, Homo sapiens
aaattgtggccagat

SEQ ID NO: 170218 - DNA, 15 bp, Homo sapiens
taaattgtggccaga

SEQ ID NO: 170219 - DNA, 15 bp, Homo sapiens
ataaattgtggccag

SEQ ID NO: 170220 - DNA, 15 bp, Homo sapiens
tataaattgtggcca

SEQ ID NO: 170221 - DNA, 15 bp, Homo sapiens
ttataaattgtggcc

SEQ ID NO: 170222 - DNA, 15 bp, Homo sapiens
attataaattgtggc

SEQ ID NO: 170223 - DNA, 15 bp, Homo sapiens
cattataaattgtgg

SEQ ID NO: 170224 - DNA, 15 bp, Homo sapiens
acattataaattgtg

SEQ ID NO: 170225 - DNA, 15 bp, Homo sapiens
tacattataaattgt

SEQ ID NO: 170226 - DNA, 15 bp, Homo sapiens
ttacattataaattg

SEQ ID NO: 170227 - DNA, 15 bp, Homo sapiens
attacattataaatt

SEQ ID NO: 170228 - DNA, 15 bp, Homo sapiens
tattacattataaat

SEQ ID NO: 170229 - DNA, 15 bp, Homo sapiens
gtattacattataaa

SEQ ID NO: 170230 - DNA, 15 bp, Homo sapiens
tgtattacattataa

SEQ ID NO: 170231 - DNA, 15 bp, Homo sapiens
ctgtattacattata

SEQ ID NO: 170232 - DNA, 15 bp, Homo sapiens
tctgtattacattat

SEQ ID NO: 170233 - DNA, 15 bp, Homo sapiens
ttctgtattacatta

SEQ ID NO: 170234 - DNA, 15 bp, Homo sapiens
tttctgtattacatt

SEQ ID NO: 170235 - DNA, 15 bp, Homo sapiens
ttttctgtattacat

SEQ ID NO: 170236 - DNA, 15 bp, Homo sapiens
cttttctgtattaca

SEQ ID NO: 170237 - DNA, 15 bp, Homo sapiens
acttttctgtattac

SEQ ID NO: 170238 - DNA, 15 bp, Homo sapiens
tacttttctgtatta

SEQ ID NO: 170239 - DNA, 15 bp, Homo sapiens
ttacttttctgtatt

SEQ ID NO: 170240 - DNA, 15 bp, Homo sapiens
attacttttctgtat

SEQ ID NO: 170241 - DNA, 15 bp, Homo sapiens
tattacttttctgta

SEQ ID NO: 170242 - DNA, 15 bp, Homo sapiens
ctattacttttctgt

SEQ ID NO: 170243 - DNA, 15 bp, Homo sapiens
cctattacttttctg

SEQ ID NO: 170244 - DNA, 15 bp, Homo sapiens
acctattacttttct

SEQ ID NO: 170245 - DNA, 15 bp, Homo sapiens
cacctattacttttc

SEQ ID NO: 170246 - DNA, 15 bp, Homo sapiens
ccacctattactttt

SEQ ID NO: 170247 - DNA, 15 bp, Homo sapiens
tccacctattacttt

SEQ ID NO: 170248 - DNA, 15 bp, Homo sapiens
ttccacctattactt

SEQ ID NO: 170249 - DNA, 15 bp, Homo sapiens
tttccacctattact

SEQ ID NO: 170250 - DNA, 15 bp, Homo sapiens
ctttccacctattac

SEQ ID NO: 170251 - DNA, 15 bp, Homo sapiens
tctttccacctatta

SEQ ID NO: 170252 - DNA, 15 bp, Homo sapiens
ttctttccacctatt

SEQ ID NO: 170253 - DNA, 15 bp, Homo sapiens
cttctttccacctat

SEQ ID NO: 170254 - DNA, 15 bp, Homo sapiens
tcttctttccaccta

SEQ ID NO: 170255 - DNA, 15 bp, Homo sapiens
ctcttctttccacct

SEQ ID NO: 170256 - DNA, 15 bp, Homo sapiens
cctcttctttccacc

SEQ ID NO: 170257 - DNA, 15 bp, Homo sapiens
ccctcttctttccac

SEQ ID NO: 170258 - DNA, 15 bp, Homo sapiens
tccctcttctttcca

SEQ ID NO: 170259 - DNA, 15 bp, Homo sapiens
ctccctcttctttcc

SEQ ID NO: 170260 - DNA, 15 bp, Homo sapiens
tctccctcttctttc

SEQ ID NO: 170261 - DNA, 15 bp, Homo sapiens
gtctccctcttcttt

SEQ ID NO: 170262 - DNA, 15 bp, Homo sapiens
ggtctccctcttctt

SEQ ID NO: 170263 - DNA, 15 bp, Homo sapiens
tggtctccctcttct

SEQ ID NO: 170264 - DNA, 15 bp, Homo sapiens
ctggtctccctcttc

SEQ ID NO: 170265 - DNA, 15 bp, Homo sapiens
cctggtctccctctt

SEQ ID NO: 170266 - DNA, 15 bp, Homo sapiens
gcctggtctccctct

SEQ ID NO: 170267 - DNA, 15 bp, Homo sapiens
tgcctggtctccctc

SEQ ID NO: 170268 - DNA, 15 bp, Homo sapiens
gtgcctggtctccct

SEQ ID NO: 170269 - DNA, 15 bp, Homo sapiens
cgtgcctggtctccc

SEQ ID NO: 170270 - DNA, 15 bp, Homo sapiens
tcgtgcctggtctcc

SEQ ID NO: 170271 - DNA, 15 bp, Homo sapiens
gtcgtgcctggtctc

SEQ ID NO: 170272 - DNA, 15 bp, Homo sapiens
cgtcgtgcctggtct

SEQ ID NO: 170273 - DNA, 15 bp, Homo sapiens
tcgtcgtgcctggtc

SEQ ID NO: 170274 - DNA, 15 bp, Homo sapiens
gtcgtcgtgcctggt

SEQ ID NO: 170275 - DNA, 15 bp, Homo sapiens
tgtcgtcgtgcctgg

SEQ ID NO: 170276 - DNA, 15 bp, Homo sapiens
ctgtcgtcgtgcctg

SEQ ID NO: 170277 - DNA, 15 bp, Homo sapiens
actgtcgtcgtgcct

SEQ ID NO: 170278 - DNA, 15 bp, Homo sapiens
tactgtcgtcgtgcc

SEQ ID NO: 170279 - DNA, 15 bp, Homo sapiens
ttactgtcgtcgtgc

SEQ ID NO: 170280 - DNA, 15 bp, Homo sapiens
cttactgtcgtcgtg

SEQ ID NO: 170281 - DNA, 15 bp, Homo sapiens
tcttactgtcgtcgt

SEQ ID NO: 170282 - DNA, 15 bp, Homo sapiens
ctcttactgtcgtcg

SEQ ID NO: 170283 - DNA, 15 bp, Homo sapiens
gctcttactgtcgtc

SEQ ID NO: 170284 - DNA, 15 bp, Homo sapiens
agctcttactgtcgt

SEQ ID NO: 170285 - DNA, 15 bp, Homo sapiens
aagctcttactgtcg

SEQ ID NO: 170286 - DNA, 15 bp, Homo sapiens
taagctcttactgtc

SEQ ID NO: 170287 - DNA, 15 bp, Homo sapiens
ctaagctcttactgt

SEQ ID NO: 170288 - DNA, 15 bp, Homo sapiens
tctaagctcttactg

SEQ ID NO: 170289 - DNA, 15 bp, Homo sapiens
gtctaagctcttact

SEQ ID NO: 170290 - DNA, 15 bp, Homo sapiens
tgtctaagctcttac

SEQ ID NO: 170291 - DNA, 15 bp, Homo sapiens
ttgtctaagctctta

SEQ ID NO: 170292 - DNA, 15 bp, Homo sapiens
cttgtctaagctctt

SEQ ID NO: 170293 - DNA, 15 bp, Homo sapiens
tcttgtctaagctct

SEQ ID NO: 170294 - DNA, 15 bp, Homo sapiens
ctcttgtctaagctc

SEQ ID NO: 170295 - DNA, 15 bp, Homo sapiens
actcttgtctaagct

SEQ ID NO: 170296 - DNA, 15 bp, Homo sapiens
gactcttgtctaagc

SEQ ID NO: 170297 - DNA, 15 bp, Homo sapiens
tgactcttgtctaag

SEQ ID NO: 170298 - DNA, 15 bp, Homo sapiens
ctgactcttgtctaa

SEQ ID NO: 170299 - DNA, 15 bp, Homo sapiens
gctgactcttgtcta

SEQ ID NO: 170300 - DNA, 15 bp, Homo sapiens
ggctgactcttgtct

SEQ ID NO: 170301 - DNA, 15 bp, Homo sapiens
tggctgactcttgtc

SEQ ID NO: 170302 - DNA, 15 bp, Homo sapiens
ttggctgactcttgt

SEQ ID NO: 170303 - DNA, 15 bp, Homo sapiens
gttggctgactcttg

SEQ ID NO: 170304 - DNA, 15 bp, Homo sapiens
tgttggctgactctt

SEQ ID NO: 170305 - DNA, 15 bp, Homo sapiens
ttgttggctgactct

SEQ ID NO: 170306 - DNA, 15 bp, Homo sapiens
gttgttggctgactc

SEQ ID NO: 170307 - DNA, 15 bp, Homo sapiens
ggttgttggctgact

SEQ ID NO: 170308 - DNA, 15 bp, Homo sapiens
cggttgttggctgac

SEQ ID NO: 170309 - DNA, 15 bp, Homo sapiens
tcggttgttggctga

SEQ ID NO: 170310 - DNA, 15 bp, Homo sapiens
ttcggttgttggctg

SEQ ID NO: 170311 - DNA, 15 bp, Homo sapiens
cttcggttgttggct

SEQ ID NO: 170312 - DNA, 15 bp, Homo sapiens
tcttcggttgttggc

SEQ ID NO: 170313 - DNA, 15 bp, Homo sapiens
ttcttcggttgttgg

SEQ ID NO: 170314 - DNA, 15 bp, Homo sapiens
attcttcggttgttg

SEQ ID NO: 170315 - DNA, 15 bp, Homo sapiens
cattcttcggttgtt

SEQ ID NO: 170316 - DNA, 15 bp, Homo sapiens
ccattcttcggttgt

SEQ ID NO: 170317 - DNA, 15 bp, Homo sapiens
tccattcttcggttg

SEQ ID NO: 170318 - DNA, 15 bp, Homo sapiens
ttccattcttcggtt

SEQ ID NO: 170319 - DNA, 15 bp, Homo sapiens
tttccattcttcggt

SEQ ID NO: 170320 - DNA, 15 bp, Homo sapiens
atttccattcttcgg

SEQ ID NO: 170321 - DNA, 15 bp, Homo sapiens
catttccattcttcg

SEQ ID NO: 170322 - DNA, 15 bp, Homo sapiens
acatttccattcttc

SEQ ID NO: 170323 - DNA, 15 bp, Homo sapiens
gacatttccattctt

SEQ ID NO: 170324 - DNA, 15 bp, Homo sapiens
tgacatttccattct

SEQ ID NO: 170325 - DNA, 15 bp, Homo sapiens
gtgacatttccattc

SEQ ID NO: 170326 - DNA, 15 bp, Homo sapiens
agtgacatttccatt

SEQ ID NO: 170327 - DNA, 15 bp, Homo sapiens
cagtgacatttccat

SEQ ID NO: 170328 - DNA, 15 bp, Homo sapiens
tcagtgacatttcca

SEQ ID NO: 170329 - DNA, 15 bp, Homo sapiens
ttcagtgacatttcc

SEQ ID NO: 170330 - DNA, 15 bp, Homo sapiens
tttcagtgacatttc

SEQ ID NO: 170331 - DNA, 15 bp, Homo sapiens
ttttcagtgacattt

SEQ ID NO: 170332 - DNA, 15 bp, Homo sapiens
attttcagtgacatt

SEQ ID NO: 170333 - DNA, 15 bp, Homo sapiens
cattttcagtgacat

SEQ ID NO: 170334 - DNA, 15 bp, Homo sapiens
ccattttcagtgaca

SEQ ID NO: 170335 - DNA, 15 bp, Homo sapiens
tccattttcagtgac

SEQ ID NO: 170336 - DNA, 15 bp, Homo sapiens
ttccattttcagtga

SEQ ID NO: 170337 - DNA, 15 bp, Homo sapiens
tttccattttcagtg

SEQ ID NO: 170338 - DNA, 15 bp, Homo sapiens
ttttccattttcagt

SEQ ID NO: 170339 - DNA, 15 bp, Homo sapiens
cttttccattttcag

SEQ ID NO: 170340 - DNA, 15 bp, Homo sapiens
gcttttccattttca

SEQ ID NO: 170341 - DNA, 15 bp, Homo sapiens
tgcttttccattttc

SEQ ID NO: 170342 - DNA, 15 bp, Homo sapiens
ctgcttttccatttt

SEQ ID NO: 170343 - DNA, 15 bp, Homo sapiens
tctgcttttccattt

SEQ ID NO: 170344 - DNA, 15 bp, Homo sapiens
ttctgcttttccatt

SEQ ID NO: 170345 - DNA, 15 bp, Homo sapiens
cttctgcttttccat

SEQ ID NO: 170346 - DNA, 15 bp, Homo sapiens
acttctgcttttcca

SEQ ID NO: 170347 - DNA, 15 bp, Homo sapiens
tacttctgcttttcc

SEQ ID NO: 170348 - DNA, 15 bp, Homo sapiens
ctacttctgcttttc

SEQ ID NO: 170349 - DNA, 15 bp, Homo sapiens
tctacttctgctttt

SEQ ID NO: 170350 - DNA, 15 bp, Homo sapiens
atctacttctgcttt

SEQ ID NO: 170351 - DNA, 15 bp, Homo sapiens
catctacttctgctt

SEQ ID NO: 170352 - DNA, 15 bp, Homo sapiens
acatctacttctgct

SEQ ID NO: 170353 - DNA, 15 bp, Homo sapiens
cacatctacttctgc

SEQ ID NO: 170354 - DNA, 15 bp, Homo sapiens
ccacatctacttctg

SEQ ID NO: 170355 - DNA, 15 bp, Homo sapiens
cccacatctacttct

SEQ ID NO: 170356 - DNA, 15 bp, Homo sapiens
gcccacatctacttc

SEQ ID NO: 170357 - DNA, 15 bp, Homo sapiens
tgcccacatctactt

SEQ ID NO: 170358 - DNA, 15 bp, Homo sapiens
ctgcccacatctact

SEQ ID NO: 170359 - DNA, 15 bp, Homo sapiens
actgcccacatctac

SEQ ID NO: 170360 - DNA, 15 bp, Homo sapiens
aactgcccacatcta

SEQ ID NO: 170361 - DNA, 15 bp, Homo sapiens
aaactgcccacatct

SEQ ID NO: 170362 - DNA, 15 bp, Homo sapiens
caaactgcccacatc

SEQ ID NO: 170363 - DNA, 15 bp, Homo sapiens
tcaaactgcccacat

SEQ ID NO: 170364 - DNA, 15 bp, Homo sapiens
ttcaaactgcccaca

SEQ ID NO: 170365 - DNA, 15 bp, Homo sapiens
attcaaactgcccac

SEQ ID NO: 170366 - DNA, 15 bp, Homo sapiens
aattcaaactgccca

SEQ ID NO: 170367 - DNA, 15 bp, Homo sapiens
caattcaaactgccc

SEQ ID NO: 170368 - DNA, 15 bp, Homo sapiens
ccaattcaaactgcc

SEQ ID NO: 170369 - DNA, 15 bp, Homo sapiens
accaattcaaactgc

SEQ ID NO: 170370 - DNA, 15 bp, Homo sapiens
taccaattcaaactg

SEQ ID NO: 170371 - DNA, 15 bp, Homo sapiens
ctaccaattcaaact

SEQ ID NO: 170372 - DNA, 15 bp, Homo sapiens
tctaccaattcaaac

SEQ ID NO: 170373 - DNA, 15 bp, Homo sapiens
ttctaccaattcaaa

SEQ ID NO: 170374 - DNA, 15 bp, Homo sapiens
tttctaccaattcaa

SEQ ID NO: 170375 - DNA, 15 bp, Homo sapiens
ttttctaccaattca

SEQ ID NO: 170376 - DNA, 15 bp, Homo sapiens
attttctaccaattc

SEQ ID NO: 170377 - DNA, 15 bp, Homo sapiens
tattttctaccaatt

SEQ ID NO: 170378 - DNA, 15 bp, Homo sapiens
ctattttctaccaat

SEQ ID NO: 170379 - DNA, 15 bp, Homo sapiens
gctattttctaccaa

SEQ ID NO: 170380 - DNA, 15 bp, Homo sapiens
ggctattttctacca

SEQ ID NO: 170381 - DNA, 15 bp, Homo sapiens
tggctattttctacc

SEQ ID NO: 170382 - DNA, 15 bp, Homo sapiens
gtggctattttctac

SEQ ID NO: 170383 - DNA, 15 bp, Homo sapiens
agtggctattttcta

SEQ ID NO: 170384 - DNA, 15 bp, Homo sapiens
cagtggctattttct

SEQ ID NO: 170385 - DNA, 15 bp, Homo sapiens
tcagtggctattttc

SEQ ID NO: 170386 - DNA, 15 bp, Homo sapiens
atcagtggctatttt

SEQ ID NO: 170387 - DNA, 15 bp, Homo sapiens
tatcagtggctattt

SEQ ID NO: 170388 - DNA, 15 bp, Homo sapiens
gtatcagtggctatt

SEQ ID NO: 170389 - DNA, 15 bp, Homo sapiens
ggtatcagtggctat

SEQ ID NO: 170390 - DNA, 15 bp, Homo sapiens
aggtatcagtggcta

SEQ ID NO: 170391 - DNA, 15 bp, Homo sapiens
caggtatcagtggct

SEQ ID NO: 170392 - DNA, 15 bp, Homo sapiens
ccaggtatcagtggc

SEQ ID NO: 170393 - DNA, 15 bp, Homo sapiens
accaggtatcagtgg

SEQ ID NO: 170394 - DNA, 15 bp, Homo sapiens
aaccaggtatcagtg

SEQ ID NO: 170395 - DNA, 15 bp, Homo sapiens
taaccaggtatcagt

SEQ ID NO: 170396 - DNA, 15 bp, Homo sapiens
ataaccaggtatcag

SEQ ID NO: 170397 - DNA, 15 bp, Homo sapiens
gataaccaggtatca

SEQ ID NO: 170398 - DNA, 15 bp, Homo sapiens
tgataaccaggtatc

SEQ ID NO: 170399 - DNA, 15 bp, Homo sapiens
atgataaccaggtat

SEQ ID NO: 170400 - DNA, 15 bp, Homo sapiens
catgataaccaggta

SEQ ID NO: 170401 - DNA, 15 bp, Homo sapiens
ccatgataaccaggt

SEQ ID NO: 170402 - DNA, 15 bp, Homo sapiens
cccatgataaccagg

SEQ ID NO: 170403 - DNA, 15 bp, Homo sapiens
acccatgataaccag

SEQ ID NO: 170404 - DNA, 15 bp, Homo sapiens
cacccatgataacca

SEQ ID NO: 170405 - DNA, 15 bp, Homo sapiens
acacccatgataacc

SEQ ID NO: 170406 - DNA, 15 bp, Homo sapiens
cacacccatgataac

SEQ ID NO: 170407 - DNA, 15 bp, Homo sapiens
gcacacccatgataa

SEQ ID NO: 170408 - DNA, 15 bp, Homo sapiens
cgcacacccatgata

SEQ ID NO: 170409 - DNA, 15 bp, Homo sapiens
tcgcacacccatgat

SEQ ID NO: 170410 - DNA, 15 bp, Homo sapiens
ctcgcacacccatga

SEQ ID NO: 170411 - DNA, 15 bp, Homo sapiens
tctcgcacacccatg

SEQ ID NO: 170412 - DNA, 15 bp, Homo sapiens
ctctcgcacacccat

SEQ ID NO: 170413 - DNA, 15 bp, Homo sapiens
cctctcgcacaccca

SEQ ID NO: 170414 - DNA, 15 bp, Homo sapiens
ccctctcgcacaccc

SEQ ID NO: 170415 - DNA, 15 bp, Homo sapiens
cccctctcgcacacc

SEQ ID NO: 170416 - DNA, 15 bp, Homo sapiens
tcccctctcgcacac

SEQ ID NO: 170417 - DNA, 15 bp, Homo sapiens
ctcccctctcgcaca

SEQ ID NO: 170418 - DNA, 15 bp, Homo sapiens
cctcccctctcgcac

SEQ ID NO: 170419 - DNA, 15 bp, Homo sapiens
ccctcccctctcgca

SEQ ID NO: 170420 - DNA, 15 bp, Homo sapiens
tccctcccctctcgc

SEQ ID NO: 170421 - DNA, 15 bp, Homo sapiens
ttccctcccctctcg

SEQ ID NO: 170422 - DNA, 15 bp, Homo sapiens
gttccctcccctctc

SEQ ID NO: 170423 - DNA, 15 bp, Homo sapiens
tgttccctcccctct

SEQ ID NO: 170424 - DNA, 15 bp, Homo sapiens
atgttccctcccctc

SEQ ID NO: 170425 - DNA, 15 bp, Homo sapiens
aatgttccctcccct

SEQ ID NO: 170426 - DNA, 15 bp, Homo sapiens
aaatgttccctcccc

SEQ ID NO: 170427 - DNA, 15 bp, Homo sapiens
caaatgttccctccc

SEQ ID NO: 170428 - DNA, 15 bp, Homo sapiens
ccaaatgttccctcc

SEQ ID NO: 170429 - DNA, 15 bp, Homo sapiens
tccaaatgttccctc

SEQ ID NO: 170430 - DNA, 15 bp, Homo sapiens
ctccaaatgttccct

SEQ ID NO: 170431 - DNA, 15 bp, Homo sapiens
tctccaaatgttccc

SEQ ID NO: 170432 - DNA, 15 bp, Homo sapiens
atctccaaatgttcc

SEQ ID NO: 170433 - DNA, 15 bp, Homo sapiens
tatctccaaatgttc

SEQ ID NO: 170434 - DNA, 15 bp, Homo sapiens
gtatctccaaatgtt

SEQ ID NO: 170435 - DNA, 15 bp, Homo sapiens
agtatctccaaatgt

SEQ ID NO: 170436 - DNA, 15 bp, Homo sapiens
aagtatctccaaatg

SEQ ID NO: 170437 - DNA, 15 bp, Homo sapiens
gaagtatctccaaat

SEQ ID NO: 170438 - DNA, 15 bp, Homo sapiens
ggaagtatctccaaa

SEQ ID NO: 170439 - DNA, 15 bp, Homo sapiens
tggaagtatctccaa

SEQ ID NO: 170440 - DNA, 15 bp, Homo sapiens
ttggaagtatctcca

SEQ ID NO: 170441 - DNA, 15 bp, Homo sapiens
tttggaagtatctcc

SEQ ID NO: 170442 - DNA, 15 bp, Homo sapiens
ttttggaagtatctc

SEQ ID NO: 170443 - DNA, 15 bp, Homo sapiens
attttggaagtatct

SEQ ID NO: 170444 - DNA, 15 bp, Homo sapiens
aattttggaagtatc

SEQ ID NO: 170445 - DNA, 15 bp, Homo sapiens
aaattttggaagtat

SEQ ID NO: 170446 - DNA, 15 bp, Homo sapiens
gaaattttggaagta

SEQ ID NO: 170447 - DNA, 15 bp, Homo sapiens
tgaaattttggaagt

SEQ ID NO: 170448 - DNA, 15 bp, Homo sapiens
ctgaaattttggaag

SEQ ID NO: 170449 - DNA, 15 bp, Homo sapiens
actgaaattttggaa

SEQ ID NO: 170450 - DNA, 15 bp, Homo sapiens
aactgaaattttgga

SEQ ID NO: 170451 - DNA, 15 bp, Homo sapiens
gaactgaaattttgg

SEQ ID NO: 170452 - DNA, 15 bp, Homo sapiens
tgaactgaaattttg

SEQ ID NO: 170453 - DNA, 15 bp, Homo sapiens
ctgaactgaaatttt

SEQ ID NO: 170454 - DNA, 15 bp, Homo sapiens
tctgaactgaaattt

SEQ ID NO: 170455 - DNA, 15 bp, Homo sapiens
ttctgaactgaaatt

SEQ ID NO: 170456 - DNA, 15 bp, Homo sapiens
cttctgaactgaaat

SEQ ID NO: 170457 - DNA, 15 bp, Homo sapiens
tcttctgaactgaaa

SEQ ID NO: 170458 - DNA, 15 bp, Homo sapiens
atcttctgaactgaa

SEQ ID NO: 170459 - DNA, 15 bp, Homo sapiens
gatcttctgaactga

SEQ ID NO: 170460 - DNA, 15 bp, Homo sapiens
tgatcttctgaactg

SEQ ID NO: 170461 - DNA, 15 bp, Homo sapiens
ctgatcttctgaact

SEQ ID NO: 170462 - DNA, 15 bp, Homo sapiens
tctgatcttctgaac

SEQ ID NO: 170463 - DNA, 15 bp, Homo sapiens
ttctgatcttctgaa

SEQ ID NO: 170464 - DNA, 15 bp, Homo sapiens
cttctgatcttctga

SEQ ID NO: 170465 - DNA, 15 bp, Homo sapiens
ccttctgatcttctg

SEQ ID NO: 170466 - DNA, 15 bp, Homo sapiens
cccttctgatcttct

SEQ ID NO: 170467 - DNA, 15 bp, Homo sapiens
acccttctgatcttc

SEQ ID NO: 170468 - DNA, 15 bp, Homo sapiens
cacccttctgatctt

SEQ ID NO: 170469 - DNA, 15 bp, Homo sapiens
ccacccttctgatct

SEQ ID NO: 170470 - DNA, 15 bp, Homo sapiens
gccacccttctgatc

SEQ ID NO: 170471 - DNA, 15 bp, Homo sapiens
ggccacccttctgat

SEQ ID NO: 170472 - DNA, 15 bp, Homo sapiens
cggccacccttctga

SEQ ID NO: 170473 - DNA, 15 bp, Homo sapiens
ccggccacccttctg

SEQ ID NO: 170474 - DNA, 15 bp, Homo sapiens
cccggccacccttct

SEQ ID NO: 170475 - DNA, 15 bp, Homo sapiens
ccccggccacccttc

SEQ ID NO: 170476 - DNA, 15 bp, Homo sapiens
cccccggccaccctt

SEQ ID NO: 170477 - DNA, 15 bp, Homo sapiens
gcccccggccaccct

SEQ ID NO: 170478 - DNA, 15 bp, Homo sapiens
ggcccccggccaccc

SEQ ID NO: 170479 - DNA, 15 bp, Homo sapiens
tggcccccggccacc

SEQ ID NO: 170480 - DNA, 15 bp, Homo sapiens
atggcccccggccac

SEQ ID NO: 170481 - DNA, 15 bp, Homo sapiens
aatggcccccggcca

SEQ ID NO: 170482 - DNA, 15 bp, Homo sapiens
taatggcccccggcc

SEQ ID NO: 170483 - DNA, 15 bp, Homo sapiens
gtaatggcccccggc

SEQ ID NO: 170484 - DNA, 15 bp, Homo sapiens
ggtaatggcccccgg

SEQ ID NO: 170485 - DNA, 15 bp, Homo sapiens
tggtaatggcccccg

SEQ ID NO: 170486 - DNA, 15 bp, Homo sapiens
ctggtaatggccccc

SEQ ID NO: 170487 - DNA, 15 bp, Homo sapiens
cctggtaatggcccc

SEQ ID NO: 170488 - DNA, 15 bp, Homo sapiens
tcctggtaatggccc

SEQ ID NO: 170489 - DNA, 15 bp, Homo sapiens
ttcctggtaatggcc

SEQ ID NO: 170490 - DNA, 15 bp, Homo sapiens
cttcctggtaatggc

SEQ ID NO: 170491 - DNA, 15 bp, Homo sapiens
tcttcctggtaatgg

SEQ ID NO: 170492 - DNA, 15 bp, Homo sapiens
ctcttcctggtaatg

SEQ ID NO: 170493 - DNA, 15 bp, Homo sapiens
actcttcctggtaat

SEQ ID NO: 170494 - DNA, 15 bp, Homo sapiens
cactcttcctggtaa

SEQ ID NO: 170495 - DNA, 15 bp, Homo sapiens
tcactcttcctggta

SEQ ID NO: 170496 - DNA, 15 bp, Homo sapiens
ttcactcttcctggt

SEQ ID NO: 170497 - DNA, 15 bp, Homo sapiens
cttcactcttcctgg

SEQ ID NO: 170498 - DNA, 15 bp, Homo sapiens
acttcactcttcctg

SEQ ID NO: 170499 - DNA, 15 bp, Homo sapiens
cacttcactcttcct

SEQ ID NO: 170500 - DNA, 15 bp, Homo sapiens
tcacttcactcttcc

SEQ ID NO: 170501 - DNA, 15 bp, Homo sapiens
ctcacttcactcttc

SEQ ID NO: 170502 - DNA, 15 bp, Homo sapiens
cctcacttcactctt

SEQ ID NO: 170503 - DNA, 15 bp, Homo sapiens
ccctcacttcactct

SEQ ID NO: 170504 - DNA, 15 bp, Homo sapiens
accctcacttcactc

SEQ ID NO: 170505 - DNA, 15 bp, Homo sapiens
taccctcacttcact

SEQ ID NO: 170506 - DNA, 15 bp, Homo sapiens
ttaccctcacttcac

SEQ ID NO: 170507 - DNA, 15 bp, Homo sapiens
cttaccctcacttca

SEQ ID NO: 170508 - DNA, 15 bp, Homo sapiens
ccttaccctcacttc

SEQ ID NO: 170509 - DNA, 15 bp, Homo sapiens
accttaccctcactt

SEQ ID NO: 170510 - DNA, 15 bp, Homo sapiens
aaccttaccctcact

SEQ ID NO: 170511 - DNA, 15 bp, Homo sapiens
caaccttaccctcac

SEQ ID NO: 170512 - DNA, 15 bp, Homo sapiens
tcaaccttaccctca

SEQ ID NO: 170513 - DNA, 15 bp, Homo sapiens
gtcaaccttaccctc

SEQ ID NO: 170514 - DNA, 15 bp, Homo sapiens
agtcaaccttaccct

SEQ ID NO: 170515 - DNA, 15 bp, Homo sapiens
cagtcaaccttaccc

SEQ ID NO: 170516 - DNA, 15 bp, Homo sapiens
ccagtcaaccttacc

SEQ ID NO: 170517 - DNA, 15 bp, Homo sapiens
cccagtcaaccttac

SEQ ID NO: 170518 - DNA, 15 bp, Homo sapiens
ccccagtcaacctta

SEQ ID NO: 170519 - DNA, 15 bp, Homo sapiens
gccccagtcaacctt

SEQ ID NO: 170520 - DNA, 15 bp, Homo sapiens
agccccagtcaacct

SEQ ID NO: 170521 - DNA, 15 bp, Homo sapiens
cagccccagtcaacc

SEQ ID NO: 170522 - DNA, 15 bp, Homo sapiens
ccagccccagtcaac

SEQ ID NO: 170523 - DNA, 15 bp, Homo sapiens
cccagccccagtcaa

SEQ ID NO: 170524 - DNA, 15 bp, Homo sapiens
gcccagccccagtca

SEQ ID NO: 170525 - DNA, 15 bp, Homo sapiens
tgcccagccccagtc

SEQ ID NO: 170526 - DNA, 15 bp, Homo sapiens
ctgcccagccccagt

SEQ ID NO: 170527 - DNA, 15 bp, Homo sapiens
tctgcccagccccag

SEQ ID NO: 170528 - DNA, 15 bp, Homo sapiens
ttctgcccagcccca

SEQ ID NO: 170529 - DNA, 15 bp, Homo sapiens
cttctgcccagcccc

SEQ ID NO: 170530 - DNA, 15 bp, Homo sapiens
ccttctgcccagccc

SEQ ID NO: 170531 - DNA, 15 bp, Homo sapiens
cccttctgcccagcc

SEQ ID NO: 170532 - DNA, 15 bp, Homo sapiens
ccccttctgcccagc

SEQ ID NO: 170533 - DNA, 15 bp, Homo sapiens
gccccttctgcccag

SEQ ID NO: 170534 - DNA, 15 bp, Homo sapiens
tgccccttctgccca

SEQ ID NO: 170535 - DNA, 15 bp, Homo sapiens
ttgccccttctgccc

SEQ ID NO: 170536 - DNA, 15 bp, Homo sapiens
attgccccttctgcc

SEQ ID NO: 170537 - DNA, 15 bp, Homo sapiens
cattgccccttctgc

SEQ ID NO: 170538 - DNA, 15 bp, Homo sapiens
ccattgccccttctg

SEQ ID NO: 170539 - DNA, 15 bp, Homo sapiens
cccattgccccttct

SEQ ID NO: 170540 - DNA, 15 bp, Homo sapiens
tcccattgccccttc

SEQ ID NO: 170541 - DNA, 15 bp, Homo sapiens
ttcccattgcccctt

SEQ ID NO: 170542 - DNA, 15 bp, Homo sapiens
cttcccattgcccct

SEQ ID NO: 170543 - DNA, 15 bp, Homo sapiens
ccttcccattgcccc

SEQ ID NO: 170544 - DNA, 15 bp, Homo sapiens
tccttcccattgccc

SEQ ID NO: 170545 - DNA, 15 bp, Homo sapiens
ctccttcccattgcc

SEQ ID NO: 170546 - DNA, 15 bp, Homo sapiens
tctccttcccattgc

SEQ ID NO: 170547 - DNA, 15 bp, Homo sapiens
atctccttcccattg

SEQ ID NO: 170548 - DNA, 15 bp, Homo sapiens
catctccttcccatt

SEQ ID NO: 170549 - DNA, 15 bp, Homo sapiens
tcatctccttcccat

SEQ ID NO: 170550 - DNA, 15 bp, Homo sapiens
ctcatctccttccca

SEQ ID NO: 170551 - DNA, 15 bp, Homo sapiens
cctcatctccttccc

SEQ ID NO: 170552 - DNA, 15 bp, Homo sapiens
tcctcatctccttcc

SEQ ID NO: 170553 - DNA, 15 bp, Homo sapiens
ctcctcatctccttc

SEQ ID NO: 170554 - DNA, 15 bp, Homo sapiens
actcctcatctcctt

SEQ ID NO: 170555 - DNA, 15 bp, Homo sapiens
aactcctcatctcct

SEQ ID NO: 170556 - DNA, 15 bp, Homo sapiens
aaactcctcatctcc

SEQ ID NO: 170557 - DNA, 15 bp, Homo sapiens
aaaactcctcatctc

SEQ ID NO: 170558 - DNA, 15 bp, Homo sapiens
gaaaactcctcatct

SEQ ID NO: 170559 - DNA, 15 bp, Homo sapiens
cgaaaactcctcatc

SEQ ID NO: 170560 - DNA, 15 bp, Homo sapiens
ccgaaaactcctcat

SEQ ID NO: 170561 - DNA, 15 bp, Homo sapiens
gccgaaaactcctca

SEQ ID NO: 170562 - DNA, 15 bp, Homo sapiens
agccgaaaactcctc

SEQ ID NO: 170563 - DNA, 15 bp, Homo sapiens
aagccgaaaactcct

SEQ ID NO: 170564 - DNA, 15 bp, Homo sapiens
gaagccgaaaactcc

SEQ ID NO: 170565 - DNA, 15 bp, Homo sapiens
tgaagccgaaaactc

SEQ ID NO: 170566 - DNA, 15 bp, Homo sapiens
atgaagccgaaaact

SEQ ID NO: 170567 - DNA, 15 bp, Homo sapiens
aatgaagccgaaaac

SEQ ID NO: 170568 - DNA, 15 bp, Homo sapiens
caatgaagccgaaaa

SEQ ID NO: 170569 - DNA, 15 bp, Homo sapiens
tcaatgaagccgaaa

SEQ ID NO: 170570 - DNA, 15 bp, Homo sapiens
gtcaatgaagccgaa

SEQ ID NO: 170571 - DNA, 15 bp, Homo sapiens
tgtcaatgaagccga

SEQ ID NO: 170572 - DNA, 15 bp, Homo sapiens
atgtcaatgaagccg

SEQ ID NO: 170573 - DNA, 15 bp, Homo sapiens
gatgtcaatgaagcc

SEQ ID NO: 170574 - DNA, 15 bp, Homo sapiens
ggatgtcaatgaagc

SEQ ID NO: 170575 - DNA, 15 bp, Homo sapiens
aggatgtcaatgaag

SEQ ID NO: 170576 - DNA, 15 bp, Homo sapiens
caggatgtcaatgaa

SEQ ID NO: 170577 - DNA, 15 bp, Homo sapiens
ccaggatgtcaatga

SEQ ID NO: 170578 - DNA, 15 bp, Homo sapiens
gccaggatgtcaatg

SEQ ID NO: 170579 - DNA, 15 bp, Homo sapiens
tgccaggatgtcaat

SEQ ID NO: 170580 - DNA, 15 bp, Homo sapiens
ctgccaggatgtcaa

SEQ ID NO: 170581 - DNA, 15 bp, Homo sapiens
gctgccaggatgtca

SEQ ID NO: 170582 - DNA, 15 bp, Homo sapiens
agctgccaggatgtc

SEQ ID NO: 170583 - DNA, 15 bp, Homo sapiens
tagctgccaggatgt

SEQ ID NO: 170584 - DNA, 15 bp, Homo sapiens
ttagctgccaggatg

SEQ ID NO: 170585 - DNA, 15 bp, Homo sapiens
cttagctgccaggat

SEQ ID NO: 170586 - DNA, 15 bp, Homo sapiens
acttagctgccagga

SEQ ID NO: 170587 - DNA, 15 bp, Homo sapiens
gacttagctgccagg

SEQ ID NO: 170588 - DNA, 15 bp, Homo sapiens
tgacttagctgccag

SEQ ID NO: 170589 - DNA, 15 bp, Homo sapiens
ctgacttagctgcca

SEQ ID NO: 170590 - DNA, 15 bp, Homo sapiens
gctgacttagctgcc

SEQ ID NO: 170591 - DNA, 15 bp, Homo sapiens
agctgacttagctgc

SEQ ID NO: 170592 - DNA, 15 bp, Homo sapiens
gagctgacttagctg

SEQ ID NO: 170593 - DNA, 15 bp, Homo sapiens
agagctgacttagct

SEQ ID NO: 170594 - DNA, 15 bp, Homo sapiens
gagagctgacttagc

SEQ ID NO: 170595 - DNA, 15 bp, Homo sapiens
ggagagctgacttag

SEQ ID NO: 170596 - DNA, 15 bp, Homo sapiens
tggagagctgactta

SEQ ID NO: 170597 - DNA, 15 bp, Homo sapiens
ctggagagctgactt

SEQ ID NO: 170598 - DNA, 15 bp, Homo sapiens
gctggagagctgact

SEQ ID NO: 170599 - DNA, 15 bp, Homo sapiens
agctggagagctgac

SEQ ID NO: 170600 - DNA, 15 bp, Homo sapiens
tagctggagagctga

SEQ ID NO: 170601 - DNA, 15 bp, Homo sapiens
ctagctggagagctg

SEQ ID NO: 170602 - DNA, 15 bp, Homo sapiens
tctagctggagagct

SEQ ID NO: 170603 - DNA, 15 bp, Homo sapiens
ttctagctggagagc

SEQ ID NO: 170604 - DNA, 15 bp, Homo sapiens
tttctagctggagag

SEQ ID NO: 170605 - DNA, 15 bp, Homo sapiens
atttctagctggaga

SEQ ID NO: 170606 - DNA, 15 bp, Homo sapiens
catttctagctggag

SEQ ID NO: 170607 - DNA, 15 bp, Homo sapiens
acatttctagctgga

SEQ ID NO: 170608 - DNA, 15 bp, Homo sapiens
cacatttctagctgg

SEQ ID NO: 170609 - DNA, 15 bp, Homo sapiens
gcacatttctagctg

SEQ ID NO: 170610 - DNA, 15 bp, Homo sapiens
tgcacatttctagct

SEQ ID NO: 170611 - DNA, 15 bp, Homo sapiens
ctgcacatttctagc

SEQ ID NO: 170612 - DNA, 15 bp, Homo sapiens
gctgcacatttctag

SEQ ID NO: 170613 - DNA, 15 bp, Homo sapiens
tgctgcacatttcta

SEQ ID NO: 170614 - DNA, 15 bp, Homo sapiens
ctgctgcacatttct

SEQ ID NO: 170615 - DNA, 15 bp, Homo sapiens
cctgctgcacatttc

SEQ ID NO: 170616 - DNA, 15 bp, Homo sapiens
gcctgctgcacattt

SEQ ID NO: 170617 - DNA, 15 bp, Homo sapiens
tgcctgctgcacatt

SEQ ID NO: 170618 - DNA, 15 bp, Homo sapiens
ctgcctgctgcacat

SEQ ID NO: 170619 - DNA, 15 bp, Homo sapiens
actgcctgctgcaca

SEQ ID NO: 170620 - DNA, 15 bp, Homo sapiens
cactgcctgctgcac

SEQ ID NO: 170621 - DNA, 15 bp, Homo sapiens
ccactgcctgctgca

SEQ ID NO: 170622 - DNA, 15 bp, Homo sapiens
accactgcctgctgc

SEQ ID NO: 170623 - DNA, 15 bp, Homo sapiens
caccactgcctgctg

SEQ ID NO: 170624 - DNA, 15 bp, Homo sapiens
tcaccactgcctgct

SEQ ID NO: 170625 - DNA, 15 bp, Homo sapiens
atcaccactgcctgc

SEQ ID NO: 170626 - DNA, 15 bp, Homo sapiens
tatcaccactgcctg

SEQ ID NO: 170627 - DNA, 15 bp, Homo sapiens
gtatcaccactgcct

SEQ ID NO: 170628 - DNA, 15 bp, Homo sapiens
tgtatcaccactgcc

SEQ ID NO: 170629 - DNA, 15 bp, Homo sapiens
ctgtatcaccactgc

SEQ ID NO: 170630 - DNA, 15 bp, Homo sapiens
actgtatcaccactg

SEQ ID NO: 170631 - DNA, 15 bp, Homo sapiens
tactgtatcaccact

SEQ ID NO: 170632 - DNA, 15 bp, Homo sapiens
gtactgtatcaccac

SEQ ID NO: 170633 - DNA, 15 bp, Homo sapiens
agtactgtatcacca

SEQ ID NO: 170634 - DNA, 15 bp, Homo sapiens
tagtactgtatcacc

SEQ ID NO: 170635 - DNA, 15 bp, Homo sapiens
ttagtactgtatcac

SEQ ID NO: 170636 - DNA, 15 bp, Homo sapiens
cttagtactgtatca

SEQ ID NO: 170637 - DNA, 15 bp, Homo sapiens
tcttagtactgtatc

SEQ ID NO: 170638 - DNA, 15 bp, Homo sapiens
atcttagtactgtat

SEQ ID NO: 170639 - DNA, 15 bp, Homo sapiens
tatcttagtactgta

SEQ ID NO: 170640 - DNA, 15 bp, Homo sapiens
ctatcttagtactgt

SEQ ID NO: 170641 - DNA, 15 bp, Homo sapiens
cctatcttagtactg

SEQ ID NO: 170642 - DNA, 15 bp, Homo sapiens
tcctatcttagtact

SEQ ID NO: 170643 - DNA, 15 bp, Homo sapiens
atcctatcttagtac

SEQ ID NO: 170644 - DNA, 15 bp, Homo sapiens
tatcctatcttagta

SEQ ID NO: 170645 - DNA, 15 bp, Homo sapiens
ctatcctatcttagt

SEQ ID NO: 170646 - DNA, 15 bp, Homo sapiens
cctatcctatcttag

SEQ ID NO: 170647 - DNA, 15 bp, Homo sapiens
tcctatcctatctta

SEQ ID NO: 170648 - DNA, 15 bp, Homo sapiens
ttcctatcctatctt

SEQ ID NO: 170649 - DNA, 15 bp, Homo sapiens
cttcctatcctatct

SEQ ID NO: 170650 - DNA, 15 bp, Homo sapiens
acttcctatcctatc

SEQ ID NO: 170651 - DNA, 15 bp, Homo sapiens
gacttcctatcctat

SEQ ID NO: 170652 - DNA, 15 bp, Homo sapiens
tgacttcctatccta

SEQ ID NO: 170653 - DNA, 15 bp, Homo sapiens
ctgacttcctatcct

SEQ ID NO: 170654 - DNA, 15 bp, Homo sapiens
cctgacttcctatcc

SEQ ID NO: 170655 - DNA, 15 bp, Homo sapiens
acctgacttcctatc

SEQ ID NO: 170656 - DNA, 15 bp, Homo sapiens
gacctgacttcctat

SEQ ID NO: 170657 - DNA, 15 bp, Homo sapiens
agacctgacttccta

SEQ ID NO: 170658 - DNA, 15 bp, Homo sapiens
aagacctgacttcct

SEQ ID NO: 170659 - DNA, 15 bp, Homo sapiens
aaagacctgacttcc

SEQ ID NO: 170660 - DNA, 15 bp, Homo sapiens
taaagacctgacttc

SEQ ID NO: 170661 - DNA, 15 bp, Homo sapiens
gtaaagacctgactt

SEQ ID NO: 170662 - DNA, 15 bp, Homo sapiens
cgtaaagacctgact

SEQ ID NO: 170663 - DNA, 15 bp, Homo sapiens
tcgtaaagacctgac

SEQ ID NO: 170664 - DNA, 15 bp, Homo sapiens
ctcgtaaagacctga

SEQ ID NO: 170665 - DNA, 15 bp, Homo sapiens
tctcgtaaagacctg

SEQ ID NO: 170666 - DNA, 15 bp, Homo sapiens
ctctcgtaaagacct

SEQ ID NO: 170667 - DNA, 15 bp, Homo sapiens
gctctcgtaaagacc

SEQ ID NO: 170668 - DNA, 15 bp, Homo sapiens
tgctctcgtaaagac

SEQ ID NO: 170669 - DNA, 15 bp, Homo sapiens
atgctctcgtaaaga

SEQ ID NO: 170670 - DNA, 15 bp, Homo sapiens
aatgctctcgtaaag

SEQ ID NO: 170671 - DNA, 15 bp, Homo sapiens
aaatgctctcgtaaa

SEQ ID NO: 170672 - DNA, 15 bp, Homo sapiens
gaaatgctctcgtaa

SEQ ID NO: 170673 - DNA, 15 bp, Homo sapiens
tgaaatgctctcgta

SEQ ID NO: 170674 - DNA, 15 bp, Homo sapiens
ctgaaatgctctcgt

SEQ ID NO: 170675 - DNA, 15 bp, Homo sapiens
actgaaatgctctcg

SEQ ID NO: 170676 - DNA, 15 bp, Homo sapiens
tactgaaatgctctc

SEQ ID NO: 170677 - DNA, 15 bp, Homo sapiens
ttactgaaatgctct

SEQ ID NO: 170678 - DNA, 15 bp, Homo sapiens
tttactgaaatgctc

SEQ ID NO: 170679 - DNA, 15 bp, Homo sapiens
atttactgaaatgct

SEQ ID NO: 170680 - DNA, 15 bp, Homo sapiens
tatttactgaaatgc

SEQ ID NO: 170681 - DNA, 15 bp, Homo sapiens
ctatttactgaaatg

SEQ ID NO: 170682 - DNA, 15 bp, Homo sapiens
gctatttactgaaat

SEQ ID NO: 170683 - DNA, 15 bp, Homo sapiens
ggctatttactgaaa

SEQ ID NO: 170684 - DNA, 15 bp, Homo sapiens
aggctatttactgaa

SEQ ID NO: 170685 - DNA, 15 bp, Homo sapiens
aaggctatttactga

SEQ ID NO: 170686 - DNA, 15 bp, Homo sapiens
taaggctatttactg

SEQ ID NO: 170687 - DNA, 15 bp, Homo sapiens
ctaaggctatttact

SEQ ID NO: 170688 - DNA, 15 bp, Homo sapiens
cctaaggctatttac

SEQ ID NO: 170689 - DNA, 15 bp, Homo sapiens
tcctaaggctattta

SEQ ID NO: 170690 - DNA, 15 bp, Homo sapiens
ttcctaaggctattt

SEQ ID NO: 170691 - DNA, 15 bp, Homo sapiens
gttcctaaggctatt

SEQ ID NO: 170692 - DNA, 15 bp, Homo sapiens
agttcctaaggctat

SEQ ID NO: 170693 - DNA, 15 bp, Homo sapiens
aagttcctaaggcta

SEQ ID NO: 170694 - DNA, 15 bp, Homo sapiens
taagttcctaaggct

SEQ ID NO: 170695 - DNA, 15 bp, Homo sapiens
ctaagttcctaaggc

SEQ ID NO: 170696 - DNA, 15 bp, Homo sapiens
tctaagttcctaagg

SEQ ID NO: 170697 - DNA, 15 bp, Homo sapiens
atctaagttcctaag

SEQ ID NO: 170698 - DNA, 15 bp, Homo sapiens
aatctaagttcctaa

SEQ ID NO: 170699 - DNA, 15 bp, Homo sapiens
taatctaagttccta

SEQ ID NO: 170700 - DNA, 15 bp, Homo sapiens
ttaatctaagttcct

SEQ ID NO: 170701 - DNA, 15 bp, Homo sapiens
tttaatctaagttcc

SEQ ID NO: 170702 - DNA, 15 bp, Homo sapiens
ttttaatctaagttc

SEQ ID NO: 170703 - DNA, 15 bp, Homo sapiens
tttttaatctaagtt

SEQ ID NO: 170704 - DNA, 15 bp, Homo sapiens
atttttaatctaagt

SEQ ID NO: 170705 - DNA, 15 bp, Homo sapiens
gatttttaatctaag

SEQ ID NO: 170706 - DNA, 15 bp, Homo sapiens
tgatttttaatctaa

SEQ ID NO: 170707 - DNA, 15 bp, Homo sapiens
ttgatttttaatcta

SEQ ID NO: 170708 - DNA, 15 bp, Homo sapiens
attgatttttaatct

SEQ ID NO: 170709 - DNA, 15 bp, Homo sapiens
cattgatttttaatc

SEQ ID NO: 170710 - DNA, 15 bp, Homo sapiens
gcattgatttttaat

SEQ ID NO: 170711 - DNA, 15 bp, Homo sapiens
agcattgatttttaa

SEQ ID NO: 170712 - DNA, 15 bp, Homo sapiens
aagcattgattttta

SEQ ID NO: 170713 - DNA, 15 bp, Homo sapiens
caagcattgattttt

SEQ ID NO: 170714 - DNA, 15 bp, Homo sapiens
tcaagcattgatttt

SEQ ID NO: 170715 - DNA, 15 bp, Homo sapiens
atcaagcattgattt

SEQ ID NO: 170716 - DNA, 15 bp, Homo sapiens
catcaagcattgatt

SEQ ID NO: 170717 - DNA, 15 bp, Homo sapiens
tcatcaagcattgat

SEQ ID NO: 170718 - DNA, 15 bp, Homo sapiens
ctcatcaagcattga

SEQ ID NO: 170719 - DNA, 15 bp, Homo sapiens
cctcatcaagcattg

SEQ ID NO: 170720 - DNA, 15 bp, Homo sapiens
gcctcatcaagcatt

SEQ ID NO: 170721 - DNA, 15 bp, Homo sapiens
tgcctcatcaagcat

SEQ ID NO: 170722 - DNA, 15 bp, Homo sapiens
ctgcctcatcaagca

SEQ ID NO: 170723 - DNA, 15 bp, Homo sapiens
actgcctcatcaagc

SEQ ID NO: 170724 - DNA, 15 bp, Homo sapiens
cactgcctcatcaag

SEQ ID NO: 170725 - DNA, 15 bp, Homo sapiens
tcactgcctcatcaa

SEQ ID NO: 170726 - DNA, 15 bp, Homo sapiens
ctcactgcctcatca

SEQ ID NO: 170727 - DNA, 15 bp, Homo sapiens
actcactgcctcatc

SEQ ID NO: 170728 - DNA, 15 bp, Homo sapiens
gactcactgcctcat

SEQ ID NO: 170729 - DNA, 15 bp, Homo sapiens
agactcactgcctca

SEQ ID NO: 170730 - DNA, 15 bp, Homo sapiens
tagactcactgcctc

SEQ ID NO: 170731 - DNA, 15 bp, Homo sapiens
ctagactcactgcct

SEQ ID NO: 170732 - DNA, 15 bp, Homo sapiens
tctagactcactgcc

SEQ ID NO: 170733 - DNA, 15 bp, Homo sapiens
atctagactcactgc

SEQ ID NO: 170734 - DNA, 15 bp, Homo sapiens
gatctagactcactg

SEQ ID NO: 170735 - DNA, 15 bp, Homo sapiens
cgatctagactcact

SEQ ID NO: 170736 - DNA, 15 bp, Homo sapiens
acgatctagactcac

SEQ ID NO: 170737 - DNA, 15 bp, Homo sapiens
aacgatctagactca

SEQ ID NO: 170738 - DNA, 15 bp, Homo sapiens
aaacgatctagactc

SEQ ID NO: 170739 - DNA, 15 bp, Homo sapiens
aaaacgatctagact

SEQ ID NO: 170740 - DNA, 15 bp, Homo sapiens
aaaaacgatctagac

SEQ ID NO: 170741 - DNA, 15 bp, Homo sapiens
caaaaacgatctaga

SEQ ID NO: 170742 - DNA, 15 bp, Homo sapiens
tcaaaaacgatctag

SEQ ID NO: 170743 - DNA, 15 bp, Homo sapiens
gtcaaaaacgatcta

SEQ ID NO: 170744 - DNA, 15 bp, Homo sapiens
tgtcaaaaacgatct

SEQ ID NO: 170745 - DNA, 15 bp, Homo sapiens
ctgtcaaaaacgatc

SEQ ID NO: 170746 - DNA, 15 bp, Homo sapiens
actgtcaaaaacgat

SEQ ID NO: 170747 - DNA, 15 bp, Homo sapiens
cactgtcaaaaacga

SEQ ID NO: 170748 - DNA, 15 bp, Homo sapiens
tcactgtcaaaaacg

SEQ ID NO: 170749 - DNA, 15 bp, Homo sapiens
ttcactgtcaaaaac

SEQ ID NO: 170750 - DNA, 15 bp, Homo sapiens
tttcactgtcaaaaa

SEQ ID NO: 170751 - DNA, 15 bp, Homo sapiens
atttcactgtcaaaa

SEQ ID NO: 170752 - DNA, 15 bp, Homo sapiens
gatttcactgtcaaa

SEQ ID NO: 170753 - DNA, 15 bp, Homo sapiens
tgatttcactgtcaa

SEQ ID NO: 170754 - DNA, 15 bp, Homo sapiens
ttgatttcactgtca

SEQ ID NO: 170755 - DNA, 15 bp, Homo sapiens
tttgatttcactgtc

SEQ ID NO: 170756 - DNA, 15 bp, Homo sapiens
atttgatttcactgt

SEQ ID NO: 170757 - DNA, 15 bp, Homo sapiens
tatttgatttcactg

SEQ ID NO: 170758 - DNA, 15 bp, Homo sapiens
gtatttgatttcact

SEQ ID NO: 170759 - DNA, 15 bp, Homo sapiens
ggtatttgatttcac

SEQ ID NO: 170760 - DNA, 15 bp, Homo sapiens
tggtatttgatttca

SEQ ID NO: 170761 - DNA, 15 bp, Homo sapiens
atggtatttgatttc

SEQ ID NO: 170762 - DNA, 15 bp, Homo sapiens
catggtatttgattt

SEQ ID NO: 170763 - DNA, 15 bp, Homo sapiens
tcatggtatttgatt

SEQ ID NO: 170764 - DNA, 15 bp, Homo sapiens
ttcatggtatttgat

SEQ ID NO: 170765 - DNA, 15 bp, Homo sapiens
attcatggtatttga

SEQ ID NO: 170766 - DNA, 15 bp, Homo sapiens
tattcatggtatttg

SEQ ID NO: 170767 - DNA, 15 bp, Homo sapiens
gtattcatggtattt

SEQ ID NO: 170768 - DNA, 15 bp, Homo sapiens
cgtattcatggtatt

SEQ ID NO: 170769 - DNA, 15 bp, Homo sapiens
acgtattcatggtat

SEQ ID NO: 170770 - DNA, 15 bp, Homo sapiens
aacgtattcatggta

SEQ ID NO: 170771 - DNA, 15 bp, Homo sapiens
caacgtattcatggt

SEQ ID NO: 170772 - DNA, 15 bp, Homo sapiens
tcaacgtattcatgg

SEQ ID NO: 170773 - DNA, 15 bp, Homo sapiens
ctcaacgtattcatg

SEQ ID NO: 170774 - DNA, 15 bp, Homo sapiens
cctcaacgtattcat

SEQ ID NO: 170775 - DNA, 15 bp, Homo sapiens
ccctcaacgtattca

SEQ ID NO: 170776 - DNA, 15 bp, Homo sapiens
tccctcaacgtattc

SEQ ID NO: 170777 - DNA, 15 bp, Homo sapiens
ctccctcaacgtatt

SEQ ID NO: 170778 - DNA, 15 bp, Homo sapiens
actccctcaacgtat

SEQ ID NO: 170779 - DNA, 15 bp, Homo sapiens
tactccctcaacgta

SEQ ID NO: 170780 - DNA, 15 bp, Homo sapiens
ttactccctcaacgt

SEQ ID NO: 170781 - DNA, 15 bp, Homo sapiens
attactccctcaacg

SEQ ID NO: 170782 - DNA, 15 bp, Homo sapiens
cattactccctcaac

SEQ ID NO: 170783 - DNA, 15 bp, Homo sapiens
tcattactccctcaa

SEQ ID NO: 170784 - DNA, 15 bp, Homo sapiens
ctcattactccctca

SEQ ID NO: 170785 - DNA, 15 bp, Homo sapiens
tctcattactccctc

SEQ ID NO: 170786 - DNA, 15 bp, Homo sapiens
gtctcattactccct

SEQ ID NO: 170787 - DNA, 15 bp, Homo sapiens
tgtctcattactccc

SEQ ID NO: 170788 - DNA, 15 bp, Homo sapiens
ctgtctcattactcc

SEQ ID NO: 170789 - DNA, 15 bp, Homo sapiens
tctgtctcattactc

SEQ ID NO: 170790 - DNA, 15 bp, Homo sapiens
ctctgtctcattact

SEQ ID NO: 170791 - DNA, 15 bp, Homo sapiens
tctctgtctcattac

SEQ ID NO: 170792 - DNA, 15 bp, Homo sapiens
atctctgtctcatta

SEQ ID NO: 170793 - DNA, 15 bp, Homo sapiens
aatctctgtctcatt

SEQ ID NO: 170794 - DNA, 15 bp, Homo sapiens
aaatctctgtctcat

SEQ ID NO: 170795 - DNA, 15 bp, Homo sapiens
gaaatctctgtctca

SEQ ID NO: 170796 - DNA, 15 bp, Homo sapiens
agaaatctctgtctc

SEQ ID NO: 170797 - DNA, 15 bp, Homo sapiens
aagaaatctctgtct

SEQ ID NO: 170798 - DNA, 15 bp, Homo sapiens
aaagaaatctctgtc

SEQ ID NO: 170799 - DNA, 15 bp, Homo sapiens
aaaagaaatctctgt

SEQ ID NO: 170800 - DNA, 15 bp, Homo sapiens
aaaaagaaatctctg

SEQ ID NO: 170801 - DNA, 15 bp, Homo sapiens
taaaaagaaatctct

SEQ ID NO: 170802 - DNA, 15 bp, Homo sapiens
ctaaaaagaaatctc

SEQ ID NO: 170803 - DNA, 15 bp, Homo sapiens
tctaaaaagaaatct

SEQ ID NO: 170804 - DNA, 15 bp, Homo sapiens
ttctaaaaagaaatc

SEQ ID NO: 170805 - DNA, 15 bp, Homo sapiens
cttttctaaaaagaa

SEQ ID NO: 170806 - DNA, 15 bp, Homo sapiens
tcttttctaaaaaga

SEQ ID NO: 170807 - DNA, 15 bp, Homo sapiens
ctcttttctaaaaag

SEQ ID NO: 170808 - DNA, 15 bp, Homo sapiens
tctcttttctaaaaa

SEQ ID NO: 170809 - DNA, 15 bp, Homo sapiens
ctctcttttctaaaa

SEQ ID NO: 170810 - DNA, 15 bp, Homo sapiens
gctctcttttctaaa

SEQ ID NO: 170811 - DNA, 15 bp, Homo sapiens
cgctctcttttctaa

SEQ ID NO: 170812 - DNA, 15 bp, Homo sapiens
ccgctctcttttcta

SEQ ID NO: 170813 - DNA, 15 bp, Homo sapiens
tccgctctcttttct

SEQ ID NO: 170814 - DNA, 15 bp, Homo sapiens
ttccgctctcttttc

SEQ ID NO: 170815 - DNA, 15 bp, Homo sapiens
attccgctctctttt

SEQ ID NO: 170816 - DNA, 15 bp, Homo sapiens
cattccgctctcttt

SEQ ID NO: 170817 - DNA, 15 bp, Homo sapiens
acattccgctctctt

SEQ ID NO: 170818 - DNA, 15 bp, Homo sapiens
cacattccgctctct

SEQ ID NO: 170819 - DNA, 15 bp, Homo sapiens
acacattccgctctc

SEQ ID NO: 170820 - DNA, 15 bp, Homo sapiens
aacacattccgctct

SEQ ID NO: 170821 - DNA, 15 bp, Homo sapiens
aaacacattccgctc

SEQ ID NO: 170822 - DNA, 15 bp, Homo sapiens
aaaacacattccgct

SEQ ID NO: 170823 - DNA, 15 bp, Homo sapiens
gaaaacacattccgc

SEQ ID NO: 170824 - DNA, 15 bp, Homo sapiens
agaaaacacattccg

SEQ ID NO: 170825 - DNA, 15 bp, Homo sapiens
gagaaaacacattcc

SEQ ID NO: 170826 - DNA, 15 bp, Homo sapiens
agagaaaacacattc

SEQ ID NO: 170827 - DNA, 15 bp, Homo sapiens
cagagaaaacacatt

SEQ ID NO: 170828 - DNA, 15 bp, Homo sapiens
tcagagaaaacacat

SEQ ID NO: 170829 - DNA, 15 bp, Homo sapiens
ctcagagaaaacaca

SEQ ID NO: 170830 - DNA, 15 bp, Homo sapiens
cctcagagaaaacac

SEQ ID NO: 170831 - DNA, 15 bp, Homo sapiens
ccctcagagaaaaca

SEQ ID NO: 170832 - DNA, 15 bp, Homo sapiens
gccctcagagaaaac

SEQ ID NO: 170833 - DNA, 15 bp, Homo sapiens
tgccctcagagaaaa

SEQ ID NO: 170834 - DNA, 15 bp, Homo sapiens
ctgccctcagagaaa

SEQ ID NO: 170835 - DNA, 15 bp, Homo sapiens
tctgccctcagagaa

SEQ ID NO: 170836 - DNA, 15 bp, Homo sapiens
ctctgccctcagaga

SEQ ID NO: 170837 - DNA, 15 bp, Homo sapiens
actctgccctcagag

SEQ ID NO: 170838 - DNA, 15 bp, Homo sapiens
gactctgccctcaga

SEQ ID NO: 170839 - DNA, 15 bp, Homo sapiens
tgactctgccctcag

SEQ ID NO: 170840 - DNA, 15 bp, Homo sapiens
ctgactctgccctca

SEQ ID NO: 170841 - DNA, 15 bp, Homo sapiens
tctgactctgccctc

SEQ ID NO: 170842 - DNA, 15 bp, Homo sapiens
ttctgactctgccct

SEQ ID NO: 170843 - DNA, 15 bp, Homo sapiens
cttctgactctgccc

SEQ ID NO: 170844 - DNA, 15 bp, Homo sapiens
tcttctgactctgcc

SEQ ID NO: 170845 - DNA, 15 bp, Homo sapiens
ctcttctgactctgc

SEQ ID NO: 170846 - DNA, 15 bp, Homo sapiens
tctcttctgactctg

SEQ ID NO: 170847 - DNA, 15 bp, Homo sapiens
ctctcttctgactct

SEQ ID NO: 170848 - DNA, 15 bp, Homo sapiens
cctctcttctgactc

SEQ ID NO: 170849 - DNA, 15 bp, Homo sapiens
tcctctcttctgact

SEQ ID NO: 170850 - DNA, 15 bp, Homo sapiens
gtcctctcttctgac

SEQ ID NO: 170851 - DNA, 15 bp, Homo sapiens
tgtcctctcttctga

SEQ ID NO: 170852 - DNA, 15 bp, Homo sapiens
ttgtcctctcttctg

SEQ ID NO: 170853 - DNA, 15 bp, Homo sapiens
cttgtcctctcttct

SEQ ID NO: 170854 - DNA, 15 bp, Homo sapiens
tcttgtcctctcttc

SEQ ID NO: 170855 - DNA, 15 bp, Homo sapiens
atcttgtcctctctt

SEQ ID NO: 170856 - DNA, 15 bp, Homo sapiens
catcttgtcctctct

SEQ ID NO: 170857 - DNA, 15 bp, Homo sapiens
tcatcttgtcctctc

SEQ ID NO: 170858 - DNA, 15 bp, Homo sapiens
gtcatcttgtcctct

SEQ ID NO: 170859 - DNA, 15 bp, Homo sapiens
ggtcatcttgtcctc

SEQ ID NO: 170860 - DNA, 15 bp, Homo sapiens
tggtcatcttgtcct

SEQ ID NO: 170861 - DNA, 15 bp, Homo sapiens
atggtcatcttgtcc

SEQ ID NO: 170862 - DNA, 15 bp, Homo sapiens
aatggtcatcttgtc

SEQ ID NO: 170863 - DNA, 15 bp, Homo sapiens
taatggtcatcttgt

SEQ ID NO: 170864 - DNA, 15 bp, Homo sapiens
ataatggtcatcttg

SEQ ID NO: 170865 - DNA, 15 bp, Homo sapiens
tataatggtcatctt

SEQ ID NO: 170866 - DNA, 15 bp, Homo sapiens
ttataatggtcatct

SEQ ID NO: 170867 - DNA, 15 bp, Homo sapiens
gttataatggtcatc

SEQ ID NO: 170868 - DNA, 15 bp, Homo sapiens
tgttataatggtcat

SEQ ID NO: 170869 - DNA, 15 bp, Homo sapiens
ctgttataatggtca

SEQ ID NO: 170870 - DNA, 15 bp, Homo sapiens
tctgttataatggtc

SEQ ID NO: 170871 - DNA, 15 bp, Homo sapiens
ctctgttataatggt

SEQ ID NO: 170872 - DNA, 15 bp, Homo sapiens
cctctgttataatgg

SEQ ID NO: 170873 - DNA, 15 bp, Homo sapiens
tcctctgttataatg

SEQ ID NO: 170874 - DNA, 15 bp, Homo sapiens
ttcctctgttataat

SEQ ID NO: 170875 - DNA, 15 bp, Homo sapiens
tttcctctgttataa

SEQ ID NO: 170876 - DNA, 15 bp, Homo sapiens
tattttcctctgtta

SEQ ID NO: 170877 - DNA, 15 bp, Homo sapiens
ctattttcctctgtt

SEQ ID NO: 170878 - DNA, 15 bp, Homo sapiens
actattttcctctgt

SEQ ID NO: 170879 - DNA, 15 bp, Homo sapiens
cactattttcctctg

SEQ ID NO: 170880 - DNA, 15 bp, Homo sapiens
gcactattttcctct

SEQ ID NO: 170881 - DNA, 15 bp, Homo sapiens
agcactattttcctc

SEQ ID NO: 170882 - DNA, 15 bp, Homo sapiens
aagcactattttcct

SEQ ID NO: 170883 - DNA, 15 bp, Homo sapiens
gaagcactattttcc

SEQ ID NO: 170884 - DNA, 15 bp, Homo sapiens
agaagcactattttc

SEQ ID NO: 170885 - DNA, 15 bp, Homo sapiens
cagaagcactatttt

SEQ ID NO: 170886 - DNA, 15 bp, Homo sapiens
tcagaagcactattt

SEQ ID NO: 170887 - DNA, 15 bp, Homo sapiens
ttcagaagcactatt

SEQ ID NO: 170888 - DNA, 15 bp, Homo sapiens
tttcagaagcactat

SEQ ID NO: 170889 - DNA, 15 bp, Homo sapiens
atttcagaagcacta

SEQ ID NO: 170890 - DNA, 15 bp, Homo sapiens
aatttcagaagcact

SEQ ID NO: 170891 - DNA, 15 bp, Homo sapiens
gaatttcagaagcac

SEQ ID NO: 170892 - DNA, 15 bp, Homo sapiens
ggaatttcagaagca

SEQ ID NO: 170893 - DNA, 15 bp, Homo sapiens
tggaatttcagaagc

SEQ ID NO: 170894 - DNA, 15 bp, Homo sapiens
atggaatttcagaag

SEQ ID NO: 170895 - DNA, 15 bp, Homo sapiens
aatggaatttcagaa

SEQ ID NO: 170896 - DNA, 15 bp, Homo sapiens
aaatggaatttcaga

SEQ ID NO: 170897 - DNA, 15 bp, Homo sapiens
gaaatggaatttcag

SEQ ID NO: 170898 - DNA, 15 bp, Homo sapiens
tgaaatggaatttca

SEQ ID NO: 170899 - DNA, 15 bp, Homo sapiens
gtgaaatggaatttc

SEQ ID NO: 170900 - DNA, 15 bp, Homo sapiens
agtgaaatggaattt

SEQ ID NO: 170901 - DNA, 15 bp, Homo sapiens
aagtgaaatggaatt

SEQ ID NO: 170902 - DNA, 15 bp, Homo sapiens
aaagtgaaatggaat

SEQ ID NO: 170903 - DNA, 15 bp, Homo sapiens
gaaagtgaaatggaa

SEQ ID NO: 170904 - DNA, 15 bp, Homo sapiens
ggaaagtgaaatgga

SEQ ID NO: 170905 - DNA, 15 bp, Homo sapiens
tggaaagtgaaatgg

SEQ ID NO: 170906 - DNA, 15 bp, Homo sapiens
gtggaaagtgaaatg

SEQ ID NO: 170907 - DNA, 15 bp, Homo sapiens
tgtggaaagtgaaat

SEQ ID NO: 170908 - DNA, 15 bp, Homo sapiens
ctgtggaaagtgaaa

SEQ ID NO: 170909 - DNA, 15 bp, Homo sapiens
gctgtggaaagtgaa

SEQ ID NO: 170910 - DNA, 15 bp, Homo sapiens
tgctgtggaaagtga

SEQ ID NO: 170911 - DNA, 15 bp, Homo sapiens
ctgctgtggaaagtg

SEQ ID NO: 170912 - DNA, 15 bp, Homo sapiens
actgctgtggaaagt

SEQ ID NO: 170913 - DNA, 15 bp, Homo sapiens
cactgctgtggaaag

SEQ ID NO: 170914 - DNA, 15 bp, Homo sapiens
ccactgctgtggaaa

SEQ ID NO: 170915 - DNA, 15 bp, Homo sapiens
gccactgctgtggaa

SEQ ID NO: 170916 - DNA, 15 bp, Homo sapiens
agccactgctgtgga

SEQ ID NO: 170917 - DNA, 15 bp, Homo sapiens
tagccactgctgtgg

SEQ ID NO: 170918 - DNA, 15 bp, Homo sapiens
ttagccactgctgtg

SEQ ID NO: 170919 - DNA, 15 bp, Homo sapiens
tttagccactgctgt

SEQ ID NO: 170920 - DNA, 15 bp, Homo sapiens
ttttagccactgctg

SEQ ID NO: 170921 - DNA, 15 bp, Homo sapiens
attttagccactgct

SEQ ID NO: 170922 - DNA, 15 bp, Homo sapiens
aattttagccactgc

SEQ ID NO: 170923 - DNA, 15 bp, Homo sapiens
caattttagccactg

SEQ ID NO: 170924 - DNA, 15 bp, Homo sapiens
tcaattttagccact

SEQ ID NO: 170925 - DNA, 15 bp, Homo sapiens
ttcaattttagccac

SEQ ID NO: 170926 - DNA, 15 bp, Homo sapiens
tttcaattttagcca

SEQ ID NO: 170927 - DNA, 15 bp, Homo sapiens
atttcaattttagcc

SEQ ID NO: 170928 - DNA, 15 bp, Homo sapiens
aatttcaattttagc

SEQ ID NO: 170929 - DNA, 15 bp, Homo sapiens
taatttcaattttag

SEQ ID NO: 170930 - DNA, 15 bp, Homo sapiens
ttaatttcaatttta

SEQ ID NO: 170931 - DNA, 15 bp, Homo sapiens
cttaatttcaatttt

SEQ ID NO: 170932 - DNA, 15 bp, Homo sapiens
ccttaatttcaattt

SEQ ID NO: 170933 - DNA, 15 bp, Homo sapiens
gccttaatttcaatt

SEQ ID NO: 170934 - DNA, 15 bp, Homo sapiens
tgccttaatttcaat

SEQ ID NO: 170935 - DNA, 15 bp, Homo sapiens
gtgccttaatttcaa

SEQ ID NO: 170936 - DNA, 15 bp, Homo sapiens
agtgccttaatttca

SEQ ID NO: 170937 - DNA, 15 bp, Homo sapiens
gagtgccttaatttc

SEQ ID NO: 170938 - DNA, 15 bp, Homo sapiens
agagtgccttaattt

SEQ ID NO: 170939 - DNA, 15 bp, Homo sapiens
tagagtgccttaatt

SEQ ID NO: 170940 - DNA, 15 bp, Homo sapiens
ttagagtgccttaat

SEQ ID NO: 170941 - DNA, 15 bp, Homo sapiens
attagagtgccttaa

SEQ ID NO: 170942 - DNA, 15 bp, Homo sapiens
cattagagtgcctta

SEQ ID NO: 170943 - DNA, 15 bp, Homo sapiens
ccattagagtgcctt

SEQ ID NO: 170944 - DNA, 15 bp, Homo sapiens
gccattagagtgcct

SEQ ID NO: 170945 - DNA, 15 bp, Homo sapiens
agccattagagtgcc

SEQ ID NO: 170946 - DNA, 15 bp, Homo sapiens
tagccattagagtgc

SEQ ID NO: 170947 - DNA, 15 bp, Homo sapiens
gtagccattagagtg

SEQ ID NO: 170948 - DNA, 15 bp, Homo sapiens
agtagccattagagt

SEQ ID NO: 170949 - DNA, 15 bp, Homo sapiens
tagtagccattagag

SEQ ID NO: 170950 - DNA, 15 bp, Homo sapiens
ttagtagccattaga

SEQ ID NO: 170951 - DNA, 15 bp, Homo sapiens
gttagtagccattag

SEQ ID NO: 170952 - DNA, 15 bp, Homo sapiens
tgttagtagccatta

SEQ ID NO: 170953 - DNA, 15 bp, Homo sapiens
atgttagtagccatt

SEQ ID NO: 170954 - DNA, 15 bp, Homo sapiens
aatgttagtagccat

SEQ ID NO: 170955 - DNA, 15 bp, Homo sapiens
caatgttagtagcca

SEQ ID NO: 170956 - DNA, 15 bp, Homo sapiens
tcaatgttagtagcc

SEQ ID NO: 170957 - DNA, 15 bp, Homo sapiens
ttcaatgttagtagc

SEQ ID NO: 170958 - DNA, 15 bp, Homo sapiens
attcaatgttagtag

SEQ ID NO: 170959 - DNA, 15 bp, Homo sapiens
aattcaatgttagta

SEQ ID NO: 170960 - DNA, 15 bp, Homo sapiens
taattcaatgttagt

SEQ ID NO: 170961 - DNA, 15 bp, Homo sapiens
ataattcaatgttag

SEQ ID NO: 170962 - DNA, 15 bp, Homo sapiens
aataattcaatgtta

SEQ ID NO: 170963 - DNA, 15 bp, Homo sapiens
caataattcaatgtt

SEQ ID NO: 170964 - DNA, 15 bp, Homo sapiens
ccaataattcaatgt

SEQ ID NO: 170965 - DNA, 15 bp, Homo sapiens
tccaataattcaatg

SEQ ID NO: 170966 - DNA, 15 bp, Homo sapiens
atccaataattcaat

SEQ ID NO: 170967 - DNA, 15 bp, Homo sapiens
aatccaataattcaa

SEQ ID NO: 170968 - DNA, 15 bp, Homo sapiens
caatccaataattca

SEQ ID NO: 170969 - DNA, 15 bp, Homo sapiens
ccaatccaataattc

SEQ ID NO: 170970 - DNA, 15 bp, Homo sapiens
gccaatccaataatt

SEQ ID NO: 170971 - DNA, 15 bp, Homo sapiens
tgccaatccaataat

SEQ ID NO: 170972 - DNA, 15 bp, Homo sapiens
ttgccaatccaataa

SEQ ID NO: 170973 - DNA, 15 bp, Homo sapiens
attgccaatccaata

SEQ ID NO: 170974 - DNA, 15 bp, Homo sapiens
tattgccaatccaat

SEQ ID NO: 170975 - DNA, 15 bp, Homo sapiens
ttattgccaatccaa

SEQ ID NO: 170976 - DNA, 15 bp, Homo sapiens
tttattgccaatcca

SEQ ID NO: 170977 - DNA, 15 bp, Homo sapiens
ctttattgccaatcc

SEQ ID NO: 170978 - DNA, 15 bp, Homo sapiens
cctttattgccaatc

SEQ ID NO: 170979 - DNA, 15 bp, Homo sapiens
gcctttattgccaat

SEQ ID NO: 170980 - DNA, 15 bp, Homo sapiens
ggcctttattgccaa

SEQ ID NO: 170981 - DNA, 15 bp, Homo sapiens
gggcctttattgcca

SEQ ID NO: 170982 - DNA, 15 bp, Homo sapiens
agggcctttattgcc

SEQ ID NO: 170983 - DNA, 15 bp, Homo sapiens
tagggcctttattgc

SEQ ID NO: 170984 - DNA, 15 bp, Homo sapiens
ttagggcctttattg

SEQ ID NO: 170985 - DNA, 15 bp, Homo sapiens
attagggcctttatt

SEQ ID NO: 170986 - DNA, 15 bp, Homo sapiens
cattagggcctttat

SEQ ID NO: 170987 - DNA, 15 bp, Homo sapiens
tcattagggccttta

SEQ ID NO: 170988 - DNA, 15 bp, Homo sapiens
ttcattagggccttt

SEQ ID NO: 170989 - DNA, 15 bp, Homo sapiens
cttcattagggcctt

SEQ ID NO: 170990 - DNA, 15 bp, Homo sapiens
acttcattagggcct

SEQ ID NO: 170991 - DNA, 15 bp, Homo sapiens
tacttcattagggcc

SEQ ID NO: 170992 - DNA, 15 bp, Homo sapiens
gtacttcattagggc

SEQ ID NO: 170993 - DNA, 15 bp, Homo sapiens
agtacttcattaggg

SEQ ID NO: 170994 - DNA, 15 bp, Homo sapiens
aagtacttcattagg

SEQ ID NO: 170995 - DNA, 15 bp, Homo sapiens
aaagtacttcattag

SEQ ID NO: 170996 - DNA, 15 bp, Homo sapiens
gaaagtacttcatta

SEQ ID NO: 170997 - DNA, 15 bp, Homo sapiens
tgaaagtacttcatt

SEQ ID NO: 170998 - DNA, 15 bp, Homo sapiens
atgaaagtacttcat

SEQ ID NO: 170999 - DNA, 15 bp, Homo sapiens
aatgaaagtacttca

SEQ ID NO: 171000 - DNA, 15 bp, Homo sapiens
taatgaaagtacttc

SEQ ID NO: 171001 - DNA, 15 bp, Homo sapiens
ctaatgaaagtactt

SEQ ID NO: 171002 - DNA, 15 bp, Homo sapiens
cctaatgaaagtact

SEQ ID NO: 171003 - DNA, 15 bp, Homo sapiens
tcctaatgaaagtac

SEQ ID NO: 171004 - DNA, 15 bp, Homo sapiens
ttcctaatgaaagta

SEQ ID NO: 171005 - DNA, 15 bp, Homo sapiens
cttcctaatgaaagt

SEQ ID NO: 171006 - DNA, 15 bp, Homo sapiens
tcttcctaatgaaag

SEQ ID NO: 171007 - DNA, 15 bp, Homo sapiens
ttcttcctaatgaaa

SEQ ID NO: 171008 - DNA, 15 bp, Homo sapiens
tttcttcctaatgaa

SEQ ID NO: 171009 - DNA, 15 bp, Homo sapiens
ttttcttcctaatga

SEQ ID NO: 171010 - DNA, 15 bp, Homo sapiens
attttcttcctaatg

SEQ ID NO: 171011 - DNA, 15 bp, Homo sapiens
tattttcttcctaat

SEQ ID NO: 171012 - DNA, 15 bp, Homo sapiens
atattttcttcctaa

SEQ ID NO: 171013 - DNA, 15 bp, Homo sapiens
gatattttcttccta

SEQ ID NO: 171014 - DNA, 15 bp, Homo sapiens
ggatattttcttcct

SEQ ID NO: 171015 - DNA, 15 bp, Homo sapiens
tggatattttcttcc

SEQ ID NO: 171016 - DNA, 15 bp, Homo sapiens
gtggatattttcttc

SEQ ID NO: 171017 - DNA, 15 bp, Homo sapiens
tgtggatattttctt

SEQ ID NO: 171018 - DNA, 15 bp, Homo sapiens
gtgtggatattttct

SEQ ID NO: 171019 - DNA, 15 bp, Homo sapiens
cgtgtggatattttc

SEQ ID NO: 171020 - DNA, 15 bp, Homo sapiens
acgtgtggatatttt

SEQ ID NO: 171021 - DNA, 15 bp, Homo sapiens
gacgtgtggatattt

SEQ ID NO: 171022 - DNA, 15 bp, Homo sapiens
agacgtgtggatatt

SEQ ID NO: 171023 - DNA, 15 bp, Homo sapiens
cagacgtgtggatat

SEQ ID NO: 171024 - DNA, 15 bp, Homo sapiens
ccagacgtgtggata

SEQ ID NO: 171025 - DNA, 15 bp, Homo sapiens
tccagacgtgtggat

SEQ ID NO: 171026 - DNA, 15 bp, Homo sapiens
ttccagacgtgtgga

SEQ ID NO: 171027 - DNA, 15 bp, Homo sapiens
cttccagacgtgtgg

SEQ ID NO: 171028 - DNA, 15 bp, Homo sapiens
tcttccagacgtgtg

SEQ ID NO: 171029 - DNA, 15 bp, Homo sapiens
ttcttccagacgtgt

SEQ ID NO: 171030 - DNA, 15 bp, Homo sapiens
tttcttccagacgtg

SEQ ID NO: 171031 - DNA, 15 bp, Homo sapiens
atttcttccagacgt

SEQ ID NO: 171032 - DNA, 15 bp, Homo sapiens
tatttcttccagacg

SEQ ID NO: 171033 - DNA, 15 bp, Homo sapiens
ctatttcttccagac

SEQ ID NO: 171034 - DNA, 15 bp, Homo sapiens
actatttcttccaga

SEQ ID NO: 171035 - DNA, 15 bp, Homo sapiens
cactatttcttccag

SEQ ID NO: 171036 - DNA, 15 bp, Homo sapiens
acactatttcttcca

SEQ ID NO: 171037 - DNA, 15 bp, Homo sapiens
cacactatttcttcc

SEQ ID NO: 171038 - DNA, 15 bp, Homo sapiens
tcacactatttcttc

SEQ ID NO: 171039 - DNA, 15 bp, Homo sapiens
atcacactatttctt

SEQ ID NO: 171040 - DNA, 15 bp, Homo sapiens
catcacactatttct

SEQ ID NO: 171041 - DNA, 15 bp, Homo sapiens
gcatcacactatttc

SEQ ID NO: 171042 - DNA, 15 bp, Homo sapiens
ggcatcacactattt

SEQ ID NO: 171043 - DNA, 15 bp, Homo sapiens
gggcatcacactatt

SEQ ID NO: 171044 - DNA, 15 bp, Homo sapiens
ggggcatcacactat

SEQ ID NO: 171045 - DNA, 15 bp, Homo sapiens
gggggcatcacacta

SEQ ID NO: 171046 - DNA, 15 bp, Homo sapiens
agggggcatcacact

SEQ ID NO: 171047 - DNA, 15 bp, Homo sapiens
cagggggcatcacac

SEQ ID NO: 171048 - DNA, 15 bp, Homo sapiens
acagggggcatcaca

SEQ ID NO: 171049 - DNA, 15 bp, Homo sapiens
tacagggggcatcac

SEQ ID NO: 171050 - DNA, 15 bp, Homo sapiens
ttacagggggcatca

SEQ ID NO: 171051 - DNA, 15 bp, Homo sapiens
tttacagggggcatc

SEQ ID NO: 171052 - DNA, 15 bp, Homo sapiens
ctttacagggggcat

SEQ ID NO: 171053 - DNA, 15 bp, Homo sapiens
tctttacagggggca

SEQ ID NO: 171054 - DNA, 15 bp, Homo sapiens
ttctttacagggggc

SEQ ID NO: 171055 - DNA, 15 bp, Homo sapiens
tttctttacaggggg

SEQ ID NO: 171056 - DNA, 15 bp, Homo sapiens
gtttctttacagggg

SEQ ID NO: 171057 - DNA, 15 bp, Homo sapiens
ggtttctttacaggg

SEQ ID NO: 171058 - DNA, 15 bp, Homo sapiens
tggtttctttacagg

SEQ ID NO: 171059 - DNA, 15 bp, Homo sapiens
ctggtttctttacag

SEQ ID NO: 171060 - DNA, 15 bp, Homo sapiens
actggtttctttaca

SEQ ID NO: 171061 - DNA, 15 bp, Homo sapiens
cactggtttctttac

SEQ ID NO: 171062 - DNA, 15 bp, Homo sapiens
tcactggtttcttta

SEQ ID NO: 171063 - DNA, 15 bp, Homo sapiens
ttcactggtttcttt

SEQ ID NO: 171064 - DNA, 15 bp, Homo sapiens
attcactggtttctt

SEQ ID NO: 171065 - DNA, 15 bp, Homo sapiens
cattcactggtttct

SEQ ID NO: 171066 - DNA, 15 bp, Homo sapiens
acattcactggtttc

SEQ ID NO: 171067 - DNA, 15 bp, Homo sapiens
tacattcactggttt

SEQ ID NO: 171068 - DNA, 15 bp, Homo sapiens
ttacattcactggtt

SEQ ID NO: 171069 - DNA, 15 bp, Homo sapiens
gttacattcactggt

SEQ ID NO: 171070 - DNA, 15 bp, Homo sapiens
cgttacattcactgg

SEQ ID NO: 171071 - DNA, 15 bp, Homo sapiens
acgttacattcactg

SEQ ID NO: 171072 - DNA, 15 bp, Homo sapiens
aacgttacattcact

SEQ ID NO: 171073 - DNA, 15 bp, Homo sapiens
aaacgttacattcac

SEQ ID NO: 171074 - DNA, 15 bp, Homo sapiens
gaaacgttacattca

SEQ ID NO: 171075 - DNA, 15 bp, Homo sapiens
tgaaacgttacattc

SEQ ID NO: 171076 - DNA, 15 bp, Homo sapiens
ttgaaacgttacatt

SEQ ID NO: 171077 - DNA, 15 bp, Homo sapiens
tttgaaacgttacat

SEQ ID NO: 171078 - DNA, 15 bp, Homo sapiens
atttgaaacgttaca

SEQ ID NO: 171079 - DNA, 15 bp, Homo sapiens
tatttgaaacgttac

SEQ ID NO: 171080 - DNA, 15 bp, Homo sapiens
atatttgaaacgtta

SEQ ID NO: 171081 - DNA, 15 bp, Homo sapiens
catatttgaaacgtt

SEQ ID NO: 171082 - DNA, 15 bp, Homo sapiens
ccatatttgaaacgt

SEQ ID NO: 171083 - DNA, 15 bp, Homo sapiens
tccatatttgaaacg

SEQ ID NO: 171084 - DNA, 15 bp, Homo sapiens
ctccatatttgaaac

SEQ ID NO: 171085 - DNA, 15 bp, Homo sapiens
gctccatatttgaaa

SEQ ID NO: 171086 - DNA, 15 bp, Homo sapiens
tgctccatatttgaa

SEQ ID NO: 171087 - DNA, 15 bp, Homo sapiens
ctgctccatatttga

SEQ ID NO: 171088 - DNA, 15 bp, Homo sapiens
gctgctccatatttg

SEQ ID NO: 171089 - DNA, 15 bp, Homo sapiens
ggctgctccatattt

SEQ ID NO: 171090 - DNA, 15 bp, Homo sapiens
tggctgctccatatt

SEQ ID NO: 171091 - DNA, 15 bp, Homo sapiens
gtggctgctccatat

SEQ ID NO: 171092 - DNA, 15 bp, Homo sapiens
tgtggctgctccata

SEQ ID NO: 171093 - DNA, 15 bp, Homo sapiens
ctgtggctgctccat

SEQ ID NO: 171094 - DNA, 15 bp, Homo sapiens
gctgtggctgctcca

SEQ ID NO: 171095 - DNA, 15 bp, Homo sapiens
tgctgtggctgctcc

SEQ ID NO: 171096 - DNA, 15 bp, Homo sapiens
ctgctgtggctgctc

SEQ ID NO: 171097 - DNA, 15 bp, Homo sapiens
tctgctgtggctgct

SEQ ID NO: 171098 - DNA, 15 bp, Homo sapiens
gtctgctgtggctgc

SEQ ID NO: 171099 - DNA, 15 bp, Homo sapiens
agtctgctgtggctg

SEQ ID NO: 171100 - DNA, 15 bp, Homo sapiens
aagtctgctgtggct

SEQ ID NO: 171101 - DNA, 15 bp, Homo sapiens
gaagtctgctgtggc

SEQ ID NO: 171102 - DNA, 15 bp, Homo sapiens
agaagtctgctgtgg

SEQ ID NO: 171103 - DNA, 15 bp, Homo sapiens
cagaagtctgctgtg

SEQ ID NO: 171104 - DNA, 15 bp, Homo sapiens
acagaagtctgctgt

SEQ ID NO: 171105 - DNA, 15 bp, Homo sapiens
tacagaagtctgctg

SEQ ID NO: 171106 - DNA, 15 bp, Homo sapiens
ttacagaagtctgct

SEQ ID NO: 171107 - DNA, 15 bp, Homo sapiens
attacagaagtctgc

SEQ ID NO: 171108 - DNA, 15 bp, Homo sapiens
aattacagaagtctg

SEQ ID NO: 171109 - DNA, 15 bp, Homo sapiens
gaattacagaagtct

SEQ ID NO: 171110 - DNA, 15 bp, Homo sapiens
agaattacagaagtc

SEQ ID NO: 171111 - DNA, 15 bp, Homo sapiens
tagaattacagaagt

SEQ ID NO: 171112 - DNA, 15 bp, Homo sapiens
ctagaattacagaag

SEQ ID NO: 171113 - DNA, 15 bp, Homo sapiens
cctagaattacagaa

SEQ ID NO: 171114 - DNA, 15 bp, Homo sapiens
acctagaattacaga

SEQ ID NO: 171115 - DNA, 15 bp, Homo sapiens
gacctagaattacag

SEQ ID NO: 171116 - DNA, 15 bp, Homo sapiens
tgacctagaattaca

SEQ ID NO: 171117 - DNA, 15 bp, Homo sapiens
ttgacctagaattac

SEQ ID NO: 171118 - DNA, 15 bp, Homo sapiens
gttgacctagaatta

SEQ ID NO: 171119 - DNA, 15 bp, Homo sapiens
tgttgacctagaatt

SEQ ID NO: 171120 - DNA, 15 bp, Homo sapiens
ttgttgacctagaat

SEQ ID NO: 171121 - DNA, 15 bp, Homo sapiens
attgttgacctagaa

SEQ ID NO: 171122 - DNA, 15 bp, Homo sapiens
cattgttgacctaga

SEQ ID NO: 171123 - DNA, 15 bp, Homo sapiens
tcattgttgacctag

SEQ ID NO: 171124 - DNA, 15 bp, Homo sapiens
ttcattgttgaccta

SEQ ID NO: 171125 - DNA, 15 bp, Homo sapiens
attcattgttgacct

SEQ ID NO: 171126 - DNA, 15 bp, Homo sapiens
aattcattgttgacc

SEQ ID NO: 171127 - DNA, 15 bp, Homo sapiens
taattcattgttgac

SEQ ID NO: 171128 - DNA, 15 bp, Homo sapiens
ttaattcattgttga

SEQ ID NO: 171129 - DNA, 15 bp, Homo sapiens
attaattcattgttg

SEQ ID NO: 171130 - DNA, 15 bp, Homo sapiens
tattaattcattgtt

SEQ ID NO: 171131 - DNA, 15 bp, Homo sapiens
ctattaattcattgt

SEQ ID NO: 171132 - DNA, 15 bp, Homo sapiens
tctattaattcattg

SEQ ID NO: 171133 - DNA, 15 bp, Homo sapiens
ttctattaattcatt

SEQ ID NO: 171134 - DNA, 15 bp, Homo sapiens
attctattaattcat

SEQ ID NO: 171135 - DNA, 15 bp, Homo sapiens
gattctattaattca

SEQ ID NO: 171136 - DNA, 15 bp, Homo sapiens
tgattctattaattc

SEQ ID NO: 171137 - DNA, 15 bp, Homo sapiens
ctgattctattaatt

SEQ ID NO: 171138 - DNA, 15 bp, Homo sapiens
actgattctattaat

SEQ ID NO: 171139 - DNA, 15 bp, Homo sapiens
aactgattctattaa

SEQ ID NO: 171140 - DNA, 15 bp, Homo sapiens
aaactgattctatta

SEQ ID NO: 171141 - DNA, 15 bp, Homo sapiens
gaaactgattctatt

SEQ ID NO: 171142 - DNA, 15 bp, Homo sapiens
agaaactgattctat

SEQ ID NO: 171143 - DNA, 15 bp, Homo sapiens
aagaaactgattcta

SEQ ID NO: 171144 - DNA, 15 bp, Homo sapiens
caagaaactgattct

SEQ ID NO: 171145 - DNA, 15 bp, Homo sapiens
acaagaaactgattc

SEQ ID NO: 171146 - DNA, 15 bp, Homo sapiens
aacaagaaactgatt

SEQ ID NO: 171147 - DNA, 15 bp, Homo sapiens
taacaagaaactgat

SEQ ID NO: 171148 - DNA, 15 bp, Homo sapiens
ttaacaagaaactga

SEQ ID NO: 171149 - DNA, 15 bp, Homo sapiens
tttaacaagaaactg

SEQ ID NO: 171150 - DNA, 15 bp, Homo sapiens
ttttaacaagaaact

SEQ ID NO: 171151 - DNA, 15 bp, Homo sapiens
attttaacaagaaac

SEQ ID NO: 171152 - DNA, 15 bp, Homo sapiens
tattttaacaagaaa

SEQ ID NO: 171153 - DNA, 15 bp, Homo sapiens
ttattttaacaagaa

SEQ ID NO: 171154 - DNA, 15 bp, Homo sapiens
gttattttaacaaga

SEQ ID NO: 171155 - DNA, 15 bp, Homo sapiens
agttattttaacaag

SEQ ID NO: 171156 - DNA, 15 bp, Homo sapiens
cagttattttaacaa

SEQ ID NO: 171157 - DNA, 15 bp, Homo sapiens
acagttattttaaca

SEQ ID NO: 171158 - DNA, 15 bp, Homo sapiens
gacagttattttaac

SEQ ID NO: 171159 - DNA, 15 bp, Homo sapiens
agacagttattttaa

SEQ ID NO: 171160 - DNA, 15 bp, Homo sapiens
aagacagttatttta

SEQ ID NO: 171161 - DNA, 15 bp, Homo sapiens
aaagacagttatttt

SEQ ID NO: 171162 - DNA, 15 bp, Homo sapiens
aaaagacagttattt

SEQ ID NO: 171163 - DNA, 15 bp, Homo sapiens
caaaagacagttatt

SEQ ID NO: 171164 - DNA, 15 bp, Homo sapiens
gcaaaagacagttat

SEQ ID NO: 171165 - DNA, 15 bp, Homo sapiens
ggcaaaagacagtta

SEQ ID NO: 171166 - DNA, 15 bp, Homo sapiens
aggcaaaagacagtt

SEQ ID NO: 171167 - DNA, 15 bp, Homo sapiens
aaggcaaaagacagt

SEQ ID NO: 171168 - DNA, 15 bp, Homo sapiens
gaaggcaaaagacag

SEQ ID NO: 171169 - DNA, 15 bp, Homo sapiens
tgaaggcaaaagaca

SEQ ID NO: 171170 - DNA, 15 bp, Homo sapiens
atgaaggcaaaagac

SEQ ID NO: 171171 - DNA, 15 bp, Homo sapiens
gatgaaggcaaaaga

SEQ ID NO: 171172 - DNA, 15 bp, Homo sapiens
tgatgaaggcaaaag

SEQ ID NO: 171173 - DNA, 15 bp, Homo sapiens
ttgatgaaggcaaaa

SEQ ID NO: 171174 - DNA, 15 bp, Homo sapiens
attgatgaaggcaaa

SEQ ID NO: 171175 - DNA, 15 bp, Homo sapiens
tattgatgaaggcaa

SEQ ID NO: 171176 - DNA, 15 bp, Homo sapiens
atattgatgaaggca

SEQ ID NO: 171177 - DNA, 15 bp, Homo sapiens
aatattgatgaaggc

SEQ ID NO: 171178 - DNA, 15 bp, Homo sapiens
aaatattgatgaagg

SEQ ID NO: 171179 - DNA, 15 bp, Homo sapiens
aaaatattgatgaag

SEQ ID NO: 171180 - DNA, 15 bp, Homo sapiens
taaaatattgatgaa

SEQ ID NO: 171181 - DNA, 15 bp, Homo sapiens
ctaaaatattgatga

SEQ ID NO: 171182 - DNA, 15 bp, Homo sapiens
tctaaaatattgatg

SEQ ID NO: 171183 - DNA, 15 bp, Homo sapiens
atctaaaatattgat

SEQ ID NO: 171184 - DNA, 15 bp, Homo sapiens
tatctaaaatattga

SEQ ID NO: 171185 - DNA, 15 bp, Homo sapiens
gtatctaaaatattg

SEQ ID NO: 171186 - DNA, 15 bp, Homo sapiens
ggtatctaaaatatt

SEQ ID NO: 171187 - DNA, 15 bp, Homo sapiens
gggtatctaaaatat

SEQ ID NO: 171188 - DNA, 15 bp, Homo sapiens
agggtatctaaaata

SEQ ID NO: 171189 - DNA, 15 bp, Homo sapiens
aagggtatctaaaat

SEQ ID NO: 171190 - DNA, 15 bp, Homo sapiens
taagggtatctaaaa

SEQ ID NO: 171191 - DNA, 15 bp, Homo sapiens
gtaagggtatctaaa

SEQ ID NO: 171192 - DNA, 15 bp, Homo sapiens
agtaagggtatctaa

SEQ ID NO: 171193 - DNA, 15 bp, Homo sapiens
cagtaagggtatcta

SEQ ID NO: 171194 - DNA, 15 bp, Homo sapiens
ccagtaagggtatct

SEQ ID NO: 171195 - DNA, 15 bp, Homo sapiens
gccagtaagggtatc

SEQ ID NO: 171196 - DNA, 15 bp, Homo sapiens
agccagtaagggtat

SEQ ID NO: 171197 - DNA, 15 bp, Homo sapiens
tagccagtaagggta

SEQ ID NO: 171198 - DNA, 15 bp, Homo sapiens
gtagccagtaagggt

SEQ ID NO: 171199 - DNA, 15 bp, Homo sapiens
ggtagccagtaaggg

SEQ ID NO: 171200 - DNA, 15 bp, Homo sapiens
aggtagccagtaagg

SEQ ID NO: 171201 - DNA, 15 bp, Homo sapiens
caggtagccagtaag

SEQ ID NO: 171202 - DNA, 15 bp, Homo sapiens
acaggtagccagtaa

SEQ ID NO: 171203 - DNA, 15 bp, Homo sapiens
gacaggtagccagta

SEQ ID NO: 171204 - DNA, 15 bp, Homo sapiens
agacaggtagccagt

SEQ ID NO: 171205 - DNA, 15 bp, Homo sapiens
aagacaggtagccag

SEQ ID NO: 171206 - DNA, 15 bp, Homo sapiens
taagacaggtagcca

SEQ ID NO: 171207 - DNA, 15 bp, Homo sapiens
ataagacaggtagcc

SEQ ID NO: 171208 - DNA, 15 bp, Homo sapiens
cataagacaggtagc

SEQ ID NO: 171209 - DNA, 15 bp, Homo sapiens
ccataagacaggtag

SEQ ID NO: 171210 - DNA, 15 bp, Homo sapiens
tccataagacaggta

SEQ ID NO: 171211 - DNA, 15 bp, Homo sapiens
ttccataagacaggt

SEQ ID NO: 171212 - DNA, 15 bp, Homo sapiens
tttccataagacagg

SEQ ID NO: 171213 - DNA, 15 bp, Homo sapiens
ctttccataagacag

SEQ ID NO: 171214 - DNA, 15 bp, Homo sapiens
gctttccataagaca

SEQ ID NO: 171215 - DNA, 15 bp, Homo sapiens
agctttccataagac

SEQ ID NO: 171216 - DNA, 15 bp, Homo sapiens
tagctttccataaga

SEQ ID NO: 171217 - DNA, 15 bp, Homo sapiens
atagctttccataag

SEQ ID NO: 171218 - DNA, 15 bp, Homo sapiens
catagctttccataa

SEQ ID NO: 171219 - DNA, 15 bp, Homo sapiens
acatagctttccata

SEQ ID NO: 171220 - DNA, 15 bp, Homo sapiens
tacatagctttccat

SEQ ID NO: 171221 - DNA, 15 bp, Homo sapiens
ttacatagctttcca

SEQ ID NO: 171222 - DNA, 15 bp, Homo sapiens
attacatagctttcc

SEQ ID NO: 171223 - DNA, 15 bp, Homo sapiens
aattacatagctttc

SEQ ID NO: 171224 - DNA, 15 bp, Homo sapiens
taattacatagcttt

SEQ ID NO: 171225 - DNA, 15 bp, Homo sapiens
ataattacatagctt

SEQ ID NO: 171226 - DNA, 15 bp, Homo sapiens
tataattacatagct

SEQ ID NO: 171227 - DNA, 15 bp, Homo sapiens
gtataattacatagc

SEQ ID NO: 171228 - DNA, 15 bp, Homo sapiens
agtataattacatag

SEQ ID NO: 171229 - DNA, 15 bp, Homo sapiens
tagtataattacata

SEQ ID NO: 171230 - DNA, 15 bp, Homo sapiens
atagtataattacat

SEQ ID NO: 171231 - DNA, 15 bp, Homo sapiens
aatagtataattaca

SEQ ID NO: 171232 - DNA, 15 bp, Homo sapiens
aaatagtataattac

SEQ ID NO: 171233 - DNA, 15 bp, Homo sapiens
aaaatagtataatta

SEQ ID NO: 171234 - DNA, 15 bp, Homo sapiens
caaaatagtataatt

SEQ ID NO: 171235 - DNA, 15 bp, Homo sapiens
tcaaaatagtataat

SEQ ID NO: 171236 - DNA, 15 bp, Homo sapiens
ctcaaaatagtataa

SEQ ID NO: 171237 - DNA, 15 bp, Homo sapiens
actcaaaatagtata

SEQ ID NO: 171238 - DNA, 15 bp, Homo sapiens
aactcaaaatagtat

SEQ ID NO: 171239 - DNA, 15 bp, Homo sapiens
caactcaaaatagta

SEQ ID NO: 171240 - DNA, 15 bp, Homo sapiens
ccaactcaaaatagt

SEQ ID NO: 171241 - DNA, 15 bp, Homo sapiens
tccaactcaaaatag

SEQ ID NO: 171242 - DNA, 15 bp, Homo sapiens
atccaactcaaaata

SEQ ID NO: 171243 - DNA, 15 bp, Homo sapiens
aatccaactcaaaat

SEQ ID NO: 171244 - DNA, 15 bp, Homo sapiens
aaatccaactcaaaa

SEQ ID NO: 171245 - DNA, 15 bp, Homo sapiens
aaaatccaactcaaa

SEQ ID NO: 171246 - DNA, 15 bp, Homo sapiens
aaaaatccaactcaa

SEQ ID NO: 171247 - DNA, 15 bp, Homo sapiens
taaaaatccaactca

SEQ ID NO: 171248 - DNA, 15 bp, Homo sapiens
ataaaaatccaactc

SEQ ID NO: 171249 - DNA, 15 bp, Homo sapiens
cataaaaatccaact

SEQ ID NO: 171250 - DNA, 15 bp, Homo sapiens
ccataaaaatccaac

SEQ ID NO: 171251 - DNA, 15 bp, Homo sapiens
accataaaaatccaa

SEQ ID NO: 171252 - DNA, 15 bp, Homo sapiens
aaccataaaaatcca

SEQ ID NO: 171253 - DNA, 15 bp, Homo sapiens
aaaccataaaaatcc

SEQ ID NO: 171254 - DNA, 15 bp, Homo sapiens
taaaccataaaaatc

SEQ ID NO: 171255 - DNA, 15 bp, Homo sapiens
ataaaccataaaaat

SEQ ID NO: 171256 - DNA, 15 bp, Homo sapiens
cataaaccataaaaa

SEQ ID NO: 171257 - DNA, 15 bp, Homo sapiens
gcataaaccataaaa

SEQ ID NO: 171258 - DNA, 15 bp, Homo sapiens
agcataaaccataaa

SEQ ID NO: 171259 - DNA, 15 bp, Homo sapiens
aagcataaaccataa

SEQ ID NO: 171260 - DNA, 15 bp, Homo sapiens
aaagcataaaccata

SEQ ID NO: 171261 - DNA, 15 bp, Homo sapiens
gaaagcataaaccat

SEQ ID NO: 171262 - DNA, 15 bp, Homo sapiens
ggaaagcataaacca

SEQ ID NO: 171263 - DNA, 15 bp, Homo sapiens
tggaaagcataaacc

SEQ ID NO: 171264 - DNA, 15 bp, Homo sapiens
atggaaagcataaac

SEQ ID NO: 171265 - DNA, 15 bp, Homo sapiens
catggaaagcataaa

SEQ ID NO: 171266 - DNA, 15 bp, Homo sapiens
ccatggaaagcataa

SEQ ID NO: 171267 - DNA, 15 bp, Homo sapiens
tccatggaaagcata

SEQ ID NO: 171268 - DNA, 15 bp, Homo sapiens
ttccatggaaagcat

SEQ ID NO: 171269 - DNA, 15 bp, Homo sapiens
tttccatggaaagca

SEQ ID NO: 171270 - DNA, 15 bp, Homo sapiens
atttccatggaaagc

SEQ ID NO: 171271 - DNA, 15 bp, Homo sapiens
aatttccatggaaag

SEQ ID NO: 171272 - DNA, 15 bp, Homo sapiens
aaatttccatggaaa

SEQ ID NO: 171273 - DNA, 15 bp, Homo sapiens
caaatttccatggaa

SEQ ID NO: 171274 - DNA, 15 bp, Homo sapiens
tcaaatttccatgga

SEQ ID NO: 171275 - DNA, 15 bp, Homo sapiens
atcaaatttccatgg

SEQ ID NO: 171276 - DNA, 15 bp, Homo sapiens
catcaaatttccatg

SEQ ID NO: 171277 - DNA, 15 bp, Homo sapiens
ccatcaaatttccat

SEQ ID NO: 171278 - DNA, 15 bp, Homo sapiens
cccatcaaatttcca

SEQ ID NO: 171279 - DNA, 15 bp, Homo sapiens
tcccatcaaatttcc

SEQ ID NO: 171280 - DNA, 15 bp, Homo sapiens
atcccatcaaatttc

SEQ ID NO: 171281 - DNA, 15 bp, Homo sapiens
tatcccatcaaattt

SEQ ID NO: 171282 - DNA, 15 bp, Homo sapiens
ttatcccatcaaatt

SEQ ID NO: 171283 - DNA, 15 bp, Homo sapiens
attatcccatcaaat

SEQ ID NO: 171284 - DNA, 15 bp, Homo sapiens
gattatcccatcaaa

SEQ ID NO: 171285 - DNA, 15 bp, Homo sapiens
agattatcccatcaa

SEQ ID NO: 171286 - DNA, 15 bp, Homo sapiens
cagattatcccatca

SEQ ID NO: 171287 - DNA, 15 bp, Homo sapiens
acagattatcccatc

SEQ ID NO: 171288 - DNA, 15 bp, Homo sapiens
aacagattatcccat

SEQ ID NO: 171289 - DNA, 15 bp, Homo sapiens
aaacagattatccca

SEQ ID NO: 171290 - DNA, 15 bp, Homo sapiens
caaacagattatccc

SEQ ID NO: 171291 - DNA, 15 bp, Homo sapiens
acaaacagattatcc

SEQ ID NO: 171292 - DNA, 15 bp, Homo sapiens
cacaaacagattatc

SEQ ID NO: 171293 - DNA, 15 bp, Homo sapiens
tcacaaacagattat

SEQ ID NO: 171294 - DNA, 15 bp, Homo sapiens
ctcacaaacagatta

SEQ ID NO: 171295 - DNA, 15 bp, Homo sapiens
cctcacaaacagatt

SEQ ID NO: 171296 - DNA, 15 bp, Homo sapiens
acctcacaaacagat

SEQ ID NO: 171297 - DNA, 15 bp, Homo sapiens
tacctcacaaacaga

SEQ ID NO: 171298 - DNA, 15 bp, Homo sapiens
atacctcacaaacag

SEQ ID NO: 171299 - DNA, 15 bp, Homo sapiens
aatacctcacaaaca

SEQ ID NO: 171300 - DNA, 15 bp, Homo sapiens
aaatacctcacaaac

SEQ ID NO: 171301 - DNA, 15 bp, Homo sapiens
taaatacctcacaaa

SEQ ID NO: 171302 - DNA, 15 bp, Homo sapiens
ataaatacctcacaa

SEQ ID NO: 171303 - DNA, 15 bp, Homo sapiens
gataaatacctcaca

SEQ ID NO: 171304 - DNA, 15 bp, Homo sapiens
agataaatacctcac

SEQ ID NO: 171305 - DNA, 15 bp, Homo sapiens
cagataaatacctca

SEQ ID NO: 171306 - DNA, 15 bp, Homo sapiens
gcagataaatacctc

SEQ ID NO: 171307 - DNA, 15 bp, Homo sapiens
tgcagataaatacct

SEQ ID NO: 171308 - DNA, 15 bp, Homo sapiens
tatgcagataaatac

SEQ ID NO: 171309 - DNA, 15 bp, Homo sapiens
atatgcagataaata

SEQ ID NO: 171310 - DNA, 15 bp, Homo sapiens
aatatgcagataaat

SEQ ID NO: 171311 - DNA, 15 bp, Homo sapiens
aaatatgcagataaa

SEQ ID NO: 171312 - DNA, 15 bp, Homo sapiens
caaatatgcagataa

SEQ ID NO: 171313 - DNA, 15 bp, Homo sapiens
tcaaatatgcagata

SEQ ID NO: 171314 - DNA, 15 bp, Homo sapiens
atcaaatatgcagat

SEQ ID NO: 171315 - DNA, 15 bp, Homo sapiens
aatcaaatatgcaga

SEQ ID NO: 171316 - DNA, 15 bp, Homo sapiens
gaatcaaatatgcag

SEQ ID NO: 171317 - DNA, 15 bp, Homo sapiens
ggaatcaaatatgca

SEQ ID NO: 171318 - DNA, 15 bp, Homo sapiens
aggaatcaaatatgc

SEQ ID NO: 171319 - DNA, 15 bp, Homo sapiens
aaggaatcaaatatg

SEQ ID NO: 171320 - DNA, 15 bp, Homo sapiens
taaggaatcaaatat

SEQ ID NO: 171321 - DNA, 15 bp, Homo sapiens
ttaaggaatcaaata

SEQ ID NO: 171322 - DNA, 15 bp, Homo sapiens
gttaaggaatcaaat

SEQ ID NO: 171323 - DNA, 15 bp, Homo sapiens
agttaaggaatcaaa

SEQ ID NO: 171324 - DNA, 15 bp, Homo sapiens
aagttaaggaatcaa

SEQ ID NO: 171325 - DNA, 15 bp, Homo sapiens
taagttaaggaatca

SEQ ID NO: 171326 - DNA, 15 bp, Homo sapiens
gtaagttaaggaatc

SEQ ID NO: 171327 - DNA, 15 bp, Homo sapiens
ggtaagttaaggaat

SEQ ID NO: 171328 - DNA, 15 bp, Homo sapiens
aggtaagttaaggaa

SEQ ID NO: 171329 - DNA, 15 bp, Homo sapiens
caggtaagttaagga

SEQ ID NO: 171330 - DNA, 15 bp, Homo sapiens
gcaggtaagttaagg

SEQ ID NO: 171331 - DNA, 15 bp, Homo sapiens
cgcaggtaagttaag

SEQ ID NO: 171332 - DNA, 15 bp, Homo sapiens
tcgcaggtaagttaa

SEQ ID NO: 171333 - DNA, 15 bp, Homo sapiens
gtcgcaggtaagtta

SEQ ID NO: 171334 - DNA, 15 bp, Homo sapiens
agtcgcaggtaagtt

SEQ ID NO: 171335 - DNA, 15 bp, Homo sapiens
aagtcgcaggtaagt

SEQ ID NO: 171336 - DNA, 15 bp, Homo sapiens
gaagtcgcaggtaag

SEQ ID NO: 171337 - DNA, 15 bp, Homo sapiens
agaagtcgcaggtaa

SEQ ID NO: 171338 - DNA, 15 bp, Homo sapiens
aagaagtcgcaggta

SEQ ID NO: 171339 - DNA, 15 bp, Homo sapiens
caagaagtcgcaggt

SEQ ID NO: 171340 - DNA, 15 bp, Homo sapiens
tcaagaagtcgcagg

SEQ ID NO: 171341 - DNA, 15 bp, Homo sapiens
gtcaagaagtcgcag

SEQ ID NO: 171342 - DNA, 15 bp, Homo sapiens
agtcaagaagtcgca

SEQ ID NO: 171343 - DNA, 15 bp, Homo sapiens
aagtcaagaagtcgc

SEQ ID NO: 171344 - DNA, 15 bp, Homo sapiens
aaagtcaagaagtcg

SEQ ID NO: 171345 - DNA, 15 bp, Homo sapiens
caaagtcaagaagtc

SEQ ID NO: 171346 - DNA, 15 bp, Homo sapiens
acaaagtcaagaagt

SEQ ID NO: 171347 - DNA, 15 bp, Homo sapiens
aacaaagtcaagaag

SEQ ID NO: 171348 - DNA, 15 bp, Homo sapiens
caacaaagtcaagaa

SEQ ID NO: 171349 - DNA, 15 bp, Homo sapiens
ccaacaaagtcaaga

SEQ ID NO: 171350 - DNA, 15 bp, Homo sapiens
accaacaaagtcaag

SEQ ID NO: 171351 - DNA, 15 bp, Homo sapiens
aaccaacaaagtcaa

SEQ ID NO: 171352 - DNA, 15 bp, Homo sapiens
aaaccaacaaagtca

SEQ ID NO: 171353 - DNA, 15 bp, Homo sapiens
aaaaccaacaaagtc

SEQ ID NO: 171354 - DNA, 15 bp, Homo sapiens
gaaaaccaacaaagt

SEQ ID NO: 171355 - DNA, 15 bp, Homo sapiens
tgaaaaccaacaaag

SEQ ID NO: 171356 - DNA, 15 bp, Homo sapiens
ctgaaaaccaacaaa

SEQ ID NO: 171357 - DNA, 15 bp, Homo sapiens
tctgaaaaccaacaa

SEQ ID NO: 171358 - DNA, 15 bp, Homo sapiens
ttctgaaaaccaaca

SEQ ID NO: 171359 - DNA, 15 bp, Homo sapiens
attctgaaaaccaac

SEQ ID NO: 171360 - DNA, 15 bp, Homo sapiens
aattctgaaaaccaa

SEQ ID NO: 171361 - DNA, 15 bp, Homo sapiens
taattctgaaaacca

SEQ ID NO: 171362 - DNA, 15 bp, Homo sapiens
ttaattctgaaaacc

SEQ ID NO: 171363 - DNA, 15 bp, Homo sapiens
tttaattctgaaaac

SEQ ID NO: 171364 - DNA, 15 bp, Homo sapiens
ttttaattctgaaaa

SEQ ID NO: 171365 - DNA, 15 bp, Homo sapiens
tttttaattctgaaa

SEQ ID NO: 171366 - DNA, 15 bp, Homo sapiens
gtttttaattctgaa

SEQ ID NO: 171367 - DNA, 15 bp, Homo sapiens
agtttttaattctga

SEQ ID NO: 171368 - DNA, 15 bp, Homo sapiens
aagtttttaattctg

SEQ ID NO: 171369 - DNA, 15 bp, Homo sapiens
caagtttttaattct

SEQ ID NO: 171370 - DNA, 15 bp, Homo sapiens
tcaagtttttaattc

SEQ ID NO: 171371 - DNA, 15 bp, Homo sapiens
ttcaagtttttaatt

SEQ ID NO: 171372 - DNA, 15 bp, Homo sapiens
tttcaagtttttaat

SEQ ID NO: 171373 - DNA, 15 bp, Homo sapiens
ctttcaagtttttaa

SEQ ID NO: 171374 - DNA, 15 bp, Homo sapiens
tctttcaagttttta

SEQ ID NO: 171375 - DNA, 15 bp, Homo sapiens
ttctttcaagttttt

SEQ ID NO: 171376 - DNA, 15 bp, Homo sapiens
attctttcaagtttt

SEQ ID NO: 171377 - DNA, 15 bp, Homo sapiens
aattctttcaagttt

SEQ ID NO: 171378 - DNA, 15 bp, Homo sapiens
aaattctttcaagtt

SEQ ID NO: 171379 - DNA, 15 bp, Homo sapiens
aaaattctttcaagt

SEQ ID NO: 171380 - DNA, 15 bp, Homo sapiens
caaaattctttcaag

SEQ ID NO: 171381 - DNA, 15 bp, Homo sapiens
acaaaattctttcaa

SEQ ID NO: 171382 - DNA, 15 bp, Homo sapiens
aacaaaattctttca

SEQ ID NO: 171383 - DNA, 15 bp, Homo sapiens
aaacaaaattctttc

SEQ ID NO: 171384 - DNA, 15 bp, Homo sapiens
taaacaaaattcttt

SEQ ID NO: 171385 - DNA, 15 bp, Homo sapiens
ataaacaaaattctt

SEQ ID NO: 171386 - DNA, 15 bp, Homo sapiens
aataaacaaaattct

SEQ ID NO: 171387 - DNA, 15 bp, Homo sapiens
aaataaacaaaattc

SEQ ID NO: 171388 - DNA, 15 bp, Homo sapiens
ccaaaataaacaaaa

SEQ ID NO: 171389 - DNA, 15 bp, Homo sapiens
gccaaaataaacaaa

SEQ ID NO: 171390 - DNA, 15 bp, Homo sapiens
tgccaaaataaacaa

SEQ ID NO: 171391 - DNA, 15 bp, Homo sapiens
atgccaaaataaaca

SEQ ID NO: 171392 - DNA, 15 bp, Homo sapiens
catgccaaaataaac

SEQ ID NO: 171393 - DNA, 15 bp, Homo sapiens
acatgccaaaataaa

SEQ ID NO: 171394 - DNA, 15 bp, Homo sapiens
tacatgccaaaataa

SEQ ID NO: 171395 - DNA, 15 bp, Homo sapiens
ttacatgccaaaata

SEQ ID NO: 171396 - DNA, 15 bp, Homo sapiens
tttacatgccaaaat

SEQ ID NO: 171397 - DNA, 15 bp, Homo sapiens
ctttacatgccaaaa

SEQ ID NO: 171398 - DNA, 15 bp, Homo sapiens
tctttacatgccaaa

SEQ ID NO: 171399 - DNA, 15 bp, Homo sapiens
ttctttacatgccaa

SEQ ID NO: 171400 - DNA, 15 bp, Homo sapiens
attctttacatgcca

SEQ ID NO: 171401 - DNA, 15 bp, Homo sapiens
tattctttacatgcc

SEQ ID NO: 171402 - DNA, 15 bp, Homo sapiens
gtattctttacatgc

SEQ ID NO: 171403 - DNA, 15 bp, Homo sapiens
agtattctttacatg

SEQ ID NO: 171404 - DNA, 15 bp, Homo sapiens
cagtattctttacat

SEQ ID NO: 171405 - DNA, 15 bp, Homo sapiens
ccagtattctttaca

SEQ ID NO: 171406 - DNA, 15 bp, Homo sapiens
accagtattctttac

SEQ ID NO: 171407 - DNA, 15 bp, Homo sapiens
gaccagtattcttta

SEQ ID NO: 171408 - DNA, 15 bp, Homo sapiens
agaccagtattcttt

SEQ ID NO: 171409 - DNA, 15 bp, Homo sapiens
tagaccagtattctt

SEQ ID NO: 171410 - DNA, 15 bp, Homo sapiens
ttagaccagtattct

SEQ ID NO: 171411 - DNA, 15 bp, Homo sapiens
tttagaccagtattc

SEQ ID NO: 171412 - DNA, 15 bp, Homo sapiens
ttttagaccagtatt

SEQ ID NO: 171413 - DNA, 15 bp, Homo sapiens
attttagaccagtat

SEQ ID NO: 171414 - DNA, 15 bp, Homo sapiens
gattttagaccagta

SEQ ID NO: 171415 - DNA, 15 bp, Homo sapiens
tgattttagaccagt

SEQ ID NO: 171416 - DNA, 15 bp, Homo sapiens
gtgattttagaccag

SEQ ID NO: 171417 - DNA, 15 bp, Homo sapiens
tgtgattttagacca

SEQ ID NO: 171418 - DNA, 15 bp, Homo sapiens
ttgtgattttagacc

SEQ ID NO: 171419 - DNA, 15 bp, Homo sapiens
gttgtgattttagac

SEQ ID NO: 171420 - DNA, 15 bp, Homo sapiens
ggttgtgattttaga

SEQ ID NO: 171421 - DNA, 15 bp, Homo sapiens
tggttgtgattttag

SEQ ID NO: 171422 - DNA, 15 bp, Homo sapiens
atggttgtgatttta

SEQ ID NO: 171423 - DNA, 15 bp, Homo sapiens
aatggttgtgatttt

SEQ ID NO: 171424 - DNA, 15 bp, Homo sapiens
taatggttgtgattt

SEQ ID NO: 171425 - DNA, 15 bp, Homo sapiens
ctaatggttgtgatt

SEQ ID NO: 171426 - DNA, 15 bp, Homo sapiens
tctaatggttgtgat

SEQ ID NO: 171427 - DNA, 15 bp, Homo sapiens
ttctaatggttgtga

SEQ ID NO: 171428 - DNA, 15 bp, Homo sapiens
attctaatggttgtg

SEQ ID NO: 171429 - DNA, 15 bp, Homo sapiens
aattctaatggttgt

SEQ ID NO: 171430 - DNA, 15 bp, Homo sapiens
gaattctaatggttg

SEQ ID NO: 171431 - DNA, 15 bp, Homo sapiens
tgaattctaatggtt

SEQ ID NO: 171432 - DNA, 15 bp, Homo sapiens
atgaattctaatggt

SEQ ID NO: 171433 - DNA, 15 bp, Homo sapiens
aatgaattctaatgg

SEQ ID NO: 171434 - DNA, 15 bp, Homo sapiens
aaatgaattctaatg

SEQ ID NO: 171435 - DNA, 15 bp, Homo sapiens
taaatgaattctaat

SEQ ID NO: 171436 - DNA, 15 bp, Homo sapiens
ctaaatgaattctaa

SEQ ID NO: 171437 - DNA, 15 bp, Homo sapiens
tctaaatgaattcta

SEQ ID NO: 171438 - DNA, 15 bp, Homo sapiens
atctaaatgaattct

SEQ ID NO: 171439 - DNA, 15 bp, Homo sapiens
aatctaaatgaattc

SEQ ID NO: 171440 - DNA, 15 bp, Homo sapiens
aaatctaaatgaatt

SEQ ID NO: 171441 - DNA, 15 bp, Homo sapiens
aaaatctaaatgaat

SEQ ID NO: 171442 - DNA, 15 bp, Homo sapiens
aaaaatctaaatgaa

SEQ ID NO: 171443 - DNA, 15 bp, Homo sapiens
gaaaaatctaaatga

SEQ ID NO: 171444 - DNA, 15 bp, Homo sapiens
tgaaaaatctaaatg

SEQ ID NO: 171445 - DNA, 15 bp, Homo sapiens
ttgaaaaatctaaat

SEQ ID NO: 171446 - DNA, 15 bp, Homo sapiens
tttgaaaaatctaaa

SEQ ID NO: 171447 - DNA, 15 bp, Homo sapiens
ctttgaaaaatctaa

SEQ ID NO: 171448 - DNA, 15 bp, Homo sapiens
cctttgaaaaatcta

SEQ ID NO: 171449 - DNA, 15 bp, Homo sapiens
tcctttgaaaaatct

SEQ ID NO: 171450 - DNA, 15 bp, Homo sapiens
ttcctttgaaaaatc

SEQ ID NO: 171451 - DNA, 15 bp, Homo sapiens
cttcctttgaaaaat

SEQ ID NO: 171452 - DNA, 15 bp, Homo sapiens
acttcctttgaaaaa

SEQ ID NO: 171453 - DNA, 15 bp, Homo sapiens
cacttcctttgaaaa

SEQ ID NO: 171454 - DNA, 15 bp, Homo sapiens
ccacttcctttgaaa

SEQ ID NO: 171455 - DNA, 15 bp, Homo sapiens
accacttcctttgaa

SEQ ID NO: 171456 - DNA, 15 bp, Homo sapiens
aaccacttcctttga

SEQ ID NO: 171457 - DNA, 15 bp, Homo sapiens
caaccacttcctttg

SEQ ID NO: 171458 - DNA, 15 bp, Homo sapiens
tcaaccacttccttt

SEQ ID NO: 171459 - DNA, 15 bp, Homo sapiens
ttcaaccacttcctt

SEQ ID NO: 171460 - DNA, 15 bp, Homo sapiens
tttcaaccacttcct

SEQ ID NO: 171461 - DNA, 15 bp, Homo sapiens
ttttcaaccacttcc

SEQ ID NO: 171462 - DNA, 15 bp, Homo sapiens
cttttcaaccacttc

SEQ ID NO: 171463 - DNA, 15 bp, Homo sapiens
gcttttcaaccactt

SEQ ID NO: 171464 - DNA, 15 bp, Homo sapiens
ggcttttcaaccact

SEQ ID NO: 171465 - DNA, 15 bp, Homo sapiens
cggcttttcaaccac

SEQ ID NO: 171466 - DNA, 15 bp, Homo sapiens
ccggcttttcaacca

SEQ ID NO: 171467 - DNA, 15 bp, Homo sapiens
tccggcttttcaacc

SEQ ID NO: 171468 - DNA, 15 bp, Homo sapiens
ctccggcttttcaac

SEQ ID NO: 171469 - DNA, 15 bp, Homo sapiens
cctccggcttttcaa

SEQ ID NO: 171470 - DNA, 15 bp, Homo sapiens
tcctccggcttttca

SEQ ID NO: 171471 - DNA, 15 bp, Homo sapiens
gtcctccggcttttc

SEQ ID NO: 171472 - DNA, 15 bp, Homo sapiens
agtcctccggctttt

SEQ ID NO: 171473 - DNA, 15 bp, Homo sapiens
cagtcctccggcttt

SEQ ID NO: 171474 - DNA, 15 bp, Homo sapiens
tcagtcctccggctt

SEQ ID NO: 171475 - DNA, 15 bp, Homo sapiens
ctcagtcctccggct

SEQ ID NO: 171476 - DNA, 15 bp, Homo sapiens
tctcagtcctccggc

SEQ ID NO: 171477 - DNA, 15 bp, Homo sapiens
atctcagtcctccgg

SEQ ID NO: 171478 - DNA, 15 bp, Homo sapiens
tatctcagtcctccg

SEQ ID NO: 171479 - DNA, 15 bp, Homo sapiens
ttatctcagtcctcc

SEQ ID NO: 171480 - DNA, 15 bp, Homo sapiens
tttatctcagtcctc

SEQ ID NO: 171481 - DNA, 15 bp, Homo sapiens
atttatctcagtcct

SEQ ID NO: 171482 - DNA, 15 bp, Homo sapiens
aatttatctcagtcc

SEQ ID NO: 171483 - DNA, 15 bp, Homo sapiens
caatttatctcagtc

SEQ ID NO: 171484 - DNA, 15 bp, Homo sapiens
ccaatttatctcagt

SEQ ID NO: 171485 - DNA, 15 bp, Homo sapiens
accaatttatctcag

SEQ ID NO: 171486 - DNA, 15 bp, Homo sapiens
caccaatttatctca

SEQ ID NO: 171487 - DNA, 15 bp, Homo sapiens
gcaccaatttatctc

SEQ ID NO: 171488 - DNA, 15 bp, Homo sapiens
ggcaccaatttatct

SEQ ID NO: 171489 - DNA, 15 bp, Homo sapiens
tggcaccaatttatc

SEQ ID NO: 171490 - DNA, 15 bp, Homo sapiens
atggcaccaatttat

SEQ ID NO: 171491 - DNA, 15 bp, Homo sapiens
catggcaccaattta

SEQ ID NO: 171492 - DNA, 15 bp, Homo sapiens
acatggcaccaattt

SEQ ID NO: 171493 - DNA, 15 bp, Homo sapiens
aacatggcaccaatt

SEQ ID NO: 171494 - DNA, 15 bp, Homo sapiens
gaacatggcaccaat

SEQ ID NO: 171495 - DNA, 15 bp, Homo sapiens
tgaacatggcaccaa

SEQ ID NO: 171496 - DNA, 15 bp, Homo sapiens
ctgaacatggcacca

SEQ ID NO: 171497 - DNA, 15 bp, Homo sapiens
actgaacatggcacc

SEQ ID NO: 171498 - DNA, 15 bp, Homo sapiens
cactgaacatggcac

SEQ ID NO: 171499 - DNA, 15 bp, Homo sapiens
tcactgaacatggca

SEQ ID NO: 171500 - DNA, 15 bp, Homo sapiens
ctcactgaacatggc

SEQ ID NO: 171501 - DNA, 15 bp, Homo sapiens
tctcactgaacatgg

SEQ ID NO: 171502 - DNA, 15 bp, Homo sapiens
ttctcactgaacatg

SEQ ID NO: 171503 - DNA, 15 bp, Homo sapiens
cttctcactgaacat

SEQ ID NO: 171504 - DNA, 15 bp, Homo sapiens
gcttctcactgaaca

SEQ ID NO: 171505 - DNA, 15 bp, Homo sapiens
agcttctcactgaac

SEQ ID NO: 171506 - DNA, 15 bp, Homo sapiens
cagcttctcactgaa

SEQ ID NO: 171507 - DNA, 15 bp, Homo sapiens
ccagcttctcactga

SEQ ID NO: 171508 - DNA, 15 bp, Homo sapiens
gccagcttctcactg

SEQ ID NO: 171509 - DNA, 15 bp, Homo sapiens
tgccagcttctcact

SEQ ID NO: 171510 - DNA, 15 bp, Homo sapiens
ttgccagcttctcac

SEQ ID NO: 171511 - DNA, 15 bp, Homo sapiens
tttgccagcttctca

SEQ ID NO: 171512 - DNA, 15 bp, Homo sapiens
atttgccagcttctc

SEQ ID NO: 171513 - DNA, 15 bp, Homo sapiens
aatttgccagcttct

SEQ ID NO: 171514 - DNA, 15 bp, Homo sapiens
aaatttgccagcttc

SEQ ID NO: 171515 - DNA, 15 bp, Homo sapiens
taaatttgccagctt

SEQ ID NO: 171516 - DNA, 15 bp, Homo sapiens
ataaatttgccagct

SEQ ID NO: 171517 - DNA, 15 bp, Homo sapiens
cataaatttgccagc

SEQ ID NO: 171518 - DNA, 15 bp, Homo sapiens
tcataaatttgccag

SEQ ID NO: 171519 - DNA, 15 bp, Homo sapiens
ttcataaatttgcca

SEQ ID NO: 171520 - DNA, 15 bp, Homo sapiens
cttcataaatttgcc

SEQ ID NO: 171521 - DNA, 15 bp, Homo sapiens
ccttcataaatttgc

SEQ ID NO: 171522 - DNA, 15 bp, Homo sapiens
tccttcataaatttg

SEQ ID NO: 171523 - DNA, 15 bp, Homo sapiens
ttccttcataaattt

SEQ ID NO: 171524 - DNA, 15 bp, Homo sapiens
attccttcataaatt

SEQ ID NO: 171525 - DNA, 15 bp, Homo sapiens
cattccttcataaat

SEQ ID NO: 171526 - DNA, 15 bp, Homo sapiens
acattccttcataaa

SEQ ID NO: 171527 - DNA, 15 bp, Homo sapiens
cacattccttcataa

SEQ ID NO: 171528 - DNA, 15 bp, Homo sapiens
gcacattccttcata

SEQ ID NO: 171529 - DNA, 15 bp, Homo sapiens
agcacattccttcat

SEQ ID NO: 171530 - DNA, 15 bp, Homo sapiens
tagcacattccttca

SEQ ID NO: 171531 - DNA, 15 bp, Homo sapiens
ttagcacattccttc

SEQ ID NO: 171532 - DNA, 15 bp, Homo sapiens
attagcacattcctt

SEQ ID NO: 171533 - DNA, 15 bp, Homo sapiens
cattagcacattcct

SEQ ID NO: 171534 - DNA, 15 bp, Homo sapiens
gcattagcacattcc

SEQ ID NO: 171535 - DNA, 15 bp, Homo sapiens
tgcattagcacattc

SEQ ID NO: 171536 - DNA, 15 bp, Homo sapiens
ttgcattagcacatt

SEQ ID NO: 171537 - DNA, 15 bp, Homo sapiens
tttgcattagcacat

SEQ ID NO: 171538 - DNA, 15 bp, Homo sapiens
atttgcattagcaca

SEQ ID NO: 171539 - DNA, 15 bp, Homo sapiens
tatttgcattagcac

SEQ ID NO: 171540 - DNA, 15 bp, Homo sapiens
gtatttgcattagca

SEQ ID NO: 171541 - DNA, 15 bp, Homo sapiens
agtatttgcattagc

SEQ ID NO: 171542 - DNA, 15 bp, Homo sapiens
aagtatttgcattag

SEQ ID NO: 171543 - DNA, 15 bp, Homo sapiens
taagtatttgcatta

SEQ ID NO: 171544 - DNA, 15 bp, Homo sapiens
ataagtatttgcatt

SEQ ID NO: 171545 - DNA, 15 bp, Homo sapiens
cataagtatttgcat

SEQ ID NO: 171546 - DNA, 15 bp, Homo sapiens
tcataagtatttgca

SEQ ID NO: 171547 - DNA, 15 bp, Homo sapiens
ttcataagtatttgc

SEQ ID NO: 171548 - DNA, 15 bp, Homo sapiens
attcataagtatttg

SEQ ID NO: 171549 - DNA, 15 bp, Homo sapiens
aattcataagtattt

SEQ ID NO: 171550 - DNA, 15 bp, Homo sapiens
caattcataagtatt

SEQ ID NO: 171551 - DNA, 15 bp, Homo sapiens
tcaattcataagtat

SEQ ID NO: 171552 - DNA, 15 bp, Homo sapiens
atcaattcataagta

SEQ ID NO: 171553 - DNA, 15 bp, Homo sapiens
aatcaattcataagt

SEQ ID NO: 171554 - DNA, 15 bp, Homo sapiens
aaatcaattcataag

SEQ ID NO: 171555 - DNA, 15 bp, Homo sapiens
caaatcaattcataa

SEQ ID NO: 171556 - DNA, 15 bp, Homo sapiens
gcaaatcaattcata

SEQ ID NO: 171557 - DNA, 15 bp, Homo sapiens
agcaaatcaattcat

SEQ ID NO: 171558 - DNA, 15 bp, Homo sapiens
gagcaaatcaattca

SEQ ID NO: 171559 - DNA, 15 bp, Homo sapiens
agagcaaatcaattc

SEQ ID NO: 171560 - DNA, 15 bp, Homo sapiens
tagagcaaatcaatt

SEQ ID NO: 171561 - DNA, 15 bp, Homo sapiens
gtagagcaaatcaat

SEQ ID NO: 171562 - DNA, 15 bp, Homo sapiens
tgtagagcaaatcaa

SEQ ID NO: 171563 - DNA, 15 bp, Homo sapiens
atgtagagcaaatca

SEQ ID NO: 171564 - DNA, 15 bp, Homo sapiens
tatgtagagcaaatc

SEQ ID NO: 171565 - DNA, 15 bp, Homo sapiens
atatgtagagcaaat

SEQ ID NO: 171566 - DNA, 15 bp, Homo sapiens
aatatgtagagcaaa

SEQ ID NO: 171567 - DNA, 15 bp, Homo sapiens
aaatatgtagagcaa

SEQ ID NO: 171568 - DNA, 15 bp, Homo sapiens
aaaatatgtagagca

SEQ ID NO: 171569 - DNA, 15 bp, Homo sapiens
gaaaatatgtagagc

SEQ ID NO: 171570 - DNA, 15 bp, Homo sapiens
ggaaaatatgtagag

SEQ ID NO: 171571 - DNA, 15 bp, Homo sapiens
gggaaaatatgtaga

SEQ ID NO: 171572 - DNA, 15 bp, Homo sapiens
agggaaaatatgtag

SEQ ID NO: 171573 - DNA, 15 bp, Homo sapiens
tagggaaaatatgta

SEQ ID NO: 171574 - DNA, 15 bp, Homo sapiens
ctagggaaaatatgt

SEQ ID NO: 171575 - DNA, 15 bp, Homo sapiens
cctagggaaaatatg

SEQ ID NO: 171576 - DNA, 15 bp, Homo sapiens
ccctagggaaaatat

SEQ ID NO: 171577 - DNA, 15 bp, Homo sapiens
gccctagggaaaata

SEQ ID NO: 171578 - DNA, 15 bp, Homo sapiens
ggccctagggaaaat

SEQ ID NO: 171579 - DNA, 15 bp, Homo sapiens
gggccctagggaaaa

SEQ ID NO: 171580 - DNA, 15 bp, Homo sapiens
ggggccctagggaaa

SEQ ID NO: 171581 - DNA, 15 bp, Homo sapiens
aggggccctagggaa

SEQ ID NO: 171582 - DNA, 15 bp, Homo sapiens
aaggggccctaggga

SEQ ID NO: 171583 - DNA, 15 bp, Homo sapiens
taaggggccctaggg

SEQ ID NO: 171584 - DNA, 15 bp, Homo sapiens
ctaaggggccctagg

SEQ ID NO: 171585 - DNA, 15 bp, Homo sapiens
actaaggggccctag

SEQ ID NO: 171586 - DNA, 15 bp, Homo sapiens
gactaaggggcccta

SEQ ID NO: 171587 - DNA, 15 bp, Homo sapiens
ggactaaggggccct

SEQ ID NO: 171588 - DNA, 15 bp, Homo sapiens
aggactaaggggccc

SEQ ID NO: 171589 - DNA, 15 bp, Homo sapiens
gaggactaaggggcc

SEQ ID NO: 171590 - DNA, 15 bp, Homo sapiens
agaggactaaggggc

SEQ ID NO: 171591 - DNA, 15 bp, Homo sapiens
tagaggactaagggg

SEQ ID NO: 171592 - DNA, 15 bp, Homo sapiens
atagaggactaaggg

SEQ ID NO: 171593 - DNA, 15 bp, Homo sapiens
aatagaggactaagg

SEQ ID NO: 171594 - DNA, 15 bp, Homo sapiens
taatagaggactaag

SEQ ID NO: 171595 - DNA, 15 bp, Homo sapiens
gtaatagaggactaa

SEQ ID NO: 171596 - DNA, 15 bp, Homo sapiens
agtaatagaggacta

SEQ ID NO: 171597 - DNA, 15 bp, Homo sapiens
aagtaatagaggact

SEQ ID NO: 171598 - DNA, 15 bp, Homo sapiens
taagtaatagaggac

SEQ ID NO: 171599 - DNA, 15 bp, Homo sapiens
ataagtaatagagga

SEQ ID NO: 171600 - DNA, 15 bp, Homo sapiens
aataagtaatagagg

SEQ ID NO: 171601 - DNA, 15 bp, Homo sapiens
taataagtaatagag

SEQ ID NO: 171602 - DNA, 15 bp, Homo sapiens
ctaataagtaataga

SEQ ID NO: 171603 - DNA, 15 bp, Homo sapiens
tctaataagtaatag

SEQ ID NO: 171604 - DNA, 15 bp, Homo sapiens
ttctaataagtaata

SEQ ID NO: 171605 - DNA, 15 bp, Homo sapiens
attctaataagtaat

SEQ ID NO: 171606 - DNA, 15 bp, Homo sapiens
gattctaataagtaa

SEQ ID NO: 171607 - DNA, 15 bp, Homo sapiens
agattctaataagta

SEQ ID NO: 171608 - DNA, 15 bp, Homo sapiens
aagattctaataagt

SEQ ID NO: 171609 - DNA, 15 bp, Homo sapiens
aaagattctaataag

SEQ ID NO: 171610 - DNA, 15 bp, Homo sapiens
taaagattctaataa

SEQ ID NO: 171611 - DNA, 15 bp, Homo sapiens
gtaaagattctaata

SEQ ID NO: 171612 - DNA, 15 bp, Homo sapiens
ggtaaagattctaat

SEQ ID NO: 171613 - DNA, 15 bp, Homo sapiens
aggtaaagattctaa

SEQ ID NO: 171614 - DNA, 15 bp, Homo sapiens
aaggtaaagattcta

SEQ ID NO: 171615 - DNA, 15 bp, Homo sapiens
gaaggtaaagattct

SEQ ID NO: 171616 - DNA, 15 bp, Homo sapiens
agaaggtaaagattc

SEQ ID NO: 171617 - DNA, 15 bp, Homo sapiens
cagaaggtaaagatt

SEQ ID NO: 171618 - DNA, 15 bp, Homo sapiens
acagaaggtaaagat

SEQ ID NO: 171619 - DNA, 15 bp, Homo sapiens
tacagaaggtaaaga

SEQ ID NO: 171620 - DNA, 15 bp, Homo sapiens
gtacagaaggtaaag

SEQ ID NO: 171621 - DNA, 15 bp, Homo sapiens
ggtacagaaggtaaa

SEQ ID NO: 171622 - DNA, 15 bp, Homo sapiens
tggtacagaaggtaa

SEQ ID NO: 171623 - DNA, 15 bp, Homo sapiens
gtggtacagaaggta

SEQ ID NO: 171624 - DNA, 15 bp, Homo sapiens
tgtggtacagaaggt

SEQ ID NO: 171625 - DNA, 15 bp, Homo sapiens
ctgtggtacagaagg

SEQ ID NO: 171626 - DNA, 15 bp, Homo sapiens
tctgtggtacagaag

SEQ ID NO: 171627 - DNA, 15 bp, Homo sapiens
ttctgtggtacagaa

SEQ ID NO: 171628 - DNA, 15 bp, Homo sapiens
cttctgtggtacaga

SEQ ID NO: 171629 - DNA, 15 bp, Homo sapiens
acttctgtggtacag

SEQ ID NO: 171630 - DNA, 15 bp, Homo sapiens
tacttctgtggtaca

SEQ ID NO: 171631 - DNA, 15 bp, Homo sapiens
ttacttctgtggtac

SEQ ID NO: 171632 - DNA, 15 bp, Homo sapiens
tttacttctgtggta

SEQ ID NO: 171633 - DNA, 15 bp, Homo sapiens
gtttacttctgtggt

SEQ ID NO: 171634 - DNA, 15 bp, Homo sapiens
ggtttacttctgtgg

SEQ ID NO: 171635 - DNA, 15 bp, Homo sapiens
aggtttacttctgtg

SEQ ID NO: 171636 - DNA, 15 bp, Homo sapiens
taggtttacttctgt

SEQ ID NO: 171637 - DNA, 15 bp, Homo sapiens
ttaggtttacttctg

SEQ ID NO: 171638 - DNA, 15 bp, Homo sapiens
tttaggtttacttct

SEQ ID NO: 171639 - DNA, 15 bp, Homo sapiens
ctttaggtttacttc

SEQ ID NO: 171640 - DNA, 15 bp, Homo sapiens
gctttaggtttactt

SEQ ID NO: 171641 - DNA, 15 bp, Homo sapiens
tgctttaggtttact

SEQ ID NO: 171642 - DNA, 15 bp, Homo sapiens
gtgctttaggtttac

SEQ ID NO: 171643 - DNA, 15 bp, Homo sapiens
tgtgctttaggttta

SEQ ID NO: 171644 - DNA, 15 bp, Homo sapiens
ctgtgctttaggttt

SEQ ID NO: 171645 - DNA, 15 bp, Homo sapiens
gctgtgctttaggtt

SEQ ID NO: 171646 - DNA, 15 bp, Homo sapiens
ggctgtgctttaggt

SEQ ID NO: 171647 - DNA, 15 bp, Homo sapiens
aggctgtgctttagg

SEQ ID NO: 171648 - DNA, 15 bp, Homo sapiens
aaggctgtgctttag

SEQ ID NO: 171649 - DNA, 15 bp, Homo sapiens
taaggctgtgcttta

SEQ ID NO: 171650 - DNA, 15 bp, Homo sapiens
gtaaggctgtgcttt

SEQ ID NO: 171651 - DNA, 15 bp, Homo sapiens
agtaaggctgtgctt

SEQ ID NO: 171652 - DNA, 15 bp, Homo sapiens
tagtaaggctgtgct

SEQ ID NO: 171653 - DNA, 15 bp, Homo sapiens
ttagtaaggctgtgc

SEQ ID NO: 171654 - DNA, 15 bp, Homo sapiens
cttagtaaggctgtg

SEQ ID NO: 171655 - DNA, 15 bp, Homo sapiens
tcttagtaaggctgt

SEQ ID NO: 171656 - DNA, 15 bp, Homo sapiens
atcttagtaaggctg

SEQ ID NO: 171657 - DNA, 15 bp, Homo sapiens
aatcttagtaaggct

SEQ ID NO: 171658 - DNA, 15 bp, Homo sapiens
caatcttagtaaggc

SEQ ID NO: 171659 - DNA, 15 bp, Homo sapiens
acaatcttagtaagg

SEQ ID NO: 171660 - DNA, 15 bp, Homo sapiens
aacaatcttagtaag

SEQ ID NO: 171661 - DNA, 15 bp, Homo sapiens
aaacaatcttagtaa

SEQ ID NO: 171662 - DNA, 15 bp, Homo sapiens
aaaacaatcttagta

SEQ ID NO: 171663 - DNA, 15 bp, Homo sapiens
aaaaacaatcttagt

SEQ ID NO: 171664 - DNA, 15 bp, Homo sapiens
caaaaacaatcttag

SEQ ID NO: 171665 - DNA, 15 bp, Homo sapiens
gcaaaaacaatctta

SEQ ID NO: 171666 - DNA, 15 bp, Homo sapiens
agcaaaaacaatctt

SEQ ID NO: 171667 - DNA, 15 bp, Homo sapiens
aagcaaaaacaatct

SEQ ID NO: 171668 - DNA, 15 bp, Homo sapiens
aaagcaaaaacaatc

SEQ ID NO: 171669 - DNA, 15 bp, Homo sapiens
gaaagcaaaaacaat

SEQ ID NO: 171670 - DNA, 15 bp, Homo sapiens
tgaaagcaaaaacaa

SEQ ID NO: 171671 - DNA, 15 bp, Homo sapiens
atgaaagcaaaaaca

SEQ ID NO: 171672 - DNA, 15 bp, Homo sapiens
catgaaagcaaaaac

SEQ ID NO: 171673 - DNA, 15 bp, Homo sapiens
ccatgaaagcaaaaa

SEQ ID NO: 171674 - DNA, 15 bp, Homo sapiens
cccatgaaagcaaaa

SEQ ID NO: 171675 - DNA, 15 bp, Homo sapiens
ccccatgaaagcaaa

SEQ ID NO: 171676 - DNA, 15 bp, Homo sapiens
gccccatgaaagcaa

SEQ ID NO: 171677 - DNA, 15 bp, Homo sapiens
ggccccatgaaagca

SEQ ID NO: 171678 - DNA, 15 bp, Homo sapiens
tggccccatgaaagc

SEQ ID NO: 171679 - DNA, 15 bp, Homo sapiens
ctggccccatgaaag

SEQ ID NO: 171680 - DNA, 15 bp, Homo sapiens
actggccccatgaaa

SEQ ID NO: 171681 - DNA, 15 bp, Homo sapiens
aactggccccatgaa

SEQ ID NO: 171682 - DNA, 15 bp, Homo sapiens
caactggccccatga

SEQ ID NO: 171683 - DNA, 15 bp, Homo sapiens
tcaactggccccatg

SEQ ID NO: 171684 - DNA, 15 bp, Homo sapiens
ttcaactggccccat

SEQ ID NO: 171685 - DNA, 15 bp, Homo sapiens
attcaactggcccca

SEQ ID NO: 171686 - DNA, 15 bp, Homo sapiens
tattcaactggcccc

SEQ ID NO: 171687 - DNA, 15 bp, Homo sapiens
atattcaactggccc

SEQ ID NO: 171688 - DNA, 15 bp, Homo sapiens
tatattcaactggcc

SEQ ID NO: 171689 - DNA, 15 bp, Homo sapiens
atatattcaactggc

SEQ ID NO: 171690 - DNA, 15 bp, Homo sapiens
aatatattcaactgg

SEQ ID NO: 171691 - DNA, 15 bp, Homo sapiens
aaatatattcaactg

SEQ ID NO: 171692 - DNA, 15 bp, Homo sapiens
gaaatatattcaact

SEQ ID NO: 171693 - DNA, 15 bp, Homo sapiens
tgaaatatattcaac

SEQ ID NO: 171694 - DNA, 15 bp, Homo sapiens
atgaaatatattcaa

SEQ ID NO: 171695 - DNA, 15 bp, Homo sapiens
gatgaaatatattca

SEQ ID NO: 171696 - DNA, 15 bp, Homo sapiens
agatgaaatatattc

SEQ ID NO: 171697 - DNA, 15 bp, Homo sapiens
aagatgaaatatatt

SEQ ID NO: 171698 - DNA, 15 bp, Homo sapiens
gaagatgaaatatat

SEQ ID NO: 171699 - DNA, 15 bp, Homo sapiens
ggaagatgaaatata

SEQ ID NO: 171700 - DNA, 15 bp, Homo sapiens
aggaagatgaaatat

SEQ ID NO: 171701 - DNA, 15 bp, Homo sapiens
aaggaagatgaaata

SEQ ID NO: 171702 - DNA, 15 bp, Homo sapiens
aaaggaagatgaaat

SEQ ID NO: 171703 - DNA, 15 bp, Homo sapiens
aaaaggaagatgaaa

SEQ ID NO: 171704 - DNA, 15 bp, Homo sapiens
taaaaggaagatgaa

SEQ ID NO: 171705 - DNA, 15 bp, Homo sapiens
ataaaaggaagatga

SEQ ID NO: 171706 - DNA, 15 bp, Homo sapiens
cataaaaggaagatg

SEQ ID NO: 171707 - DNA, 15 bp, Homo sapiens
acataaaaggaagat

SEQ ID NO: 171708 - DNA, 15 bp, Homo sapiens
cacataaaaggaaga

SEQ ID NO: 171709 - DNA, 15 bp, Homo sapiens
tcacataaaaggaag

SEQ ID NO: 171710 - DNA, 15 bp, Homo sapiens
gtcacataaaaggaa

SEQ ID NO: 171711 - DNA, 15 bp, Homo sapiens
tgtcacataaaagga

SEQ ID NO: 171712 - DNA, 15 bp, Homo sapiens
ttgtcacataaaagg

SEQ ID NO: 171713 - DNA, 15 bp, Homo sapiens
tttgtcacataaaag

SEQ ID NO: 171714 - DNA, 15 bp, Homo sapiens
ttttgtcacataaaa

SEQ ID NO: 171715 - DNA, 15 bp, Homo sapiens
tttttgtcacataaa

SEQ ID NO: 171716 - DNA, 15 bp, Homo sapiens
atttttgtcacataa

SEQ ID NO: 171717 - DNA, 15 bp, Homo sapiens
tatttttgtcacata

SEQ ID NO: 171718 - DNA, 15 bp, Homo sapiens
ttatttttgtcacat

SEQ ID NO: 171719 - DNA, 15 bp, Homo sapiens
attatttttgtcaca

SEQ ID NO: 171720 - DNA, 15 bp, Homo sapiens
aattatttttgtcac

SEQ ID NO: 171721 - DNA, 15 bp, Homo sapiens
caattatttttgtca

SEQ ID NO: 171722 - DNA, 15 bp, Homo sapiens
tcaattatttttgtc

SEQ ID NO: 171723 - DNA, 15 bp, Homo sapiens
ctcaattatttttgt

SEQ ID NO: 171724 - DNA, 15 bp, Homo sapiens
tctcaattatttttg

SEQ ID NO: 171725 - DNA, 15 bp, Homo sapiens
ttctcaattattttt

SEQ ID NO: 171726 - DNA, 15 bp, Homo sapiens
tttctcaattatttt

SEQ ID NO: 171727 - DNA, 15 bp, Homo sapiens
gtttctcaattattt

SEQ ID NO: 171728 - DNA, 15 bp, Homo sapiens
tgtttctcaattatt

SEQ ID NO: 171729 - DNA, 15 bp, Homo sapiens
atgtttctcaattat

SEQ ID NO: 171730 - DNA, 15 bp, Homo sapiens
gatgtttctcaatta

SEQ ID NO: 171731 - DNA, 15 bp, Homo sapiens
tgatgtttctcaatt

SEQ ID NO: 171732 - DNA, 15 bp, Homo sapiens
ttgatgtttctcaat

SEQ ID NO: 171733 - DNA, 15 bp, Homo sapiens
tttgatgtttctcaa

SEQ ID NO: 171734 - DNA, 15 bp, Homo sapiens
atttgatgtttctca

SEQ ID NO: 171735 - DNA, 15 bp, Homo sapiens
catttgatgtttctc

SEQ ID NO: 171736 - DNA, 15 bp, Homo sapiens
tcatttgatgtttct

SEQ ID NO: 171737 - DNA, 15 bp, Homo sapiens
atcatttgatgtttc

SEQ ID NO: 171738 - DNA, 15 bp, Homo sapiens
catcatttgatgttt

SEQ ID NO: 171739 - DNA, 15 bp, Homo sapiens
acatcatttgatgtt

SEQ ID NO: 171740 - DNA, 15 bp, Homo sapiens
aacatcatttgatgt

SEQ ID NO: 171741 - DNA, 15 bp, Homo sapiens
aaacatcatttgatg

SEQ ID NO: 171742 - DNA, 15 bp, Homo sapiens
taaacatcatttgat

SEQ ID NO: 171743 - DNA, 15 bp, Homo sapiens
ttaaacatcatttga

SEQ ID NO: 171744 - DNA, 15 bp, Homo sapiens
attaaacatcatttg

SEQ ID NO: 171745 - DNA, 15 bp, Homo sapiens
aattaaacatcattt

SEQ ID NO: 171746 - DNA, 15 bp, Homo sapiens
caattaaacatcatt

SEQ ID NO: 171747 - DNA, 15 bp, Homo sapiens
acaattaaacatcat

SEQ ID NO: 171748 - DNA, 15 bp, Homo sapiens
aacaattaaacatca

SEQ ID NO: 171749 - DNA, 15 bp, Homo sapiens
aaacaattaaacatc

SEQ ID NO: 171750 - DNA, 15 bp, Homo sapiens
aaaacaattaaacat

SEQ ID NO: 171751 - DNA, 15 bp, Homo sapiens
caaaacaattaaaca

SEQ ID NO: 171752 - DNA, 15 bp, Homo sapiens
tcaaaacaattaaac

SEQ ID NO: 171753 - DNA, 15 bp, Homo sapiens
ttcaaaacaattaaa

SEQ ID NO: 171754 - DNA, 15 bp, Homo sapiens
tttcaaaacaattaa

SEQ ID NO: 171755 - DNA, 15 bp, Homo sapiens
ttttcaaaacaatta

SEQ ID NO: 171756 - DNA, 15 bp, Homo sapiens
gttttcaaaacaatt

SEQ ID NO: 171757 - DNA, 15 bp, Homo sapiens
tgttttcaaaacaat

SEQ ID NO: 171758 - DNA, 15 bp, Homo sapiens
atgttttcaaaacaa

SEQ ID NO: 171759 - DNA, 15 bp, Homo sapiens
tatgttttcaaaaca

SEQ ID NO: 171760 - DNA, 15 bp, Homo sapiens
ttatgttttcaaaac

SEQ ID NO: 171761 - DNA, 15 bp, Homo sapiens
tttatgttttcaaaa

SEQ ID NO: 171762 - DNA, 15 bp, Homo sapiens
gtttatgttttcaaa

SEQ ID NO: 171763 - DNA, 15 bp, Homo sapiens
tgtttatgttttcaa

SEQ ID NO: 171764 - DNA, 15 bp, Homo sapiens
ttgtttatgttttca

SEQ ID NO: 171765 - DNA, 15 bp, Homo sapiens
tttgtttatgttttc

SEQ ID NO: 171766 - DNA, 15 bp, Homo sapiens
ttttgtttatgtttt

SEQ ID NO: 171767 - DNA, 15 bp, Homo sapiens
gttttgtttatgttt

SEQ ID NO: 171768 - DNA, 15 bp, Homo sapiens
agttttgtttatgtt

SEQ ID NO: 171769 - DNA, 15 bp, Homo sapiens
cagttttgtttatgt

SEQ ID NO: 171770 - DNA, 15 bp, Homo sapiens
ccagttttgtttatg

SEQ ID NO: 171771 - DNA, 15 bp, Homo sapiens
tccagttttgtttat

SEQ ID NO: 171772 - DNA, 15 bp, Homo sapiens
ctccagttttgttta

SEQ ID NO: 171773 - DNA, 15 bp, Homo sapiens
tctccagttttgttt

SEQ ID NO: 171774 - DNA, 15 bp, Homo sapiens
atctccagttttgtt

SEQ ID NO: 171775 - DNA, 15 bp, Homo sapiens
aatctccagttttgt

SEQ ID NO: 171776 - DNA, 15 bp, Homo sapiens
aaatctccagttttg

SEQ ID NO: 171777 - DNA, 15 bp, Homo sapiens
aaaatctccagtttt

SEQ ID NO: 171778 - DNA, 15 bp, Homo sapiens
taaaatctccagttt

SEQ ID NO: 171779 - DNA, 15 bp, Homo sapiens
ataaaatctccagtt

SEQ ID NO: 171780 - DNA, 15 bp, Homo sapiens
tataaaatctccagt

SEQ ID NO: 171781 - DNA, 15 bp, Homo sapiens
ttataaaatctccag

SEQ ID NO: 171782 - DNA, 15 bp, Homo sapiens
tttataaaatctcca

SEQ ID NO: 171783 - DNA, 15 bp, Homo sapiens
ctttataaaatctcc

SEQ ID NO: 171784 - DNA, 15 bp, Homo sapiens
gctttataaaatctc

SEQ ID NO: 171785 - DNA, 15 bp, Homo sapiens
ggctttataaaatct

SEQ ID NO: 171786 - DNA, 15 bp, Homo sapiens
aggctttataaaatc

SEQ ID NO: 171787 - DNA, 15 bp, Homo sapiens
aaggctttataaaat

SEQ ID NO: 171788 - DNA, 15 bp, Homo sapiens
caaggctttataaaa

SEQ ID NO: 171789 - DNA, 15 bp, Homo sapiens
acaaggctttataaa

SEQ ID NO: 171790 - DNA, 15 bp, Homo sapiens
aacaaggctttataa

SEQ ID NO: 171791 - DNA, 15 bp, Homo sapiens
gaacaaggctttata

SEQ ID NO: 171792 - DNA, 15 bp, Homo sapiens
agaacaaggctttat

SEQ ID NO: 171793 - DNA, 15 bp, Homo sapiens
tagaacaaggcttta

SEQ ID NO: 171794 - DNA, 15 bp, Homo sapiens
ttagaacaaggcttt

SEQ ID NO: 171795 - DNA, 15 bp, Homo sapiens
cttagaacaaggctt

SEQ ID NO: 171796 - DNA, 15 bp, Homo sapiens
gcttagaacaaggct

SEQ ID NO: 171797 - DNA, 15 bp, Homo sapiens
agcttagaacaaggc

SEQ ID NO: 171798 - DNA, 15 bp, Homo sapiens
aagcttagaacaagg

SEQ ID NO: 171799 - DNA, 15 bp, Homo sapiens
caagcttagaacaag

SEQ ID NO: 171800 - DNA, 15 bp, Homo sapiens
tcaagcttagaacaa

SEQ ID NO: 171801 - DNA, 15 bp, Homo sapiens
ttcaagcttagaaca

SEQ ID NO: 171802 - DNA, 15 bp, Homo sapiens
tttcaagcttagaac

SEQ ID NO: 171803 - DNA, 15 bp, Homo sapiens
ttttcaagcttagaa

SEQ ID NO: 171804 - DNA, 15 bp, Homo sapiens
cttttcaagcttaga

SEQ ID NO: 171805 - DNA, 15 bp, Homo sapiens
tcttttcaagcttag

SEQ ID NO: 171806 - DNA, 15 bp, Homo sapiens
ttcttttcaagctta

SEQ ID NO: 171807 - DNA, 15 bp, Homo sapiens
cttcttttcaagctt

SEQ ID NO: 171808 - DNA, 15 bp, Homo sapiens
ccttcttttcaagct

SEQ ID NO: 171809 - DNA, 15 bp, Homo sapiens
tccttcttttcaagc

SEQ ID NO: 171810 - DNA, 15 bp, Homo sapiens
ttccttcttttcaag

SEQ ID NO: 171811 - DNA, 15 bp, Homo sapiens
tttccttcttttcaa

SEQ ID NO: 171812 - DNA, 15 bp, Homo sapiens
ttttccttcttttca

SEQ ID NO: 171813 - DNA, 15 bp, Homo sapiens
tttttccttcttttc

SEQ ID NO: 171814 - DNA, 15 bp, Homo sapiens
ttttttccttctttt

SEQ ID NO: 171815 - DNA, 15 bp, Homo sapiens
tttttttccttcttt

SEQ ID NO: 171816 - DNA, 15 bp, Homo sapiens
ttttttttccttctt

SEQ ID NO: 171817 - DNA, 15 bp, Homo sapiens
attttttttccttct

SEQ ID NO: 171818 - DNA, 15 bp, Homo sapiens
gattttttttccttc

SEQ ID NO: 171819 - DNA, 15 bp, Homo sapiens
tgattttttttcctt

SEQ ID NO: 171820 - DNA, 15 bp, Homo sapiens
ctgattttttttcct

SEQ ID NO: 171821 - DNA, 15 bp, Homo sapiens
actgattttttttcc

SEQ ID NO: 171822 - DNA, 15 bp, Homo sapiens
aactgattttttttc

SEQ ID NO: 171823 - DNA, 15 bp, Homo sapiens
aaactgatttttttt

SEQ ID NO: 171824 - DNA, 15 bp, Homo sapiens
gaaactgattttttt

SEQ ID NO: 171825 - DNA, 15 bp, Homo sapiens
agaaactgatttttt

SEQ ID NO: 171826 - DNA, 15 bp, Homo sapiens
cagaaactgattttt

SEQ ID NO: 171827 - DNA, 15 bp, Homo sapiens
ccagaaactgatttt

SEQ ID NO: 171828 - DNA, 15 bp, Homo sapiens
gccagaaactgattt

SEQ ID NO: 171829 - DNA, 15 bp, Homo sapiens
agccagaaactgatt

SEQ ID NO: 171830 - DNA, 15 bp, Homo sapiens
cagccagaaactgat

SEQ ID NO: 171831 - DNA, 15 bp, Homo sapiens
tcagccagaaactga

SEQ ID NO: 171832 - DNA, 15 bp, Homo sapiens
ttcagccagaaactg

SEQ ID NO: 171833 - DNA, 15 bp, Homo sapiens
tttcagccagaaact

SEQ ID NO: 171834 - DNA, 15 bp, Homo sapiens
ttttcagccagaaac

SEQ ID NO: 171835 - DNA, 15 bp, Homo sapiens
cttttcagccagaaa

SEQ ID NO: 171836 - DNA, 15 bp, Homo sapiens
acttttcagccagaa

SEQ ID NO: 171837 - DNA, 15 bp, Homo sapiens
aacttttcagccaga

SEQ ID NO: 171838 - DNA, 15 bp, Homo sapiens
aaacttttcagccag

SEQ ID NO: 171839 - DNA, 15 bp, Homo sapiens
gaaacttttcagcca

SEQ ID NO: 171840 - DNA, 15 bp, Homo sapiens
agaaacttttcagcc

SEQ ID NO: 171841 - DNA, 15 bp, Homo sapiens
cagaaacttttcagc

SEQ ID NO: 171842 - DNA, 15 bp, Homo sapiens
acagaaacttttcag

SEQ ID NO: 171843 - DNA, 15 bp, Homo sapiens
aacagaaacttttca

SEQ ID NO: 171844 - DNA, 15 bp, Homo sapiens
caacagaaacttttc

SEQ ID NO: 171845 - DNA, 15 bp, Homo sapiens
tcaacagaaactttt

SEQ ID NO: 171846 - DNA, 15 bp, Homo sapiens
gtcaacagaaacttt

SEQ ID NO: 171847 - DNA, 15 bp, Homo sapiens
tgtcaacagaaactt

SEQ ID NO: 171848 - DNA, 15 bp, Homo sapiens
gtgtcaacagaaact

SEQ ID NO: 171849 - DNA, 15 bp, Homo sapiens
agtgtcaacagaaac

SEQ ID NO: 171850 - DNA, 15 bp, Homo sapiens
cagtgtcaacagaaa

SEQ ID NO: 171851 - DNA, 15 bp, Homo sapiens
ccagtgtcaacagaa

SEQ ID NO: 171852 - DNA, 15 bp, Homo sapiens
tccagtgtcaacaga

SEQ ID NO: 171853 - DNA, 15 bp, Homo sapiens
gtccagtgtcaacag

SEQ ID NO: 171854 - DNA, 15 bp, Homo sapiens
ggtccagtgtcaaca

SEQ ID NO: 171855 - DNA, 15 bp, Homo sapiens
cggtccagtgtcaac

SEQ ID NO: 171856 - DNA, 15 bp, Homo sapiens
tcggtccagtgtcaa

SEQ ID NO: 171857 - DNA, 15 bp, Homo sapiens
atcggtccagtgtca

SEQ ID NO: 171858 - DNA, 15 bp, Homo sapiens
gatcggtccagtgtc

SEQ ID NO: 171859 - DNA, 15 bp, Homo sapiens
tgatcggtccagtgt

SEQ ID NO: 171860 - DNA, 15 bp, Homo sapiens
ttgatcggtccagtg

SEQ ID NO: 171861 - DNA, 15 bp, Homo sapiens
tttgatcggtccagt

SEQ ID NO: 171862 - DNA, 15 bp, Homo sapiens
gtttgatcggtccag

SEQ ID NO: 171863 - DNA, 15 bp, Homo sapiens
tgtttgatcggtcca

SEQ ID NO: 171864 - DNA, 15 bp, Homo sapiens
ctgtttgatcggtcc

SEQ ID NO: 171865 - DNA, 15 bp, Homo sapiens
actgtttgatcggtc

SEQ ID NO: 171866 - DNA, 15 bp, Homo sapiens
aactgtttgatcggt

SEQ ID NO: 171867 - DNA, 15 bp, Homo sapiens
aaactgtttgatcgg

SEQ ID NO: 171868 - DNA, 15 bp, Homo sapiens
aaaactgtttgatcg

SEQ ID NO: 171869 - DNA, 15 bp, Homo sapiens
gaaaactgtttgatc

SEQ ID NO: 171870 - DNA, 15 bp, Homo sapiens
agaaaactgtttgat

SEQ ID NO: 171871 - DNA, 15 bp, Homo sapiens
aagaaaactgtttga

SEQ ID NO: 171872 - DNA, 15 bp, Homo sapiens
aaagaaaactgtttg

SEQ ID NO: 171873 - DNA, 15 bp, Homo sapiens
gaaagaaaactgttt

SEQ ID NO: 171874 - DNA, 15 bp, Homo sapiens
tgaaagaaaactgtt

SEQ ID NO: 171875 - DNA, 15 bp, Homo sapiens
ctgaaagaaaactgt

SEQ ID NO: 171876 - DNA, 15 bp, Homo sapiens
tctgaaagaaaactg

SEQ ID NO: 171877 - DNA, 15 bp, Homo sapiens
gtctgaaagaaaact

SEQ ID NO: 171878 - DNA, 15 bp, Homo sapiens
tgtctgaaagaaaac

SEQ ID NO: 171879 - DNA, 15 bp, Homo sapiens
ttgtctgaaagaaaa

SEQ ID NO: 171880 - DNA, 15 bp, Homo sapiens
attgtctgaaagaaa

SEQ ID NO: 171881 - DNA, 15 bp, Homo sapiens
tattgtctgaaagaa

SEQ ID NO: 171882 - DNA, 15 bp, Homo sapiens
atattgtctgaaaga

SEQ ID NO: 171883 - DNA, 15 bp, Homo sapiens
aatattgtctgaaag

SEQ ID NO: 171884 - DNA, 15 bp, Homo sapiens
aaatattgtctgaaa

SEQ ID NO: 171885 - DNA, 15 bp, Homo sapiens
gaaatattgtctgaa

SEQ ID NO: 171886 - DNA, 15 bp, Homo sapiens
agaaatattgtctga

SEQ ID NO: 171887 - DNA, 15 bp, Homo sapiens
tagaaatattgtctg

SEQ ID NO: 171888 - DNA, 15 bp, Homo sapiens
atagaaatattgtct

SEQ ID NO: 171889 - DNA, 15 bp, Homo sapiens
tatagaaatattgtc

SEQ ID NO: 171890 - DNA, 15 bp, Homo sapiens
ctatagaaatattgt

SEQ ID NO: 171891 - DNA, 15 bp, Homo sapiens
gctatagaaatattg

SEQ ID NO: 171892 - DNA, 15 bp, Homo sapiens
agctatagaaatatt

SEQ ID NO: 171893 - DNA, 15 bp, Homo sapiens
cagctatagaaatat

SEQ ID NO: 171894 - DNA, 15 bp, Homo sapiens
acagctatagaaata

SEQ ID NO: 171895 - DNA, 15 bp, Homo sapiens
tacagctatagaaat

SEQ ID NO: 171896 - DNA, 15 bp, Homo sapiens
atacagctatagaaa

SEQ ID NO: 171897 - DNA, 15 bp, Homo sapiens
gatacagctatagaa

SEQ ID NO: 171898 - DNA, 15 bp, Homo sapiens
tgatacagctataga

SEQ ID NO: 171899 - DNA, 15 bp, Homo sapiens
gtgatacagctatag

SEQ ID NO: 171900 - DNA, 15 bp, Homo sapiens
tgtgatacagctata

SEQ ID NO: 171901 - DNA, 15 bp, Homo sapiens
ctgtgatacagctat

SEQ ID NO: 171902 - DNA, 15 bp, Homo sapiens
tctgtgatacagcta

SEQ ID NO: 171903 - DNA, 15 bp, Homo sapiens
ttctgtgatacagct

SEQ ID NO: 171904 - DNA, 15 bp, Homo sapiens
tttctgtgatacagc

SEQ ID NO: 171905 - DNA, 15 bp, Homo sapiens
atttctgtgatacag

SEQ ID NO: 171906 - DNA, 15 bp, Homo sapiens
aatttctgtgataca

SEQ ID NO: 171907 - DNA, 15 bp, Homo sapiens
taatttctgtgatac

SEQ ID NO: 171908 - DNA, 15 bp, Homo sapiens
ctaatttctgtgata

SEQ ID NO: 171909 - DNA, 15 bp, Homo sapiens
cctaatttctgtgat

SEQ ID NO: 171910 - DNA, 15 bp, Homo sapiens
ccctaatttctgtga

SEQ ID NO: 171911 - DNA, 15 bp, Homo sapiens
cccctaatttctgtg

SEQ ID NO: 171912 - DNA, 15 bp, Homo sapiens
gcccctaatttctgt

SEQ ID NO: 171913 - DNA, 15 bp, Homo sapiens
agcccctaatttctg

SEQ ID NO: 171914 - DNA, 15 bp, Homo sapiens
cagcccctaatttct

SEQ ID NO: 171915 - DNA, 15 bp, Homo sapiens
tcagcccctaatttc

SEQ ID NO: 171916 - DNA, 15 bp, Homo sapiens
gtcagcccctaattt

SEQ ID NO: 171917 - DNA, 15 bp, Homo sapiens
tgtcagcccctaatt

SEQ ID NO: 171918 - DNA, 15 bp, Homo sapiens
ctgtcagcccctaat

SEQ ID NO: 171919 - DNA, 15 bp, Homo sapiens
actgtcagcccctaa

SEQ ID NO: 171920 - DNA, 15 bp, Homo sapiens
cactgtcagccccta

SEQ ID NO: 171921 - DNA, 15 bp, Homo sapiens
tcactgtcagcccct

SEQ ID NO: 171922 - DNA, 15 bp, Homo sapiens
gtcactgtcagcccc

SEQ ID NO: 171923 - DNA, 15 bp, Homo sapiens
ggtcactgtcagccc

SEQ ID NO: 171924 - DNA, 15 bp, Homo sapiens
tggtcactgtcagcc

SEQ ID NO: 171925 - DNA, 15 bp, Homo sapiens
ctggtcactgtcagc

SEQ ID NO: 171926 - DNA, 15 bp, Homo sapiens
actggtcactgtcag

SEQ ID NO: 171927 - DNA, 15 bp, Homo sapiens
tactggtcactgtca

SEQ ID NO: 171928 - DNA, 15 bp, Homo sapiens
ctactggtcactgtc

SEQ ID NO: 171929 - DNA, 15 bp, Homo sapiens
actactggtcactgt

SEQ ID NO: 171930 - DNA, 15 bp, Homo sapiens
aactactggtcactg

SEQ ID NO: 171931 - DNA, 15 bp, Homo sapiens
aaactactggtcact

SEQ ID NO: 171932 - DNA, 15 bp, Homo sapiens
taaactactggtcac

SEQ ID NO: 171933 - DNA, 15 bp, Homo sapiens
ataaactactggtca

SEQ ID NO: 171934 - DNA, 15 bp, Homo sapiens
aataaactactggtc

SEQ ID NO: 171935 - DNA, 15 bp, Homo sapiens
aaataaactactggt

SEQ ID NO: 171936 - DNA, 15 bp, Homo sapiens
aaaataaactactgg

SEQ ID NO: 171937 - DNA, 15 bp, Homo sapiens
gaaaataaactactg

SEQ ID NO: 171938 - DNA, 15 bp, Homo sapiens
tgaaaataaactact

SEQ ID NO: 171939 - DNA, 15 bp, Homo sapiens
atgaaaataaactac

SEQ ID NO: 171940 - DNA, 15 bp, Homo sapiens
aatgaaaataaacta

SEQ ID NO: 171941 - DNA, 15 bp, Homo sapiens
caatgaaaataaact

SEQ ID NO: 171942 - DNA, 15 bp, Homo sapiens
gcaatgaaaataaac

SEQ ID NO: 171943 - DNA, 15 bp, Homo sapiens
ggcaatgaaaataaa

SEQ ID NO: 171944 - DNA, 15 bp, Homo sapiens
aggcaatgaaaataa

SEQ ID NO: 171945 - DNA, 15 bp, Homo sapiens
gaggcaatgaaaata

SEQ ID NO: 171946 - DNA, 15 bp, Homo sapiens
tgaggcaatgaaaat

SEQ ID NO: 171947 - DNA, 15 bp, Homo sapiens
atgaggcaatgaaaa

SEQ ID NO: 171948 - DNA, 15 bp, Homo sapiens
tatgaggcaatgaaa

SEQ ID NO: 171949 - DNA, 15 bp, Homo sapiens
gtatgaggcaatgaa

SEQ ID NO: 171950 - DNA, 15 bp, Homo sapiens
agtatgaggcaatga

SEQ ID NO: 171951 - DNA, 15 bp, Homo sapiens
aagtatgaggcaatg

SEQ ID NO: 171952 - DNA, 15 bp, Homo sapiens
aaagtatgaggcaat

SEQ ID NO: 171953 - DNA, 15 bp, Homo sapiens
gaaagtatgaggcaa

SEQ ID NO: 171954 - DNA, 15 bp, Homo sapiens
tgaaagtatgaggca

SEQ ID NO: 171955 - DNA, 15 bp, Homo sapiens
ttgaaagtatgaggc

SEQ ID NO: 171956 - DNA, 15 bp, Homo sapiens
tttgaaagtatgagg

SEQ ID NO: 171957 - DNA, 15 bp, Homo sapiens
ctttgaaagtatgag

SEQ ID NO: 171958 - DNA, 15 bp, Homo sapiens
tctttgaaagtatga

SEQ ID NO: 171959 - DNA, 15 bp, Homo sapiens
cagaaatgtgctaca

SEQ ID NO: 171960 - DNA, 15 bp, Homo sapiens
gcagaaatgtgctac

SEQ ID NO: 171961 - DNA, 15 bp, Homo sapiens
tgcagaaatgtgcta

SEQ ID NO: 171962 - DNA, 15 bp, Homo sapiens
atgcagaaatgtgct

SEQ ID NO: 171963 - DNA, 15 bp, Homo sapiens
aatgcagaaatgtgc

SEQ ID NO: 171964 - DNA, 15 bp, Homo sapiens
aaatgcagaaatgtg

SEQ ID NO: 171965 - DNA, 15 bp, Homo sapiens
gaaatgcagaaatgt

SEQ ID NO: 171966 - DNA, 15 bp, Homo sapiens
ggaaatgcagaaatg

SEQ ID NO: 171967 - DNA, 15 bp, Homo sapiens
aggaaatgcagaaat

SEQ ID NO: 171968 - DNA, 15 bp, Homo sapiens
aaggaaatgcagaaa

SEQ ID NO: 171969 - DNA, 15 bp, Homo sapiens
gaaggaaatgcagaa

SEQ ID NO: 171970 - DNA, 15 bp, Homo sapiens
agaaggaaatgcaga

SEQ ID NO: 171971 - DNA, 15 bp, Homo sapiens
cagaaggaaatgcag

SEQ ID NO: 171972 - DNA, 15 bp, Homo sapiens
acagaaggaaatgca

SEQ ID NO: 171973 - DNA, 15 bp, Homo sapiens
cacagaaggaaatgc

SEQ ID NO: 171974 - DNA, 15 bp, Homo sapiens
acacagaaggaaatg

SEQ ID NO: 171975 - DNA, 15 bp, Homo sapiens
aacacagaaggaaat

SEQ ID NO: 171976 - DNA, 15 bp, Homo sapiens
aaacacagaaggaaa

SEQ ID NO: 171977 - DNA, 15 bp, Homo sapiens
aaaacacagaaggaa

SEQ ID NO: 171978 - DNA, 15 bp, Homo sapiens
aaaaacacagaagga

SEQ ID NO: 171979 - DNA, 15 bp, Homo sapiens
aaaaaacacagaagg

SEQ ID NO: 171980 - DNA, 15 bp, Homo sapiens
aaaaaaacacagaag

SEQ ID NO: 171981 - DNA, 15 bp, Homo sapiens
aaaaaaaacacagaa

SEQ ID NO: 171982 - DNA, 15 bp, Homo sapiens
aaaaaaaaacacaga

SEQ ID NO: 171983 - DNA, 15 bp, Homo sapiens
aaaaaaaaaacacag

SEQ ID NO: 171984 - DNA, 15 bp, Homo sapiens
aaaaaaaaaaacaca

SEQ ID NO: 171985 - DNA, 15 bp, Homo sapiens
aaaaaaaaaaaacac

SEQ ID NO: 171986 - DNA, 15 bp, Homo sapiens
cctcaaaaaaaaaaa

SEQ ID NO: 171987 - DNA, 15 bp, Homo sapiens
acctcaaaaaaaaaa

SEQ ID NO: 171988 - DNA, 15 bp, Homo sapiens
cacctcaaaaaaaaa

SEQ ID NO: 171989 - DNA, 15 bp, Homo sapiens
ccacctcaaaaaaaa

SEQ ID NO: 171990 - DNA, 15 bp, Homo sapiens
tccacctcaaaaaaa

SEQ ID NO: 171991 - DNA, 15 bp, Homo sapiens
ctccacctcaaaaaa

SEQ ID NO: 171992 - DNA, 15 bp, Homo sapiens
actccacctcaaaaa

SEQ ID NO: 171993 - DNA, 15 bp, Homo sapiens
gactccacctcaaaa

SEQ ID NO: 171994 - DNA, 15 bp, Homo sapiens
agactccacctcaaa

SEQ ID NO: 171995 - DNA, 15 bp, Homo sapiens
gagactccacctcaa

SEQ ID NO: 171996 - DNA, 15 bp, Homo sapiens
cgagactccacctca

SEQ ID NO: 171997 - DNA, 15 bp, Homo sapiens
gcgagactccacctc

SEQ ID NO: 171998 - DNA, 15 bp, Homo sapiens
agcgagactccacct

SEQ ID NO: 171999 - DNA, 15 bp, Homo sapiens
gagcgagactccacc

SEQ ID NO: 172000 - DNA, 15 bp, Homo sapiens
agagcgagactccac

SEQ ID NO: 172001 - DNA, 15 bp, Homo sapiens
tgccactgcactcta

SEQ ID NO: 172002 - DNA, 15 bp, Homo sapiens
atgccactgcactct

SEQ ID NO: 172003 - DNA, 15 bp, Homo sapiens
aagctgagatcatgc

SEQ ID NO: 172004 - DNA, 15 bp, Homo sapiens
taagctgagatcatg

SEQ ID NO: 172005 - DNA, 15 bp, Homo sapiens
gtaagctgagatcat

SEQ ID NO: 172006 - DNA, 15 bp, Homo sapiens
agtaagctgagatca

SEQ ID NO: 172007 - DNA, 15 bp, Homo sapiens
cagtaagctgagatc

SEQ ID NO: 172008 - DNA, 15 bp, Homo sapiens
gcagtaagctgagat

SEQ ID NO: 172009 - DNA, 15 bp, Homo sapiens
tgcagtaagctgaga

SEQ ID NO: 172010 - DNA, 15 bp, Homo sapiens
ttgcagtaagctgag

SEQ ID NO: 172011 - DNA, 15 bp, Homo sapiens
gttgcagtaagctga

SEQ ID NO: 172012 - DNA, 15 bp, Homo sapiens
cgttgcagtaagctg

SEQ ID NO: 172013 - DNA, 15 bp, Homo sapiens
acgttgcagtaagct

SEQ ID NO: 172014 - DNA, 15 bp, Homo sapiens
gacgttgcagtaagc

SEQ ID NO: 172015 - DNA, 15 bp, Homo sapiens
ggacgttgcagtaag

SEQ ID NO: 172016 - DNA, 15 bp, Homo sapiens
cggacgttgcagtaa

SEQ ID NO: 172017 - DNA, 15 bp, Homo sapiens
acggacgttgcagta

SEQ ID NO: 172018 - DNA, 15 bp, Homo sapiens
gacggacgttgcagt

SEQ ID NO: 172019 - DNA, 15 bp, Homo sapiens
agacggacgttgcag

SEQ ID NO: 172020 - DNA, 15 bp, Homo sapiens
gagacggacgttgca

SEQ ID NO: 172021 - DNA, 15 bp, Homo sapiens
ggagacggacgttgc

SEQ ID NO: 172022 - DNA, 15 bp, Homo sapiens
gggagacggacgttg

SEQ ID NO: 172023 - DNA, 15 bp, Homo sapiens
cgggagacggacgtt

SEQ ID NO: 172024 - DNA, 15 bp, Homo sapiens
ccgggagacggacgt

SEQ ID NO: 172025 - DNA, 15 bp, Homo sapiens
cccgggagacggacg

SEQ ID NO: 172026 - DNA, 15 bp, Homo sapiens
acccgggagacggac

SEQ ID NO: 172027 - DNA, 15 bp, Homo sapiens
aacccgggagacgga

SEQ ID NO: 172028 - DNA, 15 bp, Homo sapiens
gaacccgggagacgg

SEQ ID NO: 172029 - DNA, 15 bp, Homo sapiens
tgaacccgggagacg

SEQ ID NO: 172030 - DNA, 15 bp, Homo sapiens
ttgaacccgggagac

SEQ ID NO: 172031 - DNA, 15 bp, Homo sapiens
acccataatcccagc

SEQ ID NO: 172032 - DNA, 15 bp, Homo sapiens
cacccataatcccag

SEQ ID NO: 172033 - DNA, 15 bp, Homo sapiens
acacccataatccca

SEQ ID NO: 172034 - DNA, 15 bp, Homo sapiens
tacacccataatccc

SEQ ID NO: 172035 - DNA, 15 bp, Homo sapiens
gtacacccataatcc

SEQ ID NO: 172036 - DNA, 15 bp, Homo sapiens
tgtacacccataatc

SEQ ID NO: 172037 - DNA, 15 bp, Homo sapiens
ttgtacacccataat

SEQ ID NO: 172038 - DNA, 15 bp, Homo sapiens
gttgtacacccataa

SEQ ID NO: 172039 - DNA, 15 bp, Homo sapiens
tgttgtacacccata

SEQ ID NO: 172040 - DNA, 15 bp, Homo sapiens
gtgttgtacacccat

SEQ ID NO: 172041 - DNA, 15 bp, Homo sapiens
ggtgttgtacaccca

SEQ ID NO: 172042 - DNA, 15 bp, Homo sapiens
tggtgttgtacaccc

SEQ ID NO: 172043 - DNA, 15 bp, Homo sapiens
gtggtgttgtacacc

SEQ ID NO: 172044 - DNA, 15 bp, Homo sapiens
agtggtgttgtacac

SEQ ID NO: 172045 - DNA, 15 bp, Homo sapiens
gagtggtgttgtaca

SEQ ID NO: 172046 - DNA, 15 bp, Homo sapiens
ggagtggtgttgtac

SEQ ID NO: 172047 - DNA, 15 bp, Homo sapiens
gggagtggtgttgta

SEQ ID NO: 172048 - DNA, 15 bp, Homo sapiens
cgggagtggtgttgt

SEQ ID NO: 172049 - DNA, 15 bp, Homo sapiens
ccgggagtggtgttg

SEQ ID NO: 172050 - DNA, 15 bp, Homo sapiens
gccgggagtggtgtt

SEQ ID NO: 172051 - DNA, 15 bp, Homo sapiens
agccgggagtggtgt

SEQ ID NO: 172052 - DNA, 15 bp, Homo sapiens
tagccgggagtggtg

SEQ ID NO: 172053 - DNA, 15 bp, Homo sapiens
ttagccgggagtggt

SEQ ID NO: 172054 - DNA, 15 bp, Homo sapiens
attagccgggagtgg

SEQ ID NO: 172055 - DNA, 15 bp, Homo sapiens
aattagccgggagtg

SEQ ID NO: 172056 - DNA, 15 bp, Homo sapiens
aaattagccgggagt

SEQ ID NO: 172057 - DNA, 15 bp, Homo sapiens
aaaattagccgggag

SEQ ID NO: 172058 - DNA, 15 bp, Homo sapiens
aaaaattagccggga

SEQ ID NO: 172059 - DNA, 15 bp, Homo sapiens
tggtgaaaccccgtc

SEQ ID NO: 172060 - DNA, 15 bp, Homo sapiens
cgacatggtgaaacc

SEQ ID NO: 172061 - DNA, 15 bp, Homo sapiens
ccgacatggtgaaac

SEQ ID NO: 172062 - DNA, 15 bp, Homo sapiens
accgacatggtgaaa

SEQ ID NO: 172063 - DNA, 15 bp, Homo sapiens
gaccgacatggtgaa

SEQ ID NO: 172064 - DNA, 15 bp, Homo sapiens
tgaccgacatggtga

SEQ ID NO: 172065 - DNA, 15 bp, Homo sapiens
ctgaccgacatggtg

SEQ ID NO: 172066 - DNA, 15 bp, Homo sapiens
cctgaccgacatggt

SEQ ID NO: 172067 - DNA, 15 bp, Homo sapiens
gcctgaccgacatgg

SEQ ID NO: 172068 - DNA, 15 bp, Homo sapiens
agcctgaccgacatg

SEQ ID NO: 172069 - DNA, 15 bp, Homo sapiens
cagcctgaccgacat

SEQ ID NO: 172070 - DNA, 15 bp, Homo sapiens
ccagcctgaccgaca

SEQ ID NO: 172071 - DNA, 15 bp, Homo sapiens
accagcctgaccgac

SEQ ID NO: 172072 - DNA, 15 bp, Homo sapiens
gaccagcctgaccga

SEQ ID NO: 172073 - DNA, 15 bp, Homo sapiens
agaccagcctgaccg

SEQ ID NO: 172074 - DNA, 15 bp, Homo sapiens
gagaccagcctgacc

SEQ ID NO: 172075 - DNA, 15 bp, Homo sapiens
cgagaccagcctgac

SEQ ID NO: 172076 - DNA, 15 bp, Homo sapiens
tcgagaccagcctga

SEQ ID NO: 172077 - DNA, 15 bp, Homo sapiens
actcacgcctgtaat

SEQ ID NO: 172078 - DNA, 15 bp, Homo sapiens
gactcacgcctgtaa

SEQ ID NO: 172079 - DNA, 15 bp, Homo sapiens
tgactcacgcctgta

SEQ ID NO: 172080 - DNA, 15 bp, Homo sapiens
gtgactcacgcctgt

SEQ ID NO: 172081 - DNA, 15 bp, Homo sapiens
ggtgactcacgcctg

SEQ ID NO: 172082 - DNA, 15 bp, Homo sapiens
aggtgactcacgcct

SEQ ID NO: 172083 - DNA, 15 bp, Homo sapiens
aaggtgactcacgcc

SEQ ID NO: 172084 - DNA, 15 bp, Homo sapiens
caaggtgactcacgc

SEQ ID NO: 172085 - DNA, 15 bp, Homo sapiens
gcaaggtgactcacg

SEQ ID NO: 172086 - DNA, 15 bp, Homo sapiens
ggcaaggtgactcac

SEQ ID NO: 172087 - DNA, 15 bp, Homo sapiens
aggcaaggtgactca

SEQ ID NO: 172088 - DNA, 15 bp, Homo sapiens
caggcaaggtgactc

SEQ ID NO: 172089 - DNA, 15 bp, Homo sapiens
ccaggcaaggtgact

SEQ ID NO: 172090 - DNA, 15 bp, Homo sapiens
gccaggcaaggtgac

SEQ ID NO: 172091 - DNA, 15 bp, Homo sapiens
ggccaggcaaggtga

SEQ ID NO: 172092 - DNA, 15 bp, Homo sapiens
tggccaggcaaggtg

SEQ ID NO: 172093 - DNA, 15 bp, Homo sapiens
ttggccaggcaaggt

SEQ ID NO: 172094 - DNA, 15 bp, Homo sapiens
attggccaggcaagg

SEQ ID NO: 172095 - DNA, 15 bp, Homo sapiens
aattggccaggcaag

SEQ ID NO: 172096 - DNA, 15 bp, Homo sapiens
aaattggccaggcaa

SEQ ID NO: 172097 - DNA, 15 bp, Homo sapiens
aaaattggccaggca

SEQ ID NO: 172098 - DNA, 15 bp, Homo sapiens
gaaaattggccaggc

SEQ ID NO: 172099 - DNA, 15 bp, Homo sapiens
agaaaattggccagg

SEQ ID NO: 172100 - DNA, 15 bp, Homo sapiens
aagaaaattggccag

SEQ ID NO: 172101 - DNA, 15 bp, Homo sapiens
gaagaaaattggcca

SEQ ID NO: 172102 - DNA, 15 bp, Homo sapiens
agaagaaaattggcc

SEQ ID NO: 172103 - DNA, 15 bp, Homo sapiens
aagaagaaaattggc

SEQ ID NO: 172104 - DNA, 15 bp, Homo sapiens
aaagaagaaaattgg

SEQ ID NO: 172105 - DNA, 15 bp, Homo sapiens
aaaaagaagaaaatt

SEQ ID NO: 172106 - DNA, 15 bp, Homo sapiens
aaaaaagaagaaaat

SEQ ID NO: 172107 - DNA, 15 bp, Homo sapiens
taaaaaagaagaaaa

SEQ ID NO: 172108 - DNA, 15 bp, Homo sapiens
ttaaaaaagaagaaa

SEQ ID NO: 172109 - DNA, 15 bp, Homo sapiens
cttaaaaaagaagaa

SEQ ID NO: 172110 - DNA, 15 bp, Homo sapiens
ccttaaaaaagaaga

SEQ ID NO: 172111 - DNA, 15 bp, Homo sapiens
gccttaaaaaagaag

SEQ ID NO: 172112 - DNA, 15 bp, Homo sapiens
agccttaaaaaagaa

SEQ ID NO: 172113 - DNA, 15 bp, Homo sapiens
tagccttaaaaaaga

SEQ ID NO: 172114 - DNA, 15 bp, Homo sapiens
ttagccttaaaaaag

SEQ ID NO: 172115 - DNA, 15 bp, Homo sapiens
attagccttaaaaaa

SEQ ID NO: 172116 - DNA, 15 bp, Homo sapiens
aattagccttaaaaa

SEQ ID NO: 172117 - DNA, 15 bp, Homo sapiens
taattagccttaaaa

SEQ ID NO: 172118 - DNA, 15 bp, Homo sapiens
ataattagccttaaa

SEQ ID NO: 172119 - DNA, 15 bp, Homo sapiens
aataattagccttaa

SEQ ID NO: 172120 - DNA, 15 bp, Homo sapiens
taataattagcctta

SEQ ID NO: 172121 - DNA, 15 bp, Homo sapiens
ataataattagcctt

SEQ ID NO: 172122 - DNA, 15 bp, Homo sapiens
cataataattagcct

SEQ ID NO: 172123 - DNA, 15 bp, Homo sapiens
gcataataattagcc

SEQ ID NO: 172124 - DNA, 15 bp, Homo sapiens
tgcataataattagc

SEQ ID NO: 172125 - DNA, 15 bp, Homo sapiens
atgcataataattag

SEQ ID NO: 172126 - DNA, 15 bp, Homo sapiens
tatgcataataatta

SEQ ID NO: 172127 - DNA, 15 bp, Homo sapiens
atatgcataataatt

SEQ ID NO: 172128 - DNA, 15 bp, Homo sapiens
tatatgcataataat

SEQ ID NO: 172129 - DNA, 15 bp, Homo sapiens
atatatgcataataa

SEQ ID NO: 172130 - DNA, 15 bp, Homo sapiens
gatatatgcataata

SEQ ID NO: 172131 - DNA, 15 bp, Homo sapiens
tgatatatgcataat

SEQ ID NO: 172132 - DNA, 15 bp, Homo sapiens
gtgatatatgcataa

SEQ ID NO: 172133 - DNA, 15 bp, Homo sapiens
tgtgatatatgcata

SEQ ID NO: 172134 - DNA, 15 bp, Homo sapiens
atgtgatatatgcat

SEQ ID NO: 172135 - DNA, 15 bp, Homo sapiens
aatgtgatatatgca

SEQ ID NO: 172136 - DNA, 15 bp, Homo sapiens
aaatgtgatatatgc

SEQ ID NO: 172137 - DNA, 15 bp, Homo sapiens
aaaatgtgatatatg

SEQ ID NO: 172138 - DNA, 15 bp, Homo sapiens
caaaatgtgatatat

SEQ ID NO: 172139 - DNA, 15 bp, Homo sapiens
gcaaaatgtgatata

SEQ ID NO: 172140 - DNA, 15 bp, Homo sapiens
aagcaaaatgtgata

SEQ ID NO: 172141 - DNA, 15 bp, Homo sapiens
taagcaaaatgtgat

SEQ ID NO: 172142 - DNA, 15 bp, Homo sapiens
ataagcaaaatgtga

SEQ ID NO: 172143 - DNA, 15 bp, Homo sapiens
gataagcaaaatgtg

SEQ ID NO: 172144 - DNA, 15 bp, Homo sapiens
agataagcaaaatgt

SEQ ID NO: 172145 - DNA, 15 bp, Homo sapiens
gagataagcaaaatg

SEQ ID NO: 172146 - DNA, 15 bp, Homo sapiens
agagataagcaaaat

SEQ ID NO: 172147 - DNA, 15 bp, Homo sapiens
aagagataagcaaaa

SEQ ID NO: 172148 - DNA, 15 bp, Homo sapiens
aaagagataagcaaa

SEQ ID NO: 172149 - DNA, 15 bp, Homo sapiens
taaagagataagcaa

SEQ ID NO: 172150 - DNA, 15 bp, Homo sapiens
ataaagagataagca

SEQ ID NO: 172151 - DNA, 15 bp, Homo sapiens
gataaagagataagc

SEQ ID NO: 172152 - DNA, 15 bp, Homo sapiens
tgataaagagataag

SEQ ID NO: 172153 - DNA, 15 bp, Homo sapiens
atgataaagagataa

SEQ ID NO: 172154 - DNA, 15 bp, Homo sapiens
gatgataaagagata

SEQ ID NO: 172155 - DNA, 15 bp, Homo sapiens
agatgataaagagat

SEQ ID NO: 172156 - DNA, 15 bp, Homo sapiens
tagatgataaagaga

SEQ ID NO: 172157 - DNA, 15 bp, Homo sapiens
atagatgataaagag

SEQ ID NO: 172158 - DNA, 15 bp, Homo sapiens
catagatgataaaga

SEQ ID NO: 172159 - DNA, 15 bp, Homo sapiens
ccatagatgataaag

SEQ ID NO: 172160 - DNA, 15 bp, Homo sapiens
cccatagatgataaa

SEQ ID NO: 172161 - DNA, 15 bp, Homo sapiens
acccatagatgataa

SEQ ID NO: 172162 - DNA, 15 bp, Homo sapiens
tacccatagatgata

SEQ ID NO: 172163 - DNA, 15 bp, Homo sapiens
gtacccatagatgat

SEQ ID NO: 172164 - DNA, 15 bp, Homo sapiens
agtacccatagatga

SEQ ID NO: 172165 - DNA, 15 bp, Homo sapiens
aagtacccatagatg

SEQ ID NO: 172166 - DNA, 15 bp, Homo sapiens
caagtacccatagat

SEQ ID NO: 172167 - DNA, 15 bp, Homo sapiens
ccaagtacccataga

SEQ ID NO: 172168 - DNA, 15 bp, Homo sapiens
cccaagtacccatag

SEQ ID NO: 172169 - DNA, 15 bp, Homo sapiens
acccaagtacccata

SEQ ID NO: 172170 - DNA, 15 bp, Homo sapiens
aacccaagtacccat

SEQ ID NO: 172171 - DNA, 15 bp, Homo sapiens
aaacccaagtaccca

SEQ ID NO: 172172 - DNA, 15 bp, Homo sapiens
aaaacccaagtaccc

SEQ ID NO: 172173 - DNA, 15 bp, Homo sapiens
caaaacccaagtacc

SEQ ID NO: 172174 - DNA, 15 bp, Homo sapiens
tcaaaacccaagtac

SEQ ID NO: 172175 - DNA, 15 bp, Homo sapiens
gtcaaaacccaagta

SEQ ID NO: 172176 - DNA, 15 bp, Homo sapiens
agtcaaaacccaagt

SEQ ID NO: 172177 - DNA, 15 bp, Homo sapiens
aagtcaaaacccaag

SEQ ID NO: 172178 - DNA, 15 bp, Homo sapiens
gaagtcaaaacccaa

SEQ ID NO: 172179 - DNA, 15 bp, Homo sapiens
agaagtcaaaaccca

SEQ ID NO: 172180 - DNA, 15 bp, Homo sapiens
aagaagtcaaaaccc

SEQ ID NO: 172181 - DNA, 15 bp, Homo sapiens
caagaagtcaaaacc

SEQ ID NO: 172182 - DNA, 15 bp, Homo sapiens
ccaagaagtcaaaac

SEQ ID NO: 172183 - DNA, 15 bp, Homo sapiens
gccaagaagtcaaaa

SEQ ID NO: 172184 - DNA, 15 bp, Homo sapiens
agccaagaagtcaaa

SEQ ID NO: 172185 - DNA, 15 bp, Homo sapiens
tagccaagaagtcaa

SEQ ID NO: 172186 - DNA, 15 bp, Homo sapiens
atagccaagaagtca

SEQ ID NO: 172187 - DNA, 15 bp, Homo sapiens
aatagccaagaagtc

SEQ ID NO: 172188 - DNA, 15 bp, Homo sapiens
caatagccaagaagt

SEQ ID NO: 172189 - DNA, 15 bp, Homo sapiens
acaatagccaagaag

SEQ ID NO: 172190 - DNA, 15 bp, Homo sapiens
cacaatagccaagaa

SEQ ID NO: 172191 - DNA, 15 bp, Homo sapiens
tcacaatagccaaga

SEQ ID NO: 172192 - DNA, 15 bp, Homo sapiens
ttcacaatagccaag

SEQ ID NO: 172193 - DNA, 15 bp, Homo sapiens
attcacaatagccaa

SEQ ID NO: 172194 - DNA, 15 bp, Homo sapiens
tattcacaatagcca

SEQ ID NO: 172195 - DNA, 15 bp, Homo sapiens
ttattcacaatagcc

SEQ ID NO: 172196 - DNA, 15 bp, Homo sapiens
attattcacaatagc

SEQ ID NO: 172197 - DNA, 15 bp, Homo sapiens
cattattcacaatag

SEQ ID NO: 172198 - DNA, 15 bp, Homo sapiens
gcattattcacaata

SEQ ID NO: 172199 - DNA, 15 bp, Homo sapiens
agcattattcacaat

SEQ ID NO: 172200 - DNA, 15 bp, Homo sapiens
cagcattattcacaa

SEQ ID NO: 172201 - DNA, 15 bp, Homo sapiens
gcagcattattcaca

SEQ ID NO: 172202 - DNA, 15 bp, Homo sapiens
agcagcattattcac

SEQ ID NO: 172203 - DNA, 15 bp, Homo sapiens
tagcagcattattca

SEQ ID NO: 172204 - DNA, 15 bp, Homo sapiens
atagcagcattattc

SEQ ID NO: 172205 - DNA, 15 bp, Homo sapiens
catagcagcattatt

SEQ ID NO: 172206 - DNA, 15 bp, Homo sapiens
tcatagcagcattat

SEQ ID NO: 172207 - DNA, 15 bp, Homo sapiens
ttcatagcagcatta

SEQ ID NO: 172208 - DNA, 15 bp, Homo sapiens
gttcatagcagcatt

SEQ ID NO: 172209 - DNA, 15 bp, Homo sapiens
tgttcatagcagcat

SEQ ID NO: 172210 - DNA, 15 bp, Homo sapiens
atgttcatagcagca

SEQ ID NO: 172211 - DNA, 15 bp, Homo sapiens
aatgttcatagcagc

SEQ ID NO: 172212 - DNA, 15 bp, Homo sapiens
caatgttcatagcag

SEQ ID NO: 172213 - DNA, 15 bp, Homo sapiens
ccaatgttcatagca

SEQ ID NO: 172214 - DNA, 15 bp, Homo sapiens
accaatgttcatagc

SEQ ID NO: 172215 - DNA, 15 bp, Homo sapiens
caccaatgttcatag

SEQ ID NO: 172216 - DNA, 15 bp, Homo sapiens
acaccaatgttcata

SEQ ID NO: 172217 - DNA, 15 bp, Homo sapiens
tacaccaatgttcat

SEQ ID NO: 172218 - DNA, 15 bp, Homo sapiens
gtacaccaatgttca

SEQ ID NO: 172219 - DNA, 15 bp, Homo sapiens
tgtacaccaatgttc

SEQ ID NO: 172220 - DNA, 15 bp, Homo sapiens
ttgtacaccaatgtt

SEQ ID NO: 172221 - DNA, 15 bp, Homo sapiens
cttgtacaccaatgt

SEQ ID NO: 172222 - DNA, 15 bp, Homo sapiens
acttgtacaccaatg

SEQ ID NO: 172223 - DNA, 15 bp, Homo sapiens
tacttgtacaccaat

SEQ ID NO: 172224 - DNA, 15 bp, Homo sapiens
atacttgtacaccaa

SEQ ID NO: 172225 - DNA, 15 bp, Homo sapiens
gatacttgtacacca

SEQ ID NO: 172226 - DNA, 15 bp, Homo sapiens
ggatacttgtacacc

SEQ ID NO: 172227 - DNA, 15 bp, Homo sapiens
cggatacttgtacac

SEQ ID NO: 172228 - DNA, 15 bp, Homo sapiens
acggatacttgtaca

SEQ ID NO: 172229 - DNA, 15 bp, Homo sapiens
aacggatacttgtac

SEQ ID NO: 172230 - DNA, 15 bp, Homo sapiens
aaacggatacttgta

SEQ ID NO: 172231 - DNA, 15 bp, Homo sapiens
aaaacggatacttgt

SEQ ID NO: 172232 - DNA, 15 bp, Homo sapiens
taaaacggatacttg

SEQ ID NO: 172233 - DNA, 15 bp, Homo sapiens
ctaaaacggatactt

SEQ ID NO: 172234 - DNA, 15 bp, Homo sapiens
actaaaacggatact

SEQ ID NO: 172235 - DNA, 15 bp, Homo sapiens
gactaaaacggatac

SEQ ID NO: 172236 - DNA, 15 bp, Homo sapiens
agactaaaacggata

SEQ ID NO: 172237 - DNA, 15 bp, Homo sapiens
gagactaaaacggat

SEQ ID NO: 172238 - DNA, 15 bp, Homo sapiens
agagactaaaacgga

SEQ ID NO: 172239 - DNA, 15 bp, Homo sapiens
cagagactaaaacgg

SEQ ID NO: 172240 - DNA, 15 bp, Homo sapiens
gcagagactaaaacg

SEQ ID NO: 172241 - DNA, 15 bp, Homo sapiens
agcagagactaaaac

SEQ ID NO: 172242 - DNA, 15 bp, Homo sapiens
aagcagagactaaaa

SEQ ID NO: 172243 - DNA, 15 bp, Homo sapiens
aaagcagagactaaa

SEQ ID NO: 172244 - DNA, 15 bp, Homo sapiens
gaaagcagagactaa

SEQ ID NO: 172245 - DNA, 15 bp, Homo sapiens
tgaaagcagagacta

SEQ ID NO: 172246 - DNA, 15 bp, Homo sapiens
atgaaagcagagact

SEQ ID NO: 172247 - DNA, 15 bp, Homo sapiens
aatgaaagcagagac

SEQ ID NO: 172248 - DNA, 15 bp, Homo sapiens
aaatgaaagcagaga

SEQ ID NO: 172249 - DNA, 15 bp, Homo sapiens
gaaatgaaagcagag

SEQ ID NO: 172250 - DNA, 15 bp, Homo sapiens
agaaatgaaagcaga

SEQ ID NO: 172251 - DNA, 15 bp, Homo sapiens
aagaaatgaaagcag

SEQ ID NO: 172252 - DNA, 15 bp, Homo sapiens
aaagaaatgaaagca

SEQ ID NO: 172253 - DNA, 15 bp, Homo sapiens
caaagaaatgaaagc

SEQ ID NO: 172254 - DNA, 15 bp, Homo sapiens
ccaaagaaatgaaag

SEQ ID NO: 172255 - DNA, 15 bp, Homo sapiens
cccaaagaaatgaaa

SEQ ID NO: 172256 - DNA, 15 bp, Homo sapiens
ccccaaagaaatgaa

SEQ ID NO: 172257 - DNA, 15 bp, Homo sapiens
accccaaagaaatga

SEQ ID NO: 172258 - DNA, 15 bp, Homo sapiens
gaccccaaagaaatg

SEQ ID NO: 172259 - DNA, 15 bp, Homo sapiens
agaccccaaagaaat

SEQ ID NO: 172260 - DNA, 15 bp, Homo sapiens
tagaccccaaagaaa

SEQ ID NO: 172261 - DNA, 15 bp, Homo sapiens
atagaccccaaagaa

SEQ ID NO: 172262 - DNA, 15 bp, Homo sapiens
tatagaccccaaaga

SEQ ID NO: 172263 - DNA, 15 bp, Homo sapiens
atatagaccccaaag

SEQ ID NO: 172264 - DNA, 15 bp, Homo sapiens
tatatagaccccaaa

SEQ ID NO: 172265 - DNA, 15 bp, Homo sapiens
ttatatagaccccaa

SEQ ID NO: 172266 - DNA, 15 bp, Homo sapiens
tttatatagacccca

SEQ ID NO: 172267 - DNA, 15 bp, Homo sapiens
gtttatatagacccc

SEQ ID NO: 172268 - DNA, 15 bp, Homo sapiens
tgtttatatagaccc

SEQ ID NO: 172269 - DNA, 15 bp, Homo sapiens
atgtttatatagacc

SEQ ID NO: 172270 - DNA, 15 bp, Homo sapiens
catgtttatatagac

SEQ ID NO: 172271 - DNA, 15 bp, Homo sapiens
tcatgtttatataga

SEQ ID NO: 172272 - DNA, 15 bp, Homo sapiens
gtcatgtttatatag

SEQ ID NO: 172273 - DNA, 15 bp, Homo sapiens
cgtcatgtttatata

SEQ ID NO: 172274 - DNA, 15 bp, Homo sapiens
acgtcatgtttatat

SEQ ID NO: 172275 - DNA, 15 bp, Homo sapiens
aacgtcatgtttata

SEQ ID NO: 172276 - DNA, 15 bp, Homo sapiens
aaacgtcatgtttat

SEQ ID NO: 172277 - DNA, 15 bp, Homo sapiens
aaaacgtcatgttta

SEQ ID NO: 172278 - DNA, 15 bp, Homo sapiens
taaaacgtcatgttt

SEQ ID NO: 172279 - DNA, 15 bp, Homo sapiens
ttaaaacgtcatgtt

SEQ ID NO: 172280 - DNA, 15 bp, Homo sapiens
attaaaacgtcatgt

SEQ ID NO: 172281 - DNA, 15 bp, Homo sapiens
gattaaaacgtcatg

SEQ ID NO: 172282 - DNA, 15 bp, Homo sapiens
tgattaaaacgtcat

SEQ ID NO: 172283 - DNA, 15 bp, Homo sapiens
ctgattaaaacgtca

SEQ ID NO: 172284 - DNA, 15 bp, Homo sapiens
tctgattaaaacgtc

SEQ ID NO: 172285 - DNA, 15 bp, Homo sapiens
atctgattaaaacgt

SEQ ID NO: 172286 - DNA, 15 bp, Homo sapiens
tatctgattaaaacg

SEQ ID NO: 172287 - DNA, 15 bp, Homo sapiens
atatctgattaaaac

SEQ ID NO: 172288 - DNA, 15 bp, Homo sapiens
aatatctgattaaaa

SEQ ID NO: 172289 - DNA, 15 bp, Homo sapiens
aaatatctgattaaa

SEQ ID NO: 172290 - DNA, 15 bp, Homo sapiens
aaaatatctgattaa

SEQ ID NO: 172291 - DNA, 15 bp, Homo sapiens
taaaatatctgatta

SEQ ID NO: 172292 - DNA, 15 bp, Homo sapiens
ataaaatatctgatt

SEQ ID NO: 172293 - DNA, 15 bp, Homo sapiens
aataaaatatctgat

SEQ ID NO: 172294 - DNA, 15 bp, Homo sapiens
gaataaaatatctga

SEQ ID NO: 172295 - DNA, 15 bp, Homo sapiens
tgaataaaatatctg

SEQ ID NO: 172296 - DNA, 15 bp, Homo sapiens
gtgaataaaatatct

SEQ ID NO: 172297 - DNA, 15 bp, Homo sapiens
ggtgaataaaatatc

SEQ ID NO: 172298 - DNA, 15 bp, Homo sapiens
aggtgaataaaatat

SEQ ID NO: 172299 - DNA, 15 bp, Homo sapiens
gaggtgaataaaata

SEQ ID NO: 172300 - DNA, 15 bp, Homo sapiens
agaggtgaataaaat

SEQ ID NO: 172301 - DNA, 15 bp, Homo sapiens
gagaggtgaataaaa

SEQ ID NO: 172302 - DNA, 15 bp, Homo sapiens
tgagaggtgaataaa

SEQ ID NO: 172303 - DNA, 15 bp, Homo sapiens
ttgagaggtgaataa

SEQ ID NO: 172304 - DNA, 15 bp, Homo sapiens
tttgagaggtgaata

SEQ ID NO: 172305 - DNA, 15 bp, Homo sapiens
ctttgagaggtgaat

SEQ ID NO: 172306 - DNA, 15 bp, Homo sapiens
gctttgagaggtgaa

SEQ ID NO: 172307 - DNA, 15 bp, Homo sapiens
agctttgagaggtga

SEQ ID NO: 172308 - DNA, 15 bp, Homo sapiens
gagctttgagaggtg

SEQ ID NO: 172309 - DNA, 15 bp, Homo sapiens
agagctttgagaggt

SEQ ID NO: 172310 - DNA, 15 bp, Homo sapiens
aagagctttgagagg

SEQ ID NO: 172311 - DNA, 15 bp, Homo sapiens
caagagctttgagag

SEQ ID NO: 172312 - DNA, 15 bp, Homo sapiens
acaagagctttgaga

SEQ ID NO: 172313 - DNA, 15 bp, Homo sapiens
aacaagagctttgag

SEQ ID NO: 172314 - DNA, 15 bp, Homo sapiens
gaacaagagctttga

SEQ ID NO: 172315 - DNA, 15 bp, Homo sapiens
ggaacaagagctttg

SEQ ID NO: 172316 - DNA, 15 bp, Homo sapiens
tggaacaagagcttt

SEQ ID NO: 172317 - DNA, 15 bp, Homo sapiens
ctggaacaagagctt

SEQ ID NO: 172318 - DNA, 15 bp, Homo sapiens
actggaacaagagct

SEQ ID NO: 172319 - DNA, 15 bp, Homo sapiens
cactggaacaagagc

SEQ ID NO: 172320 - DNA, 15 bp, Homo sapiens
acactggaacaagag

SEQ ID NO: 172321 - DNA, 15 bp, Homo sapiens
aacactggaacaaga

SEQ ID NO: 172322 - DNA, 15 bp, Homo sapiens
gaacactggaacaag

SEQ ID NO: 172323 - DNA, 15 bp, Homo sapiens
tgaacactggaacaa

SEQ ID NO: 172324 - DNA, 15 bp, Homo sapiens
gtgaacactggaaca

SEQ ID NO: 172325 - DNA, 15 bp, Homo sapiens
agtgaacactggaac

SEQ ID NO: 172326 - DNA, 15 bp, Homo sapiens
aagtgaacactggaa

SEQ ID NO: 172327 - DNA, 15 bp, Homo sapiens
gaagtgaacactgga

SEQ ID NO: 172328 - DNA, 15 bp, Homo sapiens
ggaagtgaacactgg

SEQ ID NO: 172329 - DNA, 15 bp, Homo sapiens
aggaagtgaacactg

SEQ ID NO: 172330 - DNA, 15 bp, Homo sapiens
aaggaagtgaacact

SEQ ID NO: 172331 - DNA, 15 bp, Homo sapiens
aaaggaagtgaacac

SEQ ID NO: 172332 - DNA, 15 bp, Homo sapiens
caaaggaagtgaaca

SEQ ID NO: 172333 - DNA, 15 bp, Homo sapiens
tcaaaggaagtgaac

SEQ ID NO: 172334 - DNA, 15 bp, Homo sapiens
ttcaaaggaagtgaa

SEQ ID NO: 172335 - DNA, 15 bp, Homo sapiens
tttcaaaggaagtga

SEQ ID NO: 172336 - DNA, 15 bp, Homo sapiens
ttttcaaaggaagtg

SEQ ID NO: 172337 - DNA, 15 bp, Homo sapiens
tttttcaaaggaagt

SEQ ID NO: 172338 - DNA, 15 bp, Homo sapiens
atttttcaaaggaag

SEQ ID NO: 172339 - DNA, 15 bp, Homo sapiens
gatttttcaaaggaa

SEQ ID NO: 172340 - DNA, 15 bp, Homo sapiens
agatttttcaaagga

SEQ ID NO: 172341 - DNA, 15 bp, Homo sapiens
cagatttttcaaagg

SEQ ID NO: 172342 - DNA, 15 bp, Homo sapiens
acagatttttcaaag

SEQ ID NO: 172343 - DNA, 15 bp, Homo sapiens
tacagatttttcaaa

SEQ ID NO: 172344 - DNA, 15 bp, Homo sapiens
atacagatttttcaa

SEQ ID NO: 172345 - DNA, 15 bp, Homo sapiens
catacagatttttca

SEQ ID NO: 172346 - DNA, 15 bp, Homo sapiens
tcatacagatttttc

SEQ ID NO: 172347 - DNA, 15 bp, Homo sapiens
ttcatacagattttt

SEQ ID NO: 172348 - DNA, 15 bp, Homo sapiens
attcatacagatttt

SEQ ID NO: 172349 - DNA, 15 bp, Homo sapiens
tattcatacagattt

SEQ ID NO: 172350 - DNA, 15 bp, Homo sapiens
atattcatacagatt

SEQ ID NO: 172351 - DNA, 15 bp, Homo sapiens
tatattcatacagat

SEQ ID NO: 172352 - DNA, 15 bp, Homo sapiens
ctatattcatacaga

SEQ ID NO: 172353 - DNA, 15 bp, Homo sapiens
actatattcatacag

SEQ ID NO: 172354 - DNA, 15 bp, Homo sapiens
tactatattcataca

SEQ ID NO: 172355 - DNA, 15 bp, Homo sapiens
atactatattcatac

SEQ ID NO: 172356 - DNA, 15 bp, Homo sapiens
aatactatattcata

SEQ ID NO: 172357 - DNA, 15 bp, Homo sapiens
gaatactatattcat

SEQ ID NO: 172358 - DNA, 15 bp, Homo sapiens
agaatactatattca

SEQ ID NO: 172359 - DNA, 15 bp, Homo sapiens
aagaatactatattc

SEQ ID NO: 172360 - DNA, 15 bp, Homo sapiens
aaagaatactatatt

SEQ ID NO: 172361 - DNA, 15 bp, Homo sapiens
aaaagaatactatat

SEQ ID NO: 172362 - DNA, 15 bp, Homo sapiens
taaaagaatactata

SEQ ID NO: 172363 - DNA, 15 bp, Homo sapiens
ataaaagaatactat

SEQ ID NO: 172364 - DNA, 15 bp, Homo sapiens
aataaaagaatacta

SEQ ID NO: 172365 - DNA, 15 bp, Homo sapiens
taataaaagaatact

SEQ ID NO: 172366 - DNA, 15 bp, Homo sapiens
ataataaaagaatac

SEQ ID NO: 172367 - DNA, 15 bp, Homo sapiens
aataataaaagaata

SEQ ID NO: 172368 - DNA, 15 bp, Homo sapiens
caataataaaagaat

SEQ ID NO: 172369 - DNA, 15 bp, Homo sapiens
acaataataaaagaa

SEQ ID NO: 172370 - DNA, 15 bp, Homo sapiens
tacaataataaaaga

SEQ ID NO: 172371 - DNA, 15 bp, Homo sapiens
gtacaataataaaag

SEQ ID NO: 172372 - DNA, 15 bp, Homo sapiens
agtacaataataaaa

SEQ ID NO: 172373 - DNA, 15 bp, Homo sapiens
gagtacaataataaa

SEQ ID NO: 172374 - DNA, 15 bp, Homo sapiens
ggagtacaataataa

SEQ ID NO: 172375 - DNA, 15 bp, Homo sapiens
aggagtacaataata

SEQ ID NO: 172376 - DNA, 15 bp, Homo sapiens
caggagtacaataat

SEQ ID NO: 172377 - DNA, 15 bp, Homo sapiens
tcaggagtacaataa

SEQ ID NO: 172378 - DNA, 15 bp, Homo sapiens
ctcaggagtacaata

SEQ ID NO: 172379 - DNA, 15 bp, Homo sapiens
tctcaggagtacaat

SEQ ID NO: 172380 - DNA, 15 bp, Homo sapiens
ctctcaggagtacaa

SEQ ID NO: 172381 - DNA, 15 bp, Homo sapiens
cctctcaggagtaca

SEQ ID NO: 172382 - DNA, 15 bp, Homo sapiens
tcctctcaggagtac

SEQ ID NO: 172383 - DNA, 15 bp, Homo sapiens
ctcctctcaggagta

SEQ ID NO: 172384 - DNA, 15 bp, Homo sapiens
cctcctctcaggagt

SEQ ID NO: 172385 - DNA, 15 bp, Homo sapiens
ccctcctctcaggag

SEQ ID NO: 172386 - DNA, 15 bp, Homo sapiens
accctcctctcagga

SEQ ID NO: 172387 - DNA, 15 bp, Homo sapiens
caccctcctctcagg

SEQ ID NO: 172388 - DNA, 15 bp, Homo sapiens
acaccctcctctcag

SEQ ID NO: 172389 - DNA, 15 bp, Homo sapiens
aacaccctcctctca

SEQ ID NO: 172390 - DNA, 15 bp, Homo sapiens
taacaccctcctctc

SEQ ID NO: 172391 - DNA, 15 bp, Homo sapiens
ctaacaccctcctct

SEQ ID NO: 172392 - DNA, 15 bp, Homo sapiens
gctaacaccctcctc

SEQ ID NO: 172393 - DNA, 15 bp, Homo sapiens
ggctaacaccctcct

SEQ ID NO: 172394 - DNA, 15 bp, Homo sapiens
gggctaacaccctcc

SEQ ID NO: 172395 - DNA, 15 bp, Homo sapiens
ggggctaacaccctc

SEQ ID NO: 172396 - DNA, 15 bp, Homo sapiens
aggggctaacaccct

SEQ ID NO: 172397 - DNA, 15 bp, Homo sapiens
aaggggctaacaccc

SEQ ID NO: 172398 - DNA, 15 bp, Homo sapiens
aaaggggctaacacc

SEQ ID NO: 172399 - DNA, 15 bp, Homo sapiens
aaaaggggctaacac

SEQ ID NO: 172400 - DNA, 15 bp, Homo sapiens
aaaaaggggctaaca

SEQ ID NO: 172401 - DNA, 15 bp, Homo sapiens
aaaaaaggggctaac

SEQ ID NO: 172402 - DNA, 15 bp, Homo sapiens
aaaaaaaggggctaa

SEQ ID NO: 172403 - DNA, 15 bp, Homo sapiens
aaaaaaaaggggcta

SEQ ID NO: 172404 - DNA, 15 bp, Homo sapiens
caaaaaaaaggggct

SEQ ID NO: 172405 - DNA, 15 bp, Homo sapiens
tcaaaaaaaaggggc

SEQ ID NO: 172406 - DNA, 15 bp, Homo sapiens
ttcaaaaaaaagggg

SEQ ID NO: 172407 - DNA, 15 bp, Homo sapiens
tttcaaaaaaaaggg

SEQ ID NO: 172408 - DNA, 15 bp, Homo sapiens
atttcaaaaaaaagg

SEQ ID NO: 172409 - DNA, 15 bp, Homo sapiens
catttcaaaaaaaag

SEQ ID NO: 172410 - DNA, 15 bp, Homo sapiens
acatttcaaaaaaaa

SEQ ID NO: 172411 - DNA, 15 bp, Homo sapiens
cacatttcaaaaaaa

SEQ ID NO: 172412 - DNA, 15 bp, Homo sapiens
acacatttcaaaaaa

SEQ ID NO: 172413 - DNA, 15 bp, Homo sapiens
cacacatttcaaaaa

SEQ ID NO: 172414 - DNA, 15 bp, Homo sapiens
gcacacatttcaaaa

SEQ ID NO: 172415 - DNA, 15 bp, Homo sapiens
tgcacacatttcaaa

SEQ ID NO: 172416 - DNA, 15 bp, Homo sapiens
ctgcacacatttcaa

SEQ ID NO: 172417 - DNA, 15 bp, Homo sapiens
tctgcacacatttca

SEQ ID NO: 172418 - DNA, 15 bp, Homo sapiens
ttctgcacacatttc

SEQ ID NO: 172419 - DNA, 15 bp, Homo sapiens
gttctgcacacattt

SEQ ID NO: 172420 - DNA, 15 bp, Homo sapiens
agttctgcacacatt

SEQ ID NO: 172421 - DNA, 15 bp, Homo sapiens
gagttctgcacacat

SEQ ID NO: 172422 - DNA, 15 bp, Homo sapiens
ggagttctgcacaca

SEQ ID NO: 172423 - DNA, 15 bp, Homo sapiens
tggagttctgcacac

SEQ ID NO: 172424 - DNA, 15 bp, Homo sapiens
ctggagttctgcaca

SEQ ID NO: 172425 - DNA, 15 bp, Homo sapiens
actggagttctgcac

SEQ ID NO: 172426 - DNA, 15 bp, Homo sapiens
cactggagttctgca

SEQ ID NO: 172427 - DNA, 15 bp, Homo sapiens
gcactggagttctgc

SEQ ID NO: 172428 - DNA, 15 bp, Homo sapiens
agcactggagttctg

SEQ ID NO: 172429 - DNA, 15 bp, Homo sapiens
aagcactggagttct

SEQ ID NO: 172430 - DNA, 15 bp, Homo sapiens
taagcactggagttc

SEQ ID NO: 172431 - DNA, 15 bp, Homo sapiens
ttaagcactggagtt

SEQ ID NO: 172432 - DNA, 15 bp, Homo sapiens
tttaagcactggagt

SEQ ID NO: 172433 - DNA, 15 bp, Homo sapiens
ttttaagcactggag

SEQ ID NO: 172434 - DNA, 15 bp, Homo sapiens
gttttaagcactgga

SEQ ID NO: 172435 - DNA, 15 bp, Homo sapiens
agttttaagcactgg

SEQ ID NO: 172436 - DNA, 15 bp, Homo sapiens
aagttttaagcactg

SEQ ID NO: 172437 - DNA, 15 bp, Homo sapiens
gaagttttaagcact

SEQ ID NO: 172438 - DNA, 15 bp, Homo sapiens
ggaagttttaagcac

SEQ ID NO: 172439 - DNA, 15 bp, Homo sapiens
tggaagttttaagca

SEQ ID NO: 172440 - DNA, 15 bp, Homo sapiens
gtggaagttttaagc

SEQ ID NO: 172441 - DNA, 15 bp, Homo sapiens
ggtggaagttttaag

SEQ ID NO: 172442 - DNA, 15 bp, Homo sapiens
tggtggaagttttaa

SEQ ID NO: 172443 - DNA, 15 bp, Homo sapiens
ctggtggaagtttta

SEQ ID NO: 172444 - DNA, 15 bp, Homo sapiens
tctggtggaagtttt

SEQ ID NO: 172445 - DNA, 15 bp, Homo sapiens
ttctggtggaagttt

SEQ ID NO: 172446 - DNA, 15 bp, Homo sapiens
tttctggtggaagtt

SEQ ID NO: 172447 - DNA, 15 bp, Homo sapiens
gtttctggtggaagt

SEQ ID NO: 172448 - DNA, 15 bp, Homo sapiens
ggtttctggtggaag

SEQ ID NO: 172449 - DNA, 15 bp, Homo sapiens
tggtttctggtggaa

SEQ ID NO: 172450 - DNA, 15 bp, Homo sapiens
atggtttctggtgga

SEQ ID NO: 172451 - DNA, 15 bp, Homo sapiens
aatggtttctggtgg

SEQ ID NO: 172452 - DNA, 15 bp, Homo sapiens
caatggtttctggtg

SEQ ID NO: 172453 - DNA, 15 bp, Homo sapiens
ccaatggtttctggt

SEQ ID NO: 172454 - DNA, 15 bp, Homo sapiens
accaatggtttctgg

SEQ ID NO: 172455 - DNA, 15 bp, Homo sapiens
aaccaatggtttctg

SEQ ID NO: 172456 - DNA, 15 bp, Homo sapiens
aaaccaatggtttct

SEQ ID NO: 172457 - DNA, 15 bp, Homo sapiens
gaaaccaatggtttc

SEQ ID NO: 172458 - DNA, 15 bp, Homo sapiens
agaaaccaatggttt

SEQ ID NO: 172459 - DNA, 15 bp, Homo sapiens
tagaaaccaatggtt

SEQ ID NO: 172460 - DNA, 15 bp, Homo sapiens
atagaaaccaatggt

SEQ ID NO: 172461 - DNA, 15 bp, Homo sapiens
gatagaaaccaatgg

SEQ ID NO: 172462 - DNA, 15 bp, Homo sapiens
ggatagaaaccaatg

SEQ ID NO: 172463 - DNA, 15 bp, Homo sapiens
gggatagaaaccaat

SEQ ID NO: 172464 - DNA, 15 bp, Homo sapiens
tgggatagaaaccaa

SEQ ID NO: 172465 - DNA, 15 bp, Homo sapiens
gtgggatagaaacca

SEQ ID NO: 172466 - DNA, 15 bp, Homo sapiens
tgtgggatagaaacc

SEQ ID NO: 172467 - DNA, 15 bp, Homo sapiens
ttgtgggatagaaac

SEQ ID NO: 172468 - DNA, 15 bp, Homo sapiens
cttgtgggatagaaa

SEQ ID NO: 172469 - DNA, 15 bp, Homo sapiens
tcttgtgggatagaa

SEQ ID NO: 172470 - DNA, 15 bp, Homo sapiens
ttcttgtgggataga

SEQ ID NO: 172471 - DNA, 15 bp, Homo sapiens
attcttgtgggatag

SEQ ID NO: 172472 - DNA, 15 bp, Homo sapiens
aattcttgtgggata

SEQ ID NO: 172473 - DNA, 15 bp, Homo sapiens
gaattcttgtgggat

SEQ ID NO: 172474 - DNA, 15 bp, Homo sapiens
ggaattcttgtggga

SEQ ID NO: 172475 - DNA, 15 bp, Homo sapiens
tggaattcttgtggg

SEQ ID NO: 172476 - DNA, 15 bp, Homo sapiens
gtggaattcttgtgg

SEQ ID NO: 172477 - DNA, 15 bp, Homo sapiens
agtggaattcttgtg

SEQ ID NO: 172478 - DNA, 15 bp, Homo sapiens
cagtggaattcttgt

SEQ ID NO: 172479 - DNA, 15 bp, Homo sapiens
tcagtggaattcttg

SEQ ID NO: 172480 - DNA, 15 bp, Homo sapiens
ttcagtggaattctt

SEQ ID NO: 172481 - DNA, 15 bp, Homo sapiens
tttcagtggaattct

SEQ ID NO: 172482 - DNA, 15 bp, Homo sapiens
atttcagtggaattc

SEQ ID NO: 172483 - DNA, 15 bp, Homo sapiens
catttcagtggaatt

SEQ ID NO: 172484 - DNA, 15 bp, Homo sapiens
gcatttcagtggaat

SEQ ID NO: 172485 - DNA, 15 bp, Homo sapiens
agcatttcagtggaa

SEQ ID NO: 172486 - DNA, 15 bp, Homo sapiens
aagcatttcagtgga

SEQ ID NO: 172487 - DNA, 15 bp, Homo sapiens
gaagcatttcagtgg

SEQ ID NO: 172488 - DNA, 15 bp, Homo sapiens
agaagcatttcagtg

SEQ ID NO: 172489 - DNA, 15 bp, Homo sapiens
gagaagcatttcagt

SEQ ID NO: 172490 - DNA, 15 bp, Homo sapiens
agagaagcatttcag

SEQ ID NO: 172491 - DNA, 15 bp, Homo sapiens
aagagaagcatttca

SEQ ID NO: 172492 - DNA, 15 bp, Homo sapiens
aaagagaagcatttc

SEQ ID NO: 172493 - DNA, 15 bp, Homo sapiens
caaagagaagcattt

SEQ ID NO: 172494 - DNA, 15 bp, Homo sapiens
ccaaagagaagcatt

SEQ ID NO: 172495 - DNA, 15 bp, Homo sapiens
tccaaagagaagcat

SEQ ID NO: 172496 - DNA, 15 bp, Homo sapiens
ttccaaagagaagca

SEQ ID NO: 172497 - DNA, 15 bp, Homo sapiens
cttccaaagagaagc

SEQ ID NO: 172498 - DNA, 15 bp, Homo sapiens
gcttccaaagagaag

SEQ ID NO: 172499 - DNA, 15 bp, Homo sapiens
ggcttccaaagagaa

SEQ ID NO: 172500 - DNA, 15 bp, Homo sapiens
gggcttccaaagaga

SEQ ID NO: 172501 - DNA, 15 bp, Homo sapiens
agggcttccaaagag

SEQ ID NO: 172502 - DNA, 15 bp, Homo sapiens
tagggcttccaaaga

SEQ ID NO: 172503 - DNA, 15 bp, Homo sapiens
gtagggcttccaaag

SEQ ID NO: 172504 - DNA, 15 bp, Homo sapiens
agtagggcttccaaa

SEQ ID NO: 172505 - DNA, 15 bp, Homo sapiens
cagtagggcttccaa

SEQ ID NO: 172506 - DNA, 15 bp, Homo sapiens
tcagtagggcttcca

SEQ ID NO: 172507 - DNA, 15 bp, Homo sapiens
ctcagtagggcttcc

SEQ ID NO: 172508 - DNA, 15 bp, Homo sapiens
gctcagtagggcttc

SEQ ID NO: 172509 - DNA, 15 bp, Homo sapiens
agctcagtagggctt

SEQ ID NO: 172510 - DNA, 15 bp, Homo sapiens
cagctcagtagggct

SEQ ID NO: 172511 - DNA, 15 bp, Homo sapiens
acagctcagtagggc

SEQ ID NO: 172512 - DNA, 15 bp, Homo sapiens
aacagctcagtaggg

SEQ ID NO: 172513 - DNA, 15 bp, Homo sapiens
aaacagctcagtagg

SEQ ID NO: 172514 - DNA, 15 bp, Homo sapiens
taaacagctcagtag

SEQ ID NO: 172515 - DNA, 15 bp, Homo sapiens
ttaaacagctcagta

SEQ ID NO: 172516 - DNA, 15 bp, Homo sapiens
tttaaacagctcagt

SEQ ID NO: 172517 - DNA, 15 bp, Homo sapiens
gtttaaacagctcag

SEQ ID NO: 172518 - DNA, 15 bp, Homo sapiens
agtttaaacagctca

SEQ ID NO: 172519 - DNA, 15 bp, Homo sapiens
cagtttaaacagctc

SEQ ID NO: 172520 - DNA, 15 bp, Homo sapiens
acagtttaaacagct

SEQ ID NO: 172521 - DNA, 15 bp, Homo sapiens
cacagtttaaacagc

SEQ ID NO: 172522 - DNA, 15 bp, Homo sapiens
acacagtttaaacag

SEQ ID NO: 172523 - DNA, 15 bp, Homo sapiens
aacacagtttaaaca

SEQ ID NO: 172524 - DNA, 15 bp, Homo sapiens
aaacacagtttaaac

SEQ ID NO: 172525 - DNA, 15 bp, Homo sapiens
gaaacacagtttaaa

SEQ ID NO: 172526 - DNA, 15 bp, Homo sapiens
agaaacacagtttaa

SEQ ID NO: 172527 - DNA, 15 bp, Homo sapiens
aagaaacacagttta

SEQ ID NO: 172528 - DNA, 15 bp, Homo sapiens
aaagaaacacagttt

SEQ ID NO: 172529 - DNA, 15 bp, Homo sapiens
taaagaaacacagtt

SEQ ID NO: 172530 - DNA, 15 bp, Homo sapiens
ctaaagaaacacagt

SEQ ID NO: 172531 - DNA, 15 bp, Homo sapiens
tctaaagaaacacag

SEQ ID NO: 172532 - DNA, 15 bp, Homo sapiens
ttctaaagaaacaca

SEQ ID NO: 172533 - DNA, 15 bp, Homo sapiens
gttctaaagaaacac

SEQ ID NO: 172534 - DNA, 15 bp, Homo sapiens
agttctaaagaaaca

SEQ ID NO: 172535 - DNA, 15 bp, Homo sapiens
aagttctaaagaaac

SEQ ID NO: 172536 - DNA, 15 bp, Homo sapiens
gaagttctaaagaaa

SEQ ID NO: 172537 - DNA, 15 bp, Homo sapiens
ggaagttctaaagaa

SEQ ID NO: 172538 - DNA, 15 bp, Homo sapiens
tggaagttctaaaga

SEQ ID NO: 172539 - DNA, 15 bp, Homo sapiens
ttggaagttctaaag

SEQ ID NO: 172540 - DNA, 15 bp, Homo sapiens
gttggaagttctaaa

SEQ ID NO: 172541 - DNA, 15 bp, Homo sapiens
tgttggaagttctaa

SEQ ID NO: 172542 - DNA, 15 bp, Homo sapiens
atgttggaagttcta

SEQ ID NO: 172543 - DNA, 15 bp, Homo sapiens
aatgttggaagttct

SEQ ID NO: 172544 - DNA, 15 bp, Homo sapiens
aaatgttggaagttc

SEQ ID NO: 172545 - DNA, 15 bp, Homo sapiens
aaaatgttggaagtt

SEQ ID NO: 172546 - DNA, 15 bp, Homo sapiens
gaaaatgttggaagt

SEQ ID NO: 172547 - DNA, 15 bp, Homo sapiens
tgaaaatgttggaag

SEQ ID NO: 172548 - DNA, 15 bp, Homo sapiens
ctgaaaatgttggaa

SEQ ID NO: 172549 - DNA, 15 bp, Homo sapiens
gctgaaaatgttgga

SEQ ID NO: 172550 - DNA, 15 bp, Homo sapiens
agctgaaaatgttgg

SEQ ID NO: 172551 - DNA, 15 bp, Homo sapiens
aagctgaaaatgttg

SEQ ID NO: 172552 - DNA, 15 bp, Homo sapiens
aaagctgaaaatgtt

SEQ ID NO: 172553 - DNA, 15 bp, Homo sapiens
aaaagctgaaaatgt

SEQ ID NO: 172554 - DNA, 15 bp, Homo sapiens
gaaaagctgaaaatg

SEQ ID NO: 172555 - DNA, 15 bp, Homo sapiens
ggaaaagctgaaaat

SEQ ID NO: 172556 - DNA, 15 bp, Homo sapiens
aggaaaagctgaaaa

SEQ ID NO: 172557 - DNA, 15 bp, Homo sapiens
aaggaaaagctgaaa

SEQ ID NO: 172558 - DNA, 15 bp, Homo sapiens
caaggaaaagctgaa

SEQ ID NO: 172559 - DNA, 15 bp, Homo sapiens
tcaaggaaaagctga

SEQ ID NO: 172560 - DNA, 15 bp, Homo sapiens
gtcaaggaaaagctg

SEQ ID NO: 172561 - DNA, 15 bp, Homo sapiens
agtcaaggaaaagct

SEQ ID NO: 172562 - DNA, 15 bp, Homo sapiens
aagtcaaggaaaagc

SEQ ID NO: 172563 - DNA, 15 bp, Homo sapiens
aaagtcaaggaaaag

SEQ ID NO: 172564 - DNA, 15 bp, Homo sapiens
aaaagtcaaggaaaa

SEQ ID NO: 172565 - DNA, 15 bp, Homo sapiens
aaaaagtcaaggaaa

SEQ ID NO: 172566 - DNA, 15 bp, Homo sapiens
gaaaaagtcaaggaa

SEQ ID NO: 172567 - DNA, 15 bp, Homo sapiens
agaaaaagtcaagga

SEQ ID NO: 172568 - DNA, 15 bp, Homo sapiens
gagaaaaagtcaagg

SEQ ID NO: 172569 - DNA, 15 bp, Homo sapiens
agagaaaaagtcaag

SEQ ID NO: 172570 - DNA, 15 bp, Homo sapiens
tagagaaaaagtcaa

SEQ ID NO: 172571 - DNA, 15 bp, Homo sapiens
ttagagaaaaagtca

SEQ ID NO: 172572 - DNA, 15 bp, Homo sapiens
attagagaaaaagtc

SEQ ID NO: 172573 - DNA, 15 bp, Homo sapiens
tattagagaaaaagt

SEQ ID NO: 172574 - DNA, 15 bp, Homo sapiens
ctattagagaaaaag

SEQ ID NO: 172575 - DNA, 15 bp, Homo sapiens
tctattagagaaaaa

SEQ ID NO: 172576 - DNA, 15 bp, Homo sapiens
gtctattagagaaaa

SEQ ID NO: 172577 - DNA, 15 bp, Homo sapiens
tgtctattagagaaa

SEQ ID NO: 172578 - DNA, 15 bp, Homo sapiens
atgtctattagagaa

SEQ ID NO: 172579 - DNA, 15 bp, Homo sapiens
catgtctattagaga

SEQ ID NO: 172580 - DNA, 15 bp, Homo sapiens
gcatgtctattagag

SEQ ID NO: 172581 - DNA, 15 bp, Homo sapiens
agcatgtctattaga

SEQ ID NO: 172582 - DNA, 15 bp, Homo sapiens
aagcatgtctattag

SEQ ID NO: 172583 - DNA, 15 bp, Homo sapiens
aaagcatgtctatta

SEQ ID NO: 172584 - DNA, 15 bp, Homo sapiens
taaagcatgtctatt

SEQ ID NO: 172585 - DNA, 15 bp, Homo sapiens
ctaaagcatgtctat

SEQ ID NO: 172586 - DNA, 15 bp, Homo sapiens
actaaagcatgtcta

SEQ ID NO: 172587 - DNA, 15 bp, Homo sapiens
aactaaagcatgtct

SEQ ID NO: 172588 - DNA, 15 bp, Homo sapiens
taactaaagcatgtc

SEQ ID NO: 172589 - DNA, 15 bp, Homo sapiens
ttaactaaagcatgt

SEQ ID NO: 172590 - DNA, 15 bp, Homo sapiens
tttaactaaagcatg

SEQ ID NO: 172591 - DNA, 15 bp, Homo sapiens
ctttaactaaagcat

SEQ ID NO: 172592 - DNA, 15 bp, Homo sapiens
gctttaactaaagca

SEQ ID NO: 172593 - DNA, 15 bp, Homo sapiens
agctttaactaaagc

SEQ ID NO: 172594 - DNA, 15 bp, Homo sapiens
gagctttaactaaag

SEQ ID NO: 172595 - DNA, 15 bp, Homo sapiens
ggagctttaactaaa

SEQ ID NO: 172596 - DNA, 15 bp, Homo sapiens
aggagctttaactaa

SEQ ID NO: 172597 - DNA, 15 bp, Homo sapiens
aaggagctttaacta

SEQ ID NO: 172598 - DNA, 15 bp, Homo sapiens
gaaggagctttaact

SEQ ID NO: 172599 - DNA, 15 bp, Homo sapiens
tgaaggagctttaac

SEQ ID NO: 172600 - DNA, 15 bp, Homo sapiens
atgaaggagctttaa

SEQ ID NO: 172601 - DNA, 15 bp, Homo sapiens
aatgaaggagcttta

SEQ ID NO: 172602 - DNA, 15 bp, Homo sapiens
gaatgaaggagcttt

SEQ ID NO: 172603 - DNA, 15 bp, Homo sapiens
agaatgaaggagctt

SEQ ID NO: 172604 - DNA, 15 bp, Homo sapiens
cagaatgaaggagct

SEQ ID NO: 172605 - DNA, 15 bp, Homo sapiens
tcagaatgaaggagc

SEQ ID NO: 172606 - DNA, 15 bp, Homo sapiens
ctcagaatgaaggag

SEQ ID NO: 172607 - DNA, 15 bp, Homo sapiens
actcagaatgaagga

SEQ ID NO: 172608 - DNA, 15 bp, Homo sapiens
aactcagaatgaagg

SEQ ID NO: 172609 - DNA, 15 bp, Homo sapiens
caactcagaatgaag

SEQ ID NO: 172610 - DNA, 15 bp, Homo sapiens
acaactcagaatgaa

SEQ ID NO: 172611 - DNA, 15 bp, Homo sapiens
aacaactcagaatga

SEQ ID NO: 172612 - DNA, 15 bp, Homo sapiens
gaacaactcagaatg

SEQ ID NO: 172613 - DNA, 15 bp, Homo sapiens
agaacaactcagaat

SEQ ID NO: 172614 - DNA, 15 bp, Homo sapiens
cagaacaactcagaa

SEQ ID NO: 172615 - DNA, 15 bp, Homo sapiens
acagaacaactcaga

SEQ ID NO: 172616 - DNA, 15 bp, Homo sapiens
cacagaacaactcag

SEQ ID NO: 172617 - DNA, 15 bp, Homo sapiens
tcacagaacaactca

SEQ ID NO: 172618 - DNA, 15 bp, Homo sapiens
ttcacagaacaactc

SEQ ID NO: 172619 - DNA, 15 bp, Homo sapiens
gttcacagaacaact

SEQ ID NO: 172620 - DNA, 15 bp, Homo sapiens
agttcacagaacaac

SEQ ID NO: 172621 - DNA, 15 bp, Homo sapiens
tagttcacagaacaa

SEQ ID NO: 172622 - DNA, 15 bp, Homo sapiens
ctagttcacagaaca

SEQ ID NO: 172623 - DNA, 15 bp, Homo sapiens
tctagttcacagaac

SEQ ID NO: 172624 - DNA, 15 bp, Homo sapiens
atctagttcacagaa

SEQ ID NO: 172625 - DNA, 15 bp, Homo sapiens
aatctagttcacaga

SEQ ID NO: 172626 - DNA, 15 bp, Homo sapiens
aaatctagttcacag

SEQ ID NO: 172627 - DNA, 15 bp, Homo sapiens
gaaatctagttcaca

SEQ ID NO: 172628 - DNA, 15 bp, Homo sapiens
tgaaatctagttcac

SEQ ID NO: 172629 - DNA, 15 bp, Homo sapiens
atgaaatctagttca

SEQ ID NO: 172630 - DNA, 15 bp, Homo sapiens
catgaaatctagttc

SEQ ID NO: 172631 - DNA, 15 bp, Homo sapiens
ccatgaaatctagtt

SEQ ID NO: 172632 - DNA, 15 bp, Homo sapiens
accatgaaatctagt

SEQ ID NO: 172633 - DNA, 15 bp, Homo sapiens
aaccatgaaatctag

SEQ ID NO: 172634 - DNA, 15 bp, Homo sapiens
aaaccatgaaatcta

SEQ ID NO: 172635 - DNA, 15 bp, Homo sapiens
taaaccatgaaatct

SEQ ID NO: 172636 - DNA, 15 bp, Homo sapiens
gtaaaccatgaaatc

SEQ ID NO: 172637 - DNA, 15 bp, Homo sapiens
agtaaaccatgaaat

SEQ ID NO: 172638 - DNA, 15 bp, Homo sapiens
tagtaaaccatgaaa

SEQ ID NO: 172639 - DNA, 15 bp, Homo sapiens
ttagtaaaccatgaa

SEQ ID NO: 172640 - DNA, 15 bp, Homo sapiens
gttagtaaaccatga

SEQ ID NO: 172641 - DNA, 15 bp, Homo sapiens
agttagtaaaccatg

SEQ ID NO: 172642 - DNA, 15 bp, Homo sapiens
gagttagtaaaccat

SEQ ID NO: 172643 - DNA, 15 bp, Homo sapiens
tgagttagtaaacca

SEQ ID NO: 172644 - DNA, 15 bp, Homo sapiens
atgagttagtaaacc

SEQ ID NO: 172645 - DNA, 15 bp, Homo sapiens
tatgagttagtaaac

SEQ ID NO: 172646 - DNA, 15 bp, Homo sapiens
atatgagttagtaaa

SEQ ID NO: 172647 - DNA, 15 bp, Homo sapiens
gatatgagttagtaa

SEQ ID NO: 172648 - DNA, 15 bp, Homo sapiens
ggatatgagttagta

SEQ ID NO: 172649 - DNA, 15 bp, Homo sapiens
aggatatgagttagt

SEQ ID NO: 172650 - DNA, 15 bp, Homo sapiens
taggatatgagttag

SEQ ID NO: 172651 - DNA, 15 bp, Homo sapiens
ttaggatatgagtta

SEQ ID NO: 172652 - DNA, 15 bp, Homo sapiens
tttaggatatgagtt

SEQ ID NO: 172653 - DNA, 15 bp, Homo sapiens
atttaggatatgagt

SEQ ID NO: 172654 - DNA, 15 bp, Homo sapiens
tatttaggatatgag

SEQ ID NO: 172655 - DNA, 15 bp, Homo sapiens
ctatttaggatatga

SEQ ID NO: 172656 - DNA, 15 bp, Homo sapiens
tctatttaggatatg

SEQ ID NO: 172657 - DNA, 15 bp, Homo sapiens
ttctatttaggatat

SEQ ID NO: 172658 - DNA, 15 bp, Homo sapiens
attctatttaggata

SEQ ID NO: 172659 - DNA, 15 bp, Homo sapiens
gattctatttaggat

SEQ ID NO: 172660 - DNA, 15 bp, Homo sapiens
tgattctatttagga

SEQ ID NO: 172661 - DNA, 15 bp, Homo sapiens
atgattctatttagg

SEQ ID NO: 172662 - DNA, 15 bp, Homo sapiens
gatgattctatttag

SEQ ID NO: 172663 - DNA, 15 bp, Homo sapiens
ggatgattctattta

SEQ ID NO: 172664 - DNA, 15 bp, Homo sapiens
tggatgattctattt

SEQ ID NO: 172665 - DNA, 15 bp, Homo sapiens
ttggatgattctatt

SEQ ID NO: 172666 - DNA, 15 bp, Homo sapiens
tttggatgattctat

SEQ ID NO: 172667 - DNA, 15 bp, Homo sapiens
ttttggatgattcta

SEQ ID NO: 172668 - DNA, 15 bp, Homo sapiens
cttttggatgattct

SEQ ID NO: 172669 - DNA, 15 bp, Homo sapiens
tcttttggatgattc

SEQ ID NO: 172670 - DNA, 15 bp, Homo sapiens
ttcttttggatgatt

SEQ ID NO: 172671 - DNA, 15 bp, Homo sapiens
gttcttttggatgat

SEQ ID NO: 172672 - DNA, 15 bp, Homo sapiens
cgttcttttggatga

SEQ ID NO: 172673 - DNA, 15 bp, Homo sapiens
gcgttcttttggatg

SEQ ID NO: 172674 - DNA, 15 bp, Homo sapiens
tgcgttcttttggat

SEQ ID NO: 172675 - DNA, 15 bp, Homo sapiens
atgcgttcttttgga

SEQ ID NO: 172676 - DNA, 15 bp, Homo sapiens
tatgcgttcttttgg

SEQ ID NO: 172677 - DNA, 15 bp, Homo sapiens
ctatgcgttcttttg

SEQ ID NO: 172678 - DNA, 15 bp, Homo sapiens
tctatgcgttctttt

SEQ ID NO: 172679 - DNA, 15 bp, Homo sapiens
ttctatgcgttcttt

SEQ ID NO: 172680 - DNA, 15 bp, Homo sapiens
tttctatgcgttctt

SEQ ID NO: 172681 - DNA, 15 bp, Homo sapiens
gtttctatgcgttct

SEQ ID NO: 172682 - DNA, 15 bp, Homo sapiens
tgtttctatgcgttc

SEQ ID NO: 172683 - DNA, 15 bp, Homo sapiens
atgtttctatgcgtt

SEQ ID NO: 172684 - DNA, 15 bp, Homo sapiens
aatgtttctatgcgt

SEQ ID NO: 172685 - DNA, 15 bp, Homo sapiens
gaatgtttctatgcg

SEQ ID NO: 172686 - DNA, 15 bp, Homo sapiens
agaatgtttctatgc

SEQ ID NO: 172687 - DNA, 15 bp, Homo sapiens
cagaatgtttctatg

SEQ ID NO: 172688 - DNA, 15 bp, Homo sapiens
acagaatgtttctat

SEQ ID NO: 172689 - DNA, 15 bp, Homo sapiens
aacagaatgtttcta

SEQ ID NO: 172690 - DNA, 15 bp, Homo sapiens
caacagaatgtttct

SEQ ID NO: 172691 - DNA, 15 bp, Homo sapiens
tcaacagaatgtttc

SEQ ID NO: 172692 - DNA, 15 bp, Homo sapiens
atcaacagaatgttt

SEQ ID NO: 172693 - DNA, 15 bp, Homo sapiens
aatcaacagaatgtt

SEQ ID NO: 172694 - DNA, 15 bp, Homo sapiens
gaatcaacagaatgt

SEQ ID NO: 172695 - DNA, 15 bp, Homo sapiens
ggaatcaacagaatg

SEQ ID NO: 172696 - DNA, 15 bp, Homo sapiens
tggaatcaacagaat

SEQ ID NO: 172697 - DNA, 15 bp, Homo sapiens
atggaatcaacagaa

SEQ ID NO: 172698 - DNA, 15 bp, Homo sapiens
aatggaatcaacaga

SEQ ID NO: 172699 - DNA, 15 bp, Homo sapiens
aaatggaatcaacag

SEQ ID NO: 172700 - DNA, 15 bp, Homo sapiens
aaaatggaatcaaca

SEQ ID NO: 172701 - DNA, 15 bp, Homo sapiens
caaaatggaatcaac

SEQ ID NO: 172702 - DNA, 15 bp, Homo sapiens
ccaaaatggaatcaa

SEQ ID NO: 172703 - DNA, 15 bp, Homo sapiens
accaaaatggaatca

SEQ ID NO: 172704 - DNA, 15 bp, Homo sapiens
aaccaaaatggaatc

SEQ ID NO: 172705 - DNA, 15 bp, Homo sapiens
caaccaaaatggaat

SEQ ID NO: 172706 - DNA, 15 bp, Homo sapiens
ccaaccaaaatggaa

SEQ ID NO: 172707 - DNA, 15 bp, Homo sapiens
accaaccaaaatgga

SEQ ID NO: 172708 - DNA, 15 bp, Homo sapiens
taccaaccaaaatgg

SEQ ID NO: 172709 - DNA, 15 bp, Homo sapiens
ataccaaccaaaatg

SEQ ID NO: 172710 - DNA, 15 bp, Homo sapiens
cataccaaccaaaat

SEQ ID NO: 172711 - DNA, 15 bp, Homo sapiens
acataccaaccaaaa

SEQ ID NO: 172712 - DNA, 15 bp, Homo sapiens
cacataccaaccaaa

SEQ ID NO: 172713 - DNA, 15 bp, Homo sapiens
tcacataccaaccaa

SEQ ID NO: 172714 - DNA, 15 bp, Homo sapiens
gtcacataccaacca

SEQ ID NO: 172715 - DNA, 15 bp, Homo sapiens
agtcacataccaacc

SEQ ID NO: 172716 - DNA, 15 bp, Homo sapiens
tagtcacataccaac

SEQ ID NO: 172717 - DNA, 15 bp, Homo sapiens
atagtcacataccaa

SEQ ID NO: 172718 - DNA, 15 bp, Homo sapiens
aatagtcacatacca

SEQ ID NO: 172719 - DNA, 15 bp, Homo sapiens
taatagtcacatacc

SEQ ID NO: 172720 - DNA, 15 bp, Homo sapiens
ttaatagtcacatac

SEQ ID NO: 172721 - DNA, 15 bp, Homo sapiens
cttaatagtcacata

SEQ ID NO: 172722 - DNA, 15 bp, Homo sapiens
ccttaatagtcacat

SEQ ID NO: 172723 - DNA, 15 bp, Homo sapiens
cccttaatagtcaca

SEQ ID NO: 172724 - DNA, 15 bp, Homo sapiens
acccttaatagtcac

SEQ ID NO: 172725 - DNA, 15 bp, Homo sapiens
aacccttaatagtca

SEQ ID NO: 172726 - DNA, 15 bp, Homo sapiens
gaacccttaatagtc

SEQ ID NO: 172727 - DNA, 15 bp, Homo sapiens
agaacccttaatagt

SEQ ID NO: 172728 - DNA, 15 bp, Homo sapiens
aagaacccttaatag

SEQ ID NO: 172729 - DNA, 15 bp, Homo sapiens
taagaacccttaata

SEQ ID NO: 172730 - DNA, 15 bp, Homo sapiens
gtaagaacccttaat

SEQ ID NO: 172731 - DNA, 15 bp, Homo sapiens
tgtaagaacccttaa

SEQ ID NO: 172732 - DNA, 15 bp, Homo sapiens
ctgtaagaaccctta

SEQ ID NO: 172733 - DNA, 15 bp, Homo sapiens
actgtaagaaccctt

SEQ ID NO: 172734 - DNA, 15 bp, Homo sapiens
tactgtaagaaccct

SEQ ID NO: 172735 - DNA, 15 bp, Homo sapiens
atactgtaagaaccc

SEQ ID NO: 172736 - DNA, 15 bp, Homo sapiens
catactgtaagaacc

SEQ ID NO: 172737 - DNA, 15 bp, Homo sapiens
ccatactgtaagaac

SEQ ID NO: 172738 - DNA, 15 bp, Homo sapiens
accatactgtaagaa

SEQ ID NO: 172739 - DNA, 15 bp, Homo sapiens
caccatactgtaaga

SEQ ID NO: 172740 - DNA, 15 bp, Homo sapiens
tcaccatactgtaag

SEQ ID NO: 172741 - DNA, 15 bp, Homo sapiens
ttcaccatactgtaa

SEQ ID NO: 172742 - DNA, 15 bp, Homo sapiens
attcaccatactgta

SEQ ID NO: 172743 - DNA, 15 bp, Homo sapiens
gattcaccatactgt

SEQ ID NO: 172744 - DNA, 15 bp, Homo sapiens
agattcaccatactg

SEQ ID NO: 172745 - DNA, 15 bp, Homo sapiens
gagattcaccatact

SEQ ID NO: 172746 - DNA, 15 bp, Homo sapiens
tgagattcaccatac

SEQ ID NO: 172747 - DNA, 15 bp, Homo sapiens
ctgagattcaccata

SEQ ID NO: 172748 - DNA, 15 bp, Homo sapiens
tctgagattcaccat

SEQ ID NO: 172749 - DNA, 15 bp, Homo sapiens
atctgagattcacca

SEQ ID NO: 172750 - DNA, 15 bp, Homo sapiens
aatctgagattcacc

SEQ ID NO: 172751 - DNA, 15 bp, Homo sapiens
gaatctgagattcac

SEQ ID NO: 172752 - DNA, 15 bp, Homo sapiens
ggaatctgagattca

SEQ ID NO: 172753 - DNA, 15 bp, Homo sapiens
aggaatctgagattc

SEQ ID NO: 172754 - DNA, 15 bp, Homo sapiens
gaggaatctgagatt

SEQ ID NO: 172755 - DNA, 15 bp, Homo sapiens
tgaggaatctgagat

SEQ ID NO: 172756 - DNA, 15 bp, Homo sapiens
cctgaggaatctgag

SEQ ID NO: 172757 - DNA, 15 bp, Homo sapiens
ccctgaggaatctga

SEQ ID NO: 172758 - DNA, 15 bp, Homo sapiens
cccctgaggaatctg

SEQ ID NO: 172759 - DNA, 15 bp, Homo sapiens
ccccctgaggaatct

SEQ ID NO: 172760 - DNA, 15 bp, Homo sapiens
gccccctgaggaatc

SEQ ID NO: 172761 - DNA, 15 bp, Homo sapiens
agccccctgaggaat

SEQ ID NO: 172762 - DNA, 15 bp, Homo sapiens
gagccccctgaggaa

SEQ ID NO: 172763 - DNA, 15 bp, Homo sapiens
ggagccccctgagga

SEQ ID NO: 172764 - DNA, 15 bp, Homo sapiens
gggagccccctgagg

SEQ ID NO: 172765 - DNA, 15 bp, Homo sapiens
agggagccccctgag

SEQ ID NO: 172766 - DNA, 15 bp, Homo sapiens
cagggagccccctga

SEQ ID NO: 172767 - DNA, 15 bp, Homo sapiens
tcagggagccccctg

SEQ ID NO: 172768 - DNA, 15 bp, Homo sapiens
ctcagggagccccct

SEQ ID NO: 172769 - DNA, 15 bp, Homo sapiens
cctcagggagccccc

SEQ ID NO: 172770 - DNA, 15 bp, Homo sapiens
gcctcagggagcccc

SEQ ID NO: 172771 - DNA, 15 bp, Homo sapiens
agcctcagggagccc

SEQ ID NO: 172772 - DNA, 15 bp, Homo sapiens
cagcctcagggagcc

SEQ ID NO: 172773 - DNA, 15 bp, Homo sapiens
tcagcctcagggagc

SEQ ID NO: 172774 - DNA, 15 bp, Homo sapiens
ctcagcctcagggag

SEQ ID NO: 172775 - DNA, 15 bp, Homo sapiens
cctcagcctcaggga

SEQ ID NO: 172776 - DNA, 15 bp, Homo sapiens
tcctcagcctcaggg

SEQ ID NO: 172777 - DNA, 15 bp, Homo sapiens
atcctcagcctcagg

SEQ ID NO: 172778 - DNA, 15 bp, Homo sapiens
catcctcagcctcag

SEQ ID NO: 172779 - DNA, 15 bp, Homo sapiens
tcatcctcagcctca

SEQ ID NO: 172780 - DNA, 15 bp, Homo sapiens
atcatcctcagcctc

SEQ ID NO: 172781 - DNA, 15 bp, Homo sapiens
tatcatcctcagcct

SEQ ID NO: 172782 - DNA, 15 bp, Homo sapiens
ctatcatcctcagcc

SEQ ID NO: 172783 - DNA, 15 bp, Homo sapiens
tctatcatcctcagc

SEQ ID NO: 172784 - DNA, 15 bp, Homo sapiens
atctatcatcctcag

SEQ ID NO: 172785 - DNA, 15 bp, Homo sapiens
gatctatcatcctca

SEQ ID NO: 172786 - DNA, 15 bp, Homo sapiens
agatctatcatcctc

SEQ ID NO: 172787 - DNA, 15 bp, Homo sapiens
cagatctatcatcct

SEQ ID NO: 172788 - DNA, 15 bp, Homo sapiens
tcagatctatcatcc

SEQ ID NO: 172789 - DNA, 15 bp, Homo sapiens
gtcagatctatcatc

SEQ ID NO: 172790 - DNA, 15 bp, Homo sapiens
cgtcagatctatcat

SEQ ID NO: 172791 - DNA, 15 bp, Homo sapiens
tcgtcagatctatca

SEQ ID NO: 172792 - DNA, 15 bp, Homo sapiens
atcgtcagatctatc

SEQ ID NO: 172793 - DNA, 15 bp, Homo sapiens
aatcgtcagatctat

SEQ ID NO: 172794 - DNA, 15 bp, Homo sapiens
gaatcgtcagatcta

SEQ ID NO: 172795 - DNA, 15 bp, Homo sapiens
tgaatcgtcagatct

SEQ ID NO: 172796 - DNA, 15 bp, Homo sapiens
gtgaatcgtcagatc

SEQ ID NO: 172797 - DNA, 15 bp, Homo sapiens
tgtgaatcgtcagat

SEQ ID NO: 172798 - DNA, 15 bp, Homo sapiens
ttgtgaatcgtcaga

SEQ ID NO: 172799 - DNA, 15 bp, Homo sapiens
gttgtgaatcgtcag

SEQ ID NO: 172800 - DNA, 15 bp, Homo sapiens
agttgtgaatcgtca

SEQ ID NO: 172801 - DNA, 15 bp, Homo sapiens
gagttgtgaatcgtc

SEQ ID NO: 172802 - DNA, 15 bp, Homo sapiens
agagttgtgaatcgt

SEQ ID NO: 172803 - DNA, 15 bp, Homo sapiens
gagagttgtgaatcg

SEQ ID NO: 172804 - DNA, 15 bp, Homo sapiens
tgagagttgtgaatc

SEQ ID NO: 172805 - DNA, 15 bp, Homo sapiens
atgagagttgtgaat

SEQ ID NO: 172806 - DNA, 15 bp, Homo sapiens
gatgagagttgtgaa

SEQ ID NO: 172807 - DNA, 15 bp, Homo sapiens
agatgagagttgtga

SEQ ID NO: 172808 - DNA, 15 bp, Homo sapiens
gagatgagagttgtg

SEQ ID NO: 172809 - DNA, 15 bp, Homo sapiens
agagatgagagttgt

SEQ ID NO: 172810 - DNA, 15 bp, Homo sapiens
aagagatgagagttg

SEQ ID NO: 172811 - DNA, 15 bp, Homo sapiens
aaagagatgagagtt

SEQ ID NO: 172812 - DNA, 15 bp, Homo sapiens
caaagagatgagagt

SEQ ID NO: 172813 - DNA, 15 bp, Homo sapiens
ccaaagagatgagag

SEQ ID NO: 172814 - DNA, 15 bp, Homo sapiens
cccaaagagatgaga

SEQ ID NO: 172815 - DNA, 15 bp, Homo sapiens
tcccaaagagatgag

SEQ ID NO: 172816 - DNA, 15 bp, Homo sapiens
atcccaaagagatga

SEQ ID NO: 172817 - DNA, 15 bp, Homo sapiens
tatcccaaagagatg

SEQ ID NO: 172818 - DNA, 15 bp, Homo sapiens
gtatcccaaagagat

SEQ ID NO: 172819 - DNA, 15 bp, Homo sapiens
tgtatcccaaagaga

SEQ ID NO: 172820 - DNA, 15 bp, Homo sapiens
atgtatcccaaagag

SEQ ID NO: 172821 - DNA, 15 bp, Homo sapiens
aatgtatcccaaaga

SEQ ID NO: 172822 - DNA, 15 bp, Homo sapiens
caatgtatcccaaag

SEQ ID NO: 172823 - DNA, 15 bp, Homo sapiens
ccaatgtatcccaaa

SEQ ID NO: 172824 - DNA, 15 bp, Homo sapiens
accaatgtatcccaa

SEQ ID NO: 172825 - DNA, 15 bp, Homo sapiens
gaccaatgtatccca

SEQ ID NO: 172826 - DNA, 15 bp, Homo sapiens
tgaccaatgtatccc

SEQ ID NO: 172827 - DNA, 15 bp, Homo sapiens
atgaccaatgtatcc

SEQ ID NO: 172828 - DNA, 15 bp, Homo sapiens
aatgaccaatgtatc

SEQ ID NO: 172829 - DNA, 15 bp, Homo sapiens
caatgaccaatgtat

SEQ ID NO: 172830 - DNA, 15 bp, Homo sapiens
acaatgaccaatgta

SEQ ID NO: 172831 - DNA, 15 bp, Homo sapiens
aacaatgaccaatgt

SEQ ID NO: 172832 - DNA, 15 bp, Homo sapiens
taacaatgaccaatg

SEQ ID NO: 172833 - DNA, 15 bp, Homo sapiens
gtaacaatgaccaat

SEQ ID NO: 172834 - DNA, 15 bp, Homo sapiens
tgtaacaatgaccaa

SEQ ID NO: 172835 - DNA, 15 bp, Homo sapiens
ctgtaacaatgacca

SEQ ID NO: 172836 - DNA, 15 bp, Homo sapiens
tctgtaacaatgacc

SEQ ID NO: 172837 - DNA, 15 bp, Homo sapiens
ctctgtaacaatgac

SEQ ID NO: 172838 - DNA, 15 bp, Homo sapiens
actctgtaacaatga

SEQ ID NO: 172839 - DNA, 15 bp, Homo sapiens
aactctgtaacaatg

SEQ ID NO: 172840 - DNA, 15 bp, Homo sapiens
taactctgtaacaat

SEQ ID NO: 172841 - DNA, 15 bp, Homo sapiens
ttaactctgtaacaa

SEQ ID NO: 172842 - DNA, 15 bp, Homo sapiens
tttaactctgtaaca

SEQ ID NO: 172843 - DNA, 15 bp, Homo sapiens
gtttaactctgtaac

SEQ ID NO: 172844 - DNA, 15 bp, Homo sapiens
agtttaactctgtaa

SEQ ID NO: 172845 - DNA, 15 bp, Homo sapiens
cagtttaactctgta

SEQ ID NO: 172846 - DNA, 15 bp, Homo sapiens
gcagtttaactctgt

SEQ ID NO: 172847 - DNA, 15 bp, Homo sapiens
ggcagtttaactctg

SEQ ID NO: 172848 - DNA, 15 bp, Homo sapiens
gggcagtttaactct

SEQ ID NO: 172849 - DNA, 15 bp, Homo sapiens
cgggcagtttaactc

SEQ ID NO: 172850 - DNA, 15 bp, Homo sapiens
ccgggcagtttaact

SEQ ID NO: 172851 - DNA, 15 bp, Homo sapiens
cccgggcagtttaac

SEQ ID NO: 172852 - DNA, 15 bp, Homo sapiens
gcccgggcagtttaa

SEQ ID NO: 172853 - DNA, 15 bp, Homo sapiens
tgcccgggcagttta

SEQ ID NO: 172854 - DNA, 15 bp, Homo sapiens
ctgcccgggcagttt

SEQ ID NO: 172855 - DNA, 15 bp, Homo sapiens
tctgcccgggcagtt

SEQ ID NO: 172856 - DNA, 15 bp, Homo sapiens
atctgcccgggcagt

SEQ ID NO: 172857 - DNA, 15 bp, Homo sapiens
tatctgcccgggcag

SEQ ID NO: 172858 - DNA, 15 bp, Homo sapiens
ctatctgcccgggca

SEQ ID NO: 172859 - DNA, 15 bp, Homo sapiens
cctatctgcccgggc

SEQ ID NO: 172860 - DNA, 15 bp, Homo sapiens
tcctatctgcccggg

SEQ ID NO: 172861 - DNA, 15 bp, Homo sapiens
ctcctatctgcccgg

SEQ ID NO: 172862 - DNA, 15 bp, Homo sapiens
cctcctatctgcccg

SEQ ID NO: 172863 - DNA, 15 bp, Homo sapiens
acctcctatctgccc

SEQ ID NO: 172864 - DNA, 15 bp, Homo sapiens
aacctcctatctgcc

SEQ ID NO: 172865 - DNA, 15 bp, Homo sapiens
gaacctcctatctgc

SEQ ID NO: 172866 - DNA, 15 bp, Homo sapiens
agaacctcctatctg

SEQ ID NO: 172867 - DNA, 15 bp, Homo sapiens
cagaacctcctatct

SEQ ID NO: 172868 - DNA, 15 bp, Homo sapiens
ccagaacctcctatc

SEQ ID NO: 172869 - DNA, 15 bp, Homo sapiens
tccagaacctcctat

SEQ ID NO: 172870 - DNA, 15 bp, Homo sapiens
ctccagaacctccta

SEQ ID NO: 172871 - DNA, 15 bp, Homo sapiens
actccagaacctcct

SEQ ID NO: 172872 - DNA, 15 bp, Homo sapiens
aactccagaacctcc

SEQ ID NO: 172873 - DNA, 15 bp, Homo sapiens
caactccagaacctc

SEQ ID NO: 172874 - DNA, 15 bp, Homo sapiens
tcaactccagaacct

SEQ ID NO: 172875 - DNA, 15 bp, Homo sapiens
ctcaactccagaacc

SEQ ID NO: 172876 - DNA, 15 bp, Homo sapiens
cctcaactccagaac

SEQ ID NO: 172877 - DNA, 15 bp, Homo sapiens
ccctcaactccagaa

SEQ ID NO: 172878 - DNA, 15 bp, Homo sapiens
gccctcaactccaga

SEQ ID NO: 172879 - DNA, 15 bp, Homo sapiens
agccctcaactccag

SEQ ID NO: 172880 - DNA, 15 bp, Homo sapiens
cagccctcaactcca

SEQ ID NO: 172881 - DNA, 15 bp, Homo sapiens
ccagccctcaactcc

SEQ ID NO: 172882 - DNA, 15 bp, Homo sapiens
accagccctcaactc

SEQ ID NO: 172883 - DNA, 15 bp, Homo sapiens
aaccagccctcaact

SEQ ID NO: 172884 - DNA, 15 bp, Homo sapiens
aaaccagccctcaac

SEQ ID NO: 172885 - DNA, 15 bp, Homo sapiens
taaaccagccctcaa

SEQ ID NO: 172886 - DNA, 15 bp, Homo sapiens
ttaaaccagccctca

SEQ ID NO: 172887 - DNA, 15 bp, Homo sapiens
gttaaaccagccctc

SEQ ID NO: 172888 - DNA, 15 bp, Homo sapiens
agttaaaccagccct

SEQ ID NO: 172889 - DNA, 15 bp, Homo sapiens
cagttaaaccagccc

SEQ ID NO: 172890 - DNA, 15 bp, Homo sapiens
tcagttaaaccagcc

SEQ ID NO: 172891 - DNA, 15 bp, Homo sapiens
atcagttaaaccagc

SEQ ID NO: 172892 - DNA, 15 bp, Homo sapiens
gatcagttaaaccag

SEQ ID NO: 172893 - DNA, 15 bp, Homo sapiens
tgatcagttaaacca

SEQ ID NO: 172894 - DNA, 15 bp, Homo sapiens
ctgatcagttaaacc

SEQ ID NO: 172895 - DNA, 15 bp, Homo sapiens
cctgatcagttaaac

SEQ ID NO: 172896 - DNA, 15 bp, Homo sapiens
ccctgatcagttaaa

SEQ ID NO: 172897 - DNA, 15 bp, Homo sapiens
gccctgatcagttaa

SEQ ID NO: 172898 - DNA, 15 bp, Homo sapiens
tgccctgatcagtta

SEQ ID NO: 172899 - DNA, 15 bp, Homo sapiens
atgccctgatcagtt

SEQ ID NO: 172900 - DNA, 15 bp, Homo sapiens
aatgccctgatcagt

SEQ ID NO: 172901 - DNA, 15 bp, Homo sapiens
aaatgccctgatcag

SEQ ID NO: 172902 - DNA, 15 bp, Homo sapiens
taaatgccctgatca

SEQ ID NO: 172903 - DNA, 15 bp, Homo sapiens
ttaaatgccctgatc

SEQ ID NO: 172904 - DNA, 15 bp, Homo sapiens
gttaaatgccctgat

SEQ ID NO: 172905 - DNA, 15 bp, Homo sapiens
ggttaaatgccctga

SEQ ID NO: 172906 - DNA, 15 bp, Homo sapiens
aggttaaatgccctg

SEQ ID NO: 172907 - DNA, 15 bp, Homo sapiens
caggttaaatgccct

SEQ ID NO: 172908 - DNA, 15 bp, Homo sapiens
acaggttaaatgccc

SEQ ID NO: 172909 - DNA, 15 bp, Homo sapiens
cacaggttaaatgcc

SEQ ID NO: 172910 - DNA, 15 bp, Homo sapiens
acacaggttaaatgc

SEQ ID NO: 172911 - DNA, 15 bp, Homo sapiens
cacacaggttaaatg

SEQ ID NO: 172912 - DNA, 15 bp, Homo sapiens
ccacacaggttaaat

SEQ ID NO: 172913 - DNA, 15 bp, Homo sapiens
gccacacaggttaaa

SEQ ID NO: 172914 - DNA, 15 bp, Homo sapiens
tgccacacaggttaa

SEQ ID NO: 172915 - DNA, 15 bp, Homo sapiens
atgccacacaggtta

SEQ ID NO: 172916 - DNA, 15 bp, Homo sapiens
aatgccacacaggtt

SEQ ID NO: 172917 - DNA, 15 bp, Homo sapiens
caatgccacacaggt

SEQ ID NO: 172918 - DNA, 15 bp, Homo sapiens
ccaatgccacacagg

SEQ ID NO: 172919 - DNA, 15 bp, Homo sapiens
tccaatgccacacag

SEQ ID NO: 172920 - DNA, 15 bp, Homo sapiens
gtccaatgccacaca

SEQ ID NO: 172921 - DNA, 15 bp, Homo sapiens
ggtccaatgccacac

SEQ ID NO: 172922 - DNA, 15 bp, Homo sapiens
aggtccaatgccaca

SEQ ID NO: 172923 - DNA, 15 bp, Homo sapiens
caggtccaatgccac

SEQ ID NO: 172924 - DNA, 15 bp, Homo sapiens
acaggtccaatgcca

SEQ ID NO: 172925 - DNA, 15 bp, Homo sapiens
tacaggtccaatgcc

SEQ ID NO: 172926 - DNA, 15 bp, Homo sapiens
ttacaggtccaatgc

SEQ ID NO: 172927 - DNA, 15 bp, Homo sapiens
tttacaggtccaatg

SEQ ID NO: 172928 - DNA, 15 bp, Homo sapiens
ttttacaggtccaat

SEQ ID NO: 172929 - DNA, 15 bp, Homo sapiens
attttacaggtccaa

SEQ ID NO: 172930 - DNA, 15 bp, Homo sapiens
tattttacaggtcca

SEQ ID NO: 172931 - DNA, 15 bp, Homo sapiens
atattttacaggtcc

SEQ ID NO: 172932 - DNA, 15 bp, Homo sapiens
catattttacaggtc

SEQ ID NO: 172933 - DNA, 15 bp, Homo sapiens
tcatattttacaggt

SEQ ID NO: 172934 - DNA, 15 bp, Homo sapiens
gtcatattttacagg

SEQ ID NO: 172935 - DNA, 15 bp, Homo sapiens
tgtcatattttacag

SEQ ID NO: 172936 - DNA, 15 bp, Homo sapiens
ttgtcatattttaca

SEQ ID NO: 172937 - DNA, 15 bp, Homo sapiens
tttgtcatattttac

SEQ ID NO: 172938 - DNA, 15 bp, Homo sapiens
atttgtcatatttta

SEQ ID NO: 172939 - DNA, 15 bp, Homo sapiens
gatttgtcatatttt

SEQ ID NO: 172940 - DNA, 15 bp, Homo sapiens
agatttgtcatattt

SEQ ID NO: 172941 - DNA, 15 bp, Homo sapiens
aagatttgtcatatt

SEQ ID NO: 172942 - DNA, 15 bp, Homo sapiens
aaagatttgtcatat

SEQ ID NO: 172943 - DNA, 15 bp, Homo sapiens
caaagatttgtcata

SEQ ID NO: 172944 - DNA, 15 bp, Homo sapiens
ccaaagatttgtcat

SEQ ID NO: 172945 - DNA, 15 bp, Homo sapiens
cccaaagatttgtca

SEQ ID NO: 172946 - DNA, 15 bp, Homo sapiens
gcccaaagatttgtc

SEQ ID NO: 172947 - DNA, 15 bp, Homo sapiens
agcccaaagatttgt

SEQ ID NO: 172948 - DNA, 15 bp, Homo sapiens
cagcccaaagatttg

SEQ ID NO: 172949 - DNA, 15 bp, Homo sapiens
ccagcccaaagattt

SEQ ID NO: 172950 - DNA, 15 bp, Homo sapiens
tccagcccaaagatt

SEQ ID NO: 172951 - DNA, 15 bp, Homo sapiens
ctccagcccaaagat

SEQ ID NO: 172952 - DNA, 15 bp, Homo sapiens
cctccagcccaaaga

SEQ ID NO: 172953 - DNA, 15 bp, Homo sapiens
tcctccagcccaaag

SEQ ID NO: 172954 - DNA, 15 bp, Homo sapiens
ttcctccagcccaaa

SEQ ID NO: 172955 - DNA, 15 bp, Homo sapiens
attcctccagcccaa

SEQ ID NO: 172956 - DNA, 15 bp, Homo sapiens
tattcctccagccca

SEQ ID NO: 172957 - DNA, 15 bp, Homo sapiens
ttattcctccagccc

SEQ ID NO: 172958 - DNA, 15 bp, Homo sapiens
cttattcctccagcc

SEQ ID NO: 172959 - DNA, 15 bp, Homo sapiens
ccttattcctccagc

SEQ ID NO: 172960 - DNA, 15 bp, Homo sapiens
accttattcctccag

SEQ ID NO: 172961 - DNA, 15 bp, Homo sapiens
aaccttattcctcca

SEQ ID NO: 172962 - DNA, 15 bp, Homo sapiens
gaaccttattcctcc

SEQ ID NO: 172963 - DNA, 15 bp, Homo sapiens
agaaccttattcctc

SEQ ID NO: 172964 - DNA, 15 bp, Homo sapiens
cagaaccttattcct

SEQ ID NO: 172965 - DNA, 15 bp, Homo sapiens
gcagaaccttattcc

SEQ ID NO: 172966 - DNA, 15 bp, Homo sapiens
tgcagaaccttattc

SEQ ID NO: 172967 - DNA, 15 bp, Homo sapiens
ttgcagaaccttatt

SEQ ID NO: 172968 - DNA, 15 bp, Homo sapiens
gttgcagaaccttat

SEQ ID NO: 172969 - DNA, 15 bp, Homo sapiens
agttgcagaacctta

SEQ ID NO: 172970 - DNA, 15 bp, Homo sapiens
cagttgcagaacctt

SEQ ID NO: 172971 - DNA, 15 bp, Homo sapiens
acagttgcagaacct

SEQ ID NO: 172972 - DNA, 15 bp, Homo sapiens
aacagttgcagaacc

SEQ ID NO: 172973 - DNA, 15 bp, Homo sapiens
taacagttgcagaac

SEQ ID NO: 172974 - DNA, 15 bp, Homo sapiens
ttaacagttgcagaa

SEQ ID NO: 172975 - DNA, 15 bp, Homo sapiens
tttaacagttgcaga

SEQ ID NO: 172976 - DNA, 15 bp, Homo sapiens
atttaacagttgcag

SEQ ID NO: 172977 - DNA, 15 bp, Homo sapiens
aatttaacagttgca

SEQ ID NO: 172978 - DNA, 15 bp, Homo sapiens
aaatttaacagttgc

SEQ ID NO: 172979 - DNA, 15 bp, Homo sapiens
caaatttaacagttg

SEQ ID NO: 172980 - DNA, 15 bp, Homo sapiens
tcaaatttaacagtt

SEQ ID NO: 172981 - DNA, 15 bp, Homo sapiens
atcaaatttaacagt

SEQ ID NO: 172982 - DNA, 15 bp, Homo sapiens
aatcaaatttaacag

SEQ ID NO: 172983 - DNA, 15 bp, Homo sapiens
taatcaaatttaaca

SEQ ID NO: 172984 - DNA, 15 bp, Homo sapiens
ttaatcaaatttaac

SEQ ID NO: 172985 - DNA, 15 bp, Homo sapiens
attaatcaaatttaa

SEQ ID NO: 172986 - DNA, 15 bp, Homo sapiens
cattaatcaaattta

SEQ ID NO: 172987 - DNA, 15 bp, Homo sapiens
tcattaatcaaattt

SEQ ID NO: 172988 - DNA, 15 bp, Homo sapiens
atcattaatcaaatt

SEQ ID NO: 172989 - DNA, 15 bp, Homo sapiens
aatcattaatcaaat

SEQ ID NO: 172990 - DNA, 15 bp, Homo sapiens
taatcattaatcaaa

SEQ ID NO: 172991 - DNA, 15 bp, Homo sapiens
gtaatcattaatcaa

SEQ ID NO: 172992 - DNA, 15 bp, Homo sapiens
ggtaatcattaatca

SEQ ID NO: 172993 - DNA, 15 bp, Homo sapiens
gggtaatcattaatc

SEQ ID NO: 172994 - DNA, 15 bp, Homo sapiens
agggtaatcattaat

SEQ ID NO: 172995 - DNA, 15 bp, Homo sapiens
cagggtaatcattaa

SEQ ID NO: 172996 - DNA, 15 bp, Homo sapiens
acagggtaatcatta

SEQ ID NO: 172997 - DNA, 15 bp, Homo sapiens
cacagggtaatcatt

SEQ ID NO: 172998 - DNA, 15 bp, Homo sapiens
acacagggtaatcat

SEQ ID NO: 172999 - DNA, 15 bp, Homo sapiens
tacacagggtaatca

SEQ ID NO: 173000 - DNA, 15 bp, Homo sapiens
atacacagggtaatc

SEQ ID NO: 173001 - DNA, 15 bp, Homo sapiens
catacacagggtaat

SEQ ID NO: 173002 - DNA, 15 bp, Homo sapiens
ccatacacagggtaa

SEQ ID NO: 173003 - DNA, 15 bp, Homo sapiens
tccatacacagggta

SEQ ID NO: 173004 - DNA, 15 bp, Homo sapiens
ttccatacacagggt

SEQ ID NO: 173005 - DNA, 15 bp, Homo sapiens
tttccatacacaggg

SEQ ID NO: 173006 - DNA, 15 bp, Homo sapiens
ttttccatacacagg

SEQ ID NO: 173007 - DNA, 15 bp, Homo sapiens
attttccatacacag

SEQ ID NO: 173008 - DNA, 15 bp, Homo sapiens
aattttccatacaca

SEQ ID NO: 173009 - DNA, 15 bp, Homo sapiens
caattttccatacac

SEQ ID NO: 173010 - DNA, 15 bp, Homo sapiens
tcaattttccataca

SEQ ID NO: 173011 - DNA, 15 bp, Homo sapiens
atcaattttccatac

SEQ ID NO: 173012 - DNA, 15 bp, Homo sapiens
aatcaattttccata

SEQ ID NO: 173013 - DNA, 15 bp, Homo sapiens
taatcaattttccat

SEQ ID NO: 173014 - DNA, 15 bp, Homo sapiens
ataatcaattttcca

SEQ ID NO: 173015 - DNA, 15 bp, Homo sapiens
aataatcaattttcc

SEQ ID NO: 173016 - DNA, 15 bp, Homo sapiens
taataatcaattttc

SEQ ID NO: 173017 - DNA, 15 bp, Homo sapiens
gtaataatcaatttt

SEQ ID NO: 173018 - DNA, 15 bp, Homo sapiens
tgtaataatcaattt

SEQ ID NO: 173019 - DNA, 15 bp, Homo sapiens
atgtaataatcaatt

SEQ ID NO: 173020 - DNA, 15 bp, Homo sapiens
aatgtaataatcaat

SEQ ID NO: 173021 - DNA, 15 bp, Homo sapiens
caatgtaataatcaa

SEQ ID NO: 173022 - DNA, 15 bp, Homo sapiens
ccaatgtaataatca

SEQ ID NO: 173023 - DNA, 15 bp, Homo sapiens
accaatgtaataatc

SEQ ID NO: 173024 - DNA, 15 bp, Homo sapiens
taccaatgtaataat

SEQ ID NO: 173025 - DNA, 15 bp, Homo sapiens
ctaccaatgtaataa

SEQ ID NO: 173026 - DNA, 15 bp, Homo sapiens
gctaccaatgtaata

SEQ ID NO: 173027 - DNA, 15 bp, Homo sapiens
agctaccaatgtaat

SEQ ID NO: 173028 - DNA, 15 bp, Homo sapiens
gagctaccaatgtaa

SEQ ID NO: 173029 - DNA, 15 bp, Homo sapiens
agagctaccaatgta

SEQ ID NO: 173030 - DNA, 15 bp, Homo sapiens
gagagctaccaatgt

SEQ ID NO: 173031 - DNA, 15 bp, Homo sapiens
agagagctaccaatg

SEQ ID NO: 173032 - DNA, 15 bp, Homo sapiens
aagagagctaccaat

SEQ ID NO: 173033 - DNA, 15 bp, Homo sapiens
aaagagagctaccaa

SEQ ID NO: 173034 - DNA, 15 bp, Homo sapiens
taaagagagctacca

SEQ ID NO: 173035 - DNA, 15 bp, Homo sapiens
ataaagagagctacc

SEQ ID NO: 173036 - DNA, 15 bp, Homo sapiens
cataaagagagctac

SEQ ID NO: 173037 - DNA, 15 bp, Homo sapiens
tcataaagagagcta

SEQ ID NO: 173038 - DNA, 15 bp, Homo sapiens
ttcataaagagagct

SEQ ID NO: 173039 - DNA, 15 bp, Homo sapiens
tttcataaagagagc

SEQ ID NO: 173040 - DNA, 15 bp, Homo sapiens
atttcataaagagag

SEQ ID NO: 173041 - DNA, 15 bp, Homo sapiens
aatttcataaagaga

SEQ ID NO: 173042 - DNA, 15 bp, Homo sapiens
aaatttcataaagag

SEQ ID NO: 173043 - DNA, 15 bp, Homo sapiens
aaaatttcataaaga

SEQ ID NO: 173044 - DNA, 15 bp, Homo sapiens
gaaaatttcataaag

SEQ ID NO: 173045 - DNA, 15 bp, Homo sapiens
agaaaatttcataaa

SEQ ID NO: 173046 - DNA, 15 bp, Homo sapiens
aagaaaatttcataa

SEQ ID NO: 173047 - DNA, 15 bp, Homo sapiens
aaagaaaatttcata

SEQ ID NO: 173048 - DNA, 15 bp, Homo sapiens
aaaagaaaatttcat

SEQ ID NO: 173049 - DNA, 15 bp, Homo sapiens
taaaagaaaatttca

SEQ ID NO: 173050 - DNA, 15 bp, Homo sapiens
ataaaagaaaatttc

SEQ ID NO: 173051 - DNA, 15 bp, Homo sapiens
aataaaagaaaattt

SEQ ID NO: 173052 - DNA, 15 bp, Homo sapiens
gaataaaagaaaatt

SEQ ID NO: 173053 - DNA, 15 bp, Homo sapiens
agaataaaagaaaat

SEQ ID NO: 173054 - DNA, 15 bp, Homo sapiens
cagaataaaagaaaa

SEQ ID NO: 173055 - DNA, 15 bp, Homo sapiens
tcagaataaaagaaa

SEQ ID NO: 173056 - DNA, 15 bp, Homo sapiens
ctcagaataaaagaa

SEQ ID NO: 173057 - DNA, 15 bp, Homo sapiens
gctcagaataaaaga

SEQ ID NO: 173058 - DNA, 15 bp, Homo sapiens
tgctcagaataaaag

SEQ ID NO: 173059 - DNA, 15 bp, Homo sapiens
atgctcagaataaaa

SEQ ID NO: 173060 - DNA, 15 bp, Homo sapiens
catgctcagaataaa

SEQ ID NO: 173061 - DNA, 15 bp, Homo sapiens
ccatgctcagaataa

SEQ ID NO: 173062 - DNA, 15 bp, Homo sapiens
gccatgctcagaata

SEQ ID NO: 173063 - DNA, 15 bp, Homo sapiens
ggccatgctcagaat

SEQ ID NO: 173064 - DNA, 15 bp, Homo sapiens
tggccatgctcagaa

SEQ ID NO: 173065 - DNA, 15 bp, Homo sapiens
ttggccatgctcaga

SEQ ID NO: 173066 - DNA, 15 bp, Homo sapiens
attggccatgctcag

SEQ ID NO: 173067 - DNA, 15 bp, Homo sapiens
tattggccatgctca

SEQ ID NO: 173068 - DNA, 15 bp, Homo sapiens
ctattggccatgctc

SEQ ID NO: 173069 - DNA, 15 bp, Homo sapiens
gctattggccatgct

SEQ ID NO: 173070 - DNA, 15 bp, Homo sapiens
tgctattggccatgc

SEQ ID NO: 173071 - DNA, 15 bp, Homo sapiens
ctgctattggccatg

SEQ ID NO: 173072 - DNA, 15 bp, Homo sapiens
actgctattggccat

SEQ ID NO: 173073 - DNA, 15 bp, Homo sapiens
tactgctattggcca

SEQ ID NO: 173074 - DNA, 15 bp, Homo sapiens
gtactgctattggcc

SEQ ID NO: 173075 - DNA, 15 bp, Homo sapiens
agtactgctattggc

SEQ ID NO: 173076 - DNA, 15 bp, Homo sapiens
aagtactgctattgg

SEQ ID NO: 173077 - DNA, 15 bp, Homo sapiens
taagtactgctattg

SEQ ID NO: 173078 - DNA, 15 bp, Homo sapiens
ataagtactgctatt

SEQ ID NO: 173079 - DNA, 15 bp, Homo sapiens
gataagtactgctat

SEQ ID NO: 173080 - DNA, 15 bp, Homo sapiens
ggataagtactgcta

SEQ ID NO: 173081 - DNA, 15 bp, Homo sapiens
tggataagtactgct

SEQ ID NO: 173082 - DNA, 15 bp, Homo sapiens
gtggataagtactgc

SEQ ID NO: 173083 - DNA, 15 bp, Homo sapiens
tgtggataagtactg

SEQ ID NO: 173084 - DNA, 15 bp, Homo sapiens
atgtggataagtact

SEQ ID NO: 173085 - DNA, 15 bp, Homo sapiens
aatgtggataagtac

SEQ ID NO: 173086 - DNA, 15 bp, Homo sapiens
gaatgtggataagta

SEQ ID NO: 173087 - DNA, 15 bp, Homo sapiens
agaatgtggataagt

SEQ ID NO: 173088 - DNA, 15 bp, Homo sapiens
aagaatgtggataag

SEQ ID NO: 173089 - DNA, 15 bp, Homo sapiens
caagaatgtggataa

SEQ ID NO: 173090 - DNA, 15 bp, Homo sapiens
tcaagaatgtggata

SEQ ID NO: 173091 - DNA, 15 bp, Homo sapiens
ttcaagaatgtggat

SEQ ID NO: 173092 - DNA, 15 bp, Homo sapiens
tttcaagaatgtgga

SEQ ID NO: 173093 - DNA, 15 bp, Homo sapiens
ttttcaagaatgtgg

SEQ ID NO: 173094 - DNA, 15 bp, Homo sapiens
attttcaagaatgtg

SEQ ID NO: 173095 - DNA, 15 bp, Homo sapiens
gattttcaagaatgt

SEQ ID NO: 173096 - DNA, 15 bp, Homo sapiens
agattttcaagaatg

SEQ ID NO: 173097 - DNA, 15 bp, Homo sapiens
aagattttcaagaat

SEQ ID NO: 173098 - DNA, 15 bp, Homo sapiens
aaagattttcaagaa

SEQ ID NO: 173099 - DNA, 15 bp, Homo sapiens
gaaagattttcaaga

SEQ ID NO: 173100 - DNA, 15 bp, Homo sapiens
ggaaagattttcaag

SEQ ID NO: 173101 - DNA, 15 bp, Homo sapiens
gggaaagattttcaa

SEQ ID NO: 173102 - DNA, 15 bp, Homo sapiens
agggaaagattttca

SEQ ID NO: 173103 - DNA, 15 bp, Homo sapiens
aagggaaagattttc

SEQ ID NO: 173104 - DNA, 15 bp, Homo sapiens
aaagggaaagatttt

SEQ ID NO: 173105 - DNA, 15 bp, Homo sapiens
caaagggaaagattt

SEQ ID NO: 173106 - DNA, 15 bp, Homo sapiens
tcaaagggaaagatt

SEQ ID NO: 173107 - DNA, 15 bp, Homo sapiens
gtcaaagggaaagat

SEQ ID NO: 173108 - DNA, 15 bp, Homo sapiens
agtcaaagggaaaga

SEQ ID NO: 173109 - DNA, 15 bp, Homo sapiens
cagtcaaagggaaag

SEQ ID NO: 173110 - DNA, 15 bp, Homo sapiens
acagtcaaagggaaa

SEQ ID NO: 173111 - DNA, 15 bp, Homo sapiens
cacagtcaaagggaa

SEQ ID NO: 173112 - DNA, 15 bp, Homo sapiens
tcacagtcaaaggga

SEQ ID NO: 173113 - DNA, 15 bp, Homo sapiens
gtcacagtcaaaggg

SEQ ID NO: 173114 - DNA, 15 bp, Homo sapiens
tgtcacagtcaaagg

SEQ ID NO: 173115 - DNA, 15 bp, Homo sapiens
atgtcacagtcaaag

SEQ ID NO: 173116 - DNA, 15 bp, Homo sapiens
tatgtcacagtcaaa

SEQ ID NO: 173117 - DNA, 15 bp, Homo sapiens
gtatgtcacagtcaa

SEQ ID NO: 173118 - DNA, 15 bp, Homo sapiens
tgtatgtcacagtca

SEQ ID NO: 173119 - DNA, 15 bp, Homo sapiens
ttgtatgtcacagtc

SEQ ID NO: 173120 - DNA, 15 bp, Homo sapiens
tttgtatgtcacagt

SEQ ID NO: 173121 - DNA, 15 bp, Homo sapiens
atttgtatgtcacag

SEQ ID NO: 173122 - DNA, 15 bp, Homo sapiens
gatttgtatgtcaca

SEQ ID NO: 173123 - DNA, 15 bp, Homo sapiens
agatttgtatgtcac

SEQ ID NO: 173124 - DNA, 15 bp, Homo sapiens
aagatttgtatgtca

SEQ ID NO: 173125 - DNA, 15 bp, Homo sapiens
gaagatttgtatgtc

SEQ ID NO: 173126 - DNA, 15 bp, Homo sapiens
tgaagatttgtatgt

SEQ ID NO: 173127 - DNA, 15 bp, Homo sapiens
atgaagatttgtatg

SEQ ID NO: 173128 - DNA, 15 bp, Homo sapiens
aatgaagatttgtat

SEQ ID NO: 173129 - DNA, 15 bp, Homo sapiens
caatgaagatttgta

SEQ ID NO: 173130 - DNA, 15 bp, Homo sapiens
gcaatgaagatttgt

SEQ ID NO: 173131 - DNA, 15 bp, Homo sapiens
agcaatgaagatttg

SEQ ID NO: 173132 - DNA, 15 bp, Homo sapiens
aagcaatgaagattt

SEQ ID NO: 173133 - DNA, 15 bp, Homo sapiens
taagcaatgaagatt

SEQ ID NO: 173134 - DNA, 15 bp, Homo sapiens
gtaagcaatgaagat

SEQ ID NO: 173135 - DNA, 15 bp, Homo sapiens
ggtaagcaatgaaga

SEQ ID NO: 173136 - DNA, 15 bp, Homo sapiens
aggtaagcaatgaag

SEQ ID NO: 173137 - DNA, 15 bp, Homo sapiens
aaggtaagcaatgaa

SEQ ID NO: 173138 - DNA, 15 bp, Homo sapiens
caaggtaagcaatga

SEQ ID NO: 173139 - DNA, 15 bp, Homo sapiens
tcaaggtaagcaatg

SEQ ID NO: 173140 - DNA, 15 bp, Homo sapiens
ttcaaggtaagcaat

SEQ ID NO: 173141 - DNA, 15 bp, Homo sapiens
attcaaggtaagcaa

SEQ ID NO: 173142 - DNA, 15 bp, Homo sapiens
gattcaaggtaagca

SEQ ID NO: 173143 - DNA, 15 bp, Homo sapiens
agattcaaggtaagc

SEQ ID NO: 173144 - DNA, 15 bp, Homo sapiens
aagattcaaggtaag

SEQ ID NO: 173145 - DNA, 15 bp, Homo sapiens
taagattcaaggtaa

SEQ ID NO: 173146 - DNA, 15 bp, Homo sapiens
ttaagattcaaggta

SEQ ID NO: 173147 - DNA, 15 bp, Homo sapiens
attaagattcaaggt

SEQ ID NO: 173148 - DNA, 15 bp, Homo sapiens
tattaagattcaagg

SEQ ID NO: 173149 - DNA, 15 bp, Homo sapiens
atattaagattcaag

SEQ ID NO: 173150 - DNA, 15 bp, Homo sapiens
gatattaagattcaa

SEQ ID NO: 173151 - DNA, 15 bp, Homo sapiens
tgatattaagattca

SEQ ID NO: 173152 - DNA, 15 bp, Homo sapiens
atgatattaagattc

SEQ ID NO: 173153 - DNA, 15 bp, Homo sapiens
catgatattaagatt

SEQ ID NO: 173154 - DNA, 15 bp, Homo sapiens
gcatgatattaagat

SEQ ID NO: 173155 - DNA, 15 bp, Homo sapiens
cgcatgatattaaga

SEQ ID NO: 173156 - DNA, 15 bp, Homo sapiens
acgcatgatattaag

SEQ ID NO: 173157 - DNA, 15 bp, Homo sapiens
cacgcatgatattaa

SEQ ID NO: 173158 - DNA, 15 bp, Homo sapiens
tcacgcatgatatta

SEQ ID NO: 173159 - DNA, 15 bp, Homo sapiens
ctcacgcatgatatt

SEQ ID NO: 173160 - DNA, 15 bp, Homo sapiens
gctcacgcatgatat

SEQ ID NO: 173161 - DNA, 15 bp, Homo sapiens
tgctcacgcatgata

SEQ ID NO: 173162 - DNA, 15 bp, Homo sapiens
ttgctcacgcatgat

SEQ ID NO: 173163 - DNA, 15 bp, Homo sapiens
tttgctcacgcatga

SEQ ID NO: 173164 - DNA, 15 bp, Homo sapiens
ctttgctcacgcatg

SEQ ID NO: 173165 - DNA, 15 bp, Homo sapiens
actttgctcacgcat

SEQ ID NO: 173166 - DNA, 15 bp, Homo sapiens
cactttgctcacgca

SEQ ID NO: 173167 - DNA, 15 bp, Homo sapiens
acactttgctcacgc

SEQ ID NO: 173168 - DNA, 15 bp, Homo sapiens
aacactttgctcacg

SEQ ID NO: 173169 - DNA, 15 bp, Homo sapiens
taacactttgctcac

SEQ ID NO: 173170 - DNA, 15 bp, Homo sapiens
ctaacactttgctca

SEQ ID NO: 173171 - DNA, 15 bp, Homo sapiens
gctaacactttgctc

SEQ ID NO: 173172 - DNA, 15 bp, Homo sapiens
tgctaacactttgct

SEQ ID NO: 173173 - DNA, 15 bp, Homo sapiens
atgctaacactttgc

SEQ ID NO: 173174 - DNA, 15 bp, Homo sapiens
tatgctaacactttg

SEQ ID NO: 173175 - DNA, 15 bp, Homo sapiens
atatgctaacacttt

SEQ ID NO: 173176 - DNA, 15 bp, Homo sapiens
aatatgctaacactt

SEQ ID NO: 173177 - DNA, 15 bp, Homo sapiens
aaatatgctaacact

SEQ ID NO: 173178 - DNA, 15 bp, Homo sapiens
caaatatgctaacac

SEQ ID NO: 173179 - DNA, 15 bp, Homo sapiens
gcaaatatgctaaca

SEQ ID NO: 173180 - DNA, 15 bp, Homo sapiens
agcaaatatgctaac

SEQ ID NO: 173181 - DNA, 15 bp, Homo sapiens
aagcaaatatgctaa

SEQ ID NO: 173182 - DNA, 15 bp, Homo sapiens
taagcaaatatgcta

SEQ ID NO: 173183 - DNA, 15 bp, Homo sapiens
ataagcaaatatgct

SEQ ID NO: 173184 - DNA, 15 bp, Homo sapiens
aataagcaaatatgc

SEQ ID NO: 173185 - DNA, 15 bp, Homo sapiens
aaataagcaaatatg

SEQ ID NO: 173186 - DNA, 15 bp, Homo sapiens
caaataagcaaatat

SEQ ID NO: 173187 - DNA, 15 bp, Homo sapiens
gcaaataagcaaata

SEQ ID NO: 173188 - DNA, 15 bp, Homo sapiens
agcaaataagcaaat

SEQ ID NO: 173189 - DNA, 15 bp, Homo sapiens
gagcaaataagcaaa

SEQ ID NO: 173190 - DNA, 15 bp, Homo sapiens
agagcaaataagcaa

SEQ ID NO: 173191 - DNA, 15 bp, Homo sapiens
aagagcaaataagca

SEQ ID NO: 173192 - DNA, 15 bp, Homo sapiens
taagagcaaataagc

SEQ ID NO: 173193 - DNA, 15 bp, Homo sapiens
gtaagagcaaataag

SEQ ID NO: 173194 - DNA, 15 bp, Homo sapiens
agtaagagcaaataa

SEQ ID NO: 173195 - DNA, 15 bp, Homo sapiens
aagtaagagcaaata

SEQ ID NO: 173196 - DNA, 15 bp, Homo sapiens
taagtaagagcaaat

SEQ ID NO: 173197 - DNA, 15 bp, Homo sapiens
ataagtaagagcaaa

SEQ ID NO: 173198 - DNA, 15 bp, Homo sapiens
aataagtaagagcaa

SEQ ID NO: 173199 - DNA, 15 bp, Homo sapiens
aaataagtaagagca

SEQ ID NO: 173200 - DNA, 15 bp, Homo sapiens
aaaataagtaagagc

SEQ ID NO: 173201 - DNA, 15 bp, Homo sapiens
aaaaataagtaagag

SEQ ID NO: 173202 - DNA, 15 bp, Homo sapiens
gaaaaataagtaaga

SEQ ID NO: 173203 - DNA, 15 bp, Homo sapiens
tgaaaaataagtaag

SEQ ID NO: 173204 - DNA, 15 bp, Homo sapiens
ctgaaaaataagtaa

SEQ ID NO: 173205 - DNA, 15 bp, Homo sapiens
tctgaaaaataagta

SEQ ID NO: 173206 - DNA, 15 bp, Homo sapiens
ttctgaaaaataagt

SEQ ID NO: 173207 - DNA, 15 bp, Homo sapiens
cttctgaaaaataag

SEQ ID NO: 173208 - DNA, 15 bp, Homo sapiens
ccttctgaaaaataa

SEQ ID NO: 173209 - DNA, 15 bp, Homo sapiens
accttctgaaaaata

SEQ ID NO: 173210 - DNA, 15 bp, Homo sapiens
caccttctgaaaaat

SEQ ID NO: 173211 - DNA, 15 bp, Homo sapiens
gcaccttctgaaaaa

SEQ ID NO: 173212 - DNA, 15 bp, Homo sapiens
agcaccttctgaaaa

SEQ ID NO: 173213 - DNA, 15 bp, Homo sapiens
tagcaccttctgaaa

SEQ ID NO: 173214 - DNA, 15 bp, Homo sapiens
gtagcaccttctgaa

SEQ ID NO: 173215 - DNA, 15 bp, Homo sapiens
tgtagcaccttctga

SEQ ID NO: 173216 - DNA, 15 bp, Homo sapiens
atgtagcaccttctg

SEQ ID NO: 173217 - DNA, 15 bp, Homo sapiens
tatgtagcaccttct

SEQ ID NO: 173218 - DNA, 15 bp, Homo sapiens
ctatgtagcaccttc

SEQ ID NO: 173219 - DNA, 15 bp, Homo sapiens
actatgtagcacctt

SEQ ID NO: 173220 - DNA, 15 bp, Homo sapiens
aactatgtagcacct

SEQ ID NO: 173221 - DNA, 15 bp, Homo sapiens
aaactatgtagcacc

SEQ ID NO: 173222 - DNA, 15 bp, Homo sapiens
taaactatgtagcac

SEQ ID NO: 173223 - DNA, 15 bp, Homo sapiens
ttaaactatgtagca

SEQ ID NO: 173224 - DNA, 15 bp, Homo sapiens
tttaaactatgtagc

SEQ ID NO: 173225 - DNA, 15 bp, Homo sapiens
ttttaaactatgtag

SEQ ID NO: 173226 - DNA, 15 bp, Homo sapiens
tttttaaactatgta

SEQ ID NO: 173227 - DNA, 15 bp, Homo sapiens
ttttttaaactatgt

SEQ ID NO: 173228 - DNA, 15 bp, Homo sapiens
tttttttaaactatg

SEQ ID NO: 173229 - DNA, 15 bp, Homo sapiens
ttttttttaaactat

SEQ ID NO: 173230 - DNA, 15 bp, Homo sapiens
tttttttttaaacta

SEQ ID NO: 173231 - DNA, 15 bp, Homo sapiens
ttttttttttaaact

SEQ ID NO: 173232 - DNA, 15 bp, Homo sapiens
gctttttttttttaa

SEQ ID NO: 173233 - DNA, 15 bp, Homo sapiens
tgcttttttttttta

SEQ ID NO: 173234 - DNA, 15 bp, Homo sapiens
ttttgcttttttttt

SEQ ID NO: 173235 - DNA, 15 bp, Homo sapiens
tttttgctttttttt

SEQ ID NO: 173236 - DNA, 15 bp, Homo sapiens
ctttttgcttttttt

SEQ ID NO: 173237 - DNA, 15 bp, Homo sapiens
cctttttgctttttt

SEQ ID NO: 173238 - DNA, 15 bp, Homo sapiens
tcctttttgcttttt

SEQ ID NO: 173239 - DNA, 15 bp, Homo sapiens
atcctttttgctttt

SEQ ID NO: 173240 - DNA, 15 bp, Homo sapiens
catcctttttgcttt

SEQ ID NO: 173241 - DNA, 15 bp, Homo sapiens
acatcctttttgctt

SEQ ID NO: 173242 - DNA, 15 bp, Homo sapiens
cacatcctttttgct

SEQ ID NO: 173243 - DNA, 15 bp, Homo sapiens
acacatcctttttgc

SEQ ID NO: 173244 - DNA, 15 bp, Homo sapiens
tacacatcctttttg

SEQ ID NO: 173245 - DNA, 15 bp, Homo sapiens
ctacacatccttttt

SEQ ID NO: 173246 - DNA, 15 bp, Homo sapiens
actacacatcctttt

SEQ ID NO: 173247 - DNA, 15 bp, Homo sapiens
tactacacatccttt

SEQ ID NO: 173248 - DNA, 15 bp, Homo sapiens
ttactacacatcctt

SEQ ID NO: 173249 - DNA, 15 bp, Homo sapiens
tttactacacatcct

SEQ ID NO: 173250 - DNA, 15 bp, Homo sapiens
ttttactacacatcc

SEQ ID NO: 173251 - DNA, 15 bp, Homo sapiens
tttttactacacatc

SEQ ID NO: 173252 - DNA, 15 bp, Homo sapiens
ttttttactacacat

SEQ ID NO: 173253 - DNA, 15 bp, Homo sapiens
attttttactacaca

SEQ ID NO: 173254 - DNA, 15 bp, Homo sapiens
gattttttactacac

SEQ ID NO: 173255 - DNA, 15 bp, Homo sapiens
agattttttactaca

SEQ ID NO: 173256 - DNA, 15 bp, Homo sapiens
tagattttttactac

SEQ ID NO: 173257 - DNA, 15 bp, Homo sapiens
ctagattttttacta

SEQ ID NO: 173258 - DNA, 15 bp, Homo sapiens
actagattttttact

SEQ ID NO: 173259 - DNA, 15 bp, Homo sapiens
cactagattttttac

SEQ ID NO: 173260 - DNA, 15 bp, Homo sapiens
acactagatttttta

SEQ ID NO: 173261 - DNA, 15 bp, Homo sapiens
tacactagatttttt

SEQ ID NO: 173262 - DNA, 15 bp, Homo sapiens
gtacactagattttt

SEQ ID NO: 173263 - DNA, 15 bp, Homo sapiens
agtacactagatttt

SEQ ID NO: 173264 - DNA, 15 bp, Homo sapiens
cagtacactagattt

SEQ ID NO: 173265 - DNA, 15 bp, Homo sapiens
gcagtacactagatt

SEQ ID NO: 173266 - DNA, 15 bp, Homo sapiens
cgcagtacactagat

SEQ ID NO: 173267 - DNA, 15 bp, Homo sapiens
acgcagtacactaga

SEQ ID NO: 173268 - DNA, 15 bp, Homo sapiens
gacgcagtacactag

SEQ ID NO: 173269 - DNA, 15 bp, Homo sapiens
ggacgcagtacacta

SEQ ID NO: 173270 - DNA, 15 bp, Homo sapiens
aggacgcagtacact

SEQ ID NO: 173271 - DNA, 15 bp, Homo sapiens
taggacgcagtacac

SEQ ID NO: 173272 - DNA, 15 bp, Homo sapiens
ttaggacgcagtaca

SEQ ID NO: 173273 - DNA, 15 bp, Homo sapiens
tttaggacgcagtac

SEQ ID NO: 173274 - DNA, 15 bp, Homo sapiens
atttaggacgcagta

SEQ ID NO: 173275 - DNA, 15 bp, Homo sapiens
catttaggacgcagt

SEQ ID NO: 173276 - DNA, 15 bp, Homo sapiens
tcatttaggacgcag

SEQ ID NO: 173277 - DNA, 15 bp, Homo sapiens
gtcatttaggacgca

SEQ ID NO: 173278 - DNA, 15 bp, Homo sapiens
cgtcatttaggacgc

SEQ ID NO: 173279 - DNA, 15 bp, Homo sapiens
gcgtcatttaggacg

SEQ ID NO: 173280 - DNA, 15 bp, Homo sapiens
tgcgtcatttaggac

SEQ ID NO: 173281 - DNA, 15 bp, Homo sapiens
atgcgtcatttagga

SEQ ID NO: 173282 - DNA, 15 bp, Homo sapiens
gatgcgtcatttagg

SEQ ID NO: 173283 - DNA, 15 bp, Homo sapiens
tgatgcgtcatttag

SEQ ID NO: 173284 - DNA, 15 bp, Homo sapiens
atgatgcgtcattta

SEQ ID NO: 173285 - DNA, 15 bp, Homo sapiens
catgatgcgtcattt

SEQ ID NO: 173286 - DNA, 15 bp, Homo sapiens
tcatgatgcgtcatt

SEQ ID NO: 173287 - DNA, 15 bp, Homo sapiens
gtcatgatgcgtcat

SEQ ID NO: 173288 - DNA, 15 bp, Homo sapiens
ggtcatgatgcgtca

SEQ ID NO: 173289 - DNA, 15 bp, Homo sapiens
tggtcatgatgcgtc

SEQ ID NO: 173290 - DNA, 15 bp, Homo sapiens
atggtcatgatgcgt

SEQ ID NO: 173291 - DNA, 15 bp, Homo sapiens
tatggtcatgatgcg

SEQ ID NO: 173292 - DNA, 15 bp, Homo sapiens
ctatggtcatgatgc

SEQ ID NO: 173293 - DNA, 15 bp, Homo sapiens
tctatggtcatgatg

SEQ ID NO: 173294 - DNA, 15 bp, Homo sapiens
gtctatggtcatgat

SEQ ID NO: 173295 - DNA, 15 bp, Homo sapiens
agtctatggtcatga

SEQ ID NO: 173296 - DNA, 15 bp, Homo sapiens
cagtctatggtcatg

SEQ ID NO: 173297 - DNA, 15 bp, Homo sapiens
acagtctatggtcat

SEQ ID NO: 173298 - DNA, 15 bp, Homo sapiens
gacagtctatggtca

SEQ ID NO: 173299 - DNA, 15 bp, Homo sapiens
tgacagtctatggtc

SEQ ID NO: 173300 - DNA, 15 bp, Homo sapiens
gtgacagtctatggt

SEQ ID NO: 173301 - DNA, 15 bp, Homo sapiens
ggtgacagtctatgg

SEQ ID NO: 173302 - DNA, 15 bp, Homo sapiens
cggtgacagtctatg

SEQ ID NO: 173303 - DNA, 15 bp, Homo sapiens
gcggtgacagtctat

SEQ ID NO: 173304 - DNA, 15 bp, Homo sapiens
ggcggtgacagtcta

SEQ ID NO: 173305 - DNA, 15 bp, Homo sapiens
gggcggtgacagtct

SEQ ID NO: 173306 - DNA, 15 bp, Homo sapiens
agggcggtgacagtc

SEQ ID NO: 173307 - DNA, 15 bp, Homo sapiens
aagggcggtgacagt

SEQ ID NO: 173308 - DNA, 15 bp, Homo sapiens
caagggcggtgacag

SEQ ID NO: 173309 - DNA, 15 bp, Homo sapiens
gcaagggcggtgaca

SEQ ID NO: 173310 - DNA, 15 bp, Homo sapiens
tgcaagggcggtgac

SEQ ID NO: 173311 - DNA, 15 bp, Homo sapiens
ttgcaagggcggtga

SEQ ID NO: 173312 - DNA, 15 bp, Homo sapiens
cttgcaagggcggtg

SEQ ID NO: 173313 - DNA, 15 bp, Homo sapiens
tcttgcaagggcggt

SEQ ID NO: 173314 - DNA, 15 bp, Homo sapiens
ctcttgcaagggcgg

SEQ ID NO: 173315 - DNA, 15 bp, Homo sapiens
cctcttgcaagggcg

SEQ ID NO: 173316 - DNA, 15 bp, Homo sapiens
gcctcttgcaagggc

SEQ ID NO: 173317 - DNA, 15 bp, Homo sapiens
tgcctcttgcaaggg

SEQ ID NO: 173318 - DNA, 15 bp, Homo sapiens
ctgcctcttgcaagg

SEQ ID NO: 173319 - DNA, 15 bp, Homo sapiens
gctgcctcttgcaag

SEQ ID NO: 173320 - DNA, 15 bp, Homo sapiens
ggctgcctcttgcaa

SEQ ID NO: 173321 - DNA, 15 bp, Homo sapiens
tggctgcctcttgca

SEQ ID NO: 173322 - DNA, 15 bp, Homo sapiens
gtggctgcctcttgc

SEQ ID NO: 173323 - DNA, 15 bp, Homo sapiens
ggtggctgcctcttg

SEQ ID NO: 173324 - DNA, 15 bp, Homo sapiens
cggtggctgcctctt

SEQ ID NO: 173325 - DNA, 15 bp, Homo sapiens
tcggtggctgcctct

SEQ ID NO: 173326 - DNA, 15 bp, Homo sapiens
atcggtggctgcctc

SEQ ID NO: 173327 - DNA, 15 bp, Homo sapiens
catcggtggctgcct

SEQ ID NO: 173328 - DNA, 15 bp, Homo sapiens
gcatcggtggctgcc

SEQ ID NO: 173329 - DNA, 15 bp, Homo sapiens
ggcatcggtggctgc

SEQ ID NO: 173330 - DNA, 15 bp, Homo sapiens
tggcatcggtggctg

SEQ ID NO: 173331 - DNA, 15 bp, Homo sapiens
ctggcatcggtggct

SEQ ID NO: 173332 - DNA, 15 bp, Homo sapiens
actggcatcggtggc

SEQ ID NO: 173333 - DNA, 15 bp, Homo sapiens
aactggcatcggtgg

SEQ ID NO: 173334 - DNA, 15 bp, Homo sapiens
aaactggcatcggtg

SEQ ID NO: 173335 - DNA, 15 bp, Homo sapiens
gaaactggcatcggt

SEQ ID NO: 173336 - DNA, 15 bp, Homo sapiens
agaaactggcatcgg

SEQ ID NO: 173337 - DNA, 15 bp, Homo sapiens
aagaaactggcatcg

SEQ ID NO: 173338 - DNA, 15 bp, Homo sapiens
caagaaactggcatc

SEQ ID NO: 173339 - DNA, 15 bp, Homo sapiens
acaagaaactggcat

SEQ ID NO: 173340 - DNA, 15 bp, Homo sapiens
cacaagaaactggca

SEQ ID NO: 173341 - DNA, 15 bp, Homo sapiens
acacaagaaactggc

SEQ ID NO: 173342 - DNA, 15 bp, Homo sapiens
cacacaagaaactgg

SEQ ID NO: 173343 - DNA, 15 bp, Homo sapiens
gcacacaagaaactg

SEQ ID NO: 173344 - DNA, 15 bp, Homo sapiens
agcacacaagaaact

SEQ ID NO: 173345 - DNA, 15 bp, Homo sapiens
gagcacacaagaaac

SEQ ID NO: 173346 - DNA, 15 bp, Homo sapiens
agagcacacaagaaa

SEQ ID NO: 173347 - DNA, 15 bp, Homo sapiens
aagagcacacaagaa

SEQ ID NO: 173348 - DNA, 15 bp, Homo sapiens
gaagagcacacaaga

SEQ ID NO: 173349 - DNA, 15 bp, Homo sapiens
ggaagagcacacaag

SEQ ID NO: 173350 - DNA, 15 bp, Homo sapiens
tggaagagcacacaa

SEQ ID NO: 173351 - DNA, 15 bp, Homo sapiens
ctggaagagcacaca

SEQ ID NO: 173352 - DNA, 15 bp, Homo sapiens
tctggaagagcacac

SEQ ID NO: 173353 - DNA, 15 bp, Homo sapiens
ctctggaagagcaca

SEQ ID NO: 173354 - DNA, 15 bp, Homo sapiens
tctctggaagagcac

SEQ ID NO: 173355 - DNA, 15 bp, Homo sapiens
atctctggaagagca

SEQ ID NO: 173356 - DNA, 15 bp, Homo sapiens
tatctctggaagagc

SEQ ID NO: 173357 - DNA, 15 bp, Homo sapiens
gtatctctggaagag

SEQ ID NO: 173358 - DNA, 15 bp, Homo sapiens
agtatctctggaaga

SEQ ID NO: 173359 - DNA, 15 bp, Homo sapiens
aagtatctctggaag

SEQ ID NO: 173360 - DNA, 15 bp, Homo sapiens
caagtatctctggaa

SEQ ID NO: 173361 - DNA, 15 bp, Homo sapiens
gcaagtatctctgga

SEQ ID NO: 173362 - DNA, 15 bp, Homo sapiens
agcaagtatctctgg

SEQ ID NO: 173363 - DNA, 15 bp, Homo sapiens
cagcaagtatctctg

SEQ ID NO: 173364 - DNA, 15 bp, Homo sapiens
acagcaagtatctct

SEQ ID NO: 173365 - DNA, 15 bp, Homo sapiens
tacagcaagtatctc

SEQ ID NO: 173366 - DNA, 15 bp, Homo sapiens
atacagcaagtatct

SEQ ID NO: 173367 - DNA, 15 bp, Homo sapiens
aatacagcaagtatc

SEQ ID NO: 173368 - DNA, 15 bp, Homo sapiens
caatacagcaagtat

SEQ ID NO: 173369 - DNA, 15 bp, Homo sapiens
acaatacagcaagta

SEQ ID NO: 173370 - DNA, 15 bp, Homo sapiens
gacaatacagcaagt

SEQ ID NO: 173371 - DNA, 15 bp, Homo sapiens
agacaatacagcaag

SEQ ID NO: 173372 - DNA, 15 bp, Homo sapiens
aagacaatacagcaa

SEQ ID NO: 173373 - DNA, 15 bp, Homo sapiens
aaagacaatacagca

SEQ ID NO: 173374 - DNA, 15 bp, Homo sapiens
aaaagacaatacagc

SEQ ID NO: 173375 - DNA, 15 bp, Homo sapiens
taaaagacaatacag

SEQ ID NO: 173376 - DNA, 15 bp, Homo sapiens
ataaaagacaataca

SEQ ID NO: 173377 - DNA, 15 bp, Homo sapiens
aataaaagacaatac

SEQ ID NO: 173378 - DNA, 15 bp, Homo sapiens
aaataaaagacaata

SEQ ID NO: 173379 - DNA, 15 bp, Homo sapiens
aaaataaaagacaat

SEQ ID NO: 173380 - DNA, 15 bp, Homo sapiens
taaaataaaagacaa

SEQ ID NO: 173381 - DNA, 15 bp, Homo sapiens
ttaaaataaaagaca

SEQ ID NO: 173382 - DNA, 15 bp, Homo sapiens
tttaaaataaaagac

SEQ ID NO: 173383 - DNA, 15 bp, Homo sapiens
ctttaaaataaaaga

SEQ ID NO: 173384 - DNA, 15 bp, Homo sapiens
actttaaaataaaag

SEQ ID NO: 173385 - DNA, 15 bp, Homo sapiens
cactttaaaataaaa

SEQ ID NO: 173386 - DNA, 15 bp, Homo sapiens
acactttaaaataaa

SEQ ID NO: 173387 - DNA, 15 bp, Homo sapiens
cacactttaaaataa

SEQ ID NO: 173388 - DNA, 15 bp, Homo sapiens
ccacactttaaaata

SEQ ID NO: 173389 - DNA, 15 bp, Homo sapiens
gccacactttaaaat

SEQ ID NO: 173390 - DNA, 15 bp, Homo sapiens
tgccacactttaaaa

SEQ ID NO: 173391 - DNA, 15 bp, Homo sapiens
atgccacactttaaa

SEQ ID NO: 173392 - DNA, 15 bp, Homo sapiens
tatgccacactttaa

SEQ ID NO: 173393 - DNA, 15 bp, Homo sapiens
gtatgccacacttta

SEQ ID NO: 173394 - DNA, 15 bp, Homo sapiens
tgtatgccacacttt

SEQ ID NO: 173395 - DNA, 15 bp, Homo sapiens
atgtatgccacactt

SEQ ID NO: 173396 - DNA, 15 bp, Homo sapiens
tatgtatgccacact

SEQ ID NO: 173397 - DNA, 15 bp, Homo sapiens
gtatgtatgccacac

SEQ ID NO: 173398 - DNA, 15 bp, Homo sapiens
tgtatgtatgccaca

SEQ ID NO: 173399 - DNA, 15 bp, Homo sapiens
ctgtatgtatgccac

SEQ ID NO: 173400 - DNA, 15 bp, Homo sapiens
cctgtatgtatgcca

SEQ ID NO: 173401 - DNA, 15 bp, Homo sapiens
tcctgtatgtatgcc

SEQ ID NO: 173402 - DNA, 15 bp, Homo sapiens
ttcctgtatgtatgc

SEQ ID NO: 173403 - DNA, 15 bp, Homo sapiens
tttcctgtatgtatg

SEQ ID NO: 173404 - DNA, 15 bp, Homo sapiens
ctttcctgtatgtat

SEQ ID NO: 173405 - DNA, 15 bp, Homo sapiens
actttcctgtatgta

SEQ ID NO: 173406 - DNA, 15 bp, Homo sapiens
tactttcctgtatgt

SEQ ID NO: 173407 - DNA, 15 bp, Homo sapiens
atactttcctgtatg

SEQ ID NO: 173408 - DNA, 15 bp, Homo sapiens
catactttcctgtat

SEQ ID NO: 173409 - DNA, 15 bp, Homo sapiens
acatactttcctgta

SEQ ID NO: 173410 - DNA, 15 bp, Homo sapiens
tacatactttcctgt

SEQ ID NO: 173411 - DNA, 15 bp, Homo sapiens
ttacatactttcctg

SEQ ID NO: 173412 - DNA, 15 bp, Homo sapiens
tttacatactttcct

SEQ ID NO: 173413 - DNA, 15 bp, Homo sapiens
ttttacatactttcc

SEQ ID NO: 173414 - DNA, 15 bp, Homo sapiens
gttttacatactttc

SEQ ID NO: 173415 - DNA, 15 bp, Homo sapiens
tgttttacatacttt

SEQ ID NO: 173416 - DNA, 15 bp, Homo sapiens
atgttttacatactt

SEQ ID NO: 173417 - DNA, 15 bp, Homo sapiens
tatgttttacatact

SEQ ID NO: 173418 - DNA, 15 bp, Homo sapiens
gtatgttttacatac

SEQ ID NO: 173419 - DNA, 15 bp, Homo sapiens
tgtatgttttacata

SEQ ID NO: 173420 - DNA, 15 bp, Homo sapiens
atgtatgttttacat

SEQ ID NO: 173421 - DNA, 15 bp, Homo sapiens
catgtatgttttaca

SEQ ID NO: 173422 - DNA, 15 bp, Homo sapiens
ccatgtatgttttac

SEQ ID NO: 173423 - DNA, 15 bp, Homo sapiens
tccatgtatgtttta

SEQ ID NO: 173424 - DNA, 15 bp, Homo sapiens
gtccatgtatgtttt

SEQ ID NO: 173425 - DNA, 15 bp, Homo sapiens
tgtccatgtatgttt

SEQ ID NO: 173426 - DNA, 15 bp, Homo sapiens
ctgtccatgtatgtt

SEQ ID NO: 173427 - DNA, 15 bp, Homo sapiens
gctgtccatgtatgt

SEQ ID NO: 173428 - DNA, 15 bp, Homo sapiens
tgctgtccatgtatg

SEQ ID NO: 173429 - DNA, 15 bp, Homo sapiens
atgctgtccatgtat

SEQ ID NO: 173430 - DNA, 15 bp, Homo sapiens
catgctgtccatgta

SEQ ID NO: 173431 - DNA, 15 bp, Homo sapiens
tcatgctgtccatgt

SEQ ID NO: 173432 - DNA, 15 bp, Homo sapiens
ttcatgctgtccatg

SEQ ID NO: 173433 - DNA, 15 bp, Homo sapiens
cttcatgctgtccat

SEQ ID NO: 173434 - DNA, 15 bp, Homo sapiens
tcttcatgctgtcca

SEQ ID NO: 173435 - DNA, 15 bp, Homo sapiens
ttcttcatgctgtcc

SEQ ID NO: 173436 - DNA, 15 bp, Homo sapiens
attcttcatgctgtc

SEQ ID NO: 173437 - DNA, 15 bp, Homo sapiens
gattcttcatgctgt

SEQ ID NO: 173438 - DNA, 15 bp, Homo sapiens
tgattcttcatgctg

SEQ ID NO: 173439 - DNA, 15 bp, Homo sapiens
atgattcttcatgct

SEQ ID NO: 173440 - DNA, 15 bp, Homo sapiens
tatgattcttcatgc

SEQ ID NO: 173441 - DNA, 15 bp, Homo sapiens
ttatgattcttcatg

SEQ ID NO: 173442 - DNA, 15 bp, Homo sapiens
attatgattcttcat

SEQ ID NO: 173443 - DNA, 15 bp, Homo sapiens
aattatgattcttca

SEQ ID NO: 173444 - DNA, 15 bp, Homo sapiens
taattatgattcttc

SEQ ID NO: 173445 - DNA, 15 bp, Homo sapiens
ttaattatgattctt

SEQ ID NO: 173446 - DNA, 15 bp, Homo sapiens
tttaattatgattct

SEQ ID NO: 173447 - DNA, 15 bp, Homo sapiens
ttttaattatgattc

SEQ ID NO: 173448 - DNA, 15 bp, Homo sapiens
gttttaattatgatt

SEQ ID NO: 173449 - DNA, 15 bp, Homo sapiens
tgttttaattatgat

SEQ ID NO: 173450 - DNA, 15 bp, Homo sapiens
ttgttttaattatga

SEQ ID NO: 173451 - DNA, 15 bp, Homo sapiens
attgttttaattatg

SEQ ID NO: 173452 - DNA, 15 bp, Homo sapiens
gattgttttaattat

SEQ ID NO: 173453 - DNA, 15 bp, Homo sapiens
tgattgttttaatta

SEQ ID NO: 173454 - DNA, 15 bp, Homo sapiens
gtgattgttttaatt

SEQ ID NO: 173455 - DNA, 15 bp, Homo sapiens
agtgattgttttaat

SEQ ID NO: 173456 - DNA, 15 bp, Homo sapiens
tagtgattgttttaa

SEQ ID NO: 173457 - DNA, 15 bp, Homo sapiens
atagtgattgtttta

SEQ ID NO: 173458 - DNA, 15 bp, Homo sapiens
aatagtgattgtttt

SEQ ID NO: 173459 - DNA, 15 bp, Homo sapiens
gaatagtgattgttt

SEQ ID NO: 173460 - DNA, 15 bp, Homo sapiens
ggaatagtgattgtt

SEQ ID NO: 173461 - DNA, 15 bp, Homo sapiens
tggaatagtgattgt

SEQ ID NO: 173462 - DNA, 15 bp, Homo sapiens
ttggaatagtgattg

SEQ ID NO: 173463 - DNA, 15 bp, Homo sapiens
cttggaatagtgatt

SEQ ID NO: 173464 - DNA, 15 bp, Homo sapiens
acttggaatagtgat

SEQ ID NO: 173465 - DNA, 15 bp, Homo sapiens
aacttggaatagtga

SEQ ID NO: 173466 - DNA, 15 bp, Homo sapiens
taacttggaatagtg

SEQ ID NO: 173467 - DNA, 15 bp, Homo sapiens
ataacttggaatagt

SEQ ID NO: 173468 - DNA, 15 bp, Homo sapiens
aataacttggaatag

SEQ ID NO: 173469 - DNA, 15 bp, Homo sapiens
caataacttggaata

SEQ ID NO: 173470 - DNA, 15 bp, Homo sapiens
gcaataacttggaat

SEQ ID NO: 173471 - DNA, 15 bp, Homo sapiens
agcaataacttggaa

SEQ ID NO: 173472 - DNA, 15 bp, Homo sapiens
cagcaataacttgga

SEQ ID NO: 173473 - DNA, 15 bp, Homo sapiens
tcagcaataacttgg

SEQ ID NO: 173474 - DNA, 15 bp, Homo sapiens
atcagcaataacttg

SEQ ID NO: 173475 - DNA, 15 bp, Homo sapiens
gatcagcaataactt

SEQ ID NO: 173476 - DNA, 15 bp, Homo sapiens
ggatcagcaataact

SEQ ID NO: 173477 - DNA, 15 bp, Homo sapiens
aggatcagcaataac

SEQ ID NO: 173478 - DNA, 15 bp, Homo sapiens
aaggatcagcaataa

SEQ ID NO: 173479 - DNA, 15 bp, Homo sapiens
taaggatcagcaata

SEQ ID NO: 173480 - DNA, 15 bp, Homo sapiens
ctaaggatcagcaat

SEQ ID NO: 173481 - DNA, 15 bp, Homo sapiens
tctaaggatcagcaa

SEQ ID NO: 173482 - DNA, 15 bp, Homo sapiens
ttctaaggatcagca

SEQ ID NO: 173483 - DNA, 15 bp, Homo sapiens
cttctaaggatcagc

SEQ ID NO: 173484 - DNA, 15 bp, Homo sapiens
gcttctaaggatcag

SEQ ID NO: 173485 - DNA, 15 bp, Homo sapiens
agcttctaaggatca

SEQ ID NO: 173486 - DNA, 15 bp, Homo sapiens
cagcttctaaggatc

SEQ ID NO: 173487 - DNA, 15 bp, Homo sapiens
acagcttctaaggat

SEQ ID NO: 173488 - DNA, 15 bp, Homo sapiens
gacagcttctaagga

SEQ ID NO: 173489 - DNA, 15 bp, Homo sapiens
agacagcttctaagg

SEQ ID NO: 173490 - DNA, 15 bp, Homo sapiens
cagacagcttctaag

SEQ ID NO: 173491 - DNA, 15 bp, Homo sapiens
acagacagcttctaa

SEQ ID NO: 173492 - DNA, 15 bp, Homo sapiens
cacagacagcttcta

SEQ ID NO: 173493 - DNA, 15 bp, Homo sapiens
gcacagacagcttct

SEQ ID NO: 173494 - DNA, 15 bp, Homo sapiens
ggcacagacagcttc

SEQ ID NO: 173495 - DNA, 15 bp, Homo sapiens
aggcacagacagctt

SEQ ID NO: 173496 - DNA, 15 bp, Homo sapiens
gaggcacagacagct

SEQ ID NO: 173497 - DNA, 15 bp, Homo sapiens
ggaggcacagacagc

SEQ ID NO: 173498 - DNA, 15 bp, Homo sapiens
aggaggcacagacag

SEQ ID NO: 173499 - DNA, 15 bp, Homo sapiens
aaggaggcacagaca

SEQ ID NO: 173500 - DNA, 15 bp, Homo sapiens
caaggaggcacagac

SEQ ID NO: 173501 - DNA, 15 bp, Homo sapiens
tcaaggaggcacaga

SEQ ID NO: 173502 - DNA, 15 bp, Homo sapiens
atcaaggaggcacag

SEQ ID NO: 173503 - DNA, 15 bp, Homo sapiens
gatcaaggaggcaca

SEQ ID NO: 173504 - DNA, 15 bp, Homo sapiens
tgatcaaggaggcac

SEQ ID NO: 173505 - DNA, 15 bp, Homo sapiens
ctgatcaaggaggca

SEQ ID NO: 173506 - DNA, 15 bp, Homo sapiens
tctgatcaaggaggc

SEQ ID NO: 173507 - DNA, 15 bp, Homo sapiens
atctgatcaaggagg

SEQ ID NO: 173508 - DNA, 15 bp, Homo sapiens
gatctgatcaaggag

SEQ ID NO: 173509 - DNA, 15 bp, Homo sapiens
ggatctgatcaagga

SEQ ID NO: 173510 - DNA, 15 bp, Homo sapiens
gggatctgatcaagg

SEQ ID NO: 173511 - DNA, 15 bp, Homo sapiens
ggggatctgatcaag

SEQ ID NO: 173512 - DNA, 15 bp, Homo sapiens
gggggatctgatcaa

SEQ ID NO: 173513 - DNA, 15 bp, Homo sapiens
agggggatctgatca

SEQ ID NO: 173514 - DNA, 15 bp, Homo sapiens
aagggggatctgatc

SEQ ID NO: 173515 - DNA, 15 bp, Homo sapiens
gaagggggatctgat

SEQ ID NO: 173516 - DNA, 15 bp, Homo sapiens
agaagggggatctga

SEQ ID NO: 173517 - DNA, 15 bp, Homo sapiens
aagaagggggatctg

SEQ ID NO: 173518 - DNA, 15 bp, Homo sapiens
gaagaagggggatct

SEQ ID NO: 173519 - DNA, 15 bp, Homo sapiens
agaagaagggggatc

SEQ ID NO: 173520 - DNA, 15 bp, Homo sapiens
gagaagaagggggat

SEQ ID NO: 173521 - DNA, 15 bp, Homo sapiens
agagaagaaggggga

SEQ ID NO: 173522 - DNA, 15 bp, Homo sapiens
gagagaagaaggggg

SEQ ID NO: 173523 - DNA, 15 bp, Homo sapiens
tgagagaagaagggg

SEQ ID NO: 173524 - DNA, 15 bp, Homo sapiens
ttgagagaagaaggg

SEQ ID NO: 173525 - DNA, 15 bp, Homo sapiens
tttgagagaagaagg

SEQ ID NO: 173526 - DNA, 15 bp, Homo sapiens
ttttgagagaagaag

SEQ ID NO: 173527 - DNA, 15 bp, Homo sapiens
tttttgagagaagaa

SEQ ID NO: 173528 - DNA, 15 bp, Homo sapiens
ctttttgagagaaga

SEQ ID NO: 173529 - DNA, 15 bp, Homo sapiens
actttttgagagaag

SEQ ID NO: 173530 - DNA, 15 bp, Homo sapiens
tactttttgagagaa

SEQ ID NO: 173531 - DNA, 15 bp, Homo sapiens
ttactttttgagaga

SEQ ID NO: 173532 - DNA, 15 bp, Homo sapiens
gttactttttgagag

SEQ ID NO: 173533 - DNA, 15 bp, Homo sapiens
ggttactttttgaga

SEQ ID NO: 173534 - DNA, 15 bp, Homo sapiens
aggttactttttgag

SEQ ID NO: 173535 - DNA, 15 bp, Homo sapiens
gaggttactttttga

SEQ ID NO: 173536 - DNA, 15 bp, Homo sapiens
agaggttactttttg

SEQ ID NO: 173537 - DNA, 15 bp, Homo sapiens
tagaggttacttttt

SEQ ID NO: 173538 - DNA, 15 bp, Homo sapiens
atagaggttactttt

SEQ ID NO: 173539 - DNA, 15 bp, Homo sapiens
aatagaggttacttt

SEQ ID NO: 173540 - DNA, 15 bp, Homo sapiens
gaatagaggttactt

SEQ ID NO: 173541 - DNA, 15 bp, Homo sapiens
agaatagaggttact

SEQ ID NO: 173542 - DNA, 15 bp, Homo sapiens
cagaatagaggttac

SEQ ID NO: 173543 - DNA, 15 bp, Homo sapiens
tcagaatagaggtta

SEQ ID NO: 173544 - DNA, 15 bp, Homo sapiens
ctcagaatagaggtt

SEQ ID NO: 173545 - DNA, 15 bp, Homo sapiens
actcagaatagaggt

SEQ ID NO: 173546 - DNA, 15 bp, Homo sapiens
gactcagaatagagg

SEQ ID NO: 173547 - DNA, 15 bp, Homo sapiens
agactcagaatagag

SEQ ID NO: 173548 - DNA, 15 bp, Homo sapiens
aagactcagaataga

SEQ ID NO: 173549 - DNA, 15 bp, Homo sapiens
caagactcagaatag

SEQ ID NO: 173550 - DNA, 15 bp, Homo sapiens
acaagactcagaata

SEQ ID NO: 173551 - DNA, 15 bp, Homo sapiens
cacaagactcagaat

SEQ ID NO: 173552 - DNA, 15 bp, Homo sapiens
tcacaagactcagaa

SEQ ID NO: 173553 - DNA, 15 bp, Homo sapiens
atcacaagactcaga

SEQ ID NO: 173554 - DNA, 15 bp, Homo sapiens
aatcacaagactcag

SEQ ID NO: 173555 - DNA, 15 bp, Homo sapiens
gaatcacaagactca

SEQ ID NO: 173556 - DNA, 15 bp, Homo sapiens
ggaatcacaagactc

SEQ ID NO: 173557 - DNA, 15 bp, Homo sapiens
tggaatcacaagact

SEQ ID NO: 173558 - DNA, 15 bp, Homo sapiens
atggaatcacaagac

SEQ ID NO: 173559 - DNA, 15 bp, Homo sapiens
catggaatcacaaga

SEQ ID NO: 173560 - DNA, 15 bp, Homo sapiens
acatggaatcacaag

SEQ ID NO: 173561 - DNA, 15 bp, Homo sapiens
gacatggaatcacaa

SEQ ID NO: 173562 - DNA, 15 bp, Homo sapiens
ggacatggaatcaca

SEQ ID NO: 173563 - DNA, 15 bp, Homo sapiens
tggacatggaatcac

SEQ ID NO: 173564 - DNA, 15 bp, Homo sapiens
ctggacatggaatca

SEQ ID NO: 173565 - DNA, 15 bp, Homo sapiens
gctggacatggaatc

SEQ ID NO: 173566 - DNA, 15 bp, Homo sapiens
tgctggacatggaat

SEQ ID NO: 173567 - DNA, 15 bp, Homo sapiens
ttgctggacatggaa

SEQ ID NO: 173568 - DNA, 15 bp, Homo sapiens
cttgctggacatgga

SEQ ID NO: 173569 - DNA, 15 bp, Homo sapiens
ccttgctggacatgg

SEQ ID NO: 173570 - DNA, 15 bp, Homo sapiens
tccttgctggacatg

SEQ ID NO: 173571 - DNA, 15 bp, Homo sapiens
ttccttgctggacat

SEQ ID NO: 173572 - DNA, 15 bp, Homo sapiens
cttccttgctggaca

SEQ ID NO: 173573 - DNA, 15 bp, Homo sapiens
gcttccttgctggac

SEQ ID NO: 173574 - DNA, 15 bp, Homo sapiens
tgcttccttgctgga

SEQ ID NO: 173575 - DNA, 15 bp, Homo sapiens
ctgcttccttgctgg

SEQ ID NO: 173576 - DNA, 15 bp, Homo sapiens
cctgcttccttgctg

SEQ ID NO: 173577 - DNA, 15 bp, Homo sapiens
ccctgcttccttgct

SEQ ID NO: 173578 - DNA, 15 bp, Homo sapiens
tccctgcttccttgc

SEQ ID NO: 173579 - DNA, 15 bp, Homo sapiens
atccctgcttccttg

SEQ ID NO: 173580 - DNA, 15 bp, Homo sapiens
catccctgcttcctt

SEQ ID NO: 173581 - DNA, 15 bp, Homo sapiens
acatccctgcttcct

SEQ ID NO: 173582 - DNA, 15 bp, Homo sapiens
aacatccctgcttcc

SEQ ID NO: 173583 - DNA, 15 bp, Homo sapiens
caacatccctgcttc

SEQ ID NO: 173584 - DNA, 15 bp, Homo sapiens
gcaacatccctgctt

SEQ ID NO: 173585 - DNA, 15 bp, Homo sapiens
tgcaacatccctgct

SEQ ID NO: 173586 - DNA, 15 bp, Homo sapiens
atgcaacatccctgc

SEQ ID NO: 173587 - DNA, 15 bp, Homo sapiens
gatgcaacatccctg

SEQ ID NO: 173588 - DNA, 15 bp, Homo sapiens
ggatgcaacatccct

SEQ ID NO: 173589 - DNA, 15 bp, Homo sapiens
aggatgcaacatccc

SEQ ID NO: 173590 - DNA, 15 bp, Homo sapiens
taggatgcaacatcc

SEQ ID NO: 173591 - DNA, 15 bp, Homo sapiens
ttaggatgcaacatc

SEQ ID NO: 173592 - DNA, 15 bp, Homo sapiens
tttaggatgcaacat

SEQ ID NO: 173593 - DNA, 15 bp, Homo sapiens
atttaggatgcaaca

SEQ ID NO: 173594 - DNA, 15 bp, Homo sapiens
catttaggatgcaac

SEQ ID NO: 173595 - DNA, 15 bp, Homo sapiens
gcatttaggatgcaa

SEQ ID NO: 173596 - DNA, 15 bp, Homo sapiens
ggcatttaggatgca

SEQ ID NO: 173597 - DNA, 15 bp, Homo sapiens
aggcatttaggatgc

SEQ ID NO: 173598 - DNA, 15 bp, Homo sapiens
taggcatttaggatg

SEQ ID NO: 173599 - DNA, 15 bp, Homo sapiens
ttaggcatttaggat

SEQ ID NO: 173600 - DNA, 15 bp, Homo sapiens
cttaggcatttagga

SEQ ID NO: 173601 - DNA, 15 bp, Homo sapiens
acttaggcatttagg

SEQ ID NO: 173602 - DNA, 15 bp, Homo sapiens
cacttaggcatttag

SEQ ID NO: 173603 - DNA, 15 bp, Homo sapiens
acacttaggcattta

SEQ ID NO: 173604 - DNA, 15 bp, Homo sapiens
aacacttaggcattt

SEQ ID NO: 173605 - DNA, 15 bp, Homo sapiens
aaacacttaggcatt

SEQ ID NO: 173606 - DNA, 15 bp, Homo sapiens
gacttaaacacttag

SEQ ID NO: 173607 - DNA, 15 bp, Homo sapiens
agacttaaacactta

SEQ ID NO: 173608 - DNA, 15 bp, Homo sapiens
tagacttaaacactt

SEQ ID NO: 173609 - DNA, 15 bp, Homo sapiens
ctagacttaaacact

SEQ ID NO: 173610 - DNA, 15 bp, Homo sapiens
tctagacttaaacac

SEQ ID NO: 173611 - DNA, 15 bp, Homo sapiens
ctctagacttaaaca

SEQ ID NO: 173612 - DNA, 15 bp, Homo sapiens
tctctagacttaaac

SEQ ID NO: 173613 - DNA, 15 bp, Homo sapiens
gtctctagacttaaa

SEQ ID NO: 173614 - DNA, 15 bp, Homo sapiens
agtctctagacttaa

SEQ ID NO: 173615 - DNA, 15 bp, Homo sapiens
tagtctctagactta

SEQ ID NO: 173616 - DNA, 15 bp, Homo sapiens
ttagtctctagactt

SEQ ID NO: 173617 - DNA, 15 bp, Homo sapiens
attagtctctagact

SEQ ID NO: 173618 - DNA, 15 bp, Homo sapiens
aattagtctctagac

SEQ ID NO: 173619 - DNA, 15 bp, Homo sapiens
gaattagtctctaga

SEQ ID NO: 173620 - DNA, 15 bp, Homo sapiens
ggaattagtctctag

SEQ ID NO: 173621 - DNA, 15 bp, Homo sapiens
aggaattagtctcta

SEQ ID NO: 173622 - DNA, 15 bp, Homo sapiens
aaggaattagtctct

SEQ ID NO: 173623 - DNA, 15 bp, Homo sapiens
aaaggaattagtctc

SEQ ID NO: 173624 - DNA, 15 bp, Homo sapiens
taaaggaattagtct

SEQ ID NO: 173625 - DNA, 15 bp, Homo sapiens
ttaaaggaattagtc

SEQ ID NO: 173626 - DNA, 15 bp, Homo sapiens
cttaaaggaattagt

SEQ ID NO: 173627 - DNA, 15 bp, Homo sapiens
gcttaaaggaattag

SEQ ID NO: 173628 - DNA, 15 bp, Homo sapiens
tgcttaaaggaatta

SEQ ID NO: 173629 - DNA, 15 bp, Homo sapiens
atgcttaaaggaatt

SEQ ID NO: 173630 - DNA, 15 bp, Homo sapiens
aatgcttaaaggaat

SEQ ID NO: 173631 - DNA, 15 bp, Homo sapiens
caatgcttaaaggaa

SEQ ID NO: 173632 - DNA, 15 bp, Homo sapiens
acaatgcttaaagga

SEQ ID NO: 173633 - DNA, 15 bp, Homo sapiens
aacaatgcttaaagg

SEQ ID NO: 173634 - DNA, 15 bp, Homo sapiens
caacaatgcttaaag

SEQ ID NO: 173635 - DNA, 15 bp, Homo sapiens
ccaacaatgcttaaa

SEQ ID NO: 173636 - DNA, 15 bp, Homo sapiens
tccaacaatgcttaa

SEQ ID NO: 173637 - DNA, 15 bp, Homo sapiens
atccaacaatgctta

SEQ ID NO: 173638 - DNA, 15 bp, Homo sapiens
aatccaacaatgctt

SEQ ID NO: 173639 - DNA, 15 bp, Homo sapiens
caatccaacaatgct

SEQ ID NO: 173640 - DNA, 15 bp, Homo sapiens
acaatccaacaatgc

SEQ ID NO: 173641 - DNA, 15 bp, Homo sapiens
aacaatccaacaatg

SEQ ID NO: 173642 - DNA, 15 bp, Homo sapiens
gaacaatccaacaat

SEQ ID NO: 173643 - DNA, 15 bp, Homo sapiens
ggaacaatccaacaa

SEQ ID NO: 173644 - DNA, 15 bp, Homo sapiens
aggaacaatccaaca

SEQ ID NO: 173645 - DNA, 15 bp, Homo sapiens
caggaacaatccaac

SEQ ID NO: 173646 - DNA, 15 bp, Homo sapiens
ccaggaacaatccaa

SEQ ID NO: 173647 - DNA, 15 bp, Homo sapiens
accaggaacaatcca

SEQ ID NO: 173648 - DNA, 15 bp, Homo sapiens
caccaggaacaatcc

SEQ ID NO: 173649 - DNA, 15 bp, Homo sapiens
gcaccaggaacaatc

SEQ ID NO: 173650 - DNA, 15 bp, Homo sapiens
agcaccaggaacaat

SEQ ID NO: 173651 - DNA, 15 bp, Homo sapiens
aagcaccaggaacaa

SEQ ID NO: 173652 - DNA, 15 bp, Homo sapiens
aaagcaccaggaaca

SEQ ID NO: 173653 - DNA, 15 bp, Homo sapiens
aaaagcaccaggaac

SEQ ID NO: 173654 - DNA, 15 bp, Homo sapiens
caaaagcaccaggaa

SEQ ID NO: 173655 - DNA, 15 bp, Homo sapiens
tcaaaagcaccagga

SEQ ID NO: 173656 - DNA, 15 bp, Homo sapiens
ttcaaaagcaccagg

SEQ ID NO: 173657 - DNA, 15 bp, Homo sapiens
gttcaaaagcaccag

SEQ ID NO: 173658 - DNA, 15 bp, Homo sapiens
agttcaaaagcacca

SEQ ID NO: 173659 - DNA, 15 bp, Homo sapiens
gagttcaaaagcacc

SEQ ID NO: 173660 - DNA, 15 bp, Homo sapiens
ggagttcaaaagcac

SEQ ID NO: 173661 - DNA, 15 bp, Homo sapiens
tggagttcaaaagca

SEQ ID NO: 173662 - DNA, 15 bp, Homo sapiens
ttggagttcaaaagc

SEQ ID NO: 173663 - DNA, 15 bp, Homo sapiens
attggagttcaaaag

SEQ ID NO: 173664 - DNA, 15 bp, Homo sapiens
cattggagttcaaaa

SEQ ID NO: 173665 - DNA, 15 bp, Homo sapiens
acattggagttcaaa

SEQ ID NO: 173666 - DNA, 15 bp, Homo sapiens
tacattggagttcaa

SEQ ID NO: 173667 - DNA, 15 bp, Homo sapiens
ctacattggagttca

SEQ ID NO: 173668 - DNA, 15 bp, Homo sapiens
tctacattggagttc

SEQ ID NO: 173669 - DNA, 15 bp, Homo sapiens
atctacattggagtt

SEQ ID NO: 173670 - DNA, 15 bp, Homo sapiens
catctacattggagt

SEQ ID NO: 173671 - DNA, 15 bp, Homo sapiens
acatctacattggag

SEQ ID NO: 173672 - DNA, 15 bp, Homo sapiens
aacatctacattgga

SEQ ID NO: 173673 - DNA, 15 bp, Homo sapiens
caacatctacattgg

SEQ ID NO: 173674 - DNA, 15 bp, Homo sapiens
acaacatctacattg

SEQ ID NO: 173675 - DNA, 15 bp, Homo sapiens
gacaacatctacatt

SEQ ID NO: 173676 - DNA, 15 bp, Homo sapiens
tgacaacatctacat

SEQ ID NO: 173677 - DNA, 15 bp, Homo sapiens
atgacaacatctaca

SEQ ID NO: 173678 - DNA, 15 bp, Homo sapiens
catgacaacatctac

SEQ ID NO: 173679 - DNA, 15 bp, Homo sapiens
acatgacaacatcta

SEQ ID NO: 173680 - DNA, 15 bp, Homo sapiens
tacatgacaacatct

SEQ ID NO: 173681 - DNA, 15 bp, Homo sapiens
ttacatgacaacatc

SEQ ID NO: 173682 - DNA, 15 bp, Homo sapiens
attacatgacaacat

SEQ ID NO: 173683 - DNA, 15 bp, Homo sapiens
gattacatgacaaca

SEQ ID NO: 173684 - DNA, 15 bp, Homo sapiens
tgattacatgacaac

SEQ ID NO: 173685 - DNA, 15 bp, Homo sapiens
gtgattacatgacaa

SEQ ID NO: 173686 - DNA, 15 bp, Homo sapiens
agtgattacatgaca

SEQ ID NO: 173687 - DNA, 15 bp, Homo sapiens
cagtgattacatgac

SEQ ID NO: 173688 - DNA, 15 bp, Homo sapiens
acagtgattacatga

SEQ ID NO: 173689 - DNA, 15 bp, Homo sapiens
cacagtgattacatg

SEQ ID NO: 173690 - DNA, 15 bp, Homo sapiens
gcacagtgattacat

SEQ ID NO: 173691 - DNA, 15 bp, Homo sapiens
agcacagtgattaca

SEQ ID NO: 173692 - DNA, 15 bp, Homo sapiens
gagcacagtgattac

SEQ ID NO: 173693 - DNA, 15 bp, Homo sapiens
ggagcacagtgatta

SEQ ID NO: 173694 - DNA, 15 bp, Homo sapiens
aggagcacagtgatt

SEQ ID NO: 173695 - DNA, 15 bp, Homo sapiens
gaggagcacagtgat

SEQ ID NO: 173696 - DNA, 15 bp, Homo sapiens
tgaggagcacagtga

SEQ ID NO: 173697 - DNA, 15 bp, Homo sapiens
atgaggagcacagtg

SEQ ID NO: 173698 - DNA, 15 bp, Homo sapiens
gatgaggagcacagt

SEQ ID NO: 173699 - DNA, 15 bp, Homo sapiens
agatgaggagcacag

SEQ ID NO: 173700 - DNA, 15 bp, Homo sapiens
cagatgaggagcaca

SEQ ID NO: 173701 - DNA, 15 bp, Homo sapiens
tcagatgaggagcac

SEQ ID NO: 173702 - DNA, 15 bp, Homo sapiens
ctcagatgaggagca

SEQ ID NO: 173703 - DNA, 15 bp, Homo sapiens
gctcagatgaggagc

SEQ ID NO: 173704 - DNA, 15 bp, Homo sapiens
agctcagatgaggag

SEQ ID NO: 173705 - DNA, 15 bp, Homo sapiens
cagctcagatgagga

SEQ ID NO: 173706 - DNA, 15 bp, Homo sapiens
tcagctcagatgagg

SEQ ID NO: 173707 - DNA, 15 bp, Homo sapiens
ttcagctcagatgag

SEQ ID NO: 173708 - DNA, 15 bp, Homo sapiens
tttcagctcagatga

SEQ ID NO: 173709 - DNA, 15 bp, Homo sapiens
gtttcagctcagatg

SEQ ID NO: 173710 - DNA, 15 bp, Homo sapiens
agtttcagctcagat

SEQ ID NO: 173711 - DNA, 15 bp, Homo sapiens
aagtttcagctcaga

SEQ ID NO: 173712 - DNA, 15 bp, Homo sapiens
aaagtttcagctcag

SEQ ID NO: 173713 - DNA, 15 bp, Homo sapiens
caaagtttcagctca

SEQ ID NO: 173714 - DNA, 15 bp, Homo sapiens
gcaaagtttcagctc

SEQ ID NO: 173715 - DNA, 15 bp, Homo sapiens
agcaaagtttcagct

SEQ ID NO: 173716 - DNA, 15 bp, Homo sapiens
aagcaaagtttcagc

SEQ ID NO: 173717 - DNA, 15 bp, Homo sapiens
gaagcaaagtttcag

SEQ ID NO: 173718 - DNA, 15 bp, Homo sapiens
agaagcaaagtttca

SEQ ID NO: 173719 - DNA, 15 bp, Homo sapiens
cagaagcaaagtttc

SEQ ID NO: 173720 - DNA, 15 bp, Homo sapiens
gcagaagcaaagttt

SEQ ID NO: 173721 - DNA, 15 bp, Homo sapiens
agcagaagcaaagtt

SEQ ID NO: 173722 - DNA, 15 bp, Homo sapiens
aagcagaagcaaagt

SEQ ID NO: 173723 - DNA, 15 bp, Homo sapiens
aaagcagaagcaaag

SEQ ID NO: 173724 - DNA, 15 bp, Homo sapiens
taaagcagaagcaaa

SEQ ID NO: 173725 - DNA, 15 bp, Homo sapiens
ctaaagcagaagcaa

SEQ ID NO: 173726 - DNA, 15 bp, Homo sapiens
gctaaagcagaagca

SEQ ID NO: 173727 - DNA, 15 bp, Homo sapiens
ggctaaagcagaagc

SEQ ID NO: 173728 - DNA, 15 bp, Homo sapiens
tggctaaagcagaag

SEQ ID NO: 173729 - DNA, 15 bp, Homo sapiens
atggctaaagcagaa

SEQ ID NO: 173730 - DNA, 15 bp, Homo sapiens
catggctaaagcaga

SEQ ID NO: 173731 - DNA, 15 bp, Homo sapiens
ccatggctaaagcag

SEQ ID NO: 173732 - DNA, 15 bp, Homo sapiens
gccatggctaaagca

SEQ ID NO: 173733 - DNA, 15 bp, Homo sapiens
tgccatggctaaagc

SEQ ID NO: 173734 - DNA, 15 bp, Homo sapiens
atgccatggctaaag

SEQ ID NO: 173735 - DNA, 15 bp, Homo sapiens
catgccatggctaaa

SEQ ID NO: 173736 - DNA, 15 bp, Homo sapiens
tcatgccatggctaa

SEQ ID NO: 173737 - DNA, 15 bp, Homo sapiens
atcatgccatggcta

SEQ ID NO: 173738 - DNA, 15 bp, Homo sapiens
aatcatgccatggct

SEQ ID NO: 173739 - DNA, 15 bp, Homo sapiens
aaatcatgccatggc

SEQ ID NO: 173740 - DNA, 15 bp, Homo sapiens
taaatcatgccatgg

SEQ ID NO: 173741 - DNA, 15 bp, Homo sapiens
ctaaatcatgccatg

SEQ ID NO: 173742 - DNA, 15 bp, Homo sapiens
tctaaatcatgccat

SEQ ID NO: 173743 - DNA, 15 bp, Homo sapiens
atctaaatcatgcca

SEQ ID NO: 173744 - DNA, 15 bp, Homo sapiens
tatctaaatcatgcc

SEQ ID NO: 173745 - DNA, 15 bp, Homo sapiens
atatctaaatcatgc

SEQ ID NO: 173746 - DNA, 15 bp, Homo sapiens
catatctaaatcatg

SEQ ID NO: 173747 - DNA, 15 bp, Homo sapiens
acatatctaaatcat

SEQ ID NO: 173748 - DNA, 15 bp, Homo sapiens
cacatatctaaatca

SEQ ID NO: 173749 - DNA, 15 bp, Homo sapiens
tcacatatctaaatc

SEQ ID NO: 173750 - DNA, 15 bp, Homo sapiens
ttcacatatctaaat

SEQ ID NO: 173751 - DNA, 15 bp, Homo sapiens
tttcacatatctaaa

SEQ ID NO: 173752 - DNA, 15 bp, Homo sapiens
ctttcacatatctaa

SEQ ID NO: 173753 - DNA, 15 bp, Homo sapiens
tctttcacatatcta

SEQ ID NO: 173754 - DNA, 15 bp, Homo sapiens
atctttcacatatct

SEQ ID NO: 173755 - DNA, 15 bp, Homo sapiens
tatctttcacatatc

SEQ ID NO: 173756 - DNA, 15 bp, Homo sapiens
ttatctttcacatat

SEQ ID NO: 173757 - DNA, 15 bp, Homo sapiens
attatctttcacata

SEQ ID NO: 173758 - DNA, 15 bp, Homo sapiens
aattatctttcacat

SEQ ID NO: 173759 - DNA, 15 bp, Homo sapiens
gaattatctttcaca

SEQ ID NO: 173760 - DNA, 15 bp, Homo sapiens
ggaattatctttcac

SEQ ID NO: 173761 - DNA, 15 bp, Homo sapiens
tggaattatctttca

SEQ ID NO: 173762 - DNA, 15 bp, Homo sapiens
atggaattatctttc

SEQ ID NO: 173763 - DNA, 15 bp, Homo sapiens
gatggaattatcttt

SEQ ID NO: 173764 - DNA, 15 bp, Homo sapiens
agatggaattatctt

SEQ ID NO: 173765 - DNA, 15 bp, Homo sapiens
gagatggaattatct

SEQ ID NO: 173766 - DNA, 15 bp, Homo sapiens
ggagatggaattatc

SEQ ID NO: 173767 - DNA, 15 bp, Homo sapiens
aggagatggaattat

SEQ ID NO: 173768 - DNA, 15 bp, Homo sapiens
aaggagatggaatta

SEQ ID NO: 173769 - DNA, 15 bp, Homo sapiens
aaaggagatggaatt

SEQ ID NO: 173770 - DNA, 15 bp, Homo sapiens
caaaggagatggaat

SEQ ID NO: 173771 - DNA, 15 bp, Homo sapiens
acaaaggagatggaa

SEQ ID NO: 173772 - DNA, 15 bp, Homo sapiens
tacaaaggagatgga

SEQ ID NO: 173773 - DNA, 15 bp, Homo sapiens
ttacaaaggagatgg

SEQ ID NO: 173774 - DNA, 15 bp, Homo sapiens
attacaaaggagatg

SEQ ID NO: 173775 - DNA, 15 bp, Homo sapiens
aattacaaaggagat

SEQ ID NO: 173776 - DNA, 15 bp, Homo sapiens
aaattacaaaggaga

SEQ ID NO: 173777 - DNA, 15 bp, Homo sapiens
taaattacaaaggag

SEQ ID NO: 173778 - DNA, 15 bp, Homo sapiens
ttaaattacaaagga

SEQ ID NO: 173779 - DNA, 15 bp, Homo sapiens
attaaattacaaagg

SEQ ID NO: 173780 - DNA, 15 bp, Homo sapiens
aattaaattacaaag

SEQ ID NO: 173781 - DNA, 15 bp, Homo sapiens
aaattaaattacaaa

SEQ ID NO: 173782 - DNA, 15 bp, Homo sapiens
taaattaaattacaa

SEQ ID NO: 173783 - DNA, 15 bp, Homo sapiens
ataaattaaattaca

SEQ ID NO: 173784 - DNA, 15 bp, Homo sapiens
aataaattaaattac

SEQ ID NO: 173785 - DNA, 15 bp, Homo sapiens
aaataaattaaatta

SEQ ID NO: 173786 - DNA, 15 bp, Homo sapiens
caaataaattaaatt

SEQ ID NO: 173787 - DNA, 15 bp, Homo sapiens
acaaataaattaaat

SEQ ID NO: 173788 - DNA, 15 bp, Homo sapiens
cacaaataaattaaa

SEQ ID NO: 173789 - DNA, 15 bp, Homo sapiens
acacaaataaattaa

SEQ ID NO: 173790 - DNA, 15 bp, Homo sapiens
gacacaaataaatta

SEQ ID NO: 173791 - DNA, 15 bp, Homo sapiens
tgacacaaataaatt

SEQ ID NO: 173792 - DNA, 15 bp, Homo sapiens
atgacacaaataaat

SEQ ID NO: 173793 - DNA, 15 bp, Homo sapiens
aatgacacaaataaa

SEQ ID NO: 173794 - DNA, 15 bp, Homo sapiens
aaatgacacaaataa

SEQ ID NO: 173795 - DNA, 15 bp, Homo sapiens
aaaatgacacaaata

SEQ ID NO: 173796 - DNA, 15 bp, Homo sapiens
taaaatgacacaaat

SEQ ID NO: 173797 - DNA, 15 bp, Homo sapiens
ctaaaatgacacaaa

SEQ ID NO: 173798 - DNA, 15 bp, Homo sapiens
cctaaaatgacacaa

SEQ ID NO: 173799 - DNA, 15 bp, Homo sapiens
gcctaaaatgacaca

SEQ ID NO: 173800 - DNA, 15 bp, Homo sapiens
tgcctaaaatgacac

SEQ ID NO: 173801 - DNA, 15 bp, Homo sapiens
atgcctaaaatgaca

SEQ ID NO: 173802 - DNA, 15 bp, Homo sapiens
tatgcctaaaatgac

SEQ ID NO: 173803 - DNA, 15 bp, Homo sapiens
atatgcctaaaatga

SEQ ID NO: 173804 - DNA, 15 bp, Homo sapiens
aatatgcctaaaatg

SEQ ID NO: 173805 - DNA, 15 bp, Homo sapiens
caatatgcctaaaat

SEQ ID NO: 173806 - DNA, 15 bp, Homo sapiens
gcaatatgcctaaaa

SEQ ID NO: 173807 - DNA, 15 bp, Homo sapiens
tgcaatatgcctaaa

SEQ ID NO: 173808 - DNA, 15 bp, Homo sapiens
atgcaatatgcctaa

SEQ ID NO: 173809 - DNA, 15 bp, Homo sapiens
tatgcaatatgccta

SEQ ID NO: 173810 - DNA, 15 bp, Homo sapiens
gtatgcaatatgcct

SEQ ID NO: 173811 - DNA, 15 bp, Homo sapiens
ggtatgcaatatgcc

SEQ ID NO: 173812 - DNA, 15 bp, Homo sapiens
aggtatgcaatatgc

SEQ ID NO: 173813 - DNA, 15 bp, Homo sapiens
caggtatgcaatatg

SEQ ID NO: 173814 - DNA, 15 bp, Homo sapiens
gcaggtatgcaatat

SEQ ID NO: 173815 - DNA, 15 bp, Homo sapiens
agcaggtatgcaata

SEQ ID NO: 173816 - DNA, 15 bp, Homo sapiens
tagcaggtatgcaat

SEQ ID NO: 173817 - DNA, 15 bp, Homo sapiens
ttagcaggtatgcaa

SEQ ID NO: 173818 - DNA, 15 bp, Homo sapiens
attagcaggtatgca

SEQ ID NO: 173819 - DNA, 15 bp, Homo sapiens
cattagcaggtatgc

SEQ ID NO: 173820 - DNA, 15 bp, Homo sapiens
acattagcaggtatg

SEQ ID NO: 173821 - DNA, 15 bp, Homo sapiens
tacattagcaggtat

SEQ ID NO: 173822 - DNA, 15 bp, Homo sapiens
ctacattagcaggta

SEQ ID NO: 173823 - DNA, 15 bp, Homo sapiens
tctacattagcaggt

SEQ ID NO: 173824 - DNA, 15 bp, Homo sapiens
ttctacattagcagg

SEQ ID NO: 173825 - DNA, 15 bp, Homo sapiens
attctacattagcag

SEQ ID NO: 173826 - DNA, 15 bp, Homo sapiens
cattctacattagca

SEQ ID NO: 173827 - DNA, 15 bp, Homo sapiens
ccattctacattagc

SEQ ID NO: 173828 - DNA, 15 bp, Homo sapiens
tccattctacattag

SEQ ID NO: 173829 - DNA, 15 bp, Homo sapiens
ctccattctacatta

SEQ ID NO: 173830 - DNA, 15 bp, Homo sapiens
tctccattctacatt

SEQ ID NO: 173831 - DNA, 15 bp, Homo sapiens
atctccattctacat

SEQ ID NO: 173832 - DNA, 15 bp, Homo sapiens
gatctccattctaca

SEQ ID NO: 173833 - DNA, 15 bp, Homo sapiens
agatctccattctac

SEQ ID NO: 173834 - DNA, 15 bp, Homo sapiens
tagatctccattcta

SEQ ID NO: 173835 - DNA, 15 bp, Homo sapiens
ctagatctccattct

SEQ ID NO: 173836 - DNA, 15 bp, Homo sapiens
tctagatctccattc

SEQ ID NO: 173837 - DNA, 15 bp, Homo sapiens
ttctagatctccatt

SEQ ID NO: 173838 - DNA, 15 bp, Homo sapiens
attctagatctccat

SEQ ID NO: 173839 - DNA, 15 bp, Homo sapiens
tattctagatctcca

SEQ ID NO: 173840 - DNA, 15 bp, Homo sapiens
atattctagatctcc

SEQ ID NO: 173841 - DNA, 15 bp, Homo sapiens
catattctagatctc

SEQ ID NO: 173842 - DNA, 15 bp, Homo sapiens
ccatattctagatct

SEQ ID NO: 173843 - DNA, 15 bp, Homo sapiens
tccatattctagatc

SEQ ID NO: 173844 - DNA, 15 bp, Homo sapiens
ttccatattctagat

SEQ ID NO: 173845 - DNA, 15 bp, Homo sapiens
cttccatattctaga

SEQ ID NO: 173846 - DNA, 15 bp, Homo sapiens
tcttccatattctag

SEQ ID NO: 173847 - DNA, 15 bp, Homo sapiens
gtcttccatattcta

SEQ ID NO: 173848 - DNA, 15 bp, Homo sapiens
tgtcttccatattct

SEQ ID NO: 173849 - DNA, 15 bp, Homo sapiens
ctgtcttccatattc

SEQ ID NO: 173850 - DNA, 15 bp, Homo sapiens
actgtcttccatatt

SEQ ID NO: 173851 - DNA, 15 bp, Homo sapiens
aactgtcttccatat

SEQ ID NO: 173852 - DNA, 15 bp, Homo sapiens
aaactgtcttccata

SEQ ID NO: 173853 - DNA, 15 bp, Homo sapiens
taaactgtcttccat

SEQ ID NO: 173854 - DNA, 15 bp, Homo sapiens
ttaaactgtcttcca

SEQ ID NO: 173855 - DNA, 15 bp, Homo sapiens
tttaaactgtcttcc

SEQ ID NO: 173856 - DNA, 15 bp, Homo sapiens
ttttaaactgtcttc

SEQ ID NO: 173857 - DNA, 15 bp, Homo sapiens
gttttaaactgtctt

SEQ ID NO: 173858 - DNA, 15 bp, Homo sapiens
tgttttaaactgtct

SEQ ID NO: 173859 - DNA, 15 bp, Homo sapiens
atgttttaaactgtc

SEQ ID NO: 173860 - DNA, 15 bp, Homo sapiens
aatgttttaaactgt

SEQ ID NO: 173861 - DNA, 15 bp, Homo sapiens
aaatgttttaaactg

SEQ ID NO: 173862 - DNA, 15 bp, Homo sapiens
aaaatgttttaaact

SEQ ID NO: 173863 - DNA, 15 bp, Homo sapiens
taaaatgttttaaac

SEQ ID NO: 173864 - DNA, 15 bp, Homo sapiens
ttaaaatgttttaaa

SEQ ID NO: 173865 - DNA, 15 bp, Homo sapiens
tttaaaatgttttaa

SEQ ID NO: 173866 - DNA, 15 bp, Homo sapiens
ctttaaaatgtttta

SEQ ID NO: 173867 - DNA, 15 bp, Homo sapiens
gctttaaaatgtttt

SEQ ID NO: 173868 - DNA, 15 bp, Homo sapiens
tgctttaaaatgttt

SEQ ID NO: 173869 - DNA, 15 bp, Homo sapiens
atgctttaaaatgtt

SEQ ID NO: 173870 - DNA, 15 bp, Homo sapiens
aatgctttaaaatgt

SEQ ID NO: 173871 - DNA, 15 bp, Homo sapiens
gaatgctttaaaatg

SEQ ID NO: 173872 - DNA, 15 bp, Homo sapiens
tgaatgctttaaaat

SEQ ID NO: 173873 - DNA, 15 bp, Homo sapiens
ttgaatgctttaaaa

SEQ ID NO: 173874 - DNA, 15 bp, Homo sapiens
tttgaatgctttaaa

SEQ ID NO: 173875 - DNA, 15 bp, Homo sapiens
atttgaatgctttaa

SEQ ID NO: 173876 - DNA, 15 bp, Homo sapiens
catttgaatgcttta

SEQ ID NO: 173877 - DNA, 15 bp, Homo sapiens
acatttgaatgcttt

SEQ ID NO: 173878 - DNA, 15 bp, Homo sapiens
cacatttgaatgctt

SEQ ID NO: 173879 - DNA, 15 bp, Homo sapiens
ccacatttgaatgct

SEQ ID NO: 173880 - DNA, 15 bp, Homo sapiens
gccacatttgaatgc

SEQ ID NO: 173881 - DNA, 15 bp, Homo sapiens
tgccacatttgaatg

SEQ ID NO: 173882 - DNA, 15 bp, Homo sapiens
atgccacatttgaat

SEQ ID NO: 173883 - DNA, 15 bp, Homo sapiens
aatgccacatttgaa

SEQ ID NO: 173884 - DNA, 15 bp, Homo sapiens
gaatgccacatttga

SEQ ID NO: 173885 - DNA, 15 bp, Homo sapiens
agaatgccacatttg

SEQ ID NO: 173886 - DNA, 15 bp, Homo sapiens
cagaatgccacattt

SEQ ID NO: 173887 - DNA, 15 bp, Homo sapiens
ccagaatgccacatt

SEQ ID NO: 173888 - DNA, 15 bp, Homo sapiens
gccagaatgccacat

SEQ ID NO: 173889 - DNA, 15 bp, Homo sapiens
ggccagaatgccaca

SEQ ID NO: 173890 - DNA, 15 bp, Homo sapiens
cggccagaatgccac

SEQ ID NO: 173891 - DNA, 15 bp, Homo sapiens
ccggccagaatgcca

SEQ ID NO: 173892 - DNA, 15 bp, Homo sapiens
cccggccagaatgcc

SEQ ID NO: 173893 - DNA, 15 bp, Homo sapiens
gcccggccagaatgc

SEQ ID NO: 173894 - DNA, 15 bp, Homo sapiens
cgcccggccagaatg

SEQ ID NO: 173895 - DNA, 15 bp, Homo sapiens
acgcccggccagaat

SEQ ID NO: 173896 - DNA, 15 bp, Homo sapiens
tacgcccggccagaa

SEQ ID NO: 173897 - DNA, 15 bp, Homo sapiens
ctacgcccggccaga

SEQ ID NO: 173898 - DNA, 15 bp, Homo sapiens
actacgcccggccag

SEQ ID NO: 173899 - DNA, 15 bp, Homo sapiens
cactacgcccggcca

SEQ ID NO: 173900 - DNA, 15 bp, Homo sapiens
ccactacgcccggcc

SEQ ID NO: 173901 - DNA, 15 bp, Homo sapiens
gccactacgcccggc

SEQ ID NO: 173902 - DNA, 15 bp, Homo sapiens
agccactacgcccgg

SEQ ID NO: 173903 - DNA, 15 bp, Homo sapiens
gagccactacgcccg

SEQ ID NO: 173904 - DNA, 15 bp, Homo sapiens
tgagccactacgccc

SEQ ID NO: 173905 - DNA, 15 bp, Homo sapiens
gtgagccactacgcc

SEQ ID NO: 173906 - DNA, 15 bp, Homo sapiens
cgtgagccactacgc

SEQ ID NO: 173907 - DNA, 15 bp, Homo sapiens
gcgtgagccactacg

SEQ ID NO: 173908 - DNA, 15 bp, Homo sapiens
ggcgtgagccactac

SEQ ID NO: 173909 - DNA, 15 bp, Homo sapiens
aggcgtgagccacta

SEQ ID NO: 173910 - DNA, 15 bp, Homo sapiens
cgcctgcttcagcct

SEQ ID NO: 173911 - DNA, 15 bp, Homo sapiens
ccgcctgcttcagcc

SEQ ID NO: 173912 - DNA, 15 bp, Homo sapiens
tccgcctgcttcagc

SEQ ID NO: 173913 - DNA, 15 bp, Homo sapiens
atccgcctgcttcag

SEQ ID NO: 173914 - DNA, 15 bp, Homo sapiens
gatccgcctgcttca

SEQ ID NO: 173915 - DNA, 15 bp, Homo sapiens
tgatccgcctgcttc

SEQ ID NO: 173916 - DNA, 15 bp, Homo sapiens
atgatccgcctgctt

SEQ ID NO: 173917 - DNA, 15 bp, Homo sapiens
catgatccgcctgct

SEQ ID NO: 173918 - DNA, 15 bp, Homo sapiens
tcatgatccgcctgc

SEQ ID NO: 173919 - DNA, 15 bp, Homo sapiens
ctcatgatccgcctg

SEQ ID NO: 173920 - DNA, 15 bp, Homo sapiens
cctcatgatccgcct

SEQ ID NO: 173921 - DNA, 15 bp, Homo sapiens
ggtctcaatctcctg

SEQ ID NO: 173922 - DNA, 15 bp, Homo sapiens
tggtctcaatctcct

SEQ ID NO: 173923 - DNA, 15 bp, Homo sapiens
atggtctcaatctcc

SEQ ID NO: 173924 - DNA, 15 bp, Homo sapiens
gatggtctcaatctc

SEQ ID NO: 173925 - DNA, 15 bp, Homo sapiens
ggatggtctcaatct

SEQ ID NO: 173926 - DNA, 15 bp, Homo sapiens
aggatggtctcaatc

SEQ ID NO: 173927 - DNA, 15 bp, Homo sapiens
accaccacgcctggc

SEQ ID NO: 173928 - DNA, 15 bp, Homo sapiens
caccaccacgcctgg

SEQ ID NO: 173929 - DNA, 15 bp, Homo sapiens
ccaccaccacgcctg

SEQ ID NO: 173930 - DNA, 15 bp, Homo sapiens
cccaccaccacgcct

SEQ ID NO: 173931 - DNA, 15 bp, Homo sapiens
acccaccaccacgcc

SEQ ID NO: 173932 - DNA, 15 bp, Homo sapiens
cacccaccaccacgc

SEQ ID NO: 173933 - DNA, 15 bp, Homo sapiens
gcacccaccaccacg

SEQ ID NO: 173934 - DNA, 15 bp, Homo sapiens
ctacaggcacccacc

SEQ ID NO: 173935 - DNA, 15 bp, Homo sapiens
actacaggcacccac

SEQ ID NO: 173936 - DNA, 15 bp, Homo sapiens
gactacaggcaccca

SEQ ID NO: 173937 - DNA, 15 bp, Homo sapiens
ggactacaggcaccc

SEQ ID NO: 173938 - DNA, 15 bp, Homo sapiens
tgggactacaggcac

SEQ ID NO: 173939 - DNA, 15 bp, Homo sapiens
tgccattctcctgcc

SEQ ID NO: 173940 - DNA, 15 bp, Homo sapiens
agatctcggctcact

SEQ ID NO: 173941 - DNA, 15 bp, Homo sapiens
gagatctcggctcac

SEQ ID NO: 173942 - DNA, 15 bp, Homo sapiens
cgagatctcggctca

SEQ ID NO: 173943 - DNA, 15 bp, Homo sapiens
gcgagatctcggctc

SEQ ID NO: 173944 - DNA, 15 bp, Homo sapiens
ggcgagatctcggct

SEQ ID NO: 173945 - DNA, 15 bp, Homo sapiens
tggcgagatctcggc

SEQ ID NO: 173946 - DNA, 15 bp, Homo sapiens
gtggcgagatctcgg

SEQ ID NO: 173947 - DNA, 15 bp, Homo sapiens
agtggcgagatctcg

SEQ ID NO: 173948 - DNA, 15 bp, Homo sapiens
cagtggcgagatctc

SEQ ID NO: 173949 - DNA, 15 bp, Homo sapiens
gcagtggcgagatct

SEQ ID NO: 173950 - DNA, 15 bp, Homo sapiens
tgcagtggcgagatc

SEQ ID NO: 173951 - DNA, 15 bp, Homo sapiens
gtgcagtggcgagat

SEQ ID NO: 173952 - DNA, 15 bp, Homo sapiens
agtgcagtggcgaga

SEQ ID NO: 173953 - DNA, 15 bp, Homo sapiens
gagtgcagtggcgag

SEQ ID NO: 173954 - DNA, 15 bp, Homo sapiens
ggagtgcagtggcga

SEQ ID NO: 173955 - DNA, 15 bp, Homo sapiens
cgctctgtcacccag

SEQ ID NO: 173956 - DNA, 15 bp, Homo sapiens
tcgctctgtcaccca

SEQ ID NO: 173957 - DNA, 15 bp, Homo sapiens
ctcgctctgtcaccc

SEQ ID NO: 173958 - DNA, 15 bp, Homo sapiens
tctcgctctgtcacc

SEQ ID NO: 173959 - DNA, 15 bp, Homo sapiens
gtctcgctctgtcac

SEQ ID NO: 173960 - DNA, 15 bp, Homo sapiens
tggagtctcgctctg

SEQ ID NO: 173961 - DNA, 15 bp, Homo sapiens
atggagtctcgctct

SEQ ID NO: 173962 - DNA, 15 bp, Homo sapiens
gatggagtctcgctc

SEQ ID NO: 173963 - DNA, 15 bp, Homo sapiens
agatggagtctcgct

SEQ ID NO: 173964 - DNA, 15 bp, Homo sapiens
tgagatggagtctcg

SEQ ID NO: 173965 - DNA, 15 bp, Homo sapiens
attttttgagatgga

SEQ ID NO: 173966 - DNA, 15 bp, Homo sapiens
tattttttgagatgg

SEQ ID NO: 173967 - DNA, 15 bp, Homo sapiens
ttattttttgagatg

SEQ ID NO: 173968 - DNA, 15 bp, Homo sapiens
tttattttttgagat

SEQ ID NO: 173969 - DNA, 15 bp, Homo sapiens
atttattttttgaga

SEQ ID NO: 173970 - DNA, 15 bp, Homo sapiens
tatttattttttgag

SEQ ID NO: 173971 - DNA, 15 bp, Homo sapiens
ttatttattttttga

SEQ ID NO: 173972 - DNA, 15 bp, Homo sapiens
tttatttattttttg

SEQ ID NO: 173973 - DNA, 15 bp, Homo sapiens
ttttatttatttttt

SEQ ID NO: 173974 - DNA, 15 bp, Homo sapiens
tttttatttattttt

SEQ ID NO: 173975 - DNA, 15 bp, Homo sapiens
ttttttatttatttt

SEQ ID NO: 173976 - DNA, 15 bp, Homo sapiens
attttttatttattt

SEQ ID NO: 173977 - DNA, 15 bp, Homo sapiens
cattttttatttatt

SEQ ID NO: 173978 - DNA, 15 bp, Homo sapiens
tcattttttatttat

SEQ ID NO: 173979 - DNA, 15 bp, Homo sapiens
ttcattttttattta

SEQ ID NO: 173980 - DNA, 15 bp, Homo sapiens
cttcattttttattt

SEQ ID NO: 173981 - DNA, 15 bp, Homo sapiens
acttcattttttatt

SEQ ID NO: 173982 - DNA, 15 bp, Homo sapiens
cacttcattttttat

SEQ ID NO: 173983 - DNA, 15 bp, Homo sapiens
ccacttcatttttta

SEQ ID NO: 173984 - DNA, 15 bp, Homo sapiens
gccacttcatttttt

SEQ ID NO: 173985 - DNA, 15 bp, Homo sapiens
tgccacttcattttt

SEQ ID NO: 173986 - DNA, 15 bp, Homo sapiens
atgccacttcatttt

SEQ ID NO: 173987 - DNA, 15 bp, Homo sapiens
aatgccacttcattt

SEQ ID NO: 173988 - DNA, 15 bp, Homo sapiens
gaatgccacttcatt

SEQ ID NO: 173989 - DNA, 15 bp, Homo sapiens
agaatgccacttcat

SEQ ID NO: 173990 - DNA, 15 bp, Homo sapiens
cagaatgccacttca

SEQ ID NO: 173991 - DNA, 15 bp, Homo sapiens
tcagaatgccacttc

SEQ ID NO: 173992 - DNA, 15 bp, Homo sapiens
atcagaatgccactt

SEQ ID NO: 173993 - DNA, 15 bp, Homo sapiens
aatcagaatgccact

SEQ ID NO: 173994 - DNA, 15 bp, Homo sapiens
caatcagaatgccac

SEQ ID NO: 173995 - DNA, 15 bp, Homo sapiens
ccaatcagaatgcca

SEQ ID NO: 173996 - DNA, 15 bp, Homo sapiens
cccaatcagaatgcc

SEQ ID NO: 173997 - DNA, 15 bp, Homo sapiens
tcccaatcagaatgc

SEQ ID NO: 173998 - DNA, 15 bp, Homo sapiens
ctcccaatcagaatg

SEQ ID NO: 173999 - DNA, 15 bp, Homo sapiens
actcccaatcagaat

SEQ ID NO: 174000 - DNA, 15 bp, Homo sapiens
aactcccaatcagaa

SEQ ID NO: 174001 - DNA, 15 bp, Homo sapiens
taactcccaatcaga

SEQ ID NO: 174002 - DNA, 15 bp, Homo sapiens
gtaactcccaatcag

SEQ ID NO: 174003 - DNA, 15 bp, Homo sapiens
agtaactcccaatca

SEQ ID NO: 174004 - DNA, 15 bp, Homo sapiens
tagtaactcccaatc

SEQ ID NO: 174005 - DNA, 15 bp, Homo sapiens
ttagtaactcccaat

SEQ ID NO: 174006 - DNA, 15 bp, Homo sapiens
cttagtaactcccaa

SEQ ID NO: 174007 - DNA, 15 bp, Homo sapiens
gcttagtaactccca

SEQ ID NO: 174008 - DNA, 15 bp, Homo sapiens
tgcttagtaactccc

SEQ ID NO: 174009 - DNA, 15 bp, Homo sapiens
atgcttagtaactcc

SEQ ID NO: 174010 - DNA, 15 bp, Homo sapiens
tatgcttagtaactc

SEQ ID NO: 174011 - DNA, 15 bp, Homo sapiens
atatgcttagtaact

SEQ ID NO: 174012 - DNA, 15 bp, Homo sapiens
tatatgcttagtaac

SEQ ID NO: 174013 - DNA, 15 bp, Homo sapiens
atatatgcttagtaa

SEQ ID NO: 174014 - DNA, 15 bp, Homo sapiens
tatatatgcttagta

SEQ ID NO: 174015 - DNA, 15 bp, Homo sapiens
atatatatgcttagt

SEQ ID NO: 174016 - DNA, 15 bp, Homo sapiens
aatatatatgcttag

SEQ ID NO: 174017 - DNA, 15 bp, Homo sapiens
taatatatatgctta

SEQ ID NO: 174018 - DNA, 15 bp, Homo sapiens
ataatatatatgctt

SEQ ID NO: 174019 - DNA, 15 bp, Homo sapiens
tataatatatatgct

SEQ ID NO: 174020 - DNA, 15 bp, Homo sapiens
ctataatatatatgc

SEQ ID NO: 174021 - DNA, 15 bp, Homo sapiens
cctataatatatatg

SEQ ID NO: 174022 - DNA, 15 bp, Homo sapiens
tcctataatatatat

SEQ ID NO: 174023 - DNA, 15 bp, Homo sapiens
ttcctataatatata

SEQ ID NO: 174024 - DNA, 15 bp, Homo sapiens
cttcctataatatat

SEQ ID NO: 174025 - DNA, 15 bp, Homo sapiens
ccttcctataatata

SEQ ID NO: 174026 - DNA, 15 bp, Homo sapiens
tccttcctataatat

SEQ ID NO: 174027 - DNA, 15 bp, Homo sapiens
atccttcctataata

SEQ ID NO: 174028 - DNA, 15 bp, Homo sapiens
aatccttcctataat

SEQ ID NO: 174029 - DNA, 15 bp, Homo sapiens
taatccttcctataa

SEQ ID NO: 174030 - DNA, 15 bp, Homo sapiens
ttaatccttcctata

SEQ ID NO: 174031 - DNA, 15 bp, Homo sapiens
gttaatccttcctat

SEQ ID NO: 174032 - DNA, 15 bp, Homo sapiens
tgttaatccttccta

SEQ ID NO: 174033 - DNA, 15 bp, Homo sapiens
gtgttaatccttcct

SEQ ID NO: 174034 - DNA, 15 bp, Homo sapiens
agtgttaatccttcc

SEQ ID NO: 174035 - DNA, 15 bp, Homo sapiens
gagtgttaatccttc

SEQ ID NO: 174036 - DNA, 15 bp, Homo sapiens
tgagtgttaatcctt

SEQ ID NO: 174037 - DNA, 15 bp, Homo sapiens
ttgagtgttaatcct

SEQ ID NO: 174038 - DNA, 15 bp, Homo sapiens
tttgagtgttaatcc

SEQ ID NO: 174039 - DNA, 15 bp, Homo sapiens
ttttgagtgttaatc

SEQ ID NO: 174040 - DNA, 15 bp, Homo sapiens
cttttgagtgttaat

SEQ ID NO: 174041 - DNA, 15 bp, Homo sapiens
ccttttgagtgttaa

SEQ ID NO: 174042 - DNA, 15 bp, Homo sapiens
tccttttgagtgtta

SEQ ID NO: 174043 - DNA, 15 bp, Homo sapiens
ctccttttgagtgtt

SEQ ID NO: 174044 - DNA, 15 bp, Homo sapiens
tctccttttgagtgt

SEQ ID NO: 174045 - DNA, 15 bp, Homo sapiens
ctctccttttgagtg

SEQ ID NO: 174046 - DNA, 15 bp, Homo sapiens
gctctccttttgagt

SEQ ID NO: 174047 - DNA, 15 bp, Homo sapiens
agctctccttttgag

SEQ ID NO: 174048 - DNA, 15 bp, Homo sapiens
aagctctccttttga

SEQ ID NO: 174049 - DNA, 15 bp, Homo sapiens
taagctctccttttg

SEQ ID NO: 174050 - DNA, 15 bp, Homo sapiens
ctaagctctcctttt

SEQ ID NO: 174051 - DNA, 15 bp, Homo sapiens
actaagctctccttt

SEQ ID NO: 174052 - DNA, 15 bp, Homo sapiens
gactaagctctcctt

SEQ ID NO: 174053 - DNA, 15 bp, Homo sapiens
agactaagctctcct

SEQ ID NO: 174054 - DNA, 15 bp, Homo sapiens
aagactaagctctcc

SEQ ID NO: 174055 - DNA, 15 bp, Homo sapiens
caagactaagctctc

SEQ ID NO: 174056 - DNA, 15 bp, Homo sapiens
acaagactaagctct

SEQ ID NO: 174057 - DNA, 15 bp, Homo sapiens
aacaagactaagctc

SEQ ID NO: 174058 - DNA, 15 bp, Homo sapiens
taacaagactaagct

SEQ ID NO: 174059 - DNA, 15 bp, Homo sapiens
ttaacaagactaagc

SEQ ID NO: 174060 - DNA, 15 bp, Homo sapiens
attaacaagactaag

SEQ ID NO: 174061 - DNA, 15 bp, Homo sapiens
aattaacaagactaa

SEQ ID NO: 174062 - DNA, 15 bp, Homo sapiens
aaattaacaagacta

SEQ ID NO: 174063 - DNA, 15 bp, Homo sapiens
aaaattaacaagact

SEQ ID NO: 174064 - DNA, 15 bp, Homo sapiens
gaaaattaacaagac

SEQ ID NO: 174065 - DNA, 15 bp, Homo sapiens
tgaaaattaacaaga

SEQ ID NO: 174066 - DNA, 15 bp, Homo sapiens
atgaaaattaacaag

SEQ ID NO: 174067 - DNA, 15 bp, Homo sapiens
catgaaaattaacaa

SEQ ID NO: 174068 - DNA, 15 bp, Homo sapiens
gcatgaaaattaaca

SEQ ID NO: 174069 - DNA, 15 bp, Homo sapiens
agcatgaaaattaac

SEQ ID NO: 174070 - DNA, 15 bp, Homo sapiens
aagcatgaaaattaa

SEQ ID NO: 174071 - DNA, 15 bp, Homo sapiens
aaagcatgaaaatta

SEQ ID NO: 174072 - DNA, 15 bp, Homo sapiens
caaagcatgaaaatt

SEQ ID NO: 174073 - DNA, 15 bp, Homo sapiens
gcaaagcatgaaaat

SEQ ID NO: 174074 - DNA, 15 bp, Homo sapiens
agcaaagcatgaaaa

SEQ ID NO: 174075 - DNA, 15 bp, Homo sapiens
cagcaaagcatgaaa

SEQ ID NO: 174076 - DNA, 15 bp, Homo sapiens
tcagcaaagcatgaa

SEQ ID NO: 174077 - DNA, 15 bp, Homo sapiens
ctcagcaaagcatga

SEQ ID NO: 174078 - DNA, 15 bp, Homo sapiens
cctcagcaaagcatg

SEQ ID NO: 174079 - DNA, 15 bp, Homo sapiens
ccctcagcaaagcat

SEQ ID NO: 174080 - DNA, 15 bp, Homo sapiens
gccctcagcaaagca

SEQ ID NO: 174081 - DNA, 15 bp, Homo sapiens
ggccctcagcaaagc

SEQ ID NO: 174082 - DNA, 15 bp, Homo sapiens
aggccctcagcaaag

SEQ ID NO: 174083 - DNA, 15 bp, Homo sapiens
caggccctcagcaaa

SEQ ID NO: 174084 - DNA, 15 bp, Homo sapiens
acaggccctcagcaa

SEQ ID NO: 174085 - DNA, 15 bp, Homo sapiens
cacaggccctcagca

SEQ ID NO: 174086 - DNA, 15 bp, Homo sapiens
acacaggccctcagc

SEQ ID NO: 174087 - DNA, 15 bp, Homo sapiens
tacacaggccctcag

SEQ ID NO: 174088 - DNA, 15 bp, Homo sapiens
atacacaggccctca

SEQ ID NO: 174089 - DNA, 15 bp, Homo sapiens
aatacacaggccctc

SEQ ID NO: 174090 - DNA, 15 bp, Homo sapiens
taatacacaggccct

SEQ ID NO: 174091 - DNA, 15 bp, Homo sapiens
ctaatacacaggccc

SEQ ID NO: 174092 - DNA, 15 bp, Homo sapiens
gctaatacacaggcc

SEQ ID NO: 174093 - DNA, 15 bp, Homo sapiens
ggctaatacacaggc

SEQ ID NO: 174094 - DNA, 15 bp, Homo sapiens
aggctaatacacagg

SEQ ID NO: 174095 - DNA, 15 bp, Homo sapiens
caggctaatacacag

SEQ ID NO: 174096 - DNA, 15 bp, Homo sapiens
acaggctaatacaca

SEQ ID NO: 174097 - DNA, 15 bp, Homo sapiens
aacaggctaatacac

SEQ ID NO: 174098 - DNA, 15 bp, Homo sapiens
gaacaggctaataca

SEQ ID NO: 174099 - DNA, 15 bp, Homo sapiens
agaacaggctaatac

SEQ ID NO: 174100 - DNA, 15 bp, Homo sapiens
gagaacaggctaata

SEQ ID NO: 174101 - DNA, 15 bp, Homo sapiens
tgagaacaggctaat

SEQ ID NO: 174102 - DNA, 15 bp, Homo sapiens
gtgagaacaggctaa

SEQ ID NO: 174103 - DNA, 15 bp, Homo sapiens
ggtgagaacaggcta

SEQ ID NO: 174104 - DNA, 15 bp, Homo sapiens
gggtgagaacaggct

SEQ ID NO: 174105 - DNA, 15 bp, Homo sapiens
agggtgagaacaggc

SEQ ID NO: 174106 - DNA, 15 bp, Homo sapiens
cagggtgagaacagg

SEQ ID NO: 174107 - DNA, 15 bp, Homo sapiens
gcagggtgagaacag

SEQ ID NO: 174108 - DNA, 15 bp, Homo sapiens
agcagggtgagaaca

SEQ ID NO: 174109 - DNA, 15 bp, Homo sapiens
tagcagggtgagaac

SEQ ID NO: 174110 - DNA, 15 bp, Homo sapiens
ttagcagggtgagaa

SEQ ID NO: 174111 - DNA, 15 bp, Homo sapiens
attagcagggtgaga

SEQ ID NO: 174112 - DNA, 15 bp, Homo sapiens
tattagcagggtgag

SEQ ID NO: 174113 - DNA, 15 bp, Homo sapiens
ttattagcagggtga

SEQ ID NO: 174114 - DNA, 15 bp, Homo sapiens
tttattagcagggtg

SEQ ID NO: 174115 - DNA, 15 bp, Homo sapiens
ctttattagcagggt

SEQ ID NO: 174116 - DNA, 15 bp, Homo sapiens
tctttattagcaggg

SEQ ID NO: 174117 - DNA, 15 bp, Homo sapiens
gtctttattagcagg

SEQ ID NO: 174118 - DNA, 15 bp, Homo sapiens
gtcaggtatgtcttt

SEQ ID NO: 174119 - DNA, 15 bp, Homo sapiens
tgtcaggtatgtctt

SEQ ID NO: 174120 - DNA, 15 bp, Homo sapiens
gtgtcaggtatgtct

SEQ ID NO: 174121 - DNA, 15 bp, Homo sapiens
agtgtcaggtatgtc

SEQ ID NO: 174122 - DNA, 15 bp, Homo sapiens
cagtgtcaggtatgt

SEQ ID NO: 174123 - DNA, 15 bp, Homo sapiens
ccagtgtcaggtatg

SEQ ID NO: 174124 - DNA, 15 bp, Homo sapiens
cccagtgtcaggtat

SEQ ID NO: 174125 - DNA, 15 bp, Homo sapiens
acccagtgtcaggta

SEQ ID NO: 174126 - DNA, 15 bp, Homo sapiens
cacccagtgtcaggt

SEQ ID NO: 174127 - DNA, 15 bp, Homo sapiens
tcacccagtgtcagg

SEQ ID NO: 174128 - DNA, 15 bp, Homo sapiens
atcacccagtgtcag

SEQ ID NO: 174129 - DNA, 15 bp, Homo sapiens
aatcacccagtgtca

SEQ ID NO: 174130 - DNA, 15 bp, Homo sapiens
aaatcacccagtgtc

SEQ ID NO: 174131 - DNA, 15 bp, Homo sapiens
taaatcacccagtgt

SEQ ID NO: 174132 - DNA, 15 bp, Homo sapiens
ataaatcacccagtg

SEQ ID NO: 174133 - DNA, 15 bp, Homo sapiens
tataaatcacccagt

SEQ ID NO: 174134 - DNA, 15 bp, Homo sapiens
ttataaatcacccag

SEQ ID NO: 174135 - DNA, 15 bp, Homo sapiens
tttataaatcaccca

SEQ ID NO: 174136 - DNA, 15 bp, Homo sapiens
ctttataaatcaccc

SEQ ID NO: 174137 - DNA, 15 bp, Homo sapiens
cctttataaatcacc

SEQ ID NO: 174138 - DNA, 15 bp, Homo sapiens
tcctttataaatcac

SEQ ID NO: 174139 - DNA, 15 bp, Homo sapiens
ttcctttataaatca

SEQ ID NO: 174140 - DNA, 15 bp, Homo sapiens
tttcctttataaatc

SEQ ID NO: 174141 - DNA, 15 bp, Homo sapiens
taattaaacctcttt

SEQ ID NO: 174142 - DNA, 15 bp, Homo sapiens
ttaattaaacctctt

SEQ ID NO: 174143 - DNA, 15 bp, Homo sapiens
gttaattaaacctct

SEQ ID NO: 174144 - DNA, 15 bp, Homo sapiens
agttaattaaacctc

SEQ ID NO: 174145 - DNA, 15 bp, Homo sapiens
gagttaattaaacct

SEQ ID NO: 174146 - DNA, 15 bp, Homo sapiens
tgagttaattaaacc

SEQ ID NO: 174147 - DNA, 15 bp, Homo sapiens
gtgagttaattaaac

SEQ ID NO: 174148 - DNA, 15 bp, Homo sapiens
tgtgagttaattaaa

SEQ ID NO: 174149 - DNA, 15 bp, Homo sapiens
ctgtgagttaattaa

SEQ ID NO: 174150 - DNA, 15 bp, Homo sapiens
actgtgagttaatta

SEQ ID NO: 174151 - DNA, 15 bp, Homo sapiens
aactgtgagttaatt

SEQ ID NO: 174152 - DNA, 15 bp, Homo sapiens
gaactgtgagttaat

SEQ ID NO: 174153 - DNA, 15 bp, Homo sapiens
ggaactgtgagttaa

SEQ ID NO: 174154 - DNA, 15 bp, Homo sapiens
tggaactgtgagtta

SEQ ID NO: 174155 - DNA, 15 bp, Homo sapiens
gtggaactgtgagtt

SEQ ID NO: 174156 - DNA, 15 bp, Homo sapiens
tgtggaactgtgagt

SEQ ID NO: 174157 - DNA, 15 bp, Homo sapiens
atgtggaactgtgag

SEQ ID NO: 174158 - DNA, 15 bp, Homo sapiens
catgtggaactgtga

SEQ ID NO: 174159 - DNA, 15 bp, Homo sapiens
ccccagccatgtgga

SEQ ID NO: 174160 - DNA, 15 bp, Homo sapiens
tccccagccatgtgg

SEQ ID NO: 174161 - DNA, 15 bp, Homo sapiens
ctccccagccatgtg

SEQ ID NO: 174162 - DNA, 15 bp, Homo sapiens
cctccccagccatgt

SEQ ID NO: 174163 - DNA, 15 bp, Homo sapiens
gcctccccagccatg

SEQ ID NO: 174164 - DNA, 15 bp, Homo sapiens
ggcctccccagccat

SEQ ID NO: 174165 - DNA, 15 bp, Homo sapiens
aggcctccccagcca

SEQ ID NO: 174166 - DNA, 15 bp, Homo sapiens
gaggcctccccagcc

SEQ ID NO: 174167 - DNA, 15 bp, Homo sapiens
tgaggcctccccagc

SEQ ID NO: 174168 - DNA, 15 bp, Homo sapiens
gtgaggcctccccag

SEQ ID NO: 174169 - DNA, 15 bp, Homo sapiens
cgattgtgaggcctc

SEQ ID NO: 174170 - DNA, 15 bp, Homo sapiens
acgattgtgaggcct

SEQ ID NO: 174171 - DNA, 15 bp, Homo sapiens
cacgattgtgaggcc

SEQ ID NO: 174172 - DNA, 15 bp, Homo sapiens
ccacgattgtgaggc

SEQ ID NO: 174173 - DNA, 15 bp, Homo sapiens
accacgattgtgagg

SEQ ID NO: 174174 - DNA, 15 bp, Homo sapiens
caccacgattgtgag

SEQ ID NO: 174175 - DNA, 15 bp, Homo sapiens
ccaccacgattgtga

SEQ ID NO: 174176 - DNA, 15 bp, Homo sapiens
tccaccacgattgtg

SEQ ID NO: 174177 - DNA, 15 bp, Homo sapiens
ttccaccacgattgt

SEQ ID NO: 174178 - DNA, 15 bp, Homo sapiens
cttccaccacgattg

SEQ ID NO: 174179 - DNA, 15 bp, Homo sapiens
ccttccaccacgatt

SEQ ID NO: 174180 - DNA, 15 bp, Homo sapiens
gccttccaccacgat

SEQ ID NO: 174181 - DNA, 15 bp, Homo sapiens
tgccttccaccacga

SEQ ID NO: 174182 - DNA, 15 bp, Homo sapiens
ttgccttccaccacg

SEQ ID NO: 174183 - DNA, 15 bp, Homo sapiens
tttgccttccaccac

SEQ ID NO: 174184 - DNA, 15 bp, Homo sapiens
tcctttgccttccac

SEQ ID NO: 174185 - DNA, 15 bp, Homo sapiens
ctcctttgccttcca

SEQ ID NO: 174186 - DNA, 15 bp, Homo sapiens
cctcctttgccttcc

SEQ ID NO: 174187 - DNA, 15 bp, Homo sapiens
tcctcctttgccttc

SEQ ID NO: 174188 - DNA, 15 bp, Homo sapiens
ctcctcctttgcctt

SEQ ID NO: 174189 - DNA, 15 bp, Homo sapiens
gctcctcctttgcct

SEQ ID NO: 174190 - DNA, 15 bp, Homo sapiens
tgctcctcctttgcc

SEQ ID NO: 174191 - DNA, 15 bp, Homo sapiens
ccgccatgcaagacg

SEQ ID NO: 174192 - DNA, 15 bp, Homo sapiens
accgccatgcaagac

SEQ ID NO: 174193 - DNA, 15 bp, Homo sapiens
caccgccatgcaaga

SEQ ID NO: 174194 - DNA, 15 bp, Homo sapiens
ccaccgccatgcaag

SEQ ID NO: 174195 - DNA, 15 bp, Homo sapiens
cccaccgccatgcaa

SEQ ID NO: 174196 - DNA, 15 bp, Homo sapiens
gcccaccgccatgca

SEQ ID NO: 174197 - DNA, 15 bp, Homo sapiens
ggcccaccgccatgc

SEQ ID NO: 174198 - DNA, 15 bp, Homo sapiens
tggcccaccgccatg

SEQ ID NO: 174199 - DNA, 15 bp, Homo sapiens
ctggcccaccgccat

SEQ ID NO: 174200 - DNA, 15 bp, Homo sapiens
tctggcccaccgcca

SEQ ID NO: 174201 - DNA, 15 bp, Homo sapiens
ctctggcccaccgcc

SEQ ID NO: 174202 - DNA, 15 bp, Homo sapiens
tctctggcccaccgc

SEQ ID NO: 174203 - DNA, 15 bp, Homo sapiens
ctctctggcccaccg

SEQ ID NO: 174204 - DNA, 15 bp, Homo sapiens
actctctggcccacc

SEQ ID NO: 174205 - DNA, 15 bp, Homo sapiens
cactctctggcccac

SEQ ID NO: 174206 - DNA, 15 bp, Homo sapiens
acactctctggccca

SEQ ID NO: 174207 - DNA, 15 bp, Homo sapiens
cacactctctggccc

SEQ ID NO: 174208 - DNA, 15 bp, Homo sapiens
acacactctctggcc

SEQ ID NO: 174209 - DNA, 15 bp, Homo sapiens
cacacactctctggc

SEQ ID NO: 174210 - DNA, 15 bp, Homo sapiens
tcacacactctctgg

SEQ ID NO: 174211 - DNA, 15 bp, Homo sapiens
ctcacacactctctg

SEQ ID NO: 174212 - DNA, 15 bp, Homo sapiens
cctcacacactctct

SEQ ID NO: 174213 - DNA, 15 bp, Homo sapiens
ccctcacacactctc

SEQ ID NO: 174214 - DNA, 15 bp, Homo sapiens
cccctcacacactct

SEQ ID NO: 174215 - DNA, 15 bp, Homo sapiens
tcccctcacacactc

SEQ ID NO: 174216 - DNA, 15 bp, Homo sapiens
ttcccctcacacact

SEQ ID NO: 174217 - DNA, 15 bp, Homo sapiens
gttcccctcacacac

SEQ ID NO: 174218 - DNA, 15 bp, Homo sapiens
agttcccctcacaca

SEQ ID NO: 174219 - DNA, 15 bp, Homo sapiens
gagttcccctcacac

SEQ ID NO: 174220 - DNA, 15 bp, Homo sapiens
ggagttcccctcaca

SEQ ID NO: 174221 - DNA, 15 bp, Homo sapiens
gggagttcccctcac

SEQ ID NO: 174222 - DNA, 15 bp, Homo sapiens
ggggagttcccctca

SEQ ID NO: 174223 - DNA, 15 bp, Homo sapiens
aggggagttcccctc

SEQ ID NO: 174224 - DNA, 15 bp, Homo sapiens
aaggggagttcccct

SEQ ID NO: 174225 - DNA, 15 bp, Homo sapiens
gaaggggagttcccc

SEQ ID NO: 174226 - DNA, 15 bp, Homo sapiens
tgaaggggagttccc

SEQ ID NO: 174227 - DNA, 15 bp, Homo sapiens
atgaaggggagttcc

SEQ ID NO: 174228 - DNA, 15 bp, Homo sapiens
tatgaaggggagttc

SEQ ID NO: 174229 - DNA, 15 bp, Homo sapiens
ttatgaaggggagtt

SEQ ID NO: 174230 - DNA, 15 bp, Homo sapiens
tttatgaaggggagt

SEQ ID NO: 174231 - DNA, 15 bp, Homo sapiens
ttttatgaaggggag

SEQ ID NO: 174232 - DNA, 15 bp, Homo sapiens
gttttatgaagggga

SEQ ID NO: 174233 - DNA, 15 bp, Homo sapiens
ggttttatgaagggg

SEQ ID NO: 174234 - DNA, 15 bp, Homo sapiens
tggttttatgaaggg

SEQ ID NO: 174235 - DNA, 15 bp, Homo sapiens
atggttttatgaagg

SEQ ID NO: 174236 - DNA, 15 bp, Homo sapiens
gatggttttatgaag

SEQ ID NO: 174237 - DNA, 15 bp, Homo sapiens
tgatggttttatgaa

SEQ ID NO: 174238 - DNA, 15 bp, Homo sapiens
ctgatggttttatga

SEQ ID NO: 174239 - DNA, 15 bp, Homo sapiens
tctgatggttttatg

SEQ ID NO: 174240 - DNA, 15 bp, Homo sapiens
aatagtgaataagtc

SEQ ID NO: 174241 - DNA, 15 bp, Homo sapiens
taatagtgaataagt

SEQ ID NO: 174242 - DNA, 15 bp, Homo sapiens
ataatagtgaataag

SEQ ID NO: 174243 - DNA, 15 bp, Homo sapiens
cataatagtgaataa

SEQ ID NO: 174244 - DNA, 15 bp, Homo sapiens
tcataatagtgaata

SEQ ID NO: 174245 - DNA, 15 bp, Homo sapiens
ctcataatagtgaat

SEQ ID NO: 174246 - DNA, 15 bp, Homo sapiens
tctcataatagtgaa

SEQ ID NO: 174247 - DNA, 15 bp, Homo sapiens
ctctcataatagtga

SEQ ID NO: 174248 - DNA, 15 bp, Homo sapiens
gctctcataatagtg

SEQ ID NO: 174249 - DNA, 15 bp, Homo sapiens
tgctctcataatagt

SEQ ID NO: 174250 - DNA, 15 bp, Homo sapiens
ctgctctcataatag

SEQ ID NO: 174251 - DNA, 15 bp, Homo sapiens
gctgctctcataata

SEQ ID NO: 174252 - DNA, 15 bp, Homo sapiens
tgctgctctcataat

SEQ ID NO: 174253 - DNA, 15 bp, Homo sapiens
atgctgctctcataa

SEQ ID NO: 174254 - DNA, 15 bp, Homo sapiens
catgctgctctcata

SEQ ID NO: 174255 - DNA, 15 bp, Homo sapiens
ccatgctgctctcat

SEQ ID NO: 174256 - DNA, 15 bp, Homo sapiens
cccatgctgctctca

SEQ ID NO: 174257 - DNA, 15 bp, Homo sapiens
tcccatgctgctctc

SEQ ID NO: 174258 - DNA, 15 bp, Homo sapiens
ttcccatgctgctct

SEQ ID NO: 174259 - DNA, 15 bp, Homo sapiens
tttcccatgctgctc

SEQ ID NO: 174260 - DNA, 15 bp, Homo sapiens
ttttcccatgctgct

SEQ ID NO: 174261 - DNA, 15 bp, Homo sapiens
tttttcccatgctgc

SEQ ID NO: 174262 - DNA, 15 bp, Homo sapiens
gtttttcccatgctg

SEQ ID NO: 174263 - DNA, 15 bp, Homo sapiens
ggtttttcccatgct

SEQ ID NO: 174264 - DNA, 15 bp, Homo sapiens
aggtttttcccatgc

SEQ ID NO: 174265 - DNA, 15 bp, Homo sapiens
aaggtttttcccatg

SEQ ID NO: 174266 - DNA, 15 bp, Homo sapiens
aaaggtttttcccat

SEQ ID NO: 174267 - DNA, 15 bp, Homo sapiens
gaaaggtttttccca

SEQ ID NO: 174268 - DNA, 15 bp, Homo sapiens
ggaaaggtttttccc

SEQ ID NO: 174269 - DNA, 15 bp, Homo sapiens
gggaaaggtttttcc

SEQ ID NO: 174270 - DNA, 15 bp, Homo sapiens
ggggaaaggtttttc

SEQ ID NO: 174271 - DNA, 15 bp, Homo sapiens
gggggaaaggttttt

SEQ ID NO: 174272 - DNA, 15 bp, Homo sapiens
agggggaaaggtttt

SEQ ID NO: 174273 - DNA, 15 bp, Homo sapiens
cagggggaaaggttt

SEQ ID NO: 174274 - DNA, 15 bp, Homo sapiens
tcagggggaaaggtt

SEQ ID NO: 174275 - DNA, 15 bp, Homo sapiens
atcagggggaaaggt

SEQ ID NO: 174276 - DNA, 15 bp, Homo sapiens
aatcagggggaaagg

SEQ ID NO: 174277 - DNA, 15 bp, Homo sapiens
gaatcagggggaaag

SEQ ID NO: 174278 - DNA, 15 bp, Homo sapiens
tgaatcagggggaaa

SEQ ID NO: 174279 - DNA, 15 bp, Homo sapiens
ctgaatcagggggaa

SEQ ID NO: 174280 - DNA, 15 bp, Homo sapiens
actgaatcaggggga

SEQ ID NO: 174281 - DNA, 15 bp, Homo sapiens
aactgaatcaggggg

SEQ ID NO: 174282 - DNA, 15 bp, Homo sapiens
taactgaatcagggg

SEQ ID NO: 174283 - DNA, 15 bp, Homo sapiens
gtaactgaatcaggg

SEQ ID NO: 174284 - DNA, 15 bp, Homo sapiens
ggtaactgaatcagg

SEQ ID NO: 174285 - DNA, 15 bp, Homo sapiens
aggtaactgaatcag

SEQ ID NO: 174286 - DNA, 15 bp, Homo sapiens
tgtgggaggtaactg

SEQ ID NO: 174287 - DNA, 15 bp, Homo sapiens
ttgtgggaggtaact

SEQ ID NO: 174288 - DNA, 15 bp, Homo sapiens
attgtgggaggtaac

SEQ ID NO: 174289 - DNA, 15 bp, Homo sapiens
tattgtgggaggtaa

SEQ ID NO: 174290 - DNA, 15 bp, Homo sapiens
gtattgtgggaggta

SEQ ID NO: 174291 - DNA, 15 bp, Homo sapiens
cgtattgtgggaggt

SEQ ID NO: 174292 - DNA, 15 bp, Homo sapiens
acgtattgtgggagg

SEQ ID NO: 174293 - DNA, 15 bp, Homo sapiens
cacgtattgtgggag

SEQ ID NO: 174294 - DNA, 15 bp, Homo sapiens
ccacgtattgtggga

SEQ ID NO: 174295 - DNA, 15 bp, Homo sapiens
cccacgtattgtggg

SEQ ID NO: 174296 - DNA, 15 bp, Homo sapiens
ccccacgtattgtgg

SEQ ID NO: 174297 - DNA, 15 bp, Homo sapiens
tccccacgtattgtg

SEQ ID NO: 174298 - DNA, 15 bp, Homo sapiens
atccccacgtattgt

SEQ ID NO: 174299 - DNA, 15 bp, Homo sapiens
aatccccacgtattg

SEQ ID NO: 174300 - DNA, 15 bp, Homo sapiens
taatccccacgtatt

SEQ ID NO: 174301 - DNA, 15 bp, Homo sapiens
ataatccccacgtat

SEQ ID NO: 174302 - DNA, 15 bp, Homo sapiens
aataatccccacgta

SEQ ID NO: 174303 - DNA, 15 bp, Homo sapiens
taataatccccacgt

SEQ ID NO: 174304 - DNA, 15 bp, Homo sapiens
gtaataatccccacg

SEQ ID NO: 174305 - DNA, 15 bp, Homo sapiens
tgtaataatccccac

SEQ ID NO: 174306 - DNA, 15 bp, Homo sapiens
ttgtaataatcccca

SEQ ID NO: 174307 - DNA, 15 bp, Homo sapiens
attgtaataatcccc

SEQ ID NO: 174308 - DNA, 15 bp, Homo sapiens
aattgtaataatccc

SEQ ID NO: 174309 - DNA, 15 bp, Homo sapiens
gaattgtaataatcc

SEQ ID NO: 174310 - DNA, 15 bp, Homo sapiens
tgaattgtaataatc

SEQ ID NO: 174311 - DNA, 15 bp, Homo sapiens
ttgaattgtaataat

SEQ ID NO: 174312 - DNA, 15 bp, Homo sapiens
cttgaattgtaataa

SEQ ID NO: 174313 - DNA, 15 bp, Homo sapiens
ccttgaattgtaata

SEQ ID NO: 174314 - DNA, 15 bp, Homo sapiens
accttgaattgtaat

SEQ ID NO: 174315 - DNA, 15 bp, Homo sapiens
caccttgaattgtaa

SEQ ID NO: 174316 - DNA, 15 bp, Homo sapiens
tcaccttgaattgta

SEQ ID NO: 174317 - DNA, 15 bp, Homo sapiens
ctcaccttgaattgt

SEQ ID NO: 174318 - DNA, 15 bp, Homo sapiens
tctcaccttgaattg

SEQ ID NO: 174319 - DNA, 15 bp, Homo sapiens
tccaaatctcacctt

SEQ ID NO: 174320 - DNA, 15 bp, Homo sapiens
atccaaatctcacct

SEQ ID NO: 174321 - DNA, 15 bp, Homo sapiens
catccaaatctcacc

SEQ ID NO: 174322 - DNA, 15 bp, Homo sapiens
ccatccaaatctcac

SEQ ID NO: 174323 - DNA, 15 bp, Homo sapiens
cccatccaaatctca

SEQ ID NO: 174324 - DNA, 15 bp, Homo sapiens
ccccatccaaatctc

SEQ ID NO: 174325 - DNA, 15 bp, Homo sapiens
tccccatccaaatct

SEQ ID NO: 174326 - DNA, 15 bp, Homo sapiens
gtccccatccaaatc

SEQ ID NO: 174327 - DNA, 15 bp, Homo sapiens
tgtccccatccaaat

SEQ ID NO: 174328 - DNA, 15 bp, Homo sapiens
gtgtccccatccaaa

SEQ ID NO: 174329 - DNA, 15 bp, Homo sapiens
ctgtgtccccatcca

SEQ ID NO: 174330 - DNA, 15 bp, Homo sapiens
tctgtgtccccatcc

SEQ ID NO: 174331 - DNA, 15 bp, Homo sapiens
ctctgtgtccccatc

SEQ ID NO: 174332 - DNA, 15 bp, Homo sapiens
gctctgtgtccccat

SEQ ID NO: 174333 - DNA, 15 bp, Homo sapiens
ggctctgtgtcccca

SEQ ID NO: 174334 - DNA, 15 bp, Homo sapiens
tggctctgtgtcccc

SEQ ID NO: 174335 - DNA, 15 bp, Homo sapiens
ttggctctgtgtccc

SEQ ID NO: 174336 - DNA, 15 bp, Homo sapiens
tttggctctgtgtcc

SEQ ID NO: 174337 - DNA, 15 bp, Homo sapiens
gtttggctctgtgtc

SEQ ID NO: 174338 - DNA, 15 bp, Homo sapiens
ggtttggctctgtgt

SEQ ID NO: 174339 - DNA, 15 bp, Homo sapiens
tggtttggctctgtg

SEQ ID NO: 174340 - DNA, 15 bp, Homo sapiens
atggtttggctctgt

SEQ ID NO: 174341 - DNA, 15 bp, Homo sapiens
tatggtttggctctg

SEQ ID NO: 174342 - DNA, 15 bp, Homo sapiens
atatggtttggctct

SEQ ID NO: 174343 - DNA, 15 bp, Homo sapiens
gatatggtttggctc

SEQ ID NO: 174344 - DNA, 15 bp, Homo sapiens
tgatatggtttggct

SEQ ID NO: 174345 - DNA, 15 bp, Homo sapiens
atgatatggtttggc

SEQ ID NO: 174346 - DNA, 15 bp, Homo sapiens
gatgatatggtttgg

SEQ ID NO: 174347 - DNA, 15 bp, Homo sapiens
ggatgatatggtttg

SEQ ID NO: 174348 - DNA, 15 bp, Homo sapiens
aggatgatatggttt

SEQ ID NO: 174349 - DNA, 15 bp, Homo sapiens
caggatgatatggtt

SEQ ID NO: 174350 - DNA, 15 bp, Homo sapiens
tcaggatgatatggt

SEQ ID NO: 174351 - DNA, 15 bp, Homo sapiens
atcaggatgatatgg

SEQ ID NO: 174352 - DNA, 15 bp, Homo sapiens
tatcaggatgatatg

SEQ ID NO: 174353 - DNA, 15 bp, Homo sapiens
gtatcaggatgatat

SEQ ID NO: 174354 - DNA, 15 bp, Homo sapiens
tgtatcaggatgata

SEQ ID NO: 174355 - DNA, 15 bp, Homo sapiens
ttgtatcaggatgat

SEQ ID NO: 174356 - DNA, 15 bp, Homo sapiens
tttgtatcaggatga

SEQ ID NO: 174357 - DNA, 15 bp, Homo sapiens
ttttgtatcaggatg

SEQ ID NO: 174358 - DNA, 15 bp, Homo sapiens
gttttgtatcaggat

SEQ ID NO: 174359 - DNA, 15 bp, Homo sapiens
tgttttgtatcagga

SEQ ID NO: 174360 - DNA, 15 bp, Homo sapiens
ctgttttgtatcagg

SEQ ID NO: 174361 - DNA, 15 bp, Homo sapiens
cctgttttgtatcag

SEQ ID NO: 174362 - DNA, 15 bp, Homo sapiens
acctgttttgtatca

SEQ ID NO: 174363 - DNA, 15 bp, Homo sapiens
gacctgttttgtatc

SEQ ID NO: 174364 - DNA, 15 bp, Homo sapiens
tgacctgttttgtat

SEQ ID NO: 174365 - DNA, 15 bp, Homo sapiens
atgacctgttttgta

SEQ ID NO: 174366 - DNA, 15 bp, Homo sapiens
aatgacctgttttgt

SEQ ID NO: 174367 - DNA, 15 bp, Homo sapiens
taatgacctgttttg

SEQ ID NO: 174368 - DNA, 15 bp, Homo sapiens
ttaatgacctgtttt

SEQ ID NO: 174369 - DNA, 15 bp, Homo sapiens
attaatgacctgttt

SEQ ID NO: 174370 - DNA, 15 bp, Homo sapiens
tattaatgacctgtt

SEQ ID NO: 174371 - DNA, 15 bp, Homo sapiens
ttattaatgacctgt

SEQ ID NO: 174372 - DNA, 15 bp, Homo sapiens
tttattaatgacctg

SEQ ID NO: 174373 - DNA, 15 bp, Homo sapiens
atttattaatgacct

SEQ ID NO: 174374 - DNA, 15 bp, Homo sapiens
tatttattaatgacc

SEQ ID NO: 174375 - DNA, 15 bp, Homo sapiens
atatttattaatgac

SEQ ID NO: 174376 - DNA, 15 bp, Homo sapiens
aatatttattaatga

SEQ ID NO: 174377 - DNA, 15 bp, Homo sapiens
aaatatttattaatg

SEQ ID NO: 174378 - DNA, 15 bp, Homo sapiens
taaatatttattaat

SEQ ID NO: 174379 - DNA, 15 bp, Homo sapiens
ataaatatttattaa

SEQ ID NO: 174380 - DNA, 15 bp, Homo sapiens
caataaatatttatt

SEQ ID NO: 174381 - DNA, 15 bp, Homo sapiens
tcaataaatatttat

SEQ ID NO: 174382 - DNA, 15 bp, Homo sapiens
ttcaataaatattta

SEQ ID NO: 174383 - DNA, 15 bp, Homo sapiens
attcaataaatattt

SEQ ID NO: 174384 - DNA, 15 bp, Homo sapiens
tattcaataaatatt

SEQ ID NO: 174385 - DNA, 15 bp, Homo sapiens
ctattcaataaatat

SEQ ID NO: 174386 - DNA, 15 bp, Homo sapiens
tctattcaataaata

SEQ ID NO: 174387 - DNA, 15 bp, Homo sapiens
ttctattcaataaat

SEQ ID NO: 174388 - DNA, 15 bp, Homo sapiens
attctattcaataaa

SEQ ID NO: 174389 - DNA, 15 bp, Homo sapiens
aattctattcaataa

SEQ ID NO: 174390 - DNA, 15 bp, Homo sapiens
caattctattcaata

SEQ ID NO: 174391 - DNA, 15 bp, Homo sapiens
tcaattctattcaat

SEQ ID NO: 174392 - DNA, 15 bp, Homo sapiens
ctcaattctattcaa

SEQ ID NO: 174393 - DNA, 15 bp, Homo sapiens
gctcaattctattca

SEQ ID NO: 174394 - DNA, 15 bp, Homo sapiens
agctcaattctattc

SEQ ID NO: 174395 - DNA, 15 bp, Homo sapiens
cagctcaattctatt

SEQ ID NO: 174396 - DNA, 15 bp, Homo sapiens
ccagctcaattctat

SEQ ID NO: 174397 - DNA, 15 bp, Homo sapiens
tccagctcaattcta

SEQ ID NO: 174398 - DNA, 15 bp, Homo sapiens
ctccagctcaattct

SEQ ID NO: 174399 - DNA, 15 bp, Homo sapiens
tctccagctcaattc

SEQ ID NO: 174400 - DNA, 15 bp, Homo sapiens
ctctccagctcaatt

SEQ ID NO: 174401 - DNA, 15 bp, Homo sapiens
actctccagctcaat

SEQ ID NO: 174402 - DNA, 15 bp, Homo sapiens
aactctccagctcaa

SEQ ID NO: 174403 - DNA, 15 bp, Homo sapiens
aaactctccagctca

SEQ ID NO: 174404 - DNA, 15 bp, Homo sapiens
caaactctccagctc

SEQ ID NO: 174405 - DNA, 15 bp, Homo sapiens
acaaactctccagct

SEQ ID NO: 174406 - DNA, 15 bp, Homo sapiens
aacaaactctccagc

SEQ ID NO: 174407 - DNA, 15 bp, Homo sapiens
taacaaactctccag

SEQ ID NO: 174408 - DNA, 15 bp, Homo sapiens
ataacaaactctcca

SEQ ID NO: 174409 - DNA, 15 bp, Homo sapiens
tataacaaactctcc

SEQ ID NO: 174410 - DNA, 15 bp, Homo sapiens
atataacaaactctc

SEQ ID NO: 174411 - DNA, 15 bp, Homo sapiens
catataacaaactct

SEQ ID NO: 174412 - DNA, 15 bp, Homo sapiens
gcatataacaaactc

SEQ ID NO: 174413 - DNA, 15 bp, Homo sapiens
tgcatataacaaact

SEQ ID NO: 174414 - DNA, 15 bp, Homo sapiens
atgcatataacaaac

SEQ ID NO: 174415 - DNA, 15 bp, Homo sapiens
tatgcatataacaaa

SEQ ID NO: 174416 - DNA, 15 bp, Homo sapiens
atatgcatataacaa

SEQ ID NO: 174417 - DNA, 15 bp, Homo sapiens
aatatgcatataaca

SEQ ID NO: 174418 - DNA, 15 bp, Homo sapiens
aaatatgcatataac

SEQ ID NO: 174419 - DNA, 15 bp, Homo sapiens
taaatatgcatataa

SEQ ID NO: 174420 - DNA, 15 bp, Homo sapiens
ttaaatatgcatata

SEQ ID NO: 174421 - DNA, 15 bp, Homo sapiens
cttaaatatgcatat

SEQ ID NO: 174422 - DNA, 15 bp, Homo sapiens
acttaaatatgcata

SEQ ID NO: 174423 - DNA, 15 bp, Homo sapiens
aacttaaatatgcat

SEQ ID NO: 174424 - DNA, 15 bp, Homo sapiens
taacttaaatatgca

SEQ ID NO: 174425 - DNA, 15 bp, Homo sapiens
gtaacttaaatatgc

SEQ ID NO: 174426 - DNA, 15 bp, Homo sapiens
agtaacttaaatatg

SEQ ID NO: 174427 - DNA, 15 bp, Homo sapiens
gagtaacttaaatat

SEQ ID NO: 174428 - DNA, 15 bp, Homo sapiens
agagtaacttaaata

SEQ ID NO: 174429 - DNA, 15 bp, Homo sapiens
cagagtaacttaaat

SEQ ID NO: 174430 - DNA, 15 bp, Homo sapiens
gcagagtaacttaaa

SEQ ID NO: 174431 - DNA, 15 bp, Homo sapiens
tgcagagtaacttaa

SEQ ID NO: 174432 - DNA, 15 bp, Homo sapiens
atgcagagtaactta

SEQ ID NO: 174433 - DNA, 15 bp, Homo sapiens
tatgcagagtaactt

SEQ ID NO: 174434 - DNA, 15 bp, Homo sapiens
gtatgcagagtaact

SEQ ID NO: 174435 - DNA, 15 bp, Homo sapiens
ggtatgcagagtaac

SEQ ID NO: 174436 - DNA, 15 bp, Homo sapiens
tggtatgcagagtaa

SEQ ID NO: 174437 - DNA, 15 bp, Homo sapiens
atggtatgcagagta

SEQ ID NO: 174438 - DNA, 15 bp, Homo sapiens
aatggtatgcagagt

SEQ ID NO: 174439 - DNA, 15 bp, Homo sapiens
taatggtatgcagag

SEQ ID NO: 174440 - DNA, 15 bp, Homo sapiens
ttaatggtatgcaga

SEQ ID NO: 174441 - DNA, 15 bp, Homo sapiens
attaatggtatgcag

SEQ ID NO: 174442 - DNA, 15 bp, Homo sapiens
tattaatggtatgca

SEQ ID NO: 174443 - DNA, 15 bp, Homo sapiens
atattaatggtatgc

SEQ ID NO: 174444 - DNA, 15 bp, Homo sapiens
catattaatggtatg

SEQ ID NO: 174445 - DNA, 15 bp, Homo sapiens
acatattaatggtat

SEQ ID NO: 174446 - DNA, 15 bp, Homo sapiens
aacatattaatggta

SEQ ID NO: 174447 - DNA, 15 bp, Homo sapiens
aaacatattaatggt

SEQ ID NO: 174448 - DNA, 15 bp, Homo sapiens
gaaacatattaatgg

SEQ ID NO: 174449 - DNA, 15 bp, Homo sapiens
ggaaacatattaatg

SEQ ID NO: 174450 - DNA, 15 bp, Homo sapiens
aggaaacatattaat

SEQ ID NO: 174451 - DNA, 15 bp, Homo sapiens
gaggaaacatattaa

SEQ ID NO: 174452 - DNA, 15 bp, Homo sapiens
cgaggaaacatatta

SEQ ID NO: 174453 - DNA, 15 bp, Homo sapiens
ccgaggaaacatatt

SEQ ID NO: 174454 - DNA, 15 bp, Homo sapiens
accgaggaaacatat

SEQ ID NO: 174455 - DNA, 15 bp, Homo sapiens
aaccgaggaaacata

SEQ ID NO: 174456 - DNA, 15 bp, Homo sapiens
aaaccgaggaaacat

SEQ ID NO: 174457 - DNA, 15 bp, Homo sapiens
caaaccgaggaaaca

SEQ ID NO: 174458 - DNA, 15 bp, Homo sapiens
acaaaccgaggaaac

SEQ ID NO: 174459 - DNA, 15 bp, Homo sapiens
tacaaaccgaggaaa

SEQ ID NO: 174460 - DNA, 15 bp, Homo sapiens
ctacaaaccgaggaa

SEQ ID NO: 174461 - DNA, 15 bp, Homo sapiens
actacaaaccgagga

SEQ ID NO: 174462 - DNA, 15 bp, Homo sapiens
gactacaaaccgagg

SEQ ID NO: 174463 - DNA, 15 bp, Homo sapiens
ggactacaaaccgag

SEQ ID NO: 174464 - DNA, 15 bp, Homo sapiens
aggactacaaaccga

SEQ ID NO: 174465 - DNA, 15 bp, Homo sapiens
caggactacaaaccg

SEQ ID NO: 174466 - DNA, 15 bp, Homo sapiens
tcaggactacaaacc

SEQ ID NO: 174467 - DNA, 15 bp, Homo sapiens
ttcaggactacaaac

SEQ ID NO: 174468 - DNA, 15 bp, Homo sapiens
cttcaggactacaaa

SEQ ID NO: 174469 - DNA, 15 bp, Homo sapiens
tcttcaggactacaa

SEQ ID NO: 174470 - DNA, 15 bp, Homo sapiens
atcttcaggactaca

SEQ ID NO: 174471 - DNA, 15 bp, Homo sapiens
aatcttcaggactac

SEQ ID NO: 174472 - DNA, 15 bp, Homo sapiens
taatcttcaggacta

SEQ ID NO: 174473 - DNA, 15 bp, Homo sapiens
ctaatcttcaggact

SEQ ID NO: 174474 - DNA, 15 bp, Homo sapiens
cctaatcttcaggac

SEQ ID NO: 174475 - DNA, 15 bp, Homo sapiens
gcctaatcttcagga

SEQ ID NO: 174476 - DNA, 15 bp, Homo sapiens
agcctaatcttcagg

SEQ ID NO: 174477 - DNA, 15 bp, Homo sapiens
aagcctaatcttcag

SEQ ID NO: 174478 - DNA, 15 bp, Homo sapiens
caagcctaatcttca

SEQ ID NO: 174479 - DNA, 15 bp, Homo sapiens
tcaagcctaatcttc

SEQ ID NO: 174480 - DNA, 15 bp, Homo sapiens
ctcaagcctaatctt

SEQ ID NO: 174481 - DNA, 15 bp, Homo sapiens
actcaagcctaatct

SEQ ID NO: 174482 - DNA, 15 bp, Homo sapiens
aactcaagcctaatc

SEQ ID NO: 174483 - DNA, 15 bp, Homo sapiens
gaactcaagcctaat

SEQ ID NO: 174484 - DNA, 15 bp, Homo sapiens
tgaactcaagcctaa

SEQ ID NO: 174485 - DNA, 15 bp, Homo sapiens
ctgaactcaagccta

SEQ ID NO: 174486 - DNA, 15 bp, Homo sapiens
actgaactcaagcct

SEQ ID NO: 174487 - DNA, 15 bp, Homo sapiens
tactgaactcaagcc

SEQ ID NO: 174488 - DNA, 15 bp, Homo sapiens
atactgaactcaagc

SEQ ID NO: 174489 - DNA, 15 bp, Homo sapiens
aatactgaactcaag

SEQ ID NO: 174490 - DNA, 15 bp, Homo sapiens
aaatactgaactcaa

SEQ ID NO: 174491 - DNA, 15 bp, Homo sapiens
taaatactgaactca

SEQ ID NO: 174492 - DNA, 15 bp, Homo sapiens
ataaatactgaactc

SEQ ID NO: 174493 - DNA, 15 bp, Homo sapiens
gataaatactgaact

SEQ ID NO: 174494 - DNA, 15 bp, Homo sapiens
agataaatactgaac

SEQ ID NO: 174495 - DNA, 15 bp, Homo sapiens
cagataaatactgaa

SEQ ID NO: 174496 - DNA, 15 bp, Homo sapiens
gcagataaatactga

SEQ ID NO: 174497 - DNA, 15 bp, Homo sapiens
agcagataaatactg

SEQ ID NO: 174498 - DNA, 15 bp, Homo sapiens
aagcagataaatact

SEQ ID NO: 174499 - DNA, 15 bp, Homo sapiens
taagcagataaatac

SEQ ID NO: 174500 - DNA, 15 bp, Homo sapiens
ataagcagataaata

SEQ ID NO: 174501 - DNA, 15 bp, Homo sapiens
cataagcagataaat

SEQ ID NO: 174502 - DNA, 15 bp, Homo sapiens
acataagcagataaa

SEQ ID NO: 174503 - DNA, 15 bp, Homo sapiens
cacataagcagataa

SEQ ID NO: 174504 - DNA, 15 bp, Homo sapiens
acacataagcagata

SEQ ID NO: 174505 - DNA, 15 bp, Homo sapiens
gacacataagcagat

SEQ ID NO: 174506 - DNA, 15 bp, Homo sapiens
ggacacataagcaga

SEQ ID NO: 174507 - DNA, 15 bp, Homo sapiens
aggacacataagcag

SEQ ID NO: 174508 - DNA, 15 bp, Homo sapiens
caggacacataagca

SEQ ID NO: 174509 - DNA, 15 bp, Homo sapiens
acaggacacataagc

SEQ ID NO: 174510 - DNA, 15 bp, Homo sapiens
cacaggacacataag

SEQ ID NO: 174511 - DNA, 15 bp, Homo sapiens
gcacaggacacataa

SEQ ID NO: 174512 - DNA, 15 bp, Homo sapiens
agcacaggacacata

SEQ ID NO: 174513 - DNA, 15 bp, Homo sapiens
cagcacaggacacat

SEQ ID NO: 174514 - DNA, 15 bp, Homo sapiens
gcagcacaggacaca

SEQ ID NO: 174515 - DNA, 15 bp, Homo sapiens
tgcagcacaggacac

SEQ ID NO: 174516 - DNA, 15 bp, Homo sapiens
ttgcagcacaggaca

SEQ ID NO: 174517 - DNA, 15 bp, Homo sapiens
gttgcagcacaggac

SEQ ID NO: 174518 - DNA, 15 bp, Homo sapiens
agttgcagcacagga

SEQ ID NO: 174519 - DNA, 15 bp, Homo sapiens
cagttgcagcacagg

SEQ ID NO: 174520 - DNA, 15 bp, Homo sapiens
acagttgcagcacag

SEQ ID NO: 174521 - DNA, 15 bp, Homo sapiens
gacagttgcagcaca

SEQ ID NO: 174522 - DNA, 15 bp, Homo sapiens
tgacagttgcagcac

SEQ ID NO: 174523 - DNA, 15 bp, Homo sapiens
gtgacagttgcagca

SEQ ID NO: 174524 - DNA, 15 bp, Homo sapiens
ggtgacagttgcagc

SEQ ID NO: 174525 - DNA, 15 bp, Homo sapiens
gggtgacagttgcag

SEQ ID NO: 174526 - DNA, 15 bp, Homo sapiens
agggtgacagttgca

SEQ ID NO: 174527 - DNA, 15 bp, Homo sapiens
gagggtgacagttgc

SEQ ID NO: 174528 - DNA, 15 bp, Homo sapiens
ggagggtgacagttg

SEQ ID NO: 174529 - DNA, 15 bp, Homo sapiens
aggagggtgacagtt

SEQ ID NO: 174530 - DNA, 15 bp, Homo sapiens
aaggagggtgacagt

SEQ ID NO: 174531 - DNA, 15 bp, Homo sapiens
caaggagggtgacag

SEQ ID NO: 174532 - DNA, 15 bp, Homo sapiens
acaaggagggtgaca

SEQ ID NO: 174533 - DNA, 15 bp, Homo sapiens
gacaaggagggtgac

SEQ ID NO: 174534 - DNA, 15 bp, Homo sapiens
ggacaaggagggtga

SEQ ID NO: 174535 - DNA, 15 bp, Homo sapiens
gggacaaggagggtg

SEQ ID NO: 174536 - DNA, 15 bp, Homo sapiens
agggacaaggagggt

SEQ ID NO: 174537 - DNA, 15 bp, Homo sapiens
gagggacaaggaggg

SEQ ID NO: 174538 - DNA, 15 bp, Homo sapiens
tgagggacaaggagg

SEQ ID NO: 174539 - DNA, 15 bp, Homo sapiens
atgagggacaaggag

SEQ ID NO: 174540 - DNA, 15 bp, Homo sapiens
aatgagggacaagga

SEQ ID NO: 174541 - DNA, 15 bp, Homo sapiens
gaatgagggacaagg

SEQ ID NO: 174542 - DNA, 15 bp, Homo sapiens
tgaatgagggacaag

SEQ ID NO: 174543 - DNA, 15 bp, Homo sapiens
ctgaatgagggacaa

SEQ ID NO: 174544 - DNA, 15 bp, Homo sapiens
gctgaatgagggaca

SEQ ID NO: 174545 - DNA, 15 bp, Homo sapiens
ggctgaatgagggac

SEQ ID NO: 174546 - DNA, 15 bp, Homo sapiens
gggctgaatgaggga

SEQ ID NO: 174547 - DNA, 15 bp, Homo sapiens
agggctgaatgaggg

SEQ ID NO: 174548 - DNA, 15 bp, Homo sapiens
cagggctgaatgagg

SEQ ID NO: 174549 - DNA, 15 bp, Homo sapiens
gcagggctgaatgag

SEQ ID NO: 174550 - DNA, 15 bp, Homo sapiens
agcagggctgaatga

SEQ ID NO: 174551 - DNA, 15 bp, Homo sapiens
gagcagggctgaatg

SEQ ID NO: 174552 - DNA, 15 bp, Homo sapiens
agagcagggctgaat

SEQ ID NO: 174553 - DNA, 15 bp, Homo sapiens
aagagcagggctgaa

SEQ ID NO: 174554 - DNA, 15 bp, Homo sapiens
aaagagcagggctga

SEQ ID NO: 174555 - DNA, 15 bp, Homo sapiens
gaaagagcagggctg

SEQ ID NO: 174556 - DNA, 15 bp, Homo sapiens
tgaaagagcagggct

SEQ ID NO: 174557 - DNA, 15 bp, Homo sapiens
gtgaaagagcagggc

SEQ ID NO: 174558 - DNA, 15 bp, Homo sapiens
tgtgaaagagcaggg

SEQ ID NO: 174559 - DNA, 15 bp, Homo sapiens
ttgtgaaagagcagg

SEQ ID NO: 174560 - DNA, 15 bp, Homo sapiens
attgtgaaagagcag

SEQ ID NO: 174561 - DNA, 15 bp, Homo sapiens
tattgtgaaagagca

SEQ ID NO: 174562 - DNA, 15 bp, Homo sapiens
ttattgtgaaagagc

SEQ ID NO: 174563 - DNA, 15 bp, Homo sapiens
gttattgtgaaagag

SEQ ID NO: 174564 - DNA, 15 bp, Homo sapiens
ggttattgtgaaaga

SEQ ID NO: 174565 - DNA, 15 bp, Homo sapiens
tggttattgtgaaag

SEQ ID NO: 174566 - DNA, 15 bp, Homo sapiens
gtggttattgtgaaa

SEQ ID NO: 174567 - DNA, 15 bp, Homo sapiens
ggtggttattgtgaa

SEQ ID NO: 174568 - DNA, 15 bp, Homo sapiens
gggtggttattgtga

SEQ ID NO: 174569 - DNA, 15 bp, Homo sapiens
ggggtggttattgtg

SEQ ID NO: 174570 - DNA, 15 bp, Homo sapiens
tggggtggttattgt

SEQ ID NO: 174571 - DNA, 15 bp, Homo sapiens
ttggggtggttattg

SEQ ID NO: 174572 - DNA, 15 bp, Homo sapiens
cttggggtggttatt

SEQ ID NO: 174573 - DNA, 15 bp, Homo sapiens
tcttggggtggttat

SEQ ID NO: 174574 - DNA, 15 bp, Homo sapiens
ttcttggggtggtta

SEQ ID NO: 174575 - DNA, 15 bp, Homo sapiens
cttcttggggtggtt

SEQ ID NO: 174576 - DNA, 15 bp, Homo sapiens
tcttcttggggtggt

SEQ ID NO: 174577 - DNA, 15 bp, Homo sapiens
gtcttcttggggtgg

SEQ ID NO: 174578 - DNA, 15 bp, Homo sapiens
agtcttcttggggtg

SEQ ID NO: 174579 - DNA, 15 bp, Homo sapiens
aagtcttcttggggt

SEQ ID NO: 174580 - DNA, 15 bp, Homo sapiens
aaagtcttcttgggg

SEQ ID NO: 174581 - DNA, 15 bp, Homo sapiens
aaaagtcttcttggg

SEQ ID NO: 174582 - DNA, 15 bp, Homo sapiens
gaaaagtcttcttgg

SEQ ID NO: 174583 - DNA, 15 bp, Homo sapiens
tgaaaagtcttcttg

SEQ ID NO: 174584 - DNA, 15 bp, Homo sapiens
ctgaaaagtcttctt

SEQ ID NO: 174585 - DNA, 15 bp, Homo sapiens
tctgaaaagtcttct

SEQ ID NO: 174586 - DNA, 15 bp, Homo sapiens
atctgaaaagtcttc

SEQ ID NO: 174587 - DNA, 15 bp, Homo sapiens
aatctgaaaagtctt

SEQ ID NO: 174588 - DNA, 15 bp, Homo sapiens
aaatctgaaaagtct

SEQ ID NO: 174589 - DNA, 15 bp, Homo sapiens
aaaatctgaaaagtc

SEQ ID NO: 174590 - DNA, 15 bp, Homo sapiens
aaaaatctgaaaagt

SEQ ID NO: 174591 - DNA, 15 bp, Homo sapiens
aaaaaatctgaaaag

SEQ ID NO: 174592 - DNA, 15 bp, Homo sapiens
aaaaaaatctgaaaa

SEQ ID NO: 174593 - DNA, 15 bp, Homo sapiens
aaaaaaaatctgaaa

SEQ ID NO: 174594 - DNA, 15 bp, Homo sapiens
aaaaaaaaatctgaa

SEQ ID NO: 174595 - DNA, 15 bp, Homo sapiens
gaaaaaaaaatctga

SEQ ID NO: 174596 - DNA, 15 bp, Homo sapiens
tgaaaaaaaaatctg

SEQ ID NO: 174597 - DNA, 15 bp, Homo sapiens
atgaaaaaaaaatct

SEQ ID NO: 174598 - DNA, 15 bp, Homo sapiens
gatgaaaaaaaaatc

SEQ ID NO: 174599 - DNA, 15 bp, Homo sapiens
agatgaaaaaaaaat

SEQ ID NO: 174600 - DNA, 15 bp, Homo sapiens
cagatgaaaaaaaaa

SEQ ID NO: 174601 - DNA, 15 bp, Homo sapiens
gcagatgaaaaaaaa

SEQ ID NO: 174602 - DNA, 15 bp, Homo sapiens
tgcagatgaaaaaaa

SEQ ID NO: 174603 - DNA, 15 bp, Homo sapiens
atgcagatgaaaaaa

SEQ ID NO: 174604 - DNA, 15 bp, Homo sapiens
catgcagatgaaaaa

SEQ ID NO: 174605 - DNA, 15 bp, Homo sapiens
acatgcagatgaaaa

SEQ ID NO: 174606 - DNA, 15 bp, Homo sapiens
tacatgcagatgaaa

SEQ ID NO: 174607 - DNA, 15 bp, Homo sapiens
ttacatgcagatgaa

SEQ ID NO: 174608 - DNA, 15 bp, Homo sapiens
tttacatgcagatga

SEQ ID NO: 174609 - DNA, 15 bp, Homo sapiens
ttttacatgcagatg

SEQ ID NO: 174610 - DNA, 15 bp, Homo sapiens
tttttacatgcagat

SEQ ID NO: 174611 - DNA, 15 bp, Homo sapiens
ttttttacatgcaga

SEQ ID NO: 174612 - DNA, 15 bp, Homo sapiens
tttttttacatgcag

SEQ ID NO: 174613 - DNA, 15 bp, Homo sapiens
ttttttttacatgca

SEQ ID NO: 174614 - DNA, 15 bp, Homo sapiens
cttttttttacatgc

SEQ ID NO: 174615 - DNA, 15 bp, Homo sapiens
tcttttttttacatg

SEQ ID NO: 174616 - DNA, 15 bp, Homo sapiens
ttcttttttttacat

SEQ ID NO: 174617 - DNA, 15 bp, Homo sapiens
cttcttttttttaca

SEQ ID NO: 174618 - DNA, 15 bp, Homo sapiens
tcttcttttttttac

SEQ ID NO: 174619 - DNA, 15 bp, Homo sapiens
ttcttctttttttta

SEQ ID NO: 174620 - DNA, 15 bp, Homo sapiens
cttcttctttttttt

SEQ ID NO: 174621 - DNA, 15 bp, Homo sapiens
tcttcttcttttttt

SEQ ID NO: 174622 - DNA, 15 bp, Homo sapiens
ttcttcttctttttt

SEQ ID NO: 174623 - DNA, 15 bp, Homo sapiens
tttcttcttcttttt

SEQ ID NO: 174624 - DNA, 15 bp, Homo sapiens
ctttcttcttctttt

SEQ ID NO: 174625 - DNA, 15 bp, Homo sapiens
tctttcttcttcttt

SEQ ID NO: 174626 - DNA, 15 bp, Homo sapiens
ttctttcttcttctt

SEQ ID NO: 174627 - DNA, 15 bp, Homo sapiens
cttctttcttcttct

SEQ ID NO: 174628 - DNA, 15 bp, Homo sapiens
tcttctttcttcttc

SEQ ID NO: 174629 - DNA, 15 bp, Homo sapiens
atcttctttcttctt

SEQ ID NO: 174630 - DNA, 15 bp, Homo sapiens
tatcttctttcttct

SEQ ID NO: 174631 - DNA, 15 bp, Homo sapiens
gtatcttctttcttc

SEQ ID NO: 174632 - DNA, 15 bp, Homo sapiens
agtatcttctttctt

SEQ ID NO: 174633 - DNA, 15 bp, Homo sapiens
aagtatcttctttct

SEQ ID NO: 174634 - DNA, 15 bp, Homo sapiens
aaagtatcttctttc

SEQ ID NO: 174635 - DNA, 15 bp, Homo sapiens
aaaagtatcttcttt

SEQ ID NO: 174636 - DNA, 15 bp, Homo sapiens
taaaagtatcttctt

SEQ ID NO: 174637 - DNA, 15 bp, Homo sapiens
ataaaagtatcttct

SEQ ID NO: 174638 - DNA, 15 bp, Homo sapiens
aataaaagtatcttc

SEQ ID NO: 174639 - DNA, 15 bp, Homo sapiens
taataaaagtatctt

SEQ ID NO: 174640 - DNA, 15 bp, Homo sapiens
ataataaaagtatct

SEQ ID NO: 174641 - DNA, 15 bp, Homo sapiens
aataataaaagtatc

SEQ ID NO: 174642 - DNA, 15 bp, Homo sapiens
aaataataaaagtat

SEQ ID NO: 174643 - DNA, 15 bp, Homo sapiens
aaaataataaaagta

SEQ ID NO: 174644 - DNA, 15 bp, Homo sapiens
caaaataataaaagt

SEQ ID NO: 174645 - DNA, 15 bp, Homo sapiens
ccaaaataataaaag

SEQ ID NO: 174646 - DNA, 15 bp, Homo sapiens
accaaaataataaaa

SEQ ID NO: 174647 - DNA, 15 bp, Homo sapiens
aaccaaaataataaa

SEQ ID NO: 174648 - DNA, 15 bp, Homo sapiens
aaaccaaaataataa

SEQ ID NO: 174649 - DNA, 15 bp, Homo sapiens
aaaaccaaaataata

SEQ ID NO: 174650 - DNA, 15 bp, Homo sapiens
caaaaccaaaataat

SEQ ID NO: 174651 - DNA, 15 bp, Homo sapiens
ccaaaaccaaaataa

SEQ ID NO: 174652 - DNA, 15 bp, Homo sapiens
accaaaaccaaaata

SEQ ID NO: 174653 - DNA, 15 bp, Homo sapiens
aaccaaaaccaaaat

SEQ ID NO: 174654 - DNA, 15 bp, Homo sapiens
gaaccaaaaccaaaa

SEQ ID NO: 174655 - DNA, 15 bp, Homo sapiens
agaaccaaaaccaaa

SEQ ID NO: 174656 - DNA, 15 bp, Homo sapiens
aagaaccaaaaccaa

SEQ ID NO: 174657 - DNA, 15 bp, Homo sapiens
gaagaaccaaaacca

SEQ ID NO: 174658 - DNA, 15 bp, Homo sapiens
agaagaaccaaaacc

SEQ ID NO: 174659 - DNA, 15 bp, Homo sapiens
gagaagaaccaaaac

SEQ ID NO: 174660 - DNA, 15 bp, Homo sapiens
agagaagaaccaaaa

SEQ ID NO: 174661 - DNA, 15 bp, Homo sapiens
gagagaagaaccaaa

SEQ ID NO: 174662 - DNA, 15 bp, Homo sapiens
agagagaagaaccaa

SEQ ID NO: 174663 - DNA, 15 bp, Homo sapiens
aagagagaagaacca

SEQ ID NO: 174664 - DNA, 15 bp, Homo sapiens
gaagagagaagaacc

SEQ ID NO: 174665 - DNA, 15 bp, Homo sapiens
ggaagagagaagaac

SEQ ID NO: 174666 - DNA, 15 bp, Homo sapiens
gggaagagagaagaa

SEQ ID NO: 174667 - DNA, 15 bp, Homo sapiens
agggaagagagaaga

SEQ ID NO: 174668 - DNA, 15 bp, Homo sapiens
cagggaagagagaag

SEQ ID NO: 174669 - DNA, 15 bp, Homo sapiens
gcagggaagagagaa

SEQ ID NO: 174670 - DNA, 15 bp, Homo sapiens
agcagggaagagaga

SEQ ID NO: 174671 - DNA, 15 bp, Homo sapiens
aagcagggaagagag

SEQ ID NO: 174672 - DNA, 15 bp, Homo sapiens
aaagcagggaagaga

SEQ ID NO: 174673 - DNA, 15 bp, Homo sapiens
caaagcagggaagag

SEQ ID NO: 174674 - DNA, 15 bp, Homo sapiens
gcaaagcagggaaga

SEQ ID NO: 174675 - DNA, 15 bp, Homo sapiens
ggcaaagcagggaag

SEQ ID NO: 174676 - DNA, 15 bp, Homo sapiens
aggcaaagcagggaa

SEQ ID NO: 174677 - DNA, 15 bp, Homo sapiens
aaggcaaagcaggga

SEQ ID NO: 174678 - DNA, 15 bp, Homo sapiens
gaaggcaaagcaggg

SEQ ID NO: 174679 - DNA, 15 bp, Homo sapiens
ggaaggcaaagcagg

SEQ ID NO: 174680 - DNA, 15 bp, Homo sapiens
gggaaggcaaagcag

SEQ ID NO: 174681 - DNA, 15 bp, Homo sapiens
agggaaggcaaagca

SEQ ID NO: 174682 - DNA, 15 bp, Homo sapiens
aagggaaggcaaagc

SEQ ID NO: 174683 - DNA, 15 bp, Homo sapiens
gaagggaaggcaaag

SEQ ID NO: 174684 - DNA, 15 bp, Homo sapiens
tgaagggaaggcaaa

SEQ ID NO: 174685 - DNA, 15 bp, Homo sapiens
atgaagggaaggcaa

SEQ ID NO: 174686 - DNA, 15 bp, Homo sapiens
tatgaagggaaggca

SEQ ID NO: 174687 - DNA, 15 bp, Homo sapiens
gtatgaagggaaggc

SEQ ID NO: 174688 - DNA, 15 bp, Homo sapiens
tgtatgaagggaagg

SEQ ID NO: 174689 - DNA, 15 bp, Homo sapiens
atgtatgaagggaag

SEQ ID NO: 174690 - DNA, 15 bp, Homo sapiens
catgtatgaagggaa

SEQ ID NO: 174691 - DNA, 15 bp, Homo sapiens
gcatgtatgaaggga

SEQ ID NO: 174692 - DNA, 15 bp, Homo sapiens
tgcatgtatgaaggg

SEQ ID NO: 174693 - DNA, 15 bp, Homo sapiens
ctgcatgtatgaagg

SEQ ID NO: 174694 - DNA, 15 bp, Homo sapiens
actgcatgtatgaag

SEQ ID NO: 174695 - DNA, 15 bp, Homo sapiens
cactgcatgtatgaa

SEQ ID NO: 174696 - DNA, 15 bp, Homo sapiens
ccactgcatgtatga

SEQ ID NO: 174697 - DNA, 15 bp, Homo sapiens
accactgcatgtatg

SEQ ID NO: 174698 - DNA, 15 bp, Homo sapiens
taccactgcatgtat

SEQ ID NO: 174699 - DNA, 15 bp, Homo sapiens
ataccactgcatgta

SEQ ID NO: 174700 - DNA, 15 bp, Homo sapiens
aataccactgcatgt

SEQ ID NO: 174701 - DNA, 15 bp, Homo sapiens
taataccactgcatg

SEQ ID NO: 174702 - DNA, 15 bp, Homo sapiens
ctaataccactgcat

SEQ ID NO: 174703 - DNA, 15 bp, Homo sapiens
gctaataccactgca

SEQ ID NO: 174704 - DNA, 15 bp, Homo sapiens
cgctaataccactgc

SEQ ID NO: 174705 - DNA, 15 bp, Homo sapiens
ccgctaataccactg

SEQ ID NO: 174706 - DNA, 15 bp, Homo sapiens
accgctaataccact

SEQ ID NO: 174707 - DNA, 15 bp, Homo sapiens
gaccgctaataccac

SEQ ID NO: 174708 - DNA, 15 bp, Homo sapiens
tgaccgctaatacca

SEQ ID NO: 174709 - DNA, 15 bp, Homo sapiens
atgaccgctaatacc

SEQ ID NO: 174710 - DNA, 15 bp, Homo sapiens
catgaccgctaatac

SEQ ID NO: 174711 - DNA, 15 bp, Homo sapiens
acatgaccgctaata

SEQ ID NO: 174712 - DNA, 15 bp, Homo sapiens
gacatgaccgctaat

SEQ ID NO: 174713 - DNA, 15 bp, Homo sapiens
ggacatgaccgctaa

SEQ ID NO: 174714 - DNA, 15 bp, Homo sapiens
gggacatgaccgcta

SEQ ID NO: 174715 - DNA, 15 bp, Homo sapiens
ggggacatgaccgct

SEQ ID NO: 174716 - DNA, 15 bp, Homo sapiens
aggggacatgaccgc

SEQ ID NO: 174717 - DNA, 15 bp, Homo sapiens
caggggacatgaccg

SEQ ID NO: 174718 - DNA, 15 bp, Homo sapiens
tcaggggacatgacc

SEQ ID NO: 174719 - DNA, 15 bp, Homo sapiens
gtcaggggacatgac

SEQ ID NO: 174720 - DNA, 15 bp, Homo sapiens
ggtcaggggacatga

SEQ ID NO: 174721 - DNA, 15 bp, Homo sapiens
aggtcaggggacatg

SEQ ID NO: 174722 - DNA, 15 bp, Homo sapiens
aaggtcaggggacat

SEQ ID NO: 174723 - DNA, 15 bp, Homo sapiens
caaggtcaggggaca

SEQ ID NO: 174724 - DNA, 15 bp, Homo sapiens
ccaaggtcaggggac

SEQ ID NO: 174725 - DNA, 15 bp, Homo sapiens
accaaggtcagggga

SEQ ID NO: 174726 - DNA, 15 bp, Homo sapiens
aaccaaggtcagggg

SEQ ID NO: 174727 - DNA, 15 bp, Homo sapiens
caaccaaggtcaggg

SEQ ID NO: 174728 - DNA, 15 bp, Homo sapiens
tcaaccaaggtcagg

SEQ ID NO: 174729 - DNA, 15 bp, Homo sapiens
ctcaaccaaggtcag

SEQ ID NO: 174730 - DNA, 15 bp, Homo sapiens
cctcaaccaaggtca

SEQ ID NO: 174731 - DNA, 15 bp, Homo sapiens
gcctcaaccaaggtc

SEQ ID NO: 174732 - DNA, 15 bp, Homo sapiens
tgcctcaaccaaggt

SEQ ID NO: 174733 - DNA, 15 bp, Homo sapiens
ttgcctcaaccaagg

SEQ ID NO: 174734 - DNA, 15 bp, Homo sapiens
tttgcctcaaccaag

SEQ ID NO: 174735 - DNA, 15 bp, Homo sapiens
ctttgcctcaaccaa

SEQ ID NO: 174736 - DNA, 15 bp, Homo sapiens
gctttgcctcaacca

SEQ ID NO: 174737 - DNA, 15 bp, Homo sapiens
tgctttgcctcaacc

SEQ ID NO: 174738 - DNA, 15 bp, Homo sapiens
ctgctttgcctcaac

SEQ ID NO: 174739 - DNA, 15 bp, Homo sapiens
tctgctttgcctcaa

SEQ ID NO: 174740 - DNA, 15 bp, Homo sapiens
ctctgctttgcctca

SEQ ID NO: 174741 - DNA, 15 bp, Homo sapiens
cctctgctttgcctc

SEQ ID NO: 174742 - DNA, 15 bp, Homo sapiens
ccctctgctttgcct

SEQ ID NO: 174743 - DNA, 15 bp, Homo sapiens
accctctgctttgcc

SEQ ID NO: 174744 - DNA, 15 bp, Homo sapiens
caccctctgctttgc

SEQ ID NO: 174745 - DNA, 15 bp, Homo sapiens
acaccctctgctttg

SEQ ID NO: 174746 - DNA, 15 bp, Homo sapiens
gacaccctctgcttt

SEQ ID NO: 174747 - DNA, 15 bp, Homo sapiens
tgacaccctctgctt

SEQ ID NO: 174748 - DNA, 15 bp, Homo sapiens
atgacaccctctgct

SEQ ID NO: 174749 - DNA, 15 bp, Homo sapiens
tatgacaccctctgc

SEQ ID NO: 174750 - DNA, 15 bp, Homo sapiens
atatgacaccctctg

SEQ ID NO: 174751 - DNA, 15 bp, Homo sapiens
gatatgacaccctct

SEQ ID NO: 174752 - DNA, 15 bp, Homo sapiens
tgatatgacaccctc

SEQ ID NO: 174753 - DNA, 15 bp, Homo sapiens
ctgatatgacaccct

SEQ ID NO: 174754 - DNA, 15 bp, Homo sapiens
actgatatgacaccc

SEQ ID NO: 174755 - DNA, 15 bp, Homo sapiens
aactgatatgacacc

SEQ ID NO: 174756 - DNA, 15 bp, Homo sapiens
caactgatatgacac

SEQ ID NO: 174757 - DNA, 15 bp, Homo sapiens
gcaactgatatgaca

SEQ ID NO: 174758 - DNA, 15 bp, Homo sapiens
tgcaactgatatgac

SEQ ID NO: 174759 - DNA, 15 bp, Homo sapiens
ctgcaactgatatga

SEQ ID NO: 174760 - DNA, 15 bp, Homo sapiens
actgcaactgatatg

SEQ ID NO: 174761 - DNA, 15 bp, Homo sapiens
cactgcaactgatat

SEQ ID NO: 174762 - DNA, 15 bp, Homo sapiens
ccactgcaactgata

SEQ ID NO: 174763 - DNA, 15 bp, Homo sapiens
tccactgcaactgat

SEQ ID NO: 174764 - DNA, 15 bp, Homo sapiens
ttccactgcaactga

SEQ ID NO: 174765 - DNA, 15 bp, Homo sapiens
tttccactgcaactg

SEQ ID NO: 174766 - DNA, 15 bp, Homo sapiens
ctttccactgcaact

SEQ ID NO: 174767 - DNA, 15 bp, Homo sapiens
tctttccactgcaac

SEQ ID NO: 174768 - DNA, 15 bp, Homo sapiens
atctttccactgcaa

SEQ ID NO: 174769 - DNA, 15 bp, Homo sapiens
gatctttccactgca

SEQ ID NO: 174770 - DNA, 15 bp, Homo sapiens
ggatctttccactgc

SEQ ID NO: 174771 - DNA, 15 bp, Homo sapiens
aggatctttccactg

SEQ ID NO: 174772 - DNA, 15 bp, Homo sapiens
aaggatctttccact

SEQ ID NO: 174773 - DNA, 15 bp, Homo sapiens
gaaggatctttccac

SEQ ID NO: 174774 - DNA, 15 bp, Homo sapiens
agaaggatctttcca

SEQ ID NO: 174775 - DNA, 15 bp, Homo sapiens
gagaaggatctttcc

SEQ ID NO: 174776 - DNA, 15 bp, Homo sapiens
agagaaggatctttc

SEQ ID NO: 174777 - DNA, 15 bp, Homo sapiens
cagagaaggatcttt

SEQ ID NO: 174778 - DNA, 15 bp, Homo sapiens
acagagaaggatctt

SEQ ID NO: 174779 - DNA, 15 bp, Homo sapiens
gacagagaaggatct

SEQ ID NO: 174780 - DNA, 15 bp, Homo sapiens
ggacagagaaggatc

SEQ ID NO: 174781 - DNA, 15 bp, Homo sapiens
aggacagagaaggat

SEQ ID NO: 174782 - DNA, 15 bp, Homo sapiens
aaggacagagaagga

SEQ ID NO: 174783 - DNA, 15 bp, Homo sapiens
caaggacagagaagg

SEQ ID NO: 174784 - DNA, 15 bp, Homo sapiens
acaaggacagagaag

SEQ ID NO: 174785 - DNA, 15 bp, Homo sapiens
gacaaggacagagaa

SEQ ID NO: 174786 - DNA, 15 bp, Homo sapiens
agacaaggacagaga

SEQ ID NO: 174787 - DNA, 15 bp, Homo sapiens
cagacaaggacagag

SEQ ID NO: 174788 - DNA, 15 bp, Homo sapiens
acagacaaggacaga

SEQ ID NO: 174789 - DNA, 15 bp, Homo sapiens
tacagacaaggacag

SEQ ID NO: 174790 - DNA, 15 bp, Homo sapiens
ctacagacaaggaca

SEQ ID NO: 174791 - DNA, 15 bp, Homo sapiens
gctacagacaaggac

SEQ ID NO: 174792 - DNA, 15 bp, Homo sapiens
agctacagacaagga

SEQ ID NO: 174793 - DNA, 15 bp, Homo sapiens
cagctacagacaagg

SEQ ID NO: 174794 - DNA, 15 bp, Homo sapiens
tcagctacagacaag

SEQ ID NO: 174795 - DNA, 15 bp, Homo sapiens
ttcagctacagacaa

SEQ ID NO: 174796 - DNA, 15 bp, Homo sapiens
gttcagctacagaca

SEQ ID NO: 174797 - DNA, 15 bp, Homo sapiens
ggttcagctacagac

SEQ ID NO: 174798 - DNA, 15 bp, Homo sapiens
aggttcagctacaga

SEQ ID NO: 174799 - DNA, 15 bp, Homo sapiens
caggttcagctacag

SEQ ID NO: 174800 - DNA, 15 bp, Homo sapiens
gcaggttcagctaca

SEQ ID NO: 174801 - DNA, 15 bp, Homo sapiens
agcaggttcagctac

SEQ ID NO: 174802 - DNA, 15 bp, Homo sapiens
tagcaggttcagcta

SEQ ID NO: 174803 - DNA, 15 bp, Homo sapiens
ttagcaggttcagct

SEQ ID NO: 174804 - DNA, 15 bp, Homo sapiens
cttagcaggttcagc

SEQ ID NO: 174805 - DNA, 15 bp, Homo sapiens
acttagcaggttcag

SEQ ID NO: 174806 - DNA, 15 bp, Homo sapiens
cacttagcaggttca

SEQ ID NO: 174807 - DNA, 15 bp, Homo sapiens
tcacttagcaggttc

SEQ ID NO: 174808 - DNA, 15 bp, Homo sapiens
atcacttagcaggtt

SEQ ID NO: 174809 - DNA, 15 bp, Homo sapiens
tatcacttagcaggt

SEQ ID NO: 174810 - DNA, 15 bp, Homo sapiens
atatcacttagcagg

SEQ ID NO: 174811 - DNA, 15 bp, Homo sapiens
aatatcacttagcag

SEQ ID NO: 174812 - DNA, 15 bp, Homo sapiens
gaatatcacttagca

SEQ ID NO: 174813 - DNA, 15 bp, Homo sapiens
ggaatatcacttagc

SEQ ID NO: 174814 - DNA, 15 bp, Homo sapiens
gggaatatcacttag

SEQ ID NO: 174815 - DNA, 15 bp, Homo sapiens
agggaatatcactta

SEQ ID NO: 174816 - DNA, 15 bp, Homo sapiens
aagggaatatcactt

SEQ ID NO: 174817 - DNA, 15 bp, Homo sapiens
gaagggaatatcact

SEQ ID NO: 174818 - DNA, 15 bp, Homo sapiens
agaagggaatatcac

SEQ ID NO: 174819 - DNA, 15 bp, Homo sapiens
tagaagggaatatca

SEQ ID NO: 174820 - DNA, 15 bp, Homo sapiens
ctagaagggaatatc

SEQ ID NO: 174821 - DNA, 15 bp, Homo sapiens
actagaagggaatat

SEQ ID NO: 174822 - DNA, 15 bp, Homo sapiens
tactagaagggaata

SEQ ID NO: 174823 - DNA, 15 bp, Homo sapiens
atactagaagggaat

SEQ ID NO: 174824 - DNA, 15 bp, Homo sapiens
catactagaagggaa

SEQ ID NO: 174825 - DNA, 15 bp, Homo sapiens
tcatactagaaggga

SEQ ID NO: 174826 - DNA, 15 bp, Homo sapiens
ctcatactagaaggg

SEQ ID NO: 174827 - DNA, 15 bp, Homo sapiens
cctcatactagaagg

SEQ ID NO: 174828 - DNA, 15 bp, Homo sapiens
tcctcatactagaag

SEQ ID NO: 174829 - DNA, 15 bp, Homo sapiens
atcctcatactagaa

SEQ ID NO: 174830 - DNA, 15 bp, Homo sapiens
catcctcatactaga

SEQ ID NO: 174831 - DNA, 15 bp, Homo sapiens
ccatcctcatactag

SEQ ID NO: 174832 - DNA, 15 bp, Homo sapiens
tccatcctcatacta

SEQ ID NO: 174833 - DNA, 15 bp, Homo sapiens
ctccatcctcatact

SEQ ID NO: 174834 - DNA, 15 bp, Homo sapiens
actccatcctcatac

SEQ ID NO: 174835 - DNA, 15 bp, Homo sapiens
tactccatcctcata

SEQ ID NO: 174836 - DNA, 15 bp, Homo sapiens
gtactccatcctcat

SEQ ID NO: 174837 - DNA, 15 bp, Homo sapiens
tgtactccatcctca

SEQ ID NO: 174838 - DNA, 15 bp, Homo sapiens
ttgtactccatcctc

SEQ ID NO: 174839 - DNA, 15 bp, Homo sapiens
cttgtactccatcct

SEQ ID NO: 174840 - DNA, 15 bp, Homo sapiens
acttgtactccatcc

SEQ ID NO: 174841 - DNA, 15 bp, Homo sapiens
aacttgtactccatc

SEQ ID NO: 174842 - DNA, 15 bp, Homo sapiens
aaacttgtactccat

SEQ ID NO: 174843 - DNA, 15 bp, Homo sapiens
aaaacttgtactcca

SEQ ID NO: 174844 - DNA, 15 bp, Homo sapiens
aaaaacttgtactcc

SEQ ID NO: 174845 - DNA, 15 bp, Homo sapiens
caaaaacttgtactc

SEQ ID NO: 174846 - DNA, 15 bp, Homo sapiens
tcaaaaacttgtact

SEQ ID NO: 174847 - DNA, 15 bp, Homo sapiens
ctcaaaaacttgtac

SEQ ID NO: 174848 - DNA, 15 bp, Homo sapiens
cctcaaaaacttgta

SEQ ID NO: 174849 - DNA, 15 bp, Homo sapiens
acctcaaaaacttgt

SEQ ID NO: 174850 - DNA, 15 bp, Homo sapiens
aacctcaaaaacttg

SEQ ID NO: 174851 - DNA, 15 bp, Homo sapiens
caacctcaaaaactt

SEQ ID NO: 174852 - DNA, 15 bp, Homo sapiens
gcaacctcaaaaact

SEQ ID NO: 174853 - DNA, 15 bp, Homo sapiens
tgcaacctcaaaaac

SEQ ID NO: 174854 - DNA, 15 bp, Homo sapiens
gcaatgcaacctcaa

SEQ ID NO: 174855 - DNA, 15 bp, Homo sapiens
agcaatgcaacctca

SEQ ID NO: 174856 - DNA, 15 bp, Homo sapiens
cagcaatgcaacctc

SEQ ID NO: 174857 - DNA, 15 bp, Homo sapiens
tcagcaatgcaacct

SEQ ID NO: 174858 - DNA, 15 bp, Homo sapiens
ttcagcaatgcaacc

SEQ ID NO: 174859 - DNA, 15 bp, Homo sapiens
cttcagcaatgcaac

SEQ ID NO: 174860 - DNA, 15 bp, Homo sapiens
ccttcagcaatgcaa

SEQ ID NO: 174861 - DNA, 15 bp, Homo sapiens
accttcagcaatgca

SEQ ID NO: 174862 - DNA, 15 bp, Homo sapiens
taccttcagcaatgc

SEQ ID NO: 174863 - DNA, 15 bp, Homo sapiens
ttaccttcagcaatg

SEQ ID NO: 174864 - DNA, 15 bp, Homo sapiens
tttaccttcagcaat

SEQ ID NO: 174865 - DNA, 15 bp, Homo sapiens
ttttaccttcagcaa

SEQ ID NO: 174866 - DNA, 15 bp, Homo sapiens
gttttaccttcagca

SEQ ID NO: 174867 - DNA, 15 bp, Homo sapiens
ggttttaccttcagc

SEQ ID NO: 174868 - DNA, 15 bp, Homo sapiens
tggttttaccttcag

SEQ ID NO: 174869 - DNA, 15 bp, Homo sapiens
ttggttttaccttca

SEQ ID NO: 174870 - DNA, 15 bp, Homo sapiens
tttggttttaccttc

SEQ ID NO: 174871 - DNA, 15 bp, Homo sapiens
ttttggttttacctt

SEQ ID NO: 174872 - DNA, 15 bp, Homo sapiens
cttttggttttacct

SEQ ID NO: 174873 - DNA, 15 bp, Homo sapiens
tcttttggttttacc

SEQ ID NO: 174874 - DNA, 15 bp, Homo sapiens
ctcttttggttttac

SEQ ID NO: 174875 - DNA, 15 bp, Homo sapiens
tctcttttggtttta

SEQ ID NO: 174876 - DNA, 15 bp, Homo sapiens
ctctcttttggtttt

SEQ ID NO: 174877 - DNA, 15 bp, Homo sapiens
tctctctcttttggt

SEQ ID NO: 174878 - DNA, 15 bp, Homo sapiens
ctctctctcttttgg

SEQ ID NO: 174879 - DNA, 15 bp, Homo sapiens
tctctctctcttttg

SEQ ID NO: 174880 - DNA, 15 bp, Homo sapiens
ttctctctctctctc

SEQ ID NO: 174881 - DNA, 15 bp, Homo sapiens
tttctctctctctct

SEQ ID NO: 174882 - DNA, 15 bp, Homo sapiens
ctttctctctctctc

SEQ ID NO: 174883 - DNA, 15 bp, Homo sapiens
tctttctctctctct

SEQ ID NO: 174884 - DNA, 15 bp, Homo sapiens
ctctttctctctctc

SEQ ID NO: 174885 - DNA, 15 bp, Homo sapiens
tctctttctctctct

SEQ ID NO: 174886 - DNA, 15 bp, Homo sapiens
ctctctttctctctc

SEQ ID NO: 174887 - DNA, 15 bp, Homo sapiens
tctctctttctctct

SEQ ID NO: 174888 - DNA, 15 bp, Homo sapiens
ctctctctttctctc

SEQ ID NO: 174889 - DNA, 15 bp, Homo sapiens
actctctctttctct

SEQ ID NO: 174890 - DNA, 15 bp, Homo sapiens
cactctctctttctc

SEQ ID NO: 174891 - DNA, 15 bp, Homo sapiens
tcactctctctttct

SEQ ID NO: 174892 - DNA, 15 bp, Homo sapiens
ctcactctctctttc

SEQ ID NO: 174893 - DNA, 15 bp, Homo sapiens
actcactctctcttt

SEQ ID NO: 174894 - DNA, 15 bp, Homo sapiens
cactcactctctctt

SEQ ID NO: 174895 - DNA, 15 bp, Homo sapiens
acactcactctctct

SEQ ID NO: 174896 - DNA, 15 bp, Homo sapiens
cacactcactctctc

SEQ ID NO: 174897 - DNA, 15 bp, Homo sapiens
acacactcactctct

SEQ ID NO: 174898 - DNA, 15 bp, Homo sapiens
cacacactcactctc

SEQ ID NO: 174899 - DNA, 15 bp, Homo sapiens
acacacactcactct

SEQ ID NO: 174900 - DNA, 15 bp, Homo sapiens
cacacacactcactc

SEQ ID NO: 174901 - DNA, 15 bp, Homo sapiens
acacacacactcact

SEQ ID NO: 174902 - DNA, 15 bp, Homo sapiens
cacacacacactcac

SEQ ID NO: 174903 - DNA, 15 bp, Homo sapiens
ctcacacacacacac

SEQ ID NO: 174904 - DNA, 15 bp, Homo sapiens
tctcacacacacaca

SEQ ID NO: 174905 - DNA, 15 bp, Homo sapiens
ctctcacacacacac

SEQ ID NO: 174906 - DNA, 15 bp, Homo sapiens
tctctcacacacaca

SEQ ID NO: 174907 - DNA, 15 bp, Homo sapiens
ctctctcacacacac

SEQ ID NO: 174908 - DNA, 15 bp, Homo sapiens
tctctctcacacaca

SEQ ID NO: 174909 - DNA, 15 bp, Homo sapiens
ctctctctcacacac

SEQ ID NO: 174910 - DNA, 15 bp, Homo sapiens
tctctctctcacaca

SEQ ID NO: 174911 - DNA, 15 bp, Homo sapiens
ctctctctctcacac

SEQ ID NO: 174912 - DNA, 15 bp, Homo sapiens
cctctctctctcaca

SEQ ID NO: 174913 - DNA, 15 bp, Homo sapiens
acctctctctctcac

SEQ ID NO: 174914 - DNA, 15 bp, Homo sapiens
cacctctctctctca

SEQ ID NO: 174915 - DNA, 15 bp, Homo sapiens
acacctctctctctc

SEQ ID NO: 174916 - DNA, 15 bp, Homo sapiens
cacacctctctctct

SEQ ID NO: 174917 - DNA, 15 bp, Homo sapiens
acacacctctctctc

SEQ ID NO: 174918 - DNA, 15 bp, Homo sapiens
cacacacctctctct

SEQ ID NO: 174919 - DNA, 15 bp, Homo sapiens
acacacacctctctc

SEQ ID NO: 174920 - DNA, 15 bp, Homo sapiens
cacacacacctctct

SEQ ID NO: 174921 - DNA, 15 bp, Homo sapiens
acacacacacctctc

SEQ ID NO: 174922 - DNA, 15 bp, Homo sapiens
cacacacacacctct

SEQ ID NO: 174923 - DNA, 15 bp, Homo sapiens
acacacacacacctc

SEQ ID NO: 174924 - DNA, 15 bp, Homo sapiens
cacacacacacacct

SEQ ID NO: 174925 - DNA, 15 bp, Homo sapiens
ttacacacacacaca

SEQ ID NO: 174926 - DNA, 15 bp, Homo sapiens
gttacacacacacac

SEQ ID NO: 174927 - DNA, 15 bp, Homo sapiens
agttacacacacaca

SEQ ID NO: 174928 - DNA, 15 bp, Homo sapiens
tagttacacacacac

SEQ ID NO: 174929 - DNA, 15 bp, Homo sapiens
atagttacacacaca

SEQ ID NO: 174930 - DNA, 15 bp, Homo sapiens
aatagttacacacac

SEQ ID NO: 174931 - DNA, 15 bp, Homo sapiens
gaatagttacacaca

SEQ ID NO: 174932 - DNA, 15 bp, Homo sapiens
agaatagttacacac

SEQ ID NO: 174933 - DNA, 15 bp, Homo sapiens
aagaatagttacaca

SEQ ID NO: 174934 - DNA, 15 bp, Homo sapiens
aaagaatagttacac

SEQ ID NO: 174935 - DNA, 15 bp, Homo sapiens
aaaagaatagttaca

SEQ ID NO: 174936 - DNA, 15 bp, Homo sapiens
caaaagaatagttac

SEQ ID NO: 174937 - DNA, 15 bp, Homo sapiens
tcaaaagaatagtta

SEQ ID NO: 174938 - DNA, 15 bp, Homo sapiens
ttcaaaagaatagtt

SEQ ID NO: 174939 - DNA, 15 bp, Homo sapiens
cttcaaaagaatagt

SEQ ID NO: 174940 - DNA, 15 bp, Homo sapiens
tcttcaaaagaatag

SEQ ID NO: 174941 - DNA, 15 bp, Homo sapiens
atcttcaaaagaata

SEQ ID NO: 174942 - DNA, 15 bp, Homo sapiens
catcttcaaaagaat

SEQ ID NO: 174943 - DNA, 15 bp, Homo sapiens
tcatcttcaaaagaa

SEQ ID NO: 174944 - DNA, 15 bp, Homo sapiens
gtcatcttcaaaaga

SEQ ID NO: 174945 - DNA, 15 bp, Homo sapiens
agtcatcttcaaaag

SEQ ID NO: 174946 - DNA, 15 bp, Homo sapiens
aagtcatcttcaaaa

SEQ ID NO: 174947 - DNA, 15 bp, Homo sapiens
caagtcatcttcaaa

SEQ ID NO: 174948 - DNA, 15 bp, Homo sapiens
ccaagtcatcttcaa

SEQ ID NO: 174949 - DNA, 15 bp, Homo sapiens
tccaagtcatcttca

SEQ ID NO: 174950 - DNA, 15 bp, Homo sapiens
ttccaagtcatcttc

SEQ ID NO: 174951 - DNA, 15 bp, Homo sapiens
gttccaagtcatctt

SEQ ID NO: 174952 - DNA, 15 bp, Homo sapiens
agttccaagtcatct

SEQ ID NO: 174953 - DNA, 15 bp, Homo sapiens
tagttccaagtcatc

SEQ ID NO: 174954 - DNA, 15 bp, Homo sapiens
atagttccaagtcat

SEQ ID NO: 174955 - DNA, 15 bp, Homo sapiens
aatagttccaagtca

SEQ ID NO: 174956 - DNA, 15 bp, Homo sapiens
gaatagttccaagtc

SEQ ID NO: 174957 - DNA, 15 bp, Homo sapiens
ggaatagttccaagt

SEQ ID NO: 174958 - DNA, 15 bp, Homo sapiens
aggaatagttccaag

SEQ ID NO: 174959 - DNA, 15 bp, Homo sapiens
taggaatagttccaa

SEQ ID NO: 174960 - DNA, 15 bp, Homo sapiens
ttaggaatagttcca

SEQ ID NO: 174961 - DNA, 15 bp, Homo sapiens
cttaggaatagttcc

SEQ ID NO: 174962 - DNA, 15 bp, Homo sapiens
acttaggaatagttc

SEQ ID NO: 174963 - DNA, 15 bp, Homo sapiens
tacttaggaatagtt

SEQ ID NO: 174964 - DNA, 15 bp, Homo sapiens
ttacttaggaatagt

SEQ ID NO: 174965 - DNA, 15 bp, Homo sapiens
gttacttaggaatag

SEQ ID NO: 174966 - DNA, 15 bp, Homo sapiens
ggttacttaggaata

SEQ ID NO: 174967 - DNA, 15 bp, Homo sapiens
aggttacttaggaat

SEQ ID NO: 174968 - DNA, 15 bp, Homo sapiens
gaggttacttaggaa

SEQ ID NO: 174969 - DNA, 15 bp, Homo sapiens
ggaggttacttagga

SEQ ID NO: 174970 - DNA, 15 bp, Homo sapiens
aggaggttacttagg

SEQ ID NO: 174971 - DNA, 15 bp, Homo sapiens
caggaggttacttag

SEQ ID NO: 174972 - DNA, 15 bp, Homo sapiens
acaggaggttactta

SEQ ID NO: 174973 - DNA, 15 bp, Homo sapiens
gacaggaggttactt

SEQ ID NO: 174974 - DNA, 15 bp, Homo sapiens
agacaggaggttact

SEQ ID NO: 174975 - DNA, 15 bp, Homo sapiens
cagacaggaggttac

SEQ ID NO: 174976 - DNA, 15 bp, Homo sapiens
ccagacaggaggtta

SEQ ID NO: 174977 - DNA, 15 bp, Homo sapiens
gccagacaggaggtt

SEQ ID NO: 174978 - DNA, 15 bp, Homo sapiens
tgccagacaggaggt

SEQ ID NO: 174979 - DNA, 15 bp, Homo sapiens
atgccagacaggagg

SEQ ID NO: 174980 - DNA, 15 bp, Homo sapiens
aatgccagacaggag

SEQ ID NO: 174981 - DNA, 15 bp, Homo sapiens
gaatgccagacagga

SEQ ID NO: 174982 - DNA, 15 bp, Homo sapiens
tgaatgccagacagg

SEQ ID NO: 174983 - DNA, 15 bp, Homo sapiens
gtgaatgccagacag

SEQ ID NO: 174984 - DNA, 15 bp, Homo sapiens
agtgaatgccagaca

SEQ ID NO: 174985 - DNA, 15 bp, Homo sapiens
tagtgaatgccagac

SEQ ID NO: 174986 - DNA, 15 bp, Homo sapiens
ttagtgaatgccaga

SEQ ID NO: 174987 - DNA, 15 bp, Homo sapiens
attagtgaatgccag

SEQ ID NO: 174988 - DNA, 15 bp, Homo sapiens
aattagtgaatgcca

SEQ ID NO: 174989 - DNA, 15 bp, Homo sapiens
aaattagtgaatgcc

SEQ ID NO: 174990 - DNA, 15 bp, Homo sapiens
gaaattagtgaatgc

SEQ ID NO: 174991 - DNA, 15 bp, Homo sapiens
tgaaattagtgaatg

SEQ ID NO: 174992 - DNA, 15 bp, Homo sapiens
gtgaaattagtgaat

SEQ ID NO: 174993 - DNA, 15 bp, Homo sapiens
ggtgaaattagtgaa

SEQ ID NO: 174994 - DNA, 15 bp, Homo sapiens
aggtgaaattagtga

SEQ ID NO: 174995 - DNA, 15 bp, Homo sapiens
caggtgaaattagtg

SEQ ID NO: 174996 - DNA, 15 bp, Homo sapiens
ccaggtgaaattagt

SEQ ID NO: 174997 - DNA, 15 bp, Homo sapiens
gccaggtgaaattag

SEQ ID NO: 174998 - DNA, 15 bp, Homo sapiens
ggccaggtgaaatta

SEQ ID NO: 174999 - DNA, 15 bp, Homo sapiens
tggccaggtgaaatt

SEQ ID NO: 175000 - DNA, 15 bp, Homo sapiens
ttggccaggtgaaat

SEQ ID NO: 175001 - DNA, 15 bp, Homo sapiens
gttggccaggtgaaa

SEQ ID NO: 175002 - DNA, 15 bp, Homo sapiens
agttggccaggtgaa

SEQ ID NO: 175003 - DNA, 15 bp, Homo sapiens
gagttggccaggtga

SEQ ID NO: 175004 - DNA, 15 bp, Homo sapiens
ggagttggccaggtg

SEQ ID NO: 175005 - DNA, 15 bp, Homo sapiens
tggagttggccaggt

SEQ ID NO: 175006 - DNA, 15 bp, Homo sapiens
ctggagttggccagg

SEQ ID NO: 175007 - DNA, 15 bp, Homo sapiens
gctggagttggccag

SEQ ID NO: 175008 - DNA, 15 bp, Homo sapiens
tgctggagttggcca

SEQ ID NO: 175009 - DNA, 15 bp, Homo sapiens
ttgctggagttggcc

SEQ ID NO: 175010 - DNA, 15 bp, Homo sapiens
attgctggagttggc

SEQ ID NO: 175011 - DNA, 15 bp, Homo sapiens
cattgctggagttgg

SEQ ID NO: 175012 - DNA, 15 bp, Homo sapiens
gcattgctggagttg

SEQ ID NO: 175013 - DNA, 15 bp, Homo sapiens
agcattgctggagtt

SEQ ID NO: 175014 - DNA, 15 bp, Homo sapiens
cagcattgctggagt

SEQ ID NO: 175015 - DNA, 15 bp, Homo sapiens
tcagcattgctggag

SEQ ID NO: 175016 - DNA, 15 bp, Homo sapiens
atcagcattgctgga

SEQ ID NO: 175017 - DNA, 15 bp, Homo sapiens
gatcagcattgctgg

SEQ ID NO: 175018 - DNA, 15 bp, Homo sapiens
agatcagcattgctg

SEQ ID NO: 175019 - DNA, 15 bp, Homo sapiens
aagatcagcattgct

SEQ ID NO: 175020 - DNA, 15 bp, Homo sapiens
taagatcagcattgc

SEQ ID NO: 175021 - DNA, 15 bp, Homo sapiens
ctaagatcagcattg

SEQ ID NO: 175022 - DNA, 15 bp, Homo sapiens
cctaagatcagcatt

SEQ ID NO: 175023 - DNA, 15 bp, Homo sapiens
tcctaagatcagcat

SEQ ID NO: 175024 - DNA, 15 bp, Homo sapiens
atcctaagatcagca

SEQ ID NO: 175025 - DNA, 15 bp, Homo sapiens
tatcctaagatcagc

SEQ ID NO: 175026 - DNA, 15 bp, Homo sapiens
atatcctaagatcag

SEQ ID NO: 175027 - DNA, 15 bp, Homo sapiens
gatatcctaagatca

SEQ ID NO: 175028 - DNA, 15 bp, Homo sapiens
agatatcctaagatc

SEQ ID NO: 175029 - DNA, 15 bp, Homo sapiens
aagatatcctaagat

SEQ ID NO: 175030 - DNA, 15 bp, Homo sapiens
taagatatcctaaga

SEQ ID NO: 175031 - DNA, 15 bp, Homo sapiens
ataagatatcctaag

SEQ ID NO: 175032 - DNA, 15 bp, Homo sapiens
aataagatatcctaa

SEQ ID NO: 175033 - DNA, 15 bp, Homo sapiens
caataagatatccta

SEQ ID NO: 175034 - DNA, 15 bp, Homo sapiens
acaataagatatcct

SEQ ID NO: 175035 - DNA, 15 bp, Homo sapiens
tacaataagatatcc

SEQ ID NO: 175036 - DNA, 15 bp, Homo sapiens
atacaataagatatc

SEQ ID NO: 175037 - DNA, 15 bp, Homo sapiens
tatacaataagatat

SEQ ID NO: 175038 - DNA, 15 bp, Homo sapiens
ctatacaataagata

SEQ ID NO: 175039 - DNA, 15 bp, Homo sapiens
gctatacaataagat

SEQ ID NO: 175040 - DNA, 15 bp, Homo sapiens
agctatacaataaga

SEQ ID NO: 175041 - DNA, 15 bp, Homo sapiens
aagctatacaataag

SEQ ID NO: 175042 - DNA, 15 bp, Homo sapiens
taagctatacaataa

SEQ ID NO: 175043 - DNA, 15 bp, Homo sapiens
ataagctatacaata

SEQ ID NO: 175044 - DNA, 15 bp, Homo sapiens
tataagctatacaat

SEQ ID NO: 175045 - DNA, 15 bp, Homo sapiens
atataagctatacaa

SEQ ID NO: 175046 - DNA, 15 bp, Homo sapiens
aatataagctataca

SEQ ID NO: 175047 - DNA, 15 bp, Homo sapiens
gaatataagctatac

SEQ ID NO: 175048 - DNA, 15 bp, Homo sapiens
ggaatataagctata

SEQ ID NO: 175049 - DNA, 15 bp, Homo sapiens
tggaatataagctat

SEQ ID NO: 175050 - DNA, 15 bp, Homo sapiens
ttggaatataagcta

SEQ ID NO: 175051 - DNA, 15 bp, Homo sapiens
tttggaatataagct

SEQ ID NO: 175052 - DNA, 15 bp, Homo sapiens
atttggaatataagc

SEQ ID NO: 175053 - DNA, 15 bp, Homo sapiens
tatttggaatataag

SEQ ID NO: 175054 - DNA, 15 bp, Homo sapiens
atatttggaatataa

SEQ ID NO: 175055 - DNA, 15 bp, Homo sapiens
aatatttggaatata

SEQ ID NO: 175056 - DNA, 15 bp, Homo sapiens
caatatttggaatat

SEQ ID NO: 175057 - DNA, 15 bp, Homo sapiens
ccaatatttggaata

SEQ ID NO: 175058 - DNA, 15 bp, Homo sapiens
tccaatatttggaat

SEQ ID NO: 175059 - DNA, 15 bp, Homo sapiens
ctccaatatttggaa

SEQ ID NO: 175060 - DNA, 15 bp, Homo sapiens
cctccaatatttgga

SEQ ID NO: 175061 - DNA, 15 bp, Homo sapiens
tcctccaatatttgg

SEQ ID NO: 175062 - DNA, 15 bp, Homo sapiens
ttcctccaatatttg

SEQ ID NO: 175063 - DNA, 15 bp, Homo sapiens
tttcctccaatattt

SEQ ID NO: 175064 - DNA, 15 bp, Homo sapiens
ctttcctccaatatt

SEQ ID NO: 175065 - DNA, 15 bp, Homo sapiens
tctttcctccaatat

SEQ ID NO: 175066 - DNA, 15 bp, Homo sapiens
ctctttcctccaata

SEQ ID NO: 175067 - DNA, 15 bp, Homo sapiens
tctctttcctccaat

SEQ ID NO: 175068 - DNA, 15 bp, Homo sapiens
ctctctttcctccaa

SEQ ID NO: 175069 - DNA, 15 bp, Homo sapiens
cctctctttcctcca

SEQ ID NO: 175070 - DNA, 15 bp, Homo sapiens
ccctctctttcctcc

SEQ ID NO: 175071 - DNA, 15 bp, Homo sapiens
tccctctctttcctc

SEQ ID NO: 175072 - DNA, 15 bp, Homo sapiens
ctccctctctttcct

SEQ ID NO: 175073 - DNA, 15 bp, Homo sapiens
actccctctctttcc

SEQ ID NO: 175074 - DNA, 15 bp, Homo sapiens
aactccctctctttc

SEQ ID NO: 175075 - DNA, 15 bp, Homo sapiens
aaactccctctcttt

SEQ ID NO: 175076 - DNA, 15 bp, Homo sapiens
caaactccctctctt

SEQ ID NO: 175077 - DNA, 15 bp, Homo sapiens
ccaaactccctctct

SEQ ID NO: 175078 - DNA, 15 bp, Homo sapiens
tccaaactccctctc

SEQ ID NO: 175079 - DNA, 15 bp, Homo sapiens
ttccaaactccctct

SEQ ID NO: 175080 - DNA, 15 bp, Homo sapiens
tttccaaactccctc

SEQ ID NO: 175081 - DNA, 15 bp, Homo sapiens
ctttccaaactccct

SEQ ID NO: 175082 - DNA, 15 bp, Homo sapiens
tctttccaaactccc

SEQ ID NO: 175083 - DNA, 15 bp, Homo sapiens
ttctttccaaactcc

SEQ ID NO: 175084 - DNA, 15 bp, Homo sapiens
cttctttccaaactc

SEQ ID NO: 175085 - DNA, 15 bp, Homo sapiens
acttctttccaaact

SEQ ID NO: 175086 - DNA, 15 bp, Homo sapiens
aacttctttccaaac

SEQ ID NO: 175087 - DNA, 15 bp, Homo sapiens
aaacttctttccaaa

SEQ ID NO: 175088 - DNA, 15 bp, Homo sapiens
aaaacttctttccaa

SEQ ID NO: 175089 - DNA, 15 bp, Homo sapiens
taaaacttctttcca

SEQ ID NO: 175090 - DNA, 15 bp, Homo sapiens
ctaaaacttctttcc

SEQ ID NO: 175091 - DNA, 15 bp, Homo sapiens
actaaaacttctttc

SEQ ID NO: 175092 - DNA, 15 bp, Homo sapiens
aactaaaacttcttt

SEQ ID NO: 175093 - DNA, 15 bp, Homo sapiens
aaactaaaacttctt

SEQ ID NO: 175094 - DNA, 15 bp, Homo sapiens
taaactaaaacttct

SEQ ID NO: 175095 - DNA, 15 bp, Homo sapiens
ctaaactaaaacttc

SEQ ID NO: 175096 - DNA, 15 bp, Homo sapiens
tctaaactaaaactt

SEQ ID NO: 175097 - DNA, 15 bp, Homo sapiens
ctctaaactaaaact

SEQ ID NO: 175098 - DNA, 15 bp, Homo sapiens
tctctaaactaaaac

SEQ ID NO: 175099 - DNA, 15 bp, Homo sapiens
ctctctaaactaaaa

SEQ ID NO: 175100 - DNA, 15 bp, Homo sapiens
gctctctaaactaaa

SEQ ID NO: 175101 - DNA, 15 bp, Homo sapiens
agctctctaaactaa

SEQ ID NO: 175102 - DNA, 15 bp, Homo sapiens
gagctctctaaacta

SEQ ID NO: 175103 - DNA, 15 bp, Homo sapiens
agagctctctaaact

SEQ ID NO: 175104 - DNA, 15 bp, Homo sapiens
aagagctctctaaac

SEQ ID NO: 175105 - DNA, 15 bp, Homo sapiens
taagagctctctaaa

SEQ ID NO: 175106 - DNA, 15 bp, Homo sapiens
ttaagagctctctaa

SEQ ID NO: 175107 - DNA, 15 bp, Homo sapiens
tttaagagctctcta

SEQ ID NO: 175108 - DNA, 15 bp, Homo sapiens
ctttaagagctctct

SEQ ID NO: 175109 - DNA, 15 bp, Homo sapiens
actttaagagctctc

SEQ ID NO: 175110 - DNA, 15 bp, Homo sapiens
tactttaagagctct

SEQ ID NO: 175111 - DNA, 15 bp, Homo sapiens
gtactttaagagctc

SEQ ID NO: 175112 - DNA, 15 bp, Homo sapiens
agtactttaagagct

SEQ ID NO: 175113 - DNA, 15 bp, Homo sapiens
gagtactttaagagc

SEQ ID NO: 175114 - DNA, 15 bp, Homo sapiens
agagtactttaagag

SEQ ID NO: 175115 - DNA, 15 bp, Homo sapiens
aagagtactttaaga

SEQ ID NO: 175116 - DNA, 15 bp, Homo sapiens
caagagtactttaag

SEQ ID NO: 175117 - DNA, 15 bp, Homo sapiens
ccaagagtactttaa

SEQ ID NO: 175118 - DNA, 15 bp, Homo sapiens
gccaagagtacttta

SEQ ID NO: 175119 - DNA, 15 bp, Homo sapiens
agccaagagtacttt

SEQ ID NO: 175120 - DNA, 15 bp, Homo sapiens
gagccaagagtactt

SEQ ID NO: 175121 - DNA, 15 bp, Homo sapiens
tgagccaagagtact

SEQ ID NO: 175122 - DNA, 15 bp, Homo sapiens
atgagccaagagtac

SEQ ID NO: 175123 - DNA, 15 bp, Homo sapiens
gatgagccaagagta

SEQ ID NO: 175124 - DNA, 15 bp, Homo sapiens
tgatgagccaagagt

SEQ ID NO: 175125 - DNA, 15 bp, Homo sapiens
atgatgagccaagag

SEQ ID NO: 175126 - DNA, 15 bp, Homo sapiens
aatgatgagccaaga

SEQ ID NO: 175127 - DNA, 15 bp, Homo sapiens
gaatgatgagccaag

SEQ ID NO: 175128 - DNA, 15 bp, Homo sapiens
agaatgatgagccaa

SEQ ID NO: 175129 - DNA, 15 bp, Homo sapiens
aagaatgatgagcca

SEQ ID NO: 175130 - DNA, 15 bp, Homo sapiens
aaagaatgatgagcc

SEQ ID NO: 175131 - DNA, 15 bp, Homo sapiens
taaagaatgatgagc

SEQ ID NO: 175132 - DNA, 15 bp, Homo sapiens
ttaaagaatgatgag

SEQ ID NO: 175133 - DNA, 15 bp, Homo sapiens
atttaaagaatgatg

SEQ ID NO: 175134 - DNA, 15 bp, Homo sapiens
aatttaaagaatgat

SEQ ID NO: 175135 - DNA, 15 bp, Homo sapiens
gaatttaaagaatga

SEQ ID NO: 175136 - DNA, 15 bp, Homo sapiens
ggaatttaaagaatg

SEQ ID NO: 175137 - DNA, 15 bp, Homo sapiens
tggaatttaaagaat

SEQ ID NO: 175138 - DNA, 15 bp, Homo sapiens
ttggaatttaaagaa

SEQ ID NO: 175139 - DNA, 15 bp, Homo sapiens
tttggaatttaaaga

SEQ ID NO: 175140 - DNA, 15 bp, Homo sapiens
ttttggaatttaaag

SEQ ID NO: 175141 - DNA, 15 bp, Homo sapiens
tttttggaatttaaa

SEQ ID NO: 175142 - DNA, 15 bp, Homo sapiens
atttttggaatttaa

SEQ ID NO: 175143 - DNA, 15 bp, Homo sapiens
catttttggaattta

SEQ ID NO: 175144 - DNA, 15 bp, Homo sapiens
tcatttttggaattt

SEQ ID NO: 175145 - DNA, 15 bp, Homo sapiens
gtcatttttggaatt

SEQ ID NO: 175146 - DNA, 15 bp, Homo sapiens
agtcatttttggaat

SEQ ID NO: 175147 - DNA, 15 bp, Homo sapiens
tagtcatttttggaa

SEQ ID NO: 175148 - DNA, 15 bp, Homo sapiens
ttagtcatttttgga

SEQ ID NO: 175149 - DNA, 15 bp, Homo sapiens
attagtcatttttgg

SEQ ID NO: 175150 - DNA, 15 bp, Homo sapiens
aattagtcatttttg

SEQ ID NO: 175151 - DNA, 15 bp, Homo sapiens
aaattagtcattttt

SEQ ID NO: 175152 - DNA, 15 bp, Homo sapiens
caaattagtcatttt

SEQ ID NO: 175153 - DNA, 15 bp, Homo sapiens
acaaattagtcattt

SEQ ID NO: 175154 - DNA, 15 bp, Homo sapiens
cacaaattagtcatt

SEQ ID NO: 175155 - DNA, 15 bp, Homo sapiens
ccacaaattagtcat

SEQ ID NO: 175156 - DNA, 15 bp, Homo sapiens
cccacaaattagtca

SEQ ID NO: 175157 - DNA, 15 bp, Homo sapiens
ccccacaaattagtc

SEQ ID NO: 175158 - DNA, 15 bp, Homo sapiens
tccccacaaattagt

SEQ ID NO: 175159 - DNA, 15 bp, Homo sapiens
atccccacaaattag

SEQ ID NO: 175160 - DNA, 15 bp, Homo sapiens
tatccccacaaatta

SEQ ID NO: 175161 - DNA, 15 bp, Homo sapiens
gtatccccacaaatt

SEQ ID NO: 175162 - DNA, 15 bp, Homo sapiens
tgtatccccacaaat

SEQ ID NO: 175163 - DNA, 15 bp, Homo sapiens
atgtatccccacaaa

SEQ ID NO: 175164 - DNA, 15 bp, Homo sapiens
tatgtatccccacaa

SEQ ID NO: 175165 - DNA, 15 bp, Homo sapiens
ttatgtatccccaca

SEQ ID NO: 175166 - DNA, 15 bp, Homo sapiens
attatgtatccccac

SEQ ID NO: 175167 - DNA, 15 bp, Homo sapiens
aattatgtatcccca

SEQ ID NO: 175168 - DNA, 15 bp, Homo sapiens
taattatgtatcccc

SEQ ID NO: 175169 - DNA, 15 bp, Homo sapiens
ttaattatgtatccc

SEQ ID NO: 175170 - DNA, 15 bp, Homo sapiens
cttaattatgtatcc

SEQ ID NO: 175171 - DNA, 15 bp, Homo sapiens
ccttaattatgtatc

SEQ ID NO: 175172 - DNA, 15 bp, Homo sapiens
tccttaattatgtat

SEQ ID NO: 175173 - DNA, 15 bp, Homo sapiens
ttccttaattatgta

SEQ ID NO: 175174 - DNA, 15 bp, Homo sapiens
cttccttaattatgt

SEQ ID NO: 175175 - DNA, 15 bp, Homo sapiens
tcttccttaattatg

SEQ ID NO: 175176 - DNA, 15 bp, Homo sapiens
ttcttccttaattat

SEQ ID NO: 175177 - DNA, 15 bp, Homo sapiens
tttcttccttaatta

SEQ ID NO: 175178 - DNA, 15 bp, Homo sapiens
ttttcttccttaatt

SEQ ID NO: 175179 - DNA, 15 bp, Homo sapiens
cttttcttccttaat

SEQ ID NO: 175180 - DNA, 15 bp, Homo sapiens
ccttttcttccttaa

SEQ ID NO: 175181 - DNA, 15 bp, Homo sapiens
accttttcttcctta

SEQ ID NO: 175182 - DNA, 15 bp, Homo sapiens
aaccttttcttcctt

SEQ ID NO: 175183 - DNA, 15 bp, Homo sapiens
aaaccttttcttcct

SEQ ID NO: 175184 - DNA, 15 bp, Homo sapiens
aaaaccttttcttcc

SEQ ID NO: 175185 - DNA, 15 bp, Homo sapiens
caaaaccttttcttc

SEQ ID NO: 175186 - DNA, 15 bp, Homo sapiens
acaaaaccttttctt

SEQ ID NO: 175187 - DNA, 15 bp, Homo sapiens
cacaaaaccttttct

SEQ ID NO: 175188 - DNA, 15 bp, Homo sapiens
tcacaaaaccttttc

SEQ ID NO: 175189 - DNA, 15 bp, Homo sapiens
ctcacaaaacctttt

SEQ ID NO: 175190 - DNA, 15 bp, Homo sapiens
cctcacaaaaccttt

SEQ ID NO: 175191 - DNA, 15 bp, Homo sapiens
ccctcacaaaacctt

SEQ ID NO: 175192 - DNA, 15 bp, Homo sapiens
tccctcacaaaacct

SEQ ID NO: 175193 - DNA, 15 bp, Homo sapiens
ttccctcacaaaacc

SEQ ID NO: 175194 - DNA, 15 bp, Homo sapiens
tttccctcacaaaac

SEQ ID NO: 175195 - DNA, 15 bp, Homo sapiens
ctttccctcacaaaa

SEQ ID NO: 175196 - DNA, 15 bp, Homo sapiens
cctttccctcacaaa

SEQ ID NO: 175197 - DNA, 15 bp, Homo sapiens
tcctttccctcacaa

SEQ ID NO: 175198 - DNA, 15 bp, Homo sapiens
ctcctttccctcaca

SEQ ID NO: 175199 - DNA, 15 bp, Homo sapiens
actcctttccctcac

SEQ ID NO: 175200 - DNA, 15 bp, Homo sapiens
tactcctttccctca

SEQ ID NO: 175201 - DNA, 15 bp, Homo sapiens
ctactcctttccctc

SEQ ID NO: 175202 - DNA, 15 bp, Homo sapiens
gctactcctttccct

SEQ ID NO: 175203 - DNA, 15 bp, Homo sapiens
tgctactcctttccc

SEQ ID NO: 175204 - DNA, 15 bp, Homo sapiens
ctgctactcctttcc

SEQ ID NO: 175205 - DNA, 15 bp, Homo sapiens
cctgctactcctttc

SEQ ID NO: 175206 - DNA, 15 bp, Homo sapiens
ccctgctactccttt

SEQ ID NO: 175207 - DNA, 15 bp, Homo sapiens
tccctgctactcctt

SEQ ID NO: 175208 - DNA, 15 bp, Homo sapiens
ctccctgctactcct

SEQ ID NO: 175209 - DNA, 15 bp, Homo sapiens
actccctgctactcc

SEQ ID NO: 175210 - DNA, 15 bp, Homo sapiens
cactccctgctactc

SEQ ID NO: 175211 - DNA, 15 bp, Homo sapiens
gcactccctgctact

SEQ ID NO: 175212 - DNA, 15 bp, Homo sapiens
agcactccctgctac

SEQ ID NO: 175213 - DNA, 15 bp, Homo sapiens
cagcactccctgcta

SEQ ID NO: 175214 - DNA, 15 bp, Homo sapiens
tcagcactccctgct

SEQ ID NO: 175215 - DNA, 15 bp, Homo sapiens
ctcagcactccctgc

SEQ ID NO: 175216 - DNA, 15 bp, Homo sapiens
tctcagcactccctg

SEQ ID NO: 175217 - DNA, 15 bp, Homo sapiens
ctctcagcactccct

SEQ ID NO: 175218 - DNA, 15 bp, Homo sapiens
gctctcagcactccc

SEQ ID NO: 175219 - DNA, 15 bp, Homo sapiens
agctctcagcactcc

SEQ ID NO: 175220 - DNA, 15 bp, Homo sapiens
aagctctcagcactc

SEQ ID NO: 175221 - DNA, 15 bp, Homo sapiens
caagctctcagcact

SEQ ID NO: 175222 - DNA, 15 bp, Homo sapiens
ccaagctctcagcac

SEQ ID NO: 175223 - DNA, 15 bp, Homo sapiens
gccaagctctcagca

SEQ ID NO: 175224 - DNA, 15 bp, Homo sapiens
cgccaagctctcagc

SEQ ID NO: 175225 - DNA, 15 bp, Homo sapiens
acgccaagctctcag

SEQ ID NO: 175226 - DNA, 15 bp, Homo sapiens
tacgccaagctctca

SEQ ID NO: 175227 - DNA, 15 bp, Homo sapiens
atacgccaagctctc

SEQ ID NO: 175228 - DNA, 15 bp, Homo sapiens
catacgccaagctct

SEQ ID NO: 175229 - DNA, 15 bp, Homo sapiens
acatacgccaagctc

SEQ ID NO: 175230 - DNA, 15 bp, Homo sapiens
tacatacgccaagct

SEQ ID NO: 175231 - DNA, 15 bp, Homo sapiens
atacatacgccaagc

SEQ ID NO: 175232 - DNA, 15 bp, Homo sapiens
aatacatacgccaag

SEQ ID NO: 175233 - DNA, 15 bp, Homo sapiens
caatacatacgccaa

SEQ ID NO: 175234 - DNA, 15 bp, Homo sapiens
ccaatacatacgcca

SEQ ID NO: 175235 - DNA, 15 bp, Homo sapiens
tccaatacatacgcc

SEQ ID NO: 175236 - DNA, 15 bp, Homo sapiens
ttccaatacatacgc

SEQ ID NO: 175237 - DNA, 15 bp, Homo sapiens
tttccaatacatacg

SEQ ID NO: 175238 - DNA, 15 bp, Homo sapiens
ttttccaatacatac

SEQ ID NO: 175239 - DNA, 15 bp, Homo sapiens
attttccaatacata

SEQ ID NO: 175240 - DNA, 15 bp, Homo sapiens
aattttccaatacat

SEQ ID NO: 175241 - DNA, 15 bp, Homo sapiens
caattttccaataca

SEQ ID NO: 175242 - DNA, 15 bp, Homo sapiens
acaattttccaatac

SEQ ID NO: 175243 - DNA, 15 bp, Homo sapiens
cacaattttccaata

SEQ ID NO: 175244 - DNA, 15 bp, Homo sapiens
ccacaattttccaat

SEQ ID NO: 175245 - DNA, 15 bp, Homo sapiens
accacaattttccaa

SEQ ID NO: 175246 - DNA, 15 bp, Homo sapiens
taccacaattttcca

SEQ ID NO: 175247 - DNA, 15 bp, Homo sapiens
ttaccacaattttcc

SEQ ID NO: 175248 - DNA, 15 bp, Homo sapiens
gttaccacaattttc

SEQ ID NO: 175249 - DNA, 15 bp, Homo sapiens
agttaccacaatttt

SEQ ID NO: 175250 - DNA, 15 bp, Homo sapiens
aagttaccacaattt

SEQ ID NO: 175251 - DNA, 15 bp, Homo sapiens
taagttaccacaatt

SEQ ID NO: 175252 - DNA, 15 bp, Homo sapiens
ttaagttaccacaat

SEQ ID NO: 175253 - DNA, 15 bp, Homo sapiens
gttaagttaccacaa

SEQ ID NO: 175254 - DNA, 15 bp, Homo sapiens
tgttaagttaccaca

SEQ ID NO: 175255 - DNA, 15 bp, Homo sapiens
ctgttaagttaccac

SEQ ID NO: 175256 - DNA, 15 bp, Homo sapiens
cctgttaagttacca

SEQ ID NO: 175257 - DNA, 15 bp, Homo sapiens
acctgttaagttacc

SEQ ID NO: 175258 - DNA, 15 bp, Homo sapiens
tacctgttaagttac

SEQ ID NO: 175259 - DNA, 15 bp, Homo sapiens
ttacctgttaagtta

SEQ ID NO: 175260 - DNA, 15 bp, Homo sapiens
attacctgttaagtt

SEQ ID NO: 175261 - DNA, 15 bp, Homo sapiens
gattacctgttaagt

SEQ ID NO: 175262 - DNA, 15 bp, Homo sapiens
tgattacctgttaag

SEQ ID NO: 175263 - DNA, 15 bp, Homo sapiens
ttgattacctgttaa

SEQ ID NO: 175264 - DNA, 15 bp, Homo sapiens
cttgattacctgtta

SEQ ID NO: 175265 - DNA, 15 bp, Homo sapiens
ccttgattacctgtt

SEQ ID NO: 175266 - DNA, 15 bp, Homo sapiens
tccttgattacctgt

SEQ ID NO: 175267 - DNA, 15 bp, Homo sapiens
atccttgattacctg

SEQ ID NO: 175268 - DNA, 15 bp, Homo sapiens
catccttgattacct

SEQ ID NO: 175269 - DNA, 15 bp, Homo sapiens
acatccttgattacc

SEQ ID NO: 175270 - DNA, 15 bp, Homo sapiens
aacatccttgattac

SEQ ID NO: 175271 - DNA, 15 bp, Homo sapiens
caacatccttgatta

SEQ ID NO: 175272 - DNA, 15 bp, Homo sapiens
tcaacatccttgatt

SEQ ID NO: 175273 - DNA, 15 bp, Homo sapiens
ctcaacatccttgat

SEQ ID NO: 175274 - DNA, 15 bp, Homo sapiens
tctcaacatccttga

SEQ ID NO: 175275 - DNA, 15 bp, Homo sapiens
ctctcaacatccttg

SEQ ID NO: 175276 - DNA, 15 bp, Homo sapiens
tctctcaacatcctt

SEQ ID NO: 175277 - DNA, 15 bp, Homo sapiens
ctctctcaacatcct

SEQ ID NO: 175278 - DNA, 15 bp, Homo sapiens
cctctctcaacatcc

SEQ ID NO: 175279 - DNA, 15 bp, Homo sapiens
acctctctcaacatc

SEQ ID NO: 175280 - DNA, 15 bp, Homo sapiens
cacctctctcaacat

SEQ ID NO: 175281 - DNA, 15 bp, Homo sapiens
gcacctctctcaaca

SEQ ID NO: 175282 - DNA, 15 bp, Homo sapiens
agcacctctctcaac

SEQ ID NO: 175283 - DNA, 15 bp, Homo sapiens
aagcacctctctcaa

SEQ ID NO: 175284 - DNA, 15 bp, Homo sapiens
caagcacctctctca

SEQ ID NO: 175285 - DNA, 15 bp, Homo sapiens
acaagcacctctctc

SEQ ID NO: 175286 - DNA, 15 bp, Homo sapiens
gacaagcacctctct

SEQ ID NO: 175287 - DNA, 15 bp, Homo sapiens
tgacaagcacctctc

SEQ ID NO: 175288 - DNA, 15 bp, Homo sapiens
atgacaagcacctct

SEQ ID NO: 175289 - DNA, 15 bp, Homo sapiens
gatgacaagcacctc

SEQ ID NO: 175290 - DNA, 15 bp, Homo sapiens
tgatgacaagcacct

SEQ ID NO: 175291 - DNA, 15 bp, Homo sapiens
atgatgacaagcacc

SEQ ID NO: 175292 - DNA, 15 bp, Homo sapiens
aatgatgacaagcac

SEQ ID NO: 175293 - DNA, 15 bp, Homo sapiens
aaatgatgacaagca

SEQ ID NO: 175294 - DNA, 15 bp, Homo sapiens
gaaatgatgacaagc

SEQ ID NO: 175295 - DNA, 15 bp, Homo sapiens
tgaaatgatgacaag

SEQ ID NO: 175296 - DNA, 15 bp, Homo sapiens
ttgaaatgatgacaa

SEQ ID NO: 175297 - DNA, 15 bp, Homo sapiens
tttgaaatgatgaca

SEQ ID NO: 175298 - DNA, 15 bp, Homo sapiens
ttttgaaatgatgac

SEQ ID NO: 175299 - DNA, 15 bp, Homo sapiens
cttttgaaatgatga

SEQ ID NO: 175300 - DNA, 15 bp, Homo sapiens
tcttttgaaatgatg

SEQ ID NO: 175301 - DNA, 15 bp, Homo sapiens
ctcttttgaaatgat

SEQ ID NO: 175302 - DNA, 15 bp, Homo sapiens
gctcttttgaaatga

SEQ ID NO: 175303 - DNA, 15 bp, Homo sapiens
cgctcttttgaaatg

SEQ ID NO: 175304 - DNA, 15 bp, Homo sapiens
acgctcttttgaaat

SEQ ID NO: 175305 - DNA, 15 bp, Homo sapiens
tacgctcttttgaaa

SEQ ID NO: 175306 - DNA, 15 bp, Homo sapiens
ctacgctcttttgaa

SEQ ID NO: 175307 - DNA, 15 bp, Homo sapiens
tctacgctcttttga

SEQ ID NO: 175308 - DNA, 15 bp, Homo sapiens
ttctacgctcttttg

SEQ ID NO: 175309 - DNA, 15 bp, Homo sapiens
attctacgctctttt

SEQ ID NO: 175310 - DNA, 15 bp, Homo sapiens
tattctacgctcttt

SEQ ID NO: 175311 - DNA, 15 bp, Homo sapiens
atattctacgctctt

SEQ ID NO: 175312 - DNA, 15 bp, Homo sapiens
aatattctacgctct

SEQ ID NO: 175313 - DNA, 15 bp, Homo sapiens
aaatattctacgctc

SEQ ID NO: 175314 - DNA, 15 bp, Homo sapiens
aaaatattctacgct

SEQ ID NO: 175315 - DNA, 15 bp, Homo sapiens
taaaatattctacgc

SEQ ID NO: 175316 - DNA, 15 bp, Homo sapiens
ataaaatattctacg

SEQ ID NO: 175317 - DNA, 15 bp, Homo sapiens
aataaaatattctac

SEQ ID NO: 175318 - DNA, 15 bp, Homo sapiens
aaataaaatattcta

SEQ ID NO: 175319 - DNA, 15 bp, Homo sapiens
gaaataaaatattct

SEQ ID NO: 175320 - DNA, 15 bp, Homo sapiens
tgaaataaaatattc

SEQ ID NO: 175321 - DNA, 15 bp, Homo sapiens
atgaaataaaatatt

SEQ ID NO: 175322 - DNA, 15 bp, Homo sapiens
aatgaaataaaatat

SEQ ID NO: 175323 - DNA, 15 bp, Homo sapiens
aaatgaaataaaata

SEQ ID NO: 175324 - DNA, 15 bp, Homo sapiens
aaaatgaaataaaat

SEQ ID NO: 175325 - DNA, 15 bp, Homo sapiens
caaaatgaaataaaa

SEQ ID NO: 175326 - DNA, 15 bp, Homo sapiens
acaaaatgaaataaa

SEQ ID NO: 175327 - DNA, 15 bp, Homo sapiens
gacaaaatgaaataa

SEQ ID NO: 175328 - DNA, 15 bp, Homo sapiens
agacaaaatgaaata

SEQ ID NO: 175329 - DNA, 15 bp, Homo sapiens
tagacaaaatgaaat

SEQ ID NO: 175330 - DNA, 15 bp, Homo sapiens
gtagacaaaatgaaa

SEQ ID NO: 175331 - DNA, 15 bp, Homo sapiens
agtagacaaaatgaa

SEQ ID NO: 175332 - DNA, 15 bp, Homo sapiens
cagtagacaaaatga

SEQ ID NO: 175333 - DNA, 15 bp, Homo sapiens
acagtagacaaaatg

SEQ ID NO: 175334 - DNA, 15 bp, Homo sapiens
cacagtagacaaaat

SEQ ID NO: 175335 - DNA, 15 bp, Homo sapiens
ccacagtagacaaaa

SEQ ID NO: 175336 - DNA, 15 bp, Homo sapiens
tccacagtagacaaa

SEQ ID NO: 175337 - DNA, 15 bp, Homo sapiens
atccacagtagacaa

SEQ ID NO: 175338 - DNA, 15 bp, Homo sapiens
gatccacagtagaca

SEQ ID NO: 175339 - DNA, 15 bp, Homo sapiens
cgatccacagtagac

SEQ ID NO: 175340 - DNA, 15 bp, Homo sapiens
ccgatccacagtaga

SEQ ID NO: 175341 - DNA, 15 bp, Homo sapiens
accgatccacagtag

SEQ ID NO: 175342 - DNA, 15 bp, Homo sapiens
aaccgatccacagta

SEQ ID NO: 175343 - DNA, 15 bp, Homo sapiens
gaaccgatccacagt

SEQ ID NO: 175344 - DNA, 15 bp, Homo sapiens
agaaccgatccacag

SEQ ID NO: 175345 - DNA, 15 bp, Homo sapiens
gagaaccgatccaca

SEQ ID NO: 175346 - DNA, 15 bp, Homo sapiens
ggagaaccgatccac

SEQ ID NO: 175347 - DNA, 15 bp, Homo sapiens
aggagaaccgatcca

SEQ ID NO: 175348 - DNA, 15 bp, Homo sapiens
gaggagaaccgatcc

SEQ ID NO: 175349 - DNA, 15 bp, Homo sapiens
agaggagaaccgatc

SEQ ID NO: 175350 - DNA, 15 bp, Homo sapiens
gagaggagaaccgat

SEQ ID NO: 175351 - DNA, 15 bp, Homo sapiens
tgagaggagaaccga

SEQ ID NO: 175352 - DNA, 15 bp, Homo sapiens
atgagaggagaaccg

SEQ ID NO: 175353 - DNA, 15 bp, Homo sapiens
aatgagaggagaacc

SEQ ID NO: 175354 - DNA, 15 bp, Homo sapiens
aaatgagaggagaac

SEQ ID NO: 175355 - DNA, 15 bp, Homo sapiens
taaatgagaggagaa

SEQ ID NO: 175356 - DNA, 15 bp, Homo sapiens
gtaaatgagaggaga

SEQ ID NO: 175357 - DNA, 15 bp, Homo sapiens
agtaaatgagaggag

SEQ ID NO: 175358 - DNA, 15 bp, Homo sapiens
aagtaaatgagagga

SEQ ID NO: 175359 - DNA, 15 bp, Homo sapiens
gaagtaaatgagagg

SEQ ID NO: 175360 - DNA, 15 bp, Homo sapiens
agaagtaaatgagag

SEQ ID NO: 175361 - DNA, 15 bp, Homo sapiens
aagaagtaaatgaga

SEQ ID NO: 175362 - DNA, 15 bp, Homo sapiens
aaagaagtaaatgag

SEQ ID NO: 175363 - DNA, 15 bp, Homo sapiens
aaaagaagtaaatga

SEQ ID NO: 175364 - DNA, 15 bp, Homo sapiens
gaaaagaagtaaatg

SEQ ID NO: 175365 - DNA, 15 bp, Homo sapiens
tgaaaagaagtaaat

SEQ ID NO: 175366 - DNA, 15 bp, Homo sapiens
gtgaaaagaagtaaa

SEQ ID NO: 175367 - DNA, 15 bp, Homo sapiens
tgtgaaaagaagtaa

SEQ ID NO: 175368 - DNA, 15 bp, Homo sapiens
atgtgaaaagaagta

SEQ ID NO: 175369 - DNA, 15 bp, Homo sapiens
aatgtgaaaagaagt

SEQ ID NO: 175370 - DNA, 15 bp, Homo sapiens
aaatgtgaaaagaag

SEQ ID NO: 175371 - DNA, 15 bp, Homo sapiens
gaaatgtgaaaagaa

SEQ ID NO: 175372 - DNA, 15 bp, Homo sapiens
tgaaatgtgaaaaga

SEQ ID NO: 175373 - DNA, 15 bp, Homo sapiens
atgaaatgtgaaaag

SEQ ID NO: 175374 - DNA, 15 bp, Homo sapiens
tatgaaatgtgaaaa

SEQ ID NO: 175375 - DNA, 15 bp, Homo sapiens
atatgaaatgtgaaa

SEQ ID NO: 175376 - DNA, 15 bp, Homo sapiens
aatatgaaatgtgaa

SEQ ID NO: 175377 - DNA, 15 bp, Homo sapiens
aaatatgaaatgtga

SEQ ID NO: 175378 - DNA, 15 bp, Homo sapiens
caaatatgaaatgtg

SEQ ID NO: 175379 - DNA, 15 bp, Homo sapiens
ccaaatatgaaatgt

SEQ ID NO: 175380 - DNA, 15 bp, Homo sapiens
cccaaatatgaaatg

SEQ ID NO: 175381 - DNA, 15 bp, Homo sapiens
tcccaaatatgaaat

SEQ ID NO: 175382 - DNA, 15 bp, Homo sapiens
ctcccaaatatgaaa

SEQ ID NO: 175383 - DNA, 15 bp, Homo sapiens
cctcccaaatatgaa

SEQ ID NO: 175384 - DNA, 15 bp, Homo sapiens
ccctcccaaatatga

SEQ ID NO: 175385 - DNA, 15 bp, Homo sapiens
gccctcccaaatatg

SEQ ID NO: 175386 - DNA, 15 bp, Homo sapiens
agccctcccaaatat

SEQ ID NO: 175387 - DNA, 15 bp, Homo sapiens
aagccctcccaaata

SEQ ID NO: 175388 - DNA, 15 bp, Homo sapiens
aaagccctcccaaat

SEQ ID NO: 175389 - DNA, 15 bp, Homo sapiens
caaagccctcccaaa

SEQ ID NO: 175390 - DNA, 15 bp, Homo sapiens
ccaaagccctcccaa

SEQ ID NO: 175391 - DNA, 15 bp, Homo sapiens
cccaaagccctccca

SEQ ID NO: 175392 - DNA, 15 bp, Homo sapiens
gcccaaagccctccc

SEQ ID NO: 175393 - DNA, 15 bp, Homo sapiens
agcccaaagccctcc

SEQ ID NO: 175394 - DNA, 15 bp, Homo sapiens
gagcccaaagccctc

SEQ ID NO: 175395 - DNA, 15 bp, Homo sapiens
agagcccaaagccct

SEQ ID NO: 175396 - DNA, 15 bp, Homo sapiens
tagagcccaaagccc

SEQ ID NO: 175397 - DNA, 15 bp, Homo sapiens
atagagcccaaagcc

SEQ ID NO: 175398 - DNA, 15 bp, Homo sapiens
gatagagcccaaagc

SEQ ID NO: 175399 - DNA, 15 bp, Homo sapiens
agatagagcccaaag

SEQ ID NO: 175400 - DNA, 15 bp, Homo sapiens
aagatagagcccaaa

SEQ ID NO: 175401 - DNA, 15 bp, Homo sapiens
gaagatagagcccaa

SEQ ID NO: 175402 - DNA, 15 bp, Homo sapiens
agaagatagagccca

SEQ ID NO: 175403 - DNA, 15 bp, Homo sapiens
tagaagatagagccc

SEQ ID NO: 175404 - DNA, 15 bp, Homo sapiens
atagaagatagagcc

SEQ ID NO: 175405 - DNA, 15 bp, Homo sapiens
aatagaagatagagc

SEQ ID NO: 175406 - DNA, 15 bp, Homo sapiens
aaatagaagatagag

SEQ ID NO: 175407 - DNA, 15 bp, Homo sapiens
gaaatagaagataga

SEQ ID NO: 175408 - DNA, 15 bp, Homo sapiens
ggaaatagaagatag

SEQ ID NO: 175409 - DNA, 15 bp, Homo sapiens
aggaaatagaagata

SEQ ID NO: 175410 - DNA, 15 bp, Homo sapiens
aaggaaatagaagat

SEQ ID NO: 175411 - DNA, 15 bp, Homo sapiens
gaaggaaatagaaga

SEQ ID NO: 175412 - DNA, 15 bp, Homo sapiens
agaaggaaatagaag

SEQ ID NO: 175413 - DNA, 15 bp, Homo sapiens
tagaaggaaatagaa

SEQ ID NO: 175414 - DNA, 15 bp, Homo sapiens
atagaaggaaataga

SEQ ID NO: 175415 - DNA, 15 bp, Homo sapiens
aatagaaggaaatag

SEQ ID NO: 175416 - DNA, 15 bp, Homo sapiens
taatagaaggaaata

SEQ ID NO: 175417 - DNA, 15 bp, Homo sapiens
ttaatagaaggaaat

SEQ ID NO: 175418 - DNA, 15 bp, Homo sapiens
tttaatagaaggaaa

SEQ ID NO: 175419 - DNA, 15 bp, Homo sapiens
ttttaatagaaggaa

SEQ ID NO: 175420 - DNA, 15 bp, Homo sapiens
tttttaatagaagga

SEQ ID NO: 175421 - DNA, 15 bp, Homo sapiens
ttttttaatagaagg

SEQ ID NO: 175422 - DNA, 15 bp, Homo sapiens
tttttttaatagaag

SEQ ID NO: 175423 - DNA, 15 bp, Homo sapiens
ctttttttaatagaa

SEQ ID NO: 175424 - DNA, 15 bp, Homo sapiens
actttttttaataga

SEQ ID NO: 175425 - DNA, 15 bp, Homo sapiens
aactttttttaatag

SEQ ID NO: 175426 - DNA, 15 bp, Homo sapiens
aaactttttttaata

SEQ ID NO: 175427 - DNA, 15 bp, Homo sapiens
aaaactttttttaat

SEQ ID NO: 175428 - DNA, 15 bp, Homo sapiens
taaaactttttttaa

SEQ ID NO: 175429 - DNA, 15 bp, Homo sapiens
ataaaacttttttta

SEQ ID NO: 175430 - DNA, 15 bp, Homo sapiens
tataaaacttttttt

SEQ ID NO: 175431 - DNA, 15 bp, Homo sapiens
ttataaaactttttt

SEQ ID NO: 175432 - DNA, 15 bp, Homo sapiens
cttataaaacttttt

SEQ ID NO: 175433 - DNA, 15 bp, Homo sapiens
acttataaaactttt

SEQ ID NO: 175434 - DNA, 15 bp, Homo sapiens
aacttataaaacttt

SEQ ID NO: 175435 - DNA, 15 bp, Homo sapiens
taacttataaaactt

SEQ ID NO: 175436 - DNA, 15 bp, Homo sapiens
ataacttataaaact

SEQ ID NO: 175437 - DNA, 15 bp, Homo sapiens
aataacttataaaac

SEQ ID NO: 175438 - DNA, 15 bp, Homo sapiens
gaataacttataaaa

SEQ ID NO: 175439 - DNA, 15 bp, Homo sapiens
ggaataacttataaa

SEQ ID NO: 175440 - DNA, 15 bp, Homo sapiens
tggaataacttataa

SEQ ID NO: 175441 - DNA, 15 bp, Homo sapiens
gtggaataacttata

SEQ ID NO: 175442 - DNA, 15 bp, Homo sapiens
agtggaataacttat

SEQ ID NO: 175443 - DNA, 15 bp, Homo sapiens
aagtggaataactta

SEQ ID NO: 175444 - DNA, 15 bp, Homo sapiens
caagtggaataactt

SEQ ID NO: 175445 - DNA, 15 bp, Homo sapiens
ccaagtggaataact

SEQ ID NO: 175446 - DNA, 15 bp, Homo sapiens
gccaagtggaataac

SEQ ID NO: 175447 - DNA, 15 bp, Homo sapiens
tgccaagtggaataa

SEQ ID NO: 175448 - DNA, 15 bp, Homo sapiens
atgccaagtggaata

SEQ ID NO: 175449 - DNA, 15 bp, Homo sapiens
aatgccaagtggaat

SEQ ID NO: 175450 - DNA, 15 bp, Homo sapiens
gaatgccaagtggaa

SEQ ID NO: 175451 - DNA, 15 bp, Homo sapiens
cgaatgccaagtgga

SEQ ID NO: 175452 - DNA, 15 bp, Homo sapiens
ccgaatgccaagtgg

SEQ ID NO: 175453 - DNA, 15 bp, Homo sapiens
tccgaatgccaagtg

SEQ ID NO: 175454 - DNA, 15 bp, Homo sapiens
ttccgaatgccaagt

SEQ ID NO: 175455 - DNA, 15 bp, Homo sapiens
gttccgaatgccaag

SEQ ID NO: 175456 - DNA, 15 bp, Homo sapiens
tgttccgaatgccaa

SEQ ID NO: 175457 - DNA, 15 bp, Homo sapiens
gtgttccgaatgcca

SEQ ID NO: 175458 - DNA, 15 bp, Homo sapiens
tgtgttccgaatgcc

SEQ ID NO: 175459 - DNA, 15 bp, Homo sapiens
ttgtgttccgaatgc

SEQ ID NO: 175460 - DNA, 15 bp, Homo sapiens
attgtgttccgaatg

SEQ ID NO: 175461 - DNA, 15 bp, Homo sapiens
tattgtgttccgaat

SEQ ID NO: 175462 - DNA, 15 bp, Homo sapiens
ttattgtgttccgaa

SEQ ID NO: 175463 - DNA, 15 bp, Homo sapiens
attattgtgttccga

SEQ ID NO: 175464 - DNA, 15 bp, Homo sapiens
cattattgtgttccg

SEQ ID NO: 175465 - DNA, 15 bp, Homo sapiens
acattattgtgttcc

SEQ ID NO: 175466 - DNA, 15 bp, Homo sapiens
gacattattgtgttc

SEQ ID NO: 175467 - DNA, 15 bp, Homo sapiens
tgacattattgtgtt

SEQ ID NO: 175468 - DNA, 15 bp, Homo sapiens
atgacattattgtgt

SEQ ID NO: 175469 - DNA, 15 bp, Homo sapiens
tatgacattattgtg

SEQ ID NO: 175470 - DNA, 15 bp, Homo sapiens
gtatgacattattgt

SEQ ID NO: 175471 - DNA, 15 bp, Homo sapiens
agtatgacattattg

SEQ ID NO: 175472 - DNA, 15 bp, Homo sapiens
aagtatgacattatt

SEQ ID NO: 175473 - DNA, 15 bp, Homo sapiens
gaagtatgacattat

SEQ ID NO: 175474 - DNA, 15 bp, Homo sapiens
tgaagtatgacatta

SEQ ID NO: 175475 - DNA, 15 bp, Homo sapiens
gtgaagtatgacatt

SEQ ID NO: 175476 - DNA, 15 bp, Homo sapiens
agtgaagtatgacat

SEQ ID NO: 175477 - DNA, 15 bp, Homo sapiens
cagtgaagtatgaca

SEQ ID NO: 175478 - DNA, 15 bp, Homo sapiens
tcagtgaagtatgac

SEQ ID NO: 175479 - DNA, 15 bp, Homo sapiens
ctcagtgaagtatga

SEQ ID NO: 175480 - DNA, 15 bp, Homo sapiens
cctcagtgaagtatg

SEQ ID NO: 175481 - DNA, 15 bp, Homo sapiens
gcctcagtgaagtat

SEQ ID NO: 175482 - DNA, 15 bp, Homo sapiens
tgcctcagtgaagta

SEQ ID NO: 175483 - DNA, 15 bp, Homo sapiens
atgcctcagtgaagt

SEQ ID NO: 175484 - DNA, 15 bp, Homo sapiens
tatgcctcagtgaag

SEQ ID NO: 175485 - DNA, 15 bp, Homo sapiens
gtatgcctcagtgaa

SEQ ID NO: 175486 - DNA, 15 bp, Homo sapiens
agtatgcctcagtga

SEQ ID NO: 175487 - DNA, 15 bp, Homo sapiens
tagtatgcctcagtg

SEQ ID NO: 175488 - DNA, 15 bp, Homo sapiens
ttagtatgcctcagt

SEQ ID NO: 175489 - DNA, 15 bp, Homo sapiens
attagtatgcctcag

SEQ ID NO: 175490 - DNA, 15 bp, Homo sapiens
cattagtatgcctca

SEQ ID NO: 175491 - DNA, 15 bp, Homo sapiens
gcattagtatgcctc

SEQ ID NO: 175492 - DNA, 15 bp, Homo sapiens
agcattagtatgcct

SEQ ID NO: 175493 - DNA, 15 bp, Homo sapiens
gagcattagtatgcc

SEQ ID NO: 175494 - DNA, 15 bp, Homo sapiens
agagcattagtatgc

SEQ ID NO: 175495 - DNA, 15 bp, Homo sapiens
cagagcattagtatg

SEQ ID NO: 175496 - DNA, 15 bp, Homo sapiens
ccagagcattagtat

SEQ ID NO: 175497 - DNA, 15 bp, Homo sapiens
tccagagcattagta

SEQ ID NO: 175498 - DNA, 15 bp, Homo sapiens
ttccagagcattagt

SEQ ID NO: 175499 - DNA, 15 bp, Homo sapiens
tttccagagcattag

SEQ ID NO: 175500 - DNA, 15 bp, Homo sapiens
ctttccagagcatta

SEQ ID NO: 175501 - DNA, 15 bp, Homo sapiens
tctttccagagcatt

SEQ ID NO: 175502 - DNA, 15 bp, Homo sapiens
ttctttccagagcat

SEQ ID NO: 175503 - DNA, 15 bp, Homo sapiens
tttctttccagagca

SEQ ID NO: 175504 - DNA, 15 bp, Homo sapiens
ctttctttccagagc

SEQ ID NO: 175505 - DNA, 15 bp, Homo sapiens
tctttctttccagag

SEQ ID NO: 175506 - DNA, 15 bp, Homo sapiens
ttctttctttccaga

SEQ ID NO: 175507 - DNA, 15 bp, Homo sapiens
tttctttctttccag

SEQ ID NO: 175508 - DNA, 15 bp, Homo sapiens
ttttctttctttcca

SEQ ID NO: 175509 - DNA, 15 bp, Homo sapiens
tttttctttctttcc

SEQ ID NO: 175510 - DNA, 15 bp, Homo sapiens
ctttttctttctttc

SEQ ID NO: 175511 - DNA, 15 bp, Homo sapiens
tctttttctttcttt

SEQ ID NO: 175512 - DNA, 15 bp, Homo sapiens
ttctttttctttctt

SEQ ID NO: 175513 - DNA, 15 bp, Homo sapiens
cttctttttctttct

SEQ ID NO: 175514 - DNA, 15 bp, Homo sapiens
ccttctttttctttc

SEQ ID NO: 175515 - DNA, 15 bp, Homo sapiens
tccttctttttcttt

SEQ ID NO: 175516 - DNA, 15 bp, Homo sapiens
ttccttctttttctt

SEQ ID NO: 175517 - DNA, 15 bp, Homo sapiens
tttccttctttttct

SEQ ID NO: 175518 - DNA, 15 bp, Homo sapiens
ttttccttctttttc

SEQ ID NO: 175519 - DNA, 15 bp, Homo sapiens
attttccttcttttt

SEQ ID NO: 175520 - DNA, 15 bp, Homo sapiens
aattttccttctttt

SEQ ID NO: 175521 - DNA, 15 bp, Homo sapiens
taattttccttcttt

SEQ ID NO: 175522 - DNA, 15 bp, Homo sapiens
ttaattttccttctt

SEQ ID NO: 175523 - DNA, 15 bp, Homo sapiens
attaattttccttct

SEQ ID NO: 175524 - DNA, 15 bp, Homo sapiens
aattaattttccttc

SEQ ID NO: 175525 - DNA, 15 bp, Homo sapiens
aaattaattttcctt

SEQ ID NO: 175526 - DNA, 15 bp, Homo sapiens
taaattaattttcct

SEQ ID NO: 175527 - DNA, 15 bp, Homo sapiens
ctaaattaattttcc

SEQ ID NO: 175528 - DNA, 15 bp, Homo sapiens
tctaaattaattttc

SEQ ID NO: 175529 - DNA, 15 bp, Homo sapiens
ctctaaattaatttt

SEQ ID NO: 175530 - DNA, 15 bp, Homo sapiens
cctctaaattaattt

SEQ ID NO: 175531 - DNA, 15 bp, Homo sapiens
ccctctaaattaatt

SEQ ID NO: 175532 - DNA, 15 bp, Homo sapiens
tccctctaaattaat

SEQ ID NO: 175533 - DNA, 15 bp, Homo sapiens
ttccctctaaattaa

SEQ ID NO: 175534 - DNA, 15 bp, Homo sapiens
attccctctaaatta

SEQ ID NO: 175535 - DNA, 15 bp, Homo sapiens
cattccctctaaatt

SEQ ID NO: 175536 - DNA, 15 bp, Homo sapiens
ccattccctctaaat

SEQ ID NO: 175537 - DNA, 15 bp, Homo sapiens
tccattccctctaaa

SEQ ID NO: 175538 - DNA, 15 bp, Homo sapiens
ctccattccctctaa

SEQ ID NO: 175539 - DNA, 15 bp, Homo sapiens
cctccattccctcta

SEQ ID NO: 175540 - DNA, 15 bp, Homo sapiens
gcctccattccctct

SEQ ID NO: 175541 - DNA, 15 bp, Homo sapiens
agcctccattccctc

SEQ ID NO: 175542 - DNA, 15 bp, Homo sapiens
tagcctccattccct

SEQ ID NO: 175543 - DNA, 15 bp, Homo sapiens
ttagcctccattccc

SEQ ID NO: 175544 - DNA, 15 bp, Homo sapiens
tttagcctccattcc

SEQ ID NO: 175545 - DNA, 15 bp, Homo sapiens
atttagcctccattc

SEQ ID NO: 175546 - DNA, 15 bp, Homo sapiens
aatttagcctccatt

SEQ ID NO: 175547 - DNA, 15 bp, Homo sapiens
aaatttagcctccat

SEQ ID NO: 175548 - DNA, 15 bp, Homo sapiens
aaaatttagcctcca

SEQ ID NO: 175549 - DNA, 15 bp, Homo sapiens
gaaaatttagcctcc

SEQ ID NO: 175550 - DNA, 15 bp, Homo sapiens
ggaaaatttagcctc

SEQ ID NO: 175551 - DNA, 15 bp, Homo sapiens
tggaaaatttagcct

SEQ ID NO: 175552 - DNA, 15 bp, Homo sapiens
atggaaaatttagcc

SEQ ID NO: 175553 - DNA, 15 bp, Homo sapiens
catggaaaatttagc

SEQ ID NO: 175554 - DNA, 15 bp, Homo sapiens
ccatggaaaatttag

SEQ ID NO: 175555 - DNA, 15 bp, Homo sapiens
accatggaaaattta

SEQ ID NO: 175556 - DNA, 15 bp, Homo sapiens
caccatggaaaattt

SEQ ID NO: 175557 - DNA, 15 bp, Homo sapiens
tcaccatggaaaatt

SEQ ID NO: 175558 - DNA, 15 bp, Homo sapiens
ttcaccatggaaaat

SEQ ID NO: 175559 - DNA, 15 bp, Homo sapiens
cttcaccatggaaaa

SEQ ID NO: 175560 - DNA, 15 bp, Homo sapiens
tcttcaccatggaaa

SEQ ID NO: 175561 - DNA, 15 bp, Homo sapiens
ttcttcaccatggaa

SEQ ID NO: 175562 - DNA, 15 bp, Homo sapiens
tttcttcaccatgga

SEQ ID NO: 175563 - DNA, 15 bp, Homo sapiens
atttcttcaccatgg

SEQ ID NO: 175564 - DNA, 15 bp, Homo sapiens
aatttcttcaccatg

SEQ ID NO: 175565 - DNA, 15 bp, Homo sapiens
gaatttcttcaccat

SEQ ID NO: 175566 - DNA, 15 bp, Homo sapiens
agaatttcttcacca

SEQ ID NO: 175567 - DNA, 15 bp, Homo sapiens
cagaatttcttcacc

SEQ ID NO: 175568 - DNA, 15 bp, Homo sapiens
tcagaatttcttcac

SEQ ID NO: 175569 - DNA, 15 bp, Homo sapiens
gtcagaatttcttca

SEQ ID NO: 175570 - DNA, 15 bp, Homo sapiens
ggtcagaatttcttc

SEQ ID NO: 175571 - DNA, 15 bp, Homo sapiens
aggtcagaatttctt

SEQ ID NO: 175572 - DNA, 15 bp, Homo sapiens
aaggtcagaatttct

SEQ ID NO: 175573 - DNA, 15 bp, Homo sapiens
aaaggtcagaatttc

SEQ ID NO: 175574 - DNA, 15 bp, Homo sapiens
aaaaggtcagaattt

SEQ ID NO: 175575 - DNA, 15 bp, Homo sapiens
gaaaaggtcagaatt

SEQ ID NO: 175576 - DNA, 15 bp, Homo sapiens
agaaaaggtcagaat

SEQ ID NO: 175577 - DNA, 15 bp, Homo sapiens
cagaaaaggtcagaa

SEQ ID NO: 175578 - DNA, 15 bp, Homo sapiens
tcagaaaaggtcaga

SEQ ID NO: 175579 - DNA, 15 bp, Homo sapiens
ctcagaaaaggtcag

SEQ ID NO: 175580 - DNA, 15 bp, Homo sapiens
actcagaaaaggtca

SEQ ID NO: 175581 - DNA, 15 bp, Homo sapiens
aactcagaaaaggtc

SEQ ID NO: 175582 - DNA, 15 bp, Homo sapiens
taactcagaaaaggt

SEQ ID NO: 175583 - DNA, 15 bp, Homo sapiens
ataactcagaaaagg

SEQ ID NO: 175584 - DNA, 15 bp, Homo sapiens
gataactcagaaaag

SEQ ID NO: 175585 - DNA, 15 bp, Homo sapiens
cgataactcagaaaa

SEQ ID NO: 175586 - DNA, 15 bp, Homo sapiens
acgataactcagaaa

SEQ ID NO: 175587 - DNA, 15 bp, Homo sapiens
tacgataactcagaa

SEQ ID NO: 175588 - DNA, 15 bp, Homo sapiens
ttacgataactcaga

SEQ ID NO: 175589 - DNA, 15 bp, Homo sapiens
tttacgataactcag

SEQ ID NO: 175590 - DNA, 15 bp, Homo sapiens
ttttacgataactca

SEQ ID NO: 175591 - DNA, 15 bp, Homo sapiens
cttttacgataactc

SEQ ID NO: 175592 - DNA, 15 bp, Homo sapiens
tcttttacgataact

SEQ ID NO: 175593 - DNA, 15 bp, Homo sapiens
gtcttttacgataac

SEQ ID NO: 175594 - DNA, 15 bp, Homo sapiens
agtcttttacgataa

SEQ ID NO: 175595 - DNA, 15 bp, Homo sapiens
cagtcttttacgata

SEQ ID NO: 175596 - DNA, 15 bp, Homo sapiens
tcagtcttttacgat

SEQ ID NO: 175597 - DNA, 15 bp, Homo sapiens
gtcagtcttttacga

SEQ ID NO: 175598 - DNA, 15 bp, Homo sapiens
tgtcagtcttttacg

SEQ ID NO: 175599 - DNA, 15 bp, Homo sapiens
atgtcagtcttttac

SEQ ID NO: 175600 - DNA, 15 bp, Homo sapiens
aatgtcagtctttta

SEQ ID NO: 175601 - DNA, 15 bp, Homo sapiens
caatgtcagtctttt

SEQ ID NO: 175602 - DNA, 15 bp, Homo sapiens
gcaatgtcagtcttt

SEQ ID NO: 175603 - DNA, 15 bp, Homo sapiens
agcaatgtcagtctt

SEQ ID NO: 175604 - DNA, 15 bp, Homo sapiens
tagcaatgtcagtct

SEQ ID NO: 175605 - DNA, 15 bp, Homo sapiens
gtagcaatgtcagtc

SEQ ID NO: 175606 - DNA, 15 bp, Homo sapiens
ggtagcaatgtcagt

SEQ ID NO: 175607 - DNA, 15 bp, Homo sapiens
gggtagcaatgtcag

SEQ ID NO: 175608 - DNA, 15 bp, Homo sapiens
agggtagcaatgtca

SEQ ID NO: 175609 - DNA, 15 bp, Homo sapiens
aagggtagcaatgtc

SEQ ID NO: 175610 - DNA, 15 bp, Homo sapiens
aaagggtagcaatgt

SEQ ID NO: 175611 - DNA, 15 bp, Homo sapiens
caaagggtagcaatg

SEQ ID NO: 175612 - DNA, 15 bp, Homo sapiens
ccaaagggtagcaat

SEQ ID NO: 175613 - DNA, 15 bp, Homo sapiens
tccaaagggtagcaa

SEQ ID NO: 175614 - DNA, 15 bp, Homo sapiens
atccaaagggtagca

SEQ ID NO: 175615 - DNA, 15 bp, Homo sapiens
catccaaagggtagc

SEQ ID NO: 175616 - DNA, 15 bp, Homo sapiens
acatccaaagggtag

SEQ ID NO: 175617 - DNA, 15 bp, Homo sapiens
aacatccaaagggta

SEQ ID NO: 175618 - DNA, 15 bp, Homo sapiens
taacatccaaagggt

SEQ ID NO: 175619 - DNA, 15 bp, Homo sapiens
ttaacatccaaaggg

SEQ ID NO: 175620 - DNA, 15 bp, Homo sapiens
cttaacatccaaagg

SEQ ID NO: 175621 - DNA, 15 bp, Homo sapiens
tcttaacatccaaag

SEQ ID NO: 175622 - DNA, 15 bp, Homo sapiens
ttcttaacatccaaa

SEQ ID NO: 175623 - DNA, 15 bp, Homo sapiens
tttcttaacatccaa

SEQ ID NO: 175624 - DNA, 15 bp, Homo sapiens
ttttcttaacatcca

SEQ ID NO: 175625 - DNA, 15 bp, Homo sapiens
tttttcttaacatcc

SEQ ID NO: 175626 - DNA, 15 bp, Homo sapiens
ctttttcttaacatc

SEQ ID NO: 175627 - DNA, 15 bp, Homo sapiens
actttttcttaacat

SEQ ID NO: 175628 - DNA, 15 bp, Homo sapiens
gactttttcttaaca

SEQ ID NO: 175629 - DNA, 15 bp, Homo sapiens
agactttttcttaac

SEQ ID NO: 175630 - DNA, 15 bp, Homo sapiens
aagactttttcttaa

SEQ ID NO: 175631 - DNA, 15 bp, Homo sapiens
aaagactttttctta

SEQ ID NO: 175632 - DNA, 15 bp, Homo sapiens
gaaagactttttctt

SEQ ID NO: 175633 - DNA, 15 bp, Homo sapiens
tgaaagactttttct

SEQ ID NO: 175634 - DNA, 15 bp, Homo sapiens
ctgaaagactttttc

SEQ ID NO: 175635 - DNA, 15 bp, Homo sapiens
tctgaaagacttttt

SEQ ID NO: 175636 - DNA, 15 bp, Homo sapiens
atctgaaagactttt

SEQ ID NO: 175637 - DNA, 15 bp, Homo sapiens
tatctgaaagacttt

SEQ ID NO: 175638 - DNA, 15 bp, Homo sapiens
gtatctgaaagactt

SEQ ID NO: 175639 - DNA, 15 bp, Homo sapiens
ggtatctgaaagact

SEQ ID NO: 175640 - DNA, 15 bp, Homo sapiens
aggtatctgaaagac

SEQ ID NO: 175641 - DNA, 15 bp, Homo sapiens
aaggtatctgaaaga

SEQ ID NO: 175642 - DNA, 15 bp, Homo sapiens
caaggtatctgaaag

SEQ ID NO: 175643 - DNA, 15 bp, Homo sapiens
ccaaggtatctgaaa

SEQ ID NO: 175644 - DNA, 15 bp, Homo sapiens
gccaaggtatctgaa

SEQ ID NO: 175645 - DNA, 15 bp, Homo sapiens
agccaaggtatctga

SEQ ID NO: 175646 - DNA, 15 bp, Homo sapiens
aagccaaggtatctg

SEQ ID NO: 175647 - DNA, 15 bp, Homo sapiens
caagccaaggtatct

SEQ ID NO: 175648 - DNA, 15 bp, Homo sapiens
acaagccaaggtatc

SEQ ID NO: 175649 - DNA, 15 bp, Homo sapiens
tacaagccaaggtat

SEQ ID NO: 175650 - DNA, 15 bp, Homo sapiens
ttacaagccaaggta

SEQ ID NO: 175651 - DNA, 15 bp, Homo sapiens
cttacaagccaaggt

SEQ ID NO: 175652 - DNA, 15 bp, Homo sapiens
ccttacaagccaagg

SEQ ID NO: 175653 - DNA, 15 bp, Homo sapiens
cccttacaagccaag

SEQ ID NO: 175654 - DNA, 15 bp, Homo sapiens
tcccttacaagccaa

SEQ ID NO: 175655 - DNA, 15 bp, Homo sapiens
gtcccttacaagcca

SEQ ID NO: 175656 - DNA, 15 bp, Homo sapiens
ggtcccttacaagcc

SEQ ID NO: 175657 - DNA, 15 bp, Homo sapiens
aggtcccttacaagc

SEQ ID NO: 175658 - DNA, 15 bp, Homo sapiens
caggtcccttacaag

SEQ ID NO: 175659 - DNA, 15 bp, Homo sapiens
ccaggtcccttacaa

SEQ ID NO: 175660 - DNA, 15 bp, Homo sapiens
cccaggtcccttaca

SEQ ID NO: 175661 - DNA, 15 bp, Homo sapiens
tcccaggtcccttac

SEQ ID NO: 175662 - DNA, 15 bp, Homo sapiens
ttcccaggtccctta

SEQ ID NO: 175663 - DNA, 15 bp, Homo sapiens
cttcccaggtccctt

SEQ ID NO: 175664 - DNA, 15 bp, Homo sapiens
gcttcccaggtccct

SEQ ID NO: 175665 - DNA, 15 bp, Homo sapiens
cgcttcccaggtccc

SEQ ID NO: 175666 - DNA, 15 bp, Homo sapiens
gcgcttcccaggtcc

SEQ ID NO: 175667 - DNA, 15 bp, Homo sapiens
ggcgcttcccaggtc

SEQ ID NO: 175668 - DNA, 15 bp, Homo sapiens
tggcgcttcccaggt

SEQ ID NO: 175669 - DNA, 15 bp, Homo sapiens
ctggcgcttcccagg

SEQ ID NO: 175670 - DNA, 15 bp, Homo sapiens
cctggcgcttcccag

SEQ ID NO: 175671 - DNA, 15 bp, Homo sapiens
ccctggcgcttccca

SEQ ID NO: 175672 - DNA, 15 bp, Homo sapiens
accctggcgcttccc

SEQ ID NO: 175673 - DNA, 15 bp, Homo sapiens
gaccctggcgcttcc

SEQ ID NO: 175674 - DNA, 15 bp, Homo sapiens
ggaccctggcgcttc

SEQ ID NO: 175675 - DNA, 15 bp, Homo sapiens
tggaccctggcgctt

SEQ ID NO: 175676 - DNA, 15 bp, Homo sapiens
atggaccctggcgct

SEQ ID NO: 175677 - DNA, 15 bp, Homo sapiens
gatggaccctggcgc

SEQ ID NO: 175678 - DNA, 15 bp, Homo sapiens
tgatggaccctggcg

SEQ ID NO: 175679 - DNA, 15 bp, Homo sapiens
ttgatggaccctggc

SEQ ID NO: 175680 - DNA, 15 bp, Homo sapiens
tttgatggaccctgg

SEQ ID NO: 175681 - DNA, 15 bp, Homo sapiens
ttttgatggaccctg

SEQ ID NO: 175682 - DNA, 15 bp, Homo sapiens
tttttgatggaccct

SEQ ID NO: 175683 - DNA, 15 bp, Homo sapiens
atttttgatggaccc

SEQ ID NO: 175684 - DNA, 15 bp, Homo sapiens
catttttgatggacc

SEQ ID NO: 175685 - DNA, 15 bp, Homo sapiens
acatttttgatggac

SEQ ID NO: 175686 - DNA, 15 bp, Homo sapiens
tacatttttgatgga

SEQ ID NO: 175687 - DNA, 15 bp, Homo sapiens
ttacatttttgatgg

SEQ ID NO: 175688 - DNA, 15 bp, Homo sapiens
tttacatttttgatg

SEQ ID NO: 175689 - DNA, 15 bp, Homo sapiens
ctttacatttttgat

SEQ ID NO: 175690 - DNA, 15 bp, Homo sapiens
tctttacatttttga

SEQ ID NO: 175691 - DNA, 15 bp, Homo sapiens
gtctttacatttttg

SEQ ID NO: 175692 - DNA, 15 bp, Homo sapiens
tgtctttacattttt

SEQ ID NO: 175693 - DNA, 15 bp, Homo sapiens
atgtctttacatttt

SEQ ID NO: 175694 - DNA, 15 bp, Homo sapiens
aatgtctttacattt

SEQ ID NO: 175695 - DNA, 15 bp, Homo sapiens
aaatgtctttacatt

SEQ ID NO: 175696 - DNA, 15 bp, Homo sapiens
taaatgtctttacat

SEQ ID NO: 175697 - DNA, 15 bp, Homo sapiens
ataaatgtctttaca

SEQ ID NO: 175698 - DNA, 15 bp, Homo sapiens
aataaatgtctttac

SEQ ID NO: 175699 - DNA, 15 bp, Homo sapiens
taataaatgtcttta

SEQ ID NO: 175700 - DNA, 15 bp, Homo sapiens
ctaataaatgtcttt

SEQ ID NO: 175701 - DNA, 15 bp, Homo sapiens
tctaataaatgtctt

SEQ ID NO: 175702 - DNA, 15 bp, Homo sapiens
ttctaataaatgtct

SEQ ID NO: 175703 - DNA, 15 bp, Homo sapiens
gttctaataaatgtc

SEQ ID NO: 175704 - DNA, 15 bp, Homo sapiens
tgttctaataaatgt

SEQ ID NO: 175705 - DNA, 15 bp, Homo sapiens
atgttctaataaatg

SEQ ID NO: 175706 - DNA, 15 bp, Homo sapiens
catgttctaataaat

SEQ ID NO: 175707 - DNA, 15 bp, Homo sapiens
gcatgttctaataaa

SEQ ID NO: 175708 - DNA, 15 bp, Homo sapiens
tgcatgttctaataa

SEQ ID NO: 175709 - DNA, 15 bp, Homo sapiens
atgcatgttctaata

SEQ ID NO: 175710 - DNA, 15 bp, Homo sapiens
tatgcatgttctaat

SEQ ID NO: 175711 - DNA, 15 bp, Homo sapiens
atatgcatgttctaa

SEQ ID NO: 175712 - DNA, 15 bp, Homo sapiens
gatatgcatgttcta

SEQ ID NO: 175713 - DNA, 15 bp, Homo sapiens
ggatatgcatgttct

SEQ ID NO: 175714 - DNA, 15 bp, Homo sapiens
cggatatgcatgttc

SEQ ID NO: 175715 - DNA, 15 bp, Homo sapiens
tcggatatgcatgtt

SEQ ID NO: 175716 - DNA, 15 bp, Homo sapiens
ttcggatatgcatgt

SEQ ID NO: 175717 - DNA, 15 bp, Homo sapiens
tttcggatatgcatg

SEQ ID NO: 175718 - DNA, 15 bp, Homo sapiens
ctttcggatatgcat

SEQ ID NO: 175719 - DNA, 15 bp, Homo sapiens
gctttcggatatgca

SEQ ID NO: 175720 - DNA, 15 bp, Homo sapiens
agctttcggatatgc

SEQ ID NO: 175721 - DNA, 15 bp, Homo sapiens
aagctttcggatatg

SEQ ID NO: 175722 - DNA, 15 bp, Homo sapiens
aaagctttcggatat

SEQ ID NO: 175723 - DNA, 15 bp, Homo sapiens
gaaagctttcggata

SEQ ID NO: 175724 - DNA, 15 bp, Homo sapiens
agaaagctttcggat

SEQ ID NO: 175725 - DNA, 15 bp, Homo sapiens
cagaaagctttcgga

SEQ ID NO: 175726 - DNA, 15 bp, Homo sapiens
tcagaaagctttcgg

SEQ ID NO: 175727 - DNA, 15 bp, Homo sapiens
ttcagaaagctttcg

SEQ ID NO: 175728 - DNA, 15 bp, Homo sapiens
attcagaaagctttc

SEQ ID NO: 175729 - DNA, 15 bp, Homo sapiens
aattcagaaagcttt

SEQ ID NO: 175730 - DNA, 15 bp, Homo sapiens
gaattcagaaagctt

SEQ ID NO: 175731 - DNA, 15 bp, Homo sapiens
agaattcagaaagct

SEQ ID NO: 175732 - DNA, 15 bp, Homo sapiens
cagaattcagaaagc

SEQ ID NO: 175733 - DNA, 15 bp, Homo sapiens
acagaattcagaaag

SEQ ID NO: 175734 - DNA, 15 bp, Homo sapiens
cacagaattcagaaa

SEQ ID NO: 175735 - DNA, 15 bp, Homo sapiens
ccacagaattcagaa

SEQ ID NO: 175736 - DNA, 15 bp, Homo sapiens
cccacagaattcaga

SEQ ID NO: 175737 - DNA, 15 bp, Homo sapiens
ccccacagaattcag

SEQ ID NO: 175738 - DNA, 15 bp, Homo sapiens
tccccacagaattca

SEQ ID NO: 175739 - DNA, 15 bp, Homo sapiens
gtccccacagaattc

SEQ ID NO: 175740 - DNA, 15 bp, Homo sapiens
ggtccccacagaatt

SEQ ID NO: 175741 - DNA, 15 bp, Homo sapiens
tggtccccacagaat

SEQ ID NO: 175742 - DNA, 15 bp, Homo sapiens
atggtccccacagaa

SEQ ID NO: 175743 - DNA, 15 bp, Homo sapiens
gatggtccccacaga

SEQ ID NO: 175744 - DNA, 15 bp, Homo sapiens
agatggtccccacag

SEQ ID NO: 175745 - DNA, 15 bp, Homo sapiens
tagatggtccccaca

SEQ ID NO: 175746 - DNA, 15 bp, Homo sapiens
ctagatggtccccac

SEQ ID NO: 175747 - DNA, 15 bp, Homo sapiens
gctagatggtcccca

SEQ ID NO: 175748 - DNA, 15 bp, Homo sapiens
agctagatggtcccc

SEQ ID NO: 175749 - DNA, 15 bp, Homo sapiens
aagctagatggtccc

SEQ ID NO: 175750 - DNA, 15 bp, Homo sapiens
aaagctagatggtcc

SEQ ID NO: 175751 - DNA, 15 bp, Homo sapiens
aaaagctagatggtc

SEQ ID NO: 175752 - DNA, 15 bp, Homo sapiens
taaaagctagatggt

SEQ ID NO: 175753 - DNA, 15 bp, Homo sapiens
gtaaaagctagatgg

SEQ ID NO: 175754 - DNA, 15 bp, Homo sapiens
tgtaaaagctagatg

SEQ ID NO: 175755 - DNA, 15 bp, Homo sapiens
atgtaaaagctagat

SEQ ID NO: 175756 - DNA, 15 bp, Homo sapiens
catgtaaaagctaga

SEQ ID NO: 175757 - DNA, 15 bp, Homo sapiens
tcatgtaaaagctag

SEQ ID NO: 175758 - DNA, 15 bp, Homo sapiens
atcatgtaaaagcta

SEQ ID NO: 175759 - DNA, 15 bp, Homo sapiens
gatcatgtaaaagct

SEQ ID NO: 175760 - DNA, 15 bp, Homo sapiens
agatcatgtaaaagc

SEQ ID NO: 175761 - DNA, 15 bp, Homo sapiens
aagatcatgtaaaag

SEQ ID NO: 175762 - DNA, 15 bp, Homo sapiens
caagatcatgtaaaa

SEQ ID NO: 175763 - DNA, 15 bp, Homo sapiens
tcaagatcatgtaaa

SEQ ID NO: 175764 - DNA, 15 bp, Homo sapiens
ctcaagatcatgtaa

SEQ ID NO: 175765 - DNA, 15 bp, Homo sapiens
cctcaagatcatgta

SEQ ID NO: 175766 - DNA, 15 bp, Homo sapiens
ccctcaagatcatgt

SEQ ID NO: 175767 - DNA, 15 bp, Homo sapiens
tccctcaagatcatg

SEQ ID NO: 175768 - DNA, 15 bp, Homo sapiens
ttccctcaagatcat

SEQ ID NO: 175769 - DNA, 15 bp, Homo sapiens
gttccctcaagatca

SEQ ID NO: 175770 - DNA, 15 bp, Homo sapiens
ggttccctcaagatc

SEQ ID NO: 175771 - DNA, 15 bp, Homo sapiens
tggttccctcaagat

SEQ ID NO: 175772 - DNA, 15 bp, Homo sapiens
ttggttccctcaaga

SEQ ID NO: 175773 - DNA, 15 bp, Homo sapiens
tttggttccctcaag

SEQ ID NO: 175774 - DNA, 15 bp, Homo sapiens
ctttggttccctcaa

SEQ ID NO: 175775 - DNA, 15 bp, Homo sapiens
actttggttccctca

SEQ ID NO: 175776 - DNA, 15 bp, Homo sapiens
aactttggttccctc

SEQ ID NO: 175777 - DNA, 15 bp, Homo sapiens
caactttggttccct

SEQ ID NO: 175778 - DNA, 15 bp, Homo sapiens
acaactttggttccc

SEQ ID NO: 175779 - DNA, 15 bp, Homo sapiens
tacaactttggttcc

SEQ ID NO: 175780 - DNA, 15 bp, Homo sapiens
gtacaactttggttc

SEQ ID NO: 175781 - DNA, 15 bp, Homo sapiens
agtacaactttggtt

SEQ ID NO: 175782 - DNA, 15 bp, Homo sapiens
cagtacaactttggt

SEQ ID NO: 175783 - DNA, 15 bp, Homo sapiens
tcagtacaactttgg

SEQ ID NO: 175784 - DNA, 15 bp, Homo sapiens
ctcagtacaactttg

SEQ ID NO: 175785 - DNA, 15 bp, Homo sapiens
tctcagtacaacttt

SEQ ID NO: 175786 - DNA, 15 bp, Homo sapiens
ttctcagtacaactt

SEQ ID NO: 175787 - DNA, 15 bp, Homo sapiens
tttctcagtacaact

SEQ ID NO: 175788 - DNA, 15 bp, Homo sapiens
ttttctcagtacaac

SEQ ID NO: 175789 - DNA, 15 bp, Homo sapiens
gttttctcagtacaa

SEQ ID NO: 175790 - DNA, 15 bp, Homo sapiens
ggttttctcagtaca

SEQ ID NO: 175791 - DNA, 15 bp, Homo sapiens
gggttttctcagtac

SEQ ID NO: 175792 - DNA, 15 bp, Homo sapiens
tgggttttctcagta

SEQ ID NO: 175793 - DNA, 15 bp, Homo sapiens
ctgggttttctcagt

SEQ ID NO: 175794 - DNA, 15 bp, Homo sapiens
actgggttttctcag

SEQ ID NO: 175795 - DNA, 15 bp, Homo sapiens
aactgggttttctca

SEQ ID NO: 175796 - DNA, 15 bp, Homo sapiens
aaactgggttttctc

SEQ ID NO: 175797 - DNA, 15 bp, Homo sapiens
gaaactgggttttct

SEQ ID NO: 175798 - DNA, 15 bp, Homo sapiens
ggaaactgggttttc

SEQ ID NO: 175799 - DNA, 15 bp, Homo sapiens
aggaaactgggtttt

SEQ ID NO: 175800 - DNA, 15 bp, Homo sapiens
gaggaaactgggttt

SEQ ID NO: 175801 - DNA, 15 bp, Homo sapiens
agaggaaactgggtt

SEQ ID NO: 175802 - DNA, 15 bp, Homo sapiens
aagaggaaactgggt

SEQ ID NO: 175803 - DNA, 15 bp, Homo sapiens
taagaggaaactggg

SEQ ID NO: 175804 - DNA, 15 bp, Homo sapiens
ttaagaggaaactgg

SEQ ID NO: 175805 - DNA, 15 bp, Homo sapiens
attaagaggaaactg

SEQ ID NO: 175806 - DNA, 15 bp, Homo sapiens
aattaagaggaaact

SEQ ID NO: 175807 - DNA, 15 bp, Homo sapiens
gaattaagaggaaac

SEQ ID NO: 175808 - DNA, 15 bp, Homo sapiens
ggaattaagaggaaa

SEQ ID NO: 175809 - DNA, 15 bp, Homo sapiens
tggaattaagaggaa

SEQ ID NO: 175810 - DNA, 15 bp, Homo sapiens
atggaattaagagga

SEQ ID NO: 175811 - DNA, 15 bp, Homo sapiens
gatggaattaagagg

SEQ ID NO: 175812 - DNA, 15 bp, Homo sapiens
ggatggaattaagag

SEQ ID NO: 175813 - DNA, 15 bp, Homo sapiens
aggatggaattaaga

SEQ ID NO: 175814 - DNA, 15 bp, Homo sapiens
taggatggaattaag

SEQ ID NO: 175815 - DNA, 15 bp, Homo sapiens
ataggatggaattaa

SEQ ID NO: 175816 - DNA, 15 bp, Homo sapiens
cataggatggaatta

SEQ ID NO: 175817 - DNA, 15 bp, Homo sapiens
acataggatggaatt

SEQ ID NO: 175818 - DNA, 15 bp, Homo sapiens
cacataggatggaat

SEQ ID NO: 175819 - DNA, 15 bp, Homo sapiens
tcacataggatggaa

SEQ ID NO: 175820 - DNA, 15 bp, Homo sapiens
ttcacataggatgga

SEQ ID NO: 175821 - DNA, 15 bp, Homo sapiens
tttcacataggatgg

SEQ ID NO: 175822 - DNA, 15 bp, Homo sapiens
ttttcacataggatg

SEQ ID NO: 175823 - DNA, 15 bp, Homo sapiens
gttttcacataggat

SEQ ID NO: 175824 - DNA, 15 bp, Homo sapiens
tgttttcacatagga

SEQ ID NO: 175825 - DNA, 15 bp, Homo sapiens
ttgttttcacatagg

SEQ ID NO: 175826 - DNA, 15 bp, Homo sapiens
gttgttttcacatag

SEQ ID NO: 175827 - DNA, 15 bp, Homo sapiens
agttgttttcacata

SEQ ID NO: 175828 - DNA, 15 bp, Homo sapiens
aagttgttttcacat

SEQ ID NO: 175829 - DNA, 15 bp, Homo sapiens
taagttgttttcaca

SEQ ID NO: 175830 - DNA, 15 bp, Homo sapiens
ttaagttgttttcac

SEQ ID NO: 175831 - DNA, 15 bp, Homo sapiens
cttaagttgttttca

SEQ ID NO: 175832 - DNA, 15 bp, Homo sapiens
acttaagttgttttc

SEQ ID NO: 175833 - DNA, 15 bp, Homo sapiens
gacttaagttgtttt

SEQ ID NO: 175834 - DNA, 15 bp, Homo sapiens
agacttaagttgttt

SEQ ID NO: 175835 - DNA, 15 bp, Homo sapiens
gagacttaagttgtt

SEQ ID NO: 175836 - DNA, 15 bp, Homo sapiens
tgagacttaagttgt

SEQ ID NO: 175837 - DNA, 15 bp, Homo sapiens
ttgagacttaagttg

SEQ ID NO: 175838 - DNA, 15 bp, Homo sapiens
gttgagacttaagtt

SEQ ID NO: 175839 - DNA, 15 bp, Homo sapiens
agttgagacttaagt

SEQ ID NO: 175840 - DNA, 15 bp, Homo sapiens
cagttgagacttaag

SEQ ID NO: 175841 - DNA, 15 bp, Homo sapiens
gcagttgagacttaa

SEQ ID NO: 175842 - DNA, 15 bp, Homo sapiens
tgcagttgagactta

SEQ ID NO: 175843 - DNA, 15 bp, Homo sapiens
gtgcagttgagactt

SEQ ID NO: 175844 - DNA, 15 bp, Homo sapiens
agtgcagttgagact

SEQ ID NO: 175845 - DNA, 15 bp, Homo sapiens
tagtgcagttgagac

SEQ ID NO: 175846 - DNA, 15 bp, Homo sapiens
ttagtgcagttgaga

SEQ ID NO: 175847 - DNA, 15 bp, Homo sapiens
cttagtgcagttgag

SEQ ID NO: 175848 - DNA, 15 bp, Homo sapiens
acttagtgcagttga

SEQ ID NO: 175849 - DNA, 15 bp, Homo sapiens
aacttagtgcagttg

SEQ ID NO: 175850 - DNA, 15 bp, Homo sapiens
taacttagtgcagtt

SEQ ID NO: 175851 - DNA, 15 bp, Homo sapiens
ataacttagtgcagt

SEQ ID NO: 175852 - DNA, 15 bp, Homo sapiens
cataacttagtgcag

SEQ ID NO: 175853 - DNA, 15 bp, Homo sapiens
tcataacttagtgca

SEQ ID NO: 175854 - DNA, 15 bp, Homo sapiens
ttcataacttagtgc

SEQ ID NO: 175855 - DNA, 15 bp, Homo sapiens
tttcataacttagtg

SEQ ID NO: 175856 - DNA, 15 bp, Homo sapiens
ttttcataacttagt

SEQ ID NO: 175857 - DNA, 15 bp, Homo sapiens
attttcataacttag

SEQ ID NO: 175858 - DNA, 15 bp, Homo sapiens
cattttcataactta

SEQ ID NO: 175859 - DNA, 15 bp, Homo sapiens
ccattttcataactt

SEQ ID NO: 175860 - DNA, 15 bp, Homo sapiens
tccattttcataact

SEQ ID NO: 175861 - DNA, 15 bp, Homo sapiens
atccattttcataac

SEQ ID NO: 175862 - DNA, 15 bp, Homo sapiens
gatccattttcataa

SEQ ID NO: 175863 - DNA, 15 bp, Homo sapiens
ggatccattttcata

SEQ ID NO: 175864 - DNA, 15 bp, Homo sapiens
aggatccattttcat

SEQ ID NO: 175865 - DNA, 15 bp, Homo sapiens
gaggatccattttca

SEQ ID NO: 175866 - DNA, 15 bp, Homo sapiens
agaggatccattttc

SEQ ID NO: 175867 - DNA, 15 bp, Homo sapiens
aagaggatccatttt

SEQ ID NO: 175868 - DNA, 15 bp, Homo sapiens
aaagaggatccattt

SEQ ID NO: 175869 - DNA, 15 bp, Homo sapiens
aaaagaggatccatt

SEQ ID NO: 175870 - DNA, 15 bp, Homo sapiens
aaaaagaggatccat

SEQ ID NO: 175871 - DNA, 15 bp, Homo sapiens
aaaaaagaggatcca

SEQ ID NO: 175872 - DNA, 15 bp, Homo sapiens
aaaaaaagaggatcc

SEQ ID NO: 175873 - DNA, 15 bp, Homo sapiens
taaaaaaagaggatc

SEQ ID NO: 175874 - DNA, 15 bp, Homo sapiens
ttaaaaaaagaggat

SEQ ID NO: 175875 - DNA, 15 bp, Homo sapiens
gttaaaaaaagagga

SEQ ID NO: 175876 - DNA, 15 bp, Homo sapiens
tgttaaaaaaagagg

SEQ ID NO: 175877 - DNA, 15 bp, Homo sapiens
atgttaaaaaaagag

SEQ ID NO: 175878 - DNA, 15 bp, Homo sapiens
aatgttaaaaaaaga

SEQ ID NO: 175879 - DNA, 15 bp, Homo sapiens
aaatgttaaaaaaag

SEQ ID NO: 175880 - DNA, 15 bp, Homo sapiens
caaatgttaaaaaaa

SEQ ID NO: 175881 - DNA, 15 bp, Homo sapiens
ccaaatgttaaaaaa

SEQ ID NO: 175882 - DNA, 15 bp, Homo sapiens
accaaatgttaaaaa

SEQ ID NO: 175883 - DNA, 15 bp, Homo sapiens
aaccaaatgttaaaa

SEQ ID NO: 175884 - DNA, 15 bp, Homo sapiens
aaaccaaatgttaaa

SEQ ID NO: 175885 - DNA, 15 bp, Homo sapiens
aaaaccaaatgttaa

SEQ ID NO: 175886 - DNA, 15 bp, Homo sapiens
aaaaaccaaatgtta

SEQ ID NO: 175887 - DNA, 15 bp, Homo sapiens
caaaaaccaaatgtt

SEQ ID NO: 175888 - DNA, 15 bp, Homo sapiens
ccaaaaaccaaatgt

SEQ ID NO: 175889 - DNA, 15 bp, Homo sapiens
accaaaaaccaaatg

SEQ ID NO: 175890 - DNA, 15 bp, Homo sapiens
aaccaaaaaccaaat

SEQ ID NO: 175891 - DNA, 15 bp, Homo sapiens
taaccaaaaaccaaa

SEQ ID NO: 175892 - DNA, 15 bp, Homo sapiens
ataaccaaaaaccaa

SEQ ID NO: 175893 - DNA, 15 bp, Homo sapiens
aataaccaaaaacca

SEQ ID NO: 175894 - DNA, 15 bp, Homo sapiens
gaataaccaaaaacc

SEQ ID NO: 175895 - DNA, 15 bp, Homo sapiens
tgaataaccaaaaac

SEQ ID NO: 175896 - DNA, 15 bp, Homo sapiens
atgaataaccaaaaa

SEQ ID NO: 175897 - DNA, 15 bp, Homo sapiens
tatgaataaccaaaa

SEQ ID NO: 175898 - DNA, 15 bp, Homo sapiens
atatgaataaccaaa

SEQ ID NO: 175899 - DNA, 15 bp, Homo sapiens
aatatgaataaccaa

SEQ ID NO: 175900 - DNA, 15 bp, Homo sapiens
caatatgaataacca

SEQ ID NO: 175901 - DNA, 15 bp, Homo sapiens
acaatatgaataacc

SEQ ID NO: 175902 - DNA, 15 bp, Homo sapiens
gacaatatgaataac

SEQ ID NO: 175903 - DNA, 15 bp, Homo sapiens
agacaatatgaataa

SEQ ID NO: 175904 - DNA, 15 bp, Homo sapiens
tagacaatatgaata

SEQ ID NO: 175905 - DNA, 15 bp, Homo sapiens
atagacaatatgaat

SEQ ID NO: 175906 - DNA, 15 bp, Homo sapiens
tatagacaatatgaa

SEQ ID NO: 175907 - DNA, 15 bp, Homo sapiens
atatagacaatatga

SEQ ID NO: 175908 - DNA, 15 bp, Homo sapiens
aatatagacaatatg

SEQ ID NO: 175909 - DNA, 15 bp, Homo sapiens
gaatatagacaatat

SEQ ID NO: 175910 - DNA, 15 bp, Homo sapiens
agaatatagacaata

SEQ ID NO: 175911 - DNA, 15 bp, Homo sapiens
cagaatatagacaat

SEQ ID NO: 175912 - DNA, 15 bp, Homo sapiens
acagaatatagacaa

SEQ ID NO: 175913 - DNA, 15 bp, Homo sapiens
aacagaatatagaca

SEQ ID NO: 175914 - DNA, 15 bp, Homo sapiens
gaacagaatatagac

SEQ ID NO: 175915 - DNA, 15 bp, Homo sapiens
agaacagaatataga

SEQ ID NO: 175916 - DNA, 15 bp, Homo sapiens
tagaacagaatatag

SEQ ID NO: 175917 - DNA, 15 bp, Homo sapiens
atagaacagaatata

SEQ ID NO: 175918 - DNA, 15 bp, Homo sapiens
tatagaacagaatat

SEQ ID NO: 175919 - DNA, 15 bp, Homo sapiens
ttatagaacagaata

SEQ ID NO: 175920 - DNA, 15 bp, Homo sapiens
attatagaacagaat

SEQ ID NO: 175921 - DNA, 15 bp, Homo sapiens
aattatagaacagaa

SEQ ID NO: 175922 - DNA, 15 bp, Homo sapiens
caattatagaacaga

SEQ ID NO: 175923 - DNA, 15 bp, Homo sapiens
acaattatagaacag

SEQ ID NO: 175924 - DNA, 15 bp, Homo sapiens
tacaattatagaaca

SEQ ID NO: 175925 - DNA, 15 bp, Homo sapiens
atacaattatagaac

SEQ ID NO: 175926 - DNA, 15 bp, Homo sapiens
gatacaattatagaa

SEQ ID NO: 175927 - DNA, 15 bp, Homo sapiens
ggatacaattataga

SEQ ID NO: 175928 - DNA, 15 bp, Homo sapiens
tggatacaattatag

SEQ ID NO: 175929 - DNA, 15 bp, Homo sapiens
ttggatacaattata

SEQ ID NO: 175930 - DNA, 15 bp, Homo sapiens
cttggatacaattat

SEQ ID NO: 175931 - DNA, 15 bp, Homo sapiens
acttggatacaatta

SEQ ID NO: 175932 - DNA, 15 bp, Homo sapiens
cacttggatacaatt

SEQ ID NO: 175933 - DNA, 15 bp, Homo sapiens
acacttggatacaat

SEQ ID NO: 175934 - DNA, 15 bp, Homo sapiens
aacacttggatacaa

SEQ ID NO: 175935 - DNA, 15 bp, Homo sapiens
taacacttggataca

SEQ ID NO: 175936 - DNA, 15 bp, Homo sapiens
ttaacacttggatac

SEQ ID NO: 175937 - DNA, 15 bp, Homo sapiens
tttaacacttggata

SEQ ID NO: 175938 - DNA, 15 bp, Homo sapiens
ttttaacacttggat

SEQ ID NO: 175939 - DNA, 15 bp, Homo sapiens
attttaacacttgga

SEQ ID NO: 175940 - DNA, 15 bp, Homo sapiens
tattttaacacttgg

SEQ ID NO: 175941 - DNA, 15 bp, Homo sapiens
atattttaacacttg

SEQ ID NO: 175942 - DNA, 15 bp, Homo sapiens
tatattttaacactt

SEQ ID NO: 175943 - DNA, 15 bp, Homo sapiens
atatattttaacact

SEQ ID NO: 175944 - DNA, 15 bp, Homo sapiens
aatatattttaacac

SEQ ID NO: 175945 - DNA, 15 bp, Homo sapiens
aaatatattttaaca

SEQ ID NO: 175946 - DNA, 15 bp, Homo sapiens
aaaatatattttaac

SEQ ID NO: 175947 - DNA, 15 bp, Homo sapiens
taaaatatattttaa

SEQ ID NO: 175948 - DNA, 15 bp, Homo sapiens
ataaaatatatttta

SEQ ID NO: 175949 - DNA, 15 bp, Homo sapiens
tataaaatatatttt

SEQ ID NO: 175950 - DNA, 15 bp, Homo sapiens
ttataaaatatattt

SEQ ID NO: 175951 - DNA, 15 bp, Homo sapiens
tttataaaatatatt

SEQ ID NO: 175952 - DNA, 15 bp, Homo sapiens
atttataaaatatat

SEQ ID NO: 175953 - DNA, 15 bp, Homo sapiens
tatttataaaatata

SEQ ID NO: 175954 - DNA, 15 bp, Homo sapiens
atatttataaaatat

SEQ ID NO: 175955 - DNA, 15 bp, Homo sapiens
tatatttataaaata

SEQ ID NO: 175956 - DNA, 15 bp, Homo sapiens
gtatatttataaaat

SEQ ID NO: 175957 - DNA, 15 bp, Homo sapiens
agtatatttataaaa

SEQ ID NO: 175958 - DNA, 15 bp, Homo sapiens
cagtatatttataaa

SEQ ID NO: 175959 - DNA, 15 bp, Homo sapiens
tcagtatatttataa

SEQ ID NO: 175960 - DNA, 15 bp, Homo sapiens
gtcagtatatttata

SEQ ID NO: 175961 - DNA, 15 bp, Homo sapiens
tgtcagtatatttat

SEQ ID NO: 175962 - DNA, 15 bp, Homo sapiens
gtgtcagtatattta

SEQ ID NO: 175963 - DNA, 15 bp, Homo sapiens
agtgtcagtatattt

SEQ ID NO: 175964 - DNA, 15 bp, Homo sapiens
cagtgtcagtatatt

SEQ ID NO: 175965 - DNA, 15 bp, Homo sapiens
tcagtgtcagtatat

SEQ ID NO: 175966 - DNA, 15 bp, Homo sapiens
ttcagtgtcagtata

SEQ ID NO: 175967 - DNA, 15 bp, Homo sapiens
tttcagtgtcagtat

SEQ ID NO: 175968 - DNA, 15 bp, Homo sapiens
ttttcagtgtcagta

SEQ ID NO: 175969 - DNA, 15 bp, Homo sapiens
tttttcagtgtcagt

SEQ ID NO: 175970 - DNA, 15 bp, Homo sapiens
ctttttcagtgtcag

SEQ ID NO: 175971 - DNA, 15 bp, Homo sapiens
tctttttcagtgtca

SEQ ID NO: 175972 - DNA, 15 bp, Homo sapiens
ttctttttcagtgtc

SEQ ID NO: 175973 - DNA, 15 bp, Homo sapiens
tttctttttcagtgt

SEQ ID NO: 175974 - DNA, 15 bp, Homo sapiens
atttctttttcagtg

SEQ ID NO: 175975 - DNA, 15 bp, Homo sapiens
gatttctttttcagt

SEQ ID NO: 175976 - DNA, 15 bp, Homo sapiens
tgatttctttttcag

SEQ ID NO: 175977 - DNA, 15 bp, Homo sapiens
ttgatttctttttca

SEQ ID NO: 175978 - DNA, 15 bp, Homo sapiens
tttgatttctttttc

SEQ ID NO: 175979 - DNA, 15 bp, Homo sapiens
ttttgatttcttttt

SEQ ID NO: 175980 - DNA, 15 bp, Homo sapiens
cttttgatttctttt

SEQ ID NO: 175981 - DNA, 15 bp, Homo sapiens
gcttttgatttcttt

SEQ ID NO: 175982 - DNA, 15 bp, Homo sapiens
agcttttgatttctt

SEQ ID NO: 175983 - DNA, 15 bp, Homo sapiens
cagcttttgatttct

SEQ ID NO: 175984 - DNA, 15 bp, Homo sapiens
tcagcttttgatttc

SEQ ID NO: 175985 - DNA, 15 bp, Homo sapiens
ctcagcttttgattt

SEQ ID NO: 175986 - DNA, 15 bp, Homo sapiens
tctcagcttttgatt

SEQ ID NO: 175987 - DNA, 15 bp, Homo sapiens
ttctcagcttttgat

SEQ ID NO: 175988 - DNA, 15 bp, Homo sapiens
tttctcagcttttga

SEQ ID NO: 175989 - DNA, 15 bp, Homo sapiens
gtttctcagcttttg

SEQ ID NO: 175990 - DNA, 15 bp, Homo sapiens
cgtttctcagctttt

SEQ ID NO: 175991 - DNA, 15 bp, Homo sapiens
acgtttctcagcttt

SEQ ID NO: 175992 - DNA, 15 bp, Homo sapiens
aacgtttctcagctt

SEQ ID NO: 175993 - DNA, 15 bp, Homo sapiens
aaacgtttctcagct

SEQ ID NO: 175994 - DNA, 15 bp, Homo sapiens
caaacgtttctcagc

SEQ ID NO: 175995 - DNA, 15 bp, Homo sapiens
acaaacgtttctcag

SEQ ID NO: 175996 - DNA, 15 bp, Homo sapiens
cacaaacgtttctca

SEQ ID NO: 175997 - DNA, 15 bp, Homo sapiens
tcacaaacgtttctc

SEQ ID NO: 175998 - DNA, 15 bp, Homo sapiens
ttcacaaacgtttct

SEQ ID NO: 175999 - DNA, 15 bp, Homo sapiens
attcacaaacgtttc

SEQ ID NO: 176000 - DNA, 15 bp, Homo sapiens
tattcacaaacgttt

SEQ ID NO: 176001 - DNA, 15 bp, Homo sapiens
atattcacaaacgtt

SEQ ID NO: 176002 - DNA, 15 bp, Homo sapiens
catattcacaaacgt

SEQ ID NO: 176003 - DNA, 15 bp, Homo sapiens
ccatattcacaaacg

SEQ ID NO: 176004 - DNA, 15 bp, Homo sapiens
gccatattcacaaac

SEQ ID NO: 176005 - DNA, 15 bp, Homo sapiens
agccatattcacaaa

SEQ ID NO: 176006 - DNA, 15 bp, Homo sapiens
cagccatattcacaa

SEQ ID NO: 176007 - DNA, 15 bp, Homo sapiens
ccagccatattcaca

SEQ ID NO: 176008 - DNA, 15 bp, Homo sapiens
tccagccatattcac

SEQ ID NO: 176009 - DNA, 15 bp, Homo sapiens
ctccagccatattca

SEQ ID NO: 176010 - DNA, 15 bp, Homo sapiens
tctccagccatattc

SEQ ID NO: 176011 - DNA, 15 bp, Homo sapiens
ctctccagccatatt

SEQ ID NO: 176012 - DNA, 15 bp, Homo sapiens
actctccagccatat

SEQ ID NO: 176013 - DNA, 15 bp, Homo sapiens
gactctccagccata

SEQ ID NO: 176014 - DNA, 15 bp, Homo sapiens
agactctccagccat

SEQ ID NO: 176015 - DNA, 15 bp, Homo sapiens
gagactctccagcca

SEQ ID NO: 176016 - DNA, 15 bp, Homo sapiens
tgagactctccagcc

SEQ ID NO: 176017 - DNA, 15 bp, Homo sapiens
ctgagactctccagc

SEQ ID NO: 176018 - DNA, 15 bp, Homo sapiens
actgagactctccag

SEQ ID NO: 176019 - DNA, 15 bp, Homo sapiens
tactgagactctcca

SEQ ID NO: 176020 - DNA, 15 bp, Homo sapiens
ttactgagactctcc

SEQ ID NO: 176021 - DNA, 15 bp, Homo sapiens
cttactgagactctc

SEQ ID NO: 176022 - DNA, 15 bp, Homo sapiens
tcttactgagactct

SEQ ID NO: 176023 - DNA, 15 bp, Homo sapiens
atcttactgagactc

SEQ ID NO: 176024 - DNA, 15 bp, Homo sapiens
catcttactgagact

SEQ ID NO: 176025 - DNA, 15 bp, Homo sapiens
ccatcttactgagac

SEQ ID NO: 176026 - DNA, 15 bp, Homo sapiens
cccatcttactgaga

SEQ ID NO: 176027 - DNA, 15 bp, Homo sapiens
ccccatcttactgag

SEQ ID NO: 176028 - DNA, 15 bp, Homo sapiens
cccccatcttactga

SEQ ID NO: 176029 - DNA, 15 bp, Homo sapiens
tcccccatcttactg

SEQ ID NO: 176030 - DNA, 15 bp, Homo sapiens
gtcccccatcttact

SEQ ID NO: 176031 - DNA, 15 bp, Homo sapiens
tgtcccccatcttac

SEQ ID NO: 176032 - DNA, 15 bp, Homo sapiens
atgtcccccatctta

SEQ ID NO: 176033 - DNA, 15 bp, Homo sapiens
gatgtcccccatctt

SEQ ID NO: 176034 - DNA, 15 bp, Homo sapiens
agatgtcccccatct

SEQ ID NO: 176035 - DNA, 15 bp, Homo sapiens
gagatgtcccccatc

SEQ ID NO: 176036 - DNA, 15 bp, Homo sapiens
ggagatgtcccccat

SEQ ID NO: 176037 - DNA, 15 bp, Homo sapiens
aggagatgtccccca

SEQ ID NO: 176038 - DNA, 15 bp, Homo sapiens
gaggagatgtccccc

SEQ ID NO: 176039 - DNA, 15 bp, Homo sapiens
tgaggagatgtcccc

SEQ ID NO: 176040 - DNA, 15 bp, Homo sapiens
ttgaggagatgtccc

SEQ ID NO: 176041 - DNA, 15 bp, Homo sapiens
tttgaggagatgtcc

SEQ ID NO: 176042 - DNA, 15 bp, Homo sapiens
atttgaggagatgtc

SEQ ID NO: 176043 - DNA, 15 bp, Homo sapiens
aatttgaggagatgt

SEQ ID NO: 176044 - DNA, 15 bp, Homo sapiens
caatttgaggagatg

SEQ ID NO: 176045 - DNA, 15 bp, Homo sapiens
tcaatttgaggagat

SEQ ID NO: 176046 - DNA, 15 bp, Homo sapiens
ttcaatttgaggaga

SEQ ID NO: 176047 - DNA, 15 bp, Homo sapiens
cttcaatttgaggag

SEQ ID NO: 176048 - DNA, 15 bp, Homo sapiens
tcttcaatttgagga

SEQ ID NO: 176049 - DNA, 15 bp, Homo sapiens
atcttcaatttgagg

SEQ ID NO: 176050 - DNA, 15 bp, Homo sapiens
gatcttcaatttgag

SEQ ID NO: 176051 - DNA, 15 bp, Homo sapiens
agatcttcaatttga

SEQ ID NO: 176052 - DNA, 15 bp, Homo sapiens
cagatcttcaatttg

SEQ ID NO: 176053 - DNA, 15 bp, Homo sapiens
ccagatcttcaattt

SEQ ID NO: 176054 - DNA, 15 bp, Homo sapiens
cccagatcttcaatt

SEQ ID NO: 176055 - DNA, 15 bp, Homo sapiens
tcccagatcttcaat

SEQ ID NO: 176056 - DNA, 15 bp, Homo sapiens
ttcccagatcttcaa

SEQ ID NO: 176057 - DNA, 15 bp, Homo sapiens
cttcccagatcttca

SEQ ID NO: 176058 - DNA, 15 bp, Homo sapiens
acttcccagatcttc

SEQ ID NO: 176059 - DNA, 15 bp, Homo sapiens
tacttcccagatctt

SEQ ID NO: 176060 - DNA, 15 bp, Homo sapiens
ttacttcccagatct

SEQ ID NO: 176061 - DNA, 15 bp, Homo sapiens
cttacttcccagatc

SEQ ID NO: 176062 - DNA, 15 bp, Homo sapiens
acttacttcccagat

SEQ ID NO: 176063 - DNA, 15 bp, Homo sapiens
tacttacttcccaga

SEQ ID NO: 176064 - DNA, 15 bp, Homo sapiens
ttacttacttcccag

SEQ ID NO: 176065 - DNA, 15 bp, Homo sapiens
attacttacttccca

SEQ ID NO: 176066 - DNA, 15 bp, Homo sapiens
tattacttacttccc

SEQ ID NO: 176067 - DNA, 15 bp, Homo sapiens
ctattacttacttcc

SEQ ID NO: 176068 - DNA, 15 bp, Homo sapiens
tctattacttacttc

SEQ ID NO: 176069 - DNA, 15 bp, Homo sapiens
ttctattacttactt

SEQ ID NO: 176070 - DNA, 15 bp, Homo sapiens
gtttctattacttac

SEQ ID NO: 176071 - DNA, 15 bp, Homo sapiens
agtttctattactta

SEQ ID NO: 176072 - DNA, 15 bp, Homo sapiens
aagtttctattactt

SEQ ID NO: 176073 - DNA, 15 bp, Homo sapiens
taagtttctattact

SEQ ID NO: 176074 - DNA, 15 bp, Homo sapiens
gtaagtttctattac

SEQ ID NO: 176075 - DNA, 15 bp, Homo sapiens
tgtaagtttctatta

SEQ ID NO: 176076 - DNA, 15 bp, Homo sapiens
ctgtaagtttctatt

SEQ ID NO: 176077 - DNA, 15 bp, Homo sapiens
tctgtaagtttctat

SEQ ID NO: 176078 - DNA, 15 bp, Homo sapiens
gtctgtaagtttcta

SEQ ID NO: 176079 - DNA, 15 bp, Homo sapiens
tgtctgtaagtttct

SEQ ID NO: 176080 - DNA, 15 bp, Homo sapiens
ctgtctgtaagtttc

SEQ ID NO: 176081 - DNA, 15 bp, Homo sapiens
tctgtctgtaagttt

SEQ ID NO: 176082 - DNA, 15 bp, Homo sapiens
atctgtctgtaagtt

SEQ ID NO: 176083 - DNA, 15 bp, Homo sapiens
aatctgtctgtaagt

SEQ ID NO: 176084 - DNA, 15 bp, Homo sapiens
caatctgtctgtaag

SEQ ID NO: 176085 - DNA, 15 bp, Homo sapiens
tcaatctgtctgtaa

SEQ ID NO: 176086 - DNA, 15 bp, Homo sapiens
ctcaatctgtctgta

SEQ ID NO: 176087 - DNA, 15 bp, Homo sapiens
cctcaatctgtctgt

SEQ ID NO: 176088 - DNA, 15 bp, Homo sapiens
acctcaatctgtctg

SEQ ID NO: 176089 - DNA, 15 bp, Homo sapiens
cacctcaatctgtct

SEQ ID NO: 176090 - DNA, 15 bp, Homo sapiens
gcacctcaatctgtc

SEQ ID NO: 176091 - DNA, 15 bp, Homo sapiens
tgcacctcaatctgt

SEQ ID NO: 176092 - DNA, 15 bp, Homo sapiens
ctgcacctcaatctg

SEQ ID NO: 176093 - DNA, 15 bp, Homo sapiens
actgcacctcaatct

SEQ ID NO: 176094 - DNA, 15 bp, Homo sapiens
aactgcacctcaatc

SEQ ID NO: 176095 - DNA, 15 bp, Homo sapiens
aaactgcacctcaat

SEQ ID NO: 176096 - DNA, 15 bp, Homo sapiens
aaaactgcacctcaa

SEQ ID NO: 176097 - DNA, 15 bp, Homo sapiens
aaaaactgcacctca

SEQ ID NO: 176098 - DNA, 15 bp, Homo sapiens
aaaaaactgcacctc

SEQ ID NO: 176099 - DNA, 15 bp, Homo sapiens
aaaaaaactgcacct

SEQ ID NO: 176100 - DNA, 15 bp, Homo sapiens
aaaaaaaactgcacc

SEQ ID NO: 176101 - DNA, 15 bp, Homo sapiens
gaaaaaaaactgcac

SEQ ID NO: 176102 - DNA, 15 bp, Homo sapiens
agaaaaaaaactgca

SEQ ID NO: 176103 - DNA, 15 bp, Homo sapiens
tagaaaaaaaactgc

SEQ ID NO: 176104 - DNA, 15 bp, Homo sapiens
gtagaaaaaaaactg

SEQ ID NO: 176105 - DNA, 15 bp, Homo sapiens
agtagaaaaaaaact

SEQ ID NO: 176106 - DNA, 15 bp, Homo sapiens
aagtagaaaaaaaac

SEQ ID NO: 176107 - DNA, 15 bp, Homo sapiens
aaagtagaaaaaaaa

SEQ ID NO: 176108 - DNA, 15 bp, Homo sapiens
aaaagtagaaaaaaa

SEQ ID NO: 176109 - DNA, 15 bp, Homo sapiens
aaaaagtagaaaaaa

SEQ ID NO: 176110 - DNA, 15 bp, Homo sapiens
aaaaaagtagaaaaa

SEQ ID NO: 176111 - DNA, 15 bp, Homo sapiens
aaaaaaagtagaaaa

SEQ ID NO: 176112 - DNA, 15 bp, Homo sapiens
aaaaaaaagtagaaa

SEQ ID NO: 176113 - DNA, 15 bp, Homo sapiens
gaaaaaaaagtagaa

SEQ ID NO: 176114 - DNA, 15 bp, Homo sapiens
ggaaaaaaaagtaga

SEQ ID NO: 176115 - DNA, 15 bp, Homo sapiens
aggaaaaaaaagtag

SEQ ID NO: 176116 - DNA, 15 bp, Homo sapiens
caggaaaaaaaagta

SEQ ID NO: 176117 - DNA, 15 bp, Homo sapiens
tcaggaaaaaaaagt

SEQ ID NO: 176118 - DNA, 15 bp, Homo sapiens
ttcaggaaaaaaaag

SEQ ID NO: 176119 - DNA, 15 bp, Homo sapiens
tttcaggaaaaaaaa

SEQ ID NO: 176120 - DNA, 15 bp, Homo sapiens
ttttcaggaaaaaaa

SEQ ID NO: 176121 - DNA, 15 bp, Homo sapiens
attttcaggaaaaaa

SEQ ID NO: 176122 - DNA, 15 bp, Homo sapiens
aattttcaggaaaaa

SEQ ID NO: 176123 - DNA, 15 bp, Homo sapiens
aaattttcaggaaaa

SEQ ID NO: 176124 - DNA, 15 bp, Homo sapiens
gaaattttcaggaaa

SEQ ID NO: 176125 - DNA, 15 bp, Homo sapiens
tgaaattttcaggaa

SEQ ID NO: 176126 - DNA, 15 bp, Homo sapiens
ctgaaattttcagga

SEQ ID NO: 176127 - DNA, 15 bp, Homo sapiens
tctgaaattttcagg

SEQ ID NO: 176128 - DNA, 15 bp, Homo sapiens
ttctgaaattttcag

SEQ ID NO: 176129 - DNA, 15 bp, Homo sapiens
tttctgaaattttca

SEQ ID NO: 176130 - DNA, 15 bp, Homo sapiens
atttctgaaattttc

SEQ ID NO: 176131 - DNA, 15 bp, Homo sapiens
tatttctgaaatttt

SEQ ID NO: 176132 - DNA, 15 bp, Homo sapiens
atatttctgaaattt

SEQ ID NO: 176133 - DNA, 15 bp, Homo sapiens
catatttctgaaatt

SEQ ID NO: 176134 - DNA, 15 bp, Homo sapiens
tcatatttctgaaat

SEQ ID NO: 176135 - DNA, 15 bp, Homo sapiens
ctcatatttctgaaa

SEQ ID NO: 176136 - DNA, 15 bp, Homo sapiens
tctcatatttctgaa

SEQ ID NO: 176137 - DNA, 15 bp, Homo sapiens
ttctcatatttctga

SEQ ID NO: 176138 - DNA, 15 bp, Homo sapiens
cttctcatatttctg

SEQ ID NO: 176139 - DNA, 15 bp, Homo sapiens
acttctcatatttct

SEQ ID NO: 176140 - DNA, 15 bp, Homo sapiens
cacttctcatatttc

SEQ ID NO: 176141 - DNA, 15 bp, Homo sapiens
tcacttctcatattt

SEQ ID NO: 176142 - DNA, 15 bp, Homo sapiens
ttcacttctcatatt

SEQ ID NO: 176143 - DNA, 15 bp, Homo sapiens
tttcacttctcatat

SEQ ID NO: 176144 - DNA, 15 bp, Homo sapiens
atttcacttctcata

SEQ ID NO: 176145 - DNA, 15 bp, Homo sapiens
tatttcacttctcat

SEQ ID NO: 176146 - DNA, 15 bp, Homo sapiens
ttatttcacttctca

SEQ ID NO: 176147 - DNA, 15 bp, Homo sapiens
attatttcacttctc

SEQ ID NO: 176148 - DNA, 15 bp, Homo sapiens
tattatttcacttct

SEQ ID NO: 176149 - DNA, 15 bp, Homo sapiens
ctattatttcacttc

SEQ ID NO: 176150 - DNA, 15 bp, Homo sapiens
gctattatttcactt

SEQ ID NO: 176151 - DNA, 15 bp, Homo sapiens
tgctattatttcact

SEQ ID NO: 176152 - DNA, 15 bp, Homo sapiens
ttgctattatttcac

SEQ ID NO: 176153 - DNA, 15 bp, Homo sapiens
tttgctattatttca

SEQ ID NO: 176154 - DNA, 15 bp, Homo sapiens
gtttgctattatttc

SEQ ID NO: 176155 - DNA, 15 bp, Homo sapiens
tgtttgctattattt

SEQ ID NO: 176156 - DNA, 15 bp, Homo sapiens
atgtttgctattatt

SEQ ID NO: 176157 - DNA, 15 bp, Homo sapiens
catgtttgctattat

SEQ ID NO: 176158 - DNA, 15 bp, Homo sapiens
tcatgtttgctatta

SEQ ID NO: 176159 - DNA, 15 bp, Homo sapiens
gtcatgtttgctatt

SEQ ID NO: 176160 - DNA, 15 bp, Homo sapiens
agtcatgtttgctat

SEQ ID NO: 176161 - DNA, 15 bp, Homo sapiens
gagtcatgtttgcta

SEQ ID NO: 176162 - DNA, 15 bp, Homo sapiens
tgagtcatgtttgct

SEQ ID NO: 176163 - DNA, 15 bp, Homo sapiens
ctgagtcatgtttgc

SEQ ID NO: 176164 - DNA, 15 bp, Homo sapiens
tctgagtcatgtttg

SEQ ID NO: 176165 - DNA, 15 bp, Homo sapiens
gtctgagtcatgttt

SEQ ID NO: 176166 - DNA, 15 bp, Homo sapiens
ggtctgagtcatgtt

SEQ ID NO: 176167 - DNA, 15 bp, Homo sapiens
aggtctgagtcatgt

SEQ ID NO: 176168 - DNA, 15 bp, Homo sapiens
aaggtctgagtcatg

SEQ ID NO: 176169 - DNA, 15 bp, Homo sapiens
aaaggtctgagtcat

SEQ ID NO: 176170 - DNA, 15 bp, Homo sapiens
taaaggtctgagtca

SEQ ID NO: 176171 - DNA, 15 bp, Homo sapiens
ataaaggtctgagtc

SEQ ID NO: 176172 - DNA, 15 bp, Homo sapiens
tataaaggtctgagt

SEQ ID NO: 176173 - DNA, 15 bp, Homo sapiens
ttataaaggtctgag

SEQ ID NO: 176174 - DNA, 15 bp, Homo sapiens
tttataaaggtctga

SEQ ID NO: 176175 - DNA, 15 bp, Homo sapiens
atttataaaggtctg

SEQ ID NO: 176176 - DNA, 15 bp, Homo sapiens
aatttataaaggtct

SEQ ID NO: 176177 - DNA, 15 bp, Homo sapiens
caatttataaaggtc

SEQ ID NO: 176178 - DNA, 15 bp, Homo sapiens
acaatttataaaggt

SEQ ID NO: 176179 - DNA, 15 bp, Homo sapiens
gacaatttataaagg

SEQ ID NO: 176180 - DNA, 15 bp, Homo sapiens
agacaatttataaag

SEQ ID NO: 176181 - DNA, 15 bp, Homo sapiens
aagacaatttataaa

SEQ ID NO: 176182 - DNA, 15 bp, Homo sapiens
aaagacaatttataa

SEQ ID NO: 176183 - DNA, 15 bp, Homo sapiens
gaaagacaatttata

SEQ ID NO: 176184 - DNA, 15 bp, Homo sapiens
agaaagacaatttat

SEQ ID NO: 176185 - DNA, 15 bp, Homo sapiens
aagaaagacaattta

SEQ ID NO: 176186 - DNA, 15 bp, Homo sapiens
caagaaagacaattt

SEQ ID NO: 176187 - DNA, 15 bp, Homo sapiens
tcaagaaagacaatt

SEQ ID NO: 176188 - DNA, 15 bp, Homo sapiens
gtcaagaaagacaat

SEQ ID NO: 176189 - DNA, 15 bp, Homo sapiens
tgtcaagaaagacaa

SEQ ID NO: 176190 - DNA, 15 bp, Homo sapiens
ctgtcaagaaagaca

SEQ ID NO: 176191 - DNA, 15 bp, Homo sapiens
gctgtcaagaaagac

SEQ ID NO: 176192 - DNA, 15 bp, Homo sapiens
tgctgtcaagaaaga

SEQ ID NO: 176193 - DNA, 15 bp, Homo sapiens
ctgctgtcaagaaag

SEQ ID NO: 176194 - DNA, 15 bp, Homo sapiens
tctgctgtcaagaaa

SEQ ID NO: 176195 - DNA, 15 bp, Homo sapiens
ctctgctgtcaagaa

SEQ ID NO: 176196 - DNA, 15 bp, Homo sapiens
tctctgctgtcaaga

SEQ ID NO: 176197 - DNA, 15 bp, Homo sapiens
atctctgctgtcaag

SEQ ID NO: 176198 - DNA, 15 bp, Homo sapiens
catctctgctgtcaa

SEQ ID NO: 176199 - DNA, 15 bp, Homo sapiens
acatctctgctgtca

SEQ ID NO: 176200 - DNA, 15 bp, Homo sapiens
tacatctctgctgtc

SEQ ID NO: 176201 - DNA, 15 bp, Homo sapiens
gtacatctctgctgt

SEQ ID NO: 176202 - DNA, 15 bp, Homo sapiens
tgtacatctctgctg

SEQ ID NO: 176203 - DNA, 15 bp, Homo sapiens
ttgtacatctctgct

SEQ ID NO: 176204 - DNA, 15 bp, Homo sapiens
attgtacatctctgc

SEQ ID NO: 176205 - DNA, 15 bp, Homo sapiens
aattgtacatctctg

SEQ ID NO: 176206 - DNA, 15 bp, Homo sapiens
aaattgtacatctct

SEQ ID NO: 176207 - DNA, 15 bp, Homo sapiens
aaaattgtacatctc

SEQ ID NO: 176208 - DNA, 15 bp, Homo sapiens
caaaattgtacatct

SEQ ID NO: 176209 - DNA, 15 bp, Homo sapiens
acaaaattgtacatc

SEQ ID NO: 176210 - DNA, 15 bp, Homo sapiens
tacaaaattgtacat

SEQ ID NO: 176211 - DNA, 15 bp, Homo sapiens
ttacaaaattgtaca

SEQ ID NO: 176212 - DNA, 15 bp, Homo sapiens
tttacaaaattgtac

SEQ ID NO: 176213 - DNA, 15 bp, Homo sapiens
ttttacaaaattgta

SEQ ID NO: 176214 - DNA, 15 bp, Homo sapiens
attttacaaaattgt

SEQ ID NO: 176215 - DNA, 15 bp, Homo sapiens
tattttacaaaattg

SEQ ID NO: 176216 - DNA, 15 bp, Homo sapiens
atattttacaaaatt

SEQ ID NO: 176217 - DNA, 15 bp, Homo sapiens
aatattttacaaaat

SEQ ID NO: 176218 - DNA, 15 bp, Homo sapiens
caatattttacaaaa

SEQ ID NO: 176219 - DNA, 15 bp, Homo sapiens
acaatattttacaaa

SEQ ID NO: 176220 - DNA, 15 bp, Homo sapiens
gacaatattttacaa

SEQ ID NO: 176221 - DNA, 15 bp, Homo sapiens
ggacaatattttaca

SEQ ID NO: 176222 - DNA, 15 bp, Homo sapiens
aggacaatattttac

SEQ ID NO: 176223 - DNA, 15 bp, Homo sapiens
gaggacaatatttta

SEQ ID NO: 176224 - DNA, 15 bp, Homo sapiens
tgaggacaatatttt

SEQ ID NO: 176225 - DNA, 15 bp, Homo sapiens
ctgaggacaatattt

SEQ ID NO: 176226 - DNA, 15 bp, Homo sapiens
actgaggacaatatt

SEQ ID NO: 176227 - DNA, 15 bp, Homo sapiens
gactgaggacaatat

SEQ ID NO: 176228 - DNA, 15 bp, Homo sapiens
agactgaggacaata

SEQ ID NO: 176229 - DNA, 15 bp, Homo sapiens
aagactgaggacaat

SEQ ID NO: 176230 - DNA, 15 bp, Homo sapiens
caagactgaggacaa

SEQ ID NO: 176231 - DNA, 15 bp, Homo sapiens
tcaagactgaggaca

SEQ ID NO: 176232 - DNA, 15 bp, Homo sapiens
ttcaagactgaggac

SEQ ID NO: 176233 - DNA, 15 bp, Homo sapiens
gttcaagactgagga

SEQ ID NO: 176234 - DNA, 15 bp, Homo sapiens
agttcaagactgagg

SEQ ID NO: 176235 - DNA, 15 bp, Homo sapiens
cagttcaagactgag

SEQ ID NO: 176236 - DNA, 15 bp, Homo sapiens
gcagttcaagactga

SEQ ID NO: 176237 - DNA, 15 bp, Homo sapiens
tgcagttcaagactg

SEQ ID NO: 176238 - DNA, 15 bp, Homo sapiens
ctgcagttcaagact

SEQ ID NO: 176239 - DNA, 15 bp, Homo sapiens
tctgcagttcaagac

SEQ ID NO: 176240 - DNA, 15 bp, Homo sapiens
ttctgcagttcaaga

SEQ ID NO: 176241 - DNA, 15 bp, Homo sapiens
tttctgcagttcaag

SEQ ID NO: 176242 - DNA, 15 bp, Homo sapiens
gtttctgcagttcaa

SEQ ID NO: 176243 - DNA, 15 bp, Homo sapiens
agtttctgcagttca

SEQ ID NO: 176244 - DNA, 15 bp, Homo sapiens
gagtttctgcagttc

SEQ ID NO: 176245 - DNA, 15 bp, Homo sapiens
ggagtttctgcagtt

SEQ ID NO: 176246 - DNA, 15 bp, Homo sapiens
aggagtttctgcagt

SEQ ID NO: 176247 - DNA, 15 bp, Homo sapiens
aaggagtttctgcag

SEQ ID NO: 176248 - DNA, 15 bp, Homo sapiens
aaaggagtttctgca

SEQ ID NO: 176249 - DNA, 15 bp, Homo sapiens
gaaaggagtttctgc

SEQ ID NO: 176250 - DNA, 15 bp, Homo sapiens
agaaaggagtttctg

SEQ ID NO: 176251 - DNA, 15 bp, Homo sapiens
gagaaaggagtttct

SEQ ID NO: 176252 - DNA, 15 bp, Homo sapiens
agagaaaggagtttc

SEQ ID NO: 176253 - DNA, 15 bp, Homo sapiens
cagagaaaggagttt

SEQ ID NO: 176254 - DNA, 15 bp, Homo sapiens
tcagagaaaggagtt

SEQ ID NO: 176255 - DNA, 15 bp, Homo sapiens
atcagagaaaggagt

SEQ ID NO: 176256 - DNA, 15 bp, Homo sapiens
tatcagagaaaggag

SEQ ID NO: 176257 - DNA, 15 bp, Homo sapiens
gtatcagagaaagga

SEQ ID NO: 176258 - DNA, 15 bp, Homo sapiens
ggtatcagagaaagg

SEQ ID NO: 176259 - DNA, 15 bp, Homo sapiens
aggtatcagagaaag

SEQ ID NO: 176260 - DNA, 15 bp, Homo sapiens
caggtatcagagaaa

SEQ ID NO: 176261 - DNA, 15 bp, Homo sapiens
gcaggtatcagagaa

SEQ ID NO: 176262 - DNA, 15 bp, Homo sapiens
cgcaggtatcagaga

SEQ ID NO: 176263 - DNA, 15 bp, Homo sapiens
ccgcaggtatcagag

SEQ ID NO: 176264 - DNA, 15 bp, Homo sapiens
accgcaggtatcaga

SEQ ID NO: 176265 - DNA, 15 bp, Homo sapiens
gaccgcaggtatcag

SEQ ID NO: 176266 - DNA, 15 bp, Homo sapiens
agaccgcaggtatca

SEQ ID NO: 176267 - DNA, 15 bp, Homo sapiens
aagaccgcaggtatc

SEQ ID NO: 176268 - DNA, 15 bp, Homo sapiens
taagaccgcaggtat

SEQ ID NO: 176269 - DNA, 15 bp, Homo sapiens
ataagaccgcaggta

SEQ ID NO: 176270 - DNA, 15 bp, Homo sapiens
aataagaccgcaggt

SEQ ID NO: 176271 - DNA, 15 bp, Homo sapiens
aaataagaccgcagg

SEQ ID NO: 176272 - DNA, 15 bp, Homo sapiens
taaataagaccgcag

SEQ ID NO: 176273 - DNA, 15 bp, Homo sapiens
ttaaataagaccgca

SEQ ID NO: 176274 - DNA, 15 bp, Homo sapiens
attaaataagaccgc

SEQ ID NO: 176275 - DNA, 15 bp, Homo sapiens
aattaaataagaccg

SEQ ID NO: 176276 - DNA, 15 bp, Homo sapiens
aaattaaataagacc

SEQ ID NO: 176277 - DNA, 15 bp, Homo sapiens
aaaattaaataagac

SEQ ID NO: 176278 - DNA, 15 bp, Homo sapiens
aaaaattaaataaga

SEQ ID NO: 176279 - DNA, 15 bp, Homo sapiens
taaaaattaaataag

SEQ ID NO: 176280 - DNA, 15 bp, Homo sapiens
gtaaaaattaaataa

SEQ ID NO: 176281 - DNA, 15 bp, Homo sapiens
tgtaaaaattaaata

SEQ ID NO: 176282 - DNA, 15 bp, Homo sapiens
atgtaaaaattaaat

SEQ ID NO: 176283 - DNA, 15 bp, Homo sapiens
gatgtaaaaattaaa

SEQ ID NO: 176284 - DNA, 15 bp, Homo sapiens
agatgtaaaaattaa

SEQ ID NO: 176285 - DNA, 15 bp, Homo sapiens
aagatgtaaaaatta

SEQ ID NO: 176286 - DNA, 15 bp, Homo sapiens
taagatgtaaaaatt

SEQ ID NO: 176287 - DNA, 15 bp, Homo sapiens
ttaagatgtaaaaat

SEQ ID NO: 176288 - DNA, 15 bp, Homo sapiens
gttaagatgtaaaaa

SEQ ID NO: 176289 - DNA, 15 bp, Homo sapiens
tgttaagatgtaaaa

SEQ ID NO: 176290 - DNA, 15 bp, Homo sapiens
ctgttaagatgtaaa

SEQ ID NO: 176291 - DNA, 15 bp, Homo sapiens
gctgttaagatgtaa

SEQ ID NO: 176292 - DNA, 15 bp, Homo sapiens
tgctgttaagatgta

SEQ ID NO: 176293 - DNA, 15 bp, Homo sapiens
ttgctgttaagatgt

SEQ ID NO: 176294 - DNA, 15 bp, Homo sapiens
cttgctgttaagatg

SEQ ID NO: 176295 - DNA, 15 bp, Homo sapiens
tcttgctgttaagat

SEQ ID NO: 176296 - DNA, 15 bp, Homo sapiens
ctcttgctgttaaga

SEQ ID NO: 176297 - DNA, 15 bp, Homo sapiens
gctcttgctgttaag

SEQ ID NO: 176298 - DNA, 15 bp, Homo sapiens
tgctcttgctgttaa

SEQ ID NO: 176299 - DNA, 15 bp, Homo sapiens
atgctcttgctgtta

SEQ ID NO: 176300 - DNA, 15 bp, Homo sapiens
tatgctcttgctgtt

SEQ ID NO: 176301 - DNA, 15 bp, Homo sapiens
gtatgctcttgctgt

SEQ ID NO: 176302 - DNA, 15 bp, Homo sapiens
ggtatgctcttgctg

SEQ ID NO: 176303 - DNA, 15 bp, Homo sapiens
gggtatgctcttgct

SEQ ID NO: 176304 - DNA, 15 bp, Homo sapiens
cgggtatgctcttgc

SEQ ID NO: 176305 - DNA, 15 bp, Homo sapiens
acgggtatgctcttg

SEQ ID NO: 176306 - DNA, 15 bp, Homo sapiens
cacgggtatgctctt

SEQ ID NO: 176307 - DNA, 15 bp, Homo sapiens
tcacgggtatgctct

SEQ ID NO: 176308 - DNA, 15 bp, Homo sapiens
atcacgggtatgctc

SEQ ID NO: 176309 - DNA, 15 bp, Homo sapiens
aatcacgggtatgct

SEQ ID NO: 176310 - DNA, 15 bp, Homo sapiens
aaatcacgggtatgc

SEQ ID NO: 176311 - DNA, 15 bp, Homo sapiens
caaatcacgggtatg

SEQ ID NO: 176312 - DNA, 15 bp, Homo sapiens
acaaatcacgggtat

SEQ ID NO: 176313 - DNA, 15 bp, Homo sapiens
aacaaatcacgggta

SEQ ID NO: 176314 - DNA, 15 bp, Homo sapiens
aaacaaatcacgggt

SEQ ID NO: 176315 - DNA, 15 bp, Homo sapiens
aaaacaaatcacggg

SEQ ID NO: 176316 - DNA, 15 bp, Homo sapiens
gaaaacaaatcacgg

SEQ ID NO: 176317 - DNA, 15 bp, Homo sapiens
tgaaaacaaatcacg

SEQ ID NO: 176318 - DNA, 15 bp, Homo sapiens
gtgaaaacaaatcac

SEQ ID NO: 176319 - DNA, 15 bp, Homo sapiens
tgtgaaaacaaatca

SEQ ID NO: 176320 - DNA, 15 bp, Homo sapiens
ttgtgaaaacaaatc

SEQ ID NO: 176321 - DNA, 15 bp, Homo sapiens
tttgtgaaaacaaat

SEQ ID NO: 176322 - DNA, 15 bp, Homo sapiens
atttgtgaaaacaaa

SEQ ID NO: 176323 - DNA, 15 bp, Homo sapiens
catttgtgaaaacaa

SEQ ID NO: 176324 - DNA, 15 bp, Homo sapiens
acatttgtgaaaaca

SEQ ID NO: 176325 - DNA, 15 bp, Homo sapiens
aacatttgtgaaaac

SEQ ID NO: 176326 - DNA, 15 bp, Homo sapiens
taacatttgtgaaaa

SEQ ID NO: 176327 - DNA, 15 bp, Homo sapiens
ctaacatttgtgaaa

SEQ ID NO: 176328 - DNA, 15 bp, Homo sapiens
tctaacatttgtgaa

SEQ ID NO: 176329 - DNA, 15 bp, Homo sapiens
ttctaacatttgtga

SEQ ID NO: 176330 - DNA, 15 bp, Homo sapiens
tttctaacatttgtg

SEQ ID NO: 176331 - DNA, 15 bp, Homo sapiens
atttctaacatttgt

SEQ ID NO: 176332 - DNA, 15 bp, Homo sapiens
tatttctaacatttg

SEQ ID NO: 176333 - DNA, 15 bp, Homo sapiens
gtatttctaacattt

SEQ ID NO: 176334 - DNA, 15 bp, Homo sapiens
agtatttctaacatt

SEQ ID NO: 176335 - DNA, 15 bp, Homo sapiens
cagtatttctaacat

SEQ ID NO: 176336 - DNA, 15 bp, Homo sapiens
acagtatttctaaca

SEQ ID NO: 176337 - DNA, 15 bp, Homo sapiens
cacagtatttctaac

SEQ ID NO: 176338 - DNA, 15 bp, Homo sapiens
acacagtatttctaa

SEQ ID NO: 176339 - DNA, 15 bp, Homo sapiens
tacacagtatttcta

SEQ ID NO: 176340 - DNA, 15 bp, Homo sapiens
cttacacagtatttc

SEQ ID NO: 176341 - DNA, 15 bp, Homo sapiens
tcttacacagtattt

SEQ ID NO: 176342 - DNA, 15 bp, Homo sapiens
ttcttacacagtatt

SEQ ID NO: 176343 - DNA, 15 bp, Homo sapiens
attcttacacagtat

SEQ ID NO: 176344 - DNA, 15 bp, Homo sapiens
tattcttacacagta

SEQ ID NO: 176345 - DNA, 15 bp, Homo sapiens
ctattcttacacagt

SEQ ID NO: 176346 - DNA, 15 bp, Homo sapiens
tctattcttacacag

SEQ ID NO: 176347 - DNA, 15 bp, Homo sapiens
gtctattcttacaca

SEQ ID NO: 176348 - DNA, 15 bp, Homo sapiens
agtctattcttacac

SEQ ID NO: 176349 - DNA, 15 bp, Homo sapiens
aagtctattcttaca

SEQ ID NO: 176350 - DNA, 15 bp, Homo sapiens
taagtctattcttac

SEQ ID NO: 176351 - DNA, 15 bp, Homo sapiens
ataagtctattctta

SEQ ID NO: 176352 - DNA, 15 bp, Homo sapiens
aataagtctattctt

SEQ ID NO: 176353 - DNA, 15 bp, Homo sapiens
aaataagtctattct

SEQ ID NO: 176354 - DNA, 15 bp, Homo sapiens
aaaataagtctattc

SEQ ID NO: 176355 - DNA, 15 bp, Homo sapiens
aaaaataagtctatt

SEQ ID NO: 176356 - DNA, 15 bp, Homo sapiens
taaaaataagtctat

SEQ ID NO: 176357 - DNA, 15 bp, Homo sapiens
ataaaaataagtcta

SEQ ID NO: 176358 - DNA, 15 bp, Homo sapiens
tataaaaataagtct

SEQ ID NO: 176359 - DNA, 15 bp, Homo sapiens
atataaaaataagtc

SEQ ID NO: 176360 - DNA, 15 bp, Homo sapiens
aatataaaaataagt

SEQ ID NO: 176361 - DNA, 15 bp, Homo sapiens
caatataaaaataag

SEQ ID NO: 176362 - DNA, 15 bp, Homo sapiens
tacaatataaaaata

SEQ ID NO: 176363 - DNA, 15 bp, Homo sapiens
ttacaatataaaaat

SEQ ID NO: 176364 - DNA, 15 bp, Homo sapiens
tttacaatataaaaa

SEQ ID NO: 176365 - DNA, 15 bp, Homo sapiens
gtttacaatataaaa

SEQ ID NO: 176366 - DNA, 15 bp, Homo sapiens
agtttacaatataaa

SEQ ID NO: 176367 - DNA, 15 bp, Homo sapiens
aagtttacaatataa

SEQ ID NO: 176368 - DNA, 15 bp, Homo sapiens
aaagtttacaatata

SEQ ID NO: 176369 - DNA, 15 bp, Homo sapiens
aaaagtttacaatat

SEQ ID NO: 176370 - DNA, 15 bp, Homo sapiens
taaaagtttacaata

SEQ ID NO: 176371 - DNA, 15 bp, Homo sapiens
gtaaaagtttacaat

SEQ ID NO: 176372 - DNA, 15 bp, Homo sapiens
agtaaaagtttacaa

SEQ ID NO: 176373 - DNA, 15 bp, Homo sapiens
aagtaaaagtttaca

SEQ ID NO: 176374 - DNA, 15 bp, Homo sapiens
aaagtaaaagtttac

SEQ ID NO: 176375 - DNA, 15 bp, Homo sapiens
aaaagtaaaagttta

SEQ ID NO: 176376 - DNA, 15 bp, Homo sapiens
aaaaagtaaaagttt

SEQ ID NO: 176377 - DNA, 15 bp, Homo sapiens
aaaaaagtaaaagtt

SEQ ID NO: 176378 - DNA, 15 bp, Homo sapiens
aaaaaaagtaaaagt

SEQ ID NO: 176379 - DNA, 15 bp, Homo sapiens
aaaaaaaagtaaaag

SEQ ID NO: 176380 - DNA, 15 bp, Homo sapiens
aaaaaaaaagtaaaa

SEQ ID NO: 176381 - DNA, 15 bp, Homo sapiens
cagtctcaaaaaaaa

SEQ ID NO: 176382 - DNA, 15 bp, Homo sapiens
tcagtctcaaaaaaa

SEQ ID NO: 176383 - DNA, 15 bp, Homo sapiens
ctcagtctcaaaaaa

SEQ ID NO: 176384 - DNA, 15 bp, Homo sapiens
actcagtctcaaaaa

SEQ ID NO: 176385 - DNA, 15 bp, Homo sapiens
aaaactcagtctcaa

SEQ ID NO: 176386 - DNA, 15 bp, Homo sapiens
caaaactcagtctca

SEQ ID NO: 176387 - DNA, 15 bp, Homo sapiens
gcaaaactcagtctc

SEQ ID NO: 176388 - DNA, 15 bp, Homo sapiens
agcaaaactcagtct

SEQ ID NO: 176389 - DNA, 15 bp, Homo sapiens
gagcaaaactcagtc

SEQ ID NO: 176390 - DNA, 15 bp, Homo sapiens
agagcaaaactcagt

SEQ ID NO: 176391 - DNA, 15 bp, Homo sapiens
aagagcaaaactcag

SEQ ID NO: 176392 - DNA, 15 bp, Homo sapiens
caagagcaaaactca

SEQ ID NO: 176393 - DNA, 15 bp, Homo sapiens
acaagagcaaaactc

SEQ ID NO: 176394 - DNA, 15 bp, Homo sapiens
aacaagagcaaaact

SEQ ID NO: 176395 - DNA, 15 bp, Homo sapiens
caacaagagcaaaac

SEQ ID NO: 176396 - DNA, 15 bp, Homo sapiens
gcaacaagagcaaaa

SEQ ID NO: 176397 - DNA, 15 bp, Homo sapiens
ggcaacaagagcaaa

SEQ ID NO: 176398 - DNA, 15 bp, Homo sapiens
aggcaacaagagcaa

SEQ ID NO: 176399 - DNA, 15 bp, Homo sapiens
taggcaacaagagca

SEQ ID NO: 176400 - DNA, 15 bp, Homo sapiens
ctaggcaacaagagc

SEQ ID NO: 176401 - DNA, 15 bp, Homo sapiens
cctaggcaacaagag

SEQ ID NO: 176402 - DNA, 15 bp, Homo sapiens
gcctaggcaacaaga

SEQ ID NO: 176403 - DNA, 15 bp, Homo sapiens
agcctaggcaacaag

SEQ ID NO: 176404 - DNA, 15 bp, Homo sapiens
cagcctaggcaacaa

SEQ ID NO: 176405 - DNA, 15 bp, Homo sapiens
ccagcctaggcaaca

SEQ ID NO: 176406 - DNA, 15 bp, Homo sapiens
tccagcctaggcaac

SEQ ID NO: 176407 - DNA, 15 bp, Homo sapiens
ctccagcctaggcaa

SEQ ID NO: 176408 - DNA, 15 bp, Homo sapiens
actccagcctaggca

SEQ ID NO: 176409 - DNA, 15 bp, Homo sapiens
cactccagcctaggc

SEQ ID NO: 176410 - DNA, 15 bp, Homo sapiens
gcactccagcctagg

SEQ ID NO: 176411 - DNA, 15 bp, Homo sapiens
tgcactccagcctag

SEQ ID NO: 176412 - DNA, 15 bp, Homo sapiens
ttgcactccagccta

SEQ ID NO: 176413 - DNA, 15 bp, Homo sapiens
ttgccattgcactcc

SEQ ID NO: 176414 - DNA, 15 bp, Homo sapiens
cttgccattgcactc

SEQ ID NO: 176415 - DNA, 15 bp, Homo sapiens
tcttgccattgcact

SEQ ID NO: 176416 - DNA, 15 bp, Homo sapiens
atcttgccattgcac

SEQ ID NO: 176417 - DNA, 15 bp, Homo sapiens
gatcttgccattgca

SEQ ID NO: 176418 - DNA, 15 bp, Homo sapiens
agatcttgccattgc

SEQ ID NO: 176419 - DNA, 15 bp, Homo sapiens
aagatcttgccattg

SEQ ID NO: 176420 - DNA, 15 bp, Homo sapiens
caagatcttgccatt

SEQ ID NO: 176421 - DNA, 15 bp, Homo sapiens
ccaagatcttgccat

SEQ ID NO: 176422 - DNA, 15 bp, Homo sapiens
gccaagatcttgcca

SEQ ID NO: 176423 - DNA, 15 bp, Homo sapiens
agccaagatcttgcc

SEQ ID NO: 176424 - DNA, 15 bp, Homo sapiens
gagccaagatcttgc

SEQ ID NO: 176425 - DNA, 15 bp, Homo sapiens
tgagccaagatcttg

SEQ ID NO: 176426 - DNA, 15 bp, Homo sapiens
gtgagccaagatctt

SEQ ID NO: 176427 - DNA, 15 bp, Homo sapiens
agtgagccaagatct

SEQ ID NO: 176428 - DNA, 15 bp, Homo sapiens
atgaggcaggagaat

SEQ ID NO: 176429 - DNA, 15 bp, Homo sapiens
aatgaggcaggagaa

SEQ ID NO: 176430 - DNA, 15 bp, Homo sapiens
gaatgaggcaggaga

SEQ ID NO: 176431 - DNA, 15 bp, Homo sapiens
agaatgaggcaggag

SEQ ID NO: 176432 - DNA, 15 bp, Homo sapiens
gagaatgaggcagga

SEQ ID NO: 176433 - DNA, 15 bp, Homo sapiens
agagaatgaggcagg

SEQ ID NO: 176434 - DNA, 15 bp, Homo sapiens
gagagaatgaggcag

SEQ ID NO: 176435 - DNA, 15 bp, Homo sapiens
tgagagaatgaggca

SEQ ID NO: 176436 - DNA, 15 bp, Homo sapiens
ttgagagaatgaggc

SEQ ID NO: 176437 - DNA, 15 bp, Homo sapiens
cttgagagaatgagg

SEQ ID NO: 176438 - DNA, 15 bp, Homo sapiens
acttgagagaatgag

SEQ ID NO: 176439 - DNA, 15 bp, Homo sapiens
tacttgagagaatga

SEQ ID NO: 176440 - DNA, 15 bp, Homo sapiens
ctacttgagagaatg

SEQ ID NO: 176441 - DNA, 15 bp, Homo sapiens
gctacttgagagaat

SEQ ID NO: 176442 - DNA, 15 bp, Homo sapiens
agctacttgagagaa

SEQ ID NO: 176443 - DNA, 15 bp, Homo sapiens
cagctacttgagaga

SEQ ID NO: 176444 - DNA, 15 bp, Homo sapiens
gcatgcctataatcc

SEQ ID NO: 176445 - DNA, 15 bp, Homo sapiens
tgcatgcctataatc

SEQ ID NO: 176446 - DNA, 15 bp, Homo sapiens
gtgcatgcctataat

SEQ ID NO: 176447 - DNA, 15 bp, Homo sapiens
ggtgcatgcctataa

SEQ ID NO: 176448 - DNA, 15 bp, Homo sapiens
agaaaccctgtctct

SEQ ID NO: 176449 - DNA, 15 bp, Homo sapiens
gagaaaccctgtctc

SEQ ID NO: 176450 - DNA, 15 bp, Homo sapiens
ggagaaaccctgtct

SEQ ID NO: 176451 - DNA, 15 bp, Homo sapiens
tggagaaaccctgtc

SEQ ID NO: 176452 - DNA, 15 bp, Homo sapiens
atggagaaaccctgt

SEQ ID NO: 176453 - DNA, 15 bp, Homo sapiens
catggagaaaccctg

SEQ ID NO: 176454 - DNA, 15 bp, Homo sapiens
acatggagaaaccct

SEQ ID NO: 176455 - DNA, 15 bp, Homo sapiens
accaacatggagaaa

SEQ ID NO: 176456 - DNA, 15 bp, Homo sapiens
gaccaacatggagaa

SEQ ID NO: 176457 - DNA, 15 bp, Homo sapiens
tgaccaacatggaga

SEQ ID NO: 176458 - DNA, 15 bp, Homo sapiens
ctgaccaacatggag

SEQ ID NO: 176459 - DNA, 15 bp, Homo sapiens
cctgaccaacatgga

SEQ ID NO: 176460 - DNA, 15 bp, Homo sapiens
caagaccagcctgac

SEQ ID NO: 176461 - DNA, 15 bp, Homo sapiens
tcaagaccagcctga

SEQ ID NO: 176462 - DNA, 15 bp, Homo sapiens
gagagttcaagacca

SEQ ID NO: 176463 - DNA, 15 bp, Homo sapiens
tgagagttcaagacc

SEQ ID NO: 176464 - DNA, 15 bp, Homo sapiens
ttgagagttcaagac

SEQ ID NO: 176465 - DNA, 15 bp, Homo sapiens
gttgagagttcaaga

SEQ ID NO: 176466 - DNA, 15 bp, Homo sapiens
ggttgagagttcaag

SEQ ID NO: 176467 - DNA, 15 bp, Homo sapiens
aggttgagagttcaa

SEQ ID NO: 176468 - DNA, 15 bp, Homo sapiens
gaggttgagagttca

SEQ ID NO: 176469 - DNA, 15 bp, Homo sapiens
tgaggttgagagttc

SEQ ID NO: 176470 - DNA, 15 bp, Homo sapiens
ctgaggttgagagtt

SEQ ID NO: 176471 - DNA, 15 bp, Homo sapiens
cctgaggttgagagt

SEQ ID NO: 176472 - DNA, 15 bp, Homo sapiens
acctgaggttgagag

SEQ ID NO: 176473 - DNA, 15 bp, Homo sapiens
cacctgaggttgaga

SEQ ID NO: 176474 - DNA, 15 bp, Homo sapiens
tcacctgaggttgag

SEQ ID NO: 176475 - DNA, 15 bp, Homo sapiens
atcacctgaggttga

SEQ ID NO: 176476 - DNA, 15 bp, Homo sapiens
agatcacctgaggtt

SEQ ID NO: 176477 - DNA, 15 bp, Homo sapiens
gggcagatcacctga

SEQ ID NO: 176478 - DNA, 15 bp, Homo sapiens
cgggcagatcacctg

SEQ ID NO: 176479 - DNA, 15 bp, Homo sapiens
gcgggcagatcacct

SEQ ID NO: 176480 - DNA, 15 bp, Homo sapiens
agcgggcagatcacc

SEQ ID NO: 176481 - DNA, 15 bp, Homo sapiens
aagcgggcagatcac

SEQ ID NO: 176482 - DNA, 15 bp, Homo sapiens
aaagcgggcagatca

SEQ ID NO: 176483 - DNA, 15 bp, Homo sapiens
caaagcgggcagatc

SEQ ID NO: 176484 - DNA, 15 bp, Homo sapiens
ccaaagcgggcagat

SEQ ID NO: 176485 - DNA, 15 bp, Homo sapiens
gccaaagcgggcaga

SEQ ID NO: 176486 - DNA, 15 bp, Homo sapiens
ggccaaagcgggcag

SEQ ID NO: 176487 - DNA, 15 bp, Homo sapiens
aggccaaagcgggca

SEQ ID NO: 176488 - DNA, 15 bp, Homo sapiens
gaggccaaagcgggc

SEQ ID NO: 176489 - DNA, 15 bp, Homo sapiens
ggaggccaaagcggg

SEQ ID NO: 176490 - DNA, 15 bp, Homo sapiens
gggaggccaaagcgg

SEQ ID NO: 176491 - DNA, 15 bp, Homo sapiens
tgggaggccaaagcg

SEQ ID NO: 176492 - DNA, 15 bp, Homo sapiens
ttgggaggccaaagc

SEQ ID NO: 176493 - DNA, 15 bp, Homo sapiens
tttgggaggccaaag

SEQ ID NO: 176494 - DNA, 15 bp, Homo sapiens
ctttgggaggccaaa

SEQ ID NO: 176495 - DNA, 15 bp, Homo sapiens
ttgggccaggcatgg

SEQ ID NO: 176496 - DNA, 15 bp, Homo sapiens
gttgggccaggcatg

SEQ ID NO: 176497 - DNA, 15 bp, Homo sapiens
agttgggccaggcat

SEQ ID NO: 176498 - DNA, 15 bp, Homo sapiens
aagttgggccaggca

SEQ ID NO: 176499 - DNA, 15 bp, Homo sapiens
aaagttgggccaggc

SEQ ID NO: 176500 - DNA, 15 bp, Homo sapiens
aaaagttgggccagg

SEQ ID NO: 176501 - DNA, 15 bp, Homo sapiens
taaaagttgggccag

SEQ ID NO: 176502 - DNA, 15 bp, Homo sapiens
gtaaaagttgggcca

SEQ ID NO: 176503 - DNA, 15 bp, Homo sapiens
ggtaaaagttgggcc

SEQ ID NO: 176504 - DNA, 15 bp, Homo sapiens
aggtaaaagttgggc

SEQ ID NO: 176505 - DNA, 15 bp, Homo sapiens
aaggtaaaagttggg

SEQ ID NO: 176506 - DNA, 15 bp, Homo sapiens
aaaggtaaaagttgg

SEQ ID NO: 176507 - DNA, 15 bp, Homo sapiens
aaaaggtaaaagttg

SEQ ID NO: 176508 - DNA, 15 bp, Homo sapiens
aaaaaggtaaaagtt

SEQ ID NO: 176509 - DNA, 15 bp, Homo sapiens
taaaaaggtaaaagt

SEQ ID NO: 176510 - DNA, 15 bp, Homo sapiens
ttaaaaaggtaaaag

SEQ ID NO: 176511 - DNA, 15 bp, Homo sapiens
tttaaaaaggtaaaa

SEQ ID NO: 176512 - DNA, 15 bp, Homo sapiens
ctttaaaaaggtaaa

SEQ ID NO: 176513 - DNA, 15 bp, Homo sapiens
actttaaaaaggtaa

SEQ ID NO: 176514 - DNA, 15 bp, Homo sapiens
tactttaaaaaggta

SEQ ID NO: 176515 - DNA, 15 bp, Homo sapiens
atactttaaaaaggt

SEQ ID NO: 176516 - DNA, 15 bp, Homo sapiens
catactttaaaaagg

SEQ ID NO: 176517 - DNA, 15 bp, Homo sapiens
acatactttaaaaag

SEQ ID NO: 176518 - DNA, 15 bp, Homo sapiens
aacatactttaaaaa

SEQ ID NO: 176519 - DNA, 15 bp, Homo sapiens
aaacatactttaaaa

SEQ ID NO: 176520 - DNA, 15 bp, Homo sapiens
aaaacatactttaaa

SEQ ID NO: 176521 - DNA, 15 bp, Homo sapiens
aaaaacatactttaa

SEQ ID NO: 176522 - DNA, 15 bp, Homo sapiens
taaaaacatacttta

SEQ ID NO: 176523 - DNA, 15 bp, Homo sapiens
ttaaaaacatacttt

SEQ ID NO: 176524 - DNA, 15 bp, Homo sapiens
tttaaaaacatactt

SEQ ID NO: 176525 - DNA, 15 bp, Homo sapiens
gtttaaaaacatact

SEQ ID NO: 176526 - DNA, 15 bp, Homo sapiens
tgtttaaaaacatac

SEQ ID NO: 176527 - DNA, 15 bp, Homo sapiens
ttgtttaaaaacata

SEQ ID NO: 176528 - DNA, 15 bp, Homo sapiens
gttgtttaaaaacat

SEQ ID NO: 176529 - DNA, 15 bp, Homo sapiens
ggttgtttaaaaaca

SEQ ID NO: 176530 - DNA, 15 bp, Homo sapiens
tggttgtttaaaaac

SEQ ID NO: 176531 - DNA, 15 bp, Homo sapiens
ttggttgtttaaaaa

SEQ ID NO: 176532 - DNA, 15 bp, Homo sapiens
attggttgtttaaaa

SEQ ID NO: 176533 - DNA, 15 bp, Homo sapiens
tattggttgtttaaa

SEQ ID NO: 176534 - DNA, 15 bp, Homo sapiens
ttattggttgtttaa

SEQ ID NO: 176535 - DNA, 15 bp, Homo sapiens
attattggttgttta

SEQ ID NO: 176536 - DNA, 15 bp, Homo sapiens
tattattggttgttt

SEQ ID NO: 176537 - DNA, 15 bp, Homo sapiens
atattattggttgtt

SEQ ID NO: 176538 - DNA, 15 bp, Homo sapiens
aatattattggttgt

SEQ ID NO: 176539 - DNA, 15 bp, Homo sapiens
aaatattattggttg

SEQ ID NO: 176540 - DNA, 15 bp, Homo sapiens
caaatattattggtt

SEQ ID NO: 176541 - DNA, 15 bp, Homo sapiens
ccaaatattattggt

SEQ ID NO: 176542 - DNA, 15 bp, Homo sapiens
gccaaatattattgg

SEQ ID NO: 176543 - DNA, 15 bp, Homo sapiens
tgccaaatattattg

SEQ ID NO: 176544 - DNA, 15 bp, Homo sapiens
atgccaaatattatt

SEQ ID NO: 176545 - DNA, 15 bp, Homo sapiens
tatgccaaatattat

SEQ ID NO: 176546 - DNA, 15 bp, Homo sapiens
ttatgccaaatatta

SEQ ID NO: 176547 - DNA, 15 bp, Homo sapiens
attatgccaaatatt

SEQ ID NO: 176548 - DNA, 15 bp, Homo sapiens
aattatgccaaatat

SEQ ID NO: 176549 - DNA, 15 bp, Homo sapiens
aaattatgccaaata

SEQ ID NO: 176550 - DNA, 15 bp, Homo sapiens
taaattatgccaaat

SEQ ID NO: 176551 - DNA, 15 bp, Homo sapiens
ctaaattatgccaaa

SEQ ID NO: 176552 - DNA, 15 bp, Homo sapiens
actaaattatgccaa

SEQ ID NO: 176553 - DNA, 15 bp, Homo sapiens
tactaaattatgcca

SEQ ID NO: 176554 - DNA, 15 bp, Homo sapiens
atactaaattatgcc

SEQ ID NO: 176555 - DNA, 15 bp, Homo sapiens
aatactaaattatgc

SEQ ID NO: 176556 - DNA, 15 bp, Homo sapiens
aaatactaaattatg

SEQ ID NO: 176557 - DNA, 15 bp, Homo sapiens
aaaatactaaattat

SEQ ID NO: 176558 - DNA, 15 bp, Homo sapiens
caaaatactaaatta

SEQ ID NO: 176559 - DNA, 15 bp, Homo sapiens
gcaaaatactaaatt

SEQ ID NO: 176560 - DNA, 15 bp, Homo sapiens
ggcaaaatactaaat

SEQ ID NO: 176561 - DNA, 15 bp, Homo sapiens
tggcaaaatactaaa

SEQ ID NO: 176562 - DNA, 15 bp, Homo sapiens
ctggcaaaatactaa

SEQ ID NO: 176563 - DNA, 15 bp, Homo sapiens
actggcaaaatacta

SEQ ID NO: 176564 - DNA, 15 bp, Homo sapiens
cactggcaaaatact

SEQ ID NO: 176565 - DNA, 15 bp, Homo sapiens
gcactggcaaaatac

SEQ ID NO: 176566 - DNA, 15 bp, Homo sapiens
agcactggcaaaata

SEQ ID NO: 176567 - DNA, 15 bp, Homo sapiens
aagcactggcaaaat

SEQ ID NO: 176568 - DNA, 15 bp, Homo sapiens
gaagcactggcaaaa

SEQ ID NO: 176569 - DNA, 15 bp, Homo sapiens
tgaagcactggcaaa

SEQ ID NO: 176570 - DNA, 15 bp, Homo sapiens
atgaagcactggcaa

SEQ ID NO: 176571 - DNA, 15 bp, Homo sapiens
aatgaagcactggca

SEQ ID NO: 176572 - DNA, 15 bp, Homo sapiens
caatgaagcactggc

SEQ ID NO: 176573 - DNA, 15 bp, Homo sapiens
gcaatgaagcactgg

SEQ ID NO: 176574 - DNA, 15 bp, Homo sapiens
agcaatgaagcactg

SEQ ID NO: 176575 - DNA, 15 bp, Homo sapiens
aagcaatgaagcact

SEQ ID NO: 176576 - DNA, 15 bp, Homo sapiens
taagcaatgaagcac

SEQ ID NO: 176577 - DNA, 15 bp, Homo sapiens
ataagcaatgaagca

SEQ ID NO: 176578 - DNA, 15 bp, Homo sapiens
cataagcaatgaagc

SEQ ID NO: 176579 - DNA, 15 bp, Homo sapiens
acataagcaatgaag

SEQ ID NO: 176580 - DNA, 15 bp, Homo sapiens
cacataagcaatgaa

SEQ ID NO: 176581 - DNA, 15 bp, Homo sapiens
gcacataagcaatga

SEQ ID NO: 176582 - DNA, 15 bp, Homo sapiens
tgcacataagcaatg

SEQ ID NO: 176583 - DNA, 15 bp, Homo sapiens
ttgcacataagcaat

SEQ ID NO: 176584 - DNA, 15 bp, Homo sapiens
attgcacataagcaa

SEQ ID NO: 176585 - DNA, 15 bp, Homo sapiens
cattgcacataagca

SEQ ID NO: 176586 - DNA, 15 bp, Homo sapiens
tcattgcacataagc

SEQ ID NO: 176587 - DNA, 15 bp, Homo sapiens
ctcattgcacataag

SEQ ID NO: 176588 - DNA, 15 bp, Homo sapiens
cctcattgcacataa

SEQ ID NO: 176589 - DNA, 15 bp, Homo sapiens
gcctcattgcacata

SEQ ID NO: 176590 - DNA, 15 bp, Homo sapiens
tgcctcattgcacat

SEQ ID NO: 176591 - DNA, 15 bp, Homo sapiens
atgcctcattgcaca

SEQ ID NO: 176592 - DNA, 15 bp, Homo sapiens
aatgcctcattgcac

SEQ ID NO: 176593 - DNA, 15 bp, Homo sapiens
aaatgcctcattgca

SEQ ID NO: 176594 - DNA, 15 bp, Homo sapiens
taaatgcctcattgc

SEQ ID NO: 176595 - DNA, 15 bp, Homo sapiens
ttaaatgcctcattg

SEQ ID NO: 176596 - DNA, 15 bp, Homo sapiens
gttaaatgcctcatt

SEQ ID NO: 176597 - DNA, 15 bp, Homo sapiens
tgttaaatgcctcat

SEQ ID NO: 176598 - DNA, 15 bp, Homo sapiens
ttgttaaatgcctca

SEQ ID NO: 176599 - DNA, 15 bp, Homo sapiens
tttgttaaatgcctc

SEQ ID NO: 176600 - DNA, 15 bp, Homo sapiens
ttttgttaaatgcct

SEQ ID NO: 176601 - DNA, 15 bp, Homo sapiens
attttgttaaatgcc

SEQ ID NO: 176602 - DNA, 15 bp, Homo sapiens
tattttgttaaatgc

SEQ ID NO: 176603 - DNA, 15 bp, Homo sapiens
ttattttgttaaatg

SEQ ID NO: 176604 - DNA, 15 bp, Homo sapiens
tttattttgttaaat

SEQ ID NO: 176605 - DNA, 15 bp, Homo sapiens
atttattttgttaaa

SEQ ID NO: 176606 - DNA, 15 bp, Homo sapiens
aatttattttgttaa

SEQ ID NO: 176607 - DNA, 15 bp, Homo sapiens
caatttattttgtta

SEQ ID NO: 176608 - DNA, 15 bp, Homo sapiens
ccaatttattttgtt

SEQ ID NO: 176609 - DNA, 15 bp, Homo sapiens
tccaatttattttgt

SEQ ID NO: 176610 - DNA, 15 bp, Homo sapiens
gtccaatttattttg

SEQ ID NO: 176611 - DNA, 15 bp, Homo sapiens
tgtccaatttatttt

SEQ ID NO: 176612 - DNA, 15 bp, Homo sapiens
atgtccaatttattt

SEQ ID NO: 176613 - DNA, 15 bp, Homo sapiens
tatgtccaatttatt

SEQ ID NO: 176614 - DNA, 15 bp, Homo sapiens
atatgtccaatttat

SEQ ID NO: 176615 - DNA, 15 bp, Homo sapiens
tatatgtccaattta

SEQ ID NO: 176616 - DNA, 15 bp, Homo sapiens
atatatgtccaattt

SEQ ID NO: 176617 - DNA, 15 bp, Homo sapiens
tatatatgtccaatt

SEQ ID NO: 176618 - DNA, 15 bp, Homo sapiens
atatatatgtccaat

SEQ ID NO: 176619 - DNA, 15 bp, Homo sapiens
aatatatatgtccaa

SEQ ID NO: 176620 - DNA, 15 bp, Homo sapiens
aaatatatatgtcca

SEQ ID NO: 176621 - DNA, 15 bp, Homo sapiens
taaatatatatgtcc

SEQ ID NO: 176622 - DNA, 15 bp, Homo sapiens
ataaatatatatgtc

SEQ ID NO: 176623 - DNA, 15 bp, Homo sapiens
taattataaatatat

SEQ ID NO: 176624 - DNA, 15 bp, Homo sapiens
ataattataaatata

SEQ ID NO: 176625 - DNA, 15 bp, Homo sapiens
aataattataaatat

SEQ ID NO: 176626 - DNA, 15 bp, Homo sapiens
aaataattataaata

SEQ ID NO: 176627 - DNA, 15 bp, Homo sapiens
aaaataattataaat

SEQ ID NO: 176628 - DNA, 15 bp, Homo sapiens
taaaataattataaa

SEQ ID NO: 176629 - DNA, 15 bp, Homo sapiens
gtaaaataattataa

SEQ ID NO: 176630 - DNA, 15 bp, Homo sapiens
taggtaaaataatta

SEQ ID NO: 176631 - DNA, 15 bp, Homo sapiens
ataggtaaaataatt

SEQ ID NO: 176632 - DNA, 15 bp, Homo sapiens
aataggtaaaataat

SEQ ID NO: 176633 - DNA, 15 bp, Homo sapiens
gaataggtaaaataa

SEQ ID NO: 176634 - DNA, 15 bp, Homo sapiens
ggaataggtaaaata

SEQ ID NO: 176635 - DNA, 15 bp, Homo sapiens
cggaataggtaaaat

SEQ ID NO: 176636 - DNA, 15 bp, Homo sapiens
acggaataggtaaaa

SEQ ID NO: 176637 - DNA, 15 bp, Homo sapiens
gacggaataggtaaa

SEQ ID NO: 176638 - DNA, 15 bp, Homo sapiens
tgacggaataggtaa

SEQ ID NO: 176639 - DNA, 15 bp, Homo sapiens
ctgacggaataggta

SEQ ID NO: 176640 - DNA, 15 bp, Homo sapiens
tctgacggaataggt

SEQ ID NO: 176641 - DNA, 15 bp, Homo sapiens
atctgacggaatagg

SEQ ID NO: 176642 - DNA, 15 bp, Homo sapiens
tatctgacggaatag

SEQ ID NO: 176643 - DNA, 15 bp, Homo sapiens
ctatctgacggaata

SEQ ID NO: 176644 - DNA, 15 bp, Homo sapiens
actatctgacggaat

SEQ ID NO: 176645 - DNA, 15 bp, Homo sapiens
tactatctgacggaa

SEQ ID NO: 176646 - DNA, 15 bp, Homo sapiens
gtactatctgacgga

SEQ ID NO: 176647 - DNA, 15 bp, Homo sapiens
tgtactatctgacgg

SEQ ID NO: 176648 - DNA, 15 bp, Homo sapiens
atgtactatctgacg

SEQ ID NO: 176649 - DNA, 15 bp, Homo sapiens
aatgtactatctgac

SEQ ID NO: 176650 - DNA, 15 bp, Homo sapiens
aaatgtactatctga

SEQ ID NO: 176651 - DNA, 15 bp, Homo sapiens
gaaatgtactatctg

SEQ ID NO: 176652 - DNA, 15 bp, Homo sapiens
agaaatgtactatct

SEQ ID NO: 176653 - DNA, 15 bp, Homo sapiens
aagaaatgtactatc

SEQ ID NO: 176654 - DNA, 15 bp, Homo sapiens
taagaaatgtactat

SEQ ID NO: 176655 - DNA, 15 bp, Homo sapiens
ttaagaaatgtacta

SEQ ID NO: 176656 - DNA, 15 bp, Homo sapiens
cttaagaaatgtact

SEQ ID NO: 176657 - DNA, 15 bp, Homo sapiens
ccttaagaaatgtac

SEQ ID NO: 176658 - DNA, 15 bp, Homo sapiens
tccttaagaaatgta

SEQ ID NO: 176659 - DNA, 15 bp, Homo sapiens
ctccttaagaaatgt

SEQ ID NO: 176660 - DNA, 15 bp, Homo sapiens
actccttaagaaatg

SEQ ID NO: 176661 - DNA, 15 bp, Homo sapiens
tactccttaagaaat

SEQ ID NO: 176662 - DNA, 15 bp, Homo sapiens
ttactccttaagaaa

SEQ ID NO: 176663 - DNA, 15 bp, Homo sapiens
cttactccttaagaa

SEQ ID NO: 176664 - DNA, 15 bp, Homo sapiens
ccttactccttaaga

SEQ ID NO: 176665 - DNA, 15 bp, Homo sapiens
tccttactccttaag

SEQ ID NO: 176666 - DNA, 15 bp, Homo sapiens
ttccttactccttaa

SEQ ID NO: 176667 - DNA, 15 bp, Homo sapiens
tttccttactcctta

SEQ ID NO: 176668 - DNA, 15 bp, Homo sapiens
gtttccttactcctt

SEQ ID NO: 176669 - DNA, 15 bp, Homo sapiens
agtttccttactcct

SEQ ID NO: 176670 - DNA, 15 bp, Homo sapiens
aagtttccttactcc

SEQ ID NO: 176671 - DNA, 15 bp, Homo sapiens
caagtttccttactc

SEQ ID NO: 176672 - DNA, 15 bp, Homo sapiens
tcaagtttccttact

SEQ ID NO: 176673 - DNA, 15 bp, Homo sapiens
ttcaagtttccttac

SEQ ID NO: 176674 - DNA, 15 bp, Homo sapiens
tttcaagtttcctta

SEQ ID NO: 176675 - DNA, 15 bp, Homo sapiens
atttcaagtttcctt

SEQ ID NO: 176676 - DNA, 15 bp, Homo sapiens
tatttcaagtttcct

SEQ ID NO: 176677 - DNA, 15 bp, Homo sapiens
atatttcaagtttcc

SEQ ID NO: 176678 - DNA, 15 bp, Homo sapiens
tatatttcaagtttc

SEQ ID NO: 176679 - DNA, 15 bp, Homo sapiens
ttatatttcaagttt

SEQ ID NO: 176680 - DNA, 15 bp, Homo sapiens
gttatatttcaagtt

SEQ ID NO: 176681 - DNA, 15 bp, Homo sapiens
agttatatttcaagt

SEQ ID NO: 176682 - DNA, 15 bp, Homo sapiens
gagttatatttcaag

SEQ ID NO: 176683 - DNA, 15 bp, Homo sapiens
tgagttatatttcaa

SEQ ID NO: 176684 - DNA, 15 bp, Homo sapiens
gtgagttatatttca

SEQ ID NO: 176685 - DNA, 15 bp, Homo sapiens
agtgagttatatttc

SEQ ID NO: 176686 - DNA, 15 bp, Homo sapiens
tagtgagttatattt

SEQ ID NO: 176687 - DNA, 15 bp, Homo sapiens
gtagtgagttatatt

SEQ ID NO: 176688 - DNA, 15 bp, Homo sapiens
agtagtgagttatat

SEQ ID NO: 176689 - DNA, 15 bp, Homo sapiens
aagtagtgagttata

SEQ ID NO: 176690 - DNA, 15 bp, Homo sapiens
gaagtagtgagttat

SEQ ID NO: 176691 - DNA, 15 bp, Homo sapiens
agaagtagtgagtta

SEQ ID NO: 176692 - DNA, 15 bp, Homo sapiens
gagaagtagtgagtt

SEQ ID NO: 176693 - DNA, 15 bp, Homo sapiens
ggagaagtagtgagt

SEQ ID NO: 176694 - DNA, 15 bp, Homo sapiens
aggagaagtagtgag

SEQ ID NO: 176695 - DNA, 15 bp, Homo sapiens
aaggagaagtagtga

SEQ ID NO: 176696 - DNA, 15 bp, Homo sapiens
aaaggagaagtagtg

SEQ ID NO: 176697 - DNA, 15 bp, Homo sapiens
aaaaggagaagtagt

SEQ ID NO: 176698 - DNA, 15 bp, Homo sapiens
aaaaaggagaagtag

SEQ ID NO: 176699 - DNA, 15 bp, Homo sapiens
aaaaaaggagaagta

SEQ ID NO: 176700 - DNA, 15 bp, Homo sapiens
aaaaaaaggagaagt

SEQ ID NO: 176701 - DNA, 15 bp, Homo sapiens
aaaaaaaaggagaag

SEQ ID NO: 176702 - DNA, 15 bp, Homo sapiens
aaaaaaaaaggagaa

SEQ ID NO: 176703 - DNA, 15 bp, Homo sapiens
aaaaaaaaaaggaga

SEQ ID NO: 176704 - DNA, 15 bp, Homo sapiens
aaaaaaaaaaaggag

SEQ ID NO: 176705 - DNA, 15 bp, Homo sapiens
aggaaaaaaaaaaaa

SEQ ID NO: 176706 - DNA, 15 bp, Homo sapiens
caggaaaaaaaaaaa

SEQ ID NO: 176707 - DNA, 15 bp, Homo sapiens
tcaggaaaaaaaaaa

SEQ ID NO: 176708 - DNA, 15 bp, Homo sapiens
ctcaggaaaaaaaaa

SEQ ID NO: 176709 - DNA, 15 bp, Homo sapiens
tctcaggaaaaaaaa

SEQ ID NO: 176710 - DNA, 15 bp, Homo sapiens
gtctcaggaaaaaaa

SEQ ID NO: 176711 - DNA, 15 bp, Homo sapiens
cgtctcaggaaaaaa

SEQ ID NO: 176712 - DNA, 15 bp, Homo sapiens
ccgtctcaggaaaaa

SEQ ID NO: 176713 - DNA, 15 bp, Homo sapiens
tccgtctcaggaaaa

SEQ ID NO: 176714 - DNA, 15 bp, Homo sapiens
ctccgtctcaggaaa

SEQ ID NO: 176715 - DNA, 15 bp, Homo sapiens
actccgtctcaggaa

SEQ ID NO: 176716 - DNA, 15 bp, Homo sapiens
gactccgtctcagga

SEQ ID NO: 176717 - DNA, 15 bp, Homo sapiens
agactccgtctcagg

SEQ ID NO: 176718 - DNA, 15 bp, Homo sapiens
aagactccgtctcag

SEQ ID NO: 176719 - DNA, 15 bp, Homo sapiens
cagagcaagactccg

SEQ ID NO: 176720 - DNA, 15 bp, Homo sapiens
cttcagcctgggtga

SEQ ID NO: 176721 - DNA, 15 bp, Homo sapiens
acttcagcctgggtg

SEQ ID NO: 176722 - DNA, 15 bp, Homo sapiens
cacttcagcctgggt

SEQ ID NO: 176723 - DNA, 15 bp, Homo sapiens
ttgcacttcagcctg

SEQ ID NO: 176724 - DNA, 15 bp, Homo sapiens
attgcacttcagcct

SEQ ID NO: 176725 - DNA, 15 bp, Homo sapiens
cattgcacttcagcc

SEQ ID NO: 176726 - DNA, 15 bp, Homo sapiens
ccattgcacttcagc

SEQ ID NO: 176727 - DNA, 15 bp, Homo sapiens
gccattgcacttcag

SEQ ID NO: 176728 - DNA, 15 bp, Homo sapiens
cgccattgcacttca

SEQ ID NO: 176729 - DNA, 15 bp, Homo sapiens
gcgccattgcacttc

SEQ ID NO: 176730 - DNA, 15 bp, Homo sapiens
cgcgccattgcactt

SEQ ID NO: 176731 - DNA, 15 bp, Homo sapiens
cgccgagatcgcgcc

SEQ ID NO: 176732 - DNA, 15 bp, Homo sapiens
gcgccgagatcgcgc

SEQ ID NO: 176733 - DNA, 15 bp, Homo sapiens
tgcgccgagatcgcg

SEQ ID NO: 176734 - DNA, 15 bp, Homo sapiens
gtgcgccgagatcgc

SEQ ID NO: 176735 - DNA, 15 bp, Homo sapiens
agtgcgccgagatcg

SEQ ID NO: 176736 - DNA, 15 bp, Homo sapiens
cagtgcgccgagatc

SEQ ID NO: 176737 - DNA, 15 bp, Homo sapiens
gcagtgcgccgagat

SEQ ID NO: 176738 - DNA, 15 bp, Homo sapiens
tgcagtgcgccgaga

SEQ ID NO: 176739 - DNA, 15 bp, Homo sapiens
ttgcagtgcgccgag

SEQ ID NO: 176740 - DNA, 15 bp, Homo sapiens
cttgcagtgcgccga

SEQ ID NO: 176741 - DNA, 15 bp, Homo sapiens
gcttgcagtgcgccg

SEQ ID NO: 176742 - DNA, 15 bp, Homo sapiens
agcttgcagtgcgcc

SEQ ID NO: 176743 - DNA, 15 bp, Homo sapiens
gagcttgcagtgcgc

SEQ ID NO: 176744 - DNA, 15 bp, Homo sapiens
ggagcttgcagtgcg

SEQ ID NO: 176745 - DNA, 15 bp, Homo sapiens
cggagcttgcagtgc

SEQ ID NO: 176746 - DNA, 15 bp, Homo sapiens
gggaggcggagcttg

SEQ ID NO: 176747 - DNA, 15 bp, Homo sapiens
cgggaggcggagctt

SEQ ID NO: 176748 - DNA, 15 bp, Homo sapiens
ccgggaggcggagct

SEQ ID NO: 176749 - DNA, 15 bp, Homo sapiens
cccgggaggcggagc

SEQ ID NO: 176750 - DNA, 15 bp, Homo sapiens
aggtgcctgtagtcc

SEQ ID NO: 176751 - DNA, 15 bp, Homo sapiens
caggtgcctgtagtc

SEQ ID NO: 176752 - DNA, 15 bp, Homo sapiens
gcaggtgcctgtagt

SEQ ID NO: 176753 - DNA, 15 bp, Homo sapiens
tgcaggtgcctgtag

SEQ ID NO: 176754 - DNA, 15 bp, Homo sapiens
ttgcaggtgcctgta

SEQ ID NO: 176755 - DNA, 15 bp, Homo sapiens
gttgcaggtgcctgt

SEQ ID NO: 176756 - DNA, 15 bp, Homo sapiens
ggttgcaggtgcctg

SEQ ID NO: 176757 - DNA, 15 bp, Homo sapiens
tggttgcaggtgcct

SEQ ID NO: 176758 - DNA, 15 bp, Homo sapiens
gtggttgcaggtgcc

SEQ ID NO: 176759 - DNA, 15 bp, Homo sapiens
cgtggttgcaggtgc

SEQ ID NO: 176760 - DNA, 15 bp, Homo sapiens
gcgtggttgcaggtg

SEQ ID NO: 176761 - DNA, 15 bp, Homo sapiens
ggcgtggttgcaggt

SEQ ID NO: 176762 - DNA, 15 bp, Homo sapiens
gggcgtggttgcagg

SEQ ID NO: 176763 - DNA, 15 bp, Homo sapiens
cgggcgtggttgcag

SEQ ID NO: 176764 - DNA, 15 bp, Homo sapiens
ccgggcgtggttgca

SEQ ID NO: 176765 - DNA, 15 bp, Homo sapiens
gccgggcgtggttgc

SEQ ID NO: 176766 - DNA, 15 bp, Homo sapiens
agccgggcgtggttg

SEQ ID NO: 176767 - DNA, 15 bp, Homo sapiens
tagccgggcgtggtt

SEQ ID NO: 176768 - DNA, 15 bp, Homo sapiens
tattagccgggcgtg

SEQ ID NO: 176769 - DNA, 15 bp, Homo sapiens
atattagccgggcgt

SEQ ID NO: 176770 - DNA, 15 bp, Homo sapiens
aatattagccgggcg

SEQ ID NO: 176771 - DNA, 15 bp, Homo sapiens
aaatattagccgggc

SEQ ID NO: 176772 - DNA, 15 bp, Homo sapiens
caaaatattagccgg

SEQ ID NO: 176773 - DNA, 15 bp, Homo sapiens
acaaaatattagccg

SEQ ID NO: 176774 - DNA, 15 bp, Homo sapiens
tacaaaatattagcc

SEQ ID NO: 176775 - DNA, 15 bp, Homo sapiens
atacaaaatattagc

SEQ ID NO: 176776 - DNA, 15 bp, Homo sapiens
aatacaaaatattag

SEQ ID NO: 176777 - DNA, 15 bp, Homo sapiens
aaatacaaaatatta

SEQ ID NO: 176778 - DNA, 15 bp, Homo sapiens
aaaatacaaaatatt

SEQ ID NO: 176779 - DNA, 15 bp, Homo sapiens
aaaaatacaaaatat

SEQ ID NO: 176780 - DNA, 15 bp, Homo sapiens
aaaaaatacaaaata

SEQ ID NO: 176781 - DNA, 15 bp, Homo sapiens
aaaaaaatacaaaat

SEQ ID NO: 176782 - DNA, 15 bp, Homo sapiens
taaaaaaaatacaaa

SEQ ID NO: 176783 - DNA, 15 bp, Homo sapiens
ctaaaaaaaatacaa

SEQ ID NO: 176784 - DNA, 15 bp, Homo sapiens
actaaaaaaaataca

SEQ ID NO: 176785 - DNA, 15 bp, Homo sapiens
tactaaaaaaaatac

SEQ ID NO: 176786 - DNA, 15 bp, Homo sapiens
ttactaaaaaaaata

SEQ ID NO: 176787 - DNA, 15 bp, Homo sapiens
tttactaaaaaaaat

SEQ ID NO: 176788 - DNA, 15 bp, Homo sapiens
ctttactaaaaaaaa

SEQ ID NO: 176789 - DNA, 15 bp, Homo sapiens
tctttactaaaaaaa

SEQ ID NO: 176790 - DNA, 15 bp, Homo sapiens
gtctttactaaaaaa

SEQ ID NO: 176791 - DNA, 15 bp, Homo sapiens
cgtctttactaaaaa

SEQ ID NO: 176792 - DNA, 15 bp, Homo sapiens
ccgtctttactaaaa

SEQ ID NO: 176793 - DNA, 15 bp, Homo sapiens
gccgtctttactaaa

SEQ ID NO: 176794 - DNA, 15 bp, Homo sapiens
cgccgtctttactaa

SEQ ID NO: 176795 - DNA, 15 bp, Homo sapiens
acgccgtctttacta

SEQ ID NO: 176796 - DNA, 15 bp, Homo sapiens
aacgccgtctttact

SEQ ID NO: 176797 - DNA, 15 bp, Homo sapiens
aaacgccgtctttac

SEQ ID NO: 176798 - DNA, 15 bp, Homo sapiens
gaaacgccgtcttta

SEQ ID NO: 176799 - DNA, 15 bp, Homo sapiens
tgaaacgccgtcttt

SEQ ID NO: 176800 - DNA, 15 bp, Homo sapiens
gtgaaacgccgtctt

SEQ ID NO: 176801 - DNA, 15 bp, Homo sapiens
ggtgaaacgccgtct

SEQ ID NO: 176802 - DNA, 15 bp, Homo sapiens
cggtgaaacgccgtc

SEQ ID NO: 176803 - DNA, 15 bp, Homo sapiens
acggtgaaacgccgt

SEQ ID NO: 176804 - DNA, 15 bp, Homo sapiens
aacggtgaaacgccg

SEQ ID NO: 176805 - DNA, 15 bp, Homo sapiens
aaacggtgaaacgcc

SEQ ID NO: 176806 - DNA, 15 bp, Homo sapiens
aaaacggtgaaacgc

SEQ ID NO: 176807 - DNA, 15 bp, Homo sapiens
taaaacggtgaaacg

SEQ ID NO: 176808 - DNA, 15 bp, Homo sapiens
ctaaaacggtgaaac

SEQ ID NO: 176809 - DNA, 15 bp, Homo sapiens
gctaaaacggtgaaa

SEQ ID NO: 176810 - DNA, 15 bp, Homo sapiens
ggctaaaacggtgaa

SEQ ID NO: 176811 - DNA, 15 bp, Homo sapiens
tggctaaaacggtga

SEQ ID NO: 176812 - DNA, 15 bp, Homo sapiens
ctggctaaaacggtg

SEQ ID NO: 176813 - DNA, 15 bp, Homo sapiens
tctggctaaaacggt

SEQ ID NO: 176814 - DNA, 15 bp, Homo sapiens
ttctggctaaaacgg

SEQ ID NO: 176815 - DNA, 15 bp, Homo sapiens
attctggctaaaacg

SEQ ID NO: 176816 - DNA, 15 bp, Homo sapiens
cattctggctaaaac

SEQ ID NO: 176817 - DNA, 15 bp, Homo sapiens
tcattctggctaaaa

SEQ ID NO: 176818 - DNA, 15 bp, Homo sapiens
atcattctggctaaa

SEQ ID NO: 176819 - DNA, 15 bp, Homo sapiens
gatcattctggctaa

SEQ ID NO: 176820 - DNA, 15 bp, Homo sapiens
agatcattctggcta

SEQ ID NO: 176821 - DNA, 15 bp, Homo sapiens
gagatcattctggct

SEQ ID NO: 176822 - DNA, 15 bp, Homo sapiens
cgagatcattctggc

SEQ ID NO: 176823 - DNA, 15 bp, Homo sapiens
tcgagatcattctgg

SEQ ID NO: 176824 - DNA, 15 bp, Homo sapiens
atcgagatcattctg

SEQ ID NO: 176825 - DNA, 15 bp, Homo sapiens
gatcgagatcattct

SEQ ID NO: 176826 - DNA, 15 bp, Homo sapiens
agatcgagatcattc

SEQ ID NO: 176827 - DNA, 15 bp, Homo sapiens
gagatcgagatcatt

SEQ ID NO: 176828 - DNA, 15 bp, Homo sapiens
ggagatcgagatcat

SEQ ID NO: 176829 - DNA, 15 bp, Homo sapiens
aggagatcgagatca

SEQ ID NO: 176830 - DNA, 15 bp, Homo sapiens
caggagatcgagatc

SEQ ID NO: 176831 - DNA, 15 bp, Homo sapiens
tcaggagatcgagat

SEQ ID NO: 176832 - DNA, 15 bp, Homo sapiens
cgtcaggagatcgag

SEQ ID NO: 176833 - DNA, 15 bp, Homo sapiens
acgtcaggagatcga

SEQ ID NO: 176834 - DNA, 15 bp, Homo sapiens
gacgtcaggagatcg

SEQ ID NO: 176835 - DNA, 15 bp, Homo sapiens
cgacgtcaggagatc

SEQ ID NO: 176836 - DNA, 15 bp, Homo sapiens
acgacgtcaggagat

SEQ ID NO: 176837 - DNA, 15 bp, Homo sapiens
cacgacgtcaggaga

SEQ ID NO: 176838 - DNA, 15 bp, Homo sapiens
tcacgacgtcaggag

SEQ ID NO: 176839 - DNA, 15 bp, Homo sapiens
atcacgacgtcagga

SEQ ID NO: 176840 - DNA, 15 bp, Homo sapiens
gatcacgacgtcagg

SEQ ID NO: 176841 - DNA, 15 bp, Homo sapiens
ggatcacgacgtcag

SEQ ID NO: 176842 - DNA, 15 bp, Homo sapiens
cggatcacgacgtca

SEQ ID NO: 176843 - DNA, 15 bp, Homo sapiens
gcggatcacgacgtc

SEQ ID NO: 176844 - DNA, 15 bp, Homo sapiens
ggcggatcacgacgt

SEQ ID NO: 176845 - DNA, 15 bp, Homo sapiens
gggcggatcacgacg

SEQ ID NO: 176846 - DNA, 15 bp, Homo sapiens
cgggcggatcacgac

SEQ ID NO: 176847 - DNA, 15 bp, Homo sapiens
aaggcgggcggatca

SEQ ID NO: 176848 - DNA, 15 bp, Homo sapiens
caaggcgggcggatc

SEQ ID NO: 176849 - DNA, 15 bp, Homo sapiens
cgcggtggctcacgc

SEQ ID NO: 176850 - DNA, 15 bp, Homo sapiens
gcgcggtggctcacg

SEQ ID NO: 176851 - DNA, 15 bp, Homo sapiens
ggcgcggtggctcac

SEQ ID NO: 176852 - DNA, 15 bp, Homo sapiens
cgggcgcggtggctc

SEQ ID NO: 176853 - DNA, 15 bp, Homo sapiens
ccgggcgcggtggct

SEQ ID NO: 176854 - DNA, 15 bp, Homo sapiens
gccgggcgcggtggc

SEQ ID NO: 176855 - DNA, 15 bp, Homo sapiens
ggccgggcgcggtgg

SEQ ID NO: 176856 - DNA, 15 bp, Homo sapiens
aggccgggcgcggtg

SEQ ID NO: 176857 - DNA, 15 bp, Homo sapiens
caggccgggcgcggt

SEQ ID NO: 176858 - DNA, 15 bp, Homo sapiens
gcaggccgggcgcgg

SEQ ID NO: 176859 - DNA, 15 bp, Homo sapiens
agcaggccgggcgcg

SEQ ID NO: 176860 - DNA, 15 bp, Homo sapiens
aagcaggccgggcgc

SEQ ID NO: 176861 - DNA, 15 bp, Homo sapiens
gaagcaggccgggcg

SEQ ID NO: 176862 - DNA, 15 bp, Homo sapiens
agaagcaggccgggc

SEQ ID NO: 176863 - DNA, 15 bp, Homo sapiens
gagaagcaggccggg

SEQ ID NO: 176864 - DNA, 15 bp, Homo sapiens
ggagaagcaggccgg

SEQ ID NO: 176865 - DNA, 15 bp, Homo sapiens
tggagaagcaggccg

SEQ ID NO: 176866 - DNA, 15 bp, Homo sapiens
atggagaagcaggcc

SEQ ID NO: 176867 - DNA, 15 bp, Homo sapiens
aatggagaagcaggc

SEQ ID NO: 176868 - DNA, 15 bp, Homo sapiens
aaatggagaagcagg

SEQ ID NO: 176869 - DNA, 15 bp, Homo sapiens
aaaatggagaagcag

SEQ ID NO: 176870 - DNA, 15 bp, Homo sapiens
caaaatggagaagca

SEQ ID NO: 176871 - DNA, 15 bp, Homo sapiens
acaaaatggagaagc

SEQ ID NO: 176872 - DNA, 15 bp, Homo sapiens
aacaaaatggagaag

SEQ ID NO: 176873 - DNA, 15 bp, Homo sapiens
gaacaaaatggagaa

SEQ ID NO: 176874 - DNA, 15 bp, Homo sapiens
tgaacaaaatggaga

SEQ ID NO: 176875 - DNA, 15 bp, Homo sapiens
gtgaacaaaatggag

SEQ ID NO: 176876 - DNA, 15 bp, Homo sapiens
tgtgaacaaaatgga

SEQ ID NO: 176877 - DNA, 15 bp, Homo sapiens
ttgtgaacaaaatgg

SEQ ID NO: 176878 - DNA, 15 bp, Homo sapiens
tttgtgaacaaaatg

SEQ ID NO: 176879 - DNA, 15 bp, Homo sapiens
ttttgtgaacaaaat

SEQ ID NO: 176880 - DNA, 15 bp, Homo sapiens
attttgtgaacaaaa

SEQ ID NO: 176881 - DNA, 15 bp, Homo sapiens
tattttgtgaacaaa

SEQ ID NO: 176882 - DNA, 15 bp, Homo sapiens
atattttgtgaacaa

SEQ ID NO: 176883 - DNA, 15 bp, Homo sapiens
aatattttgtgaaca

SEQ ID NO: 176884 - DNA, 15 bp, Homo sapiens
aaatattttgtgaac

SEQ ID NO: 176885 - DNA, 15 bp, Homo sapiens
aaaatattttgtgaa

SEQ ID NO: 176886 - DNA, 15 bp, Homo sapiens
aaaaatattttgtga

SEQ ID NO: 176887 - DNA, 15 bp, Homo sapiens
aaaaaatattttgtg

SEQ ID NO: 176888 - DNA, 15 bp, Homo sapiens
gaaaaaatattttgt

SEQ ID NO: 176889 - DNA, 15 bp, Homo sapiens
ggaaaaaatattttg

SEQ ID NO: 176890 - DNA, 15 bp, Homo sapiens
aggaaaaaatatttt

SEQ ID NO: 176891 - DNA, 15 bp, Homo sapiens
gaggaaaaaatattt

SEQ ID NO: 176892 - DNA, 15 bp, Homo sapiens
tgaggaaaaaatatt

SEQ ID NO: 176893 - DNA, 15 bp, Homo sapiens
ctgaggaaaaaatat

SEQ ID NO: 176894 - DNA, 15 bp, Homo sapiens
tctgaggaaaaaata

SEQ ID NO: 176895 - DNA, 15 bp, Homo sapiens
ttctgaggaaaaaat

SEQ ID NO: 176896 - DNA, 15 bp, Homo sapiens
cttctgaggaaaaaa

SEQ ID NO: 176897 - DNA, 15 bp, Homo sapiens
acttctgaggaaaaa

SEQ ID NO: 176898 - DNA, 15 bp, Homo sapiens
cacttctgaggaaaa

SEQ ID NO: 176899 - DNA, 15 bp, Homo sapiens
acacttctgaggaaa

SEQ ID NO: 176900 - DNA, 15 bp, Homo sapiens
cacacttctgaggaa

SEQ ID NO: 176901 - DNA, 15 bp, Homo sapiens
ccacacttctgagga

SEQ ID NO: 176902 - DNA, 15 bp, Homo sapiens
gccacacttctgagg

SEQ ID NO: 176903 - DNA, 15 bp, Homo sapiens
tgccacacttctgag

SEQ ID NO: 176904 - DNA, 15 bp, Homo sapiens
atgccacacttctga

SEQ ID NO: 176905 - DNA, 15 bp, Homo sapiens
aatgccacacttctg

SEQ ID NO: 176906 - DNA, 15 bp, Homo sapiens
caatgccacacttct

SEQ ID NO: 176907 - DNA, 15 bp, Homo sapiens
tcaatgccacacttc

SEQ ID NO: 176908 - DNA, 15 bp, Homo sapiens
ttcaatgccacactt

SEQ ID NO: 176909 - DNA, 15 bp, Homo sapiens
attcaatgccacact

SEQ ID NO: 176910 - DNA, 15 bp, Homo sapiens
cattcaatgccacac

SEQ ID NO: 176911 - DNA, 15 bp, Homo sapiens
tcattcaatgccaca

SEQ ID NO: 176912 - DNA, 15 bp, Homo sapiens
atcattcaatgccac

SEQ ID NO: 176913 - DNA, 15 bp, Homo sapiens
catcattcaatgcca

SEQ ID NO: 176914 - DNA, 15 bp, Homo sapiens
acatcattcaatgcc

SEQ ID NO: 176915 - DNA, 15 bp, Homo sapiens
tacatcattcaatgc

SEQ ID NO: 176916 - DNA, 15 bp, Homo sapiens
atacatcattcaatg

SEQ ID NO: 176917 - DNA, 15 bp, Homo sapiens
aatacatcattcaat

SEQ ID NO: 176918 - DNA, 15 bp, Homo sapiens
caatacatcattcaa

SEQ ID NO: 176919 - DNA, 15 bp, Homo sapiens
acaatacatcattca

SEQ ID NO: 176920 - DNA, 15 bp, Homo sapiens
aacaatacatcattc

SEQ ID NO: 176921 - DNA, 15 bp, Homo sapiens
aaacaatacatcatt

SEQ ID NO: 176922 - DNA, 15 bp, Homo sapiens
aaaacaatacatcat

SEQ ID NO: 176923 - DNA, 15 bp, Homo sapiens
caaaacaatacatca

SEQ ID NO: 176924 - DNA, 15 bp, Homo sapiens
acaaaacaatacatc

SEQ ID NO: 176925 - DNA, 15 bp, Homo sapiens
tacaaaacaatacat

SEQ ID NO: 176926 - DNA, 15 bp, Homo sapiens
ctacaaaacaataca

SEQ ID NO: 176927 - DNA, 15 bp, Homo sapiens
actacaaaacaatac

SEQ ID NO: 176928 - DNA, 15 bp, Homo sapiens
cactacaaaacaata

SEQ ID NO: 176929 - DNA, 15 bp, Homo sapiens
tcactacaaaacaat

SEQ ID NO: 176930 - DNA, 15 bp, Homo sapiens
ctcactacaaaacaa

SEQ ID NO: 176931 - DNA, 15 bp, Homo sapiens
actcactacaaaaca

SEQ ID NO: 176932 - DNA, 15 bp, Homo sapiens
tactcactacaaaac

SEQ ID NO: 176933 - DNA, 15 bp, Homo sapiens
gtactcactacaaaa

SEQ ID NO: 176934 - DNA, 15 bp, Homo sapiens
tgtactcactacaaa

SEQ ID NO: 176935 - DNA, 15 bp, Homo sapiens
atgtactcactacaa

SEQ ID NO: 176936 - DNA, 15 bp, Homo sapiens
aatgtactcactaca

SEQ ID NO: 176937 - DNA, 15 bp, Homo sapiens
taatgtactcactac

SEQ ID NO: 176938 - DNA, 15 bp, Homo sapiens
ataatgtactcacta

SEQ ID NO: 176939 - DNA, 15 bp, Homo sapiens
gataatgtactcact

SEQ ID NO: 176940 - DNA, 15 bp, Homo sapiens
agataatgtactcac

SEQ ID NO: 176941 - DNA, 15 bp, Homo sapiens
gagataatgtactca

SEQ ID NO: 176942 - DNA, 15 bp, Homo sapiens
tgagataatgtactc

SEQ ID NO: 176943 - DNA, 15 bp, Homo sapiens
ctgagataatgtact

SEQ ID NO: 176944 - DNA, 15 bp, Homo sapiens
actgagataatgtac

SEQ ID NO: 176945 - DNA, 15 bp, Homo sapiens
cactgagataatgta

SEQ ID NO: 176946 - DNA, 15 bp, Homo sapiens
tcactgagataatgt

SEQ ID NO: 176947 - DNA, 15 bp, Homo sapiens
ttcactgagataatg

SEQ ID NO: 176948 - DNA, 15 bp, Homo sapiens
gttcactgagataat

SEQ ID NO: 176949 - DNA, 15 bp, Homo sapiens
tgttcactgagataa

SEQ ID NO: 176950 - DNA, 15 bp, Homo sapiens
gtgttcactgagata

SEQ ID NO: 176951 - DNA, 15 bp, Homo sapiens
tgtgttcactgagat

SEQ ID NO: 176952 - DNA, 15 bp, Homo sapiens
gtgtgttcactgaga

SEQ ID NO: 176953 - DNA, 15 bp, Homo sapiens
tgtgtgttcactgag

SEQ ID NO: 176954 - DNA, 15 bp, Homo sapiens
ttgtgtgttcactga

SEQ ID NO: 176955 - DNA, 15 bp, Homo sapiens
attgtgtgttcactg

SEQ ID NO: 176956 - DNA, 15 bp, Homo sapiens
aattgtgtgttcact

SEQ ID NO: 176957 - DNA, 15 bp, Homo sapiens
aaattgtgtgttcac

SEQ ID NO: 176958 - DNA, 15 bp, Homo sapiens
gaaattgtgtgttca

SEQ ID NO: 176959 - DNA, 15 bp, Homo sapiens
agaaattgtgtgttc

SEQ ID NO: 176960 - DNA, 15 bp, Homo sapiens
aagaaattgtgtgtt

SEQ ID NO: 176961 - DNA, 15 bp, Homo sapiens
aaagaaattgtgtgt

SEQ ID NO: 176962 - DNA, 15 bp, Homo sapiens
gaaagaaattgtgtg

SEQ ID NO: 176963 - DNA, 15 bp, Homo sapiens
tgaaagaaattgtgt

SEQ ID NO: 176964 - DNA, 15 bp, Homo sapiens
ctgaaagaaattgtg

SEQ ID NO: 176965 - DNA, 15 bp, Homo sapiens
tctgaaagaaattgt

SEQ ID NO: 176966 - DNA, 15 bp, Homo sapiens
atctgaaagaaattg

SEQ ID NO: 176967 - DNA, 15 bp, Homo sapiens
tatctgaaagaaatt

SEQ ID NO: 176968 - DNA, 15 bp, Homo sapiens
ctatctgaaagaaat

SEQ ID NO: 176969 - DNA, 15 bp, Homo sapiens
actatctgaaagaaa

SEQ ID NO: 176970 - DNA, 15 bp, Homo sapiens
gactatctgaaagaa

SEQ ID NO: 176971 - DNA, 15 bp, Homo sapiens
tgactatctgaaaga

SEQ ID NO: 176972 - DNA, 15 bp, Homo sapiens
gtgactatctgaaag

SEQ ID NO: 176973 - DNA, 15 bp, Homo sapiens
ggtgactatctgaaa

SEQ ID NO: 176974 - DNA, 15 bp, Homo sapiens
tggtgactatctgaa

SEQ ID NO: 176975 - DNA, 15 bp, Homo sapiens
ctggtgactatctga

SEQ ID NO: 176976 - DNA, 15 bp, Homo sapiens
tctggtgactatctg

SEQ ID NO: 176977 - DNA, 15 bp, Homo sapiens
ctctggtgactatct

SEQ ID NO: 176978 - DNA, 15 bp, Homo sapiens
actctggtgactatc

SEQ ID NO: 176979 - DNA, 15 bp, Homo sapiens
tactctggtgactat

SEQ ID NO: 176980 - DNA, 15 bp, Homo sapiens
ctactctggtgacta

SEQ ID NO: 176981 - DNA, 15 bp, Homo sapiens
actactctggtgact

SEQ ID NO: 176982 - DNA, 15 bp, Homo sapiens
gactactctggtgac

SEQ ID NO: 176983 - DNA, 15 bp, Homo sapiens
tgactactctggtga

SEQ ID NO: 176984 - DNA, 15 bp, Homo sapiens
atgactactctggtg

SEQ ID NO: 176985 - DNA, 15 bp, Homo sapiens
gatgactactctggt

SEQ ID NO: 176986 - DNA, 15 bp, Homo sapiens
tgatgactactctgg

SEQ ID NO: 176987 - DNA, 15 bp, Homo sapiens
ttgatgactactctg

SEQ ID NO: 176988 - DNA, 15 bp, Homo sapiens
tttgatgactactct

SEQ ID NO: 176989 - DNA, 15 bp, Homo sapiens
ttttgatgactactc

SEQ ID NO: 176990 - DNA, 15 bp, Homo sapiens
cttttgatgactact

SEQ ID NO: 176991 - DNA, 15 bp, Homo sapiens
ccttttgatgactac

SEQ ID NO: 176992 - DNA, 15 bp, Homo sapiens
tccttttgatgacta

SEQ ID NO: 176993 - DNA, 15 bp, Homo sapiens
ttccttttgatgact

SEQ ID NO: 176994 - DNA, 15 bp, Homo sapiens
tttccttttgatgac

SEQ ID NO: 176995 - DNA, 15 bp, Homo sapiens
ttttccttttgatga

SEQ ID NO: 176996 - DNA, 15 bp, Homo sapiens
cttttccttttgatg

SEQ ID NO: 176997 - DNA, 15 bp, Homo sapiens
gcttttccttttgat

SEQ ID NO: 176998 - DNA, 15 bp, Homo sapiens
tgcttttccttttga

SEQ ID NO: 176999 - DNA, 15 bp, Homo sapiens
ttgcttttccttttg

SEQ ID NO: 177000 - DNA, 15 bp, Homo sapiens
attgcttttcctttt

SEQ ID NO: 177001 - DNA, 15 bp, Homo sapiens
gattgcttttccttt

SEQ ID NO: 177002 - DNA, 15 bp, Homo sapiens
agattgcttttcctt

SEQ ID NO: 177003 - DNA, 15 bp, Homo sapiens
tagattgcttttcct

SEQ ID NO: 177004 - DNA, 15 bp, Homo sapiens
ttagattgcttttcc

SEQ ID NO: 177005 - DNA, 15 bp, Homo sapiens
cttagattgcttttc

SEQ ID NO: 177006 - DNA, 15 bp, Homo sapiens
acttagattgctttt

SEQ ID NO: 177007 - DNA, 15 bp, Homo sapiens
tacttagattgcttt

SEQ ID NO: 177008 - DNA, 15 bp, Homo sapiens
gtacttagattgctt

SEQ ID NO: 177009 - DNA, 15 bp, Homo sapiens
ggtacttagattgct

SEQ ID NO: 177010 - DNA, 15 bp, Homo sapiens
tggtacttagattgc

SEQ ID NO: 177011 - DNA, 15 bp, Homo sapiens
atggtacttagattg

SEQ ID NO: 177012 - DNA, 15 bp, Homo sapiens
aatggtacttagatt

SEQ ID NO: 177013 - DNA, 15 bp, Homo sapiens
aaatggtacttagat

SEQ ID NO: 177014 - DNA, 15 bp, Homo sapiens
taaatggtacttaga

SEQ ID NO: 177015 - DNA, 15 bp, Homo sapiens
ttaaatggtacttag

SEQ ID NO: 177016 - DNA, 15 bp, Homo sapiens
attaaatggtactta

SEQ ID NO: 177017 - DNA, 15 bp, Homo sapiens
cattaaatggtactt

SEQ ID NO: 177018 - DNA, 15 bp, Homo sapiens
ccattaaatggtact

SEQ ID NO: 177019 - DNA, 15 bp, Homo sapiens
cccattaaatggtac

SEQ ID NO: 177020 - DNA, 15 bp, Homo sapiens
gcccattaaatggta

SEQ ID NO: 177021 - DNA, 15 bp, Homo sapiens
agcccattaaatggt

SEQ ID NO: 177022 - DNA, 15 bp, Homo sapiens
cagcccattaaatgg

SEQ ID NO: 177023 - DNA, 15 bp, Homo sapiens
gcagcccattaaatg

SEQ ID NO: 177024 - DNA, 15 bp, Homo sapiens
tgcagcccattaaat

SEQ ID NO: 177025 - DNA, 15 bp, Homo sapiens
gtgcagcccattaaa

SEQ ID NO: 177026 - DNA, 15 bp, Homo sapiens
agtgcagcccattaa

SEQ ID NO: 177027 - DNA, 15 bp, Homo sapiens
tagtgcagcccatta

SEQ ID NO: 177028 - DNA, 15 bp, Homo sapiens
gtagtgcagcccatt

SEQ ID NO: 177029 - DNA, 15 bp, Homo sapiens
tgtagtgcagcccat

SEQ ID NO: 177030 - DNA, 15 bp, Homo sapiens
gtgtagtgcagccca

SEQ ID NO: 177031 - DNA, 15 bp, Homo sapiens
agtgtagtgcagccc

SEQ ID NO: 177032 - DNA, 15 bp, Homo sapiens
tagtgtagtgcagcc

SEQ ID NO: 177033 - DNA, 15 bp, Homo sapiens
ttagtgtagtgcagc

SEQ ID NO: 177034 - DNA, 15 bp, Homo sapiens
attagtgtagtgcag

SEQ ID NO: 177035 - DNA, 15 bp, Homo sapiens
tattagtgtagtgca

SEQ ID NO: 177036 - DNA, 15 bp, Homo sapiens
atattagtgtagtgc

SEQ ID NO: 177037 - DNA, 15 bp, Homo sapiens
aatattagtgtagtg

SEQ ID NO: 177038 - DNA, 15 bp, Homo sapiens
gaatattagtgtagt

SEQ ID NO: 177039 - DNA, 15 bp, Homo sapiens
agaatattagtgtag

SEQ ID NO: 177040 - DNA, 15 bp, Homo sapiens
tagaatattagtgta

SEQ ID NO: 177041 - DNA, 15 bp, Homo sapiens
atagaatattagtgt

SEQ ID NO: 177042 - DNA, 15 bp, Homo sapiens
aatagaatattagtg

SEQ ID NO: 177043 - DNA, 15 bp, Homo sapiens
aaatagaatattagt

SEQ ID NO: 177044 - DNA, 15 bp, Homo sapiens
caaatagaatattag

SEQ ID NO: 177045 - DNA, 15 bp, Homo sapiens
tcaaatagaatatta

SEQ ID NO: 177046 - DNA, 15 bp, Homo sapiens
atcaaatagaatatt

SEQ ID NO: 177047 - DNA, 15 bp, Homo sapiens
catcaaatagaatat

SEQ ID NO: 177048 - DNA, 15 bp, Homo sapiens
tcatcaaatagaata

SEQ ID NO: 177049 - DNA, 15 bp, Homo sapiens
ttcatcaaatagaat

SEQ ID NO: 177050 - DNA, 15 bp, Homo sapiens
attcatcaaatagaa

SEQ ID NO: 177051 - DNA, 15 bp, Homo sapiens
aattcatcaaataga

SEQ ID NO: 177052 - DNA, 15 bp, Homo sapiens
taattcatcaaatag

SEQ ID NO: 177053 - DNA, 15 bp, Homo sapiens
gttaattcatcaaat

SEQ ID NO: 177054 - DNA, 15 bp, Homo sapiens
agttaattcatcaaa

SEQ ID NO: 177055 - DNA, 15 bp, Homo sapiens
cagttaattcatcaa

SEQ ID NO: 177056 - DNA, 15 bp, Homo sapiens
gcagttaattcatca

SEQ ID NO: 177057 - DNA, 15 bp, Homo sapiens
tgcagttaattcatc

SEQ ID NO: 177058 - DNA, 15 bp, Homo sapiens
atgcagttaattcat

SEQ ID NO: 177059 - DNA, 15 bp, Homo sapiens
catgcagttaattca

SEQ ID NO: 177060 - DNA, 15 bp, Homo sapiens
acatgcagttaattc

SEQ ID NO: 177061 - DNA, 15 bp, Homo sapiens
aacatgcagttaatt

SEQ ID NO: 177062 - DNA, 15 bp, Homo sapiens
aaacatgcagttaat

SEQ ID NO: 177063 - DNA, 15 bp, Homo sapiens
aaaacatgcagttaa

SEQ ID NO: 177064 - DNA, 15 bp, Homo sapiens
aaaaacatgcagtta

SEQ ID NO: 177065 - DNA, 15 bp, Homo sapiens
taaaaacatgcagtt

SEQ ID NO: 177066 - DNA, 15 bp, Homo sapiens
ctaaaaacatgcagt

SEQ ID NO: 177067 - DNA, 15 bp, Homo sapiens
actaaaaacatgcag

SEQ ID NO: 177068 - DNA, 15 bp, Homo sapiens
aactaaaaacatgca

SEQ ID NO: 177069 - DNA, 15 bp, Homo sapiens
taactaaaaacatgc

SEQ ID NO: 177070 - DNA, 15 bp, Homo sapiens
ataactaaaaacatg

SEQ ID NO: 177071 - DNA, 15 bp, Homo sapiens
gataactaaaaacat

SEQ ID NO: 177072 - DNA, 15 bp, Homo sapiens
agataactaaaaaca

SEQ ID NO: 177073 - DNA, 15 bp, Homo sapiens
cagataactaaaaac

SEQ ID NO: 177074 - DNA, 15 bp, Homo sapiens
acagataactaaaaa

SEQ ID NO: 177075 - DNA, 15 bp, Homo sapiens
aacagataactaaaa

SEQ ID NO: 177076 - DNA, 15 bp, Homo sapiens
taacagataactaaa

SEQ ID NO: 177077 - DNA, 15 bp, Homo sapiens
ctaacagataactaa

SEQ ID NO: 177078 - DNA, 15 bp, Homo sapiens
tctaacagataacta

SEQ ID NO: 177079 - DNA, 15 bp, Homo sapiens
gtctaacagataact

SEQ ID NO: 177080 - DNA, 15 bp, Homo sapiens
agtctaacagataac

SEQ ID NO: 177081 - DNA, 15 bp, Homo sapiens
tagtctaacagataa

SEQ ID NO: 177082 - DNA, 15 bp, Homo sapiens
ctagtctaacagata

SEQ ID NO: 177083 - DNA, 15 bp, Homo sapiens
actagtctaacagat

SEQ ID NO: 177084 - DNA, 15 bp, Homo sapiens
aactagtctaacaga

SEQ ID NO: 177085 - DNA, 15 bp, Homo sapiens
aaactagtctaacag

SEQ ID NO: 177086 - DNA, 15 bp, Homo sapiens
aaaactagtctaaca

SEQ ID NO: 177087 - DNA, 15 bp, Homo sapiens
gaaaactagtctaac

SEQ ID NO: 177088 - DNA, 15 bp, Homo sapiens
tgaaaactagtctaa

SEQ ID NO: 177089 - DNA, 15 bp, Homo sapiens
atgaaaactagtcta

SEQ ID NO: 177090 - DNA, 15 bp, Homo sapiens
aatgaaaactagtct

SEQ ID NO: 177091 - DNA, 15 bp, Homo sapiens
gaatgaaaactagtc

SEQ ID NO: 177092 - DNA, 15 bp, Homo sapiens
agaatgaaaactagt

SEQ ID NO: 177093 - DNA, 15 bp, Homo sapiens
aagaatgaaaactag

SEQ ID NO: 177094 - DNA, 15 bp, Homo sapiens
aaagaatgaaaacta

SEQ ID NO: 177095 - DNA, 15 bp, Homo sapiens
aaaagaatgaaaact

SEQ ID NO: 177096 - DNA, 15 bp, Homo sapiens
gaaaagaatgaaaac

SEQ ID NO: 177097 - DNA, 15 bp, Homo sapiens
ggaaaagaatgaaaa

SEQ ID NO: 177098 - DNA, 15 bp, Homo sapiens
aggaaaagaatgaaa

SEQ ID NO: 177099 - DNA, 15 bp, Homo sapiens
aaggaaaagaatgaa

SEQ ID NO: 177100 - DNA, 15 bp, Homo sapiens
gaaggaaaagaatga

SEQ ID NO: 177101 - DNA, 15 bp, Homo sapiens
ggaaggaaaagaatg

SEQ ID NO: 177102 - DNA, 15 bp, Homo sapiens
gggaaggaaaagaat

SEQ ID NO: 177103 - DNA, 15 bp, Homo sapiens
agggaaggaaaagaa

SEQ ID NO: 177104 - DNA, 15 bp, Homo sapiens
aagggaaggaaaaga

SEQ ID NO: 177105 - DNA, 15 bp, Homo sapiens
gaagggaaggaaaag

SEQ ID NO: 177106 - DNA, 15 bp, Homo sapiens
cgaagggaaggaaaa

SEQ ID NO: 177107 - DNA, 15 bp, Homo sapiens
ccgaagggaaggaaa

SEQ ID NO: 177108 - DNA, 15 bp, Homo sapiens
accgaagggaaggaa

SEQ ID NO: 177109 - DNA, 15 bp, Homo sapiens
taccgaagggaagga

SEQ ID NO: 177110 - DNA, 15 bp, Homo sapiens
ataccgaagggaagg

SEQ ID NO: 177111 - DNA, 15 bp, Homo sapiens
cataccgaagggaag

SEQ ID NO: 177112 - DNA, 15 bp, Homo sapiens
tcataccgaagggaa

SEQ ID NO: 177113 - DNA, 15 bp, Homo sapiens
atcataccgaaggga

SEQ ID NO: 177114 - DNA, 15 bp, Homo sapiens
tatcataccgaaggg

SEQ ID NO: 177115 - DNA, 15 bp, Homo sapiens
ttatcataccgaagg

SEQ ID NO: 177116 - DNA, 15 bp, Homo sapiens
tttatcataccgaag

SEQ ID NO: 177117 - DNA, 15 bp, Homo sapiens
atttatcataccgaa

SEQ ID NO: 177118 - DNA, 15 bp, Homo sapiens
aatttatcataccga

SEQ ID NO: 177119 - DNA, 15 bp, Homo sapiens
gaatttatcataccg

SEQ ID NO: 177120 - DNA, 15 bp, Homo sapiens
agaatttatcatacc

SEQ ID NO: 177121 - DNA, 15 bp, Homo sapiens
aagaatttatcatac

SEQ ID NO: 177122 - DNA, 15 bp, Homo sapiens
aaagaatttatcata

SEQ ID NO: 177123 - DNA, 15 bp, Homo sapiens
aaaagaatttatcat

SEQ ID NO: 177124 - DNA, 15 bp, Homo sapiens
taaaagaatttatca

SEQ ID NO: 177125 - DNA, 15 bp, Homo sapiens
ttaaaagaatttatc

SEQ ID NO: 177126 - DNA, 15 bp, Homo sapiens
tttaaaagaatttat

SEQ ID NO: 177127 - DNA, 15 bp, Homo sapiens
ttttaaaagaattta

SEQ ID NO: 177128 - DNA, 15 bp, Homo sapiens
attttaaaagaattt

SEQ ID NO: 177129 - DNA, 15 bp, Homo sapiens
cattttaaaagaatt

SEQ ID NO: 177130 - DNA, 15 bp, Homo sapiens
ccattttaaaagaat

SEQ ID NO: 177131 - DNA, 15 bp, Homo sapiens
accattttaaaagaa

SEQ ID NO: 177132 - DNA, 15 bp, Homo sapiens
aaccattttaaaaga

SEQ ID NO: 177133 - DNA, 15 bp, Homo sapiens
aaaccattttaaaag

SEQ ID NO: 177134 - DNA, 15 bp, Homo sapiens
aaaaccattttaaaa

SEQ ID NO: 177135 - DNA, 15 bp, Homo sapiens
taaaaccattttaaa

SEQ ID NO: 177136 - DNA, 15 bp, Homo sapiens
ataaaaccattttaa

SEQ ID NO: 177137 - DNA, 15 bp, Homo sapiens
aataaaaccatttta

SEQ ID NO: 177138 - DNA, 15 bp, Homo sapiens
gaataaaaccatttt

SEQ ID NO: 177139 - DNA, 15 bp, Homo sapiens
tgaataaaaccattt

SEQ ID NO: 177140 - DNA, 15 bp, Homo sapiens
ttgaataaaaccatt

SEQ ID NO: 177141 - DNA, 15 bp, Homo sapiens
attgaataaaaccat

SEQ ID NO: 177142 - DNA, 15 bp, Homo sapiens
gattgaataaaacca

SEQ ID NO: 177143 - DNA, 15 bp, Homo sapiens
ggattgaataaaacc

SEQ ID NO: 177144 - DNA, 15 bp, Homo sapiens
gggattgaataaaac

SEQ ID NO: 177145 - DNA, 15 bp, Homo sapiens
tgggattgaataaaa

SEQ ID NO: 177146 - DNA, 15 bp, Homo sapiens
ctgggattgaataaa

SEQ ID NO: 177147 - DNA, 15 bp, Homo sapiens
cctgggattgaataa

SEQ ID NO: 177148 - DNA, 15 bp, Homo sapiens
tcctgggattgaata

SEQ ID NO: 177149 - DNA, 15 bp, Homo sapiens
ttcctgggattgaat

SEQ ID NO: 177150 - DNA, 15 bp, Homo sapiens
tttcctgggattgaa

SEQ ID NO: 177151 - DNA, 15 bp, Homo sapiens
gtttcctgggattga

SEQ ID NO: 177152 - DNA, 15 bp, Homo sapiens
agtttcctgggattg

SEQ ID NO: 177153 - DNA, 15 bp, Homo sapiens
cagtttcctgggatt

SEQ ID NO: 177154 - DNA, 15 bp, Homo sapiens
tcagtttcctgggat

SEQ ID NO: 177155 - DNA, 15 bp, Homo sapiens
ttcagtttcctggga

SEQ ID NO: 177156 - DNA, 15 bp, Homo sapiens
tttcagtttcctggg

SEQ ID NO: 177157 - DNA, 15 bp, Homo sapiens
ttttcagtttcctgg

SEQ ID NO: 177158 - DNA, 15 bp, Homo sapiens
attttcagtttcctg

SEQ ID NO: 177159 - DNA, 15 bp, Homo sapiens
tattttcagtttcct

SEQ ID NO: 177160 - DNA, 15 bp, Homo sapiens
gtattttcagtttcc

SEQ ID NO: 177161 - DNA, 15 bp, Homo sapiens
agtattttcagtttc

SEQ ID NO: 177162 - DNA, 15 bp, Homo sapiens
aagtattttcagttt

SEQ ID NO: 177163 - DNA, 15 bp, Homo sapiens
caagtattttcagtt

SEQ ID NO: 177164 - DNA, 15 bp, Homo sapiens
tcaagtattttcagt

SEQ ID NO: 177165 - DNA, 15 bp, Homo sapiens
ttcaagtattttcag

SEQ ID NO: 177166 - DNA, 15 bp, Homo sapiens
tttcaagtattttca

SEQ ID NO: 177167 - DNA, 15 bp, Homo sapiens
ttttcaagtattttc

SEQ ID NO: 177168 - DNA, 15 bp, Homo sapiens
tttttcaagtatttt

SEQ ID NO: 177169 - DNA, 15 bp, Homo sapiens
ttttttcaagtattt

SEQ ID NO: 177170 - DNA, 15 bp, Homo sapiens
attttttcaagtatt

SEQ ID NO: 177171 - DNA, 15 bp, Homo sapiens
tattttttcaagtat

SEQ ID NO: 177172 - DNA, 15 bp, Homo sapiens
ttattttttcaagta

SEQ ID NO: 177173 - DNA, 15 bp, Homo sapiens
attattttttcaagt

SEQ ID NO: 177174 - DNA, 15 bp, Homo sapiens
tattattttttcaag

SEQ ID NO: 177175 - DNA, 15 bp, Homo sapiens
atattattttttcaa

SEQ ID NO: 177176 - DNA, 15 bp, Homo sapiens
aatattattttttca

SEQ ID NO: 177177 - DNA, 15 bp, Homo sapiens
aaatattattttttc

SEQ ID NO: 177178 - DNA, 15 bp, Homo sapiens
aaaatattatttttt

SEQ ID NO: 177179 - DNA, 15 bp, Homo sapiens
caaaatattattttt

SEQ ID NO: 177180 - DNA, 15 bp, Homo sapiens
gcaaaatattatttt

SEQ ID NO: 177181 - DNA, 15 bp, Homo sapiens
tgcaaaatattattt

SEQ ID NO: 177182 - DNA, 15 bp, Homo sapiens
ttgcaaaatattatt

SEQ ID NO: 177183 - DNA, 15 bp, Homo sapiens
attgcaaaatattat

SEQ ID NO: 177184 - DNA, 15 bp, Homo sapiens
aattgcaaaatatta

SEQ ID NO: 177185 - DNA, 15 bp, Homo sapiens
aaattgcaaaatatt

SEQ ID NO: 177186 - DNA, 15 bp, Homo sapiens
caaattgcaaaatat

SEQ ID NO: 177187 - DNA, 15 bp, Homo sapiens
acaaattgcaaaata

SEQ ID NO: 177188 - DNA, 15 bp, Homo sapiens
gacaaattgcaaaat

SEQ ID NO: 177189 - DNA, 15 bp, Homo sapiens
tgacaaattgcaaaa

SEQ ID NO: 177190 - DNA, 15 bp, Homo sapiens
ctgacaaattgcaaa

SEQ ID NO: 177191 - DNA, 15 bp, Homo sapiens
tctgacaaattgcaa

SEQ ID NO: 177192 - DNA, 15 bp, Homo sapiens
ttctgacaaattgca

SEQ ID NO: 177193 - DNA, 15 bp, Homo sapiens
tttctgacaaattgc

SEQ ID NO: 177194 - DNA, 15 bp, Homo sapiens
ttttctgacaaattg

SEQ ID NO: 177195 - DNA, 15 bp, Homo sapiens
attttctgacaaatt

SEQ ID NO: 177196 - DNA, 15 bp, Homo sapiens
tattttctgacaaat

SEQ ID NO: 177197 - DNA, 15 bp, Homo sapiens
atattttctgacaaa

SEQ ID NO: 177198 - DNA, 15 bp, Homo sapiens
aatattttctgacaa

SEQ ID NO: 177199 - DNA, 15 bp, Homo sapiens
aaatattttctgaca

SEQ ID NO: 177200 - DNA, 15 bp, Homo sapiens
gaaatattttctgac

SEQ ID NO: 177201 - DNA, 15 bp, Homo sapiens
ggaaatattttctga

SEQ ID NO: 177202 - DNA, 15 bp, Homo sapiens
aggaaatattttctg

SEQ ID NO: 177203 - DNA, 15 bp, Homo sapiens
gaggaaatattttct

SEQ ID NO: 177204 - DNA, 15 bp, Homo sapiens
tgaggaaatattttc

SEQ ID NO: 177205 - DNA, 15 bp, Homo sapiens
gtgaggaaatatttt

SEQ ID NO: 177206 - DNA, 15 bp, Homo sapiens
agtgaggaaatattt

SEQ ID NO: 177207 - DNA, 15 bp, Homo sapiens
tagtgaggaaatatt

SEQ ID NO: 177208 - DNA, 15 bp, Homo sapiens
gtagtgaggaaatat

SEQ ID NO: 177209 - DNA, 15 bp, Homo sapiens
agtagtgaggaaata

SEQ ID NO: 177210 - DNA, 15 bp, Homo sapiens
aagtagtgaggaaat

SEQ ID NO: 177211 - DNA, 15 bp, Homo sapiens
caagtagtgaggaaa

SEQ ID NO: 177212 - DNA, 15 bp, Homo sapiens
tcaagtagtgaggaa

SEQ ID NO: 177213 - DNA, 15 bp, Homo sapiens
gtcaagtagtgagga

SEQ ID NO: 177214 - DNA, 15 bp, Homo sapiens
agtcaagtagtgagg

SEQ ID NO: 177215 - DNA, 15 bp, Homo sapiens
cagtcaagtagtgag

SEQ ID NO: 177216 - DNA, 15 bp, Homo sapiens
ccagtcaagtagtga

SEQ ID NO: 177217 - DNA, 15 bp, Homo sapiens
accagtcaagtagtg

SEQ ID NO: 177218 - DNA, 15 bp, Homo sapiens
taccagtcaagtagt

SEQ ID NO: 177219 - DNA, 15 bp, Homo sapiens
ttaccagtcaagtag

SEQ ID NO: 177220 - DNA, 15 bp, Homo sapiens
attaccagtcaagta

SEQ ID NO: 177221 - DNA, 15 bp, Homo sapiens
gattaccagtcaagt

SEQ ID NO: 177222 - DNA, 15 bp, Homo sapiens
agattaccagtcaag

SEQ ID NO: 177223 - DNA, 15 bp, Homo sapiens
gagattaccagtcaa

SEQ ID NO: 177224 - DNA, 15 bp, Homo sapiens
tgagattaccagtca

SEQ ID NO: 177225 - DNA, 15 bp, Homo sapiens
ttgagattaccagtc

SEQ ID NO: 177226 - DNA, 15 bp, Homo sapiens
cttgagattaccagt

SEQ ID NO: 177227 - DNA, 15 bp, Homo sapiens
gcttgagattaccag

SEQ ID NO: 177228 - DNA, 15 bp, Homo sapiens
tgcttgagattacca

SEQ ID NO: 177229 - DNA, 15 bp, Homo sapiens
atgcttgagattacc

SEQ ID NO: 177230 - DNA, 15 bp, Homo sapiens
catgcttgagattac

SEQ ID NO: 177231 - DNA, 15 bp, Homo sapiens
tcatgcttgagatta

SEQ ID NO: 177232 - DNA, 15 bp, Homo sapiens
atcatgcttgagatt

SEQ ID NO: 177233 - DNA, 15 bp, Homo sapiens
aatcatgcttgagat

SEQ ID NO: 177234 - DNA, 15 bp, Homo sapiens
taatcatgcttgaga

SEQ ID NO: 177235 - DNA, 15 bp, Homo sapiens
ctaatcatgcttgag

SEQ ID NO: 177236 - DNA, 15 bp, Homo sapiens
actaatcatgcttga

SEQ ID NO: 177237 - DNA, 15 bp, Homo sapiens
tactaatcatgcttg

SEQ ID NO: 177238 - DNA, 15 bp, Homo sapiens
atactaatcatgctt

SEQ ID NO: 177239 - DNA, 15 bp, Homo sapiens
tatactaatcatgct

SEQ ID NO: 177240 - DNA, 15 bp, Homo sapiens
ctatactaatcatgc

SEQ ID NO: 177241 - DNA, 15 bp, Homo sapiens
actatactaatcatg

SEQ ID NO: 177242 - DNA, 15 bp, Homo sapiens
cactatactaatcat

SEQ ID NO: 177243 - DNA, 15 bp, Homo sapiens
acactatactaatca

SEQ ID NO: 177244 - DNA, 15 bp, Homo sapiens
aacactatactaatc

SEQ ID NO: 177245 - DNA, 15 bp, Homo sapiens
aaacactatactaat

SEQ ID NO: 177246 - DNA, 15 bp, Homo sapiens
gaaacactatactaa

SEQ ID NO: 177247 - DNA, 15 bp, Homo sapiens
ggaaacactatacta

SEQ ID NO: 177248 - DNA, 15 bp, Homo sapiens
aggaaacactatact

SEQ ID NO: 177249 - DNA, 15 bp, Homo sapiens
taggaaacactatac

SEQ ID NO: 177250 - DNA, 15 bp, Homo sapiens
ataggaaacactata

SEQ ID NO: 177251 - DNA, 15 bp, Homo sapiens
cataggaaacactat

SEQ ID NO: 177252 - DNA, 15 bp, Homo sapiens
tcataggaaacacta

SEQ ID NO: 177253 - DNA, 15 bp, Homo sapiens
ctcataggaaacact

SEQ ID NO: 177254 - DNA, 15 bp, Homo sapiens
gctcataggaaacac

SEQ ID NO: 177255 - DNA, 15 bp, Homo sapiens
agctcataggaaaca

SEQ ID NO: 177256 - DNA, 15 bp, Homo sapiens
tagctcataggaaac

SEQ ID NO: 177257 - DNA, 15 bp, Homo sapiens
ctagctcataggaaa

SEQ ID NO: 177258 - DNA, 15 bp, Homo sapiens
tctagctcataggaa

SEQ ID NO: 177259 - DNA, 15 bp, Homo sapiens
ttctagctcatagga

SEQ ID NO: 177260 - DNA, 15 bp, Homo sapiens
cttctagctcatagg

SEQ ID NO: 177261 - DNA, 15 bp, Homo sapiens
ccttctagctcatag

SEQ ID NO: 177262 - DNA, 15 bp, Homo sapiens
accttctagctcata

SEQ ID NO: 177263 - DNA, 15 bp, Homo sapiens
aaccttctagctcat

SEQ ID NO: 177264 - DNA, 15 bp, Homo sapiens
aaaccttctagctca

SEQ ID NO: 177265 - DNA, 15 bp, Homo sapiens
aaaaccttctagctc

SEQ ID NO: 177266 - DNA, 15 bp, Homo sapiens
aaaaaccttctagct

SEQ ID NO: 177267 - DNA, 15 bp, Homo sapiens
caaaaaccttctagc

SEQ ID NO: 177268 - DNA, 15 bp, Homo sapiens
ccaaaaaccttctag

SEQ ID NO: 177269 - DNA, 15 bp, Homo sapiens
tccaaaaaccttcta

SEQ ID NO: 177270 - DNA, 15 bp, Homo sapiens
atccaaaaaccttct

SEQ ID NO: 177271 - DNA, 15 bp, Homo sapiens
aatccaaaaaccttc

SEQ ID NO: 177272 - DNA, 15 bp, Homo sapiens
taatccaaaaacctt

SEQ ID NO: 177273 - DNA, 15 bp, Homo sapiens
ctaatccaaaaacct

SEQ ID NO: 177274 - DNA, 15 bp, Homo sapiens
tctaatccaaaaacc

SEQ ID NO: 177275 - DNA, 15 bp, Homo sapiens
atctaatccaaaaac

SEQ ID NO: 177276 - DNA, 15 bp, Homo sapiens
catctaatccaaaaa

SEQ ID NO: 177277 - DNA, 15 bp, Homo sapiens
acatctaatccaaaa

SEQ ID NO: 177278 - DNA, 15 bp, Homo sapiens
cacatctaatccaaa

SEQ ID NO: 177279 - DNA, 15 bp, Homo sapiens
gcacatctaatccaa

SEQ ID NO: 177280 - DNA, 15 bp, Homo sapiens
tgcacatctaatcca

SEQ ID NO: 177281 - DNA, 15 bp, Homo sapiens
ctgcacatctaatcc

SEQ ID NO: 177282 - DNA, 15 bp, Homo sapiens
cctgcacatctaatc

SEQ ID NO: 177283 - DNA, 15 bp, Homo sapiens
tcctgcacatctaat

SEQ ID NO: 177284 - DNA, 15 bp, Homo sapiens
ttcctgcacatctaa

SEQ ID NO: 177285 - DNA, 15 bp, Homo sapiens
attcctgcacatcta

SEQ ID NO: 177286 - DNA, 15 bp, Homo sapiens
tattcctgcacatct

SEQ ID NO: 177287 - DNA, 15 bp, Homo sapiens
ctattcctgcacatc

SEQ ID NO: 177288 - DNA, 15 bp, Homo sapiens
cctattcctgcacat

SEQ ID NO: 177289 - DNA, 15 bp, Homo sapiens
gcctattcctgcaca

SEQ ID NO: 177290 - DNA, 15 bp, Homo sapiens
tgcctattcctgcac

SEQ ID NO: 177291 - DNA, 15 bp, Homo sapiens
atgcctattcctgca

SEQ ID NO: 177292 - DNA, 15 bp, Homo sapiens
aatgcctattcctgc

SEQ ID NO: 177293 - DNA, 15 bp, Homo sapiens
gaatgcctattcctg

SEQ ID NO: 177294 - DNA, 15 bp, Homo sapiens
agaatgcctattcct

SEQ ID NO: 177295 - DNA, 15 bp, Homo sapiens
cagaatgcctattcc

SEQ ID NO: 177296 - DNA, 15 bp, Homo sapiens
gcagaatgcctattc

SEQ ID NO: 177297 - DNA, 15 bp, Homo sapiens
ggcagaatgcctatt

SEQ ID NO: 177298 - DNA, 15 bp, Homo sapiens
aggcagaatgcctat

SEQ ID NO: 177299 - DNA, 15 bp, Homo sapiens
caggcagaatgccta

SEQ ID NO: 177300 - DNA, 15 bp, Homo sapiens
gcaggcagaatgcct

SEQ ID NO: 177301 - DNA, 15 bp, Homo sapiens
agcaggcagaatgcc

SEQ ID NO: 177302 - DNA, 15 bp, Homo sapiens
aagcaggcagaatgc

SEQ ID NO: 177303 - DNA, 15 bp, Homo sapiens
aaagcaggcagaatg

SEQ ID NO: 177304 - DNA, 15 bp, Homo sapiens
aaaagcaggcagaat

SEQ ID NO: 177305 - DNA, 15 bp, Homo sapiens
taaaagcaggcagaa

SEQ ID NO: 177306 - DNA, 15 bp, Homo sapiens
ttaaaagcaggcaga

SEQ ID NO: 177307 - DNA, 15 bp, Homo sapiens
tttaaaagcaggcag

SEQ ID NO: 177308 - DNA, 15 bp, Homo sapiens
atttaaaagcaggca

SEQ ID NO: 177309 - DNA, 15 bp, Homo sapiens
catttaaaagcaggc

SEQ ID NO: 177310 - DNA, 15 bp, Homo sapiens
acatttaaaagcagg

SEQ ID NO: 177311 - DNA, 15 bp, Homo sapiens
gacatttaaaagcag

SEQ ID NO: 177312 - DNA, 15 bp, Homo sapiens
agacatttaaaagca

SEQ ID NO: 177313 - DNA, 15 bp, Homo sapiens
tagacatttaaaagc

SEQ ID NO: 177314 - DNA, 15 bp, Homo sapiens
ctagacatttaaaag

SEQ ID NO: 177315 - DNA, 15 bp, Homo sapiens
gctagacatttaaaa

SEQ ID NO: 177316 - DNA, 15 bp, Homo sapiens
agctagacatttaaa

SEQ ID NO: 177317 - DNA, 15 bp, Homo sapiens
cagctagacatttaa

SEQ ID NO: 177318 - DNA, 15 bp, Homo sapiens
gcagctagacattta

SEQ ID NO: 177319 - DNA, 15 bp, Homo sapiens
tgcagctagacattt

SEQ ID NO: 177320 - DNA, 15 bp, Homo sapiens
gtgcagctagacatt

SEQ ID NO: 177321 - DNA, 15 bp, Homo sapiens
tgtgcagctagacat

SEQ ID NO: 177322 - DNA, 15 bp, Homo sapiens
ctgtgcagctagaca

SEQ ID NO: 177323 - DNA, 15 bp, Homo sapiens
gctgtgcagctagac

SEQ ID NO: 177324 - DNA, 15 bp, Homo sapiens
agctgtgcagctaga

SEQ ID NO: 177325 - DNA, 15 bp, Homo sapiens
cagctgtgcagctag

SEQ ID NO: 177326 - DNA, 15 bp, Homo sapiens
tcagctgtgcagcta

SEQ ID NO: 177327 - DNA, 15 bp, Homo sapiens
ctcagctgtgcagct

SEQ ID NO: 177328 - DNA, 15 bp, Homo sapiens
gctcagctgtgcagc

SEQ ID NO: 177329 - DNA, 15 bp, Homo sapiens
tgctcagctgtgcag

SEQ ID NO: 177330 - DNA, 15 bp, Homo sapiens
ttgctcagctgtgca

SEQ ID NO: 177331 - DNA, 15 bp, Homo sapiens
tttgctcagctgtgc

SEQ ID NO: 177332 - DNA, 15 bp, Homo sapiens
ttttgctcagctgtg

SEQ ID NO: 177333 - DNA, 15 bp, Homo sapiens
tttttgctcagctgt

SEQ ID NO: 177334 - DNA, 15 bp, Homo sapiens
ttttttgctcagctg

SEQ ID NO: 177335 - DNA, 15 bp, Homo sapiens
cttttttgctcagct

SEQ ID NO: 177336 - DNA, 15 bp, Homo sapiens
gcttttttgctcagc

SEQ ID NO: 177337 - DNA, 15 bp, Homo sapiens
ggcttttttgctcag

SEQ ID NO: 177338 - DNA, 15 bp, Homo sapiens
gggcttttttgctca

SEQ ID NO: 177339 - DNA, 15 bp, Homo sapiens
tgggcttttttgctc

SEQ ID NO: 177340 - DNA, 15 bp, Homo sapiens
ttgggcttttttgct

SEQ ID NO: 177341 - DNA, 15 bp, Homo sapiens
gttgggcttttttgc

SEQ ID NO: 177342 - DNA, 15 bp, Homo sapiens
ggttgggcttttttg

SEQ ID NO: 177343 - DNA, 15 bp, Homo sapiens
aggttgggctttttt

SEQ ID NO: 177344 - DNA, 15 bp, Homo sapiens
caggttgggcttttt

SEQ ID NO: 177345 - DNA, 15 bp, Homo sapiens
ccaggttgggctttt

SEQ ID NO: 177346 - DNA, 15 bp, Homo sapiens
gccaggttgggcttt

SEQ ID NO: 177347 - DNA, 15 bp, Homo sapiens
tgccaggttgggctt

SEQ ID NO: 177348 - DNA, 15 bp, Homo sapiens
ctgccaggttgggct

SEQ ID NO: 177349 - DNA, 15 bp, Homo sapiens
actgccaggttgggc

SEQ ID NO: 177350 - DNA, 15 bp, Homo sapiens
gactgccaggttggg

SEQ ID NO: 177351 - DNA, 15 bp, Homo sapiens
tgactgccaggttgg

SEQ ID NO: 177352 - DNA, 15 bp, Homo sapiens
ctgactgccaggttg

SEQ ID NO: 177353 - DNA, 15 bp, Homo sapiens
tctgactgccaggtt

SEQ ID NO: 177354 - DNA, 15 bp, Homo sapiens
ttctgactgccaggt

SEQ ID NO: 177355 - DNA, 15 bp, Homo sapiens
gttctgactgccagg

SEQ ID NO: 177356 - DNA, 15 bp, Homo sapiens
tgttctgactgccag

SEQ ID NO: 177357 - DNA, 15 bp, Homo sapiens
ctgttctgactgcca

SEQ ID NO: 177358 - DNA, 15 bp, Homo sapiens
cctgttctgactgcc

SEQ ID NO: 177359 - DNA, 15 bp, Homo sapiens
gcctgttctgactgc

SEQ ID NO: 177360 - DNA, 15 bp, Homo sapiens
agcctgttctgactg

SEQ ID NO: 177361 - DNA, 15 bp, Homo sapiens
cagcctgttctgact

SEQ ID NO: 177362 - DNA, 15 bp, Homo sapiens
gcagcctgttctgac

SEQ ID NO: 177363 - DNA, 15 bp, Homo sapiens
ggcagcctgttctga

SEQ ID NO: 177364 - DNA, 15 bp, Homo sapiens
gggcagcctgttctg

SEQ ID NO: 177365 - DNA, 15 bp, Homo sapiens
tgggcagcctgttct

SEQ ID NO: 177366 - DNA, 15 bp, Homo sapiens
ctgggcagcctgttc

SEQ ID NO: 177367 - DNA, 15 bp, Homo sapiens
cctgggcagcctgtt

SEQ ID NO: 177368 - DNA, 15 bp, Homo sapiens
ccctgggcagcctgt

SEQ ID NO: 177369 - DNA, 15 bp, Homo sapiens
cccctgggcagcctg

SEQ ID NO: 177370 - DNA, 15 bp, Homo sapiens
tcccctgggcagcct

SEQ ID NO: 177371 - DNA, 15 bp, Homo sapiens
ttcccctgggcagcc

SEQ ID NO: 177372 - DNA, 15 bp, Homo sapiens
gttcccctgggcagc

SEQ ID NO: 177373 - DNA, 15 bp, Homo sapiens
agttcccctgggcag

SEQ ID NO: 177374 - DNA, 15 bp, Homo sapiens
gagttcccctgggca

SEQ ID NO: 177375 - DNA, 15 bp, Homo sapiens
ggagttcccctgggc

SEQ ID NO: 177376 - DNA, 15 bp, Homo sapiens
aggagttcccctggg

SEQ ID NO: 177377 - DNA, 15 bp, Homo sapiens
taggagttcccctgg

SEQ ID NO: 177378 - DNA, 15 bp, Homo sapiens
ataggagttcccctg

SEQ ID NO: 177379 - DNA, 15 bp, Homo sapiens
aataggagttcccct

SEQ ID NO: 177380 - DNA, 15 bp, Homo sapiens
caataggagttcccc

SEQ ID NO: 177381 - DNA, 15 bp, Homo sapiens
acaataggagttccc

SEQ ID NO: 177382 - DNA, 15 bp, Homo sapiens
aacaataggagttcc

SEQ ID NO: 177383 - DNA, 15 bp, Homo sapiens
gaacaataggagttc

SEQ ID NO: 177384 - DNA, 15 bp, Homo sapiens
tgaacaataggagtt

SEQ ID NO: 177385 - DNA, 15 bp, Homo sapiens
ctgaacaataggagt

SEQ ID NO: 177386 - DNA, 15 bp, Homo sapiens
gctgaacaataggag

SEQ ID NO: 177387 - DNA, 15 bp, Homo sapiens
ggctgaacaatagga

SEQ ID NO: 177388 - DNA, 15 bp, Homo sapiens
gggctgaacaatagg

SEQ ID NO: 177389 - DNA, 15 bp, Homo sapiens
ggggctgaacaatag

SEQ ID NO: 177390 - DNA, 15 bp, Homo sapiens
tggggctgaacaata

SEQ ID NO: 177391 - DNA, 15 bp, Homo sapiens
atggggctgaacaat

SEQ ID NO: 177392 - DNA, 15 bp, Homo sapiens
aatggggctgaacaa

SEQ ID NO: 177393 - DNA, 15 bp, Homo sapiens
gaatggggctgaaca

SEQ ID NO: 177394 - DNA, 15 bp, Homo sapiens
tgaatggggctgaac

SEQ ID NO: 177395 - DNA, 15 bp, Homo sapiens
ctgaatggggctgaa

SEQ ID NO: 177396 - DNA, 15 bp, Homo sapiens
cctgaatggggctga

SEQ ID NO: 177397 - DNA, 15 bp, Homo sapiens
gcctgaatggggctg

SEQ ID NO: 177398 - DNA, 15 bp, Homo sapiens
tgcctgaatggggct

SEQ ID NO: 177399 - DNA, 15 bp, Homo sapiens
ttgcctgaatggggc

SEQ ID NO: 177400 - DNA, 15 bp, Homo sapiens
tttgcctgaatgggg

SEQ ID NO: 177401 - DNA, 15 bp, Homo sapiens
gtttgcctgaatggg

SEQ ID NO: 177402 - DNA, 15 bp, Homo sapiens
agtttgcctgaatgg

SEQ ID NO: 177403 - DNA, 15 bp, Homo sapiens
tagtttgcctgaatg

SEQ ID NO: 177404 - DNA, 15 bp, Homo sapiens
atagtttgcctgaat

SEQ ID NO: 177405 - DNA, 15 bp, Homo sapiens
tatagtttgcctgaa

SEQ ID NO: 177406 - DNA, 15 bp, Homo sapiens
ttatagtttgcctga

SEQ ID NO: 177407 - DNA, 15 bp, Homo sapiens
cttatagtttgcctg

SEQ ID NO: 177408 - DNA, 15 bp, Homo sapiens
tcttatagtttgcct

SEQ ID NO: 177409 - DNA, 15 bp, Homo sapiens
atcttatagtttgcc

SEQ ID NO: 177410 - DNA, 15 bp, Homo sapiens
gatcttatagtttgc

SEQ ID NO: 177411 - DNA, 15 bp, Homo sapiens
tgatcttatagtttg

SEQ ID NO: 177412 - DNA, 15 bp, Homo sapiens
gtgatcttatagttt

SEQ ID NO: 177413 - DNA, 15 bp, Homo sapiens
cgtgatcttatagtt

SEQ ID NO: 177414 - DNA, 15 bp, Homo sapiens
gcgtgatcttatagt

SEQ ID NO: 177415 - DNA, 15 bp, Homo sapiens
tgcgtgatcttatag

SEQ ID NO: 177416 - DNA, 15 bp, Homo sapiens
atgcgtgatcttata

SEQ ID NO: 177417 - DNA, 15 bp, Homo sapiens
tatgcgtgatcttat

SEQ ID NO: 177418 - DNA, 15 bp, Homo sapiens
ctatgcgtgatctta

SEQ ID NO: 177419 - DNA, 15 bp, Homo sapiens
actatgcgtgatctt

SEQ ID NO: 177420 - DNA, 15 bp, Homo sapiens
cactatgcgtgatct

SEQ ID NO: 177421 - DNA, 15 bp, Homo sapiens
acactatgcgtgatc

SEQ ID NO: 177422 - DNA, 15 bp, Homo sapiens
gacactatgcgtgat

SEQ ID NO: 177423 - DNA, 15 bp, Homo sapiens
ggacactatgcgtga

SEQ ID NO: 177424 - DNA, 15 bp, Homo sapiens
cggacactatgcgtg

SEQ ID NO: 177425 - DNA, 15 bp, Homo sapiens
tcggacactatgcgt

SEQ ID NO: 177426 - DNA, 15 bp, Homo sapiens
ctcggacactatgcg

SEQ ID NO: 177427 - DNA, 15 bp, Homo sapiens
gctcggacactatgc

SEQ ID NO: 177428 - DNA, 15 bp, Homo sapiens
ggctcggacactatg

SEQ ID NO: 177429 - DNA, 15 bp, Homo sapiens
cggctcggacactat

SEQ ID NO: 177430 - DNA, 15 bp, Homo sapiens
ccggctcggacacta

SEQ ID NO: 177431 - DNA, 15 bp, Homo sapiens
accggctcggacact

SEQ ID NO: 177432 - DNA, 15 bp, Homo sapiens
caccggctcggacac

SEQ ID NO: 177433 - DNA, 15 bp, Homo sapiens
gcaccggctcggaca

SEQ ID NO: 177434 - DNA, 15 bp, Homo sapiens
agcaccggctcggac

SEQ ID NO: 177435 - DNA, 15 bp, Homo sapiens
cagcaccggctcgga

SEQ ID NO: 177436 - DNA, 15 bp, Homo sapiens
ccagcaccggctcgg

SEQ ID NO: 177437 - DNA, 15 bp, Homo sapiens
accagcaccggctcg

SEQ ID NO: 177438 - DNA, 15 bp, Homo sapiens
caccagcaccggctc

SEQ ID NO: 177439 - DNA, 15 bp, Homo sapiens
gcaccagcaccggct

SEQ ID NO: 177440 - DNA, 15 bp, Homo sapiens
ggcaccagcaccggc

SEQ ID NO: 177441 - DNA, 15 bp, Homo sapiens
aggcaccagcaccgg

SEQ ID NO: 177442 - DNA, 15 bp, Homo sapiens
taggcaccagcaccg

SEQ ID NO: 177443 - DNA, 15 bp, Homo sapiens
ctaggcaccagcacc

SEQ ID NO: 177444 - DNA, 15 bp, Homo sapiens
actaggcaccagcac

SEQ ID NO: 177445 - DNA, 15 bp, Homo sapiens
cactaggcaccagca

SEQ ID NO: 177446 - DNA, 15 bp, Homo sapiens
tcactaggcaccagc

SEQ ID NO: 177447 - DNA, 15 bp, Homo sapiens
ctcactaggcaccag

SEQ ID NO: 177448 - DNA, 15 bp, Homo sapiens
tctcactaggcacca

SEQ ID NO: 177449 - DNA, 15 bp, Homo sapiens
ttctcactaggcacc

SEQ ID NO: 177450 - DNA, 15 bp, Homo sapiens
gttctcactaggcac

SEQ ID NO: 177451 - DNA, 15 bp, Homo sapiens
tgttctcactaggca

SEQ ID NO: 177452 - DNA, 15 bp, Homo sapiens
atgttctcactaggc

SEQ ID NO: 177453 - DNA, 15 bp, Homo sapiens
catgttctcactagg

SEQ ID NO: 177454 - DNA, 15 bp, Homo sapiens
ccatgttctcactag

SEQ ID NO: 177455 - DNA, 15 bp, Homo sapiens
tccatgttctcacta

SEQ ID NO: 177456 - DNA, 15 bp, Homo sapiens
gtccatgttctcact

SEQ ID NO: 177457 - DNA, 15 bp, Homo sapiens
tgtccatgttctcac

SEQ ID NO: 177458 - DNA, 15 bp, Homo sapiens
ctgtccatgttctca

SEQ ID NO: 177459 - DNA, 15 bp, Homo sapiens
actgtccatgttctc

SEQ ID NO: 177460 - DNA, 15 bp, Homo sapiens
gactgtccatgttct

SEQ ID NO: 177461 - DNA, 15 bp, Homo sapiens
ggactgtccatgttc

SEQ ID NO: 177462 - DNA, 15 bp, Homo sapiens
tggactgtccatgtt

SEQ ID NO: 177463 - DNA, 15 bp, Homo sapiens
ctggactgtccatgt

SEQ ID NO: 177464 - DNA, 15 bp, Homo sapiens
cctggactgtccatg

SEQ ID NO: 177465 - DNA, 15 bp, Homo sapiens
gcctggactgtccat

SEQ ID NO: 177466 - DNA, 15 bp, Homo sapiens
tgcctggactgtcca

SEQ ID NO: 177467 - DNA, 15 bp, Homo sapiens
atgcctggactgtcc

SEQ ID NO: 177468 - DNA, 15 bp, Homo sapiens
catgcctggactgtc

SEQ ID NO: 177469 - DNA, 15 bp, Homo sapiens
ccatgcctggactgt

SEQ ID NO: 177470 - DNA, 15 bp, Homo sapiens
cccatgcctggactg

SEQ ID NO: 177471 - DNA, 15 bp, Homo sapiens
tcccatgcctggact

SEQ ID NO: 177472 - DNA, 15 bp, Homo sapiens
atcccatgcctggac

SEQ ID NO: 177473 - DNA, 15 bp, Homo sapiens
catcccatgcctgga

SEQ ID NO: 177474 - DNA, 15 bp, Homo sapiens
acatcccatgcctgg

SEQ ID NO: 177475 - DNA, 15 bp, Homo sapiens
cacatcccatgcctg

SEQ ID NO: 177476 - DNA, 15 bp, Homo sapiens
acacatcccatgcct

SEQ ID NO: 177477 - DNA, 15 bp, Homo sapiens
cacacatcccatgcc

SEQ ID NO: 177478 - DNA, 15 bp, Homo sapiens
ccacacatcccatgc

SEQ ID NO: 177479 - DNA, 15 bp, Homo sapiens
tccacacatcccatg

SEQ ID NO: 177480 - DNA, 15 bp, Homo sapiens
atccacacatcccat

SEQ ID NO: 177481 - DNA, 15 bp, Homo sapiens
tatccacacatccca

SEQ ID NO: 177482 - DNA, 15 bp, Homo sapiens
atatccacacatccc

SEQ ID NO: 177483 - DNA, 15 bp, Homo sapiens
catatccacacatcc

SEQ ID NO: 177484 - DNA, 15 bp, Homo sapiens
gcatatccacacatc

SEQ ID NO: 177485 - DNA, 15 bp, Homo sapiens
agcatatccacacat

SEQ ID NO: 177486 - DNA, 15 bp, Homo sapiens
cagcatatccacaca

SEQ ID NO: 177487 - DNA, 15 bp, Homo sapiens
gcagcatatccacac

SEQ ID NO: 177488 - DNA, 15 bp, Homo sapiens
ggcagcatatccaca

SEQ ID NO: 177489 - DNA, 15 bp, Homo sapiens
aggcagcatatccac

SEQ ID NO: 177490 - DNA, 15 bp, Homo sapiens
aaggcagcatatcca

SEQ ID NO: 177491 - DNA, 15 bp, Homo sapiens
gaaggcagcatatcc

SEQ ID NO: 177492 - DNA, 15 bp, Homo sapiens
cgaaggcagcatatc

SEQ ID NO: 177493 - DNA, 15 bp, Homo sapiens
gcgaaggcagcatat

SEQ ID NO: 177494 - DNA, 15 bp, Homo sapiens
tgcgaaggcagcata

SEQ ID NO: 177495 - DNA, 15 bp, Homo sapiens
ctgcgaaggcagcat

SEQ ID NO: 177496 - DNA, 15 bp, Homo sapiens
actgcgaaggcagca

SEQ ID NO: 177497 - DNA, 15 bp, Homo sapiens
cactgcgaaggcagc

SEQ ID NO: 177498 - DNA, 15 bp, Homo sapiens
tcactgcgaaggcag

SEQ ID NO: 177499 - DNA, 15 bp, Homo sapiens
atcactgcgaaggca

SEQ ID NO: 177500 - DNA, 15 bp, Homo sapiens
gatcactgcgaaggc

SEQ ID NO: 177501 - DNA, 15 bp, Homo sapiens
tgatcactgcgaagg

SEQ ID NO: 177502 - DNA, 15 bp, Homo sapiens
ttgatcactgcgaag

SEQ ID NO: 177503 - DNA, 15 bp, Homo sapiens
cttgatcactgcgaa

SEQ ID NO: 177504 - DNA, 15 bp, Homo sapiens
tcttgatcactgcga

SEQ ID NO: 177505 - DNA, 15 bp, Homo sapiens
ttcttgatcactgcg

SEQ ID NO: 177506 - DNA, 15 bp, Homo sapiens
attcttgatcactgc

SEQ ID NO: 177507 - DNA, 15 bp, Homo sapiens
aattcttgatcactg

SEQ ID NO: 177508 - DNA, 15 bp, Homo sapiens
gaattcttgatcact

SEQ ID NO: 177509 - DNA, 15 bp, Homo sapiens
tgaattcttgatcac

SEQ ID NO: 177510 - DNA, 15 bp, Homo sapiens
ctgaattcttgatca

SEQ ID NO: 177511 - DNA, 15 bp, Homo sapiens
cctgaattcttgatc

SEQ ID NO: 177512 - DNA, 15 bp, Homo sapiens
tcctgaattcttgat

SEQ ID NO: 177513 - DNA, 15 bp, Homo sapiens
atcctgaattcttga

SEQ ID NO: 177514 - DNA, 15 bp, Homo sapiens
aatcctgaattcttg

SEQ ID NO: 177515 - DNA, 15 bp, Homo sapiens
aaatcctgaattctt

SEQ ID NO: 177516 - DNA, 15 bp, Homo sapiens
aaaatcctgaattct

SEQ ID NO: 177517 - DNA, 15 bp, Homo sapiens
taaaatcctgaattc

SEQ ID NO: 177518 - DNA, 15 bp, Homo sapiens
ctaaaatcctgaatt

SEQ ID NO: 177519 - DNA, 15 bp, Homo sapiens
tctaaaatcctgaat

SEQ ID NO: 177520 - DNA, 15 bp, Homo sapiens
ctctaaaatcctgaa

SEQ ID NO: 177521 - DNA, 15 bp, Homo sapiens
gctctaaaatcctga

SEQ ID NO: 177522 - DNA, 15 bp, Homo sapiens
ggctctaaaatcctg

SEQ ID NO: 177523 - DNA, 15 bp, Homo sapiens
gggctctaaaatcct

SEQ ID NO: 177524 - DNA, 15 bp, Homo sapiens
tgggctctaaaatcc

SEQ ID NO: 177525 - DNA, 15 bp, Homo sapiens
ctgggctctaaaatc

SEQ ID NO: 177526 - DNA, 15 bp, Homo sapiens
actgggctctaaaat

SEQ ID NO: 177527 - DNA, 15 bp, Homo sapiens
tactgggctctaaaa

SEQ ID NO: 177528 - DNA, 15 bp, Homo sapiens
ttactgggctctaaa

SEQ ID NO: 177529 - DNA, 15 bp, Homo sapiens
tttactgggctctaa

SEQ ID NO: 177530 - DNA, 15 bp, Homo sapiens
atttactgggctcta

SEQ ID NO: 177531 - DNA, 15 bp, Homo sapiens
tatttactgggctct

SEQ ID NO: 177532 - DNA, 15 bp, Homo sapiens
ctatttactgggctc

SEQ ID NO: 177533 - DNA, 15 bp, Homo sapiens
gctatttactgggct

SEQ ID NO: 177534 - DNA, 15 bp, Homo sapiens
agctatttactgggc

SEQ ID NO: 177535 - DNA, 15 bp, Homo sapiens
gagctatttactggg

SEQ ID NO: 177536 - DNA, 15 bp, Homo sapiens
tgagctatttactgg

SEQ ID NO: 177537 - DNA, 15 bp, Homo sapiens
atgagctatttactg

SEQ ID NO: 177538 - DNA, 15 bp, Homo sapiens
catgagctatttact

SEQ ID NO: 177539 - DNA, 15 bp, Homo sapiens
tcatgagctatttac

SEQ ID NO: 177540 - DNA, 15 bp, Homo sapiens
ctcatgagctattta

SEQ ID NO: 177541 - DNA, 15 bp, Homo sapiens
tctcatgagctattt

SEQ ID NO: 177542 - DNA, 15 bp, Homo sapiens
ttctcatgagctatt

SEQ ID NO: 177543 - DNA, 15 bp, Homo sapiens
gttctcatgagctat

SEQ ID NO: 177544 - DNA, 15 bp, Homo sapiens
agttctcatgagcta

SEQ ID NO: 177545 - DNA, 15 bp, Homo sapiens
aagttctcatgagct

SEQ ID NO: 177546 - DNA, 15 bp, Homo sapiens
caagttctcatgagc

SEQ ID NO: 177547 - DNA, 15 bp, Homo sapiens
ccaagttctcatgag

SEQ ID NO: 177548 - DNA, 15 bp, Homo sapiens
cccaagttctcatga

SEQ ID NO: 177549 - DNA, 15 bp, Homo sapiens
acccaagttctcatg

SEQ ID NO: 177550 - DNA, 15 bp, Homo sapiens
aacccaagttctcat

SEQ ID NO: 177551 - DNA, 15 bp, Homo sapiens
aaacccaagttctca

SEQ ID NO: 177552 - DNA, 15 bp, Homo sapiens
taaacccaagttctc

SEQ ID NO: 177553 - DNA, 15 bp, Homo sapiens
ctaaacccaagttct

SEQ ID NO: 177554 - DNA, 15 bp, Homo sapiens
tctaaacccaagttc

SEQ ID NO: 177555 - DNA, 15 bp, Homo sapiens
ttctaaacccaagtt

SEQ ID NO: 177556 - DNA, 15 bp, Homo sapiens
tttctaaacccaagt

SEQ ID NO: 177557 - DNA, 15 bp, Homo sapiens
ttttctaaacccaag

SEQ ID NO: 177558 - DNA, 15 bp, Homo sapiens
attttctaaacccaa

SEQ ID NO: 177559 - DNA, 15 bp, Homo sapiens
gattttctaaaccca

SEQ ID NO: 177560 - DNA, 15 bp, Homo sapiens
agattttctaaaccc

SEQ ID NO: 177561 - DNA, 15 bp, Homo sapiens
cagattttctaaacc

SEQ ID NO: 177562 - DNA, 15 bp, Homo sapiens
tcagattttctaaac

SEQ ID NO: 177563 - DNA, 15 bp, Homo sapiens
ttcagattttctaaa

SEQ ID NO: 177564 - DNA, 15 bp, Homo sapiens
gttcagattttctaa

SEQ ID NO: 177565 - DNA, 15 bp, Homo sapiens
agttcagattttcta

SEQ ID NO: 177566 - DNA, 15 bp, Homo sapiens
cagttcagattttct

SEQ ID NO: 177567 - DNA, 15 bp, Homo sapiens
gcagttcagattttc

SEQ ID NO: 177568 - DNA, 15 bp, Homo sapiens
agcagttcagatttt

SEQ ID NO: 177569 - DNA, 15 bp, Homo sapiens
cagcagttcagattt

SEQ ID NO: 177570 - DNA, 15 bp, Homo sapiens
ccagcagttcagatt

SEQ ID NO: 177571 - DNA, 15 bp, Homo sapiens
cccagcagttcagat

SEQ ID NO: 177572 - DNA, 15 bp, Homo sapiens
gcccagcagttcaga

SEQ ID NO: 177573 - DNA, 15 bp, Homo sapiens
ggcccagcagttcag

SEQ ID NO: 177574 - DNA, 15 bp, Homo sapiens
tggcccagcagttca

SEQ ID NO: 177575 - DNA, 15 bp, Homo sapiens
gtggcccagcagttc

SEQ ID NO: 177576 - DNA, 15 bp, Homo sapiens
ggtggcccagcagtt

SEQ ID NO: 177577 - DNA, 15 bp, Homo sapiens
gggtggcccagcagt

SEQ ID NO: 177578 - DNA, 15 bp, Homo sapiens
agggtggcccagcag

SEQ ID NO: 177579 - DNA, 15 bp, Homo sapiens
cagggtggcccagca

SEQ ID NO: 177580 - DNA, 15 bp, Homo sapiens
tcagggtggcccagc

SEQ ID NO: 177581 - DNA, 15 bp, Homo sapiens
ttcagggtggcccag

SEQ ID NO: 177582 - DNA, 15 bp, Homo sapiens
cttcagggtggccca

SEQ ID NO: 177583 - DNA, 15 bp, Homo sapiens
acttcagggtggccc

SEQ ID NO: 177584 - DNA, 15 bp, Homo sapiens
tacttcagggtggcc

SEQ ID NO: 177585 - DNA, 15 bp, Homo sapiens
atacttcagggtggc

SEQ ID NO: 177586 - DNA, 15 bp, Homo sapiens
gatacttcagggtgg

SEQ ID NO: 177587 - DNA, 15 bp, Homo sapiens
agatacttcagggtg

SEQ ID NO: 177588 - DNA, 15 bp, Homo sapiens
aagatacttcagggt

SEQ ID NO: 177589 - DNA, 15 bp, Homo sapiens
caagatacttcaggg

SEQ ID NO: 177590 - DNA, 15 bp, Homo sapiens
tcaagatacttcagg

SEQ ID NO: 177591 - DNA, 15 bp, Homo sapiens
ttcaagatacttcag

SEQ ID NO: 177592 - DNA, 15 bp, Homo sapiens
attcaagatacttca

SEQ ID NO: 177593 - DNA, 15 bp, Homo sapiens
aattcaagatacttc

SEQ ID NO: 177594 - DNA, 15 bp, Homo sapiens
caattcaagatactt

SEQ ID NO: 177595 - DNA, 15 bp, Homo sapiens
tcaattcaagatact

SEQ ID NO: 177596 - DNA, 15 bp, Homo sapiens
ctcaattcaagatac

SEQ ID NO: 177597 - DNA, 15 bp, Homo sapiens
cctcaattcaagata

SEQ ID NO: 177598 - DNA, 15 bp, Homo sapiens
tcctcaattcaagat

SEQ ID NO: 177599 - DNA, 15 bp, Homo sapiens
ctcctcaattcaaga

SEQ ID NO: 177600 - DNA, 15 bp, Homo sapiens
gctcctcaattcaag

SEQ ID NO: 177601 - DNA, 15 bp, Homo sapiens
agctcctcaattcaa

SEQ ID NO: 177602 - DNA, 15 bp, Homo sapiens
aagctcctcaattca

SEQ ID NO: 177603 - DNA, 15 bp, Homo sapiens
caagctcctcaattc

SEQ ID NO: 177604 - DNA, 15 bp, Homo sapiens
ccaagctcctcaatt

SEQ ID NO: 177605 - DNA, 15 bp, Homo sapiens
cccaagctcctcaat

SEQ ID NO: 177606 - DNA, 15 bp, Homo sapiens
acccaagctcctcaa

SEQ ID NO: 177607 - DNA, 15 bp, Homo sapiens
cacccaagctcctca

SEQ ID NO: 177608 - DNA, 15 bp, Homo sapiens
tcacccaagctcctc

SEQ ID NO: 177609 - DNA, 15 bp, Homo sapiens
ttcacccaagctcct

SEQ ID NO: 177610 - DNA, 15 bp, Homo sapiens
cttcacccaagctcc

SEQ ID NO: 177611 - DNA, 15 bp, Homo sapiens
tcttcacccaagctc

SEQ ID NO: 177612 - DNA, 15 bp, Homo sapiens
ttcttcacccaagct

SEQ ID NO: 177613 - DNA, 15 bp, Homo sapiens
cttcttcacccaagc

SEQ ID NO: 177614 - DNA, 15 bp, Homo sapiens
acttcttcacccaag

SEQ ID NO: 177615 - DNA, 15 bp, Homo sapiens
gacttcttcacccaa

SEQ ID NO: 177616 - DNA, 15 bp, Homo sapiens
ggacttcttcaccca

SEQ ID NO: 177617 - DNA, 15 bp, Homo sapiens
aggacttcttcaccc

SEQ ID NO: 177618 - DNA, 15 bp, Homo sapiens
caggacttcttcacc

SEQ ID NO: 177619 - DNA, 15 bp, Homo sapiens
ccaggacttcttcac

SEQ ID NO: 177620 - DNA, 15 bp, Homo sapiens
accaggacttcttca

SEQ ID NO: 177621 - DNA, 15 bp, Homo sapiens
taccaggacttcttc

SEQ ID NO: 177622 - DNA, 15 bp, Homo sapiens
ataccaggacttctt

SEQ ID NO: 177623 - DNA, 15 bp, Homo sapiens
gataccaggacttct

SEQ ID NO: 177624 - DNA, 15 bp, Homo sapiens
tgataccaggacttc

SEQ ID NO: 177625 - DNA, 15 bp, Homo sapiens
ctgataccaggactt

SEQ ID NO: 177626 - DNA, 15 bp, Homo sapiens
actgataccaggact

SEQ ID NO: 177627 - DNA, 15 bp, Homo sapiens
aactgataccaggac

SEQ ID NO: 177628 - DNA, 15 bp, Homo sapiens
caactgataccagga

SEQ ID NO: 177629 - DNA, 15 bp, Homo sapiens
ccaactgataccagg

SEQ ID NO: 177630 - DNA, 15 bp, Homo sapiens
cccaactgataccag

SEQ ID NO: 177631 - DNA, 15 bp, Homo sapiens
ccccaactgatacca

SEQ ID NO: 177632 - DNA, 15 bp, Homo sapiens
cccccaactgatacc

SEQ ID NO: 177633 - DNA, 15 bp, Homo sapiens
gcccccaactgatac

SEQ ID NO: 177634 - DNA, 15 bp, Homo sapiens
ggcccccaactgata

SEQ ID NO: 177635 - DNA, 15 bp, Homo sapiens
gggcccccaactgat

SEQ ID NO: 177636 - DNA, 15 bp, Homo sapiens
agggcccccaactga

SEQ ID NO: 177637 - DNA, 15 bp, Homo sapiens
aagggcccccaactg

SEQ ID NO: 177638 - DNA, 15 bp, Homo sapiens
gaagggcccccaact

SEQ ID NO: 177639 - DNA, 15 bp, Homo sapiens
tgaagggcccccaac

SEQ ID NO: 177640 - DNA, 15 bp, Homo sapiens
ctgaagggcccccaa

SEQ ID NO: 177641 - DNA, 15 bp, Homo sapiens
tctgaagggccccca

SEQ ID NO: 177642 - DNA, 15 bp, Homo sapiens
atctgaagggccccc

SEQ ID NO: 177643 - DNA, 15 bp, Homo sapiens
catctgaagggcccc

SEQ ID NO: 177644 - DNA, 15 bp, Homo sapiens
tcatctgaagggccc

SEQ ID NO: 177645 - DNA, 15 bp, Homo sapiens
ctcatctgaagggcc

SEQ ID NO: 177646 - DNA, 15 bp, Homo sapiens
gctcatctgaagggc

SEQ ID NO: 177647 - DNA, 15 bp, Homo sapiens
agctcatctgaaggg

SEQ ID NO: 177648 - DNA, 15 bp, Homo sapiens
cagctcatctgaagg

SEQ ID NO: 177649 - DNA, 15 bp, Homo sapiens
gcagctcatctgaag

SEQ ID NO: 177650 - DNA, 15 bp, Homo sapiens
ggcagctcatctgaa

SEQ ID NO: 177651 - DNA, 15 bp, Homo sapiens
tggcagctcatctga

SEQ ID NO: 177652 - DNA, 15 bp, Homo sapiens
gtggcagctcatctg

SEQ ID NO: 177653 - DNA, 15 bp, Homo sapiens
ggtggcagctcatct

SEQ ID NO: 177654 - DNA, 15 bp, Homo sapiens
aggtggcagctcatc

SEQ ID NO: 177655 - DNA, 15 bp, Homo sapiens
aaggtggcagctcat

SEQ ID NO: 177656 - DNA, 15 bp, Homo sapiens
caaggtggcagctca

SEQ ID NO: 177657 - DNA, 15 bp, Homo sapiens
acaaggtggcagctc

SEQ ID NO: 177658 - DNA, 15 bp, Homo sapiens
cacaaggtggcagct

SEQ ID NO: 177659 - DNA, 15 bp, Homo sapiens
tcacaaggtggcagc

SEQ ID NO: 177660 - DNA, 15 bp, Homo sapiens
gtcacaaggtggcag

SEQ ID NO: 177661 - DNA, 15 bp, Homo sapiens
agtcacaaggtggca

SEQ ID NO: 177662 - DNA, 15 bp, Homo sapiens
cagtcacaaggtggc

SEQ ID NO: 177663 - DNA, 15 bp, Homo sapiens
acagtcacaaggtgg

SEQ ID NO: 177664 - DNA, 15 bp, Homo sapiens
gacagtcacaaggtg

SEQ ID NO: 177665 - DNA, 15 bp, Homo sapiens
ggacagtcacaaggt

SEQ ID NO: 177666 - DNA, 15 bp, Homo sapiens
cggacagtcacaagg

SEQ ID NO: 177667 - DNA, 15 bp, Homo sapiens
acggacagtcacaag

SEQ ID NO: 177668 - DNA, 15 bp, Homo sapiens
gacggacagtcacaa

SEQ ID NO: 177669 - DNA, 15 bp, Homo sapiens
tgacggacagtcaca

SEQ ID NO: 177670 - DNA, 15 bp, Homo sapiens
ctgacggacagtcac

SEQ ID NO: 177671 - DNA, 15 bp, Homo sapiens
cctgacggacagtca

SEQ ID NO: 177672 - DNA, 15 bp, Homo sapiens
ccctgacggacagtc

SEQ ID NO: 177673 - DNA, 15 bp, Homo sapiens
accctgacggacagt

SEQ ID NO: 177674 - DNA, 15 bp, Homo sapiens
gaccctgacggacag

SEQ ID NO: 177675 - DNA, 15 bp, Homo sapiens
tgaccctgacggaca

SEQ ID NO: 177676 - DNA, 15 bp, Homo sapiens
atgaccctgacggac

SEQ ID NO: 177677 - DNA, 15 bp, Homo sapiens
gatgaccctgacgga

SEQ ID NO: 177678 - DNA, 15 bp, Homo sapiens
agatgaccctgacgg

SEQ ID NO: 177679 - DNA, 15 bp, Homo sapiens
aagatgaccctgacg

SEQ ID NO: 177680 - DNA, 15 bp, Homo sapiens
aaagatgaccctgac

SEQ ID NO: 177681 - DNA, 15 bp, Homo sapiens
aaaagatgaccctga

SEQ ID NO: 177682 - DNA, 15 bp, Homo sapiens
caaaagatgaccctg

SEQ ID NO: 177683 - DNA, 15 bp, Homo sapiens
ccaaaagatgaccct

SEQ ID NO: 177684 - DNA, 15 bp, Homo sapiens
gccaaaagatgaccc

SEQ ID NO: 177685 - DNA, 15 bp, Homo sapiens
ggccaaaagatgacc

SEQ ID NO: 177686 - DNA, 15 bp, Homo sapiens
tggccaaaagatgac

SEQ ID NO: 177687 - DNA, 15 bp, Homo sapiens
atggccaaaagatga

SEQ ID NO: 177688 - DNA, 15 bp, Homo sapiens
gatggccaaaagatg

SEQ ID NO: 177689 - DNA, 15 bp, Homo sapiens
ggatggccaaaagat

SEQ ID NO: 177690 - DNA, 15 bp, Homo sapiens
gggatggccaaaaga

SEQ ID NO: 177691 - DNA, 15 bp, Homo sapiens
agggatggccaaaag

SEQ ID NO: 177692 - DNA, 15 bp, Homo sapiens
cagggatggccaaaa

SEQ ID NO: 177693 - DNA, 15 bp, Homo sapiens
ccagggatggccaaa

SEQ ID NO: 177694 - DNA, 15 bp, Homo sapiens
accagggatggccaa

SEQ ID NO: 177695 - DNA, 15 bp, Homo sapiens
aaccagggatggcca

SEQ ID NO: 177696 - DNA, 15 bp, Homo sapiens
taaccagggatggcc

SEQ ID NO: 177697 - DNA, 15 bp, Homo sapiens
ctaaccagggatggc

SEQ ID NO: 177698 - DNA, 15 bp, Homo sapiens
gctaaccagggatgg

SEQ ID NO: 177699 - DNA, 15 bp, Homo sapiens
cgctaaccagggatg

SEQ ID NO: 177700 - DNA, 15 bp, Homo sapiens
acgctaaccagggat

SEQ ID NO: 177701 - DNA, 15 bp, Homo sapiens
aacgctaaccaggga

SEQ ID NO: 177702 - DNA, 15 bp, Homo sapiens
caacgctaaccaggg

SEQ ID NO: 177703 - DNA, 15 bp, Homo sapiens
gcaacgctaaccagg

SEQ ID NO: 177704 - DNA, 15 bp, Homo sapiens
ggcaacgctaaccag

SEQ ID NO: 177705 - DNA, 15 bp, Homo sapiens
tggcaacgctaacca

SEQ ID NO: 177706 - DNA, 15 bp, Homo sapiens
atggcaacgctaacc

SEQ ID NO: 177707 - DNA, 15 bp, Homo sapiens
catggcaacgctaac

SEQ ID NO: 177708 - DNA, 15 bp, Homo sapiens
acatggcaacgctaa

SEQ ID NO: 177709 - DNA, 15 bp, Homo sapiens
cacatggcaacgcta

SEQ ID NO: 177710 - DNA, 15 bp, Homo sapiens
ccacatggcaacgct

SEQ ID NO: 177711 - DNA, 15 bp, Homo sapiens
cccacatggcaacgc

SEQ ID NO: 177712 - DNA, 15 bp, Homo sapiens
acccacatggcaacg

SEQ ID NO: 177713 - DNA, 15 bp, Homo sapiens
cacccacatggcaac

SEQ ID NO: 177714 - DNA, 15 bp, Homo sapiens
tcacccacatggcaa

SEQ ID NO: 177715 - DNA, 15 bp, Homo sapiens
gtcacccacatggca

SEQ ID NO: 177716 - DNA, 15 bp, Homo sapiens
tgtcacccacatggc

SEQ ID NO: 177717 - DNA, 15 bp, Homo sapiens
ttgtcacccacatgg

SEQ ID NO: 177718 - DNA, 15 bp, Homo sapiens
gttgtcacccacatg

SEQ ID NO: 177719 - DNA, 15 bp, Homo sapiens
agttgtcacccacat

SEQ ID NO: 177720 - DNA, 15 bp, Homo sapiens
tagttgtcacccaca

SEQ ID NO: 177721 - DNA, 15 bp, Homo sapiens
ctagttgtcacccac

SEQ ID NO: 177722 - DNA, 15 bp, Homo sapiens
cctagttgtcaccca

SEQ ID NO: 177723 - DNA, 15 bp, Homo sapiens
tcctagttgtcaccc

SEQ ID NO: 177724 - DNA, 15 bp, Homo sapiens
ctcctagttgtcacc

SEQ ID NO: 177725 - DNA, 15 bp, Homo sapiens
tctcctagttgtcac

SEQ ID NO: 177726 - DNA, 15 bp, Homo sapiens
gtctcctagttgtca

SEQ ID NO: 177727 - DNA, 15 bp, Homo sapiens
agtctcctagttgtc

SEQ ID NO: 177728 - DNA, 15 bp, Homo sapiens
aagtctcctagttgt

SEQ ID NO: 177729 - DNA, 15 bp, Homo sapiens
aaagtctcctagttg

SEQ ID NO: 177730 - DNA, 15 bp, Homo sapiens
taaagtctcctagtt

SEQ ID NO: 177731 - DNA, 15 bp, Homo sapiens
gtaaagtctcctagt

SEQ ID NO: 177732 - DNA, 15 bp, Homo sapiens
agtaaagtctcctag

SEQ ID NO: 177733 - DNA, 15 bp, Homo sapiens
aagtaaagtctccta

SEQ ID NO: 177734 - DNA, 15 bp, Homo sapiens
caagtaaagtctcct

SEQ ID NO: 177735 - DNA, 15 bp, Homo sapiens
tcaagtaaagtctcc

SEQ ID NO: 177736 - DNA, 15 bp, Homo sapiens
ttcaagtaaagtctc

SEQ ID NO: 177737 - DNA, 15 bp, Homo sapiens
attcaagtaaagtct

SEQ ID NO: 177738 - DNA, 15 bp, Homo sapiens
cattcaagtaaagtc

SEQ ID NO: 177739 - DNA, 15 bp, Homo sapiens
acattcaagtaaagt

SEQ ID NO: 177740 - DNA, 15 bp, Homo sapiens
aacattcaagtaaag

SEQ ID NO: 177741 - DNA, 15 bp, Homo sapiens
gaacattcaagtaaa

SEQ ID NO: 177742 - DNA, 15 bp, Homo sapiens
ggaacattcaagtaa

SEQ ID NO: 177743 - DNA, 15 bp, Homo sapiens
gggaacattcaagta

SEQ ID NO: 177744 - DNA, 15 bp, Homo sapiens
tgggaacattcaagt

SEQ ID NO: 177745 - DNA, 15 bp, Homo sapiens
gtgggaacattcaag

SEQ ID NO: 177746 - DNA, 15 bp, Homo sapiens
tgtgggaacattcaa

SEQ ID NO: 177747 - DNA, 15 bp, Homo sapiens
ctgtgggaacattca

SEQ ID NO: 177748 - DNA, 15 bp, Homo sapiens
tctgtgggaacattc

SEQ ID NO: 177749 - DNA, 15 bp, Homo sapiens
atctgtgggaacatt

SEQ ID NO: 177750 - DNA, 15 bp, Homo sapiens
catctgtgggaacat

SEQ ID NO: 177751 - DNA, 15 bp, Homo sapiens
gcatctgtgggaaca

SEQ ID NO: 177752 - DNA, 15 bp, Homo sapiens
tgcatctgtgggaac

SEQ ID NO: 177753 - DNA, 15 bp, Homo sapiens
atgcatctgtgggaa

SEQ ID NO: 177754 - DNA, 15 bp, Homo sapiens
catgcatctgtggga

SEQ ID NO: 177755 - DNA, 15 bp, Homo sapiens
ccatgcatctgtggg

SEQ ID NO: 177756 - DNA, 15 bp, Homo sapiens
gccatgcatctgtgg

SEQ ID NO: 177757 - DNA, 15 bp, Homo sapiens
agccatgcatctgtg

SEQ ID NO: 177758 - DNA, 15 bp, Homo sapiens
cagccatgcatctgt

SEQ ID NO: 177759 - DNA, 15 bp, Homo sapiens
ccagccatgcatctg

SEQ ID NO: 177760 - DNA, 15 bp, Homo sapiens
cccagccatgcatct

SEQ ID NO: 177761 - DNA, 15 bp, Homo sapiens
tcccagccatgcatc

SEQ ID NO: 177762 - DNA, 15 bp, Homo sapiens
atcccagccatgcat

SEQ ID NO: 177763 - DNA, 15 bp, Homo sapiens
catcccagccatgca

SEQ ID NO: 177764 - DNA, 15 bp, Homo sapiens
ccatcccagccatgc

SEQ ID NO: 177765 - DNA, 15 bp, Homo sapiens
gccatcccagccatg

SEQ ID NO: 177766 - DNA, 15 bp, Homo sapiens
cgccatcccagccat

SEQ ID NO: 177767 - DNA, 15 bp, Homo sapiens
acgccatcccagcca

SEQ ID NO: 177768 - DNA, 15 bp, Homo sapiens
tacgccatcccagcc

SEQ ID NO: 177769 - DNA, 15 bp, Homo sapiens
ttacgccatcccagc

SEQ ID NO: 177770 - DNA, 15 bp, Homo sapiens
cttacgccatcccag

SEQ ID NO: 177771 - DNA, 15 bp, Homo sapiens
acttacgccatccca

SEQ ID NO: 177772 - DNA, 15 bp, Homo sapiens
aacttacgccatccc

SEQ ID NO: 177773 - DNA, 15 bp, Homo sapiens
gaacttacgccatcc

SEQ ID NO: 177774 - DNA, 15 bp, Homo sapiens
agaacttacgccatc

SEQ ID NO: 177775 - DNA, 15 bp, Homo sapiens
aagaacttacgccat

SEQ ID NO: 177776 - DNA, 15 bp, Homo sapiens
aaagaacttacgcca

SEQ ID NO: 177777 - DNA, 15 bp, Homo sapiens
aaaagaacttacgcc

SEQ ID NO: 177778 - DNA, 15 bp, Homo sapiens
gaaaagaacttacgc

SEQ ID NO: 177779 - DNA, 15 bp, Homo sapiens
agaaaagaacttacg

SEQ ID NO: 177780 - DNA, 15 bp, Homo sapiens
cagaaaagaacttac

SEQ ID NO: 177781 - DNA, 15 bp, Homo sapiens
acagaaaagaactta

SEQ ID NO: 177782 - DNA, 15 bp, Homo sapiens
aacagaaaagaactt

SEQ ID NO: 177783 - DNA, 15 bp, Homo sapiens
aaacagaaaagaact

SEQ ID NO: 177784 - DNA, 15 bp, Homo sapiens
gaaacagaaaagaac

SEQ ID NO: 177785 - DNA, 15 bp, Homo sapiens
agaaacagaaaagaa

SEQ ID NO: 177786 - DNA, 15 bp, Homo sapiens
cagaaacagaaaaga

SEQ ID NO: 177787 - DNA, 15 bp, Homo sapiens
ccagaaacagaaaag

SEQ ID NO: 177788 - DNA, 15 bp, Homo sapiens
gccagaaacagaaaa

SEQ ID NO: 177789 - DNA, 15 bp, Homo sapiens
tgccagaaacagaaa

SEQ ID NO: 177790 - DNA, 15 bp, Homo sapiens
ctgccagaaacagaa

SEQ ID NO: 177791 - DNA, 15 bp, Homo sapiens
gctgccagaaacaga

SEQ ID NO: 177792 - DNA, 15 bp, Homo sapiens
tgctgccagaaacag

SEQ ID NO: 177793 - DNA, 15 bp, Homo sapiens
ttgctgccagaaaca

SEQ ID NO: 177794 - DNA, 15 bp, Homo sapiens
attgctgccagaaac

SEQ ID NO: 177795 - DNA, 15 bp, Homo sapiens
cattgctgccagaaa

SEQ ID NO: 177796 - DNA, 15 bp, Homo sapiens
ccattgctgccagaa

SEQ ID NO: 177797 - DNA, 15 bp, Homo sapiens
gccattgctgccaga

SEQ ID NO: 177798 - DNA, 15 bp, Homo sapiens
agccattgctgccag

SEQ ID NO: 177799 - DNA, 15 bp, Homo sapiens
gagccattgctgcca

SEQ ID NO: 177800 - DNA, 15 bp, Homo sapiens
tgagccattgctgcc

SEQ ID NO: 177801 - DNA, 15 bp, Homo sapiens
ctgagccattgctgc

SEQ ID NO: 177802 - DNA, 15 bp, Homo sapiens
cctgagccattgctg

SEQ ID NO: 177803 - DNA, 15 bp, Homo sapiens
tcctgagccattgct

SEQ ID NO: 177804 - DNA, 15 bp, Homo sapiens
atcctgagccattgc

SEQ ID NO: 177805 - DNA, 15 bp, Homo sapiens
aatcctgagccattg

SEQ ID NO: 177806 - DNA, 15 bp, Homo sapiens
taatcctgagccatt

SEQ ID NO: 177807 - DNA, 15 bp, Homo sapiens
ctaatcctgagccat

SEQ ID NO: 177808 - DNA, 15 bp, Homo sapiens
cctaatcctgagcca

SEQ ID NO: 177809 - DNA, 15 bp, Homo sapiens
ccctaatcctgagcc

SEQ ID NO: 177810 - DNA, 15 bp, Homo sapiens
accctaatcctgagc

SEQ ID NO: 177811 - DNA, 15 bp, Homo sapiens
aaccctaatcctgag

SEQ ID NO: 177812 - DNA, 15 bp, Homo sapiens
aaaccctaatcctga

SEQ ID NO: 177813 - DNA, 15 bp, Homo sapiens
taaaccctaatcctg

SEQ ID NO: 177814 - DNA, 15 bp, Homo sapiens
ataaaccctaatcct

SEQ ID NO: 177815 - DNA, 15 bp, Homo sapiens
cataaaccctaatcc

SEQ ID NO: 177816 - DNA, 15 bp, Homo sapiens
tcataaaccctaatc

SEQ ID NO: 177817 - DNA, 15 bp, Homo sapiens
ctcataaaccctaat

SEQ ID NO: 177818 - DNA, 15 bp, Homo sapiens
cctcataaaccctaa

SEQ ID NO: 177819 - DNA, 15 bp, Homo sapiens
acctcataaacccta

SEQ ID NO: 177820 - DNA, 15 bp, Homo sapiens
aacctcataaaccct

SEQ ID NO: 177821 - DNA, 15 bp, Homo sapiens
taacctcataaaccc

SEQ ID NO: 177822 - DNA, 15 bp, Homo sapiens
ttaacctcataaacc

SEQ ID NO: 177823 - DNA, 15 bp, Homo sapiens
cttaacctcataaac

SEQ ID NO: 177824 - DNA, 15 bp, Homo sapiens
tcttaacctcataaa

SEQ ID NO: 177825 - DNA, 15 bp, Homo sapiens
atcttaacctcataa

SEQ ID NO: 177826 - DNA, 15 bp, Homo sapiens
aatcttaacctcata

SEQ ID NO: 177827 - DNA, 15 bp, Homo sapiens
taatcttaacctcat

SEQ ID NO: 177828 - DNA, 15 bp, Homo sapiens
ttaatcttaacctca

SEQ ID NO: 177829 - DNA, 15 bp, Homo sapiens
gttaatcttaacctc

SEQ ID NO: 177830 - DNA, 15 bp, Homo sapiens
cgttaatcttaacct

SEQ ID NO: 177831 - DNA, 15 bp, Homo sapiens
ccgttaatcttaacc

SEQ ID NO: 177832 - DNA, 15 bp, Homo sapiens
tccgttaatcttaac

SEQ ID NO: 177833 - DNA, 15 bp, Homo sapiens
ctccgttaatcttaa

SEQ ID NO: 177834 - DNA, 15 bp, Homo sapiens
tctccgttaatctta

SEQ ID NO: 177835 - DNA, 15 bp, Homo sapiens
gtctccgttaatctt

SEQ ID NO: 177836 - DNA, 15 bp, Homo sapiens
tgtctccgttaatct

SEQ ID NO: 177837 - DNA, 15 bp, Homo sapiens
ttgtctccgttaatc

SEQ ID NO: 177838 - DNA, 15 bp, Homo sapiens
attgtctccgttaat

SEQ ID NO: 177839 - DNA, 15 bp, Homo sapiens
tattgtctccgttaa

SEQ ID NO: 177840 - DNA, 15 bp, Homo sapiens
ctattgtctccgtta

SEQ ID NO: 177841 - DNA, 15 bp, Homo sapiens
tctattgtctccgtt

SEQ ID NO: 177842 - DNA, 15 bp, Homo sapiens
ttctattgtctccgt

SEQ ID NO: 177843 - DNA, 15 bp, Homo sapiens
cttctattgtctccg

SEQ ID NO: 177844 - DNA, 15 bp, Homo sapiens
tcttctattgtctcc

SEQ ID NO: 177845 - DNA, 15 bp, Homo sapiens
ctcttctattgtctc

SEQ ID NO: 177846 - DNA, 15 bp, Homo sapiens
tctcttctattgtct

SEQ ID NO: 177847 - DNA, 15 bp, Homo sapiens
ttctcttctattgtc

SEQ ID NO: 177848 - DNA, 15 bp, Homo sapiens
attctcttctattgt

SEQ ID NO: 177849 - DNA, 15 bp, Homo sapiens
gattctcttctattg

SEQ ID NO: 177850 - DNA, 15 bp, Homo sapiens
agattctcttctatt

SEQ ID NO: 177851 - DNA, 15 bp, Homo sapiens
aagattctcttctat

SEQ ID NO: 177852 - DNA, 15 bp, Homo sapiens
caagattctcttcta

SEQ ID NO: 177853 - DNA, 15 bp, Homo sapiens
tcaagattctcttct

SEQ ID NO: 177854 - DNA, 15 bp, Homo sapiens
gtcaagattctcttc

SEQ ID NO: 177855 - DNA, 15 bp, Homo sapiens
agtcaagattctctt

SEQ ID NO: 177856 - DNA, 15 bp, Homo sapiens
aagtcaagattctct

SEQ ID NO: 177857 - DNA, 15 bp, Homo sapiens
caagtcaagattctc

SEQ ID NO: 177858 - DNA, 15 bp, Homo sapiens
tcaagtcaagattct

SEQ ID NO: 177859 - DNA, 15 bp, Homo sapiens
atcaagtcaagattc

SEQ ID NO: 177860 - DNA, 15 bp, Homo sapiens
tatcaagtcaagatt

SEQ ID NO: 177861 - DNA, 15 bp, Homo sapiens
ttatcaagtcaagat

SEQ ID NO: 177862 - DNA, 15 bp, Homo sapiens
attatcaagtcaaga

SEQ ID NO: 177863 - DNA, 15 bp, Homo sapiens
tattatcaagtcaag

SEQ ID NO: 177864 - DNA, 15 bp, Homo sapiens
atattatcaagtcaa

SEQ ID NO: 177865 - DNA, 15 bp, Homo sapiens
catattatcaagtca

SEQ ID NO: 177866 - DNA, 15 bp, Homo sapiens
acatattatcaagtc

SEQ ID NO: 177867 - DNA, 15 bp, Homo sapiens
aacatattatcaagt

SEQ ID NO: 177868 - DNA, 15 bp, Homo sapiens
aaacatattatcaag

SEQ ID NO: 177869 - DNA, 15 bp, Homo sapiens
aaaacatattatcaa

SEQ ID NO: 177870 - DNA, 15 bp, Homo sapiens
aaaaacatattatca

SEQ ID NO: 177871 - DNA, 15 bp, Homo sapiens
aaaaaacatattatc

SEQ ID NO: 177872 - DNA, 15 bp, Homo sapiens
taaaaaacatattat

SEQ ID NO: 177873 - DNA, 15 bp, Homo sapiens
ataaaaaacatatta

SEQ ID NO: 177874 - DNA, 15 bp, Homo sapiens
aataaaaaacatatt

SEQ ID NO: 177875 - DNA, 15 bp, Homo sapiens
aaataaaaaacatat

SEQ ID NO: 177876 - DNA, 15 bp, Homo sapiens
aaaataaaaaacata

SEQ ID NO: 177877 - DNA, 15 bp, Homo sapiens
caaaataaaaaacat

SEQ ID NO: 177878 - DNA, 15 bp, Homo sapiens
acaaaataaaaaaca

SEQ ID NO: 177879 - DNA, 15 bp, Homo sapiens
tacaaaataaaaaac

SEQ ID NO: 177880 - DNA, 15 bp, Homo sapiens
ttacaaaataaaaaa

SEQ ID NO: 177881 - DNA, 15 bp, Homo sapiens
tttacaaaataaaaa

SEQ ID NO: 177882 - DNA, 15 bp, Homo sapiens
ttttacaaaataaaa

SEQ ID NO: 177883 - DNA, 15 bp, Homo sapiens
cttttacaaaataaa

SEQ ID NO: 177884 - DNA, 15 bp, Homo sapiens
gcttttacaaaataa

SEQ ID NO: 177885 - DNA, 15 bp, Homo sapiens
agcttttacaaaata

SEQ ID NO: 177886 - DNA, 15 bp, Homo sapiens
aagcttttacaaaat

SEQ ID NO: 177887 - DNA, 15 bp, Homo sapiens
aaagcttttacaaaa

SEQ ID NO: 177888 - DNA, 15 bp, Homo sapiens
caaagcttttacaaa

SEQ ID NO: 177889 - DNA, 15 bp, Homo sapiens
acaaagcttttacaa

SEQ ID NO: 177890 - DNA, 15 bp, Homo sapiens
aacaaagcttttaca

SEQ ID NO: 177891 - DNA, 15 bp, Homo sapiens
caacaaagcttttac

SEQ ID NO: 177892 - DNA, 15 bp, Homo sapiens
gcaacaaagctttta

SEQ ID NO: 177893 - DNA, 15 bp, Homo sapiens
tgcaacaaagctttt

SEQ ID NO: 177894 - DNA, 15 bp, Homo sapiens
ttgcaacaaagcttt

SEQ ID NO: 177895 - DNA, 15 bp, Homo sapiens
attgcaacaaagctt

SEQ ID NO: 177896 - DNA, 15 bp, Homo sapiens
tattgcaacaaagct

SEQ ID NO: 177897 - DNA, 15 bp, Homo sapiens
atattgcaacaaagc

SEQ ID NO: 177898 - DNA, 15 bp, Homo sapiens
tatattgcaacaaag

SEQ ID NO: 177899 - DNA, 15 bp, Homo sapiens
ttatattgcaacaaa

SEQ ID NO: 177900 - DNA, 15 bp, Homo sapiens
attatattgcaacaa

SEQ ID NO: 177901 - DNA, 15 bp, Homo sapiens
aattatattgcaaca

SEQ ID NO: 177902 - DNA, 15 bp, Homo sapiens
gaattatattgcaac

SEQ ID NO: 177903 - DNA, 15 bp, Homo sapiens
tatgaattatattgc

SEQ ID NO: 177904 - DNA, 15 bp, Homo sapiens
atatgaattatattg

SEQ ID NO: 177905 - DNA, 15 bp, Homo sapiens
aatatgaattatatt

SEQ ID NO: 177906 - DNA, 15 bp, Homo sapiens
gaatatgaattatat

SEQ ID NO: 177907 - DNA, 15 bp, Homo sapiens
ggaatatgaattata

SEQ ID NO: 177908 - DNA, 15 bp, Homo sapiens
tggaatatgaattat

SEQ ID NO: 177909 - DNA, 15 bp, Homo sapiens
ttggaatatgaatta

SEQ ID NO: 177910 - DNA, 15 bp, Homo sapiens
cttggaatatgaatt

SEQ ID NO: 177911 - DNA, 15 bp, Homo sapiens
acttggaatatgaat

SEQ ID NO: 177912 - DNA, 15 bp, Homo sapiens
tacttggaatatgaa

SEQ ID NO: 177913 - DNA, 15 bp, Homo sapiens
ttacttggaatatga

SEQ ID NO: 177914 - DNA, 15 bp, Homo sapiens
attacttggaatatg

SEQ ID NO: 177915 - DNA, 15 bp, Homo sapiens
cattacttggaatat

SEQ ID NO: 177916 - DNA, 15 bp, Homo sapiens
acattacttggaata

SEQ ID NO: 177917 - DNA, 15 bp, Homo sapiens
tacattacttggaat

SEQ ID NO: 177918 - DNA, 15 bp, Homo sapiens
gtacattacttggaa

SEQ ID NO: 177919 - DNA, 15 bp, Homo sapiens
ggtacattacttgga

SEQ ID NO: 177920 - DNA, 15 bp, Homo sapiens
gggtacattacttgg

SEQ ID NO: 177921 - DNA, 15 bp, Homo sapiens
tgggtacattacttg

SEQ ID NO: 177922 - DNA, 15 bp, Homo sapiens
atgggtacattactt

SEQ ID NO: 177923 - DNA, 15 bp, Homo sapiens
aatgggtacattact

SEQ ID NO: 177924 - DNA, 15 bp, Homo sapiens
caatgggtacattac

SEQ ID NO: 177925 - DNA, 15 bp, Homo sapiens
tcaatgggtacatta

SEQ ID NO: 177926 - DNA, 15 bp, Homo sapiens
ttcaatgggtacatt

SEQ ID NO: 177927 - DNA, 15 bp, Homo sapiens
tttcaatgggtacat

SEQ ID NO: 177928 - DNA, 15 bp, Homo sapiens
atttcaatgggtaca

SEQ ID NO: 177929 - DNA, 15 bp, Homo sapiens
aatttcaatgggtac

SEQ ID NO: 177930 - DNA, 15 bp, Homo sapiens
caatttcaatgggta

SEQ ID NO: 177931 - DNA, 15 bp, Homo sapiens
acaatttcaatgggt

SEQ ID NO: 177932 - DNA, 15 bp, Homo sapiens
cacaatttcaatggg

SEQ ID NO: 177933 - DNA, 15 bp, Homo sapiens
gcacaatttcaatgg

SEQ ID NO: 177934 - DNA, 15 bp, Homo sapiens
tgcacaatttcaatg

SEQ ID NO: 177935 - DNA, 15 bp, Homo sapiens
atgcacaatttcaat

SEQ ID NO: 177936 - DNA, 15 bp, Homo sapiens
aatgcacaatttcaa

SEQ ID NO: 177937 - DNA, 15 bp, Homo sapiens
aaatgcacaatttca

SEQ ID NO: 177938 - DNA, 15 bp, Homo sapiens
gaaatgcacaatttc

SEQ ID NO: 177939 - DNA, 15 bp, Homo sapiens
tgaaatgcacaattt

SEQ ID NO: 177940 - DNA, 15 bp, Homo sapiens
ctgaaatgcacaatt

SEQ ID NO: 177941 - DNA, 15 bp, Homo sapiens
actgaaatgcacaat

SEQ ID NO: 177942 - DNA, 15 bp, Homo sapiens
cactgaaatgcacaa

SEQ ID NO: 177943 - DNA, 15 bp, Homo sapiens
ccactgaaatgcaca

SEQ ID NO: 177944 - DNA, 15 bp, Homo sapiens
accactgaaatgcac

SEQ ID NO: 177945 - DNA, 15 bp, Homo sapiens
taccactgaaatgca

SEQ ID NO: 177946 - DNA, 15 bp, Homo sapiens
ataccactgaaatgc

SEQ ID NO: 177947 - DNA, 15 bp, Homo sapiens
aataccactgaaatg

SEQ ID NO: 177948 - DNA, 15 bp, Homo sapiens
aaataccactgaaat

SEQ ID NO: 177949 - DNA, 15 bp, Homo sapiens
taaataccactgaaa

SEQ ID NO: 177950 - DNA, 15 bp, Homo sapiens
ctaaataccactgaa

SEQ ID NO: 177951 - DNA, 15 bp, Homo sapiens
actaaataccactga

SEQ ID NO: 177952 - DNA, 15 bp, Homo sapiens
cactaaataccactg

SEQ ID NO: 177953 - DNA, 15 bp, Homo sapiens
acactaaataccact

SEQ ID NO: 177954 - DNA, 15 bp, Homo sapiens
tacactaaataccac

SEQ ID NO: 177955 - DNA, 15 bp, Homo sapiens
atacactaaatacca

SEQ ID NO: 177956 - DNA, 15 bp, Homo sapiens
aatacactaaatacc

SEQ ID NO: 177957 - DNA, 15 bp, Homo sapiens
aaatacactaaatac

SEQ ID NO: 177958 - DNA, 15 bp, Homo sapiens
taaatacactaaata

SEQ ID NO: 177959 - DNA, 15 bp, Homo sapiens
ataaatacactaaat

SEQ ID NO: 177960 - DNA, 15 bp, Homo sapiens
tataaatacactaaa

SEQ ID NO: 177961 - DNA, 15 bp, Homo sapiens
ctataaatacactaa

SEQ ID NO: 177962 - DNA, 15 bp, Homo sapiens
tctataaatacacta

SEQ ID NO: 177963 - DNA, 15 bp, Homo sapiens
ctctataaatacact

SEQ ID NO: 177964 - DNA, 15 bp, Homo sapiens
gctctataaatacac

SEQ ID NO: 177965 - DNA, 15 bp, Homo sapiens
agctctataaataca

SEQ ID NO: 177966 - DNA, 15 bp, Homo sapiens
cagctctataaatac

SEQ ID NO: 177967 - DNA, 15 bp, Homo sapiens
acagctctataaata

SEQ ID NO: 177968 - DNA, 15 bp, Homo sapiens
tacagctctataaat

SEQ ID NO: 177969 - DNA, 15 bp, Homo sapiens
gtacagctctataaa

SEQ ID NO: 177970 - DNA, 15 bp, Homo sapiens
tgtacagctctataa

SEQ ID NO: 177971 - DNA, 15 bp, Homo sapiens
ttgtacagctctata

SEQ ID NO: 177972 - DNA, 15 bp, Homo sapiens
gttgtacagctctat

SEQ ID NO: 177973 - DNA, 15 bp, Homo sapiens
ggttgtacagctcta

SEQ ID NO: 177974 - DNA, 15 bp, Homo sapiens
tggttgtacagctct

SEQ ID NO: 177975 - DNA, 15 bp, Homo sapiens
atggttgtacagctc

SEQ ID NO: 177976 - DNA, 15 bp, Homo sapiens
gatggttgtacagct

SEQ ID NO: 177977 - DNA, 15 bp, Homo sapiens
tgatggttgtacagc

SEQ ID NO: 177978 - DNA, 15 bp, Homo sapiens
gtgatggttgtacag

SEQ ID NO: 177979 - DNA, 15 bp, Homo sapiens
ggtgatggttgtaca

SEQ ID NO: 177980 - DNA, 15 bp, Homo sapiens
tggtgatggttgtac

SEQ ID NO: 177981 - DNA, 15 bp, Homo sapiens
gtggtgatggttgta

SEQ ID NO: 177982 - DNA, 15 bp, Homo sapiens
ggtggtgatggttgt

SEQ ID NO: 177983 - DNA, 15 bp, Homo sapiens
gggtggtgatggttg

SEQ ID NO: 177984 - DNA, 15 bp, Homo sapiens
agggtggtgatggtt

SEQ ID NO: 177985 - DNA, 15 bp, Homo sapiens
cagggtggtgatggt

SEQ ID NO: 177986 - DNA, 15 bp, Homo sapiens
acagggtggtgatgg

SEQ ID NO: 177987 - DNA, 15 bp, Homo sapiens
tacagggtggtgatg

SEQ ID NO: 177988 - DNA, 15 bp, Homo sapiens
ctacagggtggtgat

SEQ ID NO: 177989 - DNA, 15 bp, Homo sapiens
gctacagggtggtga

SEQ ID NO: 177990 - DNA, 15 bp, Homo sapiens
agctacagggtggtg

SEQ ID NO: 177991 - DNA, 15 bp, Homo sapiens
tagctacagggtggt

SEQ ID NO: 177992 - DNA, 15 bp, Homo sapiens
atagctacagggtgg

SEQ ID NO: 177993 - DNA, 15 bp, Homo sapiens
aatagctacagggtg

SEQ ID NO: 177994 - DNA, 15 bp, Homo sapiens
taatagctacagggt

SEQ ID NO: 177995 - DNA, 15 bp, Homo sapiens
ataatagctacaggg

SEQ ID NO: 177996 - DNA, 15 bp, Homo sapiens
gataatagctacagg

SEQ ID NO: 177997 - DNA, 15 bp, Homo sapiens
agataatagctacag

SEQ ID NO: 177998 - DNA, 15 bp, Homo sapiens
gagataatagctaca

SEQ ID NO: 177999 - DNA, 15 bp, Homo sapiens
ggagataatagctac

SEQ ID NO: 178000 - DNA, 15 bp, Homo sapiens
cggagataatagcta

SEQ ID NO: 178001 - DNA, 15 bp, Homo sapiens
gcggagataatagct

SEQ ID NO: 178002 - DNA, 15 bp, Homo sapiens
tgcggagataatagc

SEQ ID NO: 178003 - DNA, 15 bp, Homo sapiens
atgcggagataatag

SEQ ID NO: 178004 - DNA, 15 bp, Homo sapiens
gatgcggagataata

SEQ ID NO: 178005 - DNA, 15 bp, Homo sapiens
ggatgcggagataat

SEQ ID NO: 178006 - DNA, 15 bp, Homo sapiens
gggatgcggagataa

SEQ ID NO: 178007 - DNA, 15 bp, Homo sapiens
agggatgcggagata

SEQ ID NO: 178008 - DNA, 15 bp, Homo sapiens
tagggatgcggagat

SEQ ID NO: 178009 - DNA, 15 bp, Homo sapiens
gtagggatgcggaga

SEQ ID NO: 178010 - DNA, 15 bp, Homo sapiens
agtagggatgcggag

SEQ ID NO: 178011 - DNA, 15 bp, Homo sapiens
aagtagggatgcgga

SEQ ID NO: 178012 - DNA, 15 bp, Homo sapiens
gaagtagggatgcgg

SEQ ID NO: 178013 - DNA, 15 bp, Homo sapiens
agaagtagggatgcg

SEQ ID NO: 178014 - DNA, 15 bp, Homo sapiens
gagaagtagggatgc

SEQ ID NO: 178015 - DNA, 15 bp, Homo sapiens
ggagaagtagggatg

SEQ ID NO: 178016 - DNA, 15 bp, Homo sapiens
gggagaagtagggat

SEQ ID NO: 178017 - DNA, 15 bp, Homo sapiens
agggagaagtaggga

SEQ ID NO: 178018 - DNA, 15 bp, Homo sapiens
tagggagaagtaggg

SEQ ID NO: 178019 - DNA, 15 bp, Homo sapiens
ctagggagaagtagg

SEQ ID NO: 178020 - DNA, 15 bp, Homo sapiens
gctagggagaagtag

SEQ ID NO: 178021 - DNA, 15 bp, Homo sapiens
agctagggagaagta

SEQ ID NO: 178022 - DNA, 15 bp, Homo sapiens
cagctagggagaagt

SEQ ID NO: 178023 - DNA, 15 bp, Homo sapiens
gcagctagggagaag

SEQ ID NO: 178024 - DNA, 15 bp, Homo sapiens
agcagctagggagaa

SEQ ID NO: 178025 - DNA, 15 bp, Homo sapiens
cagcagctagggaga

SEQ ID NO: 178026 - DNA, 15 bp, Homo sapiens
ccagcagctagggag

SEQ ID NO: 178027 - DNA, 15 bp, Homo sapiens
tccagcagctaggga

SEQ ID NO: 178028 - DNA, 15 bp, Homo sapiens
ttccagcagctaggg

SEQ ID NO: 178029 - DNA, 15 bp, Homo sapiens
tttccagcagctagg

SEQ ID NO: 178030 - DNA, 15 bp, Homo sapiens
gtttccagcagctag

SEQ ID NO: 178031 - DNA, 15 bp, Homo sapiens
ggtttccagcagcta

SEQ ID NO: 178032 - DNA, 15 bp, Homo sapiens
aggtttccagcagct

SEQ ID NO: 178033 - DNA, 15 bp, Homo sapiens
aaggtttccagcagc

SEQ ID NO: 178034 - DNA, 15 bp, Homo sapiens
caaggtttccagcag

SEQ ID NO: 178035 - DNA, 15 bp, Homo sapiens
ccaaggtttccagca

SEQ ID NO: 178036 - DNA, 15 bp, Homo sapiens
cccaaggtttccagc

SEQ ID NO: 178037 - DNA, 15 bp, Homo sapiens
acccaaggtttccag

SEQ ID NO: 178038 - DNA, 15 bp, Homo sapiens
gacccaaggtttcca

SEQ ID NO: 178039 - DNA, 15 bp, Homo sapiens
agacccaaggtttcc

SEQ ID NO: 178040 - DNA, 15 bp, Homo sapiens
tagacccaaggtttc

SEQ ID NO: 178041 - DNA, 15 bp, Homo sapiens
gtagacccaaggttt

SEQ ID NO: 178042 - DNA, 15 bp, Homo sapiens
agtagacccaaggtt

SEQ ID NO: 178043 - DNA, 15 bp, Homo sapiens
aagtagacccaaggt

SEQ ID NO: 178044 - DNA, 15 bp, Homo sapiens
aaagtagacccaagg

SEQ ID NO: 178045 - DNA, 15 bp, Homo sapiens
gaaagtagacccaag

SEQ ID NO: 178046 - DNA, 15 bp, Homo sapiens
agaaagtagacccaa

SEQ ID NO: 178047 - DNA, 15 bp, Homo sapiens
cagaaagtagaccca

SEQ ID NO: 178048 - DNA, 15 bp, Homo sapiens
acagaaagtagaccc

SEQ ID NO: 178049 - DNA, 15 bp, Homo sapiens
aacagaaagtagacc

SEQ ID NO: 178050 - DNA, 15 bp, Homo sapiens
aaacagaaagtagac

SEQ ID NO: 178051 - DNA, 15 bp, Homo sapiens
caaacagaaagtaga

SEQ ID NO: 178052 - DNA, 15 bp, Homo sapiens
gcaaacagaaagtag

SEQ ID NO: 178053 - DNA, 15 bp, Homo sapiens
ggcaaacagaaagta

SEQ ID NO: 178054 - DNA, 15 bp, Homo sapiens
tggcaaacagaaagt

SEQ ID NO: 178055 - DNA, 15 bp, Homo sapiens
atggcaaacagaaag

SEQ ID NO: 178056 - DNA, 15 bp, Homo sapiens
aatggcaaacagaaa

SEQ ID NO: 178057 - DNA, 15 bp, Homo sapiens
gaatggcaaacagaa

SEQ ID NO: 178058 - DNA, 15 bp, Homo sapiens
agaatggcaaacaga

SEQ ID NO: 178059 - DNA, 15 bp, Homo sapiens
cagaatggcaaacag

SEQ ID NO: 178060 - DNA, 15 bp, Homo sapiens
tcagaatggcaaaca

SEQ ID NO: 178061 - DNA, 15 bp, Homo sapiens
ctcagaatggcaaac

SEQ ID NO: 178062 - DNA, 15 bp, Homo sapiens
actcagaatggcaaa

SEQ ID NO: 178063 - DNA, 15 bp, Homo sapiens
tactcagaatggcaa

SEQ ID NO: 178064 - DNA, 15 bp, Homo sapiens
atactcagaatggca

SEQ ID NO: 178065 - DNA, 15 bp, Homo sapiens
aatactcagaatggc

SEQ ID NO: 178066 - DNA, 15 bp, Homo sapiens
aaatactcagaatgg

SEQ ID NO: 178067 - DNA, 15 bp, Homo sapiens
gaaatactcagaatg

SEQ ID NO: 178068 - DNA, 15 bp, Homo sapiens
tgaaatactcagaat

SEQ ID NO: 178069 - DNA, 15 bp, Homo sapiens
atgaaatactcagaa

SEQ ID NO: 178070 - DNA, 15 bp, Homo sapiens
tatgaaatactcaga

SEQ ID NO: 178071 - DNA, 15 bp, Homo sapiens
atatgaaatactcag

SEQ ID NO: 178072 - DNA, 15 bp, Homo sapiens
tatatgaaatactca

SEQ ID NO: 178073 - DNA, 15 bp, Homo sapiens
ttatatgaaatactc

SEQ ID NO: 178074 - DNA, 15 bp, Homo sapiens
tttatatgaaatact

SEQ ID NO: 178075 - DNA, 15 bp, Homo sapiens
atttatatgaaatac

SEQ ID NO: 178076 - DNA, 15 bp, Homo sapiens
tatttatatgaaata

SEQ ID NO: 178077 - DNA, 15 bp, Homo sapiens
ctatttatatgaaat

SEQ ID NO: 178078 - DNA, 15 bp, Homo sapiens
tctatttatatgaaa

SEQ ID NO: 178079 - DNA, 15 bp, Homo sapiens
ttctatttatatgaa

SEQ ID NO: 178080 - DNA, 15 bp, Homo sapiens
attctatttatatga

SEQ ID NO: 178081 - DNA, 15 bp, Homo sapiens
gattctatttatatg

SEQ ID NO: 178082 - DNA, 15 bp, Homo sapiens
ggattctatttatat

SEQ ID NO: 178083 - DNA, 15 bp, Homo sapiens
aggattctatttata

SEQ ID NO: 178084 - DNA, 15 bp, Homo sapiens
taggattctatttat

SEQ ID NO: 178085 - DNA, 15 bp, Homo sapiens
gtaggattctattta

SEQ ID NO: 178086 - DNA, 15 bp, Homo sapiens
tgtaggattctattt

SEQ ID NO: 178087 - DNA, 15 bp, Homo sapiens
ctgtaggattctatt

SEQ ID NO: 178088 - DNA, 15 bp, Homo sapiens
actgtaggattctat

SEQ ID NO: 178089 - DNA, 15 bp, Homo sapiens
aactgtaggattcta

SEQ ID NO: 178090 - DNA, 15 bp, Homo sapiens
aaactgtaggattct

SEQ ID NO: 178091 - DNA, 15 bp, Homo sapiens
taaactgtaggattc

SEQ ID NO: 178092 - DNA, 15 bp, Homo sapiens
ataaactgtaggatt

SEQ ID NO: 178093 - DNA, 15 bp, Homo sapiens
tataaactgtaggat

SEQ ID NO: 178094 - DNA, 15 bp, Homo sapiens
ctataaactgtagga

SEQ ID NO: 178095 - DNA, 15 bp, Homo sapiens
actataaactgtagg

SEQ ID NO: 178096 - DNA, 15 bp, Homo sapiens
cactataaactgtag

SEQ ID NO: 178097 - DNA, 15 bp, Homo sapiens
gcactataaactgta

SEQ ID NO: 178098 - DNA, 15 bp, Homo sapiens
agcactataaactgt

SEQ ID NO: 178099 - DNA, 15 bp, Homo sapiens
aagcactataaactg

SEQ ID NO: 178100 - DNA, 15 bp, Homo sapiens
aaagcactataaact

SEQ ID NO: 178101 - DNA, 15 bp, Homo sapiens
taaagcactataaac

SEQ ID NO: 178102 - DNA, 15 bp, Homo sapiens
ttaaagcactataaa

SEQ ID NO: 178103 - DNA, 15 bp, Homo sapiens
attaaagcactataa

SEQ ID NO: 178104 - DNA, 15 bp, Homo sapiens
cattaaagcactata

SEQ ID NO: 178105 - DNA, 15 bp, Homo sapiens
tcattaaagcactat

SEQ ID NO: 178106 - DNA, 15 bp, Homo sapiens
gtcattaaagcacta

SEQ ID NO: 178107 - DNA, 15 bp, Homo sapiens
agtcattaaagcact

SEQ ID NO: 178108 - DNA, 15 bp, Homo sapiens
cagtcattaaagcac

SEQ ID NO: 178109 - DNA, 15 bp, Homo sapiens
acagtcattaaagca

SEQ ID NO: 178110 - DNA, 15 bp, Homo sapiens
gacagtcattaaagc

SEQ ID NO: 178111 - DNA, 15 bp, Homo sapiens
agacagtcattaaag

SEQ ID NO: 178112 - DNA, 15 bp, Homo sapiens
aagacagtcattaaa

SEQ ID NO: 178113 - DNA, 15 bp, Homo sapiens
aaagacagtcattaa

SEQ ID NO: 178114 - DNA, 15 bp, Homo sapiens
aaaagacagtcatta

SEQ ID NO: 178115 - DNA, 15 bp, Homo sapiens
aaaaagacagtcatt

SEQ ID NO: 178116 - DNA, 15 bp, Homo sapiens
aaaaaagacagtcat

SEQ ID NO: 178117 - DNA, 15 bp, Homo sapiens
gaaaaaagacagtca

SEQ ID NO: 178118 - DNA, 15 bp, Homo sapiens
tgaaaaaagacagtc

SEQ ID NO: 178119 - DNA, 15 bp, Homo sapiens
gtgaaaaaagacagt

SEQ ID NO: 178120 - DNA, 15 bp, Homo sapiens
agtgaaaaaagacag

SEQ ID NO: 178121 - DNA, 15 bp, Homo sapiens
aagtgaaaaaagaca

SEQ ID NO: 178122 - DNA, 15 bp, Homo sapiens
taagtgaaaaaagac

SEQ ID NO: 178123 - DNA, 15 bp, Homo sapiens
ctaagtgaaaaaaga

SEQ ID NO: 178124 - DNA, 15 bp, Homo sapiens
cctaagtgaaaaaag

SEQ ID NO: 178125 - DNA, 15 bp, Homo sapiens
tcctaagtgaaaaaa

SEQ ID NO: 178126 - DNA, 15 bp, Homo sapiens
atcctaagtgaaaaa

SEQ ID NO: 178127 - DNA, 15 bp, Homo sapiens
gatcctaagtgaaaa

SEQ ID NO: 178128 - DNA, 15 bp, Homo sapiens
tgatcctaagtgaaa

SEQ ID NO: 178129 - DNA, 15 bp, Homo sapiens
atgatcctaagtgaa

SEQ ID NO: 178130 - DNA, 15 bp, Homo sapiens
catgatcctaagtga

SEQ ID NO: 178131 - DNA, 15 bp, Homo sapiens
acatgatcctaagtg

SEQ ID NO: 178132 - DNA, 15 bp, Homo sapiens
cacatgatcctaagt

SEQ ID NO: 178133 - DNA, 15 bp, Homo sapiens
acacatgatcctaag

SEQ ID NO: 178134 - DNA, 15 bp, Homo sapiens
aacacatgatcctaa

SEQ ID NO: 178135 - DNA, 15 bp, Homo sapiens
aaacacatgatccta

SEQ ID NO: 178136 - DNA, 15 bp, Homo sapiens
taaacacatgatcct

SEQ ID NO: 178137 - DNA, 15 bp, Homo sapiens
ttaaacacatgatcc

SEQ ID NO: 178138 - DNA, 15 bp, Homo sapiens
cttaaacacatgatc

SEQ ID NO: 178139 - DNA, 15 bp, Homo sapiens
ccttaaacacatgat

SEQ ID NO: 178140 - DNA, 15 bp, Homo sapiens
accttaaacacatga

SEQ ID NO: 178141 - DNA, 15 bp, Homo sapiens
aaccttaaacacatg

SEQ ID NO: 178142 - DNA, 15 bp, Homo sapiens
aaaccttaaacacat

SEQ ID NO: 178143 - DNA, 15 bp, Homo sapiens
caaaccttaaacaca

SEQ ID NO: 178144 - DNA, 15 bp, Homo sapiens
acaaaccttaaacac

SEQ ID NO: 178145 - DNA, 15 bp, Homo sapiens
aacaaaccttaaaca

SEQ ID NO: 178146 - DNA, 15 bp, Homo sapiens
gaacaaaccttaaac

SEQ ID NO: 178147 - DNA, 15 bp, Homo sapiens
tgaacaaaccttaaa

SEQ ID NO: 178148 - DNA, 15 bp, Homo sapiens
atgaacaaaccttaa

SEQ ID NO: 178149 - DNA, 15 bp, Homo sapiens
catgaacaaacctta

SEQ ID NO: 178150 - DNA, 15 bp, Homo sapiens
acatgaacaaacctt

SEQ ID NO: 178151 - DNA, 15 bp, Homo sapiens
aacatgaacaaacct

SEQ ID NO: 178152 - DNA, 15 bp, Homo sapiens
caacatgaacaaacc

SEQ ID NO: 178153 - DNA, 15 bp, Homo sapiens
acaacatgaacaaac

SEQ ID NO: 178154 - DNA, 15 bp, Homo sapiens
tacaacatgaacaaa

SEQ ID NO: 178155 - DNA, 15 bp, Homo sapiens
ctacaacatgaacaa

SEQ ID NO: 178156 - DNA, 15 bp, Homo sapiens
gctacaacatgaaca

SEQ ID NO: 178157 - DNA, 15 bp, Homo sapiens
agctacaacatgaac

SEQ ID NO: 178158 - DNA, 15 bp, Homo sapiens
aagctacaacatgaa

SEQ ID NO: 178159 - DNA, 15 bp, Homo sapiens
aaagctacaacatga

SEQ ID NO: 178160 - DNA, 15 bp, Homo sapiens
aaaagctacaacatg

SEQ ID NO: 178161 - DNA, 15 bp, Homo sapiens
caaaagctacaacat

SEQ ID NO: 178162 - DNA, 15 bp, Homo sapiens
acaaaagctacaaca

SEQ ID NO: 178163 - DNA, 15 bp, Homo sapiens
cacaaaagctacaac

SEQ ID NO: 178164 - DNA, 15 bp, Homo sapiens
ccacaaaagctacaa

SEQ ID NO: 178165 - DNA, 15 bp, Homo sapiens
accacaaaagctaca

SEQ ID NO: 178166 - DNA, 15 bp, Homo sapiens
taccacaaaagctac

SEQ ID NO: 178167 - DNA, 15 bp, Homo sapiens
gtaccacaaaagcta

SEQ ID NO: 178168 - DNA, 15 bp, Homo sapiens
agtaccacaaaagct

SEQ ID NO: 178169 - DNA, 15 bp, Homo sapiens
aagtaccacaaaagc

SEQ ID NO: 178170 - DNA, 15 bp, Homo sapiens
aaagtaccacaaaag

SEQ ID NO: 178171 - DNA, 15 bp, Homo sapiens
gaaagtaccacaaaa

SEQ ID NO: 178172 - DNA, 15 bp, Homo sapiens
ggaaagtaccacaaa

SEQ ID NO: 178173 - DNA, 15 bp, Homo sapiens
aggaaagtaccacaa

SEQ ID NO: 178174 - DNA, 15 bp, Homo sapiens
aaggaaagtaccaca

SEQ ID NO: 178175 - DNA, 15 bp, Homo sapiens
aaaggaaagtaccac

SEQ ID NO: 178176 - DNA, 15 bp, Homo sapiens
gaaaggaaagtacca

SEQ ID NO: 178177 - DNA, 15 bp, Homo sapiens
agaaaggaaagtacc

SEQ ID NO: 178178 - DNA, 15 bp, Homo sapiens
gagaaaggaaagtac

SEQ ID NO: 178179 - DNA, 15 bp, Homo sapiens
agagaaaggaaagta

SEQ ID NO: 178180 - DNA, 15 bp, Homo sapiens
aagagaaaggaaagt

SEQ ID NO: 178181 - DNA, 15 bp, Homo sapiens
gaagagaaaggaaag

SEQ ID NO: 178182 - DNA, 15 bp, Homo sapiens
atgaagagaaaggaa

SEQ ID NO: 178183 - DNA, 15 bp, Homo sapiens
aatgaagagaaagga

SEQ ID NO: 178184 - DNA, 15 bp, Homo sapiens
caatgaagagaaagg

SEQ ID NO: 178185 - DNA, 15 bp, Homo sapiens
tcaatgaagagaaag

SEQ ID NO: 178186 - DNA, 15 bp, Homo sapiens
atcaatgaagagaaa

SEQ ID NO: 178187 - DNA, 15 bp, Homo sapiens
tatcaatgaagagaa

SEQ ID NO: 178188 - DNA, 15 bp, Homo sapiens
ttatcaatgaagaga

SEQ ID NO: 178189 - DNA, 15 bp, Homo sapiens
tttatcaatgaagag

SEQ ID NO: 178190 - DNA, 15 bp, Homo sapiens
atttatcaatgaaga

SEQ ID NO: 178191 - DNA, 15 bp, Homo sapiens
tatttatcaatgaag

SEQ ID NO: 178192 - DNA, 15 bp, Homo sapiens
ttatttatcaatgaa

SEQ ID NO: 178193 - DNA, 15 bp, Homo sapiens
attatttatcaatga

SEQ ID NO: 178194 - DNA, 15 bp, Homo sapiens
tattatttatcaatg

SEQ ID NO: 178195 - DNA, 15 bp, Homo sapiens
atattatttatcaat

SEQ ID NO: 178196 - DNA, 15 bp, Homo sapiens
aatattatttatcaa

SEQ ID NO: 178197 - DNA, 15 bp, Homo sapiens
gaatattatttatca

SEQ ID NO: 178198 - DNA, 15 bp, Homo sapiens
ggaatattatttatc

SEQ ID NO: 178199 - DNA, 15 bp, Homo sapiens
tggaatattatttat

SEQ ID NO: 178200 - DNA, 15 bp, Homo sapiens
gtggaatattattta

SEQ ID NO: 178201 - DNA, 15 bp, Homo sapiens
agtggaatattattt

SEQ ID NO: 178202 - DNA, 15 bp, Homo sapiens
cagtggaatattatt

SEQ ID NO: 178203 - DNA, 15 bp, Homo sapiens
acagtggaatattat

SEQ ID NO: 178204 - DNA, 15 bp, Homo sapiens
cacagtggaatatta

SEQ ID NO: 178205 - DNA, 15 bp, Homo sapiens
acacagtggaatatt

SEQ ID NO: 178206 - DNA, 15 bp, Homo sapiens
cacacagtggaatat

SEQ ID NO: 178207 - DNA, 15 bp, Homo sapiens
ccacacagtggaata

SEQ ID NO: 178208 - DNA, 15 bp, Homo sapiens
tccacacagtggaat

SEQ ID NO: 178209 - DNA, 15 bp, Homo sapiens
atccacacagtggaa

SEQ ID NO: 178210 - DNA, 15 bp, Homo sapiens
tatccacacagtgga

SEQ ID NO: 178211 - DNA, 15 bp, Homo sapiens
ctatccacacagtgg

SEQ ID NO: 178212 - DNA, 15 bp, Homo sapiens
cctatccacacagtg

SEQ ID NO: 178213 - DNA, 15 bp, Homo sapiens
gcctatccacacagt

SEQ ID NO: 178214 - DNA, 15 bp, Homo sapiens
agcctatccacacag

SEQ ID NO: 178215 - DNA, 15 bp, Homo sapiens
tagcctatccacaca

SEQ ID NO: 178216 - DNA, 15 bp, Homo sapiens
gtagcctatccacac

SEQ ID NO: 178217 - DNA, 15 bp, Homo sapiens
tgtagcctatccaca

SEQ ID NO: 178218 - DNA, 15 bp, Homo sapiens
atgtagcctatccac

SEQ ID NO: 178219 - DNA, 15 bp, Homo sapiens
aatgtagcctatcca

SEQ ID NO: 178220 - DNA, 15 bp, Homo sapiens
aaatgtagcctatcc

SEQ ID NO: 178221 - DNA, 15 bp, Homo sapiens
aaaatgtagcctatc

SEQ ID NO: 178222 - DNA, 15 bp, Homo sapiens
caaaatgtagcctat

SEQ ID NO: 178223 - DNA, 15 bp, Homo sapiens
acaaaatgtagccta

SEQ ID NO: 178224 - DNA, 15 bp, Homo sapiens
aacaaaatgtagcct

SEQ ID NO: 178225 - DNA, 15 bp, Homo sapiens
aaacaaaatgtagcc

SEQ ID NO: 178226 - DNA, 15 bp, Homo sapiens
caaacaaaatgtagc

SEQ ID NO: 178227 - DNA, 15 bp, Homo sapiens
acaaacaaaatgtag

SEQ ID NO: 178228 - DNA, 15 bp, Homo sapiens
gacaaacaaaatgta

SEQ ID NO: 178229 - DNA, 15 bp, Homo sapiens
ggacaaacaaaatgt

SEQ ID NO: 178230 - DNA, 15 bp, Homo sapiens
tggacaaacaaaatg

SEQ ID NO: 178231 - DNA, 15 bp, Homo sapiens
gtggacaaacaaaat

SEQ ID NO: 178232 - DNA, 15 bp, Homo sapiens
agtggacaaacaaaa

SEQ ID NO: 178233 - DNA, 15 bp, Homo sapiens
gagtggacaaacaaa

SEQ ID NO: 178234 - DNA, 15 bp, Homo sapiens
tgagtggacaaacaa

SEQ ID NO: 178235 - DNA, 15 bp, Homo sapiens
atgagtggacaaaca

SEQ ID NO: 178236 - DNA, 15 bp, Homo sapiens
gatgagtggacaaac

SEQ ID NO: 178237 - DNA, 15 bp, Homo sapiens
tgatgagtggacaaa

SEQ ID NO: 178238 - DNA, 15 bp, Homo sapiens
ctgatgagtggacaa

SEQ ID NO: 178239 - DNA, 15 bp, Homo sapiens
actgatgagtggaca

SEQ ID NO: 178240 - DNA, 15 bp, Homo sapiens
gactgatgagtggac

SEQ ID NO: 178241 - DNA, 15 bp, Homo sapiens
cgactgatgagtgga

SEQ ID NO: 178242 - DNA, 15 bp, Homo sapiens
tcgactgatgagtgg

SEQ ID NO: 178243 - DNA, 15 bp, Homo sapiens
atcgactgatgagtg

SEQ ID NO: 178244 - DNA, 15 bp, Homo sapiens
catcgactgatgagt

SEQ ID NO: 178245 - DNA, 15 bp, Homo sapiens
ccatcgactgatgag

SEQ ID NO: 178246 - DNA, 15 bp, Homo sapiens
cccatcgactgatga

SEQ ID NO: 178247 - DNA, 15 bp, Homo sapiens
gcccatcgactgatg

SEQ ID NO: 178248 - DNA, 15 bp, Homo sapiens
tgcccatcgactgat

SEQ ID NO: 178249 - DNA, 15 bp, Homo sapiens
atgcccatcgactga

SEQ ID NO: 178250 - DNA, 15 bp, Homo sapiens
aatgcccatcgactg

SEQ ID NO: 178251 - DNA, 15 bp, Homo sapiens
aaatgcccatcgact

SEQ ID NO: 178252 - DNA, 15 bp, Homo sapiens
caaatgcccatcgac

SEQ ID NO: 178253 - DNA, 15 bp, Homo sapiens
acaacccaaatgccc

SEQ ID NO: 178254 - DNA, 15 bp, Homo sapiens
aacaacccaaatgcc

SEQ ID NO: 178255 - DNA, 15 bp, Homo sapiens
aaacaacccaaatgc

SEQ ID NO: 178256 - DNA, 15 bp, Homo sapiens
gaaacaacccaaatg

SEQ ID NO: 178257 - DNA, 15 bp, Homo sapiens
ggaaacaacccaaat

SEQ ID NO: 178258 - DNA, 15 bp, Homo sapiens
tggaaacaacccaaa

SEQ ID NO: 178259 - DNA, 15 bp, Homo sapiens
atggaaacaacccaa

SEQ ID NO: 178260 - DNA, 15 bp, Homo sapiens
tatggaaacaaccca

SEQ ID NO: 178261 - DNA, 15 bp, Homo sapiens
atatggaaacaaccc

SEQ ID NO: 178262 - DNA, 15 bp, Homo sapiens
aatatggaaacaacc

SEQ ID NO: 178263 - DNA, 15 bp, Homo sapiens
aaatatggaaacaac

SEQ ID NO: 178264 - DNA, 15 bp, Homo sapiens
aaaatatggaaacaa

SEQ ID NO: 178265 - DNA, 15 bp, Homo sapiens
caaaatatggaaaca

SEQ ID NO: 178266 - DNA, 15 bp, Homo sapiens
ccaaaatatggaaac

SEQ ID NO: 178267 - DNA, 15 bp, Homo sapiens
gccaaaatatggaaa

SEQ ID NO: 178268 - DNA, 15 bp, Homo sapiens
agccaaaatatggaa

SEQ ID NO: 178269 - DNA, 15 bp, Homo sapiens
tagccaaaatatgga

SEQ ID NO: 178270 - DNA, 15 bp, Homo sapiens
atagccaaaatatgg

SEQ ID NO: 178271 - DNA, 15 bp, Homo sapiens
aatagccaaaatatg

SEQ ID NO: 178272 - DNA, 15 bp, Homo sapiens
gaatagccaaaatat

SEQ ID NO: 178273 - DNA, 15 bp, Homo sapiens
ggaatagccaaaata

SEQ ID NO: 178274 - DNA, 15 bp, Homo sapiens
cggaatagccaaaat

SEQ ID NO: 178275 - DNA, 15 bp, Homo sapiens
tcggaatagccaaaa

SEQ ID NO: 178276 - DNA, 15 bp, Homo sapiens
ttcggaatagccaaa

SEQ ID NO: 178277 - DNA, 15 bp, Homo sapiens
attcggaatagccaa

SEQ ID NO: 178278 - DNA, 15 bp, Homo sapiens
tattcggaatagcca

SEQ ID NO: 178279 - DNA, 15 bp, Homo sapiens
ttattcggaatagcc

SEQ ID NO: 178280 - DNA, 15 bp, Homo sapiens
attattcggaatagc

SEQ ID NO: 178281 - DNA, 15 bp, Homo sapiens
cattattcggaatag

SEQ ID NO: 178282 - DNA, 15 bp, Homo sapiens
gcattattcggaata

SEQ ID NO: 178283 - DNA, 15 bp, Homo sapiens
agcattattcggaat

SEQ ID NO: 178284 - DNA, 15 bp, Homo sapiens
cagcattattcggaa

SEQ ID NO: 178285 - DNA, 15 bp, Homo sapiens
gcagcattattcgga

SEQ ID NO: 178286 - DNA, 15 bp, Homo sapiens
agcagcattattcgg

SEQ ID NO: 178287 - DNA, 15 bp, Homo sapiens
tagcagcattattcg

SEQ ID NO: 178288 - DNA, 15 bp, Homo sapiens
aaatgttcatagcag

SEQ ID NO: 178289 - DNA, 15 bp, Homo sapiens
taaatgttcatagca

SEQ ID NO: 178290 - DNA, 15 bp, Homo sapiens
ataaatgttcatagc

SEQ ID NO: 178291 - DNA, 15 bp, Homo sapiens
cataaatgttcatag

SEQ ID NO: 178292 - DNA, 15 bp, Homo sapiens
acataaatgttcata

SEQ ID NO: 178293 - DNA, 15 bp, Homo sapiens
cacataaatgttcat

SEQ ID NO: 178294 - DNA, 15 bp, Homo sapiens
gcacataaatgttca

SEQ ID NO: 178295 - DNA, 15 bp, Homo sapiens
tgcacataaatgttc

SEQ ID NO: 178296 - DNA, 15 bp, Homo sapiens
ttgcacataaatgtt

SEQ ID NO: 178297 - DNA, 15 bp, Homo sapiens
cttgcacataaatgt

SEQ ID NO: 178298 - DNA, 15 bp, Homo sapiens
acttgcacataaatg

SEQ ID NO: 178299 - DNA, 15 bp, Homo sapiens
aacttgcacataaat

SEQ ID NO: 178300 - DNA, 15 bp, Homo sapiens
aaacttgcacataaa

SEQ ID NO: 178301 - DNA, 15 bp, Homo sapiens
aaaacttgcacataa

SEQ ID NO: 178302 - DNA, 15 bp, Homo sapiens
aaaaacttgcacata

SEQ ID NO: 178303 - DNA, 15 bp, Homo sapiens
caaaaacttgcacat

SEQ ID NO: 178304 - DNA, 15 bp, Homo sapiens
acaaaaacttgcaca

SEQ ID NO: 178305 - DNA, 15 bp, Homo sapiens
cacaaaaacttgcac

SEQ ID NO: 178306 - DNA, 15 bp, Homo sapiens
acacaaaaacttgca

SEQ ID NO: 178307 - DNA, 15 bp, Homo sapiens
cacacaaaaacttgc

SEQ ID NO: 178308 - DNA, 15 bp, Homo sapiens
ccacacaaaaacttg

SEQ ID NO: 178309 - DNA, 15 bp, Homo sapiens
accacacaaaaactt

SEQ ID NO: 178310 - DNA, 15 bp, Homo sapiens
aaccacacaaaaact

SEQ ID NO: 178311 - DNA, 15 bp, Homo sapiens
aaaccacacaaaaac

SEQ ID NO: 178312 - DNA, 15 bp, Homo sapiens
aaaaccacacaaaaa

SEQ ID NO: 178313 - DNA, 15 bp, Homo sapiens
taaaaccacacaaaa

SEQ ID NO: 178314 - DNA, 15 bp, Homo sapiens
ataaaaccacacaaa

SEQ ID NO: 178315 - DNA, 15 bp, Homo sapiens
aataaaaccacacaa

SEQ ID NO: 178316 - DNA, 15 bp, Homo sapiens
gaataaaaccacaca

SEQ ID NO: 178317 - DNA, 15 bp, Homo sapiens
ggaataaaaccacac

SEQ ID NO: 178318 - DNA, 15 bp, Homo sapiens
aggaataaaaccaca

SEQ ID NO: 178319 - DNA, 15 bp, Homo sapiens
gaggaataaaaccac

SEQ ID NO: 178320 - DNA, 15 bp, Homo sapiens
agaggaataaaacca

SEQ ID NO: 178321 - DNA, 15 bp, Homo sapiens
aagaggaataaaacc

SEQ ID NO: 178322 - DNA, 15 bp, Homo sapiens
caagaggaataaaac

SEQ ID NO: 178323 - DNA, 15 bp, Homo sapiens
tcaagaggaataaaa

SEQ ID NO: 178324 - DNA, 15 bp, Homo sapiens
ctcaagaggaataaa

SEQ ID NO: 178325 - DNA, 15 bp, Homo sapiens
actcaagaggaataa

SEQ ID NO: 178326 - DNA, 15 bp, Homo sapiens
tactcaagaggaata

SEQ ID NO: 178327 - DNA, 15 bp, Homo sapiens
ctactcaagaggaat

SEQ ID NO: 178328 - DNA, 15 bp, Homo sapiens
tctactcaagaggaa

SEQ ID NO: 178329 - DNA, 15 bp, Homo sapiens
ttctactcaagagga

SEQ ID NO: 178330 - DNA, 15 bp, Homo sapiens
gttctactcaagagg

SEQ ID NO: 178331 - DNA, 15 bp, Homo sapiens
agttctactcaagag

SEQ ID NO: 178332 - DNA, 15 bp, Homo sapiens
cagttctactcaaga

SEQ ID NO: 178333 - DNA, 15 bp, Homo sapiens
gcagttctactcaag

SEQ ID NO: 178334 - DNA, 15 bp, Homo sapiens
agcagttctactcaa

SEQ ID NO: 178335 - DNA, 15 bp, Homo sapiens
tagcagttctactca

SEQ ID NO: 178336 - DNA, 15 bp, Homo sapiens
ctagcagttctactc

SEQ ID NO: 178337 - DNA, 15 bp, Homo sapiens
cctagcagttctact

SEQ ID NO: 178338 - DNA, 15 bp, Homo sapiens
gcctagcagttctac

SEQ ID NO: 178339 - DNA, 15 bp, Homo sapiens
ggcctagcagttcta

SEQ ID NO: 178340 - DNA, 15 bp, Homo sapiens
aggcctagcagttct

SEQ ID NO: 178341 - DNA, 15 bp, Homo sapiens
caggcctagcagttc

SEQ ID NO: 178342 - DNA, 15 bp, Homo sapiens
acaggcctagcagtt

SEQ ID NO: 178343 - DNA, 15 bp, Homo sapiens
aacaggcctagcagt

SEQ ID NO: 178344 - DNA, 15 bp, Homo sapiens
taacaggcctagcag

SEQ ID NO: 178345 - DNA, 15 bp, Homo sapiens
ttaacaggcctagca

SEQ ID NO: 178346 - DNA, 15 bp, Homo sapiens
attaacaggcctagc

SEQ ID NO: 178347 - DNA, 15 bp, Homo sapiens
tattaacaggcctag

SEQ ID NO: 178348 - DNA, 15 bp, Homo sapiens
atattaacaggccta

SEQ ID NO: 178349 - DNA, 15 bp, Homo sapiens
catattaacaggcct

SEQ ID NO: 178350 - DNA, 15 bp, Homo sapiens
acatattaacaggcc

SEQ ID NO: 178351 - DNA, 15 bp, Homo sapiens
aacatattaacaggc

SEQ ID NO: 178352 - DNA, 15 bp, Homo sapiens
aaacatattaacagg

SEQ ID NO: 178353 - DNA, 15 bp, Homo sapiens
aaaacatattaacag

SEQ ID NO: 178354 - DNA, 15 bp, Homo sapiens
aaaaacatattaaca

SEQ ID NO: 178355 - DNA, 15 bp, Homo sapiens
taaaaacatattaac

SEQ ID NO: 178356 - DNA, 15 bp, Homo sapiens
ctaaaaacatattaa

SEQ ID NO: 178357 - DNA, 15 bp, Homo sapiens
actaaaaacatatta

SEQ ID NO: 178358 - DNA, 15 bp, Homo sapiens
gactaaaaacatatt

SEQ ID NO: 178359 - DNA, 15 bp, Homo sapiens
agactaaaaacatat

SEQ ID NO: 178360 - DNA, 15 bp, Homo sapiens
aagactaaaaacata

SEQ ID NO: 178361 - DNA, 15 bp, Homo sapiens
aaagactaaaaacat

SEQ ID NO: 178362 - DNA, 15 bp, Homo sapiens
aaaagactaaaaaca

SEQ ID NO: 178363 - DNA, 15 bp, Homo sapiens
caaaagactaaaaac

SEQ ID NO: 178364 - DNA, 15 bp, Homo sapiens
acaaaagactaaaaa

SEQ ID NO: 178365 - DNA, 15 bp, Homo sapiens
cacaaaagactaaaa

SEQ ID NO: 178366 - DNA, 15 bp, Homo sapiens
acacaaaagactaaa

SEQ ID NO: 178367 - DNA, 15 bp, Homo sapiens
tacacaaaagactaa

SEQ ID NO: 178368 - DNA, 15 bp, Homo sapiens
atacacaaaagacta

SEQ ID NO: 178369 - DNA, 15 bp, Homo sapiens
tatacacaaaagact

SEQ ID NO: 178370 - DNA, 15 bp, Homo sapiens
atatacacaaaagac

SEQ ID NO: 178371 - DNA, 15 bp, Homo sapiens
tatatacacaaaaga

SEQ ID NO: 178372 - DNA, 15 bp, Homo sapiens
atatatacacaaaag

SEQ ID NO: 178373 - DNA, 15 bp, Homo sapiens
catatatacacaaaa

SEQ ID NO: 178374 - DNA, 15 bp, Homo sapiens
ccatatatacacaaa

SEQ ID NO: 178375 - DNA, 15 bp, Homo sapiens
cccatatatacacaa

SEQ ID NO: 178376 - DNA, 15 bp, Homo sapiens
tcccatatatacaca

SEQ ID NO: 178377 - DNA, 15 bp, Homo sapiens
ttcccatatatacac

SEQ ID NO: 178378 - DNA, 15 bp, Homo sapiens
attcccatatataca

SEQ ID NO: 178379 - DNA, 15 bp, Homo sapiens
tattcccatatatac

SEQ ID NO: 178380 - DNA, 15 bp, Homo sapiens
atattcccatatata

SEQ ID NO: 178381 - DNA, 15 bp, Homo sapiens
aatattcccatatat

SEQ ID NO: 178382 - DNA, 15 bp, Homo sapiens
caatattcccatata

SEQ ID NO: 178383 - DNA, 15 bp, Homo sapiens
acaatattcccatat

SEQ ID NO: 178384 - DNA, 15 bp, Homo sapiens
gacaatattcccata

SEQ ID NO: 178385 - DNA, 15 bp, Homo sapiens
tgacaatattcccat

SEQ ID NO: 178386 - DNA, 15 bp, Homo sapiens
gtgacaatattccca

SEQ ID NO: 178387 - DNA, 15 bp, Homo sapiens
ggtgacaatattccc

SEQ ID NO: 178388 - DNA, 15 bp, Homo sapiens
aggtgacaatattcc

SEQ ID NO: 178389 - DNA, 15 bp, Homo sapiens
taggtgacaatattc

SEQ ID NO: 178390 - DNA, 15 bp, Homo sapiens
ctaggtgacaatatt

SEQ ID NO: 178391 - DNA, 15 bp, Homo sapiens
actaggtgacaatat

SEQ ID NO: 178392 - DNA, 15 bp, Homo sapiens
tactaggtgacaata

SEQ ID NO: 178393 - DNA, 15 bp, Homo sapiens
atactaggtgacaat

SEQ ID NO: 178394 - DNA, 15 bp, Homo sapiens
catactaggtgacaa

SEQ ID NO: 178395 - DNA, 15 bp, Homo sapiens
tcatactaggtgaca

SEQ ID NO: 178396 - DNA, 15 bp, Homo sapiens
ttcatactaggtgac

SEQ ID NO: 178397 - DNA, 15 bp, Homo sapiens
tttcatactaggtga

SEQ ID NO: 178398 - DNA, 15 bp, Homo sapiens
atttcatactaggtg

SEQ ID NO: 178399 - DNA, 15 bp, Homo sapiens
catttcatactaggt

SEQ ID NO: 178400 - DNA, 15 bp, Homo sapiens
ccatttcatactagg

SEQ ID NO: 178401 - DNA, 15 bp, Homo sapiens
accatttcatactag

SEQ ID NO: 178402 - DNA, 15 bp, Homo sapiens
aaccatttcatacta

SEQ ID NO: 178403 - DNA, 15 bp, Homo sapiens
aaaccatttcatact

SEQ ID NO: 178404 - DNA, 15 bp, Homo sapiens
aaaaccatttcatac

SEQ ID NO: 178405 - DNA, 15 bp, Homo sapiens
aaaaaccatttcata

SEQ ID NO: 178406 - DNA, 15 bp, Homo sapiens
taaaaaccatttcat

SEQ ID NO: 178407 - DNA, 15 bp, Homo sapiens
ttaaaaaccatttca

SEQ ID NO: 178408 - DNA, 15 bp, Homo sapiens
tttaaaaaccatttc

SEQ ID NO: 178409 - DNA, 15 bp, Homo sapiens
ctttaaaaaccattt

SEQ ID NO: 178410 - DNA, 15 bp, Homo sapiens
cctttaaaaaccatt

SEQ ID NO: 178411 - DNA, 15 bp, Homo sapiens
gcctttaaaaaccat

SEQ ID NO: 178412 - DNA, 15 bp, Homo sapiens
tgcctttaaaaacca

SEQ ID NO: 178413 - DNA, 15 bp, Homo sapiens
ttgcctttaaaaacc

SEQ ID NO: 178414 - DNA, 15 bp, Homo sapiens
attgcctttaaaaac

SEQ ID NO: 178415 - DNA, 15 bp, Homo sapiens
gattgcctttaaaaa

SEQ ID NO: 178416 - DNA, 15 bp, Homo sapiens
tgattgcctttaaaa

SEQ ID NO: 178417 - DNA, 15 bp, Homo sapiens
ttgattgcctttaaa

SEQ ID NO: 178418 - DNA, 15 bp, Homo sapiens
gttgattgcctttaa

SEQ ID NO: 178419 - DNA, 15 bp, Homo sapiens
tgttgattgccttta

SEQ ID NO: 178420 - DNA, 15 bp, Homo sapiens
ttgttgattgccttt

SEQ ID NO: 178421 - DNA, 15 bp, Homo sapiens
attgttgattgcctt

SEQ ID NO: 178422 - DNA, 15 bp, Homo sapiens
gattgttgattgcct

SEQ ID NO: 178423 - DNA, 15 bp, Homo sapiens
agattgttgattgcc

SEQ ID NO: 178424 - DNA, 15 bp, Homo sapiens
tagattgttgattgc

SEQ ID NO: 178425 - DNA, 15 bp, Homo sapiens
ttagattgttgattg

SEQ ID NO: 178426 - DNA, 15 bp, Homo sapiens
tttagattgttgatt

SEQ ID NO: 178427 - DNA, 15 bp, Homo sapiens
ttttagattgttgat

SEQ ID NO: 178428 - DNA, 15 bp, Homo sapiens
gttttagattgttga

SEQ ID NO: 178429 - DNA, 15 bp, Homo sapiens
ggttttagattgttg

SEQ ID NO: 178430 - DNA, 15 bp, Homo sapiens
aggttttagattgtt

SEQ ID NO: 178431 - DNA, 15 bp, Homo sapiens
gaggttttagattgt

SEQ ID NO: 178432 - DNA, 15 bp, Homo sapiens
ggaggttttagattg

SEQ ID NO: 178433 - DNA, 15 bp, Homo sapiens
tggaggttttagatt

SEQ ID NO: 178434 - DNA, 15 bp, Homo sapiens
ctggaggttttagat

SEQ ID NO: 178435 - DNA, 15 bp, Homo sapiens
actggaggttttaga

SEQ ID NO: 178436 - DNA, 15 bp, Homo sapiens
aactggaggttttag

SEQ ID NO: 178437 - DNA, 15 bp, Homo sapiens
taactggaggtttta

SEQ ID NO: 178438 - DNA, 15 bp, Homo sapiens
ataactggaggtttt

SEQ ID NO: 178439 - DNA, 15 bp, Homo sapiens
aataactggaggttt

SEQ ID NO: 178440 - DNA, 15 bp, Homo sapiens
aaataactggaggtt

SEQ ID NO: 178441 - DNA, 15 bp, Homo sapiens
caaataactggaggt

SEQ ID NO: 178442 - DNA, 15 bp, Homo sapiens
acaaataactggagg

SEQ ID NO: 178443 - DNA, 15 bp, Homo sapiens
cacaaataactggag

SEQ ID NO: 178444 - DNA, 15 bp, Homo sapiens
acacaaataactgga

SEQ ID NO: 178445 - DNA, 15 bp, Homo sapiens
cacacaaataactgg

SEQ ID NO: 178446 - DNA, 15 bp, Homo sapiens
acacacaaataactg

SEQ ID NO: 178447 - DNA, 15 bp, Homo sapiens
aacacacaaataact

SEQ ID NO: 178448 - DNA, 15 bp, Homo sapiens
aaacacacaaataac

SEQ ID NO: 178449 - DNA, 15 bp, Homo sapiens
aaaacacacaaataa

SEQ ID NO: 178450 - DNA, 15 bp, Homo sapiens
aaaaacacacaaata

SEQ ID NO: 178451 - DNA, 15 bp, Homo sapiens
aaaaaacacacaaat

SEQ ID NO: 178452 - DNA, 15 bp, Homo sapiens
aaaaaaacacacaaa

SEQ ID NO: 178453 - DNA, 15 bp, Homo sapiens
aaaaaaaacacacaa

SEQ ID NO: 178454 - DNA, 15 bp, Homo sapiens
aaaaaaaaacacaca

SEQ ID NO: 178455 - DNA, 15 bp, Homo sapiens
aaaaaaaaaacacac

SEQ ID NO: 178456 - DNA, 15 bp, Homo sapiens
tgtctccaaaaaaaa

SEQ ID NO: 178457 - DNA, 15 bp, Homo sapiens
atgtctccaaaaaaa

SEQ ID NO: 178458 - DNA, 15 bp, Homo sapiens
catgtctccaaaaaa

SEQ ID NO: 178459 - DNA, 15 bp, Homo sapiens
tcatgtctccaaaaa

SEQ ID NO: 178460 - DNA, 15 bp, Homo sapiens
ctcatgtctccaaaa

SEQ ID NO: 178461 - DNA, 15 bp, Homo sapiens
tctcatgtctccaaa

SEQ ID NO: 178462 - DNA, 15 bp, Homo sapiens
gtctcatgtctccaa

SEQ ID NO: 178463 - DNA, 15 bp, Homo sapiens
tgtctcatgtctcca

SEQ ID NO: 178464 - DNA, 15 bp, Homo sapiens
ctgtctcatgtctcc

SEQ ID NO: 178465 - DNA, 15 bp, Homo sapiens
cctgtctcatgtctc

SEQ ID NO: 178466 - DNA, 15 bp, Homo sapiens
ccctgtctcatgtct

SEQ ID NO: 178467 - DNA, 15 bp, Homo sapiens
accctgtctcatgtc

SEQ ID NO: 178468 - DNA, 15 bp, Homo sapiens
aaccctgtctcatgt

SEQ ID NO: 178469 - DNA, 15 bp, Homo sapiens
aaaccctgtctcatg

SEQ ID NO: 178470 - DNA, 15 bp, Homo sapiens
aaaaccctgtctcat

SEQ ID NO: 178471 - DNA, 15 bp, Homo sapiens
taaaaccctgtctca

SEQ ID NO: 178472 - DNA, 15 bp, Homo sapiens
agtaaaaccctgtct

SEQ ID NO: 178473 - DNA, 15 bp, Homo sapiens
cagtaaaaccctgtc

SEQ ID NO: 178474 - DNA, 15 bp, Homo sapiens
acagtaaaaccctgt

SEQ ID NO: 178475 - DNA, 15 bp, Homo sapiens
cacagtaaaaccctg

SEQ ID NO: 178476 - DNA, 15 bp, Homo sapiens
acacagtaaaaccct

SEQ ID NO: 178477 - DNA, 15 bp, Homo sapiens
gacacagtaaaaccc

SEQ ID NO: 178478 - DNA, 15 bp, Homo sapiens
tgacacagtaaaacc

SEQ ID NO: 178479 - DNA, 15 bp, Homo sapiens
gtgacacagtaaaac

SEQ ID NO: 178480 - DNA, 15 bp, Homo sapiens
ggtgacacagtaaaa

SEQ ID NO: 178481 - DNA, 15 bp, Homo sapiens
gggtgacacagtaaa

SEQ ID NO: 178482 - DNA, 15 bp, Homo sapiens
tgggtgacacagtaa

SEQ ID NO: 178483 - DNA, 15 bp, Homo sapiens
ctgggtgacacagta

SEQ ID NO: 178484 - DNA, 15 bp, Homo sapiens
cctgggtgacacagt

SEQ ID NO: 178485 - DNA, 15 bp, Homo sapiens
gcctgggtgacacag

SEQ ID NO: 178486 - DNA, 15 bp, Homo sapiens
agcctgggtgacaca

SEQ ID NO: 178487 - DNA, 15 bp, Homo sapiens
tagcctgggtgacac

SEQ ID NO: 178488 - DNA, 15 bp, Homo sapiens
gactctagcctgggt

SEQ ID NO: 178489 - DNA, 15 bp, Homo sapiens
ggactctagcctggg

SEQ ID NO: 178490 - DNA, 15 bp, Homo sapiens
tggactctagcctgg

SEQ ID NO: 178491 - DNA, 15 bp, Homo sapiens
ttggactctagcctg

SEQ ID NO: 178492 - DNA, 15 bp, Homo sapiens
cttggactctagcct

SEQ ID NO: 178493 - DNA, 15 bp, Homo sapiens
acttggactctagcc

SEQ ID NO: 178494 - DNA, 15 bp, Homo sapiens
tacttggactctagc

SEQ ID NO: 178495 - DNA, 15 bp, Homo sapiens
ctacttggactctag

SEQ ID NO: 178496 - DNA, 15 bp, Homo sapiens
actacttggactcta

SEQ ID NO: 178497 - DNA, 15 bp, Homo sapiens
tactacttggactct

SEQ ID NO: 178498 - DNA, 15 bp, Homo sapiens
atactacttggactc

SEQ ID NO: 178499 - DNA, 15 bp, Homo sapiens
catactacttggact

SEQ ID NO: 178500 - DNA, 15 bp, Homo sapiens
tcatactacttggac

SEQ ID NO: 178501 - DNA, 15 bp, Homo sapiens
atcatactacttgga

SEQ ID NO: 178502 - DNA, 15 bp, Homo sapiens
gatcatactacttgg

SEQ ID NO: 178503 - DNA, 15 bp, Homo sapiens
agatcatactacttg

SEQ ID NO: 178504 - DNA, 15 bp, Homo sapiens
cagatcatactactt

SEQ ID NO: 178505 - DNA, 15 bp, Homo sapiens
ccagatcatactact

SEQ ID NO: 178506 - DNA, 15 bp, Homo sapiens
cccagatcatactac

SEQ ID NO: 178507 - DNA, 15 bp, Homo sapiens
gcccagatcatacta

SEQ ID NO: 178508 - DNA, 15 bp, Homo sapiens
agcccagatcatact

SEQ ID NO: 178509 - DNA, 15 bp, Homo sapiens
gagcccagatcatac

SEQ ID NO: 178510 - DNA, 15 bp, Homo sapiens
tgagcccagatcata

SEQ ID NO: 178511 - DNA, 15 bp, Homo sapiens
gtgagcccagatcat

SEQ ID NO: 178512 - DNA, 15 bp, Homo sapiens
agtgagcccagatca

SEQ ID NO: 178513 - DNA, 15 bp, Homo sapiens
tagtgagcccagatc

SEQ ID NO: 178514 - DNA, 15 bp, Homo sapiens
gtagtgagcccagat

SEQ ID NO: 178515 - DNA, 15 bp, Homo sapiens
tgtagtgagcccaga

SEQ ID NO: 178516 - DNA, 15 bp, Homo sapiens
ctgtagtgagcccag

SEQ ID NO: 178517 - DNA, 15 bp, Homo sapiens
gctgtagtgagccca

SEQ ID NO: 178518 - DNA, 15 bp, Homo sapiens
ggctgtagtgagccc

SEQ ID NO: 178519 - DNA, 15 bp, Homo sapiens
aggctgtagtgagcc

SEQ ID NO: 178520 - DNA, 15 bp, Homo sapiens
aaggctgtagtgagc

SEQ ID NO: 178521 - DNA, 15 bp, Homo sapiens
caaggctgtagtgag

SEQ ID NO: 178522 - DNA, 15 bp, Homo sapiens
tcaaggctgtagtga

SEQ ID NO: 178523 - DNA, 15 bp, Homo sapiens
gtcaaggctgtagtg

SEQ ID NO: 178524 - DNA, 15 bp, Homo sapiens
ggtcaaggctgtagt

SEQ ID NO: 178525 - DNA, 15 bp, Homo sapiens
aggtcaaggctgtag

SEQ ID NO: 178526 - DNA, 15 bp, Homo sapiens
gaggtcaaggctgta

SEQ ID NO: 178527 - DNA, 15 bp, Homo sapiens
ggaggtcaaggctgt

SEQ ID NO: 178528 - DNA, 15 bp, Homo sapiens
cgcttgagcccagga

SEQ ID NO: 178529 - DNA, 15 bp, Homo sapiens
tcgcttgagcccagg

SEQ ID NO: 178530 - DNA, 15 bp, Homo sapiens
atcgcttgagcccag

SEQ ID NO: 178531 - DNA, 15 bp, Homo sapiens
gatcgcttgagccca

SEQ ID NO: 178532 - DNA, 15 bp, Homo sapiens
ggatcgcttgagccc

SEQ ID NO: 178533 - DNA, 15 bp, Homo sapiens
aggatcgcttgagcc

SEQ ID NO: 178534 - DNA, 15 bp, Homo sapiens
gaggatcgcttgagc

SEQ ID NO: 178535 - DNA, 15 bp, Homo sapiens
agaggtgggaggatc

SEQ ID NO: 178536 - DNA, 15 bp, Homo sapiens
cagaggtgggaggat

SEQ ID NO: 178537 - DNA, 15 bp, Homo sapiens
gcagaggtgggagga

SEQ ID NO: 178538 - DNA, 15 bp, Homo sapiens
ggcagaggtgggagg

SEQ ID NO: 178539 - DNA, 15 bp, Homo sapiens
aggcagaggtgggag

SEQ ID NO: 178540 - DNA, 15 bp, Homo sapiens
taggcagaggtggga

SEQ ID NO: 178541 - DNA, 15 bp, Homo sapiens
gtaggcagaggtggg

SEQ ID NO: 178542 - DNA, 15 bp, Homo sapiens
agtaggcagaggtgg

SEQ ID NO: 178543 - DNA, 15 bp, Homo sapiens
tagtaggcagaggtg

SEQ ID NO: 178544 - DNA, 15 bp, Homo sapiens
ttagtaggcagaggt

SEQ ID NO: 178545 - DNA, 15 bp, Homo sapiens
cttagtaggcagagg

SEQ ID NO: 178546 - DNA, 15 bp, Homo sapiens
acttagtaggcagag

SEQ ID NO: 178547 - DNA, 15 bp, Homo sapiens
tacttagtaggcaga

SEQ ID NO: 178548 - DNA, 15 bp, Homo sapiens
ctacttagtaggcag

SEQ ID NO: 178549 - DNA, 15 bp, Homo sapiens
gctacttagtaggca

SEQ ID NO: 178550 - DNA, 15 bp, Homo sapiens
agctacttagtaggc

SEQ ID NO: 178551 - DNA, 15 bp, Homo sapiens
cagctacttagtagg

SEQ ID NO: 178552 - DNA, 15 bp, Homo sapiens
ccagctacttagtag

SEQ ID NO: 178553 - DNA, 15 bp, Homo sapiens
cccagctacttagta

SEQ ID NO: 178554 - DNA, 15 bp, Homo sapiens
tcccagctacttagt

SEQ ID NO: 178555 - DNA, 15 bp, Homo sapiens
gtcccagctacttag

SEQ ID NO: 178556 - DNA, 15 bp, Homo sapiens
ggtcccagctactta

SEQ ID NO: 178557 - DNA, 15 bp, Homo sapiens
gtgtgcctgtggtcc

SEQ ID NO: 178558 - DNA, 15 bp, Homo sapiens
tgtgtgcctgtggtc

SEQ ID NO: 178559 - DNA, 15 bp, Homo sapiens
gtgtgtgcctgtggt

SEQ ID NO: 178560 - DNA, 15 bp, Homo sapiens
ggtgtgtgcctgtgg

SEQ ID NO: 178561 - DNA, 15 bp, Homo sapiens
tggtgtgtgcctgtg

SEQ ID NO: 178562 - DNA, 15 bp, Homo sapiens
gtggtgtgtgcctgt

SEQ ID NO: 178563 - DNA, 15 bp, Homo sapiens
ggtggtgtgtgcctg

SEQ ID NO: 178564 - DNA, 15 bp, Homo sapiens
tggtggtgtgtgcct

SEQ ID NO: 178565 - DNA, 15 bp, Homo sapiens
gtggtggtgtgtgcc

SEQ ID NO: 178566 - DNA, 15 bp, Homo sapiens
ggtggtggtgtgtgc

SEQ ID NO: 178567 - DNA, 15 bp, Homo sapiens
aggtggtggtgtgtg

SEQ ID NO: 178568 - DNA, 15 bp, Homo sapiens
gaggtggtggtgtgt

SEQ ID NO: 178569 - DNA, 15 bp, Homo sapiens
agaggtggtggtgtg

SEQ ID NO: 178570 - DNA, 15 bp, Homo sapiens
cagaggtggtggtgt

SEQ ID NO: 178571 - DNA, 15 bp, Homo sapiens
ccagaggtggtggtg

SEQ ID NO: 178572 - DNA, 15 bp, Homo sapiens
gccagaggtggtggt

SEQ ID NO: 178573 - DNA, 15 bp, Homo sapiens
agccagaggtggtgg

SEQ ID NO: 178574 - DNA, 15 bp, Homo sapiens
tagccagaggtggtg

SEQ ID NO: 178575 - DNA, 15 bp, Homo sapiens
ttagccagaggtggt

SEQ ID NO: 178576 - DNA, 15 bp, Homo sapiens
attagccagaggtgg

SEQ ID NO: 178577 - DNA, 15 bp, Homo sapiens
aattagccagaggtg

SEQ ID NO: 178578 - DNA, 15 bp, Homo sapiens
aaattagccagaggt

SEQ ID NO: 178579 - DNA, 15 bp, Homo sapiens
aaaattagccagagg

SEQ ID NO: 178580 - DNA, 15 bp, Homo sapiens
gaaaattagccagag

SEQ ID NO: 178581 - DNA, 15 bp, Homo sapiens
ggaaaattagccaga

SEQ ID NO: 178582 - DNA, 15 bp, Homo sapiens
aggaaaattagccag

SEQ ID NO: 178583 - DNA, 15 bp, Homo sapiens
taggaaaattagcca

SEQ ID NO: 178584 - DNA, 15 bp, Homo sapiens
ataggaaaattagcc

SEQ ID NO: 178585 - DNA, 15 bp, Homo sapiens
aataggaaaattagc

SEQ ID NO: 178586 - DNA, 15 bp, Homo sapiens
taataggaaaattag

SEQ ID NO: 178587 - DNA, 15 bp, Homo sapiens
ataataggaaaatta

SEQ ID NO: 178588 - DNA, 15 bp, Homo sapiens
aataataggaaaatt

SEQ ID NO: 178589 - DNA, 15 bp, Homo sapiens
aaataataggaaaat

SEQ ID NO: 178590 - DNA, 15 bp, Homo sapiens
caaataataggaaaa

SEQ ID NO: 178591 - DNA, 15 bp, Homo sapiens
acaaataataggaaa

SEQ ID NO: 178592 - DNA, 15 bp, Homo sapiens
tacaaataataggaa

SEQ ID NO: 178593 - DNA, 15 bp, Homo sapiens
ctacaaataatagga

SEQ ID NO: 178594 - DNA, 15 bp, Homo sapiens
tctacaaataatagg

SEQ ID NO: 178595 - DNA, 15 bp, Homo sapiens
atctacaaataatag

SEQ ID NO: 178596 - DNA, 15 bp, Homo sapiens
tatctacaaataata

SEQ ID NO: 178597 - DNA, 15 bp, Homo sapiens
gtatctacaaataat

SEQ ID NO: 178598 - DNA, 15 bp, Homo sapiens
tgtatctacaaataa

SEQ ID NO: 178599 - DNA, 15 bp, Homo sapiens
ctgtatctacaaata

SEQ ID NO: 178600 - DNA, 15 bp, Homo sapiens
cctgtatctacaaat

SEQ ID NO: 178601 - DNA, 15 bp, Homo sapiens
ccctgtatctacaaa

SEQ ID NO: 178602 - DNA, 15 bp, Homo sapiens
accctgtatctacaa

SEQ ID NO: 178603 - DNA, 15 bp, Homo sapiens
aaccctgtatctaca

SEQ ID NO: 178604 - DNA, 15 bp, Homo sapiens
aaaccctgtatctac

SEQ ID NO: 178605 - DNA, 15 bp, Homo sapiens
gaaaccctgtatcta

SEQ ID NO: 178606 - DNA, 15 bp, Homo sapiens
cgaaaccctgtatct

SEQ ID NO: 178607 - DNA, 15 bp, Homo sapiens
gcgaaaccctgtatc

SEQ ID NO: 178608 - DNA, 15 bp, Homo sapiens
ggcgaaaccctgtat

SEQ ID NO: 178609 - DNA, 15 bp, Homo sapiens
tggcgaaaccctgta

SEQ ID NO: 178610 - DNA, 15 bp, Homo sapiens
gtggcgaaaccctgt

SEQ ID NO: 178611 - DNA, 15 bp, Homo sapiens
tgtggcgaaaccctg

SEQ ID NO: 178612 - DNA, 15 bp, Homo sapiens
atgtggcgaaaccct

SEQ ID NO: 178613 - DNA, 15 bp, Homo sapiens
aatgtggcgaaaccc

SEQ ID NO: 178614 - DNA, 15 bp, Homo sapiens
taatgtggcgaaacc

SEQ ID NO: 178615 - DNA, 15 bp, Homo sapiens
gtaatgtggcgaaac

SEQ ID NO: 178616 - DNA, 15 bp, Homo sapiens
ggtaatgtggcgaaa

SEQ ID NO: 178617 - DNA, 15 bp, Homo sapiens
tggtaatgtggcgaa

SEQ ID NO: 178618 - DNA, 15 bp, Homo sapiens
ttggtaatgtggcga

SEQ ID NO: 178619 - DNA, 15 bp, Homo sapiens
cttggtaatgtggcg

SEQ ID NO: 178620 - DNA, 15 bp, Homo sapiens
ccttggtaatgtggc

SEQ ID NO: 178621 - DNA, 15 bp, Homo sapiens
gccttggtaatgtgg

SEQ ID NO: 178622 - DNA, 15 bp, Homo sapiens
agccttggtaatgtg

SEQ ID NO: 178623 - DNA, 15 bp, Homo sapiens
cagccttggtaatgt

SEQ ID NO: 178624 - DNA, 15 bp, Homo sapiens
gcagccttggtaatg

SEQ ID NO: 178625 - DNA, 15 bp, Homo sapiens
agcagccttggtaat

SEQ ID NO: 178626 - DNA, 15 bp, Homo sapiens
gagcagccttggtaa

SEQ ID NO: 178627 - DNA, 15 bp, Homo sapiens
agagcagccttggta

SEQ ID NO: 178628 - DNA, 15 bp, Homo sapiens
gagagcagccttggt

SEQ ID NO: 178629 - DNA, 15 bp, Homo sapiens
ggagagcagccttgg

SEQ ID NO: 178630 - DNA, 15 bp, Homo sapiens
tggagagcagccttg

SEQ ID NO: 178631 - DNA, 15 bp, Homo sapiens
ttggagagcagcctt

SEQ ID NO: 178632 - DNA, 15 bp, Homo sapiens
gttggagagcagcct

SEQ ID NO: 178633 - DNA, 15 bp, Homo sapiens
agttggagagcagcc

SEQ ID NO: 178634 - DNA, 15 bp, Homo sapiens
gagttggagagcagc

SEQ ID NO: 178635 - DNA, 15 bp, Homo sapiens
agagttggagagcag

SEQ ID NO: 178636 - DNA, 15 bp, Homo sapiens
cagagttggagagca

SEQ ID NO: 178637 - DNA, 15 bp, Homo sapiens
tcagagttggagagc

SEQ ID NO: 178638 - DNA, 15 bp, Homo sapiens
ctcagagttggagag

SEQ ID NO: 178639 - DNA, 15 bp, Homo sapiens
cctcagagttggaga

SEQ ID NO: 178640 - DNA, 15 bp, Homo sapiens
gcctcagagttggag

SEQ ID NO: 178641 - DNA, 15 bp, Homo sapiens
agcctcagagttgga

SEQ ID NO: 178642 - DNA, 15 bp, Homo sapiens
aagcctcagagttgg

SEQ ID NO: 178643 - DNA, 15 bp, Homo sapiens
gaagcctcagagttg

SEQ ID NO: 178644 - DNA, 15 bp, Homo sapiens
tgaagcctcagagtt

SEQ ID NO: 178645 - DNA, 15 bp, Homo sapiens
ctgaagcctcagagt

SEQ ID NO: 178646 - DNA, 15 bp, Homo sapiens
actgaagcctcagag

SEQ ID NO: 178647 - DNA, 15 bp, Homo sapiens
cactgaagcctcaga

SEQ ID NO: 178648 - DNA, 15 bp, Homo sapiens
tcactgaagcctcag

SEQ ID NO: 178649 - DNA, 15 bp, Homo sapiens
atcactgaagcctca

SEQ ID NO: 178650 - DNA, 15 bp, Homo sapiens
aatcactgaagcctc

SEQ ID NO: 178651 - DNA, 15 bp, Homo sapiens
aaatcactgaagcct

SEQ ID NO: 178652 - DNA, 15 bp, Homo sapiens
caaatcactgaagcc

SEQ ID NO: 178653 - DNA, 15 bp, Homo sapiens
gcaaatcactgaagc

SEQ ID NO: 178654 - DNA, 15 bp, Homo sapiens
ggcaaatcactgaag

SEQ ID NO: 178655 - DNA, 15 bp, Homo sapiens
gggcaaatcactgaa

SEQ ID NO: 178656 - DNA, 15 bp, Homo sapiens
tgggcaaatcactga

SEQ ID NO: 178657 - DNA, 15 bp, Homo sapiens
gtgggcaaatcactg

SEQ ID NO: 178658 - DNA, 15 bp, Homo sapiens
ggtgggcaaatcact

SEQ ID NO: 178659 - DNA, 15 bp, Homo sapiens
aggtgggcaaatcac

SEQ ID NO: 178660 - DNA, 15 bp, Homo sapiens
aaggtgggcaaatca

SEQ ID NO: 178661 - DNA, 15 bp, Homo sapiens
caaggtgggcaaatc

SEQ ID NO: 178662 - DNA, 15 bp, Homo sapiens
ccaaggtgggcaaat

SEQ ID NO: 178663 - DNA, 15 bp, Homo sapiens
gccaaggtgggcaaa

SEQ ID NO: 178664 - DNA, 15 bp, Homo sapiens
ggccaaggtgggcaa

SEQ ID NO: 178665 - DNA, 15 bp, Homo sapiens
aggccaaggtgggca

SEQ ID NO: 178666 - DNA, 15 bp, Homo sapiens
gaggccaaggtgggc

SEQ ID NO: 178667 - DNA, 15 bp, Homo sapiens
ggaggccaaggtggg

SEQ ID NO: 178668 - DNA, 15 bp, Homo sapiens
gggaggccaaggtgg

SEQ ID NO: 178669 - DNA, 15 bp, Homo sapiens
tgggaggccaaggtg

SEQ ID NO: 178670 - DNA, 15 bp, Homo sapiens
ttgggaggccaaggt

SEQ ID NO: 178671 - DNA, 15 bp, Homo sapiens
tctagcactttggga

SEQ ID NO: 178672 - DNA, 15 bp, Homo sapiens
ttctagcactttggg

SEQ ID NO: 178673 - DNA, 15 bp, Homo sapiens
attctagcactttgg

SEQ ID NO: 178674 - DNA, 15 bp, Homo sapiens
aattctagcactttg

SEQ ID NO: 178675 - DNA, 15 bp, Homo sapiens
taattctagcacttt

SEQ ID NO: 178676 - DNA, 15 bp, Homo sapiens
ttaattctagcactt

SEQ ID NO: 178677 - DNA, 15 bp, Homo sapiens
cttaattctagcact

SEQ ID NO: 178678 - DNA, 15 bp, Homo sapiens
ccttaattctagcac

SEQ ID NO: 178679 - DNA, 15 bp, Homo sapiens
cccttaattctagca

SEQ ID NO: 178680 - DNA, 15 bp, Homo sapiens
gcccttaattctagc

SEQ ID NO: 178681 - DNA, 15 bp, Homo sapiens
cgcccttaattctag

SEQ ID NO: 178682 - DNA, 15 bp, Homo sapiens
acgcccttaattcta

SEQ ID NO: 178683 - DNA, 15 bp, Homo sapiens
cacgcccttaattct

SEQ ID NO: 178684 - DNA, 15 bp, Homo sapiens
tcacgcccttaattc

SEQ ID NO: 178685 - DNA, 15 bp, Homo sapiens
ctcacgcccttaatt

SEQ ID NO: 178686 - DNA, 15 bp, Homo sapiens
gctcacgcccttaat

SEQ ID NO: 178687 - DNA, 15 bp, Homo sapiens
ggctcacgcccttaa

SEQ ID NO: 178688 - DNA, 15 bp, Homo sapiens
tggctcacgccctta

SEQ ID NO: 178689 - DNA, 15 bp, Homo sapiens
gtggctcacgccctt

SEQ ID NO: 178690 - DNA, 15 bp, Homo sapiens
ggtggctcacgccct

SEQ ID NO: 178691 - DNA, 15 bp, Homo sapiens
tggtggctcacgccc

SEQ ID NO: 178692 - DNA, 15 bp, Homo sapiens
atggtggctcacgcc

SEQ ID NO: 178693 - DNA, 15 bp, Homo sapiens
catggtggctcacgc

SEQ ID NO: 178694 - DNA, 15 bp, Homo sapiens
caggctgggcatggt

SEQ ID NO: 178695 - DNA, 15 bp, Homo sapiens
gcaggctgggcatgg

SEQ ID NO: 178696 - DNA, 15 bp, Homo sapiens
tgcaggctgggcatg

SEQ ID NO: 178697 - DNA, 15 bp, Homo sapiens
ttgcaggctgggcat

SEQ ID NO: 178698 - DNA, 15 bp, Homo sapiens
attgcaggctgggca

SEQ ID NO: 178699 - DNA, 15 bp, Homo sapiens
cattgcaggctgggc

SEQ ID NO: 178700 - DNA, 15 bp, Homo sapiens
acattgcaggctggg

SEQ ID NO: 178701 - DNA, 15 bp, Homo sapiens
gacattgcaggctgg

SEQ ID NO: 178702 - DNA, 15 bp, Homo sapiens
ggacattgcaggctg

SEQ ID NO: 178703 - DNA, 15 bp, Homo sapiens
aggacattgcaggct

SEQ ID NO: 178704 - DNA, 15 bp, Homo sapiens
aaggacattgcaggc

SEQ ID NO: 178705 - DNA, 15 bp, Homo sapiens
aaaggacattgcagg

SEQ ID NO: 178706 - DNA, 15 bp, Homo sapiens
aaaaggacattgcag

SEQ ID NO: 178707 - DNA, 15 bp, Homo sapiens
gaaaaggacattgca

SEQ ID NO: 178708 - DNA, 15 bp, Homo sapiens
agaaaaggacattgc

SEQ ID NO: 178709 - DNA, 15 bp, Homo sapiens
cagaaaaggacattg

SEQ ID NO: 178710 - DNA, 15 bp, Homo sapiens
tcagaaaaggacatt

SEQ ID NO: 178711 - DNA, 15 bp, Homo sapiens
ttcagaaaaggacat

SEQ ID NO: 178712 - DNA, 15 bp, Homo sapiens
attcagaaaaggaca

SEQ ID NO: 178713 - DNA, 15 bp, Homo sapiens
aattcagaaaaggac

SEQ ID NO: 178714 - DNA, 15 bp, Homo sapiens
gaattcagaaaagga

SEQ ID NO: 178715 - DNA, 15 bp, Homo sapiens
tgaattcagaaaagg

SEQ ID NO: 178716 - DNA, 15 bp, Homo sapiens
atgaattcagaaaag

SEQ ID NO: 178717 - DNA, 15 bp, Homo sapiens
tatgaattcagaaaa

SEQ ID NO: 178718 - DNA, 15 bp, Homo sapiens
ctatgaattcagaaa

SEQ ID NO: 178719 - DNA, 15 bp, Homo sapiens
tctatgaattcagaa

SEQ ID NO: 178720 - DNA, 15 bp, Homo sapiens
gtctatgaattcaga

SEQ ID NO: 178721 - DNA, 15 bp, Homo sapiens
agtctatgaattcag

SEQ ID NO: 178722 - DNA, 15 bp, Homo sapiens
aagtctatgaattca

SEQ ID NO: 178723 - DNA, 15 bp, Homo sapiens
gaagtctatgaattc

SEQ ID NO: 178724 - DNA, 15 bp, Homo sapiens
agaagtctatgaatt

SEQ ID NO: 178725 - DNA, 15 bp, Homo sapiens
gagaagtctatgaat

SEQ ID NO: 178726 - DNA, 15 bp, Homo sapiens
tgagaagtctatgaa

SEQ ID NO: 178727 - DNA, 15 bp, Homo sapiens
ctgagaagtctatga

SEQ ID NO: 178728 - DNA, 15 bp, Homo sapiens
actgagaagtctatg

SEQ ID NO: 178729 - DNA, 15 bp, Homo sapiens
tactgagaagtctat

SEQ ID NO: 178730 - DNA, 15 bp, Homo sapiens
atactgagaagtcta

SEQ ID NO: 178731 - DNA, 15 bp, Homo sapiens
aatactgagaagtct

SEQ ID NO: 178732 - DNA, 15 bp, Homo sapiens
taatactgagaagtc

SEQ ID NO: 178733 - DNA, 15 bp, Homo sapiens
gtaatactgagaagt

SEQ ID NO: 178734 - DNA, 15 bp, Homo sapiens
agtaatactgagaag

SEQ ID NO: 178735 - DNA, 15 bp, Homo sapiens
aagtaatactgagaa

SEQ ID NO: 178736 - DNA, 15 bp, Homo sapiens
taagtaatactgaga

SEQ ID NO: 178737 - DNA, 15 bp, Homo sapiens
ctaagtaatactgag

SEQ ID NO: 178738 - DNA, 15 bp, Homo sapiens
gctaagtaatactga

SEQ ID NO: 178739 - DNA, 15 bp, Homo sapiens
tgctaagtaatactg

SEQ ID NO: 178740 - DNA, 15 bp, Homo sapiens
ctgctaagtaatact

SEQ ID NO: 178741 - DNA, 15 bp, Homo sapiens
gctgctaagtaatac

SEQ ID NO: 178742 - DNA, 15 bp, Homo sapiens
agctgctaagtaata

SEQ ID NO: 178743 - DNA, 15 bp, Homo sapiens
tagctgctaagtaat

SEQ ID NO: 178744 - DNA, 15 bp, Homo sapiens
ctagctgctaagtaa

SEQ ID NO: 178745 - DNA, 15 bp, Homo sapiens
gctagctgctaagta

SEQ ID NO: 178746 - DNA, 15 bp, Homo sapiens
ggctagctgctaagt

SEQ ID NO: 178747 - DNA, 15 bp, Homo sapiens
aggctagctgctaag

SEQ ID NO: 178748 - DNA, 15 bp, Homo sapiens
aaggctagctgctaa

SEQ ID NO: 178749 - DNA, 15 bp, Homo sapiens
aaaggctagctgcta

SEQ ID NO: 178750 - DNA, 15 bp, Homo sapiens
aaaaggctagctgct

SEQ ID NO: 178751 - DNA, 15 bp, Homo sapiens
aaaaaggctagctgc

SEQ ID NO: 178752 - DNA, 15 bp, Homo sapiens
aaaaaaggctagctg

SEQ ID NO: 178753 - DNA, 15 bp, Homo sapiens
aaaaaaaggctagct

SEQ ID NO: 178754 - DNA, 15 bp, Homo sapiens
aaaaaaaaggctagc

SEQ ID NO: 178755 - DNA, 15 bp, Homo sapiens
aaaaaaaaaggctag

SEQ ID NO: 178756 - DNA, 15 bp, Homo sapiens
gaaaaaaaaaggcta

SEQ ID NO: 178757 - DNA, 15 bp, Homo sapiens
agaaaaaaaaaggct

SEQ ID NO: 178758 - DNA, 15 bp, Homo sapiens
aagaaaaaaaaaggc

SEQ ID NO: 178759 - DNA, 15 bp, Homo sapiens
aaaaaaaagaaaaaa

SEQ ID NO: 178760 - DNA, 15 bp, Homo sapiens
aagactccctctcaa

SEQ ID NO: 178761 - DNA, 15 bp, Homo sapiens
taagactccctctca

SEQ ID NO: 178762 - DNA, 15 bp, Homo sapiens
gtaagactccctctc

SEQ ID NO: 178763 - DNA, 15 bp, Homo sapiens
agtaagactccctct

SEQ ID NO: 178764 - DNA, 15 bp, Homo sapiens
aagtaagactccctc

SEQ ID NO: 178765 - DNA, 15 bp, Homo sapiens
aaagtaagactccct

SEQ ID NO: 178766 - DNA, 15 bp, Homo sapiens
caaagtaagactccc

SEQ ID NO: 178767 - DNA, 15 bp, Homo sapiens
acaaagtaagactcc

SEQ ID NO: 178768 - DNA, 15 bp, Homo sapiens
aacaaagtaagactc

SEQ ID NO: 178769 - DNA, 15 bp, Homo sapiens
taacaaagtaagact

SEQ ID NO: 178770 - DNA, 15 bp, Homo sapiens
gtaacaaagtaagac

SEQ ID NO: 178771 - DNA, 15 bp, Homo sapiens
ggtaacaaagtaaga

SEQ ID NO: 178772 - DNA, 15 bp, Homo sapiens
gggtaacaaagtaag

SEQ ID NO: 178773 - DNA, 15 bp, Homo sapiens
tgggtaacaaagtaa

SEQ ID NO: 178774 - DNA, 15 bp, Homo sapiens
ctgggtaacaaagta

SEQ ID NO: 178775 - DNA, 15 bp, Homo sapiens
cgtgtcactgcactc

SEQ ID NO: 178776 - DNA, 15 bp, Homo sapiens
tcgtgtcactgcact

SEQ ID NO: 178777 - DNA, 15 bp, Homo sapiens
atcgtgtcactgcac

SEQ ID NO: 178778 - DNA, 15 bp, Homo sapiens
tatcgtgtcactgca

SEQ ID NO: 178779 - DNA, 15 bp, Homo sapiens
atatcgtgtcactgc

SEQ ID NO: 178780 - DNA, 15 bp, Homo sapiens
gatatcgtgtcactg

SEQ ID NO: 178781 - DNA, 15 bp, Homo sapiens
tgatatcgtgtcact

SEQ ID NO: 178782 - DNA, 15 bp, Homo sapiens
ctgatatcgtgtcac

SEQ ID NO: 178783 - DNA, 15 bp, Homo sapiens
gctgatatcgtgtca

SEQ ID NO: 178784 - DNA, 15 bp, Homo sapiens
agctgatatcgtgtc

SEQ ID NO: 178785 - DNA, 15 bp, Homo sapiens
gagctgatatcgtgt

SEQ ID NO: 178786 - DNA, 15 bp, Homo sapiens
tgagctgatatcgtg

SEQ ID NO: 178787 - DNA, 15 bp, Homo sapiens
gtgagctgatatcgt

SEQ ID NO: 178788 - DNA, 15 bp, Homo sapiens
agtgagctgatatcg

SEQ ID NO: 178789 - DNA, 15 bp, Homo sapiens
cagtgagctgatatc

SEQ ID NO: 178790 - DNA, 15 bp, Homo sapiens
gcagtgagctgatat

SEQ ID NO: 178791 - DNA, 15 bp, Homo sapiens
tgcagtgagctgata

SEQ ID NO: 178792 - DNA, 15 bp, Homo sapiens
ttgcagtgagctgat

SEQ ID NO: 178793 - DNA, 15 bp, Homo sapiens
cagaagttgcagtga

SEQ ID NO: 178794 - DNA, 15 bp, Homo sapiens
gcagaagttgcagtg

SEQ ID NO: 178795 - DNA, 15 bp, Homo sapiens
ggcagaagttgcagt

SEQ ID NO: 178796 - DNA, 15 bp, Homo sapiens
aggcagaagttgcag

SEQ ID NO: 178797 - DNA, 15 bp, Homo sapiens
gaggcagaagttgca

SEQ ID NO: 178798 - DNA, 15 bp, Homo sapiens
agaggcagaagttgc

SEQ ID NO: 178799 - DNA, 15 bp, Homo sapiens
gagaggcagaagttg

SEQ ID NO: 178800 - DNA, 15 bp, Homo sapiens
cgagaggcagaagtt

SEQ ID NO: 178801 - DNA, 15 bp, Homo sapiens
ccgagaggcagaagt

SEQ ID NO: 178802 - DNA, 15 bp, Homo sapiens
cccgagaggcagaag

SEQ ID NO: 178803 - DNA, 15 bp, Homo sapiens
acccgagaggcagaa

SEQ ID NO: 178804 - DNA, 15 bp, Homo sapiens
atgaacccgagaggc

SEQ ID NO: 178805 - DNA, 15 bp, Homo sapiens
catgaacccgagagg

SEQ ID NO: 178806 - DNA, 15 bp, Homo sapiens
tcatgaacccgagag

SEQ ID NO: 178807 - DNA, 15 bp, Homo sapiens
ctcatgaacccgaga

SEQ ID NO: 178808 - DNA, 15 bp, Homo sapiens
tctcatgaacccgag

SEQ ID NO: 178809 - DNA, 15 bp, Homo sapiens
atctcatgaacccga

SEQ ID NO: 178810 - DNA, 15 bp, Homo sapiens
gatctcatgaacccg

SEQ ID NO: 178811 - DNA, 15 bp, Homo sapiens
ggatctcatgaaccc

SEQ ID NO: 178812 - DNA, 15 bp, Homo sapiens
aggatctcatgaacc

SEQ ID NO: 178813 - DNA, 15 bp, Homo sapiens
gaggatctcatgaac

SEQ ID NO: 178814 - DNA, 15 bp, Homo sapiens
ggaggatctcatgaa

SEQ ID NO: 178815 - DNA, 15 bp, Homo sapiens
gggaggatctcatga

SEQ ID NO: 178816 - DNA, 15 bp, Homo sapiens
tgggaggatctcatg

SEQ ID NO: 178817 - DNA, 15 bp, Homo sapiens
gtgggaggatctcat

SEQ ID NO: 178818 - DNA, 15 bp, Homo sapiens
ggtgggaggatctca

SEQ ID NO: 178819 - DNA, 15 bp, Homo sapiens
aggtgggaggatctc

SEQ ID NO: 178820 - DNA, 15 bp, Homo sapiens
gaggtgggaggatct

SEQ ID NO: 178821 - DNA, 15 bp, Homo sapiens
gagcacagggctccc

SEQ ID NO: 178822 - DNA, 15 bp, Homo sapiens
tgagcacagggctcc

SEQ ID NO: 178823 - DNA, 15 bp, Homo sapiens
ttgagcacagggctc

SEQ ID NO: 178824 - DNA, 15 bp, Homo sapiens
attgagcacagggct

SEQ ID NO: 178825 - DNA, 15 bp, Homo sapiens
aattgagcacagggc

SEQ ID NO: 178826 - DNA, 15 bp, Homo sapiens
taattgagcacaggg

SEQ ID NO: 178827 - DNA, 15 bp, Homo sapiens
ataattgagcacagg

SEQ ID NO: 178828 - DNA, 15 bp, Homo sapiens
tataattgagcacag

SEQ ID NO: 178829 - DNA, 15 bp, Homo sapiens
ttataattgagcaca

SEQ ID NO: 178830 - DNA, 15 bp, Homo sapiens
attataattgagcac

SEQ ID NO: 178831 - DNA, 15 bp, Homo sapiens
aattataattgagca

SEQ ID NO: 178832 - DNA, 15 bp, Homo sapiens
caattataattgagc

SEQ ID NO: 178833 - DNA, 15 bp, Homo sapiens
gcaattataattgag

SEQ ID NO: 178834 - DNA, 15 bp, Homo sapiens
ggcaattataattga

SEQ ID NO: 178835 - DNA, 15 bp, Homo sapiens
aggcaattataattg

SEQ ID NO: 178836 - DNA, 15 bp, Homo sapiens
taggcaattataatt

SEQ ID NO: 178837 - DNA, 15 bp, Homo sapiens
gtaggcaattataat

SEQ ID NO: 178838 - DNA, 15 bp, Homo sapiens
cgtaggcaattataa

SEQ ID NO: 178839 - DNA, 15 bp, Homo sapiens
tcgtaggcaattata

SEQ ID NO: 178840 - DNA, 15 bp, Homo sapiens
atcgtaggcaattat

SEQ ID NO: 178841 - DNA, 15 bp, Homo sapiens
tatcgtaggcaatta

SEQ ID NO: 178842 - DNA, 15 bp, Homo sapiens
ctatcgtaggcaatt

SEQ ID NO: 178843 - DNA, 15 bp, Homo sapiens
gctatcgtaggcaat

SEQ ID NO: 178844 - DNA, 15 bp, Homo sapiens
ggctatcgtaggcaa

SEQ ID NO: 178845 - DNA, 15 bp, Homo sapiens
aggctatcgtaggca

SEQ ID NO: 178846 - DNA, 15 bp, Homo sapiens
gaggctatcgtaggc

SEQ ID NO: 178847 - DNA, 15 bp, Homo sapiens
ggaggctatcgtagg

SEQ ID NO: 178848 - DNA, 15 bp, Homo sapiens
tggaggctatcgtag

SEQ ID NO: 178849 - DNA, 15 bp, Homo sapiens
gtggaggctatcgta

SEQ ID NO: 178850 - DNA, 15 bp, Homo sapiens
agtggaggctatcgt

SEQ ID NO: 178851 - DNA, 15 bp, Homo sapiens
aagtggaggctatcg

SEQ ID NO: 178852 - DNA, 15 bp, Homo sapiens
aaagtggaggctatc

SEQ ID NO: 178853 - DNA, 15 bp, Homo sapiens
gaaagtggaggctat

SEQ ID NO: 178854 - DNA, 15 bp, Homo sapiens
agaaagtggaggcta

SEQ ID NO: 178855 - DNA, 15 bp, Homo sapiens
cagaaagtggaggct

SEQ ID NO: 178856 - DNA, 15 bp, Homo sapiens
tcagaaagtggaggc

SEQ ID NO: 178857 - DNA, 15 bp, Homo sapiens
atcagaaagtggagg

SEQ ID NO: 178858 - DNA, 15 bp, Homo sapiens
aatcagaaagtggag

SEQ ID NO: 178859 - DNA, 15 bp, Homo sapiens
aaatcagaaagtgga

SEQ ID NO: 178860 - DNA, 15 bp, Homo sapiens
taaatcagaaagtgg

SEQ ID NO: 178861 - DNA, 15 bp, Homo sapiens
ttaaatcagaaagtg

SEQ ID NO: 178862 - DNA, 15 bp, Homo sapiens
attaaatcagaaagt

SEQ ID NO: 178863 - DNA, 15 bp, Homo sapiens
cattaaatcagaaag

SEQ ID NO: 178864 - DNA, 15 bp, Homo sapiens
acattaaatcagaaa

SEQ ID NO: 178865 - DNA, 15 bp, Homo sapiens
aacattaaatcagaa

SEQ ID NO: 178866 - DNA, 15 bp, Homo sapiens
gaacattaaatcaga

SEQ ID NO: 178867 - DNA, 15 bp, Homo sapiens
agaacattaaatcag

SEQ ID NO: 178868 - DNA, 15 bp, Homo sapiens
aagaacattaaatca

SEQ ID NO: 178869 - DNA, 15 bp, Homo sapiens
gaagaacattaaatc

SEQ ID NO: 178870 - DNA, 15 bp, Homo sapiens
agaagaacattaaat

SEQ ID NO: 178871 - DNA, 15 bp, Homo sapiens
aagaagaacattaaa

SEQ ID NO: 178872 - DNA, 15 bp, Homo sapiens
aaagaagaacattaa

SEQ ID NO: 178873 - DNA, 15 bp, Homo sapiens
aaaagaagaacatta

SEQ ID NO: 178874 - DNA, 15 bp, Homo sapiens
aaaaagaagaacatt

SEQ ID NO: 178875 - DNA, 15 bp, Homo sapiens
gaaaaagaagaacat

SEQ ID NO: 178876 - DNA, 15 bp, Homo sapiens
agaaaaagaagaaca

SEQ ID NO: 178877 - DNA, 15 bp, Homo sapiens
cagaaaaagaagaac

SEQ ID NO: 178878 - DNA, 15 bp, Homo sapiens
tcagaaaaagaagaa

SEQ ID NO: 178879 - DNA, 15 bp, Homo sapiens
ttcagaaaaagaaga

SEQ ID NO: 178880 - DNA, 15 bp, Homo sapiens
attcagaaaaagaag

SEQ ID NO: 178881 - DNA, 15 bp, Homo sapiens
aattcagaaaaagaa

SEQ ID NO: 178882 - DNA, 15 bp, Homo sapiens
aaattcagaaaaaga

SEQ ID NO: 178883 - DNA, 15 bp, Homo sapiens
aaaattcagaaaaag

SEQ ID NO: 178884 - DNA, 15 bp, Homo sapiens
aaaaattcagaaaaa

SEQ ID NO: 178885 - DNA, 15 bp, Homo sapiens
taaaaattcagaaaa

SEQ ID NO: 178886 - DNA, 15 bp, Homo sapiens
ttaaaaattcagaaa

SEQ ID NO: 178887 - DNA, 15 bp, Homo sapiens
tttaaaaattcagaa

SEQ ID NO: 178888 - DNA, 15 bp, Homo sapiens
ttttaaaaattcaga

SEQ ID NO: 178889 - DNA, 15 bp, Homo sapiens
tttttaaaaattcag

SEQ ID NO: 178890 - DNA, 15 bp, Homo sapiens
ttttttaaaaattca

SEQ ID NO: 178891 - DNA, 15 bp, Homo sapiens
tttttttaaaaattc

SEQ ID NO: 178892 - DNA, 15 bp, Homo sapiens
atttttttaaaaatt

SEQ ID NO: 178893 - DNA, 15 bp, Homo sapiens
agatttttttaaaaa

SEQ ID NO: 178894 - DNA, 15 bp, Homo sapiens
aagatttttttaaaa

SEQ ID NO: 178895 - DNA, 15 bp, Homo sapiens
aaagatttttttaaa

SEQ ID NO: 178896 - DNA, 15 bp, Homo sapiens
aaaagatttttttaa

SEQ ID NO: 178897 - DNA, 15 bp, Homo sapiens
aaaaagattttttta

SEQ ID NO: 178898 - DNA, 15 bp, Homo sapiens
taaaaagattttttt

SEQ ID NO: 178899 - DNA, 15 bp, Homo sapiens
ttaaaaagatttttt

SEQ ID NO: 178900 - DNA, 15 bp, Homo sapiens
tttaaaaagattttt

SEQ ID NO: 178901 - DNA, 15 bp, Homo sapiens
ttttaaaaagatttt

SEQ ID NO: 178902 - DNA, 15 bp, Homo sapiens
tttttaaaaagattt

SEQ ID NO: 178903 - DNA, 15 bp, Homo sapiens
ctttttaaaaagatt

SEQ ID NO: 178904 - DNA, 15 bp, Homo sapiens
actttttaaaaagat

SEQ ID NO: 178905 - DNA, 15 bp, Homo sapiens
aactttttaaaaaga

SEQ ID NO: 178906 - DNA, 15 bp, Homo sapiens
aaactttttaaaaag

SEQ ID NO: 178907 - DNA, 15 bp, Homo sapiens
aaaactttttaaaaa

SEQ ID NO: 178908 - DNA, 15 bp, Homo sapiens
taaaactttttaaaa

SEQ ID NO: 178909 - DNA, 15 bp, Homo sapiens
ataaaactttttaaa

SEQ ID NO: 178910 - DNA, 15 bp, Homo sapiens
aataaaactttttaa

SEQ ID NO: 178911 - DNA, 15 bp, Homo sapiens
taataaaacttttta

SEQ ID NO: 178912 - DNA, 15 bp, Homo sapiens
ataataaaacttttt

SEQ ID NO: 178913 - DNA, 15 bp, Homo sapiens
cataataaaactttt

SEQ ID NO: 178914 - DNA, 15 bp, Homo sapiens
ccataataaaacttt

SEQ ID NO: 178915 - DNA, 15 bp, Homo sapiens
gccataataaaactt

SEQ ID NO: 178916 - DNA, 15 bp, Homo sapiens
agccataataaaact

SEQ ID NO: 178917 - DNA, 15 bp, Homo sapiens
aagccataataaaac

SEQ ID NO: 178918 - DNA, 15 bp, Homo sapiens
gaagccataataaaa

SEQ ID NO: 178919 - DNA, 15 bp, Homo sapiens
agaagccataataaa

SEQ ID NO: 178920 - DNA, 15 bp, Homo sapiens
aagaagccataataa

SEQ ID NO: 178921 - DNA, 15 bp, Homo sapiens
aaagaagccataata

SEQ ID NO: 178922 - DNA, 15 bp, Homo sapiens
taaagaagccataat

SEQ ID NO: 178923 - DNA, 15 bp, Homo sapiens
gtaaagaagccataa

SEQ ID NO: 178924 - DNA, 15 bp, Homo sapiens
cgtaaagaagccata

SEQ ID NO: 178925 - DNA, 15 bp, Homo sapiens
acgtaaagaagccat

SEQ ID NO: 178926 - DNA, 15 bp, Homo sapiens
cacgtaaagaagcca

SEQ ID NO: 178927 - DNA, 15 bp, Homo sapiens
tcacgtaaagaagcc

SEQ ID NO: 178928 - DNA, 15 bp, Homo sapiens
ctcacgtaaagaagc

SEQ ID NO: 178929 - DNA, 15 bp, Homo sapiens
gctcacgtaaagaag

SEQ ID NO: 178930 - DNA, 15 bp, Homo sapiens
ggctcacgtaaagaa

SEQ ID NO: 178931 - DNA, 15 bp, Homo sapiens
aggctcacgtaaaga

SEQ ID NO: 178932 - DNA, 15 bp, Homo sapiens
aaggctcacgtaaag

SEQ ID NO: 178933 - DNA, 15 bp, Homo sapiens
aaaggctcacgtaaa

SEQ ID NO: 178934 - DNA, 15 bp, Homo sapiens
aaaaggctcacgtaa

SEQ ID NO: 178935 - DNA, 15 bp, Homo sapiens
taaaaggctcacgta

SEQ ID NO: 178936 - DNA, 15 bp, Homo sapiens
ttaaaaggctcacgt

SEQ ID NO: 178937 - DNA, 15 bp, Homo sapiens
tttaaaaggctcacg

SEQ ID NO: 178938 - DNA, 15 bp, Homo sapiens
gtttaaaaggctcac

SEQ ID NO: 178939 - DNA, 15 bp, Homo sapiens
tgtttaaaaggctca

SEQ ID NO: 178940 - DNA, 15 bp, Homo sapiens
ttgtttaaaaggctc

SEQ ID NO: 178941 - DNA, 15 bp, Homo sapiens
gttgtttaaaaggct

SEQ ID NO: 178942 - DNA, 15 bp, Homo sapiens
agttgtttaaaaggc

SEQ ID NO: 178943 - DNA, 15 bp, Homo sapiens
aagttgtttaaaagg

SEQ ID NO: 178944 - DNA, 15 bp, Homo sapiens
caagttgtttaaaag

SEQ ID NO: 178945 - DNA, 15 bp, Homo sapiens
tcaagttgtttaaaa

SEQ ID NO: 178946 - DNA, 15 bp, Homo sapiens
ctcaagttgtttaaa

SEQ ID NO: 178947 - DNA, 15 bp, Homo sapiens
actcaagttgtttaa

SEQ ID NO: 178948 - DNA, 15 bp, Homo sapiens
cactcaagttgttta

SEQ ID NO: 178949 - DNA, 15 bp, Homo sapiens
tcactcaagttgttt

SEQ ID NO: 178950 - DNA, 15 bp, Homo sapiens
ttcactcaagttgtt

SEQ ID NO: 178951 - DNA, 15 bp, Homo sapiens
attcactcaagttgt

SEQ ID NO: 178952 - DNA, 15 bp, Homo sapiens
tattcactcaagttg

SEQ ID NO: 178953 - DNA, 15 bp, Homo sapiens
ctattcactcaagtt

SEQ ID NO: 178954 - DNA, 15 bp, Homo sapiens
cctattcactcaagt

SEQ ID NO: 178955 - DNA, 15 bp, Homo sapiens
tcctattcactcaag

SEQ ID NO: 178956 - DNA, 15 bp, Homo sapiens
ctcctattcactcaa

SEQ ID NO: 178957 - DNA, 15 bp, Homo sapiens
cctcctattcactca

SEQ ID NO: 178958 - DNA, 15 bp, Homo sapiens
tcctcctattcactc

SEQ ID NO: 178959 - DNA, 15 bp, Homo sapiens
atcctcctattcact

SEQ ID NO: 178960 - DNA, 15 bp, Homo sapiens
aatcctcctattcac

SEQ ID NO: 178961 - DNA, 15 bp, Homo sapiens
gaatcctcctattca

SEQ ID NO: 178962 - DNA, 15 bp, Homo sapiens
tgaatcctcctattc

SEQ ID NO: 178963 - DNA, 15 bp, Homo sapiens
ctgaatcctcctatt

SEQ ID NO: 178964 - DNA, 15 bp, Homo sapiens
cctgaatcctcctat

SEQ ID NO: 178965 - DNA, 15 bp, Homo sapiens
tcctgaatcctccta

SEQ ID NO: 178966 - DNA, 15 bp, Homo sapiens
ttcctgaatcctcct

SEQ ID NO: 178967 - DNA, 15 bp, Homo sapiens
attcctgaatcctcc

SEQ ID NO: 178968 - DNA, 15 bp, Homo sapiens
aattcctgaatcctc

SEQ ID NO: 178969 - DNA, 15 bp, Homo sapiens
taattcctgaatcct

SEQ ID NO: 178970 - DNA, 15 bp, Homo sapiens
ataattcctgaatcc

SEQ ID NO: 178971 - DNA, 15 bp, Homo sapiens
cataattcctgaatc

SEQ ID NO: 178972 - DNA, 15 bp, Homo sapiens
ccataattcctgaat

SEQ ID NO: 178973 - DNA, 15 bp, Homo sapiens
gccataattcctgaa

SEQ ID NO: 178974 - DNA, 15 bp, Homo sapiens
agccataattcctga

SEQ ID NO: 178975 - DNA, 15 bp, Homo sapiens
gagccataattcctg

SEQ ID NO: 178976 - DNA, 15 bp, Homo sapiens
tgagccataattcct

SEQ ID NO: 178977 - DNA, 15 bp, Homo sapiens
atgagccataattcc

SEQ ID NO: 178978 - DNA, 15 bp, Homo sapiens
tatgagccataattc

SEQ ID NO: 178979 - DNA, 15 bp, Homo sapiens
ctatgagccataatt

SEQ ID NO: 178980 - DNA, 15 bp, Homo sapiens
tctatgagccataat

SEQ ID NO: 178981 - DNA, 15 bp, Homo sapiens
ttctatgagccataa

SEQ ID NO: 178982 - DNA, 15 bp, Homo sapiens
cttctatgagccata

SEQ ID NO: 178983 - DNA, 15 bp, Homo sapiens
tcttctatgagccat

SEQ ID NO: 178984 - DNA, 15 bp, Homo sapiens
ctcttctatgagcca

SEQ ID NO: 178985 - DNA, 15 bp, Homo sapiens
tctcttctatgagcc

SEQ ID NO: 178986 - DNA, 15 bp, Homo sapiens
gtctcttctatgagc

SEQ ID NO: 178987 - DNA, 15 bp, Homo sapiens
tgtctcttctatgag

SEQ ID NO: 178988 - DNA, 15 bp, Homo sapiens
atgtctcttctatga

SEQ ID NO: 178989 - DNA, 15 bp, Homo sapiens
tatgtctcttctatg

SEQ ID NO: 178990 - DNA, 15 bp, Homo sapiens
atatgtctcttctat

SEQ ID NO: 178991 - DNA, 15 bp, Homo sapiens
aatatgtctcttcta

SEQ ID NO: 178992 - DNA, 15 bp, Homo sapiens
aaatatgtctcttct

SEQ ID NO: 178993 - DNA, 15 bp, Homo sapiens
taaatatgtctcttc

SEQ ID NO: 178994 - DNA, 15 bp, Homo sapiens
ttaaatatgtctctt

SEQ ID NO: 178995 - DNA, 15 bp, Homo sapiens
gttaaatatgtctct

SEQ ID NO: 178996 - DNA, 15 bp, Homo sapiens
ggttaaatatgtctc

SEQ ID NO: 178997 - DNA, 15 bp, Homo sapiens
aggttaaatatgtct

SEQ ID NO: 178998 - DNA, 15 bp, Homo sapiens
aaggttaaatatgtc

SEQ ID NO: 178999 - DNA, 15 bp, Homo sapiens
taaggttaaatatgt

SEQ ID NO: 179000 - DNA, 15 bp, Homo sapiens
ataaggttaaatatg

SEQ ID NO: 179001 - DNA, 15 bp, Homo sapiens
cataaggttaaatat

SEQ ID NO: 179002 - DNA, 15 bp, Homo sapiens
gcataaggttaaata

SEQ ID NO: 179003 - DNA, 15 bp, Homo sapiens
tgcataaggttaaat

SEQ ID NO: 179004 - DNA, 15 bp, Homo sapiens
atgcataaggttaaa

SEQ ID NO: 179005 - DNA, 15 bp, Homo sapiens
gatgcataaggttaa

SEQ ID NO: 179006 - DNA, 15 bp, Homo sapiens
tgatgcataaggtta

SEQ ID NO: 179007 - DNA, 15 bp, Homo sapiens
ctgatgcataaggtt

SEQ ID NO: 179008 - DNA, 15 bp, Homo sapiens
tctgatgcataaggt

SEQ ID NO: 179009 - DNA, 15 bp, Homo sapiens
gtctgatgcataagg

SEQ ID NO: 179010 - DNA, 15 bp, Homo sapiens
tgtctgatgcataag

SEQ ID NO: 179011 - DNA, 15 bp, Homo sapiens
atgtctgatgcataa

SEQ ID NO: 179012 - DNA, 15 bp, Homo sapiens
aatgtctgatgcata

SEQ ID NO: 179013 - DNA, 15 bp, Homo sapiens
caatgtctgatgcat

SEQ ID NO: 179014 - DNA, 15 bp, Homo sapiens
acaatgtctgatgca

SEQ ID NO: 179015 - DNA, 15 bp, Homo sapiens
aacaatgtctgatgc

SEQ ID NO: 179016 - DNA, 15 bp, Homo sapiens
taacaatgtctgatg

SEQ ID NO: 179017 - DNA, 15 bp, Homo sapiens
ctaacaatgtctgat

SEQ ID NO: 179018 - DNA, 15 bp, Homo sapiens
tctaacaatgtctga

SEQ ID NO: 179019 - DNA, 15 bp, Homo sapiens
gtctaacaatgtctg

SEQ ID NO: 179020 - DNA, 15 bp, Homo sapiens
tgtctaacaatgtct

SEQ ID NO: 179021 - DNA, 15 bp, Homo sapiens
gtgtctaacaatgtc

SEQ ID NO: 179022 - DNA, 15 bp, Homo sapiens
agtgtctaacaatgt

SEQ ID NO: 179023 - DNA, 15 bp, Homo sapiens
tagtgtctaacaatg

SEQ ID NO: 179024 - DNA, 15 bp, Homo sapiens
gtagtgtctaacaat

SEQ ID NO: 179025 - DNA, 15 bp, Homo sapiens
cgtagtgtctaacaa

SEQ ID NO: 179026 - DNA, 15 bp, Homo sapiens
gcgtagtgtctaaca

SEQ ID NO: 179027 - DNA, 15 bp, Homo sapiens
agcgtagtgtctaac

SEQ ID NO: 179028 - DNA, 15 bp, Homo sapiens
cagcgtagtgtctaa

SEQ ID NO: 179029 - DNA, 15 bp, Homo sapiens
acagcgtagtgtcta

SEQ ID NO: 179030 - DNA, 15 bp, Homo sapiens
tacagcgtagtgtct

SEQ ID NO: 179031 - DNA, 15 bp, Homo sapiens
atacagcgtagtgtc

SEQ ID NO: 179032 - DNA, 15 bp, Homo sapiens
aatacagcgtagtgt

SEQ ID NO: 179033 - DNA, 15 bp, Homo sapiens
aaatacagcgtagtg

SEQ ID NO: 179034 - DNA, 15 bp, Homo sapiens
caaatacagcgtagt

SEQ ID NO: 179035 - DNA, 15 bp, Homo sapiens
acaaatacagcgtag

SEQ ID NO: 179036 - DNA, 15 bp, Homo sapiens
tacaaatacagcgta

SEQ ID NO: 179037 - DNA, 15 bp, Homo sapiens
atacaaatacagcgt

SEQ ID NO: 179038 - DNA, 15 bp, Homo sapiens
tatacaaatacagcg

SEQ ID NO: 179039 - DNA, 15 bp, Homo sapiens
ctatacaaatacagc

SEQ ID NO: 179040 - DNA, 15 bp, Homo sapiens
gctatacaaatacag

SEQ ID NO: 179041 - DNA, 15 bp, Homo sapiens
agctatacaaataca

SEQ ID NO: 179042 - DNA, 15 bp, Homo sapiens
aagctatacaaatac

SEQ ID NO: 179043 - DNA, 15 bp, Homo sapiens
gaagctatacaaata

SEQ ID NO: 179044 - DNA, 15 bp, Homo sapiens
tgaagctatacaaat

SEQ ID NO: 179045 - DNA, 15 bp, Homo sapiens
ctgaagctatacaaa

SEQ ID NO: 179046 - DNA, 15 bp, Homo sapiens
actgaagctatacaa

SEQ ID NO: 179047 - DNA, 15 bp, Homo sapiens
cactgaagctataca

SEQ ID NO: 179048 - DNA, 15 bp, Homo sapiens
acactgaagctatac

SEQ ID NO: 179049 - DNA, 15 bp, Homo sapiens
aacactgaagctata

SEQ ID NO: 179050 - DNA, 15 bp, Homo sapiens
aaacactgaagctat

SEQ ID NO: 179051 - DNA, 15 bp, Homo sapiens
caaacactgaagcta

SEQ ID NO: 179052 - DNA, 15 bp, Homo sapiens
ccaaacactgaagct

SEQ ID NO: 179053 - DNA, 15 bp, Homo sapiens
accaaacactgaagc

SEQ ID NO: 179054 - DNA, 15 bp, Homo sapiens
taccaaacactgaag

SEQ ID NO: 179055 - DNA, 15 bp, Homo sapiens
ctaccaaacactgaa

SEQ ID NO: 179056 - DNA, 15 bp, Homo sapiens
gctaccaaacactga

SEQ ID NO: 179057 - DNA, 15 bp, Homo sapiens
agctaccaaacactg

SEQ ID NO: 179058 - DNA, 15 bp, Homo sapiens
gagctaccaaacact

SEQ ID NO: 179059 - DNA, 15 bp, Homo sapiens
agagctaccaaacac

SEQ ID NO: 179060 - DNA, 15 bp, Homo sapiens
tagagctaccaaaca

SEQ ID NO: 179061 - DNA, 15 bp, Homo sapiens
ctagagctaccaaac

SEQ ID NO: 179062 - DNA, 15 bp, Homo sapiens
tctagagctaccaaa

SEQ ID NO: 179063 - DNA, 15 bp, Homo sapiens
atctagagctaccaa

SEQ ID NO: 179064 - DNA, 15 bp, Homo sapiens
tatctagagctacca

SEQ ID NO: 179065 - DNA, 15 bp, Homo sapiens
atatctagagctacc

SEQ ID NO: 179066 - DNA, 15 bp, Homo sapiens
gatatctagagctac

SEQ ID NO: 179067 - DNA, 15 bp, Homo sapiens
tgatatctagagcta

SEQ ID NO: 179068 - DNA, 15 bp, Homo sapiens
ttgatatctagagct

SEQ ID NO: 179069 - DNA, 15 bp, Homo sapiens
cttgatatctagagc

SEQ ID NO: 179070 - DNA, 15 bp, Homo sapiens
tcttgatatctagag

SEQ ID NO: 179071 - DNA, 15 bp, Homo sapiens
atcttgatatctaga

SEQ ID NO: 179072 - DNA, 15 bp, Homo sapiens
tatcttgatatctag

SEQ ID NO: 179073 - DNA, 15 bp, Homo sapiens
ctatcttgatatcta

SEQ ID NO: 179074 - DNA, 15 bp, Homo sapiens
actatcttgatatct

SEQ ID NO: 179075 - DNA, 15 bp, Homo sapiens
tactatcttgatatc

SEQ ID NO: 179076 - DNA, 15 bp, Homo sapiens
atactatcttgatat

SEQ ID NO: 179077 - DNA, 15 bp, Homo sapiens
aatactatcttgata

SEQ ID NO: 179078 - DNA, 15 bp, Homo sapiens
aaatactatcttgat

SEQ ID NO: 179079 - DNA, 15 bp, Homo sapiens
taaatactatcttga

SEQ ID NO: 179080 - DNA, 15 bp, Homo sapiens
ctaaatactatcttg

SEQ ID NO: 179081 - DNA, 15 bp, Homo sapiens
cctaaatactatctt

SEQ ID NO: 179082 - DNA, 15 bp, Homo sapiens
tcctaaatactatct

SEQ ID NO: 179083 - DNA, 15 bp, Homo sapiens
ttcctaaatactatc

SEQ ID NO: 179084 - DNA, 15 bp, Homo sapiens
tttcctaaatactat

SEQ ID NO: 179085 - DNA, 15 bp, Homo sapiens
atttcctaaatacta

SEQ ID NO: 179086 - DNA, 15 bp, Homo sapiens
aatttcctaaatact

SEQ ID NO: 179087 - DNA, 15 bp, Homo sapiens
aaatttcctaaatac

SEQ ID NO: 179088 - DNA, 15 bp, Homo sapiens
aaaatttcctaaata

SEQ ID NO: 179089 - DNA, 15 bp, Homo sapiens
gaaaatttcctaaat

SEQ ID NO: 179090 - DNA, 15 bp, Homo sapiens
agaaaatttcctaaa

SEQ ID NO: 179091 - DNA, 15 bp, Homo sapiens
aagaaaatttcctaa

SEQ ID NO: 179092 - DNA, 15 bp, Homo sapiens
aaagaaaatttccta

SEQ ID NO: 179093 - DNA, 15 bp, Homo sapiens
aaaagaaaatttcct

SEQ ID NO: 179094 - DNA, 15 bp, Homo sapiens
gaaaagaaaatttcc

SEQ ID NO: 179095 - DNA, 15 bp, Homo sapiens
ggaaaagaaaatttc

SEQ ID NO: 179096 - DNA, 15 bp, Homo sapiens
tggaaaagaaaattt

SEQ ID NO: 179097 - DNA, 15 bp, Homo sapiens
ttggaaaagaaaatt

SEQ ID NO: 179098 - DNA, 15 bp, Homo sapiens
gttggaaaagaaaat

SEQ ID NO: 179099 - DNA, 15 bp, Homo sapiens
tgttggaaaagaaaa

SEQ ID NO: 179100 - DNA, 15 bp, Homo sapiens
atgttggaaaagaaa

SEQ ID NO: 179101 - DNA, 15 bp, Homo sapiens
catgttggaaaagaa

SEQ ID NO: 179102 - DNA, 15 bp, Homo sapiens
acatgttggaaaaga

SEQ ID NO: 179103 - DNA, 15 bp, Homo sapiens
aacatgttggaaaag

SEQ ID NO: 179104 - DNA, 15 bp, Homo sapiens
taacatgttggaaaa

SEQ ID NO: 179105 - DNA, 15 bp, Homo sapiens
ctaacatgttggaaa

SEQ ID NO: 179106 - DNA, 15 bp, Homo sapiens
actaacatgttggaa

SEQ ID NO: 179107 - DNA, 15 bp, Homo sapiens
aactaacatgttgga

SEQ ID NO: 179108 - DNA, 15 bp, Homo sapiens
taactaacatgttgg

SEQ ID NO: 179109 - DNA, 15 bp, Homo sapiens
ctaactaacatgttg

SEQ ID NO: 179110 - DNA, 15 bp, Homo sapiens
actaactaacatgtt

SEQ ID NO: 179111 - DNA, 15 bp, Homo sapiens
aactaactaacatgt

SEQ ID NO: 179112 - DNA, 15 bp, Homo sapiens
gaactaactaacatg

SEQ ID NO: 179113 - DNA, 15 bp, Homo sapiens
agaactaactaacat

SEQ ID NO: 179114 - DNA, 15 bp, Homo sapiens
cagaactaactaaca

SEQ ID NO: 179115 - DNA, 15 bp, Homo sapiens
tcagaactaactaac

SEQ ID NO: 179116 - DNA, 15 bp, Homo sapiens
ttcagaactaactaa

SEQ ID NO: 179117 - DNA, 15 bp, Homo sapiens
tttcagaactaacta

SEQ ID NO: 179118 - DNA, 15 bp, Homo sapiens
atttcagaactaact

SEQ ID NO: 179119 - DNA, 15 bp, Homo sapiens
tatttcagaactaac

SEQ ID NO: 179120 - DNA, 15 bp, Homo sapiens
gtatttcagaactaa

SEQ ID NO: 179121 - DNA, 15 bp, Homo sapiens
ggtatttcagaacta

SEQ ID NO: 179122 - DNA, 15 bp, Homo sapiens
gggtatttcagaact

SEQ ID NO: 179123 - DNA, 15 bp, Homo sapiens
ggggtatttcagaac

SEQ ID NO: 179124 - DNA, 15 bp, Homo sapiens
tggggtatttcagaa

SEQ ID NO: 179125 - DNA, 15 bp, Homo sapiens
ttggggtatttcaga

SEQ ID NO: 179126 - DNA, 15 bp, Homo sapiens
tttggggtatttcag

SEQ ID NO: 179127 - DNA, 15 bp, Homo sapiens
atttggggtatttca

SEQ ID NO: 179128 - DNA, 15 bp, Homo sapiens
catttggggtatttc

SEQ ID NO: 179129 - DNA, 15 bp, Homo sapiens
ccatttggggtattt

SEQ ID NO: 179130 - DNA, 15 bp, Homo sapiens
accatttggggtatt

SEQ ID NO: 179131 - DNA, 15 bp, Homo sapiens
aaccatttggggtat

SEQ ID NO: 179132 - DNA, 15 bp, Homo sapiens
taaccatttggggta

SEQ ID NO: 179133 - DNA, 15 bp, Homo sapiens
ttaaccatttggggt

SEQ ID NO: 179134 - DNA, 15 bp, Homo sapiens
attaaccatttgggg

SEQ ID NO: 179135 - DNA, 15 bp, Homo sapiens
cattaaccatttggg

SEQ ID NO: 179136 - DNA, 15 bp, Homo sapiens
acattaaccatttgg

SEQ ID NO: 179137 - DNA, 15 bp, Homo sapiens
tacattaaccatttg

SEQ ID NO: 179138 - DNA, 15 bp, Homo sapiens
ctacattaaccattt

SEQ ID NO: 179139 - DNA, 15 bp, Homo sapiens
actacattaaccatt

SEQ ID NO: 179140 - DNA, 15 bp, Homo sapiens
aactacattaaccat

SEQ ID NO: 179141 - DNA, 15 bp, Homo sapiens
aaactacattaacca

SEQ ID NO: 179142 - DNA, 15 bp, Homo sapiens
taaactacattaacc

SEQ ID NO: 179143 - DNA, 15 bp, Homo sapiens
ataaactacattaac

SEQ ID NO: 179144 - DNA, 15 bp, Homo sapiens
tataaactacattaa

SEQ ID NO: 179145 - DNA, 15 bp, Homo sapiens
ttataaactacatta

SEQ ID NO: 179146 - DNA, 15 bp, Homo sapiens
tttataaactacatt

SEQ ID NO: 179147 - DNA, 15 bp, Homo sapiens
gtttataaactacat

SEQ ID NO: 179148 - DNA, 15 bp, Homo sapiens
agtttataaactaca

SEQ ID NO: 179149 - DNA, 15 bp, Homo sapiens
gagtttataaactac

SEQ ID NO: 179150 - DNA, 15 bp, Homo sapiens
ggagtttataaacta

SEQ ID NO: 179151 - DNA, 15 bp, Homo sapiens
cggagtttataaact

SEQ ID NO: 179152 - DNA, 15 bp, Homo sapiens
tcggagtttataaac

SEQ ID NO: 179153 - DNA, 15 bp, Homo sapiens
ttcggagtttataaa

SEQ ID NO: 179154 - DNA, 15 bp, Homo sapiens
tttcggagtttataa

SEQ ID NO: 179155 - DNA, 15 bp, Homo sapiens
ttttcggagtttata

SEQ ID NO: 179156 - DNA, 15 bp, Homo sapiens
cttttcggagtttat

SEQ ID NO: 179157 - DNA, 15 bp, Homo sapiens
gcttttcggagttta

SEQ ID NO: 179158 - DNA, 15 bp, Homo sapiens
agcttttcggagttt

SEQ ID NO: 179159 - DNA, 15 bp, Homo sapiens
aagcttttcggagtt

SEQ ID NO: 179160 - DNA, 15 bp, Homo sapiens
aaagcttttcggagt

SEQ ID NO: 179161 - DNA, 15 bp, Homo sapiens
aaaagcttttcggag

SEQ ID NO: 179162 - DNA, 15 bp, Homo sapiens
aaaaagcttttcgga

SEQ ID NO: 179163 - DNA, 15 bp, Homo sapiens
taaaaagcttttcgg

SEQ ID NO: 179164 - DNA, 15 bp, Homo sapiens
ataaaaagcttttcg

SEQ ID NO: 179165 - DNA, 15 bp, Homo sapiens
gataaaaagcttttc

SEQ ID NO: 179166 - DNA, 15 bp, Homo sapiens
agataaaaagctttt

SEQ ID NO: 179167 - DNA, 15 bp, Homo sapiens
tagataaaaagcttt

SEQ ID NO: 179168 - DNA, 15 bp, Homo sapiens
ttagataaaaagctt

SEQ ID NO: 179169 - DNA, 15 bp, Homo sapiens
attagataaaaagct

SEQ ID NO: 179170 - DNA, 15 bp, Homo sapiens
cattagataaaaagc

SEQ ID NO: 179171 - DNA, 15 bp, Homo sapiens
tcattagataaaaag

SEQ ID NO: 179172 - DNA, 15 bp, Homo sapiens
ctcattagataaaaa

SEQ ID NO: 179173 - DNA, 15 bp, Homo sapiens
tctcattagataaaa

SEQ ID NO: 179174 - DNA, 15 bp, Homo sapiens
ctctcattagataaa

SEQ ID NO: 179175 - DNA, 15 bp, Homo sapiens
gctctcattagataa

SEQ ID NO: 179176 - DNA, 15 bp, Homo sapiens
tgctctcattagata

SEQ ID NO: 179177 - DNA, 15 bp, Homo sapiens
gtgctctcattagat

SEQ ID NO: 179178 - DNA, 15 bp, Homo sapiens
agtgctctcattaga

SEQ ID NO: 179179 - DNA, 15 bp, Homo sapiens
cagtgctctcattag

SEQ ID NO: 179180 - DNA, 15 bp, Homo sapiens
acagtgctctcatta

SEQ ID NO: 179181 - DNA, 15 bp, Homo sapiens
aacagtgctctcatt

SEQ ID NO: 179182 - DNA, 15 bp, Homo sapiens
aaacagtgctctcat

SEQ ID NO: 179183 - DNA, 15 bp, Homo sapiens
aaaacagtgctctca

SEQ ID NO: 179184 - DNA, 15 bp, Homo sapiens
taaaacagtgctctc

SEQ ID NO: 179185 - DNA, 15 bp, Homo sapiens
ttaaaacagtgctct

SEQ ID NO: 179186 - DNA, 15 bp, Homo sapiens
ttttaaaacagtgct

SEQ ID NO: 179187 - DNA, 15 bp, Homo sapiens
tttttaaaacagtgc

SEQ ID NO: 179188 - DNA, 15 bp, Homo sapiens
ttttttaaaacagtg

SEQ ID NO: 179189 - DNA, 15 bp, Homo sapiens
tttttttaaaacagt

SEQ ID NO: 179190 - DNA, 15 bp, Homo sapiens
gtttttttaaaacag

SEQ ID NO: 179191 - DNA, 15 bp, Homo sapiens
ggtttttttaaaaca

SEQ ID NO: 179192 - DNA, 15 bp, Homo sapiens
tggtttttttaaaac

SEQ ID NO: 179193 - DNA, 15 bp, Homo sapiens
gtggtttttttaaaa

SEQ ID NO: 179194 - DNA, 15 bp, Homo sapiens
agtggtttttttaaa

SEQ ID NO: 179195 - DNA, 15 bp, Homo sapiens
tagtggtttttttaa

SEQ ID NO: 179196 - DNA, 15 bp, Homo sapiens
ttagtggttttttta

SEQ ID NO: 179197 - DNA, 15 bp, Homo sapiens
attagtggttttttt

SEQ ID NO: 179198 - DNA, 15 bp, Homo sapiens
cattagtggtttttt

SEQ ID NO: 179199 - DNA, 15 bp, Homo sapiens
tcattagtggttttt

SEQ ID NO: 179200 - DNA, 15 bp, Homo sapiens
atcattagtggtttt

SEQ ID NO: 179201 - DNA, 15 bp, Homo sapiens
aatcattagtggttt

SEQ ID NO: 179202 - DNA, 15 bp, Homo sapiens
aaatcattagtggtt

SEQ ID NO: 179203 - DNA, 15 bp, Homo sapiens
aaaatcattagtggt

SEQ ID NO: 179204 - DNA, 15 bp, Homo sapiens
gaaaatcattagtgg

SEQ ID NO: 179205 - DNA, 15 bp, Homo sapiens
agaaaatcattagtg

SEQ ID NO: 179206 - DNA, 15 bp, Homo sapiens
tagaaaatcattagt

SEQ ID NO: 179207 - DNA, 15 bp, Homo sapiens
ctagaaaatcattag

SEQ ID NO: 179208 - DNA, 15 bp, Homo sapiens
actagaaaatcatta

SEQ ID NO: 179209 - DNA, 15 bp, Homo sapiens
aactagaaaatcatt

SEQ ID NO: 179210 - DNA, 15 bp, Homo sapiens
caactagaaaatcat

SEQ ID NO: 179211 - DNA, 15 bp, Homo sapiens
tcaactagaaaatca

SEQ ID NO: 179212 - DNA, 15 bp, Homo sapiens
ttcaactagaaaatc

SEQ ID NO: 179213 - DNA, 15 bp, Homo sapiens
tttcaactagaaaat

SEQ ID NO: 179214 - DNA, 15 bp, Homo sapiens
gtttcaactagaaaa

SEQ ID NO: 179215 - DNA, 15 bp, Homo sapiens
tgtttcaactagaaa

SEQ ID NO: 179216 - DNA, 15 bp, Homo sapiens
atgtttcaactagaa

SEQ ID NO: 179217 - DNA, 15 bp, Homo sapiens
aatgtttcaactaga

SEQ ID NO: 179218 - DNA, 15 bp, Homo sapiens
aaatgtttcaactag

SEQ ID NO: 179219 - DNA, 15 bp, Homo sapiens
caaatgtttcaacta

SEQ ID NO: 179220 - DNA, 15 bp, Homo sapiens
tcaaatgtttcaact

SEQ ID NO: 179221 - DNA, 15 bp, Homo sapiens
ttcaaatgtttcaac

SEQ ID NO: 179222 - DNA, 15 bp, Homo sapiens
tttcaaatgtttcaa

SEQ ID NO: 179223 - DNA, 15 bp, Homo sapiens
tgtttcaaatgtttc

SEQ ID NO: 179224 - DNA, 15 bp, Homo sapiens
ttgtttcaaatgttt

SEQ ID NO: 179225 - DNA, 15 bp, Homo sapiens
attgtttcaaatgtt

SEQ ID NO: 179226 - DNA, 15 bp, Homo sapiens
aattgtttcaaatgt

SEQ ID NO: 179227 - DNA, 15 bp, Homo sapiens
aaattgtttcaaatg

SEQ ID NO: 179228 - DNA, 15 bp, Homo sapiens
aaaattgtttcaaat

SEQ ID NO: 179229 - DNA, 15 bp, Homo sapiens
caaaattgtttcaaa

SEQ ID NO: 179230 - DNA, 15 bp, Homo sapiens
tcaaaattgtttcaa

SEQ ID NO: 179231 - DNA, 15 bp, Homo sapiens
ttcaaaattgtttca

SEQ ID NO: 179232 - DNA, 15 bp, Homo sapiens
cttcaaaattgtttc

SEQ ID NO: 179233 - DNA, 15 bp, Homo sapiens
acttcaaaattgttt

SEQ ID NO: 179234 - DNA, 15 bp, Homo sapiens
tacttcaaaattgtt

SEQ ID NO: 179235 - DNA, 15 bp, Homo sapiens
gtacttcaaaattgt

SEQ ID NO: 179236 - DNA, 15 bp, Homo sapiens
tgtacttcaaaattg

SEQ ID NO: 179237 - DNA, 15 bp, Homo sapiens
ctgtacttcaaaatt

SEQ ID NO: 179238 - DNA, 15 bp, Homo sapiens
cctgtacttcaaaat

SEQ ID NO: 179239 - DNA, 15 bp, Homo sapiens
ccctgtacttcaaaa

SEQ ID NO: 179240 - DNA, 15 bp, Homo sapiens
cccctgtacttcaaa

SEQ ID NO: 179241 - DNA, 15 bp, Homo sapiens
tcccctgtacttcaa

SEQ ID NO: 179242 - DNA, 15 bp, Homo sapiens
gtcccctgtacttca

SEQ ID NO: 179243 - DNA, 15 bp, Homo sapiens
agtcccctgtacttc

SEQ ID NO: 179244 - DNA, 15 bp, Homo sapiens
aagtcccctgtactt

SEQ ID NO: 179245 - DNA, 15 bp, Homo sapiens
aaagtcccctgtact

SEQ ID NO: 179246 - DNA, 15 bp, Homo sapiens
aaaagtcccctgtac

SEQ ID NO: 179247 - DNA, 15 bp, Homo sapiens
gaaaagtcccctgta

SEQ ID NO: 179248 - DNA, 15 bp, Homo sapiens
agaaaagtcccctgt

SEQ ID NO: 179249 - DNA, 15 bp, Homo sapiens
aagaaaagtcccctg

SEQ ID NO: 179250 - DNA, 15 bp, Homo sapiens
aaagaaaagtcccct

SEQ ID NO: 179251 - DNA, 15 bp, Homo sapiens
taaagaaaagtcccc

SEQ ID NO: 179252 - DNA, 15 bp, Homo sapiens
ttaaagaaaagtccc

SEQ ID NO: 179253 - DNA, 15 bp, Homo sapiens
tttaaagaaaagtcc

SEQ ID NO: 179254 - DNA, 15 bp, Homo sapiens
ttttaaagaaaagtc

SEQ ID NO: 179255 - DNA, 15 bp, Homo sapiens
gttttaaagaaaagt

SEQ ID NO: 179256 - DNA, 15 bp, Homo sapiens
tgttttaaagaaaag

SEQ ID NO: 179257 - DNA, 15 bp, Homo sapiens
ctgttttaaagaaaa

SEQ ID NO: 179258 - DNA, 15 bp, Homo sapiens
actgttttaaagaaa

SEQ ID NO: 179259 - DNA, 15 bp, Homo sapiens
cactgttttaaagaa

SEQ ID NO: 179260 - DNA, 15 bp, Homo sapiens
gcactgttttaaaga

SEQ ID NO: 179261 - DNA, 15 bp, Homo sapiens
agcactgttttaaag

SEQ ID NO: 179262 - DNA, 15 bp, Homo sapiens
tgagcactgttttaa

SEQ ID NO: 179263 - DNA, 15 bp, Homo sapiens
atgagcactgtttta

SEQ ID NO: 179264 - DNA, 15 bp, Homo sapiens
aatgagcactgtttt

SEQ ID NO: 179265 - DNA, 15 bp, Homo sapiens
taatgagcactgttt

SEQ ID NO: 179266 - DNA, 15 bp, Homo sapiens
ataatgagcactgtt

SEQ ID NO: 179267 - DNA, 15 bp, Homo sapiens
tataatgagcactgt

SEQ ID NO: 179268 - DNA, 15 bp, Homo sapiens
gtataatgagcactg

SEQ ID NO: 179269 - DNA, 15 bp, Homo sapiens
agtataatgagcact

SEQ ID NO: 179270 - DNA, 15 bp, Homo sapiens
gagtataatgagcac

SEQ ID NO: 179271 - DNA, 15 bp, Homo sapiens
cgagtataatgagca

SEQ ID NO: 179272 - DNA, 15 bp, Homo sapiens
ccgagtataatgagc

SEQ ID NO: 179273 - DNA, 15 bp, Homo sapiens
tccgagtataatgag

SEQ ID NO: 179274 - DNA, 15 bp, Homo sapiens
ttccgagtataatga

SEQ ID NO: 179275 - DNA, 15 bp, Homo sapiens
cttccgagtataatg

SEQ ID NO: 179276 - DNA, 15 bp, Homo sapiens
tcttccgagtataat

SEQ ID NO: 179277 - DNA, 15 bp, Homo sapiens
atcttccgagtataa

SEQ ID NO: 179278 - DNA, 15 bp, Homo sapiens
tatcttccgagtata

SEQ ID NO: 179279 - DNA, 15 bp, Homo sapiens
ttatcttccgagtat

SEQ ID NO: 179280 - DNA, 15 bp, Homo sapiens
cttatcttccgagta

SEQ ID NO: 179281 - DNA, 15 bp, Homo sapiens
gcttatcttccgagt

SEQ ID NO: 179282 - DNA, 15 bp, Homo sapiens
agcttatcttccgag

SEQ ID NO: 179283 - DNA, 15 bp, Homo sapiens
gagcttatcttccga

SEQ ID NO: 179284 - DNA, 15 bp, Homo sapiens
agagcttatcttccg

SEQ ID NO: 179285 - DNA, 15 bp, Homo sapiens
aagagcttatcttcc

SEQ ID NO: 179286 - DNA, 15 bp, Homo sapiens
caagagcttatcttc

SEQ ID NO: 179287 - DNA, 15 bp, Homo sapiens
tcaagagcttatctt

SEQ ID NO: 179288 - DNA, 15 bp, Homo sapiens
ctcaagagcttatct

SEQ ID NO: 179289 - DNA, 15 bp, Homo sapiens
gctcaagagcttatc

SEQ ID NO: 179290 - DNA, 15 bp, Homo sapiens
tgctcaagagcttat

SEQ ID NO: 179291 - DNA, 15 bp, Homo sapiens
atgctcaagagctta

SEQ ID NO: 179292 - DNA, 15 bp, Homo sapiens
gatgctcaagagctt

SEQ ID NO: 179293 - DNA, 15 bp, Homo sapiens
agatgctcaagagct

SEQ ID NO: 179294 - DNA, 15 bp, Homo sapiens
cagatgctcaagagc

SEQ ID NO: 179295 - DNA, 15 bp, Homo sapiens
acagatgctcaagag

SEQ ID NO: 179296 - DNA, 15 bp, Homo sapiens
gacagatgctcaaga

SEQ ID NO: 179297 - DNA, 15 bp, Homo sapiens
tgacagatgctcaag

SEQ ID NO: 179298 - DNA, 15 bp, Homo sapiens
atgacagatgctcaa

SEQ ID NO: 179299 - DNA, 15 bp, Homo sapiens
gatgacagatgctca

SEQ ID NO: 179300 - DNA, 15 bp, Homo sapiens
ggatgacagatgctc

SEQ ID NO: 179301 - DNA, 15 bp, Homo sapiens
aggatgacagatgct

SEQ ID NO: 179302 - DNA, 15 bp, Homo sapiens
aaggatgacagatgc

SEQ ID NO: 179303 - DNA, 15 bp, Homo sapiens
caaggatgacagatg

SEQ ID NO: 179304 - DNA, 15 bp, Homo sapiens
acaaggatgacagat

SEQ ID NO: 179305 - DNA, 15 bp, Homo sapiens
aacaaggatgacaga

SEQ ID NO: 179306 - DNA, 15 bp, Homo sapiens
caacaaggatgacag

SEQ ID NO: 179307 - DNA, 15 bp, Homo sapiens
tcaacaaggatgaca

SEQ ID NO: 179308 - DNA, 15 bp, Homo sapiens
atcaacaaggatgac

SEQ ID NO: 179309 - DNA, 15 bp, Homo sapiens
catcaacaaggatga

SEQ ID NO: 179310 - DNA, 15 bp, Homo sapiens
acatcaacaaggatg

SEQ ID NO: 179311 - DNA, 15 bp, Homo sapiens
tacatcaacaaggat

SEQ ID NO: 179312 - DNA, 15 bp, Homo sapiens
atacatcaacaagga

SEQ ID NO: 179313 - DNA, 15 bp, Homo sapiens
aatacatcaacaagg

SEQ ID NO: 179314 - DNA, 15 bp, Homo sapiens
gaatacatcaacaag

SEQ ID NO: 179315 - DNA, 15 bp, Homo sapiens
tgaatacatcaacaa

SEQ ID NO: 179316 - DNA, 15 bp, Homo sapiens
atgaatacatcaaca

SEQ ID NO: 179317 - DNA, 15 bp, Homo sapiens
tatgaatacatcaac

SEQ ID NO: 179318 - DNA, 15 bp, Homo sapiens
gtatgaatacatcaa

SEQ ID NO: 179319 - DNA, 15 bp, Homo sapiens
agtatgaatacatca

SEQ ID NO: 179320 - DNA, 15 bp, Homo sapiens
cagtatgaatacatc

SEQ ID NO: 179321 - DNA, 15 bp, Homo sapiens
acagtatgaatacat

SEQ ID NO: 179322 - DNA, 15 bp, Homo sapiens
aacagtatgaataca

SEQ ID NO: 179323 - DNA, 15 bp, Homo sapiens
aaacagtatgaatac

SEQ ID NO: 179324 - DNA, 15 bp, Homo sapiens
aaaacagtatgaata

SEQ ID NO: 179325 - DNA, 15 bp, Homo sapiens
aaaaacagtatgaat

SEQ ID NO: 179326 - DNA, 15 bp, Homo sapiens
taaaaacagtatgaa

SEQ ID NO: 179327 - DNA, 15 bp, Homo sapiens
ataaaaacagtatga

SEQ ID NO: 179328 - DNA, 15 bp, Homo sapiens
aataaaaacagtatg

SEQ ID NO: 179329 - DNA, 15 bp, Homo sapiens
agaataaaaacagta

SEQ ID NO: 179330 - DNA, 15 bp, Homo sapiens
aagaataaaaacagt

SEQ ID NO: 179331 - DNA, 15 bp, Homo sapiens
aaagaataaaaacag

SEQ ID NO: 179332 - DNA, 15 bp, Homo sapiens
caaagaataaaaaca

SEQ ID NO: 179333 - DNA, 15 bp, Homo sapiens
tcaaagaataaaaac

SEQ ID NO: 179334 - DNA, 15 bp, Homo sapiens
ttcaaagaataaaaa

SEQ ID NO: 179335 - DNA, 15 bp, Homo sapiens
tttcaaagaataaaa

SEQ ID NO: 179336 - DNA, 15 bp, Homo sapiens
catttcaaagaataa

SEQ ID NO: 179337 - DNA, 15 bp, Homo sapiens
acatttcaaagaata

SEQ ID NO: 179338 - DNA, 15 bp, Homo sapiens
tacatttcaaagaat

SEQ ID NO: 179339 - DNA, 15 bp, Homo sapiens
atacatttcaaagaa

SEQ ID NO: 179340 - DNA, 15 bp, Homo sapiens
aatacatttcaaaga

SEQ ID NO: 179341 - DNA, 15 bp, Homo sapiens
aaatacatttcaaag

SEQ ID NO: 179342 - DNA, 15 bp, Homo sapiens
taaatacatttcaaa

SEQ ID NO: 179343 - DNA, 15 bp, Homo sapiens
ttaaatacatttcaa

SEQ ID NO: 179344 - DNA, 15 bp, Homo sapiens
tttaaatacatttca

SEQ ID NO: 179345 - DNA, 15 bp, Homo sapiens
atttaaatacatttc

SEQ ID NO: 179346 - DNA, 15 bp, Homo sapiens
ctatttaaatacatt

SEQ ID NO: 179347 - DNA, 15 bp, Homo sapiens
tctatttaaatacat

SEQ ID NO: 179348 - DNA, 15 bp, Homo sapiens
ttctatttaaataca

SEQ ID NO: 179349 - DNA, 15 bp, Homo sapiens
tttctatttaaatac

SEQ ID NO: 179350 - DNA, 15 bp, Homo sapiens
ttttctatttaaata

SEQ ID NO: 179351 - DNA, 15 bp, Homo sapiens
tttttctatttaaat

SEQ ID NO: 179352 - DNA, 15 bp, Homo sapiens
ttttttctatttaaa

SEQ ID NO: 179353 - DNA, 15 bp, Homo sapiens
attttttctatttaa

SEQ ID NO: 179354 - DNA, 15 bp, Homo sapiens
tattttttctattta

SEQ ID NO: 179355 - DNA, 15 bp, Homo sapiens
ctattttttctattt

SEQ ID NO: 179356 - DNA, 15 bp, Homo sapiens
actattttttctatt

SEQ ID NO: 179357 - DNA, 15 bp, Homo sapiens
aactattttttctat

SEQ ID NO: 179358 - DNA, 15 bp, Homo sapiens
gaactattttttcta

SEQ ID NO: 179359 - DNA, 15 bp, Homo sapiens
tgaactattttttct

SEQ ID NO: 179360 - DNA, 15 bp, Homo sapiens
catgaactatttttt

SEQ ID NO: 179361 - DNA, 15 bp, Homo sapiens
acatgaactattttt

SEQ ID NO: 179362 - DNA, 15 bp, Homo sapiens
aacatgaactatttt

SEQ ID NO: 179363 - DNA, 15 bp, Homo sapiens
aaacatgaactattt

SEQ ID NO: 179364 - DNA, 15 bp, Homo sapiens
aaaacatgaactatt

SEQ ID NO: 179365 - DNA, 15 bp, Homo sapiens
aaaaacatgaactat

SEQ ID NO: 179366 - DNA, 15 bp, Homo sapiens
aaaaaacatgaacta

SEQ ID NO: 179367 - DNA, 15 bp, Homo sapiens
caaaaaacatgaact

SEQ ID NO: 179368 - DNA, 15 bp, Homo sapiens
acaaaaaacatgaac

SEQ ID NO: 179369 - DNA, 15 bp, Homo sapiens
gacaaaaaacatgaa

SEQ ID NO: 179370 - DNA, 15 bp, Homo sapiens
tgacaaaaaacatga

SEQ ID NO: 179371 - DNA, 15 bp, Homo sapiens
atgacaaaaaacatg

SEQ ID NO: 179372 - DNA, 15 bp, Homo sapiens
aatgacaaaaaacat

SEQ ID NO: 179373 - DNA, 15 bp, Homo sapiens
gaatgacaaaaaaca

SEQ ID NO: 179374 - DNA, 15 bp, Homo sapiens
agaatgacaaaaaac

SEQ ID NO: 179375 - DNA, 15 bp, Homo sapiens
aagaatgacaaaaaa

SEQ ID NO: 179376 - DNA, 15 bp, Homo sapiens
aaagaatgacaaaaa

SEQ ID NO: 179377 - DNA, 15 bp, Homo sapiens
gaaagaatgacaaaa

SEQ ID NO: 179378 - DNA, 15 bp, Homo sapiens
tgaaagaatgacaaa

SEQ ID NO: 179379 - DNA, 15 bp, Homo sapiens
ctgaaagaatgacaa

SEQ ID NO: 179380 - DNA, 15 bp, Homo sapiens
tctgaaagaatgaca

SEQ ID NO: 179381 - DNA, 15 bp, Homo sapiens
gtctgaaagaatgac

SEQ ID NO: 179382 - DNA, 15 bp, Homo sapiens
agtctgaaagaatga

SEQ ID NO: 179383 - DNA, 15 bp, Homo sapiens
cagtctgaaagaatg

SEQ ID NO: 179384 - DNA, 15 bp, Homo sapiens
gcagtctgaaagaat

SEQ ID NO: 179385 - DNA, 15 bp, Homo sapiens
tgcagtctgaaagaa

SEQ ID NO: 179386 - DNA, 15 bp, Homo sapiens
ctgcagtctgaaaga

SEQ ID NO: 179387 - DNA, 15 bp, Homo sapiens
actgcagtctgaaag

SEQ ID NO: 179388 - DNA, 15 bp, Homo sapiens
cactgcagtctgaaa

SEQ ID NO: 179389 - DNA, 15 bp, Homo sapiens
acactgcagtctgaa

SEQ ID NO: 179390 - DNA, 15 bp, Homo sapiens
aacactgcagtctga

SEQ ID NO: 179391 - DNA, 15 bp, Homo sapiens
aaacactgcagtctg

SEQ ID NO: 179392 - DNA, 15 bp, Homo sapiens
aaaacactgcagtct

SEQ ID NO: 179393 - DNA, 15 bp, Homo sapiens
caaaacactgcagtc

SEQ ID NO: 179394 - DNA, 15 bp, Homo sapiens
acaaaacactgcagt

SEQ ID NO: 179395 - DNA, 15 bp, Homo sapiens
aacaaaacactgcag

SEQ ID NO: 179396 - DNA, 15 bp, Homo sapiens
aaacaaaacactgca

SEQ ID NO: 179397 - DNA, 15 bp, Homo sapiens
aaaacaaaacactgc

SEQ ID NO: 179398 - DNA, 15 bp, Homo sapiens
caaaacaaaacactg

SEQ ID NO: 179399 - DNA, 15 bp, Homo sapiens
tcaaaacaaaacact

SEQ ID NO: 179400 - DNA, 15 bp, Homo sapiens
ttcaaaacaaaacac

SEQ ID NO: 179401 - DNA, 15 bp, Homo sapiens
attcaaaacaaaaca

SEQ ID NO: 179402 - DNA, 15 bp, Homo sapiens
cattcaaaacaaaac

SEQ ID NO: 179403 - DNA, 15 bp, Homo sapiens
acattcaaaacaaaa

SEQ ID NO: 179404 - DNA, 15 bp, Homo sapiens
cacattcaaaacaaa

SEQ ID NO: 179405 - DNA, 15 bp, Homo sapiens
ccacattcaaaacaa

SEQ ID NO: 179406 - DNA, 15 bp, Homo sapiens
accacattcaaaaca

SEQ ID NO: 179407 - DNA, 15 bp, Homo sapiens
caccacattcaaaac

SEQ ID NO: 179408 - DNA, 15 bp, Homo sapiens
tcaccacattcaaaa

SEQ ID NO: 179409 - DNA, 15 bp, Homo sapiens
ttcaccacattcaaa

SEQ ID NO: 179410 - DNA, 15 bp, Homo sapiens
tttcaccacattcaa

SEQ ID NO: 179411 - DNA, 15 bp, Homo sapiens
atttcaccacattca

SEQ ID NO: 179412 - DNA, 15 bp, Homo sapiens
aatttcaccacattc

SEQ ID NO: 179413 - DNA, 15 bp, Homo sapiens
caatttcaccacatt

SEQ ID NO: 179414 - DNA, 15 bp, Homo sapiens
ccaatttcaccacat

SEQ ID NO: 179415 - DNA, 15 bp, Homo sapiens
accaatttcaccaca

SEQ ID NO: 179416 - DNA, 15 bp, Homo sapiens
aaccaatttcaccac

SEQ ID NO: 179417 - DNA, 15 bp, Homo sapiens
aaaccaatttcacca

SEQ ID NO: 179418 - DNA, 15 bp, Homo sapiens
aaaaccaatttcacc

SEQ ID NO: 179419 - DNA, 15 bp, Homo sapiens
taaaaccaatttcac

SEQ ID NO: 179420 - DNA, 15 bp, Homo sapiens
ataaaaccaatttca

SEQ ID NO: 179421 - DNA, 15 bp, Homo sapiens
aataaaaccaatttc

SEQ ID NO: 179422 - DNA, 15 bp, Homo sapiens
gaataaaaccaattt

SEQ ID NO: 179423 - DNA, 15 bp, Homo sapiens
ggaataaaaccaatt

SEQ ID NO: 179424 - DNA, 15 bp, Homo sapiens
aggaataaaaccaat

SEQ ID NO: 179425 - DNA, 15 bp, Homo sapiens
gaggaataaaaccaa

SEQ ID NO: 179426 - DNA, 15 bp, Homo sapiens
ccaagaggaataaaa

SEQ ID NO: 179427 - DNA, 15 bp, Homo sapiens
cccaagaggaataaa

SEQ ID NO: 179428 - DNA, 15 bp, Homo sapiens
tcccaagaggaataa

SEQ ID NO: 179429 - DNA, 15 bp, Homo sapiens
gtcccaagaggaata

SEQ ID NO: 179430 - DNA, 15 bp, Homo sapiens
agtcccaagaggaat

SEQ ID NO: 179431 - DNA, 15 bp, Homo sapiens
cagtcccaagaggaa

SEQ ID NO: 179432 - DNA, 15 bp, Homo sapiens
gcagtcccaagagga

SEQ ID NO: 179433 - DNA, 15 bp, Homo sapiens
agcagtcccaagagg

SEQ ID NO: 179434 - DNA, 15 bp, Homo sapiens
aagcagtcccaagag

SEQ ID NO: 179435 - DNA, 15 bp, Homo sapiens
taagcagtcccaaga

SEQ ID NO: 179436 - DNA, 15 bp, Homo sapiens
ataagcagtcccaag

SEQ ID NO: 179437 - DNA, 15 bp, Homo sapiens
gataagcagtcccaa

SEQ ID NO: 179438 - DNA, 15 bp, Homo sapiens
agataagcagtccca

SEQ ID NO: 179439 - DNA, 15 bp, Homo sapiens
gagataagcagtccc

SEQ ID NO: 179440 - DNA, 15 bp, Homo sapiens
agagataagcagtcc

SEQ ID NO: 179441 - DNA, 15 bp, Homo sapiens
tagagataagcagtc

SEQ ID NO: 179442 - DNA, 15 bp, Homo sapiens
ctagagataagcagt

SEQ ID NO: 179443 - DNA, 15 bp, Homo sapiens
cctagagataagcag

SEQ ID NO: 179444 - DNA, 15 bp, Homo sapiens
ccctagagataagca

SEQ ID NO: 179445 - DNA, 15 bp, Homo sapiens
gccctagagataagc

SEQ ID NO: 179446 - DNA, 15 bp, Homo sapiens
ggccctagagataag

SEQ ID NO: 179447 - DNA, 15 bp, Homo sapiens
aggccctagagataa

SEQ ID NO: 179448 - DNA, 15 bp, Homo sapiens
caggccctagagata

SEQ ID NO: 179449 - DNA, 15 bp, Homo sapiens
ccaggccctagagat

SEQ ID NO: 179450 - DNA, 15 bp, Homo sapiens
tccaggccctagaga

SEQ ID NO: 179451 - DNA, 15 bp, Homo sapiens
atccaggccctagag

SEQ ID NO: 179452 - DNA, 15 bp, Homo sapiens
catccaggccctaga

SEQ ID NO: 179453 - DNA, 15 bp, Homo sapiens
gcatccaggccctag

SEQ ID NO: 179454 - DNA, 15 bp, Homo sapiens
agcatccaggcccta

SEQ ID NO: 179455 - DNA, 15 bp, Homo sapiens
aagcatccaggccct

SEQ ID NO: 179456 - DNA, 15 bp, Homo sapiens
gaagcatccaggccc

SEQ ID NO: 179457 - DNA, 15 bp, Homo sapiens
ggaagcatccaggcc

SEQ ID NO: 179458 - DNA, 15 bp, Homo sapiens
aggaagcatccaggc

SEQ ID NO: 179459 - DNA, 15 bp, Homo sapiens
aaggaagcatccagg

SEQ ID NO: 179460 - DNA, 15 bp, Homo sapiens
aaaggaagcatccag

SEQ ID NO: 179461 - DNA, 15 bp, Homo sapiens
taaaggaagcatcca

SEQ ID NO: 179462 - DNA, 15 bp, Homo sapiens
ttaaaggaagcatcc

SEQ ID NO: 179463 - DNA, 15 bp, Homo sapiens
tttaaaggaagcatc

SEQ ID NO: 179464 - DNA, 15 bp, Homo sapiens
atttaaaggaagcat

SEQ ID NO: 179465 - DNA, 15 bp, Homo sapiens
tatttaaaggaagca

SEQ ID NO: 179466 - DNA, 15 bp, Homo sapiens
ctatttaaaggaagc

SEQ ID NO: 179467 - DNA, 15 bp, Homo sapiens
cctatttaaaggaag

SEQ ID NO: 179468 - DNA, 15 bp, Homo sapiens
ccctatttaaaggaa

SEQ ID NO: 179469 - DNA, 15 bp, Homo sapiens
tccctatttaaagga

SEQ ID NO: 179470 - DNA, 15 bp, Homo sapiens
atccctatttaaagg

SEQ ID NO: 179471 - DNA, 15 bp, Homo sapiens
aatccctatttaaag

SEQ ID NO: 179472 - DNA, 15 bp, Homo sapiens
gaatccctatttaaa

SEQ ID NO: 179473 - DNA, 15 bp, Homo sapiens
tgaatccctatttaa

SEQ ID NO: 179474 - DNA, 15 bp, Homo sapiens
gtgaatccctattta

SEQ ID NO: 179475 - DNA, 15 bp, Homo sapiens
tgtgaatccctattt

SEQ ID NO: 179476 - DNA, 15 bp, Homo sapiens
ctgtgaatccctatt

SEQ ID NO: 179477 - DNA, 15 bp, Homo sapiens
cctgtgaatccctat

SEQ ID NO: 179478 - DNA, 15 bp, Homo sapiens
acctgtgaatcccta

SEQ ID NO: 179479 - DNA, 15 bp, Homo sapiens
tacctgtgaatccct

SEQ ID NO: 179480 - DNA, 15 bp, Homo sapiens
ctacctgtgaatccc

SEQ ID NO: 179481 - DNA, 15 bp, Homo sapiens
actacctgtgaatcc

SEQ ID NO: 179482 - DNA, 15 bp, Homo sapiens
tactacctgtgaatc

SEQ ID NO: 179483 - DNA, 15 bp, Homo sapiens
ttactacctgtgaat

SEQ ID NO: 179484 - DNA, 15 bp, Homo sapiens
tttactacctgtgaa

SEQ ID NO: 179485 - DNA, 15 bp, Homo sapiens
atttactacctgtga

SEQ ID NO: 179486 - DNA, 15 bp, Homo sapiens
gatttactacctgtg

SEQ ID NO: 179487 - DNA, 15 bp, Homo sapiens
tgatttactacctgt

SEQ ID NO: 179488 - DNA, 15 bp, Homo sapiens
atgatttactacctg

SEQ ID NO: 179489 - DNA, 15 bp, Homo sapiens
aatgatttactacct

SEQ ID NO: 179490 - DNA, 15 bp, Homo sapiens
taatgatttactacc

SEQ ID NO: 179491 - DNA, 15 bp, Homo sapiens
ctaatgatttactac

SEQ ID NO: 179492 - DNA, 15 bp, Homo sapiens
tctaatgatttacta

SEQ ID NO: 179493 - DNA, 15 bp, Homo sapiens
ttctaatgatttact

SEQ ID NO: 179494 - DNA, 15 bp, Homo sapiens
attctaatgatttac

SEQ ID NO: 179495 - DNA, 15 bp, Homo sapiens
aattctaatgattta

SEQ ID NO: 179496 - DNA, 15 bp, Homo sapiens
aaattctaatgattt

SEQ ID NO: 179497 - DNA, 15 bp, Homo sapiens
aaaattctaatgatt

SEQ ID NO: 179498 - DNA, 15 bp, Homo sapiens
aaaaattctaatgat

SEQ ID NO: 179499 - DNA, 15 bp, Homo sapiens
caaaaattctaatga

SEQ ID NO: 179500 - DNA, 15 bp, Homo sapiens
acaaaaattctaatg

SEQ ID NO: 179501 - DNA, 15 bp, Homo sapiens
aacaaaaattctaat

SEQ ID NO: 179502 - DNA, 15 bp, Homo sapiens
aaacaaaaattctaa

SEQ ID NO: 179503 - DNA, 15 bp, Homo sapiens
taaacaaaaattcta

SEQ ID NO: 179504 - DNA, 15 bp, Homo sapiens
ttaaacaaaaattct

SEQ ID NO: 179505 - DNA, 15 bp, Homo sapiens
gttaaacaaaaattc

SEQ ID NO: 179506 - DNA, 15 bp, Homo sapiens
tgttaaacaaaaatt

SEQ ID NO: 179507 - DNA, 15 bp, Homo sapiens
ctgttaaacaaaaat

SEQ ID NO: 179508 - DNA, 15 bp, Homo sapiens
actgttaaacaaaaa

SEQ ID NO: 179509 - DNA, 15 bp, Homo sapiens
cactgttaaacaaaa

SEQ ID NO: 179510 - DNA, 15 bp, Homo sapiens
tcactgttaaacaaa

SEQ ID NO: 179511 - DNA, 15 bp, Homo sapiens
ttcactgttaaacaa

SEQ ID NO: 179512 - DNA, 15 bp, Homo sapiens
tttcactgttaaaca

SEQ ID NO: 179513 - DNA, 15 bp, Homo sapiens
ctttcactgttaaac

SEQ ID NO: 179514 - DNA, 15 bp, Homo sapiens
tctttcactgttaaa

SEQ ID NO: 179515 - DNA, 15 bp, Homo sapiens
ttctttcactgttaa

SEQ ID NO: 179516 - DNA, 15 bp, Homo sapiens
cttctttcactgtta

SEQ ID NO: 179517 - DNA, 15 bp, Homo sapiens
acttctttcactgtt

SEQ ID NO: 179518 - DNA, 15 bp, Homo sapiens
gacttctttcactgt

SEQ ID NO: 179519 - DNA, 15 bp, Homo sapiens
tgacttctttcactg

SEQ ID NO: 179520 - DNA, 15 bp, Homo sapiens
gtgacttctttcact

SEQ ID NO: 179521 - DNA, 15 bp, Homo sapiens
agtgacttctttcac

SEQ ID NO: 179522 - DNA, 15 bp, Homo sapiens
aagtgacttctttca

SEQ ID NO: 179523 - DNA, 15 bp, Homo sapiens
taagtgacttctttc

SEQ ID NO: 179524 - DNA, 15 bp, Homo sapiens
ttaagtgacttcttt

SEQ ID NO: 179525 - DNA, 15 bp, Homo sapiens
gttaagtgacttctt

SEQ ID NO: 179526 - DNA, 15 bp, Homo sapiens
tgttaagtgacttct

SEQ ID NO: 179527 - DNA, 15 bp, Homo sapiens
atgttaagtgacttc

SEQ ID NO: 179528 - DNA, 15 bp, Homo sapiens
tatgttaagtgactt

SEQ ID NO: 179529 - DNA, 15 bp, Homo sapiens
ctatgttaagtgact

SEQ ID NO: 179530 - DNA, 15 bp, Homo sapiens
cctatgttaagtgac

SEQ ID NO: 179531 - DNA, 15 bp, Homo sapiens
acctatgttaagtga

SEQ ID NO: 179532 - DNA, 15 bp, Homo sapiens
gacctatgttaagtg

SEQ ID NO: 179533 - DNA, 15 bp, Homo sapiens
agacctatgttaagt

SEQ ID NO: 179534 - DNA, 15 bp, Homo sapiens
cagacctatgttaag

SEQ ID NO: 179535 - DNA, 15 bp, Homo sapiens
acagacctatgttaa

SEQ ID NO: 179536 - DNA, 15 bp, Homo sapiens
gacagacctatgtta

SEQ ID NO: 179537 - DNA, 15 bp, Homo sapiens
tgacagacctatgtt

SEQ ID NO: 179538 - DNA, 15 bp, Homo sapiens
atgacagacctatgt

SEQ ID NO: 179539 - DNA, 15 bp, Homo sapiens
tatgacagacctatg

SEQ ID NO: 179540 - DNA, 15 bp, Homo sapiens
ctatgacagacctat

SEQ ID NO: 179541 - DNA, 15 bp, Homo sapiens
actatgacagaccta

SEQ ID NO: 179542 - DNA, 15 bp, Homo sapiens
aactatgacagacct

SEQ ID NO: 179543 - DNA, 15 bp, Homo sapiens
gaactatgacagacc

SEQ ID NO: 179544 - DNA, 15 bp, Homo sapiens
agaactatgacagac

SEQ ID NO: 179545 - DNA, 15 bp, Homo sapiens
cagaactatgacaga

SEQ ID NO: 179546 - DNA, 15 bp, Homo sapiens
acagaactatgacag

SEQ ID NO: 179547 - DNA, 15 bp, Homo sapiens
gacagaactatgaca

SEQ ID NO: 179548 - DNA, 15 bp, Homo sapiens
agacagaactatgac

SEQ ID NO: 179549 - DNA, 15 bp, Homo sapiens
aagacagaactatga

SEQ ID NO: 179550 - DNA, 15 bp, Homo sapiens
aaagacagaactatg

SEQ ID NO: 179551 - DNA, 15 bp, Homo sapiens
caaagacagaactat

SEQ ID NO: 179552 - DNA, 15 bp, Homo sapiens
acaaagacagaacta

SEQ ID NO: 179553 - DNA, 15 bp, Homo sapiens
gacaaagacagaact

SEQ ID NO: 179554 - DNA, 15 bp, Homo sapiens
tgacaaagacagaac

SEQ ID NO: 179555 - DNA, 15 bp, Homo sapiens
gtgacaaagacagaa

SEQ ID NO: 179556 - DNA, 15 bp, Homo sapiens
agtgacaaagacaga

SEQ ID NO: 179557 - DNA, 15 bp, Homo sapiens
cagtgacaaagacag

SEQ ID NO: 179558 - DNA, 15 bp, Homo sapiens
acagtgacaaagaca

SEQ ID NO: 179559 - DNA, 15 bp, Homo sapiens
tacagtgacaaagac

SEQ ID NO: 179560 - DNA, 15 bp, Homo sapiens
atacagtgacaaaga

SEQ ID NO: 179561 - DNA, 15 bp, Homo sapiens
catacagtgacaaag

SEQ ID NO: 179562 - DNA, 15 bp, Homo sapiens
acatacagtgacaaa

SEQ ID NO: 179563 - DNA, 15 bp, Homo sapiens
tacatacagtgacaa

SEQ ID NO: 179564 - DNA, 15 bp, Homo sapiens
ctacatacagtgaca

SEQ ID NO: 179565 - DNA, 15 bp, Homo sapiens
tctacatacagtgac

SEQ ID NO: 179566 - DNA, 15 bp, Homo sapiens
ttctacatacagtga

SEQ ID NO: 179567 - DNA, 15 bp, Homo sapiens
attctacatacagtg

SEQ ID NO: 179568 - DNA, 15 bp, Homo sapiens
aattctacatacagt

SEQ ID NO: 179569 - DNA, 15 bp, Homo sapiens
aaattctacatacag

SEQ ID NO: 179570 - DNA, 15 bp, Homo sapiens
gaaattctacataca

SEQ ID NO: 179571 - DNA, 15 bp, Homo sapiens
tgaaattctacatac

SEQ ID NO: 179572 - DNA, 15 bp, Homo sapiens
atgaaattctacata

SEQ ID NO: 179573 - DNA, 15 bp, Homo sapiens
tatgaaattctacat

SEQ ID NO: 179574 - DNA, 15 bp, Homo sapiens
ctatgaaattctaca

SEQ ID NO: 179575 - DNA, 15 bp, Homo sapiens
actatgaaattctac

SEQ ID NO: 179576 - DNA, 15 bp, Homo sapiens
cactatgaaattcta

SEQ ID NO: 179577 - DNA, 15 bp, Homo sapiens
tcactatgaaattct

SEQ ID NO: 179578 - DNA, 15 bp, Homo sapiens
atcactatgaaattc

SEQ ID NO: 179579 - DNA, 15 bp, Homo sapiens
tatcactatgaaatt

SEQ ID NO: 179580 - DNA, 15 bp, Homo sapiens
gtatcactatgaaat

SEQ ID NO: 179581 - DNA, 15 bp, Homo sapiens
tgtatcactatgaaa

SEQ ID NO: 179582 - DNA, 15 bp, Homo sapiens
ttgtatcactatgaa

SEQ ID NO: 179583 - DNA, 15 bp, Homo sapiens
gttgtatcactatga

SEQ ID NO: 179584 - DNA, 15 bp, Homo sapiens
tgttgtatcactatg

SEQ ID NO: 179585 - DNA, 15 bp, Homo sapiens
atgttgtatcactat

SEQ ID NO: 179586 - DNA, 15 bp, Homo sapiens
gatgttgtatcacta

SEQ ID NO: 179587 - DNA, 15 bp, Homo sapiens
ggatgttgtatcact

SEQ ID NO: 179588 - DNA, 15 bp, Homo sapiens
tggatgttgtatcac

SEQ ID NO: 179589 - DNA, 15 bp, Homo sapiens
atggatgttgtatca

SEQ ID NO: 179590 - DNA, 15 bp, Homo sapiens
aatggatgttgtatc

SEQ ID NO: 179591 - DNA, 15 bp, Homo sapiens
aaatggatgttgtat

SEQ ID NO: 179592 - DNA, 15 bp, Homo sapiens
aaaatggatgttgta

SEQ ID NO: 179593 - DNA, 15 bp, Homo sapiens
gaaaatggatgttgt

SEQ ID NO: 179594 - DNA, 15 bp, Homo sapiens
agaaaatggatgttg

SEQ ID NO: 179595 - DNA, 15 bp, Homo sapiens
aagaaaatggatgtt

SEQ ID NO: 179596 - DNA, 15 bp, Homo sapiens
taagaaaatggatgt

SEQ ID NO: 179597 - DNA, 15 bp, Homo sapiens
ctaagaaaatggatg

SEQ ID NO: 179598 - DNA, 15 bp, Homo sapiens
gctaagaaaatggat

SEQ ID NO: 179599 - DNA, 15 bp, Homo sapiens
tgctaagaaaatgga

SEQ ID NO: 179600 - DNA, 15 bp, Homo sapiens
ttgctaagaaaatgg

SEQ ID NO: 179601 - DNA, 15 bp, Homo sapiens
tttgctaagaaaatg

SEQ ID NO: 179602 - DNA, 15 bp, Homo sapiens
ttttgctaagaaaat

SEQ ID NO: 179603 - DNA, 15 bp, Homo sapiens
tttttgctaagaaaa

SEQ ID NO: 179604 - DNA, 15 bp, Homo sapiens
ctttttgctaagaaa

SEQ ID NO: 179605 - DNA, 15 bp, Homo sapiens
actttttgctaagaa

SEQ ID NO: 179606 - DNA, 15 bp, Homo sapiens
aactttttgctaaga

SEQ ID NO: 179607 - DNA, 15 bp, Homo sapiens
taactttttgctaag

SEQ ID NO: 179608 - DNA, 15 bp, Homo sapiens
ctaactttttgctaa

SEQ ID NO: 179609 - DNA, 15 bp, Homo sapiens
cctaactttttgcta

SEQ ID NO: 179610 - DNA, 15 bp, Homo sapiens
acctaactttttgct

SEQ ID NO: 179611 - DNA, 15 bp, Homo sapiens
gacctaactttttgc

SEQ ID NO: 179612 - DNA, 15 bp, Homo sapiens
agacctaactttttg

SEQ ID NO: 179613 - DNA, 15 bp, Homo sapiens
tagacctaacttttt

SEQ ID NO: 179614 - DNA, 15 bp, Homo sapiens
ctagacctaactttt

SEQ ID NO: 179615 - DNA, 15 bp, Homo sapiens
cctagacctaacttt

SEQ ID NO: 179616 - DNA, 15 bp, Homo sapiens
ccctagacctaactt

SEQ ID NO: 179617 - DNA, 15 bp, Homo sapiens
accctagacctaact

SEQ ID NO: 179618 - DNA, 15 bp, Homo sapiens
taccctagacctaac

SEQ ID NO: 179619 - DNA, 15 bp, Homo sapiens
ataccctagacctaa

SEQ ID NO: 179620 - DNA, 15 bp, Homo sapiens
tataccctagaccta

SEQ ID NO: 179621 - DNA, 15 bp, Homo sapiens
atataccctagacct

SEQ ID NO: 179622 - DNA, 15 bp, Homo sapiens
gatataccctagacc

SEQ ID NO: 179623 - DNA, 15 bp, Homo sapiens
agatataccctagac

SEQ ID NO: 179624 - DNA, 15 bp, Homo sapiens
cagatataccctaga

SEQ ID NO: 179625 - DNA, 15 bp, Homo sapiens
acagatataccctag

SEQ ID NO: 179626 - DNA, 15 bp, Homo sapiens
aacagatatacccta

SEQ ID NO: 179627 - DNA, 15 bp, Homo sapiens
aaacagatataccct

SEQ ID NO: 179628 - DNA, 15 bp, Homo sapiens
caaacagatataccc

SEQ ID NO: 179629 - DNA, 15 bp, Homo sapiens
ccaaacagatatacc

SEQ ID NO: 179630 - DNA, 15 bp, Homo sapiens
tccaaacagatatac

SEQ ID NO: 179631 - DNA, 15 bp, Homo sapiens
ttccaaacagatata

SEQ ID NO: 179632 - DNA, 15 bp, Homo sapiens
tttccaaacagatat

SEQ ID NO: 179633 - DNA, 15 bp, Homo sapiens
ttttccaaacagata

SEQ ID NO: 179634 - DNA, 15 bp, Homo sapiens
attttccaaacagat

SEQ ID NO: 179635 - DNA, 15 bp, Homo sapiens
aattttccaaacaga

SEQ ID NO: 179636 - DNA, 15 bp, Homo sapiens
taattttccaaacag

SEQ ID NO: 179637 - DNA, 15 bp, Homo sapiens
gtaattttccaaaca

SEQ ID NO: 179638 - DNA, 15 bp, Homo sapiens
tgtaattttccaaac

SEQ ID NO: 179639 - DNA, 15 bp, Homo sapiens
atgtaattttccaaa

SEQ ID NO: 179640 - DNA, 15 bp, Homo sapiens
gatgtaattttccaa

SEQ ID NO: 179641 - DNA, 15 bp, Homo sapiens
tgatgtaattttcca

SEQ ID NO: 179642 - DNA, 15 bp, Homo sapiens
ctgatgtaattttcc

SEQ ID NO: 179643 - DNA, 15 bp, Homo sapiens
tctgatgtaattttc

SEQ ID NO: 179644 - DNA, 15 bp, Homo sapiens
ttctgatgtaatttt

SEQ ID NO: 179645 - DNA, 15 bp, Homo sapiens
attctgatgtaattt

SEQ ID NO: 179646 - DNA, 15 bp, Homo sapiens
aattctgatgtaatt

SEQ ID NO: 179647 - DNA, 15 bp, Homo sapiens
caattctgatgtaat

SEQ ID NO: 179648 - DNA, 15 bp, Homo sapiens
tcaattctgatgtaa

SEQ ID NO: 179649 - DNA, 15 bp, Homo sapiens
atcaattctgatgta

SEQ ID NO: 179650 - DNA, 15 bp, Homo sapiens
aatcaattctgatgt

SEQ ID NO: 179651 - DNA, 15 bp, Homo sapiens
aaatcaattctgatg

SEQ ID NO: 179652 - DNA, 15 bp, Homo sapiens
aaaatcaattctgat

SEQ ID NO: 179653 - DNA, 15 bp, Homo sapiens
gaaaatcaattctga

SEQ ID NO: 179654 - DNA, 15 bp, Homo sapiens
tgaaaatcaattctg

SEQ ID NO: 179655 - DNA, 15 bp, Homo sapiens
ttgaaaatcaattct

SEQ ID NO: 179656 - DNA, 15 bp, Homo sapiens
attgaaaatcaattc

SEQ ID NO: 179657 - DNA, 15 bp, Homo sapiens
aattgaaaatcaatt

SEQ ID NO: 179658 - DNA, 15 bp, Homo sapiens
taattgaaaatcaat

SEQ ID NO: 179659 - DNA, 15 bp, Homo sapiens
ttaattgaaaatcaa

SEQ ID NO: 179660 - DNA, 15 bp, Homo sapiens
attaattgaaaatca

SEQ ID NO: 179661 - DNA, 15 bp, Homo sapiens
gattaattgaaaatc

SEQ ID NO: 179662 - DNA, 15 bp, Homo sapiens
tgattaattgaaaat

SEQ ID NO: 179663 - DNA, 15 bp, Homo sapiens
ttgattaattgaaaa

SEQ ID NO: 179664 - DNA, 15 bp, Homo sapiens
tttgattaattgaaa

SEQ ID NO: 179665 - DNA, 15 bp, Homo sapiens
ctttgattaattgaa

SEQ ID NO: 179666 - DNA, 15 bp, Homo sapiens
actttgattaattga

SEQ ID NO: 179667 - DNA, 15 bp, Homo sapiens
aactttgattaattg

SEQ ID NO: 179668 - DNA, 15 bp, Homo sapiens
taactttgattaatt

SEQ ID NO: 179669 - DNA, 15 bp, Homo sapiens
gtaactttgattaat

SEQ ID NO: 179670 - DNA, 15 bp, Homo sapiens
agtaactttgattaa

SEQ ID NO: 179671 - DNA, 15 bp, Homo sapiens
tagtaactttgatta

SEQ ID NO: 179672 - DNA, 15 bp, Homo sapiens
ttagtaactttgatt

SEQ ID NO: 179673 - DNA, 15 bp, Homo sapiens
tttagtaactttgat

SEQ ID NO: 179674 - DNA, 15 bp, Homo sapiens
atttagtaactttga

SEQ ID NO: 179675 - DNA, 15 bp, Homo sapiens
tatttagtaactttg

SEQ ID NO: 179676 - DNA, 15 bp, Homo sapiens
ctatttagtaacttt

SEQ ID NO: 179677 - DNA, 15 bp, Homo sapiens
actatttagtaactt

SEQ ID NO: 179678 - DNA, 15 bp, Homo sapiens
cactatttagtaact

SEQ ID NO: 179679 - DNA, 15 bp, Homo sapiens
gcactatttagtaac

SEQ ID NO: 179680 - DNA, 15 bp, Homo sapiens
agcactatttagtaa

SEQ ID NO: 179681 - DNA, 15 bp, Homo sapiens
gagcactatttagta

SEQ ID NO: 179682 - DNA, 15 bp, Homo sapiens
agagcactatttagt

SEQ ID NO: 179683 - DNA, 15 bp, Homo sapiens
cagagcactatttag

SEQ ID NO: 179684 - DNA, 15 bp, Homo sapiens
tcagagcactattta

SEQ ID NO: 179685 - DNA, 15 bp, Homo sapiens
ctcagagcactattt

SEQ ID NO: 179686 - DNA, 15 bp, Homo sapiens
actcagagcactatt

SEQ ID NO: 179687 - DNA, 15 bp, Homo sapiens
aactcagagcactat

SEQ ID NO: 179688 - DNA, 15 bp, Homo sapiens
taactcagagcacta

SEQ ID NO: 179689 - DNA, 15 bp, Homo sapiens
gtaactcagagcact

SEQ ID NO: 179690 - DNA, 15 bp, Homo sapiens
ggtaactcagagcac

SEQ ID NO: 179691 - DNA, 15 bp, Homo sapiens
tggtaactcagagca

SEQ ID NO: 179692 - DNA, 15 bp, Homo sapiens
ctggtaactcagagc

SEQ ID NO: 179693 - DNA, 15 bp, Homo sapiens
actggtaactcagag

SEQ ID NO: 179694 - DNA, 15 bp, Homo sapiens
cactggtaactcaga

SEQ ID NO: 179695 - DNA, 15 bp, Homo sapiens
ccactggtaactcag

SEQ ID NO: 179696 - DNA, 15 bp, Homo sapiens
accactggtaactca

SEQ ID NO: 179697 - DNA, 15 bp, Homo sapiens
taccactggtaactc

SEQ ID NO: 179698 - DNA, 15 bp, Homo sapiens
ataccactggtaact

SEQ ID NO: 179699 - DNA, 15 bp, Homo sapiens
aataccactggtaac

SEQ ID NO: 179700 - DNA, 15 bp, Homo sapiens
aaataccactggtaa

SEQ ID NO: 179701 - DNA, 15 bp, Homo sapiens
taaataccactggta

SEQ ID NO: 179702 - DNA, 15 bp, Homo sapiens
ttaaataccactggt

SEQ ID NO: 179703 - DNA, 15 bp, Homo sapiens
tttaaataccactgg

SEQ ID NO: 179704 - DNA, 15 bp, Homo sapiens
ttttaaataccactg

SEQ ID NO: 179705 - DNA, 15 bp, Homo sapiens
attttaaataccact

SEQ ID NO: 179706 - DNA, 15 bp, Homo sapiens
aattttaaataccac

SEQ ID NO: 179707 - DNA, 15 bp, Homo sapiens
taattttaaatacca

SEQ ID NO: 179708 - DNA, 15 bp, Homo sapiens
ttaattttaaatacc

SEQ ID NO: 179709 - DNA, 15 bp, Homo sapiens
attaattttaaatac

SEQ ID NO: 179710 - DNA, 15 bp, Homo sapiens
aattaattttaaata

SEQ ID NO: 179711 - DNA, 15 bp, Homo sapiens
aaattaattttaaat

SEQ ID NO: 179712 - DNA, 15 bp, Homo sapiens
aaaattaattttaaa

SEQ ID NO: 179713 - DNA, 15 bp, Homo sapiens
caaaattaattttaa

SEQ ID NO: 179714 - DNA, 15 bp, Homo sapiens
ccaaaattaatttta

SEQ ID NO: 179715 - DNA, 15 bp, Homo sapiens
tccaaaattaatttt

SEQ ID NO: 179716 - DNA, 15 bp, Homo sapiens
ttccaaaattaattt

SEQ ID NO: 179717 - DNA, 15 bp, Homo sapiens
cttccaaaattaatt

SEQ ID NO: 179718 - DNA, 15 bp, Homo sapiens
acttccaaaattaat

SEQ ID NO: 179719 - DNA, 15 bp, Homo sapiens
aacttccaaaattaa

SEQ ID NO: 179720 - DNA, 15 bp, Homo sapiens
caacttccaaaatta

SEQ ID NO: 179721 - DNA, 15 bp, Homo sapiens
gcaacttccaaaatt

SEQ ID NO: 179722 - DNA, 15 bp, Homo sapiens
tgcaacttccaaaat

SEQ ID NO: 179723 - DNA, 15 bp, Homo sapiens
gtgcaacttccaaaa

SEQ ID NO: 179724 - DNA, 15 bp, Homo sapiens
tgtgcaacttccaaa

SEQ ID NO: 179725 - DNA, 15 bp, Homo sapiens
gtgtgcaacttccaa

SEQ ID NO: 179726 - DNA, 15 bp, Homo sapiens
tgtgtgcaacttcca

SEQ ID NO: 179727 - DNA, 15 bp, Homo sapiens
atgtgtgcaacttcc

SEQ ID NO: 179728 - DNA, 15 bp, Homo sapiens
tatgtgtgcaacttc

SEQ ID NO: 179729 - DNA, 15 bp, Homo sapiens
gtatgtgtgcaactt

SEQ ID NO: 179730 - DNA, 15 bp, Homo sapiens
agtatgtgtgcaact

SEQ ID NO: 179731 - DNA, 15 bp, Homo sapiens
aagtatgtgtgcaac

SEQ ID NO: 179732 - DNA, 15 bp, Homo sapiens
aaagtatgtgtgcaa

SEQ ID NO: 179733 - DNA, 15 bp, Homo sapiens
taaagtatgtgtgca

SEQ ID NO: 179734 - DNA, 15 bp, Homo sapiens
ataaagtatgtgtgc

SEQ ID NO: 179735 - DNA, 15 bp, Homo sapiens
cataaagtatgtgtg

SEQ ID NO: 179736 - DNA, 15 bp, Homo sapiens
acataaagtatgtgt

SEQ ID NO: 179737 - DNA, 15 bp, Homo sapiens
cacataaagtatgtg

SEQ ID NO: 179738 - DNA, 15 bp, Homo sapiens
acacataaagtatgt

SEQ ID NO: 179739 - DNA, 15 bp, Homo sapiens
tacacataaagtatg

SEQ ID NO: 179740 - DNA, 15 bp, Homo sapiens
atacacataaagtat

SEQ ID NO: 179741 - DNA, 15 bp, Homo sapiens
aatacacataaagta

SEQ ID NO: 179742 - DNA, 15 bp, Homo sapiens
aaatacacataaagt

SEQ ID NO: 179743 - DNA, 15 bp, Homo sapiens
aaaatacacataaag

SEQ ID NO: 179744 - DNA, 15 bp, Homo sapiens
gaaaatacacataaa

SEQ ID NO: 179745 - DNA, 15 bp, Homo sapiens
agaaaatacacataa

SEQ ID NO: 179746 - DNA, 15 bp, Homo sapiens
aagaaaatacacata

SEQ ID NO: 179747 - DNA, 15 bp, Homo sapiens
aaagaaaatacacat

SEQ ID NO: 179748 - DNA, 15 bp, Homo sapiens
aaaagaaaatacaca

SEQ ID NO: 179749 - DNA, 15 bp, Homo sapiens
aaaaagaaaatacac

SEQ ID NO: 179750 - DNA, 15 bp, Homo sapiens
gaaaaagaaaataca

SEQ ID NO: 179751 - DNA, 15 bp, Homo sapiens
agaaaaagaaaatac

SEQ ID NO: 179752 - DNA, 15 bp, Homo sapiens
aagaaaaagaaaata

SEQ ID NO: 179753 - DNA, 15 bp, Homo sapiens
caagaaaaagaaaat

SEQ ID NO: 179754 - DNA, 15 bp, Homo sapiens
acaagaaaaagaaaa

SEQ ID NO: 179755 - DNA, 15 bp, Homo sapiens
tacaagaaaaagaaa

SEQ ID NO: 179756 - DNA, 15 bp, Homo sapiens
atacaagaaaaagaa

SEQ ID NO: 179757 - DNA, 15 bp, Homo sapiens
catacaagaaaaaga

SEQ ID NO: 179758 - DNA, 15 bp, Homo sapiens
tcatacaagaaaaag

SEQ ID NO: 179759 - DNA, 15 bp, Homo sapiens
ctcatacaagaaaaa

SEQ ID NO: 179760 - DNA, 15 bp, Homo sapiens
tctcatacaagaaaa

SEQ ID NO: 179761 - DNA, 15 bp, Homo sapiens
ctctcatacaagaaa

SEQ ID NO: 179762 - DNA, 15 bp, Homo sapiens
tctctcatacaagaa

SEQ ID NO: 179763 - DNA, 15 bp, Homo sapiens
ttctctcatacaaga

SEQ ID NO: 179764 - DNA, 15 bp, Homo sapiens
attctctcatacaag

SEQ ID NO: 179765 - DNA, 15 bp, Homo sapiens
cattctctcatacaa

SEQ ID NO: 179766 - DNA, 15 bp, Homo sapiens
tcattctctcataca

SEQ ID NO: 179767 - DNA, 15 bp, Homo sapiens
atcattctctcatac

SEQ ID NO: 179768 - DNA, 15 bp, Homo sapiens
tatcattctctcata

SEQ ID NO: 179769 - DNA, 15 bp, Homo sapiens
atatcattctctcat

SEQ ID NO: 179770 - DNA, 15 bp, Homo sapiens
tatatcattctctca

SEQ ID NO: 179771 - DNA, 15 bp, Homo sapiens
atatatcattctctc

SEQ ID NO: 179772 - DNA, 15 bp, Homo sapiens
tatatatcattctct

SEQ ID NO: 179773 - DNA, 15 bp, Homo sapiens
atatatatcattctc

SEQ ID NO: 179774 - DNA, 15 bp, Homo sapiens
aatatatatcattct

SEQ ID NO: 179775 - DNA, 15 bp, Homo sapiens
taatatatatcattc

SEQ ID NO: 179776 - DNA, 15 bp, Homo sapiens
ttaatatatatcatt

SEQ ID NO: 179777 - DNA, 15 bp, Homo sapiens
tttaatatatatcat

SEQ ID NO: 179778 - DNA, 15 bp, Homo sapiens
atttaatatatatca

SEQ ID NO: 179779 - DNA, 15 bp, Homo sapiens
aatttaatatatatc

SEQ ID NO: 179780 - DNA, 15 bp, Homo sapiens
caatttaatatatat

SEQ ID NO: 179781 - DNA, 15 bp, Homo sapiens
acaatttaatatata

SEQ ID NO: 179782 - DNA, 15 bp, Homo sapiens
tacaatttaatatat

SEQ ID NO: 179783 - DNA, 15 bp, Homo sapiens
ctacaatttaatata

SEQ ID NO: 179784 - DNA, 15 bp, Homo sapiens
actacaatttaatat

SEQ ID NO: 179785 - DNA, 15 bp, Homo sapiens
aactacaatttaata

SEQ ID NO: 179786 - DNA, 15 bp, Homo sapiens
taactacaatttaat

SEQ ID NO: 179787 - DNA, 15 bp, Homo sapiens
ataactacaatttaa

SEQ ID NO: 179788 - DNA, 15 bp, Homo sapiens
aataactacaattta

SEQ ID NO: 179789 - DNA, 15 bp, Homo sapiens
caataactacaattt

SEQ ID NO: 179790 - DNA, 15 bp, Homo sapiens
gcaataactacaatt

SEQ ID NO: 179791 - DNA, 15 bp, Homo sapiens
agcaataactacaat

SEQ ID NO: 179792 - DNA, 15 bp, Homo sapiens
aagcaataactacaa

SEQ ID NO: 179793 - DNA, 15 bp, Homo sapiens
taagcaataactaca

SEQ ID NO: 179794 - DNA, 15 bp, Homo sapiens
ataagcaataactac

SEQ ID NO: 179795 - DNA, 15 bp, Homo sapiens
tataagcaataacta

SEQ ID NO: 179796 - DNA, 15 bp, Homo sapiens
ttataagcaataact

SEQ ID NO: 179797 - DNA, 15 bp, Homo sapiens
attataagcaataac

SEQ ID NO: 179798 - DNA, 15 bp, Homo sapiens
gattataagcaataa

SEQ ID NO: 179799 - DNA, 15 bp, Homo sapiens
ggattataagcaata

SEQ ID NO: 179800 - DNA, 15 bp, Homo sapiens
aggattataagcaat

SEQ ID NO: 179801 - DNA, 15 bp, Homo sapiens
aaggattataagcaa

SEQ ID NO: 179802 - DNA, 15 bp, Homo sapiens
aaaggattataagca

SEQ ID NO: 179803 - DNA, 15 bp, Homo sapiens
aaaaggattataagc

SEQ ID NO: 179804 - DNA, 15 bp, Homo sapiens
taaaaggattataag

SEQ ID NO: 179805 - DNA, 15 bp, Homo sapiens
ctaaaaggattataa

SEQ ID NO: 179806 - DNA, 15 bp, Homo sapiens
tctaaaaggattata

SEQ ID NO: 179807 - DNA, 15 bp, Homo sapiens
ttctaaaaggattat

SEQ ID NO: 179808 - DNA, 15 bp, Homo sapiens
cttctaaaaggatta

SEQ ID NO: 179809 - DNA, 15 bp, Homo sapiens
ccttctaaaaggatt

SEQ ID NO: 179810 - DNA, 15 bp, Homo sapiens
gccttctaaaaggat

SEQ ID NO: 179811 - DNA, 15 bp, Homo sapiens
tgccttctaaaagga

SEQ ID NO: 179812 - DNA, 15 bp, Homo sapiens
ttgccttctaaaagg

SEQ ID NO: 179813 - DNA, 15 bp, Homo sapiens
attgccttctaaaag

SEQ ID NO: 179814 - DNA, 15 bp, Homo sapiens
cattgccttctaaaa

SEQ ID NO: 179815 - DNA, 15 bp, Homo sapiens
ccattgccttctaaa

SEQ ID NO: 179816 - DNA, 15 bp, Homo sapiens
cccattgccttctaa

SEQ ID NO: 179817 - DNA, 15 bp, Homo sapiens
ccccattgccttcta

SEQ ID NO: 179818 - DNA, 15 bp, Homo sapiens
gccccattgccttct

SEQ ID NO: 179819 - DNA, 15 bp, Homo sapiens
agccccattgccttc

SEQ ID NO: 179820 - DNA, 15 bp, Homo sapiens
tagccccattgcctt

SEQ ID NO: 179821 - DNA, 15 bp, Homo sapiens
gtagccccattgcct

SEQ ID NO: 179822 - DNA, 15 bp, Homo sapiens
agtagccccattgcc

SEQ ID NO: 179823 - DNA, 15 bp, Homo sapiens
gagtagccccattgc

SEQ ID NO: 179824 - DNA, 15 bp, Homo sapiens
tgagtagccccattg

SEQ ID NO: 179825 - DNA, 15 bp, Homo sapiens
ttgagtagccccatt

SEQ ID NO: 179826 - DNA, 15 bp, Homo sapiens
cttgagtagccccat

SEQ ID NO: 179827 - DNA, 15 bp, Homo sapiens
ccttgagtagcccca

SEQ ID NO: 179828 - DNA, 15 bp, Homo sapiens
tccttgagtagcccc

SEQ ID NO: 179829 - DNA, 15 bp, Homo sapiens
ctccttgagtagccc

SEQ ID NO: 179830 - DNA, 15 bp, Homo sapiens
cctccttgagtagcc

SEQ ID NO: 179831 - DNA, 15 bp, Homo sapiens
gcctccttgagtagc

SEQ ID NO: 179832 - DNA, 15 bp, Homo sapiens
agcctccttgagtag

SEQ ID NO: 179833 - DNA, 15 bp, Homo sapiens
cagcctccttgagta

SEQ ID NO: 179834 - DNA, 15 bp, Homo sapiens
tcagcctccttgagt

SEQ ID NO: 179835 - DNA, 15 bp, Homo sapiens
ctcagcctccttgag

SEQ ID NO: 179836 - DNA, 15 bp, Homo sapiens
cctcagcctccttga

SEQ ID NO: 179837 - DNA, 15 bp, Homo sapiens
acctcagcctccttg

SEQ ID NO: 179838 - DNA, 15 bp, Homo sapiens
cacctcagcctcctt

SEQ ID NO: 179839 - DNA, 15 bp, Homo sapiens
gatcctcccacctca

SEQ ID NO: 179840 - DNA, 15 bp, Homo sapiens
cctcaagcgatcctc

SEQ ID NO: 179841 - DNA, 15 bp, Homo sapiens
gcctcaagcgatcct

SEQ ID NO: 179842 - DNA, 15 bp, Homo sapiens
ggcctcaagcgatcc

SEQ ID NO: 179843 - DNA, 15 bp, Homo sapiens
tggcctcaagcgatc

SEQ ID NO: 179844 - DNA, 15 bp, Homo sapiens
ctggcctcaagcgat

SEQ ID NO: 179845 - DNA, 15 bp, Homo sapiens
cctggcctcaagcga

SEQ ID NO: 179846 - DNA, 15 bp, Homo sapiens
tcctggcctcaagcg

SEQ ID NO: 179847 - DNA, 15 bp, Homo sapiens
ttcctggcctcaagc

SEQ ID NO: 179848 - DNA, 15 bp, Homo sapiens
attcctggcctcaag

SEQ ID NO: 179849 - DNA, 15 bp, Homo sapiens
aattcctggcctcaa

SEQ ID NO: 179850 - DNA, 15 bp, Homo sapiens
gaattcctggcctca

SEQ ID NO: 179851 - DNA, 15 bp, Homo sapiens
tgaattcctggcctc

SEQ ID NO: 179852 - DNA, 15 bp, Homo sapiens
ttgaattcctggcct

SEQ ID NO: 179853 - DNA, 15 bp, Homo sapiens
cttgaattcctggcc

SEQ ID NO: 179854 - DNA, 15 bp, Homo sapiens
tcttgaattcctggc

SEQ ID NO: 179855 - DNA, 15 bp, Homo sapiens
gtcttgaattcctgg

SEQ ID NO: 179856 - DNA, 15 bp, Homo sapiens
ggtcttgaattcctg

SEQ ID NO: 179857 - DNA, 15 bp, Homo sapiens
tggtcttgaattcct

SEQ ID NO: 179858 - DNA, 15 bp, Homo sapiens
ctggtcttgaattcc

SEQ ID NO: 179859 - DNA, 15 bp, Homo sapiens
gctggtcttgaattc

SEQ ID NO: 179860 - DNA, 15 bp, Homo sapiens
tgctggtcttgaatt

SEQ ID NO: 179861 - DNA, 15 bp, Homo sapiens
atgctggtcttgaat

SEQ ID NO: 179862 - DNA, 15 bp, Homo sapiens
catgctggtcttgaa

SEQ ID NO: 179863 - DNA, 15 bp, Homo sapiens
tcatgctggtcttga

SEQ ID NO: 179864 - DNA, 15 bp, Homo sapiens
ctcatgctggtcttg

SEQ ID NO: 179865 - DNA, 15 bp, Homo sapiens
gctcatgctggtctt

SEQ ID NO: 179866 - DNA, 15 bp, Homo sapiens
tgctcatgctggtct

SEQ ID NO: 179867 - DNA, 15 bp, Homo sapiens
ttgctcatgctggtc

SEQ ID NO: 179868 - DNA, 15 bp, Homo sapiens
gttgctcatgctggt

SEQ ID NO: 179869 - DNA, 15 bp, Homo sapiens
tgttgctcatgctgg

SEQ ID NO: 179870 - DNA, 15 bp, Homo sapiens
atgttgctcatgctg

SEQ ID NO: 179871 - DNA, 15 bp, Homo sapiens
tatgttgctcatgct

SEQ ID NO: 179872 - DNA, 15 bp, Homo sapiens
ttatgttgctcatgc

SEQ ID NO: 179873 - DNA, 15 bp, Homo sapiens
gttatgttgctcatg

SEQ ID NO: 179874 - DNA, 15 bp, Homo sapiens
cgttatgttgctcat

SEQ ID NO: 179875 - DNA, 15 bp, Homo sapiens
tcgttatgttgctca

SEQ ID NO: 179876 - DNA, 15 bp, Homo sapiens
ctcgttatgttgctc

SEQ ID NO: 179877 - DNA, 15 bp, Homo sapiens
tctcgttatgttgct

SEQ ID NO: 179878 - DNA, 15 bp, Homo sapiens
gtctcgttatgttgc

SEQ ID NO: 179879 - DNA, 15 bp, Homo sapiens
ggtctcgttatgttg

SEQ ID NO: 179880 - DNA, 15 bp, Homo sapiens
gggtctcgttatgtt

SEQ ID NO: 179881 - DNA, 15 bp, Homo sapiens
ggggtctcgttatgt

SEQ ID NO: 179882 - DNA, 15 bp, Homo sapiens
cggggtctcgttatg

SEQ ID NO: 179883 - DNA, 15 bp, Homo sapiens
tcggggtctcgttat

SEQ ID NO: 179884 - DNA, 15 bp, Homo sapiens
atcggggtctcgtta

SEQ ID NO: 179885 - DNA, 15 bp, Homo sapiens
gatcggggtctcgtt

SEQ ID NO: 179886 - DNA, 15 bp, Homo sapiens
agatcggggtctcgt

SEQ ID NO: 179887 - DNA, 15 bp, Homo sapiens
gagatcggggtctcg

SEQ ID NO: 179888 - DNA, 15 bp, Homo sapiens
agagatcggggtctc

SEQ ID NO: 179889 - DNA, 15 bp, Homo sapiens
tagagatcggggtct

SEQ ID NO: 179890 - DNA, 15 bp, Homo sapiens
ttagagatcggggtc

SEQ ID NO: 179891 - DNA, 15 bp, Homo sapiens
cttagagatcggggt

SEQ ID NO: 179892 - DNA, 15 bp, Homo sapiens
tcttagagatcgggg

SEQ ID NO: 179893 - DNA, 15 bp, Homo sapiens
ttcttagagatcggg

SEQ ID NO: 179894 - DNA, 15 bp, Homo sapiens
tttcttagagatcgg

SEQ ID NO: 179895 - DNA, 15 bp, Homo sapiens
atttcttagagatcg

SEQ ID NO: 179896 - DNA, 15 bp, Homo sapiens
aatttcttagagatc

SEQ ID NO: 179897 - DNA, 15 bp, Homo sapiens
aaatttcttagagat

SEQ ID NO: 179898 - DNA, 15 bp, Homo sapiens
aaaatttcttagaga

SEQ ID NO: 179899 - DNA, 15 bp, Homo sapiens
aaaaatttcttagag

SEQ ID NO: 179900 - DNA, 15 bp, Homo sapiens
aaaaaatttcttaga

SEQ ID NO: 179901 - DNA, 15 bp, Homo sapiens
taaaaaatttcttag

SEQ ID NO: 179902 - DNA, 15 bp, Homo sapiens
ttaaaaaatttctta

SEQ ID NO: 179903 - DNA, 15 bp, Homo sapiens
tttaaaaaatttctt

SEQ ID NO: 179904 - DNA, 15 bp, Homo sapiens
ttttaaaaaatttct

SEQ ID NO: 179905 - DNA, 15 bp, Homo sapiens
tttttaaaaaatttc

SEQ ID NO: 179906 - DNA, 15 bp, Homo sapiens
ttttttaaaaaattt

SEQ ID NO: 179907 - DNA, 15 bp, Homo sapiens
tttttttaaaaaatt

SEQ ID NO: 179908 - DNA, 15 bp, Homo sapiens
ctttttttaaaaaat

SEQ ID NO: 179909 - DNA, 15 bp, Homo sapiens
ctaactttttttaaa

SEQ ID NO: 179910 - DNA, 15 bp, Homo sapiens
actaactttttttaa

SEQ ID NO: 179911 - DNA, 15 bp, Homo sapiens
gactaacttttttta

SEQ ID NO: 179912 - DNA, 15 bp, Homo sapiens
tgactaacttttttt

SEQ ID NO: 179913 - DNA, 15 bp, Homo sapiens
ctgactaactttttt

SEQ ID NO: 179914 - DNA, 15 bp, Homo sapiens
cctgactaacttttt

SEQ ID NO: 179915 - DNA, 15 bp, Homo sapiens
tcctgactaactttt

SEQ ID NO: 179916 - DNA, 15 bp, Homo sapiens
ttcctgactaacttt

SEQ ID NO: 179917 - DNA, 15 bp, Homo sapiens
attcctgactaactt

SEQ ID NO: 179918 - DNA, 15 bp, Homo sapiens
cattcctgactaact

SEQ ID NO: 179919 - DNA, 15 bp, Homo sapiens
ccattcctgactaac

SEQ ID NO: 179920 - DNA, 15 bp, Homo sapiens
gccattcctgactaa

SEQ ID NO: 179921 - DNA, 15 bp, Homo sapiens
agccattcctgacta

SEQ ID NO: 179922 - DNA, 15 bp, Homo sapiens
gagccattcctgact

SEQ ID NO: 179923 - DNA, 15 bp, Homo sapiens
tgagccattcctgac

SEQ ID NO: 179924 - DNA, 15 bp, Homo sapiens
atgagccattcctga

SEQ ID NO: 179925 - DNA, 15 bp, Homo sapiens
catgagccattcctg

SEQ ID NO: 179926 - DNA, 15 bp, Homo sapiens
gcatgagccattcct

SEQ ID NO: 179927 - DNA, 15 bp, Homo sapiens
ggcatgagccattcc

SEQ ID NO: 179928 - DNA, 15 bp, Homo sapiens
aggcatgagccattc

SEQ ID NO: 179929 - DNA, 15 bp, Homo sapiens
caggcatgagccatt

SEQ ID NO: 179930 - DNA, 15 bp, Homo sapiens
acaggcatgagccat

SEQ ID NO: 179931 - DNA, 15 bp, Homo sapiens
ggactacaggcatga

SEQ ID NO: 179932 - DNA, 15 bp, Homo sapiens
aggactacaggcatg

SEQ ID NO: 179933 - DNA, 15 bp, Homo sapiens
taggactacaggcat

SEQ ID NO: 179934 - DNA, 15 bp, Homo sapiens
ctaggactacaggca

SEQ ID NO: 179935 - DNA, 15 bp, Homo sapiens
gctaggactacaggc

SEQ ID NO: 179936 - DNA, 15 bp, Homo sapiens
agctaggactacagg

SEQ ID NO: 179937 - DNA, 15 bp, Homo sapiens
acccaggtagctagg

SEQ ID NO: 179938 - DNA, 15 bp, Homo sapiens
cacccaggtagctag

SEQ ID NO: 179939 - DNA, 15 bp, Homo sapiens
ccacccaggtagcta

SEQ ID NO: 179940 - DNA, 15 bp, Homo sapiens
gccacccaggtagct

SEQ ID NO: 179941 - DNA, 15 bp, Homo sapiens
agccacccaggtagc

SEQ ID NO: 179942 - DNA, 15 bp, Homo sapiens
cagccacccaggtag

SEQ ID NO: 179943 - DNA, 15 bp, Homo sapiens
tcagccacccaggta

SEQ ID NO: 179944 - DNA, 15 bp, Homo sapiens
ctcagccacccaggt

SEQ ID NO: 179945 - DNA, 15 bp, Homo sapiens
cctcagccacccagg

SEQ ID NO: 179946 - DNA, 15 bp, Homo sapiens
acctcagccacccag

SEQ ID NO: 179947 - DNA, 15 bp, Homo sapiens
cacctcagccaccca

SEQ ID NO: 179948 - DNA, 15 bp, Homo sapiens
ccacctcagccaccc

SEQ ID NO: 179949 - DNA, 15 bp, Homo sapiens
cccacctcagccacc

SEQ ID NO: 179950 - DNA, 15 bp, Homo sapiens
tcccacctcagccac

SEQ ID NO: 179951 - DNA, 15 bp, Homo sapiens
ctcccacctcagcca

SEQ ID NO: 179952 - DNA, 15 bp, Homo sapiens
ggcaatcctcccacc

SEQ ID NO: 179953 - DNA, 15 bp, Homo sapiens
gggcaatcctcccac

SEQ ID NO: 179954 - DNA, 15 bp, Homo sapiens
tgggcaatcctccca

SEQ ID NO: 179955 - DNA, 15 bp, Homo sapiens
ctgggcaatcctccc

SEQ ID NO: 179956 - DNA, 15 bp, Homo sapiens
cctgggcaatcctcc

SEQ ID NO: 179957 - DNA, 15 bp, Homo sapiens
tcctgggcaatcctc

SEQ ID NO: 179958 - DNA, 15 bp, Homo sapiens
gtcctgggcaatcct

SEQ ID NO: 179959 - DNA, 15 bp, Homo sapiens
agtcctgggcaatcc

SEQ ID NO: 179960 - DNA, 15 bp, Homo sapiens
aagtcctgggcaatc

SEQ ID NO: 179961 - DNA, 15 bp, Homo sapiens
gaagtcctgggcaat

SEQ ID NO: 179962 - DNA, 15 bp, Homo sapiens
tgaagtcctgggcaa

SEQ ID NO: 179963 - DNA, 15 bp, Homo sapiens
ttgaagtcctgggca

SEQ ID NO: 179964 - DNA, 15 bp, Homo sapiens
cttgaagtcctgggc

SEQ ID NO: 179965 - DNA, 15 bp, Homo sapiens
ccttgaagtcctggg

SEQ ID NO: 179966 - DNA, 15 bp, Homo sapiens
gccttgaagtcctgg

SEQ ID NO: 179967 - DNA, 15 bp, Homo sapiens
agccttgaagtcctg

SEQ ID NO: 179968 - DNA, 15 bp, Homo sapiens
cagccttgaagtcct

SEQ ID NO: 179969 - DNA, 15 bp, Homo sapiens
gcagccttgaagtcc

SEQ ID NO: 179970 - DNA, 15 bp, Homo sapiens
tgcagccttgaagtc

SEQ ID NO: 179971 - DNA, 15 bp, Homo sapiens
ctgcagccttgaagt

SEQ ID NO: 179972 - DNA, 15 bp, Homo sapiens
actgcagccttgaag

SEQ ID NO: 179973 - DNA, 15 bp, Homo sapiens
ttcactgcagccttg

SEQ ID NO: 179974 - DNA, 15 bp, Homo sapiens
gttcactgcagcctt

SEQ ID NO: 179975 - DNA, 15 bp, Homo sapiens
tcatagttcactgca

SEQ ID NO: 179976 - DNA, 15 bp, Homo sapiens
atcatagttcactgc

SEQ ID NO: 179977 - DNA, 15 bp, Homo sapiens
gatcatagttcactg

SEQ ID NO: 179978 - DNA, 15 bp, Homo sapiens
agatcatagttcact

SEQ ID NO: 179979 - DNA, 15 bp, Homo sapiens
aagatcatagttcac

SEQ ID NO: 179980 - DNA, 15 bp, Homo sapiens
caagatcatagttca

SEQ ID NO: 179981 - DNA, 15 bp, Homo sapiens
gcaagatcatagttc

SEQ ID NO: 179982 - DNA, 15 bp, Homo sapiens
ggcaagatcatagtt

SEQ ID NO: 179983 - DNA, 15 bp, Homo sapiens
tggcaagatcatagt

SEQ ID NO: 179984 - DNA, 15 bp, Homo sapiens
gtggcaagatcatag

SEQ ID NO: 179985 - DNA, 15 bp, Homo sapiens
agtggcaagatcata

SEQ ID NO: 179986 - DNA, 15 bp, Homo sapiens
cagtggcaagatcat

SEQ ID NO: 179987 - DNA, 15 bp, Homo sapiens
gcagtggcaagatca

SEQ ID NO: 179988 - DNA, 15 bp, Homo sapiens
tgcagtggcaagatc

SEQ ID NO: 179989 - DNA, 15 bp, Homo sapiens
gtgcagtggcaagat

SEQ ID NO: 179990 - DNA, 15 bp, Homo sapiens
agtgcagtggcaaga

SEQ ID NO: 179991 - DNA, 15 bp, Homo sapiens
gagtgcagtggcaag

SEQ ID NO: 179992 - DNA, 15 bp, Homo sapiens
ggagtgcagtggcaa

SEQ ID NO: 179993 - DNA, 15 bp, Homo sapiens
taggctggagtgcag

SEQ ID NO: 179994 - DNA, 15 bp, Homo sapiens
ttaggctggagtgca

SEQ ID NO: 179995 - DNA, 15 bp, Homo sapiens
cttaggctggagtgc

SEQ ID NO: 179996 - DNA, 15 bp, Homo sapiens
ccttaggctggagtg

SEQ ID NO: 179997 - DNA, 15 bp, Homo sapiens
cccttaggctggagt

SEQ ID NO: 179998 - DNA, 15 bp, Homo sapiens
tcccttaggctggag

SEQ ID NO: 179999 - DNA, 15 bp, Homo sapiens
gtcccttaggctgga

SEQ ID NO: 180000 - DNA, 15 bp, Homo sapiens
tgtcccttaggctgg

SEQ ID NO: 180001 - DNA, 15 bp, Homo sapiens
ctgtcccttaggctg

SEQ ID NO: 180002 - DNA, 15 bp, Homo sapiens
tctgtcccttaggct

SEQ ID NO: 180003 - DNA, 15 bp, Homo sapiens
ttctgtcccttaggc

SEQ ID NO: 180004 - DNA, 15 bp, Homo sapiens
attctgtcccttagg

SEQ ID NO: 180005 - DNA, 15 bp, Homo sapiens
cattctgtcccttag

SEQ ID NO: 180006 - DNA, 15 bp, Homo sapiens
tcattctgtccctta

SEQ ID NO: 180007 - DNA, 15 bp, Homo sapiens
ctcattctgtccctt

SEQ ID NO: 180008 - DNA, 15 bp, Homo sapiens
tctcattctgtccct

SEQ ID NO: 180009 - DNA, 15 bp, Homo sapiens
gtctcattctgtccc

SEQ ID NO: 180010 - DNA, 15 bp, Homo sapiens
agtctcattctgtcc

SEQ ID NO: 180011 - DNA, 15 bp, Homo sapiens
aagtctcattctgtc

SEQ ID NO: 180012 - DNA, 15 bp, Homo sapiens
aaagtctcattctgt

SEQ ID NO: 180013 - DNA, 15 bp, Homo sapiens
caaagtctcattctg

SEQ ID NO: 180014 - DNA, 15 bp, Homo sapiens
acaaagtctcattct

SEQ ID NO: 180015 - DNA, 15 bp, Homo sapiens
aacaaagtctcattc

SEQ ID NO: 180016 - DNA, 15 bp, Homo sapiens
aaacaaagtctcatt

SEQ ID NO: 180017 - DNA, 15 bp, Homo sapiens
gaaacaaagtctcat

SEQ ID NO: 180018 - DNA, 15 bp, Homo sapiens
agaaacaaagtctca

SEQ ID NO: 180019 - DNA, 15 bp, Homo sapiens
tagaaacaaagtctc

SEQ ID NO: 180020 - DNA, 15 bp, Homo sapiens
ttagaaacaaagtct

SEQ ID NO: 180021 - DNA, 15 bp, Homo sapiens
tttagaaacaaagtc

SEQ ID NO: 180022 - DNA, 15 bp, Homo sapiens
ttttagaaacaaagt

SEQ ID NO: 180023 - DNA, 15 bp, Homo sapiens
attttttagaaacaa

SEQ ID NO: 180024 - DNA, 15 bp, Homo sapiens
tattttttagaaaca

SEQ ID NO: 180025 - DNA, 15 bp, Homo sapiens
ttattttttagaaac

SEQ ID NO: 180026 - DNA, 15 bp, Homo sapiens
tttattttttagaaa

SEQ ID NO: 180027 - DNA, 15 bp, Homo sapiens
ttttattttttagaa

SEQ ID NO: 180028 - DNA, 15 bp, Homo sapiens
attttattttttaga

SEQ ID NO: 180029 - DNA, 15 bp, Homo sapiens
tattttattttttag

SEQ ID NO: 180030 - DNA, 15 bp, Homo sapiens
ttattttatttttta

SEQ ID NO: 180031 - DNA, 15 bp, Homo sapiens
tattattttatttta

SEQ ID NO: 180032 - DNA, 15 bp, Homo sapiens
ttattattttatttt

SEQ ID NO: 180033 - DNA, 15 bp, Homo sapiens
tttattattttattt

SEQ ID NO: 180034 - DNA, 15 bp, Homo sapiens
ttttattattttatt

SEQ ID NO: 180035 - DNA, 15 bp, Homo sapiens
tttttattattttat

SEQ ID NO: 180036 - DNA, 15 bp, Homo sapiens
atttttattatttta

SEQ ID NO: 180037 - DNA, 15 bp, Homo sapiens
tatttttattatttt

SEQ ID NO: 180038 - DNA, 15 bp, Homo sapiens
ttatttttattattt

SEQ ID NO: 180039 - DNA, 15 bp, Homo sapiens
tttatttttattatt

SEQ ID NO: 180040 - DNA, 15 bp, Homo sapiens
ttttatttttattat

SEQ ID NO: 180041 - DNA, 15 bp, Homo sapiens
cttttatttttatta

SEQ ID NO: 180042 - DNA, 15 bp, Homo sapiens
tcttttatttttatt

SEQ ID NO: 180043 - DNA, 15 bp, Homo sapiens
ttcttttatttttat

SEQ ID NO: 180044 - DNA, 15 bp, Homo sapiens
tttcttttattttta

SEQ ID NO: 180045 - DNA, 15 bp, Homo sapiens
cttttcttttatttt

SEQ ID NO: 180046 - DNA, 15 bp, Homo sapiens
ccttttcttttattt

SEQ ID NO: 180047 - DNA, 15 bp, Homo sapiens
tccttttcttttatt

SEQ ID NO: 180048 - DNA, 15 bp, Homo sapiens
ttccttttcttttat

SEQ ID NO: 180049 - DNA, 15 bp, Homo sapiens
cttccttttctttta

SEQ ID NO: 180050 - DNA, 15 bp, Homo sapiens
ccttccttttctttt

SEQ ID NO: 180051 - DNA, 15 bp, Homo sapiens
gccttccttttcttt

SEQ ID NO: 180052 - DNA, 15 bp, Homo sapiens
tgccttccttttctt

SEQ ID NO: 180053 - DNA, 15 bp, Homo sapiens
ttgccttccttttct

SEQ ID NO: 180054 - DNA, 15 bp, Homo sapiens
attgccttccttttc

SEQ ID NO: 180055 - DNA, 15 bp, Homo sapiens
cattgccttcctttt

SEQ ID NO: 180056 - DNA, 15 bp, Homo sapiens
tcattgccttccttt

SEQ ID NO: 180057 - DNA, 15 bp, Homo sapiens
atcattgccttcctt

SEQ ID NO: 180058 - DNA, 15 bp, Homo sapiens
catcattgccttcct

SEQ ID NO: 180059 - DNA, 15 bp, Homo sapiens
acatcattgccttcc

SEQ ID NO: 180060 - DNA, 15 bp, Homo sapiens
aacatcattgccttc

SEQ ID NO: 180061 - DNA, 15 bp, Homo sapiens
gaacatcattgcctt

SEQ ID NO: 180062 - DNA, 15 bp, Homo sapiens
agaacatcattgcct

SEQ ID NO: 180063 - DNA, 15 bp, Homo sapiens
cagaacatcattgcc

SEQ ID NO: 180064 - DNA, 15 bp, Homo sapiens
gcagaacatcattgc

SEQ ID NO: 180065 - DNA, 15 bp, Homo sapiens
tgcagaacatcattg

SEQ ID NO: 180066 - DNA, 15 bp, Homo sapiens
atgcagaacatcatt

SEQ ID NO: 180067 - DNA, 15 bp, Homo sapiens
gatgcagaacatcat

SEQ ID NO: 180068 - DNA, 15 bp, Homo sapiens
tgatgcagaacatca

SEQ ID NO: 180069 - DNA, 15 bp, Homo sapiens
ctgatgcagaacatc

SEQ ID NO: 180070 - DNA, 15 bp, Homo sapiens
actgatgcagaacat

SEQ ID NO: 180071 - DNA, 15 bp, Homo sapiens
cactgatgcagaaca

SEQ ID NO: 180072 - DNA, 15 bp, Homo sapiens
tcactgatgcagaac

SEQ ID NO: 180073 - DNA, 15 bp, Homo sapiens
gtcactgatgcagaa

SEQ ID NO: 180074 - DNA, 15 bp, Homo sapiens
tgtcactgatgcaga

SEQ ID NO: 180075 - DNA, 15 bp, Homo sapiens
ttgtcactgatgcag

SEQ ID NO: 180076 - DNA, 15 bp, Homo sapiens
gttgtcactgatgca

SEQ ID NO: 180077 - DNA, 15 bp, Homo sapiens
tgttgtcactgatgc

SEQ ID NO: 180078 - DNA, 15 bp, Homo sapiens
ctgttgtcactgatg

SEQ ID NO: 180079 - DNA, 15 bp, Homo sapiens
gctgttgtcactgat

SEQ ID NO: 180080 - DNA, 15 bp, Homo sapiens
tgctgttgtcactga

SEQ ID NO: 180081 - DNA, 15 bp, Homo sapiens
atgctgttgtcactg

SEQ ID NO: 180082 - DNA, 15 bp, Homo sapiens
catgctgttgtcact

SEQ ID NO: 180083 - DNA, 15 bp, Homo sapiens
ccatgctgttgtcac

SEQ ID NO: 180084 - DNA, 15 bp, Homo sapiens
cccatgctgttgtca

SEQ ID NO: 180085 - DNA, 15 bp, Homo sapiens
gcccatgctgttgtc

SEQ ID NO: 180086 - DNA, 15 bp, Homo sapiens
tgcccatgctgttgt

SEQ ID NO: 180087 - DNA, 15 bp, Homo sapiens
atgcccatgctgttg

SEQ ID NO: 180088 - DNA, 15 bp, Homo sapiens
aatgcccatgctgtt

SEQ ID NO: 180089 - DNA, 15 bp, Homo sapiens
caatgcccatgctgt

SEQ ID NO: 180090 - DNA, 15 bp, Homo sapiens
gcaatgcccatgctg

SEQ ID NO: 180091 - DNA, 15 bp, Homo sapiens
ggcaatgcccatgct

SEQ ID NO: 180092 - DNA, 15 bp, Homo sapiens
tggcaatgcccatgc

SEQ ID NO: 180093 - DNA, 15 bp, Homo sapiens
ttggcaatgcccatg

SEQ ID NO: 180094 - DNA, 15 bp, Homo sapiens
cttggcaatgcccat

SEQ ID NO: 180095 - DNA, 15 bp, Homo sapiens
tcttggcaatgccca

SEQ ID NO: 180096 - DNA, 15 bp, Homo sapiens
atcttggcaatgccc

SEQ ID NO: 180097 - DNA, 15 bp, Homo sapiens
gatcttggcaatgcc

SEQ ID NO: 180098 - DNA, 15 bp, Homo sapiens
agatcttggcaatgc

SEQ ID NO: 180099 - DNA, 15 bp, Homo sapiens
aagatcttggcaatg

SEQ ID NO: 180100 - DNA, 15 bp, Homo sapiens
aaagatcttggcaat

SEQ ID NO: 180101 - DNA, 15 bp, Homo sapiens
caaagatcttggcaa

SEQ ID NO: 180102 - DNA, 15 bp, Homo sapiens
tcaaagatcttggca

SEQ ID NO: 180103 - DNA, 15 bp, Homo sapiens
atcaaagatcttggc

SEQ ID NO: 180104 - DNA, 15 bp, Homo sapiens
catcaaagatcttgg

SEQ ID NO: 180105 - DNA, 15 bp, Homo sapiens
tcatcaaagatcttg

SEQ ID NO: 180106 - DNA, 15 bp, Homo sapiens
gtcatcaaagatctt

SEQ ID NO: 180107 - DNA, 15 bp, Homo sapiens
ggtcatcaaagatct

SEQ ID NO: 180108 - DNA, 15 bp, Homo sapiens
aggtcatcaaagatc

SEQ ID NO: 180109 - DNA, 15 bp, Homo sapiens
aaggtcatcaaagat

SEQ ID NO: 180110 - DNA, 15 bp, Homo sapiens
taaggtcatcaaaga

SEQ ID NO: 180111 - DNA, 15 bp, Homo sapiens
gtaaggtcatcaaag

SEQ ID NO: 180112 - DNA, 15 bp, Homo sapiens
agtaaggtcatcaaa

SEQ ID NO: 180113 - DNA, 15 bp, Homo sapiens
cagtaaggtcatcaa

SEQ ID NO: 180114 - DNA, 15 bp, Homo sapiens
gcagtaaggtcatca

SEQ ID NO: 180115 - DNA, 15 bp, Homo sapiens
agcagtaaggtcatc

SEQ ID NO: 180116 - DNA, 15 bp, Homo sapiens
aagcagtaaggtcat

SEQ ID NO: 180117 - DNA, 15 bp, Homo sapiens
taagcagtaaggtca

SEQ ID NO: 180118 - DNA, 15 bp, Homo sapiens
gtaagcagtaaggtc

SEQ ID NO: 180119 - DNA, 15 bp, Homo sapiens
ggtaagcagtaaggt

SEQ ID NO: 180120 - DNA, 15 bp, Homo sapiens
aggtaagcagtaagg

SEQ ID NO: 180121 - DNA, 15 bp, Homo sapiens
gaggtaagcagtaag

SEQ ID NO: 180122 - DNA, 15 bp, Homo sapiens
agaggtaagcagtaa

SEQ ID NO: 180123 - DNA, 15 bp, Homo sapiens
gagaggtaagcagta

SEQ ID NO: 180124 - DNA, 15 bp, Homo sapiens
ggagaggtaagcagt

SEQ ID NO: 180125 - DNA, 15 bp, Homo sapiens
gggagaggtaagcag

SEQ ID NO: 180126 - DNA, 15 bp, Homo sapiens
ggggagaggtaagca

SEQ ID NO: 180127 - DNA, 15 bp, Homo sapiens
tggggagaggtaagc

SEQ ID NO: 180128 - DNA, 15 bp, Homo sapiens
ctggggagaggtaag

SEQ ID NO: 180129 - DNA, 15 bp, Homo sapiens
tctggggagaggtaa

SEQ ID NO: 180130 - DNA, 15 bp, Homo sapiens
atctggggagaggta

SEQ ID NO: 180131 - DNA, 15 bp, Homo sapiens
aatctggggagaggt

SEQ ID NO: 180132 - DNA, 15 bp, Homo sapiens
aaatctggggagagg

SEQ ID NO: 180133 - DNA, 15 bp, Homo sapiens
aaaatctggggagag

SEQ ID NO: 180134 - DNA, 15 bp, Homo sapiens
taaaatctggggaga

SEQ ID NO: 180135 - DNA, 15 bp, Homo sapiens
gtaaaatctggggag

SEQ ID NO: 180136 - DNA, 15 bp, Homo sapiens
tgtaaaatctgggga

SEQ ID NO: 180137 - DNA, 15 bp, Homo sapiens
atgtaaaatctgggg

SEQ ID NO: 180138 - DNA, 15 bp, Homo sapiens
tatgtaaaatctggg

SEQ ID NO: 180139 - DNA, 15 bp, Homo sapiens
ttatgtaaaatctgg

SEQ ID NO: 180140 - DNA, 15 bp, Homo sapiens
attatgtaaaatctg

SEQ ID NO: 180141 - DNA, 15 bp, Homo sapiens
aattatgtaaaatct

SEQ ID NO: 180142 - DNA, 15 bp, Homo sapiens
aaattatgtaaaatc

SEQ ID NO: 180143 - DNA, 15 bp, Homo sapiens
aaaattatgtaaaat

SEQ ID NO: 180144 - DNA, 15 bp, Homo sapiens
taaaattatgtaaaa

SEQ ID NO: 180145 - DNA, 15 bp, Homo sapiens
ataaaattatgtaaa

SEQ ID NO: 180146 - DNA, 15 bp, Homo sapiens
gataaaattatgtaa

SEQ ID NO: 180147 - DNA, 15 bp, Homo sapiens
agataaaattatgta

SEQ ID NO: 180148 - DNA, 15 bp, Homo sapiens
aagataaaattatgt

SEQ ID NO: 180149 - DNA, 15 bp, Homo sapiens
gaagataaaattatg

SEQ ID NO: 180150 - DNA, 15 bp, Homo sapiens
ggaagataaaattat

SEQ ID NO: 180151 - DNA, 15 bp, Homo sapiens
aggaagataaaatta

SEQ ID NO: 180152 - DNA, 15 bp, Homo sapiens
caggaagataaaatt

SEQ ID NO: 180153 - DNA, 15 bp, Homo sapiens
acaggaagataaaat

SEQ ID NO: 180154 - DNA, 15 bp, Homo sapiens
gacaggaagataaaa

SEQ ID NO: 180155 - DNA, 15 bp, Homo sapiens
ggacaggaagataaa

SEQ ID NO: 180156 - DNA, 15 bp, Homo sapiens
gggacaggaagataa

SEQ ID NO: 180157 - DNA, 15 bp, Homo sapiens
tgggacaggaagata

SEQ ID NO: 180158 - DNA, 15 bp, Homo sapiens
atgggacaggaagat

SEQ ID NO: 180159 - DNA, 15 bp, Homo sapiens
aatgggacaggaaga

SEQ ID NO: 180160 - DNA, 15 bp, Homo sapiens
caatgggacaggaag

SEQ ID NO: 180161 - DNA, 15 bp, Homo sapiens
acaatgggacaggaa

SEQ ID NO: 180162 - DNA, 15 bp, Homo sapiens
tacaatgggacagga

SEQ ID NO: 180163 - DNA, 15 bp, Homo sapiens
gtacaatgggacagg

SEQ ID NO: 180164 - DNA, 15 bp, Homo sapiens
tgtacaatgggacag

SEQ ID NO: 180165 - DNA, 15 bp, Homo sapiens
gtgtacaatgggaca

SEQ ID NO: 180166 - DNA, 15 bp, Homo sapiens
agtgtacaatgggac

SEQ ID NO: 180167 - DNA, 15 bp, Homo sapiens
cagtgtacaatggga

SEQ ID NO: 180168 - DNA, 15 bp, Homo sapiens
tcagtgtacaatggg

SEQ ID NO: 180169 - DNA, 15 bp, Homo sapiens
gtcagtgtacaatgg

SEQ ID NO: 180170 - DNA, 15 bp, Homo sapiens
tgtcagtgtacaatg

SEQ ID NO: 180171 - DNA, 15 bp, Homo sapiens
ttgtcagtgtacaat

SEQ ID NO: 180172 - DNA, 15 bp, Homo sapiens
attgtcagtgtacaa

SEQ ID NO: 180173 - DNA, 15 bp, Homo sapiens
tattgtcagtgtaca

SEQ ID NO: 180174 - DNA, 15 bp, Homo sapiens
gtattgtcagtgtac

SEQ ID NO: 180175 - DNA, 15 bp, Homo sapiens
agtattgtcagtgta

SEQ ID NO: 180176 - DNA, 15 bp, Homo sapiens
gagtattgtcagtgt

SEQ ID NO: 180177 - DNA, 15 bp, Homo sapiens
agagtattgtcagtg

SEQ ID NO: 180178 - DNA, 15 bp, Homo sapiens
gagagtattgtcagt

SEQ ID NO: 180179 - DNA, 15 bp, Homo sapiens
ggagagtattgtcag

SEQ ID NO: 180180 - DNA, 15 bp, Homo sapiens
aggagagtattgtca

SEQ ID NO: 180181 - DNA, 15 bp, Homo sapiens
aaggagagtattgtc

SEQ ID NO: 180182 - DNA, 15 bp, Homo sapiens
gaaggagagtattgt

SEQ ID NO: 180183 - DNA, 15 bp, Homo sapiens
tgaaggagagtattg

SEQ ID NO: 180184 - DNA, 15 bp, Homo sapiens
ttgaaggagagtatt

SEQ ID NO: 180185 - DNA, 15 bp, Homo sapiens
cttgaaggagagtat

SEQ ID NO: 180186 - DNA, 15 bp, Homo sapiens
acttgaaggagagta

SEQ ID NO: 180187 - DNA, 15 bp, Homo sapiens
cacttgaaggagagt

SEQ ID NO: 180188 - DNA, 15 bp, Homo sapiens
acacttgaaggagag

SEQ ID NO: 180189 - DNA, 15 bp, Homo sapiens
gacacttgaaggaga

SEQ ID NO: 180190 - DNA, 15 bp, Homo sapiens
ggacacttgaaggag

SEQ ID NO: 180191 - DNA, 15 bp, Homo sapiens
aggacacttgaagga

SEQ ID NO: 180192 - DNA, 15 bp, Homo sapiens
gaggacacttgaagg

SEQ ID NO: 180193 - DNA, 15 bp, Homo sapiens
tgaggacacttgaag

SEQ ID NO: 180194 - DNA, 15 bp, Homo sapiens
gtgaggacacttgaa

SEQ ID NO: 180195 - DNA, 15 bp, Homo sapiens
ggtgaggacacttga

SEQ ID NO: 180196 - DNA, 15 bp, Homo sapiens
aggtgaggacacttg

SEQ ID NO: 180197 - DNA, 15 bp, Homo sapiens
gaggtgaggacactt

SEQ ID NO: 180198 - DNA, 15 bp, Homo sapiens
agaggtgaggacact

SEQ ID NO: 180199 - DNA, 15 bp, Homo sapiens
aagaggtgaggacac

SEQ ID NO: 180200 - DNA, 15 bp, Homo sapiens
caagaggtgaggaca

SEQ ID NO: 180201 - DNA, 15 bp, Homo sapiens
tcaagaggtgaggac

SEQ ID NO: 180202 - DNA, 15 bp, Homo sapiens
atcaagaggtgagga

SEQ ID NO: 180203 - DNA, 15 bp, Homo sapiens
aatcaagaggtgagg

SEQ ID NO: 180204 - DNA, 15 bp, Homo sapiens
aaatcaagaggtgag

SEQ ID NO: 180205 - DNA, 15 bp, Homo sapiens
caaatcaagaggtga

SEQ ID NO: 180206 - DNA, 15 bp, Homo sapiens
acaaatcaagaggtg

SEQ ID NO: 180207 - DNA, 15 bp, Homo sapiens
gacaaatcaagaggt

SEQ ID NO: 180208 - DNA, 15 bp, Homo sapiens
tgacaaatcaagagg

SEQ ID NO: 180209 - DNA, 15 bp, Homo sapiens
atgacaaatcaagag

SEQ ID NO: 180210 - DNA, 15 bp, Homo sapiens
tatgacaaatcaaga

SEQ ID NO: 180211 - DNA, 15 bp, Homo sapiens
atatgacaaatcaag

SEQ ID NO: 180212 - DNA, 15 bp, Homo sapiens
tatatgacaaatcaa

SEQ ID NO: 180213 - DNA, 15 bp, Homo sapiens
gtatatgacaaatca

SEQ ID NO: 180214 - DNA, 15 bp, Homo sapiens
agtatatgacaaatc

SEQ ID NO: 180215 - DNA, 15 bp, Homo sapiens
gagtatatgacaaat

SEQ ID NO: 180216 - DNA, 15 bp, Homo sapiens
agagtatatgacaaa

SEQ ID NO: 180217 - DNA, 15 bp, Homo sapiens
aagagtatatgacaa

SEQ ID NO: 180218 - DNA, 15 bp, Homo sapiens
taagagtatatgaca

SEQ ID NO: 180219 - DNA, 15 bp, Homo sapiens
ttaagagtatatgac

SEQ ID NO: 180220 - DNA, 15 bp, Homo sapiens
attaagagtatatga

SEQ ID NO: 180221 - DNA, 15 bp, Homo sapiens
aattaagagtatatg

SEQ ID NO: 180222 - DNA, 15 bp, Homo sapiens
aaattaagagtatat

SEQ ID NO: 180223 - DNA, 15 bp, Homo sapiens
aaaattaagagtata

SEQ ID NO: 180224 - DNA, 15 bp, Homo sapiens
taaaattaagagtat

SEQ ID NO: 180225 - DNA, 15 bp, Homo sapiens
ataaaattaagagta

SEQ ID NO: 180226 - DNA, 15 bp, Homo sapiens
aataaaattaagagt

SEQ ID NO: 180227 - DNA, 15 bp, Homo sapiens
caataaaattaagag

SEQ ID NO: 180228 - DNA, 15 bp, Homo sapiens
gcaataaaattaaga

SEQ ID NO: 180229 - DNA, 15 bp, Homo sapiens
agcaataaaattaag

SEQ ID NO: 180230 - DNA, 15 bp, Homo sapiens
tagcaataaaattaa

SEQ ID NO: 180231 - DNA, 15 bp, Homo sapiens
gtagcaataaaatta

SEQ ID NO: 180232 - DNA, 15 bp, Homo sapiens
tgtagcaataaaatt

SEQ ID NO: 180233 - DNA, 15 bp, Homo sapiens
atgtagcaataaaat

SEQ ID NO: 180234 - DNA, 15 bp, Homo sapiens
aatgtagcaataaaa

SEQ ID NO: 180235 - DNA, 15 bp, Homo sapiens
aaatgtagcaataaa

SEQ ID NO: 180236 - DNA, 15 bp, Homo sapiens
caaatgtagcaataa

SEQ ID NO: 180237 - DNA, 15 bp, Homo sapiens
ccaaatgtagcaata

SEQ ID NO: 180238 - DNA, 15 bp, Homo sapiens
gccaaatgtagcaat

SEQ ID NO: 180239 - DNA, 15 bp, Homo sapiens
ggccaaatgtagcaa

SEQ ID NO: 180240 - DNA, 15 bp, Homo sapiens
tggccaaatgtagca

SEQ ID NO: 180241 - DNA, 15 bp, Homo sapiens
atggccaaatgtagc

SEQ ID NO: 180242 - DNA, 15 bp, Homo sapiens
aatggccaaatgtag

SEQ ID NO: 180243 - DNA, 15 bp, Homo sapiens
aaatggccaaatgta

SEQ ID NO: 180244 - DNA, 15 bp, Homo sapiens
aaaatggccaaatgt

SEQ ID NO: 180245 - DNA, 15 bp, Homo sapiens
aaaaatggccaaatg

SEQ ID NO: 180246 - DNA, 15 bp, Homo sapiens
aaaaaatggccaaat

SEQ ID NO: 180247 - DNA, 15 bp, Homo sapiens
aaaaaaatggccaaa

SEQ ID NO: 180248 - DNA, 15 bp, Homo sapiens
gaaaaaaatggccaa

SEQ ID NO: 180249 - DNA, 15 bp, Homo sapiens
tgaaaaaaatggcca

SEQ ID NO: 180250 - DNA, 15 bp, Homo sapiens
gtgaaaaaaatggcc

SEQ ID NO: 180251 - DNA, 15 bp, Homo sapiens
agtgaaaaaaatggc

SEQ ID NO: 180252 - DNA, 15 bp, Homo sapiens
aagtgaaaaaaatgg

SEQ ID NO: 180253 - DNA, 15 bp, Homo sapiens
aaagtgaaaaaaatg

SEQ ID NO: 180254 - DNA, 15 bp, Homo sapiens
aaaagtgaaaaaaat

SEQ ID NO: 180255 - DNA, 15 bp, Homo sapiens
aaaaagtgaaaaaaa

SEQ ID NO: 180256 - DNA, 15 bp, Homo sapiens
aaaaaagtgaaaaaa

SEQ ID NO: 180257 - DNA, 15 bp, Homo sapiens
aaaaaaagtgaaaaa

SEQ ID NO: 180258 - DNA, 15 bp, Homo sapiens
gaaaaaaagtgaaaa

SEQ ID NO: 180259 - DNA, 15 bp, Homo sapiens
agaaaaaaagtgaaa

SEQ ID NO: 180260 - DNA, 15 bp, Homo sapiens
aagaaaaaaagtgaa

SEQ ID NO: 180261 - DNA, 15 bp, Homo sapiens
aaagaaaaaaagtga

SEQ ID NO: 180262 - DNA, 15 bp, Homo sapiens
caaagaaaaaaagtg

SEQ ID NO: 180263 - DNA, 15 bp, Homo sapiens
acaaagaaaaaaagt

SEQ ID NO: 180264 - DNA, 15 bp, Homo sapiens
aacaaagaaaaaaag

SEQ ID NO: 180265 - DNA, 15 bp, Homo sapiens
gaacaaagaaaaaaa

SEQ ID NO: 180266 - DNA, 15 bp, Homo sapiens
tgaacaaagaaaaaa

SEQ ID NO: 180267 - DNA, 15 bp, Homo sapiens
gtgaacaaagaaaaa

SEQ ID NO: 180268 - DNA, 15 bp, Homo sapiens
agtgaacaaagaaaa

SEQ ID NO: 180269 - DNA, 15 bp, Homo sapiens
aagtgaacaaagaaa

SEQ ID NO: 180270 - DNA, 15 bp, Homo sapiens
aaagtgaacaaagaa

SEQ ID NO: 180271 - DNA, 15 bp, Homo sapiens
gaaagtgaacaaaga

SEQ ID NO: 180272 - DNA, 15 bp, Homo sapiens
ggaaagtgaacaaag

SEQ ID NO: 180273 - DNA, 15 bp, Homo sapiens
aggaaagtgaacaaa

SEQ ID NO: 180274 - DNA, 15 bp, Homo sapiens
aaggaaagtgaacaa

SEQ ID NO: 180275 - DNA, 15 bp, Homo sapiens
aaaggaaagtgaaca

SEQ ID NO: 180276 - DNA, 15 bp, Homo sapiens
caaaggaaagtgaac

SEQ ID NO: 180277 - DNA, 15 bp, Homo sapiens
gcaaaggaaagtgaa

SEQ ID NO: 180278 - DNA, 15 bp, Homo sapiens
agcaaaggaaagtga

SEQ ID NO: 180279 - DNA, 15 bp, Homo sapiens
gagcaaaggaaagtg

SEQ ID NO: 180280 - DNA, 15 bp, Homo sapiens
ggagcaaaggaaagt

SEQ ID NO: 180281 - DNA, 15 bp, Homo sapiens
tggagcaaaggaaag

SEQ ID NO: 180282 - DNA, 15 bp, Homo sapiens
atggagcaaaggaaa

SEQ ID NO: 180283 - DNA, 15 bp, Homo sapiens
tatggagcaaaggaa

SEQ ID NO: 180284 - DNA, 15 bp, Homo sapiens
gtatggagcaaagga

SEQ ID NO: 180285 - DNA, 15 bp, Homo sapiens
agtatggagcaaagg

SEQ ID NO: 180286 - DNA, 15 bp, Homo sapiens
aagtatggagcaaag

SEQ ID NO: 180287 - DNA, 15 bp, Homo sapiens
taagtatggagcaaa

SEQ ID NO: 180288 - DNA, 15 bp, Homo sapiens
ttaagtatggagcaa

SEQ ID NO: 180289 - DNA, 15 bp, Homo sapiens
gttaagtatggagca

SEQ ID NO: 180290 - DNA, 15 bp, Homo sapiens
agttaagtatggagc

SEQ ID NO: 180291 - DNA, 15 bp, Homo sapiens
tagttaagtatggag

SEQ ID NO: 180292 - DNA, 15 bp, Homo sapiens
ttagttaagtatgga

SEQ ID NO: 180293 - DNA, 15 bp, Homo sapiens
attagttaagtatgg

SEQ ID NO: 180294 - DNA, 15 bp, Homo sapiens
aattagttaagtatg

SEQ ID NO: 180295 - DNA, 15 bp, Homo sapiens
aaattagttaagtat

SEQ ID NO: 180296 - DNA, 15 bp, Homo sapiens
aaaattagttaagta

SEQ ID NO: 180297 - DNA, 15 bp, Homo sapiens
gaaaattagttaagt

SEQ ID NO: 180298 - DNA, 15 bp, Homo sapiens
ggaaaattagttaag

SEQ ID NO: 180299 - DNA, 15 bp, Homo sapiens
tggaaaattagttaa

SEQ ID NO: 180300 - DNA, 15 bp, Homo sapiens
ctggaaaattagtta

SEQ ID NO: 180301 - DNA, 15 bp, Homo sapiens
tctggaaaattagtt

SEQ ID NO: 180302 - DNA, 15 bp, Homo sapiens
atctggaaaattagt

SEQ ID NO: 180303 - DNA, 15 bp, Homo sapiens
aatctggaaaattag

SEQ ID NO: 180304 - DNA, 15 bp, Homo sapiens
aaatctggaaaatta

SEQ ID NO: 180305 - DNA, 15 bp, Homo sapiens
gaaatctggaaaatt

SEQ ID NO: 180306 - DNA, 15 bp, Homo sapiens
agaaatctggaaaat

SEQ ID NO: 180307 - DNA, 15 bp, Homo sapiens
cagaaatctggaaaa

SEQ ID NO: 180308 - DNA, 15 bp, Homo sapiens
acagaaatctggaaa

SEQ ID NO: 180309 - DNA, 15 bp, Homo sapiens
gacagaaatctggaa

SEQ ID NO: 180310 - DNA, 15 bp, Homo sapiens
ggacagaaatctgga

SEQ ID NO: 180311 - DNA, 15 bp, Homo sapiens
aggacagaaatctgg

SEQ ID NO: 180312 - DNA, 15 bp, Homo sapiens
aaggacagaaatctg

SEQ ID NO: 180313 - DNA, 15 bp, Homo sapiens
taaggacagaaatct

SEQ ID NO: 180314 - DNA, 15 bp, Homo sapiens
ttaaggacagaaatc

SEQ ID NO: 180315 - DNA, 15 bp, Homo sapiens
tttaaggacagaaat

SEQ ID NO: 180316 - DNA, 15 bp, Homo sapiens
atttaaggacagaaa

SEQ ID NO: 180317 - DNA, 15 bp, Homo sapiens
gatttaaggacagaa

SEQ ID NO: 180318 - DNA, 15 bp, Homo sapiens
agatttaaggacaga

SEQ ID NO: 180319 - DNA, 15 bp, Homo sapiens
gagatttaaggacag

SEQ ID NO: 180320 - DNA, 15 bp, Homo sapiens
agagatttaaggaca

SEQ ID NO: 180321 - DNA, 15 bp, Homo sapiens
aagagatttaaggac

SEQ ID NO: 180322 - DNA, 15 bp, Homo sapiens
aaagagatttaagga

SEQ ID NO: 180323 - DNA, 15 bp, Homo sapiens
gaaagagatttaagg

SEQ ID NO: 180324 - DNA, 15 bp, Homo sapiens
tgaaagagatttaag

SEQ ID NO: 180325 - DNA, 15 bp, Homo sapiens
atgaaagagatttaa

SEQ ID NO: 180326 - DNA, 15 bp, Homo sapiens
aatgaaagagattta

SEQ ID NO: 180327 - DNA, 15 bp, Homo sapiens
aaatgaaagagattt

SEQ ID NO: 180328 - DNA, 15 bp, Homo sapiens
aaaatgaaagagatt

SEQ ID NO: 180329 - DNA, 15 bp, Homo sapiens
gaaaatgaaagagat

SEQ ID NO: 180330 - DNA, 15 bp, Homo sapiens
tgaaaatgaaagaga

SEQ ID NO: 180331 - DNA, 15 bp, Homo sapiens
gtgaaaatgaaagag

SEQ ID NO: 180332 - DNA, 15 bp, Homo sapiens
agtgaaaatgaaaga

SEQ ID NO: 180333 - DNA, 15 bp, Homo sapiens
cagtgaaaatgaaag

SEQ ID NO: 180334 - DNA, 15 bp, Homo sapiens
ccagtgaaaatgaaa

SEQ ID NO: 180335 - DNA, 15 bp, Homo sapiens
tccagtgaaaatgaa

SEQ ID NO: 180336 - DNA, 15 bp, Homo sapiens
atccagtgaaaatga

SEQ ID NO: 180337 - DNA, 15 bp, Homo sapiens
tatccagtgaaaatg

SEQ ID NO: 180338 - DNA, 15 bp, Homo sapiens
atatccagtgaaaat

SEQ ID NO: 180339 - DNA, 15 bp, Homo sapiens
tatatccagtgaaaa

SEQ ID NO: 180340 - DNA, 15 bp, Homo sapiens
gtatatccagtgaaa

SEQ ID NO: 180341 - DNA, 15 bp, Homo sapiens
agtatatccagtgaa

SEQ ID NO: 180342 - DNA, 15 bp, Homo sapiens
gagtatatccagtga

SEQ ID NO: 180343 - DNA, 15 bp, Homo sapiens
agagtatatccagtg

SEQ ID NO: 180344 - DNA, 15 bp, Homo sapiens
aagagtatatccagt

SEQ ID NO: 180345 - DNA, 15 bp, Homo sapiens
gaagagtatatccag

SEQ ID NO: 180346 - DNA, 15 bp, Homo sapiens
ggaagagtatatcca

SEQ ID NO: 180347 - DNA, 15 bp, Homo sapiens
gggaagagtatatcc

SEQ ID NO: 180348 - DNA, 15 bp, Homo sapiens
tgggaagagtatatc

SEQ ID NO: 180349 - DNA, 15 bp, Homo sapiens
ctgggaagagtatat

SEQ ID NO: 180350 - DNA, 15 bp, Homo sapiens
cctgggaagagtata

SEQ ID NO: 180351 - DNA, 15 bp, Homo sapiens
gcctgggaagagtat

SEQ ID NO: 180352 - DNA, 15 bp, Homo sapiens
agcctgggaagagta

SEQ ID NO: 180353 - DNA, 15 bp, Homo sapiens
aagcctgggaagagt

SEQ ID NO: 180354 - DNA, 15 bp, Homo sapiens
gaagcctgggaagag

SEQ ID NO: 180355 - DNA, 15 bp, Homo sapiens
ggaagcctgggaaga

SEQ ID NO: 180356 - DNA, 15 bp, Homo sapiens
gggaagcctgggaag

SEQ ID NO: 180357 - DNA, 15 bp, Homo sapiens
tgggaagcctgggaa

SEQ ID NO: 180358 - DNA, 15 bp, Homo sapiens
ctgggaagcctggga

SEQ ID NO: 180359 - DNA, 15 bp, Homo sapiens
cctgggaagcctggg

SEQ ID NO: 180360 - DNA, 15 bp, Homo sapiens
gcctgggaagcctgg

SEQ ID NO: 180361 - DNA, 15 bp, Homo sapiens
agcctgggaagcctg

SEQ ID NO: 180362 - DNA, 15 bp, Homo sapiens
aagcctgggaagcct

SEQ ID NO: 180363 - DNA, 15 bp, Homo sapiens
gaagcctgggaagcc

SEQ ID NO: 180364 - DNA, 15 bp, Homo sapiens
agaagcctgggaagc

SEQ ID NO: 180365 - DNA, 15 bp, Homo sapiens
cagaagcctgggaag

SEQ ID NO: 180366 - DNA, 15 bp, Homo sapiens
acagaagcctgggaa

SEQ ID NO: 180367 - DNA, 15 bp, Homo sapiens
tacagaagcctggga

SEQ ID NO: 180368 - DNA, 15 bp, Homo sapiens
ttacagaagcctggg

SEQ ID NO: 180369 - DNA, 15 bp, Homo sapiens
gttacagaagcctgg

SEQ ID NO: 180370 - DNA, 15 bp, Homo sapiens
tgttacagaagcctg

SEQ ID NO: 180371 - DNA, 15 bp, Homo sapiens
ttgttacagaagcct

SEQ ID NO: 180372 - DNA, 15 bp, Homo sapiens
attgttacagaagcc

SEQ ID NO: 180373 - DNA, 15 bp, Homo sapiens
gattgttacagaagc

SEQ ID NO: 180374 - DNA, 15 bp, Homo sapiens
agattgttacagaag

SEQ ID NO: 180375 - DNA, 15 bp, Homo sapiens
tagattgttacagaa

SEQ ID NO: 180376 - DNA, 15 bp, Homo sapiens
atagattgttacaga

SEQ ID NO: 180377 - DNA, 15 bp, Homo sapiens
aatagattgttacag

SEQ ID NO: 180378 - DNA, 15 bp, Homo sapiens
aaatagattgttaca

SEQ ID NO: 180379 - DNA, 15 bp, Homo sapiens
caaatagattgttac

SEQ ID NO: 180380 - DNA, 15 bp, Homo sapiens
gcaaatagattgtta

SEQ ID NO: 180381 - DNA, 15 bp, Homo sapiens
agcaaatagattgtt

SEQ ID NO: 180382 - DNA, 15 bp, Homo sapiens
aagcaaatagattgt

SEQ ID NO: 180383 - DNA, 15 bp, Homo sapiens
aaagcaaatagattg

SEQ ID NO: 180384 - DNA, 15 bp, Homo sapiens
caaagcaaatagatt

SEQ ID NO: 180385 - DNA, 15 bp, Homo sapiens
acaaagcaaatagat

SEQ ID NO: 180386 - DNA, 15 bp, Homo sapiens
gacaaagcaaataga

SEQ ID NO: 180387 - DNA, 15 bp, Homo sapiens
agacaaagcaaatag

SEQ ID NO: 180388 - DNA, 15 bp, Homo sapiens
gagacaaagcaaata

SEQ ID NO: 180389 - DNA, 15 bp, Homo sapiens
ggagacaaagcaaat

SEQ ID NO: 180390 - DNA, 15 bp, Homo sapiens
tggagacaaagcaaa

SEQ ID NO: 180391 - DNA, 15 bp, Homo sapiens
atggagacaaagcaa

SEQ ID NO: 180392 - DNA, 15 bp, Homo sapiens
gatggagacaaagca

SEQ ID NO: 180393 - DNA, 15 bp, Homo sapiens
ggatggagacaaagc

SEQ ID NO: 180394 - DNA, 15 bp, Homo sapiens
gggatggagacaaag

SEQ ID NO: 180395 - DNA, 15 bp, Homo sapiens
tgggatggagacaaa

SEQ ID NO: 180396 - DNA, 15 bp, Homo sapiens
atgggatggagacaa

SEQ ID NO: 180397 - DNA, 15 bp, Homo sapiens
tatgggatggagaca

SEQ ID NO: 180398 - DNA, 15 bp, Homo sapiens
ttatgggatggagac

SEQ ID NO: 180399 - DNA, 15 bp, Homo sapiens
gttatgggatggaga

SEQ ID NO: 180400 - DNA, 15 bp, Homo sapiens
agttatgggatggag

SEQ ID NO: 180401 - DNA, 15 bp, Homo sapiens
gagttatgggatgga

SEQ ID NO: 180402 - DNA, 15 bp, Homo sapiens
agagttatgggatgg

SEQ ID NO: 180403 - DNA, 15 bp, Homo sapiens
gagagttatgggatg

SEQ ID NO: 180404 - DNA, 15 bp, Homo sapiens
ggagagttatgggat

SEQ ID NO: 180405 - DNA, 15 bp, Homo sapiens
gggagagttatggga

SEQ ID NO: 180406 - DNA, 15 bp, Homo sapiens
agggagagttatggg

SEQ ID NO: 180407 - DNA, 15 bp, Homo sapiens
cagggagagttatgg

SEQ ID NO: 180408 - DNA, 15 bp, Homo sapiens
tcagggagagttatg

SEQ ID NO: 180409 - DNA, 15 bp, Homo sapiens
ctcagggagagttat

SEQ ID NO: 180410 - DNA, 15 bp, Homo sapiens
gctcagggagagtta

SEQ ID NO: 180411 - DNA, 15 bp, Homo sapiens
agctcagggagagtt

SEQ ID NO: 180412 - DNA, 15 bp, Homo sapiens
gagctcagggagagt

SEQ ID NO: 180413 - DNA, 15 bp, Homo sapiens
agagctcagggagag

SEQ ID NO: 180414 - DNA, 15 bp, Homo sapiens
tagagctcagggaga

SEQ ID NO: 180415 - DNA, 15 bp, Homo sapiens
ttagagctcagggag

SEQ ID NO: 180416 - DNA, 15 bp, Homo sapiens
tttagagctcaggga

SEQ ID NO: 180417 - DNA, 15 bp, Homo sapiens
atttagagctcaggg

SEQ ID NO: 180418 - DNA, 15 bp, Homo sapiens
aatttagagctcagg

SEQ ID NO: 180419 - DNA, 15 bp, Homo sapiens
taatttagagctcag

SEQ ID NO: 180420 - DNA, 15 bp, Homo sapiens
ataatttagagctca

SEQ ID NO: 180421 - DNA, 15 bp, Homo sapiens
aataatttagagctc

SEQ ID NO: 180422 - DNA, 15 bp, Homo sapiens
taataatttagagct

SEQ ID NO: 180423 - DNA, 15 bp, Homo sapiens
ataataatttagagc

SEQ ID NO: 180424 - DNA, 15 bp, Homo sapiens
tataataatttagag

SEQ ID NO: 180425 - DNA, 15 bp, Homo sapiens
atataataatttaga

SEQ ID NO: 180426 - DNA, 15 bp, Homo sapiens
catataataatttag

SEQ ID NO: 180427 - DNA, 15 bp, Homo sapiens
gcatataataattta

SEQ ID NO: 180428 - DNA, 15 bp, Homo sapiens
tgcatataataattt

SEQ ID NO: 180429 - DNA, 15 bp, Homo sapiens
ttgcatataataatt

SEQ ID NO: 180430 - DNA, 15 bp, Homo sapiens
gttgcatataataat

SEQ ID NO: 180431 - DNA, 15 bp, Homo sapiens
agttgcatataataa

SEQ ID NO: 180432 - DNA, 15 bp, Homo sapiens
cagttgcatataata

SEQ ID NO: 180433 - DNA, 15 bp, Homo sapiens
gcagttgcatataat

SEQ ID NO: 180434 - DNA, 15 bp, Homo sapiens
agcagttgcatataa

SEQ ID NO: 180435 - DNA, 15 bp, Homo sapiens
gagcagttgcatata

SEQ ID NO: 180436 - DNA, 15 bp, Homo sapiens
tgagcagttgcatat

SEQ ID NO: 180437 - DNA, 15 bp, Homo sapiens
gtgagcagttgcata

SEQ ID NO: 180438 - DNA, 15 bp, Homo sapiens
agtgagcagttgcat

SEQ ID NO: 180439 - DNA, 15 bp, Homo sapiens
cagtgagcagttgca

SEQ ID NO: 180440 - DNA, 15 bp, Homo sapiens
ccagtgagcagttgc

SEQ ID NO: 180441 - DNA, 15 bp, Homo sapiens
tccagtgagcagttg

SEQ ID NO: 180442 - DNA, 15 bp, Homo sapiens
gtccagtgagcagtt

SEQ ID NO: 180443 - DNA, 15 bp, Homo sapiens
tgtccagtgagcagt

SEQ ID NO: 180444 - DNA, 15 bp, Homo sapiens
atgtccagtgagcag

SEQ ID NO: 180445 - DNA, 15 bp, Homo sapiens
tatgtccagtgagca

SEQ ID NO: 180446 - DNA, 15 bp, Homo sapiens
gtatgtccagtgagc

SEQ ID NO: 180447 - DNA, 15 bp, Homo sapiens
tgtatgtccagtgag

SEQ ID NO: 180448 - DNA, 15 bp, Homo sapiens
ttgtatgtccagtga

SEQ ID NO: 180449 - DNA, 15 bp, Homo sapiens
cttgtatgtccagtg

SEQ ID NO: 180450 - DNA, 15 bp, Homo sapiens
acttgtatgtccagt

SEQ ID NO: 180451 - DNA, 15 bp, Homo sapiens
aacttgtatgtccag

SEQ ID NO: 180452 - DNA, 15 bp, Homo sapiens
gaacttgtatgtcca

SEQ ID NO: 180453 - DNA, 15 bp, Homo sapiens
cgaacttgtatgtcc

SEQ ID NO: 180454 - DNA, 15 bp, Homo sapiens
acgaacttgtatgtc

SEQ ID NO: 180455 - DNA, 15 bp, Homo sapiens
cacgaacttgtatgt

SEQ ID NO: 180456 - DNA, 15 bp, Homo sapiens
tcacgaacttgtatg

SEQ ID NO: 180457 - DNA, 15 bp, Homo sapiens
atcacgaacttgtat

SEQ ID NO: 180458 - DNA, 15 bp, Homo sapiens
aatcacgaacttgta

SEQ ID NO: 180459 - DNA, 15 bp, Homo sapiens
gaatcacgaacttgt

SEQ ID NO: 180460 - DNA, 15 bp, Homo sapiens
tgaatcacgaacttg

SEQ ID NO: 180461 - DNA, 15 bp, Homo sapiens
ttgaatcacgaactt

SEQ ID NO: 180462 - DNA, 15 bp, Homo sapiens
gttgaatcacgaact

SEQ ID NO: 180463 - DNA, 15 bp, Homo sapiens
tgttgaatcacgaac

SEQ ID NO: 180464 - DNA, 15 bp, Homo sapiens
ctgttgaatcacgaa

SEQ ID NO: 180465 - DNA, 15 bp, Homo sapiens
tctgttgaatcacga

SEQ ID NO: 180466 - DNA, 15 bp, Homo sapiens
gtctgttgaatcacg

SEQ ID NO: 180467 - DNA, 15 bp, Homo sapiens
ggtctgttgaatcac

SEQ ID NO: 180468 - DNA, 15 bp, Homo sapiens
gggtctgttgaatca

SEQ ID NO: 180469 - DNA, 15 bp, Homo sapiens
agggtctgttgaatc

SEQ ID NO: 180470 - DNA, 15 bp, Homo sapiens
aagggtctgttgaat

SEQ ID NO: 180471 - DNA, 15 bp, Homo sapiens
aaagggtctgttgaa

SEQ ID NO: 180472 - DNA, 15 bp, Homo sapiens
taaagggtctgttga

SEQ ID NO: 180473 - DNA, 15 bp, Homo sapiens
ttaaagggtctgttg

SEQ ID NO: 180474 - DNA, 15 bp, Homo sapiens
tttaaagggtctgtt

SEQ ID NO: 180475 - DNA, 15 bp, Homo sapiens
ttttaaagggtctgt

SEQ ID NO: 180476 - DNA, 15 bp, Homo sapiens
gttttaaagggtctg

SEQ ID NO: 180477 - DNA, 15 bp, Homo sapiens
agttttaaagggtct

SEQ ID NO: 180478 - DNA, 15 bp, Homo sapiens
gagttttaaagggtc

SEQ ID NO: 180479 - DNA, 15 bp, Homo sapiens
tgagttttaaagggt

SEQ ID NO: 180480 - DNA, 15 bp, Homo sapiens
ttgagttttaaaggg

SEQ ID NO: 180481 - DNA, 15 bp, Homo sapiens
tttgagttttaaagg

SEQ ID NO: 180482 - DNA, 15 bp, Homo sapiens
atttgagttttaaag

SEQ ID NO: 180483 - DNA, 15 bp, Homo sapiens
gatttgagttttaaa

SEQ ID NO: 180484 - DNA, 15 bp, Homo sapiens
agatttgagttttaa

SEQ ID NO: 180485 - DNA, 15 bp, Homo sapiens
cagatttgagtttta

SEQ ID NO: 180486 - DNA, 15 bp, Homo sapiens
acagatttgagtttt

SEQ ID NO: 180487 - DNA, 15 bp, Homo sapiens
aacagatttgagttt

SEQ ID NO: 180488 - DNA, 15 bp, Homo sapiens
aaacagatttgagtt

SEQ ID NO: 180489 - DNA, 15 bp, Homo sapiens
gaaacagatttgagt

SEQ ID NO: 180490 - DNA, 15 bp, Homo sapiens
ggaaacagatttgag

SEQ ID NO: 180491 - DNA, 15 bp, Homo sapiens
gggaaacagatttga

SEQ ID NO: 180492 - DNA, 15 bp, Homo sapiens
agggaaacagatttg

SEQ ID NO: 180493 - DNA, 15 bp, Homo sapiens
aagggaaacagattt

SEQ ID NO: 180494 - DNA, 15 bp, Homo sapiens
taagggaaacagatt

SEQ ID NO: 180495 - DNA, 15 bp, Homo sapiens
ctaagggaaacagat

SEQ ID NO: 180496 - DNA, 15 bp, Homo sapiens
actaagggaaacaga

SEQ ID NO: 180497 - DNA, 15 bp, Homo sapiens
tactaagggaaacag

SEQ ID NO: 180498 - DNA, 15 bp, Homo sapiens
atactaagggaaaca

SEQ ID NO: 180499 - DNA, 15 bp, Homo sapiens
tatactaagggaaac

SEQ ID NO: 180500 - DNA, 15 bp, Homo sapiens
atatactaagggaaa

SEQ ID NO: 180501 - DNA, 15 bp, Homo sapiens
aatatactaagggaa

SEQ ID NO: 180502 - DNA, 15 bp, Homo sapiens
gaatatactaaggga

SEQ ID NO: 180503 - DNA, 15 bp, Homo sapiens
ggaatatactaaggg

SEQ ID NO: 180504 - DNA, 15 bp, Homo sapiens
gggaatatactaagg

SEQ ID NO: 180505 - DNA, 15 bp, Homo sapiens
agggaatatactaag

SEQ ID NO: 180506 - DNA, 15 bp, Homo sapiens
aagggaatatactaa

SEQ ID NO: 180507 - DNA, 15 bp, Homo sapiens
caagggaatatacta

SEQ ID NO: 180508 - DNA, 15 bp, Homo sapiens
acaagggaatatact

SEQ ID NO: 180509 - DNA, 15 bp, Homo sapiens
aacaagggaatatac

SEQ ID NO: 180510 - DNA, 15 bp, Homo sapiens
aaacaagggaatata

SEQ ID NO: 180511 - DNA, 15 bp, Homo sapiens
caaacaagggaatat

SEQ ID NO: 180512 - DNA, 15 bp, Homo sapiens
acaaacaagggaata

SEQ ID NO: 180513 - DNA, 15 bp, Homo sapiens
aacaaacaagggaat

SEQ ID NO: 180514 - DNA, 15 bp, Homo sapiens
taacaaacaagggaa

SEQ ID NO: 180515 - DNA, 15 bp, Homo sapiens
ttaacaaacaaggga

SEQ ID NO: 180516 - DNA, 15 bp, Homo sapiens
attaacaaacaaggg

SEQ ID NO: 180517 - DNA, 15 bp, Homo sapiens
gattaacaaacaagg

SEQ ID NO: 180518 - DNA, 15 bp, Homo sapiens
agattaacaaacaag

SEQ ID NO: 180519 - DNA, 15 bp, Homo sapiens
aagattaacaaacaa

SEQ ID NO: 180520 - DNA, 15 bp, Homo sapiens
caagattaacaaaca

SEQ ID NO: 180521 - DNA, 15 bp, Homo sapiens
gcaagattaacaaac

SEQ ID NO: 180522 - DNA, 15 bp, Homo sapiens
agcaagattaacaaa

SEQ ID NO: 180523 - DNA, 15 bp, Homo sapiens
gagcaagattaacaa

SEQ ID NO: 180524 - DNA, 15 bp, Homo sapiens
tgagcaagattaaca

SEQ ID NO: 180525 - DNA, 15 bp, Homo sapiens
ctgagcaagattaac

SEQ ID NO: 180526 - DNA, 15 bp, Homo sapiens
actgagcaagattaa

SEQ ID NO: 180527 - DNA, 15 bp, Homo sapiens
aactgagcaagatta

SEQ ID NO: 180528 - DNA, 15 bp, Homo sapiens
taactgagcaagatt

SEQ ID NO: 180529 - DNA, 15 bp, Homo sapiens
gtaactgagcaagat

SEQ ID NO: 180530 - DNA, 15 bp, Homo sapiens
ggtaactgagcaaga

SEQ ID NO: 180531 - DNA, 15 bp, Homo sapiens
gggtaactgagcaag

SEQ ID NO: 180532 - DNA, 15 bp, Homo sapiens
tgggtaactgagcaa

SEQ ID NO: 180533 - DNA, 15 bp, Homo sapiens
ttgggtaactgagca

SEQ ID NO: 180534 - DNA, 15 bp, Homo sapiens
cttgggtaactgagc

SEQ ID NO: 180535 - DNA, 15 bp, Homo sapiens
gcttgggtaactgag

SEQ ID NO: 180536 - DNA, 15 bp, Homo sapiens
ggcttgggtaactga

SEQ ID NO: 180537 - DNA, 15 bp, Homo sapiens
tggcttgggtaactg

SEQ ID NO: 180538 - DNA, 15 bp, Homo sapiens
ctggcttgggtaact

SEQ ID NO: 180539 - DNA, 15 bp, Homo sapiens
tctggcttgggtaac

SEQ ID NO: 180540 - DNA, 15 bp, Homo sapiens
ttctggcttgggtaa

SEQ ID NO: 180541 - DNA, 15 bp, Homo sapiens
tttctggcttgggta

SEQ ID NO: 180542 - DNA, 15 bp, Homo sapiens
atttctggcttgggt

SEQ ID NO: 180543 - DNA, 15 bp, Homo sapiens
aatttctggcttggg

SEQ ID NO: 180544 - DNA, 15 bp, Homo sapiens
aaatttctggcttgg

SEQ ID NO: 180545 - DNA, 15 bp, Homo sapiens
taaatttctggcttg

SEQ ID NO: 180546 - DNA, 15 bp, Homo sapiens
ctaaatttctggctt

SEQ ID NO: 180547 - DNA, 15 bp, Homo sapiens
cctaaatttctggct

SEQ ID NO: 180548 - DNA, 15 bp, Homo sapiens
acctaaatttctggc

SEQ ID NO: 180549 - DNA, 15 bp, Homo sapiens
tacctaaatttctgg

SEQ ID NO: 180550 - DNA, 15 bp, Homo sapiens
atacctaaatttctg

SEQ ID NO: 180551 - DNA, 15 bp, Homo sapiens
gatacctaaatttct

SEQ ID NO: 180552 - DNA, 15 bp, Homo sapiens
tgatacctaaatttc

SEQ ID NO: 180553 - DNA, 15 bp, Homo sapiens
atgatacctaaattt

SEQ ID NO: 180554 - DNA, 15 bp, Homo sapiens
aatgatacctaaatt

SEQ ID NO: 180555 - DNA, 15 bp, Homo sapiens
gaatgatacctaaat

SEQ ID NO: 180556 - DNA, 15 bp, Homo sapiens
agaatgatacctaaa

SEQ ID NO: 180557 - DNA, 15 bp, Homo sapiens
aagaatgatacctaa

SEQ ID NO: 180558 - DNA, 15 bp, Homo sapiens
caagaatgataccta

SEQ ID NO: 180559 - DNA, 15 bp, Homo sapiens
tcaagaatgatacct

SEQ ID NO: 180560 - DNA, 15 bp, Homo sapiens
ttcaagaatgatacc

SEQ ID NO: 180561 - DNA, 15 bp, Homo sapiens
attcaagaatgatac

SEQ ID NO: 180562 - DNA, 15 bp, Homo sapiens
tattcaagaatgata

SEQ ID NO: 180563 - DNA, 15 bp, Homo sapiens
gtattcaagaatgat

SEQ ID NO: 180564 - DNA, 15 bp, Homo sapiens
tgtattcaagaatga

SEQ ID NO: 180565 - DNA, 15 bp, Homo sapiens
atgtattcaagaatg

SEQ ID NO: 180566 - DNA, 15 bp, Homo sapiens
aatgtattcaagaat

SEQ ID NO: 180567 - DNA, 15 bp, Homo sapiens
caatgtattcaagaa

SEQ ID NO: 180568 - DNA, 15 bp, Homo sapiens
acaatgtattcaaga

SEQ ID NO: 180569 - DNA, 15 bp, Homo sapiens
aacaatgtattcaag

SEQ ID NO: 180570 - DNA, 15 bp, Homo sapiens
aaacaatgtattcaa

SEQ ID NO: 180571 - DNA, 15 bp, Homo sapiens
gaaacaatgtattca

SEQ ID NO: 180572 - DNA, 15 bp, Homo sapiens
agaaacaatgtattc

SEQ ID NO: 180573 - DNA, 15 bp, Homo sapiens
gagaaacaatgtatt

SEQ ID NO: 180574 - DNA, 15 bp, Homo sapiens
agagaaacaatgtat

SEQ ID NO: 180575 - DNA, 15 bp, Homo sapiens
aagagaaacaatgta

SEQ ID NO: 180576 - DNA, 15 bp, Homo sapiens
gaagagaaacaatgt

SEQ ID NO: 180577 - DNA, 15 bp, Homo sapiens
ggaagagaaacaatg

SEQ ID NO: 180578 - DNA, 15 bp, Homo sapiens
aggaagagaaacaat

SEQ ID NO: 180579 - DNA, 15 bp, Homo sapiens
aaggaagagaaacaa

SEQ ID NO: 180580 - DNA, 15 bp, Homo sapiens
aaaggaagagaaaca

SEQ ID NO: 180581 - DNA, 15 bp, Homo sapiens
gaaaggaagagaaac

SEQ ID NO: 180582 - DNA, 15 bp, Homo sapiens
ggaaaggaagagaaa

SEQ ID NO: 180583 - DNA, 15 bp, Homo sapiens
tggaaaggaagagaa

SEQ ID NO: 180584 - DNA, 15 bp, Homo sapiens
gtggaaaggaagaga

SEQ ID NO: 180585 - DNA, 15 bp, Homo sapiens
tgtggaaaggaagag

SEQ ID NO: 180586 - DNA, 15 bp, Homo sapiens
gtgtggaaaggaaga

SEQ ID NO: 180587 - DNA, 15 bp, Homo sapiens
ggtgtggaaaggaag

SEQ ID NO: 180588 - DNA, 15 bp, Homo sapiens
gggtgtggaaaggaa

SEQ ID NO: 180589 - DNA, 15 bp, Homo sapiens
cgggtgtggaaagga

SEQ ID NO: 180590 - DNA, 15 bp, Homo sapiens
tcgggtgtggaaagg

SEQ ID NO: 180591 - DNA, 15 bp, Homo sapiens
atcgggtgtggaaag

SEQ ID NO: 180592 - DNA, 15 bp, Homo sapiens
gatcgggtgtggaaa

SEQ ID NO: 180593 - DNA, 15 bp, Homo sapiens
tgatcgggtgtggaa

SEQ ID NO: 180594 - DNA, 15 bp, Homo sapiens
ttgatcgggtgtgga

SEQ ID NO: 180595 - DNA, 15 bp, Homo sapiens
attgatcgggtgtgg

SEQ ID NO: 180596 - DNA, 15 bp, Homo sapiens
gattgatcgggtgtg

SEQ ID NO: 180597 - DNA, 15 bp, Homo sapiens
tgattgatcgggtgt

SEQ ID NO: 180598 - DNA, 15 bp, Homo sapiens
ttgattgatcgggtg

SEQ ID NO: 180599 - DNA, 15 bp, Homo sapiens
tttgattgatcgggt

SEQ ID NO: 180600 - DNA, 15 bp, Homo sapiens
atttgattgatcggg

SEQ ID NO: 180601 - DNA, 15 bp, Homo sapiens
tatttgattgatcgg

SEQ ID NO: 180602 - DNA, 15 bp, Homo sapiens
gtatttgattgatcg

SEQ ID NO: 180603 - DNA, 15 bp, Homo sapiens
tgtatttgattgatc

SEQ ID NO: 180604 - DNA, 15 bp, Homo sapiens
gtgtatttgattgat

SEQ ID NO: 180605 - DNA, 15 bp, Homo sapiens
tgtgtatttgattga

SEQ ID NO: 180606 - DNA, 15 bp, Homo sapiens
ctgtgtatttgattg

SEQ ID NO: 180607 - DNA, 15 bp, Homo sapiens
actgtgtatttgatt

SEQ ID NO: 180608 - DNA, 15 bp, Homo sapiens
gactgtgtatttgat

SEQ ID NO: 180609 - DNA, 15 bp, Homo sapiens
agactgtgtatttga

SEQ ID NO: 180610 - DNA, 15 bp, Homo sapiens
aagactgtgtatttg

SEQ ID NO: 180611 - DNA, 15 bp, Homo sapiens
taagactgtgtattt

SEQ ID NO: 180612 - DNA, 15 bp, Homo sapiens
ataagactgtgtatt

SEQ ID NO: 180613 - DNA, 15 bp, Homo sapiens
aataagactgtgtat

SEQ ID NO: 180614 - DNA, 15 bp, Homo sapiens
caataagactgtgta

SEQ ID NO: 180615 - DNA, 15 bp, Homo sapiens
gcaataagactgtgt

SEQ ID NO: 180616 - DNA, 15 bp, Homo sapiens
agcaataagactgtg

SEQ ID NO: 180617 - DNA, 15 bp, Homo sapiens
aagcaataagactgt

SEQ ID NO: 180618 - DNA, 15 bp, Homo sapiens
gaagcaataagactg

SEQ ID NO: 180619 - DNA, 15 bp, Homo sapiens
agaagcaataagact

SEQ ID NO: 180620 - DNA, 15 bp, Homo sapiens
aagaagcaataagac

SEQ ID NO: 180621 - DNA, 15 bp, Homo sapiens
taagaagcaataaga

SEQ ID NO: 180622 - DNA, 15 bp, Homo sapiens
gtaagaagcaataag

SEQ ID NO: 180623 - DNA, 15 bp, Homo sapiens
agtaagaagcaataa

SEQ ID NO: 180624 - DNA, 15 bp, Homo sapiens
aagtaagaagcaata

SEQ ID NO: 180625 - DNA, 15 bp, Homo sapiens
aaagtaagaagcaat

SEQ ID NO: 180626 - DNA, 15 bp, Homo sapiens
aaaagtaagaagcaa

SEQ ID NO: 180627 - DNA, 15 bp, Homo sapiens
aaaaagtaagaagca

SEQ ID NO: 180628 - DNA, 15 bp, Homo sapiens
aaaaaagtaagaagc

SEQ ID NO: 180629 - DNA, 15 bp, Homo sapiens
aaaaaaagtaagaag

SEQ ID NO: 180630 - DNA, 15 bp, Homo sapiens
aaaaaaaagtaagaa

SEQ ID NO: 180631 - DNA, 15 bp, Homo sapiens
aaaaaaaaagtaaga

SEQ ID NO: 180632 - DNA, 15 bp, Homo sapiens
aaaaaaaaaagtaag

SEQ ID NO: 180633 - DNA, 15 bp, Homo sapiens
gaaaaaaaaaaagta

SEQ ID NO: 180634 - DNA, 15 bp, Homo sapiens
agaaaaaaaaaaagt

SEQ ID NO: 180635 - DNA, 15 bp, Homo sapiens
taagaaaaaaaaaaa

SEQ ID NO: 180636 - DNA, 15 bp, Homo sapiens
ataagaaaaaaaaaa

SEQ ID NO: 180637 - DNA, 15 bp, Homo sapiens
gataagaaaaaaaaa

SEQ ID NO: 180638 - DNA, 15 bp, Homo sapiens
agataagaaaaaaaa

SEQ ID NO: 180639 - DNA, 15 bp, Homo sapiens
aagataagaaaaaaa

SEQ ID NO: 180640 - DNA, 15 bp, Homo sapiens
taagataagaaaaaa

SEQ ID NO: 180641 - DNA, 15 bp, Homo sapiens
ataagataagaaaaa

SEQ ID NO: 180642 - DNA, 15 bp, Homo sapiens
aataagataagaaaa

SEQ ID NO: 180643 - DNA, 15 bp, Homo sapiens
caataagataagaaa

SEQ ID NO: 180644 - DNA, 15 bp, Homo sapiens
gcaataagataagaa

SEQ ID NO: 180645 - DNA, 15 bp, Homo sapiens
agcaataagataaga

SEQ ID NO: 180646 - DNA, 15 bp, Homo sapiens
aagcaataagataag

SEQ ID NO: 180647 - DNA, 15 bp, Homo sapiens
aaagcaataagataa

SEQ ID NO: 180648 - DNA, 15 bp, Homo sapiens
aaaagcaataagata

SEQ ID NO: 180649 - DNA, 15 bp, Homo sapiens
taaaagcaataagat

SEQ ID NO: 180650 - DNA, 15 bp, Homo sapiens
ataaaagcaataaga

SEQ ID NO: 180651 - DNA, 15 bp, Homo sapiens
aataaaagcaataag

SEQ ID NO: 180652 - DNA, 15 bp, Homo sapiens
aaataaaagcaataa

SEQ ID NO: 180653 - DNA, 15 bp, Homo sapiens
aaaataaaagcaata

SEQ ID NO: 180654 - DNA, 15 bp, Homo sapiens
gaaaataaaagcaat

SEQ ID NO: 180655 - DNA, 15 bp, Homo sapiens
tgaaaataaaagcaa

SEQ ID NO: 180656 - DNA, 15 bp, Homo sapiens
ctgaaaataaaagca

SEQ ID NO: 180657 - DNA, 15 bp, Homo sapiens
actgaaaataaaagc

SEQ ID NO: 180658 - DNA, 15 bp, Homo sapiens
tactgaaaataaaag

SEQ ID NO: 180659 - DNA, 15 bp, Homo sapiens
atactgaaaataaaa

SEQ ID NO: 180660 - DNA, 15 bp, Homo sapiens
aatactgaaaataaa

SEQ ID NO: 180661 - DNA, 15 bp, Homo sapiens
aaatactgaaaataa

SEQ ID NO: 180662 - DNA, 15 bp, Homo sapiens
aaaatactgaaaata

SEQ ID NO: 180663 - DNA, 15 bp, Homo sapiens
aaaaatactgaaaat

SEQ ID NO: 180664 - DNA, 15 bp, Homo sapiens
aaaaaatactgaaaa

SEQ ID NO: 180665 - DNA, 15 bp, Homo sapiens
aaaaaaatactgaaa

SEQ ID NO: 180666 - DNA, 15 bp, Homo sapiens
caaaaaaatactgaa

SEQ ID NO: 180667 - DNA, 15 bp, Homo sapiens
tcaaaaaaatactga

SEQ ID NO: 180668 - DNA, 15 bp, Homo sapiens
ttcaaaaaaatactg

SEQ ID NO: 180669 - DNA, 15 bp, Homo sapiens
attcaaaaaaatact

SEQ ID NO: 180670 - DNA, 15 bp, Homo sapiens
gattcaaaaaaatac

SEQ ID NO: 180671 - DNA, 15 bp, Homo sapiens
tgattcaaaaaaata

SEQ ID NO: 180672 - DNA, 15 bp, Homo sapiens
atgattcaaaaaaat

SEQ ID NO: 180673 - DNA, 15 bp, Homo sapiens
catgattcaaaaaaa

SEQ ID NO: 180674 - DNA, 15 bp, Homo sapiens
tcatgattcaaaaaa

SEQ ID NO: 180675 - DNA, 15 bp, Homo sapiens
ttcatgattcaaaaa

SEQ ID NO: 180676 - DNA, 15 bp, Homo sapiens
cttcatgattcaaaa

SEQ ID NO: 180677 - DNA, 15 bp, Homo sapiens
gcttcatgattcaaa

SEQ ID NO: 180678 - DNA, 15 bp, Homo sapiens
agcttcatgattcaa

SEQ ID NO: 180679 - DNA, 15 bp, Homo sapiens
cagcttcatgattca

SEQ ID NO: 180680 - DNA, 15 bp, Homo sapiens
acagcttcatgattc

SEQ ID NO: 180681 - DNA, 15 bp, Homo sapiens
tacagcttcatgatt

SEQ ID NO: 180682 - DNA, 15 bp, Homo sapiens
atacagcttcatgat

SEQ ID NO: 180683 - DNA, 15 bp, Homo sapiens
tatacagcttcatga

SEQ ID NO: 180684 - DNA, 15 bp, Homo sapiens
ttatacagcttcatg

SEQ ID NO: 180685 - DNA, 15 bp, Homo sapiens
tttatacagcttcat

SEQ ID NO: 180686 - DNA, 15 bp, Homo sapiens
gtttatacagcttca

SEQ ID NO: 180687 - DNA, 15 bp, Homo sapiens
tgtttatacagcttc

SEQ ID NO: 180688 - DNA, 15 bp, Homo sapiens
ctgtttatacagctt

SEQ ID NO: 180689 - DNA, 15 bp, Homo sapiens
tctgtttatacagct

SEQ ID NO: 180690 - DNA, 15 bp, Homo sapiens
gtctgtttatacagc

SEQ ID NO: 180691 - DNA, 15 bp, Homo sapiens
tgtctgtttatacag

SEQ ID NO: 180692 - DNA, 15 bp, Homo sapiens
ttgtctgtttataca

SEQ ID NO: 180693 - DNA, 15 bp, Homo sapiens
cttgtctgtttatac

SEQ ID NO: 180694 - DNA, 15 bp, Homo sapiens
ccttgtctgtttata

SEQ ID NO: 180695 - DNA, 15 bp, Homo sapiens
accttgtctgtttat

SEQ ID NO: 180696 - DNA, 15 bp, Homo sapiens
caccttgtctgttta

SEQ ID NO: 180697 - DNA, 15 bp, Homo sapiens
tcaccttgtctgttt

SEQ ID NO: 180698 - DNA, 15 bp, Homo sapiens
atcaccttgtctgtt

SEQ ID NO: 180699 - DNA, 15 bp, Homo sapiens
gatcaccttgtctgt

SEQ ID NO: 180700 - DNA, 15 bp, Homo sapiens
agatcaccttgtctg

SEQ ID NO: 180701 - DNA, 15 bp, Homo sapiens
cagatcaccttgtct

SEQ ID NO: 180702 - DNA, 15 bp, Homo sapiens
acagatcaccttgtc

SEQ ID NO: 180703 - DNA, 15 bp, Homo sapiens
cacagatcaccttgt

SEQ ID NO: 180704 - DNA, 15 bp, Homo sapiens
acacagatcaccttg

SEQ ID NO: 180705 - DNA, 15 bp, Homo sapiens
aacacagatcacctt

SEQ ID NO: 180706 - DNA, 15 bp, Homo sapiens
caacacagatcacct

SEQ ID NO: 180707 - DNA, 15 bp, Homo sapiens
acaacacagatcacc

SEQ ID NO: 180708 - DNA, 15 bp, Homo sapiens
cacaacacagatcac

SEQ ID NO: 180709 - DNA, 15 bp, Homo sapiens
acacaacacagatca

SEQ ID NO: 180710 - DNA, 15 bp, Homo sapiens
aacacaacacagatc

SEQ ID NO: 180711 - DNA, 15 bp, Homo sapiens
taacacaacacagat

SEQ ID NO: 180712 - DNA, 15 bp, Homo sapiens
ctaacacaacacaga

SEQ ID NO: 180713 - DNA, 15 bp, Homo sapiens
cctaacacaacacag

SEQ ID NO: 180714 - DNA, 15 bp, Homo sapiens
ccctaacacaacaca

SEQ ID NO: 180715 - DNA, 15 bp, Homo sapiens
gccctaacacaacac

SEQ ID NO: 180716 - DNA, 15 bp, Homo sapiens
agccctaacacaaca

SEQ ID NO: 180717 - DNA, 15 bp, Homo sapiens
cagccctaacacaac

SEQ ID NO: 180718 - DNA, 15 bp, Homo sapiens
acagccctaacacaa

SEQ ID NO: 180719 - DNA, 15 bp, Homo sapiens
gacagccctaacaca

SEQ ID NO: 180720 - DNA, 15 bp, Homo sapiens
agacagccctaacac

SEQ ID NO: 180721 - DNA, 15 bp, Homo sapiens
cagacagccctaaca

SEQ ID NO: 180722 - DNA, 15 bp, Homo sapiens
acagacagccctaac

SEQ ID NO: 180723 - DNA, 15 bp, Homo sapiens
cacagacagccctaa

SEQ ID NO: 180724 - DNA, 15 bp, Homo sapiens
gcacagacagcccta

SEQ ID NO: 180725 - DNA, 15 bp, Homo sapiens
ggcacagacagccct

SEQ ID NO: 180726 - DNA, 15 bp, Homo sapiens
tggcacagacagccc

SEQ ID NO: 180727 - DNA, 15 bp, Homo sapiens
atggcacagacagcc

SEQ ID NO: 180728 - DNA, 15 bp, Homo sapiens
catggcacagacagc

SEQ ID NO: 180729 - DNA, 15 bp, Homo sapiens
acatggcacagacag

SEQ ID NO: 180730 - DNA, 15 bp, Homo sapiens
aacatggcacagaca

SEQ ID NO: 180731 - DNA, 15 bp, Homo sapiens
caacatggcacagac

SEQ ID NO: 180732 - DNA, 15 bp, Homo sapiens
gcaacatggcacaga

SEQ ID NO: 180733 - DNA, 15 bp, Homo sapiens
agcaacatggcacag

SEQ ID NO: 180734 - DNA, 15 bp, Homo sapiens
cagcaacatggcaca

SEQ ID NO: 180735 - DNA, 15 bp, Homo sapiens
acagcaacatggcac

SEQ ID NO: 180736 - DNA, 15 bp, Homo sapiens
cacagcaacatggca

SEQ ID NO: 180737 - DNA, 15 bp, Homo sapiens
ccacagcaacatggc

SEQ ID NO: 180738 - DNA, 15 bp, Homo sapiens
cccacagcaacatgg

SEQ ID NO: 180739 - DNA, 15 bp, Homo sapiens
tcccacagcaacatg

SEQ ID NO: 180740 - DNA, 15 bp, Homo sapiens
ctcccacagcaacat

SEQ ID NO: 180741 - DNA, 15 bp, Homo sapiens
actcccacagcaaca

SEQ ID NO: 180742 - DNA, 15 bp, Homo sapiens
aactcccacagcaac

SEQ ID NO: 180743 - DNA, 15 bp, Homo sapiens
aaactcccacagcaa

SEQ ID NO: 180744 - DNA, 15 bp, Homo sapiens
gaaactcccacagca

SEQ ID NO: 180745 - DNA, 15 bp, Homo sapiens
agaaactcccacagc

SEQ ID NO: 180746 - DNA, 15 bp, Homo sapiens
tagaaactcccacag

SEQ ID NO: 180747 - DNA, 15 bp, Homo sapiens
atagaaactcccaca

SEQ ID NO: 180748 - DNA, 15 bp, Homo sapiens
tatagaaactcccac

SEQ ID NO: 180749 - DNA, 15 bp, Homo sapiens
atatagaaactccca

SEQ ID NO: 180750 - DNA, 15 bp, Homo sapiens
catatagaaactccc

SEQ ID NO: 180751 - DNA, 15 bp, Homo sapiens
ccatatagaaactcc

SEQ ID NO: 180752 - DNA, 15 bp, Homo sapiens
tccatatagaaactc

SEQ ID NO: 180753 - DNA, 15 bp, Homo sapiens
ttccatatagaaact

SEQ ID NO: 180754 - DNA, 15 bp, Homo sapiens
cttccatatagaaac

SEQ ID NO: 180755 - DNA, 15 bp, Homo sapiens
tcttccatatagaaa

SEQ ID NO: 180756 - DNA, 15 bp, Homo sapiens
ctcttccatatagaa

SEQ ID NO: 180757 - DNA, 15 bp, Homo sapiens
cctcttccatataga

SEQ ID NO: 180758 - DNA, 15 bp, Homo sapiens
ccctcttccatatag

SEQ ID NO: 180759 - DNA, 15 bp, Homo sapiens
cccctcttccatata

SEQ ID NO: 180760 - DNA, 15 bp, Homo sapiens
gcccctcttccatat

SEQ ID NO: 180761 - DNA, 15 bp, Homo sapiens
tgcccctcttccata

SEQ ID NO: 180762 - DNA, 15 bp, Homo sapiens
atgcccctcttccat

SEQ ID NO: 180763 - DNA, 15 bp, Homo sapiens
aatgcccctcttcca

SEQ ID NO: 180764 - DNA, 15 bp, Homo sapiens
taatgcccctcttcc

SEQ ID NO: 180765 - DNA, 15 bp, Homo sapiens
ttaatgcccctcttc

SEQ ID NO: 180766 - DNA, 15 bp, Homo sapiens
gttaatgcccctctt

SEQ ID NO: 180767 - DNA, 15 bp, Homo sapiens
tgttaatgcccctct

SEQ ID NO: 180768 - DNA, 15 bp, Homo sapiens
ttgttaatgcccctc

SEQ ID NO: 180769 - DNA, 15 bp, Homo sapiens
tttgttaatgcccct

SEQ ID NO: 180770 - DNA, 15 bp, Homo sapiens
ctttgttaatgcccc

SEQ ID NO: 180771 - DNA, 15 bp, Homo sapiens
gctttgttaatgccc

SEQ ID NO: 180772 - DNA, 15 bp, Homo sapiens
agctttgttaatgcc

SEQ ID NO: 180773 - DNA, 15 bp, Homo sapiens
aagctttgttaatgc

SEQ ID NO: 180774 - DNA, 15 bp, Homo sapiens
aaagctttgttaatg

SEQ ID NO: 180775 - DNA, 15 bp, Homo sapiens
caaagctttgttaat

SEQ ID NO: 180776 - DNA, 15 bp, Homo sapiens
tcaaagctttgttaa

SEQ ID NO: 180777 - DNA, 15 bp, Homo sapiens
ttcaaagctttgtta

SEQ ID NO: 180778 - DNA, 15 bp, Homo sapiens
tttcaaagctttgtt

SEQ ID NO: 180779 - DNA, 15 bp, Homo sapiens
atttcaaagctttgt

SEQ ID NO: 180780 - DNA, 15 bp, Homo sapiens
catttcaaagctttg

SEQ ID NO: 180781 - DNA, 15 bp, Homo sapiens
gcatttcaaagcttt

SEQ ID NO: 180782 - DNA, 15 bp, Homo sapiens
ggcatttcaaagctt

SEQ ID NO: 180783 - DNA, 15 bp, Homo sapiens
tggcatttcaaagct

SEQ ID NO: 180784 - DNA, 15 bp, Homo sapiens
ttggcatttcaaagc

SEQ ID NO: 180785 - DNA, 15 bp, Homo sapiens
tttggcatttcaaag

SEQ ID NO: 180786 - DNA, 15 bp, Homo sapiens
ctttggcatttcaaa

SEQ ID NO: 180787 - DNA, 15 bp, Homo sapiens
gctttggcatttcaa

SEQ ID NO: 180788 - DNA, 15 bp, Homo sapiens
tgctttggcatttca

SEQ ID NO: 180789 - DNA, 15 bp, Homo sapiens
ctgctttggcatttc

SEQ ID NO: 180790 - DNA, 15 bp, Homo sapiens
tctgctttggcattt

SEQ ID NO: 180791 - DNA, 15 bp, Homo sapiens
gtctgctttggcatt

SEQ ID NO: 180792 - DNA, 15 bp, Homo sapiens
agtctgctttggcat

SEQ ID NO: 180793 - DNA, 15 bp, Homo sapiens
aagtctgctttggca

SEQ ID NO: 180794 - DNA, 15 bp, Homo sapiens
aaagtctgctttggc

SEQ ID NO: 180795 - DNA, 15 bp, Homo sapiens
gaaagtctgctttgg

SEQ ID NO: 180796 - DNA, 15 bp, Homo sapiens
ggaaagtctgctttg

SEQ ID NO: 180797 - DNA, 15 bp, Homo sapiens
tggaaagtctgcttt

SEQ ID NO: 180798 - DNA, 15 bp, Homo sapiens
ctggaaagtctgctt

SEQ ID NO: 180799 - DNA, 15 bp, Homo sapiens
cctggaaagtctgct

SEQ ID NO: 180800 - DNA, 15 bp, Homo sapiens
ccctggaaagtctgc

SEQ ID NO: 180801 - DNA, 15 bp, Homo sapiens
tccctggaaagtctg

SEQ ID NO: 180802 - DNA, 15 bp, Homo sapiens
ttccctggaaagtct

SEQ ID NO: 180803 - DNA, 15 bp, Homo sapiens
cttccctggaaagtc

SEQ ID NO: 180804 - DNA, 15 bp, Homo sapiens
tcttccctggaaagt

SEQ ID NO: 180805 - DNA, 15 bp, Homo sapiens
ctcttccctggaaag

SEQ ID NO: 180806 - DNA, 15 bp, Homo sapiens
gctcttccctggaaa

SEQ ID NO: 180807 - DNA, 15 bp, Homo sapiens
cgctcttccctggaa

SEQ ID NO: 180808 - DNA, 15 bp, Homo sapiens
acgctcttccctgga

SEQ ID NO: 180809 - DNA, 15 bp, Homo sapiens
gacgctcttccctgg

SEQ ID NO: 180810 - DNA, 15 bp, Homo sapiens
agacgctcttccctg

SEQ ID NO: 180811 - DNA, 15 bp, Homo sapiens
cagacgctcttccct

SEQ ID NO: 180812 - DNA, 15 bp, Homo sapiens
gcagacgctcttccc

SEQ ID NO: 180813 - DNA, 15 bp, Homo sapiens
tgcagacgctcttcc

SEQ ID NO: 180814 - DNA, 15 bp, Homo sapiens
ctgcagacgctcttc

SEQ ID NO: 180815 - DNA, 15 bp, Homo sapiens
tctgcagacgctctt

SEQ ID NO: 180816 - DNA, 15 bp, Homo sapiens
atctgcagacgctct

SEQ ID NO: 180817 - DNA, 15 bp, Homo sapiens
tatctgcagacgctc

SEQ ID NO: 180818 - DNA, 15 bp, Homo sapiens
ttatctgcagacgct

SEQ ID NO: 180819 - DNA, 15 bp, Homo sapiens
attatctgcagacgc

SEQ ID NO: 180820 - DNA, 15 bp, Homo sapiens
aattatctgcagacg

SEQ ID NO: 180821 - DNA, 15 bp, Homo sapiens
gaattatctgcagac

SEQ ID NO: 180822 - DNA, 15 bp, Homo sapiens
agaattatctgcaga

SEQ ID NO: 180823 - DNA, 15 bp, Homo sapiens
cagaattatctgcag

SEQ ID NO: 180824 - DNA, 15 bp, Homo sapiens
tcagaattatctgca

SEQ ID NO: 180825 - DNA, 15 bp, Homo sapiens
ttcagaattatctgc

SEQ ID NO: 180826 - DNA, 15 bp, Homo sapiens
cttcagaattatctg

SEQ ID NO: 180827 - DNA, 15 bp, Homo sapiens
tcttcagaattatct

SEQ ID NO: 180828 - DNA, 15 bp, Homo sapiens
ttcttcagaattatc

SEQ ID NO: 180829 - DNA, 15 bp, Homo sapiens
attcttcagaattat

SEQ ID NO: 180830 - DNA, 15 bp, Homo sapiens
cattcttcagaatta

SEQ ID NO: 180831 - DNA, 15 bp, Homo sapiens
acattcttcagaatt

SEQ ID NO: 180832 - DNA, 15 bp, Homo sapiens
cacattcttcagaat

SEQ ID NO: 180833 - DNA, 15 bp, Homo sapiens
acacattcttcagaa

SEQ ID NO: 180834 - DNA, 15 bp, Homo sapiens
aacacattcttcaga

SEQ ID NO: 180835 - DNA, 15 bp, Homo sapiens
caacacattcttcag

SEQ ID NO: 180836 - DNA, 15 bp, Homo sapiens
tcaacacattcttca

SEQ ID NO: 180837 - DNA, 15 bp, Homo sapiens
atcaacacattcttc

SEQ ID NO: 180838 - DNA, 15 bp, Homo sapiens
tatcaacacattctt

SEQ ID NO: 180839 - DNA, 15 bp, Homo sapiens
ctatcaacacattct

SEQ ID NO: 180840 - DNA, 15 bp, Homo sapiens
actatcaacacattc

SEQ ID NO: 180841 - DNA, 15 bp, Homo sapiens
tactatcaacacatt

SEQ ID NO: 180842 - DNA, 15 bp, Homo sapiens
atactatcaacacat

SEQ ID NO: 180843 - DNA, 15 bp, Homo sapiens
gatactatcaacaca

SEQ ID NO: 180844 - DNA, 15 bp, Homo sapiens
agatactatcaacac

SEQ ID NO: 180845 - DNA, 15 bp, Homo sapiens
aagatactatcaaca

SEQ ID NO: 180846 - DNA, 15 bp, Homo sapiens
caagatactatcaac

SEQ ID NO: 180847 - DNA, 15 bp, Homo sapiens
ccaagatactatcaa

SEQ ID NO: 180848 - DNA, 15 bp, Homo sapiens
gccaagatactatca

SEQ ID NO: 180849 - DNA, 15 bp, Homo sapiens
gtggccaagatacta

SEQ ID NO: 180850 - DNA, 15 bp, Homo sapiens
tgtggccaagatact

SEQ ID NO: 180851 - DNA, 15 bp, Homo sapiens
ctgtggccaagatac

SEQ ID NO: 180852 - DNA, 15 bp, Homo sapiens
cctgtggccaagata

SEQ ID NO: 180853 - DNA, 15 bp, Homo sapiens
ccctgtggccaagat

SEQ ID NO: 180854 - DNA, 15 bp, Homo sapiens
gccctgtggccaaga

SEQ ID NO: 180855 - DNA, 15 bp, Homo sapiens
ggccctgtggccaag

SEQ ID NO: 180856 - DNA, 15 bp, Homo sapiens
tggccctgtggccaa

SEQ ID NO: 180857 - DNA, 15 bp, Homo sapiens
atggccctgtggcca

SEQ ID NO: 180858 - DNA, 15 bp, Homo sapiens
catggccctgtggcc

SEQ ID NO: 180859 - DNA, 15 bp, Homo sapiens
tcatggccctgtggc

SEQ ID NO: 180860 - DNA, 15 bp, Homo sapiens
ctcatggccctgtgg

SEQ ID NO: 180861 - DNA, 15 bp, Homo sapiens
cctcatggccctgtg

SEQ ID NO: 180862 - DNA, 15 bp, Homo sapiens
gcctcatggccctgt

SEQ ID NO: 180863 - DNA, 15 bp, Homo sapiens
tgcctcatggccctg

SEQ ID NO: 180864 - DNA, 15 bp, Homo sapiens
atgcctcatggccct

SEQ ID NO: 180865 - DNA, 15 bp, Homo sapiens
aatgcctcatggccc

SEQ ID NO: 180866 - DNA, 15 bp, Homo sapiens
taatgcctcatggcc

SEQ ID NO: 180867 - DNA, 15 bp, Homo sapiens
ataatgcctcatggc

SEQ ID NO: 180868 - DNA, 15 bp, Homo sapiens
gataatgcctcatgg

SEQ ID NO: 180869 - DNA, 15 bp, Homo sapiens
tgataatgcctcatg

SEQ ID NO: 180870 - DNA, 15 bp, Homo sapiens
ctgataatgcctcat

SEQ ID NO: 180871 - DNA, 15 bp, Homo sapiens
cctgataatgcctca

SEQ ID NO: 180872 - DNA, 15 bp, Homo sapiens
ccctgataatgcctc

SEQ ID NO: 180873 - DNA, 15 bp, Homo sapiens
cccctgataatgcct

SEQ ID NO: 180874 - DNA, 15 bp, Homo sapiens
gcccctgataatgcc

SEQ ID NO: 180875 - DNA, 15 bp, Homo sapiens
tgcccctgataatgc

SEQ ID NO: 180876 - DNA, 15 bp, Homo sapiens
ctgcccctgataatg

SEQ ID NO: 180877 - DNA, 15 bp, Homo sapiens
cctgcccctgataat

SEQ ID NO: 180878 - DNA, 15 bp, Homo sapiens
tcctgcccctgataa

SEQ ID NO: 180879 - DNA, 15 bp, Homo sapiens
ctcctgcccctgata

SEQ ID NO: 180880 - DNA, 15 bp, Homo sapiens
tctcctgcccctgat

SEQ ID NO: 180881 - DNA, 15 bp, Homo sapiens
ctctcctgcccctga

SEQ ID NO: 180882 - DNA, 15 bp, Homo sapiens
tctctcctgcccctg

SEQ ID NO: 180883 - DNA, 15 bp, Homo sapiens
ctctctcctgcccct

SEQ ID NO: 180884 - DNA, 15 bp, Homo sapiens
cctctctcctgcccc

SEQ ID NO: 180885 - DNA, 15 bp, Homo sapiens
ccctctctcctgccc

SEQ ID NO: 180886 - DNA, 15 bp, Homo sapiens
tccctctctcctgcc

SEQ ID NO: 180887 - DNA, 15 bp, Homo sapiens
ctccctctctcctgc

SEQ ID NO: 180888 - DNA, 15 bp, Homo sapiens
cctccctctctcctg

SEQ ID NO: 180889 - DNA, 15 bp, Homo sapiens
gcctccctctctcct

SEQ ID NO: 180890 - DNA, 15 bp, Homo sapiens
agcctccctctctcc

SEQ ID NO: 180891 - DNA, 15 bp, Homo sapiens
tagcctccctctctc

SEQ ID NO: 180892 - DNA, 15 bp, Homo sapiens
atagcctccctctct

SEQ ID NO: 180893 - DNA, 15 bp, Homo sapiens
aatagcctccctctc

SEQ ID NO: 180894 - DNA, 15 bp, Homo sapiens
gaatagcctccctct

SEQ ID NO: 180895 - DNA, 15 bp, Homo sapiens
ggaatagcctccctc

SEQ ID NO: 180896 - DNA, 15 bp, Homo sapiens
gggaatagcctccct

SEQ ID NO: 180897 - DNA, 15 bp, Homo sapiens
tgggaatagcctccc

SEQ ID NO: 180898 - DNA, 15 bp, Homo sapiens
ctgggaatagcctcc

SEQ ID NO: 180899 - DNA, 15 bp, Homo sapiens
cctgggaatagcctc

SEQ ID NO: 180900 - DNA, 15 bp, Homo sapiens
tcctgggaatagcct

SEQ ID NO: 180901 - DNA, 15 bp, Homo sapiens
ttcctgggaatagcc

SEQ ID NO: 180902 - DNA, 15 bp, Homo sapiens
tttcctgggaatagc

SEQ ID NO: 180903 - DNA, 15 bp, Homo sapiens
ctttcctgggaatag

SEQ ID NO: 180904 - DNA, 15 bp, Homo sapiens
cctttcctgggaata

SEQ ID NO: 180905 - DNA, 15 bp, Homo sapiens
gcctttcctgggaat

SEQ ID NO: 180906 - DNA, 15 bp, Homo sapiens
agcctttcctgggaa

SEQ ID NO: 180907 - DNA, 15 bp, Homo sapiens
gagcctttcctggga

SEQ ID NO: 180908 - DNA, 15 bp, Homo sapiens
ggagcctttcctggg

SEQ ID NO: 180909 - DNA, 15 bp, Homo sapiens
tggagcctttcctgg

SEQ ID NO: 180910 - DNA, 15 bp, Homo sapiens
ctggagcctttcctg

SEQ ID NO: 180911 - DNA, 15 bp, Homo sapiens
gctggagcctttcct

SEQ ID NO: 180912 - DNA, 15 bp, Homo sapiens
tgctggagcctttcc

SEQ ID NO: 180913 - DNA, 15 bp, Homo sapiens
atgctggagcctttc

SEQ ID NO: 180914 - DNA, 15 bp, Homo sapiens
catgctggagccttt

SEQ ID NO: 180915 - DNA, 15 bp, Homo sapiens
acatgctggagcctt

SEQ ID NO: 180916 - DNA, 15 bp, Homo sapiens
cacatgctggagcct

SEQ ID NO: 180917 - DNA, 15 bp, Homo sapiens
gcacatgctggagcc

SEQ ID NO: 180918 - DNA, 15 bp, Homo sapiens
ggcacatgctggagc

SEQ ID NO: 180919 - DNA, 15 bp, Homo sapiens
tggcacatgctggag

SEQ ID NO: 180920 - DNA, 15 bp, Homo sapiens
ctggcacatgctgga

SEQ ID NO: 180921 - DNA, 15 bp, Homo sapiens
tctggcacatgctgg

SEQ ID NO: 180922 - DNA, 15 bp, Homo sapiens
ctctggcacatgctg

SEQ ID NO: 180923 - DNA, 15 bp, Homo sapiens
tctctggcacatgct

SEQ ID NO: 180924 - DNA, 15 bp, Homo sapiens
atctctggcacatgc

SEQ ID NO: 180925 - DNA, 15 bp, Homo sapiens
catctctggcacatg

SEQ ID NO: 180926 - DNA, 15 bp, Homo sapiens
tcatctctggcacat

SEQ ID NO: 180927 - DNA, 15 bp, Homo sapiens
atcatctctggcaca

SEQ ID NO: 180928 - DNA, 15 bp, Homo sapiens
catcatctctggcac

SEQ ID NO: 180929 - DNA, 15 bp, Homo sapiens
gcatcatctctggca

SEQ ID NO: 180930 - DNA, 15 bp, Homo sapiens
tgcatcatctctggc

SEQ ID NO: 180931 - DNA, 15 bp, Homo sapiens
ctgcatcatctctgg

SEQ ID NO: 180932 - DNA, 15 bp, Homo sapiens
tctgcatcatctctg

SEQ ID NO: 180933 - DNA, 15 bp, Homo sapiens
gtctgcatcatctct

SEQ ID NO: 180934 - DNA, 15 bp, Homo sapiens
tgtctgcatcatctc

SEQ ID NO: 180935 - DNA, 15 bp, Homo sapiens
ttgtctgcatcatct

SEQ ID NO: 180936 - DNA, 15 bp, Homo sapiens
gttgtctgcatcatc

SEQ ID NO: 180937 - DNA, 15 bp, Homo sapiens
tgttgtctgcatcat

SEQ ID NO: 180938 - DNA, 15 bp, Homo sapiens
atgttgtctgcatca

SEQ ID NO: 180939 - DNA, 15 bp, Homo sapiens
aatgttgtctgcatc

SEQ ID NO: 180940 - DNA, 15 bp, Homo sapiens
taatgttgtctgcat

SEQ ID NO: 180941 - DNA, 15 bp, Homo sapiens
ttaatgttgtctgca

SEQ ID NO: 180942 - DNA, 15 bp, Homo sapiens
cttaatgttgtctgc

SEQ ID NO: 180943 - DNA, 15 bp, Homo sapiens
tcttaatgttgtctg

SEQ ID NO: 180944 - DNA, 15 bp, Homo sapiens
atcttaatgttgtct

SEQ ID NO: 180945 - DNA, 15 bp, Homo sapiens
aatcttaatgttgtc

SEQ ID NO: 180946 - DNA, 15 bp, Homo sapiens
aaatcttaatgttgt

SEQ ID NO: 180947 - DNA, 15 bp, Homo sapiens
caaatcttaatgttg

SEQ ID NO: 180948 - DNA, 15 bp, Homo sapiens
tcaaatcttaatgtt

SEQ ID NO: 180949 - DNA, 15 bp, Homo sapiens
ttcaaatcttaatgt

SEQ ID NO: 180950 - DNA, 15 bp, Homo sapiens
tttcaaatcttaatg

SEQ ID NO: 180951 - DNA, 15 bp, Homo sapiens
ttttcaaatcttaat

SEQ ID NO: 180952 - DNA, 15 bp, Homo sapiens
tttttcaaatcttaa

SEQ ID NO: 180953 - DNA, 15 bp, Homo sapiens
ttttttcaaatctta

SEQ ID NO: 180954 - DNA, 15 bp, Homo sapiens
attttttcaaatctt

SEQ ID NO: 180955 - DNA, 15 bp, Homo sapiens
cattttttcaaatct

SEQ ID NO: 180956 - DNA, 15 bp, Homo sapiens
ccattttttcaaatc

SEQ ID NO: 180957 - DNA, 15 bp, Homo sapiens
gccattttttcaaat

SEQ ID NO: 180958 - DNA, 15 bp, Homo sapiens
ggccattttttcaaa

SEQ ID NO: 180959 - DNA, 15 bp, Homo sapiens
gggccattttttcaa

SEQ ID NO: 180960 - DNA, 15 bp, Homo sapiens
tgggccattttttca

SEQ ID NO: 180961 - DNA, 15 bp, Homo sapiens
ctgggccattttttc

SEQ ID NO: 180962 - DNA, 15 bp, Homo sapiens
actgggccatttttt

SEQ ID NO: 180963 - DNA, 15 bp, Homo sapiens
cactgggccattttt

SEQ ID NO: 180964 - DNA, 15 bp, Homo sapiens
tcactgggccatttt

SEQ ID NO: 180965 - DNA, 15 bp, Homo sapiens
ttcactgggccattt

SEQ ID NO: 180966 - DNA, 15 bp, Homo sapiens
gttcactgggccatt

SEQ ID NO: 180967 - DNA, 15 bp, Homo sapiens
tgttcactgggccat

SEQ ID NO: 180968 - DNA, 15 bp, Homo sapiens
ttgttcactgggcca

SEQ ID NO: 180969 - DNA, 15 bp, Homo sapiens
tttgttcactgggcc

SEQ ID NO: 180970 - DNA, 15 bp, Homo sapiens
ctttgttcactgggc

SEQ ID NO: 180971 - DNA, 15 bp, Homo sapiens
actttgttcactggg

SEQ ID NO: 180972 - DNA, 15 bp, Homo sapiens
cactttgttcactgg

SEQ ID NO: 180973 - DNA, 15 bp, Homo sapiens
acactttgttcactg

SEQ ID NO: 180974 - DNA, 15 bp, Homo sapiens
aacactttgttcact

SEQ ID NO: 180975 - DNA, 15 bp, Homo sapiens
aaacactttgttcac

SEQ ID NO: 180976 - DNA, 15 bp, Homo sapiens
aaaacactttgttca

SEQ ID NO: 180977 - DNA, 15 bp, Homo sapiens
aaaaacactttgttc

SEQ ID NO: 180978 - DNA, 15 bp, Homo sapiens
caaaaacactttgtt

SEQ ID NO: 180979 - DNA, 15 bp, Homo sapiens
ccaaaaacactttgt

SEQ ID NO: 180980 - DNA, 15 bp, Homo sapiens
accaaaaacactttg

SEQ ID NO: 180981 - DNA, 15 bp, Homo sapiens
aaccaaaaacacttt

SEQ ID NO: 180982 - DNA, 15 bp, Homo sapiens
aaaccaaaaacactt

SEQ ID NO: 180983 - DNA, 15 bp, Homo sapiens
aaaaccaaaaacact

SEQ ID NO: 180984 - DNA, 15 bp, Homo sapiens
caaaaccaaaaacac

SEQ ID NO: 180985 - DNA, 15 bp, Homo sapiens
tcaaaaccaaaaaca

SEQ ID NO: 180986 - DNA, 15 bp, Homo sapiens
ctcaaaaccaaaaac

SEQ ID NO: 180987 - DNA, 15 bp, Homo sapiens
tctcaaaaccaaaaa

SEQ ID NO: 180988 - DNA, 15 bp, Homo sapiens
ctctcaaaaccaaaa

SEQ ID NO: 180989 - DNA, 15 bp, Homo sapiens
tctctcaaaaccaaa

SEQ ID NO: 180990 - DNA, 15 bp, Homo sapiens
ctctctcaaaaccaa

SEQ ID NO: 180991 - DNA, 15 bp, Homo sapiens
tctctctcaaaacca

SEQ ID NO: 180992 - DNA, 15 bp, Homo sapiens
ctctctctcaaaacc

SEQ ID NO: 180993 - DNA, 15 bp, Homo sapiens
tctctctctcaaaac

SEQ ID NO: 180994 - DNA, 15 bp, Homo sapiens
ctctctctctcaaaa

SEQ ID NO: 180995 - DNA, 15 bp, Homo sapiens
tctctctctctcaaa

SEQ ID NO: 180996 - DNA, 15 bp, Homo sapiens
ctctctctctctcaa

SEQ ID NO: 180997 - DNA, 15 bp, Homo sapiens
tctctctctctctca

SEQ ID NO: 180998 - DNA, 15 bp, Homo sapiens
atctctctctctctc

SEQ ID NO: 180999 - DNA, 15 bp, Homo sapiens
aatctctctctctct

SEQ ID NO: 181000 - DNA, 15 bp, Homo sapiens
caatctctctctctc

SEQ ID NO: 181001 - DNA, 15 bp, Homo sapiens
tcaatctctctctct

SEQ ID NO: 181002 - DNA, 15 bp, Homo sapiens
ctcaatctctctctc

SEQ ID NO: 181003 - DNA, 15 bp, Homo sapiens
tctcaatctctctct

SEQ ID NO: 181004 - DNA, 15 bp, Homo sapiens
ctctcaatctctctc

SEQ ID NO: 181005 - DNA, 15 bp, Homo sapiens
tctctcaatctctct

SEQ ID NO: 181006 - DNA, 15 bp, Homo sapiens
gtctctcaatctctc

SEQ ID NO: 181007 - DNA, 15 bp, Homo sapiens
tgtctctcaatctct

SEQ ID NO: 181008 - DNA, 15 bp, Homo sapiens
ctgtctctcaatctc

SEQ ID NO: 181009 - DNA, 15 bp, Homo sapiens
tctgtctctcaatct

SEQ ID NO: 181010 - DNA, 15 bp, Homo sapiens
ctctgtctctcaatc

SEQ ID NO: 181011 - DNA, 15 bp, Homo sapiens
tctctgtctctcaat

SEQ ID NO: 181012 - DNA, 15 bp, Homo sapiens
ctctctgtctctcaa

SEQ ID NO: 181013 - DNA, 15 bp, Homo sapiens
tctctctgtctctca

SEQ ID NO: 181014 - DNA, 15 bp, Homo sapiens
ctctctctgtctctc

SEQ ID NO: 181015 - DNA, 15 bp, Homo sapiens
tctctctctgtctct

SEQ ID NO: 181016 - DNA, 15 bp, Homo sapiens
ctctctctctgtctc

SEQ ID NO: 181017 - DNA, 15 bp, Homo sapiens
tctctctctctgtct

SEQ ID NO: 181018 - DNA, 15 bp, Homo sapiens
ctctctctctctgtc

SEQ ID NO: 181019 - DNA, 15 bp, Homo sapiens
tctctctctctctgt

SEQ ID NO: 181020 - DNA, 15 bp, Homo sapiens
ctctctctctctctg

SEQ ID NO: 181021 - DNA, 15 bp, Homo sapiens
gtttctctctctctc

SEQ ID NO: 181022 - DNA, 15 bp, Homo sapiens
ggtttctctctctct

SEQ ID NO: 181023 - DNA, 15 bp, Homo sapiens
tggtttctctctctc

SEQ ID NO: 181024 - DNA, 15 bp, Homo sapiens
ttggtttctctctct

SEQ ID NO: 181025 - DNA, 15 bp, Homo sapiens
cttggtttctctctc

SEQ ID NO: 181026 - DNA, 15 bp, Homo sapiens
ccttggtttctctct

SEQ ID NO: 181027 - DNA, 15 bp, Homo sapiens
cccttggtttctctc

SEQ ID NO: 181028 - DNA, 15 bp, Homo sapiens
tcccttggtttctct

SEQ ID NO: 181029 - DNA, 15 bp, Homo sapiens
atcccttggtttctc

SEQ ID NO: 181030 - DNA, 15 bp, Homo sapiens
gatcccttggtttct

SEQ ID NO: 181031 - DNA, 15 bp, Homo sapiens
tgatcccttggtttc

SEQ ID NO: 181032 - DNA, 15 bp, Homo sapiens
atgatcccttggttt

SEQ ID NO: 181033 - DNA, 15 bp, Homo sapiens
catgatcccttggtt

SEQ ID NO: 181034 - DNA, 15 bp, Homo sapiens
tcatgatcccttggt

SEQ ID NO: 181035 - DNA, 15 bp, Homo sapiens
atcatgatcccttgg

SEQ ID NO: 181036 - DNA, 15 bp, Homo sapiens
tatcatgatcccttg

SEQ ID NO: 181037 - DNA, 15 bp, Homo sapiens
ctatcatgatccctt

SEQ ID NO: 181038 - DNA, 15 bp, Homo sapiens
actatcatgatccct

SEQ ID NO: 181039 - DNA, 15 bp, Homo sapiens
aactatcatgatccc

SEQ ID NO: 181040 - DNA, 15 bp, Homo sapiens
taactatcatgatcc

SEQ ID NO: 181041 - DNA, 15 bp, Homo sapiens
ataactatcatgatc

SEQ ID NO: 181042 - DNA, 15 bp, Homo sapiens
tataactatcatgat

SEQ ID NO: 181043 - DNA, 15 bp, Homo sapiens
ctataactatcatga

SEQ ID NO: 181044 - DNA, 15 bp, Homo sapiens
actataactatcatg

SEQ ID NO: 181045 - DNA, 15 bp, Homo sapiens
gactataactatcat

SEQ ID NO: 181046 - DNA, 15 bp, Homo sapiens
tgactataactatca

SEQ ID NO: 181047 - DNA, 15 bp, Homo sapiens
ttgactataactatc

SEQ ID NO: 181048 - DNA, 15 bp, Homo sapiens
tttgactataactat

SEQ ID NO: 181049 - DNA, 15 bp, Homo sapiens
atttgactataacta

SEQ ID NO: 181050 - DNA, 15 bp, Homo sapiens
tatttgactataact

SEQ ID NO: 181051 - DNA, 15 bp, Homo sapiens
ctatttgactataac

SEQ ID NO: 181052 - DNA, 15 bp, Homo sapiens
tctatttgactataa

SEQ ID NO: 181053 - DNA, 15 bp, Homo sapiens
ctctatttgactata

SEQ ID NO: 181054 - DNA, 15 bp, Homo sapiens
cctctatttgactat

SEQ ID NO: 181055 - DNA, 15 bp, Homo sapiens
tcctctatttgacta

SEQ ID NO: 181056 - DNA, 15 bp, Homo sapiens
ttcctctatttgact

SEQ ID NO: 181057 - DNA, 15 bp, Homo sapiens
cttcctctatttgac

SEQ ID NO: 181058 - DNA, 15 bp, Homo sapiens
ccttcctctatttga

SEQ ID NO: 181059 - DNA, 15 bp, Homo sapiens
tccttcctctatttg

SEQ ID NO: 181060 - DNA, 15 bp, Homo sapiens
atccttcctctattt

SEQ ID NO: 181061 - DNA, 15 bp, Homo sapiens
aatccttcctctatt

SEQ ID NO: 181062 - DNA, 15 bp, Homo sapiens
taatccttcctctat

SEQ ID NO: 181063 - DNA, 15 bp, Homo sapiens
ataatccttcctcta

SEQ ID NO: 181064 - DNA, 15 bp, Homo sapiens
gataatccttcctct

SEQ ID NO: 181065 - DNA, 15 bp, Homo sapiens
agataatccttcctc

SEQ ID NO: 181066 - DNA, 15 bp, Homo sapiens
aagataatccttcct

SEQ ID NO: 181067 - DNA, 15 bp, Homo sapiens
aaagataatccttcc

SEQ ID NO: 181068 - DNA, 15 bp, Homo sapiens
aaaagataatccttc

SEQ ID NO: 181069 - DNA, 15 bp, Homo sapiens
caaaagataatcctt

SEQ ID NO: 181070 - DNA, 15 bp, Homo sapiens
tcaaaagataatcct

SEQ ID NO: 181071 - DNA, 15 bp, Homo sapiens
ttcaaaagataatcc

SEQ ID NO: 181072 - DNA, 15 bp, Homo sapiens
tttcaaaagataatc

SEQ ID NO: 181073 - DNA, 15 bp, Homo sapiens
ttttcaaaagataat

SEQ ID NO: 181074 - DNA, 15 bp, Homo sapiens
attttcaaaagataa

SEQ ID NO: 181075 - DNA, 15 bp, Homo sapiens
cattttcaaaagata

SEQ ID NO: 181076 - DNA, 15 bp, Homo sapiens
acattttcaaaagat

SEQ ID NO: 181077 - DNA, 15 bp, Homo sapiens
cacattttcaaaaga

SEQ ID NO: 181078 - DNA, 15 bp, Homo sapiens
acacattttcaaaag

SEQ ID NO: 181079 - DNA, 15 bp, Homo sapiens
aacacattttcaaaa

SEQ ID NO: 181080 - DNA, 15 bp, Homo sapiens
caacacattttcaaa

SEQ ID NO: 181081 - DNA, 15 bp, Homo sapiens
ccaacacattttcaa

SEQ ID NO: 181082 - DNA, 15 bp, Homo sapiens
accaacacattttca

SEQ ID NO: 181083 - DNA, 15 bp, Homo sapiens
aaccaacacattttc

SEQ ID NO: 181084 - DNA, 15 bp, Homo sapiens
gaaccaacacatttt

SEQ ID NO: 181085 - DNA, 15 bp, Homo sapiens
agaaccaacacattt

SEQ ID NO: 181086 - DNA, 15 bp, Homo sapiens
cagaaccaacacatt

SEQ ID NO: 181087 - DNA, 15 bp, Homo sapiens
acagaaccaacacat

SEQ ID NO: 181088 - DNA, 15 bp, Homo sapiens
cacagaaccaacaca

SEQ ID NO: 181089 - DNA, 15 bp, Homo sapiens
tcacagaaccaacac

SEQ ID NO: 181090 - DNA, 15 bp, Homo sapiens
atcacagaaccaaca

SEQ ID NO: 181091 - DNA, 15 bp, Homo sapiens
tatcacagaaccaac

SEQ ID NO: 181092 - DNA, 15 bp, Homo sapiens
gtatcacagaaccaa

SEQ ID NO: 181093 - DNA, 15 bp, Homo sapiens
tgtatcacagaacca

SEQ ID NO: 181094 - DNA, 15 bp, Homo sapiens
ttgtatcacagaacc

SEQ ID NO: 181095 - DNA, 15 bp, Homo sapiens
cttgtatcacagaac

SEQ ID NO: 181096 - DNA, 15 bp, Homo sapiens
tcttgtatcacagaa

SEQ ID NO: 181097 - DNA, 15 bp, Homo sapiens
ctcttgtatcacaga

SEQ ID NO: 181098 - DNA, 15 bp, Homo sapiens
cctcttgtatcacag

SEQ ID NO: 181099 - DNA, 15 bp, Homo sapiens
tcctcttgtatcaca

SEQ ID NO: 181100 - DNA, 15 bp, Homo sapiens
ttcctcttgtatcac

SEQ ID NO: 181101 - DNA, 15 bp, Homo sapiens
cttcctcttgtatca

SEQ ID NO: 181102 - DNA, 15 bp, Homo sapiens
gcttcctcttgtatc

SEQ ID NO: 181103 - DNA, 15 bp, Homo sapiens
agcttcctcttgtat

SEQ ID NO: 181104 - DNA, 15 bp, Homo sapiens
tagcttcctcttgta

SEQ ID NO: 181105 - DNA, 15 bp, Homo sapiens
ttagcttcctcttgt

SEQ ID NO: 181106 - DNA, 15 bp, Homo sapiens
cttagcttcctcttg

SEQ ID NO: 181107 - DNA, 15 bp, Homo sapiens
tcttagcttcctctt

SEQ ID NO: 181108 - DNA, 15 bp, Homo sapiens
gtcttagcttcctct

SEQ ID NO: 181109 - DNA, 15 bp, Homo sapiens
tgtcttagcttcctc

SEQ ID NO: 181110 - DNA, 15 bp, Homo sapiens
atgtcttagcttcct

SEQ ID NO: 181111 - DNA, 15 bp, Homo sapiens
tatgtcttagcttcc

SEQ ID NO: 181112 - DNA, 15 bp, Homo sapiens
atatgtcttagcttc

SEQ ID NO: 181113 - DNA, 15 bp, Homo sapiens
gatatgtcttagctt

SEQ ID NO: 181114 - DNA, 15 bp, Homo sapiens
cgatatgtcttagct

SEQ ID NO: 181115 - DNA, 15 bp, Homo sapiens
acgatatgtcttagc

SEQ ID NO: 181116 - DNA, 15 bp, Homo sapiens
cacgatatgtcttag

SEQ ID NO: 181117 - DNA, 15 bp, Homo sapiens
ccacgatatgtctta

SEQ ID NO: 181118 - DNA, 15 bp, Homo sapiens
tccacgatatgtctt

SEQ ID NO: 181119 - DNA, 15 bp, Homo sapiens
ttccacgatatgtct

SEQ ID NO: 181120 - DNA, 15 bp, Homo sapiens
tttccacgatatgtc

SEQ ID NO: 181121 - DNA, 15 bp, Homo sapiens
gtttccacgatatgt

SEQ ID NO: 181122 - DNA, 15 bp, Homo sapiens
tgtttccacgatatg

SEQ ID NO: 181123 - DNA, 15 bp, Homo sapiens
atgtttccacgatat

SEQ ID NO: 181124 - DNA, 15 bp, Homo sapiens
gatgtttccacgata

SEQ ID NO: 181125 - DNA, 15 bp, Homo sapiens
agatgtttccacgat

SEQ ID NO: 181126 - DNA, 15 bp, Homo sapiens
gagatgtttccacga

SEQ ID NO: 181127 - DNA, 15 bp, Homo sapiens
ggagatgtttccacg

SEQ ID NO: 181128 - DNA, 15 bp, Homo sapiens
gggagatgtttccac

SEQ ID NO: 181129 - DNA, 15 bp, Homo sapiens
ggggagatgtttcca

SEQ ID NO: 181130 - DNA, 15 bp, Homo sapiens
gggggagatgtttcc

SEQ ID NO: 181131 - DNA, 15 bp, Homo sapiens
ggggggagatgtttc

SEQ ID NO: 181132 - DNA, 15 bp, Homo sapiens
aggggggagatgttt

SEQ ID NO: 181133 - DNA, 15 bp, Homo sapiens
gaggggggagatgtt

SEQ ID NO: 181134 - DNA, 15 bp, Homo sapiens
ggaggggggagatgt

SEQ ID NO: 181135 - DNA, 15 bp, Homo sapiens
tggaggggggagatg

SEQ ID NO: 181136 - DNA, 15 bp, Homo sapiens
gtggaggggggagat

SEQ ID NO: 181137 - DNA, 15 bp, Homo sapiens
ggtggaggggggaga

SEQ ID NO: 181138 - DNA, 15 bp, Homo sapiens
aggtggaggggggag

SEQ ID NO: 181139 - DNA, 15 bp, Homo sapiens
aaggtggagggggga

SEQ ID NO: 181140 - DNA, 15 bp, Homo sapiens
taaggtggagggggg

SEQ ID NO: 181141 - DNA, 15 bp, Homo sapiens
ttaaggtggaggggg

SEQ ID NO: 181142 - DNA, 15 bp, Homo sapiens
attaaggtggagggg

SEQ ID NO: 181143 - DNA, 15 bp, Homo sapiens
tattaaggtggaggg

SEQ ID NO: 181144 - DNA, 15 bp, Homo sapiens
atattaaggtggagg

SEQ ID NO: 181145 - DNA, 15 bp, Homo sapiens
gatattaaggtggag

SEQ ID NO: 181146 - DNA, 15 bp, Homo sapiens
tgatattaaggtgga

SEQ ID NO: 181147 - DNA, 15 bp, Homo sapiens
ttgatattaaggtgg

SEQ ID NO: 181148 - DNA, 15 bp, Homo sapiens
cttgatattaaggtg

SEQ ID NO: 181149 - DNA, 15 bp, Homo sapiens
tcttgatattaaggt

SEQ ID NO: 181150 - DNA, 15 bp, Homo sapiens
ttcttgatattaagg

SEQ ID NO: 181151 - DNA, 15 bp, Homo sapiens
gttcttgatattaag

SEQ ID NO: 181152 - DNA, 15 bp, Homo sapiens
tgttcttgatattaa

SEQ ID NO: 181153 - DNA, 15 bp, Homo sapiens
ttgttcttgatatta

SEQ ID NO: 181154 - DNA, 15 bp, Homo sapiens
tttgttcttgatatt

SEQ ID NO: 181155 - DNA, 15 bp, Homo sapiens
atttgttcttgatat

SEQ ID NO: 181156 - DNA, 15 bp, Homo sapiens
aatttgttcttgata

SEQ ID NO: 181157 - DNA, 15 bp, Homo sapiens
caatttgttcttgat

SEQ ID NO: 181158 - DNA, 15 bp, Homo sapiens
acaatttgttcttga

SEQ ID NO: 181159 - DNA, 15 bp, Homo sapiens
cacaatttgttcttg

SEQ ID NO: 181160 - DNA, 15 bp, Homo sapiens
ccacaatttgttctt

SEQ ID NO: 181161 - DNA, 15 bp, Homo sapiens
tccacaatttgttct

SEQ ID NO: 181162 - DNA, 15 bp, Homo sapiens
ttccacaatttgttc

SEQ ID NO: 181163 - DNA, 15 bp, Homo sapiens
attccacaatttgtt

SEQ ID NO: 181164 - DNA, 15 bp, Homo sapiens
gattccacaatttgt

SEQ ID NO: 181165 - DNA, 15 bp, Homo sapiens
agattccacaatttg

SEQ ID NO: 181166 - DNA, 15 bp, Homo sapiens
tagattccacaattt

SEQ ID NO: 181167 - DNA, 15 bp, Homo sapiens
ttagattccacaatt

SEQ ID NO: 181168 - DNA, 15 bp, Homo sapiens
attagattccacaat

SEQ ID NO: 181169 - DNA, 15 bp, Homo sapiens
cattagattccacaa

SEQ ID NO: 181170 - DNA, 15 bp, Homo sapiens
acattagattccaca

SEQ ID NO: 181171 - DNA, 15 bp, Homo sapiens
aacattagattccac

SEQ ID NO: 181172 - DNA, 15 bp, Homo sapiens
taacattagattcca

SEQ ID NO: 181173 - DNA, 15 bp, Homo sapiens
ttaacattagattcc

SEQ ID NO: 181174 - DNA, 15 bp, Homo sapiens
attaacattagattc

SEQ ID NO: 181175 - DNA, 15 bp, Homo sapiens
cattaacattagatt

SEQ ID NO: 181176 - DNA, 15 bp, Homo sapiens
tcattaacattagat

SEQ ID NO: 181177 - DNA, 15 bp, Homo sapiens
ctcattaacattaga

SEQ ID NO: 181178 - DNA, 15 bp, Homo sapiens
tctcattaacattag

SEQ ID NO: 181179 - DNA, 15 bp, Homo sapiens
ttctcattaacatta

SEQ ID NO: 181180 - DNA, 15 bp, Homo sapiens
cttctcattaacatt

SEQ ID NO: 181181 - DNA, 15 bp, Homo sapiens
acttctcattaacat

SEQ ID NO: 181182 - DNA, 15 bp, Homo sapiens
tacttctcattaaca

SEQ ID NO: 181183 - DNA, 15 bp, Homo sapiens
ctacttctcattaac

SEQ ID NO: 181184 - DNA, 15 bp, Homo sapiens
actacttctcattaa

SEQ ID NO: 181185 - DNA, 15 bp, Homo sapiens
aactacttctcatta

SEQ ID NO: 181186 - DNA, 15 bp, Homo sapiens
gaactacttctcatt

SEQ ID NO: 181187 - DNA, 15 bp, Homo sapiens
ggaactacttctcat

SEQ ID NO: 181188 - DNA, 15 bp, Homo sapiens
gggaactacttctca

SEQ ID NO: 181189 - DNA, 15 bp, Homo sapiens
ggggaactacttctc

SEQ ID NO: 181190 - DNA, 15 bp, Homo sapiens
tggggaactacttct

SEQ ID NO: 181191 - DNA, 15 bp, Homo sapiens
gtggggaactacttc

SEQ ID NO: 181192 - DNA, 15 bp, Homo sapiens
agtggggaactactt

SEQ ID NO: 181193 - DNA, 15 bp, Homo sapiens
cagtggggaactact

SEQ ID NO: 181194 - DNA, 15 bp, Homo sapiens
acagtggggaactac

SEQ ID NO: 181195 - DNA, 15 bp, Homo sapiens
cacagtggggaacta

SEQ ID NO: 181196 - DNA, 15 bp, Homo sapiens
acacagtggggaact

SEQ ID NO: 181197 - DNA, 15 bp, Homo sapiens
gacacagtggggaac

SEQ ID NO: 181198 - DNA, 15 bp, Homo sapiens
tgacacagtggggaa

SEQ ID NO: 181199 - DNA, 15 bp, Homo sapiens
ctgacacagtgggga

SEQ ID NO: 181200 - DNA, 15 bp, Homo sapiens
tctgacacagtgggg

SEQ ID NO: 181201 - DNA, 15 bp, Homo sapiens
atctgacacagtggg

SEQ ID NO: 181202 - DNA, 15 bp, Homo sapiens
catctgacacagtgg

SEQ ID NO: 181203 - DNA, 15 bp, Homo sapiens
gcatctgacacagtg

SEQ ID NO: 181204 - DNA, 15 bp, Homo sapiens
cgcatctgacacagt

SEQ ID NO: 181205 - DNA, 15 bp, Homo sapiens
gcgcatctgacacag

SEQ ID NO: 181206 - DNA, 15 bp, Homo sapiens
tgcgcatctgacaca

SEQ ID NO: 181207 - DNA, 15 bp, Homo sapiens
ttgcgcatctgacac

SEQ ID NO: 181208 - DNA, 15 bp, Homo sapiens
tttgcgcatctgaca

SEQ ID NO: 181209 - DNA, 15 bp, Homo sapiens
ctttgcgcatctgac

SEQ ID NO: 181210 - DNA, 15 bp, Homo sapiens
tctttgcgcatctga

SEQ ID NO: 181211 - DNA, 15 bp, Homo sapiens
ctctttgcgcatctg

SEQ ID NO: 181212 - DNA, 15 bp, Homo sapiens
tctctttgcgcatct

SEQ ID NO: 181213 - DNA, 15 bp, Homo sapiens
ttctctttgcgcatc

SEQ ID NO: 181214 - DNA, 15 bp, Homo sapiens
tttctctttgcgcat

SEQ ID NO: 181215 - DNA, 15 bp, Homo sapiens
atttctctttgcgca

SEQ ID NO: 181216 - DNA, 15 bp, Homo sapiens
aatttctctttgcgc

SEQ ID NO: 181217 - DNA, 15 bp, Homo sapiens
caatttctctttgcg

SEQ ID NO: 181218 - DNA, 15 bp, Homo sapiens
ccaatttctctttgc

SEQ ID NO: 181219 - DNA, 15 bp, Homo sapiens
tccaatttctctttg

SEQ ID NO: 181220 - DNA, 15 bp, Homo sapiens
ttccaatttctcttt

SEQ ID NO: 181221 - DNA, 15 bp, Homo sapiens
attccaatttctctt

SEQ ID NO: 181222 - DNA, 15 bp, Homo sapiens
tattccaatttctct

SEQ ID NO: 181223 - DNA, 15 bp, Homo sapiens
atattccaatttctc

SEQ ID NO: 181224 - DNA, 15 bp, Homo sapiens
tatattccaatttct

SEQ ID NO: 181225 - DNA, 15 bp, Homo sapiens
gtatattccaatttc

SEQ ID NO: 181226 - DNA, 15 bp, Homo sapiens
agtatattccaattt

SEQ ID NO: 181227 - DNA, 15 bp, Homo sapiens
aagtatattccaatt

SEQ ID NO: 181228 - DNA, 15 bp, Homo sapiens
taagtatattccaat

SEQ ID NO: 181229 - DNA, 15 bp, Homo sapiens
ataagtatattccaa

SEQ ID NO: 181230 - DNA, 15 bp, Homo sapiens
gataagtatattcca

SEQ ID NO: 181231 - DNA, 15 bp, Homo sapiens
tgataagtatattcc

SEQ ID NO: 181232 - DNA, 15 bp, Homo sapiens
ttgataagtatattc

SEQ ID NO: 181233 - DNA, 15 bp, Homo sapiens
cttgataagtatatt

SEQ ID NO: 181234 - DNA, 15 bp, Homo sapiens
acttgataagtatat

SEQ ID NO: 181235 - DNA, 15 bp, Homo sapiens
tacttgataagtata

SEQ ID NO: 181236 - DNA, 15 bp, Homo sapiens
atacttgataagtat

SEQ ID NO: 181237 - DNA, 15 bp, Homo sapiens
tatacttgataagta

SEQ ID NO: 181238 - DNA, 15 bp, Homo sapiens
atatacttgataagt

SEQ ID NO: 181239 - DNA, 15 bp, Homo sapiens
aatatacttgataag

SEQ ID NO: 181240 - DNA, 15 bp, Homo sapiens
taatatacttgataa

SEQ ID NO: 181241 - DNA, 15 bp, Homo sapiens
ataatatacttgata

SEQ ID NO: 181242 - DNA, 15 bp, Homo sapiens
tataatatacttgat

SEQ ID NO: 181243 - DNA, 15 bp, Homo sapiens
ctataatatacttga

SEQ ID NO: 181244 - DNA, 15 bp, Homo sapiens
tctataatatacttg

SEQ ID NO: 181245 - DNA, 15 bp, Homo sapiens
atctataatatactt

SEQ ID NO: 181246 - DNA, 15 bp, Homo sapiens
catctataatatact

SEQ ID NO: 181247 - DNA, 15 bp, Homo sapiens
ccatctataatatac

SEQ ID NO: 181248 - DNA, 15 bp, Homo sapiens
tccatctataatata

SEQ ID NO: 181249 - DNA, 15 bp, Homo sapiens
ttccatctataatat

SEQ ID NO: 181250 - DNA, 15 bp, Homo sapiens
attccatctataata

SEQ ID NO: 181251 - DNA, 15 bp, Homo sapiens
aattccatctataat

SEQ ID NO: 181252 - DNA, 15 bp, Homo sapiens
caattccatctataa

SEQ ID NO: 181253 - DNA, 15 bp, Homo sapiens
tcaattccatctata

SEQ ID NO: 181254 - DNA, 15 bp, Homo sapiens
ttcaattccatctat

SEQ ID NO: 181255 - DNA, 15 bp, Homo sapiens
attcaattccatcta

SEQ ID NO: 181256 - DNA, 15 bp, Homo sapiens
aattcaattccatct

SEQ ID NO: 181257 - DNA, 15 bp, Homo sapiens
taattcaattccatc

SEQ ID NO: 181258 - DNA, 15 bp, Homo sapiens
ataattcaattccat

SEQ ID NO: 181259 - DNA, 15 bp, Homo sapiens
aataattcaattcca

SEQ ID NO: 181260 - DNA, 15 bp, Homo sapiens
caataattcaattcc

SEQ ID NO: 181261 - DNA, 15 bp, Homo sapiens
acaataattcaattc

SEQ ID NO: 181262 - DNA, 15 bp, Homo sapiens
tacaataattcaatt

SEQ ID NO: 181263 - DNA, 15 bp, Homo sapiens
ttacaataattcaat

SEQ ID NO: 181264 - DNA, 15 bp, Homo sapiens
tttacaataattcaa

SEQ ID NO: 181265 - DNA, 15 bp, Homo sapiens
ctttacaataattca

SEQ ID NO: 181266 - DNA, 15 bp, Homo sapiens
tctttacaataattc

SEQ ID NO: 181267 - DNA, 15 bp, Homo sapiens
ctctttacaataatt

SEQ ID NO: 181268 - DNA, 15 bp, Homo sapiens
actctttacaataat

SEQ ID NO: 181269 - DNA, 15 bp, Homo sapiens
tactctttacaataa

SEQ ID NO: 181270 - DNA, 15 bp, Homo sapiens
ctactctttacaata

SEQ ID NO: 181271 - DNA, 15 bp, Homo sapiens
tctactctttacaat

SEQ ID NO: 181272 - DNA, 15 bp, Homo sapiens
atctactctttacaa

SEQ ID NO: 181273 - DNA, 15 bp, Homo sapiens
aatctactctttaca

SEQ ID NO: 181274 - DNA, 15 bp, Homo sapiens
taatctactctttac

SEQ ID NO: 181275 - DNA, 15 bp, Homo sapiens
ctaatctactcttta

SEQ ID NO: 181276 - DNA, 15 bp, Homo sapiens
tctaatctactcttt

SEQ ID NO: 181277 - DNA, 15 bp, Homo sapiens
ctctaatctactctt

SEQ ID NO: 181278 - DNA, 15 bp, Homo sapiens
tctctaatctactct

SEQ ID NO: 181279 - DNA, 15 bp, Homo sapiens
ctctctaatctactc

SEQ ID NO: 181280 - DNA, 15 bp, Homo sapiens
cctctctaatctact

SEQ ID NO: 181281 - DNA, 15 bp, Homo sapiens
tcctctctaatctac

SEQ ID NO: 181282 - DNA, 15 bp, Homo sapiens
gtcctctctaatcta

SEQ ID NO: 181283 - DNA, 15 bp, Homo sapiens
ggtcctctctaatct

SEQ ID NO: 181284 - DNA, 15 bp, Homo sapiens
cggtcctctctaatc

SEQ ID NO: 181285 - DNA, 15 bp, Homo sapiens
gcggtcctctctaat

SEQ ID NO: 181286 - DNA, 15 bp, Homo sapiens
ggcggtcctctctaa

SEQ ID NO: 181287 - DNA, 15 bp, Homo sapiens
tggcggtcctctcta

SEQ ID NO: 181288 - DNA, 15 bp, Homo sapiens
ttggcggtcctctct

SEQ ID NO: 181289 - DNA, 15 bp, Homo sapiens
tttggcggtcctctc

SEQ ID NO: 181290 - DNA, 15 bp, Homo sapiens
ctttggcggtcctct

SEQ ID NO: 181291 - DNA, 15 bp, Homo sapiens
actttggcggtcctc

SEQ ID NO: 181292 - DNA, 15 bp, Homo sapiens
gactttggcggtcct

SEQ ID NO: 181293 - DNA, 15 bp, Homo sapiens
ggactttggcggtcc

SEQ ID NO: 181294 - DNA, 15 bp, Homo sapiens
tggactttggcggtc

SEQ ID NO: 181295 - DNA, 15 bp, Homo sapiens
ctggactttggcggt

SEQ ID NO: 181296 - DNA, 15 bp, Homo sapiens
actggactttggcgg

SEQ ID NO: 181297 - DNA, 15 bp, Homo sapiens
gactggactttggcg

SEQ ID NO: 181298 - DNA, 15 bp, Homo sapiens
ggactggactttggc

SEQ ID NO: 181299 - DNA, 15 bp, Homo sapiens
gggactggactttgg

SEQ ID NO: 181300 - DNA, 15 bp, Homo sapiens
tgggactggactttg

SEQ ID NO: 181301 - DNA, 15 bp, Homo sapiens
ttgggactggacttt

SEQ ID NO: 181302 - DNA, 15 bp, Homo sapiens
tttgggactggactt

SEQ ID NO: 181303 - DNA, 15 bp, Homo sapiens
gtttgggactggact

SEQ ID NO: 181304 - DNA, 15 bp, Homo sapiens
tgtttgggactggac

SEQ ID NO: 181305 - DNA, 15 bp, Homo sapiens
atgtttgggactgga

SEQ ID NO: 181306 - DNA, 15 bp, Homo sapiens
catgtttgggactgg

SEQ ID NO: 181307 - DNA, 15 bp, Homo sapiens
tcatgtttgggactg

SEQ ID NO: 181308 - DNA, 15 bp, Homo sapiens
atcatgtttgggact

SEQ ID NO: 181309 - DNA, 15 bp, Homo sapiens
tatcatgtttgggac

SEQ ID NO: 181310 - DNA, 15 bp, Homo sapiens
gtatcatgtttggga

SEQ ID NO: 181311 - DNA, 15 bp, Homo sapiens
tgtatcatgtttggg

SEQ ID NO: 181312 - DNA, 15 bp, Homo sapiens
atgtatcatgtttgg

SEQ ID NO: 181313 - DNA, 15 bp, Homo sapiens
aatgtatcatgtttg

SEQ ID NO: 181314 - DNA, 15 bp, Homo sapiens
taatgtatcatgttt

SEQ ID NO: 181315 - DNA, 15 bp, Homo sapiens
ttaatgtatcatgtt

SEQ ID NO: 181316 - DNA, 15 bp, Homo sapiens
cttaatgtatcatgt

SEQ ID NO: 181317 - DNA, 15 bp, Homo sapiens
acttaatgtatcatg

SEQ ID NO: 181318 - DNA, 15 bp, Homo sapiens
cacttaatgtatcat

SEQ ID NO: 181319 - DNA, 15 bp, Homo sapiens
acacttaatgtatca

SEQ ID NO: 181320 - DNA, 15 bp, Homo sapiens
tacacttaatgtatc

SEQ ID NO: 181321 - DNA, 15 bp, Homo sapiens
atacacttaatgtat

SEQ ID NO: 181322 - DNA, 15 bp, Homo sapiens
gatacacttaatgta

SEQ ID NO: 181323 - DNA, 15 bp, Homo sapiens
ggatacacttaatgt

SEQ ID NO: 181324 - DNA, 15 bp, Homo sapiens
gggatacacttaatg

SEQ ID NO: 181325 - DNA, 15 bp, Homo sapiens
agggatacacttaat

SEQ ID NO: 181326 - DNA, 15 bp, Homo sapiens
aagggatacacttaa

SEQ ID NO: 181327 - DNA, 15 bp, Homo sapiens
taagggatacactta

SEQ ID NO: 181328 - DNA, 15 bp, Homo sapiens
ctaagggatacactt

SEQ ID NO: 181329 - DNA, 15 bp, Homo sapiens
actaagggatacact

SEQ ID NO: 181330 - DNA, 15 bp, Homo sapiens
tactaagggatacac

SEQ ID NO: 181331 - DNA, 15 bp, Homo sapiens
atactaagggataca

SEQ ID NO: 181332 - DNA, 15 bp, Homo sapiens
tatactaagggatac

SEQ ID NO: 181333 - DNA, 15 bp, Homo sapiens
ttatactaagggata

SEQ ID NO: 181334 - DNA, 15 bp, Homo sapiens
attatactaagggat

SEQ ID NO: 181335 - DNA, 15 bp, Homo sapiens
tattatactaaggga

SEQ ID NO: 181336 - DNA, 15 bp, Homo sapiens
gtattatactaaggg

SEQ ID NO: 181337 - DNA, 15 bp, Homo sapiens
ggtattatactaagg

SEQ ID NO: 181338 - DNA, 15 bp, Homo sapiens
tggtattatactaag

SEQ ID NO: 181339 - DNA, 15 bp, Homo sapiens
ttggtattatactaa

SEQ ID NO: 181340 - DNA, 15 bp, Homo sapiens
cttggtattatacta

SEQ ID NO: 181341 - DNA, 15 bp, Homo sapiens
ccttggtattatact

SEQ ID NO: 181342 - DNA, 15 bp, Homo sapiens
tccttggtattatac

SEQ ID NO: 181343 - DNA, 15 bp, Homo sapiens
ttccttggtattata

SEQ ID NO: 181344 - DNA, 15 bp, Homo sapiens
gttccttggtattat

SEQ ID NO: 181345 - DNA, 15 bp, Homo sapiens
ggttccttggtatta

SEQ ID NO: 181346 - DNA, 15 bp, Homo sapiens
gggttccttggtatt

SEQ ID NO: 181347 - DNA, 15 bp, Homo sapiens
ggggttccttggtat

SEQ ID NO: 181348 - DNA, 15 bp, Homo sapiens
tggggttccttggta

SEQ ID NO: 181349 - DNA, 15 bp, Homo sapiens
ttggggttccttggt

SEQ ID NO: 181350 - DNA, 15 bp, Homo sapiens
tttggggttccttgg

SEQ ID NO: 181351 - DNA, 15 bp, Homo sapiens
ttttggggttccttg

SEQ ID NO: 181352 - DNA, 15 bp, Homo sapiens
cttttggggttcctt

SEQ ID NO: 181353 - DNA, 15 bp, Homo sapiens
gcttttggggttcct

SEQ ID NO: 181354 - DNA, 15 bp, Homo sapiens
agcttttggggttcc

SEQ ID NO: 181355 - DNA, 15 bp, Homo sapiens
aagcttttggggttc

SEQ ID NO: 181356 - DNA, 15 bp, Homo sapiens
aaagcttttggggtt

SEQ ID NO: 181357 - DNA, 15 bp, Homo sapiens
taaagcttttggggt

SEQ ID NO: 181358 - DNA, 15 bp, Homo sapiens
gtaaagcttttgggg

SEQ ID NO: 181359 - DNA, 15 bp, Homo sapiens
tgtaaagcttttggg

SEQ ID NO: 181360 - DNA, 15 bp, Homo sapiens
ctgtaaagcttttgg

SEQ ID NO: 181361 - DNA, 15 bp, Homo sapiens
actgtaaagcttttg

SEQ ID NO: 181362 - DNA, 15 bp, Homo sapiens
cactgtaaagctttt

SEQ ID NO: 181363 - DNA, 15 bp, Homo sapiens
acactgtaaagcttt

SEQ ID NO: 181364 - DNA, 15 bp, Homo sapiens
gacactgtaaagctt

SEQ ID NO: 181365 - DNA, 15 bp, Homo sapiens
agacactgtaaagct

SEQ ID NO: 181366 - DNA, 15 bp, Homo sapiens
tagacactgtaaagc

SEQ ID NO: 181367 - DNA, 15 bp, Homo sapiens
ttagacactgtaaag

SEQ ID NO: 181368 - DNA, 15 bp, Homo sapiens
tttagacactgtaaa

SEQ ID NO: 181369 - DNA, 15 bp, Homo sapiens
gtttagacactgtaa

SEQ ID NO: 181370 - DNA, 15 bp, Homo sapiens
agtttagacactgta

SEQ ID NO: 181371 - DNA, 15 bp, Homo sapiens
gagtttagacactgt

SEQ ID NO: 181372 - DNA, 15 bp, Homo sapiens
agagtttagacactg

SEQ ID NO: 181373 - DNA, 15 bp, Homo sapiens
tagagtttagacact

SEQ ID NO: 181374 - DNA, 15 bp, Homo sapiens
atagagtttagacac

SEQ ID NO: 181375 - DNA, 15 bp, Homo sapiens
aatagagtttagaca

SEQ ID NO: 181376 - DNA, 15 bp, Homo sapiens
aaatagagtttagac

SEQ ID NO: 181377 - DNA, 15 bp, Homo sapiens
aaaatagagtttaga

SEQ ID NO: 181378 - DNA, 15 bp, Homo sapiens
taaaatagagtttag

SEQ ID NO: 181379 - DNA, 15 bp, Homo sapiens
gtaaaatagagttta

SEQ ID NO: 181380 - DNA, 15 bp, Homo sapiens
cgtaaaatagagttt

SEQ ID NO: 181381 - DNA, 15 bp, Homo sapiens
acgtaaaatagagtt

SEQ ID NO: 181382 - DNA, 15 bp, Homo sapiens
gacgtaaaatagagt

SEQ ID NO: 181383 - DNA, 15 bp, Homo sapiens
agacgtaaaatagag

SEQ ID NO: 181384 - DNA, 15 bp, Homo sapiens
aagacgtaaaataga

SEQ ID NO: 181385 - DNA, 15 bp, Homo sapiens
gaagacgtaaaatag

SEQ ID NO: 181386 - DNA, 15 bp, Homo sapiens
ggaagacgtaaaata

SEQ ID NO: 181387 - DNA, 15 bp, Homo sapiens
aggaagacgtaaaat

SEQ ID NO: 181388 - DNA, 15 bp, Homo sapiens
taggaagacgtaaaa

SEQ ID NO: 181389 - DNA, 15 bp, Homo sapiens
ttaggaagacgtaaa

SEQ ID NO: 181390 - DNA, 15 bp, Homo sapiens
tttaggaagacgtaa

SEQ ID NO: 181391 - DNA, 15 bp, Homo sapiens
gtttaggaagacgta

SEQ ID NO: 181392 - DNA, 15 bp, Homo sapiens
agtttaggaagacgt

SEQ ID NO: 181393 - DNA, 15 bp, Homo sapiens
cagtttaggaagacg

SEQ ID NO: 181394 - DNA, 15 bp, Homo sapiens
tcagtttaggaagac

SEQ ID NO: 181395 - DNA, 15 bp, Homo sapiens
atcagtttaggaaga

SEQ ID NO: 181396 - DNA, 15 bp, Homo sapiens
tatcagtttaggaag

SEQ ID NO: 181397 - DNA, 15 bp, Homo sapiens
atatcagtttaggaa

SEQ ID NO: 181398 - DNA, 15 bp, Homo sapiens
gatatcagtttagga

SEQ ID NO: 181399 - DNA, 15 bp, Homo sapiens
cgatatcagtttagg

SEQ ID NO: 181400 - DNA, 15 bp, Homo sapiens
acgatatcagtttag

SEQ ID NO: 181401 - DNA, 15 bp, Homo sapiens
tacgatatcagttta

SEQ ID NO: 181402 - DNA, 15 bp, Homo sapiens
gtacgatatcagttt

SEQ ID NO: 181403 - DNA, 15 bp, Homo sapiens
tgtacgatatcagtt

SEQ ID NO: 181404 - DNA, 15 bp, Homo sapiens
atgtacgatatcagt

SEQ ID NO: 181405 - DNA, 15 bp, Homo sapiens
aatgtacgatatcag

SEQ ID NO: 181406 - DNA, 15 bp, Homo sapiens
gaatgtacgatatca

SEQ ID NO: 181407 - DNA, 15 bp, Homo sapiens
tgaatgtacgatatc

SEQ ID NO: 181408 - DNA, 15 bp, Homo sapiens
ttgaatgtacgatat

SEQ ID NO: 181409 - DNA, 15 bp, Homo sapiens
attgaatgtacgata

SEQ ID NO: 181410 - DNA, 15 bp, Homo sapiens
aattgaatgtacgat

SEQ ID NO: 181411 - DNA, 15 bp, Homo sapiens
aaattgaatgtacga

SEQ ID NO: 181412 - DNA, 15 bp, Homo sapiens
taaattgaatgtacg

SEQ ID NO: 181413 - DNA, 15 bp, Homo sapiens
ataaattgaatgtac

SEQ ID NO: 181414 - DNA, 15 bp, Homo sapiens
tataaattgaatgta

SEQ ID NO: 181415 - DNA, 15 bp, Homo sapiens
atataaattgaatgt

SEQ ID NO: 181416 - DNA, 15 bp, Homo sapiens
tatataaattgaatg

SEQ ID NO: 181417 - DNA, 15 bp, Homo sapiens
atatataaattgaat

SEQ ID NO: 181418 - DNA, 15 bp, Homo sapiens
aatatataaattgaa

SEQ ID NO: 181419 - DNA, 15 bp, Homo sapiens
aaatatataaattga

SEQ ID NO: 181420 - DNA, 15 bp, Homo sapiens
gaaatatataaattg

SEQ ID NO: 181421 - DNA, 15 bp, Homo sapiens
agaaatatataaatt

SEQ ID NO: 181422 - DNA, 15 bp, Homo sapiens
cagaaatatataaat

SEQ ID NO: 181423 - DNA, 15 bp, Homo sapiens
acagaaatatataaa

SEQ ID NO: 181424 - DNA, 15 bp, Homo sapiens
tacagaaatatataa

SEQ ID NO: 181425 - DNA, 15 bp, Homo sapiens
gtacagaaatatata

SEQ ID NO: 181426 - DNA, 15 bp, Homo sapiens
agtacagaaatatat

SEQ ID NO: 181427 - DNA, 15 bp, Homo sapiens
tagtacagaaatata

SEQ ID NO: 181428 - DNA, 15 bp, Homo sapiens
ttagtacagaaatat

SEQ ID NO: 181429 - DNA, 15 bp, Homo sapiens
cttagtacagaaata

SEQ ID NO: 181430 - DNA, 15 bp, Homo sapiens
tcttagtacagaaat

SEQ ID NO: 181431 - DNA, 15 bp, Homo sapiens
atcttagtacagaaa

SEQ ID NO: 181432 - DNA, 15 bp, Homo sapiens
gatcttagtacagaa

SEQ ID NO: 181433 - DNA, 15 bp, Homo sapiens
tgatcttagtacaga

SEQ ID NO: 181434 - DNA, 15 bp, Homo sapiens
atgatcttagtacag

SEQ ID NO: 181435 - DNA, 15 bp, Homo sapiens
catgatcttagtaca

SEQ ID NO: 181436 - DNA, 15 bp, Homo sapiens
tcatgatcttagtac

SEQ ID NO: 181437 - DNA, 15 bp, Homo sapiens
ttcatgatcttagta

SEQ ID NO: 181438 - DNA, 15 bp, Homo sapiens
attcatgatcttagt

SEQ ID NO: 181439 - DNA, 15 bp, Homo sapiens
aattcatgatcttag

SEQ ID NO: 181440 - DNA, 15 bp, Homo sapiens
aaattcatgatctta

SEQ ID NO: 181441 - DNA, 15 bp, Homo sapiens
taaattcatgatctt

SEQ ID NO: 181442 - DNA, 15 bp, Homo sapiens
ctaaattcatgatct

SEQ ID NO: 181443 - DNA, 15 bp, Homo sapiens
tctaaattcatgatc

SEQ ID NO: 181444 - DNA, 15 bp, Homo sapiens
ctctaaattcatgat

SEQ ID NO: 181445 - DNA, 15 bp, Homo sapiens
actctaaattcatga

SEQ ID NO: 181446 - DNA, 15 bp, Homo sapiens
aactctaaattcatg

SEQ ID NO: 181447 - DNA, 15 bp, Homo sapiens
aaactctaaattcat

SEQ ID NO: 181448 - DNA, 15 bp, Homo sapiens
taaactctaaattca

SEQ ID NO: 181449 - DNA, 15 bp, Homo sapiens
ataaactctaaattc

SEQ ID NO: 181450 - DNA, 15 bp, Homo sapiens
aataaactctaaatt

SEQ ID NO: 181451 - DNA, 15 bp, Homo sapiens
caataaactctaaat

SEQ ID NO: 181452 - DNA, 15 bp, Homo sapiens
tcaataaactctaaa

SEQ ID NO: 181453 - DNA, 15 bp, Homo sapiens
ctcaataaactctaa

SEQ ID NO: 181454 - DNA, 15 bp, Homo sapiens
tctcaataaactcta

SEQ ID NO: 181455 - DNA, 15 bp, Homo sapiens
ttctcaataaactct

SEQ ID NO: 181456 - DNA, 15 bp, Homo sapiens
tttctcaataaactc

SEQ ID NO: 181457 - DNA, 15 bp, Homo sapiens
atttctcaataaact

SEQ ID NO: 181458 - DNA, 15 bp, Homo sapiens
aatttctcaataaac

SEQ ID NO: 181459 - DNA, 15 bp, Homo sapiens
caatttctcaataaa

SEQ ID NO: 181460 - DNA, 15 bp, Homo sapiens
gcaatttctcaataa

SEQ ID NO: 181461 - DNA, 15 bp, Homo sapiens
ggcaatttctcaata

SEQ ID NO: 181462 - DNA, 15 bp, Homo sapiens
tggcaatttctcaat

SEQ ID NO: 181463 - DNA, 15 bp, Homo sapiens
ctggcaatttctcaa

SEQ ID NO: 181464 - DNA, 15 bp, Homo sapiens
tctggcaatttctca

SEQ ID NO: 181465 - DNA, 15 bp, Homo sapiens
ttctggcaatttctc

SEQ ID NO: 181466 - DNA, 15 bp, Homo sapiens
tttctggcaatttct

SEQ ID NO: 181467 - DNA, 15 bp, Homo sapiens
ttttctggcaatttc

SEQ ID NO: 181468 - DNA, 15 bp, Homo sapiens
tttttctggcaattt

SEQ ID NO: 181469 - DNA, 15 bp, Homo sapiens
ttttttctggcaatt

SEQ ID NO: 181470 - DNA, 15 bp, Homo sapiens
tttttttctggcaat

SEQ ID NO: 181471 - DNA, 15 bp, Homo sapiens
atttttttctggcaa

SEQ ID NO: 181472 - DNA, 15 bp, Homo sapiens
catttttttctggca

SEQ ID NO: 181473 - DNA, 15 bp, Homo sapiens
acatttttttctggc

SEQ ID NO: 181474 - DNA, 15 bp, Homo sapiens
cacatttttttctgg

SEQ ID NO: 181475 - DNA, 15 bp, Homo sapiens
acacatttttttctg

SEQ ID NO: 181476 - DNA, 15 bp, Homo sapiens
aacacatttttttct

SEQ ID NO: 181477 - DNA, 15 bp, Homo sapiens
taacacatttttttc

SEQ ID NO: 181478 - DNA, 15 bp, Homo sapiens
ttaacacattttttt

SEQ ID NO: 181479 - DNA, 15 bp, Homo sapiens
cttaacacatttttt

SEQ ID NO: 181480 - DNA, 15 bp, Homo sapiens
acttaacacattttt

SEQ ID NO: 181481 - DNA, 15 bp, Homo sapiens
aacttaacacatttt

SEQ ID NO: 181482 - DNA, 15 bp, Homo sapiens
aaacttaacacattt

SEQ ID NO: 181483 - DNA, 15 bp, Homo sapiens
aaaacttaacacatt

SEQ ID NO: 181484 - DNA, 15 bp, Homo sapiens
aaaaacttaacacat

SEQ ID NO: 181485 - DNA, 15 bp, Homo sapiens
taaaaacttaacaca

SEQ ID NO: 181486 - DNA, 15 bp, Homo sapiens
ataaaaacttaacac

SEQ ID NO: 181487 - DNA, 15 bp, Homo sapiens
gataaaaacttaaca

SEQ ID NO: 181488 - DNA, 15 bp, Homo sapiens
ggataaaaacttaac

SEQ ID NO: 181489 - DNA, 15 bp, Homo sapiens
gggataaaaacttaa

SEQ ID NO: 181490 - DNA, 15 bp, Homo sapiens
agggataaaaactta

SEQ ID NO: 181491 - DNA, 15 bp, Homo sapiens
aagggataaaaactt

SEQ ID NO: 181492 - DNA, 15 bp, Homo sapiens
taagggataaaaact

SEQ ID NO: 181493 - DNA, 15 bp, Homo sapiens
ttaagggataaaaac

SEQ ID NO: 181494 - DNA, 15 bp, Homo sapiens
tttaagggataaaaa

SEQ ID NO: 181495 - DNA, 15 bp, Homo sapiens
ctttaagggataaaa

SEQ ID NO: 181496 - DNA, 15 bp, Homo sapiens
tctttaagggataaa

SEQ ID NO: 181497 - DNA, 15 bp, Homo sapiens
ctctttaagggataa

SEQ ID NO: 181498 - DNA, 15 bp, Homo sapiens
actctttaagggata

SEQ ID NO: 181499 - DNA, 15 bp, Homo sapiens
tactctttaagggat

SEQ ID NO: 181500 - DNA, 15 bp, Homo sapiens
atactctttaaggga

SEQ ID NO: 181501 - DNA, 15 bp, Homo sapiens
gatactctttaaggg

SEQ ID NO: 181502 - DNA, 15 bp, Homo sapiens
agatactctttaagg

SEQ ID NO: 181503 - DNA, 15 bp, Homo sapiens
gagatactctttaag

SEQ ID NO: 181504 - DNA, 15 bp, Homo sapiens
tgagatactctttaa

SEQ ID NO: 181505 - DNA, 15 bp, Homo sapiens
atgagatactcttta

SEQ ID NO: 181506 - DNA, 15 bp, Homo sapiens
tatgagatactcttt

SEQ ID NO: 181507 - DNA, 15 bp, Homo sapiens
ttatgagatactctt

SEQ ID NO: 181508 - DNA, 15 bp, Homo sapiens
gttatgagatactct

SEQ ID NO: 181509 - DNA, 15 bp, Homo sapiens
agttatgagatactc

SEQ ID NO: 181510 - DNA, 15 bp, Homo sapiens
aagttatgagatact

SEQ ID NO: 181511 - DNA, 15 bp, Homo sapiens
taagttatgagatac

SEQ ID NO: 181512 - DNA, 15 bp, Homo sapiens
gtaagttatgagata

SEQ ID NO: 181513 - DNA, 15 bp, Homo sapiens
tgtaagttatgagat

SEQ ID NO: 181514 - DNA, 15 bp, Homo sapiens
ctgtaagttatgaga

SEQ ID NO: 181515 - DNA, 15 bp, Homo sapiens
tctgtaagttatgag

SEQ ID NO: 181516 - DNA, 15 bp, Homo sapiens
atctgtaagttatga

SEQ ID NO: 181517 - DNA, 15 bp, Homo sapiens
aatctgtaagttatg

SEQ ID NO: 181518 - DNA, 15 bp, Homo sapiens
aaatctgtaagttat

SEQ ID NO: 181519 - DNA, 15 bp, Homo sapiens
caaatctgtaagtta

SEQ ID NO: 181520 - DNA, 15 bp, Homo sapiens
tcaaatctgtaagtt

SEQ ID NO: 181521 - DNA, 15 bp, Homo sapiens
ctcaaatctgtaagt

SEQ ID NO: 181522 - DNA, 15 bp, Homo sapiens
gctcaaatctgtaag

SEQ ID NO: 181523 - DNA, 15 bp, Homo sapiens
tgctcaaatctgtaa

SEQ ID NO: 181524 - DNA, 15 bp, Homo sapiens
ctgctcaaatctgta

SEQ ID NO: 181525 - DNA, 15 bp, Homo sapiens
cctgctcaaatctgt

SEQ ID NO: 181526 - DNA, 15 bp, Homo sapiens
ccctgctcaaatctg

SEQ ID NO: 181527 - DNA, 15 bp, Homo sapiens
tccctgctcaaatct

SEQ ID NO: 181528 - DNA, 15 bp, Homo sapiens
ctccctgctcaaatc

SEQ ID NO: 181529 - DNA, 15 bp, Homo sapiens
cctccctgctcaaat

SEQ ID NO: 181530 - DNA, 15 bp, Homo sapiens
acctccctgctcaaa

SEQ ID NO: 181531 - DNA, 15 bp, Homo sapiens
tacctccctgctcaa

SEQ ID NO: 181532 - DNA, 15 bp, Homo sapiens
atacctccctgctca

SEQ ID NO: 181533 - DNA, 15 bp, Homo sapiens
tatacctccctgctc

SEQ ID NO: 181534 - DNA, 15 bp, Homo sapiens
atatacctccctgct

SEQ ID NO: 181535 - DNA, 15 bp, Homo sapiens
tatatacctccctgc

SEQ ID NO: 181536 - DNA, 15 bp, Homo sapiens
ttatatacctccctg

SEQ ID NO: 181537 - DNA, 15 bp, Homo sapiens
attatatacctccct

SEQ ID NO: 181538 - DNA, 15 bp, Homo sapiens
gattatatacctccc

SEQ ID NO: 181539 - DNA, 15 bp, Homo sapiens
tgattatatacctcc

SEQ ID NO: 181540 - DNA, 15 bp, Homo sapiens
ctgattatatacctc

SEQ ID NO: 181541 - DNA, 15 bp, Homo sapiens
cctgattatatacct

SEQ ID NO: 181542 - DNA, 15 bp, Homo sapiens
tcctgattatatacc

SEQ ID NO: 181543 - DNA, 15 bp, Homo sapiens
ctcctgattatatac

SEQ ID NO: 181544 - DNA, 15 bp, Homo sapiens
actcctgattatata

SEQ ID NO: 181545 - DNA, 15 bp, Homo sapiens
tactcctgattatat

SEQ ID NO: 181546 - DNA, 15 bp, Homo sapiens
gtactcctgattata

SEQ ID NO: 181547 - DNA, 15 bp, Homo sapiens
tgtactcctgattat

SEQ ID NO: 181548 - DNA, 15 bp, Homo sapiens
ctgtactcctgatta

SEQ ID NO: 181549 - DNA, 15 bp, Homo sapiens
actgtactcctgatt

SEQ ID NO: 181550 - DNA, 15 bp, Homo sapiens
aactgtactcctgat

SEQ ID NO: 181551 - DNA, 15 bp, Homo sapiens
aaactgtactcctga

SEQ ID NO: 181552 - DNA, 15 bp, Homo sapiens
taaactgtactcctg

SEQ ID NO: 181553 - DNA, 15 bp, Homo sapiens
ataaactgtactcct

SEQ ID NO: 181554 - DNA, 15 bp, Homo sapiens
cataaactgtactcc

SEQ ID NO: 181555 - DNA, 15 bp, Homo sapiens
acataaactgtactc

SEQ ID NO: 181556 - DNA, 15 bp, Homo sapiens
aacataaactgtact

SEQ ID NO: 181557 - DNA, 15 bp, Homo sapiens
aaacataaactgtac

SEQ ID NO: 181558 - DNA, 15 bp, Homo sapiens
caaacataaactgta

SEQ ID NO: 181559 - DNA, 15 bp, Homo sapiens
acaaacataaactgt

SEQ ID NO: 181560 - DNA, 15 bp, Homo sapiens
aacaaacataaactg

SEQ ID NO: 181561 - DNA, 15 bp, Homo sapiens
aaacaaacataaact

SEQ ID NO: 181562 - DNA, 15 bp, Homo sapiens
taaacaaacataaac

SEQ ID NO: 181563 - DNA, 15 bp, Homo sapiens
ataaacaaacataaa

SEQ ID NO: 181564 - DNA, 15 bp, Homo sapiens
aataaacaaacataa

SEQ ID NO: 181565 - DNA, 15 bp, Homo sapiens
gaataaacaaacata

SEQ ID NO: 181566 - DNA, 15 bp, Homo sapiens
tgaataaacaaacat

SEQ ID NO: 181567 - DNA, 15 bp, Homo sapiens
ttgaataaacaaaca

SEQ ID NO: 181568 - DNA, 15 bp, Homo sapiens
tttgaataaacaaac

SEQ ID NO: 181569 - DNA, 15 bp, Homo sapiens
ctttgaataaacaaa

SEQ ID NO: 181570 - DNA, 15 bp, Homo sapiens
gctttgaataaacaa

SEQ ID NO: 181571 - DNA, 15 bp, Homo sapiens
agctttgaataaaca

SEQ ID NO: 181572 - DNA, 15 bp, Homo sapiens
gagctttgaataaac

SEQ ID NO: 181573 - DNA, 15 bp, Homo sapiens
agagctttgaataaa

SEQ ID NO: 181574 - DNA, 15 bp, Homo sapiens
cagagctttgaataa

SEQ ID NO: 181575 - DNA, 15 bp, Homo sapiens
tcagagctttgaata

SEQ ID NO: 181576 - DNA, 15 bp, Homo sapiens
atcagagctttgaat

SEQ ID NO: 181577 - DNA, 15 bp, Homo sapiens
gatcagagctttgaa

SEQ ID NO: 181578 - DNA, 15 bp, Homo sapiens
agatcagagctttga

SEQ ID NO: 181579 - DNA, 15 bp, Homo sapiens
gagatcagagctttg

SEQ ID NO: 181580 - DNA, 15 bp, Homo sapiens
tgagatcagagcttt

SEQ ID NO: 181581 - DNA, 15 bp, Homo sapiens
atgagatcagagctt

SEQ ID NO: 181582 - DNA, 15 bp, Homo sapiens
catgagatcagagct

SEQ ID NO: 181583 - DNA, 15 bp, Homo sapiens
tcatgagatcagagc

SEQ ID NO: 181584 - DNA, 15 bp, Homo sapiens
ttcatgagatcagag

SEQ ID NO: 181585 - DNA, 15 bp, Homo sapiens
tttcatgagatcaga

SEQ ID NO: 181586 - DNA, 15 bp, Homo sapiens
ttttcatgagatcag

SEQ ID NO: 181587 - DNA, 15 bp, Homo sapiens
attttcatgagatca

SEQ ID NO: 181588 - DNA, 15 bp, Homo sapiens
aattttcatgagatc

SEQ ID NO: 181589 - DNA, 15 bp, Homo sapiens
caattttcatgagat

SEQ ID NO: 181590 - DNA, 15 bp, Homo sapiens
gcaattttcatgaga

SEQ ID NO: 181591 - DNA, 15 bp, Homo sapiens
agcaattttcatgag

SEQ ID NO: 181592 - DNA, 15 bp, Homo sapiens
tagcaattttcatga

SEQ ID NO: 181593 - DNA, 15 bp, Homo sapiens
atagcaattttcatg

SEQ ID NO: 181594 - DNA, 15 bp, Homo sapiens
tatagcaattttcat

SEQ ID NO: 181595 - DNA, 15 bp, Homo sapiens
atatagcaattttca

SEQ ID NO: 181596 - DNA, 15 bp, Homo sapiens
tatatagcaattttc

SEQ ID NO: 181597 - DNA, 15 bp, Homo sapiens
ttatatagcaatttt

SEQ ID NO: 181598 - DNA, 15 bp, Homo sapiens
tttatatagcaattt

SEQ ID NO: 181599 - DNA, 15 bp, Homo sapiens
atttatatagcaatt

SEQ ID NO: 181600 - DNA, 15 bp, Homo sapiens
catttatatagcaat

SEQ ID NO: 181601 - DNA, 15 bp, Homo sapiens
gcatttatatagcaa

SEQ ID NO: 181602 - DNA, 15 bp, Homo sapiens
agcatttatatagca

SEQ ID NO: 181603 - DNA, 15 bp, Homo sapiens
aagcatttatatagc

SEQ ID NO: 181604 - DNA, 15 bp, Homo sapiens
caagcatttatatag

SEQ ID NO: 181605 - DNA, 15 bp, Homo sapiens
acaagcatttatata

SEQ ID NO: 181606 - DNA, 15 bp, Homo sapiens
aacaagcatttatat

SEQ ID NO: 181607 - DNA, 15 bp, Homo sapiens
aaacaagcatttata

SEQ ID NO: 181608 - DNA, 15 bp, Homo sapiens
aaaacaagcatttat

SEQ ID NO: 181609 - DNA, 15 bp, Homo sapiens
taaaacaagcattta

SEQ ID NO: 181610 - DNA, 15 bp, Homo sapiens
ttaaaacaagcattt

SEQ ID NO: 181611 - DNA, 15 bp, Homo sapiens
gttaaaacaagcatt

SEQ ID NO: 181612 - DNA, 15 bp, Homo sapiens
tgttaaaacaagcat

SEQ ID NO: 181613 - DNA, 15 bp, Homo sapiens
ttgttaaaacaagca

SEQ ID NO: 181614 - DNA, 15 bp, Homo sapiens
gttgttaaaacaagc

SEQ ID NO: 181615 - DNA, 15 bp, Homo sapiens
agttgttaaaacaag

SEQ ID NO: 181616 - DNA, 15 bp, Homo sapiens
cagttgttaaaacaa

SEQ ID NO: 181617 - DNA, 15 bp, Homo sapiens
acagttgttaaaaca

SEQ ID NO: 181618 - DNA, 15 bp, Homo sapiens
aacagttgttaaaac

SEQ ID NO: 181619 - DNA, 15 bp, Homo sapiens
taacagttgttaaaa

SEQ ID NO: 181620 - DNA, 15 bp, Homo sapiens
ataacagttgttaaa

SEQ ID NO: 181621 - DNA, 15 bp, Homo sapiens
aataacagttgttaa

SEQ ID NO: 181622 - DNA, 15 bp, Homo sapiens
taataacagttgtta

SEQ ID NO: 181623 - DNA, 15 bp, Homo sapiens
ataataacagttgtt

SEQ ID NO: 181624 - DNA, 15 bp, Homo sapiens
aataataacagttgt

SEQ ID NO: 181625 - DNA, 15 bp, Homo sapiens
taataataacagttg

SEQ ID NO: 181626 - DNA, 15 bp, Homo sapiens
ctaataataacagtt

SEQ ID NO: 181627 - DNA, 15 bp, Homo sapiens
cctaataataacagt

SEQ ID NO: 181628 - DNA, 15 bp, Homo sapiens
ccctaataataacag

SEQ ID NO: 181629 - DNA, 15 bp, Homo sapiens
cccctaataataaca

SEQ ID NO: 181630 - DNA, 15 bp, Homo sapiens
acccctaataataac

SEQ ID NO: 181631 - DNA, 15 bp, Homo sapiens
aacccctaataataa

SEQ ID NO: 181632 - DNA, 15 bp, Homo sapiens
aaacccctaataata

SEQ ID NO: 181633 - DNA, 15 bp, Homo sapiens
caaacccctaataat

SEQ ID NO: 181634 - DNA, 15 bp, Homo sapiens
acaaacccctaataa

SEQ ID NO: 181635 - DNA, 15 bp, Homo sapiens
tacaaacccctaata

SEQ ID NO: 181636 - DNA, 15 bp, Homo sapiens
atacaaacccctaat

SEQ ID NO: 181637 - DNA, 15 bp, Homo sapiens
catacaaacccctaa

SEQ ID NO: 181638 - DNA, 15 bp, Homo sapiens
tcatacaaaccccta

SEQ ID NO: 181639 - DNA, 15 bp, Homo sapiens
ttcatacaaacccct

SEQ ID NO: 181640 - DNA, 15 bp, Homo sapiens
tttcatacaaacccc

SEQ ID NO: 181641 - DNA, 15 bp, Homo sapiens
ctttcatacaaaccc

SEQ ID NO: 181642 - DNA, 15 bp, Homo sapiens
actttcatacaaacc

SEQ ID NO: 181643 - DNA, 15 bp, Homo sapiens
gactttcatacaaac

SEQ ID NO: 181644 - DNA, 15 bp, Homo sapiens
agactttcatacaaa

SEQ ID NO: 181645 - DNA, 15 bp, Homo sapiens
cagactttcatacaa

SEQ ID NO: 181646 - DNA, 15 bp, Homo sapiens
gcagactttcataca

SEQ ID NO: 181647 - DNA, 15 bp, Homo sapiens
ggcagactttcatac

SEQ ID NO: 181648 - DNA, 15 bp, Homo sapiens
tggcagactttcata

SEQ ID NO: 181649 - DNA, 15 bp, Homo sapiens
ttggcagactttcat

SEQ ID NO: 181650 - DNA, 15 bp, Homo sapiens
gttggcagactttca

SEQ ID NO: 181651 - DNA, 15 bp, Homo sapiens
agttggcagactttc

SEQ ID NO: 181652 - DNA, 15 bp, Homo sapiens
aagttggcagacttt

SEQ ID NO: 181653 - DNA, 15 bp, Homo sapiens
caagttggcagactt

SEQ ID NO: 181654 - DNA, 15 bp, Homo sapiens
ccaagttggcagact

SEQ ID NO: 181655 - DNA, 15 bp, Homo sapiens
accaagttggcagac

SEQ ID NO: 181656 - DNA, 15 bp, Homo sapiens
gaccaagttggcaga

SEQ ID NO: 181657 - DNA, 15 bp, Homo sapiens
ggaccaagttggcag

SEQ ID NO: 181658 - DNA, 15 bp, Homo sapiens
gggaccaagttggca

SEQ ID NO: 181659 - DNA, 15 bp, Homo sapiens
tgggaccaagttggc

SEQ ID NO: 181660 - DNA, 15 bp, Homo sapiens
ttgggaccaagttgg

SEQ ID NO: 181661 - DNA, 15 bp, Homo sapiens
attgggaccaagttg

SEQ ID NO: 181662 - DNA, 15 bp, Homo sapiens
tattgggaccaagtt

SEQ ID NO: 181663 - DNA, 15 bp, Homo sapiens
atattgggaccaagt

SEQ ID NO: 181664 - DNA, 15 bp, Homo sapiens
aatattgggaccaag

SEQ ID NO: 181665 - DNA, 15 bp, Homo sapiens
aaatattgggaccaa

SEQ ID NO: 181666 - DNA, 15 bp, Homo sapiens
taaatattgggacca

SEQ ID NO: 181667 - DNA, 15 bp, Homo sapiens
ataaatattgggacc

SEQ ID NO: 181668 - DNA, 15 bp, Homo sapiens
atataaatattggga

SEQ ID NO: 181669 - DNA, 15 bp, Homo sapiens
aatataaatattggg

SEQ ID NO: 181670 - DNA, 15 bp, Homo sapiens
taatataaatattgg

SEQ ID NO: 181671 - DNA, 15 bp, Homo sapiens
ataatataaatattg

SEQ ID NO: 181672 - DNA, 15 bp, Homo sapiens
tataatataaatatt

SEQ ID NO: 181673 - DNA, 15 bp, Homo sapiens
ttataatataaatat

SEQ ID NO: 181674 - DNA, 15 bp, Homo sapiens
tttataatataaata

SEQ ID NO: 181675 - DNA, 15 bp, Homo sapiens
atttataatataaat

SEQ ID NO: 181676 - DNA, 15 bp, Homo sapiens
aatttataatataaa

SEQ ID NO: 181677 - DNA, 15 bp, Homo sapiens
taatttataatataa

SEQ ID NO: 181678 - DNA, 15 bp, Homo sapiens
ttaatttataatata

SEQ ID NO: 181679 - DNA, 15 bp, Homo sapiens
tttaatttataatat

SEQ ID NO: 181680 - DNA, 15 bp, Homo sapiens
ttttaatttataata

SEQ ID NO: 181681 - DNA, 15 bp, Homo sapiens
attttaatttataat

SEQ ID NO: 181682 - DNA, 15 bp, Homo sapiens
cattttaatttataa

SEQ ID NO: 181683 - DNA, 15 bp, Homo sapiens
acattttaatttata

SEQ ID NO: 181684 - DNA, 15 bp, Homo sapiens
aacattttaatttat

SEQ ID NO: 181685 - DNA, 15 bp, Homo sapiens
caaaacattttaatt

SEQ ID NO: 181686 - DNA, 15 bp, Homo sapiens
tcaaaacattttaat

SEQ ID NO: 181687 - DNA, 15 bp, Homo sapiens
ttcaaaacattttaa

SEQ ID NO: 181688 - DNA, 15 bp, Homo sapiens
tttcaaaacatttta

SEQ ID NO: 181689 - DNA, 15 bp, Homo sapiens
ttttcaaaacatttt

SEQ ID NO: 181690 - DNA, 15 bp, Homo sapiens
cttttcaaaacattt

SEQ ID NO: 181691 - DNA, 15 bp, Homo sapiens
tcttttcaaaacatt

SEQ ID NO: 181692 - DNA, 15 bp, Homo sapiens
ttcttttcaaaacat

SEQ ID NO: 181693 - DNA, 15 bp, Homo sapiens
gttcttttcaaaaca

SEQ ID NO: 181694 - DNA, 15 bp, Homo sapiens
agttcttttcaaaac

SEQ ID NO: 181695 - DNA, 15 bp, Homo sapiens
cagttcttttcaaaa

SEQ ID NO: 181696 - DNA, 15 bp, Homo sapiens
gcagttcttttcaaa

SEQ ID NO: 181697 - DNA, 15 bp, Homo sapiens
agcagttcttttcaa

SEQ ID NO: 181698 - DNA, 15 bp, Homo sapiens
aagcagttcttttca

SEQ ID NO: 181699 - DNA, 15 bp, Homo sapiens
gaagcagttcttttc

SEQ ID NO: 181700 - DNA, 15 bp, Homo sapiens
agaagcagttctttt

SEQ ID NO: 181701 - DNA, 15 bp, Homo sapiens
gagaagcagttcttt

SEQ ID NO: 181702 - DNA, 15 bp, Homo sapiens
tgagaagcagttctt

SEQ ID NO: 181703 - DNA, 15 bp, Homo sapiens
ttgagaagcagttct

SEQ ID NO: 181704 - DNA, 15 bp, Homo sapiens
gttgagaagcagttc

SEQ ID NO: 181705 - DNA, 15 bp, Homo sapiens
agttgagaagcagtt

SEQ ID NO: 181706 - DNA, 15 bp, Homo sapiens
cagttgagaagcagt

SEQ ID NO: 181707 - DNA, 15 bp, Homo sapiens
acagttgagaagcag

SEQ ID NO: 181708 - DNA, 15 bp, Homo sapiens
cacagttgagaagca

SEQ ID NO: 181709 - DNA, 15 bp, Homo sapiens
tcacagttgagaagc

SEQ ID NO: 181710 - DNA, 15 bp, Homo sapiens
atcacagttgagaag

SEQ ID NO: 181711 - DNA, 15 bp, Homo sapiens
gatcacagttgagaa

SEQ ID NO: 181712 - DNA, 15 bp, Homo sapiens
ggatcacagttgaga

SEQ ID NO: 181713 - DNA, 15 bp, Homo sapiens
aggatcacagttgag

SEQ ID NO: 181714 - DNA, 15 bp, Homo sapiens
gaggatcacagttga

SEQ ID NO: 181715 - DNA, 15 bp, Homo sapiens
tgaggatcacagttg

SEQ ID NO: 181716 - DNA, 15 bp, Homo sapiens
atgaggatcacagtt

SEQ ID NO: 181717 - DNA, 15 bp, Homo sapiens
aatgaggatcacagt

SEQ ID NO: 181718 - DNA, 15 bp, Homo sapiens
caatgaggatcacag

SEQ ID NO: 181719 - DNA, 15 bp, Homo sapiens
acaatgaggatcaca

SEQ ID NO: 181720 - DNA, 15 bp, Homo sapiens
aacaatgaggatcac

SEQ ID NO: 181721 - DNA, 15 bp, Homo sapiens
aaacaatgaggatca

SEQ ID NO: 181722 - DNA, 15 bp, Homo sapiens
aaaacaatgaggatc

SEQ ID NO: 181723 - DNA, 15 bp, Homo sapiens
aaaaacaatgaggat

SEQ ID NO: 181724 - DNA, 15 bp, Homo sapiens
caaaaacaatgagga

SEQ ID NO: 181725 - DNA, 15 bp, Homo sapiens
tcaaaaacaatgagg

SEQ ID NO: 181726 - DNA, 15 bp, Homo sapiens
ttcaaaaacaatgag

SEQ ID NO: 181727 - DNA, 15 bp, Homo sapiens
tttcaaaaacaatga

SEQ ID NO: 181728 - DNA, 15 bp, Homo sapiens
gtttcaaaaacaatg

SEQ ID NO: 181729 - DNA, 15 bp, Homo sapiens
ggtttcaaaaacaat

SEQ ID NO: 181730 - DNA, 15 bp, Homo sapiens
aggtttcaaaaacaa

SEQ ID NO: 181731 - DNA, 15 bp, Homo sapiens
taggtttcaaaaaca

SEQ ID NO: 181732 - DNA, 15 bp, Homo sapiens
ttaggtttcaaaaac

SEQ ID NO: 181733 - DNA, 15 bp, Homo sapiens
tttaggtttcaaaaa

SEQ ID NO: 181734 - DNA, 15 bp, Homo sapiens
ttttaggtttcaaaa

SEQ ID NO: 181735 - DNA, 15 bp, Homo sapiens
attttaggtttcaaa

SEQ ID NO: 181736 - DNA, 15 bp, Homo sapiens
tattttaggtttcaa

SEQ ID NO: 181737 - DNA, 15 bp, Homo sapiens
atattttaggtttca

SEQ ID NO: 181738 - DNA, 15 bp, Homo sapiens
tatattttaggtttc

SEQ ID NO: 181739 - DNA, 15 bp, Homo sapiens
gtatattttaggttt

SEQ ID NO: 181740 - DNA, 15 bp, Homo sapiens
agtatattttaggtt

SEQ ID NO: 181741 - DNA, 15 bp, Homo sapiens
tagtatattttaggt

SEQ ID NO: 181742 - DNA, 15 bp, Homo sapiens
ttagtatattttagg

SEQ ID NO: 181743 - DNA, 15 bp, Homo sapiens
attagtatattttag

SEQ ID NO: 181744 - DNA, 15 bp, Homo sapiens
aattagtatatttta

SEQ ID NO: 181745 - DNA, 15 bp, Homo sapiens
aaattagtatatttt

SEQ ID NO: 181746 - DNA, 15 bp, Homo sapiens
aaaattagtatattt

SEQ ID NO: 181747 - DNA, 15 bp, Homo sapiens
aaaaattagtatatt

SEQ ID NO: 181748 - DNA, 15 bp, Homo sapiens
taaaaattagtatat

SEQ ID NO: 181749 - DNA, 15 bp, Homo sapiens
ttaaaaattagtata

SEQ ID NO: 181750 - DNA, 15 bp, Homo sapiens
attaaaaattagtat

SEQ ID NO: 181751 - DNA, 15 bp, Homo sapiens
aattaaaaattagta

SEQ ID NO: 181752 - DNA, 15 bp, Homo sapiens
aaattaaaaattagt

SEQ ID NO: 181753 - DNA, 15 bp, Homo sapiens
aaaattaaaaattag

SEQ ID NO: 181754 - DNA, 15 bp, Homo sapiens
aaaaattaaaaatta

SEQ ID NO: 181755 - DNA, 15 bp, Homo sapiens
caaaaattaaaaatt

SEQ ID NO: 181756 - DNA, 15 bp, Homo sapiens
acaaaaattaaaaat

SEQ ID NO: 181757 - DNA, 15 bp, Homo sapiens
tacaaaaattaaaaa

SEQ ID NO: 181758 - DNA, 15 bp, Homo sapiens
ctacaaaaattaaaa

SEQ ID NO: 181759 - DNA, 15 bp, Homo sapiens
actacaaaaattaaa

SEQ ID NO: 181760 - DNA, 15 bp, Homo sapiens
aactacaaaaattaa

SEQ ID NO: 181761 - DNA, 15 bp, Homo sapiens
caactacaaaaatta

SEQ ID NO: 181762 - DNA, 15 bp, Homo sapiens
tcaactacaaaaatt

SEQ ID NO: 181763 - DNA, 15 bp, Homo sapiens
ttcaactacaaaaat

SEQ ID NO: 181764 - DNA, 15 bp, Homo sapiens
tttcaactacaaaaa

SEQ ID NO: 181765 - DNA, 15 bp, Homo sapiens
atttcaactacaaaa

SEQ ID NO: 181766 - DNA, 15 bp, Homo sapiens
tatttcaactacaaa

SEQ ID NO: 181767 - DNA, 15 bp, Homo sapiens
ctatttcaactacaa

SEQ ID NO: 181768 - DNA, 15 bp, Homo sapiens
actatttcaactaca

SEQ ID NO: 181769 - DNA, 15 bp, Homo sapiens
aactatttcaactac

SEQ ID NO: 181770 - DNA, 15 bp, Homo sapiens
aaactatttcaacta

SEQ ID NO: 181771 - DNA, 15 bp, Homo sapiens
aaaactatttcaact

SEQ ID NO: 181772 - DNA, 15 bp, Homo sapiens
aaaaactatttcaac

SEQ ID NO: 181773 - DNA, 15 bp, Homo sapiens
taaaaactatttcaa

SEQ ID NO: 181774 - DNA, 15 bp, Homo sapiens
ttaaaaactatttca

SEQ ID NO: 181775 - DNA, 15 bp, Homo sapiens
attaaaaactatttc

SEQ ID NO: 181776 - DNA, 15 bp, Homo sapiens
cattaaaaactattt

SEQ ID NO: 181777 - DNA, 15 bp, Homo sapiens
gcattaaaaactatt

SEQ ID NO: 181778 - DNA, 15 bp, Homo sapiens
ggcattaaaaactat

SEQ ID NO: 181779 - DNA, 15 bp, Homo sapiens
tggcattaaaaacta

SEQ ID NO: 181780 - DNA, 15 bp, Homo sapiens
ctggcattaaaaact

SEQ ID NO: 181781 - DNA, 15 bp, Homo sapiens
gctggcattaaaaac

SEQ ID NO: 181782 - DNA, 15 bp, Homo sapiens
tgctggcattaaaaa

SEQ ID NO: 181783 - DNA, 15 bp, Homo sapiens
ctgctggcattaaaa

SEQ ID NO: 181784 - DNA, 15 bp, Homo sapiens
actgctggcattaaa

SEQ ID NO: 181785 - DNA, 15 bp, Homo sapiens
gactgctggcattaa

SEQ ID NO: 181786 - DNA, 15 bp, Homo sapiens
agactgctggcatta

SEQ ID NO: 181787 - DNA, 15 bp, Homo sapiens
aagactgctggcatt

SEQ ID NO: 181788 - DNA, 15 bp, Homo sapiens
aaagactgctggcat

SEQ ID NO: 181789 - DNA, 15 bp, Homo sapiens
aaaagactgctggca

SEQ ID NO: 181790 - DNA, 15 bp, Homo sapiens
caaaagactgctggc

SEQ ID NO: 181791 - DNA, 15 bp, Homo sapiens
ccaaaagactgctgg

SEQ ID NO: 181792 - DNA, 15 bp, Homo sapiens
accaaaagactgctg

SEQ ID NO: 181793 - DNA, 15 bp, Homo sapiens
aaccaaaagactgct

SEQ ID NO: 181794 - DNA, 15 bp, Homo sapiens
taaccaaaagactgc

SEQ ID NO: 181795 - DNA, 15 bp, Homo sapiens
ataaccaaaagactg

SEQ ID NO: 181796 - DNA, 15 bp, Homo sapiens
gataaccaaaagact

SEQ ID NO: 181797 - DNA, 15 bp, Homo sapiens
tgataaccaaaagac

SEQ ID NO: 181798 - DNA, 15 bp, Homo sapiens
ctgataaccaaaaga

SEQ ID NO: 181799 - DNA, 15 bp, Homo sapiens
actgataaccaaaag

SEQ ID NO: 181800 - DNA, 15 bp, Homo sapiens
aactgataaccaaaa

SEQ ID NO: 181801 - DNA, 15 bp, Homo sapiens
aaactgataaccaaa

SEQ ID NO: 181802 - DNA, 15 bp, Homo sapiens
gaaactgataaccaa

SEQ ID NO: 181803 - DNA, 15 bp, Homo sapiens
tgaaactgataacca

SEQ ID NO: 181804 - DNA, 15 bp, Homo sapiens
atgaaactgataacc

SEQ ID NO: 181805 - DNA, 15 bp, Homo sapiens
aatgaaactgataac

SEQ ID NO: 181806 - DNA, 15 bp, Homo sapiens
aaatgaaactgataa

SEQ ID NO: 181807 - DNA, 15 bp, Homo sapiens
caaatgaaactgata

SEQ ID NO: 181808 - DNA, 15 bp, Homo sapiens
tcaaatgaaactgat

SEQ ID NO: 181809 - DNA, 15 bp, Homo sapiens
ttcaaatgaaactga

SEQ ID NO: 181810 - DNA, 15 bp, Homo sapiens
cttcaaatgaaactg

SEQ ID NO: 181811 - DNA, 15 bp, Homo sapiens
tcttcaaatgaaact

SEQ ID NO: 181812 - DNA, 15 bp, Homo sapiens
gtcttcaaatgaaac

SEQ ID NO: 181813 - DNA, 15 bp, Homo sapiens
ggtcttcaaatgaaa

SEQ ID NO: 181814 - DNA, 15 bp, Homo sapiens
tggtcttcaaatgaa

SEQ ID NO: 181815 - DNA, 15 bp, Homo sapiens
ctggtcttcaaatga

SEQ ID NO: 181816 - DNA, 15 bp, Homo sapiens
tctggtcttcaaatg

SEQ ID NO: 181817 - DNA, 15 bp, Homo sapiens
ttctggtcttcaaat

SEQ ID NO: 181818 - DNA, 15 bp, Homo sapiens
cttctggtcttcaaa

SEQ ID NO: 181819 - DNA, 15 bp, Homo sapiens
acttctggtcttcaa

SEQ ID NO: 181820 - DNA, 15 bp, Homo sapiens
aacttctggtcttca

SEQ ID NO: 181821 - DNA, 15 bp, Homo sapiens
gaacttctggtcttc

SEQ ID NO: 181822 - DNA, 15 bp, Homo sapiens
ggaacttctggtctt

SEQ ID NO: 181823 - DNA, 15 bp, Homo sapiens
aggaacttctggtct

SEQ ID NO: 181824 - DNA, 15 bp, Homo sapiens
caggaacttctggtc

SEQ ID NO: 181825 - DNA, 15 bp, Homo sapiens
tcaggaacttctggt

SEQ ID NO: 181826 - DNA, 15 bp, Homo sapiens
ttcaggaacttctgg

SEQ ID NO: 181827 - DNA, 15 bp, Homo sapiens
gttcaggaacttctg

SEQ ID NO: 181828 - DNA, 15 bp, Homo sapiens
tgttcaggaacttct

SEQ ID NO: 181829 - DNA, 15 bp, Homo sapiens
ttgttcaggaacttc

SEQ ID NO: 181830 - DNA, 15 bp, Homo sapiens
tttgttcaggaactt

SEQ ID NO: 181831 - DNA, 15 bp, Homo sapiens
ctttgttcaggaact

SEQ ID NO: 181832 - DNA, 15 bp, Homo sapiens
tctttgttcaggaac

SEQ ID NO: 181833 - DNA, 15 bp, Homo sapiens
ttctttgttcaggaa

SEQ ID NO: 181834 - DNA, 15 bp, Homo sapiens
attctttgttcagga

SEQ ID NO: 181835 - DNA, 15 bp, Homo sapiens
tattctttgttcagg

SEQ ID NO: 181836 - DNA, 15 bp, Homo sapiens
atattctttgttcag

SEQ ID NO: 181837 - DNA, 15 bp, Homo sapiens
aatattctttgttca

SEQ ID NO: 181838 - DNA, 15 bp, Homo sapiens
aaatattctttgttc

SEQ ID NO: 181839 - DNA, 15 bp, Homo sapiens
taaatattctttgtt

SEQ ID NO: 181840 - DNA, 15 bp, Homo sapiens
ataaatattctttgt

SEQ ID NO: 181841 - DNA, 15 bp, Homo sapiens
aataaatattctttg

SEQ ID NO: 181842 - DNA, 15 bp, Homo sapiens
aaataaatattcttt

SEQ ID NO: 181843 - DNA, 15 bp, Homo sapiens
gaaataaatattctt

SEQ ID NO: 181844 - DNA, 15 bp, Homo sapiens
tgaaataaatattct

SEQ ID NO: 181845 - DNA, 15 bp, Homo sapiens
ctgaaataaatattc

SEQ ID NO: 181846 - DNA, 15 bp, Homo sapiens
tctgaaataaatatt

SEQ ID NO: 181847 - DNA, 15 bp, Homo sapiens
atctgaaataaatat

SEQ ID NO: 181848 - DNA, 15 bp, Homo sapiens
aatctgaaataaata

SEQ ID NO: 181849 - DNA, 15 bp, Homo sapiens
taatctgaaataaat

SEQ ID NO: 181850 - DNA, 15 bp, Homo sapiens
ttaatctgaaataaa

SEQ ID NO: 181851 - DNA, 15 bp, Homo sapiens
attaatctgaaataa

SEQ ID NO: 181852 - DNA, 15 bp, Homo sapiens
tattaatctgaaata

SEQ ID NO: 181853 - DNA, 15 bp, Homo sapiens
ttattaatctgaaat

SEQ ID NO: 181854 - DNA, 15 bp, Homo sapiens
cttattaatctgaaa

SEQ ID NO: 181855 - DNA, 15 bp, Homo sapiens
acttattaatctgaa

SEQ ID NO: 181856 - DNA, 15 bp, Homo sapiens
tacttattaatctga

SEQ ID NO: 181857 - DNA, 15 bp, Homo sapiens
ttacttattaatctg

SEQ ID NO: 181858 - DNA, 15 bp, Homo sapiens
tttacttattaatct

SEQ ID NO: 181859 - DNA, 15 bp, Homo sapiens
atttacttattaatc

SEQ ID NO: 181860 - DNA, 15 bp, Homo sapiens
tatttacttattaat

SEQ ID NO: 181861 - DNA, 15 bp, Homo sapiens
ttatttacttattaa

SEQ ID NO: 181862 - DNA, 15 bp, Homo sapiens
tttatttacttatta

SEQ ID NO: 181863 - DNA, 15 bp, Homo sapiens
ctttatttacttatt

SEQ ID NO: 181864 - DNA, 15 bp, Homo sapiens
actttatttacttat

SEQ ID NO: 181865 - DNA, 15 bp, Homo sapiens
cactttatttactta

SEQ ID NO: 181866 - DNA, 15 bp, Homo sapiens
tcactttatttactt

SEQ ID NO: 181867 - DNA, 15 bp, Homo sapiens
ttcactttatttact

SEQ ID NO: 181868 - DNA, 15 bp, Homo sapiens
tttcactttatttac

SEQ ID NO: 181869 - DNA, 15 bp, Homo sapiens
atttcactttattta

SEQ ID NO: 181870 - DNA, 15 bp, Homo sapiens
tatttcactttattt

SEQ ID NO: 181871 - DNA, 15 bp, Homo sapiens
ttatttcactttatt

SEQ ID NO: 181872 - DNA, 15 bp, Homo sapiens
tttatttcactttat

SEQ ID NO: 181873 - DNA, 15 bp, Homo sapiens
ttttatttcacttta

SEQ ID NO: 181874 - DNA, 15 bp, Homo sapiens
cttttatttcacttt

SEQ ID NO: 181875 - DNA, 15 bp, Homo sapiens
tcttttatttcactt

SEQ ID NO: 181876 - DNA, 15 bp, Homo sapiens
atcttttatttcact

SEQ ID NO: 181877 - DNA, 15 bp, Homo sapiens
aatcttttatttcac

SEQ ID NO: 181878 - DNA, 15 bp, Homo sapiens
aaatcttttatttca

SEQ ID NO: 181879 - DNA, 15 bp, Homo sapiens
aaaatcttttatttc

SEQ ID NO: 181880 - DNA, 15 bp, Homo sapiens
aaaaatcttttattt

SEQ ID NO: 181881 - DNA, 15 bp, Homo sapiens
aaaaaatcttttatt

SEQ ID NO: 181882 - DNA, 15 bp, Homo sapiens
aaaaaaatcttttat

SEQ ID NO: 181883 - DNA, 15 bp, Homo sapiens
gaaaaaaatctttta

SEQ ID NO: 181884 - DNA, 15 bp, Homo sapiens
ggaaaaaaatctttt

SEQ ID NO: 181885 - DNA, 15 bp, Homo sapiens
caaaggaaaaaaatc

SEQ ID NO: 181886 - DNA, 15 bp, Homo sapiens
tcaaaggaaaaaaat

SEQ ID NO: 181887 - DNA, 15 bp, Homo sapiens
ttcaaaggaaaaaaa

SEQ ID NO: 181888 - DNA, 15 bp, Homo sapiens
tttcaaaggaaaaaa

SEQ ID NO: 181889 - DNA, 15 bp, Homo sapiens
atttcaaaggaaaaa

SEQ ID NO: 181890 - DNA, 15 bp, Homo sapiens
aatttcaaaggaaaa

SEQ ID NO: 181891 - DNA, 15 bp, Homo sapiens
caatttcaaaggaaa

SEQ ID NO: 181892 - DNA, 15 bp, Homo sapiens
tcaatttcaaaggaa

SEQ ID NO: 181893 - DNA, 15 bp, Homo sapiens
ctcaatttcaaagga

SEQ ID NO: 181894 - DNA, 15 bp, Homo sapiens
cctcaatttcaaagg

SEQ ID NO: 181895 - DNA, 15 bp, Homo sapiens
tcctcaatttcaaag

SEQ ID NO: 181896 - DNA, 15 bp, Homo sapiens
ttcctcaatttcaaa

SEQ ID NO: 181897 - DNA, 15 bp, Homo sapiens
cttcctcaatttcaa

SEQ ID NO: 181898 - DNA, 15 bp, Homo sapiens
tcttcctcaatttca

SEQ ID NO: 181899 - DNA, 15 bp, Homo sapiens
atcttcctcaatttc

SEQ ID NO: 181900 - DNA, 15 bp, Homo sapiens
gatcttcctcaattt

SEQ ID NO: 181901 - DNA, 15 bp, Homo sapiens
tgatcttcctcaatt

SEQ ID NO: 181902 - DNA, 15 bp, Homo sapiens
ctgatcttcctcaat

SEQ ID NO: 181903 - DNA, 15 bp, Homo sapiens
actgatcttcctcaa

SEQ ID NO: 181904 - DNA, 15 bp, Homo sapiens
aactgatcttcctca

SEQ ID NO: 181905 - DNA, 15 bp, Homo sapiens
taactgatcttcctc

SEQ ID NO: 181906 - DNA, 15 bp, Homo sapiens
ataactgatcttcct

SEQ ID NO: 181907 - DNA, 15 bp, Homo sapiens
aataactgatcttcc

SEQ ID NO: 181908 - DNA, 15 bp, Homo sapiens
taataactgatcttc

SEQ ID NO: 181909 - DNA, 15 bp, Homo sapiens
ctaataactgatctt

SEQ ID NO: 181910 - DNA, 15 bp, Homo sapiens
actaataactgatct

SEQ ID NO: 181911 - DNA, 15 bp, Homo sapiens
tactaataactgatc

SEQ ID NO: 181912 - DNA, 15 bp, Homo sapiens
ctactaataactgat

SEQ ID NO: 181913 - DNA, 15 bp, Homo sapiens
actactaataactga

SEQ ID NO: 181914 - DNA, 15 bp, Homo sapiens
tactactaataactg

SEQ ID NO: 181915 - DNA, 15 bp, Homo sapiens
gtactactaataact

SEQ ID NO: 181916 - DNA, 15 bp, Homo sapiens
tgtactactaataac

SEQ ID NO: 181917 - DNA, 15 bp, Homo sapiens
ttgtactactaataa

SEQ ID NO: 181918 - DNA, 15 bp, Homo sapiens
tttgtactactaata

SEQ ID NO: 181919 - DNA, 15 bp, Homo sapiens
gtttgtactactaat

SEQ ID NO: 181920 - DNA, 15 bp, Homo sapiens
agtttgtactactaa

SEQ ID NO: 181921 - DNA, 15 bp, Homo sapiens
cagtttgtactacta

SEQ ID NO: 181922 - DNA, 15 bp, Homo sapiens
acagtttgtactact

SEQ ID NO: 181923 - DNA, 15 bp, Homo sapiens
cacagtttgtactac

SEQ ID NO: 181924 - DNA, 15 bp, Homo sapiens
gcacagtttgtacta

SEQ ID NO: 181925 - DNA, 15 bp, Homo sapiens
tgcacagtttgtact

SEQ ID NO: 181926 - DNA, 15 bp, Homo sapiens
gtgcacagtttgtac

SEQ ID NO: 181927 - DNA, 15 bp, Homo sapiens
agtgcacagtttgta

SEQ ID NO: 181928 - DNA, 15 bp, Homo sapiens
tagtgcacagtttgt

SEQ ID NO: 181929 - DNA, 15 bp, Homo sapiens
ctagtgcacagtttg

SEQ ID NO: 181930 - DNA, 15 bp, Homo sapiens
tctagtgcacagttt

SEQ ID NO: 181931 - DNA, 15 bp, Homo sapiens
atctagtgcacagtt

SEQ ID NO: 181932 - DNA, 15 bp, Homo sapiens
aatctagtgcacagt

SEQ ID NO: 181933 - DNA, 15 bp, Homo sapiens
caatctagtgcacag

SEQ ID NO: 181934 - DNA, 15 bp, Homo sapiens
acaatctagtgcaca

SEQ ID NO: 181935 - DNA, 15 bp, Homo sapiens
tacaatctagtgcac

SEQ ID NO: 181936 - DNA, 15 bp, Homo sapiens
atacaatctagtgca

SEQ ID NO: 181937 - DNA, 15 bp, Homo sapiens
gatacaatctagtgc

SEQ ID NO: 181938 - DNA, 15 bp, Homo sapiens
agatacaatctagtg

SEQ ID NO: 181939 - DNA, 15 bp, Homo sapiens
aagatacaatctagt

SEQ ID NO: 181940 - DNA, 15 bp, Homo sapiens
taagatacaatctag

SEQ ID NO: 181941 - DNA, 15 bp, Homo sapiens
ctaagatacaatcta

SEQ ID NO: 181942 - DNA, 15 bp, Homo sapiens
cctaagatacaatct

SEQ ID NO: 181943 - DNA, 15 bp, Homo sapiens
ccctaagatacaatc

SEQ ID NO: 181944 - DNA, 15 bp, Homo sapiens
accctaagatacaat

SEQ ID NO: 181945 - DNA, 15 bp, Homo sapiens
aaccctaagatacaa

SEQ ID NO: 181946 - DNA, 15 bp, Homo sapiens
gaaccctaagataca

SEQ ID NO: 181947 - DNA, 15 bp, Homo sapiens
ggaaccctaagatac

SEQ ID NO: 181948 - DNA, 15 bp, Homo sapiens
aggaaccctaagata

SEQ ID NO: 181949 - DNA, 15 bp, Homo sapiens
taggaaccctaagat

SEQ ID NO: 181950 - DNA, 15 bp, Homo sapiens
ttaggaaccctaaga

SEQ ID NO: 181951 - DNA, 15 bp, Homo sapiens
gttaggaaccctaag

SEQ ID NO: 181952 - DNA, 15 bp, Homo sapiens
agttaggaaccctaa

SEQ ID NO: 181953 - DNA, 15 bp, Homo sapiens
gagttaggaacccta

SEQ ID NO: 181954 - DNA, 15 bp, Homo sapiens
tgagttaggaaccct

SEQ ID NO: 181955 - DNA, 15 bp, Homo sapiens
atgagttaggaaccc

SEQ ID NO: 181956 - DNA, 15 bp, Homo sapiens
aatgagttaggaacc

SEQ ID NO: 181957 - DNA, 15 bp, Homo sapiens
gaatgagttaggaac

SEQ ID NO: 181958 - DNA, 15 bp, Homo sapiens
agaatgagttaggaa

SEQ ID NO: 181959 - DNA, 15 bp, Homo sapiens
aagaatgagttagga

SEQ ID NO: 181960 - DNA, 15 bp, Homo sapiens
taagaatgagttagg

SEQ ID NO: 181961 - DNA, 15 bp, Homo sapiens
gtaagaatgagttag

SEQ ID NO: 181962 - DNA, 15 bp, Homo sapiens
ggtaagaatgagtta

SEQ ID NO: 181963 - DNA, 15 bp, Homo sapiens
tggtaagaatgagtt

SEQ ID NO: 181964 - DNA, 15 bp, Homo sapiens
ttggtaagaatgagt

SEQ ID NO: 181965 - DNA, 15 bp, Homo sapiens
attggtaagaatgag

SEQ ID NO: 181966 - DNA, 15 bp, Homo sapiens
cattggtaagaatga

SEQ ID NO: 181967 - DNA, 15 bp, Homo sapiens
tcattggtaagaatg

SEQ ID NO: 181968 - DNA, 15 bp, Homo sapiens
atcattggtaagaat

SEQ ID NO: 181969 - DNA, 15 bp, Homo sapiens
tatcattggtaagaa

SEQ ID NO: 181970 - DNA, 15 bp, Homo sapiens
ttatcattggtaaga

SEQ ID NO: 181971 - DNA, 15 bp, Homo sapiens
attatcattggtaag

SEQ ID NO: 181972 - DNA, 15 bp, Homo sapiens
tattatcattggtaa

SEQ ID NO: 181973 - DNA, 15 bp, Homo sapiens
ttattatcattggta

SEQ ID NO: 181974 - DNA, 15 bp, Homo sapiens
gttattatcattggt

SEQ ID NO: 181975 - DNA, 15 bp, Homo sapiens
agttattatcattgg

SEQ ID NO: 181976 - DNA, 15 bp, Homo sapiens
gagttattatcattg

SEQ ID NO: 181977 - DNA, 15 bp, Homo sapiens
agagttattatcatt

SEQ ID NO: 181978 - DNA, 15 bp, Homo sapiens
cagagttattatcat

SEQ ID NO: 181979 - DNA, 15 bp, Homo sapiens
tcagagttattatca

SEQ ID NO: 181980 - DNA, 15 bp, Homo sapiens
ttcagagttattatc

SEQ ID NO: 181981 - DNA, 15 bp, Homo sapiens
gttcagagttattat

SEQ ID NO: 181982 - DNA, 15 bp, Homo sapiens
ggttcagagttatta

SEQ ID NO: 181983 - DNA, 15 bp, Homo sapiens
gggttcagagttatt

SEQ ID NO: 181984 - DNA, 15 bp, Homo sapiens
tgggttcagagttat

SEQ ID NO: 181985 - DNA, 15 bp, Homo sapiens
ttgggttcagagtta

SEQ ID NO: 181986 - DNA, 15 bp, Homo sapiens
cttgggttcagagtt

SEQ ID NO: 181987 - DNA, 15 bp, Homo sapiens
tcttgggttcagagt

SEQ ID NO: 181988 - DNA, 15 bp, Homo sapiens
ttcttgggttcagag

SEQ ID NO: 181989 - DNA, 15 bp, Homo sapiens
attcttgggttcaga

SEQ ID NO: 181990 - DNA, 15 bp, Homo sapiens
tattcttgggttcag

SEQ ID NO: 181991 - DNA, 15 bp, Homo sapiens
atattcttgggttca

SEQ ID NO: 181992 - DNA, 15 bp, Homo sapiens
gatattcttgggttc

SEQ ID NO: 181993 - DNA, 15 bp, Homo sapiens
agatattcttgggtt

SEQ ID NO: 181994 - DNA, 15 bp, Homo sapiens
cagatattcttgggt

SEQ ID NO: 181995 - DNA, 15 bp, Homo sapiens
tcagatattcttggg

SEQ ID NO: 181996 - DNA, 15 bp, Homo sapiens
ctcagatattcttgg

SEQ ID NO: 181997 - DNA, 15 bp, Homo sapiens
tctcagatattcttg

SEQ ID NO: 181998 - DNA, 15 bp, Homo sapiens
gtctcagatattctt

SEQ ID NO: 181999 - DNA, 15 bp, Homo sapiens
tgtctcagatattct

SEQ ID NO: 182000 - DNA, 15 bp, Homo sapiens
ctgtctcagatattc

SEQ ID NO: 182001 - DNA, 15 bp, Homo sapiens
actgtctcagatatt

SEQ ID NO: 182002 - DNA, 15 bp, Homo sapiens
aactgtctcagatat

SEQ ID NO: 182003 - DNA, 15 bp, Homo sapiens
gaactgtctcagata

SEQ ID NO: 182004 - DNA, 15 bp, Homo sapiens
agaactgtctcagat

SEQ ID NO: 182005 - DNA, 15 bp, Homo sapiens
gagaactgtctcaga

SEQ ID NO: 182006 - DNA, 15 bp, Homo sapiens
tgagaactgtctcag

SEQ ID NO: 182007 - DNA, 15 bp, Homo sapiens
ttgagaactgtctca

SEQ ID NO: 182008 - DNA, 15 bp, Homo sapiens
attgagaactgtctc

SEQ ID NO: 182009 - DNA, 15 bp, Homo sapiens
aattgagaactgtct

SEQ ID NO: 182010 - DNA, 15 bp, Homo sapiens
taattgagaactgtc

SEQ ID NO: 182011 - DNA, 15 bp, Homo sapiens
ttaattgagaactgt

SEQ ID NO: 182012 - DNA, 15 bp, Homo sapiens
attaattgagaactg

SEQ ID NO: 182013 - DNA, 15 bp, Homo sapiens
aattaattgagaact

SEQ ID NO: 182014 - DNA, 15 bp, Homo sapiens
aaattaattgagaac

SEQ ID NO: 182015 - DNA, 15 bp, Homo sapiens
taaattaattgagaa

SEQ ID NO: 182016 - DNA, 15 bp, Homo sapiens
ttaaattaattgaga

SEQ ID NO: 182017 - DNA, 15 bp, Homo sapiens
tttaaattaattgag

SEQ ID NO: 182018 - DNA, 15 bp, Homo sapiens
ttttaaattaattga

SEQ ID NO: 182019 - DNA, 15 bp, Homo sapiens
tttttaaattaattg

SEQ ID NO: 182020 - DNA, 15 bp, Homo sapiens
ctttttaaattaatt

SEQ ID NO: 182021 - DNA, 15 bp, Homo sapiens
actttttaaattaat

SEQ ID NO: 182022 - DNA, 15 bp, Homo sapiens
aactttttaaattaa

SEQ ID NO: 182023 - DNA, 15 bp, Homo sapiens
aaactttttaaatta

SEQ ID NO: 182024 - DNA, 15 bp, Homo sapiens
taaactttttaaatt

SEQ ID NO: 182025 - DNA, 15 bp, Homo sapiens
ataaactttttaaat

SEQ ID NO: 182026 - DNA, 15 bp, Homo sapiens
aataaactttttaaa

SEQ ID NO: 182027 - DNA, 15 bp, Homo sapiens
aaataaactttttaa

SEQ ID NO: 182028 - DNA, 15 bp, Homo sapiens
aaaataaacttttta

SEQ ID NO: 182029 - DNA, 15 bp, Homo sapiens
caaaataaacttttt

SEQ ID NO: 182030 - DNA, 15 bp, Homo sapiens
gcaaaataaactttt

SEQ ID NO: 182031 - DNA, 15 bp, Homo sapiens
ggcaaaataaacttt

SEQ ID NO: 182032 - DNA, 15 bp, Homo sapiens
tggcaaaataaactt

SEQ ID NO: 182033 - DNA, 15 bp, Homo sapiens
ctggcaaaataaact

SEQ ID NO: 182034 - DNA, 15 bp, Homo sapiens
cctggcaaaataaac

SEQ ID NO: 182035 - DNA, 15 bp, Homo sapiens
ccctggcaaaataaa

SEQ ID NO: 182036 - DNA, 15 bp, Homo sapiens
accctggcaaaataa

SEQ ID NO: 182037 - DNA, 15 bp, Homo sapiens
aaccctggcaaaata

SEQ ID NO: 182038 - DNA, 15 bp, Homo sapiens
taaccctggcaaaat

SEQ ID NO: 182039 - DNA, 15 bp, Homo sapiens
ttaaccctggcaaaa

SEQ ID NO: 182040 - DNA, 15 bp, Homo sapiens
cttaaccctggcaaa

SEQ ID NO: 182041 - DNA, 15 bp, Homo sapiens
ccttaaccctggcaa

SEQ ID NO: 182042 - DNA, 15 bp, Homo sapiens
tccttaaccctggca

SEQ ID NO: 182043 - DNA, 15 bp, Homo sapiens
atccttaaccctggc

SEQ ID NO: 182044 - DNA, 15 bp, Homo sapiens
catccttaaccctgg

SEQ ID NO: 182045 - DNA, 15 bp, Homo sapiens
gcatccttaaccctg

SEQ ID NO: 182046 - DNA, 15 bp, Homo sapiens
tgcatccttaaccct

SEQ ID NO: 182047 - DNA, 15 bp, Homo sapiens
gtgcatccttaaccc

SEQ ID NO: 182048 - DNA, 15 bp, Homo sapiens
ggtgcatccttaacc

SEQ ID NO: 182049 - DNA, 15 bp, Homo sapiens
aggtgcatccttaac

SEQ ID NO: 182050 - DNA, 15 bp, Homo sapiens
taggtgcatccttaa

SEQ ID NO: 182051 - DNA, 15 bp, Homo sapiens
ataggtgcatcctta

SEQ ID NO: 182052 - DNA, 15 bp, Homo sapiens
cataggtgcatcctt

SEQ ID NO: 182053 - DNA, 15 bp, Homo sapiens
tcataggtgcatcct

SEQ ID NO: 182054 - DNA, 15 bp, Homo sapiens
gtcataggtgcatcc

SEQ ID NO: 182055 - DNA, 15 bp, Homo sapiens
tgtcataggtgcatc

SEQ ID NO: 182056 - DNA, 15 bp, Homo sapiens
gtgtcataggtgcat

SEQ ID NO: 182057 - DNA, 15 bp, Homo sapiens
tgtgtcataggtgca

SEQ ID NO: 182058 - DNA, 15 bp, Homo sapiens
ctgtgtcataggtgc

SEQ ID NO: 182059 - DNA, 15 bp, Homo sapiens
gctgtgtcataggtg

SEQ ID NO: 182060 - DNA, 15 bp, Homo sapiens
ggctgtgtcataggt

SEQ ID NO: 182061 - DNA, 15 bp, Homo sapiens
aggctgtgtcatagg

SEQ ID NO: 182062 - DNA, 15 bp, Homo sapiens
gaggctgtgtcatag

SEQ ID NO: 182063 - DNA, 15 bp, Homo sapiens
tgaggctgtgtcata

SEQ ID NO: 182064 - DNA, 15 bp, Homo sapiens
ctgaggctgtgtcat

SEQ ID NO: 182065 - DNA, 15 bp, Homo sapiens
ctcaggacctcctga

SEQ ID NO: 182066 - DNA, 15 bp, Homo sapiens
cctcaggacctcctg

SEQ ID NO: 182067 - DNA, 15 bp, Homo sapiens
tcctcaggacctcct

SEQ ID NO: 182068 - DNA, 15 bp, Homo sapiens
gtcctcaggacctcc

SEQ ID NO: 182069 - DNA, 15 bp, Homo sapiens
tgtcctcaggacctc

SEQ ID NO: 182070 - DNA, 15 bp, Homo sapiens
atgtcctcaggacct

SEQ ID NO: 182071 - DNA, 15 bp, Homo sapiens
catgtcctcaggacc

SEQ ID NO: 182072 - DNA, 15 bp, Homo sapiens
acatgtcctcaggac

SEQ ID NO: 182073 - DNA, 15 bp, Homo sapiens
tacatgtcctcagga

SEQ ID NO: 182074 - DNA, 15 bp, Homo sapiens
gtacatgtcctcagg

SEQ ID NO: 182075 - DNA, 15 bp, Homo sapiens
ggtacatgtcctcag

SEQ ID NO: 182076 - DNA, 15 bp, Homo sapiens
gggtacatgtcctca

SEQ ID NO: 182077 - DNA, 15 bp, Homo sapiens
tgggtacatgtcctc

SEQ ID NO: 182078 - DNA, 15 bp, Homo sapiens
ttgggtacatgtcct

SEQ ID NO: 182079 - DNA, 15 bp, Homo sapiens
cttgggtacatgtcc

SEQ ID NO: 182080 - DNA, 15 bp, Homo sapiens
ccttgggtacatgtc

SEQ ID NO: 182081 - DNA, 15 bp, Homo sapiens
accttgggtacatgt

SEQ ID NO: 182082 - DNA, 15 bp, Homo sapiens
taccttgggtacatg

SEQ ID NO: 182083 - DNA, 15 bp, Homo sapiens
ctaccttgggtacat

SEQ ID NO: 182084 - DNA, 15 bp, Homo sapiens
actaccttgggtaca

SEQ ID NO: 182085 - DNA, 15 bp, Homo sapiens
aactaccttgggtac

SEQ ID NO: 182086 - DNA, 15 bp, Homo sapiens
caactaccttgggta

SEQ ID NO: 182087 - DNA, 15 bp, Homo sapiens
ccaactaccttgggt

SEQ ID NO: 182088 - DNA, 15 bp, Homo sapiens
cccaactaccttggg

SEQ ID NO: 182089 - DNA, 15 bp, Homo sapiens
ccccaactaccttgg

SEQ ID NO: 182090 - DNA, 15 bp, Homo sapiens
accccaactaccttg

SEQ ID NO: 182091 - DNA, 15 bp, Homo sapiens
taccccaactacctt

SEQ ID NO: 182092 - DNA, 15 bp, Homo sapiens
gtaccccaactacct

SEQ ID NO: 182093 - DNA, 15 bp, Homo sapiens
tgtaccccaactacc

SEQ ID NO: 182094 - DNA, 15 bp, Homo sapiens
ctgtaccccaactac

SEQ ID NO: 182095 - DNA, 15 bp, Homo sapiens
gctgtaccccaacta

SEQ ID NO: 182096 - DNA, 15 bp, Homo sapiens
ggctgtaccccaact

SEQ ID NO: 182097 - DNA, 15 bp, Homo sapiens
aggctgtaccccaac

SEQ ID NO: 182098 - DNA, 15 bp, Homo sapiens
caggctgtaccccaa

SEQ ID NO: 182099 - DNA, 15 bp, Homo sapiens
gcaggctgtacccca

SEQ ID NO: 182100 - DNA, 15 bp, Homo sapiens
agcaggctgtacccc

SEQ ID NO: 182101 - DNA, 15 bp, Homo sapiens
aagcaggctgtaccc

SEQ ID NO: 182102 - DNA, 15 bp, Homo sapiens
aaagcaggctgtacc

SEQ ID NO: 182103 - DNA, 15 bp, Homo sapiens
aaaagcaggctgtac

SEQ ID NO: 182104 - DNA, 15 bp, Homo sapiens
taaaagcaggctgta

SEQ ID NO: 182105 - DNA, 15 bp, Homo sapiens
ataaaagcaggctgt

SEQ ID NO: 182106 - DNA, 15 bp, Homo sapiens
tataaaagcaggctg

SEQ ID NO: 182107 - DNA, 15 bp, Homo sapiens
gtataaaagcaggct

SEQ ID NO: 182108 - DNA, 15 bp, Homo sapiens
tgtataaaagcaggc

SEQ ID NO: 182109 - DNA, 15 bp, Homo sapiens
atgtataaaagcagg

SEQ ID NO: 182110 - DNA, 15 bp, Homo sapiens
aatgtataaaagcag

SEQ ID NO: 182111 - DNA, 15 bp, Homo sapiens
aaatgtataaaagca

SEQ ID NO: 182112 - DNA, 15 bp, Homo sapiens
aaaatgtataaaagc

SEQ ID NO: 182113 - DNA, 15 bp, Homo sapiens
taaaatgtataaaag

SEQ ID NO: 182114 - DNA, 15 bp, Homo sapiens
tatgtctccctaaaa

SEQ ID NO: 182115 - DNA, 15 bp, Homo sapiens
ttatgtctccctaaa

SEQ ID NO: 182116 - DNA, 15 bp, Homo sapiens
attatgtctccctaa

SEQ ID NO: 182117 - DNA, 15 bp, Homo sapiens
tattatgtctcccta

SEQ ID NO: 182118 - DNA, 15 bp, Homo sapiens
gtattatgtctccct

SEQ ID NO: 182119 - DNA, 15 bp, Homo sapiens
tgtattatgtctccc

SEQ ID NO: 182120 - DNA, 15 bp, Homo sapiens
atgtattatgtctcc

SEQ ID NO: 182121 - DNA, 15 bp, Homo sapiens
gatgtattatgtctc

SEQ ID NO: 182122 - DNA, 15 bp, Homo sapiens
tgatgtattatgtct

SEQ ID NO: 182123 - DNA, 15 bp, Homo sapiens
ttgatgtattatgtc

SEQ ID NO: 182124 - DNA, 15 bp, Homo sapiens
attgatgtattatgt

SEQ ID NO: 182125 - DNA, 15 bp, Homo sapiens
gattgatgtattatg

SEQ ID NO: 182126 - DNA, 15 bp, Homo sapiens
tgattgatgtattat

SEQ ID NO: 182127 - DNA, 15 bp, Homo sapiens
ttgattgatgtatta

SEQ ID NO: 182128 - DNA, 15 bp, Homo sapiens
attgattgatgtatt

SEQ ID NO: 182129 - DNA, 15 bp, Homo sapiens
tattgattgatgtat

SEQ ID NO: 182130 - DNA, 15 bp, Homo sapiens
gtattgattgatgta

SEQ ID NO: 182131 - DNA, 15 bp, Homo sapiens
tgtattgattgatgt

SEQ ID NO: 182132 - DNA, 15 bp, Homo sapiens
atgtattgattgatg

SEQ ID NO: 182133 - DNA, 15 bp, Homo sapiens
aatgtattgattgat

SEQ ID NO: 182134 - DNA, 15 bp, Homo sapiens
aaatgtattgattga

SEQ ID NO: 182135 - DNA, 15 bp, Homo sapiens
taaatgtattgattg

SEQ ID NO: 182136 - DNA, 15 bp, Homo sapiens
ttaaatgtattgatt

SEQ ID NO: 182137 - DNA, 15 bp, Homo sapiens
cttaaatgtattgat

SEQ ID NO: 182138 - DNA, 15 bp, Homo sapiens
tcttaaatgtattga

SEQ ID NO: 182139 - DNA, 15 bp, Homo sapiens
atcttaaatgtattg

SEQ ID NO: 182140 - DNA, 15 bp, Homo sapiens
aatcttaaatgtatt

SEQ ID NO: 182141 - DNA, 15 bp, Homo sapiens
aaatcttaaatgtat

SEQ ID NO: 182142 - DNA, 15 bp, Homo sapiens
taaatcttaaatgta

SEQ ID NO: 182143 - DNA, 15 bp, Homo sapiens
gtaaatcttaaatgt

SEQ ID NO: 182144 - DNA, 15 bp, Homo sapiens
tgtaaatcttaaatg

SEQ ID NO: 182145 - DNA, 15 bp, Homo sapiens
atgtaaatcttaaat

SEQ ID NO: 182146 - DNA, 15 bp, Homo sapiens
aatgtaaatcttaaa

SEQ ID NO: 182147 - DNA, 15 bp, Homo sapiens
caatgtaaatcttaa

SEQ ID NO: 182148 - DNA, 15 bp, Homo sapiens
ccaatgtaaatctta

SEQ ID NO: 182149 - DNA, 15 bp, Homo sapiens
accaatgtaaatctt

SEQ ID NO: 182150 - DNA, 15 bp, Homo sapiens
aaccaatgtaaatct

SEQ ID NO: 182151 - DNA, 15 bp, Homo sapiens
gaaccaatgtaaatc

SEQ ID NO: 182152 - DNA, 15 bp, Homo sapiens
cgaaccaatgtaaat

SEQ ID NO: 182153 - DNA, 15 bp, Homo sapiens
tcgaaccaatgtaaa

SEQ ID NO: 182154 - DNA, 15 bp, Homo sapiens
atcgaaccaatgtaa

SEQ ID NO: 182155 - DNA, 15 bp, Homo sapiens
gatcgaaccaatgta

SEQ ID NO: 182156 - DNA, 15 bp, Homo sapiens
agatcgaaccaatgt

SEQ ID NO: 182157 - DNA, 15 bp, Homo sapiens
cagatcgaaccaatg

SEQ ID NO: 182158 - DNA, 15 bp, Homo sapiens
ccagatcgaaccaat

SEQ ID NO: 182159 - DNA, 15 bp, Homo sapiens
tccagatcgaaccaa

SEQ ID NO: 182160 - DNA, 15 bp, Homo sapiens
ttccagatcgaacca

SEQ ID NO: 182161 - DNA, 15 bp, Homo sapiens
cttccagatcgaacc

SEQ ID NO: 182162 - DNA, 15 bp, Homo sapiens
ccttccagatcgaac

SEQ ID NO: 182163 - DNA, 15 bp, Homo sapiens
cccttccagatcgaa

SEQ ID NO: 182164 - DNA, 15 bp, Homo sapiens
acccttccagatcga

SEQ ID NO: 182165 - DNA, 15 bp, Homo sapiens
cacccttccagatcg

SEQ ID NO: 182166 - DNA, 15 bp, Homo sapiens
ccacccttccagatc

SEQ ID NO: 182167 - DNA, 15 bp, Homo sapiens
cccacccttccagat

SEQ ID NO: 182168 - DNA, 15 bp, Homo sapiens
tcccacccttccaga

SEQ ID NO: 182169 - DNA, 15 bp, Homo sapiens
gtcccacccttccag

SEQ ID NO: 182170 - DNA, 15 bp, Homo sapiens
tgtcccacccttcca

SEQ ID NO: 182171 - DNA, 15 bp, Homo sapiens
ttgtcccacccttcc

SEQ ID NO: 182172 - DNA, 15 bp, Homo sapiens
gttgtcccacccttc

SEQ ID NO: 182173 - DNA, 15 bp, Homo sapiens
agttgtcccaccctt

SEQ ID NO: 182174 - DNA, 15 bp, Homo sapiens
gagttgtcccaccct

SEQ ID NO: 182175 - DNA, 15 bp, Homo sapiens
tgagttgtcccaccc

SEQ ID NO: 182176 - DNA, 15 bp, Homo sapiens
ttgagttgtcccacc

SEQ ID NO: 182177 - DNA, 15 bp, Homo sapiens
tttgagttgtcccac

SEQ ID NO: 182178 - DNA, 15 bp, Homo sapiens
ttttgagttgtccca

SEQ ID NO: 182179 - DNA, 15 bp, Homo sapiens
attttgagttgtccc

SEQ ID NO: 182180 - DNA, 15 bp, Homo sapiens
cattttgagttgtcc

SEQ ID NO: 182181 - DNA, 15 bp, Homo sapiens
ccattttgagttgtc

SEQ ID NO: 182182 - DNA, 15 bp, Homo sapiens
tccattttgagttgt

SEQ ID NO: 182183 - DNA, 15 bp, Homo sapiens
ctccattttgagttg

SEQ ID NO: 182184 - DNA, 15 bp, Homo sapiens
cctccattttgagtt

SEQ ID NO: 182185 - DNA, 15 bp, Homo sapiens
ccctccattttgagt

SEQ ID NO: 182186 - DNA, 15 bp, Homo sapiens
tccctccattttgag

SEQ ID NO: 182187 - DNA, 15 bp, Homo sapiens
gtccctccattttga

SEQ ID NO: 182188 - DNA, 15 bp, Homo sapiens
cgtccctccattttg

SEQ ID NO: 182189 - DNA, 15 bp, Homo sapiens
ccgtccctccatttt

SEQ ID NO: 182190 - DNA, 15 bp, Homo sapiens
cccgtccctccattt

SEQ ID NO: 182191 - DNA, 15 bp, Homo sapiens
acccgtccctccatt

SEQ ID NO: 182192 - DNA, 15 bp, Homo sapiens
cacccgtccctccat

SEQ ID NO: 182193 - DNA, 15 bp, Homo sapiens
gcacccgtccctcca

SEQ ID NO: 182194 - DNA, 15 bp, Homo sapiens
agcacccgtccctcc

SEQ ID NO: 182195 - DNA, 15 bp, Homo sapiens
aagcacccgtccctc

SEQ ID NO: 182196 - DNA, 15 bp, Homo sapiens
gaagcacccgtccct

SEQ ID NO: 182197 - DNA, 15 bp, Homo sapiens
ggaagcacccgtccc

SEQ ID NO: 182198 - DNA, 15 bp, Homo sapiens
tggaagcacccgtcc

SEQ ID NO: 182199 - DNA, 15 bp, Homo sapiens
ctggaagcacccgtc

SEQ ID NO: 182200 - DNA, 15 bp, Homo sapiens
cctggaagcacccgt

SEQ ID NO: 182201 - DNA, 15 bp, Homo sapiens
acctggaagcacccg

SEQ ID NO: 182202 - DNA, 15 bp, Homo sapiens
gacctggaagcaccc

SEQ ID NO: 182203 - DNA, 15 bp, Homo sapiens
tgacctggaagcacc

SEQ ID NO: 182204 - DNA, 15 bp, Homo sapiens
atgacctggaagcac

SEQ ID NO: 182205 - DNA, 15 bp, Homo sapiens
tatgacctggaagca

SEQ ID NO: 182206 - DNA, 15 bp, Homo sapiens
tacctatgacctgga

SEQ ID NO: 182207 - DNA, 15 bp, Homo sapiens
ctacctatgacctgg

SEQ ID NO: 182208 - DNA, 15 bp, Homo sapiens
tctacctatgacctg

SEQ ID NO: 182209 - DNA, 15 bp, Homo sapiens
atctacctatgacct

SEQ ID NO: 182210 - DNA, 15 bp, Homo sapiens
aatctacctatgacc

SEQ ID NO: 182211 - DNA, 15 bp, Homo sapiens
aaatctacctatgac

SEQ ID NO: 182212 - DNA, 15 bp, Homo sapiens
caaatctacctatga

SEQ ID NO: 182213 - DNA, 15 bp, Homo sapiens
tcaaatctacctatg

SEQ ID NO: 182214 - DNA, 15 bp, Homo sapiens
ttcaaatctacctat

SEQ ID NO: 182215 - DNA, 15 bp, Homo sapiens
tttcaaatctaccta

SEQ ID NO: 182216 - DNA, 15 bp, Homo sapiens
ttttcaaatctacct

SEQ ID NO: 182217 - DNA, 15 bp, Homo sapiens
attttcaaatctacc

SEQ ID NO: 182218 - DNA, 15 bp, Homo sapiens
aattttcaaatctac

SEQ ID NO: 182219 - DNA, 15 bp, Homo sapiens
aaattttcaaatcta

SEQ ID NO: 182220 - DNA, 15 bp, Homo sapiens
aaaattttcaaatct

SEQ ID NO: 182221 - DNA, 15 bp, Homo sapiens
gaaaattttcaaatc

SEQ ID NO: 182222 - DNA, 15 bp, Homo sapiens
agaaaattttcaaat

SEQ ID NO: 182223 - DNA, 15 bp, Homo sapiens
cagaaaattttcaaa

SEQ ID NO: 182224 - DNA, 15 bp, Homo sapiens
tcagaaaattttcaa

SEQ ID NO: 182225 - DNA, 15 bp, Homo sapiens
atcagaaaattttca

SEQ ID NO: 182226 - DNA, 15 bp, Homo sapiens
aatcagaaaattttc

SEQ ID NO: 182227 - DNA, 15 bp, Homo sapiens
caatcagaaaatttt

SEQ ID NO: 182228 - DNA, 15 bp, Homo sapiens
gcaatcagaaaattt

SEQ ID NO: 182229 - DNA, 15 bp, Homo sapiens
ggcaatcagaaaatt

SEQ ID NO: 182230 - DNA, 15 bp, Homo sapiens
aggcaatcagaaaat

SEQ ID NO: 182231 - DNA, 15 bp, Homo sapiens
taggcaatcagaaaa

SEQ ID NO: 182232 - DNA, 15 bp, Homo sapiens
ataggcaatcagaaa

SEQ ID NO: 182233 - DNA, 15 bp, Homo sapiens
aataggcaatcagaa

SEQ ID NO: 182234 - DNA, 15 bp, Homo sapiens
caataggcaatcaga

SEQ ID NO: 182235 - DNA, 15 bp, Homo sapiens
ccaataggcaatcag

SEQ ID NO: 182236 - DNA, 15 bp, Homo sapiens
accaataggcaatca

SEQ ID NO: 182237 - DNA, 15 bp, Homo sapiens
aaccaataggcaatc

SEQ ID NO: 182238 - DNA, 15 bp, Homo sapiens
caaccaataggcaat

SEQ ID NO: 182239 - DNA, 15 bp, Homo sapiens
tcaaccaataggcaa

SEQ ID NO: 182240 - DNA, 15 bp, Homo sapiens
ttcaaccaataggca

SEQ ID NO: 182241 - DNA, 15 bp, Homo sapiens
tttcaaccaataggc

SEQ ID NO: 182242 - DNA, 15 bp, Homo sapiens
ctttcaaccaatagg

SEQ ID NO: 182243 - DNA, 15 bp, Homo sapiens
tctttcaaccaatag

SEQ ID NO: 182244 - DNA, 15 bp, Homo sapiens
ttctttcaaccaata

SEQ ID NO: 182245 - DNA, 15 bp, Homo sapiens
attctttcaaccaat

SEQ ID NO: 182246 - DNA, 15 bp, Homo sapiens
aattctttcaaccaa

SEQ ID NO: 182247 - DNA, 15 bp, Homo sapiens
taattctttcaacca

SEQ ID NO: 182248 - DNA, 15 bp, Homo sapiens
ataattctttcaacc

SEQ ID NO: 182249 - DNA, 15 bp, Homo sapiens
aataattctttcaac

SEQ ID NO: 182250 - DNA, 15 bp, Homo sapiens
gaataattctttcaa

SEQ ID NO: 182251 - DNA, 15 bp, Homo sapiens
tgaataattctttca

SEQ ID NO: 182252 - DNA, 15 bp, Homo sapiens
ttgaataattctttc

SEQ ID NO: 182253 - DNA, 15 bp, Homo sapiens
attgaataattcttt

SEQ ID NO: 182254 - DNA, 15 bp, Homo sapiens
cattgaataattctt

SEQ ID NO: 182255 - DNA, 15 bp, Homo sapiens
acattgaataattct

SEQ ID NO: 182256 - DNA, 15 bp, Homo sapiens
tacattgaataattc

SEQ ID NO: 182257 - DNA, 15 bp, Homo sapiens
ctacattgaataatt

SEQ ID NO: 182258 - DNA, 15 bp, Homo sapiens
tctacattgaataat

SEQ ID NO: 182259 - DNA, 15 bp, Homo sapiens
ttctacattgaataa

SEQ ID NO: 182260 - DNA, 15 bp, Homo sapiens
tttctacattgaata

SEQ ID NO: 182261 - DNA, 15 bp, Homo sapiens
ttttctacattgaat

SEQ ID NO: 182262 - DNA, 15 bp, Homo sapiens
cttttctacattgaa

SEQ ID NO: 182263 - DNA, 15 bp, Homo sapiens
tcttttctacattga

SEQ ID NO: 182264 - DNA, 15 bp, Homo sapiens
ttcttttctacattg

SEQ ID NO: 182265 - DNA, 15 bp, Homo sapiens
attcttttctacatt

SEQ ID NO: 182266 - DNA, 15 bp, Homo sapiens
cattcttttctacat

SEQ ID NO: 182267 - DNA, 15 bp, Homo sapiens
acattcttttctaca

SEQ ID NO: 182268 - DNA, 15 bp, Homo sapiens
gacattcttttctac

SEQ ID NO: 182269 - DNA, 15 bp, Homo sapiens
agacattcttttcta

SEQ ID NO: 182270 - DNA, 15 bp, Homo sapiens
cagacattcttttct

SEQ ID NO: 182271 - DNA, 15 bp, Homo sapiens
ccagacattcttttc

SEQ ID NO: 182272 - DNA, 15 bp, Homo sapiens
cccagacattctttt

SEQ ID NO: 182273 - DNA, 15 bp, Homo sapiens
acccagacattcttt

SEQ ID NO: 182274 - DNA, 15 bp, Homo sapiens
aacccagacattctt

SEQ ID NO: 182275 - DNA, 15 bp, Homo sapiens
taacccagacattct

SEQ ID NO: 182276 - DNA, 15 bp, Homo sapiens
gtaacccagacattc

SEQ ID NO: 182277 - DNA, 15 bp, Homo sapiens
tgtaacccagacatt

SEQ ID NO: 182278 - DNA, 15 bp, Homo sapiens
ttgtaacccagacat

SEQ ID NO: 182279 - DNA, 15 bp, Homo sapiens
attgtaacccagaca

SEQ ID NO: 182280 - DNA, 15 bp, Homo sapiens
tattgtaacccagac

SEQ ID NO: 182281 - DNA, 15 bp, Homo sapiens
ttattgtaacccaga

SEQ ID NO: 182282 - DNA, 15 bp, Homo sapiens
cttattgtaacccag

SEQ ID NO: 182283 - DNA, 15 bp, Homo sapiens
ccttattgtaaccca

SEQ ID NO: 182284 - DNA, 15 bp, Homo sapiens
cccttattgtaaccc

SEQ ID NO: 182285 - DNA, 15 bp, Homo sapiens
ccccttattgtaacc

SEQ ID NO: 182286 - DNA, 15 bp, Homo sapiens
accccttattgtaac

SEQ ID NO: 182287 - DNA, 15 bp, Homo sapiens
aaccccttattgtaa

SEQ ID NO: 182288 - DNA, 15 bp, Homo sapiens
caaccccttattgta

SEQ ID NO: 182289 - DNA, 15 bp, Homo sapiens
acaaccccttattgt

SEQ ID NO: 182290 - DNA, 15 bp, Homo sapiens
cacaaccccttattg

SEQ ID NO: 182291 - DNA, 15 bp, Homo sapiens
tcacaaccccttatt

SEQ ID NO: 182292 - DNA, 15 bp, Homo sapiens
ttcacaaccccttat

SEQ ID NO: 182293 - DNA, 15 bp, Homo sapiens
cttcacaacccctta

SEQ ID NO: 182294 - DNA, 15 bp, Homo sapiens
tcttcacaacccctt

SEQ ID NO: 182295 - DNA, 15 bp, Homo sapiens
gtcttcacaacccct

SEQ ID NO: 182296 - DNA, 15 bp, Homo sapiens
agtcttcacaacccc

SEQ ID NO: 182297 - DNA, 15 bp, Homo sapiens
tagtcttcacaaccc

SEQ ID NO: 182298 - DNA, 15 bp, Homo sapiens
ttagtcttcacaacc

SEQ ID NO: 182299 - DNA, 15 bp, Homo sapiens
tttagtcttcacaac

SEQ ID NO: 182300 - DNA, 15 bp, Homo sapiens
ctttagtcttcacaa

SEQ ID NO: 182301 - DNA, 15 bp, Homo sapiens
actttagtcttcaca

SEQ ID NO: 182302 - DNA, 15 bp, Homo sapiens
aactttagtcttcac

SEQ ID NO: 182303 - DNA, 15 bp, Homo sapiens
aaactttagtcttca

SEQ ID NO: 182304 - DNA, 15 bp, Homo sapiens
aaaactttagtcttc

SEQ ID NO: 182305 - DNA, 15 bp, Homo sapiens
taaaactttagtctt

SEQ ID NO: 182306 - DNA, 15 bp, Homo sapiens
ataaaactttagtct

SEQ ID NO: 182307 - DNA, 15 bp, Homo sapiens
gataaaactttagtc

SEQ ID NO: 182308 - DNA, 15 bp, Homo sapiens
ggataaaactttagt

SEQ ID NO: 182309 - DNA, 15 bp, Homo sapiens
aggataaaactttag

SEQ ID NO: 182310 - DNA, 15 bp, Homo sapiens
caggataaaacttta

SEQ ID NO: 182311 - DNA, 15 bp, Homo sapiens
gcaggataaaacttt

SEQ ID NO: 182312 - DNA, 15 bp, Homo sapiens
agcaggataaaactt

SEQ ID NO: 182313 - DNA, 15 bp, Homo sapiens
cagcaggataaaact

SEQ ID NO: 182314 - DNA, 15 bp, Homo sapiens
ccagcaggataaaac

SEQ ID NO: 182315 - DNA, 15 bp, Homo sapiens
cccagcaggataaaa

SEQ ID NO: 182316 - DNA, 15 bp, Homo sapiens
ccccagcaggataaa

SEQ ID NO: 182317 - DNA, 15 bp, Homo sapiens
tccccagcaggataa

SEQ ID NO: 182318 - DNA, 15 bp, Homo sapiens
ttccccagcaggata

SEQ ID NO: 182319 - DNA, 15 bp, Homo sapiens
cttccccagcaggat

SEQ ID NO: 182320 - DNA, 15 bp, Homo sapiens
gcttccccagcagga

SEQ ID NO: 182321 - DNA, 15 bp, Homo sapiens
ggcttccccagcagg

SEQ ID NO: 182322 - DNA, 15 bp, Homo sapiens
aggcttccccagcag

SEQ ID NO: 182323 - DNA, 15 bp, Homo sapiens
gaggcttccccagca

SEQ ID NO: 182324 - DNA, 15 bp, Homo sapiens
ggaggcttccccagc

SEQ ID NO: 182325 - DNA, 15 bp, Homo sapiens
tggaggcttccccag

SEQ ID NO: 182326 - DNA, 15 bp, Homo sapiens
ttggaggcttcccca

SEQ ID NO: 182327 - DNA, 15 bp, Homo sapiens
cttggaggcttcccc

SEQ ID NO: 182328 - DNA, 15 bp, Homo sapiens
acttggaggcttccc

SEQ ID NO: 182329 - DNA, 15 bp, Homo sapiens
tacttggaggcttcc

SEQ ID NO: 182330 - DNA, 15 bp, Homo sapiens
ctacttggaggcttc

SEQ ID NO: 182331 - DNA, 15 bp, Homo sapiens
gctacttggaggctt

SEQ ID NO: 182332 - DNA, 15 bp, Homo sapiens
tgctacttggaggct

SEQ ID NO: 182333 - DNA, 15 bp, Homo sapiens
ctgctacttggaggc

SEQ ID NO: 182334 - DNA, 15 bp, Homo sapiens
cctgctacttggagg

SEQ ID NO: 182335 - DNA, 15 bp, Homo sapiens
gcctgctacttggag

SEQ ID NO: 182336 - DNA, 15 bp, Homo sapiens
agcctgctacttgga

SEQ ID NO: 182337 - DNA, 15 bp, Homo sapiens
aagcctgctacttgg

SEQ ID NO: 182338 - DNA, 15 bp, Homo sapiens
gaagcctgctacttg

SEQ ID NO: 182339 - DNA, 15 bp, Homo sapiens
tgaagcctgctactt

SEQ ID NO: 182340 - DNA, 15 bp, Homo sapiens
ctgaagcctgctact

SEQ ID NO: 182341 - DNA, 15 bp, Homo sapiens
tctgaagcctgctac

SEQ ID NO: 182342 - DNA, 15 bp, Homo sapiens
gttctctctgaagcc

SEQ ID NO: 182343 - DNA, 15 bp, Homo sapiens
tgttctctctgaagc

SEQ ID NO: 182344 - DNA, 15 bp, Homo sapiens
ctgttctctctgaag

SEQ ID NO: 182345 - DNA, 15 bp, Homo sapiens
tctgttctctctgaa

SEQ ID NO: 182346 - DNA, 15 bp, Homo sapiens
atctgttctctctga

SEQ ID NO: 182347 - DNA, 15 bp, Homo sapiens
aatctgttctctctg

SEQ ID NO: 182348 - DNA, 15 bp, Homo sapiens
taatctgttctctct

SEQ ID NO: 182349 - DNA, 15 bp, Homo sapiens
gtaatctgttctctc

SEQ ID NO: 182350 - DNA, 15 bp, Homo sapiens
tgtaatctgttctct

SEQ ID NO: 182351 - DNA, 15 bp, Homo sapiens
ctgtaatctgttctc

SEQ ID NO: 182352 - DNA, 15 bp, Homo sapiens
tctgtaatctgttct

SEQ ID NO: 182353 - DNA, 15 bp, Homo sapiens
atctgtaatctgttc

SEQ ID NO: 182354 - DNA, 15 bp, Homo sapiens
catctgtaatctgtt

SEQ ID NO: 182355 - DNA, 15 bp, Homo sapiens
acatctgtaatctgt

SEQ ID NO: 182356 - DNA, 15 bp, Homo sapiens
aacatctgtaatctg

SEQ ID NO: 182357 - DNA, 15 bp, Homo sapiens
aaacatctgtaatct

SEQ ID NO: 182358 - DNA, 15 bp, Homo sapiens
gaaacatctgtaatc

SEQ ID NO: 182359 - DNA, 15 bp, Homo sapiens
tgaaacatctgtaat

SEQ ID NO: 182360 - DNA, 15 bp, Homo sapiens
atgaaacatctgtaa

SEQ ID NO: 182361 - DNA, 15 bp, Homo sapiens
tatgaaacatctgta

SEQ ID NO: 182362 - DNA, 15 bp, Homo sapiens
atatgaaacatctgt

SEQ ID NO: 182363 - DNA, 15 bp, Homo sapiens
gatatgaaacatctg

SEQ ID NO: 182364 - DNA, 15 bp, Homo sapiens
tgatatgaaacatct

SEQ ID NO: 182365 - DNA, 15 bp, Homo sapiens
ctgatatgaaacatc

SEQ ID NO: 182366 - DNA, 15 bp, Homo sapiens
tctgatatgaaacat

SEQ ID NO: 182367 - DNA, 15 bp, Homo sapiens
gtctgatatgaaaca

SEQ ID NO: 182368 - DNA, 15 bp, Homo sapiens
agtctgatatgaaac

SEQ ID NO: 182369 - DNA, 15 bp, Homo sapiens
aagtctgatatgaaa

SEQ ID NO: 182370 - DNA, 15 bp, Homo sapiens
taagtctgatatgaa

SEQ ID NO: 182371 - DNA, 15 bp, Homo sapiens
ttaagtctgatatga

SEQ ID NO: 182372 - DNA, 15 bp, Homo sapiens
tttaagtctgatatg

SEQ ID NO: 182373 - DNA, 15 bp, Homo sapiens
ctttaagtctgatat

SEQ ID NO: 182374 - DNA, 15 bp, Homo sapiens
actttaagtctgata

SEQ ID NO: 182375 - DNA, 15 bp, Homo sapiens
gactttaagtctgat

SEQ ID NO: 182376 - DNA, 15 bp, Homo sapiens
agactttaagtctga

SEQ ID NO: 182377 - DNA, 15 bp, Homo sapiens
cagactttaagtctg

SEQ ID NO: 182378 - DNA, 15 bp, Homo sapiens
acagactttaagtct

SEQ ID NO: 182379 - DNA, 15 bp, Homo sapiens
cacagactttaagtc

SEQ ID NO: 182380 - DNA, 15 bp, Homo sapiens
acacagactttaagt

SEQ ID NO: 182381 - DNA, 15 bp, Homo sapiens
aacacagactttaag

SEQ ID NO: 182382 - DNA, 15 bp, Homo sapiens
caacacagactttaa

SEQ ID NO: 182383 - DNA, 15 bp, Homo sapiens
tcaacacagacttta

SEQ ID NO: 182384 - DNA, 15 bp, Homo sapiens
atcaacacagacttt

SEQ ID NO: 182385 - DNA, 15 bp, Homo sapiens
catcaacacagactt

SEQ ID NO: 182386 - DNA, 15 bp, Homo sapiens
acatcaacacagact

SEQ ID NO: 182387 - DNA, 15 bp, Homo sapiens
aacatcaacacagac

SEQ ID NO: 182388 - DNA, 15 bp, Homo sapiens
taacatcaacacaga

SEQ ID NO: 182389 - DNA, 15 bp, Homo sapiens
ttaacatcaacacag

SEQ ID NO: 182390 - DNA, 15 bp, Homo sapiens
attaacatcaacaca

SEQ ID NO: 182391 - DNA, 15 bp, Homo sapiens
cattaacatcaacac

SEQ ID NO: 182392 - DNA, 15 bp, Homo sapiens
gcattaacatcaaca

SEQ ID NO: 182393 - DNA, 15 bp, Homo sapiens
agcattaacatcaac

SEQ ID NO: 182394 - DNA, 15 bp, Homo sapiens
cagcattaacatcaa

SEQ ID NO: 182395 - DNA, 15 bp, Homo sapiens
ccagcattaacatca

SEQ ID NO: 182396 - DNA, 15 bp, Homo sapiens
tccagcattaacatc

SEQ ID NO: 182397 - DNA, 15 bp, Homo sapiens
ctccagcattaacat

SEQ ID NO: 182398 - DNA, 15 bp, Homo sapiens
cctccagcattaaca

SEQ ID NO: 182399 - DNA, 15 bp, Homo sapiens
ccctccagcattaac

SEQ ID NO: 182400 - DNA, 15 bp, Homo sapiens
cccctccagcattaa

SEQ ID NO: 182401 - DNA, 15 bp, Homo sapiens
acccctccagcatta

SEQ ID NO: 182402 - DNA, 15 bp, Homo sapiens
cacccctccagcatt

SEQ ID NO: 182403 - DNA, 15 bp, Homo sapiens
acacccctccagcat

SEQ ID NO: 182404 - DNA, 15 bp, Homo sapiens
tacacccctccagca

SEQ ID NO: 182405 - DNA, 15 bp, Homo sapiens
ttacacccctccagc

SEQ ID NO: 182406 - DNA, 15 bp, Homo sapiens
attacacccctccag

SEQ ID NO: 182407 - DNA, 15 bp, Homo sapiens
cattacacccctcca

SEQ ID NO: 182408 - DNA, 15 bp, Homo sapiens
tcattacacccctcc

SEQ ID NO: 182409 - DNA, 15 bp, Homo sapiens
ctcattacacccctc

SEQ ID NO: 182410 - DNA, 15 bp, Homo sapiens
cctcattacacccct

SEQ ID NO: 182411 - DNA, 15 bp, Homo sapiens
gcctcattacacccc

SEQ ID NO: 182412 - DNA, 15 bp, Homo sapiens
tgcctcattacaccc

SEQ ID NO: 182413 - DNA, 15 bp, Homo sapiens
atgcctcattacacc

SEQ ID NO: 182414 - DNA, 15 bp, Homo sapiens
catgcctcattacac

SEQ ID NO: 182415 - DNA, 15 bp, Homo sapiens
acatgcctcattaca

SEQ ID NO: 182416 - DNA, 15 bp, Homo sapiens
aacatgcctcattac

SEQ ID NO: 182417 - DNA, 15 bp, Homo sapiens
caacatgcctcatta

SEQ ID NO: 182418 - DNA, 15 bp, Homo sapiens
tcaacatgcctcatt

SEQ ID NO: 182419 - DNA, 15 bp, Homo sapiens
gtcaacatgcctcat

SEQ ID NO: 182420 - DNA, 15 bp, Homo sapiens
ggtcaacatgcctca

SEQ ID NO: 182421 - DNA, 15 bp, Homo sapiens
gggtcaacatgcctc

SEQ ID NO: 182422 - DNA, 15 bp, Homo sapiens
ggggtcaacatgcct

SEQ ID NO: 182423 - DNA, 15 bp, Homo sapiens
gggggtcaacatgcc

SEQ ID NO: 182424 - DNA, 15 bp, Homo sapiens
agggggtcaacatgc

SEQ ID NO: 182425 - DNA, 15 bp, Homo sapiens
gagggggtcaacatg

SEQ ID NO: 182426 - DNA, 15 bp, Homo sapiens
agagggggtcaacat

SEQ ID NO: 182427 - DNA, 15 bp, Homo sapiens
aagagggggtcaaca

SEQ ID NO: 182428 - DNA, 15 bp, Homo sapiens
gaagagggggtcaac

SEQ ID NO: 182429 - DNA, 15 bp, Homo sapiens
ggaagagggggtcaa

SEQ ID NO: 182430 - DNA, 15 bp, Homo sapiens
tggaagagggggtca

SEQ ID NO: 182431 - DNA, 15 bp, Homo sapiens
atggaagagggggtc

SEQ ID NO: 182432 - DNA, 15 bp, Homo sapiens
gatggaagagggggt

SEQ ID NO: 182433 - DNA, 15 bp, Homo sapiens
agatggaagaggggg

SEQ ID NO: 182434 - DNA, 15 bp, Homo sapiens
aagatggaagagggg

SEQ ID NO: 182435 - DNA, 15 bp, Homo sapiens
caagatggaagaggg

SEQ ID NO: 182436 - DNA, 15 bp, Homo sapiens
ccaagatggaagagg

SEQ ID NO: 182437 - DNA, 15 bp, Homo sapiens
gccaagatggaagag

SEQ ID NO: 182438 - DNA, 15 bp, Homo sapiens
ggccaagatggaaga

SEQ ID NO: 182439 - DNA, 15 bp, Homo sapiens
aggccaagatggaag

SEQ ID NO: 182440 - DNA, 15 bp, Homo sapiens
caggccaagatggaa

SEQ ID NO: 182441 - DNA, 15 bp, Homo sapiens
tcaggccaagatgga

SEQ ID NO: 182442 - DNA, 15 bp, Homo sapiens
ttcaggccaagatgg

SEQ ID NO: 182443 - DNA, 15 bp, Homo sapiens
gttcaggccaagatg

SEQ ID NO: 182444 - DNA, 15 bp, Homo sapiens
agttcaggccaagat

SEQ ID NO: 182445 - DNA, 15 bp, Homo sapiens
tagttcaggccaaga

SEQ ID NO: 182446 - DNA, 15 bp, Homo sapiens
ctagttcaggccaag

SEQ ID NO: 182447 - DNA, 15 bp, Homo sapiens
actagttcaggccaa

SEQ ID NO: 182448 - DNA, 15 bp, Homo sapiens
aactagttcaggcca

SEQ ID NO: 182449 - DNA, 15 bp, Homo sapiens
aaactagttcaggcc

SEQ ID NO: 182450 - DNA, 15 bp, Homo sapiens
aaaactagttcaggc

SEQ ID NO: 182451 - DNA, 15 bp, Homo sapiens
aaaaactagttcagg

SEQ ID NO: 182452 - DNA, 15 bp, Homo sapiens
gaaaaactagttcag

SEQ ID NO: 182453 - DNA, 15 bp, Homo sapiens
tgaaaaactagttca

SEQ ID NO: 182454 - DNA, 15 bp, Homo sapiens
ctgaaaaactagttc

SEQ ID NO: 182455 - DNA, 15 bp, Homo sapiens
cctgaaaaactagtt

SEQ ID NO: 182456 - DNA, 15 bp, Homo sapiens
acctgaaaaactagt

SEQ ID NO: 182457 - DNA, 15 bp, Homo sapiens
aacctgaaaaactag

SEQ ID NO: 182458 - DNA, 15 bp, Homo sapiens
taacctgaaaaacta

SEQ ID NO: 182459 - DNA, 15 bp, Homo sapiens
ttaacctgaaaaact

SEQ ID NO: 182460 - DNA, 15 bp, Homo sapiens
gttaacctgaaaaac

SEQ ID NO: 182461 - DNA, 15 bp, Homo sapiens
agttaacctgaaaaa

SEQ ID NO: 182462 - DNA, 15 bp, Homo sapiens
gagttaacctgaaaa

SEQ ID NO: 182463 - DNA, 15 bp, Homo sapiens
agagttaacctgaaa

SEQ ID NO: 182464 - DNA, 15 bp, Homo sapiens
cagagttaacctgaa

SEQ ID NO: 182465 - DNA, 15 bp, Homo sapiens
ccagagttaacctga

SEQ ID NO: 182466 - DNA, 15 bp, Homo sapiens
tccagagttaacctg

SEQ ID NO: 182467 - DNA, 15 bp, Homo sapiens
ttccagagttaacct

SEQ ID NO: 182468 - DNA, 15 bp, Homo sapiens
gttccagagttaacc

SEQ ID NO: 182469 - DNA, 15 bp, Homo sapiens
cgttccagagttaac

SEQ ID NO: 182470 - DNA, 15 bp, Homo sapiens
gcgttccagagttaa

SEQ ID NO: 182471 - DNA, 15 bp, Homo sapiens
ggcgttccagagtta

SEQ ID NO: 182472 - DNA, 15 bp, Homo sapiens
gggcgttccagagtt

SEQ ID NO: 182473 - DNA, 15 bp, Homo sapiens
agggcgttccagagt

SEQ ID NO: 182474 - DNA, 15 bp, Homo sapiens
aagggcgttccagag

SEQ ID NO: 182475 - DNA, 15 bp, Homo sapiens
caagggcgttccaga

SEQ ID NO: 182476 - DNA, 15 bp, Homo sapiens
ccaagggcgttccag

SEQ ID NO: 182477 - DNA, 15 bp, Homo sapiens
gccaagggcgttcca

SEQ ID NO: 182478 - DNA, 15 bp, Homo sapiens
ggccaagggcgttcc

SEQ ID NO: 182479 - DNA, 15 bp, Homo sapiens
tggccaagggcgttc

SEQ ID NO: 182480 - DNA, 15 bp, Homo sapiens
ttggccaagggcgtt

SEQ ID NO: 182481 - DNA, 15 bp, Homo sapiens
cttggccaagggcgt

SEQ ID NO: 182482 - DNA, 15 bp, Homo sapiens
tcttggccaagggcg

SEQ ID NO: 182483 - DNA, 15 bp, Homo sapiens
ctcttggccaagggc

SEQ ID NO: 182484 - DNA, 15 bp, Homo sapiens
cctcttggccaaggg

SEQ ID NO: 182485 - DNA, 15 bp, Homo sapiens
tcctcttggccaagg

SEQ ID NO: 182486 - DNA, 15 bp, Homo sapiens
atcctcttggccaag

SEQ ID NO: 182487 - DNA, 15 bp, Homo sapiens
aatcctcttggccaa

SEQ ID NO: 182488 - DNA, 15 bp, Homo sapiens
caatcctcttggcca

SEQ ID NO: 182489 - DNA, 15 bp, Homo sapiens
ccaatcctcttggcc

SEQ ID NO: 182490 - DNA, 15 bp, Homo sapiens
accaatcctcttggc

SEQ ID NO: 182491 - DNA, 15 bp, Homo sapiens
gaccaatcctcttgg

SEQ ID NO: 182492 - DNA, 15 bp, Homo sapiens
ggaccaatcctcttg

SEQ ID NO: 182493 - DNA, 15 bp, Homo sapiens
tggaccaatcctctt

SEQ ID NO: 182494 - DNA, 15 bp, Homo sapiens
atggaccaatcctct

SEQ ID NO: 182495 - DNA, 15 bp, Homo sapiens
aatggaccaatcctc

SEQ ID NO: 182496 - DNA, 15 bp, Homo sapiens
gaatggaccaatcct

SEQ ID NO: 182497 - DNA, 15 bp, Homo sapiens
tgaatggaccaatcc

SEQ ID NO: 182498 - DNA, 15 bp, Homo sapiens
ctgaatggaccaatc

SEQ ID NO: 182499 - DNA, 15 bp, Homo sapiens
tctgaatggaccaat

SEQ ID NO: 182500 - DNA, 15 bp, Homo sapiens
atctgaatggaccaa

SEQ ID NO: 182501 - DNA, 15 bp, Homo sapiens
catctgaatggacca

SEQ ID NO: 182502 - DNA, 15 bp, Homo sapiens
ccatctgaatggacc

SEQ ID NO: 182503 - DNA, 15 bp, Homo sapiens
accatctgaatggac

SEQ ID NO: 182504 - DNA, 15 bp, Homo sapiens
aaccatctgaatgga

SEQ ID NO: 182505 - DNA, 15 bp, Homo sapiens
taaccatctgaatgg

SEQ ID NO: 182506 - DNA, 15 bp, Homo sapiens
ctaaccatctgaatg

SEQ ID NO: 182507 - DNA, 15 bp, Homo sapiens
cctaaccatctgaat

SEQ ID NO: 182508 - DNA, 15 bp, Homo sapiens
ccctaaccatctgaa

SEQ ID NO: 182509 - DNA, 15 bp, Homo sapiens
cccctaaccatctga

SEQ ID NO: 182510 - DNA, 15 bp, Homo sapiens
ccccctaaccatctg

SEQ ID NO: 182511 - DNA, 15 bp, Homo sapiens
cccccctaaccatct

SEQ ID NO: 182512 - DNA, 15 bp, Homo sapiens
gcccccctaaccatc

SEQ ID NO: 182513 - DNA, 15 bp, Homo sapiens
tgcccccctaaccat

SEQ ID NO: 182514 - DNA, 15 bp, Homo sapiens
atgcccccctaacca

SEQ ID NO: 182515 - DNA, 15 bp, Homo sapiens
catgcccccctaacc

SEQ ID NO: 182516 - DNA, 15 bp, Homo sapiens
acatgcccccctaac

SEQ ID NO: 182517 - DNA, 15 bp, Homo sapiens
tacatgcccccctaa

SEQ ID NO: 182518 - DNA, 15 bp, Homo sapiens
ctacatgccccccta

SEQ ID NO: 182519 - DNA, 15 bp, Homo sapiens
tctacatgcccccct

SEQ ID NO: 182520 - DNA, 15 bp, Homo sapiens
ctctacatgcccccc

SEQ ID NO: 182521 - DNA, 15 bp, Homo sapiens
actctacatgccccc

SEQ ID NO: 182522 - DNA, 15 bp, Homo sapiens
aactctacatgcccc

SEQ ID NO: 182523 - DNA, 15 bp, Homo sapiens
aaactctacatgccc

SEQ ID NO: 182524 - DNA, 15 bp, Homo sapiens
aaaactctacatgcc

SEQ ID NO: 182525 - DNA, 15 bp, Homo sapiens
taaaactctacatgc

SEQ ID NO: 182526 - DNA, 15 bp, Homo sapiens
ataaaactctacatg

SEQ ID NO: 182527 - DNA, 15 bp, Homo sapiens
aataaaactctacat

SEQ ID NO: 182528 - DNA, 15 bp, Homo sapiens
aaataaaactctaca

SEQ ID NO: 182529 - DNA, 15 bp, Homo sapiens
aaaataaaactctac

SEQ ID NO: 182530 - DNA, 15 bp, Homo sapiens
caaaataaaactcta

SEQ ID NO: 182531 - DNA, 15 bp, Homo sapiens
ccaaaataaaactct

SEQ ID NO: 182532 - DNA, 15 bp, Homo sapiens
cccaaaataaaactc

SEQ ID NO: 182533 - DNA, 15 bp, Homo sapiens
acccaaaataaaact

SEQ ID NO: 182534 - DNA, 15 bp, Homo sapiens
aacccaaaataaaac

SEQ ID NO: 182535 - DNA, 15 bp, Homo sapiens
aaacccaaaataaaa

SEQ ID NO: 182536 - DNA, 15 bp, Homo sapiens
taaacccaaaataaa

SEQ ID NO: 182537 - DNA, 15 bp, Homo sapiens
gtaaacccaaaataa

SEQ ID NO: 182538 - DNA, 15 bp, Homo sapiens
tgtaaacccaaaata

SEQ ID NO: 182539 - DNA, 15 bp, Homo sapiens
atgtaaacccaaaat

SEQ ID NO: 182540 - DNA, 15 bp, Homo sapiens
tatgtaaacccaaaa

SEQ ID NO: 182541 - DNA, 15 bp, Homo sapiens
ttatgtaaacccaaa

SEQ ID NO: 182542 - DNA, 15 bp, Homo sapiens
gttatgtaaacccaa

SEQ ID NO: 182543 - DNA, 15 bp, Homo sapiens
ggttatgtaaaccca

SEQ ID NO: 182544 - DNA, 15 bp, Homo sapiens
gggttatgtaaaccc

SEQ ID NO: 182545 - DNA, 15 bp, Homo sapiens
tgggttatgtaaacc

SEQ ID NO: 182546 - DNA, 15 bp, Homo sapiens
atgggttatgtaaac

SEQ ID NO: 182547 - DNA, 15 bp, Homo sapiens
aatgggttatgtaaa

SEQ ID NO: 182548 - DNA, 15 bp, Homo sapiens
taatgggttatgtaa

SEQ ID NO: 182549 - DNA, 15 bp, Homo sapiens
ataatgggttatgta

SEQ ID NO: 182550 - DNA, 15 bp, Homo sapiens
cataatgggttatgt

SEQ ID NO: 182551 - DNA, 15 bp, Homo sapiens
ccataatgggttatg

SEQ ID NO: 182552 - DNA, 15 bp, Homo sapiens
tccataatgggttat

SEQ ID NO: 182553 - DNA, 15 bp, Homo sapiens
ttccataatgggtta

SEQ ID NO: 182554 - DNA, 15 bp, Homo sapiens
tttccataatgggtt

SEQ ID NO: 182555 - DNA, 15 bp, Homo sapiens
atttccataatgggt

SEQ ID NO: 182556 - DNA, 15 bp, Homo sapiens
catttccataatggg

SEQ ID NO: 182557 - DNA, 15 bp, Homo sapiens
tcatttccataatgg

SEQ ID NO: 182558 - DNA, 15 bp, Homo sapiens
atcatttccataatg

SEQ ID NO: 182559 - DNA, 15 bp, Homo sapiens
aatcatttccataat

SEQ ID NO: 182560 - DNA, 15 bp, Homo sapiens
gaatcatttccataa

SEQ ID NO: 182561 - DNA, 15 bp, Homo sapiens
ggaatcatttccata

SEQ ID NO: 182562 - DNA, 15 bp, Homo sapiens
aggaatcatttccat

SEQ ID NO: 182563 - DNA, 15 bp, Homo sapiens
aaggaatcatttcca

SEQ ID NO: 182564 - DNA, 15 bp, Homo sapiens
caaggaatcatttcc

SEQ ID NO: 182565 - DNA, 15 bp, Homo sapiens
ccaaggaatcatttc

SEQ ID NO: 182566 - DNA, 15 bp, Homo sapiens
gccaaggaatcattt

SEQ ID NO: 182567 - DNA, 15 bp, Homo sapiens
ggccaaggaatcatt

SEQ ID NO: 182568 - DNA, 15 bp, Homo sapiens
gggccaaggaatcat

SEQ ID NO: 182569 - DNA, 15 bp, Homo sapiens
agggccaaggaatca

SEQ ID NO: 182570 - DNA, 15 bp, Homo sapiens
tagggccaaggaatc

SEQ ID NO: 182571 - DNA, 15 bp, Homo sapiens
ttagggccaaggaat

SEQ ID NO: 182572 - DNA, 15 bp, Homo sapiens
cttagggccaaggaa

SEQ ID NO: 182573 - DNA, 15 bp, Homo sapiens
ccttagggccaagga

SEQ ID NO: 182574 - DNA, 15 bp, Homo sapiens
accttagggccaagg

SEQ ID NO: 182575 - DNA, 15 bp, Homo sapiens
taccttagggccaag

SEQ ID NO: 182576 - DNA, 15 bp, Homo sapiens
ttaccttagggccaa

SEQ ID NO: 182577 - DNA, 15 bp, Homo sapiens
attaccttagggcca

SEQ ID NO: 182578 - DNA, 15 bp, Homo sapiens
aattaccttagggcc

SEQ ID NO: 182579 - DNA, 15 bp, Homo sapiens
taattaccttagggc

SEQ ID NO: 182580 - DNA, 15 bp, Homo sapiens
ataattaccttaggg

SEQ ID NO: 182581 - DNA, 15 bp, Homo sapiens
tataattaccttagg

SEQ ID NO: 182582 - DNA, 15 bp, Homo sapiens
ctataattaccttag

SEQ ID NO: 182583 - DNA, 15 bp, Homo sapiens
tctataattacctta

SEQ ID NO: 182584 - DNA, 15 bp, Homo sapiens
atctataattacctt

SEQ ID NO: 182585 - DNA, 15 bp, Homo sapiens
aatctataattacct

SEQ ID NO: 182586 - DNA, 15 bp, Homo sapiens
gaatctataattacc

SEQ ID NO: 182587 - DNA, 15 bp, Homo sapiens
agaatctataattac

SEQ ID NO: 182588 - DNA, 15 bp, Homo sapiens
cagaatctataatta

SEQ ID NO: 182589 - DNA, 15 bp, Homo sapiens
ccagaatctataatt

SEQ ID NO: 182590 - DNA, 15 bp, Homo sapiens
tccagaatctataat

SEQ ID NO: 182591 - DNA, 15 bp, Homo sapiens
atccagaatctataa

SEQ ID NO: 182592 - DNA, 15 bp, Homo sapiens
catccagaatctata

SEQ ID NO: 182593 - DNA, 15 bp, Homo sapiens
gcatccagaatctat

SEQ ID NO: 182594 - DNA, 15 bp, Homo sapiens
ggcatccagaatcta

SEQ ID NO: 182595 - DNA, 15 bp, Homo sapiens
tggcatccagaatct

SEQ ID NO: 182596 - DNA, 15 bp, Homo sapiens
atggcatccagaatc

SEQ ID NO: 182597 - DNA, 15 bp, Homo sapiens
catggcatccagaat

SEQ ID NO: 182598 - DNA, 15 bp, Homo sapiens
gcatggcatccagaa

SEQ ID NO: 182599 - DNA, 15 bp, Homo sapiens
agcatggcatccaga

SEQ ID NO: 182600 - DNA, 15 bp, Homo sapiens
aagcatggcatccag

SEQ ID NO: 182601 - DNA, 15 bp, Homo sapiens
taagcatggcatcca

SEQ ID NO: 182602 - DNA, 15 bp, Homo sapiens
ataagcatggcatcc

SEQ ID NO: 182603 - DNA, 15 bp, Homo sapiens
tataagcatggcatc

SEQ ID NO: 182604 - DNA, 15 bp, Homo sapiens
atataagcatggcat

SEQ ID NO: 182605 - DNA, 15 bp, Homo sapiens
aatataagcatggca

SEQ ID NO: 182606 - DNA, 15 bp, Homo sapiens
taatataagcatggc

SEQ ID NO: 182607 - DNA, 15 bp, Homo sapiens
ttaatataagcatgg

SEQ ID NO: 182608 - DNA, 15 bp, Homo sapiens
cttaatataagcatg

SEQ ID NO: 182609 - DNA, 15 bp, Homo sapiens
acttaatataagcat

SEQ ID NO: 182610 - DNA, 15 bp, Homo sapiens
tacttaatataagca

SEQ ID NO: 182611 - DNA, 15 bp, Homo sapiens
ctacttaatataagc

SEQ ID NO: 182612 - DNA, 15 bp, Homo sapiens
tctacttaatataag

SEQ ID NO: 182613 - DNA, 15 bp, Homo sapiens
atctacttaatataa

SEQ ID NO: 182614 - DNA, 15 bp, Homo sapiens
tatctacttaatata

SEQ ID NO: 182615 - DNA, 15 bp, Homo sapiens
gtatctacttaatat

SEQ ID NO: 182616 - DNA, 15 bp, Homo sapiens
ggtatctacttaata

SEQ ID NO: 182617 - DNA, 15 bp, Homo sapiens
tggtatctacttaat

SEQ ID NO: 182618 - DNA, 15 bp, Homo sapiens
ttggtatctacttaa

SEQ ID NO: 182619 - DNA, 15 bp, Homo sapiens
tttggtatctactta

SEQ ID NO: 182620 - DNA, 15 bp, Homo sapiens
ttttggtatctactt

SEQ ID NO: 182621 - DNA, 15 bp, Homo sapiens
attttggtatctact

SEQ ID NO: 182622 - DNA, 15 bp, Homo sapiens
cattttggtatctac

SEQ ID NO: 182623 - DNA, 15 bp, Homo sapiens
gcattttggtatcta

SEQ ID NO: 182624 - DNA, 15 bp, Homo sapiens
agcattttggtatct

SEQ ID NO: 182625 - DNA, 15 bp, Homo sapiens
tagcattttggtatc

SEQ ID NO: 182626 - DNA, 15 bp, Homo sapiens
gtagcattttggtat

SEQ ID NO: 182627 - DNA, 15 bp, Homo sapiens
agtagcattttggta

SEQ ID NO: 182628 - DNA, 15 bp, Homo sapiens
aagtagcattttggt

SEQ ID NO: 182629 - DNA, 15 bp, Homo sapiens
aaagtagcattttgg

SEQ ID NO: 182630 - DNA, 15 bp, Homo sapiens
aaaagtagcattttg

SEQ ID NO: 182631 - DNA, 15 bp, Homo sapiens
taaaagtagcatttt

SEQ ID NO: 182632 - DNA, 15 bp, Homo sapiens
ctaaaagtagcattt

SEQ ID NO: 182633 - DNA, 15 bp, Homo sapiens
tctaaaagtagcatt

SEQ ID NO: 182634 - DNA, 15 bp, Homo sapiens
ctctaaaagtagcat

SEQ ID NO: 182635 - DNA, 15 bp, Homo sapiens
actctaaaagtagca

SEQ ID NO: 182636 - DNA, 15 bp, Homo sapiens
aactctaaaagtagc

SEQ ID NO: 182637 - DNA, 15 bp, Homo sapiens
aaactctaaaagtag

SEQ ID NO: 182638 - DNA, 15 bp, Homo sapiens
caaactctaaaagta

SEQ ID NO: 182639 - DNA, 15 bp, Homo sapiens
tcaaactctaaaagt

SEQ ID NO: 182640 - DNA, 15 bp, Homo sapiens
ctcaaactctaaaag

SEQ ID NO: 182641 - DNA, 15 bp, Homo sapiens
actcaaactctaaaa

SEQ ID NO: 182642 - DNA, 15 bp, Homo sapiens
aactcaaactctaaa

SEQ ID NO: 182643 - DNA, 15 bp, Homo sapiens
aaactcaaactctaa

SEQ ID NO: 182644 - DNA, 15 bp, Homo sapiens
gaaactcaaactcta

SEQ ID NO: 182645 - DNA, 15 bp, Homo sapiens
agaaactcaaactct

SEQ ID NO: 182646 - DNA, 15 bp, Homo sapiens
gagaaactcaaactc

SEQ ID NO: 182647 - DNA, 15 bp, Homo sapiens
agagaaactcaaact

SEQ ID NO: 182648 - DNA, 15 bp, Homo sapiens
aagagaaactcaaac

SEQ ID NO: 182649 - DNA, 15 bp, Homo sapiens
taagagaaactcaaa

SEQ ID NO: 182650 - DNA, 15 bp, Homo sapiens
gtaagagaaactcaa

SEQ ID NO: 182651 - DNA, 15 bp, Homo sapiens
cgtaagagaaactca

SEQ ID NO: 182652 - DNA, 15 bp, Homo sapiens
acgtaagagaaactc

SEQ ID NO: 182653 - DNA, 15 bp, Homo sapiens
aacgtaagagaaact

SEQ ID NO: 182654 - DNA, 15 bp, Homo sapiens
aaacgtaagagaaac

SEQ ID NO: 182655 - DNA, 15 bp, Homo sapiens
aaaacgtaagagaaa

SEQ ID NO: 182656 - DNA, 15 bp, Homo sapiens
aaaaacgtaagagaa

SEQ ID NO: 182657 - DNA, 15 bp, Homo sapiens
taaaaacgtaagaga

SEQ ID NO: 182658 - DNA, 15 bp, Homo sapiens
ctaaaaacgtaagag

SEQ ID NO: 182659 - DNA, 15 bp, Homo sapiens
tctaaaaacgtaaga

SEQ ID NO: 182660 - DNA, 15 bp, Homo sapiens
ttctaaaaacgtaag

SEQ ID NO: 182661 - DNA, 15 bp, Homo sapiens
tttctaaaaacgtaa

SEQ ID NO: 182662 - DNA, 15 bp, Homo sapiens
atttctaaaaacgta

SEQ ID NO: 182663 - DNA, 15 bp, Homo sapiens
aatttctaaaaacgt

SEQ ID NO: 182664 - DNA, 15 bp, Homo sapiens
gaatttctaaaaacg

SEQ ID NO: 182665 - DNA, 15 bp, Homo sapiens
tgaatttctaaaaac

SEQ ID NO: 182666 - DNA, 15 bp, Homo sapiens
ttgaatttctaaaaa

SEQ ID NO: 182667 - DNA, 15 bp, Homo sapiens
attgaatttctaaaa

SEQ ID NO: 182668 - DNA, 15 bp, Homo sapiens
aattgaatttctaaa

SEQ ID NO: 182669 - DNA, 15 bp, Homo sapiens
caattgaatttctaa

SEQ ID NO: 182670 - DNA, 15 bp, Homo sapiens
tcaattgaatttcta

SEQ ID NO: 182671 - DNA, 15 bp, Homo sapiens
ctcaattgaatttct

SEQ ID NO: 182672 - DNA, 15 bp, Homo sapiens
actcaattgaatttc

SEQ ID NO: 182673 - DNA, 15 bp, Homo sapiens
tactcaattgaattt

SEQ ID NO: 182674 - DNA, 15 bp, Homo sapiens
ctactcaattgaatt

SEQ ID NO: 182675 - DNA, 15 bp, Homo sapiens
tctactcaattgaat

SEQ ID NO: 182676 - DNA, 15 bp, Homo sapiens
ttctactcaattgaa

SEQ ID NO: 182677 - DNA, 15 bp, Homo sapiens
gttctactcaattga

SEQ ID NO: 182678 - DNA, 15 bp, Homo sapiens
agttctactcaattg

SEQ ID NO: 182679 - DNA, 15 bp, Homo sapiens
gagttctactcaatt

SEQ ID NO: 182680 - DNA, 15 bp, Homo sapiens
cgagttctactcaat

SEQ ID NO: 182681 - DNA, 15 bp, Homo sapiens
acgagttctactcaa

SEQ ID NO: 182682 - DNA, 15 bp, Homo sapiens
aacgagttctactca

SEQ ID NO: 182683 - DNA, 15 bp, Homo sapiens
taacgagttctactc

SEQ ID NO: 182684 - DNA, 15 bp, Homo sapiens
ataacgagttctact

SEQ ID NO: 182685 - DNA, 15 bp, Homo sapiens
aataacgagttctac

SEQ ID NO: 182686 - DNA, 15 bp, Homo sapiens
taataacgagttcta

SEQ ID NO: 182687 - DNA, 15 bp, Homo sapiens
ttaataacgagttct

SEQ ID NO: 182688 - DNA, 15 bp, Homo sapiens
cttaataacgagttc

SEQ ID NO: 182689 - DNA, 15 bp, Homo sapiens
ccttaataacgagtt

SEQ ID NO: 182690 - DNA, 15 bp, Homo sapiens
tccttaataacgagt

SEQ ID NO: 182691 - DNA, 15 bp, Homo sapiens
ttccttaataacgag

SEQ ID NO: 182692 - DNA, 15 bp, Homo sapiens
tttccttaataacga

SEQ ID NO: 182693 - DNA, 15 bp, Homo sapiens
ttttccttaataacg

SEQ ID NO: 182694 - DNA, 15 bp, Homo sapiens
tttttccttaataac

SEQ ID NO: 182695 - DNA, 15 bp, Homo sapiens
ttttttccttaataa

SEQ ID NO: 182696 - DNA, 15 bp, Homo sapiens
attttttccttaata

SEQ ID NO: 182697 - DNA, 15 bp, Homo sapiens
tattttttccttaat

SEQ ID NO: 182698 - DNA, 15 bp, Homo sapiens
gtattttttccttaa

SEQ ID NO: 182699 - DNA, 15 bp, Homo sapiens
agtattttttcctta

SEQ ID NO: 182700 - DNA, 15 bp, Homo sapiens
gagtattttttcctt

SEQ ID NO: 182701 - DNA, 15 bp, Homo sapiens
tgagtattttttcct

SEQ ID NO: 182702 - DNA, 15 bp, Homo sapiens
ttgagtattttttcc

SEQ ID NO: 182703 - DNA, 15 bp, Homo sapiens
cttgagtattttttc

SEQ ID NO: 182704 - DNA, 15 bp, Homo sapiens
tcttgagtatttttt

SEQ ID NO: 182705 - DNA, 15 bp, Homo sapiens
gtcttgagtattttt

SEQ ID NO: 182706 - DNA, 15 bp, Homo sapiens
ggtcttgagtatttt

SEQ ID NO: 182707 - DNA, 15 bp, Homo sapiens
gggtcttgagtattt

SEQ ID NO: 182708 - DNA, 15 bp, Homo sapiens
cgggtcttgagtatt

SEQ ID NO: 182709 - DNA, 15 bp, Homo sapiens
tcgggtcttgagtat

SEQ ID NO: 182710 - DNA, 15 bp, Homo sapiens
ttcgggtcttgagta

SEQ ID NO: 182711 - DNA, 15 bp, Homo sapiens
attcgggtcttgagt

SEQ ID NO: 182712 - DNA, 15 bp, Homo sapiens
tattcgggtcttgag

SEQ ID NO: 182713 - DNA, 15 bp, Homo sapiens
ttattcgggtcttga

SEQ ID NO: 182714 - DNA, 15 bp, Homo sapiens
attattcgggtcttg

SEQ ID NO: 182715 - DNA, 15 bp, Homo sapiens
tattattcgggtctt

SEQ ID NO: 182716 - DNA, 15 bp, Homo sapiens
atattattcgggtct

SEQ ID NO: 182717 - DNA, 15 bp, Homo sapiens
aatattattcgggtc

SEQ ID NO: 182718 - DNA, 15 bp, Homo sapiens
caatattattcgggt

SEQ ID NO: 182719 - DNA, 15 bp, Homo sapiens
gcaatattattcggg

SEQ ID NO: 182720 - DNA, 15 bp, Homo sapiens
ggcaatattattcgg

SEQ ID NO: 182721 - DNA, 15 bp, Homo sapiens
tggcaatattattcg

SEQ ID NO: 182722 - DNA, 15 bp, Homo sapiens
atggcaatattattc

SEQ ID NO: 182723 - DNA, 15 bp, Homo sapiens
catggcaatattatt

SEQ ID NO: 182724 - DNA, 15 bp, Homo sapiens
tcatggcaatattat

SEQ ID NO: 182725 - DNA, 15 bp, Homo sapiens
ttcatggcaatatta

SEQ ID NO: 182726 - DNA, 15 bp, Homo sapiens
attcatggcaatatt

SEQ ID NO: 182727 - DNA, 15 bp, Homo sapiens
tattcatggcaatat

SEQ ID NO: 182728 - DNA, 15 bp, Homo sapiens
ttattcatggcaata

SEQ ID NO: 182729 - DNA, 15 bp, Homo sapiens
tttattcatggcaat

SEQ ID NO: 182730 - DNA, 15 bp, Homo sapiens
ctttattcatggcaa

SEQ ID NO: 182731 - DNA, 15 bp, Homo sapiens
gctttattcatggca

SEQ ID NO: 182732 - DNA, 15 bp, Homo sapiens
cgctttattcatggc

SEQ ID NO: 182733 - DNA, 15 bp, Homo sapiens
ccgctttattcatgg

SEQ ID NO: 182734 - DNA, 15 bp, Homo sapiens
accgctttattcatg

SEQ ID NO: 182735 - DNA, 15 bp, Homo sapiens
aaccgctttattcat

SEQ ID NO: 182736 - DNA, 15 bp, Homo sapiens
caaccgctttattca

SEQ ID NO: 182737 - DNA, 15 bp, Homo sapiens
tcaaccgctttattc

SEQ ID NO: 182738 - DNA, 15 bp, Homo sapiens
atcaaccgctttatt

SEQ ID NO: 182739 - DNA, 15 bp, Homo sapiens
aatcaaccgctttat

SEQ ID NO: 182740 - DNA, 15 bp, Homo sapiens
taatcaaccgcttta

SEQ ID NO: 182741 - DNA, 15 bp, Homo sapiens
ctaatcaaccgcttt

SEQ ID NO: 182742 - DNA, 15 bp, Homo sapiens
actaatcaaccgctt

SEQ ID NO: 182743 - DNA, 15 bp, Homo sapiens
cactaatcaaccgct

SEQ ID NO: 182744 - DNA, 15 bp, Homo sapiens
tcactaatcaaccgc

SEQ ID NO: 182745 - DNA, 15 bp, Homo sapiens
atcactaatcaaccg

SEQ ID NO: 182746 - DNA, 15 bp, Homo sapiens
aatcactaatcaacc

SEQ ID NO: 182747 - DNA, 15 bp, Homo sapiens
caatcactaatcaac

SEQ ID NO: 182748 - DNA, 15 bp, Homo sapiens
ccaatcactaatcaa

SEQ ID NO: 182749 - DNA, 15 bp, Homo sapiens
accaatcactaatca

SEQ ID NO: 182750 - DNA, 15 bp, Homo sapiens
aaccaatcactaatc

SEQ ID NO: 182751 - DNA, 15 bp, Homo sapiens
caaccaatcactaat

SEQ ID NO: 182752 - DNA, 15 bp, Homo sapiens
tcaaccaatcactaa

SEQ ID NO: 182753 - DNA, 15 bp, Homo sapiens
gtcaaccaatcacta

SEQ ID NO: 182754 - DNA, 15 bp, Homo sapiens
agtcaaccaatcact

SEQ ID NO: 182755 - DNA, 15 bp, Homo sapiens
aagtcaaccaatcac

SEQ ID NO: 182756 - DNA, 15 bp, Homo sapiens
aaagtcaaccaatca

SEQ ID NO: 182757 - DNA, 15 bp, Homo sapiens
taaagtcaaccaatc

SEQ ID NO: 182758 - DNA, 15 bp, Homo sapiens
ataaagtcaaccaat

SEQ ID NO: 182759 - DNA, 15 bp, Homo sapiens
cataaagtcaaccaa

SEQ ID NO: 182760 - DNA, 15 bp, Homo sapiens
gcataaagtcaacca

SEQ ID NO: 182761 - DNA, 15 bp, Homo sapiens
agcataaagtcaacc

SEQ ID NO: 182762 - DNA, 15 bp, Homo sapiens
aagcataaagtcaac

SEQ ID NO: 182763 - DNA, 15 bp, Homo sapiens
aaagcataaagtcaa

SEQ ID NO: 182764 - DNA, 15 bp, Homo sapiens
aaaagcataaagtca

SEQ ID NO: 182765 - DNA, 15 bp, Homo sapiens
gaaaagcataaagtc

SEQ ID NO: 182766 - DNA, 15 bp, Homo sapiens
tgaaaagcataaagt

SEQ ID NO: 182767 - DNA, 15 bp, Homo sapiens
ctgaaaagcataaag

SEQ ID NO: 182768 - DNA, 15 bp, Homo sapiens
actgaaaagcataaa

SEQ ID NO: 182769 - DNA, 15 bp, Homo sapiens
aactgaaaagcataa

SEQ ID NO: 182770 - DNA, 15 bp, Homo sapiens
gaactgaaaagcata

SEQ ID NO: 182771 - DNA, 15 bp, Homo sapiens
tgaactgaaaagcat

SEQ ID NO: 182772 - DNA, 15 bp, Homo sapiens
gtgaactgaaaagca

SEQ ID NO: 182773 - DNA, 15 bp, Homo sapiens
tgtgaactgaaaagc

SEQ ID NO: 182774 - DNA, 15 bp, Homo sapiens
ctgtgaactgaaaag

SEQ ID NO: 182775 - DNA, 15 bp, Homo sapiens
aagaacaaaaattac

SEQ ID NO: 182776 - DNA, 15 bp, Homo sapiens
taagaacaaaaatta

SEQ ID NO: 182777 - DNA, 15 bp, Homo sapiens
ttaagaacaaaaatt

SEQ ID NO: 182778 - DNA, 15 bp, Homo sapiens
cttaagaacaaaaat

SEQ ID NO: 182779 - DNA, 15 bp, Homo sapiens
ccttaagaacaaaaa

SEQ ID NO: 182780 - DNA, 15 bp, Homo sapiens
tccttaagaacaaaa

SEQ ID NO: 182781 - DNA, 15 bp, Homo sapiens
gtccttaagaacaaa

SEQ ID NO: 182782 - DNA, 15 bp, Homo sapiens
tgtccttaagaacaa

SEQ ID NO: 182783 - DNA, 15 bp, Homo sapiens
gtgtccttaagaaca

SEQ ID NO: 182784 - DNA, 15 bp, Homo sapiens
agtgtccttaagaac

SEQ ID NO: 182785 - DNA, 15 bp, Homo sapiens
gagtgtccttaagaa

SEQ ID NO: 182786 - DNA, 15 bp, Homo sapiens
agagtgtccttaaga

SEQ ID NO: 182787 - DNA, 15 bp, Homo sapiens
tagagtgtccttaag

SEQ ID NO: 182788 - DNA, 15 bp, Homo sapiens
ttagagtgtccttaa

SEQ ID NO: 182789 - DNA, 15 bp, Homo sapiens
cttagagtgtcctta

SEQ ID NO: 182790 - DNA, 15 bp, Homo sapiens
ccttagagtgtcctt

SEQ ID NO: 182791 - DNA, 15 bp, Homo sapiens
tccttagagtgtcct

SEQ ID NO: 182792 - DNA, 15 bp, Homo sapiens
ttccttagagtgtcc

SEQ ID NO: 182793 - DNA, 15 bp, Homo sapiens
attccttagagtgtc

SEQ ID NO: 182794 - DNA, 15 bp, Homo sapiens
aattccttagagtgt

SEQ ID NO: 182795 - DNA, 15 bp, Homo sapiens
taattccttagagtg

SEQ ID NO: 182796 - DNA, 15 bp, Homo sapiens
ataattccttagagt

SEQ ID NO: 182797 - DNA, 15 bp, Homo sapiens
aataattccttagag

SEQ ID NO: 182798 - DNA, 15 bp, Homo sapiens
aaataattccttaga

SEQ ID NO: 182799 - DNA, 15 bp, Homo sapiens
caaataattccttag

SEQ ID NO: 182800 - DNA, 15 bp, Homo sapiens
acaaataattcctta

SEQ ID NO: 182801 - DNA, 15 bp, Homo sapiens
cacaaataattcctt

SEQ ID NO: 182802 - DNA, 15 bp, Homo sapiens
acacaaataattcct

SEQ ID NO: 182803 - DNA, 15 bp, Homo sapiens
gacacaaataattcc

SEQ ID NO: 182804 - DNA, 15 bp, Homo sapiens
agacacaaataattc

SEQ ID NO: 182805 - DNA, 15 bp, Homo sapiens
cagacacaaataatt

SEQ ID NO: 182806 - DNA, 15 bp, Homo sapiens
gcagacacaaataat

SEQ ID NO: 182807 - DNA, 15 bp, Homo sapiens
agcagacacaaataa

SEQ ID NO: 182808 - DNA, 15 bp, Homo sapiens
aagcagacacaaata

SEQ ID NO: 182809 - DNA, 15 bp, Homo sapiens
aaagcagacacaaat

SEQ ID NO: 182810 - DNA, 15 bp, Homo sapiens
taaagcagacacaaa

SEQ ID NO: 182811 - DNA, 15 bp, Homo sapiens
ttaaagcagacacaa

SEQ ID NO: 182812 - DNA, 15 bp, Homo sapiens
attaaagcagacaca

SEQ ID NO: 182813 - DNA, 15 bp, Homo sapiens
aattaaagcagacac

SEQ ID NO: 182814 - DNA, 15 bp, Homo sapiens
taattaaagcagaca

SEQ ID NO: 182815 - DNA, 15 bp, Homo sapiens
ataattaaagcagac

SEQ ID NO: 182816 - DNA, 15 bp, Homo sapiens
aataattaaagcaga

SEQ ID NO: 182817 - DNA, 15 bp, Homo sapiens
taataattaaagcag

SEQ ID NO: 182818 - DNA, 15 bp, Homo sapiens
ttaataattaaagca

SEQ ID NO: 182819 - DNA, 15 bp, Homo sapiens
tttaataattaaagc

SEQ ID NO: 182820 - DNA, 15 bp, Homo sapiens
ttttaataattaaag

SEQ ID NO: 182821 - DNA, 15 bp, Homo sapiens
tttttaataattaaa

SEQ ID NO: 182822 - DNA, 15 bp, Homo sapiens
atttttaataattaa

SEQ ID NO: 182823 - DNA, 15 bp, Homo sapiens
tatttttaataatta

SEQ ID NO: 182824 - DNA, 15 bp, Homo sapiens
ttatttttaataatt

SEQ ID NO: 182825 - DNA, 15 bp, Homo sapiens
attatttttaataat

SEQ ID NO: 182826 - DNA, 15 bp, Homo sapiens
aattatttttaataa

SEQ ID NO: 182827 - DNA, 15 bp, Homo sapiens
aaattatttttaata

SEQ ID NO: 182828 - DNA, 15 bp, Homo sapiens
aaaattatttttaat

SEQ ID NO: 182829 - DNA, 15 bp, Homo sapiens
caaaattatttttaa

SEQ ID NO: 182830 - DNA, 15 bp, Homo sapiens
acaaaattattttta

SEQ ID NO: 182831 - DNA, 15 bp, Homo sapiens
aacaaaattattttt

SEQ ID NO: 182832 - DNA, 15 bp, Homo sapiens
aaacaaaattatttt

SEQ ID NO: 182833 - DNA, 15 bp, Homo sapiens
taaacaaaattattt

SEQ ID NO: 182834 - DNA, 15 bp, Homo sapiens
ataaacaaaattatt

SEQ ID NO: 182835 - DNA, 15 bp, Homo sapiens
aataaacaaaattat

SEQ ID NO: 182836 - DNA, 15 bp, Homo sapiens
gaataaacaaaatta

SEQ ID NO: 182837 - DNA, 15 bp, Homo sapiens
tgaataaacaaaatt

SEQ ID NO: 182838 - DNA, 15 bp, Homo sapiens
ctgaataaacaaaat

SEQ ID NO: 182839 - DNA, 15 bp, Homo sapiens
actgaataaacaaaa

SEQ ID NO: 182840 - DNA, 15 bp, Homo sapiens
aactgaataaacaaa

SEQ ID NO: 182841 - DNA, 15 bp, Homo sapiens
gaactgaataaacaa

SEQ ID NO: 182842 - DNA, 15 bp, Homo sapiens
tgaactgaataaaca

SEQ ID NO: 182843 - DNA, 15 bp, Homo sapiens
ttgaactgaataaac

SEQ ID NO: 182844 - DNA, 15 bp, Homo sapiens
attgaactgaataaa

SEQ ID NO: 182845 - DNA, 15 bp, Homo sapiens
tattgaactgaataa

SEQ ID NO: 182846 - DNA, 15 bp, Homo sapiens
ctattgaactgaata

SEQ ID NO: 182847 - DNA, 15 bp, Homo sapiens
tctattgaactgaat

SEQ ID NO: 182848 - DNA, 15 bp, Homo sapiens
ttctattgaactgaa

SEQ ID NO: 182849 - DNA, 15 bp, Homo sapiens
attctattgaactga

SEQ ID NO: 182850 - DNA, 15 bp, Homo sapiens
aattctattgaactg

SEQ ID NO: 182851 - DNA, 15 bp, Homo sapiens
caattctattgaact

SEQ ID NO: 182852 - DNA, 15 bp, Homo sapiens
acaattctattgaac

SEQ ID NO: 182853 - DNA, 15 bp, Homo sapiens
tacaattctattgaa

SEQ ID NO: 182854 - DNA, 15 bp, Homo sapiens
atacaattctattga

SEQ ID NO: 182855 - DNA, 15 bp, Homo sapiens
gatacaattctattg

SEQ ID NO: 182856 - DNA, 15 bp, Homo sapiens
agatacaattctatt

SEQ ID NO: 182857 - DNA, 15 bp, Homo sapiens
aagatacaattctat

SEQ ID NO: 182858 - DNA, 15 bp, Homo sapiens
aaagatacaattcta

SEQ ID NO: 182859 - DNA, 15 bp, Homo sapiens
aaaagatacaattct

SEQ ID NO: 182860 - DNA, 15 bp, Homo sapiens
taaaagatacaattc

SEQ ID NO: 182861 - DNA, 15 bp, Homo sapiens
ttaaaagatacaatt

SEQ ID NO: 182862 - DNA, 15 bp, Homo sapiens
tttaaaagatacaat

SEQ ID NO: 182863 - DNA, 15 bp, Homo sapiens
ttttaaaagatacaa

SEQ ID NO: 182864 - DNA, 15 bp, Homo sapiens
attttaaaagataca

SEQ ID NO: 182865 - DNA, 15 bp, Homo sapiens
tattttaaaagatac

SEQ ID NO: 182866 - DNA, 15 bp, Homo sapiens
gtattttaaaagata

SEQ ID NO: 182867 - DNA, 15 bp, Homo sapiens
agtattttaaaagat

SEQ ID NO: 182868 - DNA, 15 bp, Homo sapiens
aagtattttaaaaga

SEQ ID NO: 182869 - DNA, 15 bp, Homo sapiens
taagtattttaaaag

SEQ ID NO: 182870 - DNA, 15 bp, Homo sapiens
ataagtattttaaaa

SEQ ID NO: 182871 - DNA, 15 bp, Homo sapiens
tataagtattttaaa

SEQ ID NO: 182872 - DNA, 15 bp, Homo sapiens
ctataagtattttaa

SEQ ID NO: 182873 - DNA, 15 bp, Homo sapiens
actataagtatttta

SEQ ID NO: 182874 - DNA, 15 bp, Homo sapiens
gactataagtatttt

SEQ ID NO: 182875 - DNA, 15 bp, Homo sapiens
ggactataagtattt

SEQ ID NO: 182876 - DNA, 15 bp, Homo sapiens
aggactataagtatt

SEQ ID NO: 182877 - DNA, 15 bp, Homo sapiens
aaggactataagtat

SEQ ID NO: 182878 - DNA, 15 bp, Homo sapiens
taaggactataagta

SEQ ID NO: 182879 - DNA, 15 bp, Homo sapiens
ctaaggactataagt

SEQ ID NO: 182880 - DNA, 15 bp, Homo sapiens
tctaaggactataag

SEQ ID NO: 182881 - DNA, 15 bp, Homo sapiens
atctaaggactataa

SEQ ID NO: 182882 - DNA, 15 bp, Homo sapiens
tatctaaggactata

SEQ ID NO: 182883 - DNA, 15 bp, Homo sapiens
gtatctaaggactat

SEQ ID NO: 182884 - DNA, 15 bp, Homo sapiens
agtatctaaggacta

SEQ ID NO: 182885 - DNA, 15 bp, Homo sapiens
cagtatctaaggact

SEQ ID NO: 182886 - DNA, 15 bp, Homo sapiens
acagtatctaaggac

SEQ ID NO: 182887 - DNA, 15 bp, Homo sapiens
aacagtatctaagga

SEQ ID NO: 182888 - DNA, 15 bp, Homo sapiens
aaacagtatctaagg

SEQ ID NO: 182889 - DNA, 15 bp, Homo sapiens
aaaacagtatctaag

SEQ ID NO: 182890 - DNA, 15 bp, Homo sapiens
caaaacagtatctaa

SEQ ID NO: 182891 - DNA, 15 bp, Homo sapiens
acaaaacagtatcta

SEQ ID NO: 182892 - DNA, 15 bp, Homo sapiens
aacaaaacagtatct

SEQ ID NO: 182893 - DNA, 15 bp, Homo sapiens
taacaaaacagtatc

SEQ ID NO: 182894 - DNA, 15 bp, Homo sapiens
ataacaaaacagtat

SEQ ID NO: 182895 - DNA, 15 bp, Homo sapiens
tataacaaaacagta

SEQ ID NO: 182896 - DNA, 15 bp, Homo sapiens
ttataacaaaacagt

SEQ ID NO: 182897 - DNA, 15 bp, Homo sapiens
tttataacaaaacag

SEQ ID NO: 182898 - DNA, 15 bp, Homo sapiens
ctttataacaaaaca

SEQ ID NO: 182899 - DNA, 15 bp, Homo sapiens
actttataacaaaac

SEQ ID NO: 182900 - DNA, 15 bp, Homo sapiens
tactttataacaaaa

SEQ ID NO: 182901 - DNA, 15 bp, Homo sapiens
atactttataacaaa

SEQ ID NO: 182902 - DNA, 15 bp, Homo sapiens
aatactttataacaa

SEQ ID NO: 182903 - DNA, 15 bp, Homo sapiens
aaatactttataaca

SEQ ID NO: 182904 - DNA, 15 bp, Homo sapiens
aaaatactttataac

SEQ ID NO: 182905 - DNA, 15 bp, Homo sapiens
caaaatactttataa

SEQ ID NO: 182906 - DNA, 15 bp, Homo sapiens
acaaaatactttata

SEQ ID NO: 182907 - DNA, 15 bp, Homo sapiens
aacaaaatactttat

SEQ ID NO: 182908 - DNA, 15 bp, Homo sapiens
aaacaaaatacttta

SEQ ID NO: 182909 - DNA, 15 bp, Homo sapiens
aaaacaaaatacttt

SEQ ID NO: 182910 - DNA, 15 bp, Homo sapiens
caaaacaaaatactt

SEQ ID NO: 182911 - DNA, 15 bp, Homo sapiens
tcaaaacaaaatact

SEQ ID NO: 182912 - DNA, 15 bp, Homo sapiens
ttcaaaacaaaatac

SEQ ID NO: 182913 - DNA, 15 bp, Homo sapiens
cttcaaaacaaaata

SEQ ID NO: 182914 - DNA, 15 bp, Homo sapiens
tcttcaaaacaaaat

SEQ ID NO: 182915 - DNA, 15 bp, Homo sapiens
atcttcaaaacaaaa

SEQ ID NO: 182916 - DNA, 15 bp, Homo sapiens
catcttcaaaacaaa

SEQ ID NO: 182917 - DNA, 15 bp, Homo sapiens
acatcttcaaaacaa

SEQ ID NO: 182918 - DNA, 15 bp, Homo sapiens
gacatcttcaaaaca

SEQ ID NO: 182919 - DNA, 15 bp, Homo sapiens
agacatcttcaaaac

SEQ ID NO: 182920 - DNA, 15 bp, Homo sapiens
aagacatcttcaaaa

SEQ ID NO: 182921 - DNA, 15 bp, Homo sapiens
aaagacatcttcaaa

SEQ ID NO: 182922 - DNA, 15 bp, Homo sapiens
taaagacatcttcaa

SEQ ID NO: 182923 - DNA, 15 bp, Homo sapiens
ttaaagacatcttca

SEQ ID NO: 182924 - DNA, 15 bp, Homo sapiens
tttaaagacatcttc

SEQ ID NO: 182925 - DNA, 15 bp, Homo sapiens
atttaaagacatctt

SEQ ID NO: 182926 - DNA, 15 bp, Homo sapiens
aatttaaagacatct

SEQ ID NO: 182927 - DNA, 15 bp, Homo sapiens
gaatttaaagacatc

SEQ ID NO: 182928 - DNA, 15 bp, Homo sapiens
tgaatttaaagacat

SEQ ID NO: 182929 - DNA, 15 bp, Homo sapiens
gtgaatttaaagaca

SEQ ID NO: 182930 - DNA, 15 bp, Homo sapiens
agtgaatttaaagac

SEQ ID NO: 182931 - DNA, 15 bp, Homo sapiens
cagtgaatttaaaga

SEQ ID NO: 182932 - DNA, 15 bp, Homo sapiens
ccagtgaatttaaag

SEQ ID NO: 182933 - DNA, 15 bp, Homo sapiens
gccagtgaatttaaa

SEQ ID NO: 182934 - DNA, 15 bp, Homo sapiens
agccagtgaatttaa

SEQ ID NO: 182935 - DNA, 15 bp, Homo sapiens
aagccagtgaattta

SEQ ID NO: 182936 - DNA, 15 bp, Homo sapiens
gaagccagtgaattt

SEQ ID NO: 182937 - DNA, 15 bp, Homo sapiens
tgaagccagtgaatt

SEQ ID NO: 182938 - DNA, 15 bp, Homo sapiens
ttgaagccagtgaat

SEQ ID NO: 182939 - DNA, 15 bp, Homo sapiens
tttgaagccagtgaa

SEQ ID NO: 182940 - DNA, 15 bp, Homo sapiens
ctttgaagccagtga

SEQ ID NO: 182941 - DNA, 15 bp, Homo sapiens
tctttgaagccagtg

SEQ ID NO: 182942 - DNA, 15 bp, Homo sapiens
atctttgaagccagt

SEQ ID NO: 182943 - DNA, 15 bp, Homo sapiens
tatctttgaagccag

SEQ ID NO: 182944 - DNA, 15 bp, Homo sapiens
ttatctttgaagcca

SEQ ID NO: 182945 - DNA, 15 bp, Homo sapiens
gttatctttgaagcc

SEQ ID NO: 182946 - DNA, 15 bp, Homo sapiens
agttatctttgaagc

SEQ ID NO: 182947 - DNA, 15 bp, Homo sapiens
aagttatctttgaag

SEQ ID NO: 182948 - DNA, 15 bp, Homo sapiens
gaagttatctttgaa

SEQ ID NO: 182949 - DNA, 15 bp, Homo sapiens
agaagttatctttga

SEQ ID NO: 182950 - DNA, 15 bp, Homo sapiens
cagaagttatctttg

SEQ ID NO: 182951 - DNA, 15 bp, Homo sapiens
gcagaagttatcttt

SEQ ID NO: 182952 - DNA, 15 bp, Homo sapiens
tgcagaagttatctt

SEQ ID NO: 182953 - DNA, 15 bp, Homo sapiens
atgcagaagttatct

SEQ ID NO: 182954 - DNA, 15 bp, Homo sapiens
aatgcagaagttatc

SEQ ID NO: 182955 - DNA, 15 bp, Homo sapiens
taatgcagaagttat

SEQ ID NO: 182956 - DNA, 15 bp, Homo sapiens
ataatgcagaagtta

SEQ ID NO: 182957 - DNA, 15 bp, Homo sapiens
aataatgcagaagtt

SEQ ID NO: 182958 - DNA, 15 bp, Homo sapiens
gaataatgcagaagt

SEQ ID NO: 182959 - DNA, 15 bp, Homo sapiens
ggaataatgcagaag

SEQ ID NO: 182960 - DNA, 15 bp, Homo sapiens
aggaataatgcagaa

SEQ ID NO: 182961 - DNA, 15 bp, Homo sapiens
aaggaataatgcaga

SEQ ID NO: 182962 - DNA, 15 bp, Homo sapiens
caaggaataatgcag

SEQ ID NO: 182963 - DNA, 15 bp, Homo sapiens
ccaaggaataatgca

SEQ ID NO: 182964 - DNA, 15 bp, Homo sapiens
cccaaggaataatgc

SEQ ID NO: 182965 - DNA, 15 bp, Homo sapiens
gcccaaggaataatg

SEQ ID NO: 182966 - DNA, 15 bp, Homo sapiens
agcccaaggaataat

SEQ ID NO: 182967 - DNA, 15 bp, Homo sapiens
aagcccaaggaataa

SEQ ID NO: 182968 - DNA, 15 bp, Homo sapiens
aaagcccaaggaata

SEQ ID NO: 182969 - DNA, 15 bp, Homo sapiens
gaaagcccaaggaat

SEQ ID NO: 182970 - DNA, 15 bp, Homo sapiens
ggaaagcccaaggaa

SEQ ID NO: 182971 - DNA, 15 bp, Homo sapiens
aggaaagcccaagga

SEQ ID NO: 182972 - DNA, 15 bp, Homo sapiens
gaggaaagcccaagg

SEQ ID NO: 182973 - DNA, 15 bp, Homo sapiens
agaggaaagcccaag

SEQ ID NO: 182974 - DNA, 15 bp, Homo sapiens
aagaggaaagcccaa

SEQ ID NO: 182975 - DNA, 15 bp, Homo sapiens
taagaggaaagccca

SEQ ID NO: 182976 - DNA, 15 bp, Homo sapiens
ctaagaggaaagccc

SEQ ID NO: 182977 - DNA, 15 bp, Homo sapiens
actaagaggaaagcc

SEQ ID NO: 182978 - DNA, 15 bp, Homo sapiens
aactaagaggaaagc

SEQ ID NO: 182979 - DNA, 15 bp, Homo sapiens
gaactaagaggaaag

SEQ ID NO: 182980 - DNA, 15 bp, Homo sapiens
tgaactaagaggaaa

SEQ ID NO: 182981 - DNA, 15 bp, Homo sapiens
ttgaactaagaggaa

SEQ ID NO: 182982 - DNA, 15 bp, Homo sapiens
attgaactaagagga

SEQ ID NO: 182983 - DNA, 15 bp, Homo sapiens
aattgaactaagagg

SEQ ID NO: 182984 - DNA, 15 bp, Homo sapiens
aaattgaactaagag

SEQ ID NO: 182985 - DNA, 15 bp, Homo sapiens
taaattgaactaaga

SEQ ID NO: 182986 - DNA, 15 bp, Homo sapiens
ctaaattgaactaag

SEQ ID NO: 182987 - DNA, 15 bp, Homo sapiens
tctaaattgaactaa

SEQ ID NO: 182988 - DNA, 15 bp, Homo sapiens
ttctaaattgaacta

SEQ ID NO: 182989 - DNA, 15 bp, Homo sapiens
cttctaaattgaact

SEQ ID NO: 182990 - DNA, 15 bp, Homo sapiens
ccttctaaattgaac

SEQ ID NO: 182991 - DNA, 15 bp, Homo sapiens
tccttctaaattgaa

SEQ ID NO: 182992 - DNA, 15 bp, Homo sapiens
ttccttctaaattga

SEQ ID NO: 182993 - DNA, 15 bp, Homo sapiens
gttccttctaaattg

SEQ ID NO: 182994 - DNA, 15 bp, Homo sapiens
tgttccttctaaatt

SEQ ID NO: 182995 - DNA, 15 bp, Homo sapiens
ctgttccttctaaat

SEQ ID NO: 182996 - DNA, 15 bp, Homo sapiens
tctgttccttctaaa

SEQ ID NO: 182997 - DNA, 15 bp, Homo sapiens
ctctgttccttctaa

SEQ ID NO: 182998 - DNA, 15 bp, Homo sapiens
tctctgttccttcta

SEQ ID NO: 182999 - DNA, 15 bp, Homo sapiens
ttctctgttccttct

SEQ ID NO: 183000 - DNA, 15 bp, Homo sapiens
tttctctgttccttc

SEQ ID NO: 183001 - DNA, 15 bp, Homo sapiens
ttttctctgttcctt

SEQ ID NO: 183002 - DNA, 15 bp, Homo sapiens
gttttctctgttcct

SEQ ID NO: 183003 - DNA, 15 bp, Homo sapiens
tgttttctctgttcc

SEQ ID NO: 183004 - DNA, 15 bp, Homo sapiens
gtgttttctctgttc

SEQ ID NO: 183005 - DNA, 15 bp, Homo sapiens
tgtgttttctctgtt

SEQ ID NO: 183006 - DNA, 15 bp, Homo sapiens
tttgtgttttctctg

SEQ ID NO: 183007 - DNA, 15 bp, Homo sapiens
gtttgtgttttctct

SEQ ID NO: 183008 - DNA, 15 bp, Homo sapiens
tgtttgtgttttctc

SEQ ID NO: 183009 - DNA, 15 bp, Homo sapiens
atgtttgtgttttct

SEQ ID NO: 183010 - DNA, 15 bp, Homo sapiens
aatgtttgtgttttc

SEQ ID NO: 183011 - DNA, 15 bp, Homo sapiens
aaatgtttgtgtttt

SEQ ID NO: 183012 - DNA, 15 bp, Homo sapiens
taaatgtttgtgttt

SEQ ID NO: 183013 - DNA, 15 bp, Homo sapiens
ctaaatgtttgtgtt

SEQ ID NO: 183014 - DNA, 15 bp, Homo sapiens
cctaaatgtttgtgt

SEQ ID NO: 183015 - DNA, 15 bp, Homo sapiens
acctaaatgtttgtg

SEQ ID NO: 183016 - DNA, 15 bp, Homo sapiens
tacctaaatgtttgt

SEQ ID NO: 183017 - DNA, 15 bp, Homo sapiens
ttacctaaatgtttg

SEQ ID NO: 183018 - DNA, 15 bp, Homo sapiens
tttacctaaatgttt

SEQ ID NO: 183019 - DNA, 15 bp, Homo sapiens
atttacctaaatgtt

SEQ ID NO: 183020 - DNA, 15 bp, Homo sapiens
tatttacctaaatgt

SEQ ID NO: 183021 - DNA, 15 bp, Homo sapiens
ttatttacctaaatg

SEQ ID NO: 183022 - DNA, 15 bp, Homo sapiens
attatttacctaaat

SEQ ID NO: 183023 - DNA, 15 bp, Homo sapiens
cattatttacctaaa

SEQ ID NO: 183024 - DNA, 15 bp, Homo sapiens
ccattatttacctaa

SEQ ID NO: 183025 - DNA, 15 bp, Homo sapiens
tccattatttaccta

SEQ ID NO: 183026 - DNA, 15 bp, Homo sapiens
ttccattatttacct

SEQ ID NO: 183027 - DNA, 15 bp, Homo sapiens
tttccattatttacc

SEQ ID NO: 183028 - DNA, 15 bp, Homo sapiens
atttccattatttac

SEQ ID NO: 183029 - DNA, 15 bp, Homo sapiens
tatttccattattta

SEQ ID NO: 183030 - DNA, 15 bp, Homo sapiens
ctatttccattattt

SEQ ID NO: 183031 - DNA, 15 bp, Homo sapiens
cctatttccattatt

SEQ ID NO: 183032 - DNA, 15 bp, Homo sapiens
tcctatttccattat

SEQ ID NO: 183033 - DNA, 15 bp, Homo sapiens
atcctatttccatta

SEQ ID NO: 183034 - DNA, 15 bp, Homo sapiens
aatcctatttccatt

SEQ ID NO: 183035 - DNA, 15 bp, Homo sapiens
gaatcctatttccat

SEQ ID NO: 183036 - DNA, 15 bp, Homo sapiens
tgaatcctatttcca

SEQ ID NO: 183037 - DNA, 15 bp, Homo sapiens
gtgaatcctatttcc

SEQ ID NO: 183038 - DNA, 15 bp, Homo sapiens
cgtgaatcctatttc

SEQ ID NO: 183039 - DNA, 15 bp, Homo sapiens
acgtgaatcctattt

SEQ ID NO: 183040 - DNA, 15 bp, Homo sapiens
gacgtgaatcctatt

SEQ ID NO: 183041 - DNA, 15 bp, Homo sapiens
tgacgtgaatcctat

SEQ ID NO: 183042 - DNA, 15 bp, Homo sapiens
atgacgtgaatccta

SEQ ID NO: 183043 - DNA, 15 bp, Homo sapiens
tatgacgtgaatcct

SEQ ID NO: 183044 - DNA, 15 bp, Homo sapiens
ttatgacgtgaatcc

SEQ ID NO: 183045 - DNA, 15 bp, Homo sapiens
tttatgacgtgaatc

SEQ ID NO: 183046 - DNA, 15 bp, Homo sapiens
ttttatgacgtgaat

SEQ ID NO: 183047 - DNA, 15 bp, Homo sapiens
gttttatgacgtgaa

SEQ ID NO: 183048 - DNA, 15 bp, Homo sapiens
cgttttatgacgtga

SEQ ID NO: 183049 - DNA, 15 bp, Homo sapiens
tcgttttatgacgtg

SEQ ID NO: 183050 - DNA, 15 bp, Homo sapiens
atcgttttatgacgt

SEQ ID NO: 183051 - DNA, 15 bp, Homo sapiens
tatcgttttatgacg

SEQ ID NO: 183052 - DNA, 15 bp, Homo sapiens
gtatcgttttatgac

SEQ ID NO: 183053 - DNA, 15 bp, Homo sapiens
agtatcgttttatga

SEQ ID NO: 183054 - DNA, 15 bp, Homo sapiens
aagtatcgttttatg

SEQ ID NO: 183055 - DNA, 15 bp, Homo sapiens
aaagtatcgttttat

SEQ ID NO: 183056 - DNA, 15 bp, Homo sapiens
caaagtatcgtttta

SEQ ID NO: 183057 - DNA, 15 bp, Homo sapiens
gcaaagtatcgtttt

SEQ ID NO: 183058 - DNA, 15 bp, Homo sapiens
tgcaaagtatcgttt

SEQ ID NO: 183059 - DNA, 15 bp, Homo sapiens
ttgcaaagtatcgtt

SEQ ID NO: 183060 - DNA, 15 bp, Homo sapiens
tttgcaaagtatcgt

SEQ ID NO: 183061 - DNA, 15 bp, Homo sapiens
ttttgcaaagtatcg

SEQ ID NO: 183062 - DNA, 15 bp, Homo sapiens
attttgcaaagtatc

SEQ ID NO: 183063 - DNA, 15 bp, Homo sapiens
aattttgcaaagtat

SEQ ID NO: 183064 - DNA, 15 bp, Homo sapiens
caattttgcaaagta

SEQ ID NO: 183065 - DNA, 15 bp, Homo sapiens
tcaattttgcaaagt

SEQ ID NO: 183066 - DNA, 15 bp, Homo sapiens
gtcaattttgcaaag

SEQ ID NO: 183067 - DNA, 15 bp, Homo sapiens
tgtcaattttgcaaa

SEQ ID NO: 183068 - DNA, 15 bp, Homo sapiens
ttgtcaattttgcaa

SEQ ID NO: 183069 - DNA, 15 bp, Homo sapiens
cttgtcaattttgca

SEQ ID NO: 183070 - DNA, 15 bp, Homo sapiens
ccttgtcaattttgc

SEQ ID NO: 183071 - DNA, 15 bp, Homo sapiens
accttgtcaattttg

SEQ ID NO: 183072 - DNA, 15 bp, Homo sapiens
caccttgtcaatttt

SEQ ID NO: 183073 - DNA, 15 bp, Homo sapiens
ccaccttgtcaattt

SEQ ID NO: 183074 - DNA, 15 bp, Homo sapiens
gccaccttgtcaatt

SEQ ID NO: 183075 - DNA, 15 bp, Homo sapiens
tgccaccttgtcaat

SEQ ID NO: 183076 - DNA, 15 bp, Homo sapiens
ttgccaccttgtcaa

SEQ ID NO: 183077 - DNA, 15 bp, Homo sapiens
tttgccaccttgtca

SEQ ID NO: 183078 - DNA, 15 bp, Homo sapiens
gtttgccaccttgtc

SEQ ID NO: 183079 - DNA, 15 bp, Homo sapiens
tgtttgccaccttgt

SEQ ID NO: 183080 - DNA, 15 bp, Homo sapiens
atgtttgccaccttg

SEQ ID NO: 183081 - DNA, 15 bp, Homo sapiens
tatgtttgccacctt

SEQ ID NO: 183082 - DNA, 15 bp, Homo sapiens
gtatgtttgccacct

SEQ ID NO: 183083 - DNA, 15 bp, Homo sapiens
tgtatgtttgccacc

SEQ ID NO: 183084 - DNA, 15 bp, Homo sapiens
ctgtatgtttgccac

SEQ ID NO: 183085 - DNA, 15 bp, Homo sapiens
cctgtatgtttgcca

SEQ ID NO: 183086 - DNA, 15 bp, Homo sapiens
acctgtatgtttgcc

SEQ ID NO: 183087 - DNA, 15 bp, Homo sapiens
cacctgtatgtttgc

SEQ ID NO: 183088 - DNA, 15 bp, Homo sapiens
tcacctgtatgtttg

SEQ ID NO: 183089 - DNA, 15 bp, Homo sapiens
atcacctgtatgttt

SEQ ID NO: 183090 - DNA, 15 bp, Homo sapiens
catcacctgtatgtt

SEQ ID NO: 183091 - DNA, 15 bp, Homo sapiens
acatcacctgtatgt

SEQ ID NO: 183092 - DNA, 15 bp, Homo sapiens
aacatcacctgtatg

SEQ ID NO: 183093 - DNA, 15 bp, Homo sapiens
taacatcacctgtat

SEQ ID NO: 183094 - DNA, 15 bp, Homo sapiens
ctaacatcacctgta

SEQ ID NO: 183095 - DNA, 15 bp, Homo sapiens
actaacatcacctgt

SEQ ID NO: 183096 - DNA, 15 bp, Homo sapiens
aactaacatcacctg

SEQ ID NO: 183097 - DNA, 15 bp, Homo sapiens
aaactaacatcacct

SEQ ID NO: 183098 - DNA, 15 bp, Homo sapiens
aaaactaacatcacc

SEQ ID NO: 183099 - DNA, 15 bp, Homo sapiens
aaaaactaacatcac

SEQ ID NO: 183100 - DNA, 15 bp, Homo sapiens
aaaaaactaacatca

SEQ ID NO: 183101 - DNA, 15 bp, Homo sapiens
caaaaaactaacatc

SEQ ID NO: 183102 - DNA, 15 bp, Homo sapiens
tcaaaaaactaacat

SEQ ID NO: 183103 - DNA, 15 bp, Homo sapiens
atcaaaaaactaaca

SEQ ID NO: 183104 - DNA, 15 bp, Homo sapiens
aatcaaaaaactaac

SEQ ID NO: 183105 - DNA, 15 bp, Homo sapiens
taatcaaaaaactaa

SEQ ID NO: 183106 - DNA, 15 bp, Homo sapiens
ttaatcaaaaaacta

SEQ ID NO: 183107 - DNA, 15 bp, Homo sapiens
attaatcaaaaaact

SEQ ID NO: 183108 - DNA, 15 bp, Homo sapiens
tattaatcaaaaaac

SEQ ID NO: 183109 - DNA, 15 bp, Homo sapiens
ttattaatcaaaaaa

SEQ ID NO: 183110 - DNA, 15 bp, Homo sapiens
gttattaatcaaaaa

SEQ ID NO: 183111 - DNA, 15 bp, Homo sapiens
tgttattaatcaaaa

SEQ ID NO: 183112 - DNA, 15 bp, Homo sapiens
ttgttattaatcaaa

SEQ ID NO: 183113 - DNA, 15 bp, Homo sapiens
cttgttattaatcaa

SEQ ID NO: 183114 - DNA, 15 bp, Homo sapiens
tcttgttattaatca

SEQ ID NO: 183115 - DNA, 15 bp, Homo sapiens
ctcttgttattaatc

SEQ ID NO: 183116 - DNA, 15 bp, Homo sapiens
tctcttgttattaat

SEQ ID NO: 183117 - DNA, 15 bp, Homo sapiens
gtctcttgttattaa

SEQ ID NO: 183118 - DNA, 15 bp, Homo sapiens
tgtctcttgttatta

SEQ ID NO: 183119 - DNA, 15 bp, Homo sapiens
ctgtctcttgttatt

SEQ ID NO: 183120 - DNA, 15 bp, Homo sapiens
tctgtctcttgttat

SEQ ID NO: 183121 - DNA, 15 bp, Homo sapiens
ttctgtctcttgtta

SEQ ID NO: 183122 - DNA, 15 bp, Homo sapiens
attctgtctcttgtt

SEQ ID NO: 183123 - DNA, 15 bp, Homo sapiens
gattctgtctcttgt

SEQ ID NO: 183124 - DNA, 15 bp, Homo sapiens
agattctgtctcttg

SEQ ID NO: 183125 - DNA, 15 bp, Homo sapiens
cagattctgtctctt

SEQ ID NO: 183126 - DNA, 15 bp, Homo sapiens
tcagattctgtctct

SEQ ID NO: 183127 - DNA, 15 bp, Homo sapiens
ttcagattctgtctc

SEQ ID NO: 183128 - DNA, 15 bp, Homo sapiens
cttcagattctgtct

SEQ ID NO: 183129 - DNA, 15 bp, Homo sapiens
ccttcagattctgtc

SEQ ID NO: 183130 - DNA, 15 bp, Homo sapiens
cccttcagattctgt

SEQ ID NO: 183131 - DNA, 15 bp, Homo sapiens
acccttcagattctg

SEQ ID NO: 183132 - DNA, 15 bp, Homo sapiens
aacccttcagattct

SEQ ID NO: 183133 - DNA, 15 bp, Homo sapiens
taacccttcagattc

SEQ ID NO: 183134 - DNA, 15 bp, Homo sapiens
ctaacccttcagatt

SEQ ID NO: 183135 - DNA, 15 bp, Homo sapiens
tctaacccttcagat

SEQ ID NO: 183136 - DNA, 15 bp, Homo sapiens
ctctaacccttcaga

SEQ ID NO: 183137 - DNA, 15 bp, Homo sapiens
cctctaacccttcag

SEQ ID NO: 183138 - DNA, 15 bp, Homo sapiens
tcctctaacccttca

SEQ ID NO: 183139 - DNA, 15 bp, Homo sapiens
ttcctctaacccttc

SEQ ID NO: 183140 - DNA, 15 bp, Homo sapiens
tttcctctaaccctt

SEQ ID NO: 183141 - DNA, 15 bp, Homo sapiens
atttcctctaaccct

SEQ ID NO: 183142 - DNA, 15 bp, Homo sapiens
catttcctctaaccc

SEQ ID NO: 183143 - DNA, 15 bp, Homo sapiens
gcatttcctctaacc

SEQ ID NO: 183144 - DNA, 15 bp, Homo sapiens
tgcatttcctctaac

SEQ ID NO: 183145 - DNA, 15 bp, Homo sapiens
atgcatttcctctaa

SEQ ID NO: 183146 - DNA, 15 bp, Homo sapiens
tatgcatttcctcta

SEQ ID NO: 183147 - DNA, 15 bp, Homo sapiens
ttatgcatttcctct

SEQ ID NO: 183148 - DNA, 15 bp, Homo sapiens
cttatgcatttcctc

SEQ ID NO: 183149 - DNA, 15 bp, Homo sapiens
tcttatgcatttcct

SEQ ID NO: 183150 - DNA, 15 bp, Homo sapiens
ttcttatgcatttcc

SEQ ID NO: 183151 - DNA, 15 bp, Homo sapiens
attcttatgcatttc

SEQ ID NO: 183152 - DNA, 15 bp, Homo sapiens
gattcttatgcattt

SEQ ID NO: 183153 - DNA, 15 bp, Homo sapiens
agattcttatgcatt

SEQ ID NO: 183154 - DNA, 15 bp, Homo sapiens
cagattcttatgcat

SEQ ID NO: 183155 - DNA, 15 bp, Homo sapiens
tcagattcttatgca

SEQ ID NO: 183156 - DNA, 15 bp, Homo sapiens
ttcagattcttatgc

SEQ ID NO: 183157 - DNA, 15 bp, Homo sapiens
tttcagattcttatg

SEQ ID NO: 183158 - DNA, 15 bp, Homo sapiens
ttttcagattcttat

SEQ ID NO: 183159 - DNA, 15 bp, Homo sapiens
tttttcagattctta

SEQ ID NO: 183160 - DNA, 15 bp, Homo sapiens
ttttttcagattctt

SEQ ID NO: 183161 - DNA, 15 bp, Homo sapiens
attttttcagattct

SEQ ID NO: 183162 - DNA, 15 bp, Homo sapiens
tattttttcagattc

SEQ ID NO: 183163 - DNA, 15 bp, Homo sapiens
ttattttttcagatt

SEQ ID NO: 183164 - DNA, 15 bp, Homo sapiens
tttattttttcagat

SEQ ID NO: 183165 - DNA, 15 bp, Homo sapiens
ttttattttttcaga

SEQ ID NO: 183166 - DNA, 15 bp, Homo sapiens
cttttattttttcag

SEQ ID NO: 183167 - DNA, 15 bp, Homo sapiens
ccttttattttttca

SEQ ID NO: 183168 - DNA, 15 bp, Homo sapiens
tccttttattttttc

SEQ ID NO: 183169 - DNA, 15 bp, Homo sapiens
atccttttatttttt

SEQ ID NO: 183170 - DNA, 15 bp, Homo sapiens
gatccttttattttt

SEQ ID NO: 183171 - DNA, 15 bp, Homo sapiens
agatccttttatttt

SEQ ID NO: 183172 - DNA, 15 bp, Homo sapiens
cagatccttttattt

SEQ ID NO: 183173 - DNA, 15 bp, Homo sapiens
ccagatccttttatt

SEQ ID NO: 183174 - DNA, 15 bp, Homo sapiens
tccagatccttttat

SEQ ID NO: 183175 - DNA, 15 bp, Homo sapiens
ctccagatcctttta

SEQ ID NO: 183176 - DNA, 15 bp, Homo sapiens
tctccagatcctttt

SEQ ID NO: 183177 - DNA, 15 bp, Homo sapiens
ttctccagatccttt

SEQ ID NO: 183178 - DNA, 15 bp, Homo sapiens
cttctccagatcctt

SEQ ID NO: 183179 - DNA, 15 bp, Homo sapiens
tcttctccagatcct

SEQ ID NO: 183180 - DNA, 15 bp, Homo sapiens
gtcttctccagatcc

SEQ ID NO: 183181 - DNA, 15 bp, Homo sapiens
tgtcttctccagatc

SEQ ID NO: 183182 - DNA, 15 bp, Homo sapiens
gtgtcttctccagat

SEQ ID NO: 183183 - DNA, 15 bp, Homo sapiens
ggtgtcttctccaga

SEQ ID NO: 183184 - DNA, 15 bp, Homo sapiens
gggtgtcttctccag

SEQ ID NO: 183185 - DNA, 15 bp, Homo sapiens
agggtgtcttctcca

SEQ ID NO: 183186 - DNA, 15 bp, Homo sapiens
aagggtgtcttctcc

SEQ ID NO: 183187 - DNA, 15 bp, Homo sapiens
taagggtgtcttctc

SEQ ID NO: 183188 - DNA, 15 bp, Homo sapiens
ttaagggtgtcttct

SEQ ID NO: 183189 - DNA, 15 bp, Homo sapiens
tttaagggtgtcttc

SEQ ID NO: 183190 - DNA, 15 bp, Homo sapiens
ctttaagggtgtctt

SEQ ID NO: 183191 - DNA, 15 bp, Homo sapiens
cctttaagggtgtct

SEQ ID NO: 183192 - DNA, 15 bp, Homo sapiens
acctttaagggtgtc

SEQ ID NO: 183193 - DNA, 15 bp, Homo sapiens
cacctttaagggtgt

SEQ ID NO: 183194 - DNA, 15 bp, Homo sapiens
tcacctttaagggtg

SEQ ID NO: 183195 - DNA, 15 bp, Homo sapiens
atcacctttaagggt

SEQ ID NO: 183196 - DNA, 15 bp, Homo sapiens
catcacctttaaggg

SEQ ID NO: 183197 - DNA, 15 bp, Homo sapiens
tcatcacctttaagg

SEQ ID NO: 183198 - DNA, 15 bp, Homo sapiens
atcatcacctttaag

SEQ ID NO: 183199 - DNA, 15 bp, Homo sapiens
gatcatcacctttaa

SEQ ID NO: 183200 - DNA, 15 bp, Homo sapiens
tgatcatcaccttta

SEQ ID NO: 183201 - DNA, 15 bp, Homo sapiens
ttgatcatcaccttt

SEQ ID NO: 183202 - DNA, 15 bp, Homo sapiens
cttgatcatcacctt

SEQ ID NO: 183203 - DNA, 15 bp, Homo sapiens
tcttgatcatcacct

SEQ ID NO: 183204 - DNA, 15 bp, Homo sapiens
ttcttgatcatcacc

SEQ ID NO: 183205 - DNA, 15 bp, Homo sapiens
cttcttgatcatcac

SEQ ID NO: 183206 - DNA, 15 bp, Homo sapiens
acttcttgatcatca

SEQ ID NO: 183207 - DNA, 15 bp, Homo sapiens
gacttcttgatcatc

SEQ ID NO: 183208 - DNA, 15 bp, Homo sapiens
agacttcttgatcat

SEQ ID NO: 183209 - DNA, 15 bp, Homo sapiens
cagacttcttgatca

SEQ ID NO: 183210 - DNA, 15 bp, Homo sapiens
acagacttcttgatc

SEQ ID NO: 183211 - DNA, 15 bp, Homo sapiens
cacagacttcttgat

SEQ ID NO: 183212 - DNA, 15 bp, Homo sapiens
acacagacttcttga

SEQ ID NO: 183213 - DNA, 15 bp, Homo sapiens
aacacagacttcttg

SEQ ID NO: 183214 - DNA, 15 bp, Homo sapiens
caacacagacttctt

SEQ ID NO: 183215 - DNA, 15 bp, Homo sapiens
acaacacagacttct

SEQ ID NO: 183216 - DNA, 15 bp, Homo sapiens
tacaacacagacttc

SEQ ID NO: 183217 - DNA, 15 bp, Homo sapiens
atacaacacagactt

SEQ ID NO: 183218 - DNA, 15 bp, Homo sapiens
tatacaacacagact

SEQ ID NO: 183219 - DNA, 15 bp, Homo sapiens
ttatacaacacagac

SEQ ID NO: 183220 - DNA, 15 bp, Homo sapiens
gttatacaacacaga

SEQ ID NO: 183221 - DNA, 15 bp, Homo sapiens
cgttatacaacacag

SEQ ID NO: 183222 - DNA, 15 bp, Homo sapiens
ccgttatacaacaca

SEQ ID NO: 183223 - DNA, 15 bp, Homo sapiens
cccgttatacaacac

SEQ ID NO: 183224 - DNA, 15 bp, Homo sapiens
ccccgttatacaaca

SEQ ID NO: 183225 - DNA, 15 bp, Homo sapiens
gccccgttatacaac

SEQ ID NO: 183226 - DNA, 15 bp, Homo sapiens
agccccgttatacaa

SEQ ID NO: 183227 - DNA, 15 bp, Homo sapiens
cagccccgttataca

SEQ ID NO: 183228 - DNA, 15 bp, Homo sapiens
acagccccgttatac

SEQ ID NO: 183229 - DNA, 15 bp, Homo sapiens
aacagccccgttata

SEQ ID NO: 183230 - DNA, 15 bp, Homo sapiens
caacagccccgttat

SEQ ID NO: 183231 - DNA, 15 bp, Homo sapiens
ccaacagccccgtta

SEQ ID NO: 183232 - DNA, 15 bp, Homo sapiens
cccaacagccccgtt

SEQ ID NO: 183233 - DNA, 15 bp, Homo sapiens
ccccaacagccccgt

SEQ ID NO: 183234 - DNA, 15 bp, Homo sapiens
gccccaacagccccg

SEQ ID NO: 183235 - DNA, 15 bp, Homo sapiens
agccccaacagcccc

SEQ ID NO: 183236 - DNA, 15 bp, Homo sapiens
gagccccaacagccc

SEQ ID NO: 183237 - DNA, 15 bp, Homo sapiens
tgagccccaacagcc

SEQ ID NO: 183238 - DNA, 15 bp, Homo sapiens
ttgagccccaacagc

SEQ ID NO: 183239 - DNA, 15 bp, Homo sapiens
cttgagccccaacag

SEQ ID NO: 183240 - DNA, 15 bp, Homo sapiens
ccttgagccccaaca

SEQ ID NO: 183241 - DNA, 15 bp, Homo sapiens
tccttgagccccaac

SEQ ID NO: 183242 - DNA, 15 bp, Homo sapiens
ctccttgagccccaa

SEQ ID NO: 183243 - DNA, 15 bp, Homo sapiens
tctccttgagcccca

SEQ ID NO: 183244 - DNA, 15 bp, Homo sapiens
ttctccttgagcccc

SEQ ID NO: 183245 - DNA, 15 bp, Homo sapiens
gttctccttgagccc

SEQ ID NO: 183246 - DNA, 15 bp, Homo sapiens
tgttctccttgagcc

SEQ ID NO: 183247 - DNA, 15 bp, Homo sapiens
ttgttctccttgagc

SEQ ID NO: 183248 - DNA, 15 bp, Homo sapiens
tttgttctccttgag

SEQ ID NO: 183249 - DNA, 15 bp, Homo sapiens
atttgttctccttga

SEQ ID NO: 183250 - DNA, 15 bp, Homo sapiens
aatttgttctccttg

SEQ ID NO: 183251 - DNA, 15 bp, Homo sapiens
aaatttgttctcctt

SEQ ID NO: 183252 - DNA, 15 bp, Homo sapiens
aaaatttgttctcct

SEQ ID NO: 183253 - DNA, 15 bp, Homo sapiens
taaaatttgttctcc

SEQ ID NO: 183254 - DNA, 15 bp, Homo sapiens
ttaaaatttgttctc

SEQ ID NO: 183255 - DNA, 15 bp, Homo sapiens
tttaaaatttgttct

SEQ ID NO: 183256 - DNA, 15 bp, Homo sapiens
ttttaaaatttgttc

SEQ ID NO: 183257 - DNA, 15 bp, Homo sapiens
cttttaaaatttgtt

SEQ ID NO: 183258 - DNA, 15 bp, Homo sapiens
acttttaaaatttgt

SEQ ID NO: 183259 - DNA, 15 bp, Homo sapiens
cacttttaaaatttg

SEQ ID NO: 183260 - DNA, 15 bp, Homo sapiens
ccacttttaaaattt

SEQ ID NO: 183261 - DNA, 15 bp, Homo sapiens
gccacttttaaaatt

SEQ ID NO: 183262 - DNA, 15 bp, Homo sapiens
tgccacttttaaaat

SEQ ID NO: 183263 - DNA, 15 bp, Homo sapiens
ctgccacttttaaaa

SEQ ID NO: 183264 - DNA, 15 bp, Homo sapiens
cctgccacttttaaa

SEQ ID NO: 183265 - DNA, 15 bp, Homo sapiens
tcctgccacttttaa

SEQ ID NO: 183266 - DNA, 15 bp, Homo sapiens
ctcctgccactttta

SEQ ID NO: 183267 - DNA, 15 bp, Homo sapiens
cctcctgccactttt

SEQ ID NO: 183268 - DNA, 15 bp, Homo sapiens
acctcctgccacttt

SEQ ID NO: 183269 - DNA, 15 bp, Homo sapiens
tacctcctgccactt

SEQ ID NO: 183270 - DNA, 15 bp, Homo sapiens
atacctcctgccact

SEQ ID NO: 183271 - DNA, 15 bp, Homo sapiens
catacctcctgccac

SEQ ID NO: 183272 - DNA, 15 bp, Homo sapiens
ccatacctcctgcca

SEQ ID NO: 183273 - DNA, 15 bp, Homo sapiens
tccatacctcctgcc

SEQ ID NO: 183274 - DNA, 15 bp, Homo sapiens
ctccatacctcctgc

SEQ ID NO: 183275 - DNA, 15 bp, Homo sapiens
tctccatacctcctg

SEQ ID NO: 183276 - DNA, 15 bp, Homo sapiens
ttctccatacctcct

SEQ ID NO: 183277 - DNA, 15 bp, Homo sapiens
tttctccatacctcc

SEQ ID NO: 183278 - DNA, 15 bp, Homo sapiens
ctttctccatacctc

SEQ ID NO: 183279 - DNA, 15 bp, Homo sapiens
gctttctccatacct

SEQ ID NO: 183280 - DNA, 15 bp, Homo sapiens
agctttctccatacc

SEQ ID NO: 183281 - DNA, 15 bp, Homo sapiens
cagctttctccatac

SEQ ID NO: 183282 - DNA, 15 bp, Homo sapiens
acagctttctccata

SEQ ID NO: 183283 - DNA, 15 bp, Homo sapiens
cacagctttctccat

SEQ ID NO: 183284 - DNA, 15 bp, Homo sapiens
acacagctttctcca

SEQ ID NO: 183285 - DNA, 15 bp, Homo sapiens
aacacagctttctcc

SEQ ID NO: 183286 - DNA, 15 bp, Homo sapiens
caacacagctttctc

SEQ ID NO: 183287 - DNA, 15 bp, Homo sapiens
ccaacacagctttct

SEQ ID NO: 183288 - DNA, 15 bp, Homo sapiens
accaacacagctttc

SEQ ID NO: 183289 - DNA, 15 bp, Homo sapiens
caccaacacagcttt

SEQ ID NO: 183290 - DNA, 15 bp, Homo sapiens
tcaccaacacagctt

SEQ ID NO: 183291 - DNA, 15 bp, Homo sapiens
atcaccaacacagct

SEQ ID NO: 183292 - DNA, 15 bp, Homo sapiens
catcaccaacacagc

SEQ ID NO: 183293 - DNA, 15 bp, Homo sapiens
acatcaccaacacag

SEQ ID NO: 183294 - DNA, 15 bp, Homo sapiens
cacatcaccaacaca

SEQ ID NO: 183295 - DNA, 15 bp, Homo sapiens
tcacatcaccaacac

SEQ ID NO: 183296 - DNA, 15 bp, Homo sapiens
ctcacatcaccaaca

SEQ ID NO: 183297 - DNA, 15 bp, Homo sapiens
actcacatcaccaac

SEQ ID NO: 183298 - DNA, 15 bp, Homo sapiens
tactcacatcaccaa

SEQ ID NO: 183299 - DNA, 15 bp, Homo sapiens
atactcacatcacca

SEQ ID NO: 183300 - DNA, 15 bp, Homo sapiens
aatactcacatcacc

SEQ ID NO: 183301 - DNA, 15 bp, Homo sapiens
taatactcacatcac

SEQ ID NO: 183302 - DNA, 15 bp, Homo sapiens
ataatactcacatca

SEQ ID NO: 183303 - DNA, 15 bp, Homo sapiens
cataatactcacatc

SEQ ID NO: 183304 - DNA, 15 bp, Homo sapiens
ccataatactcacat

SEQ ID NO: 183305 - DNA, 15 bp, Homo sapiens
cccataatactcaca

SEQ ID NO: 183306 - DNA, 15 bp, Homo sapiens
gcccataatactcac

SEQ ID NO: 183307 - DNA, 15 bp, Homo sapiens
agcccataatactca

SEQ ID NO: 183308 - DNA, 15 bp, Homo sapiens
aagcccataatactc

SEQ ID NO: 183309 - DNA, 15 bp, Homo sapiens
gaagcccataatact

SEQ ID NO: 183310 - DNA, 15 bp, Homo sapiens
agaagcccataatac

SEQ ID NO: 183311 - DNA, 15 bp, Homo sapiens
gagaagcccataata

SEQ ID NO: 183312 - DNA, 15 bp, Homo sapiens
tgagaagcccataat

SEQ ID NO: 183313 - DNA, 15 bp, Homo sapiens
ttgagaagcccataa

SEQ ID NO: 183314 - DNA, 15 bp, Homo sapiens
tttgagaagcccata

SEQ ID NO: 183315 - DNA, 15 bp, Homo sapiens
ctttgagaagcccat

SEQ ID NO: 183316 - DNA, 15 bp, Homo sapiens
gctttgagaagccca

SEQ ID NO: 183317 - DNA, 15 bp, Homo sapiens
tgctttgagaagccc

SEQ ID NO: 183318 - DNA, 15 bp, Homo sapiens
atgctttgagaagcc

SEQ ID NO: 183319 - DNA, 15 bp, Homo sapiens
catgctttgagaagc

SEQ ID NO: 183320 - DNA, 15 bp, Homo sapiens
ccatgctttgagaag

SEQ ID NO: 183321 - DNA, 15 bp, Homo sapiens
accatgctttgagaa

SEQ ID NO: 183322 - DNA, 15 bp, Homo sapiens
aaccatgctttgaga

SEQ ID NO: 183323 - DNA, 15 bp, Homo sapiens
gaaccatgctttgag

SEQ ID NO: 183324 - DNA, 15 bp, Homo sapiens
agaaccatgctttga

SEQ ID NO: 183325 - DNA, 15 bp, Homo sapiens
cagaaccatgctttg

SEQ ID NO: 183326 - DNA, 15 bp, Homo sapiens
tcagaaccatgcttt

SEQ ID NO: 183327 - DNA, 15 bp, Homo sapiens
gtcagaaccatgctt

SEQ ID NO: 183328 - DNA, 15 bp, Homo sapiens
agtcagaaccatgct

SEQ ID NO: 183329 - DNA, 15 bp, Homo sapiens
gagtcagaaccatgc

SEQ ID NO: 183330 - DNA, 15 bp, Homo sapiens
agagtcagaaccatg

SEQ ID NO: 183331 - DNA, 15 bp, Homo sapiens
cagagtcagaaccat

SEQ ID NO: 183332 - DNA, 15 bp, Homo sapiens
ccagagtcagaacca

SEQ ID NO: 183333 - DNA, 15 bp, Homo sapiens
gccagagtcagaacc

SEQ ID NO: 183334 - DNA, 15 bp, Homo sapiens
tgccagagtcagaac

SEQ ID NO: 183335 - DNA, 15 bp, Homo sapiens
ttgccagagtcagaa

SEQ ID NO: 183336 - DNA, 15 bp, Homo sapiens
tttgccagagtcaga

SEQ ID NO: 183337 - DNA, 15 bp, Homo sapiens
ttttgccagagtcag

SEQ ID NO: 183338 - DNA, 15 bp, Homo sapiens
tttttgccagagtca

SEQ ID NO: 183339 - DNA, 15 bp, Homo sapiens
ctttttgccagagtc

SEQ ID NO: 183340 - DNA, 15 bp, Homo sapiens
actttttgccagagt

SEQ ID NO: 183341 - DNA, 15 bp, Homo sapiens
cactttttgccagag

SEQ ID NO: 183342 - DNA, 15 bp, Homo sapiens
ccactttttgccaga

SEQ ID NO: 183343 - DNA, 15 bp, Homo sapiens
cccactttttgccag

SEQ ID NO: 183344 - DNA, 15 bp, Homo sapiens
tcccactttttgcca

SEQ ID NO: 183345 - DNA, 15 bp, Homo sapiens
ctcccactttttgcc

SEQ ID NO: 183346 - DNA, 15 bp, Homo sapiens
cctcccactttttgc

SEQ ID NO: 183347 - DNA, 15 bp, Homo sapiens
acctcccactttttg

SEQ ID NO: 183348 - DNA, 15 bp, Homo sapiens
gacctcccacttttt

SEQ ID NO: 183349 - DNA, 15 bp, Homo sapiens
tgacctcccactttt

SEQ ID NO: 183350 - DNA, 15 bp, Homo sapiens
ctgacctcccacttt

SEQ ID NO: 183351 - DNA, 15 bp, Homo sapiens
tctgacctcccactt

SEQ ID NO: 183352 - DNA, 15 bp, Homo sapiens
ctctgacctcccact

SEQ ID NO: 183353 - DNA, 15 bp, Homo sapiens
gctctgacctcccac

SEQ ID NO: 183354 - DNA, 15 bp, Homo sapiens
tgctctgacctccca

SEQ ID NO: 183355 - DNA, 15 bp, Homo sapiens
ctgctctgacctccc

SEQ ID NO: 183356 - DNA, 15 bp, Homo sapiens
tctgctctgacctcc

SEQ ID NO: 183357 - DNA, 15 bp, Homo sapiens
ctctgctctgacctc

SEQ ID NO: 183358 - DNA, 15 bp, Homo sapiens
actctgctctgacct

SEQ ID NO: 183359 - DNA, 15 bp, Homo sapiens
aactctgctctgacc

SEQ ID NO: 183360 - DNA, 15 bp, Homo sapiens
caactctgctctgac

SEQ ID NO: 183361 - DNA, 15 bp, Homo sapiens
ccaactctgctctga

SEQ ID NO: 183362 - DNA, 15 bp, Homo sapiens
gccaactctgctctg

SEQ ID NO: 183363 - DNA, 15 bp, Homo sapiens
agccaactctgctct

SEQ ID NO: 183364 - DNA, 15 bp, Homo sapiens
cagccaactctgctc

SEQ ID NO: 183365 - DNA, 15 bp, Homo sapiens
gcagccaactctgct

SEQ ID NO: 183366 - DNA, 15 bp, Homo sapiens
agcagccaactctgc

SEQ ID NO: 183367 - DNA, 15 bp, Homo sapiens
aagcagccaactctg

SEQ ID NO: 183368 - DNA, 15 bp, Homo sapiens
caagcagccaactct

SEQ ID NO: 183369 - DNA, 15 bp, Homo sapiens
acaagcagccaactc

SEQ ID NO: 183370 - DNA, 15 bp, Homo sapiens
tacaagcagccaact

SEQ ID NO: 183371 - DNA, 15 bp, Homo sapiens
ttacaagcagccaac

SEQ ID NO: 183372 - DNA, 15 bp, Homo sapiens
attacaagcagccaa

SEQ ID NO: 183373 - DNA, 15 bp, Homo sapiens
cattacaagcagcca

SEQ ID NO: 183374 - DNA, 15 bp, Homo sapiens
ccattacaagcagcc

SEQ ID NO: 183375 - DNA, 15 bp, Homo sapiens
cccattacaagcagc

SEQ ID NO: 183376 - DNA, 15 bp, Homo sapiens
tcccattacaagcag

SEQ ID NO: 183377 - DNA, 15 bp, Homo sapiens
ctcccattacaagca

SEQ ID NO: 183378 - DNA, 15 bp, Homo sapiens
actcccattacaagc

SEQ ID NO: 183379 - DNA, 15 bp, Homo sapiens
cactcccattacaag

SEQ ID NO: 183380 - DNA, 15 bp, Homo sapiens
ccactcccattacaa

SEQ ID NO: 183381 - DNA, 15 bp, Homo sapiens
cccactcccattaca

SEQ ID NO: 183382 - DNA, 15 bp, Homo sapiens
ccccactcccattac

SEQ ID NO: 183383 - DNA, 15 bp, Homo sapiens
cccccactcccatta

SEQ ID NO: 183384 - DNA, 15 bp, Homo sapiens
tcccccactcccatt

SEQ ID NO: 183385 - DNA, 15 bp, Homo sapiens
ctcccccactcccat

SEQ ID NO: 183386 - DNA, 15 bp, Homo sapiens
tctcccccactccca

SEQ ID NO: 183387 - DNA, 15 bp, Homo sapiens
ttctcccccactccc

SEQ ID NO: 183388 - DNA, 15 bp, Homo sapiens
tttctcccccactcc

SEQ ID NO: 183389 - DNA, 15 bp, Homo sapiens
ctttctcccccactc

SEQ ID NO: 183390 - DNA, 15 bp, Homo sapiens
gctttctcccccact

SEQ ID NO: 183391 - DNA, 15 bp, Homo sapiens
tgctttctcccccac

SEQ ID NO: 183392 - DNA, 15 bp, Homo sapiens
ttgctttctccccca

SEQ ID NO: 183393 - DNA, 15 bp, Homo sapiens
gttgctttctccccc

SEQ ID NO: 183394 - DNA, 15 bp, Homo sapiens
agttgctttctcccc

SEQ ID NO: 183395 - DNA, 15 bp, Homo sapiens
gagttgctttctccc

SEQ ID NO: 183396 - DNA, 15 bp, Homo sapiens
agagttgctttctcc

SEQ ID NO: 183397 - DNA, 15 bp, Homo sapiens
aagagttgctttctc

SEQ ID NO: 183398 - DNA, 15 bp, Homo sapiens
aaagagttgctttct

SEQ ID NO: 183399 - DNA, 15 bp, Homo sapiens
taaagagttgctttc

SEQ ID NO: 183400 - DNA, 15 bp, Homo sapiens
ttaaagagttgcttt

SEQ ID NO: 183401 - DNA, 15 bp, Homo sapiens
tttaaagagttgctt

SEQ ID NO: 183402 - DNA, 15 bp, Homo sapiens
ttttaaagagttgct

SEQ ID NO: 183403 - DNA, 15 bp, Homo sapiens
tttttaaagagttgc

SEQ ID NO: 183404 - DNA, 15 bp, Homo sapiens
ttttttaaagagttg

SEQ ID NO: 183405 - DNA, 15 bp, Homo sapiens
tttttttaaagagtt

SEQ ID NO: 183406 - DNA, 15 bp, Homo sapiens
atttttttaaagagt

SEQ ID NO: 183407 - DNA, 15 bp, Homo sapiens
aatttttttaaagag

SEQ ID NO: 183408 - DNA, 15 bp, Homo sapiens
aaatttttttaaaga

SEQ ID NO: 183409 - DNA, 15 bp, Homo sapiens
taaatttttttaaag

SEQ ID NO: 183410 - DNA, 15 bp, Homo sapiens
ataaatttttttaaa

SEQ ID NO: 183411 - DNA, 15 bp, Homo sapiens
cataaatttttttaa

SEQ ID NO: 183412 - DNA, 15 bp, Homo sapiens
acataaattttttta

SEQ ID NO: 183413 - DNA, 15 bp, Homo sapiens
gacataaattttttt

SEQ ID NO: 183414 - DNA, 15 bp, Homo sapiens
tgacataaatttttt

SEQ ID NO: 183415 - DNA, 15 bp, Homo sapiens
ttgacataaattttt

SEQ ID NO: 183416 - DNA, 15 bp, Homo sapiens
tttgacataaatttt

SEQ ID NO: 183417 - DNA, 15 bp, Homo sapiens
ttttgacataaattt

SEQ ID NO: 183418 - DNA, 15 bp, Homo sapiens
attttgacataaatt

SEQ ID NO: 183419 - DNA, 15 bp, Homo sapiens
cattttgacataaat

SEQ ID NO: 183420 - DNA, 15 bp, Homo sapiens
ccattttgacataaa

SEQ ID NO: 183421 - DNA, 15 bp, Homo sapiens
accattttgacataa

SEQ ID NO: 183422 - DNA, 15 bp, Homo sapiens
taccattttgacata

SEQ ID NO: 183423 - DNA, 15 bp, Homo sapiens
ataccattttgacat

SEQ ID NO: 183424 - DNA, 15 bp, Homo sapiens
aataccattttgaca

SEQ ID NO: 183425 - DNA, 15 bp, Homo sapiens
gaataccattttgac

SEQ ID NO: 183426 - DNA, 15 bp, Homo sapiens
tgaataccattttga

SEQ ID NO: 183427 - DNA, 15 bp, Homo sapiens
ctgaataccattttg

SEQ ID NO: 183428 - DNA, 15 bp, Homo sapiens
actgaataccatttt

SEQ ID NO: 183429 - DNA, 15 bp, Homo sapiens
cactgaataccattt

SEQ ID NO: 183430 - DNA, 15 bp, Homo sapiens
ccactgaataccatt

SEQ ID NO: 183431 - DNA, 15 bp, Homo sapiens
accactgaataccat

SEQ ID NO: 183432 - DNA, 15 bp, Homo sapiens
gaccactgaatacca

SEQ ID NO: 183433 - DNA, 15 bp, Homo sapiens
ggaccactgaatacc

SEQ ID NO: 183434 - DNA, 15 bp, Homo sapiens
tggaccactgaatac

SEQ ID NO: 183435 - DNA, 15 bp, Homo sapiens
atggaccactgaata

SEQ ID NO: 183436 - DNA, 15 bp, Homo sapiens
gatggaccactgaat

SEQ ID NO: 183437 - DNA, 15 bp, Homo sapiens
tgatggaccactgaa

SEQ ID NO: 183438 - DNA, 15 bp, Homo sapiens
gtgatggaccactga

SEQ ID NO: 183439 - DNA, 15 bp, Homo sapiens
tgtgatggaccactg

SEQ ID NO: 183440 - DNA, 15 bp, Homo sapiens
atgtgatggaccact

SEQ ID NO: 183441 - DNA, 15 bp, Homo sapiens
aatgtgatggaccac

SEQ ID NO: 183442 - DNA, 15 bp, Homo sapiens
caatgtgatggacca

SEQ ID NO: 183443 - DNA, 15 bp, Homo sapiens
tcaatgtgatggacc

SEQ ID NO: 183444 - DNA, 15 bp, Homo sapiens
ttcaatgtgatggac

SEQ ID NO: 183445 - DNA, 15 bp, Homo sapiens
attcaatgtgatgga

SEQ ID NO: 183446 - DNA, 15 bp, Homo sapiens
gattcaatgtgatgg

SEQ ID NO: 183447 - DNA, 15 bp, Homo sapiens
tgattcaatgtgatg

SEQ ID NO: 183448 - DNA, 15 bp, Homo sapiens
ttgattcaatgtgat

SEQ ID NO: 183449 - DNA, 15 bp, Homo sapiens
gttgattcaatgtga

SEQ ID NO: 183450 - DNA, 15 bp, Homo sapiens
tgttgattcaatgtg

SEQ ID NO: 183451 - DNA, 15 bp, Homo sapiens
gtgttgattcaatgt

SEQ ID NO: 183452 - DNA, 15 bp, Homo sapiens
tgtgttgattcaatg

SEQ ID NO: 183453 - DNA, 15 bp, Homo sapiens
gtgtgttgattcaat

SEQ ID NO: 183454 - DNA, 15 bp, Homo sapiens
ggtgtgttgattcaa

SEQ ID NO: 183455 - DNA, 15 bp, Homo sapiens
aggtgtgttgattca

SEQ ID NO: 183456 - DNA, 15 bp, Homo sapiens
aaggtgtgttgattc

SEQ ID NO: 183457 - DNA, 15 bp, Homo sapiens
aaaggtgtgttgatt

SEQ ID NO: 183458 - DNA, 15 bp, Homo sapiens
taaaggtgtgttgat

SEQ ID NO: 183459 - DNA, 15 bp, Homo sapiens
ataaaggtgtgttga

SEQ ID NO: 183460 - DNA, 15 bp, Homo sapiens
aataaaggtgtgttg

SEQ ID NO: 183461 - DNA, 15 bp, Homo sapiens
caataaaggtgtgtt

SEQ ID NO: 183462 - DNA, 15 bp, Homo sapiens
tcaataaaggtgtgt

SEQ ID NO: 183463 - DNA, 15 bp, Homo sapiens
ttcaataaaggtgtg

SEQ ID NO: 183464 - DNA, 15 bp, Homo sapiens
tttcaataaaggtgt

SEQ ID NO: 183465 - DNA, 15 bp, Homo sapiens
ttttcaataaaggtg

SEQ ID NO: 183466 - DNA, 15 bp, Homo sapiens
gttttcaataaaggt

SEQ ID NO: 183467 - DNA, 15 bp, Homo sapiens
tgttttcaataaagg

SEQ ID NO: 183468 - DNA, 15 bp, Homo sapiens
atgttttcaataaag

SEQ ID NO: 183469 - DNA, 15 bp, Homo sapiens
tatgttttcaataaa

SEQ ID NO: 183470 - DNA, 15 bp, Homo sapiens
atatgttttcaataa

SEQ ID NO: 183471 - DNA, 15 bp, Homo sapiens
aatatgttttcaata

SEQ ID NO: 183472 - DNA, 15 bp, Homo sapiens
taatatgttttcaat

SEQ ID NO: 183473 - DNA, 15 bp, Homo sapiens
ataatatgttttcaa

SEQ ID NO: 183474 - DNA, 15 bp, Homo sapiens
aataatatgttttca

SEQ ID NO: 183475 - DNA, 15 bp, Homo sapiens
aaataatatgttttc

SEQ ID NO: 183476 - DNA, 15 bp, Homo sapiens
taaataatatgtttt

SEQ ID NO: 183477 - DNA, 15 bp, Homo sapiens
ctaaataatatgttt

SEQ ID NO: 183478 - DNA, 15 bp, Homo sapiens
gctaaataatatgtt

SEQ ID NO: 183479 - DNA, 15 bp, Homo sapiens
tgctaaataatatgt

SEQ ID NO: 183480 - DNA, 15 bp, Homo sapiens
gtgctaaataatatg

SEQ ID NO: 183481 - DNA, 15 bp, Homo sapiens
tgtgctaaataatat

SEQ ID NO: 183482 - DNA, 15 bp, Homo sapiens
gtgtgctaaataata

SEQ ID NO: 183483 - DNA, 15 bp, Homo sapiens
tgtgtgctaaataat

SEQ ID NO: 183484 - DNA, 15 bp, Homo sapiens
gtgtgtgctaaataa

SEQ ID NO: 183485 - DNA, 15 bp, Homo sapiens
agtgtgtgctaaata

SEQ ID NO: 183486 - DNA, 15 bp, Homo sapiens
gagtgtgtgctaaat

SEQ ID NO: 183487 - DNA, 15 bp, Homo sapiens
agagtgtgtgctaaa

SEQ ID NO: 183488 - DNA, 15 bp, Homo sapiens
tagagtgtgtgctaa

SEQ ID NO: 183489 - DNA, 15 bp, Homo sapiens
ctagagtgtgtgcta

SEQ ID NO: 183490 - DNA, 15 bp, Homo sapiens
cctagagtgtgtgct

SEQ ID NO: 183491 - DNA, 15 bp, Homo sapiens
ccctagagtgtgtgc

SEQ ID NO: 183492 - DNA, 15 bp, Homo sapiens
cccctagagtgtgtg

SEQ ID NO: 183493 - DNA, 15 bp, Homo sapiens
acccctagagtgtgt

SEQ ID NO: 183494 - DNA, 15 bp, Homo sapiens
aacccctagagtgtg

SEQ ID NO: 183495 - DNA, 15 bp, Homo sapiens
gaacccctagagtgt

SEQ ID NO: 183496 - DNA, 15 bp, Homo sapiens
tgaacccctagagtg

SEQ ID NO: 183497 - DNA, 15 bp, Homo sapiens
atgaacccctagagt

SEQ ID NO: 183498 - DNA, 15 bp, Homo sapiens
aatgaacccctagag

SEQ ID NO: 183499 - DNA, 15 bp, Homo sapiens
aaatgaacccctaga

SEQ ID NO: 183500 - DNA, 15 bp, Homo sapiens
gaaatgaacccctag

SEQ ID NO: 183501 - DNA, 15 bp, Homo sapiens
agaaatgaaccccta

SEQ ID NO: 183502 - DNA, 15 bp, Homo sapiens
gagaaatgaacccct

SEQ ID NO: 183503 - DNA, 15 bp, Homo sapiens
agagaaatgaacccc

SEQ ID NO: 183504 - DNA, 15 bp, Homo sapiens
aagagaaatgaaccc

SEQ ID NO: 183505 - DNA, 15 bp, Homo sapiens
taagagaaatgaacc

SEQ ID NO: 183506 - DNA, 15 bp, Homo sapiens
ataagagaaatgaac

SEQ ID NO: 183507 - DNA, 15 bp, Homo sapiens
aataagagaaatgaa

SEQ ID NO: 183508 - DNA, 15 bp, Homo sapiens
gaataagagaaatga

SEQ ID NO: 183509 - DNA, 15 bp, Homo sapiens
agaataagagaaatg

SEQ ID NO: 183510 - DNA, 15 bp, Homo sapiens
gagaataagagaaat

SEQ ID NO: 183511 - DNA, 15 bp, Homo sapiens
agagaataagagaaa

SEQ ID NO: 183512 - DNA, 15 bp, Homo sapiens
cagagaataagagaa

SEQ ID NO: 183513 - DNA, 15 bp, Homo sapiens
tcagagaataagaga

SEQ ID NO: 183514 - DNA, 15 bp, Homo sapiens
ttcagagaataagag

SEQ ID NO: 183515 - DNA, 15 bp, Homo sapiens
gttcagagaataaga

SEQ ID NO: 183516 - DNA, 15 bp, Homo sapiens
agttcagagaataag

SEQ ID NO: 183517 - DNA, 15 bp, Homo sapiens
aagttcagagaataa

SEQ ID NO: 183518 - DNA, 15 bp, Homo sapiens
caagttcagagaata

SEQ ID NO: 183519 - DNA, 15 bp, Homo sapiens
tcaagttcagagaat

SEQ ID NO: 183520 - DNA, 15 bp, Homo sapiens
ttcaagttcagagaa

SEQ ID NO: 183521 - DNA, 15 bp, Homo sapiens
tttcaagttcagaga

SEQ ID NO: 183522 - DNA, 15 bp, Homo sapiens
atttcaagttcagag

SEQ ID NO: 183523 - DNA, 15 bp, Homo sapiens
gatttcaagttcaga

SEQ ID NO: 183524 - DNA, 15 bp, Homo sapiens
ggatttcaagttcag

SEQ ID NO: 183525 - DNA, 15 bp, Homo sapiens
aggatttcaagttca

SEQ ID NO: 183526 - DNA, 15 bp, Homo sapiens
aaggatttcaagttc

SEQ ID NO: 183527 - DNA, 15 bp, Homo sapiens
aaaggatttcaagtt

SEQ ID NO: 183528 - DNA, 15 bp, Homo sapiens
aaaaggatttcaagt

SEQ ID NO: 183529 - DNA, 15 bp, Homo sapiens
gaaaaggatttcaag

SEQ ID NO: 183530 - DNA, 15 bp, Homo sapiens
agaaaaggatttcaa

SEQ ID NO: 183531 - DNA, 15 bp, Homo sapiens
aagaaaaggatttca

SEQ ID NO: 183532 - DNA, 15 bp, Homo sapiens
caagaaaaggatttc

SEQ ID NO: 183533 - DNA, 15 bp, Homo sapiens
acaagaaaaggattt

SEQ ID NO: 183534 - DNA, 15 bp, Homo sapiens
aacaagaaaaggatt

SEQ ID NO: 183535 - DNA, 15 bp, Homo sapiens
caacaagaaaaggat

SEQ ID NO: 183536 - DNA, 15 bp, Homo sapiens
tcaacaagaaaagga

SEQ ID NO: 183537 - DNA, 15 bp, Homo sapiens
atcaacaagaaaagg

SEQ ID NO: 183538 - DNA, 15 bp, Homo sapiens
gatcaacaagaaaag

SEQ ID NO: 183539 - DNA, 15 bp, Homo sapiens
agatcaacaagaaaa

SEQ ID NO: 183540 - DNA, 15 bp, Homo sapiens
aagatcaacaagaaa

SEQ ID NO: 183541 - DNA, 15 bp, Homo sapiens
aaagatcaacaagaa

SEQ ID NO: 183542 - DNA, 15 bp, Homo sapiens
gaaagatcaacaaga

SEQ ID NO: 183543 - DNA, 15 bp, Homo sapiens
tgaaagatcaacaag

SEQ ID NO: 183544 - DNA, 15 bp, Homo sapiens
atgaaagatcaacaa

SEQ ID NO: 183545 - DNA, 15 bp, Homo sapiens
tatgaaagatcaaca

SEQ ID NO: 183546 - DNA, 15 bp, Homo sapiens
atatgaaagatcaac

SEQ ID NO: 183547 - DNA, 15 bp, Homo sapiens
catatgaaagatcaa

SEQ ID NO: 183548 - DNA, 15 bp, Homo sapiens
ccatatgaaagatca

SEQ ID NO: 183549 - DNA, 15 bp, Homo sapiens
cccatatgaaagatc

SEQ ID NO: 183550 - DNA, 15 bp, Homo sapiens
acccatatgaaagat

SEQ ID NO: 183551 - DNA, 15 bp, Homo sapiens
gacccatatgaaaga

SEQ ID NO: 183552 - DNA, 15 bp, Homo sapiens
tgacccatatgaaag

SEQ ID NO: 183553 - DNA, 15 bp, Homo sapiens
gtgacccatatgaaa

SEQ ID NO: 183554 - DNA, 15 bp, Homo sapiens
agtgacccatatgaa

SEQ ID NO: 183555 - DNA, 15 bp, Homo sapiens
tagtgacccatatga

SEQ ID NO: 183556 - DNA, 15 bp, Homo sapiens
ttagtgacccatatg

SEQ ID NO: 183557 - DNA, 15 bp, Homo sapiens
tttagtgacccatat

SEQ ID NO: 183558 - DNA, 15 bp, Homo sapiens
gtttagtgacccata

SEQ ID NO: 183559 - DNA, 15 bp, Homo sapiens
tgtttagtgacccat

SEQ ID NO: 183560 - DNA, 15 bp, Homo sapiens
ctgtttagtgaccca

SEQ ID NO: 183561 - DNA, 15 bp, Homo sapiens
tctgtttagtgaccc

SEQ ID NO: 183562 - DNA, 15 bp, Homo sapiens
atctgtttagtgacc

SEQ ID NO: 183563 - DNA, 15 bp, Homo sapiens
aatctgtttagtgac

SEQ ID NO: 183564 - DNA, 15 bp, Homo sapiens
gaatctgtttagtga

SEQ ID NO: 183565 - DNA, 15 bp, Homo sapiens
agaatctgtttagtg

SEQ ID NO: 183566 - DNA, 15 bp, Homo sapiens
tagaatctgtttagt

SEQ ID NO: 183567 - DNA, 15 bp, Homo sapiens
atagaatctgtttag

SEQ ID NO: 183568 - DNA, 15 bp, Homo sapiens
aatagaatctgttta

SEQ ID NO: 183569 - DNA, 15 bp, Homo sapiens
aaatagaatctgttt

SEQ ID NO: 183570 - DNA, 15 bp, Homo sapiens
aaaatagaatctgtt

SEQ ID NO: 183571 - DNA, 15 bp, Homo sapiens
taaaatagaatctgt

SEQ ID NO: 183572 - DNA, 15 bp, Homo sapiens
gtaaaatagaatctg

SEQ ID NO: 183573 - DNA, 15 bp, Homo sapiens
ggtaaaatagaatct

SEQ ID NO: 183574 - DNA, 15 bp, Homo sapiens
aggtaaaatagaatc

SEQ ID NO: 183575 - DNA, 15 bp, Homo sapiens
caggtaaaatagaat

SEQ ID NO: 183576 - DNA, 15 bp, Homo sapiens
tcaggtaaaatagaa

SEQ ID NO: 183577 - DNA, 15 bp, Homo sapiens
atcaggtaaaataga

SEQ ID NO: 183578 - DNA, 15 bp, Homo sapiens
aatcaggtaaaatag

SEQ ID NO: 183579 - DNA, 15 bp, Homo sapiens
taatcaggtaaaata

SEQ ID NO: 183580 - DNA, 15 bp, Homo sapiens
ttaatcaggtaaaat

SEQ ID NO: 183581 - DNA, 15 bp, Homo sapiens
tttaatcaggtaaaa

SEQ ID NO: 183582 - DNA, 15 bp, Homo sapiens
atttaatcaggtaaa

SEQ ID NO: 183583 - DNA, 15 bp, Homo sapiens
tatttaatcaggtaa

SEQ ID NO: 183584 - DNA, 15 bp, Homo sapiens
ttatttaatcaggta

SEQ ID NO: 183585 - DNA, 15 bp, Homo sapiens
tttatttaatcaggt

SEQ ID NO: 183586 - DNA, 15 bp, Homo sapiens
atttatttaatcagg

SEQ ID NO: 183587 - DNA, 15 bp, Homo sapiens
catttatttaatcag

SEQ ID NO: 183588 - DNA, 15 bp, Homo sapiens
ccatttatttaatca

SEQ ID NO: 183589 - DNA, 15 bp, Homo sapiens
accatttatttaatc

SEQ ID NO: 183590 - DNA, 15 bp, Homo sapiens
taccatttatttaat

SEQ ID NO: 183591 - DNA, 15 bp, Homo sapiens
ttaccatttatttaa

SEQ ID NO: 183592 - DNA, 15 bp, Homo sapiens
gttaccatttattta

SEQ ID NO: 183593 - DNA, 15 bp, Homo sapiens
tgttaccatttattt

SEQ ID NO: 183594 - DNA, 15 bp, Homo sapiens
ttgttaccatttatt

SEQ ID NO: 183595 - DNA, 15 bp, Homo sapiens
cttgttaccatttat

SEQ ID NO: 183596 - DNA, 15 bp, Homo sapiens
ccttgttaccattta

SEQ ID NO: 183597 - DNA, 15 bp, Homo sapiens
gccttgttaccattt

SEQ ID NO: 183598 - DNA, 15 bp, Homo sapiens
ggccttgttaccatt

SEQ ID NO: 183599 - DNA, 15 bp, Homo sapiens
aggccttgttaccat

SEQ ID NO: 183600 - DNA, 15 bp, Homo sapiens
taggccttgttacca

SEQ ID NO: 183601 - DNA, 15 bp, Homo sapiens
ctaggccttgttacc

SEQ ID NO: 183602 - DNA, 15 bp, Homo sapiens
cctaggccttgttac

SEQ ID NO: 183603 - DNA, 15 bp, Homo sapiens
acctaggccttgtta

SEQ ID NO: 183604 - DNA, 15 bp, Homo sapiens
gacctaggccttgtt

SEQ ID NO: 183605 - DNA, 15 bp, Homo sapiens
agacctaggccttgt

SEQ ID NO: 183606 - DNA, 15 bp, Homo sapiens
tagacctaggccttg

SEQ ID NO: 183607 - DNA, 15 bp, Homo sapiens
gtagacctaggcctt

SEQ ID NO: 183608 - DNA, 15 bp, Homo sapiens
agtagacctaggcct

SEQ ID NO: 183609 - DNA, 15 bp, Homo sapiens
gagtagacctaggcc

SEQ ID NO: 183610 - DNA, 15 bp, Homo sapiens
ggagtagacctaggc

SEQ ID NO: 183611 - DNA, 15 bp, Homo sapiens
aggagtagacctagg

SEQ ID NO: 183612 - DNA, 15 bp, Homo sapiens
aaggagtagacctag

SEQ ID NO: 183613 - DNA, 15 bp, Homo sapiens
gaaggagtagaccta

SEQ ID NO: 183614 - DNA, 15 bp, Homo sapiens
cgaaggagtagacct

SEQ ID NO: 183615 - DNA, 15 bp, Homo sapiens
tcgaaggagtagacc

SEQ ID NO: 183616 - DNA, 15 bp, Homo sapiens
atcgaaggagtagac

SEQ ID NO: 183617 - DNA, 15 bp, Homo sapiens
aatcgaaggagtaga

SEQ ID NO: 183618 - DNA, 15 bp, Homo sapiens
aaatcgaaggagtag

SEQ ID NO: 183619 - DNA, 15 bp, Homo sapiens
aaaatcgaaggagta

SEQ ID NO: 183620 - DNA, 15 bp, Homo sapiens
taaaatcgaaggagt

SEQ ID NO: 183621 - DNA, 15 bp, Homo sapiens
gtaaaatcgaaggag

SEQ ID NO: 183622 - DNA, 15 bp, Homo sapiens
agtaaaatcgaagga

SEQ ID NO: 183623 - DNA, 15 bp, Homo sapiens
cagtaaaatcgaagg

SEQ ID NO: 183624 - DNA, 15 bp, Homo sapiens
acagtaaaatcgaag

SEQ ID NO: 183625 - DNA, 15 bp, Homo sapiens
tacagtaaaatcgaa

SEQ ID NO: 183626 - DNA, 15 bp, Homo sapiens
atacagtaaaatcga

SEQ ID NO: 183627 - DNA, 15 bp, Homo sapiens
tatacagtaaaatcg

SEQ ID NO: 183628 - DNA, 15 bp, Homo sapiens
gtatacagtaaaatc

SEQ ID NO: 183629 - DNA, 15 bp, Homo sapiens
agtatacagtaaaat

SEQ ID NO: 183630 - DNA, 15 bp, Homo sapiens
aagtatacagtaaaa

SEQ ID NO: 183631 - DNA, 15 bp, Homo sapiens
taagtatacagtaaa

SEQ ID NO: 183632 - DNA, 15 bp, Homo sapiens
gtaagtatacagtaa

SEQ ID NO: 183633 - DNA, 15 bp, Homo sapiens
agtaagtatacagta

SEQ ID NO: 183634 - DNA, 15 bp, Homo sapiens
aagtaagtatacagt

SEQ ID NO: 183635 - DNA, 15 bp, Homo sapiens
taagtaagtatacag

SEQ ID NO: 183636 - DNA, 15 bp, Homo sapiens
ttaagtaagtataca

SEQ ID NO: 183637 - DNA, 15 bp, Homo sapiens
gttaagtaagtatac

SEQ ID NO: 183638 - DNA, 15 bp, Homo sapiens
tgttaagtaagtata

SEQ ID NO: 183639 - DNA, 15 bp, Homo sapiens
ctgttaagtaagtat

SEQ ID NO: 183640 - DNA, 15 bp, Homo sapiens
actgttaagtaagta

SEQ ID NO: 183641 - DNA, 15 bp, Homo sapiens
aactgttaagtaagt

SEQ ID NO: 183642 - DNA, 15 bp, Homo sapiens
gaactgttaagtaag

SEQ ID NO: 183643 - DNA, 15 bp, Homo sapiens
tgaactgttaagtaa

SEQ ID NO: 183644 - DNA, 15 bp, Homo sapiens
gtgaactgttaagta

SEQ ID NO: 183645 - DNA, 15 bp, Homo sapiens
agtgaactgttaagt

SEQ ID NO: 183646 - DNA, 15 bp, Homo sapiens
aagtgaactgttaag

SEQ ID NO: 183647 - DNA, 15 bp, Homo sapiens
aaagtgaactgttaa

SEQ ID NO: 183648 - DNA, 15 bp, Homo sapiens
caaagtgaactgtta

SEQ ID NO: 183649 - DNA, 15 bp, Homo sapiens
acaaagtgaactgtt

SEQ ID NO: 183650 - DNA, 15 bp, Homo sapiens
gacaaagtgaactgt

SEQ ID NO: 183651 - DNA, 15 bp, Homo sapiens
tgacaaagtgaactg

SEQ ID NO: 183652 - DNA, 15 bp, Homo sapiens
ctgacaaagtgaact

SEQ ID NO: 183653 - DNA, 15 bp, Homo sapiens
tctgacaaagtgaac

SEQ ID NO: 183654 - DNA, 15 bp, Homo sapiens
gtctgacaaagtgaa

SEQ ID NO: 183655 - DNA, 15 bp, Homo sapiens
agtctgacaaagtga

SEQ ID NO: 183656 - DNA, 15 bp, Homo sapiens
aagtctgacaaagtg

SEQ ID NO: 183657 - DNA, 15 bp, Homo sapiens
gaagtctgacaaagt

SEQ ID NO: 183658 - DNA, 15 bp, Homo sapiens
agaagtctgacaaag

SEQ ID NO: 183659 - DNA, 15 bp, Homo sapiens
tagaagtctgacaaa

SEQ ID NO: 183660 - DNA, 15 bp, Homo sapiens
gtagaagtctgacaa

SEQ ID NO: 183661 - DNA, 15 bp, Homo sapiens
ggtagaagtctgaca

SEQ ID NO: 183662 - DNA, 15 bp, Homo sapiens
gggtagaagtctgac

SEQ ID NO: 183663 - DNA, 15 bp, Homo sapiens
ggggtagaagtctga

SEQ ID NO: 183664 - DNA, 15 bp, Homo sapiens
gggggtagaagtctg

SEQ ID NO: 183665 - DNA, 15 bp, Homo sapiens
agggggtagaagtct

SEQ ID NO: 183666 - DNA, 15 bp, Homo sapiens
gagggggtagaagtc

SEQ ID NO: 183667 - DNA, 15 bp, Homo sapiens
agagggggtagaagt

SEQ ID NO: 183668 - DNA, 15 bp, Homo sapiens
tagagggggtagaag

SEQ ID NO: 183669 - DNA, 15 bp, Homo sapiens
gtagagggggtagaa

SEQ ID NO: 183670 - DNA, 15 bp, Homo sapiens
tgtagagggggtaga

SEQ ID NO: 183671 - DNA, 15 bp, Homo sapiens
ttgtagagggggtag

SEQ ID NO: 183672 - DNA, 15 bp, Homo sapiens
cttgtagagggggta

SEQ ID NO: 183673 - DNA, 15 bp, Homo sapiens
tcttgtagagggggt

SEQ ID NO: 183674 - DNA, 15 bp, Homo sapiens
atcttgtagaggggg

SEQ ID NO: 183675 - DNA, 15 bp, Homo sapiens
aatcttgtagagggg

SEQ ID NO: 183676 - DNA, 15 bp, Homo sapiens
taatcttgtagaggg

SEQ ID NO: 183677 - DNA, 15 bp, Homo sapiens
ttaatcttgtagagg

SEQ ID NO: 183678 - DNA, 15 bp, Homo sapiens
cttaatcttgtagag

SEQ ID NO: 183679 - DNA, 15 bp, Homo sapiens
tcttaatcttgtaga

SEQ ID NO: 183680 - DNA, 15 bp, Homo sapiens
ttcttaatcttgtag

SEQ ID NO: 183681 - DNA, 15 bp, Homo sapiens
tttcttaatcttgta

SEQ ID NO: 183682 - DNA, 15 bp, Homo sapiens
ttttcttaatcttgt

SEQ ID NO: 183683 - DNA, 15 bp, Homo sapiens
attttcttaatcttg

SEQ ID NO: 183684 - DNA, 15 bp, Homo sapiens
aattttcttaatctt

SEQ ID NO: 183685 - DNA, 15 bp, Homo sapiens
taattttcttaatct

SEQ ID NO: 183686 - DNA, 15 bp, Homo sapiens
ctaattttcttaatc

SEQ ID NO: 183687 - DNA, 15 bp, Homo sapiens
actaattttcttaat

SEQ ID NO: 183688 - DNA, 15 bp, Homo sapiens
cactaattttcttaa

SEQ ID NO: 183689 - DNA, 15 bp, Homo sapiens
ccactaattttctta

SEQ ID NO: 183690 - DNA, 15 bp, Homo sapiens
accactaattttctt

SEQ ID NO: 183691 - DNA, 15 bp, Homo sapiens
aaccactaattttct

SEQ ID NO: 183692 - DNA, 15 bp, Homo sapiens
taaccactaattttc

SEQ ID NO: 183693 - DNA, 15 bp, Homo sapiens
gtaaccactaatttt

SEQ ID NO: 183694 - DNA, 15 bp, Homo sapiens
tgtaaccactaattt

SEQ ID NO: 183695 - DNA, 15 bp, Homo sapiens
ctgtaaccactaatt

SEQ ID NO: 183696 - DNA, 15 bp, Homo sapiens
actgtaaccactaat

SEQ ID NO: 183697 - DNA, 15 bp, Homo sapiens
cactgtaaccactaa

SEQ ID NO: 183698 - DNA, 15 bp, Homo sapiens
acactgtaaccacta

SEQ ID NO: 183699 - DNA, 15 bp, Homo sapiens
gacactgtaaccact

SEQ ID NO: 183700 - DNA, 15 bp, Homo sapiens
tgacactgtaaccac

SEQ ID NO: 183701 - DNA, 15 bp, Homo sapiens
atgacactgtaacca

SEQ ID NO: 183702 - DNA, 15 bp, Homo sapiens
catgacactgtaacc

SEQ ID NO: 183703 - DNA, 15 bp, Homo sapiens
gcatgacactgtaac

SEQ ID NO: 183704 - DNA, 15 bp, Homo sapiens
tgcatgacactgtaa

SEQ ID NO: 183705 - DNA, 15 bp, Homo sapiens
ttgcatgacactgta

SEQ ID NO: 183706 - DNA, 15 bp, Homo sapiens
attgcatgacactgt

SEQ ID NO: 183707 - DNA, 15 bp, Homo sapiens
aattgcatgacactg

SEQ ID NO: 183708 - DNA, 15 bp, Homo sapiens
gaattgcatgacact

SEQ ID NO: 183709 - DNA, 15 bp, Homo sapiens
agaattgcatgacac

SEQ ID NO: 183710 - DNA, 15 bp, Homo sapiens
tagaattgcatgaca

SEQ ID NO: 183711 - DNA, 15 bp, Homo sapiens
atagaattgcatgac

SEQ ID NO: 183712 - DNA, 15 bp, Homo sapiens
aatagaattgcatga

SEQ ID NO: 183713 - DNA, 15 bp, Homo sapiens
gaatagaattgcatg

SEQ ID NO: 183714 - DNA, 15 bp, Homo sapiens
cgaatagaattgcat

SEQ ID NO: 183715 - DNA, 15 bp, Homo sapiens
ccgaatagaattgca

SEQ ID NO: 183716 - DNA, 15 bp, Homo sapiens
gccgaatagaattgc

SEQ ID NO: 183717 - DNA, 15 bp, Homo sapiens
agccgaatagaattg

SEQ ID NO: 183718 - DNA, 15 bp, Homo sapiens
aagccgaatagaatt

SEQ ID NO: 183719 - DNA, 15 bp, Homo sapiens
caagccgaatagaat

SEQ ID NO: 183720 - DNA, 15 bp, Homo sapiens
tcaagccgaatagaa

SEQ ID NO: 183721 - DNA, 15 bp, Homo sapiens
ttcaagccgaataga

SEQ ID NO: 183722 - DNA, 15 bp, Homo sapiens
tttcaagccgaatag

SEQ ID NO: 183723 - DNA, 15 bp, Homo sapiens
ttttcaagccgaata

SEQ ID NO: 183724 - DNA, 15 bp, Homo sapiens
cttttcaagccgaat

SEQ ID NO: 183725 - DNA, 15 bp, Homo sapiens
acttttcaagccgaa

SEQ ID NO: 183726 - DNA, 15 bp, Homo sapiens
aacttttcaagccga

SEQ ID NO: 183727 - DNA, 15 bp, Homo sapiens
taacttttcaagccg

SEQ ID NO: 183728 - DNA, 15 bp, Homo sapiens
ataacttttcaagcc

SEQ ID NO: 183729 - DNA, 15 bp, Homo sapiens
aataacttttcaagc

SEQ ID NO: 183730 - DNA, 15 bp, Homo sapiens
tcaataacttttcaa

SEQ ID NO: 183731 - DNA, 15 bp, Homo sapiens
ctcaataacttttca

SEQ ID NO: 183732 - DNA, 15 bp, Homo sapiens
cctcaataacttttc

SEQ ID NO: 183733 - DNA, 15 bp, Homo sapiens
gcctcaataactttt

SEQ ID NO: 183734 - DNA, 15 bp, Homo sapiens
tgcctcaataacttt

SEQ ID NO: 183735 - DNA, 15 bp, Homo sapiens
atgcctcaataactt

SEQ ID NO: 183736 - DNA, 15 bp, Homo sapiens
catgcctcaataact

SEQ ID NO: 183737 - DNA, 15 bp, Homo sapiens
acatgcctcaataac

SEQ ID NO: 183738 - DNA, 15 bp, Homo sapiens
aacatgcctcaataa

SEQ ID NO: 183739 - DNA, 15 bp, Homo sapiens
aaacatgcctcaata

SEQ ID NO: 183740 - DNA, 15 bp, Homo sapiens
aaaacatgcctcaat

SEQ ID NO: 183741 - DNA, 15 bp, Homo sapiens
aaaaacatgcctcaa

SEQ ID NO: 183742 - DNA, 15 bp, Homo sapiens
gaaaaacatgcctca

SEQ ID NO: 183743 - DNA, 15 bp, Homo sapiens
ggaaaaacatgcctc

SEQ ID NO: 183744 - DNA, 15 bp, Homo sapiens
tggaaaaacatgcct

SEQ ID NO: 183745 - DNA, 15 bp, Homo sapiens
gtggaaaaacatgcc

SEQ ID NO: 183746 - DNA, 15 bp, Homo sapiens
ggtggaaaaacatgc

SEQ ID NO: 183747 - DNA, 15 bp, Homo sapiens
aggtggaaaaacatg

SEQ ID NO: 183748 - DNA, 15 bp, Homo sapiens
aaggtggaaaaacat

SEQ ID NO: 183749 - DNA, 15 bp, Homo sapiens
aaaggtggaaaaaca

SEQ ID NO: 183750 - DNA, 15 bp, Homo sapiens
aaaaggtggaaaaac

SEQ ID NO: 183751 - DNA, 15 bp, Homo sapiens
aaaaaggtggaaaaa

SEQ ID NO: 183752 - DNA, 15 bp, Homo sapiens
taaaaaggtggaaaa

SEQ ID NO: 183753 - DNA, 15 bp, Homo sapiens
ttaaaaaggtggaaa

SEQ ID NO: 183754 - DNA, 15 bp, Homo sapiens
gttaaaaaggtggaa

SEQ ID NO: 183755 - DNA, 15 bp, Homo sapiens
ggttaaaaaggtgga

SEQ ID NO: 183756 - DNA, 15 bp, Homo sapiens
aggttaaaaaggtgg

SEQ ID NO: 183757 - DNA, 15 bp, Homo sapiens
aaggttaaaaaggtg

SEQ ID NO: 183758 - DNA, 15 bp, Homo sapiens
gaaggttaaaaaggt

SEQ ID NO: 183759 - DNA, 15 bp, Homo sapiens
tgaaggttaaaaagg

SEQ ID NO: 183760 - DNA, 15 bp, Homo sapiens
atgaaggttaaaaag

SEQ ID NO: 183761 - DNA, 15 bp, Homo sapiens
aatgaaggttaaaaa

SEQ ID NO: 183762 - DNA, 15 bp, Homo sapiens
aaatgaaggttaaaa

SEQ ID NO: 183763 - DNA, 15 bp, Homo sapiens
taaatgaaggttaaa

SEQ ID NO: 183764 - DNA, 15 bp, Homo sapiens
ataaatgaaggttaa

SEQ ID NO: 183765 - DNA, 15 bp, Homo sapiens
aataaatgaaggtta

SEQ ID NO: 183766 - DNA, 15 bp, Homo sapiens
aaataaatgaaggtt

SEQ ID NO: 183767 - DNA, 15 bp, Homo sapiens
taaataaatgaaggt

SEQ ID NO: 183768 - DNA, 15 bp, Homo sapiens
ctaaataaatgaagg

SEQ ID NO: 183769 - DNA, 15 bp, Homo sapiens
actaaataaatgaag

SEQ ID NO: 183770 - DNA, 15 bp, Homo sapiens
tactaaataaatgaa

SEQ ID NO: 183771 - DNA, 15 bp, Homo sapiens
ctactaaataaatga

SEQ ID NO: 183772 - DNA, 15 bp, Homo sapiens
tctactaaataaatg

SEQ ID NO: 183773 - DNA, 15 bp, Homo sapiens
ttctactaaataaat

SEQ ID NO: 183774 - DNA, 15 bp, Homo sapiens
cttctactaaataaa

SEQ ID NO: 183775 - DNA, 15 bp, Homo sapiens
gcttctactaaataa

SEQ ID NO: 183776 - DNA, 15 bp, Homo sapiens
tgcttctactaaata

SEQ ID NO: 183777 - DNA, 15 bp, Homo sapiens
atgcttctactaaat

SEQ ID NO: 183778 - DNA, 15 bp, Homo sapiens
aatgcttctactaaa

SEQ ID NO: 183779 - DNA, 15 bp, Homo sapiens
gaatgcttctactaa

SEQ ID NO: 183780 - DNA, 15 bp, Homo sapiens
ggaatgcttctacta

SEQ ID NO: 183781 - DNA, 15 bp, Homo sapiens
gggaatgcttctact

SEQ ID NO: 183782 - DNA, 15 bp, Homo sapiens
agggaatgcttctac

SEQ ID NO: 183783 - DNA, 15 bp, Homo sapiens
aagggaatgcttcta

SEQ ID NO: 183784 - DNA, 15 bp, Homo sapiens
taagggaatgcttct

SEQ ID NO: 183785 - DNA, 15 bp, Homo sapiens
ttaagggaatgcttc

SEQ ID NO: 183786 - DNA, 15 bp, Homo sapiens
cttaagggaatgctt

SEQ ID NO: 183787 - DNA, 15 bp, Homo sapiens
acttaagggaatgct

SEQ ID NO: 183788 - DNA, 15 bp, Homo sapiens
cacttaagggaatgc

SEQ ID NO: 183789 - DNA, 15 bp, Homo sapiens
acacttaagggaatg

SEQ ID NO: 183790 - DNA, 15 bp, Homo sapiens
tacacttaagggaat

SEQ ID NO: 183791 - DNA, 15 bp, Homo sapiens
atacacttaagggaa

SEQ ID NO: 183792 - DNA, 15 bp, Homo sapiens
catacacttaaggga

SEQ ID NO: 183793 - DNA, 15 bp, Homo sapiens
tcatacacttaaggg

SEQ ID NO: 183794 - DNA, 15 bp, Homo sapiens
atcatacacttaagg

SEQ ID NO: 183795 - DNA, 15 bp, Homo sapiens
catcatacacttaag

SEQ ID NO: 183796 - DNA, 15 bp, Homo sapiens
tcatcatacacttaa

SEQ ID NO: 183797 - DNA, 15 bp, Homo sapiens
ctcatcatacactta

SEQ ID NO: 183798 - DNA, 15 bp, Homo sapiens
actcatcatacactt

SEQ ID NO: 183799 - DNA, 15 bp, Homo sapiens
gactcatcatacact

SEQ ID NO: 183800 - DNA, 15 bp, Homo sapiens
tgactcatcatacac

SEQ ID NO: 183801 - DNA, 15 bp, Homo sapiens
ttgactcatcataca

SEQ ID NO: 183802 - DNA, 15 bp, Homo sapiens
gttgactcatcatac

SEQ ID NO: 183803 - DNA, 15 bp, Homo sapiens
tgttgactcatcata

SEQ ID NO: 183804 - DNA, 15 bp, Homo sapiens
gtgttgactcatcat

SEQ ID NO: 183805 - DNA, 15 bp, Homo sapiens
agtgttgactcatca

SEQ ID NO: 183806 - DNA, 15 bp, Homo sapiens
cagtgttgactcatc

SEQ ID NO: 183807 - DNA, 15 bp, Homo sapiens
ccagtgttgactcat

SEQ ID NO: 183808 - DNA, 15 bp, Homo sapiens
accagtgttgactca

SEQ ID NO: 183809 - DNA, 15 bp, Homo sapiens
aaccagtgttgactc

SEQ ID NO: 183810 - DNA, 15 bp, Homo sapiens
aaaccagtgttgact

SEQ ID NO: 183811 - DNA, 15 bp, Homo sapiens
aaaaccagtgttgac

SEQ ID NO: 183812 - DNA, 15 bp, Homo sapiens
caaaaccagtgttga

SEQ ID NO: 183813 - DNA, 15 bp, Homo sapiens
gcaaaaccagtgttg

SEQ ID NO: 183814 - DNA, 15 bp, Homo sapiens
ggcaaaaccagtgtt

SEQ ID NO: 183815 - DNA, 15 bp, Homo sapiens
aggcaaaaccagtgt

SEQ ID NO: 183816 - DNA, 15 bp, Homo sapiens
caggcaaaaccagtg

SEQ ID NO: 183817 - DNA, 15 bp, Homo sapiens
tcaggcaaaaccagt

SEQ ID NO: 183818 - DNA, 15 bp, Homo sapiens
gtcaggcaaaaccag

SEQ ID NO: 183819 - DNA, 15 bp, Homo sapiens
agtcaggcaaaacca

SEQ ID NO: 183820 - DNA, 15 bp, Homo sapiens
gagtcaggcaaaacc

SEQ ID NO: 183821 - DNA, 15 bp, Homo sapiens
ggagtcaggcaaaac

SEQ ID NO: 183822 - DNA, 15 bp, Homo sapiens
tggagtcaggcaaaa

SEQ ID NO: 183823 - DNA, 15 bp, Homo sapiens
ctggagtcaggcaaa

SEQ ID NO: 183824 - DNA, 15 bp, Homo sapiens
actggagtcaggcaa

SEQ ID NO: 183825 - DNA, 15 bp, Homo sapiens
tactggagtcaggca

SEQ ID NO: 183826 - DNA, 15 bp, Homo sapiens
ttactggagtcaggc

SEQ ID NO: 183827 - DNA, 15 bp, Homo sapiens
tttactggagtcagg

SEQ ID NO: 183828 - DNA, 15 bp, Homo sapiens
ctttactggagtcag

SEQ ID NO: 183829 - DNA, 15 bp, Homo sapiens
actttactggagtca

SEQ ID NO: 183830 - DNA, 15 bp, Homo sapiens
gactttactggagtc

SEQ ID NO: 183831 - DNA, 15 bp, Homo sapiens
tgactttactggagt

SEQ ID NO: 183832 - DNA, 15 bp, Homo sapiens
ttgactttactggag

SEQ ID NO: 183833 - DNA, 15 bp, Homo sapiens
tttgactttactgga

SEQ ID NO: 183834 - DNA, 15 bp, Homo sapiens
ctttgactttactgg

SEQ ID NO: 183835 - DNA, 15 bp, Homo sapiens
gctttgactttactg

SEQ ID NO: 183836 - DNA, 15 bp, Homo sapiens
tgctttgactttact

SEQ ID NO: 183837 - DNA, 15 bp, Homo sapiens
atgctttgactttac

SEQ ID NO: 183838 - DNA, 15 bp, Homo sapiens
aatgctttgacttta

SEQ ID NO: 183839 - DNA, 15 bp, Homo sapiens
taatgctttgacttt

SEQ ID NO: 183840 - DNA, 15 bp, Homo sapiens
ataatgctttgactt

SEQ ID NO: 183841 - DNA, 15 bp, Homo sapiens
aataatgctttgact

SEQ ID NO: 183842 - DNA, 15 bp, Homo sapiens
aaataatgctttgac

SEQ ID NO: 183843 - DNA, 15 bp, Homo sapiens
taaataatgctttga

SEQ ID NO: 183844 - DNA, 15 bp, Homo sapiens
ttaaataatgctttg

SEQ ID NO: 183845 - DNA, 15 bp, Homo sapiens
attaaataatgcttt

SEQ ID NO: 183846 - DNA, 15 bp, Homo sapiens
aattaaataatgctt

SEQ ID NO: 183847 - DNA, 15 bp, Homo sapiens
aaattaaataatgct

SEQ ID NO: 183848 - DNA, 15 bp, Homo sapiens
taaattaaataatgc

SEQ ID NO: 183849 - DNA, 15 bp, Homo sapiens
ttaaattaaataatg

SEQ ID NO: 183850 - DNA, 15 bp, Homo sapiens
tttaaattaaataat

SEQ ID NO: 183851 - DNA, 15 bp, Homo sapiens
ttttaaattaaataa

SEQ ID NO: 183852 - DNA, 15 bp, Homo sapiens
attttaaattaaata

SEQ ID NO: 183853 - DNA, 15 bp, Homo sapiens
cattttaaattaaat

SEQ ID NO: 183854 - DNA, 15 bp, Homo sapiens
acattttaaattaaa

SEQ ID NO: 183855 - DNA, 15 bp, Homo sapiens
cacattttaaattaa

SEQ ID NO: 183856 - DNA, 15 bp, Homo sapiens
acacattttaaatta

SEQ ID NO: 183857 - DNA, 15 bp, Homo sapiens
cacacattttaaatt

SEQ ID NO: 183858 - DNA, 15 bp, Homo sapiens
gcacacattttaaat

SEQ ID NO: 183859 - DNA, 15 bp, Homo sapiens
tgcacacattttaaa

SEQ ID NO: 183860 - DNA, 15 bp, Homo sapiens
atgcacacattttaa

SEQ ID NO: 183861 - DNA, 15 bp, Homo sapiens
catgcacacatttta

SEQ ID NO: 183862 - DNA, 15 bp, Homo sapiens
acatgcacacatttt

SEQ ID NO: 183863 - DNA, 15 bp, Homo sapiens
aacatgcacacattt

SEQ ID NO: 183864 - DNA, 15 bp, Homo sapiens
taacatgcacacatt

SEQ ID NO: 183865 - DNA, 15 bp, Homo sapiens
ttaacatgcacacat

SEQ ID NO: 183866 - DNA, 15 bp, Homo sapiens
cttaacatgcacaca

SEQ ID NO: 183867 - DNA, 15 bp, Homo sapiens
acttaacatgcacac

SEQ ID NO: 183868 - DNA, 15 bp, Homo sapiens
aacttaacatgcaca

SEQ ID NO: 183869 - DNA, 15 bp, Homo sapiens
gaacttaacatgcac

SEQ ID NO: 183870 - DNA, 15 bp, Homo sapiens
ggaacttaacatgca

SEQ ID NO: 183871 - DNA, 15 bp, Homo sapiens
aggaacttaacatgc

SEQ ID NO: 183872 - DNA, 15 bp, Homo sapiens
aaggaacttaacatg

SEQ ID NO: 183873 - DNA, 15 bp, Homo sapiens
aaaggaacttaacat

SEQ ID NO: 183874 - DNA, 15 bp, Homo sapiens
gaaaggaacttaaca

SEQ ID NO: 183875 - DNA, 15 bp, Homo sapiens
agaaaggaacttaac

SEQ ID NO: 183876 - DNA, 15 bp, Homo sapiens
aagaaaggaacttaa

SEQ ID NO: 183877 - DNA, 15 bp, Homo sapiens
aaagaaaggaactta

SEQ ID NO: 183878 - DNA, 15 bp, Homo sapiens
caaagaaaggaactt

SEQ ID NO: 183879 - DNA, 15 bp, Homo sapiens
gcaaagaaaggaact

SEQ ID NO: 183880 - DNA, 15 bp, Homo sapiens
tgcaaagaaaggaac

SEQ ID NO: 183881 - DNA, 15 bp, Homo sapiens
atgcaaagaaaggaa

SEQ ID NO: 183882 - DNA, 15 bp, Homo sapiens
aatgcaaagaaagga

SEQ ID NO: 183883 - DNA, 15 bp, Homo sapiens
aaatgcaaagaaagg

SEQ ID NO: 183884 - DNA, 15 bp, Homo sapiens
taaatgcaaagaaag

SEQ ID NO: 183885 - DNA, 15 bp, Homo sapiens
ttaaatgcaaagaaa

SEQ ID NO: 183886 - DNA, 15 bp, Homo sapiens
attaaatgcaaagaa

SEQ ID NO: 183887 - DNA, 15 bp, Homo sapiens
aattaaatgcaaaga

SEQ ID NO: 183888 - DNA, 15 bp, Homo sapiens
caattaaatgcaaag

SEQ ID NO: 183889 - DNA, 15 bp, Homo sapiens
ccaattaaatgcaaa

SEQ ID NO: 183890 - DNA, 15 bp, Homo sapiens
tccaattaaatgcaa

SEQ ID NO: 183891 - DNA, 15 bp, Homo sapiens
ctccaattaaatgca

SEQ ID NO: 183892 - DNA, 15 bp, Homo sapiens
tctccaattaaatgc

SEQ ID NO: 183893 - DNA, 15 bp, Homo sapiens
gtctccaattaaatg

SEQ ID NO: 183894 - DNA, 15 bp, Homo sapiens
agtctccaattaaat

SEQ ID NO: 183895 - DNA, 15 bp, Homo sapiens
aagtctccaattaaa

SEQ ID NO: 183896 - DNA, 15 bp, Homo sapiens
aaagtctccaattaa

SEQ ID NO: 183897 - DNA, 15 bp, Homo sapiens
aaaagtctccaatta

SEQ ID NO: 183898 - DNA, 15 bp, Homo sapiens
aaaaagtctccaatt

SEQ ID NO: 183899 - DNA, 15 bp, Homo sapiens
aaaaaagtctccaat

SEQ ID NO: 183900 - DNA, 15 bp, Homo sapiens
gaaaaaagtctccaa

SEQ ID NO: 183901 - DNA, 15 bp, Homo sapiens
ggaaaaaagtctcca

SEQ ID NO: 183902 - DNA, 15 bp, Homo sapiens
tggaaaaaagtctcc

SEQ ID NO: 183903 - DNA, 15 bp, Homo sapiens
gtggaaaaaagtctc

SEQ ID NO: 183904 - DNA, 15 bp, Homo sapiens
tgtggaaaaaagtct

SEQ ID NO: 183905 - DNA, 15 bp, Homo sapiens
ctgtggaaaaaagtc

SEQ ID NO: 183906 - DNA, 15 bp, Homo sapiens
actgtggaaaaaagt

SEQ ID NO: 183907 - DNA, 15 bp, Homo sapiens
aactgtggaaaaaag

SEQ ID NO: 183908 - DNA, 15 bp, Homo sapiens
taactgtggaaaaaa

SEQ ID NO: 183909 - DNA, 15 bp, Homo sapiens
ctaactgtggaaaaa

SEQ ID NO: 183910 - DNA, 15 bp, Homo sapiens
gctaactgtggaaaa

SEQ ID NO: 183911 - DNA, 15 bp, Homo sapiens
agctaactgtggaaa

SEQ ID NO: 183912 - DNA, 15 bp, Homo sapiens
gagctaactgtggaa

SEQ ID NO: 183913 - DNA, 15 bp, Homo sapiens
tgagctaactgtgga

SEQ ID NO: 183914 - DNA, 15 bp, Homo sapiens
gtgagctaactgtgg

SEQ ID NO: 183915 - DNA, 15 bp, Homo sapiens
ggtgagctaactgtg

SEQ ID NO: 183916 - DNA, 15 bp, Homo sapiens
tggtgagctaactgt

SEQ ID NO: 183917 - DNA, 15 bp, Homo sapiens
ttggtgagctaactg

SEQ ID NO: 183918 - DNA, 15 bp, Homo sapiens
tttggtgagctaact

SEQ ID NO: 183919 - DNA, 15 bp, Homo sapiens
ttttggtgagctaac

SEQ ID NO: 183920 - DNA, 15 bp, Homo sapiens
attttggtgagctaa

SEQ ID NO: 183921 - DNA, 15 bp, Homo sapiens
cattttggtgagcta

SEQ ID NO: 183922 - DNA, 15 bp, Homo sapiens
acattttggtgagct

SEQ ID NO: 183923 - DNA, 15 bp, Homo sapiens
aacattttggtgagc

SEQ ID NO: 183924 - DNA, 15 bp, Homo sapiens
taacattttggtgag

SEQ ID NO: 183925 - DNA, 15 bp, Homo sapiens
gtaacattttggtga

SEQ ID NO: 183926 - DNA, 15 bp, Homo sapiens
agtaacattttggtg

SEQ ID NO: 183927 - DNA, 15 bp, Homo sapiens
tagtaacattttggt

SEQ ID NO: 183928 - DNA, 15 bp, Homo sapiens
ctagtaacattttgg

SEQ ID NO: 183929 - DNA, 15 bp, Homo sapiens
cctagtaacattttg

SEQ ID NO: 183930 - DNA, 15 bp, Homo sapiens
acctagtaacatttt

SEQ ID NO: 183931 - DNA, 15 bp, Homo sapiens
aacctagtaacattt

SEQ ID NO: 183932 - DNA, 15 bp, Homo sapiens
gaacctagtaacatt

SEQ ID NO: 183933 - DNA, 15 bp, Homo sapiens
ggaacctagtaacat

SEQ ID NO: 183934 - DNA, 15 bp, Homo sapiens
aggaacctagtaaca

SEQ ID NO: 183935 - DNA, 15 bp, Homo sapiens
gaggaacctagtaac

SEQ ID NO: 183936 - DNA, 15 bp, Homo sapiens
agaggaacctagtaa

SEQ ID NO: 183937 - DNA, 15 bp, Homo sapiens
cagaggaacctagta

SEQ ID NO: 183938 - DNA, 15 bp, Homo sapiens
acagaggaacctagt

SEQ ID NO: 183939 - DNA, 15 bp, Homo sapiens
cacagaggaacctag

SEQ ID NO: 183940 - DNA, 15 bp, Homo sapiens
ccacagaggaaccta

SEQ ID NO: 183941 - DNA, 15 bp, Homo sapiens
gccacagaggaacct

SEQ ID NO: 183942 - DNA, 15 bp, Homo sapiens
agccacagaggaacc

SEQ ID NO: 183943 - DNA, 15 bp, Homo sapiens
cagccacagaggaac

SEQ ID NO: 183944 - DNA, 15 bp, Homo sapiens
acagccacagaggaa

SEQ ID NO: 183945 - DNA, 15 bp, Homo sapiens
gacagccacagagga

SEQ ID NO: 183946 - DNA, 15 bp, Homo sapiens
agacagccacagagg

SEQ ID NO: 183947 - DNA, 15 bp, Homo sapiens
tagacagccacagag

SEQ ID NO: 183948 - DNA, 15 bp, Homo sapiens
gtagacagccacaga

SEQ ID NO: 183949 - DNA, 15 bp, Homo sapiens
agtagacagccacag

SEQ ID NO: 183950 - DNA, 15 bp, Homo sapiens
tagtagacagccaca

SEQ ID NO: 183951 - DNA, 15 bp, Homo sapiens
atagtagacagccac

SEQ ID NO: 183952 - DNA, 15 bp, Homo sapiens
aatagtagacagcca

SEQ ID NO: 183953 - DNA, 15 bp, Homo sapiens
aaatagtagacagcc

SEQ ID NO: 183954 - DNA, 15 bp, Homo sapiens
caaatagtagacagc

SEQ ID NO: 183955 - DNA, 15 bp, Homo sapiens
tcaaatagtagacag

SEQ ID NO: 183956 - DNA, 15 bp, Homo sapiens
ttcaaatagtagaca

SEQ ID NO: 183957 - DNA, 15 bp, Homo sapiens
gttcaaatagtagac

SEQ ID NO: 183958 - DNA, 15 bp, Homo sapiens
tgttcaaatagtaga

SEQ ID NO: 183959 - DNA, 15 bp, Homo sapiens
ctgttcaaatagtag

SEQ ID NO: 183960 - DNA, 15 bp, Homo sapiens
tctgttcaaatagta

SEQ ID NO: 183961 - DNA, 15 bp, Homo sapiens
gtctgttcaaatagt

SEQ ID NO: 183962 - DNA, 15 bp, Homo sapiens
tgtctgttcaaatag

SEQ ID NO: 183963 - DNA, 15 bp, Homo sapiens
ttgtctgttcaaata

SEQ ID NO: 183964 - DNA, 15 bp, Homo sapiens
cttgtctgttcaaat

SEQ ID NO: 183965 - DNA, 15 bp, Homo sapiens
gcttgtctgttcaaa

SEQ ID NO: 183966 - DNA, 15 bp, Homo sapiens
tgcttgtctgttcaa

SEQ ID NO: 183967 - DNA, 15 bp, Homo sapiens
ttgcttgtctgttca

SEQ ID NO: 183968 - DNA, 15 bp, Homo sapiens
gttgcttgtctgttc

SEQ ID NO: 183969 - DNA, 15 bp, Homo sapiens
agttgcttgtctgtt

SEQ ID NO: 183970 - DNA, 15 bp, Homo sapiens
tagttgcttgtctgt

SEQ ID NO: 183971 - DNA, 15 bp, Homo sapiens
ttagttgcttgtctg

SEQ ID NO: 183972 - DNA, 15 bp, Homo sapiens
attagttgcttgtct

SEQ ID NO: 183973 - DNA, 15 bp, Homo sapiens
aattagttgcttgtc

SEQ ID NO: 183974 - DNA, 15 bp, Homo sapiens
taattagttgcttgt

SEQ ID NO: 183975 - DNA, 15 bp, Homo sapiens
ctaattagttgcttg

SEQ ID NO: 183976 - DNA, 15 bp, Homo sapiens
tctaattagttgctt

SEQ ID NO: 183977 - DNA, 15 bp, Homo sapiens
ttctaattagttgct

SEQ ID NO: 183978 - DNA, 15 bp, Homo sapiens
attctaattagttgc

SEQ ID NO: 183979 - DNA, 15 bp, Homo sapiens
tattctaattagttg

SEQ ID NO: 183980 - DNA, 15 bp, Homo sapiens
ttattctaattagtt

SEQ ID NO: 183981 - DNA, 15 bp, Homo sapiens
gttattctaattagt

SEQ ID NO: 183982 - DNA, 15 bp, Homo sapiens
tgttattctaattag

SEQ ID NO: 183983 - DNA, 15 bp, Homo sapiens
ctgttattctaatta

SEQ ID NO: 183984 - DNA, 15 bp, Homo sapiens
tctgttattctaatt

SEQ ID NO: 183985 - DNA, 15 bp, Homo sapiens
ttctgttattctaat

SEQ ID NO: 183986 - DNA, 15 bp, Homo sapiens
gttctgttattctaa

SEQ ID NO: 183987 - DNA, 15 bp, Homo sapiens
tgttctgttattcta

SEQ ID NO: 183988 - DNA, 15 bp, Homo sapiens
ttgttctgttattct

SEQ ID NO: 183989 - DNA, 15 bp, Homo sapiens
gttgttctgttattc

SEQ ID NO: 183990 - DNA, 15 bp, Homo sapiens
tgttgttctgttatt

SEQ ID NO: 183991 - DNA, 15 bp, Homo sapiens
atgttgttctgttat

SEQ ID NO: 183992 - DNA, 15 bp, Homo sapiens
catgttgttctgtta

SEQ ID NO: 183993 - DNA, 15 bp, Homo sapiens
tcatgttgttctgtt

SEQ ID NO: 183994 - DNA, 15 bp, Homo sapiens
gtcatgttgttctgt

SEQ ID NO: 183995 - DNA, 15 bp, Homo sapiens
agtcatgttgttctg

SEQ ID NO: 183996 - DNA, 15 bp, Homo sapiens
cagtcatgttgttct

SEQ ID NO: 183997 - DNA, 15 bp, Homo sapiens
acagtcatgttgttc

SEQ ID NO: 183998 - DNA, 15 bp, Homo sapiens
gacagtcatgttgtt

SEQ ID NO: 183999 - DNA, 15 bp, Homo sapiens
tgacagtcatgttgt

SEQ ID NO: 184000 - DNA, 15 bp, Homo sapiens
atgacagtcatgttg

SEQ ID NO: 184001 - DNA, 15 bp, Homo sapiens
aatgacagtcatgtt

SEQ ID NO: 184002 - DNA, 15 bp, Homo sapiens
gaatgacagtcatgt

SEQ ID NO: 184003 - DNA, 15 bp, Homo sapiens
ggaatgacagtcatg

SEQ ID NO: 184004 - DNA, 15 bp, Homo sapiens
aggaatgacagtcat

SEQ ID NO: 184005 - DNA, 15 bp, Homo sapiens
gaggaatgacagtca

SEQ ID NO: 184006 - DNA, 15 bp, Homo sapiens
ggaggaatgacagtc

SEQ ID NO: 184007 - DNA, 15 bp, Homo sapiens
tggaggaatgacagt

SEQ ID NO: 184008 - DNA, 15 bp, Homo sapiens
atggaggaatgacag

SEQ ID NO: 184009 - DNA, 15 bp, Homo sapiens
aatggaggaatgaca

SEQ ID NO: 184010 - DNA, 15 bp, Homo sapiens
gaatggaggaatgac

SEQ ID NO: 184011 - DNA, 15 bp, Homo sapiens
agaatggaggaatga

SEQ ID NO: 184012 - DNA, 15 bp, Homo sapiens
aagaatggaggaatg

SEQ ID NO: 184013 - DNA, 15 bp, Homo sapiens
taagaatggaggaat

SEQ ID NO: 184014 - DNA, 15 bp, Homo sapiens
gtaagaatggaggaa

SEQ ID NO: 184015 - DNA, 15 bp, Homo sapiens
tgtaagaatggagga

SEQ ID NO: 184016 - DNA, 15 bp, Homo sapiens
ctgtaagaatggagg

SEQ ID NO: 184017 - DNA, 15 bp, Homo sapiens
cctgtaagaatggag

SEQ ID NO: 184018 - DNA, 15 bp, Homo sapiens
acctgtaagaatgga

SEQ ID NO: 184019 - DNA, 15 bp, Homo sapiens
aacctgtaagaatgg

SEQ ID NO: 184020 - DNA, 15 bp, Homo sapiens
taacctgtaagaatg

SEQ ID NO: 184021 - DNA, 15 bp, Homo sapiens
ataacctgtaagaat

SEQ ID NO: 184022 - DNA, 15 bp, Homo sapiens
aataacctgtaagaa

SEQ ID NO: 184023 - DNA, 15 bp, Homo sapiens
aaataacctgtaaga

SEQ ID NO: 184024 - DNA, 15 bp, Homo sapiens
aaaataacctgtaag

SEQ ID NO: 184025 - DNA, 15 bp, Homo sapiens
aaaaataacctgtaa

SEQ ID NO: 184026 - DNA, 15 bp, Homo sapiens
taaaaataacctgta

SEQ ID NO: 184027 - DNA, 15 bp, Homo sapiens
ttaaaaataacctgt

SEQ ID NO: 184028 - DNA, 15 bp, Homo sapiens
tttaaaaataacctg

SEQ ID NO: 184029 - DNA, 15 bp, Homo sapiens
ttttaaaaataacct

SEQ ID NO: 184030 - DNA, 15 bp, Homo sapiens
tttttaaaaataacc

SEQ ID NO: 184031 - DNA, 15 bp, Homo sapiens
ctttttaaaaataac

SEQ ID NO: 184032 - DNA, 15 bp, Homo sapiens
tctttttaaaaataa

SEQ ID NO: 184033 - DNA, 15 bp, Homo sapiens
ctctttttaaaaata

SEQ ID NO: 184034 - DNA, 15 bp, Homo sapiens
tctctttttaaaaat

SEQ ID NO: 184035 - DNA, 15 bp, Homo sapiens
atctctttttaaaaa

SEQ ID NO: 184036 - DNA, 15 bp, Homo sapiens
aatctctttttaaaa

SEQ ID NO: 184037 - DNA, 15 bp, Homo sapiens
aaatctctttttaaa

SEQ ID NO: 184038 - DNA, 15 bp, Homo sapiens
aaaatctctttttaa

SEQ ID NO: 184039 - DNA, 15 bp, Homo sapiens
caaaatctcttttta

SEQ ID NO: 184040 - DNA, 15 bp, Homo sapiens
acaaaatctcttttt

SEQ ID NO: 184041 - DNA, 15 bp, Homo sapiens
aacaaaatctctttt

SEQ ID NO: 184042 - DNA, 15 bp, Homo sapiens
aaacaaaatctcttt

SEQ ID NO: 184043 - DNA, 15 bp, Homo sapiens
taaacaaaatctctt

SEQ ID NO: 184044 - DNA, 15 bp, Homo sapiens
ttaaacaaaatctct

SEQ ID NO: 184045 - DNA, 15 bp, Homo sapiens
tttaaacaaaatctc

SEQ ID NO: 184046 - DNA, 15 bp, Homo sapiens
ttttaaacaaaatct

SEQ ID NO: 184047 - DNA, 15 bp, Homo sapiens
tttttaaacaaaatc

SEQ ID NO: 184048 - DNA, 15 bp, Homo sapiens
ctttttaaacaaaat

SEQ ID NO: 184049 - DNA, 15 bp, Homo sapiens
tctttttaaacaaaa

SEQ ID NO: 184050 - DNA, 15 bp, Homo sapiens
ctctttttaaacaaa

SEQ ID NO: 184051 - DNA, 15 bp, Homo sapiens
tctctttttaaacaa

SEQ ID NO: 184052 - DNA, 15 bp, Homo sapiens
tttctctttttaaac

SEQ ID NO: 184053 - DNA, 15 bp, Homo sapiens
ttttctctttttaaa

SEQ ID NO: 184054 - DNA, 15 bp, Homo sapiens
attttctctttttaa

SEQ ID NO: 184055 - DNA, 15 bp, Homo sapiens
tattttctcttttta

SEQ ID NO: 184056 - DNA, 15 bp, Homo sapiens
atattttctcttttt

SEQ ID NO: 184057 - DNA, 15 bp, Homo sapiens
catattttctctttt

SEQ ID NO: 184058 - DNA, 15 bp, Homo sapiens
acatattttctcttt

SEQ ID NO: 184059 - DNA, 15 bp, Homo sapiens
tacatattttctctt

SEQ ID NO: 184060 - DNA, 15 bp, Homo sapiens
atacatattttctct

SEQ ID NO: 184061 - DNA, 15 bp, Homo sapiens
aatacatattttctc

SEQ ID NO: 184062 - DNA, 15 bp, Homo sapiens
taatacatattttct

SEQ ID NO: 184063 - DNA, 15 bp, Homo sapiens
ataatacatattttc

SEQ ID NO: 184064 - DNA, 15 bp, Homo sapiens
tataatacatatttt

SEQ ID NO: 184065 - DNA, 15 bp, Homo sapiens
atataatacatattt

SEQ ID NO: 184066 - DNA, 15 bp, Homo sapiens
aatataatacatatt

SEQ ID NO: 184067 - DNA, 15 bp, Homo sapiens
taatataatacatat

SEQ ID NO: 184068 - DNA, 15 bp, Homo sapiens
ttaatataatacata

SEQ ID NO: 184069 - DNA, 15 bp, Homo sapiens
cttaatataatacat

SEQ ID NO: 184070 - DNA, 15 bp, Homo sapiens
ccttaatataataca

SEQ ID NO: 184071 - DNA, 15 bp, Homo sapiens
tccttaatataatac

SEQ ID NO: 184072 - DNA, 15 bp, Homo sapiens
ttccttaatataata

SEQ ID NO: 184073 - DNA, 15 bp, Homo sapiens
tttccttaatataat

SEQ ID NO: 184074 - DNA, 15 bp, Homo sapiens
atttccttaatataa

SEQ ID NO: 184075 - DNA, 15 bp, Homo sapiens
tatttccttaatata

SEQ ID NO: 184076 - DNA, 15 bp, Homo sapiens
atatttccttaatat

SEQ ID NO: 184077 - DNA, 15 bp, Homo sapiens
tatatttccttaata

SEQ ID NO: 184078 - DNA, 15 bp, Homo sapiens
ttatatttccttaat

SEQ ID NO: 184079 - DNA, 15 bp, Homo sapiens
cttatatttccttaa

SEQ ID NO: 184080 - DNA, 15 bp, Homo sapiens
tcttatatttcctta

SEQ ID NO: 184081 - DNA, 15 bp, Homo sapiens
atcttatatttcctt

SEQ ID NO: 184082 - DNA, 15 bp, Homo sapiens
gatcttatatttcct

SEQ ID NO: 184083 - DNA, 15 bp, Homo sapiens
ggatcttatatttcc

SEQ ID NO: 184084 - DNA, 15 bp, Homo sapiens
tggatcttatatttc

SEQ ID NO: 184085 - DNA, 15 bp, Homo sapiens
atggatcttatattt

SEQ ID NO: 184086 - DNA, 15 bp, Homo sapiens
tatggatcttatatt

SEQ ID NO: 184087 - DNA, 15 bp, Homo sapiens
gtatggatcttatat

SEQ ID NO: 184088 - DNA, 15 bp, Homo sapiens
agtatggatcttata

SEQ ID NO: 184089 - DNA, 15 bp, Homo sapiens
gagtatggatcttat

SEQ ID NO: 184090 - DNA, 15 bp, Homo sapiens
agagtatggatctta

SEQ ID NO: 184091 - DNA, 15 bp, Homo sapiens
gagagtatggatctt

SEQ ID NO: 184092 - DNA, 15 bp, Homo sapiens
ggagagtatggatct

SEQ ID NO: 184093 - DNA, 15 bp, Homo sapiens
aggagagtatggatc

SEQ ID NO: 184094 - DNA, 15 bp, Homo sapiens
aaggagagtatggat

SEQ ID NO: 184095 - DNA, 15 bp, Homo sapiens
caaggagagtatgga

SEQ ID NO: 184096 - DNA, 15 bp, Homo sapiens
tcaaggagagtatgg

SEQ ID NO: 184097 - DNA, 15 bp, Homo sapiens
ctcaaggagagtatg

SEQ ID NO: 184098 - DNA, 15 bp, Homo sapiens
cctcaaggagagtat

SEQ ID NO: 184099 - DNA, 15 bp, Homo sapiens
gcctcaaggagagta

SEQ ID NO: 184100 - DNA, 15 bp, Homo sapiens
tgcctcaaggagagt

SEQ ID NO: 184101 - DNA, 15 bp, Homo sapiens
atgcctcaaggagag

SEQ ID NO: 184102 - DNA, 15 bp, Homo sapiens
aatgcctcaaggaga

SEQ ID NO: 184103 - DNA, 15 bp, Homo sapiens
aaatgcctcaaggag

SEQ ID NO: 184104 - DNA, 15 bp, Homo sapiens
aaaatgcctcaagga

SEQ ID NO: 184105 - DNA, 15 bp, Homo sapiens
aaaaatgcctcaagg

SEQ ID NO: 184106 - DNA, 15 bp, Homo sapiens
aaaaaatgcctcaag

SEQ ID NO: 184107 - DNA, 15 bp, Homo sapiens
gaaaaaatgcctcaa

SEQ ID NO: 184108 - DNA, 15 bp, Homo sapiens
tgaaaaaatgcctca

SEQ ID NO: 184109 - DNA, 15 bp, Homo sapiens
gtgaaaaaatgcctc

SEQ ID NO: 184110 - DNA, 15 bp, Homo sapiens
agtgaaaaaatgcct

SEQ ID NO: 184111 - DNA, 15 bp, Homo sapiens
aagtgaaaaaatgcc

SEQ ID NO: 184112 - DNA, 15 bp, Homo sapiens
gaagtgaaaaaatgc

SEQ ID NO: 184113 - DNA, 15 bp, Homo sapiens
tgaagtgaaaaaatg

SEQ ID NO: 184114 - DNA, 15 bp, Homo sapiens
gtgaagtgaaaaaat

SEQ ID NO: 184115 - DNA, 15 bp, Homo sapiens
ggtgaagtgaaaaaa

SEQ ID NO: 184116 - DNA, 15 bp, Homo sapiens
tggtgaagtgaaaaa

SEQ ID NO: 184117 - DNA, 15 bp, Homo sapiens
atggtgaagtgaaaa

SEQ ID NO: 184118 - DNA, 15 bp, Homo sapiens
catggtgaagtgaaa

SEQ ID NO: 184119 - DNA, 15 bp, Homo sapiens
gcatggtgaagtgaa

SEQ ID NO: 184120 - DNA, 15 bp, Homo sapiens
ggcatggtgaagtga

SEQ ID NO: 184121 - DNA, 15 bp, Homo sapiens
tggcatggtgaagtg

SEQ ID NO: 184122 - DNA, 15 bp, Homo sapiens
ttggcatggtgaagt

SEQ ID NO: 184123 - DNA, 15 bp, Homo sapiens
gttggcatggtgaag

SEQ ID NO: 184124 - DNA, 15 bp, Homo sapiens
tgttggcatggtgaa

SEQ ID NO: 184125 - DNA, 15 bp, Homo sapiens
atgttggcatggtga

SEQ ID NO: 184126 - DNA, 15 bp, Homo sapiens
aatgttggcatggtg

SEQ ID NO: 184127 - DNA, 15 bp, Homo sapiens
gaatgttggcatggt

SEQ ID NO: 184128 - DNA, 15 bp, Homo sapiens
ggaatgttggcatgg

SEQ ID NO: 184129 - DNA, 15 bp, Homo sapiens
aggaatgttggcatg

SEQ ID NO: 184130 - DNA, 15 bp, Homo sapiens
aaggaatgttggcat

SEQ ID NO: 184131 - DNA, 15 bp, Homo sapiens
aaaggaatgttggca

SEQ ID NO: 184132 - DNA, 15 bp, Homo sapiens
taaaggaatgttggc

SEQ ID NO: 184133 - DNA, 15 bp, Homo sapiens
ataaaggaatgttgg

SEQ ID NO: 184134 - DNA, 15 bp, Homo sapiens
aataaaggaatgttg

SEQ ID NO: 184135 - DNA, 15 bp, Homo sapiens
gaataaaggaatgtt

SEQ ID NO: 184136 - DNA, 15 bp, Homo sapiens
ggaataaaggaatgt

SEQ ID NO: 184137 - DNA, 15 bp, Homo sapiens
gggaataaaggaatg

SEQ ID NO: 184138 - DNA, 15 bp, Homo sapiens
agggaataaaggaat

SEQ ID NO: 184139 - DNA, 15 bp, Homo sapiens
tagggaataaaggaa

SEQ ID NO: 184140 - DNA, 15 bp, Homo sapiens
atagggaataaagga

SEQ ID NO: 184141 - DNA, 15 bp, Homo sapiens
gatagggaataaagg

SEQ ID NO: 184142 - DNA, 15 bp, Homo sapiens
tgatagggaataaag

SEQ ID NO: 184143 - DNA, 15 bp, Homo sapiens
atgatagggaataaa

SEQ ID NO: 184144 - DNA, 15 bp, Homo sapiens
tatgatagggaataa

SEQ ID NO: 184145 - DNA, 15 bp, Homo sapiens
ttatgatagggaata

SEQ ID NO: 184146 - DNA, 15 bp, Homo sapiens
attatgatagggaat

SEQ ID NO: 184147 - DNA, 15 bp, Homo sapiens
tattatgatagggaa

SEQ ID NO: 184148 - DNA, 15 bp, Homo sapiens
gtattatgataggga

SEQ ID NO: 184149 - DNA, 15 bp, Homo sapiens
ggtattatgataggg

SEQ ID NO: 184150 - DNA, 15 bp, Homo sapiens
cggtattatgatagg

SEQ ID NO: 184151 - DNA, 15 bp, Homo sapiens
tcggtattatgatag

SEQ ID NO: 184152 - DNA, 15 bp, Homo sapiens
atcggtattatgata

SEQ ID NO: 184153 - DNA, 15 bp, Homo sapiens
gatcggtattatgat

SEQ ID NO: 184154 - DNA, 15 bp, Homo sapiens
tgatcggtattatga

SEQ ID NO: 184155 - DNA, 15 bp, Homo sapiens
ttgatcggtattatg

SEQ ID NO: 184156 - DNA, 15 bp, Homo sapiens
cttgatcggtattat

SEQ ID NO: 184157 - DNA, 15 bp, Homo sapiens
tcttgatcggtatta

SEQ ID NO: 184158 - DNA, 15 bp, Homo sapiens
ttcttgatcggtatt

SEQ ID NO: 184159 - DNA, 15 bp, Homo sapiens
tttcttgatcggtat

SEQ ID NO: 184160 - DNA, 15 bp, Homo sapiens
atttcttgatcggta

SEQ ID NO: 184161 - DNA, 15 bp, Homo sapiens
catttcttgatcggt

SEQ ID NO: 184162 - DNA, 15 bp, Homo sapiens
ccatttcttgatcgg

SEQ ID NO: 184163 - DNA, 15 bp, Homo sapiens
cccatttcttgatcg

SEQ ID NO: 184164 - DNA, 15 bp, Homo sapiens
tcccatttcttgatc

SEQ ID NO: 184165 - DNA, 15 bp, Homo sapiens
ctcccatttcttgat

SEQ ID NO: 184166 - DNA, 15 bp, Homo sapiens
cctcccatttcttga

SEQ ID NO: 184167 - DNA, 15 bp, Homo sapiens
acctcccatttcttg

SEQ ID NO: 184168 - DNA, 15 bp, Homo sapiens
aacctcccatttctt

SEQ ID NO: 184169 - DNA, 15 bp, Homo sapiens
aaacctcccatttct

SEQ ID NO: 184170 - DNA, 15 bp, Homo sapiens
aaaacctcccatttc

SEQ ID NO: 184171 - DNA, 15 bp, Homo sapiens
gaaaacctcccattt

SEQ ID NO: 184172 - DNA, 15 bp, Homo sapiens
ggaaaacctcccatt

SEQ ID NO: 184173 - DNA, 15 bp, Homo sapiens
aggaaaacctcccat

SEQ ID NO: 184174 - DNA, 15 bp, Homo sapiens
taggaaaacctccca

SEQ ID NO: 184175 - DNA, 15 bp, Homo sapiens
ttaggaaaacctccc

SEQ ID NO: 184176 - DNA, 15 bp, Homo sapiens
cttaggaaaacctcc

SEQ ID NO: 184177 - DNA, 15 bp, Homo sapiens
acttaggaaaacctc

SEQ ID NO: 184178 - DNA, 15 bp, Homo sapiens
gacttaggaaaacct

SEQ ID NO: 184179 - DNA, 15 bp, Homo sapiens
tgacttaggaaaacc

SEQ ID NO: 184180 - DNA, 15 bp, Homo sapiens
ttgacttaggaaaac

SEQ ID NO: 184181 - DNA, 15 bp, Homo sapiens
cttgacttaggaaaa

SEQ ID NO: 184182 - DNA, 15 bp, Homo sapiens
tcttgacttaggaaa

SEQ ID NO: 184183 - DNA, 15 bp, Homo sapiens
ttcttgacttaggaa

SEQ ID NO: 184184 - DNA, 15 bp, Homo sapiens
tttcttgacttagga

SEQ ID NO: 184185 - DNA, 15 bp, Homo sapiens
ttttcttgacttagg

SEQ ID NO: 184186 - DNA, 15 bp, Homo sapiens
gttttcttgacttag

SEQ ID NO: 184187 - DNA, 15 bp, Homo sapiens
ggttttcttgactta

SEQ ID NO: 184188 - DNA, 15 bp, Homo sapiens
aggttttcttgactt

SEQ ID NO: 184189 - DNA, 15 bp, Homo sapiens
gaggttttcttgact

SEQ ID NO: 184190 - DNA, 15 bp, Homo sapiens
agaggttttcttgac

SEQ ID NO: 184191 - DNA, 15 bp, Homo sapiens
gagaggttttcttga

SEQ ID NO: 184192 - DNA, 15 bp, Homo sapiens
tgagaggttttcttg

SEQ ID NO: 184193 - DNA, 15 bp, Homo sapiens
gtgagaggttttctt

SEQ ID NO: 184194 - DNA, 15 bp, Homo sapiens
tgtgagaggttttct

SEQ ID NO: 184195 - DNA, 15 bp, Homo sapiens
gtgtgagaggttttc

SEQ ID NO: 184196 - DNA, 15 bp, Homo sapiens
tgtgtgagaggtttt

SEQ ID NO: 184197 - DNA, 15 bp, Homo sapiens
atgtgtgagaggttt

SEQ ID NO: 184198 - DNA, 15 bp, Homo sapiens
tatgtgtgagaggtt

SEQ ID NO: 184199 - DNA, 15 bp, Homo sapiens
ttatgtgtgagaggt

SEQ ID NO: 184200 - DNA, 15 bp, Homo sapiens
tttatgtgtgagagg

SEQ ID NO: 184201 - DNA, 15 bp, Homo sapiens
ttttatgtgtgagag

SEQ ID NO: 184202 - DNA, 15 bp, Homo sapiens
tttttatgtgtgaga

SEQ ID NO: 184203 - DNA, 15 bp, Homo sapiens
atttttatgtgtgag

SEQ ID NO: 184204 - DNA, 15 bp, Homo sapiens
aatttttatgtgtga

SEQ ID NO: 184205 - DNA, 15 bp, Homo sapiens
gaatttttatgtgtg

SEQ ID NO: 184206 - DNA, 15 bp, Homo sapiens
tgaatttttatgtgt

SEQ ID NO: 184207 - DNA, 15 bp, Homo sapiens
ttgaatttttatgtg

SEQ ID NO: 184208 - DNA, 15 bp, Homo sapiens
tttgaatttttatgt

SEQ ID NO: 184209 - DNA, 15 bp, Homo sapiens
gtttgaatttttatg

SEQ ID NO: 184210 - DNA, 15 bp, Homo sapiens
agtttgaatttttat

SEQ ID NO: 184211 - DNA, 15 bp, Homo sapiens
cagtttgaattttta

SEQ ID NO: 184212 - DNA, 15 bp, Homo sapiens
ccagtttgaattttt

SEQ ID NO: 184213 - DNA, 15 bp, Homo sapiens
cccagtttgaatttt

SEQ ID NO: 184214 - DNA, 15 bp, Homo sapiens
tcccagtttgaattt

SEQ ID NO: 184215 - DNA, 15 bp, Homo sapiens
ttcccagtttgaatt

SEQ ID NO: 184216 - DNA, 15 bp, Homo sapiens
tttcccagtttgaat

SEQ ID NO: 184217 - DNA, 15 bp, Homo sapiens
ctttcccagtttgaa

SEQ ID NO: 184218 - DNA, 15 bp, Homo sapiens
gctttcccagtttga

SEQ ID NO: 184219 - DNA, 15 bp, Homo sapiens
tgctttcccagtttg

SEQ ID NO: 184220 - DNA, 15 bp, Homo sapiens
ttgctttcccagttt

SEQ ID NO: 184221 - DNA, 15 bp, Homo sapiens
tttgctttcccagtt

SEQ ID NO: 184222 - DNA, 15 bp, Homo sapiens
atttgctttcccagt

SEQ ID NO: 184223 - DNA, 15 bp, Homo sapiens
catttgctttcccag

SEQ ID NO: 184224 - DNA, 15 bp, Homo sapiens
acatttgctttccca

SEQ ID NO: 184225 - DNA, 15 bp, Homo sapiens
tacatttgctttccc

SEQ ID NO: 184226 - DNA, 15 bp, Homo sapiens
atacatttgctttcc

SEQ ID NO: 184227 - DNA, 15 bp, Homo sapiens
gatacatttgctttc

SEQ ID NO: 184228 - DNA, 15 bp, Homo sapiens
tgatacatttgcttt

SEQ ID NO: 184229 - DNA, 15 bp, Homo sapiens
ctgatacatttgctt

SEQ ID NO: 184230 - DNA, 15 bp, Homo sapiens
cctgatacatttgct

SEQ ID NO: 184231 - DNA, 15 bp, Homo sapiens
ccctgatacatttgc

SEQ ID NO: 184232 - DNA, 15 bp, Homo sapiens
cccctgatacatttg

SEQ ID NO: 184233 - DNA, 15 bp, Homo sapiens
ccccctgatacattt

SEQ ID NO: 184234 - DNA, 15 bp, Homo sapiens
gccccctgatacatt

SEQ ID NO: 184235 - DNA, 15 bp, Homo sapiens
cgccccctgatacat

SEQ ID NO: 184236 - DNA, 15 bp, Homo sapiens
ccgccccctgataca

SEQ ID NO: 184237 - DNA, 15 bp, Homo sapiens
gccgccccctgatac

SEQ ID NO: 184238 - DNA, 15 bp, Homo sapiens
agccgccccctgata

SEQ ID NO: 184239 - DNA, 15 bp, Homo sapiens
aagccgccccctgat

SEQ ID NO: 184240 - DNA, 15 bp, Homo sapiens
aaagccgccccctga

SEQ ID NO: 184241 - DNA, 15 bp, Homo sapiens
aaaagccgccccctg

SEQ ID NO: 184242 - DNA, 15 bp, Homo sapiens
taaaagccgccccct

SEQ ID NO: 184243 - DNA, 15 bp, Homo sapiens
ttaaaagccgccccc

SEQ ID NO: 184244 - DNA, 15 bp, Homo sapiens
attaaaagccgcccc

SEQ ID NO: 184245 - DNA, 15 bp, Homo sapiens
aattaaaagccgccc

SEQ ID NO: 184246 - DNA, 15 bp, Homo sapiens
aaattaaaagccgcc

SEQ ID NO: 184247 - DNA, 15 bp, Homo sapiens
caaattaaaagccgc

SEQ ID NO: 184248 - DNA, 15 bp, Homo sapiens
tcaaattaaaagccg

SEQ ID NO: 184249 - DNA, 15 bp, Homo sapiens
gtcaaattaaaagcc

SEQ ID NO: 184250 - DNA, 15 bp, Homo sapiens
tgtcaaattaaaagc

SEQ ID NO: 184251 - DNA, 15 bp, Homo sapiens
ttgtcaaattaaaag

SEQ ID NO: 184252 - DNA, 15 bp, Homo sapiens
tttgtcaaattaaaa

SEQ ID NO: 184253 - DNA, 15 bp, Homo sapiens
ttttgtcaaattaaa

SEQ ID NO: 184254 - DNA, 15 bp, Homo sapiens
cttttgtcaaattaa

SEQ ID NO: 184255 - DNA, 15 bp, Homo sapiens
tcttttgtcaaatta

SEQ ID NO: 184256 - DNA, 15 bp, Homo sapiens
atcttttgtcaaatt

SEQ ID NO: 184257 - DNA, 15 bp, Homo sapiens
gatcttttgtcaaat

SEQ ID NO: 184258 - DNA, 15 bp, Homo sapiens
agatcttttgtcaaa

SEQ ID NO: 184259 - DNA, 15 bp, Homo sapiens
cagatcttttgtcaa

SEQ ID NO: 184260 - DNA, 15 bp, Homo sapiens
gcagatcttttgtca

SEQ ID NO: 184261 - DNA, 15 bp, Homo sapiens
agcagatcttttgtc

SEQ ID NO: 184262 - DNA, 15 bp, Homo sapiens
tagcagatcttttgt

SEQ ID NO: 184263 - DNA, 15 bp, Homo sapiens
gtagcagatcttttg

SEQ ID NO: 184264 - DNA, 15 bp, Homo sapiens
tgtagcagatctttt

SEQ ID NO: 184265 - DNA, 15 bp, Homo sapiens
atgtagcagatcttt

SEQ ID NO: 184266 - DNA, 15 bp, Homo sapiens
aatgtagcagatctt

SEQ ID NO: 184267 - DNA, 15 bp, Homo sapiens
taatgtagcagatct

SEQ ID NO: 184268 - DNA, 15 bp, Homo sapiens
gtaatgtagcagatc

SEQ ID NO: 184269 - DNA, 15 bp, Homo sapiens
tgtaatgtagcagat

SEQ ID NO: 184270 - DNA, 15 bp, Homo sapiens
ttgtaatgtagcaga

SEQ ID NO: 184271 - DNA, 15 bp, Homo sapiens
tttgtaatgtagcag

SEQ ID NO: 184272 - DNA, 15 bp, Homo sapiens
ttttgtaatgtagca

SEQ ID NO: 184273 - DNA, 15 bp, Homo sapiens
cttttgtaatgtagc

SEQ ID NO: 184274 - DNA, 15 bp, Homo sapiens
tcttttgtaatgtag

SEQ ID NO: 184275 - DNA, 15 bp, Homo sapiens
ttcttttgtaatgta

SEQ ID NO: 184276 - DNA, 15 bp, Homo sapiens
attcttttgtaatgt

SEQ ID NO: 184277 - DNA, 15 bp, Homo sapiens
aattcttttgtaatg

SEQ ID NO: 184278 - DNA, 15 bp, Homo sapiens
aaattcttttgtaat

SEQ ID NO: 184279 - DNA, 15 bp, Homo sapiens
aaaattcttttgtaa

SEQ ID NO: 184280 - DNA, 15 bp, Homo sapiens
aaaaattcttttgta

SEQ ID NO: 184281 - DNA, 15 bp, Homo sapiens
gaaaaattcttttgt

SEQ ID NO: 184282 - DNA, 15 bp, Homo sapiens
agaaaaattcttttg

SEQ ID NO: 184283 - DNA, 15 bp, Homo sapiens
tagaaaaattctttt

SEQ ID NO: 184284 - DNA, 15 bp, Homo sapiens
ttagaaaaattcttt

SEQ ID NO: 184285 - DNA, 15 bp, Homo sapiens
tttagaaaaattctt

SEQ ID NO: 184286 - DNA, 15 bp, Homo sapiens
ctttagaaaaattct

SEQ ID NO: 184287 - DNA, 15 bp, Homo sapiens
tctttagaaaaattc

SEQ ID NO: 184288 - DNA, 15 bp, Homo sapiens
atctttagaaaaatt

SEQ ID NO: 184289 - DNA, 15 bp, Homo sapiens
aatctttagaaaaat

SEQ ID NO: 184290 - DNA, 15 bp, Homo sapiens
taatctttagaaaaa

SEQ ID NO: 184291 - DNA, 15 bp, Homo sapiens
gtaatctttagaaaa

SEQ ID NO: 184292 - DNA, 15 bp, Homo sapiens
agtaatctttagaaa

SEQ ID NO: 184293 - DNA, 15 bp, Homo sapiens
aagtaatctttagaa

SEQ ID NO: 184294 - DNA, 15 bp, Homo sapiens
aaagtaatctttaga

SEQ ID NO: 184295 - DNA, 15 bp, Homo sapiens
taaagtaatctttag

SEQ ID NO: 184296 - DNA, 15 bp, Homo sapiens
ataaagtaatcttta

SEQ ID NO: 184297 - DNA, 15 bp, Homo sapiens
cataaagtaatcttt

SEQ ID NO: 184298 - DNA, 15 bp, Homo sapiens
acataaagtaatctt

SEQ ID NO: 184299 - DNA, 15 bp, Homo sapiens
tacataaagtaatct

SEQ ID NO: 184300 - DNA, 15 bp, Homo sapiens
ctacataaagtaatc

SEQ ID NO: 184301 - DNA, 15 bp, Homo sapiens
tctacataaagtaat

SEQ ID NO: 184302 - DNA, 15 bp, Homo sapiens
gtctacataaagtaa

SEQ ID NO: 184303 - DNA, 15 bp, Homo sapiens
tgtctacataaagta

SEQ ID NO: 184304 - DNA, 15 bp, Homo sapiens
ttgtctacataaagt

SEQ ID NO: 184305 - DNA, 15 bp, Homo sapiens
gttgtctacataaag

SEQ ID NO: 184306 - DNA, 15 bp, Homo sapiens
agttgtctacataaa

SEQ ID NO: 184307 - DNA, 15 bp, Homo sapiens
gagttgtctacataa

SEQ ID NO: 184308 - DNA, 15 bp, Homo sapiens
ggagttgtctacata

SEQ ID NO: 184309 - DNA, 15 bp, Homo sapiens
gggagttgtctacat

SEQ ID NO: 184310 - DNA, 15 bp, Homo sapiens
agggagttgtctaca

SEQ ID NO: 184311 - DNA, 15 bp, Homo sapiens
gagggagttgtctac

SEQ ID NO: 184312 - DNA, 15 bp, Homo sapiens
tgagggagttgtcta

SEQ ID NO: 184313 - DNA, 15 bp, Homo sapiens
ctgagggagttgtct

SEQ ID NO: 184314 - DNA, 15 bp, Homo sapiens
actgagggagttgtc

SEQ ID NO: 184315 - DNA, 15 bp, Homo sapiens
cactgagggagttgt

SEQ ID NO: 184316 - DNA, 15 bp, Homo sapiens
acactgagggagttg

SEQ ID NO: 184317 - DNA, 15 bp, Homo sapiens
tacactgagggagtt

SEQ ID NO: 184318 - DNA, 15 bp, Homo sapiens
gtacactgagggagt

SEQ ID NO: 184319 - DNA, 15 bp, Homo sapiens
ggtacactgagggag

SEQ ID NO: 184320 - DNA, 15 bp, Homo sapiens
cggtacactgaggga

SEQ ID NO: 184321 - DNA, 15 bp, Homo sapiens
tcggtacactgaggg

SEQ ID NO: 184322 - DNA, 15 bp, Homo sapiens
ttcggtacactgagg

SEQ ID NO: 184323 - DNA, 15 bp, Homo sapiens
tttcggtacactgag

SEQ ID NO: 184324 - DNA, 15 bp, Homo sapiens
ttttcggtacactga

SEQ ID NO: 184325 - DNA, 15 bp, Homo sapiens
attttcggtacactg

SEQ ID NO: 184326 - DNA, 15 bp, Homo sapiens
gattttcggtacact

SEQ ID NO: 184327 - DNA, 15 bp, Homo sapiens
tgattttcggtacac

SEQ ID NO: 184328 - DNA, 15 bp, Homo sapiens
ttgattttcggtaca

SEQ ID NO: 184329 - DNA, 15 bp, Homo sapiens
tttgattttcggtac

SEQ ID NO: 184330 - DNA, 15 bp, Homo sapiens
ctttgattttcggta

SEQ ID NO: 184331 - DNA, 15 bp, Homo sapiens
tctttgattttcggt

SEQ ID NO: 184332 - DNA, 15 bp, Homo sapiens
ttctttgattttcgg

SEQ ID NO: 184333 - DNA, 15 bp, Homo sapiens
attctttgattttcg

SEQ ID NO: 184334 - DNA, 15 bp, Homo sapiens
cattctttgattttc

SEQ ID NO: 184335 - DNA, 15 bp, Homo sapiens
acattctttgatttt

SEQ ID NO: 184336 - DNA, 15 bp, Homo sapiens
aacattctttgattt

SEQ ID NO: 184337 - DNA, 15 bp, Homo sapiens
gaacattctttgatt

SEQ ID NO: 184338 - DNA, 15 bp, Homo sapiens
agaacattctttgat

SEQ ID NO: 184339 - DNA, 15 bp, Homo sapiens
tagaacattctttga

SEQ ID NO: 184340 - DNA, 15 bp, Homo sapiens
gtagaacattctttg

SEQ ID NO: 184341 - DNA, 15 bp, Homo sapiens
tgtagaacattcttt

SEQ ID NO: 184342 - DNA, 15 bp, Homo sapiens
atgtagaacattctt

SEQ ID NO: 184343 - DNA, 15 bp, Homo sapiens
aatgtagaacattct

SEQ ID NO: 184344 - DNA, 15 bp, Homo sapiens
aaatgtagaacattc

SEQ ID NO: 184345 - DNA, 15 bp, Homo sapiens
aaaatgtagaacatt

SEQ ID NO: 184346 - DNA, 15 bp, Homo sapiens
taaaatgtagaacat

SEQ ID NO: 184347 - DNA, 15 bp, Homo sapiens
ttaaaatgtagaaca

SEQ ID NO: 184348 - DNA, 15 bp, Homo sapiens
tttaaaatgtagaac

SEQ ID NO: 184349 - DNA, 15 bp, Homo sapiens
gtttaaaatgtagaa

SEQ ID NO: 184350 - DNA, 15 bp, Homo sapiens
tgtttaaaatgtaga

SEQ ID NO: 184351 - DNA, 15 bp, Homo sapiens
gtgtttaaaatgtag

SEQ ID NO: 184352 - DNA, 15 bp, Homo sapiens
tgtgtttaaaatgta

SEQ ID NO: 184353 - DNA, 15 bp, Homo sapiens
atgtgtttaaaatgt

SEQ ID NO: 184354 - DNA, 15 bp, Homo sapiens
aatgtgtttaaaatg

SEQ ID NO: 184355 - DNA, 15 bp, Homo sapiens
aaatgtgtttaaaat

SEQ ID NO: 184356 - DNA, 15 bp, Homo sapiens
aaaatgtgtttaaaa

SEQ ID NO: 184357 - DNA, 15 bp, Homo sapiens
taaaatgtgtttaaa

SEQ ID NO: 184358 - DNA, 15 bp, Homo sapiens
ttaaaatgtgtttaa

SEQ ID NO: 184359 - DNA, 15 bp, Homo sapiens
tttaaaatgtgttta

SEQ ID NO: 184360 - DNA, 15 bp, Homo sapiens
ttttaaaatgtgttt

SEQ ID NO: 184361 - DNA, 15 bp, Homo sapiens
attttaaaatgtgtt

SEQ ID NO: 184362 - DNA, 15 bp, Homo sapiens
cattttaaaatgtgt

SEQ ID NO: 184363 - DNA, 15 bp, Homo sapiens
ccattttaaaatgtg

SEQ ID NO: 184364 - DNA, 15 bp, Homo sapiens
cccattttaaaatgt

SEQ ID NO: 184365 - DNA, 15 bp, Homo sapiens
gcccattttaaaatg

SEQ ID NO: 184366 - DNA, 15 bp, Homo sapiens
tgcccattttaaaat

SEQ ID NO: 184367 - DNA, 15 bp, Homo sapiens
gtgcccattttaaaa

SEQ ID NO: 184368 - DNA, 15 bp, Homo sapiens
tgtgcccattttaaa

SEQ ID NO: 184369 - DNA, 15 bp, Homo sapiens
gtgtgcccattttaa

SEQ ID NO: 184370 - DNA, 15 bp, Homo sapiens
ggtgtgcccatttta

SEQ ID NO: 184371 - DNA, 15 bp, Homo sapiens
aggtgtgcccatttt

SEQ ID NO: 184372 - DNA, 15 bp, Homo sapiens
caggtgtgcccattt

SEQ ID NO: 184373 - DNA, 15 bp, Homo sapiens
acaggtgtgcccatt

SEQ ID NO: 184374 - DNA, 15 bp, Homo sapiens
aacaggtgtgcccat

SEQ ID NO: 184375 - DNA, 15 bp, Homo sapiens
gaacaggtgtgccca

SEQ ID NO: 184376 - DNA, 15 bp, Homo sapiens
ggaacaggtgtgccc

SEQ ID NO: 184377 - DNA, 15 bp, Homo sapiens
aggaacaggtgtgcc

SEQ ID NO: 184378 - DNA, 15 bp, Homo sapiens
taggaacaggtgtgc

SEQ ID NO: 184379 - DNA, 15 bp, Homo sapiens
ttaggaacaggtgtg

SEQ ID NO: 184380 - DNA, 15 bp, Homo sapiens
attaggaacaggtgt

SEQ ID NO: 184381 - DNA, 15 bp, Homo sapiens
tattaggaacaggtg

SEQ ID NO: 184382 - DNA, 15 bp, Homo sapiens
atattaggaacaggt

SEQ ID NO: 184383 - DNA, 15 bp, Homo sapiens
aatattaggaacagg

SEQ ID NO: 184384 - DNA, 15 bp, Homo sapiens
gaatattaggaacag

SEQ ID NO: 184385 - DNA, 15 bp, Homo sapiens
agaatattaggaaca

SEQ ID NO: 184386 - DNA, 15 bp, Homo sapiens
aagaatattaggaac

SEQ ID NO: 184387 - DNA, 15 bp, Homo sapiens
taagaatattaggaa

SEQ ID NO: 184388 - DNA, 15 bp, Homo sapiens
ataagaatattagga

SEQ ID NO: 184389 - DNA, 15 bp, Homo sapiens
cataagaatattagg

SEQ ID NO: 184390 - DNA, 15 bp, Homo sapiens
acataagaatattag

SEQ ID NO: 184391 - DNA, 15 bp, Homo sapiens
tacataagaatatta

SEQ ID NO: 184392 - DNA, 15 bp, Homo sapiens
ttacataagaatatt

SEQ ID NO: 184393 - DNA, 15 bp, Homo sapiens
tttacataagaatat

SEQ ID NO: 184394 - DNA, 15 bp, Homo sapiens
atttacataagaata

SEQ ID NO: 184395 - DNA, 15 bp, Homo sapiens
catttacataagaat

SEQ ID NO: 184396 - DNA, 15 bp, Homo sapiens
ccatttacataagaa

SEQ ID NO: 184397 - DNA, 15 bp, Homo sapiens
tccatttacataaga

SEQ ID NO: 184398 - DNA, 15 bp, Homo sapiens
gtccatttacataag

SEQ ID NO: 184399 - DNA, 15 bp, Homo sapiens
ggtccatttacataa

SEQ ID NO: 184400 - DNA, 15 bp, Homo sapiens
aggtccatttacata

SEQ ID NO: 184401 - DNA, 15 bp, Homo sapiens
taggtccatttacat

SEQ ID NO: 184402 - DNA, 15 bp, Homo sapiens
ataggtccatttaca

SEQ ID NO: 184403 - DNA, 15 bp, Homo sapiens
aataggtccatttac

SEQ ID NO: 184404 - DNA, 15 bp, Homo sapiens
aaataggtccattta

SEQ ID NO: 184405 - DNA, 15 bp, Homo sapiens
taaataggtccattt

SEQ ID NO: 184406 - DNA, 15 bp, Homo sapiens
gtaaataggtccatt

SEQ ID NO: 184407 - DNA, 15 bp, Homo sapiens
tgtaaataggtccat

SEQ ID NO: 184408 - DNA, 15 bp, Homo sapiens
atgtaaataggtcca

SEQ ID NO: 184409 - DNA, 15 bp, Homo sapiens
catgtaaataggtcc

SEQ ID NO: 184410 - DNA, 15 bp, Homo sapiens
acatgtaaataggtc

SEQ ID NO: 184411 - DNA, 15 bp, Homo sapiens
cacatgtaaataggt

SEQ ID NO: 184412 - DNA, 15 bp, Homo sapiens
tcacatgtaaatagg

SEQ ID NO: 184413 - DNA, 15 bp, Homo sapiens
ctcacatgtaaatag

SEQ ID NO: 184414 - DNA, 15 bp, Homo sapiens
tctcacatgtaaata

SEQ ID NO: 184415 - DNA, 15 bp, Homo sapiens
gtctcacatgtaaat

SEQ ID NO: 184416 - DNA, 15 bp, Homo sapiens
ggtctcacatgtaaa

SEQ ID NO: 184417 - DNA, 15 bp, Homo sapiens
gggtctcacatgtaa

SEQ ID NO: 184418 - DNA, 15 bp, Homo sapiens
tgggtctcacatgta

SEQ ID NO: 184419 - DNA, 15 bp, Homo sapiens
ttgggtctcacatgt

SEQ ID NO: 184420 - DNA, 15 bp, Homo sapiens
attgggtctcacatg

SEQ ID NO: 184421 - DNA, 15 bp, Homo sapiens
cattgggtctcacat

SEQ ID NO: 184422 - DNA, 15 bp, Homo sapiens
acattgggtctcaca

SEQ ID NO: 184423 - DNA, 15 bp, Homo sapiens
cacattgggtctcac

SEQ ID NO: 184424 - DNA, 15 bp, Homo sapiens
ccacattgggtctca

SEQ ID NO: 184425 - DNA, 15 bp, Homo sapiens
accacattgggtctc

SEQ ID NO: 184426 - DNA, 15 bp, Homo sapiens
caccacattgggtct

SEQ ID NO: 184427 - DNA, 15 bp, Homo sapiens
ccaccacattgggtc

SEQ ID NO: 184428 - DNA, 15 bp, Homo sapiens
cccaccacattgggt

SEQ ID NO: 184429 - DNA, 15 bp, Homo sapiens
acccaccacattggg

SEQ ID NO: 184430 - DNA, 15 bp, Homo sapiens
tacccaccacattgg

SEQ ID NO: 184431 - DNA, 15 bp, Homo sapiens
ttacccaccacattg

SEQ ID NO: 184432 - DNA, 15 bp, Homo sapiens
tttacccaccacatt

SEQ ID NO: 184433 - DNA, 15 bp, Homo sapiens
atttacccaccacat

SEQ ID NO: 184434 - DNA, 15 bp, Homo sapiens
catttacccaccaca

SEQ ID NO: 184435 - DNA, 15 bp, Homo sapiens
tcatttacccaccac

SEQ ID NO: 184436 - DNA, 15 bp, Homo sapiens
ttcatttacccacca

SEQ ID NO: 184437 - DNA, 15 bp, Homo sapiens
tttcatttacccacc

SEQ ID NO: 184438 - DNA, 15 bp, Homo sapiens
ttttcatttacccac

SEQ ID NO: 184439 - DNA, 15 bp, Homo sapiens
gttttcatttaccca

SEQ ID NO: 184440 - DNA, 15 bp, Homo sapiens
ggttttcatttaccc

SEQ ID NO: 184441 - DNA, 15 bp, Homo sapiens
tggttttcatttacc

SEQ ID NO: 184442 - DNA, 15 bp, Homo sapiens
ctggttttcatttac

SEQ ID NO: 184443 - DNA, 15 bp, Homo sapiens
actggttttcattta

SEQ ID NO: 184444 - DNA, 15 bp, Homo sapiens
cactggttttcattt

SEQ ID NO: 184445 - DNA, 15 bp, Homo sapiens
acactggttttcatt

SEQ ID NO: 184446 - DNA, 15 bp, Homo sapiens
cacactggttttcat

SEQ ID NO: 184447 - DNA, 15 bp, Homo sapiens
acacactggttttca

SEQ ID NO: 184448 - DNA, 15 bp, Homo sapiens
cacacactggttttc

SEQ ID NO: 184449 - DNA, 15 bp, Homo sapiens
tcacacactggtttt

SEQ ID NO: 184450 - DNA, 15 bp, Homo sapiens
ctcacacactggttt

SEQ ID NO: 184451 - DNA, 15 bp, Homo sapiens
actcacacactggtt

SEQ ID NO: 184452 - DNA, 15 bp, Homo sapiens
aactcacacactggt

SEQ ID NO: 184453 - DNA, 15 bp, Homo sapiens
taactcacacactgg

SEQ ID NO: 184454 - DNA, 15 bp, Homo sapiens
gtaactcacacactg

SEQ ID NO: 184455 - DNA, 15 bp, Homo sapiens
agtaactcacacact

SEQ ID NO: 184456 - DNA, 15 bp, Homo sapiens
gagtaactcacacac

SEQ ID NO: 184457 - DNA, 15 bp, Homo sapiens
tgagtaactcacaca

SEQ ID NO: 184458 - DNA, 15 bp, Homo sapiens
ttgagtaactcacac

SEQ ID NO: 184459 - DNA, 15 bp, Homo sapiens
cttgagtaactcaca

SEQ ID NO: 184460 - DNA, 15 bp, Homo sapiens
acttgagtaactcac

SEQ ID NO: 184461 - DNA, 15 bp, Homo sapiens
aacttgagtaactca

SEQ ID NO: 184462 - DNA, 15 bp, Homo sapiens
aaacttgagtaactc

SEQ ID NO: 184463 - DNA, 15 bp, Homo sapiens
caaacttgagtaact

SEQ ID NO: 184464 - DNA, 15 bp, Homo sapiens
acaaacttgagtaac

SEQ ID NO: 184465 - DNA, 15 bp, Homo sapiens
aacaaacttgagtaa

SEQ ID NO: 184466 - DNA, 15 bp, Homo sapiens
taacaaacttgagta

SEQ ID NO: 184467 - DNA, 15 bp, Homo sapiens
ttaacaaacttgagt

SEQ ID NO: 184468 - DNA, 15 bp, Homo sapiens
attaacaaacttgag

SEQ ID NO: 184469 - DNA, 15 bp, Homo sapiens
cattaacaaacttga

SEQ ID NO: 184470 - DNA, 15 bp, Homo sapiens
tcattaacaaacttg

SEQ ID NO: 184471 - DNA, 15 bp, Homo sapiens
atcattaacaaactt

SEQ ID NO: 184472 - DNA, 15 bp, Homo sapiens
catcattaacaaact

SEQ ID NO: 184473 - DNA, 15 bp, Homo sapiens
acatcattaacaaac

SEQ ID NO: 184474 - DNA, 15 bp, Homo sapiens
aacatcattaacaaa

SEQ ID NO: 184475 - DNA, 15 bp, Homo sapiens
taacatcattaacaa

SEQ ID NO: 184476 - DNA, 15 bp, Homo sapiens
ctaacatcattaaca

SEQ ID NO: 184477 - DNA, 15 bp, Homo sapiens
tctaacatcattaac

SEQ ID NO: 184478 - DNA, 15 bp, Homo sapiens
ttctaacatcattaa

SEQ ID NO: 184479 - DNA, 15 bp, Homo sapiens
tttctaacatcatta

SEQ ID NO: 184480 - DNA, 15 bp, Homo sapiens
atttctaacatcatt

SEQ ID NO: 184481 - DNA, 15 bp, Homo sapiens
tatttctaacatcat

SEQ ID NO: 184482 - DNA, 15 bp, Homo sapiens
atatttctaacatca

SEQ ID NO: 184483 - DNA, 15 bp, Homo sapiens
tatatttctaacatc

SEQ ID NO: 184484 - DNA, 15 bp, Homo sapiens
ctatatttctaacat

SEQ ID NO: 184485 - DNA, 15 bp, Homo sapiens
actatatttctaaca

SEQ ID NO: 184486 - DNA, 15 bp, Homo sapiens
gactatatttctaac

SEQ ID NO: 184487 - DNA, 15 bp, Homo sapiens
tgactatatttctaa

SEQ ID NO: 184488 - DNA, 15 bp, Homo sapiens
ttgactatatttcta

SEQ ID NO: 184489 - DNA, 15 bp, Homo sapiens
tttgactatatttct

SEQ ID NO: 184490 - DNA, 15 bp, Homo sapiens
ttttgactatatttc

SEQ ID NO: 184491 - DNA, 15 bp, Homo sapiens
attttgactatattt

SEQ ID NO: 184492 - DNA, 15 bp, Homo sapiens
tattttgactatatt

SEQ ID NO: 184493 - DNA, 15 bp, Homo sapiens
ctattttgactatat

SEQ ID NO: 184494 - DNA, 15 bp, Homo sapiens
gctattttgactata

SEQ ID NO: 184495 - DNA, 15 bp, Homo sapiens
agctattttgactat

SEQ ID NO: 184496 - DNA, 15 bp, Homo sapiens
gagctattttgacta

SEQ ID NO: 184497 - DNA, 15 bp, Homo sapiens
tgagctattttgact

SEQ ID NO: 184498 - DNA, 15 bp, Homo sapiens
ctgagctattttgac

SEQ ID NO: 184499 - DNA, 15 bp, Homo sapiens
actgagctattttga

SEQ ID NO: 184500 - DNA, 15 bp, Homo sapiens
gactgagctattttg

SEQ ID NO: 184501 - DNA, 15 bp, Homo sapiens
agactgagctatttt

SEQ ID NO: 184502 - DNA, 15 bp, Homo sapiens
cagactgagctattt

SEQ ID NO: 184503 - DNA, 15 bp, Homo sapiens
gcagactgagctatt

SEQ ID NO: 184504 - DNA, 15 bp, Homo sapiens
agcagactgagctat

SEQ ID NO: 184505 - DNA, 15 bp, Homo sapiens
gagcagactgagcta

SEQ ID NO: 184506 - DNA, 15 bp, Homo sapiens
agagcagactgagct

SEQ ID NO: 184507 - DNA, 15 bp, Homo sapiens
aagagcagactgagc

SEQ ID NO: 184508 - DNA, 15 bp, Homo sapiens
caagagcagactgag

SEQ ID NO: 184509 - DNA, 15 bp, Homo sapiens
gcaagagcagactga

SEQ ID NO: 184510 - DNA, 15 bp, Homo sapiens
agcaagagcagactg

SEQ ID NO: 184511 - DNA, 15 bp, Homo sapiens
tagcaagagcagact

SEQ ID NO: 184512 - DNA, 15 bp, Homo sapiens
atagcaagagcagac

SEQ ID NO: 184513 - DNA, 15 bp, Homo sapiens
catagcaagagcaga

SEQ ID NO: 184514 - DNA, 15 bp, Homo sapiens
gcatagcaagagcag

SEQ ID NO: 184515 - DNA, 15 bp, Homo sapiens
agcatagcaagagca

SEQ ID NO: 184516 - DNA, 15 bp, Homo sapiens
tagcatagcaagagc

SEQ ID NO: 184517 - DNA, 15 bp, Homo sapiens
atagcatagcaagag

SEQ ID NO: 184518 - DNA, 15 bp, Homo sapiens
aatagcatagcaaga

SEQ ID NO: 184519 - DNA, 15 bp, Homo sapiens
aaatagcatagcaag

SEQ ID NO: 184520 - DNA, 15 bp, Homo sapiens
aaaatagcatagcaa

SEQ ID NO: 184521 - DNA, 15 bp, Homo sapiens
caaaatagcatagca

SEQ ID NO: 184522 - DNA, 15 bp, Homo sapiens
acaaaatagcatagc

SEQ ID NO: 184523 - DNA, 15 bp, Homo sapiens
gacaaaatagcatag

SEQ ID NO: 184524 - DNA, 15 bp, Homo sapiens
ggacaaaatagcata

SEQ ID NO: 184525 - DNA, 15 bp, Homo sapiens
tggacaaaatagcat

SEQ ID NO: 184526 - DNA, 15 bp, Homo sapiens
ctggacaaaatagca

SEQ ID NO: 184527 - DNA, 15 bp, Homo sapiens
gctggacaaaatagc

SEQ ID NO: 184528 - DNA, 15 bp, Homo sapiens
ggctggacaaaatag

SEQ ID NO: 184529 - DNA, 15 bp, Homo sapiens
tggctggacaaaata

SEQ ID NO: 184530 - DNA, 15 bp, Homo sapiens
ttggctggacaaaat

SEQ ID NO: 184531 - DNA, 15 bp, Homo sapiens
attggctggacaaaa

SEQ ID NO: 184532 - DNA, 15 bp, Homo sapiens
gattggctggacaaa

SEQ ID NO: 184533 - DNA, 15 bp, Homo sapiens
agattggctggacaa

SEQ ID NO: 184534 - DNA, 15 bp, Homo sapiens
gagattggctggaca

SEQ ID NO: 184535 - DNA, 15 bp, Homo sapiens
agagattggctggac

SEQ ID NO: 184536 - DNA, 15 bp, Homo sapiens
gagagattggctgga

SEQ ID NO: 184537 - DNA, 15 bp, Homo sapiens
tgagagattggctgg

SEQ ID NO: 184538 - DNA, 15 bp, Homo sapiens
atgagagattggctg

SEQ ID NO: 184539 - DNA, 15 bp, Homo sapiens
gatgagagattggct

SEQ ID NO: 184540 - DNA, 15 bp, Homo sapiens
ggatgagagattggc

SEQ ID NO: 184541 - DNA, 15 bp, Homo sapiens
aggatgagagattgg

SEQ ID NO: 184542 - DNA, 15 bp, Homo sapiens
gaggatgagagattg

SEQ ID NO: 184543 - DNA, 15 bp, Homo sapiens
ggaggatgagagatt

SEQ ID NO: 184544 - DNA, 15 bp, Homo sapiens
gggaggatgagagat

SEQ ID NO: 184545 - DNA, 15 bp, Homo sapiens
agggaggatgagaga

SEQ ID NO: 184546 - DNA, 15 bp, Homo sapiens
aagggaggatgagag

SEQ ID NO: 184547 - DNA, 15 bp, Homo sapiens
gaagggaggatgaga

SEQ ID NO: 184548 - DNA, 15 bp, Homo sapiens
tgaagggaggatgag

SEQ ID NO: 184549 - DNA, 15 bp, Homo sapiens
atgaagggaggatga

SEQ ID NO: 184550 - DNA, 15 bp, Homo sapiens
gatgaagggaggatg

SEQ ID NO: 184551 - DNA, 15 bp, Homo sapiens
ggatgaagggaggat

SEQ ID NO: 184552 - DNA, 15 bp, Homo sapiens
aggatgaagggagga

SEQ ID NO: 184553 - DNA, 15 bp, Homo sapiens
taggatgaagggagg

SEQ ID NO: 184554 - DNA, 15 bp, Homo sapiens
ttaggatgaagggag

SEQ ID NO: 184555 - DNA, 15 bp, Homo sapiens
attaggatgaaggga

SEQ ID NO: 184556 - DNA, 15 bp, Homo sapiens
aattaggatgaaggg

SEQ ID NO: 184557 - DNA, 15 bp, Homo sapiens
gaattaggatgaagg

SEQ ID NO: 184558 - DNA, 15 bp, Homo sapiens
ggaattaggatgaag

SEQ ID NO: 184559 - DNA, 15 bp, Homo sapiens
tggaattaggatgaa

SEQ ID NO: 184560 - DNA, 15 bp, Homo sapiens
ctggaattaggatga

SEQ ID NO: 184561 - DNA, 15 bp, Homo sapiens
tctggaattaggatg

SEQ ID NO: 184562 - DNA, 15 bp, Homo sapiens
ttctggaattaggat

SEQ ID NO: 184563 - DNA, 15 bp, Homo sapiens
cttctggaattagga

SEQ ID NO: 184564 - DNA, 15 bp, Homo sapiens
tcttctggaattagg

SEQ ID NO: 184565 - DNA, 15 bp, Homo sapiens
ctcttctggaattag

SEQ ID NO: 184566 - DNA, 15 bp, Homo sapiens
tctcttctggaatta

SEQ ID NO: 184567 - DNA, 15 bp, Homo sapiens
ctctcttctggaatt

SEQ ID NO: 184568 - DNA, 15 bp, Homo sapiens
cctctcttctggaat

SEQ ID NO: 184569 - DNA, 15 bp, Homo sapiens
tcctctcttctggaa

SEQ ID NO: 184570 - DNA, 15 bp, Homo sapiens
atcctctcttctgga

SEQ ID NO: 184571 - DNA, 15 bp, Homo sapiens
tatcctctcttctgg

SEQ ID NO: 184572 - DNA, 15 bp, Homo sapiens
ctatcctctcttctg

SEQ ID NO: 184573 - DNA, 15 bp, Homo sapiens
cctatcctctcttct

SEQ ID NO: 184574 - DNA, 15 bp, Homo sapiens
tcctatcctctcttc

SEQ ID NO: 184575 - DNA, 15 bp, Homo sapiens
ctcctatcctctctt

SEQ ID NO: 184576 - DNA, 15 bp, Homo sapiens
actcctatcctctct

SEQ ID NO: 184577 - DNA, 15 bp, Homo sapiens
tactcctatcctctc

SEQ ID NO: 184578 - DNA, 15 bp, Homo sapiens
ttactcctatcctct

SEQ ID NO: 184579 - DNA, 15 bp, Homo sapiens
tttactcctatcctc

SEQ ID NO: 184580 - DNA, 15 bp, Homo sapiens
ttttactcctatcct

SEQ ID NO: 184581 - DNA, 15 bp, Homo sapiens
cttttactcctatcc

SEQ ID NO: 184582 - DNA, 15 bp, Homo sapiens
gcttttactcctatc

SEQ ID NO: 184583 - DNA, 15 bp, Homo sapiens
tgcttttactcctat

SEQ ID NO: 184584 - DNA, 15 bp, Homo sapiens
ttgcttttactccta

SEQ ID NO: 184585 - DNA, 15 bp, Homo sapiens
tttgcttttactcct

SEQ ID NO: 184586 - DNA, 15 bp, Homo sapiens
ttttgcttttactcc

SEQ ID NO: 184587 - DNA, 15 bp, Homo sapiens
attttgcttttactc

SEQ ID NO: 184588 - DNA, 15 bp, Homo sapiens
gattttgcttttact

SEQ ID NO: 184589 - DNA, 15 bp, Homo sapiens
agattttgcttttac

SEQ ID NO: 184590 - DNA, 15 bp, Homo sapiens
aagattttgctttta

SEQ ID NO: 184591 - DNA, 15 bp, Homo sapiens
taagattttgctttt

SEQ ID NO: 184592 - DNA, 15 bp, Homo sapiens
ataagattttgcttt

SEQ ID NO: 184593 - DNA, 15 bp, Homo sapiens
aataagattttgctt

SEQ ID NO: 184594 - DNA, 15 bp, Homo sapiens
taataagattttgct

SEQ ID NO: 184595 - DNA, 15 bp, Homo sapiens
gtaataagattttgc

SEQ ID NO: 184596 - DNA, 15 bp, Homo sapiens
tgtaataagattttg

SEQ ID NO: 184597 - DNA, 15 bp, Homo sapiens
ttgtaataagatttt

SEQ ID NO: 184598 - DNA, 15 bp, Homo sapiens
tttgtaataagattt

SEQ ID NO: 184599 - DNA, 15 bp, Homo sapiens
ttttgtaataagatt

SEQ ID NO: 184600 - DNA, 15 bp, Homo sapiens
tttttgtaataagat

SEQ ID NO: 184601 - DNA, 15 bp, Homo sapiens
ttttttgtaataaga

SEQ ID NO: 184602 - DNA, 15 bp, Homo sapiens
gttttttgtaataag

SEQ ID NO: 184603 - DNA, 15 bp, Homo sapiens
tgttttttgtaataa

SEQ ID NO: 184604 - DNA, 15 bp, Homo sapiens
gtgttttttgtaata

SEQ ID NO: 184605 - DNA, 15 bp, Homo sapiens
tgtgttttttgtaat

SEQ ID NO: 184606 - DNA, 15 bp, Homo sapiens
gtgtgttttttgtaa

SEQ ID NO: 184607 - DNA, 15 bp, Homo sapiens
agtgtgttttttgta

SEQ ID NO: 184608 - DNA, 15 bp, Homo sapiens
gagtgtgttttttgt

SEQ ID NO: 184609 - DNA, 15 bp, Homo sapiens
agagtgtgttttttg

SEQ ID NO: 184610 - DNA, 15 bp, Homo sapiens
cagagtgtgtttttt

SEQ ID NO: 184611 - DNA, 15 bp, Homo sapiens
ccagagtgtgttttt

SEQ ID NO: 184612 - DNA, 15 bp, Homo sapiens
tccagagtgtgtttt

SEQ ID NO: 184613 - DNA, 15 bp, Homo sapiens
ttccagagtgtgttt

SEQ ID NO: 184614 - DNA, 15 bp, Homo sapiens
tttccagagtgtgtt

SEQ ID NO: 184615 - DNA, 15 bp, Homo sapiens
ctttccagagtgtgt

SEQ ID NO: 184616 - DNA, 15 bp, Homo sapiens
tctttccagagtgtg

SEQ ID NO: 184617 - DNA, 15 bp, Homo sapiens
ttctttccagagtgt

SEQ ID NO: 184618 - DNA, 15 bp, Homo sapiens
tttctttccagagtg

SEQ ID NO: 184619 - DNA, 15 bp, Homo sapiens
ctttctttccagagt

SEQ ID NO: 184620 - DNA, 15 bp, Homo sapiens
gttttctttctttcc

SEQ ID NO: 184621 - DNA, 15 bp, Homo sapiens
agttttctttctttc

SEQ ID NO: 184622 - DNA, 15 bp, Homo sapiens
cagttttctttcttt

SEQ ID NO: 184623 - DNA, 15 bp, Homo sapiens
tacagttttctttct

SEQ ID NO: 184624 - DNA, 15 bp, Homo sapiens
atacagttttctttc

SEQ ID NO: 184625 - DNA, 15 bp, Homo sapiens
aatacagttttcttt

SEQ ID NO: 184626 - DNA, 15 bp, Homo sapiens
caatacagttttctt

SEQ ID NO: 184627 - DNA, 15 bp, Homo sapiens
ccaatacagttttct

SEQ ID NO: 184628 - DNA, 15 bp, Homo sapiens
tccaatacagttttc

SEQ ID NO: 184629 - DNA, 15 bp, Homo sapiens
atccaatacagtttt

SEQ ID NO: 184630 - DNA, 15 bp, Homo sapiens
tatccaatacagttt

SEQ ID NO: 184631 - DNA, 15 bp, Homo sapiens
ttatccaatacagtt

SEQ ID NO: 184632 - DNA, 15 bp, Homo sapiens
attatccaatacagt

SEQ ID NO: 184633 - DNA, 15 bp, Homo sapiens
tattatccaatacag

SEQ ID NO: 184634 - DNA, 15 bp, Homo sapiens
gtattatccaataca

SEQ ID NO: 184635 - DNA, 15 bp, Homo sapiens
agtattatccaatac

SEQ ID NO: 184636 - DNA, 15 bp, Homo sapiens
gagtattatccaata

SEQ ID NO: 184637 - DNA, 15 bp, Homo sapiens
tgagtattatccaat

SEQ ID NO: 184638 - DNA, 15 bp, Homo sapiens
ctgagtattatccaa

SEQ ID NO: 184639 - DNA, 15 bp, Homo sapiens
actgagtattatcca

SEQ ID NO: 184640 - DNA, 15 bp, Homo sapiens
aactgagtattatcc

SEQ ID NO: 184641 - DNA, 15 bp, Homo sapiens
aaactgagtattatc

SEQ ID NO: 184642 - DNA, 15 bp, Homo sapiens
caaactgagtattat

SEQ ID NO: 184643 - DNA, 15 bp, Homo sapiens
ccaaactgagtatta

SEQ ID NO: 184644 - DNA, 15 bp, Homo sapiens
accaaactgagtatt

SEQ ID NO: 184645 - DNA, 15 bp, Homo sapiens
taccaaactgagtat

SEQ ID NO: 184646 - DNA, 15 bp, Homo sapiens
ataccaaactgagta

SEQ ID NO: 184647 - DNA, 15 bp, Homo sapiens
aataccaaactgagt

SEQ ID NO: 184648 - DNA, 15 bp, Homo sapiens
aaataccaaactgag

SEQ ID NO: 184649 - DNA, 15 bp, Homo sapiens
caaataccaaactga

SEQ ID NO: 184650 - DNA, 15 bp, Homo sapiens
acaaataccaaactg

SEQ ID NO: 184651 - DNA, 15 bp, Homo sapiens
aacaaataccaaact

SEQ ID NO: 184652 - DNA, 15 bp, Homo sapiens
aaacaaataccaaac

SEQ ID NO: 184653 - DNA, 15 bp, Homo sapiens
aaaacaaataccaaa

SEQ ID NO: 184654 - DNA, 15 bp, Homo sapiens
gaaaacaaataccaa

SEQ ID NO: 184655 - DNA, 15 bp, Homo sapiens
agaaaacaaatacca

SEQ ID NO: 184656 - DNA, 15 bp, Homo sapiens
gagaaaacaaatacc

SEQ ID NO: 184657 - DNA, 15 bp, Homo sapiens
caggagaaaacaaat

SEQ ID NO: 184658 - DNA, 15 bp, Homo sapiens
acaggagaaaacaaa

SEQ ID NO: 184659 - DNA, 15 bp, Homo sapiens
gacaggagaaaacaa

SEQ ID NO: 184660 - DNA, 15 bp, Homo sapiens
agacaggagaaaaca

SEQ ID NO: 184661 - DNA, 15 bp, Homo sapiens
tagacaggagaaaac

SEQ ID NO: 184662 - DNA, 15 bp, Homo sapiens
ctagacaggagaaaa

SEQ ID NO: 184663 - DNA, 15 bp, Homo sapiens
actagacaggagaaa

SEQ ID NO: 184664 - DNA, 15 bp, Homo sapiens
aactagacaggagaa

SEQ ID NO: 184665 - DNA, 15 bp, Homo sapiens
gaactagacaggaga

SEQ ID NO: 184666 - DNA, 15 bp, Homo sapiens
agaactagacaggag

SEQ ID NO: 184667 - DNA, 15 bp, Homo sapiens
aagaactagacagga

SEQ ID NO: 184668 - DNA, 15 bp, Homo sapiens
taagaactagacagg

SEQ ID NO: 184669 - DNA, 15 bp, Homo sapiens
ctaagaactagacag

SEQ ID NO: 184670 - DNA, 15 bp, Homo sapiens
actaagaactagaca

SEQ ID NO: 184671 - DNA, 15 bp, Homo sapiens
tactaagaactagac

SEQ ID NO: 184672 - DNA, 15 bp, Homo sapiens
gtactaagaactaga

SEQ ID NO: 184673 - DNA, 15 bp, Homo sapiens
ggtactaagaactag

SEQ ID NO: 184674 - DNA, 15 bp, Homo sapiens
gggtactaagaacta

SEQ ID NO: 184675 - DNA, 15 bp, Homo sapiens
agggtactaagaact

SEQ ID NO: 184676 - DNA, 15 bp, Homo sapiens
aagggtactaagaac

SEQ ID NO: 184677 - DNA, 15 bp, Homo sapiens
taagggtactaagaa

SEQ ID NO: 184678 - DNA, 15 bp, Homo sapiens
ctaagggtactaaga

SEQ ID NO: 184679 - DNA, 15 bp, Homo sapiens
tctaagggtactaag

SEQ ID NO: 184680 - DNA, 15 bp, Homo sapiens
ttctaagggtactaa

SEQ ID NO: 184681 - DNA, 15 bp, Homo sapiens
attctaagggtacta

SEQ ID NO: 184682 - DNA, 15 bp, Homo sapiens
aattctaagggtact

SEQ ID NO: 184683 - DNA, 15 bp, Homo sapiens
caattctaagggtac

SEQ ID NO: 184684 - DNA, 15 bp, Homo sapiens
tcaattctaagggta

SEQ ID NO: 184685 - DNA, 15 bp, Homo sapiens
ctcaattctaagggt

SEQ ID NO: 184686 - DNA, 15 bp, Homo sapiens
tctcaattctaaggg

SEQ ID NO: 184687 - DNA, 15 bp, Homo sapiens
atctcaattctaagg

SEQ ID NO: 184688 - DNA, 15 bp, Homo sapiens
tatctcaattctaag

SEQ ID NO: 184689 - DNA, 15 bp, Homo sapiens
ttatctcaattctaa

SEQ ID NO: 184690 - DNA, 15 bp, Homo sapiens
attatctcaattcta

SEQ ID NO: 184691 - DNA, 15 bp, Homo sapiens
aattatctcaattct

SEQ ID NO: 184692 - DNA, 15 bp, Homo sapiens
gaattatctcaattc

SEQ ID NO: 184693 - DNA, 15 bp, Homo sapiens
tgaattatctcaatt

SEQ ID NO: 184694 - DNA, 15 bp, Homo sapiens
atgaattatctcaat

SEQ ID NO: 184695 - DNA, 15 bp, Homo sapiens
aatgaattatctcaa

SEQ ID NO: 184696 - DNA, 15 bp, Homo sapiens
taatgaattatctca

SEQ ID NO: 184697 - DNA, 15 bp, Homo sapiens
ataatgaattatctc

SEQ ID NO: 184698 - DNA, 15 bp, Homo sapiens
aataatgaattatct

SEQ ID NO: 184699 - DNA, 15 bp, Homo sapiens
aaataatgaattatc

SEQ ID NO: 184700 - DNA, 15 bp, Homo sapiens
caaataatgaattat

SEQ ID NO: 184701 - DNA, 15 bp, Homo sapiens
acaaataatgaatta

SEQ ID NO: 184702 - DNA, 15 bp, Homo sapiens
gacaaataatgaatt

SEQ ID NO: 184703 - DNA, 15 bp, Homo sapiens
tgacaaataatgaat

SEQ ID NO: 184704 - DNA, 15 bp, Homo sapiens
gtgacaaataatgaa

SEQ ID NO: 184705 - DNA, 15 bp, Homo sapiens
agtgacaaataatga

SEQ ID NO: 184706 - DNA, 15 bp, Homo sapiens
gagtgacaaataatg

SEQ ID NO: 184707 - DNA, 15 bp, Homo sapiens
tgagtgacaaataat

SEQ ID NO: 184708 - DNA, 15 bp, Homo sapiens
ctgagtgacaaataa

SEQ ID NO: 184709 - DNA, 15 bp, Homo sapiens
cctgagtgacaaata

SEQ ID NO: 184710 - DNA, 15 bp, Homo sapiens
acctgagtgacaaat

SEQ ID NO: 184711 - DNA, 15 bp, Homo sapiens
tacctgagtgacaaa

SEQ ID NO: 184712 - DNA, 15 bp, Homo sapiens
ctacctgagtgacaa

SEQ ID NO: 184713 - DNA, 15 bp, Homo sapiens
cctacctgagtgaca

SEQ ID NO: 184714 - DNA, 15 bp, Homo sapiens
acctacctgagtgac

SEQ ID NO: 184715 - DNA, 15 bp, Homo sapiens
aacctacctgagtga

SEQ ID NO: 184716 - DNA, 15 bp, Homo sapiens
aaacctacctgagtg

SEQ ID NO: 184717 - DNA, 15 bp, Homo sapiens
gaaacctacctgagt

SEQ ID NO: 184718 - DNA, 15 bp, Homo sapiens
cgaaacctacctgag

SEQ ID NO: 184719 - DNA, 15 bp, Homo sapiens
tcgaaacctacctga

SEQ ID NO: 184720 - DNA, 15 bp, Homo sapiens
ctcgaaacctacctg

SEQ ID NO: 184721 - DNA, 15 bp, Homo sapiens
actcgaaacctacct

SEQ ID NO: 184722 - DNA, 15 bp, Homo sapiens
cactcgaaacctacc

SEQ ID NO: 184723 - DNA, 15 bp, Homo sapiens
tcactcgaaacctac

SEQ ID NO: 184724 - DNA, 15 bp, Homo sapiens
ttcactcgaaaccta

SEQ ID NO: 184725 - DNA, 15 bp, Homo sapiens
gttcactcgaaacct

SEQ ID NO: 184726 - DNA, 15 bp, Homo sapiens
agttcactcgaaacc

SEQ ID NO: 184727 - DNA, 15 bp, Homo sapiens
cagttcactcgaaac

SEQ ID NO: 184728 - DNA, 15 bp, Homo sapiens
tcagttcactcgaaa

SEQ ID NO: 184729 - DNA, 15 bp, Homo sapiens
atcagttcactcgaa

SEQ ID NO: 184730 - DNA, 15 bp, Homo sapiens
tatcagttcactcga

SEQ ID NO: 184731 - DNA, 15 bp, Homo sapiens
atatcagttcactcg

SEQ ID NO: 184732 - DNA, 15 bp, Homo sapiens
tatatcagttcactc

SEQ ID NO: 184733 - DNA, 15 bp, Homo sapiens
atatatcagttcact

SEQ ID NO: 184734 - DNA, 15 bp, Homo sapiens
aatatatcagttcac

SEQ ID NO: 184735 - DNA, 15 bp, Homo sapiens
aaatatatcagttca

SEQ ID NO: 184736 - DNA, 15 bp, Homo sapiens
taaatatatcagttc

SEQ ID NO: 184737 - DNA, 15 bp, Homo sapiens
ttaaatatatcagtt

SEQ ID NO: 184738 - DNA, 15 bp, Homo sapiens
attaaatatatcagt

SEQ ID NO: 184739 - DNA, 15 bp, Homo sapiens
aattaaatatatcag

SEQ ID NO: 184740 - DNA, 15 bp, Homo sapiens
taattaaatatatca

SEQ ID NO: 184741 - DNA, 15 bp, Homo sapiens
ctaattaaatatatc

SEQ ID NO: 184742 - DNA, 15 bp, Homo sapiens
tctaattaaatatat

SEQ ID NO: 184743 - DNA, 15 bp, Homo sapiens
atctaattaaatata

SEQ ID NO: 184744 - DNA, 15 bp, Homo sapiens
gatctaattaaatat

SEQ ID NO: 184745 - DNA, 15 bp, Homo sapiens
ggatctaattaaata

SEQ ID NO: 184746 - DNA, 15 bp, Homo sapiens
aggatctaattaaat

SEQ ID NO: 184747 - DNA, 15 bp, Homo sapiens
aaggatctaattaaa

SEQ ID NO: 184748 - DNA, 15 bp, Homo sapiens
taaggatctaattaa

SEQ ID NO: 184749 - DNA, 15 bp, Homo sapiens
ttaaggatctaatta

SEQ ID NO: 184750 - DNA, 15 bp, Homo sapiens
tttaaggatctaatt

SEQ ID NO: 184751 - DNA, 15 bp, Homo sapiens
ctttaaggatctaat

SEQ ID NO: 184752 - DNA, 15 bp, Homo sapiens
gctttaaggatctaa

SEQ ID NO: 184753 - DNA, 15 bp, Homo sapiens
ggctttaaggatcta

SEQ ID NO: 184754 - DNA, 15 bp, Homo sapiens
gggctttaaggatct

SEQ ID NO: 184755 - DNA, 15 bp, Homo sapiens
tgggctttaaggatc

SEQ ID NO: 184756 - DNA, 15 bp, Homo sapiens
atgggctttaaggat

SEQ ID NO: 184757 - DNA, 15 bp, Homo sapiens
tatgggctttaagga

SEQ ID NO: 184758 - DNA, 15 bp, Homo sapiens
ctatgggctttaagg

SEQ ID NO: 184759 - DNA, 15 bp, Homo sapiens
cctatgggctttaag

SEQ ID NO: 184760 - DNA, 15 bp, Homo sapiens
tcctatgggctttaa

SEQ ID NO: 184761 - DNA, 15 bp, Homo sapiens
atcctatgggcttta

SEQ ID NO: 184762 - DNA, 15 bp, Homo sapiens
aatcctatgggcttt

SEQ ID NO: 184763 - DNA, 15 bp, Homo sapiens
aaatcctatgggctt

SEQ ID NO: 184764 - DNA, 15 bp, Homo sapiens
taaatcctatgggct

SEQ ID NO: 184765 - DNA, 15 bp, Homo sapiens
ataaatcctatgggc

SEQ ID NO: 184766 - DNA, 15 bp, Homo sapiens
tataaatcctatggg

SEQ ID NO: 184767 - DNA, 15 bp, Homo sapiens
gtataaatcctatgg

SEQ ID NO: 184768 - DNA, 15 bp, Homo sapiens
agtataaatcctatg

SEQ ID NO: 184769 - DNA, 15 bp, Homo sapiens
cagtataaatcctat

SEQ ID NO: 184770 - DNA, 15 bp, Homo sapiens
ccagtataaatccta

SEQ ID NO: 184771 - DNA, 15 bp, Homo sapiens
accagtataaatcct

SEQ ID NO: 184772 - DNA, 15 bp, Homo sapiens
gaccagtataaatcc

SEQ ID NO: 184773 - DNA, 15 bp, Homo sapiens
tgaccagtataaatc

SEQ ID NO: 184774 - DNA, 15 bp, Homo sapiens
atgaccagtataaat

SEQ ID NO: 184775 - DNA, 15 bp, Homo sapiens
aatgaccagtataaa

SEQ ID NO: 184776 - DNA, 15 bp, Homo sapiens
aaatgaccagtataa

SEQ ID NO: 184777 - DNA, 15 bp, Homo sapiens
gaaatgaccagtata

SEQ ID NO: 184778 - DNA, 15 bp, Homo sapiens
agaaatgaccagtat

SEQ ID NO: 184779 - DNA, 15 bp, Homo sapiens
cagaaatgaccagta

SEQ ID NO: 184780 - DNA, 15 bp, Homo sapiens
acagaaatgaccagt

SEQ ID NO: 184781 - DNA, 15 bp, Homo sapiens
gacagaaatgaccag

SEQ ID NO: 184782 - DNA, 15 bp, Homo sapiens
tgacagaaatgacca

SEQ ID NO: 184783 - DNA, 15 bp, Homo sapiens
ttgacagaaatgacc

SEQ ID NO: 184784 - DNA, 15 bp, Homo sapiens
attgacagaaatgac

SEQ ID NO: 184785 - DNA, 15 bp, Homo sapiens
aattgacagaaatga

SEQ ID NO: 184786 - DNA, 15 bp, Homo sapiens
caattgacagaaatg

SEQ ID NO: 184787 - DNA, 15 bp, Homo sapiens
acaattgacagaaat

SEQ ID NO: 184788 - DNA, 15 bp, Homo sapiens
cacaattgacagaaa

SEQ ID NO: 184789 - DNA, 15 bp, Homo sapiens
tcacaattgacagaa

SEQ ID NO: 184790 - DNA, 15 bp, Homo sapiens
ttcacaattgacaga

SEQ ID NO: 184791 - DNA, 15 bp, Homo sapiens
attcacaattgacag

SEQ ID NO: 184792 - DNA, 15 bp, Homo sapiens
gattcacaattgaca

SEQ ID NO: 184793 - DNA, 15 bp, Homo sapiens
agattcacaattgac

SEQ ID NO: 184794 - DNA, 15 bp, Homo sapiens
cagattcacaattga

SEQ ID NO: 184795 - DNA, 15 bp, Homo sapiens
gcagattcacaattg

SEQ ID NO: 184796 - DNA, 15 bp, Homo sapiens
agcagattcacaatt

SEQ ID NO: 184797 - DNA, 15 bp, Homo sapiens
gagcagattcacaat

SEQ ID NO: 184798 - DNA, 15 bp, Homo sapiens
tgagcagattcacaa

SEQ ID NO: 184799 - DNA, 15 bp, Homo sapiens
atgagcagattcaca

SEQ ID NO: 184800 - DNA, 15 bp, Homo sapiens
tatgagcagattcac

SEQ ID NO: 184801 - DNA, 15 bp, Homo sapiens
gtatgagcagattca

SEQ ID NO: 184802 - DNA, 15 bp, Homo sapiens
agtatgagcagattc

SEQ ID NO: 184803 - DNA, 15 bp, Homo sapiens
aagtatgagcagatt

SEQ ID NO: 184804 - DNA, 15 bp, Homo sapiens
caagtatgagcagat

SEQ ID NO: 184805 - DNA, 15 bp, Homo sapiens
acaagtatgagcaga

SEQ ID NO: 184806 - DNA, 15 bp, Homo sapiens
aacaagtatgagcag

SEQ ID NO: 184807 - DNA, 15 bp, Homo sapiens
gaacaagtatgagca

SEQ ID NO: 184808 - DNA, 15 bp, Homo sapiens
agaacaagtatgagc

SEQ ID NO: 184809 - DNA, 15 bp, Homo sapiens
aagaacaagtatgag

SEQ ID NO: 184810 - DNA, 15 bp, Homo sapiens
gaagaacaagtatga

SEQ ID NO: 184811 - DNA, 15 bp, Homo sapiens
tgaagaacaagtatg

SEQ ID NO: 184812 - DNA, 15 bp, Homo sapiens
atgaagaacaagtat

SEQ ID NO: 184813 - DNA, 15 bp, Homo sapiens
catgaagaacaagta

SEQ ID NO: 184814 - DNA, 15 bp, Homo sapiens
tcatgaagaacaagt

SEQ ID NO: 184815 - DNA, 15 bp, Homo sapiens
ttcatgaagaacaag

SEQ ID NO: 184816 - DNA, 15 bp, Homo sapiens
tttcatgaagaacaa

SEQ ID NO: 184817 - DNA, 15 bp, Homo sapiens
gtttcatgaagaaca

SEQ ID NO: 184818 - DNA, 15 bp, Homo sapiens
agtttcatgaagaac

SEQ ID NO: 184819 - DNA, 15 bp, Homo sapiens
tagtttcatgaagaa

SEQ ID NO: 184820 - DNA, 15 bp, Homo sapiens
atagtttcatgaaga

SEQ ID NO: 184821 - DNA, 15 bp, Homo sapiens
catagtttcatgaag

SEQ ID NO: 184822 - DNA, 15 bp, Homo sapiens
ccatagtttcatgaa

SEQ ID NO: 184823 - DNA, 15 bp, Homo sapiens
tccatagtttcatga

SEQ ID NO: 184824 - DNA, 15 bp, Homo sapiens
ttccatagtttcatg

SEQ ID NO: 184825 - DNA, 15 bp, Homo sapiens
attccatagtttcat

SEQ ID NO: 184826 - DNA, 15 bp, Homo sapiens
tattccatagtttca

SEQ ID NO: 184827 - DNA, 15 bp, Homo sapiens
ttattccatagtttc

SEQ ID NO: 184828 - DNA, 15 bp, Homo sapiens
attattccatagttt

SEQ ID NO: 184829 - DNA, 15 bp, Homo sapiens
aattattccatagtt

SEQ ID NO: 184830 - DNA, 15 bp, Homo sapiens
aaattattccatagt

SEQ ID NO: 184831 - DNA, 15 bp, Homo sapiens
aaaattattccatag

SEQ ID NO: 184832 - DNA, 15 bp, Homo sapiens
aaaaattattccata

SEQ ID NO: 184833 - DNA, 15 bp, Homo sapiens
gaaaaattattccat

SEQ ID NO: 184834 - DNA, 15 bp, Homo sapiens
tgaaaaattattcca

SEQ ID NO: 184835 - DNA, 15 bp, Homo sapiens
atgaaaaattattcc

SEQ ID NO: 184836 - DNA, 15 bp, Homo sapiens
catgaaaaattattc

SEQ ID NO: 184837 - DNA, 15 bp, Homo sapiens
acatgaaaaattatt

SEQ ID NO: 184838 - DNA, 15 bp, Homo sapiens
tacatgaaaaattat

SEQ ID NO: 184839 - DNA, 15 bp, Homo sapiens
atacatgaaaaatta

SEQ ID NO: 184840 - DNA, 15 bp, Homo sapiens
aatacatgaaaaatt

SEQ ID NO: 184841 - DNA, 15 bp, Homo sapiens
aaatacatgaaaaat

SEQ ID NO: 184842 - DNA, 15 bp, Homo sapiens
aaaatacatgaaaaa

SEQ ID NO: 184843 - DNA, 15 bp, Homo sapiens
gaaaatacatgaaaa

SEQ ID NO: 184844 - DNA, 15 bp, Homo sapiens
tgaaaatacatgaaa

SEQ ID NO: 184845 - DNA, 15 bp, Homo sapiens
atgaaaatacatgaa

SEQ ID NO: 184846 - DNA, 15 bp, Homo sapiens
catgaaaatacatga

SEQ ID NO: 184847 - DNA, 15 bp, Homo sapiens
acatgaaaatacatg

SEQ ID NO: 184848 - DNA, 15 bp, Homo sapiens
cacatgaaaatacat

SEQ ID NO: 184849 - DNA, 15 bp, Homo sapiens
acacatgaaaataca

SEQ ID NO: 184850 - DNA, 15 bp, Homo sapiens
gacacatgaaaatac

SEQ ID NO: 184851 - DNA, 15 bp, Homo sapiens
tgacacatgaaaata

SEQ ID NO: 184852 - DNA, 15 bp, Homo sapiens
ttgacacatgaaaat

SEQ ID NO: 184853 - DNA, 15 bp, Homo sapiens
attgacacatgaaaa

SEQ ID NO: 184854 - DNA, 15 bp, Homo sapiens
gattgacacatgaaa

SEQ ID NO: 184855 - DNA, 15 bp, Homo sapiens
agattgacacatgaa

SEQ ID NO: 184856 - DNA, 15 bp, Homo sapiens
cagattgacacatga

SEQ ID NO: 184857 - DNA, 15 bp, Homo sapiens
tcagattgacacatg

SEQ ID NO: 184858 - DNA, 15 bp, Homo sapiens
ttcagattgacacat

SEQ ID NO: 184859 - DNA, 15 bp, Homo sapiens
tttcagattgacaca

SEQ ID NO: 184860 - DNA, 15 bp, Homo sapiens
ttttcagattgacac

SEQ ID NO: 184861 - DNA, 15 bp, Homo sapiens
cttttcagattgaca

SEQ ID NO: 184862 - DNA, 15 bp, Homo sapiens
tcttttcagattgac

SEQ ID NO: 184863 - DNA, 15 bp, Homo sapiens
ttcttttcagattga

SEQ ID NO: 184864 - DNA, 15 bp, Homo sapiens
tttcttttcagattg

SEQ ID NO: 184865 - DNA, 15 bp, Homo sapiens
gtttcttttcagatt

SEQ ID NO: 184866 - DNA, 15 bp, Homo sapiens
agtttcttttcagat

SEQ ID NO: 184867 - DNA, 15 bp, Homo sapiens
aagtttcttttcaga

SEQ ID NO: 184868 - DNA, 15 bp, Homo sapiens
taagtttcttttcag

SEQ ID NO: 184869 - DNA, 15 bp, Homo sapiens
ctaagtttcttttca

SEQ ID NO: 184870 - DNA, 15 bp, Homo sapiens
cctaagtttcttttc

SEQ ID NO: 184871 - DNA, 15 bp, Homo sapiens
acctaagtttctttt

SEQ ID NO: 184872 - DNA, 15 bp, Homo sapiens
aacctaagtttcttt

SEQ ID NO: 184873 - DNA, 15 bp, Homo sapiens
gaacctaagtttctt

SEQ ID NO: 184874 - DNA, 15 bp, Homo sapiens
agaacctaagtttct

SEQ ID NO: 184875 - DNA, 15 bp, Homo sapiens
gagaacctaagtttc

SEQ ID NO: 184876 - DNA, 15 bp, Homo sapiens
ggagaacctaagttt

SEQ ID NO: 184877 - DNA, 15 bp, Homo sapiens
tggagaacctaagtt

SEQ ID NO: 184878 - DNA, 15 bp, Homo sapiens
ctggagaacctaagt

SEQ ID NO: 184879 - DNA, 15 bp, Homo sapiens
tctggagaacctaag

SEQ ID NO: 184880 - DNA, 15 bp, Homo sapiens
ttctggagaacctaa

SEQ ID NO: 184881 - DNA, 15 bp, Homo sapiens
gttctggagaaccta

SEQ ID NO: 184882 - DNA, 15 bp, Homo sapiens
tgttctggagaacct

SEQ ID NO: 184883 - DNA, 15 bp, Homo sapiens
ctgttctggagaacc

SEQ ID NO: 184884 - DNA, 15 bp, Homo sapiens
tctgttctggagaac

SEQ ID NO: 184885 - DNA, 15 bp, Homo sapiens
ctctgttctggagaa

SEQ ID NO: 184886 - DNA, 15 bp, Homo sapiens
cctctgttctggaga

SEQ ID NO: 184887 - DNA, 15 bp, Homo sapiens
tcctctgttctggag

SEQ ID NO: 184888 - DNA, 15 bp, Homo sapiens
ctcctctgttctgga

SEQ ID NO: 184889 - DNA, 15 bp, Homo sapiens
actcctctgttctgg

SEQ ID NO: 184890 - DNA, 15 bp, Homo sapiens
aactcctctgttctg

SEQ ID NO: 184891 - DNA, 15 bp, Homo sapiens
aaactcctctgttct

SEQ ID NO: 184892 - DNA, 15 bp, Homo sapiens
taaactcctctgttc

SEQ ID NO: 184893 - DNA, 15 bp, Homo sapiens
ataaactcctctgtt

SEQ ID NO: 184894 - DNA, 15 bp, Homo sapiens
aataaactcctctgt

SEQ ID NO: 184895 - DNA, 15 bp, Homo sapiens
aaataaactcctctg

SEQ ID NO: 184896 - DNA, 15 bp, Homo sapiens
caaataaactcctct

SEQ ID NO: 184897 - DNA, 15 bp, Homo sapiens
tcaaataaactcctc

SEQ ID NO: 184898 - DNA, 15 bp, Homo sapiens
ttcaaataaactcct

SEQ ID NO: 184899 - DNA, 15 bp, Homo sapiens
tttcaaataaactcc

SEQ ID NO: 184900 - DNA, 15 bp, Homo sapiens
ttttcaaataaactc

SEQ ID NO: 184901 - DNA, 15 bp, Homo sapiens
attttcaaataaact

SEQ ID NO: 184902 - DNA, 15 bp, Homo sapiens
tattttcaaataaac

SEQ ID NO: 184903 - DNA, 15 bp, Homo sapiens
ctattttcaaataaa

SEQ ID NO: 184904 - DNA, 15 bp, Homo sapiens
gctattttcaaataa

SEQ ID NO: 184905 - DNA, 15 bp, Homo sapiens
tgctattttcaaata

SEQ ID NO: 184906 - DNA, 15 bp, Homo sapiens
ctgctattttcaaat

SEQ ID NO: 184907 - DNA, 15 bp, Homo sapiens
tctgctattttcaaa

SEQ ID NO: 184908 - DNA, 15 bp, Homo sapiens
ctctgctattttcaa

SEQ ID NO: 184909 - DNA, 15 bp, Homo sapiens
cctctgctattttca

SEQ ID NO: 184910 - DNA, 15 bp, Homo sapiens
tcctctgctattttc

SEQ ID NO: 184911 - DNA, 15 bp, Homo sapiens
atcctctgctatttt

SEQ ID NO: 184912 - DNA, 15 bp, Homo sapiens
aatcctctgctattt

SEQ ID NO: 184913 - DNA, 15 bp, Homo sapiens
taatcctctgctatt

SEQ ID NO: 184914 - DNA, 15 bp, Homo sapiens
ataatcctctgctat

SEQ ID NO: 184915 - DNA, 15 bp, Homo sapiens
tataatcctctgcta

SEQ ID NO: 184916 - DNA, 15 bp, Homo sapiens
ttataatcctctgct

SEQ ID NO: 184917 - DNA, 15 bp, Homo sapiens
gttataatcctctgc

SEQ ID NO: 184918 - DNA, 15 bp, Homo sapiens
ggttataatcctctg

SEQ ID NO: 184919 - DNA, 15 bp, Homo sapiens
gggttataatcctct

SEQ ID NO: 184920 - DNA, 15 bp, Homo sapiens
tgggttataatcctc

SEQ ID NO: 184921 - DNA, 15 bp, Homo sapiens
ctgggttataatcct

SEQ ID NO: 184922 - DNA, 15 bp, Homo sapiens
tctgggttataatcc

SEQ ID NO: 184923 - DNA, 15 bp, Homo sapiens
ttctgggttataatc

SEQ ID NO: 184924 - DNA, 15 bp, Homo sapiens
tttctgggttataat

SEQ ID NO: 184925 - DNA, 15 bp, Homo sapiens
ttttctgggttataa

SEQ ID NO: 184926 - DNA, 15 bp, Homo sapiens
attttctgggttata

SEQ ID NO: 184927 - DNA, 15 bp, Homo sapiens
cattttctgggttat

SEQ ID NO: 184928 - DNA, 15 bp, Homo sapiens
acattttctgggtta

SEQ ID NO: 184929 - DNA, 15 bp, Homo sapiens
cacattttctgggtt

SEQ ID NO: 184930 - DNA, 15 bp, Homo sapiens
acacattttctgggt

SEQ ID NO: 184931 - DNA, 15 bp, Homo sapiens
cacacattttctggg

SEQ ID NO: 184932 - DNA, 15 bp, Homo sapiens
gcacacattttctgg

SEQ ID NO: 184933 - DNA, 15 bp, Homo sapiens
agcacacattttctg

SEQ ID NO: 184934 - DNA, 15 bp, Homo sapiens
cagcacacattttct

SEQ ID NO: 184935 - DNA, 15 bp, Homo sapiens
tcagcacacattttc

SEQ ID NO: 184936 - DNA, 15 bp, Homo sapiens
ctcagcacacatttt

SEQ ID NO: 184937 - DNA, 15 bp, Homo sapiens
gctcagcacacattt

SEQ ID NO: 184938 - DNA, 15 bp, Homo sapiens
ggctcagcacacatt

SEQ ID NO: 184939 - DNA, 15 bp, Homo sapiens
tggctcagcacacat

SEQ ID NO: 184940 - DNA, 15 bp, Homo sapiens
ctggctcagcacaca

SEQ ID NO: 184941 - DNA, 15 bp, Homo sapiens
tctggctcagcacac

SEQ ID NO: 184942 - DNA, 15 bp, Homo sapiens
atctggctcagcaca

SEQ ID NO: 184943 - DNA, 15 bp, Homo sapiens
gatctggctcagcac

SEQ ID NO: 184944 - DNA, 15 bp, Homo sapiens
tgatctggctcagca

SEQ ID NO: 184945 - DNA, 15 bp, Homo sapiens
gtgatctggctcagc

SEQ ID NO: 184946 - DNA, 15 bp, Homo sapiens
tgtgatctggctcag

SEQ ID NO: 184947 - DNA, 15 bp, Homo sapiens
ctgtgatctggctca

SEQ ID NO: 184948 - DNA, 15 bp, Homo sapiens
cctgtgatctggctc

SEQ ID NO: 184949 - DNA, 15 bp, Homo sapiens
gcctgtgatctggct

SEQ ID NO: 184950 - DNA, 15 bp, Homo sapiens
cgcctgtgatctggc

SEQ ID NO: 184951 - DNA, 15 bp, Homo sapiens
gcgcctgtgatctgg

SEQ ID NO: 184952 - DNA, 15 bp, Homo sapiens
tgcgcctgtgatctg

SEQ ID NO: 184953 - DNA, 15 bp, Homo sapiens
atgcgcctgtgatct

SEQ ID NO: 184954 - DNA, 15 bp, Homo sapiens
gatgcgcctgtgatc

SEQ ID NO: 184955 - DNA, 15 bp, Homo sapiens
tgatgcgcctgtgat

SEQ ID NO: 184956 - DNA, 15 bp, Homo sapiens
ttgatgcgcctgtga

SEQ ID NO: 184957 - DNA, 15 bp, Homo sapiens
cttgatgcgcctgtg

SEQ ID NO: 184958 - DNA, 15 bp, Homo sapiens
ccttgatgcgcctgt

SEQ ID NO: 184959 - DNA, 15 bp, Homo sapiens
tccttgatgcgcctg

SEQ ID NO: 184960 - DNA, 15 bp, Homo sapiens
ctccttgatgcgcct

SEQ ID NO: 184961 - DNA, 15 bp, Homo sapiens
tctccttgatgcgcc

SEQ ID NO: 184962 - DNA, 15 bp, Homo sapiens
gtctccttgatgcgc

SEQ ID NO: 184963 - DNA, 15 bp, Homo sapiens
agtctccttgatgcg

SEQ ID NO: 184964 - DNA, 15 bp, Homo sapiens
cagtctccttgatgc

SEQ ID NO: 184965 - DNA, 15 bp, Homo sapiens
ccagtctccttgatg

SEQ ID NO: 184966 - DNA, 15 bp, Homo sapiens
cccagtctccttgat

SEQ ID NO: 184967 - DNA, 15 bp, Homo sapiens
tcccagtctccttga

SEQ ID NO: 184968 - DNA, 15 bp, Homo sapiens
gtcccagtctccttg

SEQ ID NO: 184969 - DNA, 15 bp, Homo sapiens
ggtcccagtctcctt

SEQ ID NO: 184970 - DNA, 15 bp, Homo sapiens
tggtcccagtctcct

SEQ ID NO: 184971 - DNA, 15 bp, Homo sapiens
ttggtcccagtctcc

SEQ ID NO: 184972 - DNA, 15 bp, Homo sapiens
tttggtcccagtctc

SEQ ID NO: 184973 - DNA, 15 bp, Homo sapiens
ctttggtcccagtct

SEQ ID NO: 184974 - DNA, 15 bp, Homo sapiens
cctttggtcccagtc

SEQ ID NO: 184975 - DNA, 15 bp, Homo sapiens
ccctttggtcccagt

SEQ ID NO: 184976 - DNA, 15 bp, Homo sapiens
tccctttggtcccag

SEQ ID NO: 184977 - DNA, 15 bp, Homo sapiens
ctccctttggtccca

SEQ ID NO: 184978 - DNA, 15 bp, Homo sapiens
tctccctttggtccc

SEQ ID NO: 184979 - DNA, 15 bp, Homo sapiens
gtctccctttggtcc

SEQ ID NO: 184980 - DNA, 15 bp, Homo sapiens
agtctccctttggtc

SEQ ID NO: 184981 - DNA, 15 bp, Homo sapiens
aagtctccctttggt

SEQ ID NO: 184982 - DNA, 15 bp, Homo sapiens
aaagtctccctttgg

SEQ ID NO: 184983 - DNA, 15 bp, Homo sapiens
aaaagtctccctttg

SEQ ID NO: 184984 - DNA, 15 bp, Homo sapiens
taaaagtctcccttt

SEQ ID NO: 184985 - DNA, 15 bp, Homo sapiens
ttaaaagtctccctt

SEQ ID NO: 184986 - DNA, 15 bp, Homo sapiens
tttaaaagtctccct

SEQ ID NO: 184987 - DNA, 15 bp, Homo sapiens
ctttaaaagtctccc

SEQ ID NO: 184988 - DNA, 15 bp, Homo sapiens
tctttaaaagtctcc

SEQ ID NO: 184989 - DNA, 15 bp, Homo sapiens
gtctttaaaagtctc

SEQ ID NO: 184990 - DNA, 15 bp, Homo sapiens
tgtctttaaaagtct

SEQ ID NO: 184991 - DNA, 15 bp, Homo sapiens
ttgtctttaaaagtc

SEQ ID NO: 184992 - DNA, 15 bp, Homo sapiens
tttgtctttaaaagt

SEQ ID NO: 184993 - DNA, 15 bp, Homo sapiens
ctttgtctttaaaag

SEQ ID NO: 184994 - DNA, 15 bp, Homo sapiens
tctttgtctttaaaa

SEQ ID NO: 184995 - DNA, 15 bp, Homo sapiens
ctctttgtctttaaa

SEQ ID NO: 184996 - DNA, 15 bp, Homo sapiens
tctctttgtctttaa

SEQ ID NO: 184997 - DNA, 15 bp, Homo sapiens
ttctctttgtcttta

SEQ ID NO: 184998 - DNA, 15 bp, Homo sapiens
cttctctttgtcttt

SEQ ID NO: 184999 - DNA, 15 bp, Homo sapiens
acttctctttgtctt

SEQ ID NO: 185000 - DNA, 15 bp, Homo sapiens
gacttctctttgtct

SEQ ID NO: 185001 - DNA, 15 bp, Homo sapiens
agacttctctttgtc

SEQ ID NO: 185002 - DNA, 15 bp, Homo sapiens
aagacttctctttgt

SEQ ID NO: 185003 - DNA, 15 bp, Homo sapiens
gaagacttctctttg

SEQ ID NO: 185004 - DNA, 15 bp, Homo sapiens
tgaagacttctcttt

SEQ ID NO: 185005 - DNA, 15 bp, Homo sapiens
atgaagacttctctt

SEQ ID NO: 185006 - DNA, 15 bp, Homo sapiens
tatgaagacttctct

SEQ ID NO: 185007 - DNA, 15 bp, Homo sapiens
ttatgaagacttctc

SEQ ID NO: 185008 - DNA, 15 bp, Homo sapiens
tttatgaagacttct

SEQ ID NO: 185009 - DNA, 15 bp, Homo sapiens
gtttatgaagacttc

SEQ ID NO: 185010 - DNA, 15 bp, Homo sapiens
agtttatgaagactt

SEQ ID NO: 185011 - DNA, 15 bp, Homo sapiens
cagtttatgaagact

SEQ ID NO: 185012 - DNA, 15 bp, Homo sapiens
acagtttatgaagac

SEQ ID NO: 185013 - DNA, 15 bp, Homo sapiens
aacagtttatgaaga

SEQ ID NO: 185014 - DNA, 15 bp, Homo sapiens
aaacagtttatgaag

SEQ ID NO: 185015 - DNA, 15 bp, Homo sapiens
caaacagtttatgaa

SEQ ID NO: 185016 - DNA, 15 bp, Homo sapiens
acaaacagtttatga

SEQ ID NO: 185017 - DNA, 15 bp, Homo sapiens
aacaaacagtttatg

SEQ ID NO: 185018 - DNA, 15 bp, Homo sapiens
taacaaacagtttat

SEQ ID NO: 185019 - DNA, 15 bp, Homo sapiens
ttaacaaacagttta

SEQ ID NO: 185020 - DNA, 15 bp, Homo sapiens
tttaacaaacagttt

SEQ ID NO: 185021 - DNA, 15 bp, Homo sapiens
gtttaacaaacagtt

SEQ ID NO: 185022 - DNA, 15 bp, Homo sapiens
ggtttaacaaacagt

SEQ ID NO: 185023 - DNA, 15 bp, Homo sapiens
tggtttaacaaacag

SEQ ID NO: 185024 - DNA, 15 bp, Homo sapiens
ctggtttaacaaaca

SEQ ID NO: 185025 - DNA, 15 bp, Homo sapiens
tctggtttaacaaac

SEQ ID NO: 185026 - DNA, 15 bp, Homo sapiens
ttctggtttaacaaa

SEQ ID NO: 185027 - DNA, 15 bp, Homo sapiens
tttctggtttaacaa

SEQ ID NO: 185028 - DNA, 15 bp, Homo sapiens
ctttctggtttaaca

SEQ ID NO: 185029 - DNA, 15 bp, Homo sapiens
tctttctggtttaac

SEQ ID NO: 185030 - DNA, 15 bp, Homo sapiens
atctttctggtttaa

SEQ ID NO: 185031 - DNA, 15 bp, Homo sapiens
gatctttctggttta

SEQ ID NO: 185032 - DNA, 15 bp, Homo sapiens
tgatctttctggttt

SEQ ID NO: 185033 - DNA, 15 bp, Homo sapiens
atgatctttctggtt

SEQ ID NO: 185034 - DNA, 15 bp, Homo sapiens
aatgatctttctggt

SEQ ID NO: 185035 - DNA, 15 bp, Homo sapiens
caatgatctttctgg

SEQ ID NO: 185036 - DNA, 15 bp, Homo sapiens
ccaatgatctttctg

SEQ ID NO: 185037 - DNA, 15 bp, Homo sapiens
accaatgatctttct

SEQ ID NO: 185038 - DNA, 15 bp, Homo sapiens
aaccaatgatctttc

SEQ ID NO: 185039 - DNA, 15 bp, Homo sapiens
taaccaatgatcttt

SEQ ID NO: 185040 - DNA, 15 bp, Homo sapiens
gtaaccaatgatctt

SEQ ID NO: 185041 - DNA, 15 bp, Homo sapiens
tgtaaccaatgatct

SEQ ID NO: 185042 - DNA, 15 bp, Homo sapiens
ttgtaaccaatgatc

SEQ ID NO: 185043 - DNA, 15 bp, Homo sapiens
cttgtaaccaatgat

SEQ ID NO: 185044 - DNA, 15 bp, Homo sapiens
tcttgtaaccaatga

SEQ ID NO: 185045 - DNA, 15 bp, Homo sapiens
ctcttgtaaccaatg

SEQ ID NO: 185046 - DNA, 15 bp, Homo sapiens
gctcttgtaaccaat

SEQ ID NO: 185047 - DNA, 15 bp, Homo sapiens
agctcttgtaaccaa

SEQ ID NO: 185048 - DNA, 15 bp, Homo sapiens
aagctcttgtaacca

SEQ ID NO: 185049 - DNA, 15 bp, Homo sapiens
caagctcttgtaacc

SEQ ID NO: 185050 - DNA, 15 bp, Homo sapiens
gcaagctcttgtaac

SEQ ID NO: 185051 - DNA, 15 bp, Homo sapiens
agcaagctcttgtaa

SEQ ID NO: 185052 - DNA, 15 bp, Homo sapiens
cagcaagctcttgta

SEQ ID NO: 185053 - DNA, 15 bp, Homo sapiens
acagcaagctcttgt

SEQ ID NO: 185054 - DNA, 15 bp, Homo sapiens
tacagcaagctcttg

SEQ ID NO: 185055 - DNA, 15 bp, Homo sapiens
ttacagcaagctctt

SEQ ID NO: 185056 - DNA, 15 bp, Homo sapiens
cttacagcaagctct

SEQ ID NO: 185057 - DNA, 15 bp, Homo sapiens
tcttacagcaagctc

SEQ ID NO: 185058 - DNA, 15 bp, Homo sapiens
ctcttacagcaagct

SEQ ID NO: 185059 - DNA, 15 bp, Homo sapiens
actcttacagcaagc

SEQ ID NO: 185060 - DNA, 15 bp, Homo sapiens
aactcttacagcaag

SEQ ID NO: 185061 - DNA, 15 bp, Homo sapiens
caactcttacagcaa

SEQ ID NO: 185062 - DNA, 15 bp, Homo sapiens
ccaactcttacagca

SEQ ID NO: 185063 - DNA, 15 bp, Homo sapiens
gccaactcttacagc

SEQ ID NO: 185064 - DNA, 15 bp, Homo sapiens
cgccaactcttacag

SEQ ID NO: 185065 - DNA, 15 bp, Homo sapiens
tcgccaactcttaca

SEQ ID NO: 185066 - DNA, 15 bp, Homo sapiens
gtcgccaactcttac

SEQ ID NO: 185067 - DNA, 15 bp, Homo sapiens
tgtcgccaactctta

SEQ ID NO: 185068 - DNA, 15 bp, Homo sapiens
ttgtcgccaactctt

SEQ ID NO: 185069 - DNA, 15 bp, Homo sapiens
tttgtcgccaactct

SEQ ID NO: 185070 - DNA, 15 bp, Homo sapiens
atttgtcgccaactc

SEQ ID NO: 185071 - DNA, 15 bp, Homo sapiens
gatttgtcgccaact

SEQ ID NO: 185072 - DNA, 15 bp, Homo sapiens
tgatttgtcgccaac

SEQ ID NO: 185073 - DNA, 15 bp, Homo sapiens
atgatttgtcgccaa

SEQ ID NO: 185074 - DNA, 15 bp, Homo sapiens
aatgatttgtcgcca

SEQ ID NO: 185075 - DNA, 15 bp, Homo sapiens
caatgatttgtcgcc

SEQ ID NO: 185076 - DNA, 15 bp, Homo sapiens
acaatgatttgtcgc

SEQ ID NO: 185077 - DNA, 15 bp, Homo sapiens
aacaatgatttgtcg

SEQ ID NO: 185078 - DNA, 15 bp, Homo sapiens
taacaatgatttgtc

SEQ ID NO: 185079 - DNA, 15 bp, Homo sapiens
ttaacaatgatttgt

SEQ ID NO: 185080 - DNA, 15 bp, Homo sapiens
tttaacaatgatttg

SEQ ID NO: 185081 - DNA, 15 bp, Homo sapiens
ctttaacaatgattt

SEQ ID NO: 185082 - DNA, 15 bp, Homo sapiens
tctttaacaatgatt

SEQ ID NO: 185083 - DNA, 15 bp, Homo sapiens
gtctttaacaatgat

SEQ ID NO: 185084 - DNA, 15 bp, Homo sapiens
cgtctttaacaatga

SEQ ID NO: 185085 - DNA, 15 bp, Homo sapiens
acgtctttaacaatg

SEQ ID NO: 185086 - DNA, 15 bp, Homo sapiens
gacgtctttaacaat

SEQ ID NO: 185087 - DNA, 15 bp, Homo sapiens
tgacgtctttaacaa

SEQ ID NO: 185088 - DNA, 15 bp, Homo sapiens
atgacgtctttaaca

SEQ ID NO: 185089 - DNA, 15 bp, Homo sapiens
aatgacgtctttaac

SEQ ID NO: 185090 - DNA, 15 bp, Homo sapiens
taatgacgtctttaa

SEQ ID NO: 185091 - DNA, 15 bp, Homo sapiens
gtaatgacgtcttta

SEQ ID NO: 185092 - DNA, 15 bp, Homo sapiens
agtaatgacgtcttt

SEQ ID NO: 185093 - DNA, 15 bp, Homo sapiens
tagtaatgacgtctt

SEQ ID NO: 185094 - DNA, 15 bp, Homo sapiens
ctagtaatgacgtct

SEQ ID NO: 185095 - DNA, 15 bp, Homo sapiens
tctagtaatgacgtc

SEQ ID NO: 185096 - DNA, 15 bp, Homo sapiens
gtctagtaatgacgt

SEQ ID NO: 185097 - DNA, 15 bp, Homo sapiens
tgtctagtaatgacg

SEQ ID NO: 185098 - DNA, 15 bp, Homo sapiens
ctgtctagtaatgac

SEQ ID NO: 185099 - DNA, 15 bp, Homo sapiens
tctgtctagtaatga

SEQ ID NO: 185100 - DNA, 15 bp, Homo sapiens
atctgtctagtaatg

SEQ ID NO: 185101 - DNA, 15 bp, Homo sapiens
catctgtctagtaat

SEQ ID NO: 185102 - DNA, 15 bp, Homo sapiens
acatctgtctagtaa

SEQ ID NO: 185103 - DNA, 15 bp, Homo sapiens
gacatctgtctagta

SEQ ID NO: 185104 - DNA, 15 bp, Homo sapiens
ggacatctgtctagt

SEQ ID NO: 185105 - DNA, 15 bp, Homo sapiens
aggacatctgtctag

SEQ ID NO: 185106 - DNA, 15 bp, Homo sapiens
aaggacatctgtcta

SEQ ID NO: 185107 - DNA, 15 bp, Homo sapiens
caaggacatctgtct

SEQ ID NO: 185108 - DNA, 15 bp, Homo sapiens
acaaggacatctgtc

SEQ ID NO: 185109 - DNA, 15 bp, Homo sapiens
cacaaggacatctgt

SEQ ID NO: 185110 - DNA, 15 bp, Homo sapiens
gcacaaggacatctg

SEQ ID NO: 185111 - DNA, 15 bp, Homo sapiens
tgcacaaggacatct

SEQ ID NO: 185112 - DNA, 15 bp, Homo sapiens
ttgcacaaggacatc

SEQ ID NO: 185113 - DNA, 15 bp, Homo sapiens
cttgcacaaggacat

SEQ ID NO: 185114 - DNA, 15 bp, Homo sapiens
gcttgcacaaggaca

SEQ ID NO: 185115 - DNA, 15 bp, Homo sapiens
agcttgcacaaggac

SEQ ID NO: 185116 - DNA, 15 bp, Homo sapiens
cagcttgcacaagga

SEQ ID NO: 185117 - DNA, 15 bp, Homo sapiens
gcagcttgcacaagg

SEQ ID NO: 185118 - DNA, 15 bp, Homo sapiens
agcagcttgcacaag

SEQ ID NO: 185119 - DNA, 15 bp, Homo sapiens
aagcagcttgcacaa

SEQ ID NO: 185120 - DNA, 15 bp, Homo sapiens
taagcagcttgcaca

SEQ ID NO: 185121 - DNA, 15 bp, Homo sapiens
ataagcagcttgcac

SEQ ID NO: 185122 - DNA, 15 bp, Homo sapiens
gataagcagcttgca

SEQ ID NO: 185123 - DNA, 15 bp, Homo sapiens
agataagcagcttgc

SEQ ID NO: 185124 - DNA, 15 bp, Homo sapiens
cagataagcagcttg

SEQ ID NO: 185125 - DNA, 15 bp, Homo sapiens
ccagataagcagctt

SEQ ID NO: 185126 - DNA, 15 bp, Homo sapiens
tccagataagcagct

SEQ ID NO: 185127 - DNA, 15 bp, Homo sapiens
ctccagataagcagc

SEQ ID NO: 185128 - DNA, 15 bp, Homo sapiens
gctccagataagcag

SEQ ID NO: 185129 - DNA, 15 bp, Homo sapiens
agctccagataagca

SEQ ID NO: 185130 - DNA, 15 bp, Homo sapiens
aagctccagataagc

SEQ ID NO: 185131 - DNA, 15 bp, Homo sapiens
aaagctccagataag

SEQ ID NO: 185132 - DNA, 15 bp, Homo sapiens
caaagctccagataa

SEQ ID NO: 185133 - DNA, 15 bp, Homo sapiens
gcaaagctccagata

SEQ ID NO: 185134 - DNA, 15 bp, Homo sapiens
cgcaaagctccagat

SEQ ID NO: 185135 - DNA, 15 bp, Homo sapiens
ccgcaaagctccaga

SEQ ID NO: 185136 - DNA, 15 bp, Homo sapiens
accgcaaagctccag

SEQ ID NO: 185137 - DNA, 15 bp, Homo sapiens
gaccgcaaagctcca

SEQ ID NO: 185138 - DNA, 15 bp, Homo sapiens
agaccgcaaagctcc

SEQ ID NO: 185139 - DNA, 15 bp, Homo sapiens
tagaccgcaaagctc

SEQ ID NO: 185140 - DNA, 15 bp, Homo sapiens
ctagaccgcaaagct

SEQ ID NO: 185141 - DNA, 15 bp, Homo sapiens
cctagaccgcaaagc

SEQ ID NO: 185142 - DNA, 15 bp, Homo sapiens
ccctagaccgcaaag

SEQ ID NO: 185143 - DNA, 15 bp, Homo sapiens
cccctagaccgcaaa

SEQ ID NO: 185144 - DNA, 15 bp, Homo sapiens
tcccctagaccgcaa

SEQ ID NO: 185145 - DNA, 15 bp, Homo sapiens
ttcccctagaccgca

SEQ ID NO: 185146 - DNA, 15 bp, Homo sapiens
attcccctagaccgc

SEQ ID NO: 185147 - DNA, 15 bp, Homo sapiens
aattcccctagaccg

SEQ ID NO: 185148 - DNA, 15 bp, Homo sapiens
aaattcccctagacc

SEQ ID NO: 185149 - DNA, 15 bp, Homo sapiens
gaaattcccctagac

SEQ ID NO: 185150 - DNA, 15 bp, Homo sapiens
ggaaattcccctaga

SEQ ID NO: 185151 - DNA, 15 bp, Homo sapiens
aggaaattcccctag

SEQ ID NO: 185152 - DNA, 15 bp, Homo sapiens
aaggaaattccccta

SEQ ID NO: 185153 - DNA, 15 bp, Homo sapiens
caaggaaattcccct

SEQ ID NO: 185154 - DNA, 15 bp, Homo sapiens
gcaaggaaattcccc

SEQ ID NO: 185155 - DNA, 15 bp, Homo sapiens
agcaaggaaattccc

SEQ ID NO: 185156 - DNA, 15 bp, Homo sapiens
tagcaaggaaattcc

SEQ ID NO: 185157 - DNA, 15 bp, Homo sapiens
ttagcaaggaaattc

SEQ ID NO: 185158 - DNA, 15 bp, Homo sapiens
tttagcaaggaaatt

SEQ ID NO: 185159 - DNA, 15 bp, Homo sapiens
ttttagcaaggaaat

SEQ ID NO: 185160 - DNA, 15 bp, Homo sapiens
cttttagcaaggaaa

SEQ ID NO: 185161 - DNA, 15 bp, Homo sapiens
acttttagcaaggaa

SEQ ID NO: 185162 - DNA, 15 bp, Homo sapiens
gacttttagcaagga

SEQ ID NO: 185163 - DNA, 15 bp, Homo sapiens
ggacttttagcaagg

SEQ ID NO: 185164 - DNA, 15 bp, Homo sapiens
aggacttttagcaag

SEQ ID NO: 185165 - DNA, 15 bp, Homo sapiens
caggacttttagcaa

SEQ ID NO: 185166 - DNA, 15 bp, Homo sapiens
acaggacttttagca

SEQ ID NO: 185167 - DNA, 15 bp, Homo sapiens
aacaggacttttagc

SEQ ID NO: 185168 - DNA, 15 bp, Homo sapiens
taacaggacttttag

SEQ ID NO: 185169 - DNA, 15 bp, Homo sapiens
gtaacaggactttta

SEQ ID NO: 185170 - DNA, 15 bp, Homo sapiens
tgtaacaggactttt

SEQ ID NO: 185171 - DNA, 15 bp, Homo sapiens
ctgtaacaggacttt

SEQ ID NO: 185172 - DNA, 15 bp, Homo sapiens
cctgtaacaggactt

SEQ ID NO: 185173 - DNA, 15 bp, Homo sapiens
gcctgtaacaggact

SEQ ID NO: 185174 - DNA, 15 bp, Homo sapiens
tgcctgtaacaggac

SEQ ID NO: 185175 - DNA, 15 bp, Homo sapiens
ttgcctgtaacagga

SEQ ID NO: 185176 - DNA, 15 bp, Homo sapiens
tttgcctgtaacagg

SEQ ID NO: 185177 - DNA, 15 bp, Homo sapiens
atttgcctgtaacag

SEQ ID NO: 185178 - DNA, 15 bp, Homo sapiens
catttgcctgtaaca

SEQ ID NO: 185179 - DNA, 15 bp, Homo sapiens
acatttgcctgtaac

SEQ ID NO: 185180 - DNA, 15 bp, Homo sapiens
cacatttgcctgtaa

SEQ ID NO: 185181 - DNA, 15 bp, Homo sapiens
gcacatttgcctgta

SEQ ID NO: 185182 - DNA, 15 bp, Homo sapiens
tgcacatttgcctgt

SEQ ID NO: 185183 - DNA, 15 bp, Homo sapiens
ctgcacatttgcctg

SEQ ID NO: 185184 - DNA, 15 bp, Homo sapiens
actgcacatttgcct

SEQ ID NO: 185185 - DNA, 15 bp, Homo sapiens
tactgcacatttgcc

SEQ ID NO: 185186 - DNA, 15 bp, Homo sapiens
ttactgcacatttgc

SEQ ID NO: 185187 - DNA, 15 bp, Homo sapiens
tttactgcacatttg

SEQ ID NO: 185188 - DNA, 15 bp, Homo sapiens
atttactgcacattt

SEQ ID NO: 185189 - DNA, 15 bp, Homo sapiens
catttactgcacatt

SEQ ID NO: 185190 - DNA, 15 bp, Homo sapiens
gcatttactgcacat

SEQ ID NO: 185191 - DNA, 15 bp, Homo sapiens
cgcatttactgcaca

SEQ ID NO: 185192 - DNA, 15 bp, Homo sapiens
ccgcatttactgcac

SEQ ID NO: 185193 - DNA, 15 bp, Homo sapiens
cccgcatttactgca

SEQ ID NO: 185194 - DNA, 15 bp, Homo sapiens
tcccgcatttactgc

SEQ ID NO: 185195 - DNA, 15 bp, Homo sapiens
ttcccgcatttactg

SEQ ID NO: 185196 - DNA, 15 bp, Homo sapiens
attcccgcatttact

SEQ ID NO: 185197 - DNA, 15 bp, Homo sapiens
cattcccgcatttac

SEQ ID NO: 185198 - DNA, 15 bp, Homo sapiens
acattcccgcattta

SEQ ID NO: 185199 - DNA, 15 bp, Homo sapiens
gacattcccgcattt

SEQ ID NO: 185200 - DNA, 15 bp, Homo sapiens
agacattcccgcatt

SEQ ID NO: 185201 - DNA, 15 bp, Homo sapiens
gagacattcccgcat

SEQ ID NO: 185202 - DNA, 15 bp, Homo sapiens
ggagacattcccgca

SEQ ID NO: 185203 - DNA, 15 bp, Homo sapiens
aggagacattcccgc

SEQ ID NO: 185204 - DNA, 15 bp, Homo sapiens
taggagacattcccg

SEQ ID NO: 185205 - DNA, 15 bp, Homo sapiens
ataggagacattccc

SEQ ID NO: 185206 - DNA, 15 bp, Homo sapiens
tataggagacattcc

SEQ ID NO: 185207 - DNA, 15 bp, Homo sapiens
ttataggagacattc

SEQ ID NO: 185208 - DNA, 15 bp, Homo sapiens
cttataggagacatt

SEQ ID NO: 185209 - DNA, 15 bp, Homo sapiens
ccttataggagacat

SEQ ID NO: 185210 - DNA, 15 bp, Homo sapiens
gccttataggagaca

SEQ ID NO: 185211 - DNA, 15 bp, Homo sapiens
ggccttataggagac

SEQ ID NO: 185212 - DNA, 15 bp, Homo sapiens
aggccttataggaga

SEQ ID NO: 185213 - DNA, 15 bp, Homo sapiens
aaggccttataggag

SEQ ID NO: 185214 - DNA, 15 bp, Homo sapiens
aaaggccttatagga

SEQ ID NO: 185215 - DNA, 15 bp, Homo sapiens
taaaggccttatagg

SEQ ID NO: 185216 - DNA, 15 bp, Homo sapiens
gtaaaggccttatag

SEQ ID NO: 185217 - DNA, 15 bp, Homo sapiens
tgtaaaggccttata

SEQ ID NO: 185218 - DNA, 15 bp, Homo sapiens
ctgtaaaggccttat

SEQ ID NO: 185219 - DNA, 15 bp, Homo sapiens
cctgtaaaggcctta

SEQ ID NO: 185220 - DNA, 15 bp, Homo sapiens
gcctgtaaaggcctt

SEQ ID NO: 185221 - DNA, 15 bp, Homo sapiens
tgcctgtaaaggcct

SEQ ID NO: 185222 - DNA, 15 bp, Homo sapiens
atgcctgtaaaggcc

SEQ ID NO: 185223 - DNA, 15 bp, Homo sapiens
aatgcctgtaaaggc

SEQ ID NO: 185224 - DNA, 15 bp, Homo sapiens
aaatgcctgtaaagg

SEQ ID NO: 185225 - DNA, 15 bp, Homo sapiens
caaatgcctgtaaag

SEQ ID NO: 185226 - DNA, 15 bp, Homo sapiens
acaaatgcctgtaaa

SEQ ID NO: 185227 - DNA, 15 bp, Homo sapiens
cacaaatgcctgtaa

SEQ ID NO: 185228 - DNA, 15 bp, Homo sapiens
tcacaaatgcctgta

SEQ ID NO: 185229 - DNA, 15 bp, Homo sapiens
ctcacaaatgcctgt

SEQ ID NO: 185230 - DNA, 15 bp, Homo sapiens
actcacaaatgcctg

SEQ ID NO: 185231 - DNA, 15 bp, Homo sapiens
cactcacaaatgcct

SEQ ID NO: 185232 - DNA, 15 bp, Homo sapiens
tcactcacaaatgcc

SEQ ID NO: 185233 - DNA, 15 bp, Homo sapiens
ctcactcacaaatgc

SEQ ID NO: 185234 - DNA, 15 bp, Homo sapiens
cctcactcacaaatg

SEQ ID NO: 185235 - DNA, 15 bp, Homo sapiens
ccctcactcacaaat

SEQ ID NO: 185236 - DNA, 15 bp, Homo sapiens
gccctcactcacaaa

SEQ ID NO: 185237 - DNA, 15 bp, Homo sapiens
agccctcactcacaa

SEQ ID NO: 185238 - DNA, 15 bp, Homo sapiens
gagccctcactcaca

SEQ ID NO: 185239 - DNA, 15 bp, Homo sapiens
ggagccctcactcac

SEQ ID NO: 185240 - DNA, 15 bp, Homo sapiens
gggagccctcactca

SEQ ID NO: 185241 - DNA, 15 bp, Homo sapiens
ggggagccctcactc

SEQ ID NO: 185242 - DNA, 15 bp, Homo sapiens
gggggagccctcact

SEQ ID NO: 185243 - DNA, 15 bp, Homo sapiens
agggggagccctcac

SEQ ID NO: 185244 - DNA, 15 bp, Homo sapiens
aagggggagccctca

SEQ ID NO: 185245 - DNA, 15 bp, Homo sapiens
gaagggggagccctc

SEQ ID NO: 185246 - DNA, 15 bp, Homo sapiens
cgaagggggagccct

SEQ ID NO: 185247 - DNA, 15 bp, Homo sapiens
acgaagggggagccc

SEQ ID NO: 185248 - DNA, 15 bp, Homo sapiens
cacgaagggggagcc

SEQ ID NO: 185249 - DNA, 15 bp, Homo sapiens
ccacgaagggggagc

SEQ ID NO: 185250 - DNA, 15 bp, Homo sapiens
gccacgaagggggag

SEQ ID NO: 185251 - DNA, 15 bp, Homo sapiens
ggccacgaaggggga

SEQ ID NO: 185252 - DNA, 15 bp, Homo sapiens
aggccacgaaggggg

SEQ ID NO: 185253 - DNA, 15 bp, Homo sapiens
aaggccacgaagggg

SEQ ID NO: 185254 - DNA, 15 bp, Homo sapiens
gaaggccacgaaggg

SEQ ID NO: 185255 - DNA, 15 bp, Homo sapiens
ggaaggccacgaagg

SEQ ID NO: 185256 - DNA, 15 bp, Homo sapiens
tggaaggccacgaag

SEQ ID NO: 185257 - DNA, 15 bp, Homo sapiens
ttggaaggccacgaa

SEQ ID NO: 185258 - DNA, 15 bp, Homo sapiens
gttggaaggccacga

SEQ ID NO: 185259 - DNA, 15 bp, Homo sapiens
agttggaaggccacg

SEQ ID NO: 185260 - DNA, 15 bp, Homo sapiens
gagttggaaggccac

SEQ ID NO: 185261 - DNA, 15 bp, Homo sapiens
ggagttggaaggcca

SEQ ID NO: 185262 - DNA, 15 bp, Homo sapiens
tggagttggaaggcc

SEQ ID NO: 185263 - DNA, 15 bp, Homo sapiens
atggagttggaaggc

SEQ ID NO: 185264 - DNA, 15 bp, Homo sapiens
aatggagttggaagg

SEQ ID NO: 185265 - DNA, 15 bp, Homo sapiens
aaatggagttggaag

SEQ ID NO: 185266 - DNA, 15 bp, Homo sapiens
caaatggagttggaa

SEQ ID NO: 185267 - DNA, 15 bp, Homo sapiens
gcaaatggagttgga

SEQ ID NO: 185268 - DNA, 15 bp, Homo sapiens
agcaaatggagttgg

SEQ ID NO: 185269 - DNA, 15 bp, Homo sapiens
tagcaaatggagttg

SEQ ID NO: 185270 - DNA, 15 bp, Homo sapiens
ctagcaaatggagtt

SEQ ID NO: 185271 - DNA, 15 bp, Homo sapiens
cctagcaaatggagt

SEQ ID NO: 185272 - DNA, 15 bp, Homo sapiens
ccctagcaaatggag

SEQ ID NO: 185273 - DNA, 15 bp, Homo sapiens
accctagcaaatgga

SEQ ID NO: 185274 - DNA, 15 bp, Homo sapiens
aaccctagcaaatgg

SEQ ID NO: 185275 - DNA, 15 bp, Homo sapiens
aaaccctagcaaatg

SEQ ID NO: 185276 - DNA, 15 bp, Homo sapiens
caaaccctagcaaat

SEQ ID NO: 185277 - DNA, 15 bp, Homo sapiens
tcaaaccctagcaaa

SEQ ID NO: 185278 - DNA, 15 bp, Homo sapiens
gtcaaaccctagcaa

SEQ ID NO: 185279 - DNA, 15 bp, Homo sapiens
tgtcaaaccctagca

SEQ ID NO: 185280 - DNA, 15 bp, Homo sapiens
atgtcaaaccctagc

SEQ ID NO: 185281 - DNA, 15 bp, Homo sapiens
tatgtcaaaccctag

SEQ ID NO: 185282 - DNA, 15 bp, Homo sapiens
ttatgtcaaacccta

SEQ ID NO: 185283 - DNA, 15 bp, Homo sapiens
attatgtcaaaccct

SEQ ID NO: 185284 - DNA, 15 bp, Homo sapiens
aattatgtcaaaccc

SEQ ID NO: 185285 - DNA, 15 bp, Homo sapiens
caattatgtcaaacc

SEQ ID NO: 185286 - DNA, 15 bp, Homo sapiens
tcaattatgtcaaac

SEQ ID NO: 185287 - DNA, 15 bp, Homo sapiens
atcaattatgtcaaa

SEQ ID NO: 185288 - DNA, 15 bp, Homo sapiens
aatcaattatgtcaa

SEQ ID NO: 185289 - DNA, 15 bp, Homo sapiens
gaatcaattatgtca

SEQ ID NO: 185290 - DNA, 15 bp, Homo sapiens
ggaatcaattatgtc

SEQ ID NO: 185291 - DNA, 15 bp, Homo sapiens
tggaatcaattatgt

SEQ ID NO: 185292 - DNA, 15 bp, Homo sapiens
atggaatcaattatg

SEQ ID NO: 185293 - DNA, 15 bp, Homo sapiens
aatggaatcaattat

SEQ ID NO: 185294 - DNA, 15 bp, Homo sapiens
aaatggaatcaatta

SEQ ID NO: 185295 - DNA, 15 bp, Homo sapiens
aaaatggaatcaatt

SEQ ID NO: 185296 - DNA, 15 bp, Homo sapiens
caaaatggaatcaat

SEQ ID NO: 185297 - DNA, 15 bp, Homo sapiens
taccaaaatggaatc

SEQ ID NO: 185298 - DNA, 15 bp, Homo sapiens
ataccaaaatggaat

SEQ ID NO: 185299 - DNA, 15 bp, Homo sapiens
gataccaaaatggaa

SEQ ID NO: 185300 - DNA, 15 bp, Homo sapiens
tgataccaaaatgga

SEQ ID NO: 185301 - DNA, 15 bp, Homo sapiens
ttgataccaaaatgg

SEQ ID NO: 185302 - DNA, 15 bp, Homo sapiens
gttgataccaaaatg

SEQ ID NO: 185303 - DNA, 15 bp, Homo sapiens
tgttgataccaaaat

SEQ ID NO: 185304 - DNA, 15 bp, Homo sapiens
ttgttgataccaaaa

SEQ ID NO: 185305 - DNA, 15 bp, Homo sapiens
gttgttgataccaaa

SEQ ID NO: 185306 - DNA, 15 bp, Homo sapiens
agttgttgataccaa

SEQ ID NO: 185307 - DNA, 15 bp, Homo sapiens
aagttgttgatacca

SEQ ID NO: 185308 - DNA, 15 bp, Homo sapiens
aaagttgttgatacc

SEQ ID NO: 185309 - DNA, 15 bp, Homo sapiens
gaaagttgttgatac

SEQ ID NO: 185310 - DNA, 15 bp, Homo sapiens
tgaaagttgttgata

SEQ ID NO: 185311 - DNA, 15 bp, Homo sapiens
gtgaaagttgttgat

SEQ ID NO: 185312 - DNA, 15 bp, Homo sapiens
tgtgaaagttgttga

SEQ ID NO: 185313 - DNA, 15 bp, Homo sapiens
gtgtgaaagttgttg

SEQ ID NO: 185314 - DNA, 15 bp, Homo sapiens
tgtgtgaaagttgtt

SEQ ID NO: 185315 - DNA, 15 bp, Homo sapiens
atgtgtgaaagttgt

SEQ ID NO: 185316 - DNA, 15 bp, Homo sapiens
catgtgtgaaagttg

SEQ ID NO: 185317 - DNA, 15 bp, Homo sapiens
ccatgtgtgaaagtt

SEQ ID NO: 185318 - DNA, 15 bp, Homo sapiens
tccatgtgtgaaagt

SEQ ID NO: 185319 - DNA, 15 bp, Homo sapiens
atccatgtgtgaaag

SEQ ID NO: 185320 - DNA, 15 bp, Homo sapiens
tatccatgtgtgaaa

SEQ ID NO: 185321 - DNA, 15 bp, Homo sapiens
ctatccatgtgtgaa

SEQ ID NO: 185322 - DNA, 15 bp, Homo sapiens
actatccatgtgtga

SEQ ID NO: 185323 - DNA, 15 bp, Homo sapiens
aactatccatgtgtg

SEQ ID NO: 185324 - DNA, 15 bp, Homo sapiens
gaactatccatgtgt

SEQ ID NO: 185325 - DNA, 15 bp, Homo sapiens
tgaactatccatgtg

SEQ ID NO: 185326 - DNA, 15 bp, Homo sapiens
ttgaactatccatgt

SEQ ID NO: 185327 - DNA, 15 bp, Homo sapiens
tttgaactatccatg

SEQ ID NO: 185328 - DNA, 15 bp, Homo sapiens
ttttgaactatccat

SEQ ID NO: 185329 - DNA, 15 bp, Homo sapiens
attttgaactatcca

SEQ ID NO: 185330 - DNA, 15 bp, Homo sapiens
cattttgaactatcc

SEQ ID NO: 185331 - DNA, 15 bp, Homo sapiens
ccattttgaactatc

SEQ ID NO: 185332 - DNA, 15 bp, Homo sapiens
tccattttgaactat

SEQ ID NO: 185333 - DNA, 15 bp, Homo sapiens
ttccattttgaacta

SEQ ID NO: 185334 - DNA, 15 bp, Homo sapiens
cttccattttgaact

SEQ ID NO: 185335 - DNA, 15 bp, Homo sapiens
gcttccattttgaac

SEQ ID NO: 185336 - DNA, 15 bp, Homo sapiens
agcttccattttgaa

SEQ ID NO: 185337 - DNA, 15 bp, Homo sapiens
gagcttccattttga

SEQ ID NO: 185338 - DNA, 15 bp, Homo sapiens
ggagcttccattttg

SEQ ID NO: 185339 - DNA, 15 bp, Homo sapiens
aggagcttccatttt

SEQ ID NO: 185340 - DNA, 15 bp, Homo sapiens
caggagcttccattt

SEQ ID NO: 185341 - DNA, 15 bp, Homo sapiens
acaggagcttccatt

SEQ ID NO: 185342 - DNA, 15 bp, Homo sapiens
tacaggagcttccat

SEQ ID NO: 185343 - DNA, 15 bp, Homo sapiens
ttacaggagcttcca

SEQ ID NO: 185344 - DNA, 15 bp, Homo sapiens
tttacaggagcttcc

SEQ ID NO: 185345 - DNA, 15 bp, Homo sapiens
ttttacaggagcttc

SEQ ID NO: 185346 - DNA, 15 bp, Homo sapiens
attttacaggagctt

SEQ ID NO: 185347 - DNA, 15 bp, Homo sapiens
tattttacaggagct

SEQ ID NO: 185348 - DNA, 15 bp, Homo sapiens
ttattttacaggagc

SEQ ID NO: 185349 - DNA, 15 bp, Homo sapiens
attattttacaggag

SEQ ID NO: 185350 - DNA, 15 bp, Homo sapiens
tattattttacagga

SEQ ID NO: 185351 - DNA, 15 bp, Homo sapiens
gtattattttacagg

SEQ ID NO: 185352 - DNA, 15 bp, Homo sapiens
agtattattttacag

SEQ ID NO: 185353 - DNA, 15 bp, Homo sapiens
aagtattattttaca

SEQ ID NO: 185354 - DNA, 15 bp, Homo sapiens
aaagtattattttac

SEQ ID NO: 185355 - DNA, 15 bp, Homo sapiens
gaaagtattatttta

SEQ ID NO: 185356 - DNA, 15 bp, Homo sapiens
tgaaagtattatttt

SEQ ID NO: 185357 - DNA, 15 bp, Homo sapiens
atgaaagtattattt

SEQ ID NO: 185358 - DNA, 15 bp, Homo sapiens
tatgaaagtattatt

SEQ ID NO: 185359 - DNA, 15 bp, Homo sapiens
atatgaaagtattat

SEQ ID NO: 185360 - DNA, 15 bp, Homo sapiens
catatgaaagtatta

SEQ ID NO: 185361 - DNA, 15 bp, Homo sapiens
acatatgaaagtatt

SEQ ID NO: 185362 - DNA, 15 bp, Homo sapiens
tacatatgaaagtat

SEQ ID NO: 185363 - DNA, 15 bp, Homo sapiens
atacatatgaaagta

SEQ ID NO: 185364 - DNA, 15 bp, Homo sapiens
aatacatatgaaagt

SEQ ID NO: 185365 - DNA, 15 bp, Homo sapiens
aaatacatatgaaag

SEQ ID NO: 185366 - DNA, 15 bp, Homo sapiens
aaaatacatatgaaa

SEQ ID NO: 185367 - DNA, 15 bp, Homo sapiens
aaaaatacatatgaa

SEQ ID NO: 185368 - DNA, 15 bp, Homo sapiens
aaaaaatacatatga

SEQ ID NO: 185369 - DNA, 15 bp, Homo sapiens
gaaaaaatacatatg

SEQ ID NO: 185370 - DNA, 15 bp, Homo sapiens
tgaaaaaatacatat

SEQ ID NO: 185371 - DNA, 15 bp, Homo sapiens
atgaaaaaatacata

SEQ ID NO: 185372 - DNA, 15 bp, Homo sapiens
catgaaaaaatacat

SEQ ID NO: 185373 - DNA, 15 bp, Homo sapiens
ccatgaaaaaataca

SEQ ID NO: 185374 - DNA, 15 bp, Homo sapiens
accatgaaaaaatac

SEQ ID NO: 185375 - DNA, 15 bp, Homo sapiens
caccatgaaaaaata

SEQ ID NO: 185376 - DNA, 15 bp, Homo sapiens
acaccatgaaaaaat

SEQ ID NO: 185377 - DNA, 15 bp, Homo sapiens
gacaccatgaaaaaa

SEQ ID NO: 185378 - DNA, 15 bp, Homo sapiens
agacaccatgaaaaa

SEQ ID NO: 185379 - DNA, 15 bp, Homo sapiens
tagacaccatgaaaa

SEQ ID NO: 185380 - DNA, 15 bp, Homo sapiens
ctagacaccatgaaa

SEQ ID NO: 185381 - DNA, 15 bp, Homo sapiens
actagacaccatgaa

SEQ ID NO: 185382 - DNA, 15 bp, Homo sapiens
tactagacaccatga

SEQ ID NO: 185383 - DNA, 15 bp, Homo sapiens
gtactagacaccatg

SEQ ID NO: 185384 - DNA, 15 bp, Homo sapiens
ggtactagacaccat

SEQ ID NO: 185385 - DNA, 15 bp, Homo sapiens
aggtactagacacca

SEQ ID NO: 185386 - DNA, 15 bp, Homo sapiens
caggtactagacacc

SEQ ID NO: 185387 - DNA, 15 bp, Homo sapiens
acaggtactagacac

SEQ ID NO: 185388 - DNA, 15 bp, Homo sapiens
cacaggtactagaca

SEQ ID NO: 185389 - DNA, 15 bp, Homo sapiens
gcacaggtactagac

SEQ ID NO: 185390 - DNA, 15 bp, Homo sapiens
ggcacaggtactaga

SEQ ID NO: 185391 - DNA, 15 bp, Homo sapiens
tggcacaggtactag

SEQ ID NO: 185392 - DNA, 15 bp, Homo sapiens
gtggcacaggtacta

SEQ ID NO: 185393 - DNA, 15 bp, Homo sapiens
tgtggcacaggtact

SEQ ID NO: 185394 - DNA, 15 bp, Homo sapiens
atgtggcacaggtac

SEQ ID NO: 185395 - DNA, 15 bp, Homo sapiens
tatgtggcacaggta

SEQ ID NO: 185396 - DNA, 15 bp, Homo sapiens
ctatgtggcacaggt

SEQ ID NO: 185397 - DNA, 15 bp, Homo sapiens
actatgtggcacagg

SEQ ID NO: 185398 - DNA, 15 bp, Homo sapiens
cactatgtggcacag

SEQ ID NO: 185399 - DNA, 15 bp, Homo sapiens
tcactatgtggcaca

SEQ ID NO: 185400 - DNA, 15 bp, Homo sapiens
ttcactatgtggcac

SEQ ID NO: 185401 - DNA, 15 bp, Homo sapiens
attcactatgtggca

SEQ ID NO: 185402 - DNA, 15 bp, Homo sapiens
cattcactatgtggc

SEQ ID NO: 185403 - DNA, 15 bp, Homo sapiens
gcattcactatgtgg

SEQ ID NO: 185404 - DNA, 15 bp, Homo sapiens
ggcattcactatgtg

SEQ ID NO: 185405 - DNA, 15 bp, Homo sapiens
aggcattcactatgt

SEQ ID NO: 185406 - DNA, 15 bp, Homo sapiens
caggcattcactatg

SEQ ID NO: 185407 - DNA, 15 bp, Homo sapiens
tcaggcattcactat

SEQ ID NO: 185408 - DNA, 15 bp, Homo sapiens
ttcaggcattcacta

SEQ ID NO: 185409 - DNA, 15 bp, Homo sapiens
attcaggcattcact

SEQ ID NO: 185410 - DNA, 15 bp, Homo sapiens
tattcaggcattcac

SEQ ID NO: 185411 - DNA, 15 bp, Homo sapiens
ttattcaggcattca

SEQ ID NO: 185412 - DNA, 15 bp, Homo sapiens
tttattcaggcattc

SEQ ID NO: 185413 - DNA, 15 bp, Homo sapiens
ctttattcaggcatt

SEQ ID NO: 185414 - DNA, 15 bp, Homo sapiens
cctttattcaggcat

SEQ ID NO: 185415 - DNA, 15 bp, Homo sapiens
tcctttattcaggca

SEQ ID NO: 185416 - DNA, 15 bp, Homo sapiens
gtcctttattcaggc

SEQ ID NO: 185417 - DNA, 15 bp, Homo sapiens
ggtcctttattcagg

SEQ ID NO: 185418 - DNA, 15 bp, Homo sapiens
tggtcctttattcag

SEQ ID NO: 185419 - DNA, 15 bp, Homo sapiens
gtggtcctttattca

SEQ ID NO: 185420 - DNA, 15 bp, Homo sapiens
tgtggtcctttattc

SEQ ID NO: 185421 - DNA, 15 bp, Homo sapiens
atgtggtcctttatt

SEQ ID NO: 185422 - DNA, 15 bp, Homo sapiens
catgtggtcctttat

SEQ ID NO: 185423 - DNA, 15 bp, Homo sapiens
acatgtggtccttta

SEQ ID NO: 185424 - DNA, 15 bp, Homo sapiens
tacatgtggtccttt

SEQ ID NO: 185425 - DNA, 15 bp, Homo sapiens
atacatgtggtcctt

SEQ ID NO: 185426 - DNA, 15 bp, Homo sapiens
aatacatgtggtcct

SEQ ID NO: 185427 - DNA, 15 bp, Homo sapiens
taatacatgtggtcc

SEQ ID NO: 185428 - DNA, 15 bp, Homo sapiens
gtaatacatgtggtc

SEQ ID NO: 185429 - DNA, 15 bp, Homo sapiens
tgtaatacatgtggt

SEQ ID NO: 185430 - DNA, 15 bp, Homo sapiens
ctgtaatacatgtgg

SEQ ID NO: 185431 - DNA, 15 bp, Homo sapiens
actgtaatacatgtg

SEQ ID NO: 185432 - DNA, 15 bp, Homo sapiens
aactgtaatacatgt

SEQ ID NO: 185433 - DNA, 15 bp, Homo sapiens
caactgtaatacatg

SEQ ID NO: 185434 - DNA, 15 bp, Homo sapiens
acaactgtaatacat

SEQ ID NO: 185435 - DNA, 15 bp, Homo sapiens
aacaactgtaataca

SEQ ID NO: 185436 - DNA, 15 bp, Homo sapiens
taacaactgtaatac

SEQ ID NO: 185437 - DNA, 15 bp, Homo sapiens
ctaacaactgtaata

SEQ ID NO: 185438 - DNA, 15 bp, Homo sapiens
tctaacaactgtaat

SEQ ID NO: 185439 - DNA, 15 bp, Homo sapiens
atctaacaactgtaa

SEQ ID NO: 185440 - DNA, 15 bp, Homo sapiens
aatctaacaactgta

SEQ ID NO: 185441 - DNA, 15 bp, Homo sapiens
aaatctaacaactgt

SEQ ID NO: 185442 - DNA, 15 bp, Homo sapiens
aaaatctaacaactg

SEQ ID NO: 185443 - DNA, 15 bp, Homo sapiens
gaaaatctaacaact

SEQ ID NO: 185444 - DNA, 15 bp, Homo sapiens
agaaaatctaacaac

SEQ ID NO: 185445 - DNA, 15 bp, Homo sapiens
aagaaaatctaacaa

SEQ ID NO: 185446 - DNA, 15 bp, Homo sapiens
taagaaaatctaaca

SEQ ID NO: 185447 - DNA, 15 bp, Homo sapiens
ctaagaaaatctaac

SEQ ID NO: 185448 - DNA, 15 bp, Homo sapiens
cctaagaaaatctaa

SEQ ID NO: 185449 - DNA, 15 bp, Homo sapiens
ccctaagaaaatcta

SEQ ID NO: 185450 - DNA, 15 bp, Homo sapiens
tccctaagaaaatct

SEQ ID NO: 185451 - DNA, 15 bp, Homo sapiens
gtccctaagaaaatc

SEQ ID NO: 185452 - DNA, 15 bp, Homo sapiens
ggtccctaagaaaat

SEQ ID NO: 185453 - DNA, 15 bp, Homo sapiens
gggtccctaagaaaa

SEQ ID NO: 185454 - DNA, 15 bp, Homo sapiens
agggtccctaagaaa

SEQ ID NO: 185455 - DNA, 15 bp, Homo sapiens
tagggtccctaagaa

SEQ ID NO: 185456 - DNA, 15 bp, Homo sapiens
atagggtccctaaga

SEQ ID NO: 185457 - DNA, 15 bp, Homo sapiens
aatagggtccctaag

SEQ ID NO: 185458 - DNA, 15 bp, Homo sapiens
caatagggtccctaa

SEQ ID NO: 185459 - DNA, 15 bp, Homo sapiens
acaatagggtcccta

SEQ ID NO: 185460 - DNA, 15 bp, Homo sapiens
aacaatagggtccct

SEQ ID NO: 185461 - DNA, 15 bp, Homo sapiens
aaacaatagggtccc

SEQ ID NO: 185462 - DNA, 15 bp, Homo sapiens
taaacaatagggtcc

SEQ ID NO: 185463 - DNA, 15 bp, Homo sapiens
ttaaacaatagggtc

SEQ ID NO: 185464 - DNA, 15 bp, Homo sapiens
tttaaacaatagggt

SEQ ID NO: 185465 - DNA, 15 bp, Homo sapiens
atttaaacaataggg

SEQ ID NO: 185466 - DNA, 15 bp, Homo sapiens
catttaaacaatagg

SEQ ID NO: 185467 - DNA, 15 bp, Homo sapiens
tcatttaaacaatag

SEQ ID NO: 185468 - DNA, 15 bp, Homo sapiens
gtcatttaaacaata

SEQ ID NO: 185469 - DNA, 15 bp, Homo sapiens
agtcatttaaacaat

SEQ ID NO: 185470 - DNA, 15 bp, Homo sapiens
aagtcatttaaacaa

SEQ ID NO: 185471 - DNA, 15 bp, Homo sapiens
taagtcatttaaaca

SEQ ID NO: 185472 - DNA, 15 bp, Homo sapiens
ataagtcatttaaac

SEQ ID NO: 185473 - DNA, 15 bp, Homo sapiens
tataagtcatttaaa

SEQ ID NO: 185474 - DNA, 15 bp, Homo sapiens
ttataagtcatttaa

SEQ ID NO: 185475 - DNA, 15 bp, Homo sapiens
attataagtcattta

SEQ ID NO: 185476 - DNA, 15 bp, Homo sapiens
tattataagtcattt

SEQ ID NO: 185477 - DNA, 15 bp, Homo sapiens
ttattataagtcatt

SEQ ID NO: 185478 - DNA, 15 bp, Homo sapiens
cttattataagtcat

SEQ ID NO: 185479 - DNA, 15 bp, Homo sapiens
gcttattataagtca

SEQ ID NO: 185480 - DNA, 15 bp, Homo sapiens
tgcttattataagtc

SEQ ID NO: 185481 - DNA, 15 bp, Homo sapiens
gtgcttattataagt

SEQ ID NO: 185482 - DNA, 15 bp, Homo sapiens
agtgcttattataag

SEQ ID NO: 185483 - DNA, 15 bp, Homo sapiens
aagtgcttattataa

SEQ ID NO: 185484 - DNA, 15 bp, Homo sapiens
taagtgcttattata

SEQ ID NO: 185485 - DNA, 15 bp, Homo sapiens
gtaagtgcttattat

SEQ ID NO: 185486 - DNA, 15 bp, Homo sapiens
cagtaagtgcttatt

SEQ ID NO: 185487 - DNA, 15 bp, Homo sapiens
acagtaagtgcttat

SEQ ID NO: 185488 - DNA, 15 bp, Homo sapiens
cacagtaagtgctta

SEQ ID NO: 185489 - DNA, 15 bp, Homo sapiens
acacagtaagtgctt

SEQ ID NO: 185490 - DNA, 15 bp, Homo sapiens
cacacagtaagtgct

SEQ ID NO: 185491 - DNA, 15 bp, Homo sapiens
tcacacagtaagtgc

SEQ ID NO: 185492 - DNA, 15 bp, Homo sapiens
atcacacagtaagtg

SEQ ID NO: 185493 - DNA, 15 bp, Homo sapiens
catcacacagtaagt

SEQ ID NO: 185494 - DNA, 15 bp, Homo sapiens
ccatcacacagtaag

SEQ ID NO: 185495 - DNA, 15 bp, Homo sapiens
accatcacacagtaa

SEQ ID NO: 185496 - DNA, 15 bp, Homo sapiens
taccatcacacagta

SEQ ID NO: 185497 - DNA, 15 bp, Homo sapiens
ttaccatcacacagt

SEQ ID NO: 185498 - DNA, 15 bp, Homo sapiens
tttaccatcacacag

SEQ ID NO: 185499 - DNA, 15 bp, Homo sapiens
gtttaccatcacaca

SEQ ID NO: 185500 - DNA, 15 bp, Homo sapiens
tgtttaccatcacac

SEQ ID NO: 185501 - DNA, 15 bp, Homo sapiens
gtgtttaccatcaca

SEQ ID NO: 185502 - DNA, 15 bp, Homo sapiens
agtgtttaccatcac

SEQ ID NO: 185503 - DNA, 15 bp, Homo sapiens
tagtgtttaccatca

SEQ ID NO: 185504 - DNA, 15 bp, Homo sapiens
atagtgtttaccatc

SEQ ID NO: 185505 - DNA, 15 bp, Homo sapiens
catagtgtttaccat

SEQ ID NO: 185506 - DNA, 15 bp, Homo sapiens
gcatagtgtttacca

SEQ ID NO: 185507 - DNA, 15 bp, Homo sapiens
agcatagtgtttacc

SEQ ID NO: 185508 - DNA, 15 bp, Homo sapiens
tagcatagtgtttac

SEQ ID NO: 185509 - DNA, 15 bp, Homo sapiens
atagcatagtgttta

SEQ ID NO: 185510 - DNA, 15 bp, Homo sapiens
aatagcatagtgttt

SEQ ID NO: 185511 - DNA, 15 bp, Homo sapiens
aaatagcatagtgtt

SEQ ID NO: 185512 - DNA, 15 bp, Homo sapiens
taaatagcatagtgt

SEQ ID NO: 185513 - DNA, 15 bp, Homo sapiens
ataaatagcatagtg

SEQ ID NO: 185514 - DNA, 15 bp, Homo sapiens
cataaatagcatagt

SEQ ID NO: 185515 - DNA, 15 bp, Homo sapiens
acataaatagcatag

SEQ ID NO: 185516 - DNA, 15 bp, Homo sapiens
gacataaatagcata

SEQ ID NO: 185517 - DNA, 15 bp, Homo sapiens
tgacataaatagcat

SEQ ID NO: 185518 - DNA, 15 bp, Homo sapiens
gtgacataaatagca

SEQ ID NO: 185519 - DNA, 15 bp, Homo sapiens
ggtgacataaatagc

SEQ ID NO: 185520 - DNA, 15 bp, Homo sapiens
aggtgacataaatag

SEQ ID NO: 185521 - DNA, 15 bp, Homo sapiens
taggtgacataaata

SEQ ID NO: 185522 - DNA, 15 bp, Homo sapiens
ataggtgacataaat

SEQ ID NO: 185523 - DNA, 15 bp, Homo sapiens
tataggtgacataaa

SEQ ID NO: 185524 - DNA, 15 bp, Homo sapiens
gtataggtgacataa

SEQ ID NO: 185525 - DNA, 15 bp, Homo sapiens
agtataggtgacata

SEQ ID NO: 185526 - DNA, 15 bp, Homo sapiens
aagtataggtgacat

SEQ ID NO: 185527 - DNA, 15 bp, Homo sapiens
gaagtataggtgaca

SEQ ID NO: 185528 - DNA, 15 bp, Homo sapiens
agaagtataggtgac

SEQ ID NO: 185529 - DNA, 15 bp, Homo sapiens
aagaagtataggtga

SEQ ID NO: 185530 - DNA, 15 bp, Homo sapiens
taagaagtataggtg

SEQ ID NO: 185531 - DNA, 15 bp, Homo sapiens
gtaagaagtataggt

SEQ ID NO: 185532 - DNA, 15 bp, Homo sapiens
agtaagaagtatagg

SEQ ID NO: 185533 - DNA, 15 bp, Homo sapiens
aagtaagaagtatag

SEQ ID NO: 185534 - DNA, 15 bp, Homo sapiens
taagtaagaagtata

SEQ ID NO: 185535 - DNA, 15 bp, Homo sapiens
ttaagtaagaagtat

SEQ ID NO: 185536 - DNA, 15 bp, Homo sapiens
gttaagtaagaagta

SEQ ID NO: 185537 - DNA, 15 bp, Homo sapiens
tgttaagtaagaagt

SEQ ID NO: 185538 - DNA, 15 bp, Homo sapiens
atgttaagtaagaag

SEQ ID NO: 185539 - DNA, 15 bp, Homo sapiens
aatgttaagtaagaa

SEQ ID NO: 185540 - DNA, 15 bp, Homo sapiens
taatgttaagtaaga

SEQ ID NO: 185541 - DNA, 15 bp, Homo sapiens
ttaatgttaagtaag

SEQ ID NO: 185542 - DNA, 15 bp, Homo sapiens
gttaatgttaagtaa

SEQ ID NO: 185543 - DNA, 15 bp, Homo sapiens
tgttaatgttaagta

SEQ ID NO: 185544 - DNA, 15 bp, Homo sapiens
gtgttaatgttaagt

SEQ ID NO: 185545 - DNA, 15 bp, Homo sapiens
tgtgttaatgttaag

SEQ ID NO: 185546 - DNA, 15 bp, Homo sapiens
ttgtgttaatgttaa

SEQ ID NO: 185547 - DNA, 15 bp, Homo sapiens
gttgtgttaatgtta

SEQ ID NO: 185548 - DNA, 15 bp, Homo sapiens
agttgtgttaatgtt

SEQ ID NO: 185549 - DNA, 15 bp, Homo sapiens
gagttgtgttaatgt

SEQ ID NO: 185550 - DNA, 15 bp, Homo sapiens
agagttgtgttaatg

SEQ ID NO: 185551 - DNA, 15 bp, Homo sapiens
tagagttgtgttaat

SEQ ID NO: 185552 - DNA, 15 bp, Homo sapiens
gtagagttgtgttaa

SEQ ID NO: 185553 - DNA, 15 bp, Homo sapiens
tgtagagttgtgtta

SEQ ID NO: 185554 - DNA, 15 bp, Homo sapiens
gtgtagagttgtgtt

SEQ ID NO: 185555 - DNA, 15 bp, Homo sapiens
tgtgtagagttgtgt

SEQ ID NO: 185556 - DNA, 15 bp, Homo sapiens
ctgtgtagagttgtg

SEQ ID NO: 185557 - DNA, 15 bp, Homo sapiens
actgtgtagagttgt

SEQ ID NO: 185558 - DNA, 15 bp, Homo sapiens
aactgtgtagagttg

SEQ ID NO: 185559 - DNA, 15 bp, Homo sapiens
aaactgtgtagagtt

SEQ ID NO: 185560 - DNA, 15 bp, Homo sapiens
caaactgtgtagagt

SEQ ID NO: 185561 - DNA, 15 bp, Homo sapiens
ccaaactgtgtagag

SEQ ID NO: 185562 - DNA, 15 bp, Homo sapiens
tccaaactgtgtaga

SEQ ID NO: 185563 - DNA, 15 bp, Homo sapiens
ttccaaactgtgtag

SEQ ID NO: 185564 - DNA, 15 bp, Homo sapiens
attccaaactgtgta

SEQ ID NO: 185565 - DNA, 15 bp, Homo sapiens
tattccaaactgtgt

SEQ ID NO: 185566 - DNA, 15 bp, Homo sapiens
atattccaaactgtg

SEQ ID NO: 185567 - DNA, 15 bp, Homo sapiens
aatattccaaactgt

SEQ ID NO: 185568 - DNA, 15 bp, Homo sapiens
caatattccaaactg

SEQ ID NO: 185569 - DNA, 15 bp, Homo sapiens
acaatattccaaact

SEQ ID NO: 185570 - DNA, 15 bp, Homo sapiens
aacaatattccaaac

SEQ ID NO: 185571 - DNA, 15 bp, Homo sapiens
caacaatattccaaa

SEQ ID NO: 185572 - DNA, 15 bp, Homo sapiens
tcaacaatattccaa

SEQ ID NO: 185573 - DNA, 15 bp, Homo sapiens
ttcaacaatattcca

SEQ ID NO: 185574 - DNA, 15 bp, Homo sapiens
tttcaacaatattcc

SEQ ID NO: 185575 - DNA, 15 bp, Homo sapiens
atttcaacaatattc

SEQ ID NO: 185576 - DNA, 15 bp, Homo sapiens
tatttcaacaatatt

SEQ ID NO: 185577 - DNA, 15 bp, Homo sapiens
ttatttcaacaatat

SEQ ID NO: 185578 - DNA, 15 bp, Homo sapiens
attatttcaacaata

SEQ ID NO: 185579 - DNA, 15 bp, Homo sapiens
gattatttcaacaat

SEQ ID NO: 185580 - DNA, 15 bp, Homo sapiens
tgattatttcaacaa

SEQ ID NO: 185581 - DNA, 15 bp, Homo sapiens
gtgattatttcaaca

SEQ ID NO: 185582 - DNA, 15 bp, Homo sapiens
agtgattatttcaac

SEQ ID NO: 185583 - DNA, 15 bp, Homo sapiens
aagtgattatttcaa

SEQ ID NO: 185584 - DNA, 15 bp, Homo sapiens
aaagtgattatttca

SEQ ID NO: 185585 - DNA, 15 bp, Homo sapiens
taaagtgattatttc

SEQ ID NO: 185586 - DNA, 15 bp, Homo sapiens
ataaagtgattattt

SEQ ID NO: 185587 - DNA, 15 bp, Homo sapiens
tataaagtgattatt

SEQ ID NO: 185588 - DNA, 15 bp, Homo sapiens
ctataaagtgattat

SEQ ID NO: 185589 - DNA, 15 bp, Homo sapiens
gctataaagtgatta

SEQ ID NO: 185590 - DNA, 15 bp, Homo sapiens
agctataaagtgatt

SEQ ID NO: 185591 - DNA, 15 bp, Homo sapiens
cagctataaagtgat

SEQ ID NO: 185592 - DNA, 15 bp, Homo sapiens
tcagctataaagtga

SEQ ID NO: 185593 - DNA, 15 bp, Homo sapiens
ctcagctataaagtg

SEQ ID NO: 185594 - DNA, 15 bp, Homo sapiens
tctcagctataaagt

SEQ ID NO: 185595 - DNA, 15 bp, Homo sapiens
ctctcagctataaag

SEQ ID NO: 185596 - DNA, 15 bp, Homo sapiens
actctcagctataaa

SEQ ID NO: 185597 - DNA, 15 bp, Homo sapiens
tactctcagctataa

SEQ ID NO: 185598 - DNA, 15 bp, Homo sapiens
ctactctcagctata

SEQ ID NO: 185599 - DNA, 15 bp, Homo sapiens
tctactctcagctat

SEQ ID NO: 185600 - DNA, 15 bp, Homo sapiens
ctctactctcagcta

SEQ ID NO: 185601 - DNA, 15 bp, Homo sapiens
gctctactctcagct

SEQ ID NO: 185602 - DNA, 15 bp, Homo sapiens
tgctctactctcagc

SEQ ID NO: 185603 - DNA, 15 bp, Homo sapiens
atgctctactctcag

SEQ ID NO: 185604 - DNA, 15 bp, Homo sapiens
catgctctactctca

SEQ ID NO: 185605 - DNA, 15 bp, Homo sapiens
acatgctctactctc

SEQ ID NO: 185606 - DNA, 15 bp, Homo sapiens
tacatgctctactct

SEQ ID NO: 185607 - DNA, 15 bp, Homo sapiens
atacatgctctactc

SEQ ID NO: 185608 - DNA, 15 bp, Homo sapiens
catacatgctctact

SEQ ID NO: 185609 - DNA, 15 bp, Homo sapiens
ccatacatgctctac

SEQ ID NO: 185610 - DNA, 15 bp, Homo sapiens
cccatacatgctcta

SEQ ID NO: 185611 - DNA, 15 bp, Homo sapiens
acccatacatgctct

SEQ ID NO: 185612 - DNA, 15 bp, Homo sapiens
aacccatacatgctc

SEQ ID NO: 185613 - DNA, 15 bp, Homo sapiens
taacccatacatgct

SEQ ID NO: 185614 - DNA, 15 bp, Homo sapiens
ttaacccatacatgc

SEQ ID NO: 185615 - DNA, 15 bp, Homo sapiens
tttaacccatacatg

SEQ ID NO: 185616 - DNA, 15 bp, Homo sapiens
gtttaacccatacat

SEQ ID NO: 185617 - DNA, 15 bp, Homo sapiens
agtttaacccataca

SEQ ID NO: 185618 - DNA, 15 bp, Homo sapiens
gagtttaacccatac

SEQ ID NO: 185619 - DNA, 15 bp, Homo sapiens
agagtttaacccata

SEQ ID NO: 185620 - DNA, 15 bp, Homo sapiens
aagagtttaacccat

SEQ ID NO: 185621 - DNA, 15 bp, Homo sapiens
caagagtttaaccca

SEQ ID NO: 185622 - DNA, 15 bp, Homo sapiens
gcaagagtttaaccc

SEQ ID NO: 185623 - DNA, 15 bp, Homo sapiens
ggcaagagtttaacc

SEQ ID NO: 185624 - DNA, 15 bp, Homo sapiens
gggcaagagtttaac

SEQ ID NO: 185625 - DNA, 15 bp, Homo sapiens
tgggcaagagtttaa

SEQ ID NO: 185626 - DNA, 15 bp, Homo sapiens
ttgggcaagagttta

SEQ ID NO: 185627 - DNA, 15 bp, Homo sapiens
cttgggcaagagttt

SEQ ID NO: 185628 - DNA, 15 bp, Homo sapiens
ccttgggcaagagtt

SEQ ID NO: 185629 - DNA, 15 bp, Homo sapiens
accttgggcaagagt

SEQ ID NO: 185630 - DNA, 15 bp, Homo sapiens
gaccttgggcaagag

SEQ ID NO: 185631 - DNA, 15 bp, Homo sapiens
tgaccttgggcaaga

SEQ ID NO: 185632 - DNA, 15 bp, Homo sapiens
ctgaccttgggcaag

SEQ ID NO: 185633 - DNA, 15 bp, Homo sapiens
tctgaccttgggcaa

SEQ ID NO: 185634 - DNA, 15 bp, Homo sapiens
gtctgaccttgggca

SEQ ID NO: 185635 - DNA, 15 bp, Homo sapiens
tgtctgaccttgggc

SEQ ID NO: 185636 - DNA, 15 bp, Homo sapiens
ctgtctgaccttggg

SEQ ID NO: 185637 - DNA, 15 bp, Homo sapiens
actgtctgaccttgg

SEQ ID NO: 185638 - DNA, 15 bp, Homo sapiens
cactgtctgaccttg

SEQ ID NO: 185639 - DNA, 15 bp, Homo sapiens
tcactgtctgacctt

SEQ ID NO: 185640 - DNA, 15 bp, Homo sapiens
ctcactgtctgacct

SEQ ID NO: 185641 - DNA, 15 bp, Homo sapiens
actcactgtctgacc

SEQ ID NO: 185642 - DNA, 15 bp, Homo sapiens
aactcactgtctgac

SEQ ID NO: 185643 - DNA, 15 bp, Homo sapiens
caactcactgtctga

SEQ ID NO: 185644 - DNA, 15 bp, Homo sapiens
tcaactcactgtctg

SEQ ID NO: 185645 - DNA, 15 bp, Homo sapiens
gtcaactcactgtct

SEQ ID NO: 185646 - DNA, 15 bp, Homo sapiens
agtcaactcactgtc

SEQ ID NO: 185647 - DNA, 15 bp, Homo sapiens
aagtcaactcactgt

SEQ ID NO: 185648 - DNA, 15 bp, Homo sapiens
caagtcaactcactg

SEQ ID NO: 185649 - DNA, 15 bp, Homo sapiens
acaagtcaactcact

SEQ ID NO: 185650 - DNA, 15 bp, Homo sapiens
cacaagtcaactcac

SEQ ID NO: 185651 - DNA, 15 bp, Homo sapiens
acacaagtcaactca

SEQ ID NO: 185652 - DNA, 15 bp, Homo sapiens
gacacaagtcaactc

SEQ ID NO: 185653 - DNA, 15 bp, Homo sapiens
agacacaagtcaact

SEQ ID NO: 185654 - DNA, 15 bp, Homo sapiens
aagacacaagtcaac

SEQ ID NO: 185655 - DNA, 15 bp, Homo sapiens
gaagacacaagtcaa

SEQ ID NO: 185656 - DNA, 15 bp, Homo sapiens
ggaagacacaagtca

SEQ ID NO: 185657 - DNA, 15 bp, Homo sapiens
gggaagacacaagtc

SEQ ID NO: 185658 - DNA, 15 bp, Homo sapiens
tgggaagacacaagt

SEQ ID NO: 185659 - DNA, 15 bp, Homo sapiens
atgggaagacacaag

SEQ ID NO: 185660 - DNA, 15 bp, Homo sapiens
catgggaagacacaa

SEQ ID NO: 185661 - DNA, 15 bp, Homo sapiens
acatgggaagacaca

SEQ ID NO: 185662 - DNA, 15 bp, Homo sapiens
aacatgggaagacac

SEQ ID NO: 185663 - DNA, 15 bp, Homo sapiens
caacatgggaagaca

SEQ ID NO: 185664 - DNA, 15 bp, Homo sapiens
acaacatgggaagac

SEQ ID NO: 185665 - DNA, 15 bp, Homo sapiens
gacaacatgggaaga

SEQ ID NO: 185666 - DNA, 15 bp, Homo sapiens
tgacaacatgggaag

SEQ ID NO: 185667 - DNA, 15 bp, Homo sapiens
gtgacaacatgggaa

SEQ ID NO: 185668 - DNA, 15 bp, Homo sapiens
agtgacaacatggga

SEQ ID NO: 185669 - DNA, 15 bp, Homo sapiens
cagtgacaacatggg

SEQ ID NO: 185670 - DNA, 15 bp, Homo sapiens
tcagtgacaacatgg

SEQ ID NO: 185671 - DNA, 15 bp, Homo sapiens
atcagtgacaacatg

SEQ ID NO: 185672 - DNA, 15 bp, Homo sapiens
catcagtgacaacat

SEQ ID NO: 185673 - DNA, 15 bp, Homo sapiens
cgcatcagtgacaac

SEQ ID NO: 185674 - DNA, 15 bp, Homo sapiens
acgcatcagtgacaa

SEQ ID NO: 185675 - DNA, 15 bp, Homo sapiens
gacgcatcagtgaca

SEQ ID NO: 185676 - DNA, 15 bp, Homo sapiens
agacgcatcagtgac

SEQ ID NO: 185677 - DNA, 15 bp, Homo sapiens
aagacgcatcagtga

SEQ ID NO: 185678 - DNA, 15 bp, Homo sapiens
gaagacgcatcagtg

SEQ ID NO: 185679 - DNA, 15 bp, Homo sapiens
agaagacgcatcagt

SEQ ID NO: 185680 - DNA, 15 bp, Homo sapiens
gagaagacgcatcag

SEQ ID NO: 185681 - DNA, 15 bp, Homo sapiens
ggagaagacgcatca

SEQ ID NO: 185682 - DNA, 15 bp, Homo sapiens
aggagaagacgcatc

SEQ ID NO: 185683 - DNA, 15 bp, Homo sapiens
aaggagaagacgcat

SEQ ID NO: 185684 - DNA, 15 bp, Homo sapiens
aaaggagaagacgca

SEQ ID NO: 185685 - DNA, 15 bp, Homo sapiens
caaaggagaagacgc

SEQ ID NO: 185686 - DNA, 15 bp, Homo sapiens
gcaaaggagaagacg

SEQ ID NO: 185687 - DNA, 15 bp, Homo sapiens
agcaaaggagaagac

SEQ ID NO: 185688 - DNA, 15 bp, Homo sapiens
cagcaaaggagaaga

SEQ ID NO: 185689 - DNA, 15 bp, Homo sapiens
ccagcaaaggagaag

SEQ ID NO: 185690 - DNA, 15 bp, Homo sapiens
gccagcaaaggagaa

SEQ ID NO: 185691 - DNA, 15 bp, Homo sapiens
agccagcaaaggaga

SEQ ID NO: 185692 - DNA, 15 bp, Homo sapiens
gagccagcaaaggag

SEQ ID NO: 185693 - DNA, 15 bp, Homo sapiens
agagccagcaaagga

SEQ ID NO: 185694 - DNA, 15 bp, Homo sapiens
aagagccagcaaagg

SEQ ID NO: 185695 - DNA, 15 bp, Homo sapiens
caagagccagcaaag

SEQ ID NO: 185696 - DNA, 15 bp, Homo sapiens
acaagagccagcaaa

SEQ ID NO: 185697 - DNA, 15 bp, Homo sapiens
aacaagagccagcaa

SEQ ID NO: 185698 - DNA, 15 bp, Homo sapiens
gaacaagagccagca

SEQ ID NO: 185699 - DNA, 15 bp, Homo sapiens
ggaacaagagccagc

SEQ ID NO: 185700 - DNA, 15 bp, Homo sapiens
gggaacaagagccag

SEQ ID NO: 185701 - DNA, 15 bp, Homo sapiens
agggaacaagagcca

SEQ ID NO: 185702 - DNA, 15 bp, Homo sapiens
aagggaacaagagcc

SEQ ID NO: 185703 - DNA, 15 bp, Homo sapiens
aaagggaacaagagc

SEQ ID NO: 185704 - DNA, 15 bp, Homo sapiens
taaagggaacaagag

SEQ ID NO: 185705 - DNA, 15 bp, Homo sapiens
ataaagggaacaaga

SEQ ID NO: 185706 - DNA, 15 bp, Homo sapiens
aataaagggaacaag

SEQ ID NO: 185707 - DNA, 15 bp, Homo sapiens
gaataaagggaacaa

SEQ ID NO: 185708 - DNA, 15 bp, Homo sapiens
ggaataaagggaaca

SEQ ID NO: 185709 - DNA, 15 bp, Homo sapiens
aggaataaagggaac

SEQ ID NO: 185710 - DNA, 15 bp, Homo sapiens
aaggaataaagggaa

SEQ ID NO: 185711 - DNA, 15 bp, Homo sapiens
gaaggaataaaggga

SEQ ID NO: 185712 - DNA, 15 bp, Homo sapiens
tgaaggaataaaggg

SEQ ID NO: 185713 - DNA, 15 bp, Homo sapiens
ctgaaggaataaagg

SEQ ID NO: 185714 - DNA, 15 bp, Homo sapiens
actgaaggaataaag

SEQ ID NO: 185715 - DNA, 15 bp, Homo sapiens
tactgaaggaataaa

SEQ ID NO: 185716 - DNA, 15 bp, Homo sapiens
ttactgaaggaataa

SEQ ID NO: 185717 - DNA, 15 bp, Homo sapiens
attactgaaggaata

SEQ ID NO: 185718 - DNA, 15 bp, Homo sapiens
tattactgaaggaat

SEQ ID NO: 185719 - DNA, 15 bp, Homo sapiens
atattactgaaggaa

SEQ ID NO: 185720 - DNA, 15 bp, Homo sapiens
tatattactgaagga

SEQ ID NO: 185721 - DNA, 15 bp, Homo sapiens
ctatattactgaagg

SEQ ID NO: 185722 - DNA, 15 bp, Homo sapiens
tctatattactgaag

SEQ ID NO: 185723 - DNA, 15 bp, Homo sapiens
ctctatattactgaa

SEQ ID NO: 185724 - DNA, 15 bp, Homo sapiens
tctctatattactga

SEQ ID NO: 185725 - DNA, 15 bp, Homo sapiens
ttctctatattactg

SEQ ID NO: 185726 - DNA, 15 bp, Homo sapiens
tttctctatattact

SEQ ID NO: 185727 - DNA, 15 bp, Homo sapiens
gtttctctatattac

SEQ ID NO: 185728 - DNA, 15 bp, Homo sapiens
agtttctctatatta

SEQ ID NO: 185729 - DNA, 15 bp, Homo sapiens
tagtttctctatatt

SEQ ID NO: 185730 - DNA, 15 bp, Homo sapiens
gtagtttctctatat

SEQ ID NO: 185731 - DNA, 15 bp, Homo sapiens
tgtagtttctctata

SEQ ID NO: 185732 - DNA, 15 bp, Homo sapiens
ctgtagtttctctat

SEQ ID NO: 185733 - DNA, 15 bp, Homo sapiens
gctgtagtttctcta

SEQ ID NO: 185734 - DNA, 15 bp, Homo sapiens
ggctgtagtttctct

SEQ ID NO: 185735 - DNA, 15 bp, Homo sapiens
aggctgtagtttctc

SEQ ID NO: 185736 - DNA, 15 bp, Homo sapiens
aaggctgtagtttct

SEQ ID NO: 185737 - DNA, 15 bp, Homo sapiens
aaaggctgtagtttc

SEQ ID NO: 185738 - DNA, 15 bp, Homo sapiens
gaaaggctgtagttt

SEQ ID NO: 185739 - DNA, 15 bp, Homo sapiens
tgaaaggctgtagtt

SEQ ID NO: 185740 - DNA, 15 bp, Homo sapiens
atgaaaggctgtagt

SEQ ID NO: 185741 - DNA, 15 bp, Homo sapiens
aatgaaaggctgtag

SEQ ID NO: 185742 - DNA, 15 bp, Homo sapiens
gaatgaaaggctgta

SEQ ID NO: 185743 - DNA, 15 bp, Homo sapiens
ggaatgaaaggctgt

SEQ ID NO: 185744 - DNA, 15 bp, Homo sapiens
gggaatgaaaggctg

SEQ ID NO: 185745 - DNA, 15 bp, Homo sapiens
tgggaatgaaaggct

SEQ ID NO: 185746 - DNA, 15 bp, Homo sapiens
ttgggaatgaaaggc

SEQ ID NO: 185747 - DNA, 15 bp, Homo sapiens
attgggaatgaaagg

SEQ ID NO: 185748 - DNA, 15 bp, Homo sapiens
tattgggaatgaaag

SEQ ID NO: 185749 - DNA, 15 bp, Homo sapiens
ctattgggaatgaaa

SEQ ID NO: 185750 - DNA, 15 bp, Homo sapiens
tctattgggaatgaa

SEQ ID NO: 185751 - DNA, 15 bp, Homo sapiens
ctctattgggaatga

SEQ ID NO: 185752 - DNA, 15 bp, Homo sapiens
actctattgggaatg

SEQ ID NO: 185753 - DNA, 15 bp, Homo sapiens
cactctattgggaat

SEQ ID NO: 185754 - DNA, 15 bp, Homo sapiens
tcactctattgggaa

SEQ ID NO: 185755 - DNA, 15 bp, Homo sapiens
ttcactctattggga

SEQ ID NO: 185756 - DNA, 15 bp, Homo sapiens
tttcactctattggg

SEQ ID NO: 185757 - DNA, 15 bp, Homo sapiens
ttttcactctattgg

SEQ ID NO: 185758 - DNA, 15 bp, Homo sapiens
attttcactctattg

SEQ ID NO: 185759 - DNA, 15 bp, Homo sapiens
tattttcactctatt

SEQ ID NO: 185760 - DNA, 15 bp, Homo sapiens
gtattttcactctat

SEQ ID NO: 185761 - DNA, 15 bp, Homo sapiens
tgtattttcactcta

SEQ ID NO: 185762 - DNA, 15 bp, Homo sapiens
gtgtattttcactct

SEQ ID NO: 185763 - DNA, 15 bp, Homo sapiens
ggtgtattttcactc

SEQ ID NO: 185764 - DNA, 15 bp, Homo sapiens
tggtgtattttcact

SEQ ID NO: 185765 - DNA, 15 bp, Homo sapiens
gtggtgtattttcac

SEQ ID NO: 185766 - DNA, 15 bp, Homo sapiens
agtggtgtattttca

SEQ ID NO: 185767 - DNA, 15 bp, Homo sapiens
gagtggtgtattttc

SEQ ID NO: 185768 - DNA, 15 bp, Homo sapiens
tgagtggtgtatttt

SEQ ID NO: 185769 - DNA, 15 bp, Homo sapiens
atgagtggtgtattt

SEQ ID NO: 185770 - DNA, 15 bp, Homo sapiens
aatgagtggtgtatt

SEQ ID NO: 185771 - DNA, 15 bp, Homo sapiens
gaatgagtggtgtat

SEQ ID NO: 185772 - DNA, 15 bp, Homo sapiens
tgaatgagtggtgta

SEQ ID NO: 185773 - DNA, 15 bp, Homo sapiens
atgaatgagtggtgt

SEQ ID NO: 185774 - DNA, 15 bp, Homo sapiens
aatgaatgagtggtg

SEQ ID NO: 185775 - DNA, 15 bp, Homo sapiens
taatgaatgagtggt

SEQ ID NO: 185776 - DNA, 15 bp, Homo sapiens
ataatgaatgagtgg

SEQ ID NO: 185777 - DNA, 15 bp, Homo sapiens
aataatgaatgagtg

SEQ ID NO: 185778 - DNA, 15 bp, Homo sapiens
aaataatgaatgagt

SEQ ID NO: 185779 - DNA, 15 bp, Homo sapiens
aaaataatgaatgag

SEQ ID NO: 185780 - DNA, 15 bp, Homo sapiens
aaaaataatgaatga

SEQ ID NO: 185781 - DNA, 15 bp, Homo sapiens
gaaaaataatgaatg

SEQ ID NO: 185782 - DNA, 15 bp, Homo sapiens
tgaaaaataatgaat

SEQ ID NO: 185783 - DNA, 15 bp, Homo sapiens
ttgaaaaataatgaa

SEQ ID NO: 185784 - DNA, 15 bp, Homo sapiens
attgaaaaataatga

SEQ ID NO: 185785 - DNA, 15 bp, Homo sapiens
aattgaaaaataatg

SEQ ID NO: 185786 - DNA, 15 bp, Homo sapiens
taattgaaaaataat

SEQ ID NO: 185787 - DNA, 15 bp, Homo sapiens
ataattgaaaaataa

SEQ ID NO: 185788 - DNA, 15 bp, Homo sapiens
tataattgaaaaata

SEQ ID NO: 185789 - DNA, 15 bp, Homo sapiens
ctataattgaaaaat

SEQ ID NO: 185790 - DNA, 15 bp, Homo sapiens
actataattgaaaaa

SEQ ID NO: 185791 - DNA, 15 bp, Homo sapiens
cactataattgaaaa

SEQ ID NO: 185792 - DNA, 15 bp, Homo sapiens
gcactataattgaaa

SEQ ID NO: 185793 - DNA, 15 bp, Homo sapiens
tgcactataattgaa

SEQ ID NO: 185794 - DNA, 15 bp, Homo sapiens
ttgcactataattga

SEQ ID NO: 185795 - DNA, 15 bp, Homo sapiens
cttgcactataattg

SEQ ID NO: 185796 - DNA, 15 bp, Homo sapiens
ccttgcactataatt

SEQ ID NO: 185797 - DNA, 15 bp, Homo sapiens
tccttgcactataat

SEQ ID NO: 185798 - DNA, 15 bp, Homo sapiens
gtccttgcactataa

SEQ ID NO: 185799 - DNA, 15 bp, Homo sapiens
cgtccttgcactata

SEQ ID NO: 185800 - DNA, 15 bp, Homo sapiens
tcgtccttgcactat

SEQ ID NO: 185801 - DNA, 15 bp, Homo sapiens
ctcgtccttgcacta

SEQ ID NO: 185802 - DNA, 15 bp, Homo sapiens
gctcgtccttgcact

SEQ ID NO: 185803 - DNA, 15 bp, Homo sapiens
tgctcgtccttgcac

SEQ ID NO: 185804 - DNA, 15 bp, Homo sapiens
ctgctcgtccttgca

SEQ ID NO: 185805 - DNA, 15 bp, Homo sapiens
actgctcgtccttgc

SEQ ID NO: 185806 - DNA, 15 bp, Homo sapiens
aactgctcgtccttg

SEQ ID NO: 185807 - DNA, 15 bp, Homo sapiens
aaactgctcgtcctt

SEQ ID NO: 185808 - DNA, 15 bp, Homo sapiens
taaactgctcgtcct

SEQ ID NO: 185809 - DNA, 15 bp, Homo sapiens
gtaaactgctcgtcc

SEQ ID NO: 185810 - DNA, 15 bp, Homo sapiens
ggtaaactgctcgtc

SEQ ID NO: 185811 - DNA, 15 bp, Homo sapiens
gggtaaactgctcgt

SEQ ID NO: 185812 - DNA, 15 bp, Homo sapiens
agggtaaactgctcg

SEQ ID NO: 185813 - DNA, 15 bp, Homo sapiens
tagggtaaactgctc

SEQ ID NO: 185814 - DNA, 15 bp, Homo sapiens
ttagggtaaactgct

SEQ ID NO: 185815 - DNA, 15 bp, Homo sapiens
attagggtaaactgc

SEQ ID NO: 185816 - DNA, 15 bp, Homo sapiens
tattagggtaaactg

SEQ ID NO: 185817 - DNA, 15 bp, Homo sapiens
atattagggtaaact

SEQ ID NO: 185818 - DNA, 15 bp, Homo sapiens
gatattagggtaaac

SEQ ID NO: 185819 - DNA, 15 bp, Homo sapiens
ggatattagggtaaa

SEQ ID NO: 185820 - DNA, 15 bp, Homo sapiens
tggatattagggtaa

SEQ ID NO: 185821 - DNA, 15 bp, Homo sapiens
atggatattagggta

SEQ ID NO: 185822 - DNA, 15 bp, Homo sapiens
aatggatattagggt

SEQ ID NO: 185823 - DNA, 15 bp, Homo sapiens
aaatggatattaggg

SEQ ID NO: 185824 - DNA, 15 bp, Homo sapiens
gaaatggatattagg

SEQ ID NO: 185825 - DNA, 15 bp, Homo sapiens
agaaatggatattag

SEQ ID NO: 185826 - DNA, 15 bp, Homo sapiens
aagaaatggatatta

SEQ ID NO: 185827 - DNA, 15 bp, Homo sapiens
caagaaatggatatt

SEQ ID NO: 185828 - DNA, 15 bp, Homo sapiens
acaagaaatggatat

SEQ ID NO: 185829 - DNA, 15 bp, Homo sapiens
aacaagaaatggata

SEQ ID NO: 185830 - DNA, 15 bp, Homo sapiens
aaacaagaaatggat

SEQ ID NO: 185831 - DNA, 15 bp, Homo sapiens
caaacaagaaatgga

SEQ ID NO: 185832 - DNA, 15 bp, Homo sapiens
ccaaacaagaaatgg

SEQ ID NO: 185833 - DNA, 15 bp, Homo sapiens
accaaacaagaaatg

SEQ ID NO: 185834 - DNA, 15 bp, Homo sapiens
aaccaaacaagaaat

SEQ ID NO: 185835 - DNA, 15 bp, Homo sapiens
caaccaaacaagaaa

SEQ ID NO: 185836 - DNA, 15 bp, Homo sapiens
ccaaccaaacaagaa

SEQ ID NO: 185837 - DNA, 15 bp, Homo sapiens
cccaaccaaacaaga

SEQ ID NO: 185838 - DNA, 15 bp, Homo sapiens
tcccaaccaaacaag

SEQ ID NO: 185839 - DNA, 15 bp, Homo sapiens
ttcccaaccaaacaa

SEQ ID NO: 185840 - DNA, 15 bp, Homo sapiens
tttcccaaccaaaca

SEQ ID NO: 185841 - DNA, 15 bp, Homo sapiens
atttcccaaccaaac

SEQ ID NO: 185842 - DNA, 15 bp, Homo sapiens
aatttcccaaccaaa

SEQ ID NO: 185843 - DNA, 15 bp, Homo sapiens
gaatttcccaaccaa

SEQ ID NO: 185844 - DNA, 15 bp, Homo sapiens
tgaatttcccaacca

SEQ ID NO: 185845 - DNA, 15 bp, Homo sapiens
gtgaatttcccaacc

SEQ ID NO: 185846 - DNA, 15 bp, Homo sapiens
ggtgaatttcccaac

SEQ ID NO: 185847 - DNA, 15 bp, Homo sapiens
tggtgaatttcccaa

SEQ ID NO: 185848 - DNA, 15 bp, Homo sapiens
ttggtgaatttccca

SEQ ID NO: 185849 - DNA, 15 bp, Homo sapiens
gttggtgaatttccc

SEQ ID NO: 185850 - DNA, 15 bp, Homo sapiens
tgttggtgaatttcc

SEQ ID NO: 185851 - DNA, 15 bp, Homo sapiens
ctgttggtgaatttc

SEQ ID NO: 185852 - DNA, 15 bp, Homo sapiens
tctgttggtgaattt

SEQ ID NO: 185853 - DNA, 15 bp, Homo sapiens
ctctgttggtgaatt

SEQ ID NO: 185854 - DNA, 15 bp, Homo sapiens
gctctgttggtgaat

SEQ ID NO: 185855 - DNA, 15 bp, Homo sapiens
tgctctgttggtgaa

SEQ ID NO: 185856 - DNA, 15 bp, Homo sapiens
ctgctctgttggtga

SEQ ID NO: 185857 - DNA, 15 bp, Homo sapiens
tctgctctgttggtg

SEQ ID NO: 185858 - DNA, 15 bp, Homo sapiens
ttctgctctgttggt

SEQ ID NO: 185859 - DNA, 15 bp, Homo sapiens
tttctgctctgttgg

SEQ ID NO: 185860 - DNA, 15 bp, Homo sapiens
ttttctgctctgttg

SEQ ID NO: 185861 - DNA, 15 bp, Homo sapiens
cttttctgctctgtt

SEQ ID NO: 185862 - DNA, 15 bp, Homo sapiens
gcttttctgctctgt

SEQ ID NO: 185863 - DNA, 15 bp, Homo sapiens
tgcttttctgctctg

SEQ ID NO: 185864 - DNA, 15 bp, Homo sapiens
gtgcttttctgctct

SEQ ID NO: 185865 - DNA, 15 bp, Homo sapiens
tgtgcttttctgctc

SEQ ID NO: 185866 - DNA, 15 bp, Homo sapiens
ctgtgcttttctgct

SEQ ID NO: 185867 - DNA, 15 bp, Homo sapiens
actgtgcttttctgc

SEQ ID NO: 185868 - DNA, 15 bp, Homo sapiens
cactgtgcttttctg

SEQ ID NO: 185869 - DNA, 15 bp, Homo sapiens
ccactgtgcttttct

SEQ ID NO: 185870 - DNA, 15 bp, Homo sapiens
cccactgtgcttttc

SEQ ID NO: 185871 - DNA, 15 bp, Homo sapiens
ccccactgtgctttt

SEQ ID NO: 185872 - DNA, 15 bp, Homo sapiens
tccccactgtgcttt

SEQ ID NO: 185873 - DNA, 15 bp, Homo sapiens
ctccccactgtgctt

SEQ ID NO: 185874 - DNA, 15 bp, Homo sapiens
tctccccactgtgct

SEQ ID NO: 185875 - DNA, 15 bp, Homo sapiens
ctctccccactgtgc

SEQ ID NO: 185876 - DNA, 15 bp, Homo sapiens
tctctccccactgtg

SEQ ID NO: 185877 - DNA, 15 bp, Homo sapiens
gtctctccccactgt

SEQ ID NO: 185878 - DNA, 15 bp, Homo sapiens
ggtctctccccactg

SEQ ID NO: 185879 - DNA, 15 bp, Homo sapiens
aggtctctccccact

SEQ ID NO: 185880 - DNA, 15 bp, Homo sapiens
gaggtctctccccac

SEQ ID NO: 185881 - DNA, 15 bp, Homo sapiens
tgaggtctctcccca

SEQ ID NO: 185882 - DNA, 15 bp, Homo sapiens
ctgaggtctctcccc

SEQ ID NO: 185883 - DNA, 15 bp, Homo sapiens
cctgaggtctctccc

SEQ ID NO: 185884 - DNA, 15 bp, Homo sapiens
ccctgaggtctctcc

SEQ ID NO: 185885 - DNA, 15 bp, Homo sapiens
cccctgaggtctctc

SEQ ID NO: 185886 - DNA, 15 bp, Homo sapiens
tcccctgaggtctct

SEQ ID NO: 185887 - DNA, 15 bp, Homo sapiens
ttcccctgaggtctc

SEQ ID NO: 185888 - DNA, 15 bp, Homo sapiens
tttcccctgaggtct

SEQ ID NO: 185889 - DNA, 15 bp, Homo sapiens
gtttcccctgaggtc

SEQ ID NO: 185890 - DNA, 15 bp, Homo sapiens
tgtttcccctgaggt

SEQ ID NO: 185891 - DNA, 15 bp, Homo sapiens
gtgtttcccctgagg

SEQ ID NO: 185892 - DNA, 15 bp, Homo sapiens
tgtgtttcccctgag

SEQ ID NO: 185893 - DNA, 15 bp, Homo sapiens
atgtgtttcccctga

SEQ ID NO: 185894 - DNA, 15 bp, Homo sapiens
tatgtgtttcccctg

SEQ ID NO: 185895 - DNA, 15 bp, Homo sapiens
gtatgtgtttcccct

SEQ ID NO: 185896 - DNA, 15 bp, Homo sapiens
tgtatgtgtttcccc

SEQ ID NO: 185897 - DNA, 15 bp, Homo sapiens
ttgtatgtgtttccc

SEQ ID NO: 185898 - DNA, 15 bp, Homo sapiens
gttgtatgtgtttcc

SEQ ID NO: 185899 - DNA, 15 bp, Homo sapiens
agttgtatgtgtttc

SEQ ID NO: 185900 - DNA, 15 bp, Homo sapiens
aagttgtatgtgttt

SEQ ID NO: 185901 - DNA, 15 bp, Homo sapiens
aaagttgtatgtgtt

SEQ ID NO: 185902 - DNA, 15 bp, Homo sapiens
caaagttgtatgtgt

SEQ ID NO: 185903 - DNA, 15 bp, Homo sapiens
tcaaagttgtatgtg

SEQ ID NO: 185904 - DNA, 15 bp, Homo sapiens
ctcaaagttgtatgt

SEQ ID NO: 185905 - DNA, 15 bp, Homo sapiens
tctcaaagttgtatg

SEQ ID NO: 185906 - DNA, 15 bp, Homo sapiens
atctcaaagttgtat

SEQ ID NO: 185907 - DNA, 15 bp, Homo sapiens
tatctcaaagttgta

SEQ ID NO: 185908 - DNA, 15 bp, Homo sapiens
ttatctcaaagttgt

SEQ ID NO: 185909 - DNA, 15 bp, Homo sapiens
tttatctcaaagttg

SEQ ID NO: 185910 - DNA, 15 bp, Homo sapiens
gtttatctcaaagtt

SEQ ID NO: 185911 - DNA, 15 bp, Homo sapiens
ggtttatctcaaagt

SEQ ID NO: 185912 - DNA, 15 bp, Homo sapiens
gggtttatctcaaag

SEQ ID NO: 185913 - DNA, 15 bp, Homo sapiens
agggtttatctcaaa

SEQ ID NO: 185914 - DNA, 15 bp, Homo sapiens
cagggtttatctcaa

SEQ ID NO: 185915 - DNA, 15 bp, Homo sapiens
acagggtttatctca

SEQ ID NO: 185916 - DNA, 15 bp, Homo sapiens
aacagggtttatctc

SEQ ID NO: 185917 - DNA, 15 bp, Homo sapiens
aaacagggtttatct

SEQ ID NO: 185918 - DNA, 15 bp, Homo sapiens
aaaacagggtttatc

SEQ ID NO: 185919 - DNA, 15 bp, Homo sapiens
aaaaacagggtttat

SEQ ID NO: 185920 - DNA, 15 bp, Homo sapiens
caaaaacagggttta

SEQ ID NO: 185921 - DNA, 15 bp, Homo sapiens
acaaaaacagggttt

SEQ ID NO: 185922 - DNA, 15 bp, Homo sapiens
aacaaaaacagggtt

SEQ ID NO: 185923 - DNA, 15 bp, Homo sapiens
aaacaaaaacagggt

SEQ ID NO: 185924 - DNA, 15 bp, Homo sapiens
aaaacaaaaacaggg

SEQ ID NO: 185925 - DNA, 15 bp, Homo sapiens
taaaacaaaaacagg

SEQ ID NO: 185926 - DNA, 15 bp, Homo sapiens
ttaaaacaaaaacag

SEQ ID NO: 185927 - DNA, 15 bp, Homo sapiens
cattaaaacaaaaac

SEQ ID NO: 185928 - DNA, 15 bp, Homo sapiens
acattaaaacaaaaa

SEQ ID NO: 185929 - DNA, 15 bp, Homo sapiens
aacattaaaacaaaa

SEQ ID NO: 185930 - DNA, 15 bp, Homo sapiens
taacattaaaacaaa

SEQ ID NO: 185931 - DNA, 15 bp, Homo sapiens
tttaacattaaaaca

SEQ ID NO: 185932 - DNA, 15 bp, Homo sapiens
ttttaacattaaaac

SEQ ID NO: 185933 - DNA, 15 bp, Homo sapiens
attttaacattaaaa

SEQ ID NO: 185934 - DNA, 15 bp, Homo sapiens
aattttaacattaaa

SEQ ID NO: 185935 - DNA, 15 bp, Homo sapiens
aaattttaacattaa

SEQ ID NO: 185936 - DNA, 15 bp, Homo sapiens
taaattttaacatta

SEQ ID NO: 185937 - DNA, 15 bp, Homo sapiens
ttaaattttaacatt

SEQ ID NO: 185938 - DNA, 15 bp, Homo sapiens
gttaaattttaacat

SEQ ID NO: 185939 - DNA, 15 bp, Homo sapiens
agttaaattttaaca

SEQ ID NO: 185940 - DNA, 15 bp, Homo sapiens
aagttaaattttaac

SEQ ID NO: 185941 - DNA, 15 bp, Homo sapiens
aaagttaaattttaa

SEQ ID NO: 185942 - DNA, 15 bp, Homo sapiens
aaaagttaaatttta

SEQ ID NO: 185943 - DNA, 15 bp, Homo sapiens
taaaagttaaatttt

SEQ ID NO: 185944 - DNA, 15 bp, Homo sapiens
ttaaaagttaaattt

SEQ ID NO: 185945 - DNA, 15 bp, Homo sapiens
attaaaagttaaatt

SEQ ID NO: 185946 - DNA, 15 bp, Homo sapiens
gattaaaagttaaat

SEQ ID NO: 185947 - DNA, 15 bp, Homo sapiens
ggattaaaagttaaa

SEQ ID NO: 185948 - DNA, 15 bp, Homo sapiens
gggattaaaagttaa

SEQ ID NO: 185949 - DNA, 15 bp, Homo sapiens
agggattaaaagtta

SEQ ID NO: 185950 - DNA, 15 bp, Homo sapiens
aagggattaaaagtt

SEQ ID NO: 185951 - DNA, 15 bp, Homo sapiens
aaagggattaaaagt

SEQ ID NO: 185952 - DNA, 15 bp, Homo sapiens
caaagggattaaaag

SEQ ID NO: 185953 - DNA, 15 bp, Homo sapiens
acaaagggattaaaa

SEQ ID NO: 185954 - DNA, 15 bp, Homo sapiens
tacaaagggattaaa

SEQ ID NO: 185955 - DNA, 15 bp, Homo sapiens
ctacaaagggattaa

SEQ ID NO: 185956 - DNA, 15 bp, Homo sapiens
actacaaagggatta

SEQ ID NO: 185957 - DNA, 15 bp, Homo sapiens
tactacaaagggatt

SEQ ID NO: 185958 - DNA, 15 bp, Homo sapiens
atactacaaagggat

SEQ ID NO: 185959 - DNA, 15 bp, Homo sapiens
aatactacaaaggga

SEQ ID NO: 185960 - DNA, 15 bp, Homo sapiens
aaatactacaaaggg

SEQ ID NO: 185961 - DNA, 15 bp, Homo sapiens
taaatactacaaagg

SEQ ID NO: 185962 - DNA, 15 bp, Homo sapiens
gtaaatactacaaag

SEQ ID NO: 185963 - DNA, 15 bp, Homo sapiens
tgtaaatactacaaa

SEQ ID NO: 185964 - DNA, 15 bp, Homo sapiens
gtgtaaatactacaa

SEQ ID NO: 185965 - DNA, 15 bp, Homo sapiens
tgtgtaaatactaca

SEQ ID NO: 185966 - DNA, 15 bp, Homo sapiens
ttgtgtaaatactac

SEQ ID NO: 185967 - DNA, 15 bp, Homo sapiens
gttgtgtaaatacta

SEQ ID NO: 185968 - DNA, 15 bp, Homo sapiens
agttgtgtaaatact

SEQ ID NO: 185969 - DNA, 15 bp, Homo sapiens
cagttgtgtaaatac

SEQ ID NO: 185970 - DNA, 15 bp, Homo sapiens
acagttgtgtaaata

SEQ ID NO: 185971 - DNA, 15 bp, Homo sapiens
gacagttgtgtaaat

SEQ ID NO: 185972 - DNA, 15 bp, Homo sapiens
tgacagttgtgtaaa

SEQ ID NO: 185973 - DNA, 15 bp, Homo sapiens
ctgacagttgtgtaa

SEQ ID NO: 185974 - DNA, 15 bp, Homo sapiens
actgacagttgtgta

SEQ ID NO: 185975 - DNA, 15 bp, Homo sapiens
cactgacagttgtgt

SEQ ID NO: 185976 - DNA, 15 bp, Homo sapiens
tcactgacagttgtg

SEQ ID NO: 185977 - DNA, 15 bp, Homo sapiens
ttcactgacagttgt

SEQ ID NO: 185978 - DNA, 15 bp, Homo sapiens
tttcactgacagttg

SEQ ID NO: 185979 - DNA, 15 bp, Homo sapiens
atttcactgacagtt

SEQ ID NO: 185980 - DNA, 15 bp, Homo sapiens
catttcactgacagt

SEQ ID NO: 185981 - DNA, 15 bp, Homo sapiens
tcatttcactgacag

SEQ ID NO: 185982 - DNA, 15 bp, Homo sapiens
atcatttcactgaca

SEQ ID NO: 185983 - DNA, 15 bp, Homo sapiens
tatcatttcactgac

SEQ ID NO: 185984 - DNA, 15 bp, Homo sapiens
ttatcatttcactga

SEQ ID NO: 185985 - DNA, 15 bp, Homo sapiens
tttatcatttcactg

SEQ ID NO: 185986 - DNA, 15 bp, Homo sapiens
atttatcatttcact

SEQ ID NO: 185987 - DNA, 15 bp, Homo sapiens
gatttatcatttcac

SEQ ID NO: 185988 - DNA, 15 bp, Homo sapiens
agatttatcatttca

SEQ ID NO: 185989 - DNA, 15 bp, Homo sapiens
aagatttatcatttc

SEQ ID NO: 185990 - DNA, 15 bp, Homo sapiens
gaagatttatcattt

SEQ ID NO: 185991 - DNA, 15 bp, Homo sapiens
agaagatttatcatt

SEQ ID NO: 185992 - DNA, 15 bp, Homo sapiens
tagaagatttatcat

SEQ ID NO: 185993 - DNA, 15 bp, Homo sapiens
ctagaagatttatca

SEQ ID NO: 185994 - DNA, 15 bp, Homo sapiens
gctagaagatttatc

SEQ ID NO: 185995 - DNA, 15 bp, Homo sapiens
agctagaagatttat

SEQ ID NO: 185996 - DNA, 15 bp, Homo sapiens
gagctagaagattta

SEQ ID NO: 185997 - DNA, 15 bp, Homo sapiens
tgagctagaagattt

SEQ ID NO: 185998 - DNA, 15 bp, Homo sapiens
atgagctagaagatt

SEQ ID NO: 185999 - DNA, 15 bp, Homo sapiens
aatgagctagaagat

SEQ ID NO: 186000 - DNA, 15 bp, Homo sapiens
aaatgagctagaaga

SEQ ID NO: 186001 - DNA, 15 bp, Homo sapiens
gaaatgagctagaag

SEQ ID NO: 186002 - DNA, 15 bp, Homo sapiens
tgaaatgagctagaa

SEQ ID NO: 186003 - DNA, 15 bp, Homo sapiens
gtgaaatgagctaga

SEQ ID NO: 186004 - DNA, 15 bp, Homo sapiens
tgtgaaatgagctag

SEQ ID NO: 186005 - DNA, 15 bp, Homo sapiens
ttgtgaaatgagcta

SEQ ID NO: 186006 - DNA, 15 bp, Homo sapiens
cttgtgaaatgagct

SEQ ID NO: 186007 - DNA, 15 bp, Homo sapiens
tcttgtgaaatgagc

SEQ ID NO: 186008 - DNA, 15 bp, Homo sapiens
ctcttgtgaaatgag

SEQ ID NO: 186009 - DNA, 15 bp, Homo sapiens
cctcttgtgaaatga

SEQ ID NO: 186010 - DNA, 15 bp, Homo sapiens
ccctcttgtgaaatg

SEQ ID NO: 186011 - DNA, 15 bp, Homo sapiens
gccctcttgtgaaat

SEQ ID NO: 186012 - DNA, 15 bp, Homo sapiens
tgccctcttgtgaaa

SEQ ID NO: 186013 - DNA, 15 bp, Homo sapiens
ctgccctcttgtgaa

SEQ ID NO: 186014 - DNA, 15 bp, Homo sapiens
gctgccctcttgtga

SEQ ID NO: 186015 - DNA, 15 bp, Homo sapiens
tgctgccctcttgtg

SEQ ID NO: 186016 - DNA, 15 bp, Homo sapiens
gtgctgccctcttgt

SEQ ID NO: 186017 - DNA, 15 bp, Homo sapiens
agtgctgccctcttg

SEQ ID NO: 186018 - DNA, 15 bp, Homo sapiens
aagtgctgccctctt

SEQ ID NO: 186019 - DNA, 15 bp, Homo sapiens
aaagtgctgccctct

SEQ ID NO: 186020 - DNA, 15 bp, Homo sapiens
gaaagtgctgccctc

SEQ ID NO: 186021 - DNA, 15 bp, Homo sapiens
agaaagtgctgccct

SEQ ID NO: 186022 - DNA, 15 bp, Homo sapiens
aagaaagtgctgccc

SEQ ID NO: 186023 - DNA, 15 bp, Homo sapiens
aaagaaagtgctgcc

SEQ ID NO: 186024 - DNA, 15 bp, Homo sapiens
aaaagaaagtgctgc

SEQ ID NO: 186025 - DNA, 15 bp, Homo sapiens
taaaagaaagtgctg

SEQ ID NO: 186026 - DNA, 15 bp, Homo sapiens
ttaaaagaaagtgct

SEQ ID NO: 186027 - DNA, 15 bp, Homo sapiens
tttaaaagaaagtgc

SEQ ID NO: 186028 - DNA, 15 bp, Homo sapiens
ttttaaaagaaagtg

SEQ ID NO: 186029 - DNA, 15 bp, Homo sapiens
attttaaaagaaagt

SEQ ID NO: 186030 - DNA, 15 bp, Homo sapiens
aattttaaaagaaag

SEQ ID NO: 186031 - DNA, 15 bp, Homo sapiens
aaattttaaaagaaa

SEQ ID NO: 186032 - DNA, 15 bp, Homo sapiens
taaattttaaaagaa

SEQ ID NO: 186033 - DNA, 15 bp, Homo sapiens
ctttaaattttaaaa

SEQ ID NO: 186034 - DNA, 15 bp, Homo sapiens
actttaaattttaaa

SEQ ID NO: 186035 - DNA, 15 bp, Homo sapiens
tactttaaattttaa

SEQ ID NO: 186036 - DNA, 15 bp, Homo sapiens
atactttaaatttta

SEQ ID NO: 186037 - DNA, 15 bp, Homo sapiens
catactttaaatttt

SEQ ID NO: 186038 - DNA, 15 bp, Homo sapiens
tcatactttaaattt

SEQ ID NO: 186039 - DNA, 15 bp, Homo sapiens
gtcatactttaaatt

SEQ ID NO: 186040 - DNA, 15 bp, Homo sapiens
agtcatactttaaat

SEQ ID NO: 186041 - DNA, 15 bp, Homo sapiens
tagtcatactttaaa

SEQ ID NO: 186042 - DNA, 15 bp, Homo sapiens
ttagtcatactttaa

SEQ ID NO: 186043 - DNA, 15 bp, Homo sapiens
tttagtcatacttta

SEQ ID NO: 186044 - DNA, 15 bp, Homo sapiens
ttttagtcatacttt

SEQ ID NO: 186045 - DNA, 15 bp, Homo sapiens
tttttagtcatactt

SEQ ID NO: 186046 - DNA, 15 bp, Homo sapiens
ttttttagtcatact

SEQ ID NO: 186047 - DNA, 15 bp, Homo sapiens
tttttttagtcatac

SEQ ID NO: 186048 - DNA, 15 bp, Homo sapiens
atttttttagtcata

SEQ ID NO: 186049 - DNA, 15 bp, Homo sapiens
tatttttttagtcat

SEQ ID NO: 186050 - DNA, 15 bp, Homo sapiens
gtatttttttagtca

SEQ ID NO: 186051 - DNA, 15 bp, Homo sapiens
tgtatttttttagtc

SEQ ID NO: 186052 - DNA, 15 bp, Homo sapiens
ttgtatttttttagt

SEQ ID NO: 186053 - DNA, 15 bp, Homo sapiens
attgtatttttttag

SEQ ID NO: 186054 - DNA, 15 bp, Homo sapiens
gattgtattttttta

SEQ ID NO: 186055 - DNA, 15 bp, Homo sapiens
tgattgtattttttt

SEQ ID NO: 186056 - DNA, 15 bp, Homo sapiens
ttgattgtatttttt

SEQ ID NO: 186057 - DNA, 15 bp, Homo sapiens
tttgattgtattttt

SEQ ID NO: 186058 - DNA, 15 bp, Homo sapiens
atttgattgtatttt

SEQ ID NO: 186059 - DNA, 15 bp, Homo sapiens
aatttgattgtattt

SEQ ID NO: 186060 - DNA, 15 bp, Homo sapiens
taatttgattgtatt

SEQ ID NO: 186061 - DNA, 15 bp, Homo sapiens
ttaatttgattgtat

SEQ ID NO: 186062 - DNA, 15 bp, Homo sapiens
gttaatttgattgta

SEQ ID NO: 186063 - DNA, 15 bp, Homo sapiens
cgttaatttgattgt

SEQ ID NO: 186064 - DNA, 15 bp, Homo sapiens
acgttaatttgattg

SEQ ID NO: 186065 - DNA, 15 bp, Homo sapiens
aacgttaatttgatt

SEQ ID NO: 186066 - DNA, 15 bp, Homo sapiens
aaacgttaatttgat

SEQ ID NO: 186067 - DNA, 15 bp, Homo sapiens
aaaacgttaatttga

SEQ ID NO: 186068 - DNA, 15 bp, Homo sapiens
gaaaacgttaatttg

SEQ ID NO: 186069 - DNA, 15 bp, Homo sapiens
agaaaacgttaattt

SEQ ID NO: 186070 - DNA, 15 bp, Homo sapiens
tagaaaacgttaatt

SEQ ID NO: 186071 - DNA, 15 bp, Homo sapiens
atagaaaacgttaat

SEQ ID NO: 186072 - DNA, 15 bp, Homo sapiens
gatagaaaacgttaa

SEQ ID NO: 186073 - DNA, 15 bp, Homo sapiens
tgatagaaaacgtta

SEQ ID NO: 186074 - DNA, 15 bp, Homo sapiens
atgatagaaaacgtt

SEQ ID NO: 186075 - DNA, 15 bp, Homo sapiens
catgatagaaaacgt

SEQ ID NO: 186076 - DNA, 15 bp, Homo sapiens
tcatgatagaaaacg

SEQ ID NO: 186077 - DNA, 15 bp, Homo sapiens
ttcatgatagaaaac

SEQ ID NO: 186078 - DNA, 15 bp, Homo sapiens
cttcatgatagaaaa

SEQ ID NO: 186079 - DNA, 15 bp, Homo sapiens
acttcatgatagaaa

SEQ ID NO: 186080 - DNA, 15 bp, Homo sapiens
aacttcatgatagaa

SEQ ID NO: 186081 - DNA, 15 bp, Homo sapiens
taacttcatgataga

SEQ ID NO: 186082 - DNA, 15 bp, Homo sapiens
ttaacttcatgatag

SEQ ID NO: 186083 - DNA, 15 bp, Homo sapiens
cttaacttcatgata

SEQ ID NO: 186084 - DNA, 15 bp, Homo sapiens
gcttaacttcatgat

SEQ ID NO: 186085 - DNA, 15 bp, Homo sapiens
agcttaacttcatga

SEQ ID NO: 186086 - DNA, 15 bp, Homo sapiens
aagcttaacttcatg

SEQ ID NO: 186087 - DNA, 15 bp, Homo sapiens
caagcttaacttcat

SEQ ID NO: 186088 - DNA, 15 bp, Homo sapiens
tcaagcttaacttca

SEQ ID NO: 186089 - DNA, 15 bp, Homo sapiens
ttcaagcttaacttc

SEQ ID NO: 186090 - DNA, 15 bp, Homo sapiens
attcaagcttaactt

SEQ ID NO: 186091 - DNA, 15 bp, Homo sapiens
cattcaagcttaact

SEQ ID NO: 186092 - DNA, 15 bp, Homo sapiens
tcattcaagcttaac

SEQ ID NO: 186093 - DNA, 15 bp, Homo sapiens
atcattcaagcttaa

SEQ ID NO: 186094 - DNA, 15 bp, Homo sapiens
aatcattcaagctta

SEQ ID NO: 186095 - DNA, 15 bp, Homo sapiens
aaatcattcaagctt

SEQ ID NO: 186096 - DNA, 15 bp, Homo sapiens
taaatcattcaagct

SEQ ID NO: 186097 - DNA, 15 bp, Homo sapiens
gtaaatcattcaagc

SEQ ID NO: 186098 - DNA, 15 bp, Homo sapiens
tgtaaatcattcaag

SEQ ID NO: 186099 - DNA, 15 bp, Homo sapiens
ctgtaaatcattcaa

SEQ ID NO: 186100 - DNA, 15 bp, Homo sapiens
cctgtaaatcattca

SEQ ID NO: 186101 - DNA, 15 bp, Homo sapiens
tcctgtaaatcattc

SEQ ID NO: 186102 - DNA, 15 bp, Homo sapiens
ttcctgtaaatcatt

SEQ ID NO: 186103 - DNA, 15 bp, Homo sapiens
cttcctgtaaatcat

SEQ ID NO: 186104 - DNA, 15 bp, Homo sapiens
tcttcctgtaaatca

SEQ ID NO: 186105 - DNA, 15 bp, Homo sapiens
atcttcctgtaaatc

SEQ ID NO: 186106 - DNA, 15 bp, Homo sapiens
catcttcctgtaaat

SEQ ID NO: 186107 - DNA, 15 bp, Homo sapiens
ccatcttcctgtaaa

SEQ ID NO: 186108 - DNA, 15 bp, Homo sapiens
cccatcttcctgtaa

SEQ ID NO: 186109 - DNA, 15 bp, Homo sapiens
tcccatcttcctgta

SEQ ID NO: 186110 - DNA, 15 bp, Homo sapiens
ctcccatcttcctgt

SEQ ID NO: 186111 - DNA, 15 bp, Homo sapiens
gctcccatcttcctg

SEQ ID NO: 186112 - DNA, 15 bp, Homo sapiens
ggctcccatcttcct

SEQ ID NO: 186113 - DNA, 15 bp, Homo sapiens
aggctcccatcttcc

SEQ ID NO: 186114 - DNA, 15 bp, Homo sapiens
gaggctcccatcttc

SEQ ID NO: 186115 - DNA, 15 bp, Homo sapiens
agaggctcccatctt

SEQ ID NO: 186116 - DNA, 15 bp, Homo sapiens
gagaggctcccatct

SEQ ID NO: 186117 - DNA, 15 bp, Homo sapiens
agagaggctcccatc

SEQ ID NO: 186118 - DNA, 15 bp, Homo sapiens
cagagaggctcccat

SEQ ID NO: 186119 - DNA, 15 bp, Homo sapiens
acagagaggctccca

SEQ ID NO: 186120 - DNA, 15 bp, Homo sapiens
gacagagaggctccc

SEQ ID NO: 186121 - DNA, 15 bp, Homo sapiens
ggacagagaggctcc

SEQ ID NO: 186122 - DNA, 15 bp, Homo sapiens
aggacagagaggctc

SEQ ID NO: 186123 - DNA, 15 bp, Homo sapiens
caggacagagaggct

SEQ ID NO: 186124 - DNA, 15 bp, Homo sapiens
ccaggacagagaggc

SEQ ID NO: 186125 - DNA, 15 bp, Homo sapiens
cccaggacagagagg

SEQ ID NO: 186126 - DNA, 15 bp, Homo sapiens
ccccaggacagagag

SEQ ID NO: 186127 - DNA, 15 bp, Homo sapiens
cccccaggacagaga

SEQ ID NO: 186128 - DNA, 15 bp, Homo sapiens
gcccccaggacagag

SEQ ID NO: 186129 - DNA, 15 bp, Homo sapiens
tgcccccaggacaga

SEQ ID NO: 186130 - DNA, 15 bp, Homo sapiens
ttgcccccaggacag

SEQ ID NO: 186131 - DNA, 15 bp, Homo sapiens
attgcccccaggaca

SEQ ID NO: 186132 - DNA, 15 bp, Homo sapiens
aattgcccccaggac

SEQ ID NO: 186133 - DNA, 15 bp, Homo sapiens
aaattgcccccagga

SEQ ID NO: 186134 - DNA, 15 bp, Homo sapiens
taaattgcccccagg

SEQ ID NO: 186135 - DNA, 15 bp, Homo sapiens
ataaattgcccccag

SEQ ID NO: 186136 - DNA, 15 bp, Homo sapiens
cataaattgccccca

SEQ ID NO: 186137 - DNA, 15 bp, Homo sapiens
tcataaattgccccc

SEQ ID NO: 186138 - DNA, 15 bp, Homo sapiens
ctcataaattgcccc

SEQ ID NO: 186139 - DNA, 15 bp, Homo sapiens
actcataaattgccc

SEQ ID NO: 186140 - DNA, 15 bp, Homo sapiens
aactcataaattgcc

SEQ ID NO: 186141 - DNA, 15 bp, Homo sapiens
taactcataaattgc

SEQ ID NO: 186142 - DNA, 15 bp, Homo sapiens
ttaactcataaattg

SEQ ID NO: 186143 - DNA, 15 bp, Homo sapiens
cttaactcataaatt

SEQ ID NO: 186144 - DNA, 15 bp, Homo sapiens
tcttaactcataaat

SEQ ID NO: 186145 - DNA, 15 bp, Homo sapiens
atcttaactcataaa

SEQ ID NO: 186146 - DNA, 15 bp, Homo sapiens
catcttaactcataa

SEQ ID NO: 186147 - DNA, 15 bp, Homo sapiens
tcatcttaactcata

SEQ ID NO: 186148 - DNA, 15 bp, Homo sapiens
ctcatcttaactcat

SEQ ID NO: 186149 - DNA, 15 bp, Homo sapiens
actcatcttaactca

SEQ ID NO: 186150 - DNA, 15 bp, Homo sapiens
cactcatcttaactc

SEQ ID NO: 186151 - DNA, 15 bp, Homo sapiens
gcactcatcttaact

SEQ ID NO: 186152 - DNA, 15 bp, Homo sapiens
tgcactcatcttaac

SEQ ID NO: 186153 - DNA, 15 bp, Homo sapiens
ctgcactcatcttaa

SEQ ID NO: 186154 - DNA, 15 bp, Homo sapiens
tctgcactcatctta

SEQ ID NO: 186155 - DNA, 15 bp, Homo sapiens
atctgcactcatctt

SEQ ID NO: 186156 - DNA, 15 bp, Homo sapiens
gatctgcactcatct

SEQ ID NO: 186157 - DNA, 15 bp, Homo sapiens
agatctgcactcatc

SEQ ID NO: 186158 - DNA, 15 bp, Homo sapiens
cagatctgcactcat

SEQ ID NO: 186159 - DNA, 15 bp, Homo sapiens
gcagatctgcactca

SEQ ID NO: 186160 - DNA, 15 bp, Homo sapiens
tgcagatctgcactc

SEQ ID NO: 186161 - DNA, 15 bp, Homo sapiens
ctgcagatctgcact

SEQ ID NO: 186162 - DNA, 15 bp, Homo sapiens
cctgcagatctgcac

SEQ ID NO: 186163 - DNA, 15 bp, Homo sapiens
ccctgcagatctgca

SEQ ID NO: 186164 - DNA, 15 bp, Homo sapiens
accctgcagatctgc

SEQ ID NO: 186165 - DNA, 15 bp, Homo sapiens
taccctgcagatctg

SEQ ID NO: 186166 - DNA, 15 bp, Homo sapiens
ttaccctgcagatct

SEQ ID NO: 186167 - DNA, 15 bp, Homo sapiens
gttaccctgcagatc

SEQ ID NO: 186168 - DNA, 15 bp, Homo sapiens
agttaccctgcagat

SEQ ID NO: 186169 - DNA, 15 bp, Homo sapiens
aagttaccctgcaga

SEQ ID NO: 186170 - DNA, 15 bp, Homo sapiens
caagttaccctgcag

SEQ ID NO: 186171 - DNA, 15 bp, Homo sapiens
ccaagttaccctgca

SEQ ID NO: 186172 - DNA, 15 bp, Homo sapiens
cccaagttaccctgc

SEQ ID NO: 186173 - DNA, 15 bp, Homo sapiens
tcccaagttaccctg

SEQ ID NO: 186174 - DNA, 15 bp, Homo sapiens
atcccaagttaccct

SEQ ID NO: 186175 - DNA, 15 bp, Homo sapiens
gatcccaagttaccc

SEQ ID NO: 186176 - DNA, 15 bp, Homo sapiens
ggatcccaagttacc

SEQ ID NO: 186177 - DNA, 15 bp, Homo sapiens
aggatcccaagttac

SEQ ID NO: 186178 - DNA, 15 bp, Homo sapiens
aaggatcccaagtta

SEQ ID NO: 186179 - DNA, 15 bp, Homo sapiens
tctaaggatcccaag

SEQ ID NO: 186180 - DNA, 15 bp, Homo sapiens
ttctaaggatcccaa

SEQ ID NO: 186181 - DNA, 15 bp, Homo sapiens
tttctaaggatccca

SEQ ID NO: 186182 - DNA, 15 bp, Homo sapiens
ttttctaaggatccc

SEQ ID NO: 186183 - DNA, 15 bp, Homo sapiens
attttctaaggatcc

SEQ ID NO: 186184 - DNA, 15 bp, Homo sapiens
cattttctaaggatc

SEQ ID NO: 186185 - DNA, 15 bp, Homo sapiens
ccattttctaaggat

SEQ ID NO: 186186 - DNA, 15 bp, Homo sapiens
tccattttctaagga

SEQ ID NO: 186187 - DNA, 15 bp, Homo sapiens
ttccattttctaagg

SEQ ID NO: 186188 - DNA, 15 bp, Homo sapiens
gttccattttctaag

SEQ ID NO: 186189 - DNA, 15 bp, Homo sapiens
cgttccattttctaa

SEQ ID NO: 186190 - DNA, 15 bp, Homo sapiens
tcgttccattttcta

SEQ ID NO: 186191 - DNA, 15 bp, Homo sapiens
atcgttccattttct

SEQ ID NO: 186192 - DNA, 15 bp, Homo sapiens
catcgttccattttc

SEQ ID NO: 186193 - DNA, 15 bp, Homo sapiens
ccatcgttccatttt

SEQ ID NO: 186194 - DNA, 15 bp, Homo sapiens
tccatcgttccattt

SEQ ID NO: 186195 - DNA, 15 bp, Homo sapiens
atccatcgttccatt

SEQ ID NO: 186196 - DNA, 15 bp, Homo sapiens
aatccatcgttccat

SEQ ID NO: 186197 - DNA, 15 bp, Homo sapiens
taatccatcgttcca

SEQ ID NO: 186198 - DNA, 15 bp, Homo sapiens
ttaatccatcgttcc

SEQ ID NO: 186199 - DNA, 15 bp, Homo sapiens
tttaatccatcgttc

SEQ ID NO: 186200 - DNA, 15 bp, Homo sapiens
ttttaatccatcgtt

SEQ ID NO: 186201 - DNA, 15 bp, Homo sapiens
attttaatccatcgt

SEQ ID NO: 186202 - DNA, 15 bp, Homo sapiens
gattttaatccatcg

SEQ ID NO: 186203 - DNA, 15 bp, Homo sapiens
tgattttaatccatc

SEQ ID NO: 186204 - DNA, 15 bp, Homo sapiens
ttgattttaatccat

SEQ ID NO: 186205 - DNA, 15 bp, Homo sapiens
cttgattttaatcca

SEQ ID NO: 186206 - DNA, 15 bp, Homo sapiens
gcttgattttaatcc

SEQ ID NO: 186207 - DNA, 15 bp, Homo sapiens
ggcttgattttaatc

SEQ ID NO: 186208 - DNA, 15 bp, Homo sapiens
gggcttgattttaat

SEQ ID NO: 186209 - DNA, 15 bp, Homo sapiens
agggcttgattttaa

SEQ ID NO: 186210 - DNA, 15 bp, Homo sapiens
tagggcttgatttta

SEQ ID NO: 186211 - DNA, 15 bp, Homo sapiens
ctagggcttgatttt

SEQ ID NO: 186212 - DNA, 15 bp, Homo sapiens
tctagggcttgattt

SEQ ID NO: 186213 - DNA, 15 bp, Homo sapiens
ttctagggcttgatt

SEQ ID NO: 186214 - DNA, 15 bp, Homo sapiens
attctagggcttgat

SEQ ID NO: 186215 - DNA, 15 bp, Homo sapiens
aattctagggcttga

SEQ ID NO: 186216 - DNA, 15 bp, Homo sapiens
aaattctagggcttg

SEQ ID NO: 186217 - DNA, 15 bp, Homo sapiens
aaaattctagggctt

SEQ ID NO: 186218 - DNA, 15 bp, Homo sapiens
aaaaattctagggct

SEQ ID NO: 186219 - DNA, 15 bp, Homo sapiens
caaaaattctagggc

SEQ ID NO: 186220 - DNA, 15 bp, Homo sapiens
tcaaaaattctaggg

SEQ ID NO: 186221 - DNA, 15 bp, Homo sapiens
gtcaaaaattctagg

SEQ ID NO: 186222 - DNA, 15 bp, Homo sapiens
agtcaaaaattctag

SEQ ID NO: 186223 - DNA, 15 bp, Homo sapiens
aagtcaaaaattcta

SEQ ID NO: 186224 - DNA, 15 bp, Homo sapiens
caagtcaaaaattct

SEQ ID NO: 186225 - DNA, 15 bp, Homo sapiens
gcaagtcaaaaattc

SEQ ID NO: 186226 - DNA, 15 bp, Homo sapiens
tgcaagtcaaaaatt

SEQ ID NO: 186227 - DNA, 15 bp, Homo sapiens
ctgcaagtcaaaaat

SEQ ID NO: 186228 - DNA, 15 bp, Homo sapiens
actgcaagtcaaaaa

SEQ ID NO: 186229 - DNA, 15 bp, Homo sapiens
aactgcaagtcaaaa

SEQ ID NO: 186230 - DNA, 15 bp, Homo sapiens
aaactgcaagtcaaa

SEQ ID NO: 186231 - DNA, 15 bp, Homo sapiens
caaactgcaagtcaa

SEQ ID NO: 186232 - DNA, 15 bp, Homo sapiens
tcaaactgcaagtca

SEQ ID NO: 186233 - DNA, 15 bp, Homo sapiens
ttcaaactgcaagtc

SEQ ID NO: 186234 - DNA, 15 bp, Homo sapiens
attcaaactgcaagt

SEQ ID NO: 186235 - DNA, 15 bp, Homo sapiens
aattcaaactgcaag

SEQ ID NO: 186236 - DNA, 15 bp, Homo sapiens
aaattcaaactgcaa

SEQ ID NO: 186237 - DNA, 15 bp, Homo sapiens
caaattcaaactgca

SEQ ID NO: 186238 - DNA, 15 bp, Homo sapiens
ccaaattcaaactgc

SEQ ID NO: 186239 - DNA, 15 bp, Homo sapiens
tccaaattcaaactg

SEQ ID NO: 186240 - DNA, 15 bp, Homo sapiens
ctccaaattcaaact

SEQ ID NO: 186241 - DNA, 15 bp, Homo sapiens
tctccaaattcaaac

SEQ ID NO: 186242 - DNA, 15 bp, Homo sapiens
gtctccaaattcaaa

SEQ ID NO: 186243 - DNA, 15 bp, Homo sapiens
agtctccaaattcaa

SEQ ID NO: 186244 - DNA, 15 bp, Homo sapiens
tagtctccaaattca

SEQ ID NO: 186245 - DNA, 15 bp, Homo sapiens
atagtctccaaattc

SEQ ID NO: 186246 - DNA, 15 bp, Homo sapiens
aatagtctccaaatt

SEQ ID NO: 186247 - DNA, 15 bp, Homo sapiens
aaatagtctccaaat

SEQ ID NO: 186248 - DNA, 15 bp, Homo sapiens
aaaatagtctccaaa

SEQ ID NO: 186249 - DNA, 15 bp, Homo sapiens
caaaatagtctccaa

SEQ ID NO: 186250 - DNA, 15 bp, Homo sapiens
ccaaaatagtctcca

SEQ ID NO: 186251 - DNA, 15 bp, Homo sapiens
accaaaatagtctcc

SEQ ID NO: 186252 - DNA, 15 bp, Homo sapiens
taccaaaatagtctc

SEQ ID NO: 186253 - DNA, 15 bp, Homo sapiens
ttaccaaaatagtct

SEQ ID NO: 186254 - DNA, 15 bp, Homo sapiens
gttaccaaaatagtc

SEQ ID NO: 186255 - DNA, 15 bp, Homo sapiens
agttaccaaaatagt

SEQ ID NO: 186256 - DNA, 15 bp, Homo sapiens
aagttaccaaaatag

SEQ ID NO: 186257 - DNA, 15 bp, Homo sapiens
aaagttaccaaaata

SEQ ID NO: 186258 - DNA, 15 bp, Homo sapiens
caaagttaccaaaat

SEQ ID NO: 186259 - DNA, 15 bp, Homo sapiens
acaaagttaccaaaa

SEQ ID NO: 186260 - DNA, 15 bp, Homo sapiens
tacaaagttaccaaa

SEQ ID NO: 186261 - DNA, 15 bp, Homo sapiens
ttacaaagttaccaa

SEQ ID NO: 186262 - DNA, 15 bp, Homo sapiens
tttacaaagttacca

SEQ ID NO: 186263 - DNA, 15 bp, Homo sapiens
atttacaaagttacc

SEQ ID NO: 186264 - DNA, 15 bp, Homo sapiens
catttacaaagttac

SEQ ID NO: 186265 - DNA, 15 bp, Homo sapiens
acatttacaaagtta

SEQ ID NO: 186266 - DNA, 15 bp, Homo sapiens
cacatttacaaagtt

SEQ ID NO: 186267 - DNA, 15 bp, Homo sapiens
acacatttacaaagt

SEQ ID NO: 186268 - DNA, 15 bp, Homo sapiens
tacacatttacaaag

SEQ ID NO: 186269 - DNA, 15 bp, Homo sapiens
ttacacatttacaaa

SEQ ID NO: 186270 - DNA, 15 bp, Homo sapiens
tttacacatttacaa

SEQ ID NO: 186271 - DNA, 15 bp, Homo sapiens
ttttacacatttaca

SEQ ID NO: 186272 - DNA, 15 bp, Homo sapiens
cttttacacatttac

SEQ ID NO: 186273 - DNA, 15 bp, Homo sapiens
acttttacacattta

SEQ ID NO: 186274 - DNA, 15 bp, Homo sapiens
gacttttacacattt

SEQ ID NO: 186275 - DNA, 15 bp, Homo sapiens
agacttttacacatt

SEQ ID NO: 186276 - DNA, 15 bp, Homo sapiens
cagacttttacacat

SEQ ID NO: 186277 - DNA, 15 bp, Homo sapiens
acagacttttacaca

SEQ ID NO: 186278 - DNA, 15 bp, Homo sapiens
gacagacttttacac

SEQ ID NO: 186279 - DNA, 15 bp, Homo sapiens
tgacagacttttaca

SEQ ID NO: 186280 - DNA, 15 bp, Homo sapiens
ttgacagacttttac

SEQ ID NO: 186281 - DNA, 15 bp, Homo sapiens
cttgacagactttta

SEQ ID NO: 186282 - DNA, 15 bp, Homo sapiens
tcttgacagactttt

SEQ ID NO: 186283 - DNA, 15 bp, Homo sapiens
atcttgacagacttt

SEQ ID NO: 186284 - DNA, 15 bp, Homo sapiens
gatcttgacagactt

SEQ ID NO: 186285 - DNA, 15 bp, Homo sapiens
tgatcttgacagact

SEQ ID NO: 186286 - DNA, 15 bp, Homo sapiens
atgatcttgacagac

SEQ ID NO: 186287 - DNA, 15 bp, Homo sapiens
catgatcttgacaga

SEQ ID NO: 186288 - DNA, 15 bp, Homo sapiens
acatgatcttgacag

SEQ ID NO: 186289 - DNA, 15 bp, Homo sapiens
gacatgatcttgaca

SEQ ID NO: 186290 - DNA, 15 bp, Homo sapiens
agacatgatcttgac

SEQ ID NO: 186291 - DNA, 15 bp, Homo sapiens
aagacatgatcttga

SEQ ID NO: 186292 - DNA, 15 bp, Homo sapiens
aaagacatgatcttg

SEQ ID NO: 186293 - DNA, 15 bp, Homo sapiens
gaaagacatgatctt

SEQ ID NO: 186294 - DNA, 15 bp, Homo sapiens
agaaagacatgatct

SEQ ID NO: 186295 - DNA, 15 bp, Homo sapiens
aagaaagacatgatc

SEQ ID NO: 186296 - DNA, 15 bp, Homo sapiens
aaagaaagacatgat

SEQ ID NO: 186297 - DNA, 15 bp, Homo sapiens
aaaagaaagacatga

SEQ ID NO: 186298 - DNA, 15 bp, Homo sapiens
gaaaagaaagacatg

SEQ ID NO: 186299 - DNA, 15 bp, Homo sapiens
agaaaagaaagacat

SEQ ID NO: 186300 - DNA, 15 bp, Homo sapiens
tagaaaagaaagaca

SEQ ID NO: 186301 - DNA, 15 bp, Homo sapiens
atagaaaagaaagac

SEQ ID NO: 186302 - DNA, 15 bp, Homo sapiens
aatagaaaagaaaga

SEQ ID NO: 186303 - DNA, 15 bp, Homo sapiens
taatagaaaagaaag

SEQ ID NO: 186304 - DNA, 15 bp, Homo sapiens
ataatagaaaagaaa

SEQ ID NO: 186305 - DNA, 15 bp, Homo sapiens
cataatagaaaagaa

SEQ ID NO: 186306 - DNA, 15 bp, Homo sapiens
ccataatagaaaaga

SEQ ID NO: 186307 - DNA, 15 bp, Homo sapiens
gccataatagaaaag

SEQ ID NO: 186308 - DNA, 15 bp, Homo sapiens
tgccataatagaaaa

SEQ ID NO: 186309 - DNA, 15 bp, Homo sapiens
ttgccataatagaaa

SEQ ID NO: 186310 - DNA, 15 bp, Homo sapiens
tttgccataatagaa

SEQ ID NO: 186311 - DNA, 15 bp, Homo sapiens
ttttgccataataga

SEQ ID NO: 186312 - DNA, 15 bp, Homo sapiens
gttttgccataatag

SEQ ID NO: 186313 - DNA, 15 bp, Homo sapiens
tgttttgccataata

SEQ ID NO: 186314 - DNA, 15 bp, Homo sapiens
atgttttgccataat

SEQ ID NO: 186315 - DNA, 15 bp, Homo sapiens
catgttttgccataa

SEQ ID NO: 186316 - DNA, 15 bp, Homo sapiens
tcatgttttgccata

SEQ ID NO: 186317 - DNA, 15 bp, Homo sapiens
ttcatgttttgccat

SEQ ID NO: 186318 - DNA, 15 bp, Homo sapiens
cttcatgttttgcca

SEQ ID NO: 186319 - DNA, 15 bp, Homo sapiens
tcttcatgttttgcc

SEQ ID NO: 186320 - DNA, 15 bp, Homo sapiens
ctcttcatgttttgc

SEQ ID NO: 186321 - DNA, 15 bp, Homo sapiens
actcttcatgttttg

SEQ ID NO: 186322 - DNA, 15 bp, Homo sapiens
cactcttcatgtttt

SEQ ID NO: 186323 - DNA, 15 bp, Homo sapiens
tcactcttcatgttt

SEQ ID NO: 186324 - DNA, 15 bp, Homo sapiens
ttcactcttcatgtt

SEQ ID NO: 186325 - DNA, 15 bp, Homo sapiens
attcactcttcatgt

SEQ ID NO: 186326 - DNA, 15 bp, Homo sapiens
gattcactcttcatg

SEQ ID NO: 186327 - DNA, 15 bp, Homo sapiens
tgattcactcttcat

SEQ ID NO: 186328 - DNA, 15 bp, Homo sapiens
atgattcactcttca

SEQ ID NO: 186329 - DNA, 15 bp, Homo sapiens
aatgattcactcttc

SEQ ID NO: 186330 - DNA, 15 bp, Homo sapiens
aaatgattcactctt

SEQ ID NO: 186331 - DNA, 15 bp, Homo sapiens
aaaatgattcactct

SEQ ID NO: 186332 - DNA, 15 bp, Homo sapiens
taaaatgattcactc

SEQ ID NO: 186333 - DNA, 15 bp, Homo sapiens
ttaaaatgattcact

SEQ ID NO: 186334 - DNA, 15 bp, Homo sapiens
attaaaatgattcac

SEQ ID NO: 186335 - DNA, 15 bp, Homo sapiens
tattaaaatgattca

SEQ ID NO: 186336 - DNA, 15 bp, Homo sapiens
atattaaaatgattc

SEQ ID NO: 186337 - DNA, 15 bp, Homo sapiens
tatattaaaatgatt

SEQ ID NO: 186338 - DNA, 15 bp, Homo sapiens
atatattaaaatgat

SEQ ID NO: 186339 - DNA, 15 bp, Homo sapiens
aatatattaaaatga

SEQ ID NO: 186340 - DNA, 15 bp, Homo sapiens
gaatatattaaaatg

SEQ ID NO: 186341 - DNA, 15 bp, Homo sapiens
tgaatatattaaaat

SEQ ID NO: 186342 - DNA, 15 bp, Homo sapiens
ttgaatatattaaaa

SEQ ID NO: 186343 - DNA, 15 bp, Homo sapiens
tttgaatatattaaa

SEQ ID NO: 186344 - DNA, 15 bp, Homo sapiens
atttgaatatattaa

SEQ ID NO: 186345 - DNA, 15 bp, Homo sapiens
aatttgaatatatta

SEQ ID NO: 186346 - DNA, 15 bp, Homo sapiens
caatttgaatatatt

SEQ ID NO: 186347 - DNA, 15 bp, Homo sapiens
acaatttgaatatat

SEQ ID NO: 186348 - DNA, 15 bp, Homo sapiens
aacaatttgaatata

SEQ ID NO: 186349 - DNA, 15 bp, Homo sapiens
aaacaatttgaatat

SEQ ID NO: 186350 - DNA, 15 bp, Homo sapiens
aaaacaatttgaata

SEQ ID NO: 186351 - DNA, 15 bp, Homo sapiens
caaaacaatttgaat

SEQ ID NO: 186352 - DNA, 15 bp, Homo sapiens
gcaaaacaatttgaa

SEQ ID NO: 186353 - DNA, 15 bp, Homo sapiens
agcaaaacaatttga

SEQ ID NO: 186354 - DNA, 15 bp, Homo sapiens
gagcaaaacaatttg

SEQ ID NO: 186355 - DNA, 15 bp, Homo sapiens
tgagcaaaacaattt

SEQ ID NO: 186356 - DNA, 15 bp, Homo sapiens
atgagcaaaacaatt

SEQ ID NO: 186357 - DNA, 15 bp, Homo sapiens
tatgagcaaaacaat

SEQ ID NO: 186358 - DNA, 15 bp, Homo sapiens
atatgagcaaaacaa

SEQ ID NO: 186359 - DNA, 15 bp, Homo sapiens
gatatgagcaaaaca

SEQ ID NO: 186360 - DNA, 15 bp, Homo sapiens
tgatatgagcaaaac

SEQ ID NO: 186361 - DNA, 15 bp, Homo sapiens
ttgatatgagcaaaa

SEQ ID NO: 186362 - DNA, 15 bp, Homo sapiens
tttgatatgagcaaa

SEQ ID NO: 186363 - DNA, 15 bp, Homo sapiens
atttgatatgagcaa

SEQ ID NO: 186364 - DNA, 15 bp, Homo sapiens
tatttgatatgagca

SEQ ID NO: 186365 - DNA, 15 bp, Homo sapiens
ttatttgatatgagc

SEQ ID NO: 186366 - DNA, 15 bp, Homo sapiens
tttatttgatatgag

SEQ ID NO: 186367 - DNA, 15 bp, Homo sapiens
ttttatttgatatga

SEQ ID NO: 186368 - DNA, 15 bp, Homo sapiens
tttttatttgatatg

SEQ ID NO: 186369 - DNA, 15 bp, Homo sapiens
ctttttatttgatat

SEQ ID NO: 186370 - DNA, 15 bp, Homo sapiens
actttttatttgata

SEQ ID NO: 186371 - DNA, 15 bp, Homo sapiens
tactttttatttgat

SEQ ID NO: 186372 - DNA, 15 bp, Homo sapiens
atactttttatttga

SEQ ID NO: 186373 - DNA, 15 bp, Homo sapiens
aatactttttatttg

SEQ ID NO: 186374 - DNA, 15 bp, Homo sapiens
aaatactttttattt

SEQ ID NO: 186375 - DNA, 15 bp, Homo sapiens
taaatactttttatt

SEQ ID NO: 186376 - DNA, 15 bp, Homo sapiens
ataaatactttttat

SEQ ID NO: 186377 - DNA, 15 bp, Homo sapiens
aataaatacttttta

SEQ ID NO: 186378 - DNA, 15 bp, Homo sapiens
caataaatacttttt

SEQ ID NO: 186379 - DNA, 15 bp, Homo sapiens
tcaataaatactttt

SEQ ID NO: 186380 - DNA, 15 bp, Homo sapiens
ctcaataaatacttt

SEQ ID NO: 186381 - DNA, 15 bp, Homo sapiens
gctcaataaatactt

SEQ ID NO: 186382 - DNA, 15 bp, Homo sapiens
tgctcaataaatact

SEQ ID NO: 186383 - DNA, 15 bp, Homo sapiens
ttgctcaataaatac

SEQ ID NO: 186384 - DNA, 15 bp, Homo sapiens
attgctcaataaata

SEQ ID NO: 186385 - DNA, 15 bp, Homo sapiens
cattgctcaataaat

SEQ ID NO: 186386 - DNA, 15 bp, Homo sapiens
ccattgctcaataaa

SEQ ID NO: 186387 - DNA, 15 bp, Homo sapiens
accattgctcaataa

SEQ ID NO: 186388 - DNA, 15 bp, Homo sapiens
aaccattgctcaata

SEQ ID NO: 186389 - DNA, 15 bp, Homo sapiens
aaaccattgctcaat

SEQ ID NO: 186390 - DNA, 15 bp, Homo sapiens
aaaaccattgctcaa

SEQ ID NO: 186391 - DNA, 15 bp, Homo sapiens
taaaaccattgctca

SEQ ID NO: 186392 - DNA, 15 bp, Homo sapiens
ataaaaccattgctc

SEQ ID NO: 186393 - DNA, 15 bp, Homo sapiens
cataaaaccattgct

SEQ ID NO: 186394 - DNA, 15 bp, Homo sapiens
acataaaaccattgc

SEQ ID NO: 186395 - DNA, 15 bp, Homo sapiens
aacataaaaccattg

SEQ ID NO: 186396 - DNA, 15 bp, Homo sapiens
aaacataaaaccatt

SEQ ID NO: 186397 - DNA, 15 bp, Homo sapiens
taaacataaaaccat

SEQ ID NO: 186398 - DNA, 15 bp, Homo sapiens
ctaaacataaaacca

SEQ ID NO: 186399 - DNA, 15 bp, Homo sapiens
cctaaacataaaacc

SEQ ID NO: 186400 - DNA, 15 bp, Homo sapiens
tcctaaacataaaac

SEQ ID NO: 186401 - DNA, 15 bp, Homo sapiens
atcctaaacataaaa

SEQ ID NO: 186402 - DNA, 15 bp, Homo sapiens
aatcctaaacataaa

SEQ ID NO: 186403 - DNA, 15 bp, Homo sapiens
gaatcctaaacataa

SEQ ID NO: 186404 - DNA, 15 bp, Homo sapiens
agaatcctaaacata

SEQ ID NO: 186405 - DNA, 15 bp, Homo sapiens
tagaatcctaaacat

SEQ ID NO: 186406 - DNA, 15 bp, Homo sapiens
atagaatcctaaaca

SEQ ID NO: 186407 - DNA, 15 bp, Homo sapiens
tatagaatcctaaac

SEQ ID NO: 186408 - DNA, 15 bp, Homo sapiens
ctatagaatcctaaa

SEQ ID NO: 186409 - DNA, 15 bp, Homo sapiens
cctatagaatcctaa

SEQ ID NO: 186410 - DNA, 15 bp, Homo sapiens
acctatagaatccta

SEQ ID NO: 186411 - DNA, 15 bp, Homo sapiens
gacctatagaatcct

SEQ ID NO: 186412 - DNA, 15 bp, Homo sapiens
tgacctatagaatcc

SEQ ID NO: 186413 - DNA, 15 bp, Homo sapiens
atgacctatagaatc

SEQ ID NO: 186414 - DNA, 15 bp, Homo sapiens
aatgacctatagaat

SEQ ID NO: 186415 - DNA, 15 bp, Homo sapiens
aaatgacctatagaa

SEQ ID NO: 186416 - DNA, 15 bp, Homo sapiens
caaatgacctataga

SEQ ID NO: 186417 - DNA, 15 bp, Homo sapiens
tcaaatgacctatag

SEQ ID NO: 186418 - DNA, 15 bp, Homo sapiens
ctcaaatgacctata

SEQ ID NO: 186419 - DNA, 15 bp, Homo sapiens
cctcaaatgacctat

SEQ ID NO: 186420 - DNA, 15 bp, Homo sapiens
tcctcaaatgaccta

SEQ ID NO: 186421 - DNA, 15 bp, Homo sapiens
ttcctcaaatgacct

SEQ ID NO: 186422 - DNA, 15 bp, Homo sapiens
gttcctcaaatgacc

SEQ ID NO: 186423 - DNA, 15 bp, Homo sapiens
tgttcctcaaatgac

SEQ ID NO: 186424 - DNA, 15 bp, Homo sapiens
ttgttcctcaaatga

SEQ ID NO: 186425 - DNA, 15 bp, Homo sapiens
tttgttcctcaaatg

SEQ ID NO: 186426 - DNA, 15 bp, Homo sapiens
atttgttcctcaaat

SEQ ID NO: 186427 - DNA, 15 bp, Homo sapiens
tatttgttcctcaaa

SEQ ID NO: 186428 - DNA, 15 bp, Homo sapiens
ttatttgttcctcaa

SEQ ID NO: 186429 - DNA, 15 bp, Homo sapiens
tttatttgttcctca

SEQ ID NO: 186430 - DNA, 15 bp, Homo sapiens
atttatttgttcctc

SEQ ID NO: 186431 - DNA, 15 bp, Homo sapiens
aatttatttgttcct

SEQ ID NO: 186432 - DNA, 15 bp, Homo sapiens
aaatttatttgttcc

SEQ ID NO: 186433 - DNA, 15 bp, Homo sapiens
taaatttatttgttc

SEQ ID NO: 186434 - DNA, 15 bp, Homo sapiens
ttaaatttatttgtt

SEQ ID NO: 186435 - DNA, 15 bp, Homo sapiens
gttaaatttatttgt

SEQ ID NO: 186436 - DNA, 15 bp, Homo sapiens
agttaaatttatttg

SEQ ID NO: 186437 - DNA, 15 bp, Homo sapiens
aagttaaatttattt

SEQ ID NO: 186438 - DNA, 15 bp, Homo sapiens
aaagttaaatttatt

SEQ ID NO: 186439 - DNA, 15 bp, Homo sapiens
aaaagttaaatttat

SEQ ID NO: 186440 - DNA, 15 bp, Homo sapiens
aaaaagttaaattta

SEQ ID NO: 186441 - DNA, 15 bp, Homo sapiens
aaaaaagttaaattt

SEQ ID NO: 186442 - DNA, 15 bp, Homo sapiens
gaaaaaagttaaatt

SEQ ID NO: 186443 - DNA, 15 bp, Homo sapiens
aagaaaaaagttaaa

SEQ ID NO: 186444 - DNA, 15 bp, Homo sapiens
gaagaaaaaagttaa

SEQ ID NO: 186445 - DNA, 15 bp, Homo sapiens
tgaagaaaaaagtta

SEQ ID NO: 186446 - DNA, 15 bp, Homo sapiens
atgaagaaaaaagtt

SEQ ID NO: 186447 - DNA, 15 bp, Homo sapiens
aatgaagaaaaaagt

SEQ ID NO: 186448 - DNA, 15 bp, Homo sapiens
taatgaagaaaaaag

SEQ ID NO: 186449 - DNA, 15 bp, Homo sapiens
ataatgaagaaaaaa

SEQ ID NO: 186450 - DNA, 15 bp, Homo sapiens
taaataatgaagaaa

SEQ ID NO: 186451 - DNA, 15 bp, Homo sapiens
ttaaataatgaagaa

SEQ ID NO: 186452 - DNA, 15 bp, Homo sapiens
tttaaataatgaaga

SEQ ID NO: 186453 - DNA, 15 bp, Homo sapiens
ctttaaataatgaag

SEQ ID NO: 186454 - DNA, 15 bp, Homo sapiens
tctttaaataatgaa

SEQ ID NO: 186455 - DNA, 15 bp, Homo sapiens
ctctttaaataatga

SEQ ID NO: 186456 - DNA, 15 bp, Homo sapiens
gctctttaaataatg

SEQ ID NO: 186457 - DNA, 15 bp, Homo sapiens
agctctttaaataat

SEQ ID NO: 186458 - DNA, 15 bp, Homo sapiens
aagctctttaaataa

SEQ ID NO: 186459 - DNA, 15 bp, Homo sapiens
taagctctttaaata

SEQ ID NO: 186460 - DNA, 15 bp, Homo sapiens
ttaagctctttaaat

SEQ ID NO: 186461 - DNA, 15 bp, Homo sapiens
gttaagctctttaaa

SEQ ID NO: 186462 - DNA, 15 bp, Homo sapiens
agttaagctctttaa

SEQ ID NO: 186463 - DNA, 15 bp, Homo sapiens
gagttaagctcttta

SEQ ID NO: 186464 - DNA, 15 bp, Homo sapiens
ggagttaagctcttt

SEQ ID NO: 186465 - DNA, 15 bp, Homo sapiens
gggagttaagctctt

SEQ ID NO: 186466 - DNA, 15 bp, Homo sapiens
agggagttaagctct

SEQ ID NO: 186467 - DNA, 15 bp, Homo sapiens
aagggagttaagctc

SEQ ID NO: 186468 - DNA, 15 bp, Homo sapiens
caagggagttaagct

SEQ ID NO: 186469 - DNA, 15 bp, Homo sapiens
ccaagggagttaagc

SEQ ID NO: 186470 - DNA, 15 bp, Homo sapiens
cccaagggagttaag

SEQ ID NO: 186471 - DNA, 15 bp, Homo sapiens
ccccaagggagttaa

SEQ ID NO: 186472 - DNA, 15 bp, Homo sapiens
accccaagggagtta

SEQ ID NO: 186473 - DNA, 15 bp, Homo sapiens
caccccaagggagtt

SEQ ID NO: 186474 - DNA, 15 bp, Homo sapiens
tcaccccaagggagt

SEQ ID NO: 186475 - DNA, 15 bp, Homo sapiens
gtcaccccaagggag

SEQ ID NO: 186476 - DNA, 15 bp, Homo sapiens
tgtcaccccaaggga

SEQ ID NO: 186477 - DNA, 15 bp, Homo sapiens
ttgtcaccccaaggg

SEQ ID NO: 186478 - DNA, 15 bp, Homo sapiens
cttgtcaccccaagg

SEQ ID NO: 186479 - DNA, 15 bp, Homo sapiens
ccttgtcaccccaag

SEQ ID NO: 186480 - DNA, 15 bp, Homo sapiens
tccttgtcaccccaa

SEQ ID NO: 186481 - DNA, 15 bp, Homo sapiens
ttccttgtcacccca

SEQ ID NO: 186482 - DNA, 15 bp, Homo sapiens
cttccttgtcacccc

SEQ ID NO: 186483 - DNA, 15 bp, Homo sapiens
ccttccttgtcaccc

SEQ ID NO: 186484 - DNA, 15 bp, Homo sapiens
cccttccttgtcacc

SEQ ID NO: 186485 - DNA, 15 bp, Homo sapiens
tcccttccttgtcac

SEQ ID NO: 186486 - DNA, 15 bp, Homo sapiens
ttcccttccttgtca

SEQ ID NO: 186487 - DNA, 15 bp, Homo sapiens
tttcccttccttgtc

SEQ ID NO: 186488 - DNA, 15 bp, Homo sapiens
ctttcccttccttgt

SEQ ID NO: 186489 - DNA, 15 bp, Homo sapiens
gctttcccttccttg

SEQ ID NO: 186490 - DNA, 15 bp, Homo sapiens
tgctttcccttcctt

SEQ ID NO: 186491 - DNA, 15 bp, Homo sapiens
gtgctttcccttcct

SEQ ID NO: 186492 - DNA, 15 bp, Homo sapiens
tgtgctttcccttcc

SEQ ID NO: 186493 - DNA, 15 bp, Homo sapiens
atgtgctttcccttc

SEQ ID NO: 186494 - DNA, 15 bp, Homo sapiens
aatgtgctttccctt

SEQ ID NO: 186495 - DNA, 15 bp, Homo sapiens
caatgtgctttccct

SEQ ID NO: 186496 - DNA, 15 bp, Homo sapiens
ccaatgtgctttccc

SEQ ID NO: 186497 - DNA, 15 bp, Homo sapiens
gccaatgtgctttcc

SEQ ID NO: 186498 - DNA, 15 bp, Homo sapiens
tgccaatgtgctttc

SEQ ID NO: 186499 - DNA, 15 bp, Homo sapiens
ttgccaatgtgcttt

SEQ ID NO: 186500 - DNA, 15 bp, Homo sapiens
tttgccaatgtgctt

SEQ ID NO: 186501 - DNA, 15 bp, Homo sapiens
ttttgccaatgtgct

SEQ ID NO: 186502 - DNA, 15 bp, Homo sapiens
gttttgccaatgtgc

SEQ ID NO: 186503 - DNA, 15 bp, Homo sapiens
tgttttgccaatgtg

SEQ ID NO: 186504 - DNA, 15 bp, Homo sapiens
ttgttttgccaatgt

SEQ ID NO: 186505 - DNA, 15 bp, Homo sapiens
gttgttttgccaatg

SEQ ID NO: 186506 - DNA, 15 bp, Homo sapiens
ggttgttttgccaat

SEQ ID NO: 186507 - DNA, 15 bp, Homo sapiens
aggttgttttgccaa

SEQ ID NO: 186508 - DNA, 15 bp, Homo sapiens
caggttgttttgcca

SEQ ID NO: 186509 - DNA, 15 bp, Homo sapiens
acaggttgttttgcc

SEQ ID NO: 186510 - DNA, 15 bp, Homo sapiens
tacaggttgttttgc

SEQ ID NO: 186511 - DNA, 15 bp, Homo sapiens
ttacaggttgttttg

SEQ ID NO: 186512 - DNA, 15 bp, Homo sapiens
tttacaggttgtttt

SEQ ID NO: 186513 - DNA, 15 bp, Homo sapiens
gtttacaggttgttt

SEQ ID NO: 186514 - DNA, 15 bp, Homo sapiens
tgtttacaggttgtt

SEQ ID NO: 186515 - DNA, 15 bp, Homo sapiens
ttgtttacaggttgt

SEQ ID NO: 186516 - DNA, 15 bp, Homo sapiens
cttgtttacaggttg

SEQ ID NO: 186517 - DNA, 15 bp, Homo sapiens
gcttgtttacaggtt

SEQ ID NO: 186518 - DNA, 15 bp, Homo sapiens
ggcttgtttacaggt

SEQ ID NO: 186519 - DNA, 15 bp, Homo sapiens
tggcttgtttacagg

SEQ ID NO: 186520 - DNA, 15 bp, Homo sapiens
ttggcttgtttacag

SEQ ID NO: 186521 - DNA, 15 bp, Homo sapiens
cttggcttgtttaca

SEQ ID NO: 186522 - DNA, 15 bp, Homo sapiens
ccttggcttgtttac

SEQ ID NO: 186523 - DNA, 15 bp, Homo sapiens
gccttggcttgttta

SEQ ID NO: 186524 - DNA, 15 bp, Homo sapiens
tgccttggcttgttt

SEQ ID NO: 186525 - DNA, 15 bp, Homo sapiens
ttgccttggcttgtt

SEQ ID NO: 186526 - DNA, 15 bp, Homo sapiens
gttgccttggcttgt

SEQ ID NO: 186527 - DNA, 15 bp, Homo sapiens
tgttgccttggcttg

SEQ ID NO: 186528 - DNA, 15 bp, Homo sapiens
atgttgccttggctt

SEQ ID NO: 186529 - DNA, 15 bp, Homo sapiens
catgttgccttggct

SEQ ID NO: 186530 - DNA, 15 bp, Homo sapiens
acatgttgccttggc

SEQ ID NO: 186531 - DNA, 15 bp, Homo sapiens
tacatgttgccttgg

SEQ ID NO: 186532 - DNA, 15 bp, Homo sapiens
ttacatgttgccttg

SEQ ID NO: 186533 - DNA, 15 bp, Homo sapiens
tttacatgttgcctt

SEQ ID NO: 186534 - DNA, 15 bp, Homo sapiens
atttacatgttgcct

SEQ ID NO: 186535 - DNA, 15 bp, Homo sapiens
tatttacatgttgcc

SEQ ID NO: 186536 - DNA, 15 bp, Homo sapiens
ttatttacatgttgc

SEQ ID NO: 186537 - DNA, 15 bp, Homo sapiens
cttatttacatgttg

SEQ ID NO: 186538 - DNA, 15 bp, Homo sapiens
ccttatttacatgtt

SEQ ID NO: 186539 - DNA, 15 bp, Homo sapiens
accttatttacatgt

SEQ ID NO: 186540 - DNA, 15 bp, Homo sapiens
taccttatttacatg

SEQ ID NO: 186541 - DNA, 15 bp, Homo sapiens
gtaccttatttacat

SEQ ID NO: 186542 - DNA, 15 bp, Homo sapiens
tgtaccttatttaca

SEQ ID NO: 186543 - DNA, 15 bp, Homo sapiens
ctgtaccttatttac

SEQ ID NO: 186544 - DNA, 15 bp, Homo sapiens
cctgtaccttattta

SEQ ID NO: 186545 - DNA, 15 bp, Homo sapiens
ccctgtaccttattt

SEQ ID NO: 186546 - DNA, 15 bp, Homo sapiens
accctgtaccttatt

SEQ ID NO: 186547 - DNA, 15 bp, Homo sapiens
taccctgtaccttat

SEQ ID NO: 186548 - DNA, 15 bp, Homo sapiens
ttaccctgtacctta

SEQ ID NO: 186549 - DNA, 15 bp, Homo sapiens
gttaccctgtacctt

SEQ ID NO: 186550 - DNA, 15 bp, Homo sapiens
tgttaccctgtacct

SEQ ID NO: 186551 - DNA, 15 bp, Homo sapiens
ctgttaccctgtacc

SEQ ID NO: 186552 - DNA, 15 bp, Homo sapiens
actgttaccctgtac

SEQ ID NO: 186553 - DNA, 15 bp, Homo sapiens
tactgttaccctgta

SEQ ID NO: 186554 - DNA, 15 bp, Homo sapiens
gtactgttaccctgt

SEQ ID NO: 186555 - DNA, 15 bp, Homo sapiens
tgtactgttaccctg

SEQ ID NO: 186556 - DNA, 15 bp, Homo sapiens
ctgtactgttaccct

SEQ ID NO: 186557 - DNA, 15 bp, Homo sapiens
gctgtactgttaccc

SEQ ID NO: 186558 - DNA, 15 bp, Homo sapiens
tgctgtactgttacc

SEQ ID NO: 186559 - DNA, 15 bp, Homo sapiens
atgctgtactgttac

SEQ ID NO: 186560 - DNA, 15 bp, Homo sapiens
tatgctgtactgtta

SEQ ID NO: 186561 - DNA, 15 bp, Homo sapiens
ttatgctgtactgtt

SEQ ID NO: 186562 - DNA, 15 bp, Homo sapiens
attatgctgtactgt

SEQ ID NO: 186563 - DNA, 15 bp, Homo sapiens
cattatgctgtactg

SEQ ID NO: 186564 - DNA, 15 bp, Homo sapiens
ccattatgctgtact

SEQ ID NO: 186565 - DNA, 15 bp, Homo sapiens
tccattatgctgtac

SEQ ID NO: 186566 - DNA, 15 bp, Homo sapiens
ctccattatgctgta

SEQ ID NO: 186567 - DNA, 15 bp, Homo sapiens
tctccattatgctgt

SEQ ID NO: 186568 - DNA, 15 bp, Homo sapiens
atctccattatgctg

SEQ ID NO: 186569 - DNA, 15 bp, Homo sapiens
catctccattatgct

SEQ ID NO: 186570 - DNA, 15 bp, Homo sapiens
ccatctccattatgc

SEQ ID NO: 186571 - DNA, 15 bp, Homo sapiens
gccatctccattatg

SEQ ID NO: 186572 - DNA, 15 bp, Homo sapiens
ggccatctccattat

SEQ ID NO: 186573 - DNA, 15 bp, Homo sapiens
cggccatctccatta

SEQ ID NO: 186574 - DNA, 15 bp, Homo sapiens
tcggccatctccatt

SEQ ID NO: 186575 - DNA, 15 bp, Homo sapiens
atcggccatctccat

SEQ ID NO: 186576 - DNA, 15 bp, Homo sapiens
aatcggccatctcca

SEQ ID NO: 186577 - DNA, 15 bp, Homo sapiens
aaatcggccatctcc

SEQ ID NO: 186578 - DNA, 15 bp, Homo sapiens
caaatcggccatctc

SEQ ID NO: 186579 - DNA, 15 bp, Homo sapiens
ccaaatcggccatct

SEQ ID NO: 186580 - DNA, 15 bp, Homo sapiens
tccaaatcggccatc

SEQ ID NO: 186581 - DNA, 15 bp, Homo sapiens
atccaaatcggccat

SEQ ID NO: 186582 - DNA, 15 bp, Homo sapiens
tatccaaatcggcca

SEQ ID NO: 186583 - DNA, 15 bp, Homo sapiens
ctatccaaatcggcc

SEQ ID NO: 186584 - DNA, 15 bp, Homo sapiens
cctatccaaatcggc

SEQ ID NO: 186585 - DNA, 15 bp, Homo sapiens
ccctatccaaatcgg

SEQ ID NO: 186586 - DNA, 15 bp, Homo sapiens
tccctatccaaatcg

SEQ ID NO: 186587 - DNA, 15 bp, Homo sapiens
ttccctatccaaatc

SEQ ID NO: 186588 - DNA, 15 bp, Homo sapiens
attccctatccaaat

SEQ ID NO: 186589 - DNA, 15 bp, Homo sapiens
aattccctatccaaa

SEQ ID NO: 186590 - DNA, 15 bp, Homo sapiens
caattccctatccaa

SEQ ID NO: 186591 - DNA, 15 bp, Homo sapiens
acaattccctatcca

SEQ ID NO: 186592 - DNA, 15 bp, Homo sapiens
aacaattccctatcc

SEQ ID NO: 186593 - DNA, 15 bp, Homo sapiens
caacaattccctatc

SEQ ID NO: 186594 - DNA, 15 bp, Homo sapiens
tcaacaattccctat

SEQ ID NO: 186595 - DNA, 15 bp, Homo sapiens
ttcaacaattcccta

SEQ ID NO: 186596 - DNA, 15 bp, Homo sapiens
attcaacaattccct

SEQ ID NO: 186597 - DNA, 15 bp, Homo sapiens
aattcaacaattccc

SEQ ID NO: 186598 - DNA, 15 bp, Homo sapiens
taattcaacaattcc

SEQ ID NO: 186599 - DNA, 15 bp, Homo sapiens
ctaattcaacaattc

SEQ ID NO: 186600 - DNA, 15 bp, Homo sapiens
cctaattcaacaatt

SEQ ID NO: 186601 - DNA, 15 bp, Homo sapiens
ccctaattcaacaat

SEQ ID NO: 186602 - DNA, 15 bp, Homo sapiens
accctaattcaacaa

SEQ ID NO: 186603 - DNA, 15 bp, Homo sapiens
aaccctaattcaaca

SEQ ID NO: 186604 - DNA, 15 bp, Homo sapiens
aaaccctaattcaac

SEQ ID NO: 186605 - DNA, 15 bp, Homo sapiens
aaaaccctaattcaa

SEQ ID NO: 186606 - DNA, 15 bp, Homo sapiens
taaaaccctaattca

SEQ ID NO: 186607 - DNA, 15 bp, Homo sapiens
ttaaaaccctaattc

SEQ ID NO: 186608 - DNA, 15 bp, Homo sapiens
attaaaaccctaatt

SEQ ID NO: 186609 - DNA, 15 bp, Homo sapiens
cattaaaaccctaat

SEQ ID NO: 186610 - DNA, 15 bp, Homo sapiens
gcattaaaaccctaa

SEQ ID NO: 186611 - DNA, 15 bp, Homo sapiens
tgcattaaaacccta

SEQ ID NO: 186612 - DNA, 15 bp, Homo sapiens
ctgcattaaaaccct

SEQ ID NO: 186613 - DNA, 15 bp, Homo sapiens
cctgcattaaaaccc

SEQ ID NO: 186614 - DNA, 15 bp, Homo sapiens
ccctgcattaaaacc

SEQ ID NO: 186615 - DNA, 15 bp, Homo sapiens
gccctgcattaaaac

SEQ ID NO: 186616 - DNA, 15 bp, Homo sapiens
agccctgcattaaaa

SEQ ID NO: 186617 - DNA, 15 bp, Homo sapiens
aagccctgcattaaa

SEQ ID NO: 186618 - DNA, 15 bp, Homo sapiens
aaagccctgcattaa

SEQ ID NO: 186619 - DNA, 15 bp, Homo sapiens
caaagccctgcatta

SEQ ID NO: 186620 - DNA, 15 bp, Homo sapiens
tcaaagccctgcatt

SEQ ID NO: 186621 - DNA, 15 bp, Homo sapiens
ctcaaagccctgcat

SEQ ID NO: 186622 - DNA, 15 bp, Homo sapiens
actcaaagccctgca

SEQ ID NO: 186623 - DNA, 15 bp, Homo sapiens
tactcaaagccctgc

SEQ ID NO: 186624 - DNA, 15 bp, Homo sapiens
ctactcaaagccctg

SEQ ID NO: 186625 - DNA, 15 bp, Homo sapiens
tctactcaaagccct

SEQ ID NO: 186626 - DNA, 15 bp, Homo sapiens
ttctactcaaagccc

SEQ ID NO: 186627 - DNA, 15 bp, Homo sapiens
cttctactcaaagcc

SEQ ID NO: 186628 - DNA, 15 bp, Homo sapiens
ccttctactcaaagc

SEQ ID NO: 186629 - DNA, 15 bp, Homo sapiens
accttctactcaaag

SEQ ID NO: 186630 - DNA, 15 bp, Homo sapiens
caccttctactcaaa

SEQ ID NO: 186631 - DNA, 15 bp, Homo sapiens
ccaccttctactcaa

SEQ ID NO: 186632 - DNA, 15 bp, Homo sapiens
tccaccttctactca

SEQ ID NO: 186633 - DNA, 15 bp, Homo sapiens
ttccaccttctactc

SEQ ID NO: 186634 - DNA, 15 bp, Homo sapiens
tttccaccttctact

SEQ ID NO: 186635 - DNA, 15 bp, Homo sapiens
atttccaccttctac

SEQ ID NO: 186636 - DNA, 15 bp, Homo sapiens
aatttccaccttcta

SEQ ID NO: 186637 - DNA, 15 bp, Homo sapiens
caatttccaccttct

SEQ ID NO: 186638 - DNA, 15 bp, Homo sapiens
tcaatttccaccttc

SEQ ID NO: 186639 - DNA, 15 bp, Homo sapiens
ttcaatttccacctt

SEQ ID NO: 186640 - DNA, 15 bp, Homo sapiens
attcaatttccacct

SEQ ID NO: 186641 - DNA, 15 bp, Homo sapiens
aattcaatttccacc

SEQ ID NO: 186642 - DNA, 15 bp, Homo sapiens
caattcaatttccac

SEQ ID NO: 186643 - DNA, 15 bp, Homo sapiens
ccaattcaatttcca

SEQ ID NO: 186644 - DNA, 15 bp, Homo sapiens
accaattcaatttcc

SEQ ID NO: 186645 - DNA, 15 bp, Homo sapiens
gaccaattcaatttc

SEQ ID NO: 186646 - DNA, 15 bp, Homo sapiens
ggaccaattcaattt

SEQ ID NO: 186647 - DNA, 15 bp, Homo sapiens
aggaccaattcaatt

SEQ ID NO: 186648 - DNA, 15 bp, Homo sapiens
gaggaccaattcaat

SEQ ID NO: 186649 - DNA, 15 bp, Homo sapiens
tgaggaccaattcaa

SEQ ID NO: 186650 - DNA, 15 bp, Homo sapiens
ctgaggaccaattca

SEQ ID NO: 186651 - DNA, 15 bp, Homo sapiens
actgaggaccaattc

SEQ ID NO: 186652 - DNA, 15 bp, Homo sapiens
cactgaggaccaatt

SEQ ID NO: 186653 - DNA, 15 bp, Homo sapiens
ccactgaggaccaat

SEQ ID NO: 186654 - DNA, 15 bp, Homo sapiens
cccactgaggaccaa

SEQ ID NO: 186655 - DNA, 15 bp, Homo sapiens
acccactgaggacca

SEQ ID NO: 186656 - DNA, 15 bp, Homo sapiens
cacccactgaggacc

SEQ ID NO: 186657 - DNA, 15 bp, Homo sapiens
ccacccactgaggac

SEQ ID NO: 186658 - DNA, 15 bp, Homo sapiens
tccacccactgagga

SEQ ID NO: 186659 - DNA, 15 bp, Homo sapiens
atccacccactgagg

SEQ ID NO: 186660 - DNA, 15 bp, Homo sapiens
tatccacccactgag

SEQ ID NO: 186661 - DNA, 15 bp, Homo sapiens
ttatccacccactga

SEQ ID NO: 186662 - DNA, 15 bp, Homo sapiens
tttatccacccactg

SEQ ID NO: 186663 - DNA, 15 bp, Homo sapiens
ttttatccacccact

SEQ ID NO: 186664 - DNA, 15 bp, Homo sapiens
attttatccacccac

SEQ ID NO: 186665 - DNA, 15 bp, Homo sapiens
aattttatccaccca

SEQ ID NO: 186666 - DNA, 15 bp, Homo sapiens
aaattttatccaccc

SEQ ID NO: 186667 - DNA, 15 bp, Homo sapiens
caaattttatccacc

SEQ ID NO: 186668 - DNA, 15 bp, Homo sapiens
tcaaattttatccac

SEQ ID NO: 186669 - DNA, 15 bp, Homo sapiens
ttcaaattttatcca

SEQ ID NO: 186670 - DNA, 15 bp, Homo sapiens
attcaaattttatcc

SEQ ID NO: 186671 - DNA, 15 bp, Homo sapiens
tattcaaattttatc

SEQ ID NO: 186672 - DNA, 15 bp, Homo sapiens
ctattcaaattttat

SEQ ID NO: 186673 - DNA, 15 bp, Homo sapiens
tctattcaaatttta

SEQ ID NO: 186674 - DNA, 15 bp, Homo sapiens
atctattcaaatttt

SEQ ID NO: 186675 - DNA, 15 bp, Homo sapiens
aatctattcaaattt

SEQ ID NO: 186676 - DNA, 15 bp, Homo sapiens
aaatctattcaaatt

SEQ ID NO: 186677 - DNA, 15 bp, Homo sapiens
taaatctattcaaat

SEQ ID NO: 186678 - DNA, 15 bp, Homo sapiens
ttaaatctattcaaa

SEQ ID NO: 186679 - DNA, 15 bp, Homo sapiens
tttaaatctattcaa

SEQ ID NO: 186680 - DNA, 15 bp, Homo sapiens
ttttaaatctattca

SEQ ID NO: 186681 - DNA, 15 bp, Homo sapiens
tttttaaatctattc

SEQ ID NO: 186682 - DNA, 15 bp, Homo sapiens
ttttttaaatctatt

SEQ ID NO: 186683 - DNA, 15 bp, Homo sapiens
tttttttaaatctat

SEQ ID NO: 186684 - DNA, 15 bp, Homo sapiens
ttttttttaaatcta

SEQ ID NO: 186685 - DNA, 15 bp, Homo sapiens
gttttttttaaatct

SEQ ID NO: 186686 - DNA, 15 bp, Homo sapiens
tgttttttttaaatc

SEQ ID NO: 186687 - DNA, 15 bp, Homo sapiens
ttgttttttttaaat

SEQ ID NO: 186688 - DNA, 15 bp, Homo sapiens
tttgttttttttaaa

SEQ ID NO: 186689 - DNA, 15 bp, Homo sapiens
ttttgttttttttaa

SEQ ID NO: 186690 - DNA, 15 bp, Homo sapiens
gttttgtttttttta

SEQ ID NO: 186691 - DNA, 15 bp, Homo sapiens
gtgttttgttttttt

SEQ ID NO: 186692 - DNA, 15 bp, Homo sapiens
cgtgttttgtttttt

SEQ ID NO: 186693 - DNA, 15 bp, Homo sapiens
tcgtgttttgttttt

SEQ ID NO: 186694 - DNA, 15 bp, Homo sapiens
ctcgtgttttgtttt

SEQ ID NO: 186695 - DNA, 15 bp, Homo sapiens
cctcgtgttttgttt

SEQ ID NO: 186696 - DNA, 15 bp, Homo sapiens
tcctcgtgttttgtt

SEQ ID NO: 186697 - DNA, 15 bp, Homo sapiens
ctcctcgtgttttgt

SEQ ID NO: 186698 - DNA, 15 bp, Homo sapiens
cctcctcgtgttttg

SEQ ID NO: 186699 - DNA, 15 bp, Homo sapiens
gcctcctcgtgtttt

SEQ ID NO: 186700 - DNA, 15 bp, Homo sapiens
agcctcctcgtgttt

SEQ ID NO: 186701 - DNA, 15 bp, Homo sapiens
tagcctcctcgtgtt

SEQ ID NO: 186702 - DNA, 15 bp, Homo sapiens
atagcctcctcgtgt

SEQ ID NO: 186703 - DNA, 15 bp, Homo sapiens
aatagcctcctcgtg

SEQ ID NO: 186704 - DNA, 15 bp, Homo sapiens
taatagcctcctcgt

SEQ ID NO: 186705 - DNA, 15 bp, Homo sapiens
ataatagcctcctcg

SEQ ID NO: 186706 - DNA, 15 bp, Homo sapiens
aataatagcctcctc

SEQ ID NO: 186707 - DNA, 15 bp, Homo sapiens
aaataatagcctcct

SEQ ID NO: 186708 - DNA, 15 bp, Homo sapiens
taaataatagcctcc

SEQ ID NO: 186709 - DNA, 15 bp, Homo sapiens
ttaaataatagcctc

SEQ ID NO: 186710 - DNA, 15 bp, Homo sapiens
cttaaataatagcct

SEQ ID NO: 186711 - DNA, 15 bp, Homo sapiens
tcttaaataatagcc

SEQ ID NO: 186712 - DNA, 15 bp, Homo sapiens
ttcttaaataatagc

SEQ ID NO: 186713 - DNA, 15 bp, Homo sapiens
tttcttaaataatag

SEQ ID NO: 186714 - DNA, 15 bp, Homo sapiens
ttttcttaaataata

SEQ ID NO: 186715 - DNA, 15 bp, Homo sapiens
attttcttaaataat

SEQ ID NO: 186716 - DNA, 15 bp, Homo sapiens
tattttcttaaataa

SEQ ID NO: 186717 - DNA, 15 bp, Homo sapiens
ctattttcttaaata

SEQ ID NO: 186718 - DNA, 15 bp, Homo sapiens
tctattttcttaaat

SEQ ID NO: 186719 - DNA, 15 bp, Homo sapiens
ttctattttcttaaa

SEQ ID NO: 186720 - DNA, 15 bp, Homo sapiens
attctattttcttaa

SEQ ID NO: 186721 - DNA, 15 bp, Homo sapiens
gattctattttctta

SEQ ID NO: 186722 - DNA, 15 bp, Homo sapiens
ggattctattttctt

SEQ ID NO: 186723 - DNA, 15 bp, Homo sapiens
aggattctattttct

SEQ ID NO: 186724 - DNA, 15 bp, Homo sapiens
caggattctattttc

SEQ ID NO: 186725 - DNA, 15 bp, Homo sapiens
acaggattctatttt

SEQ ID NO: 186726 - DNA, 15 bp, Homo sapiens
gacaggattctattt

SEQ ID NO: 186727 - DNA, 15 bp, Homo sapiens
tgacaggattctatt

SEQ ID NO: 186728 - DNA, 15 bp, Homo sapiens
ttgacaggattctat

SEQ ID NO: 186729 - DNA, 15 bp, Homo sapiens
gttgacaggattcta

SEQ ID NO: 186730 - DNA, 15 bp, Homo sapiens
tgttgacaggattct

SEQ ID NO: 186731 - DNA, 15 bp, Homo sapiens
ctgttgacaggattc

SEQ ID NO: 186732 - DNA, 15 bp, Homo sapiens
tctgttgacaggatt

SEQ ID NO: 186733 - DNA, 15 bp, Homo sapiens
ctctgttgacaggat

SEQ ID NO: 186734 - DNA, 15 bp, Homo sapiens
tctctgttgacagga

SEQ ID NO: 186735 - DNA, 15 bp, Homo sapiens
ttctctgttgacagg

SEQ ID NO: 186736 - DNA, 15 bp, Homo sapiens
tttctctgttgacag

SEQ ID NO: 186737 - DNA, 15 bp, Homo sapiens
ttttctctgttgaca

SEQ ID NO: 186738 - DNA, 15 bp, Homo sapiens
tttttctctgttgac

SEQ ID NO: 186739 - DNA, 15 bp, Homo sapiens
ctttttctctgttga

SEQ ID NO: 186740 - DNA, 15 bp, Homo sapiens
actttttctctgttg

SEQ ID NO: 186741 - DNA, 15 bp, Homo sapiens
tactttttctctgtt

SEQ ID NO: 186742 - DNA, 15 bp, Homo sapiens
gtactttttctctgt

SEQ ID NO: 186743 - DNA, 15 bp, Homo sapiens
tgtactttttctctg

SEQ ID NO: 186744 - DNA, 15 bp, Homo sapiens
ttgtactttttctct

SEQ ID NO: 186745 - DNA, 15 bp, Homo sapiens
tttgtactttttctc

SEQ ID NO: 186746 - DNA, 15 bp, Homo sapiens
ctttgtactttttct

SEQ ID NO: 186747 - DNA, 15 bp, Homo sapiens
actttgtactttttc

SEQ ID NO: 186748 - DNA, 15 bp, Homo sapiens
cactttgtacttttt

SEQ ID NO: 186749 - DNA, 15 bp, Homo sapiens
gcactttgtactttt

SEQ ID NO: 186750 - DNA, 15 bp, Homo sapiens
tgcactttgtacttt

SEQ ID NO: 186751 - DNA, 15 bp, Homo sapiens
atgcactttgtactt

SEQ ID NO: 186752 - DNA, 15 bp, Homo sapiens
gatgcactttgtact

SEQ ID NO: 186753 - DNA, 15 bp, Homo sapiens
tgatgcactttgtac

SEQ ID NO: 186754 - DNA, 15 bp, Homo sapiens
ctgatgcactttgta

SEQ ID NO: 186755 - DNA, 15 bp, Homo sapiens
cctgatgcactttgt

SEQ ID NO: 186756 - DNA, 15 bp, Homo sapiens
ccctgatgcactttg

SEQ ID NO: 186757 - DNA, 15 bp, Homo sapiens
gccctgatgcacttt

SEQ ID NO: 186758 - DNA, 15 bp, Homo sapiens
tgccctgatgcactt

SEQ ID NO: 186759 - DNA, 15 bp, Homo sapiens
atgccctgatgcact

SEQ ID NO: 186760 - DNA, 15 bp, Homo sapiens
catgccctgatgcac

SEQ ID NO: 186761 - DNA, 15 bp, Homo sapiens
gcatgccctgatgca

SEQ ID NO: 186762 - DNA, 15 bp, Homo sapiens
agcatgccctgatgc

SEQ ID NO: 186763 - DNA, 15 bp, Homo sapiens
tagcatgccctgatg

SEQ ID NO: 186764 - DNA, 15 bp, Homo sapiens
ctagcatgccctgat

SEQ ID NO: 186765 - DNA, 15 bp, Homo sapiens
cctagcatgccctga

SEQ ID NO: 186766 - DNA, 15 bp, Homo sapiens
tcctagcatgccctg

SEQ ID NO: 186767 - DNA, 15 bp, Homo sapiens
ttcctagcatgccct

SEQ ID NO: 186768 - DNA, 15 bp, Homo sapiens
tttcctagcatgccc

SEQ ID NO: 186769 - DNA, 15 bp, Homo sapiens
ctttcctagcatgcc

SEQ ID NO: 186770 - DNA, 15 bp, Homo sapiens
gctttcctagcatgc

SEQ ID NO: 186771 - DNA, 15 bp, Homo sapiens
ggctttcctagcatg

SEQ ID NO: 186772 - DNA, 15 bp, Homo sapiens
aggctttcctagcat

SEQ ID NO: 186773 - DNA, 15 bp, Homo sapiens
caggctttcctagca

SEQ ID NO: 186774 - DNA, 15 bp, Homo sapiens
acaggctttcctagc

SEQ ID NO: 186775 - DNA, 15 bp, Homo sapiens
aacaggctttcctag

SEQ ID NO: 186776 - DNA, 15 bp, Homo sapiens
caacaggctttccta

SEQ ID NO: 186777 - DNA, 15 bp, Homo sapiens
acaacaggctttcct

SEQ ID NO: 186778 - DNA, 15 bp, Homo sapiens
aacaacaggctttcc

SEQ ID NO: 186779 - DNA, 15 bp, Homo sapiens
aaacaacaggctttc

SEQ ID NO: 186780 - DNA, 15 bp, Homo sapiens
taaacaacaggcttt

SEQ ID NO: 186781 - DNA, 15 bp, Homo sapiens
ctaaacaacaggctt

SEQ ID NO: 186782 - DNA, 15 bp, Homo sapiens
tctaaacaacaggct

SEQ ID NO: 186783 - DNA, 15 bp, Homo sapiens
ttctaaacaacaggc

SEQ ID NO: 186784 - DNA, 15 bp, Homo sapiens
gttctaaacaacagg

SEQ ID NO: 186785 - DNA, 15 bp, Homo sapiens
tgttctaaacaacag

SEQ ID NO: 186786 - DNA, 15 bp, Homo sapiens
atgttctaaacaaca

SEQ ID NO: 186787 - DNA, 15 bp, Homo sapiens
aatgttctaaacaac

SEQ ID NO: 186788 - DNA, 15 bp, Homo sapiens
caatgttctaaacaa

SEQ ID NO: 186789 - DNA, 15 bp, Homo sapiens
acaatgttctaaaca

SEQ ID NO: 186790 - DNA, 15 bp, Homo sapiens
tacaatgttctaaac

SEQ ID NO: 186791 - DNA, 15 bp, Homo sapiens
ctacaatgttctaaa

SEQ ID NO: 186792 - DNA, 15 bp, Homo sapiens
cctacaatgttctaa

SEQ ID NO: 186793 - DNA, 15 bp, Homo sapiens
tcctacaatgttcta

SEQ ID NO: 186794 - DNA, 15 bp, Homo sapiens
ttcctacaatgttct

SEQ ID NO: 186795 - DNA, 15 bp, Homo sapiens
attcctacaatgttc

SEQ ID NO: 186796 - DNA, 15 bp, Homo sapiens
cattcctacaatgtt

SEQ ID NO: 186797 - DNA, 15 bp, Homo sapiens
tcattcctacaatgt

SEQ ID NO: 186798 - DNA, 15 bp, Homo sapiens
atcattcctacaatg

SEQ ID NO: 186799 - DNA, 15 bp, Homo sapiens
catcattcctacaat

SEQ ID NO: 186800 - DNA, 15 bp, Homo sapiens
gcatcattcctacaa

SEQ ID NO: 186801 - DNA, 15 bp, Homo sapiens
ggcatcattcctaca

SEQ ID NO: 186802 - DNA, 15 bp, Homo sapiens
aggcatcattcctac

SEQ ID NO: 186803 - DNA, 15 bp, Homo sapiens
caggcatcattccta

SEQ ID NO: 186804 - DNA, 15 bp, Homo sapiens
ccaggcatcattcct

SEQ ID NO: 186805 - DNA, 15 bp, Homo sapiens
accaggcatcattcc

SEQ ID NO: 186806 - DNA, 15 bp, Homo sapiens
taccaggcatcattc

SEQ ID NO: 186807 - DNA, 15 bp, Homo sapiens
ctaccaggcatcatt

SEQ ID NO: 186808 - DNA, 15 bp, Homo sapiens
cctaccaggcatcat

SEQ ID NO: 186809 - DNA, 15 bp, Homo sapiens
acctaccaggcatca

SEQ ID NO: 186810 - DNA, 15 bp, Homo sapiens
tacctaccaggcatc

SEQ ID NO: 186811 - DNA, 15 bp, Homo sapiens
ctacctaccaggcat

SEQ ID NO: 186812 - DNA, 15 bp, Homo sapiens
cctacctaccaggca

SEQ ID NO: 186813 - DNA, 15 bp, Homo sapiens
tcctacctaccaggc

SEQ ID NO: 186814 - DNA, 15 bp, Homo sapiens
atcctacctaccagg

SEQ ID NO: 186815 - DNA, 15 bp, Homo sapiens
tatcctacctaccag

SEQ ID NO: 186816 - DNA, 15 bp, Homo sapiens
ttatcctacctacca

SEQ ID NO: 186817 - DNA, 15 bp, Homo sapiens
cttatcctacctacc

SEQ ID NO: 186818 - DNA, 15 bp, Homo sapiens
aatcagaatatgcat

SEQ ID NO: 186819 - DNA, 15 bp, Homo sapiens
aaatcagaatatgca

SEQ ID NO: 186820 - DNA, 15 bp, Homo sapiens
aaaatcagaatatgc

SEQ ID NO: 186821 - DNA, 15 bp, Homo sapiens
ctaaaatcagaatat

SEQ ID NO: 186822 - DNA, 15 bp, Homo sapiens
cctaaaatcagaata

SEQ ID NO: 186823 - DNA, 15 bp, Homo sapiens
ccctaaaatcagaat

SEQ ID NO: 186824 - DNA, 15 bp, Homo sapiens
cccctaaaatcagaa

SEQ ID NO: 186825 - DNA, 15 bp, Homo sapiens
acccctaaaatcaga

SEQ ID NO: 186826 - DNA, 15 bp, Homo sapiens
aacccctaaaatcag

SEQ ID NO: 186827 - DNA, 15 bp, Homo sapiens
gaacccctaaaatca

SEQ ID NO: 186828 - DNA, 15 bp, Homo sapiens
ggaacccctaaaatc

SEQ ID NO: 186829 - DNA, 15 bp, Homo sapiens
gggaacccctaaaat

SEQ ID NO: 186830 - DNA, 15 bp, Homo sapiens
ggggaacccctaaaa

SEQ ID NO: 186831 - DNA, 15 bp, Homo sapiens
gggggaacccctaaa

SEQ ID NO: 186832 - DNA, 15 bp, Homo sapiens
ggggggaacccctaa

SEQ ID NO: 186833 - DNA, 15 bp, Homo sapiens
gggggggaaccccta

SEQ ID NO: 186834 - DNA, 15 bp, Homo sapiens
ggggggggaacccct

SEQ ID NO: 186835 - DNA, 15 bp, Homo sapiens
gggggggggaacccc

SEQ ID NO: 186836 - DNA, 15 bp, Homo sapiens
tgggggggggaaccc

SEQ ID NO: 186837 - DNA, 15 bp, Homo sapiens
gtgggggggggaacc

SEQ ID NO: 186838 - DNA, 15 bp, Homo sapiens
agtgggggggggaac

SEQ ID NO: 186839 - DNA, 15 bp, Homo sapiens
aagtgggggggggaa

SEQ ID NO: 186840 - DNA, 15 bp, Homo sapiens
aaagtggggggggga

SEQ ID NO: 186841 - DNA, 15 bp, Homo sapiens
caaagtggggggggg

SEQ ID NO: 186842 - DNA, 15 bp, Homo sapiens
ccaaagtgggggggg

SEQ ID NO: 186843 - DNA, 15 bp, Homo sapiens
accaaagtggggggg

SEQ ID NO: 186844 - DNA, 15 bp, Homo sapiens
gaccaaagtgggggg

SEQ ID NO: 186845 - DNA, 15 bp, Homo sapiens
agaccaaagtggggg

SEQ ID NO: 186846 - DNA, 15 bp, Homo sapiens
tagaccaaagtgggg

SEQ ID NO: 186847 - DNA, 15 bp, Homo sapiens
atagaccaaagtggg

SEQ ID NO: 186848 - DNA, 15 bp, Homo sapiens
catagaccaaagtgg

SEQ ID NO: 186849 - DNA, 15 bp, Homo sapiens
gcatagaccaaagtg

SEQ ID NO: 186850 - DNA, 15 bp, Homo sapiens
ggcatagaccaaagt

SEQ ID NO: 186851 - DNA, 15 bp, Homo sapiens
gggcatagaccaaag

SEQ ID NO: 186852 - DNA, 15 bp, Homo sapiens
agggcatagaccaaa

SEQ ID NO: 186853 - DNA, 15 bp, Homo sapiens
cagggcatagaccaa

SEQ ID NO: 186854 - DNA, 15 bp, Homo sapiens
tcagggcatagacca

SEQ ID NO: 186855 - DNA, 15 bp, Homo sapiens
atcagggcatagacc

SEQ ID NO: 186856 - DNA, 15 bp, Homo sapiens
catcagggcatagac

SEQ ID NO: 186857 - DNA, 15 bp, Homo sapiens
gcatcagggcataga

SEQ ID NO: 186858 - DNA, 15 bp, Homo sapiens
tgcatcagggcatag

SEQ ID NO: 186859 - DNA, 15 bp, Homo sapiens
ttgcatcagggcata

SEQ ID NO: 186860 - DNA, 15 bp, Homo sapiens
tttgcatcagggcat

SEQ ID NO: 186861 - DNA, 15 bp, Homo sapiens
ttttgcatcagggca

SEQ ID NO: 186862 - DNA, 15 bp, Homo sapiens
tttttgcatcagggc

SEQ ID NO: 186863 - DNA, 15 bp, Homo sapiens
ttttttgcatcaggg

SEQ ID NO: 186864 - DNA, 15 bp, Homo sapiens
tttttttgcatcagg

SEQ ID NO: 186865 - DNA, 15 bp, Homo sapiens
ctttttttgcatcag

SEQ ID NO: 186866 - DNA, 15 bp, Homo sapiens
actttttttgcatca

SEQ ID NO: 186867 - DNA, 15 bp, Homo sapiens
tactttttttgcatc

SEQ ID NO: 186868 - DNA, 15 bp, Homo sapiens
ttactttttttgcat

SEQ ID NO: 186869 - DNA, 15 bp, Homo sapiens
tttactttttttgca

SEQ ID NO: 186870 - DNA, 15 bp, Homo sapiens
gtttactttttttgc

SEQ ID NO: 186871 - DNA, 15 bp, Homo sapiens
agtttactttttttg

SEQ ID NO: 186872 - DNA, 15 bp, Homo sapiens
aagtttacttttttt

SEQ ID NO: 186873 - DNA, 15 bp, Homo sapiens
taagtttactttttt

SEQ ID NO: 186874 - DNA, 15 bp, Homo sapiens
gtaagtttacttttt

SEQ ID NO: 186875 - DNA, 15 bp, Homo sapiens
agtaagtttactttt

SEQ ID NO: 186876 - DNA, 15 bp, Homo sapiens
aagtaagtttacttt

SEQ ID NO: 186877 - DNA, 15 bp, Homo sapiens
taagtaagtttactt

SEQ ID NO: 186878 - DNA, 15 bp, Homo sapiens
ataagtaagtttact

SEQ ID NO: 186879 - DNA, 15 bp, Homo sapiens
tataagtaagtttac

SEQ ID NO: 186880 - DNA, 15 bp, Homo sapiens
atataagtaagttta

SEQ ID NO: 186881 - DNA, 15 bp, Homo sapiens
aatataagtaagttt

SEQ ID NO: 186882 - DNA, 15 bp, Homo sapiens
taatataagtaagtt

SEQ ID NO: 186883 - DNA, 15 bp, Homo sapiens
ttaatataagtaagt

SEQ ID NO: 186884 - DNA, 15 bp, Homo sapiens
tttaatataagtaag

SEQ ID NO: 186885 - DNA, 15 bp, Homo sapiens
ttttaatataagtaa

SEQ ID NO: 186886 - DNA, 15 bp, Homo sapiens
attttaatataagta

SEQ ID NO: 186887 - DNA, 15 bp, Homo sapiens
aattttaatataagt

SEQ ID NO: 186888 - DNA, 15 bp, Homo sapiens
aaattttaatataag

SEQ ID NO: 186889 - DNA, 15 bp, Homo sapiens
gaataatgtaaattt

SEQ ID NO: 186890 - DNA, 15 bp, Homo sapiens
agaataatgtaaatt

SEQ ID NO: 186891 - DNA, 15 bp, Homo sapiens
tagaataatgtaaat

SEQ ID NO: 186892 - DNA, 15 bp, Homo sapiens
gtagaataatgtaaa

SEQ ID NO: 186893 - DNA, 15 bp, Homo sapiens
agtagaataatgtaa

SEQ ID NO: 186894 - DNA, 15 bp, Homo sapiens
aagtagaataatgta

SEQ ID NO: 186895 - DNA, 15 bp, Homo sapiens
caagtagaataatgt

SEQ ID NO: 186896 - DNA, 15 bp, Homo sapiens
acaagtagaataatg

SEQ ID NO: 186897 - DNA, 15 bp, Homo sapiens
cacaagtagaataat

SEQ ID NO: 186898 - DNA, 15 bp, Homo sapiens
ccacaagtagaataa

SEQ ID NO: 186899 - DNA, 15 bp, Homo sapiens
accacaagtagaata

SEQ ID NO: 186900 - DNA, 15 bp, Homo sapiens
taccacaagtagaat

SEQ ID NO: 186901 - DNA, 15 bp, Homo sapiens
ctaccacaagtagaa

SEQ ID NO: 186902 - DNA, 15 bp, Homo sapiens
actaccacaagtaga

SEQ ID NO: 186903 - DNA, 15 bp, Homo sapiens
cactaccacaagtag

SEQ ID NO: 186904 - DNA, 15 bp, Homo sapiens
acactaccacaagta

SEQ ID NO: 186905 - DNA, 15 bp, Homo sapiens
gacactaccacaagt

SEQ ID NO: 186906 - DNA, 15 bp, Homo sapiens
tgacactaccacaag

SEQ ID NO: 186907 - DNA, 15 bp, Homo sapiens
gtgacactaccacaa

SEQ ID NO: 186908 - DNA, 15 bp, Homo sapiens
ggtgacactaccaca

SEQ ID NO: 186909 - DNA, 15 bp, Homo sapiens
tggtgacactaccac

SEQ ID NO: 186910 - DNA, 15 bp, Homo sapiens
atggtgacactacca

SEQ ID NO: 186911 - DNA, 15 bp, Homo sapiens
aatggtgacactacc

SEQ ID NO: 186912 - DNA, 15 bp, Homo sapiens
taatggtgacactac

SEQ ID NO: 186913 - DNA, 15 bp, Homo sapiens
ataatggtgacacta

SEQ ID NO: 186914 - DNA, 15 bp, Homo sapiens
tataatggtgacact

SEQ ID NO: 186915 - DNA, 15 bp, Homo sapiens
ttataatggtgacac

SEQ ID NO: 186916 - DNA, 15 bp, Homo sapiens
cttataatggtgaca

SEQ ID NO: 186917 - DNA, 15 bp, Homo sapiens
gcttataatggtgac

SEQ ID NO: 186918 - DNA, 15 bp, Homo sapiens
tgcttataatggtga

SEQ ID NO: 186919 - DNA, 15 bp, Homo sapiens
gtgcttataatggtg

SEQ ID NO: 186920 - DNA, 15 bp, Homo sapiens
agtgcttataatggt

SEQ ID NO: 186921 - DNA, 15 bp, Homo sapiens
cagtgcttataatgg

SEQ ID NO: 186922 - DNA, 15 bp, Homo sapiens
gcagtgcttataatg

SEQ ID NO: 186923 - DNA, 15 bp, Homo sapiens
tgcagtgcttataat

SEQ ID NO: 186924 - DNA, 15 bp, Homo sapiens
atgcagtgcttataa

SEQ ID NO: 186925 - DNA, 15 bp, Homo sapiens
gatgcagtgcttata

SEQ ID NO: 186926 - DNA, 15 bp, Homo sapiens
agatgcagtgcttat

SEQ ID NO: 186927 - DNA, 15 bp, Homo sapiens
aagatgcagtgctta

SEQ ID NO: 186928 - DNA, 15 bp, Homo sapiens
aaagatgcagtgctt

SEQ ID NO: 186929 - DNA, 15 bp, Homo sapiens
taaagatgcagtgct

SEQ ID NO: 186930 - DNA, 15 bp, Homo sapiens
ataaagatgcagtgc

SEQ ID NO: 186931 - DNA, 15 bp, Homo sapiens
cataaagatgcagtg

SEQ ID NO: 186932 - DNA, 15 bp, Homo sapiens
tcataaagatgcagt

SEQ ID NO: 186933 - DNA, 15 bp, Homo sapiens
atcataaagatgcag

SEQ ID NO: 186934 - DNA, 15 bp, Homo sapiens
catcataaagatgca

SEQ ID NO: 186935 - DNA, 15 bp, Homo sapiens
tcatcataaagatgc

SEQ ID NO: 186936 - DNA, 15 bp, Homo sapiens
ttcatcataaagatg

SEQ ID NO: 186937 - DNA, 15 bp, Homo sapiens
tttcatcataaagat

SEQ ID NO: 186938 - DNA, 15 bp, Homo sapiens
gtttcatcataaaga

SEQ ID NO: 186939 - DNA, 15 bp, Homo sapiens
agtttcatcataaag

SEQ ID NO: 186940 - DNA, 15 bp, Homo sapiens
gagtttcatcataaa

SEQ ID NO: 186941 - DNA, 15 bp, Homo sapiens
agagtttcatcataa

SEQ ID NO: 186942 - DNA, 15 bp, Homo sapiens
cagagtttcatcata

SEQ ID NO: 186943 - DNA, 15 bp, Homo sapiens
gcagagtttcatcat

SEQ ID NO: 186944 - DNA, 15 bp, Homo sapiens
ggcagagtttcatca

SEQ ID NO: 186945 - DNA, 15 bp, Homo sapiens
aggcagagtttcatc

SEQ ID NO: 186946 - DNA, 15 bp, Homo sapiens
taggcagagtttcat

SEQ ID NO: 186947 - DNA, 15 bp, Homo sapiens
gtaggcagagtttca

SEQ ID NO: 186948 - DNA, 15 bp, Homo sapiens
tgtaggcagagtttc

SEQ ID NO: 186949 - DNA, 15 bp, Homo sapiens
ttgtaggcagagttt

SEQ ID NO: 186950 - DNA, 15 bp, Homo sapiens
gttgtaggcagagtt

SEQ ID NO: 186951 - DNA, 15 bp, Homo sapiens
agttgtaggcagagt

SEQ ID NO: 186952 - DNA, 15 bp, Homo sapiens
tagttgtaggcagag

SEQ ID NO: 186953 - DNA, 15 bp, Homo sapiens
ctagttgtaggcaga

SEQ ID NO: 186954 - DNA, 15 bp, Homo sapiens
tctagttgtaggcag

SEQ ID NO: 186955 - DNA, 15 bp, Homo sapiens
ctctagttgtaggca

SEQ ID NO: 186956 - DNA, 15 bp, Homo sapiens
tctctagttgtaggc

SEQ ID NO: 186957 - DNA, 15 bp, Homo sapiens
ttctctagttgtagg

SEQ ID NO: 186958 - DNA, 15 bp, Homo sapiens
tttctctagttgtag

SEQ ID NO: 186959 - DNA, 15 bp, Homo sapiens
gtttctctagttgta

SEQ ID NO: 186960 - DNA, 15 bp, Homo sapiens
tgtttctctagttgt

SEQ ID NO: 186961 - DNA, 15 bp, Homo sapiens
atgtttctctagttg

SEQ ID NO: 186962 - DNA, 15 bp, Homo sapiens
catgtttctctagtt

SEQ ID NO: 186963 - DNA, 15 bp, Homo sapiens
acatgtttctctagt

SEQ ID NO: 186964 - DNA, 15 bp, Homo sapiens
aacatgtttctctag

SEQ ID NO: 186965 - DNA, 15 bp, Homo sapiens
aaacatgtttctcta

SEQ ID NO: 186966 - DNA, 15 bp, Homo sapiens
gaaacatgtttctct

SEQ ID NO: 186967 - DNA, 15 bp, Homo sapiens
tgaaacatgtttctc

SEQ ID NO: 186968 - DNA, 15 bp, Homo sapiens
ttgaaacatgtttct

SEQ ID NO: 186969 - DNA, 15 bp, Homo sapiens
tttgaaacatgtttc

SEQ ID NO: 186970 - DNA, 15 bp, Homo sapiens
atttgaaacatgttt

SEQ ID NO: 186971 - DNA, 15 bp, Homo sapiens
catttgaaacatgtt

SEQ ID NO: 186972 - DNA, 15 bp, Homo sapiens
ccatttgaaacatgt

SEQ ID NO: 186973 - DNA, 15 bp, Homo sapiens
tccatttgaaacatg

SEQ ID NO: 186974 - DNA, 15 bp, Homo sapiens
gtccatttgaaacat

SEQ ID NO: 186975 - DNA, 15 bp, Homo sapiens
tgtccatttgaaaca

SEQ ID NO: 186976 - DNA, 15 bp, Homo sapiens
atgtccatttgaaac

SEQ ID NO: 186977 - DNA, 15 bp, Homo sapiens
aatgtccatttgaaa

SEQ ID NO: 186978 - DNA, 15 bp, Homo sapiens
aaatgtccatttgaa

SEQ ID NO: 186979 - DNA, 15 bp, Homo sapiens
gaaatgtccatttga

SEQ ID NO: 186980 - DNA, 15 bp, Homo sapiens
agaaatgtccatttg

SEQ ID NO: 186981 - DNA, 15 bp, Homo sapiens
cagaaatgtccattt

SEQ ID NO: 186982 - DNA, 15 bp, Homo sapiens
acagaaatgtccatt

SEQ ID NO: 186983 - DNA, 15 bp, Homo sapiens
aacagaaatgtccat

SEQ ID NO: 186984 - DNA, 15 bp, Homo sapiens
taacagaaatgtcca

SEQ ID NO: 186985 - DNA, 15 bp, Homo sapiens
ataacagaaatgtcc

SEQ ID NO: 186986 - DNA, 15 bp, Homo sapiens
tataacagaaatgtc

SEQ ID NO: 186987 - DNA, 15 bp, Homo sapiens
gtataacagaaatgt

SEQ ID NO: 186988 - DNA, 15 bp, Homo sapiens
agtataacagaaatg

SEQ ID NO: 186989 - DNA, 15 bp, Homo sapiens
aagtataacagaaat

SEQ ID NO: 186990 - DNA, 15 bp, Homo sapiens
aaagtataacagaaa

SEQ ID NO: 186991 - DNA, 15 bp, Homo sapiens
taaagtataacagaa

SEQ ID NO: 186992 - DNA, 15 bp, Homo sapiens
ataaagtataacaga

SEQ ID NO: 186993 - DNA, 15 bp, Homo sapiens
aataaagtataacag

SEQ ID NO: 186994 - DNA, 15 bp, Homo sapiens
caataaagtataaca

SEQ ID NO: 186995 - DNA, 15 bp, Homo sapiens
ccaataaagtataac

SEQ ID NO: 186996 - DNA, 15 bp, Homo sapiens
accaataaagtataa

SEQ ID NO: 186997 - DNA, 15 bp, Homo sapiens
taccaataaagtata

SEQ ID NO: 186998 - DNA, 15 bp, Homo sapiens
ataccaataaagtat

SEQ ID NO: 186999 - DNA, 15 bp, Homo sapiens
tataccaataaagta

SEQ ID NO: 187000 - DNA, 15 bp, Homo sapiens
gtataccaataaagt

SEQ ID NO: 187001 - DNA, 15 bp, Homo sapiens
agtataccaataaag

SEQ ID NO: 187002 - DNA, 15 bp, Homo sapiens
cagtataccaataaa

SEQ ID NO: 187003 - DNA, 15 bp, Homo sapiens
acagtataccaataa

SEQ ID NO: 187004 - DNA, 15 bp, Homo sapiens
tacagtataccaata

SEQ ID NO: 187005 - DNA, 15 bp, Homo sapiens
atacagtataccaat

SEQ ID NO: 187006 - DNA, 15 bp, Homo sapiens
tatacagtataccaa

SEQ ID NO: 187007 - DNA, 15 bp, Homo sapiens
ctatacagtatacca

SEQ ID NO: 187008 - DNA, 15 bp, Homo sapiens
gctatacagtatacc

SEQ ID NO: 187009 - DNA, 15 bp, Homo sapiens
agctatacagtatac

SEQ ID NO: 187010 - DNA, 15 bp, Homo sapiens
tagctatacagtata

SEQ ID NO: 187011 - DNA, 15 bp, Homo sapiens
atagctatacagtat

SEQ ID NO: 187012 - DNA, 15 bp, Homo sapiens
catagctatacagta

SEQ ID NO: 187013 - DNA, 15 bp, Homo sapiens
acatagctatacagt

SEQ ID NO: 187014 - DNA, 15 bp, Homo sapiens
tacatagctatacag

SEQ ID NO: 187015 - DNA, 15 bp, Homo sapiens
ttacatagctataca

SEQ ID NO: 187016 - DNA, 15 bp, Homo sapiens
attacatagctatac

SEQ ID NO: 187017 - DNA, 15 bp, Homo sapiens
cattacatagctata

SEQ ID NO: 187018 - DNA, 15 bp, Homo sapiens
gcattacatagctat

SEQ ID NO: 187019 - DNA, 15 bp, Homo sapiens
tgcattacatagcta

SEQ ID NO: 187020 - DNA, 15 bp, Homo sapiens
ttgcattacatagct

SEQ ID NO: 187021 - DNA, 15 bp, Homo sapiens
tttgcattacatagc

SEQ ID NO: 187022 - DNA, 15 bp, Homo sapiens
ttttgcattacatag

SEQ ID NO: 187023 - DNA, 15 bp, Homo sapiens
cttttgcattacata

SEQ ID NO: 187024 - DNA, 15 bp, Homo sapiens
gcttttgcattacat

SEQ ID NO: 187025 - DNA, 15 bp, Homo sapiens
tgcttttgcattaca

SEQ ID NO: 187026 - DNA, 15 bp, Homo sapiens
ttgcttttgcattac

SEQ ID NO: 187027 - DNA, 15 bp, Homo sapiens
tttgcttttgcatta

SEQ ID NO: 187028 - DNA, 15 bp, Homo sapiens
ttttgcttttgcatt

SEQ ID NO: 187029 - DNA, 15 bp, Homo sapiens
attttgcttttgcat

SEQ ID NO: 187030 - DNA, 15 bp, Homo sapiens
gattttgcttttgca

SEQ ID NO: 187031 - DNA, 15 bp, Homo sapiens
tgattttgcttttgc

SEQ ID NO: 187032 - DNA, 15 bp, Homo sapiens
gtgattttgcttttg

SEQ ID NO: 187033 - DNA, 15 bp, Homo sapiens
tgtgattttgctttt

SEQ ID NO: 187034 - DNA, 15 bp, Homo sapiens
atgtgattttgcttt

SEQ ID NO: 187035 - DNA, 15 bp, Homo sapiens
aatgtgattttgctt

SEQ ID NO: 187036 - DNA, 15 bp, Homo sapiens
aaatgtgattttgct

SEQ ID NO: 187037 - DNA, 15 bp, Homo sapiens
caaatgtgattttgc

SEQ ID NO: 187038 - DNA, 15 bp, Homo sapiens
gcaaatgtgattttg

SEQ ID NO: 187039 - DNA, 15 bp, Homo sapiens
ggcaaatgtgatttt

SEQ ID NO: 187040 - DNA, 15 bp, Homo sapiens
aggcaaatgtgattt

SEQ ID NO: 187041 - DNA, 15 bp, Homo sapiens
aaggcaaatgtgatt

SEQ ID NO: 187042 - DNA, 15 bp, Homo sapiens
caaggcaaatgtgat

SEQ ID NO: 187043 - DNA, 15 bp, Homo sapiens
ccaaggcaaatgtga

SEQ ID NO: 187044 - DNA, 15 bp, Homo sapiens
tccaaggcaaatgtg

SEQ ID NO: 187045 - DNA, 15 bp, Homo sapiens
ttccaaggcaaatgt

SEQ ID NO: 187046 - DNA, 15 bp, Homo sapiens
attccaaggcaaatg

SEQ ID NO: 187047 - DNA, 15 bp, Homo sapiens
cattccaaggcaaat

SEQ ID NO: 187048 - DNA, 15 bp, Homo sapiens
tcattccaaggcaaa

SEQ ID NO: 187049 - DNA, 15 bp, Homo sapiens
atcattccaaggcaa

SEQ ID NO: 187050 - DNA, 15 bp, Homo sapiens
tatcattccaaggca

SEQ ID NO: 187051 - DNA, 15 bp, Homo sapiens
atatcattccaaggc

SEQ ID NO: 187052 - DNA, 15 bp, Homo sapiens
gatatcattccaagg

SEQ ID NO: 187053 - DNA, 15 bp, Homo sapiens
ggatatcattccaag

SEQ ID NO: 187054 - DNA, 15 bp, Homo sapiens
tggatatcattccaa

SEQ ID NO: 187055 - DNA, 15 bp, Homo sapiens
atggatatcattcca

SEQ ID NO: 187056 - DNA, 15 bp, Homo sapiens
tatggatatcattcc

SEQ ID NO: 187057 - DNA, 15 bp, Homo sapiens
ttatggatatcattc

SEQ ID NO: 187058 - DNA, 15 bp, Homo sapiens
attatggatatcatt

SEQ ID NO: 187059 - DNA, 15 bp, Homo sapiens
tattatggatatcat

SEQ ID NO: 187060 - DNA, 15 bp, Homo sapiens
atattatggatatca

SEQ ID NO: 187061 - DNA, 15 bp, Homo sapiens
gatattatggatatc

SEQ ID NO: 187062 - DNA, 15 bp, Homo sapiens
tgatattatggatat

SEQ ID NO: 187063 - DNA, 15 bp, Homo sapiens
gtgatattatggata

SEQ ID NO: 187064 - DNA, 15 bp, Homo sapiens
agtgatattatggat

SEQ ID NO: 187065 - DNA, 15 bp, Homo sapiens
tagtgatattatgga

SEQ ID NO: 187066 - DNA, 15 bp, Homo sapiens
gtagtgatattatgg

SEQ ID NO: 187067 - DNA, 15 bp, Homo sapiens
tgtagtgatattatg

SEQ ID NO: 187068 - DNA, 15 bp, Homo sapiens
ttgtagtgatattat

SEQ ID NO: 187069 - DNA, 15 bp, Homo sapiens
tttgtagtgatatta

SEQ ID NO: 187070 - DNA, 15 bp, Homo sapiens
ctttgtagtgatatt

SEQ ID NO: 187071 - DNA, 15 bp, Homo sapiens
tctttgtagtgatat

SEQ ID NO: 187072 - DNA, 15 bp, Homo sapiens
ttctttgtagtgata

SEQ ID NO: 187073 - DNA, 15 bp, Homo sapiens
attctttgtagtgat

SEQ ID NO: 187074 - DNA, 15 bp, Homo sapiens
aattctttgtagtga

SEQ ID NO: 187075 - DNA, 15 bp, Homo sapiens
aaattctttgtagtg

SEQ ID NO: 187076 - DNA, 15 bp, Homo sapiens
taaattctttgtagt

SEQ ID NO: 187077 - DNA, 15 bp, Homo sapiens
ataaattctttgtag

SEQ ID NO: 187078 - DNA, 15 bp, Homo sapiens
tataaattctttgta

SEQ ID NO: 187079 - DNA, 15 bp, Homo sapiens
ttataaattctttgt

SEQ ID NO: 187080 - DNA, 15 bp, Homo sapiens
attataaattctttg

SEQ ID NO: 187081 - DNA, 15 bp, Homo sapiens
aattataaattcttt

SEQ ID NO: 187082 - DNA, 15 bp, Homo sapiens
aaattataaattctt

SEQ ID NO: 187083 - DNA, 15 bp, Homo sapiens
caaattataaattct

SEQ ID NO: 187084 - DNA, 15 bp, Homo sapiens
ccaaattataaattc

SEQ ID NO: 187085 - DNA, 15 bp, Homo sapiens
tccaaattataaatt

SEQ ID NO: 187086 - DNA, 15 bp, Homo sapiens
atccaaattataaat

SEQ ID NO: 187087 - DNA, 15 bp, Homo sapiens
aatccaaattataaa

SEQ ID NO: 187088 - DNA, 15 bp, Homo sapiens
caatccaaattataa

SEQ ID NO: 187089 - DNA, 15 bp, Homo sapiens
ccaatccaaattata

SEQ ID NO: 187090 - DNA, 15 bp, Homo sapiens
tccaatccaaattat

SEQ ID NO: 187091 - DNA, 15 bp, Homo sapiens
ctccaatccaaatta

SEQ ID NO: 187092 - DNA, 15 bp, Homo sapiens
actccaatccaaatt

SEQ ID NO: 187093 - DNA, 15 bp, Homo sapiens
aactccaatccaaat

SEQ ID NO: 187094 - DNA, 15 bp, Homo sapiens
aaactccaatccaaa

SEQ ID NO: 187095 - DNA, 15 bp, Homo sapiens
aaaactccaatccaa

SEQ ID NO: 187096 - DNA, 15 bp, Homo sapiens
aaaaactccaatcca

SEQ ID NO: 187097 - DNA, 15 bp, Homo sapiens
aaaaaactccaatcc

SEQ ID NO: 187098 - DNA, 15 bp, Homo sapiens
aaaaaaactccaatc

SEQ ID NO: 187099 - DNA, 15 bp, Homo sapiens
gaaaaaaactccaat

SEQ ID NO: 187100 - DNA, 15 bp, Homo sapiens
agaaaaaaactccaa

SEQ ID NO: 187101 - DNA, 15 bp, Homo sapiens
aagaaaaaaactcca

SEQ ID NO: 187102 - DNA, 15 bp, Homo sapiens
aaagaaaaaaactcc

SEQ ID NO: 187103 - DNA, 15 bp, Homo sapiens
taaagaaaaaaactc

SEQ ID NO: 187104 - DNA, 15 bp, Homo sapiens
ttaaagaaaaaaact

SEQ ID NO: 187105 - DNA, 15 bp, Homo sapiens
tttaaagaaaaaaac

SEQ ID NO: 187106 - DNA, 15 bp, Homo sapiens
ctttaaagaaaaaaa

SEQ ID NO: 187107 - DNA, 15 bp, Homo sapiens
gctttaaagaaaaaa

SEQ ID NO: 187108 - DNA, 15 bp, Homo sapiens
cgctttaaagaaaaa

SEQ ID NO: 187109 - DNA, 15 bp, Homo sapiens
tcgctttaaagaaaa

SEQ ID NO: 187110 - DNA, 15 bp, Homo sapiens
atcgctttaaagaaa

SEQ ID NO: 187111 - DNA, 15 bp, Homo sapiens
catcgctttaaagaa

SEQ ID NO: 187112 - DNA, 15 bp, Homo sapiens
tcatcgctttaaaga

SEQ ID NO: 187113 - DNA, 15 bp, Homo sapiens
gtcatcgctttaaag

SEQ ID NO: 187114 - DNA, 15 bp, Homo sapiens
tgtcatcgctttaaa

SEQ ID NO: 187115 - DNA, 15 bp, Homo sapiens
gtgtcatcgctttaa

SEQ ID NO: 187116 - DNA, 15 bp, Homo sapiens
agtgtcatcgcttta

SEQ ID NO: 187117 - DNA, 15 bp, Homo sapiens
aagtgtcatcgcttt

SEQ ID NO: 187118 - DNA, 15 bp, Homo sapiens
taagtgtcatcgctt

SEQ ID NO: 187119 - DNA, 15 bp, Homo sapiens
ttaagtgtcatcgct

SEQ ID NO: 187120 - DNA, 15 bp, Homo sapiens
tttaagtgtcatcgc

SEQ ID NO: 187121 - DNA, 15 bp, Homo sapiens
ttttaagtgtcatcg

SEQ ID NO: 187122 - DNA, 15 bp, Homo sapiens
gttttaagtgtcatc

SEQ ID NO: 187123 - DNA, 15 bp, Homo sapiens
agttttaagtgtcat

SEQ ID NO: 187124 - DNA, 15 bp, Homo sapiens
aagttttaagtgtca

SEQ ID NO: 187125 - DNA, 15 bp, Homo sapiens
gaagttttaagtgtc

SEQ ID NO: 187126 - DNA, 15 bp, Homo sapiens
ggaagttttaagtgt

SEQ ID NO: 187127 - DNA, 15 bp, Homo sapiens
aggaagttttaagtg

SEQ ID NO: 187128 - DNA, 15 bp, Homo sapiens
caggaagttttaagt

SEQ ID NO: 187129 - DNA, 15 bp, Homo sapiens
ccaggaagttttaag

SEQ ID NO: 187130 - DNA, 15 bp, Homo sapiens
tccaggaagttttaa

SEQ ID NO: 187131 - DNA, 15 bp, Homo sapiens
ttccaggaagtttta

SEQ ID NO: 187132 - DNA, 15 bp, Homo sapiens
cttccaggaagtttt

SEQ ID NO: 187133 - DNA, 15 bp, Homo sapiens
tcttccaggaagttt

SEQ ID NO: 187134 - DNA, 15 bp, Homo sapiens
atcttccaggaagtt

SEQ ID NO: 187135 - DNA, 15 bp, Homo sapiens
catcttccaggaagt

SEQ ID NO: 187136 - DNA, 15 bp, Homo sapiens
ccatcttccaggaag

SEQ ID NO: 187137 - DNA, 15 bp, Homo sapiens
accatcttccaggaa

SEQ ID NO: 187138 - DNA, 15 bp, Homo sapiens
caccatcttccagga

SEQ ID NO: 187139 - DNA, 15 bp, Homo sapiens
acaccatcttccagg

SEQ ID NO: 187140 - DNA, 15 bp, Homo sapiens
aacaccatcttccag

SEQ ID NO: 187141 - DNA, 15 bp, Homo sapiens
aaacaccatcttcca

SEQ ID NO: 187142 - DNA, 15 bp, Homo sapiens
gaaacaccatcttcc

SEQ ID NO: 187143 - DNA, 15 bp, Homo sapiens
agaaacaccatcttc

SEQ ID NO: 187144 - DNA, 15 bp, Homo sapiens
gagaaacaccatctt

SEQ ID NO: 187145 - DNA, 15 bp, Homo sapiens
agagaaacaccatct

SEQ ID NO: 187146 - DNA, 15 bp, Homo sapiens
cagagaaacaccatc

SEQ ID NO: 187147 - DNA, 15 bp, Homo sapiens
tcagagaaacaccat

SEQ ID NO: 187148 - DNA, 15 bp, Homo sapiens
ctcagagaaacacca

SEQ ID NO: 187149 - DNA, 15 bp, Homo sapiens
actcagagaaacacc

SEQ ID NO: 187150 - DNA, 15 bp, Homo sapiens
cactcagagaaacac

SEQ ID NO: 187151 - DNA, 15 bp, Homo sapiens
gcactcagagaaaca

SEQ ID NO: 187152 - DNA, 15 bp, Homo sapiens
ggcactcagagaaac

SEQ ID NO: 187153 - DNA, 15 bp, Homo sapiens
tggcactcagagaaa

SEQ ID NO: 187154 - DNA, 15 bp, Homo sapiens
ctggcactcagagaa

SEQ ID NO: 187155 - DNA, 15 bp, Homo sapiens
actggcactcagaga

SEQ ID NO: 187156 - DNA, 15 bp, Homo sapiens
tactggcactcagag

SEQ ID NO: 187157 - DNA, 15 bp, Homo sapiens
ctactggcactcaga

SEQ ID NO: 187158 - DNA, 15 bp, Homo sapiens
actactggcactcag

SEQ ID NO: 187159 - DNA, 15 bp, Homo sapiens
tactactggcactca

SEQ ID NO: 187160 - DNA, 15 bp, Homo sapiens
ttactactggcactc

SEQ ID NO: 187161 - DNA, 15 bp, Homo sapiens
attactactggcact

SEQ ID NO: 187162 - DNA, 15 bp, Homo sapiens
aattactactggcac

SEQ ID NO: 187163 - DNA, 15 bp, Homo sapiens
aaattactactggca

SEQ ID NO: 187164 - DNA, 15 bp, Homo sapiens
taaattactactggc

SEQ ID NO: 187165 - DNA, 15 bp, Homo sapiens
ttaaattactactgg

SEQ ID NO: 187166 - DNA, 15 bp, Homo sapiens
gttaaattactactg

SEQ ID NO: 187167 - DNA, 15 bp, Homo sapiens
tgttaaattactact

SEQ ID NO: 187168 - DNA, 15 bp, Homo sapiens
atgttaaattactac

SEQ ID NO: 187169 - DNA, 15 bp, Homo sapiens
gatgttaaattacta

SEQ ID NO: 187170 - DNA, 15 bp, Homo sapiens
tgatgttaaattact

SEQ ID NO: 187171 - DNA, 15 bp, Homo sapiens
ttgatgttaaattac

SEQ ID NO: 187172 - DNA, 15 bp, Homo sapiens
tttgatgttaaatta

SEQ ID NO: 187173 - DNA, 15 bp, Homo sapiens
ttttgatgttaaatt

SEQ ID NO: 187174 - DNA, 15 bp, Homo sapiens
attttgatgttaaat

SEQ ID NO: 187175 - DNA, 15 bp, Homo sapiens
cattttgatgttaaa

SEQ ID NO: 187176 - DNA, 15 bp, Homo sapiens
ccattttgatgttaa

SEQ ID NO: 187177 - DNA, 15 bp, Homo sapiens
tccattttgatgtta

SEQ ID NO: 187178 - DNA, 15 bp, Homo sapiens
ttccattttgatgtt

SEQ ID NO: 187179 - DNA, 15 bp, Homo sapiens
cttccattttgatgt

SEQ ID NO: 187180 - DNA, 15 bp, Homo sapiens
tcttccattttgatg

SEQ ID NO: 187181 - DNA, 15 bp, Homo sapiens
gtcttccattttgat

SEQ ID NO: 187182 - DNA, 15 bp, Homo sapiens
tgtcttccattttga

SEQ ID NO: 187183 - DNA, 15 bp, Homo sapiens
gtgtcttccattttg

SEQ ID NO: 187184 - DNA, 15 bp, Homo sapiens
tgtgtcttccatttt

SEQ ID NO: 187185 - DNA, 15 bp, Homo sapiens
atgtgtcttccattt

SEQ ID NO: 187186 - DNA, 15 bp, Homo sapiens
aatgtgtcttccatt

SEQ ID NO: 187187 - DNA, 15 bp, Homo sapiens
gaatgtgtcttccat

SEQ ID NO: 187188 - DNA, 15 bp, Homo sapiens
tgaatgtgtcttcca

SEQ ID NO: 187189 - DNA, 15 bp, Homo sapiens
ttgaatgtgtcttcc

SEQ ID NO: 187190 - DNA, 15 bp, Homo sapiens
attgaatgtgtcttc

SEQ ID NO: 187191 - DNA, 15 bp, Homo sapiens
cattgaatgtgtctt

SEQ ID NO: 187192 - DNA, 15 bp, Homo sapiens
acattgaatgtgtct

SEQ ID NO: 187193 - DNA, 15 bp, Homo sapiens
tacattgaatgtgtc

SEQ ID NO: 187194 - DNA, 15 bp, Homo sapiens
ctacattgaatgtgt

SEQ ID NO: 187195 - DNA, 15 bp, Homo sapiens
actacattgaatgtg

SEQ ID NO: 187196 - DNA, 15 bp, Homo sapiens
aactacattgaatgt

SEQ ID NO: 187197 - DNA, 15 bp, Homo sapiens
taactacattgaatg

SEQ ID NO: 187198 - DNA, 15 bp, Homo sapiens
ataactacattgaat

SEQ ID NO: 187199 - DNA, 15 bp, Homo sapiens
aataactacattgaa

SEQ ID NO: 187200 - DNA, 15 bp, Homo sapiens
taataactacattga

SEQ ID NO: 187201 - DNA, 15 bp, Homo sapiens
gtaataactacattg

SEQ ID NO: 187202 - DNA, 15 bp, Homo sapiens
agtaataactacatt

SEQ ID NO: 187203 - DNA, 15 bp, Homo sapiens
gagtaataactacat

SEQ ID NO: 187204 - DNA, 15 bp, Homo sapiens
tgagtaataactaca

SEQ ID NO: 187205 - DNA, 15 bp, Homo sapiens
gtgagtaataactac

SEQ ID NO: 187206 - DNA, 15 bp, Homo sapiens
tgtgagtaataacta

SEQ ID NO: 187207 - DNA, 15 bp, Homo sapiens
atgtgagtaataact

SEQ ID NO: 187208 - DNA, 15 bp, Homo sapiens
aatgtgagtaataac

SEQ ID NO: 187209 - DNA, 15 bp, Homo sapiens
aaatgtgagtaataa

SEQ ID NO: 187210 - DNA, 15 bp, Homo sapiens
aaaatgtgagtaata

SEQ ID NO: 187211 - DNA, 15 bp, Homo sapiens
caaaatgtgagtaat

SEQ ID NO: 187212 - DNA, 15 bp, Homo sapiens
tcaaaatgtgagtaa

SEQ ID NO: 187213 - DNA, 15 bp, Homo sapiens
ctcaaaatgtgagta

SEQ ID NO: 187214 - DNA, 15 bp, Homo sapiens
actcaaaatgtgagt

SEQ ID NO: 187215 - DNA, 15 bp, Homo sapiens
tactcaaaatgtgag

SEQ ID NO: 187216 - DNA, 15 bp, Homo sapiens
gtactcaaaatgtga

SEQ ID NO: 187217 - DNA, 15 bp, Homo sapiens
tgtactcaaaatgtg

SEQ ID NO: 187218 - DNA, 15 bp, Homo sapiens
ctgtactcaaaatgt

SEQ ID NO: 187219 - DNA, 15 bp, Homo sapiens
actgtactcaaaatg

SEQ ID NO: 187220 - DNA, 15 bp, Homo sapiens
tactgtactcaaaat

SEQ ID NO: 187221 - DNA, 15 bp, Homo sapiens
ctactgtactcaaaa

SEQ ID NO: 187222 - DNA, 15 bp, Homo sapiens
actactgtactcaaa

SEQ ID NO: 187223 - DNA, 15 bp, Homo sapiens
aactactgtactcaa

SEQ ID NO: 187224 - DNA, 15 bp, Homo sapiens
aaactactgtactca

SEQ ID NO: 187225 - DNA, 15 bp, Homo sapiens
gaaactactgtactc

SEQ ID NO: 187226 - DNA, 15 bp, Homo sapiens
agaaactactgtact

SEQ ID NO: 187227 - DNA, 15 bp, Homo sapiens
gagaaactactgtac

SEQ ID NO: 187228 - DNA, 15 bp, Homo sapiens
agagaaactactgta

SEQ ID NO: 187229 - DNA, 15 bp, Homo sapiens
gagagaaactactgt

SEQ ID NO: 187230 - DNA, 15 bp, Homo sapiens
tgagagaaactactg

SEQ ID NO: 187231 - DNA, 15 bp, Homo sapiens
atgagagaaactact

SEQ ID NO: 187232 - DNA, 15 bp, Homo sapiens
aatgagagaaactac

SEQ ID NO: 187233 - DNA, 15 bp, Homo sapiens
taatgagagaaacta

SEQ ID NO: 187234 - DNA, 15 bp, Homo sapiens
ttaatgagagaaact

SEQ ID NO: 187235 - DNA, 15 bp, Homo sapiens
cttaatgagagaaac

SEQ ID NO: 187236 - DNA, 15 bp, Homo sapiens
acttaatgagagaaa

SEQ ID NO: 187237 - DNA, 15 bp, Homo sapiens
aacttaatgagagaa

SEQ ID NO: 187238 - DNA, 15 bp, Homo sapiens
aaacttaatgagaga

SEQ ID NO: 187239 - DNA, 15 bp, Homo sapiens
aaaacttaatgagag

SEQ ID NO: 187240 - DNA, 15 bp, Homo sapiens
taaaacttaatgaga

SEQ ID NO: 187241 - DNA, 15 bp, Homo sapiens
ataaaacttaatgag

SEQ ID NO: 187242 - DNA, 15 bp, Homo sapiens
cataaaacttaatga

SEQ ID NO: 187243 - DNA, 15 bp, Homo sapiens
acataaaacttaatg

SEQ ID NO: 187244 - DNA, 15 bp, Homo sapiens
gacataaaacttaat

SEQ ID NO: 187245 - DNA, 15 bp, Homo sapiens
tgacataaaacttaa

SEQ ID NO: 187246 - DNA, 15 bp, Homo sapiens
ctgacataaaactta

SEQ ID NO: 187247 - DNA, 15 bp, Homo sapiens
tctgacataaaactt

SEQ ID NO: 187248 - DNA, 15 bp, Homo sapiens
ttctgacataaaact

SEQ ID NO: 187249 - DNA, 15 bp, Homo sapiens
tttctgacataaaac

SEQ ID NO: 187250 - DNA, 15 bp, Homo sapiens
gtttctgacataaaa

SEQ ID NO: 187251 - DNA, 15 bp, Homo sapiens
tgtttctgacataaa

SEQ ID NO: 187252 - DNA, 15 bp, Homo sapiens
ttgtttctgacataa

SEQ ID NO: 187253 - DNA, 15 bp, Homo sapiens
cttgtttctgacata

SEQ ID NO: 187254 - DNA, 15 bp, Homo sapiens
acttgtttctgacat

SEQ ID NO: 187255 - DNA, 15 bp, Homo sapiens
tacttgtttctgaca

SEQ ID NO: 187256 - DNA, 15 bp, Homo sapiens
ttacttgtttctgac

SEQ ID NO: 187257 - DNA, 15 bp, Homo sapiens
tttacttgtttctga

SEQ ID NO: 187258 - DNA, 15 bp, Homo sapiens
atttacttgtttctg

SEQ ID NO: 187259 - DNA, 15 bp, Homo sapiens
aatttacttgtttct

SEQ ID NO: 187260 - DNA, 15 bp, Homo sapiens
gaatttacttgtttc

SEQ ID NO: 187261 - DNA, 15 bp, Homo sapiens
ggaatttacttgttt

SEQ ID NO: 187262 - DNA, 15 bp, Homo sapiens
gggaatttacttgtt

SEQ ID NO: 187263 - DNA, 15 bp, Homo sapiens
agggaatttacttgt

SEQ ID NO: 187264 - DNA, 15 bp, Homo sapiens
tagggaatttacttg

SEQ ID NO: 187265 - DNA, 15 bp, Homo sapiens
atagggaatttactt

SEQ ID NO: 187266 - DNA, 15 bp, Homo sapiens
tatagggaatttact

SEQ ID NO: 187267 - DNA, 15 bp, Homo sapiens
ttatagggaatttac

SEQ ID NO: 187268 - DNA, 15 bp, Homo sapiens
cttatagggaattta

SEQ ID NO: 187269 - DNA, 15 bp, Homo sapiens
tcttatagggaattt

SEQ ID NO: 187270 - DNA, 15 bp, Homo sapiens
ttcttatagggaatt

SEQ ID NO: 187271 - DNA, 15 bp, Homo sapiens
tttcttatagggaat

SEQ ID NO: 187272 - DNA, 15 bp, Homo sapiens
ttttcttatagggaa

SEQ ID NO: 187273 - DNA, 15 bp, Homo sapiens
gttttcttataggga

SEQ ID NO: 187274 - DNA, 15 bp, Homo sapiens
tgttttcttataggg

SEQ ID NO: 187275 - DNA, 15 bp, Homo sapiens
ctgttttcttatagg

SEQ ID NO: 187276 - DNA, 15 bp, Homo sapiens
actgttttcttatag

SEQ ID NO: 187277 - DNA, 15 bp, Homo sapiens
gactgttttcttata

SEQ ID NO: 187278 - DNA, 15 bp, Homo sapiens
agactgttttcttat

SEQ ID NO: 187279 - DNA, 15 bp, Homo sapiens
cagactgttttctta

SEQ ID NO: 187280 - DNA, 15 bp, Homo sapiens
tcagactgttttctt

SEQ ID NO: 187281 - DNA, 15 bp, Homo sapiens
ttcagactgttttct

SEQ ID NO: 187282 - DNA, 15 bp, Homo sapiens
attcagactgttttc

SEQ ID NO: 187283 - DNA, 15 bp, Homo sapiens
cattcagactgtttt

SEQ ID NO: 187284 - DNA, 15 bp, Homo sapiens
tcattcagactgttt

SEQ ID NO: 187285 - DNA, 15 bp, Homo sapiens
gtcattcagactgtt

SEQ ID NO: 187286 - DNA, 15 bp, Homo sapiens
agtcattcagactgt

SEQ ID NO: 187287 - DNA, 15 bp, Homo sapiens
aagtcattcagactg

SEQ ID NO: 187288 - DNA, 15 bp, Homo sapiens
aaagtcattcagact

SEQ ID NO: 187289 - DNA, 15 bp, Homo sapiens
gaaagtcattcagac

SEQ ID NO: 187290 - DNA, 15 bp, Homo sapiens
tgaaagtcattcaga

SEQ ID NO: 187291 - DNA, 15 bp, Homo sapiens
ctgaaagtcattcag

SEQ ID NO: 187292 - DNA, 15 bp, Homo sapiens
gctgaaagtcattca

SEQ ID NO: 187293 - DNA, 15 bp, Homo sapiens
cgctgaaagtcattc

SEQ ID NO: 187294 - DNA, 15 bp, Homo sapiens
ccgctgaaagtcatt

SEQ ID NO: 187295 - DNA, 15 bp, Homo sapiens
gccgctgaaagtcat

SEQ ID NO: 187296 - DNA, 15 bp, Homo sapiens
tgccgctgaaagtca

SEQ ID NO: 187297 - DNA, 15 bp, Homo sapiens
atgccgctgaaagtc

SEQ ID NO: 187298 - DNA, 15 bp, Homo sapiens
gatgccgctgaaagt

SEQ ID NO: 187299 - DNA, 15 bp, Homo sapiens
tgatgccgctgaaag

SEQ ID NO: 187300 - DNA, 15 bp, Homo sapiens
ttgatgccgctgaaa

SEQ ID NO: 187301 - DNA, 15 bp, Homo sapiens
tttgatgccgctgaa

SEQ ID NO: 187302 - DNA, 15 bp, Homo sapiens
ctttgatgccgctga

SEQ ID NO: 187303 - DNA, 15 bp, Homo sapiens
tctttgatgccgctg

SEQ ID NO: 187304 - DNA, 15 bp, Homo sapiens
ctctttgatgccgct

SEQ ID NO: 187305 - DNA, 15 bp, Homo sapiens
tctctttgatgccgc

SEQ ID NO: 187306 - DNA, 15 bp, Homo sapiens
atctctttgatgccg

SEQ ID NO: 187307 - DNA, 15 bp, Homo sapiens
gatctctttgatgcc

SEQ ID NO: 187308 - DNA, 15 bp, Homo sapiens
cgatctctttgatgc

SEQ ID NO: 187309 - DNA, 15 bp, Homo sapiens
tcgatctctttgatg

SEQ ID NO: 187310 - DNA, 15 bp, Homo sapiens
ttcgatctctttgat

SEQ ID NO: 187311 - DNA, 15 bp, Homo sapiens
tttcgatctctttga

SEQ ID NO: 187312 - DNA, 15 bp, Homo sapiens
gtttcgatctctttg

SEQ ID NO: 187313 - DNA, 15 bp, Homo sapiens
tgtttcgatctcttt

SEQ ID NO: 187314 - DNA, 15 bp, Homo sapiens
gtgtttcgatctctt

SEQ ID NO: 187315 - DNA, 15 bp, Homo sapiens
agtgtttcgatctct

SEQ ID NO: 187316 - DNA, 15 bp, Homo sapiens
aagtgtttcgatctc

SEQ ID NO: 187317 - DNA, 15 bp, Homo sapiens
aaagtgtttcgatct

SEQ ID NO: 187318 - DNA, 15 bp, Homo sapiens
taaagtgtttcgatc

SEQ ID NO: 187319 - DNA, 15 bp, Homo sapiens
ttaaagtgtttcgat

SEQ ID NO: 187320 - DNA, 15 bp, Homo sapiens
tttaaagtgtttcga

SEQ ID NO: 187321 - DNA, 15 bp, Homo sapiens
ttttaaagtgtttcg

SEQ ID NO: 187322 - DNA, 15 bp, Homo sapiens
gttttaaagtgtttc

SEQ ID NO: 187323 - DNA, 15 bp, Homo sapiens
agttttaaagtgttt

SEQ ID NO: 187324 - DNA, 15 bp, Homo sapiens
tagttttaaagtgtt

SEQ ID NO: 187325 - DNA, 15 bp, Homo sapiens
atagttttaaagtgt

SEQ ID NO: 187326 - DNA, 15 bp, Homo sapiens
aatagttttaaagtg

SEQ ID NO: 187327 - DNA, 15 bp, Homo sapiens
aaatagttttaaagt

SEQ ID NO: 187328 - DNA, 15 bp, Homo sapiens
aaaatagttttaaag

SEQ ID NO: 187329 - DNA, 15 bp, Homo sapiens
gaaaatagttttaaa

SEQ ID NO: 187330 - DNA, 15 bp, Homo sapiens
agaaaatagttttaa

SEQ ID NO: 187331 - DNA, 15 bp, Homo sapiens
aagaaaatagtttta

SEQ ID NO: 187332 - DNA, 15 bp, Homo sapiens
gaagaaaatagtttt

SEQ ID NO: 187333 - DNA, 15 bp, Homo sapiens
tgaagaaaatagttt

SEQ ID NO: 187334 - DNA, 15 bp, Homo sapiens
atgaagaaaatagtt

SEQ ID NO: 187335 - DNA, 15 bp, Homo sapiens
gatgaagaaaatagt

SEQ ID NO: 187336 - DNA, 15 bp, Homo sapiens
tgatgaagaaaatag

SEQ ID NO: 187337 - DNA, 15 bp, Homo sapiens
ctgatgaagaaaata

SEQ ID NO: 187338 - DNA, 15 bp, Homo sapiens
actgatgaagaaaat

SEQ ID NO: 187339 - DNA, 15 bp, Homo sapiens
aactgatgaagaaaa

SEQ ID NO: 187340 - DNA, 15 bp, Homo sapiens
caactgatgaagaaa

SEQ ID NO: 187341 - DNA, 15 bp, Homo sapiens
gcaactgatgaagaa

SEQ ID NO: 187342 - DNA, 15 bp, Homo sapiens
ggcaactgatgaaga

SEQ ID NO: 187343 - DNA, 15 bp, Homo sapiens
aggcaactgatgaag

SEQ ID NO: 187344 - DNA, 15 bp, Homo sapiens
caggcaactgatgaa

SEQ ID NO: 187345 - DNA, 15 bp, Homo sapiens
gcaggcaactgatga

SEQ ID NO: 187346 - DNA, 15 bp, Homo sapiens
agcaggcaactgatg

SEQ ID NO: 187347 - DNA, 15 bp, Homo sapiens
tagcaggcaactgat

SEQ ID NO: 187348 - DNA, 15 bp, Homo sapiens
ttagcaggcaactga

SEQ ID NO: 187349 - DNA, 15 bp, Homo sapiens
gttagcaggcaactg

SEQ ID NO: 187350 - DNA, 15 bp, Homo sapiens
tgttagcaggcaact

SEQ ID NO: 187351 - DNA, 15 bp, Homo sapiens
gtgttagcaggcaac

SEQ ID NO: 187352 - DNA, 15 bp, Homo sapiens
ggtgttagcaggcaa

SEQ ID NO: 187353 - DNA, 15 bp, Homo sapiens
aggtgttagcaggca

SEQ ID NO: 187354 - DNA, 15 bp, Homo sapiens
aaggtgttagcaggc

SEQ ID NO: 187355 - DNA, 15 bp, Homo sapiens
aaaggtgttagcagg

SEQ ID NO: 187356 - DNA, 15 bp, Homo sapiens
aaaaggtgttagcag

SEQ ID NO: 187357 - DNA, 15 bp, Homo sapiens
aaaaaggtgttagca

SEQ ID NO: 187358 - DNA, 15 bp, Homo sapiens
caaaaaggtgttagc

SEQ ID NO: 187359 - DNA, 15 bp, Homo sapiens
tcaaaaaggtgttag

SEQ ID NO: 187360 - DNA, 15 bp, Homo sapiens
ttcaaaaaggtgtta

SEQ ID NO: 187361 - DNA, 15 bp, Homo sapiens
tttcaaaaaggtgtt

SEQ ID NO: 187362 - DNA, 15 bp, Homo sapiens
ttttcaaaaaggtgt

SEQ ID NO: 187363 - DNA, 15 bp, Homo sapiens
tttttcaaaaaggtg

SEQ ID NO: 187364 - DNA, 15 bp, Homo sapiens
atttttcaaaaaggt

SEQ ID NO: 187365 - DNA, 15 bp, Homo sapiens
tatttttcaaaaagg

SEQ ID NO: 187366 - DNA, 15 bp, Homo sapiens
ttatttttcaaaaag

SEQ ID NO: 187367 - DNA, 15 bp, Homo sapiens
tttatttttcaaaaa

SEQ ID NO: 187368 - DNA, 15 bp, Homo sapiens
ttttatttttcaaaa

SEQ ID NO: 187369 - DNA, 15 bp, Homo sapiens
attttatttttcaaa

SEQ ID NO: 187370 - DNA, 15 bp, Homo sapiens
aattttatttttcaa

SEQ ID NO: 187371 - DNA, 15 bp, Homo sapiens
taattttatttttca

SEQ ID NO: 187372 - DNA, 15 bp, Homo sapiens
ttaattttatttttc

SEQ ID NO: 187373 - DNA, 15 bp, Homo sapiens
attaattttattttt

SEQ ID NO: 187374 - DNA, 15 bp, Homo sapiens
gattaattttatttt

SEQ ID NO: 187375 - DNA, 15 bp, Homo sapiens
tgattaattttattt

SEQ ID NO: 187376 - DNA, 15 bp, Homo sapiens
ttgattaattttatt

SEQ ID NO: 187377 - DNA, 15 bp, Homo sapiens
gttgattaattttat

SEQ ID NO: 187378 - DNA, 15 bp, Homo sapiens
cgttgattaatttta

SEQ ID NO: 187379 - DNA, 15 bp, Homo sapiens
gcgttgattaatttt

SEQ ID NO: 187380 - DNA, 15 bp, Homo sapiens
cgcgttgattaattt

SEQ ID NO: 187381 - DNA, 15 bp, Homo sapiens
acgcgttgattaatt

SEQ ID NO: 187382 - DNA, 15 bp, Homo sapiens
tacgcgttgattaat

SEQ ID NO: 187383 - DNA, 15 bp, Homo sapiens
atacgcgttgattaa

SEQ ID NO: 187384 - DNA, 15 bp, Homo sapiens
aatacgcgttgatta

SEQ ID NO: 187385 - DNA, 15 bp, Homo sapiens
aaatacgcgttgatt

SEQ ID NO: 187386 - DNA, 15 bp, Homo sapiens
gaaatacgcgttgat

SEQ ID NO: 187387 - DNA, 15 bp, Homo sapiens
ggaaatacgcgttga

SEQ ID NO: 187388 - DNA, 15 bp, Homo sapiens
aggaaatacgcgttg

SEQ ID NO: 187389 - DNA, 15 bp, Homo sapiens
aaggaaatacgcgtt

SEQ ID NO: 187390 - DNA, 15 bp, Homo sapiens
aaaggaaatacgcgt

SEQ ID NO: 187391 - DNA, 15 bp, Homo sapiens
aaaaggaaatacgcg

SEQ ID NO: 187392 - DNA, 15 bp, Homo sapiens
caaaaggaaatacgc

SEQ ID NO: 187393 - DNA, 15 bp, Homo sapiens
acaaaaggaaatacg

SEQ ID NO: 187394 - DNA, 15 bp, Homo sapiens
cacaaaaggaaatac

SEQ ID NO: 187395 - DNA, 15 bp, Homo sapiens
tcacaaaaggaaata

SEQ ID NO: 187396 - DNA, 15 bp, Homo sapiens
atcacaaaaggaaat

SEQ ID NO: 187397 - DNA, 15 bp, Homo sapiens
aatcacaaaaggaaa

SEQ ID NO: 187398 - DNA, 15 bp, Homo sapiens
aaatcacaaaaggaa

SEQ ID NO: 187399 - DNA, 15 bp, Homo sapiens
caaatcacaaaagga

SEQ ID NO: 187400 - DNA, 15 bp, Homo sapiens
acaaatcacaaaagg

SEQ ID NO: 187401 - DNA, 15 bp, Homo sapiens
tacaaatcacaaaag

SEQ ID NO: 187402 - DNA, 15 bp, Homo sapiens
atacaaatcacaaaa

SEQ ID NO: 187403 - DNA, 15 bp, Homo sapiens
aatacaaatcacaaa

SEQ ID NO: 187404 - DNA, 15 bp, Homo sapiens
caatacaaatcacaa

SEQ ID NO: 187405 - DNA, 15 bp, Homo sapiens
acaatacaaatcaca

SEQ ID NO: 187406 - DNA, 15 bp, Homo sapiens
aacaatacaaatcac

SEQ ID NO: 187407 - DNA, 15 bp, Homo sapiens
aaacaatacaaatca

SEQ ID NO: 187408 - DNA, 15 bp, Homo sapiens
aaaacaatacaaatc

SEQ ID NO: 187409 - DNA, 15 bp, Homo sapiens
caaaacaatacaaat

SEQ ID NO: 187410 - DNA, 15 bp, Homo sapiens
acaaaacaatacaaa

SEQ ID NO: 187411 - DNA, 15 bp, Homo sapiens
tacaaaacaatacaa

SEQ ID NO: 187412 - DNA, 15 bp, Homo sapiens
gtacaaaacaataca

SEQ ID NO: 187413 - DNA, 15 bp, Homo sapiens
tgtacaaaacaatac

SEQ ID NO: 187414 - DNA, 15 bp, Homo sapiens
atgtacaaaacaata

SEQ ID NO: 187415 - DNA, 15 bp, Homo sapiens
aatgtacaaaacaat

SEQ ID NO: 187416 - DNA, 15 bp, Homo sapiens
gaatgtacaaaacaa

SEQ ID NO: 187417 - DNA, 15 bp, Homo sapiens
tgaatgtacaaaaca

SEQ ID NO: 187418 - DNA, 15 bp, Homo sapiens
gtgaatgtacaaaac

SEQ ID NO: 187419 - DNA, 15 bp, Homo sapiens
agtgaatgtacaaaa

SEQ ID NO: 187420 - DNA, 15 bp, Homo sapiens
gagtgaatgtacaaa

SEQ ID NO: 187421 - DNA, 15 bp, Homo sapiens
ggagtgaatgtacaa

SEQ ID NO: 187422 - DNA, 15 bp, Homo sapiens
gggagtgaatgtaca

SEQ ID NO: 187423 - DNA, 15 bp, Homo sapiens
agggagtgaatgtac

SEQ ID NO: 187424 - DNA, 15 bp, Homo sapiens
aagggagtgaatgta

SEQ ID NO: 187425 - DNA, 15 bp, Homo sapiens
aaagggagtgaatgt

SEQ ID NO: 187426 - DNA, 15 bp, Homo sapiens
aaaagggagtgaatg

SEQ ID NO: 187427 - DNA, 15 bp, Homo sapiens
gaaaagggagtgaat

SEQ ID NO: 187428 - DNA, 15 bp, Homo sapiens
agaaaagggagtgaa

SEQ ID NO: 187429 - DNA, 15 bp, Homo sapiens
aagaaaagggagtga

SEQ ID NO: 187430 - DNA, 15 bp, Homo sapiens
aaagaaaagggagtg

SEQ ID NO: 187431 - DNA, 15 bp, Homo sapiens
aaaagaaaagggagt

SEQ ID NO: 187432 - DNA, 15 bp, Homo sapiens
gaaaagaaaagggag

SEQ ID NO: 187433 - DNA, 15 bp, Homo sapiens
tgaaaagaaaaggga

SEQ ID NO: 187434 - DNA, 15 bp, Homo sapiens
atgaaaagaaaaggg

SEQ ID NO: 187435 - DNA, 15 bp, Homo sapiens
catgaaaagaaaagg

SEQ ID NO: 187436 - DNA, 15 bp, Homo sapiens
ccatgaaaagaaaag

SEQ ID NO: 187437 - DNA, 15 bp, Homo sapiens
cccatgaaaagaaaa

SEQ ID NO: 187438 - DNA, 15 bp, Homo sapiens
acccatgaaaagaaa

SEQ ID NO: 187439 - DNA, 15 bp, Homo sapiens
aacccatgaaaagaa

SEQ ID NO: 187440 - DNA, 15 bp, Homo sapiens
caacccatgaaaaga

SEQ ID NO: 187441 - DNA, 15 bp, Homo sapiens
ccaacccatgaaaag

SEQ ID NO: 187442 - DNA, 15 bp, Homo sapiens
gccaacccatgaaaa

SEQ ID NO: 187443 - DNA, 15 bp, Homo sapiens
agccaacccatgaaa

SEQ ID NO: 187444 - DNA, 15 bp, Homo sapiens
gagccaacccatgaa

SEQ ID NO: 187445 - DNA, 15 bp, Homo sapiens
ggagccaacccatga

SEQ ID NO: 187446 - DNA, 15 bp, Homo sapiens
gggagccaacccatg

SEQ ID NO: 187447 - DNA, 15 bp, Homo sapiens
tgggagccaacccat

SEQ ID NO: 187448 - DNA, 15 bp, Homo sapiens
ttgggagccaaccca

SEQ ID NO: 187449 - DNA, 15 bp, Homo sapiens
gttgggagccaaccc

SEQ ID NO: 187450 - DNA, 15 bp, Homo sapiens
agttgggagccaacc

SEQ ID NO: 187451 - DNA, 15 bp, Homo sapiens
cagttgggagccaac

SEQ ID NO: 187452 - DNA, 15 bp, Homo sapiens
ccagttgggagccaa

SEQ ID NO: 187453 - DNA, 15 bp, Homo sapiens
tccagttgggagcca

SEQ ID NO: 187454 - DNA, 15 bp, Homo sapiens
ttccagttgggagcc

SEQ ID NO: 187455 - DNA, 15 bp, Homo sapiens
gttccagttgggagc

SEQ ID NO: 187456 - DNA, 15 bp, Homo sapiens
tgttccagttgggag

SEQ ID NO: 187457 - DNA, 15 bp, Homo sapiens
atgttccagttggga

SEQ ID NO: 187458 - DNA, 15 bp, Homo sapiens
catgttccagttggg

SEQ ID NO: 187459 - DNA, 15 bp, Homo sapiens
ccatgttccagttgg

SEQ ID NO: 187460 - DNA, 15 bp, Homo sapiens
tccatgttccagttg

SEQ ID NO: 187461 - DNA, 15 bp, Homo sapiens
ttccatgttccagtt

SEQ ID NO: 187462 - DNA, 15 bp, Homo sapiens
gttccatgttccagt

SEQ ID NO: 187463 - DNA, 15 bp, Homo sapiens
ggttccatgttccag

SEQ ID NO: 187464 - DNA, 15 bp, Homo sapiens
aggttccatgttcca

SEQ ID NO: 187465 - DNA, 15 bp, Homo sapiens
caggttccatgttcc

SEQ ID NO: 187466 - DNA, 15 bp, Homo sapiens
acaggttccatgttc

SEQ ID NO: 187467 - DNA, 15 bp, Homo sapiens
cacaggttccatgtt

SEQ ID NO: 187468 - DNA, 15 bp, Homo sapiens
tcacaggttccatgt

SEQ ID NO: 187469 - DNA, 15 bp, Homo sapiens
atcacaggttccatg

SEQ ID NO: 187470 - DNA, 15 bp, Homo sapiens
gatcacaggttccat

SEQ ID NO: 187471 - DNA, 15 bp, Homo sapiens
ggatcacaggttcca

SEQ ID NO: 187472 - DNA, 15 bp, Homo sapiens
tggatcacaggttcc

SEQ ID NO: 187473 - DNA, 15 bp, Homo sapiens
atggatcacaggttc

SEQ ID NO: 187474 - DNA, 15 bp, Homo sapiens
aatggatcacaggtt

SEQ ID NO: 187475 - DNA, 15 bp, Homo sapiens
gaatggatcacaggt

SEQ ID NO: 187476 - DNA, 15 bp, Homo sapiens
tgaatggatcacagg

SEQ ID NO: 187477 - DNA, 15 bp, Homo sapiens
ttgaatggatcacag

SEQ ID NO: 187478 - DNA, 15 bp, Homo sapiens
cttgaatggatcaca

SEQ ID NO: 187479 - DNA, 15 bp, Homo sapiens
tcttgaatggatcac

SEQ ID NO: 187480 - DNA, 15 bp, Homo sapiens
atcttgaatggatca

SEQ ID NO: 187481 - DNA, 15 bp, Homo sapiens
aatcttgaatggatc

SEQ ID NO: 187482 - DNA, 15 bp, Homo sapiens
caatcttgaatggat

SEQ ID NO: 187483 - DNA, 15 bp, Homo sapiens
tcaatcttgaatgga

SEQ ID NO: 187484 - DNA, 15 bp, Homo sapiens
ctcaatcttgaatgg

SEQ ID NO: 187485 - DNA, 15 bp, Homo sapiens
tctcaatcttgaatg

SEQ ID NO: 187486 - DNA, 15 bp, Homo sapiens
gtctcaatcttgaat

SEQ ID NO: 187487 - DNA, 15 bp, Homo sapiens
tgtctcaatcttgaa

SEQ ID NO: 187488 - DNA, 15 bp, Homo sapiens
ttgtctcaatcttga

SEQ ID NO: 187489 - DNA, 15 bp, Homo sapiens
attgtctcaatcttg

SEQ ID NO: 187490 - DNA, 15 bp, Homo sapiens
cattgtctcaatctt

SEQ ID NO: 187491 - DNA, 15 bp, Homo sapiens
acattgtctcaatct

SEQ ID NO: 187492 - DNA, 15 bp, Homo sapiens
tacattgtctcaatc

SEQ ID NO: 187493 - DNA, 15 bp, Homo sapiens
ttacattgtctcaat

SEQ ID NO: 187494 - DNA, 15 bp, Homo sapiens
tttacattgtctcaa

SEQ ID NO: 187495 - DNA, 15 bp, Homo sapiens
ttttacattgtctca

SEQ ID NO: 187496 - DNA, 15 bp, Homo sapiens
cttttacattgtctc

SEQ ID NO: 187497 - DNA, 15 bp, Homo sapiens
tcttttacattgtct

SEQ ID NO: 187498 - DNA, 15 bp, Homo sapiens
atcttttacattgtc

SEQ ID NO: 187499 - DNA, 15 bp, Homo sapiens
tatcttttacattgt

SEQ ID NO: 187500 - DNA, 15 bp, Homo sapiens
ctatcttttacattg

SEQ ID NO: 187501 - DNA, 15 bp, Homo sapiens
tctatcttttacatt

SEQ ID NO: 187502 - DNA, 15 bp, Homo sapiens
ctctatcttttacat

SEQ ID NO: 187503 - DNA, 15 bp, Homo sapiens
tctctatcttttaca

SEQ ID NO: 187504 - DNA, 15 bp, Homo sapiens
ttctctatcttttac

SEQ ID NO: 187505 - DNA, 15 bp, Homo sapiens
gttctctatctttta

SEQ ID NO: 187506 - DNA, 15 bp, Homo sapiens
agttctctatctttt

SEQ ID NO: 187507 - DNA, 15 bp, Homo sapiens
cagttctctatcttt

SEQ ID NO: 187508 - DNA, 15 bp, Homo sapiens
tcagttctctatctt

SEQ ID NO: 187509 - DNA, 15 bp, Homo sapiens
gtcagttctctatct

SEQ ID NO: 187510 - DNA, 15 bp, Homo sapiens
agtcagttctctatc

SEQ ID NO: 187511 - DNA, 15 bp, Homo sapiens
aagtcagttctctat

SEQ ID NO: 187512 - DNA, 15 bp, Homo sapiens
aaagtcagttctcta

SEQ ID NO: 187513 - DNA, 15 bp, Homo sapiens
aaaagtcagttctct

SEQ ID NO: 187514 - DNA, 15 bp, Homo sapiens
caaaagtcagttctc

SEQ ID NO: 187515 - DNA, 15 bp, Homo sapiens
ccaaaagtcagttct

SEQ ID NO: 187516 - DNA, 15 bp, Homo sapiens
cccaaaagtcagttc

SEQ ID NO: 187517 - DNA, 15 bp, Homo sapiens
ccccaaaagtcagtt

SEQ ID NO: 187518 - DNA, 15 bp, Homo sapiens
gccccaaaagtcagt

SEQ ID NO: 187519 - DNA, 15 bp, Homo sapiens
tgccccaaaagtcag

SEQ ID NO: 187520 - DNA, 15 bp, Homo sapiens
ctgccccaaaagtca

SEQ ID NO: 187521 - DNA, 15 bp, Homo sapiens
cctgccccaaaagtc

SEQ ID NO: 187522 - DNA, 15 bp, Homo sapiens
gcctgccccaaaagt

SEQ ID NO: 187523 - DNA, 15 bp, Homo sapiens
tgcctgccccaaaag

SEQ ID NO: 187524 - DNA, 15 bp, Homo sapiens
ctgcctgccccaaaa

SEQ ID NO: 187525 - DNA, 15 bp, Homo sapiens
cctgcctgccccaaa

SEQ ID NO: 187526 - DNA, 15 bp, Homo sapiens
gcctgcctgccccaa

SEQ ID NO: 187527 - DNA, 15 bp, Homo sapiens
ggcctgcctgcccca

SEQ ID NO: 187528 - DNA, 15 bp, Homo sapiens
aggcctgcctgcccc

SEQ ID NO: 187529 - DNA, 15 bp, Homo sapiens
gaggcctgcctgccc

SEQ ID NO: 187530 - DNA, 15 bp, Homo sapiens
ggaggcctgcctgcc

SEQ ID NO: 187531 - DNA, 15 bp, Homo sapiens
tggaggcctgcctgc

SEQ ID NO: 187532 - DNA, 15 bp, Homo sapiens
ctggaggcctgcctg

SEQ ID NO: 187533 - DNA, 15 bp, Homo sapiens
cctggaggcctgcct

SEQ ID NO: 187534 - DNA, 15 bp, Homo sapiens
tcctggaggcctgcc

SEQ ID NO: 187535 - DNA, 15 bp, Homo sapiens
ttcctggaggcctgc

SEQ ID NO: 187536 - DNA, 15 bp, Homo sapiens
cttcctggaggcctg

SEQ ID NO: 187537 - DNA, 15 bp, Homo sapiens
acttcctggaggcct

SEQ ID NO: 187538 - DNA, 15 bp, Homo sapiens
cacttcctggaggcc

SEQ ID NO: 187539 - DNA, 15 bp, Homo sapiens
ccacttcctggaggc

SEQ ID NO: 187540 - DNA, 15 bp, Homo sapiens
cccacttcctggagg

SEQ ID NO: 187541 - DNA, 15 bp, Homo sapiens
tcccacttcctggag

SEQ ID NO: 187542 - DNA, 15 bp, Homo sapiens
ctcccacttcctgga

SEQ ID NO: 187543 - DNA, 15 bp, Homo sapiens
actcccacttcctgg

SEQ ID NO: 187544 - DNA, 15 bp, Homo sapiens
cactcccacttcctg

SEQ ID NO: 187545 - DNA, 15 bp, Homo sapiens
tcactcccacttcct

SEQ ID NO: 187546 - DNA, 15 bp, Homo sapiens
ctcactcccacttcc

SEQ ID NO: 187547 - DNA, 15 bp, Homo sapiens
gctcactcccacttc

SEQ ID NO: 187548 - DNA, 15 bp, Homo sapiens
agctcactcccactt

SEQ ID NO: 187549 - DNA, 15 bp, Homo sapiens
aagctcactcccact

SEQ ID NO: 187550 - DNA, 15 bp, Homo sapiens
aaagctcactcccac

SEQ ID NO: 187551 - DNA, 15 bp, Homo sapiens
gaaagctcactccca

SEQ ID NO: 187552 - DNA, 15 bp, Homo sapiens
tgaaagctcactccc

SEQ ID NO: 187553 - DNA, 15 bp, Homo sapiens
gtgaaagctcactcc

SEQ ID NO: 187554 - DNA, 15 bp, Homo sapiens
agtgaaagctcactc

SEQ ID NO: 187555 - DNA, 15 bp, Homo sapiens
aagtgaaagctcact

SEQ ID NO: 187556 - DNA, 15 bp, Homo sapiens
gaagtgaaagctcac

SEQ ID NO: 187557 - DNA, 15 bp, Homo sapiens
tgaagtgaaagctca

SEQ ID NO: 187558 - DNA, 15 bp, Homo sapiens
ttgaagtgaaagctc

SEQ ID NO: 187559 - DNA, 15 bp, Homo sapiens
tttgaagtgaaagct

SEQ ID NO: 187560 - DNA, 15 bp, Homo sapiens
gtttgaagtgaaagc

SEQ ID NO: 187561 - DNA, 15 bp, Homo sapiens
agtttgaagtgaaag

SEQ ID NO: 187562 - DNA, 15 bp, Homo sapiens
cagtttgaagtgaaa

SEQ ID NO: 187563 - DNA, 15 bp, Homo sapiens
ccagtttgaagtgaa

SEQ ID NO: 187564 - DNA, 15 bp, Homo sapiens
cccagtttgaagtga

SEQ ID NO: 187565 - DNA, 15 bp, Homo sapiens
acccagtttgaagtg

SEQ ID NO: 187566 - DNA, 15 bp, Homo sapiens
cacccagtttgaagt

SEQ ID NO: 187567 - DNA, 15 bp, Homo sapiens
tcacccagtttgaag

SEQ ID NO: 187568 - DNA, 15 bp, Homo sapiens
ctcacccagtttgaa

SEQ ID NO: 187569 - DNA, 15 bp, Homo sapiens
cctcacccagtttga

SEQ ID NO: 187570 - DNA, 15 bp, Homo sapiens
ccctcacccagtttg

SEQ ID NO: 187571 - DNA, 15 bp, Homo sapiens
cccctcacccagttt

SEQ ID NO: 187572 - DNA, 15 bp, Homo sapiens
acccctcacccagtt

SEQ ID NO: 187573 - DNA, 15 bp, Homo sapiens
cacccctcacccagt

SEQ ID NO: 187574 - DNA, 15 bp, Homo sapiens
ccacccctcacccag

SEQ ID NO: 187575 - DNA, 15 bp, Homo sapiens
accacccctcaccca

SEQ ID NO: 187576 - DNA, 15 bp, Homo sapiens
caccacccctcaccc

SEQ ID NO: 187577 - DNA, 15 bp, Homo sapiens
ccaccacccctcacc

SEQ ID NO: 187578 - DNA, 15 bp, Homo sapiens
tccaccacccctcac

SEQ ID NO: 187579 - DNA, 15 bp, Homo sapiens
ttccaccacccctca

SEQ ID NO: 187580 - DNA, 15 bp, Homo sapiens
tttccaccacccctc

SEQ ID NO: 187581 - DNA, 15 bp, Homo sapiens
ctttccaccacccct

SEQ ID NO: 187582 - DNA, 15 bp, Homo sapiens
cctttccaccacccc

SEQ ID NO: 187583 - DNA, 15 bp, Homo sapiens
ccctttccaccaccc

SEQ ID NO: 187584 - DNA, 15 bp, Homo sapiens
tccctttccaccacc

SEQ ID NO: 187585 - DNA, 15 bp, Homo sapiens
ctccctttccaccac

SEQ ID NO: 187586 - DNA, 15 bp, Homo sapiens
cctccctttccacca

SEQ ID NO: 187587 - DNA, 15 bp, Homo sapiens
tcctccctttccacc

SEQ ID NO: 187588 - DNA, 15 bp, Homo sapiens
atcctccctttccac

SEQ ID NO: 187589 - DNA, 15 bp, Homo sapiens
catcctccctttcca

SEQ ID NO: 187590 - DNA, 15 bp, Homo sapiens
gcatcctccctttcc

SEQ ID NO: 187591 - DNA, 15 bp, Homo sapiens
agcatcctccctttc

SEQ ID NO: 187592 - DNA, 15 bp, Homo sapiens
cagcatcctcccttt

SEQ ID NO: 187593 - DNA, 15 bp, Homo sapiens
tcagcatcctccctt

SEQ ID NO: 187594 - DNA, 15 bp, Homo sapiens
atcagcatcctccct

SEQ ID NO: 187595 - DNA, 15 bp, Homo sapiens
aatcagcatcctccc

SEQ ID NO: 187596 - DNA, 15 bp, Homo sapiens
taatcagcatcctcc

SEQ ID NO: 187597 - DNA, 15 bp, Homo sapiens
ttaatcagcatcctc

SEQ ID NO: 187598 - DNA, 15 bp, Homo sapiens
tttaatcagcatcct

SEQ ID NO: 187599 - DNA, 15 bp, Homo sapiens
ttttaatcagcatcc

SEQ ID NO: 187600 - DNA, 15 bp, Homo sapiens
attttaatcagcatc

SEQ ID NO: 187601 - DNA, 15 bp, Homo sapiens
tattttaatcagcat

SEQ ID NO: 187602 - DNA, 15 bp, Homo sapiens
ttattttaatcagca

SEQ ID NO: 187603 - DNA, 15 bp, Homo sapiens
attattttaatcagc

SEQ ID NO: 187604 - DNA, 15 bp, Homo sapiens
tattattttaatcag

SEQ ID NO: 187605 - DNA, 15 bp, Homo sapiens
ttattattttaatca

SEQ ID NO: 187606 - DNA, 15 bp, Homo sapiens
tttattattttaatc

SEQ ID NO: 187607 - DNA, 15 bp, Homo sapiens
gtttattattttaat

SEQ ID NO: 187608 - DNA, 15 bp, Homo sapiens
tgtttattattttaa

SEQ ID NO: 187609 - DNA, 15 bp, Homo sapiens
ttgtttattatttta

SEQ ID NO: 187610 - DNA, 15 bp, Homo sapiens
gttgtttattatttt

SEQ ID NO: 187611 - DNA, 15 bp, Homo sapiens
agttgtttattattt

SEQ ID NO: 187612 - DNA, 15 bp, Homo sapiens
cagttgtttattatt

SEQ ID NO: 187613 - DNA, 15 bp, Homo sapiens
gcagttgtttattat

SEQ ID NO: 187614 - DNA, 15 bp, Homo sapiens
agcagttgtttatta

SEQ ID NO: 187615 - DNA, 15 bp, Homo sapiens
cagcagttgtttatt

SEQ ID NO: 187616 - DNA, 15 bp, Homo sapiens
ccagcagttgtttat

SEQ ID NO: 187617 - DNA, 15 bp, Homo sapiens
tccagcagttgttta

SEQ ID NO: 187618 - DNA, 15 bp, Homo sapiens
ttccagcagttgttt

SEQ ID NO: 187619 - DNA, 15 bp, Homo sapiens
tttccagcagttgtt

SEQ ID NO: 187620 - DNA, 15 bp, Homo sapiens
ctttccagcagttgt

SEQ ID NO: 187621 - DNA, 15 bp, Homo sapiens
tctttccagcagttg

SEQ ID NO: 187622 - DNA, 15 bp, Homo sapiens
ctctttccagcagtt

SEQ ID NO: 187623 - DNA, 15 bp, Homo sapiens
tctctttccagcagt

SEQ ID NO: 187624 - DNA, 15 bp, Homo sapiens
ttctctttccagcag

SEQ ID NO: 187625 - DNA, 15 bp, Homo sapiens
cttctctttccagca

SEQ ID NO: 187626 - DNA, 15 bp, Homo sapiens
acttctctttccagc

SEQ ID NO: 187627 - DNA, 15 bp, Homo sapiens
aacttctctttccag

SEQ ID NO: 187628 - DNA, 15 bp, Homo sapiens
caacttctctttcca

SEQ ID NO: 187629 - DNA, 15 bp, Homo sapiens
tcaacttctctttcc

SEQ ID NO: 187630 - DNA, 15 bp, Homo sapiens
atcaacttctctttc

SEQ ID NO: 187631 - DNA, 15 bp, Homo sapiens
aatcaacttctcttt

SEQ ID NO: 187632 - DNA, 15 bp, Homo sapiens
taatcaacttctctt

SEQ ID NO: 187633 - DNA, 15 bp, Homo sapiens
gtaatcaacttctct

SEQ ID NO: 187634 - DNA, 15 bp, Homo sapiens
ggtaatcaacttctc

SEQ ID NO: 187635 - DNA, 15 bp, Homo sapiens
tggtaatcaacttct

SEQ ID NO: 187636 - DNA, 15 bp, Homo sapiens
gtggtaatcaacttc

SEQ ID NO: 187637 - DNA, 15 bp, Homo sapiens
tgtggtaatcaactt

SEQ ID NO: 187638 - DNA, 15 bp, Homo sapiens
gtgtggtaatcaact

SEQ ID NO: 187639 - DNA, 15 bp, Homo sapiens
agtgtggtaatcaac

SEQ ID NO: 187640 - DNA, 15 bp, Homo sapiens
cagtgtggtaatcaa

SEQ ID NO: 187641 - DNA, 15 bp, Homo sapiens
gcagtgtggtaatca

SEQ ID NO: 187642 - DNA, 15 bp, Homo sapiens
agcagtgtggtaatc

SEQ ID NO: 187643 - DNA, 15 bp, Homo sapiens
cagcagtgtggtaat

SEQ ID NO: 187644 - DNA, 15 bp, Homo sapiens
acagcagtgtggtaa

SEQ ID NO: 187645 - DNA, 15 bp, Homo sapiens
gacagcagtgtggta

SEQ ID NO: 187646 - DNA, 15 bp, Homo sapiens
tgacagcagtgtggt

SEQ ID NO: 187647 - DNA, 15 bp, Homo sapiens
ctgacagcagtgtgg

SEQ ID NO: 187648 - DNA, 15 bp, Homo sapiens
tctgacagcagtgtg

SEQ ID NO: 187649 - DNA, 15 bp, Homo sapiens
atctgacagcagtgt

SEQ ID NO: 187650 - DNA, 15 bp, Homo sapiens
gatctgacagcagtg

SEQ ID NO: 187651 - DNA, 15 bp, Homo sapiens
tgatctgacagcagt

SEQ ID NO: 187652 - DNA, 15 bp, Homo sapiens
ctgatctgacagcag

SEQ ID NO: 187653 - DNA, 15 bp, Homo sapiens
gctgatctgacagca

SEQ ID NO: 187654 - DNA, 15 bp, Homo sapiens
ggctgatctgacagc

SEQ ID NO: 187655 - DNA, 15 bp, Homo sapiens
tggctgatctgacag

SEQ ID NO: 187656 - DNA, 15 bp, Homo sapiens
ctggctgatctgaca

SEQ ID NO: 187657 - DNA, 15 bp, Homo sapiens
cctggctgatctgac

SEQ ID NO: 187658 - DNA, 15 bp, Homo sapiens
ccctggctgatctga

SEQ ID NO: 187659 - DNA, 15 bp, Homo sapiens
cccctggctgatctg

SEQ ID NO: 187660 - DNA, 15 bp, Homo sapiens
tcccctggctgatct

SEQ ID NO: 187661 - DNA, 15 bp, Homo sapiens
ctcccctggctgatc

SEQ ID NO: 187662 - DNA, 15 bp, Homo sapiens
gctcccctggctgat

SEQ ID NO: 187663 - DNA, 15 bp, Homo sapiens
agctcccctggctga

SEQ ID NO: 187664 - DNA, 15 bp, Homo sapiens
cagctcccctggctg

SEQ ID NO: 187665 - DNA, 15 bp, Homo sapiens
gcagctcccctggct

SEQ ID NO: 187666 - DNA, 15 bp, Homo sapiens
ggcagctcccctggc

SEQ ID NO: 187667 - DNA, 15 bp, Homo sapiens
tggcagctcccctgg

SEQ ID NO: 187668 - DNA, 15 bp, Homo sapiens
ctggcagctcccctg

SEQ ID NO: 187669 - DNA, 15 bp, Homo sapiens
tctggcagctcccct

SEQ ID NO: 187670 - DNA, 15 bp, Homo sapiens
ctctggcagctcccc

SEQ ID NO: 187671 - DNA, 15 bp, Homo sapiens
gctctggcagctccc

SEQ ID NO: 187672 - DNA, 15 bp, Homo sapiens
ggctctggcagctcc

SEQ ID NO: 187673 - DNA, 15 bp, Homo sapiens
gggctctggcagctc

SEQ ID NO: 187674 - DNA, 15 bp, Homo sapiens
tgggctctggcagct

SEQ ID NO: 187675 - DNA, 15 bp, Homo sapiens
gtgggctctggcagc

SEQ ID NO: 187676 - DNA, 15 bp, Homo sapiens
agtgggctctggcag

SEQ ID NO: 187677 - DNA, 15 bp, Homo sapiens
cagtgggctctggca

SEQ ID NO: 187678 - DNA, 15 bp, Homo sapiens
tcagtgggctctggc

SEQ ID NO: 187679 - DNA, 15 bp, Homo sapiens
ctcagtgggctctgg

SEQ ID NO: 187680 - DNA, 15 bp, Homo sapiens
cctcagtgggctctg

SEQ ID NO: 187681 - DNA, 15 bp, Homo sapiens
gcctcagtgggctct

SEQ ID NO: 187682 - DNA, 15 bp, Homo sapiens
agcctcagtgggctc

SEQ ID NO: 187683 - DNA, 15 bp, Homo sapiens
cagcctcagtgggct

SEQ ID NO: 187684 - DNA, 15 bp, Homo sapiens
gcagcctcagtgggc

SEQ ID NO: 187685 - DNA, 15 bp, Homo sapiens
agcagcctcagtggg

SEQ ID NO: 187686 - DNA, 15 bp, Homo sapiens
gagcagcctcagtgg

SEQ ID NO: 187687 - DNA, 15 bp, Homo sapiens
agagcagcctcagtg

SEQ ID NO: 187688 - DNA, 15 bp, Homo sapiens
gagagcagcctcagt

SEQ ID NO: 187689 - DNA, 15 bp, Homo sapiens
ggagagcagcctcag

SEQ ID NO: 187690 - DNA, 15 bp, Homo sapiens
gggagagcagcctca

SEQ ID NO: 187691 - DNA, 15 bp, Homo sapiens
ggggagagcagcctc

SEQ ID NO: 187692 - DNA, 15 bp, Homo sapiens
aggggagagcagcct

SEQ ID NO: 187693 - DNA, 15 bp, Homo sapiens
caggggagagcagcc

SEQ ID NO: 187694 - DNA, 15 bp, Homo sapiens
gcaggggagagcagc

SEQ ID NO: 187695 - DNA, 15 bp, Homo sapiens
ggcaggggagagcag

SEQ ID NO: 187696 - DNA, 15 bp, Homo sapiens
tggcaggggagagca

SEQ ID NO: 187697 - DNA, 15 bp, Homo sapiens
gtggcaggggagagc

SEQ ID NO: 187698 - DNA, 15 bp, Homo sapiens
tgtggcaggggagag

SEQ ID NO: 187699 - DNA, 15 bp, Homo sapiens
ttgtggcaggggaga

SEQ ID NO: 187700 - DNA, 15 bp, Homo sapiens
tttgtggcaggggag

SEQ ID NO: 187701 - DNA, 15 bp, Homo sapiens
ctttgtggcagggga

SEQ ID NO: 187702 - DNA, 15 bp, Homo sapiens
gctttgtggcagggg

SEQ ID NO: 187703 - DNA, 15 bp, Homo sapiens
ggctttgtggcaggg

SEQ ID NO: 187704 - DNA, 15 bp, Homo sapiens
cggctttgtggcagg

SEQ ID NO: 187705 - DNA, 15 bp, Homo sapiens
ccggctttgtggcag

SEQ ID NO: 187706 - DNA, 15 bp, Homo sapiens
gccggctttgtggca

SEQ ID NO: 187707 - DNA, 15 bp, Homo sapiens
tgccggctttgtggc

SEQ ID NO: 187708 - DNA, 15 bp, Homo sapiens
ctgccggctttgtgg

SEQ ID NO: 187709 - DNA, 15 bp, Homo sapiens
tctgccggctttgtg

SEQ ID NO: 187710 - DNA, 15 bp, Homo sapiens
ttctgccggctttgt

SEQ ID NO: 187711 - DNA, 15 bp, Homo sapiens
cttctgccggctttg

SEQ ID NO: 187712 - DNA, 15 bp, Homo sapiens
ccttctgccggcttt

SEQ ID NO: 187713 - DNA, 15 bp, Homo sapiens
cccttctgccggctt

SEQ ID NO: 187714 - DNA, 15 bp, Homo sapiens
tcccttctgccggct

SEQ ID NO: 187715 - DNA, 15 bp, Homo sapiens
gtcccttctgccggc

SEQ ID NO: 187716 - DNA, 15 bp, Homo sapiens
agtcccttctgccgg

SEQ ID NO: 187717 - DNA, 15 bp, Homo sapiens
tagtcccttctgccg

SEQ ID NO: 187718 - DNA, 15 bp, Homo sapiens
ctagtcccttctgcc

SEQ ID NO: 187719 - DNA, 15 bp, Homo sapiens
tctagtcccttctgc

SEQ ID NO: 187720 - DNA, 15 bp, Homo sapiens
atctagtcccttctg

SEQ ID NO: 187721 - DNA, 15 bp, Homo sapiens
aatctagtcccttct

SEQ ID NO: 187722 - DNA, 15 bp, Homo sapiens
aaatctagtcccttc

SEQ ID NO: 187723 - DNA, 15 bp, Homo sapiens
caaatctagtccctt

SEQ ID NO: 187724 - DNA, 15 bp, Homo sapiens
gcaaatctagtccct

SEQ ID NO: 187725 - DNA, 15 bp, Homo sapiens
agcaaatctagtccc

SEQ ID NO: 187726 - DNA, 15 bp, Homo sapiens
cagcaaatctagtcc

SEQ ID NO: 187727 - DNA, 15 bp, Homo sapiens
gcagcaaatctagtc

SEQ ID NO: 187728 - DNA, 15 bp, Homo sapiens
cgcagcaaatctagt

SEQ ID NO: 187729 - DNA, 15 bp, Homo sapiens
tcgcagcaaatctag

SEQ ID NO: 187730 - DNA, 15 bp, Homo sapiens
ctcgcagcaaatcta

SEQ ID NO: 187731 - DNA, 15 bp, Homo sapiens
tctcgcagcaaatct

SEQ ID NO: 187732 - DNA, 15 bp, Homo sapiens
ctctcgcagcaaatc

SEQ ID NO: 187733 - DNA, 15 bp, Homo sapiens
gctctcgcagcaaat

SEQ ID NO: 187734 - DNA, 15 bp, Homo sapiens
agctctcgcagcaaa

SEQ ID NO: 187735 - DNA, 15 bp, Homo sapiens
aagctctcgcagcaa

SEQ ID NO: 187736 - DNA, 15 bp, Homo sapiens
aaagctctcgcagca

SEQ ID NO: 187737 - DNA, 15 bp, Homo sapiens
aaaagctctcgcagc

SEQ ID NO: 187738 - DNA, 15 bp, Homo sapiens
gaaaagctctcgcag

SEQ ID NO: 187739 - DNA, 15 bp, Homo sapiens
agaaaagctctcgca

SEQ ID NO: 187740 - DNA, 15 bp, Homo sapiens
gagaaaagctctcgc

SEQ ID NO: 187741 - DNA, 15 bp, Homo sapiens
agagaaaagctctcg

SEQ ID NO: 187742 - DNA, 15 bp, Homo sapiens
cagagaaaagctctc

SEQ ID NO: 187743 - DNA, 15 bp, Homo sapiens
ccagagaaaagctct

SEQ ID NO: 187744 - DNA, 15 bp, Homo sapiens
tccagagaaaagctc

SEQ ID NO: 187745 - DNA, 15 bp, Homo sapiens
gtccagagaaaagct

SEQ ID NO: 187746 - DNA, 15 bp, Homo sapiens
tgtccagagaaaagc

SEQ ID NO: 187747 - DNA, 15 bp, Homo sapiens
ctgtccagagaaaag

SEQ ID NO: 187748 - DNA, 15 bp, Homo sapiens
tctgtccagagaaaa

SEQ ID NO: 187749 - DNA, 15 bp, Homo sapiens
gtctgtccagagaaa

SEQ ID NO: 187750 - DNA, 15 bp, Homo sapiens
tgtctgtccagagaa

SEQ ID NO: 187751 - DNA, 15 bp, Homo sapiens
ctgtctgtccagaga

SEQ ID NO: 187752 - DNA, 15 bp, Homo sapiens
tctgtctgtccagag

SEQ ID NO: 187753 - DNA, 15 bp, Homo sapiens
ttctgtctgtccaga

SEQ ID NO: 187754 - DNA, 15 bp, Homo sapiens
gttctgtctgtccag

SEQ ID NO: 187755 - DNA, 15 bp, Homo sapiens
tgttctgtctgtcca

SEQ ID NO: 187756 - DNA, 15 bp, Homo sapiens
gtgttctgtctgtcc

SEQ ID NO: 187757 - DNA, 15 bp, Homo sapiens
ggtgttctgtctgtc

SEQ ID NO: 187758 - DNA, 15 bp, Homo sapiens
aggtgttctgtctgt

SEQ ID NO: 187759 - DNA, 15 bp, Homo sapiens
aaggtgttctgtctg

SEQ ID NO: 187760 - DNA, 15 bp, Homo sapiens
aaaggtgttctgtct

SEQ ID NO: 187761 - DNA, 15 bp, Homo sapiens
aaaaggtgttctgtc

SEQ ID NO: 187762 - DNA, 15 bp, Homo sapiens
taaaaggtgttctgt

SEQ ID NO: 187763 - DNA, 15 bp, Homo sapiens
ttaaaaggtgttctg

SEQ ID NO: 187764 - DNA, 15 bp, Homo sapiens
tttaaaaggtgttct

SEQ ID NO: 187765 - DNA, 15 bp, Homo sapiens
ttttaaaaggtgttc

SEQ ID NO: 187766 - DNA, 15 bp, Homo sapiens
gttttaaaaggtgtt

SEQ ID NO: 187767 - DNA, 15 bp, Homo sapiens
tgttttaaaaggtgt

SEQ ID NO: 187768 - DNA, 15 bp, Homo sapiens
ttgttttaaaaggtg

SEQ ID NO: 187769 - DNA, 15 bp, Homo sapiens
cttgttttaaaaggt

SEQ ID NO: 187770 - DNA, 15 bp, Homo sapiens
acttgttttaaaagg

SEQ ID NO: 187771 - DNA, 15 bp, Homo sapiens
aacttgttttaaaag

SEQ ID NO: 187772 - DNA, 15 bp, Homo sapiens
aaacttgttttaaaa

SEQ ID NO: 187773 - DNA, 15 bp, Homo sapiens
taaacttgttttaaa

SEQ ID NO: 187774 - DNA, 15 bp, Homo sapiens
ctaaacttgttttaa

SEQ ID NO: 187775 - DNA, 15 bp, Homo sapiens
actaaacttgtttta

SEQ ID NO: 187776 - DNA, 15 bp, Homo sapiens
aactaaacttgtttt

SEQ ID NO: 187777 - DNA, 15 bp, Homo sapiens
gaactaaacttgttt

SEQ ID NO: 187778 - DNA, 15 bp, Homo sapiens
agaactaaacttgtt

SEQ ID NO: 187779 - DNA, 15 bp, Homo sapiens
cagaactaaacttgt

SEQ ID NO: 187780 - DNA, 15 bp, Homo sapiens
acagaactaaacttg

SEQ ID NO: 187781 - DNA, 15 bp, Homo sapiens
aacagaactaaactt

SEQ ID NO: 187782 - DNA, 15 bp, Homo sapiens
caacagaactaaact

SEQ ID NO: 187783 - DNA, 15 bp, Homo sapiens
gcaacagaactaaac

SEQ ID NO: 187784 - DNA, 15 bp, Homo sapiens
tgcaacagaactaaa

SEQ ID NO: 187785 - DNA, 15 bp, Homo sapiens
atgcaacagaactaa

SEQ ID NO: 187786 - DNA, 15 bp, Homo sapiens
aatgcaacagaacta

SEQ ID NO: 187787 - DNA, 15 bp, Homo sapiens
caatgcaacagaact

SEQ ID NO: 187788 - DNA, 15 bp, Homo sapiens
tcaatgcaacagaac

SEQ ID NO: 187789 - DNA, 15 bp, Homo sapiens
gtcaatgcaacagaa

SEQ ID NO: 187790 - DNA, 15 bp, Homo sapiens
tgtcaatgcaacaga

SEQ ID NO: 187791 - DNA, 15 bp, Homo sapiens
ctgtcaatgcaacag

SEQ ID NO: 187792 - DNA, 15 bp, Homo sapiens
gctgtcaatgcaaca

SEQ ID NO: 187793 - DNA, 15 bp, Homo sapiens
tgctgtcaatgcaac

SEQ ID NO: 187794 - DNA, 15 bp, Homo sapiens
atgctgtcaatgcaa

SEQ ID NO: 187795 - DNA, 15 bp, Homo sapiens
gatgctgtcaatgca

SEQ ID NO: 187796 - DNA, 15 bp, Homo sapiens
ggatgctgtcaatgc

SEQ ID NO: 187797 - DNA, 15 bp, Homo sapiens
gggatgctgtcaatg

SEQ ID NO: 187798 - DNA, 15 bp, Homo sapiens
agggatgctgtcaat

SEQ ID NO: 187799 - DNA, 15 bp, Homo sapiens
aagggatgctgtcaa

SEQ ID NO: 187800 - DNA, 15 bp, Homo sapiens
taagggatgctgtca

SEQ ID NO: 187801 - DNA, 15 bp, Homo sapiens
ctaagggatgctgtc

SEQ ID NO: 187802 - DNA, 15 bp, Homo sapiens
cctaagggatgctgt

SEQ ID NO: 187803 - DNA, 15 bp, Homo sapiens
gcctaagggatgctg

SEQ ID NO: 187804 - DNA, 15 bp, Homo sapiens
ggcctaagggatgct

SEQ ID NO: 187805 - DNA, 15 bp, Homo sapiens
tggcctaagggatgc

SEQ ID NO: 187806 - DNA, 15 bp, Homo sapiens
ctggcctaagggatg

SEQ ID NO: 187807 - DNA, 15 bp, Homo sapiens
cctggcctaagggat

SEQ ID NO: 187808 - DNA, 15 bp, Homo sapiens
gcctggcctaaggga

SEQ ID NO: 187809 - DNA, 15 bp, Homo sapiens
agcctggcctaaggg

SEQ ID NO: 187810 - DNA, 15 bp, Homo sapiens
cagcctggcctaagg

SEQ ID NO: 187811 - DNA, 15 bp, Homo sapiens
tcagcctggcctaag

SEQ ID NO: 187812 - DNA, 15 bp, Homo sapiens
gtcagcctggcctaa

SEQ ID NO: 187813 - DNA, 15 bp, Homo sapiens
ggtcagcctggccta

SEQ ID NO: 187814 - DNA, 15 bp, Homo sapiens
aggtcagcctggcct

SEQ ID NO: 187815 - DNA, 15 bp, Homo sapiens
taggtcagcctggcc

SEQ ID NO: 187816 - DNA, 15 bp, Homo sapiens
ctaggtcagcctggc

SEQ ID NO: 187817 - DNA, 15 bp, Homo sapiens
cctaggtcagcctgg

SEQ ID NO: 187818 - DNA, 15 bp, Homo sapiens
ccctaggtcagcctg

SEQ ID NO: 187819 - DNA, 15 bp, Homo sapiens
tccctaggtcagcct

SEQ ID NO: 187820 - DNA, 15 bp, Homo sapiens
ttccctaggtcagcc

SEQ ID NO: 187821 - DNA, 15 bp, Homo sapiens
tttccctaggtcagc

SEQ ID NO: 187822 - DNA, 15 bp, Homo sapiens
atttccctaggtcag

SEQ ID NO: 187823 - DNA, 15 bp, Homo sapiens
catttccctaggtca

SEQ ID NO: 187824 - DNA, 15 bp, Homo sapiens
ccatttccctaggtc

SEQ ID NO: 187825 - DNA, 15 bp, Homo sapiens
tccatttccctaggt

SEQ ID NO: 187826 - DNA, 15 bp, Homo sapiens
gtccatttccctagg

SEQ ID NO: 187827 - DNA, 15 bp, Homo sapiens
agtccatttccctag

SEQ ID NO: 187828 - DNA, 15 bp, Homo sapiens
cagtccatttcccta

SEQ ID NO: 187829 - DNA, 15 bp, Homo sapiens
tcagtccatttccct

SEQ ID NO: 187830 - DNA, 15 bp, Homo sapiens
ttcagtccatttccc

SEQ ID NO: 187831 - DNA, 15 bp, Homo sapiens
tttcagtccatttcc

SEQ ID NO: 187832 - DNA, 15 bp, Homo sapiens
gtttcagtccatttc

SEQ ID NO: 187833 - DNA, 15 bp, Homo sapiens
agtttcagtccattt

SEQ ID NO: 187834 - DNA, 15 bp, Homo sapiens
tagtttcagtccatt

SEQ ID NO: 187835 - DNA, 15 bp, Homo sapiens
ctagtttcagtccat

SEQ ID NO: 187836 - DNA, 15 bp, Homo sapiens
gctagtttcagtcca

SEQ ID NO: 187837 - DNA, 15 bp, Homo sapiens
agctagtttcagtcc

SEQ ID NO: 187838 - DNA, 15 bp, Homo sapiens
aagctagtttcagtc

SEQ ID NO: 187839 - DNA, 15 bp, Homo sapiens
caagctagtttcagt

SEQ ID NO: 187840 - DNA, 15 bp, Homo sapiens
ccaagctagtttcag

SEQ ID NO: 187841 - DNA, 15 bp, Homo sapiens
accaagctagtttca

SEQ ID NO: 187842 - DNA, 15 bp, Homo sapiens
caccaagctagtttc

SEQ ID NO: 187843 - DNA, 15 bp, Homo sapiens
ccaccaagctagttt

SEQ ID NO: 187844 - DNA, 15 bp, Homo sapiens
accaccaagctagtt

SEQ ID NO: 187845 - DNA, 15 bp, Homo sapiens
aaccaccaagctagt

SEQ ID NO: 187846 - DNA, 15 bp, Homo sapiens
taaccaccaagctag

SEQ ID NO: 187847 - DNA, 15 bp, Homo sapiens
gtaaccaccaagcta

SEQ ID NO: 187848 - DNA, 15 bp, Homo sapiens
ggtaaccaccaagct

SEQ ID NO: 187849 - DNA, 15 bp, Homo sapiens
tggtaaccaccaagc

SEQ ID NO: 187850 - DNA, 15 bp, Homo sapiens
atggtaaccaccaag

SEQ ID NO: 187851 - DNA, 15 bp, Homo sapiens
tatggtaaccaccaa

SEQ ID NO: 187852 - DNA, 15 bp, Homo sapiens
ctatggtaaccacca

SEQ ID NO: 187853 - DNA, 15 bp, Homo sapiens
gctatggtaaccacc

SEQ ID NO: 187854 - DNA, 15 bp, Homo sapiens
tgctatggtaaccac

SEQ ID NO: 187855 - DNA, 15 bp, Homo sapiens
ttgctatggtaacca

SEQ ID NO: 187856 - DNA, 15 bp, Homo sapiens
gttgctatggtaacc

SEQ ID NO: 187857 - DNA, 15 bp, Homo sapiens
ggttgctatggtaac

SEQ ID NO: 187858 - DNA, 15 bp, Homo sapiens
gggttgctatggtaa

SEQ ID NO: 187859 - DNA, 15 bp, Homo sapiens
tgggttgctatggta

SEQ ID NO: 187860 - DNA, 15 bp, Homo sapiens
ctgggttgctatggt

SEQ ID NO: 187861 - DNA, 15 bp, Homo sapiens
cctgggttgctatgg

SEQ ID NO: 187862 - DNA, 15 bp, Homo sapiens
gcctgggttgctatg

SEQ ID NO: 187863 - DNA, 15 bp, Homo sapiens
agcctgggttgctat

SEQ ID NO: 187864 - DNA, 15 bp, Homo sapiens
cagcctgggttgcta

SEQ ID NO: 187865 - DNA, 15 bp, Homo sapiens
gcagcctgggttgct

SEQ ID NO: 187866 - DNA, 15 bp, Homo sapiens
agcagcctgggttgc

SEQ ID NO: 187867 - DNA, 15 bp, Homo sapiens
cagcagcctgggttg

SEQ ID NO: 187868 - DNA, 15 bp, Homo sapiens
ccagcagcctgggtt

SEQ ID NO: 187869 - DNA, 15 bp, Homo sapiens
accagcagcctgggt

SEQ ID NO: 187870 - DNA, 15 bp, Homo sapiens
caccagcagcctggg

SEQ ID NO: 187871 - DNA, 15 bp, Homo sapiens
acaccagcagcctgg

SEQ ID NO: 187872 - DNA, 15 bp, Homo sapiens
gacaccagcagcctg

SEQ ID NO: 187873 - DNA, 15 bp, Homo sapiens
agacaccagcagcct

SEQ ID NO: 187874 - DNA, 15 bp, Homo sapiens
cagacaccagcagcc

SEQ ID NO: 187875 - DNA, 15 bp, Homo sapiens
ccagacaccagcagc

SEQ ID NO: 187876 - DNA, 15 bp, Homo sapiens
cccagacaccagcag

SEQ ID NO: 187877 - DNA, 15 bp, Homo sapiens
tcccagacaccagca

SEQ ID NO: 187878 - DNA, 15 bp, Homo sapiens
ctcccagacaccagc

SEQ ID NO: 187879 - DNA, 15 bp, Homo sapiens
tctcccagacaccag

SEQ ID NO: 187880 - DNA, 15 bp, Homo sapiens
ctctcccagacacca

SEQ ID NO: 187881 - DNA, 15 bp, Homo sapiens
actctcccagacacc

SEQ ID NO: 187882 - DNA, 15 bp, Homo sapiens
cactctcccagacac

SEQ ID NO: 187883 - DNA, 15 bp, Homo sapiens
tcactctcccagaca

SEQ ID NO: 187884 - DNA, 15 bp, Homo sapiens
ctcactctcccagac

SEQ ID NO: 187885 - DNA, 15 bp, Homo sapiens
tctcactctcccaga

SEQ ID NO: 187886 - DNA, 15 bp, Homo sapiens
ttctcactctcccag

SEQ ID NO: 187887 - DNA, 15 bp, Homo sapiens
gttctcactctccca

SEQ ID NO: 187888 - DNA, 15 bp, Homo sapiens
ggttctcactctccc

SEQ ID NO: 187889 - DNA, 15 bp, Homo sapiens
cggttctcactctcc

SEQ ID NO: 187890 - DNA, 15 bp, Homo sapiens
ccggttctcactctc

SEQ ID NO: 187891 - DNA, 15 bp, Homo sapiens
accggttctcactct

SEQ ID NO: 187892 - DNA, 15 bp, Homo sapiens
caccggttctcactc

SEQ ID NO: 187893 - DNA, 15 bp, Homo sapiens
ccaccggttctcact

SEQ ID NO: 187894 - DNA, 15 bp, Homo sapiens
gccaccggttctcac

SEQ ID NO: 187895 - DNA, 15 bp, Homo sapiens
ggccaccggttctca

SEQ ID NO: 187896 - DNA, 15 bp, Homo sapiens
aggccaccggttctc

SEQ ID NO: 187897 - DNA, 15 bp, Homo sapiens
gaggccaccggttct

SEQ ID NO: 187898 - DNA, 15 bp, Homo sapiens
agaggccaccggttc

SEQ ID NO: 187899 - DNA, 15 bp, Homo sapiens
aagaggccaccggtt

SEQ ID NO: 187900 - DNA, 15 bp, Homo sapiens
caagaggccaccggt

SEQ ID NO: 187901 - DNA, 15 bp, Homo sapiens
acaagaggccaccgg

SEQ ID NO: 187902 - DNA, 15 bp, Homo sapiens
gacaagaggccaccg

SEQ ID NO: 187903 - DNA, 15 bp, Homo sapiens
ggacaagaggccacc

SEQ ID NO: 187904 - DNA, 15 bp, Homo sapiens
aggacaagaggccac

SEQ ID NO: 187905 - DNA, 15 bp, Homo sapiens
caggacaagaggcca

SEQ ID NO: 187906 - DNA, 15 bp, Homo sapiens
acaggacaagaggcc

SEQ ID NO: 187907 - DNA, 15 bp, Homo sapiens
cacaggacaagaggc

SEQ ID NO: 187908 - DNA, 15 bp, Homo sapiens
acacaggacaagagg

SEQ ID NO: 187909 - DNA, 15 bp, Homo sapiens
aacacaggacaagag

SEQ ID NO: 187910 - DNA, 15 bp, Homo sapiens
aaacacaggacaaga

SEQ ID NO: 187911 - DNA, 15 bp, Homo sapiens
aaaacacaggacaag

SEQ ID NO: 187912 - DNA, 15 bp, Homo sapiens
caaaacacaggacaa

SEQ ID NO: 187913 - DNA, 15 bp, Homo sapiens
ccaaaacacaggaca

SEQ ID NO: 187914 - DNA, 15 bp, Homo sapiens
accaaaacacaggac

SEQ ID NO: 187915 - DNA, 15 bp, Homo sapiens
caccaaaacacagga

SEQ ID NO: 187916 - DNA, 15 bp, Homo sapiens
acaccaaaacacagg

SEQ ID NO: 187917 - DNA, 15 bp, Homo sapiens
aacaccaaaacacag

SEQ ID NO: 187918 - DNA, 15 bp, Homo sapiens
aaacaccaaaacaca

SEQ ID NO: 187919 - DNA, 15 bp, Homo sapiens
gaaacaccaaaacac

SEQ ID NO: 187920 - DNA, 15 bp, Homo sapiens
agaaacaccaaaaca

SEQ ID NO: 187921 - DNA, 15 bp, Homo sapiens
aagaaacaccaaaac

SEQ ID NO: 187922 - DNA, 15 bp, Homo sapiens
gaagaaacaccaaaa

SEQ ID NO: 187923 - DNA, 15 bp, Homo sapiens
tgaagaaacaccaaa

SEQ ID NO: 187924 - DNA, 15 bp, Homo sapiens
ctgaagaaacaccaa

SEQ ID NO: 187925 - DNA, 15 bp, Homo sapiens
gctgaagaaacacca

SEQ ID NO: 187926 - DNA, 15 bp, Homo sapiens
agctgaagaaacacc

SEQ ID NO: 187927 - DNA, 15 bp, Homo sapiens
tagctgaagaaacac

SEQ ID NO: 187928 - DNA, 15 bp, Homo sapiens
ttagctgaagaaaca

SEQ ID NO: 187929 - DNA, 15 bp, Homo sapiens
cttagctgaagaaac

SEQ ID NO: 187930 - DNA, 15 bp, Homo sapiens
tcttagctgaagaaa

SEQ ID NO: 187931 - DNA, 15 bp, Homo sapiens
ctcttagctgaagaa

SEQ ID NO: 187932 - DNA, 15 bp, Homo sapiens
actcttagctgaaga

SEQ ID NO: 187933 - DNA, 15 bp, Homo sapiens
tactcttagctgaag

SEQ ID NO: 187934 - DNA, 15 bp, Homo sapiens
gtactcttagctgaa

SEQ ID NO: 187935 - DNA, 15 bp, Homo sapiens
tgtactcttagctga

SEQ ID NO: 187936 - DNA, 15 bp, Homo sapiens
gtgtactcttagctg

SEQ ID NO: 187937 - DNA, 15 bp, Homo sapiens
agtgtactcttagct

SEQ ID NO: 187938 - DNA, 15 bp, Homo sapiens
gagtgtactcttagc

SEQ ID NO: 187939 - DNA, 15 bp, Homo sapiens
ggagtgtactcttag

SEQ ID NO: 187940 - DNA, 15 bp, Homo sapiens
aggagtgtactctta

SEQ ID NO: 187941 - DNA, 15 bp, Homo sapiens
gaggagtgtactctt

SEQ ID NO: 187942 - DNA, 15 bp, Homo sapiens
ggaggagtgtactct

SEQ ID NO: 187943 - DNA, 15 bp, Homo sapiens
aggaggagtgtactc

SEQ ID NO: 187944 - DNA, 15 bp, Homo sapiens
aaggaggagtgtact

SEQ ID NO: 187945 - DNA, 15 bp, Homo sapiens
gaaggaggagtgtac

SEQ ID NO: 187946 - DNA, 15 bp, Homo sapiens
cgaaggaggagtgta

SEQ ID NO: 187947 - DNA, 15 bp, Homo sapiens
tcgaaggaggagtgt

SEQ ID NO: 187948 - DNA, 15 bp, Homo sapiens
ttcgaaggaggagtg

SEQ ID NO: 187949 - DNA, 15 bp, Homo sapiens
gttcgaaggaggagt

SEQ ID NO: 187950 - DNA, 15 bp, Homo sapiens
agttcgaaggaggag

SEQ ID NO: 187951 - DNA, 15 bp, Homo sapiens
gagttcgaaggagga

SEQ ID NO: 187952 - DNA, 15 bp, Homo sapiens
agagttcgaaggagg

SEQ ID NO: 187953 - DNA, 15 bp, Homo sapiens
tagagttcgaaggag

SEQ ID NO: 187954 - DNA, 15 bp, Homo sapiens
gtagagttcgaagga

SEQ ID NO: 187955 - DNA, 15 bp, Homo sapiens
tgtagagttcgaagg

SEQ ID NO: 187956 - DNA, 15 bp, Homo sapiens
atgtagagttcgaag

SEQ ID NO: 187957 - DNA, 15 bp, Homo sapiens
tatgtagagttcgaa

SEQ ID NO: 187958 - DNA, 15 bp, Homo sapiens
ttatgtagagttcga

SEQ ID NO: 187959 - DNA, 15 bp, Homo sapiens
cttatgtagagttcg

SEQ ID NO: 187960 - DNA, 15 bp, Homo sapiens
acttatgtagagttc

SEQ ID NO: 187961 - DNA, 15 bp, Homo sapiens
gacttatgtagagtt

SEQ ID NO: 187962 - DNA, 15 bp, Homo sapiens
tgacttatgtagagt

SEQ ID NO: 187963 - DNA, 15 bp, Homo sapiens
atgacttatgtagag

SEQ ID NO: 187964 - DNA, 15 bp, Homo sapiens
catgacttatgtaga

SEQ ID NO: 187965 - DNA, 15 bp, Homo sapiens
gcatgacttatgtag

SEQ ID NO: 187966 - DNA, 15 bp, Homo sapiens
agcatgacttatgta

SEQ ID NO: 187967 - DNA, 15 bp, Homo sapiens
gagcatgacttatgt

SEQ ID NO: 187968 - DNA, 15 bp, Homo sapiens
agagcatgacttatg

SEQ ID NO: 187969 - DNA, 15 bp, Homo sapiens
aagagcatgacttat

SEQ ID NO: 187970 - DNA, 15 bp, Homo sapiens
aaagagcatgactta

SEQ ID NO: 187971 - DNA, 15 bp, Homo sapiens
caaagagcatgactt

SEQ ID NO: 187972 - DNA, 15 bp, Homo sapiens
tcaaagagcatgact

SEQ ID NO: 187973 - DNA, 15 bp, Homo sapiens
ttcaaagagcatgac

SEQ ID NO: 187974 - DNA, 15 bp, Homo sapiens
tttcaaagagcatga

SEQ ID NO: 187975 - DNA, 15 bp, Homo sapiens
ttttcaaagagcatg

SEQ ID NO: 187976 - DNA, 15 bp, Homo sapiens
gttttcaaagagcat

SEQ ID NO: 187977 - DNA, 15 bp, Homo sapiens
agttttcaaagagca

SEQ ID NO: 187978 - DNA, 15 bp, Homo sapiens
cagttttcaaagagc

SEQ ID NO: 187979 - DNA, 15 bp, Homo sapiens
ccagttttcaaagag

SEQ ID NO: 187980 - DNA, 15 bp, Homo sapiens
gccagttttcaaaga

SEQ ID NO: 187981 - DNA, 15 bp, Homo sapiens
agccagttttcaaag

SEQ ID NO: 187982 - DNA, 15 bp, Homo sapiens
gagccagttttcaaa

SEQ ID NO: 187983 - DNA, 15 bp, Homo sapiens
agagccagttttcaa

SEQ ID NO: 187984 - DNA, 15 bp, Homo sapiens
aagagccagttttca

SEQ ID NO: 187985 - DNA, 15 bp, Homo sapiens
aaagagccagttttc

SEQ ID NO: 187986 - DNA, 15 bp, Homo sapiens
taaagagccagtttt

SEQ ID NO: 187987 - DNA, 15 bp, Homo sapiens
gtaaagagccagttt

SEQ ID NO: 187988 - DNA, 15 bp, Homo sapiens
ggtaaagagccagtt

SEQ ID NO: 187989 - DNA, 15 bp, Homo sapiens
gggtaaagagccagt

SEQ ID NO: 187990 - DNA, 15 bp, Homo sapiens
tgggtaaagagccag

SEQ ID NO: 187991 - DNA, 15 bp, Homo sapiens
ctgggtaaagagcca

SEQ ID NO: 187992 - DNA, 15 bp, Homo sapiens
cctgggtaaagagcc

SEQ ID NO: 187993 - DNA, 15 bp, Homo sapiens
tcctgggtaaagagc

SEQ ID NO: 187994 - DNA, 15 bp, Homo sapiens
atcctgggtaaagag

SEQ ID NO: 187995 - DNA, 15 bp, Homo sapiens
aatcctgggtaaaga

SEQ ID NO: 187996 - DNA, 15 bp, Homo sapiens
aaatcctgggtaaag

SEQ ID NO: 187997 - DNA, 15 bp, Homo sapiens
aaaatcctgggtaaa

SEQ ID NO: 187998 - DNA, 15 bp, Homo sapiens
aaaaatcctgggtaa

SEQ ID NO: 187999 - DNA, 15 bp, Homo sapiens
aaaaaatcctgggta

SEQ ID NO: 188000 - DNA, 15 bp, Homo sapiens
aaaaaaatcctgggt

SEQ ID NO: 188001 - DNA, 15 bp, Homo sapiens
aaaaaaaatcctggg

SEQ ID NO: 188002 - DNA, 15 bp, Homo sapiens
aaaaaaaaatcctgg

SEQ ID NO: 188003 - DNA, 15 bp, Homo sapiens
aaaaaaaaaatcctg

SEQ ID NO: 188004 - DNA, 15 bp, Homo sapiens
aaaaaaaaaaatcct

SEQ ID NO: 188005 - DNA, 15 bp, Homo sapiens
aaaaaaaaaaaatcc

SEQ ID NO: 188006 - DNA, 15 bp, Homo sapiens
gaaaaaaaaaaaatc

SEQ ID NO: 188007 - DNA, 15 bp, Homo sapiens
cgaaaaaaaaaaaat

SEQ ID NO: 188008 - DNA, 15 bp, Homo sapiens
gaacgaaaaaaaaaa

SEQ ID NO: 188009 - DNA, 15 bp, Homo sapiens
agaacgaaaaaaaaa

SEQ ID NO: 188010 - DNA, 15 bp, Homo sapiens
cagaacgaaaaaaaa

SEQ ID NO: 188011 - DNA, 15 bp, Homo sapiens
tcagaacgaaaaaaa

SEQ ID NO: 188012 - DNA, 15 bp, Homo sapiens
ttcagaacgaaaaaa

SEQ ID NO: 188013 - DNA, 15 bp, Homo sapiens
tttcagaacgaaaaa

SEQ ID NO: 188014 - DNA, 15 bp, Homo sapiens
atttcagaacgaaaa

SEQ ID NO: 188015 - DNA, 15 bp, Homo sapiens
gatttcagaacgaaa

SEQ ID NO: 188016 - DNA, 15 bp, Homo sapiens
cgatttcagaacgaa

SEQ ID NO: 188017 - DNA, 15 bp, Homo sapiens
ccgatttcagaacga

SEQ ID NO: 188018 - DNA, 15 bp, Homo sapiens
accgatttcagaacg

SEQ ID NO: 188019 - DNA, 15 bp, Homo sapiens
gaccgatttcagaac

SEQ ID NO: 188020 - DNA, 15 bp, Homo sapiens
agaccgatttcagaa

SEQ ID NO: 188021 - DNA, 15 bp, Homo sapiens
cagaccgatttcaga

SEQ ID NO: 188022 - DNA, 15 bp, Homo sapiens
tcagaccgatttcag

SEQ ID NO: 188023 - DNA, 15 bp, Homo sapiens
ttcagaccgatttca

SEQ ID NO: 188024 - DNA, 15 bp, Homo sapiens
attcagaccgatttc

SEQ ID NO: 188025 - DNA, 15 bp, Homo sapiens
cattcagaccgattt

SEQ ID NO: 188026 - DNA, 15 bp, Homo sapiens
ccattcagaccgatt

SEQ ID NO: 188027 - DNA, 15 bp, Homo sapiens
tccattcagaccgat

SEQ ID NO: 188028 - DNA, 15 bp, Homo sapiens
ctccattcagaccga

SEQ ID NO: 188029 - DNA, 15 bp, Homo sapiens
cctccattcagaccg

SEQ ID NO: 188030 - DNA, 15 bp, Homo sapiens
tcctccattcagacc

SEQ ID NO: 188031 - DNA, 15 bp, Homo sapiens
ttcctccattcagac

SEQ ID NO: 188032 - DNA, 15 bp, Homo sapiens
cttcctccattcaga

SEQ ID NO: 188033 - DNA, 15 bp, Homo sapiens
acttcctccattcag

SEQ ID NO: 188034 - DNA, 15 bp, Homo sapiens
aacttcctccattca

SEQ ID NO: 188035 - DNA, 15 bp, Homo sapiens
caacttcctccattc

SEQ ID NO: 188036 - DNA, 15 bp, Homo sapiens
ccaacttcctccatt

SEQ ID NO: 188037 - DNA, 15 bp, Homo sapiens
accaacttcctccat

SEQ ID NO: 188038 - DNA, 15 bp, Homo sapiens
taccaacttcctcca

SEQ ID NO: 188039 - DNA, 15 bp, Homo sapiens
ttaccaacttcctcc

SEQ ID NO: 188040 - DNA, 15 bp, Homo sapiens
attaccaacttcctc

SEQ ID NO: 188041 - DNA, 15 bp, Homo sapiens
tattaccaacttcct

SEQ ID NO: 188042 - DNA, 15 bp, Homo sapiens
gtattaccaacttcc

SEQ ID NO: 188043 - DNA, 15 bp, Homo sapiens
agtattaccaacttc

SEQ ID NO: 188044 - DNA, 15 bp, Homo sapiens
aagtattaccaactt

SEQ ID NO: 188045 - DNA, 15 bp, Homo sapiens
caagtattaccaact

SEQ ID NO: 188046 - DNA, 15 bp, Homo sapiens
ccaagtattaccaac

SEQ ID NO: 188047 - DNA, 15 bp, Homo sapiens
gccaagtattaccaa

SEQ ID NO: 188048 - DNA, 15 bp, Homo sapiens
agccaagtattacca

SEQ ID NO: 188049 - DNA, 15 bp, Homo sapiens
aagccaagtattacc

SEQ ID NO: 188050 - DNA, 15 bp, Homo sapiens
aaagccaagtattac

SEQ ID NO: 188051 - DNA, 15 bp, Homo sapiens
aaaagccaagtatta

SEQ ID NO: 188052 - DNA, 15 bp, Homo sapiens
aaaaagccaagtatt

SEQ ID NO: 188053 - DNA, 15 bp, Homo sapiens
aaaaaagccaagtat

SEQ ID NO: 188054 - DNA, 15 bp, Homo sapiens
aaaaaaagccaagta

SEQ ID NO: 188055 - DNA, 15 bp, Homo sapiens
aaaaaaaagccaagt

SEQ ID NO: 188056 - DNA, 15 bp, Homo sapiens
aaaaaaaaagccaag

SEQ ID NO: 188057 - DNA, 15 bp, Homo sapiens
aaaaaaaaaagccaa

SEQ ID NO: 188058 - DNA, 15 bp, Homo sapiens
gaaaaaaaaaaagcc

SEQ ID NO: 188059 - DNA, 15 bp, Homo sapiens
gaagaaaaaaaaaaa

SEQ ID NO: 188060 - DNA, 15 bp, Homo sapiens
agaagaaaaaaaaaa

SEQ ID NO: 188061 - DNA, 15 bp, Homo sapiens
gagaagaaaaaaaaa

SEQ ID NO: 188062 - DNA, 15 bp, Homo sapiens
agagaagaaaaaaaa

SEQ ID NO: 188063 - DNA, 15 bp, Homo sapiens
gagagaagaaaaaaa

SEQ ID NO: 188064 - DNA, 15 bp, Homo sapiens
tgagagaagaaaaaa

SEQ ID NO: 188065 - DNA, 15 bp, Homo sapiens
atgagagaagaaaaa

SEQ ID NO: 188066 - DNA, 15 bp, Homo sapiens
catgagagaagaaaa

SEQ ID NO: 188067 - DNA, 15 bp, Homo sapiens
gcatgagagaagaaa

SEQ ID NO: 188068 - DNA, 15 bp, Homo sapiens
tgcatgagagaagaa

SEQ ID NO: 188069 - DNA, 15 bp, Homo sapiens
ttgcatgagagaaga

SEQ ID NO: 188070 - DNA, 15 bp, Homo sapiens
cttgcatgagagaag

SEQ ID NO: 188071 - DNA, 15 bp, Homo sapiens
acttgcatgagagaa

SEQ ID NO: 188072 - DNA, 15 bp, Homo sapiens
aacttgcatgagaga

SEQ ID NO: 188073 - DNA, 15 bp, Homo sapiens
aaacttgcatgagag

SEQ ID NO: 188074 - DNA, 15 bp, Homo sapiens
gaaacttgcatgaga

SEQ ID NO: 188075 - DNA, 15 bp, Homo sapiens
ggaaacttgcatgag

SEQ ID NO: 188076 - DNA, 15 bp, Homo sapiens
tggaaacttgcatga

SEQ ID NO: 188077 - DNA, 15 bp, Homo sapiens
ctggaaacttgcatg

SEQ ID NO: 188078 - DNA, 15 bp, Homo sapiens
cctggaaacttgcat

SEQ ID NO: 188079 - DNA, 15 bp, Homo sapiens
tcctggaaacttgca

SEQ ID NO: 188080 - DNA, 15 bp, Homo sapiens
atcctggaaacttgc

SEQ ID NO: 188081 - DNA, 15 bp, Homo sapiens
tatcctggaaacttg

SEQ ID NO: 188082 - DNA, 15 bp, Homo sapiens
atatcctggaaactt

SEQ ID NO: 188083 - DNA, 15 bp, Homo sapiens
tatatcctggaaact

SEQ ID NO: 188084 - DNA, 15 bp, Homo sapiens
ctatatcctggaaac

SEQ ID NO: 188085 - DNA, 15 bp, Homo sapiens
gctatatcctggaaa

SEQ ID NO: 188086 - DNA, 15 bp, Homo sapiens
agctatatcctggaa

SEQ ID NO: 188087 - DNA, 15 bp, Homo sapiens
aagctatatcctgga

SEQ ID NO: 188088 - DNA, 15 bp, Homo sapiens
gaagctatatcctgg

SEQ ID NO: 188089 - DNA, 15 bp, Homo sapiens
agaagctatatcctg

SEQ ID NO: 188090 - DNA, 15 bp, Homo sapiens
aagaagctatatcct

SEQ ID NO: 188091 - DNA, 15 bp, Homo sapiens
aaagaagctatatcc

SEQ ID NO: 188092 - DNA, 15 bp, Homo sapiens
aaaagaagctatatc

SEQ ID NO: 188093 - DNA, 15 bp, Homo sapiens
aaaaagaagctatat

SEQ ID NO: 188094 - DNA, 15 bp, Homo sapiens
aaaaaagaagctata

SEQ ID NO: 188095 - DNA, 15 bp, Homo sapiens
aaaaaaagaagctat

SEQ ID NO: 188096 - DNA, 15 bp, Homo sapiens
caaaaaaagaagcta

SEQ ID NO: 188097 - DNA, 15 bp, Homo sapiens
gcaaaaaaagaagct

SEQ ID NO: 188098 - DNA, 15 bp, Homo sapiens
agcaaaaaaagaagc

SEQ ID NO: 188099 - DNA, 15 bp, Homo sapiens
cagcaaaaaaagaag

SEQ ID NO: 188100 - DNA, 15 bp, Homo sapiens
acagcaaaaaaagaa

SEQ ID NO: 188101 - DNA, 15 bp, Homo sapiens
tacagcaaaaaaaga

SEQ ID NO: 188102 - DNA, 15 bp, Homo sapiens
atacagcaaaaaaag

SEQ ID NO: 188103 - DNA, 15 bp, Homo sapiens
catacagcaaaaaaa

SEQ ID NO: 188104 - DNA, 15 bp, Homo sapiens
acatacagcaaaaaa

SEQ ID NO: 188105 - DNA, 15 bp, Homo sapiens
tacatacagcaaaaa

SEQ ID NO: 188106 - DNA, 15 bp, Homo sapiens
ttacatacagcaaaa

SEQ ID NO: 188107 - DNA, 15 bp, Homo sapiens
attacatacagcaaa

SEQ ID NO: 188108 - DNA, 15 bp, Homo sapiens
aattacatacagcaa

SEQ ID NO: 188109 - DNA, 15 bp, Homo sapiens
caattacatacagca

SEQ ID NO: 188110 - DNA, 15 bp, Homo sapiens
tcaattacatacagc

SEQ ID NO: 188111 - DNA, 15 bp, Homo sapiens
ctcaattacatacag

SEQ ID NO: 188112 - DNA, 15 bp, Homo sapiens
tctcaattacataca

SEQ ID NO: 188113 - DNA, 15 bp, Homo sapiens
gtctcaattacatac

SEQ ID NO: 188114 - DNA, 15 bp, Homo sapiens
ggtctcaattacata

SEQ ID NO: 188115 - DNA, 15 bp, Homo sapiens
tggtctcaattacat

SEQ ID NO: 188116 - DNA, 15 bp, Homo sapiens
ttggtctcaattaca

SEQ ID NO: 188117 - DNA, 15 bp, Homo sapiens
tttggtctcaattac

SEQ ID NO: 188118 - DNA, 15 bp, Homo sapiens
gtttggtctcaatta

SEQ ID NO: 188119 - DNA, 15 bp, Homo sapiens
agtttggtctcaatt

SEQ ID NO: 188120 - DNA, 15 bp, Homo sapiens
gagtttggtctcaat

SEQ ID NO: 188121 - DNA, 15 bp, Homo sapiens
agagtttggtctcaa

SEQ ID NO: 188122 - DNA, 15 bp, Homo sapiens
tagagtttggtctca

SEQ ID NO: 188123 - DNA, 15 bp, Homo sapiens
ttagagtttggtctc

SEQ ID NO: 188124 - DNA, 15 bp, Homo sapiens
cttagagtttggtct

SEQ ID NO: 188125 - DNA, 15 bp, Homo sapiens
gcttagagtttggtc

SEQ ID NO: 188126 - DNA, 15 bp, Homo sapiens
agcttagagtttggt

SEQ ID NO: 188127 - DNA, 15 bp, Homo sapiens
aagcttagagtttgg

SEQ ID NO: 188128 - DNA, 15 bp, Homo sapiens
caagcttagagtttg

SEQ ID NO: 188129 - DNA, 15 bp, Homo sapiens
ccaagcttagagttt

SEQ ID NO: 188130 - DNA, 15 bp, Homo sapiens
cccaagcttagagtt

SEQ ID NO: 188131 - DNA, 15 bp, Homo sapiens
ccccaagcttagagt

SEQ ID NO: 188132 - DNA, 15 bp, Homo sapiens
gccccaagcttagag

SEQ ID NO: 188133 - DNA, 15 bp, Homo sapiens
ggccccaagcttaga

SEQ ID NO: 188134 - DNA, 15 bp, Homo sapiens
gggccccaagcttag

SEQ ID NO: 188135 - DNA, 15 bp, Homo sapiens
agggccccaagctta

SEQ ID NO: 188136 - DNA, 15 bp, Homo sapiens
cagggccccaagctt

SEQ ID NO: 188137 - DNA, 15 bp, Homo sapiens
ccagggccccaagct

SEQ ID NO: 188138 - DNA, 15 bp, Homo sapiens
tccagggccccaagc

SEQ ID NO: 188139 - DNA, 15 bp, Homo sapiens
ctccagggccccaag

SEQ ID NO: 188140 - DNA, 15 bp, Homo sapiens
tctccagggccccaa

SEQ ID NO: 188141 - DNA, 15 bp, Homo sapiens
ctctccagggcccca

SEQ ID NO: 188142 - DNA, 15 bp, Homo sapiens
tctctccagggcccc

SEQ ID NO: 188143 - DNA, 15 bp, Homo sapiens
ttctctccagggccc

SEQ ID NO: 188144 - DNA, 15 bp, Homo sapiens
gttctctccagggcc

SEQ ID NO: 188145 - DNA, 15 bp, Homo sapiens
tgttctctccagggc

SEQ ID NO: 188146 - DNA, 15 bp, Homo sapiens
ctgttctctccaggg

SEQ ID NO: 188147 - DNA, 15 bp, Homo sapiens
actgttctctccagg

SEQ ID NO: 188148 - DNA, 15 bp, Homo sapiens
aactgttctctccag

SEQ ID NO: 188149 - DNA, 15 bp, Homo sapiens
caactgttctctcca

SEQ ID NO: 188150 - DNA, 15 bp, Homo sapiens
acaactgttctctcc

SEQ ID NO: 188151 - DNA, 15 bp, Homo sapiens
cacaactgttctctc

SEQ ID NO: 188152 - DNA, 15 bp, Homo sapiens
ccacaactgttctct

SEQ ID NO: 188153 - DNA, 15 bp, Homo sapiens
gccacaactgttctc

SEQ ID NO: 188154 - DNA, 15 bp, Homo sapiens
ggccacaactgttct

SEQ ID NO: 188155 - DNA, 15 bp, Homo sapiens
aggccacaactgttc

SEQ ID NO: 188156 - DNA, 15 bp, Homo sapiens
caggccacaactgtt

SEQ ID NO: 188157 - DNA, 15 bp, Homo sapiens
gcaggccacaactgt

SEQ ID NO: 188158 - DNA, 15 bp, Homo sapiens
tgcaggccacaactg

SEQ ID NO: 188159 - DNA, 15 bp, Homo sapiens
ctgcaggccacaact

SEQ ID NO: 188160 - DNA, 15 bp, Homo sapiens
cctgcaggccacaac

SEQ ID NO: 188161 - DNA, 15 bp, Homo sapiens
acctgcaggccacaa

SEQ ID NO: 188162 - DNA, 15 bp, Homo sapiens
gacctgcaggccaca

SEQ ID NO: 188163 - DNA, 15 bp, Homo sapiens
tgacctgcaggccac

SEQ ID NO: 188164 - DNA, 15 bp, Homo sapiens
atgacctgcaggcca

SEQ ID NO: 188165 - DNA, 15 bp, Homo sapiens
aatgacctgcaggcc

SEQ ID NO: 188166 - DNA, 15 bp, Homo sapiens
taatgacctgcaggc

SEQ ID NO: 188167 - DNA, 15 bp, Homo sapiens
ctaatgacctgcagg

SEQ ID NO: 188168 - DNA, 15 bp, Homo sapiens
actaatgacctgcag

SEQ ID NO: 188169 - DNA, 15 bp, Homo sapiens
cactaatgacctgca

SEQ ID NO: 188170 - DNA, 15 bp, Homo sapiens
tcactaatgacctgc

SEQ ID NO: 188171 - DNA, 15 bp, Homo sapiens
ctcactaatgacctg

SEQ ID NO: 188172 - DNA, 15 bp, Homo sapiens
cctcactaatgacct

SEQ ID NO: 188173 - DNA, 15 bp, Homo sapiens
acctcactaatgacc

SEQ ID NO: 188174 - DNA, 15 bp, Homo sapiens
cacctcactaatgac

SEQ ID NO: 188175 - DNA, 15 bp, Homo sapiens
tcacctcactaatga

SEQ ID NO: 188176 - DNA, 15 bp, Homo sapiens
ctcacctcactaatg

SEQ ID NO: 188177 - DNA, 15 bp, Homo sapiens
gctcacctcactaat

SEQ ID NO: 188178 - DNA, 15 bp, Homo sapiens
tgctcacctcactaa

SEQ ID NO: 188179 - DNA, 15 bp, Homo sapiens
ctgctcacctcacta

SEQ ID NO: 188180 - DNA, 15 bp, Homo sapiens
tctgctcacctcact

SEQ ID NO: 188181 - DNA, 15 bp, Homo sapiens
ttctgctcacctcac

SEQ ID NO: 188182 - DNA, 15 bp, Homo sapiens
cttctgctcacctca

SEQ ID NO: 188183 - DNA, 15 bp, Homo sapiens
ccttctgctcacctc

SEQ ID NO: 188184 - DNA, 15 bp, Homo sapiens
cccttctgctcacct

SEQ ID NO: 188185 - DNA, 15 bp, Homo sapiens
tcccttctgctcacc

SEQ ID NO: 188186 - DNA, 15 bp, Homo sapiens
ttcccttctgctcac

SEQ ID NO: 188187 - DNA, 15 bp, Homo sapiens
attcccttctgctca

SEQ ID NO: 188188 - DNA, 15 bp, Homo sapiens
gattcccttctgctc

SEQ ID NO: 188189 - DNA, 15 bp, Homo sapiens
ggattcccttctgct

SEQ ID NO: 188190 - DNA, 15 bp, Homo sapiens
aggattcccttctgc

SEQ ID NO: 188191 - DNA, 15 bp, Homo sapiens
caggattcccttctg

SEQ ID NO: 188192 - DNA, 15 bp, Homo sapiens
ccaggattcccttct

SEQ ID NO: 188193 - DNA, 15 bp, Homo sapiens
tccaggattcccttc

SEQ ID NO: 188194 - DNA, 15 bp, Homo sapiens
gtccaggattccctt

SEQ ID NO: 188195 - DNA, 15 bp, Homo sapiens
agtccaggattccct

SEQ ID NO: 188196 - DNA, 15 bp, Homo sapiens
aagtccaggattccc

SEQ ID NO: 188197 - DNA, 15 bp, Homo sapiens
gaagtccaggattcc

SEQ ID NO: 188198 - DNA, 15 bp, Homo sapiens
ggaagtccaggattc

SEQ ID NO: 188199 - DNA, 15 bp, Homo sapiens
gggaagtccaggatt

SEQ ID NO: 188200 - DNA, 15 bp, Homo sapiens
tgggaagtccaggat

SEQ ID NO: 188201 - DNA, 15 bp, Homo sapiens
ctgggaagtccagga

SEQ ID NO: 188202 - DNA, 15 bp, Homo sapiens
tctgggaagtccagg

SEQ ID NO: 188203 - DNA, 15 bp, Homo sapiens
ctctgggaagtccag

SEQ ID NO: 188204 - DNA, 15 bp, Homo sapiens
tctctgggaagtcca

SEQ ID NO: 188205 - DNA, 15 bp, Homo sapiens
ttctctgggaagtcc

SEQ ID NO: 188206 - DNA, 15 bp, Homo sapiens
tttctctgggaagtc

SEQ ID NO: 188207 - DNA, 15 bp, Homo sapiens
ctttctctgggaagt

SEQ ID NO: 188208 - DNA, 15 bp, Homo sapiens
tctttctctgggaag

SEQ ID NO: 188209 - DNA, 15 bp, Homo sapiens
ctctttctctgggaa

SEQ ID NO: 188210 - DNA, 15 bp, Homo sapiens
cctctttctctggga

SEQ ID NO: 188211 - DNA, 15 bp, Homo sapiens
tcctctttctctggg

SEQ ID NO: 188212 - DNA, 15 bp, Homo sapiens
ctcctctttctctgg

SEQ ID NO: 188213 - DNA, 15 bp, Homo sapiens
tctcctctttctctg

SEQ ID NO: 188214 - DNA, 15 bp, Homo sapiens
gtctcctctttctct

SEQ ID NO: 188215 - DNA, 15 bp, Homo sapiens
ggtctcctctttctc

SEQ ID NO: 188216 - DNA, 15 bp, Homo sapiens
tggtctcctctttct

SEQ ID NO: 188217 - DNA, 15 bp, Homo sapiens
atggtctcctctttc

SEQ ID NO: 188218 - DNA, 15 bp, Homo sapiens
catggtctcctcttt

SEQ ID NO: 188219 - DNA, 15 bp, Homo sapiens
gcatggtctcctctt

SEQ ID NO: 188220 - DNA, 15 bp, Homo sapiens
ggcatggtctcctct

SEQ ID NO: 188221 - DNA, 15 bp, Homo sapiens
tggcatggtctcctc

SEQ ID NO: 188222 - DNA, 15 bp, Homo sapiens
ctggcatggtctcct

SEQ ID NO: 188223 - DNA, 15 bp, Homo sapiens
gctggcatggtctcc

SEQ ID NO: 188224 - DNA, 15 bp, Homo sapiens
ggctggcatggtctc

SEQ ID NO: 188225 - DNA, 15 bp, Homo sapiens
aggctggcatggtct

SEQ ID NO: 188226 - DNA, 15 bp, Homo sapiens
gaggctggcatggtc

SEQ ID NO: 188227 - DNA, 15 bp, Homo sapiens
cgaggctggcatggt

SEQ ID NO: 188228 - DNA, 15 bp, Homo sapiens
acgaggctggcatgg

SEQ ID NO: 188229 - DNA, 15 bp, Homo sapiens
cacgaggctggcatg

SEQ ID NO: 188230 - DNA, 15 bp, Homo sapiens
ccacgaggctggcat

SEQ ID NO: 188231 - DNA, 15 bp, Homo sapiens
tccacgaggctggca

SEQ ID NO: 188232 - DNA, 15 bp, Homo sapiens
ttccacgaggctggc

SEQ ID NO: 188233 - DNA, 15 bp, Homo sapiens
gttccacgaggctgg

SEQ ID NO: 188234 - DNA, 15 bp, Homo sapiens
tgttccacgaggctg

SEQ ID NO: 188235 - DNA, 15 bp, Homo sapiens
gtgttccacgaggct

SEQ ID NO: 188236 - DNA, 15 bp, Homo sapiens
tgtgttccacgaggc

SEQ ID NO: 188237 - DNA, 15 bp, Homo sapiens
ctgtgttccacgagg

SEQ ID NO: 188238 - DNA, 15 bp, Homo sapiens
gctgtgttccacgag

SEQ ID NO: 188239 - DNA, 15 bp, Homo sapiens
agctgtgttccacga

SEQ ID NO: 188240 - DNA, 15 bp, Homo sapiens
tagctgtgttccacg

SEQ ID NO: 188241 - DNA, 15 bp, Homo sapiens
gtagctgtgttccac

SEQ ID NO: 188242 - DNA, 15 bp, Homo sapiens
ggtagctgtgttcca

SEQ ID NO: 188243 - DNA, 15 bp, Homo sapiens
tggtagctgtgttcc

SEQ ID NO: 188244 - DNA, 15 bp, Homo sapiens
ctggtagctgtgttc

SEQ ID NO: 188245 - DNA, 15 bp, Homo sapiens
cctggtagctgtgtt

SEQ ID NO: 188246 - DNA, 15 bp, Homo sapiens
tcctggtagctgtgt

SEQ ID NO: 188247 - DNA, 15 bp, Homo sapiens
ttcctggtagctgtg

SEQ ID NO: 188248 - DNA, 15 bp, Homo sapiens
tttcctggtagctgt

SEQ ID NO: 188249 - DNA, 15 bp, Homo sapiens
atttcctggtagctg

SEQ ID NO: 188250 - DNA, 15 bp, Homo sapiens
tatttcctggtagct

SEQ ID NO: 188251 - DNA, 15 bp, Homo sapiens
gtatttcctggtagc

SEQ ID NO: 188252 - DNA, 15 bp, Homo sapiens
tgtatttcctggtag

SEQ ID NO: 188253 - DNA, 15 bp, Homo sapiens
ctgtatttcctggta

SEQ ID NO: 188254 - DNA, 15 bp, Homo sapiens
tctgtatttcctggt

SEQ ID NO: 188255 - DNA, 15 bp, Homo sapiens
ttctgtatttcctgg

SEQ ID NO: 188256 - DNA, 15 bp, Homo sapiens
cttctgtatttcctg

SEQ ID NO: 188257 - DNA, 15 bp, Homo sapiens
gcttctgtatttcct

SEQ ID NO: 188258 - DNA, 15 bp, Homo sapiens
tgcttctgtatttcc

SEQ ID NO: 188259 - DNA, 15 bp, Homo sapiens
ctgcttctgtatttc

SEQ ID NO: 188260 - DNA, 15 bp, Homo sapiens
cctgcttctgtattt

SEQ ID NO: 188261 - DNA, 15 bp, Homo sapiens
acctgcttctgtatt

SEQ ID NO: 188262 - DNA, 15 bp, Homo sapiens
gacctgcttctgtat

SEQ ID NO: 188263 - DNA, 15 bp, Homo sapiens
agacctgcttctgta

SEQ ID NO: 188264 - DNA, 15 bp, Homo sapiens
tagacctgcttctgt

SEQ ID NO: 188265 - DNA, 15 bp, Homo sapiens
atagacctgcttctg

SEQ ID NO: 188266 - DNA, 15 bp, Homo sapiens
aatagacctgcttct

SEQ ID NO: 188267 - DNA, 15 bp, Homo sapiens
gaatagacctgcttc

SEQ ID NO: 188268 - DNA, 15 bp, Homo sapiens
ggaatagacctgctt

SEQ ID NO: 188269 - DNA, 15 bp, Homo sapiens
aggaatagacctgct

SEQ ID NO: 188270 - DNA, 15 bp, Homo sapiens
aaggaatagacctgc

SEQ ID NO: 188271 - DNA, 15 bp, Homo sapiens
caaggaatagacctg

SEQ ID NO: 188272 - DNA, 15 bp, Homo sapiens
gcaaggaatagacct

SEQ ID NO: 188273 - DNA, 15 bp, Homo sapiens
cgcaaggaatagacc

SEQ ID NO: 188274 - DNA, 15 bp, Homo sapiens
tcgcaaggaatagac

SEQ ID NO: 188275 - DNA, 15 bp, Homo sapiens
ttcgcaaggaataga

SEQ ID NO: 188276 - DNA, 15 bp, Homo sapiens
gttcgcaaggaatag

SEQ ID NO: 188277 - DNA, 15 bp, Homo sapiens
agttcgcaaggaata

SEQ ID NO: 188278 - DNA, 15 bp, Homo sapiens
gagttcgcaaggaat

SEQ ID NO: 188279 - DNA, 15 bp, Homo sapiens
ggagttcgcaaggaa

SEQ ID NO: 188280 - DNA, 15 bp, Homo sapiens
cggagttcgcaagga

SEQ ID NO: 188281 - DNA, 15 bp, Homo sapiens
tcggagttcgcaagg

SEQ ID NO: 188282 - DNA, 15 bp, Homo sapiens
ttcggagttcgcaag

SEQ ID NO: 188283 - DNA, 15 bp, Homo sapiens
cttcggagttcgcaa

SEQ ID NO: 188284 - DNA, 15 bp, Homo sapiens
acttcggagttcgca

SEQ ID NO: 188285 - DNA, 15 bp, Homo sapiens
gacttcggagttcgc

SEQ ID NO: 188286 - DNA, 15 bp, Homo sapiens
ggacttcggagttcg

SEQ ID NO: 188287 - DNA, 15 bp, Homo sapiens
tggacttcggagttc

SEQ ID NO: 188288 - DNA, 15 bp, Homo sapiens
atggacttcggagtt

SEQ ID NO: 188289 - DNA, 15 bp, Homo sapiens
catggacttcggagt

SEQ ID NO: 188290 - DNA, 15 bp, Homo sapiens
tcatggacttcggag

SEQ ID NO: 188291 - DNA, 15 bp, Homo sapiens
ttcatggacttcgga

SEQ ID NO: 188292 - DNA, 15 bp, Homo sapiens
tttcatggacttcgg

SEQ ID NO: 188293 - DNA, 15 bp, Homo sapiens
ttttcatggacttcg

SEQ ID NO: 188294 - DNA, 15 bp, Homo sapiens
tttttcatggacttc

SEQ ID NO: 188295 - DNA, 15 bp, Homo sapiens
ttttttcatggactt

SEQ ID NO: 188296 - DNA, 15 bp, Homo sapiens
gttttttcatggact

SEQ ID NO: 188297 - DNA, 15 bp, Homo sapiens
cgttttttcatggac

SEQ ID NO: 188298 - DNA, 15 bp, Homo sapiens
ccgttttttcatgga

SEQ ID NO: 188299 - DNA, 15 bp, Homo sapiens
tccgttttttcatgg

SEQ ID NO: 188300 - DNA, 15 bp, Homo sapiens
gtccgttttttcatg

SEQ ID NO: 188301 - DNA, 15 bp, Homo sapiens
ggtccgttttttcat

SEQ ID NO: 188302 - DNA, 15 bp, Homo sapiens
gggtccgttttttca

SEQ ID NO: 188303 - DNA, 15 bp, Homo sapiens
tgggtccgttttttc

SEQ ID NO: 188304 - DNA, 15 bp, Homo sapiens
gtgggtccgtttttt

SEQ ID NO: 188305 - DNA, 15 bp, Homo sapiens
tgtgggtccgttttt

SEQ ID NO: 188306 - DNA, 15 bp, Homo sapiens
ctgtgggtccgtttt

SEQ ID NO: 188307 - DNA, 15 bp, Homo sapiens
actgtgggtccgttt

SEQ ID NO: 188308 - DNA, 15 bp, Homo sapiens
cactgtgggtccgtt

SEQ ID NO: 188309 - DNA, 15 bp, Homo sapiens
ccactgtgggtccgt

SEQ ID NO: 188310 - DNA, 15 bp, Homo sapiens
cccactgtgggtccg

SEQ ID NO: 188311 - DNA, 15 bp, Homo sapiens
ccccactgtgggtcc

SEQ ID NO: 188312 - DNA, 15 bp, Homo sapiens
accccactgtgggtc

SEQ ID NO: 188313 - DNA, 15 bp, Homo sapiens
caccccactgtgggt

SEQ ID NO: 188314 - DNA, 15 bp, Homo sapiens
ccaccccactgtggg

SEQ ID NO: 188315 - DNA, 15 bp, Homo sapiens
gccaccccactgtgg

SEQ ID NO: 188316 - DNA, 15 bp, Homo sapiens
agccaccccactgtg

SEQ ID NO: 188317 - DNA, 15 bp, Homo sapiens
tagccaccccactgt

SEQ ID NO: 188318 - DNA, 15 bp, Homo sapiens
ttagccaccccactg

SEQ ID NO: 188319 - DNA, 15 bp, Homo sapiens
tttagccaccccact

SEQ ID NO: 188320 - DNA, 15 bp, Homo sapiens
ttttagccaccccac

SEQ ID NO: 188321 - DNA, 15 bp, Homo sapiens
attttagccacccca

SEQ ID NO: 188322 - DNA, 15 bp, Homo sapiens
cattttagccacccc

SEQ ID NO: 188323 - DNA, 15 bp, Homo sapiens
acattttagccaccc

SEQ ID NO: 188324 - DNA, 15 bp, Homo sapiens
gacattttagccacc

SEQ ID NO: 188325 - DNA, 15 bp, Homo sapiens
ggacattttagccac

SEQ ID NO: 188326 - DNA, 15 bp, Homo sapiens
gggacattttagcca

SEQ ID NO: 188327 - DNA, 15 bp, Homo sapiens
tgggacattttagcc

SEQ ID NO: 188328 - DNA, 15 bp, Homo sapiens
ctgggacattttagc

SEQ ID NO: 188329 - DNA, 15 bp, Homo sapiens
gctgggacattttag

SEQ ID NO: 188330 - DNA, 15 bp, Homo sapiens
cgctgggacatttta

SEQ ID NO: 188331 - DNA, 15 bp, Homo sapiens
gcgctgggacatttt

SEQ ID NO: 188332 - DNA, 15 bp, Homo sapiens
tgcgctgggacattt

SEQ ID NO: 188333 - DNA, 15 bp, Homo sapiens
ttgcgctgggacatt

SEQ ID NO: 188334 - DNA, 15 bp, Homo sapiens
cttgcgctgggacat

SEQ ID NO: 188335 - DNA, 15 bp, Homo sapiens
gcttgcgctgggaca

SEQ ID NO: 188336 - DNA, 15 bp, Homo sapiens
agcttgcgctgggac

SEQ ID NO: 188337 - DNA, 15 bp, Homo sapiens
cagcttgcgctggga

SEQ ID NO: 188338 - DNA, 15 bp, Homo sapiens
gcagcttgcgctggg

SEQ ID NO: 188339 - DNA, 15 bp, Homo sapiens
ggcagcttgcgctgg

SEQ ID NO: 188340 - DNA, 15 bp, Homo sapiens
cggcagcttgcgctg

SEQ ID NO: 188341 - DNA, 15 bp, Homo sapiens
gcggcagcttgcgct

SEQ ID NO: 188342 - DNA, 15 bp, Homo sapiens
agcggcagcttgcgc

SEQ ID NO: 188343 - DNA, 15 bp, Homo sapiens
cagcggcagcttgcg

SEQ ID NO: 188344 - DNA, 15 bp, Homo sapiens
gcagcggcagcttgc

SEQ ID NO: 188345 - DNA, 15 bp, Homo sapiens
agcagcggcagcttg

SEQ ID NO: 188346 - DNA, 15 bp, Homo sapiens
cagcagcggcagctt

SEQ ID NO: 188347 - DNA, 15 bp, Homo sapiens
gcagcagcggcagct

SEQ ID NO: 188348 - DNA, 15 bp, Homo sapiens
agcagcagcggcagc

SEQ ID NO: 188349 - DNA, 15 bp, Homo sapiens
cagcagcagcggcag

SEQ ID NO: 188350 - DNA, 15 bp, Homo sapiens
tcagcagcagcggca

SEQ ID NO: 188351 - DNA, 15 bp, Homo sapiens
atcagcagcagcggc

SEQ ID NO: 188352 - DNA, 15 bp, Homo sapiens
catcagcagcagcgg

SEQ ID NO: 188353 - DNA, 15 bp, Homo sapiens
ccatcagcagcagcg

SEQ ID NO: 188354 - DNA, 15 bp, Homo sapiens
tccatcagcagcagc

SEQ ID NO: 188355 - DNA, 15 bp, Homo sapiens
gtccatcagcagcag

SEQ ID NO: 188356 - DNA, 15 bp, Homo sapiens
ggtccatcagcagca

SEQ ID NO: 188357 - DNA, 15 bp, Homo sapiens
tggtccatcagcagc

SEQ ID NO: 188358 - DNA, 15 bp, Homo sapiens
atggtccatcagcag

SEQ ID NO: 188359 - DNA, 15 bp, Homo sapiens
tatggtccatcagca

SEQ ID NO: 188360 - DNA, 15 bp, Homo sapiens
ctatggtccatcagc

SEQ ID NO: 188361 - DNA, 15 bp, Homo sapiens
gctatggtccatcag

SEQ ID NO: 188362 - DNA, 15 bp, Homo sapiens
agctatggtccatca

SEQ ID NO: 188363 - DNA, 15 bp, Homo sapiens
gagctatggtccatc

SEQ ID NO: 188364 - DNA, 15 bp, Homo sapiens
tgagctatggtccat

SEQ ID NO: 188365 - DNA, 15 bp, Homo sapiens
ttgagctatggtcca

SEQ ID NO: 188366 - DNA, 15 bp, Homo sapiens
cttgagctatggtcc

SEQ ID NO: 188367 - DNA, 15 bp, Homo sapiens
ccttgagctatggtc

SEQ ID NO: 188368 - DNA, 15 bp, Homo sapiens
cccttgagctatggt

SEQ ID NO: 188369 - DNA, 15 bp, Homo sapiens
gcccttgagctatgg

SEQ ID NO: 188370 - DNA, 15 bp, Homo sapiens
tgcccttgagctatg

SEQ ID NO: 188371 - DNA, 15 bp, Homo sapiens
ttgcccttgagctat

SEQ ID NO: 188372 - DNA, 15 bp, Homo sapiens
cttgcccttgagcta

SEQ ID NO: 188373 - DNA, 15 bp, Homo sapiens
ccttgcccttgagct

SEQ ID NO: 188374 - DNA, 15 bp, Homo sapiens
gccttgcccttgagc

SEQ ID NO: 188375 - DNA, 15 bp, Homo sapiens
agccttgcccttgag

SEQ ID NO: 188376 - DNA, 15 bp, Homo sapiens
aagccttgcccttga

SEQ ID NO: 188377 - DNA, 15 bp, Homo sapiens
caagccttgcccttg

SEQ ID NO: 188378 - DNA, 15 bp, Homo sapiens
acaagccttgccctt

SEQ ID NO: 188379 - DNA, 15 bp, Homo sapiens
tacaagccttgccct

SEQ ID NO: 188380 - DNA, 15 bp, Homo sapiens
ttacaagccttgccc

SEQ ID NO: 188381 - DNA, 15 bp, Homo sapiens
tttacaagccttgcc

SEQ ID NO: 188382 - DNA, 15 bp, Homo sapiens
ctttacaagccttgc

SEQ ID NO: 188383 - DNA, 15 bp, Homo sapiens
cctttacaagccttg

SEQ ID NO: 188384 - DNA, 15 bp, Homo sapiens
tcctttacaagcctt

SEQ ID NO: 188385 - DNA, 15 bp, Homo sapiens
atcctttacaagcct

SEQ ID NO: 188386 - DNA, 15 bp, Homo sapiens
aatcctttacaagcc

SEQ ID NO: 188387 - DNA, 15 bp, Homo sapiens
aaatcctttacaagc

SEQ ID NO: 188388 - DNA, 15 bp, Homo sapiens
aaaatcctttacaag

SEQ ID NO: 188389 - DNA, 15 bp, Homo sapiens
taaaatcctttacaa

SEQ ID NO: 188390 - DNA, 15 bp, Homo sapiens
gtaaaatcctttaca

SEQ ID NO: 188391 - DNA, 15 bp, Homo sapiens
tgtaaaatcctttac

SEQ ID NO: 188392 - DNA, 15 bp, Homo sapiens
ttgtaaaatccttta

SEQ ID NO: 188393 - DNA, 15 bp, Homo sapiens
tttgtaaaatccttt

SEQ ID NO: 188394 - DNA, 15 bp, Homo sapiens
ctttgtaaaatcctt

SEQ ID NO: 188395 - DNA, 15 bp, Homo sapiens
cctttgtaaaatcct

SEQ ID NO: 188396 - DNA, 15 bp, Homo sapiens
tcctttgtaaaatcc

SEQ ID NO: 188397 - DNA, 15 bp, Homo sapiens
atcctttgtaaaatc

SEQ ID NO: 188398 - DNA, 15 bp, Homo sapiens
aatcctttgtaaaat

SEQ ID NO: 188399 - DNA, 15 bp, Homo sapiens
aaatcctttgtaaaa

SEQ ID NO: 188400 - DNA, 15 bp, Homo sapiens
aaaatcctttgtaaa

SEQ ID NO: 188401 - DNA, 15 bp, Homo sapiens
taaaatcctttgtaa

SEQ ID NO: 188402 - DNA, 15 bp, Homo sapiens
ttaaaatcctttgta

SEQ ID NO: 188403 - DNA, 15 bp, Homo sapiens
tttaaaatcctttgt

SEQ ID NO: 188404 - DNA, 15 bp, Homo sapiens
ctttaaaatcctttg

SEQ ID NO: 188405 - DNA, 15 bp, Homo sapiens
actttaaaatccttt

SEQ ID NO: 188406 - DNA, 15 bp, Homo sapiens
tactttaaaatcctt

SEQ ID NO: 188407 - DNA, 15 bp, Homo sapiens
atactttaaaatcct

SEQ ID NO: 188408 - DNA, 15 bp, Homo sapiens
tatactttaaaatcc

SEQ ID NO: 188409 - DNA, 15 bp, Homo sapiens
ctatactttaaaatc

SEQ ID NO: 188410 - DNA, 15 bp, Homo sapiens
gctatactttaaaat

SEQ ID NO: 188411 - DNA, 15 bp, Homo sapiens
ggctatactttaaaa

SEQ ID NO: 188412 - DNA, 15 bp, Homo sapiens
tggctatactttaaa

SEQ ID NO: 188413 - DNA, 15 bp, Homo sapiens
ctggctatactttaa

SEQ ID NO: 188414 - DNA, 15 bp, Homo sapiens
tctggctatacttta

SEQ ID NO: 188415 - DNA, 15 bp, Homo sapiens
ttctggctatacttt

SEQ ID NO: 188416 - DNA, 15 bp, Homo sapiens
tttctggctatactt

SEQ ID NO: 188417 - DNA, 15 bp, Homo sapiens
ttttctggctatact

SEQ ID NO: 188418 - DNA, 15 bp, Homo sapiens
cttttctggctatac

SEQ ID NO: 188419 - DNA, 15 bp, Homo sapiens
tcttttctggctata

SEQ ID NO: 188420 - DNA, 15 bp, Homo sapiens
atcttttctggctat

SEQ ID NO: 188421 - DNA, 15 bp, Homo sapiens
tatcttttctggcta

SEQ ID NO: 188422 - DNA, 15 bp, Homo sapiens
gtatcttttctggct

SEQ ID NO: 188423 - DNA, 15 bp, Homo sapiens
cgtatcttttctggc

SEQ ID NO: 188424 - DNA, 15 bp, Homo sapiens
ccgtatcttttctgg

SEQ ID NO: 188425 - DNA, 15 bp, Homo sapiens
accgtatcttttctg

SEQ ID NO: 188426 - DNA, 15 bp, Homo sapiens
caccgtatcttttct

SEQ ID NO: 188427 - DNA, 15 bp, Homo sapiens
acaccgtatcttttc

SEQ ID NO: 188428 - DNA, 15 bp, Homo sapiens
aacaccgtatctttt

SEQ ID NO: 188429 - DNA, 15 bp, Homo sapiens
aaacaccgtatcttt

SEQ ID NO: 188430 - DNA, 15 bp, Homo sapiens
taaacaccgtatctt

SEQ ID NO: 188431 - DNA, 15 bp, Homo sapiens
ctaaacaccgtatct

SEQ ID NO: 188432 - DNA, 15 bp, Homo sapiens
tctaaacaccgtatc

SEQ ID NO: 188433 - DNA, 15 bp, Homo sapiens
ttctaaacaccgtat

SEQ ID NO: 188434 - DNA, 15 bp, Homo sapiens
cttctaaacaccgta

SEQ ID NO: 188435 - DNA, 15 bp, Homo sapiens
acttctaaacaccgt

SEQ ID NO: 188436 - DNA, 15 bp, Homo sapiens
aacttctaaacaccg

SEQ ID NO: 188437 - DNA, 15 bp, Homo sapiens
taacttctaaacacc

SEQ ID NO: 188438 - DNA, 15 bp, Homo sapiens
ttaacttctaaacac

SEQ ID NO: 188439 - DNA, 15 bp, Homo sapiens
tttaacttctaaaca

SEQ ID NO: 188440 - DNA, 15 bp, Homo sapiens
gtttaacttctaaac

SEQ ID NO: 188441 - DNA, 15 bp, Homo sapiens
cgtttaacttctaaa

SEQ ID NO: 188442 - DNA, 15 bp, Homo sapiens
gcgtttaacttctaa

SEQ ID NO: 188443 - DNA, 15 bp, Homo sapiens
agcgtttaacttcta

SEQ ID NO: 188444 - DNA, 15 bp, Homo sapiens
cagcgtttaacttct

SEQ ID NO: 188445 - DNA, 15 bp, Homo sapiens
acagcgtttaacttc

SEQ ID NO: 188446 - DNA, 15 bp, Homo sapiens
aacagcgtttaactt

SEQ ID NO: 188447 - DNA, 15 bp, Homo sapiens
caacagcgtttaact

SEQ ID NO: 188448 - DNA, 15 bp, Homo sapiens
acaacagcgtttaac

SEQ ID NO: 188449 - DNA, 15 bp, Homo sapiens
gacaacagcgtttaa

SEQ ID NO: 188450 - DNA, 15 bp, Homo sapiens
agacaacagcgttta

SEQ ID NO: 188451 - DNA, 15 bp, Homo sapiens
cagacaacagcgttt

SEQ ID NO: 188452 - DNA, 15 bp, Homo sapiens
tcagacaacagcgtt

SEQ ID NO: 188453 - DNA, 15 bp, Homo sapiens
ttcagacaacagcgt

SEQ ID NO: 188454 - DNA, 15 bp, Homo sapiens
cttcagacaacagcg

SEQ ID NO: 188455 - DNA, 15 bp, Homo sapiens
ccttcagacaacagc

SEQ ID NO: 188456 - DNA, 15 bp, Homo sapiens
tccttcagacaacag

SEQ ID NO: 188457 - DNA, 15 bp, Homo sapiens
ttccttcagacaaca

SEQ ID NO: 188458 - DNA, 15 bp, Homo sapiens
cttccttcagacaac

SEQ ID NO: 188459 - DNA, 15 bp, Homo sapiens
acttccttcagacaa

SEQ ID NO: 188460 - DNA, 15 bp, Homo sapiens
aacttccttcagaca

SEQ ID NO: 188461 - DNA, 15 bp, Homo sapiens
aaacttccttcagac

SEQ ID NO: 188462 - DNA, 15 bp, Homo sapiens
caaacttccttcaga

SEQ ID NO: 188463 - DNA, 15 bp, Homo sapiens
gcaaacttccttcag

SEQ ID NO: 188464 - DNA, 15 bp, Homo sapiens
ggcaaacttccttca

SEQ ID NO: 188465 - DNA, 15 bp, Homo sapiens
cggcaaacttccttc

SEQ ID NO: 188466 - DNA, 15 bp, Homo sapiens
ccggcaaacttcctt

SEQ ID NO: 188467 - DNA, 15 bp, Homo sapiens
tccggcaaacttcct

SEQ ID NO: 188468 - DNA, 15 bp, Homo sapiens
ttccggcaaacttcc

SEQ ID NO: 188469 - DNA, 15 bp, Homo sapiens
tttccggcaaacttc

SEQ ID NO: 188470 - DNA, 15 bp, Homo sapiens
ctttccggcaaactt

SEQ ID NO: 188471 - DNA, 15 bp, Homo sapiens
tctttccggcaaact

SEQ ID NO: 188472 - DNA, 15 bp, Homo sapiens
atctttccggcaaac

SEQ ID NO: 188473 - DNA, 15 bp, Homo sapiens
catctttccggcaaa

SEQ ID NO: 188474 - DNA, 15 bp, Homo sapiens
acatctttccggcaa

SEQ ID NO: 188475 - DNA, 15 bp, Homo sapiens
tacatctttccggca

SEQ ID NO: 188476 - DNA, 15 bp, Homo sapiens
ctacatctttccggc

SEQ ID NO: 188477 - DNA, 15 bp, Homo sapiens
cctacatctttccgg

SEQ ID NO: 188478 - DNA, 15 bp, Homo sapiens
gcctacatctttccg

SEQ ID NO: 188479 - DNA, 15 bp, Homo sapiens
agcctacatctttcc

SEQ ID NO: 188480 - DNA, 15 bp, Homo sapiens
aagcctacatctttc

SEQ ID NO: 188481 - DNA, 15 bp, Homo sapiens
gaagcctacatcttt

SEQ ID NO: 188482 - DNA, 15 bp, Homo sapiens
tgaagcctacatctt

SEQ ID NO: 188483 - DNA, 15 bp, Homo sapiens
ttgaagcctacatct

SEQ ID NO: 188484 - DNA, 15 bp, Homo sapiens
cttgaagcctacatc

SEQ ID NO: 188485 - DNA, 15 bp, Homo sapiens
ccttgaagcctacat

SEQ ID NO: 188486 - DNA, 15 bp, Homo sapiens
cccttgaagcctaca

SEQ ID NO: 188487 - DNA, 15 bp, Homo sapiens
gcccttgaagcctac

SEQ ID NO: 188488 - DNA, 15 bp, Homo sapiens
agcccttgaagccta

SEQ ID NO: 188489 - DNA, 15 bp, Homo sapiens
tagcccttgaagcct

SEQ ID NO: 188490 - DNA, 15 bp, Homo sapiens
gtagcccttgaagcc

SEQ ID NO: 188491 - DNA, 15 bp, Homo sapiens
agtagcccttgaagc

SEQ ID NO: 188492 - DNA, 15 bp, Homo sapiens
cagtagcccttgaag

SEQ ID NO: 188493 - DNA, 15 bp, Homo sapiens
ccagtagcccttgaa

SEQ ID NO: 188494 - DNA, 15 bp, Homo sapiens
tccagtagcccttga

SEQ ID NO: 188495 - DNA, 15 bp, Homo sapiens
gtccagtagcccttg

SEQ ID NO: 188496 - DNA, 15 bp, Homo sapiens
tgtccagtagccctt

SEQ ID NO: 188497 - DNA, 15 bp, Homo sapiens
ttgtccagtagccct

SEQ ID NO: 188498 - DNA, 15 bp, Homo sapiens
attgtccagtagccc

SEQ ID NO: 188499 - DNA, 15 bp, Homo sapiens
cattgtccagtagcc

SEQ ID NO: 188500 - DNA, 15 bp, Homo sapiens
tcattgtccagtagc

SEQ ID NO: 188501 - DNA, 15 bp, Homo sapiens
atcattgtccagtag

SEQ ID NO: 188502 - DNA, 15 bp, Homo sapiens
aatcattgtccagta

SEQ ID NO: 188503 - DNA, 15 bp, Homo sapiens
caatcattgtccagt

SEQ ID NO: 188504 - DNA, 15 bp, Homo sapiens
ccaatcattgtccag

SEQ ID NO: 188505 - DNA, 15 bp, Homo sapiens
accaatcattgtcca

SEQ ID NO: 188506 - DNA, 15 bp, Homo sapiens
gaccaatcattgtcc

SEQ ID NO: 188507 - DNA, 15 bp, Homo sapiens
agaccaatcattgtc

SEQ ID NO: 188508 - DNA, 15 bp, Homo sapiens
cagaccaatcattgt

SEQ ID NO: 188509 - DNA, 15 bp, Homo sapiens
tcagaccaatcattg

SEQ ID NO: 188510 - DNA, 15 bp, Homo sapiens
ttcagaccaatcatt

SEQ ID NO: 188511 - DNA, 15 bp, Homo sapiens
gttcagaccaatcat

SEQ ID NO: 188512 - DNA, 15 bp, Homo sapiens
agttcagaccaatca

SEQ ID NO: 188513 - DNA, 15 bp, Homo sapiens
aagttcagaccaatc

SEQ ID NO: 188514 - DNA, 15 bp, Homo sapiens
gaagttcagaccaat

SEQ ID NO: 188515 - DNA, 15 bp, Homo sapiens
tgaagttcagaccaa

SEQ ID NO: 188516 - DNA, 15 bp, Homo sapiens
ttgaagttcagacca

SEQ ID NO: 188517 - DNA, 15 bp, Homo sapiens
gttgaagttcagacc

SEQ ID NO: 188518 - DNA, 15 bp, Homo sapiens
agttgaagttcagac

SEQ ID NO: 188519 - DNA, 15 bp, Homo sapiens
aagttgaagttcaga

SEQ ID NO: 188520 - DNA, 15 bp, Homo sapiens
taagttgaagttcag

SEQ ID NO: 188521 - DNA, 15 bp, Homo sapiens
gtaagttgaagttca

SEQ ID NO: 188522 - DNA, 15 bp, Homo sapiens
cgtaagttgaagttc

SEQ ID NO: 188523 - DNA, 15 bp, Homo sapiens
ccgtaagttgaagtt

SEQ ID NO: 188524 - DNA, 15 bp, Homo sapiens
cccgtaagttgaagt

SEQ ID NO: 188525 - DNA, 15 bp, Homo sapiens
tcccgtaagttgaag

SEQ ID NO: 188526 - DNA, 15 bp, Homo sapiens
ttcccgtaagttgaa

SEQ ID NO: 188527 - DNA, 15 bp, Homo sapiens
gttcccgtaagttga

SEQ ID NO: 188528 - DNA, 15 bp, Homo sapiens
agttcccgtaagttg

SEQ ID NO: 188529 - DNA, 15 bp, Homo sapiens
cagttcccgtaagtt

SEQ ID NO: 188530 - DNA, 15 bp, Homo sapiens
gcagttcccgtaagt

SEQ ID NO: 188531 - DNA, 15 bp, Homo sapiens
agcagttcccgtaag

SEQ ID NO: 188532 - DNA, 15 bp, Homo sapiens
cagcagttcccgtaa

SEQ ID NO: 188533 - DNA, 15 bp, Homo sapiens
tcagcagttcccgta

SEQ ID NO: 188534 - DNA, 15 bp, Homo sapiens
gtcagcagttcccgt

SEQ ID NO: 188535 - DNA, 15 bp, Homo sapiens
tgtcagcagttcccg

SEQ ID NO: 188536 - DNA, 15 bp, Homo sapiens
ttgtcagcagttccc

SEQ ID NO: 188537 - DNA, 15 bp, Homo sapiens
tttgtcagcagttcc

SEQ ID NO: 188538 - DNA, 15 bp, Homo sapiens
ttttgtcagcagttc

SEQ ID NO: 188539 - DNA, 15 bp, Homo sapiens
attttgtcagcagtt

SEQ ID NO: 188540 - DNA, 15 bp, Homo sapiens
aattttgtcagcagt

SEQ ID NO: 188541 - DNA, 15 bp, Homo sapiens
aaattttgtcagcag

SEQ ID NO: 188542 - DNA, 15 bp, Homo sapiens
caaattttgtcagca

SEQ ID NO: 188543 - DNA, 15 bp, Homo sapiens
tcaaattttgtcagc

SEQ ID NO: 188544 - DNA, 15 bp, Homo sapiens
ttcaaattttgtcag

SEQ ID NO: 188545 - DNA, 15 bp, Homo sapiens
tttcaaattttgtca

SEQ ID NO: 188546 - DNA, 15 bp, Homo sapiens
ttttcaaattttgtc

SEQ ID NO: 188547 - DNA, 15 bp, Homo sapiens
cttttcaaattttgt

SEQ ID NO: 188548 - DNA, 15 bp, Homo sapiens
ccttttcaaattttg

SEQ ID NO: 188549 - DNA, 15 bp, Homo sapiens
accttttcaaatttt

SEQ ID NO: 188550 - DNA, 15 bp, Homo sapiens
taccttttcaaattt

SEQ ID NO: 188551 - DNA, 15 bp, Homo sapiens
ataccttttcaaatt

SEQ ID NO: 188552 - DNA, 15 bp, Homo sapiens
cataccttttcaaat

SEQ ID NO: 188553 - DNA, 15 bp, Homo sapiens
gcataccttttcaaa

SEQ ID NO: 188554 - DNA, 15 bp, Homo sapiens
tgcataccttttcaa

SEQ ID NO: 188555 - DNA, 15 bp, Homo sapiens
ctgcataccttttca

SEQ ID NO: 188556 - DNA, 15 bp, Homo sapiens
tctgcataccttttc

SEQ ID NO: 188557 - DNA, 15 bp, Homo sapiens
ttctgcatacctttt

SEQ ID NO: 188558 - DNA, 15 bp, Homo sapiens
tttctgcataccttt

SEQ ID NO: 188559 - DNA, 15 bp, Homo sapiens
ctttctgcatacctt

SEQ ID NO: 188560 - DNA, 15 bp, Homo sapiens
gctttctgcatacct

SEQ ID NO: 188561 - DNA, 15 bp, Homo sapiens
tgctttctgcatacc

SEQ ID NO: 188562 - DNA, 15 bp, Homo sapiens
ttgctttctgcatac

SEQ ID NO: 188563 - DNA, 15 bp, Homo sapiens
tttgctttctgcata

SEQ ID NO: 188564 - DNA, 15 bp, Homo sapiens
gtttgctttctgcat

SEQ ID NO: 188565 - DNA, 15 bp, Homo sapiens
agtttgctttctgca

SEQ ID NO: 188566 - DNA, 15 bp, Homo sapiens
aagtttgctttctgc

SEQ ID NO: 188567 - DNA, 15 bp, Homo sapiens
gaagtttgctttctg

SEQ ID NO: 188568 - DNA, 15 bp, Homo sapiens
tgaagtttgctttct

SEQ ID NO: 188569 - DNA, 15 bp, Homo sapiens
atgaagtttgctttc

SEQ ID NO: 188570 - DNA, 15 bp, Homo sapiens
catgaagtttgcttt

SEQ ID NO: 188571 - DNA, 15 bp, Homo sapiens
tcatgaagtttgctt

SEQ ID NO: 188572 - DNA, 15 bp, Homo sapiens
ttcatgaagtttgct

SEQ ID NO: 188573 - DNA, 15 bp, Homo sapiens
attcatgaagtttgc

SEQ ID NO: 188574 - DNA, 15 bp, Homo sapiens
cattcatgaagtttg

SEQ ID NO: 188575 - DNA, 15 bp, Homo sapiens
acattcatgaagttt

SEQ ID NO: 188576 - DNA, 15 bp, Homo sapiens
tacattcatgaagtt

SEQ ID NO: 188577 - DNA, 15 bp, Homo sapiens
gtacattcatgaagt

SEQ ID NO: 188578 - DNA, 15 bp, Homo sapiens
agtacattcatgaag

SEQ ID NO: 188579 - DNA, 15 bp, Homo sapiens
aagtacattcatgaa

SEQ ID NO: 188580 - DNA, 15 bp, Homo sapiens
aaagtacattcatga

SEQ ID NO: 188581 - DNA, 15 bp, Homo sapiens
aaaagtacattcatg

SEQ ID NO: 188582 - DNA, 15 bp, Homo sapiens
aaaaagtacattcat

SEQ ID NO: 188583 - DNA, 15 bp, Homo sapiens
aaaaaagtacattca

SEQ ID NO: 188584 - DNA, 15 bp, Homo sapiens
gaaaaaagtacattc

SEQ ID NO: 188585 - DNA, 15 bp, Homo sapiens
ggaaaaaagtacatt

SEQ ID NO: 188586 - DNA, 15 bp, Homo sapiens
aggaaaaaagtacat

SEQ ID NO: 188587 - DNA, 15 bp, Homo sapiens
aaggaaaaaagtaca

SEQ ID NO: 188588 - DNA, 15 bp, Homo sapiens
aaaggaaaaaagtac

SEQ ID NO: 188589 - DNA, 15 bp, Homo sapiens
gaaaggaaaaaagta

SEQ ID NO: 188590 - DNA, 15 bp, Homo sapiens
agaaaggaaaaaagt

SEQ ID NO: 188591 - DNA, 15 bp, Homo sapiens
aagaaaggaaaaaag

SEQ ID NO: 188592 - DNA, 15 bp, Homo sapiens
aaagaaaggaaaaaa

SEQ ID NO: 188593 - DNA, 15 bp, Homo sapiens
gaaagaaaggaaaaa

SEQ ID NO: 188594 - DNA, 15 bp, Homo sapiens
agaaagaaaggaaaa

SEQ ID NO: 188595 - DNA, 15 bp, Homo sapiens
aagaaagaaaggaaa

SEQ ID NO: 188596 - DNA, 15 bp, Homo sapiens
caagaaagaaaggaa

SEQ ID NO: 188597 - DNA, 15 bp, Homo sapiens
gcaagaaagaaagga

SEQ ID NO: 188598 - DNA, 15 bp, Homo sapiens
ggcaagaaagaaagg

SEQ ID NO: 188599 - DNA, 15 bp, Homo sapiens
aggcaagaaagaaag

SEQ ID NO: 188600 - DNA, 15 bp, Homo sapiens
aaggcaagaaagaaa

SEQ ID NO: 188601 - DNA, 15 bp, Homo sapiens
aaaggcaagaaagaa

SEQ ID NO: 188602 - DNA, 15 bp, Homo sapiens
aaaaggcaagaaaga

SEQ ID NO: 188603 - DNA, 15 bp, Homo sapiens
aaaaaggcaagaaag

SEQ ID NO: 188604 - DNA, 15 bp, Homo sapiens
aaaaaaggcaagaaa

SEQ ID NO: 188605 - DNA, 15 bp, Homo sapiens
aaaaaaaggcaagaa

SEQ ID NO: 188606 - DNA, 15 bp, Homo sapiens
aaaaaaaaggcaaga

SEQ ID NO: 188607 - DNA, 15 bp, Homo sapiens
gaaaaaaaaggcaag

SEQ ID NO: 188608 - DNA, 15 bp, Homo sapiens
tgaaaaaaaaggcaa

SEQ ID NO: 188609 - DNA, 15 bp, Homo sapiens
gtgaaaaaaaaggca

SEQ ID NO: 188610 - DNA, 15 bp, Homo sapiens
agtgaaaaaaaaggc

SEQ ID NO: 188611 - DNA, 15 bp, Homo sapiens
tagtgaaaaaaaagg

SEQ ID NO: 188612 - DNA, 15 bp, Homo sapiens
atagtgaaaaaaaag

SEQ ID NO: 188613 - DNA, 15 bp, Homo sapiens
tatagtgaaaaaaaa

SEQ ID NO: 188614 - DNA, 15 bp, Homo sapiens
gtatagtgaaaaaaa

SEQ ID NO: 188615 - DNA, 15 bp, Homo sapiens
tgtatagtgaaaaaa

SEQ ID NO: 188616 - DNA, 15 bp, Homo sapiens
atgtatagtgaaaaa

SEQ ID NO: 188617 - DNA, 15 bp, Homo sapiens
aatgtatagtgaaaa

SEQ ID NO: 188618 - DNA, 15 bp, Homo sapiens
aaatgtatagtgaaa

SEQ ID NO: 188619 - DNA, 15 bp, Homo sapiens
taaatgtatagtgaa

SEQ ID NO: 188620 - DNA, 15 bp, Homo sapiens
ctaaatgtatagtga

SEQ ID NO: 188621 - DNA, 15 bp, Homo sapiens
tctaaatgtatagtg

SEQ ID NO: 188622 - DNA, 15 bp, Homo sapiens
atctaaatgtatagt

SEQ ID NO: 188623 - DNA, 15 bp, Homo sapiens
tatctaaatgtatag

SEQ ID NO: 188624 - DNA, 15 bp, Homo sapiens
ctatctaaatgtata

SEQ ID NO: 188625 - DNA, 15 bp, Homo sapiens
tctatctaaatgtat

SEQ ID NO: 188626 - DNA, 15 bp, Homo sapiens
atctatctaaatgta

SEQ ID NO: 188627 - DNA, 15 bp, Homo sapiens
catctatctaaatgt

SEQ ID NO: 188628 - DNA, 15 bp, Homo sapiens
gcatctatctaaatg

SEQ ID NO: 188629 - DNA, 15 bp, Homo sapiens
agcatctatctaaat

SEQ ID NO: 188630 - DNA, 15 bp, Homo sapiens
gagcatctatctaaa

SEQ ID NO: 188631 - DNA, 15 bp, Homo sapiens
agagcatctatctaa

SEQ ID NO: 188632 - DNA, 15 bp, Homo sapiens
tagagcatctatcta

SEQ ID NO: 188633 - DNA, 15 bp, Homo sapiens
atagagcatctatct

SEQ ID NO: 188634 - DNA, 15 bp, Homo sapiens
aatagagcatctatc

SEQ ID NO: 188635 - DNA, 15 bp, Homo sapiens
caatagagcatctat

SEQ ID NO: 188636 - DNA, 15 bp, Homo sapiens
tcaatagagcatcta

SEQ ID NO: 188637 - DNA, 15 bp, Homo sapiens
gtcaatagagcatct

SEQ ID NO: 188638 - DNA, 15 bp, Homo sapiens
agtcaatagagcatc

SEQ ID NO: 188639 - DNA, 15 bp, Homo sapiens
gagtcaatagagcat

SEQ ID NO: 188640 - DNA, 15 bp, Homo sapiens
agagtcaatagagca

SEQ ID NO: 188641 - DNA, 15 bp, Homo sapiens
aagagtcaatagagc

SEQ ID NO: 188642 - DNA, 15 bp, Homo sapiens
aaagagtcaatagag

SEQ ID NO: 188643 - DNA, 15 bp, Homo sapiens
caaagagtcaataga

SEQ ID NO: 188644 - DNA, 15 bp, Homo sapiens
ccaaagagtcaatag

SEQ ID NO: 188645 - DNA, 15 bp, Homo sapiens
accaaagagtcaata

SEQ ID NO: 188646 - DNA, 15 bp, Homo sapiens
caccaaagagtcaat

SEQ ID NO: 188647 - DNA, 15 bp, Homo sapiens
ccaccaaagagtcaa

SEQ ID NO: 188648 - DNA, 15 bp, Homo sapiens
accaccaaagagtca

SEQ ID NO: 188649 - DNA, 15 bp, Homo sapiens
aaccaccaaagagtc

SEQ ID NO: 188650 - DNA, 15 bp, Homo sapiens
aaaccaccaaagagt

SEQ ID NO: 188651 - DNA, 15 bp, Homo sapiens
taaaccaccaaagag

SEQ ID NO: 188652 - DNA, 15 bp, Homo sapiens
ctaaaccaccaaaga

SEQ ID NO: 188653 - DNA, 15 bp, Homo sapiens
actaaaccaccaaag

SEQ ID NO: 188654 - DNA, 15 bp, Homo sapiens
tactaaaccaccaaa

SEQ ID NO: 188655 - DNA, 15 bp, Homo sapiens
atactaaaccaccaa

SEQ ID NO: 188656 - DNA, 15 bp, Homo sapiens
tatactaaaccacca

SEQ ID NO: 188657 - DNA, 15 bp, Homo sapiens
ttatactaaaccacc

SEQ ID NO: 188658 - DNA, 15 bp, Homo sapiens
attatactaaaccac

SEQ ID NO: 188659 - DNA, 15 bp, Homo sapiens
aattatactaaacca

SEQ ID NO: 188660 - DNA, 15 bp, Homo sapiens
aaattatactaaacc

SEQ ID NO: 188661 - DNA, 15 bp, Homo sapiens
taaattatactaaac

SEQ ID NO: 188662 - DNA, 15 bp, Homo sapiens
ataaattatactaaa

SEQ ID NO: 188663 - DNA, 15 bp, Homo sapiens
tataaattatactaa

SEQ ID NO: 188664 - DNA, 15 bp, Homo sapiens
ttataaattatacta

SEQ ID NO: 188665 - DNA, 15 bp, Homo sapiens
cttataaattatact

SEQ ID NO: 188666 - DNA, 15 bp, Homo sapiens
ccttataaattatac

SEQ ID NO: 188667 - DNA, 15 bp, Homo sapiens
tccttataaattata

SEQ ID NO: 188668 - DNA, 15 bp, Homo sapiens
ttccttataaattat

SEQ ID NO: 188669 - DNA, 15 bp, Homo sapiens
attccttataaatta

SEQ ID NO: 188670 - DNA, 15 bp, Homo sapiens
tattccttataaatt

SEQ ID NO: 188671 - DNA, 15 bp, Homo sapiens
atattccttataaat

SEQ ID NO: 188672 - DNA, 15 bp, Homo sapiens
aatattccttataaa

SEQ ID NO: 188673 - DNA, 15 bp, Homo sapiens
gaatattccttataa

SEQ ID NO: 188674 - DNA, 15 bp, Homo sapiens
tgaatattccttata

SEQ ID NO: 188675 - DNA, 15 bp, Homo sapiens
ttgaatattccttat

SEQ ID NO: 188676 - DNA, 15 bp, Homo sapiens
attgaatattcctta

SEQ ID NO: 188677 - DNA, 15 bp, Homo sapiens
aattgaatattcctt

SEQ ID NO: 188678 - DNA, 15 bp, Homo sapiens
aaattgaatattcct

SEQ ID NO: 188679 - DNA, 15 bp, Homo sapiens
aaaattgaatattcc

SEQ ID NO: 188680 - DNA, 15 bp, Homo sapiens
caaaattgaatattc

SEQ ID NO: 188681 - DNA, 15 bp, Homo sapiens
gcaaaattgaatatt

SEQ ID NO: 188682 - DNA, 15 bp, Homo sapiens
agcaaaattgaatat

SEQ ID NO: 188683 - DNA, 15 bp, Homo sapiens
cagcaaaattgaata

SEQ ID NO: 188684 - DNA, 15 bp, Homo sapiens
acagcaaaattgaat

SEQ ID NO: 188685 - DNA, 15 bp, Homo sapiens
gacagcaaaattgaa

SEQ ID NO: 188686 - DNA, 15 bp, Homo sapiens
agacagcaaaattga

SEQ ID NO: 188687 - DNA, 15 bp, Homo sapiens
gagacagcaaaattg

SEQ ID NO: 188688 - DNA, 15 bp, Homo sapiens
ggagacagcaaaatt

SEQ ID NO: 188689 - DNA, 15 bp, Homo sapiens
aggagacagcaaaat

SEQ ID NO: 188690 - DNA, 15 bp, Homo sapiens
aaggagacagcaaaa

SEQ ID NO: 188691 - DNA, 15 bp, Homo sapiens
aaaggagacagcaaa

SEQ ID NO: 188692 - DNA, 15 bp, Homo sapiens
taaaggagacagcaa

SEQ ID NO: 188693 - DNA, 15 bp, Homo sapiens
ttaaaggagacagca

SEQ ID NO: 188694 - DNA, 15 bp, Homo sapiens
tttaaaggagacagc

SEQ ID NO: 188695 - DNA, 15 bp, Homo sapiens
ctttaaaggagacag

SEQ ID NO: 188696 - DNA, 15 bp, Homo sapiens
tctttaaaggagaca

SEQ ID NO: 188697 - DNA, 15 bp, Homo sapiens
atctttaaaggagac

SEQ ID NO: 188698 - DNA, 15 bp, Homo sapiens
catctttaaaggaga

SEQ ID NO: 188699 - DNA, 15 bp, Homo sapiens
acatctttaaaggag

SEQ ID NO: 188700 - DNA, 15 bp, Homo sapiens
aacatctttaaagga

SEQ ID NO: 188701 - DNA, 15 bp, Homo sapiens
aaacatctttaaagg

SEQ ID NO: 188702 - DNA, 15 bp, Homo sapiens
aaaacatctttaaag

SEQ ID NO: 188703 - DNA, 15 bp, Homo sapiens
aaaaacatctttaaa

SEQ ID NO: 188704 - DNA, 15 bp, Homo sapiens
gaaaaacatctttaa

SEQ ID NO: 188705 - DNA, 15 bp, Homo sapiens
tgaaaaacatcttta

SEQ ID NO: 188706 - DNA, 15 bp, Homo sapiens
ttgaaaaacatcttt

SEQ ID NO: 188707 - DNA, 15 bp, Homo sapiens
cttgaaaaacatctt

SEQ ID NO: 188708 - DNA, 15 bp, Homo sapiens
acttgaaaaacatct

SEQ ID NO: 188709 - DNA, 15 bp, Homo sapiens
tacttgaaaaacatc

SEQ ID NO: 188710 - DNA, 15 bp, Homo sapiens
ttacttgaaaaacat

SEQ ID NO: 188711 - DNA, 15 bp, Homo sapiens
tttacttgaaaaaca

SEQ ID NO: 188712 - DNA, 15 bp, Homo sapiens
ctttacttgaaaaac

SEQ ID NO: 188713 - DNA, 15 bp, Homo sapiens
cctttacttgaaaaa

SEQ ID NO: 188714 - DNA, 15 bp, Homo sapiens
ccctttacttgaaaa

SEQ ID NO: 188715 - DNA, 15 bp, Homo sapiens
gccctttacttgaaa

SEQ ID NO: 188716 - DNA, 15 bp, Homo sapiens
agccctttacttgaa

SEQ ID NO: 188717 - DNA, 15 bp, Homo sapiens
tagccctttacttga

SEQ ID NO: 188718 - DNA, 15 bp, Homo sapiens
ttagccctttacttg

SEQ ID NO: 188719 - DNA, 15 bp, Homo sapiens
attagccctttactt

SEQ ID NO: 188720 - DNA, 15 bp, Homo sapiens
aattagccctttact

SEQ ID NO: 188721 - DNA, 15 bp, Homo sapiens
taattagccctttac

SEQ ID NO: 188722 - DNA, 15 bp, Homo sapiens
ctaattagcccttta

SEQ ID NO: 188723 - DNA, 15 bp, Homo sapiens
gctaattagcccttt

SEQ ID NO: 188724 - DNA, 15 bp, Homo sapiens
tgctaattagccctt

SEQ ID NO: 188725 - DNA, 15 bp, Homo sapiens
ttgctaattagccct

SEQ ID NO: 188726 - DNA, 15 bp, Homo sapiens
attgctaattagccc

SEQ ID NO: 188727 - DNA, 15 bp, Homo sapiens
aattgctaattagcc

SEQ ID NO: 188728 - DNA, 15 bp, Homo sapiens
taattgctaattagc

SEQ ID NO: 188729 - DNA, 15 bp, Homo sapiens
gtaattgctaattag

SEQ ID NO: 188730 - DNA, 15 bp, Homo sapiens
agtaattgctaatta

SEQ ID NO: 188731 - DNA, 15 bp, Homo sapiens
aagtaattgctaatt

SEQ ID NO: 188732 - DNA, 15 bp, Homo sapiens
gaagtaattgctaat

SEQ ID NO: 188733 - DNA, 15 bp, Homo sapiens
ggaagtaattgctaa

SEQ ID NO: 188734 - DNA, 15 bp, Homo sapiens
aggaagtaattgcta

SEQ ID NO: 188735 - DNA, 15 bp, Homo sapiens
aaggaagtaattgct

SEQ ID NO: 188736 - DNA, 15 bp, Homo sapiens
aaaggaagtaattgc

SEQ ID NO: 188737 - DNA, 15 bp, Homo sapiens
caaaggaagtaattg

SEQ ID NO: 188738 - DNA, 15 bp, Homo sapiens
ccaaaggaagtaatt

SEQ ID NO: 188739 - DNA, 15 bp, Homo sapiens
accaaaggaagtaat

SEQ ID NO: 188740 - DNA, 15 bp, Homo sapiens
gaccaaaggaagtaa

SEQ ID NO: 188741 - DNA, 15 bp, Homo sapiens
tgaccaaaggaagta

SEQ ID NO: 188742 - DNA, 15 bp, Homo sapiens
ctgaccaaaggaagt

SEQ ID NO: 188743 - DNA, 15 bp, Homo sapiens
cctgaccaaaggaag

SEQ ID NO: 188744 - DNA, 15 bp, Homo sapiens
tcctgaccaaaggaa

SEQ ID NO: 188745 - DNA, 15 bp, Homo sapiens
ctcctgaccaaagga

SEQ ID NO: 188746 - DNA, 15 bp, Homo sapiens
cctcctgaccaaagg

SEQ ID NO: 188747 - DNA, 15 bp, Homo sapiens
ccctcctgaccaaag

SEQ ID NO: 188748 - DNA, 15 bp, Homo sapiens
gccctcctgaccaaa

SEQ ID NO: 188749 - DNA, 15 bp, Homo sapiens
agccctcctgaccaa

SEQ ID NO: 188750 - DNA, 15 bp, Homo sapiens
aagccctcctgacca

SEQ ID NO: 188751 - DNA, 15 bp, Homo sapiens
gaagccctcctgacc

SEQ ID NO: 188752 - DNA, 15 bp, Homo sapiens
agaagccctcctgac

SEQ ID NO: 188753 - DNA, 15 bp, Homo sapiens
gagaagccctcctga

SEQ ID NO: 188754 - DNA, 15 bp, Homo sapiens
tgagaagccctcctg

SEQ ID NO: 188755 - DNA, 15 bp, Homo sapiens
atgagaagccctcct

SEQ ID NO: 188756 - DNA, 15 bp, Homo sapiens
catgagaagccctcc

SEQ ID NO: 188757 - DNA, 15 bp, Homo sapiens
tcatgagaagccctc

SEQ ID NO: 188758 - DNA, 15 bp, Homo sapiens
atcatgagaagccct

SEQ ID NO: 188759 - DNA, 15 bp, Homo sapiens
catcatgagaagccc

SEQ ID NO: 188760 - DNA, 15 bp, Homo sapiens
gcatcatgagaagcc

SEQ ID NO: 188761 - DNA, 15 bp, Homo sapiens
ggcatcatgagaagc

SEQ ID NO: 188762 - DNA, 15 bp, Homo sapiens
aggcatcatgagaag

SEQ ID NO: 188763 - DNA, 15 bp, Homo sapiens
caggcatcatgagaa

SEQ ID NO: 188764 - DNA, 15 bp, Homo sapiens
acaggcatcatgaga

SEQ ID NO: 188765 - DNA, 15 bp, Homo sapiens
gacaggcatcatgag

SEQ ID NO: 188766 - DNA, 15 bp, Homo sapiens
tgacaggcatcatga

SEQ ID NO: 188767 - DNA, 15 bp, Homo sapiens
gtgacaggcatcatg

SEQ ID NO: 188768 - DNA, 15 bp, Homo sapiens
agtgacaggcatcat

SEQ ID NO: 188769 - DNA, 15 bp, Homo sapiens
aagtgacaggcatca

SEQ ID NO: 188770 - DNA, 15 bp, Homo sapiens
aaagtgacaggcatc

SEQ ID NO: 188771 - DNA, 15 bp, Homo sapiens
aaaagtgacaggcat

SEQ ID NO: 188772 - DNA, 15 bp, Homo sapiens
taaaagtgacaggca

SEQ ID NO: 188773 - DNA, 15 bp, Homo sapiens
ctaaaagtgacaggc

SEQ ID NO: 188774 - DNA, 15 bp, Homo sapiens
tctaaaagtgacagg

SEQ ID NO: 188775 - DNA, 15 bp, Homo sapiens
ttctaaaagtgacag

SEQ ID NO: 188776 - DNA, 15 bp, Homo sapiens
attctaaaagtgaca

SEQ ID NO: 188777 - DNA, 15 bp, Homo sapiens
aattctaaaagtgac

SEQ ID NO: 188778 - DNA, 15 bp, Homo sapiens
gaattctaaaagtga

SEQ ID NO: 188779 - DNA, 15 bp, Homo sapiens
ggaattctaaaagtg

SEQ ID NO: 188780 - DNA, 15 bp, Homo sapiens
tggaattctaaaagt

SEQ ID NO: 188781 - DNA, 15 bp, Homo sapiens
gtggaattctaaaag

SEQ ID NO: 188782 - DNA, 15 bp, Homo sapiens
tgtggaattctaaaa

SEQ ID NO: 188783 - DNA, 15 bp, Homo sapiens
atgtggaattctaaa

SEQ ID NO: 188784 - DNA, 15 bp, Homo sapiens
gatgtggaattctaa

SEQ ID NO: 188785 - DNA, 15 bp, Homo sapiens
tgatgtggaattcta

SEQ ID NO: 188786 - DNA, 15 bp, Homo sapiens
ctgatgtggaattct

SEQ ID NO: 188787 - DNA, 15 bp, Homo sapiens
tctgatgtggaattc

SEQ ID NO: 188788 - DNA, 15 bp, Homo sapiens
ttctgatgtggaatt

SEQ ID NO: 188789 - DNA, 15 bp, Homo sapiens
cttctgatgtggaat

SEQ ID NO: 188790 - DNA, 15 bp, Homo sapiens
tcttctgatgtggaa

SEQ ID NO: 188791 - DNA, 15 bp, Homo sapiens
ttcttctgatgtgga

SEQ ID NO: 188792 - DNA, 15 bp, Homo sapiens
tttcttctgatgtgg

SEQ ID NO: 188793 - DNA, 15 bp, Homo sapiens
gtttcttctgatgtg

SEQ ID NO: 188794 - DNA, 15 bp, Homo sapiens
agtttcttctgatgt

SEQ ID NO: 188795 - DNA, 15 bp, Homo sapiens
gagtttcttctgatg

SEQ ID NO: 188796 - DNA, 15 bp, Homo sapiens
agagtttcttctgat

SEQ ID NO: 188797 - DNA, 15 bp, Homo sapiens
aagagtttcttctga

SEQ ID NO: 188798 - DNA, 15 bp, Homo sapiens
aaagagtttcttctg

SEQ ID NO: 188799 - DNA, 15 bp, Homo sapiens
caaagagtttcttct

SEQ ID NO: 188800 - DNA, 15 bp, Homo sapiens
acaaagagtttcttc

SEQ ID NO: 188801 - DNA, 15 bp, Homo sapiens
tacaaagagtttctt

SEQ ID NO: 188802 - DNA, 15 bp, Homo sapiens
gtacaaagagtttct

SEQ ID NO: 188803 - DNA, 15 bp, Homo sapiens
agtacaaagagtttc

SEQ ID NO: 188804 - DNA, 15 bp, Homo sapiens
gagtacaaagagttt

SEQ ID NO: 188805 - DNA, 15 bp, Homo sapiens
tgagtacaaagagtt

SEQ ID NO: 188806 - DNA, 15 bp, Homo sapiens
ttgagtacaaagagt

SEQ ID NO: 188807 - DNA, 15 bp, Homo sapiens
cttgagtacaaagag

SEQ ID NO: 188808 - DNA, 15 bp, Homo sapiens
acttgagtacaaaga

SEQ ID NO: 188809 - DNA, 15 bp, Homo sapiens
gacttgagtacaaag

SEQ ID NO: 188810 - DNA, 15 bp, Homo sapiens
tgacttgagtacaaa

SEQ ID NO: 188811 - DNA, 15 bp, Homo sapiens
ctgacttgagtacaa

SEQ ID NO: 188812 - DNA, 15 bp, Homo sapiens
gctgacttgagtaca

SEQ ID NO: 188813 - DNA, 15 bp, Homo sapiens
agctgacttgagtac

SEQ ID NO: 188814 - DNA, 15 bp, Homo sapiens
cagctgacttgagta

SEQ ID NO: 188815 - DNA, 15 bp, Homo sapiens
ccagctgacttgagt

SEQ ID NO: 188816 - DNA, 15 bp, Homo sapiens
accagctgacttgag

SEQ ID NO: 188817 - DNA, 15 bp, Homo sapiens
taccagctgacttga

SEQ ID NO: 188818 - DNA, 15 bp, Homo sapiens
ttaccagctgacttg

SEQ ID NO: 188819 - DNA, 15 bp, Homo sapiens
attaccagctgactt

SEQ ID NO: 188820 - DNA, 15 bp, Homo sapiens
aattaccagctgact

SEQ ID NO: 188821 - DNA, 15 bp, Homo sapiens
aaattaccagctgac

SEQ ID NO: 188822 - DNA, 15 bp, Homo sapiens
taaattaccagctga

SEQ ID NO: 188823 - DNA, 15 bp, Homo sapiens
ttaaattaccagctg

SEQ ID NO: 188824 - DNA, 15 bp, Homo sapiens
gttaaattaccagct

SEQ ID NO: 188825 - DNA, 15 bp, Homo sapiens
agttaaattaccagc

SEQ ID NO: 188826 - DNA, 15 bp, Homo sapiens
cagttaaattaccag

SEQ ID NO: 188827 - DNA, 15 bp, Homo sapiens
tcagttaaattacca

SEQ ID NO: 188828 - DNA, 15 bp, Homo sapiens
ttcagttaaattacc

SEQ ID NO: 188829 - DNA, 15 bp, Homo sapiens
tttcagttaaattac

SEQ ID NO: 188830 - DNA, 15 bp, Homo sapiens
gtttcagttaaatta

SEQ ID NO: 188831 - DNA, 15 bp, Homo sapiens
agtttcagttaaatt

SEQ ID NO: 188832 - DNA, 15 bp, Homo sapiens
aagtttcagttaaat

SEQ ID NO: 188833 - DNA, 15 bp, Homo sapiens
gaagtttcagttaaa

SEQ ID NO: 188834 - DNA, 15 bp, Homo sapiens
agaagtttcagttaa

SEQ ID NO: 188835 - DNA, 15 bp, Homo sapiens
aagaagtttcagtta

SEQ ID NO: 188836 - DNA, 15 bp, Homo sapiens
aaagaagtttcagtt

SEQ ID NO: 188837 - DNA, 15 bp, Homo sapiens
caaagaagtttcagt

SEQ ID NO: 188838 - DNA, 15 bp, Homo sapiens
ccaaagaagtttcag

SEQ ID NO: 188839 - DNA, 15 bp, Homo sapiens
tccaaagaagtttca

SEQ ID NO: 188840 - DNA, 15 bp, Homo sapiens
ctccaaagaagtttc

SEQ ID NO: 188841 - DNA, 15 bp, Homo sapiens
tctccaaagaagttt

SEQ ID NO: 188842 - DNA, 15 bp, Homo sapiens
ttctccaaagaagtt

SEQ ID NO: 188843 - DNA, 15 bp, Homo sapiens
tttctccaaagaagt

SEQ ID NO: 188844 - DNA, 15 bp, Homo sapiens
ttttctccaaagaag

SEQ ID NO: 188845 - DNA, 15 bp, Homo sapiens
tttttctccaaagaa

SEQ ID NO: 188846 - DNA, 15 bp, Homo sapiens
ttttttctccaaaga

SEQ ID NO: 188847 - DNA, 15 bp, Homo sapiens
tttttttctccaaag

SEQ ID NO: 188848 - DNA, 15 bp, Homo sapiens
ttttttttctccaaa

SEQ ID NO: 188849 - DNA, 15 bp, Homo sapiens
tttttttttctccaa

SEQ ID NO: 188850 - DNA, 15 bp, Homo sapiens
ttttttttttctcca

SEQ ID NO: 188851 - DNA, 15 bp, Homo sapiens
cttttttttttctcc

SEQ ID NO: 188852 - DNA, 15 bp, Homo sapiens
tcttttttttttctc

SEQ ID NO: 188853 - DNA, 15 bp, Homo sapiens
ttcttttttttttct

SEQ ID NO: 188854 - DNA, 15 bp, Homo sapiens
tttcttttttttttc

SEQ ID NO: 188855 - DNA, 15 bp, Homo sapiens
attttcttttttttt

SEQ ID NO: 188856 - DNA, 15 bp, Homo sapiens
cattttctttttttt

SEQ ID NO: 188857 - DNA, 15 bp, Homo sapiens
tcattttcttttttt

SEQ ID NO: 188858 - DNA, 15 bp, Homo sapiens
ttcattttctttttt

SEQ ID NO: 188859 - DNA, 15 bp, Homo sapiens
tttcattttcttttt

SEQ ID NO: 188860 - DNA, 15 bp, Homo sapiens
ttttcattttctttt

SEQ ID NO: 188861 - DNA, 15 bp, Homo sapiens
attttcattttcttt

SEQ ID NO: 188862 - DNA, 15 bp, Homo sapiens
ttttattttcatttt

SEQ ID NO: 188863 - DNA, 15 bp, Homo sapiens
attttattttcattt

SEQ ID NO: 188864 - DNA, 15 bp, Homo sapiens
tattttattttcatt

SEQ ID NO: 188865 - DNA, 15 bp, Homo sapiens
ttattttattttcat

SEQ ID NO: 188866 - DNA, 15 bp, Homo sapiens
tttattttattttca

SEQ ID NO: 188867 - DNA, 15 bp, Homo sapiens
ttttattttattttc

SEQ ID NO: 188868 - DNA, 15 bp, Homo sapiens
atttttattttattt

SEQ ID NO: 188869 - DNA, 15 bp, Homo sapiens
gatttttattttatt

SEQ ID NO: 188870 - DNA, 15 bp, Homo sapiens
ggatttttattttat

SEQ ID NO: 188871 - DNA, 15 bp, Homo sapiens
tggatttttatttta

SEQ ID NO: 188872 - DNA, 15 bp, Homo sapiens
ctggatttttatttt

SEQ ID NO: 188873 - DNA, 15 bp, Homo sapiens
gctggatttttattt

SEQ ID NO: 188874 - DNA, 15 bp, Homo sapiens
tgctggatttttatt

SEQ ID NO: 188875 - DNA, 15 bp, Homo sapiens
ttgctggatttttat

SEQ ID NO: 188876 - DNA, 15 bp, Homo sapiens
tttgctggattttta

SEQ ID NO: 188877 - DNA, 15 bp, Homo sapiens
ttttgctggattttt

SEQ ID NO: 188878 - DNA, 15 bp, Homo sapiens
tttttgctggatttt

SEQ ID NO: 188879 - DNA, 15 bp, Homo sapiens
ttttttgctggattt

SEQ ID NO: 188880 - DNA, 15 bp, Homo sapiens
gttttttgctggatt

SEQ ID NO: 188881 - DNA, 15 bp, Homo sapiens
tgttttttgctggat

SEQ ID NO: 188882 - DNA, 15 bp, Homo sapiens
gtgttttttgctgga

SEQ ID NO: 188883 - DNA, 15 bp, Homo sapiens
agtgttttttgctgg

SEQ ID NO: 188884 - DNA, 15 bp, Homo sapiens
cagtgttttttgctg

SEQ ID NO: 188885 - DNA, 15 bp, Homo sapiens
ccagtgttttttgct

SEQ ID NO: 188886 - DNA, 15 bp, Homo sapiens
cccagtgttttttgc

SEQ ID NO: 188887 - DNA, 15 bp, Homo sapiens
acccagtgttttttg

SEQ ID NO: 188888 - DNA, 15 bp, Homo sapiens
tacccagtgtttttt

SEQ ID NO: 188889 - DNA, 15 bp, Homo sapiens
atacccagtgttttt

SEQ ID NO: 188890 - DNA, 15 bp, Homo sapiens
aatacccagtgtttt

SEQ ID NO: 188891 - DNA, 15 bp, Homo sapiens
caatacccagtgttt

SEQ ID NO: 188892 - DNA, 15 bp, Homo sapiens
ccaatacccagtgtt

SEQ ID NO: 188893 - DNA, 15 bp, Homo sapiens
accaatacccagtgt

SEQ ID NO: 188894 - DNA, 15 bp, Homo sapiens
caccaatacccagtg

SEQ ID NO: 188895 - DNA, 15 bp, Homo sapiens
gcaccaatacccagt

SEQ ID NO: 188896 - DNA, 15 bp, Homo sapiens
ggcaccaatacccag

SEQ ID NO: 188897 - DNA, 15 bp, Homo sapiens
tggcaccaataccca

SEQ ID NO: 188898 - DNA, 15 bp, Homo sapiens
ttggcaccaataccc

SEQ ID NO: 188899 - DNA, 15 bp, Homo sapiens
tttggcaccaatacc

SEQ ID NO: 188900 - DNA, 15 bp, Homo sapiens
ctttggcaccaatac

SEQ ID NO: 188901 - DNA, 15 bp, Homo sapiens
actttggcaccaata

SEQ ID NO: 188902 - DNA, 15 bp, Homo sapiens
gactttggcaccaat

SEQ ID NO: 188903 - DNA, 15 bp, Homo sapiens
agactttggcaccaa

SEQ ID NO: 188904 - DNA, 15 bp, Homo sapiens
cagactttggcacca

SEQ ID NO: 188905 - DNA, 15 bp, Homo sapiens
tcagactttggcacc

SEQ ID NO: 188906 - DNA, 15 bp, Homo sapiens
gtcagactttggcac

SEQ ID NO: 188907 - DNA, 15 bp, Homo sapiens
agtcagactttggca

SEQ ID NO: 188908 - DNA, 15 bp, Homo sapiens
aagtcagactttggc

SEQ ID NO: 188909 - DNA, 15 bp, Homo sapiens
gaagtcagactttgg

SEQ ID NO: 188910 - DNA, 15 bp, Homo sapiens
cgaagtcagactttg

SEQ ID NO: 188911 - DNA, 15 bp, Homo sapiens
acgaagtcagacttt

SEQ ID NO: 188912 - DNA, 15 bp, Homo sapiens
tacgaagtcagactt

SEQ ID NO: 188913 - DNA, 15 bp, Homo sapiens
ctacgaagtcagact

SEQ ID NO: 188914 - DNA, 15 bp, Homo sapiens
cctacgaagtcagac

SEQ ID NO: 188915 - DNA, 15 bp, Homo sapiens
gcctacgaagtcaga

SEQ ID NO: 188916 - DNA, 15 bp, Homo sapiens
tgcctacgaagtcag

SEQ ID NO: 188917 - DNA, 15 bp, Homo sapiens
atgcctacgaagtca

SEQ ID NO: 188918 - DNA, 15 bp, Homo sapiens
catgcctacgaagtc

SEQ ID NO: 188919 - DNA, 15 bp, Homo sapiens
ccatgcctacgaagt

SEQ ID NO: 188920 - DNA, 15 bp, Homo sapiens
cccatgcctacgaag

SEQ ID NO: 188921 - DNA, 15 bp, Homo sapiens
acccatgcctacgaa

SEQ ID NO: 188922 - DNA, 15 bp, Homo sapiens
aacccatgcctacga

SEQ ID NO: 188923 - DNA, 15 bp, Homo sapiens
gaacccatgcctacg

SEQ ID NO: 188924 - DNA, 15 bp, Homo sapiens
agaacccatgcctac

SEQ ID NO: 188925 - DNA, 15 bp, Homo sapiens
cagaacccatgccta

SEQ ID NO: 188926 - DNA, 15 bp, Homo sapiens
acagaacccatgcct

SEQ ID NO: 188927 - DNA, 15 bp, Homo sapiens
aacagaacccatgcc

SEQ ID NO: 188928 - DNA, 15 bp, Homo sapiens
gaacagaacccatgc

SEQ ID NO: 188929 - DNA, 15 bp, Homo sapiens
agaacagaacccatg

SEQ ID NO: 188930 - DNA, 15 bp, Homo sapiens
gagaacagaacccat

SEQ ID NO: 188931 - DNA, 15 bp, Homo sapiens
ggagaacagaaccca

SEQ ID NO: 188932 - DNA, 15 bp, Homo sapiens
tggagaacagaaccc

SEQ ID NO: 188933 - DNA, 15 bp, Homo sapiens
atggagaacagaacc

SEQ ID NO: 188934 - DNA, 15 bp, Homo sapiens
tatggagaacagaac

SEQ ID NO: 188935 - DNA, 15 bp, Homo sapiens
gtatggagaacagaa

SEQ ID NO: 188936 - DNA, 15 bp, Homo sapiens
ggtatggagaacaga

SEQ ID NO: 188937 - DNA, 15 bp, Homo sapiens
gggtatggagaacag

SEQ ID NO: 188938 - DNA, 15 bp, Homo sapiens
ggggtatggagaaca

SEQ ID NO: 188939 - DNA, 15 bp, Homo sapiens
aggggtatggagaac

SEQ ID NO: 188940 - DNA, 15 bp, Homo sapiens
gaggggtatggagaa

SEQ ID NO: 188941 - DNA, 15 bp, Homo sapiens
tgaggggtatggaga

SEQ ID NO: 188942 - DNA, 15 bp, Homo sapiens
ctgaggggtatggag

SEQ ID NO: 188943 - DNA, 15 bp, Homo sapiens
cctgaggggtatgga

SEQ ID NO: 188944 - DNA, 15 bp, Homo sapiens
acctgaggggtatgg

SEQ ID NO: 188945 - DNA, 15 bp, Homo sapiens
aacctgaggggtatg

SEQ ID NO: 188946 - DNA, 15 bp, Homo sapiens
aaacctgaggggtat

SEQ ID NO: 188947 - DNA, 15 bp, Homo sapiens
taaacctgaggggta

SEQ ID NO: 188948 - DNA, 15 bp, Homo sapiens
ataaacctgaggggt

SEQ ID NO: 188949 - DNA, 15 bp, Homo sapiens
gataaacctgagggg

SEQ ID NO: 188950 - DNA, 15 bp, Homo sapiens
agataaacctgaggg

SEQ ID NO: 188951 - DNA, 15 bp, Homo sapiens
cagataaacctgagg

SEQ ID NO: 188952 - DNA, 15 bp, Homo sapiens
acagataaacctgag

SEQ ID NO: 188953 - DNA, 15 bp, Homo sapiens
gacagataaacctga

SEQ ID NO: 188954 - DNA, 15 bp, Homo sapiens
ggacagataaacctg

SEQ ID NO: 188955 - DNA, 15 bp, Homo sapiens
tggacagataaacct

SEQ ID NO: 188956 - DNA, 15 bp, Homo sapiens
ctggacagataaacc

SEQ ID NO: 188957 - DNA, 15 bp, Homo sapiens
gctggacagataaac

SEQ ID NO: 188958 - DNA, 15 bp, Homo sapiens
ggctggacagataaa

SEQ ID NO: 188959 - DNA, 15 bp, Homo sapiens
tggctggacagataa

SEQ ID NO: 188960 - DNA, 15 bp, Homo sapiens
gtggctggacagata

SEQ ID NO: 188961 - DNA, 15 bp, Homo sapiens
agtggctggacagat

SEQ ID NO: 188962 - DNA, 15 bp, Homo sapiens
cagtggctggacaga

SEQ ID NO: 188963 - DNA, 15 bp, Homo sapiens
gcagtggctggacag

SEQ ID NO: 188964 - DNA, 15 bp, Homo sapiens
ggcagtggctggaca

SEQ ID NO: 188965 - DNA, 15 bp, Homo sapiens
aggcagtggctggac

SEQ ID NO: 188966 - DNA, 15 bp, Homo sapiens
caggcagtggctgga

SEQ ID NO: 188967 - DNA, 15 bp, Homo sapiens
gcaggcagtggctgg

SEQ ID NO: 188968 - DNA, 15 bp, Homo sapiens
ggcaggcagtggctg

SEQ ID NO: 188969 - DNA, 15 bp, Homo sapiens
cggcaggcagtggct

SEQ ID NO: 188970 - DNA, 15 bp, Homo sapiens
acggcaggcagtggc

SEQ ID NO: 188971 - DNA, 15 bp, Homo sapiens
cacggcaggcagtgg

SEQ ID NO: 188972 - DNA, 15 bp, Homo sapiens
gcacggcaggcagtg

SEQ ID NO: 188973 - DNA, 15 bp, Homo sapiens
tgcacggcaggcagt

SEQ ID NO: 188974 - DNA, 15 bp, Homo sapiens
gtgcacggcaggcag

SEQ ID NO: 188975 - DNA, 15 bp, Homo sapiens
agtgcacggcaggca

SEQ ID NO: 188976 - DNA, 15 bp, Homo sapiens
cagtgcacggcaggc

SEQ ID NO: 188977 - DNA, 15 bp, Homo sapiens
gcagtgcacggcagg

SEQ ID NO: 188978 - DNA, 15 bp, Homo sapiens
ggcagtgcacggcag

SEQ ID NO: 188979 - DNA, 15 bp, Homo sapiens
gggcagtgcacggca

SEQ ID NO: 188980 - DNA, 15 bp, Homo sapiens
agggcagtgcacggc

SEQ ID NO: 188981 - DNA, 15 bp, Homo sapiens
cagggcagtgcacgg

SEQ ID NO: 188982 - DNA, 15 bp, Homo sapiens
acagggcagtgcacg

SEQ ID NO: 188983 - DNA, 15 bp, Homo sapiens
tacagggcagtgcac

SEQ ID NO: 188984 - DNA, 15 bp, Homo sapiens
gtacagggcagtgca

SEQ ID NO: 188985 - DNA, 15 bp, Homo sapiens
tgtacagggcagtgc

SEQ ID NO: 188986 - DNA, 15 bp, Homo sapiens
ctgtacagggcagtg

SEQ ID NO: 188987 - DNA, 15 bp, Homo sapiens
gctgtacagggcagt

SEQ ID NO: 188988 - DNA, 15 bp, Homo sapiens
ggctgtacagggcag

SEQ ID NO: 188989 - DNA, 15 bp, Homo sapiens
gggctgtacagggca

SEQ ID NO: 188990 - DNA, 15 bp, Homo sapiens
agggctgtacagggc

SEQ ID NO: 188991 - DNA, 15 bp, Homo sapiens
gagggctgtacaggg

SEQ ID NO: 188992 - DNA, 15 bp, Homo sapiens
agagggctgtacagg

SEQ ID NO: 188993 - DNA, 15 bp, Homo sapiens
cagagggctgtacag

SEQ ID NO: 188994 - DNA, 15 bp, Homo sapiens
gcagagggctgtaca

SEQ ID NO: 188995 - DNA, 15 bp, Homo sapiens
ggcagagggctgtac

SEQ ID NO: 188996 - DNA, 15 bp, Homo sapiens
aggcagagggctgta

SEQ ID NO: 188997 - DNA, 15 bp, Homo sapiens
caggcagagggctgt

SEQ ID NO: 188998 - DNA, 15 bp, Homo sapiens
ccaggcagagggctg

SEQ ID NO: 188999 - DNA, 15 bp, Homo sapiens
cccaggcagagggct

SEQ ID NO: 189000 - DNA, 15 bp, Homo sapiens
ccccaggcagagggc

SEQ ID NO: 189001 - DNA, 15 bp, Homo sapiens
tccccaggcagaggg

SEQ ID NO: 189002 - DNA, 15 bp, Homo sapiens
gtccccaggcagagg

SEQ ID NO: 189003 - DNA, 15 bp, Homo sapiens
agtccccaggcagag

SEQ ID NO: 189004 - DNA, 15 bp, Homo sapiens
gagtccccaggcaga

SEQ ID NO: 189005 - DNA, 15 bp, Homo sapiens
tgagtccccaggcag

SEQ ID NO: 189006 - DNA, 15 bp, Homo sapiens
ctgagtccccaggca

SEQ ID NO: 189007 - DNA, 15 bp, Homo sapiens
gctgagtccccaggc

SEQ ID NO: 189008 - DNA, 15 bp, Homo sapiens
agctgagtccccagg

SEQ ID NO: 189009 - DNA, 15 bp, Homo sapiens
cagctgagtccccag

SEQ ID NO: 189010 - DNA, 15 bp, Homo sapiens
acagctgagtcccca

SEQ ID NO: 189011 - DNA, 15 bp, Homo sapiens
cacagctgagtcccc

SEQ ID NO: 189012 - DNA, 15 bp, Homo sapiens
ccacagctgagtccc

SEQ ID NO: 189013 - DNA, 15 bp, Homo sapiens
cccacagctgagtcc

SEQ ID NO: 189014 - DNA, 15 bp, Homo sapiens
acccacagctgagtc

SEQ ID NO: 189015 - DNA, 15 bp, Homo sapiens
cacccacagctgagt

SEQ ID NO: 189016 - DNA, 15 bp, Homo sapiens
ccacccacagctgag

SEQ ID NO: 189017 - DNA, 15 bp, Homo sapiens
gccacccacagctga

SEQ ID NO: 189018 - DNA, 15 bp, Homo sapiens
tgccacccacagctg

SEQ ID NO: 189019 - DNA, 15 bp, Homo sapiens
ctgccacccacagct

SEQ ID NO: 189020 - DNA, 15 bp, Homo sapiens
tctgccacccacagc

SEQ ID NO: 189021 - DNA, 15 bp, Homo sapiens
ttctgccacccacag

SEQ ID NO: 189022 - DNA, 15 bp, Homo sapiens
cttctgccacccaca

SEQ ID NO: 189023 - DNA, 15 bp, Homo sapiens
acttctgccacccac

SEQ ID NO: 189024 - DNA, 15 bp, Homo sapiens
gacttctgccaccca

SEQ ID NO: 189025 - DNA, 15 bp, Homo sapiens
cgacttctgccaccc

SEQ ID NO: 189026 - DNA, 15 bp, Homo sapiens
gcgacttctgccacc

SEQ ID NO: 189027 - DNA, 15 bp, Homo sapiens
agcgacttctgccac

SEQ ID NO: 189028 - DNA, 15 bp, Homo sapiens
aagcgacttctgcca

SEQ ID NO: 189029 - DNA, 15 bp, Homo sapiens
gaagcgacttctgcc

SEQ ID NO: 189030 - DNA, 15 bp, Homo sapiens
tgaagcgacttctgc

SEQ ID NO: 189031 - DNA, 15 bp, Homo sapiens
gtgaagcgacttctg

SEQ ID NO: 189032 - DNA, 15 bp, Homo sapiens
tgtgaagcgacttct

SEQ ID NO: 189033 - DNA, 15 bp, Homo sapiens
ctgtgaagcgacttc

SEQ ID NO: 189034 - DNA, 15 bp, Homo sapiens
actgtgaagcgactt

SEQ ID NO: 189035 - DNA, 15 bp, Homo sapiens
cactgtgaagcgact

SEQ ID NO: 189036 - DNA, 15 bp, Homo sapiens
tcactgtgaagcgac

SEQ ID NO: 189037 - DNA, 15 bp, Homo sapiens
gtcactgtgaagcga

SEQ ID NO: 189038 - DNA, 15 bp, Homo sapiens
tgtcactgtgaagcg

SEQ ID NO: 189039 - DNA, 15 bp, Homo sapiens
ctgtcactgtgaagc

SEQ ID NO: 189040 - DNA, 15 bp, Homo sapiens
actgtcactgtgaag

SEQ ID NO: 189041 - DNA, 15 bp, Homo sapiens
cactgtcactgtgaa

SEQ ID NO: 189042 - DNA, 15 bp, Homo sapiens
ccactgtcactgtga

SEQ ID NO: 189043 - DNA, 15 bp, Homo sapiens
gccactgtcactgtg

SEQ ID NO: 189044 - DNA, 15 bp, Homo sapiens
tgccactgtcactgt

SEQ ID NO: 189045 - DNA, 15 bp, Homo sapiens
gtgccactgtcactg

SEQ ID NO: 189046 - DNA, 15 bp, Homo sapiens
tgtgccactgtcact

SEQ ID NO: 189047 - DNA, 15 bp, Homo sapiens
atgtgccactgtcac

SEQ ID NO: 189048 - DNA, 15 bp, Homo sapiens
gatgtgccactgtca

SEQ ID NO: 189049 - DNA, 15 bp, Homo sapiens
agatgtgccactgtc

SEQ ID NO: 189050 - DNA, 15 bp, Homo sapiens
cagatgtgccactgt

SEQ ID NO: 189051 - DNA, 15 bp, Homo sapiens
tcagatgtgccactg

SEQ ID NO: 189052 - DNA, 15 bp, Homo sapiens
gtcagatgtgccact

SEQ ID NO: 189053 - DNA, 15 bp, Homo sapiens
ggtcagatgtgccac

SEQ ID NO: 189054 - DNA, 15 bp, Homo sapiens
aggtcagatgtgcca

SEQ ID NO: 189055 - DNA, 15 bp, Homo sapiens
gaggtcagatgtgcc

SEQ ID NO: 189056 - DNA, 15 bp, Homo sapiens
tgaggtcagatgtgc

SEQ ID NO: 189057 - DNA, 15 bp, Homo sapiens
ctgaggtcagatgtg

SEQ ID NO: 189058 - DNA, 15 bp, Homo sapiens
cctgaggtcagatgt

SEQ ID NO: 189059 - DNA, 15 bp, Homo sapiens
gcctgaggtcagatg

SEQ ID NO: 189060 - DNA, 15 bp, Homo sapiens
agcctgaggtcagat

SEQ ID NO: 189061 - DNA, 15 bp, Homo sapiens
aagcctgaggtcaga

SEQ ID NO: 189062 - DNA, 15 bp, Homo sapiens
aaagcctgaggtcag

SEQ ID NO: 189063 - DNA, 15 bp, Homo sapiens
aaaagcctgaggtca

SEQ ID NO: 189064 - DNA, 15 bp, Homo sapiens
aaaaagcctgaggtc

SEQ ID NO: 189065 - DNA, 15 bp, Homo sapiens
taaaaagcctgaggt

SEQ ID NO: 189066 - DNA, 15 bp, Homo sapiens
ataaaaagcctgagg

SEQ ID NO: 189067 - DNA, 15 bp, Homo sapiens
gataaaaagcctgag

SEQ ID NO: 189068 - DNA, 15 bp, Homo sapiens
agataaaaagcctga

SEQ ID NO: 189069 - DNA, 15 bp, Homo sapiens
cagataaaaagcctg

SEQ ID NO: 189070 - DNA, 15 bp, Homo sapiens
tcagataaaaagcct

SEQ ID NO: 189071 - DNA, 15 bp, Homo sapiens
ctcagataaaaagcc

SEQ ID NO: 189072 - DNA, 15 bp, Homo sapiens
gctcagataaaaagc

SEQ ID NO: 189073 - DNA, 15 bp, Homo sapiens
cgctcagataaaaag

SEQ ID NO: 189074 - DNA, 15 bp, Homo sapiens
acgctcagataaaaa

SEQ ID NO: 189075 - DNA, 15 bp, Homo sapiens
cacgctcagataaaa

SEQ ID NO: 189076 - DNA, 15 bp, Homo sapiens
acacgctcagataaa

SEQ ID NO: 189077 - DNA, 15 bp, Homo sapiens
gacacgctcagataa

SEQ ID NO: 189078 - DNA, 15 bp, Homo sapiens
agacacgctcagata

SEQ ID NO: 189079 - DNA, 15 bp, Homo sapiens
cagacacgctcagat

SEQ ID NO: 189080 - DNA, 15 bp, Homo sapiens
acagacacgctcaga

SEQ ID NO: 189081 - DNA, 15 bp, Homo sapiens
aacagacacgctcag

SEQ ID NO: 189082 - DNA, 15 bp, Homo sapiens
aaacagacacgctca

SEQ ID NO: 189083 - DNA, 15 bp, Homo sapiens
aaaacagacacgctc

SEQ ID NO: 189084 - DNA, 15 bp, Homo sapiens
taaaacagacacgct

SEQ ID NO: 189085 - DNA, 15 bp, Homo sapiens
ttaaaacagacacgc

SEQ ID NO: 189086 - DNA, 15 bp, Homo sapiens
tttaaaacagacacg

SEQ ID NO: 189087 - DNA, 15 bp, Homo sapiens
gtttaaaacagacac

SEQ ID NO: 189088 - DNA, 15 bp, Homo sapiens
tgtttaaaacagaca

SEQ ID NO: 189089 - DNA, 15 bp, Homo sapiens
atgtttaaaacagac

SEQ ID NO: 189090 - DNA, 15 bp, Homo sapiens
catgtttaaaacaga

SEQ ID NO: 189091 - DNA, 15 bp, Homo sapiens
ccatgtttaaaacag

SEQ ID NO: 189092 - DNA, 15 bp, Homo sapiens
tccatgtttaaaaca

SEQ ID NO: 189093 - DNA, 15 bp, Homo sapiens
ctccatgtttaaaac

SEQ ID NO: 189094 - DNA, 15 bp, Homo sapiens
actccatgtttaaaa

SEQ ID NO: 189095 - DNA, 15 bp, Homo sapiens
cactccatgtttaaa

SEQ ID NO: 189096 - DNA, 15 bp, Homo sapiens
gcactccatgtttaa

SEQ ID NO: 189097 - DNA, 15 bp, Homo sapiens
agcactccatgttta

SEQ ID NO: 189098 - DNA, 15 bp, Homo sapiens
aagcactccatgttt

SEQ ID NO: 189099 - DNA, 15 bp, Homo sapiens
caagcactccatgtt

SEQ ID NO: 189100 - DNA, 15 bp, Homo sapiens
gcaagcactccatgt

SEQ ID NO: 189101 - DNA, 15 bp, Homo sapiens
tgcaagcactccatg

SEQ ID NO: 189102 - DNA, 15 bp, Homo sapiens
atgcaagcactccat

SEQ ID NO: 189103 - DNA, 15 bp, Homo sapiens
catgcaagcactcca

SEQ ID NO: 189104 - DNA, 15 bp, Homo sapiens
gcatgcaagcactcc

SEQ ID NO: 189105 - DNA, 15 bp, Homo sapiens
tgcatgcaagcactc

SEQ ID NO: 189106 - DNA, 15 bp, Homo sapiens
gtgcatgcaagcact

SEQ ID NO: 189107 - DNA, 15 bp, Homo sapiens
agtgcatgcaagcac

SEQ ID NO: 189108 - DNA, 15 bp, Homo sapiens
cagtgcatgcaagca

SEQ ID NO: 189109 - DNA, 15 bp, Homo sapiens
acagtgcatgcaagc

SEQ ID NO: 189110 - DNA, 15 bp, Homo sapiens
cacagtgcatgcaag

SEQ ID NO: 189111 - DNA, 15 bp, Homo sapiens
tcacagtgcatgcaa

SEQ ID NO: 189112 - DNA, 15 bp, Homo sapiens
ttcacagtgcatgca

SEQ ID NO: 189113 - DNA, 15 bp, Homo sapiens
cttcacagtgcatgc

SEQ ID NO: 189114 - DNA, 15 bp, Homo sapiens
gcttcacagtgcatg

SEQ ID NO: 189115 - DNA, 15 bp, Homo sapiens
agcttcacagtgcat

SEQ ID NO: 189116 - DNA, 15 bp, Homo sapiens
aagcttcacagtgca

SEQ ID NO: 189117 - DNA, 15 bp, Homo sapiens
aaagcttcacagtgc

SEQ ID NO: 189118 - DNA, 15 bp, Homo sapiens
taaagcttcacagtg

SEQ ID NO: 189119 - DNA, 15 bp, Homo sapiens
ttaaagcttcacagt

SEQ ID NO: 189120 - DNA, 15 bp, Homo sapiens
attaaagcttcacag

SEQ ID NO: 189121 - DNA, 15 bp, Homo sapiens
cattaaagcttcaca

SEQ ID NO: 189122 - DNA, 15 bp, Homo sapiens
gcattaaagcttcac

SEQ ID NO: 189123 - DNA, 15 bp, Homo sapiens
agcattaaagcttca

SEQ ID NO: 189124 - DNA, 15 bp, Homo sapiens
aagcattaaagcttc

SEQ ID NO: 189125 - DNA, 15 bp, Homo sapiens
caagcattaaagctt

SEQ ID NO: 189126 - DNA, 15 bp, Homo sapiens
ccaagcattaaagct

SEQ ID NO: 189127 - DNA, 15 bp, Homo sapiens
tccaagcattaaagc

SEQ ID NO: 189128 - DNA, 15 bp, Homo sapiens
atccaagcattaaag

SEQ ID NO: 189129 - DNA, 15 bp, Homo sapiens
aatccaagcattaaa

SEQ ID NO: 189130 - DNA, 15 bp, Homo sapiens
taatccaagcattaa

SEQ ID NO: 189131 - DNA, 15 bp, Homo sapiens
ataatccaagcatta

SEQ ID NO: 189132 - DNA, 15 bp, Homo sapiens
aataatccaagcatt

SEQ ID NO: 189133 - DNA, 15 bp, Homo sapiens
taataatccaagcat

SEQ ID NO: 189134 - DNA, 15 bp, Homo sapiens
ttaataatccaagca

SEQ ID NO: 189135 - DNA, 15 bp, Homo sapiens
tttaataatccaagc

SEQ ID NO: 189136 - DNA, 15 bp, Homo sapiens
atttaataatccaag

SEQ ID NO: 189137 - DNA, 15 bp, Homo sapiens
catttaataatccaa

SEQ ID NO: 189138 - DNA, 15 bp, Homo sapiens
acatttaataatcca

SEQ ID NO: 189139 - DNA, 15 bp, Homo sapiens
cacatttaataatcc

SEQ ID NO: 189140 - DNA, 15 bp, Homo sapiens
gcacatttaataatc

SEQ ID NO: 189141 - DNA, 15 bp, Homo sapiens
cgcacatttaataat

SEQ ID NO: 189142 - DNA, 15 bp, Homo sapiens
acgcacatttaataa

SEQ ID NO: 189143 - DNA, 15 bp, Homo sapiens
cacgcacatttaata

SEQ ID NO: 189144 - DNA, 15 bp, Homo sapiens
acacgcacatttaat

SEQ ID NO: 189145 - DNA, 15 bp, Homo sapiens
tacacgcacatttaa

SEQ ID NO: 189146 - DNA, 15 bp, Homo sapiens
ctacacgcacattta

SEQ ID NO: 189147 - DNA, 15 bp, Homo sapiens
gctacacgcacattt

SEQ ID NO: 189148 - DNA, 15 bp, Homo sapiens
agctacacgcacatt

SEQ ID NO: 189149 - DNA, 15 bp, Homo sapiens
gagctacacgcacat

SEQ ID NO: 189150 - DNA, 15 bp, Homo sapiens
agagctacacgcaca

SEQ ID NO: 189151 - DNA, 15 bp, Homo sapiens
aagagctacacgcac

SEQ ID NO: 189152 - DNA, 15 bp, Homo sapiens
aaagagctacacgca

SEQ ID NO: 189153 - DNA, 15 bp, Homo sapiens
aaaagagctacacgc

SEQ ID NO: 189154 - DNA, 15 bp, Homo sapiens
aaaaagagctacacg

SEQ ID NO: 189155 - DNA, 15 bp, Homo sapiens
aaaaaagagctacac

SEQ ID NO: 189156 - DNA, 15 bp, Homo sapiens
gaaaaaagagctaca

SEQ ID NO: 189157 - DNA, 15 bp, Homo sapiens
ggaaaaaagagctac

SEQ ID NO: 189158 - DNA, 15 bp, Homo sapiens
tggaaaaaagagcta

SEQ ID NO: 189159 - DNA, 15 bp, Homo sapiens
atggaaaaaagagct

SEQ ID NO: 189160 - DNA, 15 bp, Homo sapiens
tatggaaaaaagagc

SEQ ID NO: 189161 - DNA, 15 bp, Homo sapiens
ctatggaaaaaagag

SEQ ID NO: 189162 - DNA, 15 bp, Homo sapiens
cctatggaaaaaaga

SEQ ID NO: 189163 - DNA, 15 bp, Homo sapiens
tcctatggaaaaaag

SEQ ID NO: 189164 - DNA, 15 bp, Homo sapiens
ttcctatggaaaaaa

SEQ ID NO: 189165 - DNA, 15 bp, Homo sapiens
cttcctatggaaaaa

SEQ ID NO: 189166 - DNA, 15 bp, Homo sapiens
ccttcctatggaaaa

SEQ ID NO: 189167 - DNA, 15 bp, Homo sapiens
gccttcctatggaaa

SEQ ID NO: 189168 - DNA, 15 bp, Homo sapiens
agccttcctatggaa

SEQ ID NO: 189169 - DNA, 15 bp, Homo sapiens
gagccttcctatgga

SEQ ID NO: 189170 - DNA, 15 bp, Homo sapiens
ggagccttcctatgg

SEQ ID NO: 189171 - DNA, 15 bp, Homo sapiens
aggagccttcctatg

SEQ ID NO: 189172 - DNA, 15 bp, Homo sapiens
caggagccttcctat

SEQ ID NO: 189173 - DNA, 15 bp, Homo sapiens
ccaggagccttccta

SEQ ID NO: 189174 - DNA, 15 bp, Homo sapiens
gccaggagccttcct

SEQ ID NO: 189175 - DNA, 15 bp, Homo sapiens
tgccaggagccttcc

SEQ ID NO: 189176 - DNA, 15 bp, Homo sapiens
gtgccaggagccttc

SEQ ID NO: 189177 - DNA, 15 bp, Homo sapiens
tgtgccaggagcctt

SEQ ID NO: 189178 - DNA, 15 bp, Homo sapiens
ttgtgccaggagcct

SEQ ID NO: 189179 - DNA, 15 bp, Homo sapiens
attgtgccaggagcc

SEQ ID NO: 189180 - DNA, 15 bp, Homo sapiens
gattgtgccaggagc

SEQ ID NO: 189181 - DNA, 15 bp, Homo sapiens
agattgtgccaggag

SEQ ID NO: 189182 - DNA, 15 bp, Homo sapiens
tagattgtgccagga

SEQ ID NO: 189183 - DNA, 15 bp, Homo sapiens
ctagattgtgccagg

SEQ ID NO: 189184 - DNA, 15 bp, Homo sapiens
tctagattgtgccag

SEQ ID NO: 189185 - DNA, 15 bp, Homo sapiens
atctagattgtgcca

SEQ ID NO: 189186 - DNA, 15 bp, Homo sapiens
catctagattgtgcc

SEQ ID NO: 189187 - DNA, 15 bp, Homo sapiens
ccatctagattgtgc

SEQ ID NO: 189188 - DNA, 15 bp, Homo sapiens
tccatctagattgtg

SEQ ID NO: 189189 - DNA, 15 bp, Homo sapiens
ctccatctagattgt

SEQ ID NO: 189190 - DNA, 15 bp, Homo sapiens
actccatctagattg

SEQ ID NO: 189191 - DNA, 15 bp, Homo sapiens
gactccatctagatt

SEQ ID NO: 189192 - DNA, 15 bp, Homo sapiens
agactccatctagat

SEQ ID NO: 189193 - DNA, 15 bp, Homo sapiens
tagactccatctaga

SEQ ID NO: 189194 - DNA, 15 bp, Homo sapiens
ctagactccatctag

SEQ ID NO: 189195 - DNA, 15 bp, Homo sapiens
gctagactccatcta

SEQ ID NO: 189196 - DNA, 15 bp, Homo sapiens
ggctagactccatct

SEQ ID NO: 189197 - DNA, 15 bp, Homo sapiens
aggctagactccatc

SEQ ID NO: 189198 - DNA, 15 bp, Homo sapiens
caggctagactccat

SEQ ID NO: 189199 - DNA, 15 bp, Homo sapiens
gcaggctagactcca

SEQ ID NO: 189200 - DNA, 15 bp, Homo sapiens
ggcaggctagactcc

SEQ ID NO: 189201 - DNA, 15 bp, Homo sapiens
tggcaggctagactc

SEQ ID NO: 189202 - DNA, 15 bp, Homo sapiens
ttggcaggctagact

SEQ ID NO: 189203 - DNA, 15 bp, Homo sapiens
tttggcaggctagac

SEQ ID NO: 189204 - DNA, 15 bp, Homo sapiens
atttggcaggctaga

SEQ ID NO: 189205 - DNA, 15 bp, Homo sapiens
tatttggcaggctag

SEQ ID NO: 189206 - DNA, 15 bp, Homo sapiens
gtatttggcaggcta

SEQ ID NO: 189207 - DNA, 15 bp, Homo sapiens
agtatttggcaggct

SEQ ID NO: 189208 - DNA, 15 bp, Homo sapiens
tagtatttggcaggc

SEQ ID NO: 189209 - DNA, 15 bp, Homo sapiens
gtagtatttggcagg

SEQ ID NO: 189210 - DNA, 15 bp, Homo sapiens
ggtagtatttggcag

SEQ ID NO: 189211 - DNA, 15 bp, Homo sapiens
aggtagtatttggca

SEQ ID NO: 189212 - DNA, 15 bp, Homo sapiens
aaggtagtatttggc

SEQ ID NO: 189213 - DNA, 15 bp, Homo sapiens
taaggtagtatttgg

SEQ ID NO: 189214 - DNA, 15 bp, Homo sapiens
gtaaggtagtatttg

SEQ ID NO: 189215 - DNA, 15 bp, Homo sapiens
tgtaaggtagtattt

SEQ ID NO: 189216 - DNA, 15 bp, Homo sapiens
atgtaaggtagtatt

SEQ ID NO: 189217 - DNA, 15 bp, Homo sapiens
aatgtaaggtagtat

SEQ ID NO: 189218 - DNA, 15 bp, Homo sapiens
aaatgtaaggtagta

SEQ ID NO: 189219 - DNA, 15 bp, Homo sapiens
taaatgtaaggtagt

SEQ ID NO: 189220 - DNA, 15 bp, Homo sapiens
ataaatgtaaggtag

SEQ ID NO: 189221 - DNA, 15 bp, Homo sapiens
tataaatgtaaggta

SEQ ID NO: 189222 - DNA, 15 bp, Homo sapiens
ctataaatgtaaggt

SEQ ID NO: 189223 - DNA, 15 bp, Homo sapiens
actataaatgtaagg

SEQ ID NO: 189224 - DNA, 15 bp, Homo sapiens
aactataaatgtaag

SEQ ID NO: 189225 - DNA, 15 bp, Homo sapiens
taactataaatgtaa

SEQ ID NO: 189226 - DNA, 15 bp, Homo sapiens
ttaactataaatgta

SEQ ID NO: 189227 - DNA, 15 bp, Homo sapiens
tttaactataaatgt

SEQ ID NO: 189228 - DNA, 15 bp, Homo sapiens
ttttaactataaatg

SEQ ID NO: 189229 - DNA, 15 bp, Homo sapiens
gttttaactataaat

SEQ ID NO: 189230 - DNA, 15 bp, Homo sapiens
tgttttaactataaa

SEQ ID NO: 189231 - DNA, 15 bp, Homo sapiens
ctgttttaactataa

SEQ ID NO: 189232 - DNA, 15 bp, Homo sapiens
tctgttttaactata

SEQ ID NO: 189233 - DNA, 15 bp, Homo sapiens
ttctgttttaactat

SEQ ID NO: 189234 - DNA, 15 bp, Homo sapiens
tttctgttttaacta

SEQ ID NO: 189235 - DNA, 15 bp, Homo sapiens
ttttctgttttaact

SEQ ID NO: 189236 - DNA, 15 bp, Homo sapiens
gttttctgttttaac

SEQ ID NO: 189237 - DNA, 15 bp, Homo sapiens
ggttttctgttttaa

SEQ ID NO: 189238 - DNA, 15 bp, Homo sapiens
aggttttctgtttta

SEQ ID NO: 189239 - DNA, 15 bp, Homo sapiens
gaggttttctgtttt

SEQ ID NO: 189240 - DNA, 15 bp, Homo sapiens
ggaggttttctgttt

SEQ ID NO: 189241 - DNA, 15 bp, Homo sapiens
tggaggttttctgtt

SEQ ID NO: 189242 - DNA, 15 bp, Homo sapiens
gtggaggttttctgt

SEQ ID NO: 189243 - DNA, 15 bp, Homo sapiens
tgtggaggttttctg

SEQ ID NO: 189244 - DNA, 15 bp, Homo sapiens
atgtggaggttttct

SEQ ID NO: 189245 - DNA, 15 bp, Homo sapiens
catgtggaggttttc

SEQ ID NO: 189246 - DNA, 15 bp, Homo sapiens
gcatgtggaggtttt

SEQ ID NO: 189247 - DNA, 15 bp, Homo sapiens
cgcatgtggaggttt

SEQ ID NO: 189248 - DNA, 15 bp, Homo sapiens
acgcatgtggaggtt

SEQ ID NO: 189249 - DNA, 15 bp, Homo sapiens
cacgcatgtggaggt

SEQ ID NO: 189250 - DNA, 15 bp, Homo sapiens
acacgcatgtggagg

SEQ ID NO: 189251 - DNA, 15 bp, Homo sapiens
tacacgcatgtggag

SEQ ID NO: 189252 - DNA, 15 bp, Homo sapiens
atacacgcatgtgga

SEQ ID NO: 189253 - DNA, 15 bp, Homo sapiens
catacacgcatgtgg

SEQ ID NO: 189254 - DNA, 15 bp, Homo sapiens
gcatacacgcatgtg

SEQ ID NO: 189255 - DNA, 15 bp, Homo sapiens
cgcatacacgcatgt

SEQ ID NO: 189256 - DNA, 15 bp, Homo sapiens
gcgcatacacgcatg

SEQ ID NO: 189257 - DNA, 15 bp, Homo sapiens
agcgcatacacgcat

SEQ ID NO: 189258 - DNA, 15 bp, Homo sapiens
gagcgcatacacgca

SEQ ID NO: 189259 - DNA, 15 bp, Homo sapiens
ggagcgcatacacgc

SEQ ID NO: 189260 - DNA, 15 bp, Homo sapiens
aggagcgcatacacg

SEQ ID NO: 189261 - DNA, 15 bp, Homo sapiens
caggagcgcatacac

SEQ ID NO: 189262 - DNA, 15 bp, Homo sapiens
gcaggagcgcataca

SEQ ID NO: 189263 - DNA, 15 bp, Homo sapiens
ggcaggagcgcatac

SEQ ID NO: 189264 - DNA, 15 bp, Homo sapiens
gggcaggagcgcata

SEQ ID NO: 189265 - DNA, 15 bp, Homo sapiens
agggcaggagcgcat

SEQ ID NO: 189266 - DNA, 15 bp, Homo sapiens
gagggcaggagcgca

SEQ ID NO: 189267 - DNA, 15 bp, Homo sapiens
agagggcaggagcgc

SEQ ID NO: 189268 - DNA, 15 bp, Homo sapiens
aagagggcaggagcg

SEQ ID NO: 189269 - DNA, 15 bp, Homo sapiens
aaagagggcaggagc

SEQ ID NO: 189270 - DNA, 15 bp, Homo sapiens
taaagagggcaggag

SEQ ID NO: 189271 - DNA, 15 bp, Homo sapiens
ctaaagagggcagga

SEQ ID NO: 189272 - DNA, 15 bp, Homo sapiens
gctaaagagggcagg

SEQ ID NO: 189273 - DNA, 15 bp, Homo sapiens
ggctaaagagggcag

SEQ ID NO: 189274 - DNA, 15 bp, Homo sapiens
aggctaaagagggca

SEQ ID NO: 189275 - DNA, 15 bp, Homo sapiens
aaggctaaagagggc

SEQ ID NO: 189276 - DNA, 15 bp, Homo sapiens
aaaggctaaagaggg

SEQ ID NO: 189277 - DNA, 15 bp, Homo sapiens
caaaggctaaagagg

SEQ ID NO: 189278 - DNA, 15 bp, Homo sapiens
ccaaaggctaaagag

SEQ ID NO: 189279 - DNA, 15 bp, Homo sapiens
tccaaaggctaaaga

SEQ ID NO: 189280 - DNA, 15 bp, Homo sapiens
atccaaaggctaaag

SEQ ID NO: 189281 - DNA, 15 bp, Homo sapiens
catccaaaggctaaa

SEQ ID NO: 189282 - DNA, 15 bp, Homo sapiens
gcatccaaaggctaa

SEQ ID NO: 189283 - DNA, 15 bp, Homo sapiens
ggcatccaaaggcta

SEQ ID NO: 189284 - DNA, 15 bp, Homo sapiens
tggcatccaaaggct

SEQ ID NO: 189285 - DNA, 15 bp, Homo sapiens
ttggcatccaaaggc

SEQ ID NO: 189286 - DNA, 15 bp, Homo sapiens
tttggcatccaaagg

SEQ ID NO: 189287 - DNA, 15 bp, Homo sapiens
gtttggcatccaaag

SEQ ID NO: 189288 - DNA, 15 bp, Homo sapiens
tgtttggcatccaaa

SEQ ID NO: 189289 - DNA, 15 bp, Homo sapiens
gtgtttggcatccaa

SEQ ID NO: 189290 - DNA, 15 bp, Homo sapiens
ggtgtttggcatcca

SEQ ID NO: 189291 - DNA, 15 bp, Homo sapiens
tggtgtttggcatcc

SEQ ID NO: 189292 - DNA, 15 bp, Homo sapiens
ttggtgtttggcatc

SEQ ID NO: 189293 - DNA, 15 bp, Homo sapiens
attggtgtttggcat

SEQ ID NO: 189294 - DNA, 15 bp, Homo sapiens
gattggtgtttggca

SEQ ID NO: 189295 - DNA, 15 bp, Homo sapiens
agattggtgtttggc

SEQ ID NO: 189296 - DNA, 15 bp, Homo sapiens
aagattggtgtttgg

SEQ ID NO: 189297 - DNA, 15 bp, Homo sapiens
gaagattggtgtttg

SEQ ID NO: 189298 - DNA, 15 bp, Homo sapiens
agaagattggtgttt

SEQ ID NO: 189299 - DNA, 15 bp, Homo sapiens
aagaagattggtgtt

SEQ ID NO: 189300 - DNA, 15 bp, Homo sapiens
gaagaagattggtgt

SEQ ID NO: 189301 - DNA, 15 bp, Homo sapiens
ggaagaagattggtg

SEQ ID NO: 189302 - DNA, 15 bp, Homo sapiens
tggaagaagattggt

SEQ ID NO: 189303 - DNA, 15 bp, Homo sapiens
ttggaagaagattgg

SEQ ID NO: 189304 - DNA, 15 bp, Homo sapiens
attggaagaagattg

SEQ ID NO: 189305 - DNA, 15 bp, Homo sapiens
aattggaagaagatt

SEQ ID NO: 189306 - DNA, 15 bp, Homo sapiens
aaattggaagaagat

SEQ ID NO: 189307 - DNA, 15 bp, Homo sapiens
gaaattggaagaaga

SEQ ID NO: 189308 - DNA, 15 bp, Homo sapiens
ggaaattggaagaag

SEQ ID NO: 189309 - DNA, 15 bp, Homo sapiens
tggaaattggaagaa

SEQ ID NO: 189310 - DNA, 15 bp, Homo sapiens
ctggaaattggaaga

SEQ ID NO: 189311 - DNA, 15 bp, Homo sapiens
actggaaattggaag

SEQ ID NO: 189312 - DNA, 15 bp, Homo sapiens
gactggaaattggaa

SEQ ID NO: 189313 - DNA, 15 bp, Homo sapiens
agactggaaattgga

SEQ ID NO: 189314 - DNA, 15 bp, Homo sapiens
aagactggaaattgg

SEQ ID NO: 189315 - DNA, 15 bp, Homo sapiens
aaagactggaaattg

SEQ ID NO: 189316 - DNA, 15 bp, Homo sapiens
taaagactggaaatt

SEQ ID NO: 189317 - DNA, 15 bp, Homo sapiens
ttaaagactggaaat

SEQ ID NO: 189318 - DNA, 15 bp, Homo sapiens
tttaaagactggaaa

SEQ ID NO: 189319 - DNA, 15 bp, Homo sapiens
ctttaaagactggaa

SEQ ID NO: 189320 - DNA, 15 bp, Homo sapiens
tctttaaagactgga

SEQ ID NO: 189321 - DNA, 15 bp, Homo sapiens
ttctttaaagactgg

SEQ ID NO: 189322 - DNA, 15 bp, Homo sapiens
tttctttaaagactg

SEQ ID NO: 189323 - DNA, 15 bp, Homo sapiens
ttttctttaaagact

SEQ ID NO: 189324 - DNA, 15 bp, Homo sapiens
tttttctttaaagac

SEQ ID NO: 189325 - DNA, 15 bp, Homo sapiens
ctttttctttaaaga

SEQ ID NO: 189326 - DNA, 15 bp, Homo sapiens
tctttttctttaaag

SEQ ID NO: 189327 - DNA, 15 bp, Homo sapiens
ttctttttctttaaa

SEQ ID NO: 189328 - DNA, 15 bp, Homo sapiens
tttctttttctttaa

SEQ ID NO: 189329 - DNA, 15 bp, Homo sapiens
ctttctttttcttta

SEQ ID NO: 189330 - DNA, 15 bp, Homo sapiens
cctttctttttcttt

SEQ ID NO: 189331 - DNA, 15 bp, Homo sapiens
gcctttctttttctt

SEQ ID NO: 189332 - DNA, 15 bp, Homo sapiens
tgcctttctttttct

SEQ ID NO: 189333 - DNA, 15 bp, Homo sapiens
ctgcctttctttttc

SEQ ID NO: 189334 - DNA, 15 bp, Homo sapiens
tctgcctttcttttt

SEQ ID NO: 189335 - DNA, 15 bp, Homo sapiens
ttctgcctttctttt

SEQ ID NO: 189336 - DNA, 15 bp, Homo sapiens
tttctgcctttcttt

SEQ ID NO: 189337 - DNA, 15 bp, Homo sapiens
ctttctgcctttctt

SEQ ID NO: 189338 - DNA, 15 bp, Homo sapiens
cctttctgcctttct

SEQ ID NO: 189339 - DNA, 15 bp, Homo sapiens
ccctttctgcctttc

SEQ ID NO: 189340 - DNA, 15 bp, Homo sapiens
cccctttctgccttt

SEQ ID NO: 189341 - DNA, 15 bp, Homo sapiens
acccctttctgcctt

SEQ ID NO: 189342 - DNA, 15 bp, Homo sapiens
cacccctttctgcct

SEQ ID NO: 189343 - DNA, 15 bp, Homo sapiens
tcacccctttctgcc

SEQ ID NO: 189344 - DNA, 15 bp, Homo sapiens
ttcacccctttctgc

SEQ ID NO: 189345 - DNA, 15 bp, Homo sapiens
cttcacccctttctg

SEQ ID NO: 189346 - DNA, 15 bp, Homo sapiens
acttcacccctttct

SEQ ID NO: 189347 - DNA, 15 bp, Homo sapiens
gacttcacccctttc

SEQ ID NO: 189348 - DNA, 15 bp, Homo sapiens
ggacttcaccccttt

SEQ ID NO: 189349 - DNA, 15 bp, Homo sapiens
aggacttcacccctt

SEQ ID NO: 189350 - DNA, 15 bp, Homo sapiens
gaggacttcacccct

SEQ ID NO: 189351 - DNA, 15 bp, Homo sapiens
ggaggacttcacccc

SEQ ID NO: 189352 - DNA, 15 bp, Homo sapiens
gggaggacttcaccc

SEQ ID NO: 189353 - DNA, 15 bp, Homo sapiens
agggaggacttcacc

SEQ ID NO: 189354 - DNA, 15 bp, Homo sapiens
gagggaggacttcac

SEQ ID NO: 189355 - DNA, 15 bp, Homo sapiens
tgagggaggacttca

SEQ ID NO: 189356 - DNA, 15 bp, Homo sapiens
gtgagggaggacttc

SEQ ID NO: 189357 - DNA, 15 bp, Homo sapiens
agtgagggaggactt

SEQ ID NO: 189358 - DNA, 15 bp, Homo sapiens
aagtgagggaggact

SEQ ID NO: 189359 - DNA, 15 bp, Homo sapiens
caagtgagggaggac

SEQ ID NO: 189360 - DNA, 15 bp, Homo sapiens
ccaagtgagggagga

SEQ ID NO: 189361 - DNA, 15 bp, Homo sapiens
accaagtgagggagg

SEQ ID NO: 189362 - DNA, 15 bp, Homo sapiens
taccaagtgagggag

SEQ ID NO: 189363 - DNA, 15 bp, Homo sapiens
ataccaagtgaggga

SEQ ID NO: 189364 - DNA, 15 bp, Homo sapiens
cataccaagtgaggg

SEQ ID NO: 189365 - DNA, 15 bp, Homo sapiens
acataccaagtgagg

SEQ ID NO: 189366 - DNA, 15 bp, Homo sapiens
tacataccaagtgag

SEQ ID NO: 189367 - DNA, 15 bp, Homo sapiens
ttacataccaagtga

SEQ ID NO: 189368 - DNA, 15 bp, Homo sapiens
cttacataccaagtg

SEQ ID NO: 189369 - DNA, 15 bp, Homo sapiens
acttacataccaagt

SEQ ID NO: 189370 - DNA, 15 bp, Homo sapiens
gacttacataccaag

SEQ ID NO: 189371 - DNA, 15 bp, Homo sapiens
tgacttacataccaa

SEQ ID NO: 189372 - DNA, 15 bp, Homo sapiens
ttgacttacatacca

SEQ ID NO: 189373 - DNA, 15 bp, Homo sapiens
attgacttacatacc

SEQ ID NO: 189374 - DNA, 15 bp, Homo sapiens
aattgacttacatac

SEQ ID NO: 189375 - DNA, 15 bp, Homo sapiens
taattgacttacata

SEQ ID NO: 189376 - DNA, 15 bp, Homo sapiens
ataattgacttacat

SEQ ID NO: 189377 - DNA, 15 bp, Homo sapiens
aataattgacttaca

SEQ ID NO: 189378 - DNA, 15 bp, Homo sapiens
taataattgacttac

SEQ ID NO: 189379 - DNA, 15 bp, Homo sapiens
ttaataattgactta

SEQ ID NO: 189380 - DNA, 15 bp, Homo sapiens
attaataattgactt

SEQ ID NO: 189381 - DNA, 15 bp, Homo sapiens
tattaataattgact

SEQ ID NO: 189382 - DNA, 15 bp, Homo sapiens
atattaataattgac

SEQ ID NO: 189383 - DNA, 15 bp, Homo sapiens
aatattaataattga

SEQ ID NO: 189384 - DNA, 15 bp, Homo sapiens
aaatattaataattg

SEQ ID NO: 189385 - DNA, 15 bp, Homo sapiens
taaatattaataatt

SEQ ID NO: 189386 - DNA, 15 bp, Homo sapiens
ttaaatattaataat

SEQ ID NO: 189387 - DNA, 15 bp, Homo sapiens
tttaaatattaataa

SEQ ID NO: 189388 - DNA, 15 bp, Homo sapiens
ttttaaatattaata

SEQ ID NO: 189389 - DNA, 15 bp, Homo sapiens
tttttaaatattaat

SEQ ID NO: 189390 - DNA, 15 bp, Homo sapiens
ctttttaaatattaa

SEQ ID NO: 189391 - DNA, 15 bp, Homo sapiens
gctttttaaatatta

SEQ ID NO: 189392 - DNA, 15 bp, Homo sapiens
agctttttaaatatt

SEQ ID NO: 189393 - DNA, 15 bp, Homo sapiens
cagctttttaaatat

SEQ ID NO: 189394 - DNA, 15 bp, Homo sapiens
acagctttttaaata

SEQ ID NO: 189395 - DNA, 15 bp, Homo sapiens
cacagctttttaaat

SEQ ID NO: 189396 - DNA, 15 bp, Homo sapiens
gcacagctttttaaa

SEQ ID NO: 189397 - DNA, 15 bp, Homo sapiens
agcacagctttttaa

SEQ ID NO: 189398 - DNA, 15 bp, Homo sapiens
gagcacagcttttta

SEQ ID NO: 189399 - DNA, 15 bp, Homo sapiens
tgagcacagcttttt

SEQ ID NO: 189400 - DNA, 15 bp, Homo sapiens
ctgagcacagctttt

SEQ ID NO: 189401 - DNA, 15 bp, Homo sapiens
actgagcacagcttt

SEQ ID NO: 189402 - DNA, 15 bp, Homo sapiens
cactgagcacagctt

SEQ ID NO: 189403 - DNA, 15 bp, Homo sapiens
ccactgagcacagct

SEQ ID NO: 189404 - DNA, 15 bp, Homo sapiens
gccactgagcacagc

SEQ ID NO: 189405 - DNA, 15 bp, Homo sapiens
agccactgagcacag

SEQ ID NO: 189406 - DNA, 15 bp, Homo sapiens
aagccactgagcaca

SEQ ID NO: 189407 - DNA, 15 bp, Homo sapiens
aaagccactgagcac

SEQ ID NO: 189408 - DNA, 15 bp, Homo sapiens
gaaagccactgagca

SEQ ID NO: 189409 - DNA, 15 bp, Homo sapiens
tgaaagccactgagc

SEQ ID NO: 189410 - DNA, 15 bp, Homo sapiens
gtgaaagccactgag

SEQ ID NO: 189411 - DNA, 15 bp, Homo sapiens
ggtgaaagccactga

SEQ ID NO: 189412 - DNA, 15 bp, Homo sapiens
cggtgaaagccactg

SEQ ID NO: 189413 - DNA, 15 bp, Homo sapiens
acggtgaaagccact

SEQ ID NO: 189414 - DNA, 15 bp, Homo sapiens
cacggtgaaagccac

SEQ ID NO: 189415 - DNA, 15 bp, Homo sapiens
tcacggtgaaagcca

SEQ ID NO: 189416 - DNA, 15 bp, Homo sapiens
ttcacggtgaaagcc

SEQ ID NO: 189417 - DNA, 15 bp, Homo sapiens
attcacggtgaaagc

SEQ ID NO: 189418 - DNA, 15 bp, Homo sapiens
cattcacggtgaaag

SEQ ID NO: 189419 - DNA, 15 bp, Homo sapiens
gcattcacggtgaaa

SEQ ID NO: 189420 - DNA, 15 bp, Homo sapiens
ggcattcacggtgaa

SEQ ID NO: 189421 - DNA, 15 bp, Homo sapiens
gggcattcacggtga

SEQ ID NO: 189422 - DNA, 15 bp, Homo sapiens
ggggcattcacggtg

SEQ ID NO: 189423 - DNA, 15 bp, Homo sapiens
tggggcattcacggt

SEQ ID NO: 189424 - DNA, 15 bp, Homo sapiens
atggggcattcacgg

SEQ ID NO: 189425 - DNA, 15 bp, Homo sapiens
catggggcattcacg

SEQ ID NO: 189426 - DNA, 15 bp, Homo sapiens
ccatggggcattcac

SEQ ID NO: 189427 - DNA, 15 bp, Homo sapiens
tccatggggcattca

SEQ ID NO: 189428 - DNA, 15 bp, Homo sapiens
atccatggggcattc

SEQ ID NO: 189429 - DNA, 15 bp, Homo sapiens
gatccatggggcatt

SEQ ID NO: 189430 - DNA, 15 bp, Homo sapiens
tgatccatggggcat

SEQ ID NO: 189431 - DNA, 15 bp, Homo sapiens
atgatccatggggca

SEQ ID NO: 189432 - DNA, 15 bp, Homo sapiens
aatgatccatggggc

SEQ ID NO: 189433 - DNA, 15 bp, Homo sapiens
caatgatccatgggg

SEQ ID NO: 189434 - DNA, 15 bp, Homo sapiens
gcaatgatccatggg

SEQ ID NO: 189435 - DNA, 15 bp, Homo sapiens
tgcaatgatccatgg

SEQ ID NO: 189436 - DNA, 15 bp, Homo sapiens
ttgcaatgatccatg

SEQ ID NO: 189437 - DNA, 15 bp, Homo sapiens
cttgcaatgatccat

SEQ ID NO: 189438 - DNA, 15 bp, Homo sapiens
acttgcaatgatcca

SEQ ID NO: 189439 - DNA, 15 bp, Homo sapiens
tacttgcaatgatcc

SEQ ID NO: 189440 - DNA, 15 bp, Homo sapiens
gtacttgcaatgatc

SEQ ID NO: 189441 - DNA, 15 bp, Homo sapiens
tgtacttgcaatgat

SEQ ID NO: 189442 - DNA, 15 bp, Homo sapiens
ttgtacttgcaatga

SEQ ID NO: 189443 - DNA, 15 bp, Homo sapiens
tttgtacttgcaatg

SEQ ID NO: 189444 - DNA, 15 bp, Homo sapiens
atttgtacttgcaat

SEQ ID NO: 189445 - DNA, 15 bp, Homo sapiens
tatttgtacttgcaa

SEQ ID NO: 189446 - DNA, 15 bp, Homo sapiens
gtatttgtacttgca

SEQ ID NO: 189447 - DNA, 15 bp, Homo sapiens
agtatttgtacttgc

SEQ ID NO: 189448 - DNA, 15 bp, Homo sapiens
cagtatttgtacttg

SEQ ID NO: 189449 - DNA, 15 bp, Homo sapiens
acagtatttgtactt

SEQ ID NO: 189450 - DNA, 15 bp, Homo sapiens
tacagtatttgtact

SEQ ID NO: 189451 - DNA, 15 bp, Homo sapiens
ctacagtatttgtac

SEQ ID NO: 189452 - DNA, 15 bp, Homo sapiens
tctacagtatttgta

SEQ ID NO: 189453 - DNA, 15 bp, Homo sapiens
ttctacagtatttgt

SEQ ID NO: 189454 - DNA, 15 bp, Homo sapiens
cttctacagtatttg

SEQ ID NO: 189455 - DNA, 15 bp, Homo sapiens
gcttctacagtattt

SEQ ID NO: 189456 - DNA, 15 bp, Homo sapiens
cgcttctacagtatt

SEQ ID NO: 189457 - DNA, 15 bp, Homo sapiens
ccgcttctacagtat

SEQ ID NO: 189458 - DNA, 15 bp, Homo sapiens
cccgcttctacagta

SEQ ID NO: 189459 - DNA, 15 bp, Homo sapiens
tcccgcttctacagt

SEQ ID NO: 189460 - DNA, 15 bp, Homo sapiens
gtcccgcttctacag

SEQ ID NO: 189461 - DNA, 15 bp, Homo sapiens
agtcccgcttctaca

SEQ ID NO: 189462 - DNA, 15 bp, Homo sapiens
cagtcccgcttctac

SEQ ID NO: 189463 - DNA, 15 bp, Homo sapiens
ccagtcccgcttcta

SEQ ID NO: 189464 - DNA, 15 bp, Homo sapiens
tccagtcccgcttct

SEQ ID NO: 189465 - DNA, 15 bp, Homo sapiens
atccagtcccgcttc

SEQ ID NO: 189466 - DNA, 15 bp, Homo sapiens
aatccagtcccgctt

SEQ ID NO: 189467 - DNA, 15 bp, Homo sapiens
caatccagtcccgct

SEQ ID NO: 189468 - DNA, 15 bp, Homo sapiens
tcaatccagtcccgc

SEQ ID NO: 189469 - DNA, 15 bp, Homo sapiens
ctcaatccagtcccg

SEQ ID NO: 189470 - DNA, 15 bp, Homo sapiens
actcaatccagtccc

SEQ ID NO: 189471 - DNA, 15 bp, Homo sapiens
gactcaatccagtcc

SEQ ID NO: 189472 - DNA, 15 bp, Homo sapiens
tgactcaatccagtc

SEQ ID NO: 189473 - DNA, 15 bp, Homo sapiens
atgactcaatccagt

SEQ ID NO: 189474 - DNA, 15 bp, Homo sapiens
aatgactcaatccag

SEQ ID NO: 189475 - DNA, 15 bp, Homo sapiens
taatgactcaatcca

SEQ ID NO: 189476 - DNA, 15 bp, Homo sapiens
ttaatgactcaatcc

SEQ ID NO: 189477 - DNA, 15 bp, Homo sapiens
tttaatgactcaatc

SEQ ID NO: 189478 - DNA, 15 bp, Homo sapiens
ttttaatgactcaat

SEQ ID NO: 189479 - DNA, 15 bp, Homo sapiens
cttttaatgactcaa

SEQ ID NO: 189480 - DNA, 15 bp, Homo sapiens
tcttttaatgactca

SEQ ID NO: 189481 - DNA, 15 bp, Homo sapiens
ttcttttaatgactc

SEQ ID NO: 189482 - DNA, 15 bp, Homo sapiens
attcttttaatgact

SEQ ID NO: 189483 - DNA, 15 bp, Homo sapiens
tattcttttaatgac

SEQ ID NO: 189484 - DNA, 15 bp, Homo sapiens
ttattcttttaatga

SEQ ID NO: 189485 - DNA, 15 bp, Homo sapiens
attattcttttaatg

SEQ ID NO: 189486 - DNA, 15 bp, Homo sapiens
cattattcttttaat

SEQ ID NO: 189487 - DNA, 15 bp, Homo sapiens
ccattattcttttaa

SEQ ID NO: 189488 - DNA, 15 bp, Homo sapiens
cccattattctttta

SEQ ID NO: 189489 - DNA, 15 bp, Homo sapiens
gcccattattctttt

SEQ ID NO: 189490 - DNA, 15 bp, Homo sapiens
agcccattattcttt

SEQ ID NO: 189491 - DNA, 15 bp, Homo sapiens
aagcccattattctt

SEQ ID NO: 189492 - DNA, 15 bp, Homo sapiens
aaagcccattattct

SEQ ID NO: 189493 - DNA, 15 bp, Homo sapiens
aaaagcccattattc

SEQ ID NO: 189494 - DNA, 15 bp, Homo sapiens
aaaaagcccattatt

SEQ ID NO: 189495 - DNA, 15 bp, Homo sapiens
gaaaaagcccattat

SEQ ID NO: 189496 - DNA, 15 bp, Homo sapiens
agaaaaagcccatta

SEQ ID NO: 189497 - DNA, 15 bp, Homo sapiens
aagaaaaagcccatt

SEQ ID NO: 189498 - DNA, 15 bp, Homo sapiens
taagaaaaagcccat

SEQ ID NO: 189499 - DNA, 15 bp, Homo sapiens
gtaagaaaaagccca

SEQ ID NO: 189500 - DNA, 15 bp, Homo sapiens
tgtaagaaaaagccc

SEQ ID NO: 189501 - DNA, 15 bp, Homo sapiens
ttgtaagaaaaagcc

SEQ ID NO: 189502 - DNA, 15 bp, Homo sapiens
tttgtaagaaaaagc

SEQ ID NO: 189503 - DNA, 15 bp, Homo sapiens
gtttgtaagaaaaag

SEQ ID NO: 189504 - DNA, 15 bp, Homo sapiens
ggtttgtaagaaaaa

SEQ ID NO: 189505 - DNA, 15 bp, Homo sapiens
tggtttgtaagaaaa

SEQ ID NO: 189506 - DNA, 15 bp, Homo sapiens
gtggtttgtaagaaa

SEQ ID NO: 189507 - DNA, 15 bp, Homo sapiens
tgtggtttgtaagaa

SEQ ID NO: 189508 - DNA, 15 bp, Homo sapiens
ttgtggtttgtaaga

SEQ ID NO: 189509 - DNA, 15 bp, Homo sapiens
attgtggtttgtaag

SEQ ID NO: 189510 - DNA, 15 bp, Homo sapiens
aattgtggtttgtaa

SEQ ID NO: 189511 - DNA, 15 bp, Homo sapiens
caattgtggtttgta

SEQ ID NO: 189512 - DNA, 15 bp, Homo sapiens
gcaattgtggtttgt

SEQ ID NO: 189513 - DNA, 15 bp, Homo sapiens
ggcaattgtggtttg

SEQ ID NO: 189514 - DNA, 15 bp, Homo sapiens
tggcaattgtggttt

SEQ ID NO: 189515 - DNA, 15 bp, Homo sapiens
ctggcaattgtggtt

SEQ ID NO: 189516 - DNA, 15 bp, Homo sapiens
tctggcaattgtggt

SEQ ID NO: 189517 - DNA, 15 bp, Homo sapiens
ctctggcaattgtgg

SEQ ID NO: 189518 - DNA, 15 bp, Homo sapiens
cctctggcaattgtg

SEQ ID NO: 189519 - DNA, 15 bp, Homo sapiens
ccctctggcaattgt

SEQ ID NO: 189520 - DNA, 15 bp, Homo sapiens
tccctctggcaattg

SEQ ID NO: 189521 - DNA, 15 bp, Homo sapiens
ttccctctggcaatt

SEQ ID NO: 189522 - DNA, 15 bp, Homo sapiens
tttccctctggcaat

SEQ ID NO: 189523 - DNA, 15 bp, Homo sapiens
ttttccctctggcaa

SEQ ID NO: 189524 - DNA, 15 bp, Homo sapiens
cttttccctctggca

SEQ ID NO: 189525 - DNA, 15 bp, Homo sapiens
tcttttccctctggc

SEQ ID NO: 189526 - DNA, 15 bp, Homo sapiens
atcttttccctctgg

SEQ ID NO: 189527 - DNA, 15 bp, Homo sapiens
catcttttccctctg

SEQ ID NO: 189528 - DNA, 15 bp, Homo sapiens
gcatcttttccctct

SEQ ID NO: 189529 - DNA, 15 bp, Homo sapiens
tgcatcttttccctc

SEQ ID NO: 189530 - DNA, 15 bp, Homo sapiens
ttgcatcttttccct

SEQ ID NO: 189531 - DNA, 15 bp, Homo sapiens
gttgcatcttttccc

SEQ ID NO: 189532 - DNA, 15 bp, Homo sapiens
tgttgcatcttttcc

SEQ ID NO: 189533 - DNA, 15 bp, Homo sapiens
atgttgcatcttttc

SEQ ID NO: 189534 - DNA, 15 bp, Homo sapiens
gatgttgcatctttt

SEQ ID NO: 189535 - DNA, 15 bp, Homo sapiens
tgatgttgcatcttt

SEQ ID NO: 189536 - DNA, 15 bp, Homo sapiens
atgatgttgcatctt

SEQ ID NO: 189537 - DNA, 15 bp, Homo sapiens
catgatgttgcatct

SEQ ID NO: 189538 - DNA, 15 bp, Homo sapiens
gcatgatgttgcatc

SEQ ID NO: 189539 - DNA, 15 bp, Homo sapiens
ggcatgatgttgcat

SEQ ID NO: 189540 - DNA, 15 bp, Homo sapiens
tggcatgatgttgca

SEQ ID NO: 189541 - DNA, 15 bp, Homo sapiens
atggcatgatgttgc

SEQ ID NO: 189542 - DNA, 15 bp, Homo sapiens
gatggcatgatgttg

SEQ ID NO: 189543 - DNA, 15 bp, Homo sapiens
agatggcatgatgtt

SEQ ID NO: 189544 - DNA, 15 bp, Homo sapiens
cagatggcatgatgt

SEQ ID NO: 189545 - DNA, 15 bp, Homo sapiens
tcagatggcatgatg

SEQ ID NO: 189546 - DNA, 15 bp, Homo sapiens
ttcagatggcatgat

SEQ ID NO: 189547 - DNA, 15 bp, Homo sapiens
tttcagatggcatga

SEQ ID NO: 189548 - DNA, 15 bp, Homo sapiens
ttttcagatggcatg

SEQ ID NO: 189549 - DNA, 15 bp, Homo sapiens
cttttcagatggcat

SEQ ID NO: 189550 - DNA, 15 bp, Homo sapiens
acttttcagatggca

SEQ ID NO: 189551 - DNA, 15 bp, Homo sapiens
aacttttcagatggc

SEQ ID NO: 189552 - DNA, 15 bp, Homo sapiens
aaacttttcagatgg

SEQ ID NO: 189553 - DNA, 15 bp, Homo sapiens
caaacttttcagatg

SEQ ID NO: 189554 - DNA, 15 bp, Homo sapiens
ccaaacttttcagat

SEQ ID NO: 189555 - DNA, 15 bp, Homo sapiens
tccaaacttttcaga

SEQ ID NO: 189556 - DNA, 15 bp, Homo sapiens
ttccaaacttttcag

SEQ ID NO: 189557 - DNA, 15 bp, Homo sapiens
cttccaaacttttca

SEQ ID NO: 189558 - DNA, 15 bp, Homo sapiens
gcttccaaacttttc

SEQ ID NO: 189559 - DNA, 15 bp, Homo sapiens
agcttccaaactttt

SEQ ID NO: 189560 - DNA, 15 bp, Homo sapiens
aagcttccaaacttt

SEQ ID NO: 189561 - DNA, 15 bp, Homo sapiens
aaagcttccaaactt

SEQ ID NO: 189562 - DNA, 15 bp, Homo sapiens
aaaagcttccaaact

SEQ ID NO: 189563 - DNA, 15 bp, Homo sapiens
gaaaagcttccaaac

SEQ ID NO: 189564 - DNA, 15 bp, Homo sapiens
ggaaaagcttccaaa

SEQ ID NO: 189565 - DNA, 15 bp, Homo sapiens
tggaaaagcttccaa

SEQ ID NO: 189566 - DNA, 15 bp, Homo sapiens
ttggaaaagcttcca

SEQ ID NO: 189567 - DNA, 15 bp, Homo sapiens
tttggaaaagcttcc

SEQ ID NO: 189568 - DNA, 15 bp, Homo sapiens
ttttggaaaagcttc

SEQ ID NO: 189569 - DNA, 15 bp, Homo sapiens
gttttggaaaagctt

SEQ ID NO: 189570 - DNA, 15 bp, Homo sapiens
tgttttggaaaagct

SEQ ID NO: 189571 - DNA, 15 bp, Homo sapiens
ttgttttggaaaagc

SEQ ID NO: 189572 - DNA, 15 bp, Homo sapiens
attgttttggaaaag

SEQ ID NO: 189573 - DNA, 15 bp, Homo sapiens
aattgttttggaaaa

SEQ ID NO: 189574 - DNA, 15 bp, Homo sapiens
caattgttttggaaa

SEQ ID NO: 189575 - DNA, 15 bp, Homo sapiens
gcaattgttttggaa

SEQ ID NO: 189576 - DNA, 15 bp, Homo sapiens
tgcaattgttttgga

SEQ ID NO: 189577 - DNA, 15 bp, Homo sapiens
ctgcaattgttttgg

SEQ ID NO: 189578 - DNA, 15 bp, Homo sapiens
actgcaattgttttg

SEQ ID NO: 189579 - DNA, 15 bp, Homo sapiens
gactgcaattgtttt

SEQ ID NO: 189580 - DNA, 15 bp, Homo sapiens
tgactgcaattgttt

SEQ ID NO: 189581 - DNA, 15 bp, Homo sapiens
gtgactgcaattgtt

SEQ ID NO: 189582 - DNA, 15 bp, Homo sapiens
agtgactgcaattgt

SEQ ID NO: 189583 - DNA, 15 bp, Homo sapiens
cagtgactgcaattg

SEQ ID NO: 189584 - DNA, 15 bp, Homo sapiens
gcagtgactgcaatt

SEQ ID NO: 189585 - DNA, 15 bp, Homo sapiens
agcagtgactgcaat

SEQ ID NO: 189586 - DNA, 15 bp, Homo sapiens
aagcagtgactgcaa

SEQ ID NO: 189587 - DNA, 15 bp, Homo sapiens
caagcagtgactgca

SEQ ID NO: 189588 - DNA, 15 bp, Homo sapiens
gcaagcagtgactgc

SEQ ID NO: 189589 - DNA, 15 bp, Homo sapiens
ggcaagcagtgactg

SEQ ID NO: 189590 - DNA, 15 bp, Homo sapiens
aggcaagcagtgact

SEQ ID NO: 189591 - DNA, 15 bp, Homo sapiens
aaggcaagcagtgac

SEQ ID NO: 189592 - DNA, 15 bp, Homo sapiens
aaaggcaagcagtga

SEQ ID NO: 189593 - DNA, 15 bp, Homo sapiens
aaaaggcaagcagtg

SEQ ID NO: 189594 - DNA, 15 bp, Homo sapiens
caaaaggcaagcagt

SEQ ID NO: 189595 - DNA, 15 bp, Homo sapiens
tcaaaaggcaagcag

SEQ ID NO: 189596 - DNA, 15 bp, Homo sapiens
atcaaaaggcaagca

SEQ ID NO: 189597 - DNA, 15 bp, Homo sapiens
catcaaaaggcaagc

SEQ ID NO: 189598 - DNA, 15 bp, Homo sapiens
tcatcaaaaggcaag

SEQ ID NO: 189599 - DNA, 15 bp, Homo sapiens
atcatcaaaaggcaa

SEQ ID NO: 189600 - DNA, 15 bp, Homo sapiens
tatcatcaaaaggca

SEQ ID NO: 189601 - DNA, 15 bp, Homo sapiens
ctatcatcaaaaggc

SEQ ID NO: 189602 - DNA, 15 bp, Homo sapiens
cctatcatcaaaagg

SEQ ID NO: 189603 - DNA, 15 bp, Homo sapiens
tcctatcatcaaaag

SEQ ID NO: 189604 - DNA, 15 bp, Homo sapiens
ttcctatcatcaaaa

SEQ ID NO: 189605 - DNA, 15 bp, Homo sapiens
gttcctatcatcaaa

SEQ ID NO: 189606 - DNA, 15 bp, Homo sapiens
cgttcctatcatcaa

SEQ ID NO: 189607 - DNA, 15 bp, Homo sapiens
acgttcctatcatca

SEQ ID NO: 189608 - DNA, 15 bp, Homo sapiens
aacgttcctatcatc

SEQ ID NO: 189609 - DNA, 15 bp, Homo sapiens
taacgttcctatcat

SEQ ID NO: 189610 - DNA, 15 bp, Homo sapiens
ataacgttcctatca

SEQ ID NO: 189611 - DNA, 15 bp, Homo sapiens
cataacgttcctatc

SEQ ID NO: 189612 - DNA, 15 bp, Homo sapiens
ccataacgttcctat

SEQ ID NO: 189613 - DNA, 15 bp, Homo sapiens
accataacgttccta

SEQ ID NO: 189614 - DNA, 15 bp, Homo sapiens
caccataacgttcct

SEQ ID NO: 189615 - DNA, 15 bp, Homo sapiens
ccaccataacgttcc

SEQ ID NO: 189616 - DNA, 15 bp, Homo sapiens
cccaccataacgttc

SEQ ID NO: 189617 - DNA, 15 bp, Homo sapiens
tcccaccataacgtt

SEQ ID NO: 189618 - DNA, 15 bp, Homo sapiens
atcccaccataacgt

SEQ ID NO: 189619 - DNA, 15 bp, Homo sapiens
catcccaccataacg

SEQ ID NO: 189620 - DNA, 15 bp, Homo sapiens
tcatcccaccataac

SEQ ID NO: 189621 - DNA, 15 bp, Homo sapiens
ttcatcccaccataa

SEQ ID NO: 189622 - DNA, 15 bp, Homo sapiens
attcatcccaccata

SEQ ID NO: 189623 - DNA, 15 bp, Homo sapiens
cattcatcccaccat

SEQ ID NO: 189624 - DNA, 15 bp, Homo sapiens
acattcatcccacca

SEQ ID NO: 189625 - DNA, 15 bp, Homo sapiens
cacattcatcccacc

SEQ ID NO: 189626 - DNA, 15 bp, Homo sapiens
ccacattcatcccac

SEQ ID NO: 189627 - DNA, 15 bp, Homo sapiens
tccacattcatccca

SEQ ID NO: 189628 - DNA, 15 bp, Homo sapiens
ctccacattcatccc

SEQ ID NO: 189629 - DNA, 15 bp, Homo sapiens
tctccacattcatcc

SEQ ID NO: 189630 - DNA, 15 bp, Homo sapiens
ctctccacattcatc

SEQ ID NO: 189631 - DNA, 15 bp, Homo sapiens
tctctccacattcat

SEQ ID NO: 189632 - DNA, 15 bp, Homo sapiens
ctctctccacattca

SEQ ID NO: 189633 - DNA, 15 bp, Homo sapiens
tctctctccacattc

SEQ ID NO: 189634 - DNA, 15 bp, Homo sapiens
ttctctctccacatt

SEQ ID NO: 189635 - DNA, 15 bp, Homo sapiens
cttctctctccacat

SEQ ID NO: 189636 - DNA, 15 bp, Homo sapiens
tcttctctctccaca

SEQ ID NO: 189637 - DNA, 15 bp, Homo sapiens
ttcttctctctccac

SEQ ID NO: 189638 - DNA, 15 bp, Homo sapiens
attcttctctctcca

SEQ ID NO: 189639 - DNA, 15 bp, Homo sapiens
aattcttctctctcc

SEQ ID NO: 189640 - DNA, 15 bp, Homo sapiens
aaattcttctctctc

SEQ ID NO: 189641 - DNA, 15 bp, Homo sapiens
taaattcttctctct

SEQ ID NO: 189642 - DNA, 15 bp, Homo sapiens
ctaaattcttctctc

SEQ ID NO: 189643 - DNA, 15 bp, Homo sapiens
gctaaattcttctct

SEQ ID NO: 189644 - DNA, 15 bp, Homo sapiens
agctaaattcttctc

SEQ ID NO: 189645 - DNA, 15 bp, Homo sapiens
gagctaaattcttct

SEQ ID NO: 189646 - DNA, 15 bp, Homo sapiens
agagctaaattcttc

SEQ ID NO: 189647 - DNA, 15 bp, Homo sapiens
aagagctaaattctt

SEQ ID NO: 189648 - DNA, 15 bp, Homo sapiens
aaagagctaaattct

SEQ ID NO: 189649 - DNA, 15 bp, Homo sapiens
caaagagctaaattc

SEQ ID NO: 189650 - DNA, 15 bp, Homo sapiens
gcaaagagctaaatt

SEQ ID NO: 189651 - DNA, 15 bp, Homo sapiens
agcaaagagctaaat

SEQ ID NO: 189652 - DNA, 15 bp, Homo sapiens
gagcaaagagctaaa

SEQ ID NO: 189653 - DNA, 15 bp, Homo sapiens
ggagcaaagagctaa

SEQ ID NO: 189654 - DNA, 15 bp, Homo sapiens
gggagcaaagagcta

SEQ ID NO: 189655 - DNA, 15 bp, Homo sapiens
agggagcaaagagct

SEQ ID NO: 189656 - DNA, 15 bp, Homo sapiens
gagggagcaaagagc

SEQ ID NO: 189657 - DNA, 15 bp, Homo sapiens
ggagggagcaaagag

SEQ ID NO: 189658 - DNA, 15 bp, Homo sapiens
aggagggagcaaaga

SEQ ID NO: 189659 - DNA, 15 bp, Homo sapiens
caggagggagcaaag

SEQ ID NO: 189660 - DNA, 15 bp, Homo sapiens
ccaggagggagcaaa

SEQ ID NO: 189661 - DNA, 15 bp, Homo sapiens
gccaggagggagcaa

SEQ ID NO: 189662 - DNA, 15 bp, Homo sapiens
agccaggagggagca

SEQ ID NO: 189663 - DNA, 15 bp, Homo sapiens
cagccaggagggagc

SEQ ID NO: 189664 - DNA, 15 bp, Homo sapiens
gcagccaggagggag

SEQ ID NO: 189665 - DNA, 15 bp, Homo sapiens
tgcagccaggaggga

SEQ ID NO: 189666 - DNA, 15 bp, Homo sapiens
ctgcagccaggaggg

SEQ ID NO: 189667 - DNA, 15 bp, Homo sapiens
actgcagccaggagg

SEQ ID NO: 189668 - DNA, 15 bp, Homo sapiens
aactgcagccaggag

SEQ ID NO: 189669 - DNA, 15 bp, Homo sapiens
caactgcagccagga

SEQ ID NO: 189670 - DNA, 15 bp, Homo sapiens
gcaactgcagccagg

SEQ ID NO: 189671 - DNA, 15 bp, Homo sapiens
agcaactgcagccag

SEQ ID NO: 189672 - DNA, 15 bp, Homo sapiens
aagcaactgcagcca

SEQ ID NO: 189673 - DNA, 15 bp, Homo sapiens
gaagcaactgcagcc

SEQ ID NO: 189674 - DNA, 15 bp, Homo sapiens
gagaagcaactgcag

SEQ ID NO: 189675 - DNA, 15 bp, Homo sapiens
ggagaagcaactgca

SEQ ID NO: 189676 - DNA, 15 bp, Homo sapiens
gggagaagcaactgc

SEQ ID NO: 189677 - DNA, 15 bp, Homo sapiens
tgggagaagcaactg

SEQ ID NO: 189678 - DNA, 15 bp, Homo sapiens
ttgggagaagcaact

SEQ ID NO: 189679 - DNA, 15 bp, Homo sapiens
attgggagaagcaac

SEQ ID NO: 189680 - DNA, 15 bp, Homo sapiens
gattgggagaagcaa

SEQ ID NO: 189681 - DNA, 15 bp, Homo sapiens
agattgggagaagca

SEQ ID NO: 189682 - DNA, 15 bp, Homo sapiens
gagattgggagaagc

SEQ ID NO: 189683 - DNA, 15 bp, Homo sapiens
agagattgggagaag

SEQ ID NO: 189684 - DNA, 15 bp, Homo sapiens
gagagattgggagaa

SEQ ID NO: 189685 - DNA, 15 bp, Homo sapiens
agagagattgggaga

SEQ ID NO: 189686 - DNA, 15 bp, Homo sapiens
gagagagattgggag

SEQ ID NO: 189687 - DNA, 15 bp, Homo sapiens
agagagagattggga

SEQ ID NO: 189688 - DNA, 15 bp, Homo sapiens
cagagagagattggg

SEQ ID NO: 189689 - DNA, 15 bp, Homo sapiens
gcagagagagattgg

SEQ ID NO: 189690 - DNA, 15 bp, Homo sapiens
tgcagagagagattg

SEQ ID NO: 189691 - DNA, 15 bp, Homo sapiens
gtgcagagagagatt

SEQ ID NO: 189692 - DNA, 15 bp, Homo sapiens
ggtgcagagagagat

SEQ ID NO: 189693 - DNA, 15 bp, Homo sapiens
aggtgcagagagaga

SEQ ID NO: 189694 - DNA, 15 bp, Homo sapiens
gaggtgcagagagag

SEQ ID NO: 189695 - DNA, 15 bp, Homo sapiens
agaggtgcagagaga

SEQ ID NO: 189696 - DNA, 15 bp, Homo sapiens
tagaggtgcagagag

SEQ ID NO: 189697 - DNA, 15 bp, Homo sapiens
gtagaggtgcagaga

SEQ ID NO: 189698 - DNA, 15 bp, Homo sapiens
agtagaggtgcagag

SEQ ID NO: 189699 - DNA, 15 bp, Homo sapiens
cagtagaggtgcaga

SEQ ID NO: 189700 - DNA, 15 bp, Homo sapiens
acagtagaggtgcag

SEQ ID NO: 189701 - DNA, 15 bp, Homo sapiens
tacagtagaggtgca

SEQ ID NO: 189702 - DNA, 15 bp, Homo sapiens
ttacagtagaggtgc

SEQ ID NO: 189703 - DNA, 15 bp, Homo sapiens
attacagtagaggtg

SEQ ID NO: 189704 - DNA, 15 bp, Homo sapiens
cattacagtagaggt

SEQ ID NO: 189705 - DNA, 15 bp, Homo sapiens
acattacagtagagg

SEQ ID NO: 189706 - DNA, 15 bp, Homo sapiens
tacattacagtagag

SEQ ID NO: 189707 - DNA, 15 bp, Homo sapiens
ttacattacagtaga

SEQ ID NO: 189708 - DNA, 15 bp, Homo sapiens
cttacattacagtag

SEQ ID NO: 189709 - DNA, 15 bp, Homo sapiens
ccttacattacagta

SEQ ID NO: 189710 - DNA, 15 bp, Homo sapiens
tccttacattacagt

SEQ ID NO: 189711 - DNA, 15 bp, Homo sapiens
atccttacattacag

SEQ ID NO: 189712 - DNA, 15 bp, Homo sapiens
aatccttacattaca

SEQ ID NO: 189713 - DNA, 15 bp, Homo sapiens
taatccttacattac

SEQ ID NO: 189714 - DNA, 15 bp, Homo sapiens
ctaatccttacatta

SEQ ID NO: 189715 - DNA, 15 bp, Homo sapiens
cctaatccttacatt

SEQ ID NO: 189716 - DNA, 15 bp, Homo sapiens
gcctaatccttacat

SEQ ID NO: 189717 - DNA, 15 bp, Homo sapiens
agcctaatccttaca

SEQ ID NO: 189718 - DNA, 15 bp, Homo sapiens
aagcctaatccttac

SEQ ID NO: 189719 - DNA, 15 bp, Homo sapiens
caagcctaatcctta

SEQ ID NO: 189720 - DNA, 15 bp, Homo sapiens
acaagcctaatcctt

SEQ ID NO: 189721 - DNA, 15 bp, Homo sapiens
tacaagcctaatcct

SEQ ID NO: 189722 - DNA, 15 bp, Homo sapiens
ttacaagcctaatcc

SEQ ID NO: 189723 - DNA, 15 bp, Homo sapiens
gttacaagcctaatc

SEQ ID NO: 189724 - DNA, 15 bp, Homo sapiens
tgttacaagcctaat

SEQ ID NO: 189725 - DNA, 15 bp, Homo sapiens
gtgttacaagcctaa

SEQ ID NO: 189726 - DNA, 15 bp, Homo sapiens
tgtgttacaagccta

SEQ ID NO: 189727 - DNA, 15 bp, Homo sapiens
ctgtgttacaagcct

SEQ ID NO: 189728 - DNA, 15 bp, Homo sapiens
cctgtgttacaagcc

SEQ ID NO: 189729 - DNA, 15 bp, Homo sapiens
ccctgtgttacaagc

SEQ ID NO: 189730 - DNA, 15 bp, Homo sapiens
gccctgtgttacaag

SEQ ID NO: 189731 - DNA, 15 bp, Homo sapiens
cgccctgtgttacaa

SEQ ID NO: 189732 - DNA, 15 bp, Homo sapiens
ccgccctgtgttaca

SEQ ID NO: 189733 - DNA, 15 bp, Homo sapiens
tccgccctgtgttac

SEQ ID NO: 189734 - DNA, 15 bp, Homo sapiens
gtccgccctgtgtta

SEQ ID NO: 189735 - DNA, 15 bp, Homo sapiens
agtccgccctgtgtt

SEQ ID NO: 189736 - DNA, 15 bp, Homo sapiens
aagtccgccctgtgt

SEQ ID NO: 189737 - DNA, 15 bp, Homo sapiens
gaagtccgccctgtg

SEQ ID NO: 189738 - DNA, 15 bp, Homo sapiens
cgaagtccgccctgt

SEQ ID NO: 189739 - DNA, 15 bp, Homo sapiens
tcgaagtccgccctg

SEQ ID NO: 189740 - DNA, 15 bp, Homo sapiens
gtcgaagtccgccct

SEQ ID NO: 189741 - DNA, 15 bp, Homo sapiens
ggtcgaagtccgccc

SEQ ID NO: 189742 - DNA, 15 bp, Homo sapiens
aggtcgaagtccgcc

SEQ ID NO: 189743 - DNA, 15 bp, Homo sapiens
gaggtcgaagtccgc

SEQ ID NO: 189744 - DNA, 15 bp, Homo sapiens
agaggtcgaagtccg

SEQ ID NO: 189745 - DNA, 15 bp, Homo sapiens
gagaggtcgaagtcc

SEQ ID NO: 189746 - DNA, 15 bp, Homo sapiens
cgagaggtcgaagtc

SEQ ID NO: 189747 - DNA, 15 bp, Homo sapiens
gcgagaggtcgaagt

SEQ ID NO: 189748 - DNA, 15 bp, Homo sapiens
agcgagaggtcgaag

SEQ ID NO: 189749 - DNA, 15 bp, Homo sapiens
aagcgagaggtcgaa

SEQ ID NO: 189750 - DNA, 15 bp, Homo sapiens
aaagcgagaggtcga

SEQ ID NO: 189751 - DNA, 15 bp, Homo sapiens
taaagcgagaggtcg

SEQ ID NO: 189752 - DNA, 15 bp, Homo sapiens
ttaaagcgagaggtc

SEQ ID NO: 189753 - DNA, 15 bp, Homo sapiens
attaaagcgagaggt

SEQ ID NO: 189754 - DNA, 15 bp, Homo sapiens
tattaaagcgagagg

SEQ ID NO: 189755 - DNA, 15 bp, Homo sapiens
atattaaagcgagag

SEQ ID NO: 189756 - DNA, 15 bp, Homo sapiens
catattaaagcgaga

SEQ ID NO: 189757 - DNA, 15 bp, Homo sapiens
acatattaaagcgag

SEQ ID NO: 189758 - DNA, 15 bp, Homo sapiens
cacatattaaagcga

SEQ ID NO: 189759 - DNA, 15 bp, Homo sapiens
ccacatattaaagcg

SEQ ID NO: 189760 - DNA, 15 bp, Homo sapiens
accacatattaaagc

SEQ ID NO: 189761 - DNA, 15 bp, Homo sapiens
aaccacatattaaag

SEQ ID NO: 189762 - DNA, 15 bp, Homo sapiens
taaccacatattaaa

SEQ ID NO: 189763 - DNA, 15 bp, Homo sapiens
ttaaccacatattaa

SEQ ID NO: 189764 - DNA, 15 bp, Homo sapiens
cttaaccacatatta

SEQ ID NO: 189765 - DNA, 15 bp, Homo sapiens
gcttaaccacatatt

SEQ ID NO: 189766 - DNA, 15 bp, Homo sapiens
tgcttaaccacatat

SEQ ID NO: 189767 - DNA, 15 bp, Homo sapiens
atgcttaaccacata

SEQ ID NO: 189768 - DNA, 15 bp, Homo sapiens
gatgcttaaccacat

SEQ ID NO: 189769 - DNA, 15 bp, Homo sapiens
agatgcttaaccaca

SEQ ID NO: 189770 - DNA, 15 bp, Homo sapiens
tagatgcttaaccac

SEQ ID NO: 189771 - DNA, 15 bp, Homo sapiens
ttagatgcttaacca

SEQ ID NO: 189772 - DNA, 15 bp, Homo sapiens
tttagatgcttaacc

SEQ ID NO: 189773 - DNA, 15 bp, Homo sapiens
atttagatgcttaac

SEQ ID NO: 189774 - DNA, 15 bp, Homo sapiens
aatttagatgcttaa

SEQ ID NO: 189775 - DNA, 15 bp, Homo sapiens
gaatttagatgctta

SEQ ID NO: 189776 - DNA, 15 bp, Homo sapiens
ggaatttagatgctt

SEQ ID NO: 189777 - DNA, 15 bp, Homo sapiens
aggaatttagatgct

SEQ ID NO: 189778 - DNA, 15 bp, Homo sapiens
caggaatttagatgc

SEQ ID NO: 189779 - DNA, 15 bp, Homo sapiens
tcaggaatttagatg

SEQ ID NO: 189780 - DNA, 15 bp, Homo sapiens
ctcaggaatttagat

SEQ ID NO: 189781 - DNA, 15 bp, Homo sapiens
tctcaggaatttaga

SEQ ID NO: 189782 - DNA, 15 bp, Homo sapiens
ctctcaggaatttag

SEQ ID NO: 189783 - DNA, 15 bp, Homo sapiens
actctcaggaattta

SEQ ID NO: 189784 - DNA, 15 bp, Homo sapiens
tactctcaggaattt

SEQ ID NO: 189785 - DNA, 15 bp, Homo sapiens
ttactctcaggaatt

SEQ ID NO: 189786 - DNA, 15 bp, Homo sapiens
tttactctcaggaat

SEQ ID NO: 189787 - DNA, 15 bp, Homo sapiens
ttttactctcaggaa

SEQ ID NO: 189788 - DNA, 15 bp, Homo sapiens
cttttactctcagga

SEQ ID NO: 189789 - DNA, 15 bp, Homo sapiens
tcttttactctcagg

SEQ ID NO: 189790 - DNA, 15 bp, Homo sapiens
gtcttttactctcag

SEQ ID NO: 189791 - DNA, 15 bp, Homo sapiens
cgtcttttactctca

SEQ ID NO: 189792 - DNA, 15 bp, Homo sapiens
ccgtcttttactctc

SEQ ID NO: 189793 - DNA, 15 bp, Homo sapiens
accgtcttttactct

SEQ ID NO: 189794 - DNA, 15 bp, Homo sapiens
aaccgtcttttactc

SEQ ID NO: 189795 - DNA, 15 bp, Homo sapiens
gaaccgtcttttact

SEQ ID NO: 189796 - DNA, 15 bp, Homo sapiens
agaaccgtcttttac

SEQ ID NO: 189797 - DNA, 15 bp, Homo sapiens
gagaaccgtctttta

SEQ ID NO: 189798 - DNA, 15 bp, Homo sapiens
ggagaaccgtctttt

SEQ ID NO: 189799 - DNA, 15 bp, Homo sapiens
gggagaaccgtcttt

SEQ ID NO: 189800 - DNA, 15 bp, Homo sapiens
agggagaaccgtctt

SEQ ID NO: 189801 - DNA, 15 bp, Homo sapiens
gagggagaaccgtct

SEQ ID NO: 189802 - DNA, 15 bp, Homo sapiens
tgagggagaaccgtc

SEQ ID NO: 189803 - DNA, 15 bp, Homo sapiens
ctgagggagaaccgt

SEQ ID NO: 189804 - DNA, 15 bp, Homo sapiens
gctgagggagaaccg

SEQ ID NO: 189805 - DNA, 15 bp, Homo sapiens
agctgagggagaacc

SEQ ID NO: 189806 - DNA, 15 bp, Homo sapiens
aagctgagggagaac

SEQ ID NO: 189807 - DNA, 15 bp, Homo sapiens
caagctgagggagaa

SEQ ID NO: 189808 - DNA, 15 bp, Homo sapiens
gcaagctgagggaga

SEQ ID NO: 189809 - DNA, 15 bp, Homo sapiens
agcaagctgagggag

SEQ ID NO: 189810 - DNA, 15 bp, Homo sapiens
gagcaagctgaggga

SEQ ID NO: 189811 - DNA, 15 bp, Homo sapiens
agagcaagctgaggg

SEQ ID NO: 189812 - DNA, 15 bp, Homo sapiens
gagagcaagctgagg

SEQ ID NO: 189813 - DNA, 15 bp, Homo sapiens
ggagagcaagctgag

SEQ ID NO: 189814 - DNA, 15 bp, Homo sapiens
tggagagcaagctga

SEQ ID NO: 189815 - DNA, 15 bp, Homo sapiens
gtggagagcaagctg

SEQ ID NO: 189816 - DNA, 15 bp, Homo sapiens
agtggagagcaagct

SEQ ID NO: 189817 - DNA, 15 bp, Homo sapiens
aagtggagagcaagc

SEQ ID NO: 189818 - DNA, 15 bp, Homo sapiens
taagtggagagcaag

SEQ ID NO: 189819 - DNA, 15 bp, Homo sapiens
ctaagtggagagcaa

SEQ ID NO: 189820 - DNA, 15 bp, Homo sapiens
tctaagtggagagca

SEQ ID NO: 189821 - DNA, 15 bp, Homo sapiens
ttctaagtggagagc

SEQ ID NO: 189822 - DNA, 15 bp, Homo sapiens
cttctaagtggagag

SEQ ID NO: 189823 - DNA, 15 bp, Homo sapiens
ccttctaagtggaga

SEQ ID NO: 189824 - DNA, 15 bp, Homo sapiens
cccttctaagtggag

SEQ ID NO: 189825 - DNA, 15 bp, Homo sapiens
ccccttctaagtgga

SEQ ID NO: 189826 - DNA, 15 bp, Homo sapiens
gccccttctaagtgg

SEQ ID NO: 189827 - DNA, 15 bp, Homo sapiens
cgccccttctaagtg

SEQ ID NO: 189828 - DNA, 15 bp, Homo sapiens
ccgccccttctaagt

SEQ ID NO: 189829 - DNA, 15 bp, Homo sapiens
cccgccccttctaag

SEQ ID NO: 189830 - DNA, 15 bp, Homo sapiens
ccccgccccttctaa

SEQ ID NO: 189831 - DNA, 15 bp, Homo sapiens
tccccgccccttcta

SEQ ID NO: 189832 - DNA, 15 bp, Homo sapiens
ttccccgccccttct

SEQ ID NO: 189833 - DNA, 15 bp, Homo sapiens
cttccccgccccttc

SEQ ID NO: 189834 - DNA, 15 bp, Homo sapiens
ccttccccgcccctt

SEQ ID NO: 189835 - DNA, 15 bp, Homo sapiens
gccttccccgcccct

SEQ ID NO: 189836 - DNA, 15 bp, Homo sapiens
tgccttccccgcccc

SEQ ID NO: 189837 - DNA, 15 bp, Homo sapiens
ttgccttccccgccc

SEQ ID NO: 189838 - DNA, 15 bp, Homo sapiens
cttgccttccccgcc

SEQ ID NO: 189839 - DNA, 15 bp, Homo sapiens
ccttgccttccccgc

SEQ ID NO: 189840 - DNA, 15 bp, Homo sapiens
tccttgccttccccg

SEQ ID NO: 189841 - DNA, 15 bp, Homo sapiens
ttccttgccttcccc

SEQ ID NO: 189842 - DNA, 15 bp, Homo sapiens
attccttgccttccc

SEQ ID NO: 189843 - DNA, 15 bp, Homo sapiens
tattccttgccttcc

SEQ ID NO: 189844 - DNA, 15 bp, Homo sapiens
atattccttgccttc

SEQ ID NO: 189845 - DNA, 15 bp, Homo sapiens
gatattccttgcctt

SEQ ID NO: 189846 - DNA, 15 bp, Homo sapiens
agatattccttgcct

SEQ ID NO: 189847 - DNA, 15 bp, Homo sapiens
aagatattccttgcc

SEQ ID NO: 189848 - DNA, 15 bp, Homo sapiens
gaagatattccttgc

SEQ ID NO: 189849 - DNA, 15 bp, Homo sapiens
ggaagatattccttg

SEQ ID NO: 189850 - DNA, 15 bp, Homo sapiens
aggaagatattcctt

SEQ ID NO: 189851 - DNA, 15 bp, Homo sapiens
aaggaagatattcct

SEQ ID NO: 189852 - DNA, 15 bp, Homo sapiens
taaggaagatattcc

SEQ ID NO: 189853 - DNA, 15 bp, Homo sapiens
ataaggaagatattc

SEQ ID NO: 189854 - DNA, 15 bp, Homo sapiens
cataaggaagatatt

SEQ ID NO: 189855 - DNA, 15 bp, Homo sapiens
ccataaggaagatat

SEQ ID NO: 189856 - DNA, 15 bp, Homo sapiens
gccataaggaagata

SEQ ID NO: 189857 - DNA, 15 bp, Homo sapiens
tgccataaggaagat

SEQ ID NO: 189858 - DNA, 15 bp, Homo sapiens
ctgccataaggaaga

SEQ ID NO: 189859 - DNA, 15 bp, Homo sapiens
gctgccataaggaag

SEQ ID NO: 189860 - DNA, 15 bp, Homo sapiens
agctgccataaggaa

SEQ ID NO: 189861 - DNA, 15 bp, Homo sapiens
cagctgccataagga

SEQ ID NO: 189862 - DNA, 15 bp, Homo sapiens
ccagctgccataagg

SEQ ID NO: 189863 - DNA, 15 bp, Homo sapiens
accagctgccataag

SEQ ID NO: 189864 - DNA, 15 bp, Homo sapiens
taccagctgccataa

SEQ ID NO: 189865 - DNA, 15 bp, Homo sapiens
ttaccagctgccata

SEQ ID NO: 189866 - DNA, 15 bp, Homo sapiens
gttaccagctgccat

SEQ ID NO: 189867 - DNA, 15 bp, Homo sapiens
tgttaccagctgcca

SEQ ID NO: 189868 - DNA, 15 bp, Homo sapiens
ctgttaccagctgcc

SEQ ID NO: 189869 - DNA, 15 bp, Homo sapiens
gctgttaccagctgc

SEQ ID NO: 189870 - DNA, 15 bp, Homo sapiens
tgctgttaccagctg

SEQ ID NO: 189871 - DNA, 15 bp, Homo sapiens
ctgctgttaccagct

SEQ ID NO: 189872 - DNA, 15 bp, Homo sapiens
cctgctgttaccagc

SEQ ID NO: 189873 - DNA, 15 bp, Homo sapiens
acctgctgttaccag

SEQ ID NO: 189874 - DNA, 15 bp, Homo sapiens
cacctgctgttacca

SEQ ID NO: 189875 - DNA, 15 bp, Homo sapiens
tcacctgctgttacc

SEQ ID NO: 189876 - DNA, 15 bp, Homo sapiens
gtcacctgctgttac

SEQ ID NO: 189877 - DNA, 15 bp, Homo sapiens
tgtcacctgctgtta

SEQ ID NO: 189878 - DNA, 15 bp, Homo sapiens
ttgtcacctgctgtt

SEQ ID NO: 189879 - DNA, 15 bp, Homo sapiens
tttgtcacctgctgt

SEQ ID NO: 189880 - DNA, 15 bp, Homo sapiens
gtttgtcacctgctg

SEQ ID NO: 189881 - DNA, 15 bp, Homo sapiens
agtttgtcacctgct

SEQ ID NO: 189882 - DNA, 15 bp, Homo sapiens
aagtttgtcacctgc

SEQ ID NO: 189883 - DNA, 15 bp, Homo sapiens
aaagtttgtcacctg

SEQ ID NO: 189884 - DNA, 15 bp, Homo sapiens
taaagtttgtcacct

SEQ ID NO: 189885 - DNA, 15 bp, Homo sapiens
ataaagtttgtcacc

SEQ ID NO: 189886 - DNA, 15 bp, Homo sapiens
cataaagtttgtcac

SEQ ID NO: 189887 - DNA, 15 bp, Homo sapiens
tcataaagtttgtca

SEQ ID NO: 189888 - DNA, 15 bp, Homo sapiens
gtcataaagtttgtc

SEQ ID NO: 189889 - DNA, 15 bp, Homo sapiens
ggtcataaagtttgt

SEQ ID NO: 189890 - DNA, 15 bp, Homo sapiens
tggtcataaagtttg

SEQ ID NO: 189891 - DNA, 15 bp, Homo sapiens
atggtcataaagttt

SEQ ID NO: 189892 - DNA, 15 bp, Homo sapiens
tatggtcataaagtt

SEQ ID NO: 189893 - DNA, 15 bp, Homo sapiens
ttatggtcataaagt

SEQ ID NO: 189894 - DNA, 15 bp, Homo sapiens
tttatggtcataaag

SEQ ID NO: 189895 - DNA, 15 bp, Homo sapiens
ctttatggtcataaa

SEQ ID NO: 189896 - DNA, 15 bp, Homo sapiens
tctttatggtcataa

SEQ ID NO: 189897 - DNA, 15 bp, Homo sapiens
ctctttatggtcata

SEQ ID NO: 189898 - DNA, 15 bp, Homo sapiens
cctctttatggtcat

SEQ ID NO: 189899 - DNA, 15 bp, Homo sapiens
acctctttatggtca

SEQ ID NO: 189900 - DNA, 15 bp, Homo sapiens
gacctctttatggtc

SEQ ID NO: 189901 - DNA, 15 bp, Homo sapiens
agacctctttatggt

SEQ ID NO: 189902 - DNA, 15 bp, Homo sapiens
cagacctctttatgg

SEQ ID NO: 189903 - DNA, 15 bp, Homo sapiens
acagacctctttatg

SEQ ID NO: 189904 - DNA, 15 bp, Homo sapiens
aacagacctctttat

SEQ ID NO: 189905 - DNA, 15 bp, Homo sapiens
taacagacctcttta

SEQ ID NO: 189906 - DNA, 15 bp, Homo sapiens
ctaacagacctcttt

SEQ ID NO: 189907 - DNA, 15 bp, Homo sapiens
gctaacagacctctt

SEQ ID NO: 189908 - DNA, 15 bp, Homo sapiens
agctaacagacctct

SEQ ID NO: 189909 - DNA, 15 bp, Homo sapiens
aagctaacagacctc

SEQ ID NO: 189910 - DNA, 15 bp, Homo sapiens
caagctaacagacct

SEQ ID NO: 189911 - DNA, 15 bp, Homo sapiens
acaagctaacagacc

SEQ ID NO: 189912 - DNA, 15 bp, Homo sapiens
aacaagctaacagac

SEQ ID NO: 189913 - DNA, 15 bp, Homo sapiens
aaacaagctaacaga

SEQ ID NO: 189914 - DNA, 15 bp, Homo sapiens
aaaacaagctaacag

SEQ ID NO: 189915 - DNA, 15 bp, Homo sapiens
caaaacaagctaaca

SEQ ID NO: 189916 - DNA, 15 bp, Homo sapiens
acaaaacaagctaac

SEQ ID NO: 189917 - DNA, 15 bp, Homo sapiens
tacaaaacaagctaa

SEQ ID NO: 189918 - DNA, 15 bp, Homo sapiens
atacaaaacaagcta

SEQ ID NO: 189919 - DNA, 15 bp, Homo sapiens
tatacaaaacaagct

SEQ ID NO: 189920 - DNA, 15 bp, Homo sapiens
ctatacaaaacaagc

SEQ ID NO: 189921 - DNA, 15 bp, Homo sapiens
tctatacaaaacaag

SEQ ID NO: 189922 - DNA, 15 bp, Homo sapiens
atctatacaaaacaa

SEQ ID NO: 189923 - DNA, 15 bp, Homo sapiens
aatctatacaaaaca

SEQ ID NO: 189924 - DNA, 15 bp, Homo sapiens
aaatctatacaaaac

SEQ ID NO: 189925 - DNA, 15 bp, Homo sapiens
caaatctatacaaaa

SEQ ID NO: 189926 - DNA, 15 bp, Homo sapiens
acaaatctatacaaa

SEQ ID NO: 189927 - DNA, 15 bp, Homo sapiens
gacaaatctatacaa

SEQ ID NO: 189928 - DNA, 15 bp, Homo sapiens
agacaaatctataca

SEQ ID NO: 189929 - DNA, 15 bp, Homo sapiens
cagacaaatctatac

SEQ ID NO: 189930 - DNA, 15 bp, Homo sapiens
acagacaaatctata

SEQ ID NO: 189931 - DNA, 15 bp, Homo sapiens
aacagacaaatctat

SEQ ID NO: 189932 - DNA, 15 bp, Homo sapiens
aaacagacaaatcta

SEQ ID NO: 189933 - DNA, 15 bp, Homo sapiens
gaaacagacaaatct

SEQ ID NO: 189934 - DNA, 15 bp, Homo sapiens
agaaacagacaaatc

SEQ ID NO: 189935 - DNA, 15 bp, Homo sapiens
aagaaacagacaaat

SEQ ID NO: 189936 - DNA, 15 bp, Homo sapiens
gaagaaacagacaaa

SEQ ID NO: 189937 - DNA, 15 bp, Homo sapiens
ggaagaaacagacaa

SEQ ID NO: 189938 - DNA, 15 bp, Homo sapiens
aggaagaaacagaca

SEQ ID NO: 189939 - DNA, 15 bp, Homo sapiens
aaggaagaaacagac

SEQ ID NO: 189940 - DNA, 15 bp, Homo sapiens
aaaggaagaaacaga

SEQ ID NO: 189941 - DNA, 15 bp, Homo sapiens
taaaggaagaaacag

SEQ ID NO: 189942 - DNA, 15 bp, Homo sapiens
ttaaaggaagaaaca

SEQ ID NO: 189943 - DNA, 15 bp, Homo sapiens
tttaaaggaagaaac

SEQ ID NO: 189944 - DNA, 15 bp, Homo sapiens
ctttaaaggaagaaa

SEQ ID NO: 189945 - DNA, 15 bp, Homo sapiens
cctttaaaggaagaa

SEQ ID NO: 189946 - DNA, 15 bp, Homo sapiens
acctttaaaggaaga

SEQ ID NO: 189947 - DNA, 15 bp, Homo sapiens
tacctttaaaggaag

SEQ ID NO: 189948 - DNA, 15 bp, Homo sapiens
atacctttaaaggaa

SEQ ID NO: 189949 - DNA, 15 bp, Homo sapiens
tatacctttaaagga

SEQ ID NO: 189950 - DNA, 15 bp, Homo sapiens
ctatacctttaaagg

SEQ ID NO: 189951 - DNA, 15 bp, Homo sapiens
tctatacctttaaag

SEQ ID NO: 189952 - DNA, 15 bp, Homo sapiens
ctctatacctttaaa

SEQ ID NO: 189953 - DNA, 15 bp, Homo sapiens
gctctatacctttaa

SEQ ID NO: 189954 - DNA, 15 bp, Homo sapiens
tgctctataccttta

SEQ ID NO: 189955 - DNA, 15 bp, Homo sapiens
atgctctataccttt

SEQ ID NO: 189956 - DNA, 15 bp, Homo sapiens
tatgctctatacctt

SEQ ID NO: 189957 - DNA, 15 bp, Homo sapiens
atatgctctatacct

SEQ ID NO: 189958 - DNA, 15 bp, Homo sapiens
catatgctctatacc

SEQ ID NO: 189959 - DNA, 15 bp, Homo sapiens
acatatgctctatac

SEQ ID NO: 189960 - DNA, 15 bp, Homo sapiens
aacatatgctctata

SEQ ID NO: 189961 - DNA, 15 bp, Homo sapiens
taacatatgctctat

SEQ ID NO: 189962 - DNA, 15 bp, Homo sapiens
gtaacatatgctcta

SEQ ID NO: 189963 - DNA, 15 bp, Homo sapiens
tgtaacatatgctct

SEQ ID NO: 189964 - DNA, 15 bp, Homo sapiens
atgtaacatatgctc

SEQ ID NO: 189965 - DNA, 15 bp, Homo sapiens
catgtaacatatgct

SEQ ID NO: 189966 - DNA, 15 bp, Homo sapiens
tcatgtaacatatgc

SEQ ID NO: 189967 - DNA, 15 bp, Homo sapiens
ttcatgtaacatatg

SEQ ID NO: 189968 - DNA, 15 bp, Homo sapiens
attcatgtaacatat

SEQ ID NO: 189969 - DNA, 15 bp, Homo sapiens
tattcatgtaacata

SEQ ID NO: 189970 - DNA, 15 bp, Homo sapiens
ttattcatgtaacat

SEQ ID NO: 189971 - DNA, 15 bp, Homo sapiens
attattcatgtaaca

SEQ ID NO: 189972 - DNA, 15 bp, Homo sapiens
aattattcatgtaac

SEQ ID NO: 189973 - DNA, 15 bp, Homo sapiens
gaattattcatgtaa

SEQ ID NO: 189974 - DNA, 15 bp, Homo sapiens
tgaattattcatgta

SEQ ID NO: 189975 - DNA, 15 bp, Homo sapiens
atgaattattcatgt

SEQ ID NO: 189976 - DNA, 15 bp, Homo sapiens
aatgaattattcatg

SEQ ID NO: 189977 - DNA, 15 bp, Homo sapiens
taatgaattattcat

SEQ ID NO: 189978 - DNA, 15 bp, Homo sapiens
gtaatgaattattca

SEQ ID NO: 189979 - DNA, 15 bp, Homo sapiens
agtaatgaattattc

SEQ ID NO: 189980 - DNA, 15 bp, Homo sapiens
aagtaatgaattatt

SEQ ID NO: 189981 - DNA, 15 bp, Homo sapiens
taagtaatgaattat

SEQ ID NO: 189982 - DNA, 15 bp, Homo sapiens
ctaagtaatgaatta

SEQ ID NO: 189983 - DNA, 15 bp, Homo sapiens
tctaagtaatgaatt

SEQ ID NO: 189984 - DNA, 15 bp, Homo sapiens
gtctaagtaatgaat

SEQ ID NO: 189985 - DNA, 15 bp, Homo sapiens
ggtctaagtaatgaa

SEQ ID NO: 189986 - DNA, 15 bp, Homo sapiens
gggtctaagtaatga

SEQ ID NO: 189987 - DNA, 15 bp, Homo sapiens
ggggtctaagtaatg

SEQ ID NO: 189988 - DNA, 15 bp, Homo sapiens
gggggtctaagtaat

SEQ ID NO: 189989 - DNA, 15 bp, Homo sapiens
agggggtctaagtaa

SEQ ID NO: 189990 - DNA, 15 bp, Homo sapiens
cagggggtctaagta

SEQ ID NO: 189991 - DNA, 15 bp, Homo sapiens
tcagggggtctaagt

SEQ ID NO: 189992 - DNA, 15 bp, Homo sapiens
ctcagggggtctaag

SEQ ID NO: 189993 - DNA, 15 bp, Homo sapiens
tctcagggggtctaa

SEQ ID NO: 189994 - DNA, 15 bp, Homo sapiens
ctctcagggggtcta

SEQ ID NO: 189995 - DNA, 15 bp, Homo sapiens
cctctcagggggtct

SEQ ID NO: 189996 - DNA, 15 bp, Homo sapiens
gcctctcagggggtc

SEQ ID NO: 189997 - DNA, 15 bp, Homo sapiens
tgcctctcagggggt

SEQ ID NO: 189998 - DNA, 15 bp, Homo sapiens
ctgcctctcaggggg

SEQ ID NO: 189999 - DNA, 15 bp, Homo sapiens
actgcctctcagggg

SEQ ID NO: 190000 - DNA, 15 bp, Homo sapiens
tactgcctctcaggg

SEQ ID NO: 190001 - DNA, 15 bp, Homo sapiens
ttactgcctctcagg

SEQ ID NO: 190002 - DNA, 15 bp, Homo sapiens
attactgcctctcag

SEQ ID NO: 190003 - DNA, 15 bp, Homo sapiens
aattactgcctctca

SEQ ID NO: 190004 - DNA, 15 bp, Homo sapiens
caattactgcctctc

SEQ ID NO: 190005 - DNA, 15 bp, Homo sapiens
acaattactgcctct

SEQ ID NO: 190006 - DNA, 15 bp, Homo sapiens
cacaattactgcctc

SEQ ID NO: 190007 - DNA, 15 bp, Homo sapiens
ccacaattactgcct

SEQ ID NO: 190008 - DNA, 15 bp, Homo sapiens
cccacaattactgcc

SEQ ID NO: 190009 - DNA, 15 bp, Homo sapiens
gcccacaattactgc

SEQ ID NO: 190010 - DNA, 15 bp, Homo sapiens
tgcccacaattactg

SEQ ID NO: 190011 - DNA, 15 bp, Homo sapiens
ttgcccacaattact

SEQ ID NO: 190012 - DNA, 15 bp, Homo sapiens
attgcccacaattac

SEQ ID NO: 190013 - DNA, 15 bp, Homo sapiens
tattgcccacaatta

SEQ ID NO: 190014 - DNA, 15 bp, Homo sapiens
ctattgcccacaatt

SEQ ID NO: 190015 - DNA, 15 bp, Homo sapiens
gctattgcccacaat

SEQ ID NO: 190016 - DNA, 15 bp, Homo sapiens
agctattgcccacaa

SEQ ID NO: 190017 - DNA, 15 bp, Homo sapiens
cagctattgcccaca

SEQ ID NO: 190018 - DNA, 15 bp, Homo sapiens
ccagctattgcccac

SEQ ID NO: 190019 - DNA, 15 bp, Homo sapiens
tccagctattgccca

SEQ ID NO: 190020 - DNA, 15 bp, Homo sapiens
gtccagctattgccc

SEQ ID NO: 190021 - DNA, 15 bp, Homo sapiens
agtccagctattgcc

SEQ ID NO: 190022 - DNA, 15 bp, Homo sapiens
aagtccagctattgc

SEQ ID NO: 190023 - DNA, 15 bp, Homo sapiens
aaagtccagctattg

SEQ ID NO: 190024 - DNA, 15 bp, Homo sapiens
aaaagtccagctatt

SEQ ID NO: 190025 - DNA, 15 bp, Homo sapiens
caaaagtccagctat

SEQ ID NO: 190026 - DNA, 15 bp, Homo sapiens
acaaaagtccagcta

SEQ ID NO: 190027 - DNA, 15 bp, Homo sapiens
tacaaaagtccagct

SEQ ID NO: 190028 - DNA, 15 bp, Homo sapiens
atacaaaagtccagc

SEQ ID NO: 190029 - DNA, 15 bp, Homo sapiens
aatacaaaagtccag

SEQ ID NO: 190030 - DNA, 15 bp, Homo sapiens
caatacaaaagtcca

SEQ ID NO: 190031 - DNA, 15 bp, Homo sapiens
acaatacaaaagtcc

SEQ ID NO: 190032 - DNA, 15 bp, Homo sapiens
tacaatacaaaagtc

SEQ ID NO: 190033 - DNA, 15 bp, Homo sapiens
ttacaatacaaaagt

SEQ ID NO: 190034 - DNA, 15 bp, Homo sapiens
attacaatacaaaag

SEQ ID NO: 190035 - DNA, 15 bp, Homo sapiens
aattacaatacaaaa

SEQ ID NO: 190036 - DNA, 15 bp, Homo sapiens
caattacaatacaaa

SEQ ID NO: 190037 - DNA, 15 bp, Homo sapiens
gcaattacaatacaa

SEQ ID NO: 190038 - DNA, 15 bp, Homo sapiens
agcaattacaataca

SEQ ID NO: 190039 - DNA, 15 bp, Homo sapiens
cagcaattacaatac

SEQ ID NO: 190040 - DNA, 15 bp, Homo sapiens
gcagcaattacaata

SEQ ID NO: 190041 - DNA, 15 bp, Homo sapiens
agcagcaattacaat

SEQ ID NO: 190042 - DNA, 15 bp, Homo sapiens
tagcagcaattacaa

SEQ ID NO: 190043 - DNA, 15 bp, Homo sapiens
atagcagcaattaca

SEQ ID NO: 190044 - DNA, 15 bp, Homo sapiens
aatagcagcaattac

SEQ ID NO: 190045 - DNA, 15 bp, Homo sapiens
taatagcagcaatta

SEQ ID NO: 190046 - DNA, 15 bp, Homo sapiens
ctaatagcagcaatt

SEQ ID NO: 190047 - DNA, 15 bp, Homo sapiens
actaatagcagcaat

SEQ ID NO: 190048 - DNA, 15 bp, Homo sapiens
gactaatagcagcaa

SEQ ID NO: 190049 - DNA, 15 bp, Homo sapiens
agactaatagcagca

SEQ ID NO: 190050 - DNA, 15 bp, Homo sapiens
aagactaatagcagc

SEQ ID NO: 190051 - DNA, 15 bp, Homo sapiens
taagactaatagcag

SEQ ID NO: 190052 - DNA, 15 bp, Homo sapiens
ttaagactaatagca

SEQ ID NO: 190053 - DNA, 15 bp, Homo sapiens
tttaagactaatagc

SEQ ID NO: 190054 - DNA, 15 bp, Homo sapiens
ttttaagactaatag

SEQ ID NO: 190055 - DNA, 15 bp, Homo sapiens
cttttaagactaata

SEQ ID NO: 190056 - DNA, 15 bp, Homo sapiens
acttttaagactaat

SEQ ID NO: 190057 - DNA, 15 bp, Homo sapiens
gacttttaagactaa

SEQ ID NO: 190058 - DNA, 15 bp, Homo sapiens
agacttttaagacta

SEQ ID NO: 190059 - DNA, 15 bp, Homo sapiens
tagacttttaagact

SEQ ID NO: 190060 - DNA, 15 bp, Homo sapiens
ctagacttttaagac

SEQ ID NO: 190061 - DNA, 15 bp, Homo sapiens
cctagacttttaaga

SEQ ID NO: 190062 - DNA, 15 bp, Homo sapiens
acctagacttttaag

SEQ ID NO: 190063 - DNA, 15 bp, Homo sapiens
gacctagacttttaa

SEQ ID NO: 190064 - DNA, 15 bp, Homo sapiens
tgacctagactttta

SEQ ID NO: 190065 - DNA, 15 bp, Homo sapiens
ctgacctagactttt

SEQ ID NO: 190066 - DNA, 15 bp, Homo sapiens
tctgacctagacttt

SEQ ID NO: 190067 - DNA, 15 bp, Homo sapiens
atctgacctagactt

SEQ ID NO: 190068 - DNA, 15 bp, Homo sapiens
tatctgacctagact

SEQ ID NO: 190069 - DNA, 15 bp, Homo sapiens
gtatctgacctagac

SEQ ID NO: 190070 - DNA, 15 bp, Homo sapiens
ggtatctgacctaga

SEQ ID NO: 190071 - DNA, 15 bp, Homo sapiens
tggtatctgacctag

SEQ ID NO: 190072 - DNA, 15 bp, Homo sapiens
ctggtatctgaccta

SEQ ID NO: 190073 - DNA, 15 bp, Homo sapiens
cctggtatctgacct

SEQ ID NO: 190074 - DNA, 15 bp, Homo sapiens
ccctggtatctgacc

SEQ ID NO: 190075 - DNA, 15 bp, Homo sapiens
cccctggtatctgac

SEQ ID NO: 190076 - DNA, 15 bp, Homo sapiens
acccctggtatctga

SEQ ID NO: 190077 - DNA, 15 bp, Homo sapiens
aacccctggtatctg

SEQ ID NO: 190078 - DNA, 15 bp, Homo sapiens
gaacccctggtatct

SEQ ID NO: 190079 - DNA, 15 bp, Homo sapiens
ggaacccctggtatc

SEQ ID NO: 190080 - DNA, 15 bp, Homo sapiens
aggaacccctggtat

SEQ ID NO: 190081 - DNA, 15 bp, Homo sapiens
taggaacccctggta

SEQ ID NO: 190082 - DNA, 15 bp, Homo sapiens
ttaggaacccctggt

SEQ ID NO: 190083 - DNA, 15 bp, Homo sapiens
gttaggaacccctgg

SEQ ID NO: 190084 - DNA, 15 bp, Homo sapiens
ggttaggaacccctg

SEQ ID NO: 190085 - DNA, 15 bp, Homo sapiens
aggttaggaacccct

SEQ ID NO: 190086 - DNA, 15 bp, Homo sapiens
caggttaggaacccc

SEQ ID NO: 190087 - DNA, 15 bp, Homo sapiens
gcaggttaggaaccc

SEQ ID NO: 190088 - DNA, 15 bp, Homo sapiens
ggcaggttaggaacc

SEQ ID NO: 190089 - DNA, 15 bp, Homo sapiens
aggcaggttaggaac

SEQ ID NO: 190090 - DNA, 15 bp, Homo sapiens
gaggcaggttaggaa

SEQ ID NO: 190091 - DNA, 15 bp, Homo sapiens
tgaggcaggttagga

SEQ ID NO: 190092 - DNA, 15 bp, Homo sapiens
ctgaggcaggttagg

SEQ ID NO: 190093 - DNA, 15 bp, Homo sapiens
gctgaggcaggttag

SEQ ID NO: 190094 - DNA, 15 bp, Homo sapiens
agctgaggcaggtta

SEQ ID NO: 190095 - DNA, 15 bp, Homo sapiens
aagctgaggcaggtt

SEQ ID NO: 190096 - DNA, 15 bp, Homo sapiens
gaagctgaggcaggt

SEQ ID NO: 190097 - DNA, 15 bp, Homo sapiens
tgaagctgaggcagg

SEQ ID NO: 190098 - DNA, 15 bp, Homo sapiens
ttgaagctgaggcag

SEQ ID NO: 190099 - DNA, 15 bp, Homo sapiens
cttgaagctgaggca

SEQ ID NO: 190100 - DNA, 15 bp, Homo sapiens
gcttgaagctgaggc

SEQ ID NO: 190101 - DNA, 15 bp, Homo sapiens
ggcttgaagctgagg

SEQ ID NO: 190102 - DNA, 15 bp, Homo sapiens
tggcttgaagctgag

SEQ ID NO: 190103 - DNA, 15 bp, Homo sapiens
atggcttgaagctga

SEQ ID NO: 190104 - DNA, 15 bp, Homo sapiens
aatggcttgaagctg

SEQ ID NO: 190105 - DNA, 15 bp, Homo sapiens
aaatggcttgaagct

SEQ ID NO: 190106 - DNA, 15 bp, Homo sapiens
aaaatggcttgaagc

SEQ ID NO: 190107 - DNA, 15 bp, Homo sapiens
taaaatggcttgaag

SEQ ID NO: 190108 - DNA, 15 bp, Homo sapiens
ataaaatggcttgaa

SEQ ID NO: 190109 - DNA, 15 bp, Homo sapiens
aataaaatggcttga

SEQ ID NO: 190110 - DNA, 15 bp, Homo sapiens
caataaaatggcttg

SEQ ID NO: 190111 - DNA, 15 bp, Homo sapiens
ccaataaaatggctt

SEQ ID NO: 190112 - DNA, 15 bp, Homo sapiens
gccaataaaatggct

SEQ ID NO: 190113 - DNA, 15 bp, Homo sapiens
tgccaataaaatggc

SEQ ID NO: 190114 - DNA, 15 bp, Homo sapiens
ctgccaataaaatgg

SEQ ID NO: 190115 - DNA, 15 bp, Homo sapiens
tctgccaataaaatg

SEQ ID NO: 190116 - DNA, 15 bp, Homo sapiens
ctctgccaataaaat

SEQ ID NO: 190117 - DNA, 15 bp, Homo sapiens
actctgccaataaaa

SEQ ID NO: 190118 - DNA, 15 bp, Homo sapiens
aactctgccaataaa

SEQ ID NO: 190119 - DNA, 15 bp, Homo sapiens
taactctgccaataa

SEQ ID NO: 190120 - DNA, 15 bp, Homo sapiens
ctaactctgccaata

SEQ ID NO: 190121 - DNA, 15 bp, Homo sapiens
tctaactctgccaat

SEQ ID NO: 190122 - DNA, 15 bp, Homo sapiens
ttctaactctgccaa

SEQ ID NO: 190123 - DNA, 15 bp, Homo sapiens
cttctaactctgcca

SEQ ID NO: 190124 - DNA, 15 bp, Homo sapiens
acttctaactctgcc

SEQ ID NO: 190125 - DNA, 15 bp, Homo sapiens
aacttctaactctgc

SEQ ID NO: 190126 - DNA, 15 bp, Homo sapiens
gaacttctaactctg

SEQ ID NO: 190127 - DNA, 15 bp, Homo sapiens
agaacttctaactct

SEQ ID NO: 190128 - DNA, 15 bp, Homo sapiens
cagaacttctaactc

SEQ ID NO: 190129 - DNA, 15 bp, Homo sapiens
ccagaacttctaact

SEQ ID NO: 190130 - DNA, 15 bp, Homo sapiens
accagaacttctaac

SEQ ID NO: 190131 - DNA, 15 bp, Homo sapiens
aaccagaacttctaa

SEQ ID NO: 190132 - DNA, 15 bp, Homo sapiens
taaccagaacttcta

SEQ ID NO: 190133 - DNA, 15 bp, Homo sapiens
ataaccagaacttct

SEQ ID NO: 190134 - DNA, 15 bp, Homo sapiens
tataaccagaacttc

SEQ ID NO: 190135 - DNA, 15 bp, Homo sapiens
atataaccagaactt

SEQ ID NO: 190136 - DNA, 15 bp, Homo sapiens
aatataaccagaact

SEQ ID NO: 190137 - DNA, 15 bp, Homo sapiens
taatataaccagaac

SEQ ID NO: 190138 - DNA, 15 bp, Homo sapiens
ctaatataaccagaa

SEQ ID NO: 190139 - DNA, 15 bp, Homo sapiens
gctaatataaccaga

SEQ ID NO: 190140 - DNA, 15 bp, Homo sapiens
tgctaatataaccag

SEQ ID NO: 190141 - DNA, 15 bp, Homo sapiens
atgctaatataacca

SEQ ID NO: 190142 - DNA, 15 bp, Homo sapiens
catgctaatataacc

SEQ ID NO: 190143 - DNA, 15 bp, Homo sapiens
acatgctaatataac

SEQ ID NO: 190144 - DNA, 15 bp, Homo sapiens
aacatgctaatataa

SEQ ID NO: 190145 - DNA, 15 bp, Homo sapiens
aaacatgctaatata

SEQ ID NO: 190146 - DNA, 15 bp, Homo sapiens
gaaacatgctaatat

SEQ ID NO: 190147 - DNA, 15 bp, Homo sapiens
ggaaacatgctaata

SEQ ID NO: 190148 - DNA, 15 bp, Homo sapiens
gggaaacatgctaat

SEQ ID NO: 190149 - DNA, 15 bp, Homo sapiens
ggggaaacatgctaa

SEQ ID NO: 190150 - DNA, 15 bp, Homo sapiens
aggggaaacatgcta

SEQ ID NO: 190151 - DNA, 15 bp, Homo sapiens
aaggggaaacatgct

SEQ ID NO: 190152 - DNA, 15 bp, Homo sapiens
aaaggggaaacatgc

SEQ ID NO: 190153 - DNA, 15 bp, Homo sapiens
aaaaggggaaacatg

SEQ ID NO: 190154 - DNA, 15 bp, Homo sapiens
taaaaggggaaacat

SEQ ID NO: 190155 - DNA, 15 bp, Homo sapiens
ttaaaaggggaaaca

SEQ ID NO: 190156 - DNA, 15 bp, Homo sapiens
gttaaaaggggaaac

SEQ ID NO: 190157 - DNA, 15 bp, Homo sapiens
agttaaaaggggaaa

SEQ ID NO: 190158 - DNA, 15 bp, Homo sapiens
gagttaaaaggggaa

SEQ ID NO: 190159 - DNA, 15 bp, Homo sapiens
ggagttaaaagggga

SEQ ID NO: 190160 - DNA, 15 bp, Homo sapiens
gggagttaaaagggg

SEQ ID NO: 190161 - DNA, 15 bp, Homo sapiens
tgggagttaaaaggg

SEQ ID NO: 190162 - DNA, 15 bp, Homo sapiens
atgggagttaaaagg

SEQ ID NO: 190163 - DNA, 15 bp, Homo sapiens
catgggagttaaaag

SEQ ID NO: 190164 - DNA, 15 bp, Homo sapiens
acatgggagttaaaa

SEQ ID NO: 190165 - DNA, 15 bp, Homo sapiens
gacatgggagttaaa

SEQ ID NO: 190166 - DNA, 15 bp, Homo sapiens
agacatgggagttaa

SEQ ID NO: 190167 - DNA, 15 bp, Homo sapiens
aagacatgggagtta

SEQ ID NO: 190168 - DNA, 15 bp, Homo sapiens
taagacatgggagtt

SEQ ID NO: 190169 - DNA, 15 bp, Homo sapiens
ctaagacatgggagt

SEQ ID NO: 190170 - DNA, 15 bp, Homo sapiens
actaagacatgggag

SEQ ID NO: 190171 - DNA, 15 bp, Homo sapiens
tactaagacatggga

SEQ ID NO: 190172 - DNA, 15 bp, Homo sapiens
atactaagacatggg

SEQ ID NO: 190173 - DNA, 15 bp, Homo sapiens
aatactaagacatgg

SEQ ID NO: 190174 - DNA, 15 bp, Homo sapiens
aaatactaagacatg

SEQ ID NO: 190175 - DNA, 15 bp, Homo sapiens
caaatactaagacat

SEQ ID NO: 190176 - DNA, 15 bp, Homo sapiens
acaaatactaagaca

SEQ ID NO: 190177 - DNA, 15 bp, Homo sapiens
gacaaatactaagac

SEQ ID NO: 190178 - DNA, 15 bp, Homo sapiens
agacaaatactaaga

SEQ ID NO: 190179 - DNA, 15 bp, Homo sapiens
aagacaaatactaag

SEQ ID NO: 190180 - DNA, 15 bp, Homo sapiens
taagacaaatactaa

SEQ ID NO: 190181 - DNA, 15 bp, Homo sapiens
ataagacaaatacta

SEQ ID NO: 190182 - DNA, 15 bp, Homo sapiens
aataagacaaatact

SEQ ID NO: 190183 - DNA, 15 bp, Homo sapiens
gaataagacaaatac

SEQ ID NO: 190184 - DNA, 15 bp, Homo sapiens
ggaataagacaaata

SEQ ID NO: 190185 - DNA, 15 bp, Homo sapiens
aggaataagacaaat

SEQ ID NO: 190186 - DNA, 15 bp, Homo sapiens
taggaataagacaaa

SEQ ID NO: 190187 - DNA, 15 bp, Homo sapiens
ataggaataagacaa

SEQ ID NO: 190188 - DNA, 15 bp, Homo sapiens
aataggaataagaca

SEQ ID NO: 190189 - DNA, 15 bp, Homo sapiens
aaataggaataagac

SEQ ID NO: 190190 - DNA, 15 bp, Homo sapiens
aaaataggaataaga

SEQ ID NO: 190191 - DNA, 15 bp, Homo sapiens
taaaataggaataag

SEQ ID NO: 190192 - DNA, 15 bp, Homo sapiens
ctaaaataggaataa

SEQ ID NO: 190193 - DNA, 15 bp, Homo sapiens
actaaaataggaata

SEQ ID NO: 190194 - DNA, 15 bp, Homo sapiens
tactaaaataggaat

SEQ ID NO: 190195 - DNA, 15 bp, Homo sapiens
ctactaaaataggaa

SEQ ID NO: 190196 - DNA, 15 bp, Homo sapiens
actactaaaatagga

SEQ ID NO: 190197 - DNA, 15 bp, Homo sapiens
aactactaaaatagg

SEQ ID NO: 190198 - DNA, 15 bp, Homo sapiens
caactactaaaatag

SEQ ID NO: 190199 - DNA, 15 bp, Homo sapiens
tcaactactaaaata

SEQ ID NO: 190200 - DNA, 15 bp, Homo sapiens
ttcaactactaaaat

SEQ ID NO: 190201 - DNA, 15 bp, Homo sapiens
attcaactactaaaa

SEQ ID NO: 190202 - DNA, 15 bp, Homo sapiens
aattcaactactaaa

SEQ ID NO: 190203 - DNA, 15 bp, Homo sapiens
caattcaactactaa

SEQ ID NO: 190204 - DNA, 15 bp, Homo sapiens
tcaattcaactacta

SEQ ID NO: 190205 - DNA, 15 bp, Homo sapiens
gtcaattcaactact

SEQ ID NO: 190206 - DNA, 15 bp, Homo sapiens
tgtcaattcaactac

SEQ ID NO: 190207 - DNA, 15 bp, Homo sapiens
ctgtcaattcaacta

SEQ ID NO: 190208 - DNA, 15 bp, Homo sapiens
actgtcaattcaact

SEQ ID NO: 190209 - DNA, 15 bp, Homo sapiens
tactgtcaattcaac

SEQ ID NO: 190210 - DNA, 15 bp, Homo sapiens
ctactgtcaattcaa

SEQ ID NO: 190211 - DNA, 15 bp, Homo sapiens
tctactgtcaattca

SEQ ID NO: 190212 - DNA, 15 bp, Homo sapiens
ttctactgtcaattc

SEQ ID NO: 190213 - DNA, 15 bp, Homo sapiens
cttctactgtcaatt

SEQ ID NO: 190214 - DNA, 15 bp, Homo sapiens
tcttctactgtcaat

SEQ ID NO: 190215 - DNA, 15 bp, Homo sapiens
atcttctactgtcaa

SEQ ID NO: 190216 - DNA, 15 bp, Homo sapiens
tatcttctactgtca

SEQ ID NO: 190217 - DNA, 15 bp, Homo sapiens
atatcttctactgtc

SEQ ID NO: 190218 - DNA, 15 bp, Homo sapiens
gatatcttctactgt

SEQ ID NO: 190219 - DNA, 15 bp, Homo sapiens
agatatcttctactg

SEQ ID NO: 190220 - DNA, 15 bp, Homo sapiens
tagatatcttctact

SEQ ID NO: 190221 - DNA, 15 bp, Homo sapiens
gtagatatcttctac

SEQ ID NO: 190222 - DNA, 15 bp, Homo sapiens
agtagatatcttcta

SEQ ID NO: 190223 - DNA, 15 bp, Homo sapiens
cagtagatatcttct

SEQ ID NO: 190224 - DNA, 15 bp, Homo sapiens
ccagtagatatcttc

SEQ ID NO: 190225 - DNA, 15 bp, Homo sapiens
gccagtagatatctt

SEQ ID NO: 190226 - DNA, 15 bp, Homo sapiens
agccagtagatatct

SEQ ID NO: 190227 - DNA, 15 bp, Homo sapiens
aagccagtagatatc

SEQ ID NO: 190228 - DNA, 15 bp, Homo sapiens
aaagccagtagatat

SEQ ID NO: 190229 - DNA, 15 bp, Homo sapiens
aaaagccagtagata

SEQ ID NO: 190230 - DNA, 15 bp, Homo sapiens
aaaaagccagtagat

SEQ ID NO: 190231 - DNA, 15 bp, Homo sapiens
gaaaaagccagtaga

SEQ ID NO: 190232 - DNA, 15 bp, Homo sapiens
ggaaaaagccagtag

SEQ ID NO: 190233 - DNA, 15 bp, Homo sapiens
aggaaaaagccagta

SEQ ID NO: 190234 - DNA, 15 bp, Homo sapiens
caggaaaaagccagt

SEQ ID NO: 190235 - DNA, 15 bp, Homo sapiens
acaggaaaaagccag

SEQ ID NO: 190236 - DNA, 15 bp, Homo sapiens
gacaggaaaaagcca

SEQ ID NO: 190237 - DNA, 15 bp, Homo sapiens
tgacaggaaaaagcc

SEQ ID NO: 190238 - DNA, 15 bp, Homo sapiens
ttgacaggaaaaagc

SEQ ID NO: 190239 - DNA, 15 bp, Homo sapiens
tttgacaggaaaaag

SEQ ID NO: 190240 - DNA, 15 bp, Homo sapiens
ctttgacaggaaaaa

SEQ ID NO: 190241 - DNA, 15 bp, Homo sapiens
cctttgacaggaaaa

SEQ ID NO: 190242 - DNA, 15 bp, Homo sapiens
gcctttgacaggaaa

SEQ ID NO: 190243 - DNA, 15 bp, Homo sapiens
agcctttgacaggaa

SEQ ID NO: 190244 - DNA, 15 bp, Homo sapiens
aagcctttgacagga

SEQ ID NO: 190245 - DNA, 15 bp, Homo sapiens
caagcctttgacagg

SEQ ID NO: 190246 - DNA, 15 bp, Homo sapiens
tcaagcctttgacag

SEQ ID NO: 190247 - DNA, 15 bp, Homo sapiens
atcaagcctttgaca

SEQ ID NO: 190248 - DNA, 15 bp, Homo sapiens
aatcaagcctttgac

SEQ ID NO: 190249 - DNA, 15 bp, Homo sapiens
aaatcaagcctttga

SEQ ID NO: 190250 - DNA, 15 bp, Homo sapiens
caaatcaagcctttg

SEQ ID NO: 190251 - DNA, 15 bp, Homo sapiens
ccaaatcaagccttt

SEQ ID NO: 190252 - DNA, 15 bp, Homo sapiens
cccaaatcaagcctt

SEQ ID NO: 190253 - DNA, 15 bp, Homo sapiens
tcccaaatcaagcct

SEQ ID NO: 190254 - DNA, 15 bp, Homo sapiens
atcccaaatcaagcc

SEQ ID NO: 190255 - DNA, 15 bp, Homo sapiens
aatcccaaatcaagc

SEQ ID NO: 190256 - DNA, 15 bp, Homo sapiens
aaatcccaaatcaag

SEQ ID NO: 190257 - DNA, 15 bp, Homo sapiens
aaaatcccaaatcaa

SEQ ID NO: 190258 - DNA, 15 bp, Homo sapiens
aaaaatcccaaatca

SEQ ID NO: 190259 - DNA, 15 bp, Homo sapiens
taaaaatcccaaatc

SEQ ID NO: 190260 - DNA, 15 bp, Homo sapiens
ataaaaatcccaaat

SEQ ID NO: 190261 - DNA, 15 bp, Homo sapiens
aataaaaatcccaaa

SEQ ID NO: 190262 - DNA, 15 bp, Homo sapiens
ataataaaaatccca

SEQ ID NO: 190263 - DNA, 15 bp, Homo sapiens
aataataaaaatccc

SEQ ID NO: 190264 - DNA, 15 bp, Homo sapiens
taataataaaaatcc

SEQ ID NO: 190265 - DNA, 15 bp, Homo sapiens
ataataataaaaatc

SEQ ID NO: 190266 - DNA, 15 bp, Homo sapiens
aataataataaaaat

SEQ ID NO: 190267 - DNA, 15 bp, Homo sapiens
taataataataaaaa

SEQ ID NO: 190268 - DNA, 15 bp, Homo sapiens
aataataataataaa

SEQ ID NO: 190269 - DNA, 15 bp, Homo sapiens
tagataataataata

SEQ ID NO: 190270 - DNA, 15 bp, Homo sapiens
atagataataataat

SEQ ID NO: 190271 - DNA, 15 bp, Homo sapiens
aatagataataataa

SEQ ID NO: 190272 - DNA, 15 bp, Homo sapiens
aaatagataataata

SEQ ID NO: 190273 - DNA, 15 bp, Homo sapiens
taaatagataataat

SEQ ID NO: 190274 - DNA, 15 bp, Homo sapiens
ataaatagataataa

SEQ ID NO: 190275 - DNA, 15 bp, Homo sapiens
aataaatagataata

SEQ ID NO: 190276 - DNA, 15 bp, Homo sapiens
aaataaatagataat

SEQ ID NO: 190277 - DNA, 15 bp, Homo sapiens
taaataaatagataa

SEQ ID NO: 190278 - DNA, 15 bp, Homo sapiens
ataaataaatagata

SEQ ID NO: 190279 - DNA, 15 bp, Homo sapiens
aataaataaatagat

SEQ ID NO: 190280 - DNA, 15 bp, Homo sapiens
aaataaataaataga

SEQ ID NO: 190281 - DNA, 15 bp, Homo sapiens
taaataaataaatag

SEQ ID NO: 190282 - DNA, 15 bp, Homo sapiens
caaaaataaataaat

SEQ ID NO: 190283 - DNA, 15 bp, Homo sapiens
tcaaaaataaataaa

SEQ ID NO: 190284 - DNA, 15 bp, Homo sapiens
ctcaaaaataaataa

SEQ ID NO: 190285 - DNA, 15 bp, Homo sapiens
tctcaaaaataaata

SEQ ID NO: 190286 - DNA, 15 bp, Homo sapiens
gtctcaaaaataaat

SEQ ID NO: 190287 - DNA, 15 bp, Homo sapiens
tgtctcaaaaataaa

SEQ ID NO: 190288 - DNA, 15 bp, Homo sapiens
ttgtctcaaaaataa

SEQ ID NO: 190289 - DNA, 15 bp, Homo sapiens
tttgtctcaaaaata

SEQ ID NO: 190290 - DNA, 15 bp, Homo sapiens
ttttgtctcaaaaat

SEQ ID NO: 190291 - DNA, 15 bp, Homo sapiens
cttttgtctcaaaaa

SEQ ID NO: 190292 - DNA, 15 bp, Homo sapiens
ccttttgtctcaaaa

SEQ ID NO: 190293 - DNA, 15 bp, Homo sapiens
gccttttgtctcaaa

SEQ ID NO: 190294 - DNA, 15 bp, Homo sapiens
cgccttttgtctcaa

SEQ ID NO: 190295 - DNA, 15 bp, Homo sapiens
tcgccttttgtctca

SEQ ID NO: 190296 - DNA, 15 bp, Homo sapiens
ttcgccttttgtctc

SEQ ID NO: 190297 - DNA, 15 bp, Homo sapiens
gttcgccttttgtct

SEQ ID NO: 190298 - DNA, 15 bp, Homo sapiens
agttcgccttttgtc

SEQ ID NO: 190299 - DNA, 15 bp, Homo sapiens
gagttcgccttttgt

SEQ ID NO: 190300 - DNA, 15 bp, Homo sapiens
tgagttcgccttttg

SEQ ID NO: 190301 - DNA, 15 bp, Homo sapiens
ttgagttcgcctttt

SEQ ID NO: 190302 - DNA, 15 bp, Homo sapiens
tttgagttcgccttt

SEQ ID NO: 190303 - DNA, 15 bp, Homo sapiens
ctttgagttcgcctt

SEQ ID NO: 190304 - DNA, 15 bp, Homo sapiens
tctttgagttcgcct

SEQ ID NO: 190305 - DNA, 15 bp, Homo sapiens
ttctttgagttcgcc

SEQ ID NO: 190306 - DNA, 15 bp, Homo sapiens
tttctttgagttcgc

SEQ ID NO: 190307 - DNA, 15 bp, Homo sapiens
gtttctttgagttcg

SEQ ID NO: 190308 - DNA, 15 bp, Homo sapiens
tgtttctttgagttc

SEQ ID NO: 190309 - DNA, 15 bp, Homo sapiens
ctgtttctttgagtt

SEQ ID NO: 190310 - DNA, 15 bp, Homo sapiens
actgtttctttgagt

SEQ ID NO: 190311 - DNA, 15 bp, Homo sapiens
gactgtttctttgag

SEQ ID NO: 190312 - DNA, 15 bp, Homo sapiens
ggactgtttctttga

SEQ ID NO: 190313 - DNA, 15 bp, Homo sapiens
aggactgtttctttg

SEQ ID NO: 190314 - DNA, 15 bp, Homo sapiens
caggactgtttcttt

SEQ ID NO: 190315 - DNA, 15 bp, Homo sapiens
tcaggactgtttctt

SEQ ID NO: 190316 - DNA, 15 bp, Homo sapiens
atcaggactgtttct

SEQ ID NO: 190317 - DNA, 15 bp, Homo sapiens
catcaggactgtttc

SEQ ID NO: 190318 - DNA, 15 bp, Homo sapiens
acatcaggactgttt

SEQ ID NO: 190319 - DNA, 15 bp, Homo sapiens
tacatcaggactgtt

SEQ ID NO: 190320 - DNA, 15 bp, Homo sapiens
ttacatcaggactgt

SEQ ID NO: 190321 - DNA, 15 bp, Homo sapiens
attacatcaggactg

SEQ ID NO: 190322 - DNA, 15 bp, Homo sapiens
aattacatcaggact

SEQ ID NO: 190323 - DNA, 15 bp, Homo sapiens
gaattacatcaggac

SEQ ID NO: 190324 - DNA, 15 bp, Homo sapiens
agaattacatcagga

SEQ ID NO: 190325 - DNA, 15 bp, Homo sapiens
gagaattacatcagg

SEQ ID NO: 190326 - DNA, 15 bp, Homo sapiens
tgagaattacatcag

SEQ ID NO: 190327 - DNA, 15 bp, Homo sapiens
ctgagaattacatca

SEQ ID NO: 190328 - DNA, 15 bp, Homo sapiens
actgagaattacatc

SEQ ID NO: 190329 - DNA, 15 bp, Homo sapiens
gactgagaattacat

SEQ ID NO: 190330 - DNA, 15 bp, Homo sapiens
agactgagaattaca

SEQ ID NO: 190331 - DNA, 15 bp, Homo sapiens
cagactgagaattac

SEQ ID NO: 190332 - DNA, 15 bp, Homo sapiens
tcagactgagaatta

SEQ ID NO: 190333 - DNA, 15 bp, Homo sapiens
ttcagactgagaatt

SEQ ID NO: 190334 - DNA, 15 bp, Homo sapiens
cttcagactgagaat

SEQ ID NO: 190335 - DNA, 15 bp, Homo sapiens
acttcagactgagaa

SEQ ID NO: 190336 - DNA, 15 bp, Homo sapiens
aacttcagactgaga

SEQ ID NO: 190337 - DNA, 15 bp, Homo sapiens
gaacttcagactgag

SEQ ID NO: 190338 - DNA, 15 bp, Homo sapiens
agaacttcagactga

SEQ ID NO: 190339 - DNA, 15 bp, Homo sapiens
gagaacttcagactg

SEQ ID NO: 190340 - DNA, 15 bp, Homo sapiens
ggagaacttcagact

SEQ ID NO: 190341 - DNA, 15 bp, Homo sapiens
tggagaacttcagac

SEQ ID NO: 190342 - DNA, 15 bp, Homo sapiens
atggagaacttcaga

SEQ ID NO: 190343 - DNA, 15 bp, Homo sapiens
tatggagaacttcag

SEQ ID NO: 190344 - DNA, 15 bp, Homo sapiens
atatggagaacttca

SEQ ID NO: 190345 - DNA, 15 bp, Homo sapiens
tatatggagaacttc

SEQ ID NO: 190346 - DNA, 15 bp, Homo sapiens
atatatggagaactt

SEQ ID NO: 190347 - DNA, 15 bp, Homo sapiens
catatatggagaact

SEQ ID NO: 190348 - DNA, 15 bp, Homo sapiens
acatatatggagaac

SEQ ID NO: 190349 - DNA, 15 bp, Homo sapiens
cacatatatggagaa

SEQ ID NO: 190350 - DNA, 15 bp, Homo sapiens
acacatatatggaga

SEQ ID NO: 190351 - DNA, 15 bp, Homo sapiens
tacacatatatggag

SEQ ID NO: 190352 - DNA, 15 bp, Homo sapiens
atacacatatatgga

SEQ ID NO: 190353 - DNA, 15 bp, Homo sapiens
aatacacatatatgg

SEQ ID NO: 190354 - DNA, 15 bp, Homo sapiens
aaatacacatatatg

SEQ ID NO: 190355 - DNA, 15 bp, Homo sapiens
aaaatacacatatat

SEQ ID NO: 190356 - DNA, 15 bp, Homo sapiens
aaaaatacacatata

SEQ ID NO: 190357 - DNA, 15 bp, Homo sapiens
caaaaatacacatat

SEQ ID NO: 190358 - DNA, 15 bp, Homo sapiens
acaaaaatacacata

SEQ ID NO: 190359 - DNA, 15 bp, Homo sapiens
cacaaaaatacacat

SEQ ID NO: 190360 - DNA, 15 bp, Homo sapiens
acacaaaaatacaca

SEQ ID NO: 190361 - DNA, 15 bp, Homo sapiens
aacacaaaaatacac

SEQ ID NO: 190362 - DNA, 15 bp, Homo sapiens
taacacaaaaataca

SEQ ID NO: 190363 - DNA, 15 bp, Homo sapiens
ctaacacaaaaatac

SEQ ID NO: 190364 - DNA, 15 bp, Homo sapiens
cctaacacaaaaata

SEQ ID NO: 190365 - DNA, 15 bp, Homo sapiens
gcctaacacaaaaat

SEQ ID NO: 190366 - DNA, 15 bp, Homo sapiens
tgcctaacacaaaaa

SEQ ID NO: 190367 - DNA, 15 bp, Homo sapiens
ctgcctaacacaaaa

SEQ ID NO: 190368 - DNA, 15 bp, Homo sapiens
actgcctaacacaaa

SEQ ID NO: 190369 - DNA, 15 bp, Homo sapiens
aactgcctaacacaa

SEQ ID NO: 190370 - DNA, 15 bp, Homo sapiens
aaactgcctaacaca

SEQ ID NO: 190371 - DNA, 15 bp, Homo sapiens
aaaactgcctaacac

SEQ ID NO: 190372 - DNA, 15 bp, Homo sapiens
taaaactgcctaaca

SEQ ID NO: 190373 - DNA, 15 bp, Homo sapiens
ataaaactgcctaac

SEQ ID NO: 190374 - DNA, 15 bp, Homo sapiens
tataaaactgcctaa

SEQ ID NO: 190375 - DNA, 15 bp, Homo sapiens
ttataaaactgccta

SEQ ID NO: 190376 - DNA, 15 bp, Homo sapiens
tttataaaactgcct

SEQ ID NO: 190377 - DNA, 15 bp, Homo sapiens
ttttataaaactgcc

SEQ ID NO: 190378 - DNA, 15 bp, Homo sapiens
tttttataaaactgc

SEQ ID NO: 190379 - DNA, 15 bp, Homo sapiens
gtttttataaaactg

SEQ ID NO: 190380 - DNA, 15 bp, Homo sapiens
ggtttttataaaact

SEQ ID NO: 190381 - DNA, 15 bp, Homo sapiens
aggtttttataaaac

SEQ ID NO: 190382 - DNA, 15 bp, Homo sapiens
taggtttttataaaa

SEQ ID NO: 190383 - DNA, 15 bp, Homo sapiens
ataggtttttataaa

SEQ ID NO: 190384 - DNA, 15 bp, Homo sapiens
cataggtttttataa

SEQ ID NO: 190385 - DNA, 15 bp, Homo sapiens
acataggtttttata

SEQ ID NO: 190386 - DNA, 15 bp, Homo sapiens
cacataggtttttat

SEQ ID NO: 190387 - DNA, 15 bp, Homo sapiens
tcacataggttttta

SEQ ID NO: 190388 - DNA, 15 bp, Homo sapiens
ttcacataggttttt

SEQ ID NO: 190389 - DNA, 15 bp, Homo sapiens
tttcacataggtttt

SEQ ID NO: 190390 - DNA, 15 bp, Homo sapiens
ctttcacataggttt

SEQ ID NO: 190391 - DNA, 15 bp, Homo sapiens
actttcacataggtt

SEQ ID NO: 190392 - DNA, 15 bp, Homo sapiens
aactttcacataggt

SEQ ID NO: 190393 - DNA, 15 bp, Homo sapiens
caactttcacatagg

SEQ ID NO: 190394 - DNA, 15 bp, Homo sapiens
tcaactttcacatag

SEQ ID NO: 190395 - DNA, 15 bp, Homo sapiens
atcaactttcacata

SEQ ID NO: 190396 - DNA, 15 bp, Homo sapiens
gatcaactttcacat

SEQ ID NO: 190397 - DNA, 15 bp, Homo sapiens
agatcaactttcaca

SEQ ID NO: 190398 - DNA, 15 bp, Homo sapiens
gagatcaactttcac

SEQ ID NO: 190399 - DNA, 15 bp, Homo sapiens
agagatcaactttca

SEQ ID NO: 190400 - DNA, 15 bp, Homo sapiens
aagagatcaactttc

SEQ ID NO: 190401 - DNA, 15 bp, Homo sapiens
aaagagatcaacttt

SEQ ID NO: 190402 - DNA, 15 bp, Homo sapiens
caaagagatcaactt

SEQ ID NO: 190403 - DNA, 15 bp, Homo sapiens
ccaaagagatcaact

SEQ ID NO: 190404 - DNA, 15 bp, Homo sapiens
gccaaagagatcaac

SEQ ID NO: 190405 - DNA, 15 bp, Homo sapiens
ggccaaagagatcaa

SEQ ID NO: 190406 - DNA, 15 bp, Homo sapiens
cggccaaagagatca

SEQ ID NO: 190407 - DNA, 15 bp, Homo sapiens
acggccaaagagatc

SEQ ID NO: 190408 - DNA, 15 bp, Homo sapiens
tacggccaaagagat

SEQ ID NO: 190409 - DNA, 15 bp, Homo sapiens
atacggccaaagaga

SEQ ID NO: 190410 - DNA, 15 bp, Homo sapiens
aatacggccaaagag

SEQ ID NO: 190411 - DNA, 15 bp, Homo sapiens
aaatacggccaaaga

SEQ ID NO: 190412 - DNA, 15 bp, Homo sapiens
aaaatacggccaaag

SEQ ID NO: 190413 - DNA, 15 bp, Homo sapiens
taaaatacggccaaa

SEQ ID NO: 190414 - DNA, 15 bp, Homo sapiens
gtaaaatacggccaa

SEQ ID NO: 190415 - DNA, 15 bp, Homo sapiens
agtaaaatacggcca

SEQ ID NO: 190416 - DNA, 15 bp, Homo sapiens
aagtaaaatacggcc

SEQ ID NO: 190417 - DNA, 15 bp, Homo sapiens
gaagtaaaatacggc

SEQ ID NO: 190418 - DNA, 15 bp, Homo sapiens
agaagtaaaatacgg

SEQ ID NO: 190419 - DNA, 15 bp, Homo sapiens
tagaagtaaaatacg

SEQ ID NO: 190420 - DNA, 15 bp, Homo sapiens
ctagaagtaaaatac

SEQ ID NO: 190421 - DNA, 15 bp, Homo sapiens
cctagaagtaaaata

SEQ ID NO: 190422 - DNA, 15 bp, Homo sapiens
tcctagaagtaaaat

SEQ ID NO: 190423 - DNA, 15 bp, Homo sapiens
ttcctagaagtaaaa

SEQ ID NO: 190424 - DNA, 15 bp, Homo sapiens
cttcctagaagtaaa

SEQ ID NO: 190425 - DNA, 15 bp, Homo sapiens
acttcctagaagtaa

SEQ ID NO: 190426 - DNA, 15 bp, Homo sapiens
aacttcctagaagta

SEQ ID NO: 190427 - DNA, 15 bp, Homo sapiens
caacttcctagaagt

SEQ ID NO: 190428 - DNA, 15 bp, Homo sapiens
acaacttcctagaag

SEQ ID NO: 190429 - DNA, 15 bp, Homo sapiens
gacaacttcctagaa

SEQ ID NO: 190430 - DNA, 15 bp, Homo sapiens
cgacaacttcctaga

SEQ ID NO: 190431 - DNA, 15 bp, Homo sapiens
acgacaacttcctag

SEQ ID NO: 190432 - DNA, 15 bp, Homo sapiens
tacgacaacttccta

SEQ ID NO: 190433 - DNA, 15 bp, Homo sapiens
gtacgacaacttcct

SEQ ID NO: 190434 - DNA, 15 bp, Homo sapiens
tgtacgacaacttcc

SEQ ID NO: 190435 - DNA, 15 bp, Homo sapiens
atgtacgacaacttc

SEQ ID NO: 190436 - DNA, 15 bp, Homo sapiens
catgtacgacaactt

SEQ ID NO: 190437 - DNA, 15 bp, Homo sapiens
tcatgtacgacaact

SEQ ID NO: 190438 - DNA, 15 bp, Homo sapiens
ttcatgtacgacaac

SEQ ID NO: 190439 - DNA, 15 bp, Homo sapiens
attcatgtacgacaa

SEQ ID NO: 190440 - DNA, 15 bp, Homo sapiens
cattcatgtacgaca

SEQ ID NO: 190441 - DNA, 15 bp, Homo sapiens
acattcatgtacgac

SEQ ID NO: 190442 - DNA, 15 bp, Homo sapiens
tacattcatgtacga

SEQ ID NO: 190443 - DNA, 15 bp, Homo sapiens
atacattcatgtacg

SEQ ID NO: 190444 - DNA, 15 bp, Homo sapiens
aatacattcatgtac

SEQ ID NO: 190445 - DNA, 15 bp, Homo sapiens
gaatacattcatgta

SEQ ID NO: 190446 - DNA, 15 bp, Homo sapiens
agaatacattcatgt

SEQ ID NO: 190447 - DNA, 15 bp, Homo sapiens
aagaatacattcatg

SEQ ID NO: 190448 - DNA, 15 bp, Homo sapiens
aaagaatacattcat

SEQ ID NO: 190449 - DNA, 15 bp, Homo sapiens
gaaagaatacattca

SEQ ID NO: 190450 - DNA, 15 bp, Homo sapiens
ggaaagaatacattc

SEQ ID NO: 190451 - DNA, 15 bp, Homo sapiens
tggaaagaatacatt

SEQ ID NO: 190452 - DNA, 15 bp, Homo sapiens
ttggaaagaatacat

SEQ ID NO: 190453 - DNA, 15 bp, Homo sapiens
tttggaaagaataca

SEQ ID NO: 190454 - DNA, 15 bp, Homo sapiens
ctttggaaagaatac

SEQ ID NO: 190455 - DNA, 15 bp, Homo sapiens
actttggaaagaata

SEQ ID NO: 190456 - DNA, 15 bp, Homo sapiens
cactttggaaagaat

SEQ ID NO: 190457 - DNA, 15 bp, Homo sapiens
acactttggaaagaa

SEQ ID NO: 190458 - DNA, 15 bp, Homo sapiens
aacactttggaaaga

SEQ ID NO: 190459 - DNA, 15 bp, Homo sapiens
taacactttggaaag

SEQ ID NO: 190460 - DNA, 15 bp, Homo sapiens
ttaacactttggaaa

SEQ ID NO: 190461 - DNA, 15 bp, Homo sapiens
attaacactttggaa

SEQ ID NO: 190462 - DNA, 15 bp, Homo sapiens
tattaacactttgga

SEQ ID NO: 190463 - DNA, 15 bp, Homo sapiens
ttattaacactttgg

SEQ ID NO: 190464 - DNA, 15 bp, Homo sapiens
tttattaacactttg

SEQ ID NO: 190465 - DNA, 15 bp, Homo sapiens
ttttattaacacttt

SEQ ID NO: 190466 - DNA, 15 bp, Homo sapiens
attttattaacactt

SEQ ID NO: 190467 - DNA, 15 bp, Homo sapiens
gattttattaacact

SEQ ID NO: 190468 - DNA, 15 bp, Homo sapiens
ggattttattaacac

SEQ ID NO: 190469 - DNA, 15 bp, Homo sapiens
aggattttattaaca

SEQ ID NO: 190470 - DNA, 15 bp, Homo sapiens
aaggattttattaac

SEQ ID NO: 190471 - DNA, 15 bp, Homo sapiens
aaaggattttattaa

SEQ ID NO: 190472 - DNA, 15 bp, Homo sapiens
caaaggattttatta

SEQ ID NO: 190473 - DNA, 15 bp, Homo sapiens
gcaaaggattttatt

SEQ ID NO: 190474 - DNA, 15 bp, Homo sapiens
cgcaaaggattttat

SEQ ID NO: 190475 - DNA, 15 bp, Homo sapiens
acgcaaaggatttta

SEQ ID NO: 190476 - DNA, 15 bp, Homo sapiens
tacgcaaaggatttt

SEQ ID NO: 190477 - DNA, 15 bp, Homo sapiens
atacgcaaaggattt

SEQ ID NO: 190478 - DNA, 15 bp, Homo sapiens
aatacgcaaaggatt

SEQ ID NO: 190479 - DNA, 15 bp, Homo sapiens
gaatacgcaaaggat

SEQ ID NO: 190480 - DNA, 15 bp, Homo sapiens
agaatacgcaaagga

SEQ ID NO: 190481 - DNA, 15 bp, Homo sapiens
aagaatacgcaaagg

SEQ ID NO: 190482 - DNA, 15 bp, Homo sapiens
taagaatacgcaaag

SEQ ID NO: 190483 - DNA, 15 bp, Homo sapiens
gtaagaatacgcaaa

SEQ ID NO: 190484 - DNA, 15 bp, Homo sapiens
tgtaagaatacgcaa

SEQ ID NO: 190485 - DNA, 15 bp, Homo sapiens
ttgtaagaatacgca

SEQ ID NO: 190486 - DNA, 15 bp, Homo sapiens
tttgtaagaatacgc

SEQ ID NO: 190487 - DNA, 15 bp, Homo sapiens
ttttgtaagaatacg

SEQ ID NO: 190488 - DNA, 15 bp, Homo sapiens
attttgtaagaatac

SEQ ID NO: 190489 - DNA, 15 bp, Homo sapiens
gattttgtaagaata

SEQ ID NO: 190490 - DNA, 15 bp, Homo sapiens
agattttgtaagaat

SEQ ID NO: 190491 - DNA, 15 bp, Homo sapiens
cagattttgtaagaa

SEQ ID NO: 190492 - DNA, 15 bp, Homo sapiens
acagattttgtaaga

SEQ ID NO: 190493 - DNA, 15 bp, Homo sapiens
gacagattttgtaag

SEQ ID NO: 190494 - DNA, 15 bp, Homo sapiens
agacagattttgtaa

SEQ ID NO: 190495 - DNA, 15 bp, Homo sapiens
gagacagattttgta

SEQ ID NO: 190496 - DNA, 15 bp, Homo sapiens
tgagacagattttgt

SEQ ID NO: 190497 - DNA, 15 bp, Homo sapiens
atgagacagattttg

SEQ ID NO: 190498 - DNA, 15 bp, Homo sapiens
tatgagacagatttt

SEQ ID NO: 190499 - DNA, 15 bp, Homo sapiens
tatatgagacagatt

SEQ ID NO: 190500 - DNA, 15 bp, Homo sapiens
atatatgagacagat

SEQ ID NO: 190501 - DNA, 15 bp, Homo sapiens
aatatatgagacaga

SEQ ID NO: 190502 - DNA, 15 bp, Homo sapiens
caatatatgagacag

SEQ ID NO: 190503 - DNA, 15 bp, Homo sapiens
tcaatatatgagaca

SEQ ID NO: 190504 - DNA, 15 bp, Homo sapiens
ctcaatatatgagac

SEQ ID NO: 190505 - DNA, 15 bp, Homo sapiens
tctcaatatatgaga

SEQ ID NO: 190506 - DNA, 15 bp, Homo sapiens
atctcaatatatgag

SEQ ID NO: 190507 - DNA, 15 bp, Homo sapiens
catctcaatatatga

SEQ ID NO: 190508 - DNA, 15 bp, Homo sapiens
acatctcaatatatg

SEQ ID NO: 190509 - DNA, 15 bp, Homo sapiens
aacatctcaatatat

SEQ ID NO: 190510 - DNA, 15 bp, Homo sapiens
caacatctcaatata

SEQ ID NO: 190511 - DNA, 15 bp, Homo sapiens
gcaacatctcaatat

SEQ ID NO: 190512 - DNA, 15 bp, Homo sapiens
agcaacatctcaata

SEQ ID NO: 190513 - DNA, 15 bp, Homo sapiens
aagcaacatctcaat

SEQ ID NO: 190514 - DNA, 15 bp, Homo sapiens
gaagcaacatctcaa

SEQ ID NO: 190515 - DNA, 15 bp, Homo sapiens
tgaagcaacatctca

SEQ ID NO: 190516 - DNA, 15 bp, Homo sapiens
atgaagcaacatctc

SEQ ID NO: 190517 - DNA, 15 bp, Homo sapiens
aatgaagcaacatct

SEQ ID NO: 190518 - DNA, 15 bp, Homo sapiens
caatgaagcaacatc

SEQ ID NO: 190519 - DNA, 15 bp, Homo sapiens
ccaatgaagcaacat

SEQ ID NO: 190520 - DNA, 15 bp, Homo sapiens
accaatgaagcaaca

SEQ ID NO: 190521 - DNA, 15 bp, Homo sapiens
aaccaatgaagcaac

SEQ ID NO: 190522 - DNA, 15 bp, Homo sapiens
aaaccaatgaagcaa

SEQ ID NO: 190523 - DNA, 15 bp, Homo sapiens
taaaccaatgaagca

SEQ ID NO: 190524 - DNA, 15 bp, Homo sapiens
ataaaccaatgaagc

SEQ ID NO: 190525 - DNA, 15 bp, Homo sapiens
aataaaccaatgaag

SEQ ID NO: 190526 - DNA, 15 bp, Homo sapiens
caataaaccaatgaa

SEQ ID NO: 190527 - DNA, 15 bp, Homo sapiens
ccaataaaccaatga

SEQ ID NO: 190528 - DNA, 15 bp, Homo sapiens
gccaataaaccaatg

SEQ ID NO: 190529 - DNA, 15 bp, Homo sapiens
tgccaataaaccaat

SEQ ID NO: 190530 - DNA, 15 bp, Homo sapiens
ctgccaataaaccaa

SEQ ID NO: 190531 - DNA, 15 bp, Homo sapiens
cctgccaataaacca

SEQ ID NO: 190532 - DNA, 15 bp, Homo sapiens
tcctgccaataaacc

SEQ ID NO: 190533 - DNA, 15 bp, Homo sapiens
ttcctgccaataaac

SEQ ID NO: 190534 - DNA, 15 bp, Homo sapiens
tttcctgccaataaa

SEQ ID NO: 190535 - DNA, 15 bp, Homo sapiens
ttttcctgccaataa

SEQ ID NO: 190536 - DNA, 15 bp, Homo sapiens
gttttcctgccaata

SEQ ID NO: 190537 - DNA, 15 bp, Homo sapiens
agttttcctgccaat

SEQ ID NO: 190538 - DNA, 15 bp, Homo sapiens
cagttttcctgccaa

SEQ ID NO: 190539 - DNA, 15 bp, Homo sapiens
ccagttttcctgcca

SEQ ID NO: 190540 - DNA, 15 bp, Homo sapiens
tccagttttcctgcc

SEQ ID NO: 190541 - DNA, 15 bp, Homo sapiens
ttccagttttcctgc

SEQ ID NO: 190542 - DNA, 15 bp, Homo sapiens
attccagttttcctg

SEQ ID NO: 190543 - DNA, 15 bp, Homo sapiens
aattccagttttcct

SEQ ID NO: 190544 - DNA, 15 bp, Homo sapiens
taattccagttttcc

SEQ ID NO: 190545 - DNA, 15 bp, Homo sapiens
gtaattccagttttc

SEQ ID NO: 190546 - DNA, 15 bp, Homo sapiens
cgtaattccagtttt

SEQ ID NO: 190547 - DNA, 15 bp, Homo sapiens
ccgtaattccagttt

SEQ ID NO: 190548 - DNA, 15 bp, Homo sapiens
tccgtaattccagtt

SEQ ID NO: 190549 - DNA, 15 bp, Homo sapiens
ttccgtaattccagt

SEQ ID NO: 190550 - DNA, 15 bp, Homo sapiens
tttccgtaattccag

SEQ ID NO: 190551 - DNA, 15 bp, Homo sapiens
ttttccgtaattcca

SEQ ID NO: 190552 - DNA, 15 bp, Homo sapiens
cttttccgtaattcc

SEQ ID NO: 190553 - DNA, 15 bp, Homo sapiens
acttttccgtaattc

SEQ ID NO: 190554 - DNA, 15 bp, Homo sapiens
tacttttccgtaatt

SEQ ID NO: 190555 - DNA, 15 bp, Homo sapiens
atacttttccgtaat

SEQ ID NO: 190556 - DNA, 15 bp, Homo sapiens
gatacttttccgtaa

SEQ ID NO: 190557 - DNA, 15 bp, Homo sapiens
tgatacttttccgta

SEQ ID NO: 190558 - DNA, 15 bp, Homo sapiens
ctgatacttttccgt

SEQ ID NO: 190559 - DNA, 15 bp, Homo sapiens
actgatacttttccg

SEQ ID NO: 190560 - DNA, 15 bp, Homo sapiens
tactgatacttttcc

SEQ ID NO: 190561 - DNA, 15 bp, Homo sapiens
gtactgatacttttc

SEQ ID NO: 190562 - DNA, 15 bp, Homo sapiens
ggtactgatactttt

SEQ ID NO: 190563 - DNA, 15 bp, Homo sapiens
aggtactgatacttt

SEQ ID NO: 190564 - DNA, 15 bp, Homo sapiens
gaggtactgatactt

SEQ ID NO: 190565 - DNA, 15 bp, Homo sapiens
tgaggtactgatact

SEQ ID NO: 190566 - DNA, 15 bp, Homo sapiens
gtgaggtactgatac

SEQ ID NO: 190567 - DNA, 15 bp, Homo sapiens
tgtgaggtactgata

SEQ ID NO: 190568 - DNA, 15 bp, Homo sapiens
gtgtgaggtactgat

SEQ ID NO: 190569 - DNA, 15 bp, Homo sapiens
cgtgtgaggtactga

SEQ ID NO: 190570 - DNA, 15 bp, Homo sapiens
acgtgtgaggtactg

SEQ ID NO: 190571 - DNA, 15 bp, Homo sapiens
gacgtgtgaggtact

SEQ ID NO: 190572 - DNA, 15 bp, Homo sapiens
agacgtgtgaggtac

SEQ ID NO: 190573 - DNA, 15 bp, Homo sapiens
gagacgtgtgaggta

SEQ ID NO: 190574 - DNA, 15 bp, Homo sapiens
tgagacgtgtgaggt

SEQ ID NO: 190575 - DNA, 15 bp, Homo sapiens
ttgagacgtgtgagg

SEQ ID NO: 190576 - DNA, 15 bp, Homo sapiens
tttgagacgtgtgag

SEQ ID NO: 190577 - DNA, 15 bp, Homo sapiens
atttgagacgtgtga

SEQ ID NO: 190578 - DNA, 15 bp, Homo sapiens
tatttgagacgtgtg

SEQ ID NO: 190579 - DNA, 15 bp, Homo sapiens
gtatttgagacgtgt

SEQ ID NO: 190580 - DNA, 15 bp, Homo sapiens
tgtatttgagacgtg

SEQ ID NO: 190581 - DNA, 15 bp, Homo sapiens
ttgtatttgagacgt

SEQ ID NO: 190582 - DNA, 15 bp, Homo sapiens
gttgtatttgagacg

SEQ ID NO: 190583 - DNA, 15 bp, Homo sapiens
agttgtatttgagac

SEQ ID NO: 190584 - DNA, 15 bp, Homo sapiens
tagttgtatttgaga

SEQ ID NO: 190585 - DNA, 15 bp, Homo sapiens
ttagttgtatttgag

SEQ ID NO: 190586 - DNA, 15 bp, Homo sapiens
gttagttgtatttga

SEQ ID NO: 190587 - DNA, 15 bp, Homo sapiens
ggttagttgtatttg

SEQ ID NO: 190588 - DNA, 15 bp, Homo sapiens
tggttagttgtattt

SEQ ID NO: 190589 - DNA, 15 bp, Homo sapiens
gtggttagttgtatt

SEQ ID NO: 190590 - DNA, 15 bp, Homo sapiens
ggtggttagttgtat

SEQ ID NO: 190591 - DNA, 15 bp, Homo sapiens
aggtggttagttgta

SEQ ID NO: 190592 - DNA, 15 bp, Homo sapiens
aaggtggttagttgt

SEQ ID NO: 190593 - DNA, 15 bp, Homo sapiens
gaaggtggttagttg

SEQ ID NO: 190594 - DNA, 15 bp, Homo sapiens
ggaaggtggttagtt

SEQ ID NO: 190595 - DNA, 15 bp, Homo sapiens
gggaaggtggttagt

SEQ ID NO: 190596 - DNA, 15 bp, Homo sapiens
ggggaaggtggttag

SEQ ID NO: 190597 - DNA, 15 bp, Homo sapiens
gggggaaggtggtta

SEQ ID NO: 190598 - DNA, 15 bp, Homo sapiens
tgggggaaggtggtt

SEQ ID NO: 190599 - DNA, 15 bp, Homo sapiens
ttgggggaaggtggt

SEQ ID NO: 190600 - DNA, 15 bp, Homo sapiens
gttgggggaaggtgg

SEQ ID NO: 190601 - DNA, 15 bp, Homo sapiens
tgttgggggaaggtg

SEQ ID NO: 190602 - DNA, 15 bp, Homo sapiens
ttgttgggggaaggt

SEQ ID NO: 190603 - DNA, 15 bp, Homo sapiens
tttgttgggggaagg

SEQ ID NO: 190604 - DNA, 15 bp, Homo sapiens
ctttgttgggggaag

SEQ ID NO: 190605 - DNA, 15 bp, Homo sapiens
gctttgttgggggaa

SEQ ID NO: 190606 - DNA, 15 bp, Homo sapiens
tgctttgttggggga

SEQ ID NO: 190607 - DNA, 15 bp, Homo sapiens
ttgctttgttggggg

SEQ ID NO: 190608 - DNA, 15 bp, Homo sapiens
attgctttgttgggg

SEQ ID NO: 190609 - DNA, 15 bp, Homo sapiens
tattgctttgttggg

SEQ ID NO: 190610 - DNA, 15 bp, Homo sapiens
ttattgctttgttgg

SEQ ID NO: 190611 - DNA, 15 bp, Homo sapiens
attattgctttgttg

SEQ ID NO: 190612 - DNA, 15 bp, Homo sapiens
cattattgctttgtt

SEQ ID NO: 190613 - DNA, 15 bp, Homo sapiens
gcattattgctttgt

SEQ ID NO: 190614 - DNA, 15 bp, Homo sapiens
ggcattattgctttg

SEQ ID NO: 190615 - DNA, 15 bp, Homo sapiens
tggcattattgcttt

SEQ ID NO: 190616 - DNA, 15 bp, Homo sapiens
atggcattattgctt

SEQ ID NO: 190617 - DNA, 15 bp, Homo sapiens
aatggcattattgct

SEQ ID NO: 190618 - DNA, 15 bp, Homo sapiens
aaatggcattattgc

SEQ ID NO: 190619 - DNA, 15 bp, Homo sapiens
gaaatggcattattg

SEQ ID NO: 190620 - DNA, 15 bp, Homo sapiens
agaaatggcattatt

SEQ ID NO: 190621 - DNA, 15 bp, Homo sapiens
tagaaatggcattat

SEQ ID NO: 190622 - DNA, 15 bp, Homo sapiens
ctagaaatggcatta

SEQ ID NO: 190623 - DNA, 15 bp, Homo sapiens
cctagaaatggcatt

SEQ ID NO: 190624 - DNA, 15 bp, Homo sapiens
ccctagaaatggcat

SEQ ID NO: 190625 - DNA, 15 bp, Homo sapiens
tccctagaaatggca

SEQ ID NO: 190626 - DNA, 15 bp, Homo sapiens
ttccctagaaatggc

SEQ ID NO: 190627 - DNA, 15 bp, Homo sapiens
tttccctagaaatgg

SEQ ID NO: 190628 - DNA, 15 bp, Homo sapiens
ctttccctagaaatg

SEQ ID NO: 190629 - DNA, 15 bp, Homo sapiens
tctttccctagaaat

SEQ ID NO: 190630 - DNA, 15 bp, Homo sapiens
gtctttccctagaaa

SEQ ID NO: 190631 - DNA, 15 bp, Homo sapiens
ggtctttccctagaa

SEQ ID NO: 190632 - DNA, 15 bp, Homo sapiens
tggtctttccctaga

SEQ ID NO: 190633 - DNA, 15 bp, Homo sapiens
ttggtctttccctag

SEQ ID NO: 190634 - DNA, 15 bp, Homo sapiens
cttggtctttcccta

SEQ ID NO: 190635 - DNA, 15 bp, Homo sapiens
ccttggtctttccct

SEQ ID NO: 190636 - DNA, 15 bp, Homo sapiens
gccttggtctttccc

SEQ ID NO: 190637 - DNA, 15 bp, Homo sapiens
ggccttggtctttcc

SEQ ID NO: 190638 - DNA, 15 bp, Homo sapiens
aggccttggtctttc

SEQ ID NO: 190639 - DNA, 15 bp, Homo sapiens
taggccttggtcttt

SEQ ID NO: 190640 - DNA, 15 bp, Homo sapiens
gtaggccttggtctt

SEQ ID NO: 190641 - DNA, 15 bp, Homo sapiens
agtaggccttggtct

SEQ ID NO: 190642 - DNA, 15 bp, Homo sapiens
cagtaggccttggtc

SEQ ID NO: 190643 - DNA, 15 bp, Homo sapiens
gcagtaggccttggt

SEQ ID NO: 190644 - DNA, 15 bp, Homo sapiens
agcagtaggccttgg

SEQ ID NO: 190645 - DNA, 15 bp, Homo sapiens
tagcagtaggccttg

SEQ ID NO: 190646 - DNA, 15 bp, Homo sapiens
atagcagtaggcctt

SEQ ID NO: 190647 - DNA, 15 bp, Homo sapiens
tatagcagtaggcct

SEQ ID NO: 190648 - DNA, 15 bp, Homo sapiens
ttatagcagtaggcc

SEQ ID NO: 190649 - DNA, 15 bp, Homo sapiens
attatagcagtaggc

SEQ ID NO: 190650 - DNA, 15 bp, Homo sapiens
cattatagcagtagg

SEQ ID NO: 190651 - DNA, 15 bp, Homo sapiens
gcattatagcagtag

SEQ ID NO: 190652 - DNA, 15 bp, Homo sapiens
tgcattatagcagta

SEQ ID NO: 190653 - DNA, 15 bp, Homo sapiens
ctgcattatagcagt

SEQ ID NO: 190654 - DNA, 15 bp, Homo sapiens
tctgcattatagcag

SEQ ID NO: 190655 - DNA, 15 bp, Homo sapiens
ttctgcattatagca

SEQ ID NO: 190656 - DNA, 15 bp, Homo sapiens
cttctgcattatagc

SEQ ID NO: 190657 - DNA, 15 bp, Homo sapiens
gcttctgcattatag

SEQ ID NO: 190658 - DNA, 15 bp, Homo sapiens
ggcttctgcattata

SEQ ID NO: 190659 - DNA, 15 bp, Homo sapiens
tggcttctgcattat

SEQ ID NO: 190660 - DNA, 15 bp, Homo sapiens
gtggcttctgcatta

SEQ ID NO: 190661 - DNA, 15 bp, Homo sapiens
tgtggcttctgcatt

SEQ ID NO: 190662 - DNA, 15 bp, Homo sapiens
ctgtggcttctgcat

SEQ ID NO: 190663 - DNA, 15 bp, Homo sapiens
cctgtggcttctgca

SEQ ID NO: 190664 - DNA, 15 bp, Homo sapiens
tcctgtggcttctgc

SEQ ID NO: 190665 - DNA, 15 bp, Homo sapiens
atcctgtggcttctg

SEQ ID NO: 190666 - DNA, 15 bp, Homo sapiens
gatcctgtggcttct

SEQ ID NO: 190667 - DNA, 15 bp, Homo sapiens
ggatcctgtggcttc

SEQ ID NO: 190668 - DNA, 15 bp, Homo sapiens
gggatcctgtggctt

SEQ ID NO: 190669 - DNA, 15 bp, Homo sapiens
agggatcctgtggct

SEQ ID NO: 190670 - DNA, 15 bp, Homo sapiens
aagggatcctgtggc

SEQ ID NO: 190671 - DNA, 15 bp, Homo sapiens
gaagggatcctgtgg

SEQ ID NO: 190672 - DNA, 15 bp, Homo sapiens
tgaagggatcctgtg

SEQ ID NO: 190673 - DNA, 15 bp, Homo sapiens
ctgaagggatcctgt

SEQ ID NO: 190674 - DNA, 15 bp, Homo sapiens
tctgaagggatcctg

SEQ ID NO: 190675 - DNA, 15 bp, Homo sapiens
ttctgaagggatcct

SEQ ID NO: 190676 - DNA, 15 bp, Homo sapiens
cttctgaagggatcc

SEQ ID NO: 190677 - DNA, 15 bp, Homo sapiens
gcttctgaagggatc

SEQ ID NO: 190678 - DNA, 15 bp, Homo sapiens
agcttctgaagggat

SEQ ID NO: 190679 - DNA, 15 bp, Homo sapiens
cagcttctgaaggga

SEQ ID NO: 190680 - DNA, 15 bp, Homo sapiens
tcagcttctgaaggg

SEQ ID NO: 190681 - DNA, 15 bp, Homo sapiens
ctcagcttctgaagg

SEQ ID NO: 190682 - DNA, 15 bp, Homo sapiens
actcagcttctgaag

SEQ ID NO: 190683 - DNA, 15 bp, Homo sapiens
tactcagcttctgaa

SEQ ID NO: 190684 - DNA, 15 bp, Homo sapiens
ttactcagcttctga

SEQ ID NO: 190685 - DNA, 15 bp, Homo sapiens
gttactcagcttctg

SEQ ID NO: 190686 - DNA, 15 bp, Homo sapiens
tgttactcagcttct

SEQ ID NO: 190687 - DNA, 15 bp, Homo sapiens
ctgttactcagcttc

SEQ ID NO: 190688 - DNA, 15 bp, Homo sapiens
gctgttactcagctt

SEQ ID NO: 190689 - DNA, 15 bp, Homo sapiens
ggctgttactcagct

SEQ ID NO: 190690 - DNA, 15 bp, Homo sapiens
tggctgttactcagc

SEQ ID NO: 190691 - DNA, 15 bp, Homo sapiens
atggctgttactcag

SEQ ID NO: 190692 - DNA, 15 bp, Homo sapiens
aatggctgttactca

SEQ ID NO: 190693 - DNA, 15 bp, Homo sapiens
gaatggctgttactc

SEQ ID NO: 190694 - DNA, 15 bp, Homo sapiens
agaatggctgttact

SEQ ID NO: 190695 - DNA, 15 bp, Homo sapiens
tagaatggctgttac

SEQ ID NO: 190696 - DNA, 15 bp, Homo sapiens
gtagaatggctgtta

SEQ ID NO: 190697 - DNA, 15 bp, Homo sapiens
tgtagaatggctgtt

SEQ ID NO: 190698 - DNA, 15 bp, Homo sapiens
gtgtagaatggctgt

SEQ ID NO: 190699 - DNA, 15 bp, Homo sapiens
cgtgtagaatggctg

SEQ ID NO: 190700 - DNA, 15 bp, Homo sapiens
gcgtgtagaatggct

SEQ ID NO: 190701 - DNA, 15 bp, Homo sapiens
tgcgtgtagaatggc

SEQ ID NO: 190702 - DNA, 15 bp, Homo sapiens
ctgcgtgtagaatgg

SEQ ID NO: 190703 - DNA, 15 bp, Homo sapiens
tctgcgtgtagaatg

SEQ ID NO: 190704 - DNA, 15 bp, Homo sapiens
ctctgcgtgtagaat

SEQ ID NO: 190705 - DNA, 15 bp, Homo sapiens
cctctgcgtgtagaa

SEQ ID NO: 190706 - DNA, 15 bp, Homo sapiens
acctctgcgtgtaga

SEQ ID NO: 190707 - DNA, 15 bp, Homo sapiens
tacctctgcgtgtag

SEQ ID NO: 190708 - DNA, 15 bp, Homo sapiens
ctacctctgcgtgta

SEQ ID NO: 190709 - DNA, 15 bp, Homo sapiens
tctacctctgcgtgt

SEQ ID NO: 190710 - DNA, 15 bp, Homo sapiens
ctctacctctgcgtg

SEQ ID NO: 190711 - DNA, 15 bp, Homo sapiens
actctacctctgcgt

SEQ ID NO: 190712 - DNA, 15 bp, Homo sapiens
gactctacctctgcg

SEQ ID NO: 190713 - DNA, 15 bp, Homo sapiens
ggactctacctctgc

SEQ ID NO: 190714 - DNA, 15 bp, Homo sapiens
gggactctacctctg

SEQ ID NO: 190715 - DNA, 15 bp, Homo sapiens
agggactctacctct

SEQ ID NO: 190716 - DNA, 15 bp, Homo sapiens
aagggactctacctc

SEQ ID NO: 190717 - DNA, 15 bp, Homo sapiens
aaagggactctacct

SEQ ID NO: 190718 - DNA, 15 bp, Homo sapiens
taaagggactctacc

SEQ ID NO: 190719 - DNA, 15 bp, Homo sapiens
gtaaagggactctac

SEQ ID NO: 190720 - DNA, 15 bp, Homo sapiens
ggtaaagggactcta

SEQ ID NO: 190721 - DNA, 15 bp, Homo sapiens
gggtaaagggactct

SEQ ID NO: 190722 - DNA, 15 bp, Homo sapiens
agggtaaagggactc

SEQ ID NO: 190723 - DNA, 15 bp, Homo sapiens
gagggtaaagggact

SEQ ID NO: 190724 - DNA, 15 bp, Homo sapiens
tgagggtaaagggac

SEQ ID NO: 190725 - DNA, 15 bp, Homo sapiens
ttgagggtaaaggga

SEQ ID NO: 190726 - DNA, 15 bp, Homo sapiens
attgagggtaaaggg

SEQ ID NO: 190727 - DNA, 15 bp, Homo sapiens
aattgagggtaaagg

SEQ ID NO: 190728 - DNA, 15 bp, Homo sapiens
gaattgagggtaaag

SEQ ID NO: 190729 - DNA, 15 bp, Homo sapiens
agaattgagggtaaa

SEQ ID NO: 190730 - DNA, 15 bp, Homo sapiens
gagaattgagggtaa

SEQ ID NO: 190731 - DNA, 15 bp, Homo sapiens
tgagaattgagggta

SEQ ID NO: 190732 - DNA, 15 bp, Homo sapiens
ctgagaattgagggt

SEQ ID NO: 190733 - DNA, 15 bp, Homo sapiens
actgagaattgaggg

SEQ ID NO: 190734 - DNA, 15 bp, Homo sapiens
gactgagaattgagg

SEQ ID NO: 190735 - DNA, 15 bp, Homo sapiens
ggactgagaattgag

SEQ ID NO: 190736 - DNA, 15 bp, Homo sapiens
aggactgagaattga

SEQ ID NO: 190737 - DNA, 15 bp, Homo sapiens
caggactgagaattg

SEQ ID NO: 190738 - DNA, 15 bp, Homo sapiens
acaggactgagaatt

SEQ ID NO: 190739 - DNA, 15 bp, Homo sapiens
gacaggactgagaat

SEQ ID NO: 190740 - DNA, 15 bp, Homo sapiens
agacaggactgagaa

SEQ ID NO: 190741 - DNA, 15 bp, Homo sapiens
gagacaggactgaga

SEQ ID NO: 190742 - DNA, 15 bp, Homo sapiens
agagacaggactgag

SEQ ID NO: 190743 - DNA, 15 bp, Homo sapiens
aagagacaggactga

SEQ ID NO: 190744 - DNA, 15 bp, Homo sapiens
gaagagacaggactg

SEQ ID NO: 190745 - DNA, 15 bp, Homo sapiens
ggaagagacaggact

SEQ ID NO: 190746 - DNA, 15 bp, Homo sapiens
aggaagagacaggac

SEQ ID NO: 190747 - DNA, 15 bp, Homo sapiens
gaggaagagacagga

SEQ ID NO: 190748 - DNA, 15 bp, Homo sapiens
tgaggaagagacagg

SEQ ID NO: 190749 - DNA, 15 bp, Homo sapiens
ctgaggaagagacag

SEQ ID NO: 190750 - DNA, 15 bp, Homo sapiens
actgaggaagagaca

SEQ ID NO: 190751 - DNA, 15 bp, Homo sapiens
tactgaggaagagac

SEQ ID NO: 190752 - DNA, 15 bp, Homo sapiens
atactgaggaagaga

SEQ ID NO: 190753 - DNA, 15 bp, Homo sapiens
aatactgaggaagag

SEQ ID NO: 190754 - DNA, 15 bp, Homo sapiens
taatactgaggaaga

SEQ ID NO: 190755 - DNA, 15 bp, Homo sapiens
ctaatactgaggaag

SEQ ID NO: 190756 - DNA, 15 bp, Homo sapiens
actaatactgaggaa

SEQ ID NO: 190757 - DNA, 15 bp, Homo sapiens
tactaatactgagga

SEQ ID NO: 190758 - DNA, 15 bp, Homo sapiens
ttactaatactgagg

SEQ ID NO: 190759 - DNA, 15 bp, Homo sapiens
gttactaatactgag

SEQ ID NO: 190760 - DNA, 15 bp, Homo sapiens
ggttactaatactga

SEQ ID NO: 190761 - DNA, 15 bp, Homo sapiens
aggttactaatactg

SEQ ID NO: 190762 - DNA, 15 bp, Homo sapiens
caggttactaatact

SEQ ID NO: 190763 - DNA, 15 bp, Homo sapiens
acaggttactaatac

SEQ ID NO: 190764 - DNA, 15 bp, Homo sapiens
aacaggttactaata

SEQ ID NO: 190765 - DNA, 15 bp, Homo sapiens
aaacaggttactaat

SEQ ID NO: 190766 - DNA, 15 bp, Homo sapiens
gaaacaggttactaa

SEQ ID NO: 190767 - DNA, 15 bp, Homo sapiens
agaaacaggttacta

SEQ ID NO: 190768 - DNA, 15 bp, Homo sapiens
tagaaacaggttact

SEQ ID NO: 190769 - DNA, 15 bp, Homo sapiens
ctagaaacaggttac

SEQ ID NO: 190770 - DNA, 15 bp, Homo sapiens
tctagaaacaggtta

SEQ ID NO: 190771 - DNA, 15 bp, Homo sapiens
ctctagaaacaggtt

SEQ ID NO: 190772 - DNA, 15 bp, Homo sapiens
tctctagaaacaggt

SEQ ID NO: 190773 - DNA, 15 bp, Homo sapiens
ctctctagaaacagg

SEQ ID NO: 190774 - DNA, 15 bp, Homo sapiens
tctctctagaaacag

SEQ ID NO: 190775 - DNA, 15 bp, Homo sapiens
ttctctctagaaaca

SEQ ID NO: 190776 - DNA, 15 bp, Homo sapiens
attctctctagaaac

SEQ ID NO: 190777 - DNA, 15 bp, Homo sapiens
tattctctctagaaa

SEQ ID NO: 190778 - DNA, 15 bp, Homo sapiens
gtattctctctagaa

SEQ ID NO: 190779 - DNA, 15 bp, Homo sapiens
agtattctctctaga

SEQ ID NO: 190780 - DNA, 15 bp, Homo sapiens
tagtattctctctag

SEQ ID NO: 190781 - DNA, 15 bp, Homo sapiens
ctagtattctctcta

SEQ ID NO: 190782 - DNA, 15 bp, Homo sapiens
gctagtattctctct

SEQ ID NO: 190783 - DNA, 15 bp, Homo sapiens
ggctagtattctctc

SEQ ID NO: 190784 - DNA, 15 bp, Homo sapiens
aggctagtattctct

SEQ ID NO: 190785 - DNA, 15 bp, Homo sapiens
aaggctagtattctc

SEQ ID NO: 190786 - DNA, 15 bp, Homo sapiens
taaggctagtattct

SEQ ID NO: 190787 - DNA, 15 bp, Homo sapiens
ttaaggctagtattc

SEQ ID NO: 190788 - DNA, 15 bp, Homo sapiens
gttaaggctagtatt

SEQ ID NO: 190789 - DNA, 15 bp, Homo sapiens
cgttaaggctagtat

SEQ ID NO: 190790 - DNA, 15 bp, Homo sapiens
tcgttaaggctagta

SEQ ID NO: 190791 - DNA, 15 bp, Homo sapiens
atcgttaaggctagt

SEQ ID NO: 190792 - DNA, 15 bp, Homo sapiens
aatcgttaaggctag

SEQ ID NO: 190793 - DNA, 15 bp, Homo sapiens
aaatcgttaaggcta

SEQ ID NO: 190794 - DNA, 15 bp, Homo sapiens
taaatcgttaaggct

SEQ ID NO: 190795 - DNA, 15 bp, Homo sapiens
gtaaatcgttaaggc

SEQ ID NO: 190796 - DNA, 15 bp, Homo sapiens
ggtaaatcgttaagg

SEQ ID NO: 190797 - DNA, 15 bp, Homo sapiens
tggtaaatcgttaag

SEQ ID NO: 190798 - DNA, 15 bp, Homo sapiens
gtggtaaatcgttaa

SEQ ID NO: 190799 - DNA, 15 bp, Homo sapiens
agtggtaaatcgtta

SEQ ID NO: 190800 - DNA, 15 bp, Homo sapiens
aagtggtaaatcgtt

SEQ ID NO: 190801 - DNA, 15 bp, Homo sapiens
aaagtggtaaatcgt

SEQ ID NO: 190802 - DNA, 15 bp, Homo sapiens
aaaagtggtaaatcg

SEQ ID NO: 190803 - DNA, 15 bp, Homo sapiens
gaaaagtggtaaatc

SEQ ID NO: 190804 - DNA, 15 bp, Homo sapiens
tgaaaagtggtaaat

SEQ ID NO: 190805 - DNA, 15 bp, Homo sapiens
atgaaaagtggtaaa

SEQ ID NO: 190806 - DNA, 15 bp, Homo sapiens
tatgaaaagtggtaa

SEQ ID NO: 190807 - DNA, 15 bp, Homo sapiens
atatgaaaagtggta

SEQ ID NO: 190808 - DNA, 15 bp, Homo sapiens
gatatgaaaagtggt

SEQ ID NO: 190809 - DNA, 15 bp, Homo sapiens
tgatatgaaaagtgg

SEQ ID NO: 190810 - DNA, 15 bp, Homo sapiens
ctgatatgaaaagtg

SEQ ID NO: 190811 - DNA, 15 bp, Homo sapiens
gctgatatgaaaagt

SEQ ID NO: 190812 - DNA, 15 bp, Homo sapiens
tgctgatatgaaaag

SEQ ID NO: 190813 - DNA, 15 bp, Homo sapiens
ctgctgatatgaaaa

SEQ ID NO: 190814 - DNA, 15 bp, Homo sapiens
actgctgatatgaaa

SEQ ID NO: 190815 - DNA, 15 bp, Homo sapiens
aactgctgatatgaa

SEQ ID NO: 190816 - DNA, 15 bp, Homo sapiens
caactgctgatatga

SEQ ID NO: 190817 - DNA, 15 bp, Homo sapiens
acaactgctgatatg

SEQ ID NO: 190818 - DNA, 15 bp, Homo sapiens
gacaactgctgatat

SEQ ID NO: 190819 - DNA, 15 bp, Homo sapiens
tgacaactgctgata

SEQ ID NO: 190820 - DNA, 15 bp, Homo sapiens
atgacaactgctgat

SEQ ID NO: 190821 - DNA, 15 bp, Homo sapiens
aatgacaactgctga

SEQ ID NO: 190822 - DNA, 15 bp, Homo sapiens
caatgacaactgctg

SEQ ID NO: 190823 - DNA, 15 bp, Homo sapiens
acaatgacaactgct

SEQ ID NO: 190824 - DNA, 15 bp, Homo sapiens
aacaatgacaactgc

SEQ ID NO: 190825 - DNA, 15 bp, Homo sapiens
gaacaatgacaactg

SEQ ID NO: 190826 - DNA, 15 bp, Homo sapiens
tgaacaatgacaact

SEQ ID NO: 190827 - DNA, 15 bp, Homo sapiens
ctgaacaatgacaac

SEQ ID NO: 190828 - DNA, 15 bp, Homo sapiens
actgaacaatgacaa

SEQ ID NO: 190829 - DNA, 15 bp, Homo sapiens
gactgaacaatgaca

SEQ ID NO: 190830 - DNA, 15 bp, Homo sapiens
agactgaacaatgac

SEQ ID NO: 190831 - DNA, 15 bp, Homo sapiens
cagactgaacaatga

SEQ ID NO: 190832 - DNA, 15 bp, Homo sapiens
tcagactgaacaatg

SEQ ID NO: 190833 - DNA, 15 bp, Homo sapiens
ttcagactgaacaat

SEQ ID NO: 190834 - DNA, 15 bp, Homo sapiens
cttcagactgaacaa

SEQ ID NO: 190835 - DNA, 15 bp, Homo sapiens
acttcagactgaaca

SEQ ID NO: 190836 - DNA, 15 bp, Homo sapiens
aacttcagactgaac

SEQ ID NO: 190837 - DNA, 15 bp, Homo sapiens
aaacttcagactgaa

SEQ ID NO: 190838 - DNA, 15 bp, Homo sapiens
taaacttcagactga

SEQ ID NO: 190839 - DNA, 15 bp, Homo sapiens
ctaaacttcagactg

SEQ ID NO: 190840 - DNA, 15 bp, Homo sapiens
cctaaacttcagact

SEQ ID NO: 190841 - DNA, 15 bp, Homo sapiens
acctaaacttcagac

SEQ ID NO: 190842 - DNA, 15 bp, Homo sapiens
cacctaaacttcaga

SEQ ID NO: 190843 - DNA, 15 bp, Homo sapiens
tcacctaaacttcag

SEQ ID NO: 190844 - DNA, 15 bp, Homo sapiens
gtcacctaaacttca

SEQ ID NO: 190845 - DNA, 15 bp, Homo sapiens
ggtcacctaaacttc

SEQ ID NO: 190846 - DNA, 15 bp, Homo sapiens
tggtcacctaaactt

SEQ ID NO: 190847 - DNA, 15 bp, Homo sapiens
gtggtcacctaaact

SEQ ID NO: 190848 - DNA, 15 bp, Homo sapiens
tgtggtcacctaaac

SEQ ID NO: 190849 - DNA, 15 bp, Homo sapiens
ctgtggtcacctaaa

SEQ ID NO: 190850 - DNA, 15 bp, Homo sapiens
actgtggtcacctaa

SEQ ID NO: 190851 - DNA, 15 bp, Homo sapiens
tactgtggtcaccta

SEQ ID NO: 190852 - DNA, 15 bp, Homo sapiens
ctactgtggtcacct

SEQ ID NO: 190853 - DNA, 15 bp, Homo sapiens
tctactgtggtcacc

SEQ ID NO: 190854 - DNA, 15 bp, Homo sapiens
ttctactgtggtcac

SEQ ID NO: 190855 - DNA, 15 bp, Homo sapiens
tttctactgtggtca

SEQ ID NO: 190856 - DNA, 15 bp, Homo sapiens
ctttctactgtggtc

SEQ ID NO: 190857 - DNA, 15 bp, Homo sapiens
cctttctactgtggt

SEQ ID NO: 190858 - DNA, 15 bp, Homo sapiens
ccctttctactgtgg

SEQ ID NO: 190859 - DNA, 15 bp, Homo sapiens
cccctttctactgtg

SEQ ID NO: 190860 - DNA, 15 bp, Homo sapiens
tcccctttctactgt

SEQ ID NO: 190861 - DNA, 15 bp, Homo sapiens
atcccctttctactg

SEQ ID NO: 190862 - DNA, 15 bp, Homo sapiens
aatcccctttctact

SEQ ID NO: 190863 - DNA, 15 bp, Homo sapiens
aaatcccctttctac

SEQ ID NO: 190864 - DNA, 15 bp, Homo sapiens
aaaatcccctttcta

SEQ ID NO: 190865 - DNA, 15 bp, Homo sapiens
caaaatcccctttct

SEQ ID NO: 190866 - DNA, 15 bp, Homo sapiens
gcaaaatcccctttc

SEQ ID NO: 190867 - DNA, 15 bp, Homo sapiens
agcaaaatccccttt

SEQ ID NO: 190868 - DNA, 15 bp, Homo sapiens
cagcaaaatcccctt

SEQ ID NO: 190869 - DNA, 15 bp, Homo sapiens
acagcaaaatcccct

SEQ ID NO: 190870 - DNA, 15 bp, Homo sapiens
tacagcaaaatcccc

SEQ ID NO: 190871 - DNA, 15 bp, Homo sapiens
atacagcaaaatccc

SEQ ID NO: 190872 - DNA, 15 bp, Homo sapiens
aatacagcaaaatcc

SEQ ID NO: 190873 - DNA, 15 bp, Homo sapiens
gaatacagcaaaatc

SEQ ID NO: 190874 - DNA, 15 bp, Homo sapiens
ggaatacagcaaaat

SEQ ID NO: 190875 - DNA, 15 bp, Homo sapiens
aggaatacagcaaaa

SEQ ID NO: 190876 - DNA, 15 bp, Homo sapiens
caggaatacagcaaa

SEQ ID NO: 190877 - DNA, 15 bp, Homo sapiens
tcaggaatacagcaa

SEQ ID NO: 190878 - DNA, 15 bp, Homo sapiens
ttcaggaatacagca

SEQ ID NO: 190879 - DNA, 15 bp, Homo sapiens
cttcaggaatacagc

SEQ ID NO: 190880 - DNA, 15 bp, Homo sapiens
ccttcaggaatacag

SEQ ID NO: 190881 - DNA, 15 bp, Homo sapiens
tccttcaggaataca

SEQ ID NO: 190882 - DNA, 15 bp, Homo sapiens
ttccttcaggaatac

SEQ ID NO: 190883 - DNA, 15 bp, Homo sapiens
attccttcaggaata

SEQ ID NO: 190884 - DNA, 15 bp, Homo sapiens
aattccttcaggaat

SEQ ID NO: 190885 - DNA, 15 bp, Homo sapiens
aaattccttcaggaa

SEQ ID NO: 190886 - DNA, 15 bp, Homo sapiens
gaaattccttcagga

SEQ ID NO: 190887 - DNA, 15 bp, Homo sapiens
tgaaattccttcagg

SEQ ID NO: 190888 - DNA, 15 bp, Homo sapiens
ctgaaattccttcag

SEQ ID NO: 190889 - DNA, 15 bp, Homo sapiens
cctgaaattccttca

SEQ ID NO: 190890 - DNA, 15 bp, Homo sapiens
gcctgaaattccttc

SEQ ID NO: 190891 - DNA, 15 bp, Homo sapiens
agcctgaaattcctt

SEQ ID NO: 190892 - DNA, 15 bp, Homo sapiens
aagcctgaaattcct

SEQ ID NO: 190893 - DNA, 15 bp, Homo sapiens
aaagcctgaaattcc

SEQ ID NO: 190894 - DNA, 15 bp, Homo sapiens
taaagcctgaaattc

SEQ ID NO: 190895 - DNA, 15 bp, Homo sapiens
ttaaagcctgaaatt

SEQ ID NO: 190896 - DNA, 15 bp, Homo sapiens
cttaaagcctgaaat

SEQ ID NO: 190897 - DNA, 15 bp, Homo sapiens
tcttaaagcctgaaa

SEQ ID NO: 190898 - DNA, 15 bp, Homo sapiens
ttcttaaagcctgaa

SEQ ID NO: 190899 - DNA, 15 bp, Homo sapiens
tttcttaaagcctga

SEQ ID NO: 190900 - DNA, 15 bp, Homo sapiens
ttttcttaaagcctg

SEQ ID NO: 190901 - DNA, 15 bp, Homo sapiens
gttttcttaaagcct

SEQ ID NO: 190902 - DNA, 15 bp, Homo sapiens
cgttttcttaaagcc

SEQ ID NO: 190903 - DNA, 15 bp, Homo sapiens
tcgttttcttaaagc

SEQ ID NO: 190904 - DNA, 15 bp, Homo sapiens
ctcgttttcttaaag

SEQ ID NO: 190905 - DNA, 15 bp, Homo sapiens
cctcgttttcttaaa

SEQ ID NO: 190906 - DNA, 15 bp, Homo sapiens
ccctcgttttcttaa

SEQ ID NO: 190907 - DNA, 15 bp, Homo sapiens
accctcgttttctta

SEQ ID NO: 190908 - DNA, 15 bp, Homo sapiens
gaccctcgttttctt

SEQ ID NO: 190909 - DNA, 15 bp, Homo sapiens
ggaccctcgttttct

SEQ ID NO: 190910 - DNA, 15 bp, Homo sapiens
tggaccctcgttttc

SEQ ID NO: 190911 - DNA, 15 bp, Homo sapiens
gtggaccctcgtttt

SEQ ID NO: 190912 - DNA, 15 bp, Homo sapiens
agtggaccctcgttt

SEQ ID NO: 190913 - DNA, 15 bp, Homo sapiens
cagtggaccctcgtt

SEQ ID NO: 190914 - DNA, 15 bp, Homo sapiens
acagtggaccctcgt

SEQ ID NO: 190915 - DNA, 15 bp, Homo sapiens
aacagtggaccctcg

SEQ ID NO: 190916 - DNA, 15 bp, Homo sapiens
caacagtggaccctc

SEQ ID NO: 190917 - DNA, 15 bp, Homo sapiens
ccaacagtggaccct

SEQ ID NO: 190918 - DNA, 15 bp, Homo sapiens
tccaacagtggaccc

SEQ ID NO: 190919 - DNA, 15 bp, Homo sapiens
gtccaacagtggacc

SEQ ID NO: 190920 - DNA, 15 bp, Homo sapiens
agtccaacagtggac

SEQ ID NO: 190921 - DNA, 15 bp, Homo sapiens
tagtccaacagtgga

SEQ ID NO: 190922 - DNA, 15 bp, Homo sapiens
ctagtccaacagtgg

SEQ ID NO: 190923 - DNA, 15 bp, Homo sapiens
actagtccaacagtg

SEQ ID NO: 190924 - DNA, 15 bp, Homo sapiens
tactagtccaacagt

SEQ ID NO: 190925 - DNA, 15 bp, Homo sapiens
ctactagtccaacag

SEQ ID NO: 190926 - DNA, 15 bp, Homo sapiens
tctactagtccaaca

SEQ ID NO: 190927 - DNA, 15 bp, Homo sapiens
gtctactagtccaac

SEQ ID NO: 190928 - DNA, 15 bp, Homo sapiens
agtctactagtccaa

SEQ ID NO: 190929 - DNA, 15 bp, Homo sapiens
gagtctactagtcca

SEQ ID NO: 190930 - DNA, 15 bp, Homo sapiens
tgagtctactagtcc

SEQ ID NO: 190931 - DNA, 15 bp, Homo sapiens
ttgagtctactagtc

SEQ ID NO: 190932 - DNA, 15 bp, Homo sapiens
tttgagtctactagt

SEQ ID NO: 190933 - DNA, 15 bp, Homo sapiens
atttgagtctactag

SEQ ID NO: 190934 - DNA, 15 bp, Homo sapiens
gatttgagtctacta

SEQ ID NO: 190935 - DNA, 15 bp, Homo sapiens
ggatttgagtctact

SEQ ID NO: 190936 - DNA, 15 bp, Homo sapiens
aggatttgagtctac

SEQ ID NO: 190937 - DNA, 15 bp, Homo sapiens
caggatttgagtcta

SEQ ID NO: 190938 - DNA, 15 bp, Homo sapiens
tcaggatttgagtct

SEQ ID NO: 190939 - DNA, 15 bp, Homo sapiens
atcaggatttgagtc

SEQ ID NO: 190940 - DNA, 15 bp, Homo sapiens
tatcaggatttgagt

SEQ ID NO: 190941 - DNA, 15 bp, Homo sapiens
gtatcaggatttgag

SEQ ID NO: 190942 - DNA, 15 bp, Homo sapiens
cgtatcaggatttga

SEQ ID NO: 190943 - DNA, 15 bp, Homo sapiens
gcgtatcaggatttg

SEQ ID NO: 190944 - DNA, 15 bp, Homo sapiens
agcgtatcaggattt

SEQ ID NO: 190945 - DNA, 15 bp, Homo sapiens
aagcgtatcaggatt

SEQ ID NO: 190946 - DNA, 15 bp, Homo sapiens
taagcgtatcaggat

SEQ ID NO: 190947 - DNA, 15 bp, Homo sapiens
ctaagcgtatcagga

SEQ ID NO: 190948 - DNA, 15 bp, Homo sapiens
actaagcgtatcagg

SEQ ID NO: 190949 - DNA, 15 bp, Homo sapiens
tactaagcgtatcag

SEQ ID NO: 190950 - DNA, 15 bp, Homo sapiens
ctactaagcgtatca

SEQ ID NO: 190951 - DNA, 15 bp, Homo sapiens
actactaagcgtatc

SEQ ID NO: 190952 - DNA, 15 bp, Homo sapiens
aactactaagcgtat

SEQ ID NO: 190953 - DNA, 15 bp, Homo sapiens
caactactaagcgta

SEQ ID NO: 190954 - DNA, 15 bp, Homo sapiens
tcaactactaagcgt

SEQ ID NO: 190955 - DNA, 15 bp, Homo sapiens
ctcaactactaagcg

SEQ ID NO: 190956 - DNA, 15 bp, Homo sapiens
cctcaactactaagc

SEQ ID NO: 190957 - DNA, 15 bp, Homo sapiens
gcctcaactactaag

SEQ ID NO: 190958 - DNA, 15 bp, Homo sapiens
ggcctcaactactaa

SEQ ID NO: 190959 - DNA, 15 bp, Homo sapiens
tggcctcaactacta

SEQ ID NO: 190960 - DNA, 15 bp, Homo sapiens
ttggcctcaactact

SEQ ID NO: 190961 - DNA, 15 bp, Homo sapiens
gttggcctcaactac

SEQ ID NO: 190962 - DNA, 15 bp, Homo sapiens
tgttggcctcaacta

SEQ ID NO: 190963 - DNA, 15 bp, Homo sapiens
ctgttggcctcaact

SEQ ID NO: 190964 - DNA, 15 bp, Homo sapiens
gctgttggcctcaac

SEQ ID NO: 190965 - DNA, 15 bp, Homo sapiens
agctgttggcctcaa

SEQ ID NO: 190966 - DNA, 15 bp, Homo sapiens
cagctgttggcctca

SEQ ID NO: 190967 - DNA, 15 bp, Homo sapiens
tcagctgttggcctc

SEQ ID NO: 190968 - DNA, 15 bp, Homo sapiens
ctcagctgttggcct

SEQ ID NO: 190969 - DNA, 15 bp, Homo sapiens
gctcagctgttggcc

SEQ ID NO: 190970 - DNA, 15 bp, Homo sapiens
tgctcagctgttggc

SEQ ID NO: 190971 - DNA, 15 bp, Homo sapiens
ctgctcagctgttgg

SEQ ID NO: 190972 - DNA, 15 bp, Homo sapiens
gctgctcagctgttg

SEQ ID NO: 190973 - DNA, 15 bp, Homo sapiens
tgctgctcagctgtt

SEQ ID NO: 190974 - DNA, 15 bp, Homo sapiens
ctgctgctcagctgt

SEQ ID NO: 190975 - DNA, 15 bp, Homo sapiens
cctgctgctcagctg

SEQ ID NO: 190976 - DNA, 15 bp, Homo sapiens
gcctgctgctcagct

SEQ ID NO: 190977 - DNA, 15 bp, Homo sapiens
ggcctgctgctcagc

SEQ ID NO: 190978 - DNA, 15 bp, Homo sapiens
aggcctgctgctcag

SEQ ID NO: 190979 - DNA, 15 bp, Homo sapiens
aaggcctgctgctca

SEQ ID NO: 190980 - DNA, 15 bp, Homo sapiens
gaaggcctgctgctc

SEQ ID NO: 190981 - DNA, 15 bp, Homo sapiens
ggaaggcctgctgct

SEQ ID NO: 190982 - DNA, 15 bp, Homo sapiens
tggaaggcctgctgc

SEQ ID NO: 190983 - DNA, 15 bp, Homo sapiens
ttggaaggcctgctg

SEQ ID NO: 190984 - DNA, 15 bp, Homo sapiens
attggaaggcctgct

SEQ ID NO: 190985 - DNA, 15 bp, Homo sapiens
cattggaaggcctgc

SEQ ID NO: 190986 - DNA, 15 bp, Homo sapiens
ccattggaaggcctg

SEQ ID NO: 190987 - DNA, 15 bp, Homo sapiens
accattggaaggcct

SEQ ID NO: 190988 - DNA, 15 bp, Homo sapiens
caccattggaaggcc

SEQ ID NO: 190989 - DNA, 15 bp, Homo sapiens
ccaccattggaaggc

SEQ ID NO: 190990 - DNA, 15 bp, Homo sapiens
gccaccattggaagg

SEQ ID NO: 190991 - DNA, 15 bp, Homo sapiens
agccaccattggaag

SEQ ID NO: 190992 - DNA, 15 bp, Homo sapiens
tagccaccattggaa

SEQ ID NO: 190993 - DNA, 15 bp, Homo sapiens
ttagccaccattgga

SEQ ID NO: 190994 - DNA, 15 bp, Homo sapiens
attagccaccattgg

SEQ ID NO: 190995 - DNA, 15 bp, Homo sapiens
gattagccaccattg

SEQ ID NO: 190996 - DNA, 15 bp, Homo sapiens
agattagccaccatt

SEQ ID NO: 190997 - DNA, 15 bp, Homo sapiens
cagattagccaccat

SEQ ID NO: 190998 - DNA, 15 bp, Homo sapiens
ccagattagccacca

SEQ ID NO: 190999 - DNA, 15 bp, Homo sapiens
tccagattagccacc

SEQ ID NO: 191000 - DNA, 15 bp, Homo sapiens
ttccagattagccac

SEQ ID NO: 191001 - DNA, 15 bp, Homo sapiens
tttccagattagcca

SEQ ID NO: 191002 - DNA, 15 bp, Homo sapiens
ctttccagattagcc

SEQ ID NO: 191003 - DNA, 15 bp, Homo sapiens
actttccagattagc

SEQ ID NO: 191004 - DNA, 15 bp, Homo sapiens
aactttccagattag

SEQ ID NO: 191005 - DNA, 15 bp, Homo sapiens
taactttccagatta

SEQ ID NO: 191006 - DNA, 15 bp, Homo sapiens
ataactttccagatt

SEQ ID NO: 191007 - DNA, 15 bp, Homo sapiens
tataactttccagat

SEQ ID NO: 191008 - DNA, 15 bp, Homo sapiens
ctataactttccaga

SEQ ID NO: 191009 - DNA, 15 bp, Homo sapiens
tctataactttccag

SEQ ID NO: 191010 - DNA, 15 bp, Homo sapiens
gtctataactttcca

SEQ ID NO: 191011 - DNA, 15 bp, Homo sapiens
agtctataactttcc

SEQ ID NO: 191012 - DNA, 15 bp, Homo sapiens
cagtctataactttc

SEQ ID NO: 191013 - DNA, 15 bp, Homo sapiens
ccagtctataacttt

SEQ ID NO: 191014 - DNA, 15 bp, Homo sapiens
accagtctataactt

SEQ ID NO: 191015 - DNA, 15 bp, Homo sapiens
gaccagtctataact

SEQ ID NO: 191016 - DNA, 15 bp, Homo sapiens
tgaccagtctataac

SEQ ID NO: 191017 - DNA, 15 bp, Homo sapiens
ctgaccagtctataa

SEQ ID NO: 191018 - DNA, 15 bp, Homo sapiens
tctgaccagtctata

SEQ ID NO: 191019 - DNA, 15 bp, Homo sapiens
atctgaccagtctat

SEQ ID NO: 191020 - DNA, 15 bp, Homo sapiens
gatctgaccagtcta

SEQ ID NO: 191021 - DNA, 15 bp, Homo sapiens
tgatctgaccagtct

SEQ ID NO: 191022 - DNA, 15 bp, Homo sapiens
atgatctgaccagtc

SEQ ID NO: 191023 - DNA, 15 bp, Homo sapiens
aatgatctgaccagt

SEQ ID NO: 191024 - DNA, 15 bp, Homo sapiens
taatgatctgaccag

SEQ ID NO: 191025 - DNA, 15 bp, Homo sapiens
ttaatgatctgacca

SEQ ID NO: 191026 - DNA, 15 bp, Homo sapiens
tttaatgatctgacc

SEQ ID NO: 191027 - DNA, 15 bp, Homo sapiens
ttttaatgatctgac

SEQ ID NO: 191028 - DNA, 15 bp, Homo sapiens
attttaatgatctga

SEQ ID NO: 191029 - DNA, 15 bp, Homo sapiens
aattttaatgatctg

SEQ ID NO: 191030 - DNA, 15 bp, Homo sapiens
gaattttaatgatct

SEQ ID NO: 191031 - DNA, 15 bp, Homo sapiens
ggaattttaatgatc

SEQ ID NO: 191032 - DNA, 15 bp, Homo sapiens
gggaattttaatgat

SEQ ID NO: 191033 - DNA, 15 bp, Homo sapiens
tgggaattttaatga

SEQ ID NO: 191034 - DNA, 15 bp, Homo sapiens
ctgggaattttaatg

SEQ ID NO: 191035 - DNA, 15 bp, Homo sapiens
cctgggaattttaat

SEQ ID NO: 191036 - DNA, 15 bp, Homo sapiens
acctgggaattttaa

SEQ ID NO: 191037 - DNA, 15 bp, Homo sapiens
cacctgggaatttta

SEQ ID NO: 191038 - DNA, 15 bp, Homo sapiens
tcacctgggaatttt

SEQ ID NO: 191039 - DNA, 15 bp, Homo sapiens
ttcacctgggaattt

SEQ ID NO: 191040 - DNA, 15 bp, Homo sapiens
tttcacctgggaatt

SEQ ID NO: 191041 - DNA, 15 bp, Homo sapiens
ctttcacctgggaat

SEQ ID NO: 191042 - DNA, 15 bp, Homo sapiens
gctttcacctgggaa

SEQ ID NO: 191043 - DNA, 15 bp, Homo sapiens
tgctttcacctggga

SEQ ID NO: 191044 - DNA, 15 bp, Homo sapiens
ctgctttcacctggg

SEQ ID NO: 191045 - DNA, 15 bp, Homo sapiens
tctgctttcacctgg

SEQ ID NO: 191046 - DNA, 15 bp, Homo sapiens
gtctgctttcacctg

SEQ ID NO: 191047 - DNA, 15 bp, Homo sapiens
ggtctgctttcacct

SEQ ID NO: 191048 - DNA, 15 bp, Homo sapiens
aggtctgctttcacc

SEQ ID NO: 191049 - DNA, 15 bp, Homo sapiens
aaggtctgctttcac

SEQ ID NO: 191050 - DNA, 15 bp, Homo sapiens
gaaggtctgctttca

SEQ ID NO: 191051 - DNA, 15 bp, Homo sapiens
tgaaggtctgctttc

SEQ ID NO: 191052 - DNA, 15 bp, Homo sapiens
ctgaaggtctgcttt

SEQ ID NO: 191053 - DNA, 15 bp, Homo sapiens
gctgaaggtctgctt

SEQ ID NO: 191054 - DNA, 15 bp, Homo sapiens
tgctgaaggtctgct

SEQ ID NO: 191055 - DNA, 15 bp, Homo sapiens
atgctgaaggtctgc

SEQ ID NO: 191056 - DNA, 15 bp, Homo sapiens
tatgctgaaggtctg

SEQ ID NO: 191057 - DNA, 15 bp, Homo sapiens
ttatgctgaaggtct

SEQ ID NO: 191058 - DNA, 15 bp, Homo sapiens
gttatgctgaaggtc

SEQ ID NO: 191059 - DNA, 15 bp, Homo sapiens
agttatgctgaaggt

SEQ ID NO: 191060 - DNA, 15 bp, Homo sapiens
aagttatgctgaagg

SEQ ID NO: 191061 - DNA, 15 bp, Homo sapiens
aaagttatgctgaag

SEQ ID NO: 191062 - DNA, 15 bp, Homo sapiens
taaagttatgctgaa

SEQ ID NO: 191063 - DNA, 15 bp, Homo sapiens
ttaaagttatgctga

SEQ ID NO: 191064 - DNA, 15 bp, Homo sapiens
cttaaagttatgctg

SEQ ID NO: 191065 - DNA, 15 bp, Homo sapiens
tcttaaagttatgct

SEQ ID NO: 191066 - DNA, 15 bp, Homo sapiens
gtcttaaagttatgc

SEQ ID NO: 191067 - DNA, 15 bp, Homo sapiens
tgtcttaaagttatg

SEQ ID NO: 191068 - DNA, 15 bp, Homo sapiens
ctgtcttaaagttat

SEQ ID NO: 191069 - DNA, 15 bp, Homo sapiens
gctgtcttaaagtta

SEQ ID NO: 191070 - DNA, 15 bp, Homo sapiens
tgctgtcttaaagtt

SEQ ID NO: 191071 - DNA, 15 bp, Homo sapiens
ctgctgtcttaaagt

SEQ ID NO: 191072 - DNA, 15 bp, Homo sapiens
actgctgtcttaaag

SEQ ID NO: 191073 - DNA, 15 bp, Homo sapiens
aactgctgtcttaaa

SEQ ID NO: 191074 - DNA, 15 bp, Homo sapiens
aaactgctgtcttaa

SEQ ID NO: 191075 - DNA, 15 bp, Homo sapiens
aaaactgctgtctta

SEQ ID NO: 191076 - DNA, 15 bp, Homo sapiens
aaaaactgctgtctt

SEQ ID NO: 191077 - DNA, 15 bp, Homo sapiens
aaaaaactgctgtct

SEQ ID NO: 191078 - DNA, 15 bp, Homo sapiens
aaaaaaactgctgtc

SEQ ID NO: 191079 - DNA, 15 bp, Homo sapiens
caaaaaaactgctgt

SEQ ID NO: 191080 - DNA, 15 bp, Homo sapiens
acaaaaaaactgctg

SEQ ID NO: 191081 - DNA, 15 bp, Homo sapiens
cacaaaaaaactgct

SEQ ID NO: 191082 - DNA, 15 bp, Homo sapiens
tcacaaaaaaactgc

SEQ ID NO: 191083 - DNA, 15 bp, Homo sapiens
ttcacaaaaaaactg

SEQ ID NO: 191084 - DNA, 15 bp, Homo sapiens
cttcacaaaaaaact

SEQ ID NO: 191085 - DNA, 15 bp, Homo sapiens
ccttcacaaaaaaac

SEQ ID NO: 191086 - DNA, 15 bp, Homo sapiens
accttcacaaaaaaa

SEQ ID NO: 191087 - DNA, 15 bp, Homo sapiens
taccttcacaaaaaa

SEQ ID NO: 191088 - DNA, 15 bp, Homo sapiens
ttaccttcacaaaaa

SEQ ID NO: 191089 - DNA, 15 bp, Homo sapiens
tttaccttcacaaaa

SEQ ID NO: 191090 - DNA, 15 bp, Homo sapiens
atttaccttcacaaa

SEQ ID NO: 191091 - DNA, 15 bp, Homo sapiens
aatttaccttcacaa

SEQ ID NO: 191092 - DNA, 15 bp, Homo sapiens
caatttaccttcaca

SEQ ID NO: 191093 - DNA, 15 bp, Homo sapiens
tcaatttaccttcac

SEQ ID NO: 191094 - DNA, 15 bp, Homo sapiens
ttcaatttaccttca

SEQ ID NO: 191095 - DNA, 15 bp, Homo sapiens
tttcaatttaccttc

SEQ ID NO: 191096 - DNA, 15 bp, Homo sapiens
ctttcaatttacctt

SEQ ID NO: 191097 - DNA, 15 bp, Homo sapiens
cctttcaatttacct

SEQ ID NO: 191098 - DNA, 15 bp, Homo sapiens
ccctttcaatttacc

SEQ ID NO: 191099 - DNA, 15 bp, Homo sapiens
tccctttcaatttac

SEQ ID NO: 191100 - DNA, 15 bp, Homo sapiens
atccctttcaattta

SEQ ID NO: 191101 - DNA, 15 bp, Homo sapiens
tatccctttcaattt

SEQ ID NO: 191102 - DNA, 15 bp, Homo sapiens
atatccctttcaatt

SEQ ID NO: 191103 - DNA, 15 bp, Homo sapiens
aatatccctttcaat

SEQ ID NO: 191104 - DNA, 15 bp, Homo sapiens
aaatatccctttcaa

SEQ ID NO: 191105 - DNA, 15 bp, Homo sapiens
aaaatatccctttca

SEQ ID NO: 191106 - DNA, 15 bp, Homo sapiens
taaaatatccctttc

SEQ ID NO: 191107 - DNA, 15 bp, Homo sapiens
ctaaaatatcccttt

SEQ ID NO: 191108 - DNA, 15 bp, Homo sapiens
actaaaatatccctt

SEQ ID NO: 191109 - DNA, 15 bp, Homo sapiens
aactaaaatatccct

SEQ ID NO: 191110 - DNA, 15 bp, Homo sapiens
caactaaaatatccc

SEQ ID NO: 191111 - DNA, 15 bp, Homo sapiens
tcaactaaaatatcc

SEQ ID NO: 191112 - DNA, 15 bp, Homo sapiens
atcaactaaaatatc

SEQ ID NO: 191113 - DNA, 15 bp, Homo sapiens
tatcaactaaaatat

SEQ ID NO: 191114 - DNA, 15 bp, Homo sapiens
atatcaactaaaata

SEQ ID NO: 191115 - DNA, 15 bp, Homo sapiens
aatatcaactaaaat

SEQ ID NO: 191116 - DNA, 15 bp, Homo sapiens
aaatatcaactaaaa

SEQ ID NO: 191117 - DNA, 15 bp, Homo sapiens
aaaatatcaactaaa

SEQ ID NO: 191118 - DNA, 15 bp, Homo sapiens
aaaaatatcaactaa

SEQ ID NO: 191119 - DNA, 15 bp, Homo sapiens
caaaaatatcaacta

SEQ ID NO: 191120 - DNA, 15 bp, Homo sapiens
tcaaaaatatcaact

SEQ ID NO: 191121 - DNA, 15 bp, Homo sapiens
ttcaaaaatatcaac

SEQ ID NO: 191122 - DNA, 15 bp, Homo sapiens
attcaaaaatatcaa

SEQ ID NO: 191123 - DNA, 15 bp, Homo sapiens
aattcaaaaatatca

SEQ ID NO: 191124 - DNA, 15 bp, Homo sapiens
aaattcaaaaatatc

SEQ ID NO: 191125 - DNA, 15 bp, Homo sapiens
aaaattcaaaaatat

SEQ ID NO: 191126 - DNA, 15 bp, Homo sapiens
caaaattcaaaaata

SEQ ID NO: 191127 - DNA, 15 bp, Homo sapiens
ccaaaattcaaaaat

SEQ ID NO: 191128 - DNA, 15 bp, Homo sapiens
tccaaaattcaaaaa

SEQ ID NO: 191129 - DNA, 15 bp, Homo sapiens
ctccaaaattcaaaa

SEQ ID NO: 191130 - DNA, 15 bp, Homo sapiens
tctccaaaattcaaa

SEQ ID NO: 191131 - DNA, 15 bp, Homo sapiens
gtctccaaaattcaa

SEQ ID NO: 191132 - DNA, 15 bp, Homo sapiens
tgtctccaaaattca

SEQ ID NO: 191133 - DNA, 15 bp, Homo sapiens
atgtctccaaaattc

SEQ ID NO: 191134 - DNA, 15 bp, Homo sapiens
gatgtctccaaaatt

SEQ ID NO: 191135 - DNA, 15 bp, Homo sapiens
ggatgtctccaaaat

SEQ ID NO: 191136 - DNA, 15 bp, Homo sapiens
tggatgtctccaaaa

SEQ ID NO: 191137 - DNA, 15 bp, Homo sapiens
ctggatgtctccaaa

SEQ ID NO: 191138 - DNA, 15 bp, Homo sapiens
actggatgtctccaa

SEQ ID NO: 191139 - DNA, 15 bp, Homo sapiens
cactggatgtctcca

SEQ ID NO: 191140 - DNA, 15 bp, Homo sapiens
ccactggatgtctcc

SEQ ID NO: 191141 - DNA, 15 bp, Homo sapiens
accactggatgtctc

SEQ ID NO: 191142 - DNA, 15 bp, Homo sapiens
aaccactggatgtct

SEQ ID NO: 191143 - DNA, 15 bp, Homo sapiens
aaaccactggatgtc

SEQ ID NO: 191144 - DNA, 15 bp, Homo sapiens
aaaaccactggatgt

SEQ ID NO: 191145 - DNA, 15 bp, Homo sapiens
caaaaccactggatg

SEQ ID NO: 191146 - DNA, 15 bp, Homo sapiens
acaaaaccactggat

SEQ ID NO: 191147 - DNA, 15 bp, Homo sapiens
cacaaaaccactgga

SEQ ID NO: 191148 - DNA, 15 bp, Homo sapiens
tcacaaaaccactgg

SEQ ID NO: 191149 - DNA, 15 bp, Homo sapiens
atcacaaaaccactg

SEQ ID NO: 191150 - DNA, 15 bp, Homo sapiens
aatcacaaaaccact

SEQ ID NO: 191151 - DNA, 15 bp, Homo sapiens
aaatcacaaaaccac

SEQ ID NO: 191152 - DNA, 15 bp, Homo sapiens
aaaatcacaaaacca

SEQ ID NO: 191153 - DNA, 15 bp, Homo sapiens
aaaaatcacaaaacc

SEQ ID NO: 191154 - DNA, 15 bp, Homo sapiens
taaaaatcacaaaac

SEQ ID NO: 191155 - DNA, 15 bp, Homo sapiens
gtaaaaatcacaaaa

SEQ ID NO: 191156 - DNA, 15 bp, Homo sapiens
agtaaaaatcacaaa

SEQ ID NO: 191157 - DNA, 15 bp, Homo sapiens
cagtaaaaatcacaa

SEQ ID NO: 191158 - DNA, 15 bp, Homo sapiens
ccagtaaaaatcaca

SEQ ID NO: 191159 - DNA, 15 bp, Homo sapiens
tccagtaaaaatcac

SEQ ID NO: 191160 - DNA, 15 bp, Homo sapiens
atccagtaaaaatca

SEQ ID NO: 191161 - DNA, 15 bp, Homo sapiens
tatccagtaaaaatc

SEQ ID NO: 191162 - DNA, 15 bp, Homo sapiens
atatccagtaaaaat

SEQ ID NO: 191163 - DNA, 15 bp, Homo sapiens
tatatccagtaaaaa

SEQ ID NO: 191164 - DNA, 15 bp, Homo sapiens
ttatatccagtaaaa

SEQ ID NO: 191165 - DNA, 15 bp, Homo sapiens
cttatatccagtaaa

SEQ ID NO: 191166 - DNA, 15 bp, Homo sapiens
tcttatatccagtaa

SEQ ID NO: 191167 - DNA, 15 bp, Homo sapiens
ttcttatatccagta

SEQ ID NO: 191168 - DNA, 15 bp, Homo sapiens
attcttatatccagt

SEQ ID NO: 191169 - DNA, 15 bp, Homo sapiens
cattcttatatccag

SEQ ID NO: 191170 - DNA, 15 bp, Homo sapiens
acattcttatatcca

SEQ ID NO: 191171 - DNA, 15 bp, Homo sapiens
aacattcttatatcc

SEQ ID NO: 191172 - DNA, 15 bp, Homo sapiens
aaacattcttatatc

SEQ ID NO: 191173 - DNA, 15 bp, Homo sapiens
caaacattcttatat

SEQ ID NO: 191174 - DNA, 15 bp, Homo sapiens
ccaaacattcttata

SEQ ID NO: 191175 - DNA, 15 bp, Homo sapiens
gccaaacattcttat

SEQ ID NO: 191176 - DNA, 15 bp, Homo sapiens
tgccaaacattctta

SEQ ID NO: 191177 - DNA, 15 bp, Homo sapiens
atgccaaacattctt

SEQ ID NO: 191178 - DNA, 15 bp, Homo sapiens
catgccaaacattct

SEQ ID NO: 191179 - DNA, 15 bp, Homo sapiens
acatgccaaacattc

SEQ ID NO: 191180 - DNA, 15 bp, Homo sapiens
aacatgccaaacatt

SEQ ID NO: 191181 - DNA, 15 bp, Homo sapiens
taacatgccaaacat

SEQ ID NO: 191182 - DNA, 15 bp, Homo sapiens
ataacatgccaaaca

SEQ ID NO: 191183 - DNA, 15 bp, Homo sapiens
tataacatgccaaac

SEQ ID NO: 191184 - DNA, 15 bp, Homo sapiens
gtataacatgccaaa

SEQ ID NO: 191185 - DNA, 15 bp, Homo sapiens
agtataacatgccaa

SEQ ID NO: 191186 - DNA, 15 bp, Homo sapiens
gagtataacatgcca

SEQ ID NO: 191187 - DNA, 15 bp, Homo sapiens
tgagtataacatgcc

SEQ ID NO: 191188 - DNA, 15 bp, Homo sapiens
atgagtataacatgc

SEQ ID NO: 191189 - DNA, 15 bp, Homo sapiens
tatgagtataacatg

SEQ ID NO: 191190 - DNA, 15 bp, Homo sapiens
atatgagtataacat

SEQ ID NO: 191191 - DNA, 15 bp, Homo sapiens
tatatgagtataaca

SEQ ID NO: 191192 - DNA, 15 bp, Homo sapiens
ttatatgagtataac

SEQ ID NO: 191193 - DNA, 15 bp, Homo sapiens
cttatatgagtataa

SEQ ID NO: 191194 - DNA, 15 bp, Homo sapiens
tcttatatgagtata

SEQ ID NO: 191195 - DNA, 15 bp, Homo sapiens
ttcttatatgagtat

SEQ ID NO: 191196 - DNA, 15 bp, Homo sapiens
attcttatatgagta

SEQ ID NO: 191197 - DNA, 15 bp, Homo sapiens
cattcttatatgagt

SEQ ID NO: 191198 - DNA, 15 bp, Homo sapiens
acattcttatatgag

SEQ ID NO: 191199 - DNA, 15 bp, Homo sapiens
aacattcttatatga

SEQ ID NO: 191200 - DNA, 15 bp, Homo sapiens
aaacattcttatatg

SEQ ID NO: 191201 - DNA, 15 bp, Homo sapiens
cacatgccaaacatt

SEQ ID NO: 191202 - DNA, 15 bp, Homo sapiens
ccacatgccaaacat

SEQ ID NO: 191203 - DNA, 15 bp, Homo sapiens
accacatgccaaaca

SEQ ID NO: 191204 - DNA, 15 bp, Homo sapiens
aaccacatgccaaac

SEQ ID NO: 191205 - DNA, 15 bp, Homo sapiens
caaccacatgccaaa

SEQ ID NO: 191206 - DNA, 15 bp, Homo sapiens
tcaaccacatgccaa

SEQ ID NO: 191207 - DNA, 15 bp, Homo sapiens
ctcaaccacatgcca

SEQ ID NO: 191208 - DNA, 15 bp, Homo sapiens
gctcaaccacatgcc

SEQ ID NO: 191209 - DNA, 15 bp, Homo sapiens
tgctcaaccacatgc

SEQ ID NO: 191210 - DNA, 15 bp, Homo sapiens
gtgctcaaccacatg

SEQ ID NO: 191211 - DNA, 15 bp, Homo sapiens
ggtgctcaaccacat

SEQ ID NO: 191212 - DNA, 15 bp, Homo sapiens
aggtgctcaaccaca

SEQ ID NO: 191213 - DNA, 15 bp, Homo sapiens
aaggtgctcaaccac

SEQ ID NO: 191214 - DNA, 15 bp, Homo sapiens
caaggtgctcaacca

SEQ ID NO: 191215 - DNA, 15 bp, Homo sapiens
acaaggtgctcaacc

SEQ ID NO: 191216 - DNA, 15 bp, Homo sapiens
gacaaggtgctcaac

SEQ ID NO: 191217 - DNA, 15 bp, Homo sapiens
agacaaggtgctcaa

SEQ ID NO: 191218 - DNA, 15 bp, Homo sapiens
gagacaaggtgctca

SEQ ID NO: 191219 - DNA, 15 bp, Homo sapiens
tgagacaaggtgctc

SEQ ID NO: 191220 - DNA, 15 bp, Homo sapiens
ctgagacaaggtgct

SEQ ID NO: 191221 - DNA, 15 bp, Homo sapiens
gctgagacaaggtgc

SEQ ID NO: 191222 - DNA, 15 bp, Homo sapiens
tgctgagacaaggtg

SEQ ID NO: 191223 - DNA, 15 bp, Homo sapiens
atgctgagacaaggt

SEQ ID NO: 191224 - DNA, 15 bp, Homo sapiens
catgctgagacaagg

SEQ ID NO: 191225 - DNA, 15 bp, Homo sapiens
acatgctgagacaag

SEQ ID NO: 191226 - DNA, 15 bp, Homo sapiens
cacatgctgagacaa

SEQ ID NO: 191227 - DNA, 15 bp, Homo sapiens
acacatgctgagaca

SEQ ID NO: 191228 - DNA, 15 bp, Homo sapiens
cacacatgctgagac

SEQ ID NO: 191229 - DNA, 15 bp, Homo sapiens
tcacacatgctgaga

SEQ ID NO: 191230 - DNA, 15 bp, Homo sapiens
atcacacatgctgag

SEQ ID NO: 191231 - DNA, 15 bp, Homo sapiens
catcacacatgctga

SEQ ID NO: 191232 - DNA, 15 bp, Homo sapiens
gcatcacacatgctg

SEQ ID NO: 191233 - DNA, 15 bp, Homo sapiens
agcatcacacatgct

SEQ ID NO: 191234 - DNA, 15 bp, Homo sapiens
cagcatcacacatgc

SEQ ID NO: 191235 - DNA, 15 bp, Homo sapiens
ccagcatcacacatg

SEQ ID NO: 191236 - DNA, 15 bp, Homo sapiens
cccagcatcacacat

SEQ ID NO: 191237 - DNA, 15 bp, Homo sapiens
tcccagcatcacaca

SEQ ID NO: 191238 - DNA, 15 bp, Homo sapiens
atcccagcatcacac

SEQ ID NO: 191239 - DNA, 15 bp, Homo sapiens
aatcccagcatcaca

SEQ ID NO: 191240 - DNA, 15 bp, Homo sapiens
caatcccagcatcac

SEQ ID NO: 191241 - DNA, 15 bp, Homo sapiens
acaatcccagcatca

SEQ ID NO: 191242 - DNA, 15 bp, Homo sapiens
tacaatcccagcatc

SEQ ID NO: 191243 - DNA, 15 bp, Homo sapiens
ctacaatcccagcat

SEQ ID NO: 191244 - DNA, 15 bp, Homo sapiens
actacaatcccagca

SEQ ID NO: 191245 - DNA, 15 bp, Homo sapiens
aactacaatcccagc

SEQ ID NO: 191246 - DNA, 15 bp, Homo sapiens
aaactacaatcccag

SEQ ID NO: 191247 - DNA, 15 bp, Homo sapiens
gaaactacaatccca

SEQ ID NO: 191248 - DNA, 15 bp, Homo sapiens
ggaaactacaatccc

SEQ ID NO: 191249 - DNA, 15 bp, Homo sapiens
gggaaactacaatcc

SEQ ID NO: 191250 - DNA, 15 bp, Homo sapiens
tgggaaactacaatc

SEQ ID NO: 191251 - DNA, 15 bp, Homo sapiens
ctgggaaactacaat

SEQ ID NO: 191252 - DNA, 15 bp, Homo sapiens
gctgggaaactacaa

SEQ ID NO: 191253 - DNA, 15 bp, Homo sapiens
tgctgggaaactaca

SEQ ID NO: 191254 - DNA, 15 bp, Homo sapiens
gtgctgggaaactac

SEQ ID NO: 191255 - DNA, 15 bp, Homo sapiens
tgtgctgggaaacta

SEQ ID NO: 191256 - DNA, 15 bp, Homo sapiens
ctgtgctgggaaact

SEQ ID NO: 191257 - DNA, 15 bp, Homo sapiens
cctgtgctgggaaac

SEQ ID NO: 191258 - DNA, 15 bp, Homo sapiens
gcctgtgctgggaaa

SEQ ID NO: 191259 - DNA, 15 bp, Homo sapiens
tgcctgtgctgggaa

SEQ ID NO: 191260 - DNA, 15 bp, Homo sapiens
ctgcctgtgctggga

SEQ ID NO: 191261 - DNA, 15 bp, Homo sapiens
cctgcctgtgctggg

SEQ ID NO: 191262 - DNA, 15 bp, Homo sapiens
tcctgcctgtgctgg

SEQ ID NO: 191263 - DNA, 15 bp, Homo sapiens
atcctgcctgtgctg

SEQ ID NO: 191264 - DNA, 15 bp, Homo sapiens
catcctgcctgtgct

SEQ ID NO: 191265 - DNA, 15 bp, Homo sapiens
ccatcctgcctgtgc

SEQ ID NO: 191266 - DNA, 15 bp, Homo sapiens
cccatcctgcctgtg

SEQ ID NO: 191267 - DNA, 15 bp, Homo sapiens
gcccatcctgcctgt

SEQ ID NO: 191268 - DNA, 15 bp, Homo sapiens
tgcccatcctgcctg

SEQ ID NO: 191269 - DNA, 15 bp, Homo sapiens
ttgcccatcctgcct

SEQ ID NO: 191270 - DNA, 15 bp, Homo sapiens
attgcccatcctgcc

SEQ ID NO: 191271 - DNA, 15 bp, Homo sapiens
aattgcccatcctgc

SEQ ID NO: 191272 - DNA, 15 bp, Homo sapiens
aaattgcccatcctg

SEQ ID NO: 191273 - DNA, 15 bp, Homo sapiens
gaaattgcccatcct

SEQ ID NO: 191274 - DNA, 15 bp, Homo sapiens
agaaattgcccatcc

SEQ ID NO: 191275 - DNA, 15 bp, Homo sapiens
aagaaattgcccatc

SEQ ID NO: 191276 - DNA, 15 bp, Homo sapiens
taagaaattgcccat

SEQ ID NO: 191277 - DNA, 15 bp, Homo sapiens
gtaagaaattgccca

SEQ ID NO: 191278 - DNA, 15 bp, Homo sapiens
tgtaagaaattgccc

SEQ ID NO: 191279 - DNA, 15 bp, Homo sapiens
atgtaagaaattgcc

SEQ ID NO: 191280 - DNA, 15 bp, Homo sapiens
aatgtaagaaattgc

SEQ ID NO: 191281 - DNA, 15 bp, Homo sapiens
caatgtaagaaattg

SEQ ID NO: 191282 - DNA, 15 bp, Homo sapiens
ccaatgtaagaaatt

SEQ ID NO: 191283 - DNA, 15 bp, Homo sapiens
cccaatgtaagaaat

SEQ ID NO: 191284 - DNA, 15 bp, Homo sapiens
acccaatgtaagaaa

SEQ ID NO: 191285 - DNA, 15 bp, Homo sapiens
tacccaatgtaagaa

SEQ ID NO: 191286 - DNA, 15 bp, Homo sapiens
gtacccaatgtaaga

SEQ ID NO: 191287 - DNA, 15 bp, Homo sapiens
agtacccaatgtaag

SEQ ID NO: 191288 - DNA, 15 bp, Homo sapiens
cagtacccaatgtaa

SEQ ID NO: 191289 - DNA, 15 bp, Homo sapiens
tcagtacccaatgta

SEQ ID NO: 191290 - DNA, 15 bp, Homo sapiens
atcagtacccaatgt

SEQ ID NO: 191291 - DNA, 15 bp, Homo sapiens
aatcagtacccaatg

SEQ ID NO: 191292 - DNA, 15 bp, Homo sapiens
aaatcagtacccaat

SEQ ID NO: 191293 - DNA, 15 bp, Homo sapiens
gaaatcagtacccaa

SEQ ID NO: 191294 - DNA, 15 bp, Homo sapiens
agaaatcagtaccca

SEQ ID NO: 191295 - DNA, 15 bp, Homo sapiens
tagaaatcagtaccc

SEQ ID NO: 191296 - DNA, 15 bp, Homo sapiens
ctagaaatcagtacc

SEQ ID NO: 191297 - DNA, 15 bp, Homo sapiens
actagaaatcagtac

SEQ ID NO: 191298 - DNA, 15 bp, Homo sapiens
gactagaaatcagta

SEQ ID NO: 191299 - DNA, 15 bp, Homo sapiens
agactagaaatcagt

SEQ ID NO: 191300 - DNA, 15 bp, Homo sapiens
aagactagaaatcag

SEQ ID NO: 191301 - DNA, 15 bp, Homo sapiens
gaagactagaaatca

SEQ ID NO: 191302 - DNA, 15 bp, Homo sapiens
agaagactagaaatc

SEQ ID NO: 191303 - DNA, 15 bp, Homo sapiens
tagaagactagaaat

SEQ ID NO: 191304 - DNA, 15 bp, Homo sapiens
ctagaagactagaaa

SEQ ID NO: 191305 - DNA, 15 bp, Homo sapiens
tctagaagactagaa

SEQ ID NO: 191306 - DNA, 15 bp, Homo sapiens
ttctagaagactaga

SEQ ID NO: 191307 - DNA, 15 bp, Homo sapiens
gttctagaagactag

SEQ ID NO: 191308 - DNA, 15 bp, Homo sapiens
ggttctagaagacta

SEQ ID NO: 191309 - DNA, 15 bp, Homo sapiens
tggttctagaagact

SEQ ID NO: 191310 - DNA, 15 bp, Homo sapiens
ctggttctagaagac

SEQ ID NO: 191311 - DNA, 15 bp, Homo sapiens
tctggttctagaaga

SEQ ID NO: 191312 - DNA, 15 bp, Homo sapiens
ttctggttctagaag

SEQ ID NO: 191313 - DNA, 15 bp, Homo sapiens
tttctggttctagaa

SEQ ID NO: 191314 - DNA, 15 bp, Homo sapiens
ctttctggttctaga

SEQ ID NO: 191315 - DNA, 15 bp, Homo sapiens
cctttctggttctag

SEQ ID NO: 191316 - DNA, 15 bp, Homo sapiens
ccctttctggttcta

SEQ ID NO: 191317 - DNA, 15 bp, Homo sapiens
gccctttctggttct

SEQ ID NO: 191318 - DNA, 15 bp, Homo sapiens
tgccctttctggttc

SEQ ID NO: 191319 - DNA, 15 bp, Homo sapiens
ttgccctttctggtt

SEQ ID NO: 191320 - DNA, 15 bp, Homo sapiens
cttgccctttctggt

SEQ ID NO: 191321 - DNA, 15 bp, Homo sapiens
ccttgccctttctgg

SEQ ID NO: 191322 - DNA, 15 bp, Homo sapiens
gccttgccctttctg

SEQ ID NO: 191323 - DNA, 15 bp, Homo sapiens
agccttgccctttct

SEQ ID NO: 191324 - DNA, 15 bp, Homo sapiens
tagccttgccctttc

SEQ ID NO: 191325 - DNA, 15 bp, Homo sapiens
ctagccttgcccttt

SEQ ID NO: 191326 - DNA, 15 bp, Homo sapiens
cctagccttgccctt

SEQ ID NO: 191327 - DNA, 15 bp, Homo sapiens
tcctagccttgccct

SEQ ID NO: 191328 - DNA, 15 bp, Homo sapiens
ctcctagccttgccc

SEQ ID NO: 191329 - DNA, 15 bp, Homo sapiens
actcctagccttgcc

SEQ ID NO: 191330 - DNA, 15 bp, Homo sapiens
gactcctagccttgc

SEQ ID NO: 191331 - DNA, 15 bp, Homo sapiens
agactcctagccttg

SEQ ID NO: 191332 - DNA, 15 bp, Homo sapiens
gagactcctagcctt

SEQ ID NO: 191333 - DNA, 15 bp, Homo sapiens
agagactcctagcct

SEQ ID NO: 191334 - DNA, 15 bp, Homo sapiens
aagagactcctagcc

SEQ ID NO: 191335 - DNA, 15 bp, Homo sapiens
caagagactcctagc

SEQ ID NO: 191336 - DNA, 15 bp, Homo sapiens
gcaagagactcctag

SEQ ID NO: 191337 - DNA, 15 bp, Homo sapiens
tgcaagagactccta

SEQ ID NO: 191338 - DNA, 15 bp, Homo sapiens
ctgcaagagactcct

SEQ ID NO: 191339 - DNA, 15 bp, Homo sapiens
cctgcaagagactcc

SEQ ID NO: 191340 - DNA, 15 bp, Homo sapiens
gcctgcaagagactc

SEQ ID NO: 191341 - DNA, 15 bp, Homo sapiens
tgcctgcaagagact

SEQ ID NO: 191342 - DNA, 15 bp, Homo sapiens
ctgcctgcaagagac

SEQ ID NO: 191343 - DNA, 15 bp, Homo sapiens
cctgcctgcaagaga

SEQ ID NO: 191344 - DNA, 15 bp, Homo sapiens
tcctgcctgcaagag

SEQ ID NO: 191345 - DNA, 15 bp, Homo sapiens
ttcctgcctgcaaga

SEQ ID NO: 191346 - DNA, 15 bp, Homo sapiens
cttcctgcctgcaag

SEQ ID NO: 191347 - DNA, 15 bp, Homo sapiens
acttcctgcctgcaa

SEQ ID NO: 191348 - DNA, 15 bp, Homo sapiens
tacttcctgcctgca

SEQ ID NO: 191349 - DNA, 15 bp, Homo sapiens
atacttcctgcctgc

SEQ ID NO: 191350 - DNA, 15 bp, Homo sapiens
aatacttcctgcctg

SEQ ID NO: 191351 - DNA, 15 bp, Homo sapiens
taatacttcctgcct

SEQ ID NO: 191352 - DNA, 15 bp, Homo sapiens
ataatacttcctgcc

SEQ ID NO: 191353 - DNA, 15 bp, Homo sapiens
cataatacttcctgc

SEQ ID NO: 191354 - DNA, 15 bp, Homo sapiens
acataatacttcctg

SEQ ID NO: 191355 - DNA, 15 bp, Homo sapiens
aacataatacttcct

SEQ ID NO: 191356 - DNA, 15 bp, Homo sapiens
gaacataatacttcc

SEQ ID NO: 191357 - DNA, 15 bp, Homo sapiens
ggaacataatacttc

SEQ ID NO: 191358 - DNA, 15 bp, Homo sapiens
aggaacataatactt

SEQ ID NO: 191359 - DNA, 15 bp, Homo sapiens
taggaacataatact

SEQ ID NO: 191360 - DNA, 15 bp, Homo sapiens
gtaggaacataatac

SEQ ID NO: 191361 - DNA, 15 bp, Homo sapiens
tgtaggaacataata

SEQ ID NO: 191362 - DNA, 15 bp, Homo sapiens
ttgtaggaacataat

SEQ ID NO: 191363 - DNA, 15 bp, Homo sapiens
cttgtaggaacataa

SEQ ID NO: 191364 - DNA, 15 bp, Homo sapiens
tcttgtaggaacata

SEQ ID NO: 191365 - DNA, 15 bp, Homo sapiens
atcttgtaggaacat

SEQ ID NO: 191366 - DNA, 15 bp, Homo sapiens
catcttgtaggaaca

SEQ ID NO: 191367 - DNA, 15 bp, Homo sapiens
tcatcttgtaggaac

SEQ ID NO: 191368 - DNA, 15 bp, Homo sapiens
gtcatcttgtaggaa

SEQ ID NO: 191369 - DNA, 15 bp, Homo sapiens
tgtcatcttgtagga

SEQ ID NO: 191370 - DNA, 15 bp, Homo sapiens
ctgtcatcttgtagg

SEQ ID NO: 191371 - DNA, 15 bp, Homo sapiens
gctgtcatcttgtag

SEQ ID NO: 191372 - DNA, 15 bp, Homo sapiens
agctgtcatcttgta

SEQ ID NO: 191373 - DNA, 15 bp, Homo sapiens
gagctgtcatcttgt

SEQ ID NO: 191374 - DNA, 15 bp, Homo sapiens
tgagctgtcatcttg

SEQ ID NO: 191375 - DNA, 15 bp, Homo sapiens
atgagctgtcatctt

SEQ ID NO: 191376 - DNA, 15 bp, Homo sapiens
aatgagctgtcatct

SEQ ID NO: 191377 - DNA, 15 bp, Homo sapiens
taatgagctgtcatc

SEQ ID NO: 191378 - DNA, 15 bp, Homo sapiens
gtaatgagctgtcat

SEQ ID NO: 191379 - DNA, 15 bp, Homo sapiens
tgtaatgagctgtca

SEQ ID NO: 191380 - DNA, 15 bp, Homo sapiens
ctgtaatgagctgtc

SEQ ID NO: 191381 - DNA, 15 bp, Homo sapiens
tctgtaatgagctgt

SEQ ID NO: 191382 - DNA, 15 bp, Homo sapiens
atctgtaatgagctg

SEQ ID NO: 191383 - DNA, 15 bp, Homo sapiens
aatctgtaatgagct

SEQ ID NO: 191384 - DNA, 15 bp, Homo sapiens
taatctgtaatgagc

SEQ ID NO: 191385 - DNA, 15 bp, Homo sapiens
ctaatctgtaatgag

SEQ ID NO: 191386 - DNA, 15 bp, Homo sapiens
cctaatctgtaatga

SEQ ID NO: 191387 - DNA, 15 bp, Homo sapiens
tcctaatctgtaatg

SEQ ID NO: 191388 - DNA, 15 bp, Homo sapiens
ttcctaatctgtaat

SEQ ID NO: 191389 - DNA, 15 bp, Homo sapiens
cttcctaatctgtaa

SEQ ID NO: 191390 - DNA, 15 bp, Homo sapiens
ccttcctaatctgta

SEQ ID NO: 191391 - DNA, 15 bp, Homo sapiens
gccttcctaatctgt

SEQ ID NO: 191392 - DNA, 15 bp, Homo sapiens
ggccttcctaatctg

SEQ ID NO: 191393 - DNA, 15 bp, Homo sapiens
gggccttcctaatct

SEQ ID NO: 191394 - DNA, 15 bp, Homo sapiens
tgggccttcctaatc

SEQ ID NO: 191395 - DNA, 15 bp, Homo sapiens
ttgggccttcctaat

SEQ ID NO: 191396 - DNA, 15 bp, Homo sapiens
attgggccttcctaa

SEQ ID NO: 191397 - DNA, 15 bp, Homo sapiens
aattgggccttccta

SEQ ID NO: 191398 - DNA, 15 bp, Homo sapiens
caattgggccttcct

SEQ ID NO: 191399 - DNA, 15 bp, Homo sapiens
ccaattgggccttcc

SEQ ID NO: 191400 - DNA, 15 bp, Homo sapiens
tccaattgggccttc

SEQ ID NO: 191401 - DNA, 15 bp, Homo sapiens
ctccaattgggcctt

SEQ ID NO: 191402 - DNA, 15 bp, Homo sapiens
cctccaattgggcct

SEQ ID NO: 191403 - DNA, 15 bp, Homo sapiens
ccctccaattgggcc

SEQ ID NO: 191404 - DNA, 15 bp, Homo sapiens
tccctccaattgggc

SEQ ID NO: 191405 - DNA, 15 bp, Homo sapiens
ttccctccaattggg

SEQ ID NO: 191406 - DNA, 15 bp, Homo sapiens
gttccctccaattgg

SEQ ID NO: 191407 - DNA, 15 bp, Homo sapiens
ggttccctccaattg

SEQ ID NO: 191408 - DNA, 15 bp, Homo sapiens
tggttccctccaatt

SEQ ID NO: 191409 - DNA, 15 bp, Homo sapiens
atggttccctccaat

SEQ ID NO: 191410 - DNA, 15 bp, Homo sapiens
catggttccctccaa

SEQ ID NO: 191411 - DNA, 15 bp, Homo sapiens
gcatggttccctcca

SEQ ID NO: 191412 - DNA, 15 bp, Homo sapiens
ggcatggttccctcc

SEQ ID NO: 191413 - DNA, 15 bp, Homo sapiens
tggcatggttccctc

SEQ ID NO: 191414 - DNA, 15 bp, Homo sapiens
ttggcatggttccct

SEQ ID NO: 191415 - DNA, 15 bp, Homo sapiens
gttggcatggttccc

SEQ ID NO: 191416 - DNA, 15 bp, Homo sapiens
agttggcatggttcc

SEQ ID NO: 191417 - DNA, 15 bp, Homo sapiens
gagttggcatggttc

SEQ ID NO: 191418 - DNA, 15 bp, Homo sapiens
cgagttggcatggtt

SEQ ID NO: 191419 - DNA, 15 bp, Homo sapiens
tcgagttggcatggt

SEQ ID NO: 191420 - DNA, 15 bp, Homo sapiens
ctcgagttggcatgg

SEQ ID NO: 191421 - DNA, 15 bp, Homo sapiens
actcgagttggcatg

SEQ ID NO: 191422 - DNA, 15 bp, Homo sapiens
cactcgagttggcat

SEQ ID NO: 191423 - DNA, 15 bp, Homo sapiens
ccactcgagttggca

SEQ ID NO: 191424 - DNA, 15 bp, Homo sapiens
accactcgagttggc

SEQ ID NO: 191425 - DNA, 15 bp, Homo sapiens
taccactcgagttgg

SEQ ID NO: 191426 - DNA, 15 bp, Homo sapiens
gtaccactcgagttg

SEQ ID NO: 191427 - DNA, 15 bp, Homo sapiens
ggtaccactcgagtt

SEQ ID NO: 191428 - DNA, 15 bp, Homo sapiens
aggtaccactcgagt

SEQ ID NO: 191429 - DNA, 15 bp, Homo sapiens
taggtaccactcgag

SEQ ID NO: 191430 - DNA, 15 bp, Homo sapiens
ttaggtaccactcga

SEQ ID NO: 191431 - DNA, 15 bp, Homo sapiens
tttaggtaccactcg

SEQ ID NO: 191432 - DNA, 15 bp, Homo sapiens
ctttaggtaccactc

SEQ ID NO: 191433 - DNA, 15 bp, Homo sapiens
tctttaggtaccact

SEQ ID NO: 191434 - DNA, 15 bp, Homo sapiens
ctctttaggtaccac

SEQ ID NO: 191435 - DNA, 15 bp, Homo sapiens
cctctttaggtacca

SEQ ID NO: 191436 - DNA, 15 bp, Homo sapiens
tcctctttaggtacc

SEQ ID NO: 191437 - DNA, 15 bp, Homo sapiens
ttcctctttaggtac

SEQ ID NO: 191438 - DNA, 15 bp, Homo sapiens
cttcctctttaggta

SEQ ID NO: 191439 - DNA, 15 bp, Homo sapiens
tcttcctctttaggt

SEQ ID NO: 191440 - DNA, 15 bp, Homo sapiens
ttcttcctctttagg

SEQ ID NO: 191441 - DNA, 15 bp, Homo sapiens
gttcttcctctttag

SEQ ID NO: 191442 - DNA, 15 bp, Homo sapiens
agttcttcctcttta

SEQ ID NO: 191443 - DNA, 15 bp, Homo sapiens
aagttcttcctcttt

SEQ ID NO: 191444 - DNA, 15 bp, Homo sapiens
gaagttcttcctctt

SEQ ID NO: 191445 - DNA, 15 bp, Homo sapiens
agaagttcttcctct

SEQ ID NO: 191446 - DNA, 15 bp, Homo sapiens
aagaagttcttcctc

SEQ ID NO: 191447 - DNA, 15 bp, Homo sapiens
taagaagttcttcct

SEQ ID NO: 191448 - DNA, 15 bp, Homo sapiens
gtaagaagttcttcc

SEQ ID NO: 191449 - DNA, 15 bp, Homo sapiens
ggtaagaagttcttc

SEQ ID NO: 191450 - DNA, 15 bp, Homo sapiens
tggtaagaagttctt

SEQ ID NO: 191451 - DNA, 15 bp, Homo sapiens
ctggtaagaagttct

SEQ ID NO: 191452 - DNA, 15 bp, Homo sapiens
cctggtaagaagttc

SEQ ID NO: 191453 - DNA, 15 bp, Homo sapiens
ccctggtaagaagtt

SEQ ID NO: 191454 - DNA, 15 bp, Homo sapiens
cccctggtaagaagt

SEQ ID NO: 191455 - DNA, 15 bp, Homo sapiens
tcccctggtaagaag

SEQ ID NO: 191456 - DNA, 15 bp, Homo sapiens
ctcccctggtaagaa

SEQ ID NO: 191457 - DNA, 15 bp, Homo sapiens
cctcccctggtaaga

SEQ ID NO: 191458 - DNA, 15 bp, Homo sapiens
tcctcccctggtaag

SEQ ID NO: 191459 - DNA, 15 bp, Homo sapiens
atcctcccctggtaa

SEQ ID NO: 191460 - DNA, 15 bp, Homo sapiens
catcctcccctggta

SEQ ID NO: 191461 - DNA, 15 bp, Homo sapiens
tcatcctcccctggt

SEQ ID NO: 191462 - DNA, 15 bp, Homo sapiens
gtcatcctcccctgg

SEQ ID NO: 191463 - DNA, 15 bp, Homo sapiens
ggtcatcctcccctg

SEQ ID NO: 191464 - DNA, 15 bp, Homo sapiens
gggtcatcctcccct

SEQ ID NO: 191465 - DNA, 15 bp, Homo sapiens
ggggtcatcctcccc

SEQ ID NO: 191466 - DNA, 15 bp, Homo sapiens
tggggtcatcctccc

SEQ ID NO: 191467 - DNA, 15 bp, Homo sapiens
atggggtcatcctcc

SEQ ID NO: 191468 - DNA, 15 bp, Homo sapiens
tatggggtcatcctc

SEQ ID NO: 191469 - DNA, 15 bp, Homo sapiens
gtatggggtcatcct

SEQ ID NO: 191470 - DNA, 15 bp, Homo sapiens
ggtatggggtcatcc

SEQ ID NO: 191471 - DNA, 15 bp, Homo sapiens
tggtatggggtcatc

SEQ ID NO: 191472 - DNA, 15 bp, Homo sapiens
ttggtatggggtcat

SEQ ID NO: 191473 - DNA, 15 bp, Homo sapiens
cttggtatggggtca

SEQ ID NO: 191474 - DNA, 15 bp, Homo sapiens
tcttggtatggggtc

SEQ ID NO: 191475 - DNA, 15 bp, Homo sapiens
atcttggtatggggt

SEQ ID NO: 191476 - DNA, 15 bp, Homo sapiens
catcttggtatgggg

SEQ ID NO: 191477 - DNA, 15 bp, Homo sapiens
acatcttggtatggg

SEQ ID NO: 191478 - DNA, 15 bp, Homo sapiens
cacatcttggtatgg

SEQ ID NO: 191479 - DNA, 15 bp, Homo sapiens
gcacatcttggtatg

SEQ ID NO: 191480 - DNA, 15 bp, Homo sapiens
ggcacatcttggtat

SEQ ID NO: 191481 - DNA, 15 bp, Homo sapiens
aggcacatcttggta

SEQ ID NO: 191482 - DNA, 15 bp, Homo sapiens
caggcacatcttggt

SEQ ID NO: 191483 - DNA, 15 bp, Homo sapiens
gcaggcacatcttgg

SEQ ID NO: 191484 - DNA, 15 bp, Homo sapiens
ggcaggcacatcttg

SEQ ID NO: 191485 - DNA, 15 bp, Homo sapiens
tggcaggcacatctt

SEQ ID NO: 191486 - DNA, 15 bp, Homo sapiens
ctggcaggcacatct

SEQ ID NO: 191487 - DNA, 15 bp, Homo sapiens
gctggcaggcacatc

SEQ ID NO: 191488 - DNA, 15 bp, Homo sapiens
tgctggcaggcacat

SEQ ID NO: 191489 - DNA, 15 bp, Homo sapiens
ttgctggcaggcaca

SEQ ID NO: 191490 - DNA, 15 bp, Homo sapiens
cttgctggcaggcac

SEQ ID NO: 191491 - DNA, 15 bp, Homo sapiens
gcttgctggcaggca

SEQ ID NO: 191492 - DNA, 15 bp, Homo sapiens
tgcttgctggcaggc

SEQ ID NO: 191493 - DNA, 15 bp, Homo sapiens
ctgcttgctggcagg

SEQ ID NO: 191494 - DNA, 15 bp, Homo sapiens
cctgcttgctggcag

SEQ ID NO: 191495 - DNA, 15 bp, Homo sapiens
acctgcttgctggca

SEQ ID NO: 191496 - DNA, 15 bp, Homo sapiens
gacctgcttgctggc

SEQ ID NO: 191497 - DNA, 15 bp, Homo sapiens
ggacctgcttgctgg

SEQ ID NO: 191498 - DNA, 15 bp, Homo sapiens
aggacctgcttgctg

SEQ ID NO: 191499 - DNA, 15 bp, Homo sapiens
taggacctgcttgct

SEQ ID NO: 191500 - DNA, 15 bp, Homo sapiens
ttaggacctgcttgc

SEQ ID NO: 191501 - DNA, 15 bp, Homo sapiens
attaggacctgcttg

SEQ ID NO: 191502 - DNA, 15 bp, Homo sapiens
gattaggacctgctt

SEQ ID NO: 191503 - DNA, 15 bp, Homo sapiens
tgattaggacctgct

SEQ ID NO: 191504 - DNA, 15 bp, Homo sapiens
atgattaggacctgc

SEQ ID NO: 191505 - DNA, 15 bp, Homo sapiens
gatgattaggacctg

SEQ ID NO: 191506 - DNA, 15 bp, Homo sapiens
agatgattaggacct

SEQ ID NO: 191507 - DNA, 15 bp, Homo sapiens
tagatgattaggacc

SEQ ID NO: 191508 - DNA, 15 bp, Homo sapiens
ttagatgattaggac

SEQ ID NO: 191509 - DNA, 15 bp, Homo sapiens
gttagatgattagga

SEQ ID NO: 191510 - DNA, 15 bp, Homo sapiens
tgttagatgattagg

SEQ ID NO: 191511 - DNA, 15 bp, Homo sapiens
ttgttagatgattag

SEQ ID NO: 191512 - DNA, 15 bp, Homo sapiens
tttgttagatgatta

SEQ ID NO: 191513 - DNA, 15 bp, Homo sapiens
ctttgttagatgatt

SEQ ID NO: 191514 - DNA, 15 bp, Homo sapiens
actttgttagatgat

SEQ ID NO: 191515 - DNA, 15 bp, Homo sapiens
cactttgttagatga

SEQ ID NO: 191516 - DNA, 15 bp, Homo sapiens
tcactttgttagatg

SEQ ID NO: 191517 - DNA, 15 bp, Homo sapiens
atcactttgttagat

SEQ ID NO: 191518 - DNA, 15 bp, Homo sapiens
tatcactttgttaga

SEQ ID NO: 191519 - DNA, 15 bp, Homo sapiens
ttatcactttgttag

SEQ ID NO: 191520 - DNA, 15 bp, Homo sapiens
cttatcactttgtta

SEQ ID NO: 191521 - DNA, 15 bp, Homo sapiens
ccttatcactttgtt

SEQ ID NO: 191522 - DNA, 15 bp, Homo sapiens
cccttatcactttgt

SEQ ID NO: 191523 - DNA, 15 bp, Homo sapiens
tcccttatcactttg

SEQ ID NO: 191524 - DNA, 15 bp, Homo sapiens
atcccttatcacttt

SEQ ID NO: 191525 - DNA, 15 bp, Homo sapiens
catcccttatcactt

SEQ ID NO: 191526 - DNA, 15 bp, Homo sapiens
tcatcccttatcact

SEQ ID NO: 191527 - DNA, 15 bp, Homo sapiens
ctcatcccttatcac

SEQ ID NO: 191528 - DNA, 15 bp, Homo sapiens
tctcatcccttatca

SEQ ID NO: 191529 - DNA, 15 bp, Homo sapiens
ttctcatcccttatc

SEQ ID NO: 191530 - DNA, 15 bp, Homo sapiens
cttctcatcccttat

SEQ ID NO: 191531 - DNA, 15 bp, Homo sapiens
acttctcatccctta

SEQ ID NO: 191532 - DNA, 15 bp, Homo sapiens
aacttctcatccctt

SEQ ID NO: 191533 - DNA, 15 bp, Homo sapiens
caacttctcatccct

SEQ ID NO: 191534 - DNA, 15 bp, Homo sapiens
acaacttctcatccc

SEQ ID NO: 191535 - DNA, 15 bp, Homo sapiens
cacaacttctcatcc

SEQ ID NO: 191536 - DNA, 15 bp, Homo sapiens
ccacaacttctcatc

SEQ ID NO: 191537 - DNA, 15 bp, Homo sapiens
gccacaacttctcat

SEQ ID NO: 191538 - DNA, 15 bp, Homo sapiens
ggccacaacttctca

SEQ ID NO: 191539 - DNA, 15 bp, Homo sapiens
tggccacaacttctc

SEQ ID NO: 191540 - DNA, 15 bp, Homo sapiens
atggccacaacttct

SEQ ID NO: 191541 - DNA, 15 bp, Homo sapiens
catggccacaacttc

SEQ ID NO: 191542 - DNA, 15 bp, Homo sapiens
ccatggccacaactt

SEQ ID NO: 191543 - DNA, 15 bp, Homo sapiens
cccatggccacaact

SEQ ID NO: 191544 - DNA, 15 bp, Homo sapiens
gcccatggccacaac

SEQ ID NO: 191545 - DNA, 15 bp, Homo sapiens
agcccatggccacaa

SEQ ID NO: 191546 - DNA, 15 bp, Homo sapiens
gagcccatggccaca

SEQ ID NO: 191547 - DNA, 15 bp, Homo sapiens
tgagcccatggccac

SEQ ID NO: 191548 - DNA, 15 bp, Homo sapiens
ttgagcccatggcca

SEQ ID NO: 191549 - DNA, 15 bp, Homo sapiens
cttgagcccatggcc

SEQ ID NO: 191550 - DNA, 15 bp, Homo sapiens
ccttgagcccatggc

SEQ ID NO: 191551 - DNA, 15 bp, Homo sapiens
cccttgagcccatgg

SEQ ID NO: 191552 - DNA, 15 bp, Homo sapiens
acccttgagcccatg

SEQ ID NO: 191553 - DNA, 15 bp, Homo sapiens
cacccttgagcccat

SEQ ID NO: 191554 - DNA, 15 bp, Homo sapiens
tcacccttgagccca

SEQ ID NO: 191555 - DNA, 15 bp, Homo sapiens
gtcacccttgagccc

SEQ ID NO: 191556 - DNA, 15 bp, Homo sapiens
agtcacccttgagcc

SEQ ID NO: 191557 - DNA, 15 bp, Homo sapiens
tagtcacccttgagc

SEQ ID NO: 191558 - DNA, 15 bp, Homo sapiens
atagtcacccttgag

SEQ ID NO: 191559 - DNA, 15 bp, Homo sapiens
catagtcacccttga

SEQ ID NO: 191560 - DNA, 15 bp, Homo sapiens
ccatagtcacccttg

SEQ ID NO: 191561 - DNA, 15 bp, Homo sapiens
cccatagtcaccctt

SEQ ID NO: 191562 - DNA, 15 bp, Homo sapiens
tcccatagtcaccct

SEQ ID NO: 191563 - DNA, 15 bp, Homo sapiens
ttcccatagtcaccc

SEQ ID NO: 191564 - DNA, 15 bp, Homo sapiens
cttcccatagtcacc

SEQ ID NO: 191565 - DNA, 15 bp, Homo sapiens
tcttcccatagtcac

SEQ ID NO: 191566 - DNA, 15 bp, Homo sapiens
ctcttcccatagtca

SEQ ID NO: 191567 - DNA, 15 bp, Homo sapiens
actcttcccatagtc

SEQ ID NO: 191568 - DNA, 15 bp, Homo sapiens
aactcttcccatagt

SEQ ID NO: 191569 - DNA, 15 bp, Homo sapiens
gaactcttcccatag

SEQ ID NO: 191570 - DNA, 15 bp, Homo sapiens
tgaactcttcccata

SEQ ID NO: 191571 - DNA, 15 bp, Homo sapiens
gtgaactcttcccat

SEQ ID NO: 191572 - DNA, 15 bp, Homo sapiens
tgtgaactcttccca

SEQ ID NO: 191573 - DNA, 15 bp, Homo sapiens
atgtgaactcttccc

SEQ ID NO: 191574 - DNA, 15 bp, Homo sapiens
aatgtgaactcttcc

SEQ ID NO: 191575 - DNA, 15 bp, Homo sapiens
gaatgtgaactcttc

SEQ ID NO: 191576 - DNA, 15 bp, Homo sapiens
tgaatgtgaactctt

SEQ ID NO: 191577 - DNA, 15 bp, Homo sapiens
ttgaatgtgaactct

SEQ ID NO: 191578 - DNA, 15 bp, Homo sapiens
tttgaatgtgaactc

SEQ ID NO: 191579 - DNA, 15 bp, Homo sapiens
ctttgaatgtgaact

SEQ ID NO: 191580 - DNA, 15 bp, Homo sapiens
actttgaatgtgaac

SEQ ID NO: 191581 - DNA, 15 bp, Homo sapiens
aactttgaatgtgaa

SEQ ID NO: 191582 - DNA, 15 bp, Homo sapiens
caactttgaatgtga

SEQ ID NO: 191583 - DNA, 15 bp, Homo sapiens
tcaactttgaatgtg

SEQ ID NO: 191584 - DNA, 15 bp, Homo sapiens
gtcaactttgaatgt

SEQ ID NO: 191585 - DNA, 15 bp, Homo sapiens
agtcaactttgaatg

SEQ ID NO: 191586 - DNA, 15 bp, Homo sapiens
tagtcaactttgaat

SEQ ID NO: 191587 - DNA, 15 bp, Homo sapiens
ctagtcaactttgaa

SEQ ID NO: 191588 - DNA, 15 bp, Homo sapiens
actagtcaactttga

SEQ ID NO: 191589 - DNA, 15 bp, Homo sapiens
gactagtcaactttg

SEQ ID NO: 191590 - DNA, 15 bp, Homo sapiens
ggactagtcaacttt

SEQ ID NO: 191591 - DNA, 15 bp, Homo sapiens
tggactagtcaactt

SEQ ID NO: 191592 - DNA, 15 bp, Homo sapiens
gtggactagtcaact

SEQ ID NO: 191593 - DNA, 15 bp, Homo sapiens
ggtggactagtcaac

SEQ ID NO: 191594 - DNA, 15 bp, Homo sapiens
tggtggactagtcaa

SEQ ID NO: 191595 - DNA, 15 bp, Homo sapiens
ttggtggactagtca

SEQ ID NO: 191596 - DNA, 15 bp, Homo sapiens
gttggtggactagtc

SEQ ID NO: 191597 - DNA, 15 bp, Homo sapiens
tgttggtggactagt

SEQ ID NO: 191598 - DNA, 15 bp, Homo sapiens
gtgttggtggactag

SEQ ID NO: 191599 - DNA, 15 bp, Homo sapiens
tgtgttggtggacta

SEQ ID NO: 191600 - DNA, 15 bp, Homo sapiens
gtgtgttggtggact

SEQ ID NO: 191601 - DNA, 15 bp, Homo sapiens
ggtgtgttggtggac

SEQ ID NO: 191602 - DNA, 15 bp, Homo sapiens
aggtgtgttggtgga

SEQ ID NO: 191603 - DNA, 15 bp, Homo sapiens
gaggtgtgttggtgg

SEQ ID NO: 191604 - DNA, 15 bp, Homo sapiens
agaggtgtgttggtg

SEQ ID NO: 191605 - DNA, 15 bp, Homo sapiens
gagaggtgtgttggt

SEQ ID NO: 191606 - DNA, 15 bp, Homo sapiens
agagaggtgtgttgg

SEQ ID NO: 191607 - DNA, 15 bp, Homo sapiens
cagagaggtgtgttg

SEQ ID NO: 191608 - DNA, 15 bp, Homo sapiens
tcagagaggtgtgtt

SEQ ID NO: 191609 - DNA, 15 bp, Homo sapiens
ctcagagaggtgtgt

SEQ ID NO: 191610 - DNA, 15 bp, Homo sapiens
tctcagagaggtgtg

SEQ ID NO: 191611 - DNA, 15 bp, Homo sapiens
atctcagagaggtgt

SEQ ID NO: 191612 - DNA, 15 bp, Homo sapiens
gatctcagagaggtg

SEQ ID NO: 191613 - DNA, 15 bp, Homo sapiens
ggatctcagagaggt

SEQ ID NO: 191614 - DNA, 15 bp, Homo sapiens
tggatctcagagagg

SEQ ID NO: 191615 - DNA, 15 bp, Homo sapiens
ctggatctcagagag

SEQ ID NO: 191616 - DNA, 15 bp, Homo sapiens
gctggatctcagaga

SEQ ID NO: 191617 - DNA, 15 bp, Homo sapiens
ggctggatctcagag

SEQ ID NO: 191618 - DNA, 15 bp, Homo sapiens
tggctggatctcaga

SEQ ID NO: 191619 - DNA, 15 bp, Homo sapiens
ttggctggatctcag

SEQ ID NO: 191620 - DNA, 15 bp, Homo sapiens
attggctggatctca

SEQ ID NO: 191621 - DNA, 15 bp, Homo sapiens
tattggctggatctc

SEQ ID NO: 191622 - DNA, 15 bp, Homo sapiens
ctattggctggatct

SEQ ID NO: 191623 - DNA, 15 bp, Homo sapiens
cctattggctggatc

SEQ ID NO: 191624 - DNA, 15 bp, Homo sapiens
acctattggctggat

SEQ ID NO: 191625 - DNA, 15 bp, Homo sapiens
tacctattggctgga

SEQ ID NO: 191626 - DNA, 15 bp, Homo sapiens
ctacctattggctgg

SEQ ID NO: 191627 - DNA, 15 bp, Homo sapiens
actacctattggctg

SEQ ID NO: 191628 - DNA, 15 bp, Homo sapiens
aactacctattggct

SEQ ID NO: 191629 - DNA, 15 bp, Homo sapiens
aaactacctattggc

SEQ ID NO: 191630 - DNA, 15 bp, Homo sapiens
aaaactacctattgg

SEQ ID NO: 191631 - DNA, 15 bp, Homo sapiens
taaaactacctattg

SEQ ID NO: 191632 - DNA, 15 bp, Homo sapiens
ataaaactacctatt

SEQ ID NO: 191633 - DNA, 15 bp, Homo sapiens
aataaaactacctat

SEQ ID NO: 191634 - DNA, 15 bp, Homo sapiens
aaataaaactaccta

SEQ ID NO: 191635 - DNA, 15 bp, Homo sapiens
caaataaaactacct

SEQ ID NO: 191636 - DNA, 15 bp, Homo sapiens
gcaaataaaactacc

SEQ ID NO: 191637 - DNA, 15 bp, Homo sapiens
ggcaaataaaactac

SEQ ID NO: 191638 - DNA, 15 bp, Homo sapiens
tggcaaataaaacta

SEQ ID NO: 191639 - DNA, 15 bp, Homo sapiens
gtggcaaataaaact

SEQ ID NO: 191640 - DNA, 15 bp, Homo sapiens
cgtggcaaataaaac

SEQ ID NO: 191641 - DNA, 15 bp, Homo sapiens
gcgtggcaaataaaa

SEQ ID NO: 191642 - DNA, 15 bp, Homo sapiens
agcgtggcaaataaa

SEQ ID NO: 191643 - DNA, 15 bp, Homo sapiens
cagcgtggcaaataa

SEQ ID NO: 191644 - DNA, 15 bp, Homo sapiens
tcagcgtggcaaata

SEQ ID NO: 191645 - DNA, 15 bp, Homo sapiens
atcagcgtggcaaat

SEQ ID NO: 191646 - DNA, 15 bp, Homo sapiens
aatcagcgtggcaaa

SEQ ID NO: 191647 - DNA, 15 bp, Homo sapiens
aaatcagcgtggcaa

SEQ ID NO: 191648 - DNA, 15 bp, Homo sapiens
aaaatcagcgtggca

SEQ ID NO: 191649 - DNA, 15 bp, Homo sapiens
taaaatcagcgtggc

SEQ ID NO: 191650 - DNA, 15 bp, Homo sapiens
ttaaaatcagcgtgg

SEQ ID NO: 191651 - DNA, 15 bp, Homo sapiens
attaaaatcagcgtg

SEQ ID NO: 191652 - DNA, 15 bp, Homo sapiens
aattaaaatcagcgt

SEQ ID NO: 191653 - DNA, 15 bp, Homo sapiens
taattaaaatcagcg

SEQ ID NO: 191654 - DNA, 15 bp, Homo sapiens
ttaattaaaatcagc

SEQ ID NO: 191655 - DNA, 15 bp, Homo sapiens
attaattaaaatcag

SEQ ID NO: 191656 - DNA, 15 bp, Homo sapiens
aattaattaaaatca

SEQ ID NO: 191657 - DNA, 15 bp, Homo sapiens
aaattaattaaaatc

SEQ ID NO: 191658 - DNA, 15 bp, Homo sapiens
aaaattaattaaaat

SEQ ID NO: 191659 - DNA, 15 bp, Homo sapiens
aaaaattaattaaaa

SEQ ID NO: 191660 - DNA, 15 bp, Homo sapiens
aaaaaattaattaaa

SEQ ID NO: 191661 - DNA, 15 bp, Homo sapiens
aaaaaaattaattaa

SEQ ID NO: 191662 - DNA, 15 bp, Homo sapiens
gaaaaaaattaatta

SEQ ID NO: 191663 - DNA, 15 bp, Homo sapiens
ggaaaaaaattaatt

SEQ ID NO: 191664 - DNA, 15 bp, Homo sapiens
gggaaaaaaattaat

SEQ ID NO: 191665 - DNA, 15 bp, Homo sapiens
agggaaaaaaattaa

SEQ ID NO: 191666 - DNA, 15 bp, Homo sapiens
cagggaaaaaaatta

SEQ ID NO: 191667 - DNA, 15 bp, Homo sapiens
tcagggaaaaaaatt

SEQ ID NO: 191668 - DNA, 15 bp, Homo sapiens
ttcagggaaaaaaat

SEQ ID NO: 191669 - DNA, 15 bp, Homo sapiens
tttcagggaaaaaaa

SEQ ID NO: 191670 - DNA, 15 bp, Homo sapiens
ctttcagggaaaaaa

SEQ ID NO: 191671 - DNA, 15 bp, Homo sapiens
actttcagggaaaaa

SEQ ID NO: 191672 - DNA, 15 bp, Homo sapiens
tactttcagggaaaa

SEQ ID NO: 191673 - DNA, 15 bp, Homo sapiens
gtactttcagggaaa

SEQ ID NO: 191674 - DNA, 15 bp, Homo sapiens
agtactttcagggaa

SEQ ID NO: 191675 - DNA, 15 bp, Homo sapiens
aagtactttcaggga

SEQ ID NO: 191676 - DNA, 15 bp, Homo sapiens
gaagtactttcaggg

SEQ ID NO: 191677 - DNA, 15 bp, Homo sapiens
ggaagtactttcagg

SEQ ID NO: 191678 - DNA, 15 bp, Homo sapiens
aggaagtactttcag

SEQ ID NO: 191679 - DNA, 15 bp, Homo sapiens
taggaagtactttca

SEQ ID NO: 191680 - DNA, 15 bp, Homo sapiens
ttaggaagtactttc

SEQ ID NO: 191681 - DNA, 15 bp, Homo sapiens
tttaggaagtacttt

SEQ ID NO: 191682 - DNA, 15 bp, Homo sapiens
ctttaggaagtactt

SEQ ID NO: 191683 - DNA, 15 bp, Homo sapiens
cctttaggaagtact

SEQ ID NO: 191684 - DNA, 15 bp, Homo sapiens
tcctttaggaagtac

SEQ ID NO: 191685 - DNA, 15 bp, Homo sapiens
ttcctttaggaagta

SEQ ID NO: 191686 - DNA, 15 bp, Homo sapiens
cttcctttaggaagt

SEQ ID NO: 191687 - DNA, 15 bp, Homo sapiens
acttcctttaggaag

SEQ ID NO: 191688 - DNA, 15 bp, Homo sapiens
tacttcctttaggaa

SEQ ID NO: 191689 - DNA, 15 bp, Homo sapiens
atacttcctttagga

SEQ ID NO: 191690 - DNA, 15 bp, Homo sapiens
gatacttcctttagg

SEQ ID NO: 191691 - DNA, 15 bp, Homo sapiens
agatacttcctttag

SEQ ID NO: 191692 - DNA, 15 bp, Homo sapiens
gagatacttccttta

SEQ ID NO: 191693 - DNA, 15 bp, Homo sapiens
tgagatacttccttt

SEQ ID NO: 191694 - DNA, 15 bp, Homo sapiens
atgagatacttcctt

SEQ ID NO: 191695 - DNA, 15 bp, Homo sapiens
catgagatacttcct

SEQ ID NO: 191696 - DNA, 15 bp, Homo sapiens
tcatgagatacttcc

SEQ ID NO: 191697 - DNA, 15 bp, Homo sapiens
gtcatgagatacttc

SEQ ID NO: 191698 - DNA, 15 bp, Homo sapiens
agtcatgagatactt

SEQ ID NO: 191699 - DNA, 15 bp, Homo sapiens
aagtcatgagatact

SEQ ID NO: 191700 - DNA, 15 bp, Homo sapiens
aaagtcatgagatac

SEQ ID NO: 191701 - DNA, 15 bp, Homo sapiens
taaagtcatgagata

SEQ ID NO: 191702 - DNA, 15 bp, Homo sapiens
ctaaagtcatgagat

SEQ ID NO: 191703 - DNA, 15 bp, Homo sapiens
cctaaagtcatgaga

SEQ ID NO: 191704 - DNA, 15 bp, Homo sapiens
ccctaaagtcatgag

SEQ ID NO: 191705 - DNA, 15 bp, Homo sapiens
tccctaaagtcatga

SEQ ID NO: 191706 - DNA, 15 bp, Homo sapiens
gtccctaaagtcatg

SEQ ID NO: 191707 - DNA, 15 bp, Homo sapiens
agtccctaaagtcat

SEQ ID NO: 191708 - DNA, 15 bp, Homo sapiens
tagtccctaaagtca

SEQ ID NO: 191709 - DNA, 15 bp, Homo sapiens
atagtccctaaagtc

SEQ ID NO: 191710 - DNA, 15 bp, Homo sapiens
aatagtccctaaagt

SEQ ID NO: 191711 - DNA, 15 bp, Homo sapiens
ttaatagtccctaaa

SEQ ID NO: 191712 - DNA, 15 bp, Homo sapiens
gttaatagtccctaa

SEQ ID NO: 191713 - DNA, 15 bp, Homo sapiens
tgttaatagtcccta

SEQ ID NO: 191714 - DNA, 15 bp, Homo sapiens
atgttaatagtccct

SEQ ID NO: 191715 - DNA, 15 bp, Homo sapiens
tatgttaatagtccc

SEQ ID NO: 191716 - DNA, 15 bp, Homo sapiens
gtatgttaatagtcc

SEQ ID NO: 191717 - DNA, 15 bp, Homo sapiens
agtatgttaatagtc

SEQ ID NO: 191718 - DNA, 15 bp, Homo sapiens
cagtatgttaatagt

SEQ ID NO: 191719 - DNA, 15 bp, Homo sapiens
acagtatgttaatag

SEQ ID NO: 191720 - DNA, 15 bp, Homo sapiens
gacagtatgttaata

SEQ ID NO: 191721 - DNA, 15 bp, Homo sapiens
tgacagtatgttaat

SEQ ID NO: 191722 - DNA, 15 bp, Homo sapiens
atgacagtatgttaa

SEQ ID NO: 191723 - DNA, 15 bp, Homo sapiens
tatgacagtatgtta

SEQ ID NO: 191724 - DNA, 15 bp, Homo sapiens
gtatgacagtatgtt

SEQ ID NO: 191725 - DNA, 15 bp, Homo sapiens
agtatgacagtatgt

SEQ ID NO: 191726 - DNA, 15 bp, Homo sapiens
aagtatgacagtatg

SEQ ID NO: 191727 - DNA, 15 bp, Homo sapiens
taagtatgacagtat

SEQ ID NO: 191728 - DNA, 15 bp, Homo sapiens
ttaagtatgacagta

SEQ ID NO: 191729 - DNA, 15 bp, Homo sapiens
cttaagtatgacagt

SEQ ID NO: 191730 - DNA, 15 bp, Homo sapiens
gcttaagtatgacag

SEQ ID NO: 191731 - DNA, 15 bp, Homo sapiens
ggcttaagtatgaca

SEQ ID NO: 191732 - DNA, 15 bp, Homo sapiens
tggcttaagtatgac

SEQ ID NO: 191733 - DNA, 15 bp, Homo sapiens
atggcttaagtatga

SEQ ID NO: 191734 - DNA, 15 bp, Homo sapiens
aatggcttaagtatg

SEQ ID NO: 191735 - DNA, 15 bp, Homo sapiens
aaatggcttaagtat

SEQ ID NO: 191736 - DNA, 15 bp, Homo sapiens
caaatggcttaagta

SEQ ID NO: 191737 - DNA, 15 bp, Homo sapiens
gcaaatggcttaagt

SEQ ID NO: 191738 - DNA, 15 bp, Homo sapiens
tgcaaatggcttaag

SEQ ID NO: 191739 - DNA, 15 bp, Homo sapiens
atgcaaatggcttaa

SEQ ID NO: 191740 - DNA, 15 bp, Homo sapiens
aatgcaaatggctta

SEQ ID NO: 191741 - DNA, 15 bp, Homo sapiens
caatgcaaatggctt

SEQ ID NO: 191742 - DNA, 15 bp, Homo sapiens
acaatgcaaatggct

SEQ ID NO: 191743 - DNA, 15 bp, Homo sapiens
cacaatgcaaatggc

SEQ ID NO: 191744 - DNA, 15 bp, Homo sapiens
acacaatgcaaatgg

SEQ ID NO: 191745 - DNA, 15 bp, Homo sapiens
tacacaatgcaaatg

SEQ ID NO: 191746 - DNA, 15 bp, Homo sapiens
gtacacaatgcaaat

SEQ ID NO: 191747 - DNA, 15 bp, Homo sapiens
agtacacaatgcaaa

SEQ ID NO: 191748 - DNA, 15 bp, Homo sapiens
cagtacacaatgcaa

SEQ ID NO: 191749 - DNA, 15 bp, Homo sapiens
acagtacacaatgca

SEQ ID NO: 191750 - DNA, 15 bp, Homo sapiens
tacagtacacaatgc

SEQ ID NO: 191751 - DNA, 15 bp, Homo sapiens
atacagtacacaatg

SEQ ID NO: 191752 - DNA, 15 bp, Homo sapiens
aatacagtacacaat

SEQ ID NO: 191753 - DNA, 15 bp, Homo sapiens
aaatacagtacacaa

SEQ ID NO: 191754 - DNA, 15 bp, Homo sapiens
gaaatacagtacaca

SEQ ID NO: 191755 - DNA, 15 bp, Homo sapiens
agaaatacagtacac

SEQ ID NO: 191756 - DNA, 15 bp, Homo sapiens
aagaaatacagtaca

SEQ ID NO: 191757 - DNA, 15 bp, Homo sapiens
aaagaaatacagtac

SEQ ID NO: 191758 - DNA, 15 bp, Homo sapiens
aaaagaaatacagta

SEQ ID NO: 191759 - DNA, 15 bp, Homo sapiens
caaaagaaatacagt

SEQ ID NO: 191760 - DNA, 15 bp, Homo sapiens
acaaaagaaatacag

SEQ ID NO: 191761 - DNA, 15 bp, Homo sapiens
aacaaaagaaataca

SEQ ID NO: 191762 - DNA, 15 bp, Homo sapiens
aaacaaaagaaatac

SEQ ID NO: 191763 - DNA, 15 bp, Homo sapiens
taaacaaaagaaata

SEQ ID NO: 191764 - DNA, 15 bp, Homo sapiens
ttaaacaaaagaaat

SEQ ID NO: 191765 - DNA, 15 bp, Homo sapiens
attaaacaaaagaaa

SEQ ID NO: 191766 - DNA, 15 bp, Homo sapiens
tattaaacaaaagaa

SEQ ID NO: 191767 - DNA, 15 bp, Homo sapiens
ctattaaacaaaaga

SEQ ID NO: 191768 - DNA, 15 bp, Homo sapiens
actattaaacaaaag

SEQ ID NO: 191769 - DNA, 15 bp, Homo sapiens
gactattaaacaaaa

SEQ ID NO: 191770 - DNA, 15 bp, Homo sapiens
tgactattaaacaaa

SEQ ID NO: 191771 - DNA, 15 bp, Homo sapiens
gtgactattaaacaa

SEQ ID NO: 191772 - DNA, 15 bp, Homo sapiens
tgtgactattaaaca

SEQ ID NO: 191773 - DNA, 15 bp, Homo sapiens
ctgtgactattaaac

SEQ ID NO: 191774 - DNA, 15 bp, Homo sapiens
tctgtgactattaaa

SEQ ID NO: 191775 - DNA, 15 bp, Homo sapiens
ctctgtgactattaa

SEQ ID NO: 191776 - DNA, 15 bp, Homo sapiens
cctctgtgactatta

SEQ ID NO: 191777 - DNA, 15 bp, Homo sapiens
tcctctgtgactatt

SEQ ID NO: 191778 - DNA, 15 bp, Homo sapiens
atcctctgtgactat

SEQ ID NO: 191779 - DNA, 15 bp, Homo sapiens
tatcctctgtgacta

SEQ ID NO: 191780 - DNA, 15 bp, Homo sapiens
ctatcctctgtgact

SEQ ID NO: 191781 - DNA, 15 bp, Homo sapiens
actatcctctgtgac

SEQ ID NO: 191782 - DNA, 15 bp, Homo sapiens
cactatcctctgtga

SEQ ID NO: 191783 - DNA, 15 bp, Homo sapiens
acactatcctctgtg

SEQ ID NO: 191784 - DNA, 15 bp, Homo sapiens
tacactatcctctgt

SEQ ID NO: 191785 - DNA, 15 bp, Homo sapiens
ttacactatcctctg

SEQ ID NO: 191786 - DNA, 15 bp, Homo sapiens
attacactatcctct

SEQ ID NO: 191787 - DNA, 15 bp, Homo sapiens
cattacactatcctc

SEQ ID NO: 191788 - DNA, 15 bp, Homo sapiens
ccattacactatcct

SEQ ID NO: 191789 - DNA, 15 bp, Homo sapiens
gccattacactatcc

SEQ ID NO: 191790 - DNA, 15 bp, Homo sapiens
ggccattacactatc

SEQ ID NO: 191791 - DNA, 15 bp, Homo sapiens
tggccattacactat

SEQ ID NO: 191792 - DNA, 15 bp, Homo sapiens
ttggccattacacta

SEQ ID NO: 191793 - DNA, 15 bp, Homo sapiens
attggccattacact

SEQ ID NO: 191794 - DNA, 15 bp, Homo sapiens
aattggccattacac

SEQ ID NO: 191795 - DNA, 15 bp, Homo sapiens
aaattggccattaca

SEQ ID NO: 191796 - DNA, 15 bp, Homo sapiens
aaaattggccattac

SEQ ID NO: 191797 - DNA, 15 bp, Homo sapiens
taaaattggccatta

SEQ ID NO: 191798 - DNA, 15 bp, Homo sapiens
ctaaaattggccatt

SEQ ID NO: 191799 - DNA, 15 bp, Homo sapiens
gctaaaattggccat

SEQ ID NO: 191800 - DNA, 15 bp, Homo sapiens
agctaaaattggcca

SEQ ID NO: 191801 - DNA, 15 bp, Homo sapiens
gagctaaaattggcc

SEQ ID NO: 191802 - DNA, 15 bp, Homo sapiens
tgagctaaaattggc

SEQ ID NO: 191803 - DNA, 15 bp, Homo sapiens
ctgagctaaaattgg

SEQ ID NO: 191804 - DNA, 15 bp, Homo sapiens
actgagctaaaattg

SEQ ID NO: 191805 - DNA, 15 bp, Homo sapiens
cactgagctaaaatt

SEQ ID NO: 191806 - DNA, 15 bp, Homo sapiens
tcactgagctaaaat

SEQ ID NO: 191807 - DNA, 15 bp, Homo sapiens
gtcactgagctaaaa

SEQ ID NO: 191808 - DNA, 15 bp, Homo sapiens
tgtcactgagctaaa

SEQ ID NO: 191809 - DNA, 15 bp, Homo sapiens
atgtcactgagctaa

SEQ ID NO: 191810 - DNA, 15 bp, Homo sapiens
aatgtcactgagcta

SEQ ID NO: 191811 - DNA, 15 bp, Homo sapiens
aaatgtcactgagct

SEQ ID NO: 191812 - DNA, 15 bp, Homo sapiens
aaaatgtcactgagc

SEQ ID NO: 191813 - DNA, 15 bp, Homo sapiens
caaaatgtcactgag

SEQ ID NO: 191814 - DNA, 15 bp, Homo sapiens
tcaaaatgtcactga

SEQ ID NO: 191815 - DNA, 15 bp, Homo sapiens
ctcaaaatgtcactg

SEQ ID NO: 191816 - DNA, 15 bp, Homo sapiens
actcaaaatgtcact

SEQ ID NO: 191817 - DNA, 15 bp, Homo sapiens
cactcaaaatgtcac

SEQ ID NO: 191818 - DNA, 15 bp, Homo sapiens
tcactcaaaatgtca

SEQ ID NO: 191819 - DNA, 15 bp, Homo sapiens
gtcactcaaaatgtc

SEQ ID NO: 191820 - DNA, 15 bp, Homo sapiens
agtcactcaaaatgt

SEQ ID NO: 191821 - DNA, 15 bp, Homo sapiens
cagtcactcaaaatg

SEQ ID NO: 191822 - DNA, 15 bp, Homo sapiens
gcagtcactcaaaat

SEQ ID NO: 191823 - DNA, 15 bp, Homo sapiens
agcagtcactcaaaa

SEQ ID NO: 191824 - DNA, 15 bp, Homo sapiens
cagcagtcactcaaa

SEQ ID NO: 191825 - DNA, 15 bp, Homo sapiens
gcagcagtcactcaa

SEQ ID NO: 191826 - DNA, 15 bp, Homo sapiens
ggcagcagtcactca

SEQ ID NO: 191827 - DNA, 15 bp, Homo sapiens
aggcagcagtcactc

SEQ ID NO: 191828 - DNA, 15 bp, Homo sapiens
aaggcagcagtcact

SEQ ID NO: 191829 - DNA, 15 bp, Homo sapiens
aaaggcagcagtcac

SEQ ID NO: 191830 - DNA, 15 bp, Homo sapiens
aaaaggcagcagtca

SEQ ID NO: 191831 - DNA, 15 bp, Homo sapiens
taaaaggcagcagtc

SEQ ID NO: 191832 - DNA, 15 bp, Homo sapiens
ataaaaggcagcagt

SEQ ID NO: 191833 - DNA, 15 bp, Homo sapiens
aataaaaggcagcag

SEQ ID NO: 191834 - DNA, 15 bp, Homo sapiens
taataaaaggcagca

SEQ ID NO: 191835 - DNA, 15 bp, Homo sapiens
ttaataaaaggcagc

SEQ ID NO: 191836 - DNA, 15 bp, Homo sapiens
attaataaaaggcag

SEQ ID NO: 191837 - DNA, 15 bp, Homo sapiens
aattaataaaaggca

SEQ ID NO: 191838 - DNA, 15 bp, Homo sapiens
aaattaataaaaggc

SEQ ID NO: 191839 - DNA, 15 bp, Homo sapiens
taaattaataaaagg

SEQ ID NO: 191840 - DNA, 15 bp, Homo sapiens
ataaattaataaaag

SEQ ID NO: 191841 - DNA, 15 bp, Homo sapiens
aataaattaataaaa

SEQ ID NO: 191842 - DNA, 15 bp, Homo sapiens
gaataaattaataaa

SEQ ID NO: 191843 - DNA, 15 bp, Homo sapiens
tgaataaattaataa

SEQ ID NO: 191844 - DNA, 15 bp, Homo sapiens
ctgaataaattaata

SEQ ID NO: 191845 - DNA, 15 bp, Homo sapiens
tctgaataaattaat

SEQ ID NO: 191846 - DNA, 15 bp, Homo sapiens
gtctgaataaattaa

SEQ ID NO: 191847 - DNA, 15 bp, Homo sapiens
ggtctgaataaatta

SEQ ID NO: 191848 - DNA, 15 bp, Homo sapiens
aggtctgaataaatt

SEQ ID NO: 191849 - DNA, 15 bp, Homo sapiens
caggtctgaataaat

SEQ ID NO: 191850 - DNA, 15 bp, Homo sapiens
gcaggtctgaataaa

SEQ ID NO: 191851 - DNA, 15 bp, Homo sapiens
agcaggtctgaataa

SEQ ID NO: 191852 - DNA, 15 bp, Homo sapiens
tagcaggtctgaata

SEQ ID NO: 191853 - DNA, 15 bp, Homo sapiens
gtagcaggtctgaat

SEQ ID NO: 191854 - DNA, 15 bp, Homo sapiens
agtagcaggtctgaa

SEQ ID NO: 191855 - DNA, 15 bp, Homo sapiens
cagtagcaggtctga

SEQ ID NO: 191856 - DNA, 15 bp, Homo sapiens
tcagtagcaggtctg

SEQ ID NO: 191857 - DNA, 15 bp, Homo sapiens
ttcagtagcaggtct

SEQ ID NO: 191858 - DNA, 15 bp, Homo sapiens
attcagtagcaggtc

SEQ ID NO: 191859 - DNA, 15 bp, Homo sapiens
cattcagtagcaggt

SEQ ID NO: 191860 - DNA, 15 bp, Homo sapiens
ccattcagtagcagg

SEQ ID NO: 191861 - DNA, 15 bp, Homo sapiens
accattcagtagcag

SEQ ID NO: 191862 - DNA, 15 bp, Homo sapiens
aaccattcagtagca

SEQ ID NO: 191863 - DNA, 15 bp, Homo sapiens
taaccattcagtagc

SEQ ID NO: 191864 - DNA, 15 bp, Homo sapiens
ttaaccattcagtag

SEQ ID NO: 191865 - DNA, 15 bp, Homo sapiens
attaaccattcagta

SEQ ID NO: 191866 - DNA, 15 bp, Homo sapiens
cattaaccattcagt

SEQ ID NO: 191867 - DNA, 15 bp, Homo sapiens
tcattaaccattcag

SEQ ID NO: 191868 - DNA, 15 bp, Homo sapiens
atcattaaccattca

SEQ ID NO: 191869 - DNA, 15 bp, Homo sapiens
tatcattaaccattc

SEQ ID NO: 191870 - DNA, 15 bp, Homo sapiens
ttatcattaaccatt

SEQ ID NO: 191871 - DNA, 15 bp, Homo sapiens
attatcattaaccat

SEQ ID NO: 191872 - DNA, 15 bp, Homo sapiens
gattatcattaacca

SEQ ID NO: 191873 - DNA, 15 bp, Homo sapiens
cgattatcattaacc

SEQ ID NO: 191874 - DNA, 15 bp, Homo sapiens
acgattatcattaac

SEQ ID NO: 191875 - DNA, 15 bp, Homo sapiens
tacgattatcattaa

SEQ ID NO: 191876 - DNA, 15 bp, Homo sapiens
ctacgattatcatta

SEQ ID NO: 191877 - DNA, 15 bp, Homo sapiens
actacgattatcatt

SEQ ID NO: 191878 - DNA, 15 bp, Homo sapiens
aactacgattatcat

SEQ ID NO: 191879 - DNA, 15 bp, Homo sapiens
gaactacgattatca

SEQ ID NO: 191880 - DNA, 15 bp, Homo sapiens
agaactacgattatc

SEQ ID NO: 191881 - DNA, 15 bp, Homo sapiens
gagaactacgattat

SEQ ID NO: 191882 - DNA, 15 bp, Homo sapiens
agagaactacgatta

SEQ ID NO: 191883 - DNA, 15 bp, Homo sapiens
tagagaactacgatt

SEQ ID NO: 191884 - DNA, 15 bp, Homo sapiens
ttagagaactacgat

SEQ ID NO: 191885 - DNA, 15 bp, Homo sapiens
cttagagaactacga

SEQ ID NO: 191886 - DNA, 15 bp, Homo sapiens
ccttagagaactacg

SEQ ID NO: 191887 - DNA, 15 bp, Homo sapiens
cccttagagaactac

SEQ ID NO: 191888 - DNA, 15 bp, Homo sapiens
tcccttagagaacta

SEQ ID NO: 191889 - DNA, 15 bp, Homo sapiens
atcccttagagaact

SEQ ID NO: 191890 - DNA, 15 bp, Homo sapiens
aatcccttagagaac

SEQ ID NO: 191891 - DNA, 15 bp, Homo sapiens
aaatcccttagagaa

SEQ ID NO: 191892 - DNA, 15 bp, Homo sapiens
aaaatcccttagaga

SEQ ID NO: 191893 - DNA, 15 bp, Homo sapiens
aaaaatcccttagag

SEQ ID NO: 191894 - DNA, 15 bp, Homo sapiens
aaaaaatcccttaga

SEQ ID NO: 191895 - DNA, 15 bp, Homo sapiens
caaaaaatcccttag

SEQ ID NO: 191896 - DNA, 15 bp, Homo sapiens
tcaaaaaatccctta

SEQ ID NO: 191897 - DNA, 15 bp, Homo sapiens
atcaaaaaatccctt

SEQ ID NO: 191898 - DNA, 15 bp, Homo sapiens
catcaaaaaatccct

SEQ ID NO: 191899 - DNA, 15 bp, Homo sapiens
acatcaaaaaatccc

SEQ ID NO: 191900 - DNA, 15 bp, Homo sapiens
tacatcaaaaaatcc

SEQ ID NO: 191901 - DNA, 15 bp, Homo sapiens
atacatcaaaaaatc

SEQ ID NO: 191902 - DNA, 15 bp, Homo sapiens
catacatcaaaaaat

SEQ ID NO: 191903 - DNA, 15 bp, Homo sapiens
acatacatcaaaaaa

SEQ ID NO: 191904 - DNA, 15 bp, Homo sapiens
cacatacatcaaaaa

SEQ ID NO: 191905 - DNA, 15 bp, Homo sapiens
acacatacatcaaaa

SEQ ID NO: 191906 - DNA, 15 bp, Homo sapiens
gacacatacatcaaa

SEQ ID NO: 191907 - DNA, 15 bp, Homo sapiens
agacacatacatcaa

SEQ ID NO: 191908 - DNA, 15 bp, Homo sapiens
cagacacatacatca

SEQ ID NO: 191909 - DNA, 15 bp, Homo sapiens
gcagacacatacatc

SEQ ID NO: 191910 - DNA, 15 bp, Homo sapiens
agcagacacatacat

SEQ ID NO: 191911 - DNA, 15 bp, Homo sapiens
cagcagacacataca

SEQ ID NO: 191912 - DNA, 15 bp, Homo sapiens
acagcagacacatac

SEQ ID NO: 191913 - DNA, 15 bp, Homo sapiens
cacagcagacacata

SEQ ID NO: 191914 - DNA, 15 bp, Homo sapiens
acacagcagacacat

SEQ ID NO: 191915 - DNA, 15 bp, Homo sapiens
cacacagcagacaca

SEQ ID NO: 191916 - DNA, 15 bp, Homo sapiens
acacacagcagacac

SEQ ID NO: 191917 - DNA, 15 bp, Homo sapiens
cacacacagcagaca

SEQ ID NO: 191918 - DNA, 15 bp, Homo sapiens
acacacacagcagac

SEQ ID NO: 191919 - DNA, 15 bp, Homo sapiens
cacacacacagcaga

SEQ ID NO: 191920 - DNA, 15 bp, Homo sapiens
tcacacacacagcag

SEQ ID NO: 191921 - DNA, 15 bp, Homo sapiens
ctcacacacacagca

SEQ ID NO: 191922 - DNA, 15 bp, Homo sapiens
actcacacacacagc

SEQ ID NO: 191923 - DNA, 15 bp, Homo sapiens
cactcacacacacag

SEQ ID NO: 191924 - DNA, 15 bp, Homo sapiens
gcactcacacacaca

SEQ ID NO: 191925 - DNA, 15 bp, Homo sapiens
ggcactcacacacac

SEQ ID NO: 191926 - DNA, 15 bp, Homo sapiens
cggcactcacacaca

SEQ ID NO: 191927 - DNA, 15 bp, Homo sapiens
acggcactcacacac

SEQ ID NO: 191928 - DNA, 15 bp, Homo sapiens
aacggcactcacaca

SEQ ID NO: 191929 - DNA, 15 bp, Homo sapiens
gaacggcactcacac

SEQ ID NO: 191930 - DNA, 15 bp, Homo sapiens
agaacggcactcaca

SEQ ID NO: 191931 - DNA, 15 bp, Homo sapiens
gagaacggcactcac

SEQ ID NO: 191932 - DNA, 15 bp, Homo sapiens
agagaacggcactca

SEQ ID NO: 191933 - DNA, 15 bp, Homo sapiens
aagagaacggcactc

SEQ ID NO: 191934 - DNA, 15 bp, Homo sapiens
taagagaacggcact

SEQ ID NO: 191935 - DNA, 15 bp, Homo sapiens
ctaagagaacggcac

SEQ ID NO: 191936 - DNA, 15 bp, Homo sapiens
actaagagaacggca

SEQ ID NO: 191937 - DNA, 15 bp, Homo sapiens
tactaagagaacggc

SEQ ID NO: 191938 - DNA, 15 bp, Homo sapiens
gtactaagagaacgg

SEQ ID NO: 191939 - DNA, 15 bp, Homo sapiens
ggtactaagagaacg

SEQ ID NO: 191940 - DNA, 15 bp, Homo sapiens
tggtactaagagaac

SEQ ID NO: 191941 - DNA, 15 bp, Homo sapiens
atggtactaagagaa

SEQ ID NO: 191942 - DNA, 15 bp, Homo sapiens
aatggtactaagaga

SEQ ID NO: 191943 - DNA, 15 bp, Homo sapiens
gaatggtactaagag

SEQ ID NO: 191944 - DNA, 15 bp, Homo sapiens
agaatggtactaaga

SEQ ID NO: 191945 - DNA, 15 bp, Homo sapiens
gagaatggtactaag

SEQ ID NO: 191946 - DNA, 15 bp, Homo sapiens
agagaatggtactaa

SEQ ID NO: 191947 - DNA, 15 bp, Homo sapiens
aagagaatggtacta

SEQ ID NO: 191948 - DNA, 15 bp, Homo sapiens
caagagaatggtact

SEQ ID NO: 191949 - DNA, 15 bp, Homo sapiens
ccaagagaatggtac

SEQ ID NO: 191950 - DNA, 15 bp, Homo sapiens
accaagagaatggta

SEQ ID NO: 191951 - DNA, 15 bp, Homo sapiens
caccaagagaatggt

SEQ ID NO: 191952 - DNA, 15 bp, Homo sapiens
tcaccaagagaatgg

SEQ ID NO: 191953 - DNA, 15 bp, Homo sapiens
gtcaccaagagaatg

SEQ ID NO: 191954 - DNA, 15 bp, Homo sapiens
agtcaccaagagaat

SEQ ID NO: 191955 - DNA, 15 bp, Homo sapiens
gagtcaccaagagaa

SEQ ID NO: 191956 - DNA, 15 bp, Homo sapiens
ggagtcaccaagaga

SEQ ID NO: 191957 - DNA, 15 bp, Homo sapiens
aggagtcaccaagag

SEQ ID NO: 191958 - DNA, 15 bp, Homo sapiens
aaggagtcaccaaga

SEQ ID NO: 191959 - DNA, 15 bp, Homo sapiens
caaggagtcaccaag

SEQ ID NO: 191960 - DNA, 15 bp, Homo sapiens
ccaaggagtcaccaa

SEQ ID NO: 191961 - DNA, 15 bp, Homo sapiens
cccaaggagtcacca

SEQ ID NO: 191962 - DNA, 15 bp, Homo sapiens
gcccaaggagtcacc

SEQ ID NO: 191963 - DNA, 15 bp, Homo sapiens
tgcccaaggagtcac

SEQ ID NO: 191964 - DNA, 15 bp, Homo sapiens
ttgcccaaggagtca

SEQ ID NO: 191965 - DNA, 15 bp, Homo sapiens
tttgcccaaggagtc

SEQ ID NO: 191966 - DNA, 15 bp, Homo sapiens
ctttgcccaaggagt

SEQ ID NO: 191967 - DNA, 15 bp, Homo sapiens
tctttgcccaaggag

SEQ ID NO: 191968 - DNA, 15 bp, Homo sapiens
atctttgcccaagga

SEQ ID NO: 191969 - DNA, 15 bp, Homo sapiens
catctttgcccaagg

SEQ ID NO: 191970 - DNA, 15 bp, Homo sapiens
gcatctttgcccaag

SEQ ID NO: 191971 - DNA, 15 bp, Homo sapiens
agcatctttgcccaa

SEQ ID NO: 191972 - DNA, 15 bp, Homo sapiens
aagcatctttgccca

SEQ ID NO: 191973 - DNA, 15 bp, Homo sapiens
gaagcatctttgccc

SEQ ID NO: 191974 - DNA, 15 bp, Homo sapiens
ggaagcatctttgcc

SEQ ID NO: 191975 - DNA, 15 bp, Homo sapiens
aggaagcatctttgc

SEQ ID NO: 191976 - DNA, 15 bp, Homo sapiens
taggaagcatctttg

SEQ ID NO: 191977 - DNA, 15 bp, Homo sapiens
ataggaagcatcttt

SEQ ID NO: 191978 - DNA, 15 bp, Homo sapiens
gataggaagcatctt

SEQ ID NO: 191979 - DNA, 15 bp, Homo sapiens
tgataggaagcatct

SEQ ID NO: 191980 - DNA, 15 bp, Homo sapiens
atgataggaagcatc

SEQ ID NO: 191981 - DNA, 15 bp, Homo sapiens
tatgataggaagcat

SEQ ID NO: 191982 - DNA, 15 bp, Homo sapiens
ttatgataggaagca

SEQ ID NO: 191983 - DNA, 15 bp, Homo sapiens
gttatgataggaagc

SEQ ID NO: 191984 - DNA, 15 bp, Homo sapiens
tgttatgataggaag

SEQ ID NO: 191985 - DNA, 15 bp, Homo sapiens
ttgttatgataggaa

SEQ ID NO: 191986 - DNA, 15 bp, Homo sapiens
gttgttatgatagga

SEQ ID NO: 191987 - DNA, 15 bp, Homo sapiens
tgttgttatgatagg

SEQ ID NO: 191988 - DNA, 15 bp, Homo sapiens
gtgttgttatgatag

SEQ ID NO: 191989 - DNA, 15 bp, Homo sapiens
tgtgttgttatgata

SEQ ID NO: 191990 - DNA, 15 bp, Homo sapiens
ctgtgttgttatgat

SEQ ID NO: 191991 - DNA, 15 bp, Homo sapiens
tctgtgttgttatga

SEQ ID NO: 191992 - DNA, 15 bp, Homo sapiens
ctctgtgttgttatg

SEQ ID NO: 191993 - DNA, 15 bp, Homo sapiens
tctctgtgttgttat

SEQ ID NO: 191994 - DNA, 15 bp, Homo sapiens
ctctctgtgttgtta

SEQ ID NO: 191995 - DNA, 15 bp, Homo sapiens
tctctctgtgttgtt

SEQ ID NO: 191996 - DNA, 15 bp, Homo sapiens
ttctctctgtgttgt

SEQ ID NO: 191997 - DNA, 15 bp, Homo sapiens
tttctctctgtgttg

SEQ ID NO: 191998 - DNA, 15 bp, Homo sapiens
gtttctctctgtgtt

SEQ ID NO: 191999 - DNA, 15 bp, Homo sapiens
ggtttctctctgtgt

SEQ ID NO: 192000 - DNA, 15 bp, Homo sapiens
tggtttctctctgtg

SEQ ID NO: 192001 - DNA, 15 bp, Homo sapiens
gtggtttctctctgt

SEQ ID NO: 192002 - DNA, 15 bp, Homo sapiens
agtggtttctctctg

SEQ ID NO: 192003 - DNA, 15 bp, Homo sapiens
gagtggtttctctct

SEQ ID NO: 192004 - DNA, 15 bp, Homo sapiens
tgagtggtttctctc

SEQ ID NO: 192005 - DNA, 15 bp, Homo sapiens
ttgagtggtttctct

SEQ ID NO: 192006 - DNA, 15 bp, Homo sapiens
attgagtggtttctc

SEQ ID NO: 192007 - DNA, 15 bp, Homo sapiens
cattgagtggtttct

SEQ ID NO: 192008 - DNA, 15 bp, Homo sapiens
gcattgagtggtttc

SEQ ID NO: 192009 - DNA, 15 bp, Homo sapiens
agcattgagtggttt

SEQ ID NO: 192010 - DNA, 15 bp, Homo sapiens
cagcattgagtggtt

SEQ ID NO: 192011 - DNA, 15 bp, Homo sapiens
tcagcattgagtggt

SEQ ID NO: 192012 - DNA, 15 bp, Homo sapiens
ttcagcattgagtgg

SEQ ID NO: 192013 - DNA, 15 bp, Homo sapiens
attcagcattgagtg

SEQ ID NO: 192014 - DNA, 15 bp, Homo sapiens
aattcagcattgagt

SEQ ID NO: 192015 - DNA, 15 bp, Homo sapiens
taattcagcattgag

SEQ ID NO: 192016 - DNA, 15 bp, Homo sapiens
gtaattcagcattga

SEQ ID NO: 192017 - DNA, 15 bp, Homo sapiens
agtaattcagcattg

SEQ ID NO: 192018 - DNA, 15 bp, Homo sapiens
aagtaattcagcatt

SEQ ID NO: 192019 - DNA, 15 bp, Homo sapiens
aaagtaattcagcat

SEQ ID NO: 192020 - DNA, 15 bp, Homo sapiens
taaagtaattcagca

SEQ ID NO: 192021 - DNA, 15 bp, Homo sapiens
ataaagtaattcagc

SEQ ID NO: 192022 - DNA, 15 bp, Homo sapiens
cataaagtaattcag

SEQ ID NO: 192023 - DNA, 15 bp, Homo sapiens
ccataaagtaattca

SEQ ID NO: 192024 - DNA, 15 bp, Homo sapiens
gccataaagtaattc

SEQ ID NO: 192025 - DNA, 15 bp, Homo sapiens
tgccataaagtaatt

SEQ ID NO: 192026 - DNA, 15 bp, Homo sapiens
atgccataaagtaat

SEQ ID NO: 192027 - DNA, 15 bp, Homo sapiens
aatgccataaagtaa

SEQ ID NO: 192028 - DNA, 15 bp, Homo sapiens
aaatgccataaagta

SEQ ID NO: 192029 - DNA, 15 bp, Homo sapiens
taaatgccataaagt

SEQ ID NO: 192030 - DNA, 15 bp, Homo sapiens
gtaaatgccataaag

SEQ ID NO: 192031 - DNA, 15 bp, Homo sapiens
ggtaaatgccataaa

SEQ ID NO: 192032 - DNA, 15 bp, Homo sapiens
aggtaaatgccataa

SEQ ID NO: 192033 - DNA, 15 bp, Homo sapiens
gaggtaaatgccata

SEQ ID NO: 192034 - DNA, 15 bp, Homo sapiens
ggaggtaaatgccat

SEQ ID NO: 192035 - DNA, 15 bp, Homo sapiens
aggaggtaaatgcca

SEQ ID NO: 192036 - DNA, 15 bp, Homo sapiens
aaggaggtaaatgcc

SEQ ID NO: 192037 - DNA, 15 bp, Homo sapiens
aaaggaggtaaatgc

SEQ ID NO: 192038 - DNA, 15 bp, Homo sapiens
gaaaggaggtaaatg

SEQ ID NO: 192039 - DNA, 15 bp, Homo sapiens
tgaaaggaggtaaat

SEQ ID NO: 192040 - DNA, 15 bp, Homo sapiens
gtgaaaggaggtaaa

SEQ ID NO: 192041 - DNA, 15 bp, Homo sapiens
tgtgaaaggaggtaa

SEQ ID NO: 192042 - DNA, 15 bp, Homo sapiens
atgtgaaaggaggta

SEQ ID NO: 192043 - DNA, 15 bp, Homo sapiens
catgtgaaaggaggt

SEQ ID NO: 192044 - DNA, 15 bp, Homo sapiens
tcatgtgaaaggagg

SEQ ID NO: 192045 - DNA, 15 bp, Homo sapiens
gtcatgtgaaaggag

SEQ ID NO: 192046 - DNA, 15 bp, Homo sapiens
agtcatgtgaaagga

SEQ ID NO: 192047 - DNA, 15 bp, Homo sapiens
gagtcatgtgaaagg

SEQ ID NO: 192048 - DNA, 15 bp, Homo sapiens
agagtcatgtgaaag

SEQ ID NO: 192049 - DNA, 15 bp, Homo sapiens
tagagtcatgtgaaa

SEQ ID NO: 192050 - DNA, 15 bp, Homo sapiens
atagagtcatgtgaa

SEQ ID NO: 192051 - DNA, 15 bp, Homo sapiens
gatagagtcatgtga

SEQ ID NO: 192052 - DNA, 15 bp, Homo sapiens
agatagagtcatgtg

SEQ ID NO: 192053 - DNA, 15 bp, Homo sapiens
aagatagagtcatgt

SEQ ID NO: 192054 - DNA, 15 bp, Homo sapiens
aaagatagagtcatg

SEQ ID NO: 192055 - DNA, 15 bp, Homo sapiens
aaaagatagagtcat

SEQ ID NO: 192056 - DNA, 15 bp, Homo sapiens
taaaagatagagtca

SEQ ID NO: 192057 - DNA, 15 bp, Homo sapiens
ataaaagatagagtc

SEQ ID NO: 192058 - DNA, 15 bp, Homo sapiens
tataaaagatagagt

SEQ ID NO: 192059 - DNA, 15 bp, Homo sapiens
ttataaaagatagag

SEQ ID NO: 192060 - DNA, 15 bp, Homo sapiens
attataaaagataga

SEQ ID NO: 192061 - DNA, 15 bp, Homo sapiens
aattataaaagatag

SEQ ID NO: 192062 - DNA, 15 bp, Homo sapiens
taattataaaagata

SEQ ID NO: 192063 - DNA, 15 bp, Homo sapiens
gtaattataaaagat

SEQ ID NO: 192064 - DNA, 15 bp, Homo sapiens
tgtaattataaaaga

SEQ ID NO: 192065 - DNA, 15 bp, Homo sapiens
ttgtaattataaaag

SEQ ID NO: 192066 - DNA, 15 bp, Homo sapiens
attgtaattataaaa

SEQ ID NO: 192067 - DNA, 15 bp, Homo sapiens
aattgtaattataaa

SEQ ID NO: 192068 - DNA, 15 bp, Homo sapiens
aaattgtaattataa

SEQ ID NO: 192069 - DNA, 15 bp, Homo sapiens
caaattgtaattata

SEQ ID NO: 192070 - DNA, 15 bp, Homo sapiens
tcaaattgtaattat

SEQ ID NO: 192071 - DNA, 15 bp, Homo sapiens
ttcaaattgtaatta

SEQ ID NO: 192072 - DNA, 15 bp, Homo sapiens
cttcaaattgtaatt

SEQ ID NO: 192073 - DNA, 15 bp, Homo sapiens
gcttcaaattgtaat

SEQ ID NO: 192074 - DNA, 15 bp, Homo sapiens
agcttcaaattgtaa

SEQ ID NO: 192075 - DNA, 15 bp, Homo sapiens
tagcttcaaattgta

SEQ ID NO: 192076 - DNA, 15 bp, Homo sapiens
atagcttcaaattgt

SEQ ID NO: 192077 - DNA, 15 bp, Homo sapiens
tatagcttcaaattg

SEQ ID NO: 192078 - DNA, 15 bp, Homo sapiens
atatagcttcaaatt

SEQ ID NO: 192079 - DNA, 15 bp, Homo sapiens
aatatagcttcaaat

SEQ ID NO: 192080 - DNA, 15 bp, Homo sapiens
caatatagcttcaaa

SEQ ID NO: 192081 - DNA, 15 bp, Homo sapiens
acaatatagcttcaa

SEQ ID NO: 192082 - DNA, 15 bp, Homo sapiens
tacaatatagcttca

SEQ ID NO: 192083 - DNA, 15 bp, Homo sapiens
atacaatatagcttc

SEQ ID NO: 192084 - DNA, 15 bp, Homo sapiens
aatacaatatagctt

SEQ ID NO: 192085 - DNA, 15 bp, Homo sapiens
caatacaatatagct

SEQ ID NO: 192086 - DNA, 15 bp, Homo sapiens
gcaatacaatatagc

SEQ ID NO: 192087 - DNA, 15 bp, Homo sapiens
agcaatacaatatag

SEQ ID NO: 192088 - DNA, 15 bp, Homo sapiens
gagcaatacaatata

SEQ ID NO: 192089 - DNA, 15 bp, Homo sapiens
tgagcaatacaatat

SEQ ID NO: 192090 - DNA, 15 bp, Homo sapiens
ctgagcaatacaata

SEQ ID NO: 192091 - DNA, 15 bp, Homo sapiens
actgagcaatacaat

SEQ ID NO: 192092 - DNA, 15 bp, Homo sapiens
aactgagcaatacaa

SEQ ID NO: 192093 - DNA, 15 bp, Homo sapiens
aaactgagcaataca

SEQ ID NO: 192094 - DNA, 15 bp, Homo sapiens
caaactgagcaatac

SEQ ID NO: 192095 - DNA, 15 bp, Homo sapiens
gcaaactgagcaata

SEQ ID NO: 192096 - DNA, 15 bp, Homo sapiens
ggcaaactgagcaat

SEQ ID NO: 192097 - DNA, 15 bp, Homo sapiens
tggcaaactgagcaa

SEQ ID NO: 192098 - DNA, 15 bp, Homo sapiens
atggcaaactgagca

SEQ ID NO: 192099 - DNA, 15 bp, Homo sapiens
tatggcaaactgagc

SEQ ID NO: 192100 - DNA, 15 bp, Homo sapiens
atatggcaaactgag

SEQ ID NO: 192101 - DNA, 15 bp, Homo sapiens
gatatggcaaactga

SEQ ID NO: 192102 - DNA, 15 bp, Homo sapiens
agatatggcaaactg

SEQ ID NO: 192103 - DNA, 15 bp, Homo sapiens
gagatatggcaaact

SEQ ID NO: 192104 - DNA, 15 bp, Homo sapiens
tgagatatggcaaac

SEQ ID NO: 192105 - DNA, 15 bp, Homo sapiens
atgagatatggcaaa

SEQ ID NO: 192106 - DNA, 15 bp, Homo sapiens
aatgagatatggcaa

SEQ ID NO: 192107 - DNA, 15 bp, Homo sapiens
aaatgagatatggca

SEQ ID NO: 192108 - DNA, 15 bp, Homo sapiens
aaaatgagatatggc

SEQ ID NO: 192109 - DNA, 15 bp, Homo sapiens
taaaatgagatatgg

SEQ ID NO: 192110 - DNA, 15 bp, Homo sapiens
ttaaaatgagatatg

SEQ ID NO: 192111 - DNA, 15 bp, Homo sapiens
tttaaaatgagatat

SEQ ID NO: 192112 - DNA, 15 bp, Homo sapiens
ttttaaaatgagata

SEQ ID NO: 192113 - DNA, 15 bp, Homo sapiens
gttttaaaatgagat

SEQ ID NO: 192114 - DNA, 15 bp, Homo sapiens
tgttttaaaatgaga

SEQ ID NO: 192115 - DNA, 15 bp, Homo sapiens
ttgttttaaaatgag

SEQ ID NO: 192116 - DNA, 15 bp, Homo sapiens
tttgttttaaaatga

SEQ ID NO: 192117 - DNA, 15 bp, Homo sapiens
atttgttttaaaatg

SEQ ID NO: 192118 - DNA, 15 bp, Homo sapiens
catttgttttaaaat

SEQ ID NO: 192119 - DNA, 15 bp, Homo sapiens
acatttgttttaaaa

SEQ ID NO: 192120 - DNA, 15 bp, Homo sapiens
cacatttgttttaaa

SEQ ID NO: 192121 - DNA, 15 bp, Homo sapiens
acacatttgttttaa

SEQ ID NO: 192122 - DNA, 15 bp, Homo sapiens
gacacatttgtttta

SEQ ID NO: 192123 - DNA, 15 bp, Homo sapiens
ggacacatttgtttt

SEQ ID NO: 192124 - DNA, 15 bp, Homo sapiens
aggacacatttgttt

SEQ ID NO: 192125 - DNA, 15 bp, Homo sapiens
gaggacacatttgtt

SEQ ID NO: 192126 - DNA, 15 bp, Homo sapiens
tgaggacacatttgt

SEQ ID NO: 192127 - DNA, 15 bp, Homo sapiens
ttgaggacacatttg

SEQ ID NO: 192128 - DNA, 15 bp, Homo sapiens
attgaggacacattt

SEQ ID NO: 192129 - DNA, 15 bp, Homo sapiens
tattgaggacacatt

SEQ ID NO: 192130 - DNA, 15 bp, Homo sapiens
ttattgaggacacat

SEQ ID NO: 192131 - DNA, 15 bp, Homo sapiens
cttattgaggacaca

SEQ ID NO: 192132 - DNA, 15 bp, Homo sapiens
tcttattgaggacac

SEQ ID NO: 192133 - DNA, 15 bp, Homo sapiens
atcttattgaggaca

SEQ ID NO: 192134 - DNA, 15 bp, Homo sapiens
tatcttattgaggac

SEQ ID NO: 192135 - DNA, 15 bp, Homo sapiens
atatcttattgagga

SEQ ID NO: 192136 - DNA, 15 bp, Homo sapiens
tatatcttattgagg

SEQ ID NO: 192137 - DNA, 15 bp, Homo sapiens
ctatatcttattgag

SEQ ID NO: 192138 - DNA, 15 bp, Homo sapiens
actatatcttattga

SEQ ID NO: 192139 - DNA, 15 bp, Homo sapiens
tactatatcttattg

SEQ ID NO: 192140 - DNA, 15 bp, Homo sapiens
ttactatatcttatt

SEQ ID NO: 192141 - DNA, 15 bp, Homo sapiens
tttactatatcttat

SEQ ID NO: 192142 - DNA, 15 bp, Homo sapiens
gtttactatatctta

SEQ ID NO: 192143 - DNA, 15 bp, Homo sapiens
tgtttactatatctt

SEQ ID NO: 192144 - DNA, 15 bp, Homo sapiens
gtgtttactatatct

SEQ ID NO: 192145 - DNA, 15 bp, Homo sapiens
tgtgtttactatatc

SEQ ID NO: 192146 - DNA, 15 bp, Homo sapiens
atgtgtttactatat

SEQ ID NO: 192147 - DNA, 15 bp, Homo sapiens
aatgtgtttactata

SEQ ID NO: 192148 - DNA, 15 bp, Homo sapiens
aaatgtgtttactat

SEQ ID NO: 192149 - DNA, 15 bp, Homo sapiens
gaaatgtgtttacta

SEQ ID NO: 192150 - DNA, 15 bp, Homo sapiens
tgaaatgtgtttact

SEQ ID NO: 192151 - DNA, 15 bp, Homo sapiens
ttgaaatgtgtttac

SEQ ID NO: 192152 - DNA, 15 bp, Homo sapiens
tttgaaatgtgttta

SEQ ID NO: 192153 - DNA, 15 bp, Homo sapiens
ctttgaaatgtgttt

SEQ ID NO: 192154 - DNA, 15 bp, Homo sapiens
actttgaaatgtgtt

SEQ ID NO: 192155 - DNA, 15 bp, Homo sapiens
gactttgaaatgtgt

SEQ ID NO: 192156 - DNA, 15 bp, Homo sapiens
agactttgaaatgtg

SEQ ID NO: 192157 - DNA, 15 bp, Homo sapiens
gagactttgaaatgt

SEQ ID NO: 192158 - DNA, 15 bp, Homo sapiens
ggagactttgaaatg

SEQ ID NO: 192159 - DNA, 15 bp, Homo sapiens
aggagactttgaaat

SEQ ID NO: 192160 - DNA, 15 bp, Homo sapiens
gaggagactttgaaa

SEQ ID NO: 192161 - DNA, 15 bp, Homo sapiens
tgaggagactttgaa

SEQ ID NO: 192162 - DNA, 15 bp, Homo sapiens
atgaggagactttga

SEQ ID NO: 192163 - DNA, 15 bp, Homo sapiens
aatgaggagactttg

SEQ ID NO: 192164 - DNA, 15 bp, Homo sapiens
aaatgaggagacttt

SEQ ID NO: 192165 - DNA, 15 bp, Homo sapiens
taaatgaggagactt

SEQ ID NO: 192166 - DNA, 15 bp, Homo sapiens
ataaatgaggagact

SEQ ID NO: 192167 - DNA, 15 bp, Homo sapiens
aataaatgaggagac

SEQ ID NO: 192168 - DNA, 15 bp, Homo sapiens
gaataaatgaggaga

SEQ ID NO: 192169 - DNA, 15 bp, Homo sapiens
ggaataaatgaggag

SEQ ID NO: 192170 - DNA, 15 bp, Homo sapiens
gggaataaatgagga

SEQ ID NO: 192171 - DNA, 15 bp, Homo sapiens
agggaataaatgagg

SEQ ID NO: 192172 - DNA, 15 bp, Homo sapiens
tagggaataaatgag

SEQ ID NO: 192173 - DNA, 15 bp, Homo sapiens
gtagggaataaatga

SEQ ID NO: 192174 - DNA, 15 bp, Homo sapiens
agtagggaataaatg

SEQ ID NO: 192175 - DNA, 15 bp, Homo sapiens
aagtagggaataaat

SEQ ID NO: 192176 - DNA, 15 bp, Homo sapiens
taagtagggaataaa

SEQ ID NO: 192177 - DNA, 15 bp, Homo sapiens
ctaagtagggaataa

SEQ ID NO: 192178 - DNA, 15 bp, Homo sapiens
gctaagtagggaata

SEQ ID NO: 192179 - DNA, 15 bp, Homo sapiens
tgctaagtagggaat

SEQ ID NO: 192180 - DNA, 15 bp, Homo sapiens
ttgctaagtagggaa

SEQ ID NO: 192181 - DNA, 15 bp, Homo sapiens
tttgctaagtaggga

SEQ ID NO: 192182 - DNA, 15 bp, Homo sapiens
atttgctaagtaggg

SEQ ID NO: 192183 - DNA, 15 bp, Homo sapiens
tatttgctaagtagg

SEQ ID NO: 192184 - DNA, 15 bp, Homo sapiens
atatttgctaagtag

SEQ ID NO: 192185 - DNA, 15 bp, Homo sapiens
caaatatttgctaag

SEQ ID NO: 192186 - DNA, 15 bp, Homo sapiens
acaaatatttgctaa

SEQ ID NO: 192187 - DNA, 15 bp, Homo sapiens
cacaaatatttgcta

SEQ ID NO: 192188 - DNA, 15 bp, Homo sapiens
tcacaaatatttgct

SEQ ID NO: 192189 - DNA, 15 bp, Homo sapiens
ttcacaaatatttgc

SEQ ID NO: 192190 - DNA, 15 bp, Homo sapiens
cttcacaaatatttg

SEQ ID NO: 192191 - DNA, 15 bp, Homo sapiens
acttcacaaatattt

SEQ ID NO: 192192 - DNA, 15 bp, Homo sapiens
tacttcacaaatatt

SEQ ID NO: 192193 - DNA, 15 bp, Homo sapiens
atacttcacaaatat

SEQ ID NO: 192194 - DNA, 15 bp, Homo sapiens
catacttcacaaata

SEQ ID NO: 192195 - DNA, 15 bp, Homo sapiens
acatacttcacaaat

SEQ ID NO: 192196 - DNA, 15 bp, Homo sapiens
tacatacttcacaaa

SEQ ID NO: 192197 - DNA, 15 bp, Homo sapiens
gtacatacttcacaa

SEQ ID NO: 192198 - DNA, 15 bp, Homo sapiens
ggtacatacttcaca

SEQ ID NO: 192199 - DNA, 15 bp, Homo sapiens
tggtacatacttcac

SEQ ID NO: 192200 - DNA, 15 bp, Homo sapiens
ctggtacatacttca

SEQ ID NO: 192201 - DNA, 15 bp, Homo sapiens
cctggtacatacttc

SEQ ID NO: 192202 - DNA, 15 bp, Homo sapiens
acctggtacatactt

SEQ ID NO: 192203 - DNA, 15 bp, Homo sapiens
cacctggtacatact

SEQ ID NO: 192204 - DNA, 15 bp, Homo sapiens
gcacctggtacatac

SEQ ID NO: 192205 - DNA, 15 bp, Homo sapiens
agcacctggtacata

SEQ ID NO: 192206 - DNA, 15 bp, Homo sapiens
tagcacctggtacat

SEQ ID NO: 192207 - DNA, 15 bp, Homo sapiens
ctagcacctggtaca

SEQ ID NO: 192208 - DNA, 15 bp, Homo sapiens
actagcacctggtac

SEQ ID NO: 192209 - DNA, 15 bp, Homo sapiens
gactagcacctggta

SEQ ID NO: 192210 - DNA, 15 bp, Homo sapiens
agactagcacctggt

SEQ ID NO: 192211 - DNA, 15 bp, Homo sapiens
tagactagcacctgg

SEQ ID NO: 192212 - DNA, 15 bp, Homo sapiens
ttagactagcacctg

SEQ ID NO: 192213 - DNA, 15 bp, Homo sapiens
cttagactagcacct

SEQ ID NO: 192214 - DNA, 15 bp, Homo sapiens
acttagactagcacc

SEQ ID NO: 192215 - DNA, 15 bp, Homo sapiens
cacttagactagcac

SEQ ID NO: 192216 - DNA, 15 bp, Homo sapiens
acacttagactagca

SEQ ID NO: 192217 - DNA, 15 bp, Homo sapiens
tacacttagactagc

SEQ ID NO: 192218 - DNA, 15 bp, Homo sapiens
atacacttagactag

SEQ ID NO: 192219 - DNA, 15 bp, Homo sapiens
tatacacttagacta

SEQ ID NO: 192220 - DNA, 15 bp, Homo sapiens
ctatacacttagact

SEQ ID NO: 192221 - DNA, 15 bp, Homo sapiens
tctatacacttagac

SEQ ID NO: 192222 - DNA, 15 bp, Homo sapiens
atctatacacttaga

SEQ ID NO: 192223 - DNA, 15 bp, Homo sapiens
catctatacacttag

SEQ ID NO: 192224 - DNA, 15 bp, Homo sapiens
ccatctatacactta

SEQ ID NO: 192225 - DNA, 15 bp, Homo sapiens
tccatctatacactt

SEQ ID NO: 192226 - DNA, 15 bp, Homo sapiens
ctccatctatacact

SEQ ID NO: 192227 - DNA, 15 bp, Homo sapiens
tctccatctatacac

SEQ ID NO: 192228 - DNA, 15 bp, Homo sapiens
ttctccatctataca

SEQ ID NO: 192229 - DNA, 15 bp, Homo sapiens
cttctccatctatac

SEQ ID NO: 192230 - DNA, 15 bp, Homo sapiens
tcttctccatctata

SEQ ID NO: 192231 - DNA, 15 bp, Homo sapiens
gtcttctccatctat

SEQ ID NO: 192232 - DNA, 15 bp, Homo sapiens
tgtcttctccatcta

SEQ ID NO: 192233 - DNA, 15 bp, Homo sapiens
atgtcttctccatct

SEQ ID NO: 192234 - DNA, 15 bp, Homo sapiens
aatgtcttctccatc

SEQ ID NO: 192235 - DNA, 15 bp, Homo sapiens
caatgtcttctccat

SEQ ID NO: 192236 - DNA, 15 bp, Homo sapiens
tcaatgtcttctcca

SEQ ID NO: 192237 - DNA, 15 bp, Homo sapiens
atcaatgtcttctcc

SEQ ID NO: 192238 - DNA, 15 bp, Homo sapiens
gatcaatgtcttctc

SEQ ID NO: 192239 - DNA, 15 bp, Homo sapiens
agatcaatgtcttct

SEQ ID NO: 192240 - DNA, 15 bp, Homo sapiens
aagatcaatgtcttc

SEQ ID NO: 192241 - DNA, 15 bp, Homo sapiens
taagatcaatgtctt

SEQ ID NO: 192242 - DNA, 15 bp, Homo sapiens
ataagatcaatgtct

SEQ ID NO: 192243 - DNA, 15 bp, Homo sapiens
cataagatcaatgtc

SEQ ID NO: 192244 - DNA, 15 bp, Homo sapiens
ccataagatcaatgt

SEQ ID NO: 192245 - DNA, 15 bp, Homo sapiens
gccataagatcaatg

SEQ ID NO: 192246 - DNA, 15 bp, Homo sapiens
ggccataagatcaat

SEQ ID NO: 192247 - DNA, 15 bp, Homo sapiens
cggccataagatcaa

SEQ ID NO: 192248 - DNA, 15 bp, Homo sapiens
tcggccataagatca

SEQ ID NO: 192249 - DNA, 15 bp, Homo sapiens
ttcggccataagatc

SEQ ID NO: 192250 - DNA, 15 bp, Homo sapiens
attcggccataagat

SEQ ID NO: 192251 - DNA, 15 bp, Homo sapiens
cattcggccataaga

SEQ ID NO: 192252 - DNA, 15 bp, Homo sapiens
ccattcggccataag

SEQ ID NO: 192253 - DNA, 15 bp, Homo sapiens
cccattcggccataa

SEQ ID NO: 192254 - DNA, 15 bp, Homo sapiens
tcccattcggccata

SEQ ID NO: 192255 - DNA, 15 bp, Homo sapiens
ctcccattcggccat

SEQ ID NO: 192256 - DNA, 15 bp, Homo sapiens
cctcccattcggcca

SEQ ID NO: 192257 - DNA, 15 bp, Homo sapiens
tcctcccattcggcc

SEQ ID NO: 192258 - DNA, 15 bp, Homo sapiens
atcctcccattcggc

SEQ ID NO: 192259 - DNA, 15 bp, Homo sapiens
tatcctcccattcgg

SEQ ID NO: 192260 - DNA, 15 bp, Homo sapiens
gtatcctcccattcg

SEQ ID NO: 192261 - DNA, 15 bp, Homo sapiens
tgtatcctcccattc

SEQ ID NO: 192262 - DNA, 15 bp, Homo sapiens
ctgtatcctcccatt

SEQ ID NO: 192263 - DNA, 15 bp, Homo sapiens
tctgtatcctcccat

SEQ ID NO: 192264 - DNA, 15 bp, Homo sapiens
gtctgtatcctccca

SEQ ID NO: 192265 - DNA, 15 bp, Homo sapiens
tgtctgtatcctccc

SEQ ID NO: 192266 - DNA, 15 bp, Homo sapiens
ttgtctgtatcctcc

SEQ ID NO: 192267 - DNA, 15 bp, Homo sapiens
cttgtctgtatcctc

SEQ ID NO: 192268 - DNA, 15 bp, Homo sapiens
ccttgtctgtatcct

SEQ ID NO: 192269 - DNA, 15 bp, Homo sapiens
tccttgtctgtatcc

SEQ ID NO: 192270 - DNA, 15 bp, Homo sapiens
gtccttgtctgtatc

SEQ ID NO: 192271 - DNA, 15 bp, Homo sapiens
tgtccttgtctgtat

SEQ ID NO: 192272 - DNA, 15 bp, Homo sapiens
atgtccttgtctgta

SEQ ID NO: 192273 - DNA, 15 bp, Homo sapiens
aatgtccttgtctgt

SEQ ID NO: 192274 - DNA, 15 bp, Homo sapiens
aaatgtccttgtctg

SEQ ID NO: 192275 - DNA, 15 bp, Homo sapiens
aaaatgtccttgtct

SEQ ID NO: 192276 - DNA, 15 bp, Homo sapiens
gaaaatgtccttgtc

SEQ ID NO: 192277 - DNA, 15 bp, Homo sapiens
tgaaaatgtccttgt

SEQ ID NO: 192278 - DNA, 15 bp, Homo sapiens
ttgaaaatgtccttg

SEQ ID NO: 192279 - DNA, 15 bp, Homo sapiens
attgaaaatgtcctt

SEQ ID NO: 192280 - DNA, 15 bp, Homo sapiens
cattgaaaatgtcct

SEQ ID NO: 192281 - DNA, 15 bp, Homo sapiens
tcattgaaaatgtcc

SEQ ID NO: 192282 - DNA, 15 bp, Homo sapiens
gtcattgaaaatgtc

SEQ ID NO: 192283 - DNA, 15 bp, Homo sapiens
tgtcattgaaaatgt

SEQ ID NO: 192284 - DNA, 15 bp, Homo sapiens
ttgtcattgaaaatg

SEQ ID NO: 192285 - DNA, 15 bp, Homo sapiens
gttgtcattgaaaat

SEQ ID NO: 192286 - DNA, 15 bp, Homo sapiens
agttgtcattgaaaa

SEQ ID NO: 192287 - DNA, 15 bp, Homo sapiens
cagttgtcattgaaa

SEQ ID NO: 192288 - DNA, 15 bp, Homo sapiens
gcagttgtcattgaa

SEQ ID NO: 192289 - DNA, 15 bp, Homo sapiens
tgcagttgtcattga

SEQ ID NO: 192290 - DNA, 15 bp, Homo sapiens
atgcagttgtcattg

SEQ ID NO: 192291 - DNA, 15 bp, Homo sapiens
tatgcagttgtcatt

SEQ ID NO: 192292 - DNA, 15 bp, Homo sapiens
ttatgcagttgtcat

SEQ ID NO: 192293 - DNA, 15 bp, Homo sapiens
attatgcagttgtca

SEQ ID NO: 192294 - DNA, 15 bp, Homo sapiens
aattatgcagttgtc

SEQ ID NO: 192295 - DNA, 15 bp, Homo sapiens
taattatgcagttgt

SEQ ID NO: 192296 - DNA, 15 bp, Homo sapiens
ttaattatgcagttg

SEQ ID NO: 192297 - DNA, 15 bp, Homo sapiens
cttaattatgcagtt

SEQ ID NO: 192298 - DNA, 15 bp, Homo sapiens
gcttaattatgcagt

SEQ ID NO: 192299 - DNA, 15 bp, Homo sapiens
tgcttaattatgcag

SEQ ID NO: 192300 - DNA, 15 bp, Homo sapiens
ttgcttaattatgca

SEQ ID NO: 192301 - DNA, 15 bp, Homo sapiens
tttgcttaattatgc

SEQ ID NO: 192302 - DNA, 15 bp, Homo sapiens
ttttgcttaattatg

SEQ ID NO: 192303 - DNA, 15 bp, Homo sapiens
cttttgcttaattat

SEQ ID NO: 192304 - DNA, 15 bp, Homo sapiens
acttttgcttaatta

SEQ ID NO: 192305 - DNA, 15 bp, Homo sapiens
tacttttgcttaatt

SEQ ID NO: 192306 - DNA, 15 bp, Homo sapiens
ctacttttgcttaat

SEQ ID NO: 192307 - DNA, 15 bp, Homo sapiens
tctacttttgcttaa

SEQ ID NO: 192308 - DNA, 15 bp, Homo sapiens
atctacttttgctta

SEQ ID NO: 192309 - DNA, 15 bp, Homo sapiens
catctacttttgctt

SEQ ID NO: 192310 - DNA, 15 bp, Homo sapiens
tcatctacttttgct

SEQ ID NO: 192311 - DNA, 15 bp, Homo sapiens
ttcatctacttttgc

SEQ ID NO: 192312 - DNA, 15 bp, Homo sapiens
tttcatctacttttg

SEQ ID NO: 192313 - DNA, 15 bp, Homo sapiens
atttcatctactttt

SEQ ID NO: 192314 - DNA, 15 bp, Homo sapiens
aatttcatctacttt

SEQ ID NO: 192315 - DNA, 15 bp, Homo sapiens
taatttcatctactt

SEQ ID NO: 192316 - DNA, 15 bp, Homo sapiens
ataatttcatctact

SEQ ID NO: 192317 - DNA, 15 bp, Homo sapiens
tataatttcatctac

SEQ ID NO: 192318 - DNA, 15 bp, Homo sapiens
ttataatttcatcta

SEQ ID NO: 192319 - DNA, 15 bp, Homo sapiens
cttataatttcatct

SEQ ID NO: 192320 - DNA, 15 bp, Homo sapiens
tcttataatttcatc

SEQ ID NO: 192321 - DNA, 15 bp, Homo sapiens
ctcttataatttcat

SEQ ID NO: 192322 - DNA, 15 bp, Homo sapiens
actcttataatttca

SEQ ID NO: 192323 - DNA, 15 bp, Homo sapiens
tactcttataatttc

SEQ ID NO: 192324 - DNA, 15 bp, Homo sapiens
ttactcttataattt

SEQ ID NO: 192325 - DNA, 15 bp, Homo sapiens
attactcttataatt

SEQ ID NO: 192326 - DNA, 15 bp, Homo sapiens
cattactcttataat

SEQ ID NO: 192327 - DNA, 15 bp, Homo sapiens
tcattactcttataa

SEQ ID NO: 192328 - DNA, 15 bp, Homo sapiens
atcattactcttata

SEQ ID NO: 192329 - DNA, 15 bp, Homo sapiens
tatcattactcttat

SEQ ID NO: 192330 - DNA, 15 bp, Homo sapiens
ctatcattactctta

SEQ ID NO: 192331 - DNA, 15 bp, Homo sapiens
gctatcattactctt

SEQ ID NO: 192332 - DNA, 15 bp, Homo sapiens
ggctatcattactct

SEQ ID NO: 192333 - DNA, 15 bp, Homo sapiens
gggctatcattactc

SEQ ID NO: 192334 - DNA, 15 bp, Homo sapiens
agggctatcattact

SEQ ID NO: 192335 - DNA, 15 bp, Homo sapiens
tagggctatcattac

SEQ ID NO: 192336 - DNA, 15 bp, Homo sapiens
ttagggctatcatta

SEQ ID NO: 192337 - DNA, 15 bp, Homo sapiens
attagggctatcatt

SEQ ID NO: 192338 - DNA, 15 bp, Homo sapiens
gattagggctatcat

SEQ ID NO: 192339 - DNA, 15 bp, Homo sapiens
agattagggctatca

SEQ ID NO: 192340 - DNA, 15 bp, Homo sapiens
gagattagggctatc

SEQ ID NO: 192341 - DNA, 15 bp, Homo sapiens
tgagattagggctat

SEQ ID NO: 192342 - DNA, 15 bp, Homo sapiens
ctgagattagggcta

SEQ ID NO: 192343 - DNA, 15 bp, Homo sapiens
actgagattagggct

SEQ ID NO: 192344 - DNA, 15 bp, Homo sapiens
tactgagattagggc

SEQ ID NO: 192345 - DNA, 15 bp, Homo sapiens
gtactgagattaggg

SEQ ID NO: 192346 - DNA, 15 bp, Homo sapiens
agtactgagattagg

SEQ ID NO: 192347 - DNA, 15 bp, Homo sapiens
aagtactgagattag

SEQ ID NO: 192348 - DNA, 15 bp, Homo sapiens
caagtactgagatta

SEQ ID NO: 192349 - DNA, 15 bp, Homo sapiens
acaagtactgagatt

SEQ ID NO: 192350 - DNA, 15 bp, Homo sapiens
cacaagtactgagat

SEQ ID NO: 192351 - DNA, 15 bp, Homo sapiens
tcacaagtactgaga

SEQ ID NO: 192352 - DNA, 15 bp, Homo sapiens
ttcacaagtactgag

SEQ ID NO: 192353 - DNA, 15 bp, Homo sapiens
cttcacaagtactga

SEQ ID NO: 192354 - DNA, 15 bp, Homo sapiens
acttcacaagtactg

SEQ ID NO: 192355 - DNA, 15 bp, Homo sapiens
gacttcacaagtact

SEQ ID NO: 192356 - DNA, 15 bp, Homo sapiens
agacttcacaagtac

SEQ ID NO: 192357 - DNA, 15 bp, Homo sapiens
gagacttcacaagta

SEQ ID NO: 192358 - DNA, 15 bp, Homo sapiens
agagacttcacaagt

SEQ ID NO: 192359 - DNA, 15 bp, Homo sapiens
gagagacttcacaag

SEQ ID NO: 192360 - DNA, 15 bp, Homo sapiens
ggagagacttcacaa

SEQ ID NO: 192361 - DNA, 15 bp, Homo sapiens
aggagagacttcaca

SEQ ID NO: 192362 - DNA, 15 bp, Homo sapiens
caggagagacttcac

SEQ ID NO: 192363 - DNA, 15 bp, Homo sapiens
ccaggagagacttca

SEQ ID NO: 192364 - DNA, 15 bp, Homo sapiens
tccaggagagacttc

SEQ ID NO: 192365 - DNA, 15 bp, Homo sapiens
ctccaggagagactt

SEQ ID NO: 192366 - DNA, 15 bp, Homo sapiens
tctccaggagagact

SEQ ID NO: 192367 - DNA, 15 bp, Homo sapiens
ttctccaggagagac

SEQ ID NO: 192368 - DNA, 15 bp, Homo sapiens
tttctccaggagaga

SEQ ID NO: 192369 - DNA, 15 bp, Homo sapiens
atttctccaggagag

SEQ ID NO: 192370 - DNA, 15 bp, Homo sapiens
aatttctccaggaga

SEQ ID NO: 192371 - DNA, 15 bp, Homo sapiens
taatttctccaggag

SEQ ID NO: 192372 - DNA, 15 bp, Homo sapiens
gtaatttctccagga

SEQ ID NO: 192373 - DNA, 15 bp, Homo sapiens
tgtaatttctccagg

SEQ ID NO: 192374 - DNA, 15 bp, Homo sapiens
atgtaatttctccag

SEQ ID NO: 192375 - DNA, 15 bp, Homo sapiens
aatgtaatttctcca

SEQ ID NO: 192376 - DNA, 15 bp, Homo sapiens
aaatgtaatttctcc

SEQ ID NO: 192377 - DNA, 15 bp, Homo sapiens
taaatgtaatttctc

SEQ ID NO: 192378 - DNA, 15 bp, Homo sapiens
ttaaatgtaatttct

SEQ ID NO: 192379 - DNA, 15 bp, Homo sapiens
tttaaatgtaatttc

SEQ ID NO: 192380 - DNA, 15 bp, Homo sapiens
gtttaaatgtaattt

SEQ ID NO: 192381 - DNA, 15 bp, Homo sapiens
agtttaaatgtaatt

SEQ ID NO: 192382 - DNA, 15 bp, Homo sapiens
cagtttaaatgtaat

SEQ ID NO: 192383 - DNA, 15 bp, Homo sapiens
tcagtttaaatgtaa

SEQ ID NO: 192384 - DNA, 15 bp, Homo sapiens
ctcagtttaaatgta

SEQ ID NO: 192385 - DNA, 15 bp, Homo sapiens
tctcagtttaaatgt

SEQ ID NO: 192386 - DNA, 15 bp, Homo sapiens
gtctcagtttaaatg

SEQ ID NO: 192387 - DNA, 15 bp, Homo sapiens
agtctcagtttaaat

SEQ ID NO: 192388 - DNA, 15 bp, Homo sapiens
aagtctcagtttaaa

SEQ ID NO: 192389 - DNA, 15 bp, Homo sapiens
taagtctcagtttaa

SEQ ID NO: 192390 - DNA, 15 bp, Homo sapiens
ttaagtctcagttta

SEQ ID NO: 192391 - DNA, 15 bp, Homo sapiens
gttaagtctcagttt

SEQ ID NO: 192392 - DNA, 15 bp, Homo sapiens
tgttaagtctcagtt

SEQ ID NO: 192393 - DNA, 15 bp, Homo sapiens
ctgttaagtctcagt

SEQ ID NO: 192394 - DNA, 15 bp, Homo sapiens
tctgttaagtctcag

SEQ ID NO: 192395 - DNA, 15 bp, Homo sapiens
atctgttaagtctca

SEQ ID NO: 192396 - DNA, 15 bp, Homo sapiens
catctgttaagtctc

SEQ ID NO: 192397 - DNA, 15 bp, Homo sapiens
tcatctgttaagtct

SEQ ID NO: 192398 - DNA, 15 bp, Homo sapiens
ctcatctgttaagtc

SEQ ID NO: 192399 - DNA, 15 bp, Homo sapiens
actcatctgttaagt

SEQ ID NO: 192400 - DNA, 15 bp, Homo sapiens
aactcatctgttaag

SEQ ID NO: 192401 - DNA, 15 bp, Homo sapiens
aaactcatctgttaa

SEQ ID NO: 192402 - DNA, 15 bp, Homo sapiens
taaactcatctgtta

SEQ ID NO: 192403 - DNA, 15 bp, Homo sapiens
ttaaactcatctgtt

SEQ ID NO: 192404 - DNA, 15 bp, Homo sapiens
cttaaactcatctgt

SEQ ID NO: 192405 - DNA, 15 bp, Homo sapiens
acttaaactcatctg

SEQ ID NO: 192406 - DNA, 15 bp, Homo sapiens
aacttaaactcatct

SEQ ID NO: 192407 - DNA, 15 bp, Homo sapiens
caacttaaactcatc

SEQ ID NO: 192408 - DNA, 15 bp, Homo sapiens
tcaacttaaactcat

SEQ ID NO: 192409 - DNA, 15 bp, Homo sapiens
ttcaacttaaactca

SEQ ID NO: 192410 - DNA, 15 bp, Homo sapiens
tttcaacttaaactc

SEQ ID NO: 192411 - DNA, 15 bp, Homo sapiens
ctttcaacttaaact

SEQ ID NO: 192412 - DNA, 15 bp, Homo sapiens
tctttcaacttaaac

SEQ ID NO: 192413 - DNA, 15 bp, Homo sapiens
ttctttcaacttaaa

SEQ ID NO: 192414 - DNA, 15 bp, Homo sapiens
cttctttcaacttaa

SEQ ID NO: 192415 - DNA, 15 bp, Homo sapiens
ccttctttcaactta

SEQ ID NO: 192416 - DNA, 15 bp, Homo sapiens
tccttctttcaactt

SEQ ID NO: 192417 - DNA, 15 bp, Homo sapiens
ttccttctttcaact

SEQ ID NO: 192418 - DNA, 15 bp, Homo sapiens
tttccttctttcaac

SEQ ID NO: 192419 - DNA, 15 bp, Homo sapiens
atttccttctttcaa

SEQ ID NO: 192420 - DNA, 15 bp, Homo sapiens
catttccttctttca

SEQ ID NO: 192421 - DNA, 15 bp, Homo sapiens
tcatttccttctttc

SEQ ID NO: 192422 - DNA, 15 bp, Homo sapiens
ctcatttccttcttt

SEQ ID NO: 192423 - DNA, 15 bp, Homo sapiens
tctcatttccttctt

SEQ ID NO: 192424 - DNA, 15 bp, Homo sapiens
atctcatttccttct

SEQ ID NO: 192425 - DNA, 15 bp, Homo sapiens
aatctcatttccttc

SEQ ID NO: 192426 - DNA, 15 bp, Homo sapiens
taatctcatttcctt

SEQ ID NO: 192427 - DNA, 15 bp, Homo sapiens
ataatctcatttcct

SEQ ID NO: 192428 - DNA, 15 bp, Homo sapiens
tataatctcatttcc

SEQ ID NO: 192429 - DNA, 15 bp, Homo sapiens
atataatctcatttc

SEQ ID NO: 192430 - DNA, 15 bp, Homo sapiens
tatataatctcattt

SEQ ID NO: 192431 - DNA, 15 bp, Homo sapiens
gtatataatctcatt

SEQ ID NO: 192432 - DNA, 15 bp, Homo sapiens
ggtatataatctcat

SEQ ID NO: 192433 - DNA, 15 bp, Homo sapiens
tggtatataatctca

SEQ ID NO: 192434 - DNA, 15 bp, Homo sapiens
ttggtatataatctc

SEQ ID NO: 192435 - DNA, 15 bp, Homo sapiens
attggtatataatct

SEQ ID NO: 192436 - DNA, 15 bp, Homo sapiens
cattggtatataatc

SEQ ID NO: 192437 - DNA, 15 bp, Homo sapiens
acattggtatataat

SEQ ID NO: 192438 - DNA, 15 bp, Homo sapiens
cacattggtatataa

SEQ ID NO: 192439 - DNA, 15 bp, Homo sapiens
acacattggtatata

SEQ ID NO: 192440 - DNA, 15 bp, Homo sapiens
cacacattggtatat

SEQ ID NO: 192441 - DNA, 15 bp, Homo sapiens
acacacattggtata

SEQ ID NO: 192442 - DNA, 15 bp, Homo sapiens
cacacacattggtat

SEQ ID NO: 192443 - DNA, 15 bp, Homo sapiens
gcacacacattggta

SEQ ID NO: 192444 - DNA, 15 bp, Homo sapiens
tgcacacacattggt

SEQ ID NO: 192445 - DNA, 15 bp, Homo sapiens
atgcacacacattgg

SEQ ID NO: 192446 - DNA, 15 bp, Homo sapiens
catgcacacacattg

SEQ ID NO: 192447 - DNA, 15 bp, Homo sapiens
acatgcacacacatt

SEQ ID NO: 192448 - DNA, 15 bp, Homo sapiens
cacatgcacacacat

SEQ ID NO: 192449 - DNA, 15 bp, Homo sapiens
acacatgcacacaca

SEQ ID NO: 192450 - DNA, 15 bp, Homo sapiens
cacacatgcacacac

SEQ ID NO: 192451 - DNA, 15 bp, Homo sapiens
acacacatgcacaca

SEQ ID NO: 192452 - DNA, 15 bp, Homo sapiens
ccacacacatgcaca

SEQ ID NO: 192453 - DNA, 15 bp, Homo sapiens
gccacacacatgcac

SEQ ID NO: 192454 - DNA, 15 bp, Homo sapiens
ggccacacacatgca

SEQ ID NO: 192455 - DNA, 15 bp, Homo sapiens
gggccacacacatgc

SEQ ID NO: 192456 - DNA, 15 bp, Homo sapiens
tgggccacacacatg

SEQ ID NO: 192457 - DNA, 15 bp, Homo sapiens
atgggccacacacat

SEQ ID NO: 192458 - DNA, 15 bp, Homo sapiens
catgggccacacaca

SEQ ID NO: 192459 - DNA, 15 bp, Homo sapiens
ccatgggccacacac

SEQ ID NO: 192460 - DNA, 15 bp, Homo sapiens
cccatgggccacaca

SEQ ID NO: 192461 - DNA, 15 bp, Homo sapiens
acccatgggccacac

SEQ ID NO: 192462 - DNA, 15 bp, Homo sapiens
cacccatgggccaca

SEQ ID NO: 192463 - DNA, 15 bp, Homo sapiens
ccacccatgggccac

SEQ ID NO: 192464 - DNA, 15 bp, Homo sapiens
tccacccatgggcca

SEQ ID NO: 192465 - DNA, 15 bp, Homo sapiens
gtccacccatgggcc

SEQ ID NO: 192466 - DNA, 15 bp, Homo sapiens
agtccacccatgggc

SEQ ID NO: 192467 - DNA, 15 bp, Homo sapiens
aagtccacccatggg

SEQ ID NO: 192468 - DNA, 15 bp, Homo sapiens
caagtccacccatgg

SEQ ID NO: 192469 - DNA, 15 bp, Homo sapiens
acaagtccacccatg

SEQ ID NO: 192470 - DNA, 15 bp, Homo sapiens
cacaagtccacccat

SEQ ID NO: 192471 - DNA, 15 bp, Homo sapiens
acacaagtccaccca

SEQ ID NO: 192472 - DNA, 15 bp, Homo sapiens
gacacaagtccaccc

SEQ ID NO: 192473 - DNA, 15 bp, Homo sapiens
tgacacaagtccacc

SEQ ID NO: 192474 - DNA, 15 bp, Homo sapiens
ctgacacaagtccac

SEQ ID NO: 192475 - DNA, 15 bp, Homo sapiens
cctgacacaagtcca

SEQ ID NO: 192476 - DNA, 15 bp, Homo sapiens
ccctgacacaagtcc

SEQ ID NO: 192477 - DNA, 15 bp, Homo sapiens
cccctgacacaagtc

SEQ ID NO: 192478 - DNA, 15 bp, Homo sapiens
tcccctgacacaagt

SEQ ID NO: 192479 - DNA, 15 bp, Homo sapiens
ttcccctgacacaag

SEQ ID NO: 192480 - DNA, 15 bp, Homo sapiens
cttcccctgacacaa

SEQ ID NO: 192481 - DNA, 15 bp, Homo sapiens
tcttcccctgacaca

SEQ ID NO: 192482 - DNA, 15 bp, Homo sapiens
ttcttcccctgacac

SEQ ID NO: 192483 - DNA, 15 bp, Homo sapiens
tttcttcccctgaca

SEQ ID NO: 192484 - DNA, 15 bp, Homo sapiens
atttcttcccctgac

SEQ ID NO: 192485 - DNA, 15 bp, Homo sapiens
aatttcttcccctga

SEQ ID NO: 192486 - DNA, 15 bp, Homo sapiens
caatttcttcccctg

SEQ ID NO: 192487 - DNA, 15 bp, Homo sapiens
ccaatttcttcccct

SEQ ID NO: 192488 - DNA, 15 bp, Homo sapiens
cccaatttcttcccc

SEQ ID NO: 192489 - DNA, 15 bp, Homo sapiens
tcccaatttcttccc

SEQ ID NO: 192490 - DNA, 15 bp, Homo sapiens
ctcccaatttcttcc

SEQ ID NO: 192491 - DNA, 15 bp, Homo sapiens
gctcccaatttcttc

SEQ ID NO: 192492 - DNA, 15 bp, Homo sapiens
agctcccaatttctt

SEQ ID NO: 192493 - DNA, 15 bp, Homo sapiens
aagctcccaatttct

SEQ ID NO: 192494 - DNA, 15 bp, Homo sapiens
aaagctcccaatttc

SEQ ID NO: 192495 - DNA, 15 bp, Homo sapiens
gaaagctcccaattt

SEQ ID NO: 192496 - DNA, 15 bp, Homo sapiens
tgaaagctcccaatt

SEQ ID NO: 192497 - DNA, 15 bp, Homo sapiens
ctgaaagctcccaat

SEQ ID NO: 192498 - DNA, 15 bp, Homo sapiens
cctgaaagctcccaa

SEQ ID NO: 192499 - DNA, 15 bp, Homo sapiens
ccctgaaagctccca

SEQ ID NO: 192500 - DNA, 15 bp, Homo sapiens
accctgaaagctccc

SEQ ID NO: 192501 - DNA, 15 bp, Homo sapiens
taccctgaaagctcc

SEQ ID NO: 192502 - DNA, 15 bp, Homo sapiens
ttaccctgaaagctc

SEQ ID NO: 192503 - DNA, 15 bp, Homo sapiens
gttaccctgaaagct

SEQ ID NO: 192504 - DNA, 15 bp, Homo sapiens
tgttaccctgaaagc

SEQ ID NO: 192505 - DNA, 15 bp, Homo sapiens
ctgttaccctgaaag

SEQ ID NO: 192506 - DNA, 15 bp, Homo sapiens
cctgttaccctgaaa

SEQ ID NO: 192507 - DNA, 15 bp, Homo sapiens
ccctgttaccctgaa

SEQ ID NO: 192508 - DNA, 15 bp, Homo sapiens
tccctgttaccctga

SEQ ID NO: 192509 - DNA, 15 bp, Homo sapiens
gtccctgttaccctg

SEQ ID NO: 192510 - DNA, 15 bp, Homo sapiens
agtccctgttaccct

SEQ ID NO: 192511 - DNA, 15 bp, Homo sapiens
cagtccctgttaccc

SEQ ID NO: 192512 - DNA, 15 bp, Homo sapiens
gcagtccctgttacc

SEQ ID NO: 192513 - DNA, 15 bp, Homo sapiens
agcagtccctgttac

SEQ ID NO: 192514 - DNA, 15 bp, Homo sapiens
aagcagtccctgtta

SEQ ID NO: 192515 - DNA, 15 bp, Homo sapiens
aaagcagtccctgtt

SEQ ID NO: 192516 - DNA, 15 bp, Homo sapiens
caaagcagtccctgt

SEQ ID NO: 192517 - DNA, 15 bp, Homo sapiens
tcaaagcagtccctg

SEQ ID NO: 192518 - DNA, 15 bp, Homo sapiens
gtcaaagcagtccct

SEQ ID NO: 192519 - DNA, 15 bp, Homo sapiens
tgtcaaagcagtccc

SEQ ID NO: 192520 - DNA, 15 bp, Homo sapiens
atgtcaaagcagtcc

SEQ ID NO: 192521 - DNA, 15 bp, Homo sapiens
catgtcaaagcagtc

SEQ ID NO: 192522 - DNA, 15 bp, Homo sapiens
ccatgtcaaagcagt

SEQ ID NO: 192523 - DNA, 15 bp, Homo sapiens
cccatgtcaaagcag

SEQ ID NO: 192524 - DNA, 15 bp, Homo sapiens
acccatgtcaaagca

SEQ ID NO: 192525 - DNA, 15 bp, Homo sapiens
gacccatgtcaaagc

SEQ ID NO: 192526 - DNA, 15 bp, Homo sapiens
tgacccatgtcaaag

SEQ ID NO: 192527 - DNA, 15 bp, Homo sapiens
ctgacccatgtcaaa

SEQ ID NO: 192528 - DNA, 15 bp, Homo sapiens
tctgacccatgtcaa

SEQ ID NO: 192529 - DNA, 15 bp, Homo sapiens
ttctgacccatgtca

SEQ ID NO: 192530 - DNA, 15 bp, Homo sapiens
cttctgacccatgtc

SEQ ID NO: 192531 - DNA, 15 bp, Homo sapiens
acttctgacccatgt

SEQ ID NO: 192532 - DNA, 15 bp, Homo sapiens
aacttctgacccatg

SEQ ID NO: 192533 - DNA, 15 bp, Homo sapiens
caacttctgacccat

SEQ ID NO: 192534 - DNA, 15 bp, Homo sapiens
tcaacttctgaccca

SEQ ID NO: 192535 - DNA, 15 bp, Homo sapiens
ctcaacttctgaccc

SEQ ID NO: 192536 - DNA, 15 bp, Homo sapiens
tctcaacttctgacc

SEQ ID NO: 192537 - DNA, 15 bp, Homo sapiens
ttctcaacttctgac

SEQ ID NO: 192538 - DNA, 15 bp, Homo sapiens
cttctcaacttctga

SEQ ID NO: 192539 - DNA, 15 bp, Homo sapiens
gcttctcaacttctg

SEQ ID NO: 192540 - DNA, 15 bp, Homo sapiens
agcttctcaacttct

SEQ ID NO: 192541 - DNA, 15 bp, Homo sapiens
cagcttctcaacttc

SEQ ID NO: 192542 - DNA, 15 bp, Homo sapiens
acagcttctcaactt

SEQ ID NO: 192543 - DNA, 15 bp, Homo sapiens
cacagcttctcaact

SEQ ID NO: 192544 - DNA, 15 bp, Homo sapiens
acacagcttctcaac

SEQ ID NO: 192545 - DNA, 15 bp, Homo sapiens
cacacagcttctcaa

SEQ ID NO: 192546 - DNA, 15 bp, Homo sapiens
gcacacagcttctca

SEQ ID NO: 192547 - DNA, 15 bp, Homo sapiens
tggggcacacagctt

SEQ ID NO: 192548 - DNA, 15 bp, Homo sapiens
ctggggcacacagct

SEQ ID NO: 192549 - DNA, 15 bp, Homo sapiens
gcctggggcacacag

SEQ ID NO: 192550 - DNA, 15 bp, Homo sapiens
agcctggggcacaca

SEQ ID NO: 192551 - DNA, 15 bp, Homo sapiens
aagcctggggcacac

SEQ ID NO: 192552 - DNA, 15 bp, Homo sapiens
caagcctggggcaca

SEQ ID NO: 192553 - DNA, 15 bp, Homo sapiens
acaagcctggggcac

SEQ ID NO: 192554 - DNA, 15 bp, Homo sapiens
tacaagcctggggca

SEQ ID NO: 192555 - DNA, 15 bp, Homo sapiens
ctacaagcctggggc

SEQ ID NO: 192556 - DNA, 15 bp, Homo sapiens
actacaagcctgggg

SEQ ID NO: 192557 - DNA, 15 bp, Homo sapiens
aactacaagcctggg

SEQ ID NO: 192558 - DNA, 15 bp, Homo sapiens
aaactacaagcctgg

SEQ ID NO: 192559 - DNA, 15 bp, Homo sapiens
aaaactacaagcctg

SEQ ID NO: 192560 - DNA, 15 bp, Homo sapiens
taaaactacaagcct

SEQ ID NO: 192561 - DNA, 15 bp, Homo sapiens
ttaaaactacaagcc

SEQ ID NO: 192562 - DNA, 15 bp, Homo sapiens
tttaaaactacaagc

SEQ ID NO: 192563 - DNA, 15 bp, Homo sapiens
gtttaaaactacaag

SEQ ID NO: 192564 - DNA, 15 bp, Homo sapiens
tgtttaaaactacaa

SEQ ID NO: 192565 - DNA, 15 bp, Homo sapiens
atgtttaaaactaca

SEQ ID NO: 192566 - DNA, 15 bp, Homo sapiens
aatgtttaaaactac

SEQ ID NO: 192567 - DNA, 15 bp, Homo sapiens
aaatgtttaaaacta

SEQ ID NO: 192568 - DNA, 15 bp, Homo sapiens
caaatgtttaaaact

SEQ ID NO: 192569 - DNA, 15 bp, Homo sapiens
tcaaatgtttaaaac

SEQ ID NO: 192570 - DNA, 15 bp, Homo sapiens
ttcaaatgtttaaaa

SEQ ID NO: 192571 - DNA, 15 bp, Homo sapiens
tttcaaatgtttaaa

SEQ ID NO: 192572 - DNA, 15 bp, Homo sapiens
atttcaaatgtttaa

SEQ ID NO: 192573 - DNA, 15 bp, Homo sapiens
catttcaaatgttta

SEQ ID NO: 192574 - DNA, 15 bp, Homo sapiens
gcatttcaaatgttt

SEQ ID NO: 192575 - DNA, 15 bp, Homo sapiens
cgcatttcaaatgtt

SEQ ID NO: 192576 - DNA, 15 bp, Homo sapiens
tcgcatttcaaatgt

SEQ ID NO: 192577 - DNA, 15 bp, Homo sapiens
atcgcatttcaaatg

SEQ ID NO: 192578 - DNA, 15 bp, Homo sapiens
tatcgcatttcaaat

SEQ ID NO: 192579 - DNA, 15 bp, Homo sapiens
ttatcgcatttcaaa

SEQ ID NO: 192580 - DNA, 15 bp, Homo sapiens
attatcgcatttcaa

SEQ ID NO: 192581 - DNA, 15 bp, Homo sapiens
aattatcgcatttca

SEQ ID NO: 192582 - DNA, 15 bp, Homo sapiens
aaattatcgcatttc

SEQ ID NO: 192583 - DNA, 15 bp, Homo sapiens
aaaattatcgcattt

SEQ ID NO: 192584 - DNA, 15 bp, Homo sapiens
aaaaattatcgcatt

SEQ ID NO: 192585 - DNA, 15 bp, Homo sapiens
gaaaaattatcgcat

SEQ ID NO: 192586 - DNA, 15 bp, Homo sapiens
agaaaaattatcgca

SEQ ID NO: 192587 - DNA, 15 bp, Homo sapiens
gagaaaaattatcgc

SEQ ID NO: 192588 - DNA, 15 bp, Homo sapiens
agagaaaaattatcg

SEQ ID NO: 192589 - DNA, 15 bp, Homo sapiens
cagagaaaaattatc

SEQ ID NO: 192590 - DNA, 15 bp, Homo sapiens
ccagagaaaaattat

SEQ ID NO: 192591 - DNA, 15 bp, Homo sapiens
cccagagaaaaatta

SEQ ID NO: 192592 - DNA, 15 bp, Homo sapiens
acccagagaaaaatt

SEQ ID NO: 192593 - DNA, 15 bp, Homo sapiens
aacccagagaaaaat

SEQ ID NO: 192594 - DNA, 15 bp, Homo sapiens
aaacccagagaaaaa

SEQ ID NO: 192595 - DNA, 15 bp, Homo sapiens
aaaacccagagaaaa

SEQ ID NO: 192596 - DNA, 15 bp, Homo sapiens
gaaaacccagagaaa

SEQ ID NO: 192597 - DNA, 15 bp, Homo sapiens
agaaaacccagagaa

SEQ ID NO: 192598 - DNA, 15 bp, Homo sapiens
cagaaaacccagaga

SEQ ID NO: 192599 - DNA, 15 bp, Homo sapiens
tcagaaaacccagag

SEQ ID NO: 192600 - DNA, 15 bp, Homo sapiens
gtcagaaaacccaga

SEQ ID NO: 192601 - DNA, 15 bp, Homo sapiens
ggtcagaaaacccag

SEQ ID NO: 192602 - DNA, 15 bp, Homo sapiens
aggtcagaaaaccca

SEQ ID NO: 192603 - DNA, 15 bp, Homo sapiens
caggtcagaaaaccc

SEQ ID NO: 192604 - DNA, 15 bp, Homo sapiens
acaggtcagaaaacc

SEQ ID NO: 192605 - DNA, 15 bp, Homo sapiens
aacaggtcagaaaac

SEQ ID NO: 192606 - DNA, 15 bp, Homo sapiens
gaacaggtcagaaaa

SEQ ID NO: 192607 - DNA, 15 bp, Homo sapiens
tgaacaggtcagaaa

SEQ ID NO: 192608 - DNA, 15 bp, Homo sapiens
ctgaacaggtcagaa

SEQ ID NO: 192609 - DNA, 15 bp, Homo sapiens
actgaacaggtcaga

SEQ ID NO: 192610 - DNA, 15 bp, Homo sapiens
aactgaacaggtcag

SEQ ID NO: 192611 - DNA, 15 bp, Homo sapiens
aaactgaacaggtca

SEQ ID NO: 192612 - DNA, 15 bp, Homo sapiens
aaaactgaacaggtc

SEQ ID NO: 192613 - DNA, 15 bp, Homo sapiens
caaaactgaacaggt

SEQ ID NO: 192614 - DNA, 15 bp, Homo sapiens
tcaaaactgaacagg

SEQ ID NO: 192615 - DNA, 15 bp, Homo sapiens
atcaaaactgaacag

SEQ ID NO: 192616 - DNA, 15 bp, Homo sapiens
aatcaaaactgaaca

SEQ ID NO: 192617 - DNA, 15 bp, Homo sapiens
taatcaaaactgaac

SEQ ID NO: 192618 - DNA, 15 bp, Homo sapiens
gtaatcaaaactgaa

SEQ ID NO: 192619 - DNA, 15 bp, Homo sapiens
tgtaatcaaaactga

SEQ ID NO: 192620 - DNA, 15 bp, Homo sapiens
gtgtaatcaaaactg

SEQ ID NO: 192621 - DNA, 15 bp, Homo sapiens
cgtgtaatcaaaact

SEQ ID NO: 192622 - DNA, 15 bp, Homo sapiens
tcgtgtaatcaaaac

SEQ ID NO: 192623 - DNA, 15 bp, Homo sapiens
atcgtgtaatcaaaa

SEQ ID NO: 192624 - DNA, 15 bp, Homo sapiens
gatcgtgtaatcaaa

SEQ ID NO: 192625 - DNA, 15 bp, Homo sapiens
agatcgtgtaatcaa

SEQ ID NO: 192626 - DNA, 15 bp, Homo sapiens
cagatcgtgtaatca

SEQ ID NO: 192627 - DNA, 15 bp, Homo sapiens
tcagatcgtgtaatc

SEQ ID NO: 192628 - DNA, 15 bp, Homo sapiens
atcagatcgtgtaat

SEQ ID NO: 192629 - DNA, 15 bp, Homo sapiens
aatcagatcgtgtaa

SEQ ID NO: 192630 - DNA, 15 bp, Homo sapiens
aaatcagatcgtgta

SEQ ID NO: 192631 - DNA, 15 bp, Homo sapiens
caaatcagatcgtgt

SEQ ID NO: 192632 - DNA, 15 bp, Homo sapiens
acaaatcagatcgtg

SEQ ID NO: 192633 - DNA, 15 bp, Homo sapiens
aacaaatcagatcgt

SEQ ID NO: 192634 - DNA, 15 bp, Homo sapiens
aaacaaatcagatcg

SEQ ID NO: 192635 - DNA, 15 bp, Homo sapiens
caaacaaatcagatc

SEQ ID NO: 192636 - DNA, 15 bp, Homo sapiens
acaaacaaatcagat

SEQ ID NO: 192637 - DNA, 15 bp, Homo sapiens
aacaaacaaatcaga

SEQ ID NO: 192638 - DNA, 15 bp, Homo sapiens
gaacaaacaaatcag

SEQ ID NO: 192639 - DNA, 15 bp, Homo sapiens
tgaacaaacaaatca

SEQ ID NO: 192640 - DNA, 15 bp, Homo sapiens
ctgaacaaacaaatc

SEQ ID NO: 192641 - DNA, 15 bp, Homo sapiens
actgaacaaacaaat

SEQ ID NO: 192642 - DNA, 15 bp, Homo sapiens
aactgaacaaacaaa

SEQ ID NO: 192643 - DNA, 15 bp, Homo sapiens
aaactgaacaaacaa

SEQ ID NO: 192644 - DNA, 15 bp, Homo sapiens
aaaactgaacaaaca

SEQ ID NO: 192645 - DNA, 15 bp, Homo sapiens
gaaaactgaacaaac

SEQ ID NO: 192646 - DNA, 15 bp, Homo sapiens
tgaaaactgaacaaa

SEQ ID NO: 192647 - DNA, 15 bp, Homo sapiens
atgaaaactgaacaa

SEQ ID NO: 192648 - DNA, 15 bp, Homo sapiens
gatgaaaactgaaca

SEQ ID NO: 192649 - DNA, 15 bp, Homo sapiens
tgatgaaaactgaac

SEQ ID NO: 192650 - DNA, 15 bp, Homo sapiens
gtgatgaaaactgaa

SEQ ID NO: 192651 - DNA, 15 bp, Homo sapiens
tgtgatgaaaactga

SEQ ID NO: 192652 - DNA, 15 bp, Homo sapiens
gtgtgatgaaaactg

SEQ ID NO: 192653 - DNA, 15 bp, Homo sapiens
agtgtgatgaaaact

SEQ ID NO: 192654 - DNA, 15 bp, Homo sapiens
tagtgtgatgaaaac

SEQ ID NO: 192655 - DNA, 15 bp, Homo sapiens
atagtgtgatgaaaa

SEQ ID NO: 192656 - DNA, 15 bp, Homo sapiens
gatagtgtgatgaaa

SEQ ID NO: 192657 - DNA, 15 bp, Homo sapiens
agatagtgtgatgaa

SEQ ID NO: 192658 - DNA, 15 bp, Homo sapiens
cagatagtgtgatga

SEQ ID NO: 192659 - DNA, 15 bp, Homo sapiens
tcagatagtgtgatg

SEQ ID NO: 192660 - DNA, 15 bp, Homo sapiens
ctcagatagtgtgat

SEQ ID NO: 192661 - DNA, 15 bp, Homo sapiens
actcagatagtgtga

SEQ ID NO: 192662 - DNA, 15 bp, Homo sapiens
aactcagatagtgtg

SEQ ID NO: 192663 - DNA, 15 bp, Homo sapiens
aaactcagatagtgt

SEQ ID NO: 192664 - DNA, 15 bp, Homo sapiens
caaactcagatagtg

SEQ ID NO: 192665 - DNA, 15 bp, Homo sapiens
acaaactcagatagt

SEQ ID NO: 192666 - DNA, 15 bp, Homo sapiens
aacaaactcagatag

SEQ ID NO: 192667 - DNA, 15 bp, Homo sapiens
gaacaaactcagata

SEQ ID NO: 192668 - DNA, 15 bp, Homo sapiens
ggaacaaactcagat

SEQ ID NO: 192669 - DNA, 15 bp, Homo sapiens
tggaacaaactcaga

SEQ ID NO: 192670 - DNA, 15 bp, Homo sapiens
gtggaacaaactcag

SEQ ID NO: 192671 - DNA, 15 bp, Homo sapiens
agtggaacaaactca

SEQ ID NO: 192672 - DNA, 15 bp, Homo sapiens
aagtggaacaaactc

SEQ ID NO: 192673 - DNA, 15 bp, Homo sapiens
taagtggaacaaact

SEQ ID NO: 192674 - DNA, 15 bp, Homo sapiens
ctaagtggaacaaac

SEQ ID NO: 192675 - DNA, 15 bp, Homo sapiens
actaagtggaacaaa

SEQ ID NO: 192676 - DNA, 15 bp, Homo sapiens
tactaagtggaacaa

SEQ ID NO: 192677 - DNA, 15 bp, Homo sapiens
ttactaagtggaaca

SEQ ID NO: 192678 - DNA, 15 bp, Homo sapiens
attactaagtggaac

SEQ ID NO: 192679 - DNA, 15 bp, Homo sapiens
aattactaagtggaa

SEQ ID NO: 192680 - DNA, 15 bp, Homo sapiens
aaattactaagtgga

SEQ ID NO: 192681 - DNA, 15 bp, Homo sapiens
caaattactaagtgg

SEQ ID NO: 192682 - DNA, 15 bp, Homo sapiens
tcaaattactaagtg

SEQ ID NO: 192683 - DNA, 15 bp, Homo sapiens
gtcaaattactaagt

SEQ ID NO: 192684 - DNA, 15 bp, Homo sapiens
agtcaaattactaag

SEQ ID NO: 192685 - DNA, 15 bp, Homo sapiens
cagtcaaattactaa

SEQ ID NO: 192686 - DNA, 15 bp, Homo sapiens
acagtcaaattacta

SEQ ID NO: 192687 - DNA, 15 bp, Homo sapiens
aacagtcaaattact

SEQ ID NO: 192688 - DNA, 15 bp, Homo sapiens
aaacagtcaaattac

SEQ ID NO: 192689 - DNA, 15 bp, Homo sapiens
gaaaacagtcaaatt

SEQ ID NO: 192690 - DNA, 15 bp, Homo sapiens
agaaaacagtcaaat

SEQ ID NO: 192691 - DNA, 15 bp, Homo sapiens
tagaaaacagtcaaa

SEQ ID NO: 192692 - DNA, 15 bp, Homo sapiens
gtagaaaacagtcaa

SEQ ID NO: 192693 - DNA, 15 bp, Homo sapiens
agtagaaaacagtca

SEQ ID NO: 192694 - DNA, 15 bp, Homo sapiens
gagtagaaaacagtc

SEQ ID NO: 192695 - DNA, 15 bp, Homo sapiens
agagtagaaaacagt

SEQ ID NO: 192696 - DNA, 15 bp, Homo sapiens
cagagtagaaaacag

SEQ ID NO: 192697 - DNA, 15 bp, Homo sapiens
acagagtagaaaaca

SEQ ID NO: 192698 - DNA, 15 bp, Homo sapiens
aacagagtagaaaac

SEQ ID NO: 192699 - DNA, 15 bp, Homo sapiens
caacagagtagaaaa

SEQ ID NO: 192700 - DNA, 15 bp, Homo sapiens
acaacagagtagaaa

SEQ ID NO: 192701 - DNA, 15 bp, Homo sapiens
gacaacagagtagaa

SEQ ID NO: 192702 - DNA, 15 bp, Homo sapiens
agacaacagagtaga

SEQ ID NO: 192703 - DNA, 15 bp, Homo sapiens
aagacaacagagtag

SEQ ID NO: 192704 - DNA, 15 bp, Homo sapiens
taagacaacagagta

SEQ ID NO: 192705 - DNA, 15 bp, Homo sapiens
gtaagacaacagagt

SEQ ID NO: 192706 - DNA, 15 bp, Homo sapiens
agtaagacaacagag

SEQ ID NO: 192707 - DNA, 15 bp, Homo sapiens
aagtaagacaacaga

SEQ ID NO: 192708 - DNA, 15 bp, Homo sapiens
aaagtaagacaacag

SEQ ID NO: 192709 - DNA, 15 bp, Homo sapiens
aaaagtaagacaaca

SEQ ID NO: 192710 - DNA, 15 bp, Homo sapiens
aaaaagtaagacaac

SEQ ID NO: 192711 - DNA, 15 bp, Homo sapiens
aaaaaagtaagacaa

SEQ ID NO: 192712 - DNA, 15 bp, Homo sapiens
aaaaaaagtaagaca

SEQ ID NO: 192713 - DNA, 15 bp, Homo sapiens
aaaaaaaagtaagac

SEQ ID NO: 192714 - DNA, 15 bp, Homo sapiens
ccatgtctccaaaaa

SEQ ID NO: 192715 - DNA, 15 bp, Homo sapiens
tccatgtctccaaaa

SEQ ID NO: 192716 - DNA, 15 bp, Homo sapiens
gtccatgtctccaaa

SEQ ID NO: 192717 - DNA, 15 bp, Homo sapiens
agtccatgtctccaa

SEQ ID NO: 192718 - DNA, 15 bp, Homo sapiens
aagtccatgtctcca

SEQ ID NO: 192719 - DNA, 15 bp, Homo sapiens
caagtccatgtctcc

SEQ ID NO: 192720 - DNA, 15 bp, Homo sapiens
gcaagtccatgtctc

SEQ ID NO: 192721 - DNA, 15 bp, Homo sapiens
agcaagtccatgtct

SEQ ID NO: 192722 - DNA, 15 bp, Homo sapiens
cagcaagtccatgtc

SEQ ID NO: 192723 - DNA, 15 bp, Homo sapiens
acagcaagtccatgt

SEQ ID NO: 192724 - DNA, 15 bp, Homo sapiens
cacagcaagtccatg

SEQ ID NO: 192725 - DNA, 15 bp, Homo sapiens
acacagcaagtccat

SEQ ID NO: 192726 - DNA, 15 bp, Homo sapiens
aacacagcaagtcca

SEQ ID NO: 192727 - DNA, 15 bp, Homo sapiens
caacacagcaagtcc

SEQ ID NO: 192728 - DNA, 15 bp, Homo sapiens
gcaacacagcaagtc

SEQ ID NO: 192729 - DNA, 15 bp, Homo sapiens
agcaacacagcaagt

SEQ ID NO: 192730 - DNA, 15 bp, Homo sapiens
gagcaacacagcaag

SEQ ID NO: 192731 - DNA, 15 bp, Homo sapiens
tgagcaacacagcaa

SEQ ID NO: 192732 - DNA, 15 bp, Homo sapiens
ctgagcaacacagca

SEQ ID NO: 192733 - DNA, 15 bp, Homo sapiens
cctgagcaacacagc

SEQ ID NO: 192734 - DNA, 15 bp, Homo sapiens
gcctgagcaacacag

SEQ ID NO: 192735 - DNA, 15 bp, Homo sapiens
agcctgagcaacaca

SEQ ID NO: 192736 - DNA, 15 bp, Homo sapiens
cagcctgagcaacac

SEQ ID NO: 192737 - DNA, 15 bp, Homo sapiens
tcagcctgagcaaca

SEQ ID NO: 192738 - DNA, 15 bp, Homo sapiens
gtcagcctgagcaac

SEQ ID NO: 192739 - DNA, 15 bp, Homo sapiens
ggtcagcctgagcaa

SEQ ID NO: 192740 - DNA, 15 bp, Homo sapiens
aggtcagcctgagca

SEQ ID NO: 192741 - DNA, 15 bp, Homo sapiens
aaggtcagcctgagc

SEQ ID NO: 192742 - DNA, 15 bp, Homo sapiens
caaggtcagcctgag

SEQ ID NO: 192743 - DNA, 15 bp, Homo sapiens
tcaaggtcagcctga

SEQ ID NO: 192744 - DNA, 15 bp, Homo sapiens
ttcaaggtcagcctg

SEQ ID NO: 192745 - DNA, 15 bp, Homo sapiens
gttcaaggtcagcct

SEQ ID NO: 192746 - DNA, 15 bp, Homo sapiens
agttcaaggtcagcc

SEQ ID NO: 192747 - DNA, 15 bp, Homo sapiens
gagttcaaggtcagc

SEQ ID NO: 192748 - DNA, 15 bp, Homo sapiens
ggagttcaaggtcag

SEQ ID NO: 192749 - DNA, 15 bp, Homo sapiens
aggagttcaaggtca

SEQ ID NO: 192750 - DNA, 15 bp, Homo sapiens
caggagttcaaggtc

SEQ ID NO: 192751 - DNA, 15 bp, Homo sapiens
ccaggagttcaaggt

SEQ ID NO: 192752 - DNA, 15 bp, Homo sapiens
tggatagcttgagcc

SEQ ID NO: 192753 - DNA, 15 bp, Homo sapiens
gtggatagcttgagc

SEQ ID NO: 192754 - DNA, 15 bp, Homo sapiens
ggtggatagcttgag

SEQ ID NO: 192755 - DNA, 15 bp, Homo sapiens
gggtggatagcttga

SEQ ID NO: 192756 - DNA, 15 bp, Homo sapiens
tgggtggatagcttg

SEQ ID NO: 192757 - DNA, 15 bp, Homo sapiens
gtgggtggatagctt

SEQ ID NO: 192758 - DNA, 15 bp, Homo sapiens
ggtgggtggatagct

SEQ ID NO: 192759 - DNA, 15 bp, Homo sapiens
aggtgggtggatagc

SEQ ID NO: 192760 - DNA, 15 bp, Homo sapiens
gaggtgggtggatag

SEQ ID NO: 192761 - DNA, 15 bp, Homo sapiens
cgaggtgggtggata

SEQ ID NO: 192762 - DNA, 15 bp, Homo sapiens
tcgaggtgggtggat

SEQ ID NO: 192763 - DNA, 15 bp, Homo sapiens
ctcgaggtgggtgga

SEQ ID NO: 192764 - DNA, 15 bp, Homo sapiens
actcgaggtgggtgg

SEQ ID NO: 192765 - DNA, 15 bp, Homo sapiens
gactcgaggtgggtg

SEQ ID NO: 192766 - DNA, 15 bp, Homo sapiens
agactcgaggtgggt

SEQ ID NO: 192767 - DNA, 15 bp, Homo sapiens
aagactcgaggtggg

SEQ ID NO: 192768 - DNA, 15 bp, Homo sapiens
taagactcgaggtgg

SEQ ID NO: 192769 - DNA, 15 bp, Homo sapiens
gtaagactcgaggtg

SEQ ID NO: 192770 - DNA, 15 bp, Homo sapiens
ggtaagactcgaggt

SEQ ID NO: 192771 - DNA, 15 bp, Homo sapiens
aggtaagactcgagg

SEQ ID NO: 192772 - DNA, 15 bp, Homo sapiens
taggtaagactcgag

SEQ ID NO: 192773 - DNA, 15 bp, Homo sapiens
ataggtaagactcga

SEQ ID NO: 192774 - DNA, 15 bp, Homo sapiens
tataggtaagactcg

SEQ ID NO: 192775 - DNA, 15 bp, Homo sapiens
atataggtaagactc

SEQ ID NO: 192776 - DNA, 15 bp, Homo sapiens
aatataggtaagact

SEQ ID NO: 192777 - DNA, 15 bp, Homo sapiens
aaatataggtaagac

SEQ ID NO: 192778 - DNA, 15 bp, Homo sapiens
taaatataggtaaga

SEQ ID NO: 192779 - DNA, 15 bp, Homo sapiens
ataaatataggtaag

SEQ ID NO: 192780 - DNA, 15 bp, Homo sapiens
gataaatataggtaa

SEQ ID NO: 192781 - DNA, 15 bp, Homo sapiens
tgataaatataggta

SEQ ID NO: 192782 - DNA, 15 bp, Homo sapiens
atgataaatataggt

SEQ ID NO: 192783 - DNA, 15 bp, Homo sapiens
gatgataaatatagg

SEQ ID NO: 192784 - DNA, 15 bp, Homo sapiens
tgatgataaatatag

SEQ ID NO: 192785 - DNA, 15 bp, Homo sapiens
gtgatgataaatata

SEQ ID NO: 192786 - DNA, 15 bp, Homo sapiens
tgtgatgataaatat

SEQ ID NO: 192787 - DNA, 15 bp, Homo sapiens
ctgtgatgataaata

SEQ ID NO: 192788 - DNA, 15 bp, Homo sapiens
tctgtgatgataaat

SEQ ID NO: 192789 - DNA, 15 bp, Homo sapiens
atctgtgatgataaa

SEQ ID NO: 192790 - DNA, 15 bp, Homo sapiens
tatctgtgatgataa

SEQ ID NO: 192791 - DNA, 15 bp, Homo sapiens
ttatctgtgatgata

SEQ ID NO: 192792 - DNA, 15 bp, Homo sapiens
attatctgtgatgat

SEQ ID NO: 192793 - DNA, 15 bp, Homo sapiens
tattatctgtgatga

SEQ ID NO: 192794 - DNA, 15 bp, Homo sapiens
ctattatctgtgatg

SEQ ID NO: 192795 - DNA, 15 bp, Homo sapiens
cctattatctgtgat

SEQ ID NO: 192796 - DNA, 15 bp, Homo sapiens
tcctattatctgtga

SEQ ID NO: 192797 - DNA, 15 bp, Homo sapiens
ttcctattatctgtg

SEQ ID NO: 192798 - DNA, 15 bp, Homo sapiens
tttcctattatctgt

SEQ ID NO: 192799 - DNA, 15 bp, Homo sapiens
ttttcctattatctg

SEQ ID NO: 192800 - DNA, 15 bp, Homo sapiens
cttttcctattatct

SEQ ID NO: 192801 - DNA, 15 bp, Homo sapiens
tcttttcctattatc

SEQ ID NO: 192802 - DNA, 15 bp, Homo sapiens
ttcttttcctattat

SEQ ID NO: 192803 - DNA, 15 bp, Homo sapiens
gttcttttcctatta

SEQ ID NO: 192804 - DNA, 15 bp, Homo sapiens
tgttcttttcctatt

SEQ ID NO: 192805 - DNA, 15 bp, Homo sapiens
atgttcttttcctat

SEQ ID NO: 192806 - DNA, 15 bp, Homo sapiens
aatgttcttttccta

SEQ ID NO: 192807 - DNA, 15 bp, Homo sapiens
taatgttcttttcct

SEQ ID NO: 192808 - DNA, 15 bp, Homo sapiens
ataatgttcttttcc

SEQ ID NO: 192809 - DNA, 15 bp, Homo sapiens
aataatgttcttttc

SEQ ID NO: 192810 - DNA, 15 bp, Homo sapiens
taataatgttctttt

SEQ ID NO: 192811 - DNA, 15 bp, Homo sapiens
ctaataatgttcttt

SEQ ID NO: 192812 - DNA, 15 bp, Homo sapiens
gctaataatgttctt

SEQ ID NO: 192813 - DNA, 15 bp, Homo sapiens
tgctaataatgttct

SEQ ID NO: 192814 - DNA, 15 bp, Homo sapiens
atgctaataatgttc

SEQ ID NO: 192815 - DNA, 15 bp, Homo sapiens
gatgctaataatgtt

SEQ ID NO: 192816 - DNA, 15 bp, Homo sapiens
cgatgctaataatgt

SEQ ID NO: 192817 - DNA, 15 bp, Homo sapiens
tcgatgctaataatg

SEQ ID NO: 192818 - DNA, 15 bp, Homo sapiens
atcgatgctaataat

SEQ ID NO: 192819 - DNA, 15 bp, Homo sapiens
aatcgatgctaataa

SEQ ID NO: 192820 - DNA, 15 bp, Homo sapiens
aaatcgatgctaata

SEQ ID NO: 192821 - DNA, 15 bp, Homo sapiens
gaaatcgatgctaat

SEQ ID NO: 192822 - DNA, 15 bp, Homo sapiens
agaaatcgatgctaa

SEQ ID NO: 192823 - DNA, 15 bp, Homo sapiens
aagaaatcgatgcta

SEQ ID NO: 192824 - DNA, 15 bp, Homo sapiens
taagaaatcgatgct

SEQ ID NO: 192825 - DNA, 15 bp, Homo sapiens
ttaagaaatcgatgc

SEQ ID NO: 192826 - DNA, 15 bp, Homo sapiens
attaagaaatcgatg

SEQ ID NO: 192827 - DNA, 15 bp, Homo sapiens
aattaagaaatcgat

SEQ ID NO: 192828 - DNA, 15 bp, Homo sapiens
gaattaagaaatcga

SEQ ID NO: 192829 - DNA, 15 bp, Homo sapiens
tgaattaagaaatcg

SEQ ID NO: 192830 - DNA, 15 bp, Homo sapiens
ctgaattaagaaatc

SEQ ID NO: 192831 - DNA, 15 bp, Homo sapiens
tctgaattaagaaat

SEQ ID NO: 192832 - DNA, 15 bp, Homo sapiens
ttctgaattaagaaa

SEQ ID NO: 192833 - DNA, 15 bp, Homo sapiens
tttctgaattaagaa

SEQ ID NO: 192834 - DNA, 15 bp, Homo sapiens
atttctgaattaaga

SEQ ID NO: 192835 - DNA, 15 bp, Homo sapiens
catttctgaattaag

SEQ ID NO: 192836 - DNA, 15 bp, Homo sapiens
gcatttctgaattaa

SEQ ID NO: 192837 - DNA, 15 bp, Homo sapiens
agcatttctgaatta

SEQ ID NO: 192838 - DNA, 15 bp, Homo sapiens
cagcatttctgaatt

SEQ ID NO: 192839 - DNA, 15 bp, Homo sapiens
gcagcatttctgaat

SEQ ID NO: 192840 - DNA, 15 bp, Homo sapiens
agcagcatttctgaa

SEQ ID NO: 192841 - DNA, 15 bp, Homo sapiens
cagcagcatttctga

SEQ ID NO: 192842 - DNA, 15 bp, Homo sapiens
acagcagcatttctg

SEQ ID NO: 192843 - DNA, 15 bp, Homo sapiens
tacagcagcatttct

SEQ ID NO: 192844 - DNA, 15 bp, Homo sapiens
ctacagcagcatttc

SEQ ID NO: 192845 - DNA, 15 bp, Homo sapiens
tctacagcagcattt

SEQ ID NO: 192846 - DNA, 15 bp, Homo sapiens
gtctacagcagcatt

SEQ ID NO: 192847 - DNA, 15 bp, Homo sapiens
ggtctacagcagcat

SEQ ID NO: 192848 - DNA, 15 bp, Homo sapiens
aggtctacagcagca

SEQ ID NO: 192849 - DNA, 15 bp, Homo sapiens
caggtctacagcagc

SEQ ID NO: 192850 - DNA, 15 bp, Homo sapiens
tcaggtctacagcag

SEQ ID NO: 192851 - DNA, 15 bp, Homo sapiens
atcaggtctacagca

SEQ ID NO: 192852 - DNA, 15 bp, Homo sapiens
catcaggtctacagc

SEQ ID NO: 192853 - DNA, 15 bp, Homo sapiens
tcatcaggtctacag

SEQ ID NO: 192854 - DNA, 15 bp, Homo sapiens
atcatcaggtctaca

SEQ ID NO: 192855 - DNA, 15 bp, Homo sapiens
tatcatcaggtctac

SEQ ID NO: 192856 - DNA, 15 bp, Homo sapiens
gtatcatcaggtcta

SEQ ID NO: 192857 - DNA, 15 bp, Homo sapiens
ggtatcatcaggtct

SEQ ID NO: 192858 - DNA, 15 bp, Homo sapiens
tggtatcatcaggtc

SEQ ID NO: 192859 - DNA, 15 bp, Homo sapiens
gtggtatcatcaggt

SEQ ID NO: 192860 - DNA, 15 bp, Homo sapiens
ggtggtatcatcagg

SEQ ID NO: 192861 - DNA, 15 bp, Homo sapiens
aggtggtatcatcag

SEQ ID NO: 192862 - DNA, 15 bp, Homo sapiens
gaggtggtatcatca

SEQ ID NO: 192863 - DNA, 15 bp, Homo sapiens
agaggtggtatcatc

SEQ ID NO: 192864 - DNA, 15 bp, Homo sapiens
tagaggtggtatcat

SEQ ID NO: 192865 - DNA, 15 bp, Homo sapiens
atagaggtggtatca

SEQ ID NO: 192866 - DNA, 15 bp, Homo sapiens
aatagaggtggtatc

SEQ ID NO: 192867 - DNA, 15 bp, Homo sapiens
caatagaggtggtat

SEQ ID NO: 192868 - DNA, 15 bp, Homo sapiens
acaatagaggtggta

SEQ ID NO: 192869 - DNA, 15 bp, Homo sapiens
gacaatagaggtggt

SEQ ID NO: 192870 - DNA, 15 bp, Homo sapiens
tgacaatagaggtgg

SEQ ID NO: 192871 - DNA, 15 bp, Homo sapiens
ctgacaatagaggtg

SEQ ID NO: 192872 - DNA, 15 bp, Homo sapiens
actgacaatagaggt

SEQ ID NO: 192873 - DNA, 15 bp, Homo sapiens
gactgacaatagagg

SEQ ID NO: 192874 - DNA, 15 bp, Homo sapiens
tgactgacaatagag

SEQ ID NO: 192875 - DNA, 15 bp, Homo sapiens
ttgactgacaataga

SEQ ID NO: 192876 - DNA, 15 bp, Homo sapiens
tttgactgacaatag

SEQ ID NO: 192877 - DNA, 15 bp, Homo sapiens
ttttgactgacaata

SEQ ID NO: 192878 - DNA, 15 bp, Homo sapiens
tttttgactgacaat

SEQ ID NO: 192879 - DNA, 15 bp, Homo sapiens
atttttgactgacaa

SEQ ID NO: 192880 - DNA, 15 bp, Homo sapiens
catttttgactgaca

SEQ ID NO: 192881 - DNA, 15 bp, Homo sapiens
acatttttgactgac

SEQ ID NO: 192882 - DNA, 15 bp, Homo sapiens
cacatttttgactga

SEQ ID NO: 192883 - DNA, 15 bp, Homo sapiens
tcacatttttgactg

SEQ ID NO: 192884 - DNA, 15 bp, Homo sapiens
atcacatttttgact

SEQ ID NO: 192885 - DNA, 15 bp, Homo sapiens
aatcacatttttgac

SEQ ID NO: 192886 - DNA, 15 bp, Homo sapiens
gaatcacatttttga

SEQ ID NO: 192887 - DNA, 15 bp, Homo sapiens
tgaatcacatttttg

SEQ ID NO: 192888 - DNA, 15 bp, Homo sapiens
ttgaatcacattttt

SEQ ID NO: 192889 - DNA, 15 bp, Homo sapiens
attgaatcacatttt

SEQ ID NO: 192890 - DNA, 15 bp, Homo sapiens
tattgaatcacattt

SEQ ID NO: 192891 - DNA, 15 bp, Homo sapiens
ctattgaatcacatt

SEQ ID NO: 192892 - DNA, 15 bp, Homo sapiens
tctattgaatcacat

SEQ ID NO: 192893 - DNA, 15 bp, Homo sapiens
ctctattgaatcaca

SEQ ID NO: 192894 - DNA, 15 bp, Homo sapiens
actctattgaatcac

SEQ ID NO: 192895 - DNA, 15 bp, Homo sapiens
cactctattgaatca

SEQ ID NO: 192896 - DNA, 15 bp, Homo sapiens
tcactctattgaatc

SEQ ID NO: 192897 - DNA, 15 bp, Homo sapiens
atcactctattgaat

SEQ ID NO: 192898 - DNA, 15 bp, Homo sapiens
aatcactctattgaa

SEQ ID NO: 192899 - DNA, 15 bp, Homo sapiens
taatcactctattga

SEQ ID NO: 192900 - DNA, 15 bp, Homo sapiens
ttaatcactctattg

SEQ ID NO: 192901 - DNA, 15 bp, Homo sapiens
tttaatcactctatt

SEQ ID NO: 192902 - DNA, 15 bp, Homo sapiens
ttttaatcactctat

SEQ ID NO: 192903 - DNA, 15 bp, Homo sapiens
attttaatcactcta

SEQ ID NO: 192904 - DNA, 15 bp, Homo sapiens
gattttaatcactct

SEQ ID NO: 192905 - DNA, 15 bp, Homo sapiens
agattttaatcactc

SEQ ID NO: 192906 - DNA, 15 bp, Homo sapiens
cagattttaatcact

SEQ ID NO: 192907 - DNA, 15 bp, Homo sapiens
acagattttaatcac

SEQ ID NO: 192908 - DNA, 15 bp, Homo sapiens
cacagattttaatca

SEQ ID NO: 192909 - DNA, 15 bp, Homo sapiens
tcacagattttaatc

SEQ ID NO: 192910 - DNA, 15 bp, Homo sapiens
ctcacagattttaat

SEQ ID NO: 192911 - DNA, 15 bp, Homo sapiens
tctcacagattttaa

SEQ ID NO: 192912 - DNA, 15 bp, Homo sapiens
atctcacagatttta

SEQ ID NO: 192913 - DNA, 15 bp, Homo sapiens
aatctcacagatttt

SEQ ID NO: 192914 - DNA, 15 bp, Homo sapiens
taatctcacagattt

SEQ ID NO: 192915 - DNA, 15 bp, Homo sapiens
ctaatctcacagatt

SEQ ID NO: 192916 - DNA, 15 bp, Homo sapiens
gctaatctcacagat

SEQ ID NO: 192917 - DNA, 15 bp, Homo sapiens
agctaatctcacaga

SEQ ID NO: 192918 - DNA, 15 bp, Homo sapiens
cagctaatctcacag

SEQ ID NO: 192919 - DNA, 15 bp, Homo sapiens
acagctaatctcaca

SEQ ID NO: 192920 - DNA, 15 bp, Homo sapiens
aacagctaatctcac

SEQ ID NO: 192921 - DNA, 15 bp, Homo sapiens
caacagctaatctca

SEQ ID NO: 192922 - DNA, 15 bp, Homo sapiens
ccaacagctaatctc

SEQ ID NO: 192923 - DNA, 15 bp, Homo sapiens
tccaacagctaatct

SEQ ID NO: 192924 - DNA, 15 bp, Homo sapiens
ttccaacagctaatc

SEQ ID NO: 192925 - DNA, 15 bp, Homo sapiens
cttccaacagctaat

SEQ ID NO: 192926 - DNA, 15 bp, Homo sapiens
tcttccaacagctaa

SEQ ID NO: 192927 - DNA, 15 bp, Homo sapiens
ttcttccaacagcta

SEQ ID NO: 192928 - DNA, 15 bp, Homo sapiens
tttcttccaacagct

SEQ ID NO: 192929 - DNA, 15 bp, Homo sapiens
ttttcttccaacagc

SEQ ID NO: 192930 - DNA, 15 bp, Homo sapiens
attttcttccaacag

SEQ ID NO: 192931 - DNA, 15 bp, Homo sapiens
aattttcttccaaca

SEQ ID NO: 192932 - DNA, 15 bp, Homo sapiens
aaattttcttccaac

SEQ ID NO: 192933 - DNA, 15 bp, Homo sapiens
ataaattttcttcca

SEQ ID NO: 192934 - DNA, 15 bp, Homo sapiens
tataaattttcttcc

SEQ ID NO: 192935 - DNA, 15 bp, Homo sapiens
ctataaattttcttc

SEQ ID NO: 192936 - DNA, 15 bp, Homo sapiens
tctataaattttctt

SEQ ID NO: 192937 - DNA, 15 bp, Homo sapiens
ttctataaattttct

SEQ ID NO: 192938 - DNA, 15 bp, Homo sapiens
attctataaattttc

SEQ ID NO: 192939 - DNA, 15 bp, Homo sapiens
tattctataaatttt

SEQ ID NO: 192940 - DNA, 15 bp, Homo sapiens
ttattctataaattt

SEQ ID NO: 192941 - DNA, 15 bp, Homo sapiens
attattctataaatt

SEQ ID NO: 192942 - DNA, 15 bp, Homo sapiens
tattattctataaat

SEQ ID NO: 192943 - DNA, 15 bp, Homo sapiens
ttattattctataaa

SEQ ID NO: 192944 - DNA, 15 bp, Homo sapiens
attattattctataa

SEQ ID NO: 192945 - DNA, 15 bp, Homo sapiens
aattattattctata

SEQ ID NO: 192946 - DNA, 15 bp, Homo sapiens
taattattattctat

SEQ ID NO: 192947 - DNA, 15 bp, Homo sapiens
ttaattattattcta

SEQ ID NO: 192948 - DNA, 15 bp, Homo sapiens
tttaattattattct

SEQ ID NO: 192949 - DNA, 15 bp, Homo sapiens
ttttaattattattc

SEQ ID NO: 192950 - DNA, 15 bp, Homo sapiens
attttaattattatt

SEQ ID NO: 192951 - DNA, 15 bp, Homo sapiens
gattttaattattat

SEQ ID NO: 192952 - DNA, 15 bp, Homo sapiens
tgattttaattatta

SEQ ID NO: 192953 - DNA, 15 bp, Homo sapiens
ttgattttaattatt

SEQ ID NO: 192954 - DNA, 15 bp, Homo sapiens
attgattttaattat

SEQ ID NO: 192955 - DNA, 15 bp, Homo sapiens
tattgattttaatta

SEQ ID NO: 192956 - DNA, 15 bp, Homo sapiens
ttattgattttaatt

SEQ ID NO: 192957 - DNA, 15 bp, Homo sapiens
tttattgattttaat

SEQ ID NO: 192958 - DNA, 15 bp, Homo sapiens
atttattgattttaa

SEQ ID NO: 192959 - DNA, 15 bp, Homo sapiens
aatttattgatttta

SEQ ID NO: 192960 - DNA, 15 bp, Homo sapiens
taatttattgatttt

SEQ ID NO: 192961 - DNA, 15 bp, Homo sapiens
ttaatttattgattt

SEQ ID NO: 192962 - DNA, 15 bp, Homo sapiens
attaatttattgatt

SEQ ID NO: 192963 - DNA, 15 bp, Homo sapiens
aattaatttattgat

SEQ ID NO: 192964 - DNA, 15 bp, Homo sapiens
caattaatttattga

SEQ ID NO: 192965 - DNA, 15 bp, Homo sapiens
tcaattaatttattg

SEQ ID NO: 192966 - DNA, 15 bp, Homo sapiens
ttcaattaatttatt

SEQ ID NO: 192967 - DNA, 15 bp, Homo sapiens
attcaattaatttat

SEQ ID NO: 192968 - DNA, 15 bp, Homo sapiens
tattcaattaattta

SEQ ID NO: 192969 - DNA, 15 bp, Homo sapiens
ttattcaattaattt

SEQ ID NO: 192970 - DNA, 15 bp, Homo sapiens
attattcaattaatt

SEQ ID NO: 192971 - DNA, 15 bp, Homo sapiens
aattattcaattaat

SEQ ID NO: 192972 - DNA, 15 bp, Homo sapiens
taattattcaattaa

SEQ ID NO: 192973 - DNA, 15 bp, Homo sapiens
ttaattattcaatta

SEQ ID NO: 192974 - DNA, 15 bp, Homo sapiens
attaattattcaatt

SEQ ID NO: 192975 - DNA, 15 bp, Homo sapiens
cattaattattcaat

SEQ ID NO: 192976 - DNA, 15 bp, Homo sapiens
tcattaattattcaa

SEQ ID NO: 192977 - DNA, 15 bp, Homo sapiens
gtcattaattattca

SEQ ID NO: 192978 - DNA, 15 bp, Homo sapiens
tgtcattaattattc

SEQ ID NO: 192979 - DNA, 15 bp, Homo sapiens
ttgtcattaattatt

SEQ ID NO: 192980 - DNA, 15 bp, Homo sapiens
attgtcattaattat

SEQ ID NO: 192981 - DNA, 15 bp, Homo sapiens
aattgtcattaatta

SEQ ID NO: 192982 - DNA, 15 bp, Homo sapiens
taattgtcattaatt

SEQ ID NO: 192983 - DNA, 15 bp, Homo sapiens
gtaattgtcattaat

SEQ ID NO: 192984 - DNA, 15 bp, Homo sapiens
agtaattgtcattaa

SEQ ID NO: 192985 - DNA, 15 bp, Homo sapiens
tagtaattgtcatta

SEQ ID NO: 192986 - DNA, 15 bp, Homo sapiens
atagtaattgtcatt

SEQ ID NO: 192987 - DNA, 15 bp, Homo sapiens
gatagtaattgtcat

SEQ ID NO: 192988 - DNA, 15 bp, Homo sapiens
ggatagtaattgtca

SEQ ID NO: 192989 - DNA, 15 bp, Homo sapiens
gggatagtaattgtc

SEQ ID NO: 192990 - DNA, 15 bp, Homo sapiens
tgggatagtaattgt

SEQ ID NO: 192991 - DNA, 15 bp, Homo sapiens
ctgggatagtaattg

SEQ ID NO: 192992 - DNA, 15 bp, Homo sapiens
tctgggatagtaatt

SEQ ID NO: 192993 - DNA, 15 bp, Homo sapiens
ttctgggatagtaat

SEQ ID NO: 192994 - DNA, 15 bp, Homo sapiens
tttctgggatagtaa

SEQ ID NO: 192995 - DNA, 15 bp, Homo sapiens
gtttctgggatagta

SEQ ID NO: 192996 - DNA, 15 bp, Homo sapiens
ggtttctgggatagt

SEQ ID NO: 192997 - DNA, 15 bp, Homo sapiens
aggtttctgggatag

SEQ ID NO: 192998 - DNA, 15 bp, Homo sapiens
gaggtttctgggata

SEQ ID NO: 192999 - DNA, 15 bp, Homo sapiens
tgaggtttctgggat

SEQ ID NO: 193000 - DNA, 15 bp, Homo sapiens
gtgaggtttctggga

SEQ ID NO: 193001 - DNA, 15 bp, Homo sapiens
tgtgaggtttctggg

SEQ ID NO: 193002 - DNA, 15 bp, Homo sapiens
ttgtgaggtttctgg

SEQ ID NO: 193003 - DNA, 15 bp, Homo sapiens
tttgtgaggtttctg

SEQ ID NO: 193004 - DNA, 15 bp, Homo sapiens
gtttgtgaggtttct

SEQ ID NO: 193005 - DNA, 15 bp, Homo sapiens
agtttgtgaggtttc

SEQ ID NO: 193006 - DNA, 15 bp, Homo sapiens
cagtttgtgaggttt

SEQ ID NO: 193007 - DNA, 15 bp, Homo sapiens
acagtttgtgaggtt

SEQ ID NO: 193008 - DNA, 15 bp, Homo sapiens
aacagtttgtgaggt

SEQ ID NO: 193009 - DNA, 15 bp, Homo sapiens
aaacagtttgtgagg

SEQ ID NO: 193010 - DNA, 15 bp, Homo sapiens
gaaacagtttgtgag

SEQ ID NO: 193011 - DNA, 15 bp, Homo sapiens
tgaaacagtttgtga

SEQ ID NO: 193012 - DNA, 15 bp, Homo sapiens
ttgaaacagtttgtg

SEQ ID NO: 193013 - DNA, 15 bp, Homo sapiens
tttgaaacagtttgt

SEQ ID NO: 193014 - DNA, 15 bp, Homo sapiens
ttttgaaacagtttg

SEQ ID NO: 193015 - DNA, 15 bp, Homo sapiens
gttttgaaacagttt

SEQ ID NO: 193016 - DNA, 15 bp, Homo sapiens
tgttttgaaacagtt

SEQ ID NO: 193017 - DNA, 15 bp, Homo sapiens
atgttttgaaacagt

SEQ ID NO: 193018 - DNA, 15 bp, Homo sapiens
tatgttttgaaacag

SEQ ID NO: 193019 - DNA, 15 bp, Homo sapiens
atatgttttgaaaca

SEQ ID NO: 193020 - DNA, 15 bp, Homo sapiens
aatatgttttgaaac

SEQ ID NO: 193021 - DNA, 15 bp, Homo sapiens
aaatatgttttgaaa

SEQ ID NO: 193022 - DNA, 15 bp, Homo sapiens
taaatatgttttgaa

SEQ ID NO: 193023 - DNA, 15 bp, Homo sapiens
gtaaatatgttttga

SEQ ID NO: 193024 - DNA, 15 bp, Homo sapiens
tgtaaatatgttttg

SEQ ID NO: 193025 - DNA, 15 bp, Homo sapiens
atgtaaatatgtttt

SEQ ID NO: 193026 - DNA, 15 bp, Homo sapiens
tatgtaaatatgttt

SEQ ID NO: 193027 - DNA, 15 bp, Homo sapiens
atatgtaaatatgtt

SEQ ID NO: 193028 - DNA, 15 bp, Homo sapiens
catatgtaaatatgt

SEQ ID NO: 193029 - DNA, 15 bp, Homo sapiens
tcatatgtaaatatg

SEQ ID NO: 193030 - DNA, 15 bp, Homo sapiens
gtcatatgtaaatat

SEQ ID NO: 193031 - DNA, 15 bp, Homo sapiens
tgtcatatgtaaata

SEQ ID NO: 193032 - DNA, 15 bp, Homo sapiens
atgtcatatgtaaat

SEQ ID NO: 193033 - DNA, 15 bp, Homo sapiens
tatgtcatatgtaaa

SEQ ID NO: 193034 - DNA, 15 bp, Homo sapiens
ttatgtcatatgtaa

SEQ ID NO: 193035 - DNA, 15 bp, Homo sapiens
gttatgtcatatgta

SEQ ID NO: 193036 - DNA, 15 bp, Homo sapiens
ggttatgtcatatgt

SEQ ID NO: 193037 - DNA, 15 bp, Homo sapiens
aggttatgtcatatg

SEQ ID NO: 193038 - DNA, 15 bp, Homo sapiens
aaggttatgtcatat

SEQ ID NO: 193039 - DNA, 15 bp, Homo sapiens
aaaggttatgtcata

SEQ ID NO: 193040 - DNA, 15 bp, Homo sapiens
caaaggttatgtcat

SEQ ID NO: 193041 - DNA, 15 bp, Homo sapiens
tcaaaggttatgtca

SEQ ID NO: 193042 - DNA, 15 bp, Homo sapiens
ttcaaaggttatgtc

SEQ ID NO: 193043 - DNA, 15 bp, Homo sapiens
cttcaaaggttatgt

SEQ ID NO: 193044 - DNA, 15 bp, Homo sapiens
tcttcaaaggttatg

SEQ ID NO: 193045 - DNA, 15 bp, Homo sapiens
atcttcaaaggttat

SEQ ID NO: 193046 - DNA, 15 bp, Homo sapiens
catcttcaaaggtta

SEQ ID NO: 193047 - DNA, 15 bp, Homo sapiens
tcatcttcaaaggtt

SEQ ID NO: 193048 - DNA, 15 bp, Homo sapiens
atcatcttcaaaggt

SEQ ID NO: 193049 - DNA, 15 bp, Homo sapiens
catcatcttcaaagg

SEQ ID NO: 193050 - DNA, 15 bp, Homo sapiens
acatcatcttcaaag

SEQ ID NO: 193051 - DNA, 15 bp, Homo sapiens
aacatcatcttcaaa

SEQ ID NO: 193052 - DNA, 15 bp, Homo sapiens
taacatcatcttcaa

SEQ ID NO: 193053 - DNA, 15 bp, Homo sapiens
ataacatcatcttca

SEQ ID NO: 193054 - DNA, 15 bp, Homo sapiens
aataacatcatcttc

SEQ ID NO: 193055 - DNA, 15 bp, Homo sapiens
aaataacatcatctt

SEQ ID NO: 193056 - DNA, 15 bp, Homo sapiens
caaataacatcatct

SEQ ID NO: 193057 - DNA, 15 bp, Homo sapiens
gcaaataacatcatc

SEQ ID NO: 193058 - DNA, 15 bp, Homo sapiens
ggcaaataacatcat

SEQ ID NO: 193059 - DNA, 15 bp, Homo sapiens
aggcaaataacatca

SEQ ID NO: 193060 - DNA, 15 bp, Homo sapiens
taggcaaataacatc

SEQ ID NO: 193061 - DNA, 15 bp, Homo sapiens
ataggcaaataacat

SEQ ID NO: 193062 - DNA, 15 bp, Homo sapiens
aataggcaaataaca

SEQ ID NO: 193063 - DNA, 15 bp, Homo sapiens
gaataggcaaataac

SEQ ID NO: 193064 - DNA, 15 bp, Homo sapiens
agaataggcaaataa

SEQ ID NO: 193065 - DNA, 15 bp, Homo sapiens
tagaataggcaaata

SEQ ID NO: 193066 - DNA, 15 bp, Homo sapiens
atagaataggcaaat

SEQ ID NO: 193067 - DNA, 15 bp, Homo sapiens
aatagaataggcaaa

SEQ ID NO: 193068 - DNA, 15 bp, Homo sapiens
taatagaataggcaa

SEQ ID NO: 193069 - DNA, 15 bp, Homo sapiens
ataatagaataggca

SEQ ID NO: 193070 - DNA, 15 bp, Homo sapiens
aataatagaataggc

SEQ ID NO: 193071 - DNA, 15 bp, Homo sapiens
taataatagaatagg

SEQ ID NO: 193072 - DNA, 15 bp, Homo sapiens
ataataatagaatag

SEQ ID NO: 193073 - DNA, 15 bp, Homo sapiens
aataataatagaata

SEQ ID NO: 193074 - DNA, 15 bp, Homo sapiens
aaataataatagaat

SEQ ID NO: 193075 - DNA, 15 bp, Homo sapiens
taaataataatagaa

SEQ ID NO: 193076 - DNA, 15 bp, Homo sapiens
ttaaataataataga

SEQ ID NO: 193077 - DNA, 15 bp, Homo sapiens
cttaaataataatag

SEQ ID NO: 193078 - DNA, 15 bp, Homo sapiens
acttaaataataata

SEQ ID NO: 193079 - DNA, 15 bp, Homo sapiens
tacttaaataataat

SEQ ID NO: 193080 - DNA, 15 bp, Homo sapiens
ttacttaaataataa

SEQ ID NO: 193081 - DNA, 15 bp, Homo sapiens
attacttaaataata

SEQ ID NO: 193082 - DNA, 15 bp, Homo sapiens
tattacttaaataat

SEQ ID NO: 193083 - DNA, 15 bp, Homo sapiens
atattacttaaataa

SEQ ID NO: 193084 - DNA, 15 bp, Homo sapiens
tatattacttaaata

SEQ ID NO: 193085 - DNA, 15 bp, Homo sapiens
atatattacttaaat

SEQ ID NO: 193086 - DNA, 15 bp, Homo sapiens
tatatattacttaaa

SEQ ID NO: 193087 - DNA, 15 bp, Homo sapiens
atatatattacttaa

SEQ ID NO: 193088 - DNA, 15 bp, Homo sapiens
tatatatattactta

SEQ ID NO: 193089 - DNA, 15 bp, Homo sapiens
atatatatattactt

SEQ ID NO: 193090 - DNA, 15 bp, Homo sapiens
tatatatatattact

SEQ ID NO: 193091 - DNA, 15 bp, Homo sapiens
atatatatatattac

SEQ ID NO: 193092 - DNA, 15 bp, Homo sapiens
tatatatatatatta

SEQ ID NO: 193093 - DNA, 15 bp, Homo sapiens
ttaaaaatatatata

SEQ ID NO: 193094 - DNA, 15 bp, Homo sapiens
tttaaaaatatatat

SEQ ID NO: 193095 - DNA, 15 bp, Homo sapiens
attttaaaaatatat

SEQ ID NO: 193096 - DNA, 15 bp, Homo sapiens
gattttaaaaatata

SEQ ID NO: 193097 - DNA, 15 bp, Homo sapiens
tgattttaaaaatat

SEQ ID NO: 193098 - DNA, 15 bp, Homo sapiens
atgattttaaaaata

SEQ ID NO: 193099 - DNA, 15 bp, Homo sapiens
catgattttaaaaat

SEQ ID NO: 193100 - DNA, 15 bp, Homo sapiens
tcatgattttaaaaa

SEQ ID NO: 193101 - DNA, 15 bp, Homo sapiens
atcatgattttaaaa

SEQ ID NO: 193102 - DNA, 15 bp, Homo sapiens
aatcatgattttaaa

SEQ ID NO: 193103 - DNA, 15 bp, Homo sapiens
gaatcatgattttaa

SEQ ID NO: 193104 - DNA, 15 bp, Homo sapiens
ggaatcatgatttta

SEQ ID NO: 193105 - DNA, 15 bp, Homo sapiens
aggaatcatgatttt

SEQ ID NO: 193106 - DNA, 15 bp, Homo sapiens
gaggaatcatgattt

SEQ ID NO: 193107 - DNA, 15 bp, Homo sapiens
tgaggaatcatgatt

SEQ ID NO: 193108 - DNA, 15 bp, Homo sapiens
atgaggaatcatgat

SEQ ID NO: 193109 - DNA, 15 bp, Homo sapiens
aatgaggaatcatga

SEQ ID NO: 193110 - DNA, 15 bp, Homo sapiens
aaatgaggaatcatg

SEQ ID NO: 193111 - DNA, 15 bp, Homo sapiens
aaaatgaggaatcat

SEQ ID NO: 193112 - DNA, 15 bp, Homo sapiens
gaaaatgaggaatca

SEQ ID NO: 193113 - DNA, 15 bp, Homo sapiens
tgaaaatgaggaatc

SEQ ID NO: 193114 - DNA, 15 bp, Homo sapiens
ttttgaaaatgagga

SEQ ID NO: 193115 - DNA, 15 bp, Homo sapiens
gttttgaaaatgagg

SEQ ID NO: 193116 - DNA, 15 bp, Homo sapiens
ggttttgaaaatgag

SEQ ID NO: 193117 - DNA, 15 bp, Homo sapiens
aggttttgaaaatga

SEQ ID NO: 193118 - DNA, 15 bp, Homo sapiens
taggttttgaaaatg

SEQ ID NO: 193119 - DNA, 15 bp, Homo sapiens
ttaggttttgaaaat

SEQ ID NO: 193120 - DNA, 15 bp, Homo sapiens
tttaggttttgaaaa

SEQ ID NO: 193121 - DNA, 15 bp, Homo sapiens
ctttaggttttgaaa

SEQ ID NO: 193122 - DNA, 15 bp, Homo sapiens
gctttaggttttgaa

SEQ ID NO: 193123 - DNA, 15 bp, Homo sapiens
agctttaggttttga

SEQ ID NO: 193124 - DNA, 15 bp, Homo sapiens
gagctttaggttttg

SEQ ID NO: 193125 - DNA, 15 bp, Homo sapiens
agagctttaggtttt

SEQ ID NO: 193126 - DNA, 15 bp, Homo sapiens
cagagctttaggttt

SEQ ID NO: 193127 - DNA, 15 bp, Homo sapiens
ccagagctttaggtt

SEQ ID NO: 193128 - DNA, 15 bp, Homo sapiens
gccagagctttaggt

SEQ ID NO: 193129 - DNA, 15 bp, Homo sapiens
tgccagagctttagg

SEQ ID NO: 193130 - DNA, 15 bp, Homo sapiens
ctgccagagctttag

SEQ ID NO: 193131 - DNA, 15 bp, Homo sapiens
actgccagagcttta

SEQ ID NO: 193132 - DNA, 15 bp, Homo sapiens
tactgccagagcttt

SEQ ID NO: 193133 - DNA, 15 bp, Homo sapiens
ttactgccagagctt

SEQ ID NO: 193134 - DNA, 15 bp, Homo sapiens
attactgccagagct

SEQ ID NO: 193135 - DNA, 15 bp, Homo sapiens
gattactgccagagc

SEQ ID NO: 193136 - DNA, 15 bp, Homo sapiens
ggattactgccagag

SEQ ID NO: 193137 - DNA, 15 bp, Homo sapiens
aggattactgccaga

SEQ ID NO: 193138 - DNA, 15 bp, Homo sapiens
caggattactgccag

SEQ ID NO: 193139 - DNA, 15 bp, Homo sapiens
gcaggattactgcca

SEQ ID NO: 193140 - DNA, 15 bp, Homo sapiens
agcaggattactgcc

SEQ ID NO: 193141 - DNA, 15 bp, Homo sapiens
cagcaggattactgc

SEQ ID NO: 193142 - DNA, 15 bp, Homo sapiens
tcagcaggattactg

SEQ ID NO: 193143 - DNA, 15 bp, Homo sapiens
ctcagcaggattact

SEQ ID NO: 193144 - DNA, 15 bp, Homo sapiens
gctcagcaggattac

SEQ ID NO: 193145 - DNA, 15 bp, Homo sapiens
agctcagcaggatta

SEQ ID NO: 193146 - DNA, 15 bp, Homo sapiens
gagctcagcaggatt

SEQ ID NO: 193147 - DNA, 15 bp, Homo sapiens
ggagctcagcaggat

SEQ ID NO: 193148 - DNA, 15 bp, Homo sapiens
aggagctcagcagga

SEQ ID NO: 193149 - DNA, 15 bp, Homo sapiens
caggagctcagcagg

SEQ ID NO: 193150 - DNA, 15 bp, Homo sapiens
tcaggagctcagcag

SEQ ID NO: 193151 - DNA, 15 bp, Homo sapiens
atcaggagctcagca

SEQ ID NO: 193152 - DNA, 15 bp, Homo sapiens
tatcaggagctcagc

SEQ ID NO: 193153 - DNA, 15 bp, Homo sapiens
ttatcaggagctcag

SEQ ID NO: 193154 - DNA, 15 bp, Homo sapiens
attatcaggagctca

SEQ ID NO: 193155 - DNA, 15 bp, Homo sapiens
tattatcaggagctc

SEQ ID NO: 193156 - DNA, 15 bp, Homo sapiens
ttattatcaggagct

SEQ ID NO: 193157 - DNA, 15 bp, Homo sapiens
attattatcaggagc

SEQ ID NO: 193158 - DNA, 15 bp, Homo sapiens
aattattatcaggag

SEQ ID NO: 193159 - DNA, 15 bp, Homo sapiens
gaattattatcagga

SEQ ID NO: 193160 - DNA, 15 bp, Homo sapiens
agaattattatcagg

SEQ ID NO: 193161 - DNA, 15 bp, Homo sapiens
cagaattattatcag

SEQ ID NO: 193162 - DNA, 15 bp, Homo sapiens
tcagaattattatca

SEQ ID NO: 193163 - DNA, 15 bp, Homo sapiens
ttcagaattattatc

SEQ ID NO: 193164 - DNA, 15 bp, Homo sapiens
tttcagaattattat

SEQ ID NO: 193165 - DNA, 15 bp, Homo sapiens
atttcagaattatta

SEQ ID NO: 193166 - DNA, 15 bp, Homo sapiens
gatttcagaattatt

SEQ ID NO: 193167 - DNA, 15 bp, Homo sapiens
agatttcagaattat

SEQ ID NO: 193168 - DNA, 15 bp, Homo sapiens
tagatttcagaatta

SEQ ID NO: 193169 - DNA, 15 bp, Homo sapiens
ctagatttcagaatt

SEQ ID NO: 193170 - DNA, 15 bp, Homo sapiens
actagatttcagaat

SEQ ID NO: 193171 - DNA, 15 bp, Homo sapiens
gactagatttcagaa

SEQ ID NO: 193172 - DNA, 15 bp, Homo sapiens
agactagatttcaga

SEQ ID NO: 193173 - DNA, 15 bp, Homo sapiens
cagactagatttcag

SEQ ID NO: 193174 - DNA, 15 bp, Homo sapiens
tcagactagatttca

SEQ ID NO: 193175 - DNA, 15 bp, Homo sapiens
gtcagactagatttc

SEQ ID NO: 193176 - DNA, 15 bp, Homo sapiens
agtcagactagattt

SEQ ID NO: 193177 - DNA, 15 bp, Homo sapiens
aagtcagactagatt

SEQ ID NO: 193178 - DNA, 15 bp, Homo sapiens
aaagtcagactagat

SEQ ID NO: 193179 - DNA, 15 bp, Homo sapiens
aaaagtcagactaga

SEQ ID NO: 193180 - DNA, 15 bp, Homo sapiens
caaaagtcagactag

SEQ ID NO: 193181 - DNA, 15 bp, Homo sapiens
tcaaaagtcagacta

SEQ ID NO: 193182 - DNA, 15 bp, Homo sapiens
ttcaaaagtcagact

SEQ ID NO: 193183 - DNA, 15 bp, Homo sapiens
tttcaaaagtcagac

SEQ ID NO: 193184 - DNA, 15 bp, Homo sapiens
ctttcaaaagtcaga

SEQ ID NO: 193185 - DNA, 15 bp, Homo sapiens
cctttcaaaagtcag

SEQ ID NO: 193186 - DNA, 15 bp, Homo sapiens
tcctttcaaaagtca

SEQ ID NO: 193187 - DNA, 15 bp, Homo sapiens
ttcctttcaaaagtc

SEQ ID NO: 193188 - DNA, 15 bp, Homo sapiens
attcctttcaaaagt

SEQ ID NO: 193189 - DNA, 15 bp, Homo sapiens
cattcctttcaaaag

SEQ ID NO: 193190 - DNA, 15 bp, Homo sapiens
ccattcctttcaaaa

SEQ ID NO: 193191 - DNA, 15 bp, Homo sapiens
accattcctttcaaa

SEQ ID NO: 193192 - DNA, 15 bp, Homo sapiens
caccattcctttcaa

SEQ ID NO: 193193 - DNA, 15 bp, Homo sapiens
ccaccattcctttca

SEQ ID NO: 193194 - DNA, 15 bp, Homo sapiens
tccaccattcctttc

SEQ ID NO: 193195 - DNA, 15 bp, Homo sapiens
atccaccattccttt

SEQ ID NO: 193196 - DNA, 15 bp, Homo sapiens
aatccaccattcctt

SEQ ID NO: 193197 - DNA, 15 bp, Homo sapiens
aaatccaccattcct

SEQ ID NO: 193198 - DNA, 15 bp, Homo sapiens
taaatccaccattcc

SEQ ID NO: 193199 - DNA, 15 bp, Homo sapiens
ataaatccaccattc

SEQ ID NO: 193200 - DNA, 15 bp, Homo sapiens
aataaatccaccatt

SEQ ID NO: 193201 - DNA, 15 bp, Homo sapiens
aaataaatccaccat

SEQ ID NO: 193202 - DNA, 15 bp, Homo sapiens
aaaataaatccacca

SEQ ID NO: 193203 - DNA, 15 bp, Homo sapiens
gaaaataaatccacc

SEQ ID NO: 193204 - DNA, 15 bp, Homo sapiens
ggaaaataaatccac

SEQ ID NO: 193205 - DNA, 15 bp, Homo sapiens
aggaaaataaatcca

SEQ ID NO: 193206 - DNA, 15 bp, Homo sapiens
gaggaaaataaatcc

SEQ ID NO: 193207 - DNA, 15 bp, Homo sapiens
agaggaaaataaatc

SEQ ID NO: 193208 - DNA, 15 bp, Homo sapiens
tagaggaaaataaat

SEQ ID NO: 193209 - DNA, 15 bp, Homo sapiens
ttagaggaaaataaa

SEQ ID NO: 193210 - DNA, 15 bp, Homo sapiens
attagaggaaaataa

SEQ ID NO: 193211 - DNA, 15 bp, Homo sapiens
cattagaggaaaata

SEQ ID NO: 193212 - DNA, 15 bp, Homo sapiens
tcattagaggaaaat

SEQ ID NO: 193213 - DNA, 15 bp, Homo sapiens
atcattagaggaaaa

SEQ ID NO: 193214 - DNA, 15 bp, Homo sapiens
aatcattagaggaaa

SEQ ID NO: 193215 - DNA, 15 bp, Homo sapiens
taatcattagaggaa

SEQ ID NO: 193216 - DNA, 15 bp, Homo sapiens
ttaatcattagagga

SEQ ID NO: 193217 - DNA, 15 bp, Homo sapiens
gttaatcattagagg

SEQ ID NO: 193218 - DNA, 15 bp, Homo sapiens
agttaatcattagag

SEQ ID NO: 193219 - DNA, 15 bp, Homo sapiens
aagttaatcattaga

SEQ ID NO: 193220 - DNA, 15 bp, Homo sapiens
aaagttaatcattag

SEQ ID NO: 193221 - DNA, 15 bp, Homo sapiens
caaagttaatcatta

SEQ ID NO: 193222 - DNA, 15 bp, Homo sapiens
acaaagttaatcatt

SEQ ID NO: 193223 - DNA, 15 bp, Homo sapiens
aacaaagttaatcat

SEQ ID NO: 193224 - DNA, 15 bp, Homo sapiens
aaacaaagttaatca

SEQ ID NO: 193225 - DNA, 15 bp, Homo sapiens
taaacaaagttaatc

SEQ ID NO: 193226 - DNA, 15 bp, Homo sapiens
ctaaacaaagttaat

SEQ ID NO: 193227 - DNA, 15 bp, Homo sapiens
actaaacaaagttaa

SEQ ID NO: 193228 - DNA, 15 bp, Homo sapiens
aactaaacaaagtta

SEQ ID NO: 193229 - DNA, 15 bp, Homo sapiens
taactaaacaaagtt

SEQ ID NO: 193230 - DNA, 15 bp, Homo sapiens
ctaactaaacaaagt

SEQ ID NO: 193231 - DNA, 15 bp, Homo sapiens
cctaactaaacaaag

SEQ ID NO: 193232 - DNA, 15 bp, Homo sapiens
gcctaactaaacaaa

SEQ ID NO: 193233 - DNA, 15 bp, Homo sapiens
agcctaactaaacaa

SEQ ID NO: 193234 - DNA, 15 bp, Homo sapiens
cagcctaactaaaca

SEQ ID NO: 193235 - DNA, 15 bp, Homo sapiens
tcagcctaactaaac

SEQ ID NO: 193236 - DNA, 15 bp, Homo sapiens
ctcagcctaactaaa

SEQ ID NO: 193237 - DNA, 15 bp, Homo sapiens
gctcagcctaactaa

SEQ ID NO: 193238 - DNA, 15 bp, Homo sapiens
agctcagcctaacta

SEQ ID NO: 193239 - DNA, 15 bp, Homo sapiens
aagctcagcctaact

SEQ ID NO: 193240 - DNA, 15 bp, Homo sapiens
aaagctcagcctaac

SEQ ID NO: 193241 - DNA, 15 bp, Homo sapiens
caaagctcagcctaa

SEQ ID NO: 193242 - DNA, 15 bp, Homo sapiens
ccaaagctcagccta

SEQ ID NO: 193243 - DNA, 15 bp, Homo sapiens
cccaaagctcagcct

SEQ ID NO: 193244 - DNA, 15 bp, Homo sapiens
tcccaaagctcagcc

SEQ ID NO: 193245 - DNA, 15 bp, Homo sapiens
gtcccaaagctcagc

SEQ ID NO: 193246 - DNA, 15 bp, Homo sapiens
tgtcccaaagctcag

SEQ ID NO: 193247 - DNA, 15 bp, Homo sapiens
atgtcccaaagctca

SEQ ID NO: 193248 - DNA, 15 bp, Homo sapiens
catgtcccaaagctc

SEQ ID NO: 193249 - DNA, 15 bp, Homo sapiens
tcatgtcccaaagct

SEQ ID NO: 193250 - DNA, 15 bp, Homo sapiens
atcatgtcccaaagc

SEQ ID NO: 193251 - DNA, 15 bp, Homo sapiens
tatcatgtcccaaag

SEQ ID NO: 193252 - DNA, 15 bp, Homo sapiens
ctatcatgtcccaaa

SEQ ID NO: 193253 - DNA, 15 bp, Homo sapiens
gctatcatgtcccaa

SEQ ID NO: 193254 - DNA, 15 bp, Homo sapiens
cgctatcatgtccca

SEQ ID NO: 193255 - DNA, 15 bp, Homo sapiens
tcgctatcatgtccc

SEQ ID NO: 193256 - DNA, 15 bp, Homo sapiens
ttcgctatcatgtcc

SEQ ID NO: 193257 - DNA, 15 bp, Homo sapiens
tttcgctatcatgtc

SEQ ID NO: 193258 - DNA, 15 bp, Homo sapiens
atttcgctatcatgt

SEQ ID NO: 193259 - DNA, 15 bp, Homo sapiens
aatttcgctatcatg

SEQ ID NO: 193260 - DNA, 15 bp, Homo sapiens
caatttcgctatcat

SEQ ID NO: 193261 - DNA, 15 bp, Homo sapiens
acaatttcgctatca

SEQ ID NO: 193262 - DNA, 15 bp, Homo sapiens
aacaatttcgctatc

SEQ ID NO: 193263 - DNA, 15 bp, Homo sapiens
gaacaatttcgctat

SEQ ID NO: 193264 - DNA, 15 bp, Homo sapiens
agaacaatttcgcta

SEQ ID NO: 193265 - DNA, 15 bp, Homo sapiens
tagaacaatttcgct

SEQ ID NO: 193266 - DNA, 15 bp, Homo sapiens
ttagaacaatttcgc

SEQ ID NO: 193267 - DNA, 15 bp, Homo sapiens
gttagaacaatttcg

SEQ ID NO: 193268 - DNA, 15 bp, Homo sapiens
ggttagaacaatttc

SEQ ID NO: 193269 - DNA, 15 bp, Homo sapiens
aggttagaacaattt

SEQ ID NO: 193270 - DNA, 15 bp, Homo sapiens
gaggttagaacaatt

SEQ ID NO: 193271 - DNA, 15 bp, Homo sapiens
tgaggttagaacaat

SEQ ID NO: 193272 - DNA, 15 bp, Homo sapiens
atgaggttagaacaa

SEQ ID NO: 193273 - DNA, 15 bp, Homo sapiens
aatgaggttagaaca

SEQ ID NO: 193274 - DNA, 15 bp, Homo sapiens
aaatgaggttagaac

SEQ ID NO: 193275 - DNA, 15 bp, Homo sapiens
gaaatgaggttagaa

SEQ ID NO: 193276 - DNA, 15 bp, Homo sapiens
agaaatgaggttaga

SEQ ID NO: 193277 - DNA, 15 bp, Homo sapiens
aagaaatgaggttag

SEQ ID NO: 193278 - DNA, 15 bp, Homo sapiens
gaagaaatgaggtta

SEQ ID NO: 193279 - DNA, 15 bp, Homo sapiens
agaagaaatgaggtt

SEQ ID NO: 193280 - DNA, 15 bp, Homo sapiens
aagaagaaatgaggt

SEQ ID NO: 193281 - DNA, 15 bp, Homo sapiens
gaagaagaaatgagg

SEQ ID NO: 193282 - DNA, 15 bp, Homo sapiens
tgaagaagaaatgag

SEQ ID NO: 193283 - DNA, 15 bp, Homo sapiens
gtgaagaagaaatga

SEQ ID NO: 193284 - DNA, 15 bp, Homo sapiens
ggtgaagaagaaatg

SEQ ID NO: 193285 - DNA, 15 bp, Homo sapiens
aggtgaagaagaaat

SEQ ID NO: 193286 - DNA, 15 bp, Homo sapiens
aaggtgaagaagaaa

SEQ ID NO: 193287 - DNA, 15 bp, Homo sapiens
gaaggtgaagaagaa

SEQ ID NO: 193288 - DNA, 15 bp, Homo sapiens
tgaaggtgaagaaga

SEQ ID NO: 193289 - DNA, 15 bp, Homo sapiens
ctgaaggtgaagaag

SEQ ID NO: 193290 - DNA, 15 bp, Homo sapiens
cctgaaggtgaagaa

SEQ ID NO: 193291 - DNA, 15 bp, Homo sapiens
tcctgaaggtgaaga

SEQ ID NO: 193292 - DNA, 15 bp, Homo sapiens
ttcctgaaggtgaag

SEQ ID NO: 193293 - DNA, 15 bp, Homo sapiens
tttcctgaaggtgaa

SEQ ID NO: 193294 - DNA, 15 bp, Homo sapiens
ctttcctgaaggtga

SEQ ID NO: 193295 - DNA, 15 bp, Homo sapiens
cctttcctgaaggtg

SEQ ID NO: 193296 - DNA, 15 bp, Homo sapiens
ccctttcctgaaggt

SEQ ID NO: 193297 - DNA, 15 bp, Homo sapiens
cccctttcctgaagg

SEQ ID NO: 193298 - DNA, 15 bp, Homo sapiens
acccctttcctgaag

SEQ ID NO: 193299 - DNA, 15 bp, Homo sapiens
gacccctttcctgaa

SEQ ID NO: 193300 - DNA, 15 bp, Homo sapiens
tgacccctttcctga

SEQ ID NO: 193301 - DNA, 15 bp, Homo sapiens
ctgacccctttcctg

SEQ ID NO: 193302 - DNA, 15 bp, Homo sapiens
tctgacccctttcct

SEQ ID NO: 193303 - DNA, 15 bp, Homo sapiens
ttctgacccctttcc

SEQ ID NO: 193304 - DNA, 15 bp, Homo sapiens
gttctgacccctttc

SEQ ID NO: 193305 - DNA, 15 bp, Homo sapiens
agttctgaccccttt

SEQ ID NO: 193306 - DNA, 15 bp, Homo sapiens
gagttctgacccctt

SEQ ID NO: 193307 - DNA, 15 bp, Homo sapiens
ggagttctgacccct

SEQ ID NO: 193308 - DNA, 15 bp, Homo sapiens
aggagttctgacccc

SEQ ID NO: 193309 - DNA, 15 bp, Homo sapiens
aaggagttctgaccc

SEQ ID NO: 193310 - DNA, 15 bp, Homo sapiens
gaaggagttctgacc

SEQ ID NO: 193311 - DNA, 15 bp, Homo sapiens
tgaaggagttctgac

SEQ ID NO: 193312 - DNA, 15 bp, Homo sapiens
ctgaaggagttctga

SEQ ID NO: 193313 - DNA, 15 bp, Homo sapiens
tctgaaggagttctg

SEQ ID NO: 193314 - DNA, 15 bp, Homo sapiens
ttctgaaggagttct

SEQ ID NO: 193315 - DNA, 15 bp, Homo sapiens
tttctgaaggagttc

SEQ ID NO: 193316 - DNA, 15 bp, Homo sapiens
ttttctgaaggagtt

SEQ ID NO: 193317 - DNA, 15 bp, Homo sapiens
tttttctgaaggagt

SEQ ID NO: 193318 - DNA, 15 bp, Homo sapiens
ttttttctgaaggag

SEQ ID NO: 193319 - DNA, 15 bp, Homo sapiens
tttttttctgaagga

SEQ ID NO: 193320 - DNA, 15 bp, Homo sapiens
gtttttttctgaagg

SEQ ID NO: 193321 - DNA, 15 bp, Homo sapiens
tgtttttttctgaag

SEQ ID NO: 193322 - DNA, 15 bp, Homo sapiens
atgtttttttctgaa

SEQ ID NO: 193323 - DNA, 15 bp, Homo sapiens
gatgtttttttctga

SEQ ID NO: 193324 - DNA, 15 bp, Homo sapiens
tgatgtttttttctg

SEQ ID NO: 193325 - DNA, 15 bp, Homo sapiens
gtgatgtttttttct

SEQ ID NO: 193326 - DNA, 15 bp, Homo sapiens
agtgatgtttttttc

SEQ ID NO: 193327 - DNA, 15 bp, Homo sapiens
cagtgatgttttttt

SEQ ID NO: 193328 - DNA, 15 bp, Homo sapiens
acagtgatgtttttt

SEQ ID NO: 193329 - DNA, 15 bp, Homo sapiens
aacagtgatgttttt

SEQ ID NO: 193330 - DNA, 15 bp, Homo sapiens
caacagtgatgtttt

SEQ ID NO: 193331 - DNA, 15 bp, Homo sapiens
gcaacagtgatgttt

SEQ ID NO: 193332 - DNA, 15 bp, Homo sapiens
ggcaacagtgatgtt

SEQ ID NO: 193333 - DNA, 15 bp, Homo sapiens
tggcaacagtgatgt

SEQ ID NO: 193334 - DNA, 15 bp, Homo sapiens
gtggcaacagtgatg

SEQ ID NO: 193335 - DNA, 15 bp, Homo sapiens
tgtggcaacagtgat

SEQ ID NO: 193336 - DNA, 15 bp, Homo sapiens
atgtggcaacagtga

SEQ ID NO: 193337 - DNA, 15 bp, Homo sapiens
tatgtggcaacagtg

SEQ ID NO: 193338 - DNA, 15 bp, Homo sapiens
ttatgtggcaacagt

SEQ ID NO: 193339 - DNA, 15 bp, Homo sapiens
cttatgtggcaacag

SEQ ID NO: 193340 - DNA, 15 bp, Homo sapiens
ccttatgtggcaaca

SEQ ID NO: 193341 - DNA, 15 bp, Homo sapiens
accttatgtggcaac

SEQ ID NO: 193342 - DNA, 15 bp, Homo sapiens
aaccttatgtggcaa

SEQ ID NO: 193343 - DNA, 15 bp, Homo sapiens
taaccttatgtggca

SEQ ID NO: 193344 - DNA, 15 bp, Homo sapiens
ttaaccttatgtggc

SEQ ID NO: 193345 - DNA, 15 bp, Homo sapiens
cttaaccttatgtgg

SEQ ID NO: 193346 - DNA, 15 bp, Homo sapiens
acttaaccttatgtg

SEQ ID NO: 193347 - DNA, 15 bp, Homo sapiens
tacttaaccttatgt

SEQ ID NO: 193348 - DNA, 15 bp, Homo sapiens
ttacttaaccttatg

SEQ ID NO: 193349 - DNA, 15 bp, Homo sapiens
tttacttaaccttat

SEQ ID NO: 193350 - DNA, 15 bp, Homo sapiens
atttacttaacctta

SEQ ID NO: 193351 - DNA, 15 bp, Homo sapiens
tatttacttaacctt

SEQ ID NO: 193352 - DNA, 15 bp, Homo sapiens
ctatttacttaacct

SEQ ID NO: 193353 - DNA, 15 bp, Homo sapiens
actatttacttaacc

SEQ ID NO: 193354 - DNA, 15 bp, Homo sapiens
aactatttacttaac

SEQ ID NO: 193355 - DNA, 15 bp, Homo sapiens
caactatttacttaa

SEQ ID NO: 193356 - DNA, 15 bp, Homo sapiens
ccaactatttactta

SEQ ID NO: 193357 - DNA, 15 bp, Homo sapiens
accaactatttactt

SEQ ID NO: 193358 - DNA, 15 bp, Homo sapiens
caccaactatttact

SEQ ID NO: 193359 - DNA, 15 bp, Homo sapiens
gcaccaactatttac

SEQ ID NO: 193360 - DNA, 15 bp, Homo sapiens
tgcaccaactattta

SEQ ID NO: 193361 - DNA, 15 bp, Homo sapiens
ttgcaccaactattt

SEQ ID NO: 193362 - DNA, 15 bp, Homo sapiens
tttgcaccaactatt

SEQ ID NO: 193363 - DNA, 15 bp, Homo sapiens
ttttgcaccaactat

SEQ ID NO: 193364 - DNA, 15 bp, Homo sapiens
tttttgcaccaacta

SEQ ID NO: 193365 - DNA, 15 bp, Homo sapiens
atttttgcaccaact

SEQ ID NO: 193366 - DNA, 15 bp, Homo sapiens
tatttttgcaccaac

SEQ ID NO: 193367 - DNA, 15 bp, Homo sapiens
ttatttttgcaccaa

SEQ ID NO: 193368 - DNA, 15 bp, Homo sapiens
tttatttttgcacca

SEQ ID NO: 193369 - DNA, 15 bp, Homo sapiens
gtttatttttgcacc

SEQ ID NO: 193370 - DNA, 15 bp, Homo sapiens
ggtttatttttgcac

SEQ ID NO: 193371 - DNA, 15 bp, Homo sapiens
tggtttatttttgca

SEQ ID NO: 193372 - DNA, 15 bp, Homo sapiens
ttggtttatttttgc

SEQ ID NO: 193373 - DNA, 15 bp, Homo sapiens
tttggtttatttttg

SEQ ID NO: 193374 - DNA, 15 bp, Homo sapiens
ttttggtttattttt

SEQ ID NO: 193375 - DNA, 15 bp, Homo sapiens
attttggtttatttt

SEQ ID NO: 193376 - DNA, 15 bp, Homo sapiens
aattttggtttattt

SEQ ID NO: 193377 - DNA, 15 bp, Homo sapiens
taattttggtttatt

SEQ ID NO: 193378 - DNA, 15 bp, Homo sapiens
ataattttggtttat

SEQ ID NO: 193379 - DNA, 15 bp, Homo sapiens
aataattttggttta

SEQ ID NO: 193380 - DNA, 15 bp, Homo sapiens
aaataattttggttt

SEQ ID NO: 193381 - DNA, 15 bp, Homo sapiens
aaaataattttggtt

SEQ ID NO: 193382 - DNA, 15 bp, Homo sapiens
taaaataattttggt

SEQ ID NO: 193383 - DNA, 15 bp, Homo sapiens
ttaaaataattttgg

SEQ ID NO: 193384 - DNA, 15 bp, Homo sapiens
gttaaaataattttg

SEQ ID NO: 193385 - DNA, 15 bp, Homo sapiens
tgttaaaataatttt

SEQ ID NO: 193386 - DNA, 15 bp, Homo sapiens
ttgttaaaataattt

SEQ ID NO: 193387 - DNA, 15 bp, Homo sapiens
cttgttaaaataatt

SEQ ID NO: 193388 - DNA, 15 bp, Homo sapiens
tcttgttaaaataat

SEQ ID NO: 193389 - DNA, 15 bp, Homo sapiens
gtcttgttaaaataa

SEQ ID NO: 193390 - DNA, 15 bp, Homo sapiens
ggtcttgttaaaata

SEQ ID NO: 193391 - DNA, 15 bp, Homo sapiens
tggtcttgttaaaat

SEQ ID NO: 193392 - DNA, 15 bp, Homo sapiens
ttggtcttgttaaaa

SEQ ID NO: 193393 - DNA, 15 bp, Homo sapiens
tttggtcttgttaaa

SEQ ID NO: 193394 - DNA, 15 bp, Homo sapiens
ctttggtcttgttaa

SEQ ID NO: 193395 - DNA, 15 bp, Homo sapiens
tctttggtcttgtta

SEQ ID NO: 193396 - DNA, 15 bp, Homo sapiens
ctctttggtcttgtt

SEQ ID NO: 193397 - DNA, 15 bp, Homo sapiens
cctctttggtcttgt

SEQ ID NO: 193398 - DNA, 15 bp, Homo sapiens
tcctctttggtcttg

SEQ ID NO: 193399 - DNA, 15 bp, Homo sapiens
atcctctttggtctt

SEQ ID NO: 193400 - DNA, 15 bp, Homo sapiens
catcctctttggtct

SEQ ID NO: 193401 - DNA, 15 bp, Homo sapiens
tcatcctctttggtc

SEQ ID NO: 193402 - DNA, 15 bp, Homo sapiens
ttcatcctctttggt

SEQ ID NO: 193403 - DNA, 15 bp, Homo sapiens
attcatcctctttgg

SEQ ID NO: 193404 - DNA, 15 bp, Homo sapiens
gattcatcctctttg

SEQ ID NO: 193405 - DNA, 15 bp, Homo sapiens
agattcatcctcttt

SEQ ID NO: 193406 - DNA, 15 bp, Homo sapiens
tagattcatcctctt

SEQ ID NO: 193407 - DNA, 15 bp, Homo sapiens
ctagattcatcctct

SEQ ID NO: 193408 - DNA, 15 bp, Homo sapiens
actagattcatcctc

SEQ ID NO: 193409 - DNA, 15 bp, Homo sapiens
gactagattcatcct

SEQ ID NO: 193410 - DNA, 15 bp, Homo sapiens
agactagattcatcc

SEQ ID NO: 193411 - DNA, 15 bp, Homo sapiens
tagactagattcatc

SEQ ID NO: 193412 - DNA, 15 bp, Homo sapiens
ctagactagattcat

SEQ ID NO: 193413 - DNA, 15 bp, Homo sapiens
gctagactagattca

SEQ ID NO: 193414 - DNA, 15 bp, Homo sapiens
tgctagactagattc

SEQ ID NO: 193415 - DNA, 15 bp, Homo sapiens
gtgctagactagatt

SEQ ID NO: 193416 - DNA, 15 bp, Homo sapiens
ggtgctagactagat

SEQ ID NO: 193417 - DNA, 15 bp, Homo sapiens
gggtgctagactaga

SEQ ID NO: 193418 - DNA, 15 bp, Homo sapiens
tgggtgctagactag

SEQ ID NO: 193419 - DNA, 15 bp, Homo sapiens
atgggtgctagacta

SEQ ID NO: 193420 - DNA, 15 bp, Homo sapiens
aatgggtgctagact

SEQ ID NO: 193421 - DNA, 15 bp, Homo sapiens
aaatgggtgctagac

SEQ ID NO: 193422 - DNA, 15 bp, Homo sapiens
taaatgggtgctaga

SEQ ID NO: 193423 - DNA, 15 bp, Homo sapiens
ctaaatgggtgctag

SEQ ID NO: 193424 - DNA, 15 bp, Homo sapiens
actaaatgggtgcta

SEQ ID NO: 193425 - DNA, 15 bp, Homo sapiens
aactaaatgggtgct

SEQ ID NO: 193426 - DNA, 15 bp, Homo sapiens
caactaaatgggtgc

SEQ ID NO: 193427 - DNA, 15 bp, Homo sapiens
acaactaaatgggtg

SEQ ID NO: 193428 - DNA, 15 bp, Homo sapiens
aacaactaaatgggt

SEQ ID NO: 193429 - DNA, 15 bp, Homo sapiens
caacaactaaatggg

SEQ ID NO: 193430 - DNA, 15 bp, Homo sapiens
tcaacaactaaatgg

SEQ ID NO: 193431 - DNA, 15 bp, Homo sapiens
ttcaacaactaaatg

SEQ ID NO: 193432 - DNA, 15 bp, Homo sapiens
cttcaacaactaaat

SEQ ID NO: 193433 - DNA, 15 bp, Homo sapiens
tcttcaacaactaaa

SEQ ID NO: 193434 - DNA, 15 bp, Homo sapiens
gtcttcaacaactaa

SEQ ID NO: 193435 - DNA, 15 bp, Homo sapiens
agtcttcaacaacta

SEQ ID NO: 193436 - DNA, 15 bp, Homo sapiens
aagtcttcaacaact

SEQ ID NO: 193437 - DNA, 15 bp, Homo sapiens
gaagtcttcaacaac

SEQ ID NO: 193438 - DNA, 15 bp, Homo sapiens
ggaagtcttcaacaa

SEQ ID NO: 193439 - DNA, 15 bp, Homo sapiens
aggaagtcttcaaca

SEQ ID NO: 193440 - DNA, 15 bp, Homo sapiens
caggaagtcttcaac

SEQ ID NO: 193441 - DNA, 15 bp, Homo sapiens
ccaggaagtcttcaa

SEQ ID NO: 193442 - DNA, 15 bp, Homo sapiens
accaggaagtcttca

SEQ ID NO: 193443 - DNA, 15 bp, Homo sapiens
caccaggaagtcttc

SEQ ID NO: 193444 - DNA, 15 bp, Homo sapiens
ccaccaggaagtctt

SEQ ID NO: 193445 - DNA, 15 bp, Homo sapiens
accaccaggaagtct

SEQ ID NO: 193446 - DNA, 15 bp, Homo sapiens
taccaccaggaagtc

SEQ ID NO: 193447 - DNA, 15 bp, Homo sapiens
gtaccaccaggaagt

SEQ ID NO: 193448 - DNA, 15 bp, Homo sapiens
agtaccaccaggaag

SEQ ID NO: 193449 - DNA, 15 bp, Homo sapiens
cagtaccaccaggaa

SEQ ID NO: 193450 - DNA, 15 bp, Homo sapiens
acagtaccaccagga

SEQ ID NO: 193451 - DNA, 15 bp, Homo sapiens
aacagtaccaccagg

SEQ ID NO: 193452 - DNA, 15 bp, Homo sapiens
gaacagtaccaccag

SEQ ID NO: 193453 - DNA, 15 bp, Homo sapiens
agaacagtaccacca

SEQ ID NO: 193454 - DNA, 15 bp, Homo sapiens
tagaacagtaccacc

SEQ ID NO: 193455 - DNA, 15 bp, Homo sapiens
ttagaacagtaccac

SEQ ID NO: 193456 - DNA, 15 bp, Homo sapiens
tttagaacagtacca

SEQ ID NO: 193457 - DNA, 15 bp, Homo sapiens
atttagaacagtacc

SEQ ID NO: 193458 - DNA, 15 bp, Homo sapiens
gatttagaacagtac

SEQ ID NO: 193459 - DNA, 15 bp, Homo sapiens
agatttagaacagta

SEQ ID NO: 193460 - DNA, 15 bp, Homo sapiens
gagatttagaacagt

SEQ ID NO: 193461 - DNA, 15 bp, Homo sapiens
agagatttagaacag

SEQ ID NO: 193462 - DNA, 15 bp, Homo sapiens
cagagatttagaaca

SEQ ID NO: 193463 - DNA, 15 bp, Homo sapiens
acagagatttagaac

SEQ ID NO: 193464 - DNA, 15 bp, Homo sapiens
aacagagatttagaa

SEQ ID NO: 193465 - DNA, 15 bp, Homo sapiens
aaacagagatttaga

SEQ ID NO: 193466 - DNA, 15 bp, Homo sapiens
gaaacagagatttag

SEQ ID NO: 193467 - DNA, 15 bp, Homo sapiens
ggaaacagagattta

SEQ ID NO: 193468 - DNA, 15 bp, Homo sapiens
aggaaacagagattt

SEQ ID NO: 193469 - DNA, 15 bp, Homo sapiens
caggaaacagagatt

SEQ ID NO: 193470 - DNA, 15 bp, Homo sapiens
acaggaaacagagat

SEQ ID NO: 193471 - DNA, 15 bp, Homo sapiens
gacaggaaacagaga

SEQ ID NO: 193472 - DNA, 15 bp, Homo sapiens
tgacaggaaacagag

SEQ ID NO: 193473 - DNA, 15 bp, Homo sapiens
ctgacaggaaacaga

SEQ ID NO: 193474 - DNA, 15 bp, Homo sapiens
tctgacaggaaacag

SEQ ID NO: 193475 - DNA, 15 bp, Homo sapiens
ctctgacaggaaaca

SEQ ID NO: 193476 - DNA, 15 bp, Homo sapiens
tctctgacaggaaac

SEQ ID NO: 193477 - DNA, 15 bp, Homo sapiens
atctctgacaggaaa

SEQ ID NO: 193478 - DNA, 15 bp, Homo sapiens
aatctctgacaggaa

SEQ ID NO: 193479 - DNA, 15 bp, Homo sapiens
aaatctctgacagga

SEQ ID NO: 193480 - DNA, 15 bp, Homo sapiens
gaaatctctgacagg

SEQ ID NO: 193481 - DNA, 15 bp, Homo sapiens
tgaaatctctgacag

SEQ ID NO: 193482 - DNA, 15 bp, Homo sapiens
ctgaaatctctgaca

SEQ ID NO: 193483 - DNA, 15 bp, Homo sapiens
tctgaaatctctgac

SEQ ID NO: 193484 - DNA, 15 bp, Homo sapiens
gtctgaaatctctga

SEQ ID NO: 193485 - DNA, 15 bp, Homo sapiens
tgtctgaaatctctg

SEQ ID NO: 193486 - DNA, 15 bp, Homo sapiens
ctgtctgaaatctct

SEQ ID NO: 193487 - DNA, 15 bp, Homo sapiens
actgtctgaaatctc

SEQ ID NO: 193488 - DNA, 15 bp, Homo sapiens
aactgtctgaaatct

SEQ ID NO: 193489 - DNA, 15 bp, Homo sapiens
gaactgtctgaaatc

SEQ ID NO: 193490 - DNA, 15 bp, Homo sapiens
agaactgtctgaaat

SEQ ID NO: 193491 - DNA, 15 bp, Homo sapiens
cagaactgtctgaaa

SEQ ID NO: 193492 - DNA, 15 bp, Homo sapiens
acagaactgtctgaa

SEQ ID NO: 193493 - DNA, 15 bp, Homo sapiens
aacagaactgtctga

SEQ ID NO: 193494 - DNA, 15 bp, Homo sapiens
aaacagaactgtctg

SEQ ID NO: 193495 - DNA, 15 bp, Homo sapiens
taaacagaactgtct

SEQ ID NO: 193496 - DNA, 15 bp, Homo sapiens
ataaacagaactgtc

SEQ ID NO: 193497 - DNA, 15 bp, Homo sapiens
aataaacagaactgt

SEQ ID NO: 193498 - DNA, 15 bp, Homo sapiens
taataaacagaactg

SEQ ID NO: 193499 - DNA, 15 bp, Homo sapiens
ataataaacagaact

SEQ ID NO: 193500 - DNA, 15 bp, Homo sapiens
tataataaacagaac

SEQ ID NO: 193501 - DNA, 15 bp, Homo sapiens
ttataataaacagaa

SEQ ID NO: 193502 - DNA, 15 bp, Homo sapiens
attataataaacaga

SEQ ID NO: 193503 - DNA, 15 bp, Homo sapiens
cattataataaacag

SEQ ID NO: 193504 - DNA, 15 bp, Homo sapiens
acattataataaaca

SEQ ID NO: 193505 - DNA, 15 bp, Homo sapiens
cacattataataaac

SEQ ID NO: 193506 - DNA, 15 bp, Homo sapiens
tcacattataataaa

SEQ ID NO: 193507 - DNA, 15 bp, Homo sapiens
ctcacattataataa

SEQ ID NO: 193508 - DNA, 15 bp, Homo sapiens
cctcacattataata

SEQ ID NO: 193509 - DNA, 15 bp, Homo sapiens
tcctcacattataat

SEQ ID NO: 193510 - DNA, 15 bp, Homo sapiens
ttcctcacattataa

SEQ ID NO: 193511 - DNA, 15 bp, Homo sapiens
tttcctcacattata

SEQ ID NO: 193512 - DNA, 15 bp, Homo sapiens
atttcctcacattat

SEQ ID NO: 193513 - DNA, 15 bp, Homo sapiens
tatttcctcacatta

SEQ ID NO: 193514 - DNA, 15 bp, Homo sapiens
atatttcctcacatt

SEQ ID NO: 193515 - DNA, 15 bp, Homo sapiens
aatatttcctcacat

SEQ ID NO: 193516 - DNA, 15 bp, Homo sapiens
aaatatttcctcaca

SEQ ID NO: 193517 - DNA, 15 bp, Homo sapiens
aaaaatatttcctca

SEQ ID NO: 193518 - DNA, 15 bp, Homo sapiens
caaaaatatttcctc

SEQ ID NO: 193519 - DNA, 15 bp, Homo sapiens
gcaaaaatatttcct

SEQ ID NO: 193520 - DNA, 15 bp, Homo sapiens
agcaaaaatatttcc

SEQ ID NO: 193521 - DNA, 15 bp, Homo sapiens
aagcaaaaatatttc

SEQ ID NO: 193522 - DNA, 15 bp, Homo sapiens
taagcaaaaatattt

SEQ ID NO: 193523 - DNA, 15 bp, Homo sapiens
gtaagcaaaaatatt

SEQ ID NO: 193524 - DNA, 15 bp, Homo sapiens
tgtaagcaaaaatat

SEQ ID NO: 193525 - DNA, 15 bp, Homo sapiens
atgtaagcaaaaata

SEQ ID NO: 193526 - DNA, 15 bp, Homo sapiens
tatgtaagcaaaaat

SEQ ID NO: 193527 - DNA, 15 bp, Homo sapiens
atatgtaagcaaaaa

SEQ ID NO: 193528 - DNA, 15 bp, Homo sapiens
aatatgtaagcaaaa

SEQ ID NO: 193529 - DNA, 15 bp, Homo sapiens
aaatatgtaagcaaa

SEQ ID NO: 193530 - DNA, 15 bp, Homo sapiens
taaatatgtaagcaa

SEQ ID NO: 193531 - DNA, 15 bp, Homo sapiens
ttaaatatgtaagca

SEQ ID NO: 193532 - DNA, 15 bp, Homo sapiens
cttaaatatgtaagc

SEQ ID NO: 193533 - DNA, 15 bp, Homo sapiens
gcttaaatatgtaag

SEQ ID NO: 193534 - DNA, 15 bp, Homo sapiens
tgcttaaatatgtaa

SEQ ID NO: 193535 - DNA, 15 bp, Homo sapiens
ttgcttaaatatgta

SEQ ID NO: 193536 - DNA, 15 bp, Homo sapiens
tttgcttaaatatgt

SEQ ID NO: 193537 - DNA, 15 bp, Homo sapiens
ttttgcttaaatatg

SEQ ID NO: 193538 - DNA, 15 bp, Homo sapiens
attttgcttaaatat

SEQ ID NO: 193539 - DNA, 15 bp, Homo sapiens
tattttgcttaaata

SEQ ID NO: 193540 - DNA, 15 bp, Homo sapiens
atattttgcttaaat

SEQ ID NO: 193541 - DNA, 15 bp, Homo sapiens
catattttgcttaaa

SEQ ID NO: 193542 - DNA, 15 bp, Homo sapiens
acatattttgcttaa

SEQ ID NO: 193543 - DNA, 15 bp, Homo sapiens
aacatattttgctta

SEQ ID NO: 193544 - DNA, 15 bp, Homo sapiens
aaacatattttgctt

SEQ ID NO: 193545 - DNA, 15 bp, Homo sapiens
aaaacatattttgct

SEQ ID NO: 193546 - DNA, 15 bp, Homo sapiens
taaaacatattttgc

SEQ ID NO: 193547 - DNA, 15 bp, Homo sapiens
ataaaacatattttg

SEQ ID NO: 193548 - DNA, 15 bp, Homo sapiens
aataaaacatatttt

SEQ ID NO: 193549 - DNA, 15 bp, Homo sapiens
aaaataaaacatatt

SEQ ID NO: 193550 - DNA, 15 bp, Homo sapiens
gaaaataaaacatat

SEQ ID NO: 193551 - DNA, 15 bp, Homo sapiens
tgaaaataaaacata

SEQ ID NO: 193552 - DNA, 15 bp, Homo sapiens
atgaaaataaaacat

SEQ ID NO: 193553 - DNA, 15 bp, Homo sapiens
catgaaaataaaaca

SEQ ID NO: 193554 - DNA, 15 bp, Homo sapiens
tcatgaaaataaaac

SEQ ID NO: 193555 - DNA, 15 bp, Homo sapiens
atcatgaaaataaaa

SEQ ID NO: 193556 - DNA, 15 bp, Homo sapiens
catcatgaaaataaa

SEQ ID NO: 193557 - DNA, 15 bp, Homo sapiens
acatcatgaaaataa

SEQ ID NO: 193558 - DNA, 15 bp, Homo sapiens
aacatcatgaaaata

SEQ ID NO: 193559 - DNA, 15 bp, Homo sapiens
aaacatcatgaaaat

SEQ ID NO: 193560 - DNA, 15 bp, Homo sapiens
aaaacatcatgaaaa

SEQ ID NO: 193561 - DNA, 15 bp, Homo sapiens
taaaacatcatgaaa

SEQ ID NO: 193562 - DNA, 15 bp, Homo sapiens
ataaaacatcatgaa

SEQ ID NO: 193563 - DNA, 15 bp, Homo sapiens
aataaaacatcatga

SEQ ID NO: 193564 - DNA, 15 bp, Homo sapiens
caataaaacatcatg

SEQ ID NO: 193565 - DNA, 15 bp, Homo sapiens
tcaataaaacatcat

SEQ ID NO: 193566 - DNA, 15 bp, Homo sapiens
atcaataaaacatca

SEQ ID NO: 193567 - DNA, 15 bp, Homo sapiens
aatcaataaaacatc

SEQ ID NO: 193568 - DNA, 15 bp, Homo sapiens
aaatcaataaaacat

SEQ ID NO: 193569 - DNA, 15 bp, Homo sapiens
caaatcaataaaaca

SEQ ID NO: 193570 - DNA, 15 bp, Homo sapiens
acaaatcaataaaac

SEQ ID NO: 193571 - DNA, 15 bp, Homo sapiens
aacaaatcaataaaa

SEQ ID NO: 193572 - DNA, 15 bp, Homo sapiens
aaacaaatcaataaa

SEQ ID NO: 193573 - DNA, 15 bp, Homo sapiens
aaaacaaatcaataa

SEQ ID NO: 193574 - DNA, 15 bp, Homo sapiens
taaaacaaatcaata

SEQ ID NO: 193575 - DNA, 15 bp, Homo sapiens
ataaaacaaatcaat

SEQ ID NO: 193576 - DNA, 15 bp, Homo sapiens
tataaaacaaatcaa

SEQ ID NO: 193577 - DNA, 15 bp, Homo sapiens
ttataaaacaaatca

SEQ ID NO: 193578 - DNA, 15 bp, Homo sapiens
attataaaacaaatc

SEQ ID NO: 193579 - DNA, 15 bp, Homo sapiens
cattataaaacaaat

SEQ ID NO: 193580 - DNA, 15 bp, Homo sapiens
acattataaaacaaa

SEQ ID NO: 193581 - DNA, 15 bp, Homo sapiens
tacattataaaacaa

SEQ ID NO: 193582 - DNA, 15 bp, Homo sapiens
atacattataaaaca

SEQ ID NO: 193583 - DNA, 15 bp, Homo sapiens
tatacattataaaac

SEQ ID NO: 193584 - DNA, 15 bp, Homo sapiens
atatacattataaaa

SEQ ID NO: 193585 - DNA, 15 bp, Homo sapiens
gatatacattataaa

SEQ ID NO: 193586 - DNA, 15 bp, Homo sapiens
tgatatacattataa

SEQ ID NO: 193587 - DNA, 15 bp, Homo sapiens
gtgatatacattata

SEQ ID NO: 193588 - DNA, 15 bp, Homo sapiens
tgtgatatacattat

SEQ ID NO: 193589 - DNA, 15 bp, Homo sapiens
atgtgatatacatta

SEQ ID NO: 193590 - DNA, 15 bp, Homo sapiens
tatgtgatatacatt

SEQ ID NO: 193591 - DNA, 15 bp, Homo sapiens
ttatgtgatatacat

SEQ ID NO: 193592 - DNA, 15 bp, Homo sapiens
attatgtgatataca

SEQ ID NO: 193593 - DNA, 15 bp, Homo sapiens
aattatgtgatatac

SEQ ID NO: 193594 - DNA, 15 bp, Homo sapiens
aaattatgtgatata

SEQ ID NO: 193595 - DNA, 15 bp, Homo sapiens
caaattatgtgatat

SEQ ID NO: 193596 - DNA, 15 bp, Homo sapiens
acaaattatgtgata

SEQ ID NO: 193597 - DNA, 15 bp, Homo sapiens
aacaaattatgtgat

SEQ ID NO: 193598 - DNA, 15 bp, Homo sapiens
aaacaaattatgtga

SEQ ID NO: 193599 - DNA, 15 bp, Homo sapiens
taaacaaattatgtg

SEQ ID NO: 193600 - DNA, 15 bp, Homo sapiens
ataaacaaattatgt

SEQ ID NO: 193601 - DNA, 15 bp, Homo sapiens
tataaacaaattatg

SEQ ID NO: 193602 - DNA, 15 bp, Homo sapiens
ttataaacaaattat

SEQ ID NO: 193603 - DNA, 15 bp, Homo sapiens
attataaacaaatta

SEQ ID NO: 193604 - DNA, 15 bp, Homo sapiens
cattataaacaaatt

SEQ ID NO: 193605 - DNA, 15 bp, Homo sapiens
acattataaacaaat

SEQ ID NO: 193606 - DNA, 15 bp, Homo sapiens
aacattataaacaaa

SEQ ID NO: 193607 - DNA, 15 bp, Homo sapiens
aaacattataaacaa

SEQ ID NO: 193608 - DNA, 15 bp, Homo sapiens
aaaacattataaaca

SEQ ID NO: 193609 - DNA, 15 bp, Homo sapiens
taaaacattataaac

SEQ ID NO: 193610 - DNA, 15 bp, Homo sapiens
ataaaacattataaa

SEQ ID NO: 193611 - DNA, 15 bp, Homo sapiens
tataaaacattataa

SEQ ID NO: 193612 - DNA, 15 bp, Homo sapiens
ttataaaacattata

SEQ ID NO: 193613 - DNA, 15 bp, Homo sapiens
attataaaacattat

SEQ ID NO: 193614 - DNA, 15 bp, Homo sapiens
gattataaaacatta

SEQ ID NO: 193615 - DNA, 15 bp, Homo sapiens
tgattataaaacatt

SEQ ID NO: 193616 - DNA, 15 bp, Homo sapiens
ttgattataaaacat

SEQ ID NO: 193617 - DNA, 15 bp, Homo sapiens
cttgattataaaaca

SEQ ID NO: 193618 - DNA, 15 bp, Homo sapiens
gcttgattataaaac

SEQ ID NO: 193619 - DNA, 15 bp, Homo sapiens
agcttgattataaaa

SEQ ID NO: 193620 - DNA, 15 bp, Homo sapiens
tagcttgattataaa

SEQ ID NO: 193621 - DNA, 15 bp, Homo sapiens
gtagcttgattataa

SEQ ID NO: 193622 - DNA, 15 bp, Homo sapiens
agtagcttgattata

SEQ ID NO: 193623 - DNA, 15 bp, Homo sapiens
tagtagcttgattat

SEQ ID NO: 193624 - DNA, 15 bp, Homo sapiens
gtagtagcttgatta

SEQ ID NO: 193625 - DNA, 15 bp, Homo sapiens
agtagtagcttgatt

SEQ ID NO: 193626 - DNA, 15 bp, Homo sapiens
aagtagtagcttgat

SEQ ID NO: 193627 - DNA, 15 bp, Homo sapiens
caagtagtagcttga

SEQ ID NO: 193628 - DNA, 15 bp, Homo sapiens
acaagtagtagcttg

SEQ ID NO: 193629 - DNA, 15 bp, Homo sapiens
tacaagtagtagctt

SEQ ID NO: 193630 - DNA, 15 bp, Homo sapiens
ctacaagtagtagct

SEQ ID NO: 193631 - DNA, 15 bp, Homo sapiens
gctacaagtagtagc

SEQ ID NO: 193632 - DNA, 15 bp, Homo sapiens
agctacaagtagtag

SEQ ID NO: 193633 - DNA, 15 bp, Homo sapiens
aagctacaagtagta

SEQ ID NO: 193634 - DNA, 15 bp, Homo sapiens
aaagctacaagtagt

SEQ ID NO: 193635 - DNA, 15 bp, Homo sapiens
taaagctacaagtag

SEQ ID NO: 193636 - DNA, 15 bp, Homo sapiens
ataaagctacaagta

SEQ ID NO: 193637 - DNA, 15 bp, Homo sapiens
tataaagctacaagt

SEQ ID NO: 193638 - DNA, 15 bp, Homo sapiens
ttataaagctacaag

SEQ ID NO: 193639 - DNA, 15 bp, Homo sapiens
attataaagctacaa

SEQ ID NO: 193640 - DNA, 15 bp, Homo sapiens
gattataaagctaca

SEQ ID NO: 193641 - DNA, 15 bp, Homo sapiens
tgattataaagctac

SEQ ID NO: 193642 - DNA, 15 bp, Homo sapiens
ttgattataaagcta

SEQ ID NO: 193643 - DNA, 15 bp, Homo sapiens
cttgattataaagct

SEQ ID NO: 193644 - DNA, 15 bp, Homo sapiens
acttgattataaagc

SEQ ID NO: 193645 - DNA, 15 bp, Homo sapiens
tacttgattataaag

SEQ ID NO: 193646 - DNA, 15 bp, Homo sapiens
ctacttgattataaa

SEQ ID NO: 193647 - DNA, 15 bp, Homo sapiens
actacttgattataa

SEQ ID NO: 193648 - DNA, 15 bp, Homo sapiens
tactacttgattata

SEQ ID NO: 193649 - DNA, 15 bp, Homo sapiens
ctactacttgattat

SEQ ID NO: 193650 - DNA, 15 bp, Homo sapiens
gctactacttgatta

SEQ ID NO: 193651 - DNA, 15 bp, Homo sapiens
agctactacttgatt

SEQ ID NO: 193652 - DNA, 15 bp, Homo sapiens
aagctactacttgat

SEQ ID NO: 193653 - DNA, 15 bp, Homo sapiens
caagctactacttga

SEQ ID NO: 193654 - DNA, 15 bp, Homo sapiens
tcaagctactacttg

SEQ ID NO: 193655 - DNA, 15 bp, Homo sapiens
gtcaagctactactt

SEQ ID NO: 193656 - DNA, 15 bp, Homo sapiens
agtcaagctactact

SEQ ID NO: 193657 - DNA, 15 bp, Homo sapiens
cagtcaagctactac

SEQ ID NO: 193658 - DNA, 15 bp, Homo sapiens
acagtcaagctacta

SEQ ID NO: 193659 - DNA, 15 bp, Homo sapiens
cacagtcaagctact

SEQ ID NO: 193660 - DNA, 15 bp, Homo sapiens
tcacagtcaagctac

SEQ ID NO: 193661 - DNA, 15 bp, Homo sapiens
ttcacagtcaagcta

SEQ ID NO: 193662 - DNA, 15 bp, Homo sapiens
tttcacagtcaagct

SEQ ID NO: 193663 - DNA, 15 bp, Homo sapiens
gtttcacagtcaagc

SEQ ID NO: 193664 - DNA, 15 bp, Homo sapiens
tgtttcacagtcaag

SEQ ID NO: 193665 - DNA, 15 bp, Homo sapiens
atgtttcacagtcaa

SEQ ID NO: 193666 - DNA, 15 bp, Homo sapiens
aatgtttcacagtca

SEQ ID NO: 193667 - DNA, 15 bp, Homo sapiens
taatgtttcacagtc

SEQ ID NO: 193668 - DNA, 15 bp, Homo sapiens
ataatgtttcacagt

SEQ ID NO: 193669 - DNA, 15 bp, Homo sapiens
tataatgtttcacag

SEQ ID NO: 193670 - DNA, 15 bp, Homo sapiens
ttataatgtttcaca

SEQ ID NO: 193671 - DNA, 15 bp, Homo sapiens
tttataatgtttcac

SEQ ID NO: 193672 - DNA, 15 bp, Homo sapiens
gtttataatgtttca

SEQ ID NO: 193673 - DNA, 15 bp, Homo sapiens
tgtttataatgtttc

SEQ ID NO: 193674 - DNA, 15 bp, Homo sapiens
ttgtttataatgttt

SEQ ID NO: 193675 - DNA, 15 bp, Homo sapiens
cttgtttataatgtt

SEQ ID NO: 193676 - DNA, 15 bp, Homo sapiens
acttgtttataatgt

SEQ ID NO: 193677 - DNA, 15 bp, Homo sapiens
aacttgtttataatg

SEQ ID NO: 193678 - DNA, 15 bp, Homo sapiens
taacttgtttataat

SEQ ID NO: 193679 - DNA, 15 bp, Homo sapiens
ataacttgtttataa

SEQ ID NO: 193680 - DNA, 15 bp, Homo sapiens
aataacttgtttata

SEQ ID NO: 193681 - DNA, 15 bp, Homo sapiens
aaataacttgtttat

SEQ ID NO: 193682 - DNA, 15 bp, Homo sapiens
caaataacttgttta

SEQ ID NO: 193683 - DNA, 15 bp, Homo sapiens
tcaaataacttgttt

SEQ ID NO: 193684 - DNA, 15 bp, Homo sapiens
atcaaataacttgtt

SEQ ID NO: 193685 - DNA, 15 bp, Homo sapiens
tatcaaataacttgt

SEQ ID NO: 193686 - DNA, 15 bp, Homo sapiens
atatcaaataacttg

SEQ ID NO: 193687 - DNA, 15 bp, Homo sapiens
tatatcaaataactt

SEQ ID NO: 193688 - DNA, 15 bp, Homo sapiens
gtatatcaaataact

SEQ ID NO: 193689 - DNA, 15 bp, Homo sapiens
tgtatatcaaataac

SEQ ID NO: 193690 - DNA, 15 bp, Homo sapiens
atgtatatcaaataa

SEQ ID NO: 193691 - DNA, 15 bp, Homo sapiens
aatgtatatcaaata

SEQ ID NO: 193692 - DNA, 15 bp, Homo sapiens
taatgtatatcaaat

SEQ ID NO: 193693 - DNA, 15 bp, Homo sapiens
ataatgtatatcaaa

SEQ ID NO: 193694 - DNA, 15 bp, Homo sapiens
tataatgtatatcaa

SEQ ID NO: 193695 - DNA, 15 bp, Homo sapiens
ttataatgtatatca

SEQ ID NO: 193696 - DNA, 15 bp, Homo sapiens
tttataatgtatatc

SEQ ID NO: 193697 - DNA, 15 bp, Homo sapiens
ctttataatgtatat

SEQ ID NO: 193698 - DNA, 15 bp, Homo sapiens
actttataatgtata

SEQ ID NO: 193699 - DNA, 15 bp, Homo sapiens
cactttataatgtat

SEQ ID NO: 193700 - DNA, 15 bp, Homo sapiens
acactttataatgta

SEQ ID NO: 193701 - DNA, 15 bp, Homo sapiens
aacactttataatgt

SEQ ID NO: 193702 - DNA, 15 bp, Homo sapiens
aaacactttataatg

SEQ ID NO: 193703 - DNA, 15 bp, Homo sapiens
taaacactttataat

SEQ ID NO: 193704 - DNA, 15 bp, Homo sapiens
gtaaacactttataa

SEQ ID NO: 193705 - DNA, 15 bp, Homo sapiens
tgtaaacactttata

SEQ ID NO: 193706 - DNA, 15 bp, Homo sapiens
ctgtaaacactttat

SEQ ID NO: 193707 - DNA, 15 bp, Homo sapiens
actgtaaacacttta

SEQ ID NO: 193708 - DNA, 15 bp, Homo sapiens
aactgtaaacacttt

SEQ ID NO: 193709 - DNA, 15 bp, Homo sapiens
taactgtaaacactt

SEQ ID NO: 193710 - DNA, 15 bp, Homo sapiens
ataactgtaaacact

SEQ ID NO: 193711 - DNA, 15 bp, Homo sapiens
tataactgtaaacac

SEQ ID NO: 193712 - DNA, 15 bp, Homo sapiens
atataactgtaaaca

SEQ ID NO: 193713 - DNA, 15 bp, Homo sapiens
gatataactgtaaac

SEQ ID NO: 193714 - DNA, 15 bp, Homo sapiens
agatataactgtaaa

SEQ ID NO: 193715 - DNA, 15 bp, Homo sapiens
gagatataactgtaa

SEQ ID NO: 193716 - DNA, 15 bp, Homo sapiens
agagatataactgta

SEQ ID NO: 193717 - DNA, 15 bp, Homo sapiens
tagagatataactgt

SEQ ID NO: 193718 - DNA, 15 bp, Homo sapiens
atagagatataactg

SEQ ID NO: 193719 - DNA, 15 bp, Homo sapiens
catagagatataact

SEQ ID NO: 193720 - DNA, 15 bp, Homo sapiens
ccatagagatataac

SEQ ID NO: 193721 - DNA, 15 bp, Homo sapiens
cccatagagatataa

SEQ ID NO: 193722 - DNA, 15 bp, Homo sapiens
acccatagagatata

SEQ ID NO: 193723 - DNA, 15 bp, Homo sapiens
aacccatagagatat

SEQ ID NO: 193724 - DNA, 15 bp, Homo sapiens
taacccatagagata

SEQ ID NO: 193725 - DNA, 15 bp, Homo sapiens
ataacccatagagat

SEQ ID NO: 193726 - DNA, 15 bp, Homo sapiens
tataacccatagaga

SEQ ID NO: 193727 - DNA, 15 bp, Homo sapiens
atataacccatagag

SEQ ID NO: 193728 - DNA, 15 bp, Homo sapiens
gatataacccataga

SEQ ID NO: 193729 - DNA, 15 bp, Homo sapiens
tgatataacccatag

SEQ ID NO: 193730 - DNA, 15 bp, Homo sapiens
atgatataacccata

SEQ ID NO: 193731 - DNA, 15 bp, Homo sapiens
aatgatataacccat

SEQ ID NO: 193732 - DNA, 15 bp, Homo sapiens
taatgatataaccca

SEQ ID NO: 193733 - DNA, 15 bp, Homo sapiens
ctaatgatataaccc

SEQ ID NO: 193734 - DNA, 15 bp, Homo sapiens
tctaatgatataacc

SEQ ID NO: 193735 - DNA, 15 bp, Homo sapiens
ctctaatgatataac

SEQ ID NO: 193736 - DNA, 15 bp, Homo sapiens
tctctaatgatataa

SEQ ID NO: 193737 - DNA, 15 bp, Homo sapiens
ttctctaatgatata

SEQ ID NO: 193738 - DNA, 15 bp, Homo sapiens
tttctctaatgatat

SEQ ID NO: 193739 - DNA, 15 bp, Homo sapiens
atttctctaatgata

SEQ ID NO: 193740 - DNA, 15 bp, Homo sapiens
catttctctaatgat

SEQ ID NO: 193741 - DNA, 15 bp, Homo sapiens
gcatttctctaatga

SEQ ID NO: 193742 - DNA, 15 bp, Homo sapiens
ggcatttctctaatg

SEQ ID NO: 193743 - DNA, 15 bp, Homo sapiens
gggcatttctctaat

SEQ ID NO: 193744 - DNA, 15 bp, Homo sapiens
tgggcatttctctaa

SEQ ID NO: 193745 - DNA, 15 bp, Homo sapiens
ctgggcatttctcta

SEQ ID NO: 193746 - DNA, 15 bp, Homo sapiens
actgggcatttctct

SEQ ID NO: 193747 - DNA, 15 bp, Homo sapiens
aactgggcatttctc

SEQ ID NO: 193748 - DNA, 15 bp, Homo sapiens
taactgggcatttct

SEQ ID NO: 193749 - DNA, 15 bp, Homo sapiens
ttaactgggcatttc

SEQ ID NO: 193750 - DNA, 15 bp, Homo sapiens
cttaactgggcattt

SEQ ID NO: 193751 - DNA, 15 bp, Homo sapiens
ccttaactgggcatt

SEQ ID NO: 193752 - DNA, 15 bp, Homo sapiens
cccttaactgggcat

SEQ ID NO: 193753 - DNA, 15 bp, Homo sapiens
gcccttaactgggca

SEQ ID NO: 193754 - DNA, 15 bp, Homo sapiens
tgcccttaactgggc

SEQ ID NO: 193755 - DNA, 15 bp, Homo sapiens
ttgcccttaactggg

SEQ ID NO: 193756 - DNA, 15 bp, Homo sapiens
tttgcccttaactgg

SEQ ID NO: 193757 - DNA, 15 bp, Homo sapiens
ttttgcccttaactg

SEQ ID NO: 193758 - DNA, 15 bp, Homo sapiens
gttttgcccttaact

SEQ ID NO: 193759 - DNA, 15 bp, Homo sapiens
agttttgcccttaac

SEQ ID NO: 193760 - DNA, 15 bp, Homo sapiens
aagttttgcccttaa

SEQ ID NO: 193761 - DNA, 15 bp, Homo sapiens
caagttttgccctta

SEQ ID NO: 193762 - DNA, 15 bp, Homo sapiens
acaagttttgccctt

SEQ ID NO: 193763 - DNA, 15 bp, Homo sapiens
tacaagttttgccct

SEQ ID NO: 193764 - DNA, 15 bp, Homo sapiens
ctacaagttttgccc

SEQ ID NO: 193765 - DNA, 15 bp, Homo sapiens
actacaagttttgcc

SEQ ID NO: 193766 - DNA, 15 bp, Homo sapiens
gactacaagttttgc

SEQ ID NO: 193767 - DNA, 15 bp, Homo sapiens
tgactacaagttttg

SEQ ID NO: 193768 - DNA, 15 bp, Homo sapiens
ttgactacaagtttt

SEQ ID NO: 193769 - DNA, 15 bp, Homo sapiens
tttgactacaagttt

SEQ ID NO: 193770 - DNA, 15 bp, Homo sapiens
atttgactacaagtt

SEQ ID NO: 193771 - DNA, 15 bp, Homo sapiens
tatttgactacaagt

SEQ ID NO: 193772 - DNA, 15 bp, Homo sapiens
gtatttgactacaag

SEQ ID NO: 193773 - DNA, 15 bp, Homo sapiens
agtatttgactacaa

SEQ ID NO: 193774 - DNA, 15 bp, Homo sapiens
tagtatttgactaca

SEQ ID NO: 193775 - DNA, 15 bp, Homo sapiens
ttagtatttgactac

SEQ ID NO: 193776 - DNA, 15 bp, Homo sapiens
attagtatttgacta

SEQ ID NO: 193777 - DNA, 15 bp, Homo sapiens
aattagtatttgact

SEQ ID NO: 193778 - DNA, 15 bp, Homo sapiens
taattagtatttgac

SEQ ID NO: 193779 - DNA, 15 bp, Homo sapiens
ataattagtatttga

SEQ ID NO: 193780 - DNA, 15 bp, Homo sapiens
ttaataattagtatt

SEQ ID NO: 193781 - DNA, 15 bp, Homo sapiens
tttaataattagtat

SEQ ID NO: 193782 - DNA, 15 bp, Homo sapiens
atttaataattagta

SEQ ID NO: 193783 - DNA, 15 bp, Homo sapiens
tatttaataattagt

SEQ ID NO: 193784 - DNA, 15 bp, Homo sapiens
ttatttaataattag

SEQ ID NO: 193785 - DNA, 15 bp, Homo sapiens
cttatttaataatta

SEQ ID NO: 193786 - DNA, 15 bp, Homo sapiens
acttatttaataatt

SEQ ID NO: 193787 - DNA, 15 bp, Homo sapiens
tacttatttaataat

SEQ ID NO: 193788 - DNA, 15 bp, Homo sapiens
ttacttatttaataa

SEQ ID NO: 193789 - DNA, 15 bp, Homo sapiens
tttacttatttaata

SEQ ID NO: 193790 - DNA, 15 bp, Homo sapiens
ttttacttatttaat

SEQ ID NO: 193791 - DNA, 15 bp, Homo sapiens
tttttacttatttaa

SEQ ID NO: 193792 - DNA, 15 bp, Homo sapiens
ctttttacttattta

SEQ ID NO: 193793 - DNA, 15 bp, Homo sapiens
actttttacttattt

SEQ ID NO: 193794 - DNA, 15 bp, Homo sapiens
tactttttacttatt

SEQ ID NO: 193795 - DNA, 15 bp, Homo sapiens
ttactttttacttat

SEQ ID NO: 193796 - DNA, 15 bp, Homo sapiens
tttactttttactta

SEQ ID NO: 193797 - DNA, 15 bp, Homo sapiens
atttactttttactt

SEQ ID NO: 193798 - DNA, 15 bp, Homo sapiens
tatttactttttact

SEQ ID NO: 193799 - DNA, 15 bp, Homo sapiens
ttatttactttttac

SEQ ID NO: 193800 - DNA, 15 bp, Homo sapiens
tttatttacttttta

SEQ ID NO: 193801 - DNA, 15 bp, Homo sapiens
atttatttacttttt

SEQ ID NO: 193802 - DNA, 15 bp, Homo sapiens
tatttatttactttt

SEQ ID NO: 193803 - DNA, 15 bp, Homo sapiens
ttatttatttacttt

SEQ ID NO: 193804 - DNA, 15 bp, Homo sapiens
tttatttatttactt

SEQ ID NO: 193805 - DNA, 15 bp, Homo sapiens
atttatttatttact

SEQ ID NO: 193806 - DNA, 15 bp, Homo sapiens
catttatttatttac

SEQ ID NO: 193807 - DNA, 15 bp, Homo sapiens
aacatttatttattt

SEQ ID NO: 193808 - DNA, 15 bp, Homo sapiens
aaacatttatttatt

SEQ ID NO: 193809 - DNA, 15 bp, Homo sapiens
aaaacatttatttat

SEQ ID NO: 193810 - DNA, 15 bp, Homo sapiens
gaaaacatttattta

SEQ ID NO: 193811 - DNA, 15 bp, Homo sapiens
ggaaaacatttattt

SEQ ID NO: 193812 - DNA, 15 bp, Homo sapiens
gggaaaacatttatt

SEQ ID NO: 193813 - DNA, 15 bp, Homo sapiens
cgggaaaacatttat

SEQ ID NO: 193814 - DNA, 15 bp, Homo sapiens
acgggaaaacattta

SEQ ID NO: 193815 - DNA, 15 bp, Homo sapiens
tacgggaaaacattt

SEQ ID NO: 193816 - DNA, 15 bp, Homo sapiens
atacgggaaaacatt

SEQ ID NO: 193817 - DNA, 15 bp, Homo sapiens
aatacgggaaaacat

SEQ ID NO: 193818 - DNA, 15 bp, Homo sapiens
aaatacgggaaaaca

SEQ ID NO: 193819 - DNA, 15 bp, Homo sapiens
caaatacgggaaaac

SEQ ID NO: 193820 - DNA, 15 bp, Homo sapiens
acaaatacgggaaaa

SEQ ID NO: 193821 - DNA, 15 bp, Homo sapiens
cacaaatacgggaaa

SEQ ID NO: 193822 - DNA, 15 bp, Homo sapiens
tcacaaatacgggaa

SEQ ID NO: 193823 - DNA, 15 bp, Homo sapiens
ttcacaaatacggga

SEQ ID NO: 193824 - DNA, 15 bp, Homo sapiens
cttcacaaatacggg

SEQ ID NO: 193825 - DNA, 15 bp, Homo sapiens
acttcacaaatacgg

SEQ ID NO: 193826 - DNA, 15 bp, Homo sapiens
aacttcacaaatacg

SEQ ID NO: 193827 - DNA, 15 bp, Homo sapiens
aaacttcacaaatac

SEQ ID NO: 193828 - DNA, 15 bp, Homo sapiens
taaacttcacaaata

SEQ ID NO: 193829 - DNA, 15 bp, Homo sapiens
ataaacttcacaaat

SEQ ID NO: 193830 - DNA, 15 bp, Homo sapiens
gataaacttcacaaa

SEQ ID NO: 193831 - DNA, 15 bp, Homo sapiens
agataaacttcacaa

SEQ ID NO: 193832 - DNA, 15 bp, Homo sapiens
aagataaacttcaca

SEQ ID NO: 193833 - DNA, 15 bp, Homo sapiens
caagataaacttcac

SEQ ID NO: 193834 - DNA, 15 bp, Homo sapiens
tcaagataaacttca

SEQ ID NO: 193835 - DNA, 15 bp, Homo sapiens
atcaagataaacttc

SEQ ID NO: 193836 - DNA, 15 bp, Homo sapiens
gatcaagataaactt

SEQ ID NO: 193837 - DNA, 15 bp, Homo sapiens
agatcaagataaact

SEQ ID NO: 193838 - DNA, 15 bp, Homo sapiens
cagatcaagataaac

SEQ ID NO: 193839 - DNA, 15 bp, Homo sapiens
tcagatcaagataaa

SEQ ID NO: 193840 - DNA, 15 bp, Homo sapiens
ttcagatcaagataa

SEQ ID NO: 193841 - DNA, 15 bp, Homo sapiens
attcagatcaagata

SEQ ID NO: 193842 - DNA, 15 bp, Homo sapiens
tattcagatcaagat

SEQ ID NO: 193843 - DNA, 15 bp, Homo sapiens
ctattcagatcaaga

SEQ ID NO: 193844 - DNA, 15 bp, Homo sapiens
actattcagatcaag

SEQ ID NO: 193845 - DNA, 15 bp, Homo sapiens
cactattcagatcaa

SEQ ID NO: 193846 - DNA, 15 bp, Homo sapiens
ccactattcagatca

SEQ ID NO: 193847 - DNA, 15 bp, Homo sapiens
cccactattcagatc

SEQ ID NO: 193848 - DNA, 15 bp, Homo sapiens
acccactattcagat

SEQ ID NO: 193849 - DNA, 15 bp, Homo sapiens
cacccactattcaga

SEQ ID NO: 193850 - DNA, 15 bp, Homo sapiens
acacccactattcag

SEQ ID NO: 193851 - DNA, 15 bp, Homo sapiens
aacacccactattca

SEQ ID NO: 193852 - DNA, 15 bp, Homo sapiens
caacacccactattc

SEQ ID NO: 193853 - DNA, 15 bp, Homo sapiens
acaacacccactatt

SEQ ID NO: 193854 - DNA, 15 bp, Homo sapiens
aacaacacccactat

SEQ ID NO: 193855 - DNA, 15 bp, Homo sapiens
aaacaacacccacta

SEQ ID NO: 193856 - DNA, 15 bp, Homo sapiens
taaacaacacccact

SEQ ID NO: 193857 - DNA, 15 bp, Homo sapiens
gtaaacaacacccac

SEQ ID NO: 193858 - DNA, 15 bp, Homo sapiens
tgtaaacaacaccca

SEQ ID NO: 193859 - DNA, 15 bp, Homo sapiens
ctgtaaacaacaccc

SEQ ID NO: 193860 - DNA, 15 bp, Homo sapiens
tctgtaaacaacacc

SEQ ID NO: 193861 - DNA, 15 bp, Homo sapiens
ttctgtaaacaacac

SEQ ID NO: 193862 - DNA, 15 bp, Homo sapiens
tttctgtaaacaaca

SEQ ID NO: 193863 - DNA, 15 bp, Homo sapiens
ctttctgtaaacaac

SEQ ID NO: 193864 - DNA, 15 bp, Homo sapiens
tctttctgtaaacaa

SEQ ID NO: 193865 - DNA, 15 bp, Homo sapiens
gtctttctgtaaaca

SEQ ID NO: 193866 - DNA, 15 bp, Homo sapiens
agtctttctgtaaac

SEQ ID NO: 193867 - DNA, 15 bp, Homo sapiens
tagtctttctgtaaa

SEQ ID NO: 193868 - DNA, 15 bp, Homo sapiens
ttagtctttctgtaa

SEQ ID NO: 193869 - DNA, 15 bp, Homo sapiens
gttagtctttctgta

SEQ ID NO: 193870 - DNA, 15 bp, Homo sapiens
ggttagtctttctgt

SEQ ID NO: 193871 - DNA, 15 bp, Homo sapiens
tggttagtctttctg

SEQ ID NO: 193872 - DNA, 15 bp, Homo sapiens
gtggttagtctttct

SEQ ID NO: 193873 - DNA, 15 bp, Homo sapiens
agtggttagtctttc

SEQ ID NO: 193874 - DNA, 15 bp, Homo sapiens
aagtggttagtcttt

SEQ ID NO: 193875 - DNA, 15 bp, Homo sapiens
taagtggttagtctt

SEQ ID NO: 193876 - DNA, 15 bp, Homo sapiens
ataagtggttagtct

SEQ ID NO: 193877 - DNA, 15 bp, Homo sapiens
gataagtggttagtc

SEQ ID NO: 193878 - DNA, 15 bp, Homo sapiens
tgataagtggttagt

SEQ ID NO: 193879 - DNA, 15 bp, Homo sapiens
ctgataagtggttag

SEQ ID NO: 193880 - DNA, 15 bp, Homo sapiens
actgataagtggtta

SEQ ID NO: 193881 - DNA, 15 bp, Homo sapiens
cactgataagtggtt

SEQ ID NO: 193882 - DNA, 15 bp, Homo sapiens
tcactgataagtggt

SEQ ID NO: 193883 - DNA, 15 bp, Homo sapiens
ttcactgataagtgg

SEQ ID NO: 193884 - DNA, 15 bp, Homo sapiens
gttcactgataagtg

SEQ ID NO: 193885 - DNA, 15 bp, Homo sapiens
ggttcactgataagt

SEQ ID NO: 193886 - DNA, 15 bp, Homo sapiens
aggttcactgataag

SEQ ID NO: 193887 - DNA, 15 bp, Homo sapiens
gaggttcactgataa

SEQ ID NO: 193888 - DNA, 15 bp, Homo sapiens
tgaggttcactgata

SEQ ID NO: 193889 - DNA, 15 bp, Homo sapiens
ctgaggttcactgat

SEQ ID NO: 193890 - DNA, 15 bp, Homo sapiens
actgaggttcactga

SEQ ID NO: 193891 - DNA, 15 bp, Homo sapiens
cactgaggttcactg

SEQ ID NO: 193892 - DNA, 15 bp, Homo sapiens
tcactgaggttcact

SEQ ID NO: 193893 - DNA, 15 bp, Homo sapiens
ctcactgaggttcac

SEQ ID NO: 193894 - DNA, 15 bp, Homo sapiens
gctcactgaggttca

SEQ ID NO: 193895 - DNA, 15 bp, Homo sapiens
agctcactgaggttc

SEQ ID NO: 193896 - DNA, 15 bp, Homo sapiens
aagctcactgaggtt

SEQ ID NO: 193897 - DNA, 15 bp, Homo sapiens
aaagctcactgaggt

SEQ ID NO: 193898 - DNA, 15 bp, Homo sapiens
aaaagctcactgagg

SEQ ID NO: 193899 - DNA, 15 bp, Homo sapiens
caaaagctcactgag

SEQ ID NO: 193900 - DNA, 15 bp, Homo sapiens
acaaaagctcactga

SEQ ID NO: 193901 - DNA, 15 bp, Homo sapiens
tacaaaagctcactg

SEQ ID NO: 193902 - DNA, 15 bp, Homo sapiens
ctacaaaagctcact

SEQ ID NO: 193903 - DNA, 15 bp, Homo sapiens
gctacaaaagctcac

SEQ ID NO: 193904 - DNA, 15 bp, Homo sapiens
ggctacaaaagctca

SEQ ID NO: 193905 - DNA, 15 bp, Homo sapiens
tggctacaaaagctc

SEQ ID NO: 193906 - DNA, 15 bp, Homo sapiens
atggctacaaaagct

SEQ ID NO: 193907 - DNA, 15 bp, Homo sapiens
gatggctacaaaagc

SEQ ID NO: 193908 - DNA, 15 bp, Homo sapiens
agatggctacaaaag

SEQ ID NO: 193909 - DNA, 15 bp, Homo sapiens
aagatggctacaaaa

SEQ ID NO: 193910 - DNA, 15 bp, Homo sapiens
gaagatggctacaaa

SEQ ID NO: 193911 - DNA, 15 bp, Homo sapiens
agaagatggctacaa

SEQ ID NO: 193912 - DNA, 15 bp, Homo sapiens
cagaagatggctaca

SEQ ID NO: 193913 - DNA, 15 bp, Homo sapiens
ccagaagatggctac

SEQ ID NO: 193914 - DNA, 15 bp, Homo sapiens
tccagaagatggcta

SEQ ID NO: 193915 - DNA, 15 bp, Homo sapiens
ctccagaagatggct

SEQ ID NO: 193916 - DNA, 15 bp, Homo sapiens
cctccagaagatggc

SEQ ID NO: 193917 - DNA, 15 bp, Homo sapiens
ccctccagaagatgg

SEQ ID NO: 193918 - DNA, 15 bp, Homo sapiens
gccctccagaagatg

SEQ ID NO: 193919 - DNA, 15 bp, Homo sapiens
agccctccagaagat

SEQ ID NO: 193920 - DNA, 15 bp, Homo sapiens
cagccctccagaaga

SEQ ID NO: 193921 - DNA, 15 bp, Homo sapiens
acagccctccagaag

SEQ ID NO: 193922 - DNA, 15 bp, Homo sapiens
aacagccctccagaa

SEQ ID NO: 193923 - DNA, 15 bp, Homo sapiens
gaacagccctccaga

SEQ ID NO: 193924 - DNA, 15 bp, Homo sapiens
agaacagccctccag

SEQ ID NO: 193925 - DNA, 15 bp, Homo sapiens
cagaacagccctcca

SEQ ID NO: 193926 - DNA, 15 bp, Homo sapiens
tcagaacagccctcc

SEQ ID NO: 193927 - DNA, 15 bp, Homo sapiens
ctcagaacagccctc

SEQ ID NO: 193928 - DNA, 15 bp, Homo sapiens
cctcagaacagccct

SEQ ID NO: 193929 - DNA, 15 bp, Homo sapiens
ccctcagaacagccc

SEQ ID NO: 193930 - DNA, 15 bp, Homo sapiens
accctcagaacagcc

SEQ ID NO: 193931 - DNA, 15 bp, Homo sapiens
aaccctcagaacagc

SEQ ID NO: 193932 - DNA, 15 bp, Homo sapiens
aaaccctcagaacag

SEQ ID NO: 193933 - DNA, 15 bp, Homo sapiens
caaaccctcagaaca

SEQ ID NO: 193934 - DNA, 15 bp, Homo sapiens
gcaaaccctcagaac

SEQ ID NO: 193935 - DNA, 15 bp, Homo sapiens
tgcaaaccctcagaa

SEQ ID NO: 193936 - DNA, 15 bp, Homo sapiens
atgcaaaccctcaga

SEQ ID NO: 193937 - DNA, 15 bp, Homo sapiens
gatgcaaaccctcag

SEQ ID NO: 193938 - DNA, 15 bp, Homo sapiens
agatgcaaaccctca

SEQ ID NO: 193939 - DNA, 15 bp, Homo sapiens
aagatgcaaaccctc

SEQ ID NO: 193940 - DNA, 15 bp, Homo sapiens
taagatgcaaaccct

SEQ ID NO: 193941 - DNA, 15 bp, Homo sapiens
ataagatgcaaaccc

SEQ ID NO: 193942 - DNA, 15 bp, Homo sapiens
cataagatgcaaacc

SEQ ID NO: 193943 - DNA, 15 bp, Homo sapiens
gcataagatgcaaac

SEQ ID NO: 193944 - DNA, 15 bp, Homo sapiens
agcataagatgcaaa

SEQ ID NO: 193945 - DNA, 15 bp, Homo sapiens
aagcataagatgcaa

SEQ ID NO: 193946 - DNA, 15 bp, Homo sapiens
aaagcataagatgca

SEQ ID NO: 193947 - DNA, 15 bp, Homo sapiens
aaaagcataagatgc

SEQ ID NO: 193948 - DNA, 15 bp, Homo sapiens
caaaagcataagatg

SEQ ID NO: 193949 - DNA, 15 bp, Homo sapiens
tcaaaagcataagat

SEQ ID NO: 193950 - DNA, 15 bp, Homo sapiens
atcaaaagcataaga

SEQ ID NO: 193951 - DNA, 15 bp, Homo sapiens
catcaaaagcataag

SEQ ID NO: 193952 - DNA, 15 bp, Homo sapiens
ccatcaaaagcataa

SEQ ID NO: 193953 - DNA, 15 bp, Homo sapiens
accatcaaaagcata

SEQ ID NO: 193954 - DNA, 15 bp, Homo sapiens
caccatcaaaagcat

SEQ ID NO: 193955 - DNA, 15 bp, Homo sapiens
acaccatcaaaagca

SEQ ID NO: 193956 - DNA, 15 bp, Homo sapiens
aacaccatcaaaagc

SEQ ID NO: 193957 - DNA, 15 bp, Homo sapiens
aaacaccatcaaaag

SEQ ID NO: 193958 - DNA, 15 bp, Homo sapiens
aaaacaccatcaaaa

SEQ ID NO: 193959 - DNA, 15 bp, Homo sapiens
taaaacaccatcaaa

SEQ ID NO: 193960 - DNA, 15 bp, Homo sapiens
ataaaacaccatcaa

SEQ ID NO: 193961 - DNA, 15 bp, Homo sapiens
aataaaacaccatca

SEQ ID NO: 193962 - DNA, 15 bp, Homo sapiens
aaataaaacaccatc

SEQ ID NO: 193963 - DNA, 15 bp, Homo sapiens
taaataaaacaccat

SEQ ID NO: 193964 - DNA, 15 bp, Homo sapiens
ctaaataaaacacca

SEQ ID NO: 193965 - DNA, 15 bp, Homo sapiens
tctaaataaaacacc

SEQ ID NO: 193966 - DNA, 15 bp, Homo sapiens
ctctaaataaaacac

SEQ ID NO: 193967 - DNA, 15 bp, Homo sapiens
tctctaaataaaaca

SEQ ID NO: 193968 - DNA, 15 bp, Homo sapiens
ttctctaaataaaac

SEQ ID NO: 193969 - DNA, 15 bp, Homo sapiens
tttctctaaataaaa

SEQ ID NO: 193970 - DNA, 15 bp, Homo sapiens
ttttctctaaataaa

SEQ ID NO: 193971 - DNA, 15 bp, Homo sapiens
cttttctctaaataa

SEQ ID NO: 193972 - DNA, 15 bp, Homo sapiens
acttttctctaaata

SEQ ID NO: 193973 - DNA, 15 bp, Homo sapiens
cacttttctctaaat

SEQ ID NO: 193974 - DNA, 15 bp, Homo sapiens
acacttttctctaaa

SEQ ID NO: 193975 - DNA, 15 bp, Homo sapiens
cacacttttctctaa

SEQ ID NO: 193976 - DNA, 15 bp, Homo sapiens
acacacttttctcta

SEQ ID NO: 193977 - DNA, 15 bp, Homo sapiens
tacacacttttctct

SEQ ID NO: 193978 - DNA, 15 bp, Homo sapiens
ctacacacttttctc

SEQ ID NO: 193979 - DNA, 15 bp, Homo sapiens
actacacacttttct

SEQ ID NO: 193980 - DNA, 15 bp, Homo sapiens
gactacacacttttc

SEQ ID NO: 193981 - DNA, 15 bp, Homo sapiens
ggactacacactttt

SEQ ID NO: 193982 - DNA, 15 bp, Homo sapiens
aggactacacacttt

SEQ ID NO: 193983 - DNA, 15 bp, Homo sapiens
taggactacacactt

SEQ ID NO: 193984 - DNA, 15 bp, Homo sapiens
ataggactacacact

SEQ ID NO: 193985 - DNA, 15 bp, Homo sapiens
aataggactacacac

SEQ ID NO: 193986 - DNA, 15 bp, Homo sapiens
aaataggactacaca

SEQ ID NO: 193987 - DNA, 15 bp, Homo sapiens
aaaataggactacac

SEQ ID NO: 193988 - DNA, 15 bp, Homo sapiens
aaaaataggactaca

SEQ ID NO: 193989 - DNA, 15 bp, Homo sapiens
gaaaaataggactac

SEQ ID NO: 193990 - DNA, 15 bp, Homo sapiens
agaaaaataggacta

SEQ ID NO: 193991 - DNA, 15 bp, Homo sapiens
tagaaaaataggact

SEQ ID NO: 193992 - DNA, 15 bp, Homo sapiens
ttagaaaaataggac

SEQ ID NO: 193993 - DNA, 15 bp, Homo sapiens
gttagaaaaatagga

SEQ ID NO: 193994 - DNA, 15 bp, Homo sapiens
agttagaaaaatagg

SEQ ID NO: 193995 - DNA, 15 bp, Homo sapiens
gagttagaaaaatag

SEQ ID NO: 193996 - DNA, 15 bp, Homo sapiens
ggagttagaaaaata

SEQ ID NO: 193997 - DNA, 15 bp, Homo sapiens
aggagttagaaaaat

SEQ ID NO: 193998 - DNA, 15 bp, Homo sapiens
caggagttagaaaaa

SEQ ID NO: 193999 - DNA, 15 bp, Homo sapiens
ccaggagttagaaaa

SEQ ID NO: 194000 - DNA, 15 bp, Homo sapiens
gccaggagttagaaa

SEQ ID NO: 194001 - DNA, 15 bp, Homo sapiens
agccaggagttagaa

SEQ ID NO: 194002 - DNA, 15 bp, Homo sapiens
aagccaggagttaga

SEQ ID NO: 194003 - DNA, 15 bp, Homo sapiens
aaagccaggagttag

SEQ ID NO: 194004 - DNA, 15 bp, Homo sapiens
aaaagccaggagtta

SEQ ID NO: 194005 - DNA, 15 bp, Homo sapiens
gaaaagccaggagtt

SEQ ID NO: 194006 - DNA, 15 bp, Homo sapiens
agaaaagccaggagt

SEQ ID NO: 194007 - DNA, 15 bp, Homo sapiens
aagaaaagccaggag

SEQ ID NO: 194008 - DNA, 15 bp, Homo sapiens
taagaaaagccagga

SEQ ID NO: 194009 - DNA, 15 bp, Homo sapiens
ttaagaaaagccagg

SEQ ID NO: 194010 - DNA, 15 bp, Homo sapiens
gttaagaaaagccag

SEQ ID NO: 194011 - DNA, 15 bp, Homo sapiens
ggttaagaaaagcca

SEQ ID NO: 194012 - DNA, 15 bp, Homo sapiens
aggttaagaaaagcc

SEQ ID NO: 194013 - DNA, 15 bp, Homo sapiens
aaggttaagaaaagc

SEQ ID NO: 194014 - DNA, 15 bp, Homo sapiens
gaaggttaagaaaag

SEQ ID NO: 194015 - DNA, 15 bp, Homo sapiens
agaaggttaagaaaa

SEQ ID NO: 194016 - DNA, 15 bp, Homo sapiens
tagaaggttaagaaa

SEQ ID NO: 194017 - DNA, 15 bp, Homo sapiens
gtagaaggttaagaa

SEQ ID NO: 194018 - DNA, 15 bp, Homo sapiens
tgtagaaggttaaga

SEQ ID NO: 194019 - DNA, 15 bp, Homo sapiens
atgtagaaggttaag

SEQ ID NO: 194020 - DNA, 15 bp, Homo sapiens
aatgtagaaggttaa

SEQ ID NO: 194021 - DNA, 15 bp, Homo sapiens
taatgtagaaggtta

SEQ ID NO: 194022 - DNA, 15 bp, Homo sapiens
ataatgtagaaggtt

SEQ ID NO: 194023 - DNA, 15 bp, Homo sapiens
tataatgtagaaggt

SEQ ID NO: 194024 - DNA, 15 bp, Homo sapiens
gtataatgtagaagg

SEQ ID NO: 194025 - DNA, 15 bp, Homo sapiens
agtataatgtagaag

SEQ ID NO: 194026 - DNA, 15 bp, Homo sapiens
aagtataatgtagaa

SEQ ID NO: 194027 - DNA, 15 bp, Homo sapiens
taagtataatgtaga

SEQ ID NO: 194028 - DNA, 15 bp, Homo sapiens
gtaagtataatgtag

SEQ ID NO: 194029 - DNA, 15 bp, Homo sapiens
tgtaagtataatgta

SEQ ID NO: 194030 - DNA, 15 bp, Homo sapiens
atgtaagtataatgt

SEQ ID NO: 194031 - DNA, 15 bp, Homo sapiens
aatgtaagtataatg

SEQ ID NO: 194032 - DNA, 15 bp, Homo sapiens
caatgtaagtataat

SEQ ID NO: 194033 - DNA, 15 bp, Homo sapiens
acaatgtaagtataa

SEQ ID NO: 194034 - DNA, 15 bp, Homo sapiens
aacaatgtaagtata

SEQ ID NO: 194035 - DNA, 15 bp, Homo sapiens
aaacaatgtaagtat

SEQ ID NO: 194036 - DNA, 15 bp, Homo sapiens
aaaacaatgtaagta

SEQ ID NO: 194037 - DNA, 15 bp, Homo sapiens
taaaacaatgtaagt

SEQ ID NO: 194038 - DNA, 15 bp, Homo sapiens
ttaaaacaatgtaag

SEQ ID NO: 194039 - DNA, 15 bp, Homo sapiens
attttaaaacaatgt

SEQ ID NO: 194040 - DNA, 15 bp, Homo sapiens
tattttaaaacaatg

SEQ ID NO: 194041 - DNA, 15 bp, Homo sapiens
gtattttaaaacaat

SEQ ID NO: 194042 - DNA, 15 bp, Homo sapiens
agtattttaaaacaa

SEQ ID NO: 194043 - DNA, 15 bp, Homo sapiens
aagtattttaaaaca

SEQ ID NO: 194044 - DNA, 15 bp, Homo sapiens
aaagtattttaaaac

SEQ ID NO: 194045 - DNA, 15 bp, Homo sapiens
aaaagtattttaaaa

SEQ ID NO: 194046 - DNA, 15 bp, Homo sapiens
gaaaagtattttaaa

SEQ ID NO: 194047 - DNA, 15 bp, Homo sapiens
tgaaaagtattttaa

SEQ ID NO: 194048 - DNA, 15 bp, Homo sapiens
ttgaaaagtatttta

SEQ ID NO: 194049 - DNA, 15 bp, Homo sapiens
cttgaaaagtatttt

SEQ ID NO: 194050 - DNA, 15 bp, Homo sapiens
acttgaaaagtattt

SEQ ID NO: 194051 - DNA, 15 bp, Homo sapiens
cacttgaaaagtatt

SEQ ID NO: 194052 - DNA, 15 bp, Homo sapiens
tcacttgaaaagtat

SEQ ID NO: 194053 - DNA, 15 bp, Homo sapiens
ttcacttgaaaagta

SEQ ID NO: 194054 - DNA, 15 bp, Homo sapiens
attcacttgaaaagt

SEQ ID NO: 194055 - DNA, 15 bp, Homo sapiens
gattcacttgaaaag

SEQ ID NO: 194056 - DNA, 15 bp, Homo sapiens
ggattcacttgaaaa

SEQ ID NO: 194057 - DNA, 15 bp, Homo sapiens
aggattcacttgaaa

SEQ ID NO: 194058 - DNA, 15 bp, Homo sapiens
aaggattcacttgaa

SEQ ID NO: 194059 - DNA, 15 bp, Homo sapiens
taaggattcacttga

SEQ ID NO: 194060 - DNA, 15 bp, Homo sapiens
ctaaggattcacttg

SEQ ID NO: 194061 - DNA, 15 bp, Homo sapiens
cctaaggattcactt

SEQ ID NO: 194062 - DNA, 15 bp, Homo sapiens
tcctaaggattcact

SEQ ID NO: 194063 - DNA, 15 bp, Homo sapiens
gtcctaaggattcac

SEQ ID NO: 194064 - DNA, 15 bp, Homo sapiens
tgtcctaaggattca

SEQ ID NO: 194065 - DNA, 15 bp, Homo sapiens
atgtcctaaggattc

SEQ ID NO: 194066 - DNA, 15 bp, Homo sapiens
aatgtcctaaggatt

SEQ ID NO: 194067 - DNA, 15 bp, Homo sapiens
caatgtcctaaggat

SEQ ID NO: 194068 - DNA, 15 bp, Homo sapiens
gcaatgtcctaagga

SEQ ID NO: 194069 - DNA, 15 bp, Homo sapiens
agcaatgtcctaagg

SEQ ID NO: 194070 - DNA, 15 bp, Homo sapiens
aagcaatgtcctaag

SEQ ID NO: 194071 - DNA, 15 bp, Homo sapiens
gaagcaatgtcctaa

SEQ ID NO: 194072 - DNA, 15 bp, Homo sapiens
agaagcaatgtccta

SEQ ID NO: 194073 - DNA, 15 bp, Homo sapiens
cagaagcaatgtcct

SEQ ID NO: 194074 - DNA, 15 bp, Homo sapiens
gcagaagcaatgtcc

SEQ ID NO: 194075 - DNA, 15 bp, Homo sapiens
ggcagaagcaatgtc

SEQ ID NO: 194076 - DNA, 15 bp, Homo sapiens
gggcagaagcaatgt

SEQ ID NO: 194077 - DNA, 15 bp, Homo sapiens
agggcagaagcaatg

SEQ ID NO: 194078 - DNA, 15 bp, Homo sapiens
cagggcagaagcaat

SEQ ID NO: 194079 - DNA, 15 bp, Homo sapiens
acagggcagaagcaa

SEQ ID NO: 194080 - DNA, 15 bp, Homo sapiens
aacagggcagaagca

SEQ ID NO: 194081 - DNA, 15 bp, Homo sapiens
aaacagggcagaagc

SEQ ID NO: 194082 - DNA, 15 bp, Homo sapiens
aaaacagggcagaag

SEQ ID NO: 194083 - DNA, 15 bp, Homo sapiens
gaaaacagggcagaa

SEQ ID NO: 194084 - DNA, 15 bp, Homo sapiens
tgaaaacagggcaga

SEQ ID NO: 194085 - DNA, 15 bp, Homo sapiens
ttgaaaacagggcag

SEQ ID NO: 194086 - DNA, 15 bp, Homo sapiens
tttgaaaacagggca

SEQ ID NO: 194087 - DNA, 15 bp, Homo sapiens
atttgaaaacagggc

SEQ ID NO: 194088 - DNA, 15 bp, Homo sapiens
catttgaaaacaggg

SEQ ID NO: 194089 - DNA, 15 bp, Homo sapiens
acatttgaaaacagg

SEQ ID NO: 194090 - DNA, 15 bp, Homo sapiens
aacatttgaaaacag

SEQ ID NO: 194091 - DNA, 15 bp, Homo sapiens
taacatttgaaaaca

SEQ ID NO: 194092 - DNA, 15 bp, Homo sapiens
ctaacatttgaaaac

SEQ ID NO: 194093 - DNA, 15 bp, Homo sapiens
actaacatttgaaaa

SEQ ID NO: 194094 - DNA, 15 bp, Homo sapiens
aactaacatttgaaa

SEQ ID NO: 194095 - DNA, 15 bp, Homo sapiens
gaactaacatttgaa

SEQ ID NO: 194096 - DNA, 15 bp, Homo sapiens
tgaactaacatttga

SEQ ID NO: 194097 - DNA, 15 bp, Homo sapiens
ttgaactaacatttg

SEQ ID NO: 194098 - DNA, 15 bp, Homo sapiens
gttgaactaacattt

SEQ ID NO: 194099 - DNA, 15 bp, Homo sapiens
agttgaactaacatt

SEQ ID NO: 194100 - DNA, 15 bp, Homo sapiens
cagttgaactaacat

SEQ ID NO: 194101 - DNA, 15 bp, Homo sapiens
gcagttgaactaaca

SEQ ID NO: 194102 - DNA, 15 bp, Homo sapiens
agcagttgaactaac

SEQ ID NO: 194103 - DNA, 15 bp, Homo sapiens
aagcagttgaactaa

SEQ ID NO: 194104 - DNA, 15 bp, Homo sapiens
caagcagttgaacta

SEQ ID NO: 194105 - DNA, 15 bp, Homo sapiens
tcaagcagttgaact

SEQ ID NO: 194106 - DNA, 15 bp, Homo sapiens
ttcaagcagttgaac

SEQ ID NO: 194107 - DNA, 15 bp, Homo sapiens
attcaagcagttgaa

SEQ ID NO: 194108 - DNA, 15 bp, Homo sapiens
tattcaagcagttga

SEQ ID NO: 194109 - DNA, 15 bp, Homo sapiens
atattcaagcagttg

SEQ ID NO: 194110 - DNA, 15 bp, Homo sapiens
gatattcaagcagtt

SEQ ID NO: 194111 - DNA, 15 bp, Homo sapiens
agatattcaagcagt

SEQ ID NO: 194112 - DNA, 15 bp, Homo sapiens
aagatattcaagcag

SEQ ID NO: 194113 - DNA, 15 bp, Homo sapiens
caagatattcaagca

SEQ ID NO: 194114 - DNA, 15 bp, Homo sapiens
gcaagatattcaagc

SEQ ID NO: 194115 - DNA, 15 bp, Homo sapiens
ggcaagatattcaag

SEQ ID NO: 194116 - DNA, 15 bp, Homo sapiens
tggcaagatattcaa

SEQ ID NO: 194117 - DNA, 15 bp, Homo sapiens
atggcaagatattca

SEQ ID NO: 194118 - DNA, 15 bp, Homo sapiens
catggcaagatattc

SEQ ID NO: 194119 - DNA, 15 bp, Homo sapiens
ccatggcaagatatt

SEQ ID NO: 194120 - DNA, 15 bp, Homo sapiens
gccatggcaagatat

SEQ ID NO: 194121 - DNA, 15 bp, Homo sapiens
ggccatggcaagata

SEQ ID NO: 194122 - DNA, 15 bp, Homo sapiens
gggccatggcaagat

SEQ ID NO: 194123 - DNA, 15 bp, Homo sapiens
ggggccatggcaaga

SEQ ID NO: 194124 - DNA, 15 bp, Homo sapiens
aggggccatggcaag

SEQ ID NO: 194125 - DNA, 15 bp, Homo sapiens
gaggggccatggcaa

SEQ ID NO: 194126 - DNA, 15 bp, Homo sapiens
agaggggccatggca

SEQ ID NO: 194127 - DNA, 15 bp, Homo sapiens
cagaggggccatggc

SEQ ID NO: 194128 - DNA, 15 bp, Homo sapiens
acagaggggccatgg

SEQ ID NO: 194129 - DNA, 15 bp, Homo sapiens
cacagaggggccatg

SEQ ID NO: 194130 - DNA, 15 bp, Homo sapiens
gcacagaggggccat

SEQ ID NO: 194131 - DNA, 15 bp, Homo sapiens
tgcacagaggggcca

SEQ ID NO: 194132 - DNA, 15 bp, Homo sapiens
gtgcacagaggggcc

SEQ ID NO: 194133 - DNA, 15 bp, Homo sapiens
tgtgcacagaggggc

SEQ ID NO: 194134 - DNA, 15 bp, Homo sapiens
atgtgcacagagggg

SEQ ID NO: 194135 - DNA, 15 bp, Homo sapiens
catgtgcacagaggg

SEQ ID NO: 194136 - DNA, 15 bp, Homo sapiens
tcatgtgcacagagg

SEQ ID NO: 194137 - DNA, 15 bp, Homo sapiens
gtcatgtgcacagag

SEQ ID NO: 194138 - DNA, 15 bp, Homo sapiens
agtcatgtgcacaga

SEQ ID NO: 194139 - DNA, 15 bp, Homo sapiens
acttccaaaagcata

SEQ ID NO: 194140 - DNA, 15 bp, Homo sapiens
tacttccaaaagcat

SEQ ID NO: 194141 - DNA, 15 bp, Homo sapiens
atacttccaaaagca

SEQ ID NO: 194142 - DNA, 15 bp, Homo sapiens
aatacttccaaaagc

SEQ ID NO: 194143 - DNA, 15 bp, Homo sapiens
aaatacttccaaaag

SEQ ID NO: 194144 - DNA, 15 bp, Homo sapiens
aaaatacttccaaaa

SEQ ID NO: 194145 - DNA, 15 bp, Homo sapiens
aaaaatacttccaaa

SEQ ID NO: 194146 - DNA, 15 bp, Homo sapiens
caaaaatacttccaa

SEQ ID NO: 194147 - DNA, 15 bp, Homo sapiens
gcaaaaatacttcca

SEQ ID NO: 194148 - DNA, 15 bp, Homo sapiens
agcaaaaatacttcc

SEQ ID NO: 194149 - DNA, 15 bp, Homo sapiens
cagcaaaaatacttc

SEQ ID NO: 194150 - DNA, 15 bp, Homo sapiens
tcagcaaaaatactt

SEQ ID NO: 194151 - DNA, 15 bp, Homo sapiens
gtcagcaaaaatact

SEQ ID NO: 194152 - DNA, 15 bp, Homo sapiens
tgtcagcaaaaatac

SEQ ID NO: 194153 - DNA, 15 bp, Homo sapiens
gtgtcagcaaaaata

SEQ ID NO: 194154 - DNA, 15 bp, Homo sapiens
cgtgtcagcaaaaat

SEQ ID NO: 194155 - DNA, 15 bp, Homo sapiens
acgtgtcagcaaaaa

SEQ ID NO: 194156 - DNA, 15 bp, Homo sapiens
aacgtgtcagcaaaa

SEQ ID NO: 194157 - DNA, 15 bp, Homo sapiens
taacgtgtcagcaaa

SEQ ID NO: 194158 - DNA, 15 bp, Homo sapiens
ttaacgtgtcagcaa

SEQ ID NO: 194159 - DNA, 15 bp, Homo sapiens
tttaacgtgtcagca

SEQ ID NO: 194160 - DNA, 15 bp, Homo sapiens
ttttaacgtgtcagc

SEQ ID NO: 194161 - DNA, 15 bp, Homo sapiens
cttttaacgtgtcag

SEQ ID NO: 194162 - DNA, 15 bp, Homo sapiens
acttttaacgtgtca

SEQ ID NO: 194163 - DNA, 15 bp, Homo sapiens
aacttttaacgtgtc

SEQ ID NO: 194164 - DNA, 15 bp, Homo sapiens
aaacttttaacgtgt

SEQ ID NO: 194165 - DNA, 15 bp, Homo sapiens
caaacttttaacgtg

SEQ ID NO: 194166 - DNA, 15 bp, Homo sapiens
acaaacttttaacgt

SEQ ID NO: 194167 - DNA, 15 bp, Homo sapiens
aacaaacttttaacg

SEQ ID NO: 194168 - DNA, 15 bp, Homo sapiens
aaacaaacttttaac

SEQ ID NO: 194169 - DNA, 15 bp, Homo sapiens
aaaacaaacttttaa

SEQ ID NO: 194170 - DNA, 15 bp, Homo sapiens
aaaaacaaactttta

SEQ ID NO: 194171 - DNA, 15 bp, Homo sapiens
aaaaaacaaactttt

SEQ ID NO: 194172 - DNA, 15 bp, Homo sapiens
aaaaaaacaaacttt

SEQ ID NO: 194173 - DNA, 15 bp, Homo sapiens
aaaaaaaacaaactt

SEQ ID NO: 194174 - DNA, 15 bp, Homo sapiens
aaaaaaaaacaaact

SEQ ID NO: 194175 - DNA, 15 bp, Homo sapiens
aaaaaaaaaacaaac

SEQ ID NO: 194176 - DNA, 15 bp, Homo sapiens
tataattaaaaaaaa

SEQ ID NO: 194177 - DNA, 15 bp, Homo sapiens
gtataattaaaaaaa

SEQ ID NO: 194178 - DNA, 15 bp, Homo sapiens
agtataattaaaaaa

SEQ ID NO: 194179 - DNA, 15 bp, Homo sapiens
aagtataattaaaaa

SEQ ID NO: 194180 - DNA, 15 bp, Homo sapiens
aaagtataattaaaa

SEQ ID NO: 194181 - DNA, 15 bp, Homo sapiens
taaagtataattaaa

SEQ ID NO: 194182 - DNA, 15 bp, Homo sapiens
ttaaagtataattaa

SEQ ID NO: 194183 - DNA, 15 bp, Homo sapiens
cttaaagtataatta

SEQ ID NO: 194184 - DNA, 15 bp, Homo sapiens
acttaaagtataatt

SEQ ID NO: 194185 - DNA, 15 bp, Homo sapiens
gaacttaaagtataa

SEQ ID NO: 194186 - DNA, 15 bp, Homo sapiens
agaacttaaagtata

SEQ ID NO: 194187 - DNA, 15 bp, Homo sapiens
cagaacttaaagtat

SEQ ID NO: 194188 - DNA, 15 bp, Homo sapiens
tatgtatcccagaac

SEQ ID NO: 194189 - DNA, 15 bp, Homo sapiens
atatgtatcccagaa

SEQ ID NO: 194190 - DNA, 15 bp, Homo sapiens
catatgtatcccaga

SEQ ID NO: 194191 - DNA, 15 bp, Homo sapiens
gcatatgtatcccag

SEQ ID NO: 194192 - DNA, 15 bp, Homo sapiens
tgcatatgtatccca

SEQ ID NO: 194193 - DNA, 15 bp, Homo sapiens
ttgcatatgtatccc

SEQ ID NO: 194194 - DNA, 15 bp, Homo sapiens
tttgcatatgtatcc

SEQ ID NO: 194195 - DNA, 15 bp, Homo sapiens
ttttgcatatgtatc

SEQ ID NO: 194196 - DNA, 15 bp, Homo sapiens
attttgcatatgtat

SEQ ID NO: 194197 - DNA, 15 bp, Homo sapiens
cattttgcatatgta

SEQ ID NO: 194198 - DNA, 15 bp, Homo sapiens
acattttgcatatgt

SEQ ID NO: 194199 - DNA, 15 bp, Homo sapiens
cacattttgcatatg

SEQ ID NO: 194200 - DNA, 15 bp, Homo sapiens
gcacattttgcatat

SEQ ID NO: 194201 - DNA, 15 bp, Homo sapiens
tgcacattttgcata

SEQ ID NO: 194202 - DNA, 15 bp, Homo sapiens
ctgcacattttgcat

SEQ ID NO: 194203 - DNA, 15 bp, Homo sapiens
cctgcacattttgca

SEQ ID NO: 194204 - DNA, 15 bp, Homo sapiens
acctgcacattttgc

SEQ ID NO: 194205 - DNA, 15 bp, Homo sapiens
aacctgcacattttg

SEQ ID NO: 194206 - DNA, 15 bp, Homo sapiens
aaacctgcacatttt

SEQ ID NO: 194207 - DNA, 15 bp, Homo sapiens
caaacctgcacattt

SEQ ID NO: 194208 - DNA, 15 bp, Homo sapiens
ggcacatgtatacct

SEQ ID NO: 194209 - DNA, 15 bp, Homo sapiens
tggcacatgtatacc

SEQ ID NO: 194210 - DNA, 15 bp, Homo sapiens
aacatggcacatgta

SEQ ID NO: 194211 - DNA, 15 bp, Homo sapiens
caacatggcacatgt

SEQ ID NO: 194212 - DNA, 15 bp, Homo sapiens
ccaacatggcacatg

SEQ ID NO: 194213 - DNA, 15 bp, Homo sapiens
accaacatggcacat

SEQ ID NO: 194214 - DNA, 15 bp, Homo sapiens
aaccaacatggcaca

SEQ ID NO: 194215 - DNA, 15 bp, Homo sapiens
aaaccaacatggcac

SEQ ID NO: 194216 - DNA, 15 bp, Homo sapiens
caaaccaacatggca

SEQ ID NO: 194217 - DNA, 15 bp, Homo sapiens
acaaaccaacatggc

SEQ ID NO: 194218 - DNA, 15 bp, Homo sapiens
aacaaaccaacatgg

SEQ ID NO: 194219 - DNA, 15 bp, Homo sapiens
caacaaaccaacatg

SEQ ID NO: 194220 - DNA, 15 bp, Homo sapiens
gcaacaaaccaacat

SEQ ID NO: 194221 - DNA, 15 bp, Homo sapiens
tgcaacaaaccaaca

SEQ ID NO: 194222 - DNA, 15 bp, Homo sapiens
gtgcaacaaaccaac

SEQ ID NO: 194223 - DNA, 15 bp, Homo sapiens
ggtgcaacaaaccaa

SEQ ID NO: 194224 - DNA, 15 bp, Homo sapiens
gggtgcaacaaacca

SEQ ID NO: 194225 - DNA, 15 bp, Homo sapiens
tgggtgcaacaaacc

SEQ ID NO: 194226 - DNA, 15 bp, Homo sapiens
atgggtgcaacaaac

SEQ ID NO: 194227 - DNA, 15 bp, Homo sapiens
aatgggtgcaacaaa

SEQ ID NO: 194228 - DNA, 15 bp, Homo sapiens
taatgggtgcaacaa

SEQ ID NO: 194229 - DNA, 15 bp, Homo sapiens
ttaatgggtgcaaca

SEQ ID NO: 194230 - DNA, 15 bp, Homo sapiens
gttaatgggtgcaac

SEQ ID NO: 194231 - DNA, 15 bp, Homo sapiens
ggttaatgggtgcaa

SEQ ID NO: 194232 - DNA, 15 bp, Homo sapiens
gggttaatgggtgca

SEQ ID NO: 194233 - DNA, 15 bp, Homo sapiens
cgggttaatgggtgc

SEQ ID NO: 194234 - DNA, 15 bp, Homo sapiens
acgggttaatgggtg

SEQ ID NO: 194235 - DNA, 15 bp, Homo sapiens
gacgggttaatgggt

SEQ ID NO: 194236 - DNA, 15 bp, Homo sapiens
tgacgggttaatggg

SEQ ID NO: 194237 - DNA, 15 bp, Homo sapiens
atgacgggttaatgg

SEQ ID NO: 194238 - DNA, 15 bp, Homo sapiens
gatgacgggttaatg

SEQ ID NO: 194239 - DNA, 15 bp, Homo sapiens
agatgacgggttaat

SEQ ID NO: 194240 - DNA, 15 bp, Homo sapiens
tagatgacgggttaa

SEQ ID NO: 194241 - DNA, 15 bp, Homo sapiens
gtagatgacgggtta

SEQ ID NO: 194242 - DNA, 15 bp, Homo sapiens
atagcattaggagaa

SEQ ID NO: 194243 - DNA, 15 bp, Homo sapiens
ggatagcattaggag

SEQ ID NO: 194244 - DNA, 15 bp, Homo sapiens
gggatagcattagga

SEQ ID NO: 194245 - DNA, 15 bp, Homo sapiens
agggatagcattagg

SEQ ID NO: 194246 - DNA, 15 bp, Homo sapiens
aagggatagcattag

SEQ ID NO: 194247 - DNA, 15 bp, Homo sapiens
gaagggatagcatta

SEQ ID NO: 194248 - DNA, 15 bp, Homo sapiens
ggaagggatagcatt

SEQ ID NO: 194249 - DNA, 15 bp, Homo sapiens
gggaagggatagcat

SEQ ID NO: 194250 - DNA, 15 bp, Homo sapiens
agggaagggatagca

SEQ ID NO: 194251 - DNA, 15 bp, Homo sapiens
tagggaagggatagc

SEQ ID NO: 194252 - DNA, 15 bp, Homo sapiens
ctagggaagggatag

SEQ ID NO: 194253 - DNA, 15 bp, Homo sapiens
gctagggaagggata

SEQ ID NO: 194254 - DNA, 15 bp, Homo sapiens
ggctagggaagggat

SEQ ID NO: 194255 - DNA, 15 bp, Homo sapiens
gggctagggaaggga

SEQ ID NO: 194256 - DNA, 15 bp, Homo sapiens
ggggctagggaaggg

SEQ ID NO: 194257 - DNA, 15 bp, Homo sapiens
aggggctagggaagg

SEQ ID NO: 194258 - DNA, 15 bp, Homo sapiens
gaggggctagggaag

SEQ ID NO: 194259 - DNA, 15 bp, Homo sapiens
tgaggggctagggaa

SEQ ID NO: 194260 - DNA, 15 bp, Homo sapiens
gtgaggggctaggga

SEQ ID NO: 194261 - DNA, 15 bp, Homo sapiens
ggtgaggggctaggg

SEQ ID NO: 194262 - DNA, 15 bp, Homo sapiens
gggtgaggggctagg

SEQ ID NO: 194263 - DNA, 15 bp, Homo sapiens
ggggtgaggggctag

SEQ ID NO: 194264 - DNA, 15 bp, Homo sapiens
tggggtgaggggcta

SEQ ID NO: 194265 - DNA, 15 bp, Homo sapiens
gtggggtgaggggct

SEQ ID NO: 194266 - DNA, 15 bp, Homo sapiens
tgtggggtgaggggc

SEQ ID NO: 194267 - DNA, 15 bp, Homo sapiens
ttgtggggtgagggg

SEQ ID NO: 194268 - DNA, 15 bp, Homo sapiens
gttgtggggtgaggg

SEQ ID NO: 194269 - DNA, 15 bp, Homo sapiens
tgttgtggggtgagg

SEQ ID NO: 194270 - DNA, 15 bp, Homo sapiens
ctgttgtggggtgag

SEQ ID NO: 194271 - DNA, 15 bp, Homo sapiens
cctgttgtggggtga

SEQ ID NO: 194272 - DNA, 15 bp, Homo sapiens
gcctgttgtggggtg

SEQ ID NO: 194273 - DNA, 15 bp, Homo sapiens
ggcctgttgtggggt

SEQ ID NO: 194274 - DNA, 15 bp, Homo sapiens
gggcctgttgtgggg

SEQ ID NO: 194275 - DNA, 15 bp, Homo sapiens
ggggcctgttgtggg

SEQ ID NO: 194276 - DNA, 15 bp, Homo sapiens
cggggcctgttgtgg

SEQ ID NO: 194277 - DNA, 15 bp, Homo sapiens
ccggggcctgttgtg

SEQ ID NO: 194278 - DNA, 15 bp, Homo sapiens
accggggcctgttgt

SEQ ID NO: 194279 - DNA, 15 bp, Homo sapiens
caccggggcctgttg

SEQ ID NO: 194280 - DNA, 15 bp, Homo sapiens
acaccggggcctgtt

SEQ ID NO: 194281 - DNA, 15 bp, Homo sapiens
tcatcacacaccggg

SEQ ID NO: 194282 - DNA, 15 bp, Homo sapiens
ttcatcacacaccgg

SEQ ID NO: 194283 - DNA, 15 bp, Homo sapiens
tttcatcacacaccg

SEQ ID NO: 194284 - DNA, 15 bp, Homo sapiens
gtttcatcacacacc

SEQ ID NO: 194285 - DNA, 15 bp, Homo sapiens
ggtttcatcacacac

SEQ ID NO: 194286 - DNA, 15 bp, Homo sapiens
cggtttcatcacaca

SEQ ID NO: 194287 - DNA, 15 bp, Homo sapiens
acggtttcatcacac

SEQ ID NO: 194288 - DNA, 15 bp, Homo sapiens
aacggtttcatcaca

SEQ ID NO: 194289 - DNA, 15 bp, Homo sapiens
caacggtttcatcac

SEQ ID NO: 194290 - DNA, 15 bp, Homo sapiens
acaacggtttcatca

SEQ ID NO: 194291 - DNA, 15 bp, Homo sapiens
aacaacggtttcatc

SEQ ID NO: 194292 - DNA, 15 bp, Homo sapiens
taacaacggtttcat

SEQ ID NO: 194293 - DNA, 15 bp, Homo sapiens
gtaacaacggtttca

SEQ ID NO: 194294 - DNA, 15 bp, Homo sapiens
agtaacaacggtttc

SEQ ID NO: 194295 - DNA, 15 bp, Homo sapiens
tagtaacaacggttt

SEQ ID NO: 194296 - DNA, 15 bp, Homo sapiens
ctagtaacaacggtt

SEQ ID NO: 194297 - DNA, 15 bp, Homo sapiens
actagtaacaacggt

SEQ ID NO: 194298 - DNA, 15 bp, Homo sapiens
aactagtaacaacgg

SEQ ID NO: 194299 - DNA, 15 bp, Homo sapiens
aaactagtaacaacg

SEQ ID NO: 194300 - DNA, 15 bp, Homo sapiens
aaaactagtaacaac

SEQ ID NO: 194301 - DNA, 15 bp, Homo sapiens
aaaaactagtaacaa

SEQ ID NO: 194302 - DNA, 15 bp, Homo sapiens
taaaaactagtaaca

SEQ ID NO: 194303 - DNA, 15 bp, Homo sapiens
ataaaaactagtaac

SEQ ID NO: 194304 - DNA, 15 bp, Homo sapiens
aataaaaactagtaa

SEQ ID NO: 194305 - DNA, 15 bp, Homo sapiens
aaataaaaactagta

SEQ ID NO: 194306 - DNA, 15 bp, Homo sapiens
gaaataaaaactagt

SEQ ID NO: 194307 - DNA, 15 bp, Homo sapiens
agaaataaaaactag

SEQ ID NO: 194308 - DNA, 15 bp, Homo sapiens
aagaaataaaaacta

SEQ ID NO: 194309 - DNA, 15 bp, Homo sapiens
taagaaataaaaact

SEQ ID NO: 194310 - DNA, 15 bp, Homo sapiens
ttaagaaataaaaac

SEQ ID NO: 194311 - DNA, 15 bp, Homo sapiens
tttaagaaataaaaa

SEQ ID NO: 194312 - DNA, 15 bp, Homo sapiens
ctttaagaaataaaa

SEQ ID NO: 194313 - DNA, 15 bp, Homo sapiens
tctttaagaaataaa

SEQ ID NO: 194314 - DNA, 15 bp, Homo sapiens
atctttaagaaataa

SEQ ID NO: 194315 - DNA, 15 bp, Homo sapiens
catctttaagaaata

SEQ ID NO: 194316 - DNA, 15 bp, Homo sapiens
tcatctttaagaaat

SEQ ID NO: 194317 - DNA, 15 bp, Homo sapiens
atcatctttaagaaa

SEQ ID NO: 194318 - DNA, 15 bp, Homo sapiens
catcatctttaagaa

SEQ ID NO: 194319 - DNA, 15 bp, Homo sapiens
tcatcatctttaaga

SEQ ID NO: 194320 - DNA, 15 bp, Homo sapiens
ttcatcatctttaag

SEQ ID NO: 194321 - DNA, 15 bp, Homo sapiens
gttcatcatctttaa

SEQ ID NO: 194322 - DNA, 15 bp, Homo sapiens
agttcatcatcttta

SEQ ID NO: 194323 - DNA, 15 bp, Homo sapiens
aagttcatcatcttt

SEQ ID NO: 194324 - DNA, 15 bp, Homo sapiens
caagttcatcatctt

SEQ ID NO: 194325 - DNA, 15 bp, Homo sapiens
acaagttcatcatct

SEQ ID NO: 194326 - DNA, 15 bp, Homo sapiens
tacaagttcatcatc

SEQ ID NO: 194327 - DNA, 15 bp, Homo sapiens
atacaagttcatcat

SEQ ID NO: 194328 - DNA, 15 bp, Homo sapiens
tatacaagttcatca

SEQ ID NO: 194329 - DNA, 15 bp, Homo sapiens
atatacaagttcatc

SEQ ID NO: 194330 - DNA, 15 bp, Homo sapiens
tatatacaagttcat

SEQ ID NO: 194331 - DNA, 15 bp, Homo sapiens
ttatatacaagttca

SEQ ID NO: 194332 - DNA, 15 bp, Homo sapiens
tttatatacaagttc

SEQ ID NO: 194333 - DNA, 15 bp, Homo sapiens
ttttatatacaagtt

SEQ ID NO: 194334 - DNA, 15 bp, Homo sapiens
tttttatatacaagt

SEQ ID NO: 194335 - DNA, 15 bp, Homo sapiens
atttttatatacaag

SEQ ID NO: 194336 - DNA, 15 bp, Homo sapiens
tatttttatatacaa

SEQ ID NO: 194337 - DNA, 15 bp, Homo sapiens
atatttttatataca

SEQ ID NO: 194338 - DNA, 15 bp, Homo sapiens
aatatttttatatac

SEQ ID NO: 194339 - DNA, 15 bp, Homo sapiens
gaatatttttatata

SEQ ID NO: 194340 - DNA, 15 bp, Homo sapiens
agaatatttttatat

SEQ ID NO: 194341 - DNA, 15 bp, Homo sapiens
aagaatatttttata

SEQ ID NO: 194342 - DNA, 15 bp, Homo sapiens
aaagaatatttttat

SEQ ID NO: 194343 - DNA, 15 bp, Homo sapiens
aaaagaatattttta

SEQ ID NO: 194344 - DNA, 15 bp, Homo sapiens
taaaagaatattttt

SEQ ID NO: 194345 - DNA, 15 bp, Homo sapiens
ttaaaagaatatttt

SEQ ID NO: 194346 - DNA, 15 bp, Homo sapiens
gttaaaagaatattt

SEQ ID NO: 194347 - DNA, 15 bp, Homo sapiens
tgttaaaagaatatt

SEQ ID NO: 194348 - DNA, 15 bp, Homo sapiens
atgttaaaagaatat

SEQ ID NO: 194349 - DNA, 15 bp, Homo sapiens
aatgttaaaagaata

SEQ ID NO: 194350 - DNA, 15 bp, Homo sapiens
aaatgttaaaagaat

SEQ ID NO: 194351 - DNA, 15 bp, Homo sapiens
aaaatgttaaaagaa

SEQ ID NO: 194352 - DNA, 15 bp, Homo sapiens
taaaatgttaaaaga

SEQ ID NO: 194353 - DNA, 15 bp, Homo sapiens
ctaaaatgttaaaag

SEQ ID NO: 194354 - DNA, 15 bp, Homo sapiens
tctaaaatgttaaaa

SEQ ID NO: 194355 - DNA, 15 bp, Homo sapiens
ttctaaaatgttaaa

SEQ ID NO: 194356 - DNA, 15 bp, Homo sapiens
tttctaaaatgttaa

SEQ ID NO: 194357 - DNA, 15 bp, Homo sapiens
atttctaaaatgtta

SEQ ID NO: 194358 - DNA, 15 bp, Homo sapiens
tatttctaaaatgtt

SEQ ID NO: 194359 - DNA, 15 bp, Homo sapiens
ttatttctaaaatgt

SEQ ID NO: 194360 - DNA, 15 bp, Homo sapiens
tttatttctaaaatg

SEQ ID NO: 194361 - DNA, 15 bp, Homo sapiens
atttatttctaaaat

SEQ ID NO: 194362 - DNA, 15 bp, Homo sapiens
aatttatttctaaaa

SEQ ID NO: 194363 - DNA, 15 bp, Homo sapiens
aaatttatttctaaa

SEQ ID NO: 194364 - DNA, 15 bp, Homo sapiens
aaaatttatttctaa

SEQ ID NO: 194365 - DNA, 15 bp, Homo sapiens
taaaatttatttcta

SEQ ID NO: 194366 - DNA, 15 bp, Homo sapiens
ataaaatttatttct

SEQ ID NO: 194367 - DNA, 15 bp, Homo sapiens
tataaaatttatttc

SEQ ID NO: 194368 - DNA, 15 bp, Homo sapiens
ttataaaatttattt

SEQ ID NO: 194369 - DNA, 15 bp, Homo sapiens
cttataaaatttatt

SEQ ID NO: 194370 - DNA, 15 bp, Homo sapiens
tcttataaaatttat

SEQ ID NO: 194371 - DNA, 15 bp, Homo sapiens
gtcttataaaattta

SEQ ID NO: 194372 - DNA, 15 bp, Homo sapiens
agtcttataaaattt

SEQ ID NO: 194373 - DNA, 15 bp, Homo sapiens
cagtcttataaaatt

SEQ ID NO: 194374 - DNA, 15 bp, Homo sapiens
tcagtcttataaaat

SEQ ID NO: 194375 - DNA, 15 bp, Homo sapiens
ttcagtcttataaaa

SEQ ID NO: 194376 - DNA, 15 bp, Homo sapiens
tttcagtcttataaa

SEQ ID NO: 194377 - DNA, 15 bp, Homo sapiens
ctttcagtcttataa

SEQ ID NO: 194378 - DNA, 15 bp, Homo sapiens
cctttcagtcttata

SEQ ID NO: 194379 - DNA, 15 bp, Homo sapiens
tcctttcagtcttat

SEQ ID NO: 194380 - DNA, 15 bp, Homo sapiens
gtcctttcagtctta

SEQ ID NO: 194381 - DNA, 15 bp, Homo sapiens
tgtcctttcagtctt

SEQ ID NO: 194382 - DNA, 15 bp, Homo sapiens
ttgtcctttcagtct

SEQ ID NO: 194383 - DNA, 15 bp, Homo sapiens
tttgtcctttcagtc

SEQ ID NO: 194384 - DNA, 15 bp, Homo sapiens
gtttgtcctttcagt

SEQ ID NO: 194385 - DNA, 15 bp, Homo sapiens
agtttgtcctttcag

SEQ ID NO: 194386 - DNA, 15 bp, Homo sapiens
tagtttgtcctttca

SEQ ID NO: 194387 - DNA, 15 bp, Homo sapiens
atagtttgtcctttc

SEQ ID NO: 194388 - DNA, 15 bp, Homo sapiens
aatagtttgtccttt

SEQ ID NO: 194389 - DNA, 15 bp, Homo sapiens
taatagtttgtcctt

SEQ ID NO: 194390 - DNA, 15 bp, Homo sapiens
ctaatagtttgtcct

SEQ ID NO: 194391 - DNA, 15 bp, Homo sapiens
actaatagtttgtcc

SEQ ID NO: 194392 - DNA, 15 bp, Homo sapiens
tactaatagtttgtc

SEQ ID NO: 194393 - DNA, 15 bp, Homo sapiens
ttactaatagtttgt

SEQ ID NO: 194394 - DNA, 15 bp, Homo sapiens
tttactaatagtttg

SEQ ID NO: 194395 - DNA, 15 bp, Homo sapiens
atttactaatagttt

SEQ ID NO: 194396 - DNA, 15 bp, Homo sapiens
catttactaatagtt

SEQ ID NO: 194397 - DNA, 15 bp, Homo sapiens
acatttactaatagt

SEQ ID NO: 194398 - DNA, 15 bp, Homo sapiens
aacatttactaatag

SEQ ID NO: 194399 - DNA, 15 bp, Homo sapiens
aaacatttactaata

SEQ ID NO: 194400 - DNA, 15 bp, Homo sapiens
gaaacatttactaat

SEQ ID NO: 194401 - DNA, 15 bp, Homo sapiens
tgaaacatttactaa

SEQ ID NO: 194402 - DNA, 15 bp, Homo sapiens
ttgaaacatttacta

SEQ ID NO: 194403 - DNA, 15 bp, Homo sapiens
tttgaaacatttact

SEQ ID NO: 194404 - DNA, 15 bp, Homo sapiens
ttttgaaacatttac

SEQ ID NO: 194405 - DNA, 15 bp, Homo sapiens
attttgaaacattta

SEQ ID NO: 194406 - DNA, 15 bp, Homo sapiens
cattttgaaacattt

SEQ ID NO: 194407 - DNA, 15 bp, Homo sapiens
acattttgaaacatt

SEQ ID NO: 194408 - DNA, 15 bp, Homo sapiens
cacattttgaaacat

SEQ ID NO: 194409 - DNA, 15 bp, Homo sapiens
tcacattttgaaaca

SEQ ID NO: 194410 - DNA, 15 bp, Homo sapiens
ttcacattttgaaac

SEQ ID NO: 194411 - DNA, 15 bp, Homo sapiens
tttcacattttgaaa

SEQ ID NO: 194412 - DNA, 15 bp, Homo sapiens
ttttcacattttgaa

SEQ ID NO: 194413 - DNA, 15 bp, Homo sapiens
tttttcacattttga

SEQ ID NO: 194414 - DNA, 15 bp, Homo sapiens
gtttttcacattttg

SEQ ID NO: 194415 - DNA, 15 bp, Homo sapiens
tgtttttcacatttt

SEQ ID NO: 194416 - DNA, 15 bp, Homo sapiens
gtgtttttcacattt

SEQ ID NO: 194417 - DNA, 15 bp, Homo sapiens
agtgtttttcacatt

SEQ ID NO: 194418 - DNA, 15 bp, Homo sapiens
aagtgtttttcacat

SEQ ID NO: 194419 - DNA, 15 bp, Homo sapiens
aaagtgtttttcaca

SEQ ID NO: 194420 - DNA, 15 bp, Homo sapiens
taaagtgtttttcac

SEQ ID NO: 194421 - DNA, 15 bp, Homo sapiens
ctaaagtgtttttca

SEQ ID NO: 194422 - DNA, 15 bp, Homo sapiens
actaaagtgtttttc

SEQ ID NO: 194423 - DNA, 15 bp, Homo sapiens
aactaaagtgttttt

SEQ ID NO: 194424 - DNA, 15 bp, Homo sapiens
taactaaagtgtttt

SEQ ID NO: 194425 - DNA, 15 bp, Homo sapiens
ataactaaagtgttt

SEQ ID NO: 194426 - DNA, 15 bp, Homo sapiens
tataactaaagtgtt

SEQ ID NO: 194427 - DNA, 15 bp, Homo sapiens
ctataactaaagtgt

SEQ ID NO: 194428 - DNA, 15 bp, Homo sapiens
actataactaaagtg

SEQ ID NO: 194429 - DNA, 15 bp, Homo sapiens
aactataactaaagt

SEQ ID NO: 194430 - DNA, 15 bp, Homo sapiens
taactataactaaag

SEQ ID NO: 194431 - DNA, 15 bp, Homo sapiens
ataactataactaaa

SEQ ID NO: 194432 - DNA, 15 bp, Homo sapiens
cataactataactaa

SEQ ID NO: 194433 - DNA, 15 bp, Homo sapiens
acataactataacta

SEQ ID NO: 194434 - DNA, 15 bp, Homo sapiens
tacataactataact

SEQ ID NO: 194435 - DNA, 15 bp, Homo sapiens
ttacataactataac

SEQ ID NO: 194436 - DNA, 15 bp, Homo sapiens
attacataactataa

SEQ ID NO: 194437 - DNA, 15 bp, Homo sapiens
tattacataactata

SEQ ID NO: 194438 - DNA, 15 bp, Homo sapiens
atattacataactat

SEQ ID NO: 194439 - DNA, 15 bp, Homo sapiens
gatattacataacta

SEQ ID NO: 194440 - DNA, 15 bp, Homo sapiens
agatattacataact

SEQ ID NO: 194441 - DNA, 15 bp, Homo sapiens
aagatattacataac

SEQ ID NO: 194442 - DNA, 15 bp, Homo sapiens
taagatattacataa

SEQ ID NO: 194443 - DNA, 15 bp, Homo sapiens
ctaagatattacata

SEQ ID NO: 194444 - DNA, 15 bp, Homo sapiens
actaagatattacat

SEQ ID NO: 194445 - DNA, 15 bp, Homo sapiens
cactaagatattaca

SEQ ID NO: 194446 - DNA, 15 bp, Homo sapiens
tcactaagatattac

SEQ ID NO: 194447 - DNA, 15 bp, Homo sapiens
gtcactaagatatta

SEQ ID NO: 194448 - DNA, 15 bp, Homo sapiens
ggtcactaagatatt

SEQ ID NO: 194449 - DNA, 15 bp, Homo sapiens
aggtcactaagatat

SEQ ID NO: 194450 - DNA, 15 bp, Homo sapiens
gaggtcactaagata

SEQ ID NO: 194451 - DNA, 15 bp, Homo sapiens
agaggtcactaagat

SEQ ID NO: 194452 - DNA, 15 bp, Homo sapiens
cagaggtcactaaga

SEQ ID NO: 194453 - DNA, 15 bp, Homo sapiens
acagaggtcactaag

SEQ ID NO: 194454 - DNA, 15 bp, Homo sapiens
tacagaggtcactaa

SEQ ID NO: 194455 - DNA, 15 bp, Homo sapiens
ttacagaggtcacta

SEQ ID NO: 194456 - DNA, 15 bp, Homo sapiens
cttacagaggtcact

SEQ ID NO: 194457 - DNA, 15 bp, Homo sapiens
tcttacagaggtcac

SEQ ID NO: 194458 - DNA, 15 bp, Homo sapiens
atcttacagaggtca

SEQ ID NO: 194459 - DNA, 15 bp, Homo sapiens
catcttacagaggtc

SEQ ID NO: 194460 - DNA, 15 bp, Homo sapiens
acatcttacagaggt

SEQ ID NO: 194461 - DNA, 15 bp, Homo sapiens
tacatcttacagagg

SEQ ID NO: 194462 - DNA, 15 bp, Homo sapiens
ttacatcttacagag

SEQ ID NO: 194463 - DNA, 15 bp, Homo sapiens
attacatcttacaga

SEQ ID NO: 194464 - DNA, 15 bp, Homo sapiens
tattacatcttacag

SEQ ID NO: 194465 - DNA, 15 bp, Homo sapiens
atattacatcttaca

SEQ ID NO: 194466 - DNA, 15 bp, Homo sapiens
aatattacatcttac

SEQ ID NO: 194467 - DNA, 15 bp, Homo sapiens
aaatattacatctta

SEQ ID NO: 194468 - DNA, 15 bp, Homo sapiens
aaaatattacatctt

SEQ ID NO: 194469 - DNA, 15 bp, Homo sapiens
taaaatattacatct

SEQ ID NO: 194470 - DNA, 15 bp, Homo sapiens
ttaaaatattacatc

SEQ ID NO: 194471 - DNA, 15 bp, Homo sapiens
cttaaaatattacat

SEQ ID NO: 194472 - DNA, 15 bp, Homo sapiens
ccttaaaatattaca

SEQ ID NO: 194473 - DNA, 15 bp, Homo sapiens
cccttaaaatattac

SEQ ID NO: 194474 - DNA, 15 bp, Homo sapiens
tcccttaaaatatta

SEQ ID NO: 194475 - DNA, 15 bp, Homo sapiens
ttcccttaaaatatt

SEQ ID NO: 194476 - DNA, 15 bp, Homo sapiens
cttcccttaaaatat

SEQ ID NO: 194477 - DNA, 15 bp, Homo sapiens
acttcccttaaaata

SEQ ID NO: 194478 - DNA, 15 bp, Homo sapiens
aacttcccttaaaat

SEQ ID NO: 194479 - DNA, 15 bp, Homo sapiens
aaacttcccttaaaa

SEQ ID NO: 194480 - DNA, 15 bp, Homo sapiens
aaaacttcccttaaa

SEQ ID NO: 194481 - DNA, 15 bp, Homo sapiens
taaaacttcccttaa

SEQ ID NO: 194482 - DNA, 15 bp, Homo sapiens
gtaaaacttccctta

SEQ ID NO: 194483 - DNA, 15 bp, Homo sapiens
ggtaaaacttccctt

SEQ ID NO: 194484 - DNA, 15 bp, Homo sapiens
aggtaaaacttccct

SEQ ID NO: 194485 - DNA, 15 bp, Homo sapiens
taggtaaaacttccc

SEQ ID NO: 194486 - DNA, 15 bp, Homo sapiens
ataggtaaaacttcc

SEQ ID NO: 194487 - DNA, 15 bp, Homo sapiens
cataggtaaaacttc

SEQ ID NO: 194488 - DNA, 15 bp, Homo sapiens
acataggtaaaactt

SEQ ID NO: 194489 - DNA, 15 bp, Homo sapiens
cacataggtaaaact

SEQ ID NO: 194490 - DNA, 15 bp, Homo sapiens
tcacataggtaaaac

SEQ ID NO: 194491 - DNA, 15 bp, Homo sapiens
ttcacataggtaaaa

SEQ ID NO: 194492 - DNA, 15 bp, Homo sapiens
tttcacataggtaaa

SEQ ID NO: 194493 - DNA, 15 bp, Homo sapiens
ttttcacataggtaa

SEQ ID NO: 194494 - DNA, 15 bp, Homo sapiens
gttttcacataggta

SEQ ID NO: 194495 - DNA, 15 bp, Homo sapiens
cgttttcacataggt

SEQ ID NO: 194496 - DNA, 15 bp, Homo sapiens
ccgttttcacatagg

SEQ ID NO: 194497 - DNA, 15 bp, Homo sapiens
cccgttttcacatag

SEQ ID NO: 194498 - DNA, 15 bp, Homo sapiens
tcccgttttcacata

SEQ ID NO: 194499 - DNA, 15 bp, Homo sapiens
ctcccgttttcacat

SEQ ID NO: 194500 - DNA, 15 bp, Homo sapiens
tctcccgttttcaca

SEQ ID NO: 194501 - DNA, 15 bp, Homo sapiens
ctctcccgttttcac

SEQ ID NO: 194502 - DNA, 15 bp, Homo sapiens
actctcccgttttca

SEQ ID NO: 194503 - DNA, 15 bp, Homo sapiens
tactctcccgttttc

SEQ ID NO: 194504 - DNA, 15 bp, Homo sapiens
ttactctcccgtttt

SEQ ID NO: 194505 - DNA, 15 bp, Homo sapiens
cttactctcccgttt

SEQ ID NO: 194506 - DNA, 15 bp, Homo sapiens
tcttactctcccgtt

SEQ ID NO: 194507 - DNA, 15 bp, Homo sapiens
ctcttactctcccgt

SEQ ID NO: 194508 - DNA, 15 bp, Homo sapiens
actcttactctcccg

SEQ ID NO: 194509 - DNA, 15 bp, Homo sapiens
gactcttactctccc

SEQ ID NO: 194510 - DNA, 15 bp, Homo sapiens
agactcttactctcc

SEQ ID NO: 194511 - DNA, 15 bp, Homo sapiens
cagactcttactctc

SEQ ID NO: 194512 - DNA, 15 bp, Homo sapiens
acagactcttactct

SEQ ID NO: 194513 - DNA, 15 bp, Homo sapiens
aacagactcttactc

SEQ ID NO: 194514 - DNA, 15 bp, Homo sapiens
caacagactcttact

SEQ ID NO: 194515 - DNA, 15 bp, Homo sapiens
ccaacagactcttac

SEQ ID NO: 194516 - DNA, 15 bp, Homo sapiens
tccaacagactctta

SEQ ID NO: 194517 - DNA, 15 bp, Homo sapiens
atccaacagactctt

SEQ ID NO: 194518 - DNA, 15 bp, Homo sapiens
tatccaacagactct

SEQ ID NO: 194519 - DNA, 15 bp, Homo sapiens
atatccaacagactc

SEQ ID NO: 194520 - DNA, 15 bp, Homo sapiens
aatatccaacagact

SEQ ID NO: 194521 - DNA, 15 bp, Homo sapiens
taatatccaacagac

SEQ ID NO: 194522 - DNA, 15 bp, Homo sapiens
ctaatatccaacaga

SEQ ID NO: 194523 - DNA, 15 bp, Homo sapiens
cctaatatccaacag

SEQ ID NO: 194524 - DNA, 15 bp, Homo sapiens
gcctaatatccaaca

SEQ ID NO: 194525 - DNA, 15 bp, Homo sapiens
tgcctaatatccaac

SEQ ID NO: 194526 - DNA, 15 bp, Homo sapiens
ttgcctaatatccaa

SEQ ID NO: 194527 - DNA, 15 bp, Homo sapiens
tttgcctaatatcca

SEQ ID NO: 194528 - DNA, 15 bp, Homo sapiens
ctttgcctaatatcc

SEQ ID NO: 194529 - DNA, 15 bp, Homo sapiens
actttgcctaatatc

SEQ ID NO: 194530 - DNA, 15 bp, Homo sapiens
aactttgcctaatat

SEQ ID NO: 194531 - DNA, 15 bp, Homo sapiens
gaactttgcctaata

SEQ ID NO: 194532 - DNA, 15 bp, Homo sapiens
tgaactttgcctaat

SEQ ID NO: 194533 - DNA, 15 bp, Homo sapiens
ctgaactttgcctaa

SEQ ID NO: 194534 - DNA, 15 bp, Homo sapiens
actgaactttgccta

SEQ ID NO: 194535 - DNA, 15 bp, Homo sapiens
cactgaactttgcct

SEQ ID NO: 194536 - DNA, 15 bp, Homo sapiens
tcactgaactttgcc

SEQ ID NO: 194537 - DNA, 15 bp, Homo sapiens
atcactgaactttgc

SEQ ID NO: 194538 - DNA, 15 bp, Homo sapiens
aatcactgaactttg

SEQ ID NO: 194539 - DNA, 15 bp, Homo sapiens
aaatcactgaacttt

SEQ ID NO: 194540 - DNA, 15 bp, Homo sapiens
caaatcactgaactt

SEQ ID NO: 194541 - DNA, 15 bp, Homo sapiens
ccaaatcactgaact

SEQ ID NO: 194542 - DNA, 15 bp, Homo sapiens
gccaaatcactgaac

SEQ ID NO: 194543 - DNA, 15 bp, Homo sapiens
tgccaaatcactgaa

SEQ ID NO: 194544 - DNA, 15 bp, Homo sapiens
ttgccaaatcactga

SEQ ID NO: 194545 - DNA, 15 bp, Homo sapiens
gttgccaaatcactg

SEQ ID NO: 194546 - DNA, 15 bp, Homo sapiens
tgttgccaaatcact

SEQ ID NO: 194547 - DNA, 15 bp, Homo sapiens
ttgttgccaaatcac

SEQ ID NO: 194548 - DNA, 15 bp, Homo sapiens
gttgttgccaaatca

SEQ ID NO: 194549 - DNA, 15 bp, Homo sapiens
tgttgttgccaaatc

SEQ ID NO: 194550 - DNA, 15 bp, Homo sapiens
ctgttgttgccaaat

SEQ ID NO: 194551 - DNA, 15 bp, Homo sapiens
actgttgttgccaaa

SEQ ID NO: 194552 - DNA, 15 bp, Homo sapiens
aactgttgttgccaa

SEQ ID NO: 194553 - DNA, 15 bp, Homo sapiens
caactgttgttgcca

SEQ ID NO: 194554 - DNA, 15 bp, Homo sapiens
acaactgttgttgcc

SEQ ID NO: 194555 - DNA, 15 bp, Homo sapiens
tacaactgttgttgc

SEQ ID NO: 194556 - DNA, 15 bp, Homo sapiens
atacaactgttgttg

SEQ ID NO: 194557 - DNA, 15 bp, Homo sapiens
tatacaactgttgtt

SEQ ID NO: 194558 - DNA, 15 bp, Homo sapiens
ttatacaactgttgt

SEQ ID NO: 194559 - DNA, 15 bp, Homo sapiens
cttatacaactgttg

SEQ ID NO: 194560 - DNA, 15 bp, Homo sapiens
tcttatacaactgtt

SEQ ID NO: 194561 - DNA, 15 bp, Homo sapiens
atcttatacaactgt

SEQ ID NO: 194562 - DNA, 15 bp, Homo sapiens
aatcttatacaactg

SEQ ID NO: 194563 - DNA, 15 bp, Homo sapiens
aaatcttatacaact

SEQ ID NO: 194564 - DNA, 15 bp, Homo sapiens
gaaatcttatacaac

SEQ ID NO: 194565 - DNA, 15 bp, Homo sapiens
tgaaatcttatacaa

SEQ ID NO: 194566 - DNA, 15 bp, Homo sapiens
ttgaaatcttataca

SEQ ID NO: 194567 - DNA, 15 bp, Homo sapiens
tttgaaatcttatac

SEQ ID NO: 194568 - DNA, 15 bp, Homo sapiens
ttttgaaatcttata

SEQ ID NO: 194569 - DNA, 15 bp, Homo sapiens
tttttgaaatcttat

SEQ ID NO: 194570 - DNA, 15 bp, Homo sapiens
atttttgaaatctta

SEQ ID NO: 194571 - DNA, 15 bp, Homo sapiens
aatttttgaaatctt

SEQ ID NO: 194572 - DNA, 15 bp, Homo sapiens
caatttttgaaatct

SEQ ID NO: 194573 - DNA, 15 bp, Homo sapiens
gcaatttttgaaatc

SEQ ID NO: 194574 - DNA, 15 bp, Homo sapiens
agcaatttttgaaat

SEQ ID NO: 194575 - DNA, 15 bp, Homo sapiens
tagcaatttttgaaa

SEQ ID NO: 194576 - DNA, 15 bp, Homo sapiens
ttagcaatttttgaa

SEQ ID NO: 194577 - DNA, 15 bp, Homo sapiens
attagcaatttttga

SEQ ID NO: 194578 - DNA, 15 bp, Homo sapiens
aattagcaatttttg

SEQ ID NO: 194579 - DNA, 15 bp, Homo sapiens
caattagcaattttt

SEQ ID NO: 194580 - DNA, 15 bp, Homo sapiens
tcaattagcaatttt

SEQ ID NO: 194581 - DNA, 15 bp, Homo sapiens
ttcaattagcaattt

SEQ ID NO: 194582 - DNA, 15 bp, Homo sapiens
attcaattagcaatt

SEQ ID NO: 194583 - DNA, 15 bp, Homo sapiens
gattcaattagcaat

SEQ ID NO: 194584 - DNA, 15 bp, Homo sapiens
agattcaattagcaa

SEQ ID NO: 194585 - DNA, 15 bp, Homo sapiens
cagattcaattagca

SEQ ID NO: 194586 - DNA, 15 bp, Homo sapiens
tcagattcaattagc

SEQ ID NO: 194587 - DNA, 15 bp, Homo sapiens
atcagattcaattag

SEQ ID NO: 194588 - DNA, 15 bp, Homo sapiens
tatcagattcaatta

SEQ ID NO: 194589 - DNA, 15 bp, Homo sapiens
atatcagattcaatt

SEQ ID NO: 194590 - DNA, 15 bp, Homo sapiens
tatatcagattcaat

SEQ ID NO: 194591 - DNA, 15 bp, Homo sapiens
gtatatcagattcaa

SEQ ID NO: 194592 - DNA, 15 bp, Homo sapiens
ggtatatcagattca

SEQ ID NO: 194593 - DNA, 15 bp, Homo sapiens
tggtatatcagattc

SEQ ID NO: 194594 - DNA, 15 bp, Homo sapiens
ttggtatatcagatt

SEQ ID NO: 194595 - DNA, 15 bp, Homo sapiens
gttggtatatcagat

SEQ ID NO: 194596 - DNA, 15 bp, Homo sapiens
tgttggtatatcaga

SEQ ID NO: 194597 - DNA, 15 bp, Homo sapiens
atgttggtatatcag

SEQ ID NO: 194598 - DNA, 15 bp, Homo sapiens
gatgttggtatatca

SEQ ID NO: 194599 - DNA, 15 bp, Homo sapiens
agatgttggtatatc

SEQ ID NO: 194600 - DNA, 15 bp, Homo sapiens
tagatgttggtatat

SEQ ID NO: 194601 - DNA, 15 bp, Homo sapiens
ttagatgttggtata

SEQ ID NO: 194602 - DNA, 15 bp, Homo sapiens
gttagatgttggtat

SEQ ID NO: 194603 - DNA, 15 bp, Homo sapiens
agttagatgttggta

SEQ ID NO: 194604 - DNA, 15 bp, Homo sapiens
tagttagatgttggt

SEQ ID NO: 194605 - DNA, 15 bp, Homo sapiens
ctagttagatgttgg

SEQ ID NO: 194606 - DNA, 15 bp, Homo sapiens
gctagttagatgttg

SEQ ID NO: 194607 - DNA, 15 bp, Homo sapiens
agctagttagatgtt

SEQ ID NO: 194608 - DNA, 15 bp, Homo sapiens
cagctagttagatgt

SEQ ID NO: 194609 - DNA, 15 bp, Homo sapiens
ccagctagttagatg

SEQ ID NO: 194610 - DNA, 15 bp, Homo sapiens
accagctagttagat

SEQ ID NO: 194611 - DNA, 15 bp, Homo sapiens
taccagctagttaga

SEQ ID NO: 194612 - DNA, 15 bp, Homo sapiens
gtaccagctagttag

SEQ ID NO: 194613 - DNA, 15 bp, Homo sapiens
tgtaccagctagtta

SEQ ID NO: 194614 - DNA, 15 bp, Homo sapiens
atgtaccagctagtt

SEQ ID NO: 194615 - DNA, 15 bp, Homo sapiens
catgtaccagctagt

SEQ ID NO: 194616 - DNA, 15 bp, Homo sapiens
tcatgtaccagctag

SEQ ID NO: 194617 - DNA, 15 bp, Homo sapiens
ttcatgtaccagcta

SEQ ID NO: 194618 - DNA, 15 bp, Homo sapiens
gttcatgtaccagct

SEQ ID NO: 194619 - DNA, 15 bp, Homo sapiens
agttcatgtaccagc

SEQ ID NO: 194620 - DNA, 15 bp, Homo sapiens
tagttcatgtaccag

SEQ ID NO: 194621 - DNA, 15 bp, Homo sapiens
atagttcatgtacca

SEQ ID NO: 194622 - DNA, 15 bp, Homo sapiens
tatagttcatgtacc

SEQ ID NO: 194623 - DNA, 15 bp, Homo sapiens
ctatagttcatgtac

SEQ ID NO: 194624 - DNA, 15 bp, Homo sapiens
tctatagttcatgta

SEQ ID NO: 194625 - DNA, 15 bp, Homo sapiens
atctatagttcatgt

SEQ ID NO: 194626 - DNA, 15 bp, Homo sapiens
aatctatagttcatg

SEQ ID NO: 194627 - DNA, 15 bp, Homo sapiens
taatctatagttcat

SEQ ID NO: 194628 - DNA, 15 bp, Homo sapiens
gtaatctatagttca

SEQ ID NO: 194629 - DNA, 15 bp, Homo sapiens
tgtaatctatagttc

SEQ ID NO: 194630 - DNA, 15 bp, Homo sapiens
ttgtaatctatagtt

SEQ ID NO: 194631 - DNA, 15 bp, Homo sapiens
attgtaatctatagt

SEQ ID NO: 194632 - DNA, 15 bp, Homo sapiens
tattgtaatctatag

SEQ ID NO: 194633 - DNA, 15 bp, Homo sapiens
gtattgtaatctata

SEQ ID NO: 194634 - DNA, 15 bp, Homo sapiens
tgtattgtaatctat

SEQ ID NO: 194635 - DNA, 15 bp, Homo sapiens
atgtattgtaatcta

SEQ ID NO: 194636 - DNA, 15 bp, Homo sapiens
aatgtattgtaatct

SEQ ID NO: 194637 - DNA, 15 bp, Homo sapiens
aaatgtattgtaatc

SEQ ID NO: 194638 - DNA, 15 bp, Homo sapiens
aaaatgtattgtaat

SEQ ID NO: 194639 - DNA, 15 bp, Homo sapiens
aaaaatgtattgtaa

SEQ ID NO: 194640 - DNA, 15 bp, Homo sapiens
aaaaaatgtattgta

SEQ ID NO: 194641 - DNA, 15 bp, Homo sapiens
taaaaaatgtattgt

SEQ ID NO: 194642 - DNA, 15 bp, Homo sapiens
ttaaaaaatgtattg

SEQ ID NO: 194643 - DNA, 15 bp, Homo sapiens
tttaaaaaatgtatt

SEQ ID NO: 194644 - DNA, 15 bp, Homo sapiens
ttttaaaaaatgtat

SEQ ID NO: 194645 - DNA, 15 bp, Homo sapiens
tttttaaaaaatgta

SEQ ID NO: 194646 - DNA, 15 bp, Homo sapiens
ttttttaaaaaatgt

SEQ ID NO: 194647 - DNA, 15 bp, Homo sapiens
tttttttaaaaaatg

SEQ ID NO: 194648 - DNA, 15 bp, Homo sapiens
caatttttttaaaaa

SEQ ID NO: 194649 - DNA, 15 bp, Homo sapiens
tcaatttttttaaaa

SEQ ID NO: 194650 - DNA, 15 bp, Homo sapiens
ctcaatttttttaaa

SEQ ID NO: 194651 - DNA, 15 bp, Homo sapiens
cctcaatttttttaa

SEQ ID NO: 194652 - DNA, 15 bp, Homo sapiens
tcctcaattttttta

SEQ ID NO: 194653 - DNA, 15 bp, Homo sapiens
ctcctcaattttttt

SEQ ID NO: 194654 - DNA, 15 bp, Homo sapiens
actcctcaatttttt

SEQ ID NO: 194655 - DNA, 15 bp, Homo sapiens
gactcctcaattttt

SEQ ID NO: 194656 - DNA, 15 bp, Homo sapiens
tgactcctcaatttt

SEQ ID NO: 194657 - DNA, 15 bp, Homo sapiens
ctgactcctcaattt

SEQ ID NO: 194658 - DNA, 15 bp, Homo sapiens
actgactcctcaatt

SEQ ID NO: 194659 - DNA, 15 bp, Homo sapiens
cactgactcctcaat

SEQ ID NO: 194660 - DNA, 15 bp, Homo sapiens
acactgactcctcaa

SEQ ID NO: 194661 - DNA, 15 bp, Homo sapiens
tacactgactcctca

SEQ ID NO: 194662 - DNA, 15 bp, Homo sapiens
atacactgactcctc

SEQ ID NO: 194663 - DNA, 15 bp, Homo sapiens
aatacactgactcct

SEQ ID NO: 194664 - DNA, 15 bp, Homo sapiens
caatacactgactcc

SEQ ID NO: 194665 - DNA, 15 bp, Homo sapiens
tcaatacactgactc

SEQ ID NO: 194666 - DNA, 15 bp, Homo sapiens
ttcaatacactgact

SEQ ID NO: 194667 - DNA, 15 bp, Homo sapiens
gttcaatacactgac

SEQ ID NO: 194668 - DNA, 15 bp, Homo sapiens
tgttcaatacactga

SEQ ID NO: 194669 - DNA, 15 bp, Homo sapiens
gtgttcaatacactg

SEQ ID NO: 194670 - DNA, 15 bp, Homo sapiens
ggtgttcaatacact

SEQ ID NO: 194671 - DNA, 15 bp, Homo sapiens
aggtgttcaatacac

SEQ ID NO: 194672 - DNA, 15 bp, Homo sapiens
aaggtgttcaataca

SEQ ID NO: 194673 - DNA, 15 bp, Homo sapiens
aaaggtgttcaatac

SEQ ID NO: 194674 - DNA, 15 bp, Homo sapiens
aaaaggtgttcaata

SEQ ID NO: 194675 - DNA, 15 bp, Homo sapiens
taaaaggtgttcaat

SEQ ID NO: 194676 - DNA, 15 bp, Homo sapiens
ttaaaaggtgttcaa

SEQ ID NO: 194677 - DNA, 15 bp, Homo sapiens
tttaaaaggtgttca

SEQ ID NO: 194678 - DNA, 15 bp, Homo sapiens
tttttaaaaggtgtt

SEQ ID NO: 194679 - DNA, 15 bp, Homo sapiens
ttttttaaaaggtgt

SEQ ID NO: 194680 - DNA, 15 bp, Homo sapiens
attttttaaaaggtg

SEQ ID NO: 194681 - DNA, 15 bp, Homo sapiens
aattttttaaaaggt

SEQ ID NO: 194682 - DNA, 15 bp, Homo sapiens
aaattttttaaaagg

SEQ ID NO: 194683 - DNA, 15 bp, Homo sapiens
gaaattttttaaaag

SEQ ID NO: 194684 - DNA, 15 bp, Homo sapiens
tgaaattttttaaaa

SEQ ID NO: 194685 - DNA, 15 bp, Homo sapiens
ttgaaattttttaaa

SEQ ID NO: 194686 - DNA, 15 bp, Homo sapiens
attgaaattttttaa

SEQ ID NO: 194687 - DNA, 15 bp, Homo sapiens
aattgaaatttttta

SEQ ID NO: 194688 - DNA, 15 bp, Homo sapiens
aaattgaaatttttt

SEQ ID NO: 194689 - DNA, 15 bp, Homo sapiens
taaattgaaattttt

SEQ ID NO: 194690 - DNA, 15 bp, Homo sapiens
ttaaattgaaatttt

SEQ ID NO: 194691 - DNA, 15 bp, Homo sapiens
cttaaattgaaattt

SEQ ID NO: 194692 - DNA, 15 bp, Homo sapiens
acttaaattgaaatt

SEQ ID NO: 194693 - DNA, 15 bp, Homo sapiens
aacttaaattgaaat

SEQ ID NO: 194694 - DNA, 15 bp, Homo sapiens
gaacttaaattgaaa

SEQ ID NO: 194695 - DNA, 15 bp, Homo sapiens
agaacttaaattgaa

SEQ ID NO: 194696 - DNA, 15 bp, Homo sapiens
cagaacttaaattga

SEQ ID NO: 194697 - DNA, 15 bp, Homo sapiens
ccagaacttaaattg

SEQ ID NO: 194698 - DNA, 15 bp, Homo sapiens
cccagaacttaaatt

SEQ ID NO: 194699 - DNA, 15 bp, Homo sapiens
tcccagaacttaaat

SEQ ID NO: 194700 - DNA, 15 bp, Homo sapiens
agcacatgtatccca

SEQ ID NO: 194701 - DNA, 15 bp, Homo sapiens
cagcacatgtatccc

SEQ ID NO: 194702 - DNA, 15 bp, Homo sapiens
tcagcacatgtatcc

SEQ ID NO: 194703 - DNA, 15 bp, Homo sapiens
ttcagcacatgtatc

SEQ ID NO: 194704 - DNA, 15 bp, Homo sapiens
gttcagcacatgtat

SEQ ID NO: 194705 - DNA, 15 bp, Homo sapiens
cgttcagcacatgta

SEQ ID NO: 194706 - DNA, 15 bp, Homo sapiens
acgttcagcacatgt

SEQ ID NO: 194707 - DNA, 15 bp, Homo sapiens
cacgttcagcacatg

SEQ ID NO: 194708 - DNA, 15 bp, Homo sapiens
gcacgttcagcacat

SEQ ID NO: 194709 - DNA, 15 bp, Homo sapiens
tgcacgttcagcaca

SEQ ID NO: 194710 - DNA, 15 bp, Homo sapiens
ctgcacgttcagcac

SEQ ID NO: 194711 - DNA, 15 bp, Homo sapiens
cctgcacgttcagca

SEQ ID NO: 194712 - DNA, 15 bp, Homo sapiens
acctgcacgttcagc

SEQ ID NO: 194713 - DNA, 15 bp, Homo sapiens
aacctgcacgttcag

SEQ ID NO: 194714 - DNA, 15 bp, Homo sapiens
aaacctgcacgttca

SEQ ID NO: 194715 - DNA, 15 bp, Homo sapiens
gaacaaacctgcacg

SEQ ID NO: 194716 - DNA, 15 bp, Homo sapiens
ggaacaaacctgcac

SEQ ID NO: 194717 - DNA, 15 bp, Homo sapiens
tggaacaaacctgca

SEQ ID NO: 194718 - DNA, 15 bp, Homo sapiens
atggaacaaacctgc

SEQ ID NO: 194719 - DNA, 15 bp, Homo sapiens
tatggaacaaacctg

SEQ ID NO: 194720 - DNA, 15 bp, Homo sapiens
ctatggaacaaacct

SEQ ID NO: 194721 - DNA, 15 bp, Homo sapiens
cctatggaacaaacc

SEQ ID NO: 194722 - DNA, 15 bp, Homo sapiens
acctatggaacaaac

SEQ ID NO: 194723 - DNA, 15 bp, Homo sapiens
cacctatggaacaaa

SEQ ID NO: 194724 - DNA, 15 bp, Homo sapiens
acacctatggaacaa

SEQ ID NO: 194725 - DNA, 15 bp, Homo sapiens
tacacctatggaaca

SEQ ID NO: 194726 - DNA, 15 bp, Homo sapiens
gtacacctatggaac

SEQ ID NO: 194727 - DNA, 15 bp, Homo sapiens
tgtacacctatggaa

SEQ ID NO: 194728 - DNA, 15 bp, Homo sapiens
atgtacacctatgga

SEQ ID NO: 194729 - DNA, 15 bp, Homo sapiens
catgtacacctatgg

SEQ ID NO: 194730 - DNA, 15 bp, Homo sapiens
acatgtacacctatg

SEQ ID NO: 194731 - DNA, 15 bp, Homo sapiens
cacatgtacacctat

SEQ ID NO: 194732 - DNA, 15 bp, Homo sapiens
tcacatgtacaccta

SEQ ID NO: 194733 - DNA, 15 bp, Homo sapiens
gtcacatgtacacct

SEQ ID NO: 194734 - DNA, 15 bp, Homo sapiens
tgtcacatgtacacc

SEQ ID NO: 194735 - DNA, 15 bp, Homo sapiens
atgtcacatgtacac

SEQ ID NO: 194736 - DNA, 15 bp, Homo sapiens
catgtcacatgtaca

SEQ ID NO: 194737 - DNA, 15 bp, Homo sapiens
ccatgtcacatgtac

SEQ ID NO: 194738 - DNA, 15 bp, Homo sapiens
accatgtcacatgta

SEQ ID NO: 194739 - DNA, 15 bp, Homo sapiens
caccatgtcacatgt

SEQ ID NO: 194740 - DNA, 15 bp, Homo sapiens
ccaccatgtcacatg

SEQ ID NO: 194741 - DNA, 15 bp, Homo sapiens
accaccatgtcacat

SEQ ID NO: 194742 - DNA, 15 bp, Homo sapiens
aaccaccatgtcaca

SEQ ID NO: 194743 - DNA, 15 bp, Homo sapiens
aaaccaccatgtcac

SEQ ID NO: 194744 - DNA, 15 bp, Homo sapiens
caaaccaccatgtca

SEQ ID NO: 194745 - DNA, 15 bp, Homo sapiens
gcaaaccaccatgtc

SEQ ID NO: 194746 - DNA, 15 bp, Homo sapiens
agcaaaccaccatgt

SEQ ID NO: 194747 - DNA, 15 bp, Homo sapiens
cagcaaaccaccatg

SEQ ID NO: 194748 - DNA, 15 bp, Homo sapiens
gcagcaaaccaccat

SEQ ID NO: 194749 - DNA, 15 bp, Homo sapiens
gggttgataggtgca

SEQ ID NO: 194750 - DNA, 15 bp, Homo sapiens
tgggttgataggtgc

SEQ ID NO: 194751 - DNA, 15 bp, Homo sapiens
atgggttgataggtg

SEQ ID NO: 194752 - DNA, 15 bp, Homo sapiens
gatgggttgataggt

SEQ ID NO: 194753 - DNA, 15 bp, Homo sapiens
ctagatgatgggttg

SEQ ID NO: 194754 - DNA, 15 bp, Homo sapiens
cctagatgatgggtt

SEQ ID NO: 194755 - DNA, 15 bp, Homo sapiens
acctagatgatgggt

SEQ ID NO: 194756 - DNA, 15 bp, Homo sapiens
aacctagatgatggg

SEQ ID NO: 194757 - DNA, 15 bp, Homo sapiens
aaacctagatgatgg

SEQ ID NO: 194758 - DNA, 15 bp, Homo sapiens
aaaacctagatgatg

SEQ ID NO: 194759 - DNA, 15 bp, Homo sapiens
taaaacctagatgat

SEQ ID NO: 194760 - DNA, 15 bp, Homo sapiens
attaaaacctagatg

SEQ ID NO: 194761 - DNA, 15 bp, Homo sapiens
gattaaaacctagat

SEQ ID NO: 194762 - DNA, 15 bp, Homo sapiens
ggattaaaacctaga

SEQ ID NO: 194763 - DNA, 15 bp, Homo sapiens
gggattaaaacctag

SEQ ID NO: 194764 - DNA, 15 bp, Homo sapiens
agggattaaaaccta

SEQ ID NO: 194765 - DNA, 15 bp, Homo sapiens
cagggattaaaacct

SEQ ID NO: 194766 - DNA, 15 bp, Homo sapiens
gcagggattaaaacc

SEQ ID NO: 194767 - DNA, 15 bp, Homo sapiens
tgcagggattaaaac

SEQ ID NO: 194768 - DNA, 15 bp, Homo sapiens
atgcagggattaaaa

SEQ ID NO: 194769 - DNA, 15 bp, Homo sapiens
tatgcagggattaaa

SEQ ID NO: 194770 - DNA, 15 bp, Homo sapiens
gtatgcagggattaa

SEQ ID NO: 194771 - DNA, 15 bp, Homo sapiens
tgtatgcagggatta

SEQ ID NO: 194772 - DNA, 15 bp, Homo sapiens
atgtatgcagggatt

SEQ ID NO: 194773 - DNA, 15 bp, Homo sapiens
aatgtatgcagggat

SEQ ID NO: 194774 - DNA, 15 bp, Homo sapiens
taatgtatgcaggga

SEQ ID NO: 194775 - DNA, 15 bp, Homo sapiens
ctaatgtatgcaggg

SEQ ID NO: 194776 - DNA, 15 bp, Homo sapiens
cctaatgtatgcagg

SEQ ID NO: 194777 - DNA, 15 bp, Homo sapiens
acctaatgtatgcag

SEQ ID NO: 194778 - DNA, 15 bp, Homo sapiens
tacctaatgtatgca

SEQ ID NO: 194779 - DNA, 15 bp, Homo sapiens
atacctaatgtatgc

SEQ ID NO: 194780 - DNA, 15 bp, Homo sapiens
aatacctaatgtatg

SEQ ID NO: 194781 - DNA, 15 bp, Homo sapiens
aaatacctaatgtat

SEQ ID NO: 194782 - DNA, 15 bp, Homo sapiens
caaatacctaatgta

SEQ ID NO: 194783 - DNA, 15 bp, Homo sapiens
acaaatacctaatgt

SEQ ID NO: 194784 - DNA, 15 bp, Homo sapiens
gacaaatacctaatg

SEQ ID NO: 194785 - DNA, 15 bp, Homo sapiens
ggacaaatacctaat

SEQ ID NO: 194786 - DNA, 15 bp, Homo sapiens
aggacaaatacctaa

SEQ ID NO: 194787 - DNA, 15 bp, Homo sapiens
taggacaaataccta

SEQ ID NO: 194788 - DNA, 15 bp, Homo sapiens
ttaggacaaatacct

SEQ ID NO: 194789 - DNA, 15 bp, Homo sapiens
attaggacaaatacc

SEQ ID NO: 194790 - DNA, 15 bp, Homo sapiens
cattaggacaaatac

SEQ ID NO: 194791 - DNA, 15 bp, Homo sapiens
gcattaggacaaata

SEQ ID NO: 194792 - DNA, 15 bp, Homo sapiens
aaagggagagcatta

SEQ ID NO: 194793 - DNA, 15 bp, Homo sapiens
gaaagggagagcatt

SEQ ID NO: 194794 - DNA, 15 bp, Homo sapiens
ggaaagggagagcat

SEQ ID NO: 194795 - DNA, 15 bp, Homo sapiens
aggaaagggagagca

SEQ ID NO: 194796 - DNA, 15 bp, Homo sapiens
aaggaaagggagagc

SEQ ID NO: 194797 - DNA, 15 bp, Homo sapiens
aaaggaaagggagag

SEQ ID NO: 194798 - DNA, 15 bp, Homo sapiens
gaaaggaaagggaga

SEQ ID NO: 194799 - DNA, 15 bp, Homo sapiens
cgaaaggaaagggag

SEQ ID NO: 194800 - DNA, 15 bp, Homo sapiens
gcgaaaggaaaggga

SEQ ID NO: 194801 - DNA, 15 bp, Homo sapiens
ggcgaaaggaaaggg

SEQ ID NO: 194802 - DNA, 15 bp, Homo sapiens
gggcgaaaggaaagg

SEQ ID NO: 194803 - DNA, 15 bp, Homo sapiens
agggcgaaaggaaag

SEQ ID NO: 194804 - DNA, 15 bp, Homo sapiens
tagggcgaaaggaaa

SEQ ID NO: 194805 - DNA, 15 bp, Homo sapiens
gtagggcgaaaggaa

SEQ ID NO: 194806 - DNA, 15 bp, Homo sapiens
ggtagggcgaaagga

SEQ ID NO: 194807 - DNA, 15 bp, Homo sapiens
gggtagggcgaaagg

SEQ ID NO: 194808 - DNA, 15 bp, Homo sapiens
ggggtagggcgaaag

SEQ ID NO: 194809 - DNA, 15 bp, Homo sapiens
gggggtagggcgaaa

SEQ ID NO: 194810 - DNA, 15 bp, Homo sapiens
ggggggtagggcgaa

SEQ ID NO: 194811 - DNA, 15 bp, Homo sapiens
cggggggtagggcga

SEQ ID NO: 194812 - DNA, 15 bp, Homo sapiens
tcggggggtagggcg

SEQ ID NO: 194813 - DNA, 15 bp, Homo sapiens
gtcggggggtagggc

SEQ ID NO: 194814 - DNA, 15 bp, Homo sapiens
tgtcggggggtaggg

SEQ ID NO: 194815 - DNA, 15 bp, Homo sapiens
atgtcggggggtagg

SEQ ID NO: 194816 - DNA, 15 bp, Homo sapiens
gatgtcggggggtag

SEQ ID NO: 194817 - DNA, 15 bp, Homo sapiens
ggatgtcggggggta

SEQ ID NO: 194818 - DNA, 15 bp, Homo sapiens
gggatgtcggggggt

SEQ ID NO: 194819 - DNA, 15 bp, Homo sapiens
ggggatgtcgggggg

SEQ ID NO: 194820 - DNA, 15 bp, Homo sapiens
gggggatgtcggggg

SEQ ID NO: 194821 - DNA, 15 bp, Homo sapiens
cgggggatgtcgggg

SEQ ID NO: 194822 - DNA, 15 bp, Homo sapiens
ccgggggatgtcggg

SEQ ID NO: 194823 - DNA, 15 bp, Homo sapiens
accgggggatgtcgg

SEQ ID NO: 194824 - DNA, 15 bp, Homo sapiens
caccgggggatgtcg

SEQ ID NO: 194825 - DNA, 15 bp, Homo sapiens
acaccgggggatgtc

SEQ ID NO: 194826 - DNA, 15 bp, Homo sapiens
cacaccgggggatgt

SEQ ID NO: 194827 - DNA, 15 bp, Homo sapiens
acacaccgggggatg

SEQ ID NO: 194828 - DNA, 15 bp, Homo sapiens
cacacaccgggggat

SEQ ID NO: 194829 - DNA, 15 bp, Homo sapiens
tcacacaccggggga

SEQ ID NO: 194830 - DNA, 15 bp, Homo sapiens
atcacacaccggggg

SEQ ID NO: 194831 - DNA, 15 bp, Homo sapiens
gacatcacacaccgg

SEQ ID NO: 194832 - DNA, 15 bp, Homo sapiens
ggacatcacacaccg

SEQ ID NO: 194833 - DNA, 15 bp, Homo sapiens
gggacatcacacacc

SEQ ID NO: 194834 - DNA, 15 bp, Homo sapiens
ggggacatcacacac

SEQ ID NO: 194835 - DNA, 15 bp, Homo sapiens
aggggacatcacaca

SEQ ID NO: 194836 - DNA, 15 bp, Homo sapiens
aaggggacatcacac

SEQ ID NO: 194837 - DNA, 15 bp, Homo sapiens
gaaggggacatcaca

SEQ ID NO: 194838 - DNA, 15 bp, Homo sapiens
ggaaggggacatcac

SEQ ID NO: 194839 - DNA, 15 bp, Homo sapiens
gggaaggggacatca

SEQ ID NO: 194840 - DNA, 15 bp, Homo sapiens
agggaaggggacatc

SEQ ID NO: 194841 - DNA, 15 bp, Homo sapiens
cagggaaggggacat

SEQ ID NO: 194842 - DNA, 15 bp, Homo sapiens
acagggaaggggaca

SEQ ID NO: 194843 - DNA, 15 bp, Homo sapiens
cacagggaaggggac

SEQ ID NO: 194844 - DNA, 15 bp, Homo sapiens
acacagggaagggga

SEQ ID NO: 194845 - DNA, 15 bp, Homo sapiens
gacacagggaagggg

SEQ ID NO: 194846 - DNA, 15 bp, Homo sapiens
ggacacagggaaggg

SEQ ID NO: 194847 - DNA, 15 bp, Homo sapiens
tggacacagggaagg

SEQ ID NO: 194848 - DNA, 15 bp, Homo sapiens
atggacacagggaag

SEQ ID NO: 194849 - DNA, 15 bp, Homo sapiens
catggacacagggaa

SEQ ID NO: 194850 - DNA, 15 bp, Homo sapiens
aaatgagaacacatg

SEQ ID NO: 194851 - DNA, 15 bp, Homo sapiens
aaaatgagaacacat

SEQ ID NO: 194852 - DNA, 15 bp, Homo sapiens
aaaaatgagaacaca

SEQ ID NO: 194853 - DNA, 15 bp, Homo sapiens
gaaaaatgagaacac

SEQ ID NO: 194854 - DNA, 15 bp, Homo sapiens
tgaaaaatgagaaca

SEQ ID NO: 194855 - DNA, 15 bp, Homo sapiens
ctgaaaaatgagaac

SEQ ID NO: 194856 - DNA, 15 bp, Homo sapiens
gctgaaaaatgagaa

SEQ ID NO: 194857 - DNA, 15 bp, Homo sapiens
agctgaaaaatgaga

SEQ ID NO: 194858 - DNA, 15 bp, Homo sapiens
gagctgaaaaatgag

SEQ ID NO: 194859 - DNA, 15 bp, Homo sapiens
ggagctgaaaaatga

SEQ ID NO: 194860 - DNA, 15 bp, Homo sapiens
gggagctgaaaaatg

SEQ ID NO: 194861 - DNA, 15 bp, Homo sapiens
tgggagctgaaaaat

SEQ ID NO: 194862 - DNA, 15 bp, Homo sapiens
gtgggagctgaaaaa

SEQ ID NO: 194863 - DNA, 15 bp, Homo sapiens
agtgggagctgaaaa

SEQ ID NO: 194864 - DNA, 15 bp, Homo sapiens
aagtgggagctgaaa

SEQ ID NO: 194865 - DNA, 15 bp, Homo sapiens
cataagtgggagctg

SEQ ID NO: 194866 - DNA, 15 bp, Homo sapiens
cgcatgttctcactc

SEQ ID NO: 194867 - DNA, 15 bp, Homo sapiens
caactaacacaggaa

SEQ ID NO: 194868 - DNA, 15 bp, Homo sapiens
gcaactaacacagga

SEQ ID NO: 194869 - DNA, 15 bp, Homo sapiens
agcaactaacacagg

SEQ ID NO: 194870 - DNA, 15 bp, Homo sapiens
cagcaactaacacag

SEQ ID NO: 194871 - DNA, 15 bp, Homo sapiens
tcagcaactaacaca

SEQ ID NO: 194872 - DNA, 15 bp, Homo sapiens
ctcagcaactaacac

SEQ ID NO: 194873 - DNA, 15 bp, Homo sapiens
cctcagcaactaaca

SEQ ID NO: 194874 - DNA, 15 bp, Homo sapiens
tcctcagcaactaac

SEQ ID NO: 194875 - DNA, 15 bp, Homo sapiens
atcctcagcaactaa

SEQ ID NO: 194876 - DNA, 15 bp, Homo sapiens
catcctcagcaacta

SEQ ID NO: 194877 - DNA, 15 bp, Homo sapiens
tcatcctcagcaact

SEQ ID NO: 194878 - DNA, 15 bp, Homo sapiens
atcatcctcagcaac

SEQ ID NO: 194879 - DNA, 15 bp, Homo sapiens
catcatcctcagcaa

SEQ ID NO: 194880 - DNA, 15 bp, Homo sapiens
ccatcatcctcagca

SEQ ID NO: 194881 - DNA, 15 bp, Homo sapiens
accatcatcctcagc

SEQ ID NO: 194882 - DNA, 15 bp, Homo sapiens
aaccatcatcctcag

SEQ ID NO: 194883 - DNA, 15 bp, Homo sapiens
aaaccatcatcctca

SEQ ID NO: 194884 - DNA, 15 bp, Homo sapiens
gaaaccatcatcctc

SEQ ID NO: 194885 - DNA, 15 bp, Homo sapiens
ggaaaccatcatcct

SEQ ID NO: 194886 - DNA, 15 bp, Homo sapiens
tggaaaccatcatcc

SEQ ID NO: 194887 - DNA, 15 bp, Homo sapiens
ctggaaaccatcatc

SEQ ID NO: 194888 - DNA, 15 bp, Homo sapiens
acagccataaaaaag

SEQ ID NO: 194889 - DNA, 15 bp, Homo sapiens
tacagccataaaaaa

SEQ ID NO: 194890 - DNA, 15 bp, Homo sapiens
atacagccataaaaa

SEQ ID NO: 194891 - DNA, 15 bp, Homo sapiens
tatacagccataaaa

SEQ ID NO: 194892 - DNA, 15 bp, Homo sapiens
ctatacagccataaa

SEQ ID NO: 194893 - DNA, 15 bp, Homo sapiens
actatacagccataa

SEQ ID NO: 194894 - DNA, 15 bp, Homo sapiens
tactatacagccata

SEQ ID NO: 194895 - DNA, 15 bp, Homo sapiens
atactatacagccat

SEQ ID NO: 194896 - DNA, 15 bp, Homo sapiens
aatactatacagcca

SEQ ID NO: 194897 - DNA, 15 bp, Homo sapiens
gaatactatacagcc

SEQ ID NO: 194898 - DNA, 15 bp, Homo sapiens
ggaatactatacagc

SEQ ID NO: 194899 - DNA, 15 bp, Homo sapiens
tggaatactatacag

SEQ ID NO: 194900 - DNA, 15 bp, Homo sapiens
atggaatactataca

SEQ ID NO: 194901 - DNA, 15 bp, Homo sapiens
catggaatactatac

SEQ ID NO: 194902 - DNA, 15 bp, Homo sapiens
ccatggaatactata

SEQ ID NO: 194903 - DNA, 15 bp, Homo sapiens
tacaccatggaatac

SEQ ID NO: 194904 - DNA, 15 bp, Homo sapiens
atacaccatggaata

SEQ ID NO: 194905 - DNA, 15 bp, Homo sapiens
tatacaccatggaat

SEQ ID NO: 194906 - DNA, 15 bp, Homo sapiens
atatacaccatggaa

SEQ ID NO: 194907 - DNA, 15 bp, Homo sapiens
caaatgtggcacata

SEQ ID NO: 194908 - DNA, 15 bp, Homo sapiens
gcaaatgtggcacat

SEQ ID NO: 194909 - DNA, 15 bp, Homo sapiens
agcaaatgtggcaca

SEQ ID NO: 194910 - DNA, 15 bp, Homo sapiens
aagcaaatgtggcac

SEQ ID NO: 194911 - DNA, 15 bp, Homo sapiens
aaagcaaatgtggca

SEQ ID NO: 194912 - DNA, 15 bp, Homo sapiens
taaagcaaatgtggc

SEQ ID NO: 194913 - DNA, 15 bp, Homo sapiens
ataaagcaaatgtgg

SEQ ID NO: 194914 - DNA, 15 bp, Homo sapiens
gataaagcaaatgtg

SEQ ID NO: 194915 - DNA, 15 bp, Homo sapiens
ggataaagcaaatgt

SEQ ID NO: 194916 - DNA, 15 bp, Homo sapiens
tggataaagcaaatg

SEQ ID NO: 194917 - DNA, 15 bp, Homo sapiens
ctggataaagcaaat

SEQ ID NO: 194918 - DNA, 15 bp, Homo sapiens
actggataaagcaaa

SEQ ID NO: 194919 - DNA, 15 bp, Homo sapiens
gactggataaagcaa

SEQ ID NO: 194920 - DNA, 15 bp, Homo sapiens
agactggataaagca

SEQ ID NO: 194921 - DNA, 15 bp, Homo sapiens
tagactggataaagc

SEQ ID NO: 194922 - DNA, 15 bp, Homo sapiens
aaaccaacccaaatg

SEQ ID NO: 194923 - DNA, 15 bp, Homo sapiens
gaaaccaacccaaat

SEQ ID NO: 194924 - DNA, 15 bp, Homo sapiens
tgaaaccaacccaaa

SEQ ID NO: 194925 - DNA, 15 bp, Homo sapiens
ttgaaaccaacccaa

SEQ ID NO: 194926 - DNA, 15 bp, Homo sapiens
cttgaaaccaaccca

SEQ ID NO: 194927 - DNA, 15 bp, Homo sapiens
acttgaaaccaaccc

SEQ ID NO: 194928 - DNA, 15 bp, Homo sapiens
gacttgaaaccaacc

SEQ ID NO: 194929 - DNA, 15 bp, Homo sapiens
agacttgaaaccaac

SEQ ID NO: 194930 - DNA, 15 bp, Homo sapiens
aagacttgaaaccaa

SEQ ID NO: 194931 - DNA, 15 bp, Homo sapiens
aaagacttgaaacca

SEQ ID NO: 194932 - DNA, 15 bp, Homo sapiens
caaagacttgaaacc

SEQ ID NO: 194933 - DNA, 15 bp, Homo sapiens
acaaagacttgaaac

SEQ ID NO: 194934 - DNA, 15 bp, Homo sapiens
aacaaagacttgaaa

SEQ ID NO: 194935 - DNA, 15 bp, Homo sapiens
taacaaagacttgaa

SEQ ID NO: 194936 - DNA, 15 bp, Homo sapiens
gtaacaaagacttga

SEQ ID NO: 194937 - DNA, 15 bp, Homo sapiens
agtaacaaagacttg

SEQ ID NO: 194938 - DNA, 15 bp, Homo sapiens
tacagtaacaaagac

SEQ ID NO: 194939 - DNA, 15 bp, Homo sapiens
ttacagtaacaaaga

SEQ ID NO: 194940 - DNA, 15 bp, Homo sapiens
tttacagtaacaaag

SEQ ID NO: 194941 - DNA, 15 bp, Homo sapiens
atttacagtaacaaa

SEQ ID NO: 194942 - DNA, 15 bp, Homo sapiens
tatttacagtaacaa

SEQ ID NO: 194943 - DNA, 15 bp, Homo sapiens
ctatttacagtaaca

SEQ ID NO: 194944 - DNA, 15 bp, Homo sapiens
actatttacagtaac

SEQ ID NO: 194945 - DNA, 15 bp, Homo sapiens
cactatttacagtaa

SEQ ID NO: 194946 - DNA, 15 bp, Homo sapiens
gcactatttacagta

SEQ ID NO: 194947 - DNA, 15 bp, Homo sapiens
agcactatttacagt

SEQ ID NO: 194948 - DNA, 15 bp, Homo sapiens
cagcactatttacag

SEQ ID NO: 194949 - DNA, 15 bp, Homo sapiens
gcagcactatttaca

SEQ ID NO: 194950 - DNA, 15 bp, Homo sapiens
tgcagcactatttac

SEQ ID NO: 194951 - DNA, 15 bp, Homo sapiens
ctgcagcactattta

SEQ ID NO: 194952 - DNA, 15 bp, Homo sapiens
actgcagcactattt

SEQ ID NO: 194953 - DNA, 15 bp, Homo sapiens
tactgcagcactatt

SEQ ID NO: 194954 - DNA, 15 bp, Homo sapiens
ttactgcagcactat

SEQ ID NO: 194955 - DNA, 15 bp, Homo sapiens
tttactgcagcacta

SEQ ID NO: 194956 - DNA, 15 bp, Homo sapiens
gtttactgcagcact

SEQ ID NO: 194957 - DNA, 15 bp, Homo sapiens
tgtttactgcagcac

SEQ ID NO: 194958 - DNA, 15 bp, Homo sapiens
atgtttactgcagca

SEQ ID NO: 194959 - DNA, 15 bp, Homo sapiens
tatgtttactgcagc

SEQ ID NO: 194960 - DNA, 15 bp, Homo sapiens
gtatgtttactgcag

SEQ ID NO: 194961 - DNA, 15 bp, Homo sapiens
tgtatgtttactgca

SEQ ID NO: 194962 - DNA, 15 bp, Homo sapiens
atgtatgtttactgc

SEQ ID NO: 194963 - DNA, 15 bp, Homo sapiens
aatgcacatgtatgt

SEQ ID NO: 194964 - DNA, 15 bp, Homo sapiens
aaatgcacatgtatg

SEQ ID NO: 194965 - DNA, 15 bp, Homo sapiens
caaatgcacatgtat

SEQ ID NO: 194966 - DNA, 15 bp, Homo sapiens
acaaatgcacatgta

SEQ ID NO: 194967 - DNA, 15 bp, Homo sapiens
gacaaatgcacatgt

SEQ ID NO: 194968 - DNA, 15 bp, Homo sapiens
agacaaatgcacatg

SEQ ID NO: 194969 - DNA, 15 bp, Homo sapiens
cagacaaatgcacat

SEQ ID NO: 194970 - DNA, 15 bp, Homo sapiens
acagacaaatgcaca

SEQ ID NO: 194971 - DNA, 15 bp, Homo sapiens
tacagacaaatgcac

SEQ ID NO: 194972 - DNA, 15 bp, Homo sapiens
atacagacaaatgca

SEQ ID NO: 194973 - DNA, 15 bp, Homo sapiens
catacagacaaatgc

SEQ ID NO: 194974 - DNA, 15 bp, Homo sapiens
ccatacagacaaatg

SEQ ID NO: 194975 - DNA, 15 bp, Homo sapiens
accatacagacaaat

SEQ ID NO: 194976 - DNA, 15 bp, Homo sapiens
taccatacagacaaa

SEQ ID NO: 194977 - DNA, 15 bp, Homo sapiens
ctaccatacagacaa

SEQ ID NO: 194978 - DNA, 15 bp, Homo sapiens
tctaccatacagaca

SEQ ID NO: 194979 - DNA, 15 bp, Homo sapiens
ttctaccatacagac

SEQ ID NO: 194980 - DNA, 15 bp, Homo sapiens
attctaccatacaga

SEQ ID NO: 194981 - DNA, 15 bp, Homo sapiens
cattctaccatacag

SEQ ID NO: 194982 - DNA, 15 bp, Homo sapiens
tcattctaccataca

SEQ ID NO: 194983 - DNA, 15 bp, Homo sapiens
atcattctaccatac

SEQ ID NO: 194984 - DNA, 15 bp, Homo sapiens
aatcattctaccata

SEQ ID NO: 194985 - DNA, 15 bp, Homo sapiens
aaatcattctaccat

SEQ ID NO: 194986 - DNA, 15 bp, Homo sapiens
taaatcattctacca

SEQ ID NO: 194987 - DNA, 15 bp, Homo sapiens
ataaatcattctacc

SEQ ID NO: 194988 - DNA, 15 bp, Homo sapiens
ccaaaggattataaa

SEQ ID NO: 194989 - DNA, 15 bp, Homo sapiens
cccaaaggattataa

SEQ ID NO: 194990 - DNA, 15 bp, Homo sapiens
acccaaaggattata

SEQ ID NO: 194991 - DNA, 15 bp, Homo sapiens
tacccaaaggattat

SEQ ID NO: 194992 - DNA, 15 bp, Homo sapiens
atacccaaaggatta

SEQ ID NO: 194993 - DNA, 15 bp, Homo sapiens
tatacccaaaggatt

SEQ ID NO: 194994 - DNA, 15 bp, Homo sapiens
atatacccaaaggat

SEQ ID NO: 194995 - DNA, 15 bp, Homo sapiens
tactgggtatatacc

SEQ ID NO: 194996 - DNA, 15 bp, Homo sapiens
ttactgggtatatac

SEQ ID NO: 194997 - DNA, 15 bp, Homo sapiens
gaatcccattactgg

SEQ ID NO: 194998 - DNA, 15 bp, Homo sapiens
agaatcccattactg

SEQ ID NO: 194999 - DNA, 15 bp, Homo sapiens
cagaatcccattact

SEQ ID NO: 195000 - DNA, 15 bp, Homo sapiens
ccagaatcccattac

SEQ ID NO: 195001 - DNA, 15 bp, Homo sapiens
cccagaatcccatta

SEQ ID NO: 195002 - DNA, 15 bp, Homo sapiens
acccagaatcccatt

SEQ ID NO: 195003 - DNA, 15 bp, Homo sapiens
gacccagaatcccat

SEQ ID NO: 195004 - DNA, 15 bp, Homo sapiens
tgacccagaatccca

SEQ ID NO: 195005 - DNA, 15 bp, Homo sapiens
ttgacccagaatccc

SEQ ID NO: 195006 - DNA, 15 bp, Homo sapiens
tttgacccagaatcc

SEQ ID NO: 195007 - DNA, 15 bp, Homo sapiens
atttgacccagaatc

SEQ ID NO: 195008 - DNA, 15 bp, Homo sapiens
catttgacccagaat

SEQ ID NO: 195009 - DNA, 15 bp, Homo sapiens
ccatttgacccagaa

SEQ ID NO: 195010 - DNA, 15 bp, Homo sapiens
accatttgacccaga

SEQ ID NO: 195011 - DNA, 15 bp, Homo sapiens
aaaataccatttgac

SEQ ID NO: 195012 - DNA, 15 bp, Homo sapiens
aaaaataccatttga

SEQ ID NO: 195013 - DNA, 15 bp, Homo sapiens
caaaaataccatttg

SEQ ID NO: 195014 - DNA, 15 bp, Homo sapiens
ccaaaaataccattt

SEQ ID NO: 195015 - DNA, 15 bp, Homo sapiens
accaaaaataccatt

SEQ ID NO: 195016 - DNA, 15 bp, Homo sapiens
aaccaaaaataccat

SEQ ID NO: 195017 - DNA, 15 bp, Homo sapiens
gaaccaaaaatacca

SEQ ID NO: 195018 - DNA, 15 bp, Homo sapiens
agaaccaaaaatacc

SEQ ID NO: 195019 - DNA, 15 bp, Homo sapiens
tagaaccaaaaatac

SEQ ID NO: 195020 - DNA, 15 bp, Homo sapiens
atagaaccaaaaata

SEQ ID NO: 195021 - DNA, 15 bp, Homo sapiens
tatagaaccaaaaat

SEQ ID NO: 195022 - DNA, 15 bp, Homo sapiens
atatagaaccaaaaa

SEQ ID NO: 195023 - DNA, 15 bp, Homo sapiens
gatatagaaccaaaa

SEQ ID NO: 195024 - DNA, 15 bp, Homo sapiens
ggatatagaaccaaa

SEQ ID NO: 195025 - DNA, 15 bp, Homo sapiens
aggatatagaaccaa

SEQ ID NO: 195026 - DNA, 15 bp, Homo sapiens
aaggatatagaacca

SEQ ID NO: 195027 - DNA, 15 bp, Homo sapiens
caaggatatagaacc

SEQ ID NO: 195028 - DNA, 15 bp, Homo sapiens
tcaaggatatagaac

SEQ ID NO: 195029 - DNA, 15 bp, Homo sapiens
ctcaaggatatagaa

SEQ ID NO: 195030 - DNA, 15 bp, Homo sapiens
cctcaaggatataga

SEQ ID NO: 195031 - DNA, 15 bp, Homo sapiens
tcctcaaggatatag

SEQ ID NO: 195032 - DNA, 15 bp, Homo sapiens
ttcctcaaggatata

SEQ ID NO: 195033 - DNA, 15 bp, Homo sapiens
attcctcaaggatat

SEQ ID NO: 195034 - DNA, 15 bp, Homo sapiens
gattcctcaaggata

SEQ ID NO: 195035 - DNA, 15 bp, Homo sapiens
cgattcctcaaggat

SEQ ID NO: 195036 - DNA, 15 bp, Homo sapiens
gcgattcctcaagga

SEQ ID NO: 195037 - DNA, 15 bp, Homo sapiens
ggcgattcctcaagg

SEQ ID NO: 195038 - DNA, 15 bp, Homo sapiens
tggcgattcctcaag

SEQ ID NO: 195039 - DNA, 15 bp, Homo sapiens
gtggcgattcctcaa

SEQ ID NO: 195040 - DNA, 15 bp, Homo sapiens
tgtggcgattcctca

SEQ ID NO: 195041 - DNA, 15 bp, Homo sapiens
gtgtggcgattcctc

SEQ ID NO: 195042 - DNA, 15 bp, Homo sapiens
agtgtggcgattcct

SEQ ID NO: 195043 - DNA, 15 bp, Homo sapiens
cagtgtggcgattcc

SEQ ID NO: 195044 - DNA, 15 bp, Homo sapiens
acagtgtggcgattc

SEQ ID NO: 195045 - DNA, 15 bp, Homo sapiens
gacagtgtggcgatt

SEQ ID NO: 195046 - DNA, 15 bp, Homo sapiens
agacagtgtggcgat

SEQ ID NO: 195047 - DNA, 15 bp, Homo sapiens
aagacagtgtggcga

SEQ ID NO: 195048 - DNA, 15 bp, Homo sapiens
gaagacagtgtggcg

SEQ ID NO: 195049 - DNA, 15 bp, Homo sapiens
acaaccattgtggaa

SEQ ID NO: 195050 - DNA, 15 bp, Homo sapiens
tacaaccattgtgga

SEQ ID NO: 195051 - DNA, 15 bp, Homo sapiens
gtacaaccattgtgg

SEQ ID NO: 195052 - DNA, 15 bp, Homo sapiens
agtacaaccattgtg

SEQ ID NO: 195053 - DNA, 15 bp, Homo sapiens
tagtacaaccattgt

SEQ ID NO: 195054 - DNA, 15 bp, Homo sapiens
ttagtacaaccattg

SEQ ID NO: 195055 - DNA, 15 bp, Homo sapiens
attagtacaaccatt

SEQ ID NO: 195056 - DNA, 15 bp, Homo sapiens
aattagtacaaccat

SEQ ID NO: 195057 - DNA, 15 bp, Homo sapiens
aaattagtacaacca

SEQ ID NO: 195058 - DNA, 15 bp, Homo sapiens
taaattagtacaacc

SEQ ID NO: 195059 - DNA, 15 bp, Homo sapiens
gtaaattagtacaac

SEQ ID NO: 195060 - DNA, 15 bp, Homo sapiens
tgtaaattagtacaa

SEQ ID NO: 195061 - DNA, 15 bp, Homo sapiens
gtgtaaattagtaca

SEQ ID NO: 195062 - DNA, 15 bp, Homo sapiens
agtgtaaattagtac

SEQ ID NO: 195063 - DNA, 15 bp, Homo sapiens
gagtgtaaattagta

SEQ ID NO: 195064 - DNA, 15 bp, Homo sapiens
ttacactgttggtag

SEQ ID NO: 195065 - DNA, 15 bp, Homo sapiens
tttacactgttggta

SEQ ID NO: 195066 - DNA, 15 bp, Homo sapiens
tggaatgcttttaca

SEQ ID NO: 195067 - DNA, 15 bp, Homo sapiens
ttggaatgcttttac

SEQ ID NO: 195068 - DNA, 15 bp, Homo sapiens
attggaatgctttta

SEQ ID NO: 195069 - DNA, 15 bp, Homo sapiens
aattggaatgctttt

SEQ ID NO: 195070 - DNA, 15 bp, Homo sapiens
aaattggaatgcttt

SEQ ID NO: 195071 - DNA, 15 bp, Homo sapiens
gaaattggaatgctt

SEQ ID NO: 195072 - DNA, 15 bp, Homo sapiens
tgaaattggaatgct

SEQ ID NO: 195073 - DNA, 15 bp, Homo sapiens
gtgaaattggaatgc

SEQ ID NO: 195074 - DNA, 15 bp, Homo sapiens
ggtgaaattggaatg

SEQ ID NO: 195075 - DNA, 15 bp, Homo sapiens
tggtgaaattggaat

SEQ ID NO: 195076 - DNA, 15 bp, Homo sapiens
gtggtgaaattggaa

SEQ ID NO: 195077 - DNA, 15 bp, Homo sapiens
tgtggtgaaattgga

SEQ ID NO: 195078 - DNA, 15 bp, Homo sapiens
gatgtggtgaaattg

SEQ ID NO: 195079 - DNA, 15 bp, Homo sapiens
ggatgtggtgaaatt

SEQ ID NO: 195080 - DNA, 15 bp, Homo sapiens
aggatgtggtgaaat

SEQ ID NO: 195081 - DNA, 15 bp, Homo sapiens
gaggatgtggtgaaa

SEQ ID NO: 195082 - DNA, 15 bp, Homo sapiens
cgaggatgtggtgaa

SEQ ID NO: 195083 - DNA, 15 bp, Homo sapiens
gcgaggatgtggtga

SEQ ID NO: 195084 - DNA, 15 bp, Homo sapiens
ggcgaggatgtggtg

SEQ ID NO: 195085 - DNA, 15 bp, Homo sapiens
tggcgaggatgtggt

SEQ ID NO: 195086 - DNA, 15 bp, Homo sapiens
ctggcgaggatgtgg

SEQ ID NO: 195087 - DNA, 15 bp, Homo sapiens
gctggcgaggatgtg

SEQ ID NO: 195088 - DNA, 15 bp, Homo sapiens
tgctggcgaggatgt

SEQ ID NO: 195089 - DNA, 15 bp, Homo sapiens
gtgctggcgaggatg

SEQ ID NO: 195090 - DNA, 15 bp, Homo sapiens
ggtgctggcgaggat

SEQ ID NO: 195091 - DNA, 15 bp, Homo sapiens
aggtgctggcgagga

SEQ ID NO: 195092 - DNA, 15 bp, Homo sapiens
caggtgctggcgagg

SEQ ID NO: 195093 - DNA, 15 bp, Homo sapiens
acaggtgctggcgag

SEQ ID NO: 195094 - DNA, 15 bp, Homo sapiens
aacaggtgctggcga

SEQ ID NO: 195095 - DNA, 15 bp, Homo sapiens
caacaggtgctggcg

SEQ ID NO: 195096 - DNA, 15 bp, Homo sapiens
acaacaggtgctggc

SEQ ID NO: 195097 - DNA, 15 bp, Homo sapiens
cacaacaggtgctgg

SEQ ID NO: 195098 - DNA, 15 bp, Homo sapiens
acacaacaggtgctg

SEQ ID NO: 195099 - DNA, 15 bp, Homo sapiens
tacacaacaggtgct

SEQ ID NO: 195100 - DNA, 15 bp, Homo sapiens
gtacacaacaggtgc

SEQ ID NO: 195101 - DNA, 15 bp, Homo sapiens
agtacacaacaggtg

SEQ ID NO: 195102 - DNA, 15 bp, Homo sapiens
aagtacacaacaggt

SEQ ID NO: 195103 - DNA, 15 bp, Homo sapiens
caagtacacaacagg

SEQ ID NO: 195104 - DNA, 15 bp, Homo sapiens
gcaagtacacaacag

SEQ ID NO: 195105 - DNA, 15 bp, Homo sapiens
ggcaagtacacaaca

SEQ ID NO: 195106 - DNA, 15 bp, Homo sapiens
tggcaagtacacaac

SEQ ID NO: 195107 - DNA, 15 bp, Homo sapiens
atggcaagtacacaa

SEQ ID NO: 195108 - DNA, 15 bp, Homo sapiens
aatggcaagtacaca

SEQ ID NO: 195109 - DNA, 15 bp, Homo sapiens
gaatggcaagtacac

SEQ ID NO: 195110 - DNA, 15 bp, Homo sapiens
agaatggcaagtaca

SEQ ID NO: 195111 - DNA, 15 bp, Homo sapiens
tagaatggcaagtac

SEQ ID NO: 195112 - DNA, 15 bp, Homo sapiens
ttagaatggcaagta

SEQ ID NO: 195113 - DNA, 15 bp, Homo sapiens
gttagaatggcaagt

SEQ ID NO: 195114 - DNA, 15 bp, Homo sapiens
agttagaatggcaag

SEQ ID NO: 195115 - DNA, 15 bp, Homo sapiens
gccagttagaatggc

SEQ ID NO: 195116 - DNA, 15 bp, Homo sapiens
tgccagttagaatgg

SEQ ID NO: 195117 - DNA, 15 bp, Homo sapiens
ctgccagttagaatg

SEQ ID NO: 195118 - DNA, 15 bp, Homo sapiens
cctgccagttagaat

SEQ ID NO: 195119 - DNA, 15 bp, Homo sapiens
tcctgccagttagaa

SEQ ID NO: 195120 - DNA, 15 bp, Homo sapiens
ctcctgccagttaga

SEQ ID NO: 195121 - DNA, 15 bp, Homo sapiens
tctcctgccagttag

SEQ ID NO: 195122 - DNA, 15 bp, Homo sapiens
atctcctgccagtta

SEQ ID NO: 195123 - DNA, 15 bp, Homo sapiens
catctcctgccagtt

SEQ ID NO: 195124 - DNA, 15 bp, Homo sapiens
ccatctcctgccagt

SEQ ID NO: 195125 - DNA, 15 bp, Homo sapiens
accatctcctgccag

SEQ ID NO: 195126 - DNA, 15 bp, Homo sapiens
taccatctcctgcca

SEQ ID NO: 195127 - DNA, 15 bp, Homo sapiens
ataccatctcctgcc

SEQ ID NO: 195128 - DNA, 15 bp, Homo sapiens
gataccatctcctgc

SEQ ID NO: 195129 - DNA, 15 bp, Homo sapiens
agataccatctcctg

SEQ ID NO: 195130 - DNA, 15 bp, Homo sapiens
gagataccatctcct

SEQ ID NO: 195131 - DNA, 15 bp, Homo sapiens
tgagataccatctcc

SEQ ID NO: 195132 - DNA, 15 bp, Homo sapiens
gagaaatgcaaatca

SEQ ID NO: 195133 - DNA, 15 bp, Homo sapiens
agagaaatgcaaatc

SEQ ID NO: 195134 - DNA, 15 bp, Homo sapiens
gtcattagagaaatg

SEQ ID NO: 195135 - DNA, 15 bp, Homo sapiens
ggtcattagagaaat

SEQ ID NO: 195136 - DNA, 15 bp, Homo sapiens
tggtcattagagaaa

SEQ ID NO: 195137 - DNA, 15 bp, Homo sapiens
ctggtcattagagaa

SEQ ID NO: 195138 - DNA, 15 bp, Homo sapiens
actggtcattagaga

SEQ ID NO: 195139 - DNA, 15 bp, Homo sapiens
cactggtcattagag

SEQ ID NO: 195140 - DNA, 15 bp, Homo sapiens
gcactggtcattaga

SEQ ID NO: 195141 - DNA, 15 bp, Homo sapiens
agcactggtcattag

SEQ ID NO: 195142 - DNA, 15 bp, Homo sapiens
cagcactggtcatta

SEQ ID NO: 195143 - DNA, 15 bp, Homo sapiens
tcagcactggtcatt

SEQ ID NO: 195144 - DNA, 15 bp, Homo sapiens
atcagcactggtcat

SEQ ID NO: 195145 - DNA, 15 bp, Homo sapiens
catcagcactggtca

SEQ ID NO: 195146 - DNA, 15 bp, Homo sapiens
tcatcagcactggtc

SEQ ID NO: 195147 - DNA, 15 bp, Homo sapiens
ctcatcagcactggt

SEQ ID NO: 195148 - DNA, 15 bp, Homo sapiens
gctcatcagcactgg

SEQ ID NO: 195149 - DNA, 15 bp, Homo sapiens
agctcatcagcactg

SEQ ID NO: 195150 - DNA, 15 bp, Homo sapiens
aagctcatcagcact

SEQ ID NO: 195151 - DNA, 15 bp, Homo sapiens
aaagctcatcagcac

SEQ ID NO: 195152 - DNA, 15 bp, Homo sapiens
aaaagctcatcagca

SEQ ID NO: 195153 - DNA, 15 bp, Homo sapiens
aaaaagctcatcagc

SEQ ID NO: 195154 - DNA, 15 bp, Homo sapiens
aaaaaagctcatcag

SEQ ID NO: 195155 - DNA, 15 bp, Homo sapiens
acaaacatatgaaaa

SEQ ID NO: 195156 - DNA, 15 bp, Homo sapiens
aacaaacatatgaaa

SEQ ID NO: 195157 - DNA, 15 bp, Homo sapiens
caacaaacatatgaa

SEQ ID NO: 195158 - DNA, 15 bp, Homo sapiens
ccaacaaacatatga

SEQ ID NO: 195159 - DNA, 15 bp, Homo sapiens
gccaacaaacatatg

SEQ ID NO: 195160 - DNA, 15 bp, Homo sapiens
ggccaacaaacatat

SEQ ID NO: 195161 - DNA, 15 bp, Homo sapiens
tggccaacaaacata

SEQ ID NO: 195162 - DNA, 15 bp, Homo sapiens
gtggccaacaaacat

SEQ ID NO: 195163 - DNA, 15 bp, Homo sapiens
tgtggccaacaaaca

SEQ ID NO: 195164 - DNA, 15 bp, Homo sapiens
atgtggccaacaaac

SEQ ID NO: 195165 - DNA, 15 bp, Homo sapiens
tatgtggccaacaaa

SEQ ID NO: 195166 - DNA, 15 bp, Homo sapiens
ttatgtggccaacaa

SEQ ID NO: 195167 - DNA, 15 bp, Homo sapiens
tttatgtggccaaca

SEQ ID NO: 195168 - DNA, 15 bp, Homo sapiens
atttatgtggccaac

SEQ ID NO: 195169 - DNA, 15 bp, Homo sapiens
tcacttctcaaaaga

SEQ ID NO: 195170 - DNA, 15 bp, Homo sapiens
gtcacttctcaaaag

SEQ ID NO: 195171 - DNA, 15 bp, Homo sapiens
agtcacttctcaaaa

SEQ ID NO: 195172 - DNA, 15 bp, Homo sapiens
gagtcacttctcaaa

SEQ ID NO: 195173 - DNA, 15 bp, Homo sapiens
agagtcacttctcaa

SEQ ID NO: 195174 - DNA, 15 bp, Homo sapiens
aagagtcacttctca

SEQ ID NO: 195175 - DNA, 15 bp, Homo sapiens
aaagagtcacttctc

SEQ ID NO: 195176 - DNA, 15 bp, Homo sapiens
caaagagtcacttct

SEQ ID NO: 195177 - DNA, 15 bp, Homo sapiens
tcaaagagtcacttc

SEQ ID NO: 195178 - DNA, 15 bp, Homo sapiens
ttcaaagagtcactt

SEQ ID NO: 195179 - DNA, 15 bp, Homo sapiens
attcaaagagtcact

SEQ ID NO: 195180 - DNA, 15 bp, Homo sapiens
gattcaaagagtcac

SEQ ID NO: 195181 - DNA, 15 bp, Homo sapiens
ggattcaaagagtca

SEQ ID NO: 195182 - DNA, 15 bp, Homo sapiens
aggattcaaagagtc

SEQ ID NO: 195183 - DNA, 15 bp, Homo sapiens
aaggattcaaagagt

SEQ ID NO: 195184 - DNA, 15 bp, Homo sapiens
aaaggattcaaagag

SEQ ID NO: 195185 - DNA, 15 bp, Homo sapiens
caaaggattcaaaga

SEQ ID NO: 195186 - DNA, 15 bp, Homo sapiens
gcaaaggattcaaag

SEQ ID NO: 195187 - DNA, 15 bp, Homo sapiens
ggcaaaggattcaaa

SEQ ID NO: 195188 - DNA, 15 bp, Homo sapiens
gggcaaaggattcaa

SEQ ID NO: 195189 - DNA, 15 bp, Homo sapiens
tgggcaaaggattca

SEQ ID NO: 195190 - DNA, 15 bp, Homo sapiens
gtgggcaaaggattc

SEQ ID NO: 195191 - DNA, 15 bp, Homo sapiens
agtgggcaaaggatt

SEQ ID NO: 195192 - DNA, 15 bp, Homo sapiens
aagtgggcaaaggat

SEQ ID NO: 195193 - DNA, 15 bp, Homo sapiens
aaagtgggcaaagga

SEQ ID NO: 195194 - DNA, 15 bp, Homo sapiens
aaaagtgggcaaagg

SEQ ID NO: 195195 - DNA, 15 bp, Homo sapiens
aaaaagtgggcaaag

SEQ ID NO: 195196 - DNA, 15 bp, Homo sapiens
caaaaagtgggcaaa

SEQ ID NO: 195197 - DNA, 15 bp, Homo sapiens
tcaaaaagtgggcaa

SEQ ID NO: 195198 - DNA, 15 bp, Homo sapiens
atcaaaaagtgggca

SEQ ID NO: 195199 - DNA, 15 bp, Homo sapiens
catcaaaaagtgggc

SEQ ID NO: 195200 - DNA, 15 bp, Homo sapiens
ccatcaaaaagtggg

SEQ ID NO: 195201 - DNA, 15 bp, Homo sapiens
cccatcaaaaagtgg

SEQ ID NO: 195202 - DNA, 15 bp, Homo sapiens
ccccatcaaaaagtg

SEQ ID NO: 195203 - DNA, 15 bp, Homo sapiens
accccatcaaaaagt

SEQ ID NO: 195204 - DNA, 15 bp, Homo sapiens
aaccccatcaaaaag

SEQ ID NO: 195205 - DNA, 15 bp, Homo sapiens
caaccccatcaaaaa

SEQ ID NO: 195206 - DNA, 15 bp, Homo sapiens
acaaccccatcaaaa

SEQ ID NO: 195207 - DNA, 15 bp, Homo sapiens
aacaaccccatcaaa

SEQ ID NO: 195208 - DNA, 15 bp, Homo sapiens
aaacaaccccatcaa

SEQ ID NO: 195209 - DNA, 15 bp, Homo sapiens
caaacaaccccatca

SEQ ID NO: 195210 - DNA, 15 bp, Homo sapiens
gcaaacaaccccatc

SEQ ID NO: 195211 - DNA, 15 bp, Homo sapiens
agcaaacaaccccat

SEQ ID NO: 195212 - DNA, 15 bp, Homo sapiens
aagcaaacaacccca

SEQ ID NO: 195213 - DNA, 15 bp, Homo sapiens
aaagcaaacaacccc

SEQ ID NO: 195214 - DNA, 15 bp, Homo sapiens
aaaagcaaacaaccc

SEQ ID NO: 195215 - DNA, 15 bp, Homo sapiens
aaaaagcaaacaacc

SEQ ID NO: 195216 - DNA, 15 bp, Homo sapiens
aaaaaagcaaacaac

SEQ ID NO: 195217 - DNA, 15 bp, Homo sapiens
aaaaaaagcaaacaa

SEQ ID NO: 195218 - DNA, 15 bp, Homo sapiens
gaaaaaaagcaaaca

SEQ ID NO: 195219 - DNA, 15 bp, Homo sapiens
agaaaaaaagcaaac

SEQ ID NO: 195220 - DNA, 15 bp, Homo sapiens
aagaaaaaaagcaaa

SEQ ID NO: 195221 - DNA, 15 bp, Homo sapiens
caagaaaaaaagcaa

SEQ ID NO: 195222 - DNA, 15 bp, Homo sapiens
acaagaaaaaaagca

SEQ ID NO: 195223 - DNA, 15 bp, Homo sapiens
tacaagaaaaaaagc

SEQ ID NO: 195224 - DNA, 15 bp, Homo sapiens
ttacaagaaaaaaag

SEQ ID NO: 195225 - DNA, 15 bp, Homo sapiens
tatttacaagaaaaa

SEQ ID NO: 195226 - DNA, 15 bp, Homo sapiens
atatttacaagaaaa

SEQ ID NO: 195227 - DNA, 15 bp, Homo sapiens
tatatttacaagaaa

SEQ ID NO: 195228 - DNA, 15 bp, Homo sapiens
ttatatttacaagaa

SEQ ID NO: 195229 - DNA, 15 bp, Homo sapiens
cttatatttacaaga

SEQ ID NO: 195230 - DNA, 15 bp, Homo sapiens
acttatatttacaag

SEQ ID NO: 195231 - DNA, 15 bp, Homo sapiens
aacttatatttacaa

SEQ ID NO: 195232 - DNA, 15 bp, Homo sapiens
gaacttatatttaca

SEQ ID NO: 195233 - DNA, 15 bp, Homo sapiens
ggaacttatatttac

SEQ ID NO: 195234 - DNA, 15 bp, Homo sapiens
aggaacttatattta

SEQ ID NO: 195235 - DNA, 15 bp, Homo sapiens
gaggaacttatattt

SEQ ID NO: 195236 - DNA, 15 bp, Homo sapiens
cgaggaacttatatt

SEQ ID NO: 195237 - DNA, 15 bp, Homo sapiens
acgaggaacttatat

SEQ ID NO: 195238 - DNA, 15 bp, Homo sapiens
tacgaggaacttata

SEQ ID NO: 195239 - DNA, 15 bp, Homo sapiens
ctacgaggaacttat

SEQ ID NO: 195240 - DNA, 15 bp, Homo sapiens
tctacgaggaactta

SEQ ID NO: 195241 - DNA, 15 bp, Homo sapiens
atctacgaggaactt

SEQ ID NO: 195242 - DNA, 15 bp, Homo sapiens
aatctacgaggaact

SEQ ID NO: 195243 - DNA, 15 bp, Homo sapiens
gaatctacgaggaac

SEQ ID NO: 195244 - DNA, 15 bp, Homo sapiens
agaatctacgaggaa

SEQ ID NO: 195245 - DNA, 15 bp, Homo sapiens
cagaatctacgagga

SEQ ID NO: 195246 - DNA, 15 bp, Homo sapiens
ccagaatctacgagg

SEQ ID NO: 195247 - DNA, 15 bp, Homo sapiens
tccagaatctacgag

SEQ ID NO: 195248 - DNA, 15 bp, Homo sapiens
atccagaatctacga

SEQ ID NO: 195249 - DNA, 15 bp, Homo sapiens
tatccagaatctacg

SEQ ID NO: 195250 - DNA, 15 bp, Homo sapiens
atatccagaatctac

SEQ ID NO: 195251 - DNA, 15 bp, Homo sapiens
aatatccagaatcta

SEQ ID NO: 195252 - DNA, 15 bp, Homo sapiens
taatatccagaatct

SEQ ID NO: 195253 - DNA, 15 bp, Homo sapiens
ctaatatccagaatc

SEQ ID NO: 195254 - DNA, 15 bp, Homo sapiens
gctaatatccagaat

SEQ ID NO: 195255 - DNA, 15 bp, Homo sapiens
agctaatatccagaa

SEQ ID NO: 195256 - DNA, 15 bp, Homo sapiens
gagctaatatccaga

SEQ ID NO: 195257 - DNA, 15 bp, Homo sapiens
agagctaatatccag

SEQ ID NO: 195258 - DNA, 15 bp, Homo sapiens
aagagctaatatcca

SEQ ID NO: 195259 - DNA, 15 bp, Homo sapiens
aaagagctaatatcc

SEQ ID NO: 195260 - DNA, 15 bp, Homo sapiens
caaagagctaatatc

SEQ ID NO: 195261 - DNA, 15 bp, Homo sapiens
acaaagagctaatat

SEQ ID NO: 195262 - DNA, 15 bp, Homo sapiens
gacaaagagctaata

SEQ ID NO: 195263 - DNA, 15 bp, Homo sapiens
tgacaaagagctaat

SEQ ID NO: 195264 - DNA, 15 bp, Homo sapiens
ctgacaaagagctaa

SEQ ID NO: 195265 - DNA, 15 bp, Homo sapiens
tctgacaaagagcta

SEQ ID NO: 195266 - DNA, 15 bp, Homo sapiens
atctgacaaagagct

SEQ ID NO: 195267 - DNA, 15 bp, Homo sapiens
catctgacaaagagc

SEQ ID NO: 195268 - DNA, 15 bp, Homo sapiens
ccatctgacaaagag

SEQ ID NO: 195269 - DNA, 15 bp, Homo sapiens
tccatctgacaaaga

SEQ ID NO: 195270 - DNA, 15 bp, Homo sapiens
ctgcaatctatccat

SEQ ID NO: 195271 - DNA, 15 bp, Homo sapiens
tctgcaatctatcca

SEQ ID NO: 195272 - DNA, 15 bp, Homo sapiens
ttctgcaatctatcc

SEQ ID NO: 195273 - DNA, 15 bp, Homo sapiens
tttctgcaatctatc

SEQ ID NO: 195274 - DNA, 15 bp, Homo sapiens
atttctgcaatctat

SEQ ID NO: 195275 - DNA, 15 bp, Homo sapiens
aatttctgcaatcta

SEQ ID NO: 195276 - DNA, 15 bp, Homo sapiens
aaatttctgcaatct

SEQ ID NO: 195277 - DNA, 15 bp, Homo sapiens
aaaatttctgcaatc

SEQ ID NO: 195278 - DNA, 15 bp, Homo sapiens
gaaaatttctgcaat

SEQ ID NO: 195279 - DNA, 15 bp, Homo sapiens
agaaaatttctgcaa

SEQ ID NO: 195280 - DNA, 15 bp, Homo sapiens
gagaaaatttctgca

SEQ ID NO: 195281 - DNA, 15 bp, Homo sapiens
ggagaaaatttctgc

SEQ ID NO: 195282 - DNA, 15 bp, Homo sapiens
gggagaaaatttctg

SEQ ID NO: 195283 - DNA, 15 bp, Homo sapiens
tgggagaaaatttct

SEQ ID NO: 195284 - DNA, 15 bp, Homo sapiens
atgggagaaaatttc

SEQ ID NO: 195285 - DNA, 15 bp, Homo sapiens
aatgggagaaaattt

SEQ ID NO: 195286 - DNA, 15 bp, Homo sapiens
gaatgggagaaaatt

SEQ ID NO: 195287 - DNA, 15 bp, Homo sapiens
agaatgggagaaaat

SEQ ID NO: 195288 - DNA, 15 bp, Homo sapiens
cagaatgggagaaaa

SEQ ID NO: 195289 - DNA, 15 bp, Homo sapiens
acagaatgggagaaa

SEQ ID NO: 195290 - DNA, 15 bp, Homo sapiens
tacagaatgggagaa

SEQ ID NO: 195291 - DNA, 15 bp, Homo sapiens
ctacagaatgggaga

SEQ ID NO: 195292 - DNA, 15 bp, Homo sapiens
cctacagaatgggag

SEQ ID NO: 195293 - DNA, 15 bp, Homo sapiens
acctacagaatggga

SEQ ID NO: 195294 - DNA, 15 bp, Homo sapiens
aacctacagaatggg

SEQ ID NO: 195295 - DNA, 15 bp, Homo sapiens
caacctacagaatgg

SEQ ID NO: 195296 - DNA, 15 bp, Homo sapiens
gcaacctacagaatg

SEQ ID NO: 195297 - DNA, 15 bp, Homo sapiens
ggcaacctacagaat

SEQ ID NO: 195298 - DNA, 15 bp, Homo sapiens
aggcaacctacagaa

SEQ ID NO: 195299 - DNA, 15 bp, Homo sapiens
caggcaacctacaga

SEQ ID NO: 195300 - DNA, 15 bp, Homo sapiens
acaggcaacctacag

SEQ ID NO: 195301 - DNA, 15 bp, Homo sapiens
aacaggcaacctaca

SEQ ID NO: 195302 - DNA, 15 bp, Homo sapiens
gaacaggcaacctac

SEQ ID NO: 195303 - DNA, 15 bp, Homo sapiens
gagtgaacaggcaac

SEQ ID NO: 195304 - DNA, 15 bp, Homo sapiens
agagtgaacaggcaa

SEQ ID NO: 195305 - DNA, 15 bp, Homo sapiens
cagagtgaacaggca

SEQ ID NO: 195306 - DNA, 15 bp, Homo sapiens
tcagagtgaacaggc

SEQ ID NO: 195307 - DNA, 15 bp, Homo sapiens
atcagagtgaacagg

SEQ ID NO: 195308 - DNA, 15 bp, Homo sapiens
catcagagtgaacag

SEQ ID NO: 195309 - DNA, 15 bp, Homo sapiens
ccatcagagtgaaca

SEQ ID NO: 195310 - DNA, 15 bp, Homo sapiens
accatcagagtgaac

SEQ ID NO: 195311 - DNA, 15 bp, Homo sapiens
taccatcagagtgaa

SEQ ID NO: 195312 - DNA, 15 bp, Homo sapiens
ctaccatcagagtga

SEQ ID NO: 195313 - DNA, 15 bp, Homo sapiens
actaccatcagagtg

SEQ ID NO: 195314 - DNA, 15 bp, Homo sapiens
aactaccatcagagt

SEQ ID NO: 195315 - DNA, 15 bp, Homo sapiens
aaactaccatcagag

SEQ ID NO: 195316 - DNA, 15 bp, Homo sapiens
gaaactaccatcaga

SEQ ID NO: 195317 - DNA, 15 bp, Homo sapiens
agaaactaccatcag

SEQ ID NO: 195318 - DNA, 15 bp, Homo sapiens
aagaaactaccatca

SEQ ID NO: 195319 - DNA, 15 bp, Homo sapiens
aaagaaactaccatc

SEQ ID NO: 195320 - DNA, 15 bp, Homo sapiens
aaaagaaactaccat

SEQ ID NO: 195321 - DNA, 15 bp, Homo sapiens
caaaagaaactacca

SEQ ID NO: 195322 - DNA, 15 bp, Homo sapiens
gcaaaagaaactacc

SEQ ID NO: 195323 - DNA, 15 bp, Homo sapiens
agcaaaagaaactac

SEQ ID NO: 195324 - DNA, 15 bp, Homo sapiens
cagcaaaagaaacta

SEQ ID NO: 195325 - DNA, 15 bp, Homo sapiens
gcagcaaaagaaact

SEQ ID NO: 195326 - DNA, 15 bp, Homo sapiens
ggcagcaaaagaaac

SEQ ID NO: 195327 - DNA, 15 bp, Homo sapiens
gggcagcaaaagaaa

SEQ ID NO: 195328 - DNA, 15 bp, Homo sapiens
tgggcagcaaaagaa

SEQ ID NO: 195329 - DNA, 15 bp, Homo sapiens
ctgggcagcaaaaga

SEQ ID NO: 195330 - DNA, 15 bp, Homo sapiens
tctgggcagcaaaag

SEQ ID NO: 195331 - DNA, 15 bp, Homo sapiens
ctctgggcagcaaaa

SEQ ID NO: 195332 - DNA, 15 bp, Homo sapiens
actctgggcagcaaa

SEQ ID NO: 195333 - DNA, 15 bp, Homo sapiens
tactctgggcagcaa

SEQ ID NO: 195334 - DNA, 15 bp, Homo sapiens
ttactctgggcagca

SEQ ID NO: 195335 - DNA, 15 bp, Homo sapiens
attactctgggcagc

SEQ ID NO: 195336 - DNA, 15 bp, Homo sapiens
aattactctgggcag

SEQ ID NO: 195337 - DNA, 15 bp, Homo sapiens
caattactctgggca

SEQ ID NO: 195338 - DNA, 15 bp, Homo sapiens
tcaattactctgggc

SEQ ID NO: 195339 - DNA, 15 bp, Homo sapiens
atcaattactctggg

SEQ ID NO: 195340 - DNA, 15 bp, Homo sapiens
tatcaattactctgg

SEQ ID NO: 195341 - DNA, 15 bp, Homo sapiens
ctatcaattactctg

SEQ ID NO: 195342 - DNA, 15 bp, Homo sapiens
tctatcaattactct

SEQ ID NO: 195343 - DNA, 15 bp, Homo sapiens
atctatcaattactc

SEQ ID NO: 195344 - DNA, 15 bp, Homo sapiens
aatctatcaattact

SEQ ID NO: 195345 - DNA, 15 bp, Homo sapiens
gaatctatcaattac

SEQ ID NO: 195346 - DNA, 15 bp, Homo sapiens
tgaatctatcaatta

SEQ ID NO: 195347 - DNA, 15 bp, Homo sapiens
ctgaatctatcaatt

SEQ ID NO: 195348 - DNA, 15 bp, Homo sapiens
actgaatctatcaat

SEQ ID NO: 195349 - DNA, 15 bp, Homo sapiens
cactgaatctatcaa

SEQ ID NO: 195350 - DNA, 15 bp, Homo sapiens
gcactgaatctatca

SEQ ID NO: 195351 - DNA, 15 bp, Homo sapiens
agcactgaatctatc

SEQ ID NO: 195352 - DNA, 15 bp, Homo sapiens
tagcactgaatctat

SEQ ID NO: 195353 - DNA, 15 bp, Homo sapiens
atagcactgaatcta

SEQ ID NO: 195354 - DNA, 15 bp, Homo sapiens
aatagcactgaatct

SEQ ID NO: 195355 - DNA, 15 bp, Homo sapiens
gaatagcactgaatc

SEQ ID NO: 195356 - DNA, 15 bp, Homo sapiens
ggaatagcactgaat

SEQ ID NO: 195357 - DNA, 15 bp, Homo sapiens
gggaatagcactgaa

SEQ ID NO: 195358 - DNA, 15 bp, Homo sapiens
tgggaatagcactga

SEQ ID NO: 195359 - DNA, 15 bp, Homo sapiens
atgggaatagcactg

SEQ ID NO: 195360 - DNA, 15 bp, Homo sapiens
gatgggaatagcact

SEQ ID NO: 195361 - DNA, 15 bp, Homo sapiens
tgatgggaatagcac

SEQ ID NO: 195362 - DNA, 15 bp, Homo sapiens
ttgatgggaatagca

SEQ ID NO: 195363 - DNA, 15 bp, Homo sapiens
cttgatgggaatagc

SEQ ID NO: 195364 - DNA, 15 bp, Homo sapiens
gcttgatgggaatag

SEQ ID NO: 195365 - DNA, 15 bp, Homo sapiens
agcttgatgggaata

SEQ ID NO: 195366 - DNA, 15 bp, Homo sapiens
tagcttgatgggaat

SEQ ID NO: 195367 - DNA, 15 bp, Homo sapiens
gtagcttgatgggaa

SEQ ID NO: 195368 - DNA, 15 bp, Homo sapiens
ggtagcttgatggga

SEQ ID NO: 195369 - DNA, 15 bp, Homo sapiens
tggtagcttgatggg

SEQ ID NO: 195370 - DNA, 15 bp, Homo sapiens
atggtagcttgatgg

SEQ ID NO: 195371 - DNA, 15 bp, Homo sapiens
aatggtagcttgatg

SEQ ID NO: 195372 - DNA, 15 bp, Homo sapiens
caatggtagcttgat

SEQ ID NO: 195373 - DNA, 15 bp, Homo sapiens
tcaatggtagcttga

SEQ ID NO: 195374 - DNA, 15 bp, Homo sapiens
gtcaatggtagcttg

SEQ ID NO: 195375 - DNA, 15 bp, Homo sapiens
agtcaatggtagctt

SEQ ID NO: 195376 - DNA, 15 bp, Homo sapiens
aagtcaatggtagct

SEQ ID NO: 195377 - DNA, 15 bp, Homo sapiens
aaagtcaatggtagc

SEQ ID NO: 195378 - DNA, 15 bp, Homo sapiens
gaaagtcaatggtag

SEQ ID NO: 195379 - DNA, 15 bp, Homo sapiens
agaaagtcaatggta

SEQ ID NO: 195380 - DNA, 15 bp, Homo sapiens
aagaaagtcaatggt

SEQ ID NO: 195381 - DNA, 15 bp, Homo sapiens
gaagaaagtcaatgg

SEQ ID NO: 195382 - DNA, 15 bp, Homo sapiens
tgaagaaagtcaatg

SEQ ID NO: 195383 - DNA, 15 bp, Homo sapiens
gtgaagaaagtcaat

SEQ ID NO: 195384 - DNA, 15 bp, Homo sapiens
tgtgaagaaagtcaa

SEQ ID NO: 195385 - DNA, 15 bp, Homo sapiens
ctgtgaagaaagtca

SEQ ID NO: 195386 - DNA, 15 bp, Homo sapiens
tctgtgaagaaagtc

SEQ ID NO: 195387 - DNA, 15 bp, Homo sapiens
gtctgtgaagaaagt

SEQ ID NO: 195388 - DNA, 15 bp, Homo sapiens
ggtctgtgaagaaag

SEQ ID NO: 195389 - DNA, 15 bp, Homo sapiens
aggtctgtgaagaaa

SEQ ID NO: 195390 - DNA, 15 bp, Homo sapiens
taggtctgtgaagaa

SEQ ID NO: 195391 - DNA, 15 bp, Homo sapiens
ctaggtctgtgaaga

SEQ ID NO: 195392 - DNA, 15 bp, Homo sapiens
tctaggtctgtgaag

SEQ ID NO: 195393 - DNA, 15 bp, Homo sapiens
ctctaggtctgtgaa

SEQ ID NO: 195394 - DNA, 15 bp, Homo sapiens
tctctaggtctgtga

SEQ ID NO: 195395 - DNA, 15 bp, Homo sapiens
ttctctaggtctgtg

SEQ ID NO: 195396 - DNA, 15 bp, Homo sapiens
tttctctaggtctgt

SEQ ID NO: 195397 - DNA, 15 bp, Homo sapiens
ttttctctaggtctg

SEQ ID NO: 195398 - DNA, 15 bp, Homo sapiens
attttctctaggtct

SEQ ID NO: 195399 - DNA, 15 bp, Homo sapiens
cattttctctaggtc

SEQ ID NO: 195400 - DNA, 15 bp, Homo sapiens
tcattttctctaggt

SEQ ID NO: 195401 - DNA, 15 bp, Homo sapiens
gtcattttctctagg

SEQ ID NO: 195402 - DNA, 15 bp, Homo sapiens
agtcattttctctag

SEQ ID NO: 195403 - DNA, 15 bp, Homo sapiens
aagtcattttctcta

SEQ ID NO: 195404 - DNA, 15 bp, Homo sapiens
aaagtcattttctct

SEQ ID NO: 195405 - DNA, 15 bp, Homo sapiens
taaagtcattttctc

SEQ ID NO: 195406 - DNA, 15 bp, Homo sapiens
ttaaagtcattttct

SEQ ID NO: 195407 - DNA, 15 bp, Homo sapiens
tttaaagtcattttc

SEQ ID NO: 195408 - DNA, 15 bp, Homo sapiens
atttaaagtcatttt

SEQ ID NO: 195409 - DNA, 15 bp, Homo sapiens
aatttaaagtcattt

SEQ ID NO: 195410 - DNA, 15 bp, Homo sapiens
aaatttaaagtcatt

SEQ ID NO: 195411 - DNA, 15 bp, Homo sapiens
gaaatttaaagtcat

SEQ ID NO: 195412 - DNA, 15 bp, Homo sapiens
tgaaatttaaagtca

SEQ ID NO: 195413 - DNA, 15 bp, Homo sapiens
atgaaatttaaagtc

SEQ ID NO: 195414 - DNA, 15 bp, Homo sapiens
tatgaaatttaaagt

SEQ ID NO: 195415 - DNA, 15 bp, Homo sapiens
atatgaaatttaaag

SEQ ID NO: 195416 - DNA, 15 bp, Homo sapiens
catatgaaatttaaa

SEQ ID NO: 195417 - DNA, 15 bp, Homo sapiens
ccatatgaaatttaa

SEQ ID NO: 195418 - DNA, 15 bp, Homo sapiens
tccatatgaaattta

SEQ ID NO: 195419 - DNA, 15 bp, Homo sapiens
ttccatatgaaattt

SEQ ID NO: 195420 - DNA, 15 bp, Homo sapiens
gttccatatgaaatt

SEQ ID NO: 195421 - DNA, 15 bp, Homo sapiens
ggttccatatgaaat

SEQ ID NO: 195422 - DNA, 15 bp, Homo sapiens
tggttccatatgaaa

SEQ ID NO: 195423 - DNA, 15 bp, Homo sapiens
ttggttccatatgaa

SEQ ID NO: 195424 - DNA, 15 bp, Homo sapiens
tttggttccatatga

SEQ ID NO: 195425 - DNA, 15 bp, Homo sapiens
ttttggttccatatg

SEQ ID NO: 195426 - DNA, 15 bp, Homo sapiens
tttttggttccatat

SEQ ID NO: 195427 - DNA, 15 bp, Homo sapiens
ttttttggttccata

SEQ ID NO: 195428 - DNA, 15 bp, Homo sapiens
cttttttggttccat

SEQ ID NO: 195429 - DNA, 15 bp, Homo sapiens
tcttttttggttcca

SEQ ID NO: 195430 - DNA, 15 bp, Homo sapiens
ctcttttttggttcc

SEQ ID NO: 195431 - DNA, 15 bp, Homo sapiens
gctcttttttggttc

SEQ ID NO: 195432 - DNA, 15 bp, Homo sapiens
ggctcttttttggtt

SEQ ID NO: 195433 - DNA, 15 bp, Homo sapiens
aggctcttttttggt

SEQ ID NO: 195434 - DNA, 15 bp, Homo sapiens
caggctcttttttgg

SEQ ID NO: 195435 - DNA, 15 bp, Homo sapiens
acaggctcttttttg

SEQ ID NO: 195436 - DNA, 15 bp, Homo sapiens
tacaggctctttttt

SEQ ID NO: 195437 - DNA, 15 bp, Homo sapiens
atacaggctcttttt

SEQ ID NO: 195438 - DNA, 15 bp, Homo sapiens
tatacaggctctttt

SEQ ID NO: 195439 - DNA, 15 bp, Homo sapiens
ctatacaggctcttt

SEQ ID NO: 195440 - DNA, 15 bp, Homo sapiens
gctatacaggctctt

SEQ ID NO: 195441 - DNA, 15 bp, Homo sapiens
ggctatacaggctct

SEQ ID NO: 195442 - DNA, 15 bp, Homo sapiens
tggctatacaggctc

SEQ ID NO: 195443 - DNA, 15 bp, Homo sapiens
ttggctatacaggct

SEQ ID NO: 195444 - DNA, 15 bp, Homo sapiens
cttggctatacaggc

SEQ ID NO: 195445 - DNA, 15 bp, Homo sapiens
tcttggctatacagg

SEQ ID NO: 195446 - DNA, 15 bp, Homo sapiens
gtcttggctatacag

SEQ ID NO: 195447 - DNA, 15 bp, Homo sapiens
tgtcttggctataca

SEQ ID NO: 195448 - DNA, 15 bp, Homo sapiens
ttgtcttggctatac

SEQ ID NO: 195449 - DNA, 15 bp, Homo sapiens
attgtcttggctata

SEQ ID NO: 195450 - DNA, 15 bp, Homo sapiens
gattgtcttggctat

SEQ ID NO: 195451 - DNA, 15 bp, Homo sapiens
ggattgtcttggcta

SEQ ID NO: 195452 - DNA, 15 bp, Homo sapiens
aggattgtcttggct

SEQ ID NO: 195453 - DNA, 15 bp, Homo sapiens
taggattgtcttggc

SEQ ID NO: 195454 - DNA, 15 bp, Homo sapiens
ttaggattgtcttgg

SEQ ID NO: 195455 - DNA, 15 bp, Homo sapiens
cttaggattgtcttg

SEQ ID NO: 195456 - DNA, 15 bp, Homo sapiens
gcttaggattgtctt

SEQ ID NO: 195457 - DNA, 15 bp, Homo sapiens
tgcttaggattgtct

SEQ ID NO: 195458 - DNA, 15 bp, Homo sapiens
ttgcttaggattgtc

SEQ ID NO: 195459 - DNA, 15 bp, Homo sapiens
tttgcttaggattgt

SEQ ID NO: 195460 - DNA, 15 bp, Homo sapiens
ttttgcttaggattg

SEQ ID NO: 195461 - DNA, 15 bp, Homo sapiens
tttttgcttaggatt

SEQ ID NO: 195462 - DNA, 15 bp, Homo sapiens
ctttttgcttaggat

SEQ ID NO: 195463 - DNA, 15 bp, Homo sapiens
tctttttgcttagga

SEQ ID NO: 195464 - DNA, 15 bp, Homo sapiens
ttctttttgcttagg

SEQ ID NO: 195465 - DNA, 15 bp, Homo sapiens
gttctttttgcttag

SEQ ID NO: 195466 - DNA, 15 bp, Homo sapiens
tgttctttttgctta

SEQ ID NO: 195467 - DNA, 15 bp, Homo sapiens
ttgttctttttgctt

SEQ ID NO: 195468 - DNA, 15 bp, Homo sapiens
tttgttctttttgct

SEQ ID NO: 195469 - DNA, 15 bp, Homo sapiens
ctttgttctttttgc

SEQ ID NO: 195470 - DNA, 15 bp, Homo sapiens
gctttgttctttttg

SEQ ID NO: 195471 - DNA, 15 bp, Homo sapiens
agctttgttcttttt

SEQ ID NO: 195472 - DNA, 15 bp, Homo sapiens
cagctttgttctttt

SEQ ID NO: 195473 - DNA, 15 bp, Homo sapiens
ccagctttgttcttt

SEQ ID NO: 195474 - DNA, 15 bp, Homo sapiens
tccagctttgttctt

SEQ ID NO: 195475 - DNA, 15 bp, Homo sapiens
ctccagctttgttct

SEQ ID NO: 195476 - DNA, 15 bp, Homo sapiens
cctccagctttgttc

SEQ ID NO: 195477 - DNA, 15 bp, Homo sapiens
acctccagctttgtt

SEQ ID NO: 195478 - DNA, 15 bp, Homo sapiens
tacctccagctttgt

SEQ ID NO: 195479 - DNA, 15 bp, Homo sapiens
gtacctccagctttg

SEQ ID NO: 195480 - DNA, 15 bp, Homo sapiens
agtacctccagcttt

SEQ ID NO: 195481 - DNA, 15 bp, Homo sapiens
cagtacctccagctt

SEQ ID NO: 195482 - DNA, 15 bp, Homo sapiens
tcagtacctccagct

SEQ ID NO: 195483 - DNA, 15 bp, Homo sapiens
ttcagtacctccagc

SEQ ID NO: 195484 - DNA, 15 bp, Homo sapiens
cttcagtacctccag

SEQ ID NO: 195485 - DNA, 15 bp, Homo sapiens
tcttcagtacctcca

SEQ ID NO: 195486 - DNA, 15 bp, Homo sapiens
atcttcagtacctcc

SEQ ID NO: 195487 - DNA, 15 bp, Homo sapiens
aatcttcagtacctc

SEQ ID NO: 195488 - DNA, 15 bp, Homo sapiens
aaatcttcagtacct

SEQ ID NO: 195489 - DNA, 15 bp, Homo sapiens
taaatcttcagtacc

SEQ ID NO: 195490 - DNA, 15 bp, Homo sapiens
ttaaatcttcagtac

SEQ ID NO: 195491 - DNA, 15 bp, Homo sapiens
tttaaatcttcagta

SEQ ID NO: 195492 - DNA, 15 bp, Homo sapiens
ctttaaatcttcagt

SEQ ID NO: 195493 - DNA, 15 bp, Homo sapiens
tctttaaatcttcag

SEQ ID NO: 195494 - DNA, 15 bp, Homo sapiens
gtctttaaatcttca

SEQ ID NO: 195495 - DNA, 15 bp, Homo sapiens
agtctttaaatcttc

SEQ ID NO: 195496 - DNA, 15 bp, Homo sapiens
tagtctttaaatctt

SEQ ID NO: 195497 - DNA, 15 bp, Homo sapiens
atagtctttaaatct

SEQ ID NO: 195498 - DNA, 15 bp, Homo sapiens
tatagtctttaaatc

SEQ ID NO: 195499 - DNA, 15 bp, Homo sapiens
ttatagtctttaaat

SEQ ID NO: 195500 - DNA, 15 bp, Homo sapiens
attatagtctttaaa

SEQ ID NO: 195501 - DNA, 15 bp, Homo sapiens
aattatagtctttaa

SEQ ID NO: 195502 - DNA, 15 bp, Homo sapiens
aaattatagtcttta

SEQ ID NO: 195503 - DNA, 15 bp, Homo sapiens
aaaattatagtcttt

SEQ ID NO: 195504 - DNA, 15 bp, Homo sapiens
gaaaattatagtctt

SEQ ID NO: 195505 - DNA, 15 bp, Homo sapiens
tgaaaattatagtct

SEQ ID NO: 195506 - DNA, 15 bp, Homo sapiens
ctgaaaattatagtc

SEQ ID NO: 195507 - DNA, 15 bp, Homo sapiens
tctgaaaattatagt

SEQ ID NO: 195508 - DNA, 15 bp, Homo sapiens
ttctgaaaattatag

SEQ ID NO: 195509 - DNA, 15 bp, Homo sapiens
attctgaaaattata

SEQ ID NO: 195510 - DNA, 15 bp, Homo sapiens
tattctgaaaattat

SEQ ID NO: 195511 - DNA, 15 bp, Homo sapiens
ttattctgaaaatta

SEQ ID NO: 195512 - DNA, 15 bp, Homo sapiens
attattctgaaaatt

SEQ ID NO: 195513 - DNA, 15 bp, Homo sapiens
tattattctgaaaat

SEQ ID NO: 195514 - DNA, 15 bp, Homo sapiens
ttattattctgaaaa

SEQ ID NO: 195515 - DNA, 15 bp, Homo sapiens
cttattattctgaaa

SEQ ID NO: 195516 - DNA, 15 bp, Homo sapiens
tcttattattctgaa

SEQ ID NO: 195517 - DNA, 15 bp, Homo sapiens
ttcttattattctga

SEQ ID NO: 195518 - DNA, 15 bp, Homo sapiens
attcttattattctg

SEQ ID NO: 195519 - DNA, 15 bp, Homo sapiens
aattcttattattct

SEQ ID NO: 195520 - DNA, 15 bp, Homo sapiens
aaattcttattattc

SEQ ID NO: 195521 - DNA, 15 bp, Homo sapiens
aaaattcttattatt

SEQ ID NO: 195522 - DNA, 15 bp, Homo sapiens
caaaattcttattat

SEQ ID NO: 195523 - DNA, 15 bp, Homo sapiens
ccaaaattcttatta

SEQ ID NO: 195524 - DNA, 15 bp, Homo sapiens
tccaaaattcttatt

SEQ ID NO: 195525 - DNA, 15 bp, Homo sapiens
ttccaaaattcttat

SEQ ID NO: 195526 - DNA, 15 bp, Homo sapiens
cttccaaaattctta

SEQ ID NO: 195527 - DNA, 15 bp, Homo sapiens
gcttccaaaattctt

SEQ ID NO: 195528 - DNA, 15 bp, Homo sapiens
tgcttccaaaattct

SEQ ID NO: 195529 - DNA, 15 bp, Homo sapiens
gtgcttccaaaattc

SEQ ID NO: 195530 - DNA, 15 bp, Homo sapiens
agtgcttccaaaatt

SEQ ID NO: 195531 - DNA, 15 bp, Homo sapiens
aagtgcttccaaaat

SEQ ID NO: 195532 - DNA, 15 bp, Homo sapiens
caagtgcttccaaaa

SEQ ID NO: 195533 - DNA, 15 bp, Homo sapiens
tcaagtgcttccaaa

SEQ ID NO: 195534 - DNA, 15 bp, Homo sapiens
ttcaagtgcttccaa

SEQ ID NO: 195535 - DNA, 15 bp, Homo sapiens
attcaagtgcttcca

SEQ ID NO: 195536 - DNA, 15 bp, Homo sapiens
aattcaagtgcttcc

SEQ ID NO: 195537 - DNA, 15 bp, Homo sapiens
aaattcaagtgcttc

SEQ ID NO: 195538 - DNA, 15 bp, Homo sapiens
gaaattcaagtgctt

SEQ ID NO: 195539 - DNA, 15 bp, Homo sapiens
agaaattcaagtgct

SEQ ID NO: 195540 - DNA, 15 bp, Homo sapiens
aagaaattcaagtgc

SEQ ID NO: 195541 - DNA, 15 bp, Homo sapiens
taagaaattcaagtg

SEQ ID NO: 195542 - DNA, 15 bp, Homo sapiens
ataagaaattcaagt

SEQ ID NO: 195543 - DNA, 15 bp, Homo sapiens
tataagaaattcaag

SEQ ID NO: 195544 - DNA, 15 bp, Homo sapiens
ttataagaaattcaa

SEQ ID NO: 195545 - DNA, 15 bp, Homo sapiens
attataagaaattca

SEQ ID NO: 195546 - DNA, 15 bp, Homo sapiens
aattataagaaattc

SEQ ID NO: 195547 - DNA, 15 bp, Homo sapiens
aaattataagaaatt

SEQ ID NO: 195548 - DNA, 15 bp, Homo sapiens
taaattataagaaat

SEQ ID NO: 195549 - DNA, 15 bp, Homo sapiens
ttaaattataagaaa

SEQ ID NO: 195550 - DNA, 15 bp, Homo sapiens
cttaaattataagaa

SEQ ID NO: 195551 - DNA, 15 bp, Homo sapiens
ccttaaattataaga

SEQ ID NO: 195552 - DNA, 15 bp, Homo sapiens
accttaaattataag

SEQ ID NO: 195553 - DNA, 15 bp, Homo sapiens
caccttaaattataa

SEQ ID NO: 195554 - DNA, 15 bp, Homo sapiens
tcaccttaaattata

SEQ ID NO: 195555 - DNA, 15 bp, Homo sapiens
ttcaccttaaattat

SEQ ID NO: 195556 - DNA, 15 bp, Homo sapiens
tttcaccttaaatta

SEQ ID NO: 195557 - DNA, 15 bp, Homo sapiens
atttcaccttaaatt

SEQ ID NO: 195558 - DNA, 15 bp, Homo sapiens
catttcaccttaaat

SEQ ID NO: 195559 - DNA, 15 bp, Homo sapiens
tcatttcaccttaaa

SEQ ID NO: 195560 - DNA, 15 bp, Homo sapiens
ttcatttcaccttaa

SEQ ID NO: 195561 - DNA, 15 bp, Homo sapiens
gttcatttcacctta

SEQ ID NO: 195562 - DNA, 15 bp, Homo sapiens
agttcatttcacctt

SEQ ID NO: 195563 - DNA, 15 bp, Homo sapiens
tagttcatttcacct

SEQ ID NO: 195564 - DNA, 15 bp, Homo sapiens
atagttcatttcacc

SEQ ID NO: 195565 - DNA, 15 bp, Homo sapiens
aatagttcatttcac

SEQ ID NO: 195566 - DNA, 15 bp, Homo sapiens
aaatagttcatttca

SEQ ID NO: 195567 - DNA, 15 bp, Homo sapiens
aaaatagttcatttc

SEQ ID NO: 195568 - DNA, 15 bp, Homo sapiens
caaaatagttcattt

SEQ ID NO: 195569 - DNA, 15 bp, Homo sapiens
gcaaaatagttcatt

SEQ ID NO: 195570 - DNA, 15 bp, Homo sapiens
agcaaaatagttcat

SEQ ID NO: 195571 - DNA, 15 bp, Homo sapiens
aagcaaaatagttca

SEQ ID NO: 195572 - DNA, 15 bp, Homo sapiens
caagcaaaatagttc

SEQ ID NO: 195573 - DNA, 15 bp, Homo sapiens
tcaagcaaaatagtt

SEQ ID NO: 195574 - DNA, 15 bp, Homo sapiens
ctcaagcaaaatagt

SEQ ID NO: 195575 - DNA, 15 bp, Homo sapiens
tctcaagcaaaatag

SEQ ID NO: 195576 - DNA, 15 bp, Homo sapiens
ctctcaagcaaaata

SEQ ID NO: 195577 - DNA, 15 bp, Homo sapiens
gctctcaagcaaaat

SEQ ID NO: 195578 - DNA, 15 bp, Homo sapiens
tgctctcaagcaaaa

SEQ ID NO: 195579 - DNA, 15 bp, Homo sapiens
ttgctctcaagcaaa

SEQ ID NO: 195580 - DNA, 15 bp, Homo sapiens
gttgctctcaagcaa

SEQ ID NO: 195581 - DNA, 15 bp, Homo sapiens
agttgctctcaagca

SEQ ID NO: 195582 - DNA, 15 bp, Homo sapiens
gagttgctctcaagc

SEQ ID NO: 195583 - DNA, 15 bp, Homo sapiens
tgagttgctctcaag

SEQ ID NO: 195584 - DNA, 15 bp, Homo sapiens
atgagttgctctcaa

SEQ ID NO: 195585 - DNA, 15 bp, Homo sapiens
gatgagttgctctca

SEQ ID NO: 195586 - DNA, 15 bp, Homo sapiens
agatgagttgctctc

SEQ ID NO: 195587 - DNA, 15 bp, Homo sapiens
cagatgagttgctct

SEQ ID NO: 195588 - DNA, 15 bp, Homo sapiens
acagatgagttgctc

SEQ ID NO: 195589 - DNA, 15 bp, Homo sapiens
cacagatgagttgct

SEQ ID NO: 195590 - DNA, 15 bp, Homo sapiens
tcacagatgagttgc

SEQ ID NO: 195591 - DNA, 15 bp, Homo sapiens
ttcacagatgagttg

SEQ ID NO: 195592 - DNA, 15 bp, Homo sapiens
attcacagatgagtt

SEQ ID NO: 195593 - DNA, 15 bp, Homo sapiens
tattcacagatgagt

SEQ ID NO: 195594 - DNA, 15 bp, Homo sapiens
atattcacagatgag

SEQ ID NO: 195595 - DNA, 15 bp, Homo sapiens
tatattcacagatga

SEQ ID NO: 195596 - DNA, 15 bp, Homo sapiens
ttatattcacagatg

SEQ ID NO: 195597 - DNA, 15 bp, Homo sapiens
tttatattcacagat

SEQ ID NO: 195598 - DNA, 15 bp, Homo sapiens
ctttatattcacaga

SEQ ID NO: 195599 - DNA, 15 bp, Homo sapiens
tctttatattcacag

SEQ ID NO: 195600 - DNA, 15 bp, Homo sapiens
atctttatattcaca

SEQ ID NO: 195601 - DNA, 15 bp, Homo sapiens
tatctttatattcac

SEQ ID NO: 195602 - DNA, 15 bp, Homo sapiens
atatctttatattca

SEQ ID NO: 195603 - DNA, 15 bp, Homo sapiens
tatatctttatattc

SEQ ID NO: 195604 - DNA, 15 bp, Homo sapiens
gtatatctttatatt

SEQ ID NO: 195605 - DNA, 15 bp, Homo sapiens
agtatatctttatat

SEQ ID NO: 195606 - DNA, 15 bp, Homo sapiens
cagtatatctttata

SEQ ID NO: 195607 - DNA, 15 bp, Homo sapiens
tcagtatatctttat

SEQ ID NO: 195608 - DNA, 15 bp, Homo sapiens
atcagtatatcttta

SEQ ID NO: 195609 - DNA, 15 bp, Homo sapiens
aatcagtatatcttt

SEQ ID NO: 195610 - DNA, 15 bp, Homo sapiens
gaatcagtatatctt

SEQ ID NO: 195611 - DNA, 15 bp, Homo sapiens
ggaatcagtatatct

SEQ ID NO: 195612 - DNA, 15 bp, Homo sapiens
aggaatcagtatatc

SEQ ID NO: 195613 - DNA, 15 bp, Homo sapiens
taggaatcagtatat

SEQ ID NO: 195614 - DNA, 15 bp, Homo sapiens
ttaggaatcagtata

SEQ ID NO: 195615 - DNA, 15 bp, Homo sapiens
gttaggaatcagtat

SEQ ID NO: 195616 - DNA, 15 bp, Homo sapiens
tgttaggaatcagta

SEQ ID NO: 195617 - DNA, 15 bp, Homo sapiens
gtgttaggaatcagt

SEQ ID NO: 195618 - DNA, 15 bp, Homo sapiens
agtgttaggaatcag

SEQ ID NO: 195619 - DNA, 15 bp, Homo sapiens
aagtgttaggaatca

SEQ ID NO: 195620 - DNA, 15 bp, Homo sapiens
caagtgttaggaatc

SEQ ID NO: 195621 - DNA, 15 bp, Homo sapiens
gcaagtgttaggaat

SEQ ID NO: 195622 - DNA, 15 bp, Homo sapiens
tgcaagtgttaggaa

SEQ ID NO: 195623 - DNA, 15 bp, Homo sapiens
atgcaagtgttagga

SEQ ID NO: 195624 - DNA, 15 bp, Homo sapiens
aatgcaagtgttagg

SEQ ID NO: 195625 - DNA, 15 bp, Homo sapiens
taatgcaagtgttag

SEQ ID NO: 195626 - DNA, 15 bp, Homo sapiens
ataatgcaagtgtta

SEQ ID NO: 195627 - DNA, 15 bp, Homo sapiens
gataatgcaagtgtt

SEQ ID NO: 195628 - DNA, 15 bp, Homo sapiens
agataatgcaagtgt

SEQ ID NO: 195629 - DNA, 15 bp, Homo sapiens
tagataatgcaagtg

SEQ ID NO: 195630 - DNA, 15 bp, Homo sapiens
atagataatgcaagt

SEQ ID NO: 195631 - DNA, 15 bp, Homo sapiens
aatagataatgcaag

SEQ ID NO: 195632 - DNA, 15 bp, Homo sapiens
aaatagataatgcaa

SEQ ID NO: 195633 - DNA, 15 bp, Homo sapiens
caaatagataatgca

SEQ ID NO: 195634 - DNA, 15 bp, Homo sapiens
gcaaatagataatgc

SEQ ID NO: 195635 - DNA, 15 bp, Homo sapiens
agcaaatagataatg

SEQ ID NO: 195636 - DNA, 15 bp, Homo sapiens
aagcaaatagataat

SEQ ID NO: 195637 - DNA, 15 bp, Homo sapiens
aaagcaaatagataa

SEQ ID NO: 195638 - DNA, 15 bp, Homo sapiens
aaaagcaaatagata

SEQ ID NO: 195639 - DNA, 15 bp, Homo sapiens
aaaaagcaaatagat

SEQ ID NO: 195640 - DNA, 15 bp, Homo sapiens
aaaaaagcaaataga

SEQ ID NO: 195641 - DNA, 15 bp, Homo sapiens
gaaaaaagcaaatag

SEQ ID NO: 195642 - DNA, 15 bp, Homo sapiens
agaaaaaagcaaata

SEQ ID NO: 195643 - DNA, 15 bp, Homo sapiens
cagaaaaaagcaaat

SEQ ID NO: 195644 - DNA, 15 bp, Homo sapiens
acagaaaaaagcaaa

SEQ ID NO: 195645 - DNA, 15 bp, Homo sapiens
aacagaaaaaagcaa

SEQ ID NO: 195646 - DNA, 15 bp, Homo sapiens
aaacagaaaaaagca

SEQ ID NO: 195647 - DNA, 15 bp, Homo sapiens
taaacagaaaaaagc

SEQ ID NO: 195648 - DNA, 15 bp, Homo sapiens
ctaaacagaaaaaag

SEQ ID NO: 195649 - DNA, 15 bp, Homo sapiens
cctaaacagaaaaaa

SEQ ID NO: 195650 - DNA, 15 bp, Homo sapiens
tcctaaacagaaaaa

SEQ ID NO: 195651 - DNA, 15 bp, Homo sapiens
gtcctaaacagaaaa

SEQ ID NO: 195652 - DNA, 15 bp, Homo sapiens
tgtcctaaacagaaa

SEQ ID NO: 195653 - DNA, 15 bp, Homo sapiens
atgtcctaaacagaa

SEQ ID NO: 195654 - DNA, 15 bp, Homo sapiens
gatgtcctaaacaga

SEQ ID NO: 195655 - DNA, 15 bp, Homo sapiens
ggatgtcctaaacag

SEQ ID NO: 195656 - DNA, 15 bp, Homo sapiens
tggatgtcctaaaca

SEQ ID NO: 195657 - DNA, 15 bp, Homo sapiens
ctggatgtcctaaac

SEQ ID NO: 195658 - DNA, 15 bp, Homo sapiens
cctggatgtcctaaa

SEQ ID NO: 195659 - DNA, 15 bp, Homo sapiens
gcctggatgtcctaa

SEQ ID NO: 195660 - DNA, 15 bp, Homo sapiens
tgcctggatgtccta

SEQ ID NO: 195661 - DNA, 15 bp, Homo sapiens
ctgcctggatgtcct

SEQ ID NO: 195662 - DNA, 15 bp, Homo sapiens
tctgcctggatgtcc

SEQ ID NO: 195663 - DNA, 15 bp, Homo sapiens
ttctgcctggatgtc

SEQ ID NO: 195664 - DNA, 15 bp, Homo sapiens
tttctgcctggatgt

SEQ ID NO: 195665 - DNA, 15 bp, Homo sapiens
atttctgcctggatg

SEQ ID NO: 195666 - DNA, 15 bp, Homo sapiens
aatttctgcctggat

SEQ ID NO: 195667 - DNA, 15 bp, Homo sapiens
caatttctgcctgga

SEQ ID NO: 195668 - DNA, 15 bp, Homo sapiens
tcaatttctgcctgg

SEQ ID NO: 195669 - DNA, 15 bp, Homo sapiens
atcaatttctgcctg

SEQ ID NO: 195670 - DNA, 15 bp, Homo sapiens
catcaatttctgcct

SEQ ID NO: 195671 - DNA, 15 bp, Homo sapiens
gcatcaatttctgcc

SEQ ID NO: 195672 - DNA, 15 bp, Homo sapiens
ggcatcaatttctgc

SEQ ID NO: 195673 - DNA, 15 bp, Homo sapiens
gggcatcaatttctg

SEQ ID NO: 195674 - DNA, 15 bp, Homo sapiens
tgggcatcaatttct

SEQ ID NO: 195675 - DNA, 15 bp, Homo sapiens
gtgggcatcaatttc

SEQ ID NO: 195676 - DNA, 15 bp, Homo sapiens
tgtgggcatcaattt

SEQ ID NO: 195677 - DNA, 15 bp, Homo sapiens
ttgtgggcatcaatt

SEQ ID NO: 195678 - DNA, 15 bp, Homo sapiens
attgtgggcatcaat

SEQ ID NO: 195679 - DNA, 15 bp, Homo sapiens
cattgtgggcatcaa

SEQ ID NO: 195680 - DNA, 15 bp, Homo sapiens
tcattgtgggcatca

SEQ ID NO: 195681 - DNA, 15 bp, Homo sapiens
gtcattgtgggcatc

SEQ ID NO: 195682 - DNA, 15 bp, Homo sapiens
tgtcattgtgggcat

SEQ ID NO: 195683 - DNA, 15 bp, Homo sapiens
atgtcattgtgggca

SEQ ID NO: 195684 - DNA, 15 bp, Homo sapiens
tatgtcattgtgggc

SEQ ID NO: 195685 - DNA, 15 bp, Homo sapiens
atatgtcattgtggg

SEQ ID NO: 195686 - DNA, 15 bp, Homo sapiens
aatatgtcattgtgg

SEQ ID NO: 195687 - DNA, 15 bp, Homo sapiens
aaatatgtcattgtg

SEQ ID NO: 195688 - DNA, 15 bp, Homo sapiens
taaatatgtcattgt

SEQ ID NO: 195689 - DNA, 15 bp, Homo sapiens
ttaaatatgtcattg

SEQ ID NO: 195690 - DNA, 15 bp, Homo sapiens
tttaaatatgtcatt

SEQ ID NO: 195691 - DNA, 15 bp, Homo sapiens
ttttaaatatgtcat

SEQ ID NO: 195692 - DNA, 15 bp, Homo sapiens
cttttaaatatgtca

SEQ ID NO: 195693 - DNA, 15 bp, Homo sapiens
gcttttaaatatgtc

SEQ ID NO: 195694 - DNA, 15 bp, Homo sapiens
tgcttttaaatatgt

SEQ ID NO: 195695 - DNA, 15 bp, Homo sapiens
atgcttttaaatatg

SEQ ID NO: 195696 - DNA, 15 bp, Homo sapiens
aatgcttttaaatat

SEQ ID NO: 195697 - DNA, 15 bp, Homo sapiens
caatgcttttaaata

SEQ ID NO: 195698 - DNA, 15 bp, Homo sapiens
tcaatgcttttaaat

SEQ ID NO: 195699 - DNA, 15 bp, Homo sapiens
gtcaatgcttttaaa

SEQ ID NO: 195700 - DNA, 15 bp, Homo sapiens
cgtcaatgcttttaa

SEQ ID NO: 195701 - DNA, 15 bp, Homo sapiens
ccgtcaatgctttta

SEQ ID NO: 195702 - DNA, 15 bp, Homo sapiens
tccgtcaatgctttt

SEQ ID NO: 195703 - DNA, 15 bp, Homo sapiens
ttccgtcaatgcttt

SEQ ID NO: 195704 - DNA, 15 bp, Homo sapiens
tttccgtcaatgctt

SEQ ID NO: 195705 - DNA, 15 bp, Homo sapiens
gtttccgtcaatgct

SEQ ID NO: 195706 - DNA, 15 bp, Homo sapiens
tgtttccgtcaatgc

SEQ ID NO: 195707 - DNA, 15 bp, Homo sapiens
ctgtttccgtcaatg

SEQ ID NO: 195708 - DNA, 15 bp, Homo sapiens
cctgtttccgtcaat

SEQ ID NO: 195709 - DNA, 15 bp, Homo sapiens
gcctgtttccgtcaa

SEQ ID NO: 195710 - DNA, 15 bp, Homo sapiens
tgcctgtttccgtca

SEQ ID NO: 195711 - DNA, 15 bp, Homo sapiens
ctgcctgtttccgtc

SEQ ID NO: 195712 - DNA, 15 bp, Homo sapiens
tctgcctgtttccgt

SEQ ID NO: 195713 - DNA, 15 bp, Homo sapiens
ttctgcctgtttccg

SEQ ID NO: 195714 - DNA, 15 bp, Homo sapiens
cttctgcctgtttcc

SEQ ID NO: 195715 - DNA, 15 bp, Homo sapiens
tcttctgcctgtttc

SEQ ID NO: 195716 - DNA, 15 bp, Homo sapiens
atcttctgcctgttt

SEQ ID NO: 195717 - DNA, 15 bp, Homo sapiens
catcttctgcctgtt

SEQ ID NO: 195718 - DNA, 15 bp, Homo sapiens
ccatcttctgcctgt

SEQ ID NO: 195719 - DNA, 15 bp, Homo sapiens
accatcttctgcctg

SEQ ID NO: 195720 - DNA, 15 bp, Homo sapiens
taccatcttctgcct

SEQ ID NO: 195721 - DNA, 15 bp, Homo sapiens
ttaccatcttctgcc

SEQ ID NO: 195722 - DNA, 15 bp, Homo sapiens
tttaccatcttctgc

SEQ ID NO: 195723 - DNA, 15 bp, Homo sapiens
ttttaccatcttctg

SEQ ID NO: 195724 - DNA, 15 bp, Homo sapiens
cttttaccatcttct

SEQ ID NO: 195725 - DNA, 15 bp, Homo sapiens
gcttttaccatcttc

SEQ ID NO: 195726 - DNA, 15 bp, Homo sapiens
agcttttaccatctt

SEQ ID NO: 195727 - DNA, 15 bp, Homo sapiens
aagcttttaccatct

SEQ ID NO: 195728 - DNA, 15 bp, Homo sapiens
aaagcttttaccatc

SEQ ID NO: 195729 - DNA, 15 bp, Homo sapiens
caaagcttttaccat

SEQ ID NO: 195730 - DNA, 15 bp, Homo sapiens
ccaaagcttttacca

SEQ ID NO: 195731 - DNA, 15 bp, Homo sapiens
cccaaagcttttacc

SEQ ID NO: 195732 - DNA, 15 bp, Homo sapiens
tcccaaagcttttac

SEQ ID NO: 195733 - DNA, 15 bp, Homo sapiens
ttcccaaagctttta

SEQ ID NO: 195734 - DNA, 15 bp, Homo sapiens
tttcccaaagctttt

SEQ ID NO: 195735 - DNA, 15 bp, Homo sapiens
atttcccaaagcttt

SEQ ID NO: 195736 - DNA, 15 bp, Homo sapiens
aatttcccaaagctt

SEQ ID NO: 195737 - DNA, 15 bp, Homo sapiens
gaatttcccaaagct

SEQ ID NO: 195738 - DNA, 15 bp, Homo sapiens
agaatttcccaaagc

SEQ ID NO: 195739 - DNA, 15 bp, Homo sapiens
cagaatttcccaaag

SEQ ID NO: 195740 - DNA, 15 bp, Homo sapiens
tcagaatttcccaaa

SEQ ID NO: 195741 - DNA, 15 bp, Homo sapiens
ttcagaatttcccaa

SEQ ID NO: 195742 - DNA, 15 bp, Homo sapiens
cttcagaatttccca

SEQ ID NO: 195743 - DNA, 15 bp, Homo sapiens
tcttcagaatttccc

SEQ ID NO: 195744 - DNA, 15 bp, Homo sapiens
ctcttcagaatttcc

SEQ ID NO: 195745 - DNA, 15 bp, Homo sapiens
cctcttcagaatttc

SEQ ID NO: 195746 - DNA, 15 bp, Homo sapiens
gcctcttcagaattt

SEQ ID NO: 195747 - DNA, 15 bp, Homo sapiens
agcctcttcagaatt

SEQ ID NO: 195748 - DNA, 15 bp, Homo sapiens
tagcctcttcagaat

SEQ ID NO: 195749 - DNA, 15 bp, Homo sapiens
gtagcctcttcagaa

SEQ ID NO: 195750 - DNA, 15 bp, Homo sapiens
agtagcctcttcaga

SEQ ID NO: 195751 - DNA, 15 bp, Homo sapiens
tagtagcctcttcag

SEQ ID NO: 195752 - DNA, 15 bp, Homo sapiens
atagtagcctcttca

SEQ ID NO: 195753 - DNA, 15 bp, Homo sapiens
catagtagcctcttc

SEQ ID NO: 195754 - DNA, 15 bp, Homo sapiens
gcatagtagcctctt

SEQ ID NO: 195755 - DNA, 15 bp, Homo sapiens
agcatagtagcctct

SEQ ID NO: 195756 - DNA, 15 bp, Homo sapiens
aagcatagtagcctc

SEQ ID NO: 195757 - DNA, 15 bp, Homo sapiens
gaagcatagtagcct

SEQ ID NO: 195758 - DNA, 15 bp, Homo sapiens
tgaagcatagtagcc

SEQ ID NO: 195759 - DNA, 15 bp, Homo sapiens
ttgaagcatagtagc

SEQ ID NO: 195760 - DNA, 15 bp, Homo sapiens
gttgaagcatagtag

SEQ ID NO: 195761 - DNA, 15 bp, Homo sapiens
tgttgaagcatagta

SEQ ID NO: 195762 - DNA, 15 bp, Homo sapiens
atgttgaagcatagt

SEQ ID NO: 195763 - DNA, 15 bp, Homo sapiens
gatgttgaagcatag

SEQ ID NO: 195764 - DNA, 15 bp, Homo sapiens
cgatgttgaagcata

SEQ ID NO: 195765 - DNA, 15 bp, Homo sapiens
tcgatgttgaagcat

SEQ ID NO: 195766 - DNA, 15 bp, Homo sapiens
gtcgatgttgaagca

SEQ ID NO: 195767 - DNA, 15 bp, Homo sapiens
agtcgatgttgaagc

SEQ ID NO: 195768 - DNA, 15 bp, Homo sapiens
cagtcgatgttgaag

SEQ ID NO: 195769 - DNA, 15 bp, Homo sapiens
ccagtcgatgttgaa

SEQ ID NO: 195770 - DNA, 15 bp, Homo sapiens
tccagtcgatgttga

SEQ ID NO: 195771 - DNA, 15 bp, Homo sapiens
atccagtcgatgttg

SEQ ID NO: 195772 - DNA, 15 bp, Homo sapiens
catccagtcgatgtt

SEQ ID NO: 195773 - DNA, 15 bp, Homo sapiens
tcatccagtcgatgt

SEQ ID NO: 195774 - DNA, 15 bp, Homo sapiens
atcatccagtcgatg

SEQ ID NO: 195775 - DNA, 15 bp, Homo sapiens
tatcatccagtcgat

SEQ ID NO: 195776 - DNA, 15 bp, Homo sapiens
atatcatccagtcga

SEQ ID NO: 195777 - DNA, 15 bp, Homo sapiens
catatcatccagtcg

SEQ ID NO: 195778 - DNA, 15 bp, Homo sapiens
tcatatcatccagtc

SEQ ID NO: 195779 - DNA, 15 bp, Homo sapiens
ttcatatcatccagt

SEQ ID NO: 195780 - DNA, 15 bp, Homo sapiens
gttcatatcatccag

SEQ ID NO: 195781 - DNA, 15 bp, Homo sapiens
ggttcatatcatcca

SEQ ID NO: 195782 - DNA, 15 bp, Homo sapiens
tggttcatatcatcc

SEQ ID NO: 195783 - DNA, 15 bp, Homo sapiens
ttggttcatatcatc

SEQ ID NO: 195784 - DNA, 15 bp, Homo sapiens
tttggttcatatcat

SEQ ID NO: 195785 - DNA, 15 bp, Homo sapiens
ctttggttcatatca

SEQ ID NO: 195786 - DNA, 15 bp, Homo sapiens
tctttggttcatatc

SEQ ID NO: 195787 - DNA, 15 bp, Homo sapiens
atctttggttcatat

SEQ ID NO: 195788 - DNA, 15 bp, Homo sapiens
catctttggttcata

SEQ ID NO: 195789 - DNA, 15 bp, Homo sapiens
ccatctttggttcat

SEQ ID NO: 195790 - DNA, 15 bp, Homo sapiens
tccatctttggttca

SEQ ID NO: 195791 - DNA, 15 bp, Homo sapiens
ttccatctttggttc

SEQ ID NO: 195792 - DNA, 15 bp, Homo sapiens
attccatctttggtt

SEQ ID NO: 195793 - DNA, 15 bp, Homo sapiens
cattccatctttggt

SEQ ID NO: 195794 - DNA, 15 bp, Homo sapiens
tcattccatctttgg

SEQ ID NO: 195795 - DNA, 15 bp, Homo sapiens
gtcattccatctttg

SEQ ID NO: 195796 - DNA, 15 bp, Homo sapiens
agtcattccatcttt

SEQ ID NO: 195797 - DNA, 15 bp, Homo sapiens
aagtcattccatctt

SEQ ID NO: 195798 - DNA, 15 bp, Homo sapiens
taagtcattccatct

SEQ ID NO: 195799 - DNA, 15 bp, Homo sapiens
ttaagtcattccatc

SEQ ID NO: 195800 - DNA, 15 bp, Homo sapiens
tttaagtcattccat

SEQ ID NO: 195801 - DNA, 15 bp, Homo sapiens
ttttaagtcattcca

SEQ ID NO: 195802 - DNA, 15 bp, Homo sapiens
cttttaagtcattcc

SEQ ID NO: 195803 - DNA, 15 bp, Homo sapiens
gcttttaagtcattc

SEQ ID NO: 195804 - DNA, 15 bp, Homo sapiens
tgcttttaagtcatt

SEQ ID NO: 195805 - DNA, 15 bp, Homo sapiens
ttgcttttaagtcat

SEQ ID NO: 195806 - DNA, 15 bp, Homo sapiens
tttgcttttaagtca

SEQ ID NO: 195807 - DNA, 15 bp, Homo sapiens
ttttgcttttaagtc

SEQ ID NO: 195808 - DNA, 15 bp, Homo sapiens
attttgcttttaagt

SEQ ID NO: 195809 - DNA, 15 bp, Homo sapiens
gattttgcttttaag

SEQ ID NO: 195810 - DNA, 15 bp, Homo sapiens
agattttgcttttaa

SEQ ID NO: 195811 - DNA, 15 bp, Homo sapiens
cagattttgctttta

SEQ ID NO: 195812 - DNA, 15 bp, Homo sapiens
gcagattttgctttt

SEQ ID NO: 195813 - DNA, 15 bp, Homo sapiens
agcagattttgcttt

SEQ ID NO: 195814 - DNA, 15 bp, Homo sapiens
tagcagattttgctt

SEQ ID NO: 195815 - DNA, 15 bp, Homo sapiens
ctagcagattttgct

SEQ ID NO: 195816 - DNA, 15 bp, Homo sapiens
gctagcagattttgc

SEQ ID NO: 195817 - DNA, 15 bp, Homo sapiens
tgctagcagattttg

SEQ ID NO: 195818 - DNA, 15 bp, Homo sapiens
atgctagcagatttt

SEQ ID NO: 195819 - DNA, 15 bp, Homo sapiens
gatgctagcagattt

SEQ ID NO: 195820 - DNA, 15 bp, Homo sapiens
tgatgctagcagatt

SEQ ID NO: 195821 - DNA, 15 bp, Homo sapiens
ctgatgctagcagat

SEQ ID NO: 195822 - DNA, 15 bp, Homo sapiens
cctgatgctagcaga

SEQ ID NO: 195823 - DNA, 15 bp, Homo sapiens
acctgatgctagcag

SEQ ID NO: 195824 - DNA, 15 bp, Homo sapiens
gacctgatgctagca

SEQ ID NO: 195825 - DNA, 15 bp, Homo sapiens
tgacctgatgctagc

SEQ ID NO: 195826 - DNA, 15 bp, Homo sapiens
ctgacctgatgctag

SEQ ID NO: 195827 - DNA, 15 bp, Homo sapiens
tctgacctgatgcta

SEQ ID NO: 195828 - DNA, 15 bp, Homo sapiens
ttctgacctgatgct

SEQ ID NO: 195829 - DNA, 15 bp, Homo sapiens
attctgacctgatgc

SEQ ID NO: 195830 - DNA, 15 bp, Homo sapiens
tattctgacctgatg

SEQ ID NO: 195831 - DNA, 15 bp, Homo sapiens
ctattctgacctgat

SEQ ID NO: 195832 - DNA, 15 bp, Homo sapiens
actattctgacctga

SEQ ID NO: 195833 - DNA, 15 bp, Homo sapiens
gactattctgacctg

SEQ ID NO: 195834 - DNA, 15 bp, Homo sapiens
tgactattctgacct

SEQ ID NO: 195835 - DNA, 15 bp, Homo sapiens
ttgactattctgacc

SEQ ID NO: 195836 - DNA, 15 bp, Homo sapiens
attgactattctgac

SEQ ID NO: 195837 - DNA, 15 bp, Homo sapiens
tattgactattctga

SEQ ID NO: 195838 - DNA, 15 bp, Homo sapiens
atattgactattctg

SEQ ID NO: 195839 - DNA, 15 bp, Homo sapiens
gatattgactattct

SEQ ID NO: 195840 - DNA, 15 bp, Homo sapiens
tgatattgactattc

SEQ ID NO: 195841 - DNA, 15 bp, Homo sapiens
ttgatattgactatt

SEQ ID NO: 195842 - DNA, 15 bp, Homo sapiens
tttgatattgactat

SEQ ID NO: 195843 - DNA, 15 bp, Homo sapiens
ttttgatattgacta

SEQ ID NO: 195844 - DNA, 15 bp, Homo sapiens
attttgatattgact

SEQ ID NO: 195845 - DNA, 15 bp, Homo sapiens
tattttgatattgac

SEQ ID NO: 195846 - DNA, 15 bp, Homo sapiens
ttattttgatattga

SEQ ID NO: 195847 - DNA, 15 bp, Homo sapiens
tttattttgatattg

SEQ ID NO: 195848 - DNA, 15 bp, Homo sapiens
ttttattttgatatt

SEQ ID NO: 195849 - DNA, 15 bp, Homo sapiens
tttttattttgatat

SEQ ID NO: 195850 - DNA, 15 bp, Homo sapiens
atttttattttgata

SEQ ID NO: 195851 - DNA, 15 bp, Homo sapiens
tatttttattttgat

SEQ ID NO: 195852 - DNA, 15 bp, Homo sapiens
ttatttttattttga

SEQ ID NO: 195853 - DNA, 15 bp, Homo sapiens
attatttttattttg

SEQ ID NO: 195854 - DNA, 15 bp, Homo sapiens
cattatttttatttt

SEQ ID NO: 195855 - DNA, 15 bp, Homo sapiens
ccattatttttattt

SEQ ID NO: 195856 - DNA, 15 bp, Homo sapiens
cccattatttttatt

SEQ ID NO: 195857 - DNA, 15 bp, Homo sapiens
ccccattatttttat

SEQ ID NO: 195858 - DNA, 15 bp, Homo sapiens
accccattattttta

SEQ ID NO: 195859 - DNA, 15 bp, Homo sapiens
caccccattattttt

SEQ ID NO: 195860 - DNA, 15 bp, Homo sapiens
ccaccccattatttt

SEQ ID NO: 195861 - DNA, 15 bp, Homo sapiens
tccaccccattattt

SEQ ID NO: 195862 - DNA, 15 bp, Homo sapiens
ttccaccccattatt

SEQ ID NO: 195863 - DNA, 15 bp, Homo sapiens
cttccaccccattat

SEQ ID NO: 195864 - DNA, 15 bp, Homo sapiens
ccttccaccccatta

SEQ ID NO: 195865 - DNA, 15 bp, Homo sapiens
cccttccaccccatt

SEQ ID NO: 195866 - DNA, 15 bp, Homo sapiens
ccccttccaccccat

SEQ ID NO: 195867 - DNA, 15 bp, Homo sapiens
accccttccacccca

SEQ ID NO: 195868 - DNA, 15 bp, Homo sapiens
taccccttccacccc

SEQ ID NO: 195869 - DNA, 15 bp, Homo sapiens
ctaccccttccaccc

SEQ ID NO: 195870 - DNA, 15 bp, Homo sapiens
tctaccccttccacc

SEQ ID NO: 195871 - DNA, 15 bp, Homo sapiens
atctaccccttccac

SEQ ID NO: 195872 - DNA, 15 bp, Homo sapiens
tatctaccccttcca

SEQ ID NO: 195873 - DNA, 15 bp, Homo sapiens
gtatctaccccttcc

SEQ ID NO: 195874 - DNA, 15 bp, Homo sapiens
agtatctaccccttc

SEQ ID NO: 195875 - DNA, 15 bp, Homo sapiens
aagtatctacccctt

SEQ ID NO: 195876 - DNA, 15 bp, Homo sapiens
caagtatctacccct

SEQ ID NO: 195877 - DNA, 15 bp, Homo sapiens
acaagtatctacccc

SEQ ID NO: 195878 - DNA, 15 bp, Homo sapiens
cacaagtatctaccc

SEQ ID NO: 195879 - DNA, 15 bp, Homo sapiens
tcacaagtatctacc

SEQ ID NO: 195880 - DNA, 15 bp, Homo sapiens
atcacaagtatctac

SEQ ID NO: 195881 - DNA, 15 bp, Homo sapiens
aatcacaagtatcta

SEQ ID NO: 195882 - DNA, 15 bp, Homo sapiens
aaatcacaagtatct

SEQ ID NO: 195883 - DNA, 15 bp, Homo sapiens
aaaatcacaagtatc

SEQ ID NO: 195884 - DNA, 15 bp, Homo sapiens
aaaaatcacaagtat

SEQ ID NO: 195885 - DNA, 15 bp, Homo sapiens
caaaaatcacaagta

SEQ ID NO: 195886 - DNA, 15 bp, Homo sapiens
acaaaaatcacaagt

SEQ ID NO: 195887 - DNA, 15 bp, Homo sapiens
tacaaaaatcacaag

SEQ ID NO: 195888 - DNA, 15 bp, Homo sapiens
atacaaaaatcacaa

SEQ ID NO: 195889 - DNA, 15 bp, Homo sapiens
tatacaaaaatcaca

SEQ ID NO: 195890 - DNA, 15 bp, Homo sapiens
atatacaaaaatcac

SEQ ID NO: 195891 - DNA, 15 bp, Homo sapiens
gatatacaaaaatca

SEQ ID NO: 195892 - DNA, 15 bp, Homo sapiens
tgatatacaaaaatc

SEQ ID NO: 195893 - DNA, 15 bp, Homo sapiens
ctgatatacaaaaat

SEQ ID NO: 195894 - DNA, 15 bp, Homo sapiens
tctgatatacaaaaa

SEQ ID NO: 195895 - DNA, 15 bp, Homo sapiens
ttctgatatacaaaa

SEQ ID NO: 195896 - DNA, 15 bp, Homo sapiens
tttctgatatacaaa

SEQ ID NO: 195897 - DNA, 15 bp, Homo sapiens
ctttctgatatacaa

SEQ ID NO: 195898 - DNA, 15 bp, Homo sapiens
tctttctgatataca

SEQ ID NO: 195899 - DNA, 15 bp, Homo sapiens
ctctttctgatatac

SEQ ID NO: 195900 - DNA, 15 bp, Homo sapiens
tctctttctgatata

SEQ ID NO: 195901 - DNA, 15 bp, Homo sapiens
ttctctttctgatat

SEQ ID NO: 195902 - DNA, 15 bp, Homo sapiens
tttctctttctgata

SEQ ID NO: 195903 - DNA, 15 bp, Homo sapiens
ctttctctttctgat

SEQ ID NO: 195904 - DNA, 15 bp, Homo sapiens
gctttctctttctga

SEQ ID NO: 195905 - DNA, 15 bp, Homo sapiens
cgctttctctttctg

SEQ ID NO: 195906 - DNA, 15 bp, Homo sapiens
gcgctttctctttct

SEQ ID NO: 195907 - DNA, 15 bp, Homo sapiens
tgcgctttctctttc

SEQ ID NO: 195908 - DNA, 15 bp, Homo sapiens
ctgcgctttctcttt

SEQ ID NO: 195909 - DNA, 15 bp, Homo sapiens
gctgcgctttctctt

SEQ ID NO: 195910 - DNA, 15 bp, Homo sapiens
ggctgcgctttctct

SEQ ID NO: 195911 - DNA, 15 bp, Homo sapiens
aggctgcgctttctc

SEQ ID NO: 195912 - DNA, 15 bp, Homo sapiens
aaggctgcgctttct

SEQ ID NO: 195913 - DNA, 15 bp, Homo sapiens
taaggctgcgctttc

SEQ ID NO: 195914 - DNA, 15 bp, Homo sapiens
gtaaggctgcgcttt

SEQ ID NO: 195915 - DNA, 15 bp, Homo sapiens
ggtaaggctgcgctt

SEQ ID NO: 195916 - DNA, 15 bp, Homo sapiens
tggtaaggctgcgct

SEQ ID NO: 195917 - DNA, 15 bp, Homo sapiens
gtggtaaggctgcgc

SEQ ID NO: 195918 - DNA, 15 bp, Homo sapiens
ggtggtaaggctgcg

SEQ ID NO: 195919 - DNA, 15 bp, Homo sapiens
tggtggtaaggctgc

SEQ ID NO: 195920 - DNA, 15 bp, Homo sapiens
gtggtggtaaggctg

SEQ ID NO: 195921 - DNA, 15 bp, Homo sapiens
agtggtggtaaggct

SEQ ID NO: 195922 - DNA, 15 bp, Homo sapiens
aagtggtggtaaggc

SEQ ID NO: 195923 - DNA, 15 bp, Homo sapiens
gaagtggtggtaagg

SEQ ID NO: 195924 - DNA, 15 bp, Homo sapiens
agaagtggtggtaag

SEQ ID NO: 195925 - DNA, 15 bp, Homo sapiens
tagaagtggtggtaa

SEQ ID NO: 195926 - DNA, 15 bp, Homo sapiens
atagaagtggtggta

SEQ ID NO: 195927 - DNA, 15 bp, Homo sapiens
aatagaagtggtggt

SEQ ID NO: 195928 - DNA, 15 bp, Homo sapiens
aaatagaagtggtgg

SEQ ID NO: 195929 - DNA, 15 bp, Homo sapiens
gaaatagaagtggtg

SEQ ID NO: 195930 - DNA, 15 bp, Homo sapiens
tgaaatagaagtggt

SEQ ID NO: 195931 - DNA, 15 bp, Homo sapiens
atgaaatagaagtgg

SEQ ID NO: 195932 - DNA, 15 bp, Homo sapiens
gatgaaatagaagtg

SEQ ID NO: 195933 - DNA, 15 bp, Homo sapiens
tgatgaaatagaagt

SEQ ID NO: 195934 - DNA, 15 bp, Homo sapiens
ctgatgaaatagaag

SEQ ID NO: 195935 - DNA, 15 bp, Homo sapiens
tctgatgaaatagaa

SEQ ID NO: 195936 - DNA, 15 bp, Homo sapiens
ttctgatgaaataga

SEQ ID NO: 195937 - DNA, 15 bp, Homo sapiens
tttctgatgaaatag

SEQ ID NO: 195938 - DNA, 15 bp, Homo sapiens
atttctgatgaaata

SEQ ID NO: 195939 - DNA, 15 bp, Homo sapiens
tatttctgatgaaat

SEQ ID NO: 195940 - DNA, 15 bp, Homo sapiens
ctatttctgatgaaa

SEQ ID NO: 195941 - DNA, 15 bp, Homo sapiens
actatttctgatgaa

SEQ ID NO: 195942 - DNA, 15 bp, Homo sapiens
aactatttctgatga

SEQ ID NO: 195943 - DNA, 15 bp, Homo sapiens
aaactatttctgatg

SEQ ID NO: 195944 - DNA, 15 bp, Homo sapiens
taaactatttctgat

SEQ ID NO: 195945 - DNA, 15 bp, Homo sapiens
ttaaactatttctga

SEQ ID NO: 195946 - DNA, 15 bp, Homo sapiens
cttaaactatttctg

SEQ ID NO: 195947 - DNA, 15 bp, Homo sapiens
tcttaaactatttct

SEQ ID NO: 195948 - DNA, 15 bp, Homo sapiens
atcttaaactatttc

SEQ ID NO: 195949 - DNA, 15 bp, Homo sapiens
aatcttaaactattt

SEQ ID NO: 195950 - DNA, 15 bp, Homo sapiens
aaatcttaaactatt

SEQ ID NO: 195951 - DNA, 15 bp, Homo sapiens
aaaatcttaaactat

SEQ ID NO: 195952 - DNA, 15 bp, Homo sapiens
taaaatcttaaacta

SEQ ID NO: 195953 - DNA, 15 bp, Homo sapiens
ttaaaatcttaaact

SEQ ID NO: 195954 - DNA, 15 bp, Homo sapiens
attaaaatcttaaac

SEQ ID NO: 195955 - DNA, 15 bp, Homo sapiens
cattaaaatcttaaa

SEQ ID NO: 195956 - DNA, 15 bp, Homo sapiens
gcattaaaatcttaa

SEQ ID NO: 195957 - DNA, 15 bp, Homo sapiens
tgcattaaaatctta

SEQ ID NO: 195958 - DNA, 15 bp, Homo sapiens
ttgcattaaaatctt

SEQ ID NO: 195959 - DNA, 15 bp, Homo sapiens
tttgcattaaaatct

SEQ ID NO: 195960 - DNA, 15 bp, Homo sapiens
ctttgcattaaaatc

SEQ ID NO: 195961 - DNA, 15 bp, Homo sapiens
gctttgcattaaaat

SEQ ID NO: 195962 - DNA, 15 bp, Homo sapiens
ggctttgcattaaaa

SEQ ID NO: 195963 - DNA, 15 bp, Homo sapiens
aggctttgcattaaa

SEQ ID NO: 195964 - DNA, 15 bp, Homo sapiens
caggctttgcattaa

SEQ ID NO: 195965 - DNA, 15 bp, Homo sapiens
acaggctttgcatta

SEQ ID NO: 195966 - DNA, 15 bp, Homo sapiens
aacaggctttgcatt

SEQ ID NO: 195967 - DNA, 15 bp, Homo sapiens
aaacaggctttgcat

SEQ ID NO: 195968 - DNA, 15 bp, Homo sapiens
gaaacaggctttgca

SEQ ID NO: 195969 - DNA, 15 bp, Homo sapiens
ggaaacaggctttgc

SEQ ID NO: 195970 - DNA, 15 bp, Homo sapiens
aggaaacaggctttg

SEQ ID NO: 195971 - DNA, 15 bp, Homo sapiens
aaggaaacaggcttt

SEQ ID NO: 195972 - DNA, 15 bp, Homo sapiens
caaggaaacaggctt

SEQ ID NO: 195973 - DNA, 15 bp, Homo sapiens
tcaaggaaacaggct

SEQ ID NO: 195974 - DNA, 15 bp, Homo sapiens
ctcaaggaaacaggc

SEQ ID NO: 195975 - DNA, 15 bp, Homo sapiens
actcaaggaaacagg

SEQ ID NO: 195976 - DNA, 15 bp, Homo sapiens
aactcaaggaaacag

SEQ ID NO: 195977 - DNA, 15 bp, Homo sapiens
taactcaaggaaaca

SEQ ID NO: 195978 - DNA, 15 bp, Homo sapiens
ataactcaaggaaac

SEQ ID NO: 195979 - DNA, 15 bp, Homo sapiens
tataactcaaggaaa

SEQ ID NO: 195980 - DNA, 15 bp, Homo sapiens
atataactcaaggaa

SEQ ID NO: 195981 - DNA, 15 bp, Homo sapiens
tatataactcaagga

SEQ ID NO: 195982 - DNA, 15 bp, Homo sapiens
ctatataactcaagg

SEQ ID NO: 195983 - DNA, 15 bp, Homo sapiens
actatataactcaag

SEQ ID NO: 195984 - DNA, 15 bp, Homo sapiens
aactatataactcaa

SEQ ID NO: 195985 - DNA, 15 bp, Homo sapiens
gaactatataactca

SEQ ID NO: 195986 - DNA, 15 bp, Homo sapiens
tgaactatataactc

SEQ ID NO: 195987 - DNA, 15 bp, Homo sapiens
ttgaactatataact

SEQ ID NO: 195988 - DNA, 15 bp, Homo sapiens
cttgaactatataac

SEQ ID NO: 195989 - DNA, 15 bp, Homo sapiens
gcttgaactatataa

SEQ ID NO: 195990 - DNA, 15 bp, Homo sapiens
agcttgaactatata

SEQ ID NO: 195991 - DNA, 15 bp, Homo sapiens
gagcttgaactatat

SEQ ID NO: 195992 - DNA, 15 bp, Homo sapiens
agagcttgaactata

SEQ ID NO: 195993 - DNA, 15 bp, Homo sapiens
tagagcttgaactat

SEQ ID NO: 195994 - DNA, 15 bp, Homo sapiens
atagagcttgaacta

SEQ ID NO: 195995 - DNA, 15 bp, Homo sapiens
aatagagcttgaact

SEQ ID NO: 195996 - DNA, 15 bp, Homo sapiens
aaatagagcttgaac

SEQ ID NO: 195997 - DNA, 15 bp, Homo sapiens
caaatagagcttgaa

SEQ ID NO: 195998 - DNA, 15 bp, Homo sapiens
acaaatagagcttga

SEQ ID NO: 195999 - DNA, 15 bp, Homo sapiens
cacaaatagagcttg

SEQ ID NO: 196000 - DNA, 15 bp, Homo sapiens
acacaaatagagctt

SEQ ID NO: 196001 - DNA, 15 bp, Homo sapiens
gacacaaatagagct

SEQ ID NO: 196002 - DNA, 15 bp, Homo sapiens
ggacacaaatagagc

SEQ ID NO: 196003 - DNA, 15 bp, Homo sapiens
tggacacaaatagag

SEQ ID NO: 196004 - DNA, 15 bp, Homo sapiens
ttggacacaaataga

SEQ ID NO: 196005 - DNA, 15 bp, Homo sapiens
attggacacaaatag

SEQ ID NO: 196006 - DNA, 15 bp, Homo sapiens
tattggacacaaata

SEQ ID NO: 196007 - DNA, 15 bp, Homo sapiens
gtattggacacaaat

SEQ ID NO: 196008 - DNA, 15 bp, Homo sapiens
agtattggacacaaa

SEQ ID NO: 196009 - DNA, 15 bp, Homo sapiens
aagtattggacacaa

SEQ ID NO: 196010 - DNA, 15 bp, Homo sapiens
aaagtattggacaca

SEQ ID NO: 196011 - DNA, 15 bp, Homo sapiens
gaaagtattggacac

SEQ ID NO: 196012 - DNA, 15 bp, Homo sapiens
agaaagtattggaca

SEQ ID NO: 196013 - DNA, 15 bp, Homo sapiens
cagaaagtattggac

SEQ ID NO: 196014 - DNA, 15 bp, Homo sapiens
gcagaaagtattgga

SEQ ID NO: 196015 - DNA, 15 bp, Homo sapiens
ggcagaaagtattgg

SEQ ID NO: 196016 - DNA, 15 bp, Homo sapiens
tggcagaaagtattg

SEQ ID NO: 196017 - DNA, 15 bp, Homo sapiens
gtggcagaaagtatt

SEQ ID NO: 196018 - DNA, 15 bp, Homo sapiens
ggtggcagaaagtat

SEQ ID NO: 196019 - DNA, 15 bp, Homo sapiens
aggtggcagaaagta

SEQ ID NO: 196020 - DNA, 15 bp, Homo sapiens
caggtggcagaaagt

SEQ ID NO: 196021 - DNA, 15 bp, Homo sapiens
acaggtggcagaaag

SEQ ID NO: 196022 - DNA, 15 bp, Homo sapiens
aacaggtggcagaaa

SEQ ID NO: 196023 - DNA, 15 bp, Homo sapiens
gaacaggtggcagaa

SEQ ID NO: 196024 - DNA, 15 bp, Homo sapiens
agaacaggtggcaga

SEQ ID NO: 196025 - DNA, 15 bp, Homo sapiens
tagaacaggtggcag

SEQ ID NO: 196026 - DNA, 15 bp, Homo sapiens
ctagaacaggtggca

SEQ ID NO: 196027 - DNA, 15 bp, Homo sapiens
tctagaacaggtggc

SEQ ID NO: 196028 - DNA, 15 bp, Homo sapiens
gtctagaacaggtgg

SEQ ID NO: 196029 - DNA, 15 bp, Homo sapiens
agtctagaacaggtg

SEQ ID NO: 196030 - DNA, 15 bp, Homo sapiens
tagtctagaacaggt

SEQ ID NO: 196031 - DNA, 15 bp, Homo sapiens
atagtctagaacagg

SEQ ID NO: 196032 - DNA, 15 bp, Homo sapiens
aatagtctagaacag

SEQ ID NO: 196033 - DNA, 15 bp, Homo sapiens
gaatagtctagaaca

SEQ ID NO: 196034 - DNA, 15 bp, Homo sapiens
tgaatagtctagaac

SEQ ID NO: 196035 - DNA, 15 bp, Homo sapiens
atgaatagtctagaa

SEQ ID NO: 196036 - DNA, 15 bp, Homo sapiens
tatgaatagtctaga

SEQ ID NO: 196037 - DNA, 15 bp, Homo sapiens
ttatgaatagtctag

SEQ ID NO: 196038 - DNA, 15 bp, Homo sapiens
tttatgaatagtcta

SEQ ID NO: 196039 - DNA, 15 bp, Homo sapiens
atttatgaatagtct

SEQ ID NO: 196040 - DNA, 15 bp, Homo sapiens
catttatgaatagtc

SEQ ID NO: 196041 - DNA, 15 bp, Homo sapiens
acatttatgaatagt

SEQ ID NO: 196042 - DNA, 15 bp, Homo sapiens
aacatttatgaatag

SEQ ID NO: 196043 - DNA, 15 bp, Homo sapiens
gaacatttatgaata

SEQ ID NO: 196044 - DNA, 15 bp, Homo sapiens
tgaacatttatgaat

SEQ ID NO: 196045 - DNA, 15 bp, Homo sapiens
atgaacatttatgaa

SEQ ID NO: 196046 - DNA, 15 bp, Homo sapiens
tatgaacatttatga

SEQ ID NO: 196047 - DNA, 15 bp, Homo sapiens
atatgaacatttatg

SEQ ID NO: 196048 - DNA, 15 bp, Homo sapiens
tatatgaacatttat

SEQ ID NO: 196049 - DNA, 15 bp, Homo sapiens
atatatgaacattta

SEQ ID NO: 196050 - DNA, 15 bp, Homo sapiens
aatatatgaacattt

SEQ ID NO: 196051 - DNA, 15 bp, Homo sapiens
aaatatatgaacatt

SEQ ID NO: 196052 - DNA, 15 bp, Homo sapiens
aaaatatatgaacat

SEQ ID NO: 196053 - DNA, 15 bp, Homo sapiens
taaaatatatgaaca

SEQ ID NO: 196054 - DNA, 15 bp, Homo sapiens
ttaaaatatatgaac

SEQ ID NO: 196055 - DNA, 15 bp, Homo sapiens
tttaaaatatatgaa

SEQ ID NO: 196056 - DNA, 15 bp, Homo sapiens
atttaaaatatatga

SEQ ID NO: 196057 - DNA, 15 bp, Homo sapiens
gatttaaaatatatg

SEQ ID NO: 196058 - DNA, 15 bp, Homo sapiens
agatttaaaatatat

SEQ ID NO: 196059 - DNA, 15 bp, Homo sapiens
tagatttaaaatata

SEQ ID NO: 196060 - DNA, 15 bp, Homo sapiens
ttagatttaaaatat

SEQ ID NO: 196061 - DNA, 15 bp, Homo sapiens
gttagatttaaaata

SEQ ID NO: 196062 - DNA, 15 bp, Homo sapiens
tgttagatttaaaat

SEQ ID NO: 196063 - DNA, 15 bp, Homo sapiens
ttgttagatttaaaa

SEQ ID NO: 196064 - DNA, 15 bp, Homo sapiens
attgttagatttaaa

SEQ ID NO: 196065 - DNA, 15 bp, Homo sapiens
tattgttagatttaa

SEQ ID NO: 196066 - DNA, 15 bp, Homo sapiens
gtattgttagattta

SEQ ID NO: 196067 - DNA, 15 bp, Homo sapiens
agtattgttagattt

SEQ ID NO: 196068 - DNA, 15 bp, Homo sapiens
tagtattgttagatt

SEQ ID NO: 196069 - DNA, 15 bp, Homo sapiens
ctagtattgttagat

SEQ ID NO: 196070 - DNA, 15 bp, Homo sapiens
actagtattgttaga

SEQ ID NO: 196071 - DNA, 15 bp, Homo sapiens
tactagtattgttag

SEQ ID NO: 196072 - DNA, 15 bp, Homo sapiens
ttactagtattgtta

SEQ ID NO: 196073 - DNA, 15 bp, Homo sapiens
gttactagtattgtt

SEQ ID NO: 196074 - DNA, 15 bp, Homo sapiens
tgttactagtattgt

SEQ ID NO: 196075 - DNA, 15 bp, Homo sapiens
ttgttactagtattg

SEQ ID NO: 196076 - DNA, 15 bp, Homo sapiens
attgttactagtatt

SEQ ID NO: 196077 - DNA, 15 bp, Homo sapiens
tattgttactagtat

SEQ ID NO: 196078 - DNA, 15 bp, Homo sapiens
gtattgttactagta

SEQ ID NO: 196079 - DNA, 15 bp, Homo sapiens
agtattgttactagt

SEQ ID NO: 196080 - DNA, 15 bp, Homo sapiens
cagtattgttactag

SEQ ID NO: 196081 - DNA, 15 bp, Homo sapiens
acagtattgttacta

SEQ ID NO: 196082 - DNA, 15 bp, Homo sapiens
aacagtattgttact

SEQ ID NO: 196083 - DNA, 15 bp, Homo sapiens
taacagtattgttac

SEQ ID NO: 196084 - DNA, 15 bp, Homo sapiens
ctaacagtattgtta

SEQ ID NO: 196085 - DNA, 15 bp, Homo sapiens
gctaacagtattgtt

SEQ ID NO: 196086 - DNA, 15 bp, Homo sapiens
tgctaacagtattgt

SEQ ID NO: 196087 - DNA, 15 bp, Homo sapiens
ttgctaacagtattg

SEQ ID NO: 196088 - DNA, 15 bp, Homo sapiens
gttgctaacagtatt

SEQ ID NO: 196089 - DNA, 15 bp, Homo sapiens
tgttgctaacagtat

SEQ ID NO: 196090 - DNA, 15 bp, Homo sapiens
atgttgctaacagta

SEQ ID NO: 196091 - DNA, 15 bp, Homo sapiens
gatgttgctaacagt

SEQ ID NO: 196092 - DNA, 15 bp, Homo sapiens
agatgttgctaacag

SEQ ID NO: 196093 - DNA, 15 bp, Homo sapiens
cagatgttgctaaca

SEQ ID NO: 196094 - DNA, 15 bp, Homo sapiens
gcagatgttgctaac

SEQ ID NO: 196095 - DNA, 15 bp, Homo sapiens
agcagatgttgctaa

SEQ ID NO: 196096 - DNA, 15 bp, Homo sapiens
tagcagatgttgcta

SEQ ID NO: 196097 - DNA, 15 bp, Homo sapiens
ttagcagatgttgct

SEQ ID NO: 196098 - DNA, 15 bp, Homo sapiens
attagcagatgttgc

SEQ ID NO: 196099 - DNA, 15 bp, Homo sapiens
aattagcagatgttg

SEQ ID NO: 196100 - DNA, 15 bp, Homo sapiens
taattagcagatgtt

SEQ ID NO: 196101 - DNA, 15 bp, Homo sapiens
gtaattagcagatgt

SEQ ID NO: 196102 - DNA, 15 bp, Homo sapiens
agtaattagcagatg

SEQ ID NO: 196103 - DNA, 15 bp, Homo sapiens
cagtaattagcagat

SEQ ID NO: 196104 - DNA, 15 bp, Homo sapiens
tcagtaattagcaga

SEQ ID NO: 196105 - DNA, 15 bp, Homo sapiens
ctcagtaattagcag

SEQ ID NO: 196106 - DNA, 15 bp, Homo sapiens
actcagtaattagca

SEQ ID NO: 196107 - DNA, 15 bp, Homo sapiens
cactcagtaattagc

SEQ ID NO: 196108 - DNA, 15 bp, Homo sapiens
acactcagtaattag

SEQ ID NO: 196109 - DNA, 15 bp, Homo sapiens
aacactcagtaatta

SEQ ID NO: 196110 - DNA, 15 bp, Homo sapiens
aaacactcagtaatt

SEQ ID NO: 196111 - DNA, 15 bp, Homo sapiens
taaacactcagtaat

SEQ ID NO: 196112 - DNA, 15 bp, Homo sapiens
gtaaacactcagtaa

SEQ ID NO: 196113 - DNA, 15 bp, Homo sapiens
ggtaaacactcagta

SEQ ID NO: 196114 - DNA, 15 bp, Homo sapiens
aggtaaacactcagt

SEQ ID NO: 196115 - DNA, 15 bp, Homo sapiens
aaggtaaacactcag

SEQ ID NO: 196116 - DNA, 15 bp, Homo sapiens
caaggtaaacactca

SEQ ID NO: 196117 - DNA, 15 bp, Homo sapiens
tcaaggtaaacactc

SEQ ID NO: 196118 - DNA, 15 bp, Homo sapiens
gtcaaggtaaacact

SEQ ID NO: 196119 - DNA, 15 bp, Homo sapiens
agtcaaggtaaacac

SEQ ID NO: 196120 - DNA, 15 bp, Homo sapiens
tagtcaaggtaaaca

SEQ ID NO: 196121 - DNA, 15 bp, Homo sapiens
ttagtcaaggtaaac

SEQ ID NO: 196122 - DNA, 15 bp, Homo sapiens
cttagtcaaggtaaa

SEQ ID NO: 196123 - DNA, 15 bp, Homo sapiens
acttagtcaaggtaa

SEQ ID NO: 196124 - DNA, 15 bp, Homo sapiens
tacttagtcaaggta

SEQ ID NO: 196125 - DNA, 15 bp, Homo sapiens
gtacttagtcaaggt

SEQ ID NO: 196126 - DNA, 15 bp, Homo sapiens
agtacttagtcaagg

SEQ ID NO: 196127 - DNA, 15 bp, Homo sapiens
aagtacttagtcaag

SEQ ID NO: 196128 - DNA, 15 bp, Homo sapiens
caagtacttagtcaa

SEQ ID NO: 196129 - DNA, 15 bp, Homo sapiens
acaagtacttagtca

SEQ ID NO: 196130 - DNA, 15 bp, Homo sapiens
aacaagtacttagtc

SEQ ID NO: 196131 - DNA, 15 bp, Homo sapiens
taacaagtacttagt

SEQ ID NO: 196132 - DNA, 15 bp, Homo sapiens
ctaacaagtacttag

SEQ ID NO: 196133 - DNA, 15 bp, Homo sapiens
cctaacaagtactta

SEQ ID NO: 196134 - DNA, 15 bp, Homo sapiens
tcctaacaagtactt

SEQ ID NO: 196135 - DNA, 15 bp, Homo sapiens
atcctaacaagtact

SEQ ID NO: 196136 - DNA, 15 bp, Homo sapiens
gatcctaacaagtac

SEQ ID NO: 196137 - DNA, 15 bp, Homo sapiens
agatcctaacaagta

SEQ ID NO: 196138 - DNA, 15 bp, Homo sapiens
aagatcctaacaagt

SEQ ID NO: 196139 - DNA, 15 bp, Homo sapiens
aaagatcctaacaag

SEQ ID NO: 196140 - DNA, 15 bp, Homo sapiens
taaagatcctaacaa

SEQ ID NO: 196141 - DNA, 15 bp, Homo sapiens
gtaaagatcctaaca

SEQ ID NO: 196142 - DNA, 15 bp, Homo sapiens
tgtaaagatcctaac

SEQ ID NO: 196143 - DNA, 15 bp, Homo sapiens
ttgtaaagatcctaa

SEQ ID NO: 196144 - DNA, 15 bp, Homo sapiens
tttgtaaagatccta

SEQ ID NO: 196145 - DNA, 15 bp, Homo sapiens
atttgtaaagatcct

SEQ ID NO: 196146 - DNA, 15 bp, Homo sapiens
catttgtaaagatcc

SEQ ID NO: 196147 - DNA, 15 bp, Homo sapiens
acatttgtaaagatc

SEQ ID NO: 196148 - DNA, 15 bp, Homo sapiens
aacatttgtaaagat

SEQ ID NO: 196149 - DNA, 15 bp, Homo sapiens
taacatttgtaaaga

SEQ ID NO: 196150 - DNA, 15 bp, Homo sapiens
gtaacatttgtaaag

SEQ ID NO: 196151 - DNA, 15 bp, Homo sapiens
agtaacatttgtaaa

SEQ ID NO: 196152 - DNA, 15 bp, Homo sapiens
aagtaacatttgtaa

SEQ ID NO: 196153 - DNA, 15 bp, Homo sapiens
aaagtaacatttgta

SEQ ID NO: 196154 - DNA, 15 bp, Homo sapiens
taaagtaacatttgt

SEQ ID NO: 196155 - DNA, 15 bp, Homo sapiens
ataaagtaacatttg

SEQ ID NO: 196156 - DNA, 15 bp, Homo sapiens
aataaagtaacattt

SEQ ID NO: 196157 - DNA, 15 bp, Homo sapiens
aaataaagtaacatt

SEQ ID NO: 196158 - DNA, 15 bp, Homo sapiens
gaaataaagtaacat

SEQ ID NO: 196159 - DNA, 15 bp, Homo sapiens
cgaaataaagtaaca

SEQ ID NO: 196160 - DNA, 15 bp, Homo sapiens
acgaaataaagtaac

SEQ ID NO: 196161 - DNA, 15 bp, Homo sapiens
tacgaaataaagtaa

SEQ ID NO: 196162 - DNA, 15 bp, Homo sapiens
ttacgaaataaagta

SEQ ID NO: 196163 - DNA, 15 bp, Homo sapiens
attacgaaataaagt

SEQ ID NO: 196164 - DNA, 15 bp, Homo sapiens
gattacgaaataaag

SEQ ID NO: 196165 - DNA, 15 bp, Homo sapiens
tgattacgaaataaa

SEQ ID NO: 196166 - DNA, 15 bp, Homo sapiens
ttgattacgaaataa

SEQ ID NO: 196167 - DNA, 15 bp, Homo sapiens
tttgattacgaaata

SEQ ID NO: 196168 - DNA, 15 bp, Homo sapiens
ttttgattacgaaat

SEQ ID NO: 196169 - DNA, 15 bp, Homo sapiens
tttttgattacgaaa

SEQ ID NO: 196170 - DNA, 15 bp, Homo sapiens
ttttttgattacgaa

SEQ ID NO: 196171 - DNA, 15 bp, Homo sapiens
attttttgattacga

SEQ ID NO: 196172 - DNA, 15 bp, Homo sapiens
gattttttgattacg

SEQ ID NO: 196173 - DNA, 15 bp, Homo sapiens
ggattttttgattac

SEQ ID NO: 196174 - DNA, 15 bp, Homo sapiens
aggattttttgatta

SEQ ID NO: 196175 - DNA, 15 bp, Homo sapiens
taggattttttgatt

SEQ ID NO: 196176 - DNA, 15 bp, Homo sapiens
ctaggattttttgat

SEQ ID NO: 196177 - DNA, 15 bp, Homo sapiens
actaggattttttga

SEQ ID NO: 196178 - DNA, 15 bp, Homo sapiens
tactaggattttttg

SEQ ID NO: 196179 - DNA, 15 bp, Homo sapiens
ttactaggatttttt

SEQ ID NO: 196180 - DNA, 15 bp, Homo sapiens
cttactaggattttt

SEQ ID NO: 196181 - DNA, 15 bp, Homo sapiens
ccttactaggatttt

SEQ ID NO: 196182 - DNA, 15 bp, Homo sapiens
accttactaggattt

SEQ ID NO: 196183 - DNA, 15 bp, Homo sapiens
caccttactaggatt

SEQ ID NO: 196184 - DNA, 15 bp, Homo sapiens
ccaccttactaggat

SEQ ID NO: 196185 - DNA, 15 bp, Homo sapiens
cccaccttactagga

SEQ ID NO: 196186 - DNA, 15 bp, Homo sapiens
acccaccttactagg

SEQ ID NO: 196187 - DNA, 15 bp, Homo sapiens
cacccaccttactag

SEQ ID NO: 196188 - DNA, 15 bp, Homo sapiens
ccacccaccttacta

SEQ ID NO: 196189 - DNA, 15 bp, Homo sapiens
accacccaccttact

SEQ ID NO: 196190 - DNA, 15 bp, Homo sapiens
taccacccaccttac

SEQ ID NO: 196191 - DNA, 15 bp, Homo sapiens
ttaccacccacctta

SEQ ID NO: 196192 - DNA, 15 bp, Homo sapiens
gttaccacccacctt

SEQ ID NO: 196193 - DNA, 15 bp, Homo sapiens
tgttaccacccacct

SEQ ID NO: 196194 - DNA, 15 bp, Homo sapiens
atgttaccacccacc

SEQ ID NO: 196195 - DNA, 15 bp, Homo sapiens
aatgttaccacccac

SEQ ID NO: 196196 - DNA, 15 bp, Homo sapiens
taatgttaccaccca

SEQ ID NO: 196197 - DNA, 15 bp, Homo sapiens
ataatgttaccaccc

SEQ ID NO: 196198 - DNA, 15 bp, Homo sapiens
aataatgttaccacc

SEQ ID NO: 196199 - DNA, 15 bp, Homo sapiens
aaataatgttaccac

SEQ ID NO: 196200 - DNA, 15 bp, Homo sapiens
gaaataatgttacca

SEQ ID NO: 196201 - DNA, 15 bp, Homo sapiens
agaaataatgttacc

SEQ ID NO: 196202 - DNA, 15 bp, Homo sapiens
aagaaataatgttac

SEQ ID NO: 196203 - DNA, 15 bp, Homo sapiens
gaagaaataatgtta

SEQ ID NO: 196204 - DNA, 15 bp, Homo sapiens
agaagaaataatgtt

SEQ ID NO: 196205 - DNA, 15 bp, Homo sapiens
tagaagaaataatgt

SEQ ID NO: 196206 - DNA, 15 bp, Homo sapiens
atagaagaaataatg

SEQ ID NO: 196207 - DNA, 15 bp, Homo sapiens
catagaagaaataat

SEQ ID NO: 196208 - DNA, 15 bp, Homo sapiens
tcatagaagaaataa

SEQ ID NO: 196209 - DNA, 15 bp, Homo sapiens
ctcatagaagaaata

SEQ ID NO: 196210 - DNA, 15 bp, Homo sapiens
cctcatagaagaaat

SEQ ID NO: 196211 - DNA, 15 bp, Homo sapiens
tcctcatagaagaaa

SEQ ID NO: 196212 - DNA, 15 bp, Homo sapiens
ttcctcatagaagaa

SEQ ID NO: 196213 - DNA, 15 bp, Homo sapiens
tttcctcatagaaga

SEQ ID NO: 196214 - DNA, 15 bp, Homo sapiens
gtttcctcatagaag

SEQ ID NO: 196215 - DNA, 15 bp, Homo sapiens
tgtttcctcatagaa

SEQ ID NO: 196216 - DNA, 15 bp, Homo sapiens
ctgtttcctcataga

SEQ ID NO: 196217 - DNA, 15 bp, Homo sapiens
tctgtttcctcatag

SEQ ID NO: 196218 - DNA, 15 bp, Homo sapiens
ctctgtttcctcata

SEQ ID NO: 196219 - DNA, 15 bp, Homo sapiens
cctctgtttcctcat

SEQ ID NO: 196220 - DNA, 15 bp, Homo sapiens
acctctgtttcctca

SEQ ID NO: 196221 - DNA, 15 bp, Homo sapiens
aacctctgtttcctc

SEQ ID NO: 196222 - DNA, 15 bp, Homo sapiens
aaacctctgtttcct

SEQ ID NO: 196223 - DNA, 15 bp, Homo sapiens
taaacctctgtttcc

SEQ ID NO: 196224 - DNA, 15 bp, Homo sapiens
ttaaacctctgtttc

SEQ ID NO: 196225 - DNA, 15 bp, Homo sapiens
attaaacctctgttt

SEQ ID NO: 196226 - DNA, 15 bp, Homo sapiens
cattaaacctctgtt

SEQ ID NO: 196227 - DNA, 15 bp, Homo sapiens
tcattaaacctctgt

SEQ ID NO: 196228 - DNA, 15 bp, Homo sapiens
ttcattaaacctctg

SEQ ID NO: 196229 - DNA, 15 bp, Homo sapiens
attcattaaacctct

SEQ ID NO: 196230 - DNA, 15 bp, Homo sapiens
tattcattaaacctc

SEQ ID NO: 196231 - DNA, 15 bp, Homo sapiens
atattcattaaacct

SEQ ID NO: 196232 - DNA, 15 bp, Homo sapiens
tatattcattaaacc

SEQ ID NO: 196233 - DNA, 15 bp, Homo sapiens
ttatattcattaaac

SEQ ID NO: 196234 - DNA, 15 bp, Homo sapiens
cttatattcattaaa

SEQ ID NO: 196235 - DNA, 15 bp, Homo sapiens
ccttatattcattaa

SEQ ID NO: 196236 - DNA, 15 bp, Homo sapiens
tccttatattcatta

SEQ ID NO: 196237 - DNA, 15 bp, Homo sapiens
ttccttatattcatt

SEQ ID NO: 196238 - DNA, 15 bp, Homo sapiens
gttccttatattcat

SEQ ID NO: 196239 - DNA, 15 bp, Homo sapiens
agttccttatattca

SEQ ID NO: 196240 - DNA, 15 bp, Homo sapiens
aagttccttatattc

SEQ ID NO: 196241 - DNA, 15 bp, Homo sapiens
caagttccttatatt

SEQ ID NO: 196242 - DNA, 15 bp, Homo sapiens
gcaagttccttatat

SEQ ID NO: 196243 - DNA, 15 bp, Homo sapiens
ggcaagttccttata

SEQ ID NO: 196244 - DNA, 15 bp, Homo sapiens
tggcaagttccttat

SEQ ID NO: 196245 - DNA, 15 bp, Homo sapiens
ttggcaagttcctta

SEQ ID NO: 196246 - DNA, 15 bp, Homo sapiens
cttggcaagttcctt

SEQ ID NO: 196247 - DNA, 15 bp, Homo sapiens
acttggcaagttcct

SEQ ID NO: 196248 - DNA, 15 bp, Homo sapiens
aacttggcaagttcc

SEQ ID NO: 196249 - DNA, 15 bp, Homo sapiens
aaacttggcaagttc

SEQ ID NO: 196250 - DNA, 15 bp, Homo sapiens
aaaacttggcaagtt

SEQ ID NO: 196251 - DNA, 15 bp, Homo sapiens
caaaacttggcaagt

SEQ ID NO: 196252 - DNA, 15 bp, Homo sapiens
ccaaaacttggcaag

SEQ ID NO: 196253 - DNA, 15 bp, Homo sapiens
cccaaaacttggcaa

SEQ ID NO: 196254 - DNA, 15 bp, Homo sapiens
ccccaaaacttggca

SEQ ID NO: 196255 - DNA, 15 bp, Homo sapiens
gccccaaaacttggc

SEQ ID NO: 196256 - DNA, 15 bp, Homo sapiens
agccccaaaacttgg

SEQ ID NO: 196257 - DNA, 15 bp, Homo sapiens
tagccccaaaacttg

SEQ ID NO: 196258 - DNA, 15 bp, Homo sapiens
ttagccccaaaactt

SEQ ID NO: 196259 - DNA, 15 bp, Homo sapiens
cttagccccaaaact

SEQ ID NO: 196260 - DNA, 15 bp, Homo sapiens
tcttagccccaaaac

SEQ ID NO: 196261 - DNA, 15 bp, Homo sapiens
ttcttagccccaaaa

SEQ ID NO: 196262 - DNA, 15 bp, Homo sapiens
cttcttagccccaaa

SEQ ID NO: 196263 - DNA, 15 bp, Homo sapiens
acttcttagccccaa

SEQ ID NO: 196264 - DNA, 15 bp, Homo sapiens
cacttcttagcccca

SEQ ID NO: 196265 - DNA, 15 bp, Homo sapiens
gcacttcttagcccc

SEQ ID NO: 196266 - DNA, 15 bp, Homo sapiens
ggcacttcttagccc

SEQ ID NO: 196267 - DNA, 15 bp, Homo sapiens
tggcacttcttagcc

SEQ ID NO: 196268 - DNA, 15 bp, Homo sapiens
ttggcacttcttagc

SEQ ID NO: 196269 - DNA, 15 bp, Homo sapiens
cttggcacttcttag

SEQ ID NO: 196270 - DNA, 15 bp, Homo sapiens
acttggcacttctta

SEQ ID NO: 196271 - DNA, 15 bp, Homo sapiens
gacttggcacttctt

SEQ ID NO: 196272 - DNA, 15 bp, Homo sapiens
tgacttggcacttct

SEQ ID NO: 196273 - DNA, 15 bp, Homo sapiens
ctgacttggcacttc

SEQ ID NO: 196274 - DNA, 15 bp, Homo sapiens
tctgacttggcactt

SEQ ID NO: 196275 - DNA, 15 bp, Homo sapiens
ctctgacttggcact

SEQ ID NO: 196276 - DNA, 15 bp, Homo sapiens
actctgacttggcac

SEQ ID NO: 196277 - DNA, 15 bp, Homo sapiens
aactctgacttggca

SEQ ID NO: 196278 - DNA, 15 bp, Homo sapiens
aaactctgacttggc

SEQ ID NO: 196279 - DNA, 15 bp, Homo sapiens
caaactctgacttgg

SEQ ID NO: 196280 - DNA, 15 bp, Homo sapiens
tcaaactctgacttg

SEQ ID NO: 196281 - DNA, 15 bp, Homo sapiens
ttcaaactctgactt

SEQ ID NO: 196282 - DNA, 15 bp, Homo sapiens
attcaaactctgact

SEQ ID NO: 196283 - DNA, 15 bp, Homo sapiens
gattcaaactctgac

SEQ ID NO: 196284 - DNA, 15 bp, Homo sapiens
agattcaaactctga

SEQ ID NO: 196285 - DNA, 15 bp, Homo sapiens
tagattcaaactctg

SEQ ID NO: 196286 - DNA, 15 bp, Homo sapiens
ctagattcaaactct

SEQ ID NO: 196287 - DNA, 15 bp, Homo sapiens
tctagattcaaactc

SEQ ID NO: 196288 - DNA, 15 bp, Homo sapiens
atctagattcaaact

SEQ ID NO: 196289 - DNA, 15 bp, Homo sapiens
gatctagattcaaac

SEQ ID NO: 196290 - DNA, 15 bp, Homo sapiens
agatctagattcaaa

SEQ ID NO: 196291 - DNA, 15 bp, Homo sapiens
aagatctagattcaa

SEQ ID NO: 196292 - DNA, 15 bp, Homo sapiens
aaagatctagattca

SEQ ID NO: 196293 - DNA, 15 bp, Homo sapiens
aaaagatctagattc

SEQ ID NO: 196294 - DNA, 15 bp, Homo sapiens
aaaaagatctagatt

SEQ ID NO: 196295 - DNA, 15 bp, Homo sapiens
aaaaaagatctagat

SEQ ID NO: 196296 - DNA, 15 bp, Homo sapiens
taaaaaagatctaga

SEQ ID NO: 196297 - DNA, 15 bp, Homo sapiens
gtaaaaaagatctag

SEQ ID NO: 196298 - DNA, 15 bp, Homo sapiens
agtaaaaaagatcta

SEQ ID NO: 196299 - DNA, 15 bp, Homo sapiens
gagtaaaaaagatct

SEQ ID NO: 196300 - DNA, 15 bp, Homo sapiens
agagtaaaaaagatc

SEQ ID NO: 196301 - DNA, 15 bp, Homo sapiens
aagagtaaaaaagat

SEQ ID NO: 196302 - DNA, 15 bp, Homo sapiens
caagagtaaaaaaga

SEQ ID NO: 196303 - DNA, 15 bp, Homo sapiens
ccaagagtaaaaaag

SEQ ID NO: 196304 - DNA, 15 bp, Homo sapiens
gccaagagtaaaaaa

SEQ ID NO: 196305 - DNA, 15 bp, Homo sapiens
tgccaagagtaaaaa

SEQ ID NO: 196306 - DNA, 15 bp, Homo sapiens
ctgccaagagtaaaa

SEQ ID NO: 196307 - DNA, 15 bp, Homo sapiens
actgccaagagtaaa

SEQ ID NO: 196308 - DNA, 15 bp, Homo sapiens
cactgccaagagtaa

SEQ ID NO: 196309 - DNA, 15 bp, Homo sapiens
tcactgccaagagta

SEQ ID NO: 196310 - DNA, 15 bp, Homo sapiens
ttcactgccaagagt

SEQ ID NO: 196311 - DNA, 15 bp, Homo sapiens
gttcactgccaagag

SEQ ID NO: 196312 - DNA, 15 bp, Homo sapiens
tgttcactgccaaga

SEQ ID NO: 196313 - DNA, 15 bp, Homo sapiens
atgttcactgccaag

SEQ ID NO: 196314 - DNA, 15 bp, Homo sapiens
catgttcactgccaa

SEQ ID NO: 196315 - DNA, 15 bp, Homo sapiens
acatgttcactgcca

SEQ ID NO: 196316 - DNA, 15 bp, Homo sapiens
aacatgttcactgcc

SEQ ID NO: 196317 - DNA, 15 bp, Homo sapiens
aaacatgttcactgc

SEQ ID NO: 196318 - DNA, 15 bp, Homo sapiens
aaaacatgttcactg

SEQ ID NO: 196319 - DNA, 15 bp, Homo sapiens
caaaacatgttcact

SEQ ID NO: 196320 - DNA, 15 bp, Homo sapiens
gcaaaacatgttcac

SEQ ID NO: 196321 - DNA, 15 bp, Homo sapiens
agcaaaacatgttca

SEQ ID NO: 196322 - DNA, 15 bp, Homo sapiens
aagcaaaacatgttc

SEQ ID NO: 196323 - DNA, 15 bp, Homo sapiens
taagcaaaacatgtt

SEQ ID NO: 196324 - DNA, 15 bp, Homo sapiens
ttaagcaaaacatgt

SEQ ID NO: 196325 - DNA, 15 bp, Homo sapiens
attaagcaaaacatg

SEQ ID NO: 196326 - DNA, 15 bp, Homo sapiens
gattaagcaaaacat

SEQ ID NO: 196327 - DNA, 15 bp, Homo sapiens
tgattaagcaaaaca

SEQ ID NO: 196328 - DNA, 15 bp, Homo sapiens
atgattaagcaaaac

SEQ ID NO: 196329 - DNA, 15 bp, Homo sapiens
catgattaagcaaaa

SEQ ID NO: 196330 - DNA, 15 bp, Homo sapiens
acatgattaagcaaa

SEQ ID NO: 196331 - DNA, 15 bp, Homo sapiens
aacatgattaagcaa

SEQ ID NO: 196332 - DNA, 15 bp, Homo sapiens
caacatgattaagca

SEQ ID NO: 196333 - DNA, 15 bp, Homo sapiens
acaacatgattaagc

SEQ ID NO: 196334 - DNA, 15 bp, Homo sapiens
aacaacatgattaag

SEQ ID NO: 196335 - DNA, 15 bp, Homo sapiens
aaacaacatgattaa

SEQ ID NO: 196336 - DNA, 15 bp, Homo sapiens
aaaacaacatgatta

SEQ ID NO: 196337 - DNA, 15 bp, Homo sapiens
aaaaacaacatgatt

SEQ ID NO: 196338 - DNA, 15 bp, Homo sapiens
aaaaaacaacatgat

SEQ ID NO: 196339 - DNA, 15 bp, Homo sapiens
taaaaaacaacatga

SEQ ID NO: 196340 - DNA, 15 bp, Homo sapiens
ataaaaaacaacatg

SEQ ID NO: 196341 - DNA, 15 bp, Homo sapiens
cataaaaaacaacat

SEQ ID NO: 196342 - DNA, 15 bp, Homo sapiens
gcataaaaaacaaca

SEQ ID NO: 196343 - DNA, 15 bp, Homo sapiens
ggcataaaaaacaac

SEQ ID NO: 196344 - DNA, 15 bp, Homo sapiens
aggcataaaaaacaa

SEQ ID NO: 196345 - DNA, 15 bp, Homo sapiens
gaggcataaaaaaca

SEQ ID NO: 196346 - DNA, 15 bp, Homo sapiens
tgaggcataaaaaac

SEQ ID NO: 196347 - DNA, 15 bp, Homo sapiens
atgaggcataaaaaa

SEQ ID NO: 196348 - DNA, 15 bp, Homo sapiens
aatgaggcataaaaa

SEQ ID NO: 196349 - DNA, 15 bp, Homo sapiens
gaatgaggcataaaa

SEQ ID NO: 196350 - DNA, 15 bp, Homo sapiens
tgaatgaggcataaa

SEQ ID NO: 196351 - DNA, 15 bp, Homo sapiens
ttgaatgaggcataa

SEQ ID NO: 196352 - DNA, 15 bp, Homo sapiens
cttgaatgaggcata

SEQ ID NO: 196353 - DNA, 15 bp, Homo sapiens
tcttgaatgaggcat

SEQ ID NO: 196354 - DNA, 15 bp, Homo sapiens
atcttgaatgaggca

SEQ ID NO: 196355 - DNA, 15 bp, Homo sapiens
catcttgaatgaggc

SEQ ID NO: 196356 - DNA, 15 bp, Homo sapiens
acatcttgaatgagg

SEQ ID NO: 196357 - DNA, 15 bp, Homo sapiens
tacatcttgaatgag

SEQ ID NO: 196358 - DNA, 15 bp, Homo sapiens
atacatcttgaatga

SEQ ID NO: 196359 - DNA, 15 bp, Homo sapiens
aatacatcttgaatg

SEQ ID NO: 196360 - DNA, 15 bp, Homo sapiens
aaatacatcttgaat

SEQ ID NO: 196361 - DNA, 15 bp, Homo sapiens
taaatacatcttgaa

SEQ ID NO: 196362 - DNA, 15 bp, Homo sapiens
ataaatacatcttga

SEQ ID NO: 196363 - DNA, 15 bp, Homo sapiens
tataaatacatcttg

SEQ ID NO: 196364 - DNA, 15 bp, Homo sapiens
ctataaatacatctt

SEQ ID NO: 196365 - DNA, 15 bp, Homo sapiens
tctataaatacatct

SEQ ID NO: 196366 - DNA, 15 bp, Homo sapiens
ttctataaatacatc

SEQ ID NO: 196367 - DNA, 15 bp, Homo sapiens
tttctataaatacat

SEQ ID NO: 196368 - DNA, 15 bp, Homo sapiens
atttctataaataca

SEQ ID NO: 196369 - DNA, 15 bp, Homo sapiens
aatttctataaatac

SEQ ID NO: 196370 - DNA, 15 bp, Homo sapiens
taatttctataaata

SEQ ID NO: 196371 - DNA, 15 bp, Homo sapiens
ttaatttctataaat

SEQ ID NO: 196372 - DNA, 15 bp, Homo sapiens
tttaatttctataaa

SEQ ID NO: 196373 - DNA, 15 bp, Homo sapiens
atttaatttctataa

SEQ ID NO: 196374 - DNA, 15 bp, Homo sapiens
tatttaatttctata

SEQ ID NO: 196375 - DNA, 15 bp, Homo sapiens
atatttaatttctat

SEQ ID NO: 196376 - DNA, 15 bp, Homo sapiens
gatatttaatttcta

SEQ ID NO: 196377 - DNA, 15 bp, Homo sapiens
agatatttaatttct

SEQ ID NO: 196378 - DNA, 15 bp, Homo sapiens
gagatatttaatttc

SEQ ID NO: 196379 - DNA, 15 bp, Homo sapiens
agagatatttaattt

SEQ ID NO: 196380 - DNA, 15 bp, Homo sapiens
aagagatatttaatt

SEQ ID NO: 196381 - DNA, 15 bp, Homo sapiens
taagagatatttaat

SEQ ID NO: 196382 - DNA, 15 bp, Homo sapiens
ataagagatatttaa

SEQ ID NO: 196383 - DNA, 15 bp, Homo sapiens
cataagagatattta

SEQ ID NO: 196384 - DNA, 15 bp, Homo sapiens
ccataagagatattt

SEQ ID NO: 196385 - DNA, 15 bp, Homo sapiens
tccataagagatatt

SEQ ID NO: 196386 - DNA, 15 bp, Homo sapiens
gtccataagagatat

SEQ ID NO: 196387 - DNA, 15 bp, Homo sapiens
tgtccataagagata

SEQ ID NO: 196388 - DNA, 15 bp, Homo sapiens
gtgtccataagagat

SEQ ID NO: 196389 - DNA, 15 bp, Homo sapiens
agtgtccataagaga

SEQ ID NO: 196390 - DNA, 15 bp, Homo sapiens
tagtgtccataagag

SEQ ID NO: 196391 - DNA, 15 bp, Homo sapiens
ttagtgtccataaga

SEQ ID NO: 196392 - DNA, 15 bp, Homo sapiens
tttagtgtccataag

SEQ ID NO: 196393 - DNA, 15 bp, Homo sapiens
ttttagtgtccataa

SEQ ID NO: 196394 - DNA, 15 bp, Homo sapiens
attttagtgtccata

SEQ ID NO: 196395 - DNA, 15 bp, Homo sapiens
cattttagtgtccat

SEQ ID NO: 196396 - DNA, 15 bp, Homo sapiens
ccattttagtgtcca

SEQ ID NO: 196397 - DNA, 15 bp, Homo sapiens
tccattttagtgtcc

SEQ ID NO: 196398 - DNA, 15 bp, Homo sapiens
ttccattttagtgtc

SEQ ID NO: 196399 - DNA, 15 bp, Homo sapiens
tttccattttagtgt

SEQ ID NO: 196400 - DNA, 15 bp, Homo sapiens
ttttccattttagtg

SEQ ID NO: 196401 - DNA, 15 bp, Homo sapiens
attttccattttagt

SEQ ID NO: 196402 - DNA, 15 bp, Homo sapiens
aattttccattttag

SEQ ID NO: 196403 - DNA, 15 bp, Homo sapiens
caattttccatttta

SEQ ID NO: 196404 - DNA, 15 bp, Homo sapiens
tcaattttccatttt

SEQ ID NO: 196405 - DNA, 15 bp, Homo sapiens
atcaattttccattt

SEQ ID NO: 196406 - DNA, 15 bp, Homo sapiens
catcaattttccatt

SEQ ID NO: 196407 - DNA, 15 bp, Homo sapiens
tcatcaattttccat

SEQ ID NO: 196408 - DNA, 15 bp, Homo sapiens
atcatcaattttcca

SEQ ID NO: 196409 - DNA, 15 bp, Homo sapiens
aatcatcaattttcc

SEQ ID NO: 196410 - DNA, 15 bp, Homo sapiens
gaatcatcaattttc

SEQ ID NO: 196411 - DNA, 15 bp, Homo sapiens
tgaatcatcaatttt

SEQ ID NO: 196412 - DNA, 15 bp, Homo sapiens
atgaatcatcaattt

SEQ ID NO: 196413 - DNA, 15 bp, Homo sapiens
catgaatcatcaatt

SEQ ID NO: 196414 - DNA, 15 bp, Homo sapiens
acatgaatcatcaat

SEQ ID NO: 196415 - DNA, 15 bp, Homo sapiens
gacatgaatcatcaa

SEQ ID NO: 196416 - DNA, 15 bp, Homo sapiens
agacatgaatcatca

SEQ ID NO: 196417 - DNA, 15 bp, Homo sapiens
cagacatgaatcatc

SEQ ID NO: 196418 - DNA, 15 bp, Homo sapiens
gcagacatgaatcat

SEQ ID NO: 196419 - DNA, 15 bp, Homo sapiens
tgcagacatgaatca

SEQ ID NO: 196420 - DNA, 15 bp, Homo sapiens
atgcagacatgaatc

SEQ ID NO: 196421 - DNA, 15 bp, Homo sapiens
aatgcagacatgaat

SEQ ID NO: 196422 - DNA, 15 bp, Homo sapiens
aaatgcagacatgaa

SEQ ID NO: 196423 - DNA, 15 bp, Homo sapiens
caaatgcagacatga

SEQ ID NO: 196424 - DNA, 15 bp, Homo sapiens
ccaaatgcagacatg

SEQ ID NO: 196425 - DNA, 15 bp, Homo sapiens
tccaaatgcagacat

SEQ ID NO: 196426 - DNA, 15 bp, Homo sapiens
ctccaaatgcagaca

SEQ ID NO: 196427 - DNA, 15 bp, Homo sapiens
tctccaaatgcagac

SEQ ID NO: 196428 - DNA, 15 bp, Homo sapiens
ctctccaaatgcaga

SEQ ID NO: 196429 - DNA, 15 bp, Homo sapiens
tctctccaaatgcag

SEQ ID NO: 196430 - DNA, 15 bp, Homo sapiens
ctctctccaaatgca

SEQ ID NO: 196431 - DNA, 15 bp, Homo sapiens
actctctccaaatgc

SEQ ID NO: 196432 - DNA, 15 bp, Homo sapiens
tactctctccaaatg

SEQ ID NO: 196433 - DNA, 15 bp, Homo sapiens
ttactctctccaaat

SEQ ID NO: 196434 - DNA, 15 bp, Homo sapiens
tttactctctccaaa

SEQ ID NO: 196435 - DNA, 15 bp, Homo sapiens
ttttactctctccaa

SEQ ID NO: 196436 - DNA, 15 bp, Homo sapiens
attttactctctcca

SEQ ID NO: 196437 - DNA, 15 bp, Homo sapiens
aattttactctctcc

SEQ ID NO: 196438 - DNA, 15 bp, Homo sapiens
taattttactctctc

SEQ ID NO: 196439 - DNA, 15 bp, Homo sapiens
ttaattttactctct

SEQ ID NO: 196440 - DNA, 15 bp, Homo sapiens
tttaattttactctc

SEQ ID NO: 196441 - DNA, 15 bp, Homo sapiens
atttaattttactct

SEQ ID NO: 196442 - DNA, 15 bp, Homo sapiens
tatttaattttactc

SEQ ID NO: 196443 - DNA, 15 bp, Homo sapiens
ttatttaattttact

SEQ ID NO: 196444 - DNA, 15 bp, Homo sapiens
cttatttaattttac

SEQ ID NO: 196445 - DNA, 15 bp, Homo sapiens
ccttatttaatttta

SEQ ID NO: 196446 - DNA, 15 bp, Homo sapiens
tccttatttaatttt

SEQ ID NO: 196447 - DNA, 15 bp, Homo sapiens
atccttatttaattt

SEQ ID NO: 196448 - DNA, 15 bp, Homo sapiens
catccttatttaatt

SEQ ID NO: 196449 - DNA, 15 bp, Homo sapiens
tcatccttatttaat

SEQ ID NO: 196450 - DNA, 15 bp, Homo sapiens
ttcatccttatttaa

SEQ ID NO: 196451 - DNA, 15 bp, Homo sapiens
gttcatccttattta

SEQ ID NO: 196452 - DNA, 15 bp, Homo sapiens
ggttcatccttattt

SEQ ID NO: 196453 - DNA, 15 bp, Homo sapiens
aggttcatccttatt

SEQ ID NO: 196454 - DNA, 15 bp, Homo sapiens
aaggttcatccttat

SEQ ID NO: 196455 - DNA, 15 bp, Homo sapiens
taaggttcatcctta

SEQ ID NO: 196456 - DNA, 15 bp, Homo sapiens
ctaaggttcatcctt

SEQ ID NO: 196457 - DNA, 15 bp, Homo sapiens
cctaaggttcatcct

SEQ ID NO: 196458 - DNA, 15 bp, Homo sapiens
tcctaaggttcatcc

SEQ ID NO: 196459 - DNA, 15 bp, Homo sapiens
gtcctaaggttcatc

SEQ ID NO: 196460 - DNA, 15 bp, Homo sapiens
ggtcctaaggttcat

SEQ ID NO: 196461 - DNA, 15 bp, Homo sapiens
tggtcctaaggttca

SEQ ID NO: 196462 - DNA, 15 bp, Homo sapiens
ctggtcctaaggttc

SEQ ID NO: 196463 - DNA, 15 bp, Homo sapiens
tctggtcctaaggtt

SEQ ID NO: 196464 - DNA, 15 bp, Homo sapiens
ttctggtcctaaggt

SEQ ID NO: 196465 - DNA, 15 bp, Homo sapiens
attctggtcctaagg

SEQ ID NO: 196466 - DNA, 15 bp, Homo sapiens
aattctggtcctaag

SEQ ID NO: 196467 - DNA, 15 bp, Homo sapiens
gaattctggtcctaa

SEQ ID NO: 196468 - DNA, 15 bp, Homo sapiens
agaattctggtccta

SEQ ID NO: 196469 - DNA, 15 bp, Homo sapiens
cagaattctggtcct

SEQ ID NO: 196470 - DNA, 15 bp, Homo sapiens
tcagaattctggtcc

SEQ ID NO: 196471 - DNA, 15 bp, Homo sapiens
gtcagaattctggtc

SEQ ID NO: 196472 - DNA, 15 bp, Homo sapiens
agtcagaattctggt

SEQ ID NO: 196473 - DNA, 15 bp, Homo sapiens
tagtcagaattctgg

SEQ ID NO: 196474 - DNA, 15 bp, Homo sapiens
ctagtcagaattctg

SEQ ID NO: 196475 - DNA, 15 bp, Homo sapiens
cctagtcagaattct

SEQ ID NO: 196476 - DNA, 15 bp, Homo sapiens
tcctagtcagaattc

SEQ ID NO: 196477 - DNA, 15 bp, Homo sapiens
ttcctagtcagaatt

SEQ ID NO: 196478 - DNA, 15 bp, Homo sapiens
tttcctagtcagaat

SEQ ID NO: 196479 - DNA, 15 bp, Homo sapiens
ttttcctagtcagaa

SEQ ID NO: 196480 - DNA, 15 bp, Homo sapiens
cttttcctagtcaga

SEQ ID NO: 196481 - DNA, 15 bp, Homo sapiens
tcttttcctagtcag

SEQ ID NO: 196482 - DNA, 15 bp, Homo sapiens
gtcttttcctagtca

SEQ ID NO: 196483 - DNA, 15 bp, Homo sapiens
ggtcttttcctagtc

SEQ ID NO: 196484 - DNA, 15 bp, Homo sapiens
aggtcttttcctagt

SEQ ID NO: 196485 - DNA, 15 bp, Homo sapiens
aaggtcttttcctag

SEQ ID NO: 196486 - DNA, 15 bp, Homo sapiens
caaggtcttttccta

SEQ ID NO: 196487 - DNA, 15 bp, Homo sapiens
tcaaggtcttttcct

SEQ ID NO: 196488 - DNA, 15 bp, Homo sapiens
ttcaaggtcttttcc

SEQ ID NO: 196489 - DNA, 15 bp, Homo sapiens
tttcaaggtcttttc

SEQ ID NO: 196490 - DNA, 15 bp, Homo sapiens
ttttcaaggtctttt

SEQ ID NO: 196491 - DNA, 15 bp, Homo sapiens
attttcaaggtcttt

SEQ ID NO: 196492 - DNA, 15 bp, Homo sapiens
aattttcaaggtctt

SEQ ID NO: 196493 - DNA, 15 bp, Homo sapiens
taattttcaaggtct

SEQ ID NO: 196494 - DNA, 15 bp, Homo sapiens
gtaattttcaaggtc

SEQ ID NO: 196495 - DNA, 15 bp, Homo sapiens
ggtaattttcaaggt

SEQ ID NO: 196496 - DNA, 15 bp, Homo sapiens
gggtaattttcaagg

SEQ ID NO: 196497 - DNA, 15 bp, Homo sapiens
tgggtaattttcaag

SEQ ID NO: 196498 - DNA, 15 bp, Homo sapiens
ctgggtaattttcaa

SEQ ID NO: 196499 - DNA, 15 bp, Homo sapiens
tctgggtaattttca

SEQ ID NO: 196500 - DNA, 15 bp, Homo sapiens
ctctgggtaattttc

SEQ ID NO: 196501 - DNA, 15 bp, Homo sapiens
tctctgggtaatttt

SEQ ID NO: 196502 - DNA, 15 bp, Homo sapiens
ctctctgggtaattt

SEQ ID NO: 196503 - DNA, 15 bp, Homo sapiens
tctctctgggtaatt

SEQ ID NO: 196504 - DNA, 15 bp, Homo sapiens
gtctctctgggtaat

SEQ ID NO: 196505 - DNA, 15 bp, Homo sapiens
tgtctctctgggtaa

SEQ ID NO: 196506 - DNA, 15 bp, Homo sapiens
ctgtctctctgggta

SEQ ID NO: 196507 - DNA, 15 bp, Homo sapiens
actgtctctctgggt

SEQ ID NO: 196508 - DNA, 15 bp, Homo sapiens
tactgtctctctggg

SEQ ID NO: 196509 - DNA, 15 bp, Homo sapiens
atactgtctctctgg

SEQ ID NO: 196510 - DNA, 15 bp, Homo sapiens
catactgtctctctg

SEQ ID NO: 196511 - DNA, 15 bp, Homo sapiens
tcatactgtctctct

SEQ ID NO: 196512 - DNA, 15 bp, Homo sapiens
atcatactgtctctc

SEQ ID NO: 196513 - DNA, 15 bp, Homo sapiens
aatcatactgtctct

SEQ ID NO: 196514 - DNA, 15 bp, Homo sapiens
taatcatactgtctc

SEQ ID NO: 196515 - DNA, 15 bp, Homo sapiens
ctaatcatactgtct

SEQ ID NO: 196516 - DNA, 15 bp, Homo sapiens
actaatcatactgtc

SEQ ID NO: 196517 - DNA, 15 bp, Homo sapiens
cactaatcatactgt

SEQ ID NO: 196518 - DNA, 15 bp, Homo sapiens
acactaatcatactg

SEQ ID NO: 196519 - DNA, 15 bp, Homo sapiens
aacactaatcatact

SEQ ID NO: 196520 - DNA, 15 bp, Homo sapiens
taacactaatcatac

SEQ ID NO: 196521 - DNA, 15 bp, Homo sapiens
ataacactaatcata

SEQ ID NO: 196522 - DNA, 15 bp, Homo sapiens
aataacactaatcat

SEQ ID NO: 196523 - DNA, 15 bp, Homo sapiens
caataacactaatca

SEQ ID NO: 196524 - DNA, 15 bp, Homo sapiens
ccaataacactaatc

SEQ ID NO: 196525 - DNA, 15 bp, Homo sapiens
cccaataacactaat

SEQ ID NO: 196526 - DNA, 15 bp, Homo sapiens
tcccaataacactaa

SEQ ID NO: 196527 - DNA, 15 bp, Homo sapiens
atcccaataacacta

SEQ ID NO: 196528 - DNA, 15 bp, Homo sapiens
gatcccaataacact

SEQ ID NO: 196529 - DNA, 15 bp, Homo sapiens
tgatcccaataacac

SEQ ID NO: 196530 - DNA, 15 bp, Homo sapiens
ttgatcccaataaca

SEQ ID NO: 196531 - DNA, 15 bp, Homo sapiens
cttgatcccaataac

SEQ ID NO: 196532 - DNA, 15 bp, Homo sapiens
tcttgatcccaataa

SEQ ID NO: 196533 - DNA, 15 bp, Homo sapiens
ttcttgatcccaata

SEQ ID NO: 196534 - DNA, 15 bp, Homo sapiens
attcttgatcccaat

SEQ ID NO: 196535 - DNA, 15 bp, Homo sapiens
tattcttgatcccaa

SEQ ID NO: 196536 - DNA, 15 bp, Homo sapiens
atattcttgatccca

SEQ ID NO: 196537 - DNA, 15 bp, Homo sapiens
aatattcttgatccc

SEQ ID NO: 196538 - DNA, 15 bp, Homo sapiens
aaatattcttgatcc

SEQ ID NO: 196539 - DNA, 15 bp, Homo sapiens
aaaatattcttgatc

SEQ ID NO: 196540 - DNA, 15 bp, Homo sapiens
taaaatattcttgat

SEQ ID NO: 196541 - DNA, 15 bp, Homo sapiens
ttaaaatattcttga

SEQ ID NO: 196542 - DNA, 15 bp, Homo sapiens
cttaaaatattcttg

SEQ ID NO: 196543 - DNA, 15 bp, Homo sapiens
tcttaaaatattctt

SEQ ID NO: 196544 - DNA, 15 bp, Homo sapiens
atcttaaaatattct

SEQ ID NO: 196545 - DNA, 15 bp, Homo sapiens
gatcttaaaatattc

SEQ ID NO: 196546 - DNA, 15 bp, Homo sapiens
tgatcttaaaatatt

SEQ ID NO: 196547 - DNA, 15 bp, Homo sapiens
atgatcttaaaatat

SEQ ID NO: 196548 - DNA, 15 bp, Homo sapiens
tatgatcttaaaata

SEQ ID NO: 196549 - DNA, 15 bp, Homo sapiens
atatgatcttaaaat

SEQ ID NO: 196550 - DNA, 15 bp, Homo sapiens
aatatgatcttaaaa

SEQ ID NO: 196551 - DNA, 15 bp, Homo sapiens
aaatatgatcttaaa

SEQ ID NO: 196552 - DNA, 15 bp, Homo sapiens
taaatatgatcttaa

SEQ ID NO: 196553 - DNA, 15 bp, Homo sapiens
ttaaatatgatctta

SEQ ID NO: 196554 - DNA, 15 bp, Homo sapiens
attaaatatgatctt

SEQ ID NO: 196555 - DNA, 15 bp, Homo sapiens
tattaaatatgatct

SEQ ID NO: 196556 - DNA, 15 bp, Homo sapiens
ctattaaatatgatc

SEQ ID NO: 196557 - DNA, 15 bp, Homo sapiens
tctattaaatatgat

SEQ ID NO: 196558 - DNA, 15 bp, Homo sapiens
ctctattaaatatga

SEQ ID NO: 196559 - DNA, 15 bp, Homo sapiens
tctctattaaatatg

SEQ ID NO: 196560 - DNA, 15 bp, Homo sapiens
ctctctattaaatat

SEQ ID NO: 196561 - DNA, 15 bp, Homo sapiens
actctctattaaata

SEQ ID NO: 196562 - DNA, 15 bp, Homo sapiens
cactctctattaaat

SEQ ID NO: 196563 - DNA, 15 bp, Homo sapiens
ccactctctattaaa

SEQ ID NO: 196564 - DNA, 15 bp, Homo sapiens
tccactctctattaa

SEQ ID NO: 196565 - DNA, 15 bp, Homo sapiens
gtccactctctatta

SEQ ID NO: 196566 - DNA, 15 bp, Homo sapiens
tgtccactctctatt

SEQ ID NO: 196567 - DNA, 15 bp, Homo sapiens
ctgtccactctctat

SEQ ID NO: 196568 - DNA, 15 bp, Homo sapiens
gctgtccactctcta

SEQ ID NO: 196569 - DNA, 15 bp, Homo sapiens
agctgtccactctct

SEQ ID NO: 196570 - DNA, 15 bp, Homo sapiens
gagctgtccactctc

SEQ ID NO: 196571 - DNA, 15 bp, Homo sapiens
ggagctgtccactct

SEQ ID NO: 196572 - DNA, 15 bp, Homo sapiens
aggagctgtccactc

SEQ ID NO: 196573 - DNA, 15 bp, Homo sapiens
taggagctgtccact

SEQ ID NO: 196574 - DNA, 15 bp, Homo sapiens
ttaggagctgtccac

SEQ ID NO: 196575 - DNA, 15 bp, Homo sapiens
attaggagctgtcca

SEQ ID NO: 196576 - DNA, 15 bp, Homo sapiens
aattaggagctgtcc

SEQ ID NO: 196577 - DNA, 15 bp, Homo sapiens
taattaggagctgtc

SEQ ID NO: 196578 - DNA, 15 bp, Homo sapiens
ataattaggagctgt

SEQ ID NO: 196579 - DNA, 15 bp, Homo sapiens
tataattaggagctg

SEQ ID NO: 196580 - DNA, 15 bp, Homo sapiens
atataattaggagct

SEQ ID NO: 196581 - DNA, 15 bp, Homo sapiens
tatataattaggagc

SEQ ID NO: 196582 - DNA, 15 bp, Homo sapiens
atatataattaggag

SEQ ID NO: 196583 - DNA, 15 bp, Homo sapiens
tatatataattagga

SEQ ID NO: 196584 - DNA, 15 bp, Homo sapiens
ttatatataattagg

SEQ ID NO: 196585 - DNA, 15 bp, Homo sapiens
tttatatataattag

SEQ ID NO: 196586 - DNA, 15 bp, Homo sapiens
atttatatataatta

SEQ ID NO: 196587 - DNA, 15 bp, Homo sapiens
aatttatatataatt

SEQ ID NO: 196588 - DNA, 15 bp, Homo sapiens
aaatttatatataat

SEQ ID NO: 196589 - DNA, 15 bp, Homo sapiens
taaatttatatataa

SEQ ID NO: 196590 - DNA, 15 bp, Homo sapiens
ctaaatttatatata

SEQ ID NO: 196591 - DNA, 15 bp, Homo sapiens
actaaatttatatat

SEQ ID NO: 196592 - DNA, 15 bp, Homo sapiens
cactaaatttatata

SEQ ID NO: 196593 - DNA, 15 bp, Homo sapiens
tcactaaatttatat

SEQ ID NO: 196594 - DNA, 15 bp, Homo sapiens
ttcactaaatttata

SEQ ID NO: 196595 - DNA, 15 bp, Homo sapiens
attcactaaatttat

SEQ ID NO: 196596 - DNA, 15 bp, Homo sapiens
tattcactaaattta

SEQ ID NO: 196597 - DNA, 15 bp, Homo sapiens
gtattcactaaattt

SEQ ID NO: 196598 - DNA, 15 bp, Homo sapiens
agtattcactaaatt

SEQ ID NO: 196599 - DNA, 15 bp, Homo sapiens
cagtattcactaaat

SEQ ID NO: 196600 - DNA, 15 bp, Homo sapiens
ccagtattcactaaa

SEQ ID NO: 196601 - DNA, 15 bp, Homo sapiens
gccagtattcactaa

SEQ ID NO: 196602 - DNA, 15 bp, Homo sapiens
agccagtattcacta

SEQ ID NO: 196603 - DNA, 15 bp, Homo sapiens
cagccagtattcact

SEQ ID NO: 196604 - DNA, 15 bp, Homo sapiens
tcagccagtattcac

SEQ ID NO: 196605 - DNA, 15 bp, Homo sapiens
ttcagccagtattca

SEQ ID NO: 196606 - DNA, 15 bp, Homo sapiens
tttcagccagtattc

SEQ ID NO: 196607 - DNA, 15 bp, Homo sapiens
ttttcagccagtatt

SEQ ID NO: 196608 - DNA, 15 bp, Homo sapiens
tttttcagccagtat

SEQ ID NO: 196609 - DNA, 15 bp, Homo sapiens
atttttcagccagta

SEQ ID NO: 196610 - DNA, 15 bp, Homo sapiens
tatttttcagccagt

SEQ ID NO: 196611 - DNA, 15 bp, Homo sapiens
atatttttcagccag

SEQ ID NO: 196612 - DNA, 15 bp, Homo sapiens
catatttttcagcca

SEQ ID NO: 196613 - DNA, 15 bp, Homo sapiens
acatatttttcagcc

SEQ ID NO: 196614 - DNA, 15 bp, Homo sapiens
aacatatttttcagc

SEQ ID NO: 196615 - DNA, 15 bp, Homo sapiens
taacatatttttcag

SEQ ID NO: 196616 - DNA, 15 bp, Homo sapiens
ataacatatttttca

SEQ ID NO: 196617 - DNA, 15 bp, Homo sapiens
aataacatatttttc

SEQ ID NO: 196618 - DNA, 15 bp, Homo sapiens
caataacatattttt

SEQ ID NO: 196619 - DNA, 15 bp, Homo sapiens
tcaataacatatttt

SEQ ID NO: 196620 - DNA, 15 bp, Homo sapiens
ctcaataacatattt

SEQ ID NO: 196621 - DNA, 15 bp, Homo sapiens
gctcaataacatatt

SEQ ID NO: 196622 - DNA, 15 bp, Homo sapiens
tgctcaataacatat

SEQ ID NO: 196623 - DNA, 15 bp, Homo sapiens
ttgctcaataacata

SEQ ID NO: 196624 - DNA, 15 bp, Homo sapiens
tttgctcaataacat

SEQ ID NO: 196625 - DNA, 15 bp, Homo sapiens
ttttgctcaataaca

SEQ ID NO: 196626 - DNA, 15 bp, Homo sapiens
tttttgctcaataac

SEQ ID NO: 196627 - DNA, 15 bp, Homo sapiens
atttttgctcaataa

SEQ ID NO: 196628 - DNA, 15 bp, Homo sapiens
gatttttgctcaata

SEQ ID NO: 196629 - DNA, 15 bp, Homo sapiens
agatttttgctcaat

SEQ ID NO: 196630 - DNA, 15 bp, Homo sapiens
tagatttttgctcaa

SEQ ID NO: 196631 - DNA, 15 bp, Homo sapiens
ttagatttttgctca

SEQ ID NO: 196632 - DNA, 15 bp, Homo sapiens
tttagatttttgctc

SEQ ID NO: 196633 - DNA, 15 bp, Homo sapiens
ttttagatttttgct

SEQ ID NO: 196634 - DNA, 15 bp, Homo sapiens
cttttagatttttgc

SEQ ID NO: 196635 - DNA, 15 bp, Homo sapiens
gcttttagatttttg

SEQ ID NO: 196636 - DNA, 15 bp, Homo sapiens
tgcttttagattttt

SEQ ID NO: 196637 - DNA, 15 bp, Homo sapiens
ctgcttttagatttt

SEQ ID NO: 196638 - DNA, 15 bp, Homo sapiens
tctgcttttagattt

SEQ ID NO: 196639 - DNA, 15 bp, Homo sapiens
ttctgcttttagatt

SEQ ID NO: 196640 - DNA, 15 bp, Homo sapiens
gttctgcttttagat

SEQ ID NO: 196641 - DNA, 15 bp, Homo sapiens
tgttctgcttttaga

SEQ ID NO: 196642 - DNA, 15 bp, Homo sapiens
atgttctgcttttag

SEQ ID NO: 196643 - DNA, 15 bp, Homo sapiens
aatgttctgctttta

SEQ ID NO: 196644 - DNA, 15 bp, Homo sapiens
caatgttctgctttt

SEQ ID NO: 196645 - DNA, 15 bp, Homo sapiens
ccaatgttctgcttt

SEQ ID NO: 196646 - DNA, 15 bp, Homo sapiens
gccaatgttctgctt

SEQ ID NO: 196647 - DNA, 15 bp, Homo sapiens
tgccaatgttctgct

SEQ ID NO: 196648 - DNA, 15 bp, Homo sapiens
ctgccaatgttctgc

SEQ ID NO: 196649 - DNA, 15 bp, Homo sapiens
cctgccaatgttctg

SEQ ID NO: 196650 - DNA, 15 bp, Homo sapiens
tcctgccaatgttct

SEQ ID NO: 196651 - DNA, 15 bp, Homo sapiens
ttcctgccaatgttc

SEQ ID NO: 196652 - DNA, 15 bp, Homo sapiens
cttcctgccaatgtt

SEQ ID NO: 196653 - DNA, 15 bp, Homo sapiens
acttcctgccaatgt

SEQ ID NO: 196654 - DNA, 15 bp, Homo sapiens
gacttcctgccaatg

SEQ ID NO: 196655 - DNA, 15 bp, Homo sapiens
ggacttcctgccaat

SEQ ID NO: 196656 - DNA, 15 bp, Homo sapiens
aggacttcctgccaa

SEQ ID NO: 196657 - DNA, 15 bp, Homo sapiens
caggacttcctgcca

SEQ ID NO: 196658 - DNA, 15 bp, Homo sapiens
ccaggacttcctgcc

SEQ ID NO: 196659 - DNA, 15 bp, Homo sapiens
tccaggacttcctgc

SEQ ID NO: 196660 - DNA, 15 bp, Homo sapiens
atccaggacttcctg

SEQ ID NO: 196661 - DNA, 15 bp, Homo sapiens
gatccaggacttcct

SEQ ID NO: 196662 - DNA, 15 bp, Homo sapiens
tgatccaggacttcc

SEQ ID NO: 196663 - DNA, 15 bp, Homo sapiens
ctgatccaggacttc

SEQ ID NO: 196664 - DNA, 15 bp, Homo sapiens
gctgatccaggactt

SEQ ID NO: 196665 - DNA, 15 bp, Homo sapiens
agctgatccaggact

SEQ ID NO: 196666 - DNA, 15 bp, Homo sapiens
aagctgatccaggac

SEQ ID NO: 196667 - DNA, 15 bp, Homo sapiens
aaagctgatccagga

SEQ ID NO: 196668 - DNA, 15 bp, Homo sapiens
aaaagctgatccagg

SEQ ID NO: 196669 - DNA, 15 bp, Homo sapiens
caaaagctgatccag

SEQ ID NO: 196670 - DNA, 15 bp, Homo sapiens
acaaaagctgatcca

SEQ ID NO: 196671 - DNA, 15 bp, Homo sapiens
aacaaaagctgatcc

SEQ ID NO: 196672 - DNA, 15 bp, Homo sapiens
aaacaaaagctgatc

SEQ ID NO: 196673 - DNA, 15 bp, Homo sapiens
aaaacaaaagctgat

SEQ ID NO: 196674 - DNA, 15 bp, Homo sapiens
caaaacaaaagctga

SEQ ID NO: 196675 - DNA, 15 bp, Homo sapiens
acaaaacaaaagctg

SEQ ID NO: 196676 - DNA, 15 bp, Homo sapiens
aacaaaacaaaagct

SEQ ID NO: 196677 - DNA, 15 bp, Homo sapiens
aaacaaaacaaaagc

SEQ ID NO: 196678 - DNA, 15 bp, Homo sapiens
gcaaaaaacaaaaca

SEQ ID NO: 196679 - DNA, 15 bp, Homo sapiens
ggcaaaaaacaaaac

SEQ ID NO: 196680 - DNA, 15 bp, Homo sapiens
aggcaaaaaacaaaa

SEQ ID NO: 196681 - DNA, 15 bp, Homo sapiens
aaggcaaaaaacaaa

SEQ ID NO: 196682 - DNA, 15 bp, Homo sapiens
caaggcaaaaaacaa

SEQ ID NO: 196683 - DNA, 15 bp, Homo sapiens
acaaggcaaaaaaca

SEQ ID NO: 196684 - DNA, 15 bp, Homo sapiens
tacaaggcaaaaaac

SEQ ID NO: 196685 - DNA, 15 bp, Homo sapiens
gtacaaggcaaaaaa

SEQ ID NO: 196686 - DNA, 15 bp, Homo sapiens
ggtacaaggcaaaaa

SEQ ID NO: 196687 - DNA, 15 bp, Homo sapiens
tggtacaaggcaaaa

SEQ ID NO: 196688 - DNA, 15 bp, Homo sapiens
ttggtacaaggcaaa

SEQ ID NO: 196689 - DNA, 15 bp, Homo sapiens
cttggtacaaggcaa

SEQ ID NO: 196690 - DNA, 15 bp, Homo sapiens
acttggtacaaggca

SEQ ID NO: 196691 - DNA, 15 bp, Homo sapiens
cacttggtacaaggc

SEQ ID NO: 196692 - DNA, 15 bp, Homo sapiens
acacttggtacaagg

SEQ ID NO: 196693 - DNA, 15 bp, Homo sapiens
tacacttggtacaag

SEQ ID NO: 196694 - DNA, 15 bp, Homo sapiens
gtacacttggtacaa

SEQ ID NO: 196695 - DNA, 15 bp, Homo sapiens
tgtacacttggtaca

SEQ ID NO: 196696 - DNA, 15 bp, Homo sapiens
atgtacacttggtac

SEQ ID NO: 196697 - DNA, 15 bp, Homo sapiens
gatgtacacttggta

SEQ ID NO: 196698 - DNA, 15 bp, Homo sapiens
ggatgtacacttggt

SEQ ID NO: 196699 - DNA, 15 bp, Homo sapiens
aggatgtacacttgg

SEQ ID NO: 196700 - DNA, 15 bp, Homo sapiens
aaggatgtacacttg

SEQ ID NO: 196701 - DNA, 15 bp, Homo sapiens
aaaggatgtacactt

SEQ ID NO: 196702 - DNA, 15 bp, Homo sapiens
taaaggatgtacact

SEQ ID NO: 196703 - DNA, 15 bp, Homo sapiens
ttaaaggatgtacac

SEQ ID NO: 196704 - DNA, 15 bp, Homo sapiens
tttaaaggatgtaca

SEQ ID NO: 196705 - DNA, 15 bp, Homo sapiens
gtttaaaggatgtac

SEQ ID NO: 196706 - DNA, 15 bp, Homo sapiens
ggtttaaaggatgta

SEQ ID NO: 196707 - DNA, 15 bp, Homo sapiens
tggtttaaaggatgt

SEQ ID NO: 196708 - DNA, 15 bp, Homo sapiens
ttggtttaaaggatg

SEQ ID NO: 196709 - DNA, 15 bp, Homo sapiens
tttggtttaaaggat

SEQ ID NO: 196710 - DNA, 15 bp, Homo sapiens
atttggtttaaagga

SEQ ID NO: 196711 - DNA, 15 bp, Homo sapiens
catttggtttaaagg

SEQ ID NO: 196712 - DNA, 15 bp, Homo sapiens
ccatttggtttaaag

SEQ ID NO: 196713 - DNA, 15 bp, Homo sapiens
accatttggtttaaa

SEQ ID NO: 196714 - DNA, 15 bp, Homo sapiens
gaccatttggtttaa

SEQ ID NO: 196715 - DNA, 15 bp, Homo sapiens
agaccatttggttta

SEQ ID NO: 196716 - DNA, 15 bp, Homo sapiens
aagaccatttggttt

SEQ ID NO: 196717 - DNA, 15 bp, Homo sapiens
caagaccatttggtt

SEQ ID NO: 196718 - DNA, 15 bp, Homo sapiens
tcaagaccatttggt

SEQ ID NO: 196719 - DNA, 15 bp, Homo sapiens
ttcaagaccatttgg

SEQ ID NO: 196720 - DNA, 15 bp, Homo sapiens
attcaagaccatttg

SEQ ID NO: 196721 - DNA, 15 bp, Homo sapiens
aattcaagaccattt

SEQ ID NO: 196722 - DNA, 15 bp, Homo sapiens
aaattcaagaccatt

SEQ ID NO: 196723 - DNA, 15 bp, Homo sapiens
caaattcaagaccat

SEQ ID NO: 196724 - DNA, 15 bp, Homo sapiens
tcaaattcaagacca

SEQ ID NO: 196725 - DNA, 15 bp, Homo sapiens
gtcaaattcaagacc

SEQ ID NO: 196726 - DNA, 15 bp, Homo sapiens
agtcaaattcaagac

SEQ ID NO: 196727 - DNA, 15 bp, Homo sapiens
gagtcaaattcaaga

SEQ ID NO: 196728 - DNA, 15 bp, Homo sapiens
agagtcaaattcaag

SEQ ID NO: 196729 - DNA, 15 bp, Homo sapiens
cagagtcaaattcaa

SEQ ID NO: 196730 - DNA, 15 bp, Homo sapiens
tcagagtcaaattca

SEQ ID NO: 196731 - DNA, 15 bp, Homo sapiens
gtcagagtcaaattc

SEQ ID NO: 196732 - DNA, 15 bp, Homo sapiens
agtcagagtcaaatt

SEQ ID NO: 196733 - DNA, 15 bp, Homo sapiens
aagtcagagtcaaat

SEQ ID NO: 196734 - DNA, 15 bp, Homo sapiens
gaagtcagagtcaaa

SEQ ID NO: 196735 - DNA, 15 bp, Homo sapiens
tgaagtcagagtcaa

SEQ ID NO: 196736 - DNA, 15 bp, Homo sapiens
gtgaagtcagagtca

SEQ ID NO: 196737 - DNA, 15 bp, Homo sapiens
agtgaagtcagagtc

SEQ ID NO: 196738 - DNA, 15 bp, Homo sapiens
tagtgaagtcagagt

SEQ ID NO: 196739 - DNA, 15 bp, Homo sapiens
atagtgaagtcagag

SEQ ID NO: 196740 - DNA, 15 bp, Homo sapiens
aatagtgaagtcaga

SEQ ID NO: 196741 - DNA, 15 bp, Homo sapiens
aaatagtgaagtcag

SEQ ID NO: 196742 - DNA, 15 bp, Homo sapiens
taaatagtgaagtca

SEQ ID NO: 196743 - DNA, 15 bp, Homo sapiens
gtaaatagtgaagtc

SEQ ID NO: 196744 - DNA, 15 bp, Homo sapiens
agtaaatagtgaagt

SEQ ID NO: 196745 - DNA, 15 bp, Homo sapiens
gagtaaatagtgaag

SEQ ID NO: 196746 - DNA, 15 bp, Homo sapiens
agagtaaatagtgaa

SEQ ID NO: 196747 - DNA, 15 bp, Homo sapiens
gagagtaaatagtga

SEQ ID NO: 196748 - DNA, 15 bp, Homo sapiens
agagagtaaatagtg

SEQ ID NO: 196749 - DNA, 15 bp, Homo sapiens
cagagagtaaatagt

SEQ ID NO: 196750 - DNA, 15 bp, Homo sapiens
tcagagagtaaatag

SEQ ID NO: 196751 - DNA, 15 bp, Homo sapiens
atcagagagtaaata

SEQ ID NO: 196752 - DNA, 15 bp, Homo sapiens
gatcagagagtaaat

SEQ ID NO: 196753 - DNA, 15 bp, Homo sapiens
agatcagagagtaaa

SEQ ID NO: 196754 - DNA, 15 bp, Homo sapiens
aagatcagagagtaa

SEQ ID NO: 196755 - DNA, 15 bp, Homo sapiens
caagatcagagagta

SEQ ID NO: 196756 - DNA, 15 bp, Homo sapiens
tcaagatcagagagt

SEQ ID NO: 196757 - DNA, 15 bp, Homo sapiens
ttcaagatcagagag

SEQ ID NO: 196758 - DNA, 15 bp, Homo sapiens
gttcaagatcagaga

SEQ ID NO: 196759 - DNA, 15 bp, Homo sapiens
tgttcaagatcagag

SEQ ID NO: 196760 - DNA, 15 bp, Homo sapiens
ttgttcaagatcaga

SEQ ID NO: 196761 - DNA, 15 bp, Homo sapiens
tttgttcaagatcag

SEQ ID NO: 196762 - DNA, 15 bp, Homo sapiens
gtttgttcaagatca

SEQ ID NO: 196763 - DNA, 15 bp, Homo sapiens
agtttgttcaagatc

SEQ ID NO: 196764 - DNA, 15 bp, Homo sapiens
tagtttgttcaagat

SEQ ID NO: 196765 - DNA, 15 bp, Homo sapiens
gtagtttgttcaaga

SEQ ID NO: 196766 - DNA, 15 bp, Homo sapiens
agtagtttgttcaag

SEQ ID NO: 196767 - DNA, 15 bp, Homo sapiens
gagtagtttgttcaa

SEQ ID NO: 196768 - DNA, 15 bp, Homo sapiens
tgagtagtttgttca

SEQ ID NO: 196769 - DNA, 15 bp, Homo sapiens
ctgagtagtttgttc

SEQ ID NO: 196770 - DNA, 15 bp, Homo sapiens
gctgagtagtttgtt

SEQ ID NO: 196771 - DNA, 15 bp, Homo sapiens
ggctgagtagtttgt

SEQ ID NO: 196772 - DNA, 15 bp, Homo sapiens
aggctgagtagtttg

SEQ ID NO: 196773 - DNA, 15 bp, Homo sapiens
gaggctgagtagttt

SEQ ID NO: 196774 - DNA, 15 bp, Homo sapiens
agaggctgagtagtt

SEQ ID NO: 196775 - DNA, 15 bp, Homo sapiens
aagaggctgagtagt

SEQ ID NO: 196776 - DNA, 15 bp, Homo sapiens
aaagaggctgagtag

SEQ ID NO: 196777 - DNA, 15 bp, Homo sapiens
caaagaggctgagta

SEQ ID NO: 196778 - DNA, 15 bp, Homo sapiens
tcaaagaggctgagt

SEQ ID NO: 196779 - DNA, 15 bp, Homo sapiens
ctcaaagaggctgag

SEQ ID NO: 196780 - DNA, 15 bp, Homo sapiens
gctcaaagaggctga

SEQ ID NO: 196781 - DNA, 15 bp, Homo sapiens
ggctcaaagaggctg

SEQ ID NO: 196782 - DNA, 15 bp, Homo sapiens
aggctcaaagaggct

SEQ ID NO: 196783 - DNA, 15 bp, Homo sapiens
aaggctcaaagaggc

SEQ ID NO: 196784 - DNA, 15 bp, Homo sapiens
caaggctcaaagagg

SEQ ID NO: 196785 - DNA, 15 bp, Homo sapiens
ccaaggctcaaagag

SEQ ID NO: 196786 - DNA, 15 bp, Homo sapiens
tccaaggctcaaaga

SEQ ID NO: 196787 - DNA, 15 bp, Homo sapiens
atccaaggctcaaag

SEQ ID NO: 196788 - DNA, 15 bp, Homo sapiens
aatccaaggctcaaa

SEQ ID NO: 196789 - DNA, 15 bp, Homo sapiens
taatccaaggctcaa

SEQ ID NO: 196790 - DNA, 15 bp, Homo sapiens
ataatccaaggctca

SEQ ID NO: 196791 - DNA, 15 bp, Homo sapiens
aataatccaaggctc

SEQ ID NO: 196792 - DNA, 15 bp, Homo sapiens
aaataatccaaggct

SEQ ID NO: 196793 - DNA, 15 bp, Homo sapiens
aaaataatccaaggc

SEQ ID NO: 196794 - DNA, 15 bp, Homo sapiens
taaaataatccaagg

SEQ ID NO: 196795 - DNA, 15 bp, Homo sapiens
ataaaataatccaag

SEQ ID NO: 196796 - DNA, 15 bp, Homo sapiens
aataaaataatccaa

SEQ ID NO: 196797 - DNA, 15 bp, Homo sapiens
aaataaaataatcca

SEQ ID NO: 196798 - DNA, 15 bp, Homo sapiens
taaataaaataatcc

SEQ ID NO: 196799 - DNA, 15 bp, Homo sapiens
gtaaataaaataatc

SEQ ID NO: 196800 - DNA, 15 bp, Homo sapiens
tgtaaataaaataat

SEQ ID NO: 196801 - DNA, 15 bp, Homo sapiens
ttgtaaataaaataa

SEQ ID NO: 196802 - DNA, 15 bp, Homo sapiens
tttgtaaataaaata

SEQ ID NO: 196803 - DNA, 15 bp, Homo sapiens
ttttgtaaataaaat

SEQ ID NO: 196804 - DNA, 15 bp, Homo sapiens
attttgtaaataaaa

SEQ ID NO: 196805 - DNA, 15 bp, Homo sapiens
gattttgtaaataaa

SEQ ID NO: 196806 - DNA, 15 bp, Homo sapiens
tgattttgtaaataa

SEQ ID NO: 196807 - DNA, 15 bp, Homo sapiens
ctgattttgtaaata

SEQ ID NO: 196808 - DNA, 15 bp, Homo sapiens
tctgattttgtaaat

SEQ ID NO: 196809 - DNA, 15 bp, Homo sapiens
ttctgattttgtaaa

SEQ ID NO: 196810 - DNA, 15 bp, Homo sapiens
attctgattttgtaa

SEQ ID NO: 196811 - DNA, 15 bp, Homo sapiens
tattctgattttgta

SEQ ID NO: 196812 - DNA, 15 bp, Homo sapiens
ctattctgattttgt

SEQ ID NO: 196813 - DNA, 15 bp, Homo sapiens
tctattctgattttg

SEQ ID NO: 196814 - DNA, 15 bp, Homo sapiens
ttctattctgatttt

SEQ ID NO: 196815 - DNA, 15 bp, Homo sapiens
tttctattctgattt

SEQ ID NO: 196816 - DNA, 15 bp, Homo sapiens
atttctattctgatt

SEQ ID NO: 196817 - DNA, 15 bp, Homo sapiens
tatttctattctgat

SEQ ID NO: 196818 - DNA, 15 bp, Homo sapiens
atatttctattctga

SEQ ID NO: 196819 - DNA, 15 bp, Homo sapiens
aatatttctattctg

SEQ ID NO: 196820 - DNA, 15 bp, Homo sapiens
aaatatttctattct

SEQ ID NO: 196821 - DNA, 15 bp, Homo sapiens
taaatatttctattc

SEQ ID NO: 196822 - DNA, 15 bp, Homo sapiens
ttaaatatttctatt

SEQ ID NO: 196823 - DNA, 15 bp, Homo sapiens
gttaaatatttctat

SEQ ID NO: 196824 - DNA, 15 bp, Homo sapiens
tgttaaatatttcta

SEQ ID NO: 196825 - DNA, 15 bp, Homo sapiens
gtgttaaatatttct

SEQ ID NO: 196826 - DNA, 15 bp, Homo sapiens
agtgttaaatatttc

SEQ ID NO: 196827 - DNA, 15 bp, Homo sapiens
gagtgttaaatattt

SEQ ID NO: 196828 - DNA, 15 bp, Homo sapiens
tgagtgttaaatatt

SEQ ID NO: 196829 - DNA, 15 bp, Homo sapiens
atgagtgttaaatat

SEQ ID NO: 196830 - DNA, 15 bp, Homo sapiens
catgagtgttaaata

SEQ ID NO: 196831 - DNA, 15 bp, Homo sapiens
tcatgagtgttaaat

SEQ ID NO: 196832 - DNA, 15 bp, Homo sapiens
atcatgagtgttaaa

SEQ ID NO: 196833 - DNA, 15 bp, Homo sapiens
aatcatgagtgttaa

SEQ ID NO: 196834 - DNA, 15 bp, Homo sapiens
caatcatgagtgtta

SEQ ID NO: 196835 - DNA, 15 bp, Homo sapiens
gcaatcatgagtgtt

SEQ ID NO: 196836 - DNA, 15 bp, Homo sapiens
agcaatcatgagtgt

SEQ ID NO: 196837 - DNA, 15 bp, Homo sapiens
tagcaatcatgagtg

SEQ ID NO: 196838 - DNA, 15 bp, Homo sapiens
atagcaatcatgagt

SEQ ID NO: 196839 - DNA, 15 bp, Homo sapiens
catagcaatcatgag

SEQ ID NO: 196840 - DNA, 15 bp, Homo sapiens
tcatagcaatcatga

SEQ ID NO: 196841 - DNA, 15 bp, Homo sapiens
ttcatagcaatcatg

SEQ ID NO: 196842 - DNA, 15 bp, Homo sapiens
cttcatagcaatcat

SEQ ID NO: 196843 - DNA, 15 bp, Homo sapiens
tcttcatagcaatca

SEQ ID NO: 196844 - DNA, 15 bp, Homo sapiens
atcttcatagcaatc

SEQ ID NO: 196845 - DNA, 15 bp, Homo sapiens
aatcttcatagcaat

SEQ ID NO: 196846 - DNA, 15 bp, Homo sapiens
aaatcttcatagcaa

SEQ ID NO: 196847 - DNA, 15 bp, Homo sapiens
taaatcttcatagca

SEQ ID NO: 196848 - DNA, 15 bp, Homo sapiens
ttaaatcttcatagc

SEQ ID NO: 196849 - DNA, 15 bp, Homo sapiens
attaaatcttcatag

SEQ ID NO: 196850 - DNA, 15 bp, Homo sapiens
cattaaatcttcata

SEQ ID NO: 196851 - DNA, 15 bp, Homo sapiens
ccattaaatcttcat

SEQ ID NO: 196852 - DNA, 15 bp, Homo sapiens
tccattaaatcttca

SEQ ID NO: 196853 - DNA, 15 bp, Homo sapiens
ttccattaaatcttc

SEQ ID NO: 196854 - DNA, 15 bp, Homo sapiens
attccattaaatctt

SEQ ID NO: 196855 - DNA, 15 bp, Homo sapiens
cattccattaaatct

SEQ ID NO: 196856 - DNA, 15 bp, Homo sapiens
ccattccattaaatc

SEQ ID NO: 196857 - DNA, 15 bp, Homo sapiens
accattccattaaat

SEQ ID NO: 196858 - DNA, 15 bp, Homo sapiens
aaccattccattaaa

SEQ ID NO: 196859 - DNA, 15 bp, Homo sapiens
aaaccattccattaa

SEQ ID NO: 196860 - DNA, 15 bp, Homo sapiens
caaaccattccatta

SEQ ID NO: 196861 - DNA, 15 bp, Homo sapiens
tcaaaccattccatt

SEQ ID NO: 196862 - DNA, 15 bp, Homo sapiens
atcaaaccattccat

SEQ ID NO: 196863 - DNA, 15 bp, Homo sapiens
tatcaaaccattcca

SEQ ID NO: 196864 - DNA, 15 bp, Homo sapiens
ctatcaaaccattcc

SEQ ID NO: 196865 - DNA, 15 bp, Homo sapiens
actatcaaaccattc

SEQ ID NO: 196866 - DNA, 15 bp, Homo sapiens
aactatcaaaccatt

SEQ ID NO: 196867 - DNA, 15 bp, Homo sapiens
gaactatcaaaccat

SEQ ID NO: 196868 - DNA, 15 bp, Homo sapiens
ggaactatcaaacca

SEQ ID NO: 196869 - DNA, 15 bp, Homo sapiens
gggaactatcaaacc

SEQ ID NO: 196870 - DNA, 15 bp, Homo sapiens
agggaactatcaaac

SEQ ID NO: 196871 - DNA, 15 bp, Homo sapiens
tagggaactatcaaa

SEQ ID NO: 196872 - DNA, 15 bp, Homo sapiens
ttagggaactatcaa

SEQ ID NO: 196873 - DNA, 15 bp, Homo sapiens
attagggaactatca

SEQ ID NO: 196874 - DNA, 15 bp, Homo sapiens
gattagggaactatc

SEQ ID NO: 196875 - DNA, 15 bp, Homo sapiens
agattagggaactat

SEQ ID NO: 196876 - DNA, 15 bp, Homo sapiens
tagattagggaacta

SEQ ID NO: 196877 - DNA, 15 bp, Homo sapiens
atagattagggaact

SEQ ID NO: 196878 - DNA, 15 bp, Homo sapiens
catagattagggaac

SEQ ID NO: 196879 - DNA, 15 bp, Homo sapiens
acatagattagggaa

SEQ ID NO: 196880 - DNA, 15 bp, Homo sapiens
tacatagattaggga

SEQ ID NO: 196881 - DNA, 15 bp, Homo sapiens
ttacatagattaggg

SEQ ID NO: 196882 - DNA, 15 bp, Homo sapiens
tttacatagattagg

SEQ ID NO: 196883 - DNA, 15 bp, Homo sapiens
atttacatagattag

SEQ ID NO: 196884 - DNA, 15 bp, Homo sapiens
gatttacatagatta

SEQ ID NO: 196885 - DNA, 15 bp, Homo sapiens
ggatttacatagatt

SEQ ID NO: 196886 - DNA, 15 bp, Homo sapiens
aggatttacatagat

SEQ ID NO: 196887 - DNA, 15 bp, Homo sapiens
caggatttacataga

SEQ ID NO: 196888 - DNA, 15 bp, Homo sapiens
gcaggatttacatag

SEQ ID NO: 196889 - DNA, 15 bp, Homo sapiens
ggcaggatttacata

SEQ ID NO: 196890 - DNA, 15 bp, Homo sapiens
aggcaggatttacat

SEQ ID NO: 196891 - DNA, 15 bp, Homo sapiens
taggcaggatttaca

SEQ ID NO: 196892 - DNA, 15 bp, Homo sapiens
ttaggcaggatttac

SEQ ID NO: 196893 - DNA, 15 bp, Homo sapiens
cttaggcaggattta

SEQ ID NO: 196894 - DNA, 15 bp, Homo sapiens
tcttaggcaggattt

SEQ ID NO: 196895 - DNA, 15 bp, Homo sapiens
ttcttaggcaggatt

SEQ ID NO: 196896 - DNA, 15 bp, Homo sapiens
tttcttaggcaggat

SEQ ID NO: 196897 - DNA, 15 bp, Homo sapiens
ctttcttaggcagga

SEQ ID NO: 196898 - DNA, 15 bp, Homo sapiens
gctttcttaggcagg

SEQ ID NO: 196899 - DNA, 15 bp, Homo sapiens
tgctttcttaggcag

SEQ ID NO: 196900 - DNA, 15 bp, Homo sapiens
atgctttcttaggca

SEQ ID NO: 196901 - DNA, 15 bp, Homo sapiens
gatgctttcttaggc

SEQ ID NO: 196902 - DNA, 15 bp, Homo sapiens
agatgctttcttagg

SEQ ID NO: 196903 - DNA, 15 bp, Homo sapiens
tagatgctttcttag

SEQ ID NO: 196904 - DNA, 15 bp, Homo sapiens
ctagatgctttctta

SEQ ID NO: 196905 - DNA, 15 bp, Homo sapiens
actagatgctttctt

SEQ ID NO: 196906 - DNA, 15 bp, Homo sapiens
aactagatgctttct

SEQ ID NO: 196907 - DNA, 15 bp, Homo sapiens
taactagatgctttc

SEQ ID NO: 196908 - DNA, 15 bp, Homo sapiens
ttaactagatgcttt

SEQ ID NO: 196909 - DNA, 15 bp, Homo sapiens
cttaactagatgctt

SEQ ID NO: 196910 - DNA, 15 bp, Homo sapiens
acttaactagatgct

SEQ ID NO: 196911 - DNA, 15 bp, Homo sapiens
tacttaactagatgc

SEQ ID NO: 196912 - DNA, 15 bp, Homo sapiens
atacttaactagatg

SEQ ID NO: 196913 - DNA, 15 bp, Homo sapiens
aatacttaactagat

SEQ ID NO: 196914 - DNA, 15 bp, Homo sapiens
aaatacttaactaga

SEQ ID NO: 196915 - DNA, 15 bp, Homo sapiens
aaaatacttaactag

SEQ ID NO: 196916 - DNA, 15 bp, Homo sapiens
aaaaatacttaacta

SEQ ID NO: 196917 - DNA, 15 bp, Homo sapiens
taaaaatacttaact

SEQ ID NO: 196918 - DNA, 15 bp, Homo sapiens
ataaaaatacttaac

SEQ ID NO: 196919 - DNA, 15 bp, Homo sapiens
tataaaaatacttaa

SEQ ID NO: 196920 - DNA, 15 bp, Homo sapiens
gtataaaaatactta

SEQ ID NO: 196921 - DNA, 15 bp, Homo sapiens
tgtataaaaatactt

SEQ ID NO: 196922 - DNA, 15 bp, Homo sapiens
atgtataaaaatact

SEQ ID NO: 196923 - DNA, 15 bp, Homo sapiens
tatgtataaaaatac

SEQ ID NO: 196924 - DNA, 15 bp, Homo sapiens
ttatgtataaaaata

SEQ ID NO: 196925 - DNA, 15 bp, Homo sapiens
tttatgtataaaaat

SEQ ID NO: 196926 - DNA, 15 bp, Homo sapiens
ctttatgtataaaaa

SEQ ID NO: 196927 - DNA, 15 bp, Homo sapiens
cctttatgtataaaa

SEQ ID NO: 196928 - DNA, 15 bp, Homo sapiens
ccctttatgtataaa

SEQ ID NO: 196929 - DNA, 15 bp, Homo sapiens
cccctttatgtataa

SEQ ID NO: 196930 - DNA, 15 bp, Homo sapiens
gcccctttatgtata

SEQ ID NO: 196931 - DNA, 15 bp, Homo sapiens
agcccctttatgtat

SEQ ID NO: 196932 - DNA, 15 bp, Homo sapiens
gagcccctttatgta

SEQ ID NO: 196933 - DNA, 15 bp, Homo sapiens
tgagcccctttatgt

SEQ ID NO: 196934 - DNA, 15 bp, Homo sapiens
gtgagcccctttatg

SEQ ID NO: 196935 - DNA, 15 bp, Homo sapiens
agtgagcccctttat

SEQ ID NO: 196936 - DNA, 15 bp, Homo sapiens
cagtgagccccttta

SEQ ID NO: 196937 - DNA, 15 bp, Homo sapiens
ccagtgagccccttt

SEQ ID NO: 196938 - DNA, 15 bp, Homo sapiens
tccagtgagcccctt

SEQ ID NO: 196939 - DNA, 15 bp, Homo sapiens
atccagtgagcccct

SEQ ID NO: 196940 - DNA, 15 bp, Homo sapiens
gatccagtgagcccc

SEQ ID NO: 196941 - DNA, 15 bp, Homo sapiens
agatccagtgagccc

SEQ ID NO: 196942 - DNA, 15 bp, Homo sapiens
cagatccagtgagcc

SEQ ID NO: 196943 - DNA, 15 bp, Homo sapiens
gcagatccagtgagc

SEQ ID NO: 196944 - DNA, 15 bp, Homo sapiens
ggcagatccagtgag

SEQ ID NO: 196945 - DNA, 15 bp, Homo sapiens
aggcagatccagtga

SEQ ID NO: 196946 - DNA, 15 bp, Homo sapiens
gaggcagatccagtg

SEQ ID NO: 196947 - DNA, 15 bp, Homo sapiens
tgaggcagatccagt

SEQ ID NO: 196948 - DNA, 15 bp, Homo sapiens
ctgaggcagatccag

SEQ ID NO: 196949 - DNA, 15 bp, Homo sapiens
gctgaggcagatcca

SEQ ID NO: 196950 - DNA, 15 bp, Homo sapiens
agctgaggcagatcc

SEQ ID NO: 196951 - DNA, 15 bp, Homo sapiens
cagctgaggcagatc

SEQ ID NO: 196952 - DNA, 15 bp, Homo sapiens
ccagctgaggcagat

SEQ ID NO: 196953 - DNA, 15 bp, Homo sapiens
accagctgaggcaga

SEQ ID NO: 196954 - DNA, 15 bp, Homo sapiens
aaccagctgaggcag

SEQ ID NO: 196955 - DNA, 15 bp, Homo sapiens
aaaccagctgaggca

SEQ ID NO: 196956 - DNA, 15 bp, Homo sapiens
gaaaccagctgaggc

SEQ ID NO: 196957 - DNA, 15 bp, Homo sapiens
tgaaaccagctgagg

SEQ ID NO: 196958 - DNA, 15 bp, Homo sapiens
ttgaaaccagctgag

SEQ ID NO: 196959 - DNA, 15 bp, Homo sapiens
cttgaaaccagctga

SEQ ID NO: 196960 - DNA, 15 bp, Homo sapiens
tcttgaaaccagctg

SEQ ID NO: 196961 - DNA, 15 bp, Homo sapiens
atcttgaaaccagct

SEQ ID NO: 196962 - DNA, 15 bp, Homo sapiens
aatcttgaaaccagc

SEQ ID NO: 196963 - DNA, 15 bp, Homo sapiens
aaatcttgaaaccag

SEQ ID NO: 196964 - DNA, 15 bp, Homo sapiens
taaatcttgaaacca

SEQ ID NO: 196965 - DNA, 15 bp, Homo sapiens
ttaaatcttgaaacc

SEQ ID NO: 196966 - DNA, 15 bp, Homo sapiens
attaaatcttgaaac

SEQ ID NO: 196967 - DNA, 15 bp, Homo sapiens
cattaaatcttgaaa

SEQ ID NO: 196968 - DNA, 15 bp, Homo sapiens
ccattaaatcttgaa

SEQ ID NO: 196969 - DNA, 15 bp, Homo sapiens
tccattaaatcttga

SEQ ID NO: 196970 - DNA, 15 bp, Homo sapiens
ctccattaaatcttg

SEQ ID NO: 196971 - DNA, 15 bp, Homo sapiens
tctccattaaatctt

SEQ ID NO: 196972 - DNA, 15 bp, Homo sapiens
ttctccattaaatct

SEQ ID NO: 196973 - DNA, 15 bp, Homo sapiens
gttctccattaaatc

SEQ ID NO: 196974 - DNA, 15 bp, Homo sapiens
tgttctccattaaat

SEQ ID NO: 196975 - DNA, 15 bp, Homo sapiens
ctgttctccattaaa

SEQ ID NO: 196976 - DNA, 15 bp, Homo sapiens
tctgttctccattaa

SEQ ID NO: 196977 - DNA, 15 bp, Homo sapiens
ttctgttctccatta

SEQ ID NO: 196978 - DNA, 15 bp, Homo sapiens
attctgttctccatt

SEQ ID NO: 196979 - DNA, 15 bp, Homo sapiens
aattctgttctccat

SEQ ID NO: 196980 - DNA, 15 bp, Homo sapiens
aaattctgttctcca

SEQ ID NO: 196981 - DNA, 15 bp, Homo sapiens
aaaattctgttctcc

SEQ ID NO: 196982 - DNA, 15 bp, Homo sapiens
gaaaattctgttctc

SEQ ID NO: 196983 - DNA, 15 bp, Homo sapiens
tgaaaattctgttct

SEQ ID NO: 196984 - DNA, 15 bp, Homo sapiens
ttgaaaattctgttc

SEQ ID NO: 196985 - DNA, 15 bp, Homo sapiens
attgaaaattctgtt

SEQ ID NO: 196986 - DNA, 15 bp, Homo sapiens
cattgaaaattctgt

SEQ ID NO: 196987 - DNA, 15 bp, Homo sapiens
tcattgaaaattctg

SEQ ID NO: 196988 - DNA, 15 bp, Homo sapiens
atcattgaaaattct

SEQ ID NO: 196989 - DNA, 15 bp, Homo sapiens
aatcattgaaaattc

SEQ ID NO: 196990 - DNA, 15 bp, Homo sapiens
taatcattgaaaatt

SEQ ID NO: 196991 - DNA, 15 bp, Homo sapiens
gtaatcattgaaaat

SEQ ID NO: 196992 - DNA, 15 bp, Homo sapiens
agtaatcattgaaaa

SEQ ID NO: 196993 - DNA, 15 bp, Homo sapiens
aagtaatcattgaaa

SEQ ID NO: 196994 - DNA, 15 bp, Homo sapiens
taagtaatcattgaa

SEQ ID NO: 196995 - DNA, 15 bp, Homo sapiens
ataagtaatcattga

SEQ ID NO: 196996 - DNA, 15 bp, Homo sapiens
gataagtaatcattg

SEQ ID NO: 196997 - DNA, 15 bp, Homo sapiens
tgataagtaatcatt

SEQ ID NO: 196998 - DNA, 15 bp, Homo sapiens
atgataagtaatcat

SEQ ID NO: 196999 - DNA, 15 bp, Homo sapiens
tatgataagtaatca

SEQ ID NO: 197000 - DNA, 15 bp, Homo sapiens
ttatgataagtaatc

SEQ ID NO: 197001 - DNA, 15 bp, Homo sapiens
tttatgataagtaat

SEQ ID NO: 197002 - DNA, 15 bp, Homo sapiens
atttatgataagtaa

SEQ ID NO: 197003 - DNA, 15 bp, Homo sapiens
catttatgataagta

SEQ ID NO: 197004 - DNA, 15 bp, Homo sapiens
tcatttatgataagt

SEQ ID NO: 197005 - DNA, 15 bp, Homo sapiens
ttcatttatgataag

SEQ ID NO: 197006 - DNA, 15 bp, Homo sapiens
attcatttatgataa

SEQ ID NO: 197007 - DNA, 15 bp, Homo sapiens
aattcatttatgata

SEQ ID NO: 197008 - DNA, 15 bp, Homo sapiens
taattcatttatgat

SEQ ID NO: 197009 - DNA, 15 bp, Homo sapiens
ttaattcatttatga

SEQ ID NO: 197010 - DNA, 15 bp, Homo sapiens
tttaattcatttatg

SEQ ID NO: 197011 - DNA, 15 bp, Homo sapiens
ttttaattcatttat

SEQ ID NO: 197012 - DNA, 15 bp, Homo sapiens
aattttaattcattt

SEQ ID NO: 197013 - DNA, 15 bp, Homo sapiens
aaattttaattcatt

SEQ ID NO: 197014 - DNA, 15 bp, Homo sapiens
aaaattttaattcat

SEQ ID NO: 197015 - DNA, 15 bp, Homo sapiens
aaaaattttaattca

SEQ ID NO: 197016 - DNA, 15 bp, Homo sapiens
aaaaaattttaattc

SEQ ID NO: 197017 - DNA, 15 bp, Homo sapiens
aaaaaaattttaatt

SEQ ID NO: 197018 - DNA, 15 bp, Homo sapiens
aaaaaaaattttaat

SEQ ID NO: 197019 - DNA, 15 bp, Homo sapiens
aaaaaaaaattttaa

SEQ ID NO: 197020 - DNA, 15 bp, Homo sapiens
gaaaaaaaaatttta

SEQ ID NO: 197021 - DNA, 15 bp, Homo sapiens
agaaaaaaaaatttt

SEQ ID NO: 197022 - DNA, 15 bp, Homo sapiens
tagaaaaaaaaattt

SEQ ID NO: 197023 - DNA, 15 bp, Homo sapiens
ttagaaaaaaaaatt

SEQ ID NO: 197024 - DNA, 15 bp, Homo sapiens
cttagaaaaaaaaat

SEQ ID NO: 197025 - DNA, 15 bp, Homo sapiens
tcttagaaaaaaaaa

SEQ ID NO: 197026 - DNA, 15 bp, Homo sapiens
atcttagaaaaaaaa

SEQ ID NO: 197027 - DNA, 15 bp, Homo sapiens
catcttagaaaaaaa

SEQ ID NO: 197028 - DNA, 15 bp, Homo sapiens
acatcttagaaaaaa

SEQ ID NO: 197029 - DNA, 15 bp, Homo sapiens
tacatcttagaaaaa

SEQ ID NO: 197030 - DNA, 15 bp, Homo sapiens
atacatcttagaaaa

SEQ ID NO: 197031 - DNA, 15 bp, Homo sapiens
aatacatcttagaaa

SEQ ID NO: 197032 - DNA, 15 bp, Homo sapiens
caatacatcttagaa

SEQ ID NO: 197033 - DNA, 15 bp, Homo sapiens
tcaatacatcttaga

SEQ ID NO: 197034 - DNA, 15 bp, Homo sapiens
ttcaatacatcttag

SEQ ID NO: 197035 - DNA, 15 bp, Homo sapiens
tttcaatacatctta

SEQ ID NO: 197036 - DNA, 15 bp, Homo sapiens
ctttcaatacatctt

SEQ ID NO: 197037 - DNA, 15 bp, Homo sapiens
cctttcaatacatct

SEQ ID NO: 197038 - DNA, 15 bp, Homo sapiens
acctttcaatacatc

SEQ ID NO: 197039 - DNA, 15 bp, Homo sapiens
aacctttcaatacat

SEQ ID NO: 197040 - DNA, 15 bp, Homo sapiens
aaacctttcaataca

SEQ ID NO: 197041 - DNA, 15 bp, Homo sapiens
aaaacctttcaatac

SEQ ID NO: 197042 - DNA, 15 bp, Homo sapiens
aaaaacctttcaata

SEQ ID NO: 197043 - DNA, 15 bp, Homo sapiens
taaaaacctttcaat

SEQ ID NO: 197044 - DNA, 15 bp, Homo sapiens
ataaaaacctttcaa

SEQ ID NO: 197045 - DNA, 15 bp, Homo sapiens
aataaaaacctttca

SEQ ID NO: 197046 - DNA, 15 bp, Homo sapiens
gaataaaaacctttc

SEQ ID NO: 197047 - DNA, 15 bp, Homo sapiens
agaataaaaaccttt

SEQ ID NO: 197048 - DNA, 15 bp, Homo sapiens
aagaataaaaacctt

SEQ ID NO: 197049 - DNA, 15 bp, Homo sapiens
gaagaataaaaacct

SEQ ID NO: 197050 - DNA, 15 bp, Homo sapiens
agaagaataaaaacc

SEQ ID NO: 197051 - DNA, 15 bp, Homo sapiens
cagaagaataaaaac

SEQ ID NO: 197052 - DNA, 15 bp, Homo sapiens
ccagaagaataaaaa

SEQ ID NO: 197053 - DNA, 15 bp, Homo sapiens
tccagaagaataaaa

SEQ ID NO: 197054 - DNA, 15 bp, Homo sapiens
ctccagaagaataaa

SEQ ID NO: 197055 - DNA, 15 bp, Homo sapiens
gctccagaagaataa

SEQ ID NO: 197056 - DNA, 15 bp, Homo sapiens
agctccagaagaata

SEQ ID NO: 197057 - DNA, 15 bp, Homo sapiens
gagctccagaagaat

SEQ ID NO: 197058 - DNA, 15 bp, Homo sapiens
tgagctccagaagaa

SEQ ID NO: 197059 - DNA, 15 bp, Homo sapiens
ctgagctccagaaga

SEQ ID NO: 197060 - DNA, 15 bp, Homo sapiens
tctgagctccagaag

SEQ ID NO: 197061 - DNA, 15 bp, Homo sapiens
ctctgagctccagaa

SEQ ID NO: 197062 - DNA, 15 bp, Homo sapiens
tctctgagctccaga

SEQ ID NO: 197063 - DNA, 15 bp, Homo sapiens
ctctctgagctccag

SEQ ID NO: 197064 - DNA, 15 bp, Homo sapiens
actctctgagctcca

SEQ ID NO: 197065 - DNA, 15 bp, Homo sapiens
cactctctgagctcc

SEQ ID NO: 197066 - DNA, 15 bp, Homo sapiens
ccactctctgagctc

SEQ ID NO: 197067 - DNA, 15 bp, Homo sapiens
tccactctctgagct

SEQ ID NO: 197068 - DNA, 15 bp, Homo sapiens
ttccactctctgagc

SEQ ID NO: 197069 - DNA, 15 bp, Homo sapiens
attccactctctgag

SEQ ID NO: 197070 - DNA, 15 bp, Homo sapiens
aattccactctctga

SEQ ID NO: 197071 - DNA, 15 bp, Homo sapiens
aaattccactctctg

SEQ ID NO: 197072 - DNA, 15 bp, Homo sapiens
caaattccactctct

SEQ ID NO: 197073 - DNA, 15 bp, Homo sapiens
gcaaattccactctc

SEQ ID NO: 197074 - DNA, 15 bp, Homo sapiens
tgcaaattccactct

SEQ ID NO: 197075 - DNA, 15 bp, Homo sapiens
ctgcaaattccactc

SEQ ID NO: 197076 - DNA, 15 bp, Homo sapiens
actgcaaattccact

SEQ ID NO: 197077 - DNA, 15 bp, Homo sapiens
aactgcaaattccac

SEQ ID NO: 197078 - DNA, 15 bp, Homo sapiens
gaactgcaaattcca

SEQ ID NO: 197079 - DNA, 15 bp, Homo sapiens
ggaactgcaaattcc

SEQ ID NO: 197080 - DNA, 15 bp, Homo sapiens
aggaactgcaaattc

SEQ ID NO: 197081 - DNA, 15 bp, Homo sapiens
gaggaactgcaaatt

SEQ ID NO: 197082 - DNA, 15 bp, Homo sapiens
agaggaactgcaaat

SEQ ID NO: 197083 - DNA, 15 bp, Homo sapiens
aagaggaactgcaaa

SEQ ID NO: 197084 - DNA, 15 bp, Homo sapiens
taagaggaactgcaa

SEQ ID NO: 197085 - DNA, 15 bp, Homo sapiens
gtaagaggaactgca

SEQ ID NO: 197086 - DNA, 15 bp, Homo sapiens
tgtaagaggaactgc

SEQ ID NO: 197087 - DNA, 15 bp, Homo sapiens
atgtaagaggaactg

SEQ ID NO: 197088 - DNA, 15 bp, Homo sapiens
catgtaagaggaact

SEQ ID NO: 197089 - DNA, 15 bp, Homo sapiens
acatgtaagaggaac

SEQ ID NO: 197090 - DNA, 15 bp, Homo sapiens
cacatgtaagaggaa

SEQ ID NO: 197091 - DNA, 15 bp, Homo sapiens
tcacatgtaagagga

SEQ ID NO: 197092 - DNA, 15 bp, Homo sapiens
ctcacatgtaagagg

SEQ ID NO: 197093 - DNA, 15 bp, Homo sapiens
cctcacatgtaagag

SEQ ID NO: 197094 - DNA, 15 bp, Homo sapiens
tcctcacatgtaaga

SEQ ID NO: 197095 - DNA, 15 bp, Homo sapiens
ttcctcacatgtaag

SEQ ID NO: 197096 - DNA, 15 bp, Homo sapiens
cttcctcacatgtaa

SEQ ID NO: 197097 - DNA, 15 bp, Homo sapiens
ccttcctcacatgta

SEQ ID NO: 197098 - DNA, 15 bp, Homo sapiens
cccttcctcacatgt

SEQ ID NO: 197099 - DNA, 15 bp, Homo sapiens
tcccttcctcacatg

SEQ ID NO: 197100 - DNA, 15 bp, Homo sapiens
ctcccttcctcacat

SEQ ID NO: 197101 - DNA, 15 bp, Homo sapiens
gctcccttcctcaca

SEQ ID NO: 197102 - DNA, 15 bp, Homo sapiens
tgctcccttcctcac

SEQ ID NO: 197103 - DNA, 15 bp, Homo sapiens
ttgctcccttcctca

SEQ ID NO: 197104 - DNA, 15 bp, Homo sapiens
attgctcccttcctc

SEQ ID NO: 197105 - DNA, 15 bp, Homo sapiens
cattgctcccttcct

SEQ ID NO: 197106 - DNA, 15 bp, Homo sapiens
gcattgctcccttcc

SEQ ID NO: 197107 - DNA, 15 bp, Homo sapiens
tgcattgctcccttc

SEQ ID NO: 197108 - DNA, 15 bp, Homo sapiens
ctgcattgctccctt

SEQ ID NO: 197109 - DNA, 15 bp, Homo sapiens
gctgcattgctccct

SEQ ID NO: 197110 - DNA, 15 bp, Homo sapiens
tgctgcattgctccc

SEQ ID NO: 197111 - DNA, 15 bp, Homo sapiens
atgctgcattgctcc

SEQ ID NO: 197112 - DNA, 15 bp, Homo sapiens
catgctgcattgctc

SEQ ID NO: 197113 - DNA, 15 bp, Homo sapiens
ccatgctgcattgct

SEQ ID NO: 197114 - DNA, 15 bp, Homo sapiens
tccatgctgcattgc

SEQ ID NO: 197115 - DNA, 15 bp, Homo sapiens
gtccatgctgcattg

SEQ ID NO: 197116 - DNA, 15 bp, Homo sapiens
tgtccatgctgcatt

SEQ ID NO: 197117 - DNA, 15 bp, Homo sapiens
atgtccatgctgcat

SEQ ID NO: 197118 - DNA, 15 bp, Homo sapiens
catgtccatgctgca

SEQ ID NO: 197119 - DNA, 15 bp, Homo sapiens
ccatgtccatgctgc

SEQ ID NO: 197120 - DNA, 15 bp, Homo sapiens
tccatgtccatgctg

SEQ ID NO: 197121 - DNA, 15 bp, Homo sapiens
atccatgtccatgct

SEQ ID NO: 197122 - DNA, 15 bp, Homo sapiens
catccatgtccatgc

SEQ ID NO: 197123 - DNA, 15 bp, Homo sapiens
gcatccatgtccatg

SEQ ID NO: 197124 - DNA, 15 bp, Homo sapiens
agcatccatgtccat

SEQ ID NO: 197125 - DNA, 15 bp, Homo sapiens
gagcatccatgtcca

SEQ ID NO: 197126 - DNA, 15 bp, Homo sapiens
agagcatccatgtcc

SEQ ID NO: 197127 - DNA, 15 bp, Homo sapiens
cagagcatccatgtc

SEQ ID NO: 197128 - DNA, 15 bp, Homo sapiens
acagagcatccatgt

SEQ ID NO: 197129 - DNA, 15 bp, Homo sapiens
cacagagcatccatg

SEQ ID NO: 197130 - DNA, 15 bp, Homo sapiens
acacagagcatccat

SEQ ID NO: 197131 - DNA, 15 bp, Homo sapiens
tacacagagcatcca

SEQ ID NO: 197132 - DNA, 15 bp, Homo sapiens
ttacacagagcatcc

SEQ ID NO: 197133 - DNA, 15 bp, Homo sapiens
tttacacagagcatc

SEQ ID NO: 197134 - DNA, 15 bp, Homo sapiens
ctttacacagagcat

SEQ ID NO: 197135 - DNA, 15 bp, Homo sapiens
actttacacagagca

SEQ ID NO: 197136 - DNA, 15 bp, Homo sapiens
aactttacacagagc

SEQ ID NO: 197137 - DNA, 15 bp, Homo sapiens
gaactttacacagag

SEQ ID NO: 197138 - DNA, 15 bp, Homo sapiens
ggaactttacacaga

SEQ ID NO: 197139 - DNA, 15 bp, Homo sapiens
gggaactttacacag

SEQ ID NO: 197140 - DNA, 15 bp, Homo sapiens
tgggaactttacaca

SEQ ID NO: 197141 - DNA, 15 bp, Homo sapiens
atgggaactttacac

SEQ ID NO: 197142 - DNA, 15 bp, Homo sapiens
aatgggaactttaca

SEQ ID NO: 197143 - DNA, 15 bp, Homo sapiens
caatgggaactttac

SEQ ID NO: 197144 - DNA, 15 bp, Homo sapiens
ccaatgggaacttta

SEQ ID NO: 197145 - DNA, 15 bp, Homo sapiens
cccaatgggaacttt

SEQ ID NO: 197146 - DNA, 15 bp, Homo sapiens
tcccaatgggaactt

SEQ ID NO: 197147 - DNA, 15 bp, Homo sapiens
ttcccaatgggaact

SEQ ID NO: 197148 - DNA, 15 bp, Homo sapiens
tttcccaatgggaac

SEQ ID NO: 197149 - DNA, 15 bp, Homo sapiens
atttcccaatgggaa

SEQ ID NO: 197150 - DNA, 15 bp, Homo sapiens
tatttcccaatggga

SEQ ID NO: 197151 - DNA, 15 bp, Homo sapiens
gtatttcccaatggg

SEQ ID NO: 197152 - DNA, 15 bp, Homo sapiens
tgtatttcccaatgg

SEQ ID NO: 197153 - DNA, 15 bp, Homo sapiens
ttgtatttcccaatg

SEQ ID NO: 197154 - DNA, 15 bp, Homo sapiens
attgtatttcccaat

SEQ ID NO: 197155 - DNA, 15 bp, Homo sapiens
tattgtatttcccaa

SEQ ID NO: 197156 - DNA, 15 bp, Homo sapiens
ctattgtatttccca

SEQ ID NO: 197157 - DNA, 15 bp, Homo sapiens
cctattgtatttccc

SEQ ID NO: 197158 - DNA, 15 bp, Homo sapiens
acctattgtatttcc

SEQ ID NO: 197159 - DNA, 15 bp, Homo sapiens
gacctattgtatttc

SEQ ID NO: 197160 - DNA, 15 bp, Homo sapiens
tgacctattgtattt

SEQ ID NO: 197161 - DNA, 15 bp, Homo sapiens
ctgacctattgtatt

SEQ ID NO: 197162 - DNA, 15 bp, Homo sapiens
gctgacctattgtat

SEQ ID NO: 197163 - DNA, 15 bp, Homo sapiens
tgctgacctattgta

SEQ ID NO: 197164 - DNA, 15 bp, Homo sapiens
atgctgacctattgt

SEQ ID NO: 197165 - DNA, 15 bp, Homo sapiens
aatgctgacctattg

SEQ ID NO: 197166 - DNA, 15 bp, Homo sapiens
caatgctgacctatt

SEQ ID NO: 197167 - DNA, 15 bp, Homo sapiens
ccaatgctgacctat

SEQ ID NO: 197168 - DNA, 15 bp, Homo sapiens
gccaatgctgaccta

SEQ ID NO: 197169 - DNA, 15 bp, Homo sapiens
ggccaatgctgacct

SEQ ID NO: 197170 - DNA, 15 bp, Homo sapiens
tggccaatgctgacc

SEQ ID NO: 197171 - DNA, 15 bp, Homo sapiens
ttggccaatgctgac

SEQ ID NO: 197172 - DNA, 15 bp, Homo sapiens
gttggccaatgctga

SEQ ID NO: 197173 - DNA, 15 bp, Homo sapiens
agttggccaatgctg

SEQ ID NO: 197174 - DNA, 15 bp, Homo sapiens
tagttggccaatgct

SEQ ID NO: 197175 - DNA, 15 bp, Homo sapiens
gtagttggccaatgc

SEQ ID NO: 197176 - DNA, 15 bp, Homo sapiens
agtagttggccaatg

SEQ ID NO: 197177 - DNA, 15 bp, Homo sapiens
aagtagttggccaat

SEQ ID NO: 197178 - DNA, 15 bp, Homo sapiens
aaagtagttggccaa

SEQ ID NO: 197179 - DNA, 15 bp, Homo sapiens
aaaagtagttggcca

SEQ ID NO: 197180 - DNA, 15 bp, Homo sapiens
aaaaagtagttggcc

SEQ ID NO: 197181 - DNA, 15 bp, Homo sapiens
gaaaaagtagttggc

SEQ ID NO: 197182 - DNA, 15 bp, Homo sapiens
agaaaaagtagttgg

SEQ ID NO: 197183 - DNA, 15 bp, Homo sapiens
aagaaaaagtagttg

SEQ ID NO: 197184 - DNA, 15 bp, Homo sapiens
taagaaaaagtagtt

SEQ ID NO: 197185 - DNA, 15 bp, Homo sapiens
ctaagaaaaagtagt

SEQ ID NO: 197186 - DNA, 15 bp, Homo sapiens
actaagaaaaagtag

SEQ ID NO: 197187 - DNA, 15 bp, Homo sapiens
tactaagaaaaagta

SEQ ID NO: 197188 - DNA, 15 bp, Homo sapiens
ttactaagaaaaagt

SEQ ID NO: 197189 - DNA, 15 bp, Homo sapiens
cttactaagaaaaag

SEQ ID NO: 197190 - DNA, 15 bp, Homo sapiens
tcttactaagaaaaa

SEQ ID NO: 197191 - DNA, 15 bp, Homo sapiens
ctcttactaagaaaa

SEQ ID NO: 197192 - DNA, 15 bp, Homo sapiens
tctcttactaagaaa

SEQ ID NO: 197193 - DNA, 15 bp, Homo sapiens
ttctcttactaagaa

SEQ ID NO: 197194 - DNA, 15 bp, Homo sapiens
cttctcttactaaga

SEQ ID NO: 197195 - DNA, 15 bp, Homo sapiens
tcttctcttactaag

SEQ ID NO: 197196 - DNA, 15 bp, Homo sapiens
ttcttctcttactaa

SEQ ID NO: 197197 - DNA, 15 bp, Homo sapiens
tttcttctcttacta

SEQ ID NO: 197198 - DNA, 15 bp, Homo sapiens
ttttcttctcttact

SEQ ID NO: 197199 - DNA, 15 bp, Homo sapiens
attttcttctcttac

SEQ ID NO: 197200 - DNA, 15 bp, Homo sapiens
aattttcttctctta

SEQ ID NO: 197201 - DNA, 15 bp, Homo sapiens
taattttcttctctt

SEQ ID NO: 197202 - DNA, 15 bp, Homo sapiens
ctaattttcttctct

SEQ ID NO: 197203 - DNA, 15 bp, Homo sapiens
cctaattttcttctc

SEQ ID NO: 197204 - DNA, 15 bp, Homo sapiens
ccctaattttcttct

SEQ ID NO: 197205 - DNA, 15 bp, Homo sapiens
tccctaattttcttc

SEQ ID NO: 197206 - DNA, 15 bp, Homo sapiens
ctccctaattttctt

SEQ ID NO: 197207 - DNA, 15 bp, Homo sapiens
actccctaattttct

SEQ ID NO: 197208 - DNA, 15 bp, Homo sapiens
aactccctaattttc

SEQ ID NO: 197209 - DNA, 15 bp, Homo sapiens
gaactccctaatttt

SEQ ID NO: 197210 - DNA, 15 bp, Homo sapiens
agaactccctaattt

SEQ ID NO: 197211 - DNA, 15 bp, Homo sapiens
tagaactccctaatt

SEQ ID NO: 197212 - DNA, 15 bp, Homo sapiens
atagaactccctaat

SEQ ID NO: 197213 - DNA, 15 bp, Homo sapiens
catagaactccctaa

SEQ ID NO: 197214 - DNA, 15 bp, Homo sapiens
acatagaactcccta

SEQ ID NO: 197215 - DNA, 15 bp, Homo sapiens
tacatagaactccct

SEQ ID NO: 197216 - DNA, 15 bp, Homo sapiens
ctacatagaactccc

SEQ ID NO: 197217 - DNA, 15 bp, Homo sapiens
actacatagaactcc

SEQ ID NO: 197218 - DNA, 15 bp, Homo sapiens
cactacatagaactc

SEQ ID NO: 197219 - DNA, 15 bp, Homo sapiens
tcactacatagaact

SEQ ID NO: 197220 - DNA, 15 bp, Homo sapiens
ctcactacatagaac

SEQ ID NO: 197221 - DNA, 15 bp, Homo sapiens
cctcactacatagaa

SEQ ID NO: 197222 - DNA, 15 bp, Homo sapiens
ccctcactacataga

SEQ ID NO: 197223 - DNA, 15 bp, Homo sapiens
tccctcactacatag

SEQ ID NO: 197224 - DNA, 15 bp, Homo sapiens
atccctcactacata

SEQ ID NO: 197225 - DNA, 15 bp, Homo sapiens
aatccctcactacat

SEQ ID NO: 197226 - DNA, 15 bp, Homo sapiens
taatccctcactaca

SEQ ID NO: 197227 - DNA, 15 bp, Homo sapiens
ataatccctcactac

SEQ ID NO: 197228 - DNA, 15 bp, Homo sapiens
tataatccctcacta

SEQ ID NO: 197229 - DNA, 15 bp, Homo sapiens
gtataatccctcact

SEQ ID NO: 197230 - DNA, 15 bp, Homo sapiens
agtataatccctcac

SEQ ID NO: 197231 - DNA, 15 bp, Homo sapiens
aagtataatccctca

SEQ ID NO: 197232 - DNA, 15 bp, Homo sapiens
aaagtataatccctc

SEQ ID NO: 197233 - DNA, 15 bp, Homo sapiens
aaaagtataatccct

SEQ ID NO: 197234 - DNA, 15 bp, Homo sapiens
aaaaagtataatccc

SEQ ID NO: 197235 - DNA, 15 bp, Homo sapiens
aaaaaagtataatcc

SEQ ID NO: 197236 - DNA, 15 bp, Homo sapiens
taaaaaagtataatc

SEQ ID NO: 197237 - DNA, 15 bp, Homo sapiens
ttaaaaaagtataat

SEQ ID NO: 197238 - DNA, 15 bp, Homo sapiens
cttaaaaaagtataa

SEQ ID NO: 197239 - DNA, 15 bp, Homo sapiens
tcttaaaaaagtata

SEQ ID NO: 197240 - DNA, 15 bp, Homo sapiens
atcttaaaaaagtat

SEQ ID NO: 197241 - DNA, 15 bp, Homo sapiens
aatcttaaaaaagta

SEQ ID NO: 197242 - DNA, 15 bp, Homo sapiens
aaatcttaaaaaagt

SEQ ID NO: 197243 - DNA, 15 bp, Homo sapiens
caaatcttaaaaaag

SEQ ID NO: 197244 - DNA, 15 bp, Homo sapiens
tcaaatcttaaaaaa

SEQ ID NO: 197245 - DNA, 15 bp, Homo sapiens
ttcaaatcttaaaaa

SEQ ID NO: 197246 - DNA, 15 bp, Homo sapiens
attcaaatcttaaaa

SEQ ID NO: 197247 - DNA, 15 bp, Homo sapiens
aattcaaatcttaaa

SEQ ID NO: 197248 - DNA, 15 bp, Homo sapiens
aaattcaaatcttaa

SEQ ID NO: 197249 - DNA, 15 bp, Homo sapiens
aaaattcaaatctta

SEQ ID NO: 197250 - DNA, 15 bp, Homo sapiens
gaaaattcaaatctt

SEQ ID NO: 197251 - DNA, 15 bp, Homo sapiens
tgaaaattcaaatct

SEQ ID NO: 197252 - DNA, 15 bp, Homo sapiens
ttgaaaattcaaatc

SEQ ID NO: 197253 - DNA, 15 bp, Homo sapiens
gttgaaaattcaaat

SEQ ID NO: 197254 - DNA, 15 bp, Homo sapiens
agttgaaaattcaaa

SEQ ID NO: 197255 - DNA, 15 bp, Homo sapiens
cagttgaaaattcaa

SEQ ID NO: 197256 - DNA, 15 bp, Homo sapiens
gcagttgaaaattca

SEQ ID NO: 197257 - DNA, 15 bp, Homo sapiens
ggcagttgaaaattc

SEQ ID NO: 197258 - DNA, 15 bp, Homo sapiens
aggcagttgaaaatt

SEQ ID NO: 197259 - DNA, 15 bp, Homo sapiens
taggcagttgaaaat

SEQ ID NO: 197260 - DNA, 15 bp, Homo sapiens
ctaggcagttgaaaa

SEQ ID NO: 197261 - DNA, 15 bp, Homo sapiens
tctaggcagttgaaa

SEQ ID NO: 197262 - DNA, 15 bp, Homo sapiens
atctaggcagttgaa

SEQ ID NO: 197263 - DNA, 15 bp, Homo sapiens
gatctaggcagttga

SEQ ID NO: 197264 - DNA, 15 bp, Homo sapiens
ggatctaggcagttg

SEQ ID NO: 197265 - DNA, 15 bp, Homo sapiens
gggatctaggcagtt

SEQ ID NO: 197266 - DNA, 15 bp, Homo sapiens
tgggatctaggcagt

SEQ ID NO: 197267 - DNA, 15 bp, Homo sapiens
atgggatctaggcag

SEQ ID NO: 197268 - DNA, 15 bp, Homo sapiens
gatgggatctaggca

SEQ ID NO: 197269 - DNA, 15 bp, Homo sapiens
tgatgggatctaggc

SEQ ID NO: 197270 - DNA, 15 bp, Homo sapiens
ctgatgggatctagg

SEQ ID NO: 197271 - DNA, 15 bp, Homo sapiens
cctgatgggatctag

SEQ ID NO: 197272 - DNA, 15 bp, Homo sapiens
acctgatgggatcta

SEQ ID NO: 197273 - DNA, 15 bp, Homo sapiens
aacctgatgggatct

SEQ ID NO: 197274 - DNA, 15 bp, Homo sapiens
caacctgatgggatc

SEQ ID NO: 197275 - DNA, 15 bp, Homo sapiens
gcaacctgatgggat

SEQ ID NO: 197276 - DNA, 15 bp, Homo sapiens
tgcaacctgatggga

SEQ ID NO: 197277 - DNA, 15 bp, Homo sapiens
ttgcaacctgatggg

SEQ ID NO: 197278 - DNA, 15 bp, Homo sapiens
gttgcaacctgatgg

SEQ ID NO: 197279 - DNA, 15 bp, Homo sapiens
agttgcaacctgatg

SEQ ID NO: 197280 - DNA, 15 bp, Homo sapiens
aagttgcaacctgat

SEQ ID NO: 197281 - DNA, 15 bp, Homo sapiens
aaagttgcaacctga

SEQ ID NO: 197282 - DNA, 15 bp, Homo sapiens
gaaagttgcaacctg

SEQ ID NO: 197283 - DNA, 15 bp, Homo sapiens
ggaaagttgcaacct

SEQ ID NO: 197284 - DNA, 15 bp, Homo sapiens
tggaaagttgcaacc

SEQ ID NO: 197285 - DNA, 15 bp, Homo sapiens
atggaaagttgcaac

SEQ ID NO: 197286 - DNA, 15 bp, Homo sapiens
aatggaaagttgcaa

SEQ ID NO: 197287 - DNA, 15 bp, Homo sapiens
gaatggaaagttgca

SEQ ID NO: 197288 - DNA, 15 bp, Homo sapiens
ggaatggaaagttgc

SEQ ID NO: 197289 - DNA, 15 bp, Homo sapiens
aggaatggaaagttg

SEQ ID NO: 197290 - DNA, 15 bp, Homo sapiens
gaggaatggaaagtt

SEQ ID NO: 197291 - DNA, 15 bp, Homo sapiens
tgaggaatggaaagt

SEQ ID NO: 197292 - DNA, 15 bp, Homo sapiens
atgaggaatggaaag

SEQ ID NO: 197293 - DNA, 15 bp, Homo sapiens
tatgaggaatggaaa

SEQ ID NO: 197294 - DNA, 15 bp, Homo sapiens
ttatgaggaatggaa

SEQ ID NO: 197295 - DNA, 15 bp, Homo sapiens
tttatgaggaatgga

SEQ ID NO: 197296 - DNA, 15 bp, Homo sapiens
atttatgaggaatgg

SEQ ID NO: 197297 - DNA, 15 bp, Homo sapiens
tatttatgaggaatg

SEQ ID NO: 197298 - DNA, 15 bp, Homo sapiens
atatttatgaggaat

SEQ ID NO: 197299 - DNA, 15 bp, Homo sapiens
catatttatgaggaa

SEQ ID NO: 197300 - DNA, 15 bp, Homo sapiens
tcatatttatgagga

SEQ ID NO: 197301 - DNA, 15 bp, Homo sapiens
ttcatatttatgagg

SEQ ID NO: 197302 - DNA, 15 bp, Homo sapiens
gttcatatttatgag

SEQ ID NO: 197303 - DNA, 15 bp, Homo sapiens
tgttcatatttatga

SEQ ID NO: 197304 - DNA, 15 bp, Homo sapiens
ttgttcatatttatg

SEQ ID NO: 197305 - DNA, 15 bp, Homo sapiens
tttgttcatatttat

SEQ ID NO: 197306 - DNA, 15 bp, Homo sapiens
ttttgttcatattta

SEQ ID NO: 197307 - DNA, 15 bp, Homo sapiens
tttttgttcatattt

SEQ ID NO: 197308 - DNA, 15 bp, Homo sapiens
atttttgttcatatt

SEQ ID NO: 197309 - DNA, 15 bp, Homo sapiens
tatttttgttcatat

SEQ ID NO: 197310 - DNA, 15 bp, Homo sapiens
atatttttgttcata

SEQ ID NO: 197311 - DNA, 15 bp, Homo sapiens
aatatttttgttcat

SEQ ID NO: 197312 - DNA, 15 bp, Homo sapiens
aaatatttttgttca

SEQ ID NO: 197313 - DNA, 15 bp, Homo sapiens
taaatatttttgttc

SEQ ID NO: 197314 - DNA, 15 bp, Homo sapiens
ttaaatatttttgtt

SEQ ID NO: 197315 - DNA, 15 bp, Homo sapiens
tttaaatatttttgt

SEQ ID NO: 197316 - DNA, 15 bp, Homo sapiens
ttttaaatatttttg

SEQ ID NO: 197317 - DNA, 15 bp, Homo sapiens
attttaaatattttt

SEQ ID NO: 197318 - DNA, 15 bp, Homo sapiens
tattttaaatatttt

SEQ ID NO: 197319 - DNA, 15 bp, Homo sapiens
atattttaaatattt

SEQ ID NO: 197320 - DNA, 15 bp, Homo sapiens
aatattttaaatatt

SEQ ID NO: 197321 - DNA, 15 bp, Homo sapiens
taatattttaaatat

SEQ ID NO: 197322 - DNA, 15 bp, Homo sapiens
ttaatattttaaata

SEQ ID NO: 197323 - DNA, 15 bp, Homo sapiens
attaatattttaaat

SEQ ID NO: 197324 - DNA, 15 bp, Homo sapiens
tattaatattttaaa

SEQ ID NO: 197325 - DNA, 15 bp, Homo sapiens
ctattaatattttaa

SEQ ID NO: 197326 - DNA, 15 bp, Homo sapiens
actattaatatttta

SEQ ID NO: 197327 - DNA, 15 bp, Homo sapiens
cactattaatatttt

SEQ ID NO: 197328 - DNA, 15 bp, Homo sapiens
tcactattaatattt

SEQ ID NO: 197329 - DNA, 15 bp, Homo sapiens
ttcactattaatatt

SEQ ID NO: 197330 - DNA, 15 bp, Homo sapiens
tttcactattaatat

SEQ ID NO: 197331 - DNA, 15 bp, Homo sapiens
ttttcactattaata

SEQ ID NO: 197332 - DNA, 15 bp, Homo sapiens
cttttcactattaat

SEQ ID NO: 197333 - DNA, 15 bp, Homo sapiens
gcttttcactattaa

SEQ ID NO: 197334 - DNA, 15 bp, Homo sapiens
tgcttttcactatta

SEQ ID NO: 197335 - DNA, 15 bp, Homo sapiens
atgcttttcactatt

SEQ ID NO: 197336 - DNA, 15 bp, Homo sapiens
aatgcttttcactat

SEQ ID NO: 197337 - DNA, 15 bp, Homo sapiens
gaatgcttttcacta

SEQ ID NO: 197338 - DNA, 15 bp, Homo sapiens
tgaatgcttttcact

SEQ ID NO: 197339 - DNA, 15 bp, Homo sapiens
gtgaatgcttttcac

SEQ ID NO: 197340 - DNA, 15 bp, Homo sapiens
agtgaatgcttttca

SEQ ID NO: 197341 - DNA, 15 bp, Homo sapiens
cagtgaatgcttttc

SEQ ID NO: 197342 - DNA, 15 bp, Homo sapiens
tcagtgaatgctttt

SEQ ID NO: 197343 - DNA, 15 bp, Homo sapiens
atgctcagtgaatgc

SEQ ID NO: 197344 - DNA, 15 bp, Homo sapiens
gatgctcagtgaatg

SEQ ID NO: 197345 - DNA, 15 bp, Homo sapiens
ggatgctcagtgaat

SEQ ID NO: 197346 - DNA, 15 bp, Homo sapiens
tggatgctcagtgaa

SEQ ID NO: 197347 - DNA, 15 bp, Homo sapiens
ctggatgctcagtga

SEQ ID NO: 197348 - DNA, 15 bp, Homo sapiens
gctggatgctcagtg

SEQ ID NO: 197349 - DNA, 15 bp, Homo sapiens
tgctggatgctcagt

SEQ ID NO: 197350 - DNA, 15 bp, Homo sapiens
ttgctggatgctcag

SEQ ID NO: 197351 - DNA, 15 bp, Homo sapiens
cttgctggatgctca

SEQ ID NO: 197352 - DNA, 15 bp, Homo sapiens
acttgctggatgctc

SEQ ID NO: 197353 - DNA, 15 bp, Homo sapiens
gacttgctggatgct

SEQ ID NO: 197354 - DNA, 15 bp, Homo sapiens
tgacttgctggatgc

SEQ ID NO: 197355 - DNA, 15 bp, Homo sapiens
atgacttgctggatg

SEQ ID NO: 197356 - DNA, 15 bp, Homo sapiens
gatgacttgctggat

SEQ ID NO: 197357 - DNA, 15 bp, Homo sapiens
agatgacttgctgga

SEQ ID NO: 197358 - DNA, 15 bp, Homo sapiens
tagatgacttgctgg

SEQ ID NO: 197359 - DNA, 15 bp, Homo sapiens
atagatgacttgctg

SEQ ID NO: 197360 - DNA, 15 bp, Homo sapiens
catagatgacttgct

SEQ ID NO: 197361 - DNA, 15 bp, Homo sapiens
gcatagatgacttgc

SEQ ID NO: 197362 - DNA, 15 bp, Homo sapiens
ggcatagatgacttg

SEQ ID NO: 197363 - DNA, 15 bp, Homo sapiens
tggcatagatgactt

SEQ ID NO: 197364 - DNA, 15 bp, Homo sapiens
ctggcatagatgact

SEQ ID NO: 197365 - DNA, 15 bp, Homo sapiens
gctggcatagatgac

SEQ ID NO: 197366 - DNA, 15 bp, Homo sapiens
tgctggcatagatga

SEQ ID NO: 197367 - DNA, 15 bp, Homo sapiens
ttgctggcatagatg

SEQ ID NO: 197368 - DNA, 15 bp, Homo sapiens
gttgctggcatagat

SEQ ID NO: 197369 - DNA, 15 bp, Homo sapiens
ggttgctggcataga

SEQ ID NO: 197370 - DNA, 15 bp, Homo sapiens
aggttgctggcatag

SEQ ID NO: 197371 - DNA, 15 bp, Homo sapiens
taggttgctggcata

SEQ ID NO: 197372 - DNA, 15 bp, Homo sapiens
ttaggttgctggcat

SEQ ID NO: 197373 - DNA, 15 bp, Homo sapiens
cttaggttgctggca

SEQ ID NO: 197374 - DNA, 15 bp, Homo sapiens
tcttaggttgctggc

SEQ ID NO: 197375 - DNA, 15 bp, Homo sapiens
ttcttaggttgctgg

SEQ ID NO: 197376 - DNA, 15 bp, Homo sapiens
attcttaggttgctg

SEQ ID NO: 197377 - DNA, 15 bp, Homo sapiens
aattcttaggttgct

SEQ ID NO: 197378 - DNA, 15 bp, Homo sapiens
gaattcttaggttgc

SEQ ID NO: 197379 - DNA, 15 bp, Homo sapiens
ggaattcttaggttg

SEQ ID NO: 197380 - DNA, 15 bp, Homo sapiens
tggaattcttaggtt

SEQ ID NO: 197381 - DNA, 15 bp, Homo sapiens
ctggaattcttaggt

SEQ ID NO: 197382 - DNA, 15 bp, Homo sapiens
tctggaattcttagg

SEQ ID NO: 197383 - DNA, 15 bp, Homo sapiens
ctctggaattcttag

SEQ ID NO: 197384 - DNA, 15 bp, Homo sapiens
gctctggaattctta

SEQ ID NO: 197385 - DNA, 15 bp, Homo sapiens
agctctggaattctt

SEQ ID NO: 197386 - DNA, 15 bp, Homo sapiens
cagctctggaattct

SEQ ID NO: 197387 - DNA, 15 bp, Homo sapiens
ccagctctggaattc

SEQ ID NO: 197388 - DNA, 15 bp, Homo sapiens
gccagctctggaatt

SEQ ID NO: 197389 - DNA, 15 bp, Homo sapiens
ggccagctctggaat

SEQ ID NO: 197390 - DNA, 15 bp, Homo sapiens
gggccagctctggaa

SEQ ID NO: 197391 - DNA, 15 bp, Homo sapiens
agggccagctctgga

SEQ ID NO: 197392 - DNA, 15 bp, Homo sapiens
tagggccagctctgg

SEQ ID NO: 197393 - DNA, 15 bp, Homo sapiens
ctagggccagctctg

SEQ ID NO: 197394 - DNA, 15 bp, Homo sapiens
actagggccagctct

SEQ ID NO: 197395 - DNA, 15 bp, Homo sapiens
cactagggccagctc

SEQ ID NO: 197396 - DNA, 15 bp, Homo sapiens
tcactagggccagct

SEQ ID NO: 197397 - DNA, 15 bp, Homo sapiens
ttcactagggccagc

SEQ ID NO: 197398 - DNA, 15 bp, Homo sapiens
cttcactagggccag

SEQ ID NO: 197399 - DNA, 15 bp, Homo sapiens
tcttcactagggcca

SEQ ID NO: 197400 - DNA, 15 bp, Homo sapiens
atcttcactagggcc

SEQ ID NO: 197401 - DNA, 15 bp, Homo sapiens
catcttcactagggc

SEQ ID NO: 197402 - DNA, 15 bp, Homo sapiens
ccatcttcactaggg

SEQ ID NO: 197403 - DNA, 15 bp, Homo sapiens
accatcttcactagg

SEQ ID NO: 197404 - DNA, 15 bp, Homo sapiens
taccatcttcactag

SEQ ID NO: 197405 - DNA, 15 bp, Homo sapiens
ataccatcttcacta

SEQ ID NO: 197406 - DNA, 15 bp, Homo sapiens
tataccatcttcact

SEQ ID NO: 197407 - DNA, 15 bp, Homo sapiens
gtataccatcttcac

SEQ ID NO: 197408 - DNA, 15 bp, Homo sapiens
tgtataccatcttca

SEQ ID NO: 197409 - DNA, 15 bp, Homo sapiens
atgtataccatcttc

SEQ ID NO: 197410 - DNA, 15 bp, Homo sapiens
catgtataccatctt

SEQ ID NO: 197411 - DNA, 15 bp, Homo sapiens
ccatgtataccatct

SEQ ID NO: 197412 - DNA, 15 bp, Homo sapiens
accatgtataccatc

SEQ ID NO: 197413 - DNA, 15 bp, Homo sapiens
caccatgtataccat

SEQ ID NO: 197414 - DNA, 15 bp, Homo sapiens
gcaccatgtatacca

SEQ ID NO: 197415 - DNA, 15 bp, Homo sapiens
agcaccatgtatacc

SEQ ID NO: 197416 - DNA, 15 bp, Homo sapiens
cagcaccatgtatac

SEQ ID NO: 197417 - DNA, 15 bp, Homo sapiens
ccagcaccatgtata

SEQ ID NO: 197418 - DNA, 15 bp, Homo sapiens
cccagcaccatgtat

SEQ ID NO: 197419 - DNA, 15 bp, Homo sapiens
tcccagcaccatgta

SEQ ID NO: 197420 - DNA, 15 bp, Homo sapiens
atcccagcaccatgt

SEQ ID NO: 197421 - DNA, 15 bp, Homo sapiens
aatcccagcaccatg

SEQ ID NO: 197422 - DNA, 15 bp, Homo sapiens
aaatcccagcaccat

SEQ ID NO: 197423 - DNA, 15 bp, Homo sapiens
aaaatcccagcacca

SEQ ID NO: 197424 - DNA, 15 bp, Homo sapiens
gaaaatcccagcacc

SEQ ID NO: 197425 - DNA, 15 bp, Homo sapiens
tgaaaatcccagcac

SEQ ID NO: 197426 - DNA, 15 bp, Homo sapiens
ctgaaaatcccagca

SEQ ID NO: 197427 - DNA, 15 bp, Homo sapiens
tctgaaaatcccagc

SEQ ID NO: 197428 - DNA, 15 bp, Homo sapiens
ctctgaaaatcccag

SEQ ID NO: 197429 - DNA, 15 bp, Homo sapiens
cctctgaaaatccca

SEQ ID NO: 197430 - DNA, 15 bp, Homo sapiens
acctctgaaaatccc

SEQ ID NO: 197431 - DNA, 15 bp, Homo sapiens
aacctctgaaaatcc

SEQ ID NO: 197432 - DNA, 15 bp, Homo sapiens
taacctctgaaaatc

SEQ ID NO: 197433 - DNA, 15 bp, Homo sapiens
ctaacctctgaaaat

SEQ ID NO: 197434 - DNA, 15 bp, Homo sapiens
tctaacctctgaaaa

SEQ ID NO: 197435 - DNA, 15 bp, Homo sapiens
ctctaacctctgaaa

SEQ ID NO: 197436 - DNA, 15 bp, Homo sapiens
tctctaacctctgaa

SEQ ID NO: 197437 - DNA, 15 bp, Homo sapiens
ttctctaacctctga

SEQ ID NO: 197438 - DNA, 15 bp, Homo sapiens
attctctaacctctg

SEQ ID NO: 197439 - DNA, 15 bp, Homo sapiens
cattctctaacctct

SEQ ID NO: 197440 - DNA, 15 bp, Homo sapiens
tcattctctaacctc

SEQ ID NO: 197441 - DNA, 15 bp, Homo sapiens
gtcattctctaacct

SEQ ID NO: 197442 - DNA, 15 bp, Homo sapiens
agtcattctctaacc

SEQ ID NO: 197443 - DNA, 15 bp, Homo sapiens
aagtcattctctaac

SEQ ID NO: 197444 - DNA, 15 bp, Homo sapiens
taagtcattctctaa

SEQ ID NO: 197445 - DNA, 15 bp, Homo sapiens
ataagtcattctcta

SEQ ID NO: 197446 - DNA, 15 bp, Homo sapiens
aataagtcattctct

SEQ ID NO: 197447 - DNA, 15 bp, Homo sapiens
aaataagtcattctc

SEQ ID NO: 197448 - DNA, 15 bp, Homo sapiens
taaataagtcattct

SEQ ID NO: 197449 - DNA, 15 bp, Homo sapiens
ctaaataagtcattc

SEQ ID NO: 197450 - DNA, 15 bp, Homo sapiens
cctaaataagtcatt

SEQ ID NO: 197451 - DNA, 15 bp, Homo sapiens
tcctaaataagtcat

SEQ ID NO: 197452 - DNA, 15 bp, Homo sapiens
ttcctaaataagtca

SEQ ID NO: 197453 - DNA, 15 bp, Homo sapiens
cttcctaaataagtc

SEQ ID NO: 197454 - DNA, 15 bp, Homo sapiens
tcttcctaaataagt

SEQ ID NO: 197455 - DNA, 15 bp, Homo sapiens
ttcttcctaaataag

SEQ ID NO: 197456 - DNA, 15 bp, Homo sapiens
attcttcctaaataa

SEQ ID NO: 197457 - DNA, 15 bp, Homo sapiens
tattcttcctaaata

SEQ ID NO: 197458 - DNA, 15 bp, Homo sapiens
ttattcttcctaaat

SEQ ID NO: 197459 - DNA, 15 bp, Homo sapiens
attattcttcctaaa

SEQ ID NO: 197460 - DNA, 15 bp, Homo sapiens
aattattcttcctaa

SEQ ID NO: 197461 - DNA, 15 bp, Homo sapiens
aaattattcttccta

SEQ ID NO: 197462 - DNA, 15 bp, Homo sapiens
taaattattcttcct

SEQ ID NO: 197463 - DNA, 15 bp, Homo sapiens
ttaaattattcttcc

SEQ ID NO: 197464 - DNA, 15 bp, Homo sapiens
attaaattattcttc

SEQ ID NO: 197465 - DNA, 15 bp, Homo sapiens
cattaaattattctt

SEQ ID NO: 197466 - DNA, 15 bp, Homo sapiens
tcattaaattattct

SEQ ID NO: 197467 - DNA, 15 bp, Homo sapiens
ttcattaaattattc

SEQ ID NO: 197468 - DNA, 15 bp, Homo sapiens
cttcattaaattatt

SEQ ID NO: 197469 - DNA, 15 bp, Homo sapiens
tcttcattaaattat

SEQ ID NO: 197470 - DNA, 15 bp, Homo sapiens
gtcttcattaaatta

SEQ ID NO: 197471 - DNA, 15 bp, Homo sapiens
ggtcttcattaaatt

SEQ ID NO: 197472 - DNA, 15 bp, Homo sapiens
aggtcttcattaaat

SEQ ID NO: 197473 - DNA, 15 bp, Homo sapiens
taggtcttcattaaa

SEQ ID NO: 197474 - DNA, 15 bp, Homo sapiens
ataggtcttcattaa

SEQ ID NO: 197475 - DNA, 15 bp, Homo sapiens
tataggtcttcatta

SEQ ID NO: 197476 - DNA, 15 bp, Homo sapiens
atataggtcttcatt

SEQ ID NO: 197477 - DNA, 15 bp, Homo sapiens
gatataggtcttcat

SEQ ID NO: 197478 - DNA, 15 bp, Homo sapiens
tgatataggtcttca

SEQ ID NO: 197479 - DNA, 15 bp, Homo sapiens
atgatataggtcttc

SEQ ID NO: 197480 - DNA, 15 bp, Homo sapiens
tatgatataggtctt

SEQ ID NO: 197481 - DNA, 15 bp, Homo sapiens
ttatgatataggtct

SEQ ID NO: 197482 - DNA, 15 bp, Homo sapiens
tttatgatataggtc

SEQ ID NO: 197483 - DNA, 15 bp, Homo sapiens
gtttatgatataggt

SEQ ID NO: 197484 - DNA, 15 bp, Homo sapiens
tgtttatgatatagg

SEQ ID NO: 197485 - DNA, 15 bp, Homo sapiens
ctgtttatgatatag

SEQ ID NO: 197486 - DNA, 15 bp, Homo sapiens
tctgtttatgatata

SEQ ID NO: 197487 - DNA, 15 bp, Homo sapiens
atctgtttatgatat

SEQ ID NO: 197488 - DNA, 15 bp, Homo sapiens
gatctgtttatgata

SEQ ID NO: 197489 - DNA, 15 bp, Homo sapiens
tgatctgtttatgat

SEQ ID NO: 197490 - DNA, 15 bp, Homo sapiens
atgatctgtttatga

SEQ ID NO: 197491 - DNA, 15 bp, Homo sapiens
aatgatctgtttatg

SEQ ID NO: 197492 - DNA, 15 bp, Homo sapiens
gaatgatctgtttat

SEQ ID NO: 197493 - DNA, 15 bp, Homo sapiens
agaatgatctgttta

SEQ ID NO: 197494 - DNA, 15 bp, Homo sapiens
tagaatgatctgttt

SEQ ID NO: 197495 - DNA, 15 bp, Homo sapiens
ttagaatgatctgtt

SEQ ID NO: 197496 - DNA, 15 bp, Homo sapiens
cttagaatgatctgt

SEQ ID NO: 197497 - DNA, 15 bp, Homo sapiens
acttagaatgatctg

SEQ ID NO: 197498 - DNA, 15 bp, Homo sapiens
tacttagaatgatct

SEQ ID NO: 197499 - DNA, 15 bp, Homo sapiens
ttacttagaatgatc

SEQ ID NO: 197500 - DNA, 15 bp, Homo sapiens
tttacttagaatgat

SEQ ID NO: 197501 - DNA, 15 bp, Homo sapiens
ttttacttagaatga

SEQ ID NO: 197502 - DNA, 15 bp, Homo sapiens
tttttacttagaatg

SEQ ID NO: 197503 - DNA, 15 bp, Homo sapiens
ctttttacttagaat

SEQ ID NO: 197504 - DNA, 15 bp, Homo sapiens
actttttacttagaa

SEQ ID NO: 197505 - DNA, 15 bp, Homo sapiens
aactttttacttaga

SEQ ID NO: 197506 - DNA, 15 bp, Homo sapiens
taactttttacttag

SEQ ID NO: 197507 - DNA, 15 bp, Homo sapiens
gtaactttttactta

SEQ ID NO: 197508 - DNA, 15 bp, Homo sapiens
tgtaactttttactt

SEQ ID NO: 197509 - DNA, 15 bp, Homo sapiens
ctgtaactttttact

SEQ ID NO: 197510 - DNA, 15 bp, Homo sapiens
tctgtaactttttac

SEQ ID NO: 197511 - DNA, 15 bp, Homo sapiens
gtctgtaacttttta

SEQ ID NO: 197512 - DNA, 15 bp, Homo sapiens
tgtctgtaacttttt

SEQ ID NO: 197513 - DNA, 15 bp, Homo sapiens
ttgtctgtaactttt

SEQ ID NO: 197514 - DNA, 15 bp, Homo sapiens
cttgtctgtaacttt

SEQ ID NO: 197515 - DNA, 15 bp, Homo sapiens
tcttgtctgtaactt

SEQ ID NO: 197516 - DNA, 15 bp, Homo sapiens
ttcttgtctgtaact

SEQ ID NO: 197517 - DNA, 15 bp, Homo sapiens
tttcttgtctgtaac

SEQ ID NO: 197518 - DNA, 15 bp, Homo sapiens
atttcttgtctgtaa

SEQ ID NO: 197519 - DNA, 15 bp, Homo sapiens
aatttcttgtctgta

SEQ ID NO: 197520 - DNA, 15 bp, Homo sapiens
aaatttcttgtctgt

SEQ ID NO: 197521 - DNA, 15 bp, Homo sapiens
aaaatttcttgtctg

SEQ ID NO: 197522 - DNA, 15 bp, Homo sapiens
aaaaatttcttgtct

SEQ ID NO: 197523 - DNA, 15 bp, Homo sapiens
caaaaatttcttgtc

SEQ ID NO: 197524 - DNA, 15 bp, Homo sapiens
ccaaaaatttcttgt

SEQ ID NO: 197525 - DNA, 15 bp, Homo sapiens
accaaaaatttcttg

SEQ ID NO: 197526 - DNA, 15 bp, Homo sapiens
gaccaaaaatttctt

SEQ ID NO: 197527 - DNA, 15 bp, Homo sapiens
agaccaaaaatttct

SEQ ID NO: 197528 - DNA, 15 bp, Homo sapiens
aagaccaaaaatttc

SEQ ID NO: 197529 - DNA, 15 bp, Homo sapiens
aaagaccaaaaattt

SEQ ID NO: 197530 - DNA, 15 bp, Homo sapiens
gaaagaccaaaaatt

SEQ ID NO: 197531 - DNA, 15 bp, Homo sapiens
agaaagaccaaaaat

SEQ ID NO: 197532 - DNA, 15 bp, Homo sapiens
aagaaagaccaaaaa

SEQ ID NO: 197533 - DNA, 15 bp, Homo sapiens
caagaaagaccaaaa

SEQ ID NO: 197534 - DNA, 15 bp, Homo sapiens
ccaagaaagaccaaa

SEQ ID NO: 197535 - DNA, 15 bp, Homo sapiens
cccaagaaagaccaa

SEQ ID NO: 197536 - DNA, 15 bp, Homo sapiens
tcccaagaaagacca

SEQ ID NO: 197537 - DNA, 15 bp, Homo sapiens
ctcccaagaaagacc

SEQ ID NO: 197538 - DNA, 15 bp, Homo sapiens
actcccaagaaagac

SEQ ID NO: 197539 - DNA, 15 bp, Homo sapiens
aactcccaagaaaga

SEQ ID NO: 197540 - DNA, 15 bp, Homo sapiens
taactcccaagaaag

SEQ ID NO: 197541 - DNA, 15 bp, Homo sapiens
ataactcccaagaaa

SEQ ID NO: 197542 - DNA, 15 bp, Homo sapiens
aataactcccaagaa

SEQ ID NO: 197543 - DNA, 15 bp, Homo sapiens
caataactcccaaga

SEQ ID NO: 197544 - DNA, 15 bp, Homo sapiens
gcaataactcccaag

SEQ ID NO: 197545 - DNA, 15 bp, Homo sapiens
ggcaataactcccaa

SEQ ID NO: 197546 - DNA, 15 bp, Homo sapiens
aggcaataactccca

SEQ ID NO: 197547 - DNA, 15 bp, Homo sapiens
taggcaataactccc

SEQ ID NO: 197548 - DNA, 15 bp, Homo sapiens
ttaggcaataactcc

SEQ ID NO: 197549 - DNA, 15 bp, Homo sapiens
cttaggcaataactc

SEQ ID NO: 197550 - DNA, 15 bp, Homo sapiens
gcttaggcaataact

SEQ ID NO: 197551 - DNA, 15 bp, Homo sapiens
ggcttaggcaataac

SEQ ID NO: 197552 - DNA, 15 bp, Homo sapiens
aggcttaggcaataa

SEQ ID NO: 197553 - DNA, 15 bp, Homo sapiens
taggcttaggcaata

SEQ ID NO: 197554 - DNA, 15 bp, Homo sapiens
ataggcttaggcaat

SEQ ID NO: 197555 - DNA, 15 bp, Homo sapiens
gataggcttaggcaa

SEQ ID NO: 197556 - DNA, 15 bp, Homo sapiens
tgataggcttaggca

SEQ ID NO: 197557 - DNA, 15 bp, Homo sapiens
atgataggcttaggc

SEQ ID NO: 197558 - DNA, 15 bp, Homo sapiens
catgataggcttagg

SEQ ID NO: 197559 - DNA, 15 bp, Homo sapiens
tcatgataggcttag

SEQ ID NO: 197560 - DNA, 15 bp, Homo sapiens
gtcatgataggctta

SEQ ID NO: 197561 - DNA, 15 bp, Homo sapiens
tgtcatgataggctt

SEQ ID NO: 197562 - DNA, 15 bp, Homo sapiens
gtgtcatgataggct

SEQ ID NO: 197563 - DNA, 15 bp, Homo sapiens
tgtgtcatgataggc

SEQ ID NO: 197564 - DNA, 15 bp, Homo sapiens
atgtgtcatgatagg

SEQ ID NO: 197565 - DNA, 15 bp, Homo sapiens
aatgtgtcatgatag

SEQ ID NO: 197566 - DNA, 15 bp, Homo sapiens
aaatgtgtcatgata

SEQ ID NO: 197567 - DNA, 15 bp, Homo sapiens
aaaatgtgtcatgat

SEQ ID NO: 197568 - DNA, 15 bp, Homo sapiens
aaaaatgtgtcatga

SEQ ID NO: 197569 - DNA, 15 bp, Homo sapiens
aaaaaatgtgtcatg

SEQ ID NO: 197570 - DNA, 15 bp, Homo sapiens
aaaaaaatgtgtcat

SEQ ID NO: 197571 - DNA, 15 bp, Homo sapiens
aaaaaaaatgtgtca

SEQ ID NO: 197572 - DNA, 15 bp, Homo sapiens
aaaaaaaaatgtgtc

SEQ ID NO: 197573 - DNA, 15 bp, Homo sapiens
taaaaaaaaatgtgt

SEQ ID NO: 197574 - DNA, 15 bp, Homo sapiens
gttaaaaaaaaatgt

SEQ ID NO: 197575 - DNA, 15 bp, Homo sapiens
ggttaaaaaaaaatg

SEQ ID NO: 197576 - DNA, 15 bp, Homo sapiens
aggttaaaaaaaaat

SEQ ID NO: 197577 - DNA, 15 bp, Homo sapiens
caggttaaaaaaaaa

SEQ ID NO: 197578 - DNA, 15 bp, Homo sapiens
ccaggttaaaaaaaa

SEQ ID NO: 197579 - DNA, 15 bp, Homo sapiens
tccaggttaaaaaaa

SEQ ID NO: 197580 - DNA, 15 bp, Homo sapiens
ttccaggttaaaaaa

SEQ ID NO: 197581 - DNA, 15 bp, Homo sapiens
tttccaggttaaaaa

SEQ ID NO: 197582 - DNA, 15 bp, Homo sapiens
ctttccaggttaaaa

SEQ ID NO: 197583 - DNA, 15 bp, Homo sapiens
tctttccaggttaaa

SEQ ID NO: 197584 - DNA, 15 bp, Homo sapiens
ttctttccaggttaa

SEQ ID NO: 197585 - DNA, 15 bp, Homo sapiens
tttctttccaggtta

SEQ ID NO: 197586 - DNA, 15 bp, Homo sapiens
ctttctttccaggtt

SEQ ID NO: 197587 - DNA, 15 bp, Homo sapiens
tctttctttccaggt

SEQ ID NO: 197588 - DNA, 15 bp, Homo sapiens
ttctttctttccagg

SEQ ID NO: 197589 - DNA, 15 bp, Homo sapiens
gttctttctttccag

SEQ ID NO: 197590 - DNA, 15 bp, Homo sapiens
agttctttctttcca

SEQ ID NO: 197591 - DNA, 15 bp, Homo sapiens
aagttctttctttcc

SEQ ID NO: 197592 - DNA, 15 bp, Homo sapiens
taagttctttctttc

SEQ ID NO: 197593 - DNA, 15 bp, Homo sapiens
ataagttctttcttt

SEQ ID NO: 197594 - DNA, 15 bp, Homo sapiens
tataagttctttctt

SEQ ID NO: 197595 - DNA, 15 bp, Homo sapiens
ttataagttctttct

SEQ ID NO: 197596 - DNA, 15 bp, Homo sapiens
tttataagttctttc

SEQ ID NO: 197597 - DNA, 15 bp, Homo sapiens
gtttataagttcttt

SEQ ID NO: 197598 - DNA, 15 bp, Homo sapiens
agtttataagttctt

SEQ ID NO: 197599 - DNA, 15 bp, Homo sapiens
tagtttataagttct

SEQ ID NO: 197600 - DNA, 15 bp, Homo sapiens
gtagtttataagttc

SEQ ID NO: 197601 - DNA, 15 bp, Homo sapiens
tgtagtttataagtt

SEQ ID NO: 197602 - DNA, 15 bp, Homo sapiens
ctgtagtttataagt

SEQ ID NO: 197603 - DNA, 15 bp, Homo sapiens
actgtagtttataag

SEQ ID NO: 197604 - DNA, 15 bp, Homo sapiens
aactgtagtttataa

SEQ ID NO: 197605 - DNA, 15 bp, Homo sapiens
caactgtagtttata

SEQ ID NO: 197606 - DNA, 15 bp, Homo sapiens
ccaactgtagtttat

SEQ ID NO: 197607 - DNA, 15 bp, Homo sapiens
tccaactgtagttta

SEQ ID NO: 197608 - DNA, 15 bp, Homo sapiens
ttccaactgtagttt

SEQ ID NO: 197609 - DNA, 15 bp, Homo sapiens
attccaactgtagtt

SEQ ID NO: 197610 - DNA, 15 bp, Homo sapiens
tattccaactgtagt

SEQ ID NO: 197611 - DNA, 15 bp, Homo sapiens
atattccaactgtag

SEQ ID NO: 197612 - DNA, 15 bp, Homo sapiens
aatattccaactgta

SEQ ID NO: 197613 - DNA, 15 bp, Homo sapiens
taatattccaactgt

SEQ ID NO: 197614 - DNA, 15 bp, Homo sapiens
ataatattccaactg

SEQ ID NO: 197615 - DNA, 15 bp, Homo sapiens
cataatattccaact

SEQ ID NO: 197616 - DNA, 15 bp, Homo sapiens
acataatattccaac

SEQ ID NO: 197617 - DNA, 15 bp, Homo sapiens
tacataatattccaa

SEQ ID NO: 197618 - DNA, 15 bp, Homo sapiens
ttacataatattcca

SEQ ID NO: 197619 - DNA, 15 bp, Homo sapiens
attacataatattcc

SEQ ID NO: 197620 - DNA, 15 bp, Homo sapiens
tattacataatattc

SEQ ID NO: 197621 - DNA, 15 bp, Homo sapiens
ttattacataatatt

SEQ ID NO: 197622 - DNA, 15 bp, Homo sapiens
cttattacataatat

SEQ ID NO: 197623 - DNA, 15 bp, Homo sapiens
acttattacataata

SEQ ID NO: 197624 - DNA, 15 bp, Homo sapiens
tacttattacataat

SEQ ID NO: 197625 - DNA, 15 bp, Homo sapiens
ttacttattacataa

SEQ ID NO: 197626 - DNA, 15 bp, Homo sapiens
cttacttattacata

SEQ ID NO: 197627 - DNA, 15 bp, Homo sapiens
acttacttattacat

SEQ ID NO: 197628 - DNA, 15 bp, Homo sapiens
aacttacttattaca

SEQ ID NO: 197629 - DNA, 15 bp, Homo sapiens
taacttacttattac

SEQ ID NO: 197630 - DNA, 15 bp, Homo sapiens
ttaacttacttatta

SEQ ID NO: 197631 - DNA, 15 bp, Homo sapiens
gttaacttacttatt

SEQ ID NO: 197632 - DNA, 15 bp, Homo sapiens
tgttaacttacttat

SEQ ID NO: 197633 - DNA, 15 bp, Homo sapiens
atgttaacttactta

SEQ ID NO: 197634 - DNA, 15 bp, Homo sapiens
aatgttaacttactt

SEQ ID NO: 197635 - DNA, 15 bp, Homo sapiens
taatgttaacttact

SEQ ID NO: 197636 - DNA, 15 bp, Homo sapiens
ataatgttaacttac

SEQ ID NO: 197637 - DNA, 15 bp, Homo sapiens
aataatgttaactta

SEQ ID NO: 197638 - DNA, 15 bp, Homo sapiens
aaataatgttaactt

SEQ ID NO: 197639 - DNA, 15 bp, Homo sapiens
aaaataatgttaact

SEQ ID NO: 197640 - DNA, 15 bp, Homo sapiens
aaaaataatgttaac

SEQ ID NO: 197641 - DNA, 15 bp, Homo sapiens
taaaaataatgttaa

SEQ ID NO: 197642 - DNA, 15 bp, Homo sapiens
ctaaaaataatgtta

SEQ ID NO: 197643 - DNA, 15 bp, Homo sapiens
tctaaaaataatgtt

SEQ ID NO: 197644 - DNA, 15 bp, Homo sapiens
ttctaaaaataatgt

SEQ ID NO: 197645 - DNA, 15 bp, Homo sapiens
cttctaaaaataatg

SEQ ID NO: 197646 - DNA, 15 bp, Homo sapiens
tcttctaaaaataat

SEQ ID NO: 197647 - DNA, 15 bp, Homo sapiens
atcttctaaaaataa

SEQ ID NO: 197648 - DNA, 15 bp, Homo sapiens
catcttctaaaaata

SEQ ID NO: 197649 - DNA, 15 bp, Homo sapiens
ccatcttctaaaaat

SEQ ID NO: 197650 - DNA, 15 bp, Homo sapiens
cccatcttctaaaaa

SEQ ID NO: 197651 - DNA, 15 bp, Homo sapiens
tcccatcttctaaaa

SEQ ID NO: 197652 - DNA, 15 bp, Homo sapiens
ctcccatcttctaaa

SEQ ID NO: 197653 - DNA, 15 bp, Homo sapiens
tctcccatcttctaa

SEQ ID NO: 197654 - DNA, 15 bp, Homo sapiens
ttctcccatcttcta

SEQ ID NO: 197655 - DNA, 15 bp, Homo sapiens
attctcccatcttct

SEQ ID NO: 197656 - DNA, 15 bp, Homo sapiens
tattctcccatcttc

SEQ ID NO: 197657 - DNA, 15 bp, Homo sapiens
atattctcccatctt

SEQ ID NO: 197658 - DNA, 15 bp, Homo sapiens
catattctcccatct

SEQ ID NO: 197659 - DNA, 15 bp, Homo sapiens
gcatattctcccatc

SEQ ID NO: 197660 - DNA, 15 bp, Homo sapiens
agcatattctcccat

SEQ ID NO: 197661 - DNA, 15 bp, Homo sapiens
aagcatattctccca

SEQ ID NO: 197662 - DNA, 15 bp, Homo sapiens
caagcatattctccc

SEQ ID NO: 197663 - DNA, 15 bp, Homo sapiens
acaagcatattctcc

SEQ ID NO: 197664 - DNA, 15 bp, Homo sapiens
cacaagcatattctc

SEQ ID NO: 197665 - DNA, 15 bp, Homo sapiens
ccacaagcatattct

SEQ ID NO: 197666 - DNA, 15 bp, Homo sapiens
gccacaagcatattc

SEQ ID NO: 197667 - DNA, 15 bp, Homo sapiens
tgccacaagcatatt

SEQ ID NO: 197668 - DNA, 15 bp, Homo sapiens
ctgccacaagcatat

SEQ ID NO: 197669 - DNA, 15 bp, Homo sapiens
actgccacaagcata

SEQ ID NO: 197670 - DNA, 15 bp, Homo sapiens
cactgccacaagcat

SEQ ID NO: 197671 - DNA, 15 bp, Homo sapiens
ccactgccacaagca

SEQ ID NO: 197672 - DNA, 15 bp, Homo sapiens
tccactgccacaagc

SEQ ID NO: 197673 - DNA, 15 bp, Homo sapiens
gtccactgccacaag

SEQ ID NO: 197674 - DNA, 15 bp, Homo sapiens
agtccactgccacaa

SEQ ID NO: 197675 - DNA, 15 bp, Homo sapiens
aagtccactgccaca

SEQ ID NO: 197676 - DNA, 15 bp, Homo sapiens
aaagtccactgccac

SEQ ID NO: 197677 - DNA, 15 bp, Homo sapiens
aaaagtccactgcca

SEQ ID NO: 197678 - DNA, 15 bp, Homo sapiens
caaaagtccactgcc

SEQ ID NO: 197679 - DNA, 15 bp, Homo sapiens
gcaaaagtccactgc

SEQ ID NO: 197680 - DNA, 15 bp, Homo sapiens
tgcaaaagtccactg

SEQ ID NO: 197681 - DNA, 15 bp, Homo sapiens
atgcaaaagtccact

SEQ ID NO: 197682 - DNA, 15 bp, Homo sapiens
aatgcaaaagtccac

SEQ ID NO: 197683 - DNA, 15 bp, Homo sapiens
taatgcaaaagtcca

SEQ ID NO: 197684 - DNA, 15 bp, Homo sapiens
ttaatgcaaaagtcc

SEQ ID NO: 197685 - DNA, 15 bp, Homo sapiens
cttaatgcaaaagtc

SEQ ID NO: 197686 - DNA, 15 bp, Homo sapiens
ccttaatgcaaaagt

SEQ ID NO: 197687 - DNA, 15 bp, Homo sapiens
accttaatgcaaaag

SEQ ID NO: 197688 - DNA, 15 bp, Homo sapiens
taccttaatgcaaaa

SEQ ID NO: 197689 - DNA, 15 bp, Homo sapiens
ctaccttaatgcaaa

SEQ ID NO: 197690 - DNA, 15 bp, Homo sapiens
tctaccttaatgcaa

SEQ ID NO: 197691 - DNA, 15 bp, Homo sapiens
atctaccttaatgca

SEQ ID NO: 197692 - DNA, 15 bp, Homo sapiens
gatctaccttaatgc

SEQ ID NO: 197693 - DNA, 15 bp, Homo sapiens
tgatctaccttaatg

SEQ ID NO: 197694 - DNA, 15 bp, Homo sapiens
ctgatctaccttaat

SEQ ID NO: 197695 - DNA, 15 bp, Homo sapiens
tctgatctaccttaa

SEQ ID NO: 197696 - DNA, 15 bp, Homo sapiens
gtctgatctacctta

SEQ ID NO: 197697 - DNA, 15 bp, Homo sapiens
tgtctgatctacctt

SEQ ID NO: 197698 - DNA, 15 bp, Homo sapiens
atgtctgatctacct

SEQ ID NO: 197699 - DNA, 15 bp, Homo sapiens
aatgtctgatctacc

SEQ ID NO: 197700 - DNA, 15 bp, Homo sapiens
gaatgtctgatctac

SEQ ID NO: 197701 - DNA, 15 bp, Homo sapiens
ggaatgtctgatcta

SEQ ID NO: 197702 - DNA, 15 bp, Homo sapiens
tggaatgtctgatct

SEQ ID NO: 197703 - DNA, 15 bp, Homo sapiens
ctggaatgtctgatc

SEQ ID NO: 197704 - DNA, 15 bp, Homo sapiens
actggaatgtctgat

SEQ ID NO: 197705 - DNA, 15 bp, Homo sapiens
tactggaatgtctga

SEQ ID NO: 197706 - DNA, 15 bp, Homo sapiens
ttactggaatgtctg

SEQ ID NO: 197707 - DNA, 15 bp, Homo sapiens
tttactggaatgtct

SEQ ID NO: 197708 - DNA, 15 bp, Homo sapiens
ttttactggaatgtc

SEQ ID NO: 197709 - DNA, 15 bp, Homo sapiens
attttactggaatgt

SEQ ID NO: 197710 - DNA, 15 bp, Homo sapiens
cattttactggaatg

SEQ ID NO: 197711 - DNA, 15 bp, Homo sapiens
acattttactggaat

SEQ ID NO: 197712 - DNA, 15 bp, Homo sapiens
tacattttactggaa

SEQ ID NO: 197713 - DNA, 15 bp, Homo sapiens
ttacattttactgga

SEQ ID NO: 197714 - DNA, 15 bp, Homo sapiens
attacattttactgg

SEQ ID NO: 197715 - DNA, 15 bp, Homo sapiens
tattacattttactg

SEQ ID NO: 197716 - DNA, 15 bp, Homo sapiens
ttattacattttact

SEQ ID NO: 197717 - DNA, 15 bp, Homo sapiens
attattacattttac

SEQ ID NO: 197718 - DNA, 15 bp, Homo sapiens
tattattacatttta

SEQ ID NO: 197719 - DNA, 15 bp, Homo sapiens
ttattattacatttt

SEQ ID NO: 197720 - DNA, 15 bp, Homo sapiens
tttattattacattt

SEQ ID NO: 197721 - DNA, 15 bp, Homo sapiens
atttattattacatt

SEQ ID NO: 197722 - DNA, 15 bp, Homo sapiens
aatttattattacat

SEQ ID NO: 197723 - DNA, 15 bp, Homo sapiens
taatttattattaca

SEQ ID NO: 197724 - DNA, 15 bp, Homo sapiens
ttaatttattattac

SEQ ID NO: 197725 - DNA, 15 bp, Homo sapiens
attaatttattatta

SEQ ID NO: 197726 - DNA, 15 bp, Homo sapiens
cattaatttattatt

SEQ ID NO: 197727 - DNA, 15 bp, Homo sapiens
acattaatttattat

SEQ ID NO: 197728 - DNA, 15 bp, Homo sapiens
cacattaatttatta

SEQ ID NO: 197729 - DNA, 15 bp, Homo sapiens
tcacattaatttatt

SEQ ID NO: 197730 - DNA, 15 bp, Homo sapiens
atcacattaatttat

SEQ ID NO: 197731 - DNA, 15 bp, Homo sapiens
tatcacattaattta

SEQ ID NO: 197732 - DNA, 15 bp, Homo sapiens
ttatcacattaattt

SEQ ID NO: 197733 - DNA, 15 bp, Homo sapiens
attatcacattaatt

SEQ ID NO: 197734 - DNA, 15 bp, Homo sapiens
cattatcacattaat

SEQ ID NO: 197735 - DNA, 15 bp, Homo sapiens
tcattatcacattaa

SEQ ID NO: 197736 - DNA, 15 bp, Homo sapiens
ttcattatcacatta

SEQ ID NO: 197737 - DNA, 15 bp, Homo sapiens
attcattatcacatt

SEQ ID NO: 197738 - DNA, 15 bp, Homo sapiens
aattcattatcacat

SEQ ID NO: 197739 - DNA, 15 bp, Homo sapiens
taattcattatcaca

SEQ ID NO: 197740 - DNA, 15 bp, Homo sapiens
ttaattcattatcac

SEQ ID NO: 197741 - DNA, 15 bp, Homo sapiens
tttaattcattatca

SEQ ID NO: 197742 - DNA, 15 bp, Homo sapiens
ttttaattcattatc

SEQ ID NO: 197743 - DNA, 15 bp, Homo sapiens
attttaattcattat

SEQ ID NO: 197744 - DNA, 15 bp, Homo sapiens
tattttaattcatta

SEQ ID NO: 197745 - DNA, 15 bp, Homo sapiens
ttattttaattcatt

SEQ ID NO: 197746 - DNA, 15 bp, Homo sapiens
gttattttaattcat

SEQ ID NO: 197747 - DNA, 15 bp, Homo sapiens
agttattttaattca

SEQ ID NO: 197748 - DNA, 15 bp, Homo sapiens
aagttattttaattc

SEQ ID NO: 197749 - DNA, 15 bp, Homo sapiens
aaagttattttaatt

SEQ ID NO: 197750 - DNA, 15 bp, Homo sapiens
aaaagttattttaat

SEQ ID NO: 197751 - DNA, 15 bp, Homo sapiens
taaaagttattttaa

SEQ ID NO: 197752 - DNA, 15 bp, Homo sapiens
gtaaaagttatttta

SEQ ID NO: 197753 - DNA, 15 bp, Homo sapiens
agtaaaagttatttt

SEQ ID NO: 197754 - DNA, 15 bp, Homo sapiens
aagtaaaagttattt

SEQ ID NO: 197755 - DNA, 15 bp, Homo sapiens
aaagtaaaagttatt

SEQ ID NO: 197756 - DNA, 15 bp, Homo sapiens
caaagtaaaagttat

SEQ ID NO: 197757 - DNA, 15 bp, Homo sapiens
tcaaagtaaaagtta

SEQ ID NO: 197758 - DNA, 15 bp, Homo sapiens
atcaaagtaaaagtt

SEQ ID NO: 197759 - DNA, 15 bp, Homo sapiens
aatcaaagtaaaagt

SEQ ID NO: 197760 - DNA, 15 bp, Homo sapiens
taatcaaagtaaaag

SEQ ID NO: 197761 - DNA, 15 bp, Homo sapiens
ctaatcaaagtaaaa

SEQ ID NO: 197762 - DNA, 15 bp, Homo sapiens
actaatcaaagtaaa

SEQ ID NO: 197763 - DNA, 15 bp, Homo sapiens
gactaatcaaagtaa

SEQ ID NO: 197764 - DNA, 15 bp, Homo sapiens
tgactaatcaaagta

SEQ ID NO: 197765 - DNA, 15 bp, Homo sapiens
gtgactaatcaaagt

SEQ ID NO: 197766 - DNA, 15 bp, Homo sapiens
ggtgactaatcaaag

SEQ ID NO: 197767 - DNA, 15 bp, Homo sapiens
aggtgactaatcaaa

SEQ ID NO: 197768 - DNA, 15 bp, Homo sapiens
gaggtgactaatcaa

SEQ ID NO: 197769 - DNA, 15 bp, Homo sapiens
tgaggtgactaatca

SEQ ID NO: 197770 - DNA, 15 bp, Homo sapiens
ttgaggtgactaatc

SEQ ID NO: 197771 - DNA, 15 bp, Homo sapiens
cttgaggtgactaat

SEQ ID NO: 197772 - DNA, 15 bp, Homo sapiens
tcttgaggtgactaa

SEQ ID NO: 197773 - DNA, 15 bp, Homo sapiens
ctcttgaggtgacta

SEQ ID NO: 197774 - DNA, 15 bp, Homo sapiens
tctcttgaggtgact

SEQ ID NO: 197775 - DNA, 15 bp, Homo sapiens
atctcttgaggtgac

SEQ ID NO: 197776 - DNA, 15 bp, Homo sapiens
aatctcttgaggtga

SEQ ID NO: 197777 - DNA, 15 bp, Homo sapiens
gaatctcttgaggtg

SEQ ID NO: 197778 - DNA, 15 bp, Homo sapiens
tgaatctcttgaggt

SEQ ID NO: 197779 - DNA, 15 bp, Homo sapiens
ttgaatctcttgagg

SEQ ID NO: 197780 - DNA, 15 bp, Homo sapiens
cttgaatctcttgag

SEQ ID NO: 197781 - DNA, 15 bp, Homo sapiens
gcttgaatctcttga

SEQ ID NO: 197782 - DNA, 15 bp, Homo sapiens
tgcttgaatctcttg

SEQ ID NO: 197783 - DNA, 15 bp, Homo sapiens
gtgcttgaatctctt

SEQ ID NO: 197784 - DNA, 15 bp, Homo sapiens
agtgcttgaatctct

SEQ ID NO: 197785 - DNA, 15 bp, Homo sapiens
aagtgcttgaatctc

SEQ ID NO: 197786 - DNA, 15 bp, Homo sapiens
taagtgcttgaatct

SEQ ID NO: 197787 - DNA, 15 bp, Homo sapiens
ataagtgcttgaatc

SEQ ID NO: 197788 - DNA, 15 bp, Homo sapiens
aataagtgcttgaat

SEQ ID NO: 197789 - DNA, 15 bp, Homo sapiens
gaataagtgcttgaa

SEQ ID NO: 197790 - DNA, 15 bp, Homo sapiens
tgaataagtgcttga

SEQ ID NO: 197791 - DNA, 15 bp, Homo sapiens
ttgaataagtgcttg

SEQ ID NO: 197792 - DNA, 15 bp, Homo sapiens
cttgaataagtgctt

SEQ ID NO: 197793 - DNA, 15 bp, Homo sapiens
gcttgaataagtgct

SEQ ID NO: 197794 - DNA, 15 bp, Homo sapiens
tgcttgaataagtgc

SEQ ID NO: 197795 - DNA, 15 bp, Homo sapiens
atgcttgaataagtg

SEQ ID NO: 197796 - DNA, 15 bp, Homo sapiens
catgcttgaataagt

SEQ ID NO: 197797 - DNA, 15 bp, Homo sapiens
acatgcttgaataag

SEQ ID NO: 197798 - DNA, 15 bp, Homo sapiens
tacatgcttgaataa

SEQ ID NO: 197799 - DNA, 15 bp, Homo sapiens
ttacatgcttgaata

SEQ ID NO: 197800 - DNA, 15 bp, Homo sapiens
attacatgcttgaat

SEQ ID NO: 197801 - DNA, 15 bp, Homo sapiens
tattacatgcttgaa

SEQ ID NO: 197802 - DNA, 15 bp, Homo sapiens
ttattacatgcttga

SEQ ID NO: 197803 - DNA, 15 bp, Homo sapiens
tttattacatgcttg

SEQ ID NO: 197804 - DNA, 15 bp, Homo sapiens
ttttattacatgctt

SEQ ID NO: 197805 - DNA, 15 bp, Homo sapiens
tttttattacatgct

SEQ ID NO: 197806 - DNA, 15 bp, Homo sapiens
gtttttattacatgc

SEQ ID NO: 197807 - DNA, 15 bp, Homo sapiens
agtttttattacatg

SEQ ID NO: 197808 - DNA, 15 bp, Homo sapiens
aagtttttattacat

SEQ ID NO: 197809 - DNA, 15 bp, Homo sapiens
taagtttttattaca

SEQ ID NO: 197810 - DNA, 15 bp, Homo sapiens
ataagtttttattac

SEQ ID NO: 197811 - DNA, 15 bp, Homo sapiens
aataagtttttatta

SEQ ID NO: 197812 - DNA, 15 bp, Homo sapiens
aaataagtttttatt

SEQ ID NO: 197813 - DNA, 15 bp, Homo sapiens
gaaataagtttttat

SEQ ID NO: 197814 - DNA, 15 bp, Homo sapiens
agaaataagttttta

SEQ ID NO: 197815 - DNA, 15 bp, Homo sapiens
cagaaataagttttt

SEQ ID NO: 197816 - DNA, 15 bp, Homo sapiens
acagaaataagtttt

SEQ ID NO: 197817 - DNA, 15 bp, Homo sapiens
cacagaaataagttt

SEQ ID NO: 197818 - DNA, 15 bp, Homo sapiens
gcacagaaataagtt

SEQ ID NO: 197819 - DNA, 15 bp, Homo sapiens
agcacagaaataagt

SEQ ID NO: 197820 - DNA, 15 bp, Homo sapiens
aagcacagaaataag

SEQ ID NO: 197821 - DNA, 15 bp, Homo sapiens
taagcacagaaataa

SEQ ID NO: 197822 - DNA, 15 bp, Homo sapiens
ttaagcacagaaata

SEQ ID NO: 197823 - DNA, 15 bp, Homo sapiens
cttaagcacagaaat

SEQ ID NO: 197824 - DNA, 15 bp, Homo sapiens
ccttaagcacagaaa

SEQ ID NO: 197825 - DNA, 15 bp, Homo sapiens
gccttaagcacagaa

SEQ ID NO: 197826 - DNA, 15 bp, Homo sapiens
tgccttaagcacaga

SEQ ID NO: 197827 - DNA, 15 bp, Homo sapiens
atgccttaagcacag

SEQ ID NO: 197828 - DNA, 15 bp, Homo sapiens
aatgccttaagcaca

SEQ ID NO: 197829 - DNA, 15 bp, Homo sapiens
caatgccttaagcac

SEQ ID NO: 197830 - DNA, 15 bp, Homo sapiens
gcaatgccttaagca

SEQ ID NO: 197831 - DNA, 15 bp, Homo sapiens
agcaatgccttaagc

SEQ ID NO: 197832 - DNA, 15 bp, Homo sapiens
tagcaatgccttaag

SEQ ID NO: 197833 - DNA, 15 bp, Homo sapiens
atagcaatgccttaa

SEQ ID NO: 197834 - DNA, 15 bp, Homo sapiens
aatagcaatgcctta

SEQ ID NO: 197835 - DNA, 15 bp, Homo sapiens
taatagcaatgcctt

SEQ ID NO: 197836 - DNA, 15 bp, Homo sapiens
ttaatagcaatgcct

SEQ ID NO: 197837 - DNA, 15 bp, Homo sapiens
attaatagcaatgcc

SEQ ID NO: 197838 - DNA, 15 bp, Homo sapiens
tattaatagcaatgc

SEQ ID NO: 197839 - DNA, 15 bp, Homo sapiens
ttattaatagcaatg

SEQ ID NO: 197840 - DNA, 15 bp, Homo sapiens
cttattaatagcaat

SEQ ID NO: 197841 - DNA, 15 bp, Homo sapiens
tcttattaatagcaa

SEQ ID NO: 197842 - DNA, 15 bp, Homo sapiens
atcttattaatagca

SEQ ID NO: 197843 - DNA, 15 bp, Homo sapiens
catcttattaatagc

SEQ ID NO: 197844 - DNA, 15 bp, Homo sapiens
acatcttattaatag

SEQ ID NO: 197845 - DNA, 15 bp, Homo sapiens
tacatcttattaata

SEQ ID NO: 197846 - DNA, 15 bp, Homo sapiens
ctacatcttattaat

SEQ ID NO: 197847 - DNA, 15 bp, Homo sapiens
actacatcttattaa

SEQ ID NO: 197848 - DNA, 15 bp, Homo sapiens
gactacatcttatta

SEQ ID NO: 197849 - DNA, 15 bp, Homo sapiens
ggactacatcttatt

SEQ ID NO: 197850 - DNA, 15 bp, Homo sapiens
gggactacatcttat

SEQ ID NO: 197851 - DNA, 15 bp, Homo sapiens
agggactacatctta

SEQ ID NO: 197852 - DNA, 15 bp, Homo sapiens
tagggactacatctt

SEQ ID NO: 197853 - DNA, 15 bp, Homo sapiens
gtagggactacatct

SEQ ID NO: 197854 - DNA, 15 bp, Homo sapiens
ggtagggactacatc

SEQ ID NO: 197855 - DNA, 15 bp, Homo sapiens
gggtagggactacat

SEQ ID NO: 197856 - DNA, 15 bp, Homo sapiens
ggggtagggactaca

SEQ ID NO: 197857 - DNA, 15 bp, Homo sapiens
aggggtagggactac

SEQ ID NO: 197858 - DNA, 15 bp, Homo sapiens
taggggtagggacta

SEQ ID NO: 197859 - DNA, 15 bp, Homo sapiens
ctaggggtagggact

SEQ ID NO: 197860 - DNA, 15 bp, Homo sapiens
tctaggggtagggac

SEQ ID NO: 197861 - DNA, 15 bp, Homo sapiens
ctctaggggtaggga

SEQ ID NO: 197862 - DNA, 15 bp, Homo sapiens
cctctaggggtaggg

SEQ ID NO: 197863 - DNA, 15 bp, Homo sapiens
acctctaggggtagg

SEQ ID NO: 197864 - DNA, 15 bp, Homo sapiens
aacctctaggggtag

SEQ ID NO: 197865 - DNA, 15 bp, Homo sapiens
gaacctctaggggta

SEQ ID NO: 197866 - DNA, 15 bp, Homo sapiens
tgaacctctaggggt

SEQ ID NO: 197867 - DNA, 15 bp, Homo sapiens
gtgaacctctagggg

SEQ ID NO: 197868 - DNA, 15 bp, Homo sapiens
tgtgaacctctaggg

SEQ ID NO: 197869 - DNA, 15 bp, Homo sapiens
ttgtgaacctctagg

SEQ ID NO: 197870 - DNA, 15 bp, Homo sapiens
tttgtgaacctctag

SEQ ID NO: 197871 - DNA, 15 bp, Homo sapiens
atttgtgaacctcta

SEQ ID NO: 197872 - DNA, 15 bp, Homo sapiens
gatttgtgaacctct

SEQ ID NO: 197873 - DNA, 15 bp, Homo sapiens
agatttgtgaacctc

SEQ ID NO: 197874 - DNA, 15 bp, Homo sapiens
cagatttgtgaacct

SEQ ID NO: 197875 - DNA, 15 bp, Homo sapiens
acagatttgtgaacc

SEQ ID NO: 197876 - DNA, 15 bp, Homo sapiens
aacagatttgtgaac

SEQ ID NO: 197877 - DNA, 15 bp, Homo sapiens
aaacagatttgtgaa

SEQ ID NO: 197878 - DNA, 15 bp, Homo sapiens
taaacagatttgtga

SEQ ID NO: 197879 - DNA, 15 bp, Homo sapiens
ctaaacagatttgtg

SEQ ID NO: 197880 - DNA, 15 bp, Homo sapiens
tctaaacagatttgt

SEQ ID NO: 197881 - DNA, 15 bp, Homo sapiens
atctaaacagatttg

SEQ ID NO: 197882 - DNA, 15 bp, Homo sapiens
aatctaaacagattt

SEQ ID NO: 197883 - DNA, 15 bp, Homo sapiens
taatctaaacagatt

SEQ ID NO: 197884 - DNA, 15 bp, Homo sapiens
ttaatctaaacagat

SEQ ID NO: 197885 - DNA, 15 bp, Homo sapiens
cttaatctaaacaga

SEQ ID NO: 197886 - DNA, 15 bp, Homo sapiens
ccttaatctaaacag

SEQ ID NO: 197887 - DNA, 15 bp, Homo sapiens
accttaatctaaaca

SEQ ID NO: 197888 - DNA, 15 bp, Homo sapiens
taccttaatctaaac

SEQ ID NO: 197889 - DNA, 15 bp, Homo sapiens
ctaccttaatctaaa

SEQ ID NO: 197890 - DNA, 15 bp, Homo sapiens
cctaccttaatctaa

SEQ ID NO: 197891 - DNA, 15 bp, Homo sapiens
ccctaccttaatcta

SEQ ID NO: 197892 - DNA, 15 bp, Homo sapiens
gccctaccttaatct

SEQ ID NO: 197893 - DNA, 15 bp, Homo sapiens
ggccctaccttaatc

SEQ ID NO: 197894 - DNA, 15 bp, Homo sapiens
gggccctaccttaat

SEQ ID NO: 197895 - DNA, 15 bp, Homo sapiens
tgggccctaccttaa

SEQ ID NO: 197896 - DNA, 15 bp, Homo sapiens
ttgggccctacctta

SEQ ID NO: 197897 - DNA, 15 bp, Homo sapiens
tttgggccctacctt

SEQ ID NO: 197898 - DNA, 15 bp, Homo sapiens
ctttgggccctacct

SEQ ID NO: 197899 - DNA, 15 bp, Homo sapiens
gctttgggccctacc

SEQ ID NO: 197900 - DNA, 15 bp, Homo sapiens
tgctttgggccctac

SEQ ID NO: 197901 - DNA, 15 bp, Homo sapiens
ctgctttgggcccta

SEQ ID NO: 197902 - DNA, 15 bp, Homo sapiens
tctgctttgggccct

SEQ ID NO: 197903 - DNA, 15 bp, Homo sapiens
ctctgctttgggccc

SEQ ID NO: 197904 - DNA, 15 bp, Homo sapiens
tctctgctttgggcc

SEQ ID NO: 197905 - DNA, 15 bp, Homo sapiens
ctctctgctttgggc

SEQ ID NO: 197906 - DNA, 15 bp, Homo sapiens
actctctgctttggg

SEQ ID NO: 197907 - DNA, 15 bp, Homo sapiens
cactctctgctttgg

SEQ ID NO: 197908 - DNA, 15 bp, Homo sapiens
ccactctctgctttg

SEQ ID NO: 197909 - DNA, 15 bp, Homo sapiens
accactctctgcttt

SEQ ID NO: 197910 - DNA, 15 bp, Homo sapiens
aaccactctctgctt

SEQ ID NO: 197911 - DNA, 15 bp, Homo sapiens
taaccactctctgct

SEQ ID NO: 197912 - DNA, 15 bp, Homo sapiens
gtaaccactctctgc

SEQ ID NO: 197913 - DNA, 15 bp, Homo sapiens
agtaaccactctctg

SEQ ID NO: 197914 - DNA, 15 bp, Homo sapiens
gagtaaccactctct

SEQ ID NO: 197915 - DNA, 15 bp, Homo sapiens
agagtaaccactctc

SEQ ID NO: 197916 - DNA, 15 bp, Homo sapiens
gagagtaaccactct

SEQ ID NO: 197917 - DNA, 15 bp, Homo sapiens
tgagagtaaccactc

SEQ ID NO: 197918 - DNA, 15 bp, Homo sapiens
gtgagagtaaccact

SEQ ID NO: 197919 - DNA, 15 bp, Homo sapiens
agtgagagtaaccac

SEQ ID NO: 197920 - DNA, 15 bp, Homo sapiens
aagtgagagtaacca

SEQ ID NO: 197921 - DNA, 15 bp, Homo sapiens
gaagtgagagtaacc

SEQ ID NO: 197922 - DNA, 15 bp, Homo sapiens
tgaagtgagagtaac

SEQ ID NO: 197923 - DNA, 15 bp, Homo sapiens
ctgaagtgagagtaa

SEQ ID NO: 197924 - DNA, 15 bp, Homo sapiens
tctgaagtgagagta

SEQ ID NO: 197925 - DNA, 15 bp, Homo sapiens
atctgaagtgagagt

SEQ ID NO: 197926 - DNA, 15 bp, Homo sapiens
catctgaagtgagag

SEQ ID NO: 197927 - DNA, 15 bp, Homo sapiens
tcatctgaagtgaga

SEQ ID NO: 197928 - DNA, 15 bp, Homo sapiens
atcatctgaagtgag

SEQ ID NO: 197929 - DNA, 15 bp, Homo sapiens
gatcatctgaagtga

SEQ ID NO: 197930 - DNA, 15 bp, Homo sapiens
tgatcatctgaagtg

SEQ ID NO: 197931 - DNA, 15 bp, Homo sapiens
ttgatcatctgaagt

SEQ ID NO: 197932 - DNA, 15 bp, Homo sapiens
tttgatcatctgaag

SEQ ID NO: 197933 - DNA, 15 bp, Homo sapiens
ctttgatcatctgaa

SEQ ID NO: 197934 - DNA, 15 bp, Homo sapiens
tctttgatcatctga

SEQ ID NO: 197935 - DNA, 15 bp, Homo sapiens
ttctttgatcatctg

SEQ ID NO: 197936 - DNA, 15 bp, Homo sapiens
cttctttgatcatct

SEQ ID NO: 197937 - DNA, 15 bp, Homo sapiens
ccttctttgatcatc

SEQ ID NO: 197938 - DNA, 15 bp, Homo sapiens
gccttctttgatcat

SEQ ID NO: 197939 - DNA, 15 bp, Homo sapiens
agccttctttgatca

SEQ ID NO: 197940 - DNA, 15 bp, Homo sapiens
aagccttctttgatc

SEQ ID NO: 197941 - DNA, 15 bp, Homo sapiens
gaagccttctttgat

SEQ ID NO: 197942 - DNA, 15 bp, Homo sapiens
tgaagccttctttga

SEQ ID NO: 197943 - DNA, 15 bp, Homo sapiens
atgaagccttctttg

SEQ ID NO: 197944 - DNA, 15 bp, Homo sapiens
tatgaagccttcttt

SEQ ID NO: 197945 - DNA, 15 bp, Homo sapiens
ttatgaagccttctt

SEQ ID NO: 197946 - DNA, 15 bp, Homo sapiens
tttatgaagccttct

SEQ ID NO: 197947 - DNA, 15 bp, Homo sapiens
ttttatgaagccttc

SEQ ID NO: 197948 - DNA, 15 bp, Homo sapiens
cttttatgaagcctt

SEQ ID NO: 197949 - DNA, 15 bp, Homo sapiens
tcttttatgaagcct

SEQ ID NO: 197950 - DNA, 15 bp, Homo sapiens
ctcttttatgaagcc

SEQ ID NO: 197951 - DNA, 15 bp, Homo sapiens
cctcttttatgaagc

SEQ ID NO: 197952 - DNA, 15 bp, Homo sapiens
acctcttttatgaag

SEQ ID NO: 197953 - DNA, 15 bp, Homo sapiens
gacctcttttatgaa

SEQ ID NO: 197954 - DNA, 15 bp, Homo sapiens
tgacctcttttatga

SEQ ID NO: 197955 - DNA, 15 bp, Homo sapiens
atgacctcttttatg

SEQ ID NO: 197956 - DNA, 15 bp, Homo sapiens
aatgacctcttttat

SEQ ID NO: 197957 - DNA, 15 bp, Homo sapiens
gaatgacctctttta

SEQ ID NO: 197958 - DNA, 15 bp, Homo sapiens
ggaatgacctctttt

SEQ ID NO: 197959 - DNA, 15 bp, Homo sapiens
aggaatgacctcttt

SEQ ID NO: 197960 - DNA, 15 bp, Homo sapiens
aaggaatgacctctt

SEQ ID NO: 197961 - DNA, 15 bp, Homo sapiens
taaggaatgacctct

SEQ ID NO: 197962 - DNA, 15 bp, Homo sapiens
ctaaggaatgacctc

SEQ ID NO: 197963 - DNA, 15 bp, Homo sapiens
gctaaggaatgacct

SEQ ID NO: 197964 - DNA, 15 bp, Homo sapiens
agctaaggaatgacc

SEQ ID NO: 197965 - DNA, 15 bp, Homo sapiens
cagctaaggaatgac

SEQ ID NO: 197966 - DNA, 15 bp, Homo sapiens
tcagctaaggaatga

SEQ ID NO: 197967 - DNA, 15 bp, Homo sapiens
ctcagctaaggaatg

SEQ ID NO: 197968 - DNA, 15 bp, Homo sapiens
gctcagctaaggaat

SEQ ID NO: 197969 - DNA, 15 bp, Homo sapiens
ggctcagctaaggaa

SEQ ID NO: 197970 - DNA, 15 bp, Homo sapiens
aggctcagctaagga

SEQ ID NO: 197971 - DNA, 15 bp, Homo sapiens
aaggctcagctaagg

SEQ ID NO: 197972 - DNA, 15 bp, Homo sapiens
caaggctcagctaag

SEQ ID NO: 197973 - DNA, 15 bp, Homo sapiens
tcaaggctcagctaa

SEQ ID NO: 197974 - DNA, 15 bp, Homo sapiens
ttcaaggctcagcta

SEQ ID NO: 197975 - DNA, 15 bp, Homo sapiens
tttcaaggctcagct

SEQ ID NO: 197976 - DNA, 15 bp, Homo sapiens
gtttcaaggctcagc

SEQ ID NO: 197977 - DNA, 15 bp, Homo sapiens
tgtttcaaggctcag

SEQ ID NO: 197978 - DNA, 15 bp, Homo sapiens
atgtttcaaggctca

SEQ ID NO: 197979 - DNA, 15 bp, Homo sapiens
tatgtttcaaggctc

SEQ ID NO: 197980 - DNA, 15 bp, Homo sapiens
atatgtttcaaggct

SEQ ID NO: 197981 - DNA, 15 bp, Homo sapiens
tatatgtttcaaggc

SEQ ID NO: 197982 - DNA, 15 bp, Homo sapiens
atatatgtttcaagg

SEQ ID NO: 197983 - DNA, 15 bp, Homo sapiens
tatatatgtttcaag

SEQ ID NO: 197984 - DNA, 15 bp, Homo sapiens
ctatatatgtttcaa

SEQ ID NO: 197985 - DNA, 15 bp, Homo sapiens
actatatatgtttca

SEQ ID NO: 197986 - DNA, 15 bp, Homo sapiens
aactatatatgtttc

SEQ ID NO: 197987 - DNA, 15 bp, Homo sapiens
taactatatatgttt

SEQ ID NO: 197988 - DNA, 15 bp, Homo sapiens
ataactatatatgtt

SEQ ID NO: 197989 - DNA, 15 bp, Homo sapiens
aataactatatatgt

SEQ ID NO: 197990 - DNA, 15 bp, Homo sapiens
gaataactatatatg

SEQ ID NO: 197991 - DNA, 15 bp, Homo sapiens
ggaataactatatat

SEQ ID NO: 197992 - DNA, 15 bp, Homo sapiens
gggaataactatata

SEQ ID NO: 197993 - DNA, 15 bp, Homo sapiens
ggggaataactatat

SEQ ID NO: 197994 - DNA, 15 bp, Homo sapiens
tggggaataactata

SEQ ID NO: 197995 - DNA, 15 bp, Homo sapiens
ctggggaataactat

SEQ ID NO: 197996 - DNA, 15 bp, Homo sapiens
tctggggaataacta

SEQ ID NO: 197997 - DNA, 15 bp, Homo sapiens
atctggggaataact

SEQ ID NO: 197998 - DNA, 15 bp, Homo sapiens
tatctggggaataac

SEQ ID NO: 197999 - DNA, 15 bp, Homo sapiens
ctatctggggaataa

SEQ ID NO: 198000 - DNA, 15 bp, Homo sapiens
actatctggggaata

SEQ ID NO: 198001 - DNA, 15 bp, Homo sapiens
gactatctggggaat

SEQ ID NO: 198002 - DNA, 15 bp, Homo sapiens
agactatctggggaa

SEQ ID NO: 198003 - DNA, 15 bp, Homo sapiens
tagactatctgggga

SEQ ID NO: 198004 - DNA, 15 bp, Homo sapiens
ctagactatctgggg

SEQ ID NO: 198005 - DNA, 15 bp, Homo sapiens
cctagactatctggg

SEQ ID NO: 198006 - DNA, 15 bp, Homo sapiens
acctagactatctgg

SEQ ID NO: 198007 - DNA, 15 bp, Homo sapiens
cacctagactatctg

SEQ ID NO: 198008 - DNA, 15 bp, Homo sapiens
tcacctagactatct

SEQ ID NO: 198009 - DNA, 15 bp, Homo sapiens
atcacctagactatc

SEQ ID NO: 198010 - DNA, 15 bp, Homo sapiens
catcacctagactat

SEQ ID NO: 198011 - DNA, 15 bp, Homo sapiens
tcatcacctagacta

SEQ ID NO: 198012 - DNA, 15 bp, Homo sapiens
gtcatcacctagact

SEQ ID NO: 198013 - DNA, 15 bp, Homo sapiens
agtcatcacctagac

SEQ ID NO: 198014 - DNA, 15 bp, Homo sapiens
cagtcatcacctaga

SEQ ID NO: 198015 - DNA, 15 bp, Homo sapiens
ccagtcatcacctag

SEQ ID NO: 198016 - DNA, 15 bp, Homo sapiens
cccagtcatcaccta

SEQ ID NO: 198017 - DNA, 15 bp, Homo sapiens
ccccagtcatcacct

SEQ ID NO: 198018 - DNA, 15 bp, Homo sapiens
tccccagtcatcacc

SEQ ID NO: 198019 - DNA, 15 bp, Homo sapiens
ttccccagtcatcac

SEQ ID NO: 198020 - DNA, 15 bp, Homo sapiens
cttccccagtcatca

SEQ ID NO: 198021 - DNA, 15 bp, Homo sapiens
ccttccccagtcatc

SEQ ID NO: 198022 - DNA, 15 bp, Homo sapiens
cccttccccagtcat

SEQ ID NO: 198023 - DNA, 15 bp, Homo sapiens
acccttccccagtca

SEQ ID NO: 198024 - DNA, 15 bp, Homo sapiens
tacccttccccagtc

SEQ ID NO: 198025 - DNA, 15 bp, Homo sapiens
ttacccttccccagt

SEQ ID NO: 198026 - DNA, 15 bp, Homo sapiens
gttacccttccccag

SEQ ID NO: 198027 - DNA, 15 bp, Homo sapiens
agttacccttcccca

SEQ ID NO: 198028 - DNA, 15 bp, Homo sapiens
tagttacccttcccc

SEQ ID NO: 198029 - DNA, 15 bp, Homo sapiens
ttagttacccttccc

SEQ ID NO: 198030 - DNA, 15 bp, Homo sapiens
cttagttacccttcc

SEQ ID NO: 198031 - DNA, 15 bp, Homo sapiens
acttagttacccttc

SEQ ID NO: 198032 - DNA, 15 bp, Homo sapiens
aacttagttaccctt

SEQ ID NO: 198033 - DNA, 15 bp, Homo sapiens
taacttagttaccct

SEQ ID NO: 198034 - DNA, 15 bp, Homo sapiens
ctaacttagttaccc

SEQ ID NO: 198035 - DNA, 15 bp, Homo sapiens
cctaacttagttacc

SEQ ID NO: 198036 - DNA, 15 bp, Homo sapiens
ccctaacttagttac

SEQ ID NO: 198037 - DNA, 15 bp, Homo sapiens
cccctaacttagtta

SEQ ID NO: 198038 - DNA, 15 bp, Homo sapiens
gcccctaacttagtt

SEQ ID NO: 198039 - DNA, 15 bp, Homo sapiens
agcccctaacttagt

SEQ ID NO: 198040 - DNA, 15 bp, Homo sapiens
aagcccctaacttag

SEQ ID NO: 198041 - DNA, 15 bp, Homo sapiens
caagcccctaactta

SEQ ID NO: 198042 - DNA, 15 bp, Homo sapiens
tcaagcccctaactt

SEQ ID NO: 198043 - DNA, 15 bp, Homo sapiens
ttcaagcccctaact

SEQ ID NO: 198044 - DNA, 15 bp, Homo sapiens
tttcaagcccctaac

SEQ ID NO: 198045 - DNA, 15 bp, Homo sapiens
atttcaagcccctaa

SEQ ID NO: 198046 - DNA, 15 bp, Homo sapiens
tatttcaagccccta

SEQ ID NO: 198047 - DNA, 15 bp, Homo sapiens
ttatttcaagcccct

SEQ ID NO: 198048 - DNA, 15 bp, Homo sapiens
gttatttcaagcccc

SEQ ID NO: 198049 - DNA, 15 bp, Homo sapiens
tgttatttcaagccc

SEQ ID NO: 198050 - DNA, 15 bp, Homo sapiens
gtgttatttcaagcc

SEQ ID NO: 198051 - DNA, 15 bp, Homo sapiens
agtgttatttcaagc

SEQ ID NO: 198052 - DNA, 15 bp, Homo sapiens
cagtgttatttcaag

SEQ ID NO: 198053 - DNA, 15 bp, Homo sapiens
acagtgttatttcaa

SEQ ID NO: 198054 - DNA, 15 bp, Homo sapiens
cacagtgttatttca

SEQ ID NO: 198055 - DNA, 15 bp, Homo sapiens
acacagtgttatttc

SEQ ID NO: 198056 - DNA, 15 bp, Homo sapiens
aacacagtgttattt

SEQ ID NO: 198057 - DNA, 15 bp, Homo sapiens
caacacagtgttatt

SEQ ID NO: 198058 - DNA, 15 bp, Homo sapiens
tcaacacagtgttat

SEQ ID NO: 198059 - DNA, 15 bp, Homo sapiens
atcaacacagtgtta

SEQ ID NO: 198060 - DNA, 15 bp, Homo sapiens
tatcaacacagtgtt

SEQ ID NO: 198061 - DNA, 15 bp, Homo sapiens
atatcaacacagtgt

SEQ ID NO: 198062 - DNA, 15 bp, Homo sapiens
catatcaacacagtg

SEQ ID NO: 198063 - DNA, 15 bp, Homo sapiens
tcatatcaacacagt

SEQ ID NO: 198064 - DNA, 15 bp, Homo sapiens
atctgtgtcatctga

SEQ ID NO: 198065 - DNA, 15 bp, Homo sapiens
tatctgtgtcatctg

SEQ ID NO: 198066 - DNA, 15 bp, Homo sapiens
gtatctgtgtcatct

SEQ ID NO: 198067 - DNA, 15 bp, Homo sapiens
ggtatctgtgtcatc

SEQ ID NO: 198068 - DNA, 15 bp, Homo sapiens
aggtatctgtgtcat

SEQ ID NO: 198069 - DNA, 15 bp, Homo sapiens
gaggtatctgtgtca

SEQ ID NO: 198070 - DNA, 15 bp, Homo sapiens
agaggtatctgtgtc

SEQ ID NO: 198071 - DNA, 15 bp, Homo sapiens
aagaggtatctgtgt

SEQ ID NO: 198072 - DNA, 15 bp, Homo sapiens
aaagaggtatctgtg

SEQ ID NO: 198073 - DNA, 15 bp, Homo sapiens
gaaagaggtatctgt

SEQ ID NO: 198074 - DNA, 15 bp, Homo sapiens
ggaaagaggtatctg

SEQ ID NO: 198075 - DNA, 15 bp, Homo sapiens
tggaaagaggtatct

SEQ ID NO: 198076 - DNA, 15 bp, Homo sapiens
atggaaagaggtatc

SEQ ID NO: 198077 - DNA, 15 bp, Homo sapiens
gatggaaagaggtat

SEQ ID NO: 198078 - DNA, 15 bp, Homo sapiens
agatggaaagaggta

SEQ ID NO: 198079 - DNA, 15 bp, Homo sapiens
cagatggaaagaggt

SEQ ID NO: 198080 - DNA, 15 bp, Homo sapiens
acagatggaaagagg

SEQ ID NO: 198081 - DNA, 15 bp, Homo sapiens
tacagatggaaagag

SEQ ID NO: 198082 - DNA, 15 bp, Homo sapiens
ctacagatggaaaga

SEQ ID NO: 198083 - DNA, 15 bp, Homo sapiens
cctacagatggaaag

SEQ ID NO: 198084 - DNA, 15 bp, Homo sapiens
tcctacagatggaaa

SEQ ID NO: 198085 - DNA, 15 bp, Homo sapiens
ttcctacagatggaa

SEQ ID NO: 198086 - DNA, 15 bp, Homo sapiens
attcctacagatgga

SEQ ID NO: 198087 - DNA, 15 bp, Homo sapiens
cattcctacagatgg

SEQ ID NO: 198088 - DNA, 15 bp, Homo sapiens
gcattcctacagatg

SEQ ID NO: 198089 - DNA, 15 bp, Homo sapiens
agcattcctacagat

SEQ ID NO: 198090 - DNA, 15 bp, Homo sapiens
cagcattcctacaga

SEQ ID NO: 198091 - DNA, 15 bp, Homo sapiens
tcagcattcctacag

SEQ ID NO: 198092 - DNA, 15 bp, Homo sapiens
atcagcattcctaca

SEQ ID NO: 198093 - DNA, 15 bp, Homo sapiens
catcagcattcctac

SEQ ID NO: 198094 - DNA, 15 bp, Homo sapiens
acatcagcattccta

SEQ ID NO: 198095 - DNA, 15 bp, Homo sapiens
aacatcagcattcct

SEQ ID NO: 198096 - DNA, 15 bp, Homo sapiens
taacatcagcattcc

SEQ ID NO: 198097 - DNA, 15 bp, Homo sapiens
gtaacatcagcattc

SEQ ID NO: 198098 - DNA, 15 bp, Homo sapiens
tgtaacatcagcatt

SEQ ID NO: 198099 - DNA, 15 bp, Homo sapiens
atgtaacatcagcat

SEQ ID NO: 198100 - DNA, 15 bp, Homo sapiens
tatgtaacatcagca

SEQ ID NO: 198101 - DNA, 15 bp, Homo sapiens
atatgtaacatcagc

SEQ ID NO: 198102 - DNA, 15 bp, Homo sapiens
tatatgtaacatcag

SEQ ID NO: 198103 - DNA, 15 bp, Homo sapiens
ctatatgtaacatca

SEQ ID NO: 198104 - DNA, 15 bp, Homo sapiens
tctatatgtaacatc

SEQ ID NO: 198105 - DNA, 15 bp, Homo sapiens
ctctatatgtaacat

SEQ ID NO: 198106 - DNA, 15 bp, Homo sapiens
tctctatatgtaaca

SEQ ID NO: 198107 - DNA, 15 bp, Homo sapiens
ctctctatatgtaac

SEQ ID NO: 198108 - DNA, 15 bp, Homo sapiens
cctctctatatgtaa

SEQ ID NO: 198109 - DNA, 15 bp, Homo sapiens
ccctctctatatgta

SEQ ID NO: 198110 - DNA, 15 bp, Homo sapiens
tccctctctatatgt

SEQ ID NO: 198111 - DNA, 15 bp, Homo sapiens
gtccctctctatatg

SEQ ID NO: 198112 - DNA, 15 bp, Homo sapiens
agtccctctctatat

SEQ ID NO: 198113 - DNA, 15 bp, Homo sapiens
cagtccctctctata

SEQ ID NO: 198114 - DNA, 15 bp, Homo sapiens
acagtccctctctat

SEQ ID NO: 198115 - DNA, 15 bp, Homo sapiens
cacagtccctctcta

SEQ ID NO: 198116 - DNA, 15 bp, Homo sapiens
tcacagtccctctct

SEQ ID NO: 198117 - DNA, 15 bp, Homo sapiens
gtcacagtccctctc

SEQ ID NO: 198118 - DNA, 15 bp, Homo sapiens
agtcacagtccctct

SEQ ID NO: 198119 - DNA, 15 bp, Homo sapiens
gagtcacagtccctc

SEQ ID NO: 198120 - DNA, 15 bp, Homo sapiens
agagtcacagtccct

SEQ ID NO: 198121 - DNA, 15 bp, Homo sapiens
tagagtcacagtccc

SEQ ID NO: 198122 - DNA, 15 bp, Homo sapiens
gtagagtcacagtcc

SEQ ID NO: 198123 - DNA, 15 bp, Homo sapiens
ggtagagtcacagtc

SEQ ID NO: 198124 - DNA, 15 bp, Homo sapiens
gggtagagtcacagt

SEQ ID NO: 198125 - DNA, 15 bp, Homo sapiens
ggggtagagtcacag

SEQ ID NO: 198126 - DNA, 15 bp, Homo sapiens
aggggtagagtcaca

SEQ ID NO: 198127 - DNA, 15 bp, Homo sapiens
gaggggtagagtcac

SEQ ID NO: 198128 - DNA, 15 bp, Homo sapiens
tgaggggtagagtca

SEQ ID NO: 198129 - DNA, 15 bp, Homo sapiens
atgaggggtagagtc

SEQ ID NO: 198130 - DNA, 15 bp, Homo sapiens
catgaggggtagagt

SEQ ID NO: 198131 - DNA, 15 bp, Homo sapiens
acatgaggggtagag

SEQ ID NO: 198132 - DNA, 15 bp, Homo sapiens
tacatgaggggtaga

SEQ ID NO: 198133 - DNA, 15 bp, Homo sapiens
ttacatgaggggtag

SEQ ID NO: 198134 - DNA, 15 bp, Homo sapiens
cttacatgaggggta

SEQ ID NO: 198135 - DNA, 15 bp, Homo sapiens
gcttacatgaggggt

SEQ ID NO: 198136 - DNA, 15 bp, Homo sapiens
ggcttacatgagggg

SEQ ID NO: 198137 - DNA, 15 bp, Homo sapiens
aggcttacatgaggg

SEQ ID NO: 198138 - DNA, 15 bp, Homo sapiens
caggcttacatgagg

SEQ ID NO: 198139 - DNA, 15 bp, Homo sapiens
tcaggcttacatgag

SEQ ID NO: 198140 - DNA, 15 bp, Homo sapiens
ttcaggcttacatga

SEQ ID NO: 198141 - DNA, 15 bp, Homo sapiens
gttcaggcttacatg

SEQ ID NO: 198142 - DNA, 15 bp, Homo sapiens
ggttcaggcttacat

SEQ ID NO: 198143 - DNA, 15 bp, Homo sapiens
aggttcaggcttaca

SEQ ID NO: 198144 - DNA, 15 bp, Homo sapiens
caggttcaggcttac

SEQ ID NO: 198145 - DNA, 15 bp, Homo sapiens
ccaggttcaggctta

SEQ ID NO: 198146 - DNA, 15 bp, Homo sapiens
tccaggttcaggctt

SEQ ID NO: 198147 - DNA, 15 bp, Homo sapiens
ttccaggttcaggct

SEQ ID NO: 198148 - DNA, 15 bp, Homo sapiens
cttccaggttcaggc

SEQ ID NO: 198149 - DNA, 15 bp, Homo sapiens
ccttccaggttcagg

SEQ ID NO: 198150 - DNA, 15 bp, Homo sapiens
accttccaggttcag

SEQ ID NO: 198151 - DNA, 15 bp, Homo sapiens
taccttccaggttca

SEQ ID NO: 198152 - DNA, 15 bp, Homo sapiens
gtaccttccaggttc

SEQ ID NO: 198153 - DNA, 15 bp, Homo sapiens
agtaccttccaggtt

SEQ ID NO: 198154 - DNA, 15 bp, Homo sapiens
aagtaccttccaggt

SEQ ID NO: 198155 - DNA, 15 bp, Homo sapiens
gaagtaccttccagg

SEQ ID NO: 198156 - DNA, 15 bp, Homo sapiens
agaagtaccttccag

SEQ ID NO: 198157 - DNA, 15 bp, Homo sapiens
gagaagtaccttcca

SEQ ID NO: 198158 - DNA, 15 bp, Homo sapiens
agagaagtaccttcc

SEQ ID NO: 198159 - DNA, 15 bp, Homo sapiens
aagagaagtaccttc

SEQ ID NO: 198160 - DNA, 15 bp, Homo sapiens
caagagaagtacctt

SEQ ID NO: 198161 - DNA, 15 bp, Homo sapiens
acaagagaagtacct

SEQ ID NO: 198162 - DNA, 15 bp, Homo sapiens
cacaagagaagtacc

SEQ ID NO: 198163 - DNA, 15 bp, Homo sapiens
ccacaagagaagtac

SEQ ID NO: 198164 - DNA, 15 bp, Homo sapiens
cccacaagagaagta

SEQ ID NO: 198165 - DNA, 15 bp, Homo sapiens
ccccacaagagaagt

SEQ ID NO: 198166 - DNA, 15 bp, Homo sapiens
tccccacaagagaag

SEQ ID NO: 198167 - DNA, 15 bp, Homo sapiens
atccccacaagagaa

SEQ ID NO: 198168 - DNA, 15 bp, Homo sapiens
catccccacaagaga

SEQ ID NO: 198169 - DNA, 15 bp, Homo sapiens
gcatccccacaagag

SEQ ID NO: 198170 - DNA, 15 bp, Homo sapiens
tgcatccccacaaga

SEQ ID NO: 198171 - DNA, 15 bp, Homo sapiens
ctgcatccccacaag

SEQ ID NO: 198172 - DNA, 15 bp, Homo sapiens
actgcatccccacaa

SEQ ID NO: 198173 - DNA, 15 bp, Homo sapiens
gactgcatccccaca

SEQ ID NO: 198174 - DNA, 15 bp, Homo sapiens
tgactgcatccccac

SEQ ID NO: 198175 - DNA, 15 bp, Homo sapiens
gtgactgcatcccca

SEQ ID NO: 198176 - DNA, 15 bp, Homo sapiens
ggtgactgcatcccc

SEQ ID NO: 198177 - DNA, 15 bp, Homo sapiens
gggtgactgcatccc

SEQ ID NO: 198178 - DNA, 15 bp, Homo sapiens
ggggtgactgcatcc

SEQ ID NO: 198179 - DNA, 15 bp, Homo sapiens
tggggtgactgcatc

SEQ ID NO: 198180 - DNA, 15 bp, Homo sapiens
gtggggtgactgcat

SEQ ID NO: 198181 - DNA, 15 bp, Homo sapiens
agtggggtgactgca

SEQ ID NO: 198182 - DNA, 15 bp, Homo sapiens
cagtggggtgactgc

SEQ ID NO: 198183 - DNA, 15 bp, Homo sapiens
acagtggggtgactg

SEQ ID NO: 198184 - DNA, 15 bp, Homo sapiens
aacagtggggtgact

SEQ ID NO: 198185 - DNA, 15 bp, Homo sapiens
gaacagtggggtgac

SEQ ID NO: 198186 - DNA, 15 bp, Homo sapiens
agaacagtggggtga

SEQ ID NO: 198187 - DNA, 15 bp, Homo sapiens
tagaacagtggggtg

SEQ ID NO: 198188 - DNA, 15 bp, Homo sapiens
ctagaacagtggggt

SEQ ID NO: 198189 - DNA, 15 bp, Homo sapiens
tctagaacagtgggg

SEQ ID NO: 198190 - DNA, 15 bp, Homo sapiens
ttctagaacagtggg

SEQ ID NO: 198191 - DNA, 15 bp, Homo sapiens
attctagaacagtgg

SEQ ID NO: 198192 - DNA, 15 bp, Homo sapiens
cattctagaacagtg

SEQ ID NO: 198193 - DNA, 15 bp, Homo sapiens
ccattctagaacagt

SEQ ID NO: 198194 - DNA, 15 bp, Homo sapiens
gccattctagaacag

SEQ ID NO: 198195 - DNA, 15 bp, Homo sapiens
agccattctagaaca

SEQ ID NO: 198196 - DNA, 15 bp, Homo sapiens
cagccattctagaac

SEQ ID NO: 198197 - DNA, 15 bp, Homo sapiens
acagccattctagaa

SEQ ID NO: 198198 - DNA, 15 bp, Homo sapiens
gacagccattctaga

SEQ ID NO: 198199 - DNA, 15 bp, Homo sapiens
agacagccattctag

SEQ ID NO: 198200 - DNA, 15 bp, Homo sapiens
tagacagccattcta

SEQ ID NO: 198201 - DNA, 15 bp, Homo sapiens
gtagacagccattct

SEQ ID NO: 198202 - DNA, 15 bp, Homo sapiens
tgtagacagccattc

SEQ ID NO: 198203 - DNA, 15 bp, Homo sapiens
ctgtagacagccatt

SEQ ID NO: 198204 - DNA, 15 bp, Homo sapiens
cctgtagacagccat

SEQ ID NO: 198205 - DNA, 15 bp, Homo sapiens
acctgtagacagcca

SEQ ID NO: 198206 - DNA, 15 bp, Homo sapiens
cacctgtagacagcc

SEQ ID NO: 198207 - DNA, 15 bp, Homo sapiens
gcacctgtagacagc

SEQ ID NO: 198208 - DNA, 15 bp, Homo sapiens
tgcacctgtagacag

SEQ ID NO: 198209 - DNA, 15 bp, Homo sapiens
gtgcacctgtagaca

SEQ ID NO: 198210 - DNA, 15 bp, Homo sapiens
ggtgcacctgtagac

SEQ ID NO: 198211 - DNA, 15 bp, Homo sapiens
gggtgcacctgtaga

SEQ ID NO: 198212 - DNA, 15 bp, Homo sapiens
tgggtgcacctgtag

SEQ ID NO: 198213 - DNA, 15 bp, Homo sapiens
gtgggtgcacctgta

SEQ ID NO: 198214 - DNA, 15 bp, Homo sapiens
cgtgggtgcacctgt

SEQ ID NO: 198215 - DNA, 15 bp, Homo sapiens
gcgtgggtgcacctg

SEQ ID NO: 198216 - DNA, 15 bp, Homo sapiens
ggcgtgggtgcacct

SEQ ID NO: 198217 - DNA, 15 bp, Homo sapiens
tggcgtgggtgcacc

SEQ ID NO: 198218 - DNA, 15 bp, Homo sapiens
ttggcgtgggtgcac

SEQ ID NO: 198219 - DNA, 15 bp, Homo sapiens
cttggcgtgggtgca

SEQ ID NO: 198220 - DNA, 15 bp, Homo sapiens
gcttggcgtgggtgc

SEQ ID NO: 198221 - DNA, 15 bp, Homo sapiens
agcttggcgtgggtg

SEQ ID NO: 198222 - DNA, 15 bp, Homo sapiens
gagcttggcgtgggt

SEQ ID NO: 198223 - DNA, 15 bp, Homo sapiens
ggagcttggcgtggg

SEQ ID NO: 198224 - DNA, 15 bp, Homo sapiens
aggagcttggcgtgg

SEQ ID NO: 198225 - DNA, 15 bp, Homo sapiens
caggagcttggcgtg

SEQ ID NO: 198226 - DNA, 15 bp, Homo sapiens
acaggagcttggcgt

SEQ ID NO: 198227 - DNA, 15 bp, Homo sapiens
cacaggagcttggcg

SEQ ID NO: 198228 - DNA, 15 bp, Homo sapiens
ccacaggagcttggc

SEQ ID NO: 198229 - DNA, 15 bp, Homo sapiens
cccacaggagcttgg

SEQ ID NO: 198230 - DNA, 15 bp, Homo sapiens
tcccacaggagcttg

SEQ ID NO: 198231 - DNA, 15 bp, Homo sapiens
ctcccacaggagctt

SEQ ID NO: 198232 - DNA, 15 bp, Homo sapiens
gctcccacaggagct

SEQ ID NO: 198233 - DNA, 15 bp, Homo sapiens
tgctcccacaggagc

SEQ ID NO: 198234 - DNA, 15 bp, Homo sapiens
ctgctcccacaggag

SEQ ID NO: 198235 - DNA, 15 bp, Homo sapiens
gctgctcccacagga

SEQ ID NO: 198236 - DNA, 15 bp, Homo sapiens
ggctgctcccacagg

SEQ ID NO: 198237 - DNA, 15 bp, Homo sapiens
gggctgctcccacag

SEQ ID NO: 198238 - DNA, 15 bp, Homo sapiens
ggggctgctcccaca

SEQ ID NO: 198239 - DNA, 15 bp, Homo sapiens
tggggctgctcccac

SEQ ID NO: 198240 - DNA, 15 bp, Homo sapiens
ctggggctgctccca

SEQ ID NO: 198241 - DNA, 15 bp, Homo sapiens
cctggggctgctccc

SEQ ID NO: 198242 - DNA, 15 bp, Homo sapiens
acctggggctgctcc

SEQ ID NO: 198243 - DNA, 15 bp, Homo sapiens
cacctggggctgctc

SEQ ID NO: 198244 - DNA, 15 bp, Homo sapiens
acacctggggctgct

SEQ ID NO: 198245 - DNA, 15 bp, Homo sapiens
cacacctggggctgc

SEQ ID NO: 198246 - DNA, 15 bp, Homo sapiens
acacacctggggctg

SEQ ID NO: 198247 - DNA, 15 bp, Homo sapiens
gacacacctggggct

SEQ ID NO: 198248 - DNA, 15 bp, Homo sapiens
agacacacctggggc

SEQ ID NO: 198249 - DNA, 15 bp, Homo sapiens
cagacacacctgggg

SEQ ID NO: 198250 - DNA, 15 bp, Homo sapiens
gcagacacacctggg

SEQ ID NO: 198251 - DNA, 15 bp, Homo sapiens
tgcagacacacctgg

SEQ ID NO: 198252 - DNA, 15 bp, Homo sapiens
ttgcagacacacctg

SEQ ID NO: 198253 - DNA, 15 bp, Homo sapiens
attgcagacacacct

SEQ ID NO: 198254 - DNA, 15 bp, Homo sapiens
cattgcagacacacc

SEQ ID NO: 198255 - DNA, 15 bp, Homo sapiens
ccattgcagacacac

SEQ ID NO: 198256 - DNA, 15 bp, Homo sapiens
accattgcagacaca

SEQ ID NO: 198257 - DNA, 15 bp, Homo sapiens
caccattgcagacac

SEQ ID NO: 198258 - DNA, 15 bp, Homo sapiens
ccaccattgcagaca

SEQ ID NO: 198259 - DNA, 15 bp, Homo sapiens
cccaccattgcagac

SEQ ID NO: 198260 - DNA, 15 bp, Homo sapiens
acccaccattgcaga

SEQ ID NO: 198261 - DNA, 15 bp, Homo sapiens
cacccaccattgcag

SEQ ID NO: 198262 - DNA, 15 bp, Homo sapiens
tcacccaccattgca

SEQ ID NO: 198263 - DNA, 15 bp, Homo sapiens
ttcacccaccattgc

SEQ ID NO: 198264 - DNA, 15 bp, Homo sapiens
cttcacccaccattg

SEQ ID NO: 198265 - DNA, 15 bp, Homo sapiens
ccttcacccaccatt

SEQ ID NO: 198266 - DNA, 15 bp, Homo sapiens
tccttcacccaccat

SEQ ID NO: 198267 - DNA, 15 bp, Homo sapiens
ctccttcacccacca

SEQ ID NO: 198268 - DNA, 15 bp, Homo sapiens
tctccttcacccacc

SEQ ID NO: 198269 - DNA, 15 bp, Homo sapiens
ctctccttcacccac

SEQ ID NO: 198270 - DNA, 15 bp, Homo sapiens
tctctccttcaccca

SEQ ID NO: 198271 - DNA, 15 bp, Homo sapiens
ttctctccttcaccc

SEQ ID NO: 198272 - DNA, 15 bp, Homo sapiens
cttctctccttcacc

SEQ ID NO: 198273 - DNA, 15 bp, Homo sapiens
acttctctccttcac

SEQ ID NO: 198274 - DNA, 15 bp, Homo sapiens
gacttctctccttca

SEQ ID NO: 198275 - DNA, 15 bp, Homo sapiens
ggacttctctccttc

SEQ ID NO: 198276 - DNA, 15 bp, Homo sapiens
gggacttctctcctt

SEQ ID NO: 198277 - DNA, 15 bp, Homo sapiens
ggggacttctctcct

SEQ ID NO: 198278 - DNA, 15 bp, Homo sapiens
aggggacttctctcc

SEQ ID NO: 198279 - DNA, 15 bp, Homo sapiens
gaggggacttctctc

SEQ ID NO: 198280 - DNA, 15 bp, Homo sapiens
ggaggggacttctct

SEQ ID NO: 198281 - DNA, 15 bp, Homo sapiens
aggaggggacttctc

SEQ ID NO: 198282 - DNA, 15 bp, Homo sapiens
gaggaggggacttct

SEQ ID NO: 198283 - DNA, 15 bp, Homo sapiens
ggaggaggggacttc

SEQ ID NO: 198284 - DNA, 15 bp, Homo sapiens
tggaggaggggactt

SEQ ID NO: 198285 - DNA, 15 bp, Homo sapiens
ttggaggaggggact

SEQ ID NO: 198286 - DNA, 15 bp, Homo sapiens
cttggaggaggggac

SEQ ID NO: 198287 - DNA, 15 bp, Homo sapiens
tcttggaggagggga

SEQ ID NO: 198288 - DNA, 15 bp, Homo sapiens
gtcttggaggagggg

SEQ ID NO: 198289 - DNA, 15 bp, Homo sapiens
ggtcttggaggaggg

SEQ ID NO: 198290 - DNA, 15 bp, Homo sapiens
gggtcttggaggagg

SEQ ID NO: 198291 - DNA, 15 bp, Homo sapiens
agggtcttggaggag

SEQ ID NO: 198292 - DNA, 15 bp, Homo sapiens
aagggtcttggagga

SEQ ID NO: 198293 - DNA, 15 bp, Homo sapiens
gaagggtcttggagg

SEQ ID NO: 198294 - DNA, 15 bp, Homo sapiens
tgaagggtcttggag

SEQ ID NO: 198295 - DNA, 15 bp, Homo sapiens
ctgaagggtcttgga

SEQ ID NO: 198296 - DNA, 15 bp, Homo sapiens
cctgaagggtcttgg

SEQ ID NO: 198297 - DNA, 15 bp, Homo sapiens
tcctgaagggtcttg

SEQ ID NO: 198298 - DNA, 15 bp, Homo sapiens
ctcctgaagggtctt

SEQ ID NO: 198299 - DNA, 15 bp, Homo sapiens
gctcctgaagggtct

SEQ ID NO: 198300 - DNA, 15 bp, Homo sapiens
tgctcctgaagggtc

SEQ ID NO: 198301 - DNA, 15 bp, Homo sapiens
gtgctcctgaagggt

SEQ ID NO: 198302 - DNA, 15 bp, Homo sapiens
ggtgctcctgaaggg

SEQ ID NO: 198303 - DNA, 15 bp, Homo sapiens
tggtgctcctgaagg

SEQ ID NO: 198304 - DNA, 15 bp, Homo sapiens
ctggtgctcctgaag

SEQ ID NO: 198305 - DNA, 15 bp, Homo sapiens
cctggtgctcctgaa

SEQ ID NO: 198306 - DNA, 15 bp, Homo sapiens
ccctggtgctcctga

SEQ ID NO: 198307 - DNA, 15 bp, Homo sapiens
gccctggtgctcctg

SEQ ID NO: 198308 - DNA, 15 bp, Homo sapiens
agccctggtgctcct

SEQ ID NO: 198309 - DNA, 15 bp, Homo sapiens
cagccctggtgctcc

SEQ ID NO: 198310 - DNA, 15 bp, Homo sapiens
gcagccctggtgctc

SEQ ID NO: 198311 - DNA, 15 bp, Homo sapiens
ggcagccctggtgct

SEQ ID NO: 198312 - DNA, 15 bp, Homo sapiens
aggcagccctggtgc

SEQ ID NO: 198313 - DNA, 15 bp, Homo sapiens
caggcagccctggtg

SEQ ID NO: 198314 - DNA, 15 bp, Homo sapiens
tcaggcagccctggt

SEQ ID NO: 198315 - DNA, 15 bp, Homo sapiens
gtcaggcagccctgg

SEQ ID NO: 198316 - DNA, 15 bp, Homo sapiens
agtcaggcagccctg

SEQ ID NO: 198317 - DNA, 15 bp, Homo sapiens
gagtcaggcagccct

SEQ ID NO: 198318 - DNA, 15 bp, Homo sapiens
agagtcaggcagccc

SEQ ID NO: 198319 - DNA, 15 bp, Homo sapiens
aagagtcaggcagcc

SEQ ID NO: 198320 - DNA, 15 bp, Homo sapiens
caagagtcaggcagc

SEQ ID NO: 198321 - DNA, 15 bp, Homo sapiens
ccaagagtcaggcag

SEQ ID NO: 198322 - DNA, 15 bp, Homo sapiens
cccaagagtcaggca

SEQ ID NO: 198323 - DNA, 15 bp, Homo sapiens
ccccaagagtcaggc

SEQ ID NO: 198324 - DNA, 15 bp, Homo sapiens
gccccaagagtcagg

SEQ ID NO: 198325 - DNA, 15 bp, Homo sapiens
tgccccaagagtcag

SEQ ID NO: 198326 - DNA, 15 bp, Homo sapiens
ctgccccaagagtca

SEQ ID NO: 198327 - DNA, 15 bp, Homo sapiens
tctgccccaagagtc

SEQ ID NO: 198328 - DNA, 15 bp, Homo sapiens
ctctgccccaagagt

SEQ ID NO: 198329 - DNA, 15 bp, Homo sapiens
gctctgccccaagag

SEQ ID NO: 198330 - DNA, 15 bp, Homo sapiens
agctctgccccaaga

SEQ ID NO: 198331 - DNA, 15 bp, Homo sapiens
cagctctgccccaag

SEQ ID NO: 198332 - DNA, 15 bp, Homo sapiens
gcagctctgccccaa

SEQ ID NO: 198333 - DNA, 15 bp, Homo sapiens
tgcagctctgcccca

SEQ ID NO: 198334 - DNA, 15 bp, Homo sapiens
ctgcagctctgcccc

SEQ ID NO: 198335 - DNA, 15 bp, Homo sapiens
tctgcagctctgccc

SEQ ID NO: 198336 - DNA, 15 bp, Homo sapiens
gtctgcagctctgcc

SEQ ID NO: 198337 - DNA, 15 bp, Homo sapiens
agtctgcagctctgc

SEQ ID NO: 198338 - DNA, 15 bp, Homo sapiens
aagtctgcagctctg

SEQ ID NO: 198339 - DNA, 15 bp, Homo sapiens
aaagtctgcagctct

SEQ ID NO: 198340 - DNA, 15 bp, Homo sapiens
gaaagtctgcagctc

SEQ ID NO: 198341 - DNA, 15 bp, Homo sapiens
agaaagtctgcagct

SEQ ID NO: 198342 - DNA, 15 bp, Homo sapiens
gagaaagtctgcagc

SEQ ID NO: 198343 - DNA, 15 bp, Homo sapiens
ggagaaagtctgcag

SEQ ID NO: 198344 - DNA, 15 bp, Homo sapiens
tggagaaagtctgca

SEQ ID NO: 198345 - DNA, 15 bp, Homo sapiens
gtggagaaagtctgc

SEQ ID NO: 198346 - DNA, 15 bp, Homo sapiens
agtggagaaagtctg

SEQ ID NO: 198347 - DNA, 15 bp, Homo sapiens
cagtggagaaagtct

SEQ ID NO: 198348 - DNA, 15 bp, Homo sapiens
tcagtggagaaagtc

SEQ ID NO: 198349 - DNA, 15 bp, Homo sapiens
ctcagtggagaaagt

SEQ ID NO: 198350 - DNA, 15 bp, Homo sapiens
gctcagtggagaaag

SEQ ID NO: 198351 - DNA, 15 bp, Homo sapiens
ggctcagtggagaaa

SEQ ID NO: 198352 - DNA, 15 bp, Homo sapiens
gggctcagtggagaa

SEQ ID NO: 198353 - DNA, 15 bp, Homo sapiens
tgggctcagtggaga

SEQ ID NO: 198354 - DNA, 15 bp, Homo sapiens
ctgggctcagtggag

SEQ ID NO: 198355 - DNA, 15 bp, Homo sapiens
gctgggctcagtgga

SEQ ID NO: 198356 - DNA, 15 bp, Homo sapiens
tgctgggctcagtgg

SEQ ID NO: 198357 - DNA, 15 bp, Homo sapiens
atgctgggctcagtg

SEQ ID NO: 198358 - DNA, 15 bp, Homo sapiens
aatgctgggctcagt

SEQ ID NO: 198359 - DNA, 15 bp, Homo sapiens
taatgctgggctcag

SEQ ID NO: 198360 - DNA, 15 bp, Homo sapiens
gtaatgctgggctca

SEQ ID NO: 198361 - DNA, 15 bp, Homo sapiens
tgtaatgctgggctc

SEQ ID NO: 198362 - DNA, 15 bp, Homo sapiens
gtgtaatgctgggct

SEQ ID NO: 198363 - DNA, 15 bp, Homo sapiens
ggtgtaatgctgggc

SEQ ID NO: 198364 - DNA, 15 bp, Homo sapiens
gggtgtaatgctggg

SEQ ID NO: 198365 - DNA, 15 bp, Homo sapiens
tgggtgtaatgctgg

SEQ ID NO: 198366 - DNA, 15 bp, Homo sapiens
atgggtgtaatgctg

SEQ ID NO: 198367 - DNA, 15 bp, Homo sapiens
catgggtgtaatgct

SEQ ID NO: 198368 - DNA, 15 bp, Homo sapiens
gcatgggtgtaatgc

SEQ ID NO: 198369 - DNA, 15 bp, Homo sapiens
ggcatgggtgtaatg

SEQ ID NO: 198370 - DNA, 15 bp, Homo sapiens
aggcatgggtgtaat

SEQ ID NO: 198371 - DNA, 15 bp, Homo sapiens
gaggcatgggtgtaa

SEQ ID NO: 198372 - DNA, 15 bp, Homo sapiens
agaggcatgggtgta

SEQ ID NO: 198373 - DNA, 15 bp, Homo sapiens
cagaggcatgggtgt

SEQ ID NO: 198374 - DNA, 15 bp, Homo sapiens
gcagaggcatgggtg

SEQ ID NO: 198375 - DNA, 15 bp, Homo sapiens
agcagaggcatgggt

SEQ ID NO: 198376 - DNA, 15 bp, Homo sapiens
cagcagaggcatggg

SEQ ID NO: 198377 - DNA, 15 bp, Homo sapiens
tcagcagaggcatgg

SEQ ID NO: 198378 - DNA, 15 bp, Homo sapiens
ttcagcagaggcatg

SEQ ID NO: 198379 - DNA, 15 bp, Homo sapiens
tttcagcagaggcat

SEQ ID NO: 198380 - DNA, 15 bp, Homo sapiens
ctttcagcagaggca

SEQ ID NO: 198381 - DNA, 15 bp, Homo sapiens
tctttcagcagaggc

SEQ ID NO: 198382 - DNA, 15 bp, Homo sapiens
ttctttcagcagagg

SEQ ID NO: 198383 - DNA, 15 bp, Homo sapiens
tttctttcagcagag

SEQ ID NO: 198384 - DNA, 15 bp, Homo sapiens
gtttctttcagcaga

SEQ ID NO: 198385 - DNA, 15 bp, Homo sapiens
agtttctttcagcag

SEQ ID NO: 198386 - DNA, 15 bp, Homo sapiens
aagtttctttcagca

SEQ ID NO: 198387 - DNA, 15 bp, Homo sapiens
gaagtttctttcagc

SEQ ID NO: 198388 - DNA, 15 bp, Homo sapiens
ggaagtttctttcag

SEQ ID NO: 198389 - DNA, 15 bp, Homo sapiens
gggaagtttctttca

SEQ ID NO: 198390 - DNA, 15 bp, Homo sapiens
tgggaagtttctttc

SEQ ID NO: 198391 - DNA, 15 bp, Homo sapiens
gtgggaagtttcttt

SEQ ID NO: 198392 - DNA, 15 bp, Homo sapiens
tgtgggaagtttctt

SEQ ID NO: 198393 - DNA, 15 bp, Homo sapiens
ctgtgggaagtttct

SEQ ID NO: 198394 - DNA, 15 bp, Homo sapiens
cctgtgggaagtttc

SEQ ID NO: 198395 - DNA, 15 bp, Homo sapiens
acctgtgggaagttt

SEQ ID NO: 198396 - DNA, 15 bp, Homo sapiens
cacctgtgggaagtt

SEQ ID NO: 198397 - DNA, 15 bp, Homo sapiens
ccacctgtgggaagt

SEQ ID NO: 198398 - DNA, 15 bp, Homo sapiens
tccacctgtgggaag

SEQ ID NO: 198399 - DNA, 15 bp, Homo sapiens
ttccacctgtgggaa

SEQ ID NO: 198400 - DNA, 15 bp, Homo sapiens
tttccacctgtggga

SEQ ID NO: 198401 - DNA, 15 bp, Homo sapiens
atttccacctgtggg

SEQ ID NO: 198402 - DNA, 15 bp, Homo sapiens
catttccacctgtgg

SEQ ID NO: 198403 - DNA, 15 bp, Homo sapiens
acatttccacctgtg

SEQ ID NO: 198404 - DNA, 15 bp, Homo sapiens
gacatttccacctgt

SEQ ID NO: 198405 - DNA, 15 bp, Homo sapiens
agacatttccacctg

SEQ ID NO: 198406 - DNA, 15 bp, Homo sapiens
cagacatttccacct

SEQ ID NO: 198407 - DNA, 15 bp, Homo sapiens
ccagacatttccacc

SEQ ID NO: 198408 - DNA, 15 bp, Homo sapiens
cccagacatttccac

SEQ ID NO: 198409 - DNA, 15 bp, Homo sapiens
tcccagacatttcca

SEQ ID NO: 198410 - DNA, 15 bp, Homo sapiens
ctcccagacatttcc

SEQ ID NO: 198411 - DNA, 15 bp, Homo sapiens
actcccagacatttc

SEQ ID NO: 198412 - DNA, 15 bp, Homo sapiens
gactcccagacattt

SEQ ID NO: 198413 - DNA, 15 bp, Homo sapiens
tgactcccagacatt

SEQ ID NO: 198414 - DNA, 15 bp, Homo sapiens
ttgactcccagacat

SEQ ID NO: 198415 - DNA, 15 bp, Homo sapiens
cttgactcccagaca

SEQ ID NO: 198416 - DNA, 15 bp, Homo sapiens
ccttgactcccagac

SEQ ID NO: 198417 - DNA, 15 bp, Homo sapiens
gccttgactcccaga

SEQ ID NO: 198418 - DNA, 15 bp, Homo sapiens
ggccttgactcccag

SEQ ID NO: 198419 - DNA, 15 bp, Homo sapiens
aggccttgactccca

SEQ ID NO: 198420 - DNA, 15 bp, Homo sapiens
caggccttgactccc

SEQ ID NO: 198421 - DNA, 15 bp, Homo sapiens
gcaggccttgactcc

SEQ ID NO: 198422 - DNA, 15 bp, Homo sapiens
agcaggccttgactc

SEQ ID NO: 198423 - DNA, 15 bp, Homo sapiens
cagcaggccttgact

SEQ ID NO: 198424 - DNA, 15 bp, Homo sapiens
acagcaggccttgac

SEQ ID NO: 198425 - DNA, 15 bp, Homo sapiens
gacagcaggccttga

SEQ ID NO: 198426 - DNA, 15 bp, Homo sapiens
agacagcaggccttg

SEQ ID NO: 198427 - DNA, 15 bp, Homo sapiens
aagacagcaggcctt

SEQ ID NO: 198428 - DNA, 15 bp, Homo sapiens
gaagacagcaggcct

SEQ ID NO: 198429 - DNA, 15 bp, Homo sapiens
tgaagacagcaggcc

SEQ ID NO: 198430 - DNA, 15 bp, Homo sapiens
atgaagacagcaggc

SEQ ID NO: 198431 - DNA, 15 bp, Homo sapiens
aatgaagacagcagg

SEQ ID NO: 198432 - DNA, 15 bp, Homo sapiens
gaatgaagacagcag

SEQ ID NO: 198433 - DNA, 15 bp, Homo sapiens
agaatgaagacagca

SEQ ID NO: 198434 - DNA, 15 bp, Homo sapiens
aagaatgaagacagc

SEQ ID NO: 198435 - DNA, 15 bp, Homo sapiens
aaagaatgaagacag

SEQ ID NO: 198436 - DNA, 15 bp, Homo sapiens
aaaagaatgaagaca

SEQ ID NO: 198437 - DNA, 15 bp, Homo sapiens
caaaagaatgaagac

SEQ ID NO: 198438 - DNA, 15 bp, Homo sapiens
acaaaagaatgaaga

SEQ ID NO: 198439 - DNA, 15 bp, Homo sapiens
gacaaaagaatgaag

SEQ ID NO: 198440 - DNA, 15 bp, Homo sapiens
tgacaaaagaatgaa

SEQ ID NO: 198441 - DNA, 15 bp, Homo sapiens
atgacaaaagaatga

SEQ ID NO: 198442 - DNA, 15 bp, Homo sapiens
aatgacaaaagaatg

SEQ ID NO: 198443 - DNA, 15 bp, Homo sapiens
gaatgacaaaagaat

SEQ ID NO: 198444 - DNA, 15 bp, Homo sapiens
agaatgacaaaagaa

SEQ ID NO: 198445 - DNA, 15 bp, Homo sapiens
aagaatgacaaaaga

SEQ ID NO: 198446 - DNA, 15 bp, Homo sapiens
aaagaatgacaaaag

SEQ ID NO: 198447 - DNA, 15 bp, Homo sapiens
aaaagaatgacaaaa

SEQ ID NO: 198448 - DNA, 15 bp, Homo sapiens
caaaagaatgacaaa

SEQ ID NO: 198449 - DNA, 15 bp, Homo sapiens
acaaaagaatgacaa

SEQ ID NO: 198450 - DNA, 15 bp, Homo sapiens
gacaaaagaatgaca

SEQ ID NO: 198451 - DNA, 15 bp, Homo sapiens
ggacaaaagaatgac

SEQ ID NO: 198452 - DNA, 15 bp, Homo sapiens
gggacaaaagaatga

SEQ ID NO: 198453 - DNA, 15 bp, Homo sapiens
tgggacaaaagaatg

SEQ ID NO: 198454 - DNA, 15 bp, Homo sapiens
gtgggacaaaagaat

SEQ ID NO: 198455 - DNA, 15 bp, Homo sapiens
cgtgggacaaaagaa

SEQ ID NO: 198456 - DNA, 15 bp, Homo sapiens
ccgtgggacaaaaga

SEQ ID NO: 198457 - DNA, 15 bp, Homo sapiens
cccgtgggacaaaag

SEQ ID NO: 198458 - DNA, 15 bp, Homo sapiens
acccgtgggacaaaa

SEQ ID NO: 198459 - DNA, 15 bp, Homo sapiens
aacccgtgggacaaa

SEQ ID NO: 198460 - DNA, 15 bp, Homo sapiens
caacccgtgggacaa

SEQ ID NO: 198461 - DNA, 15 bp, Homo sapiens
gcaacccgtgggaca

SEQ ID NO: 198462 - DNA, 15 bp, Homo sapiens
agcaacccgtgggac

SEQ ID NO: 198463 - DNA, 15 bp, Homo sapiens
gagcaacccgtggga

SEQ ID NO: 198464 - DNA, 15 bp, Homo sapiens
ggagcaacccgtggg

SEQ ID NO: 198465 - DNA, 15 bp, Homo sapiens
gggagcaacccgtgg

SEQ ID NO: 198466 - DNA, 15 bp, Homo sapiens
agggagcaacccgtg

SEQ ID NO: 198467 - DNA, 15 bp, Homo sapiens
aagggagcaacccgt

SEQ ID NO: 198468 - DNA, 15 bp, Homo sapiens
caagggagcaacccg

SEQ ID NO: 198469 - DNA, 15 bp, Homo sapiens
tcaagggagcaaccc

SEQ ID NO: 198470 - DNA, 15 bp, Homo sapiens
atcaagggagcaacc

SEQ ID NO: 198471 - DNA, 15 bp, Homo sapiens
catcaagggagcaac

SEQ ID NO: 198472 - DNA, 15 bp, Homo sapiens
acatcaagggagcaa

SEQ ID NO: 198473 - DNA, 15 bp, Homo sapiens
cacatcaagggagca

SEQ ID NO: 198474 - DNA, 15 bp, Homo sapiens
ccacatcaagggagc

SEQ ID NO: 198475 - DNA, 15 bp, Homo sapiens
tccacatcaagggag

SEQ ID NO: 198476 - DNA, 15 bp, Homo sapiens
ctccacatcaaggga

SEQ ID NO: 198477 - DNA, 15 bp, Homo sapiens
gctccacatcaaggg

SEQ ID NO: 198478 - DNA, 15 bp, Homo sapiens
tgctccacatcaagg

SEQ ID NO: 198479 - DNA, 15 bp, Homo sapiens
gtgctccacatcaag

SEQ ID NO: 198480 - DNA, 15 bp, Homo sapiens
agtgctccacatcaa

SEQ ID NO: 198481 - DNA, 15 bp, Homo sapiens
gagtgctccacatca

SEQ ID NO: 198482 - DNA, 15 bp, Homo sapiens
ggagtgctccacatc

SEQ ID NO: 198483 - DNA, 15 bp, Homo sapiens
gggagtgctccacat

SEQ ID NO: 198484 - DNA, 15 bp, Homo sapiens
agggagtgctccaca

SEQ ID NO: 198485 - DNA, 15 bp, Homo sapiens
gagggagtgctccac

SEQ ID NO: 198486 - DNA, 15 bp, Homo sapiens
agagggagtgctcca

SEQ ID NO: 198487 - DNA, 15 bp, Homo sapiens
aagagggagtgctcc

SEQ ID NO: 198488 - DNA, 15 bp, Homo sapiens
aaagagggagtgctc

SEQ ID NO: 198489 - DNA, 15 bp, Homo sapiens
gaaagagggagtgct

SEQ ID NO: 198490 - DNA, 15 bp, Homo sapiens
ggaaagagggagtgc

SEQ ID NO: 198491 - DNA, 15 bp, Homo sapiens
gggaaagagggagtg

SEQ ID NO: 198492 - DNA, 15 bp, Homo sapiens
ggggaaagagggagt

SEQ ID NO: 198493 - DNA, 15 bp, Homo sapiens
aggggaaagagggag

SEQ ID NO: 198494 - DNA, 15 bp, Homo sapiens
taggggaaagaggga

SEQ ID NO: 198495 - DNA, 15 bp, Homo sapiens
ctaggggaaagaggg

SEQ ID NO: 198496 - DNA, 15 bp, Homo sapiens
cctaggggaaagagg

SEQ ID NO: 198497 - DNA, 15 bp, Homo sapiens
tcctaggggaaagag

SEQ ID NO: 198498 - DNA, 15 bp, Homo sapiens
ctcctaggggaaaga

SEQ ID NO: 198499 - DNA, 15 bp, Homo sapiens
cctcctaggggaaag

SEQ ID NO: 198500 - DNA, 15 bp, Homo sapiens
tcctcctaggggaaa

SEQ ID NO: 198501 - DNA, 15 bp, Homo sapiens
ctcctcctaggggaa

SEQ ID NO: 198502 - DNA, 15 bp, Homo sapiens
cctcctcctagggga

SEQ ID NO: 198503 - DNA, 15 bp, Homo sapiens
tcctcctcctagggg

SEQ ID NO: 198504 - DNA, 15 bp, Homo sapiens
ttcctcctcctaggg

SEQ ID NO: 198505 - DNA, 15 bp, Homo sapiens
attcctcctcctagg

SEQ ID NO: 198506 - DNA, 15 bp, Homo sapiens
gattcctcctcctag

SEQ ID NO: 198507 - DNA, 15 bp, Homo sapiens
ggattcctcctccta

SEQ ID NO: 198508 - DNA, 15 bp, Homo sapiens
gggattcctcctcct

SEQ ID NO: 198509 - DNA, 15 bp, Homo sapiens
agggattcctcctcc

SEQ ID NO: 198510 - DNA, 15 bp, Homo sapiens
cagggattcctcctc

SEQ ID NO: 198511 - DNA, 15 bp, Homo sapiens
tcagggattcctcct

SEQ ID NO: 198512 - DNA, 15 bp, Homo sapiens
ctcagggattcctcc

SEQ ID NO: 198513 - DNA, 15 bp, Homo sapiens
cctcagggattcctc

SEQ ID NO: 198514 - DNA, 15 bp, Homo sapiens
ccctcagggattcct

SEQ ID NO: 198515 - DNA, 15 bp, Homo sapiens
gccctcagggattcc

SEQ ID NO: 198516 - DNA, 15 bp, Homo sapiens
ggccctcagggattc

SEQ ID NO: 198517 - DNA, 15 bp, Homo sapiens
tggccctcagggatt

SEQ ID NO: 198518 - DNA, 15 bp, Homo sapiens
ctggccctcagggat

SEQ ID NO: 198519 - DNA, 15 bp, Homo sapiens
tctggccctcaggga

SEQ ID NO: 198520 - DNA, 15 bp, Homo sapiens
gtctggccctcaggg

SEQ ID NO: 198521 - DNA, 15 bp, Homo sapiens
agtctggccctcagg

SEQ ID NO: 198522 - DNA, 15 bp, Homo sapiens
tagtctggccctcag

SEQ ID NO: 198523 - DNA, 15 bp, Homo sapiens
atagtctggccctca

SEQ ID NO: 198524 - DNA, 15 bp, Homo sapiens
aatagtctggccctc

SEQ ID NO: 198525 - DNA, 15 bp, Homo sapiens
caatagtctggccct

SEQ ID NO: 198526 - DNA, 15 bp, Homo sapiens
acaatagtctggccc

SEQ ID NO: 198527 - DNA, 15 bp, Homo sapiens
cacaatagtctggcc

SEQ ID NO: 198528 - DNA, 15 bp, Homo sapiens
tcacaatagtctggc

SEQ ID NO: 198529 - DNA, 15 bp, Homo sapiens
ttcacaatagtctgg

SEQ ID NO: 198530 - DNA, 15 bp, Homo sapiens
attcacaatagtctg

SEQ ID NO: 198531 - DNA, 15 bp, Homo sapiens
cattcacaatagtct

SEQ ID NO: 198532 - DNA, 15 bp, Homo sapiens
gcattcacaatagtc

SEQ ID NO: 198533 - DNA, 15 bp, Homo sapiens
agcattcacaatagt

SEQ ID NO: 198534 - DNA, 15 bp, Homo sapiens
cagcattcacaatag

SEQ ID NO: 198535 - DNA, 15 bp, Homo sapiens
gcagcattcacaata

SEQ ID NO: 198536 - DNA, 15 bp, Homo sapiens
agcagcattcacaat

SEQ ID NO: 198537 - DNA, 15 bp, Homo sapiens
cagcagcattcacaa

SEQ ID NO: 198538 - DNA, 15 bp, Homo sapiens
gcagcagcattcaca

SEQ ID NO: 198539 - DNA, 15 bp, Homo sapiens
agcagcagcattcac

SEQ ID NO: 198540 - DNA, 15 bp, Homo sapiens
gagcagcagcattca

SEQ ID NO: 198541 - DNA, 15 bp, Homo sapiens
ggagcagcagcattc

SEQ ID NO: 198542 - DNA, 15 bp, Homo sapiens
tggagcagcagcatt

SEQ ID NO: 198543 - DNA, 15 bp, Homo sapiens
gtggagcagcagcat

SEQ ID NO: 198544 - DNA, 15 bp, Homo sapiens
agtggagcagcagca

SEQ ID NO: 198545 - DNA, 15 bp, Homo sapiens
gagtggagcagcagc

SEQ ID NO: 198546 - DNA, 15 bp, Homo sapiens
tgagtggagcagcag

SEQ ID NO: 198547 - DNA, 15 bp, Homo sapiens
ctgagtggagcagca

SEQ ID NO: 198548 - DNA, 15 bp, Homo sapiens
actgagtggagcagc

SEQ ID NO: 198549 - DNA, 15 bp, Homo sapiens
gactgagtggagcag

SEQ ID NO: 198550 - DNA, 15 bp, Homo sapiens
agactgagtggagca

SEQ ID NO: 198551 - DNA, 15 bp, Homo sapiens
tagactgagtggagc

SEQ ID NO: 198552 - DNA, 15 bp, Homo sapiens
ctagactgagtggag

SEQ ID NO: 198553 - DNA, 15 bp, Homo sapiens
gctagactgagtgga

SEQ ID NO: 198554 - DNA, 15 bp, Homo sapiens
tgctagactgagtgg

SEQ ID NO: 198555 - DNA, 15 bp, Homo sapiens
ttgctagactgagtg

SEQ ID NO: 198556 - DNA, 15 bp, Homo sapiens
gttgctagactgagt

SEQ ID NO: 198557 - DNA, 15 bp, Homo sapiens
ggttgctagactgag

SEQ ID NO: 198558 - DNA, 15 bp, Homo sapiens
gggttgctagactga

SEQ ID NO: 198559 - DNA, 15 bp, Homo sapiens
tgggttgctagactg

SEQ ID NO: 198560 - DNA, 15 bp, Homo sapiens
atgggttgctagact

SEQ ID NO: 198561 - DNA, 15 bp, Homo sapiens
aatgggttgctagac

SEQ ID NO: 198562 - DNA, 15 bp, Homo sapiens
aaatgggttgctaga

SEQ ID NO: 198563 - DNA, 15 bp, Homo sapiens
caaatgggttgctag

SEQ ID NO: 198564 - DNA, 15 bp, Homo sapiens
ccaaatgggttgcta

SEQ ID NO: 198565 - DNA, 15 bp, Homo sapiens
tccaaatgggttgct

SEQ ID NO: 198566 - DNA, 15 bp, Homo sapiens
gtccaaatgggttgc

SEQ ID NO: 198567 - DNA, 15 bp, Homo sapiens
agtccaaatgggttg

SEQ ID NO: 198568 - DNA, 15 bp, Homo sapiens
cagtccaaatgggtt

SEQ ID NO: 198569 - DNA, 15 bp, Homo sapiens
gcagtccaaatgggt

SEQ ID NO: 198570 - DNA, 15 bp, Homo sapiens
ggcagtccaaatggg

SEQ ID NO: 198571 - DNA, 15 bp, Homo sapiens
tggcagtccaaatgg

SEQ ID NO: 198572 - DNA, 15 bp, Homo sapiens
gtggcagtccaaatg

SEQ ID NO: 198573 - DNA, 15 bp, Homo sapiens
tgtggcagtccaaat

SEQ ID NO: 198574 - DNA, 15 bp, Homo sapiens
ctgtggcagtccaaa

SEQ ID NO: 198575 - DNA, 15 bp, Homo sapiens
actgtggcagtccaa

SEQ ID NO: 198576 - DNA, 15 bp, Homo sapiens
gactgtggcagtcca

SEQ ID NO: 198577 - DNA, 15 bp, Homo sapiens
ggactgtggcagtcc

SEQ ID NO: 198578 - DNA, 15 bp, Homo sapiens
tggactgtggcagtc

SEQ ID NO: 198579 - DNA, 15 bp, Homo sapiens
ctggactgtggcagt

SEQ ID NO: 198580 - DNA, 15 bp, Homo sapiens
cctggactgtggcag

SEQ ID NO: 198581 - DNA, 15 bp, Homo sapiens
gcctggactgtggca

SEQ ID NO: 198582 - DNA, 15 bp, Homo sapiens
agcctggactgtggc

SEQ ID NO: 198583 - DNA, 15 bp, Homo sapiens
cagcctggactgtgg

SEQ ID NO: 198584 - DNA, 15 bp, Homo sapiens
ccagcctggactgtg

SEQ ID NO: 198585 - DNA, 15 bp, Homo sapiens
accagcctggactgt

SEQ ID NO: 198586 - DNA, 15 bp, Homo sapiens
caccagcctggactg

SEQ ID NO: 198587 - DNA, 15 bp, Homo sapiens
gcaccagcctggact

SEQ ID NO: 198588 - DNA, 15 bp, Homo sapiens
tgcaccagcctggac

SEQ ID NO: 198589 - DNA, 15 bp, Homo sapiens
ctgcaccagcctgga

SEQ ID NO: 198590 - DNA, 15 bp, Homo sapiens
cctgcaccagcctgg

SEQ ID NO: 198591 - DNA, 15 bp, Homo sapiens
ccctgcaccagcctg

SEQ ID NO: 198592 - DNA, 15 bp, Homo sapiens
cccctgcaccagcct

SEQ ID NO: 198593 - DNA, 15 bp, Homo sapiens
ccccctgcaccagcc

SEQ ID NO: 198594 - DNA, 15 bp, Homo sapiens
tccccctgcaccagc

SEQ ID NO: 198595 - DNA, 15 bp, Homo sapiens
ttccccctgcaccag

SEQ ID NO: 198596 - DNA, 15 bp, Homo sapiens
attccccctgcacca

SEQ ID NO: 198597 - DNA, 15 bp, Homo sapiens
cattccccctgcacc

SEQ ID NO: 198598 - DNA, 15 bp, Homo sapiens
acattccccctgcac

SEQ ID NO: 198599 - DNA, 15 bp, Homo sapiens
gacattccccctgca

SEQ ID NO: 198600 - DNA, 15 bp, Homo sapiens
agacattccccctgc

SEQ ID NO: 198601 - DNA, 15 bp, Homo sapiens
cagacattccccctg

SEQ ID NO: 198602 - DNA, 15 bp, Homo sapiens
gcagacattccccct

SEQ ID NO: 198603 - DNA, 15 bp, Homo sapiens
tgcagacattccccc

SEQ ID NO: 198604 - DNA, 15 bp, Homo sapiens
ttgcagacattcccc

SEQ ID NO: 198605 - DNA, 15 bp, Homo sapiens
cttgcagacattccc

SEQ ID NO: 198606 - DNA, 15 bp, Homo sapiens
ccttgcagacattcc

SEQ ID NO: 198607 - DNA, 15 bp, Homo sapiens
cccttgcagacattc

SEQ ID NO: 198608 - DNA, 15 bp, Homo sapiens
tcccttgcagacatt

SEQ ID NO: 198609 - DNA, 15 bp, Homo sapiens
atcccttgcagacat

SEQ ID NO: 198610 - DNA, 15 bp, Homo sapiens
gatcccttgcagaca

SEQ ID NO: 198611 - DNA, 15 bp, Homo sapiens
ggatcccttgcagac

SEQ ID NO: 198612 - DNA, 15 bp, Homo sapiens
tggatcccttgcaga

SEQ ID NO: 198613 - DNA, 15 bp, Homo sapiens
ctggatcccttgcag

SEQ ID NO: 198614 - DNA, 15 bp, Homo sapiens
actggatcccttgca

SEQ ID NO: 198615 - DNA, 15 bp, Homo sapiens
cactggatcccttgc

SEQ ID NO: 198616 - DNA, 15 bp, Homo sapiens
tcactggatcccttg

SEQ ID NO: 198617 - DNA, 15 bp, Homo sapiens
atcactggatccctt

SEQ ID NO: 198618 - DNA, 15 bp, Homo sapiens
catcactggatccct

SEQ ID NO: 198619 - DNA, 15 bp, Homo sapiens
acatcactggatccc

SEQ ID NO: 198620 - DNA, 15 bp, Homo sapiens
cacatcactggatcc

SEQ ID NO: 198621 - DNA, 15 bp, Homo sapiens
tcacatcactggatc

SEQ ID NO: 198622 - DNA, 15 bp, Homo sapiens
gtcacatcactggat

SEQ ID NO: 198623 - DNA, 15 bp, Homo sapiens
ggtcacatcactgga

SEQ ID NO: 198624 - DNA, 15 bp, Homo sapiens
aggtcacatcactgg

SEQ ID NO: 198625 - DNA, 15 bp, Homo sapiens
caggtcacatcactg

SEQ ID NO: 198626 - DNA, 15 bp, Homo sapiens
acaggtcacatcact

SEQ ID NO: 198627 - DNA, 15 bp, Homo sapiens
gacaggtcacatcac

SEQ ID NO: 198628 - DNA, 15 bp, Homo sapiens
ggacaggtcacatca

SEQ ID NO: 198629 - DNA, 15 bp, Homo sapiens
aggacaggtcacatc

SEQ ID NO: 198630 - DNA, 15 bp, Homo sapiens
caggacaggtcacat

SEQ ID NO: 198631 - DNA, 15 bp, Homo sapiens
tcaggacaggtcaca

SEQ ID NO: 198632 - DNA, 15 bp, Homo sapiens
ttcaggacaggtcac

SEQ ID NO: 198633 - DNA, 15 bp, Homo sapiens
cttcaggacaggtca

SEQ ID NO: 198634 - DNA, 15 bp, Homo sapiens
acttcaggacaggtc

SEQ ID NO: 198635 - DNA, 15 bp, Homo sapiens
gacttcaggacaggt

SEQ ID NO: 198636 - DNA, 15 bp, Homo sapiens
agacttcaggacagg

SEQ ID NO: 198637 - DNA, 15 bp, Homo sapiens
gagacttcaggacag

SEQ ID NO: 198638 - DNA, 15 bp, Homo sapiens
tgagacttcaggaca

SEQ ID NO: 198639 - DNA, 15 bp, Homo sapiens
gtgagacttcaggac

SEQ ID NO: 198640 - DNA, 15 bp, Homo sapiens
tgtgagacttcagga

SEQ ID NO: 198641 - DNA, 15 bp, Homo sapiens
ctgtgagacttcagg

SEQ ID NO: 198642 - DNA, 15 bp, Homo sapiens
gctgtgagacttcag

SEQ ID NO: 198643 - DNA, 15 bp, Homo sapiens
tgctgtgagacttca

SEQ ID NO: 198644 - DNA, 15 bp, Homo sapiens
ctgctgtgagacttc

SEQ ID NO: 198645 - DNA, 15 bp, Homo sapiens
actgctgtgagactt

SEQ ID NO: 198646 - DNA, 15 bp, Homo sapiens
cactgctgtgagact

SEQ ID NO: 198647 - DNA, 15 bp, Homo sapiens
ccactgctgtgagac

SEQ ID NO: 198648 - DNA, 15 bp, Homo sapiens
cccactgctgtgaga

SEQ ID NO: 198649 - DNA, 15 bp, Homo sapiens
acccactgctgtgag

SEQ ID NO: 198650 - DNA, 15 bp, Homo sapiens
cacccactgctgtga

SEQ ID NO: 198651 - DNA, 15 bp, Homo sapiens
gcacccactgctgtg

SEQ ID NO: 198652 - DNA, 15 bp, Homo sapiens
ggcacccactgctgt

SEQ ID NO: 198653 - DNA, 15 bp, Homo sapiens
tggcacccactgctg

SEQ ID NO: 198654 - DNA, 15 bp, Homo sapiens
ctggcacccactgct

SEQ ID NO: 198655 - DNA, 15 bp, Homo sapiens
gctggcacccactgc

SEQ ID NO: 198656 - DNA, 15 bp, Homo sapiens
tgctggcacccactg

SEQ ID NO: 198657 - DNA, 15 bp, Homo sapiens
gtgctggcacccact

SEQ ID NO: 198658 - DNA, 15 bp, Homo sapiens
ggtgctggcacccac

SEQ ID NO: 198659 - DNA, 15 bp, Homo sapiens
tggtgctggcaccca

SEQ ID NO: 198660 - DNA, 15 bp, Homo sapiens
ctggtgctggcaccc

SEQ ID NO: 198661 - DNA, 15 bp, Homo sapiens
gctggtgctggcacc

SEQ ID NO: 198662 - DNA, 15 bp, Homo sapiens
agctggtgctggcac

SEQ ID NO: 198663 - DNA, 15 bp, Homo sapiens
gagctggtgctggca

SEQ ID NO: 198664 - DNA, 15 bp, Homo sapiens
agagctggtgctggc

SEQ ID NO: 198665 - DNA, 15 bp, Homo sapiens
cagagctggtgctgg

SEQ ID NO: 198666 - DNA, 15 bp, Homo sapiens
tcagagctggtgctg

SEQ ID NO: 198667 - DNA, 15 bp, Homo sapiens
ctcagagctggtgct

SEQ ID NO: 198668 - DNA, 15 bp, Homo sapiens
cctcagagctggtgc

SEQ ID NO: 198669 - DNA, 15 bp, Homo sapiens
ccctcagagctggtg

SEQ ID NO: 198670 - DNA, 15 bp, Homo sapiens
cccctcagagctggt

SEQ ID NO: 198671 - DNA, 15 bp, Homo sapiens
ccccctcagagctgg

SEQ ID NO: 198672 - DNA, 15 bp, Homo sapiens
cccccctcagagctg

SEQ ID NO: 198673 - DNA, 15 bp, Homo sapiens
acccccctcagagct

SEQ ID NO: 198674 - DNA, 15 bp, Homo sapiens
aacccccctcagagc

SEQ ID NO: 198675 - DNA, 15 bp, Homo sapiens
caacccccctcagag

SEQ ID NO: 198676 - DNA, 15 bp, Homo sapiens
gcaacccccctcaga

SEQ ID NO: 198677 - DNA, 15 bp, Homo sapiens
tgcaacccccctcag

SEQ ID NO: 198678 - DNA, 15 bp, Homo sapiens
ctgcaacccccctca

SEQ ID NO: 198679 - DNA, 15 bp, Homo sapiens
tctgcaacccccctc

SEQ ID NO: 198680 - DNA, 15 bp, Homo sapiens
ctctgcaacccccct

SEQ ID NO: 198681 - DNA, 15 bp, Homo sapiens
cctctgcaacccccc

SEQ ID NO: 198682 - DNA, 15 bp, Homo sapiens
tcctctgcaaccccc

SEQ ID NO: 198683 - DNA, 15 bp, Homo sapiens
ctcctctgcaacccc

SEQ ID NO: 198684 - DNA, 15 bp, Homo sapiens
actcctctgcaaccc

SEQ ID NO: 198685 - DNA, 15 bp, Homo sapiens
cactcctctgcaacc

SEQ ID NO: 198686 - DNA, 15 bp, Homo sapiens
tcactcctctgcaac

SEQ ID NO: 198687 - DNA, 15 bp, Homo sapiens
atcactcctctgcaa

SEQ ID NO: 198688 - DNA, 15 bp, Homo sapiens
catcactcctctgca

SEQ ID NO: 198689 - DNA, 15 bp, Homo sapiens
acatcactcctctgc

SEQ ID NO: 198690 - DNA, 15 bp, Homo sapiens
tacatcactcctctg

SEQ ID NO: 198691 - DNA, 15 bp, Homo sapiens
ctacatcactcctct

SEQ ID NO: 198692 - DNA, 15 bp, Homo sapiens
tctacatcactcctc

SEQ ID NO: 198693 - DNA, 15 bp, Homo sapiens
gtctacatcactcct

SEQ ID NO: 198694 - DNA, 15 bp, Homo sapiens
agtctacatcactcc

SEQ ID NO: 198695 - DNA, 15 bp, Homo sapiens
gagtctacatcactc

SEQ ID NO: 198696 - DNA, 15 bp, Homo sapiens
agagtctacatcact

SEQ ID NO: 198697 - DNA, 15 bp, Homo sapiens
cagagtctacatcac

SEQ ID NO: 198698 - DNA, 15 bp, Homo sapiens
acagagtctacatca

SEQ ID NO: 198699 - DNA, 15 bp, Homo sapiens
cacagagtctacatc

SEQ ID NO: 198700 - DNA, 15 bp, Homo sapiens
tcacagagtctacat

SEQ ID NO: 198701 - DNA, 15 bp, Homo sapiens
atcacagagtctaca

SEQ ID NO: 198702 - DNA, 15 bp, Homo sapiens
tatcacagagtctac

SEQ ID NO: 198703 - DNA, 15 bp, Homo sapiens
atatcacagagtcta

SEQ ID NO: 198704 - DNA, 15 bp, Homo sapiens
aatatcacagagtct

SEQ ID NO: 198705 - DNA, 15 bp, Homo sapiens
gaatatcacagagtc

SEQ ID NO: 198706 - DNA, 15 bp, Homo sapiens
ggaatatcacagagt

SEQ ID NO: 198707 - DNA, 15 bp, Homo sapiens
aggaatatcacagag

SEQ ID NO: 198708 - DNA, 15 bp, Homo sapiens
aaggaatatcacaga

SEQ ID NO: 198709 - DNA, 15 bp, Homo sapiens
caaggaatatcacag

SEQ ID NO: 198710 - DNA, 15 bp, Homo sapiens
ccaaggaatatcaca

SEQ ID NO: 198711 - DNA, 15 bp, Homo sapiens
accaaggaatatcac

SEQ ID NO: 198712 - DNA, 15 bp, Homo sapiens
aaccaaggaatatca

SEQ ID NO: 198713 - DNA, 15 bp, Homo sapiens
taaccaaggaatatc

SEQ ID NO: 198714 - DNA, 15 bp, Homo sapiens
ataaccaaggaatat

SEQ ID NO: 198715 - DNA, 15 bp, Homo sapiens
tataaccaaggaata

SEQ ID NO: 198716 - DNA, 15 bp, Homo sapiens
atttataaccaagga

SEQ ID NO: 198717 - DNA, 15 bp, Homo sapiens
tatttataaccaagg

SEQ ID NO: 198718 - DNA, 15 bp, Homo sapiens
ctatttataaccaag

SEQ ID NO: 198719 - DNA, 15 bp, Homo sapiens
gctatttataaccaa

SEQ ID NO: 198720 - DNA, 15 bp, Homo sapiens
ggctatttataacca

SEQ ID NO: 198721 - DNA, 15 bp, Homo sapiens
aaggctatttataac

SEQ ID NO: 198722 - DNA, 15 bp, Homo sapiens
taaggctatttataa

SEQ ID NO: 198723 - DNA, 15 bp, Homo sapiens
ctaaggctatttata

SEQ ID NO: 198724 - DNA, 15 bp, Homo sapiens
actaaggctatttat

SEQ ID NO: 198725 - DNA, 15 bp, Homo sapiens
cactaaggctattta

SEQ ID NO: 198726 - DNA, 15 bp, Homo sapiens
acactaaggctattt

SEQ ID NO: 198727 - DNA, 15 bp, Homo sapiens
cacactaaggctatt

SEQ ID NO: 198728 - DNA, 15 bp, Homo sapiens
acacactaaggctat

SEQ ID NO: 198729 - DNA, 15 bp, Homo sapiens
aacacactaaggcta

SEQ ID NO: 198730 - DNA, 15 bp, Homo sapiens
caacacactaaggct

SEQ ID NO: 198731 - DNA, 15 bp, Homo sapiens
ccaacacactaaggc

SEQ ID NO: 198732 - DNA, 15 bp, Homo sapiens
gccaacacactaagg

SEQ ID NO: 198733 - DNA, 15 bp, Homo sapiens
agccaacacactaag

SEQ ID NO: 198734 - DNA, 15 bp, Homo sapiens
aagccaacacactaa

SEQ ID NO: 198735 - DNA, 15 bp, Homo sapiens
aaagccaacacacta

SEQ ID NO: 198736 - DNA, 15 bp, Homo sapiens
gaaagccaacacact

SEQ ID NO: 198737 - DNA, 15 bp, Homo sapiens
agaaagccaacacac

SEQ ID NO: 198738 - DNA, 15 bp, Homo sapiens
gagaaagccaacaca

SEQ ID NO: 198739 - DNA, 15 bp, Homo sapiens
tgagaaagccaacac

SEQ ID NO: 198740 - DNA, 15 bp, Homo sapiens
gtgagaaagccaaca

SEQ ID NO: 198741 - DNA, 15 bp, Homo sapiens
tgtgagaaagccaac

SEQ ID NO: 198742 - DNA, 15 bp, Homo sapiens
atgtgagaaagccaa

SEQ ID NO: 198743 - DNA, 15 bp, Homo sapiens
catgtgagaaagcca

SEQ ID NO: 198744 - DNA, 15 bp, Homo sapiens
gcatgtgagaaagcc

SEQ ID NO: 198745 - DNA, 15 bp, Homo sapiens
ggcatgtgagaaagc

SEQ ID NO: 198746 - DNA, 15 bp, Homo sapiens
tggcatgtgagaaag

SEQ ID NO: 198747 - DNA, 15 bp, Homo sapiens
atggcatgtgagaaa

SEQ ID NO: 198748 - DNA, 15 bp, Homo sapiens
catggcatgtgagaa

SEQ ID NO: 198749 - DNA, 15 bp, Homo sapiens
acatggcatgtgaga

SEQ ID NO: 198750 - DNA, 15 bp, Homo sapiens
cacatggcatgtgag

SEQ ID NO: 198751 - DNA, 15 bp, Homo sapiens
acacatggcatgtga

SEQ ID NO: 198752 - DNA, 15 bp, Homo sapiens
tacacatggcatgtg

SEQ ID NO: 198753 - DNA, 15 bp, Homo sapiens
ttacacatggcatgt

SEQ ID NO: 198754 - DNA, 15 bp, Homo sapiens
attacacatggcatg

SEQ ID NO: 198755 - DNA, 15 bp, Homo sapiens
tattacacatggcat

SEQ ID NO: 198756 - DNA, 15 bp, Homo sapiens
ctattacacatggca

SEQ ID NO: 198757 - DNA, 15 bp, Homo sapiens
actattacacatggc

SEQ ID NO: 198758 - DNA, 15 bp, Homo sapiens
tactattacacatgg

SEQ ID NO: 198759 - DNA, 15 bp, Homo sapiens
ttactattacacatg

SEQ ID NO: 198760 - DNA, 15 bp, Homo sapiens
gttactattacacat

SEQ ID NO: 198761 - DNA, 15 bp, Homo sapiens
cgttactattacaca

SEQ ID NO: 198762 - DNA, 15 bp, Homo sapiens
tcgttactattacac

SEQ ID NO: 198763 - DNA, 15 bp, Homo sapiens
ttcgttactattaca

SEQ ID NO: 198764 - DNA, 15 bp, Homo sapiens
gttcgttactattac

SEQ ID NO: 198765 - DNA, 15 bp, Homo sapiens
tgttcgttactatta

SEQ ID NO: 198766 - DNA, 15 bp, Homo sapiens
ctgttcgttactatt

SEQ ID NO: 198767 - DNA, 15 bp, Homo sapiens
cctgttcgttactat

SEQ ID NO: 198768 - DNA, 15 bp, Homo sapiens
acctgttcgttacta

SEQ ID NO: 198769 - DNA, 15 bp, Homo sapiens
gacctgttcgttact

SEQ ID NO: 198770 - DNA, 15 bp, Homo sapiens
tgacctgttcgttac

SEQ ID NO: 198771 - DNA, 15 bp, Homo sapiens
gtgacctgttcgtta

SEQ ID NO: 198772 - DNA, 15 bp, Homo sapiens
cgtgacctgttcgtt

SEQ ID NO: 198773 - DNA, 15 bp, Homo sapiens
acgtgacctgttcgt

SEQ ID NO: 198774 - DNA, 15 bp, Homo sapiens
cacgtgacctgttcg

SEQ ID NO: 198775 - DNA, 15 bp, Homo sapiens
ccacgtgacctgttc

SEQ ID NO: 198776 - DNA, 15 bp, Homo sapiens
cccacgtgacctgtt

SEQ ID NO: 198777 - DNA, 15 bp, Homo sapiens
gcccacgtgacctgt

SEQ ID NO: 198778 - DNA, 15 bp, Homo sapiens
tgcccacgtgacctg

SEQ ID NO: 198779 - DNA, 15 bp, Homo sapiens
ctgcccacgtgacct

SEQ ID NO: 198780 - DNA, 15 bp, Homo sapiens
tctgcccacgtgacc

SEQ ID NO: 198781 - DNA, 15 bp, Homo sapiens
gtctgcccacgtgac

SEQ ID NO: 198782 - DNA, 15 bp, Homo sapiens
agtctgcccacgtga

SEQ ID NO: 198783 - DNA, 15 bp, Homo sapiens
gagtctgcccacgtg

SEQ ID NO: 198784 - DNA, 15 bp, Homo sapiens
tgagtctgcccacgt

SEQ ID NO: 198785 - DNA, 15 bp, Homo sapiens
ctgagtctgcccacg

SEQ ID NO: 198786 - DNA, 15 bp, Homo sapiens
cctgagtctgcccac

SEQ ID NO: 198787 - DNA, 15 bp, Homo sapiens
ccctgagtctgccca

SEQ ID NO: 198788 - DNA, 15 bp, Homo sapiens
gccctgagtctgccc

SEQ ID NO: 198789 - DNA, 15 bp, Homo sapiens
ggccctgagtctgcc

SEQ ID NO: 198790 - DNA, 15 bp, Homo sapiens
aggccctgagtctgc

SEQ ID NO: 198791 - DNA, 15 bp, Homo sapiens
gaggccctgagtctg

SEQ ID NO: 198792 - DNA, 15 bp, Homo sapiens
ggaggccctgagtct

SEQ ID NO: 198793 - DNA, 15 bp, Homo sapiens
aggaggccctgagtc

SEQ ID NO: 198794 - DNA, 15 bp, Homo sapiens
caggaggccctgagt

SEQ ID NO: 198795 - DNA, 15 bp, Homo sapiens
ccaggaggccctgag

SEQ ID NO: 198796 - DNA, 15 bp, Homo sapiens
accaggaggccctga

SEQ ID NO: 198797 - DNA, 15 bp, Homo sapiens
aaccaggaggccctg

SEQ ID NO: 198798 - DNA, 15 bp, Homo sapiens
taaccaggaggccct

SEQ ID NO: 198799 - DNA, 15 bp, Homo sapiens
ctaaccaggaggccc

SEQ ID NO: 198800 - DNA, 15 bp, Homo sapiens
gctaaccaggaggcc

SEQ ID NO: 198801 - DNA, 15 bp, Homo sapiens
ggctaaccaggaggc

SEQ ID NO: 198802 - DNA, 15 bp, Homo sapiens
tggctaaccaggagg

SEQ ID NO: 198803 - DNA, 15 bp, Homo sapiens
ctggctaaccaggag

SEQ ID NO: 198804 - DNA, 15 bp, Homo sapiens
cctggctaaccagga

SEQ ID NO: 198805 - DNA, 15 bp, Homo sapiens
ccctggctaaccagg

SEQ ID NO: 198806 - DNA, 15 bp, Homo sapiens
accctggctaaccag

SEQ ID NO: 198807 - DNA, 15 bp, Homo sapiens
caccctggctaacca

SEQ ID NO: 198808 - DNA, 15 bp, Homo sapiens
tcaccctggctaacc

SEQ ID NO: 198809 - DNA, 15 bp, Homo sapiens
atcaccctggctaac

SEQ ID NO: 198810 - DNA, 15 bp, Homo sapiens
catcaccctggctaa

SEQ ID NO: 198811 - DNA, 15 bp, Homo sapiens
gcatcaccctggcta

SEQ ID NO: 198812 - DNA, 15 bp, Homo sapiens
tgcatcaccctggct

SEQ ID NO: 198813 - DNA, 15 bp, Homo sapiens
ctgcatcaccctggc

SEQ ID NO: 198814 - DNA, 15 bp, Homo sapiens
cctgcatcaccctgg

SEQ ID NO: 198815 - DNA, 15 bp, Homo sapiens
acctgcatcaccctg

SEQ ID NO: 198816 - DNA, 15 bp, Homo sapiens
tacctgcatcaccct

SEQ ID NO: 198817 - DNA, 15 bp, Homo sapiens
ttacctgcatcaccc

SEQ ID NO: 198818 - DNA, 15 bp, Homo sapiens
attacctgcatcacc

SEQ ID NO: 198819 - DNA, 15 bp, Homo sapiens
cattacctgcatcac

SEQ ID NO: 198820 - DNA, 15 bp, Homo sapiens
ccattacctgcatca

SEQ ID NO: 198821 - DNA, 15 bp, Homo sapiens
accattacctgcatc

SEQ ID NO: 198822 - DNA, 15 bp, Homo sapiens
caccattacctgcat

SEQ ID NO: 198823 - DNA, 15 bp, Homo sapiens
tcaccattacctgca

SEQ ID NO: 198824 - DNA, 15 bp, Homo sapiens
gtcaccattacctgc

SEQ ID NO: 198825 - DNA, 15 bp, Homo sapiens
cgtcaccattacctg

SEQ ID NO: 198826 - DNA, 15 bp, Homo sapiens
ccgtcaccattacct

SEQ ID NO: 198827 - DNA, 15 bp, Homo sapiens
gccgtcaccattacc

SEQ ID NO: 198828 - DNA, 15 bp, Homo sapiens
ggccgtcaccattac

SEQ ID NO: 198829 - DNA, 15 bp, Homo sapiens
tggccgtcaccatta

SEQ ID NO: 198830 - DNA, 15 bp, Homo sapiens
ttggccgtcaccatt

SEQ ID NO: 198831 - DNA, 15 bp, Homo sapiens
cttggccgtcaccat

SEQ ID NO: 198832 - DNA, 15 bp, Homo sapiens
ccttggccgtcacca

SEQ ID NO: 198833 - DNA, 15 bp, Homo sapiens
accttggccgtcacc

SEQ ID NO: 198834 - DNA, 15 bp, Homo sapiens
gaccttggccgtcac

SEQ ID NO: 198835 - DNA, 15 bp, Homo sapiens
tgaccttggccgtca

SEQ ID NO: 198836 - DNA, 15 bp, Homo sapiens
gtgaccttggccgtc

SEQ ID NO: 198837 - DNA, 15 bp, Homo sapiens
tgtgaccttggccgt

SEQ ID NO: 198838 - DNA, 15 bp, Homo sapiens
gtgtgaccttggccg

SEQ ID NO: 198839 - DNA, 15 bp, Homo sapiens
tgtgtgaccttggcc

SEQ ID NO: 198840 - DNA, 15 bp, Homo sapiens
ttgtgtgaccttggc

SEQ ID NO: 198841 - DNA, 15 bp, Homo sapiens
cttgtgtgaccttgg

SEQ ID NO: 198842 - DNA, 15 bp, Homo sapiens
acttgtgtgaccttg

SEQ ID NO: 198843 - DNA, 15 bp, Homo sapiens
aacttgtgtgacctt

SEQ ID NO: 198844 - DNA, 15 bp, Homo sapiens
aaacttgtgtgacct

SEQ ID NO: 198845 - DNA, 15 bp, Homo sapiens
aaaacttgtgtgacc

SEQ ID NO: 198846 - DNA, 15 bp, Homo sapiens
gaaaacttgtgtgac

SEQ ID NO: 198847 - DNA, 15 bp, Homo sapiens
ggaaaacttgtgtga

SEQ ID NO: 198848 - DNA, 15 bp, Homo sapiens
gggaaaacttgtgtg

SEQ ID NO: 198849 - DNA, 15 bp, Homo sapiens
ggggaaaacttgtgt

SEQ ID NO: 198850 - DNA, 15 bp, Homo sapiens
aggggaaaacttgtg

SEQ ID NO: 198851 - DNA, 15 bp, Homo sapiens
aaggggaaaacttgt

SEQ ID NO: 198852 - DNA, 15 bp, Homo sapiens
gaaggggaaaacttg

SEQ ID NO: 198853 - DNA, 15 bp, Homo sapiens
ggaaggggaaaactt

SEQ ID NO: 198854 - DNA, 15 bp, Homo sapiens
aggaaggggaaaact

SEQ ID NO: 198855 - DNA, 15 bp, Homo sapiens
caggaaggggaaaac

SEQ ID NO: 198856 - DNA, 15 bp, Homo sapiens
ccaggaaggggaaaa

SEQ ID NO: 198857 - DNA, 15 bp, Homo sapiens
accaggaaggggaaa

SEQ ID NO: 198858 - DNA, 15 bp, Homo sapiens
caccaggaaggggaa

SEQ ID NO: 198859 - DNA, 15 bp, Homo sapiens
acaccaggaagggga

SEQ ID NO: 198860 - DNA, 15 bp, Homo sapiens
cacaccaggaagggg

SEQ ID NO: 198861 - DNA, 15 bp, Homo sapiens
ccacaccaggaaggg

SEQ ID NO: 198862 - DNA, 15 bp, Homo sapiens
accacaccaggaagg

SEQ ID NO: 198863 - DNA, 15 bp, Homo sapiens
caccacaccaggaag

SEQ ID NO: 198864 - DNA, 15 bp, Homo sapiens
acaccacaccaggaa

SEQ ID NO: 198865 - DNA, 15 bp, Homo sapiens
aacaccacaccagga

SEQ ID NO: 198866 - DNA, 15 bp, Homo sapiens
taacaccacaccagg

SEQ ID NO: 198867 - DNA, 15 bp, Homo sapiens
ataacaccacaccag

SEQ ID NO: 198868 - DNA, 15 bp, Homo sapiens
aataacaccacacca

SEQ ID NO: 198869 - DNA, 15 bp, Homo sapiens
gaataacaccacacc

SEQ ID NO: 198870 - DNA, 15 bp, Homo sapiens
agaataacaccacac

SEQ ID NO: 198871 - DNA, 15 bp, Homo sapiens
gagaataacaccaca

SEQ ID NO: 198872 - DNA, 15 bp, Homo sapiens
ggagaataacaccac

SEQ ID NO: 198873 - DNA, 15 bp, Homo sapiens
aggagaataacacca

SEQ ID NO: 198874 - DNA, 15 bp, Homo sapiens
aaggagaataacacc

SEQ ID NO: 198875 - DNA, 15 bp, Homo sapiens
caaggagaataacac

SEQ ID NO: 198876 - DNA, 15 bp, Homo sapiens
gcaaggagaataaca

SEQ ID NO: 198877 - DNA, 15 bp, Homo sapiens
tgcaaggagaataac

SEQ ID NO: 198878 - DNA, 15 bp, Homo sapiens
ctgcaaggagaataa

SEQ ID NO: 198879 - DNA, 15 bp, Homo sapiens
tctgcaaggagaata

SEQ ID NO: 198880 - DNA, 15 bp, Homo sapiens
atctgcaaggagaat

SEQ ID NO: 198881 - DNA, 15 bp, Homo sapiens
catctgcaaggagaa

SEQ ID NO: 198882 - DNA, 15 bp, Homo sapiens
gcatctgcaaggaga

SEQ ID NO: 198883 - DNA, 15 bp, Homo sapiens
agcatctgcaaggag

SEQ ID NO: 198884 - DNA, 15 bp, Homo sapiens
tagcatctgcaagga

SEQ ID NO: 198885 - DNA, 15 bp, Homo sapiens
atagcatctgcaagg

SEQ ID NO: 198886 - DNA, 15 bp, Homo sapiens
gatagcatctgcaag

SEQ ID NO: 198887 - DNA, 15 bp, Homo sapiens
tgatagcatctgcaa

SEQ ID NO: 198888 - DNA, 15 bp, Homo sapiens
atgatagcatctgca

SEQ ID NO: 198889 - DNA, 15 bp, Homo sapiens
catgatagcatctgc

SEQ ID NO: 198890 - DNA, 15 bp, Homo sapiens
ccatgatagcatctg

SEQ ID NO: 198891 - DNA, 15 bp, Homo sapiens
tccatgatagcatct

SEQ ID NO: 198892 - DNA, 15 bp, Homo sapiens
ctccatgatagcatc

SEQ ID NO: 198893 - DNA, 15 bp, Homo sapiens
actccatgatagcat

SEQ ID NO: 198894 - DNA, 15 bp, Homo sapiens
cactccatgatagca

SEQ ID NO: 198895 - DNA, 15 bp, Homo sapiens
tcactccatgatagc

SEQ ID NO: 198896 - DNA, 15 bp, Homo sapiens
ctcactccatgatag

SEQ ID NO: 198897 - DNA, 15 bp, Homo sapiens
actcactccatgata

SEQ ID NO: 198898 - DNA, 15 bp, Homo sapiens
gactcactccatgat

SEQ ID NO: 198899 - DNA, 15 bp, Homo sapiens
tgactcactccatga

SEQ ID NO: 198900 - DNA, 15 bp, Homo sapiens
ctgactcactccatg

SEQ ID NO: 198901 - DNA, 15 bp, Homo sapiens
actgactcactccat

SEQ ID NO: 198902 - DNA, 15 bp, Homo sapiens
aactgactcactcca

SEQ ID NO: 198903 - DNA, 15 bp, Homo sapiens
caactgactcactcc

SEQ ID NO: 198904 - DNA, 15 bp, Homo sapiens
ccaactgactcactc

SEQ ID NO: 198905 - DNA, 15 bp, Homo sapiens
gccaactgactcact

SEQ ID NO: 198906 - DNA, 15 bp, Homo sapiens
ggccaactgactcac

SEQ ID NO: 198907 - DNA, 15 bp, Homo sapiens
aggccaactgactca

SEQ ID NO: 198908 - DNA, 15 bp, Homo sapiens
gaggccaactgactc

SEQ ID NO: 198909 - DNA, 15 bp, Homo sapiens
ggaggccaactgact

SEQ ID NO: 198910 - DNA, 15 bp, Homo sapiens
tggaggccaactgac

SEQ ID NO: 198911 - DNA, 15 bp, Homo sapiens
ctggaggccaactga

SEQ ID NO: 198912 - DNA, 15 bp, Homo sapiens
gctggaggccaactg

SEQ ID NO: 198913 - DNA, 15 bp, Homo sapiens
agctggaggccaact

SEQ ID NO: 198914 - DNA, 15 bp, Homo sapiens
tagctggaggccaac

SEQ ID NO: 198915 - DNA, 15 bp, Homo sapiens
ctagctggaggccaa

SEQ ID NO: 198916 - DNA, 15 bp, Homo sapiens
tctagctggaggcca

SEQ ID NO: 198917 - DNA, 15 bp, Homo sapiens
ttctagctggaggcc

SEQ ID NO: 198918 - DNA, 15 bp, Homo sapiens
cttctagctggaggc

SEQ ID NO: 198919 - DNA, 15 bp, Homo sapiens
ccttctagctggagg

SEQ ID NO: 198920 - DNA, 15 bp, Homo sapiens
accttctagctggag

SEQ ID NO: 198921 - DNA, 15 bp, Homo sapiens
caccttctagctgga

SEQ ID NO: 198922 - DNA, 15 bp, Homo sapiens
ccaccttctagctgg

SEQ ID NO: 198923 - DNA, 15 bp, Homo sapiens
gccaccttctagctg

SEQ ID NO: 198924 - DNA, 15 bp, Homo sapiens
tgccaccttctagct

SEQ ID NO: 198925 - DNA, 15 bp, Homo sapiens
gtgccaccttctagc

SEQ ID NO: 198926 - DNA, 15 bp, Homo sapiens
agtgccaccttctag

SEQ ID NO: 198927 - DNA, 15 bp, Homo sapiens
aagtgccaccttcta

SEQ ID NO: 198928 - DNA, 15 bp, Homo sapiens
caagtgccaccttct

SEQ ID NO: 198929 - DNA, 15 bp, Homo sapiens
ccaagtgccaccttc

SEQ ID NO: 198930 - DNA, 15 bp, Homo sapiens
tccaagtgccacctt

SEQ ID NO: 198931 - DNA, 15 bp, Homo sapiens
ttccaagtgccacct

SEQ ID NO: 198932 - DNA, 15 bp, Homo sapiens
tttccaagtgccacc

SEQ ID NO: 198933 - DNA, 15 bp, Homo sapiens
ttttccaagtgccac

SEQ ID NO: 198934 - DNA, 15 bp, Homo sapiens
cttttccaagtgcca

SEQ ID NO: 198935 - DNA, 15 bp, Homo sapiens
ccttttccaagtgcc

SEQ ID NO: 198936 - DNA, 15 bp, Homo sapiens
cccttttccaagtgc

SEQ ID NO: 198937 - DNA, 15 bp, Homo sapiens
gcccttttccaagtg

SEQ ID NO: 198938 - DNA, 15 bp, Homo sapiens
tgcccttttccaagt

SEQ ID NO: 198939 - DNA, 15 bp, Homo sapiens
gtgcccttttccaag

SEQ ID NO: 198940 - DNA, 15 bp, Homo sapiens
agtgcccttttccaa

SEQ ID NO: 198941 - DNA, 15 bp, Homo sapiens
cagtgcccttttcca

SEQ ID NO: 198942 - DNA, 15 bp, Homo sapiens
ccagtgcccttttcc

SEQ ID NO: 198943 - DNA, 15 bp, Homo sapiens
gccagtgcccttttc

SEQ ID NO: 198944 - DNA, 15 bp, Homo sapiens
agccagtgccctttt

SEQ ID NO: 198945 - DNA, 15 bp, Homo sapiens
cagccagtgcccttt

SEQ ID NO: 198946 - DNA, 15 bp, Homo sapiens
acagccagtgccctt

SEQ ID NO: 198947 - DNA, 15 bp, Homo sapiens
cacagccagtgccct

SEQ ID NO: 198948 - DNA, 15 bp, Homo sapiens
ccacagccagtgccc

SEQ ID NO: 198949 - DNA, 15 bp, Homo sapiens
accacagccagtgcc

SEQ ID NO: 198950 - DNA, 15 bp, Homo sapiens
caccacagccagtgc

SEQ ID NO: 198951 - DNA, 15 bp, Homo sapiens
ccaccacagccagtg

SEQ ID NO: 198952 - DNA, 15 bp, Homo sapiens
accaccacagccagt

SEQ ID NO: 198953 - DNA, 15 bp, Homo sapiens
taccaccacagccag

SEQ ID NO: 198954 - DNA, 15 bp, Homo sapiens
gtaccaccacagcca

SEQ ID NO: 198955 - DNA, 15 bp, Homo sapiens
agtaccaccacagcc

SEQ ID NO: 198956 - DNA, 15 bp, Homo sapiens
cagtaccaccacagc

SEQ ID NO: 198957 - DNA, 15 bp, Homo sapiens
ccagtaccaccacag

SEQ ID NO: 198958 - DNA, 15 bp, Homo sapiens
accagtaccaccaca

SEQ ID NO: 198959 - DNA, 15 bp, Homo sapiens
caccagtaccaccac

SEQ ID NO: 198960 - DNA, 15 bp, Homo sapiens
ccaccagtaccacca

SEQ ID NO: 198961 - DNA, 15 bp, Homo sapiens
cccaccagtaccacc

SEQ ID NO: 198962 - DNA, 15 bp, Homo sapiens
tcccaccagtaccac

SEQ ID NO: 198963 - DNA, 15 bp, Homo sapiens
atcccaccagtacca

SEQ ID NO: 198964 - DNA, 15 bp, Homo sapiens
aatcccaccagtacc

SEQ ID NO: 198965 - DNA, 15 bp, Homo sapiens
aaatcccaccagtac

SEQ ID NO: 198966 - DNA, 15 bp, Homo sapiens
taaatcccaccagta

SEQ ID NO: 198967 - DNA, 15 bp, Homo sapiens
ataaatcccaccagt

SEQ ID NO: 198968 - DNA, 15 bp, Homo sapiens
cataaatcccaccag

SEQ ID NO: 198969 - DNA, 15 bp, Homo sapiens
gcataaatcccacca

SEQ ID NO: 198970 - DNA, 15 bp, Homo sapiens
agcataaatcccacc

SEQ ID NO: 198971 - DNA, 15 bp, Homo sapiens
aagcataaatcccac

SEQ ID NO: 198972 - DNA, 15 bp, Homo sapiens
aaagcataaatccca

SEQ ID NO: 198973 - DNA, 15 bp, Homo sapiens
caaagcataaatccc

SEQ ID NO: 198974 - DNA, 15 bp, Homo sapiens
gcaaagcataaatcc

SEQ ID NO: 198975 - DNA, 15 bp, Homo sapiens
ggcaaagcataaatc

SEQ ID NO: 198976 - DNA, 15 bp, Homo sapiens
aggcaaagcataaat

SEQ ID NO: 198977 - DNA, 15 bp, Homo sapiens
aaggcaaagcataaa

SEQ ID NO: 198978 - DNA, 15 bp, Homo sapiens
taaggcaaagcataa

SEQ ID NO: 198979 - DNA, 15 bp, Homo sapiens
ataaggcaaagcata

SEQ ID NO: 198980 - DNA, 15 bp, Homo sapiens
cataaggcaaagcat

SEQ ID NO: 198981 - DNA, 15 bp, Homo sapiens
acataaggcaaagca

SEQ ID NO: 198982 - DNA, 15 bp, Homo sapiens
aacataaggcaaagc

SEQ ID NO: 198983 - DNA, 15 bp, Homo sapiens
taacataaggcaaag

SEQ ID NO: 198984 - DNA, 15 bp, Homo sapiens
gtaacataaggcaaa

SEQ ID NO: 198985 - DNA, 15 bp, Homo sapiens
ggtaacataaggcaa

SEQ ID NO: 198986 - DNA, 15 bp, Homo sapiens
gggtaacataaggca

SEQ ID NO: 198987 - DNA, 15 bp, Homo sapiens
tgggtaacataaggc

SEQ ID NO: 198988 - DNA, 15 bp, Homo sapiens
ctgggtaacataagg

SEQ ID NO: 198989 - DNA, 15 bp, Homo sapiens
cctgggtaacataag

SEQ ID NO: 198990 - DNA, 15 bp, Homo sapiens
ccctgggtaacataa

SEQ ID NO: 198991 - DNA, 15 bp, Homo sapiens
cccctgggtaacata

SEQ ID NO: 198992 - DNA, 15 bp, Homo sapiens
tcccctgggtaacat

SEQ ID NO: 198993 - DNA, 15 bp, Homo sapiens
ctcccctgggtaaca

SEQ ID NO: 198994 - DNA, 15 bp, Homo sapiens
cctcccctgggtaac

SEQ ID NO: 198995 - DNA, 15 bp, Homo sapiens
acctcccctgggtaa

SEQ ID NO: 198996 - DNA, 15 bp, Homo sapiens
tacctcccctgggta

SEQ ID NO: 198997 - DNA, 15 bp, Homo sapiens
gtacctcccctgggt

SEQ ID NO: 198998 - DNA, 15 bp, Homo sapiens
agtacctcccctggg

SEQ ID NO: 198999 - DNA, 15 bp, Homo sapiens
gagtacctcccctgg

SEQ ID NO: 199000 - DNA, 15 bp, Homo sapiens
agagtacctcccctg

SEQ ID NO: 199001 - DNA, 15 bp, Homo sapiens
cagagtacctcccct

SEQ ID NO: 199002 - DNA, 15 bp, Homo sapiens
ccagagtacctcccc

SEQ ID NO: 199003 - DNA, 15 bp, Homo sapiens
accagagtacctccc

SEQ ID NO: 199004 - DNA, 15 bp, Homo sapiens
caccagagtacctcc

SEQ ID NO: 199005 - DNA, 15 bp, Homo sapiens
acaccagagtacctc

SEQ ID NO: 199006 - DNA, 15 bp, Homo sapiens
gacaccagagtacct

SEQ ID NO: 199007 - DNA, 15 bp, Homo sapiens
ggacaccagagtacc

SEQ ID NO: 199008 - DNA, 15 bp, Homo sapiens
gggacaccagagtac

SEQ ID NO: 199009 - DNA, 15 bp, Homo sapiens
tgggacaccagagta

SEQ ID NO: 199010 - DNA, 15 bp, Homo sapiens
ttgggacaccagagt

SEQ ID NO: 199011 - DNA, 15 bp, Homo sapiens
cttgggacaccagag

SEQ ID NO: 199012 - DNA, 15 bp, Homo sapiens
gcttgggacaccaga

SEQ ID NO: 199013 - DNA, 15 bp, Homo sapiens
tgcttgggacaccag

SEQ ID NO: 199014 - DNA, 15 bp, Homo sapiens
ttgcttgggacacca

SEQ ID NO: 199015 - DNA, 15 bp, Homo sapiens
attgcttgggacacc

SEQ ID NO: 199016 - DNA, 15 bp, Homo sapiens
cattgcttgggacac

SEQ ID NO: 199017 - DNA, 15 bp, Homo sapiens
ccattgcttgggaca

SEQ ID NO: 199018 - DNA, 15 bp, Homo sapiens
cccattgcttgggac

SEQ ID NO: 199019 - DNA, 15 bp, Homo sapiens
tcccattgcttggga

SEQ ID NO: 199020 - DNA, 15 bp, Homo sapiens
ctcccattgcttggg

SEQ ID NO: 199021 - DNA, 15 bp, Homo sapiens
cctcccattgcttgg

SEQ ID NO: 199022 - DNA, 15 bp, Homo sapiens
ccctcccattgcttg

SEQ ID NO: 199023 - DNA, 15 bp, Homo sapiens
cccctcccattgctt

SEQ ID NO: 199024 - DNA, 15 bp, Homo sapiens
gcccctcccattgct

SEQ ID NO: 199025 - DNA, 15 bp, Homo sapiens
ggcccctcccattgc

SEQ ID NO: 199026 - DNA, 15 bp, Homo sapiens
tggcccctcccattg

SEQ ID NO: 199027 - DNA, 15 bp, Homo sapiens
atggcccctcccatt

SEQ ID NO: 199028 - DNA, 15 bp, Homo sapiens
tatggcccctcccat

SEQ ID NO: 199029 - DNA, 15 bp, Homo sapiens
ctatggcccctccca

SEQ ID NO: 199030 - DNA, 15 bp, Homo sapiens
tctatggcccctccc

SEQ ID NO: 199031 - DNA, 15 bp, Homo sapiens
ctctatggcccctcc

SEQ ID NO: 199032 - DNA, 15 bp, Homo sapiens
gctctatggcccctc

SEQ ID NO: 199033 - DNA, 15 bp, Homo sapiens
agctctatggcccct

SEQ ID NO: 199034 - DNA, 15 bp, Homo sapiens
gagctctatggcccc

SEQ ID NO: 199035 - DNA, 15 bp, Homo sapiens
gggagctctatggcc

SEQ ID NO: 199036 - DNA, 15 bp, Homo sapiens
tgggagctctatggc

SEQ ID NO: 199037 - DNA, 15 bp, Homo sapiens
ttgggagctctatgg

SEQ ID NO: 199038 - DNA, 15 bp, Homo sapiens
tttgggagctctatg

SEQ ID NO: 199039 - DNA, 15 bp, Homo sapiens
ttttgggagctctat

SEQ ID NO: 199040 - DNA, 15 bp, Homo sapiens
cttttgggagctcta

SEQ ID NO: 199041 - DNA, 15 bp, Homo sapiens
acttttgggagctct

SEQ ID NO: 199042 - DNA, 15 bp, Homo sapiens
aacttttgggagctc

SEQ ID NO: 199043 - DNA, 15 bp, Homo sapiens
aaacttttgggagct

SEQ ID NO: 199044 - DNA, 15 bp, Homo sapiens
gaaacttttgggagc

SEQ ID NO: 199045 - DNA, 15 bp, Homo sapiens
agaaacttttgggag

SEQ ID NO: 199046 - DNA, 15 bp, Homo sapiens
cagaaacttttggga

SEQ ID NO: 199047 - DNA, 15 bp, Homo sapiens
acagaaacttttggg

SEQ ID NO: 199048 - DNA, 15 bp, Homo sapiens
aacagaaacttttgg

SEQ ID NO: 199049 - DNA, 15 bp, Homo sapiens
aaacagaaacttttg

SEQ ID NO: 199050 - DNA, 15 bp, Homo sapiens
aaaacagaaactttt

SEQ ID NO: 199051 - DNA, 15 bp, Homo sapiens
aaaaacagaaacttt

SEQ ID NO: 199052 - DNA, 15 bp, Homo sapiens
aaaaaacagaaactt

SEQ ID NO: 199053 - DNA, 15 bp, Homo sapiens
aaaaaaacagaaact

SEQ ID NO: 199054 - DNA, 15 bp, Homo sapiens
aaaaaaaacagaaac

SEQ ID NO: 199055 - DNA, 15 bp, Homo sapiens
aaaaaaaaacagaaa

SEQ ID NO: 199056 - DNA, 15 bp, Homo sapiens
aaaaaaaaaacagaa

SEQ ID NO: 199057 - DNA, 15 bp, Homo sapiens
aaaaaaaaaaacaga

SEQ ID NO: 199058 - DNA, 15 bp, Homo sapiens
aaaaaaaaaaaacag

SEQ ID NO: 199059 - DNA, 15 bp, Homo sapiens
cacaaaaaaaaaaaa

SEQ ID NO: 199060 - DNA, 15 bp, Homo sapiens
acacaaaaaaaaaaa

SEQ ID NO: 199061 - DNA, 15 bp, Homo sapiens
cacacaaaaaaaaaa

SEQ ID NO: 199062 - DNA, 15 bp, Homo sapiens
acacacaaaaaaaaa

SEQ ID NO: 199063 - DNA, 15 bp, Homo sapiens
cacacacaaaaaaaa

SEQ ID NO: 199064 - DNA, 15 bp, Homo sapiens
acacacacacaaaaa

SEQ ID NO: 199065 - DNA, 15 bp, Homo sapiens
aacacacacacacac

SEQ ID NO: 199066 - DNA, 15 bp, Homo sapiens
taacacacacacaca

SEQ ID NO: 199067 - DNA, 15 bp, Homo sapiens
ttaacacacacacac

SEQ ID NO: 199068 - DNA, 15 bp, Homo sapiens
cttaacacacacaca

SEQ ID NO: 199069 - DNA, 15 bp, Homo sapiens
gcttaacacacacac

SEQ ID NO: 199070 - DNA, 15 bp, Homo sapiens
agcttaacacacaca

SEQ ID NO: 199071 - DNA, 15 bp, Homo sapiens
tagcttaacacacac

SEQ ID NO: 199072 - DNA, 15 bp, Homo sapiens
gtagcttaacacaca

SEQ ID NO: 199073 - DNA, 15 bp, Homo sapiens
ggtagcttaacacac

SEQ ID NO: 199074 - DNA, 15 bp, Homo sapiens
tggtagcttaacaca

SEQ ID NO: 199075 - DNA, 15 bp, Homo sapiens
ctggtagcttaacac

SEQ ID NO: 199076 - DNA, 15 bp, Homo sapiens
cctggtagcttaaca

SEQ ID NO: 199077 - DNA, 15 bp, Homo sapiens
tcctggtagcttaac

SEQ ID NO: 199078 - DNA, 15 bp, Homo sapiens
ctcctggtagcttaa

SEQ ID NO: 199079 - DNA, 15 bp, Homo sapiens
cctcctggtagctta

SEQ ID NO: 199080 - DNA, 15 bp, Homo sapiens
tcctcctggtagctt

SEQ ID NO: 199081 - DNA, 15 bp, Homo sapiens
ctcctcctggtagct

SEQ ID NO: 199082 - DNA, 15 bp, Homo sapiens
actcctcctggtagc

SEQ ID NO: 199083 - DNA, 15 bp, Homo sapiens
cactcctcctggtag

SEQ ID NO: 199084 - DNA, 15 bp, Homo sapiens
tcactcctcctggta

SEQ ID NO: 199085 - DNA, 15 bp, Homo sapiens
ttcactcctcctggt

SEQ ID NO: 199086 - DNA, 15 bp, Homo sapiens
cttcactcctcctgg

SEQ ID NO: 199087 - DNA, 15 bp, Homo sapiens
ccttcactcctcctg

SEQ ID NO: 199088 - DNA, 15 bp, Homo sapiens
cccttcactcctcct

SEQ ID NO: 199089 - DNA, 15 bp, Homo sapiens
ccccttcactcctcc

SEQ ID NO: 199090 - DNA, 15 bp, Homo sapiens
gccccttcactcctc

SEQ ID NO: 199091 - DNA, 15 bp, Homo sapiens
tgccccttcactcct

SEQ ID NO: 199092 - DNA, 15 bp, Homo sapiens
ttgccccttcactcc

SEQ ID NO: 199093 - DNA, 15 bp, Homo sapiens
tttgccccttcactc

SEQ ID NO: 199094 - DNA, 15 bp, Homo sapiens
ttttgccccttcact

SEQ ID NO: 199095 - DNA, 15 bp, Homo sapiens
gttttgccccttcac

SEQ ID NO: 199096 - DNA, 15 bp, Homo sapiens
ggttttgccccttca

SEQ ID NO: 199097 - DNA, 15 bp, Homo sapiens
tggttttgccccttc

SEQ ID NO: 199098 - DNA, 15 bp, Homo sapiens
ctggttttgcccctt

SEQ ID NO: 199099 - DNA, 15 bp, Homo sapiens
cctggttttgcccct

SEQ ID NO: 199100 - DNA, 15 bp, Homo sapiens
tcctggttttgcccc

SEQ ID NO: 199101 - DNA, 15 bp, Homo sapiens
ctcctggttttgccc

SEQ ID NO: 199102 - DNA, 15 bp, Homo sapiens
cctcctggttttgcc

SEQ ID NO: 199103 - DNA, 15 bp, Homo sapiens
ccctcctggttttgc

SEQ ID NO: 199104 - DNA, 15 bp, Homo sapiens
tccctcctggttttg

SEQ ID NO: 199105 - DNA, 15 bp, Homo sapiens
ctccctcctggtttt

SEQ ID NO: 199106 - DNA, 15 bp, Homo sapiens
cctccctcctggttt

SEQ ID NO: 199107 - DNA, 15 bp, Homo sapiens
acctccctcctggtt

SEQ ID NO: 199108 - DNA, 15 bp, Homo sapiens
cacctccctcctggt

SEQ ID NO: 199109 - DNA, 15 bp, Homo sapiens
ccacctccctcctgg

SEQ ID NO: 199110 - DNA, 15 bp, Homo sapiens
cccacctccctcctg

SEQ ID NO: 199111 - DNA, 15 bp, Homo sapiens
acccacctccctcct

SEQ ID NO: 199112 - DNA, 15 bp, Homo sapiens
gacccacctccctcc

SEQ ID NO: 199113 - DNA, 15 bp, Homo sapiens
tgacccacctccctc

SEQ ID NO: 199114 - DNA, 15 bp, Homo sapiens
ctgacccacctccct

SEQ ID NO: 199115 - DNA, 15 bp, Homo sapiens
cctgacccacctccc

SEQ ID NO: 199116 - DNA, 15 bp, Homo sapiens
gcctgacccacctcc

SEQ ID NO: 199117 - DNA, 15 bp, Homo sapiens
tgcctgacccacctc

SEQ ID NO: 199118 - DNA, 15 bp, Homo sapiens
ttgcctgacccacct

SEQ ID NO: 199119 - DNA, 15 bp, Homo sapiens
cttgcctgacccacc

SEQ ID NO: 199120 - DNA, 15 bp, Homo sapiens
acttgcctgacccac

SEQ ID NO: 199121 - DNA, 15 bp, Homo sapiens
gacttgcctgaccca

SEQ ID NO: 199122 - DNA, 15 bp, Homo sapiens
ggacttgcctgaccc

SEQ ID NO: 199123 - DNA, 15 bp, Homo sapiens
tggacttgcctgacc

SEQ ID NO: 199124 - DNA, 15 bp, Homo sapiens
atggacttgcctgac

SEQ ID NO: 199125 - DNA, 15 bp, Homo sapiens
catggacttgcctga

SEQ ID NO: 199126 - DNA, 15 bp, Homo sapiens
gcatggacttgcctg

SEQ ID NO: 199127 - DNA, 15 bp, Homo sapiens
agcatggacttgcct

SEQ ID NO: 199128 - DNA, 15 bp, Homo sapiens
gagcatggacttgcc

SEQ ID NO: 199129 - DNA, 15 bp, Homo sapiens
agagcatggacttgc

SEQ ID NO: 199130 - DNA, 15 bp, Homo sapiens
cagagcatggacttg

SEQ ID NO: 199131 - DNA, 15 bp, Homo sapiens
ccagagcatggactt

SEQ ID NO: 199132 - DNA, 15 bp, Homo sapiens
gccagagcatggact

SEQ ID NO: 199133 - DNA, 15 bp, Homo sapiens
agccagagcatggac

SEQ ID NO: 199134 - DNA, 15 bp, Homo sapiens
gagccagagcatgga

SEQ ID NO: 199135 - DNA, 15 bp, Homo sapiens
agagccagagcatgg

SEQ ID NO: 199136 - DNA, 15 bp, Homo sapiens
gagagccagagcatg

SEQ ID NO: 199137 - DNA, 15 bp, Homo sapiens
ggagagccagagcat

SEQ ID NO: 199138 - DNA, 15 bp, Homo sapiens
tggagagccagagca

SEQ ID NO: 199139 - DNA, 15 bp, Homo sapiens
gtggagagccagagc

SEQ ID NO: 199140 - DNA, 15 bp, Homo sapiens
tgtggagagccagag

SEQ ID NO: 199141 - DNA, 15 bp, Homo sapiens
ctgtggagagccaga

SEQ ID NO: 199142 - DNA, 15 bp, Homo sapiens
gcctgtggagagcca

SEQ ID NO: 199143 - DNA, 15 bp, Homo sapiens
tgcctgtggagagcc

SEQ ID NO: 199144 - DNA, 15 bp, Homo sapiens
ctgcctgtggagagc

SEQ ID NO: 199145 - DNA, 15 bp, Homo sapiens
tctgcctgtggagag

SEQ ID NO: 199146 - DNA, 15 bp, Homo sapiens
gtctgcctgtggaga

SEQ ID NO: 199147 - DNA, 15 bp, Homo sapiens
cgtctgcctgtggag

SEQ ID NO: 199148 - DNA, 15 bp, Homo sapiens
gcgtctgcctgtgga

SEQ ID NO: 199149 - DNA, 15 bp, Homo sapiens
tgcgtctgcctgtgg

SEQ ID NO: 199150 - DNA, 15 bp, Homo sapiens
ttgcgtctgcctgtg

SEQ ID NO: 199151 - DNA, 15 bp, Homo sapiens
cttgcgtctgcctgt

SEQ ID NO: 199152 - DNA, 15 bp, Homo sapiens
gcttgcgtctgcctg

SEQ ID NO: 199153 - DNA, 15 bp, Homo sapiens
tgcttgcgtctgcct

SEQ ID NO: 199154 - DNA, 15 bp, Homo sapiens
ctgcttgcgtctgcc

SEQ ID NO: 199155 - DNA, 15 bp, Homo sapiens
gctgcttgcgtctgc

SEQ ID NO: 199156 - DNA, 15 bp, Homo sapiens
tgctgcttgcgtctg

SEQ ID NO: 199157 - DNA, 15 bp, Homo sapiens
ctgctgcttgcgtct

SEQ ID NO: 199158 - DNA, 15 bp, Homo sapiens
gctgctgcttgcgtc

SEQ ID NO: 199159 - DNA, 15 bp, Homo sapiens
ggctgctgcttgcgt

SEQ ID NO: 199160 - DNA, 15 bp, Homo sapiens
gggctgctgcttgcg

SEQ ID NO: 199161 - DNA, 15 bp, Homo sapiens
agggctgctgcttgc

SEQ ID NO: 199162 - DNA, 15 bp, Homo sapiens
tagggctgctgcttg

SEQ ID NO: 199163 - DNA, 15 bp, Homo sapiens
ctagggctgctgctt

SEQ ID NO: 199164 - DNA, 15 bp, Homo sapiens
actagggctgctgct

SEQ ID NO: 199165 - DNA, 15 bp, Homo sapiens
cactagggctgctgc

SEQ ID NO: 199166 - DNA, 15 bp, Homo sapiens
ccactagggctgctg

SEQ ID NO: 199167 - DNA, 15 bp, Homo sapiens
cccactagggctgct

SEQ ID NO: 199168 - DNA, 15 bp, Homo sapiens
tcccactagggctgc

SEQ ID NO: 199169 - DNA, 15 bp, Homo sapiens
atcccactagggctg

SEQ ID NO: 199170 - DNA, 15 bp, Homo sapiens
aatcccactagggct

SEQ ID NO: 199171 - DNA, 15 bp, Homo sapiens
caatcccactagggc

SEQ ID NO: 199172 - DNA, 15 bp, Homo sapiens
ccaatcccactaggg

SEQ ID NO: 199173 - DNA, 15 bp, Homo sapiens
tccaatcccactagg

SEQ ID NO: 199174 - DNA, 15 bp, Homo sapiens
ctccaatcccactag

SEQ ID NO: 199175 - DNA, 15 bp, Homo sapiens
cctccaatcccacta

SEQ ID NO: 199176 - DNA, 15 bp, Homo sapiens
tcctccaatcccact

SEQ ID NO: 199177 - DNA, 15 bp, Homo sapiens
gtcctccaatcccac

SEQ ID NO: 199178 - DNA, 15 bp, Homo sapiens
tgtcctccaatccca

SEQ ID NO: 199179 - DNA, 15 bp, Homo sapiens
ctgtcctccaatccc

SEQ ID NO: 199180 - DNA, 15 bp, Homo sapiens
actgtcctccaatcc

SEQ ID NO: 199181 - DNA, 15 bp, Homo sapiens
aactgtcctccaatc

SEQ ID NO: 199182 - DNA, 15 bp, Homo sapiens
aaactgtcctccaat

SEQ ID NO: 199183 - DNA, 15 bp, Homo sapiens
caaactgtcctccaa

SEQ ID NO: 199184 - DNA, 15 bp, Homo sapiens
gcaaactgtcctcca

SEQ ID NO: 199185 - DNA, 15 bp, Homo sapiens
agcaaactgtcctcc

SEQ ID NO: 199186 - DNA, 15 bp, Homo sapiens
cagcaaactgtcctc

SEQ ID NO: 199187 - DNA, 15 bp, Homo sapiens
ccagcaaactgtcct

SEQ ID NO: 199188 - DNA, 15 bp, Homo sapiens
gccagcaaactgtcc

SEQ ID NO: 199189 - DNA, 15 bp, Homo sapiens
agccagcaaactgtc

SEQ ID NO: 199190 - DNA, 15 bp, Homo sapiens
cagccagcaaactgt

SEQ ID NO: 199191 - DNA, 15 bp, Homo sapiens
gcagccagcaaactg

SEQ ID NO: 199192 - DNA, 15 bp, Homo sapiens
agcagccagcaaact

SEQ ID NO: 199193 - DNA, 15 bp, Homo sapiens
cagcagccagcaaac

SEQ ID NO: 199194 - DNA, 15 bp, Homo sapiens
ccagcagccagcaaa

SEQ ID NO: 199195 - DNA, 15 bp, Homo sapiens
cccagcagccagcaa

SEQ ID NO: 199196 - DNA, 15 bp, Homo sapiens
ccccagcagccagca

SEQ ID NO: 199197 - DNA, 15 bp, Homo sapiens
accccagcagccagc

SEQ ID NO: 199198 - DNA, 15 bp, Homo sapiens
taccccagcagccag

SEQ ID NO: 199199 - DNA, 15 bp, Homo sapiens
ctaccccagcagcca

SEQ ID NO: 199200 - DNA, 15 bp, Homo sapiens
actaccccagcagcc

SEQ ID NO: 199201 - DNA, 15 bp, Homo sapiens
cactaccccagcagc

SEQ ID NO: 199202 - DNA, 15 bp, Homo sapiens
acactaccccagcag

SEQ ID NO: 199203 - DNA, 15 bp, Homo sapiens
aacactaccccagca

SEQ ID NO: 199204 - DNA, 15 bp, Homo sapiens
gaacactaccccagc

SEQ ID NO: 199205 - DNA, 15 bp, Homo sapiens
ggaacactaccccag

SEQ ID NO: 199206 - DNA, 15 bp, Homo sapiens
tggaacactacccca

SEQ ID NO: 199207 - DNA, 15 bp, Homo sapiens
ttggaacactacccc

SEQ ID NO: 199208 - DNA, 15 bp, Homo sapiens
cttggaacactaccc

SEQ ID NO: 199209 - DNA, 15 bp, Homo sapiens
ccttggaacactacc

SEQ ID NO: 199210 - DNA, 15 bp, Homo sapiens
tccttggaacactac

SEQ ID NO: 199211 - DNA, 15 bp, Homo sapiens
ctccttggaacacta

SEQ ID NO: 199212 - DNA, 15 bp, Homo sapiens
cctccttggaacact

SEQ ID NO: 199213 - DNA, 15 bp, Homo sapiens
tcctccttggaacac

SEQ ID NO: 199214 - DNA, 15 bp, Homo sapiens
ctcctccttggaaca

SEQ ID NO: 199215 - DNA, 15 bp, Homo sapiens
gctcctccttggaac

SEQ ID NO: 199216 - DNA, 15 bp, Homo sapiens
tgctcctccttggaa

SEQ ID NO: 199217 - DNA, 15 bp, Homo sapiens
gtgctcctccttgga

SEQ ID NO: 199218 - DNA, 15 bp, Homo sapiens
tgtgctcctccttgg

SEQ ID NO: 199219 - DNA, 15 bp, Homo sapiens
ctgtgctcctccttg

SEQ ID NO: 199220 - DNA, 15 bp, Homo sapiens
gctgtgctcctcctt

SEQ ID NO: 199221 - DNA, 15 bp, Homo sapiens
agctgtgctcctcct

SEQ ID NO: 199222 - DNA, 15 bp, Homo sapiens
cagctgtgctcctcc

SEQ ID NO: 199223 - DNA, 15 bp, Homo sapiens
gcagctgtgctcctc

SEQ ID NO: 199224 - DNA, 15 bp, Homo sapiens
ggcagctgtgctcct

SEQ ID NO: 199225 - DNA, 15 bp, Homo sapiens
aggcagctgtgctcc

SEQ ID NO: 199226 - DNA, 15 bp, Homo sapiens
gaggcagctgtgctc

SEQ ID NO: 199227 - DNA, 15 bp, Homo sapiens
agaggcagctgtgct

SEQ ID NO: 199228 - DNA, 15 bp, Homo sapiens
cagaggcagctgtgc

SEQ ID NO: 199229 - DNA, 15 bp, Homo sapiens
gcagaggcagctgtg

SEQ ID NO: 199230 - DNA, 15 bp, Homo sapiens
agcagaggcagctgt

SEQ ID NO: 199231 - DNA, 15 bp, Homo sapiens
cagcagaggcagctg

SEQ ID NO: 199232 - DNA, 15 bp, Homo sapiens
gcagcagaggcagct

SEQ ID NO: 199233 - DNA, 15 bp, Homo sapiens
gtgcagcagaggcag

SEQ ID NO: 199234 - DNA, 15 bp, Homo sapiens
tgtgcagcagaggca

SEQ ID NO: 199235 - DNA, 15 bp, Homo sapiens
ctgtgcagcagaggc

SEQ ID NO: 199236 - DNA, 15 bp, Homo sapiens
tctgtgcagcagagg

SEQ ID NO: 199237 - DNA, 15 bp, Homo sapiens
ttctgtgcagcagag

SEQ ID NO: 199238 - DNA, 15 bp, Homo sapiens
cttctgtgcagcaga

SEQ ID NO: 199239 - DNA, 15 bp, Homo sapiens
tcttctgtgcagcag

SEQ ID NO: 199240 - DNA, 15 bp, Homo sapiens
ctcttctgtgcagca

SEQ ID NO: 199241 - DNA, 15 bp, Homo sapiens
actcttctgtgcagc

SEQ ID NO: 199242 - DNA, 15 bp, Homo sapiens
cactcttctgtgcag

SEQ ID NO: 199243 - DNA, 15 bp, Homo sapiens
gcactcttctgtgca

SEQ ID NO: 199244 - DNA, 15 bp, Homo sapiens
tgcactcttctgtgc

SEQ ID NO: 199245 - DNA, 15 bp, Homo sapiens
ttgcactcttctgtg

SEQ ID NO: 199246 - DNA, 15 bp, Homo sapiens
tttgcactcttctgt

SEQ ID NO: 199247 - DNA, 15 bp, Homo sapiens
atttgcactcttctg

SEQ ID NO: 199248 - DNA, 15 bp, Homo sapiens
catttgcactcttct

SEQ ID NO: 199249 - DNA, 15 bp, Homo sapiens
tcatttgcactcttc

SEQ ID NO: 199250 - DNA, 15 bp, Homo sapiens
ctcatttgcactctt

SEQ ID NO: 199251 - DNA, 15 bp, Homo sapiens
cctcatttgcactct

SEQ ID NO: 199252 - DNA, 15 bp, Homo sapiens
ccctcatttgcactc

SEQ ID NO: 199253 - DNA, 15 bp, Homo sapiens
cccctcatttgcact

SEQ ID NO: 199254 - DNA, 15 bp, Homo sapiens
ccccctcatttgcac

SEQ ID NO: 199255 - DNA, 15 bp, Homo sapiens
cccccctcatttgca

SEQ ID NO: 199256 - DNA, 15 bp, Homo sapiens
acccccctcatttgc

SEQ ID NO: 199257 - DNA, 15 bp, Homo sapiens
cacccccctcatttg

SEQ ID NO: 199258 - DNA, 15 bp, Homo sapiens
acacccccctcattt

SEQ ID NO: 199259 - DNA, 15 bp, Homo sapiens
tacacccccctcatt

SEQ ID NO: 199260 - DNA, 15 bp, Homo sapiens
ctacacccccctcat

SEQ ID NO: 199261 - DNA, 15 bp, Homo sapiens
gctacacccccctca

SEQ ID NO: 199262 - DNA, 15 bp, Homo sapiens
ggctacacccccctc

SEQ ID NO: 199263 - DNA, 15 bp, Homo sapiens
tggctacacccccct

SEQ ID NO: 199264 - DNA, 15 bp, Homo sapiens
ctggctacacccccc

SEQ ID NO: 199265 - DNA, 15 bp, Homo sapiens
gctggctacaccccc

SEQ ID NO: 199266 - DNA, 15 bp, Homo sapiens
tgctggctacacccc

SEQ ID NO: 199267 - DNA, 15 bp, Homo sapiens
ctgctggctacaccc

SEQ ID NO: 199268 - DNA, 15 bp, Homo sapiens
gctgctggctacacc

SEQ ID NO: 199269 - DNA, 15 bp, Homo sapiens
tgctgctggctacac

SEQ ID NO: 199270 - DNA, 15 bp, Homo sapiens
ctgctgctggctaca

SEQ ID NO: 199271 - DNA, 15 bp, Homo sapiens
actgctgctggctac

SEQ ID NO: 199272 - DNA, 15 bp, Homo sapiens
tactgctgctggcta

SEQ ID NO: 199273 - DNA, 15 bp, Homo sapiens
ttactgctgctggct

SEQ ID NO: 199274 - DNA, 15 bp, Homo sapiens
cttactgctgctggc

SEQ ID NO: 199275 - DNA, 15 bp, Homo sapiens
tcttactgctgctgg

SEQ ID NO: 199276 - DNA, 15 bp, Homo sapiens
gtcttactgctgctg

SEQ ID NO: 199277 - DNA, 15 bp, Homo sapiens
ggtcttactgctgct

SEQ ID NO: 199278 - DNA, 15 bp, Homo sapiens
gggtcttactgctgc

SEQ ID NO: 199279 - DNA, 15 bp, Homo sapiens
tgggtcttactgctg

SEQ ID NO: 199280 - DNA, 15 bp, Homo sapiens
gtgggtcttactgct

SEQ ID NO: 199281 - DNA, 15 bp, Homo sapiens
ggtgggtcttactgc

SEQ ID NO: 199282 - DNA, 15 bp, Homo sapiens
aggtgggtcttactg

SEQ ID NO: 199283 - DNA, 15 bp, Homo sapiens
taggtgggtcttact

SEQ ID NO: 199284 - DNA, 15 bp, Homo sapiens
ctaggtgggtcttac

SEQ ID NO: 199285 - DNA, 15 bp, Homo sapiens
gctaggtgggtctta

SEQ ID NO: 199286 - DNA, 15 bp, Homo sapiens
agctaggtgggtctt

SEQ ID NO: 199287 - DNA, 15 bp, Homo sapiens
aagctaggtgggtct

SEQ ID NO: 199288 - DNA, 15 bp, Homo sapiens
gaagctaggtgggtc

SEQ ID NO: 199289 - DNA, 15 bp, Homo sapiens
ggaagctaggtgggt

SEQ ID NO: 199290 - DNA, 15 bp, Homo sapiens
gggaagctaggtggg

SEQ ID NO: 199291 - DNA, 15 bp, Homo sapiens
agggaagctaggtgg

SEQ ID NO: 199292 - DNA, 15 bp, Homo sapiens
cagggaagctaggtg

SEQ ID NO: 199293 - DNA, 15 bp, Homo sapiens
gcagggaagctaggt

SEQ ID NO: 199294 - DNA, 15 bp, Homo sapiens
tgcagggaagctagg

SEQ ID NO: 199295 - DNA, 15 bp, Homo sapiens
gtgcagggaagctag

SEQ ID NO: 199296 - DNA, 15 bp, Homo sapiens
agtgcagggaagcta

SEQ ID NO: 199297 - DNA, 15 bp, Homo sapiens
aagtgcagggaagct

SEQ ID NO: 199298 - DNA, 15 bp, Homo sapiens
caagtgcagggaagc

SEQ ID NO: 199299 - DNA, 15 bp, Homo sapiens
ccaagtgcagggaag

SEQ ID NO: 199300 - DNA, 15 bp, Homo sapiens
gccaagtgcagggaa

SEQ ID NO: 199301 - DNA, 15 bp, Homo sapiens
tgccaagtgcaggga

SEQ ID NO: 199302 - DNA, 15 bp, Homo sapiens
ttgccaagtgcaggg

SEQ ID NO: 199303 - DNA, 15 bp, Homo sapiens
cttgccaagtgcagg

SEQ ID NO: 199304 - DNA, 15 bp, Homo sapiens
ccttgccaagtgcag

SEQ ID NO: 199305 - DNA, 15 bp, Homo sapiens
gccttgccaagtgca

SEQ ID NO: 199306 - DNA, 15 bp, Homo sapiens
tgccttgccaagtgc

SEQ ID NO: 199307 - DNA, 15 bp, Homo sapiens
ctgccttgccaagtg

SEQ ID NO: 199308 - DNA, 15 bp, Homo sapiens
cctgccttgccaagt

SEQ ID NO: 199309 - DNA, 15 bp, Homo sapiens
acctgccttgccaag

SEQ ID NO: 199310 - DNA, 15 bp, Homo sapiens
gacctgccttgccaa

SEQ ID NO: 199311 - DNA, 15 bp, Homo sapiens
agacctgccttgcca

SEQ ID NO: 199312 - DNA, 15 bp, Homo sapiens
gagacctgccttgcc

SEQ ID NO: 199313 - DNA, 15 bp, Homo sapiens
tgagacctgccttgc

SEQ ID NO: 199314 - DNA, 15 bp, Homo sapiens
gtgagacctgccttg

SEQ ID NO: 199315 - DNA, 15 bp, Homo sapiens
tgtgagacctgcctt

SEQ ID NO: 199316 - DNA, 15 bp, Homo sapiens
atgtgagacctgcct

SEQ ID NO: 199317 - DNA, 15 bp, Homo sapiens
gatgtgagacctgcc

SEQ ID NO: 199318 - DNA, 15 bp, Homo sapiens
agatgtgagacctgc

SEQ ID NO: 199319 - DNA, 15 bp, Homo sapiens
cagatgtgagacctg

SEQ ID NO: 199320 - DNA, 15 bp, Homo sapiens
gcagatgtgagacct

SEQ ID NO: 199321 - DNA, 15 bp, Homo sapiens
tgcagatgtgagacc

SEQ ID NO: 199322 - DNA, 15 bp, Homo sapiens
ctgcagatgtgagac

SEQ ID NO: 199323 - DNA, 15 bp, Homo sapiens
gctgcagatgtgaga

SEQ ID NO: 199324 - DNA, 15 bp, Homo sapiens
tgctgcagatgtgag

SEQ ID NO: 199325 - DNA, 15 bp, Homo sapiens
atgctgcagatgtga

SEQ ID NO: 199326 - DNA, 15 bp, Homo sapiens
aatgctgcagatgtg

SEQ ID NO: 199327 - DNA, 15 bp, Homo sapiens
gaatgctgcagatgt

SEQ ID NO: 199328 - DNA, 15 bp, Homo sapiens
ggaatgctgcagatg

SEQ ID NO: 199329 - DNA, 15 bp, Homo sapiens
tggaatgctgcagat

SEQ ID NO: 199330 - DNA, 15 bp, Homo sapiens
gtggaatgctgcaga

SEQ ID NO: 199331 - DNA, 15 bp, Homo sapiens
agtggaatgctgcag

SEQ ID NO: 199332 - DNA, 15 bp, Homo sapiens
tagtggaatgctgca

SEQ ID NO: 199333 - DNA, 15 bp, Homo sapiens
ttagtggaatgctgc

SEQ ID NO: 199334 - DNA, 15 bp, Homo sapiens
gttagtggaatgctg

SEQ ID NO: 199335 - DNA, 15 bp, Homo sapiens
tgttagtggaatgct

SEQ ID NO: 199336 - DNA, 15 bp, Homo sapiens
ctgttagtggaatgc

SEQ ID NO: 199337 - DNA, 15 bp, Homo sapiens
gctgttagtggaatg

SEQ ID NO: 199338 - DNA, 15 bp, Homo sapiens
tgctgttagtggaat

SEQ ID NO: 199339 - DNA, 15 bp, Homo sapiens
ttgctgttagtggaa

SEQ ID NO: 199340 - DNA, 15 bp, Homo sapiens
gttgctgttagtgga

SEQ ID NO: 199341 - DNA, 15 bp, Homo sapiens
tgttgctgttagtgg

SEQ ID NO: 199342 - DNA, 15 bp, Homo sapiens
ctgttgctgttagtg

SEQ ID NO: 199343 - DNA, 15 bp, Homo sapiens
gctgttgctgttagt

SEQ ID NO: 199344 - DNA, 15 bp, Homo sapiens
agctgttgctgttag

SEQ ID NO: 199345 - DNA, 15 bp, Homo sapiens
tagctgttgctgtta

SEQ ID NO: 199346 - DNA, 15 bp, Homo sapiens
ctagctgttgctgtt

SEQ ID NO: 199347 - DNA, 15 bp, Homo sapiens
gctagctgttgctgt

SEQ ID NO: 199348 - DNA, 15 bp, Homo sapiens
tgctagctgttgctg

SEQ ID NO: 199349 - DNA, 15 bp, Homo sapiens
ttgctagctgttgct

SEQ ID NO: 199350 - DNA, 15 bp, Homo sapiens
tttgctagctgttgc

SEQ ID NO: 199351 - DNA, 15 bp, Homo sapiens
ctttgctagctgttg

SEQ ID NO: 199352 - DNA, 15 bp, Homo sapiens
actttgctagctgtt

SEQ ID NO: 199353 - DNA, 15 bp, Homo sapiens
aactttgctagctgt

SEQ ID NO: 199354 - DNA, 15 bp, Homo sapiens
gaactttgctagctg

SEQ ID NO: 199355 - DNA, 15 bp, Homo sapiens
ggaactttgctagct

SEQ ID NO: 199356 - DNA, 15 bp, Homo sapiens
tggaactttgctagc

SEQ ID NO: 199357 - DNA, 15 bp, Homo sapiens
ctggaactttgctag

SEQ ID NO: 199358 - DNA, 15 bp, Homo sapiens
gctggaactttgcta

SEQ ID NO: 199359 - DNA, 15 bp, Homo sapiens
ggctggaactttgct

SEQ ID NO: 199360 - DNA, 15 bp, Homo sapiens
tggctggaactttgc

SEQ ID NO: 199361 - DNA, 15 bp, Homo sapiens
ctggctggaactttg

SEQ ID NO: 199362 - DNA, 15 bp, Homo sapiens
actggctggaacttt

SEQ ID NO: 199363 - DNA, 15 bp, Homo sapiens
gactggctggaactt

SEQ ID NO: 199364 - DNA, 15 bp, Homo sapiens
agactggctggaact

SEQ ID NO: 199365 - DNA, 15 bp, Homo sapiens
cagactggctggaac

SEQ ID NO: 199366 - DNA, 15 bp, Homo sapiens
gcagactggctggaa

SEQ ID NO: 199367 - DNA, 15 bp, Homo sapiens
tgcagactggctgga

SEQ ID NO: 199368 - DNA, 15 bp, Homo sapiens
gtgcagactggctgg

SEQ ID NO: 199369 - DNA, 15 bp, Homo sapiens
agtgcagactggctg

SEQ ID NO: 199370 - DNA, 15 bp, Homo sapiens
cagtgcagactggct

SEQ ID NO: 199371 - DNA, 15 bp, Homo sapiens
tcagtgcagactggc

SEQ ID NO: 199372 - DNA, 15 bp, Homo sapiens
ttcagtgcagactgg

SEQ ID NO: 199373 - DNA, 15 bp, Homo sapiens
tttcagtgcagactg

SEQ ID NO: 199374 - DNA, 15 bp, Homo sapiens
gtttcagtgcagact

SEQ ID NO: 199375 - DNA, 15 bp, Homo sapiens
agtttcagtgcagac

SEQ ID NO: 199376 - DNA, 15 bp, Homo sapiens
gagtttcagtgcaga

SEQ ID NO: 199377 - DNA, 15 bp, Homo sapiens
tgagtttcagtgcag

SEQ ID NO: 199378 - DNA, 15 bp, Homo sapiens
ttgagtttcagtgca

SEQ ID NO: 199379 - DNA, 15 bp, Homo sapiens
tttgagtttcagtgc

SEQ ID NO: 199380 - DNA, 15 bp, Homo sapiens
ttttgagtttcagtg

SEQ ID NO: 199381 - DNA, 15 bp, Homo sapiens
gttttgagtttcagt

SEQ ID NO: 199382 - DNA, 15 bp, Homo sapiens
agttttgagtttcag

SEQ ID NO: 199383 - DNA, 15 bp, Homo sapiens
cagttttgagtttca

SEQ ID NO: 199384 - DNA, 15 bp, Homo sapiens
gcagttttgagtttc

SEQ ID NO: 199385 - DNA, 15 bp, Homo sapiens
ggcagttttgagttt

SEQ ID NO: 199386 - DNA, 15 bp, Homo sapiens
gggcagttttgagtt

SEQ ID NO: 199387 - DNA, 15 bp, Homo sapiens
ggggcagttttgagt

SEQ ID NO: 199388 - DNA, 15 bp, Homo sapiens
tggggcagttttgag

SEQ ID NO: 199389 - DNA, 15 bp, Homo sapiens
ctggggcagttttga

SEQ ID NO: 199390 - DNA, 15 bp, Homo sapiens
tctggggcagttttg

SEQ ID NO: 199391 - DNA, 15 bp, Homo sapiens
atctggggcagtttt

SEQ ID NO: 199392 - DNA, 15 bp, Homo sapiens
gatctggggcagttt

SEQ ID NO: 199393 - DNA, 15 bp, Homo sapiens
tgatctggggcagtt

SEQ ID NO: 199394 - DNA, 15 bp, Homo sapiens
atgatctggggcagt

SEQ ID NO: 199395 - DNA, 15 bp, Homo sapiens
tatgatctggggcag

SEQ ID NO: 199396 - DNA, 15 bp, Homo sapiens
ttatgatctggggca

SEQ ID NO: 199397 - DNA, 15 bp, Homo sapiens
cttatgatctggggc

SEQ ID NO: 199398 - DNA, 15 bp, Homo sapiens
gcttatgatctgggg

SEQ ID NO: 199399 - DNA, 15 bp, Homo sapiens
ggcttatgatctggg

SEQ ID NO: 199400 - DNA, 15 bp, Homo sapiens
aggcttatgatctgg

SEQ ID NO: 199401 - DNA, 15 bp, Homo sapiens
aaggcttatgatctg

SEQ ID NO: 199402 - DNA, 15 bp, Homo sapiens
gaaggcttatgatct

SEQ ID NO: 199403 - DNA, 15 bp, Homo sapiens
ggaaggcttatgatc

SEQ ID NO: 199404 - DNA, 15 bp, Homo sapiens
gggaaggcttatgat

SEQ ID NO: 199405 - DNA, 15 bp, Homo sapiens
tgggaaggcttatga

SEQ ID NO: 199406 - DNA, 15 bp, Homo sapiens
ctgggaaggcttatg

SEQ ID NO: 199407 - DNA, 15 bp, Homo sapiens
actgggaaggcttat

SEQ ID NO: 199408 - DNA, 15 bp, Homo sapiens
cactgggaaggctta

SEQ ID NO: 199409 - DNA, 15 bp, Homo sapiens
ccactgggaaggctt

SEQ ID NO: 199410 - DNA, 15 bp, Homo sapiens
tccactgggaaggct

SEQ ID NO: 199411 - DNA, 15 bp, Homo sapiens
ctccactgggaaggc

SEQ ID NO: 199412 - DNA, 15 bp, Homo sapiens
tctccactgggaagg

SEQ ID NO: 199413 - DNA, 15 bp, Homo sapiens
atctccactgggaag

SEQ ID NO: 199414 - DNA, 15 bp, Homo sapiens
catctccactgggaa

SEQ ID NO: 199415 - DNA, 15 bp, Homo sapiens
ccatctccactggga

SEQ ID NO: 199416 - DNA, 15 bp, Homo sapiens
tccatctccactggg

SEQ ID NO: 199417 - DNA, 15 bp, Homo sapiens
ttccatctccactgg

SEQ ID NO: 199418 - DNA, 15 bp, Homo sapiens
tttccatctccactg

SEQ ID NO: 199419 - DNA, 15 bp, Homo sapiens
gtttccatctccact

SEQ ID NO: 199420 - DNA, 15 bp, Homo sapiens
agtttccatctccac

SEQ ID NO: 199421 - DNA, 15 bp, Homo sapiens
cagtttccatctcca

SEQ ID NO: 199422 - DNA, 15 bp, Homo sapiens
gcagtttccatctcc

SEQ ID NO: 199423 - DNA, 15 bp, Homo sapiens
tgcagtttccatctc

SEQ ID NO: 199424 - DNA, 15 bp, Homo sapiens
ctgcagtttccatct

SEQ ID NO: 199425 - DNA, 15 bp, Homo sapiens
cctgcagtttccatc

SEQ ID NO: 199426 - DNA, 15 bp, Homo sapiens
ccctgcagtttccat

SEQ ID NO: 199427 - DNA, 15 bp, Homo sapiens
gccctgcagtttcca

SEQ ID NO: 199428 - DNA, 15 bp, Homo sapiens
agccctgcagtttcc

SEQ ID NO: 199429 - DNA, 15 bp, Homo sapiens
aagccctgcagtttc

SEQ ID NO: 199430 - DNA, 15 bp, Homo sapiens
aaagccctgcagttt

SEQ ID NO: 199431 - DNA, 15 bp, Homo sapiens
gaaagccctgcagtt

SEQ ID NO: 199432 - DNA, 15 bp, Homo sapiens
tgaaagccctgcagt

SEQ ID NO: 199433 - DNA, 15 bp, Homo sapiens
ctgaaagccctgcag

SEQ ID NO: 199434 - DNA, 15 bp, Homo sapiens
cctgaaagccctgca

SEQ ID NO: 199435 - DNA, 15 bp, Homo sapiens
gcctgaaagccctgc

SEQ ID NO: 199436 - DNA, 15 bp, Homo sapiens
ggcctgaaagccctg

SEQ ID NO: 199437 - DNA, 15 bp, Homo sapiens
tggcctgaaagccct

SEQ ID NO: 199438 - DNA, 15 bp, Homo sapiens
atggcctgaaagccc

SEQ ID NO: 199439 - DNA, 15 bp, Homo sapiens
catggcctgaaagcc

SEQ ID NO: 199440 - DNA, 15 bp, Homo sapiens
gcatggcctgaaagc

SEQ ID NO: 199441 - DNA, 15 bp, Homo sapiens
ggcatggcctgaaag

SEQ ID NO: 199442 - DNA, 15 bp, Homo sapiens
gggcatggcctgaaa

SEQ ID NO: 199443 - DNA, 15 bp, Homo sapiens
tgggcatggcctgaa

SEQ ID NO: 199444 - DNA, 15 bp, Homo sapiens
atgggcatggcctga

SEQ ID NO: 199445 - DNA, 15 bp, Homo sapiens
gatgggcatggcctg

SEQ ID NO: 199446 - DNA, 15 bp, Homo sapiens
ggatgggcatggcct

SEQ ID NO: 199447 - DNA, 15 bp, Homo sapiens
aggatgggcatggcc

SEQ ID NO: 199448 - DNA, 15 bp, Homo sapiens
gaggatgggcatggc

SEQ ID NO: 199449 - DNA, 15 bp, Homo sapiens
tgaggatgggcatgg

SEQ ID NO: 199450 - DNA, 15 bp, Homo sapiens
atgaggatgggcatg

SEQ ID NO: 199451 - DNA, 15 bp, Homo sapiens
gatgaggatgggcat

SEQ ID NO: 199452 - DNA, 15 bp, Homo sapiens
agatgaggatgggca

SEQ ID NO: 199453 - DNA, 15 bp, Homo sapiens
cagatgaggatgggc

SEQ ID NO: 199454 - DNA, 15 bp, Homo sapiens
gcagatgaggatggg

SEQ ID NO: 199455 - DNA, 15 bp, Homo sapiens
ggcagatgaggatgg

SEQ ID NO: 199456 - DNA, 15 bp, Homo sapiens
gggcagatgaggatg

SEQ ID NO: 199457 - DNA, 15 bp, Homo sapiens
tgggcagatgaggat

SEQ ID NO: 199458 - DNA, 15 bp, Homo sapiens
atgggcagatgagga

SEQ ID NO: 199459 - DNA, 15 bp, Homo sapiens
catgggcagatgagg

SEQ ID NO: 199460 - DNA, 15 bp, Homo sapiens
tcatgggcagatgag

SEQ ID NO: 199461 - DNA, 15 bp, Homo sapiens
ttcatgggcagatga

SEQ ID NO: 199462 - DNA, 15 bp, Homo sapiens
cttcatgggcagatg

SEQ ID NO: 199463 - DNA, 15 bp, Homo sapiens
gcttcatgggcagat

SEQ ID NO: 199464 - DNA, 15 bp, Homo sapiens
tgcttcatgggcaga

SEQ ID NO: 199465 - DNA, 15 bp, Homo sapiens
ctgcttcatgggcag

SEQ ID NO: 199466 - DNA, 15 bp, Homo sapiens
cctgcttcatgggca

SEQ ID NO: 199467 - DNA, 15 bp, Homo sapiens
ccctgcttcatgggc

SEQ ID NO: 199468 - DNA, 15 bp, Homo sapiens
cccctgcttcatggg

SEQ ID NO: 199469 - DNA, 15 bp, Homo sapiens
gcccctgcttcatgg

SEQ ID NO: 199470 - DNA, 15 bp, Homo sapiens
tgcccctgcttcatg

SEQ ID NO: 199471 - DNA, 15 bp, Homo sapiens
gtgcccctgcttcat

SEQ ID NO: 199472 - DNA, 15 bp, Homo sapiens
ggtgcccctgcttca

SEQ ID NO: 199473 - DNA, 15 bp, Homo sapiens
gggtgcccctgcttc

SEQ ID NO: 199474 - DNA, 15 bp, Homo sapiens
tgggtgcccctgctt

SEQ ID NO: 199475 - DNA, 15 bp, Homo sapiens
ctgggtgcccctgct

SEQ ID NO: 199476 - DNA, 15 bp, Homo sapiens
gctgggtgcccctgc

SEQ ID NO: 199477 - DNA, 15 bp, Homo sapiens
agctgggtgcccctg

SEQ ID NO: 199478 - DNA, 15 bp, Homo sapiens
gagctgggtgcccct

SEQ ID NO: 199479 - DNA, 15 bp, Homo sapiens
ggagctgggtgcccc

SEQ ID NO: 199480 - DNA, 15 bp, Homo sapiens
aggagctgggtgccc

SEQ ID NO: 199481 - DNA, 15 bp, Homo sapiens
taggagctgggtgcc

SEQ ID NO: 199482 - DNA, 15 bp, Homo sapiens
ataggagctgggtgc

SEQ ID NO: 199483 - DNA, 15 bp, Homo sapiens
cataggagctgggtg

SEQ ID NO: 199484 - DNA, 15 bp, Homo sapiens
gcataggagctgggt

SEQ ID NO: 199485 - DNA, 15 bp, Homo sapiens
ggcataggagctggg

SEQ ID NO: 199486 - DNA, 15 bp, Homo sapiens
gggcataggagctgg

SEQ ID NO: 199487 - DNA, 15 bp, Homo sapiens
tgggcataggagctg

SEQ ID NO: 199488 - DNA, 15 bp, Homo sapiens
gtgggcataggagct

SEQ ID NO: 199489 - DNA, 15 bp, Homo sapiens
agtgggcataggagc

SEQ ID NO: 199490 - DNA, 15 bp, Homo sapiens
gagtgggcataggag

SEQ ID NO: 199491 - DNA, 15 bp, Homo sapiens
tgagtgggcatagga

SEQ ID NO: 199492 - DNA, 15 bp, Homo sapiens
ttgagtgggcatagg

SEQ ID NO: 199493 - DNA, 15 bp, Homo sapiens
cttgagtgggcatag

SEQ ID NO: 199494 - DNA, 15 bp, Homo sapiens
acttgagtgggcata

SEQ ID NO: 199495 - DNA, 15 bp, Homo sapiens
aacttgagtgggcat

SEQ ID NO: 199496 - DNA, 15 bp, Homo sapiens
aaacttgagtgggca

SEQ ID NO: 199497 - DNA, 15 bp, Homo sapiens
taaacttgagtgggc

SEQ ID NO: 199498 - DNA, 15 bp, Homo sapiens
ataaacttgagtggg

SEQ ID NO: 199499 - DNA, 15 bp, Homo sapiens
tataaacttgagtgg

SEQ ID NO: 199500 - DNA, 15 bp, Homo sapiens
atataaacttgagtg

SEQ ID NO: 199501 - DNA, 15 bp, Homo sapiens
gatataaacttgagt

SEQ ID NO: 199502 - DNA, 15 bp, Homo sapiens
tgatataaacttgag

SEQ ID NO: 199503 - DNA, 15 bp, Homo sapiens
atgatataaacttga

SEQ ID NO: 199504 - DNA, 15 bp, Homo sapiens
catgatataaacttg

SEQ ID NO: 199505 - DNA, 15 bp, Homo sapiens
tcatgatataaactt

SEQ ID NO: 199506 - DNA, 15 bp, Homo sapiens
ttcatgatataaact

SEQ ID NO: 199507 - DNA, 15 bp, Homo sapiens
attcatgatataaac

SEQ ID NO: 199508 - DNA, 15 bp, Homo sapiens
aattcatgatataaa

SEQ ID NO: 199509 - DNA, 15 bp, Homo sapiens
aaattcatgatataa

SEQ ID NO: 199510 - DNA, 15 bp, Homo sapiens
gaaattcatgatata

SEQ ID NO: 199511 - DNA, 15 bp, Homo sapiens
tgaaattcatgatat

SEQ ID NO: 199512 - DNA, 15 bp, Homo sapiens
ctgaaattcatgata

SEQ ID NO: 199513 - DNA, 15 bp, Homo sapiens
actgaaattcatgat

SEQ ID NO: 199514 - DNA, 15 bp, Homo sapiens
aactgaaattcatga

SEQ ID NO: 199515 - DNA, 15 bp, Homo sapiens
caactgaaattcatg

SEQ ID NO: 199516 - DNA, 15 bp, Homo sapiens
ccaactgaaattcat

SEQ ID NO: 199517 - DNA, 15 bp, Homo sapiens
cccaactgaaattca

SEQ ID NO: 199518 - DNA, 15 bp, Homo sapiens
tcccaactgaaattc

SEQ ID NO: 199519 - DNA, 15 bp, Homo sapiens
ctcccaactgaaatt

SEQ ID NO: 199520 - DNA, 15 bp, Homo sapiens
gctcccaactgaaat

SEQ ID NO: 199521 - DNA, 15 bp, Homo sapiens
tgctcccaactgaaa

SEQ ID NO: 199522 - DNA, 15 bp, Homo sapiens
atgctcccaactgaa

SEQ ID NO: 199523 - DNA, 15 bp, Homo sapiens
gatgctcccaactga

SEQ ID NO: 199524 - DNA, 15 bp, Homo sapiens
agatgctcccaactg

SEQ ID NO: 199525 - DNA, 15 bp, Homo sapiens
gagatgctcccaact

SEQ ID NO: 199526 - DNA, 15 bp, Homo sapiens
agagatgctcccaac

SEQ ID NO: 199527 - DNA, 15 bp, Homo sapiens
aagagatgctcccaa

SEQ ID NO: 199528 - DNA, 15 bp, Homo sapiens
taagagatgctccca

SEQ ID NO: 199529 - DNA, 15 bp, Homo sapiens
ttaagagatgctccc

SEQ ID NO: 199530 - DNA, 15 bp, Homo sapiens
gttaagagatgctcc

SEQ ID NO: 199531 - DNA, 15 bp, Homo sapiens
ggttaagagatgctc

SEQ ID NO: 199532 - DNA, 15 bp, Homo sapiens
aggttaagagatgct

SEQ ID NO: 199533 - DNA, 15 bp, Homo sapiens
caggttaagagatgc

SEQ ID NO: 199534 - DNA, 15 bp, Homo sapiens
gcaggttaagagatg

SEQ ID NO: 199535 - DNA, 15 bp, Homo sapiens
cgcaggttaagagat

SEQ ID NO: 199536 - DNA, 15 bp, Homo sapiens
tcgcaggttaagaga

SEQ ID NO: 199537 - DNA, 15 bp, Homo sapiens
gtcgcaggttaagag

SEQ ID NO: 199538 - DNA, 15 bp, Homo sapiens
ggtcgcaggttaaga

SEQ ID NO: 199539 - DNA, 15 bp, Homo sapiens
gggtcgcaggttaag

SEQ ID NO: 199540 - DNA, 15 bp, Homo sapiens
cgggtcgcaggttaa

SEQ ID NO: 199541 - DNA, 15 bp, Homo sapiens
acgggtcgcaggtta

SEQ ID NO: 199542 - DNA, 15 bp, Homo sapiens
cacgggtcgcaggtt

SEQ ID NO: 199543 - DNA, 15 bp, Homo sapiens
gcacgggtcgcaggt

SEQ ID NO: 199544 - DNA, 15 bp, Homo sapiens
ggcacgggtcgcagg

SEQ ID NO: 199545 - DNA, 15 bp, Homo sapiens
aggcacgggtcgcag

SEQ ID NO: 199546 - DNA, 15 bp, Homo sapiens
caggcacgggtcgca

SEQ ID NO: 199547 - DNA, 15 bp, Homo sapiens
tcaggcacgggtcgc

SEQ ID NO: 199548 - DNA, 15 bp, Homo sapiens
ctcaggcacgggtcg

SEQ ID NO: 199549 - DNA, 15 bp, Homo sapiens
actcaggcacgggtc

SEQ ID NO: 199550 - DNA, 15 bp, Homo sapiens
aactcaggcacgggt

SEQ ID NO: 199551 - DNA, 15 bp, Homo sapiens
taactcaggcacggg

SEQ ID NO: 199552 - DNA, 15 bp, Homo sapiens
ttaactcaggcacgg

SEQ ID NO: 199553 - DNA, 15 bp, Homo sapiens
attaactcaggcacg

SEQ ID NO: 199554 - DNA, 15 bp, Homo sapiens
aattaactcaggcac

SEQ ID NO: 199555 - DNA, 15 bp, Homo sapiens
caattaactcaggca

SEQ ID NO: 199556 - DNA, 15 bp, Homo sapiens
ccaattaactcaggc

SEQ ID NO: 199557 - DNA, 15 bp, Homo sapiens
gccaattaactcagg

SEQ ID NO: 199558 - DNA, 15 bp, Homo sapiens
agccaattaactcag

SEQ ID NO: 199559 - DNA, 15 bp, Homo sapiens
cagccaattaactca

SEQ ID NO: 199560 - DNA, 15 bp, Homo sapiens
tcagccaattaactc

SEQ ID NO: 199561 - DNA, 15 bp, Homo sapiens
gtcagccaattaact

SEQ ID NO: 199562 - DNA, 15 bp, Homo sapiens
ggtcagccaattaac

SEQ ID NO: 199563 - DNA, 15 bp, Homo sapiens
aggtcagccaattaa

SEQ ID NO: 199564 - DNA, 15 bp, Homo sapiens
gaggtcagccaatta

SEQ ID NO: 199565 - DNA, 15 bp, Homo sapiens
ggaggtcagccaatt

SEQ ID NO: 199566 - DNA, 15 bp, Homo sapiens
tggaggtcagccaat

SEQ ID NO: 199567 - DNA, 15 bp, Homo sapiens
gtggaggtcagccaa

SEQ ID NO: 199568 - DNA, 15 bp, Homo sapiens
tgtggaggtcagcca

SEQ ID NO: 199569 - DNA, 15 bp, Homo sapiens
ttgtggaggtcagcc

SEQ ID NO: 199570 - DNA, 15 bp, Homo sapiens
cttgtggaggtcagc

SEQ ID NO: 199571 - DNA, 15 bp, Homo sapiens
ccttgtggaggtcag

SEQ ID NO: 199572 - DNA, 15 bp, Homo sapiens
accttgtggaggtca

SEQ ID NO: 199573 - DNA, 15 bp, Homo sapiens
gaccttgtggaggtc

SEQ ID NO: 199574 - DNA, 15 bp, Homo sapiens
agaccttgtggaggt

SEQ ID NO: 199575 - DNA, 15 bp, Homo sapiens
gagaccttgtggagg

SEQ ID NO: 199576 - DNA, 15 bp, Homo sapiens
ggagaccttgtggag

SEQ ID NO: 199577 - DNA, 15 bp, Homo sapiens
aggagaccttgtgga

SEQ ID NO: 199578 - DNA, 15 bp, Homo sapiens
caggagaccttgtgg

SEQ ID NO: 199579 - DNA, 15 bp, Homo sapiens
acaggagaccttgtg

SEQ ID NO: 199580 - DNA, 15 bp, Homo sapiens
cacaggagaccttgt

SEQ ID NO: 199581 - DNA, 15 bp, Homo sapiens
tcacaggagaccttg

SEQ ID NO: 199582 - DNA, 15 bp, Homo sapiens
ctcacaggagacctt

SEQ ID NO: 199583 - DNA, 15 bp, Homo sapiens
tctcacaggagacct

SEQ ID NO: 199584 - DNA, 15 bp, Homo sapiens
gtctcacaggagacc

SEQ ID NO: 199585 - DNA, 15 bp, Homo sapiens
tgtctcacaggagac

SEQ ID NO: 199586 - DNA, 15 bp, Homo sapiens
ctgtctcacaggaga

SEQ ID NO: 199587 - DNA, 15 bp, Homo sapiens
cctgtctcacaggag

SEQ ID NO: 199588 - DNA, 15 bp, Homo sapiens
tcctgtctcacagga

SEQ ID NO: 199589 - DNA, 15 bp, Homo sapiens
atcctgtctcacagg

SEQ ID NO: 199590 - DNA, 15 bp, Homo sapiens
gatcctgtctcacag

SEQ ID NO: 199591 - DNA, 15 bp, Homo sapiens
tgatcctgtctcaca

SEQ ID NO: 199592 - DNA, 15 bp, Homo sapiens
ctgatcctgtctcac

SEQ ID NO: 199593 - DNA, 15 bp, Homo sapiens
cctgatcctgtctca

SEQ ID NO: 199594 - DNA, 15 bp, Homo sapiens
tcctgatcctgtctc

SEQ ID NO: 199595 - DNA, 15 bp, Homo sapiens
ttcctgatcctgtct

SEQ ID NO: 199596 - DNA, 15 bp, Homo sapiens
attcctgatcctgtc

SEQ ID NO: 199597 - DNA, 15 bp, Homo sapiens
cattcctgatcctgt

SEQ ID NO: 199598 - DNA, 15 bp, Homo sapiens
tcattcctgatcctg

SEQ ID NO: 199599 - DNA, 15 bp, Homo sapiens
gtcattcctgatcct

SEQ ID NO: 199600 - DNA, 15 bp, Homo sapiens
agtcattcctgatcc

SEQ ID NO: 199601 - DNA, 15 bp, Homo sapiens
aagtcattcctgatc

SEQ ID NO: 199602 - DNA, 15 bp, Homo sapiens
gaagtcattcctgat

SEQ ID NO: 199603 - DNA, 15 bp, Homo sapiens
ggaagtcattcctga

SEQ ID NO: 199604 - DNA, 15 bp, Homo sapiens
gggaagtcattcctg

SEQ ID NO: 199605 - DNA, 15 bp, Homo sapiens
agggaagtcattcct

SEQ ID NO: 199606 - DNA, 15 bp, Homo sapiens
aagggaagtcattcc

SEQ ID NO: 199607 - DNA, 15 bp, Homo sapiens
gaagggaagtcattc

SEQ ID NO: 199608 - DNA, 15 bp, Homo sapiens
tgaagggaagtcatt

SEQ ID NO: 199609 - DNA, 15 bp, Homo sapiens
atgaagggaagtcat

SEQ ID NO: 199610 - DNA, 15 bp, Homo sapiens
gatgaagggaagtca

SEQ ID NO: 199611 - DNA, 15 bp, Homo sapiens
ggatgaagggaagtc

SEQ ID NO: 199612 - DNA, 15 bp, Homo sapiens
gggatgaagggaagt

SEQ ID NO: 199613 - DNA, 15 bp, Homo sapiens
agggatgaagggaag

SEQ ID NO: 199614 - DNA, 15 bp, Homo sapiens
gagggatgaagggaa

SEQ ID NO: 199615 - DNA, 15 bp, Homo sapiens
agagggatgaaggga

SEQ ID NO: 199616 - DNA, 15 bp, Homo sapiens
cagagggatgaaggg

SEQ ID NO: 199617 - DNA, 15 bp, Homo sapiens
ccagagggatgaagg

SEQ ID NO: 199618 - DNA, 15 bp, Homo sapiens
tccagagggatgaag

SEQ ID NO: 199619 - DNA, 15 bp, Homo sapiens
ctccagagggatgaa

SEQ ID NO: 199620 - DNA, 15 bp, Homo sapiens
tctccagagggatga

SEQ ID NO: 199621 - DNA, 15 bp, Homo sapiens
gtctccagagggatg

SEQ ID NO: 199622 - DNA, 15 bp, Homo sapiens
agtctccagagggat

SEQ ID NO: 199623 - DNA, 15 bp, Homo sapiens
cagtctccagaggga

SEQ ID NO: 199624 - DNA, 15 bp, Homo sapiens
ccagtctccagaggg

SEQ ID NO: 199625 - DNA, 15 bp, Homo sapiens
cccagtctccagagg

SEQ ID NO: 199626 - DNA, 15 bp, Homo sapiens
tcccagtctccagag

SEQ ID NO: 199627 - DNA, 15 bp, Homo sapiens
ctcccagtctccaga

SEQ ID NO: 199628 - DNA, 15 bp, Homo sapiens
actcccagtctccag

SEQ ID NO: 199629 - DNA, 15 bp, Homo sapiens
cactcccagtctcca

SEQ ID NO: 199630 - DNA, 15 bp, Homo sapiens
gcactcccagtctcc

SEQ ID NO: 199631 - DNA, 15 bp, Homo sapiens
tgcactcccagtctc

SEQ ID NO: 199632 - DNA, 15 bp, Homo sapiens
gtgcactcccagtct

SEQ ID NO: 199633 - DNA, 15 bp, Homo sapiens
tgtgcactcccagtc

SEQ ID NO: 199634 - DNA, 15 bp, Homo sapiens
gtgtgcactcccagt

SEQ ID NO: 199635 - DNA, 15 bp, Homo sapiens
tgtgtgcactcccag

SEQ ID NO: 199636 - DNA, 15 bp, Homo sapiens
gtgtgtgcactccca

SEQ ID NO: 199637 - DNA, 15 bp, Homo sapiens
tgtgtgtgcactccc

SEQ ID NO: 199638 - DNA, 15 bp, Homo sapiens
ctgtgtgtgcactcc

SEQ ID NO: 199639 - DNA, 15 bp, Homo sapiens
gctgtgtgtgcactc

SEQ ID NO: 199640 - DNA, 15 bp, Homo sapiens
tgctgtgtgtgcact

SEQ ID NO: 199641 - DNA, 15 bp, Homo sapiens
gtgctgtgtgtgcac

SEQ ID NO: 199642 - DNA, 15 bp, Homo sapiens
tgtgctgtgtgtgca

SEQ ID NO: 199643 - DNA, 15 bp, Homo sapiens
atgtgctgtgtgtgc

SEQ ID NO: 199644 - DNA, 15 bp, Homo sapiens
gatgtgctgtgtgtg

SEQ ID NO: 199645 - DNA, 15 bp, Homo sapiens
ggatgtgctgtgtgt

SEQ ID NO: 199646 - DNA, 15 bp, Homo sapiens
gggatgtgctgtgtg

SEQ ID NO: 199647 - DNA, 15 bp, Homo sapiens
cgggatgtgctgtgt

SEQ ID NO: 199648 - DNA, 15 bp, Homo sapiens
tcgggatgtgctgtg

SEQ ID NO: 199649 - DNA, 15 bp, Homo sapiens
atcgggatgtgctgt

SEQ ID NO: 199650 - DNA, 15 bp, Homo sapiens
catcgggatgtgctg

SEQ ID NO: 199651 - DNA, 15 bp, Homo sapiens
acatcgggatgtgct

SEQ ID NO: 199652 - DNA, 15 bp, Homo sapiens
cacatcgggatgtgc

SEQ ID NO: 199653 - DNA, 15 bp, Homo sapiens
ccacatcgggatgtg

SEQ ID NO: 199654 - DNA, 15 bp, Homo sapiens
accacatcgggatgt

SEQ ID NO: 199655 - DNA, 15 bp, Homo sapiens
aaccacatcgggatg

SEQ ID NO: 199656 - DNA, 15 bp, Homo sapiens
gaaccacatcgggat

SEQ ID NO: 199657 - DNA, 15 bp, Homo sapiens
ggaaccacatcggga

SEQ ID NO: 199658 - DNA, 15 bp, Homo sapiens
aggaaccacatcggg

SEQ ID NO: 199659 - DNA, 15 bp, Homo sapiens
aaggaaccacatcgg

SEQ ID NO: 199660 - DNA, 15 bp, Homo sapiens
gaaggaaccacatcg

SEQ ID NO: 199661 - DNA, 15 bp, Homo sapiens
agaaggaaccacatc

SEQ ID NO: 199662 - DNA, 15 bp, Homo sapiens
gagaaggaaccacat

SEQ ID NO: 199663 - DNA, 15 bp, Homo sapiens
tgagaaggaaccaca

SEQ ID NO: 199664 - DNA, 15 bp, Homo sapiens
atgagaaggaaccac

SEQ ID NO: 199665 - DNA, 15 bp, Homo sapiens
gatgagaaggaacca

SEQ ID NO: 199666 - DNA, 15 bp, Homo sapiens
agatgagaaggaacc

SEQ ID NO: 199667 - DNA, 15 bp, Homo sapiens
tagatgagaaggaac

SEQ ID NO: 199668 - DNA, 15 bp, Homo sapiens
gtagatgagaaggaa

SEQ ID NO: 199669 - DNA, 15 bp, Homo sapiens
agtagatgagaagga

SEQ ID NO: 199670 - DNA, 15 bp, Homo sapiens
gagtagatgagaagg

SEQ ID NO: 199671 - DNA, 15 bp, Homo sapiens
ggagtagatgagaag

SEQ ID NO: 199672 - DNA, 15 bp, Homo sapiens
gggagtagatgagaa

SEQ ID NO: 199673 - DNA, 15 bp, Homo sapiens
ggggagtagatgaga

SEQ ID NO: 199674 - DNA, 15 bp, Homo sapiens
tggggagtagatgag

SEQ ID NO: 199675 - DNA, 15 bp, Homo sapiens
atggggagtagatga

SEQ ID NO: 199676 - DNA, 15 bp, Homo sapiens
aatggggagtagatg

SEQ ID NO: 199677 - DNA, 15 bp, Homo sapiens
caatggggagtagat

SEQ ID NO: 199678 - DNA, 15 bp, Homo sapiens
gcaatggggagtaga

SEQ ID NO: 199679 - DNA, 15 bp, Homo sapiens
agcaatggggagtag

SEQ ID NO: 199680 - DNA, 15 bp, Homo sapiens
gagcaatggggagta

SEQ ID NO: 199681 - DNA, 15 bp, Homo sapiens
tgagcaatggggagt

SEQ ID NO: 199682 - DNA, 15 bp, Homo sapiens
gtgagcaatggggag

SEQ ID NO: 199683 - DNA, 15 bp, Homo sapiens
agtgagcaatgggga

SEQ ID NO: 199684 - DNA, 15 bp, Homo sapiens
tagtgagcaatgggg

SEQ ID NO: 199685 - DNA, 15 bp, Homo sapiens
gtagtgagcaatggg

SEQ ID NO: 199686 - DNA, 15 bp, Homo sapiens
tgtagtgagcaatgg

SEQ ID NO: 199687 - DNA, 15 bp, Homo sapiens
gtgtagtgagcaatg

SEQ ID NO: 199688 - DNA, 15 bp, Homo sapiens
ggtgtagtgagcaat

SEQ ID NO: 199689 - DNA, 15 bp, Homo sapiens
tggtgtagtgagcaa

SEQ ID NO: 199690 - DNA, 15 bp, Homo sapiens
ctggtgtagtgagca

SEQ ID NO: 199691 - DNA, 15 bp, Homo sapiens
gctggtgtagtgagc

SEQ ID NO: 199692 - DNA, 15 bp, Homo sapiens
agctggtgtagtgag

SEQ ID NO: 199693 - DNA, 15 bp, Homo sapiens
gagctggtgtagtga

SEQ ID NO: 199694 - DNA, 15 bp, Homo sapiens
ggagctggtgtagtg

SEQ ID NO: 199695 - DNA, 15 bp, Homo sapiens
cggagctggtgtagt

SEQ ID NO: 199696 - DNA, 15 bp, Homo sapiens
ccggagctggtgtag

SEQ ID NO: 199697 - DNA, 15 bp, Homo sapiens
tccggagctggtgta

SEQ ID NO: 199698 - DNA, 15 bp, Homo sapiens
ctccggagctggtgt

SEQ ID NO: 199699 - DNA, 15 bp, Homo sapiens
gctccggagctggtg

SEQ ID NO: 199700 - DNA, 15 bp, Homo sapiens
agctccggagctggt

SEQ ID NO: 199701 - DNA, 15 bp, Homo sapiens
cagctccggagctgg

SEQ ID NO: 199702 - DNA, 15 bp, Homo sapiens
ccagctccggagctg

SEQ ID NO: 199703 - DNA, 15 bp, Homo sapiens
cccagctccggagct

SEQ ID NO: 199704 - DNA, 15 bp, Homo sapiens
acccagctccggagc

SEQ ID NO: 199705 - DNA, 15 bp, Homo sapiens
tacccagctccggag

SEQ ID NO: 199706 - DNA, 15 bp, Homo sapiens
ctacccagctccgga

SEQ ID NO: 199707 - DNA, 15 bp, Homo sapiens
cctacccagctccgg

SEQ ID NO: 199708 - DNA, 15 bp, Homo sapiens
ccctacccagctccg

SEQ ID NO: 199709 - DNA, 15 bp, Homo sapiens
accctacccagctcc

SEQ ID NO: 199710 - DNA, 15 bp, Homo sapiens
aaccctacccagctc

SEQ ID NO: 199711 - DNA, 15 bp, Homo sapiens
taaccctacccagct

SEQ ID NO: 199712 - DNA, 15 bp, Homo sapiens
ttaaccctacccagc

SEQ ID NO: 199713 - DNA, 15 bp, Homo sapiens
cttaaccctacccag

SEQ ID NO: 199714 - DNA, 15 bp, Homo sapiens
ccttaaccctaccca

SEQ ID NO: 199715 - DNA, 15 bp, Homo sapiens
gccttaaccctaccc

SEQ ID NO: 199716 - DNA, 15 bp, Homo sapiens
ggccttaaccctacc

SEQ ID NO: 199717 - DNA, 15 bp, Homo sapiens
aggccttaaccctac

SEQ ID NO: 199718 - DNA, 15 bp, Homo sapiens
aaggccttaacccta

SEQ ID NO: 199719 - DNA, 15 bp, Homo sapiens
aaaggccttaaccct

SEQ ID NO: 199720 - DNA, 15 bp, Homo sapiens
aaaaggccttaaccc

SEQ ID NO: 199721 - DNA, 15 bp, Homo sapiens
gaaaaggccttaacc

SEQ ID NO: 199722 - DNA, 15 bp, Homo sapiens
ggaaaaggccttaac

SEQ ID NO: 199723 - DNA, 15 bp, Homo sapiens
gggaaaaggccttaa

SEQ ID NO: 199724 - DNA, 15 bp, Homo sapiens
agggaaaaggcctta

SEQ ID NO: 199725 - DNA, 15 bp, Homo sapiens
cagggaaaaggcctt

SEQ ID NO: 199726 - DNA, 15 bp, Homo sapiens
tcagggaaaaggcct

SEQ ID NO: 199727 - DNA, 15 bp, Homo sapiens
gtcagggaaaaggcc

SEQ ID NO: 199728 - DNA, 15 bp, Homo sapiens
ggtcagggaaaaggc

SEQ ID NO: 199729 - DNA, 15 bp, Homo sapiens
aggtcagggaaaagg

SEQ ID NO: 199730 - DNA, 15 bp, Homo sapiens
caggtcagggaaaag

SEQ ID NO: 199731 - DNA, 15 bp, Homo sapiens
ccaggtcagggaaaa

SEQ ID NO: 199732 - DNA, 15 bp, Homo sapiens
tccaggtcagggaaa

SEQ ID NO: 199733 - DNA, 15 bp, Homo sapiens
atccaggtcagggaa

SEQ ID NO: 199734 - DNA, 15 bp, Homo sapiens
aatccaggtcaggga

SEQ ID NO: 199735 - DNA, 15 bp, Homo sapiens
caatccaggtcaggg

SEQ ID NO: 199736 - DNA, 15 bp, Homo sapiens
gcaatccaggtcagg

SEQ ID NO: 199737 - DNA, 15 bp, Homo sapiens
ggcaatccaggtcag

SEQ ID NO: 199738 - DNA, 15 bp, Homo sapiens
tggcaatccaggtca

SEQ ID NO: 199739 - DNA, 15 bp, Homo sapiens
ctggcaatccaggtc

SEQ ID NO: 199740 - DNA, 15 bp, Homo sapiens
cctggcaatccaggt

SEQ ID NO: 199741 - DNA, 15 bp, Homo sapiens
acctggcaatccagg

SEQ ID NO: 199742 - DNA, 15 bp, Homo sapiens
aacctggcaatccag

SEQ ID NO: 199743 - DNA, 15 bp, Homo sapiens
gaacctggcaatcca

SEQ ID NO: 199744 - DNA, 15 bp, Homo sapiens
ggaacctggcaatcc

SEQ ID NO: 199745 - DNA, 15 bp, Homo sapiens
gggaacctggcaatc

SEQ ID NO: 199746 - DNA, 15 bp, Homo sapiens
ggggaacctggcaat

SEQ ID NO: 199747 - DNA, 15 bp, Homo sapiens
cggggaacctggcaa

SEQ ID NO: 199748 - DNA, 15 bp, Homo sapiens
ccggggaacctggca

SEQ ID NO: 199749 - DNA, 15 bp, Homo sapiens
accggggaacctggc

SEQ ID NO: 199750 - DNA, 15 bp, Homo sapiens
caccggggaacctgg

SEQ ID NO: 199751 - DNA, 15 bp, Homo sapiens
ccaccggggaacctg

SEQ ID NO: 199752 - DNA, 15 bp, Homo sapiens
cccaccggggaacct

SEQ ID NO: 199753 - DNA, 15 bp, Homo sapiens
acccaccggggaacc

SEQ ID NO: 199754 - DNA, 15 bp, Homo sapiens
cacccaccggggaac

SEQ ID NO: 199755 - DNA, 15 bp, Homo sapiens
acacccaccggggaa

SEQ ID NO: 199756 - DNA, 15 bp, Homo sapiens
cacacccaccgggga

SEQ ID NO: 199757 - DNA, 15 bp, Homo sapiens
acacacccaccgggg

SEQ ID NO: 199758 - DNA, 15 bp, Homo sapiens
tacacacccaccggg

SEQ ID NO: 199759 - DNA, 15 bp, Homo sapiens
atacacacccaccgg

SEQ ID NO: 199760 - DNA, 15 bp, Homo sapiens
catacacacccaccg

SEQ ID NO: 199761 - DNA, 15 bp, Homo sapiens
acatacacacccacc

SEQ ID NO: 199762 - DNA, 15 bp, Homo sapiens
cacatacacacccac

SEQ ID NO: 199763 - DNA, 15 bp, Homo sapiens
gcacatacacaccca

SEQ ID NO: 199764 - DNA, 15 bp, Homo sapiens
agcacatacacaccc

SEQ ID NO: 199765 - DNA, 15 bp, Homo sapiens
cagcacatacacacc

SEQ ID NO: 199766 - DNA, 15 bp, Homo sapiens
acagcacatacacac

SEQ ID NO: 199767 - DNA, 15 bp, Homo sapiens
tacagcacatacaca

SEQ ID NO: 199768 - DNA, 15 bp, Homo sapiens
ctacagcacatacac

SEQ ID NO: 199769 - DNA, 15 bp, Homo sapiens
cctacagcacataca

SEQ ID NO: 199770 - DNA, 15 bp, Homo sapiens
gcctacagcacatac

SEQ ID NO: 199771 - DNA, 15 bp, Homo sapiens
tgcctacagcacata

SEQ ID NO: 199772 - DNA, 15 bp, Homo sapiens
ctgcctacagcacat

SEQ ID NO: 199773 - DNA, 15 bp, Homo sapiens
actgcctacagcaca

SEQ ID NO: 199774 - DNA, 15 bp, Homo sapiens
aactgcctacagcac

SEQ ID NO: 199775 - DNA, 15 bp, Homo sapiens
aaactgcctacagca

SEQ ID NO: 199776 - DNA, 15 bp, Homo sapiens
gaaactgcctacagc

SEQ ID NO: 199777 - DNA, 15 bp, Homo sapiens
agaaactgcctacag

SEQ ID NO: 199778 - DNA, 15 bp, Homo sapiens
gagaaactgcctaca

SEQ ID NO: 199779 - DNA, 15 bp, Homo sapiens
ggagaaactgcctac

SEQ ID NO: 199780 - DNA, 15 bp, Homo sapiens
gggagaaactgccta

SEQ ID NO: 199781 - DNA, 15 bp, Homo sapiens
agggagaaactgcct

SEQ ID NO: 199782 - DNA, 15 bp, Homo sapiens
aagggagaaactgcc

SEQ ID NO: 199783 - DNA, 15 bp, Homo sapiens
aaagggagaaactgc

SEQ ID NO: 199784 - DNA, 15 bp, Homo sapiens
aaaagggagaaactg

SEQ ID NO: 199785 - DNA, 15 bp, Homo sapiens
aaaaagggagaaact

SEQ ID NO: 199786 - DNA, 15 bp, Homo sapiens
gaaaaagggagaaac

SEQ ID NO: 199787 - DNA, 15 bp, Homo sapiens
tgaaaaagggagaaa

SEQ ID NO: 199788 - DNA, 15 bp, Homo sapiens
gtgaaaaagggagaa

SEQ ID NO: 199789 - DNA, 15 bp, Homo sapiens
tgtgaaaaagggaga

SEQ ID NO: 199790 - DNA, 15 bp, Homo sapiens
gtgtgaaaaagggag

SEQ ID NO: 199791 - DNA, 15 bp, Homo sapiens
agtgtgaaaaaggga

SEQ ID NO: 199792 - DNA, 15 bp, Homo sapiens
gagtgtgaaaaaggg

SEQ ID NO: 199793 - DNA, 15 bp, Homo sapiens
agagtgtgaaaaagg

SEQ ID NO: 199794 - DNA, 15 bp, Homo sapiens
cagagtgtgaaaaag

SEQ ID NO: 199795 - DNA, 15 bp, Homo sapiens
ccagagtgtgaaaaa

SEQ ID NO: 199796 - DNA, 15 bp, Homo sapiens
cccagagtgtgaaaa

SEQ ID NO: 199797 - DNA, 15 bp, Homo sapiens
ccccagagtgtgaaa

SEQ ID NO: 199798 - DNA, 15 bp, Homo sapiens
tccccagagtgtgaa

SEQ ID NO: 199799 - DNA, 15 bp, Homo sapiens
gtccccagagtgtga

SEQ ID NO: 199800 - DNA, 15 bp, Homo sapiens
agtccccagagtgtg

SEQ ID NO: 199801 - DNA, 15 bp, Homo sapiens
aagtccccagagtgt

SEQ ID NO: 199802 - DNA, 15 bp, Homo sapiens
taagtccccagagtg

SEQ ID NO: 199803 - DNA, 15 bp, Homo sapiens
gtaagtccccagagt

SEQ ID NO: 199804 - DNA, 15 bp, Homo sapiens
tgtaagtccccagag

SEQ ID NO: 199805 - DNA, 15 bp, Homo sapiens
ttgtaagtccccaga

SEQ ID NO: 199806 - DNA, 15 bp, Homo sapiens
attgtaagtccccag

SEQ ID NO: 199807 - DNA, 15 bp, Homo sapiens
aattgtaagtcccca

SEQ ID NO: 199808 - DNA, 15 bp, Homo sapiens
aaattgtaagtcccc

SEQ ID NO: 199809 - DNA, 15 bp, Homo sapiens
aaaattgtaagtccc

SEQ ID NO: 199810 - DNA, 15 bp, Homo sapiens
aaaaattgtaagtcc

SEQ ID NO: 199811 - DNA, 15 bp, Homo sapiens
caaaaattgtaagtc

SEQ ID NO: 199812 - DNA, 15 bp, Homo sapiens
ccaaaaattgtaagt

SEQ ID NO: 199813 - DNA, 15 bp, Homo sapiens
gccaaaaattgtaag

SEQ ID NO: 199814 - DNA, 15 bp, Homo sapiens
ggccaaaaattgtaa

SEQ ID NO: 199815 - DNA, 15 bp, Homo sapiens
aggccaaaaattgta

SEQ ID NO: 199816 - DNA, 15 bp, Homo sapiens
caggccaaaaattgt

SEQ ID NO: 199817 - DNA, 15 bp, Homo sapiens
ccaggccaaaaattg

SEQ ID NO: 199818 - DNA, 15 bp, Homo sapiens
gccaggccaaaaatt

SEQ ID NO: 199819 - DNA, 15 bp, Homo sapiens
agccaggccaaaaat

SEQ ID NO: 199820 - DNA, 15 bp, Homo sapiens
gagccaggccaaaaa

SEQ ID NO: 199821 - DNA, 15 bp, Homo sapiens
tgagccaggccaaaa

SEQ ID NO: 199822 - DNA, 15 bp, Homo sapiens
atgagccaggccaaa

SEQ ID NO: 199823 - DNA, 15 bp, Homo sapiens
catgagccaggccaa

SEQ ID NO: 199824 - DNA, 15 bp, Homo sapiens
tcatgagccaggcca

SEQ ID NO: 199825 - DNA, 15 bp, Homo sapiens
atcatgagccaggcc

SEQ ID NO: 199826 - DNA, 15 bp, Homo sapiens
tatcatgagccaggc

SEQ ID NO: 199827 - DNA, 15 bp, Homo sapiens
atatcatgagccagg

SEQ ID NO: 199828 - DNA, 15 bp, Homo sapiens
tatatcatgagccag

SEQ ID NO: 199829 - DNA, 15 bp, Homo sapiens
gtatatcatgagcca

SEQ ID NO: 199830 - DNA, 15 bp, Homo sapiens
tgtatatcatgagcc

SEQ ID NO: 199831 - DNA, 15 bp, Homo sapiens
gtgtatatcatgagc

SEQ ID NO: 199832 - DNA, 15 bp, Homo sapiens
agtgtatatcatgag

SEQ ID NO: 199833 - DNA, 15 bp, Homo sapiens
cagtgtatatcatga

SEQ ID NO: 199834 - DNA, 15 bp, Homo sapiens
gcagtgtatatcatg

SEQ ID NO: 199835 - DNA, 15 bp, Homo sapiens
tgcagtgtatatcat

SEQ ID NO: 199836 - DNA, 15 bp, Homo sapiens
ctgcagtgtatatca

SEQ ID NO: 199837 - DNA, 15 bp, Homo sapiens
gctgcagtgtatatc

SEQ ID NO: 199838 - DNA, 15 bp, Homo sapiens
ggctgcagtgtatat

SEQ ID NO: 199839 - DNA, 15 bp, Homo sapiens
aggctgcagtgtata

SEQ ID NO: 199840 - DNA, 15 bp, Homo sapiens
caggctgcagtgtat

SEQ ID NO: 199841 - DNA, 15 bp, Homo sapiens
gcaggctgcagtgta

SEQ ID NO: 199842 - DNA, 15 bp, Homo sapiens
agcaggctgcagtgt

SEQ ID NO: 199843 - DNA, 15 bp, Homo sapiens
cagcaggctgcagtg

SEQ ID NO: 199844 - DNA, 15 bp, Homo sapiens
gcagcaggctgcagt

SEQ ID NO: 199845 - DNA, 15 bp, Homo sapiens
agcagcaggctgcag

SEQ ID NO: 199846 - DNA, 15 bp, Homo sapiens
aagcagcaggctgca

SEQ ID NO: 199847 - DNA, 15 bp, Homo sapiens
gaagcagcaggctgc

SEQ ID NO: 199848 - DNA, 15 bp, Homo sapiens
agaagcagcaggctg

SEQ ID NO: 199849 - DNA, 15 bp, Homo sapiens
aagaagcagcaggct

SEQ ID NO: 199850 - DNA, 15 bp, Homo sapiens
aaagaagcagcaggc

SEQ ID NO: 199851 - DNA, 15 bp, Homo sapiens
gaaagaagcagcagg

SEQ ID NO: 199852 - DNA, 15 bp, Homo sapiens
tgaaagaagcagcag

SEQ ID NO: 199853 - DNA, 15 bp, Homo sapiens
ttgaaagaagcagca

SEQ ID NO: 199854 - DNA, 15 bp, Homo sapiens
tttgaaagaagcagc

SEQ ID NO: 199855 - DNA, 15 bp, Homo sapiens
ctttgaaagaagcag

SEQ ID NO: 199856 - DNA, 15 bp, Homo sapiens
cctttgaaagaagca

SEQ ID NO: 199857 - DNA, 15 bp, Homo sapiens
ccctttgaaagaagc

SEQ ID NO: 199858 - DNA, 15 bp, Homo sapiens
accctttgaaagaag

SEQ ID NO: 199859 - DNA, 15 bp, Homo sapiens
gaccctttgaaagaa

SEQ ID NO: 199860 - DNA, 15 bp, Homo sapiens
agaccctttgaaaga

SEQ ID NO: 199861 - DNA, 15 bp, Homo sapiens
cagaccctttgaaag

SEQ ID NO: 199862 - DNA, 15 bp, Homo sapiens
acagaccctttgaaa

SEQ ID NO: 199863 - DNA, 15 bp, Homo sapiens
cacagaccctttgaa

SEQ ID NO: 199864 - DNA, 15 bp, Homo sapiens
ccacagaccctttga

SEQ ID NO: 199865 - DNA, 15 bp, Homo sapiens
accacagaccctttg

SEQ ID NO: 199866 - DNA, 15 bp, Homo sapiens
caccacagacccttt

SEQ ID NO: 199867 - DNA, 15 bp, Homo sapiens
acaccacagaccctt

SEQ ID NO: 199868 - DNA, 15 bp, Homo sapiens
gacaccacagaccct

SEQ ID NO: 199869 - DNA, 15 bp, Homo sapiens
agacaccacagaccc

SEQ ID NO: 199870 - DNA, 15 bp, Homo sapiens
cagacaccacagacc

SEQ ID NO: 199871 - DNA, 15 bp, Homo sapiens
acagacaccacagac

SEQ ID NO: 199872 - DNA, 15 bp, Homo sapiens
gacagacaccacaga

SEQ ID NO: 199873 - DNA, 15 bp, Homo sapiens
tgacagacaccacag

SEQ ID NO: 199874 - DNA, 15 bp, Homo sapiens
ctgacagacaccaca

SEQ ID NO: 199875 - DNA, 15 bp, Homo sapiens
actgacagacaccac

SEQ ID NO: 199876 - DNA, 15 bp, Homo sapiens
aactgacagacacca

SEQ ID NO: 199877 - DNA, 15 bp, Homo sapiens
aaactgacagacacc

SEQ ID NO: 199878 - DNA, 15 bp, Homo sapiens
aaaactgacagacac

SEQ ID NO: 199879 - DNA, 15 bp, Homo sapiens
gaaaactgacagaca

SEQ ID NO: 199880 - DNA, 15 bp, Homo sapiens
agaaaactgacagac

SEQ ID NO: 199881 - DNA, 15 bp, Homo sapiens
aagaaaactgacaga

SEQ ID NO: 199882 - DNA, 15 bp, Homo sapiens
caagaaaactgacag

SEQ ID NO: 199883 - DNA, 15 bp, Homo sapiens
acaagaaaactgaca

SEQ ID NO: 199884 - DNA, 15 bp, Homo sapiens
aacaagaaaactgac

SEQ ID NO: 199885 - DNA, 15 bp, Homo sapiens
taacaagaaaactga

SEQ ID NO: 199886 - DNA, 15 bp, Homo sapiens
ttaacaagaaaactg

SEQ ID NO: 199887 - DNA, 15 bp, Homo sapiens
cttaacaagaaaact

SEQ ID NO: 199888 - DNA, 15 bp, Homo sapiens
acttaacaagaaaac

SEQ ID NO: 199889 - DNA, 15 bp, Homo sapiens
aacttaacaagaaaa

SEQ ID NO: 199890 - DNA, 15 bp, Homo sapiens
gaacttaacaagaaa

SEQ ID NO: 199891 - DNA, 15 bp, Homo sapiens
ggaacttaacaagaa

SEQ ID NO: 199892 - DNA, 15 bp, Homo sapiens
aggaacttaacaaga

SEQ ID NO: 199893 - DNA, 15 bp, Homo sapiens
caggaacttaacaag

SEQ ID NO: 199894 - DNA, 15 bp, Homo sapiens
acaggaacttaacaa

SEQ ID NO: 199895 - DNA, 15 bp, Homo sapiens
cacaggaacttaaca

SEQ ID NO: 199896 - DNA, 15 bp, Homo sapiens
acacaggaacttaac

SEQ ID NO: 199897 - DNA, 15 bp, Homo sapiens
aacacaggaacttaa

SEQ ID NO: 199898 - DNA, 15 bp, Homo sapiens
caacacaggaactta

SEQ ID NO: 199899 - DNA, 15 bp, Homo sapiens
gcaacacaggaactt

SEQ ID NO: 199900 - DNA, 15 bp, Homo sapiens
agcaacacaggaact

SEQ ID NO: 199901 - DNA, 15 bp, Homo sapiens
aagcaacacaggaac

SEQ ID NO: 199902 - DNA, 15 bp, Homo sapiens
gaagcaacacaggaa

SEQ ID NO: 199903 - DNA, 15 bp, Homo sapiens
agaagcaacacagga

SEQ ID NO: 199904 - DNA, 15 bp, Homo sapiens
aagaagcaacacagg

SEQ ID NO: 199905 - DNA, 15 bp, Homo sapiens
caagaagcaacacag

SEQ ID NO: 199906 - DNA, 15 bp, Homo sapiens
ccaagaagcaacaca

SEQ ID NO: 199907 - DNA, 15 bp, Homo sapiens
tccaagaagcaacac

SEQ ID NO: 199908 - DNA, 15 bp, Homo sapiens
ttccaagaagcaaca

SEQ ID NO: 199909 - DNA, 15 bp, Homo sapiens
tttccaagaagcaac

SEQ ID NO: 199910 - DNA, 15 bp, Homo sapiens
atttccaagaagcaa

SEQ ID NO: 199911 - DNA, 15 bp, Homo sapiens
tatttccaagaagca

SEQ ID NO: 199912 - DNA, 15 bp, Homo sapiens
ttatttccaagaagc

SEQ ID NO: 199913 - DNA, 15 bp, Homo sapiens
cttatttccaagaag

SEQ ID NO: 199914 - DNA, 15 bp, Homo sapiens
acttatttccaagaa

SEQ ID NO: 199915 - DNA, 15 bp, Homo sapiens
aacttatttccaaga

SEQ ID NO: 199916 - DNA, 15 bp, Homo sapiens
gaacttatttccaag

SEQ ID NO: 199917 - DNA, 15 bp, Homo sapiens
tgaacttatttccaa

SEQ ID NO: 199918 - DNA, 15 bp, Homo sapiens
gtgaacttatttcca

SEQ ID NO: 199919 - DNA, 15 bp, Homo sapiens
tgtgaacttatttcc

SEQ ID NO: 199920 - DNA, 15 bp, Homo sapiens
ctgtgaacttatttc

SEQ ID NO: 199921 - DNA, 15 bp, Homo sapiens
actgtgaacttattt

SEQ ID NO: 199922 - DNA, 15 bp, Homo sapiens
tactgtgaacttatt

SEQ ID NO: 199923 - DNA, 15 bp, Homo sapiens
atactgtgaacttat

SEQ ID NO: 199924 - DNA, 15 bp, Homo sapiens
catactgtgaactta

SEQ ID NO: 199925 - DNA, 15 bp, Homo sapiens
tcatactgtgaactt

SEQ ID NO: 199926 - DNA, 15 bp, Homo sapiens
ttcatactgtgaact

SEQ ID NO: 199927 - DNA, 15 bp, Homo sapiens
attcatactgtgaac

SEQ ID NO: 199928 - DNA, 15 bp, Homo sapiens
gattcatactgtgaa

SEQ ID NO: 199929 - DNA, 15 bp, Homo sapiens
agattcatactgtga

SEQ ID NO: 199930 - DNA, 15 bp, Homo sapiens
aagattcatactgtg

SEQ ID NO: 199931 - DNA, 15 bp, Homo sapiens
aaagattcatactgt

SEQ ID NO: 199932 - DNA, 15 bp, Homo sapiens
taaagattcatactg

SEQ ID NO: 199933 - DNA, 15 bp, Homo sapiens
gtaaagattcatact

SEQ ID NO: 199934 - DNA, 15 bp, Homo sapiens
tgtaaagattcatac

SEQ ID NO: 199935 - DNA, 15 bp, Homo sapiens
gtgtaaagattcata

SEQ ID NO: 199936 - DNA, 15 bp, Homo sapiens
tgtgtaaagattcat

SEQ ID NO: 199937 - DNA, 15 bp, Homo sapiens
gtgtgtaaagattca

SEQ ID NO: 199938 - DNA, 15 bp, Homo sapiens
agtgtgtaaagattc

SEQ ID NO: 199939 - DNA, 15 bp, Homo sapiens
tagtgtgtaaagatt

SEQ ID NO: 199940 - DNA, 15 bp, Homo sapiens
atagtgtgtaaagat

SEQ ID NO: 199941 - DNA, 15 bp, Homo sapiens
aatagtgtgtaaaga

SEQ ID NO: 199942 - DNA, 15 bp, Homo sapiens
aaatagtgtgtaaag

SEQ ID NO: 199943 - DNA, 15 bp, Homo sapiens
gaaatagtgtgtaaa

SEQ ID NO: 199944 - DNA, 15 bp, Homo sapiens
cgaaatagtgtgtaa

SEQ ID NO: 199945 - DNA, 15 bp, Homo sapiens
acgaaatagtgtgta

SEQ ID NO: 199946 - DNA, 15 bp, Homo sapiens
gacgaaatagtgtgt

SEQ ID NO: 199947 - DNA, 15 bp, Homo sapiens
agacgaaatagtgtg

SEQ ID NO: 199948 - DNA, 15 bp, Homo sapiens
aagacgaaatagtgt

SEQ ID NO: 199949 - DNA, 15 bp, Homo sapiens
aaagacgaaatagtg

SEQ ID NO: 199950 - DNA, 15 bp, Homo sapiens
gaaagacgaaatagt

SEQ ID NO: 199951 - DNA, 15 bp, Homo sapiens
ggaaagacgaaatag

SEQ ID NO: 199952 - DNA, 15 bp, Homo sapiens
tggaaagacgaaata

SEQ ID NO: 199953 - DNA, 15 bp, Homo sapiens
ttggaaagacgaaat

SEQ ID NO: 199954 - DNA, 15 bp, Homo sapiens
cttggaaagacgaaa

SEQ ID NO: 199955 - DNA, 15 bp, Homo sapiens
acttggaaagacgaa

SEQ ID NO: 199956 - DNA, 15 bp, Homo sapiens
cacttggaaagacga

SEQ ID NO: 199957 - DNA, 15 bp, Homo sapiens
ccacttggaaagacg

SEQ ID NO: 199958 - DNA, 15 bp, Homo sapiens
tccacttggaaagac

SEQ ID NO: 199959 - DNA, 15 bp, Homo sapiens
ttccacttggaaaga

SEQ ID NO: 199960 - DNA, 15 bp, Homo sapiens
cttccacttggaaag

SEQ ID NO: 199961 - DNA, 15 bp, Homo sapiens
tcttccacttggaaa

SEQ ID NO: 199962 - DNA, 15 bp, Homo sapiens
ttcttccacttggaa

SEQ ID NO: 199963 - DNA, 15 bp, Homo sapiens
cttcttccacttgga

SEQ ID NO: 199964 - DNA, 15 bp, Homo sapiens
gcttcttccacttgg

SEQ ID NO: 199965 - DNA, 15 bp, Homo sapiens
tgcttcttccacttg

SEQ ID NO: 199966 - DNA, 15 bp, Homo sapiens
atgcttcttccactt

SEQ ID NO: 199967 - DNA, 15 bp, Homo sapiens
catgcttcttccact

SEQ ID NO: 199968 - DNA, 15 bp, Homo sapiens
gcatgcttcttccac

SEQ ID NO: 199969 - DNA, 15 bp, Homo sapiens
agcatgcttcttcca

SEQ ID NO: 199970 - DNA, 15 bp, Homo sapiens
tagcatgcttcttcc

SEQ ID NO: 199971 - DNA, 15 bp, Homo sapiens
ttagcatgcttcttc

SEQ ID NO: 199972 - DNA, 15 bp, Homo sapiens
gttagcatgcttctt

SEQ ID NO: 199973 - DNA, 15 bp, Homo sapiens
tgttagcatgcttct

SEQ ID NO: 199974 - DNA, 15 bp, Homo sapiens
ttgttagcatgcttc

SEQ ID NO: 199975 - DNA, 15 bp, Homo sapiens
attgttagcatgctt

SEQ ID NO: 199976 - DNA, 15 bp, Homo sapiens
cattgttagcatgct

SEQ ID NO: 199977 - DNA, 15 bp, Homo sapiens
gcattgttagcatgc

SEQ ID NO: 199978 - DNA, 15 bp, Homo sapiens
agcattgttagcatg

SEQ ID NO: 199979 - DNA, 15 bp, Homo sapiens
aagcattgttagcat

SEQ ID NO: 199980 - DNA, 15 bp, Homo sapiens
gaagcattgttagca

SEQ ID NO: 199981 - DNA, 15 bp, Homo sapiens
ggaagcattgttagc

SEQ ID NO: 199982 - DNA, 15 bp, Homo sapiens
tggaagcattgttag

SEQ ID NO: 199983 - DNA, 15 bp, Homo sapiens
ttggaagcattgtta

SEQ ID NO: 199984 - DNA, 15 bp, Homo sapiens
attggaagcattgtt

SEQ ID NO: 199985 - DNA, 15 bp, Homo sapiens
aattggaagcattgt

SEQ ID NO: 199986 - DNA, 15 bp, Homo sapiens
gaattggaagcattg

SEQ ID NO: 199987 - DNA, 15 bp, Homo sapiens
tgaattggaagcatt

SEQ ID NO: 199988 - DNA, 15 bp, Homo sapiens
ttgaattggaagcat

SEQ ID NO: 199989 - DNA, 15 bp, Homo sapiens
gttgaattggaagca

SEQ ID NO: 199990 - DNA, 15 bp, Homo sapiens
tgttgaattggaagc

SEQ ID NO: 199991 - DNA, 15 bp, Homo sapiens
atgttgaattggaag

SEQ ID NO: 199992 - DNA, 15 bp, Homo sapiens
gatgttgaattggaa

SEQ ID NO: 199993 - DNA, 15 bp, Homo sapiens
agatgttgaattgga

SEQ ID NO: 199994 - DNA, 15 bp, Homo sapiens
tagatgttgaattgg

SEQ ID NO: 199995 - DNA, 15 bp, Homo sapiens
ctagatgttgaattg

SEQ ID NO: 199996 - DNA, 15 bp, Homo sapiens
cctagatgttgaatt

SEQ ID NO: 199997 - DNA, 15 bp, Homo sapiens
ccctagatgttgaat

SEQ ID NO: 199998 - DNA, 15 bp, Homo sapiens
tccctagatgttgaa

SEQ ID NO: 199999 - DNA, 15 bp, Homo sapiens
ttccctagatgttga

SEQ ID NO: 200000 - DNA, 15 bp, Homo sapiens
tttccctagatgttg

SEQ ID NO: 200001 - DNA, 15 bp, Homo sapiens
ttttccctagatgtt

SEQ ID NO: 200002 - DNA, 15 bp, Homo sapiens
tttttccctagatgt

SEQ ID NO: 200003 - DNA, 15 bp, Homo sapiens
ttttttccctagatg

SEQ ID NO: 200004 - DNA, 15 bp, Homo sapiens
tttttttccctagat

SEQ ID NO: 200005 - DNA, 15 bp, Homo sapiens
ttttttttccctaga

SEQ ID NO: 200006 - DNA, 15 bp, Homo sapiens
tttttttttccctag

SEQ ID NO: 200007 - DNA, 15 bp, Homo sapiens
ctttttttttcccta

SEQ ID NO: 200008 - DNA, 15 bp, Homo sapiens
actttttttttccct

SEQ ID NO: 200009 - DNA, 15 bp, Homo sapiens
aactttttttttccc

SEQ ID NO: 200010 - DNA, 15 bp, Homo sapiens
aaactttttttttcc

SEQ ID NO: 200011 - DNA, 15 bp, Homo sapiens
aaaactttttttttc

SEQ ID NO: 200012 - DNA, 15 bp, Homo sapiens
taaaacttttttttt

SEQ ID NO: 200013 - DNA, 15 bp, Homo sapiens
ataaaactttttttt

SEQ ID NO: 200014 - DNA, 15 bp, Homo sapiens
aataaaacttttttt

SEQ ID NO: 200015 - DNA, 15 bp, Homo sapiens
gaataaaactttttt

SEQ ID NO: 200016 - DNA, 15 bp, Homo sapiens
tgaataaaacttttt

SEQ ID NO: 200017 - DNA, 15 bp, Homo sapiens
ctgaataaaactttt

SEQ ID NO: 200018 - DNA, 15 bp, Homo sapiens
actgaataaaacttt

SEQ ID NO: 200019 - DNA, 15 bp, Homo sapiens
aactgaataaaactt

SEQ ID NO: 200020 - DNA, 15 bp, Homo sapiens
aaactgaataaaact

SEQ ID NO: 200021 - DNA, 15 bp, Homo sapiens
taaactgaataaaac

SEQ ID NO: 200022 - DNA, 15 bp, Homo sapiens
ataaactgaataaaa

SEQ ID NO: 200023 - DNA, 15 bp, Homo sapiens
tataaactgaataaa

SEQ ID NO: 200024 - DNA, 15 bp, Homo sapiens
atataaactgaataa

SEQ ID NO: 200025 - DNA, 15 bp, Homo sapiens
catataaactgaata

SEQ ID NO: 200026 - DNA, 15 bp, Homo sapiens
gcatataaactgaat

SEQ ID NO: 200027 - DNA, 15 bp, Homo sapiens
agcatataaactgaa

SEQ ID NO: 200028 - DNA, 15 bp, Homo sapiens
tagcatataaactga

SEQ ID NO: 200029 - DNA, 15 bp, Homo sapiens
ctagcatataaactg

SEQ ID NO: 200030 - DNA, 15 bp, Homo sapiens
tctagcatataaact

SEQ ID NO: 200031 - DNA, 15 bp, Homo sapiens
atctagcatataaac

SEQ ID NO: 200032 - DNA, 15 bp, Homo sapiens
gatctagcatataaa

SEQ ID NO: 200033 - DNA, 15 bp, Homo sapiens
agatctagcatataa

SEQ ID NO: 200034 - DNA, 15 bp, Homo sapiens
tagatctagcatata

SEQ ID NO: 200035 - DNA, 15 bp, Homo sapiens
gtagatctagcatat

SEQ ID NO: 200036 - DNA, 15 bp, Homo sapiens
tgtagatctagcata

SEQ ID NO: 200037 - DNA, 15 bp, Homo sapiens
ttgtagatctagcat

SEQ ID NO: 200038 - DNA, 15 bp, Homo sapiens
attgtagatctagca

SEQ ID NO: 200039 - DNA, 15 bp, Homo sapiens
tattgtagatctagc

SEQ ID NO: 200040 - DNA, 15 bp, Homo sapiens
atattgtagatctag

SEQ ID NO: 200041 - DNA, 15 bp, Homo sapiens
aatattgtagatcta

SEQ ID NO: 200042 - DNA, 15 bp, Homo sapiens
aaatattgtagatct

SEQ ID NO: 200043 - DNA, 15 bp, Homo sapiens
gaaatattgtagatc

SEQ ID NO: 200044 - DNA, 15 bp, Homo sapiens
tgaaatattgtagat

SEQ ID NO: 200045 - DNA, 15 bp, Homo sapiens
ttgaaatattgtaga

SEQ ID NO: 200046 - DNA, 15 bp, Homo sapiens
gttgaaatattgtag

SEQ ID NO: 200047 - DNA, 15 bp, Homo sapiens
agttgaaatattgta

SEQ ID NO: 200048 - DNA, 15 bp, Homo sapiens
aagttgaaatattgt

SEQ ID NO: 200049 - DNA, 15 bp, Homo sapiens
caagttgaaatattg

SEQ ID NO: 200050 - DNA, 15 bp, Homo sapiens
tcaagttgaaatatt

SEQ ID NO: 200051 - DNA, 15 bp, Homo sapiens
atcaagttgaaatat

SEQ ID NO: 200052 - DNA, 15 bp, Homo sapiens
aatcaagttgaaata

SEQ ID NO: 200053 - DNA, 15 bp, Homo sapiens
taatcaagttgaaat

SEQ ID NO: 200054 - DNA, 15 bp, Homo sapiens
ataatcaagttgaaa

SEQ ID NO: 200055 - DNA, 15 bp, Homo sapiens
aataatcaagttgaa

SEQ ID NO: 200056 - DNA, 15 bp, Homo sapiens
aaataatcaagttga

SEQ ID NO: 200057 - DNA, 15 bp, Homo sapiens
taaataatcaagttg

SEQ ID NO: 200058 - DNA, 15 bp, Homo sapiens
ataaataatcaagtt

SEQ ID NO: 200059 - DNA, 15 bp, Homo sapiens
aataaataatcaagt

SEQ ID NO: 200060 - DNA, 15 bp, Homo sapiens
aaataaataatcaag

SEQ ID NO: 200061 - DNA, 15 bp, Homo sapiens
taaataaataatcaa

SEQ ID NO: 200062 - DNA, 15 bp, Homo sapiens
ataaataaataatca

SEQ ID NO: 200063 - DNA, 15 bp, Homo sapiens
aataaataaataatc

SEQ ID NO: 200064 - DNA, 15 bp, Homo sapiens
ccataaataaataaa

SEQ ID NO: 200065 - DNA, 15 bp, Homo sapiens
tccataaataaataa

SEQ ID NO: 200066 - DNA, 15 bp, Homo sapiens
ttccataaataaata

SEQ ID NO: 200067 - DNA, 15 bp, Homo sapiens
gttccataaataaat

SEQ ID NO: 200068 - DNA, 15 bp, Homo sapiens
tgttccataaataaa

SEQ ID NO: 200069 - DNA, 15 bp, Homo sapiens
ctgttccataaataa

SEQ ID NO: 200070 - DNA, 15 bp, Homo sapiens
tctgttccataaata

SEQ ID NO: 200071 - DNA, 15 bp, Homo sapiens
ctctgttccataaat

SEQ ID NO: 200072 - DNA, 15 bp, Homo sapiens
actctgttccataaa

SEQ ID NO: 200073 - DNA, 15 bp, Homo sapiens
gactctgttccataa

SEQ ID NO: 200074 - DNA, 15 bp, Homo sapiens
agactctgttccata

SEQ ID NO: 200075 - DNA, 15 bp, Homo sapiens
aagactctgttccat

SEQ ID NO: 200076 - DNA, 15 bp, Homo sapiens
caagactctgttcca

SEQ ID NO: 200077 - DNA, 15 bp, Homo sapiens
gcaagactctgttcc

SEQ ID NO: 200078 - DNA, 15 bp, Homo sapiens
agcaagactctgttc

SEQ ID NO: 200079 - DNA, 15 bp, Homo sapiens
gagcaagactctgtt

SEQ ID NO: 200080 - DNA, 15 bp, Homo sapiens
gcagagcaagactct

SEQ ID NO: 200081 - DNA, 15 bp, Homo sapiens
agcagagcaagactc

SEQ ID NO: 200082 - DNA, 15 bp, Homo sapiens
cagcagagcaagact

SEQ ID NO: 200083 - DNA, 15 bp, Homo sapiens
gcagcagagcaagac

SEQ ID NO: 200084 - DNA, 15 bp, Homo sapiens
ggcagcagagcaaga

SEQ ID NO: 200085 - DNA, 15 bp, Homo sapiens
gggcagcagagcaag

SEQ ID NO: 200086 - DNA, 15 bp, Homo sapiens
tgggcagcagagcaa

SEQ ID NO: 200087 - DNA, 15 bp, Homo sapiens
ctgggcagcagagca

SEQ ID NO: 200088 - DNA, 15 bp, Homo sapiens
cctgggcagcagagc

SEQ ID NO: 200089 - DNA, 15 bp, Homo sapiens
gcctgggcagcagag

SEQ ID NO: 200090 - DNA, 15 bp, Homo sapiens
agcctgggcagcaga

SEQ ID NO: 200091 - DNA, 15 bp, Homo sapiens
cagcctgggcagcag

SEQ ID NO: 200092 - DNA, 15 bp, Homo sapiens
ccagcctgggcagca

SEQ ID NO: 200093 - DNA, 15 bp, Homo sapiens
tccagcctgggcagc

SEQ ID NO: 200094 - DNA, 15 bp, Homo sapiens
ctccagcctgggcag

SEQ ID NO: 200095 - DNA, 15 bp, Homo sapiens
cgcactccagcctgg

SEQ ID NO: 200096 - DNA, 15 bp, Homo sapiens
tcgcactccagcctg

SEQ ID NO: 200097 - DNA, 15 bp, Homo sapiens
atcgcactccagcct

SEQ ID NO: 200098 - DNA, 15 bp, Homo sapiens
catcgcactccagcc

SEQ ID NO: 200099 - DNA, 15 bp, Homo sapiens
ccatcgcactccagc

SEQ ID NO: 200100 - DNA, 15 bp, Homo sapiens
accatcgcactccag

SEQ ID NO: 200101 - DNA, 15 bp, Homo sapiens
caccatcgcactcca

SEQ ID NO: 200102 - DNA, 15 bp, Homo sapiens
gcaccatcgcactcc

SEQ ID NO: 200103 - DNA, 15 bp, Homo sapiens
tgcaccatcgcactc

SEQ ID NO: 200104 - DNA, 15 bp, Homo sapiens
ttgcaccatcgcact

SEQ ID NO: 200105 - DNA, 15 bp, Homo sapiens
attgcaccatcgcac

SEQ ID NO: 200106 - DNA, 15 bp, Homo sapiens
gattgcaccatcgca

SEQ ID NO: 200107 - DNA, 15 bp, Homo sapiens
agattgcaccatcgc

SEQ ID NO: 200108 - DNA, 15 bp, Homo sapiens
aagattgcaccatcg

SEQ ID NO: 200109 - DNA, 15 bp, Homo sapiens
caagattgcaccatc

SEQ ID NO: 200110 - DNA, 15 bp, Homo sapiens
tagtgagccaagatt

SEQ ID NO: 200111 - DNA, 15 bp, Homo sapiens
gtagtgagccaagat

SEQ ID NO: 200112 - DNA, 15 bp, Homo sapiens
tgtagtgagccaaga

SEQ ID NO: 200113 - DNA, 15 bp, Homo sapiens
ttgtagtgagccaag

SEQ ID NO: 200114 - DNA, 15 bp, Homo sapiens
gttgtagtgagccaa

SEQ ID NO: 200115 - DNA, 15 bp, Homo sapiens
ggttgtagtgagcca

SEQ ID NO: 200116 - DNA, 15 bp, Homo sapiens
aggttgtagtgagcc

SEQ ID NO: 200117 - DNA, 15 bp, Homo sapiens
gaggttgtagtgagc

SEQ ID NO: 200118 - DNA, 15 bp, Homo sapiens
ggaggttgtagtgag

SEQ ID NO: 200119 - DNA, 15 bp, Homo sapiens
tggaggttgtagtga

SEQ ID NO: 200120 - DNA, 15 bp, Homo sapiens
atggaggttgtagtg

SEQ ID NO: 200121 - DNA, 15 bp, Homo sapiens
gatggaggttgtagt

SEQ ID NO: 200122 - DNA, 15 bp, Homo sapiens
agatggaggttgtag

SEQ ID NO: 200123 - DNA, 15 bp, Homo sapiens
gagatggaggttgta

SEQ ID NO: 200124 - DNA, 15 bp, Homo sapiens
ggagatggaggttgt

SEQ ID NO: 200125 - DNA, 15 bp, Homo sapiens
tgggagatggaggtt

SEQ ID NO: 200126 - DNA, 15 bp, Homo sapiens
ctgggagatggaggt

SEQ ID NO: 200127 - DNA, 15 bp, Homo sapiens
cctgggagatggagg

SEQ ID NO: 200128 - DNA, 15 bp, Homo sapiens
acctgggagatggag

SEQ ID NO: 200129 - DNA, 15 bp, Homo sapiens
aacctgggagatgga

SEQ ID NO: 200130 - DNA, 15 bp, Homo sapiens
gaacctgggagatgg

SEQ ID NO: 200131 - DNA, 15 bp, Homo sapiens
tgaacctgggagatg

SEQ ID NO: 200132 - DNA, 15 bp, Homo sapiens
ttgaacctgggagat

SEQ ID NO: 200133 - DNA, 15 bp, Homo sapiens
catcacttgaacctg

SEQ ID NO: 200134 - DNA, 15 bp, Homo sapiens
gcatcacttgaacct

SEQ ID NO: 200135 - DNA, 15 bp, Homo sapiens
agcatcacttgaacc

SEQ ID NO: 200136 - DNA, 15 bp, Homo sapiens
gagcatcacttgaac

SEQ ID NO: 200137 - DNA, 15 bp, Homo sapiens
tgagcatcacttgaa

SEQ ID NO: 200138 - DNA, 15 bp, Homo sapiens
atgagcatcacttga

SEQ ID NO: 200139 - DNA, 15 bp, Homo sapiens
catgagcatcacttg

SEQ ID NO: 200140 - DNA, 15 bp, Homo sapiens
gcatgagcatcactt

SEQ ID NO: 200141 - DNA, 15 bp, Homo sapiens
ggcatgagcatcact

SEQ ID NO: 200142 - DNA, 15 bp, Homo sapiens
aggcatgagcatcac

SEQ ID NO: 200143 - DNA, 15 bp, Homo sapiens
gaggcatgagcatca

SEQ ID NO: 200144 - DNA, 15 bp, Homo sapiens
tgaggcatgagcatc

SEQ ID NO: 200145 - DNA, 15 bp, Homo sapiens
ctgaggcatgagcat

SEQ ID NO: 200146 - DNA, 15 bp, Homo sapiens
gctgaggcatgagca

SEQ ID NO: 200147 - DNA, 15 bp, Homo sapiens
ggctgaggcatgagc

SEQ ID NO: 200148 - DNA, 15 bp, Homo sapiens
tccagctacatggga

SEQ ID NO: 200149 - DNA, 15 bp, Homo sapiens
ttccagctacatggg

SEQ ID NO: 200150 - DNA, 15 bp, Homo sapiens
tttccagctacatgg

SEQ ID NO: 200151 - DNA, 15 bp, Homo sapiens
atttccagctacatg

SEQ ID NO: 200152 - DNA, 15 bp, Homo sapiens
tatttccagctacat

SEQ ID NO: 200153 - DNA, 15 bp, Homo sapiens
gtatttccagctaca

SEQ ID NO: 200154 - DNA, 15 bp, Homo sapiens
tgtatttccagctac

SEQ ID NO: 200155 - DNA, 15 bp, Homo sapiens
ctgtatttccagcta

SEQ ID NO: 200156 - DNA, 15 bp, Homo sapiens
cctgtatttccagct

SEQ ID NO: 200157 - DNA, 15 bp, Homo sapiens
gtgcctgtatttcca

SEQ ID NO: 200158 - DNA, 15 bp, Homo sapiens
cgtgcctgtatttcc

SEQ ID NO: 200159 - DNA, 15 bp, Homo sapiens
acgtgcctgtatttc

SEQ ID NO: 200160 - DNA, 15 bp, Homo sapiens
cacgtgcctgtattt

SEQ ID NO: 200161 - DNA, 15 bp, Homo sapiens
gcacgtgcctgtatt

SEQ ID NO: 200162 - DNA, 15 bp, Homo sapiens
ggcacgtgcctgtat

SEQ ID NO: 200163 - DNA, 15 bp, Homo sapiens
atggtggcacgtgcc

SEQ ID NO: 200164 - DNA, 15 bp, Homo sapiens
catggtggcacgtgc

SEQ ID NO: 200165 - DNA, 15 bp, Homo sapiens
gcatggtggcacgtg

SEQ ID NO: 200166 - DNA, 15 bp, Homo sapiens
gggcatggtggcacg

SEQ ID NO: 200167 - DNA, 15 bp, Homo sapiens
tgggcatggtggcac

SEQ ID NO: 200168 - DNA, 15 bp, Homo sapiens
cgaaaccttgtctct

SEQ ID NO: 200169 - DNA, 15 bp, Homo sapiens
gcgaaaccttgtctc

SEQ ID NO: 200170 - DNA, 15 bp, Homo sapiens
ggcgaaaccttgtct

SEQ ID NO: 200171 - DNA, 15 bp, Homo sapiens
tggcgaaaccttgtc

SEQ ID NO: 200172 - DNA, 15 bp, Homo sapiens
atggcgaaaccttgt

SEQ ID NO: 200173 - DNA, 15 bp, Homo sapiens
tatggcgaaaccttg

SEQ ID NO: 200174 - DNA, 15 bp, Homo sapiens
atatggcgaaacctt

SEQ ID NO: 200175 - DNA, 15 bp, Homo sapiens
aatatggcgaaacct

SEQ ID NO: 200176 - DNA, 15 bp, Homo sapiens
caatatggcgaaacc

SEQ ID NO: 200177 - DNA, 15 bp, Homo sapiens
ccaatatggcgaaac

SEQ ID NO: 200178 - DNA, 15 bp, Homo sapiens
gccaatatggcgaaa

SEQ ID NO: 200179 - DNA, 15 bp, Homo sapiens
agccaatatggcgaa

SEQ ID NO: 200180 - DNA, 15 bp, Homo sapiens
cagccaatatggcga

SEQ ID NO: 200181 - DNA, 15 bp, Homo sapiens
ccagccaatatggcg

SEQ ID NO: 200182 - DNA, 15 bp, Homo sapiens
cccagccaatatggc

SEQ ID NO: 200183 - DNA, 15 bp, Homo sapiens
gcccagccaatatgg

SEQ ID NO: 200184 - DNA, 15 bp, Homo sapiens
agcccagccaatatg

SEQ ID NO: 200185 - DNA, 15 bp, Homo sapiens
cagcccagccaatat

SEQ ID NO: 200186 - DNA, 15 bp, Homo sapiens
gcagcccagccaata

SEQ ID NO: 200187 - DNA, 15 bp, Homo sapiens
agcagcccagccaat

SEQ ID NO: 200188 - DNA, 15 bp, Homo sapiens
gagcagcccagccaa

SEQ ID NO: 200189 - DNA, 15 bp, Homo sapiens
agagcagcccagcca

SEQ ID NO: 200190 - DNA, 15 bp, Homo sapiens
gagagcagcccagcc

SEQ ID NO: 200191 - DNA, 15 bp, Homo sapiens
cgagagcagcccagc

SEQ ID NO: 200192 - DNA, 15 bp, Homo sapiens
tcgagagcagcccag

SEQ ID NO: 200193 - DNA, 15 bp, Homo sapiens
ttcgagagcagccca

SEQ ID NO: 200194 - DNA, 15 bp, Homo sapiens
gttcgagagcagccc

SEQ ID NO: 200195 - DNA, 15 bp, Homo sapiens
agttcgagagcagcc

SEQ ID NO: 200196 - DNA, 15 bp, Homo sapiens
gagttcgagagcagc

SEQ ID NO: 200197 - DNA, 15 bp, Homo sapiens
ggagttcgagagcag

SEQ ID NO: 200198 - DNA, 15 bp, Homo sapiens
aggagttcgagagca

SEQ ID NO: 200199 - DNA, 15 bp, Homo sapiens
caggagttcgagagc

SEQ ID NO: 200200 - DNA, 15 bp, Homo sapiens
ccaggagttcgagag

SEQ ID NO: 200201 - DNA, 15 bp, Homo sapiens
gccaggagttcgaga

SEQ ID NO: 200202 - DNA, 15 bp, Homo sapiens
ggccaggagttcgag

SEQ ID NO: 200203 - DNA, 15 bp, Homo sapiens
aggccaggagttcga

SEQ ID NO: 200204 - DNA, 15 bp, Homo sapiens
gaggccaggagttcg

SEQ ID NO: 200205 - DNA, 15 bp, Homo sapiens
tgaggccaggagttc

SEQ ID NO: 200206 - DNA, 15 bp, Homo sapiens
ttgaggccaggagtt

SEQ ID NO: 200207 - DNA, 15 bp, Homo sapiens
cttgaggccaggagt

SEQ ID NO: 200208 - DNA, 15 bp, Homo sapiens
ggatcacttgaggcc

SEQ ID NO: 200209 - DNA, 15 bp, Homo sapiens
agggtggatcacttg

SEQ ID NO: 200210 - DNA, 15 bp, Homo sapiens
gagggtggatcactt

SEQ ID NO: 200211 - DNA, 15 bp, Homo sapiens
ggagggtggatcact

SEQ ID NO: 200212 - DNA, 15 bp, Homo sapiens
aaggccgaggagggt

SEQ ID NO: 200213 - DNA, 15 bp, Homo sapiens
gaaggccgaggaggg

SEQ ID NO: 200214 - DNA, 15 bp, Homo sapiens
ggaaggccgaggagg

SEQ ID NO: 200215 - DNA, 15 bp, Homo sapiens
tggaaggccgaggag

SEQ ID NO: 200216 - DNA, 15 bp, Homo sapiens
ttggaaggccgagga

SEQ ID NO: 200217 - DNA, 15 bp, Homo sapiens
cactttggaaggccg

SEQ ID NO: 200218 - DNA, 15 bp, Homo sapiens
gcactttggaaggcc

SEQ ID NO: 200219 - DNA, 15 bp, Homo sapiens
agcactttggaaggc

SEQ ID NO: 200220 - DNA, 15 bp, Homo sapiens
tagcactttggaagg

SEQ ID NO: 200221 - DNA, 15 bp, Homo sapiens
ctagcactttggaag

SEQ ID NO: 200222 - DNA, 15 bp, Homo sapiens
cctagcactttggaa

SEQ ID NO: 200223 - DNA, 15 bp, Homo sapiens
ccctagcactttgga

SEQ ID NO: 200224 - DNA, 15 bp, Homo sapiens
accctagcactttgg

SEQ ID NO: 200225 - DNA, 15 bp, Homo sapiens
aaccctagcactttg

SEQ ID NO: 200226 - DNA, 15 bp, Homo sapiens
taaccctagcacttt

SEQ ID NO: 200227 - DNA, 15 bp, Homo sapiens
gtaaccctagcactt

SEQ ID NO: 200228 - DNA, 15 bp, Homo sapiens
tgtaaccctagcact

SEQ ID NO: 200229 - DNA, 15 bp, Homo sapiens
ctgtaaccctagcac

SEQ ID NO: 200230 - DNA, 15 bp, Homo sapiens
cctgtaaccctagca

SEQ ID NO: 200231 - DNA, 15 bp, Homo sapiens
gcctgtaaccctagc

SEQ ID NO: 200232 - DNA, 15 bp, Homo sapiens
cgcctgtaaccctag

SEQ ID NO: 200233 - DNA, 15 bp, Homo sapiens
acgcctgtaacccta

SEQ ID NO: 200234 - DNA, 15 bp, Homo sapiens
cacgcctgtaaccct

SEQ ID NO: 200235 - DNA, 15 bp, Homo sapiens
tcacgcctgtaaccc

SEQ ID NO: 200236 - DNA, 15 bp, Homo sapiens
ctcacgcctgtaacc

SEQ ID NO: 200237 - DNA, 15 bp, Homo sapiens
gctcacgcctgtaac

SEQ ID NO: 200238 - DNA, 15 bp, Homo sapiens
gggccaggtgcagtg

SEQ ID NO: 200239 - DNA, 15 bp, Homo sapiens
ggggccaggtgcagt

SEQ ID NO: 200240 - DNA, 15 bp, Homo sapiens
tggggccaggtgcag

SEQ ID NO: 200241 - DNA, 15 bp, Homo sapiens
ttggggccaggtgca

SEQ ID NO: 200242 - DNA, 15 bp, Homo sapiens
gttggggccaggtgc

SEQ ID NO: 200243 - DNA, 15 bp, Homo sapiens
agttggggccaggtg

SEQ ID NO: 200244 - DNA, 15 bp, Homo sapiens
aagttggggccaggt

SEQ ID NO: 200245 - DNA, 15 bp, Homo sapiens
caagttggggccagg

SEQ ID NO: 200246 - DNA, 15 bp, Homo sapiens
tcaagttggggccag

SEQ ID NO: 200247 - DNA, 15 bp, Homo sapiens
atcaagttggggcca

SEQ ID NO: 200248 - DNA, 15 bp, Homo sapiens
aatcaagttggggcc

SEQ ID NO: 200249 - DNA, 15 bp, Homo sapiens
taatcaagttggggc

SEQ ID NO: 200250 - DNA, 15 bp, Homo sapiens
ataatcaagttgggg

SEQ ID NO: 200251 - DNA, 15 bp, Homo sapiens
tataatcaagttggg

SEQ ID NO: 200252 - DNA, 15 bp, Homo sapiens
atataatcaagttgg

SEQ ID NO: 200253 - DNA, 15 bp, Homo sapiens
aatataatcaagttg

SEQ ID NO: 200254 - DNA, 15 bp, Homo sapiens
aaatataatcaagtt

SEQ ID NO: 200255 - DNA, 15 bp, Homo sapiens
taaatataatcaagt

SEQ ID NO: 200256 - DNA, 15 bp, Homo sapiens
ttaaatataatcaag

SEQ ID NO: 200257 - DNA, 15 bp, Homo sapiens
tttaaatataatcaa

SEQ ID NO: 200258 - DNA, 15 bp, Homo sapiens
atttaaatataatca

SEQ ID NO: 200259 - DNA, 15 bp, Homo sapiens
catttaaatataatc

SEQ ID NO: 200260 - DNA, 15 bp, Homo sapiens
gcatttaaatataat

SEQ ID NO: 200261 - DNA, 15 bp, Homo sapiens
tgcatttaaatataa

SEQ ID NO: 200262 - DNA, 15 bp, Homo sapiens
gtgcatttaaatata

SEQ ID NO: 200263 - DNA, 15 bp, Homo sapiens
tgtgcatttaaatat

SEQ ID NO: 200264 - DNA, 15 bp, Homo sapiens
atgtgcatttaaata

SEQ ID NO: 200265 - DNA, 15 bp, Homo sapiens
gatgtgcatttaaat

SEQ ID NO: 200266 - DNA, 15 bp, Homo sapiens
ggatgtgcatttaaa

SEQ ID NO: 200267 - DNA, 15 bp, Homo sapiens
aggatgtgcatttaa

SEQ ID NO: 200268 - DNA, 15 bp, Homo sapiens
taggatgtgcattta

SEQ ID NO: 200269 - DNA, 15 bp, Homo sapiens
ttaggatgtgcattt

SEQ ID NO: 200270 - DNA, 15 bp, Homo sapiens
tttaggatgtgcatt

SEQ ID NO: 200271 - DNA, 15 bp, Homo sapiens
ctttaggatgtgcat

SEQ ID NO: 200272 - DNA, 15 bp, Homo sapiens
actttaggatgtgca

SEQ ID NO: 200273 - DNA, 15 bp, Homo sapiens
tactttaggatgtgc

SEQ ID NO: 200274 - DNA, 15 bp, Homo sapiens
atactttaggatgtg

SEQ ID NO: 200275 - DNA, 15 bp, Homo sapiens
aatactttaggatgt

SEQ ID NO: 200276 - DNA, 15 bp, Homo sapiens
aaatactttaggatg

SEQ ID NO: 200277 - DNA, 15 bp, Homo sapiens
aaaatactttaggat

SEQ ID NO: 200278 - DNA, 15 bp, Homo sapiens
gaaaatactttagga

SEQ ID NO: 200279 - DNA, 15 bp, Homo sapiens
tgaaaatactttagg

SEQ ID NO: 200280 - DNA, 15 bp, Homo sapiens
ttgaaaatactttag

SEQ ID NO: 200281 - DNA, 15 bp, Homo sapiens
gttgaaaatacttta

SEQ ID NO: 200282 - DNA, 15 bp, Homo sapiens
agttgaaaatacttt

SEQ ID NO: 200283 - DNA, 15 bp, Homo sapiens
cagttgaaaatactt

SEQ ID NO: 200284 - DNA, 15 bp, Homo sapiens
acagttgaaaatact

SEQ ID NO: 200285 - DNA, 15 bp, Homo sapiens
gacagttgaaaatac

SEQ ID NO: 200286 - DNA, 15 bp, Homo sapiens
tgacagttgaaaata

SEQ ID NO: 200287 - DNA, 15 bp, Homo sapiens
ttgacagttgaaaat

SEQ ID NO: 200288 - DNA, 15 bp, Homo sapiens
tttgacagttgaaaa

SEQ ID NO: 200289 - DNA, 15 bp, Homo sapiens
atttgacagttgaaa

SEQ ID NO: 200290 - DNA, 15 bp, Homo sapiens
aatttgacagttgaa

SEQ ID NO: 200291 - DNA, 15 bp, Homo sapiens
gaatttgacagttga

SEQ ID NO: 200292 - DNA, 15 bp, Homo sapiens
agaatttgacagttg

SEQ ID NO: 200293 - DNA, 15 bp, Homo sapiens
gagaatttgacagtt

SEQ ID NO: 200294 - DNA, 15 bp, Homo sapiens
ggagaatttgacagt

SEQ ID NO: 200295 - DNA, 15 bp, Homo sapiens
tggagaatttgacag

SEQ ID NO: 200296 - DNA, 15 bp, Homo sapiens
ctggagaatttgaca

SEQ ID NO: 200297 - DNA, 15 bp, Homo sapiens
gctggagaatttgac

SEQ ID NO: 200298 - DNA, 15 bp, Homo sapiens
agctggagaatttga

SEQ ID NO: 200299 - DNA, 15 bp, Homo sapiens
aagctggagaatttg

SEQ ID NO: 200300 - DNA, 15 bp, Homo sapiens
aaagctggagaattt

SEQ ID NO: 200301 - DNA, 15 bp, Homo sapiens
aaaagctggagaatt

SEQ ID NO: 200302 - DNA, 15 bp, Homo sapiens
taaaagctggagaat

SEQ ID NO: 200303 - DNA, 15 bp, Homo sapiens
ttaaaagctggagaa

SEQ ID NO: 200304 - DNA, 15 bp, Homo sapiens
tttaaaagctggaga

SEQ ID NO: 200305 - DNA, 15 bp, Homo sapiens
gtttaaaagctggag

SEQ ID NO: 200306 - DNA, 15 bp, Homo sapiens
tgtttaaaagctgga

SEQ ID NO: 200307 - DNA, 15 bp, Homo sapiens
atgtttaaaagctgg

SEQ ID NO: 200308 - DNA, 15 bp, Homo sapiens
aatgtttaaaagctg

SEQ ID NO: 200309 - DNA, 15 bp, Homo sapiens
aaatgtttaaaagct

SEQ ID NO: 200310 - DNA, 15 bp, Homo sapiens
taaatgtttaaaagc

SEQ ID NO: 200311 - DNA, 15 bp, Homo sapiens
ataaatgtttaaaag

SEQ ID NO: 200312 - DNA, 15 bp, Homo sapiens
aataaatgtttaaaa

SEQ ID NO: 200313 - DNA, 15 bp, Homo sapiens
gaataaatgtttaaa

SEQ ID NO: 200314 - DNA, 15 bp, Homo sapiens
ggaataaatgtttaa

SEQ ID NO: 200315 - DNA, 15 bp, Homo sapiens
aggaataaatgttta

SEQ ID NO: 200316 - DNA, 15 bp, Homo sapiens
aaggaataaatgttt

SEQ ID NO: 200317 - DNA, 15 bp, Homo sapiens
aaaggaataaatgtt

SEQ ID NO: 200318 - DNA, 15 bp, Homo sapiens
aaaaggaataaatgt

SEQ ID NO: 200319 - DNA, 15 bp, Homo sapiens
aaaaaggaataaatg

SEQ ID NO: 200320 - DNA, 15 bp, Homo sapiens
aaaaaaggaataaat

SEQ ID NO: 200321 - DNA, 15 bp, Homo sapiens
aaaaaaaggaataaa

SEQ ID NO: 200322 - DNA, 15 bp, Homo sapiens
aaaaaaaaggaataa

SEQ ID NO: 200323 - DNA, 15 bp, Homo sapiens
gaaaaaaaaggaata

SEQ ID NO: 200324 - DNA, 15 bp, Homo sapiens
ggaaaaaaaaggaat

SEQ ID NO: 200325 - DNA, 15 bp, Homo sapiens
aggaaaaaaaaggaa

SEQ ID NO: 200326 - DNA, 15 bp, Homo sapiens
caggaaaaaaaagga

SEQ ID NO: 200327 - DNA, 15 bp, Homo sapiens
tcaggaaaaaaaagg

SEQ ID NO: 200328 - DNA, 15 bp, Homo sapiens
attcaggaaaaaaaa

SEQ ID NO: 200329 - DNA, 15 bp, Homo sapiens
aattcaggaaaaaaa

SEQ ID NO: 200330 - DNA, 15 bp, Homo sapiens
aaattcaggaaaaaa

SEQ ID NO: 200331 - DNA, 15 bp, Homo sapiens
aaaattcaggaaaaa

SEQ ID NO: 200332 - DNA, 15 bp, Homo sapiens
gaaaattcaggaaaa

SEQ ID NO: 200333 - DNA, 15 bp, Homo sapiens
tgaaaattcaggaaa

SEQ ID NO: 200334 - DNA, 15 bp, Homo sapiens
gtgaaaattcaggaa

SEQ ID NO: 200335 - DNA, 15 bp, Homo sapiens
tgtgaaaattcagga

SEQ ID NO: 200336 - DNA, 15 bp, Homo sapiens
atgtgaaaattcagg

SEQ ID NO: 200337 - DNA, 15 bp, Homo sapiens
gatgtgaaaattcag

SEQ ID NO: 200338 - DNA, 15 bp, Homo sapiens
agatgtgaaaattca

SEQ ID NO: 200339 - DNA, 15 bp, Homo sapiens
aagatgtgaaaattc

SEQ ID NO: 200340 - DNA, 15 bp, Homo sapiens
aaagatgtgaaaatt

SEQ ID NO: 200341 - DNA, 15 bp, Homo sapiens
gaaagatgtgaaaat

SEQ ID NO: 200342 - DNA, 15 bp, Homo sapiens
agaaagatgtgaaaa

SEQ ID NO: 200343 - DNA, 15 bp, Homo sapiens
aagaaagatgtgaaa

SEQ ID NO: 200344 - DNA, 15 bp, Homo sapiens
gaagaaagatgtgaa

SEQ ID NO: 200345 - DNA, 15 bp, Homo sapiens
agaagaaagatgtga

SEQ ID NO: 200346 - DNA, 15 bp, Homo sapiens
tagaagaaagatgtg

SEQ ID NO: 200347 - DNA, 15 bp, Homo sapiens
ttagaagaaagatgt

SEQ ID NO: 200348 - DNA, 15 bp, Homo sapiens
attagaagaaagatg

SEQ ID NO: 200349 - DNA, 15 bp, Homo sapiens
gattagaagaaagat

SEQ ID NO: 200350 - DNA, 15 bp, Homo sapiens
agattagaagaaaga

SEQ ID NO: 200351 - DNA, 15 bp, Homo sapiens
aagattagaagaaag

SEQ ID NO: 200352 - DNA, 15 bp, Homo sapiens
gaagattagaagaaa

SEQ ID NO: 200353 - DNA, 15 bp, Homo sapiens
tgaagattagaagaa

SEQ ID NO: 200354 - DNA, 15 bp, Homo sapiens
ctgaagattagaaga

SEQ ID NO: 200355 - DNA, 15 bp, Homo sapiens
actgaagattagaag

SEQ ID NO: 200356 - DNA, 15 bp, Homo sapiens
aactgaagattagaa

SEQ ID NO: 200357 - DNA, 15 bp, Homo sapiens
taactgaagattaga

SEQ ID NO: 200358 - DNA, 15 bp, Homo sapiens
gtaactgaagattag

SEQ ID NO: 200359 - DNA, 15 bp, Homo sapiens
agtaactgaagatta

SEQ ID NO: 200360 - DNA, 15 bp, Homo sapiens
aagtaactgaagatt

SEQ ID NO: 200361 - DNA, 15 bp, Homo sapiens
taagtaactgaagat

SEQ ID NO: 200362 - DNA, 15 bp, Homo sapiens
ttaagtaactgaaga

SEQ ID NO: 200363 - DNA, 15 bp, Homo sapiens
tttaagtaactgaag

SEQ ID NO: 200364 - DNA, 15 bp, Homo sapiens
gtttaagtaactgaa

SEQ ID NO: 200365 - DNA, 15 bp, Homo sapiens
ggtttaagtaactga

SEQ ID NO: 200366 - DNA, 15 bp, Homo sapiens
gggtttaagtaactg

SEQ ID NO: 200367 - DNA, 15 bp, Homo sapiens
agggtttaagtaact

SEQ ID NO: 200368 - DNA, 15 bp, Homo sapiens
aagggtttaagtaac

SEQ ID NO: 200369 - DNA, 15 bp, Homo sapiens
gaagggtttaagtaa

SEQ ID NO: 200370 - DNA, 15 bp, Homo sapiens
ggaagggtttaagta

SEQ ID NO: 200371 - DNA, 15 bp, Homo sapiens
aggaagggtttaagt

SEQ ID NO: 200372 - DNA, 15 bp, Homo sapiens
gaggaagggtttaag

SEQ ID NO: 200373 - DNA, 15 bp, Homo sapiens
agaggaagggtttaa

SEQ ID NO: 200374 - DNA, 15 bp, Homo sapiens
aagaggaagggttta

SEQ ID NO: 200375 - DNA, 15 bp, Homo sapiens
aaagaggaagggttt

SEQ ID NO: 200376 - DNA, 15 bp, Homo sapiens
aaaagaggaagggtt

SEQ ID NO: 200377 - DNA, 15 bp, Homo sapiens
gaaaagaggaagggt

SEQ ID NO: 200378 - DNA, 15 bp, Homo sapiens
tgaaaagaggaaggg

SEQ ID NO: 200379 - DNA, 15 bp, Homo sapiens
ctgaaaagaggaagg

SEQ ID NO: 200380 - DNA, 15 bp, Homo sapiens
tctgaaaagaggaag

SEQ ID NO: 200381 - DNA, 15 bp, Homo sapiens
gtctgaaaagaggaa

SEQ ID NO: 200382 - DNA, 15 bp, Homo sapiens
agtctgaaaagagga

SEQ ID NO: 200383 - DNA, 15 bp, Homo sapiens
gagtctgaaaagagg

SEQ ID NO: 200384 - DNA, 15 bp, Homo sapiens
ggagtctgaaaagag

SEQ ID NO: 200385 - DNA, 15 bp, Homo sapiens
tggagtctgaaaaga

SEQ ID NO: 200386 - DNA, 15 bp, Homo sapiens
atggagtctgaaaag

SEQ ID NO: 200387 - DNA, 15 bp, Homo sapiens
aatggagtctgaaaa

SEQ ID NO: 200388 - DNA, 15 bp, Homo sapiens
taatggagtctgaaa

SEQ ID NO: 200389 - DNA, 15 bp, Homo sapiens
ttaatggagtctgaa

SEQ ID NO: 200390 - DNA, 15 bp, Homo sapiens
attaatggagtctga

SEQ ID NO: 200391 - DNA, 15 bp, Homo sapiens
gattaatggagtctg

SEQ ID NO: 200392 - DNA, 15 bp, Homo sapiens
ggattaatggagtct

SEQ ID NO: 200393 - DNA, 15 bp, Homo sapiens
gggattaatggagtc

SEQ ID NO: 200394 - DNA, 15 bp, Homo sapiens
agggattaatggagt

SEQ ID NO: 200395 - DNA, 15 bp, Homo sapiens
aagggattaatggag

SEQ ID NO: 200396 - DNA, 15 bp, Homo sapiens
gaagggattaatgga

SEQ ID NO: 200397 - DNA, 15 bp, Homo sapiens
agaagggattaatgg

SEQ ID NO: 200398 - DNA, 15 bp, Homo sapiens
tagaagggattaatg

SEQ ID NO: 200399 - DNA, 15 bp, Homo sapiens
gtagaagggattaat

SEQ ID NO: 200400 - DNA, 15 bp, Homo sapiens
ggtagaagggattaa

SEQ ID NO: 200401 - DNA, 15 bp, Homo sapiens
aggtagaagggatta

SEQ ID NO: 200402 - DNA, 15 bp, Homo sapiens
taggtagaagggatt

SEQ ID NO: 200403 - DNA, 15 bp, Homo sapiens
ctaggtagaagggat

SEQ ID NO: 200404 - DNA, 15 bp, Homo sapiens
actaggtagaaggga

SEQ ID NO: 200405 - DNA, 15 bp, Homo sapiens
aactaggtagaaggg

SEQ ID NO: 200406 - DNA, 15 bp, Homo sapiens
aaactaggtagaagg

SEQ ID NO: 200407 - DNA, 15 bp, Homo sapiens
caaactaggtagaag

SEQ ID NO: 200408 - DNA, 15 bp, Homo sapiens
ccaaactaggtagaa

SEQ ID NO: 200409 - DNA, 15 bp, Homo sapiens
tccaaactaggtaga

SEQ ID NO: 200410 - DNA, 15 bp, Homo sapiens
ctccaaactaggtag

SEQ ID NO: 200411 - DNA, 15 bp, Homo sapiens
gctccaaactaggta

SEQ ID NO: 200412 - DNA, 15 bp, Homo sapiens
ggctccaaactaggt

SEQ ID NO: 200413 - DNA, 15 bp, Homo sapiens
gggctccaaactagg

SEQ ID NO: 200414 - DNA, 15 bp, Homo sapiens
tgggctccaaactag

SEQ ID NO: 200415 - DNA, 15 bp, Homo sapiens
atgggctccaaacta

SEQ ID NO: 200416 - DNA, 15 bp, Homo sapiens
gatgggctccaaact

SEQ ID NO: 200417 - DNA, 15 bp, Homo sapiens
tgatgggctccaaac

SEQ ID NO: 200418 - DNA, 15 bp, Homo sapiens
atgatgggctccaaa

SEQ ID NO: 200419 - DNA, 15 bp, Homo sapiens
tatgatgggctccaa

SEQ ID NO: 200420 - DNA, 15 bp, Homo sapiens
ttatgatgggctcca

SEQ ID NO: 200421 - DNA, 15 bp, Homo sapiens
cttatgatgggctcc

SEQ ID NO: 200422 - DNA, 15 bp, Homo sapiens
tcttatgatgggctc

SEQ ID NO: 200423 - DNA, 15 bp, Homo sapiens
atcttatgatgggct

SEQ ID NO: 200424 - DNA, 15 bp, Homo sapiens
tatcttatgatgggc

SEQ ID NO: 200425 - DNA, 15 bp, Homo sapiens
gtatcttatgatggg

SEQ ID NO: 200426 - DNA, 15 bp, Homo sapiens
agtatcttatgatgg

SEQ ID NO: 200427 - DNA, 15 bp, Homo sapiens
aagtatcttatgatg

SEQ ID NO: 200428 - DNA, 15 bp, Homo sapiens
gaagtatcttatgat

SEQ ID NO: 200429 - DNA, 15 bp, Homo sapiens
tgaagtatcttatga

SEQ ID NO: 200430 - DNA, 15 bp, Homo sapiens
ctgaagtatcttatg

SEQ ID NO: 200431 - DNA, 15 bp, Homo sapiens
gctgaagtatcttat

SEQ ID NO: 200432 - DNA, 15 bp, Homo sapiens
tgctgaagtatctta

SEQ ID NO: 200433 - DNA, 15 bp, Homo sapiens
ctgctgaagtatctt

SEQ ID NO: 200434 - DNA, 15 bp, Homo sapiens
actgctgaagtatct

SEQ ID NO: 200435 - DNA, 15 bp, Homo sapiens
cactgctgaagtatc

SEQ ID NO: 200436 - DNA, 15 bp, Homo sapiens
acactgctgaagtat

SEQ ID NO: 200437 - DNA, 15 bp, Homo sapiens
gacactgctgaagta

SEQ ID NO: 200438 - DNA, 15 bp, Homo sapiens
tgacactgctgaagt

SEQ ID NO: 200439 - DNA, 15 bp, Homo sapiens
ttgacactgctgaag

SEQ ID NO: 200440 - DNA, 15 bp, Homo sapiens
cttgacactgctgaa

SEQ ID NO: 200441 - DNA, 15 bp, Homo sapiens
tcttgacactgctga

SEQ ID NO: 200442 - DNA, 15 bp, Homo sapiens
ctcttgacactgctg

SEQ ID NO: 200443 - DNA, 15 bp, Homo sapiens
gctcttgacactgct

SEQ ID NO: 200444 - DNA, 15 bp, Homo sapiens
agctcttgacactgc

SEQ ID NO: 200445 - DNA, 15 bp, Homo sapiens
aagctcttgacactg

SEQ ID NO: 200446 - DNA, 15 bp, Homo sapiens
caagctcttgacact

SEQ ID NO: 200447 - DNA, 15 bp, Homo sapiens
tcaagctcttgacac

SEQ ID NO: 200448 - DNA, 15 bp, Homo sapiens
ttcaagctcttgaca

SEQ ID NO: 200449 - DNA, 15 bp, Homo sapiens
attcaagctcttgac

SEQ ID NO: 200450 - DNA, 15 bp, Homo sapiens
aattcaagctcttga

SEQ ID NO: 200451 - DNA, 15 bp, Homo sapiens
aaattcaagctcttg

SEQ ID NO: 200452 - DNA, 15 bp, Homo sapiens
gaaattcaagctctt

SEQ ID NO: 200453 - DNA, 15 bp, Homo sapiens
ggaaattcaagctct

SEQ ID NO: 200454 - DNA, 15 bp, Homo sapiens
aggaaattcaagctc

SEQ ID NO: 200455 - DNA, 15 bp, Homo sapiens
aaggaaattcaagct

SEQ ID NO: 200456 - DNA, 15 bp, Homo sapiens
aaaggaaattcaagc

SEQ ID NO: 200457 - DNA, 15 bp, Homo sapiens
gaaaggaaattcaag

SEQ ID NO: 200458 - DNA, 15 bp, Homo sapiens
ggaaaggaaattcaa

SEQ ID NO: 200459 - DNA, 15 bp, Homo sapiens
gggaaaggaaattca

SEQ ID NO: 200460 - DNA, 15 bp, Homo sapiens
ggggaaaggaaattc

SEQ ID NO: 200461 - DNA, 15 bp, Homo sapiens
aggggaaaggaaatt

SEQ ID NO: 200462 - DNA, 15 bp, Homo sapiens
aaggggaaaggaaat

SEQ ID NO: 200463 - DNA, 15 bp, Homo sapiens
aaaggggaaaggaaa

SEQ ID NO: 200464 - DNA, 15 bp, Homo sapiens
aaaaggggaaaggaa

SEQ ID NO: 200465 - DNA, 15 bp, Homo sapiens
taaaaggggaaagga

SEQ ID NO: 200466 - DNA, 15 bp, Homo sapiens
ttaaaaggggaaagg

SEQ ID NO: 200467 - DNA, 15 bp, Homo sapiens
gttaaaaggggaaag

SEQ ID NO: 200468 - DNA, 15 bp, Homo sapiens
aagttaaaaggggaa

SEQ ID NO: 200469 - DNA, 15 bp, Homo sapiens
gaagttaaaagggga

SEQ ID NO: 200470 - DNA, 15 bp, Homo sapiens
agaagttaaaagggg

SEQ ID NO: 200471 - DNA, 15 bp, Homo sapiens
aagaagttaaaaggg

SEQ ID NO: 200472 - DNA, 15 bp, Homo sapiens
gaagaagttaaaagg

SEQ ID NO: 200473 - DNA, 15 bp, Homo sapiens
agaagaagttaaaag

SEQ ID NO: 200474 - DNA, 15 bp, Homo sapiens
tagaagaagttaaaa

SEQ ID NO: 200475 - DNA, 15 bp, Homo sapiens
atagaagaagttaaa

SEQ ID NO: 200476 - DNA, 15 bp, Homo sapiens
aatagaagaagttaa

SEQ ID NO: 200477 - DNA, 15 bp, Homo sapiens
aaatagaagaagtta

SEQ ID NO: 200478 - DNA, 15 bp, Homo sapiens
gaaatagaagaagtt

SEQ ID NO: 200479 - DNA, 15 bp, Homo sapiens
ggaaatagaagaagt

SEQ ID NO: 200480 - DNA, 15 bp, Homo sapiens
gggaaatagaagaag

SEQ ID NO: 200481 - DNA, 15 bp, Homo sapiens
tgggaaatagaagaa

SEQ ID NO: 200482 - DNA, 15 bp, Homo sapiens
ctgggaaatagaaga

SEQ ID NO: 200483 - DNA, 15 bp, Homo sapiens
actgggaaatagaag

SEQ ID NO: 200484 - DNA, 15 bp, Homo sapiens
gactgggaaatagaa

SEQ ID NO: 200485 - DNA, 15 bp, Homo sapiens
agactgggaaataga

SEQ ID NO: 200486 - DNA, 15 bp, Homo sapiens
gagactgggaaatag

SEQ ID NO: 200487 - DNA, 15 bp, Homo sapiens
agagactgggaaata

SEQ ID NO: 200488 - DNA, 15 bp, Homo sapiens
cagagactgggaaat

SEQ ID NO: 200489 - DNA, 15 bp, Homo sapiens
tcagagactgggaaa

SEQ ID NO: 200490 - DNA, 15 bp, Homo sapiens
gtcagagactgggaa

SEQ ID NO: 200491 - DNA, 15 bp, Homo sapiens
tgtcagagactggga

SEQ ID NO: 200492 - DNA, 15 bp, Homo sapiens
atgtcagagactggg

SEQ ID NO: 200493 - DNA, 15 bp, Homo sapiens
aatgtcagagactgg

SEQ ID NO: 200494 - DNA, 15 bp, Homo sapiens
gaatgtcagagactg

SEQ ID NO: 200495 - DNA, 15 bp, Homo sapiens
ggaatgtcagagact

SEQ ID NO: 200496 - DNA, 15 bp, Homo sapiens
tggaatgtcagagac

SEQ ID NO: 200497 - DNA, 15 bp, Homo sapiens
ttggaatgtcagaga

SEQ ID NO: 200498 - DNA, 15 bp, Homo sapiens
attggaatgtcagag

SEQ ID NO: 200499 - DNA, 15 bp, Homo sapiens
cattggaatgtcaga

SEQ ID NO: 200500 - DNA, 15 bp, Homo sapiens
acattggaatgtcag

SEQ ID NO: 200501 - DNA, 15 bp, Homo sapiens
gacattggaatgtca

SEQ ID NO: 200502 - DNA, 15 bp, Homo sapiens
ggacattggaatgtc

SEQ ID NO: 200503 - DNA, 15 bp, Homo sapiens
tggacattggaatgt

SEQ ID NO: 200504 - DNA, 15 bp, Homo sapiens
atggacattggaatg

SEQ ID NO: 200505 - DNA, 15 bp, Homo sapiens
tatggacattggaat

SEQ ID NO: 200506 - DNA, 15 bp, Homo sapiens
gtatggacattggaa

SEQ ID NO: 200507 - DNA, 15 bp, Homo sapiens
agtatggacattgga

SEQ ID NO: 200508 - DNA, 15 bp, Homo sapiens
gagtatggacattgg

SEQ ID NO: 200509 - DNA, 15 bp, Homo sapiens
agagtatggacattg

SEQ ID NO: 200510 - DNA, 15 bp, Homo sapiens
gagagtatggacatt

SEQ ID NO: 200511 - DNA, 15 bp, Homo sapiens
agagagtatggacat

SEQ ID NO: 200512 - DNA, 15 bp, Homo sapiens
gagagagtatggaca

SEQ ID NO: 200513 - DNA, 15 bp, Homo sapiens
agagagagtatggac

SEQ ID NO: 200514 - DNA, 15 bp, Homo sapiens
tagagagagtatgga

SEQ ID NO: 200515 - DNA, 15 bp, Homo sapiens
atagagagagtatgg

SEQ ID NO: 200516 - DNA, 15 bp, Homo sapiens
gatagagagagtatg

SEQ ID NO: 200517 - DNA, 15 bp, Homo sapiens
ggatagagagagtat

SEQ ID NO: 200518 - DNA, 15 bp, Homo sapiens
gggatagagagagta

SEQ ID NO: 200519 - DNA, 15 bp, Homo sapiens
agggatagagagagt

SEQ ID NO: 200520 - DNA, 15 bp, Homo sapiens
aagggatagagagag

SEQ ID NO: 200521 - DNA, 15 bp, Homo sapiens
caagggatagagaga

SEQ ID NO: 200522 - DNA, 15 bp, Homo sapiens
acaagggatagagag

SEQ ID NO: 200523 - DNA, 15 bp, Homo sapiens
gacaagggatagaga

SEQ ID NO: 200524 - DNA, 15 bp, Homo sapiens
agacaagggatagag

SEQ ID NO: 200525 - DNA, 15 bp, Homo sapiens
aagacaagggataga

SEQ ID NO: 200526 - DNA, 15 bp, Homo sapiens
aaagacaagggatag

SEQ ID NO: 200527 - DNA, 15 bp, Homo sapiens
taaagacaagggata

SEQ ID NO: 200528 - DNA, 15 bp, Homo sapiens
ttaaagacaagggat

SEQ ID NO: 200529 - DNA, 15 bp, Homo sapiens
attaaagacaaggga

SEQ ID NO: 200530 - DNA, 15 bp, Homo sapiens
gattaaagacaaggg

SEQ ID NO: 200531 - DNA, 15 bp, Homo sapiens
agattaaagacaagg

SEQ ID NO: 200532 - DNA, 15 bp, Homo sapiens
aagattaaagacaag

SEQ ID NO: 200533 - DNA, 15 bp, Homo sapiens
caagattaaagacaa

SEQ ID NO: 200534 - DNA, 15 bp, Homo sapiens
ccaagattaaagaca

SEQ ID NO: 200535 - DNA, 15 bp, Homo sapiens
tccaagattaaagac

SEQ ID NO: 200536 - DNA, 15 bp, Homo sapiens
atccaagattaaaga

SEQ ID NO: 200537 - DNA, 15 bp, Homo sapiens
aatccaagattaaag

SEQ ID NO: 200538 - DNA, 15 bp, Homo sapiens
gaatccaagattaaa

SEQ ID NO: 200539 - DNA, 15 bp, Homo sapiens
agaatccaagattaa

SEQ ID NO: 200540 - DNA, 15 bp, Homo sapiens
cagaatccaagatta

SEQ ID NO: 200541 - DNA, 15 bp, Homo sapiens
gcagaatccaagatt

SEQ ID NO: 200542 - DNA, 15 bp, Homo sapiens
ggcagaatccaagat

SEQ ID NO: 200543 - DNA, 15 bp, Homo sapiens
aggcagaatccaaga

SEQ ID NO: 200544 - DNA, 15 bp, Homo sapiens
taggcagaatccaag

SEQ ID NO: 200545 - DNA, 15 bp, Homo sapiens
ctaggcagaatccaa

SEQ ID NO: 200546 - DNA, 15 bp, Homo sapiens
actaggcagaatcca

SEQ ID NO: 200547 - DNA, 15 bp, Homo sapiens
cactaggcagaatcc

SEQ ID NO: 200548 - DNA, 15 bp, Homo sapiens
acactaggcagaatc

SEQ ID NO: 200549 - DNA, 15 bp, Homo sapiens
aacactaggcagaat

SEQ ID NO: 200550 - DNA, 15 bp, Homo sapiens
caacactaggcagaa

SEQ ID NO: 200551 - DNA, 15 bp, Homo sapiens
gcaacactaggcaga

SEQ ID NO: 200552 - DNA, 15 bp, Homo sapiens
tgcaacactaggcag

SEQ ID NO: 200553 - DNA, 15 bp, Homo sapiens
gtgcaacactaggca

SEQ ID NO: 200554 - DNA, 15 bp, Homo sapiens
agtgcaacactaggc

SEQ ID NO: 200555 - DNA, 15 bp, Homo sapiens
tagtgcaacactagg

SEQ ID NO: 200556 - DNA, 15 bp, Homo sapiens
ctagtgcaacactag

SEQ ID NO: 200557 - DNA, 15 bp, Homo sapiens
tctagtgcaacacta

SEQ ID NO: 200558 - DNA, 15 bp, Homo sapiens
ttctagtgcaacact

SEQ ID NO: 200559 - DNA, 15 bp, Homo sapiens
tttctagtgcaacac

SEQ ID NO: 200560 - DNA, 15 bp, Homo sapiens
ctttctagtgcaaca

SEQ ID NO: 200561 - DNA, 15 bp, Homo sapiens
actttctagtgcaac

SEQ ID NO: 200562 - DNA, 15 bp, Homo sapiens
cactttctagtgcaa

SEQ ID NO: 200563 - DNA, 15 bp, Homo sapiens
tcactttctagtgca

SEQ ID NO: 200564 - DNA, 15 bp, Homo sapiens
ttcactttctagtgc

SEQ ID NO: 200565 - DNA, 15 bp, Homo sapiens
tttcactttctagtg

SEQ ID NO: 200566 - DNA, 15 bp, Homo sapiens
ttttcactttctagt

SEQ ID NO: 200567 - DNA, 15 bp, Homo sapiens
tttttcactttctag

SEQ ID NO: 200568 - DNA, 15 bp, Homo sapiens
atttttcactttcta

SEQ ID NO: 200569 - DNA, 15 bp, Homo sapiens
catttttcactttct

SEQ ID NO: 200570 - DNA, 15 bp, Homo sapiens
ccatttttcactttc

SEQ ID NO: 200571 - DNA, 15 bp, Homo sapiens
accatttttcacttt

SEQ ID NO: 200572 - DNA, 15 bp, Homo sapiens
taccatttttcactt

SEQ ID NO: 200573 - DNA, 15 bp, Homo sapiens
ttaccatttttcact

SEQ ID NO: 200574 - DNA, 15 bp, Homo sapiens
gttaccatttttcac

SEQ ID NO: 200575 - DNA, 15 bp, Homo sapiens
tgttaccatttttca

SEQ ID NO: 200576 - DNA, 15 bp, Homo sapiens
atgttaccatttttc

SEQ ID NO: 200577 - DNA, 15 bp, Homo sapiens
aatgttaccattttt

SEQ ID NO: 200578 - DNA, 15 bp, Homo sapiens
caatgttaccatttt

SEQ ID NO: 200579 - DNA, 15 bp, Homo sapiens
tcaatgttaccattt

SEQ ID NO: 200580 - DNA, 15 bp, Homo sapiens
atcaatgttaccatt

SEQ ID NO: 200581 - DNA, 15 bp, Homo sapiens
gatcaatgttaccat

SEQ ID NO: 200582 - DNA, 15 bp, Homo sapiens
ggatcaatgttacca

SEQ ID NO: 200583 - DNA, 15 bp, Homo sapiens
aggatcaatgttacc

SEQ ID NO: 200584 - DNA, 15 bp, Homo sapiens
caggatcaatgttac

SEQ ID NO: 200585 - DNA, 15 bp, Homo sapiens
gcaggatcaatgtta

SEQ ID NO: 200586 - DNA, 15 bp, Homo sapiens
agcaggatcaatgtt

SEQ ID NO: 200587 - DNA, 15 bp, Homo sapiens
tagcaggatcaatgt

SEQ ID NO: 200588 - DNA, 15 bp, Homo sapiens
atagcaggatcaatg

SEQ ID NO: 200589 - DNA, 15 bp, Homo sapiens
tatagcaggatcaat

SEQ ID NO: 200590 - DNA, 15 bp, Homo sapiens
ttatagcaggatcaa

SEQ ID NO: 200591 - DNA, 15 bp, Homo sapiens
attatagcaggatca

SEQ ID NO: 200592 - DNA, 15 bp, Homo sapiens
aattatagcaggatc

SEQ ID NO: 200593 - DNA, 15 bp, Homo sapiens
aaattatagcaggat

SEQ ID NO: 200594 - DNA, 15 bp, Homo sapiens
caaattatagcagga

SEQ ID NO: 200595 - DNA, 15 bp, Homo sapiens
tcaaattatagcagg

SEQ ID NO: 200596 - DNA, 15 bp, Homo sapiens
atcaaattatagcag

SEQ ID NO: 200597 - DNA, 15 bp, Homo sapiens
tatcaaattatagca

SEQ ID NO: 200598 - DNA, 15 bp, Homo sapiens
gtatcaaattatagc

SEQ ID NO: 200599 - DNA, 15 bp, Homo sapiens
agtatcaaattatag

SEQ ID NO: 200600 - DNA, 15 bp, Homo sapiens
aagtatcaaattata

SEQ ID NO: 200601 - DNA, 15 bp, Homo sapiens
aaagtatcaaattat

SEQ ID NO: 200602 - DNA, 15 bp, Homo sapiens
gaaagtatcaaatta

SEQ ID NO: 200603 - DNA, 15 bp, Homo sapiens
agaaagtatcaaatt

SEQ ID NO: 200604 - DNA, 15 bp, Homo sapiens
tagaaagtatcaaat

SEQ ID NO: 200605 - DNA, 15 bp, Homo sapiens
gtagaaagtatcaaa

SEQ ID NO: 200606 - DNA, 15 bp, Homo sapiens
agtagaaagtatcaa

SEQ ID NO: 200607 - DNA, 15 bp, Homo sapiens
aagtagaaagtatca

SEQ ID NO: 200608 - DNA, 15 bp, Homo sapiens
taagtagaaagtatc

SEQ ID NO: 200609 - DNA, 15 bp, Homo sapiens
ttaagtagaaagtat

SEQ ID NO: 200610 - DNA, 15 bp, Homo sapiens
tttaagtagaaagta

SEQ ID NO: 200611 - DNA, 15 bp, Homo sapiens
ttttaagtagaaagt

SEQ ID NO: 200612 - DNA, 15 bp, Homo sapiens
attttaagtagaaag

SEQ ID NO: 200613 - DNA, 15 bp, Homo sapiens
aattttaagtagaaa

SEQ ID NO: 200614 - DNA, 15 bp, Homo sapiens
caattttaagtagaa

SEQ ID NO: 200615 - DNA, 15 bp, Homo sapiens
ccaattttaagtaga

SEQ ID NO: 200616 - DNA, 15 bp, Homo sapiens
gccaattttaagtag

SEQ ID NO: 200617 - DNA, 15 bp, Homo sapiens
tgccaattttaagta

SEQ ID NO: 200618 - DNA, 15 bp, Homo sapiens
atgccaattttaagt

SEQ ID NO: 200619 - DNA, 15 bp, Homo sapiens
aatgccaattttaag

SEQ ID NO: 200620 - DNA, 15 bp, Homo sapiens
caatgccaattttaa

SEQ ID NO: 200621 - DNA, 15 bp, Homo sapiens
acaatgccaatttta

SEQ ID NO: 200622 - DNA, 15 bp, Homo sapiens
cacaatgccaatttt

SEQ ID NO: 200623 - DNA, 15 bp, Homo sapiens
tcacaatgccaattt

SEQ ID NO: 200624 - DNA, 15 bp, Homo sapiens
atcacaatgccaatt

SEQ ID NO: 200625 - DNA, 15 bp, Homo sapiens
aatcacaatgccaat

SEQ ID NO: 200626 - DNA, 15 bp, Homo sapiens
aaatcacaatgccaa

SEQ ID NO: 200627 - DNA, 15 bp, Homo sapiens
caaatcacaatgcca

SEQ ID NO: 200628 - DNA, 15 bp, Homo sapiens
gcaaatcacaatgcc

SEQ ID NO: 200629 - DNA, 15 bp, Homo sapiens
tgcaaatcacaatgc

SEQ ID NO: 200630 - DNA, 15 bp, Homo sapiens
ttgcaaatcacaatg

SEQ ID NO: 200631 - DNA, 15 bp, Homo sapiens
attgcaaatcacaat

SEQ ID NO: 200632 - DNA, 15 bp, Homo sapiens
cattgcaaatcacaa

SEQ ID NO: 200633 - DNA, 15 bp, Homo sapiens
tcattgcaaatcaca

SEQ ID NO: 200634 - DNA, 15 bp, Homo sapiens
atcattgcaaatcac

SEQ ID NO: 200635 - DNA, 15 bp, Homo sapiens
aatcattgcaaatca

SEQ ID NO: 200636 - DNA, 15 bp, Homo sapiens
aaatcattgcaaatc

SEQ ID NO: 200637 - DNA, 15 bp, Homo sapiens
aaaatcattgcaaat

SEQ ID NO: 200638 - DNA, 15 bp, Homo sapiens
gaaaatcattgcaaa

SEQ ID NO: 200639 - DNA, 15 bp, Homo sapiens
agaaaatcattgcaa

SEQ ID NO: 200640 - DNA, 15 bp, Homo sapiens
tagaaaatcattgca

SEQ ID NO: 200641 - DNA, 15 bp, Homo sapiens
atagaaaatcattgc

SEQ ID NO: 200642 - DNA, 15 bp, Homo sapiens
aatagaaaatcattg

SEQ ID NO: 200643 - DNA, 15 bp, Homo sapiens
taatagaaaatcatt

SEQ ID NO: 200644 - DNA, 15 bp, Homo sapiens
ataatagaaaatcat

SEQ ID NO: 200645 - DNA, 15 bp, Homo sapiens
tataatagaaaatca

SEQ ID NO: 200646 - DNA, 15 bp, Homo sapiens
atataatagaaaatc

SEQ ID NO: 200647 - DNA, 15 bp, Homo sapiens
aatataatagaaaat

SEQ ID NO: 200648 - DNA, 15 bp, Homo sapiens
gaatataatagaaaa

SEQ ID NO: 200649 - DNA, 15 bp, Homo sapiens
tgaatataatagaaa

SEQ ID NO: 200650 - DNA, 15 bp, Homo sapiens
gtgaatataatagaa

SEQ ID NO: 200651 - DNA, 15 bp, Homo sapiens
ggtgaatataataga

SEQ ID NO: 200652 - DNA, 15 bp, Homo sapiens
tggtgaatataatag

SEQ ID NO: 200653 - DNA, 15 bp, Homo sapiens
gtggtgaatataata

SEQ ID NO: 200654 - DNA, 15 bp, Homo sapiens
ggtggtgaatataat

SEQ ID NO: 200655 - DNA, 15 bp, Homo sapiens
aggtggtgaatataa

SEQ ID NO: 200656 - DNA, 15 bp, Homo sapiens
aaggtggtgaatata

SEQ ID NO: 200657 - DNA, 15 bp, Homo sapiens
caaggtggtgaatat

SEQ ID NO: 200658 - DNA, 15 bp, Homo sapiens
acaaggtggtgaata

SEQ ID NO: 200659 - DNA, 15 bp, Homo sapiens
gacaaggtggtgaat

SEQ ID NO: 200660 - DNA, 15 bp, Homo sapiens
agacaaggtggtgaa

SEQ ID NO: 200661 - DNA, 15 bp, Homo sapiens
tagacaaggtggtga

SEQ ID NO: 200662 - DNA, 15 bp, Homo sapiens
atagacaaggtggtg

SEQ ID NO: 200663 - DNA, 15 bp, Homo sapiens
aatagacaaggtggt

SEQ ID NO: 200664 - DNA, 15 bp, Homo sapiens
aaatagacaaggtgg

SEQ ID NO: 200665 - DNA, 15 bp, Homo sapiens
aaaatagacaaggtg

SEQ ID NO: 200666 - DNA, 15 bp, Homo sapiens
taaaatagacaaggt

SEQ ID NO: 200667 - DNA, 15 bp, Homo sapiens
ataaaatagacaagg

SEQ ID NO: 200668 - DNA, 15 bp, Homo sapiens
aataaaatagacaag

SEQ ID NO: 200669 - DNA, 15 bp, Homo sapiens
aaataaaatagacaa

SEQ ID NO: 200670 - DNA, 15 bp, Homo sapiens
aaaataaaatagaca

SEQ ID NO: 200671 - DNA, 15 bp, Homo sapiens
taaaataaaatagac

SEQ ID NO: 200672 - DNA, 15 bp, Homo sapiens
ataaaataaaataga

SEQ ID NO: 200673 - DNA, 15 bp, Homo sapiens
aataaaataaaatag

SEQ ID NO: 200674 - DNA, 15 bp, Homo sapiens
ttaaaaaataaaata

SEQ ID NO: 200675 - DNA, 15 bp, Homo sapiens
attaaaaaataaaat

SEQ ID NO: 200676 - DNA, 15 bp, Homo sapiens
aataattaaaaaata

SEQ ID NO: 200677 - DNA, 15 bp, Homo sapiens
aaataattaaaaaat

SEQ ID NO: 200678 - DNA, 15 bp, Homo sapiens
taaataattaaaaaa

SEQ ID NO: 200679 - DNA, 15 bp, Homo sapiens
ataaataattaaaaa

SEQ ID NO: 200680 - DNA, 15 bp, Homo sapiens
aataaataattaaaa

SEQ ID NO: 200681 - DNA, 15 bp, Homo sapiens
taataaataattaaa

SEQ ID NO: 200682 - DNA, 15 bp, Homo sapiens
ataataaataattaa

SEQ ID NO: 200683 - DNA, 15 bp, Homo sapiens
aataataaataatta

SEQ ID NO: 200684 - DNA, 15 bp, Homo sapiens
aaataataaataatt

SEQ ID NO: 200685 - DNA, 15 bp, Homo sapiens
taaataataaataat

SEQ ID NO: 200686 - DNA, 15 bp, Homo sapiens
ctaaataataaataa

SEQ ID NO: 200687 - DNA, 15 bp, Homo sapiens
tctaaataataaata

SEQ ID NO: 200688 - DNA, 15 bp, Homo sapiens
atctaaataataaat

SEQ ID NO: 200689 - DNA, 15 bp, Homo sapiens
aatctaaataataaa

SEQ ID NO: 200690 - DNA, 15 bp, Homo sapiens
aaatctaaataataa

SEQ ID NO: 200691 - DNA, 15 bp, Homo sapiens
gaaatctaaataata

SEQ ID NO: 200692 - DNA, 15 bp, Homo sapiens
tgaaatctaaataat

SEQ ID NO: 200693 - DNA, 15 bp, Homo sapiens
atgaaatctaaataa

SEQ ID NO: 200694 - DNA, 15 bp, Homo sapiens
catgaaatctaaata

SEQ ID NO: 200695 - DNA, 15 bp, Homo sapiens
acatgaaatctaaat

SEQ ID NO: 200696 - DNA, 15 bp, Homo sapiens
aacatgaaatctaaa

SEQ ID NO: 200697 - DNA, 15 bp, Homo sapiens
aaacatgaaatctaa

SEQ ID NO: 200698 - DNA, 15 bp, Homo sapiens
taaacatgaaatcta

SEQ ID NO: 200699 - DNA, 15 bp, Homo sapiens
ataaacatgaaatct

SEQ ID NO: 200700 - DNA, 15 bp, Homo sapiens
aataaacatgaaatc

SEQ ID NO: 200701 - DNA, 15 bp, Homo sapiens
aaataaacatgaaat

SEQ ID NO: 200702 - DNA, 15 bp, Homo sapiens
aaaataaacatgaaa

SEQ ID NO: 200703 - DNA, 15 bp, Homo sapiens
taaaataaacatgaa

SEQ ID NO: 200704 - DNA, 15 bp, Homo sapiens
ataaaataaacatga

SEQ ID NO: 200705 - DNA, 15 bp, Homo sapiens
aataaaataaacatg

SEQ ID NO: 200706 - DNA, 15 bp, Homo sapiens
aaataaaataaacat

SEQ ID NO: 200707 - DNA, 15 bp, Homo sapiens
taaataaaataaaca

SEQ ID NO: 200708 - DNA, 15 bp, Homo sapiens
ttaaataaaataaac

SEQ ID NO: 200709 - DNA, 15 bp, Homo sapiens
gttaaataaaataaa

SEQ ID NO: 200710 - DNA, 15 bp, Homo sapiens
agttaaataaaataa

SEQ ID NO: 200711 - DNA, 15 bp, Homo sapiens
aagttaaataaaata

SEQ ID NO: 200712 - DNA, 15 bp, Homo sapiens
aaagttaaataaaat

SEQ ID NO: 200713 - DNA, 15 bp, Homo sapiens
aaaagttaaataaaa

SEQ ID NO: 200714 - DNA, 15 bp, Homo sapiens
taaaagttaaataaa

SEQ ID NO: 200715 - DNA, 15 bp, Homo sapiens
gtaaaagttaaataa

SEQ ID NO: 200716 - DNA, 15 bp, Homo sapiens
agtaaaagttaaata

SEQ ID NO: 200717 - DNA, 15 bp, Homo sapiens
aagtaaaagttaaat

SEQ ID NO: 200718 - DNA, 15 bp, Homo sapiens
aaagtaaaagttaaa

SEQ ID NO: 200719 - DNA, 15 bp, Homo sapiens
gaaagtaaaagttaa

SEQ ID NO: 200720 - DNA, 15 bp, Homo sapiens
tgaaagtaaaagtta

SEQ ID NO: 200721 - DNA, 15 bp, Homo sapiens
ctgaaagtaaaagtt

SEQ ID NO: 200722 - DNA, 15 bp, Homo sapiens
actgaaagtaaaagt

SEQ ID NO: 200723 - DNA, 15 bp, Homo sapiens
aactgaaagtaaaag

SEQ ID NO: 200724 - DNA, 15 bp, Homo sapiens
gaactgaaagtaaaa

SEQ ID NO: 200725 - DNA, 15 bp, Homo sapiens
tgaactgaaagtaaa

SEQ ID NO: 200726 - DNA, 15 bp, Homo sapiens
ctgaactgaaagtaa

SEQ ID NO: 200727 - DNA, 15 bp, Homo sapiens
cctgaactgaaagta

SEQ ID NO: 200728 - DNA, 15 bp, Homo sapiens
ccctgaactgaaagt

SEQ ID NO: 200729 - DNA, 15 bp, Homo sapiens
accctgaactgaaag

SEQ ID NO: 200730 - DNA, 15 bp, Homo sapiens
taccctgaactgaaa

SEQ ID NO: 200731 - DNA, 15 bp, Homo sapiens
gtaccctgaactgaa

SEQ ID NO: 200732 - DNA, 15 bp, Homo sapiens
tgtaccctgaactga

SEQ ID NO: 200733 - DNA, 15 bp, Homo sapiens
atgtaccctgaactg

SEQ ID NO: 200734 - DNA, 15 bp, Homo sapiens
catgtaccctgaact

SEQ ID NO: 200735 - DNA, 15 bp, Homo sapiens
acatgtaccctgaac

SEQ ID NO: 200736 - DNA, 15 bp, Homo sapiens
tacatgtaccctgaa

SEQ ID NO: 200737 - DNA, 15 bp, Homo sapiens
gtacatgtaccctga

SEQ ID NO: 200738 - DNA, 15 bp, Homo sapiens
tgtacatgtaccctg

SEQ ID NO: 200739 - DNA, 15 bp, Homo sapiens
ctgtacatgtaccct

SEQ ID NO: 200740 - DNA, 15 bp, Homo sapiens
cctgtacatgtaccc

SEQ ID NO: 200741 - DNA, 15 bp, Homo sapiens
acctgtacatgtacc

SEQ ID NO: 200742 - DNA, 15 bp, Homo sapiens
aacctgtacatgtac

SEQ ID NO: 200743 - DNA, 15 bp, Homo sapiens
aaacctgtacatgta

SEQ ID NO: 200744 - DNA, 15 bp, Homo sapiens
caaacctgtacatgt

SEQ ID NO: 200745 - DNA, 15 bp, Homo sapiens
acaaacctgtacatg

SEQ ID NO: 200746 - DNA, 15 bp, Homo sapiens
aacaaacctgtacat

SEQ ID NO: 200747 - DNA, 15 bp, Homo sapiens
taacaaacctgtaca

SEQ ID NO: 200748 - DNA, 15 bp, Homo sapiens
ataacaaacctgtac

SEQ ID NO: 200749 - DNA, 15 bp, Homo sapiens
tataacaaacctgta

SEQ ID NO: 200750 - DNA, 15 bp, Homo sapiens
atataacaaacctgt

SEQ ID NO: 200751 - DNA, 15 bp, Homo sapiens
tatataacaaacctg

SEQ ID NO: 200752 - DNA, 15 bp, Homo sapiens
ctatataacaaacct

SEQ ID NO: 200753 - DNA, 15 bp, Homo sapiens
cctatataacaaacc

SEQ ID NO: 200754 - DNA, 15 bp, Homo sapiens
acctatataacaaac

SEQ ID NO: 200755 - DNA, 15 bp, Homo sapiens
tacctatataacaaa

SEQ ID NO: 200756 - DNA, 15 bp, Homo sapiens
ttacctatataacaa

SEQ ID NO: 200757 - DNA, 15 bp, Homo sapiens
tttacctatataaca

SEQ ID NO: 200758 - DNA, 15 bp, Homo sapiens
gtttacctatataac

SEQ ID NO: 200759 - DNA, 15 bp, Homo sapiens
agtttacctatataa

SEQ ID NO: 200760 - DNA, 15 bp, Homo sapiens
tagtttacctatata

SEQ ID NO: 200761 - DNA, 15 bp, Homo sapiens
ctagtttacctatat

SEQ ID NO: 200762 - DNA, 15 bp, Homo sapiens
actagtttacctata

SEQ ID NO: 200763 - DNA, 15 bp, Homo sapiens
cactagtttacctat

SEQ ID NO: 200764 - DNA, 15 bp, Homo sapiens
acactagtttaccta

SEQ ID NO: 200765 - DNA, 15 bp, Homo sapiens
gacactagtttacct

SEQ ID NO: 200766 - DNA, 15 bp, Homo sapiens
tgacactagtttacc

SEQ ID NO: 200767 - DNA, 15 bp, Homo sapiens
atgacactagtttac

SEQ ID NO: 200768 - DNA, 15 bp, Homo sapiens
catgacactagttta

SEQ ID NO: 200769 - DNA, 15 bp, Homo sapiens
ccatgacactagttt

SEQ ID NO: 200770 - DNA, 15 bp, Homo sapiens
cccatgacactagtt

SEQ ID NO: 200771 - DNA, 15 bp, Homo sapiens
ccccatgacactagt

SEQ ID NO: 200772 - DNA, 15 bp, Homo sapiens
cccccatgacactag

SEQ ID NO: 200773 - DNA, 15 bp, Homo sapiens
acccccatgacacta

SEQ ID NO: 200774 - DNA, 15 bp, Homo sapiens
aacccccatgacact

SEQ ID NO: 200775 - DNA, 15 bp, Homo sapiens
aaacccccatgacac

SEQ ID NO: 200776 - DNA, 15 bp, Homo sapiens
caaacccccatgaca

SEQ ID NO: 200777 - DNA, 15 bp, Homo sapiens
acaaacccccatgac

SEQ ID NO: 200778 - DNA, 15 bp, Homo sapiens
aacaaacccccatga

SEQ ID NO: 200779 - DNA, 15 bp, Homo sapiens
caacaaacccccatg

SEQ ID NO: 200780 - DNA, 15 bp, Homo sapiens
gcaacaaacccccat

SEQ ID NO: 200781 - DNA, 15 bp, Homo sapiens
tgcaacaaaccccca

SEQ ID NO: 200782 - DNA, 15 bp, Homo sapiens
gtgcaacaaaccccc

SEQ ID NO: 200783 - DNA, 15 bp, Homo sapiens
tgtgcaacaaacccc

SEQ ID NO: 200784 - DNA, 15 bp, Homo sapiens
ctgtgcaacaaaccc

SEQ ID NO: 200785 - DNA, 15 bp, Homo sapiens
tctgtgcaacaaacc

SEQ ID NO: 200786 - DNA, 15 bp, Homo sapiens
atctgtgcaacaaac

SEQ ID NO: 200787 - DNA, 15 bp, Homo sapiens
aatctgtgcaacaaa

SEQ ID NO: 200788 - DNA, 15 bp, Homo sapiens
taatctgtgcaacaa

SEQ ID NO: 200789 - DNA, 15 bp, Homo sapiens
ataatctgtgcaaca

SEQ ID NO: 200790 - DNA, 15 bp, Homo sapiens
aataatctgtgcaac

SEQ ID NO: 200791 - DNA, 15 bp, Homo sapiens
aaataatctgtgcaa

SEQ ID NO: 200792 - DNA, 15 bp, Homo sapiens
gaaataatctgtgca

SEQ ID NO: 200793 - DNA, 15 bp, Homo sapiens
tgaaataatctgtgc

SEQ ID NO: 200794 - DNA, 15 bp, Homo sapiens
atgaaataatctgtg

SEQ ID NO: 200795 - DNA, 15 bp, Homo sapiens
gatgaaataatctgt

SEQ ID NO: 200796 - DNA, 15 bp, Homo sapiens
tgatgaaataatctg

SEQ ID NO: 200797 - DNA, 15 bp, Homo sapiens
gtgatgaaataatct

SEQ ID NO: 200798 - DNA, 15 bp, Homo sapiens
agtgatgaaataatc

SEQ ID NO: 200799 - DNA, 15 bp, Homo sapiens
gagtgatgaaataat

SEQ ID NO: 200800 - DNA, 15 bp, Homo sapiens
tgagtgatgaaataa

SEQ ID NO: 200801 - DNA, 15 bp, Homo sapiens
ctgagtgatgaaata

SEQ ID NO: 200802 - DNA, 15 bp, Homo sapiens
cctgagtgatgaaat

SEQ ID NO: 200803 - DNA, 15 bp, Homo sapiens
gcctgagtgatgaaa

SEQ ID NO: 200804 - DNA, 15 bp, Homo sapiens
tgcctgagtgatgaa

SEQ ID NO: 200805 - DNA, 15 bp, Homo sapiens
atgcctgagtgatga

SEQ ID NO: 200806 - DNA, 15 bp, Homo sapiens
aatgcctgagtgatg

SEQ ID NO: 200807 - DNA, 15 bp, Homo sapiens
gaatgcctgagtgat

SEQ ID NO: 200808 - DNA, 15 bp, Homo sapiens
tgaatgcctgagtga

SEQ ID NO: 200809 - DNA, 15 bp, Homo sapiens
ctgaatgcctgagtg

SEQ ID NO: 200810 - DNA, 15 bp, Homo sapiens
gctgaatgcctgagt

SEQ ID NO: 200811 - DNA, 15 bp, Homo sapiens
ggctgaatgcctgag

SEQ ID NO: 200812 - DNA, 15 bp, Homo sapiens
aggctgaatgcctga

SEQ ID NO: 200813 - DNA, 15 bp, Homo sapiens
taggctgaatgcctg

SEQ ID NO: 200814 - DNA, 15 bp, Homo sapiens
ctaggctgaatgcct

SEQ ID NO: 200815 - DNA, 15 bp, Homo sapiens
actaggctgaatgcc

SEQ ID NO: 200816 - DNA, 15 bp, Homo sapiens
tactaggctgaatgc

SEQ ID NO: 200817 - DNA, 15 bp, Homo sapiens
gtactaggctgaatg

SEQ ID NO: 200818 - DNA, 15 bp, Homo sapiens
ggtactaggctgaat

SEQ ID NO: 200819 - DNA, 15 bp, Homo sapiens
gggtactaggctgaa

SEQ ID NO: 200820 - DNA, 15 bp, Homo sapiens
agggtactaggctga

SEQ ID NO: 200821 - DNA, 15 bp, Homo sapiens
tagggtactaggctg

SEQ ID NO: 200822 - DNA, 15 bp, Homo sapiens
atagggtactaggct

SEQ ID NO: 200823 - DNA, 15 bp, Homo sapiens
tatagggtactaggc

SEQ ID NO: 200824 - DNA, 15 bp, Homo sapiens
ctatagggtactagg

SEQ ID NO: 200825 - DNA, 15 bp, Homo sapiens
actatagggtactag

SEQ ID NO: 200826 - DNA, 15 bp, Homo sapiens
aactatagggtacta

SEQ ID NO: 200827 - DNA, 15 bp, Homo sapiens
taactatagggtact

SEQ ID NO: 200828 - DNA, 15 bp, Homo sapiens
ataactatagggtac

SEQ ID NO: 200829 - DNA, 15 bp, Homo sapiens
aataactatagggta

SEQ ID NO: 200830 - DNA, 15 bp, Homo sapiens
aaataactatagggt

SEQ ID NO: 200831 - DNA, 15 bp, Homo sapiens
aaaataactataggg

SEQ ID NO: 200832 - DNA, 15 bp, Homo sapiens
aaaaataactatagg

SEQ ID NO: 200833 - DNA, 15 bp, Homo sapiens
gaaaaataactatag

SEQ ID NO: 200834 - DNA, 15 bp, Homo sapiens
ggaaaaataactata

SEQ ID NO: 200835 - DNA, 15 bp, Homo sapiens
aggaaaaataactat

SEQ ID NO: 200836 - DNA, 15 bp, Homo sapiens
caggaaaaataacta

SEQ ID NO: 200837 - DNA, 15 bp, Homo sapiens
tcaggaaaaataact

SEQ ID NO: 200838 - DNA, 15 bp, Homo sapiens
gatcaggaaaaataa

SEQ ID NO: 200839 - DNA, 15 bp, Homo sapiens
ggatcaggaaaaata

SEQ ID NO: 200840 - DNA, 15 bp, Homo sapiens
aggatcaggaaaaat

SEQ ID NO: 200841 - DNA, 15 bp, Homo sapiens
gaggatcaggaaaaa

SEQ ID NO: 200842 - DNA, 15 bp, Homo sapiens
agaggatcaggaaaa

SEQ ID NO: 200843 - DNA, 15 bp, Homo sapiens
gagaggatcaggaaa

SEQ ID NO: 200844 - DNA, 15 bp, Homo sapiens
ggagaggatcaggaa

SEQ ID NO: 200845 - DNA, 15 bp, Homo sapiens
gggagaggatcagga

SEQ ID NO: 200846 - DNA, 15 bp, Homo sapiens
agggagaggatcagg

SEQ ID NO: 200847 - DNA, 15 bp, Homo sapiens
gagggagaggatcag

SEQ ID NO: 200848 - DNA, 15 bp, Homo sapiens
ggagggagaggatca

SEQ ID NO: 200849 - DNA, 15 bp, Homo sapiens
aggagggagaggatc

SEQ ID NO: 200850 - DNA, 15 bp, Homo sapiens
gaggagggagaggat

SEQ ID NO: 200851 - DNA, 15 bp, Homo sapiens
ggaggagggagagga

SEQ ID NO: 200852 - DNA, 15 bp, Homo sapiens
gggaggagggagagg

SEQ ID NO: 200853 - DNA, 15 bp, Homo sapiens
tgggaggagggagag

SEQ ID NO: 200854 - DNA, 15 bp, Homo sapiens
atgggaggagggaga

SEQ ID NO: 200855 - DNA, 15 bp, Homo sapiens
gatgggaggagggag

SEQ ID NO: 200856 - DNA, 15 bp, Homo sapiens
aagatgggaggaggg

SEQ ID NO: 200857 - DNA, 15 bp, Homo sapiens
gaagatgggaggagg

SEQ ID NO: 200858 - DNA, 15 bp, Homo sapiens
ggaagatgggaggag

SEQ ID NO: 200859 - DNA, 15 bp, Homo sapiens
atggaagatgggagg

SEQ ID NO: 200860 - DNA, 15 bp, Homo sapiens
gatggaagatgggag

SEQ ID NO: 200861 - DNA, 15 bp, Homo sapiens
ggatggaagatggga

SEQ ID NO: 200862 - DNA, 15 bp, Homo sapiens
aggatggaagatggg

SEQ ID NO: 200863 - DNA, 15 bp, Homo sapiens
gaggatggaagatgg

SEQ ID NO: 200864 - DNA, 15 bp, Homo sapiens
agaggatggaagatg

SEQ ID NO: 200865 - DNA, 15 bp, Homo sapiens
cagaggatggaagat

SEQ ID NO: 200866 - DNA, 15 bp, Homo sapiens
tcagaggatggaaga

SEQ ID NO: 200867 - DNA, 15 bp, Homo sapiens
atcagaggatggaag

SEQ ID NO: 200868 - DNA, 15 bp, Homo sapiens
tatcagaggatggaa

SEQ ID NO: 200869 - DNA, 15 bp, Homo sapiens
ctatcagaggatgga

SEQ ID NO: 200870 - DNA, 15 bp, Homo sapiens
cctatcagaggatgg

SEQ ID NO: 200871 - DNA, 15 bp, Homo sapiens
gcctatcagaggatg

SEQ ID NO: 200872 - DNA, 15 bp, Homo sapiens
ggcctatcagaggat

SEQ ID NO: 200873 - DNA, 15 bp, Homo sapiens
gggcctatcagagga

SEQ ID NO: 200874 - DNA, 15 bp, Homo sapiens
ggggcctatcagagg

SEQ ID NO: 200875 - DNA, 15 bp, Homo sapiens
tggggcctatcagag

SEQ ID NO: 200876 - DNA, 15 bp, Homo sapiens
ctggggcctatcaga

SEQ ID NO: 200877 - DNA, 15 bp, Homo sapiens
actggggcctatcag

SEQ ID NO: 200878 - DNA, 15 bp, Homo sapiens
cactggggcctatca

SEQ ID NO: 200879 - DNA, 15 bp, Homo sapiens
acactggggcctatc

SEQ ID NO: 200880 - DNA, 15 bp, Homo sapiens
aacactggggcctat

SEQ ID NO: 200881 - DNA, 15 bp, Homo sapiens
aaacactggggccta

SEQ ID NO: 200882 - DNA, 15 bp, Homo sapiens
caaacactggggcct

SEQ ID NO: 200883 - DNA, 15 bp, Homo sapiens
acaaacactggggcc

SEQ ID NO: 200884 - DNA, 15 bp, Homo sapiens
aacaaacactggggc

SEQ ID NO: 200885 - DNA, 15 bp, Homo sapiens
caacaaacactgggg

SEQ ID NO: 200886 - DNA, 15 bp, Homo sapiens
ccaacaaacactggg

SEQ ID NO: 200887 - DNA, 15 bp, Homo sapiens
accaacaaacactgg

SEQ ID NO: 200888 - DNA, 15 bp, Homo sapiens
gaccaacaaacactg

SEQ ID NO: 200889 - DNA, 15 bp, Homo sapiens
agaccaacaaacact

SEQ ID NO: 200890 - DNA, 15 bp, Homo sapiens
gagaccaacaaacac

SEQ ID NO: 200891 - DNA, 15 bp, Homo sapiens
ggagaccaacaaaca

SEQ ID NO: 200892 - DNA, 15 bp, Homo sapiens
aggagaccaacaaac

SEQ ID NO: 200893 - DNA, 15 bp, Homo sapiens
gaggagaccaacaaa

SEQ ID NO: 200894 - DNA, 15 bp, Homo sapiens
agaggagaccaacaa

SEQ ID NO: 200895 - DNA, 15 bp, Homo sapiens
tagaggagaccaaca

SEQ ID NO: 200896 - DNA, 15 bp, Homo sapiens
atagaggagaccaac

SEQ ID NO: 200897 - DNA, 15 bp, Homo sapiens
catagaggagaccaa

SEQ ID NO: 200898 - DNA, 15 bp, Homo sapiens
acatagaggagacca

SEQ ID NO: 200899 - DNA, 15 bp, Homo sapiens
tacatagaggagacc

SEQ ID NO: 200900 - DNA, 15 bp, Homo sapiens
atacatagaggagac

SEQ ID NO: 200901 - DNA, 15 bp, Homo sapiens
gatacatagaggaga

SEQ ID NO: 200902 - DNA, 15 bp, Homo sapiens
ggatacatagaggag

SEQ ID NO: 200903 - DNA, 15 bp, Homo sapiens
tggatacatagagga

SEQ ID NO: 200904 - DNA, 15 bp, Homo sapiens
ttggatacatagagg

SEQ ID NO: 200905 - DNA, 15 bp, Homo sapiens
cttggatacatagag

SEQ ID NO: 200906 - DNA, 15 bp, Homo sapiens
acttggatacataga

SEQ ID NO: 200907 - DNA, 15 bp, Homo sapiens
cacttggatacatag

SEQ ID NO: 200908 - DNA, 15 bp, Homo sapiens
acacttggatacata

SEQ ID NO: 200909 - DNA, 15 bp, Homo sapiens
aacacttggatacat

SEQ ID NO: 200910 - DNA, 15 bp, Homo sapiens
gaacacttggataca

SEQ ID NO: 200911 - DNA, 15 bp, Homo sapiens
agaacacttggatac

SEQ ID NO: 200912 - DNA, 15 bp, Homo sapiens
gagaacacttggata

SEQ ID NO: 200913 - DNA, 15 bp, Homo sapiens
tgagaacacttggat

SEQ ID NO: 200914 - DNA, 15 bp, Homo sapiens
atgagaacacttgga

SEQ ID NO: 200915 - DNA, 15 bp, Homo sapiens
gatgagaacacttgg

SEQ ID NO: 200916 - DNA, 15 bp, Homo sapiens
tgatgagaacacttg

SEQ ID NO: 200917 - DNA, 15 bp, Homo sapiens
atgatgagaacactt

SEQ ID NO: 200918 - DNA, 15 bp, Homo sapiens
aatgatgagaacact

SEQ ID NO: 200919 - DNA, 15 bp, Homo sapiens
aaatgatgagaacac

SEQ ID NO: 200920 - DNA, 15 bp, Homo sapiens
taaatgatgagaaca

SEQ ID NO: 200921 - DNA, 15 bp, Homo sapiens
ctaaatgatgagaac

SEQ ID NO: 200922 - DNA, 15 bp, Homo sapiens
gctaaatgatgagaa

SEQ ID NO: 200923 - DNA, 15 bp, Homo sapiens
agctaaatgatgaga

SEQ ID NO: 200924 - DNA, 15 bp, Homo sapiens
gagctaaatgatgag

SEQ ID NO: 200925 - DNA, 15 bp, Homo sapiens
tataagtgggagcta

SEQ ID NO: 200926 - DNA, 15 bp, Homo sapiens
ttcacttataagtgg

SEQ ID NO: 200927 - DNA, 15 bp, Homo sapiens
cttcacttataagtg

SEQ ID NO: 200928 - DNA, 15 bp, Homo sapiens
tcttcacttataagt

SEQ ID NO: 200929 - DNA, 15 bp, Homo sapiens
gtcttcacttataag

SEQ ID NO: 200930 - DNA, 15 bp, Homo sapiens
tgtcttcacttataa

SEQ ID NO: 200931 - DNA, 15 bp, Homo sapiens
atgtcttcacttata

SEQ ID NO: 200932 - DNA, 15 bp, Homo sapiens
catgtcttcacttat

SEQ ID NO: 200933 - DNA, 15 bp, Homo sapiens
acatgtcttcactta

SEQ ID NO: 200934 - DNA, 15 bp, Homo sapiens
cacatgtcttcactt

SEQ ID NO: 200935 - DNA, 15 bp, Homo sapiens
ccacatgtcttcact

SEQ ID NO: 200936 - DNA, 15 bp, Homo sapiens
accacatgtcttcac

SEQ ID NO: 200937 - DNA, 15 bp, Homo sapiens
taccacatgtcttca

SEQ ID NO: 200938 - DNA, 15 bp, Homo sapiens
ataccacatgtcttc

SEQ ID NO: 200939 - DNA, 15 bp, Homo sapiens
aataccacatgtctt

SEQ ID NO: 200940 - DNA, 15 bp, Homo sapiens
aaataccacatgtct

SEQ ID NO: 200941 - DNA, 15 bp, Homo sapiens
caaataccacatgtc

SEQ ID NO: 200942 - DNA, 15 bp, Homo sapiens
ccaaataccacatgt

SEQ ID NO: 200943 - DNA, 15 bp, Homo sapiens
accaaataccacatg

SEQ ID NO: 200944 - DNA, 15 bp, Homo sapiens
aaccaaataccacat

SEQ ID NO: 200945 - DNA, 15 bp, Homo sapiens
aaaccaaataccaca

SEQ ID NO: 200946 - DNA, 15 bp, Homo sapiens
aaaaccaaataccac

SEQ ID NO: 200947 - DNA, 15 bp, Homo sapiens
gaaaaccaaatacca

SEQ ID NO: 200948 - DNA, 15 bp, Homo sapiens
agaaaaccaaatacc

SEQ ID NO: 200949 - DNA, 15 bp, Homo sapiens
aaaactaatgcagga

SEQ ID NO: 200950 - DNA, 15 bp, Homo sapiens
gaaaactaatgcagg

SEQ ID NO: 200951 - DNA, 15 bp, Homo sapiens
agaaaactaatgcag

SEQ ID NO: 200952 - DNA, 15 bp, Homo sapiens
gagaaaactaatgca

SEQ ID NO: 200953 - DNA, 15 bp, Homo sapiens
tgagaaaactaatgc

SEQ ID NO: 200954 - DNA, 15 bp, Homo sapiens
ctgagaaaactaatg

SEQ ID NO: 200955 - DNA, 15 bp, Homo sapiens
cctgagaaaactaat

SEQ ID NO: 200956 - DNA, 15 bp, Homo sapiens
tcctgagaaaactaa

SEQ ID NO: 200957 - DNA, 15 bp, Homo sapiens
atcctgagaaaacta

SEQ ID NO: 200958 - DNA, 15 bp, Homo sapiens
tatcctgagaaaact

SEQ ID NO: 200959 - DNA, 15 bp, Homo sapiens
ttatcctgagaaaac

SEQ ID NO: 200960 - DNA, 15 bp, Homo sapiens
attatcctgagaaaa

SEQ ID NO: 200961 - DNA, 15 bp, Homo sapiens
cattatcctgagaaa

SEQ ID NO: 200962 - DNA, 15 bp, Homo sapiens
ccattatcctgagaa

SEQ ID NO: 200963 - DNA, 15 bp, Homo sapiens
gccattatcctgaga

SEQ ID NO: 200964 - DNA, 15 bp, Homo sapiens
ggccattatcctgag

SEQ ID NO: 200965 - DNA, 15 bp, Homo sapiens
aggccattatcctga

SEQ ID NO: 200966 - DNA, 15 bp, Homo sapiens
gaggccattatcctg

SEQ ID NO: 200967 - DNA, 15 bp, Homo sapiens
aagctggaggccatt

SEQ ID NO: 200968 - DNA, 15 bp, Homo sapiens
gaagctggaggccat

SEQ ID NO: 200969 - DNA, 15 bp, Homo sapiens
tgaagctggaggcca

SEQ ID NO: 200970 - DNA, 15 bp, Homo sapiens
atgaagctggaggcc

SEQ ID NO: 200971 - DNA, 15 bp, Homo sapiens
gatgaagctggaggc

SEQ ID NO: 200972 - DNA, 15 bp, Homo sapiens
ggatgaagctggagg

SEQ ID NO: 200973 - DNA, 15 bp, Homo sapiens
gggatgaagctggag

SEQ ID NO: 200974 - DNA, 15 bp, Homo sapiens
agggatgaagctgga

SEQ ID NO: 200975 - DNA, 15 bp, Homo sapiens
cagggatgaagctgg

SEQ ID NO: 200976 - DNA, 15 bp, Homo sapiens
acagggatgaagctg

SEQ ID NO: 200977 - DNA, 15 bp, Homo sapiens
aacagggatgaagct

SEQ ID NO: 200978 - DNA, 15 bp, Homo sapiens
gaacagggatgaagc

SEQ ID NO: 200979 - DNA, 15 bp, Homo sapiens
ggaacagggatgaag

SEQ ID NO: 200980 - DNA, 15 bp, Homo sapiens
aggaacagggatgaa

SEQ ID NO: 200981 - DNA, 15 bp, Homo sapiens
caggaacagggatga

SEQ ID NO: 200982 - DNA, 15 bp, Homo sapiens
gcaggaacagggatg

SEQ ID NO: 200983 - DNA, 15 bp, Homo sapiens
tgcaggaacagggat

SEQ ID NO: 200984 - DNA, 15 bp, Homo sapiens
ttgcaggaacaggga

SEQ ID NO: 200985 - DNA, 15 bp, Homo sapiens
tttgcaggaacaggg

SEQ ID NO: 200986 - DNA, 15 bp, Homo sapiens
ctttgcaggaacagg

SEQ ID NO: 200987 - DNA, 15 bp, Homo sapiens
tctttgcaggaacag

SEQ ID NO: 200988 - DNA, 15 bp, Homo sapiens
ttctttgcaggaaca

SEQ ID NO: 200989 - DNA, 15 bp, Homo sapiens
gttctttgcaggaac

SEQ ID NO: 200990 - DNA, 15 bp, Homo sapiens
tgttctttgcaggaa

SEQ ID NO: 200991 - DNA, 15 bp, Homo sapiens
atgttctttgcagga

SEQ ID NO: 200992 - DNA, 15 bp, Homo sapiens
catgttctttgcagg

SEQ ID NO: 200993 - DNA, 15 bp, Homo sapiens
ccatgttctttgcag

SEQ ID NO: 200994 - DNA, 15 bp, Homo sapiens
accatgttctttgca

SEQ ID NO: 200995 - DNA, 15 bp, Homo sapiens
gaccatgttctttgc

SEQ ID NO: 200996 - DNA, 15 bp, Homo sapiens
agaccatgttctttg

SEQ ID NO: 200997 - DNA, 15 bp, Homo sapiens
gagaccatgttcttt

SEQ ID NO: 200998 - DNA, 15 bp, Homo sapiens
cgagaccatgttctt

SEQ ID NO: 200999 - DNA, 15 bp, Homo sapiens
acgagaccatgttct

SEQ ID NO: 201000 - DNA, 15 bp, Homo sapiens
aacgagaccatgttc

SEQ ID NO: 201001 - DNA, 15 bp, Homo sapiens
gaacgagaccatgtt

SEQ ID NO: 201002 - DNA, 15 bp, Homo sapiens
agaacgagaccatgt

SEQ ID NO: 201003 - DNA, 15 bp, Homo sapiens
aagaacgagaccatg

SEQ ID NO: 201004 - DNA, 15 bp, Homo sapiens
aaagaacgagaccat

SEQ ID NO: 201005 - DNA, 15 bp, Homo sapiens
aaaagaacgagacca

SEQ ID NO: 201006 - DNA, 15 bp, Homo sapiens
aaaaagaacgagacc

SEQ ID NO: 201007 - DNA, 15 bp, Homo sapiens
gaaaaagaacgagac

SEQ ID NO: 201008 - DNA, 15 bp, Homo sapiens
tgaaaaagaacgaga

SEQ ID NO: 201009 - DNA, 15 bp, Homo sapiens
atgaaaaagaacgag

SEQ ID NO: 201010 - DNA, 15 bp, Homo sapiens
catgaaaaagaacga

SEQ ID NO: 201011 - DNA, 15 bp, Homo sapiens
ccatgaaaaagaacg

SEQ ID NO: 201012 - DNA, 15 bp, Homo sapiens
gccatgaaaaagaac

SEQ ID NO: 201013 - DNA, 15 bp, Homo sapiens
agccatgaaaaagaa

SEQ ID NO: 201014 - DNA, 15 bp, Homo sapiens
cagccatgaaaaaga

SEQ ID NO: 201015 - DNA, 15 bp, Homo sapiens
gcagccatgaaaaag

SEQ ID NO: 201016 - DNA, 15 bp, Homo sapiens
tgcagccatgaaaaa

SEQ ID NO: 201017 - DNA, 15 bp, Homo sapiens
atgcagccatgaaaa

SEQ ID NO: 201018 - DNA, 15 bp, Homo sapiens
tatgcagccatgaaa

SEQ ID NO: 201019 - DNA, 15 bp, Homo sapiens
ctatgcagccatgaa

SEQ ID NO: 201020 - DNA, 15 bp, Homo sapiens
actatgcagccatga

SEQ ID NO: 201021 - DNA, 15 bp, Homo sapiens
tactatgcagccatg

SEQ ID NO: 201022 - DNA, 15 bp, Homo sapiens
gtacatatacaccat

SEQ ID NO: 201023 - DNA, 15 bp, Homo sapiens
ggtacatatacacca

SEQ ID NO: 201024 - DNA, 15 bp, Homo sapiens
tggtacatatacacc

SEQ ID NO: 201025 - DNA, 15 bp, Homo sapiens
gtggtacatatacac

SEQ ID NO: 201026 - DNA, 15 bp, Homo sapiens
tgtggtacatataca

SEQ ID NO: 201027 - DNA, 15 bp, Homo sapiens
ctgtggtacatatac

SEQ ID NO: 201028 - DNA, 15 bp, Homo sapiens
actgtggtacatata

SEQ ID NO: 201029 - DNA, 15 bp, Homo sapiens
aactgtggtacatat

SEQ ID NO: 201030 - DNA, 15 bp, Homo sapiens
aaactgtggtacata

SEQ ID NO: 201031 - DNA, 15 bp, Homo sapiens
aaaactgtggtacat

SEQ ID NO: 201032 - DNA, 15 bp, Homo sapiens
aaaaactgtggtaca

SEQ ID NO: 201033 - DNA, 15 bp, Homo sapiens
gaaaaactgtggtac

SEQ ID NO: 201034 - DNA, 15 bp, Homo sapiens
tgaaaaactgtggta

SEQ ID NO: 201035 - DNA, 15 bp, Homo sapiens
ttgaaaaactgtggt

SEQ ID NO: 201036 - DNA, 15 bp, Homo sapiens
attgaaaaactgtgg

SEQ ID NO: 201037 - DNA, 15 bp, Homo sapiens
gattgaaaaactgtg

SEQ ID NO: 201038 - DNA, 15 bp, Homo sapiens
ggattgaaaaactgt

SEQ ID NO: 201039 - DNA, 15 bp, Homo sapiens
tggattgaaaaactg

SEQ ID NO: 201040 - DNA, 15 bp, Homo sapiens
ctggattgaaaaact

SEQ ID NO: 201041 - DNA, 15 bp, Homo sapiens
actggattgaaaaac

SEQ ID NO: 201042 - DNA, 15 bp, Homo sapiens
gactggattgaaaaa

SEQ ID NO: 201043 - DNA, 15 bp, Homo sapiens
agactggattgaaaa

SEQ ID NO: 201044 - DNA, 15 bp, Homo sapiens
aagactggattgaaa

SEQ ID NO: 201045 - DNA, 15 bp, Homo sapiens
taagactggattgaa

SEQ ID NO: 201046 - DNA, 15 bp, Homo sapiens
ataagactggattga

SEQ ID NO: 201047 - DNA, 15 bp, Homo sapiens
gataagactggattg

SEQ ID NO: 201048 - DNA, 15 bp, Homo sapiens
tgataagactggatt

SEQ ID NO: 201049 - DNA, 15 bp, Homo sapiens
atgataagactggat

SEQ ID NO: 201050 - DNA, 15 bp, Homo sapiens
aatgataagactgga

SEQ ID NO: 201051 - DNA, 15 bp, Homo sapiens
caatgataagactgg

SEQ ID NO: 201052 - DNA, 15 bp, Homo sapiens
tcaatgataagactg

SEQ ID NO: 201053 - DNA, 15 bp, Homo sapiens
atcaatgataagact

SEQ ID NO: 201054 - DNA, 15 bp, Homo sapiens
catcaatgataagac

SEQ ID NO: 201055 - DNA, 15 bp, Homo sapiens
ccatcaatgataaga

SEQ ID NO: 201056 - DNA, 15 bp, Homo sapiens
cccatcaatgataag

SEQ ID NO: 201057 - DNA, 15 bp, Homo sapiens
gcccatcaatgataa

SEQ ID NO: 201058 - DNA, 15 bp, Homo sapiens
ttaaatgcccatcaa

SEQ ID NO: 201059 - DNA, 15 bp, Homo sapiens
cttaaatgcccatca

SEQ ID NO: 201060 - DNA, 15 bp, Homo sapiens
acttaaatgcccatc

SEQ ID NO: 201061 - DNA, 15 bp, Homo sapiens
aacttaaatgcccat

SEQ ID NO: 201062 - DNA, 15 bp, Homo sapiens
caacttaaatgccca

SEQ ID NO: 201063 - DNA, 15 bp, Homo sapiens
tcaacttaaatgccc

SEQ ID NO: 201064 - DNA, 15 bp, Homo sapiens
atcaacttaaatgcc

SEQ ID NO: 201065 - DNA, 15 bp, Homo sapiens
aatcaacttaaatgc

SEQ ID NO: 201066 - DNA, 15 bp, Homo sapiens
gaatcaacttaaatg

SEQ ID NO: 201067 - DNA, 15 bp, Homo sapiens
ggaatcaacttaaat

SEQ ID NO: 201068 - DNA, 15 bp, Homo sapiens
tggaatcaacttaaa

SEQ ID NO: 201069 - DNA, 15 bp, Homo sapiens
atggaatcaacttaa

SEQ ID NO: 201070 - DNA, 15 bp, Homo sapiens
catggaatcaactta

SEQ ID NO: 201071 - DNA, 15 bp, Homo sapiens
acatggaatcaactt

SEQ ID NO: 201072 - DNA, 15 bp, Homo sapiens
aacatggaatcaact

SEQ ID NO: 201073 - DNA, 15 bp, Homo sapiens
caacatggaatcaac

SEQ ID NO: 201074 - DNA, 15 bp, Homo sapiens
acaacatggaatcaa

SEQ ID NO: 201075 - DNA, 15 bp, Homo sapiens
aacaacatggaatca

SEQ ID NO: 201076 - DNA, 15 bp, Homo sapiens
caacaacatggaatc

SEQ ID NO: 201077 - DNA, 15 bp, Homo sapiens
gcaacaacatggaat

SEQ ID NO: 201078 - DNA, 15 bp, Homo sapiens
agcaacaacatggaa

SEQ ID NO: 201079 - DNA, 15 bp, Homo sapiens
tagcaacaacatgga

SEQ ID NO: 201080 - DNA, 15 bp, Homo sapiens
atagcaacaacatgg

SEQ ID NO: 201081 - DNA, 15 bp, Homo sapiens
aatagcaacaacatg

SEQ ID NO: 201082 - DNA, 15 bp, Homo sapiens
caatagcaacaacat

SEQ ID NO: 201083 - DNA, 15 bp, Homo sapiens
acaatagcaacaaca

SEQ ID NO: 201084 - DNA, 15 bp, Homo sapiens
cacaatagcaacaac

SEQ ID NO: 201085 - DNA, 15 bp, Homo sapiens
gcacaatagcaacaa

SEQ ID NO: 201086 - DNA, 15 bp, Homo sapiens
tgcacaatagcaaca

SEQ ID NO: 201087 - DNA, 15 bp, Homo sapiens
atgcacaatagcaac

SEQ ID NO: 201088 - DNA, 15 bp, Homo sapiens
tatgcacaatagcaa

SEQ ID NO: 201089 - DNA, 15 bp, Homo sapiens
ctatgcacaatagca

SEQ ID NO: 201090 - DNA, 15 bp, Homo sapiens
actatgcacaatagc

SEQ ID NO: 201091 - DNA, 15 bp, Homo sapiens
tactatgcacaatag

SEQ ID NO: 201092 - DNA, 15 bp, Homo sapiens
gtactatgcacaata

SEQ ID NO: 201093 - DNA, 15 bp, Homo sapiens
agtactatgcacaat

SEQ ID NO: 201094 - DNA, 15 bp, Homo sapiens
tagtactatgcacaa

SEQ ID NO: 201095 - DNA, 15 bp, Homo sapiens
gtagtactatgcaca

SEQ ID NO: 201096 - DNA, 15 bp, Homo sapiens
tgtagtactatgcac

SEQ ID NO: 201097 - DNA, 15 bp, Homo sapiens
ttgtagtactatgca

SEQ ID NO: 201098 - DNA, 15 bp, Homo sapiens
attgtagtactatgc

SEQ ID NO: 201099 - DNA, 15 bp, Homo sapiens
cattgtagtactatg

SEQ ID NO: 201100 - DNA, 15 bp, Homo sapiens
tcattgtagtactat

SEQ ID NO: 201101 - DNA, 15 bp, Homo sapiens
ttcattgtagtacta

SEQ ID NO: 201102 - DNA, 15 bp, Homo sapiens
gttcattgtagtact

SEQ ID NO: 201103 - DNA, 15 bp, Homo sapiens
tgttcattgtagtac

SEQ ID NO: 201104 - DNA, 15 bp, Homo sapiens
atgttcattgtagta

SEQ ID NO: 201105 - DNA, 15 bp, Homo sapiens
tatgttcattgtagt

SEQ ID NO: 201106 - DNA, 15 bp, Homo sapiens
gtatgttcattgtag

SEQ ID NO: 201107 - DNA, 15 bp, Homo sapiens
tgtatgttcattgta

SEQ ID NO: 201108 - DNA, 15 bp, Homo sapiens
atgtatgttcattgt

SEQ ID NO: 201109 - DNA, 15 bp, Homo sapiens
tatgtatgttcattg

SEQ ID NO: 201110 - DNA, 15 bp, Homo sapiens
atatgtatgttcatt

SEQ ID NO: 201111 - DNA, 15 bp, Homo sapiens
catatgtatgttcat

SEQ ID NO: 201112 - DNA, 15 bp, Homo sapiens
gcatatgtatgttca

SEQ ID NO: 201113 - DNA, 15 bp, Homo sapiens
tgcatatgtatgttc

SEQ ID NO: 201114 - DNA, 15 bp, Homo sapiens
atgcatatgtatgtt

SEQ ID NO: 201115 - DNA, 15 bp, Homo sapiens
catgcatatgtatgt

SEQ ID NO: 201116 - DNA, 15 bp, Homo sapiens
acatgcatatgtatg

SEQ ID NO: 201117 - DNA, 15 bp, Homo sapiens
cacatgcatatgtat

SEQ ID NO: 201118 - DNA, 15 bp, Homo sapiens
acacatgcatatgta

SEQ ID NO: 201119 - DNA, 15 bp, Homo sapiens
gacacatgcatatgt

SEQ ID NO: 201120 - DNA, 15 bp, Homo sapiens
agacacatgcatatg

SEQ ID NO: 201121 - DNA, 15 bp, Homo sapiens
aagacacatgcatat

SEQ ID NO: 201122 - DNA, 15 bp, Homo sapiens
aaagacacatgcata

SEQ ID NO: 201123 - DNA, 15 bp, Homo sapiens
taaagacacatgcat

SEQ ID NO: 201124 - DNA, 15 bp, Homo sapiens
ttataaagacacatg

SEQ ID NO: 201125 - DNA, 15 bp, Homo sapiens
attataaagacacat

SEQ ID NO: 201126 - DNA, 15 bp, Homo sapiens
tattataaagacaca

SEQ ID NO: 201127 - DNA, 15 bp, Homo sapiens
ctattataaagacac

SEQ ID NO: 201128 - DNA, 15 bp, Homo sapiens
tctattataaagaca

SEQ ID NO: 201129 - DNA, 15 bp, Homo sapiens
ttctattataaagac

SEQ ID NO: 201130 - DNA, 15 bp, Homo sapiens
tacccaaaggaatat

SEQ ID NO: 201131 - DNA, 15 bp, Homo sapiens
taaataccatttgac

SEQ ID NO: 201132 - DNA, 15 bp, Homo sapiens
ataaataccatttga

SEQ ID NO: 201133 - DNA, 15 bp, Homo sapiens
cataaataccatttg

SEQ ID NO: 201134 - DNA, 15 bp, Homo sapiens
acataaataccattt

SEQ ID NO: 201135 - DNA, 15 bp, Homo sapiens
aacataaataccatt

SEQ ID NO: 201136 - DNA, 15 bp, Homo sapiens
aaacataaataccat

SEQ ID NO: 201137 - DNA, 15 bp, Homo sapiens
aaaacataaatacca

SEQ ID NO: 201138 - DNA, 15 bp, Homo sapiens
aaaaacataaatacc

SEQ ID NO: 201139 - DNA, 15 bp, Homo sapiens
taaaaacataaatac

SEQ ID NO: 201140 - DNA, 15 bp, Homo sapiens
ctaaaaacataaata

SEQ ID NO: 201141 - DNA, 15 bp, Homo sapiens
cctaaaaacataaat

SEQ ID NO: 201142 - DNA, 15 bp, Homo sapiens
acctaaaaacataaa

SEQ ID NO: 201143 - DNA, 15 bp, Homo sapiens
gacctaaaaacataa

SEQ ID NO: 201144 - DNA, 15 bp, Homo sapiens
agacctaaaaacata

SEQ ID NO: 201145 - DNA, 15 bp, Homo sapiens
aagacctaaaaacat

SEQ ID NO: 201146 - DNA, 15 bp, Homo sapiens
aaagacctaaaaaca

SEQ ID NO: 201147 - DNA, 15 bp, Homo sapiens
caaagacctaaaaac

SEQ ID NO: 201148 - DNA, 15 bp, Homo sapiens
tcaaagacctaaaaa

SEQ ID NO: 201149 - DNA, 15 bp, Homo sapiens
ctcctcaaagaccta

SEQ ID NO: 201150 - DNA, 15 bp, Homo sapiens
actcctcaaagacct

SEQ ID NO: 201151 - DNA, 15 bp, Homo sapiens
gactcctcaaagacc

SEQ ID NO: 201152 - DNA, 15 bp, Homo sapiens
cgactcctcaaagac

SEQ ID NO: 201153 - DNA, 15 bp, Homo sapiens
gcgactcctcaaaga

SEQ ID NO: 201154 - DNA, 15 bp, Homo sapiens
ggcgactcctcaaag

SEQ ID NO: 201155 - DNA, 15 bp, Homo sapiens
tggcgactcctcaaa

SEQ ID NO: 201156 - DNA, 15 bp, Homo sapiens
gtggcgactcctcaa

SEQ ID NO: 201157 - DNA, 15 bp, Homo sapiens
tgtggcgactcctca

SEQ ID NO: 201158 - DNA, 15 bp, Homo sapiens
gtgtggcgactcctc

SEQ ID NO: 201159 - DNA, 15 bp, Homo sapiens
agtgtggcgactcct

SEQ ID NO: 201160 - DNA, 15 bp, Homo sapiens
cagtgtggcgactcc

SEQ ID NO: 201161 - DNA, 15 bp, Homo sapiens
acagtgtggcgactc

SEQ ID NO: 201162 - DNA, 15 bp, Homo sapiens
gacagtgtggcgact

SEQ ID NO: 201163 - DNA, 15 bp, Homo sapiens
agacagtgtggcgac

SEQ ID NO: 201164 - DNA, 15 bp, Homo sapiens
agaagacagtgtggc

SEQ ID NO: 201165 - DNA, 15 bp, Homo sapiens
gagaagacagtgtgg

SEQ ID NO: 201166 - DNA, 15 bp, Homo sapiens
tgagaagacagtgtg

SEQ ID NO: 201167 - DNA, 15 bp, Homo sapiens
ttgagaagacagtgt

SEQ ID NO: 201168 - DNA, 15 bp, Homo sapiens
attgagaagacagtg

SEQ ID NO: 201169 - DNA, 15 bp, Homo sapiens
tattgagaagacagt

SEQ ID NO: 201170 - DNA, 15 bp, Homo sapiens
ctattgagaagacag

SEQ ID NO: 201171 - DNA, 15 bp, Homo sapiens
tctattgagaagaca

SEQ ID NO: 201172 - DNA, 15 bp, Homo sapiens
atctattgagaagac

SEQ ID NO: 201173 - DNA, 15 bp, Homo sapiens
catctattgagaaga

SEQ ID NO: 201174 - DNA, 15 bp, Homo sapiens
tcatctattgagaag

SEQ ID NO: 201175 - DNA, 15 bp, Homo sapiens
ttcatctattgagaa

SEQ ID NO: 201176 - DNA, 15 bp, Homo sapiens
gttcatctattgaga

SEQ ID NO: 201177 - DNA, 15 bp, Homo sapiens
agttcatctattgag

SEQ ID NO: 201178 - DNA, 15 bp, Homo sapiens
tagttcatctattga

SEQ ID NO: 201179 - DNA, 15 bp, Homo sapiens
ttagttcatctattg

SEQ ID NO: 201180 - DNA, 15 bp, Homo sapiens
attagttcatctatt

SEQ ID NO: 201181 - DNA, 15 bp, Homo sapiens
aattagttcatctat

SEQ ID NO: 201182 - DNA, 15 bp, Homo sapiens
aaattagttcatcta

SEQ ID NO: 201183 - DNA, 15 bp, Homo sapiens
taaattagttcatct

SEQ ID NO: 201184 - DNA, 15 bp, Homo sapiens
gtaaattagttcatc

SEQ ID NO: 201185 - DNA, 15 bp, Homo sapiens
tgtaaattagttcat

SEQ ID NO: 201186 - DNA, 15 bp, Homo sapiens
tggagtgtaaattag

SEQ ID NO: 201187 - DNA, 15 bp, Homo sapiens
ttggagtgtaaatta

SEQ ID NO: 201188 - DNA, 15 bp, Homo sapiens
gttggagtgtaaatt

SEQ ID NO: 201189 - DNA, 15 bp, Homo sapiens
ggttggagtgtaaat

SEQ ID NO: 201190 - DNA, 15 bp, Homo sapiens
tggttggagtgtaaa

SEQ ID NO: 201191 - DNA, 15 bp, Homo sapiens
ttggttggagtgtaa

SEQ ID NO: 201192 - DNA, 15 bp, Homo sapiens
gttggttggagtgta

SEQ ID NO: 201193 - DNA, 15 bp, Homo sapiens
tgttggttggagtgt

SEQ ID NO: 201194 - DNA, 15 bp, Homo sapiens
ctgttggttggagtg

SEQ ID NO: 201195 - DNA, 15 bp, Homo sapiens
actgttggttggagt

SEQ ID NO: 201196 - DNA, 15 bp, Homo sapiens
cactgttggttggag

SEQ ID NO: 201197 - DNA, 15 bp, Homo sapiens
acactgttggttgga

SEQ ID NO: 201198 - DNA, 15 bp, Homo sapiens
tacactgttggttgg

SEQ ID NO: 201199 - DNA, 15 bp, Homo sapiens
ttacactgttggttg

SEQ ID NO: 201200 - DNA, 15 bp, Homo sapiens
tttacactgttggtt

SEQ ID NO: 201201 - DNA, 15 bp, Homo sapiens
acttttacactgttg

SEQ ID NO: 201202 - DNA, 15 bp, Homo sapiens
cacttttacactgtt

SEQ ID NO: 201203 - DNA, 15 bp, Homo sapiens
acacttttacactgt

SEQ ID NO: 201204 - DNA, 15 bp, Homo sapiens
aacacttttacactg

SEQ ID NO: 201205 - DNA, 15 bp, Homo sapiens
gaacacttttacact

SEQ ID NO: 201206 - DNA, 15 bp, Homo sapiens
ggaacacttttacac

SEQ ID NO: 201207 - DNA, 15 bp, Homo sapiens
aggaacacttttaca

SEQ ID NO: 201208 - DNA, 15 bp, Homo sapiens
aaggaacacttttac

SEQ ID NO: 201209 - DNA, 15 bp, Homo sapiens
ggagaaaaaggaaca

SEQ ID NO: 201210 - DNA, 15 bp, Homo sapiens
aggagaaaaaggaac

SEQ ID NO: 201211 - DNA, 15 bp, Homo sapiens
gaggagaaaaaggaa

SEQ ID NO: 201212 - DNA, 15 bp, Homo sapiens
tgaggagaaaaagga

SEQ ID NO: 201213 - DNA, 15 bp, Homo sapiens
ttgaggagaaaaagg

SEQ ID NO: 201214 - DNA, 15 bp, Homo sapiens
gttgaggagaaaaag

SEQ ID NO: 201215 - DNA, 15 bp, Homo sapiens
ggttgaggagaaaaa

SEQ ID NO: 201216 - DNA, 15 bp, Homo sapiens
aggttgaggagaaaa

SEQ ID NO: 201217 - DNA, 15 bp, Homo sapiens
aaggttgaggagaaa

SEQ ID NO: 201218 - DNA, 15 bp, Homo sapiens
caaggttgaggagaa

SEQ ID NO: 201219 - DNA, 15 bp, Homo sapiens
acaaggttgaggaga

SEQ ID NO: 201220 - DNA, 15 bp, Homo sapiens
gacaaggttgaggag

SEQ ID NO: 201221 - DNA, 15 bp, Homo sapiens
tgacaaggttgagga

SEQ ID NO: 201222 - DNA, 15 bp, Homo sapiens
ctgacaaggttgagg

SEQ ID NO: 201223 - DNA, 15 bp, Homo sapiens
gctgacaaggttgag

SEQ ID NO: 201224 - DNA, 15 bp, Homo sapiens
tgctgacaaggttga

SEQ ID NO: 201225 - DNA, 15 bp, Homo sapiens
atgctgacaaggttg

SEQ ID NO: 201226 - DNA, 15 bp, Homo sapiens
gatgctgacaaggtt

SEQ ID NO: 201227 - DNA, 15 bp, Homo sapiens
agatgctgacaaggt

SEQ ID NO: 201228 - DNA, 15 bp, Homo sapiens
cagatgctgacaagg

SEQ ID NO: 201229 - DNA, 15 bp, Homo sapiens
acagatgctgacaag

SEQ ID NO: 201230 - DNA, 15 bp, Homo sapiens
aacagatgctgacaa

SEQ ID NO: 201231 - DNA, 15 bp, Homo sapiens
taacagatgctgaca

SEQ ID NO: 201232 - DNA, 15 bp, Homo sapiens
ataacagatgctgac

SEQ ID NO: 201233 - DNA, 15 bp, Homo sapiens
tataacagatgctga

SEQ ID NO: 201234 - DNA, 15 bp, Homo sapiens
atataacagatgctg

SEQ ID NO: 201235 - DNA, 15 bp, Homo sapiens
aatataacagatgct

SEQ ID NO: 201236 - DNA, 15 bp, Homo sapiens
aaatataacagatgc

SEQ ID NO: 201237 - DNA, 15 bp, Homo sapiens
aaaatataacagatg

SEQ ID NO: 201238 - DNA, 15 bp, Homo sapiens
caaaatataacagat

SEQ ID NO: 201239 - DNA, 15 bp, Homo sapiens
tcaaaatataacaga

SEQ ID NO: 201240 - DNA, 15 bp, Homo sapiens
gtcaaaatataacag

SEQ ID NO: 201241 - DNA, 15 bp, Homo sapiens
agtcaaaatataaca

SEQ ID NO: 201242 - DNA, 15 bp, Homo sapiens
aagtcaaaatataac

SEQ ID NO: 201243 - DNA, 15 bp, Homo sapiens
aaagtcaaaatataa

SEQ ID NO: 201244 - DNA, 15 bp, Homo sapiens
aaaagtcaaaatata

SEQ ID NO: 201245 - DNA, 15 bp, Homo sapiens
aaaaagtcaaaatat

SEQ ID NO: 201246 - DNA, 15 bp, Homo sapiens
taaaaagtcaaaata

SEQ ID NO: 201247 - DNA, 15 bp, Homo sapiens
gtaaaaagtcaaaat

SEQ ID NO: 201248 - DNA, 15 bp, Homo sapiens
agtaaaaagtcaaaa

SEQ ID NO: 201249 - DNA, 15 bp, Homo sapiens
tagtaaaaagtcaaa

SEQ ID NO: 201250 - DNA, 15 bp, Homo sapiens
ttagtaaaaagtcaa

SEQ ID NO: 201251 - DNA, 15 bp, Homo sapiens
attagtaaaaagtca

SEQ ID NO: 201252 - DNA, 15 bp, Homo sapiens
tattagtaaaaagtc

SEQ ID NO: 201253 - DNA, 15 bp, Homo sapiens
ctattagtaaaaagt

SEQ ID NO: 201254 - DNA, 15 bp, Homo sapiens
gctattagtaaaaag

SEQ ID NO: 201255 - DNA, 15 bp, Homo sapiens
ggctattagtaaaaa

SEQ ID NO: 201256 - DNA, 15 bp, Homo sapiens
tggctattagtaaaa

SEQ ID NO: 201257 - DNA, 15 bp, Homo sapiens
atggctattagtaaa

SEQ ID NO: 201258 - DNA, 15 bp, Homo sapiens
aatggctattagtaa

SEQ ID NO: 201259 - DNA, 15 bp, Homo sapiens
gaatggctattagta

SEQ ID NO: 201260 - DNA, 15 bp, Homo sapiens
agaatggctattagt

SEQ ID NO: 201261 - DNA, 15 bp, Homo sapiens
cagaatggctattag

SEQ ID NO: 201262 - DNA, 15 bp, Homo sapiens
ctcacaccagtcaga

SEQ ID NO: 201263 - DNA, 15 bp, Homo sapiens
tctcacaccagtcag

SEQ ID NO: 201264 - DNA, 15 bp, Homo sapiens
atctcacaccagtca

SEQ ID NO: 201265 - DNA, 15 bp, Homo sapiens
catctcacaccagtc

SEQ ID NO: 201266 - DNA, 15 bp, Homo sapiens
gatcattagagaaat

SEQ ID NO: 201267 - DNA, 15 bp, Homo sapiens
tgatcattagagaaa

SEQ ID NO: 201268 - DNA, 15 bp, Homo sapiens
ctgatcattagagaa

SEQ ID NO: 201269 - DNA, 15 bp, Homo sapiens
actgatcattagaga

SEQ ID NO: 201270 - DNA, 15 bp, Homo sapiens
cactgatcattagag

SEQ ID NO: 201271 - DNA, 15 bp, Homo sapiens
tcactgatcattaga

SEQ ID NO: 201272 - DNA, 15 bp, Homo sapiens
atcactgatcattag

SEQ ID NO: 201273 - DNA, 15 bp, Homo sapiens
catcactgatcatta

SEQ ID NO: 201274 - DNA, 15 bp, Homo sapiens
acatcactgatcatt

SEQ ID NO: 201275 - DNA, 15 bp, Homo sapiens
aacatcactgatcat

SEQ ID NO: 201276 - DNA, 15 bp, Homo sapiens
caacatcactgatca

SEQ ID NO: 201277 - DNA, 15 bp, Homo sapiens
tcaacatcactgatc

SEQ ID NO: 201278 - DNA, 15 bp, Homo sapiens
ttcaacatcactgat

SEQ ID NO: 201279 - DNA, 15 bp, Homo sapiens
cttcaacatcactga

SEQ ID NO: 201280 - DNA, 15 bp, Homo sapiens
ccttcaacatcactg

SEQ ID NO: 201281 - DNA, 15 bp, Homo sapiens
accttcaacatcact

SEQ ID NO: 201282 - DNA, 15 bp, Homo sapiens
aaccttcaacatcac

SEQ ID NO: 201283 - DNA, 15 bp, Homo sapiens
aaaccttcaacatca

SEQ ID NO: 201284 - DNA, 15 bp, Homo sapiens
aaaaccttcaacatc

SEQ ID NO: 201285 - DNA, 15 bp, Homo sapiens
aaaaaccttcaacat

SEQ ID NO: 201286 - DNA, 15 bp, Homo sapiens
aaaaaaccttcaaca

SEQ ID NO: 201287 - DNA, 15 bp, Homo sapiens
aaaaaaaccttcaac

SEQ ID NO: 201288 - DNA, 15 bp, Homo sapiens
aaaaaaaaccttcaa

SEQ ID NO: 201289 - DNA, 15 bp, Homo sapiens
aaaaaaaaaccttca

SEQ ID NO: 201290 - DNA, 15 bp, Homo sapiens
taaaaaaaaaccttc

SEQ ID NO: 201291 - DNA, 15 bp, Homo sapiens
ttaaaaaaaaacctt

SEQ ID NO: 201292 - DNA, 15 bp, Homo sapiens
attaaaaaaaaacct

SEQ ID NO: 201293 - DNA, 15 bp, Homo sapiens
tattaaaaaaaaacc

SEQ ID NO: 201294 - DNA, 15 bp, Homo sapiens
atattaaaaaaaaac

SEQ ID NO: 201295 - DNA, 15 bp, Homo sapiens
catattaaaaaaaaa

SEQ ID NO: 201296 - DNA, 15 bp, Homo sapiens
gcatattaaaaaaaa

SEQ ID NO: 201297 - DNA, 15 bp, Homo sapiens
acaagcatattaaaa

SEQ ID NO: 201298 - DNA, 15 bp, Homo sapiens
gacaagcatattaaa

SEQ ID NO: 201299 - DNA, 15 bp, Homo sapiens
tgacaagcatattaa

SEQ ID NO: 201300 - DNA, 15 bp, Homo sapiens
ctgacaagcatatta

SEQ ID NO: 201301 - DNA, 15 bp, Homo sapiens
gctgacaagcatatt

SEQ ID NO: 201302 - DNA, 15 bp, Homo sapiens
agctgacaagcatat

SEQ ID NO: 201303 - DNA, 15 bp, Homo sapiens
cagctgacaagcata

SEQ ID NO: 201304 - DNA, 15 bp, Homo sapiens
gcagctgacaagcat

SEQ ID NO: 201305 - DNA, 15 bp, Homo sapiens
tgcagctgacaagca

SEQ ID NO: 201306 - DNA, 15 bp, Homo sapiens
atgcagctgacaagc

SEQ ID NO: 201307 - DNA, 15 bp, Homo sapiens
tatgcagctgacaag

SEQ ID NO: 201308 - DNA, 15 bp, Homo sapiens
atatgcagctgacaa

SEQ ID NO: 201309 - DNA, 15 bp, Homo sapiens
tatatgcagctgaca

SEQ ID NO: 201310 - DNA, 15 bp, Homo sapiens
atatatgcagctgac

SEQ ID NO: 201311 - DNA, 15 bp, Homo sapiens
catatatgcagctga

SEQ ID NO: 201312 - DNA, 15 bp, Homo sapiens
acatatatgcagctg

SEQ ID NO: 201313 - DNA, 15 bp, Homo sapiens
gacatatatgcagct

SEQ ID NO: 201314 - DNA, 15 bp, Homo sapiens
agacatatatgcagc

SEQ ID NO: 201315 - DNA, 15 bp, Homo sapiens
aagacatatatgcag

SEQ ID NO: 201316 - DNA, 15 bp, Homo sapiens
gaagacatatatgca

SEQ ID NO: 201317 - DNA, 15 bp, Homo sapiens
agaagacatatatgc

SEQ ID NO: 201318 - DNA, 15 bp, Homo sapiens
aagaagacatatatg

SEQ ID NO: 201319 - DNA, 15 bp, Homo sapiens
aaagaagacatatat

SEQ ID NO: 201320 - DNA, 15 bp, Homo sapiens
aaaagaagacatata

SEQ ID NO: 201321 - DNA, 15 bp, Homo sapiens
caaaagaagacatat

SEQ ID NO: 201322 - DNA, 15 bp, Homo sapiens
tcaaaagaagacata

SEQ ID NO: 201323 - DNA, 15 bp, Homo sapiens
ttcaaaagaagacat

SEQ ID NO: 201324 - DNA, 15 bp, Homo sapiens
tttcaaaagaagaca

SEQ ID NO: 201325 - DNA, 15 bp, Homo sapiens
ttttcaaaagaagac

SEQ ID NO: 201326 - DNA, 15 bp, Homo sapiens
cttttcaaaagaaga

SEQ ID NO: 201327 - DNA, 15 bp, Homo sapiens
acttttcaaaagaag

SEQ ID NO: 201328 - DNA, 15 bp, Homo sapiens
cacttttcaaaagaa

SEQ ID NO: 201329 - DNA, 15 bp, Homo sapiens
acacttttcaaaaga

SEQ ID NO: 201330 - DNA, 15 bp, Homo sapiens
gacacttttcaaaag

SEQ ID NO: 201331 - DNA, 15 bp, Homo sapiens
agacacttttcaaaa

SEQ ID NO: 201332 - DNA, 15 bp, Homo sapiens
cagacacttttcaaa

SEQ ID NO: 201333 - DNA, 15 bp, Homo sapiens
acagacacttttcaa

SEQ ID NO: 201334 - DNA, 15 bp, Homo sapiens
aacagacacttttca

SEQ ID NO: 201335 - DNA, 15 bp, Homo sapiens
gaacagacacttttc

SEQ ID NO: 201336 - DNA, 15 bp, Homo sapiens
tgaacagacactttt

SEQ ID NO: 201337 - DNA, 15 bp, Homo sapiens
atgaacagacacttt

SEQ ID NO: 201338 - DNA, 15 bp, Homo sapiens
catgaacagacactt

SEQ ID NO: 201339 - DNA, 15 bp, Homo sapiens
acatgaacagacact

SEQ ID NO: 201340 - DNA, 15 bp, Homo sapiens
gacatgaacagacac

SEQ ID NO: 201341 - DNA, 15 bp, Homo sapiens
ggacatgaacagaca

SEQ ID NO: 201342 - DNA, 15 bp, Homo sapiens
aggacatgaacagac

SEQ ID NO: 201343 - DNA, 15 bp, Homo sapiens
aaggacatgaacaga

SEQ ID NO: 201344 - DNA, 15 bp, Homo sapiens
aaaggacatgaacag

SEQ ID NO: 201345 - DNA, 15 bp, Homo sapiens
caaaggacatgaaca

SEQ ID NO: 201346 - DNA, 15 bp, Homo sapiens
gcaaaggacatgaac

SEQ ID NO: 201347 - DNA, 15 bp, Homo sapiens
ggcaaaggacatgaa

SEQ ID NO: 201348 - DNA, 15 bp, Homo sapiens
gggcaaaggacatga

SEQ ID NO: 201349 - DNA, 15 bp, Homo sapiens
tgggcaaaggacatg

SEQ ID NO: 201350 - DNA, 15 bp, Homo sapiens
gtgggcaaaggacat

SEQ ID NO: 201351 - DNA, 15 bp, Homo sapiens
agtgggcaaaggaca

SEQ ID NO: 201352 - DNA, 15 bp, Homo sapiens
aagtgggcaaaggac

SEQ ID NO: 201353 - DNA, 15 bp, Homo sapiens
ataaaaagtgggcaa

SEQ ID NO: 201354 - DNA, 15 bp, Homo sapiens
cataaaaagtgggca

SEQ ID NO: 201355 - DNA, 15 bp, Homo sapiens
ccataaaaagtgggc

SEQ ID NO: 201356 - DNA, 15 bp, Homo sapiens
accataaaaagtggg

SEQ ID NO: 201357 - DNA, 15 bp, Homo sapiens
caccataaaaagtgg

SEQ ID NO: 201358 - DNA, 15 bp, Homo sapiens
acaccataaaaagtg

SEQ ID NO: 201359 - DNA, 15 bp, Homo sapiens
aacaccataaaaagt

SEQ ID NO: 201360 - DNA, 15 bp, Homo sapiens
aaacaccataaaaag

SEQ ID NO: 201361 - DNA, 15 bp, Homo sapiens
caaacaccataaaaa

SEQ ID NO: 201362 - DNA, 15 bp, Homo sapiens
acaaacaccataaaa

SEQ ID NO: 201363 - DNA, 15 bp, Homo sapiens
aacaaacaccataaa

SEQ ID NO: 201364 - DNA, 15 bp, Homo sapiens
aaacaaacaccataa

SEQ ID NO: 201365 - DNA, 15 bp, Homo sapiens
aaaacaaacaccata

SEQ ID NO: 201366 - DNA, 15 bp, Homo sapiens
aaaaacaaacaccat

SEQ ID NO: 201367 - DNA, 15 bp, Homo sapiens
aaaaaacaaacacca

SEQ ID NO: 201368 - DNA, 15 bp, Homo sapiens
gaaaaaacaaacacc

SEQ ID NO: 201369 - DNA, 15 bp, Homo sapiens
ggaaaaaacaaacac

SEQ ID NO: 201370 - DNA, 15 bp, Homo sapiens
aggaaaaaacaaaca

SEQ ID NO: 201371 - DNA, 15 bp, Homo sapiens
aaggaaaaaacaaac

SEQ ID NO: 201372 - DNA, 15 bp, Homo sapiens
taaggaaaaaacaaa

SEQ ID NO: 201373 - DNA, 15 bp, Homo sapiens
ataaggaaaaaacaa

SEQ ID NO: 201374 - DNA, 15 bp, Homo sapiens
tataaggaaaaaaca

SEQ ID NO: 201375 - DNA, 15 bp, Homo sapiens
ttataaggaaaaaac

SEQ ID NO: 201376 - DNA, 15 bp, Homo sapiens
tttataaggaaaaaa

SEQ ID NO: 201377 - DNA, 15 bp, Homo sapiens
atttataaggaaaaa

SEQ ID NO: 201378 - DNA, 15 bp, Homo sapiens
aatttataaggaaaa

SEQ ID NO: 201379 - DNA, 15 bp, Homo sapiens
aaatttataaggaaa

SEQ ID NO: 201380 - DNA, 15 bp, Homo sapiens
caaatttataaggaa

SEQ ID NO: 201381 - DNA, 15 bp, Homo sapiens
acaaatttataagga

SEQ ID NO: 201382 - DNA, 15 bp, Homo sapiens
aacaaatttataagg

SEQ ID NO: 201383 - DNA, 15 bp, Homo sapiens
aaacaaatttataag

SEQ ID NO: 201384 - DNA, 15 bp, Homo sapiens
taaacaaatttataa

SEQ ID NO: 201385 - DNA, 15 bp, Homo sapiens
gtaaacaaatttata

SEQ ID NO: 201386 - DNA, 15 bp, Homo sapiens
tgtaaacaaatttat

SEQ ID NO: 201387 - DNA, 15 bp, Homo sapiens
atgtaaacaaattta

SEQ ID NO: 201388 - DNA, 15 bp, Homo sapiens
aatgtaaacaaattt

SEQ ID NO: 201389 - DNA, 15 bp, Homo sapiens
gaatgtaaacaaatt

SEQ ID NO: 201390 - DNA, 15 bp, Homo sapiens
ggaatgtaaacaaat

SEQ ID NO: 201391 - DNA, 15 bp, Homo sapiens
aggaatgtaaacaaa

SEQ ID NO: 201392 - DNA, 15 bp, Homo sapiens
aaggaatgtaaacaa

SEQ ID NO: 201393 - DNA, 15 bp, Homo sapiens
taaggaatgtaaaca

SEQ ID NO: 201394 - DNA, 15 bp, Homo sapiens
ataaggaatgtaaac

SEQ ID NO: 201395 - DNA, 15 bp, Homo sapiens
tataaggaatgtaaa

SEQ ID NO: 201396 - DNA, 15 bp, Homo sapiens
ctataaggaatgtaa

SEQ ID NO: 201397 - DNA, 15 bp, Homo sapiens
tctataaggaatgta

SEQ ID NO: 201398 - DNA, 15 bp, Homo sapiens
atctataaggaatgt

SEQ ID NO: 201399 - DNA, 15 bp, Homo sapiens
catctataaggaatg

SEQ ID NO: 201400 - DNA, 15 bp, Homo sapiens
gcatctataaggaat

SEQ ID NO: 201401 - DNA, 15 bp, Homo sapiens
agcatctataaggaa

SEQ ID NO: 201402 - DNA, 15 bp, Homo sapiens
gagcatctataagga

SEQ ID NO: 201403 - DNA, 15 bp, Homo sapiens
tgagcatctataagg

SEQ ID NO: 201404 - DNA, 15 bp, Homo sapiens
ttgagcatctataag

SEQ ID NO: 201405 - DNA, 15 bp, Homo sapiens
attgagcatctataa

SEQ ID NO: 201406 - DNA, 15 bp, Homo sapiens
tattgagcatctata

SEQ ID NO: 201407 - DNA, 15 bp, Homo sapiens
atattgagcatctat

SEQ ID NO: 201408 - DNA, 15 bp, Homo sapiens
aatattgagcatcta

SEQ ID NO: 201409 - DNA, 15 bp, Homo sapiens
taatattgagcatct

SEQ ID NO: 201410 - DNA, 15 bp, Homo sapiens
ctaatattgagcatc

SEQ ID NO: 201411 - DNA, 15 bp, Homo sapiens
tctaatattgagcat

SEQ ID NO: 201412 - DNA, 15 bp, Homo sapiens
gtctaatattgagca

SEQ ID NO: 201413 - DNA, 15 bp, Homo sapiens
ggtctaatattgagc

SEQ ID NO: 201414 - DNA, 15 bp, Homo sapiens
aggtctaatattgag

SEQ ID NO: 201415 - DNA, 15 bp, Homo sapiens
aaggtctaatattga

SEQ ID NO: 201416 - DNA, 15 bp, Homo sapiens
aaaggtctaatattg

SEQ ID NO: 201417 - DNA, 15 bp, Homo sapiens
caaaggtctaatatt

SEQ ID NO: 201418 - DNA, 15 bp, Homo sapiens
acaaaggtctaatat

SEQ ID NO: 201419 - DNA, 15 bp, Homo sapiens
gacaaaggtctaata

SEQ ID NO: 201420 - DNA, 15 bp, Homo sapiens
tgacaaaggtctaat

SEQ ID NO: 201421 - DNA, 15 bp, Homo sapiens
ctgacaaaggtctaa

SEQ ID NO: 201422 - DNA, 15 bp, Homo sapiens
tctgacaaaggtcta

SEQ ID NO: 201423 - DNA, 15 bp, Homo sapiens
atctgacaaaggtct

SEQ ID NO: 201424 - DNA, 15 bp, Homo sapiens
catctgacaaaggtc

SEQ ID NO: 201425 - DNA, 15 bp, Homo sapiens
gcatctgacaaaggt

SEQ ID NO: 201426 - DNA, 15 bp, Homo sapiens
tgcatctgacaaagg

SEQ ID NO: 201427 - DNA, 15 bp, Homo sapiens
atgcatctgacaaag

SEQ ID NO: 201428 - DNA, 15 bp, Homo sapiens
tatgcatctgacaaa

SEQ ID NO: 201429 - DNA, 15 bp, Homo sapiens
ctatgcatctgacaa

SEQ ID NO: 201430 - DNA, 15 bp, Homo sapiens
actatgcatctgaca

SEQ ID NO: 201431 - DNA, 15 bp, Homo sapiens
aactatgcatctgac

SEQ ID NO: 201432 - DNA, 15 bp, Homo sapiens
aaactatgcatctga

SEQ ID NO: 201433 - DNA, 15 bp, Homo sapiens
caaactatgcatctg

SEQ ID NO: 201434 - DNA, 15 bp, Homo sapiens
gcaaactatgcatct

SEQ ID NO: 201435 - DNA, 15 bp, Homo sapiens
tgcaaactatgcatc

SEQ ID NO: 201436 - DNA, 15 bp, Homo sapiens
ttgcaaactatgcat

SEQ ID NO: 201437 - DNA, 15 bp, Homo sapiens
gttgcaaactatgca

SEQ ID NO: 201438 - DNA, 15 bp, Homo sapiens
tgttgcaaactatgc

SEQ ID NO: 201439 - DNA, 15 bp, Homo sapiens
ttgttgcaaactatg

SEQ ID NO: 201440 - DNA, 15 bp, Homo sapiens
attgttgcaaactat

SEQ ID NO: 201441 - DNA, 15 bp, Homo sapiens
aattgttgcaaacta

SEQ ID NO: 201442 - DNA, 15 bp, Homo sapiens
aaattgttgcaaact

SEQ ID NO: 201443 - DNA, 15 bp, Homo sapiens
aaaattgttgcaaac

SEQ ID NO: 201444 - DNA, 15 bp, Homo sapiens
aaaaattgttgcaaa

SEQ ID NO: 201445 - DNA, 15 bp, Homo sapiens
aaaaaattgttgcaa

SEQ ID NO: 201446 - DNA, 15 bp, Homo sapiens
gaaaaaattgttgca

SEQ ID NO: 201447 - DNA, 15 bp, Homo sapiens
ggaaaaaattgttgc

SEQ ID NO: 201448 - DNA, 15 bp, Homo sapiens
gggaaaaaattgttg

SEQ ID NO: 201449 - DNA, 15 bp, Homo sapiens
tgggaaaaaattgtt

SEQ ID NO: 201450 - DNA, 15 bp, Homo sapiens
atgggaaaaaattgt

SEQ ID NO: 201451 - DNA, 15 bp, Homo sapiens
aatgggaaaaaattg

SEQ ID NO: 201452 - DNA, 15 bp, Homo sapiens
gaatgggaaaaaatt

SEQ ID NO: 201453 - DNA, 15 bp, Homo sapiens
agaatgggaaaaaat

SEQ ID NO: 201454 - DNA, 15 bp, Homo sapiens
cagaatgggaaaaaa

SEQ ID NO: 201455 - DNA, 15 bp, Homo sapiens
acagaatgggaaaaa

SEQ ID NO: 201456 - DNA, 15 bp, Homo sapiens
tacagaatgggaaaa

SEQ ID NO: 201457 - DNA, 15 bp, Homo sapiens
atacagaatgggaaa

SEQ ID NO: 201458 - DNA, 15 bp, Homo sapiens
catacagaatgggaa

SEQ ID NO: 201459 - DNA, 15 bp, Homo sapiens
acatacagaatggga

SEQ ID NO: 201460 - DNA, 15 bp, Homo sapiens
aacatacagaatggg

SEQ ID NO: 201461 - DNA, 15 bp, Homo sapiens
aaacatacagaatgg

SEQ ID NO: 201462 - DNA, 15 bp, Homo sapiens
taaacatacagaatg

SEQ ID NO: 201463 - DNA, 15 bp, Homo sapiens
gtaaacatacagaat

SEQ ID NO: 201464 - DNA, 15 bp, Homo sapiens
agtaaacatacagaa

SEQ ID NO: 201465 - DNA, 15 bp, Homo sapiens
gagtaaacatacaga

SEQ ID NO: 201466 - DNA, 15 bp, Homo sapiens
agagtaaacatacag

SEQ ID NO: 201467 - DNA, 15 bp, Homo sapiens
cagagtaaacataca

SEQ ID NO: 201468 - DNA, 15 bp, Homo sapiens
acagagtaaacatac

SEQ ID NO: 201469 - DNA, 15 bp, Homo sapiens
aacagagtaaacata

SEQ ID NO: 201470 - DNA, 15 bp, Homo sapiens
caacagagtaaacat

SEQ ID NO: 201471 - DNA, 15 bp, Homo sapiens
tcaacagagtaaaca

SEQ ID NO: 201472 - DNA, 15 bp, Homo sapiens
atcaacagagtaaac

SEQ ID NO: 201473 - DNA, 15 bp, Homo sapiens
tatcaacagagtaaa

SEQ ID NO: 201474 - DNA, 15 bp, Homo sapiens
ctatcaacagagtaa

SEQ ID NO: 201475 - DNA, 15 bp, Homo sapiens
actatcaacagagta

SEQ ID NO: 201476 - DNA, 15 bp, Homo sapiens
aactatcaacagagt

SEQ ID NO: 201477 - DNA, 15 bp, Homo sapiens
aaactatcaacagag

SEQ ID NO: 201478 - DNA, 15 bp, Homo sapiens
gaaactatcaacaga

SEQ ID NO: 201479 - DNA, 15 bp, Homo sapiens
agaaactatcaacag

SEQ ID NO: 201480 - DNA, 15 bp, Homo sapiens
aagaaactatcaaca

SEQ ID NO: 201481 - DNA, 15 bp, Homo sapiens
aaagaaactatcaac

SEQ ID NO: 201482 - DNA, 15 bp, Homo sapiens
aaaagaaactatcaa

SEQ ID NO: 201483 - DNA, 15 bp, Homo sapiens
caaaagaaactatca

SEQ ID NO: 201484 - DNA, 15 bp, Homo sapiens
gcaaaagaaactatc

SEQ ID NO: 201485 - DNA, 15 bp, Homo sapiens
agcaaaagaaactat

SEQ ID NO: 201486 - DNA, 15 bp, Homo sapiens
acagcaaaagaaact

SEQ ID NO: 201487 - DNA, 15 bp, Homo sapiens
agcttctgcacagca

SEQ ID NO: 201488 - DNA, 15 bp, Homo sapiens
gagcttctgcacagc

SEQ ID NO: 201489 - DNA, 15 bp, Homo sapiens
agagcttctgcacag

SEQ ID NO: 201490 - DNA, 15 bp, Homo sapiens
aagagcttctgcaca

SEQ ID NO: 201491 - DNA, 15 bp, Homo sapiens
aaagagcttctgcac

SEQ ID NO: 201492 - DNA, 15 bp, Homo sapiens
gctaaagagcttctg

SEQ ID NO: 201493 - DNA, 15 bp, Homo sapiens
agctaaagagcttct

SEQ ID NO: 201494 - DNA, 15 bp, Homo sapiens
aagctaaagagcttc

SEQ ID NO: 201495 - DNA, 15 bp, Homo sapiens
taagctaaagagctt

SEQ ID NO: 201496 - DNA, 15 bp, Homo sapiens
ttaagctaaagagct

SEQ ID NO: 201497 - DNA, 15 bp, Homo sapiens
attaagctaaagagc

SEQ ID NO: 201498 - DNA, 15 bp, Homo sapiens
aattaagctaaagag

SEQ ID NO: 201499 - DNA, 15 bp, Homo sapiens
taattaagctaaaga

SEQ ID NO: 201500 - DNA, 15 bp, Homo sapiens
ctaattaagctaaag

SEQ ID NO: 201501 - DNA, 15 bp, Homo sapiens
tctaattaagctaaa

SEQ ID NO: 201502 - DNA, 15 bp, Homo sapiens
atctaattaagctaa

SEQ ID NO: 201503 - DNA, 15 bp, Homo sapiens
gatctaattaagcta

SEQ ID NO: 201504 - DNA, 15 bp, Homo sapiens
ggatctaattaagct

SEQ ID NO: 201505 - DNA, 15 bp, Homo sapiens
gggatctaattaagc

SEQ ID NO: 201506 - DNA, 15 bp, Homo sapiens
tgggatctaattaag

SEQ ID NO: 201507 - DNA, 15 bp, Homo sapiens
atgggatctaattaa

SEQ ID NO: 201508 - DNA, 15 bp, Homo sapiens
aatgggatctaatta

SEQ ID NO: 201509 - DNA, 15 bp, Homo sapiens
aaatgggatctaatt

SEQ ID NO: 201510 - DNA, 15 bp, Homo sapiens
taaatgggatctaat

SEQ ID NO: 201511 - DNA, 15 bp, Homo sapiens
ataaatgggatctaa

SEQ ID NO: 201512 - DNA, 15 bp, Homo sapiens
gataaatgggatcta

SEQ ID NO: 201513 - DNA, 15 bp, Homo sapiens
tgataaatgggatct

SEQ ID NO: 201514 - DNA, 15 bp, Homo sapiens
ttgataaatgggatc

SEQ ID NO: 201515 - DNA, 15 bp, Homo sapiens
tttgataaatgggat

SEQ ID NO: 201516 - DNA, 15 bp, Homo sapiens
atttgataaatggga

SEQ ID NO: 201517 - DNA, 15 bp, Homo sapiens
aatttgataaatggg

SEQ ID NO: 201518 - DNA, 15 bp, Homo sapiens
aaatttgataaatgg

SEQ ID NO: 201519 - DNA, 15 bp, Homo sapiens
aaaatttgataaatg

SEQ ID NO: 201520 - DNA, 15 bp, Homo sapiens
aaaaatttgataaat

SEQ ID NO: 201521 - DNA, 15 bp, Homo sapiens
caaaaatttgataaa

SEQ ID NO: 201522 - DNA, 15 bp, Homo sapiens
gcaaaaatttgataa

SEQ ID NO: 201523 - DNA, 15 bp, Homo sapiens
ggcaaaaatttgata

SEQ ID NO: 201524 - DNA, 15 bp, Homo sapiens
aggcaaaaatttgat

SEQ ID NO: 201525 - DNA, 15 bp, Homo sapiens
aaggcaaaaatttga

SEQ ID NO: 201526 - DNA, 15 bp, Homo sapiens
aaaggcaaaaatttg

SEQ ID NO: 201527 - DNA, 15 bp, Homo sapiens
caaaggcaaaaattt

SEQ ID NO: 201528 - DNA, 15 bp, Homo sapiens
acaaaggcaaaaatt

SEQ ID NO: 201529 - DNA, 15 bp, Homo sapiens
aacaaaggcaaaaat

SEQ ID NO: 201530 - DNA, 15 bp, Homo sapiens
caacaaaggcaaaaa

SEQ ID NO: 201531 - DNA, 15 bp, Homo sapiens
gcaacaaaggcaaaa

SEQ ID NO: 201532 - DNA, 15 bp, Homo sapiens
tgcaacaaaggcaaa

SEQ ID NO: 201533 - DNA, 15 bp, Homo sapiens
ctgcaacaaaggcaa

SEQ ID NO: 201534 - DNA, 15 bp, Homo sapiens
actgcaacaaaggca

SEQ ID NO: 201535 - DNA, 15 bp, Homo sapiens
aactgcaacaaaggc

SEQ ID NO: 201536 - DNA, 15 bp, Homo sapiens
caactgcaacaaagg

SEQ ID NO: 201537 - DNA, 15 bp, Homo sapiens
gcaactgcaacaaag

SEQ ID NO: 201538 - DNA, 15 bp, Homo sapiens
agcaactgcaacaaa

SEQ ID NO: 201539 - DNA, 15 bp, Homo sapiens
aagcaactgcaacaa

SEQ ID NO: 201540 - DNA, 15 bp, Homo sapiens
aaagcaactgcaaca

SEQ ID NO: 201541 - DNA, 15 bp, Homo sapiens
aaaagcaactgcaac

SEQ ID NO: 201542 - DNA, 15 bp, Homo sapiens
caaaagcaactgcaa

SEQ ID NO: 201543 - DNA, 15 bp, Homo sapiens
ccaaaagcaactgca

SEQ ID NO: 201544 - DNA, 15 bp, Homo sapiens
accaaaagcaactgc

SEQ ID NO: 201545 - DNA, 15 bp, Homo sapiens
caccaaaagcaactg

SEQ ID NO: 201546 - DNA, 15 bp, Homo sapiens
acaccaaaagcaact

SEQ ID NO: 201547 - DNA, 15 bp, Homo sapiens
gacaccaaaagcaac

SEQ ID NO: 201548 - DNA, 15 bp, Homo sapiens
agacaccaaaagcaa

SEQ ID NO: 201549 - DNA, 15 bp, Homo sapiens
aagacaccaaaagca

SEQ ID NO: 201550 - DNA, 15 bp, Homo sapiens
gaagacaccaaaagc

SEQ ID NO: 201551 - DNA, 15 bp, Homo sapiens
tgaagacaccaaaag

SEQ ID NO: 201552 - DNA, 15 bp, Homo sapiens
atgaagacaccaaaa

SEQ ID NO: 201553 - DNA, 15 bp, Homo sapiens
gatgaagacaccaaa

SEQ ID NO: 201554 - DNA, 15 bp, Homo sapiens
tgatgaagacaccaa

SEQ ID NO: 201555 - DNA, 15 bp, Homo sapiens
atgatgaagacacca

SEQ ID NO: 201556 - DNA, 15 bp, Homo sapiens
catgatgaagacacc

SEQ ID NO: 201557 - DNA, 15 bp, Homo sapiens
tcatgatgaagacac

SEQ ID NO: 201558 - DNA, 15 bp, Homo sapiens
ttcatgatgaagaca

SEQ ID NO: 201559 - DNA, 15 bp, Homo sapiens
tttcatgatgaagac

SEQ ID NO: 201560 - DNA, 15 bp, Homo sapiens
atttcatgatgaaga

SEQ ID NO: 201561 - DNA, 15 bp, Homo sapiens
aatttcatgatgaag

SEQ ID NO: 201562 - DNA, 15 bp, Homo sapiens
aaatttcatgatgaa

SEQ ID NO: 201563 - DNA, 15 bp, Homo sapiens
aaaatttcatgatga

SEQ ID NO: 201564 - DNA, 15 bp, Homo sapiens
aaaaatttcatgatg

SEQ ID NO: 201565 - DNA, 15 bp, Homo sapiens
caaaaatttcatgat

SEQ ID NO: 201566 - DNA, 15 bp, Homo sapiens
gcaaaaatttcatga

SEQ ID NO: 201567 - DNA, 15 bp, Homo sapiens
ggcaaaaatttcatg

SEQ ID NO: 201568 - DNA, 15 bp, Homo sapiens
gggcaaaaatttcat

SEQ ID NO: 201569 - DNA, 15 bp, Homo sapiens
tgggcaaaaatttca

SEQ ID NO: 201570 - DNA, 15 bp, Homo sapiens
atgggcaaaaatttc

SEQ ID NO: 201571 - DNA, 15 bp, Homo sapiens
aatgggcaaaaattt

SEQ ID NO: 201572 - DNA, 15 bp, Homo sapiens
gaatgggcaaaaatt

SEQ ID NO: 201573 - DNA, 15 bp, Homo sapiens
ggaatgggcaaaaat

SEQ ID NO: 201574 - DNA, 15 bp, Homo sapiens
aggaatgggcaaaaa

SEQ ID NO: 201575 - DNA, 15 bp, Homo sapiens
taggaatgggcaaaa

SEQ ID NO: 201576 - DNA, 15 bp, Homo sapiens
ataggaatgggcaaa

SEQ ID NO: 201577 - DNA, 15 bp, Homo sapiens
cataggaatgggcaa

SEQ ID NO: 201578 - DNA, 15 bp, Homo sapiens
acataggaatgggca

SEQ ID NO: 201579 - DNA, 15 bp, Homo sapiens
cacataggaatgggc

SEQ ID NO: 201580 - DNA, 15 bp, Homo sapiens
acacataggaatggg

SEQ ID NO: 201581 - DNA, 15 bp, Homo sapiens
tacacataggaatgg

SEQ ID NO: 201582 - DNA, 15 bp, Homo sapiens
ctacacataggaatg

SEQ ID NO: 201583 - DNA, 15 bp, Homo sapiens
tctacacataggaat

SEQ ID NO: 201584 - DNA, 15 bp, Homo sapiens
ttctacacataggaa

SEQ ID NO: 201585 - DNA, 15 bp, Homo sapiens
attctacacatagga

SEQ ID NO: 201586 - DNA, 15 bp, Homo sapiens
cattctacacatagg

SEQ ID NO: 201587 - DNA, 15 bp, Homo sapiens
ccattctacacatag

SEQ ID NO: 201588 - DNA, 15 bp, Homo sapiens
accattctacacata

SEQ ID NO: 201589 - DNA, 15 bp, Homo sapiens
taccattctacacat

SEQ ID NO: 201590 - DNA, 15 bp, Homo sapiens
ataccattctacaca

SEQ ID NO: 201591 - DNA, 15 bp, Homo sapiens
aataccattctacac

SEQ ID NO: 201592 - DNA, 15 bp, Homo sapiens
caataccattctaca

SEQ ID NO: 201593 - DNA, 15 bp, Homo sapiens
gcaataccattctac

SEQ ID NO: 201594 - DNA, 15 bp, Homo sapiens
ggcaataccattcta

SEQ ID NO: 201595 - DNA, 15 bp, Homo sapiens
aggcaataccattct

SEQ ID NO: 201596 - DNA, 15 bp, Homo sapiens
gaggcaataccattc

SEQ ID NO: 201597 - DNA, 15 bp, Homo sapiens
tgaggcaataccatt

SEQ ID NO: 201598 - DNA, 15 bp, Homo sapiens
ctgaggcaataccat

SEQ ID NO: 201599 - DNA, 15 bp, Homo sapiens
actgaggcaatacca

SEQ ID NO: 201600 - DNA, 15 bp, Homo sapiens
aactgaggcaatacc

SEQ ID NO: 201601 - DNA, 15 bp, Homo sapiens
caactgaggcaatac

SEQ ID NO: 201602 - DNA, 15 bp, Homo sapiens
acaactgaggcaata

SEQ ID NO: 201603 - DNA, 15 bp, Homo sapiens
gacaactgaggcaat

SEQ ID NO: 201604 - DNA, 15 bp, Homo sapiens
agacaactgaggcaa

SEQ ID NO: 201605 - DNA, 15 bp, Homo sapiens
aagacaactgaggca

SEQ ID NO: 201606 - DNA, 15 bp, Homo sapiens
aaagacaactgaggc

SEQ ID NO: 201607 - DNA, 15 bp, Homo sapiens
gaaagacaactgagg

SEQ ID NO: 201608 - DNA, 15 bp, Homo sapiens
tgaaagacaactgag

SEQ ID NO: 201609 - DNA, 15 bp, Homo sapiens
ctgaaagacaactga

SEQ ID NO: 201610 - DNA, 15 bp, Homo sapiens
cctgaaagacaactg

SEQ ID NO: 201611 - DNA, 15 bp, Homo sapiens
ccctgaaagacaact

SEQ ID NO: 201612 - DNA, 15 bp, Homo sapiens
accctgaaagacaac

SEQ ID NO: 201613 - DNA, 15 bp, Homo sapiens
aaccctgaaagacaa

SEQ ID NO: 201614 - DNA, 15 bp, Homo sapiens
aaaccctgaaagaca

SEQ ID NO: 201615 - DNA, 15 bp, Homo sapiens
aaaaccctgaaagac

SEQ ID NO: 201616 - DNA, 15 bp, Homo sapiens
aaaaaccctgaaaga

SEQ ID NO: 201617 - DNA, 15 bp, Homo sapiens
aaaaaaccctgaaag

SEQ ID NO: 201618 - DNA, 15 bp, Homo sapiens
aaaaaaaccctgaaa

SEQ ID NO: 201619 - DNA, 15 bp, Homo sapiens
aaaaaaaaccctgaa

SEQ ID NO: 201620 - DNA, 15 bp, Homo sapiens
aaaaaaaaaccctga

SEQ ID NO: 201621 - DNA, 15 bp, Homo sapiens
aaaaaaaaaaccctg

SEQ ID NO: 201622 - DNA, 15 bp, Homo sapiens
aaaaaaaaaaaccct

SEQ ID NO: 201623 - DNA, 15 bp, Homo sapiens
taaaaaaaaaaaccc

SEQ ID NO: 201624 - DNA, 15 bp, Homo sapiens
ataaaaaaaaaaacc

SEQ ID NO: 201625 - DNA, 15 bp, Homo sapiens
tataaaaaaaaaaac

SEQ ID NO: 201626 - DNA, 15 bp, Homo sapiens
ctataaaaaaaaaaa

SEQ ID NO: 201627 - DNA, 15 bp, Homo sapiens
actataaaaaaaaaa

SEQ ID NO: 201628 - DNA, 15 bp, Homo sapiens
aactataaaaaaaaa

SEQ ID NO: 201629 - DNA, 15 bp, Homo sapiens
aaactataaaaaaaa

SEQ ID NO: 201630 - DNA, 15 bp, Homo sapiens
aaaactataaaaaaa

SEQ ID NO: 201631 - DNA, 15 bp, Homo sapiens
caaaactataaaaaa

SEQ ID NO: 201632 - DNA, 15 bp, Homo sapiens
ccaaaactataaaaa

SEQ ID NO: 201633 - DNA, 15 bp, Homo sapiens
cccaaaactataaaa

SEQ ID NO: 201634 - DNA, 15 bp, Homo sapiens
acccaaaactataaa

SEQ ID NO: 201635 - DNA, 15 bp, Homo sapiens
aacccaaaactataa

SEQ ID NO: 201636 - DNA, 15 bp, Homo sapiens
aaacccaaaactata

SEQ ID NO: 201637 - DNA, 15 bp, Homo sapiens
aaaacccaaaactat

SEQ ID NO: 201638 - DNA, 15 bp, Homo sapiens
taaaacccaaaacta

SEQ ID NO: 201639 - DNA, 15 bp, Homo sapiens
gtaaaacccaaaact

SEQ ID NO: 201640 - DNA, 15 bp, Homo sapiens
tgtaaaacccaaaac

SEQ ID NO: 201641 - DNA, 15 bp, Homo sapiens
atgtaaaacccaaaa

SEQ ID NO: 201642 - DNA, 15 bp, Homo sapiens
aatgtaaaacccaaa

SEQ ID NO: 201643 - DNA, 15 bp, Homo sapiens
aaatgtaaaacccaa

SEQ ID NO: 201644 - DNA, 15 bp, Homo sapiens
taaatgtaaaaccca

SEQ ID NO: 201645 - DNA, 15 bp, Homo sapiens
ttaaatgtaaaaccc

SEQ ID NO: 201646 - DNA, 15 bp, Homo sapiens
cttaaatgtaaaacc

SEQ ID NO: 201647 - DNA, 15 bp, Homo sapiens
acttaaatgtaaaac

SEQ ID NO: 201648 - DNA, 15 bp, Homo sapiens
tacttaaatgtaaaa

SEQ ID NO: 201649 - DNA, 15 bp, Homo sapiens
atacttaaatgtaaa

SEQ ID NO: 201650 - DNA, 15 bp, Homo sapiens
aatacttaaatgtaa

SEQ ID NO: 201651 - DNA, 15 bp, Homo sapiens
aaatacttaaatgta

SEQ ID NO: 201652 - DNA, 15 bp, Homo sapiens
taaatacttaaatgt

SEQ ID NO: 201653 - DNA, 15 bp, Homo sapiens
ttaaatacttaaatg

SEQ ID NO: 201654 - DNA, 15 bp, Homo sapiens
attaaatacttaaat

SEQ ID NO: 201655 - DNA, 15 bp, Homo sapiens
gattaaatacttaaa

SEQ ID NO: 201656 - DNA, 15 bp, Homo sapiens
ggattaaatacttaa

SEQ ID NO: 201657 - DNA, 15 bp, Homo sapiens
tggattaaatactta

SEQ ID NO: 201658 - DNA, 15 bp, Homo sapiens
atggattaaatactt

SEQ ID NO: 201659 - DNA, 15 bp, Homo sapiens
aatggattaaatact

SEQ ID NO: 201660 - DNA, 15 bp, Homo sapiens
aaatggattaaatac

SEQ ID NO: 201661 - DNA, 15 bp, Homo sapiens
aaaatggattaaata

SEQ ID NO: 201662 - DNA, 15 bp, Homo sapiens
caaaatggattaaat

SEQ ID NO: 201663 - DNA, 15 bp, Homo sapiens
tcaaaatggattaaa

SEQ ID NO: 201664 - DNA, 15 bp, Homo sapiens
ctcaaaatggattaa

SEQ ID NO: 201665 - DNA, 15 bp, Homo sapiens
actcaaaatggatta

SEQ ID NO: 201666 - DNA, 15 bp, Homo sapiens
aactcaaaatggatt

SEQ ID NO: 201667 - DNA, 15 bp, Homo sapiens
aaactcaaaatggat

SEQ ID NO: 201668 - DNA, 15 bp, Homo sapiens
taaactcaaaatgga

SEQ ID NO: 201669 - DNA, 15 bp, Homo sapiens
ataaactcaaaatgg

SEQ ID NO: 201670 - DNA, 15 bp, Homo sapiens
aataaactcaaaatg

SEQ ID NO: 201671 - DNA, 15 bp, Homo sapiens
aaataaactcaaaat

SEQ ID NO: 201672 - DNA, 15 bp, Homo sapiens
gaaaaataaactcaa

SEQ ID NO: 201673 - DNA, 15 bp, Homo sapiens
agaaaaataaactca

SEQ ID NO: 201674 - DNA, 15 bp, Homo sapiens
tagaaaaataaactc

SEQ ID NO: 201675 - DNA, 15 bp, Homo sapiens
atagaaaaataaact

SEQ ID NO: 201676 - DNA, 15 bp, Homo sapiens
tatagaaaaataaac

SEQ ID NO: 201677 - DNA, 15 bp, Homo sapiens
atatagaaaaataaa

SEQ ID NO: 201678 - DNA, 15 bp, Homo sapiens
catatagaaaaataa

SEQ ID NO: 201679 - DNA, 15 bp, Homo sapiens
tcatatagaaaaata

SEQ ID NO: 201680 - DNA, 15 bp, Homo sapiens
atcatatagaaaaat

SEQ ID NO: 201681 - DNA, 15 bp, Homo sapiens
tatcatatagaaaaa

SEQ ID NO: 201682 - DNA, 15 bp, Homo sapiens
atatcatatagaaaa

SEQ ID NO: 201683 - DNA, 15 bp, Homo sapiens
tatatcatatagaaa

SEQ ID NO: 201684 - DNA, 15 bp, Homo sapiens
ttatatcatatagaa

SEQ ID NO: 201685 - DNA, 15 bp, Homo sapiens
cttatatcatataga

SEQ ID NO: 201686 - DNA, 15 bp, Homo sapiens
ccttatatcatatag

SEQ ID NO: 201687 - DNA, 15 bp, Homo sapiens
tccttatatcatata

SEQ ID NO: 201688 - DNA, 15 bp, Homo sapiens
ttccttatatcatat

SEQ ID NO: 201689 - DNA, 15 bp, Homo sapiens
cttccttatatcata

SEQ ID NO: 201690 - DNA, 15 bp, Homo sapiens
tcttccttatatcat

SEQ ID NO: 201691 - DNA, 15 bp, Homo sapiens
ctcttccttatatca

SEQ ID NO: 201692 - DNA, 15 bp, Homo sapiens
cctcttccttatatc

SEQ ID NO: 201693 - DNA, 15 bp, Homo sapiens
acctcttccttatat

SEQ ID NO: 201694 - DNA, 15 bp, Homo sapiens
gacctcttccttata

SEQ ID NO: 201695 - DNA, 15 bp, Homo sapiens
ggacctcttccttat

SEQ ID NO: 201696 - DNA, 15 bp, Homo sapiens
tggacctcttcctta

SEQ ID NO: 201697 - DNA, 15 bp, Homo sapiens
ctggacctcttcctt

SEQ ID NO: 201698 - DNA, 15 bp, Homo sapiens
actggacctcttcct

SEQ ID NO: 201699 - DNA, 15 bp, Homo sapiens
aactggacctcttcc

SEQ ID NO: 201700 - DNA, 15 bp, Homo sapiens
aaactggacctcttc

SEQ ID NO: 201701 - DNA, 15 bp, Homo sapiens
gaaactggacctctt

SEQ ID NO: 201702 - DNA, 15 bp, Homo sapiens
tgaaactggacctct

SEQ ID NO: 201703 - DNA, 15 bp, Homo sapiens
ttgaaactggacctc

SEQ ID NO: 201704 - DNA, 15 bp, Homo sapiens
attgaaactggacct

SEQ ID NO: 201705 - DNA, 15 bp, Homo sapiens
cattgaaactggacc

SEQ ID NO: 201706 - DNA, 15 bp, Homo sapiens
acattgaaactggac

SEQ ID NO: 201707 - DNA, 15 bp, Homo sapiens
aacattgaaactgga

SEQ ID NO: 201708 - DNA, 15 bp, Homo sapiens
aaacattgaaactgg

SEQ ID NO: 201709 - DNA, 15 bp, Homo sapiens
aaaacattgaaactg

SEQ ID NO: 201710 - DNA, 15 bp, Homo sapiens
caaaacattgaaact

SEQ ID NO: 201711 - DNA, 15 bp, Homo sapiens
gcaaaacattgaaac

SEQ ID NO: 201712 - DNA, 15 bp, Homo sapiens
tgcaaaacattgaaa

SEQ ID NO: 201713 - DNA, 15 bp, Homo sapiens
atgcaaaacattgaa

SEQ ID NO: 201714 - DNA, 15 bp, Homo sapiens
tatgcaaaacattga

SEQ ID NO: 201715 - DNA, 15 bp, Homo sapiens
atatgcaaaacattg

SEQ ID NO: 201716 - DNA, 15 bp, Homo sapiens
catatgcaaaacatt

SEQ ID NO: 201717 - DNA, 15 bp, Homo sapiens
ccatatgcaaaacat

SEQ ID NO: 201718 - DNA, 15 bp, Homo sapiens
gccatatgcaaaaca

SEQ ID NO: 201719 - DNA, 15 bp, Homo sapiens
agccatatgcaaaac

SEQ ID NO: 201720 - DNA, 15 bp, Homo sapiens
tagccatatgcaaaa

SEQ ID NO: 201721 - DNA, 15 bp, Homo sapiens
ctagccatatgcaaa

SEQ ID NO: 201722 - DNA, 15 bp, Homo sapiens
gctagccatatgcaa

SEQ ID NO: 201723 - DNA, 15 bp, Homo sapiens
tggctagccatatgc

SEQ ID NO: 201724 - DNA, 15 bp, Homo sapiens
ctggctagccatatg

SEQ ID NO: 201725 - DNA, 15 bp, Homo sapiens
actggctagccatat

SEQ ID NO: 201726 - DNA, 15 bp, Homo sapiens
aactggctagccata

SEQ ID NO: 201727 - DNA, 15 bp, Homo sapiens
taactggctagccat

SEQ ID NO: 201728 - DNA, 15 bp, Homo sapiens
gtaactggctagcca

SEQ ID NO: 201729 - DNA, 15 bp, Homo sapiens
ggtaactggctagcc

SEQ ID NO: 201730 - DNA, 15 bp, Homo sapiens
gggtaactggctagc

SEQ ID NO: 201731 - DNA, 15 bp, Homo sapiens
tgggtaactggctag

SEQ ID NO: 201732 - DNA, 15 bp, Homo sapiens
ctgggtaactggcta

SEQ ID NO: 201733 - DNA, 15 bp, Homo sapiens
gctgggtaactggct

SEQ ID NO: 201734 - DNA, 15 bp, Homo sapiens
tgctgggtaactggc

SEQ ID NO: 201735 - DNA, 15 bp, Homo sapiens
ttgctgggtaactgg

SEQ ID NO: 201736 - DNA, 15 bp, Homo sapiens
gttgctgggtaactg

SEQ ID NO: 201737 - DNA, 15 bp, Homo sapiens
cgttgctgggtaact

SEQ ID NO: 201738 - DNA, 15 bp, Homo sapiens
acgttgctgggtaac

SEQ ID NO: 201739 - DNA, 15 bp, Homo sapiens
aacgttgctgggtaa

SEQ ID NO: 201740 - DNA, 15 bp, Homo sapiens
aaacgttgctgggta

SEQ ID NO: 201741 - DNA, 15 bp, Homo sapiens
taaacgttgctgggt

SEQ ID NO: 201742 - DNA, 15 bp, Homo sapiens
ataaacgttgctggg

SEQ ID NO: 201743 - DNA, 15 bp, Homo sapiens
aataaacgttgctgg

SEQ ID NO: 201744 - DNA, 15 bp, Homo sapiens
caataaacgttgctg

SEQ ID NO: 201745 - DNA, 15 bp, Homo sapiens
tcaataaacgttgct

SEQ ID NO: 201746 - DNA, 15 bp, Homo sapiens
ttcaataaacgttgc

SEQ ID NO: 201747 - DNA, 15 bp, Homo sapiens
attcaataaacgttg

SEQ ID NO: 201748 - DNA, 15 bp, Homo sapiens
tattcaataaacgtt

SEQ ID NO: 201749 - DNA, 15 bp, Homo sapiens
ctattcaataaacgt

SEQ ID NO: 201750 - DNA, 15 bp, Homo sapiens
cctattcaataaacg

SEQ ID NO: 201751 - DNA, 15 bp, Homo sapiens
ccctattcaataaac

SEQ ID NO: 201752 - DNA, 15 bp, Homo sapiens
tccctattcaataaa

SEQ ID NO: 201753 - DNA, 15 bp, Homo sapiens
ttccctattcaataa

SEQ ID NO: 201754 - DNA, 15 bp, Homo sapiens
attccctattcaata

SEQ ID NO: 201755 - DNA, 15 bp, Homo sapiens
gattccctattcaat

SEQ ID NO: 201756 - DNA, 15 bp, Homo sapiens
tgattccctattcaa

SEQ ID NO: 201757 - DNA, 15 bp, Homo sapiens
atgattccctattca

SEQ ID NO: 201758 - DNA, 15 bp, Homo sapiens
aatgattccctattc

SEQ ID NO: 201759 - DNA, 15 bp, Homo sapiens
aaatgattccctatt

SEQ ID NO: 201760 - DNA, 15 bp, Homo sapiens
gaaatgattccctat

SEQ ID NO: 201761 - DNA, 15 bp, Homo sapiens
ggaaatgattcccta

SEQ ID NO: 201762 - DNA, 15 bp, Homo sapiens
gggaaatgattccct

SEQ ID NO: 201763 - DNA, 15 bp, Homo sapiens
ggggaaatgattccc

SEQ ID NO: 201764 - DNA, 15 bp, Homo sapiens
tggggaaatgattcc

SEQ ID NO: 201765 - DNA, 15 bp, Homo sapiens
atggggaaatgattc

SEQ ID NO: 201766 - DNA, 15 bp, Homo sapiens
aatggggaaatgatt

SEQ ID NO: 201767 - DNA, 15 bp, Homo sapiens
caatggggaaatgat

SEQ ID NO: 201768 - DNA, 15 bp, Homo sapiens
gcaatggggaaatga

SEQ ID NO: 201769 - DNA, 15 bp, Homo sapiens
agcaatggggaaatg

SEQ ID NO: 201770 - DNA, 15 bp, Homo sapiens
aagcaatggggaaat

SEQ ID NO: 201771 - DNA, 15 bp, Homo sapiens
taagcaatggggaaa

SEQ ID NO: 201772 - DNA, 15 bp, Homo sapiens
ataagcaatggggaa

SEQ ID NO: 201773 - DNA, 15 bp, Homo sapiens
aataagcaatgggga

SEQ ID NO: 201774 - DNA, 15 bp, Homo sapiens
aaataagcaatgggg

SEQ ID NO: 201775 - DNA, 15 bp, Homo sapiens
aaaataagcaatggg

SEQ ID NO: 201776 - DNA, 15 bp, Homo sapiens
aaaaataagcaatgg

SEQ ID NO: 201777 - DNA, 15 bp, Homo sapiens
caaaaataagcaatg

SEQ ID NO: 201778 - DNA, 15 bp, Homo sapiens
acaaaaataagcaat

SEQ ID NO: 201779 - DNA, 15 bp, Homo sapiens
gacaaaaataagcaa

SEQ ID NO: 201780 - DNA, 15 bp, Homo sapiens
tgacaaaaataagca

SEQ ID NO: 201781 - DNA, 15 bp, Homo sapiens
ctgacaaaaataagc

SEQ ID NO: 201782 - DNA, 15 bp, Homo sapiens
gctgacaaaaataag

SEQ ID NO: 201783 - DNA, 15 bp, Homo sapiens
agctgacaaaaataa

SEQ ID NO: 201784 - DNA, 15 bp, Homo sapiens
aagctgacaaaaata

SEQ ID NO: 201785 - DNA, 15 bp, Homo sapiens
aaagctgacaaaaat

SEQ ID NO: 201786 - DNA, 15 bp, Homo sapiens
caaagctgacaaaaa

SEQ ID NO: 201787 - DNA, 15 bp, Homo sapiens
acaaagctgacaaaa

SEQ ID NO: 201788 - DNA, 15 bp, Homo sapiens
gacaaagctgacaaa

SEQ ID NO: 201789 - DNA, 15 bp, Homo sapiens
tgacaaagctgacaa

SEQ ID NO: 201790 - DNA, 15 bp, Homo sapiens
ttgacaaagctgaca

SEQ ID NO: 201791 - DNA, 15 bp, Homo sapiens
tttgacaaagctgac

SEQ ID NO: 201792 - DNA, 15 bp, Homo sapiens
ctttgacaaagctga

SEQ ID NO: 201793 - DNA, 15 bp, Homo sapiens
tctttgacaaagctg

SEQ ID NO: 201794 - DNA, 15 bp, Homo sapiens
atctttgacaaagct

SEQ ID NO: 201795 - DNA, 15 bp, Homo sapiens
gatctttgacaaagc

SEQ ID NO: 201796 - DNA, 15 bp, Homo sapiens
tgatctttgacaaag

SEQ ID NO: 201797 - DNA, 15 bp, Homo sapiens
atgatctttgacaaa

SEQ ID NO: 201798 - DNA, 15 bp, Homo sapiens
tatgatctttgacaa

SEQ ID NO: 201799 - DNA, 15 bp, Homo sapiens
atatgatctttgaca

SEQ ID NO: 201800 - DNA, 15 bp, Homo sapiens
tatatgatctttgac

SEQ ID NO: 201801 - DNA, 15 bp, Homo sapiens
actatatgatctttg

SEQ ID NO: 201802 - DNA, 15 bp, Homo sapiens
aactatatgatcttt

SEQ ID NO: 201803 - DNA, 15 bp, Homo sapiens
caactatatgatctt

SEQ ID NO: 201804 - DNA, 15 bp, Homo sapiens
acaactatatgatct

SEQ ID NO: 201805 - DNA, 15 bp, Homo sapiens
tacaactatatgatc

SEQ ID NO: 201806 - DNA, 15 bp, Homo sapiens
ctacaactatatgat

SEQ ID NO: 201807 - DNA, 15 bp, Homo sapiens
gctacaactatatga

SEQ ID NO: 201808 - DNA, 15 bp, Homo sapiens
ggctacaactatatg

SEQ ID NO: 201809 - DNA, 15 bp, Homo sapiens
tggctacaactatat

SEQ ID NO: 201810 - DNA, 15 bp, Homo sapiens
atggctacaactata

SEQ ID NO: 201811 - DNA, 15 bp, Homo sapiens
tatggctacaactat

SEQ ID NO: 201812 - DNA, 15 bp, Homo sapiens
gtatggctacaacta

SEQ ID NO: 201813 - DNA, 15 bp, Homo sapiens
tgtatggctacaact

SEQ ID NO: 201814 - DNA, 15 bp, Homo sapiens
ctgtatggctacaac

SEQ ID NO: 201815 - DNA, 15 bp, Homo sapiens
gctgtatggctacaa

SEQ ID NO: 201816 - DNA, 15 bp, Homo sapiens
ggctgtatggctaca

SEQ ID NO: 201817 - DNA, 15 bp, Homo sapiens
aggctgtatggctac

SEQ ID NO: 201818 - DNA, 15 bp, Homo sapiens
aaggctgtatggcta

SEQ ID NO: 201819 - DNA, 15 bp, Homo sapiens
taaggctgtatggct

SEQ ID NO: 201820 - DNA, 15 bp, Homo sapiens
ataaggctgtatggc

SEQ ID NO: 201821 - DNA, 15 bp, Homo sapiens
aataaggctgtatgg

SEQ ID NO: 201822 - DNA, 15 bp, Homo sapiens
aaataaggctgtatg

SEQ ID NO: 201823 - DNA, 15 bp, Homo sapiens
gaaataaggctgtat

SEQ ID NO: 201824 - DNA, 15 bp, Homo sapiens
agaaataaggctgta

SEQ ID NO: 201825 - DNA, 15 bp, Homo sapiens
cagaaataaggctgt

SEQ ID NO: 201826 - DNA, 15 bp, Homo sapiens
tcagaaataaggctg

SEQ ID NO: 201827 - DNA, 15 bp, Homo sapiens
ctcagaaataaggct

SEQ ID NO: 201828 - DNA, 15 bp, Homo sapiens
actcagaaataaggc

SEQ ID NO: 201829 - DNA, 15 bp, Homo sapiens
aactcagaaataagg

SEQ ID NO: 201830 - DNA, 15 bp, Homo sapiens
gaactcagaaataag

SEQ ID NO: 201831 - DNA, 15 bp, Homo sapiens
agaactcagaaataa

SEQ ID NO: 201832 - DNA, 15 bp, Homo sapiens
gagaactcagaaata

SEQ ID NO: 201833 - DNA, 15 bp, Homo sapiens
agagaactcagaaat

SEQ ID NO: 201834 - DNA, 15 bp, Homo sapiens
cagagaactcagaaa

SEQ ID NO: 201835 - DNA, 15 bp, Homo sapiens
acagagaactcagaa

SEQ ID NO: 201836 - DNA, 15 bp, Homo sapiens
aacagagaactcaga

SEQ ID NO: 201837 - DNA, 15 bp, Homo sapiens
gaacagagaactcag

SEQ ID NO: 201838 - DNA, 15 bp, Homo sapiens
agaacagagaactca

SEQ ID NO: 201839 - DNA, 15 bp, Homo sapiens
cagaacagagaactc

SEQ ID NO: 201840 - DNA, 15 bp, Homo sapiens
acagaacagagaact

SEQ ID NO: 201841 - DNA, 15 bp, Homo sapiens
aacagaacagagaac

SEQ ID NO: 201842 - DNA, 15 bp, Homo sapiens
gaacagaacagagaa

SEQ ID NO: 201843 - DNA, 15 bp, Homo sapiens
ggaacagaacagaga

SEQ ID NO: 201844 - DNA, 15 bp, Homo sapiens
catagaccaatggaa

SEQ ID NO: 201845 - DNA, 15 bp, Homo sapiens
acatagaccaatgga

SEQ ID NO: 201846 - DNA, 15 bp, Homo sapiens
cacatagaccaatgg

SEQ ID NO: 201847 - DNA, 15 bp, Homo sapiens
acacatagaccaatg

SEQ ID NO: 201848 - DNA, 15 bp, Homo sapiens
gacacatagaccaat

SEQ ID NO: 201849 - DNA, 15 bp, Homo sapiens
agacacatagaccaa

SEQ ID NO: 201850 - DNA, 15 bp, Homo sapiens
tagacacatagacca

SEQ ID NO: 201851 - DNA, 15 bp, Homo sapiens
atagacacatagacc

SEQ ID NO: 201852 - DNA, 15 bp, Homo sapiens
aatagacacatagac

SEQ ID NO: 201853 - DNA, 15 bp, Homo sapiens
aaatagacacataga

SEQ ID NO: 201854 - DNA, 15 bp, Homo sapiens
aaaatagacacatag

SEQ ID NO: 201855 - DNA, 15 bp, Homo sapiens
aaaaatagacacata

SEQ ID NO: 201856 - DNA, 15 bp, Homo sapiens
taaaaatagacacat

SEQ ID NO: 201857 - DNA, 15 bp, Homo sapiens
ataaaaatagacaca

SEQ ID NO: 201858 - DNA, 15 bp, Homo sapiens
tataaaaatagacac

SEQ ID NO: 201859 - DNA, 15 bp, Homo sapiens
gtataaaaatagaca

SEQ ID NO: 201860 - DNA, 15 bp, Homo sapiens
ggtataaaaatagac

SEQ ID NO: 201861 - DNA, 15 bp, Homo sapiens
tggtataaaaataga

SEQ ID NO: 201862 - DNA, 15 bp, Homo sapiens
ctggtataaaaatag

SEQ ID NO: 201863 - DNA, 15 bp, Homo sapiens
actggtataaaaata

SEQ ID NO: 201864 - DNA, 15 bp, Homo sapiens
tactggtataaaaat

SEQ ID NO: 201865 - DNA, 15 bp, Homo sapiens
cggtactggtataaa

SEQ ID NO: 201866 - DNA, 15 bp, Homo sapiens
acggtactggtataa

SEQ ID NO: 201867 - DNA, 15 bp, Homo sapiens
cacggtactggtata

SEQ ID NO: 201868 - DNA, 15 bp, Homo sapiens
gcacggtactggtat

SEQ ID NO: 201869 - DNA, 15 bp, Homo sapiens
agcacggtactggta

SEQ ID NO: 201870 - DNA, 15 bp, Homo sapiens
cagcacggtactggt

SEQ ID NO: 201871 - DNA, 15 bp, Homo sapiens
acagcacggtactgg

SEQ ID NO: 201872 - DNA, 15 bp, Homo sapiens
aacagcacggtactg

SEQ ID NO: 201873 - DNA, 15 bp, Homo sapiens
aaacagcacggtact

SEQ ID NO: 201874 - DNA, 15 bp, Homo sapiens
aaaacagcacggtac

SEQ ID NO: 201875 - DNA, 15 bp, Homo sapiens
caaaacagcacggta

SEQ ID NO: 201876 - DNA, 15 bp, Homo sapiens
ccaaaacagcacggt

SEQ ID NO: 201877 - DNA, 15 bp, Homo sapiens
accaaaacagcacgg

SEQ ID NO: 201878 - DNA, 15 bp, Homo sapiens
aaccaaaacagcacg

SEQ ID NO: 201879 - DNA, 15 bp, Homo sapiens
taaccaaaacagcac

SEQ ID NO: 201880 - DNA, 15 bp, Homo sapiens
tagtaaccaaaacag

SEQ ID NO: 201881 - DNA, 15 bp, Homo sapiens
atagtaaccaaaaca

SEQ ID NO: 201882 - DNA, 15 bp, Homo sapiens
tatagtaaccaaaac

SEQ ID NO: 201883 - DNA, 15 bp, Homo sapiens
ctatagtaaccaaaa

SEQ ID NO: 201884 - DNA, 15 bp, Homo sapiens
tctatagtaaccaaa

SEQ ID NO: 201885 - DNA, 15 bp, Homo sapiens
gtctatagtaaccaa

SEQ ID NO: 201886 - DNA, 15 bp, Homo sapiens
ggtctatagtaacca

SEQ ID NO: 201887 - DNA, 15 bp, Homo sapiens
aggtctatagtaacc

SEQ ID NO: 201888 - DNA, 15 bp, Homo sapiens
caggtctatagtaac

SEQ ID NO: 201889 - DNA, 15 bp, Homo sapiens
acaggtctatagtaa

SEQ ID NO: 201890 - DNA, 15 bp, Homo sapiens
tacaggtctatagta

SEQ ID NO: 201891 - DNA, 15 bp, Homo sapiens
ctacaggtctatagt

SEQ ID NO: 201892 - DNA, 15 bp, Homo sapiens
actacaggtctatag

SEQ ID NO: 201893 - DNA, 15 bp, Homo sapiens
tactacaggtctata

SEQ ID NO: 201894 - DNA, 15 bp, Homo sapiens
atactacaggtctat

SEQ ID NO: 201895 - DNA, 15 bp, Homo sapiens
tatactacaggtcta

SEQ ID NO: 201896 - DNA, 15 bp, Homo sapiens
ctatactacaggtct

SEQ ID NO: 201897 - DNA, 15 bp, Homo sapiens
actatactacaggtc

SEQ ID NO: 201898 - DNA, 15 bp, Homo sapiens
gactatactacaggt

SEQ ID NO: 201899 - DNA, 15 bp, Homo sapiens
agactatactacagg

SEQ ID NO: 201900 - DNA, 15 bp, Homo sapiens
cagactatactacag

SEQ ID NO: 201901 - DNA, 15 bp, Homo sapiens
tcagactatactaca

SEQ ID NO: 201902 - DNA, 15 bp, Homo sapiens
ttcagactatactac

SEQ ID NO: 201903 - DNA, 15 bp, Homo sapiens
cttcagactatacta

SEQ ID NO: 201904 - DNA, 15 bp, Homo sapiens
acttcagactatact

SEQ ID NO: 201905 - DNA, 15 bp, Homo sapiens
gacttcagactatac

SEQ ID NO: 201906 - DNA, 15 bp, Homo sapiens
tgacttcagactata

SEQ ID NO: 201907 - DNA, 15 bp, Homo sapiens
ctgacttcagactat

SEQ ID NO: 201908 - DNA, 15 bp, Homo sapiens
cctgacttcagacta

SEQ ID NO: 201909 - DNA, 15 bp, Homo sapiens
acctgacttcagact

SEQ ID NO: 201910 - DNA, 15 bp, Homo sapiens
tacctgacttcagac

SEQ ID NO: 201911 - DNA, 15 bp, Homo sapiens
atacctgacttcaga

SEQ ID NO: 201912 - DNA, 15 bp, Homo sapiens
gatacctgacttcag

SEQ ID NO: 201913 - DNA, 15 bp, Homo sapiens
tgatacctgacttca

SEQ ID NO: 201914 - DNA, 15 bp, Homo sapiens
atgatacctgacttc

SEQ ID NO: 201915 - DNA, 15 bp, Homo sapiens
catgatacctgactt

SEQ ID NO: 201916 - DNA, 15 bp, Homo sapiens
tcatgatacctgact

SEQ ID NO: 201917 - DNA, 15 bp, Homo sapiens
atcatgatacctgac

SEQ ID NO: 201918 - DNA, 15 bp, Homo sapiens
catcatgatacctga

SEQ ID NO: 201919 - DNA, 15 bp, Homo sapiens
gcatcatgatacctg

SEQ ID NO: 201920 - DNA, 15 bp, Homo sapiens
ggcatcatgatacct

SEQ ID NO: 201921 - DNA, 15 bp, Homo sapiens
aggcatcatgatacc

SEQ ID NO: 201922 - DNA, 15 bp, Homo sapiens
gaggcatcatgatac

SEQ ID NO: 201923 - DNA, 15 bp, Homo sapiens
ggaggcatcatgata

SEQ ID NO: 201924 - DNA, 15 bp, Homo sapiens
tggaggcatcatgat

SEQ ID NO: 201925 - DNA, 15 bp, Homo sapiens
ctggaggcatcatga

SEQ ID NO: 201926 - DNA, 15 bp, Homo sapiens
gctggaggcatcatg

SEQ ID NO: 201927 - DNA, 15 bp, Homo sapiens
agctggaggcatcat

SEQ ID NO: 201928 - DNA, 15 bp, Homo sapiens
aagctggaggcatca

SEQ ID NO: 201929 - DNA, 15 bp, Homo sapiens
taaagctggaggcat

SEQ ID NO: 201930 - DNA, 15 bp, Homo sapiens
ataaagctggaggca

SEQ ID NO: 201931 - DNA, 15 bp, Homo sapiens
aataaagctggaggc

SEQ ID NO: 201932 - DNA, 15 bp, Homo sapiens
gaataaagctggagg

SEQ ID NO: 201933 - DNA, 15 bp, Homo sapiens
agaataaagctggag

SEQ ID NO: 201934 - DNA, 15 bp, Homo sapiens
aagaataaagctgga

SEQ ID NO: 201935 - DNA, 15 bp, Homo sapiens
aaagaataaagctgg

SEQ ID NO: 201936 - DNA, 15 bp, Homo sapiens
aaaagaataaagctg

SEQ ID NO: 201937 - DNA, 15 bp, Homo sapiens
aaaaagaataaagct

SEQ ID NO: 201938 - DNA, 15 bp, Homo sapiens
caaaaagaataaagc

SEQ ID NO: 201939 - DNA, 15 bp, Homo sapiens
gcaaaaagaataaag

SEQ ID NO: 201940 - DNA, 15 bp, Homo sapiens
agcaaaaagaataaa

SEQ ID NO: 201941 - DNA, 15 bp, Homo sapiens
aagcaaaaagaataa

SEQ ID NO: 201942 - DNA, 15 bp, Homo sapiens
taagcaaaaagaata

SEQ ID NO: 201943 - DNA, 15 bp, Homo sapiens
ctaagcaaaaagaat

SEQ ID NO: 201944 - DNA, 15 bp, Homo sapiens
caatcctaagcaaaa

SEQ ID NO: 201945 - DNA, 15 bp, Homo sapiens
gcaatcctaagcaaa

SEQ ID NO: 201946 - DNA, 15 bp, Homo sapiens
ggcaatcctaagcaa

SEQ ID NO: 201947 - DNA, 15 bp, Homo sapiens
aggcaatcctaagca

SEQ ID NO: 201948 - DNA, 15 bp, Homo sapiens
aaggcaatcctaagc

SEQ ID NO: 201949 - DNA, 15 bp, Homo sapiens
caaggcaatcctaag

SEQ ID NO: 201950 - DNA, 15 bp, Homo sapiens
ccaaggcaatcctaa

SEQ ID NO: 201951 - DNA, 15 bp, Homo sapiens
gccaaggcaatccta

SEQ ID NO: 201952 - DNA, 15 bp, Homo sapiens
agccaaggcaatcct

SEQ ID NO: 201953 - DNA, 15 bp, Homo sapiens
tagccaaggcaatcc

SEQ ID NO: 201954 - DNA, 15 bp, Homo sapiens
atagccaaggcaatc

SEQ ID NO: 201955 - DNA, 15 bp, Homo sapiens
aatagccaaggcaat

SEQ ID NO: 201956 - DNA, 15 bp, Homo sapiens
caatagccaaggcaa

SEQ ID NO: 201957 - DNA, 15 bp, Homo sapiens
acaatagccaaggca

SEQ ID NO: 201958 - DNA, 15 bp, Homo sapiens
cacaatagccaaggc

SEQ ID NO: 201959 - DNA, 15 bp, Homo sapiens
gcacaatagccaagg

SEQ ID NO: 201960 - DNA, 15 bp, Homo sapiens
agcacaatagccaag

SEQ ID NO: 201961 - DNA, 15 bp, Homo sapiens
gagcacaatagccaa

SEQ ID NO: 201962 - DNA, 15 bp, Homo sapiens
agagcacaatagcca

SEQ ID NO: 201963 - DNA, 15 bp, Homo sapiens
aagagcacaatagcc

SEQ ID NO: 201964 - DNA, 15 bp, Homo sapiens
aaagagcacaatagc

SEQ ID NO: 201965 - DNA, 15 bp, Homo sapiens
aaaagagcacaatag

SEQ ID NO: 201966 - DNA, 15 bp, Homo sapiens
aaaaagagcacaata

SEQ ID NO: 201967 - DNA, 15 bp, Homo sapiens
aaaaaagagcacaat

SEQ ID NO: 201968 - DNA, 15 bp, Homo sapiens
caaaaaagagcacaa

SEQ ID NO: 201969 - DNA, 15 bp, Homo sapiens
ccaaaaaagagcaca

SEQ ID NO: 201970 - DNA, 15 bp, Homo sapiens
accaaaaaagagcac

SEQ ID NO: 201971 - DNA, 15 bp, Homo sapiens
aaccaaaaaagagca

SEQ ID NO: 201972 - DNA, 15 bp, Homo sapiens
aaaccaaaaaagagc

SEQ ID NO: 201973 - DNA, 15 bp, Homo sapiens
gaaaccaaaaaagag

SEQ ID NO: 201974 - DNA, 15 bp, Homo sapiens
tgaaaccaaaaaaga

SEQ ID NO: 201975 - DNA, 15 bp, Homo sapiens
atgaaaccaaaaaag

SEQ ID NO: 201976 - DNA, 15 bp, Homo sapiens
tatgaaaccaaaaaa

SEQ ID NO: 201977 - DNA, 15 bp, Homo sapiens
atatgaaaccaaaaa

SEQ ID NO: 201978 - DNA, 15 bp, Homo sapiens
catatgaaaccaaaa

SEQ ID NO: 201979 - DNA, 15 bp, Homo sapiens
tcatatgaaaccaaa

SEQ ID NO: 201980 - DNA, 15 bp, Homo sapiens
ttcatatgaaaccaa

SEQ ID NO: 201981 - DNA, 15 bp, Homo sapiens
attcatatgaaacca

SEQ ID NO: 201982 - DNA, 15 bp, Homo sapiens
aattcatatgaaacc

SEQ ID NO: 201983 - DNA, 15 bp, Homo sapiens
aaattcatatgaaac

SEQ ID NO: 201984 - DNA, 15 bp, Homo sapiens
aaaattcatatgaaa

SEQ ID NO: 201985 - DNA, 15 bp, Homo sapiens
taaaattcatatgaa

SEQ ID NO: 201986 - DNA, 15 bp, Homo sapiens
ttaaaattcatatga

SEQ ID NO: 201987 - DNA, 15 bp, Homo sapiens
tttaaaattcatatg

SEQ ID NO: 201988 - DNA, 15 bp, Homo sapiens
ttttaaaattcatat

SEQ ID NO: 201989 - DNA, 15 bp, Homo sapiens
attttaaaattcata

SEQ ID NO: 201990 - DNA, 15 bp, Homo sapiens
tattttaaaattcat

SEQ ID NO: 201991 - DNA, 15 bp, Homo sapiens
ctattttaaaattca

SEQ ID NO: 201992 - DNA, 15 bp, Homo sapiens
actattttaaaattc

SEQ ID NO: 201993 - DNA, 15 bp, Homo sapiens
aactattttaaaatt

SEQ ID NO: 201994 - DNA, 15 bp, Homo sapiens
aaactattttaaaat

SEQ ID NO: 201995 - DNA, 15 bp, Homo sapiens
aaaactattttaaaa

SEQ ID NO: 201996 - DNA, 15 bp, Homo sapiens
gaaaactattttaaa

SEQ ID NO: 201997 - DNA, 15 bp, Homo sapiens
agaaaactattttaa

SEQ ID NO: 201998 - DNA, 15 bp, Homo sapiens
gagaaaactatttta

SEQ ID NO: 201999 - DNA, 15 bp, Homo sapiens
agagaaaactatttt

SEQ ID NO: 202000 - DNA, 15 bp, Homo sapiens
tagagaaaactattt

SEQ ID NO: 202001 - DNA, 15 bp, Homo sapiens
ctagagaaaactatt

SEQ ID NO: 202002 - DNA, 15 bp, Homo sapiens
actagagaaaactat

SEQ ID NO: 202003 - DNA, 15 bp, Homo sapiens
aactagagaaaacta

SEQ ID NO: 202004 - DNA, 15 bp, Homo sapiens
gaactagagaaaact

SEQ ID NO: 202005 - DNA, 15 bp, Homo sapiens
agaactagagaaaac

SEQ ID NO: 202006 - DNA, 15 bp, Homo sapiens
cagaactagagaaaa

SEQ ID NO: 202007 - DNA, 15 bp, Homo sapiens
acagaactagagaaa

SEQ ID NO: 202008 - DNA, 15 bp, Homo sapiens
cacagaactagagaa

SEQ ID NO: 202009 - DNA, 15 bp, Homo sapiens
tcacagaactagaga

SEQ ID NO: 202010 - DNA, 15 bp, Homo sapiens
ttcacagaactagag

SEQ ID NO: 202011 - DNA, 15 bp, Homo sapiens
cttcacagaactaga

SEQ ID NO: 202012 - DNA, 15 bp, Homo sapiens
tcttcacagaactag

SEQ ID NO: 202013 - DNA, 15 bp, Homo sapiens
ttcttcacagaacta

SEQ ID NO: 202014 - DNA, 15 bp, Homo sapiens
gttcttcacagaact

SEQ ID NO: 202015 - DNA, 15 bp, Homo sapiens
tgttcttcacagaac

SEQ ID NO: 202016 - DNA, 15 bp, Homo sapiens
atgttcttcacagaa

SEQ ID NO: 202017 - DNA, 15 bp, Homo sapiens
aatgttcttcacaga

SEQ ID NO: 202018 - DNA, 15 bp, Homo sapiens
taatgttcttcacag

SEQ ID NO: 202019 - DNA, 15 bp, Homo sapiens
ataatgttcttcaca

SEQ ID NO: 202020 - DNA, 15 bp, Homo sapiens
aataatgttcttcac

SEQ ID NO: 202021 - DNA, 15 bp, Homo sapiens
caataatgttcttca

SEQ ID NO: 202022 - DNA, 15 bp, Homo sapiens
ccaataatgttcttc

SEQ ID NO: 202023 - DNA, 15 bp, Homo sapiens
accaataatgttctt

SEQ ID NO: 202024 - DNA, 15 bp, Homo sapiens
ataaatgcaatcaga

SEQ ID NO: 202025 - DNA, 15 bp, Homo sapiens
aataaatgcaatcag

SEQ ID NO: 202026 - DNA, 15 bp, Homo sapiens
aaataaatgcaatca

SEQ ID NO: 202027 - DNA, 15 bp, Homo sapiens
caaataaatgcaatc

SEQ ID NO: 202028 - DNA, 15 bp, Homo sapiens
tcaaataaatgcaat

SEQ ID NO: 202029 - DNA, 15 bp, Homo sapiens
ctcaaataaatgcaa

SEQ ID NO: 202030 - DNA, 15 bp, Homo sapiens
actcaaataaatgca

SEQ ID NO: 202031 - DNA, 15 bp, Homo sapiens
gactcaaataaatgc

SEQ ID NO: 202032 - DNA, 15 bp, Homo sapiens
agactcaaataaatg

SEQ ID NO: 202033 - DNA, 15 bp, Homo sapiens
aagactcaaataaat

SEQ ID NO: 202034 - DNA, 15 bp, Homo sapiens
gaagactcaaataaa

SEQ ID NO: 202035 - DNA, 15 bp, Homo sapiens
agaagactcaaataa

SEQ ID NO: 202036 - DNA, 15 bp, Homo sapiens
gagaagactcaaata

SEQ ID NO: 202037 - DNA, 15 bp, Homo sapiens
agagaagactcaaat

SEQ ID NO: 202038 - DNA, 15 bp, Homo sapiens
gagagaagactcaaa

SEQ ID NO: 202039 - DNA, 15 bp, Homo sapiens
agagagaagactcaa

SEQ ID NO: 202040 - DNA, 15 bp, Homo sapiens
aagagagaagactca

SEQ ID NO: 202041 - DNA, 15 bp, Homo sapiens
aaagagagaagactc

SEQ ID NO: 202042 - DNA, 15 bp, Homo sapiens
aaaagagagaagact

SEQ ID NO: 202043 - DNA, 15 bp, Homo sapiens
gaaaagagagaagac

SEQ ID NO: 202044 - DNA, 15 bp, Homo sapiens
aagactaataaagaa

SEQ ID NO: 202045 - DNA, 15 bp, Homo sapiens
caagactaataaaga

SEQ ID NO: 202046 - DNA, 15 bp, Homo sapiens
gcaagactaataaag

SEQ ID NO: 202047 - DNA, 15 bp, Homo sapiens
agcaagactaataaa

SEQ ID NO: 202048 - DNA, 15 bp, Homo sapiens
tagcaagactaataa

SEQ ID NO: 202049 - DNA, 15 bp, Homo sapiens
ctagcaagactaata

SEQ ID NO: 202050 - DNA, 15 bp, Homo sapiens
gctagcaagactaat

SEQ ID NO: 202051 - DNA, 15 bp, Homo sapiens
tgctagcaagactaa

SEQ ID NO: 202052 - DNA, 15 bp, Homo sapiens
ctgctagcaagacta

SEQ ID NO: 202053 - DNA, 15 bp, Homo sapiens
actgctagcaagact

SEQ ID NO: 202054 - DNA, 15 bp, Homo sapiens
gactgctagcaagac

SEQ ID NO: 202055 - DNA, 15 bp, Homo sapiens
agactgctagcaaga

SEQ ID NO: 202056 - DNA, 15 bp, Homo sapiens
tagactgctagcaag

SEQ ID NO: 202057 - DNA, 15 bp, Homo sapiens
atagactgctagcaa

SEQ ID NO: 202058 - DNA, 15 bp, Homo sapiens
gatagactgctagca

SEQ ID NO: 202059 - DNA, 15 bp, Homo sapiens
agatagactgctagc

SEQ ID NO: 202060 - DNA, 15 bp, Homo sapiens
tagatagactgctag

SEQ ID NO: 202061 - DNA, 15 bp, Homo sapiens
atagatagactgcta

SEQ ID NO: 202062 - DNA, 15 bp, Homo sapiens
aatagatagactgct

SEQ ID NO: 202063 - DNA, 15 bp, Homo sapiens
aaatagatagactgc

SEQ ID NO: 202064 - DNA, 15 bp, Homo sapiens
aaaatagatagactg

SEQ ID NO: 202065 - DNA, 15 bp, Homo sapiens
taaaatagatagact

SEQ ID NO: 202066 - DNA, 15 bp, Homo sapiens
ataaaatagatagac

SEQ ID NO: 202067 - DNA, 15 bp, Homo sapiens
aataaaatagataga

SEQ ID NO: 202068 - DNA, 15 bp, Homo sapiens
aaataaaatagatag

SEQ ID NO: 202069 - DNA, 15 bp, Homo sapiens
gaaataaaatagata

SEQ ID NO: 202070 - DNA, 15 bp, Homo sapiens
tgaaataaaatagat

SEQ ID NO: 202071 - DNA, 15 bp, Homo sapiens
atgaaataaaataga

SEQ ID NO: 202072 - DNA, 15 bp, Homo sapiens
aatgaaataaaatag

SEQ ID NO: 202073 - DNA, 15 bp, Homo sapiens
aaaaatgaaataaaa

SEQ ID NO: 202074 - DNA, 15 bp, Homo sapiens
aaaaaatgaaataaa

SEQ ID NO: 202075 - DNA, 15 bp, Homo sapiens
aaaaaaatgaaataa

SEQ ID NO: 202076 - DNA, 15 bp, Homo sapiens
aaaaaaaatgaaata

SEQ ID NO: 202077 - DNA, 15 bp, Homo sapiens
gaaaaaaaatgaaat

SEQ ID NO: 202078 - DNA, 15 bp, Homo sapiens
tgaaaaaaaatgaaa

SEQ ID NO: 202079 - DNA, 15 bp, Homo sapiens
ttgaaaaaaaatgaa

SEQ ID NO: 202080 - DNA, 15 bp, Homo sapiens
tttgaaaaaaaatga

SEQ ID NO: 202081 - DNA, 15 bp, Homo sapiens
ttttgaaaaaaaatg

SEQ ID NO: 202082 - DNA, 15 bp, Homo sapiens
tttttgaaaaaaaat

SEQ ID NO: 202083 - DNA, 15 bp, Homo sapiens
gtttttgaaaaaaaa

SEQ ID NO: 202084 - DNA, 15 bp, Homo sapiens
ggtttttgaaaaaaa

SEQ ID NO: 202085 - DNA, 15 bp, Homo sapiens
gggtttttgaaaaaa

SEQ ID NO: 202086 - DNA, 15 bp, Homo sapiens
tgggtttttgaaaaa

SEQ ID NO: 202087 - DNA, 15 bp, Homo sapiens
ctgggtttttgaaaa

SEQ ID NO: 202088 - DNA, 15 bp, Homo sapiens
gctgggtttttgaaa

SEQ ID NO: 202089 - DNA, 15 bp, Homo sapiens
agctgggtttttgaa

SEQ ID NO: 202090 - DNA, 15 bp, Homo sapiens
gagctgggtttttga

SEQ ID NO: 202091 - DNA, 15 bp, Homo sapiens
ggagctgggtttttg

SEQ ID NO: 202092 - DNA, 15 bp, Homo sapiens
aggagctgggttttt

SEQ ID NO: 202093 - DNA, 15 bp, Homo sapiens
caggagctgggtttt

SEQ ID NO: 202094 - DNA, 15 bp, Homo sapiens
ccaggagctgggttt

SEQ ID NO: 202095 - DNA, 15 bp, Homo sapiens
tccaggagctgggtt

SEQ ID NO: 202096 - DNA, 15 bp, Homo sapiens
atccaggagctgggt

SEQ ID NO: 202097 - DNA, 15 bp, Homo sapiens
tatccaggagctggg

SEQ ID NO: 202098 - DNA, 15 bp, Homo sapiens
ttatccaggagctgg

SEQ ID NO: 202099 - DNA, 15 bp, Homo sapiens
cttatccaggagctg

SEQ ID NO: 202100 - DNA, 15 bp, Homo sapiens
acttatccaggagct

SEQ ID NO: 202101 - DNA, 15 bp, Homo sapiens
aacttatccaggagc

SEQ ID NO: 202102 - DNA, 15 bp, Homo sapiens
caacttatccaggag

SEQ ID NO: 202103 - DNA, 15 bp, Homo sapiens
tcaacttatccagga

SEQ ID NO: 202104 - DNA, 15 bp, Homo sapiens
atcaacttatccagg

SEQ ID NO: 202105 - DNA, 15 bp, Homo sapiens
gatcaacttatccag

SEQ ID NO: 202106 - DNA, 15 bp, Homo sapiens
agatcaacttatcca

SEQ ID NO: 202107 - DNA, 15 bp, Homo sapiens
aagatcaacttatcc

SEQ ID NO: 202108 - DNA, 15 bp, Homo sapiens
aaagatcaacttatc

SEQ ID NO: 202109 - DNA, 15 bp, Homo sapiens
aaaagatcaacttat

SEQ ID NO: 202110 - DNA, 15 bp, Homo sapiens
caaaagatcaactta

SEQ ID NO: 202111 - DNA, 15 bp, Homo sapiens
tcaaaagatcaactt

SEQ ID NO: 202112 - DNA, 15 bp, Homo sapiens
ttcaaaagatcaact

SEQ ID NO: 202113 - DNA, 15 bp, Homo sapiens
attcaaaagatcaac

SEQ ID NO: 202114 - DNA, 15 bp, Homo sapiens
cattcaaaagatcaa

SEQ ID NO: 202115 - DNA, 15 bp, Homo sapiens
ccattcaaaagatca

SEQ ID NO: 202116 - DNA, 15 bp, Homo sapiens
accattcaaaagatc

SEQ ID NO: 202117 - DNA, 15 bp, Homo sapiens
aaccattcaaaagat

SEQ ID NO: 202118 - DNA, 15 bp, Homo sapiens
aaaccattcaaaaga

SEQ ID NO: 202119 - DNA, 15 bp, Homo sapiens
aaaaccattcaaaag

SEQ ID NO: 202120 - DNA, 15 bp, Homo sapiens
aaaaaccattcaaaa

SEQ ID NO: 202121 - DNA, 15 bp, Homo sapiens
aaaaaaccattcaaa

SEQ ID NO: 202122 - DNA, 15 bp, Homo sapiens
aaaaaaaccattcaa

SEQ ID NO: 202123 - DNA, 15 bp, Homo sapiens
caaaaaaaccattca

SEQ ID NO: 202124 - DNA, 15 bp, Homo sapiens
acaaaaaaaccattc

SEQ ID NO: 202125 - DNA, 15 bp, Homo sapiens
cacaaaaaaaccatt

SEQ ID NO: 202126 - DNA, 15 bp, Homo sapiens
acacaaaaaaaccat

SEQ ID NO: 202127 - DNA, 15 bp, Homo sapiens
gacacaaaaaaacca

SEQ ID NO: 202128 - DNA, 15 bp, Homo sapiens
agacacaaaaaaacc

SEQ ID NO: 202129 - DNA, 15 bp, Homo sapiens
gagacacaaaaaaac

SEQ ID NO: 202130 - DNA, 15 bp, Homo sapiens
tgagacacaaaaaaa

SEQ ID NO: 202131 - DNA, 15 bp, Homo sapiens
ctgagacacaaaaaa

SEQ ID NO: 202132 - DNA, 15 bp, Homo sapiens
actgagacacaaaaa

SEQ ID NO: 202133 - DNA, 15 bp, Homo sapiens
gactgagacacaaaa

SEQ ID NO: 202134 - DNA, 15 bp, Homo sapiens
agactgagacacaaa

SEQ ID NO: 202135 - DNA, 15 bp, Homo sapiens
gagactgagacacaa

SEQ ID NO: 202136 - DNA, 15 bp, Homo sapiens
ggagactgagacaca

SEQ ID NO: 202137 - DNA, 15 bp, Homo sapiens
aggagactgagacac

SEQ ID NO: 202138 - DNA, 15 bp, Homo sapiens
taggagactgagaca

SEQ ID NO: 202139 - DNA, 15 bp, Homo sapiens
gtaggagactgagac

SEQ ID NO: 202140 - DNA, 15 bp, Homo sapiens
tgtaggagactgaga

SEQ ID NO: 202141 - DNA, 15 bp, Homo sapiens
ctgtaggagactgag

SEQ ID NO: 202142 - DNA, 15 bp, Homo sapiens
actgtaggagactga

SEQ ID NO: 202143 - DNA, 15 bp, Homo sapiens
aactgtaggagactg

SEQ ID NO: 202144 - DNA, 15 bp, Homo sapiens
gaactgtaggagact

SEQ ID NO: 202145 - DNA, 15 bp, Homo sapiens
agaactgtaggagac

SEQ ID NO: 202146 - DNA, 15 bp, Homo sapiens
cagaactgtaggaga

SEQ ID NO: 202147 - DNA, 15 bp, Homo sapiens
gcagaactgtaggag

SEQ ID NO: 202148 - DNA, 15 bp, Homo sapiens
agcagaactgtagga

SEQ ID NO: 202149 - DNA, 15 bp, Homo sapiens
gagcagaactgtagg

SEQ ID NO: 202150 - DNA, 15 bp, Homo sapiens
agagcagaactgtag

SEQ ID NO: 202151 - DNA, 15 bp, Homo sapiens
cagagcagaactgta

SEQ ID NO: 202152 - DNA, 15 bp, Homo sapiens
tcagagcagaactgt

SEQ ID NO: 202153 - DNA, 15 bp, Homo sapiens
atcagagcagaactg

SEQ ID NO: 202154 - DNA, 15 bp, Homo sapiens
tatcagagcagaact

SEQ ID NO: 202155 - DNA, 15 bp, Homo sapiens
atatcagagcagaac

SEQ ID NO: 202156 - DNA, 15 bp, Homo sapiens
gatatcagagcagaa

SEQ ID NO: 202157 - DNA, 15 bp, Homo sapiens
tgatatcagagcaga

SEQ ID NO: 202158 - DNA, 15 bp, Homo sapiens
gtgatatcagagcag

SEQ ID NO: 202159 - DNA, 15 bp, Homo sapiens
ggtgatatcagagca

SEQ ID NO: 202160 - DNA, 15 bp, Homo sapiens
tggtgatatcagagc

SEQ ID NO: 202161 - DNA, 15 bp, Homo sapiens
atggtgatatcagag

SEQ ID NO: 202162 - DNA, 15 bp, Homo sapiens
catggtgatatcaga

SEQ ID NO: 202163 - DNA, 15 bp, Homo sapiens
gcatggtgatatcag

SEQ ID NO: 202164 - DNA, 15 bp, Homo sapiens
ggcatggtgatatca

SEQ ID NO: 202165 - DNA, 15 bp, Homo sapiens
aggcatggtgatatc

SEQ ID NO: 202166 - DNA, 15 bp, Homo sapiens
taggcatggtgatat

SEQ ID NO: 202167 - DNA, 15 bp, Homo sapiens
ataggcatggtgata

SEQ ID NO: 202168 - DNA, 15 bp, Homo sapiens
aataggcatggtgat

SEQ ID NO: 202169 - DNA, 15 bp, Homo sapiens
aaataggcatggtga

SEQ ID NO: 202170 - DNA, 15 bp, Homo sapiens
aaaataggcatggtg

SEQ ID NO: 202171 - DNA, 15 bp, Homo sapiens
taaaataggcatggt

SEQ ID NO: 202172 - DNA, 15 bp, Homo sapiens
ttaaaataggcatgg

SEQ ID NO: 202173 - DNA, 15 bp, Homo sapiens
tttaaaataggcatg

SEQ ID NO: 202174 - DNA, 15 bp, Homo sapiens
ttttaaaataggcat

SEQ ID NO: 202175 - DNA, 15 bp, Homo sapiens
cttttaaaataggca

SEQ ID NO: 202176 - DNA, 15 bp, Homo sapiens
tcttttaaaataggc

SEQ ID NO: 202177 - DNA, 15 bp, Homo sapiens
atcttttaaaatagg

SEQ ID NO: 202178 - DNA, 15 bp, Homo sapiens
aatcttttaaaatag

SEQ ID NO: 202179 - DNA, 15 bp, Homo sapiens
aaatcttttaaaata

SEQ ID NO: 202180 - DNA, 15 bp, Homo sapiens
aaaatcttttaaaat

SEQ ID NO: 202181 - DNA, 15 bp, Homo sapiens
caaaatcttttaaaa

SEQ ID NO: 202182 - DNA, 15 bp, Homo sapiens
tcaaaatcttttaaa

SEQ ID NO: 202183 - DNA, 15 bp, Homo sapiens
atcaaaatcttttaa

SEQ ID NO: 202184 - DNA, 15 bp, Homo sapiens
gatcaaaatctttta

SEQ ID NO: 202185 - DNA, 15 bp, Homo sapiens
ggatcaaaatctttt

SEQ ID NO: 202186 - DNA, 15 bp, Homo sapiens
aggatcaaaatcttt

SEQ ID NO: 202187 - DNA, 15 bp, Homo sapiens
aaggatcaaaatctt

SEQ ID NO: 202188 - DNA, 15 bp, Homo sapiens
aaaggatcaaaatct

SEQ ID NO: 202189 - DNA, 15 bp, Homo sapiens
aaaaggatcaaaatc

SEQ ID NO: 202190 - DNA, 15 bp, Homo sapiens
aaaaaggatcaaaat

SEQ ID NO: 202191 - DNA, 15 bp, Homo sapiens
taaaaaggatcaaaa

SEQ ID NO: 202192 - DNA, 15 bp, Homo sapiens
ctaaaaaggatcaaa

SEQ ID NO: 202193 - DNA, 15 bp, Homo sapiens
actaaaaaggatcaa

SEQ ID NO: 202194 - DNA, 15 bp, Homo sapiens
gactaaaaaggatca

SEQ ID NO: 202195 - DNA, 15 bp, Homo sapiens
ggactaaaaaggatc

SEQ ID NO: 202196 - DNA, 15 bp, Homo sapiens
gggactaaaaaggat

SEQ ID NO: 202197 - DNA, 15 bp, Homo sapiens
ggggactaaaaagga

SEQ ID NO: 202198 - DNA, 15 bp, Homo sapiens
tggggactaaaaagg

SEQ ID NO: 202199 - DNA, 15 bp, Homo sapiens
ttggggactaaaaag

SEQ ID NO: 202200 - DNA, 15 bp, Homo sapiens
tttggggactaaaaa

SEQ ID NO: 202201 - DNA, 15 bp, Homo sapiens
atttggggactaaaa

SEQ ID NO: 202202 - DNA, 15 bp, Homo sapiens
aatttggggactaaa

SEQ ID NO: 202203 - DNA, 15 bp, Homo sapiens
gaatttggggactaa

SEQ ID NO: 202204 - DNA, 15 bp, Homo sapiens
agaatttggggacta

SEQ ID NO: 202205 - DNA, 15 bp, Homo sapiens
gagaatttggggact

SEQ ID NO: 202206 - DNA, 15 bp, Homo sapiens
agagaatttggggac

SEQ ID NO: 202207 - DNA, 15 bp, Homo sapiens
gagagaatttgggga

SEQ ID NO: 202208 - DNA, 15 bp, Homo sapiens
agagagaatttgggg

SEQ ID NO: 202209 - DNA, 15 bp, Homo sapiens
gagagagaatttggg

SEQ ID NO: 202210 - DNA, 15 bp, Homo sapiens
agagagagaatttgg

SEQ ID NO: 202211 - DNA, 15 bp, Homo sapiens
cagagagagaatttg

SEQ ID NO: 202212 - DNA, 15 bp, Homo sapiens
gcagagagagaattt

SEQ ID NO: 202213 - DNA, 15 bp, Homo sapiens
tgcagagagagaatt

SEQ ID NO: 202214 - DNA, 15 bp, Homo sapiens
ctgcagagagagaat

SEQ ID NO: 202215 - DNA, 15 bp, Homo sapiens
cctgcagagagagaa

SEQ ID NO: 202216 - DNA, 15 bp, Homo sapiens
acctgcagagagaga

SEQ ID NO: 202217 - DNA, 15 bp, Homo sapiens
cacctgcagagagag

SEQ ID NO: 202218 - DNA, 15 bp, Homo sapiens
ccacctgcagagaga

SEQ ID NO: 202219 - DNA, 15 bp, Homo sapiens
gccacctgcagagag

SEQ ID NO: 202220 - DNA, 15 bp, Homo sapiens
ggccacctgcagaga

SEQ ID NO: 202221 - DNA, 15 bp, Homo sapiens
aggccacctgcagag

SEQ ID NO: 202222 - DNA, 15 bp, Homo sapiens
aaggccacctgcaga

SEQ ID NO: 202223 - DNA, 15 bp, Homo sapiens
aaaggccacctgcag

SEQ ID NO: 202224 - DNA, 15 bp, Homo sapiens
aaaaggccacctgca

SEQ ID NO: 202225 - DNA, 15 bp, Homo sapiens
aaaaaggccacctgc

SEQ ID NO: 202226 - DNA, 15 bp, Homo sapiens
aaaaaaggccacctg

SEQ ID NO: 202227 - DNA, 15 bp, Homo sapiens
aaaaaaaggccacct

SEQ ID NO: 202228 - DNA, 15 bp, Homo sapiens
aaaaaaaaggccacc

SEQ ID NO: 202229 - DNA, 15 bp, Homo sapiens
aaaaaaaaaggccac

SEQ ID NO: 202230 - DNA, 15 bp, Homo sapiens
actctcaaaaaaaaa

SEQ ID NO: 202231 - DNA, 15 bp, Homo sapiens
cactctcaaaaaaaa

SEQ ID NO: 202232 - DNA, 15 bp, Homo sapiens
tcactctcaaaaaaa

SEQ ID NO: 202233 - DNA, 15 bp, Homo sapiens
ctcactctcaaaaaa

SEQ ID NO: 202234 - DNA, 15 bp, Homo sapiens
cctcactctcaaaaa

SEQ ID NO: 202235 - DNA, 15 bp, Homo sapiens
gcctcactctcaaaa

SEQ ID NO: 202236 - DNA, 15 bp, Homo sapiens
agcctcactctcaaa

SEQ ID NO: 202237 - DNA, 15 bp, Homo sapiens
tagcctcactctcaa

SEQ ID NO: 202238 - DNA, 15 bp, Homo sapiens
atagcctcactctca

SEQ ID NO: 202239 - DNA, 15 bp, Homo sapiens
gatagcctcactctc

SEQ ID NO: 202240 - DNA, 15 bp, Homo sapiens
agatagcctcactct

SEQ ID NO: 202241 - DNA, 15 bp, Homo sapiens
cagatagcctcactc

SEQ ID NO: 202242 - DNA, 15 bp, Homo sapiens
tcagatagcctcact

SEQ ID NO: 202243 - DNA, 15 bp, Homo sapiens
atcagatagcctcac

SEQ ID NO: 202244 - DNA, 15 bp, Homo sapiens
aatcagatagcctca

SEQ ID NO: 202245 - DNA, 15 bp, Homo sapiens
caatcagatagcctc

SEQ ID NO: 202246 - DNA, 15 bp, Homo sapiens
tcaatcagatagcct

SEQ ID NO: 202247 - DNA, 15 bp, Homo sapiens
atcaatcagatagcc

SEQ ID NO: 202248 - DNA, 15 bp, Homo sapiens
tatcaatcagatagc

SEQ ID NO: 202249 - DNA, 15 bp, Homo sapiens
gtatcaatcagatag

SEQ ID NO: 202250 - DNA, 15 bp, Homo sapiens
agtatcaatcagata

SEQ ID NO: 202251 - DNA, 15 bp, Homo sapiens
gagtatcaatcagat

SEQ ID NO: 202252 - DNA, 15 bp, Homo sapiens
agagtatcaatcaga

SEQ ID NO: 202253 - DNA, 15 bp, Homo sapiens
aagagtatcaatcag

SEQ ID NO: 202254 - DNA, 15 bp, Homo sapiens
aaagagtatcaatca

SEQ ID NO: 202255 - DNA, 15 bp, Homo sapiens
taaagagtatcaatc

SEQ ID NO: 202256 - DNA, 15 bp, Homo sapiens
ataaagagtatcaat

SEQ ID NO: 202257 - DNA, 15 bp, Homo sapiens
cataaagagtatcaa

SEQ ID NO: 202258 - DNA, 15 bp, Homo sapiens
gcataaagagtatca

SEQ ID NO: 202259 - DNA, 15 bp, Homo sapiens
agcataaagagtatc

SEQ ID NO: 202260 - DNA, 15 bp, Homo sapiens
tagcataaagagtat

SEQ ID NO: 202261 - DNA, 15 bp, Homo sapiens
gtagcataaagagta

SEQ ID NO: 202262 - DNA, 15 bp, Homo sapiens
agtagcataaagagt

SEQ ID NO: 202263 - DNA, 15 bp, Homo sapiens
aagtagcataaagag

SEQ ID NO: 202264 - DNA, 15 bp, Homo sapiens
caagtagcataaaga

SEQ ID NO: 202265 - DNA, 15 bp, Homo sapiens
ccaagtagcataaag

SEQ ID NO: 202266 - DNA, 15 bp, Homo sapiens
tccaagtagcataaa

SEQ ID NO: 202267 - DNA, 15 bp, Homo sapiens
ctccaagtagcataa

SEQ ID NO: 202268 - DNA, 15 bp, Homo sapiens
actccaagtagcata

SEQ ID NO: 202269 - DNA, 15 bp, Homo sapiens
tactccaagtagcat

SEQ ID NO: 202270 - DNA, 15 bp, Homo sapiens
atactccaagtagca

SEQ ID NO: 202271 - DNA, 15 bp, Homo sapiens
aatactccaagtagc

SEQ ID NO: 202272 - DNA, 15 bp, Homo sapiens
aaatactccaagtag

SEQ ID NO: 202273 - DNA, 15 bp, Homo sapiens
taaatactccaagta

SEQ ID NO: 202274 - DNA, 15 bp, Homo sapiens
ttaaatactccaagt

SEQ ID NO: 202275 - DNA, 15 bp, Homo sapiens
attaaatactccaag

SEQ ID NO: 202276 - DNA, 15 bp, Homo sapiens
tattaaatactccaa

SEQ ID NO: 202277 - DNA, 15 bp, Homo sapiens
atattaaatactcca

SEQ ID NO: 202278 - DNA, 15 bp, Homo sapiens
catattaaatactcc

SEQ ID NO: 202279 - DNA, 15 bp, Homo sapiens
gcatattaaatactc

SEQ ID NO: 202280 - DNA, 15 bp, Homo sapiens
tgcatattaaatact

SEQ ID NO: 202281 - DNA, 15 bp, Homo sapiens
atgcatattaaatac

SEQ ID NO: 202282 - DNA, 15 bp, Homo sapiens
aatgcatattaaata

SEQ ID NO: 202283 - DNA, 15 bp, Homo sapiens
caatgcatattaaat

SEQ ID NO: 202284 - DNA, 15 bp, Homo sapiens
ccaatgcatattaaa

SEQ ID NO: 202285 - DNA, 15 bp, Homo sapiens
accaatgcatattaa

SEQ ID NO: 202286 - DNA, 15 bp, Homo sapiens
aaccaatgcatatta

SEQ ID NO: 202287 - DNA, 15 bp, Homo sapiens
gaaccaatgcatatt

SEQ ID NO: 202288 - DNA, 15 bp, Homo sapiens
agaaccaatgcatat

SEQ ID NO: 202289 - DNA, 15 bp, Homo sapiens
cagaaccaatgcata

SEQ ID NO: 202290 - DNA, 15 bp, Homo sapiens
acagaaccaatgcat

SEQ ID NO: 202291 - DNA, 15 bp, Homo sapiens
tacagaaccaatgca

SEQ ID NO: 202292 - DNA, 15 bp, Homo sapiens
atacagaaccaatgc

SEQ ID NO: 202293 - DNA, 15 bp, Homo sapiens
aatacagaaccaatg

SEQ ID NO: 202294 - DNA, 15 bp, Homo sapiens
aaatacagaaccaat

SEQ ID NO: 202295 - DNA, 15 bp, Homo sapiens
gaaatacagaaccaa

SEQ ID NO: 202296 - DNA, 15 bp, Homo sapiens
tgaaatacagaacca

SEQ ID NO: 202297 - DNA, 15 bp, Homo sapiens
gtgaaatacagaacc

SEQ ID NO: 202298 - DNA, 15 bp, Homo sapiens
tgtgaaatacagaac

SEQ ID NO: 202299 - DNA, 15 bp, Homo sapiens
atgtgaaatacagaa

SEQ ID NO: 202300 - DNA, 15 bp, Homo sapiens
aatgtgaaatacaga

SEQ ID NO: 202301 - DNA, 15 bp, Homo sapiens
taatgtgaaatacag

SEQ ID NO: 202302 - DNA, 15 bp, Homo sapiens
ataatgtgaaataca

SEQ ID NO: 202303 - DNA, 15 bp, Homo sapiens
cataatgtgaaatac

SEQ ID NO: 202304 - DNA, 15 bp, Homo sapiens
gcataatgtgaaata

SEQ ID NO: 202305 - DNA, 15 bp, Homo sapiens
agcataatgtgaaat

SEQ ID NO: 202306 - DNA, 15 bp, Homo sapiens
aagcataatgtgaaa

SEQ ID NO: 202307 - DNA, 15 bp, Homo sapiens
aaagcataatgtgaa

SEQ ID NO: 202308 - DNA, 15 bp, Homo sapiens
aaaagcataatgtga

SEQ ID NO: 202309 - DNA, 15 bp, Homo sapiens
taaaagcataatgtg

SEQ ID NO: 202310 - DNA, 15 bp, Homo sapiens
ataaaagcataatgt

SEQ ID NO: 202311 - DNA, 15 bp, Homo sapiens
aataaaagcataatg

SEQ ID NO: 202312 - DNA, 15 bp, Homo sapiens
caataaaagcataat

SEQ ID NO: 202313 - DNA, 15 bp, Homo sapiens
gcaataaaagcataa

SEQ ID NO: 202314 - DNA, 15 bp, Homo sapiens
cgcaataaaagcata

SEQ ID NO: 202315 - DNA, 15 bp, Homo sapiens
gcgcaataaaagcat

SEQ ID NO: 202316 - DNA, 15 bp, Homo sapiens
agcgcaataaaagca

SEQ ID NO: 202317 - DNA, 15 bp, Homo sapiens
tagcgcaataaaagc

SEQ ID NO: 202318 - DNA, 15 bp, Homo sapiens
ttagcgcaataaaag

SEQ ID NO: 202319 - DNA, 15 bp, Homo sapiens
tttagcgcaataaaa

SEQ ID NO: 202320 - DNA, 15 bp, Homo sapiens
ctttagcgcaataaa

SEQ ID NO: 202321 - DNA, 15 bp, Homo sapiens
actttagcgcaataa

SEQ ID NO: 202322 - DNA, 15 bp, Homo sapiens
aactttagcgcaata

SEQ ID NO: 202323 - DNA, 15 bp, Homo sapiens
caactttagcgcaat

SEQ ID NO: 202324 - DNA, 15 bp, Homo sapiens
tcaactttagcgcaa

SEQ ID NO: 202325 - DNA, 15 bp, Homo sapiens
atcaactttagcgca

SEQ ID NO: 202326 - DNA, 15 bp, Homo sapiens
tatcaactttagcgc

SEQ ID NO: 202327 - DNA, 15 bp, Homo sapiens
atatcaactttagcg

SEQ ID NO: 202328 - DNA, 15 bp, Homo sapiens
aatatcaactttagc

SEQ ID NO: 202329 - DNA, 15 bp, Homo sapiens
taatatcaactttag

SEQ ID NO: 202330 - DNA, 15 bp, Homo sapiens
ttaatatcaacttta

SEQ ID NO: 202331 - DNA, 15 bp, Homo sapiens
tttaatatcaacttt

SEQ ID NO: 202332 - DNA, 15 bp, Homo sapiens
ctttaatatcaactt

SEQ ID NO: 202333 - DNA, 15 bp, Homo sapiens
actttaatatcaact

SEQ ID NO: 202334 - DNA, 15 bp, Homo sapiens
aactttaatatcaac

SEQ ID NO: 202335 - DNA, 15 bp, Homo sapiens
aaactttaatatcaa

SEQ ID NO: 202336 - DNA, 15 bp, Homo sapiens
aaaactttaatatca

SEQ ID NO: 202337 - DNA, 15 bp, Homo sapiens
taaaactttaatatc

SEQ ID NO: 202338 - DNA, 15 bp, Homo sapiens
ataaaactttaatat

SEQ ID NO: 202339 - DNA, 15 bp, Homo sapiens
tataaaactttaata

SEQ ID NO: 202340 - DNA, 15 bp, Homo sapiens
ctataaaactttaat

SEQ ID NO: 202341 - DNA, 15 bp, Homo sapiens
gctataaaactttaa

SEQ ID NO: 202342 - DNA, 15 bp, Homo sapiens
tgctataaaacttta

SEQ ID NO: 202343 - DNA, 15 bp, Homo sapiens
atgctataaaacttt

SEQ ID NO: 202344 - DNA, 15 bp, Homo sapiens
tatgctataaaactt

SEQ ID NO: 202345 - DNA, 15 bp, Homo sapiens
ttatgctataaaact

SEQ ID NO: 202346 - DNA, 15 bp, Homo sapiens
tttatgctataaaac

SEQ ID NO: 202347 - DNA, 15 bp, Homo sapiens
ttttatgctataaaa

SEQ ID NO: 202348 - DNA, 15 bp, Homo sapiens
attttatgctataaa

SEQ ID NO: 202349 - DNA, 15 bp, Homo sapiens
cattttatgctataa

SEQ ID NO: 202350 - DNA, 15 bp, Homo sapiens
acattttatgctata

SEQ ID NO: 202351 - DNA, 15 bp, Homo sapiens
gacattttatgctat

SEQ ID NO: 202352 - DNA, 15 bp, Homo sapiens
tgacattttatgcta

SEQ ID NO: 202353 - DNA, 15 bp, Homo sapiens
atgacattttatgct

SEQ ID NO: 202354 - DNA, 15 bp, Homo sapiens
catgacattttatgc

SEQ ID NO: 202355 - DNA, 15 bp, Homo sapiens
ccatgacattttatg

SEQ ID NO: 202356 - DNA, 15 bp, Homo sapiens
gccatgacattttat

SEQ ID NO: 202357 - DNA, 15 bp, Homo sapiens
tgccatgacatttta

SEQ ID NO: 202358 - DNA, 15 bp, Homo sapiens
ctgccatgacatttt

SEQ ID NO: 202359 - DNA, 15 bp, Homo sapiens
cctgccatgacattt

SEQ ID NO: 202360 - DNA, 15 bp, Homo sapiens
ccctgccatgacatt

SEQ ID NO: 202361 - DNA, 15 bp, Homo sapiens
tccctgccatgacat

SEQ ID NO: 202362 - DNA, 15 bp, Homo sapiens
ttccctgccatgaca

SEQ ID NO: 202363 - DNA, 15 bp, Homo sapiens
gttccctgccatgac

SEQ ID NO: 202364 - DNA, 15 bp, Homo sapiens
tgttccctgccatga

SEQ ID NO: 202365 - DNA, 15 bp, Homo sapiens
atgttccctgccatg

SEQ ID NO: 202366 - DNA, 15 bp, Homo sapiens
aatgttccctgccat

SEQ ID NO: 202367 - DNA, 15 bp, Homo sapiens
aaatgttccctgcca

SEQ ID NO: 202368 - DNA, 15 bp, Homo sapiens
caaatgttccctgcc

SEQ ID NO: 202369 - DNA, 15 bp, Homo sapiens
gcaaatgttccctgc

SEQ ID NO: 202370 - DNA, 15 bp, Homo sapiens
agcaaatgttccctg

SEQ ID NO: 202371 - DNA, 15 bp, Homo sapiens
gagcaaatgttccct

SEQ ID NO: 202372 - DNA, 15 bp, Homo sapiens
ttagagcaaatgttc

SEQ ID NO: 202373 - DNA, 15 bp, Homo sapiens
attagagcaaatgtt

SEQ ID NO: 202374 - DNA, 15 bp, Homo sapiens
aattagagcaaatgt

SEQ ID NO: 202375 - DNA, 15 bp, Homo sapiens
aaattagagcaaatg

SEQ ID NO: 202376 - DNA, 15 bp, Homo sapiens
taaattagagcaaat

SEQ ID NO: 202377 - DNA, 15 bp, Homo sapiens
ataaattagagcaaa

SEQ ID NO: 202378 - DNA, 15 bp, Homo sapiens
gataaattagagcaa

SEQ ID NO: 202379 - DNA, 15 bp, Homo sapiens
tgataaattagagca

SEQ ID NO: 202380 - DNA, 15 bp, Homo sapiens
atgataaattagagc

SEQ ID NO: 202381 - DNA, 15 bp, Homo sapiens
tatgataaattagag

SEQ ID NO: 202382 - DNA, 15 bp, Homo sapiens
ttatgataaattaga

SEQ ID NO: 202383 - DNA, 15 bp, Homo sapiens
attatgataaattag

SEQ ID NO: 202384 - DNA, 15 bp, Homo sapiens
aattatgataaatta

SEQ ID NO: 202385 - DNA, 15 bp, Homo sapiens
aaattatgataaatt

SEQ ID NO: 202386 - DNA, 15 bp, Homo sapiens
aaaattatgataaat

SEQ ID NO: 202387 - DNA, 15 bp, Homo sapiens
aaaaattatgataaa

SEQ ID NO: 202388 - DNA, 15 bp, Homo sapiens
aaaaaattatgataa

SEQ ID NO: 202389 - DNA, 15 bp, Homo sapiens
taaaaaattatgata

SEQ ID NO: 202390 - DNA, 15 bp, Homo sapiens
ttaaaaaattatgat

SEQ ID NO: 202391 - DNA, 15 bp, Homo sapiens
tttaaaaaattatga

SEQ ID NO: 202392 - DNA, 15 bp, Homo sapiens
ttttaaaaaattatg

SEQ ID NO: 202393 - DNA, 15 bp, Homo sapiens
tctttttaaaaaatt

SEQ ID NO: 202394 - DNA, 15 bp, Homo sapiens
ttctttttaaaaaat

SEQ ID NO: 202395 - DNA, 15 bp, Homo sapiens
tttctttttaaaaaa

SEQ ID NO: 202396 - DNA, 15 bp, Homo sapiens
ttttctttttaaaaa

SEQ ID NO: 202397 - DNA, 15 bp, Homo sapiens
attttctttttaaaa

SEQ ID NO: 202398 - DNA, 15 bp, Homo sapiens
cattttctttttaaa

SEQ ID NO: 202399 - DNA, 15 bp, Homo sapiens
acattttctttttaa

SEQ ID NO: 202400 - DNA, 15 bp, Homo sapiens
gacattttcttttta

SEQ ID NO: 202401 - DNA, 15 bp, Homo sapiens
agacattttcttttt

SEQ ID NO: 202402 - DNA, 15 bp, Homo sapiens
cagacattttctttt

SEQ ID NO: 202403 - DNA, 15 bp, Homo sapiens
gcagacattttcttt

SEQ ID NO: 202404 - DNA, 15 bp, Homo sapiens
agcagacattttctt

SEQ ID NO: 202405 - DNA, 15 bp, Homo sapiens
tagcagacattttct

SEQ ID NO: 202406 - DNA, 15 bp, Homo sapiens
ttagcagacattttc

SEQ ID NO: 202407 - DNA, 15 bp, Homo sapiens
cttagcagacatttt

SEQ ID NO: 202408 - DNA, 15 bp, Homo sapiens
tcttagcagacattt

SEQ ID NO: 202409 - DNA, 15 bp, Homo sapiens
atcttagcagacatt

SEQ ID NO: 202410 - DNA, 15 bp, Homo sapiens
gatcttagcagacat

SEQ ID NO: 202411 - DNA, 15 bp, Homo sapiens
tgatcttagcagaca

SEQ ID NO: 202412 - DNA, 15 bp, Homo sapiens
atgatcttagcagac

SEQ ID NO: 202413 - DNA, 15 bp, Homo sapiens
tatgatcttagcaga

SEQ ID NO: 202414 - DNA, 15 bp, Homo sapiens
ttatgatcttagcag

SEQ ID NO: 202415 - DNA, 15 bp, Homo sapiens
attatgatcttagca

SEQ ID NO: 202416 - DNA, 15 bp, Homo sapiens
tattatgatcttagc

SEQ ID NO: 202417 - DNA, 15 bp, Homo sapiens
ttattatgatcttag

SEQ ID NO: 202418 - DNA, 15 bp, Homo sapiens
gttattatgatctta

SEQ ID NO: 202419 - DNA, 15 bp, Homo sapiens
tgttattatgatctt

SEQ ID NO: 202420 - DNA, 15 bp, Homo sapiens
ctgttattatgatct

SEQ ID NO: 202421 - DNA, 15 bp, Homo sapiens
gctgttattatgatc

SEQ ID NO: 202422 - DNA, 15 bp, Homo sapiens
agctgttattatgat

SEQ ID NO: 202423 - DNA, 15 bp, Homo sapiens
tagctgttattatga

SEQ ID NO: 202424 - DNA, 15 bp, Homo sapiens
ttagctgttattatg

SEQ ID NO: 202425 - DNA, 15 bp, Homo sapiens
attagctgttattat

SEQ ID NO: 202426 - DNA, 15 bp, Homo sapiens
tattagctgttatta

SEQ ID NO: 202427 - DNA, 15 bp, Homo sapiens
atattagctgttatt

SEQ ID NO: 202428 - DNA, 15 bp, Homo sapiens
aatattagctgttat

SEQ ID NO: 202429 - DNA, 15 bp, Homo sapiens
aaatattagctgtta

SEQ ID NO: 202430 - DNA, 15 bp, Homo sapiens
taaatattagctgtt

SEQ ID NO: 202431 - DNA, 15 bp, Homo sapiens
ataaatattagctgt

SEQ ID NO: 202432 - DNA, 15 bp, Homo sapiens
tataaatattagctg

SEQ ID NO: 202433 - DNA, 15 bp, Homo sapiens
atataaatattagct

SEQ ID NO: 202434 - DNA, 15 bp, Homo sapiens
catataaatattagc

SEQ ID NO: 202435 - DNA, 15 bp, Homo sapiens
gcatataaatattag

SEQ ID NO: 202436 - DNA, 15 bp, Homo sapiens
agcatataaatatta

SEQ ID NO: 202437 - DNA, 15 bp, Homo sapiens
tagcatataaatatt

SEQ ID NO: 202438 - DNA, 15 bp, Homo sapiens
ctagcatataaatat

SEQ ID NO: 202439 - DNA, 15 bp, Homo sapiens
tctagcatataaata

SEQ ID NO: 202440 - DNA, 15 bp, Homo sapiens
atctagcatataaat

SEQ ID NO: 202441 - DNA, 15 bp, Homo sapiens
ggtagatctagcata

SEQ ID NO: 202442 - DNA, 15 bp, Homo sapiens
gggtagatctagcat

SEQ ID NO: 202443 - DNA, 15 bp, Homo sapiens
agggtagatctagca

SEQ ID NO: 202444 - DNA, 15 bp, Homo sapiens
tagggtagatctagc

SEQ ID NO: 202445 - DNA, 15 bp, Homo sapiens
ttagggtagatctag

SEQ ID NO: 202446 - DNA, 15 bp, Homo sapiens
cttagggtagatcta

SEQ ID NO: 202447 - DNA, 15 bp, Homo sapiens
acttagggtagatct

SEQ ID NO: 202448 - DNA, 15 bp, Homo sapiens
cacttagggtagatc

SEQ ID NO: 202449 - DNA, 15 bp, Homo sapiens
acacttagggtagat

SEQ ID NO: 202450 - DNA, 15 bp, Homo sapiens
aacacttagggtaga

SEQ ID NO: 202451 - DNA, 15 bp, Homo sapiens
aaacacttagggtag

SEQ ID NO: 202452 - DNA, 15 bp, Homo sapiens
aaaacacttagggta

SEQ ID NO: 202453 - DNA, 15 bp, Homo sapiens
taaaacacttagggt

SEQ ID NO: 202454 - DNA, 15 bp, Homo sapiens
gtaaaacacttaggg

SEQ ID NO: 202455 - DNA, 15 bp, Homo sapiens
tgtaaaacacttagg

SEQ ID NO: 202456 - DNA, 15 bp, Homo sapiens
ctgtaaaacacttag

SEQ ID NO: 202457 - DNA, 15 bp, Homo sapiens
cctgtaaaacactta

SEQ ID NO: 202458 - DNA, 15 bp, Homo sapiens
acctgtaaaacactt

SEQ ID NO: 202459 - DNA, 15 bp, Homo sapiens
tacctgtaaaacact

SEQ ID NO: 202460 - DNA, 15 bp, Homo sapiens
atacctgtaaaacac

SEQ ID NO: 202461 - DNA, 15 bp, Homo sapiens
aatacctgtaaaaca

SEQ ID NO: 202462 - DNA, 15 bp, Homo sapiens
taatacctgtaaaac

SEQ ID NO: 202463 - DNA, 15 bp, Homo sapiens
ttaatacctgtaaaa

SEQ ID NO: 202464 - DNA, 15 bp, Homo sapiens
gttaatacctgtaaa

SEQ ID NO: 202465 - DNA, 15 bp, Homo sapiens
agttaatacctgtaa

SEQ ID NO: 202466 - DNA, 15 bp, Homo sapiens
aagttaatacctgta

SEQ ID NO: 202467 - DNA, 15 bp, Homo sapiens
gaagttaatacctgt

SEQ ID NO: 202468 - DNA, 15 bp, Homo sapiens
agaagttaatacctg

SEQ ID NO: 202469 - DNA, 15 bp, Homo sapiens
aagaagttaatacct

SEQ ID NO: 202470 - DNA, 15 bp, Homo sapiens
aaagaagttaatacc

SEQ ID NO: 202471 - DNA, 15 bp, Homo sapiens
caaagaagttaatac

SEQ ID NO: 202472 - DNA, 15 bp, Homo sapiens
tcaaagaagttaata

SEQ ID NO: 202473 - DNA, 15 bp, Homo sapiens
gtcaaagaagttaat

SEQ ID NO: 202474 - DNA, 15 bp, Homo sapiens
ggtcaaagaagttaa

SEQ ID NO: 202475 - DNA, 15 bp, Homo sapiens
tggtcaaagaagtta

SEQ ID NO: 202476 - DNA, 15 bp, Homo sapiens
atggtcaaagaagtt

SEQ ID NO: 202477 - DNA, 15 bp, Homo sapiens
catggtcaaagaagt

SEQ ID NO: 202478 - DNA, 15 bp, Homo sapiens
ccatggtcaaagaag

SEQ ID NO: 202479 - DNA, 15 bp, Homo sapiens
accatggtcaaagaa

SEQ ID NO: 202480 - DNA, 15 bp, Homo sapiens
caccatggtcaaaga

SEQ ID NO: 202481 - DNA, 15 bp, Homo sapiens
acaccatggtcaaag

SEQ ID NO: 202482 - DNA, 15 bp, Homo sapiens
cacaccatggtcaaa

SEQ ID NO: 202483 - DNA, 15 bp, Homo sapiens
ccacaccatggtcaa

SEQ ID NO: 202484 - DNA, 15 bp, Homo sapiens
gccacaccatggtca

SEQ ID NO: 202485 - DNA, 15 bp, Homo sapiens
ggccacaccatggtc

SEQ ID NO: 202486 - DNA, 15 bp, Homo sapiens
tggccacaccatggt

SEQ ID NO: 202487 - DNA, 15 bp, Homo sapiens
atggccacaccatgg

SEQ ID NO: 202488 - DNA, 15 bp, Homo sapiens
aatggccacaccatg

SEQ ID NO: 202489 - DNA, 15 bp, Homo sapiens
ccaatggccacacca

SEQ ID NO: 202490 - DNA, 15 bp, Homo sapiens
tccaatggccacacc

SEQ ID NO: 202491 - DNA, 15 bp, Homo sapiens
ttccaatggccacac

SEQ ID NO: 202492 - DNA, 15 bp, Homo sapiens
gttccaatggccaca

SEQ ID NO: 202493 - DNA, 15 bp, Homo sapiens
tgttccaatggccac

SEQ ID NO: 202494 - DNA, 15 bp, Homo sapiens
ttgttccaatggcca

SEQ ID NO: 202495 - DNA, 15 bp, Homo sapiens
attgttccaatggcc

SEQ ID NO: 202496 - DNA, 15 bp, Homo sapiens
cattgttccaatggc

SEQ ID NO: 202497 - DNA, 15 bp, Homo sapiens
acattgttccaatgg

SEQ ID NO: 202498 - DNA, 15 bp, Homo sapiens
tacattgttccaatg

SEQ ID NO: 202499 - DNA, 15 bp, Homo sapiens
ttacattgttccaat

SEQ ID NO: 202500 - DNA, 15 bp, Homo sapiens
attacattgttccaa

SEQ ID NO: 202501 - DNA, 15 bp, Homo sapiens
tattacattgttcca

SEQ ID NO: 202502 - DNA, 15 bp, Homo sapiens
ttattacattgttcc

SEQ ID NO: 202503 - DNA, 15 bp, Homo sapiens
attattacattgttc

SEQ ID NO: 202504 - DNA, 15 bp, Homo sapiens
tattattacattgtt

SEQ ID NO: 202505 - DNA, 15 bp, Homo sapiens
atattattacattgt

SEQ ID NO: 202506 - DNA, 15 bp, Homo sapiens
catattattacattg

SEQ ID NO: 202507 - DNA, 15 bp, Homo sapiens
acatattattacatt

SEQ ID NO: 202508 - DNA, 15 bp, Homo sapiens
cacatattattacat

SEQ ID NO: 202509 - DNA, 15 bp, Homo sapiens
ccacatattattaca

SEQ ID NO: 202510 - DNA, 15 bp, Homo sapiens
gccacatattattac

SEQ ID NO: 202511 - DNA, 15 bp, Homo sapiens
agccacatattatta

SEQ ID NO: 202512 - DNA, 15 bp, Homo sapiens
gagccacatattatt

SEQ ID NO: 202513 - DNA, 15 bp, Homo sapiens
tgagccacatattat

SEQ ID NO: 202514 - DNA, 15 bp, Homo sapiens
ttgagccacatatta

SEQ ID NO: 202515 - DNA, 15 bp, Homo sapiens
attgagccacatatt

SEQ ID NO: 202516 - DNA, 15 bp, Homo sapiens
tattgagccacatat

SEQ ID NO: 202517 - DNA, 15 bp, Homo sapiens
gtattgagccacata

SEQ ID NO: 202518 - DNA, 15 bp, Homo sapiens
ggtattgagccacat

SEQ ID NO: 202519 - DNA, 15 bp, Homo sapiens
tggtattgagccaca

SEQ ID NO: 202520 - DNA, 15 bp, Homo sapiens
atggtattgagccac

SEQ ID NO: 202521 - DNA, 15 bp, Homo sapiens
tatggtattgagcca

SEQ ID NO: 202522 - DNA, 15 bp, Homo sapiens
ctatggtattgagcc

SEQ ID NO: 202523 - DNA, 15 bp, Homo sapiens
cctatggtattgagc

SEQ ID NO: 202524 - DNA, 15 bp, Homo sapiens
acctatggtattgag

SEQ ID NO: 202525 - DNA, 15 bp, Homo sapiens
aacctatggtattga

SEQ ID NO: 202526 - DNA, 15 bp, Homo sapiens
taacctatggtattg

SEQ ID NO: 202527 - DNA, 15 bp, Homo sapiens
ttaacctatggtatt

SEQ ID NO: 202528 - DNA, 15 bp, Homo sapiens
attaacctatggtat

SEQ ID NO: 202529 - DNA, 15 bp, Homo sapiens
tattaacctatggta

SEQ ID NO: 202530 - DNA, 15 bp, Homo sapiens
atattaacctatggt

SEQ ID NO: 202531 - DNA, 15 bp, Homo sapiens
gatattaacctatgg

SEQ ID NO: 202532 - DNA, 15 bp, Homo sapiens
agatattaacctatg

SEQ ID NO: 202533 - DNA, 15 bp, Homo sapiens
aagatattaacctat

SEQ ID NO: 202534 - DNA, 15 bp, Homo sapiens
taagatattaaccta

SEQ ID NO: 202535 - DNA, 15 bp, Homo sapiens
ttaagatattaacct

SEQ ID NO: 202536 - DNA, 15 bp, Homo sapiens
tttaagatattaacc

SEQ ID NO: 202537 - DNA, 15 bp, Homo sapiens
gtttaagatattaac

SEQ ID NO: 202538 - DNA, 15 bp, Homo sapiens
cgtttaagatattaa

SEQ ID NO: 202539 - DNA, 15 bp, Homo sapiens
acgtttaagatatta

SEQ ID NO: 202540 - DNA, 15 bp, Homo sapiens
aacgtttaagatatt

SEQ ID NO: 202541 - DNA, 15 bp, Homo sapiens
taacgtttaagatat

SEQ ID NO: 202542 - DNA, 15 bp, Homo sapiens
ataacgtttaagata

SEQ ID NO: 202543 - DNA, 15 bp, Homo sapiens
aataacgtttaagat

SEQ ID NO: 202544 - DNA, 15 bp, Homo sapiens
aaataacgtttaaga

SEQ ID NO: 202545 - DNA, 15 bp, Homo sapiens
aaaataacgtttaag

SEQ ID NO: 202546 - DNA, 15 bp, Homo sapiens
aaaaataacgtttaa

SEQ ID NO: 202547 - DNA, 15 bp, Homo sapiens
gaaaaataacgttta

SEQ ID NO: 202548 - DNA, 15 bp, Homo sapiens
tgaaaaataacgttt

SEQ ID NO: 202549 - DNA, 15 bp, Homo sapiens
atgaaaaataacgtt

SEQ ID NO: 202550 - DNA, 15 bp, Homo sapiens
aatgaaaaataacgt

SEQ ID NO: 202551 - DNA, 15 bp, Homo sapiens
gaatgaaaaataacg

SEQ ID NO: 202552 - DNA, 15 bp, Homo sapiens
agaatgaaaaataac

SEQ ID NO: 202553 - DNA, 15 bp, Homo sapiens
gagaatgaaaaataa

SEQ ID NO: 202554 - DNA, 15 bp, Homo sapiens
agagaatgaaaaata

SEQ ID NO: 202555 - DNA, 15 bp, Homo sapiens
aagagaatgaaaaat

SEQ ID NO: 202556 - DNA, 15 bp, Homo sapiens
aaagagaatgaaaaa

SEQ ID NO: 202557 - DNA, 15 bp, Homo sapiens
caaagagaatgaaaa

SEQ ID NO: 202558 - DNA, 15 bp, Homo sapiens
ccaaagagaatgaaa

SEQ ID NO: 202559 - DNA, 15 bp, Homo sapiens
tccaaagagaatgaa

SEQ ID NO: 202560 - DNA, 15 bp, Homo sapiens
atccaaagagaatga

SEQ ID NO: 202561 - DNA, 15 bp, Homo sapiens
tatccaaagagaatg

SEQ ID NO: 202562 - DNA, 15 bp, Homo sapiens
ctatccaaagagaat

SEQ ID NO: 202563 - DNA, 15 bp, Homo sapiens
gctatccaaagagaa

SEQ ID NO: 202564 - DNA, 15 bp, Homo sapiens
ggctatccaaagaga

SEQ ID NO: 202565 - DNA, 15 bp, Homo sapiens
tggctatccaaagag

SEQ ID NO: 202566 - DNA, 15 bp, Homo sapiens
atggctatccaaaga

SEQ ID NO: 202567 - DNA, 15 bp, Homo sapiens
catggctatccaaag

SEQ ID NO: 202568 - DNA, 15 bp, Homo sapiens
tcatggctatccaaa

SEQ ID NO: 202569 - DNA, 15 bp, Homo sapiens
atcatggctatccaa

SEQ ID NO: 202570 - DNA, 15 bp, Homo sapiens
aatcatggctatcca

SEQ ID NO: 202571 - DNA, 15 bp, Homo sapiens
taatcatggctatcc

SEQ ID NO: 202572 - DNA, 15 bp, Homo sapiens
ttaatcatggctatc

SEQ ID NO: 202573 - DNA, 15 bp, Homo sapiens
tttaatcatggctat

SEQ ID NO: 202574 - DNA, 15 bp, Homo sapiens
gtttaatcatggcta

SEQ ID NO: 202575 - DNA, 15 bp, Homo sapiens
agtttaatcatggct

SEQ ID NO: 202576 - DNA, 15 bp, Homo sapiens
aagtttaatcatggc

SEQ ID NO: 202577 - DNA, 15 bp, Homo sapiens
aaagtttaatcatgg

SEQ ID NO: 202578 - DNA, 15 bp, Homo sapiens
aaaagtttaatcatg

SEQ ID NO: 202579 - DNA, 15 bp, Homo sapiens
aaaaagtttaatcat

SEQ ID NO: 202580 - DNA, 15 bp, Homo sapiens
aaaaaagtttaatca

SEQ ID NO: 202581 - DNA, 15 bp, Homo sapiens
aaaaaaagtttaatc

SEQ ID NO: 202582 - DNA, 15 bp, Homo sapiens
aaaaaaaagtttaat

SEQ ID NO: 202583 - DNA, 15 bp, Homo sapiens
aaaaaaaaagtttaa

SEQ ID NO: 202584 - DNA, 15 bp, Homo sapiens
aaaaaaaaaagttta

SEQ ID NO: 202585 - DNA, 15 bp, Homo sapiens
tgagactctgtctca

SEQ ID NO: 202586 - DNA, 15 bp, Homo sapiens
gtgagactctgtctc

SEQ ID NO: 202587 - DNA, 15 bp, Homo sapiens
agtgagactctgtct

SEQ ID NO: 202588 - DNA, 15 bp, Homo sapiens
cagtgagactctgtc

SEQ ID NO: 202589 - DNA, 15 bp, Homo sapiens
acagtgagactctgt

SEQ ID NO: 202590 - DNA, 15 bp, Homo sapiens
cacagtgagactctg

SEQ ID NO: 202591 - DNA, 15 bp, Homo sapiens
acacagtgagactct

SEQ ID NO: 202592 - DNA, 15 bp, Homo sapiens
aacacagtgagactc

SEQ ID NO: 202593 - DNA, 15 bp, Homo sapiens
caacacagtgagact

SEQ ID NO: 202594 - DNA, 15 bp, Homo sapiens
gcaacacagtgagac

SEQ ID NO: 202595 - DNA, 15 bp, Homo sapiens
ggcaacacagtgaga

SEQ ID NO: 202596 - DNA, 15 bp, Homo sapiens
tggcaacacagtgag

SEQ ID NO: 202597 - DNA, 15 bp, Homo sapiens
ctggcaacacagtga

SEQ ID NO: 202598 - DNA, 15 bp, Homo sapiens
cctggcaacacagtg

SEQ ID NO: 202599 - DNA, 15 bp, Homo sapiens
ccctggcaacacagt

SEQ ID NO: 202600 - DNA, 15 bp, Homo sapiens
gccctggcaacacag

SEQ ID NO: 202601 - DNA, 15 bp, Homo sapiens
agccctggcaacaca

SEQ ID NO: 202602 - DNA, 15 bp, Homo sapiens
cagccctggcaacac

SEQ ID NO: 202603 - DNA, 15 bp, Homo sapiens
ccagccctggcaaca

SEQ ID NO: 202604 - DNA, 15 bp, Homo sapiens
tccagccctggcaac

SEQ ID NO: 202605 - DNA, 15 bp, Homo sapiens
ctccagccctggcaa

SEQ ID NO: 202606 - DNA, 15 bp, Homo sapiens
actccagccctggca

SEQ ID NO: 202607 - DNA, 15 bp, Homo sapiens
cactccagccctggc

SEQ ID NO: 202608 - DNA, 15 bp, Homo sapiens
gcactccagccctgg

SEQ ID NO: 202609 - DNA, 15 bp, Homo sapiens
tgcactccagccctg

SEQ ID NO: 202610 - DNA, 15 bp, Homo sapiens
ctgcactccagccct

SEQ ID NO: 202611 - DNA, 15 bp, Homo sapiens
actgcactccagccc

SEQ ID NO: 202612 - DNA, 15 bp, Homo sapiens
atgagctgagatcat

SEQ ID NO: 202613 - DNA, 15 bp, Homo sapiens
aatgagctgagatca

SEQ ID NO: 202614 - DNA, 15 bp, Homo sapiens
caatgagctgagatc

SEQ ID NO: 202615 - DNA, 15 bp, Homo sapiens
ggttgcaatgagctg

SEQ ID NO: 202616 - DNA, 15 bp, Homo sapiens
aggttgcaatgagct

SEQ ID NO: 202617 - DNA, 15 bp, Homo sapiens
atggcgggtgcctgt

SEQ ID NO: 202618 - DNA, 15 bp, Homo sapiens
aatggcgggtgcctg

SEQ ID NO: 202619 - DNA, 15 bp, Homo sapiens
taatggcgggtgcct

SEQ ID NO: 202620 - DNA, 15 bp, Homo sapiens
gtaatggcgggtgcc

SEQ ID NO: 202621 - DNA, 15 bp, Homo sapiens
cgtaatggcgggtgc

SEQ ID NO: 202622 - DNA, 15 bp, Homo sapiens
gcgtaatggcgggtg

SEQ ID NO: 202623 - DNA, 15 bp, Homo sapiens
ggcgtaatggcgggt

SEQ ID NO: 202624 - DNA, 15 bp, Homo sapiens
gggcgtaatggcggg

SEQ ID NO: 202625 - DNA, 15 bp, Homo sapiens
tgggcgtaatggcgg

SEQ ID NO: 202626 - DNA, 15 bp, Homo sapiens
ctgggcgtaatggcg

SEQ ID NO: 202627 - DNA, 15 bp, Homo sapiens
gctgggcgtaatggc

SEQ ID NO: 202628 - DNA, 15 bp, Homo sapiens
agctgggcgtaatgg

SEQ ID NO: 202629 - DNA, 15 bp, Homo sapiens
tagctgggcgtaatg

SEQ ID NO: 202630 - DNA, 15 bp, Homo sapiens
ttagctgggcgtaat

SEQ ID NO: 202631 - DNA, 15 bp, Homo sapiens
attagctgggcgtaa

SEQ ID NO: 202632 - DNA, 15 bp, Homo sapiens
aattagctgggcgta

SEQ ID NO: 202633 - DNA, 15 bp, Homo sapiens
caacacggtgaaacc

SEQ ID NO: 202634 - DNA, 15 bp, Homo sapiens
gcagcctggccaaca

SEQ ID NO: 202635 - DNA, 15 bp, Homo sapiens
agcagcctggccaac

SEQ ID NO: 202636 - DNA, 15 bp, Homo sapiens
gagcagcctggccaa

SEQ ID NO: 202637 - DNA, 15 bp, Homo sapiens
agagcagcctggcca

SEQ ID NO: 202638 - DNA, 15 bp, Homo sapiens
aagagcagcctggcc

SEQ ID NO: 202639 - DNA, 15 bp, Homo sapiens
caagagcagcctggc

SEQ ID NO: 202640 - DNA, 15 bp, Homo sapiens
tcaagagcagcctgg

SEQ ID NO: 202641 - DNA, 15 bp, Homo sapiens
ttcaagagcagcctg

SEQ ID NO: 202642 - DNA, 15 bp, Homo sapiens
gttcaagagcagcct

SEQ ID NO: 202643 - DNA, 15 bp, Homo sapiens
agttcaagagcagcc

SEQ ID NO: 202644 - DNA, 15 bp, Homo sapiens
gagttcaagagcagc

SEQ ID NO: 202645 - DNA, 15 bp, Homo sapiens
ggagttcaagagcag

SEQ ID NO: 202646 - DNA, 15 bp, Homo sapiens
aggagttcaagagca

SEQ ID NO: 202647 - DNA, 15 bp, Homo sapiens
caggagttcaagagc

SEQ ID NO: 202648 - DNA, 15 bp, Homo sapiens
tcaggagttcaagag

SEQ ID NO: 202649 - DNA, 15 bp, Homo sapiens
caaggtcaggagttc

SEQ ID NO: 202650 - DNA, 15 bp, Homo sapiens
acaaggtcaggagtt

SEQ ID NO: 202651 - DNA, 15 bp, Homo sapiens
cacaaggtcaggagt

SEQ ID NO: 202652 - DNA, 15 bp, Homo sapiens
tcacaaggtcaggag

SEQ ID NO: 202653 - DNA, 15 bp, Homo sapiens
atcacaaggtcagga

SEQ ID NO: 202654 - DNA, 15 bp, Homo sapiens
aatcacaaggtcagg

SEQ ID NO: 202655 - DNA, 15 bp, Homo sapiens
gaatcacaaggtcag

SEQ ID NO: 202656 - DNA, 15 bp, Homo sapiens
tgaatcacaaggtca

SEQ ID NO: 202657 - DNA, 15 bp, Homo sapiens
gtgaatcacaaggtc

SEQ ID NO: 202658 - DNA, 15 bp, Homo sapiens
ggtgaatcacaaggt

SEQ ID NO: 202659 - DNA, 15 bp, Homo sapiens
gggtgaatcacaagg

SEQ ID NO: 202660 - DNA, 15 bp, Homo sapiens
cgggtgaatcacaag

SEQ ID NO: 202661 - DNA, 15 bp, Homo sapiens
gcgggtgaatcacaa

SEQ ID NO: 202662 - DNA, 15 bp, Homo sapiens
ggcgggtgaatcaca

SEQ ID NO: 202663 - DNA, 15 bp, Homo sapiens
aggcgggtgaatcac

SEQ ID NO: 202664 - DNA, 15 bp, Homo sapiens
gaggcgggtgaatca

SEQ ID NO: 202665 - DNA, 15 bp, Homo sapiens
tgaggcgggtgaatc

SEQ ID NO: 202666 - DNA, 15 bp, Homo sapiens
ctgaggcgggtgaat

SEQ ID NO: 202667 - DNA, 15 bp, Homo sapiens
gctgaggcgggtgaa

SEQ ID NO: 202668 - DNA, 15 bp, Homo sapiens
ggctgaggcgggtga

SEQ ID NO: 202669 - DNA, 15 bp, Homo sapiens
aggctgaggcgggtg

SEQ ID NO: 202670 - DNA, 15 bp, Homo sapiens
gaggctgaggcgggt

SEQ ID NO: 202671 - DNA, 15 bp, Homo sapiens
agcgcagtggctcac

SEQ ID NO: 202672 - DNA, 15 bp, Homo sapiens
gagcgcagtggctca

SEQ ID NO: 202673 - DNA, 15 bp, Homo sapiens
tgagcgcagtggctc

SEQ ID NO: 202674 - DNA, 15 bp, Homo sapiens
ctgagcgcagtggct

SEQ ID NO: 202675 - DNA, 15 bp, Homo sapiens
gctgagcgcagtggc

SEQ ID NO: 202676 - DNA, 15 bp, Homo sapiens
ggctgagcgcagtgg

SEQ ID NO: 202677 - DNA, 15 bp, Homo sapiens
aggctgagcgcagtg

SEQ ID NO: 202678 - DNA, 15 bp, Homo sapiens
taggctgagcgcagt

SEQ ID NO: 202679 - DNA, 15 bp, Homo sapiens
ttaggctgagcgcag

SEQ ID NO: 202680 - DNA, 15 bp, Homo sapiens
tttaggctgagcgca

SEQ ID NO: 202681 - DNA, 15 bp, Homo sapiens
gtttaggctgagcgc

SEQ ID NO: 202682 - DNA, 15 bp, Homo sapiens
agtttaggctgagcg

SEQ ID NO: 202683 - DNA, 15 bp, Homo sapiens
aagtttaggctgagc

SEQ ID NO: 202684 - DNA, 15 bp, Homo sapiens
aaagtttaggctgag

SEQ ID NO: 202685 - DNA, 15 bp, Homo sapiens
aaaagtttaggctga

SEQ ID NO: 202686 - DNA, 15 bp, Homo sapiens
aaaaagtttaggctg

SEQ ID NO: 202687 - DNA, 15 bp, Homo sapiens
taaaaagtttaggct

SEQ ID NO: 202688 - DNA, 15 bp, Homo sapiens
ataaaaagtttaggc

SEQ ID NO: 202689 - DNA, 15 bp, Homo sapiens
tataaaaagtttagg

SEQ ID NO: 202690 - DNA, 15 bp, Homo sapiens
atataaaaagtttag

SEQ ID NO: 202691 - DNA, 15 bp, Homo sapiens
catataaaaagttta

SEQ ID NO: 202692 - DNA, 15 bp, Homo sapiens
gcatataaaaagttt

SEQ ID NO: 202693 - DNA, 15 bp, Homo sapiens
agcatataaaaagtt

SEQ ID NO: 202694 - DNA, 15 bp, Homo sapiens
tagcatataaaaagt

SEQ ID NO: 202695 - DNA, 15 bp, Homo sapiens
ttagcatataaaaag

SEQ ID NO: 202696 - DNA, 15 bp, Homo sapiens
tttagcatataaaaa

SEQ ID NO: 202697 - DNA, 15 bp, Homo sapiens
ttttagcatataaaa

SEQ ID NO: 202698 - DNA, 15 bp, Homo sapiens
attttagcatataaa

SEQ ID NO: 202699 - DNA, 15 bp, Homo sapiens
gattttagcatataa

SEQ ID NO: 202700 - DNA, 15 bp, Homo sapiens
ggattttagcatata

SEQ ID NO: 202701 - DNA, 15 bp, Homo sapiens
tggattttagcatat

SEQ ID NO: 202702 - DNA, 15 bp, Homo sapiens
ttggattttagcata

SEQ ID NO: 202703 - DNA, 15 bp, Homo sapiens
gttggattttagcat

SEQ ID NO: 202704 - DNA, 15 bp, Homo sapiens
tgttggattttagca

SEQ ID NO: 202705 - DNA, 15 bp, Homo sapiens
atgttggattttagc

SEQ ID NO: 202706 - DNA, 15 bp, Homo sapiens
catgttggattttag

SEQ ID NO: 202707 - DNA, 15 bp, Homo sapiens
gcatgttggatttta

SEQ ID NO: 202708 - DNA, 15 bp, Homo sapiens
agcatgttggatttt

SEQ ID NO: 202709 - DNA, 15 bp, Homo sapiens
tagcatgttggattt

SEQ ID NO: 202710 - DNA, 15 bp, Homo sapiens
gtagcatgttggatt

SEQ ID NO: 202711 - DNA, 15 bp, Homo sapiens
tgtagcatgttggat

SEQ ID NO: 202712 - DNA, 15 bp, Homo sapiens
atgtagcatgttgga

SEQ ID NO: 202713 - DNA, 15 bp, Homo sapiens
gatgtagcatgttgg

SEQ ID NO: 202714 - DNA, 15 bp, Homo sapiens
agatgtagcatgttg

SEQ ID NO: 202715 - DNA, 15 bp, Homo sapiens
gagatgtagcatgtt

SEQ ID NO: 202716 - DNA, 15 bp, Homo sapiens
ggagatgtagcatgt

SEQ ID NO: 202717 - DNA, 15 bp, Homo sapiens
aggagatgtagcatg

SEQ ID NO: 202718 - DNA, 15 bp, Homo sapiens
aaggagatgtagcat

SEQ ID NO: 202719 - DNA, 15 bp, Homo sapiens
aaaggagatgtagca

SEQ ID NO: 202720 - DNA, 15 bp, Homo sapiens
taaaggagatgtagc

SEQ ID NO: 202721 - DNA, 15 bp, Homo sapiens
ctaaaggagatgtag

SEQ ID NO: 202722 - DNA, 15 bp, Homo sapiens
gctaaaggagatgta

SEQ ID NO: 202723 - DNA, 15 bp, Homo sapiens
tgctaaaggagatgt

SEQ ID NO: 202724 - DNA, 15 bp, Homo sapiens
atgctaaaggagatg

SEQ ID NO: 202725 - DNA, 15 bp, Homo sapiens
gatgctaaaggagat

SEQ ID NO: 202726 - DNA, 15 bp, Homo sapiens
agatgctaaaggaga

SEQ ID NO: 202727 - DNA, 15 bp, Homo sapiens
tagatgctaaaggag

SEQ ID NO: 202728 - DNA, 15 bp, Homo sapiens
ttagatgctaaagga

SEQ ID NO: 202729 - DNA, 15 bp, Homo sapiens
tttagatgctaaagg

SEQ ID NO: 202730 - DNA, 15 bp, Homo sapiens
ttttagatgctaaag

SEQ ID NO: 202731 - DNA, 15 bp, Homo sapiens
gttttagatgctaaa

SEQ ID NO: 202732 - DNA, 15 bp, Homo sapiens
tgttttagatgctaa

SEQ ID NO: 202733 - DNA, 15 bp, Homo sapiens
ttgttttagatgcta

SEQ ID NO: 202734 - DNA, 15 bp, Homo sapiens
attgttttagatgct

SEQ ID NO: 202735 - DNA, 15 bp, Homo sapiens
tattgttttagatgc

SEQ ID NO: 202736 - DNA, 15 bp, Homo sapiens
gtattgttttagatg

SEQ ID NO: 202737 - DNA, 15 bp, Homo sapiens
tgtattgttttagat

SEQ ID NO: 202738 - DNA, 15 bp, Homo sapiens
atgtattgttttaga

SEQ ID NO: 202739 - DNA, 15 bp, Homo sapiens
tatgtattgttttag

SEQ ID NO: 202740 - DNA, 15 bp, Homo sapiens
gtatgtattgtttta

SEQ ID NO: 202741 - DNA, 15 bp, Homo sapiens
tgtatgtattgtttt

SEQ ID NO: 202742 - DNA, 15 bp, Homo sapiens
ttgtatgtattgttt

SEQ ID NO: 202743 - DNA, 15 bp, Homo sapiens
attgtatgtattgtt

SEQ ID NO: 202744 - DNA, 15 bp, Homo sapiens
cattgtatgtattgt

SEQ ID NO: 202745 - DNA, 15 bp, Homo sapiens
tcattgtatgtattg

SEQ ID NO: 202746 - DNA, 15 bp, Homo sapiens
atcattgtatgtatt

SEQ ID NO: 202747 - DNA, 15 bp, Homo sapiens
tatcattgtatgtat

SEQ ID NO: 202748 - DNA, 15 bp, Homo sapiens
ttatcattgtatgta

SEQ ID NO: 202749 - DNA, 15 bp, Homo sapiens
tttatcattgtatgt

SEQ ID NO: 202750 - DNA, 15 bp, Homo sapiens
atttatcattgtatg

SEQ ID NO: 202751 - DNA, 15 bp, Homo sapiens
aatttatcattgtat

SEQ ID NO: 202752 - DNA, 15 bp, Homo sapiens
aaatttatcattgta

SEQ ID NO: 202753 - DNA, 15 bp, Homo sapiens
gaaatttatcattgt

SEQ ID NO: 202754 - DNA, 15 bp, Homo sapiens
tgaaatttatcattg

SEQ ID NO: 202755 - DNA, 15 bp, Homo sapiens
gtgaaatttatcatt

SEQ ID NO: 202756 - DNA, 15 bp, Homo sapiens
agtgaaatttatcat

SEQ ID NO: 202757 - DNA, 15 bp, Homo sapiens
aagtgaaatttatca

SEQ ID NO: 202758 - DNA, 15 bp, Homo sapiens
gaagtgaaatttatc

SEQ ID NO: 202759 - DNA, 15 bp, Homo sapiens
tgaagtgaaatttat

SEQ ID NO: 202760 - DNA, 15 bp, Homo sapiens
ttgaagtgaaattta

SEQ ID NO: 202761 - DNA, 15 bp, Homo sapiens
attgaagtgaaattt

SEQ ID NO: 202762 - DNA, 15 bp, Homo sapiens
gattgaagtgaaatt

SEQ ID NO: 202763 - DNA, 15 bp, Homo sapiens
agattgaagtgaaat

SEQ ID NO: 202764 - DNA, 15 bp, Homo sapiens
cagattgaagtgaaa

SEQ ID NO: 202765 - DNA, 15 bp, Homo sapiens
acagattgaagtgaa

SEQ ID NO: 202766 - DNA, 15 bp, Homo sapiens
tacagattgaagtga

SEQ ID NO: 202767 - DNA, 15 bp, Homo sapiens
gtacagattgaagtg

SEQ ID NO: 202768 - DNA, 15 bp, Homo sapiens
tgtacagattgaagt

SEQ ID NO: 202769 - DNA, 15 bp, Homo sapiens
ttgtacagattgaag

SEQ ID NO: 202770 - DNA, 15 bp, Homo sapiens
cttgtacagattgaa

SEQ ID NO: 202771 - DNA, 15 bp, Homo sapiens
tcttgtacagattga

SEQ ID NO: 202772 - DNA, 15 bp, Homo sapiens
ctcttgtacagattg

SEQ ID NO: 202773 - DNA, 15 bp, Homo sapiens
tctcttgtacagatt

SEQ ID NO: 202774 - DNA, 15 bp, Homo sapiens
ttctcttgtacagat

SEQ ID NO: 202775 - DNA, 15 bp, Homo sapiens
cttctcttgtacaga

SEQ ID NO: 202776 - DNA, 15 bp, Homo sapiens
tcttctcttgtacag

SEQ ID NO: 202777 - DNA, 15 bp, Homo sapiens
ttcttctcttgtaca

SEQ ID NO: 202778 - DNA, 15 bp, Homo sapiens
attcttctcttgtac

SEQ ID NO: 202779 - DNA, 15 bp, Homo sapiens
cattcttctcttgta

SEQ ID NO: 202780 - DNA, 15 bp, Homo sapiens
gcattcttctcttgt

SEQ ID NO: 202781 - DNA, 15 bp, Homo sapiens
agcattcttctcttg

SEQ ID NO: 202782 - DNA, 15 bp, Homo sapiens
tagcattcttctctt

SEQ ID NO: 202783 - DNA, 15 bp, Homo sapiens
ttagcattcttctct

SEQ ID NO: 202784 - DNA, 15 bp, Homo sapiens
attagcattcttctc

SEQ ID NO: 202785 - DNA, 15 bp, Homo sapiens
cattagcattcttct

SEQ ID NO: 202786 - DNA, 15 bp, Homo sapiens
tcattagcattcttc

SEQ ID NO: 202787 - DNA, 15 bp, Homo sapiens
atcattagcattctt

SEQ ID NO: 202788 - DNA, 15 bp, Homo sapiens
aatcattagcattct

SEQ ID NO: 202789 - DNA, 15 bp, Homo sapiens
aaatcattagcattc

SEQ ID NO: 202790 - DNA, 15 bp, Homo sapiens
caaatcattagcatt

SEQ ID NO: 202791 - DNA, 15 bp, Homo sapiens
tcaaatcattagcat

SEQ ID NO: 202792 - DNA, 15 bp, Homo sapiens
ttcaaatcattagca

SEQ ID NO: 202793 - DNA, 15 bp, Homo sapiens
tttcaaatcattagc

SEQ ID NO: 202794 - DNA, 15 bp, Homo sapiens
gtttcaaatcattag

SEQ ID NO: 202795 - DNA, 15 bp, Homo sapiens
cgtttcaaatcatta

SEQ ID NO: 202796 - DNA, 15 bp, Homo sapiens
acgtttcaaatcatt

SEQ ID NO: 202797 - DNA, 15 bp, Homo sapiens
gacgtttcaaatcat

SEQ ID NO: 202798 - DNA, 15 bp, Homo sapiens
tgacgtttcaaatca

SEQ ID NO: 202799 - DNA, 15 bp, Homo sapiens
ctgacgtttcaaatc

SEQ ID NO: 202800 - DNA, 15 bp, Homo sapiens
gctgacgtttcaaat

SEQ ID NO: 202801 - DNA, 15 bp, Homo sapiens
agctgacgtttcaaa

SEQ ID NO: 202802 - DNA, 15 bp, Homo sapiens
tagctgacgtttcaa

SEQ ID NO: 202803 - DNA, 15 bp, Homo sapiens
ctagctgacgtttca

SEQ ID NO: 202804 - DNA, 15 bp, Homo sapiens
tctagctgacgtttc

SEQ ID NO: 202805 - DNA, 15 bp, Homo sapiens
ttctagctgacgttt

SEQ ID NO: 202806 - DNA, 15 bp, Homo sapiens
cttctagctgacgtt

SEQ ID NO: 202807 - DNA, 15 bp, Homo sapiens
tcttctagctgacgt

SEQ ID NO: 202808 - DNA, 15 bp, Homo sapiens
gtcttctagctgacg

SEQ ID NO: 202809 - DNA, 15 bp, Homo sapiens
tgtcttctagctgac

SEQ ID NO: 202810 - DNA, 15 bp, Homo sapiens
ctgtcttctagctga

SEQ ID NO: 202811 - DNA, 15 bp, Homo sapiens
cctgtcttctagctg

SEQ ID NO: 202812 - DNA, 15 bp, Homo sapiens
gcctgtcttctagct

SEQ ID NO: 202813 - DNA, 15 bp, Homo sapiens
agcctgtcttctagc

SEQ ID NO: 202814 - DNA, 15 bp, Homo sapiens
cagcctgtcttctag

SEQ ID NO: 202815 - DNA, 15 bp, Homo sapiens
acagcctgtcttcta

SEQ ID NO: 202816 - DNA, 15 bp, Homo sapiens
gacagcctgtcttct

SEQ ID NO: 202817 - DNA, 15 bp, Homo sapiens
tgacagcctgtcttc

SEQ ID NO: 202818 - DNA, 15 bp, Homo sapiens
ctgacagcctgtctt

SEQ ID NO: 202819 - DNA, 15 bp, Homo sapiens
cctgacagcctgtct

SEQ ID NO: 202820 - DNA, 15 bp, Homo sapiens
tcctgacagcctgtc

SEQ ID NO: 202821 - DNA, 15 bp, Homo sapiens
ttcctgacagcctgt

SEQ ID NO: 202822 - DNA, 15 bp, Homo sapiens
gttcctgacagcctg

SEQ ID NO: 202823 - DNA, 15 bp, Homo sapiens
agttcctgacagcct

SEQ ID NO: 202824 - DNA, 15 bp, Homo sapiens
aagttcctgacagcc

SEQ ID NO: 202825 - DNA, 15 bp, Homo sapiens
aaagttcctgacagc

SEQ ID NO: 202826 - DNA, 15 bp, Homo sapiens
aaaagttcctgacag

SEQ ID NO: 202827 - DNA, 15 bp, Homo sapiens
taaaagttcctgaca

SEQ ID NO: 202828 - DNA, 15 bp, Homo sapiens
ataaaagttcctgac

SEQ ID NO: 202829 - DNA, 15 bp, Homo sapiens
aataaaagttcctga

SEQ ID NO: 202830 - DNA, 15 bp, Homo sapiens
taataaaagttcctg

SEQ ID NO: 202831 - DNA, 15 bp, Homo sapiens
ataataaaagttcct

SEQ ID NO: 202832 - DNA, 15 bp, Homo sapiens
tataataaaagttcc

SEQ ID NO: 202833 - DNA, 15 bp, Homo sapiens
atataataaaagttc

SEQ ID NO: 202834 - DNA, 15 bp, Homo sapiens
aatataataaaagtt

SEQ ID NO: 202835 - DNA, 15 bp, Homo sapiens
aaatataataaaagt

SEQ ID NO: 202836 - DNA, 15 bp, Homo sapiens
aaaatataataaaag

SEQ ID NO: 202837 - DNA, 15 bp, Homo sapiens
aaaaatataataaaa

SEQ ID NO: 202838 - DNA, 15 bp, Homo sapiens
aaaaaatataataaa

SEQ ID NO: 202839 - DNA, 15 bp, Homo sapiens
taaaaaatataataa

SEQ ID NO: 202840 - DNA, 15 bp, Homo sapiens
gtaaaaaatataata

SEQ ID NO: 202841 - DNA, 15 bp, Homo sapiens
agtaaaaaatataat

SEQ ID NO: 202842 - DNA, 15 bp, Homo sapiens
gagtaaaaaatataa

SEQ ID NO: 202843 - DNA, 15 bp, Homo sapiens
tgagtaaaaaatata

SEQ ID NO: 202844 - DNA, 15 bp, Homo sapiens
gtgagtaaaaaatat

SEQ ID NO: 202845 - DNA, 15 bp, Homo sapiens
agtgagtaaaaaata

SEQ ID NO: 202846 - DNA, 15 bp, Homo sapiens
cagtgagtaaaaaat

SEQ ID NO: 202847 - DNA, 15 bp, Homo sapiens
ccagtgagtaaaaaa

SEQ ID NO: 202848 - DNA, 15 bp, Homo sapiens
tccagtgagtaaaaa

SEQ ID NO: 202849 - DNA, 15 bp, Homo sapiens
ttccagtgagtaaaa

SEQ ID NO: 202850 - DNA, 15 bp, Homo sapiens
tttccagtgagtaaa

SEQ ID NO: 202851 - DNA, 15 bp, Homo sapiens
ttttccagtgagtaa

SEQ ID NO: 202852 - DNA, 15 bp, Homo sapiens
tttttccagtgagta

SEQ ID NO: 202853 - DNA, 15 bp, Homo sapiens
atttttccagtgagt

SEQ ID NO: 202854 - DNA, 15 bp, Homo sapiens
tatttttccagtgag

SEQ ID NO: 202855 - DNA, 15 bp, Homo sapiens
atatttttccagtga

SEQ ID NO: 202856 - DNA, 15 bp, Homo sapiens
catatttttccagtg

SEQ ID NO: 202857 - DNA, 15 bp, Homo sapiens
tcatatttttccagt

SEQ ID NO: 202858 - DNA, 15 bp, Homo sapiens
ttcatatttttccag

SEQ ID NO: 202859 - DNA, 15 bp, Homo sapiens
attcatatttttcca

SEQ ID NO: 202860 - DNA, 15 bp, Homo sapiens
aattcatatttttcc

SEQ ID NO: 202861 - DNA, 15 bp, Homo sapiens
caattcatatttttc

SEQ ID NO: 202862 - DNA, 15 bp, Homo sapiens
ccaattcatattttt

SEQ ID NO: 202863 - DNA, 15 bp, Homo sapiens
tccaattcatatttt

SEQ ID NO: 202864 - DNA, 15 bp, Homo sapiens
ttccaattcatattt

SEQ ID NO: 202865 - DNA, 15 bp, Homo sapiens
tttccaattcatatt

SEQ ID NO: 202866 - DNA, 15 bp, Homo sapiens
atttccaattcatat

SEQ ID NO: 202867 - DNA, 15 bp, Homo sapiens
tatttccaattcata

SEQ ID NO: 202868 - DNA, 15 bp, Homo sapiens
gtatttccaattcat

SEQ ID NO: 202869 - DNA, 15 bp, Homo sapiens
tgtatttccaattca

SEQ ID NO: 202870 - DNA, 15 bp, Homo sapiens
gtgtatttccaattc

SEQ ID NO: 202871 - DNA, 15 bp, Homo sapiens
agtgtatttccaatt

SEQ ID NO: 202872 - DNA, 15 bp, Homo sapiens
tagtgtatttccaat

SEQ ID NO: 202873 - DNA, 15 bp, Homo sapiens
ttagtgtatttccaa

SEQ ID NO: 202874 - DNA, 15 bp, Homo sapiens
attagtgtatttcca

SEQ ID NO: 202875 - DNA, 15 bp, Homo sapiens
tattagtgtatttcc

SEQ ID NO: 202876 - DNA, 15 bp, Homo sapiens
ttattagtgtatttc

SEQ ID NO: 202877 - DNA, 15 bp, Homo sapiens
cttattagtgtattt

SEQ ID NO: 202878 - DNA, 15 bp, Homo sapiens
acttattagtgtatt

SEQ ID NO: 202879 - DNA, 15 bp, Homo sapiens
aacttattagtgtat

SEQ ID NO: 202880 - DNA, 15 bp, Homo sapiens
gaacttattagtgta

SEQ ID NO: 202881 - DNA, 15 bp, Homo sapiens
agaacttattagtgt

SEQ ID NO: 202882 - DNA, 15 bp, Homo sapiens
gagaacttattagtg

SEQ ID NO: 202883 - DNA, 15 bp, Homo sapiens
agagaacttattagt

SEQ ID NO: 202884 - DNA, 15 bp, Homo sapiens
cagagaacttattag

SEQ ID NO: 202885 - DNA, 15 bp, Homo sapiens
gcagagaacttatta

SEQ ID NO: 202886 - DNA, 15 bp, Homo sapiens
agcagagaacttatt

SEQ ID NO: 202887 - DNA, 15 bp, Homo sapiens
cagcagagaacttat

SEQ ID NO: 202888 - DNA, 15 bp, Homo sapiens
acagcagagaactta

SEQ ID NO: 202889 - DNA, 15 bp, Homo sapiens
cacagcagagaactt

SEQ ID NO: 202890 - DNA, 15 bp, Homo sapiens
ccacagcagagaact

SEQ ID NO: 202891 - DNA, 15 bp, Homo sapiens
tccacagcagagaac

SEQ ID NO: 202892 - DNA, 15 bp, Homo sapiens
atccacagcagagaa

SEQ ID NO: 202893 - DNA, 15 bp, Homo sapiens
tatccacagcagaga

SEQ ID NO: 202894 - DNA, 15 bp, Homo sapiens
ttatccacagcagag

SEQ ID NO: 202895 - DNA, 15 bp, Homo sapiens
gttatccacagcaga

SEQ ID NO: 202896 - DNA, 15 bp, Homo sapiens
tgttatccacagcag

SEQ ID NO: 202897 - DNA, 15 bp, Homo sapiens
atgttatccacagca

SEQ ID NO: 202898 - DNA, 15 bp, Homo sapiens
catgttatccacagc

SEQ ID NO: 202899 - DNA, 15 bp, Homo sapiens
ccatgttatccacag

SEQ ID NO: 202900 - DNA, 15 bp, Homo sapiens
cccatgttatccaca

SEQ ID NO: 202901 - DNA, 15 bp, Homo sapiens
acccatgttatccac

SEQ ID NO: 202902 - DNA, 15 bp, Homo sapiens
aacccatgttatcca

SEQ ID NO: 202903 - DNA, 15 bp, Homo sapiens
aaacccatgttatcc

SEQ ID NO: 202904 - DNA, 15 bp, Homo sapiens
taaacccatgttatc

SEQ ID NO: 202905 - DNA, 15 bp, Homo sapiens
ttaaacccatgttat

SEQ ID NO: 202906 - DNA, 15 bp, Homo sapiens
tttaaacccatgtta

SEQ ID NO: 202907 - DNA, 15 bp, Homo sapiens
atttaaacccatgtt

SEQ ID NO: 202908 - DNA, 15 bp, Homo sapiens
aatttaaacccatgt

SEQ ID NO: 202909 - DNA, 15 bp, Homo sapiens
aaatttaaacccatg

SEQ ID NO: 202910 - DNA, 15 bp, Homo sapiens
aaaatttaaacccat

SEQ ID NO: 202911 - DNA, 15 bp, Homo sapiens
gaaaatttaaaccca

SEQ ID NO: 202912 - DNA, 15 bp, Homo sapiens
tgaaaatttaaaccc

SEQ ID NO: 202913 - DNA, 15 bp, Homo sapiens
atgaaaatttaaacc

SEQ ID NO: 202914 - DNA, 15 bp, Homo sapiens
catgaaaatttaaac

SEQ ID NO: 202915 - DNA, 15 bp, Homo sapiens
acatgaaaatttaaa

SEQ ID NO: 202916 - DNA, 15 bp, Homo sapiens
aacatgaaaatttaa

SEQ ID NO: 202917 - DNA, 15 bp, Homo sapiens
taacatgaaaattta

SEQ ID NO: 202918 - DNA, 15 bp, Homo sapiens
ttaacatgaaaattt

SEQ ID NO: 202919 - DNA, 15 bp, Homo sapiens
tttaacatgaaaatt

SEQ ID NO: 202920 - DNA, 15 bp, Homo sapiens
gtttaacatgaaaat

SEQ ID NO: 202921 - DNA, 15 bp, Homo sapiens
agtttaacatgaaaa

SEQ ID NO: 202922 - DNA, 15 bp, Homo sapiens
aagtttaacatgaaa

SEQ ID NO: 202923 - DNA, 15 bp, Homo sapiens
taagtttaacatgaa

SEQ ID NO: 202924 - DNA, 15 bp, Homo sapiens
ataagtttaacatga

SEQ ID NO: 202925 - DNA, 15 bp, Homo sapiens
aataagtttaacatg

SEQ ID NO: 202926 - DNA, 15 bp, Homo sapiens
aaataagtttaacat

SEQ ID NO: 202927 - DNA, 15 bp, Homo sapiens
taaataagtttaaca

SEQ ID NO: 202928 - DNA, 15 bp, Homo sapiens
ttaaataagtttaac

SEQ ID NO: 202929 - DNA, 15 bp, Homo sapiens
attaaataagtttaa

SEQ ID NO: 202930 - DNA, 15 bp, Homo sapiens
aattaaataagttta

SEQ ID NO: 202931 - DNA, 15 bp, Homo sapiens
aaattaaataagttt

SEQ ID NO: 202932 - DNA, 15 bp, Homo sapiens
caaattaaataagtt

SEQ ID NO: 202933 - DNA, 15 bp, Homo sapiens
tcaaattaaataagt

SEQ ID NO: 202934 - DNA, 15 bp, Homo sapiens
ctcaaattaaataag

SEQ ID NO: 202935 - DNA, 15 bp, Homo sapiens
tctcaaattaaataa

SEQ ID NO: 202936 - DNA, 15 bp, Homo sapiens
atctcaaattaaata

SEQ ID NO: 202937 - DNA, 15 bp, Homo sapiens
aatctcaaattaaat

SEQ ID NO: 202938 - DNA, 15 bp, Homo sapiens
caatctcaaattaaa

SEQ ID NO: 202939 - DNA, 15 bp, Homo sapiens
acaatctcaaattaa

SEQ ID NO: 202940 - DNA, 15 bp, Homo sapiens
gacaatctcaaatta

SEQ ID NO: 202941 - DNA, 15 bp, Homo sapiens
agacaatctcaaatt

SEQ ID NO: 202942 - DNA, 15 bp, Homo sapiens
aagacaatctcaaat

SEQ ID NO: 202943 - DNA, 15 bp, Homo sapiens
taagacaatctcaaa

SEQ ID NO: 202944 - DNA, 15 bp, Homo sapiens
ttaagacaatctcaa

SEQ ID NO: 202945 - DNA, 15 bp, Homo sapiens
attaagacaatctca

SEQ ID NO: 202946 - DNA, 15 bp, Homo sapiens
aattaagacaatctc

SEQ ID NO: 202947 - DNA, 15 bp, Homo sapiens
taattaagacaatct

SEQ ID NO: 202948 - DNA, 15 bp, Homo sapiens
ttaattaagacaatc

SEQ ID NO: 202949 - DNA, 15 bp, Homo sapiens
tttaattaagacaat

SEQ ID NO: 202950 - DNA, 15 bp, Homo sapiens
atttaattaagacaa

SEQ ID NO: 202951 - DNA, 15 bp, Homo sapiens
tatttaattaagaca

SEQ ID NO: 202952 - DNA, 15 bp, Homo sapiens
atatttaattaagac

SEQ ID NO: 202953 - DNA, 15 bp, Homo sapiens
gatatttaattaaga

SEQ ID NO: 202954 - DNA, 15 bp, Homo sapiens
ggatatttaattaag

SEQ ID NO: 202955 - DNA, 15 bp, Homo sapiens
tggatatttaattaa

SEQ ID NO: 202956 - DNA, 15 bp, Homo sapiens
atggatatttaatta

SEQ ID NO: 202957 - DNA, 15 bp, Homo sapiens
aatggatatttaatt

SEQ ID NO: 202958 - DNA, 15 bp, Homo sapiens
aaatggatatttaat

SEQ ID NO: 202959 - DNA, 15 bp, Homo sapiens
taaatggatatttaa

SEQ ID NO: 202960 - DNA, 15 bp, Homo sapiens
ataaatggatattta

SEQ ID NO: 202961 - DNA, 15 bp, Homo sapiens
gataaatggatattt

SEQ ID NO: 202962 - DNA, 15 bp, Homo sapiens
tgataaatggatatt

SEQ ID NO: 202963 - DNA, 15 bp, Homo sapiens
ctgataaatggatat

SEQ ID NO: 202964 - DNA, 15 bp, Homo sapiens
gctgataaatggata

SEQ ID NO: 202965 - DNA, 15 bp, Homo sapiens
tgctgataaatggat

SEQ ID NO: 202966 - DNA, 15 bp, Homo sapiens
atgctgataaatgga

SEQ ID NO: 202967 - DNA, 15 bp, Homo sapiens
tatgctgataaatgg

SEQ ID NO: 202968 - DNA, 15 bp, Homo sapiens
ttatgctgataaatg

SEQ ID NO: 202969 - DNA, 15 bp, Homo sapiens
attatgctgataaat

SEQ ID NO: 202970 - DNA, 15 bp, Homo sapiens
cattatgctgataaa

SEQ ID NO: 202971 - DNA, 15 bp, Homo sapiens
tcattatgctgataa

SEQ ID NO: 202972 - DNA, 15 bp, Homo sapiens
atcattatgctgata

SEQ ID NO: 202973 - DNA, 15 bp, Homo sapiens
catcattatgctgat

SEQ ID NO: 202974 - DNA, 15 bp, Homo sapiens
acatcattatgctga

SEQ ID NO: 202975 - DNA, 15 bp, Homo sapiens
aacatcattatgctg

SEQ ID NO: 202976 - DNA, 15 bp, Homo sapiens
aaacatcattatgct

SEQ ID NO: 202977 - DNA, 15 bp, Homo sapiens
taaacatcattatgc

SEQ ID NO: 202978 - DNA, 15 bp, Homo sapiens
ttaaacatcattatg

SEQ ID NO: 202979 - DNA, 15 bp, Homo sapiens
attaaacatcattat

SEQ ID NO: 202980 - DNA, 15 bp, Homo sapiens
tattaaacatcatta

SEQ ID NO: 202981 - DNA, 15 bp, Homo sapiens
atattaaacatcatt

SEQ ID NO: 202982 - DNA, 15 bp, Homo sapiens
tatattaaacatcat

SEQ ID NO: 202983 - DNA, 15 bp, Homo sapiens
ctatattaaacatca

SEQ ID NO: 202984 - DNA, 15 bp, Homo sapiens
tctatattaaacatc

SEQ ID NO: 202985 - DNA, 15 bp, Homo sapiens
atctatattaaacat

SEQ ID NO: 202986 - DNA, 15 bp, Homo sapiens
gatctatattaaaca

SEQ ID NO: 202987 - DNA, 15 bp, Homo sapiens
agatctatattaaac

SEQ ID NO: 202988 - DNA, 15 bp, Homo sapiens
aagatctatattaaa

SEQ ID NO: 202989 - DNA, 15 bp, Homo sapiens
aaagatctatattaa

SEQ ID NO: 202990 - DNA, 15 bp, Homo sapiens
taaagatctatatta

SEQ ID NO: 202991 - DNA, 15 bp, Homo sapiens
ataaagatctatatt

SEQ ID NO: 202992 - DNA, 15 bp, Homo sapiens
aataaagatctatat

SEQ ID NO: 202993 - DNA, 15 bp, Homo sapiens
taataaagatctata

SEQ ID NO: 202994 - DNA, 15 bp, Homo sapiens
ttaataaagatctat

SEQ ID NO: 202995 - DNA, 15 bp, Homo sapiens
gttaataaagatcta

SEQ ID NO: 202996 - DNA, 15 bp, Homo sapiens
tgttaataaagatct

SEQ ID NO: 202997 - DNA, 15 bp, Homo sapiens
atgttaataaagatc

SEQ ID NO: 202998 - DNA, 15 bp, Homo sapiens
catgttaataaagat

SEQ ID NO: 202999 - DNA, 15 bp, Homo sapiens
ccatgttaataaaga

SEQ ID NO: 203000 - DNA, 15 bp, Homo sapiens
accatgttaataaag

SEQ ID NO: 203001 - DNA, 15 bp, Homo sapiens
aaccatgttaataaa

SEQ ID NO: 203002 - DNA, 15 bp, Homo sapiens
aaaccatgttaataa

SEQ ID NO: 203003 - DNA, 15 bp, Homo sapiens
tgaaaccatgttaat

SEQ ID NO: 203004 - DNA, 15 bp, Homo sapiens
ttgaaaccatgttaa

SEQ ID NO: 203005 - DNA, 15 bp, Homo sapiens
tttgaaaccatgtta

SEQ ID NO: 203006 - DNA, 15 bp, Homo sapiens
ctttgaaaccatgtt

SEQ ID NO: 203007 - DNA, 15 bp, Homo sapiens
cctttgaaaccatgt

SEQ ID NO: 203008 - DNA, 15 bp, Homo sapiens
gcctttgaaaccatg

SEQ ID NO: 203009 - DNA, 15 bp, Homo sapiens
ggcctttgaaaccat

SEQ ID NO: 203010 - DNA, 15 bp, Homo sapiens
tggcctttgaaacca

SEQ ID NO: 203011 - DNA, 15 bp, Homo sapiens
ctggcctttgaaacc

SEQ ID NO: 203012 - DNA, 15 bp, Homo sapiens
actggcctttgaaac

SEQ ID NO: 203013 - DNA, 15 bp, Homo sapiens
tactggcctttgaaa

SEQ ID NO: 203014 - DNA, 15 bp, Homo sapiens
ttactggcctttgaa

SEQ ID NO: 203015 - DNA, 15 bp, Homo sapiens
tttactggcctttga

SEQ ID NO: 203016 - DNA, 15 bp, Homo sapiens
ttttactggcctttg

SEQ ID NO: 203017 - DNA, 15 bp, Homo sapiens
attttactggccttt

SEQ ID NO: 203018 - DNA, 15 bp, Homo sapiens
aattttactggcctt

SEQ ID NO: 203019 - DNA, 15 bp, Homo sapiens
caattttactggcct

SEQ ID NO: 203020 - DNA, 15 bp, Homo sapiens
acaattttactggcc

SEQ ID NO: 203021 - DNA, 15 bp, Homo sapiens
gacaattttactggc

SEQ ID NO: 203022 - DNA, 15 bp, Homo sapiens
tgacaattttactgg

SEQ ID NO: 203023 - DNA, 15 bp, Homo sapiens
ttgacaattttactg

SEQ ID NO: 203024 - DNA, 15 bp, Homo sapiens
tttgacaattttact

SEQ ID NO: 203025 - DNA, 15 bp, Homo sapiens
atttgacaattttac

SEQ ID NO: 203026 - DNA, 15 bp, Homo sapiens
gatttgacaatttta

SEQ ID NO: 203027 - DNA, 15 bp, Homo sapiens
agatttgacaatttt

SEQ ID NO: 203028 - DNA, 15 bp, Homo sapiens
tagatttgacaattt

SEQ ID NO: 203029 - DNA, 15 bp, Homo sapiens
ttagatttgacaatt

SEQ ID NO: 203030 - DNA, 15 bp, Homo sapiens
attagatttgacaat

SEQ ID NO: 203031 - DNA, 15 bp, Homo sapiens
cattagatttgacaa

SEQ ID NO: 203032 - DNA, 15 bp, Homo sapiens
tcattagatttgaca

SEQ ID NO: 203033 - DNA, 15 bp, Homo sapiens
ttcattagatttgac

SEQ ID NO: 203034 - DNA, 15 bp, Homo sapiens
tttcattagatttga

SEQ ID NO: 203035 - DNA, 15 bp, Homo sapiens
ttttcattagatttg

SEQ ID NO: 203036 - DNA, 15 bp, Homo sapiens
gttttcattagattt

SEQ ID NO: 203037 - DNA, 15 bp, Homo sapiens
tgttttcattagatt

SEQ ID NO: 203038 - DNA, 15 bp, Homo sapiens
ctgttttcattagat

SEQ ID NO: 203039 - DNA, 15 bp, Homo sapiens
tctgttttcattaga

SEQ ID NO: 203040 - DNA, 15 bp, Homo sapiens
ctctgttttcattag

SEQ ID NO: 203041 - DNA, 15 bp, Homo sapiens
actctgttttcatta

SEQ ID NO: 203042 - DNA, 15 bp, Homo sapiens
aactctgttttcatt

SEQ ID NO: 203043 - DNA, 15 bp, Homo sapiens
gaactctgttttcat

SEQ ID NO: 203044 - DNA, 15 bp, Homo sapiens
tgaactctgttttca

SEQ ID NO: 203045 - DNA, 15 bp, Homo sapiens
ttgaactctgttttc

SEQ ID NO: 203046 - DNA, 15 bp, Homo sapiens
tttgaactctgtttt

SEQ ID NO: 203047 - DNA, 15 bp, Homo sapiens
ctttgaactctgttt

SEQ ID NO: 203048 - DNA, 15 bp, Homo sapiens
tctttgaactctgtt

SEQ ID NO: 203049 - DNA, 15 bp, Homo sapiens
atctttgaactctgt

SEQ ID NO: 203050 - DNA, 15 bp, Homo sapiens
tatctttgaactctg

SEQ ID NO: 203051 - DNA, 15 bp, Homo sapiens
ttatctttgaactct

SEQ ID NO: 203052 - DNA, 15 bp, Homo sapiens
tttatctttgaactc

SEQ ID NO: 203053 - DNA, 15 bp, Homo sapiens
ttttatctttgaact

SEQ ID NO: 203054 - DNA, 15 bp, Homo sapiens
attttatctttgaac

SEQ ID NO: 203055 - DNA, 15 bp, Homo sapiens
aattttatctttgaa

SEQ ID NO: 203056 - DNA, 15 bp, Homo sapiens
gaattttatctttga

SEQ ID NO: 203057 - DNA, 15 bp, Homo sapiens
agaattttatctttg

SEQ ID NO: 203058 - DNA, 15 bp, Homo sapiens
tagaattttatcttt

SEQ ID NO: 203059 - DNA, 15 bp, Homo sapiens
atagaattttatctt

SEQ ID NO: 203060 - DNA, 15 bp, Homo sapiens
gatagaattttatct

SEQ ID NO: 203061 - DNA, 15 bp, Homo sapiens
agatagaattttatc

SEQ ID NO: 203062 - DNA, 15 bp, Homo sapiens
aagatagaattttat

SEQ ID NO: 203063 - DNA, 15 bp, Homo sapiens
gaagatagaatttta

SEQ ID NO: 203064 - DNA, 15 bp, Homo sapiens
ggaagatagaatttt

SEQ ID NO: 203065 - DNA, 15 bp, Homo sapiens
gggaagatagaattt

SEQ ID NO: 203066 - DNA, 15 bp, Homo sapiens
agggaagatagaatt

SEQ ID NO: 203067 - DNA, 15 bp, Homo sapiens
aagggaagatagaat

SEQ ID NO: 203068 - DNA, 15 bp, Homo sapiens
aaagggaagatagaa

SEQ ID NO: 203069 - DNA, 15 bp, Homo sapiens
gaaagggaagataga

SEQ ID NO: 203070 - DNA, 15 bp, Homo sapiens
agaaagggaagatag

SEQ ID NO: 203071 - DNA, 15 bp, Homo sapiens
aagaaagggaagata

SEQ ID NO: 203072 - DNA, 15 bp, Homo sapiens
aaagaaagggaagat

SEQ ID NO: 203073 - DNA, 15 bp, Homo sapiens
aaaagaaagggaaga

SEQ ID NO: 203074 - DNA, 15 bp, Homo sapiens
taaaagaaagggaag

SEQ ID NO: 203075 - DNA, 15 bp, Homo sapiens
ataaaagaaagggaa

SEQ ID NO: 203076 - DNA, 15 bp, Homo sapiens
cataaaagaaaggga

SEQ ID NO: 203077 - DNA, 15 bp, Homo sapiens
tcataaaagaaaggg

SEQ ID NO: 203078 - DNA, 15 bp, Homo sapiens
ctcataaaagaaagg

SEQ ID NO: 203079 - DNA, 15 bp, Homo sapiens
actcataaaagaaag

SEQ ID NO: 203080 - DNA, 15 bp, Homo sapiens
gactcataaaagaaa

SEQ ID NO: 203081 - DNA, 15 bp, Homo sapiens
agactcataaaagaa

SEQ ID NO: 203082 - DNA, 15 bp, Homo sapiens
tagactcataaaaga

SEQ ID NO: 203083 - DNA, 15 bp, Homo sapiens
atagactcataaaag

SEQ ID NO: 203084 - DNA, 15 bp, Homo sapiens
aatagactcataaaa

SEQ ID NO: 203085 - DNA, 15 bp, Homo sapiens
taatagactcataaa

SEQ ID NO: 203086 - DNA, 15 bp, Homo sapiens
ttaatagactcataa

SEQ ID NO: 203087 - DNA, 15 bp, Homo sapiens
tttaatagactcata

SEQ ID NO: 203088 - DNA, 15 bp, Homo sapiens
ttttaatagactcat

SEQ ID NO: 203089 - DNA, 15 bp, Homo sapiens
tttttaatagactca

SEQ ID NO: 203090 - DNA, 15 bp, Homo sapiens
atttttaatagactc

SEQ ID NO: 203091 - DNA, 15 bp, Homo sapiens
aatttttaatagact

SEQ ID NO: 203092 - DNA, 15 bp, Homo sapiens
gaatttttaatagac

SEQ ID NO: 203093 - DNA, 15 bp, Homo sapiens
tgaatttttaataga

SEQ ID NO: 203094 - DNA, 15 bp, Homo sapiens
ctgaatttttaatag

SEQ ID NO: 203095 - DNA, 15 bp, Homo sapiens
cctgaatttttaata

SEQ ID NO: 203096 - DNA, 15 bp, Homo sapiens
ccctgaatttttaat

SEQ ID NO: 203097 - DNA, 15 bp, Homo sapiens
gccctgaatttttaa

SEQ ID NO: 203098 - DNA, 15 bp, Homo sapiens
tgccctgaattttta

SEQ ID NO: 203099 - DNA, 15 bp, Homo sapiens
gtgccctgaattttt

SEQ ID NO: 203100 - DNA, 15 bp, Homo sapiens
ggtgccctgaatttt

SEQ ID NO: 203101 - DNA, 15 bp, Homo sapiens
aggtgccctgaattt

SEQ ID NO: 203102 - DNA, 15 bp, Homo sapiens
aaggtgccctgaatt

SEQ ID NO: 203103 - DNA, 15 bp, Homo sapiens
aaaggtgccctgaat

SEQ ID NO: 203104 - DNA, 15 bp, Homo sapiens
aaaaggtgccctgaa

SEQ ID NO: 203105 - DNA, 15 bp, Homo sapiens
aaaaaggtgccctga

SEQ ID NO: 203106 - DNA, 15 bp, Homo sapiens
taaaaaggtgccctg

SEQ ID NO: 203107 - DNA, 15 bp, Homo sapiens
ttaaaaaggtgccct

SEQ ID NO: 203108 - DNA, 15 bp, Homo sapiens
tttaaaaaggtgccc

SEQ ID NO: 203109 - DNA, 15 bp, Homo sapiens
ttttaaaaaggtgcc

SEQ ID NO: 203110 - DNA, 15 bp, Homo sapiens
cttttaaaaaggtgc

SEQ ID NO: 203111 - DNA, 15 bp, Homo sapiens
gcttttaaaaaggtg

SEQ ID NO: 203112 - DNA, 15 bp, Homo sapiens
ggcttttaaaaaggt

SEQ ID NO: 203113 - DNA, 15 bp, Homo sapiens
gggcttttaaaaagg

SEQ ID NO: 203114 - DNA, 15 bp, Homo sapiens
cgggcttttaaaaag

SEQ ID NO: 203115 - DNA, 15 bp, Homo sapiens
acgggcttttaaaaa

SEQ ID NO: 203116 - DNA, 15 bp, Homo sapiens
tacgggcttttaaaa

SEQ ID NO: 203117 - DNA, 15 bp, Homo sapiens
ctacgggcttttaaa

SEQ ID NO: 203118 - DNA, 15 bp, Homo sapiens
tctacgggcttttaa

SEQ ID NO: 203119 - DNA, 15 bp, Homo sapiens
ctctacgggctttta

SEQ ID NO: 203120 - DNA, 15 bp, Homo sapiens
tctctacgggctttt

SEQ ID NO: 203121 - DNA, 15 bp, Homo sapiens
ttctctacgggcttt

SEQ ID NO: 203122 - DNA, 15 bp, Homo sapiens
cttctctacgggctt

SEQ ID NO: 203123 - DNA, 15 bp, Homo sapiens
tcttctctacgggct

SEQ ID NO: 203124 - DNA, 15 bp, Homo sapiens
atcttctctacgggc

SEQ ID NO: 203125 - DNA, 15 bp, Homo sapiens
aatcttctctacggg

SEQ ID NO: 203126 - DNA, 15 bp, Homo sapiens
taatcttctctacgg

SEQ ID NO: 203127 - DNA, 15 bp, Homo sapiens
ttaatcttctctacg

SEQ ID NO: 203128 - DNA, 15 bp, Homo sapiens
gttaatcttctctac

SEQ ID NO: 203129 - DNA, 15 bp, Homo sapiens
ggttaatcttctcta

SEQ ID NO: 203130 - DNA, 15 bp, Homo sapiens
aggttaatcttctct

SEQ ID NO: 203131 - DNA, 15 bp, Homo sapiens
aaggttaatcttctc

SEQ ID NO: 203132 - DNA, 15 bp, Homo sapiens
aaaggttaatcttct

SEQ ID NO: 203133 - DNA, 15 bp, Homo sapiens
taaaggttaatcttc

SEQ ID NO: 203134 - DNA, 15 bp, Homo sapiens
ttaaaggttaatctt

SEQ ID NO: 203135 - DNA, 15 bp, Homo sapiens
gttaaaggttaatct

SEQ ID NO: 203136 - DNA, 15 bp, Homo sapiens
tgttaaaggttaatc

SEQ ID NO: 203137 - DNA, 15 bp, Homo sapiens
atgttaaaggttaat

SEQ ID NO: 203138 - DNA, 15 bp, Homo sapiens
gatgttaaaggttaa

SEQ ID NO: 203139 - DNA, 15 bp, Homo sapiens
tgatgttaaaggtta

SEQ ID NO: 203140 - DNA, 15 bp, Homo sapiens
atgatgttaaaggtt

SEQ ID NO: 203141 - DNA, 15 bp, Homo sapiens
gatgatgttaaaggt

SEQ ID NO: 203142 - DNA, 15 bp, Homo sapiens
tgatgatgttaaagg

SEQ ID NO: 203143 - DNA, 15 bp, Homo sapiens
atgatgatgttaaag

SEQ ID NO: 203144 - DNA, 15 bp, Homo sapiens
aatgatgatgttaaa

SEQ ID NO: 203145 - DNA, 15 bp, Homo sapiens
aaatgatgatgttaa

SEQ ID NO: 203146 - DNA, 15 bp, Homo sapiens
taaatgatgatgtta

SEQ ID NO: 203147 - DNA, 15 bp, Homo sapiens
ttaaatgatgatgtt

SEQ ID NO: 203148 - DNA, 15 bp, Homo sapiens
tttaaatgatgatgt

SEQ ID NO: 203149 - DNA, 15 bp, Homo sapiens
atttaaatgatgatg

SEQ ID NO: 203150 - DNA, 15 bp, Homo sapiens
gatttaaatgatgat

SEQ ID NO: 203151 - DNA, 15 bp, Homo sapiens
agatttaaatgatga

SEQ ID NO: 203152 - DNA, 15 bp, Homo sapiens
tagatttaaatgatg

SEQ ID NO: 203153 - DNA, 15 bp, Homo sapiens
ttagatttaaatgat

SEQ ID NO: 203154 - DNA, 15 bp, Homo sapiens
attagatttaaatga

SEQ ID NO: 203155 - DNA, 15 bp, Homo sapiens
cattagatttaaatg

SEQ ID NO: 203156 - DNA, 15 bp, Homo sapiens
acattagatttaaat

SEQ ID NO: 203157 - DNA, 15 bp, Homo sapiens
aacattagatttaaa

SEQ ID NO: 203158 - DNA, 15 bp, Homo sapiens
taacattagatttaa

SEQ ID NO: 203159 - DNA, 15 bp, Homo sapiens
gtaacattagattta

SEQ ID NO: 203160 - DNA, 15 bp, Homo sapiens
ggtaacattagattt

SEQ ID NO: 203161 - DNA, 15 bp, Homo sapiens
tggtaacattagatt

SEQ ID NO: 203162 - DNA, 15 bp, Homo sapiens
gtggtaacattagat

SEQ ID NO: 203163 - DNA, 15 bp, Homo sapiens
tgtggtaacattaga

SEQ ID NO: 203164 - DNA, 15 bp, Homo sapiens
atgtggtaacattag

SEQ ID NO: 203165 - DNA, 15 bp, Homo sapiens
aatgtggtaacatta

SEQ ID NO: 203166 - DNA, 15 bp, Homo sapiens
aaatgtggtaacatt

SEQ ID NO: 203167 - DNA, 15 bp, Homo sapiens
aaaatgtggtaacat

SEQ ID NO: 203168 - DNA, 15 bp, Homo sapiens
taaaatgtggtaaca

SEQ ID NO: 203169 - DNA, 15 bp, Homo sapiens
gtaaaatgtggtaac

SEQ ID NO: 203170 - DNA, 15 bp, Homo sapiens
tgtaaaatgtggtaa

SEQ ID NO: 203171 - DNA, 15 bp, Homo sapiens
ctgtaaaatgtggta

SEQ ID NO: 203172 - DNA, 15 bp, Homo sapiens
actgtaaaatgtggt

SEQ ID NO: 203173 - DNA, 15 bp, Homo sapiens
cactgtaaaatgtgg

SEQ ID NO: 203174 - DNA, 15 bp, Homo sapiens
acactgtaaaatgtg

SEQ ID NO: 203175 - DNA, 15 bp, Homo sapiens
gacactgtaaaatgt

SEQ ID NO: 203176 - DNA, 15 bp, Homo sapiens
tgacactgtaaaatg

SEQ ID NO: 203177 - DNA, 15 bp, Homo sapiens
atgacactgtaaaat

SEQ ID NO: 203178 - DNA, 15 bp, Homo sapiens
aatgacactgtaaaa

SEQ ID NO: 203179 - DNA, 15 bp, Homo sapiens
caatgacactgtaaa

SEQ ID NO: 203180 - DNA, 15 bp, Homo sapiens
tcaatgacactgtaa

SEQ ID NO: 203181 - DNA, 15 bp, Homo sapiens
gtcaatgacactgta

SEQ ID NO: 203182 - DNA, 15 bp, Homo sapiens
tgtcaatgacactgt

SEQ ID NO: 203183 - DNA, 15 bp, Homo sapiens
gtgtcaatgacactg

SEQ ID NO: 203184 - DNA, 15 bp, Homo sapiens
agtgtcaatgacact

SEQ ID NO: 203185 - DNA, 15 bp, Homo sapiens
tagtgtcaatgacac

SEQ ID NO: 203186 - DNA, 15 bp, Homo sapiens
atagtgtcaatgaca

SEQ ID NO: 203187 - DNA, 15 bp, Homo sapiens
catagtgtcaatgac

SEQ ID NO: 203188 - DNA, 15 bp, Homo sapiens
acatagtgtcaatga

SEQ ID NO: 203189 - DNA, 15 bp, Homo sapiens
aacatagtgtcaatg

SEQ ID NO: 203190 - DNA, 15 bp, Homo sapiens
aaacatagtgtcaat

SEQ ID NO: 203191 - DNA, 15 bp, Homo sapiens
taaacatagtgtcaa

SEQ ID NO: 203192 - DNA, 15 bp, Homo sapiens
ctaaacatagtgtca

SEQ ID NO: 203193 - DNA, 15 bp, Homo sapiens
gctaaacatagtgtc

SEQ ID NO: 203194 - DNA, 15 bp, Homo sapiens
ggctaaacatagtgt

SEQ ID NO: 203195 - DNA, 15 bp, Homo sapiens
aggctaaacatagtg

SEQ ID NO: 203196 - DNA, 15 bp, Homo sapiens
aaggctaaacatagt

SEQ ID NO: 203197 - DNA, 15 bp, Homo sapiens
taaggctaaacatag

SEQ ID NO: 203198 - DNA, 15 bp, Homo sapiens
ctaaggctaaacata

SEQ ID NO: 203199 - DNA, 15 bp, Homo sapiens
tctaaggctaaacat

SEQ ID NO: 203200 - DNA, 15 bp, Homo sapiens
atctaaggctaaaca

SEQ ID NO: 203201 - DNA, 15 bp, Homo sapiens
tatctaaggctaaac

SEQ ID NO: 203202 - DNA, 15 bp, Homo sapiens
ctatctaaggctaaa

SEQ ID NO: 203203 - DNA, 15 bp, Homo sapiens
actatctaaggctaa

SEQ ID NO: 203204 - DNA, 15 bp, Homo sapiens
aactatctaaggcta

SEQ ID NO: 203205 - DNA, 15 bp, Homo sapiens
caactatctaaggct

SEQ ID NO: 203206 - DNA, 15 bp, Homo sapiens
gcaactatctaaggc

SEQ ID NO: 203207 - DNA, 15 bp, Homo sapiens
agcaactatctaagg

SEQ ID NO: 203208 - DNA, 15 bp, Homo sapiens
aagcaactatctaag

SEQ ID NO: 203209 - DNA, 15 bp, Homo sapiens
aaagcaactatctaa

SEQ ID NO: 203210 - DNA, 15 bp, Homo sapiens
aaaagcaactatcta

SEQ ID NO: 203211 - DNA, 15 bp, Homo sapiens
gaaaagcaactatct

SEQ ID NO: 203212 - DNA, 15 bp, Homo sapiens
ggaaaagcaactatc

SEQ ID NO: 203213 - DNA, 15 bp, Homo sapiens
aggaaaagcaactat

SEQ ID NO: 203214 - DNA, 15 bp, Homo sapiens
taggaaaagcaacta

SEQ ID NO: 203215 - DNA, 15 bp, Homo sapiens
ttaggaaaagcaact

SEQ ID NO: 203216 - DNA, 15 bp, Homo sapiens
gttaggaaaagcaac

SEQ ID NO: 203217 - DNA, 15 bp, Homo sapiens
ggttaggaaaagcaa

SEQ ID NO: 203218 - DNA, 15 bp, Homo sapiens
tggttaggaaaagca

SEQ ID NO: 203219 - DNA, 15 bp, Homo sapiens
atggttaggaaaagc

SEQ ID NO: 203220 - DNA, 15 bp, Homo sapiens
tatggttaggaaaag

SEQ ID NO: 203221 - DNA, 15 bp, Homo sapiens
atatggttaggaaaa

SEQ ID NO: 203222 - DNA, 15 bp, Homo sapiens
aatatggttaggaaa

SEQ ID NO: 203223 - DNA, 15 bp, Homo sapiens
caatatggttaggaa

SEQ ID NO: 203224 - DNA, 15 bp, Homo sapiens
acaatatggttagga

SEQ ID NO: 203225 - DNA, 15 bp, Homo sapiens
cacaatatggttagg

SEQ ID NO: 203226 - DNA, 15 bp, Homo sapiens
tcacaatatggttag

SEQ ID NO: 203227 - DNA, 15 bp, Homo sapiens
ttcacaatatggtta

SEQ ID NO: 203228 - DNA, 15 bp, Homo sapiens
tttcacaatatggtt

SEQ ID NO: 203229 - DNA, 15 bp, Homo sapiens
gtttcacaatatggt

SEQ ID NO: 203230 - DNA, 15 bp, Homo sapiens
agtttcacaatatgg

SEQ ID NO: 203231 - DNA, 15 bp, Homo sapiens
tagtttcacaatatg

SEQ ID NO: 203232 - DNA, 15 bp, Homo sapiens
gtagtttcacaatat

SEQ ID NO: 203233 - DNA, 15 bp, Homo sapiens
agtagtttcacaata

SEQ ID NO: 203234 - DNA, 15 bp, Homo sapiens
tagtagtttcacaat

SEQ ID NO: 203235 - DNA, 15 bp, Homo sapiens
ttagtagtttcacaa

SEQ ID NO: 203236 - DNA, 15 bp, Homo sapiens
tttagtagtttcaca

SEQ ID NO: 203237 - DNA, 15 bp, Homo sapiens
atttagtagtttcac

SEQ ID NO: 203238 - DNA, 15 bp, Homo sapiens
aatttagtagtttca

SEQ ID NO: 203239 - DNA, 15 bp, Homo sapiens
aaatttagtagtttc

SEQ ID NO: 203240 - DNA, 15 bp, Homo sapiens
aaaatttagtagttt

SEQ ID NO: 203241 - DNA, 15 bp, Homo sapiens
aaaaatttagtagtt

SEQ ID NO: 203242 - DNA, 15 bp, Homo sapiens
aaaaaatttagtagt

SEQ ID NO: 203243 - DNA, 15 bp, Homo sapiens
aaaaaaatttagtag

SEQ ID NO: 203244 - DNA, 15 bp, Homo sapiens
aaaaaaaatttagta

SEQ ID NO: 203245 - DNA, 15 bp, Homo sapiens
aaaaaaaaatttagt

SEQ ID NO: 203246 - DNA, 15 bp, Homo sapiens
aaaaaaaaaatttag

SEQ ID NO: 203247 - DNA, 15 bp, Homo sapiens
aaaaaaaaaaaattt

SEQ ID NO: 203248 - DNA, 15 bp, Homo sapiens
gaaaaaaaaaaaatt

SEQ ID NO: 203249 - DNA, 15 bp, Homo sapiens
ggaaaaaaaaaaaat

SEQ ID NO: 203250 - DNA, 15 bp, Homo sapiens
tggaaaaaaaaaaaa

SEQ ID NO: 203251 - DNA, 15 bp, Homo sapiens
ttggaaaaaaaaaaa

SEQ ID NO: 203252 - DNA, 15 bp, Homo sapiens
tttggaaaaaaaaaa

SEQ ID NO: 203253 - DNA, 15 bp, Homo sapiens
atttggaaaaaaaaa

SEQ ID NO: 203254 - DNA, 15 bp, Homo sapiens
gatttggaaaaaaaa

SEQ ID NO: 203255 - DNA, 15 bp, Homo sapiens
agatttggaaaaaaa

SEQ ID NO: 203256 - DNA, 15 bp, Homo sapiens
tagatttggaaaaaa

SEQ ID NO: 203257 - DNA, 15 bp, Homo sapiens
ttagatttggaaaaa

SEQ ID NO: 203258 - DNA, 15 bp, Homo sapiens
attagatttggaaaa

SEQ ID NO: 203259 - DNA, 15 bp, Homo sapiens
tattagatttggaaa

SEQ ID NO: 203260 - DNA, 15 bp, Homo sapiens
ctattagatttggaa

SEQ ID NO: 203261 - DNA, 15 bp, Homo sapiens
tctattagatttgga

SEQ ID NO: 203262 - DNA, 15 bp, Homo sapiens
ctctattagatttgg

SEQ ID NO: 203263 - DNA, 15 bp, Homo sapiens
cctctattagatttg

SEQ ID NO: 203264 - DNA, 15 bp, Homo sapiens
tcctctattagattt

SEQ ID NO: 203265 - DNA, 15 bp, Homo sapiens
ttcctctattagatt

SEQ ID NO: 203266 - DNA, 15 bp, Homo sapiens
gttcctctattagat

SEQ ID NO: 203267 - DNA, 15 bp, Homo sapiens
agttcctctattaga

SEQ ID NO: 203268 - DNA, 15 bp, Homo sapiens
cagttcctctattag

SEQ ID NO: 203269 - DNA, 15 bp, Homo sapiens
gcagttcctctatta

SEQ ID NO: 203270 - DNA, 15 bp, Homo sapiens
agcagttcctctatt

SEQ ID NO: 203271 - DNA, 15 bp, Homo sapiens
gagcagttcctctat

SEQ ID NO: 203272 - DNA, 15 bp, Homo sapiens
agagcagttcctcta

SEQ ID NO: 203273 - DNA, 15 bp, Homo sapiens
gagagcagttcctct

SEQ ID NO: 203274 - DNA, 15 bp, Homo sapiens
agagagcagttcctc

SEQ ID NO: 203275 - DNA, 15 bp, Homo sapiens
aagagagcagttcct

SEQ ID NO: 203276 - DNA, 15 bp, Homo sapiens
aaagagagcagttcc

SEQ ID NO: 203277 - DNA, 15 bp, Homo sapiens
aaaagagagcagttc

SEQ ID NO: 203278 - DNA, 15 bp, Homo sapiens
aaaaagagagcagtt

SEQ ID NO: 203279 - DNA, 15 bp, Homo sapiens
aaaaaagagagcagt

SEQ ID NO: 203280 - DNA, 15 bp, Homo sapiens
aaaaaaagagagcag

SEQ ID NO: 203281 - DNA, 15 bp, Homo sapiens
aaaaaaaagagagca

SEQ ID NO: 203282 - DNA, 15 bp, Homo sapiens
gaaaaaaaagagagc

SEQ ID NO: 203283 - DNA, 15 bp, Homo sapiens
agaaaaaaaagagag

SEQ ID NO: 203284 - DNA, 15 bp, Homo sapiens
cagaaaaaaaagaga

SEQ ID NO: 203285 - DNA, 15 bp, Homo sapiens
ccagaaaaaaaagag

SEQ ID NO: 203286 - DNA, 15 bp, Homo sapiens
accagaaaaaaaaga

SEQ ID NO: 203287 - DNA, 15 bp, Homo sapiens
aaccagaaaaaaaag

SEQ ID NO: 203288 - DNA, 15 bp, Homo sapiens
aaaccagaaaaaaaa

SEQ ID NO: 203289 - DNA, 15 bp, Homo sapiens
gaaaccagaaaaaaa

SEQ ID NO: 203290 - DNA, 15 bp, Homo sapiens
agaaaccagaaaaaa

SEQ ID NO: 203291 - DNA, 15 bp, Homo sapiens
gagaaaccagaaaaa

SEQ ID NO: 203292 - DNA, 15 bp, Homo sapiens
agagaaaccagaaaa

SEQ ID NO: 203293 - DNA, 15 bp, Homo sapiens
tagagaaaccagaaa

SEQ ID NO: 203294 - DNA, 15 bp, Homo sapiens
ctagagaaaccagaa

SEQ ID NO: 203295 - DNA, 15 bp, Homo sapiens
actagagaaaccaga

SEQ ID NO: 203296 - DNA, 15 bp, Homo sapiens
cactagagaaaccag

SEQ ID NO: 203297 - DNA, 15 bp, Homo sapiens
acactagagaaacca

SEQ ID NO: 203298 - DNA, 15 bp, Homo sapiens
tacactagagaaacc

SEQ ID NO: 203299 - DNA, 15 bp, Homo sapiens
ctacactagagaaac

SEQ ID NO: 203300 - DNA, 15 bp, Homo sapiens
gctacactagagaaa

SEQ ID NO: 203301 - DNA, 15 bp, Homo sapiens
tgctacactagagaa

SEQ ID NO: 203302 - DNA, 15 bp, Homo sapiens
gtgctacactagaga

SEQ ID NO: 203303 - DNA, 15 bp, Homo sapiens
tgtgctacactagag

SEQ ID NO: 203304 - DNA, 15 bp, Homo sapiens
atgtgctacactaga

SEQ ID NO: 203305 - DNA, 15 bp, Homo sapiens
aatgtgctacactag

SEQ ID NO: 203306 - DNA, 15 bp, Homo sapiens
gaatgtgctacacta

SEQ ID NO: 203307 - DNA, 15 bp, Homo sapiens
agaatgtgctacact

SEQ ID NO: 203308 - DNA, 15 bp, Homo sapiens
tagaatgtgctacac

SEQ ID NO: 203309 - DNA, 15 bp, Homo sapiens
ttagaatgtgctaca

SEQ ID NO: 203310 - DNA, 15 bp, Homo sapiens
attagaatgtgctac

SEQ ID NO: 203311 - DNA, 15 bp, Homo sapiens
tattagaatgtgcta

SEQ ID NO: 203312 - DNA, 15 bp, Homo sapiens
ctattagaatgtgct

SEQ ID NO: 203313 - DNA, 15 bp, Homo sapiens
tctattagaatgtgc

SEQ ID NO: 203314 - DNA, 15 bp, Homo sapiens
ttctattagaatgtg

SEQ ID NO: 203315 - DNA, 15 bp, Homo sapiens
gttctattagaatgt

SEQ ID NO: 203316 - DNA, 15 bp, Homo sapiens
agttctattagaatg

SEQ ID NO: 203317 - DNA, 15 bp, Homo sapiens
aagttctattagaat

SEQ ID NO: 203318 - DNA, 15 bp, Homo sapiens
aaagttctattagaa

SEQ ID NO: 203319 - DNA, 15 bp, Homo sapiens
gaaagttctattaga

SEQ ID NO: 203320 - DNA, 15 bp, Homo sapiens
agaaagttctattag

SEQ ID NO: 203321 - DNA, 15 bp, Homo sapiens
gagaaagttctatta

SEQ ID NO: 203322 - DNA, 15 bp, Homo sapiens
ggagaaagttctatt

SEQ ID NO: 203323 - DNA, 15 bp, Homo sapiens
tggagaaagttctat

SEQ ID NO: 203324 - DNA, 15 bp, Homo sapiens
ttggagaaagttcta

SEQ ID NO: 203325 - DNA, 15 bp, Homo sapiens
attggagaaagttct

SEQ ID NO: 203326 - DNA, 15 bp, Homo sapiens
cattggagaaagttc

SEQ ID NO: 203327 - DNA, 15 bp, Homo sapiens
tcattggagaaagtt

SEQ ID NO: 203328 - DNA, 15 bp, Homo sapiens
atcattggagaaagt

SEQ ID NO: 203329 - DNA, 15 bp, Homo sapiens
tatcattggagaaag

SEQ ID NO: 203330 - DNA, 15 bp, Homo sapiens
ctatcattggagaaa

SEQ ID NO: 203331 - DNA, 15 bp, Homo sapiens
tctatcattggagaa

SEQ ID NO: 203332 - DNA, 15 bp, Homo sapiens
ttctatcattggaga

SEQ ID NO: 203333 - DNA, 15 bp, Homo sapiens
tttctatcattggag

SEQ ID NO: 203334 - DNA, 15 bp, Homo sapiens
atttctatcattgga

SEQ ID NO: 203335 - DNA, 15 bp, Homo sapiens
aatttctatcattgg

SEQ ID NO: 203336 - DNA, 15 bp, Homo sapiens
taatttctatcattg

SEQ ID NO: 203337 - DNA, 15 bp, Homo sapiens
ataatttctatcatt

SEQ ID NO: 203338 - DNA, 15 bp, Homo sapiens
gataatttctatcat

SEQ ID NO: 203339 - DNA, 15 bp, Homo sapiens
agataatttctatca

SEQ ID NO: 203340 - DNA, 15 bp, Homo sapiens
tagataatttctatc

SEQ ID NO: 203341 - DNA, 15 bp, Homo sapiens
atagataatttctat

SEQ ID NO: 203342 - DNA, 15 bp, Homo sapiens
tatagataatttcta

SEQ ID NO: 203343 - DNA, 15 bp, Homo sapiens
atatagataatttct

SEQ ID NO: 203344 - DNA, 15 bp, Homo sapiens
gatatagataatttc

SEQ ID NO: 203345 - DNA, 15 bp, Homo sapiens
agatatagataattt

SEQ ID NO: 203346 - DNA, 15 bp, Homo sapiens
tagatatagataatt

SEQ ID NO: 203347 - DNA, 15 bp, Homo sapiens
gtagatatagataat

SEQ ID NO: 203348 - DNA, 15 bp, Homo sapiens
tgtagatatagataa

SEQ ID NO: 203349 - DNA, 15 bp, Homo sapiens
gtgtagatatagata

SEQ ID NO: 203350 - DNA, 15 bp, Homo sapiens
agtgtagatatagat

SEQ ID NO: 203351 - DNA, 15 bp, Homo sapiens
cagtgtagatataga

SEQ ID NO: 203352 - DNA, 15 bp, Homo sapiens
ccagtgtagatatag

SEQ ID NO: 203353 - DNA, 15 bp, Homo sapiens
accagtgtagatata

SEQ ID NO: 203354 - DNA, 15 bp, Homo sapiens
aaccagtgtagatat

SEQ ID NO: 203355 - DNA, 15 bp, Homo sapiens
taaccagtgtagata

SEQ ID NO: 203356 - DNA, 15 bp, Homo sapiens
ttaaccagtgtagat

SEQ ID NO: 203357 - DNA, 15 bp, Homo sapiens
attaaccagtgtaga

SEQ ID NO: 203358 - DNA, 15 bp, Homo sapiens
tattaaccagtgtag

SEQ ID NO: 203359 - DNA, 15 bp, Homo sapiens
gtattaaccagtgta

SEQ ID NO: 203360 - DNA, 15 bp, Homo sapiens
tgtattaaccagtgt

SEQ ID NO: 203361 - DNA, 15 bp, Homo sapiens
ttgtattaaccagtg

SEQ ID NO: 203362 - DNA, 15 bp, Homo sapiens
attgtattaaccagt

SEQ ID NO: 203363 - DNA, 15 bp, Homo sapiens
aattgtattaaccag

SEQ ID NO: 203364 - DNA, 15 bp, Homo sapiens
caattgtattaacca

SEQ ID NO: 203365 - DNA, 15 bp, Homo sapiens
gcaattgtattaacc

SEQ ID NO: 203366 - DNA, 15 bp, Homo sapiens
agcaattgtattaac

SEQ ID NO: 203367 - DNA, 15 bp, Homo sapiens
cagcaattgtattaa

SEQ ID NO: 203368 - DNA, 15 bp, Homo sapiens
gcagcaattgtatta

SEQ ID NO: 203369 - DNA, 15 bp, Homo sapiens
agcagcaattgtatt

SEQ ID NO: 203370 - DNA, 15 bp, Homo sapiens
tagcagcaattgtat

SEQ ID NO: 203371 - DNA, 15 bp, Homo sapiens
ctagcagcaattgta

SEQ ID NO: 203372 - DNA, 15 bp, Homo sapiens
gctagcagcaattgt

SEQ ID NO: 203373 - DNA, 15 bp, Homo sapiens
ggctagcagcaattg

SEQ ID NO: 203374 - DNA, 15 bp, Homo sapiens
tggctagcagcaatt

SEQ ID NO: 203375 - DNA, 15 bp, Homo sapiens
atggctagcagcaat

SEQ ID NO: 203376 - DNA, 15 bp, Homo sapiens
tatggctagcagcaa

SEQ ID NO: 203377 - DNA, 15 bp, Homo sapiens
atatggctagcagca

SEQ ID NO: 203378 - DNA, 15 bp, Homo sapiens
catatggctagcagc

SEQ ID NO: 203379 - DNA, 15 bp, Homo sapiens
acatatggctagcag

SEQ ID NO: 203380 - DNA, 15 bp, Homo sapiens
cacatatggctagca

SEQ ID NO: 203381 - DNA, 15 bp, Homo sapiens
ccacatatggctagc

SEQ ID NO: 203382 - DNA, 15 bp, Homo sapiens
gccacatatggctag

SEQ ID NO: 203383 - DNA, 15 bp, Homo sapiens
ggccacatatggcta

SEQ ID NO: 203384 - DNA, 15 bp, Homo sapiens
aggccacatatggct

SEQ ID NO: 203385 - DNA, 15 bp, Homo sapiens
taggccacatatggc

SEQ ID NO: 203386 - DNA, 15 bp, Homo sapiens
ttaggccacatatgg

SEQ ID NO: 203387 - DNA, 15 bp, Homo sapiens
attaggccacatatg

SEQ ID NO: 203388 - DNA, 15 bp, Homo sapiens
cattaggccacatat

SEQ ID NO: 203389 - DNA, 15 bp, Homo sapiens
tcattaggccacata

SEQ ID NO: 203390 - DNA, 15 bp, Homo sapiens
ctcattaggccacat

SEQ ID NO: 203391 - DNA, 15 bp, Homo sapiens
gctcattaggccaca

SEQ ID NO: 203392 - DNA, 15 bp, Homo sapiens
tgctcattaggccac

SEQ ID NO: 203393 - DNA, 15 bp, Homo sapiens
gtgctcattaggcca

SEQ ID NO: 203394 - DNA, 15 bp, Homo sapiens
agtgctcattaggcc

SEQ ID NO: 203395 - DNA, 15 bp, Homo sapiens
aagtgctcattaggc

SEQ ID NO: 203396 - DNA, 15 bp, Homo sapiens
caagtgctcattagg

SEQ ID NO: 203397 - DNA, 15 bp, Homo sapiens
tcaagtgctcattag

SEQ ID NO: 203398 - DNA, 15 bp, Homo sapiens
ttcaagtgctcatta

SEQ ID NO: 203399 - DNA, 15 bp, Homo sapiens
tttcaagtgctcatt

SEQ ID NO: 203400 - DNA, 15 bp, Homo sapiens
atttcaagtgctcat

SEQ ID NO: 203401 - DNA, 15 bp, Homo sapiens
catttcaagtgctca

SEQ ID NO: 203402 - DNA, 15 bp, Homo sapiens
acatttcaagtgctc

SEQ ID NO: 203403 - DNA, 15 bp, Homo sapiens
cacatttcaagtgct

SEQ ID NO: 203404 - DNA, 15 bp, Homo sapiens
tcacatttcaagtgc

SEQ ID NO: 203405 - DNA, 15 bp, Homo sapiens
gtcacatttcaagtg

SEQ ID NO: 203406 - DNA, 15 bp, Homo sapiens
ggtcacatttcaagt

SEQ ID NO: 203407 - DNA, 15 bp, Homo sapiens
tggtcacatttcaag

SEQ ID NO: 203408 - DNA, 15 bp, Homo sapiens
ctggtcacatttcaa

SEQ ID NO: 203409 - DNA, 15 bp, Homo sapiens
actggtcacatttca

SEQ ID NO: 203410 - DNA, 15 bp, Homo sapiens
cactggtcacatttc

SEQ ID NO: 203411 - DNA, 15 bp, Homo sapiens
gcactggtcacattt

SEQ ID NO: 203412 - DNA, 15 bp, Homo sapiens
tgcactggtcacatt

SEQ ID NO: 203413 - DNA, 15 bp, Homo sapiens
ttgcactggtcacat

SEQ ID NO: 203414 - DNA, 15 bp, Homo sapiens
gttgcactggtcaca

SEQ ID NO: 203415 - DNA, 15 bp, Homo sapiens
agttgcactggtcac

SEQ ID NO: 203416 - DNA, 15 bp, Homo sapiens
cagttgcactggtca

SEQ ID NO: 203417 - DNA, 15 bp, Homo sapiens
tcagttgcactggtc

SEQ ID NO: 203418 - DNA, 15 bp, Homo sapiens
atcagttgcactggt

SEQ ID NO: 203419 - DNA, 15 bp, Homo sapiens
tatcagttgcactgg

SEQ ID NO: 203420 - DNA, 15 bp, Homo sapiens
ttatcagttgcactg

SEQ ID NO: 203421 - DNA, 15 bp, Homo sapiens
attatcagttgcact

SEQ ID NO: 203422 - DNA, 15 bp, Homo sapiens
gattatcagttgcac

SEQ ID NO: 203423 - DNA, 15 bp, Homo sapiens
agattatcagttgca

SEQ ID NO: 203424 - DNA, 15 bp, Homo sapiens
cagattatcagttgc

SEQ ID NO: 203425 - DNA, 15 bp, Homo sapiens
tcagattatcagttg

SEQ ID NO: 203426 - DNA, 15 bp, Homo sapiens
ttcagattatcagtt

SEQ ID NO: 203427 - DNA, 15 bp, Homo sapiens
attcagattatcagt

SEQ ID NO: 203428 - DNA, 15 bp, Homo sapiens
aattcagattatcag

SEQ ID NO: 203429 - DNA, 15 bp, Homo sapiens
aaattcagattatca

SEQ ID NO: 203430 - DNA, 15 bp, Homo sapiens
gaaattcagattatc

SEQ ID NO: 203431 - DNA, 15 bp, Homo sapiens
tgaaattcagattat

SEQ ID NO: 203432 - DNA, 15 bp, Homo sapiens
ttgaaattcagatta

SEQ ID NO: 203433 - DNA, 15 bp, Homo sapiens
tttgaaattcagatt

SEQ ID NO: 203434 - DNA, 15 bp, Homo sapiens
ttttgaaattcagat

SEQ ID NO: 203435 - DNA, 15 bp, Homo sapiens
attttgaaattcaga

SEQ ID NO: 203436 - DNA, 15 bp, Homo sapiens
aattttgaaattcag

SEQ ID NO: 203437 - DNA, 15 bp, Homo sapiens
aaattttgaaattca

SEQ ID NO: 203438 - DNA, 15 bp, Homo sapiens
taaattttgaaattc

SEQ ID NO: 203439 - DNA, 15 bp, Homo sapiens
gtaaattttgaaatt

SEQ ID NO: 203440 - DNA, 15 bp, Homo sapiens
agtaaattttgaaat

SEQ ID NO: 203441 - DNA, 15 bp, Homo sapiens
gagtaaattttgaaa

SEQ ID NO: 203442 - DNA, 15 bp, Homo sapiens
tgagtaaattttgaa

SEQ ID NO: 203443 - DNA, 15 bp, Homo sapiens
atgagtaaattttga

SEQ ID NO: 203444 - DNA, 15 bp, Homo sapiens
aatgagtaaattttg

SEQ ID NO: 203445 - DNA, 15 bp, Homo sapiens
aaatgagtaaatttt

SEQ ID NO: 203446 - DNA, 15 bp, Homo sapiens
aaaatgagtaaattt

SEQ ID NO: 203447 - DNA, 15 bp, Homo sapiens
taaaatgagtaaatt

SEQ ID NO: 203448 - DNA, 15 bp, Homo sapiens
ataaaatgagtaaat

SEQ ID NO: 203449 - DNA, 15 bp, Homo sapiens
aataaaatgagtaaa

SEQ ID NO: 203450 - DNA, 15 bp, Homo sapiens
aaataaaatgagtaa

SEQ ID NO: 203451 - DNA, 15 bp, Homo sapiens
taaataaaatgagta

SEQ ID NO: 203452 - DNA, 15 bp, Homo sapiens
ataaataaaatgagt

SEQ ID NO: 203453 - DNA, 15 bp, Homo sapiens
gataaataaaatgag

SEQ ID NO: 203454 - DNA, 15 bp, Homo sapiens
ggataaataaaatga

SEQ ID NO: 203455 - DNA, 15 bp, Homo sapiens
aggataaataaaatg

SEQ ID NO: 203456 - DNA, 15 bp, Homo sapiens
taggataaataaaat

SEQ ID NO: 203457 - DNA, 15 bp, Homo sapiens
ttaggataaataaaa

SEQ ID NO: 203458 - DNA, 15 bp, Homo sapiens
tttaggataaataaa

SEQ ID NO: 203459 - DNA, 15 bp, Homo sapiens
atttaggataaataa

SEQ ID NO: 203460 - DNA, 15 bp, Homo sapiens
aatttaggataaata

SEQ ID NO: 203461 - DNA, 15 bp, Homo sapiens
taatttaggataaat

SEQ ID NO: 203462 - DNA, 15 bp, Homo sapiens
ttaatttaggataaa

SEQ ID NO: 203463 - DNA, 15 bp, Homo sapiens
tttaatttaggataa

SEQ ID NO: 203464 - DNA, 15 bp, Homo sapiens
ttttaatttaggata

SEQ ID NO: 203465 - DNA, 15 bp, Homo sapiens
attttaatttaggat

SEQ ID NO: 203466 - DNA, 15 bp, Homo sapiens
aattttaatttagga

SEQ ID NO: 203467 - DNA, 15 bp, Homo sapiens
aaattttaatttagg

SEQ ID NO: 203468 - DNA, 15 bp, Homo sapiens
taaattttaatttag

SEQ ID NO: 203469 - DNA, 15 bp, Homo sapiens
ttaaattttaattta

SEQ ID NO: 203470 - DNA, 15 bp, Homo sapiens
tttaaattttaattt

SEQ ID NO: 203471 - DNA, 15 bp, Homo sapiens
atttaaattttaatt

SEQ ID NO: 203472 - DNA, 15 bp, Homo sapiens
tatttaaattttaat

SEQ ID NO: 203473 - DNA, 15 bp, Homo sapiens
ctatttaaattttaa

SEQ ID NO: 203474 - DNA, 15 bp, Homo sapiens
gctatttaaatttta

SEQ ID NO: 203475 - DNA, 15 bp, Homo sapiens
ggctatttaaatttt

SEQ ID NO: 203476 - DNA, 15 bp, Homo sapiens
tggctatttaaattt

SEQ ID NO: 203477 - DNA, 15 bp, Homo sapiens
gtggctatttaaatt

SEQ ID NO: 203478 - DNA, 15 bp, Homo sapiens
tgtggctatttaaat

SEQ ID NO: 203479 - DNA, 15 bp, Homo sapiens
atgtggctatttaaa

SEQ ID NO: 203480 - DNA, 15 bp, Homo sapiens
catgtggctatttaa

SEQ ID NO: 203481 - DNA, 15 bp, Homo sapiens
gcatgtggctattta

SEQ ID NO: 203482 - DNA, 15 bp, Homo sapiens
agcatgtggctattt

SEQ ID NO: 203483 - DNA, 15 bp, Homo sapiens
cagcatgtggctatt

SEQ ID NO: 203484 - DNA, 15 bp, Homo sapiens
gcagcatgtggctat

SEQ ID NO: 203485 - DNA, 15 bp, Homo sapiens
agcagcatgtggcta

SEQ ID NO: 203486 - DNA, 15 bp, Homo sapiens
cagcagcatgtggct

SEQ ID NO: 203487 - DNA, 15 bp, Homo sapiens
tcagcagcatgtggc

SEQ ID NO: 203488 - DNA, 15 bp, Homo sapiens
atcagcagcatgtgg

SEQ ID NO: 203489 - DNA, 15 bp, Homo sapiens
catcagcagcatgtg

SEQ ID NO: 203490 - DNA, 15 bp, Homo sapiens
acatcagcagcatgt

SEQ ID NO: 203491 - DNA, 15 bp, Homo sapiens
gacatcagcagcatg

SEQ ID NO: 203492 - DNA, 15 bp, Homo sapiens
agacatcagcagcat

SEQ ID NO: 203493 - DNA, 15 bp, Homo sapiens
tagacatcagcagca

SEQ ID NO: 203494 - DNA, 15 bp, Homo sapiens
gtagacatcagcagc

SEQ ID NO: 203495 - DNA, 15 bp, Homo sapiens
agtagacatcagcag

SEQ ID NO: 203496 - DNA, 15 bp, Homo sapiens
cagtagacatcagca

SEQ ID NO: 203497 - DNA, 15 bp, Homo sapiens
acagtagacatcagc

SEQ ID NO: 203498 - DNA, 15 bp, Homo sapiens
tacagtagacatcag

SEQ ID NO: 203499 - DNA, 15 bp, Homo sapiens
atacagtagacatca

SEQ ID NO: 203500 - DNA, 15 bp, Homo sapiens
aatacagtagacatc

SEQ ID NO: 203501 - DNA, 15 bp, Homo sapiens
caatacagtagacat

SEQ ID NO: 203502 - DNA, 15 bp, Homo sapiens
ccaatacagtagaca

SEQ ID NO: 203503 - DNA, 15 bp, Homo sapiens
tccaatacagtagac

SEQ ID NO: 203504 - DNA, 15 bp, Homo sapiens
ttccaatacagtaga

SEQ ID NO: 203505 - DNA, 15 bp, Homo sapiens
attccaatacagtag

SEQ ID NO: 203506 - DNA, 15 bp, Homo sapiens
gattccaatacagta

SEQ ID NO: 203507 - DNA, 15 bp, Homo sapiens
tgattccaatacagt

SEQ ID NO: 203508 - DNA, 15 bp, Homo sapiens
gtgattccaatacag

SEQ ID NO: 203509 - DNA, 15 bp, Homo sapiens
cgtgattccaataca

SEQ ID NO: 203510 - DNA, 15 bp, Homo sapiens
ccgtgattccaatac

SEQ ID NO: 203511 - DNA, 15 bp, Homo sapiens
gccgtgattccaata

SEQ ID NO: 203512 - DNA, 15 bp, Homo sapiens
agccgtgattccaat

SEQ ID NO: 203513 - DNA, 15 bp, Homo sapiens
aagccgtgattccaa

SEQ ID NO: 203514 - DNA, 15 bp, Homo sapiens
aaagccgtgattcca

SEQ ID NO: 203515 - DNA, 15 bp, Homo sapiens
caaagccgtgattcc

SEQ ID NO: 203516 - DNA, 15 bp, Homo sapiens
ccaaagccgtgattc

SEQ ID NO: 203517 - DNA, 15 bp, Homo sapiens
accaaagccgtgatt

SEQ ID NO: 203518 - DNA, 15 bp, Homo sapiens
caccaaagccgtgat

SEQ ID NO: 203519 - DNA, 15 bp, Homo sapiens
acaccaaagccgtga

SEQ ID NO: 203520 - DNA, 15 bp, Homo sapiens
aacaccaaagccgtg

SEQ ID NO: 203521 - DNA, 15 bp, Homo sapiens
gaacaccaaagccgt

SEQ ID NO: 203522 - DNA, 15 bp, Homo sapiens
agaacaccaaagccg

SEQ ID NO: 203523 - DNA, 15 bp, Homo sapiens
aagaacaccaaagcc

SEQ ID NO: 203524 - DNA, 15 bp, Homo sapiens
aaagaacaccaaagc

SEQ ID NO: 203525 - DNA, 15 bp, Homo sapiens
aaaagaacaccaaag

SEQ ID NO: 203526 - DNA, 15 bp, Homo sapiens
gaaaagaacaccaaa

SEQ ID NO: 203527 - DNA, 15 bp, Homo sapiens
tgaaaagaacaccaa

SEQ ID NO: 203528 - DNA, 15 bp, Homo sapiens
ctgaaaagaacacca

SEQ ID NO: 203529 - DNA, 15 bp, Homo sapiens
gctgaaaagaacacc

SEQ ID NO: 203530 - DNA, 15 bp, Homo sapiens
tgctgaaaagaacac

SEQ ID NO: 203531 - DNA, 15 bp, Homo sapiens
gtgctgaaaagaaca

SEQ ID NO: 203532 - DNA, 15 bp, Homo sapiens
ggtgctgaaaagaac

SEQ ID NO: 203533 - DNA, 15 bp, Homo sapiens
cggtgctgaaaagaa

SEQ ID NO: 203534 - DNA, 15 bp, Homo sapiens
acggtgctgaaaaga

SEQ ID NO: 203535 - DNA, 15 bp, Homo sapiens
gacggtgctgaaaag

SEQ ID NO: 203536 - DNA, 15 bp, Homo sapiens
tgacggtgctgaaaa

SEQ ID NO: 203537 - DNA, 15 bp, Homo sapiens
ctgacggtgctgaaa

SEQ ID NO: 203538 - DNA, 15 bp, Homo sapiens
tctgacggtgctgaa

SEQ ID NO: 203539 - DNA, 15 bp, Homo sapiens
gtctgacggtgctga

SEQ ID NO: 203540 - DNA, 15 bp, Homo sapiens
agtctgacggtgctg

SEQ ID NO: 203541 - DNA, 15 bp, Homo sapiens
cagtctgacggtgct

SEQ ID NO: 203542 - DNA, 15 bp, Homo sapiens
tcagtctgacggtgc

SEQ ID NO: 203543 - DNA, 15 bp, Homo sapiens
ttcagtctgacggtg

SEQ ID NO: 203544 - DNA, 15 bp, Homo sapiens
attcagtctgacggt

SEQ ID NO: 203545 - DNA, 15 bp, Homo sapiens
aattcagtctgacgg

SEQ ID NO: 203546 - DNA, 15 bp, Homo sapiens
gaattcagtctgacg

SEQ ID NO: 203547 - DNA, 15 bp, Homo sapiens
agaattcagtctgac

SEQ ID NO: 203548 - DNA, 15 bp, Homo sapiens
cagaattcagtctga

SEQ ID NO: 203549 - DNA, 15 bp, Homo sapiens
tcagaattcagtctg

SEQ ID NO: 203550 - DNA, 15 bp, Homo sapiens
ttcagaattcagtct

SEQ ID NO: 203551 - DNA, 15 bp, Homo sapiens
cttcagaattcagtc

SEQ ID NO: 203552 - DNA, 15 bp, Homo sapiens
tcttcagaattcagt

SEQ ID NO: 203553 - DNA, 15 bp, Homo sapiens
gtcttcagaattcag

SEQ ID NO: 203554 - DNA, 15 bp, Homo sapiens
agtcttcagaattca

SEQ ID NO: 203555 - DNA, 15 bp, Homo sapiens
aagtcttcagaattc

SEQ ID NO: 203556 - DNA, 15 bp, Homo sapiens
caagtcttcagaatt

SEQ ID NO: 203557 - DNA, 15 bp, Homo sapiens
tcaagtcttcagaat

SEQ ID NO: 203558 - DNA, 15 bp, Homo sapiens
gtcaagtcttcagaa

SEQ ID NO: 203559 - DNA, 15 bp, Homo sapiens
agtcaagtcttcaga

SEQ ID NO: 203560 - DNA, 15 bp, Homo sapiens
gagtcaagtcttcag

SEQ ID NO: 203561 - DNA, 15 bp, Homo sapiens
agagtcaagtcttca

SEQ ID NO: 203562 - DNA, 15 bp, Homo sapiens
aagagtcaagtcttc

SEQ ID NO: 203563 - DNA, 15 bp, Homo sapiens
aaagagtcaagtctt

SEQ ID NO: 203564 - DNA, 15 bp, Homo sapiens
aaaagagtcaagtct

SEQ ID NO: 203565 - DNA, 15 bp, Homo sapiens
gaaaagagtcaagtc

SEQ ID NO: 203566 - DNA, 15 bp, Homo sapiens
agaaaagagtcaagt

SEQ ID NO: 203567 - DNA, 15 bp, Homo sapiens
gagaaaagagtcaag

SEQ ID NO: 203568 - DNA, 15 bp, Homo sapiens
ggagaaaagagtcaa

SEQ ID NO: 203569 - DNA, 15 bp, Homo sapiens
aggagaaaagagtca

SEQ ID NO: 203570 - DNA, 15 bp, Homo sapiens
taggagaaaagagtc

SEQ ID NO: 203571 - DNA, 15 bp, Homo sapiens
ttaggagaaaagagt

SEQ ID NO: 203572 - DNA, 15 bp, Homo sapiens
attaggagaaaagag

SEQ ID NO: 203573 - DNA, 15 bp, Homo sapiens
tattaggagaaaaga

SEQ ID NO: 203574 - DNA, 15 bp, Homo sapiens
atattaggagaaaag

SEQ ID NO: 203575 - DNA, 15 bp, Homo sapiens
catattaggagaaaa

SEQ ID NO: 203576 - DNA, 15 bp, Homo sapiens
acatattaggagaaa

SEQ ID NO: 203577 - DNA, 15 bp, Homo sapiens
gacatattaggagaa

SEQ ID NO: 203578 - DNA, 15 bp, Homo sapiens
agacatattaggaga

SEQ ID NO: 203579 - DNA, 15 bp, Homo sapiens
aagacatattaggag

SEQ ID NO: 203580 - DNA, 15 bp, Homo sapiens
taagacatattagga

SEQ ID NO: 203581 - DNA, 15 bp, Homo sapiens
ttaagacatattagg

SEQ ID NO: 203582 - DNA, 15 bp, Homo sapiens
attaagacatattag

SEQ ID NO: 203583 - DNA, 15 bp, Homo sapiens
aattaagacatatta

SEQ ID NO: 203584 - DNA, 15 bp, Homo sapiens
gaattaagacatatt

SEQ ID NO: 203585 - DNA, 15 bp, Homo sapiens
ggaattaagacatat

SEQ ID NO: 203586 - DNA, 15 bp, Homo sapiens
aggaattaagacata

SEQ ID NO: 203587 - DNA, 15 bp, Homo sapiens
aaggaattaagacat

SEQ ID NO: 203588 - DNA, 15 bp, Homo sapiens
aaaggaattaagaca

SEQ ID NO: 203589 - DNA, 15 bp, Homo sapiens
gaaaggaattaagac

SEQ ID NO: 203590 - DNA, 15 bp, Homo sapiens
ggaaaggaattaaga

SEQ ID NO: 203591 - DNA, 15 bp, Homo sapiens
aggaaaggaattaag

SEQ ID NO: 203592 - DNA, 15 bp, Homo sapiens
caggaaaggaattaa

SEQ ID NO: 203593 - DNA, 15 bp, Homo sapiens
ccaggaaaggaatta

SEQ ID NO: 203594 - DNA, 15 bp, Homo sapiens
cccaggaaaggaatt

SEQ ID NO: 203595 - DNA, 15 bp, Homo sapiens
tcccaggaaaggaat

SEQ ID NO: 203596 - DNA, 15 bp, Homo sapiens
ctcccaggaaaggaa

SEQ ID NO: 203597 - DNA, 15 bp, Homo sapiens
actcccaggaaagga

SEQ ID NO: 203598 - DNA, 15 bp, Homo sapiens
tactcccaggaaagg

SEQ ID NO: 203599 - DNA, 15 bp, Homo sapiens
ctactcccaggaaag

SEQ ID NO: 203600 - DNA, 15 bp, Homo sapiens
cctactcccaggaaa

SEQ ID NO: 203601 - DNA, 15 bp, Homo sapiens
tcctactcccaggaa

SEQ ID NO: 203602 - DNA, 15 bp, Homo sapiens
ttcctactcccagga

SEQ ID NO: 203603 - DNA, 15 bp, Homo sapiens
gttcctactcccagg

SEQ ID NO: 203604 - DNA, 15 bp, Homo sapiens
tgttcctactcccag

SEQ ID NO: 203605 - DNA, 15 bp, Homo sapiens
ttgttcctactccca

SEQ ID NO: 203606 - DNA, 15 bp, Homo sapiens
attgttcctactccc

SEQ ID NO: 203607 - DNA, 15 bp, Homo sapiens
gattgttcctactcc

SEQ ID NO: 203608 - DNA, 15 bp, Homo sapiens
agattgttcctactc

SEQ ID NO: 203609 - DNA, 15 bp, Homo sapiens
aagattgttcctact

SEQ ID NO: 203610 - DNA, 15 bp, Homo sapiens
aaagattgttcctac

SEQ ID NO: 203611 - DNA, 15 bp, Homo sapiens
aaaagattgttccta

SEQ ID NO: 203612 - DNA, 15 bp, Homo sapiens
taaaagattgttcct

SEQ ID NO: 203613 - DNA, 15 bp, Homo sapiens
ttaaaagattgttcc

SEQ ID NO: 203614 - DNA, 15 bp, Homo sapiens
tttaaaagattgttc

SEQ ID NO: 203615 - DNA, 15 bp, Homo sapiens
ctttaaaagattgtt

SEQ ID NO: 203616 - DNA, 15 bp, Homo sapiens
actttaaaagattgt

SEQ ID NO: 203617 - DNA, 15 bp, Homo sapiens
aactttaaaagattg

SEQ ID NO: 203618 - DNA, 15 bp, Homo sapiens
taactttaaaagatt

SEQ ID NO: 203619 - DNA, 15 bp, Homo sapiens
gtaactttaaaagat

SEQ ID NO: 203620 - DNA, 15 bp, Homo sapiens
agtaactttaaaaga

SEQ ID NO: 203621 - DNA, 15 bp, Homo sapiens
aagtaactttaaaag

SEQ ID NO: 203622 - DNA, 15 bp, Homo sapiens
caagtaactttaaaa

SEQ ID NO: 203623 - DNA, 15 bp, Homo sapiens
acaagtaactttaaa

SEQ ID NO: 203624 - DNA, 15 bp, Homo sapiens
aacaagtaactttaa

SEQ ID NO: 203625 - DNA, 15 bp, Homo sapiens
caacaagtaacttta

SEQ ID NO: 203626 - DNA, 15 bp, Homo sapiens
acaacaagtaacttt

SEQ ID NO: 203627 - DNA, 15 bp, Homo sapiens
aacaacaagtaactt

SEQ ID NO: 203628 - DNA, 15 bp, Homo sapiens
gaacaacaagtaact

SEQ ID NO: 203629 - DNA, 15 bp, Homo sapiens
agaacaacaagtaac

SEQ ID NO: 203630 - DNA, 15 bp, Homo sapiens
aagaacaacaagtaa

SEQ ID NO: 203631 - DNA, 15 bp, Homo sapiens
caagaacaacaagta

SEQ ID NO: 203632 - DNA, 15 bp, Homo sapiens
ccaagaacaacaagt

SEQ ID NO: 203633 - DNA, 15 bp, Homo sapiens
tccaagaacaacaag

SEQ ID NO: 203634 - DNA, 15 bp, Homo sapiens
gtccaagaacaacaa

SEQ ID NO: 203635 - DNA, 15 bp, Homo sapiens
agtccaagaacaaca

SEQ ID NO: 203636 - DNA, 15 bp, Homo sapiens
tagtccaagaacaac

SEQ ID NO: 203637 - DNA, 15 bp, Homo sapiens
ttagtccaagaacaa

SEQ ID NO: 203638 - DNA, 15 bp, Homo sapiens
attagtccaagaaca

SEQ ID NO: 203639 - DNA, 15 bp, Homo sapiens
tattagtccaagaac

SEQ ID NO: 203640 - DNA, 15 bp, Homo sapiens
ttattagtccaagaa

SEQ ID NO: 203641 - DNA, 15 bp, Homo sapiens
tttattagtccaaga

SEQ ID NO: 203642 - DNA, 15 bp, Homo sapiens
ctttattagtccaag

SEQ ID NO: 203643 - DNA, 15 bp, Homo sapiens
cctttattagtccaa

SEQ ID NO: 203644 - DNA, 15 bp, Homo sapiens
acctttattagtcca

SEQ ID NO: 203645 - DNA, 15 bp, Homo sapiens
tacctttattagtcc

SEQ ID NO: 203646 - DNA, 15 bp, Homo sapiens
atacctttattagtc

SEQ ID NO: 203647 - DNA, 15 bp, Homo sapiens
aatacctttattagt

SEQ ID NO: 203648 - DNA, 15 bp, Homo sapiens
aaatacctttattag

SEQ ID NO: 203649 - DNA, 15 bp, Homo sapiens
aaaatacctttatta

SEQ ID NO: 203650 - DNA, 15 bp, Homo sapiens
gaaaatacctttatt

SEQ ID NO: 203651 - DNA, 15 bp, Homo sapiens
agaaaatacctttat

SEQ ID NO: 203652 - DNA, 15 bp, Homo sapiens
aagaaaataccttta

SEQ ID NO: 203653 - DNA, 15 bp, Homo sapiens
aaagaaaataccttt

SEQ ID NO: 203654 - DNA, 15 bp, Homo sapiens
gaaagaaaatacctt

SEQ ID NO: 203655 - DNA, 15 bp, Homo sapiens
tgaaagaaaatacct

SEQ ID NO: 203656 - DNA, 15 bp, Homo sapiens
atgaaagaaaatacc

SEQ ID NO: 203657 - DNA, 15 bp, Homo sapiens
aatgaaagaaaatac

SEQ ID NO: 203658 - DNA, 15 bp, Homo sapiens
taatgaaagaaaata

SEQ ID NO: 203659 - DNA, 15 bp, Homo sapiens
ataatgaaagaaaat

SEQ ID NO: 203660 - DNA, 15 bp, Homo sapiens
tataatgaaagaaaa

SEQ ID NO: 203661 - DNA, 15 bp, Homo sapiens
ttataatgaaagaaa

SEQ ID NO: 203662 - DNA, 15 bp, Homo sapiens
gttataatgaaagaa

SEQ ID NO: 203663 - DNA, 15 bp, Homo sapiens
ggttataatgaaaga

SEQ ID NO: 203664 - DNA, 15 bp, Homo sapiens
gggttataatgaaag

SEQ ID NO: 203665 - DNA, 15 bp, Homo sapiens
tgggttataatgaaa

SEQ ID NO: 203666 - DNA, 15 bp, Homo sapiens
ttgggttataatgaa

SEQ ID NO: 203667 - DNA, 15 bp, Homo sapiens
attgggttataatga

SEQ ID NO: 203668 - DNA, 15 bp, Homo sapiens
aattgggttataatg

SEQ ID NO: 203669 - DNA, 15 bp, Homo sapiens
aaattgggttataat

SEQ ID NO: 203670 - DNA, 15 bp, Homo sapiens
taaattgggttataa

SEQ ID NO: 203671 - DNA, 15 bp, Homo sapiens
ataaattgggttata

SEQ ID NO: 203672 - DNA, 15 bp, Homo sapiens
tataaattgggttat

SEQ ID NO: 203673 - DNA, 15 bp, Homo sapiens
ctataaattgggtta

SEQ ID NO: 203674 - DNA, 15 bp, Homo sapiens
actataaattgggtt

SEQ ID NO: 203675 - DNA, 15 bp, Homo sapiens
aactataaattgggt

SEQ ID NO: 203676 - DNA, 15 bp, Homo sapiens
aaactataaattggg

SEQ ID NO: 203677 - DNA, 15 bp, Homo sapiens
caaactataaattgg

SEQ ID NO: 203678 - DNA, 15 bp, Homo sapiens
ccaaactataaattg

SEQ ID NO: 203679 - DNA, 15 bp, Homo sapiens
tccaaactataaatt

SEQ ID NO: 203680 - DNA, 15 bp, Homo sapiens
ctccaaactataaat

SEQ ID NO: 203681 - DNA, 15 bp, Homo sapiens
tctccaaactataaa

SEQ ID NO: 203682 - DNA, 15 bp, Homo sapiens
atctccaaactataa

SEQ ID NO: 203683 - DNA, 15 bp, Homo sapiens
aatctccaaactata

SEQ ID NO: 203684 - DNA, 15 bp, Homo sapiens
aaatctccaaactat

SEQ ID NO: 203685 - DNA, 15 bp, Homo sapiens
aaaatctccaaacta

SEQ ID NO: 203686 - DNA, 15 bp, Homo sapiens
taaaatctccaaact

SEQ ID NO: 203687 - DNA, 15 bp, Homo sapiens
gtaaaatctccaaac

SEQ ID NO: 203688 - DNA, 15 bp, Homo sapiens
ggtaaaatctccaaa

SEQ ID NO: 203689 - DNA, 15 bp, Homo sapiens
tggtaaaatctccaa

SEQ ID NO: 203690 - DNA, 15 bp, Homo sapiens
atggtaaaatctcca

SEQ ID NO: 203691 - DNA, 15 bp, Homo sapiens
tatggtaaaatctcc

SEQ ID NO: 203692 - DNA, 15 bp, Homo sapiens
ttatggtaaaatctc

SEQ ID NO: 203693 - DNA, 15 bp, Homo sapiens
tttatggtaaaatct

SEQ ID NO: 203694 - DNA, 15 bp, Homo sapiens
gtttatggtaaaatc

SEQ ID NO: 203695 - DNA, 15 bp, Homo sapiens
ggtttatggtaaaat

SEQ ID NO: 203696 - DNA, 15 bp, Homo sapiens
tggtttatggtaaaa

SEQ ID NO: 203697 - DNA, 15 bp, Homo sapiens
ttggtttatggtaaa

SEQ ID NO: 203698 - DNA, 15 bp, Homo sapiens
tttggtttatggtaa

SEQ ID NO: 203699 - DNA, 15 bp, Homo sapiens
ttttggtttatggta

SEQ ID NO: 203700 - DNA, 15 bp, Homo sapiens
attttggtttatggt

SEQ ID NO: 203701 - DNA, 15 bp, Homo sapiens
tattttggtttatgg

SEQ ID NO: 203702 - DNA, 15 bp, Homo sapiens
atattttggtttatg

SEQ ID NO: 203703 - DNA, 15 bp, Homo sapiens
tatattttggtttat

SEQ ID NO: 203704 - DNA, 15 bp, Homo sapiens
atatattttggttta

SEQ ID NO: 203705 - DNA, 15 bp, Homo sapiens
tatatattttggttt

SEQ ID NO: 203706 - DNA, 15 bp, Homo sapiens
atatatattttggtt

SEQ ID NO: 203707 - DNA, 15 bp, Homo sapiens
tatatatattttggt

SEQ ID NO: 203708 - DNA, 15 bp, Homo sapiens
atatatatattttgg

SEQ ID NO: 203709 - DNA, 15 bp, Homo sapiens
tatatatatattttg

SEQ ID NO: 203710 - DNA, 15 bp, Homo sapiens
agtatatatatatat

SEQ ID NO: 203711 - DNA, 15 bp, Homo sapiens
aagtatatatatata

SEQ ID NO: 203712 - DNA, 15 bp, Homo sapiens
aaagtatatatatat

SEQ ID NO: 203713 - DNA, 15 bp, Homo sapiens
aaaagtatatatata

SEQ ID NO: 203714 - DNA, 15 bp, Homo sapiens
caaaagtatatatat

SEQ ID NO: 203715 - DNA, 15 bp, Homo sapiens
acaaaagtatatata

SEQ ID NO: 203716 - DNA, 15 bp, Homo sapiens
tacaaaagtatatat

SEQ ID NO: 203717 - DNA, 15 bp, Homo sapiens
ctacaaaagtatata

SEQ ID NO: 203718 - DNA, 15 bp, Homo sapiens
actacaaaagtatat

SEQ ID NO: 203719 - DNA, 15 bp, Homo sapiens
tactacaaaagtata

SEQ ID NO: 203720 - DNA, 15 bp, Homo sapiens
ttactacaaaagtat

SEQ ID NO: 203721 - DNA, 15 bp, Homo sapiens
cttactacaaaagta

SEQ ID NO: 203722 - DNA, 15 bp, Homo sapiens
tcttactacaaaagt

SEQ ID NO: 203723 - DNA, 15 bp, Homo sapiens
ttcttactacaaaag

SEQ ID NO: 203724 - DNA, 15 bp, Homo sapiens
attcttactacaaaa

SEQ ID NO: 203725 - DNA, 15 bp, Homo sapiens
tattcttactacaaa

SEQ ID NO: 203726 - DNA, 15 bp, Homo sapiens
gtattcttactacaa

SEQ ID NO: 203727 - DNA, 15 bp, Homo sapiens
ggtattcttactaca

SEQ ID NO: 203728 - DNA, 15 bp, Homo sapiens
tggtattcttactac

SEQ ID NO: 203729 - DNA, 15 bp, Homo sapiens
ttggtattcttacta

SEQ ID NO: 203730 - DNA, 15 bp, Homo sapiens
tttggtattcttact

SEQ ID NO: 203731 - DNA, 15 bp, Homo sapiens
atttggtattcttac

SEQ ID NO: 203732 - DNA, 15 bp, Homo sapiens
aatttggtattctta

SEQ ID NO: 203733 - DNA, 15 bp, Homo sapiens
caatttggtattctt

SEQ ID NO: 203734 - DNA, 15 bp, Homo sapiens
ccaatttggtattct

SEQ ID NO: 203735 - DNA, 15 bp, Homo sapiens
tccaatttggtattc

SEQ ID NO: 203736 - DNA, 15 bp, Homo sapiens
gtccaatttggtatt

SEQ ID NO: 203737 - DNA, 15 bp, Homo sapiens
tgtccaatttggtat

SEQ ID NO: 203738 - DNA, 15 bp, Homo sapiens
atgtccaatttggta

SEQ ID NO: 203739 - DNA, 15 bp, Homo sapiens
aatgtccaatttggt

SEQ ID NO: 203740 - DNA, 15 bp, Homo sapiens
aaatgtccaatttgg

SEQ ID NO: 203741 - DNA, 15 bp, Homo sapiens
caaatgtccaatttg

SEQ ID NO: 203742 - DNA, 15 bp, Homo sapiens
tcaaatgtccaattt

SEQ ID NO: 203743 - DNA, 15 bp, Homo sapiens
atcaaatgtccaatt

SEQ ID NO: 203744 - DNA, 15 bp, Homo sapiens
aatcaaatgtccaat

SEQ ID NO: 203745 - DNA, 15 bp, Homo sapiens
gaatcaaatgtccaa

SEQ ID NO: 203746 - DNA, 15 bp, Homo sapiens
agaatcaaatgtcca

SEQ ID NO: 203747 - DNA, 15 bp, Homo sapiens
cagaatcaaatgtcc

SEQ ID NO: 203748 - DNA, 15 bp, Homo sapiens
ccagaatcaaatgtc

SEQ ID NO: 203749 - DNA, 15 bp, Homo sapiens
cccagaatcaaatgt

SEQ ID NO: 203750 - DNA, 15 bp, Homo sapiens
acccagaatcaaatg

SEQ ID NO: 203751 - DNA, 15 bp, Homo sapiens
tacccagaatcaaat

SEQ ID NO: 203752 - DNA, 15 bp, Homo sapiens
ctacccagaatcaaa

SEQ ID NO: 203753 - DNA, 15 bp, Homo sapiens
actacccagaatcaa

SEQ ID NO: 203754 - DNA, 15 bp, Homo sapiens
gactacccagaatca

SEQ ID NO: 203755 - DNA, 15 bp, Homo sapiens
tgactacccagaatc

SEQ ID NO: 203756 - DNA, 15 bp, Homo sapiens
atgactacccagaat

SEQ ID NO: 203757 - DNA, 15 bp, Homo sapiens
aatgactacccagaa

SEQ ID NO: 203758 - DNA, 15 bp, Homo sapiens
taatgactacccaga

SEQ ID NO: 203759 - DNA, 15 bp, Homo sapiens
gtaatgactacccag

SEQ ID NO: 203760 - DNA, 15 bp, Homo sapiens
tgtaatgactaccca

SEQ ID NO: 203761 - DNA, 15 bp, Homo sapiens
gtgtaatgactaccc

SEQ ID NO: 203762 - DNA, 15 bp, Homo sapiens
tgtgtaatgactacc

SEQ ID NO: 203763 - DNA, 15 bp, Homo sapiens
ttgtgtaatgactac

SEQ ID NO: 203764 - DNA, 15 bp, Homo sapiens
gttgtgtaatgacta

SEQ ID NO: 203765 - DNA, 15 bp, Homo sapiens
tgttgtgtaatgact

SEQ ID NO: 203766 - DNA, 15 bp, Homo sapiens
ctgttgtgtaatgac

SEQ ID NO: 203767 - DNA, 15 bp, Homo sapiens
tctgttgtgtaatga

SEQ ID NO: 203768 - DNA, 15 bp, Homo sapiens
ctctgttgtgtaatg

SEQ ID NO: 203769 - DNA, 15 bp, Homo sapiens
cctctgttgtgtaat

SEQ ID NO: 203770 - DNA, 15 bp, Homo sapiens
tcctctgttgtgtaa

SEQ ID NO: 203771 - DNA, 15 bp, Homo sapiens
atcctctgttgtgta

SEQ ID NO: 203772 - DNA, 15 bp, Homo sapiens
catcctctgttgtgt

SEQ ID NO: 203773 - DNA, 15 bp, Homo sapiens
ccatcctctgttgtg

SEQ ID NO: 203774 - DNA, 15 bp, Homo sapiens
cccatcctctgttgt

SEQ ID NO: 203775 - DNA, 15 bp, Homo sapiens
tcccatcctctgttg

SEQ ID NO: 203776 - DNA, 15 bp, Homo sapiens
atcccatcctctgtt

SEQ ID NO: 203777 - DNA, 15 bp, Homo sapiens
tatcccatcctctgt

SEQ ID NO: 203778 - DNA, 15 bp, Homo sapiens
atatcccatcctctg

SEQ ID NO: 203779 - DNA, 15 bp, Homo sapiens
gatatcccatcctct

SEQ ID NO: 203780 - DNA, 15 bp, Homo sapiens
agatatcccatcctc

SEQ ID NO: 203781 - DNA, 15 bp, Homo sapiens
cagatatcccatcct

SEQ ID NO: 203782 - DNA, 15 bp, Homo sapiens
gcagatatcccatcc

SEQ ID NO: 203783 - DNA, 15 bp, Homo sapiens
ggcagatatcccatc

SEQ ID NO: 203784 - DNA, 15 bp, Homo sapiens
tggcagatatcccat

SEQ ID NO: 203785 - DNA, 15 bp, Homo sapiens
ctggcagatatccca

SEQ ID NO: 203786 - DNA, 15 bp, Homo sapiens
tctggcagatatccc

SEQ ID NO: 203787 - DNA, 15 bp, Homo sapiens
ctctggcagatatcc

SEQ ID NO: 203788 - DNA, 15 bp, Homo sapiens
actctggcagatatc

SEQ ID NO: 203789 - DNA, 15 bp, Homo sapiens
cactctggcagatat

SEQ ID NO: 203790 - DNA, 15 bp, Homo sapiens
ccactctggcagata

SEQ ID NO: 203791 - DNA, 15 bp, Homo sapiens
cccactctggcagat

SEQ ID NO: 203792 - DNA, 15 bp, Homo sapiens
acccactctggcaga

SEQ ID NO: 203793 - DNA, 15 bp, Homo sapiens
cacccactctggcag

SEQ ID NO: 203794 - DNA, 15 bp, Homo sapiens
gcacccactctggca

SEQ ID NO: 203795 - DNA, 15 bp, Homo sapiens
agcacccactctggc

SEQ ID NO: 203796 - DNA, 15 bp, Homo sapiens
gagcacccactctgg

SEQ ID NO: 203797 - DNA, 15 bp, Homo sapiens
ggagcacccactctg

SEQ ID NO: 203798 - DNA, 15 bp, Homo sapiens
cggagcacccactct

SEQ ID NO: 203799 - DNA, 15 bp, Homo sapiens
acggagcacccactc

SEQ ID NO: 203800 - DNA, 15 bp, Homo sapiens
tacggagcacccact

SEQ ID NO: 203801 - DNA, 15 bp, Homo sapiens
ttacggagcacccac

SEQ ID NO: 203802 - DNA, 15 bp, Homo sapiens
tttacggagcaccca

SEQ ID NO: 203803 - DNA, 15 bp, Homo sapiens
atttacggagcaccc

SEQ ID NO: 203804 - DNA, 15 bp, Homo sapiens
catttacggagcacc

SEQ ID NO: 203805 - DNA, 15 bp, Homo sapiens
acatttacggagcac

SEQ ID NO: 203806 - DNA, 15 bp, Homo sapiens
aacatttacggagca

SEQ ID NO: 203807 - DNA, 15 bp, Homo sapiens
aaacatttacggagc

SEQ ID NO: 203808 - DNA, 15 bp, Homo sapiens
taaacatttacggag

SEQ ID NO: 203809 - DNA, 15 bp, Homo sapiens
gtaaacatttacgga

SEQ ID NO: 203810 - DNA, 15 bp, Homo sapiens
agtaaacatttacgg

SEQ ID NO: 203811 - DNA, 15 bp, Homo sapiens
aagtaaacatttacg

SEQ ID NO: 203812 - DNA, 15 bp, Homo sapiens
caagtaaacatttac

SEQ ID NO: 203813 - DNA, 15 bp, Homo sapiens
acaagtaaacattta

SEQ ID NO: 203814 - DNA, 15 bp, Homo sapiens
cacaagtaaacattt

SEQ ID NO: 203815 - DNA, 15 bp, Homo sapiens
gcacaagtaaacatt

SEQ ID NO: 203816 - DNA, 15 bp, Homo sapiens
agcacaagtaaacat

SEQ ID NO: 203817 - DNA, 15 bp, Homo sapiens
cagcacaagtaaaca

SEQ ID NO: 203818 - DNA, 15 bp, Homo sapiens
tcagcacaagtaaac

SEQ ID NO: 203819 - DNA, 15 bp, Homo sapiens
ctcagcacaagtaaa

SEQ ID NO: 203820 - DNA, 15 bp, Homo sapiens
actcagcacaagtaa

SEQ ID NO: 203821 - DNA, 15 bp, Homo sapiens
tactcagcacaagta

SEQ ID NO: 203822 - DNA, 15 bp, Homo sapiens
ttactcagcacaagt

SEQ ID NO: 203823 - DNA, 15 bp, Homo sapiens
tttactcagcacaag

SEQ ID NO: 203824 - DNA, 15 bp, Homo sapiens
atttactcagcacaa

SEQ ID NO: 203825 - DNA, 15 bp, Homo sapiens
catttactcagcaca

SEQ ID NO: 203826 - DNA, 15 bp, Homo sapiens
tcatttactcagcac

SEQ ID NO: 203827 - DNA, 15 bp, Homo sapiens
ttcatttactcagca

SEQ ID NO: 203828 - DNA, 15 bp, Homo sapiens
tttcatttactcagc

SEQ ID NO: 203829 - DNA, 15 bp, Homo sapiens
ttttcatttactcag

SEQ ID NO: 203830 - DNA, 15 bp, Homo sapiens
tttttcatttactca

SEQ ID NO: 203831 - DNA, 15 bp, Homo sapiens
gtttttcatttactc

SEQ ID NO: 203832 - DNA, 15 bp, Homo sapiens
agtttttcatttact

SEQ ID NO: 203833 - DNA, 15 bp, Homo sapiens
cagtttttcatttac

SEQ ID NO: 203834 - DNA, 15 bp, Homo sapiens
acagtttttcattta

SEQ ID NO: 203835 - DNA, 15 bp, Homo sapiens
tacagtttttcattt

SEQ ID NO: 203836 - DNA, 15 bp, Homo sapiens
atacagtttttcatt

SEQ ID NO: 203837 - DNA, 15 bp, Homo sapiens
aatacagtttttcat

SEQ ID NO: 203838 - DNA, 15 bp, Homo sapiens
aaatacagtttttca

SEQ ID NO: 203839 - DNA, 15 bp, Homo sapiens
aaaatacagtttttc

SEQ ID NO: 203840 - DNA, 15 bp, Homo sapiens
taaaatacagttttt

SEQ ID NO: 203841 - DNA, 15 bp, Homo sapiens
ataaaatacagtttt

SEQ ID NO: 203842 - DNA, 15 bp, Homo sapiens
aataaaatacagttt

SEQ ID NO: 203843 - DNA, 15 bp, Homo sapiens
aaataaaatacagtt

SEQ ID NO: 203844 - DNA, 15 bp, Homo sapiens
aaaataaaatacagt

SEQ ID NO: 203845 - DNA, 15 bp, Homo sapiens
taaaataaaatacag

SEQ ID NO: 203846 - DNA, 15 bp, Homo sapiens
ttaaaataaaataca

SEQ ID NO: 203847 - DNA, 15 bp, Homo sapiens
gttaaaataaaatac

SEQ ID NO: 203848 - DNA, 15 bp, Homo sapiens
ggttaaaataaaata

SEQ ID NO: 203849 - DNA, 15 bp, Homo sapiens
tggttaaaataaaat

SEQ ID NO: 203850 - DNA, 15 bp, Homo sapiens
ttggttaaaataaaa

SEQ ID NO: 203851 - DNA, 15 bp, Homo sapiens
attggttaaaataaa

SEQ ID NO: 203852 - DNA, 15 bp, Homo sapiens
cattggttaaaataa

SEQ ID NO: 203853 - DNA, 15 bp, Homo sapiens
gcattggttaaaata

SEQ ID NO: 203854 - DNA, 15 bp, Homo sapiens
agcattggttaaaat

SEQ ID NO: 203855 - DNA, 15 bp, Homo sapiens
gagcattggttaaaa

SEQ ID NO: 203856 - DNA, 15 bp, Homo sapiens
ggagcattggttaaa

SEQ ID NO: 203857 - DNA, 15 bp, Homo sapiens
aggagcattggttaa

SEQ ID NO: 203858 - DNA, 15 bp, Homo sapiens
aaggagcattggtta

SEQ ID NO: 203859 - DNA, 15 bp, Homo sapiens
gaaggagcattggtt

SEQ ID NO: 203860 - DNA, 15 bp, Homo sapiens
agaaggagcattggt

SEQ ID NO: 203861 - DNA, 15 bp, Homo sapiens
gagaaggagcattgg

SEQ ID NO: 203862 - DNA, 15 bp, Homo sapiens
tgagaaggagcattg

SEQ ID NO: 203863 - DNA, 15 bp, Homo sapiens
gtgagaaggagcatt

SEQ ID NO: 203864 - DNA, 15 bp, Homo sapiens
tgtgagaaggagcat

SEQ ID NO: 203865 - DNA, 15 bp, Homo sapiens
gtgtgagaaggagca

SEQ ID NO: 203866 - DNA, 15 bp, Homo sapiens
agtgtgagaaggagc

SEQ ID NO: 203867 - DNA, 15 bp, Homo sapiens
aagtgtgagaaggag

SEQ ID NO: 203868 - DNA, 15 bp, Homo sapiens
taagtgtgagaagga

SEQ ID NO: 203869 - DNA, 15 bp, Homo sapiens
gtaagtgtgagaagg

SEQ ID NO: 203870 - DNA, 15 bp, Homo sapiens
agtaagtgtgagaag

SEQ ID NO: 203871 - DNA, 15 bp, Homo sapiens
gagtaagtgtgagaa

SEQ ID NO: 203872 - DNA, 15 bp, Homo sapiens
tgagtaagtgtgaga

SEQ ID NO: 203873 - DNA, 15 bp, Homo sapiens
gtgagtaagtgtgag

SEQ ID NO: 203874 - DNA, 15 bp, Homo sapiens
tgtgagtaagtgtga

SEQ ID NO: 203875 - DNA, 15 bp, Homo sapiens
gtgtgagtaagtgtg

SEQ ID NO: 203876 - DNA, 15 bp, Homo sapiens
agtgtgagtaagtgt

SEQ ID NO: 203877 - DNA, 15 bp, Homo sapiens
tagtgtgagtaagtg

SEQ ID NO: 203878 - DNA, 15 bp, Homo sapiens
atagtgtgagtaagt

SEQ ID NO: 203879 - DNA, 15 bp, Homo sapiens
aatagtgtgagtaag

SEQ ID NO: 203880 - DNA, 15 bp, Homo sapiens
aaatagtgtgagtaa

SEQ ID NO: 203881 - DNA, 15 bp, Homo sapiens
gaaatagtgtgagta

SEQ ID NO: 203882 - DNA, 15 bp, Homo sapiens
ggaaatagtgtgagt

SEQ ID NO: 203883 - DNA, 15 bp, Homo sapiens
aggaaatagtgtgag

SEQ ID NO: 203884 - DNA, 15 bp, Homo sapiens
aaggaaatagtgtga

SEQ ID NO: 203885 - DNA, 15 bp, Homo sapiens
aaaggaaatagtgtg

SEQ ID NO: 203886 - DNA, 15 bp, Homo sapiens
aaaaggaaatagtgt

SEQ ID NO: 203887 - DNA, 15 bp, Homo sapiens
taaaaggaaatagtg

SEQ ID NO: 203888 - DNA, 15 bp, Homo sapiens
ataaaaggaaatagt

SEQ ID NO: 203889 - DNA, 15 bp, Homo sapiens
tataaaaggaaatag

SEQ ID NO: 203890 - DNA, 15 bp, Homo sapiens
atataaaaggaaata

SEQ ID NO: 203891 - DNA, 15 bp, Homo sapiens
gatataaaaggaaat

SEQ ID NO: 203892 - DNA, 15 bp, Homo sapiens
agatataaaaggaaa

SEQ ID NO: 203893 - DNA, 15 bp, Homo sapiens
cagatataaaaggaa

SEQ ID NO: 203894 - DNA, 15 bp, Homo sapiens
acagatataaaagga

SEQ ID NO: 203895 - DNA, 15 bp, Homo sapiens
tacagatataaaagg

SEQ ID NO: 203896 - DNA, 15 bp, Homo sapiens
gtacagatataaaag

SEQ ID NO: 203897 - DNA, 15 bp, Homo sapiens
tgtacagatataaaa

SEQ ID NO: 203898 - DNA, 15 bp, Homo sapiens
gtgtacagatataaa

SEQ ID NO: 203899 - DNA, 15 bp, Homo sapiens
agtgtacagatataa

SEQ ID NO: 203900 - DNA, 15 bp, Homo sapiens
cagtgtacagatata

SEQ ID NO: 203901 - DNA, 15 bp, Homo sapiens
ccagtgtacagatat

SEQ ID NO: 203902 - DNA, 15 bp, Homo sapiens
cccagtgtacagata

SEQ ID NO: 203903 - DNA, 15 bp, Homo sapiens
tcccagtgtacagat

SEQ ID NO: 203904 - DNA, 15 bp, Homo sapiens
ctcccagtgtacaga

SEQ ID NO: 203905 - DNA, 15 bp, Homo sapiens
tctcccagtgtacag

SEQ ID NO: 203906 - DNA, 15 bp, Homo sapiens
ttctcccagtgtaca

SEQ ID NO: 203907 - DNA, 15 bp, Homo sapiens
cttctcccagtgtac

SEQ ID NO: 203908 - DNA, 15 bp, Homo sapiens
ccttctcccagtgta

SEQ ID NO: 203909 - DNA, 15 bp, Homo sapiens
tccttctcccagtgt

SEQ ID NO: 203910 - DNA, 15 bp, Homo sapiens
ttccttctcccagtg

SEQ ID NO: 203911 - DNA, 15 bp, Homo sapiens
attccttctcccagt

SEQ ID NO: 203912 - DNA, 15 bp, Homo sapiens
tattccttctcccag

SEQ ID NO: 203913 - DNA, 15 bp, Homo sapiens
ttattccttctccca

SEQ ID NO: 203914 - DNA, 15 bp, Homo sapiens
attattccttctccc

SEQ ID NO: 203915 - DNA, 15 bp, Homo sapiens
tattattccttctcc

SEQ ID NO: 203916 - DNA, 15 bp, Homo sapiens
ttattattccttctc

SEQ ID NO: 203917 - DNA, 15 bp, Homo sapiens
gttattattccttct

SEQ ID NO: 203918 - DNA, 15 bp, Homo sapiens
agttattattccttc

SEQ ID NO: 203919 - DNA, 15 bp, Homo sapiens
aagttattattcctt

SEQ ID NO: 203920 - DNA, 15 bp, Homo sapiens
caagttattattcct

SEQ ID NO: 203921 - DNA, 15 bp, Homo sapiens
gcaagttattattcc

SEQ ID NO: 203922 - DNA, 15 bp, Homo sapiens
agcaagttattattc

SEQ ID NO: 203923 - DNA, 15 bp, Homo sapiens
aagcaagttattatt

SEQ ID NO: 203924 - DNA, 15 bp, Homo sapiens
caagcaagttattat

SEQ ID NO: 203925 - DNA, 15 bp, Homo sapiens
tcaagcaagttatta

SEQ ID NO: 203926 - DNA, 15 bp, Homo sapiens
ttcaagcaagttatt

SEQ ID NO: 203927 - DNA, 15 bp, Homo sapiens
cttcaagcaagttat

SEQ ID NO: 203928 - DNA, 15 bp, Homo sapiens
tcttcaagcaagtta

SEQ ID NO: 203929 - DNA, 15 bp, Homo sapiens
atcttcaagcaagtt

SEQ ID NO: 203930 - DNA, 15 bp, Homo sapiens
tatcttcaagcaagt

SEQ ID NO: 203931 - DNA, 15 bp, Homo sapiens
gtatcttcaagcaag

SEQ ID NO: 203932 - DNA, 15 bp, Homo sapiens
tgtatcttcaagcaa

SEQ ID NO: 203933 - DNA, 15 bp, Homo sapiens
ctgtatcttcaagca

SEQ ID NO: 203934 - DNA, 15 bp, Homo sapiens
actgtatcttcaagc

SEQ ID NO: 203935 - DNA, 15 bp, Homo sapiens
aactgtatcttcaag

SEQ ID NO: 203936 - DNA, 15 bp, Homo sapiens
aaactgtatcttcaa

SEQ ID NO: 203937 - DNA, 15 bp, Homo sapiens
caaactgtatcttca

SEQ ID NO: 203938 - DNA, 15 bp, Homo sapiens
acaaactgtatcttc

SEQ ID NO: 203939 - DNA, 15 bp, Homo sapiens
aacaaactgtatctt

SEQ ID NO: 203940 - DNA, 15 bp, Homo sapiens
aaacaaactgtatct

SEQ ID NO: 203941 - DNA, 15 bp, Homo sapiens
caaacaaactgtatc

SEQ ID NO: 203942 - DNA, 15 bp, Homo sapiens
tcaaacaaactgtat

SEQ ID NO: 203943 - DNA, 15 bp, Homo sapiens
ttcaaacaaactgta

SEQ ID NO: 203944 - DNA, 15 bp, Homo sapiens
tttcaaacaaactgt

SEQ ID NO: 203945 - DNA, 15 bp, Homo sapiens
ctttcaaacaaactg

SEQ ID NO: 203946 - DNA, 15 bp, Homo sapiens
actttcaaacaaact

SEQ ID NO: 203947 - DNA, 15 bp, Homo sapiens
aactttcaaacaaac

SEQ ID NO: 203948 - DNA, 15 bp, Homo sapiens
caactttcaaacaaa

SEQ ID NO: 203949 - DNA, 15 bp, Homo sapiens
ccaactttcaaacaa

SEQ ID NO: 203950 - DNA, 15 bp, Homo sapiens
tccaactttcaaaca

SEQ ID NO: 203951 - DNA, 15 bp, Homo sapiens
ctccaactttcaaac

SEQ ID NO: 203952 - DNA, 15 bp, Homo sapiens
cctccaactttcaaa

SEQ ID NO: 203953 - DNA, 15 bp, Homo sapiens
gcctccaactttcaa

SEQ ID NO: 203954 - DNA, 15 bp, Homo sapiens
agcctccaactttca

SEQ ID NO: 203955 - DNA, 15 bp, Homo sapiens
aagcctccaactttc

SEQ ID NO: 203956 - DNA, 15 bp, Homo sapiens
aaagcctccaacttt

SEQ ID NO: 203957 - DNA, 15 bp, Homo sapiens
aaaagcctccaactt

SEQ ID NO: 203958 - DNA, 15 bp, Homo sapiens
caaaagcctccaact

SEQ ID NO: 203959 - DNA, 15 bp, Homo sapiens
gcaaaagcctccaac

SEQ ID NO: 203960 - DNA, 15 bp, Homo sapiens
agcaaaagcctccaa

SEQ ID NO: 203961 - DNA, 15 bp, Homo sapiens
cagcaaaagcctcca

SEQ ID NO: 203962 - DNA, 15 bp, Homo sapiens
tcagcaaaagcctcc

SEQ ID NO: 203963 - DNA, 15 bp, Homo sapiens
atcagcaaaagcctc

SEQ ID NO: 203964 - DNA, 15 bp, Homo sapiens
aatcagcaaaagcct

SEQ ID NO: 203965 - DNA, 15 bp, Homo sapiens
aaatcagcaaaagcc

SEQ ID NO: 203966 - DNA, 15 bp, Homo sapiens
taaatcagcaaaagc

SEQ ID NO: 203967 - DNA, 15 bp, Homo sapiens
ttaaatcagcaaaag

SEQ ID NO: 203968 - DNA, 15 bp, Homo sapiens
tttaaatcagcaaaa

SEQ ID NO: 203969 - DNA, 15 bp, Homo sapiens
ttttaaatcagcaaa

SEQ ID NO: 203970 - DNA, 15 bp, Homo sapiens
gttttaaatcagcaa

SEQ ID NO: 203971 - DNA, 15 bp, Homo sapiens
tgttttaaatcagca

SEQ ID NO: 203972 - DNA, 15 bp, Homo sapiens
ctgttttaaatcagc

SEQ ID NO: 203973 - DNA, 15 bp, Homo sapiens
tctgttttaaatcag

SEQ ID NO: 203974 - DNA, 15 bp, Homo sapiens
atctgttttaaatca

SEQ ID NO: 203975 - DNA, 15 bp, Homo sapiens
tatctgttttaaatc

SEQ ID NO: 203976 - DNA, 15 bp, Homo sapiens
gtatctgttttaaat

SEQ ID NO: 203977 - DNA, 15 bp, Homo sapiens
agtatctgttttaaa

SEQ ID NO: 203978 - DNA, 15 bp, Homo sapiens
cagtatctgttttaa

SEQ ID NO: 203979 - DNA, 15 bp, Homo sapiens
ccagtatctgtttta

SEQ ID NO: 203980 - DNA, 15 bp, Homo sapiens
accagtatctgtttt

SEQ ID NO: 203981 - DNA, 15 bp, Homo sapiens
aaccagtatctgttt

SEQ ID NO: 203982 - DNA, 15 bp, Homo sapiens
aaaccagtatctgtt

SEQ ID NO: 203983 - DNA, 15 bp, Homo sapiens
caaaccagtatctgt

SEQ ID NO: 203984 - DNA, 15 bp, Homo sapiens
acaaaccagtatctg

SEQ ID NO: 203985 - DNA, 15 bp, Homo sapiens
tacaaaccagtatct

SEQ ID NO: 203986 - DNA, 15 bp, Homo sapiens
ctacaaaccagtatc

SEQ ID NO: 203987 - DNA, 15 bp, Homo sapiens
actacaaaccagtat

SEQ ID NO: 203988 - DNA, 15 bp, Homo sapiens
aactacaaaccagta

SEQ ID NO: 203989 - DNA, 15 bp, Homo sapiens
taactacaaaccagt

SEQ ID NO: 203990 - DNA, 15 bp, Homo sapiens
gtaactacaaaccag

SEQ ID NO: 203991 - DNA, 15 bp, Homo sapiens
agtaactacaaacca

SEQ ID NO: 203992 - DNA, 15 bp, Homo sapiens
aagtaactacaaacc

SEQ ID NO: 203993 - DNA, 15 bp, Homo sapiens
gaagtaactacaaac

SEQ ID NO: 203994 - DNA, 15 bp, Homo sapiens
ggaagtaactacaaa

SEQ ID NO: 203995 - DNA, 15 bp, Homo sapiens
tggaagtaactacaa

SEQ ID NO: 203996 - DNA, 15 bp, Homo sapiens
atggaagtaactaca

SEQ ID NO: 203997 - DNA, 15 bp, Homo sapiens
tatggaagtaactac

SEQ ID NO: 203998 - DNA, 15 bp, Homo sapiens
ttatggaagtaacta

SEQ ID NO: 203999 - DNA, 15 bp, Homo sapiens
attatggaagtaact

SEQ ID NO: 204000 - DNA, 15 bp, Homo sapiens
aattatggaagtaac

SEQ ID NO: 204001 - DNA, 15 bp, Homo sapiens
gaattatggaagtaa

SEQ ID NO: 204002 - DNA, 15 bp, Homo sapiens
ggaattatggaagta

SEQ ID NO: 204003 - DNA, 15 bp, Homo sapiens
aggaattatggaagt

SEQ ID NO: 204004 - DNA, 15 bp, Homo sapiens
aaggaattatggaag

SEQ ID NO: 204005 - DNA, 15 bp, Homo sapiens
aaaggaattatggaa

SEQ ID NO: 204006 - DNA, 15 bp, Homo sapiens
gaaaggaattatgga

SEQ ID NO: 204007 - DNA, 15 bp, Homo sapiens
agaaaggaattatgg

SEQ ID NO: 204008 - DNA, 15 bp, Homo sapiens
tagaaaggaattatg

SEQ ID NO: 204009 - DNA, 15 bp, Homo sapiens
gtagaaaggaattat

SEQ ID NO: 204010 - DNA, 15 bp, Homo sapiens
agtagaaaggaatta

SEQ ID NO: 204011 - DNA, 15 bp, Homo sapiens
cagtagaaaggaatt

SEQ ID NO: 204012 - DNA, 15 bp, Homo sapiens
acagtagaaaggaat

SEQ ID NO: 204013 - DNA, 15 bp, Homo sapiens
cacagtagaaaggaa

SEQ ID NO: 204014 - DNA, 15 bp, Homo sapiens
gcacagtagaaagga

SEQ ID NO: 204015 - DNA, 15 bp, Homo sapiens
agcacagtagaaagg

SEQ ID NO: 204016 - DNA, 15 bp, Homo sapiens
aagcacagtagaaag

SEQ ID NO: 204017 - DNA, 15 bp, Homo sapiens
taagcacagtagaaa

SEQ ID NO: 204018 - DNA, 15 bp, Homo sapiens
ttaagcacagtagaa

SEQ ID NO: 204019 - DNA, 15 bp, Homo sapiens
tttaagcacagtaga

SEQ ID NO: 204020 - DNA, 15 bp, Homo sapiens
atttaagcacagtag

SEQ ID NO: 204021 - DNA, 15 bp, Homo sapiens
catttaagcacagta

SEQ ID NO: 204022 - DNA, 15 bp, Homo sapiens
tcatttaagcacagt

SEQ ID NO: 204023 - DNA, 15 bp, Homo sapiens
atcatttaagcacag

SEQ ID NO: 204024 - DNA, 15 bp, Homo sapiens
catcatttaagcaca

SEQ ID NO: 204025 - DNA, 15 bp, Homo sapiens
tcatcatttaagcac

SEQ ID NO: 204026 - DNA, 15 bp, Homo sapiens
ttcatcatttaagca

SEQ ID NO: 204027 - DNA, 15 bp, Homo sapiens
cttcatcatttaagc

SEQ ID NO: 204028 - DNA, 15 bp, Homo sapiens
acttcatcatttaag

SEQ ID NO: 204029 - DNA, 15 bp, Homo sapiens
tacttcatcatttaa

SEQ ID NO: 204030 - DNA, 15 bp, Homo sapiens
gtacttcatcattta

SEQ ID NO: 204031 - DNA, 15 bp, Homo sapiens
ggtacttcatcattt

SEQ ID NO: 204032 - DNA, 15 bp, Homo sapiens
tggtacttcatcatt

SEQ ID NO: 204033 - DNA, 15 bp, Homo sapiens
atggtacttcatcat

SEQ ID NO: 204034 - DNA, 15 bp, Homo sapiens
aatggtacttcatca

SEQ ID NO: 204035 - DNA, 15 bp, Homo sapiens
aaatggtacttcatc

SEQ ID NO: 204036 - DNA, 15 bp, Homo sapiens
aaaatggtacttcat

SEQ ID NO: 204037 - DNA, 15 bp, Homo sapiens
aaaaatggtacttca

SEQ ID NO: 204038 - DNA, 15 bp, Homo sapiens
taaaaatggtacttc

SEQ ID NO: 204039 - DNA, 15 bp, Homo sapiens
ataaaaatggtactt

SEQ ID NO: 204040 - DNA, 15 bp, Homo sapiens
cataaaaatggtact

SEQ ID NO: 204041 - DNA, 15 bp, Homo sapiens
ccataaaaatggtac

SEQ ID NO: 204042 - DNA, 15 bp, Homo sapiens
cccataaaaatggta

SEQ ID NO: 204043 - DNA, 15 bp, Homo sapiens
acccataaaaatggt

SEQ ID NO: 204044 - DNA, 15 bp, Homo sapiens
gacccataaaaatgg

SEQ ID NO: 204045 - DNA, 15 bp, Homo sapiens
agacccataaaaatg

SEQ ID NO: 204046 - DNA, 15 bp, Homo sapiens
aagacccataaaaat

SEQ ID NO: 204047 - DNA, 15 bp, Homo sapiens
aaagacccataaaaa

SEQ ID NO: 204048 - DNA, 15 bp, Homo sapiens
taaagacccataaaa

SEQ ID NO: 204049 - DNA, 15 bp, Homo sapiens
gtaaagacccataaa

SEQ ID NO: 204050 - DNA, 15 bp, Homo sapiens
ggtaaagacccataa

SEQ ID NO: 204051 - DNA, 15 bp, Homo sapiens
aggtaaagacccata

SEQ ID NO: 204052 - DNA, 15 bp, Homo sapiens
aaggtaaagacccat

SEQ ID NO: 204053 - DNA, 15 bp, Homo sapiens
gaaggtaaagaccca

SEQ ID NO: 204054 - DNA, 15 bp, Homo sapiens
agaaggtaaagaccc

SEQ ID NO: 204055 - DNA, 15 bp, Homo sapiens
tagaaggtaaagacc

SEQ ID NO: 204056 - DNA, 15 bp, Homo sapiens
ttagaaggtaaagac

SEQ ID NO: 204057 - DNA, 15 bp, Homo sapiens
gttagaaggtaaaga

SEQ ID NO: 204058 - DNA, 15 bp, Homo sapiens
tgttagaaggtaaag

SEQ ID NO: 204059 - DNA, 15 bp, Homo sapiens
atgttagaaggtaaa

SEQ ID NO: 204060 - DNA, 15 bp, Homo sapiens
catgttagaaggtaa

SEQ ID NO: 204061 - DNA, 15 bp, Homo sapiens
acatgttagaaggta

SEQ ID NO: 204062 - DNA, 15 bp, Homo sapiens
aacatgttagaaggt

SEQ ID NO: 204063 - DNA, 15 bp, Homo sapiens
aaacatgttagaagg

SEQ ID NO: 204064 - DNA, 15 bp, Homo sapiens
aaaacatgttagaag

SEQ ID NO: 204065 - DNA, 15 bp, Homo sapiens
aaaaacatgttagaa

SEQ ID NO: 204066 - DNA, 15 bp, Homo sapiens
caaaaacatgttaga

SEQ ID NO: 204067 - DNA, 15 bp, Homo sapiens
gcaaaaacatgttag

SEQ ID NO: 204068 - DNA, 15 bp, Homo sapiens
tgcaaaaacatgtta

SEQ ID NO: 204069 - DNA, 15 bp, Homo sapiens
atgcaaaaacatgtt

SEQ ID NO: 204070 - DNA, 15 bp, Homo sapiens
aatgcaaaaacatgt

SEQ ID NO: 204071 - DNA, 15 bp, Homo sapiens
taatgcaaaaacatg

SEQ ID NO: 204072 - DNA, 15 bp, Homo sapiens
gtaatgcaaaaacat

SEQ ID NO: 204073 - DNA, 15 bp, Homo sapiens
tgtaatgcaaaaaca

SEQ ID NO: 204074 - DNA, 15 bp, Homo sapiens
atgtaatgcaaaaac

SEQ ID NO: 204075 - DNA, 15 bp, Homo sapiens
aatgtaatgcaaaaa

SEQ ID NO: 204076 - DNA, 15 bp, Homo sapiens
aaatgtaatgcaaaa

SEQ ID NO: 204077 - DNA, 15 bp, Homo sapiens
aaaatgtaatgcaaa

SEQ ID NO: 204078 - DNA, 15 bp, Homo sapiens
aaaaatgtaatgcaa

SEQ ID NO: 204079 - DNA, 15 bp, Homo sapiens
aaaaaatgtaatgca

SEQ ID NO: 204080 - DNA, 15 bp, Homo sapiens
taaaaaatgtaatgc

SEQ ID NO: 204081 - DNA, 15 bp, Homo sapiens
ttaaaaaatgtaatg

SEQ ID NO: 204082 - DNA, 15 bp, Homo sapiens
cttaaaaaatgtaat

SEQ ID NO: 204083 - DNA, 15 bp, Homo sapiens
tcttaaaaaatgtaa

SEQ ID NO: 204084 - DNA, 15 bp, Homo sapiens
ttcttaaaaaatgta

SEQ ID NO: 204085 - DNA, 15 bp, Homo sapiens
attcttaaaaaatgt

SEQ ID NO: 204086 - DNA, 15 bp, Homo sapiens
tattcttaaaaaatg

SEQ ID NO: 204087 - DNA, 15 bp, Homo sapiens
ttattcttaaaaaat

SEQ ID NO: 204088 - DNA, 15 bp, Homo sapiens
gttattcttaaaaaa

SEQ ID NO: 204089 - DNA, 15 bp, Homo sapiens
agttattcttaaaaa

SEQ ID NO: 204090 - DNA, 15 bp, Homo sapiens
cagttattcttaaaa

SEQ ID NO: 204091 - DNA, 15 bp, Homo sapiens
ccagttattcttaaa

SEQ ID NO: 204092 - DNA, 15 bp, Homo sapiens
accagttattcttaa

SEQ ID NO: 204093 - DNA, 15 bp, Homo sapiens
gaccagttattctta

SEQ ID NO: 204094 - DNA, 15 bp, Homo sapiens
tgaccagttattctt

SEQ ID NO: 204095 - DNA, 15 bp, Homo sapiens
gtgaccagttattct

SEQ ID NO: 204096 - DNA, 15 bp, Homo sapiens
agtgaccagttattc

SEQ ID NO: 204097 - DNA, 15 bp, Homo sapiens
aagtgaccagttatt

SEQ ID NO: 204098 - DNA, 15 bp, Homo sapiens
taagtgaccagttat

SEQ ID NO: 204099 - DNA, 15 bp, Homo sapiens
ttaagtgaccagtta

SEQ ID NO: 204100 - DNA, 15 bp, Homo sapiens
tttaagtgaccagtt

SEQ ID NO: 204101 - DNA, 15 bp, Homo sapiens
ttttaagtgaccagt

SEQ ID NO: 204102 - DNA, 15 bp, Homo sapiens
tttttaagtgaccag

SEQ ID NO: 204103 - DNA, 15 bp, Homo sapiens
atttttaagtgacca

SEQ ID NO: 204104 - DNA, 15 bp, Homo sapiens
tatttttaagtgacc

SEQ ID NO: 204105 - DNA, 15 bp, Homo sapiens
gtatttttaagtgac

SEQ ID NO: 204106 - DNA, 15 bp, Homo sapiens
agtatttttaagtga

SEQ ID NO: 204107 - DNA, 15 bp, Homo sapiens
aagtatttttaagtg

SEQ ID NO: 204108 - DNA, 15 bp, Homo sapiens
taagtatttttaagt

SEQ ID NO: 204109 - DNA, 15 bp, Homo sapiens
ataagtatttttaag

SEQ ID NO: 204110 - DNA, 15 bp, Homo sapiens
tataagtatttttaa

SEQ ID NO: 204111 - DNA, 15 bp, Homo sapiens
ctataagtattttta

SEQ ID NO: 204112 - DNA, 15 bp, Homo sapiens
tctataagtattttt

SEQ ID NO: 204113 - DNA, 15 bp, Homo sapiens
ctctataagtatttt

SEQ ID NO: 204114 - DNA, 15 bp, Homo sapiens
actctataagtattt

SEQ ID NO: 204115 - DNA, 15 bp, Homo sapiens
aactctataagtatt

SEQ ID NO: 204116 - DNA, 15 bp, Homo sapiens
caactctataagtat

SEQ ID NO: 204117 - DNA, 15 bp, Homo sapiens
acaactctataagta

SEQ ID NO: 204118 - DNA, 15 bp, Homo sapiens
tacaactctataagt

SEQ ID NO: 204119 - DNA, 15 bp, Homo sapiens
ttacaactctataag

SEQ ID NO: 204120 - DNA, 15 bp, Homo sapiens
tttacaactctataa

SEQ ID NO: 204121 - DNA, 15 bp, Homo sapiens
ttttacaactctata

SEQ ID NO: 204122 - DNA, 15 bp, Homo sapiens
tttttacaactctat

SEQ ID NO: 204123 - DNA, 15 bp, Homo sapiens
cattttttacaactc

SEQ ID NO: 204124 - DNA, 15 bp, Homo sapiens
tcattttttacaact

SEQ ID NO: 204125 - DNA, 15 bp, Homo sapiens
atcattttttacaac

SEQ ID NO: 204126 - DNA, 15 bp, Homo sapiens
aatcattttttacaa

SEQ ID NO: 204127 - DNA, 15 bp, Homo sapiens
gaatcattttttaca

SEQ ID NO: 204128 - DNA, 15 bp, Homo sapiens
tgaatcattttttac

SEQ ID NO: 204129 - DNA, 15 bp, Homo sapiens
ttgaatcatttttta

SEQ ID NO: 204130 - DNA, 15 bp, Homo sapiens
attgaatcatttttt

SEQ ID NO: 204131 - DNA, 15 bp, Homo sapiens
aattgaatcattttt

SEQ ID NO: 204132 - DNA, 15 bp, Homo sapiens
aaattgaatcatttt

SEQ ID NO: 204133 - DNA, 15 bp, Homo sapiens
aaaattgaatcattt

SEQ ID NO: 204134 - DNA, 15 bp, Homo sapiens
taaaattgaatcatt

SEQ ID NO: 204135 - DNA, 15 bp, Homo sapiens
ttaaaattgaatcat

SEQ ID NO: 204136 - DNA, 15 bp, Homo sapiens
tttaaaattgaatca

SEQ ID NO: 204137 - DNA, 15 bp, Homo sapiens
ttttaaaattgaatc

SEQ ID NO: 204138 - DNA, 15 bp, Homo sapiens
cttttaaaattgaat

SEQ ID NO: 204139 - DNA, 15 bp, Homo sapiens
ccttttaaaattgaa

SEQ ID NO: 204140 - DNA, 15 bp, Homo sapiens
tccttttaaaattga

SEQ ID NO: 204141 - DNA, 15 bp, Homo sapiens
ctccttttaaaattg

SEQ ID NO: 204142 - DNA, 15 bp, Homo sapiens
actccttttaaaatt

SEQ ID NO: 204143 - DNA, 15 bp, Homo sapiens
tactccttttaaaat

SEQ ID NO: 204144 - DNA, 15 bp, Homo sapiens
ttactccttttaaaa

SEQ ID NO: 204145 - DNA, 15 bp, Homo sapiens
gttactccttttaaa

SEQ ID NO: 204146 - DNA, 15 bp, Homo sapiens
agttactccttttaa

SEQ ID NO: 204147 - DNA, 15 bp, Homo sapiens
aagttactcctttta

SEQ ID NO: 204148 - DNA, 15 bp, Homo sapiens
caagttactcctttt

SEQ ID NO: 204149 - DNA, 15 bp, Homo sapiens
gcaagttactccttt

SEQ ID NO: 204150 - DNA, 15 bp, Homo sapiens
cgcaagttactcctt

SEQ ID NO: 204151 - DNA, 15 bp, Homo sapiens
acgcaagttactcct

SEQ ID NO: 204152 - DNA, 15 bp, Homo sapiens
tacgcaagttactcc

SEQ ID NO: 204153 - DNA, 15 bp, Homo sapiens
ttacgcaagttactc

SEQ ID NO: 204154 - DNA, 15 bp, Homo sapiens
tttacgcaagttact

SEQ ID NO: 204155 - DNA, 15 bp, Homo sapiens
ttttacgcaagttac

SEQ ID NO: 204156 - DNA, 15 bp, Homo sapiens
cttttacgcaagtta

SEQ ID NO: 204157 - DNA, 15 bp, Homo sapiens
tcttttacgcaagtt

SEQ ID NO: 204158 - DNA, 15 bp, Homo sapiens
atcttttacgcaagt

SEQ ID NO: 204159 - DNA, 15 bp, Homo sapiens
tatcttttacgcaag

SEQ ID NO: 204160 - DNA, 15 bp, Homo sapiens
atatcttttacgcaa

SEQ ID NO: 204161 - DNA, 15 bp, Homo sapiens
aatatcttttacgca

SEQ ID NO: 204162 - DNA, 15 bp, Homo sapiens
gaatatcttttacgc

SEQ ID NO: 204163 - DNA, 15 bp, Homo sapiens
agaatatcttttacg

SEQ ID NO: 204164 - DNA, 15 bp, Homo sapiens
cagaatatcttttac

SEQ ID NO: 204165 - DNA, 15 bp, Homo sapiens
acagaatatctttta

SEQ ID NO: 204166 - DNA, 15 bp, Homo sapiens
tacagaatatctttt

SEQ ID NO: 204167 - DNA, 15 bp, Homo sapiens
ctacagaatatcttt

SEQ ID NO: 204168 - DNA, 15 bp, Homo sapiens
actacagaatatctt

SEQ ID NO: 204169 - DNA, 15 bp, Homo sapiens
tactacagaatatct

SEQ ID NO: 204170 - DNA, 15 bp, Homo sapiens
ctactacagaatatc

SEQ ID NO: 204171 - DNA, 15 bp, Homo sapiens
tctactacagaatat

SEQ ID NO: 204172 - DNA, 15 bp, Homo sapiens
gtctactacagaata

SEQ ID NO: 204173 - DNA, 15 bp, Homo sapiens
tgtctactacagaat

SEQ ID NO: 204174 - DNA, 15 bp, Homo sapiens
atgtctactacagaa

SEQ ID NO: 204175 - DNA, 15 bp, Homo sapiens
gatgtctactacaga

SEQ ID NO: 204176 - DNA, 15 bp, Homo sapiens
tgatgtctactacag

SEQ ID NO: 204177 - DNA, 15 bp, Homo sapiens
atgatgtctactaca

SEQ ID NO: 204178 - DNA, 15 bp, Homo sapiens
gatgatgtctactac

SEQ ID NO: 204179 - DNA, 15 bp, Homo sapiens
ggatgatgtctacta

SEQ ID NO: 204180 - DNA, 15 bp, Homo sapiens
aggatgatgtctact

SEQ ID NO: 204181 - DNA, 15 bp, Homo sapiens
taggatgatgtctac

SEQ ID NO: 204182 - DNA, 15 bp, Homo sapiens
ctaggatgatgtcta

SEQ ID NO: 204183 - DNA, 15 bp, Homo sapiens
cctaggatgatgtct

SEQ ID NO: 204184 - DNA, 15 bp, Homo sapiens
acctaggatgatgtc

SEQ ID NO: 204185 - DNA, 15 bp, Homo sapiens
aacctaggatgatgt

SEQ ID NO: 204186 - DNA, 15 bp, Homo sapiens
caacctaggatgatg

SEQ ID NO: 204187 - DNA, 15 bp, Homo sapiens
tcaacctaggatgat

SEQ ID NO: 204188 - DNA, 15 bp, Homo sapiens
atcaacctaggatga

SEQ ID NO: 204189 - DNA, 15 bp, Homo sapiens
tatcaacctaggatg

SEQ ID NO: 204190 - DNA, 15 bp, Homo sapiens
ttatcaacctaggat

SEQ ID NO: 204191 - DNA, 15 bp, Homo sapiens
attatcaacctagga

SEQ ID NO: 204192 - DNA, 15 bp, Homo sapiens
tattatcaacctagg

SEQ ID NO: 204193 - DNA, 15 bp, Homo sapiens
gtattatcaacctag

SEQ ID NO: 204194 - DNA, 15 bp, Homo sapiens
tgtattatcaaccta

SEQ ID NO: 204195 - DNA, 15 bp, Homo sapiens
ctgtattatcaacct

SEQ ID NO: 204196 - DNA, 15 bp, Homo sapiens
actgtattatcaacc

SEQ ID NO: 204197 - DNA, 15 bp, Homo sapiens
gactgtattatcaac

SEQ ID NO: 204198 - DNA, 15 bp, Homo sapiens
tgactgtattatcaa

SEQ ID NO: 204199 - DNA, 15 bp, Homo sapiens
ttgactgtattatca

SEQ ID NO: 204200 - DNA, 15 bp, Homo sapiens
attgactgtattatc

SEQ ID NO: 204201 - DNA, 15 bp, Homo sapiens
tattgactgtattat

SEQ ID NO: 204202 - DNA, 15 bp, Homo sapiens
ttattgactgtatta

SEQ ID NO: 204203 - DNA, 15 bp, Homo sapiens
tttattgactgtatt

SEQ ID NO: 204204 - DNA, 15 bp, Homo sapiens
ttttattgactgtat

SEQ ID NO: 204205 - DNA, 15 bp, Homo sapiens
cttttattgactgta

SEQ ID NO: 204206 - DNA, 15 bp, Homo sapiens
acttttattgactgt

SEQ ID NO: 204207 - DNA, 15 bp, Homo sapiens
cacttttattgactg

SEQ ID NO: 204208 - DNA, 15 bp, Homo sapiens
acacttttattgact

SEQ ID NO: 204209 - DNA, 15 bp, Homo sapiens
aacacttttattgac

SEQ ID NO: 204210 - DNA, 15 bp, Homo sapiens
aaacacttttattga

SEQ ID NO: 204211 - DNA, 15 bp, Homo sapiens
taaacacttttattg

SEQ ID NO: 204212 - DNA, 15 bp, Homo sapiens
ataaacacttttatt

SEQ ID NO: 204213 - DNA, 15 bp, Homo sapiens
aataaacacttttat

SEQ ID NO: 204214 - DNA, 15 bp, Homo sapiens
caataaacactttta

SEQ ID NO: 204215 - DNA, 15 bp, Homo sapiens
gcaataaacactttt

SEQ ID NO: 204216 - DNA, 15 bp, Homo sapiens
agcaataaacacttt

SEQ ID NO: 204217 - DNA, 15 bp, Homo sapiens
aagcaataaacactt

SEQ ID NO: 204218 - DNA, 15 bp, Homo sapiens
aaagcaataaacact

SEQ ID NO: 204219 - DNA, 15 bp, Homo sapiens
caaagcaataaacac

SEQ ID NO: 204220 - DNA, 15 bp, Homo sapiens
acaaagcaataaaca

SEQ ID NO: 204221 - DNA, 15 bp, Homo sapiens
tacaaagcaataaac

SEQ ID NO: 204222 - DNA, 15 bp, Homo sapiens
gtacaaagcaataaa

SEQ ID NO: 204223 - DNA, 15 bp, Homo sapiens
tgtacaaagcaataa

SEQ ID NO: 204224 - DNA, 15 bp, Homo sapiens
atgtacaaagcaata

SEQ ID NO: 204225 - DNA, 15 bp, Homo sapiens
tatgtacaaagcaat

SEQ ID NO: 204226 - DNA, 15 bp, Homo sapiens
atatgtacaaagcaa

SEQ ID NO: 204227 - DNA, 15 bp, Homo sapiens
gatatgtacaaagca

SEQ ID NO: 204228 - DNA, 15 bp, Homo sapiens
tgatatgtacaaagc

SEQ ID NO: 204229 - DNA, 15 bp, Homo sapiens
ttgatatgtacaaag

SEQ ID NO: 204230 - DNA, 15 bp, Homo sapiens
tttgatatgtacaaa

SEQ ID NO: 204231 - DNA, 15 bp, Homo sapiens
ctttgatatgtacaa

SEQ ID NO: 204232 - DNA, 15 bp, Homo sapiens
actttgatatgtaca

SEQ ID NO: 204233 - DNA, 15 bp, Homo sapiens
tactttgatatgtac

SEQ ID NO: 204234 - DNA, 15 bp, Homo sapiens
gtactttgatatgta

SEQ ID NO: 204235 - DNA, 15 bp, Homo sapiens
agtactttgatatgt

SEQ ID NO: 204236 - DNA, 15 bp, Homo sapiens
tagtactttgatatg

SEQ ID NO: 204237 - DNA, 15 bp, Homo sapiens
ttagtactttgatat

SEQ ID NO: 204238 - DNA, 15 bp, Homo sapiens
tttagtactttgata

SEQ ID NO: 204239 - DNA, 15 bp, Homo sapiens
ctttagtactttgat

SEQ ID NO: 204240 - DNA, 15 bp, Homo sapiens
cctttagtactttga

SEQ ID NO: 204241 - DNA, 15 bp, Homo sapiens
tcctttagtactttg

SEQ ID NO: 204242 - DNA, 15 bp, Homo sapiens
ctcctttagtacttt

SEQ ID NO: 204243 - DNA, 15 bp, Homo sapiens
actcctttagtactt

SEQ ID NO: 204244 - DNA, 15 bp, Homo sapiens
cactcctttagtact

SEQ ID NO: 204245 - DNA, 15 bp, Homo sapiens
tcactcctttagtac

SEQ ID NO: 204246 - DNA, 15 bp, Homo sapiens
ttcactcctttagta

SEQ ID NO: 204247 - DNA, 15 bp, Homo sapiens
gttcactcctttagt

SEQ ID NO: 204248 - DNA, 15 bp, Homo sapiens
agttcactcctttag

SEQ ID NO: 204249 - DNA, 15 bp, Homo sapiens
cagttcactccttta

SEQ ID NO: 204250 - DNA, 15 bp, Homo sapiens
tcagttcactccttt

SEQ ID NO: 204251 - DNA, 15 bp, Homo sapiens
ttcagttcactcctt

SEQ ID NO: 204252 - DNA, 15 bp, Homo sapiens
cttcagttcactcct

SEQ ID NO: 204253 - DNA, 15 bp, Homo sapiens
gcttcagttcactcc

SEQ ID NO: 204254 - DNA, 15 bp, Homo sapiens
tgcttcagttcactc

SEQ ID NO: 204255 - DNA, 15 bp, Homo sapiens
ctgcttcagttcact

SEQ ID NO: 204256 - DNA, 15 bp, Homo sapiens
gctgcttcagttcac

SEQ ID NO: 204257 - DNA, 15 bp, Homo sapiens
agctgcttcagttca

SEQ ID NO: 204258 - DNA, 15 bp, Homo sapiens
cagctgcttcagttc

SEQ ID NO: 204259 - DNA, 15 bp, Homo sapiens
tcagctgcttcagtt

SEQ ID NO: 204260 - DNA, 15 bp, Homo sapiens
ctcagctgcttcagt

SEQ ID NO: 204261 - DNA, 15 bp, Homo sapiens
tctcagctgcttcag

SEQ ID NO: 204262 - DNA, 15 bp, Homo sapiens
atctcagctgcttca

SEQ ID NO: 204263 - DNA, 15 bp, Homo sapiens
catctcagctgcttc

SEQ ID NO: 204264 - DNA, 15 bp, Homo sapiens
acatctcagctgctt

SEQ ID NO: 204265 - DNA, 15 bp, Homo sapiens
aacatctcagctgct

SEQ ID NO: 204266 - DNA, 15 bp, Homo sapiens
taacatctcagctgc

SEQ ID NO: 204267 - DNA, 15 bp, Homo sapiens
ctaacatctcagctg

SEQ ID NO: 204268 - DNA, 15 bp, Homo sapiens
tctaacatctcagct

SEQ ID NO: 204269 - DNA, 15 bp, Homo sapiens
ttctaacatctcagc

SEQ ID NO: 204270 - DNA, 15 bp, Homo sapiens
attctaacatctcag

SEQ ID NO: 204271 - DNA, 15 bp, Homo sapiens
tattctaacatctca

SEQ ID NO: 204272 - DNA, 15 bp, Homo sapiens
ttattctaacatctc

SEQ ID NO: 204273 - DNA, 15 bp, Homo sapiens
cttattctaacatct

SEQ ID NO: 204274 - DNA, 15 bp, Homo sapiens
acttattctaacatc

SEQ ID NO: 204275 - DNA, 15 bp, Homo sapiens
gacttattctaacat

SEQ ID NO: 204276 - DNA, 15 bp, Homo sapiens
tgacttattctaaca

SEQ ID NO: 204277 - DNA, 15 bp, Homo sapiens
ttgacttattctaac

SEQ ID NO: 204278 - DNA, 15 bp, Homo sapiens
attgacttattctaa

SEQ ID NO: 204279 - DNA, 15 bp, Homo sapiens
aattgacttattcta

SEQ ID NO: 204280 - DNA, 15 bp, Homo sapiens
caattgacttattct

SEQ ID NO: 204281 - DNA, 15 bp, Homo sapiens
acaattgacttattc

SEQ ID NO: 204282 - DNA, 15 bp, Homo sapiens
gacaattgacttatt

SEQ ID NO: 204283 - DNA, 15 bp, Homo sapiens
agacaattgacttat

SEQ ID NO: 204284 - DNA, 15 bp, Homo sapiens
tagacaattgactta

SEQ ID NO: 204285 - DNA, 15 bp, Homo sapiens
ttagacaattgactt

SEQ ID NO: 204286 - DNA, 15 bp, Homo sapiens
tttagacaattgact

SEQ ID NO: 204287 - DNA, 15 bp, Homo sapiens
ttttagacaattgac

SEQ ID NO: 204288 - DNA, 15 bp, Homo sapiens
tttttagacaattga

SEQ ID NO: 204289 - DNA, 15 bp, Homo sapiens
atttttagacaattg

SEQ ID NO: 204290 - DNA, 15 bp, Homo sapiens
tatttttagacaatt

SEQ ID NO: 204291 - DNA, 15 bp, Homo sapiens
atatttttagacaat

SEQ ID NO: 204292 - DNA, 15 bp, Homo sapiens
catatttttagacaa

SEQ ID NO: 204293 - DNA, 15 bp, Homo sapiens
tcatatttttagaca

SEQ ID NO: 204294 - DNA, 15 bp, Homo sapiens
attcatatttttaga

SEQ ID NO: 204295 - DNA, 15 bp, Homo sapiens
cattcatatttttag

SEQ ID NO: 204296 - DNA, 15 bp, Homo sapiens
gcattcatattttta

SEQ ID NO: 204297 - DNA, 15 bp, Homo sapiens
ggcattcatattttt

SEQ ID NO: 204298 - DNA, 15 bp, Homo sapiens
gggcattcatatttt

SEQ ID NO: 204299 - DNA, 15 bp, Homo sapiens
tgggcattcatattt

SEQ ID NO: 204300 - DNA, 15 bp, Homo sapiens
gtgggcattcatatt

SEQ ID NO: 204301 - DNA, 15 bp, Homo sapiens
tgtgggcattcatat

SEQ ID NO: 204302 - DNA, 15 bp, Homo sapiens
ctgtgggcattcata

SEQ ID NO: 204303 - DNA, 15 bp, Homo sapiens
tctgtgggcattcat

SEQ ID NO: 204304 - DNA, 15 bp, Homo sapiens
atctgtgggcattca

SEQ ID NO: 204305 - DNA, 15 bp, Homo sapiens
tatctgtgggcattc

SEQ ID NO: 204306 - DNA, 15 bp, Homo sapiens
atatctgtgggcatt

SEQ ID NO: 204307 - DNA, 15 bp, Homo sapiens
catatctgtgggcat

SEQ ID NO: 204308 - DNA, 15 bp, Homo sapiens
acatatctgtgggca

SEQ ID NO: 204309 - DNA, 15 bp, Homo sapiens
aacatatctgtgggc

SEQ ID NO: 204310 - DNA, 15 bp, Homo sapiens
aaacatatctgtggg

SEQ ID NO: 204311 - DNA, 15 bp, Homo sapiens
caaacatatctgtgg

SEQ ID NO: 204312 - DNA, 15 bp, Homo sapiens
tcaaacatatctgtg

SEQ ID NO: 204313 - DNA, 15 bp, Homo sapiens
atcaaacatatctgt

SEQ ID NO: 204314 - DNA, 15 bp, Homo sapiens
tatcaaacatatctg

SEQ ID NO: 204315 - DNA, 15 bp, Homo sapiens
ttatcaaacatatct

SEQ ID NO: 204316 - DNA, 15 bp, Homo sapiens
tttatcaaacatatc

SEQ ID NO: 204317 - DNA, 15 bp, Homo sapiens
ctttatcaaacatat

SEQ ID NO: 204318 - DNA, 15 bp, Homo sapiens
tctttatcaaacata

SEQ ID NO: 204319 - DNA, 15 bp, Homo sapiens
ttctttatcaaacat

SEQ ID NO: 204320 - DNA, 15 bp, Homo sapiens
tttctttatcaaaca

SEQ ID NO: 204321 - DNA, 15 bp, Homo sapiens
atttctttatcaaac

SEQ ID NO: 204322 - DNA, 15 bp, Homo sapiens
catttctttatcaaa

SEQ ID NO: 204323 - DNA, 15 bp, Homo sapiens
acatttctttatcaa

SEQ ID NO: 204324 - DNA, 15 bp, Homo sapiens
aacatttctttatca

SEQ ID NO: 204325 - DNA, 15 bp, Homo sapiens
aaacatttctttatc

SEQ ID NO: 204326 - DNA, 15 bp, Homo sapiens
aaaacatttctttat

SEQ ID NO: 204327 - DNA, 15 bp, Homo sapiens
taaaacatttcttta

SEQ ID NO: 204328 - DNA, 15 bp, Homo sapiens
ataaaacatttcttt

SEQ ID NO: 204329 - DNA, 15 bp, Homo sapiens
cataaaacatttctt

SEQ ID NO: 204330 - DNA, 15 bp, Homo sapiens
acataaaacatttct

SEQ ID NO: 204331 - DNA, 15 bp, Homo sapiens
cacataaaacatttc

SEQ ID NO: 204332 - DNA, 15 bp, Homo sapiens
tcacataaaacattt

SEQ ID NO: 204333 - DNA, 15 bp, Homo sapiens
ttcacataaaacatt

SEQ ID NO: 204334 - DNA, 15 bp, Homo sapiens
cttcacataaaacat

SEQ ID NO: 204335 - DNA, 15 bp, Homo sapiens
tcttcacataaaaca

SEQ ID NO: 204336 - DNA, 15 bp, Homo sapiens
atcttcacataaaac

SEQ ID NO: 204337 - DNA, 15 bp, Homo sapiens
aatcttcacataaaa

SEQ ID NO: 204338 - DNA, 15 bp, Homo sapiens
aaatcttcacataaa

SEQ ID NO: 204339 - DNA, 15 bp, Homo sapiens
aaaatcttcacataa

SEQ ID NO: 204340 - DNA, 15 bp, Homo sapiens
caaaatcttcacata

SEQ ID NO: 204341 - DNA, 15 bp, Homo sapiens
tcaaaatcttcacat

SEQ ID NO: 204342 - DNA, 15 bp, Homo sapiens
ttcaaaatcttcaca

SEQ ID NO: 204343 - DNA, 15 bp, Homo sapiens
tttcaaaatcttcac

SEQ ID NO: 204344 - DNA, 15 bp, Homo sapiens
ttttcaaaatcttca

SEQ ID NO: 204345 - DNA, 15 bp, Homo sapiens
attttcaaaatcttc

SEQ ID NO: 204346 - DNA, 15 bp, Homo sapiens
gattttcaaaatctt

SEQ ID NO: 204347 - DNA, 15 bp, Homo sapiens
agattttcaaaatct

SEQ ID NO: 204348 - DNA, 15 bp, Homo sapiens
cagattttcaaaatc

SEQ ID NO: 204349 - DNA, 15 bp, Homo sapiens
ccagattttcaaaat

SEQ ID NO: 204350 - DNA, 15 bp, Homo sapiens
accagattttcaaaa

SEQ ID NO: 204351 - DNA, 15 bp, Homo sapiens
aaccagattttcaaa

SEQ ID NO: 204352 - DNA, 15 bp, Homo sapiens
caaccagattttcaa

SEQ ID NO: 204353 - DNA, 15 bp, Homo sapiens
tcaaccagattttca

SEQ ID NO: 204354 - DNA, 15 bp, Homo sapiens
atcaaccagattttc

SEQ ID NO: 204355 - DNA, 15 bp, Homo sapiens
gatcaaccagatttt

SEQ ID NO: 204356 - DNA, 15 bp, Homo sapiens
tgatcaaccagattt

SEQ ID NO: 204357 - DNA, 15 bp, Homo sapiens
gtgatcaaccagatt

SEQ ID NO: 204358 - DNA, 15 bp, Homo sapiens
agtgatcaaccagat

SEQ ID NO: 204359 - DNA, 15 bp, Homo sapiens
tagtgatcaaccaga

SEQ ID NO: 204360 - DNA, 15 bp, Homo sapiens
ctagtgatcaaccag

SEQ ID NO: 204361 - DNA, 15 bp, Homo sapiens
actagtgatcaacca

SEQ ID NO: 204362 - DNA, 15 bp, Homo sapiens
aactagtgatcaacc

SEQ ID NO: 204363 - DNA, 15 bp, Homo sapiens
taactagtgatcaac

SEQ ID NO: 204364 - DNA, 15 bp, Homo sapiens
ataactagtgatcaa

SEQ ID NO: 204365 - DNA, 15 bp, Homo sapiens
gataactagtgatca

SEQ ID NO: 204366 - DNA, 15 bp, Homo sapiens
tgataactagtgatc

SEQ ID NO: 204367 - DNA, 15 bp, Homo sapiens
ttgataactagtgat

SEQ ID NO: 204368 - DNA, 15 bp, Homo sapiens
attgataactagtga

SEQ ID NO: 204369 - DNA, 15 bp, Homo sapiens
tattgataactagtg

SEQ ID NO: 204370 - DNA, 15 bp, Homo sapiens
ctattgataactagt

SEQ ID NO: 204371 - DNA, 15 bp, Homo sapiens
actattgataactag

SEQ ID NO: 204372 - DNA, 15 bp, Homo sapiens
gactattgataacta

SEQ ID NO: 204373 - DNA, 15 bp, Homo sapiens
agactattgataact

SEQ ID NO: 204374 - DNA, 15 bp, Homo sapiens
aagactattgataac

SEQ ID NO: 204375 - DNA, 15 bp, Homo sapiens
taagactattgataa

SEQ ID NO: 204376 - DNA, 15 bp, Homo sapiens
ctaagactattgata

SEQ ID NO: 204377 - DNA, 15 bp, Homo sapiens
tctaagactattgat

SEQ ID NO: 204378 - DNA, 15 bp, Homo sapiens
ctctaagactattga

SEQ ID NO: 204379 - DNA, 15 bp, Homo sapiens
tctctaagactattg

SEQ ID NO: 204380 - DNA, 15 bp, Homo sapiens
ttctctaagactatt

SEQ ID NO: 204381 - DNA, 15 bp, Homo sapiens
tttctctaagactat

SEQ ID NO: 204382 - DNA, 15 bp, Homo sapiens
atttctctaagacta

SEQ ID NO: 204383 - DNA, 15 bp, Homo sapiens
aatttctctaagact

SEQ ID NO: 204384 - DNA, 15 bp, Homo sapiens
aaatttctctaagac

SEQ ID NO: 204385 - DNA, 15 bp, Homo sapiens
taaatttctctaaga

SEQ ID NO: 204386 - DNA, 15 bp, Homo sapiens
ttaaatttctctaag

SEQ ID NO: 204387 - DNA, 15 bp, Homo sapiens
cttaaatttctctaa

SEQ ID NO: 204388 - DNA, 15 bp, Homo sapiens
acttaaatttctcta

SEQ ID NO: 204389 - DNA, 15 bp, Homo sapiens
aacttaaatttctct

SEQ ID NO: 204390 - DNA, 15 bp, Homo sapiens
aaacttaaatttctc

SEQ ID NO: 204391 - DNA, 15 bp, Homo sapiens
aaaacttaaatttct

SEQ ID NO: 204392 - DNA, 15 bp, Homo sapiens
taaaacttaaatttc

SEQ ID NO: 204393 - DNA, 15 bp, Homo sapiens
ttaaaacttaaattt

SEQ ID NO: 204394 - DNA, 15 bp, Homo sapiens
tttaaaacttaaatt

SEQ ID NO: 204395 - DNA, 15 bp, Homo sapiens
ttttaaaacttaaat

SEQ ID NO: 204396 - DNA, 15 bp, Homo sapiens
attttaaaacttaaa

SEQ ID NO: 204397 - DNA, 15 bp, Homo sapiens
cattttaaaacttaa

SEQ ID NO: 204398 - DNA, 15 bp, Homo sapiens
gcattttaaaactta

SEQ ID NO: 204399 - DNA, 15 bp, Homo sapiens
agcattttaaaactt

SEQ ID NO: 204400 - DNA, 15 bp, Homo sapiens
aagcattttaaaact

SEQ ID NO: 204401 - DNA, 15 bp, Homo sapiens
taagcattttaaaac

SEQ ID NO: 204402 - DNA, 15 bp, Homo sapiens
ataagcattttaaaa

SEQ ID NO: 204403 - DNA, 15 bp, Homo sapiens
tataagcattttaaa

SEQ ID NO: 204404 - DNA, 15 bp, Homo sapiens
ctataagcattttaa

SEQ ID NO: 204405 - DNA, 15 bp, Homo sapiens
cctataagcatttta

SEQ ID NO: 204406 - DNA, 15 bp, Homo sapiens
tcctataagcatttt

SEQ ID NO: 204407 - DNA, 15 bp, Homo sapiens
atcctataagcattt

SEQ ID NO: 204408 - DNA, 15 bp, Homo sapiens
tatcctataagcatt

SEQ ID NO: 204409 - DNA, 15 bp, Homo sapiens
ttatcctataagcat

SEQ ID NO: 204410 - DNA, 15 bp, Homo sapiens
attatcctataagca

SEQ ID NO: 204411 - DNA, 15 bp, Homo sapiens
aattatcctataagc

SEQ ID NO: 204412 - DNA, 15 bp, Homo sapiens
caattatcctataag

SEQ ID NO: 204413 - DNA, 15 bp, Homo sapiens
tcaattatcctataa

SEQ ID NO: 204414 - DNA, 15 bp, Homo sapiens
ctcaattatcctata

SEQ ID NO: 204415 - DNA, 15 bp, Homo sapiens
tctcaattatcctat

SEQ ID NO: 204416 - DNA, 15 bp, Homo sapiens
ttctcaattatccta

SEQ ID NO: 204417 - DNA, 15 bp, Homo sapiens
tttctcaattatcct

SEQ ID NO: 204418 - DNA, 15 bp, Homo sapiens
ctttctcaattatcc

SEQ ID NO: 204419 - DNA, 15 bp, Homo sapiens
actttctcaattatc

SEQ ID NO: 204420 - DNA, 15 bp, Homo sapiens
tactttctcaattat

SEQ ID NO: 204421 - DNA, 15 bp, Homo sapiens
gtactttctcaatta

SEQ ID NO: 204422 - DNA, 15 bp, Homo sapiens
ggtactttctcaatt

SEQ ID NO: 204423 - DNA, 15 bp, Homo sapiens
tggtactttctcaat

SEQ ID NO: 204424 - DNA, 15 bp, Homo sapiens
gtggtactttctcaa

SEQ ID NO: 204425 - DNA, 15 bp, Homo sapiens
agtggtactttctca

SEQ ID NO: 204426 - DNA, 15 bp, Homo sapiens
tagtggtactttctc

SEQ ID NO: 204427 - DNA, 15 bp, Homo sapiens
ttagtggtactttct

SEQ ID NO: 204428 - DNA, 15 bp, Homo sapiens
cttagtggtactttc

SEQ ID NO: 204429 - DNA, 15 bp, Homo sapiens
gcttagtggtacttt

SEQ ID NO: 204430 - DNA, 15 bp, Homo sapiens
agcttagtggtactt

SEQ ID NO: 204431 - DNA, 15 bp, Homo sapiens
cagcttagtggtact

SEQ ID NO: 204432 - DNA, 15 bp, Homo sapiens
tcagcttagtggtac

SEQ ID NO: 204433 - DNA, 15 bp, Homo sapiens
ttcagcttagtggta

SEQ ID NO: 204434 - DNA, 15 bp, Homo sapiens
gttcagcttagtggt

SEQ ID NO: 204435 - DNA, 15 bp, Homo sapiens
cgttcagcttagtgg

SEQ ID NO: 204436 - DNA, 15 bp, Homo sapiens
gcgttcagcttagtg

SEQ ID NO: 204437 - DNA, 15 bp, Homo sapiens
tgcgttcagcttagt

SEQ ID NO: 204438 - DNA, 15 bp, Homo sapiens
ttgcgttcagcttag

SEQ ID NO: 204439 - DNA, 15 bp, Homo sapiens
tttgcgttcagctta

SEQ ID NO: 204440 - DNA, 15 bp, Homo sapiens
atttgcgttcagctt

SEQ ID NO: 204441 - DNA, 15 bp, Homo sapiens
aatttgcgttcagct

SEQ ID NO: 204442 - DNA, 15 bp, Homo sapiens
aaatttgcgttcagc

SEQ ID NO: 204443 - DNA, 15 bp, Homo sapiens
taaatttgcgttcag

SEQ ID NO: 204444 - DNA, 15 bp, Homo sapiens
ttaaatttgcgttca

SEQ ID NO: 204445 - DNA, 15 bp, Homo sapiens
tttaaatttgcgttc

SEQ ID NO: 204446 - DNA, 15 bp, Homo sapiens
ctttaaatttgcgtt

SEQ ID NO: 204447 - DNA, 15 bp, Homo sapiens
actttaaatttgcgt

SEQ ID NO: 204448 - DNA, 15 bp, Homo sapiens
aactttaaatttgcg

SEQ ID NO: 204449 - DNA, 15 bp, Homo sapiens
aaactttaaatttgc

SEQ ID NO: 204450 - DNA, 15 bp, Homo sapiens
gaaactttaaatttg

SEQ ID NO: 204451 - DNA, 15 bp, Homo sapiens
agaaactttaaattt

SEQ ID NO: 204452 - DNA, 15 bp, Homo sapiens
aagaaactttaaatt

SEQ ID NO: 204453 - DNA, 15 bp, Homo sapiens
gaagaaactttaaat

SEQ ID NO: 204454 - DNA, 15 bp, Homo sapiens
agaagaaactttaaa

SEQ ID NO: 204455 - DNA, 15 bp, Homo sapiens
aagaagaaactttaa

SEQ ID NO: 204456 - DNA, 15 bp, Homo sapiens
taagaagaaacttta

SEQ ID NO: 204457 - DNA, 15 bp, Homo sapiens
gtaagaagaaacttt

SEQ ID NO: 204458 - DNA, 15 bp, Homo sapiens
tgtaagaagaaactt

SEQ ID NO: 204459 - DNA, 15 bp, Homo sapiens
ttgtaagaagaaact

SEQ ID NO: 204460 - DNA, 15 bp, Homo sapiens
tttgtaagaagaaac

SEQ ID NO: 204461 - DNA, 15 bp, Homo sapiens
ctttgtaagaagaaa

SEQ ID NO: 204462 - DNA, 15 bp, Homo sapiens
gctttgtaagaagaa

SEQ ID NO: 204463 - DNA, 15 bp, Homo sapiens
tgctttgtaagaaga

SEQ ID NO: 204464 - DNA, 15 bp, Homo sapiens
atgctttgtaagaag

SEQ ID NO: 204465 - DNA, 15 bp, Homo sapiens
aatgctttgtaagaa

SEQ ID NO: 204466 - DNA, 15 bp, Homo sapiens
gaatgctttgtaaga

SEQ ID NO: 204467 - DNA, 15 bp, Homo sapiens
cgaatgctttgtaag

SEQ ID NO: 204468 - DNA, 15 bp, Homo sapiens
tcgaatgctttgtaa

SEQ ID NO: 204469 - DNA, 15 bp, Homo sapiens
gtcgaatgctttgta

SEQ ID NO: 204470 - DNA, 15 bp, Homo sapiens
ggtcgaatgctttgt

SEQ ID NO: 204471 - DNA, 15 bp, Homo sapiens
aggtcgaatgctttg

SEQ ID NO: 204472 - DNA, 15 bp, Homo sapiens
caggtcgaatgcttt

SEQ ID NO: 204473 - DNA, 15 bp, Homo sapiens
acaggtcgaatgctt

SEQ ID NO: 204474 - DNA, 15 bp, Homo sapiens
aacaggtcgaatgct

SEQ ID NO: 204475 - DNA, 15 bp, Homo sapiens
caacaggtcgaatgc

SEQ ID NO: 204476 - DNA, 15 bp, Homo sapiens
gcaacaggtcgaatg

SEQ ID NO: 204477 - DNA, 15 bp, Homo sapiens
ggcaacaggtcgaat

SEQ ID NO: 204478 - DNA, 15 bp, Homo sapiens
gggcaacaggtcgaa

SEQ ID NO: 204479 - DNA, 15 bp, Homo sapiens
tgggcaacaggtcga

SEQ ID NO: 204480 - DNA, 15 bp, Homo sapiens
ttgggcaacaggtcg

SEQ ID NO: 204481 - DNA, 15 bp, Homo sapiens
cttgggcaacaggtc

SEQ ID NO: 204482 - DNA, 15 bp, Homo sapiens
tcttgggcaacaggt

SEQ ID NO: 204483 - DNA, 15 bp, Homo sapiens
ttcttgggcaacagg

SEQ ID NO: 204484 - DNA, 15 bp, Homo sapiens
tttcttgggcaacag

SEQ ID NO: 204485 - DNA, 15 bp, Homo sapiens
ttttcttgggcaaca

SEQ ID NO: 204486 - DNA, 15 bp, Homo sapiens
cttttcttgggcaac

SEQ ID NO: 204487 - DNA, 15 bp, Homo sapiens
ccttttcttgggcaa

SEQ ID NO: 204488 - DNA, 15 bp, Homo sapiens
gccttttcttgggca

SEQ ID NO: 204489 - DNA, 15 bp, Homo sapiens
agccttttcttgggc

SEQ ID NO: 204490 - DNA, 15 bp, Homo sapiens
aagccttttcttggg

SEQ ID NO: 204491 - DNA, 15 bp, Homo sapiens
aaagccttttcttgg

SEQ ID NO: 204492 - DNA, 15 bp, Homo sapiens
gaaagccttttcttg

SEQ ID NO: 204493 - DNA, 15 bp, Homo sapiens
tgaaagccttttctt

SEQ ID NO: 204494 - DNA, 15 bp, Homo sapiens
atgaaagccttttct

SEQ ID NO: 204495 - DNA, 15 bp, Homo sapiens
gatgaaagccttttc

SEQ ID NO: 204496 - DNA, 15 bp, Homo sapiens
agatgaaagcctttt

SEQ ID NO: 204497 - DNA, 15 bp, Homo sapiens
aagatgaaagccttt

SEQ ID NO: 204498 - DNA, 15 bp, Homo sapiens
aaagatgaaagcctt

SEQ ID NO: 204499 - DNA, 15 bp, Homo sapiens
gaaagatgaaagcct

SEQ ID NO: 204500 - DNA, 15 bp, Homo sapiens
tgaaagatgaaagcc

SEQ ID NO: 204501 - DNA, 15 bp, Homo sapiens
ttgaaagatgaaagc

SEQ ID NO: 204502 - DNA, 15 bp, Homo sapiens
cttgaaagatgaaag

SEQ ID NO: 204503 - DNA, 15 bp, Homo sapiens
tcttgaaagatgaaa

SEQ ID NO: 204504 - DNA, 15 bp, Homo sapiens
atcttgaaagatgaa

SEQ ID NO: 204505 - DNA, 15 bp, Homo sapiens
catcttgaaagatga

SEQ ID NO: 204506 - DNA, 15 bp, Homo sapiens
tcatcttgaaagatg

SEQ ID NO: 204507 - DNA, 15 bp, Homo sapiens
ttcatcttgaaagat

SEQ ID NO: 204508 - DNA, 15 bp, Homo sapiens
tttcatcttgaaaga

SEQ ID NO: 204509 - DNA, 15 bp, Homo sapiens
ctttcatcttgaaag

SEQ ID NO: 204510 - DNA, 15 bp, Homo sapiens
tctttcatcttgaaa

SEQ ID NO: 204511 - DNA, 15 bp, Homo sapiens
ttctttcatcttgaa

SEQ ID NO: 204512 - DNA, 15 bp, Homo sapiens
attctttcatcttga

SEQ ID NO: 204513 - DNA, 15 bp, Homo sapiens
aattctttcatcttg

SEQ ID NO: 204514 - DNA, 15 bp, Homo sapiens
taattctttcatctt

SEQ ID NO: 204515 - DNA, 15 bp, Homo sapiens
ttaattctttcatct

SEQ ID NO: 204516 - DNA, 15 bp, Homo sapiens
tttaattctttcatc

SEQ ID NO: 204517 - DNA, 15 bp, Homo sapiens
ttttaattctttcat

SEQ ID NO: 204518 - DNA, 15 bp, Homo sapiens
attttaattctttca

SEQ ID NO: 204519 - DNA, 15 bp, Homo sapiens
cattttaattctttc

SEQ ID NO: 204520 - DNA, 15 bp, Homo sapiens
tcattttaattcttt

SEQ ID NO: 204521 - DNA, 15 bp, Homo sapiens
ttcattttaattctt

SEQ ID NO: 204522 - DNA, 15 bp, Homo sapiens
tttcattttaattct

SEQ ID NO: 204523 - DNA, 15 bp, Homo sapiens
gtttcattttaattc

SEQ ID NO: 204524 - DNA, 15 bp, Homo sapiens
agtttcattttaatt

SEQ ID NO: 204525 - DNA, 15 bp, Homo sapiens
tagtttcattttaat

SEQ ID NO: 204526 - DNA, 15 bp, Homo sapiens
ctagtttcattttaa

SEQ ID NO: 204527 - DNA, 15 bp, Homo sapiens
tctagtttcatttta

SEQ ID NO: 204528 - DNA, 15 bp, Homo sapiens
ttctagtttcatttt

SEQ ID NO: 204529 - DNA, 15 bp, Homo sapiens
gttctagtttcattt

SEQ ID NO: 204530 - DNA, 15 bp, Homo sapiens
tgttctagtttcatt

SEQ ID NO: 204531 - DNA, 15 bp, Homo sapiens
gtgttctagtttcat

SEQ ID NO: 204532 - DNA, 15 bp, Homo sapiens
agtgttctagtttca

SEQ ID NO: 204533 - DNA, 15 bp, Homo sapiens
cagtgttctagtttc

SEQ ID NO: 204534 - DNA, 15 bp, Homo sapiens
tcagtgttctagttt

SEQ ID NO: 204535 - DNA, 15 bp, Homo sapiens
ttcagtgttctagtt

SEQ ID NO: 204536 - DNA, 15 bp, Homo sapiens
cttcagtgttctagt

SEQ ID NO: 204537 - DNA, 15 bp, Homo sapiens
ccttcagtgttctag

SEQ ID NO: 204538 - DNA, 15 bp, Homo sapiens
gccttcagtgttcta

SEQ ID NO: 204539 - DNA, 15 bp, Homo sapiens
agccttcagtgttct

SEQ ID NO: 204540 - DNA, 15 bp, Homo sapiens
cagccttcagtgttc

SEQ ID NO: 204541 - DNA, 15 bp, Homo sapiens
gcagccttcagtgtt

SEQ ID NO: 204542 - DNA, 15 bp, Homo sapiens
agcagccttcagtgt

SEQ ID NO: 204543 - DNA, 15 bp, Homo sapiens
tagcagccttcagtg

SEQ ID NO: 204544 - DNA, 15 bp, Homo sapiens
gtagcagccttcagt

SEQ ID NO: 204545 - DNA, 15 bp, Homo sapiens
tgtagcagccttcag

SEQ ID NO: 204546 - DNA, 15 bp, Homo sapiens
ctgtagcagccttca

SEQ ID NO: 204547 - DNA, 15 bp, Homo sapiens
tctgtagcagccttc

SEQ ID NO: 204548 - DNA, 15 bp, Homo sapiens
ttctgtagcagcctt

SEQ ID NO: 204549 - DNA, 15 bp, Homo sapiens
cttctgtagcagcct

SEQ ID NO: 204550 - DNA, 15 bp, Homo sapiens
gcttctgtagcagcc

SEQ ID NO: 204551 - DNA, 15 bp, Homo sapiens
tgcttctgtagcagc

SEQ ID NO: 204552 - DNA, 15 bp, Homo sapiens
atgcttctgtagcag

SEQ ID NO: 204553 - DNA, 15 bp, Homo sapiens
catgcttctgtagca

SEQ ID NO: 204554 - DNA, 15 bp, Homo sapiens
gcatgcttctgtagc

SEQ ID NO: 204555 - DNA, 15 bp, Homo sapiens
tgcatgcttctgtag

SEQ ID NO: 204556 - DNA, 15 bp, Homo sapiens
atgcatgcttctgta

SEQ ID NO: 204557 - DNA, 15 bp, Homo sapiens
aatgcatgcttctgt

SEQ ID NO: 204558 - DNA, 15 bp, Homo sapiens
aaatgcatgcttctg

SEQ ID NO: 204559 - DNA, 15 bp, Homo sapiens
taaatgcatgcttct

SEQ ID NO: 204560 - DNA, 15 bp, Homo sapiens
ataaatgcatgcttc

SEQ ID NO: 204561 - DNA, 15 bp, Homo sapiens
aataaatgcatgctt

SEQ ID NO: 204562 - DNA, 15 bp, Homo sapiens
aaataaatgcatgct

SEQ ID NO: 204563 - DNA, 15 bp, Homo sapiens
caaataaatgcatgc

SEQ ID NO: 204564 - DNA, 15 bp, Homo sapiens
tcaaataaatgcatg

SEQ ID NO: 204565 - DNA, 15 bp, Homo sapiens
ctcaaataaatgcat

SEQ ID NO: 204566 - DNA, 15 bp, Homo sapiens
gctcaaataaatgca

SEQ ID NO: 204567 - DNA, 15 bp, Homo sapiens
tgctcaaataaatgc

SEQ ID NO: 204568 - DNA, 15 bp, Homo sapiens
atgctcaaataaatg

SEQ ID NO: 204569 - DNA, 15 bp, Homo sapiens
tatgctcaaataaat

SEQ ID NO: 204570 - DNA, 15 bp, Homo sapiens
atatgctcaaataaa

SEQ ID NO: 204571 - DNA, 15 bp, Homo sapiens
catatgctcaaataa

SEQ ID NO: 204572 - DNA, 15 bp, Homo sapiens
ccatatgctcaaata

SEQ ID NO: 204573 - DNA, 15 bp, Homo sapiens
accatatgctcaaat

SEQ ID NO: 204574 - DNA, 15 bp, Homo sapiens
taccatatgctcaaa

SEQ ID NO: 204575 - DNA, 15 bp, Homo sapiens
ctaccatatgctcaa

SEQ ID NO: 204576 - DNA, 15 bp, Homo sapiens
actaccatatgctca

SEQ ID NO: 204577 - DNA, 15 bp, Homo sapiens
tactaccatatgctc

SEQ ID NO: 204578 - DNA, 15 bp, Homo sapiens
ttactaccatatgct

SEQ ID NO: 204579 - DNA, 15 bp, Homo sapiens
attactaccatatgc

SEQ ID NO: 204580 - DNA, 15 bp, Homo sapiens
gattactaccatatg

SEQ ID NO: 204581 - DNA, 15 bp, Homo sapiens
ggattactaccatat

SEQ ID NO: 204582 - DNA, 15 bp, Homo sapiens
tggattactaccata

SEQ ID NO: 204583 - DNA, 15 bp, Homo sapiens
gtggattactaccat

SEQ ID NO: 204584 - DNA, 15 bp, Homo sapiens
agtggattactacca

SEQ ID NO: 204585 - DNA, 15 bp, Homo sapiens
tagtggattactacc

SEQ ID NO: 204586 - DNA, 15 bp, Homo sapiens
ttagtggattactac

SEQ ID NO: 204587 - DNA, 15 bp, Homo sapiens
tttagtggattacta

SEQ ID NO: 204588 - DNA, 15 bp, Homo sapiens
gtttagtggattact

SEQ ID NO: 204589 - DNA, 15 bp, Homo sapiens
tgtttagtggattac

SEQ ID NO: 204590 - DNA, 15 bp, Homo sapiens
gtgtttagtggatta

SEQ ID NO: 204591 - DNA, 15 bp, Homo sapiens
tgtgtttagtggatt

SEQ ID NO: 204592 - DNA, 15 bp, Homo sapiens
atgtgtttagtggat

SEQ ID NO: 204593 - DNA, 15 bp, Homo sapiens
tatgtgtttagtgga

SEQ ID NO: 204594 - DNA, 15 bp, Homo sapiens
ctatgtgtttagtgg

SEQ ID NO: 204595 - DNA, 15 bp, Homo sapiens
actatgtgtttagtg

SEQ ID NO: 204596 - DNA, 15 bp, Homo sapiens
aactatgtgtttagt

SEQ ID NO: 204597 - DNA, 15 bp, Homo sapiens
taactatgtgtttag

SEQ ID NO: 204598 - DNA, 15 bp, Homo sapiens
ataactatgtgttta

SEQ ID NO: 204599 - DNA, 15 bp, Homo sapiens
tataactatgtgttt

SEQ ID NO: 204600 - DNA, 15 bp, Homo sapiens
ttataactatgtgtt

SEQ ID NO: 204601 - DNA, 15 bp, Homo sapiens
attataactatgtgt

SEQ ID NO: 204602 - DNA, 15 bp, Homo sapiens
gattataactatgtg

SEQ ID NO: 204603 - DNA, 15 bp, Homo sapiens
agattataactatgt

SEQ ID NO: 204604 - DNA, 15 bp, Homo sapiens
tagattataactatg

SEQ ID NO: 204605 - DNA, 15 bp, Homo sapiens
atagattataactat

SEQ ID NO: 204606 - DNA, 15 bp, Homo sapiens
aatagattataacta

SEQ ID NO: 204607 - DNA, 15 bp, Homo sapiens
aaatagattataact

SEQ ID NO: 204608 - DNA, 15 bp, Homo sapiens
caaatagattataac

SEQ ID NO: 204609 - DNA, 15 bp, Homo sapiens
tcaaatagattataa

SEQ ID NO: 204610 - DNA, 15 bp, Homo sapiens
ctcaaatagattata

SEQ ID NO: 204611 - DNA, 15 bp, Homo sapiens
tctcaaatagattat

SEQ ID NO: 204612 - DNA, 15 bp, Homo sapiens
ttctcaaatagatta

SEQ ID NO: 204613 - DNA, 15 bp, Homo sapiens
attctcaaatagatt

SEQ ID NO: 204614 - DNA, 15 bp, Homo sapiens
tattctcaaatagat

SEQ ID NO: 204615 - DNA, 15 bp, Homo sapiens
ttattctcaaataga

SEQ ID NO: 204616 - DNA, 15 bp, Homo sapiens
gttattctcaaatag

SEQ ID NO: 204617 - DNA, 15 bp, Homo sapiens
ggttattctcaaata

SEQ ID NO: 204618 - DNA, 15 bp, Homo sapiens
tggttattctcaaat

SEQ ID NO: 204619 - DNA, 15 bp, Homo sapiens
ctggttattctcaaa

SEQ ID NO: 204620 - DNA, 15 bp, Homo sapiens
tctggttattctcaa

SEQ ID NO: 204621 - DNA, 15 bp, Homo sapiens
ttctggttattctca

SEQ ID NO: 204622 - DNA, 15 bp, Homo sapiens
gttctggttattctc

SEQ ID NO: 204623 - DNA, 15 bp, Homo sapiens
tgttctggttattct

SEQ ID NO: 204624 - DNA, 15 bp, Homo sapiens
ctgttctggttattc

SEQ ID NO: 204625 - DNA, 15 bp, Homo sapiens
tctgttctggttatt

SEQ ID NO: 204626 - DNA, 15 bp, Homo sapiens
atctgttctggttat

SEQ ID NO: 204627 - DNA, 15 bp, Homo sapiens
aatctgttctggtta

SEQ ID NO: 204628 - DNA, 15 bp, Homo sapiens
aaatctgttctggtt

SEQ ID NO: 204629 - DNA, 15 bp, Homo sapiens
caaatctgttctggt

SEQ ID NO: 204630 - DNA, 15 bp, Homo sapiens
gcaaatctgttctgg

SEQ ID NO: 204631 - DNA, 15 bp, Homo sapiens
ggcaaatctgttctg

SEQ ID NO: 204632 - DNA, 15 bp, Homo sapiens
tggcaaatctgttct

SEQ ID NO: 204633 - DNA, 15 bp, Homo sapiens
ctggcaaatctgttc

SEQ ID NO: 204634 - DNA, 15 bp, Homo sapiens
tctggcaaatctgtt

SEQ ID NO: 204635 - DNA, 15 bp, Homo sapiens
gtctggcaaatctgt

SEQ ID NO: 204636 - DNA, 15 bp, Homo sapiens
tgtctggcaaatctg

SEQ ID NO: 204637 - DNA, 15 bp, Homo sapiens
ttgtctggcaaatct

SEQ ID NO: 204638 - DNA, 15 bp, Homo sapiens
tttgtctggcaaatc

SEQ ID NO: 204639 - DNA, 15 bp, Homo sapiens
ctttgtctggcaaat

SEQ ID NO: 204640 - DNA, 15 bp, Homo sapiens
tctttgtctggcaaa

SEQ ID NO: 204641 - DNA, 15 bp, Homo sapiens
atctttgtctggcaa

SEQ ID NO: 204642 - DNA, 15 bp, Homo sapiens
aatctttgtctggca

SEQ ID NO: 204643 - DNA, 15 bp, Homo sapiens
gaatctttgtctggc

SEQ ID NO: 204644 - DNA, 15 bp, Homo sapiens
agaatctttgtctgg

SEQ ID NO: 204645 - DNA, 15 bp, Homo sapiens
cagaatctttgtctg

SEQ ID NO: 204646 - DNA, 15 bp, Homo sapiens
ccagaatctttgtct

SEQ ID NO: 204647 - DNA, 15 bp, Homo sapiens
gccagaatctttgtc

SEQ ID NO: 204648 - DNA, 15 bp, Homo sapiens
tgccagaatctttgt

SEQ ID NO: 204649 - DNA, 15 bp, Homo sapiens
ctgccagaatctttg

SEQ ID NO: 204650 - DNA, 15 bp, Homo sapiens
tctgccagaatcttt

SEQ ID NO: 204651 - DNA, 15 bp, Homo sapiens
atctgccagaatctt

SEQ ID NO: 204652 - DNA, 15 bp, Homo sapiens
gatctgccagaatct

SEQ ID NO: 204653 - DNA, 15 bp, Homo sapiens
tgatctgccagaatc

SEQ ID NO: 204654 - DNA, 15 bp, Homo sapiens
ttgatctgccagaat

SEQ ID NO: 204655 - DNA, 15 bp, Homo sapiens
gttgatctgccagaa

SEQ ID NO: 204656 - DNA, 15 bp, Homo sapiens
agttgatctgccaga

SEQ ID NO: 204657 - DNA, 15 bp, Homo sapiens
aagttgatctgccag

SEQ ID NO: 204658 - DNA, 15 bp, Homo sapiens
caagttgatctgcca

SEQ ID NO: 204659 - DNA, 15 bp, Homo sapiens
gcaagttgatctgcc

SEQ ID NO: 204660 - DNA, 15 bp, Homo sapiens
agcaagttgatctgc

SEQ ID NO: 204661 - DNA, 15 bp, Homo sapiens
aagcaagttgatctg

SEQ ID NO: 204662 - DNA, 15 bp, Homo sapiens
aaagcaagttgatct

SEQ ID NO: 204663 - DNA, 15 bp, Homo sapiens
aaaagcaagttgatc

SEQ ID NO: 204664 - DNA, 15 bp, Homo sapiens
aaaaagcaagttgat

SEQ ID NO: 204665 - DNA, 15 bp, Homo sapiens
taaaaagcaagttga

SEQ ID NO: 204666 - DNA, 15 bp, Homo sapiens
gtaaaaagcaagttg

SEQ ID NO: 204667 - DNA, 15 bp, Homo sapiens
agtaaaaagcaagtt

SEQ ID NO: 204668 - DNA, 15 bp, Homo sapiens
tagtaaaaagcaagt

SEQ ID NO: 204669 - DNA, 15 bp, Homo sapiens
atagtaaaaagcaag

SEQ ID NO: 204670 - DNA, 15 bp, Homo sapiens
catagtaaaaagcaa

SEQ ID NO: 204671 - DNA, 15 bp, Homo sapiens
tcatagtaaaaagca

SEQ ID NO: 204672 - DNA, 15 bp, Homo sapiens
ttcatagtaaaaagc

SEQ ID NO: 204673 - DNA, 15 bp, Homo sapiens
tttcatagtaaaaag

SEQ ID NO: 204674 - DNA, 15 bp, Homo sapiens
ttttcatagtaaaaa

SEQ ID NO: 204675 - DNA, 15 bp, Homo sapiens
tttttcatagtaaaa

SEQ ID NO: 204676 - DNA, 15 bp, Homo sapiens
atttttcatagtaaa

SEQ ID NO: 204677 - DNA, 15 bp, Homo sapiens
gatttttcatagtaa

SEQ ID NO: 204678 - DNA, 15 bp, Homo sapiens
tgatttttcatagta

SEQ ID NO: 204679 - DNA, 15 bp, Homo sapiens
ttgatttttcatagt

SEQ ID NO: 204680 - DNA, 15 bp, Homo sapiens
tttgatttttcatag

SEQ ID NO: 204681 - DNA, 15 bp, Homo sapiens
ctttgatttttcata

SEQ ID NO: 204682 - DNA, 15 bp, Homo sapiens
tctttgatttttcat

SEQ ID NO: 204683 - DNA, 15 bp, Homo sapiens
atctttgatttttca

SEQ ID NO: 204684 - DNA, 15 bp, Homo sapiens
catctttgatttttc

SEQ ID NO: 204685 - DNA, 15 bp, Homo sapiens
gcatctttgattttt

SEQ ID NO: 204686 - DNA, 15 bp, Homo sapiens
tgcatctttgatttt

SEQ ID NO: 204687 - DNA, 15 bp, Homo sapiens
ctgcatctttgattt

SEQ ID NO: 204688 - DNA, 15 bp, Homo sapiens
tctgcatctttgatt

SEQ ID NO: 204689 - DNA, 15 bp, Homo sapiens
ctctgcatctttgat

SEQ ID NO: 204690 - DNA, 15 bp, Homo sapiens
tctctgcatctttga

SEQ ID NO: 204691 - DNA, 15 bp, Homo sapiens
ttctctgcatctttg

SEQ ID NO: 204692 - DNA, 15 bp, Homo sapiens
cttctctgcatcttt

SEQ ID NO: 204693 - DNA, 15 bp, Homo sapiens
gcttctctgcatctt

SEQ ID NO: 204694 - DNA, 15 bp, Homo sapiens
tgcttctctgcatct

SEQ ID NO: 204695 - DNA, 15 bp, Homo sapiens
gtgcttctctgcatc

SEQ ID NO: 204696 - DNA, 15 bp, Homo sapiens
tgtgcttctctgcat

SEQ ID NO: 204697 - DNA, 15 bp, Homo sapiens
gtgtgcttctctgca

SEQ ID NO: 204698 - DNA, 15 bp, Homo sapiens
tgtgtgcttctctgc

SEQ ID NO: 204699 - DNA, 15 bp, Homo sapiens
atgtgtgcttctctg

SEQ ID NO: 204700 - DNA, 15 bp, Homo sapiens
tatgtgtgcttctct

SEQ ID NO: 204701 - DNA, 15 bp, Homo sapiens
atatgtgtgcttctc

SEQ ID NO: 204702 - DNA, 15 bp, Homo sapiens
tatatgtgtgcttct

SEQ ID NO: 204703 - DNA, 15 bp, Homo sapiens
gtatatgtgtgcttc

SEQ ID NO: 204704 - DNA, 15 bp, Homo sapiens
ggtatatgtgtgctt

SEQ ID NO: 204705 - DNA, 15 bp, Homo sapiens
tggtatatgtgtgct

SEQ ID NO: 204706 - DNA, 15 bp, Homo sapiens
ttggtatatgtgtgc

SEQ ID NO: 204707 - DNA, 15 bp, Homo sapiens
attggtatatgtgtg

SEQ ID NO: 204708 - DNA, 15 bp, Homo sapiens
cattggtatatgtgt

SEQ ID NO: 204709 - DNA, 15 bp, Homo sapiens
acattggtatatgtg

SEQ ID NO: 204710 - DNA, 15 bp, Homo sapiens
aacattggtatatgt

SEQ ID NO: 204711 - DNA, 15 bp, Homo sapiens
aaacattggtatatg

SEQ ID NO: 204712 - DNA, 15 bp, Homo sapiens
aaaacattggtatat

SEQ ID NO: 204713 - DNA, 15 bp, Homo sapiens
gaaaacattggtata

SEQ ID NO: 204714 - DNA, 15 bp, Homo sapiens
agaaaacattggtat

SEQ ID NO: 204715 - DNA, 15 bp, Homo sapiens
aagaaaacattggta

SEQ ID NO: 204716 - DNA, 15 bp, Homo sapiens
aaagaaaacattggt

SEQ ID NO: 204717 - DNA, 15 bp, Homo sapiens
aaaagaaaacattgg

SEQ ID NO: 204718 - DNA, 15 bp, Homo sapiens
aaaaagaaaacattg

SEQ ID NO: 204719 - DNA, 15 bp, Homo sapiens
caaaaagaaaacatt

SEQ ID NO: 204720 - DNA, 15 bp, Homo sapiens
tcaaaaagaaaacat

SEQ ID NO: 204721 - DNA, 15 bp, Homo sapiens
atcaaaaagaaaaca

SEQ ID NO: 204722 - DNA, 15 bp, Homo sapiens
aatcaaaaagaaaac

SEQ ID NO: 204723 - DNA, 15 bp, Homo sapiens
aaatcaaaaagaaaa

SEQ ID NO: 204724 - DNA, 15 bp, Homo sapiens
gaaatcaaaaagaaa

SEQ ID NO: 204725 - DNA, 15 bp, Homo sapiens
tgaaatcaaaaagaa

SEQ ID NO: 204726 - DNA, 15 bp, Homo sapiens
ttgaaatcaaaaaga

SEQ ID NO: 204727 - DNA, 15 bp, Homo sapiens
tttgaaatcaaaaag

SEQ ID NO: 204728 - DNA, 15 bp, Homo sapiens
ctttgaaatcaaaaa

SEQ ID NO: 204729 - DNA, 15 bp, Homo sapiens
gctttgaaatcaaaa

SEQ ID NO: 204730 - DNA, 15 bp, Homo sapiens
ggctttgaaatcaaa

SEQ ID NO: 204731 - DNA, 15 bp, Homo sapiens
tggctttgaaatcaa

SEQ ID NO: 204732 - DNA, 15 bp, Homo sapiens
gtggctttgaaatca

SEQ ID NO: 204733 - DNA, 15 bp, Homo sapiens
agtggctttgaaatc

SEQ ID NO: 204734 - DNA, 15 bp, Homo sapiens
aagtggctttgaaat

SEQ ID NO: 204735 - DNA, 15 bp, Homo sapiens
gaagtggctttgaaa

SEQ ID NO: 204736 - DNA, 15 bp, Homo sapiens
tgaagtggctttgaa

SEQ ID NO: 204737 - DNA, 15 bp, Homo sapiens
ctgaagtggctttga

SEQ ID NO: 204738 - DNA, 15 bp, Homo sapiens
gctgaagtggctttg

SEQ ID NO: 204739 - DNA, 15 bp, Homo sapiens
tgctgaagtggcttt

SEQ ID NO: 204740 - DNA, 15 bp, Homo sapiens
atgctgaagtggctt

SEQ ID NO: 204741 - DNA, 15 bp, Homo sapiens
aatgctgaagtggct

SEQ ID NO: 204742 - DNA, 15 bp, Homo sapiens
aaatgctgaagtggc

SEQ ID NO: 204743 - DNA, 15 bp, Homo sapiens
gaaatgctgaagtgg

SEQ ID NO: 204744 - DNA, 15 bp, Homo sapiens
agaaatgctgaagtg

SEQ ID NO: 204745 - DNA, 15 bp, Homo sapiens
aagaaatgctgaagt

SEQ ID NO: 204746 - DNA, 15 bp, Homo sapiens
aaagaaatgctgaag

SEQ ID NO: 204747 - DNA, 15 bp, Homo sapiens
aaaagaaatgctgaa

SEQ ID NO: 204748 - DNA, 15 bp, Homo sapiens
taaaagaaatgctga

SEQ ID NO: 204749 - DNA, 15 bp, Homo sapiens
ttaaaagaaatgctg

SEQ ID NO: 204750 - DNA, 15 bp, Homo sapiens
tttaaaagaaatgct

SEQ ID NO: 204751 - DNA, 15 bp, Homo sapiens
ttttaaaagaaatgc

SEQ ID NO: 204752 - DNA, 15 bp, Homo sapiens
tttttaaaagaaatg

SEQ ID NO: 204753 - DNA, 15 bp, Homo sapiens
ctttttaaaagaaat

SEQ ID NO: 204754 - DNA, 15 bp, Homo sapiens
actttttaaaagaaa

SEQ ID NO: 204755 - DNA, 15 bp, Homo sapiens
tactttttaaaagaa

SEQ ID NO: 204756 - DNA, 15 bp, Homo sapiens
atactttttaaaaga

SEQ ID NO: 204757 - DNA, 15 bp, Homo sapiens
aatactttttaaaag

SEQ ID NO: 204758 - DNA, 15 bp, Homo sapiens
caatactttttaaaa

SEQ ID NO: 204759 - DNA, 15 bp, Homo sapiens
acaatactttttaaa

SEQ ID NO: 204760 - DNA, 15 bp, Homo sapiens
gacaatactttttaa

SEQ ID NO: 204761 - DNA, 15 bp, Homo sapiens
agacaatacttttta

SEQ ID NO: 204762 - DNA, 15 bp, Homo sapiens
aagacaatacttttt

SEQ ID NO: 204763 - DNA, 15 bp, Homo sapiens
gaagacaatactttt

SEQ ID NO: 204764 - DNA, 15 bp, Homo sapiens
tgaagacaatacttt

SEQ ID NO: 204765 - DNA, 15 bp, Homo sapiens
atgaagacaatactt

SEQ ID NO: 204766 - DNA, 15 bp, Homo sapiens
gatgaagacaatact

SEQ ID NO: 204767 - DNA, 15 bp, Homo sapiens
ggatgaagacaatac

SEQ ID NO: 204768 - DNA, 15 bp, Homo sapiens
aggatgaagacaata

SEQ ID NO: 204769 - DNA, 15 bp, Homo sapiens
gaggatgaagacaat

SEQ ID NO: 204770 - DNA, 15 bp, Homo sapiens
tgaggatgaagacaa

SEQ ID NO: 204771 - DNA, 15 bp, Homo sapiens
atgaggatgaagaca

SEQ ID NO: 204772 - DNA, 15 bp, Homo sapiens
tatgaggatgaagac

SEQ ID NO: 204773 - DNA, 15 bp, Homo sapiens
ttatgaggatgaaga

SEQ ID NO: 204774 - DNA, 15 bp, Homo sapiens
attatgaggatgaag

SEQ ID NO: 204775 - DNA, 15 bp, Homo sapiens
aattatgaggatgaa

SEQ ID NO: 204776 - DNA, 15 bp, Homo sapiens
taattatgaggatga

SEQ ID NO: 204777 - DNA, 15 bp, Homo sapiens
ttaattatgaggatg

SEQ ID NO: 204778 - DNA, 15 bp, Homo sapiens
attaattatgaggat

SEQ ID NO: 204779 - DNA, 15 bp, Homo sapiens
tattaattatgagga

SEQ ID NO: 204780 - DNA, 15 bp, Homo sapiens
ctattaattatgagg

SEQ ID NO: 204781 - DNA, 15 bp, Homo sapiens
tctattaattatgag

SEQ ID NO: 204782 - DNA, 15 bp, Homo sapiens
atctattaattatga

SEQ ID NO: 204783 - DNA, 15 bp, Homo sapiens
tatctattaattatg

SEQ ID NO: 204784 - DNA, 15 bp, Homo sapiens
ctatctattaattat

SEQ ID NO: 204785 - DNA, 15 bp, Homo sapiens
actatctattaatta

SEQ ID NO: 204786 - DNA, 15 bp, Homo sapiens
aactatctattaatt

SEQ ID NO: 204787 - DNA, 15 bp, Homo sapiens
aaactatctattaat

SEQ ID NO: 204788 - DNA, 15 bp, Homo sapiens
aaaactatctattaa

SEQ ID NO: 204789 - DNA, 15 bp, Homo sapiens
aaaaactatctatta

SEQ ID NO: 204790 - DNA, 15 bp, Homo sapiens
gaaaaactatctatt

SEQ ID NO: 204791 - DNA, 15 bp, Homo sapiens
tgaaaaactatctat

SEQ ID NO: 204792 - DNA, 15 bp, Homo sapiens
ctgaaaaactatcta

SEQ ID NO: 204793 - DNA, 15 bp, Homo sapiens
tctgaaaaactatct

SEQ ID NO: 204794 - DNA, 15 bp, Homo sapiens
atctgaaaaactatc

SEQ ID NO: 204795 - DNA, 15 bp, Homo sapiens
aatctgaaaaactat

SEQ ID NO: 204796 - DNA, 15 bp, Homo sapiens
gaatctgaaaaacta

SEQ ID NO: 204797 - DNA, 15 bp, Homo sapiens
agaatctgaaaaact

SEQ ID NO: 204798 - DNA, 15 bp, Homo sapiens
tagaatctgaaaaac

SEQ ID NO: 204799 - DNA, 15 bp, Homo sapiens
ttagaatctgaaaaa

SEQ ID NO: 204800 - DNA, 15 bp, Homo sapiens
tttagaatctgaaaa

SEQ ID NO: 204801 - DNA, 15 bp, Homo sapiens
atttagaatctgaaa

SEQ ID NO: 204802 - DNA, 15 bp, Homo sapiens
tatttagaatctgaa

SEQ ID NO: 204803 - DNA, 15 bp, Homo sapiens
gtatttagaatctga

SEQ ID NO: 204804 - DNA, 15 bp, Homo sapiens
agtatttagaatctg

SEQ ID NO: 204805 - DNA, 15 bp, Homo sapiens
cagtatttagaatct

SEQ ID NO: 204806 - DNA, 15 bp, Homo sapiens
acagtatttagaatc

SEQ ID NO: 204807 - DNA, 15 bp, Homo sapiens
tacagtatttagaat

SEQ ID NO: 204808 - DNA, 15 bp, Homo sapiens
ttacagtatttagaa

SEQ ID NO: 204809 - DNA, 15 bp, Homo sapiens
cttacagtatttaga

SEQ ID NO: 204810 - DNA, 15 bp, Homo sapiens
acttacagtatttag

SEQ ID NO: 204811 - DNA, 15 bp, Homo sapiens
aacttacagtattta

SEQ ID NO: 204812 - DNA, 15 bp, Homo sapiens
aaacttacagtattt

SEQ ID NO: 204813 - DNA, 15 bp, Homo sapiens
gaaacttacagtatt

SEQ ID NO: 204814 - DNA, 15 bp, Homo sapiens
tgaaacttacagtat

SEQ ID NO: 204815 - DNA, 15 bp, Homo sapiens
ctgaaacttacagta

SEQ ID NO: 204816 - DNA, 15 bp, Homo sapiens
actgaaacttacagt

SEQ ID NO: 204817 - DNA, 15 bp, Homo sapiens
tactgaaacttacag

SEQ ID NO: 204818 - DNA, 15 bp, Homo sapiens
ttactgaaacttaca

SEQ ID NO: 204819 - DNA, 15 bp, Homo sapiens
attactgaaacttac

SEQ ID NO: 204820 - DNA, 15 bp, Homo sapiens
gattactgaaactta

SEQ ID NO: 204821 - DNA, 15 bp, Homo sapiens
tgattactgaaactt

SEQ ID NO: 204822 - DNA, 15 bp, Homo sapiens
ctgattactgaaact

SEQ ID NO: 204823 - DNA, 15 bp, Homo sapiens
actgattactgaaac

SEQ ID NO: 204824 - DNA, 15 bp, Homo sapiens
aactgattactgaaa

SEQ ID NO: 204825 - DNA, 15 bp, Homo sapiens
aaactgattactgaa

SEQ ID NO: 204826 - DNA, 15 bp, Homo sapiens
gaaactgattactga

SEQ ID NO: 204827 - DNA, 15 bp, Homo sapiens
tgaaactgattactg

SEQ ID NO: 204828 - DNA, 15 bp, Homo sapiens
atgaaactgattact

SEQ ID NO: 204829 - DNA, 15 bp, Homo sapiens
aatgaaactgattac

SEQ ID NO: 204830 - DNA, 15 bp, Homo sapiens
taatgaaactgatta

SEQ ID NO: 204831 - DNA, 15 bp, Homo sapiens
ataatgaaactgatt

SEQ ID NO: 204832 - DNA, 15 bp, Homo sapiens
aataatgaaactgat

SEQ ID NO: 204833 - DNA, 15 bp, Homo sapiens
aaataatgaaactga

SEQ ID NO: 204834 - DNA, 15 bp, Homo sapiens
gaaataatgaaactg

SEQ ID NO: 204835 - DNA, 15 bp, Homo sapiens
agaaataatgaaact

SEQ ID NO: 204836 - DNA, 15 bp, Homo sapiens
cagaaataatgaaac

SEQ ID NO: 204837 - DNA, 15 bp, Homo sapiens
acagaaataatgaaa

SEQ ID NO: 204838 - DNA, 15 bp, Homo sapiens
cacagaaataatgaa

SEQ ID NO: 204839 - DNA, 15 bp, Homo sapiens
gcacagaaataatga

SEQ ID NO: 204840 - DNA, 15 bp, Homo sapiens
tgcacagaaataatg

SEQ ID NO: 204841 - DNA, 15 bp, Homo sapiens
ctgcacagaaataat

SEQ ID NO: 204842 - DNA, 15 bp, Homo sapiens
actgcacagaaataa

SEQ ID NO: 204843 - DNA, 15 bp, Homo sapiens
gactgcacagaaata

SEQ ID NO: 204844 - DNA, 15 bp, Homo sapiens
tgactgcacagaaat

SEQ ID NO: 204845 - DNA, 15 bp, Homo sapiens
ttgactgcacagaaa

SEQ ID NO: 204846 - DNA, 15 bp, Homo sapiens
tttgactgcacagaa

SEQ ID NO: 204847 - DNA, 15 bp, Homo sapiens
ctttgactgcacaga

SEQ ID NO: 204848 - DNA, 15 bp, Homo sapiens
tctttgactgcacag

SEQ ID NO: 204849 - DNA, 15 bp, Homo sapiens
ttctttgactgcaca

SEQ ID NO: 204850 - DNA, 15 bp, Homo sapiens
cttctttgactgcac

SEQ ID NO: 204851 - DNA, 15 bp, Homo sapiens
tcttctttgactgca

SEQ ID NO: 204852 - DNA, 15 bp, Homo sapiens
gtcttctttgactgc

SEQ ID NO: 204853 - DNA, 15 bp, Homo sapiens
agtcttctttgactg

SEQ ID NO: 204854 - DNA, 15 bp, Homo sapiens
cagtcttctttgact

SEQ ID NO: 204855 - DNA, 15 bp, Homo sapiens
gcagtcttctttgac

SEQ ID NO: 204856 - DNA, 15 bp, Homo sapiens
tgcagtcttctttga

SEQ ID NO: 204857 - DNA, 15 bp, Homo sapiens
atgcagtcttctttg

SEQ ID NO: 204858 - DNA, 15 bp, Homo sapiens
aatgcagtcttcttt

SEQ ID NO: 204859 - DNA, 15 bp, Homo sapiens
caatgcagtcttctt

SEQ ID NO: 204860 - DNA, 15 bp, Homo sapiens
ccaatgcagtcttct

SEQ ID NO: 204861 - DNA, 15 bp, Homo sapiens
tccaatgcagtcttc

SEQ ID NO: 204862 - DNA, 15 bp, Homo sapiens
ttccaatgcagtctt

SEQ ID NO: 204863 - DNA, 15 bp, Homo sapiens
tttccaatgcagtct

SEQ ID NO: 204864 - DNA, 15 bp, Homo sapiens
ttttccaatgcagtc

SEQ ID NO: 204865 - DNA, 15 bp, Homo sapiens
attttccaatgcagt

SEQ ID NO: 204866 - DNA, 15 bp, Homo sapiens
tattttccaatgcag

SEQ ID NO: 204867 - DNA, 15 bp, Homo sapiens
atattttccaatgca

SEQ ID NO: 204868 - DNA, 15 bp, Homo sapiens
catattttccaatgc

SEQ ID NO: 204869 - DNA, 15 bp, Homo sapiens
acatattttccaatg

SEQ ID NO: 204870 - DNA, 15 bp, Homo sapiens
aacatattttccaat

SEQ ID NO: 204871 - DNA, 15 bp, Homo sapiens
aaacatattttccaa

SEQ ID NO: 204872 - DNA, 15 bp, Homo sapiens
caaacatattttcca

SEQ ID NO: 204873 - DNA, 15 bp, Homo sapiens
acaaacatattttcc

SEQ ID NO: 204874 - DNA, 15 bp, Homo sapiens
cacaaacatattttc

SEQ ID NO: 204875 - DNA, 15 bp, Homo sapiens
acacaaacatatttt

SEQ ID NO: 204876 - DNA, 15 bp, Homo sapiens
cacacaaacatattt

SEQ ID NO: 204877 - DNA, 15 bp, Homo sapiens
gcacacaaacatatt

SEQ ID NO: 204878 - DNA, 15 bp, Homo sapiens
tgcacacaaacatat

SEQ ID NO: 204879 - DNA, 15 bp, Homo sapiens
atgcacacaaacata

SEQ ID NO: 204880 - DNA, 15 bp, Homo sapiens
aatgcacacaaacat

SEQ ID NO: 204881 - DNA, 15 bp, Homo sapiens
aaatgcacacaaaca

SEQ ID NO: 204882 - DNA, 15 bp, Homo sapiens
gaaatgcacacaaac

SEQ ID NO: 204883 - DNA, 15 bp, Homo sapiens
tgaaatgcacacaaa

SEQ ID NO: 204884 - DNA, 15 bp, Homo sapiens
ttgaaatgcacacaa

SEQ ID NO: 204885 - DNA, 15 bp, Homo sapiens
attgaaatgcacaca

SEQ ID NO: 204886 - DNA, 15 bp, Homo sapiens
tattgaaatgcacac

SEQ ID NO: 204887 - DNA, 15 bp, Homo sapiens
gtattgaaatgcaca

SEQ ID NO: 204888 - DNA, 15 bp, Homo sapiens
tgtattgaaatgcac

SEQ ID NO: 204889 - DNA, 15 bp, Homo sapiens
ttgtattgaaatgca

SEQ ID NO: 204890 - DNA, 15 bp, Homo sapiens
attgtattgaaatgc

SEQ ID NO: 204891 - DNA, 15 bp, Homo sapiens
tattgtattgaaatg

SEQ ID NO: 204892 - DNA, 15 bp, Homo sapiens
ttattgtattgaaat

SEQ ID NO: 204893 - DNA, 15 bp, Homo sapiens
cttattgtattgaaa

SEQ ID NO: 204894 - DNA, 15 bp, Homo sapiens
acttattgtattgaa

SEQ ID NO: 204895 - DNA, 15 bp, Homo sapiens
cacttattgtattga

SEQ ID NO: 204896 - DNA, 15 bp, Homo sapiens
acacttattgtattg

SEQ ID NO: 204897 - DNA, 15 bp, Homo sapiens
aacacttattgtatt

SEQ ID NO: 204898 - DNA, 15 bp, Homo sapiens
aaacacttattgtat

SEQ ID NO: 204899 - DNA, 15 bp, Homo sapiens
caaacacttattgta

SEQ ID NO: 204900 - DNA, 15 bp, Homo sapiens
gcaaacacttattgt

SEQ ID NO: 204901 - DNA, 15 bp, Homo sapiens
tgcaaacacttattg

SEQ ID NO: 204902 - DNA, 15 bp, Homo sapiens
ttgcaaacacttatt

SEQ ID NO: 204903 - DNA, 15 bp, Homo sapiens
gttgcaaacacttat

SEQ ID NO: 204904 - DNA, 15 bp, Homo sapiens
agttgcaaacactta

SEQ ID NO: 204905 - DNA, 15 bp, Homo sapiens
gagttgcaaacactt

SEQ ID NO: 204906 - DNA, 15 bp, Homo sapiens
tgagttgcaaacact

SEQ ID NO: 204907 - DNA, 15 bp, Homo sapiens
ttgagttgcaaacac

SEQ ID NO: 204908 - DNA, 15 bp, Homo sapiens
attgagttgcaaaca

SEQ ID NO: 204909 - DNA, 15 bp, Homo sapiens
aattgagttgcaaac

SEQ ID NO: 204910 - DNA, 15 bp, Homo sapiens
aaattgagttgcaaa

SEQ ID NO: 204911 - DNA, 15 bp, Homo sapiens
gaaattgagttgcaa

SEQ ID NO: 204912 - DNA, 15 bp, Homo sapiens
tgaaattgagttgca

SEQ ID NO: 204913 - DNA, 15 bp, Homo sapiens
ttgaaattgagttgc

SEQ ID NO: 204914 - DNA, 15 bp, Homo sapiens
tttgaaattgagttg

SEQ ID NO: 204915 - DNA, 15 bp, Homo sapiens
ctttgaaattgagtt

SEQ ID NO: 204916 - DNA, 15 bp, Homo sapiens
cctttgaaattgagt

SEQ ID NO: 204917 - DNA, 15 bp, Homo sapiens
attcctttgaaattg

SEQ ID NO: 204918 - DNA, 15 bp, Homo sapiens
tattcctttgaaatt

SEQ ID NO: 204919 - DNA, 15 bp, Homo sapiens
atattcctttgaaat

SEQ ID NO: 204920 - DNA, 15 bp, Homo sapiens
tatattcctttgaaa

SEQ ID NO: 204921 - DNA, 15 bp, Homo sapiens
ttatattcctttgaa

SEQ ID NO: 204922 - DNA, 15 bp, Homo sapiens
attatattcctttga

SEQ ID NO: 204923 - DNA, 15 bp, Homo sapiens
cattatattcctttg

SEQ ID NO: 204924 - DNA, 15 bp, Homo sapiens
acattatattccttt

SEQ ID NO: 204925 - DNA, 15 bp, Homo sapiens
cacattatattcctt

SEQ ID NO: 204926 - DNA, 15 bp, Homo sapiens
acacattatattcct

SEQ ID NO: 204927 - DNA, 15 bp, Homo sapiens
cacacattatattcc

SEQ ID NO: 204928 - DNA, 15 bp, Homo sapiens
tcacacattatattc

SEQ ID NO: 204929 - DNA, 15 bp, Homo sapiens
atcacacattatatt

SEQ ID NO: 204930 - DNA, 15 bp, Homo sapiens
aatcacacattatat

SEQ ID NO: 204931 - DNA, 15 bp, Homo sapiens
aaatcacacattata

SEQ ID NO: 204932 - DNA, 15 bp, Homo sapiens
taaatcacacattat

SEQ ID NO: 204933 - DNA, 15 bp, Homo sapiens
ctaaatcacacatta

SEQ ID NO: 204934 - DNA, 15 bp, Homo sapiens
actaaatcacacatt

SEQ ID NO: 204935 - DNA, 15 bp, Homo sapiens
aactaaatcacacat

SEQ ID NO: 204936 - DNA, 15 bp, Homo sapiens
taactaaatcacaca

SEQ ID NO: 204937 - DNA, 15 bp, Homo sapiens
ataactaaatcacac

SEQ ID NO: 204938 - DNA, 15 bp, Homo sapiens
aataactaaatcaca

SEQ ID NO: 204939 - DNA, 15 bp, Homo sapiens
caataactaaatcac

SEQ ID NO: 204940 - DNA, 15 bp, Homo sapiens
tcaataactaaatca

SEQ ID NO: 204941 - DNA, 15 bp, Homo sapiens
atcaataactaaatc

SEQ ID NO: 204942 - DNA, 15 bp, Homo sapiens
aatcaataactaaat

SEQ ID NO: 204943 - DNA, 15 bp, Homo sapiens
taatcaataactaaa

SEQ ID NO: 204944 - DNA, 15 bp, Homo sapiens
ataatcaataactaa

SEQ ID NO: 204945 - DNA, 15 bp, Homo sapiens
aataatcaataacta

SEQ ID NO: 204946 - DNA, 15 bp, Homo sapiens
caataatcaataact

SEQ ID NO: 204947 - DNA, 15 bp, Homo sapiens
tcaataatcaataac

SEQ ID NO: 204948 - DNA, 15 bp, Homo sapiens
ctcaataatcaataa

SEQ ID NO: 204949 - DNA, 15 bp, Homo sapiens
actcaataatcaata

SEQ ID NO: 204950 - DNA, 15 bp, Homo sapiens
aactcaataatcaat

SEQ ID NO: 204951 - DNA, 15 bp, Homo sapiens
taactcaataatcaa

SEQ ID NO: 204952 - DNA, 15 bp, Homo sapiens
ttaactcaataatca

SEQ ID NO: 204953 - DNA, 15 bp, Homo sapiens
tttaactcaataatc

SEQ ID NO: 204954 - DNA, 15 bp, Homo sapiens
gtttaactcaataat

SEQ ID NO: 204955 - DNA, 15 bp, Homo sapiens
agtttaactcaataa

SEQ ID NO: 204956 - DNA, 15 bp, Homo sapiens
tagtttaactcaata

SEQ ID NO: 204957 - DNA, 15 bp, Homo sapiens
gtagtttaactcaat

SEQ ID NO: 204958 - DNA, 15 bp, Homo sapiens
tgtagtttaactcaa

SEQ ID NO: 204959 - DNA, 15 bp, Homo sapiens
ctgtagtttaactca

SEQ ID NO: 204960 - DNA, 15 bp, Homo sapiens
tctgtagtttaactc

SEQ ID NO: 204961 - DNA, 15 bp, Homo sapiens
gtctgtagtttaact

SEQ ID NO: 204962 - DNA, 15 bp, Homo sapiens
cgtctgtagtttaac

SEQ ID NO: 204963 - DNA, 15 bp, Homo sapiens
acgtctgtagtttaa

SEQ ID NO: 204964 - DNA, 15 bp, Homo sapiens
aacgtctgtagttta

SEQ ID NO: 204965 - DNA, 15 bp, Homo sapiens
caacgtctgtagttt

SEQ ID NO: 204966 - DNA, 15 bp, Homo sapiens
tcaacgtctgtagtt

SEQ ID NO: 204967 - DNA, 15 bp, Homo sapiens
ttcaacgtctgtagt

SEQ ID NO: 204968 - DNA, 15 bp, Homo sapiens
cttcaacgtctgtag

SEQ ID NO: 204969 - DNA, 15 bp, Homo sapiens
tcttcaacgtctgta

SEQ ID NO: 204970 - DNA, 15 bp, Homo sapiens
atcttcaacgtctgt

SEQ ID NO: 204971 - DNA, 15 bp, Homo sapiens
catcttcaacgtctg

SEQ ID NO: 204972 - DNA, 15 bp, Homo sapiens
gcatcttcaacgtct

SEQ ID NO: 204973 - DNA, 15 bp, Homo sapiens
tgcatcttcaacgtc

SEQ ID NO: 204974 - DNA, 15 bp, Homo sapiens
ctgcatcttcaacgt

SEQ ID NO: 204975 - DNA, 15 bp, Homo sapiens
cctgcatcttcaacg

SEQ ID NO: 204976 - DNA, 15 bp, Homo sapiens
tcctgcatcttcaac

SEQ ID NO: 204977 - DNA, 15 bp, Homo sapiens
atcctgcatcttcaa

SEQ ID NO: 204978 - DNA, 15 bp, Homo sapiens
gatcctgcatcttca

SEQ ID NO: 204979 - DNA, 15 bp, Homo sapiens
tgatcctgcatcttc

SEQ ID NO: 204980 - DNA, 15 bp, Homo sapiens
ttgatcctgcatctt

SEQ ID NO: 204981 - DNA, 15 bp, Homo sapiens
tttgatcctgcatct

SEQ ID NO: 204982 - DNA, 15 bp, Homo sapiens
atttgatcctgcatc

SEQ ID NO: 204983 - DNA, 15 bp, Homo sapiens
gatttgatcctgcat

SEQ ID NO: 204984 - DNA, 15 bp, Homo sapiens
tgatttgatcctgca

SEQ ID NO: 204985 - DNA, 15 bp, Homo sapiens
atgatttgatcctgc

SEQ ID NO: 204986 - DNA, 15 bp, Homo sapiens
gatgatttgatcctg

SEQ ID NO: 204987 - DNA, 15 bp, Homo sapiens
agatgatttgatcct

SEQ ID NO: 204988 - DNA, 15 bp, Homo sapiens
cagatgatttgatcc

SEQ ID NO: 204989 - DNA, 15 bp, Homo sapiens
tcagatgatttgatc

SEQ ID NO: 204990 - DNA, 15 bp, Homo sapiens
ttcagatgatttgat

SEQ ID NO: 204991 - DNA, 15 bp, Homo sapiens
tttcagatgatttga

SEQ ID NO: 204992 - DNA, 15 bp, Homo sapiens
atttcagatgatttg

SEQ ID NO: 204993 - DNA, 15 bp, Homo sapiens
tatttcagatgattt

SEQ ID NO: 204994 - DNA, 15 bp, Homo sapiens
ttatttcagatgatt

SEQ ID NO: 204995 - DNA, 15 bp, Homo sapiens
tttatttcagatgat

SEQ ID NO: 204996 - DNA, 15 bp, Homo sapiens
ttttatttcagatga

SEQ ID NO: 204997 - DNA, 15 bp, Homo sapiens
cttttatttcagatg

SEQ ID NO: 204998 - DNA, 15 bp, Homo sapiens
ccttttatttcagat

SEQ ID NO: 204999 - DNA, 15 bp, Homo sapiens
cccttttatttcaga

SEQ ID NO: 205000 - DNA, 15 bp, Homo sapiens
gcccttttatttcag

SEQ ID NO: 205001 - DNA, 15 bp, Homo sapiens
tgcccttttatttca

SEQ ID NO: 205002 - DNA, 15 bp, Homo sapiens
ctgcccttttatttc

SEQ ID NO: 205003 - DNA, 15 bp, Homo sapiens
cctgcccttttattt

SEQ ID NO: 205004 - DNA, 15 bp, Homo sapiens
ccctgcccttttatt

SEQ ID NO: 205005 - DNA, 15 bp, Homo sapiens
tccctgcccttttat

SEQ ID NO: 205006 - DNA, 15 bp, Homo sapiens
ttccctgccctttta

SEQ ID NO: 205007 - DNA, 15 bp, Homo sapiens
gttccctgccctttt

SEQ ID NO: 205008 - DNA, 15 bp, Homo sapiens
tgttccctgcccttt

SEQ ID NO: 205009 - DNA, 15 bp, Homo sapiens
gtgttccctgccctt

SEQ ID NO: 205010 - DNA, 15 bp, Homo sapiens
cgtgttccctgccct

SEQ ID NO: 205011 - DNA, 15 bp, Homo sapiens
acgtgttccctgccc

SEQ ID NO: 205012 - DNA, 15 bp, Homo sapiens
tacgtgttccctgcc

SEQ ID NO: 205013 - DNA, 15 bp, Homo sapiens
atacgtgttccctgc

SEQ ID NO: 205014 - DNA, 15 bp, Homo sapiens
tatacgtgttccctg

SEQ ID NO: 205015 - DNA, 15 bp, Homo sapiens
ttatacgtgttccct

SEQ ID NO: 205016 - DNA, 15 bp, Homo sapiens
tttatacgtgttccc

SEQ ID NO: 205017 - DNA, 15 bp, Homo sapiens
atttatacgtgttcc

SEQ ID NO: 205018 - DNA, 15 bp, Homo sapiens
catttatacgtgttc

SEQ ID NO: 205019 - DNA, 15 bp, Homo sapiens
acatttatacgtgtt

SEQ ID NO: 205020 - DNA, 15 bp, Homo sapiens
aacatttatacgtgt

SEQ ID NO: 205021 - DNA, 15 bp, Homo sapiens
aaacatttatacgtg

SEQ ID NO: 205022 - DNA, 15 bp, Homo sapiens
aaaacatttatacgt

SEQ ID NO: 205023 - DNA, 15 bp, Homo sapiens
caaaacatttatacg

SEQ ID NO: 205024 - DNA, 15 bp, Homo sapiens
gcaaaacatttatac

SEQ ID NO: 205025 - DNA, 15 bp, Homo sapiens
tgcaaaacatttata

SEQ ID NO: 205026 - DNA, 15 bp, Homo sapiens
gtgcaaaacatttat

SEQ ID NO: 205027 - DNA, 15 bp, Homo sapiens
tgtgcaaaacattta

SEQ ID NO: 205028 - DNA, 15 bp, Homo sapiens
gtgtgcaaaacattt

SEQ ID NO: 205029 - DNA, 15 bp, Homo sapiens
cgtgtgcaaaacatt

SEQ ID NO: 205030 - DNA, 15 bp, Homo sapiens
ccgtgtgcaaaacat

SEQ ID NO: 205031 - DNA, 15 bp, Homo sapiens
tccgtgtgcaaaaca

SEQ ID NO: 205032 - DNA, 15 bp, Homo sapiens
ctccgtgtgcaaaac

SEQ ID NO: 205033 - DNA, 15 bp, Homo sapiens
tctccgtgtgcaaaa

SEQ ID NO: 205034 - DNA, 15 bp, Homo sapiens
gtctccgtgtgcaaa

SEQ ID NO: 205035 - DNA, 15 bp, Homo sapiens
tgtctccgtgtgcaa

SEQ ID NO: 205036 - DNA, 15 bp, Homo sapiens
gtgtctccgtgtgca

SEQ ID NO: 205037 - DNA, 15 bp, Homo sapiens
agtgtctccgtgtgc

SEQ ID NO: 205038 - DNA, 15 bp, Homo sapiens
gagtgtctccgtgtg

SEQ ID NO: 205039 - DNA, 15 bp, Homo sapiens
tgagtgtctccgtgt

SEQ ID NO: 205040 - DNA, 15 bp, Homo sapiens
ttgagtgtctccgtg

SEQ ID NO: 205041 - DNA, 15 bp, Homo sapiens
cttgagtgtctccgt

SEQ ID NO: 205042 - DNA, 15 bp, Homo sapiens
acttgagtgtctccg

SEQ ID NO: 205043 - DNA, 15 bp, Homo sapiens
cacttgagtgtctcc

SEQ ID NO: 205044 - DNA, 15 bp, Homo sapiens
gcacttgagtgtctc

SEQ ID NO: 205045 - DNA, 15 bp, Homo sapiens
agcacttgagtgtct

SEQ ID NO: 205046 - DNA, 15 bp, Homo sapiens
aagcacttgagtgtc

SEQ ID NO: 205047 - DNA, 15 bp, Homo sapiens
gaagcacttgagtgt

SEQ ID NO: 205048 - DNA, 15 bp, Homo sapiens
agaagcacttgagtg

SEQ ID NO: 205049 - DNA, 15 bp, Homo sapiens
aagaagcacttgagt

SEQ ID NO: 205050 - DNA, 15 bp, Homo sapiens
caagaagcacttgag

SEQ ID NO: 205051 - DNA, 15 bp, Homo sapiens
tcaagaagcacttga

SEQ ID NO: 205052 - DNA, 15 bp, Homo sapiens
caatcaagaagcact

SEQ ID NO: 205053 - DNA, 15 bp, Homo sapiens
tcaatcaagaagcac

SEQ ID NO: 205054 - DNA, 15 bp, Homo sapiens
ctcaatcaagaagca

SEQ ID NO: 205055 - DNA, 15 bp, Homo sapiens
cctcaatcaagaagc

SEQ ID NO: 205056 - DNA, 15 bp, Homo sapiens
tcctcaatcaagaag

SEQ ID NO: 205057 - DNA, 15 bp, Homo sapiens
gtcctcaatcaagaa

SEQ ID NO: 205058 - DNA, 15 bp, Homo sapiens
tgtcctcaatcaaga

SEQ ID NO: 205059 - DNA, 15 bp, Homo sapiens
atgtcctcaatcaag

SEQ ID NO: 205060 - DNA, 15 bp, Homo sapiens
gatgtcctcaatcaa

SEQ ID NO: 205061 - DNA, 15 bp, Homo sapiens
agatgtcctcaatca

SEQ ID NO: 205062 - DNA, 15 bp, Homo sapiens
cagatgtcctcaatc

SEQ ID NO: 205063 - DNA, 15 bp, Homo sapiens
tcagatgtcctcaat

SEQ ID NO: 205064 - DNA, 15 bp, Homo sapiens
atcagatgtcctcaa

SEQ ID NO: 205065 - DNA, 15 bp, Homo sapiens
aatcagatgtcctca

SEQ ID NO: 205066 - DNA, 15 bp, Homo sapiens
aaatcagatgtcctc

SEQ ID NO: 205067 - DNA, 15 bp, Homo sapiens
gaaatcagatgtcct

SEQ ID NO: 205068 - DNA, 15 bp, Homo sapiens
agaaatcagatgtcc

SEQ ID NO: 205069 - DNA, 15 bp, Homo sapiens
tagaaatcagatgtc

SEQ ID NO: 205070 - DNA, 15 bp, Homo sapiens
ctagaaatcagatgt

SEQ ID NO: 205071 - DNA, 15 bp, Homo sapiens
gctagaaatcagatg

SEQ ID NO: 205072 - DNA, 15 bp, Homo sapiens
agctagaaatcagat

SEQ ID NO: 205073 - DNA, 15 bp, Homo sapiens
cagctagaaatcaga

SEQ ID NO: 205074 - DNA, 15 bp, Homo sapiens
ccagctagaaatcag

SEQ ID NO: 205075 - DNA, 15 bp, Homo sapiens
accagctagaaatca

SEQ ID NO: 205076 - DNA, 15 bp, Homo sapiens
aaccagctagaaatc

SEQ ID NO: 205077 - DNA, 15 bp, Homo sapiens
aaaccagctagaaat

SEQ ID NO: 205078 - DNA, 15 bp, Homo sapiens
aaaaccagctagaaa

SEQ ID NO: 205079 - DNA, 15 bp, Homo sapiens
caaaaccagctagaa

SEQ ID NO: 205080 - DNA, 15 bp, Homo sapiens
gcaaaaccagctaga

SEQ ID NO: 205081 - DNA, 15 bp, Homo sapiens
tgcaaaaccagctag

SEQ ID NO: 205082 - DNA, 15 bp, Homo sapiens
ttgcaaaaccagcta

SEQ ID NO: 205083 - DNA, 15 bp, Homo sapiens
attgcaaaaccagct

SEQ ID NO: 205084 - DNA, 15 bp, Homo sapiens
aattgcaaaaccagc

SEQ ID NO: 205085 - DNA, 15 bp, Homo sapiens
taattgcaaaaccag

SEQ ID NO: 205086 - DNA, 15 bp, Homo sapiens
ttaattgcaaaacca

SEQ ID NO: 205087 - DNA, 15 bp, Homo sapiens
tttaattgcaaaacc

SEQ ID NO: 205088 - DNA, 15 bp, Homo sapiens
ttttaattgcaaaac

SEQ ID NO: 205089 - DNA, 15 bp, Homo sapiens
tttttaattgcaaaa

SEQ ID NO: 205090 - DNA, 15 bp, Homo sapiens
atttttaattgcaaa

SEQ ID NO: 205091 - DNA, 15 bp, Homo sapiens
tatttttaattgcaa

SEQ ID NO: 205092 - DNA, 15 bp, Homo sapiens
atatttttaattgca

SEQ ID NO: 205093 - DNA, 15 bp, Homo sapiens
aatatttttaattgc

SEQ ID NO: 205094 - DNA, 15 bp, Homo sapiens
caatatttttaattg

SEQ ID NO: 205095 - DNA, 15 bp, Homo sapiens
ccaatatttttaatt

SEQ ID NO: 205096 - DNA, 15 bp, Homo sapiens
tccaatatttttaat

SEQ ID NO: 205097 - DNA, 15 bp, Homo sapiens
ttccaatatttttaa

SEQ ID NO: 205098 - DNA, 15 bp, Homo sapiens
tttccaatattttta

SEQ ID NO: 205099 - DNA, 15 bp, Homo sapiens
ctttccaatattttt

SEQ ID NO: 205100 - DNA, 15 bp, Homo sapiens
tctttccaatatttt

SEQ ID NO: 205101 - DNA, 15 bp, Homo sapiens
ttctttccaatattt

SEQ ID NO: 205102 - DNA, 15 bp, Homo sapiens
tttctttccaatatt

SEQ ID NO: 205103 - DNA, 15 bp, Homo sapiens
atttctttccaatat

SEQ ID NO: 205104 - DNA, 15 bp, Homo sapiens
aatttctttccaata

SEQ ID NO: 205105 - DNA, 15 bp, Homo sapiens
caatttctttccaat

SEQ ID NO: 205106 - DNA, 15 bp, Homo sapiens
gcaatttctttccaa

SEQ ID NO: 205107 - DNA, 15 bp, Homo sapiens
tgcaatttctttcca

SEQ ID NO: 205108 - DNA, 15 bp, Homo sapiens
ctgcaatttctttcc

SEQ ID NO: 205109 - DNA, 15 bp, Homo sapiens
actgcaatttctttc

SEQ ID NO: 205110 - DNA, 15 bp, Homo sapiens
tactgcaatttcttt

SEQ ID NO: 205111 - DNA, 15 bp, Homo sapiens
ctactgcaatttctt

SEQ ID NO: 205112 - DNA, 15 bp, Homo sapiens
gctactgcaatttct

SEQ ID NO: 205113 - DNA, 15 bp, Homo sapiens
agctactgcaatttc

SEQ ID NO: 205114 - DNA, 15 bp, Homo sapiens
gagctactgcaattt

SEQ ID NO: 205115 - DNA, 15 bp, Homo sapiens
tgagctactgcaatt

SEQ ID NO: 205116 - DNA, 15 bp, Homo sapiens
ctgagctactgcaat

SEQ ID NO: 205117 - DNA, 15 bp, Homo sapiens
actgagctactgcaa
